United States Patent 11,421,016 (CANCER NEOEPITOPES) - sequence listing, part 30

SEQ ID NO: 1335183 - protein, 9 aa, Homo Sapiens
DLGLVVKHD

SEQ ID NO: 1335184 - protein, 9 aa, Homo Sapiens
YIINIHSMS

SEQ ID NO: 1335185 - protein, 9 aa, Homo Sapiens
SDLFELDYC

SEQ ID NO: 1335186 - protein, 9 aa, Homo Sapiens
NLSDTLNKL

SEQ ID NO: 1335187 - protein, 9 aa, Homo Sapiens
FRSFDTLLA

SEQ ID NO: 1335188 - protein, 9 aa, Homo Sapiens
RQPEQARWP

SEQ ID NO: 1335189 - protein, 9 aa, Homo Sapiens
ESLPELNTA

SEQ ID NO: 1335190 - protein, 9 aa, Homo Sapiens
VVVDDLHLC

SEQ ID NO: 1335191 - protein, 9 aa, Homo Sapiens
ARSITTGKN

SEQ ID NO: 1335192 - protein, 9 aa, Homo Sapiens
ETTSCSTFN

SEQ ID NO: 1335193 - protein, 9 aa, Homo Sapiens
RVQHKQFLR

SEQ ID NO: 1335194 - protein, 9 aa, Homo Sapiens
EPTKPVIAK

SEQ ID NO: 1335195 - protein, 9 aa, Homo Sapiens
KNGYRLMNS

SEQ ID NO: 1335196 - protein, 9 aa, Homo Sapiens
KLEAKKKCD

SEQ ID NO: 1335197 - protein, 9 aa, Homo Sapiens
VPNAYHPQF

SEQ ID NO: 1335198 - protein, 9 aa, Homo Sapiens
GDGKSFLHD

SEQ ID NO: 1335199 - protein, 9 aa, Homo Sapiens
DAHSDYAHY

SEQ ID NO: 1335200 - protein, 9 aa, Homo Sapiens
CLGSLSKLS

SEQ ID NO: 1335201 - protein, 9 aa, Homo Sapiens
QAAGKLALI

SEQ ID NO: 1335202 - protein, 9 aa, Homo Sapiens
ALFIYIRSK

SEQ ID NO: 1335203 - protein, 9 aa, Homo Sapiens
GVAVDAQVG

SEQ ID NO: 1335204 - protein, 9 aa, Homo Sapiens
VKSLHLLVA

SEQ ID NO: 1335205 - protein, 9 aa, Homo Sapiens
CRPSVYTSS

SEQ ID NO: 1335206 - protein, 9 aa, Homo Sapiens
LKKADVVRV

SEQ ID NO: 1335207 - protein, 9 aa, Homo Sapiens
VGRIIKCTH

SEQ ID NO: 1335208 - protein, 9 aa, Homo Sapiens
LPRGSSGVP

SEQ ID NO: 1335209 - protein, 9 aa, Homo Sapiens
EHADSAHQD

SEQ ID NO: 1335210 - protein, 9 aa, Homo Sapiens
AHISAAAAL

SEQ ID NO: 1335211 - protein, 9 aa, Homo Sapiens
STHLFFSRS

SEQ ID NO: 1335212 - protein, 9 aa, Homo Sapiens
GRPRPGTKT

SEQ ID NO: 1335213 - protein, 9 aa, Homo Sapiens
QAIKGVFYR

SEQ ID NO: 1335214 - protein, 9 aa, Homo Sapiens
EIKYEVVRD

SEQ ID NO: 1335215 - protein, 9 aa, Homo Sapiens
FIAPKQCLS

SEQ ID NO: 1335216 - protein, 9 aa, Homo Sapiens
VSATEDENV

SEQ ID NO: 1335217 - protein, 9 aa, Homo Sapiens
NQVQTCSAD

SEQ ID NO: 1335218 - protein, 9 aa, Homo Sapiens
SIEEVEVTP

SEQ ID NO: 1335219 - protein, 9 aa, Homo Sapiens
PKNIDTTPV

SEQ ID NO: 1335220 - protein, 9 aa, Homo Sapiens
AKRLCYFDP

SEQ ID NO: 1335221 - protein, 9 aa, Homo Sapiens
CKEYGKAFN

SEQ ID NO: 1335222 - protein, 9 aa, Homo Sapiens
DPFHSIECY

SEQ ID NO: 1335223 - protein, 9 aa, Homo Sapiens
HTYVRCTHS

SEQ ID NO: 1335224 - protein, 9 aa, Homo Sapiens
TTQHYSDAS

SEQ ID NO: 1335225 - protein, 9 aa, Homo Sapiens
NLVTETRRI

SEQ ID NO: 1335226 - protein, 9 aa, Homo Sapiens
TELPDVPYD

SEQ ID NO: 1335227 - protein, 9 aa, Homo Sapiens
ELREVLWTV

SEQ ID NO: 1335228 - protein, 9 aa, Homo Sapiens
CTDPRGRFY

SEQ ID NO: 1335229 - protein, 9 aa, Homo Sapiens
GYSDGSNDS

SEQ ID NO: 1335230 - protein, 9 aa, Homo Sapiens
SRWDDRRTP

SEQ ID NO: 1335231 - protein, 9 aa, Homo Sapiens
ANVLLELRQ

SEQ ID NO: 1335232 - protein, 9 aa, Homo Sapiens
RLAAASGPC

SEQ ID NO: 1335233 - protein, 9 aa, Homo Sapiens
YLFLAYLFF

SEQ ID NO: 1335234 - protein, 9 aa, Homo Sapiens
MSPGMAQKG

SEQ ID NO: 1335235 - protein, 9 aa, Homo Sapiens
SKEGNHLLG

SEQ ID NO: 1335236 - protein, 9 aa, Homo Sapiens
PIVPSHVIE

SEQ ID NO: 1335237 - protein, 9 aa, Homo Sapiens
TKALQTAIE

SEQ ID NO: 1335238 - protein, 9 aa, Homo Sapiens
DKKIDLQKN

SEQ ID NO: 1335239 - protein, 9 aa, Homo Sapiens
SNSTIPVEP

SEQ ID NO: 1335240 - protein, 9 aa, Homo Sapiens
KMDPTGLEG

SEQ ID NO: 1335241 - protein, 9 aa, Homo Sapiens
GTGKTMVMN

SEQ ID NO: 1335242 - protein, 9 aa, Homo Sapiens
IMMDLNHPE

SEQ ID NO: 1335243 - protein, 9 aa, Homo Sapiens
RKKKDVCIE

SEQ ID NO: 1335244 - protein, 9 aa, Homo Sapiens
GGGPRGLMP

SEQ ID NO: 1335245 - protein, 9 aa, Homo Sapiens
KMNVIGHMS

SEQ ID NO: 1335246 - protein, 9 aa, Homo Sapiens
ALARKSTLK

SEQ ID NO: 1335247 - protein, 9 aa, Homo Sapiens
VVGHALHNN

SEQ ID NO: 1335248 - protein, 9 aa, Homo Sapiens
STTDTSTDK

SEQ ID NO: 1335249 - protein, 9 aa, Homo Sapiens
FQIYHFKIF

SEQ ID NO: 1335250 - protein, 9 aa, Homo Sapiens
KGFKDTNQY

SEQ ID NO: 1335251 - protein, 9 aa, Homo Sapiens
KFGQVRKLL

SEQ ID NO: 1335252 - protein, 9 aa, Homo Sapiens
HGRWKYSSN

SEQ ID NO: 1335253 - protein, 9 aa, Homo Sapiens
PQGAGSPTL

SEQ ID NO: 1335254 - protein, 9 aa, Homo Sapiens
QMKTTKESL

SEQ ID NO: 1335255 - protein, 9 aa, Homo Sapiens
QLGDWFPGS

SEQ ID NO: 1335256 - protein, 9 aa, Homo Sapiens
DLNIPDAPE

SEQ ID NO: 1335257 - protein, 9 aa, Homo Sapiens
ITEIAPQHR

SEQ ID NO: 1335258 - protein, 9 aa, Homo Sapiens
DKFSDTEGL

SEQ ID NO: 1335259 - protein, 9 aa, Homo Sapiens
TLPASQRSS

SEQ ID NO: 1335260 - protein, 9 aa, Homo Sapiens
RSARAPPSR

SEQ ID NO: 1335261 - protein, 9 aa, Homo Sapiens
WRQFNREMK

SEQ ID NO: 1335262 - protein, 9 aa, Homo Sapiens
PEPSRRVRR

SEQ ID NO: 1335263 - protein, 9 aa, Homo Sapiens
IEENDQQVT

SEQ ID NO: 1335264 - protein, 9 aa, Homo Sapiens
VQTRPFDLK

SEQ ID NO: 1335265 - protein, 9 aa, Homo Sapiens
GNTIIITLS

SEQ ID NO: 1335266 - protein, 9 aa, Homo Sapiens
RENVMGDFL

SEQ ID NO: 1335267 - protein, 9 aa, Homo Sapiens
RYYADITKM

SEQ ID NO: 1335268 - protein, 9 aa, Homo Sapiens
YLNLIKPTL

SEQ ID NO: 1335269 - protein, 9 aa, Homo Sapiens
ALVRHCVCR

SEQ ID NO: 1335270 - protein, 9 aa, Homo Sapiens
YIDITKEEN

SEQ ID NO: 1335271 - protein, 9 aa, Homo Sapiens
KTSRRCWAR

SEQ ID NO: 1335272 - protein, 9 aa, Homo Sapiens
SHVSSEAGN

SEQ ID NO: 1335273 - protein, 9 aa, Homo Sapiens
IHFDPENPQ

SEQ ID NO: 1335274 - protein, 9 aa, Homo Sapiens
CHYFQNTQG

SEQ ID NO: 1335275 - protein, 9 aa, Homo Sapiens
LSQLRDPHH

SEQ ID NO: 1335276 - protein, 9 aa, Homo Sapiens
LGDPAKRLC

SEQ ID NO: 1335277 - protein, 9 aa, Homo Sapiens
GFQAAHTLA

SEQ ID NO: 1335278 - protein, 9 aa, Homo Sapiens
QVVRAREAL

SEQ ID NO: 1335279 - protein, 9 aa, Homo Sapiens
LEYHRTESE

SEQ ID NO: 1335280 - protein, 9 aa, Homo Sapiens
VNQEILNTN

SEQ ID NO: 1335281 - protein, 9 aa, Homo Sapiens
LSCLLHITR

SEQ ID NO: 1335282 - protein, 9 aa, Homo Sapiens
NLGEGTIAC

SEQ ID NO: 1335283 - protein, 9 aa, Homo Sapiens
RPRTYYLEP

SEQ ID NO: 1335284 - protein, 9 aa, Homo Sapiens
IKCTHCGCR

SEQ ID NO: 1335285 - protein, 9 aa, Homo Sapiens
MGSTSIPLS

SEQ ID NO: 1335286 - protein, 9 aa, Homo Sapiens
CIPATAAPS

SEQ ID NO: 1335287 - protein, 9 aa, Homo Sapiens
WNTASLIFN

SEQ ID NO: 1335288 - protein, 9 aa, Homo Sapiens
KHFFSLPDG

SEQ ID NO: 1335289 - protein, 9 aa, Homo Sapiens
GCHVRALVL

SEQ ID NO: 1335290 - protein, 9 aa, Homo Sapiens
RLIRKCFLC

SEQ ID NO: 1335291 - protein, 9 aa, Homo Sapiens
GNSGAEAVM

SEQ ID NO: 1335292 - protein, 9 aa, Homo Sapiens
RKKSRHHGR

SEQ ID NO: 1335293 - protein, 9 aa, Homo Sapiens
HALSPEENI

SEQ ID NO: 1335294 - protein, 9 aa, Homo Sapiens
GTSVIITNR

SEQ ID NO: 1335295 - protein, 9 aa, Homo Sapiens
SLWVMCRRM

SEQ ID NO: 1335296 - protein, 9 aa, Homo Sapiens
QQEKEKKFF

SEQ ID NO: 1335297 - protein, 9 aa, Homo Sapiens
SRRSSKKKP

SEQ ID NO: 1335298 - protein, 9 aa, Homo Sapiens
IRHSFIDGS

SEQ ID NO: 1335299 - protein, 9 aa, Homo Sapiens
SVSVATCKQ

SEQ ID NO: 1335300 - protein, 9 aa, Homo Sapiens
CPKKIHILH

SEQ ID NO: 1335301 - protein, 9 aa, Homo Sapiens
NAKQLKDGI

SEQ ID NO: 1335302 - protein, 9 aa, Homo Sapiens
DVSVERVQP

SEQ ID NO: 1335303 - protein, 9 aa, Homo Sapiens
SSSGPRLGV

SEQ ID NO: 1335304 - protein, 9 aa, Homo Sapiens
KVGEQVTYT

SEQ ID NO: 1335305 - protein, 9 aa, Homo Sapiens
DPEADVWSL

SEQ ID NO: 1335306 - protein, 9 aa, Homo Sapiens
AEAPVPSPV

SEQ ID NO: 1335307 - protein, 9 aa, Homo Sapiens
ALFLKRPKC

SEQ ID NO: 1335308 - protein, 9 aa, Homo Sapiens
SHPHSCRDV

SEQ ID NO: 1335309 - protein, 9 aa, Homo Sapiens
TVVDVEEIV

SEQ ID NO: 1335310 - protein, 9 aa, Homo Sapiens
LGEPSASLG

SEQ ID NO: 1335311 - protein, 9 aa, Homo Sapiens
EMLGTKIKA

SEQ ID NO: 1335312 - protein, 9 aa, Homo Sapiens
LTTTVTMTR

SEQ ID NO: 1335313 - protein, 9 aa, Homo Sapiens
SYVRHLKGE

SEQ ID NO: 1335314 - protein, 9 aa, Homo Sapiens
RAFEARDHN

SEQ ID NO: 1335315 - protein, 9 aa, Homo Sapiens
ILLKYAHMI

SEQ ID NO: 1335316 - protein, 9 aa, Homo Sapiens
LCKPDVIAQ

SEQ ID NO: 1335317 - protein, 9 aa, Homo Sapiens
DEIKVNLTR

SEQ ID NO: 1335318 - protein, 9 aa, Homo Sapiens
INNENADAL

SEQ ID NO: 1335319 - protein, 9 aa, Homo Sapiens
HVVDGDHLI

SEQ ID NO: 1335320 - protein, 9 aa, Homo Sapiens
TNFLHWCRD

SEQ ID NO: 1335321 - protein, 9 aa, Homo Sapiens
CPYISNTNQ

SEQ ID NO: 1335322 - protein, 9 aa, Homo Sapiens
MGLDRPDVW

SEQ ID NO: 1335323 - protein, 9 aa, Homo Sapiens
RLSWHHPGD

SEQ ID NO: 1335324 - protein, 9 aa, Homo Sapiens
VTKWYISPR

SEQ ID NO: 1335325 - protein, 9 aa, Homo Sapiens
GGCTSIVRN

SEQ ID NO: 1335326 - protein, 9 aa, Homo Sapiens
TREHLELLK

SEQ ID NO: 1335327 - protein, 9 aa, Homo Sapiens
MILMFLLAI

SEQ ID NO: 1335328 - protein, 9 aa, Homo Sapiens
SYPAHVPPP

SEQ ID NO: 1335329 - protein, 9 aa, Homo Sapiens
IDRPNTYFR

SEQ ID NO: 1335330 - protein, 9 aa, Homo Sapiens
EDIVDVINE

SEQ ID NO: 1335331 - protein, 9 aa, Homo Sapiens
DIPFTCETC

SEQ ID NO: 1335332 - protein, 9 aa, Homo Sapiens
GKKCWTSHQ

SEQ ID NO: 1335333 - protein, 9 aa, Homo Sapiens
MRKGTTMKG

SEQ ID NO: 1335334 - protein, 9 aa, Homo Sapiens
HILSVEPRL

SEQ ID NO: 1335335 - protein, 9 aa, Homo Sapiens
RNSDVRHTP

SEQ ID NO: 1335336 - protein, 9 aa, Homo Sapiens
TYVSWAITY

SEQ ID NO: 1335337 - protein, 9 aa, Homo Sapiens
QLHLERLQI

SEQ ID NO: 1335338 - protein, 9 aa, Homo Sapiens
QRVHMGKKP

SEQ ID NO: 1335339 - protein, 9 aa, Homo Sapiens
PGTTPPGRS

SEQ ID NO: 1335340 - protein, 9 aa, Homo Sapiens
EKTPITIEI

SEQ ID NO: 1335341 - protein, 9 aa, Homo Sapiens
WIDGTDKAT

SEQ ID NO: 1335342 - protein, 9 aa, Homo Sapiens
SPNPEVMCS

SEQ ID NO: 1335343 - protein, 9 aa, Homo Sapiens
PVKHIQEEE

SEQ ID NO: 1335344 - protein, 9 aa, Homo Sapiens
FVIVIWGVL

SEQ ID NO: 1335345 - protein, 9 aa, Homo Sapiens
CHLDDTCVS

SEQ ID NO: 1335346 - protein, 9 aa, Homo Sapiens
KVTPEEYVG

SEQ ID NO: 1335347 - protein, 9 aa, Homo Sapiens
MLSNVVERV

SEQ ID NO: 1335348 - protein, 9 aa, Homo Sapiens
KQLVPASSL

SEQ ID NO: 1335349 - protein, 9 aa, Homo Sapiens
EMKHEERAL

SEQ ID NO: 1335350 - protein, 9 aa, Homo Sapiens
WDPQMSGQP

SEQ ID NO: 1335351 - protein, 9 aa, Homo Sapiens
SRSAISEQI

SEQ ID NO: 1335352 - protein, 9 aa, Homo Sapiens
KWEQLSLVL

SEQ ID NO: 1335353 - protein, 9 aa, Homo Sapiens
SRLCLLPTG

SEQ ID NO: 1335354 - protein, 9 aa, Homo Sapiens
EDKVTCHDG

SEQ ID NO: 1335355 - protein, 9 aa, Homo Sapiens
LIESTVCAI

SEQ ID NO: 1335356 - protein, 9 aa, Homo Sapiens
IDMMELYNR

SEQ ID NO: 1335357 - protein, 9 aa, Homo Sapiens
LTQKVTSLS

SEQ ID NO: 1335358 - protein, 9 aa, Homo Sapiens
LHWKKDGQL

SEQ ID NO: 1335359 - protein, 9 aa, Homo Sapiens
FENMLSTYP

SEQ ID NO: 1335360 - protein, 9 aa, Homo Sapiens
GGGGPRGLM

SEQ ID NO: 1335361 - protein, 9 aa, Homo Sapiens
PYSAPPQPT

SEQ ID NO: 1335362 - protein, 9 aa, Homo Sapiens
RKNFTMTRT

SEQ ID NO: 1335363 - protein, 9 aa, Homo Sapiens
PDMPFPSIR

SEQ ID NO: 1335364 - protein, 9 aa, Homo Sapiens
RKHNLELTI

SEQ ID NO: 1335365 - protein, 9 aa, Homo Sapiens
DDRAWYLIV

SEQ ID NO: 1335366 - protein, 9 aa, Homo Sapiens
QMEFPDTSF

SEQ ID NO: 1335367 - protein, 9 aa, Homo Sapiens
AVNMAGMGT

SEQ ID NO: 1335368 - protein, 9 aa, Homo Sapiens
SVQRITKYQ

SEQ ID NO: 1335369 - protein, 9 aa, Homo Sapiens
FHTAQKSGD

SEQ ID NO: 1335370 - protein, 9 aa, Homo Sapiens
TGHHIVAPP

SEQ ID NO: 1335371 - protein, 9 aa, Homo Sapiens
EKAITTLKR

SEQ ID NO: 1335372 - protein, 9 aa, Homo Sapiens
SALHTIHTA

SEQ ID NO: 1335373 - protein, 9 aa, Homo Sapiens
PWQGSKPRE

SEQ ID NO: 1335374 - protein, 9 aa, Homo Sapiens
WSSVFLRGS

SEQ ID NO: 1335375 - protein, 9 aa, Homo Sapiens
EVDNMDGLP

SEQ ID NO: 1335376 - protein, 9 aa, Homo Sapiens
AQHPAGRSC

SEQ ID NO: 1335377 - protein, 9 aa, Homo Sapiens
MFEYFQTTW

SEQ ID NO: 1335378 - protein, 9 aa, Homo Sapiens
IYLKNKMSS

SEQ ID NO: 1335379 - protein, 9 aa, Homo Sapiens
IDASEDIQL

SEQ ID NO: 1335380 - protein, 9 aa, Homo Sapiens
KGGKNRHRG

SEQ ID NO: 1335381 - protein, 9 aa, Homo Sapiens
VHLGQSLLE

SEQ ID NO: 1335382 - protein, 9 aa, Homo Sapiens
GLYHTCLAS

SEQ ID NO: 1335383 - protein, 9 aa, Homo Sapiens
ETVGPQGPP

SEQ ID NO: 1335384 - protein, 9 aa, Homo Sapiens
AGGKVSLWD

SEQ ID NO: 1335385 - protein, 9 aa, Homo Sapiens
ELALWRGDV

SEQ ID NO: 1335386 - protein, 9 aa, Homo Sapiens
GFTADEKVD

SEQ ID NO: 1335387 - protein, 9 aa, Homo Sapiens
IVIFSLFML

SEQ ID NO: 1335388 - protein, 9 aa, Homo Sapiens
VICGFDALA

SEQ ID NO: 1335389 - protein, 9 aa, Homo Sapiens
CWMLYECPN

SEQ ID NO: 1335390 - protein, 9 aa, Homo Sapiens
INCIACYSN

SEQ ID NO: 1335391 - protein, 9 aa, Homo Sapiens
SAGHCYKSH

SEQ ID NO: 1335392 - protein, 9 aa, Homo Sapiens
DVILDRKKK

SEQ ID NO: 1335393 - protein, 9 aa, Homo Sapiens
LAFLYKDRY

SEQ ID NO: 1335394 - protein, 9 aa, Homo Sapiens
MLMEGVKTE

SEQ ID NO: 1335395 - protein, 9 aa, Homo Sapiens
SAALALDLV

SEQ ID NO: 1335396 - protein, 9 aa, Homo Sapiens
RPGIKKAQN

SEQ ID NO: 1335397 - protein, 9 aa, Homo Sapiens
HSLHPGYYL

SEQ ID NO: 1335398 - protein, 9 aa, Homo Sapiens
MTTLVMVEA

SEQ ID NO: 1335399 - protein, 9 aa, Homo Sapiens
SMYRPVNWC

SEQ ID NO: 1335400 - protein, 9 aa, Homo Sapiens
GFGIMCIYK

SEQ ID NO: 1335401 - protein, 9 aa, Homo Sapiens
GRKGQIWRG

SEQ ID NO: 1335402 - protein, 9 aa, Homo Sapiens
QALANILMA

SEQ ID NO: 1335403 - protein, 9 aa, Homo Sapiens
VLNSIENSI

SEQ ID NO: 1335404 - protein, 9 aa, Homo Sapiens
FDKSAGENT

SEQ ID NO: 1335405 - protein, 9 aa, Homo Sapiens
FEKIYLAPY

SEQ ID NO: 1335406 - protein, 9 aa, Homo Sapiens
VGDDCGHII

SEQ ID NO: 1335407 - protein, 9 aa, Homo Sapiens
DGEMSVQEE

SEQ ID NO: 1335408 - protein, 9 aa, Homo Sapiens
TAMVILCHF

SEQ ID NO: 1335409 - protein, 9 aa, Homo Sapiens
SFFLWNSRE

SEQ ID NO: 1335410 - protein, 9 aa, Homo Sapiens
MCQQLLLAE

SEQ ID NO: 1335411 - protein, 9 aa, Homo Sapiens
ENKCGAHMM

SEQ ID NO: 1335412 - protein, 9 aa, Homo Sapiens
HFKEVICSS

SEQ ID NO: 1335413 - protein, 9 aa, Homo Sapiens
GHPDTPPNI

SEQ ID NO: 1335414 - protein, 9 aa, Homo Sapiens
WGTIGDDDF

SEQ ID NO: 1335415 - protein, 9 aa, Homo Sapiens
VITEGPPAL

SEQ ID NO: 1335416 - protein, 9 aa, Homo Sapiens
SELEEFMNK

SEQ ID NO: 1335417 - protein, 9 aa, Homo Sapiens
IAELVPKYH

SEQ ID NO: 1335418 - protein, 9 aa, Homo Sapiens
RHQEELRRL

SEQ ID NO: 1335419 - protein, 9 aa, Homo Sapiens
LKQRMFEYF

SEQ ID NO: 1335420 - protein, 9 aa, Homo Sapiens
REQEQKMWD

SEQ ID NO: 1335421 - protein, 9 aa, Homo Sapiens
QRRSDLDHF

SEQ ID NO: 1335422 - protein, 9 aa, Homo Sapiens
EDTVTFIRS

SEQ ID NO: 1335423 - protein, 9 aa, Homo Sapiens
AILNAVLTS

SEQ ID NO: 1335424 - protein, 9 aa, Homo Sapiens
GVKLDAAGL

SEQ ID NO: 1335425 - protein, 9 aa, Homo Sapiens
CTEVWTGLT

SEQ ID NO: 1335426 - protein, 9 aa, Homo Sapiens
DGHYTMDNI

SEQ ID NO: 1335427 - protein, 9 aa, Homo Sapiens
DQVRKHLGT

SEQ ID NO: 1335428 - protein, 9 aa, Homo Sapiens
EDAEIEVDK

SEQ ID NO: 1335429 - protein, 9 aa, Homo Sapiens
GPHAPVGHN

SEQ ID NO: 1335430 - protein, 9 aa, Homo Sapiens
SQTTTIPSC

SEQ ID NO: 1335431 - protein, 9 aa, Homo Sapiens
WPHDPGASV

SEQ ID NO: 1335432 - protein, 9 aa, Homo Sapiens
TMNDLEDNY

SEQ ID NO: 1335433 - protein, 9 aa, Homo Sapiens
LIILIKNAL

SEQ ID NO: 1335434 - protein, 9 aa, Homo Sapiens
QIHQDILAA

SEQ ID NO: 1335435 - protein, 9 aa, Homo Sapiens
STGAPQEPT

SEQ ID NO: 1335436 - protein, 9 aa, Homo Sapiens
TEYENKLYD

SEQ ID NO: 1335437 - protein, 9 aa, Homo Sapiens
QKICQNRAR

SEQ ID NO: 1335438 - protein, 9 aa, Homo Sapiens
MTQSQPSGA

SEQ ID NO: 1335439 - protein, 9 aa, Homo Sapiens
MPNVLTTQQ

SEQ ID NO: 1335440 - protein, 9 aa, Homo Sapiens
NRDELRCRI

SEQ ID NO: 1335441 - protein, 9 aa, Homo Sapiens
IDFTLWRQF

SEQ ID NO: 1335442 - protein, 9 aa, Homo Sapiens
GAPQEPTFS

SEQ ID NO: 1335443 - protein, 9 aa, Homo Sapiens
SNFEPFATG

SEQ ID NO: 1335444 - protein, 9 aa, Homo Sapiens
RKVSQHTEL

SEQ ID NO: 1335445 - protein, 9 aa, Homo Sapiens
VACQNEPLL

SEQ ID NO: 1335446 - protein, 9 aa, Homo Sapiens
KKWCPYTKH

SEQ ID NO: 1335447 - protein, 9 aa, Homo Sapiens
LPTFRDRLI

SEQ ID NO: 1335448 - protein, 9 aa, Homo Sapiens
LWMQSPCWQ

SEQ ID NO: 1335449 - protein, 9 aa, Homo Sapiens
KPTISPEKT

SEQ ID NO: 1335450 - protein, 9 aa, Homo Sapiens
KSIILLKVK

SEQ ID NO: 1335451 - protein, 9 aa, Homo Sapiens
RMRKKFPLP

SEQ ID NO: 1335452 - protein, 9 aa, Homo Sapiens
HCRNMLSQG

SEQ ID NO: 1335453 - protein, 9 aa, Homo Sapiens
MWLGRKHRT

SEQ ID NO: 1335454 - protein, 9 aa, Homo Sapiens
FIIQPSNTC

SEQ ID NO: 1335455 - protein, 9 aa, Homo Sapiens
LSKDPHFSK

SEQ ID NO: 1335456 - protein, 9 aa, Homo Sapiens
SSNVIFLIF

SEQ ID NO: 1335457 - protein, 9 aa, Homo Sapiens
ISRVQLIDT

SEQ ID NO: 1335458 - protein, 9 aa, Homo Sapiens
FELVVHFFA

SEQ ID NO: 1335459 - protein, 9 aa, Homo Sapiens
VTYLRFLEL

SEQ ID NO: 1335460 - protein, 9 aa, Homo Sapiens
SVLVVSVPA

SEQ ID NO: 1335461 - protein, 9 aa, Homo Sapiens
KELEWLTSL

SEQ ID NO: 1335462 - protein, 9 aa, Homo Sapiens
YGRDRSPLC

SEQ ID NO: 1335463 - protein, 9 aa, Homo Sapiens
SLIRQKRQT

SEQ ID NO: 1335464 - protein, 9 aa, Homo Sapiens
ACFRSCKPW

SEQ ID NO: 1335465 - protein, 9 aa, Homo Sapiens
ADVDSLSEY

SEQ ID NO: 1335466 - protein, 9 aa, Homo Sapiens
EPSKELSKC

SEQ ID NO: 1335467 - protein, 9 aa, Homo Sapiens
EKQEEERLH

SEQ ID NO: 1335468 - protein, 9 aa, Homo Sapiens
DSKTEQSAA

SEQ ID NO: 1335469 - protein, 9 aa, Homo Sapiens
GGTQEVEIG

SEQ ID NO: 1335470 - protein, 9 aa, Homo Sapiens
CLYTLPSLC

SEQ ID NO: 1335471 - protein, 9 aa, Homo Sapiens
TYTPRHPRS

SEQ ID NO: 1335472 - protein, 9 aa, Homo Sapiens
QQPYITNHT

SEQ ID NO: 1335473 - protein, 9 aa, Homo Sapiens
VSEDKHISL

SEQ ID NO: 1335474 - protein, 9 aa, Homo Sapiens
SIPPFPVSC

SEQ ID NO: 1335475 - protein, 9 aa, Homo Sapiens
MKDSDMDYI

SEQ ID NO: 1335476 - protein, 9 aa, Homo Sapiens
LTTYRSKCL

SEQ ID NO: 1335477 - protein, 9 aa, Homo Sapiens
SCMVLRATE

SEQ ID NO: 1335478 - protein, 9 aa, Homo Sapiens
AGLHTLLPV

SEQ ID NO: 1335479 - protein, 9 aa, Homo Sapiens
LYSAGEENE

SEQ ID NO: 1335480 - protein, 9 aa, Homo Sapiens
AHNATCTHY

SEQ ID NO: 1335481 - protein, 9 aa, Homo Sapiens
LCTLCRRLQ

SEQ ID NO: 1335482 - protein, 9 aa, Homo Sapiens
SLKRSLAGG

SEQ ID NO: 1335483 - protein, 9 aa, Homo Sapiens
LGIVRSRGH

SEQ ID NO: 1335484 - protein, 9 aa, Homo Sapiens
LKDCEAEVW

SEQ ID NO: 1335485 - protein, 9 aa, Homo Sapiens
DDEVRAIRH

SEQ ID NO: 1335486 - protein, 9 aa, Homo Sapiens
LAWRKQHQV

SEQ ID NO: 1335487 - protein, 9 aa, Homo Sapiens
MHLMKHDVN

SEQ ID NO: 1335488 - protein, 9 aa, Homo Sapiens
NLSRMQNRF

SEQ ID NO: 1335489 - protein, 9 aa, Homo Sapiens
GNRRSWLNN

SEQ ID NO: 1335490 - protein, 9 aa, Homo Sapiens
YHRTESEWE

SEQ ID NO: 1335491 - protein, 9 aa, Homo Sapiens
SSRDSLRYS

SEQ ID NO: 1335492 - protein, 9 aa, Homo Sapiens
WPLDPEDRA

SEQ ID NO: 1335493 - protein, 9 aa, Homo Sapiens
LEQILPPRL

SEQ ID NO: 1335494 - protein, 9 aa, Homo Sapiens
SHGKQDFLK

SEQ ID NO: 1335495 - protein, 9 aa, Homo Sapiens
TPLHIVIRG

SEQ ID NO: 1335496 - protein, 9 aa, Homo Sapiens
RESNSSHMC

SEQ ID NO: 1335497 - protein, 9 aa, Homo Sapiens
RPHSSPDDL

SEQ ID NO: 1335498 - protein, 9 aa, Homo Sapiens
NPQMFHTVS

SEQ ID NO: 1335499 - protein, 9 aa, Homo Sapiens
SVVRPRRSE

SEQ ID NO: 1335500 - protein, 9 aa, Homo Sapiens
SLKWQIAQL

SEQ ID NO: 1335501 - protein, 9 aa, Homo Sapiens
LSWHHPGDS

SEQ ID NO: 1335502 - protein, 9 aa, Homo Sapiens
MVRYACNVI

SEQ ID NO: 1335503 - protein, 9 aa, Homo Sapiens
TLKLLLVFV

SEQ ID NO: 1335504 - protein, 9 aa, Homo Sapiens
IRTIAEVEG

SEQ ID NO: 1335505 - protein, 9 aa, Homo Sapiens
CLQKYLKKH

SEQ ID NO: 1335506 - protein, 9 aa, Homo Sapiens
VHGRTAKDT

SEQ ID NO: 1335507 - protein, 9 aa, Homo Sapiens
KKIMSLVRS

SEQ ID NO: 1335508 - protein, 9 aa, Homo Sapiens
GSRFVVPFG

SEQ ID NO: 1335509 - protein, 9 aa, Homo Sapiens
RYAVMQISM

SEQ ID NO: 1335510 - protein, 9 aa, Homo Sapiens
PKAEAVFFT

SEQ ID NO: 1335511 - protein, 9 aa, Homo Sapiens
FFTIGITWI

SEQ ID NO: 1335512 - protein, 9 aa, Homo Sapiens
TSTAPDGTA

SEQ ID NO: 1335513 - protein, 9 aa, Homo Sapiens
FRRHVKTHN

SEQ ID NO: 1335514 - protein, 9 aa, Homo Sapiens
LDVPSGITA

SEQ ID NO: 1335515 - protein, 9 aa, Homo Sapiens
MRLETRTHR

SEQ ID NO: 1335516 - protein, 9 aa, Homo Sapiens
LHMAANMPN

SEQ ID NO: 1335517 - protein, 9 aa, Homo Sapiens
GLASDAGGR

SEQ ID NO: 1335518 - protein, 9 aa, Homo Sapiens
ISDPQRPHL

SEQ ID NO: 1335519 - protein, 9 aa, Homo Sapiens
HKLGNISKP

SEQ ID NO: 1335520 - protein, 9 aa, Homo Sapiens
LRGSCVVAL

SEQ ID NO: 1335521 - protein, 9 aa, Homo Sapiens
TWLGYVNFL

SEQ ID NO: 1335522 - protein, 9 aa, Homo Sapiens
KVVCEFEGG

SEQ ID NO: 1335523 - protein, 9 aa, Homo Sapiens
STSVPISSS

SEQ ID NO: 1335524 - protein, 9 aa, Homo Sapiens
SVSHKNAKY

SEQ ID NO: 1335525 - protein, 9 aa, Homo Sapiens
KEMPEILKT

SEQ ID NO: 1335526 - protein, 9 aa, Homo Sapiens
YCYPHFTCT

SEQ ID NO: 1335527 - protein, 9 aa, Homo Sapiens
NAAKSLLFW

SEQ ID NO: 1335528 - protein, 9 aa, Homo Sapiens
SAQAANFQL

SEQ ID NO: 1335529 - protein, 9 aa, Homo Sapiens
RCQLQKATC

SEQ ID NO: 1335530 - protein, 9 aa, Homo Sapiens
SCESHKHRG

SEQ ID NO: 1335531 - protein, 9 aa, Homo Sapiens
LAVDPNDLY

SEQ ID NO: 1335532 - protein, 9 aa, Homo Sapiens
IQEIISDNC

SEQ ID NO: 1335533 - protein, 9 aa, Homo Sapiens
MHFSFFSSL

SEQ ID NO: 1335534 - protein, 9 aa, Homo Sapiens
ARTSSRRWT

SEQ ID NO: 1335535 - protein, 9 aa, Homo Sapiens
EFHKSLVKE

SEQ ID NO: 1335536 - protein, 9 aa, Homo Sapiens
LTPCPYFSP

SEQ ID NO: 1335537 - protein, 9 aa, Homo Sapiens
GSGEGIAVS

SEQ ID NO: 1335538 - protein, 9 aa, Homo Sapiens
DNFNWGVHR

SEQ ID NO: 1335539 - protein, 9 aa, Homo Sapiens
IRAGLPTAQ

SEQ ID NO: 1335540 - protein, 9 aa, Homo Sapiens
SAAGPAGGE

SEQ ID NO: 1335541 - protein, 9 aa, Homo Sapiens
QAHIKALLV

SEQ ID NO: 1335542 - protein, 9 aa, Homo Sapiens
FNMRMGERG

SEQ ID NO: 1335543 - protein, 9 aa, Homo Sapiens
TDEIKVNLT

SEQ ID NO: 1335544 - protein, 9 aa, Homo Sapiens
MSTHLNVHK

SEQ ID NO: 1335545 - protein, 9 aa, Homo Sapiens
AVCVGIADG

SEQ ID NO: 1335546 - protein, 9 aa, Homo Sapiens
VPRHDKVTF

SEQ ID NO: 1335547 - protein, 9 aa, Homo Sapiens
LEEEDTETA

SEQ ID NO: 1335548 - protein, 9 aa, Homo Sapiens
LGLLQKPRV

SEQ ID NO: 1335549 - protein, 9 aa, Homo Sapiens
AEKDANWTR

SEQ ID NO: 1335550 - protein, 9 aa, Homo Sapiens
GQSTILPSE

SEQ ID NO: 1335551 - protein, 9 aa, Homo Sapiens
GHDAASSSG

SEQ ID NO: 1335552 - protein, 9 aa, Homo Sapiens
SGNFFMMLP

SEQ ID NO: 1335553 - protein, 9 aa, Homo Sapiens
TTDFPSENS

SEQ ID NO: 1335554 - protein, 9 aa, Homo Sapiens
VCDEAFTYN

SEQ ID NO: 1335555 - protein, 9 aa, Homo Sapiens
ELISQLCAL

SEQ ID NO: 1335556 - protein, 9 aa, Homo Sapiens
EQMVDGSMW

SEQ ID NO: 1335557 - protein, 9 aa, Homo Sapiens
GQYYLPNSV

SEQ ID NO: 1335558 - protein, 9 aa, Homo Sapiens
CIPSKVTKK

SEQ ID NO: 1335559 - protein, 9 aa, Homo Sapiens
QQDKHLWVL

SEQ ID NO: 1335560 - protein, 9 aa, Homo Sapiens
PVVLPHSLD

SEQ ID NO: 1335561 - protein, 9 aa, Homo Sapiens
LICEDGNHF

SEQ ID NO: 1335562 - protein, 9 aa, Homo Sapiens
IQLTQGGGA

SEQ ID NO: 1335563 - protein, 9 aa, Homo Sapiens
QVLTYEWRL

SEQ ID NO: 1335564 - protein, 9 aa, Homo Sapiens
IEKKTRHLG

SEQ ID NO: 1335565 - protein, 9 aa, Homo Sapiens
YYTHMDDPS

SEQ ID NO: 1335566 - protein, 9 aa, Homo Sapiens
GSRHRPLPA

SEQ ID NO: 1335567 - protein, 9 aa, Homo Sapiens
FGNTIIITL

SEQ ID NO: 1335568 - protein, 9 aa, Homo Sapiens
SQWKHVFVL

SEQ ID NO: 1335569 - protein, 9 aa, Homo Sapiens
HTLTVAIQD

SEQ ID NO: 1335570 - protein, 9 aa, Homo Sapiens
DRDSGDNRK

SEQ ID NO: 1335571 - protein, 9 aa, Homo Sapiens
EKNDFLSAP

SEQ ID NO: 1335572 - protein, 9 aa, Homo Sapiens
PQCIPATAA

SEQ ID NO: 1335573 - protein, 9 aa, Homo Sapiens
EKIGPNMAI

SEQ ID NO: 1335574 - protein, 9 aa, Homo Sapiens
TGAASAARP

SEQ ID NO: 1335575 - protein, 9 aa, Homo Sapiens
EGMEASVEK

SEQ ID NO: 1335576 - protein, 9 aa, Homo Sapiens
LSSSPIVPM

SEQ ID NO: 1335577 - protein, 9 aa, Homo Sapiens
YSAPPQPTA

SEQ ID NO: 1335578 - protein, 9 aa, Homo Sapiens
EESSANNIV

SEQ ID NO: 1335579 - protein, 9 aa, Homo Sapiens
SKRNRHHIE

SEQ ID NO: 1335580 - protein, 9 aa, Homo Sapiens
SKVVRHFHS

SEQ ID NO: 1335581 - protein, 9 aa, Homo Sapiens
NVTSEPHEM

SEQ ID NO: 1335582 - protein, 9 aa, Homo Sapiens
PKESGLEGR

SEQ ID NO: 1335583 - protein, 9 aa, Homo Sapiens
IDFIDCVSE

SEQ ID NO: 1335584 - protein, 9 aa, Homo Sapiens
DYKSYQVPK

SEQ ID NO: 1335585 - protein, 9 aa, Homo Sapiens
HRLDELEEA

SEQ ID NO: 1335586 - protein, 9 aa, Homo Sapiens
DSFILCKEG

SEQ ID NO: 1335587 - protein, 9 aa, Homo Sapiens
PLVPSDPFS

SEQ ID NO: 1335588 - protein, 9 aa, Homo Sapiens
KGERHMEDE

SEQ ID NO: 1335589 - protein, 9 aa, Homo Sapiens
QSCRKVMEA

SEQ ID NO: 1335590 - protein, 9 aa, Homo Sapiens
EEEVDIISL

SEQ ID NO: 1335591 - protein, 9 aa, Homo Sapiens
DPEPLSMVF

SEQ ID NO: 1335592 - protein, 9 aa, Homo Sapiens
EDLSLPPPP

SEQ ID NO: 1335593 - protein, 9 aa, Homo Sapiens
SVLSIDADV

SEQ ID NO: 1335594 - protein, 9 aa, Homo Sapiens
HLNPQKPGD

SEQ ID NO: 1335595 - protein, 9 aa, Homo Sapiens
RCTIWIITQ

SEQ ID NO: 1335596 - protein, 9 aa, Homo Sapiens
CTLLFFLHQ

SEQ ID NO: 1335597 - protein, 9 aa, Homo Sapiens
MSENECLGG

SEQ ID NO: 1335598 - protein, 9 aa, Homo Sapiens
DEEELWFNT

SEQ ID NO: 1335599 - protein, 9 aa, Homo Sapiens
GPGIKFSTE

SEQ ID NO: 1335600 - protein, 9 aa, Homo Sapiens
DKLLDHMEN

SEQ ID NO: 1335601 - protein, 9 aa, Homo Sapiens
AITAAHGHL

SEQ ID NO: 1335602 - protein, 9 aa, Homo Sapiens
HLAAQPQAL

SEQ ID NO: 1335603 - protein, 9 aa, Homo Sapiens
FLRAHAALF

SEQ ID NO: 1335604 - protein, 9 aa, Homo Sapiens
DSKLDQDLL

SEQ ID NO: 1335605 - protein, 9 aa, Homo Sapiens
LALVGPHAR

SEQ ID NO: 1335606 - protein, 9 aa, Homo Sapiens
PQVLQNYYT

SEQ ID NO: 1335607 - protein, 9 aa, Homo Sapiens
LIAAVILRY

SEQ ID NO: 1335608 - protein, 9 aa, Homo Sapiens
RDASHLIFQ

SEQ ID NO: 1335609 - protein, 9 aa, Homo Sapiens
WYGNQNPVN

SEQ ID NO: 1335610 - protein, 9 aa, Homo Sapiens
QEWQEREEC

SEQ ID NO: 1335611 - protein, 9 aa, Homo Sapiens
QPKDAALSN

SEQ ID NO: 1335612 - protein, 9 aa, Homo Sapiens
HYTSKDMLR

SEQ ID NO: 1335613 - protein, 9 aa, Homo Sapiens
NYGLMCLGF

SEQ ID NO: 1335614 - protein, 9 aa, Homo Sapiens
TVVTSKMLV

SEQ ID NO: 1335615 - protein, 9 aa, Homo Sapiens
ESRWRAWSS

SEQ ID NO: 1335616 - protein, 9 aa, Homo Sapiens
RVLMSVVPS

SEQ ID NO: 1335617 - protein, 9 aa, Homo Sapiens
GSMLQSQLL

SEQ ID NO: 1335618 - protein, 9 aa, Homo Sapiens
LTCTETPLI

SEQ ID NO: 1335619 - protein, 9 aa, Homo Sapiens
HYSGSYNDY

SEQ ID NO: 1335620 - protein, 9 aa, Homo Sapiens
SNRSLLTFI

SEQ ID NO: 1335621 - protein, 9 aa, Homo Sapiens
QGGDLLRQM

SEQ ID NO: 1335622 - protein, 9 aa, Homo Sapiens
AQSLSRHAQ

SEQ ID NO: 1335623 - protein, 9 aa, Homo Sapiens
TFQAENSQS

SEQ ID NO: 1335624 - protein, 9 aa, Homo Sapiens
HNRIGVGVI

SEQ ID NO: 1335625 - protein, 9 aa, Homo Sapiens
GPRVEAGTP

SEQ ID NO: 1335626 - protein, 9 aa, Homo Sapiens
DITRDLILL

SEQ ID NO: 1335627 - protein, 9 aa, Homo Sapiens
KDALTRVYG

SEQ ID NO: 1335628 - protein, 9 aa, Homo Sapiens
ASSSAASAE

SEQ ID NO: 1335629 - protein, 9 aa, Homo Sapiens
GAEGCPDAK

SEQ ID NO: 1335630 - protein, 9 aa, Homo Sapiens
MLCLRLPNL

SEQ ID NO: 1335631 - protein, 9 aa, Homo Sapiens
EDQESPHQE

SEQ ID NO: 1335632 - protein, 9 aa, Homo Sapiens
ILDDLYWTA

SEQ ID NO: 1335633 - protein, 9 aa, Homo Sapiens
IEERAQRLF

SEQ ID NO: 1335634 - protein, 9 aa, Homo Sapiens
QPNERHVRI

SEQ ID NO: 1335635 - protein, 9 aa, Homo Sapiens
FSNKLHLLR

SEQ ID NO: 1335636 - protein, 9 aa, Homo Sapiens
VSSAVKVEL

SEQ ID NO: 1335637 - protein, 9 aa, Homo Sapiens
RRHRAVKMV

SEQ ID NO: 1335638 - protein, 9 aa, Homo Sapiens
SGIGRTVMY

SEQ ID NO: 1335639 - protein, 9 aa, Homo Sapiens
IALTLVEAY

SEQ ID NO: 1335640 - protein, 9 aa, Homo Sapiens
QNQCRFSME

SEQ ID NO: 1335641 - protein, 9 aa, Homo Sapiens
DYSENCLLA

SEQ ID NO: 1335642 - protein, 9 aa, Homo Sapiens
RVSSRLKEL

SEQ ID NO: 1335643 - protein, 9 aa, Homo Sapiens
KLILVMLEI

SEQ ID NO: 1335644 - protein, 9 aa, Homo Sapiens
PEKGCWTEL

SEQ ID NO: 1335645 - protein, 9 aa, Homo Sapiens
FEMMTGRSP

SEQ ID NO: 1335646 - protein, 9 aa, Homo Sapiens
CGKLTPEKE

SEQ ID NO: 1335647 - protein, 9 aa, Homo Sapiens
ILNQCTGKC

SEQ ID NO: 1335648 - protein, 9 aa, Homo Sapiens
IINASGYHI

SEQ ID NO: 1335649 - protein, 9 aa, Homo Sapiens
PCRLLKMVI

SEQ ID NO: 1335650 - protein, 9 aa, Homo Sapiens
LHHQRTHSG

SEQ ID NO: 1335651 - protein, 9 aa, Homo Sapiens
RASPSTRGR

SEQ ID NO: 1335652 - protein, 9 aa, Homo Sapiens
ERAARACFR

SEQ ID NO: 1335653 - protein, 9 aa, Homo Sapiens
NMCEQVLLI

SEQ ID NO: 1335654 - protein, 9 aa, Homo Sapiens
PPPPPSPMD

SEQ ID NO: 1335655 - protein, 9 aa, Homo Sapiens
AQKYLYRSV

SEQ ID NO: 1335656 - protein, 9 aa, Homo Sapiens
TPIITTLAS

SEQ ID NO: 1335657 - protein, 9 aa, Homo Sapiens
FNPFQHLEK

SEQ ID NO: 1335658 - protein, 9 aa, Homo Sapiens
VPSMQPVVL

SEQ ID NO: 1335659 - protein, 9 aa, Homo Sapiens
ADSWSGSED

SEQ ID NO: 1335660 - protein, 9 aa, Homo Sapiens
GDQSTLQHY

SEQ ID NO: 1335661 - protein, 9 aa, Homo Sapiens
LLIYCRLRK

SEQ ID NO: 1335662 - protein, 9 aa, Homo Sapiens
HWRDRHHQK

SEQ ID NO: 1335663 - protein, 9 aa, Homo Sapiens
NPWVCLTCS

SEQ ID NO: 1335664 - protein, 9 aa, Homo Sapiens
LDKDAPLHY

SEQ ID NO: 1335665 - protein, 9 aa, Homo Sapiens
EEVDIISLS

SEQ ID NO: 1335666 - protein, 9 aa, Homo Sapiens
SLQPLRQQI

SEQ ID NO: 1335667 - protein, 9 aa, Homo Sapiens
GGRRGMRAL

SEQ ID NO: 1335668 - protein, 9 aa, Homo Sapiens
LKVTPEEYV

SEQ ID NO: 1335669 - protein, 9 aa, Homo Sapiens
KTYAPLAFQ

SEQ ID NO: 1335670 - protein, 9 aa, Homo Sapiens
DVTPQAISV

SEQ ID NO: 1335671 - protein, 9 aa, Homo Sapiens
GEVQQVWLD

SEQ ID NO: 1335672 - protein, 9 aa, Homo Sapiens
SCQATGQPP

SEQ ID NO: 1335673 - protein, 9 aa, Homo Sapiens
ADNTFSRLQ

SEQ ID NO: 1335674 - protein, 9 aa, Homo Sapiens
KGPAGECGA

SEQ ID NO: 1335675 - protein, 9 aa, Homo Sapiens
SDGEADPFV

SEQ ID NO: 1335676 - protein, 9 aa, Homo Sapiens
HIPFRVGLY

SEQ ID NO: 1335677 - protein, 9 aa, Homo Sapiens
IDADVFEVK

SEQ ID NO: 1335678 - protein, 9 aa, Homo Sapiens
KEIKYEVVR

SEQ ID NO: 1335679 - protein, 9 aa, Homo Sapiens
LYTLNKHQH

SEQ ID NO: 1335680 - protein, 9 aa, Homo Sapiens
APHFNSLPQ

SEQ ID NO: 1335681 - protein, 9 aa, Homo Sapiens
GLWTTCVDA

SEQ ID NO: 1335682 - protein, 9 aa, Homo Sapiens
NTPKLLPAG

SEQ ID NO: 1335683 - protein, 9 aa, Homo Sapiens
ISHRECQQS

SEQ ID NO: 1335684 - protein, 9 aa, Homo Sapiens
IAGHEPHIK

SEQ ID NO: 1335685 - protein, 9 aa, Homo Sapiens
KGEKGEPVD

SEQ ID NO: 1335686 - protein, 9 aa, Homo Sapiens
QKRQCRVQK

SEQ ID NO: 1335687 - protein, 9 aa, Homo Sapiens
TELFLLFTG

SEQ ID NO: 1335688 - protein, 9 aa, Homo Sapiens
KHNDLIAQS

SEQ ID NO: 1335689 - protein, 9 aa, Homo Sapiens
PSIKTHDPK

SEQ ID NO: 1335690 - protein, 9 aa, Homo Sapiens
KKRRNPQLR

SEQ ID NO: 1335691 - protein, 9 aa, Homo Sapiens
TLIDEVERA

SEQ ID NO: 1335692 - protein, 9 aa, Homo Sapiens
NCSGLVDPN

SEQ ID NO: 1335693 - protein, 9 aa, Homo Sapiens
STLSHLHRL

SEQ ID NO: 1335694 - protein, 9 aa, Homo Sapiens
AAEMAKKQL

SEQ ID NO: 1335695 - protein, 9 aa, Homo Sapiens
QEQRRELYS

SEQ ID NO: 1335696 - protein, 9 aa, Homo Sapiens
VCLHAGGVG

SEQ ID NO: 1335697 - protein, 9 aa, Homo Sapiens
QKRKKEDGI

SEQ ID NO: 1335698 - protein, 9 aa, Homo Sapiens
INASGYHIG

SEQ ID NO: 1335699 - protein, 9 aa, Homo Sapiens
KFASSIVGS

SEQ ID NO: 1335700 - protein, 9 aa, Homo Sapiens
CPILSATVT

SEQ ID NO: 1335701 - protein, 9 aa, Homo Sapiens
NPGICDKQG

SEQ ID NO: 1335702 - protein, 9 aa, Homo Sapiens
DRLLSVWPG

SEQ ID NO: 1335703 - protein, 9 aa, Homo Sapiens
REKERCNQE

SEQ ID NO: 1335704 - protein, 9 aa, Homo Sapiens
TRKDTSTSM

SEQ ID NO: 1335705 - protein, 9 aa, Homo Sapiens
WAIRAYSSH

SEQ ID NO: 1335706 - protein, 9 aa, Homo Sapiens
QLAIEERYE

SEQ ID NO: 1335707 - protein, 9 aa, Homo Sapiens
DELASCGHS

SEQ ID NO: 1335708 - protein, 9 aa, Homo Sapiens
TPCTVLRPS

SEQ ID NO: 1335709 - protein, 9 aa, Homo Sapiens
RQATKCATI

SEQ ID NO: 1335710 - protein, 9 aa, Homo Sapiens
EDTLLKEES

SEQ ID NO: 1335711 - protein, 9 aa, Homo Sapiens
LTRMYFQPY

SEQ ID NO: 1335712 - protein, 9 aa, Homo Sapiens
GPTSAAPAR

SEQ ID NO: 1335713 - protein, 9 aa, Homo Sapiens
PKATRGCLL

SEQ ID NO: 1335714 - protein, 9 aa, Homo Sapiens
AGKSTILCL

SEQ ID NO: 1335715 - protein, 9 aa, Homo Sapiens
SGKLSATST

SEQ ID NO: 1335716 - protein, 9 aa, Homo Sapiens
GRGWNFTGT

SEQ ID NO: 1335717 - protein, 9 aa, Homo Sapiens
GDPAKRLCY

SEQ ID NO: 1335718 - protein, 9 aa, Homo Sapiens
GLQLALFYQ

SEQ ID NO: 1335719 - protein, 9 aa, Homo Sapiens
SKGSMVLAY

SEQ ID NO: 1335720 - protein, 9 aa, Homo Sapiens
GCSYMPSTH

SEQ ID NO: 1335721 - protein, 9 aa, Homo Sapiens
IRGQEVNMC

SEQ ID NO: 1335722 - protein, 9 aa, Homo Sapiens
GDSLTRPGL

SEQ ID NO: 1335723 - protein, 9 aa, Homo Sapiens
CTLSEDTIR

SEQ ID NO: 1335724 - protein, 9 aa, Homo Sapiens
ADIDLKYDL

SEQ ID NO: 1335725 - protein, 9 aa, Homo Sapiens
STQVVPPEW

SEQ ID NO: 1335726 - protein, 9 aa, Homo Sapiens
DREEKHNQA

SEQ ID NO: 1335727 - protein, 9 aa, Homo Sapiens
AYPIQVLTY

SEQ ID NO: 1335728 - protein, 9 aa, Homo Sapiens
GPNDILLVS

SEQ ID NO: 1335729 - protein, 9 aa, Homo Sapiens
ASNIYEKLL

SEQ ID NO: 1335730 - protein, 9 aa, Homo Sapiens
AHKSKEWYH

SEQ ID NO: 1335731 - protein, 9 aa, Homo Sapiens
HIFQVYMAD

SEQ ID NO: 1335732 - protein, 9 aa, Homo Sapiens
ILYVLTGSS

SEQ ID NO: 1335733 - protein, 9 aa, Homo Sapiens
IVLFAIGAF

SEQ ID NO: 1335734 - protein, 9 aa, Homo Sapiens
HNESTGSLG

SEQ ID NO: 1335735 - protein, 9 aa, Homo Sapiens
KASQVRDLL

SEQ ID NO: 1335736 - protein, 9 aa, Homo Sapiens
ISSLRVERS

SEQ ID NO: 1335737 - protein, 9 aa, Homo Sapiens
RVHMGKKPY

SEQ ID NO: 1335738 - protein, 9 aa, Homo Sapiens
ETTDESPRS

SEQ ID NO: 1335739 - protein, 9 aa, Homo Sapiens
FVEAEDGGS

SEQ ID NO: 1335740 - protein, 9 aa, Homo Sapiens
RLEATEMQL

SEQ ID NO: 1335741 - protein, 9 aa, Homo Sapiens
ESYQLDSMV

SEQ ID NO: 1335742 - protein, 9 aa, Homo Sapiens
SRVSIAVAP

SEQ ID NO: 1335743 - protein, 9 aa, Homo Sapiens
VTGPDPGSL

SEQ ID NO: 1335744 - protein, 9 aa, Homo Sapiens
QINKIIPKP

SEQ ID NO: 1335745 - protein, 9 aa, Homo Sapiens
EDDDDIVDT

SEQ ID NO: 1335746 - protein, 9 aa, Homo Sapiens
MIPQLFGHE

SEQ ID NO: 1335747 - protein, 9 aa, Homo Sapiens
LLGGTAIIL

SEQ ID NO: 1335748 - protein, 9 aa, Homo Sapiens
DVSHGHLDC

SEQ ID NO: 1335749 - protein, 9 aa, Homo Sapiens
LYGPITFKD

SEQ ID NO: 1335750 - protein, 9 aa, Homo Sapiens
RWSEKKARK

SEQ ID NO: 1335751 - protein, 9 aa, Homo Sapiens
GNACVAMSH

SEQ ID NO: 1335752 - protein, 9 aa, Homo Sapiens
MNLNWPQGE

SEQ ID NO: 1335753 - protein, 9 aa, Homo Sapiens
CNKFVTVQA

SEQ ID NO: 1335754 - protein, 9 aa, Homo Sapiens
LEDNYGQEW

SEQ ID NO: 1335755 - protein, 9 aa, Homo Sapiens
IHQDILAAY

SEQ ID NO: 1335756 - protein, 9 aa, Homo Sapiens
DFFSSAFQA

SEQ ID NO: 1335757 - protein, 9 aa, Homo Sapiens
PPACADPHH

SEQ ID NO: 1335758 - protein, 9 aa, Homo Sapiens
ITFKNMQRR

SEQ ID NO: 1335759 - protein, 9 aa, Homo Sapiens
DMLLCTPFR

SEQ ID NO: 1335760 - protein, 9 aa, Homo Sapiens
GSCVVALHS

SEQ ID NO: 1335761 - protein, 9 aa, Homo Sapiens
GNVDNKEYV

SEQ ID NO: 1335762 - protein, 9 aa, Homo Sapiens
KSFSWCSRL

SEQ ID NO: 1335763 - protein, 9 aa, Homo Sapiens
RKKKSRTLG

SEQ ID NO: 1335764 - protein, 9 aa, Homo Sapiens
ERMWSPQNL

SEQ ID NO: 1335765 - protein, 9 aa, Homo Sapiens
IGDRFKIER

SEQ ID NO: 1335766 - protein, 9 aa, Homo Sapiens
PQAQAALQV

SEQ ID NO: 1335767 - protein, 9 aa, Homo Sapiens
EMIAEKLRQ

SEQ ID NO: 1335768 - protein, 9 aa, Homo Sapiens
ILSTQDGSC

SEQ ID NO: 1335769 - protein, 9 aa, Homo Sapiens
GECRSPPLC

SEQ ID NO: 1335770 - protein, 9 aa, Homo Sapiens
YHIISIGGA

SEQ ID NO: 1335771 - protein, 9 aa, Homo Sapiens
KNFTMTRTM

SEQ ID NO: 1335772 - protein, 9 aa, Homo Sapiens
RASQGEFQV

SEQ ID NO: 1335773 - protein, 9 aa, Homo Sapiens
LMTQKYKHT

SEQ ID NO: 1335774 - protein, 9 aa, Homo Sapiens
EGEEEKSEP

SEQ ID NO: 1335775 - protein, 9 aa, Homo Sapiens
QEAFLRFMV

SEQ ID NO: 1335776 - protein, 9 aa, Homo Sapiens
LHQLHPNTF

SEQ ID NO: 1335777 - protein, 9 aa, Homo Sapiens
AIVQLNKCP

SEQ ID NO: 1335778 - protein, 9 aa, Homo Sapiens
LDGVPSPPR

SEQ ID NO: 1335779 - protein, 9 aa, Homo Sapiens
KVKSKDASK

SEQ ID NO: 1335780 - protein, 9 aa, Homo Sapiens
KLLRRVSHL

SEQ ID NO: 1335781 - protein, 9 aa, Homo Sapiens
IVKEDRRFN

SEQ ID NO: 1335782 - protein, 9 aa, Homo Sapiens
TMPRVRKLK

SEQ ID NO: 1335783 - protein, 9 aa, Homo Sapiens
YQVRLQQSF

SEQ ID NO: 1335784 - protein, 9 aa, Homo Sapiens
RENYVSRPH

SEQ ID NO: 1335785 - protein, 9 aa, Homo Sapiens
TQKKCWENI

SEQ ID NO: 1335786 - protein, 9 aa, Homo Sapiens
ADMDLLHRI

SEQ ID NO: 1335787 - protein, 9 aa, Homo Sapiens
KQCLIKSDQ

SEQ ID NO: 1335788 - protein, 9 aa, Homo Sapiens
MLEQIRALQ

SEQ ID NO: 1335789 - protein, 9 aa, Homo Sapiens
LSKSTQKKL

SEQ ID NO: 1335790 - protein, 9 aa, Homo Sapiens
REVSVVDRV

SEQ ID NO: 1335791 - protein, 9 aa, Homo Sapiens
GDSDLLRCG

SEQ ID NO: 1335792 - protein, 9 aa, Homo Sapiens
ESRRRHKMI

SEQ ID NO: 1335793 - protein, 9 aa, Homo Sapiens
RKDFEIWLD

SEQ ID NO: 1335794 - protein, 9 aa, Homo Sapiens
SSRSALIPH

SEQ ID NO: 1335795 - protein, 9 aa, Homo Sapiens
RGALGSITL

SEQ ID NO: 1335796 - protein, 9 aa, Homo Sapiens
PWYSEACTS

SEQ ID NO: 1335797 - protein, 9 aa, Homo Sapiens
SWQQMSLQG

SEQ ID NO: 1335798 - protein, 9 aa, Homo Sapiens
RYSFEDEGR

SEQ ID NO: 1335799 - protein, 9 aa, Homo Sapiens
GTSSKGPWS

SEQ ID NO: 1335800 - protein, 9 aa, Homo Sapiens
GPGRFRDNH

SEQ ID NO: 1335801 - protein, 9 aa, Homo Sapiens
LLWVLLYVQ

SEQ ID NO: 1335802 - protein, 9 aa, Homo Sapiens
HLLTCVERP

SEQ ID NO: 1335803 - protein, 9 aa, Homo Sapiens
WVLQDYMSP

SEQ ID NO: 1335804 - protein, 9 aa, Homo Sapiens
LHQPEMAAM

SEQ ID NO: 1335805 - protein, 9 aa, Homo Sapiens
QPRTRCTKF

SEQ ID NO: 1335806 - protein, 9 aa, Homo Sapiens
SLILRQFRA

SEQ ID NO: 1335807 - protein, 9 aa, Homo Sapiens
VLGVQWAIL

SEQ ID NO: 1335808 - protein, 9 aa, Homo Sapiens
MSGRCKANP

SEQ ID NO: 1335809 - protein, 9 aa, Homo Sapiens
LGLSGASGL

SEQ ID NO: 1335810 - protein, 9 aa, Homo Sapiens
CRPRTFCLA

SEQ ID NO: 1335811 - protein, 9 aa, Homo Sapiens
QVCGYSEAE

SEQ ID NO: 1335812 - protein, 9 aa, Homo Sapiens
NDNIYIAQN

SEQ ID NO: 1335813 - protein, 9 aa, Homo Sapiens
VLIITPWNY

SEQ ID NO: 1335814 - protein, 9 aa, Homo Sapiens
CRSPPLCAL

SEQ ID NO: 1335815 - protein, 9 aa, Homo Sapiens
YHSFHTDKL

SEQ ID NO: 1335816 - protein, 9 aa, Homo Sapiens
RSPEVQFIG

SEQ ID NO: 1335817 - protein, 9 aa, Homo Sapiens
ILENAVPSS

SEQ ID NO: 1335818 - protein, 9 aa, Homo Sapiens
LQGLWHRFN

SEQ ID NO: 1335819 - protein, 9 aa, Homo Sapiens
CFSLRHCCL

SEQ ID NO: 1335820 - protein, 9 aa, Homo Sapiens
ADAVHPFFL

SEQ ID NO: 1335821 - protein, 9 aa, Homo Sapiens
MTLLKLASP

SEQ ID NO: 1335822 - protein, 9 aa, Homo Sapiens
GTIGDDDFT

SEQ ID NO: 1335823 - protein, 9 aa, Homo Sapiens
GSTMGEICW

SEQ ID NO: 1335824 - protein, 9 aa, Homo Sapiens
TTDHIERYE

SEQ ID NO: 1335825 - protein, 9 aa, Homo Sapiens
SPASKKKEI

SEQ ID NO: 1335826 - protein, 9 aa, Homo Sapiens
VMNKKKCQR

SEQ ID NO: 1335827 - protein, 9 aa, Homo Sapiens
RSRTNLMDR

SEQ ID NO: 1335828 - protein, 9 aa, Homo Sapiens
PFYIWTADM

SEQ ID NO: 1335829 - protein, 9 aa, Homo Sapiens
LLLWAKAMR

SEQ ID NO: 1335830 - protein, 9 aa, Homo Sapiens
GRYSFEDEG

SEQ ID NO: 1335831 - protein, 9 aa, Homo Sapiens
LPPHLNGPW

SEQ ID NO: 1335832 - protein, 9 aa, Homo Sapiens
FYHPYSPAH

SEQ ID NO: 1335833 - protein, 9 aa, Homo Sapiens
RVHVFQIDP

SEQ ID NO: 1335834 - protein, 9 aa, Homo Sapiens
QIPPPLPTM

SEQ ID NO: 1335835 - protein, 9 aa, Homo Sapiens
THADSTGES

SEQ ID NO: 1335836 - protein, 9 aa, Homo Sapiens
SESPELSQK

SEQ ID NO: 1335837 - protein, 9 aa, Homo Sapiens
EWLSPDITL

SEQ ID NO: 1335838 - protein, 9 aa, Homo Sapiens
VYGAGLLSS

SEQ ID NO: 1335839 - protein, 9 aa, Homo Sapiens
EHCKVSAFV

SEQ ID NO: 1335840 - protein, 9 aa, Homo Sapiens
SFSPQSSSL

SEQ ID NO: 1335841 - protein, 9 aa, Homo Sapiens
SLYEQGMIQ

SEQ ID NO: 1335842 - protein, 9 aa, Homo Sapiens
MYLTGNNIS

SEQ ID NO: 1335843 - protein, 9 aa, Homo Sapiens
PPGRSLPAG

SEQ ID NO: 1335844 - protein, 9 aa, Homo Sapiens
LHSKLQSQL

SEQ ID NO: 1335845 - protein, 9 aa, Homo Sapiens
KTLLIPPSS

SEQ ID NO: 1335846 - protein, 9 aa, Homo Sapiens
NHTSGLITT

SEQ ID NO: 1335847 - protein, 9 aa, Homo Sapiens
GWAHSGVSV

SEQ ID NO: 1335848 - protein, 9 aa, Homo Sapiens
QFLRVMTWQ

SEQ ID NO: 1335849 - protein, 9 aa, Homo Sapiens
HHQRVHTQE

SEQ ID NO: 1335850 - protein, 9 aa, Homo Sapiens
RQCLSHSVF

SEQ ID NO: 1335851 - protein, 9 aa, Homo Sapiens
HIPDYTPLC

SEQ ID NO: 1335852 - protein, 9 aa, Homo Sapiens
KAVVNATIP

SEQ ID NO: 1335853 - protein, 9 aa, Homo Sapiens
SQVQKELQI

SEQ ID NO: 1335854 - protein, 9 aa, Homo Sapiens
PEGAGWTSK

SEQ ID NO: 1335855 - protein, 9 aa, Homo Sapiens
IITPWNYPL

SEQ ID NO: 1335856 - protein, 9 aa, Homo Sapiens
KCTYTSSEE

SEQ ID NO: 1335857 - protein, 9 aa, Homo Sapiens
DKISDARVV

SEQ ID NO: 1335858 - protein, 9 aa, Homo Sapiens
QSWCPVIKQ

SEQ ID NO: 1335859 - protein, 9 aa, Homo Sapiens
KATLKAAGQ

SEQ ID NO: 1335860 - protein, 9 aa, Homo Sapiens
IDCVSEKGG

SEQ ID NO: 1335861 - protein, 9 aa, Homo Sapiens
RVMIEAMER

SEQ ID NO: 1335862 - protein, 9 aa, Homo Sapiens
FDVCLSANL

SEQ ID NO: 1335863 - protein, 9 aa, Homo Sapiens
ALQNAFGDH

SEQ ID NO: 1335864 - protein, 9 aa, Homo Sapiens
TMGEICWPG

SEQ ID NO: 1335865 - protein, 9 aa, Homo Sapiens
RRVYYSPTP

SEQ ID NO: 1335866 - protein, 9 aa, Homo Sapiens
HSTFVPTRS

SEQ ID NO: 1335867 - protein, 9 aa, Homo Sapiens
PIRSPVMSG

SEQ ID NO: 1335868 - protein, 9 aa, Homo Sapiens
VFMEGPESG

SEQ ID NO: 1335869 - protein, 9 aa, Homo Sapiens
RDLNYIRSL

SEQ ID NO: 1335870 - protein, 9 aa, Homo Sapiens
ERRTIDIYM

SEQ ID NO: 1335871 - protein, 9 aa, Homo Sapiens
YKRNPMCSE

SEQ ID NO: 1335872 - protein, 9 aa, Homo Sapiens
SIPRVGKRH

SEQ ID NO: 1335873 - protein, 9 aa, Homo Sapiens
DFKVIIDGV

SEQ ID NO: 1335874 - protein, 9 aa, Homo Sapiens
RRSPRSTPW

SEQ ID NO: 1335875 - protein, 9 aa, Homo Sapiens
NCIACYSNM

SEQ ID NO: 1335876 - protein, 9 aa, Homo Sapiens
RDPAKMRRR

SEQ ID NO: 1335877 - protein, 9 aa, Homo Sapiens
KEHMRVYDN

SEQ ID NO: 1335878 - protein, 9 aa, Homo Sapiens
IISLKEEFY

SEQ ID NO: 1335879 - protein, 9 aa, Homo Sapiens
VTYYLYMKY

SEQ ID NO: 1335880 - protein, 9 aa, Homo Sapiens
NKSRGFTFV

SEQ ID NO: 1335881 - protein, 9 aa, Homo Sapiens
SQHYKAEEG

SEQ ID NO: 1335882 - protein, 9 aa, Homo Sapiens
NLLKPCCPC

SEQ ID NO: 1335883 - protein, 9 aa, Homo Sapiens
VNCHVIATP

SEQ ID NO: 1335884 - protein, 9 aa, Homo Sapiens
PELLWMCLH

SEQ ID NO: 1335885 - protein, 9 aa, Homo Sapiens
RDWTLCYTP

SEQ ID NO: 1335886 - protein, 9 aa, Homo Sapiens
VVIHCKGGT

SEQ ID NO: 1335887 - protein, 9 aa, Homo Sapiens
LCKSEECGK

SEQ ID NO: 1335888 - protein, 9 aa, Homo Sapiens
DQPLGMAFI

SEQ ID NO: 1335889 - protein, 9 aa, Homo Sapiens
MCMPLSKMP

SEQ ID NO: 1335890 - protein, 9 aa, Homo Sapiens
GFTTHLEDV

SEQ ID NO: 1335891 - protein, 9 aa, Homo Sapiens
FITSTGALY

SEQ ID NO: 1335892 - protein, 9 aa, Homo Sapiens
QNTQTFNLE

SEQ ID NO: 1335893 - protein, 9 aa, Homo Sapiens
QILFPNRQP

SEQ ID NO: 1335894 - protein, 9 aa, Homo Sapiens
APNDITRDL

SEQ ID NO: 1335895 - protein, 9 aa, Homo Sapiens
EICWPGTKK

SEQ ID NO: 1335896 - protein, 9 aa, Homo Sapiens
VRRSYQRRG

SEQ ID NO: 1335897 - protein, 9 aa, Homo Sapiens
PNSVHGSCR

SEQ ID NO: 1335898 - protein, 9 aa, Homo Sapiens
NCARVEENF

SEQ ID NO: 1335899 - protein, 9 aa, Homo Sapiens
NYHPLQPLM

SEQ ID NO: 1335900 - protein, 9 aa, Homo Sapiens
PEDQESPHQ

SEQ ID NO: 1335901 - protein, 9 aa, Homo Sapiens
KFYVIDCHY

SEQ ID NO: 1335902 - protein, 9 aa, Homo Sapiens
HVIFGDDHR

SEQ ID NO: 1335903 - protein, 9 aa, Homo Sapiens
SSHNLITAN

SEQ ID NO: 1335904 - protein, 9 aa, Homo Sapiens
YKHDVLTRK

SEQ ID NO: 1335905 - protein, 9 aa, Homo Sapiens
CVLRAVVIA

SEQ ID NO: 1335906 - protein, 9 aa, Homo Sapiens
ISLYDTVAE

SEQ ID NO: 1335907 - protein, 9 aa, Homo Sapiens
KSRRGPHAP

SEQ ID NO: 1335908 - protein, 9 aa, Homo Sapiens
LKHQVQQHK

SEQ ID NO: 1335909 - protein, 9 aa, Homo Sapiens
YILWPEVME

SEQ ID NO: 1335910 - protein, 9 aa, Homo Sapiens
MYASRLYRT

SEQ ID NO: 1335911 - protein, 9 aa, Homo Sapiens
RASSCAASA

SEQ ID NO: 1335912 - protein, 9 aa, Homo Sapiens
LAKTYSTKD

SEQ ID NO: 1335913 - protein, 9 aa, Homo Sapiens
DLQTTHSTF

SEQ ID NO: 1335914 - protein, 9 aa, Homo Sapiens
LDLLMDLLR

SEQ ID NO: 1335915 - protein, 9 aa, Homo Sapiens
RSLHYTACR

SEQ ID NO: 1335916 - protein, 9 aa, Homo Sapiens
LLQAECRAL

SEQ ID NO: 1335917 - protein, 9 aa, Homo Sapiens
EGFLLSVMT

SEQ ID NO: 1335918 - protein, 9 aa, Homo Sapiens
VKSTLILVC

SEQ ID NO: 1335919 - protein, 9 aa, Homo Sapiens
SSSSCKKQA

SEQ ID NO: 1335920 - protein, 9 aa, Homo Sapiens
SDHVLKRSA

SEQ ID NO: 1335921 - protein, 9 aa, Homo Sapiens
LHVPHPAQT

SEQ ID NO: 1335922 - protein, 9 aa, Homo Sapiens
LLCSNMSCC

SEQ ID NO: 1335923 - protein, 9 aa, Homo Sapiens
DELALWRGD

SEQ ID NO: 1335924 - protein, 9 aa, Homo Sapiens
ACEVLPRSA

SEQ ID NO: 1335925 - protein, 9 aa, Homo Sapiens
AHVLNTHCQ

SEQ ID NO: 1335926 - protein, 9 aa, Homo Sapiens
CGVGQRIRD

SEQ ID NO: 1335927 - protein, 9 aa, Homo Sapiens
SRKQFEEMA

SEQ ID NO: 1335928 - protein, 9 aa, Homo Sapiens
RNLHEEDTL

SEQ ID NO: 1335929 - protein, 9 aa, Homo Sapiens
LTPAFLPHR

SEQ ID NO: 1335930 - protein, 9 aa, Homo Sapiens
RLKKVVPYN

SEQ ID NO: 1335931 - protein, 9 aa, Homo Sapiens
YVTRVCGPA

SEQ ID NO: 1335932 - protein, 9 aa, Homo Sapiens
DLRTRTQLR

SEQ ID NO: 1335933 - protein, 9 aa, Homo Sapiens
EVIREGWRW

SEQ ID NO: 1335934 - protein, 9 aa, Homo Sapiens
RMGGRHPSW

SEQ ID NO: 1335935 - protein, 9 aa, Homo Sapiens
KIFPNYRHS

SEQ ID NO: 1335936 - protein, 9 aa, Homo Sapiens
HLTLDEMDN

SEQ ID NO: 1335937 - protein, 9 aa, Homo Sapiens
SPTSAASAA

SEQ ID NO: 1335938 - protein, 9 aa, Homo Sapiens
GRNGTPACE

SEQ ID NO: 1335939 - protein, 9 aa, Homo Sapiens
TFSECPSLI

SEQ ID NO: 1335940 - protein, 9 aa, Homo Sapiens
EERVAMKEV

SEQ ID NO: 1335941 - protein, 9 aa, Homo Sapiens
GRMGGRHPS

SEQ ID NO: 1335942 - protein, 9 aa, Homo Sapiens
HEIVEKILS

SEQ ID NO: 1335943 - protein, 9 aa, Homo Sapiens
TPLMLWPAL

SEQ ID NO: 1335944 - protein, 9 aa, Homo Sapiens
GKSLVNKLR

SEQ ID NO: 1335945 - protein, 9 aa, Homo Sapiens
RVYGAGLLS

SEQ ID NO: 1335946 - protein, 9 aa, Homo Sapiens
TERGCTFVN

SEQ ID NO: 1335947 - protein, 9 aa, Homo Sapiens
KKVQTCHVT

SEQ ID NO: 1335948 - protein, 9 aa, Homo Sapiens
LLDITMGFK

SEQ ID NO: 1335949 - protein, 9 aa, Homo Sapiens
TAARSPSSA

SEQ ID NO: 1335950 - protein, 9 aa, Homo Sapiens
YEVVPQQPT

SEQ ID NO: 1335951 - protein, 9 aa, Homo Sapiens
TTLDTIDNL

SEQ ID NO: 1335952 - protein, 9 aa, Homo Sapiens
DEHSSMNRL

SEQ ID NO: 1335953 - protein, 9 aa, Homo Sapiens
EYTIKCNYV

SEQ ID NO: 1335954 - protein, 9 aa, Homo Sapiens
KDFEIWLDN

SEQ ID NO: 1335955 - protein, 9 aa, Homo Sapiens
RAYDPKGSL

SEQ ID NO: 1335956 - protein, 9 aa, Homo Sapiens
ECRHADQYK

SEQ ID NO: 1335957 - protein, 9 aa, Homo Sapiens
FTLSSQVPD

SEQ ID NO: 1335958 - protein, 9 aa, Homo Sapiens
PIVGVHLVS

SEQ ID NO: 1335959 - protein, 9 aa, Homo Sapiens
QDRPFDDTC

SEQ ID NO: 1335960 - protein, 9 aa, Homo Sapiens
GDFLPTGLQ

SEQ ID NO: 1335961 - protein, 9 aa, Homo Sapiens
TWLRDNRPL

SEQ ID NO: 1335962 - protein, 9 aa, Homo Sapiens
EEKIRIRDR

SEQ ID NO: 1335963 - protein, 9 aa, Homo Sapiens
PGSQSSPRT

SEQ ID NO: 1335964 - protein, 9 aa, Homo Sapiens
HPSAVLMAL

SEQ ID NO: 1335965 - protein, 9 aa, Homo Sapiens
TVALHEIRR

SEQ ID NO: 1335966 - protein, 9 aa, Homo Sapiens
CSGCCNNHN

SEQ ID NO: 1335967 - protein, 9 aa, Homo Sapiens
FAIVTALGD

SEQ ID NO: 1335968 - protein, 9 aa, Homo Sapiens
LNHISTIVP

SEQ ID NO: 1335969 - protein, 9 aa, Homo Sapiens
KDEIMRNHK

SEQ ID NO: 1335970 - protein, 9 aa, Homo Sapiens
ILVVQSAKW

SEQ ID NO: 1335971 - protein, 9 aa, Homo Sapiens
SLRKWRPGA

SEQ ID NO: 1335972 - protein, 9 aa, Homo Sapiens
KVKADQIDK

SEQ ID NO: 1335973 - protein, 9 aa, Homo Sapiens
TCPRFLSGL

SEQ ID NO: 1335974 - protein, 9 aa, Homo Sapiens
DRCGKRFYM

SEQ ID NO: 1335975 - protein, 9 aa, Homo Sapiens
PEHITTITG

SEQ ID NO: 1335976 - protein, 9 aa, Homo Sapiens
FVTSLNFFK

SEQ ID NO: 1335977 - protein, 9 aa, Homo Sapiens
KLQTYDVSS

SEQ ID NO: 1335978 - protein, 9 aa, Homo Sapiens
KGIFVHRYC

SEQ ID NO: 1335979 - protein, 9 aa, Homo Sapiens
IIIITLLDP

SEQ ID NO: 1335980 - protein, 9 aa, Homo Sapiens
LSCTGPSRV

SEQ ID NO: 1335981 - protein, 9 aa, Homo Sapiens
VVLDTSWVG

SEQ ID NO: 1335982 - protein, 9 aa, Homo Sapiens
GLPVRQDME

SEQ ID NO: 1335983 - protein, 9 aa, Homo Sapiens
LNISTKEYT

SEQ ID NO: 1335984 - protein, 9 aa, Homo Sapiens
LQHMDMKPL

SEQ ID NO: 1335985 - protein, 9 aa, Homo Sapiens
SGAMGPPER

SEQ ID NO: 1335986 - protein, 9 aa, Homo Sapiens
GLGSKYFTL

SEQ ID NO: 1335987 - protein, 9 aa, Homo Sapiens
SSFSTATSS

SEQ ID NO: 1335988 - protein, 9 aa, Homo Sapiens
IQRLHIPRF

SEQ ID NO: 1335989 - protein, 9 aa, Homo Sapiens
VTLSMALPC

SEQ ID NO: 1335990 - protein, 9 aa, Homo Sapiens
GEGTIACLQ

SEQ ID NO: 1335991 - protein, 9 aa, Homo Sapiens
HTFETARHN

SEQ ID NO: 1335992 - protein, 9 aa, Homo Sapiens
EDLVEMVLL

SEQ ID NO: 1335993 - protein, 9 aa, Homo Sapiens
NGAFVYLYK

SEQ ID NO: 1335994 - protein, 9 aa, Homo Sapiens
TDYMFWLGG

SEQ ID NO: 1335995 - protein, 9 aa, Homo Sapiens
EGAGWTSKT

SEQ ID NO: 1335996 - protein, 9 aa, Homo Sapiens
QKSEEPLVS

SEQ ID NO: 1335997 - protein, 9 aa, Homo Sapiens
AVAICKGPM

SEQ ID NO: 1335998 - protein, 9 aa, Homo Sapiens
NPNGDSAEF

SEQ ID NO: 1335999 - protein, 9 aa, Homo Sapiens
LKNRKKSDY

SEQ ID NO: 1336000 - protein, 9 aa, Homo Sapiens
TVEVLAIDN

SEQ ID NO: 1336001 - protein, 9 aa, Homo Sapiens
VKQPHHHRS

SEQ ID NO: 1336002 - protein, 9 aa, Homo Sapiens
SGTFWLWCS

SEQ ID NO: 1336003 - protein, 9 aa, Homo Sapiens
KPITGRTHQ

SEQ ID NO: 1336004 - protein, 9 aa, Homo Sapiens
YIKTPTHRE

SEQ ID NO: 1336005 - protein, 9 aa, Homo Sapiens
LMYTCLLWL

SEQ ID NO: 1336006 - protein, 9 aa, Homo Sapiens
LIHTGEKHY

SEQ ID NO: 1336007 - protein, 9 aa, Homo Sapiens
VLGGMEVWW

SEQ ID NO: 1336008 - protein, 9 aa, Homo Sapiens
SSPTSPSWL

SEQ ID NO: 1336009 - protein, 9 aa, Homo Sapiens
TPSQNRKCL

SEQ ID NO: 1336010 - protein, 9 aa, Homo Sapiens
PLEAPAEPL

SEQ ID NO: 1336011 - protein, 9 aa, Homo Sapiens
TWLHPRGER

SEQ ID NO: 1336012 - protein, 9 aa, Homo Sapiens
GEKSFKCEQ

SEQ ID NO: 1336013 - protein, 9 aa, Homo Sapiens
LVLNDIRNP

SEQ ID NO: 1336014 - protein, 9 aa, Homo Sapiens
LNEVTMVLV

SEQ ID NO: 1336015 - protein, 9 aa, Homo Sapiens
QPGHILLIL

SEQ ID NO: 1336016 - protein, 9 aa, Homo Sapiens
AESHRKNHS

SEQ ID NO: 1336017 - protein, 9 aa, Homo Sapiens
EIFRRVYYS

SEQ ID NO: 1336018 - protein, 9 aa, Homo Sapiens
RCNIDRTPE

SEQ ID NO: 1336019 - protein, 9 aa, Homo Sapiens
RKMRHMYNS

SEQ ID NO: 1336020 - protein, 9 aa, Homo Sapiens
SRPCRMRLY

SEQ ID NO: 1336021 - protein, 9 aa, Homo Sapiens
WLRLRVLVP

SEQ ID NO: 1336022 - protein, 9 aa, Homo Sapiens
HIKHAPARA

SEQ ID NO: 1336023 - protein, 9 aa, Homo Sapiens
EFSSTVQGN

SEQ ID NO: 1336024 - protein, 9 aa, Homo Sapiens
GLGSRPPCS

SEQ ID NO: 1336025 - protein, 9 aa, Homo Sapiens
MLQKCIRYV

SEQ ID NO: 1336026 - protein, 9 aa, Homo Sapiens
RVYSGHQGH

SEQ ID NO: 1336027 - protein, 9 aa, Homo Sapiens
SYTGQMTPK

SEQ ID NO: 1336028 - protein, 9 aa, Homo Sapiens
EKFVEWMRL

SEQ ID NO: 1336029 - protein, 9 aa, Homo Sapiens
CVSQEHRCI

SEQ ID NO: 1336030 - protein, 9 aa, Homo Sapiens
EALYLYGVI

SEQ ID NO: 1336031 - protein, 9 aa, Homo Sapiens
NDFVFLLHM

SEQ ID NO: 1336032 - protein, 9 aa, Homo Sapiens
TDFPSQLQM

SEQ ID NO: 1336033 - protein, 9 aa, Homo Sapiens
MNGYWGPAN

SEQ ID NO: 1336034 - protein, 9 aa, Homo Sapiens
VIEDEGFQA

SEQ ID NO: 1336035 - protein, 9 aa, Homo Sapiens
VAVFVICWL

SEQ ID NO: 1336036 - protein, 9 aa, Homo Sapiens
TLLVWYRHY

SEQ ID NO: 1336037 - protein, 9 aa, Homo Sapiens
HTMGYMPTE

SEQ ID NO: 1336038 - protein, 9 aa, Homo Sapiens
AAPKILRLV

SEQ ID NO: 1336039 - protein, 9 aa, Homo Sapiens
SVLQNIHLR

SEQ ID NO: 1336040 - protein, 9 aa, Homo Sapiens
KARMRQISD

SEQ ID NO: 1336041 - protein, 9 aa, Homo Sapiens
DQPNNRMSP

SEQ ID NO: 1336042 - protein, 9 aa, Homo Sapiens
KILREVDKV

SEQ ID NO: 1336043 - protein, 9 aa, Homo Sapiens
RSEKQKSII

SEQ ID NO: 1336044 - protein, 9 aa, Homo Sapiens
EKVCQLEQE

SEQ ID NO: 1336045 - protein, 9 aa, Homo Sapiens
HQGIKHAVV

SEQ ID NO: 1336046 - protein, 9 aa, Homo Sapiens
GGSLSSCGW

SEQ ID NO: 1336047 - protein, 9 aa, Homo Sapiens
RVLRAYPIQ

SEQ ID NO: 1336048 - protein, 9 aa, Homo Sapiens
NLNNRLASY

SEQ ID NO: 1336049 - protein, 9 aa, Homo Sapiens
NLFKVPGNL

SEQ ID NO: 1336050 - protein, 9 aa, Homo Sapiens
YHPYSPAHP

SEQ ID NO: 1336051 - protein, 9 aa, Homo Sapiens
TDCFLKTYT

SEQ ID NO: 1336052 - protein, 9 aa, Homo Sapiens
KEIMVQLEE

SEQ ID NO: 1336053 - protein, 9 aa, Homo Sapiens
CIRNPSIQK

SEQ ID NO: 1336054 - protein, 9 aa, Homo Sapiens
DDNHISTIS

SEQ ID NO: 1336055 - protein, 9 aa, Homo Sapiens
KASNQISRV

SEQ ID NO: 1336056 - protein, 9 aa, Homo Sapiens
YQLLLKMEI

SEQ ID NO: 1336057 - protein, 9 aa, Homo Sapiens
AFRCSRWVR

SEQ ID NO: 1336058 - protein, 9 aa, Homo Sapiens
NKYQGRDDD

SEQ ID NO: 1336059 - protein, 9 aa, Homo Sapiens
LMSVKLALV

SEQ ID NO: 1336060 - protein, 9 aa, Homo Sapiens
PEEPSHFLR

SEQ ID NO: 1336061 - protein, 9 aa, Homo Sapiens
VSWNAICIG

SEQ ID NO: 1336062 - protein, 9 aa, Homo Sapiens
MASPGLTAP

SEQ ID NO: 1336063 - protein, 9 aa, Homo Sapiens
IPVRTMVQD

SEQ ID NO: 1336064 - protein, 9 aa, Homo Sapiens
PWAYIKMMG

SEQ ID NO: 1336065 - protein, 9 aa, Homo Sapiens
STWTVRSAA

SEQ ID NO: 1336066 - protein, 9 aa, Homo Sapiens
ALHVAECPC

SEQ ID NO: 1336067 - protein, 9 aa, Homo Sapiens
PLDTPHQRG

SEQ ID NO: 1336068 - protein, 9 aa, Homo Sapiens
IKYLRIPNE

SEQ ID NO: 1336069 - protein, 9 aa, Homo Sapiens
ISCAQIPCI

SEQ ID NO: 1336070 - protein, 9 aa, Homo Sapiens
FYFEEVQHL

SEQ ID NO: 1336071 - protein, 9 aa, Homo Sapiens
FSIEEVEVT

SEQ ID NO: 1336072 - protein, 9 aa, Homo Sapiens
CAPMSVPHN

SEQ ID NO: 1336073 - protein, 9 aa, Homo Sapiens
TILVLVALF

SEQ ID NO: 1336074 - protein, 9 aa, Homo Sapiens
AAASGPCHA

SEQ ID NO: 1336075 - protein, 9 aa, Homo Sapiens
QHQVDYILA

SEQ ID NO: 1336076 - protein, 9 aa, Homo Sapiens
KDVFETRQD

SEQ ID NO: 1336077 - protein, 9 aa, Homo Sapiens
QKTTTLVLM

SEQ ID NO: 1336078 - protein, 9 aa, Homo Sapiens
FLWPCGPVM

SEQ ID NO: 1336079 - protein, 9 aa, Homo Sapiens
KRCQPHPTA

SEQ ID NO: 1336080 - protein, 9 aa, Homo Sapiens
LVQWGDIVK

SEQ ID NO: 1336081 - protein, 9 aa, Homo Sapiens
LNLIKPTLV

SEQ ID NO: 1336082 - protein, 9 aa, Homo Sapiens
KVSVKNYEG

SEQ ID NO: 1336083 - protein, 9 aa, Homo Sapiens
LANQRIADN

SEQ ID NO: 1336084 - protein, 9 aa, Homo Sapiens
PHARALVHY

SEQ ID NO: 1336085 - protein, 9 aa, Homo Sapiens
VRVVFAELA

SEQ ID NO: 1336086 - protein, 9 aa, Homo Sapiens
VEELRKCVL

SEQ ID NO: 1336087 - protein, 9 aa, Homo Sapiens
SPGIAGPVT

SEQ ID NO: 1336088 - protein, 9 aa, Homo Sapiens
QNRKCLYKV

SEQ ID NO: 1336089 - protein, 9 aa, Homo Sapiens
LEARKDLRV

SEQ ID NO: 1336090 - protein, 9 aa, Homo Sapiens
KSRTLGNCG

SEQ ID NO: 1336091 - protein, 9 aa, Homo Sapiens
ELVQWGDIV

SEQ ID NO: 1336092 - protein, 9 aa, Homo Sapiens
SEEMNQTNK

SEQ ID NO: 1336093 - protein, 9 aa, Homo Sapiens
RGGDHHVEL

SEQ ID NO: 1336094 - protein, 9 aa, Homo Sapiens
QSSVQQRLT

SEQ ID NO: 1336095 - protein, 9 aa, Homo Sapiens
MSKLNSTFV

SEQ ID NO: 1336096 - protein, 9 aa, Homo Sapiens
KEETLDEIT

SEQ ID NO: 1336097 - protein, 9 aa, Homo Sapiens
SGPYSAPPQ

SEQ ID NO: 1336098 - protein, 9 aa, Homo Sapiens
EADHVISVI

SEQ ID NO: 1336099 - protein, 9 aa, Homo Sapiens
FHFYRVLTC

SEQ ID NO: 1336100 - protein, 9 aa, Homo Sapiens
TYDRYVAIV

SEQ ID NO: 1336101 - protein, 9 aa, Homo Sapiens
GKKGESGAL

SEQ ID NO: 1336102 - protein, 9 aa, Homo Sapiens
VETQPRVVS

SEQ ID NO: 1336103 - protein, 9 aa, Homo Sapiens
YPVEDLATT

SEQ ID NO: 1336104 - protein, 9 aa, Homo Sapiens
MQTVRGVAV

SEQ ID NO: 1336105 - protein, 9 aa, Homo Sapiens
YNNANGTYE

SEQ ID NO: 1336106 - protein, 9 aa, Homo Sapiens
GPEEPSHFL

SEQ ID NO: 1336107 - protein, 9 aa, Homo Sapiens
SLSPKPCDK

SEQ ID NO: 1336108 - protein, 9 aa, Homo Sapiens
KDFRMNMCV

SEQ ID NO: 1336109 - protein, 9 aa, Homo Sapiens
ATGKEEKSN

SEQ ID NO: 1336110 - protein, 9 aa, Homo Sapiens
SDKNLRWRK

SEQ ID NO: 1336111 - protein, 9 aa, Homo Sapiens
SDMDNLSSE

SEQ ID NO: 1336112 - protein, 9 aa, Homo Sapiens
NVCCLVREY

SEQ ID NO: 1336113 - protein, 9 aa, Homo Sapiens
TSSRRWTWW

SEQ ID NO: 1336114 - protein, 9 aa, Homo Sapiens
LASYTANLV

SEQ ID NO: 1336115 - protein, 9 aa, Homo Sapiens
EANGNTGTS

SEQ ID NO: 1336116 - protein, 9 aa, Homo Sapiens
CKEPVIAGL

SEQ ID NO: 1336117 - protein, 9 aa, Homo Sapiens
AVLTSLLPI

SEQ ID NO: 1336118 - protein, 9 aa, Homo Sapiens
HTIRMTIDA

SEQ ID NO: 1336119 - protein, 9 aa, Homo Sapiens
GVINDWRHF

SEQ ID NO: 1336120 - protein, 9 aa, Homo Sapiens
PVLLPPVFI

SEQ ID NO: 1336121 - protein, 9 aa, Homo Sapiens
SAASAAEPS

SEQ ID NO: 1336122 - protein, 9 aa, Homo Sapiens
RLPGVGLAP

SEQ ID NO: 1336123 - protein, 9 aa, Homo Sapiens
PLWEVWAPP

SEQ ID NO: 1336124 - protein, 9 aa, Homo Sapiens
WQVHHHATA

SEQ ID NO: 1336125 - protein, 9 aa, Homo Sapiens
PRVGKRHAG

SEQ ID NO: 1336126 - protein, 9 aa, Homo Sapiens
LDLAGWELP

SEQ ID NO: 1336127 - protein, 9 aa, Homo Sapiens
ELLALEEND

SEQ ID NO: 1336128 - protein, 9 aa, Homo Sapiens
KLKMWYQTS

SEQ ID NO: 1336129 - protein, 9 aa, Homo Sapiens
AEEENTDKS

SEQ ID NO: 1336130 - protein, 9 aa, Homo Sapiens
FREDPIIVM

SEQ ID NO: 1336131 - protein, 9 aa, Homo Sapiens
APSEVDFQL

SEQ ID NO: 1336132 - protein, 9 aa, Homo Sapiens
MAILFHILQ

SEQ ID NO: 1336133 - protein, 9 aa, Homo Sapiens
SNEAKQQKC

SEQ ID NO: 1336134 - protein, 9 aa, Homo Sapiens
AVVIPDAVL

SEQ ID NO: 1336135 - protein, 9 aa, Homo Sapiens
LVLHSFTDV

SEQ ID NO: 1336136 - protein, 9 aa, Homo Sapiens
DGNCLMYAT

SEQ ID NO: 1336137 - protein, 9 aa, Homo Sapiens
MDTTTSLKG

SEQ ID NO: 1336138 - protein, 9 aa, Homo Sapiens
SPKEIEWMV

SEQ ID NO: 1336139 - protein, 9 aa, Homo Sapiens
ILRSPRVFP

SEQ ID NO: 1336140 - protein, 9 aa, Homo Sapiens
EPLENDKAK

SEQ ID NO: 1336141 - protein, 9 aa, Homo Sapiens
GEEADTPGV

SEQ ID NO: 1336142 - protein, 9 aa, Homo Sapiens
FVTHVYASG

SEQ ID NO: 1336143 - protein, 9 aa, Homo Sapiens
DVYRHIVES

SEQ ID NO: 1336144 - protein, 9 aa, Homo Sapiens
LRLGQMDTN

SEQ ID NO: 1336145 - protein, 9 aa, Homo Sapiens
KKQRKPKRA

SEQ ID NO: 1336146 - protein, 9 aa, Homo Sapiens
QDPYSHVSD

SEQ ID NO: 1336147 - protein, 9 aa, Homo Sapiens
EDAMPLIRP

SEQ ID NO: 1336148 - protein, 9 aa, Homo Sapiens
PAVRDIDAF

SEQ ID NO: 1336149 - protein, 9 aa, Homo Sapiens
IMHTSYRQI

SEQ ID NO: 1336150 - protein, 9 aa, Homo Sapiens
DNRIHMYSE

SEQ ID NO: 1336151 - protein, 9 aa, Homo Sapiens
GYHQDDPSY

SEQ ID NO: 1336152 - protein, 9 aa, Homo Sapiens
SKWLLSTYI

SEQ ID NO: 1336153 - protein, 9 aa, Homo Sapiens
TSSLEMAGW

SEQ ID NO: 1336154 - protein, 9 aa, Homo Sapiens
EVQTRPFDL

SEQ ID NO: 1336155 - protein, 9 aa, Homo Sapiens
VKVDSPLPS

SEQ ID NO: 1336156 - protein, 9 aa, Homo Sapiens
RKIGRWREE

SEQ ID NO: 1336157 - protein, 9 aa, Homo Sapiens
GDDFKEPYQ

SEQ ID NO: 1336158 - protein, 9 aa, Homo Sapiens
PPIFPPPSL

SEQ ID NO: 1336159 - protein, 9 aa, Homo Sapiens
QKEEEQVRA

SEQ ID NO: 1336160 - protein, 9 aa, Homo Sapiens
RLGGGEDCA

SEQ ID NO: 1336161 - protein, 9 aa, Homo Sapiens
WYRHYFRLL

SEQ ID NO: 1336162 - protein, 9 aa, Homo Sapiens
LLQQLCPQN

SEQ ID NO: 1336163 - protein, 9 aa, Homo Sapiens
FVTAMMSKL

SEQ ID NO: 1336164 - protein, 9 aa, Homo Sapiens
VYKIFHILV

SEQ ID NO: 1336165 - protein, 9 aa, Homo Sapiens
TNKSESNED

SEQ ID NO: 1336166 - protein, 9 aa, Homo Sapiens
VPCPVDRTT

SEQ ID NO: 1336167 - protein, 9 aa, Homo Sapiens
TSYRQISGQ

SEQ ID NO: 1336168 - protein, 9 aa, Homo Sapiens
SKYIELPYG

SEQ ID NO: 1336169 - protein, 9 aa, Homo Sapiens
PPHRRRLAV

SEQ ID NO: 1336170 - protein, 9 aa, Homo Sapiens
LHCCDPGTS

SEQ ID NO: 1336171 - protein, 9 aa, Homo Sapiens
HRLSTVHNA

SEQ ID NO: 1336172 - protein, 9 aa, Homo Sapiens
PRQLPGPHD

SEQ ID NO: 1336173 - protein, 9 aa, Homo Sapiens
PHPTTLDPS

SEQ ID NO: 1336174 - protein, 9 aa, Homo Sapiens
VLHENRNKK

SEQ ID NO: 1336175 - protein, 9 aa, Homo Sapiens
PAQKYLYRS

SEQ ID NO: 1336176 - protein, 9 aa, Homo Sapiens
ECILPALSK

SEQ ID NO: 1336177 - protein, 9 aa, Homo Sapiens
CHPATLDTA

SEQ ID NO: 1336178 - protein, 9 aa, Homo Sapiens
LPAAIHTAT

SEQ ID NO: 1336179 - protein, 9 aa, Homo Sapiens
ETGDMCISI

SEQ ID NO: 1336180 - protein, 9 aa, Homo Sapiens
QTCSADEPM

SEQ ID NO: 1336181 - protein, 9 aa, Homo Sapiens
ALQPGEKKS

SEQ ID NO: 1336182 - protein, 9 aa, Homo Sapiens
MREANMACL

SEQ ID NO: 1336183 - protein, 9 aa, Homo Sapiens
VLVHLAQLT

SEQ ID NO: 1336184 - protein, 9 aa, Homo Sapiens
RYVVICFPL

SEQ ID NO: 1336185 - protein, 9 aa, Homo Sapiens
RLYLRSLEM

SEQ ID NO: 1336186 - protein, 9 aa, Homo Sapiens
EIRAPPAAT

SEQ ID NO: 1336187 - protein, 9 aa, Homo Sapiens
SSPVTKRCS

SEQ ID NO: 1336188 - protein, 9 aa, Homo Sapiens
YCDCCLRAT

SEQ ID NO: 1336189 - protein, 9 aa, Homo Sapiens
TSTSVPISS

SEQ ID NO: 1336190 - protein, 9 aa, Homo Sapiens
KINQSIQQR

SEQ ID NO: 1336191 - protein, 9 aa, Homo Sapiens
RRRLNLTQH

SEQ ID NO: 1336192 - protein, 9 aa, Homo Sapiens
TCDSSPPHA

SEQ ID NO: 1336193 - protein, 9 aa, Homo Sapiens
VREPQPAVS

SEQ ID NO: 1336194 - protein, 9 aa, Homo Sapiens
NVLLRTADL

SEQ ID NO: 1336195 - protein, 9 aa, Homo Sapiens
NNHNVQCRP

SEQ ID NO: 1336196 - protein, 9 aa, Homo Sapiens
EHITTITGS

SEQ ID NO: 1336197 - protein, 9 aa, Homo Sapiens
DLNYIRSLI

SEQ ID NO: 1336198 - protein, 9 aa, Homo Sapiens
IVVNQEILN

SEQ ID NO: 1336199 - protein, 9 aa, Homo Sapiens
RITLYCHQL

SEQ ID NO: 1336200 - protein, 9 aa, Homo Sapiens
RDEKVEAGE

SEQ ID NO: 1336201 - protein, 9 aa, Homo Sapiens
FKDALTRVY

SEQ ID NO: 1336202 - protein, 9 aa, Homo Sapiens
RMLFPEVQR

SEQ ID NO: 1336203 - protein, 9 aa, Homo Sapiens
ARAKGSSAT

SEQ ID NO: 1336204 - protein, 9 aa, Homo Sapiens
PLKSCKYHA

SEQ ID NO: 1336205 - protein, 9 aa, Homo Sapiens
RTLMAPQMI

SEQ ID NO: 1336206 - protein, 9 aa, Homo Sapiens
DYTPLCSPP

SEQ ID NO: 1336207 - protein, 9 aa, Homo Sapiens
DLMWINAGT

SEQ ID NO: 1336208 - protein, 9 aa, Homo Sapiens
PLENDKAKL

SEQ ID NO: 1336209 - protein, 9 aa, Homo Sapiens
DMIWDDLSE

SEQ ID NO: 1336210 - protein, 9 aa, Homo Sapiens
DTDTIEANE

SEQ ID NO: 1336211 - protein, 9 aa, Homo Sapiens
ALGLALTLG

SEQ ID NO: 1336212 - protein, 9 aa, Homo Sapiens
PNLSKILTL

SEQ ID NO: 1336213 - protein, 9 aa, Homo Sapiens
GQLSLADTL

SEQ ID NO: 1336214 - protein, 9 aa, Homo Sapiens
ATSAAKPSA

SEQ ID NO: 1336215 - protein, 9 aa, Homo Sapiens
DSILSITVD

SEQ ID NO: 1336216 - protein, 9 aa, Homo Sapiens
SSHLEIDDI

SEQ ID NO: 1336217 - protein, 9 aa, Homo Sapiens
APTQALMSN

SEQ ID NO: 1336218 - protein, 9 aa, Homo Sapiens
KACAKSKSR

SEQ ID NO: 1336219 - protein, 9 aa, Homo Sapiens
QNIHLRGEA

SEQ ID NO: 1336220 - protein, 9 aa, Homo Sapiens
ENVRHIAEV

SEQ ID NO: 1336221 - protein, 9 aa, Homo Sapiens
PSHLVRESS

SEQ ID NO: 1336222 - protein, 9 aa, Homo Sapiens
LTGIRLSIM

SEQ ID NO: 1336223 - protein, 9 aa, Homo Sapiens
QLLPFELEI

SEQ ID NO: 1336224 - protein, 9 aa, Homo Sapiens
IDARKNDMI

SEQ ID NO: 1336225 - protein, 9 aa, Homo Sapiens
PHTLNPDSP

SEQ ID NO: 1336226 - protein, 9 aa, Homo Sapiens
DTLWETIKF

SEQ ID NO: 1336227 - protein, 9 aa, Homo Sapiens
YNNQEPLRE

SEQ ID NO: 1336228 - protein, 9 aa, Homo Sapiens
QLPEAARLT

SEQ ID NO: 1336229 - protein, 9 aa, Homo Sapiens
YPEGDDNWA

SEQ ID NO: 1336230 - protein, 9 aa, Homo Sapiens
GVQCENVGV

SEQ ID NO: 1336231 - protein, 9 aa, Homo Sapiens
DFPYLGTFP

SEQ ID NO: 1336232 - protein, 9 aa, Homo Sapiens
CRILSQSTD

SEQ ID NO: 1336233 - protein, 9 aa, Homo Sapiens
PKIGVIKTA

SEQ ID NO: 1336234 - protein, 9 aa, Homo Sapiens
VFLSRTSPV

SEQ ID NO: 1336235 - protein, 9 aa, Homo Sapiens
CIIFEYYVR

SEQ ID NO: 1336236 - protein, 9 aa, Homo Sapiens
SGPSSACNV

SEQ ID NO: 1336237 - protein, 9 aa, Homo Sapiens
EGVMDIYNC

SEQ ID NO: 1336238 - protein, 9 aa, Homo Sapiens
ILEEEQQIR

SEQ ID NO: 1336239 - protein, 9 aa, Homo Sapiens
CAVRVTVDV

SEQ ID NO: 1336240 - protein, 9 aa, Homo Sapiens
KVFGNFNLL

SEQ ID NO: 1336241 - protein, 9 aa, Homo Sapiens
QDSKEANTN

SEQ ID NO: 1336242 - protein, 9 aa, Homo Sapiens
VTPEAIKSV

SEQ ID NO: 1336243 - protein, 9 aa, Homo Sapiens
EERMWADVS

SEQ ID NO: 1336244 - protein, 9 aa, Homo Sapiens
AEEADLNHK

SEQ ID NO: 1336245 - protein, 9 aa, Homo Sapiens
LLMNLPEDK

SEQ ID NO: 1336246 - protein, 9 aa, Homo Sapiens
HPPGSPQIP

SEQ ID NO: 1336247 - protein, 9 aa, Homo Sapiens
APWPPPAGA

SEQ ID NO: 1336248 - protein, 9 aa, Homo Sapiens
RWKSHRRSV

SEQ ID NO: 1336249 - protein, 9 aa, Homo Sapiens
VLVTVGGHP

SEQ ID NO: 1336250 - protein, 9 aa, Homo Sapiens
FIKKTFDAE

SEQ ID NO: 1336251 - protein, 9 aa, Homo Sapiens
ASSGAEGDM

SEQ ID NO: 1336252 - protein, 9 aa, Homo Sapiens
DQEIQEIHD

SEQ ID NO: 1336253 - protein, 9 aa, Homo Sapiens
PNIPYKRVF

SEQ ID NO: 1336254 - protein, 9 aa, Homo Sapiens
HFLQRASKI

SEQ ID NO: 1336255 - protein, 9 aa, Homo Sapiens
TSSSSCKKQ

SEQ ID NO: 1336256 - protein, 9 aa, Homo Sapiens
FKYFEVQSV

SEQ ID NO: 1336257 - protein, 9 aa, Homo Sapiens
KLYINCIAC

SEQ ID NO: 1336258 - protein, 9 aa, Homo Sapiens
IICFIFISM

SEQ ID NO: 1336259 - protein, 9 aa, Homo Sapiens
TIAEVRSSL

SEQ ID NO: 1336260 - protein, 9 aa, Homo Sapiens
SLQSAAYNL

SEQ ID NO: 1336261 - protein, 9 aa, Homo Sapiens
KMRRRVIAQ

SEQ ID NO: 1336262 - protein, 9 aa, Homo Sapiens
SLTSQQSVA

SEQ ID NO: 1336263 - protein, 9 aa, Homo Sapiens
LSNTPAHKI

SEQ ID NO: 1336264 - protein, 9 aa, Homo Sapiens
RQHVQPPKP

SEQ ID NO: 1336265 - protein, 9 aa, Homo Sapiens
KKNDKEEVT

SEQ ID NO: 1336266 - protein, 9 aa, Homo Sapiens
VNFLINPLL

SEQ ID NO: 1336267 - protein, 9 aa, Homo Sapiens
IFFLLLCVV

SEQ ID NO: 1336268 - protein, 9 aa, Homo Sapiens
VSIAVAPFD

SEQ ID NO: 1336269 - protein, 9 aa, Homo Sapiens
NQSIKVPVN

SEQ ID NO: 1336270 - protein, 9 aa, Homo Sapiens
FRIAKQILQ

SEQ ID NO: 1336271 - protein, 9 aa, Homo Sapiens
NNSKLPNDI

SEQ ID NO: 1336272 - protein, 9 aa, Homo Sapiens
YSMHMVGKW

SEQ ID NO: 1336273 - protein, 9 aa, Homo Sapiens
FSLVKTPQC

SEQ ID NO: 1336274 - protein, 9 aa, Homo Sapiens
APENTGTQQ

SEQ ID NO: 1336275 - protein, 9 aa, Homo Sapiens
MHYSIGKQK

SEQ ID NO: 1336276 - protein, 9 aa, Homo Sapiens
KSWTDVVKL

SEQ ID NO: 1336277 - protein, 9 aa, Homo Sapiens
EAETWEGTG

SEQ ID NO: 1336278 - protein, 9 aa, Homo Sapiens
AFAIITTLL

SEQ ID NO: 1336279 - protein, 9 aa, Homo Sapiens
GSTKIWSKS

SEQ ID NO: 1336280 - protein, 9 aa, Homo Sapiens
FLTLAALSI

SEQ ID NO: 1336281 - protein, 9 aa, Homo Sapiens
CFVREDRVL

SEQ ID NO: 1336282 - protein, 9 aa, Homo Sapiens
HMLTDLSTI

SEQ ID NO: 1336283 - protein, 9 aa, Homo Sapiens
GPGRRLCTG

SEQ ID NO: 1336284 - protein, 9 aa, Homo Sapiens
MNMCVPHPR

SEQ ID NO: 1336285 - protein, 9 aa, Homo Sapiens
HLWVLHLKR

SEQ ID NO: 1336286 - protein, 9 aa, Homo Sapiens
IMEDTMHFR

SEQ ID NO: 1336287 - protein, 9 aa, Homo Sapiens
EPPVQPNGL

SEQ ID NO: 1336288 - protein, 9 aa, Homo Sapiens
KLLNQEEGK

SEQ ID NO: 1336289 - protein, 9 aa, Homo Sapiens
TGPDPGSLA

SEQ ID NO: 1336290 - protein, 9 aa, Homo Sapiens
INYGKKCWT

SEQ ID NO: 1336291 - protein, 9 aa, Homo Sapiens
SELRQHKFY

SEQ ID NO: 1336292 - protein, 9 aa, Homo Sapiens
SCGDGTVTE

SEQ ID NO: 1336293 - protein, 9 aa, Homo Sapiens
LYLWGPLKK

SEQ ID NO: 1336294 - protein, 9 aa, Homo Sapiens
KPDIGDHQA

SEQ ID NO: 1336295 - protein, 9 aa, Homo Sapiens
PYCTSKAYN

SEQ ID NO: 1336296 - protein, 9 aa, Homo Sapiens
QSKDDKSPL

SEQ ID NO: 1336297 - protein, 9 aa, Homo Sapiens
LCDFTYRDV

SEQ ID NO: 1336298 - protein, 9 aa, Homo Sapiens
QIFGQASMI

SEQ ID NO: 1336299 - protein, 9 aa, Homo Sapiens
VTHMGIYVG

SEQ ID NO: 1336300 - protein, 9 aa, Homo Sapiens
RRFDFTGNL

SEQ ID NO: 1336301 - protein, 9 aa, Homo Sapiens
CIEDISGKS

SEQ ID NO: 1336302 - protein, 9 aa, Homo Sapiens
AEGTSFRLE

SEQ ID NO: 1336303 - protein, 9 aa, Homo Sapiens
CTSQSLYTG

SEQ ID NO: 1336304 - protein, 9 aa, Homo Sapiens
NGSITQVVS

SEQ ID NO: 1336305 - protein, 9 aa, Homo Sapiens
VNASRDIII

SEQ ID NO: 1336306 - protein, 9 aa, Homo Sapiens
QNVNVSAMY

SEQ ID NO: 1336307 - protein, 9 aa, Homo Sapiens
IWIFFFFLF

SEQ ID NO: 1336308 - protein, 9 aa, Homo Sapiens
RPDDRFCGT

SEQ ID NO: 1336309 - protein, 9 aa, Homo Sapiens
GGLTDRLGR

SEQ ID NO: 1336310 - protein, 9 aa, Homo Sapiens
TLAAYPQTS

SEQ ID NO: 1336311 - protein, 9 aa, Homo Sapiens
ARKAATKTR

SEQ ID NO: 1336312 - protein, 9 aa, Homo Sapiens
APDNEAGRE

SEQ ID NO: 1336313 - protein, 9 aa, Homo Sapiens
GLGTSQHRR

SEQ ID NO: 1336314 - protein, 9 aa, Homo Sapiens
TTGKIFEKI

SEQ ID NO: 1336315 - protein, 9 aa, Homo Sapiens
CQSSVTVVS

SEQ ID NO: 1336316 - protein, 9 aa, Homo Sapiens
TCTGAASTP

SEQ ID NO: 1336317 - protein, 9 aa, Homo Sapiens
AVCVHQCLR

SEQ ID NO: 1336318 - protein, 9 aa, Homo Sapiens
MSNSNDCMM

SEQ ID NO: 1336319 - protein, 9 aa, Homo Sapiens
DLAVFVEEL

SEQ ID NO: 1336320 - protein, 9 aa, Homo Sapiens
SVIYLQFVP

SEQ ID NO: 1336321 - protein, 9 aa, Homo Sapiens
CLLRFILFF

SEQ ID NO: 1336322 - protein, 9 aa, Homo Sapiens
AHLTPLFDN

SEQ ID NO: 1336323 - protein, 9 aa, Homo Sapiens
PHDPGASVQ

SEQ ID NO: 1336324 - protein, 9 aa, Homo Sapiens
KKIYYRSAL

SEQ ID NO: 1336325 - protein, 9 aa, Homo Sapiens
AMQRCCDHM

SEQ ID NO: 1336326 - protein, 9 aa, Homo Sapiens
FKHPVNVPR

SEQ ID NO: 1336327 - protein, 9 aa, Homo Sapiens
SPEGDNPKE

SEQ ID NO: 1336328 - protein, 9 aa, Homo Sapiens
KDTSSSTIV

SEQ ID NO: 1336329 - protein, 9 aa, Homo Sapiens
QTLEGKAGH

SEQ ID NO: 1336330 - protein, 9 aa, Homo Sapiens
PNLVGIHGG

SEQ ID NO: 1336331 - protein, 9 aa, Homo Sapiens
DDISRHETM

SEQ ID NO: 1336332 - protein, 9 aa, Homo Sapiens
SVQAVTVTV

SEQ ID NO: 1336333 - protein, 9 aa, Homo Sapiens
AIKGVFYRR

SEQ ID NO: 1336334 - protein, 9 aa, Homo Sapiens
FVYLYKLKE

SEQ ID NO: 1336335 - protein, 9 aa, Homo Sapiens
NPRESHPST

SEQ ID NO: 1336336 - protein, 9 aa, Homo Sapiens
TMAGARAKG

SEQ ID NO: 1336337 - protein, 9 aa, Homo Sapiens
VNATIPAYH

SEQ ID NO: 1336338 - protein, 9 aa, Homo Sapiens
MEMLTGCGA

SEQ ID NO: 1336339 - protein, 9 aa, Homo Sapiens
IFTTRVHVF

SEQ ID NO: 1336340 - protein, 9 aa, Homo Sapiens
NETAALFLA

SEQ ID NO: 1336341 - protein, 9 aa, Homo Sapiens
ISKVCSSVA

SEQ ID NO: 1336342 - protein, 9 aa, Homo Sapiens
HDLQVFDLE

SEQ ID NO: 1336343 - protein, 9 aa, Homo Sapiens
LLMRLPHMF

SEQ ID NO: 1336344 - protein, 9 aa, Homo Sapiens
LKECLNRIL

SEQ ID NO: 1336345 - protein, 9 aa, Homo Sapiens
RDQPNERHV

SEQ ID NO: 1336346 - protein, 9 aa, Homo Sapiens
MVMNMFYAY

SEQ ID NO: 1336347 - protein, 9 aa, Homo Sapiens
GWWQKFWLR

SEQ ID NO: 1336348 - protein, 9 aa, Homo Sapiens
DCLEGRPDG

SEQ ID NO: 1336349 - protein, 9 aa, Homo Sapiens
GPRLGRDTE

SEQ ID NO: 1336350 - protein, 9 aa, Homo Sapiens
TQQVFYNDP

SEQ ID NO: 1336351 - protein, 9 aa, Homo Sapiens
IMGSAGGLS

SEQ ID NO: 1336352 - protein, 9 aa, Homo Sapiens
CVLDMEGKD

SEQ ID NO: 1336353 - protein, 9 aa, Homo Sapiens
GKDGLLDTS

SEQ ID NO: 1336354 - protein, 9 aa, Homo Sapiens
KSSVSHKNA

SEQ ID NO: 1336355 - protein, 9 aa, Homo Sapiens
TSESYPLRQ

SEQ ID NO: 1336356 - protein, 9 aa, Homo Sapiens
PMWGGPMRG

SEQ ID NO: 1336357 - protein, 9 aa, Homo Sapiens
EERDIMTFA

SEQ ID NO: 1336358 - protein, 9 aa, Homo Sapiens
GGSVPIFDE

SEQ ID NO: 1336359 - protein, 9 aa, Homo Sapiens
PTTEVPMSS

SEQ ID NO: 1336360 - protein, 9 aa, Homo Sapiens
GYRVTQITC

SEQ ID NO: 1336361 - protein, 9 aa, Homo Sapiens
HFEGEKVFC

SEQ ID NO: 1336362 - protein, 9 aa, Homo Sapiens
KFLLDNVRI

SEQ ID NO: 1336363 - protein, 9 aa, Homo Sapiens
RHFGTMSSM

SEQ ID NO: 1336364 - protein, 9 aa, Homo Sapiens
RYHHIMTVR

SEQ ID NO: 1336365 - protein, 9 aa, Homo Sapiens
AIPKHLCLV

SEQ ID NO: 1336366 - protein, 9 aa, Homo Sapiens
LSEPGNSSD

SEQ ID NO: 1336367 - protein, 9 aa, Homo Sapiens
ASWVTNDTF

SEQ ID NO: 1336368 - protein, 9 aa, Homo Sapiens
DISSVNSLV

SEQ ID NO: 1336369 - protein, 9 aa, Homo Sapiens
DISVKIKIP

SEQ ID NO: 1336370 - protein, 9 aa, Homo Sapiens
ARGLMNGYW

SEQ ID NO: 1336371 - protein, 9 aa, Homo Sapiens
DMSPTFTWN

SEQ ID NO: 1336372 - protein, 9 aa, Homo Sapiens
ESGKADETT

SEQ ID NO: 1336373 - protein, 9 aa, Homo Sapiens
LRHTSLWPL

SEQ ID NO: 1336374 - protein, 9 aa, Homo Sapiens
VYCLSVFAT

SEQ ID NO: 1336375 - protein, 9 aa, Homo Sapiens
TAITIFHDT

SEQ ID NO: 1336376 - protein, 9 aa, Homo Sapiens
TEIKFLKLV

SEQ ID NO: 1336377 - protein, 9 aa, Homo Sapiens
DRLIFLHSA

SEQ ID NO: 1336378 - protein, 9 aa, Homo Sapiens
DKYTNLVTV

SEQ ID NO: 1336379 - protein, 9 aa, Homo Sapiens
LDADSYDPG

SEQ ID NO: 1336380 - protein, 9 aa, Homo Sapiens
KQLPQDLGS

SEQ ID NO: 1336381 - protein, 9 aa, Homo Sapiens
SYAEYLAHH

SEQ ID NO: 1336382 - protein, 9 aa, Homo Sapiens
QNKMRAILC

SEQ ID NO: 1336383 - protein, 9 aa, Homo Sapiens
RESHPSTLL

SEQ ID NO: 1336384 - protein, 9 aa, Homo Sapiens
THKDHALKW

SEQ ID NO: 1336385 - protein, 9 aa, Homo Sapiens
ELEWLTSLY

SEQ ID NO: 1336386 - protein, 9 aa, Homo Sapiens
RFDFTGNLI

SEQ ID NO: 1336387 - protein, 9 aa, Homo Sapiens
PVEEKDKSP

SEQ ID NO: 1336388 - protein, 9 aa, Homo Sapiens
MLPTSGIPS

SEQ ID NO: 1336389 - protein, 9 aa, Homo Sapiens
CIEVEAVRF

SEQ ID NO: 1336390 - protein, 9 aa, Homo Sapiens
NARVQAPRV

SEQ ID NO: 1336391 - protein, 9 aa, Homo Sapiens
QLLDPAQKY

SEQ ID NO: 1336392 - protein, 9 aa, Homo Sapiens
LCLRLPNLK

SEQ ID NO: 1336393 - protein, 9 aa, Homo Sapiens
CFRTHEMPH

SEQ ID NO: 1336394 - protein, 9 aa, Homo Sapiens
KCEHLLLYL

SEQ ID NO: 1336395 - protein, 9 aa, Homo Sapiens
PLPPGWEKC

SEQ ID NO: 1336396 - protein, 9 aa, Homo Sapiens
EHCYVIYRL

SEQ ID NO: 1336397 - protein, 9 aa, Homo Sapiens
TLDGHFLLP

SEQ ID NO: 1336398 - protein, 9 aa, Homo Sapiens
IHAKCVTIM

SEQ ID NO: 1336399 - protein, 9 aa, Homo Sapiens
NPSPSKKFR

SEQ ID NO: 1336400 - protein, 9 aa, Homo Sapiens
EQKINTMIL

SEQ ID NO: 1336401 - protein, 9 aa, Homo Sapiens
DRHAFIITL

SEQ ID NO: 1336402 - protein, 9 aa, Homo Sapiens
WTGSLPPTR

SEQ ID NO: 1336403 - protein, 9 aa, Homo Sapiens
PTAQTQIDL

SEQ ID NO: 1336404 - protein, 9 aa, Homo Sapiens
ITVPIDHGV

SEQ ID NO: 1336405 - protein, 9 aa, Homo Sapiens
GKYQDVETL

SEQ ID NO: 1336406 - protein, 9 aa, Homo Sapiens
GPQPMVPRE

SEQ ID NO: 1336407 - protein, 9 aa, Homo Sapiens
EALLKVQLA

SEQ ID NO: 1336408 - protein, 9 aa, Homo Sapiens
HECDTCGEA

SEQ ID NO: 1336409 - protein, 9 aa, Homo Sapiens
LYHEGHVKE

SEQ ID NO: 1336410 - protein, 9 aa, Homo Sapiens
HGWLQETHK

SEQ ID NO: 1336411 - protein, 9 aa, Homo Sapiens
FALAFLQHM

SEQ ID NO: 1336412 - protein, 9 aa, Homo Sapiens
ATVTEEDVK

SEQ ID NO: 1336413 - protein, 9 aa, Homo Sapiens
VVLKNNVLS

SEQ ID NO: 1336414 - protein, 9 aa, Homo Sapiens
LLSCKHSPS

SEQ ID NO: 1336415 - protein, 9 aa, Homo Sapiens
HICCLNCRS

SEQ ID NO: 1336416 - protein, 9 aa, Homo Sapiens
QRQKKIFFK

SEQ ID NO: 1336417 - protein, 9 aa, Homo Sapiens
TVILHQGCL

SEQ ID NO: 1336418 - protein, 9 aa, Homo Sapiens
IPVLGPDPR

SEQ ID NO: 1336419 - protein, 9 aa, Homo Sapiens
TTCLAACWV

SEQ ID NO: 1336420 - protein, 9 aa, Homo Sapiens
HTWHNTCFI

SEQ ID NO: 1336421 - protein, 9 aa, Homo Sapiens
KVDVWSVGF

SEQ ID NO: 1336422 - protein, 9 aa, Homo Sapiens
PDTCFMAYT

SEQ ID NO: 1336423 - protein, 9 aa, Homo Sapiens
AASAAEPSA

SEQ ID NO: 1336424 - protein, 9 aa, Homo Sapiens
IKYYLDNGA

SEQ ID NO: 1336425 - protein, 9 aa, Homo Sapiens
RVLQAQRGA

SEQ ID NO: 1336426 - protein, 9 aa, Homo Sapiens
KENHTCSGW

SEQ ID NO: 1336427 - protein, 9 aa, Homo Sapiens
AACDTTYNE

SEQ ID NO: 1336428 - protein, 9 aa, Homo Sapiens
SLYMSPELV

SEQ ID NO: 1336429 - protein, 9 aa, Homo Sapiens
QVIILNSSA

SEQ ID NO: 1336430 - protein, 9 aa, Homo Sapiens
YKSHVYIVW

SEQ ID NO: 1336431 - protein, 9 aa, Homo Sapiens
EEGIDEVII

SEQ ID NO: 1336432 - protein, 9 aa, Homo Sapiens
FFASMWSEL

SEQ ID NO: 1336433 - protein, 9 aa, Homo Sapiens
KHLKYVEQR

SEQ ID NO: 1336434 - protein, 9 aa, Homo Sapiens
RLDTVRQET

SEQ ID NO: 1336435 - protein, 9 aa, Homo Sapiens
SLGLARMFS

SEQ ID NO: 1336436 - protein, 9 aa, Homo Sapiens
PRCQPKKPA

SEQ ID NO: 1336437 - protein, 9 aa, Homo Sapiens
RFLEENLDP

SEQ ID NO: 1336438 - protein, 9 aa, Homo Sapiens
AAPSPGSVP

SEQ ID NO: 1336439 - protein, 9 aa, Homo Sapiens
VMNMFYAYV

SEQ ID NO: 1336440 - protein, 9 aa, Homo Sapiens
GGQDLTIDG

SEQ ID NO: 1336441 - protein, 9 aa, Homo Sapiens
QEKEKKFFV

SEQ ID NO: 1336442 - protein, 9 aa, Homo Sapiens
IQGLPDLPR

SEQ ID NO: 1336443 - protein, 9 aa, Homo Sapiens
AGFTHVLNV

SEQ ID NO: 1336444 - protein, 9 aa, Homo Sapiens
AAPALDTTI

SEQ ID NO: 1336445 - protein, 9 aa, Homo Sapiens
SKKKSIRAR

SEQ ID NO: 1336446 - protein, 9 aa, Homo Sapiens
LSVMTYDRY

SEQ ID NO: 1336447 - protein, 9 aa, Homo Sapiens
GEADQSAGH

SEQ ID NO: 1336448 - protein, 9 aa, Homo Sapiens
DTETAQMLT

SEQ ID NO: 1336449 - protein, 9 aa, Homo Sapiens
PPPFPAHVV

SEQ ID NO: 1336450 - protein, 9 aa, Homo Sapiens
KVITEKPPG

SEQ ID NO: 1336451 - protein, 9 aa, Homo Sapiens
MEAIRLIHH

SEQ ID NO: 1336452 - protein, 9 aa, Homo Sapiens
KATMNVKQA

SEQ ID NO: 1336453 - protein, 9 aa, Homo Sapiens
TEEEALRMD

SEQ ID NO: 1336454 - protein, 9 aa, Homo Sapiens
FGHPLSFQQ

SEQ ID NO: 1336455 - protein, 9 aa, Homo Sapiens
MQRLGTKLG

SEQ ID NO: 1336456 - protein, 9 aa, Homo Sapiens
FQKRQCRVQ

SEQ ID NO: 1336457 - protein, 9 aa, Homo Sapiens
LDTFAMEGL

SEQ ID NO: 1336458 - protein, 9 aa, Homo Sapiens
SRHSGRKLM

SEQ ID NO: 1336459 - protein, 9 aa, Homo Sapiens
NWVVNTCLH

SEQ ID NO: 1336460 - protein, 9 aa, Homo Sapiens
AKQQKCPFA

SEQ ID NO: 1336461 - protein, 9 aa, Homo Sapiens
LVFSLKKFV

SEQ ID NO: 1336462 - protein, 9 aa, Homo Sapiens
TFVPHWTPP

SEQ ID NO: 1336463 - protein, 9 aa, Homo Sapiens
WWEENCVPR

SEQ ID NO: 1336464 - protein, 9 aa, Homo Sapiens
PYLALPLNH

SEQ ID NO: 1336465 - protein, 9 aa, Homo Sapiens
YEMYFVSYD

SEQ ID NO: 1336466 - protein, 9 aa, Homo Sapiens
CVHQCLRLL

SEQ ID NO: 1336467 - protein, 9 aa, Homo Sapiens
CTSPPSCRA

SEQ ID NO: 1336468 - protein, 9 aa, Homo Sapiens
FPAVFVRPY

SEQ ID NO: 1336469 - protein, 9 aa, Homo Sapiens
QGEAVHMTH

SEQ ID NO: 1336470 - protein, 9 aa, Homo Sapiens
LKLGLTITA

SEQ ID NO: 1336471 - protein, 9 aa, Homo Sapiens
GEIPKDEHI

SEQ ID NO: 1336472 - protein, 9 aa, Homo Sapiens
QREHLLGIC

SEQ ID NO: 1336473 - protein, 9 aa, Homo Sapiens
SLPPQDSCW

SEQ ID NO: 1336474 - protein, 9 aa, Homo Sapiens
SAGEENEKE

SEQ ID NO: 1336475 - protein, 9 aa, Homo Sapiens
CICTYTCPC

SEQ ID NO: 1336476 - protein, 9 aa, Homo Sapiens
PELSQKSPL

SEQ ID NO: 1336477 - protein, 9 aa, Homo Sapiens
EGSPSSDQQ

SEQ ID NO: 1336478 - protein, 9 aa, Homo Sapiens
RGFTFVTFE

SEQ ID NO: 1336479 - protein, 9 aa, Homo Sapiens
QPKRCPILS

SEQ ID NO: 1336480 - protein, 9 aa, Homo Sapiens
RLETIRNPK

SEQ ID NO: 1336481 - protein, 9 aa, Homo Sapiens
STNTCSAHT

SEQ ID NO: 1336482 - protein, 9 aa, Homo Sapiens
TLLSEHTTI

SEQ ID NO: 1336483 - protein, 9 aa, Homo Sapiens
AFSAAQHHS

SEQ ID NO: 1336484 - protein, 9 aa, Homo Sapiens
DVKNDFVFL

SEQ ID NO: 1336485 - protein, 9 aa, Homo Sapiens
YIEAIYSLN

SEQ ID NO: 1336486 - protein, 9 aa, Homo Sapiens
EANATSTVV

SEQ ID NO: 1336487 - protein, 9 aa, Homo Sapiens
SQLWEFCLQ

SEQ ID NO: 1336488 - protein, 9 aa, Homo Sapiens
MTSSLPWLC

SEQ ID NO: 1336489 - protein, 9 aa, Homo Sapiens
NVAQEEYSR

SEQ ID NO: 1336490 - protein, 9 aa, Homo Sapiens
CGASATTGR

SEQ ID NO: 1336491 - protein, 9 aa, Homo Sapiens
NLQDVIGAV

SEQ ID NO: 1336492 - protein, 9 aa, Homo Sapiens
HCRRFCWSC

SEQ ID NO: 1336493 - protein, 9 aa, Homo Sapiens
YVDNNCSWF

SEQ ID NO: 1336494 - protein, 9 aa, Homo Sapiens
RQQAFLRSV

SEQ ID NO: 1336495 - protein, 9 aa, Homo Sapiens
AHTGEKTYK

SEQ ID NO: 1336496 - protein, 9 aa, Homo Sapiens
EANTNGSSP

SEQ ID NO: 1336497 - protein, 9 aa, Homo Sapiens
GDIDNQPLV

SEQ ID NO: 1336498 - protein, 9 aa, Homo Sapiens
TRTRLASRS

SEQ ID NO: 1336499 - protein, 9 aa, Homo Sapiens
ISCLEDTGH

SEQ ID NO: 1336500 - protein, 9 aa, Homo Sapiens
VLTSLLETF

SEQ ID NO: 1336501 - protein, 9 aa, Homo Sapiens
RYQLLLKME

SEQ ID NO: 1336502 - protein, 9 aa, Homo Sapiens
TKSGGKCVF

SEQ ID NO: 1336503 - protein, 9 aa, Homo Sapiens
VNLIRHKLK

SEQ ID NO: 1336504 - protein, 9 aa, Homo Sapiens
QKDSQPYMR

SEQ ID NO: 1336505 - protein, 9 aa, Homo Sapiens
LTCSATGGI

SEQ ID NO: 1336506 - protein, 9 aa, Homo Sapiens
QPPPGPLSQ

SEQ ID NO: 1336507 - protein, 9 aa, Homo Sapiens
LFTDVSHGH

SEQ ID NO: 1336508 - protein, 9 aa, Homo Sapiens
NRRASQMIL

SEQ ID NO: 1336509 - protein, 9 aa, Homo Sapiens
GVFYRRAQR

SEQ ID NO: 1336510 - protein, 9 aa, Homo Sapiens
DITMGFKTL

SEQ ID NO: 1336511 - protein, 9 aa, Homo Sapiens
MDLLLHLLT

SEQ ID NO: 1336512 - protein, 9 aa, Homo Sapiens
HVLDELVRP

SEQ ID NO: 1336513 - protein, 9 aa, Homo Sapiens
LFTGLLQRY

SEQ ID NO: 1336514 - protein, 9 aa, Homo Sapiens
EMKSVNRFG

SEQ ID NO: 1336515 - protein, 9 aa, Homo Sapiens
KHFSFSPTG

SEQ ID NO: 1336516 - protein, 9 aa, Homo Sapiens
EGYATYYCE

SEQ ID NO: 1336517 - protein, 9 aa, Homo Sapiens
RVCGRCCAE

SEQ ID NO: 1336518 - protein, 9 aa, Homo Sapiens
SSDSSTSSS

SEQ ID NO: 1336519 - protein, 9 aa, Homo Sapiens
LKELHSMLM

SEQ ID NO: 1336520 - protein, 9 aa, Homo Sapiens
FGNTDGAAC

SEQ ID NO: 1336521 - protein, 9 aa, Homo Sapiens
AHPMPVYAF

SEQ ID NO: 1336522 - protein, 9 aa, Homo Sapiens
SRHLVSLIF

SEQ ID NO: 1336523 - protein, 9 aa, Homo Sapiens
MCKKFEGNI

SEQ ID NO: 1336524 - protein, 9 aa, Homo Sapiens
DPHHDLDRV

SEQ ID NO: 1336525 - protein, 9 aa, Homo Sapiens
SVFIPKKLN

SEQ ID NO: 1336526 - protein, 9 aa, Homo Sapiens
QRARKECEK

SEQ ID NO: 1336527 - protein, 9 aa, Homo Sapiens
DDILIPEES

SEQ ID NO: 1336528 - protein, 9 aa, Homo Sapiens
LGHTWHNTC

SEQ ID NO: 1336529 - protein, 9 aa, Homo Sapiens
KKEKKNDKE

SEQ ID NO: 1336530 - protein, 9 aa, Homo Sapiens
CYKSHIQVR

SEQ ID NO: 1336531 - protein, 9 aa, Homo Sapiens
SLHNSKEER

SEQ ID NO: 1336532 - protein, 9 aa, Homo Sapiens
DLKGKSKWE

SEQ ID NO: 1336533 - protein, 9 aa, Homo Sapiens
KDPLTKDER

SEQ ID NO: 1336534 - protein, 9 aa, Homo Sapiens
YACNVIEEF

SEQ ID NO: 1336535 - protein, 9 aa, Homo Sapiens
PNAPGWALT

SEQ ID NO: 1336536 - protein, 9 aa, Homo Sapiens
QDSTQDTTS

SEQ ID NO: 1336537 - protein, 9 aa, Homo Sapiens
EYLAHHQHH

SEQ ID NO: 1336538 - protein, 9 aa, Homo Sapiens
NLCSQMSTV

SEQ ID NO: 1336539 - protein, 9 aa, Homo Sapiens
TLQVMILQL

SEQ ID NO: 1336540 - protein, 9 aa, Homo Sapiens
EAKSLNACV

SEQ ID NO: 1336541 - protein, 9 aa, Homo Sapiens
MYFVSYDIR

SEQ ID NO: 1336542 - protein, 9 aa, Homo Sapiens
RPDTCFMAY

SEQ ID NO: 1336543 - protein, 9 aa, Homo Sapiens
RFAWDTSNH

SEQ ID NO: 1336544 - protein, 9 aa, Homo Sapiens
IPMLSREGR

SEQ ID NO: 1336545 - protein, 9 aa, Homo Sapiens
ARAFLRAHA

SEQ ID NO: 1336546 - protein, 9 aa, Homo Sapiens
CCIITSTYG

SEQ ID NO: 1336547 - protein, 9 aa, Homo Sapiens
GLVVGDQVI

SEQ ID NO: 1336548 - protein, 9 aa, Homo Sapiens
SEGPRPAHM

SEQ ID NO: 1336549 - protein, 9 aa, Homo Sapiens
TNRSLEESP

SEQ ID NO: 1336550 - protein, 9 aa, Homo Sapiens
TLPLRSAVD

SEQ ID NO: 1336551 - protein, 9 aa, Homo Sapiens
LLERVNMCH

SEQ ID NO: 1336552 - protein, 9 aa, Homo Sapiens
KAFICGFQL

SEQ ID NO: 1336553 - protein, 9 aa, Homo Sapiens
SNESTDTTS

SEQ ID NO: 1336554 - protein, 9 aa, Homo Sapiens
YLDFSIIIT

SEQ ID NO: 1336555 - protein, 9 aa, Homo Sapiens
GSPSLVKTC

SEQ ID NO: 1336556 - protein, 9 aa, Homo Sapiens
CITFFIFVL

SEQ ID NO: 1336557 - protein, 9 aa, Homo Sapiens
ERDELYVQW

SEQ ID NO: 1336558 - protein, 9 aa, Homo Sapiens
QLEGKHSVL

SEQ ID NO: 1336559 - protein, 9 aa, Homo Sapiens
NSFEYGPLL

SEQ ID NO: 1336560 - protein, 9 aa, Homo Sapiens
QLQTPHAEK

SEQ ID NO: 1336561 - protein, 9 aa, Homo Sapiens
RPHLTGQLF

SEQ ID NO: 1336562 - protein, 9 aa, Homo Sapiens
GEMSVQEED

SEQ ID NO: 1336563 - protein, 9 aa, Homo Sapiens
TTTLLPPLR

SEQ ID NO: 1336564 - protein, 9 aa, Homo Sapiens
QCHHGETCH

SEQ ID NO: 1336565 - protein, 9 aa, Homo Sapiens
RLASRSQGA

SEQ ID NO: 1336566 - protein, 9 aa, Homo Sapiens
SSVRLKLTI

SEQ ID NO: 1336567 - protein, 9 aa, Homo Sapiens
TPCYDNVPQ

SEQ ID NO: 1336568 - protein, 9 aa, Homo Sapiens
VPVRPGPHQ

SEQ ID NO: 1336569 - protein, 9 aa, Homo Sapiens
IWALKMLLT

SEQ ID NO: 1336570 - protein, 9 aa, Homo Sapiens
AEGHISLRL

SEQ ID NO: 1336571 - protein, 9 aa, Homo Sapiens
DVHIKGRLI

SEQ ID NO: 1336572 - protein, 9 aa, Homo Sapiens
GVRKWSVTC

SEQ ID NO: 1336573 - protein, 9 aa, Homo Sapiens
VVEANTKYP

SEQ ID NO: 1336574 - protein, 9 aa, Homo Sapiens
KVMQCWCCK

SEQ ID NO: 1336575 - protein, 9 aa, Homo Sapiens
KYIFKITVS

SEQ ID NO: 1336576 - protein, 9 aa, Homo Sapiens
KKIHILHKR

SEQ ID NO: 1336577 - protein, 9 aa, Homo Sapiens
WLSPPLGLH

SEQ ID NO: 1336578 - protein, 9 aa, Homo Sapiens
QRPGRAGRV

SEQ ID NO: 1336579 - protein, 9 aa, Homo Sapiens
LHKQWDRAL

SEQ ID NO: 1336580 - protein, 9 aa, Homo Sapiens
APSRQGLAE

SEQ ID NO: 1336581 - protein, 9 aa, Homo Sapiens
FCGHNESKA

SEQ ID NO: 1336582 - protein, 9 aa, Homo Sapiens
MVAPSCGGD

SEQ ID NO: 1336583 - protein, 9 aa, Homo Sapiens
ERARPSEGP

SEQ ID NO: 1336584 - protein, 9 aa, Homo Sapiens
RKERRRRRH

SEQ ID NO: 1336585 - protein, 9 aa, Homo Sapiens
MLQDSDSDQ

SEQ ID NO: 1336586 - protein, 9 aa, Homo Sapiens
RHLIVHLLA

SEQ ID NO: 1336587 - protein, 9 aa, Homo Sapiens
EDAVSTFEI

SEQ ID NO: 1336588 - protein, 9 aa, Homo Sapiens
YQNTHHKSS

SEQ ID NO: 1336589 - protein, 9 aa, Homo Sapiens
MSFGRNMEL

SEQ ID NO: 1336590 - protein, 9 aa, Homo Sapiens
YGWIVADNC

SEQ ID NO: 1336591 - protein, 9 aa, Homo Sapiens
GESCTMWGL

SEQ ID NO: 1336592 - protein, 9 aa, Homo Sapiens
PRVVSREEP

SEQ ID NO: 1336593 - protein, 9 aa, Homo Sapiens
RKEGEEADT

SEQ ID NO: 1336594 - protein, 9 aa, Homo Sapiens
KQQLTGAGI

SEQ ID NO: 1336595 - protein, 9 aa, Homo Sapiens
WREEAALVA

SEQ ID NO: 1336596 - protein, 9 aa, Homo Sapiens
LTCADTWVH

SEQ ID NO: 1336597 - protein, 9 aa, Homo Sapiens
EHIKIESLL

SEQ ID NO: 1336598 - protein, 9 aa, Homo Sapiens
EPPMVPQGW

SEQ ID NO: 1336599 - protein, 9 aa, Homo Sapiens
LPLVKRRRL

SEQ ID NO: 1336600 - protein, 9 aa, Homo Sapiens
TLKEVSLTK

SEQ ID NO: 1336601 - protein, 9 aa, Homo Sapiens
ESTDTTSEI

SEQ ID NO: 1336602 - protein, 9 aa, Homo Sapiens
ATSALRSLH

SEQ ID NO: 1336603 - protein, 9 aa, Homo Sapiens
LTVHMTQPK

SEQ ID NO: 1336604 - protein, 9 aa, Homo Sapiens
KIGCRSLSR

SEQ ID NO: 1336605 - protein, 9 aa, Homo Sapiens
VTMHDTRGC

SEQ ID NO: 1336606 - protein, 9 aa, Homo Sapiens
EDLVRMYRD

SEQ ID NO: 1336607 - protein, 9 aa, Homo Sapiens
AYEYYVSCC

SEQ ID NO: 1336608 - protein, 9 aa, Homo Sapiens
KLKYKVISE

SEQ ID NO: 1336609 - protein, 9 aa, Homo Sapiens
YPAHVPPPP

SEQ ID NO: 1336610 - protein, 9 aa, Homo Sapiens
VFKKIPLNP

SEQ ID NO: 1336611 - protein, 9 aa, Homo Sapiens
AGERSKPKC

SEQ ID NO: 1336612 - protein, 9 aa, Homo Sapiens
DLKQCLGHR

SEQ ID NO: 1336613 - protein, 9 aa, Homo Sapiens
FPYLGTFPI

SEQ ID NO: 1336614 - protein, 9 aa, Homo Sapiens
PWACATCGA

SEQ ID NO: 1336615 - protein, 9 aa, Homo Sapiens
MRCDHKMEV

SEQ ID NO: 1336616 - protein, 9 aa, Homo Sapiens
FFLKQHCEP

SEQ ID NO: 1336617 - protein, 9 aa, Homo Sapiens
RLELGHRTQ

SEQ ID NO: 1336618 - protein, 9 aa, Homo Sapiens
VALIEAVTV

SEQ ID NO: 1336619 - protein, 9 aa, Homo Sapiens
YYTGGWHHH

SEQ ID NO: 1336620 - protein, 9 aa, Homo Sapiens
MSKGLPVRQ

SEQ ID NO: 1336621 - protein, 9 aa, Homo Sapiens
DVIDGMEKC

SEQ ID NO: 1336622 - protein, 9 aa, Homo Sapiens
ARHHCSNTP

SEQ ID NO: 1336623 - protein, 9 aa, Homo Sapiens
VICDSYVCP

SEQ ID NO: 1336624 - protein, 9 aa, Homo Sapiens
TSPQPKCWQ

SEQ ID NO: 1336625 - protein, 9 aa, Homo Sapiens
AEEVVTLGG

SEQ ID NO: 1336626 - protein, 9 aa, Homo Sapiens
AAEQKVTHL

SEQ ID NO: 1336627 - protein, 9 aa, Homo Sapiens
DTMSHMHKN

SEQ ID NO: 1336628 - protein, 9 aa, Homo Sapiens
CWFRRHKVR

SEQ ID NO: 1336629 - protein, 9 aa, Homo Sapiens
CILNQSIKV

SEQ ID NO: 1336630 - protein, 9 aa, Homo Sapiens
LDQWAIRAY

SEQ ID NO: 1336631 - protein, 9 aa, Homo Sapiens
VIRANIGDT

SEQ ID NO: 1336632 - protein, 9 aa, Homo Sapiens
DYQLTFSLS

SEQ ID NO: 1336633 - protein, 9 aa, Homo Sapiens
RFGQVFDSV

SEQ ID NO: 1336634 - protein, 9 aa, Homo Sapiens
KTEVSKYIM

SEQ ID NO: 1336635 - protein, 9 aa, Homo Sapiens
SRSHSLLRS

SEQ ID NO: 1336636 - protein, 9 aa, Homo Sapiens
SLIDLNHIS

SEQ ID NO: 1336637 - protein, 9 aa, Homo Sapiens
SVEAYNIHT

SEQ ID NO: 1336638 - protein, 9 aa, Homo Sapiens
LTIQYLVWL

SEQ ID NO: 1336639 - protein, 9 aa, Homo Sapiens
AKMSSLPET

SEQ ID NO: 1336640 - protein, 9 aa, Homo Sapiens
DSIAEGHIS

SEQ ID NO: 1336641 - protein, 9 aa, Homo Sapiens
VHRVRALQN

SEQ ID NO: 1336642 - protein, 9 aa, Homo Sapiens
LAASLSSRA

SEQ ID NO: 1336643 - protein, 9 aa, Homo Sapiens
LWLLITAWE

SEQ ID NO: 1336644 - protein, 9 aa, Homo Sapiens
CGQGVQFLE

SEQ ID NO: 1336645 - protein, 9 aa, Homo Sapiens
EWLLCPIRT

SEQ ID NO: 1336646 - protein, 9 aa, Homo Sapiens
EVTDLRHTL

SEQ ID NO: 1336647 - protein, 9 aa, Homo Sapiens
PKQCLSFVF

SEQ ID NO: 1336648 - protein, 9 aa, Homo Sapiens
AGTFMFYCV

SEQ ID NO: 1336649 - protein, 9 aa, Homo Sapiens
SDTSCMSQR

SEQ ID NO: 1336650 - protein, 9 aa, Homo Sapiens
EVWRVSPLP

SEQ ID NO: 1336651 - protein, 9 aa, Homo Sapiens
NSVIINCDR

SEQ ID NO: 1336652 - protein, 9 aa, Homo Sapiens
LSYVGCVIS

SEQ ID NO: 1336653 - protein, 9 aa, Homo Sapiens
TGKLKKADV

SEQ ID NO: 1336654 - protein, 9 aa, Homo Sapiens
KELHTWEEE

SEQ ID NO: 1336655 - protein, 9 aa, Homo Sapiens
AVNKVLLKV

SEQ ID NO: 1336656 - protein, 9 aa, Homo Sapiens
ADLYVLVPP

SEQ ID NO: 1336657 - protein, 9 aa, Homo Sapiens
SPEVQFIGF

SEQ ID NO: 1336658 - protein, 9 aa, Homo Sapiens
VLPGEADLA

SEQ ID NO: 1336659 - protein, 9 aa, Homo Sapiens
RLPPTPPAP

SEQ ID NO: 1336660 - protein, 9 aa, Homo Sapiens
PGPLLTPAF

SEQ ID NO: 1336661 - protein, 9 aa, Homo Sapiens
PVMSWARGR

SEQ ID NO: 1336662 - protein, 9 aa, Homo Sapiens
AATKTRATE

SEQ ID NO: 1336663 - protein, 9 aa, Homo Sapiens
ERQEVFVHR

SEQ ID NO: 1336664 - protein, 9 aa, Homo Sapiens
DMIGLSDFF

SEQ ID NO: 1336665 - protein, 9 aa, Homo Sapiens
QHLTWLTVS

SEQ ID NO: 1336666 - protein, 9 aa, Homo Sapiens
MPMLNPLIY

SEQ ID NO: 1336667 - protein, 9 aa, Homo Sapiens
TMKHRILPK

SEQ ID NO: 1336668 - protein, 9 aa, Homo Sapiens
LRAINLNLR

SEQ ID NO: 1336669 - protein, 9 aa, Homo Sapiens
YQVVRAHLQ

SEQ ID NO: 1336670 - protein, 9 aa, Homo Sapiens
PKLEPIPEC

SEQ ID NO: 1336671 - protein, 9 aa, Homo Sapiens
IRHTMNLEA

SEQ ID NO: 1336672 - protein, 9 aa, Homo Sapiens
TYWKTLVQE

SEQ ID NO: 1336673 - protein, 9 aa, Homo Sapiens
SYNTKFTIP

SEQ ID NO: 1336674 - protein, 9 aa, Homo Sapiens
MEHIWQYVY

SEQ ID NO: 1336675 - protein, 9 aa, Homo Sapiens
QVTLIMAPS

SEQ ID NO: 1336676 - protein, 9 aa, Homo Sapiens
QAMQRCCDH

SEQ ID NO: 1336677 - protein, 9 aa, Homo Sapiens
RGERRALAC

SEQ ID NO: 1336678 - protein, 9 aa, Homo Sapiens
PRPLCPHAR

SEQ ID NO: 1336679 - protein, 9 aa, Homo Sapiens
SKLCHINSL

SEQ ID NO: 1336680 - protein, 9 aa, Homo Sapiens
KTPTHREPV

SEQ ID NO: 1336681 - protein, 9 aa, Homo Sapiens
QSAALALDL

SEQ ID NO: 1336682 - protein, 9 aa, Homo Sapiens
SKNLYKISL

SEQ ID NO: 1336683 - protein, 9 aa, Homo Sapiens
DLYVLVPPV

SEQ ID NO: 1336684 - protein, 9 aa, Homo Sapiens
DDWKYVVMV

SEQ ID NO: 1336685 - protein, 9 aa, Homo Sapiens
MVVSGSSDD

SEQ ID NO: 1336686 - protein, 9 aa, Homo Sapiens
VLNLLQHGT

SEQ ID NO: 1336687 - protein, 9 aa, Homo Sapiens
LLLPETKWV

SEQ ID NO: 1336688 - protein, 9 aa, Homo Sapiens
EAIRLIHHC

SEQ ID NO: 1336689 - protein, 9 aa, Homo Sapiens
AAVTGPDPG

SEQ ID NO: 1336690 - protein, 9 aa, Homo Sapiens
SVEAENTYL

SEQ ID NO: 1336691 - protein, 9 aa, Homo Sapiens
EMKQIIKIC

SEQ ID NO: 1336692 - protein, 9 aa, Homo Sapiens
WRTEVVFSE

SEQ ID NO: 1336693 - protein, 9 aa, Homo Sapiens
TLEIESYDY

SEQ ID NO: 1336694 - protein, 9 aa, Homo Sapiens
AYLFFADIS

SEQ ID NO: 1336695 - protein, 9 aa, Homo Sapiens
EQLTRALPL

SEQ ID NO: 1336696 - protein, 9 aa, Homo Sapiens
NDKEEVTVS

SEQ ID NO: 1336697 - protein, 9 aa, Homo Sapiens
TIHQGIKHA

SEQ ID NO: 1336698 - protein, 9 aa, Homo Sapiens
TTPVSPSTS

SEQ ID NO: 1336699 - protein, 9 aa, Homo Sapiens
ENKPCIKYI

SEQ ID NO: 1336700 - protein, 9 aa, Homo Sapiens
GLPEKDTMD

SEQ ID NO: 1336701 - protein, 9 aa, Homo Sapiens
GPGAHKGQI

SEQ ID NO: 1336702 - protein, 9 aa, Homo Sapiens
NLSKPYDAA

SEQ ID NO: 1336703 - protein, 9 aa, Homo Sapiens
PLEALHLSI

SEQ ID NO: 1336704 - protein, 9 aa, Homo Sapiens
GKIKSSVSH

SEQ ID NO: 1336705 - protein, 9 aa, Homo Sapiens
NLSKSTQKK

SEQ ID NO: 1336706 - protein, 9 aa, Homo Sapiens
HKKIHRMGA

SEQ ID NO: 1336707 - protein, 9 aa, Homo Sapiens
LGPEDLRTR

SEQ ID NO: 1336708 - protein, 9 aa, Homo Sapiens
SKFGQVRKL

SEQ ID NO: 1336709 - protein, 9 aa, Homo Sapiens
YHPQIVLTS

SEQ ID NO: 1336710 - protein, 9 aa, Homo Sapiens
LNKAIKLQY

SEQ ID NO: 1336711 - protein, 9 aa, Homo Sapiens
RAFSLKSHF

SEQ ID NO: 1336712 - protein, 9 aa, Homo Sapiens
SLTPLLLHA

SEQ ID NO: 1336713 - protein, 9 aa, Homo Sapiens
VFRRGVSTW

SEQ ID NO: 1336714 - protein, 9 aa, Homo Sapiens
MRHQEELRR

SEQ ID NO: 1336715 - protein, 9 aa, Homo Sapiens
RGQEVNMCK

SEQ ID NO: 1336716 - protein, 9 aa, Homo Sapiens
LFSLPHIVY

SEQ ID NO: 1336717 - protein, 9 aa, Homo Sapiens
QCHYRFKNL

SEQ ID NO: 1336718 - protein, 9 aa, Homo Sapiens
KKKERERGL

SEQ ID NO: 1336719 - protein, 9 aa, Homo Sapiens
LSCDSAQIW

SEQ ID NO: 1336720 - protein, 9 aa, Homo Sapiens
KQEAYADSW

SEQ ID NO: 1336721 - protein, 9 aa, Homo Sapiens
ILFVLSVHY

SEQ ID NO: 1336722 - protein, 9 aa, Homo Sapiens
MEFCRLYHR

SEQ ID NO: 1336723 - protein, 9 aa, Homo Sapiens
HHHDKDGWP

SEQ ID NO: 1336724 - protein, 9 aa, Homo Sapiens
LNHIEMTWK

SEQ ID NO: 1336725 - protein, 9 aa, Homo Sapiens
FRIELDKYI

SEQ ID NO: 1336726 - protein, 9 aa, Homo Sapiens
HRVMNQQHM

SEQ ID NO: 1336727 - protein, 9 aa, Homo Sapiens
QGPHTALLA

SEQ ID NO: 1336728 - protein, 9 aa, Homo Sapiens
TDHIERYEF

SEQ ID NO: 1336729 - protein, 9 aa, Homo Sapiens
GFRDESALF

SEQ ID NO: 1336730 - protein, 9 aa, Homo Sapiens
KAFNRNSYM

SEQ ID NO: 1336731 - protein, 9 aa, Homo Sapiens
LHQHMGQYY

SEQ ID NO: 1336732 - protein, 9 aa, Homo Sapiens
QEEYSRKGF

SEQ ID NO: 1336733 - protein, 9 aa, Homo Sapiens
SRDATPLPR

SEQ ID NO: 1336734 - protein, 9 aa, Homo Sapiens
NHHKKYQYI

SEQ ID NO: 1336735 - protein, 9 aa, Homo Sapiens
LVRPQAELG

SEQ ID NO: 1336736 - protein, 9 aa, Homo Sapiens
YEGDTVTFT

SEQ ID NO: 1336737 - protein, 9 aa, Homo Sapiens
LLLLVCTSL

SEQ ID NO: 1336738 - protein, 9 aa, Homo Sapiens
IVPRDDEGW

SEQ ID NO: 1336739 - protein, 9 aa, Homo Sapiens
STVHADYSG

SEQ ID NO: 1336740 - protein, 9 aa, Homo Sapiens
AYWHSLHPG

SEQ ID NO: 1336741 - protein, 9 aa, Homo Sapiens
DHYHSFHTD

SEQ ID NO: 1336742 - protein, 9 aa, Homo Sapiens
VRMYRDDIT

SEQ ID NO: 1336743 - protein, 9 aa, Homo Sapiens
FADLVTAEK

SEQ ID NO: 1336744 - protein, 9 aa, Homo Sapiens
LSGGQKVRV

SEQ ID NO: 1336745 - protein, 9 aa, Homo Sapiens
HHVSSDLEG

SEQ ID NO: 1336746 - protein, 9 aa, Homo Sapiens
SAHISAAAA

SEQ ID NO: 1336747 - protein, 9 aa, Homo Sapiens
NTDSNFTLL

SEQ ID NO: 1336748 - protein, 9 aa, Homo Sapiens
GPLFNELHN

SEQ ID NO: 1336749 - protein, 9 aa, Homo Sapiens
GSSPIYQLE

SEQ ID NO: 1336750 - protein, 9 aa, Homo Sapiens
TAFANGRFT

SEQ ID NO: 1336751 - protein, 9 aa, Homo Sapiens
TKIIYGDPV

SEQ ID NO: 1336752 - protein, 9 aa, Homo Sapiens
AFVRVDLEY

SEQ ID NO: 1336753 - protein, 9 aa, Homo Sapiens
FGQVRKLLL

SEQ ID NO: 1336754 - protein, 9 aa, Homo Sapiens
GKAKHLCLS

SEQ ID NO: 1336755 - protein, 9 aa, Homo Sapiens
DSLRWDVAH

SEQ ID NO: 1336756 - protein, 9 aa, Homo Sapiens
NSTWKDDMN

SEQ ID NO: 1336757 - protein, 9 aa, Homo Sapiens
TKRMHTSFK

SEQ ID NO: 1336758 - protein, 9 aa, Homo Sapiens
RVHTGEKSF

SEQ ID NO: 1336759 - protein, 9 aa, Homo Sapiens
GTQQVFYND

SEQ ID NO: 1336760 - protein, 9 aa, Homo Sapiens
FTYDSDVTG

SEQ ID NO: 1336761 - protein, 9 aa, Homo Sapiens
IILNFHTTF

SEQ ID NO: 1336762 - protein, 9 aa, Homo Sapiens
PFPVPVGPF

SEQ ID NO: 1336763 - protein, 9 aa, Homo Sapiens
WLSEGFTTH

SEQ ID NO: 1336764 - protein, 9 aa, Homo Sapiens
RVRRAPLGT

SEQ ID NO: 1336765 - protein, 9 aa, Homo Sapiens
LPPTNFLDG

SEQ ID NO: 1336766 - protein, 9 aa, Homo Sapiens
PDKNGQNNS

SEQ ID NO: 1336767 - protein, 9 aa, Homo Sapiens
LDSDVRNPP

SEQ ID NO: 1336768 - protein, 9 aa, Homo Sapiens
REQDCAHAC

SEQ ID NO: 1336769 - protein, 9 aa, Homo Sapiens
SEKKLEDAW

SEQ ID NO: 1336770 - protein, 9 aa, Homo Sapiens
PTQRDCSFP

SEQ ID NO: 1336771 - protein, 9 aa, Homo Sapiens
VLWTTLTIL

SEQ ID NO: 1336772 - protein, 9 aa, Homo Sapiens
MPCTWVMTC

SEQ ID NO: 1336773 - protein, 9 aa, Homo Sapiens
IGDDDFTLQ

SEQ ID NO: 1336774 - protein, 9 aa, Homo Sapiens
GKEISESEY

SEQ ID NO: 1336775 - protein, 9 aa, Homo Sapiens
HIYLKNKMS

SEQ ID NO: 1336776 - protein, 9 aa, Homo Sapiens
YRHIFQKFL

SEQ ID NO: 1336777 - protein, 9 aa, Homo Sapiens
MHLDLAGRD

SEQ ID NO: 1336778 - protein, 9 aa, Homo Sapiens
FSVILNQCT

SEQ ID NO: 1336779 - protein, 9 aa, Homo Sapiens
GLHSALLHL

SEQ ID NO: 1336780 - protein, 9 aa, Homo Sapiens
IIVLGLVRI

SEQ ID NO: 1336781 - protein, 9 aa, Homo Sapiens
QESCWKQYL

SEQ ID NO: 1336782 - protein, 9 aa, Homo Sapiens
STASSAPSR

SEQ ID NO: 1336783 - protein, 9 aa, Homo Sapiens
ADDPEVWVL

SEQ ID NO: 1336784 - protein, 9 aa, Homo Sapiens
DKYDACDVE

SEQ ID NO: 1336785 - protein, 9 aa, Homo Sapiens
GGFQIHPTL

SEQ ID NO: 1336786 - protein, 9 aa, Homo Sapiens
TIMRDPKRL

SEQ ID NO: 1336787 - protein, 9 aa, Homo Sapiens
NILNARVQA

SEQ ID NO: 1336788 - protein, 9 aa, Homo Sapiens
DGTALTPPS

SEQ ID NO: 1336789 - protein, 9 aa, Homo Sapiens
ELFLRRLHL

SEQ ID NO: 1336790 - protein, 9 aa, Homo Sapiens
SYPMHSVQH

SEQ ID NO: 1336791 - protein, 9 aa, Homo Sapiens
RRTAPINSK

SEQ ID NO: 1336792 - protein, 9 aa, Homo Sapiens
DEPEKELDL

SEQ ID NO: 1336793 - protein, 9 aa, Homo Sapiens
LLLWKYGFF

SEQ ID NO: 1336794 - protein, 9 aa, Homo Sapiens
VDFSCYDFF

SEQ ID NO: 1336795 - protein, 9 aa, Homo Sapiens
QISKEYEHF

SEQ ID NO: 1336796 - protein, 9 aa, Homo Sapiens
IWKADPGMT

SEQ ID NO: 1336797 - protein, 9 aa, Homo Sapiens
LRAHAALFG

SEQ ID NO: 1336798 - protein, 9 aa, Homo Sapiens
RYGMLHFLL

SEQ ID NO: 1336799 - protein, 9 aa, Homo Sapiens
QNQSQNPNL

SEQ ID NO: 1336800 - protein, 9 aa, Homo Sapiens
SDLLTDTVP

SEQ ID NO: 1336801 - protein, 9 aa, Homo Sapiens
AMKEVLKGA

SEQ ID NO: 1336802 - protein, 9 aa, Homo Sapiens
SKHLEKVHV

SEQ ID NO: 1336803 - protein, 9 aa, Homo Sapiens
TNLPLEKVI

SEQ ID NO: 1336804 - protein, 9 aa, Homo Sapiens
NQHVFAWEH

SEQ ID NO: 1336805 - protein, 9 aa, Homo Sapiens
LQLLRTFMR

SEQ ID NO: 1336806 - protein, 9 aa, Homo Sapiens
QMEKYACQA

SEQ ID NO: 1336807 - protein, 9 aa, Homo Sapiens
RELWITYGQ

SEQ ID NO: 1336808 - protein, 9 aa, Homo Sapiens
FVISSIVSC

SEQ ID NO: 1336809 - protein, 9 aa, Homo Sapiens
KQQMGADSM

SEQ ID NO: 1336810 - protein, 9 aa, Homo Sapiens
PLEGNANGG

SEQ ID NO: 1336811 - protein, 9 aa, Homo Sapiens
YTECLYRMI

SEQ ID NO: 1336812 - protein, 9 aa, Homo Sapiens
VVHFFACPS

SEQ ID NO: 1336813 - protein, 9 aa, Homo Sapiens
DPTYTPREC

SEQ ID NO: 1336814 - protein, 9 aa, Homo Sapiens
QDLENIVVI

SEQ ID NO: 1336815 - protein, 9 aa, Homo Sapiens
VAPSCGGDR

SEQ ID NO: 1336816 - protein, 9 aa, Homo Sapiens
SEMKSGARL

SEQ ID NO: 1336817 - protein, 9 aa, Homo Sapiens
NIFCVKEFL

SEQ ID NO: 1336818 - protein, 9 aa, Homo Sapiens
VEEIIKKQE

SEQ ID NO: 1336819 - protein, 9 aa, Homo Sapiens
REEGSRQLG

SEQ ID NO: 1336820 - protein, 9 aa, Homo Sapiens
GIDRADENI

SEQ ID NO: 1336821 - protein, 9 aa, Homo Sapiens
LPASRCLHC

SEQ ID NO: 1336822 - protein, 9 aa, Homo Sapiens
LRLRHIDDR

SEQ ID NO: 1336823 - protein, 9 aa, Homo Sapiens
LCSMEIPGL

SEQ ID NO: 1336824 - protein, 9 aa, Homo Sapiens
SHIQVRLGE

SEQ ID NO: 1336825 - protein, 9 aa, Homo Sapiens
MELVQWGDI

SEQ ID NO: 1336826 - protein, 9 aa, Homo Sapiens
PLSDPITDK

SEQ ID NO: 1336827 - protein, 9 aa, Homo Sapiens
YQRRGKSQQ

SEQ ID NO: 1336828 - protein, 9 aa, Homo Sapiens
TEAEKLARR

SEQ ID NO: 1336829 - protein, 9 aa, Homo Sapiens
EKGCNKFVT

SEQ ID NO: 1336830 - protein, 9 aa, Homo Sapiens
VSCEKCCHA

SEQ ID NO: 1336831 - protein, 9 aa, Homo Sapiens
LTNLPLEKV

SEQ ID NO: 1336832 - protein, 9 aa, Homo Sapiens
RGARPSDWA

SEQ ID NO: 1336833 - protein, 9 aa, Homo Sapiens
QVFDSVMAR

SEQ ID NO: 1336834 - protein, 9 aa, Homo Sapiens
FGDHWGPYF

SEQ ID NO: 1336835 - protein, 9 aa, Homo Sapiens
EGCGSTFAK

SEQ ID NO: 1336836 - protein, 9 aa, Homo Sapiens
KIGVIKTAL

SEQ ID NO: 1336837 - protein, 9 aa, Homo Sapiens
CTASNAQDQ

SEQ ID NO: 1336838 - protein, 9 aa, Homo Sapiens
VIRINQEPL

SEQ ID NO: 1336839 - protein, 9 aa, Homo Sapiens
KKCRLTIIE

SEQ ID NO: 1336840 - protein, 9 aa, Homo Sapiens
LKQEIEHLT

SEQ ID NO: 1336841 - protein, 9 aa, Homo Sapiens
VVVKEEMDV

SEQ ID NO: 1336842 - protein, 9 aa, Homo Sapiens
GELADKKDH

SEQ ID NO: 1336843 - protein, 9 aa, Homo Sapiens
EPKITQLQD

SEQ ID NO: 1336844 - protein, 9 aa, Homo Sapiens
MKPYIKCAE

SEQ ID NO: 1336845 - protein, 9 aa, Homo Sapiens
PLHNFLEGD

SEQ ID NO: 1336846 - protein, 9 aa, Homo Sapiens
ASLSGGGMV

SEQ ID NO: 1336847 - protein, 9 aa, Homo Sapiens
ANRQAINVA

SEQ ID NO: 1336848 - protein, 9 aa, Homo Sapiens
ISFLTPLHN

SEQ ID NO: 1336849 - protein, 9 aa, Homo Sapiens
STCTKGGSC

SEQ ID NO: 1336850 - protein, 9 aa, Homo Sapiens
TDMFLGLLV

SEQ ID NO: 1336851 - protein, 9 aa, Homo Sapiens
GIHYARIQL

SEQ ID NO: 1336852 - protein, 9 aa, Homo Sapiens
TMPHGQLEK

SEQ ID NO: 1336853 - protein, 9 aa, Homo Sapiens
GQTVVTFHS

SEQ ID NO: 1336854 - protein, 9 aa, Homo Sapiens
VDKYRMRKK

SEQ ID NO: 1336855 - protein, 9 aa, Homo Sapiens
ENEGIPDGV

SEQ ID NO: 1336856 - protein, 9 aa, Homo Sapiens
LDPSGWPVF

SEQ ID NO: 1336857 - protein, 9 aa, Homo Sapiens
SLTVMDLEA

SEQ ID NO: 1336858 - protein, 9 aa, Homo Sapiens
QKTTLLCHR

SEQ ID NO: 1336859 - protein, 9 aa, Homo Sapiens
YRLKEALQP

SEQ ID NO: 1336860 - protein, 9 aa, Homo Sapiens
QPGAASTPR

SEQ ID NO: 1336861 - protein, 9 aa, Homo Sapiens
EVWDQLLEA

SEQ ID NO: 1336862 - protein, 9 aa, Homo Sapiens
PRPKCTCIV

SEQ ID NO: 1336863 - protein, 9 aa, Homo Sapiens
ATAEDLSLP

SEQ ID NO: 1336864 - protein, 9 aa, Homo Sapiens
RPQAELGGF

SEQ ID NO: 1336865 - protein, 9 aa, Homo Sapiens
QTYSGPICL

SEQ ID NO: 1336866 - protein, 9 aa, Homo Sapiens
ITMGFKTLR

SEQ ID NO: 1336867 - protein, 9 aa, Homo Sapiens
MEVAVSKAW

SEQ ID NO: 1336868 - protein, 9 aa, Homo Sapiens
LTGSILPPQ

SEQ ID NO: 1336869 - protein, 9 aa, Homo Sapiens
HFSIFLSEV

SEQ ID NO: 1336870 - protein, 9 aa, Homo Sapiens
TRGHQLYQP

SEQ ID NO: 1336871 - protein, 9 aa, Homo Sapiens
LLKVIESEK

SEQ ID NO: 1336872 - protein, 9 aa, Homo Sapiens
RVDYVTVKQ

SEQ ID NO: 1336873 - protein, 9 aa, Homo Sapiens
NLPPHAETA

SEQ ID NO: 1336874 - protein, 9 aa, Homo Sapiens
MGFMLVTAF

SEQ ID NO: 1336875 - protein, 9 aa, Homo Sapiens
RLEVQTRPF

SEQ ID NO: 1336876 - protein, 9 aa, Homo Sapiens
QAHSIYPIT

SEQ ID NO: 1336877 - protein, 9 aa, Homo Sapiens
NPQKPGDID

SEQ ID NO: 1336878 - protein, 9 aa, Homo Sapiens
IAVCIPMHG

SEQ ID NO: 1336879 - protein, 9 aa, Homo Sapiens
INMTDGPHT

SEQ ID NO: 1336880 - protein, 9 aa, Homo Sapiens
FEVSQLGIV

SEQ ID NO: 1336881 - protein, 9 aa, Homo Sapiens
GWEPAAHQR

SEQ ID NO: 1336882 - protein, 9 aa, Homo Sapiens
LARWKSHRR

SEQ ID NO: 1336883 - protein, 9 aa, Homo Sapiens
ISEECKAGA

SEQ ID NO: 1336884 - protein, 9 aa, Homo Sapiens
NAFFSIPAH

SEQ ID NO: 1336885 - protein, 9 aa, Homo Sapiens
STRVIYSIL

SEQ ID NO: 1336886 - protein, 9 aa, Homo Sapiens
GAGWTSKTW

SEQ ID NO: 1336887 - protein, 9 aa, Homo Sapiens
DKDGWPLCM

SEQ ID NO: 1336888 - protein, 9 aa, Homo Sapiens
RIQGRVTHL

SEQ ID NO: 1336889 - protein, 9 aa, Homo Sapiens
RCLHNETYS

SEQ ID NO: 1336890 - protein, 9 aa, Homo Sapiens
ISKLCKLEA

SEQ ID NO: 1336891 - protein, 9 aa, Homo Sapiens
ADIPNLRRF

SEQ ID NO: 1336892 - protein, 9 aa, Homo Sapiens
GMLPKSALV

SEQ ID NO: 1336893 - protein, 9 aa, Homo Sapiens
PLIIAGNPA

SEQ ID NO: 1336894 - protein, 9 aa, Homo Sapiens
KYALWRTDR

SEQ ID NO: 1336895 - protein, 9 aa, Homo Sapiens
VSTGDNWNR

SEQ ID NO: 1336896 - protein, 9 aa, Homo Sapiens
GVHLGQSLL

SEQ ID NO: 1336897 - protein, 9 aa, Homo Sapiens
NCEVLKREL

SEQ ID NO: 1336898 - protein, 9 aa, Homo Sapiens
KHCELNINE

SEQ ID NO: 1336899 - protein, 9 aa, Homo Sapiens
IMKNQIRKL

SEQ ID NO: 1336900 - protein, 9 aa, Homo Sapiens
IPPFPVSCH

SEQ ID NO: 1336901 - protein, 9 aa, Homo Sapiens
HHGQTQEYM

SEQ ID NO: 1336902 - protein, 9 aa, Homo Sapiens
IDTVQSYAA

SEQ ID NO: 1336903 - protein, 9 aa, Homo Sapiens
AVKTEAISG

SEQ ID NO: 1336904 - protein, 9 aa, Homo Sapiens
GAAPSTVAT

SEQ ID NO: 1336905 - protein, 9 aa, Homo Sapiens
AGQRHSPGV

SEQ ID NO: 1336906 - protein, 9 aa, Homo Sapiens
VIHYLYLCQ

SEQ ID NO: 1336907 - protein, 9 aa, Homo Sapiens
LNQLTGHNL

SEQ ID NO: 1336908 - protein, 9 aa, Homo Sapiens
SLHPGYYLS

SEQ ID NO: 1336909 - protein, 9 aa, Homo Sapiens
FTSLFDAKE

SEQ ID NO: 1336910 - protein, 9 aa, Homo Sapiens
WTSHQDASL

SEQ ID NO: 1336911 - protein, 9 aa, Homo Sapiens
NTGTSPYRL

SEQ ID NO: 1336912 - protein, 9 aa, Homo Sapiens
ATTMYFPSE

SEQ ID NO: 1336913 - protein, 9 aa, Homo Sapiens
LLTTGSLCV

SEQ ID NO: 1336914 - protein, 9 aa, Homo Sapiens
YFTLYEVAG

SEQ ID NO: 1336915 - protein, 9 aa, Homo Sapiens
ERCCLRTFI

SEQ ID NO: 1336916 - protein, 9 aa, Homo Sapiens
QNIKYLDVF

SEQ ID NO: 1336917 - protein, 9 aa, Homo Sapiens
VVAVSVIMM

SEQ ID NO: 1336918 - protein, 9 aa, Homo Sapiens
TAQDTTRHS

SEQ ID NO: 1336919 - protein, 9 aa, Homo Sapiens
PKTCQIRQY

SEQ ID NO: 1336920 - protein, 9 aa, Homo Sapiens
KRWPIVGVH

SEQ ID NO: 1336921 - protein, 9 aa, Homo Sapiens
TTKEDVMMA

SEQ ID NO: 1336922 - protein, 9 aa, Homo Sapiens
YPPHCPSPY

SEQ ID NO: 1336923 - protein, 9 aa, Homo Sapiens
YQPHGKCQS

SEQ ID NO: 1336924 - protein, 9 aa, Homo Sapiens
DTRLSFDKD

SEQ ID NO: 1336925 - protein, 9 aa, Homo Sapiens
RLRYKGIHP

SEQ ID NO: 1336926 - protein, 9 aa, Homo Sapiens
ELPAMKWPR

SEQ ID NO: 1336927 - protein, 9 aa, Homo Sapiens
TFEMILGPL

SEQ ID NO: 1336928 - protein, 9 aa, Homo Sapiens
VMIVGINCY

SEQ ID NO: 1336929 - protein, 9 aa, Homo Sapiens
SLKAKRVKV

SEQ ID NO: 1336930 - protein, 9 aa, Homo Sapiens
LACQNIKYL

SEQ ID NO: 1336931 - protein, 9 aa, Homo Sapiens
GAAVSRHQT

SEQ ID NO: 1336932 - protein, 9 aa, Homo Sapiens
KEMRETHLN

SEQ ID NO: 1336933 - protein, 9 aa, Homo Sapiens
EVIPPNNQS

SEQ ID NO: 1336934 - protein, 9 aa, Homo Sapiens
EYVLKQERA

SEQ ID NO: 1336935 - protein, 9 aa, Homo Sapiens
LPPPVKSTL

SEQ ID NO: 1336936 - protein, 9 aa, Homo Sapiens
ERFDNQPCV

SEQ ID NO: 1336937 - protein, 9 aa, Homo Sapiens
FLYKGSFCR

SEQ ID NO: 1336938 - protein, 9 aa, Homo Sapiens
VCHHTQDQV

SEQ ID NO: 1336939 - protein, 9 aa, Homo Sapiens
CINLSFAYM

SEQ ID NO: 1336940 - protein, 9 aa, Homo Sapiens
ARHGHDAAS

SEQ ID NO: 1336941 - protein, 9 aa, Homo Sapiens
ALKRLHRKR

SEQ ID NO: 1336942 - protein, 9 aa, Homo Sapiens
GDQVAHIPV

SEQ ID NO: 1336943 - protein, 9 aa, Homo Sapiens
LDPALPVLV

SEQ ID NO: 1336944 - protein, 9 aa, Homo Sapiens
IEVADPKYW

SEQ ID NO: 1336945 - protein, 9 aa, Homo Sapiens
DDHHLRGCG

SEQ ID NO: 1336946 - protein, 9 aa, Homo Sapiens
AVHPFFLAQ

SEQ ID NO: 1336947 - protein, 9 aa, Homo Sapiens
GSSGVPPPG

SEQ ID NO: 1336948 - protein, 9 aa, Homo Sapiens
NLSSESSES

SEQ ID NO: 1336949 - protein, 9 aa, Homo Sapiens
SPFGYLDIL

SEQ ID NO: 1336950 - protein, 9 aa, Homo Sapiens
TYSQIVKED

SEQ ID NO: 1336951 - protein, 9 aa, Homo Sapiens
SLKSGRKRK

SEQ ID NO: 1336952 - protein, 9 aa, Homo Sapiens
RAIGRITGK

SEQ ID NO: 1336953 - protein, 9 aa, Homo Sapiens
PVKVIEKKT

SEQ ID NO: 1336954 - protein, 9 aa, Homo Sapiens
FAFATCSSY

SEQ ID NO: 1336955 - protein, 9 aa, Homo Sapiens
LKEALIRYA

SEQ ID NO: 1336956 - protein, 9 aa, Homo Sapiens
TYVSSLTRS

SEQ ID NO: 1336957 - protein, 9 aa, Homo Sapiens
QESDHKVVG

SEQ ID NO: 1336958 - protein, 9 aa, Homo Sapiens
PTRPGLNKS

SEQ ID NO: 1336959 - protein, 9 aa, Homo Sapiens
VSLGSIVVI

SEQ ID NO: 1336960 - protein, 9 aa, Homo Sapiens
LWNLPPHAE

SEQ ID NO: 1336961 - protein, 9 aa, Homo Sapiens
EKEVRLIRN

SEQ ID NO: 1336962 - protein, 9 aa, Homo Sapiens
RSFFTSAHP

SEQ ID NO: 1336963 - protein, 9 aa, Homo Sapiens
MWRLSSIKR

SEQ ID NO: 1336964 - protein, 9 aa, Homo Sapiens
PDGHYTMDN

SEQ ID NO: 1336965 - protein, 9 aa, Homo Sapiens
PSCPSQLGA

SEQ ID NO: 1336966 - protein, 9 aa, Homo Sapiens
AILSLENCR

SEQ ID NO: 1336967 - protein, 9 aa, Homo Sapiens
FPEVQRLES

SEQ ID NO: 1336968 - protein, 9 aa, Homo Sapiens
YKGHRPESH

SEQ ID NO: 1336969 - protein, 9 aa, Homo Sapiens
VDRVSHASV

SEQ ID NO: 1336970 - protein, 9 aa, Homo Sapiens
WRTDRPKIL

SEQ ID NO: 1336971 - protein, 9 aa, Homo Sapiens
RYEEAVGEK

SEQ ID NO: 1336972 - protein, 9 aa, Homo Sapiens
TVNLIRHKL

SEQ ID NO: 1336973 - protein, 9 aa, Homo Sapiens
NLELLSALG

SEQ ID NO: 1336974 - protein, 9 aa, Homo Sapiens
DEFKKFREN

SEQ ID NO: 1336975 - protein, 9 aa, Homo Sapiens
VALSMYQLE

SEQ ID NO: 1336976 - protein, 9 aa, Homo Sapiens
LIGLSRAWR

SEQ ID NO: 1336977 - protein, 9 aa, Homo Sapiens
TGITLIGEP

SEQ ID NO: 1336978 - protein, 9 aa, Homo Sapiens
KKRLGLVND

SEQ ID NO: 1336979 - protein, 9 aa, Homo Sapiens
LVLIITPWN

SEQ ID NO: 1336980 - protein, 9 aa, Homo Sapiens
ELAKMIKMF

SEQ ID NO: 1336981 - protein, 9 aa, Homo Sapiens
LARAVPAFL

SEQ ID NO: 1336982 - protein, 9 aa, Homo Sapiens
KLGAFLAQS

SEQ ID NO: 1336983 - protein, 9 aa, Homo Sapiens
QLQALNIPF

SEQ ID NO: 1336984 - protein, 9 aa, Homo Sapiens
GDLPCMENT

SEQ ID NO: 1336985 - protein, 9 aa, Homo Sapiens
GGHSSMMCY

SEQ ID NO: 1336986 - protein, 9 aa, Homo Sapiens
EPASNHNGA

SEQ ID NO: 1336987 - protein, 9 aa, Homo Sapiens
PDGVCSKDS

SEQ ID NO: 1336988 - protein, 9 aa, Homo Sapiens
EKDTMDIEW

SEQ ID NO: 1336989 - protein, 9 aa, Homo Sapiens
VMSTDFFLA

SEQ ID NO: 1336990 - protein, 9 aa, Homo Sapiens
ARRPSAAAR

SEQ ID NO: 1336991 - protein, 9 aa, Homo Sapiens
REEAAKWNQ

SEQ ID NO: 1336992 - protein, 9 aa, Homo Sapiens
FYQERANKK

SEQ ID NO: 1336993 - protein, 9 aa, Homo Sapiens
FVKTTTVGQ

SEQ ID NO: 1336994 - protein, 9 aa, Homo Sapiens
LGNISKPIM

SEQ ID NO: 1336995 - protein, 9 aa, Homo Sapiens
SWRVYTVLA

SEQ ID NO: 1336996 - protein, 9 aa, Homo Sapiens
NYPLWEVWA

SEQ ID NO: 1336997 - protein, 9 aa, Homo Sapiens
PTRFGNTDG

SEQ ID NO: 1336998 - protein, 9 aa, Homo Sapiens
PPFSLPGTI

SEQ ID NO: 1336999 - protein, 9 aa, Homo Sapiens
SLLNPPEAL

SEQ ID NO: 1337000 - protein, 9 aa, Homo Sapiens
EAKGNQALY

SEQ ID NO: 1337001 - protein, 9 aa, Homo Sapiens
WAHSGVSVQ

SEQ ID NO: 1337002 - protein, 9 aa, Homo Sapiens
SNTLSLWSH

SEQ ID NO: 1337003 - protein, 9 aa, Homo Sapiens
SMGINYHFH

SEQ ID NO: 1337004 - protein, 9 aa, Homo Sapiens
KWNQVRKDL

SEQ ID NO: 1337005 - protein, 9 aa, Homo Sapiens
NMACLDLGF

SEQ ID NO: 1337006 - protein, 9 aa, Homo Sapiens
ESDVIDGME

SEQ ID NO: 1337007 - protein, 9 aa, Homo Sapiens
AISIIMISL

SEQ ID NO: 1337008 - protein, 9 aa, Homo Sapiens
STVLTTTVT

SEQ ID NO: 1337009 - protein, 9 aa, Homo Sapiens
QLLSTCFCS

SEQ ID NO: 1337010 - protein, 9 aa, Homo Sapiens
RENNSPTLH

SEQ ID NO: 1337011 - protein, 9 aa, Homo Sapiens
KSMVERAAI

SEQ ID NO: 1337012 - protein, 9 aa, Homo Sapiens
PGSGQHDLD

SEQ ID NO: 1337013 - protein, 9 aa, Homo Sapiens
EGEHSNIVD

SEQ ID NO: 1337014 - protein, 9 aa, Homo Sapiens
TPLFDNPKL

SEQ ID NO: 1337015 - protein, 9 aa, Homo Sapiens
DGITNSPIQ

SEQ ID NO: 1337016 - protein, 9 aa, Homo Sapiens
KDTLWETIK

SEQ ID NO: 1337017 - protein, 9 aa, Homo Sapiens
IADACHLTL

SEQ ID NO: 1337018 - protein, 9 aa, Homo Sapiens
NYWMNVITG

SEQ ID NO: 1337019 - protein, 9 aa, Homo Sapiens
CFYIDITKE

SEQ ID NO: 1337020 - protein, 9 aa, Homo Sapiens
SRAEVVELQ

SEQ ID NO: 1337021 - protein, 9 aa, Homo Sapiens
SELRVGRLM

SEQ ID NO: 1337022 - protein, 9 aa, Homo Sapiens
SLRSGTKYK

SEQ ID NO: 1337023 - protein, 9 aa, Homo Sapiens
DHVIFLTRQ

SEQ ID NO: 1337024 - protein, 9 aa, Homo Sapiens
VVNCSSDFD

SEQ ID NO: 1337025 - protein, 9 aa, Homo Sapiens
GMLMEIIQA

SEQ ID NO: 1337026 - protein, 9 aa, Homo Sapiens
LAMHAASSS

SEQ ID NO: 1337027 - protein, 9 aa, Homo Sapiens
LITCCPFVQ

SEQ ID NO: 1337028 - protein, 9 aa, Homo Sapiens
LMIWFYAKI

SEQ ID NO: 1337029 - protein, 9 aa, Homo Sapiens
ELVLFNCSI

SEQ ID NO: 1337030 - protein, 9 aa, Homo Sapiens
WKKPSIEVA

SEQ ID NO: 1337031 - protein, 9 aa, Homo Sapiens
DQDLLRDAT

SEQ ID NO: 1337032 - protein, 9 aa, Homo Sapiens
AQCRALTQV

SEQ ID NO: 1337033 - protein, 9 aa, Homo Sapiens
AEHCFSRGE

SEQ ID NO: 1337034 - protein, 9 aa, Homo Sapiens
ATPPRALAA

SEQ ID NO: 1337035 - protein, 9 aa, Homo Sapiens
LLMAMRCLG

SEQ ID NO: 1337036 - protein, 9 aa, Homo Sapiens
KMYGWSSSL

SEQ ID NO: 1337037 - protein, 9 aa, Homo Sapiens
ISVAPYPST

SEQ ID NO: 1337038 - protein, 9 aa, Homo Sapiens
RRSSTPSMC

SEQ ID NO: 1337039 - protein, 9 aa, Homo Sapiens
EQSCESHKH

SEQ ID NO: 1337040 - protein, 9 aa, Homo Sapiens
RYERELSEI

SEQ ID NO: 1337041 - protein, 9 aa, Homo Sapiens
NQSIQQRKA

SEQ ID NO: 1337042 - protein, 9 aa, Homo Sapiens
TLLPFMQAC

SEQ ID NO: 1337043 - protein, 9 aa, Homo Sapiens
SPLRLSESG

SEQ ID NO: 1337044 - protein, 9 aa, Homo Sapiens
LLLMEAQMQ

SEQ ID NO: 1337045 - protein, 9 aa, Homo Sapiens
VAAHVLRQT

SEQ ID NO: 1337046 - protein, 9 aa, Homo Sapiens
YITHSCDVV

SEQ ID NO: 1337047 - protein, 9 aa, Homo Sapiens
FRHVSHSQY

SEQ ID NO: 1337048 - protein, 9 aa, Homo Sapiens
LKQLVILLM

SEQ ID NO: 1337049 - protein, 9 aa, Homo Sapiens
PATSDSVSL

SEQ ID NO: 1337050 - protein, 9 aa, Homo Sapiens
NDANPGICD

SEQ ID NO: 1337051 - protein, 9 aa, Homo Sapiens
KKFEGNIMS

SEQ ID NO: 1337052 - protein, 9 aa, Homo Sapiens
SGGGGGDTG

SEQ ID NO: 1337053 - protein, 9 aa, Homo Sapiens
DLKETAGEN

SEQ ID NO: 1337054 - protein, 9 aa, Homo Sapiens
VKAPVPSVC

SEQ ID NO: 1337055 - protein, 9 aa, Homo Sapiens
CDNIIDLFL

SEQ ID NO: 1337056 - protein, 9 aa, Homo Sapiens
TPCQMTYIK

SEQ ID NO: 1337057 - protein, 9 aa, Homo Sapiens
NRFSKDIGY

SEQ ID NO: 1337058 - protein, 9 aa, Homo Sapiens
LTCTSKNSS

SEQ ID NO: 1337059 - protein, 9 aa, Homo Sapiens
ICDKQGYNA

SEQ ID NO: 1337060 - protein, 9 aa, Homo Sapiens
SFYAHFFLS

SEQ ID NO: 1337061 - protein, 9 aa, Homo Sapiens
HTSLELCWF

SEQ ID NO: 1337062 - protein, 9 aa, Homo Sapiens
EKERKAFKA

SEQ ID NO: 1337063 - protein, 9 aa, Homo Sapiens
KAGVKTQKK

SEQ ID NO: 1337064 - protein, 9 aa, Homo Sapiens
VHQCLRLLQ

SEQ ID NO: 1337065 - protein, 9 aa, Homo Sapiens
AGSTFLNPE

SEQ ID NO: 1337066 - protein, 9 aa, Homo Sapiens
WVTNDTFDW

SEQ ID NO: 1337067 - protein, 9 aa, Homo Sapiens
QDPHTKAGL

SEQ ID NO: 1337068 - protein, 9 aa, Homo Sapiens
WTHARTSRP

SEQ ID NO: 1337069 - protein, 9 aa, Homo Sapiens
RRTRPNRVL

SEQ ID NO: 1337070 - protein, 9 aa, Homo Sapiens
YQLDSMVTA

SEQ ID NO: 1337071 - protein, 9 aa, Homo Sapiens
RAVKKKAAL

SEQ ID NO: 1337072 - protein, 9 aa, Homo Sapiens
MHLEASKLN

SEQ ID NO: 1337073 - protein, 9 aa, Homo Sapiens
RTARKAPAP

SEQ ID NO: 1337074 - protein, 9 aa, Homo Sapiens
DTDSDSPDE

SEQ ID NO: 1337075 - protein, 9 aa, Homo Sapiens
EHFEELLVF

SEQ ID NO: 1337076 - protein, 9 aa, Homo Sapiens
VHFQSHGLE

SEQ ID NO: 1337077 - protein, 9 aa, Homo Sapiens
NRYHYYQNV

SEQ ID NO: 1337078 - protein, 9 aa, Homo Sapiens
LNMHIRADT

SEQ ID NO: 1337079 - protein, 9 aa, Homo Sapiens
YPCSLFQPH

SEQ ID NO: 1337080 - protein, 9 aa, Homo Sapiens
EKVQMYRCY

SEQ ID NO: 1337081 - protein, 9 aa, Homo Sapiens
SSALHTIHT

SEQ ID NO: 1337082 - protein, 9 aa, Homo Sapiens
SLMHQSKGL

SEQ ID NO: 1337083 - protein, 9 aa, Homo Sapiens
EEYSRKGFC

SEQ ID NO: 1337084 - protein, 9 aa, Homo Sapiens
MWGGPMRGG

SEQ ID NO: 1337085 - protein, 9 aa, Homo Sapiens
PKSTGSIRQ

SEQ ID NO: 1337086 - protein, 9 aa, Homo Sapiens
FRIPGQANL

SEQ ID NO: 1337087 - protein, 9 aa, Homo Sapiens
VNGPRAIEA

SEQ ID NO: 1337088 - protein, 9 aa, Homo Sapiens
RSWQRRRLP

SEQ ID NO: 1337089 - protein, 9 aa, Homo Sapiens
SGCCFSFAE

SEQ ID NO: 1337090 - protein, 9 aa, Homo Sapiens
LYEQGMIQM

SEQ ID NO: 1337091 - protein, 9 aa, Homo Sapiens
RVVSREEPG

SEQ ID NO: 1337092 - protein, 9 aa, Homo Sapiens
FMNKFHSMN

SEQ ID NO: 1337093 - protein, 9 aa, Homo Sapiens
DIPFTARVG

SEQ ID NO: 1337094 - protein, 9 aa, Homo Sapiens
DLLHRIVAP

SEQ ID NO: 1337095 - protein, 9 aa, Homo Sapiens
ERSKPKCQK

SEQ ID NO: 1337096 - protein, 9 aa, Homo Sapiens
GPSSLGQPS

SEQ ID NO: 1337097 - protein, 9 aa, Homo Sapiens
RQRQRQQQQ

SEQ ID NO: 1337098 - protein, 9 aa, Homo Sapiens
VSLIAQYFA

SEQ ID NO: 1337099 - protein, 9 aa, Homo Sapiens
QLIESLQIF

SEQ ID NO: 1337100 - protein, 9 aa, Homo Sapiens
LDPAGLHTL

SEQ ID NO: 1337101 - protein, 9 aa, Homo Sapiens
AFFWPSLLC

SEQ ID NO: 1337102 - protein, 9 aa, Homo Sapiens
LHLAVAWNR

SEQ ID NO: 1337103 - protein, 9 aa, Homo Sapiens
YLPTLLMIW

SEQ ID NO: 1337104 - protein, 9 aa, Homo Sapiens
VYHSLEELA

SEQ ID NO: 1337105 - protein, 9 aa, Homo Sapiens
PKGERHMED

SEQ ID NO: 1337106 - protein, 9 aa, Homo Sapiens
ERLVHVDKC

SEQ ID NO: 1337107 - protein, 9 aa, Homo Sapiens
MNVKQAAKV

SEQ ID NO: 1337108 - protein, 9 aa, Homo Sapiens
VQLHKTTWL

SEQ ID NO: 1337109 - protein, 9 aa, Homo Sapiens
NQEVSPPVE

SEQ ID NO: 1337110 - protein, 9 aa, Homo Sapiens
LYPTDNEDY

SEQ ID NO: 1337111 - protein, 9 aa, Homo Sapiens
EATPNRYHY

SEQ ID NO: 1337112 - protein, 9 aa, Homo Sapiens
DGLPVPSGT

SEQ ID NO: 1337113 - protein, 9 aa, Homo Sapiens
EMETTTELF

SEQ ID NO: 1337114 - protein, 9 aa, Homo Sapiens
GASTAARSP

SEQ ID NO: 1337115 - protein, 9 aa, Homo Sapiens
STMARRGSS

SEQ ID NO: 1337116 - protein, 9 aa, Homo Sapiens
SQPCVLCPA

SEQ ID NO: 1337117 - protein, 9 aa, Homo Sapiens
TLEECWAMR

SEQ ID NO: 1337118 - protein, 9 aa, Homo Sapiens
SPSQDERMW

SEQ ID NO: 1337119 - protein, 9 aa, Homo Sapiens
YSIPQAIFV

SEQ ID NO: 1337120 - protein, 9 aa, Homo Sapiens
EETMFHCQF

SEQ ID NO: 1337121 - protein, 9 aa, Homo Sapiens
VNGATGHIS

SEQ ID NO: 1337122 - protein, 9 aa, Homo Sapiens
RVKQALATL

SEQ ID NO: 1337123 - protein, 9 aa, Homo Sapiens
HMFKQEFTG

SEQ ID NO: 1337124 - protein, 9 aa, Homo Sapiens
GARLEAESV

SEQ ID NO: 1337125 - protein, 9 aa, Homo Sapiens
NSQVQVVLL

SEQ ID NO: 1337126 - protein, 9 aa, Homo Sapiens
IEGYTKSGV

SEQ ID NO: 1337127 - protein, 9 aa, Homo Sapiens
RVHTKEKPY

SEQ ID NO: 1337128 - protein, 9 aa, Homo Sapiens
SIIADRITL

SEQ ID NO: 1337129 - protein, 9 aa, Homo Sapiens
KRDLNYIRS

SEQ ID NO: 1337130 - protein, 9 aa, Homo Sapiens
GGFPEPFHS

SEQ ID NO: 1337131 - protein, 9 aa, Homo Sapiens
LSTVHNADV

SEQ ID NO: 1337132 - protein, 9 aa, Homo Sapiens
VGEQVTYTC

SEQ ID NO: 1337133 - protein, 9 aa, Homo Sapiens
IRAYDPKGS

SEQ ID NO: 1337134 - protein, 9 aa, Homo Sapiens
TQRQKAIHL

SEQ ID NO: 1337135 - protein, 9 aa, Homo Sapiens
ASTSVPKNP

SEQ ID NO: 1337136 - protein, 9 aa, Homo Sapiens
FDVHISQHA

SEQ ID NO: 1337137 - protein, 9 aa, Homo Sapiens
APEWCHLAA

SEQ ID NO: 1337138 - protein, 9 aa, Homo Sapiens
LAQHFGPVF

SEQ ID NO: 1337139 - protein, 9 aa, Homo Sapiens
KFVEWMRLD

SEQ ID NO: 1337140 - protein, 9 aa, Homo Sapiens
YCTPPHRSE

SEQ ID NO: 1337141 - protein, 9 aa, Homo Sapiens
EFKRKHGKS

SEQ ID NO: 1337142 - protein, 9 aa, Homo Sapiens
LVTKLVEVM

SEQ ID NO: 1337143 - protein, 9 aa, Homo Sapiens
TPNTEMRTS

SEQ ID NO: 1337144 - protein, 9 aa, Homo Sapiens
PGPVPQLPL

SEQ ID NO: 1337145 - protein, 9 aa, Homo Sapiens
DFTPQCLKK

SEQ ID NO: 1337146 - protein, 9 aa, Homo Sapiens
LDHMENYNI

SEQ ID NO: 1337147 - protein, 9 aa, Homo Sapiens
DHIQSSRAF

SEQ ID NO: 1337148 - protein, 9 aa, Homo Sapiens
QDRMAFCVT

SEQ ID NO: 1337149 - protein, 9 aa, Homo Sapiens
LKKMCAHLF

SEQ ID NO: 1337150 - protein, 9 aa, Homo Sapiens
MTKEDDKHH

SEQ ID NO: 1337151 - protein, 9 aa, Homo Sapiens
HLLELRKIL

SEQ ID NO: 1337152 - protein, 9 aa, Homo Sapiens
DQLMAVTYT

SEQ ID NO: 1337153 - protein, 9 aa, Homo Sapiens
TILSARKTF

SEQ ID NO: 1337154 - protein, 9 aa, Homo Sapiens
PRPAHMVVG

SEQ ID NO: 1337155 - protein, 9 aa, Homo Sapiens
RDTSSGGSV

SEQ ID NO: 1337156 - protein, 9 aa, Homo Sapiens
ISPQCIPAT

SEQ ID NO: 1337157 - protein, 9 aa, Homo Sapiens
KQLTYYSKS

SEQ ID NO: 1337158 - protein, 9 aa, Homo Sapiens
STRPPPGSQ

SEQ ID NO: 1337159 - protein, 9 aa, Homo Sapiens
NIVVIHCKG

SEQ ID NO: 1337160 - protein, 9 aa, Homo Sapiens
KTSKYWSKD

SEQ ID NO: 1337161 - protein, 9 aa, Homo Sapiens
LMLDVLMAA

SEQ ID NO: 1337162 - protein, 9 aa, Homo Sapiens
ELCFKQYLH

SEQ ID NO: 1337163 - protein, 9 aa, Homo Sapiens
VDAGETACK

SEQ ID NO: 1337164 - protein, 9 aa, Homo Sapiens
TCFSSFRVV

SEQ ID NO: 1337165 - protein, 9 aa, Homo Sapiens
DKSRLISGV

SEQ ID NO: 1337166 - protein, 9 aa, Homo Sapiens
DGWPLCMLR

SEQ ID NO: 1337167 - protein, 9 aa, Homo Sapiens
GWTYASTSG

SEQ ID NO: 1337168 - protein, 9 aa, Homo Sapiens
ATPWNIFPV

SEQ ID NO: 1337169 - protein, 9 aa, Homo Sapiens
TGTTIQCVR

SEQ ID NO: 1337170 - protein, 9 aa, Homo Sapiens
IWLMFPTPF

SEQ ID NO: 1337171 - protein, 9 aa, Homo Sapiens
LPVRLQWME

SEQ ID NO: 1337172 - protein, 9 aa, Homo Sapiens
MSAYLQEQR

SEQ ID NO: 1337173 - protein, 9 aa, Homo Sapiens
VHLKEGDQH

SEQ ID NO: 1337174 - protein, 9 aa, Homo Sapiens
DVHFTVDKQ

SEQ ID NO: 1337175 - protein, 9 aa, Homo Sapiens
RQRREIKLH

SEQ ID NO: 1337176 - protein, 9 aa, Homo Sapiens
VPQAQRPGP

SEQ ID NO: 1337177 - protein, 9 aa, Homo Sapiens
LTDQRSPYA

SEQ ID NO: 1337178 - protein, 9 aa, Homo Sapiens
SIPLSQAEV

SEQ ID NO: 1337179 - protein, 9 aa, Homo Sapiens
PTHHPISHH

SEQ ID NO: 1337180 - protein, 9 aa, Homo Sapiens
HVQKRKGTH

SEQ ID NO: 1337181 - protein, 9 aa, Homo Sapiens
TCGKMYGWS

SEQ ID NO: 1337182 - protein, 9 aa, Homo Sapiens
VIREGWRWG

SEQ ID NO: 1337183 - protein, 9 aa, Homo Sapiens
RSIRDPPED

SEQ ID NO: 1337184 - protein, 9 aa, Homo Sapiens
TVTTYWKTL

SEQ ID NO: 1337185 - protein, 9 aa, Homo Sapiens
PLTHTQDLT

SEQ ID NO: 1337186 - protein, 9 aa, Homo Sapiens
GLTIMVTWY

SEQ ID NO: 1337187 - protein, 9 aa, Homo Sapiens
GDHWGPYFA

SEQ ID NO: 1337188 - protein, 9 aa, Homo Sapiens
RVDIFTNLG

SEQ ID NO: 1337189 - protein, 9 aa, Homo Sapiens
CGAHMMRRL

SEQ ID NO: 1337190 - protein, 9 aa, Homo Sapiens
KLLLFKELQ

SEQ ID NO: 1337191 - protein, 9 aa, Homo Sapiens
GSPVRLARN

SEQ ID NO: 1337192 - protein, 9 aa, Homo Sapiens
STIPVEPGC

SEQ ID NO: 1337193 - protein, 9 aa, Homo Sapiens
RPRTFCLAD

SEQ ID NO: 1337194 - protein, 9 aa, Homo Sapiens
KDYEICQYV

SEQ ID NO: 1337195 - protein, 9 aa, Homo Sapiens
HPTTLDPSS

SEQ ID NO: 1337196 - protein, 9 aa, Homo Sapiens
MAVGWLTTW

SEQ ID NO: 1337197 - protein, 9 aa, Homo Sapiens
YVWNVEPLS

SEQ ID NO: 1337198 - protein, 9 aa, Homo Sapiens
IVPLIKSHS

SEQ ID NO: 1337199 - protein, 9 aa, Homo Sapiens
SENHQDYFD

SEQ ID NO: 1337200 - protein, 9 aa, Homo Sapiens
EKLMRDVKI

SEQ ID NO: 1337201 - protein, 9 aa, Homo Sapiens
TLSLWSHCL

SEQ ID NO: 1337202 - protein, 9 aa, Homo Sapiens
LGVLPLPED

SEQ ID NO: 1337203 - protein, 9 aa, Homo Sapiens
STVATPPRA

SEQ ID NO: 1337204 - protein, 9 aa, Homo Sapiens
KIMWLGRKH

SEQ ID NO: 1337205 - protein, 9 aa, Homo Sapiens
FSFRANMGT

SEQ ID NO: 1337206 - protein, 9 aa, Homo Sapiens
GDMWICMEL

SEQ ID NO: 1337207 - protein, 9 aa, Homo Sapiens
AMAQLRFLK

SEQ ID NO: 1337208 - protein, 9 aa, Homo Sapiens
GEFERLHRL

SEQ ID NO: 1337209 - protein, 9 aa, Homo Sapiens
LMRHQEELR

SEQ ID NO: 1337210 - protein, 9 aa, Homo Sapiens
ERSPASTSV

SEQ ID NO: 1337211 - protein, 9 aa, Homo Sapiens
ASAARPSTS

SEQ ID NO: 1337212 - protein, 9 aa, Homo Sapiens
GEIQDAFDI

SEQ ID NO: 1337213 - protein, 9 aa, Homo Sapiens
SEKVAHSIL

SEQ ID NO: 1337214 - protein, 9 aa, Homo Sapiens
VPQALHRVT

SEQ ID NO: 1337215 - protein, 9 aa, Homo Sapiens
VQVSATEDE

SEQ ID NO: 1337216 - protein, 9 aa, Homo Sapiens
LSLHRLQAD

SEQ ID NO: 1337217 - protein, 9 aa, Homo Sapiens
FRHYLRAYF

SEQ ID NO: 1337218 - protein, 9 aa, Homo Sapiens
SIVTRGALP

SEQ ID NO: 1337219 - protein, 9 aa, Homo Sapiens
HRPEKDRYP

SEQ ID NO: 1337220 - protein, 9 aa, Homo Sapiens
TSFQVVLDK

SEQ ID NO: 1337221 - protein, 9 aa, Homo Sapiens
PLGEPSASL

SEQ ID NO: 1337222 - protein, 9 aa, Homo Sapiens
PQPTAAPAS

SEQ ID NO: 1337223 - protein, 9 aa, Homo Sapiens
TANLVAFMI

SEQ ID NO: 1337224 - protein, 9 aa, Homo Sapiens
WLHPRGERR

SEQ ID NO: 1337225 - protein, 9 aa, Homo Sapiens
PSFLQPLRQ

SEQ ID NO: 1337226 - protein, 9 aa, Homo Sapiens
SAGRRSARA

SEQ ID NO: 1337227 - protein, 9 aa, Homo Sapiens
SYAWHFETR

SEQ ID NO: 1337228 - protein, 9 aa, Homo Sapiens
TGDLPPPLQ

SEQ ID NO: 1337229 - protein, 9 aa, Homo Sapiens
IRPQFLLPG

SEQ ID NO: 1337230 - protein, 9 aa, Homo Sapiens
STLAMGPGE

SEQ ID NO: 1337231 - protein, 9 aa, Homo Sapiens
SLLMNLPED

SEQ ID NO: 1337232 - protein, 9 aa, Homo Sapiens
WKPLWGVWL

SEQ ID NO: 1337233 - protein, 9 aa, Homo Sapiens
SVLTSLLET

SEQ ID NO: 1337234 - protein, 9 aa, Homo Sapiens
QLRQVNGIN

SEQ ID NO: 1337235 - protein, 9 aa, Homo Sapiens
QSINNYNPK

SEQ ID NO: 1337236 - protein, 9 aa, Homo Sapiens
MFYVAIRHR

SEQ ID NO: 1337237 - protein, 9 aa, Homo Sapiens
SGAVDWVMM

SEQ ID NO: 1337238 - protein, 9 aa, Homo Sapiens
FVLCTRTVR

SEQ ID NO: 1337239 - protein, 9 aa, Homo Sapiens
LPEILQSTS

SEQ ID NO: 1337240 - protein, 9 aa, Homo Sapiens
SIHLYKENE

SEQ ID NO: 1337241 - protein, 9 aa, Homo Sapiens
LVIVGLIFA

SEQ ID NO: 1337242 - protein, 9 aa, Homo Sapiens
TRASFSVLG

SEQ ID NO: 1337243 - protein, 9 aa, Homo Sapiens
ETRKRITIQ

SEQ ID NO: 1337244 - protein, 9 aa, Homo Sapiens
EIPVCLHAG

SEQ ID NO: 1337245 - protein, 9 aa, Homo Sapiens
AQDSDYVLH

SEQ ID NO: 1337246 - protein, 9 aa, Homo Sapiens
DFTYRDVSY

SEQ ID NO: 1337247 - protein, 9 aa, Homo Sapiens
PPPPSPMDP

SEQ ID NO: 1337248 - protein, 9 aa, Homo Sapiens
TRSYYHNSV

SEQ ID NO: 1337249 - protein, 9 aa, Homo Sapiens
MSCTEASRD

SEQ ID NO: 1337250 - protein, 9 aa, Homo Sapiens
TGGIIYKLG

SEQ ID NO: 1337251 - protein, 9 aa, Homo Sapiens
GSTSIPLSS

SEQ ID NO: 1337252 - protein, 9 aa, Homo Sapiens
VRIHIRVGV

SEQ ID NO: 1337253 - protein, 9 aa, Homo Sapiens
DQWHWGVFS

SEQ ID NO: 1337254 - protein, 9 aa, Homo Sapiens
VPLVNLTNL

SEQ ID NO: 1337255 - protein, 9 aa, Homo Sapiens
HRWFVETEG

SEQ ID NO: 1337256 - protein, 9 aa, Homo Sapiens
PTSLVVWHR

SEQ ID NO: 1337257 - protein, 9 aa, Homo Sapiens
ASGSEHCYV

SEQ ID NO: 1337258 - protein, 9 aa, Homo Sapiens
MDTPPDIDL

SEQ ID NO: 1337259 - protein, 9 aa, Homo Sapiens
IHPAPGYPS

SEQ ID NO: 1337260 - protein, 9 aa, Homo Sapiens
HTGKKLYEY

SEQ ID NO: 1337261 - protein, 9 aa, Homo Sapiens
VCWLPFFLA

SEQ ID NO: 1337262 - protein, 9 aa, Homo Sapiens
VTIKFGKFS

SEQ ID NO: 1337263 - protein, 9 aa, Homo Sapiens
TPDGHLLFS

SEQ ID NO: 1337264 - protein, 9 aa, Homo Sapiens
LPETKWVAL

SEQ ID NO: 1337265 - protein, 9 aa, Homo Sapiens
NKGCVRGLW

SEQ ID NO: 1337266 - protein, 9 aa, Homo Sapiens
TCTKGGSCP

SEQ ID NO: 1337267 - protein, 9 aa, Homo Sapiens
NHISTISSP

SEQ ID NO: 1337268 - protein, 9 aa, Homo Sapiens
YRSALMTAI

SEQ ID NO: 1337269 - protein, 9 aa, Homo Sapiens
YFVMTHQEY

SEQ ID NO: 1337270 - protein, 9 aa, Homo Sapiens
EHLLGICDA

SEQ ID NO: 1337271 - protein, 9 aa, Homo Sapiens
MVAHTKDIP

SEQ ID NO: 1337272 - protein, 9 aa, Homo Sapiens
LQVYYDTIK

SEQ ID NO: 1337273 - protein, 9 aa, Homo Sapiens
LQDQLSALQ

SEQ ID NO: 1337274 - protein, 9 aa, Homo Sapiens
QLWARHMGK

SEQ ID NO: 1337275 - protein, 9 aa, Homo Sapiens
IGAGMDSYF

SEQ ID NO: 1337276 - protein, 9 aa, Homo Sapiens
EQLRKIGRW

SEQ ID NO: 1337277 - protein, 9 aa, Homo Sapiens
VLLRRMTLE

SEQ ID NO: 1337278 - protein, 9 aa, Homo Sapiens
QSEIEHIFE

SEQ ID NO: 1337279 - protein, 9 aa, Homo Sapiens
AEKGSLILL

SEQ ID NO: 1337280 - protein, 9 aa, Homo Sapiens
RKRRKFMMQ

SEQ ID NO: 1337281 - protein, 9 aa, Homo Sapiens
LPPARHITI

SEQ ID NO: 1337282 - protein, 9 aa, Homo Sapiens
ISRNFLPGG

SEQ ID NO: 1337283 - protein, 9 aa, Homo Sapiens
QRVHTGEKS

SEQ ID NO: 1337284 - protein, 9 aa, Homo Sapiens
EVAFSSVEM

SEQ ID NO: 1337285 - protein, 9 aa, Homo Sapiens
NRAHNNTHS

SEQ ID NO: 1337286 - protein, 9 aa, Homo Sapiens
NLSDLFQWV

SEQ ID NO: 1337287 - protein, 9 aa, Homo Sapiens
PEVWKEVRG

SEQ ID NO: 1337288 - protein, 9 aa, Homo Sapiens
VMTDLVDKN

SEQ ID NO: 1337289 - protein, 9 aa, Homo Sapiens
KHSRTMILV

SEQ ID NO: 1337290 - protein, 9 aa, Homo Sapiens
QAWKEVQLH

SEQ ID NO: 1337291 - protein, 9 aa, Homo Sapiens
THHILSHSE

SEQ ID NO: 1337292 - protein, 9 aa, Homo Sapiens
PRINSQLVT

SEQ ID NO: 1337293 - protein, 9 aa, Homo Sapiens
FSQRAVYDT

SEQ ID NO: 1337294 - protein, 9 aa, Homo Sapiens
ASRHFGTMS

SEQ ID NO: 1337295 - protein, 9 aa, Homo Sapiens
TYQGRVQSI

SEQ ID NO: 1337296 - protein, 9 aa, Homo Sapiens
LPTRGHALL

SEQ ID NO: 1337297 - protein, 9 aa, Homo Sapiens
LKFTSVFQP

SEQ ID NO: 1337298 - protein, 9 aa, Homo Sapiens
LATHKGYHP

SEQ ID NO: 1337299 - protein, 9 aa, Homo Sapiens
YDACDVERL

SEQ ID NO: 1337300 - protein, 9 aa, Homo Sapiens
VTREHLELL

SEQ ID NO: 1337301 - protein, 9 aa, Homo Sapiens
KPIRSPVMS

SEQ ID NO: 1337302 - protein, 9 aa, Homo Sapiens
DLHRLHMHG

SEQ ID NO: 1337303 - protein, 9 aa, Homo Sapiens
QPPDAVKPV

SEQ ID NO: 1337304 - protein, 9 aa, Homo Sapiens
QVDMRVAQV

SEQ ID NO: 1337305 - protein, 9 aa, Homo Sapiens
IVRRRGRRS

SEQ ID NO: 1337306 - protein, 9 aa, Homo Sapiens
HSQTTTIPS

SEQ ID NO: 1337307 - protein, 9 aa, Homo Sapiens
FIILFVEKL

SEQ ID NO: 1337308 - protein, 9 aa, Homo Sapiens
GLGPQPMVP

SEQ ID NO: 1337309 - protein, 9 aa, Homo Sapiens
TQTLDREVI

SEQ ID NO: 1337310 - protein, 9 aa, Homo Sapiens
TVFAASQGA

SEQ ID NO: 1337311 - protein, 9 aa, Homo Sapiens
YHRIDVIFC

SEQ ID NO: 1337312 - protein, 9 aa, Homo Sapiens
HINPHLPSD

SEQ ID NO: 1337313 - protein, 9 aa, Homo Sapiens
QQQLQINKI

SEQ ID NO: 1337314 - protein, 9 aa, Homo Sapiens
VAQTPRIPS

SEQ ID NO: 1337315 - protein, 9 aa, Homo Sapiens
AEAVMNWVM

SEQ ID NO: 1337316 - protein, 9 aa, Homo Sapiens
CQVQAPVAA

SEQ ID NO: 1337317 - protein, 9 aa, Homo Sapiens
AVTVTVGAV

SEQ ID NO: 1337318 - protein, 9 aa, Homo Sapiens
LPPGWEKCT

SEQ ID NO: 1337319 - protein, 9 aa, Homo Sapiens
RSQDVLHHY

SEQ ID NO: 1337320 - protein, 9 aa, Homo Sapiens
ATRPSTCTS

SEQ ID NO: 1337321 - protein, 9 aa, Homo Sapiens
LRSGTKYKV

SEQ ID NO: 1337322 - protein, 9 aa, Homo Sapiens
TSPTPPYNK

SEQ ID NO: 1337323 - protein, 9 aa, Homo Sapiens
KPGWFFKKN

SEQ ID NO: 1337324 - protein, 9 aa, Homo Sapiens
ERTGAEWNS

SEQ ID NO: 1337325 - protein, 9 aa, Homo Sapiens
LCTGEDVAA

SEQ ID NO: 1337326 - protein, 9 aa, Homo Sapiens
EDVMVASRL

SEQ ID NO: 1337327 - protein, 9 aa, Homo Sapiens
VACSTTINR

SEQ ID NO: 1337328 - protein, 9 aa, Homo Sapiens
SVALYKHFF

SEQ ID NO: 1337329 - protein, 9 aa, Homo Sapiens
LGYPFPSPG

SEQ ID NO: 1337330 - protein, 9 aa, Homo Sapiens
LRRTRHYNV

SEQ ID NO: 1337331 - protein, 9 aa, Homo Sapiens
KDSIAEGHI

SEQ ID NO: 1337332 - protein, 9 aa, Homo Sapiens
RQAINVALT

SEQ ID NO: 1337333 - protein, 9 aa, Homo Sapiens
MDWGLFDKS

SEQ ID NO: 1337334 - protein, 9 aa, Homo Sapiens
QPHHHRSKS

SEQ ID NO: 1337335 - protein, 9 aa, Homo Sapiens
QEISVVHIH

SEQ ID NO: 1337336 - protein, 9 aa, Homo Sapiens
VFMCAAVSF

SEQ ID NO: 1337337 - protein, 9 aa, Homo Sapiens
SLPELNTAQ

SEQ ID NO: 1337338 - protein, 9 aa, Homo Sapiens
LSDLTDHLP

SEQ ID NO: 1337339 - protein, 9 aa, Homo Sapiens
YSGRLIVCY

SEQ ID NO: 1337340 - protein, 9 aa, Homo Sapiens
CKDTLQVSK

SEQ ID NO: 1337341 - protein, 9 aa, Homo Sapiens
SKLQRVFDS

SEQ ID NO: 1337342 - protein, 9 aa, Homo Sapiens
VFVTYEAVL

SEQ ID NO: 1337343 - protein, 9 aa, Homo Sapiens
PDSVVVYVY

SEQ ID NO: 1337344 - protein, 9 aa, Homo Sapiens
DGRMDQDIF

SEQ ID NO: 1337345 - protein, 9 aa, Homo Sapiens
DGGQLVSIK

SEQ ID NO: 1337346 - protein, 9 aa, Homo Sapiens
PGICDKQGY

SEQ ID NO: 1337347 - protein, 9 aa, Homo Sapiens
WVVVSDATR

SEQ ID NO: 1337348 - protein, 9 aa, Homo Sapiens
KEDISGITS

SEQ ID NO: 1337349 - protein, 9 aa, Homo Sapiens
VARTDAPQV

SEQ ID NO: 1337350 - protein, 9 aa, Homo Sapiens
MRSNYETLI

SEQ ID NO: 1337351 - protein, 9 aa, Homo Sapiens
TYLRFLELH

SEQ ID NO: 1337352 - protein, 9 aa, Homo Sapiens
PTFQAENSQ

SEQ ID NO: 1337353 - protein, 9 aa, Homo Sapiens
QMSATFAKL

SEQ ID NO: 1337354 - protein, 9 aa, Homo Sapiens
EDIVTDVSP

SEQ ID NO: 1337355 - protein, 9 aa, Homo Sapiens
STVQGNTEV

SEQ ID NO: 1337356 - protein, 9 aa, Homo Sapiens
EERCAVHEA

SEQ ID NO: 1337357 - protein, 9 aa, Homo Sapiens
HFGTMSSMS

SEQ ID NO: 1337358 - protein, 9 aa, Homo Sapiens
EHIWQYVYS

SEQ ID NO: 1337359 - protein, 9 aa, Homo Sapiens
HLAQDAEVE

SEQ ID NO: 1337360 - protein, 9 aa, Homo Sapiens
GNDEDWLLL

SEQ ID NO: 1337361 - protein, 9 aa, Homo Sapiens
ELFVTEVSH

SEQ ID NO: 1337362 - protein, 9 aa, Homo Sapiens
GGTYQIGTT

SEQ ID NO: 1337363 - protein, 9 aa, Homo Sapiens
PLVDDRTGV

SEQ ID NO: 1337364 - protein, 9 aa, Homo Sapiens
HIQVGYYTS

SEQ ID NO: 1337365 - protein, 9 aa, Homo Sapiens
HNFLCILQR

SEQ ID NO: 1337366 - protein, 9 aa, Homo Sapiens
DEWVQCALH

SEQ ID NO: 1337367 - protein, 9 aa, Homo Sapiens
RNVSILYAD

SEQ ID NO: 1337368 - protein, 9 aa, Homo Sapiens
ASGYHIGPA

SEQ ID NO: 1337369 - protein, 9 aa, Homo Sapiens
AEWMSFDVT

SEQ ID NO: 1337370 - protein, 9 aa, Homo Sapiens
LRREEHADS

SEQ ID NO: 1337371 - protein, 9 aa, Homo Sapiens
SNPEEVKRP

SEQ ID NO: 1337372 - protein, 9 aa, Homo Sapiens
GSLPFDDQN

SEQ ID NO: 1337373 - protein, 9 aa, Homo Sapiens
IIVMVLNAT

SEQ ID NO: 1337374 - protein, 9 aa, Homo Sapiens
RDPGAQVFV

SEQ ID NO: 1337375 - protein, 9 aa, Homo Sapiens
STSSLEMAG

SEQ ID NO: 1337376 - protein, 9 aa, Homo Sapiens
CQKKQDGAL

SEQ ID NO: 1337377 - protein, 9 aa, Homo Sapiens
VERTRDARV

SEQ ID NO: 1337378 - protein, 9 aa, Homo Sapiens
QVMILQLQP

SEQ ID NO: 1337379 - protein, 9 aa, Homo Sapiens
NDTLLFLIR

SEQ ID NO: 1337380 - protein, 9 aa, Homo Sapiens
ATTTQHYSD

SEQ ID NO: 1337381 - protein, 9 aa, Homo Sapiens
FRKILISLA

SEQ ID NO: 1337382 - protein, 9 aa, Homo Sapiens
QRVFDSIVN

SEQ ID NO: 1337383 - protein, 9 aa, Homo Sapiens
GATYQKYWL

SEQ ID NO: 1337384 - protein, 9 aa, Homo Sapiens
HVQTLQIRG

SEQ ID NO: 1337385 - protein, 9 aa, Homo Sapiens
VQPEKQVSS

SEQ ID NO: 1337386 - protein, 9 aa, Homo Sapiens
TNQDFLPSG

SEQ ID NO: 1337387 - protein, 9 aa, Homo Sapiens
NLEEGNDQS

SEQ ID NO: 1337388 - protein, 9 aa, Homo Sapiens
RCPLQIILF

SEQ ID NO: 1337389 - protein, 9 aa, Homo Sapiens
EVQHLRFEV

SEQ ID NO: 1337390 - protein, 9 aa, Homo Sapiens
DMNGRYSVK

SEQ ID NO: 1337391 - protein, 9 aa, Homo Sapiens
NLPLEKVIH

SEQ ID NO: 1337392 - protein, 9 aa, Homo Sapiens
EDRNSTWKD

SEQ ID NO: 1337393 - protein, 9 aa, Homo Sapiens
DTLHCFFQP

SEQ ID NO: 1337394 - protein, 9 aa, Homo Sapiens
LLSNEQKVL

SEQ ID NO: 1337395 - protein, 9 aa, Homo Sapiens
MCTKIDYCA

SEQ ID NO: 1337396 - protein, 9 aa, Homo Sapiens
AKGNQALYS

SEQ ID NO: 1337397 - protein, 9 aa, Homo Sapiens
SATPCRKLC

SEQ ID NO: 1337398 - protein, 9 aa, Homo Sapiens
WGGRGQDPA

SEQ ID NO: 1337399 - protein, 9 aa, Homo Sapiens
TMWGLPCGS

SEQ ID NO: 1337400 - protein, 9 aa, Homo Sapiens
FPGSPQAAG

SEQ ID NO: 1337401 - protein, 9 aa, Homo Sapiens
QERHYECAA

SEQ ID NO: 1337402 - protein, 9 aa, Homo Sapiens
FKWKFLTGL

SEQ ID NO: 1337403 - protein, 9 aa, Homo Sapiens
LEAQTELCC

SEQ ID NO: 1337404 - protein, 9 aa, Homo Sapiens
TCGRWHTLA

SEQ ID NO: 1337405 - protein, 9 aa, Homo Sapiens
KARQAKAHP

SEQ ID NO: 1337406 - protein, 9 aa, Homo Sapiens
HCALCPLDH

SEQ ID NO: 1337407 - protein, 9 aa, Homo Sapiens
VQRLESTGR

SEQ ID NO: 1337408 - protein, 9 aa, Homo Sapiens
YKDEEGVTL

SEQ ID NO: 1337409 - protein, 9 aa, Homo Sapiens
SEKQHFYSC

SEQ ID NO: 1337410 - protein, 9 aa, Homo Sapiens
VFNEGWGPK

SEQ ID NO: 1337411 - protein, 9 aa, Homo Sapiens
RTQIFLDNC

SEQ ID NO: 1337412 - protein, 9 aa, Homo Sapiens
PFTLKSDGT

SEQ ID NO: 1337413 - protein, 9 aa, Homo Sapiens
EVALQRGKQ

SEQ ID NO: 1337414 - protein, 9 aa, Homo Sapiens
ALHRPPNSA

SEQ ID NO: 1337415 - protein, 9 aa, Homo Sapiens
VLPAVRSPA

SEQ ID NO: 1337416 - protein, 9 aa, Homo Sapiens
YGVILLVID

SEQ ID NO: 1337417 - protein, 9 aa, Homo Sapiens
RRVSHLLTE

SEQ ID NO: 1337418 - protein, 9 aa, Homo Sapiens
GTVCIWHSS

SEQ ID NO: 1337419 - protein, 9 aa, Homo Sapiens
DKLNAKLAL

SEQ ID NO: 1337420 - protein, 9 aa, Homo Sapiens
HFDFYYGTC

SEQ ID NO: 1337421 - protein, 9 aa, Homo Sapiens
VVHTESLLG

SEQ ID NO: 1337422 - protein, 9 aa, Homo Sapiens
NYWSLDPVS

SEQ ID NO: 1337423 - protein, 9 aa, Homo Sapiens
ICIKDEETG

SEQ ID NO: 1337424 - protein, 9 aa, Homo Sapiens
IFQNFSMAS

SEQ ID NO: 1337425 - protein, 9 aa, Homo Sapiens
IITNGITKA

SEQ ID NO: 1337426 - protein, 9 aa, Homo Sapiens
TAQNISEDF

SEQ ID NO: 1337427 - protein, 9 aa, Homo Sapiens
SSYLMKPYI

SEQ ID NO: 1337428 - protein, 9 aa, Homo Sapiens
PGPGPHLSP

SEQ ID NO: 1337429 - protein, 9 aa, Homo Sapiens
EQSEVVATE

SEQ ID NO: 1337430 - protein, 9 aa, Homo Sapiens
LVMVGLART

SEQ ID NO: 1337431 - protein, 9 aa, Homo Sapiens
TVDDKCEKA

SEQ ID NO: 1337432 - protein, 9 aa, Homo Sapiens
GQVTEVTLW

SEQ ID NO: 1337433 - protein, 9 aa, Homo Sapiens
WAPPSPHLL

SEQ ID NO: 1337434 - protein, 9 aa, Homo Sapiens
CPLQIILFF

SEQ ID NO: 1337435 - protein, 9 aa, Homo Sapiens
RQQHIAQQG

SEQ ID NO: 1337436 - protein, 9 aa, Homo Sapiens
PGHVLRVKH

SEQ ID NO: 1337437 - protein, 9 aa, Homo Sapiens
YDATRNVYH

SEQ ID NO: 1337438 - protein, 9 aa, Homo Sapiens
CREDVMVAS

SEQ ID NO: 1337439 - protein, 9 aa, Homo Sapiens
NNPCEREKH

SEQ ID NO: 1337440 - protein, 9 aa, Homo Sapiens
SKEYEHFSK

SEQ ID NO: 1337441 - protein, 9 aa, Homo Sapiens
YIGTYCGQS

SEQ ID NO: 1337442 - protein, 9 aa, Homo Sapiens
WMWYVPHPK

SEQ ID NO: 1337443 - protein, 9 aa, Homo Sapiens
WPNLVDAAK

SEQ ID NO: 1337444 - protein, 9 aa, Homo Sapiens
NVRIVSGSH

SEQ ID NO: 1337445 - protein, 9 aa, Homo Sapiens
RKLWAAWVA

SEQ ID NO: 1337446 - protein, 9 aa, Homo Sapiens
LGLQLALFY

SEQ ID NO: 1337447 - protein, 9 aa, Homo Sapiens
CSLYRAGYV

SEQ ID NO: 1337448 - protein, 9 aa, Homo Sapiens
ECLETIFTK

SEQ ID NO: 1337449 - protein, 9 aa, Homo Sapiens
HLQDQHMFY

SEQ ID NO: 1337450 - protein, 9 aa, Homo Sapiens
HAPQNSNPA

SEQ ID NO: 1337451 - protein, 9 aa, Homo Sapiens
RAGRDHFAF

SEQ ID NO: 1337452 - protein, 9 aa, Homo Sapiens
ECSPAPPPP

SEQ ID NO: 1337453 - protein, 9 aa, Homo Sapiens
KVQEAEAQS

SEQ ID NO: 1337454 - protein, 9 aa, Homo Sapiens
QPNTKYIFK

SEQ ID NO: 1337455 - protein, 9 aa, Homo Sapiens
NKENAKQLK

SEQ ID NO: 1337456 - protein, 9 aa, Homo Sapiens
QEELEVALQ

SEQ ID NO: 1337457 - protein, 9 aa, Homo Sapiens
RPSQNVISF

SEQ ID NO: 1337458 - protein, 9 aa, Homo Sapiens
YHLDTYIPL

SEQ ID NO: 1337459 - protein, 9 aa, Homo Sapiens
FNNPTTKTT

SEQ ID NO: 1337460 - protein, 9 aa, Homo Sapiens
DAAEMLGTK

SEQ ID NO: 1337461 - protein, 9 aa, Homo Sapiens
HGPDWHLKI

SEQ ID NO: 1337462 - protein, 9 aa, Homo Sapiens
VMFHLFDHV

SEQ ID NO: 1337463 - protein, 9 aa, Homo Sapiens
AAQHHSYMR

SEQ ID NO: 1337464 - protein, 9 aa, Homo Sapiens
EQYIFRVKV

SEQ ID NO: 1337465 - protein, 9 aa, Homo Sapiens
SLLLLQQLC

SEQ ID NO: 1337466 - protein, 9 aa, Homo Sapiens
CSHKQLYMY

SEQ ID NO: 1337467 - protein, 9 aa, Homo Sapiens
GYNMYASRL

SEQ ID NO: 1337468 - protein, 9 aa, Homo Sapiens
LTVGLVQQC

SEQ ID NO: 1337469 - protein, 9 aa, Homo Sapiens
APEIFQCCD

SEQ ID NO: 1337470 - protein, 9 aa, Homo Sapiens
GTFMFYCVH

SEQ ID NO: 1337471 - protein, 9 aa, Homo Sapiens
VKDVLNILI

SEQ ID NO: 1337472 - protein, 9 aa, Homo Sapiens
SVWQRRRRI

SEQ ID NO: 1337473 - protein, 9 aa, Homo Sapiens
VLEVVVVHE

SEQ ID NO: 1337474 - protein, 9 aa, Homo Sapiens
CFVEYYSHA

SEQ ID NO: 1337475 - protein, 9 aa, Homo Sapiens
PELDKEAAV

SEQ ID NO: 1337476 - protein, 9 aa, Homo Sapiens
IRPKSHPKA

SEQ ID NO: 1337477 - protein, 9 aa, Homo Sapiens
YPTQRALYR

SEQ ID NO: 1337478 - protein, 9 aa, Homo Sapiens
VSRCTPQHI

SEQ ID NO: 1337479 - protein, 9 aa, Homo Sapiens
LQRWMPQTF

SEQ ID NO: 1337480 - protein, 9 aa, Homo Sapiens
FPPHLNHPP

SEQ ID NO: 1337481 - protein, 9 aa, Homo Sapiens
KHYECEECG

SEQ ID NO: 1337482 - protein, 9 aa, Homo Sapiens
KVNHFAYRT

SEQ ID NO: 1337483 - protein, 9 aa, Homo Sapiens
SCRVDIFTN

SEQ ID NO: 1337484 - protein, 9 aa, Homo Sapiens
FTLYEVAGV

SEQ ID NO: 1337485 - protein, 9 aa, Homo Sapiens
FQVFKMHKK

SEQ ID NO: 1337486 - protein, 9 aa, Homo Sapiens
AGIYTYLLE

SEQ ID NO: 1337487 - protein, 9 aa, Homo Sapiens
TELCCLFLQ

SEQ ID NO: 1337488 - protein, 9 aa, Homo Sapiens
SAGYHLPTW

SEQ ID NO: 1337489 - protein, 9 aa, Homo Sapiens
IFGQASMIP

SEQ ID NO: 1337490 - protein, 9 aa, Homo Sapiens
IKLHLLGTS

SEQ ID NO: 1337491 - protein, 9 aa, Homo Sapiens
SRSSSRIRF

SEQ ID NO: 1337492 - protein, 9 aa, Homo Sapiens
VCCIKPNDD

SEQ ID NO: 1337493 - protein, 9 aa, Homo Sapiens
TLDPSSTPV

SEQ ID NO: 1337494 - protein, 9 aa, Homo Sapiens
TVPTLMSLA

SEQ ID NO: 1337495 - protein, 9 aa, Homo Sapiens
VRMYNKIFT

SEQ ID NO: 1337496 - protein, 9 aa, Homo Sapiens
QGKAKHLCL

SEQ ID NO: 1337497 - protein, 9 aa, Homo Sapiens
LGRVPHQVQ

SEQ ID NO: 1337498 - protein, 9 aa, Homo Sapiens
LQWEPYCRD

SEQ ID NO: 1337499 - protein, 9 aa, Homo Sapiens
IESEGCGST

SEQ ID NO: 1337500 - protein, 9 aa, Homo Sapiens
CTQTGFYGE

SEQ ID NO: 1337501 - protein, 9 aa, Homo Sapiens
KVFSAYSSV

SEQ ID NO: 1337502 - protein, 9 aa, Homo Sapiens
LHGVSCWSG

SEQ ID NO: 1337503 - protein, 9 aa, Homo Sapiens
GKPFRMSTH

SEQ ID NO: 1337504 - protein, 9 aa, Homo Sapiens
VTLVPPQAS

SEQ ID NO: 1337505 - protein, 9 aa, Homo Sapiens
EVNNKLIGS

SEQ ID NO: 1337506 - protein, 9 aa, Homo Sapiens
MLDVLMAAT

SEQ ID NO: 1337507 - protein, 9 aa, Homo Sapiens
GVSQHLLPP

SEQ ID NO: 1337508 - protein, 9 aa, Homo Sapiens
PRFPASNIY

SEQ ID NO: 1337509 - protein, 9 aa, Homo Sapiens
EEWNKVKRV

SEQ ID NO: 1337510 - protein, 9 aa, Homo Sapiens
IDWNCEVLK

SEQ ID NO: 1337511 - protein, 9 aa, Homo Sapiens
QAKVWMIAA

SEQ ID NO: 1337512 - protein, 9 aa, Homo Sapiens
KINVLMHAL

SEQ ID NO: 1337513 - protein, 9 aa, Homo Sapiens
MKFWCKAGG

SEQ ID NO: 1337514 - protein, 9 aa, Homo Sapiens
AKGGLEDEC

SEQ ID NO: 1337515 - protein, 9 aa, Homo Sapiens
YAPLAFQYF

SEQ ID NO: 1337516 - protein, 9 aa, Homo Sapiens
DPHFIGNWW

SEQ ID NO: 1337517 - protein, 9 aa, Homo Sapiens
EALIVPVPE

SEQ ID NO: 1337518 - protein, 9 aa, Homo Sapiens
NKKQCMMVR

SEQ ID NO: 1337519 - protein, 9 aa, Homo Sapiens
HVLGAQVFA

SEQ ID NO: 1337520 - protein, 9 aa, Homo Sapiens
FHVVWLNCK

SEQ ID NO: 1337521 - protein, 9 aa, Homo Sapiens
SILKQLVVT

SEQ ID NO: 1337522 - protein, 9 aa, Homo Sapiens
SCLPEPPLP

SEQ ID NO: 1337523 - protein, 9 aa, Homo Sapiens
SSFMLPIHL

SEQ ID NO: 1337524 - protein, 9 aa, Homo Sapiens
MPMWSAHLL

SEQ ID NO: 1337525 - protein, 9 aa, Homo Sapiens
MSDRNLPFV

SEQ ID NO: 1337526 - protein, 9 aa, Homo Sapiens
SSLMLLTQK

SEQ ID NO: 1337527 - protein, 9 aa, Homo Sapiens
KGKNKLNTI

SEQ ID NO: 1337528 - protein, 9 aa, Homo Sapiens
PLELMLLCT

SEQ ID NO: 1337529 - protein, 9 aa, Homo Sapiens
MLKRQHSLY

SEQ ID NO: 1337530 - protein, 9 aa, Homo Sapiens
AVQQYRHKM

SEQ ID NO: 1337531 - protein, 9 aa, Homo Sapiens
AGYRCNIDR

SEQ ID NO: 1337532 - protein, 9 aa, Homo Sapiens
ATCNDFLFE

SEQ ID NO: 1337533 - protein, 9 aa, Homo Sapiens
ATHEQTAAA

SEQ ID NO: 1337534 - protein, 9 aa, Homo Sapiens
DGTFKLSAK

SEQ ID NO: 1337535 - protein, 9 aa, Homo Sapiens
LQKYLKKHQ

SEQ ID NO: 1337536 - protein, 9 aa, Homo Sapiens
REDTLDDSV

SEQ ID NO: 1337537 - protein, 9 aa, Homo Sapiens
LTVLVPPSV

SEQ ID NO: 1337538 - protein, 9 aa, Homo Sapiens
LGNDTLLFL

SEQ ID NO: 1337539 - protein, 9 aa, Homo Sapiens
LPPCIYMVP

SEQ ID NO: 1337540 - protein, 9 aa, Homo Sapiens
PEALHHPYG

SEQ ID NO: 1337541 - protein, 9 aa, Homo Sapiens
RYNDLKKKR

SEQ ID NO: 1337542 - protein, 9 aa, Homo Sapiens
RRKKKVRSL

SEQ ID NO: 1337543 - protein, 9 aa, Homo Sapiens
SPTHPGRPH

SEQ ID NO: 1337544 - protein, 9 aa, Homo Sapiens
SHEDNPKGR

SEQ ID NO: 1337545 - protein, 9 aa, Homo Sapiens
DGITFIEKS

SEQ ID NO: 1337546 - protein, 9 aa, Homo Sapiens
AHKAHQKQF

SEQ ID NO: 1337547 - protein, 9 aa, Homo Sapiens
ICRNKQWSE

SEQ ID NO: 1337548 - protein, 9 aa, Homo Sapiens
RAYGRSRSK

SEQ ID NO: 1337549 - protein, 9 aa, Homo Sapiens
GYSKAQYNV

SEQ ID NO: 1337550 - protein, 9 aa, Homo Sapiens
ADVDQDGRM

SEQ ID NO: 1337551 - protein, 9 aa, Homo Sapiens
DSIEKAAED

SEQ ID NO: 1337552 - protein, 9 aa, Homo Sapiens
RDNHMDRRE

SEQ ID NO: 1337553 - protein, 9 aa, Homo Sapiens
FTPTSSWAV

SEQ ID NO: 1337554 - protein, 9 aa, Homo Sapiens
DEIMRNHKR

SEQ ID NO: 1337555 - protein, 9 aa, Homo Sapiens
LGYTDHILH

SEQ ID NO: 1337556 - protein, 9 aa, Homo Sapiens
CNECGNIFK

SEQ ID NO: 1337557 - protein, 9 aa, Homo Sapiens
EQFKVTMNY

SEQ ID NO: 1337558 - protein, 9 aa, Homo Sapiens
SVIINCDRF

SEQ ID NO: 1337559 - protein, 9 aa, Homo Sapiens
IPYKRVFSS

SEQ ID NO: 1337560 - protein, 9 aa, Homo Sapiens
VSYHTSGHS

SEQ ID NO: 1337561 - protein, 9 aa, Homo Sapiens
NLCYWLEEA

SEQ ID NO: 1337562 - protein, 9 aa, Homo Sapiens
GSQPCVLCP

SEQ ID NO: 1337563 - protein, 9 aa, Homo Sapiens
SLPTFSEVI

SEQ ID NO: 1337564 - protein, 9 aa, Homo Sapiens
ALFLHQNTH

SEQ ID NO: 1337565 - protein, 9 aa, Homo Sapiens
ETTEDEHKI

SEQ ID NO: 1337566 - protein, 9 aa, Homo Sapiens
ITKHNQVEA

SEQ ID NO: 1337567 - protein, 9 aa, Homo Sapiens
GNLLFLFPS

SEQ ID NO: 1337568 - protein, 9 aa, Homo Sapiens
SHFDFYYGT

SEQ ID NO: 1337569 - protein, 9 aa, Homo Sapiens
SGHYLEELS

SEQ ID NO: 1337570 - protein, 9 aa, Homo Sapiens
LFQVISPQC

SEQ ID NO: 1337571 - protein, 9 aa, Homo Sapiens
GSHARFNCT

SEQ ID NO: 1337572 - protein, 9 aa, Homo Sapiens
VSQEETQGL

SEQ ID NO: 1337573 - protein, 9 aa, Homo Sapiens
EAHINTCYK

SEQ ID NO: 1337574 - protein, 9 aa, Homo Sapiens
HGDASKVTA

SEQ ID NO: 1337575 - protein, 9 aa, Homo Sapiens
AVRVTVDVI

SEQ ID NO: 1337576 - protein, 9 aa, Homo Sapiens
QEWERGWEP

SEQ ID NO: 1337577 - protein, 9 aa, Homo Sapiens
GLRKAVNAE

SEQ ID NO: 1337578 - protein, 9 aa, Homo Sapiens
TCGADHNAY

SEQ ID NO: 1337579 - protein, 9 aa, Homo Sapiens
YGFVLEDFK

SEQ ID NO: 1337580 - protein, 9 aa, Homo Sapiens
SCHPATLDT

SEQ ID NO: 1337581 - protein, 9 aa, Homo Sapiens
KHILSEFYE

SEQ ID NO: 1337582 - protein, 9 aa, Homo Sapiens
SLNLVDNEI

SEQ ID NO: 1337583 - protein, 9 aa, Homo Sapiens
SNAHFLTLD

SEQ ID NO: 1337584 - protein, 9 aa, Homo Sapiens
KCNDLVTSV

SEQ ID NO: 1337585 - protein, 9 aa, Homo Sapiens
CGDGTVTEV

SEQ ID NO: 1337586 - protein, 9 aa, Homo Sapiens
RGREENLFS

SEQ ID NO: 1337587 - protein, 9 aa, Homo Sapiens
GYDCGCGSF

SEQ ID NO: 1337588 - protein, 9 aa, Homo Sapiens
NVTLLRSLT

SEQ ID NO: 1337589 - protein, 9 aa, Homo Sapiens
HLNCAPKSI

SEQ ID NO: 1337590 - protein, 9 aa, Homo Sapiens
NMDKYTNLV

SEQ ID NO: 1337591 - protein, 9 aa, Homo Sapiens
MVFTLKHRA

SEQ ID NO: 1337592 - protein, 9 aa, Homo Sapiens
LVDTLLFVH

SEQ ID NO: 1337593 - protein, 9 aa, Homo Sapiens
QDDWKYVVM

SEQ ID NO: 1337594 - protein, 9 aa, Homo Sapiens
YDVVPSMQP

SEQ ID NO: 1337595 - protein, 9 aa, Homo Sapiens
MSDRSSNTF

SEQ ID NO: 1337596 - protein, 9 aa, Homo Sapiens
VDMLLCTPF

SEQ ID NO: 1337597 - protein, 9 aa, Homo Sapiens
GRHPSWPWT

SEQ ID NO: 1337598 - protein, 9 aa, Homo Sapiens
MVTWYWCTD

SEQ ID NO: 1337599 - protein, 9 aa, Homo Sapiens
TIWIITQRN

SEQ ID NO: 1337600 - protein, 9 aa, Homo Sapiens
SYMRCDHKM

SEQ ID NO: 1337601 - protein, 9 aa, Homo Sapiens
TGVICHVGD

SEQ ID NO: 1337602 - protein, 9 aa, Homo Sapiens
VVATEAQGM

SEQ ID NO: 1337603 - protein, 9 aa, Homo Sapiens
DFVADGALL

SEQ ID NO: 1337604 - protein, 9 aa, Homo Sapiens
WLCLENTPC

SEQ ID NO: 1337605 - protein, 9 aa, Homo Sapiens
KNLEKVHAE

SEQ ID NO: 1337606 - protein, 9 aa, Homo Sapiens
LPIASRIHL

SEQ ID NO: 1337607 - protein, 9 aa, Homo Sapiens
MMMLEKLSD

SEQ ID NO: 1337608 - protein, 9 aa, Homo Sapiens
MAEIIQEVE

SEQ ID NO: 1337609 - protein, 9 aa, Homo Sapiens
TDTLCKRLY

SEQ ID NO: 1337610 - protein, 9 aa, Homo Sapiens
EHIKIPSTP

SEQ ID NO: 1337611 - protein, 9 aa, Homo Sapiens
KLTGRGFSH

SEQ ID NO: 1337612 - protein, 9 aa, Homo Sapiens
DMPFPSIRS

SEQ ID NO: 1337613 - protein, 9 aa, Homo Sapiens
VSPTTEVPM

SEQ ID NO: 1337614 - protein, 9 aa, Homo Sapiens
LYHNNSPKW

SEQ ID NO: 1337615 - protein, 9 aa, Homo Sapiens
DSGTFEVVL

SEQ ID NO: 1337616 - protein, 9 aa, Homo Sapiens
TWAEWRQFN

SEQ ID NO: 1337617 - protein, 9 aa, Homo Sapiens
DIRKKKDVC

SEQ ID NO: 1337618 - protein, 9 aa, Homo Sapiens
WEVYGERCC

SEQ ID NO: 1337619 - protein, 9 aa, Homo Sapiens
SRVLNQYTY

SEQ ID NO: 1337620 - protein, 9 aa, Homo Sapiens
DIDGSNVAM

SEQ ID NO: 1337621 - protein, 9 aa, Homo Sapiens
KTPNTEMRT

SEQ ID NO: 1337622 - protein, 9 aa, Homo Sapiens
GAPRGSSLT

SEQ ID NO: 1337623 - protein, 9 aa, Homo Sapiens
GGLPIPHVS

SEQ ID NO: 1337624 - protein, 9 aa, Homo Sapiens
HWYKLQTYD

SEQ ID NO: 1337625 - protein, 9 aa, Homo Sapiens
VVLGPHAGQ

SEQ ID NO: 1337626 - protein, 9 aa, Homo Sapiens
VICKDTLQV

SEQ ID NO: 1337627 - protein, 9 aa, Homo Sapiens
NCCHFCYPC

SEQ ID NO: 1337628 - protein, 9 aa, Homo Sapiens
EILSHLLSV

SEQ ID NO: 1337629 - protein, 9 aa, Homo Sapiens
LVHERDAYK

SEQ ID NO: 1337630 - protein, 9 aa, Homo Sapiens
SQKSPLFQF

SEQ ID NO: 1337631 - protein, 9 aa, Homo Sapiens
SLALAMSQA

SEQ ID NO: 1337632 - protein, 9 aa, Homo Sapiens
FLLICGFRQ

SEQ ID NO: 1337633 - protein, 9 aa, Homo Sapiens
TKYKVTGWG

SEQ ID NO: 1337634 - protein, 9 aa, Homo Sapiens
TGEDADWLE

SEQ ID NO: 1337635 - protein, 9 aa, Homo Sapiens
GSSIPENDR

SEQ ID NO: 1337636 - protein, 9 aa, Homo Sapiens
RTSGKVHAM

SEQ ID NO: 1337637 - protein, 9 aa, Homo Sapiens
ARRGSSPGS

SEQ ID NO: 1337638 - protein, 9 aa, Homo Sapiens
AQINCFESA

SEQ ID NO: 1337639 - protein, 9 aa, Homo Sapiens
CIMVDKEEV

SEQ ID NO: 1337640 - protein, 9 aa, Homo Sapiens
LRQGHDPEA

SEQ ID NO: 1337641 - protein, 9 aa, Homo Sapiens
HLHGHLIKF

SEQ ID NO: 1337642 - protein, 9 aa, Homo Sapiens
IFRKVSQHT

SEQ ID NO: 1337643 - protein, 9 aa, Homo Sapiens
LHPVNVCCL

SEQ ID NO: 1337644 - protein, 9 aa, Homo Sapiens
TSWGPTAGA

SEQ ID NO: 1337645 - protein, 9 aa, Homo Sapiens
EEDTLLKEE

SEQ ID NO: 1337646 - protein, 9 aa, Homo Sapiens
AAKGGLEDE

SEQ ID NO: 1337647 - protein, 9 aa, Homo Sapiens
QILQELVLM

SEQ ID NO: 1337648 - protein, 9 aa, Homo Sapiens
VGIHGGDPE

SEQ ID NO: 1337649 - protein, 9 aa, Homo Sapiens
RRYHQDFFQ

SEQ ID NO: 1337650 - protein, 9 aa, Homo Sapiens
IRILEHLQK

SEQ ID NO: 1337651 - protein, 9 aa, Homo Sapiens
FLPHRILSD

SEQ ID NO: 1337652 - protein, 9 aa, Homo Sapiens
PKCGQKRKS

SEQ ID NO: 1337653 - protein, 9 aa, Homo Sapiens
STSIKIAPP

SEQ ID NO: 1337654 - protein, 9 aa, Homo Sapiens
RLANELHVS

SEQ ID NO: 1337655 - protein, 9 aa, Homo Sapiens
PYDAAKAEH

SEQ ID NO: 1337656 - protein, 9 aa, Homo Sapiens
FFNHPKGCD

SEQ ID NO: 1337657 - protein, 9 aa, Homo Sapiens
PARDSTSCK

SEQ ID NO: 1337658 - protein, 9 aa, Homo Sapiens
RVKIISINN

SEQ ID NO: 1337659 - protein, 9 aa, Homo Sapiens
QHDLHNRLR

SEQ ID NO: 1337660 - protein, 9 aa, Homo Sapiens
FHDFSLSIP

SEQ ID NO: 1337661 - protein, 9 aa, Homo Sapiens
TTTDGNILR

SEQ ID NO: 1337662 - protein, 9 aa, Homo Sapiens
QYWPAEHSA

SEQ ID NO: 1337663 - protein, 9 aa, Homo Sapiens
PNLELLSAL

SEQ ID NO: 1337664 - protein, 9 aa, Homo Sapiens
ILTNESSRE

SEQ ID NO: 1337665 - protein, 9 aa, Homo Sapiens
RGILEELLP

SEQ ID NO: 1337666 - protein, 9 aa, Homo Sapiens
IQFVDLCPT

SEQ ID NO: 1337667 - protein, 9 aa, Homo Sapiens
RPVMQLYQP

SEQ ID NO: 1337668 - protein, 9 aa, Homo Sapiens
ALTPPGTVT

SEQ ID NO: 1337669 - protein, 9 aa, Homo Sapiens
FIHHWRSYH

SEQ ID NO: 1337670 - protein, 9 aa, Homo Sapiens
LLVCTSLGL

SEQ ID NO: 1337671 - protein, 9 aa, Homo Sapiens
SMAYDRYVV

SEQ ID NO: 1337672 - protein, 9 aa, Homo Sapiens
LTASDHKNL

SEQ ID NO: 1337673 - protein, 9 aa, Homo Sapiens
HPPLNICVV

SEQ ID NO: 1337674 - protein, 9 aa, Homo Sapiens
HLLGICDAA

SEQ ID NO: 1337675 - protein, 9 aa, Homo Sapiens
KGKHSLDID

SEQ ID NO: 1337676 - protein, 9 aa, Homo Sapiens
YDILNWKRQ

SEQ ID NO: 1337677 - protein, 9 aa, Homo Sapiens
IIILMYRRK

SEQ ID NO: 1337678 - protein, 9 aa, Homo Sapiens
QTVVTFHSP

SEQ ID NO: 1337679 - protein, 9 aa, Homo Sapiens
HIQHHLVEK

SEQ ID NO: 1337680 - protein, 9 aa, Homo Sapiens
TQMKPNAPG

SEQ ID NO: 1337681 - protein, 9 aa, Homo Sapiens
QQHHKEVKA

SEQ ID NO: 1337682 - protein, 9 aa, Homo Sapiens
QKNKLKEMC

SEQ ID NO: 1337683 - protein, 9 aa, Homo Sapiens
WQAVWPVWQ

SEQ ID NO: 1337684 - protein, 9 aa, Homo Sapiens
QQPRVPLVL

SEQ ID NO: 1337685 - protein, 9 aa, Homo Sapiens
LLHITRLYG

SEQ ID NO: 1337686 - protein, 9 aa, Homo Sapiens
EKLLKLLDQ

SEQ ID NO: 1337687 - protein, 9 aa, Homo Sapiens
KNHSIVTNM

SEQ ID NO: 1337688 - protein, 9 aa, Homo Sapiens
YSHADAENA

SEQ ID NO: 1337689 - protein, 9 aa, Homo Sapiens
WILTGGINT

SEQ ID NO: 1337690 - protein, 9 aa, Homo Sapiens
GPMLPSQHT

SEQ ID NO: 1337691 - protein, 9 aa, Homo Sapiens
ITPRTVYTK

SEQ ID NO: 1337692 - protein, 9 aa, Homo Sapiens
VTICYHYFC

SEQ ID NO: 1337693 - protein, 9 aa, Homo Sapiens
ANHVLDELV

SEQ ID NO: 1337694 - protein, 9 aa, Homo Sapiens
SCAQIPCIP

SEQ ID NO: 1337695 - protein, 9 aa, Homo Sapiens
TRGSSIPEN

SEQ ID NO: 1337696 - protein, 9 aa, Homo Sapiens
LHTHSVSSP

SEQ ID NO: 1337697 - protein, 9 aa, Homo Sapiens
KWLVVVIMG

SEQ ID NO: 1337698 - protein, 9 aa, Homo Sapiens
EEMDVSIKK

SEQ ID NO: 1337699 - protein, 9 aa, Homo Sapiens
QWKEAIKAK

SEQ ID NO: 1337700 - protein, 9 aa, Homo Sapiens
PGKHFWYLP

SEQ ID NO: 1337701 - protein, 9 aa, Homo Sapiens
ERLEVQTRP

SEQ ID NO: 1337702 - protein, 9 aa, Homo Sapiens
EKYMQKLFQ

SEQ ID NO: 1337703 - protein, 9 aa, Homo Sapiens
TPPAQDGKK

SEQ ID NO: 1337704 - protein, 9 aa, Homo Sapiens
HWQTKLEVA

SEQ ID NO: 1337705 - protein, 9 aa, Homo Sapiens
EKKKNKELT

SEQ ID NO: 1337706 - protein, 9 aa, Homo Sapiens
HILLSSTES

SEQ ID NO: 1337707 - protein, 9 aa, Homo Sapiens
DEGYCQVQA

SEQ ID NO: 1337708 - protein, 9 aa, Homo Sapiens
CRWWGSALH

SEQ ID NO: 1337709 - protein, 9 aa, Homo Sapiens
YPHVSPSDY

SEQ ID NO: 1337710 - protein, 9 aa, Homo Sapiens
TMQIWDMAG

SEQ ID NO: 1337711 - protein, 9 aa, Homo Sapiens
EHAWLTQHQ

SEQ ID NO: 1337712 - protein, 9 aa, Homo Sapiens
ENSTGNKRE

SEQ ID NO: 1337713 - protein, 9 aa, Homo Sapiens
PRGVCYGAD

SEQ ID NO: 1337714 - protein, 9 aa, Homo Sapiens
DECDMRFTR

SEQ ID NO: 1337715 - protein, 9 aa, Homo Sapiens
ENVAYLSNT

SEQ ID NO: 1337716 - protein, 9 aa, Homo Sapiens
HSKVLKDLP

SEQ ID NO: 1337717 - protein, 9 aa, Homo Sapiens
EQWPYRVFA

SEQ ID NO: 1337718 - protein, 9 aa, Homo Sapiens
LFIVLALVE

SEQ ID NO: 1337719 - protein, 9 aa, Homo Sapiens
ITAEDSAEI

SEQ ID NO: 1337720 - protein, 9 aa, Homo Sapiens
AAPILHINS

SEQ ID NO: 1337721 - protein, 9 aa, Homo Sapiens
EEGVHLGQS

SEQ ID NO: 1337722 - protein, 9 aa, Homo Sapiens
HLLFSSCSQ

SEQ ID NO: 1337723 - protein, 9 aa, Homo Sapiens
PFYNPGDHI

SEQ ID NO: 1337724 - protein, 9 aa, Homo Sapiens
FTHLPDCKG

SEQ ID NO: 1337725 - protein, 9 aa, Homo Sapiens
ICLITLLPF

SEQ ID NO: 1337726 - protein, 9 aa, Homo Sapiens
TNIFVPSSS

SEQ ID NO: 1337727 - protein, 9 aa, Homo Sapiens
TSRTQKSAV

SEQ ID NO: 1337728 - protein, 9 aa, Homo Sapiens
DVVMFITIS

SEQ ID NO: 1337729 - protein, 9 aa, Homo Sapiens
FNELHNPDP

SEQ ID NO: 1337730 - protein, 9 aa, Homo Sapiens
MDSLYSGQN

SEQ ID NO: 1337731 - protein, 9 aa, Homo Sapiens
VSVDKAHGD

SEQ ID NO: 1337732 - protein, 9 aa, Homo Sapiens
TVNIHTRDN

SEQ ID NO: 1337733 - protein, 9 aa, Homo Sapiens
STFLNPEGD

SEQ ID NO: 1337734 - protein, 9 aa, Homo Sapiens
STGITLIGE

SEQ ID NO: 1337735 - protein, 9 aa, Homo Sapiens
MCQWCDKDF

SEQ ID NO: 1337736 - protein, 9 aa, Homo Sapiens
RWIWIDTSC

SEQ ID NO: 1337737 - protein, 9 aa, Homo Sapiens
TDLCKGKSL

SEQ ID NO: 1337738 - protein, 9 aa, Homo Sapiens
AIMHLDLAG

SEQ ID NO: 1337739 - protein, 9 aa, Homo Sapiens
EMPKTSRRC

SEQ ID NO: 1337740 - protein, 9 aa, Homo Sapiens
FLSRSDLQC

SEQ ID NO: 1337741 - protein, 9 aa, Homo Sapiens
ADLNHKFNE

SEQ ID NO: 1337742 - protein, 9 aa, Homo Sapiens
SLLRQGVPQ

SEQ ID NO: 1337743 - protein, 9 aa, Homo Sapiens
VVGSHGMPK

SEQ ID NO: 1337744 - protein, 9 aa, Homo Sapiens
QFMCQWCDK

SEQ ID NO: 1337745 - protein, 9 aa, Homo Sapiens
CSLGEELCL

SEQ ID NO: 1337746 - protein, 9 aa, Homo Sapiens
KVTGETVYN

SEQ ID NO: 1337747 - protein, 9 aa, Homo Sapiens
IMFVLCTRT

SEQ ID NO: 1337748 - protein, 9 aa, Homo Sapiens
ESTIVVKIQ

SEQ ID NO: 1337749 - protein, 9 aa, Homo Sapiens
VSVMRYSTS

SEQ ID NO: 1337750 - protein, 9 aa, Homo Sapiens
TGTQQGRAT

SEQ ID NO: 1337751 - protein, 9 aa, Homo Sapiens
DSDVIYPAR

SEQ ID NO: 1337752 - protein, 9 aa, Homo Sapiens
TLYVDMLLC

SEQ ID NO: 1337753 - protein, 9 aa, Homo Sapiens
SVCTKAPKD

SEQ ID NO: 1337754 - protein, 9 aa, Homo Sapiens
MQKTTTLVL

SEQ ID NO: 1337755 - protein, 9 aa, Homo Sapiens
AAISYDRYV

SEQ ID NO: 1337756 - protein, 9 aa, Homo Sapiens
EAKVVCEFE

SEQ ID NO: 1337757 - protein, 9 aa, Homo Sapiens
HNADVIAGF

SEQ ID NO: 1337758 - protein, 9 aa, Homo Sapiens
KQRMSLARA

SEQ ID NO: 1337759 - protein, 9 aa, Homo Sapiens
GRASAATRT

SEQ ID NO: 1337760 - protein, 9 aa, Homo Sapiens
VAFKLHINK

SEQ ID NO: 1337761 - protein, 9 aa, Homo Sapiens
TLKLVGPEG

SEQ ID NO: 1337762 - protein, 9 aa, Homo Sapiens
LELDRNNVD

SEQ ID NO: 1337763 - protein, 9 aa, Homo Sapiens
VLRHSYHLT

SEQ ID NO: 1337764 - protein, 9 aa, Homo Sapiens
CKKRNRAIM

SEQ ID NO: 1337765 - protein, 9 aa, Homo Sapiens
GFTELPDVP

SEQ ID NO: 1337766 - protein, 9 aa, Homo Sapiens
DSIVRQCDM

SEQ ID NO: 1337767 - protein, 9 aa, Homo Sapiens
QVFTEANLV

SEQ ID NO: 1337768 - protein, 9 aa, Homo Sapiens
GGLHSALLH

SEQ ID NO: 1337769 - protein, 9 aa, Homo Sapiens
APRGVCYGA

SEQ ID NO: 1337770 - protein, 9 aa, Homo Sapiens
SREKGSKEH

SEQ ID NO: 1337771 - protein, 9 aa, Homo Sapiens
ATRQNISQS

SEQ ID NO: 1337772 - protein, 9 aa, Homo Sapiens
FVAVRLYRR

SEQ ID NO: 1337773 - protein, 9 aa, Homo Sapiens
IKDLLSQMY

SEQ ID NO: 1337774 - protein, 9 aa, Homo Sapiens
RAATDLERF

SEQ ID NO: 1337775 - protein, 9 aa, Homo Sapiens
LLLPSLPGS

SEQ ID NO: 1337776 - protein, 9 aa, Homo Sapiens
NLSGAVDWV

SEQ ID NO: 1337777 - protein, 9 aa, Homo Sapiens
INDWRHFKQ

SEQ ID NO: 1337778 - protein, 9 aa, Homo Sapiens
VMPAPPEGA

SEQ ID NO: 1337779 - protein, 9 aa, Homo Sapiens
EYVVNEVVA

SEQ ID NO: 1337780 - protein, 9 aa, Homo Sapiens
REENVRHIA

SEQ ID NO: 1337781 - protein, 9 aa, Homo Sapiens
PLLRHHLKT

SEQ ID NO: 1337782 - protein, 9 aa, Homo Sapiens
ILFCIIAIT

SEQ ID NO: 1337783 - protein, 9 aa, Homo Sapiens
TCPLANSQY

SEQ ID NO: 1337784 - protein, 9 aa, Homo Sapiens
LEHLKIFYC

SEQ ID NO: 1337785 - protein, 9 aa, Homo Sapiens
MRHLWRPDV

SEQ ID NO: 1337786 - protein, 9 aa, Homo Sapiens
NYCTPPHRS

SEQ ID NO: 1337787 - protein, 9 aa, Homo Sapiens
LTNILKEID

SEQ ID NO: 1337788 - protein, 9 aa, Homo Sapiens
GLSRHQVLT

SEQ ID NO: 1337789 - protein, 9 aa, Homo Sapiens
RVHEKQKLF

SEQ ID NO: 1337790 - protein, 9 aa, Homo Sapiens
CTKFTLLQV

SEQ ID NO: 1337791 - protein, 9 aa, Homo Sapiens
SKMLVNFLA

SEQ ID NO: 1337792 - protein, 9 aa, Homo Sapiens
VMCSDSETS

SEQ ID NO: 1337793 - protein, 9 aa, Homo Sapiens
RSLLTFIFF

SEQ ID NO: 1337794 - protein, 9 aa, Homo Sapiens
EAKEKVTGI

SEQ ID NO: 1337795 - protein, 9 aa, Homo Sapiens
KIFFKATRQ

SEQ ID NO: 1337796 - protein, 9 aa, Homo Sapiens
SPGSRSSSV

SEQ ID NO: 1337797 - protein, 9 aa, Homo Sapiens
AVSTLEEDH

SEQ ID NO: 1337798 - protein, 9 aa, Homo Sapiens
REHLLGICD

SEQ ID NO: 1337799 - protein, 9 aa, Homo Sapiens
QLGAVCAWE

SEQ ID NO: 1337800 - protein, 9 aa, Homo Sapiens
TGNRGETRE

SEQ ID NO: 1337801 - protein, 9 aa, Homo Sapiens
NYQALDTDF

SEQ ID NO: 1337802 - protein, 9 aa, Homo Sapiens
ISDIWAIHV

SEQ ID NO: 1337803 - protein, 9 aa, Homo Sapiens
ICLLTRGRH

SEQ ID NO: 1337804 - protein, 9 aa, Homo Sapiens
DKSDKYDAC

SEQ ID NO: 1337805 - protein, 9 aa, Homo Sapiens
SYVVWKCCE

SEQ ID NO: 1337806 - protein, 9 aa, Homo Sapiens
FHPSGTVMA

SEQ ID NO: 1337807 - protein, 9 aa, Homo Sapiens
SDHKNLGLV

SEQ ID NO: 1337808 - protein, 9 aa, Homo Sapiens
TENPEKSIS

SEQ ID NO: 1337809 - protein, 9 aa, Homo Sapiens
GFTVDKAFL

SEQ ID NO: 1337810 - protein, 9 aa, Homo Sapiens
SDYMNMTPH

SEQ ID NO: 1337811 - protein, 9 aa, Homo Sapiens
IVDEINVKY

SEQ ID NO: 1337812 - protein, 9 aa, Homo Sapiens
FGCRPPQIL

SEQ ID NO: 1337813 - protein, 9 aa, Homo Sapiens
VKCSTAPFN

SEQ ID NO: 1337814 - protein, 9 aa, Homo Sapiens
LVGIHGGDP

SEQ ID NO: 1337815 - protein, 9 aa, Homo Sapiens
FAYMEGESL

SEQ ID NO: 1337816 - protein, 9 aa, Homo Sapiens
SSTVCFNIV

SEQ ID NO: 1337817 - protein, 9 aa, Homo Sapiens
YPEGKDTLW

SEQ ID NO: 1337818 - protein, 9 aa, Homo Sapiens
PTLHIGSVS

SEQ ID NO: 1337819 - protein, 9 aa, Homo Sapiens
PGSCKKAPL

SEQ ID NO: 1337820 - protein, 9 aa, Homo Sapiens
CVNMCEQVL

SEQ ID NO: 1337821 - protein, 9 aa, Homo Sapiens
ALLARDADL

SEQ ID NO: 1337822 - protein, 9 aa, Homo Sapiens
AMELAARAV

SEQ ID NO: 1337823 - protein, 9 aa, Homo Sapiens
LQQVVNLNS

SEQ ID NO: 1337824 - protein, 9 aa, Homo Sapiens
KKLEKKNKT

SEQ ID NO: 1337825 - protein, 9 aa, Homo Sapiens
TTWPPSRNP

SEQ ID NO: 1337826 - protein, 9 aa, Homo Sapiens
VKLAGQEDL

SEQ ID NO: 1337827 - protein, 9 aa, Homo Sapiens
MLFCETVER

SEQ ID NO: 1337828 - protein, 9 aa, Homo Sapiens
HPHPHPREA

SEQ ID NO: 1337829 - protein, 9 aa, Homo Sapiens
DGLHPLWPT

SEQ ID NO: 1337830 - protein, 9 aa, Homo Sapiens
LMRICVQAH

SEQ ID NO: 1337831 - protein, 9 aa, Homo Sapiens
DCCLRATHP

SEQ ID NO: 1337832 - protein, 9 aa, Homo Sapiens
ATVTHLVGA

SEQ ID NO: 1337833 - protein, 9 aa, Homo Sapiens
AKALEELWA

SEQ ID NO: 1337834 - protein, 9 aa, Homo Sapiens
WSRGWYSRG

SEQ ID NO: 1337835 - protein, 9 aa, Homo Sapiens
EASASQVSC

SEQ ID NO: 1337836 - protein, 9 aa, Homo Sapiens
KYHDSIEKA

SEQ ID NO: 1337837 - protein, 9 aa, Homo Sapiens
VVSMLVSSW

SEQ ID NO: 1337838 - protein, 9 aa, Homo Sapiens
DLLRDPRAS

SEQ ID NO: 1337839 - protein, 9 aa, Homo Sapiens
WIQFQEGFA

SEQ ID NO: 1337840 - protein, 9 aa, Homo Sapiens
ECQQSHYYG

SEQ ID NO: 1337841 - protein, 9 aa, Homo Sapiens
ERQDECDVS

SEQ ID NO: 1337842 - protein, 9 aa, Homo Sapiens
WLLPAPWPP

SEQ ID NO: 1337843 - protein, 9 aa, Homo Sapiens
QERQEVFVH

SEQ ID NO: 1337844 - protein, 9 aa, Homo Sapiens
LDILTEKEI

SEQ ID NO: 1337845 - protein, 9 aa, Homo Sapiens
RDRCRVTQL

SEQ ID NO: 1337846 - protein, 9 aa, Homo Sapiens
VVELQLRAA

SEQ ID NO: 1337847 - protein, 9 aa, Homo Sapiens
SSHDNAFFK

SEQ ID NO: 1337848 - protein, 9 aa, Homo Sapiens
PPTPPAPAP

SEQ ID NO: 1337849 - protein, 9 aa, Homo Sapiens
VNYMMSSHS

SEQ ID NO: 1337850 - protein, 9 aa, Homo Sapiens
AMAISEECK

SEQ ID NO: 1337851 - protein, 9 aa, Homo Sapiens
PSSTTTDGN

SEQ ID NO: 1337852 - protein, 9 aa, Homo Sapiens
NDEWVQCAL

SEQ ID NO: 1337853 - protein, 9 aa, Homo Sapiens
SWSKLCHIN

SEQ ID NO: 1337854 - protein, 9 aa, Homo Sapiens
LIIIIVFFF

SEQ ID NO: 1337855 - protein, 9 aa, Homo Sapiens
DFHPSGTVM

SEQ ID NO: 1337856 - protein, 9 aa, Homo Sapiens
IRKTSQVLT

SEQ ID NO: 1337857 - protein, 9 aa, Homo Sapiens
GISQLEHDL

SEQ ID NO: 1337858 - protein, 9 aa, Homo Sapiens
KPGDIDNQP

SEQ ID NO: 1337859 - protein, 9 aa, Homo Sapiens
DIILNFHTT

SEQ ID NO: 1337860 - protein, 9 aa, Homo Sapiens
ISRSFFLWN

SEQ ID NO: 1337861 - protein, 9 aa, Homo Sapiens
PSNTANRIS

SEQ ID NO: 1337862 - protein, 9 aa, Homo Sapiens
SDSLRWDVA

SEQ ID NO: 1337863 - protein, 9 aa, Homo Sapiens
GPLDETQIT

SEQ ID NO: 1337864 - protein, 9 aa, Homo Sapiens
GATPWNIFP

SEQ ID NO: 1337865 - protein, 9 aa, Homo Sapiens
KEVCKELHH

SEQ ID NO: 1337866 - protein, 9 aa, Homo Sapiens
HQRRGRGKG

SEQ ID NO: 1337867 - protein, 9 aa, Homo Sapiens
CPSQLGAVC

SEQ ID NO: 1337868 - protein, 9 aa, Homo Sapiens
PPQHLTWLT

SEQ ID NO: 1337869 - protein, 9 aa, Homo Sapiens
ELSPTEEEA

SEQ ID NO: 1337870 - protein, 9 aa, Homo Sapiens
VMQCWCCKR

SEQ ID NO: 1337871 - protein, 9 aa, Homo Sapiens
MYITSNPMS

SEQ ID NO: 1337872 - protein, 9 aa, Homo Sapiens
FCFVEYYSH

SEQ ID NO: 1337873 - protein, 9 aa, Homo Sapiens
NLYKISLRN

SEQ ID NO: 1337874 - protein, 9 aa, Homo Sapiens
TVSGPLLQW

SEQ ID NO: 1337875 - protein, 9 aa, Homo Sapiens
FARCLSSLN

SEQ ID NO: 1337876 - protein, 9 aa, Homo Sapiens
IDGNSEDDI

SEQ ID NO: 1337877 - protein, 9 aa, Homo Sapiens
EKLYINCIA

SEQ ID NO: 1337878 - protein, 9 aa, Homo Sapiens
TWVPPFPIC

SEQ ID NO: 1337879 - protein, 9 aa, Homo Sapiens
NPPIFPPPS

SEQ ID NO: 1337880 - protein, 9 aa, Homo Sapiens
LSSNRECFL

SEQ ID NO: 1337881 - protein, 9 aa, Homo Sapiens
FTDTYQAFK

SEQ ID NO: 1337882 - protein, 9 aa, Homo Sapiens
GYQWLDLCK

SEQ ID NO: 1337883 - protein, 9 aa, Homo Sapiens
PVPSPVPLT

SEQ ID NO: 1337884 - protein, 9 aa, Homo Sapiens
QRKCEHLLL

SEQ ID NO: 1337885 - protein, 9 aa, Homo Sapiens
LCTRTVRTR

SEQ ID NO: 1337886 - protein, 9 aa, Homo Sapiens
VQDAESDLV

SEQ ID NO: 1337887 - protein, 9 aa, Homo Sapiens
GKGTEVPWP

SEQ ID NO: 1337888 - protein, 9 aa, Homo Sapiens
LTIRSLQID

SEQ ID NO: 1337889 - protein, 9 aa, Homo Sapiens
LTSQFINGE

SEQ ID NO: 1337890 - protein, 9 aa, Homo Sapiens
LQCSPPVRL

SEQ ID NO: 1337891 - protein, 9 aa, Homo Sapiens
QTYDVSSLP

SEQ ID NO: 1337892 - protein, 9 aa, Homo Sapiens
VRPGPHQLI

SEQ ID NO: 1337893 - protein, 9 aa, Homo Sapiens
SAYWHSLHP

SEQ ID NO: 1337894 - protein, 9 aa, Homo Sapiens
QVSKPCAHQ

SEQ ID NO: 1337895 - protein, 9 aa, Homo Sapiens
LEEVIREGW

SEQ ID NO: 1337896 - protein, 9 aa, Homo Sapiens
AYYRGTVGA

SEQ ID NO: 1337897 - protein, 9 aa, Homo Sapiens
YIIPKNMLV

SEQ ID NO: 1337898 - protein, 9 aa, Homo Sapiens
EPTFSGEEA

SEQ ID NO: 1337899 - protein, 9 aa, Homo Sapiens
IEAVTVSWF

SEQ ID NO: 1337900 - protein, 9 aa, Homo Sapiens
EVIKNPDSI

SEQ ID NO: 1337901 - protein, 9 aa, Homo Sapiens
VSRWMTSLI

SEQ ID NO: 1337902 - protein, 9 aa, Homo Sapiens
EWRLHSVQG

SEQ ID NO: 1337903 - protein, 9 aa, Homo Sapiens
FHHLHHLEV

SEQ ID NO: 1337904 - protein, 9 aa, Homo Sapiens
VTLKELNTR

SEQ ID NO: 1337905 - protein, 9 aa, Homo Sapiens
QNQVPRLTG

SEQ ID NO: 1337906 - protein, 9 aa, Homo Sapiens
DDTTTKHWL

SEQ ID NO: 1337907 - protein, 9 aa, Homo Sapiens
KTGNLYLWG

SEQ ID NO: 1337908 - protein, 9 aa, Homo Sapiens
KSMQVPFSG

SEQ ID NO: 1337909 - protein, 9 aa, Homo Sapiens
FFLFPDSFY

SEQ ID NO: 1337910 - protein, 9 aa, Homo Sapiens
LLELPIASR

SEQ ID NO: 1337911 - protein, 9 aa, Homo Sapiens
VKPSWIHCI

SEQ ID NO: 1337912 - protein, 9 aa, Homo Sapiens
VEKVQMYRC

SEQ ID NO: 1337913 - protein, 9 aa, Homo Sapiens
CMHAIFTNK

SEQ ID NO: 1337914 - protein, 9 aa, Homo Sapiens
YKQAKCNAR

SEQ ID NO: 1337915 - protein, 9 aa, Homo Sapiens
EESFDTGSD

SEQ ID NO: 1337916 - protein, 9 aa, Homo Sapiens
YCGRSYKQH

SEQ ID NO: 1337917 - protein, 9 aa, Homo Sapiens
YRSNFVLYN

SEQ ID NO: 1337918 - protein, 9 aa, Homo Sapiens
DKKRLVHKE

SEQ ID NO: 1337919 - protein, 9 aa, Homo Sapiens
EEIIGSLDT

SEQ ID NO: 1337920 - protein, 9 aa, Homo Sapiens
TFTLSSQVP

SEQ ID NO: 1337921 - protein, 9 aa, Homo Sapiens
PALVLCVLL

SEQ ID NO: 1337922 - protein, 9 aa, Homo Sapiens
LASVSEKGT

SEQ ID NO: 1337923 - protein, 9 aa, Homo Sapiens
PLCSPPSPQ

SEQ ID NO: 1337924 - protein, 9 aa, Homo Sapiens
PDSKLDQDL

SEQ ID NO: 1337925 - protein, 9 aa, Homo Sapiens
LWHRFNRPL

SEQ ID NO: 1337926 - protein, 9 aa, Homo Sapiens
HGNGTQQVF

SEQ ID NO: 1337927 - protein, 9 aa, Homo Sapiens
PEKCSLEAY

SEQ ID NO: 1337928 - protein, 9 aa, Homo Sapiens
PIASRIHLK

SEQ ID NO: 1337929 - protein, 9 aa, Homo Sapiens
GSRQLGEQQ

SEQ ID NO: 1337930 - protein, 9 aa, Homo Sapiens
SSSLWKAVK

SEQ ID NO: 1337931 - protein, 9 aa, Homo Sapiens
PYCVDENME

SEQ ID NO: 1337932 - protein, 9 aa, Homo Sapiens
SPTTPSPAS

SEQ ID NO: 1337933 - protein, 9 aa, Homo Sapiens
QMENLQDVI

SEQ ID NO: 1337934 - protein, 9 aa, Homo Sapiens
HRPGTPPPL

SEQ ID NO: 1337935 - protein, 9 aa, Homo Sapiens
SANFSNRPV

SEQ ID NO: 1337936 - protein, 9 aa, Homo Sapiens
HQVQQHKVL

SEQ ID NO: 1337937 - protein, 9 aa, Homo Sapiens
DTNSHNDDT

SEQ ID NO: 1337938 - protein, 9 aa, Homo Sapiens
LGLVRIRCV

SEQ ID NO: 1337939 - protein, 9 aa, Homo Sapiens
KKKVRSLHT

SEQ ID NO: 1337940 - protein, 9 aa, Homo Sapiens
GDIRAGLPT

SEQ ID NO: 1337941 - protein, 9 aa, Homo Sapiens
KKEMPEILK

SEQ ID NO: 1337942 - protein, 9 aa, Homo Sapiens
TQDTTSESR

SEQ ID NO: 1337943 - protein, 9 aa, Homo Sapiens
RGRDQIKKR

SEQ ID NO: 1337944 - protein, 9 aa, Homo Sapiens
RCNQEAHQE

SEQ ID NO: 1337945 - protein, 9 aa, Homo Sapiens
ASEDIQLEA

SEQ ID NO: 1337946 - protein, 9 aa, Homo Sapiens
TPPAPAPPG

SEQ ID NO: 1337947 - protein, 9 aa, Homo Sapiens
HVLRQTPPL

SEQ ID NO: 1337948 - protein, 9 aa, Homo Sapiens
RYFTTYDMN

SEQ ID NO: 1337949 - protein, 9 aa, Homo Sapiens
DLMEKSSKA

SEQ ID NO: 1337950 - protein, 9 aa, Homo Sapiens
HQLIASLDS

SEQ ID NO: 1337951 - protein, 9 aa, Homo Sapiens
ICFPVCVEV

SEQ ID NO: 1337952 - protein, 9 aa, Homo Sapiens
VIRIEKHQN

SEQ ID NO: 1337953 - protein, 9 aa, Homo Sapiens
PVDKYRMRK

SEQ ID NO: 1337954 - protein, 9 aa, Homo Sapiens
LEAKKKCDE

SEQ ID NO: 1337955 - protein, 9 aa, Homo Sapiens
RKPDIGDHQ

SEQ ID NO: 1337956 - protein, 9 aa, Homo Sapiens
QSHYYGSEV

SEQ ID NO: 1337957 - protein, 9 aa, Homo Sapiens
AIAGMYKQC

SEQ ID NO: 1337958 - protein, 9 aa, Homo Sapiens
SAYLDELHL

SEQ ID NO: 1337959 - protein, 9 aa, Homo Sapiens
LSGYYRMDG

SEQ ID NO: 1337960 - protein, 9 aa, Homo Sapiens
VFKWDYMMP

SEQ ID NO: 1337961 - protein, 9 aa, Homo Sapiens
TVLHDSKIM

SEQ ID NO: 1337962 - protein, 9 aa, Homo Sapiens
AAYPQTSGG

SEQ ID NO: 1337963 - protein, 9 aa, Homo Sapiens
RWKTLLIPP

SEQ ID NO: 1337964 - protein, 9 aa, Homo Sapiens
PTKPVIAKK

SEQ ID NO: 1337965 - protein, 9 aa, Homo Sapiens
EHHDHVIFL

SEQ ID NO: 1337966 - protein, 9 aa, Homo Sapiens
LYPHLYEDT

SEQ ID NO: 1337967 - protein, 9 aa, Homo Sapiens
GDVGFGRSS

SEQ ID NO: 1337968 - protein, 9 aa, Homo Sapiens
HNHPPRKIS

SEQ ID NO: 1337969 - protein, 9 aa, Homo Sapiens
CLHAEDSAP

SEQ ID NO: 1337970 - protein, 9 aa, Homo Sapiens
IAGSKKKSI

SEQ ID NO: 1337971 - protein, 9 aa, Homo Sapiens
FHGDSANCS

SEQ ID NO: 1337972 - protein, 9 aa, Homo Sapiens
YFILVDRYM

SEQ ID NO: 1337973 - protein, 9 aa, Homo Sapiens
KDEDQTSLA

SEQ ID NO: 1337974 - protein, 9 aa, Homo Sapiens
FTADEKVDI

SEQ ID NO: 1337975 - protein, 9 aa, Homo Sapiens
CKRLYRIGL

SEQ ID NO: 1337976 - protein, 9 aa, Homo Sapiens
YFQPYTYSQ

SEQ ID NO: 1337977 - protein, 9 aa, Homo Sapiens
SKLCKLEAS

SEQ ID NO: 1337978 - protein, 9 aa, Homo Sapiens
SKKKGEDLF

SEQ ID NO: 1337979 - protein, 9 aa, Homo Sapiens
MWSELQARG

SEQ ID NO: 1337980 - protein, 9 aa, Homo Sapiens
LPECVEPDR

SEQ ID NO: 1337981 - protein, 9 aa, Homo Sapiens
EECKAGAYL

SEQ ID NO: 1337982 - protein, 9 aa, Homo Sapiens
PGPRPLCPH

SEQ ID NO: 1337983 - protein, 9 aa, Homo Sapiens
KTIKVYCQH

SEQ ID NO: 1337984 - protein, 9 aa, Homo Sapiens
VCTALQHGA

SEQ ID NO: 1337985 - protein, 9 aa, Homo Sapiens
CNSDHVLKR

SEQ ID NO: 1337986 - protein, 9 aa, Homo Sapiens
QPSSLSQEV

SEQ ID NO: 1337987 - protein, 9 aa, Homo Sapiens
CSQASHSEP

SEQ ID NO: 1337988 - protein, 9 aa, Homo Sapiens
NPEDTYERC

SEQ ID NO: 1337989 - protein, 9 aa, Homo Sapiens
VSELRVGRL

SEQ ID NO: 1337990 - protein, 9 aa, Homo Sapiens
NATVTHLVG

SEQ ID NO: 1337991 - protein, 9 aa, Homo Sapiens
AEHSARYQY

SEQ ID NO: 1337992 - protein, 9 aa, Homo Sapiens
HPPRKRHAT

SEQ ID NO: 1337993 - protein, 9 aa, Homo Sapiens
PREHQPLSI

SEQ ID NO: 1337994 - protein, 9 aa, Homo Sapiens
SPSNYVCRE

SEQ ID NO: 1337995 - protein, 9 aa, Homo Sapiens
LDTRFWMWI

SEQ ID NO: 1337996 - protein, 9 aa, Homo Sapiens
LSMVFPHVT

SEQ ID NO: 1337997 - protein, 9 aa, Homo Sapiens
EKCHSIRRQ

SEQ ID NO: 1337998 - protein, 9 aa, Homo Sapiens
SKQESYEES

SEQ ID NO: 1337999 - protein, 9 aa, Homo Sapiens
PNDLYLMSG

SEQ ID NO: 1338000 - protein, 9 aa, Homo Sapiens
QTWWEKPCT

SEQ ID NO: 1338001 - protein, 9 aa, Homo Sapiens
GALGSITLL

SEQ ID NO: 1338002 - protein, 9 aa, Homo Sapiens
SRSKERRWS

SEQ ID NO: 1338003 - protein, 9 aa, Homo Sapiens
QKLEAKKKC

SEQ ID NO: 1338004 - protein, 9 aa, Homo Sapiens
MAVTYTVVT

SEQ ID NO: 1338005 - protein, 9 aa, Homo Sapiens
VATGIWGFV

SEQ ID NO: 1338006 - protein, 9 aa, Homo Sapiens
SLELTHTTP

SEQ ID NO: 1338007 - protein, 9 aa, Homo Sapiens
YKSLPLWDD

SEQ ID NO: 1338008 - protein, 9 aa, Homo Sapiens
VIQRGSLGV

SEQ ID NO: 1338009 - protein, 9 aa, Homo Sapiens
LAGYLEKVC

SEQ ID NO: 1338010 - protein, 9 aa, Homo Sapiens
ERCMVKKSR

SEQ ID NO: 1338011 - protein, 9 aa, Homo Sapiens
TADLPYQFA

SEQ ID NO: 1338012 - protein, 9 aa, Homo Sapiens
VKEDTQLGT

SEQ ID NO: 1338013 - protein, 9 aa, Homo Sapiens
DEKNETKKK

SEQ ID NO: 1338014 - protein, 9 aa, Homo Sapiens
LLNQEEGKY

SEQ ID NO: 1338015 - protein, 9 aa, Homo Sapiens
TAVTDPQYR

SEQ ID NO: 1338016 - protein, 9 aa, Homo Sapiens
VFVVEGKAP

SEQ ID NO: 1338017 - protein, 9 aa, Homo Sapiens
ITPTTGVPT

SEQ ID NO: 1338018 - protein, 9 aa, Homo Sapiens
SRGEGDCNV

SEQ ID NO: 1338019 - protein, 9 aa, Homo Sapiens
QMMHWLKGE

SEQ ID NO: 1338020 - protein, 9 aa, Homo Sapiens
FHLPIFSSI

SEQ ID NO: 1338021 - protein, 9 aa, Homo Sapiens
MPSVICEHI

SEQ ID NO: 1338022 - protein, 9 aa, Homo Sapiens
MHDENVDLW

SEQ ID NO: 1338023 - protein, 9 aa, Homo Sapiens
HAQVSQPFR

SEQ ID NO: 1338024 - protein, 9 aa, Homo Sapiens
EVILLRRSM

SEQ ID NO: 1338025 - protein, 9 aa, Homo Sapiens
GGGGGQKPG

SEQ ID NO: 1338026 - protein, 9 aa, Homo Sapiens
TPPYRDWTL

SEQ ID NO: 1338027 - protein, 9 aa, Homo Sapiens
SAPPQPTAA

SEQ ID NO: 1338028 - protein, 9 aa, Homo Sapiens
TRFWMWINH

SEQ ID NO: 1338029 - protein, 9 aa, Homo Sapiens
KDPHFSKIL

SEQ ID NO: 1338030 - protein, 9 aa, Homo Sapiens
GGRGHASQR

SEQ ID NO: 1338031 - protein, 9 aa, Homo Sapiens
PCGTCDLVL

SEQ ID NO: 1338032 - protein, 9 aa, Homo Sapiens
CGGVQCENV

SEQ ID NO: 1338033 - protein, 9 aa, Homo Sapiens
GKQPNMETD

SEQ ID NO: 1338034 - protein, 9 aa, Homo Sapiens
GLLQKPRVY

SEQ ID NO: 1338035 - protein, 9 aa, Homo Sapiens
HTEDGIIIA

SEQ ID NO: 1338036 - protein, 9 aa, Homo Sapiens
DYISMAVVD

SEQ ID NO: 1338037 - protein, 9 aa, Homo Sapiens
AVIVYCLSV

SEQ ID NO: 1338038 - protein, 9 aa, Homo Sapiens
TQLALLDGP

SEQ ID NO: 1338039 - protein, 9 aa, Homo Sapiens
MIAEKLRQA

SEQ ID NO: 1338040 - protein, 9 aa, Homo Sapiens
ASQMGPWDV

SEQ ID NO: 1338041 - protein, 9 aa, Homo Sapiens
LKKCSLYGK

SEQ ID NO: 1338042 - protein, 9 aa, Homo Sapiens
FSAMLPKIT

SEQ ID NO: 1338043 - protein, 9 aa, Homo Sapiens
ERAWTHRLR

SEQ ID NO: 1338044 - protein, 9 aa, Homo Sapiens
TPPRALAAG

SEQ ID NO: 1338045 - protein, 9 aa, Homo Sapiens
TSDSAEKCR

SEQ ID NO: 1338046 - protein, 9 aa, Homo Sapiens
SNDSHGSVL

SEQ ID NO: 1338047 - protein, 9 aa, Homo Sapiens
SECLCIPAC

SEQ ID NO: 1338048 - protein, 9 aa, Homo Sapiens
TSSLSSSST

SEQ ID NO: 1338049 - protein, 9 aa, Homo Sapiens
QNLINVCTK

SEQ ID NO: 1338050 - protein, 9 aa, Homo Sapiens
FHTEEDISG

SEQ ID NO: 1338051 - protein, 9 aa, Homo Sapiens
RGVIANSLT

SEQ ID NO: 1338052 - protein, 9 aa, Homo Sapiens
SKCLMKRHV

SEQ ID NO: 1338053 - protein, 9 aa, Homo Sapiens
FQHNGKKWN

SEQ ID NO: 1338054 - protein, 9 aa, Homo Sapiens
CHMKREHPA

SEQ ID NO: 1338055 - protein, 9 aa, Homo Sapiens
TAKASEITS

SEQ ID NO: 1338056 - protein, 9 aa, Homo Sapiens
RMFLATHKG

SEQ ID NO: 1338057 - protein, 9 aa, Homo Sapiens
SEHCYVIYR

SEQ ID NO: 1338058 - protein, 9 aa, Homo Sapiens
GSPSSDQQF

SEQ ID NO: 1338059 - protein, 9 aa, Homo Sapiens
STDICFYID

SEQ ID NO: 1338060 - protein, 9 aa, Homo Sapiens
QVRGIKTFP

SEQ ID NO: 1338061 - protein, 9 aa, Homo Sapiens
VVPIPPQMG

SEQ ID NO: 1338062 - protein, 9 aa, Homo Sapiens
LAKHIYTKL

SEQ ID NO: 1338063 - protein, 9 aa, Homo Sapiens
GIVNTSISL

SEQ ID NO: 1338064 - protein, 9 aa, Homo Sapiens
LPRTLMAPQ

SEQ ID NO: 1338065 - protein, 9 aa, Homo Sapiens
SGDKQCTYT

SEQ ID NO: 1338066 - protein, 9 aa, Homo Sapiens
TQQLIQTYE

SEQ ID NO: 1338067 - protein, 9 aa, Homo Sapiens
TRGCSPPYQ

SEQ ID NO: 1338068 - protein, 9 aa, Homo Sapiens
CEWCSIDGS

SEQ ID NO: 1338069 - protein, 9 aa, Homo Sapiens
TRNRDDPAD

SEQ ID NO: 1338070 - protein, 9 aa, Homo Sapiens
GCLYMTCAK

SEQ ID NO: 1338071 - protein, 9 aa, Homo Sapiens
LHGKTHHPH

SEQ ID NO: 1338072 - protein, 9 aa, Homo Sapiens
FLHQSVKNV

SEQ ID NO: 1338073 - protein, 9 aa, Homo Sapiens
PKGEDFYCM

SEQ ID NO: 1338074 - protein, 9 aa, Homo Sapiens
MSLEERRSS

SEQ ID NO: 1338075 - protein, 9 aa, Homo Sapiens
CTGAIIPEL

SEQ ID NO: 1338076 - protein, 9 aa, Homo Sapiens
IDCVECLLL

SEQ ID NO: 1338077 - protein, 9 aa, Homo Sapiens
QKGKAGGHV

SEQ ID NO: 1338078 - protein, 9 aa, Homo Sapiens
FLLRSQLRV

SEQ ID NO: 1338079 - protein, 9 aa, Homo Sapiens
WLRLRPCNL

SEQ ID NO: 1338080 - protein, 9 aa, Homo Sapiens
VTCSHIDVM

SEQ ID NO: 1338081 - protein, 9 aa, Homo Sapiens
KDQIKMLST

SEQ ID NO: 1338082 - protein, 9 aa, Homo Sapiens
TCSSYSGEL

SEQ ID NO: 1338083 - protein, 9 aa, Homo Sapiens
VIAGLMKIV

SEQ ID NO: 1338084 - protein, 9 aa, Homo Sapiens
TESFDPLFV

SEQ ID NO: 1338085 - protein, 9 aa, Homo Sapiens
SCLSNTPAH

SEQ ID NO: 1338086 - protein, 9 aa, Homo Sapiens
ASVEKQRVR

SEQ ID NO: 1338087 - protein, 9 aa, Homo Sapiens
SLITLREFM

SEQ ID NO: 1338088 - protein, 9 aa, Homo Sapiens
PLRTSLTSL

SEQ ID NO: 1338089 - protein, 9 aa, Homo Sapiens
PSSEKIAVI

SEQ ID NO: 1338090 - protein, 9 aa, Homo Sapiens
LQGTGCIAD

SEQ ID NO: 1338091 - protein, 9 aa, Homo Sapiens
VTEEDVKMK

SEQ ID NO: 1338092 - protein, 9 aa, Homo Sapiens
IHLRGEAVH

SEQ ID NO: 1338093 - protein, 9 aa, Homo Sapiens
ERKRHEVTL

SEQ ID NO: 1338094 - protein, 9 aa, Homo Sapiens
QGVSQHLLP

SEQ ID NO: 1338095 - protein, 9 aa, Homo Sapiens
LRSNIACDG

SEQ ID NO: 1338096 - protein, 9 aa, Homo Sapiens
SSSEFYKVQ

SEQ ID NO: 1338097 - protein, 9 aa, Homo Sapiens
RKFYVHIKH

SEQ ID NO: 1338098 - protein, 9 aa, Homo Sapiens
DPIIVMVLN

SEQ ID NO: 1338099 - protein, 9 aa, Homo Sapiens
LPQAFPALH

SEQ ID NO: 1338100 - protein, 9 aa, Homo Sapiens
HPYSPAHPT

SEQ ID NO: 1338101 - protein, 9 aa, Homo Sapiens
HMRLETRTH

SEQ ID NO: 1338102 - protein, 9 aa, Homo Sapiens
ETSQGRTKP

SEQ ID NO: 1338103 - protein, 9 aa, Homo Sapiens
AAIIEELVV

SEQ ID NO: 1338104 - protein, 9 aa, Homo Sapiens
MHDILNMEK

SEQ ID NO: 1338105 - protein, 9 aa, Homo Sapiens
LVKETRKRI

SEQ ID NO: 1338106 - protein, 9 aa, Homo Sapiens
RLHRKRPPR

SEQ ID NO: 1338107 - protein, 9 aa, Homo Sapiens
KLLSAAGPA

SEQ ID NO: 1338108 - protein, 9 aa, Homo Sapiens
AYLAHFLIK

SEQ ID NO: 1338109 - protein, 9 aa, Homo Sapiens
GFTIDNTCI

SEQ ID NO: 1338110 - protein, 9 aa, Homo Sapiens
MLRKRHYWR

SEQ ID NO: 1338111 - protein, 9 aa, Homo Sapiens
CTLEIESYD

SEQ ID NO: 1338112 - protein, 9 aa, Homo Sapiens
SPWPSSSTN

SEQ ID NO: 1338113 - protein, 9 aa, Homo Sapiens
SKLWSAIPP

SEQ ID NO: 1338114 - protein, 9 aa, Homo Sapiens
LLHLYQECE

SEQ ID NO: 1338115 - protein, 9 aa, Homo Sapiens
RPQFLLPGP

SEQ ID NO: 1338116 - protein, 9 aa, Homo Sapiens
EGNVSFLSD

SEQ ID NO: 1338117 - protein, 9 aa, Homo Sapiens
VHHHATAYR

SEQ ID NO: 1338118 - protein, 9 aa, Homo Sapiens
PYLGTFPIN

SEQ ID NO: 1338119 - protein, 9 aa, Homo Sapiens
SKGPWSSTG

SEQ ID NO: 1338120 - protein, 9 aa, Homo Sapiens
CMHERTHTG

SEQ ID NO: 1338121 - protein, 9 aa, Homo Sapiens
DHLITEPLP

SEQ ID NO: 1338122 - protein, 9 aa, Homo Sapiens
PNLVDAAKA

SEQ ID NO: 1338123 - protein, 9 aa, Homo Sapiens
KKKEAYSAA

SEQ ID NO: 1338124 - protein, 9 aa, Homo Sapiens
ALFYQGPGW

SEQ ID NO: 1338125 - protein, 9 aa, Homo Sapiens
VAVLASLLV

SEQ ID NO: 1338126 - protein, 9 aa, Homo Sapiens
LAVFLLFFW

SEQ ID NO: 1338127 - protein, 9 aa, Homo Sapiens
NGGGTFMFP

SEQ ID NO: 1338128 - protein, 9 aa, Homo Sapiens
AEASASQVS

SEQ ID NO: 1338129 - protein, 9 aa, Homo Sapiens
IADVFAQIN

SEQ ID NO: 1338130 - protein, 9 aa, Homo Sapiens
KFPQLGATL

SEQ ID NO: 1338131 - protein, 9 aa, Homo Sapiens
TGVTSEDFL

SEQ ID NO: 1338132 - protein, 9 aa, Homo Sapiens
GLVLIITPW

SEQ ID NO: 1338133 - protein, 9 aa, Homo Sapiens
ALIVPVPEA

SEQ ID NO: 1338134 - protein, 9 aa, Homo Sapiens
TTPHPTTLD

SEQ ID NO: 1338135 - protein, 9 aa, Homo Sapiens
NGTYEVSVY

SEQ ID NO: 1338136 - protein, 9 aa, Homo Sapiens
EEVSAAESA

SEQ ID NO: 1338137 - protein, 9 aa, Homo Sapiens
TPQNSPLSS

SEQ ID NO: 1338138 - protein, 9 aa, Homo Sapiens
SMVFLSRTS

SEQ ID NO: 1338139 - protein, 9 aa, Homo Sapiens
GLDQKMCPF

SEQ ID NO: 1338140 - protein, 9 aa, Homo Sapiens
VLLECLGSP

SEQ ID NO: 1338141 - protein, 9 aa, Homo Sapiens
TWAVPQVLQ

SEQ ID NO: 1338142 - protein, 9 aa, Homo Sapiens
LTQKPLAVS

SEQ ID NO: 1338143 - protein, 9 aa, Homo Sapiens
EGFSKRKLR

SEQ ID NO: 1338144 - protein, 9 aa, Homo Sapiens
SQLMEQLWL

SEQ ID NO: 1338145 - protein, 9 aa, Homo Sapiens
RQEALEMSC

SEQ ID NO: 1338146 - protein, 9 aa, Homo Sapiens
TLVIVCACW

SEQ ID NO: 1338147 - protein, 9 aa, Homo Sapiens
INIHSMSCN

SEQ ID NO: 1338148 - protein, 9 aa, Homo Sapiens
PPSPQNRSR

SEQ ID NO: 1338149 - protein, 9 aa, Homo Sapiens
ALIQRLEAL

SEQ ID NO: 1338150 - protein, 9 aa, Homo Sapiens
PVVAEYAHV

SEQ ID NO: 1338151 - protein, 9 aa, Homo Sapiens
DDQGDMEKS

SEQ ID NO: 1338152 - protein, 9 aa, Homo Sapiens
VREESRRRH

SEQ ID NO: 1338153 - protein, 9 aa, Homo Sapiens
VGHPNHNKT

SEQ ID NO: 1338154 - protein, 9 aa, Homo Sapiens
GMVRLEPED

SEQ ID NO: 1338155 - protein, 9 aa, Homo Sapiens
VHERDAYKE

SEQ ID NO: 1338156 - protein, 9 aa, Homo Sapiens
RFWMWINHF

SEQ ID NO: 1338157 - protein, 9 aa, Homo Sapiens
YFDLESYLQ

SEQ ID NO: 1338158 - protein, 9 aa, Homo Sapiens
GEDLYILIG

SEQ ID NO: 1338159 - protein, 9 aa, Homo Sapiens
KLPKKKKEA

SEQ ID NO: 1338160 - protein, 9 aa, Homo Sapiens
LPKKPTSMD

SEQ ID NO: 1338161 - protein, 9 aa, Homo Sapiens
DEENRALRR

SEQ ID NO: 1338162 - protein, 9 aa, Homo Sapiens
MVVGDVLQA

SEQ ID NO: 1338163 - protein, 9 aa, Homo Sapiens
RGPHAPVGH

SEQ ID NO: 1338164 - protein, 9 aa, Homo Sapiens
SAAATMAGA

SEQ ID NO: 1338165 - protein, 9 aa, Homo Sapiens
EVSPPVEQQ

SEQ ID NO: 1338166 - protein, 9 aa, Homo Sapiens
NFTLLVENR

SEQ ID NO: 1338167 - protein, 9 aa, Homo Sapiens
DDEGSPGGC

SEQ ID NO: 1338168 - protein, 9 aa, Homo Sapiens
MQRTMCTRK

SEQ ID NO: 1338169 - protein, 9 aa, Homo Sapiens
AQWQLIVKE

SEQ ID NO: 1338170 - protein, 9 aa, Homo Sapiens
PKTQVSSNL

SEQ ID NO: 1338171 - protein, 9 aa, Homo Sapiens
AGLGTSQHR

SEQ ID NO: 1338172 - protein, 9 aa, Homo Sapiens
KDDIIYLTR

SEQ ID NO: 1338173 - protein, 9 aa, Homo Sapiens
SRGYMPSGD

SEQ ID NO: 1338174 - protein, 9 aa, Homo Sapiens
HTLNPDSPR

SEQ ID NO: 1338175 - protein, 9 aa, Homo Sapiens
DVSWNAICI

SEQ ID NO: 1338176 - protein, 9 aa, Homo Sapiens
TDVNSILHY

SEQ ID NO: 1338177 - protein, 9 aa, Homo Sapiens
YTYLKGTVL

SEQ ID NO: 1338178 - protein, 9 aa, Homo Sapiens
HIPEARYRL

SEQ ID NO: 1338179 - protein, 9 aa, Homo Sapiens
EQGRPDAKD

SEQ ID NO: 1338180 - protein, 9 aa, Homo Sapiens
RPNLELLSA

SEQ ID NO: 1338181 - protein, 9 aa, Homo Sapiens
GTRYPDVNR

SEQ ID NO: 1338182 - protein, 9 aa, Homo Sapiens
FSYMGAPLC

SEQ ID NO: 1338183 - protein, 9 aa, Homo Sapiens
TFYRNSPSR

SEQ ID NO: 1338184 - protein, 9 aa, Homo Sapiens
FVPFPYLYL

SEQ ID NO: 1338185 - protein, 9 aa, Homo Sapiens
LLKICGVIN

SEQ ID NO: 1338186 - protein, 9 aa, Homo Sapiens
IPDGHFSIL

SEQ ID NO: 1338187 - protein, 9 aa, Homo Sapiens
EWNKVKRVA

SEQ ID NO: 1338188 - protein, 9 aa, Homo Sapiens
IIKICAQTE

SEQ ID NO: 1338189 - protein, 9 aa, Homo Sapiens
SGLVMAALY

SEQ ID NO: 1338190 - protein, 9 aa, Homo Sapiens
VDRDTSSGG

SEQ ID NO: 1338191 - protein, 9 aa, Homo Sapiens
KRIKNQRLN

SEQ ID NO: 1338192 - protein, 9 aa, Homo Sapiens
HPITRKDTS

SEQ ID NO: 1338193 - protein, 9 aa, Homo Sapiens
RKQRKEHKN

SEQ ID NO: 1338194 - protein, 9 aa, Homo Sapiens
STVTRFIEE

SEQ ID NO: 1338195 - protein, 9 aa, Homo Sapiens
LHRWFVETE

SEQ ID NO: 1338196 - protein, 9 aa, Homo Sapiens
VQHTCQALA

SEQ ID NO: 1338197 - protein, 9 aa, Homo Sapiens
FVPHICSLV

SEQ ID NO: 1338198 - protein, 9 aa, Homo Sapiens
ASPLKSCKY

SEQ ID NO: 1338199 - protein, 9 aa, Homo Sapiens
ACTRGSIVA

SEQ ID NO: 1338200 - protein, 9 aa, Homo Sapiens
LRGSTKIWS

SEQ ID NO: 1338201 - protein, 9 aa, Homo Sapiens
LGMLMEIIQ

SEQ ID NO: 1338202 - protein, 9 aa, Homo Sapiens
APKGISQLI

SEQ ID NO: 1338203 - protein, 9 aa, Homo Sapiens
LHLAATHGY

SEQ ID NO: 1338204 - protein, 9 aa, Homo Sapiens
AVDSAQLLM

SEQ ID NO: 1338205 - protein, 9 aa, Homo Sapiens
LFLKRPKCS

SEQ ID NO: 1338206 - protein, 9 aa, Homo Sapiens
RDMVRYACN

SEQ ID NO: 1338207 - protein, 9 aa, Homo Sapiens
NLSFAYMEG

SEQ ID NO: 1338208 - protein, 9 aa, Homo Sapiens
QICLILVGD

SEQ ID NO: 1338209 - protein, 9 aa, Homo Sapiens
TVGIRQDGS

SEQ ID NO: 1338210 - protein, 9 aa, Homo Sapiens
HHHPFIEWA

SEQ ID NO: 1338211 - protein, 9 aa, Homo Sapiens
ASLYGGSDY

SEQ ID NO: 1338212 - protein, 9 aa, Homo Sapiens
SVCENGCQN

SEQ ID NO: 1338213 - protein, 9 aa, Homo Sapiens
QGKEAYPMP

SEQ ID NO: 1338214 - protein, 9 aa, Homo Sapiens
FLEKEVQEA

SEQ ID NO: 1338215 - protein, 9 aa, Homo Sapiens
CHLAAQPQA

SEQ ID NO: 1338216 - protein, 9 aa, Homo Sapiens
KDALLFSAS

SEQ ID NO: 1338217 - protein, 9 aa, Homo Sapiens
TGLCNRSTC

SEQ ID NO: 1338218 - protein, 9 aa, Homo Sapiens
GQKGKAGGH

SEQ ID NO: 1338219 - protein, 9 aa, Homo Sapiens
NRRSWLNNF

SEQ ID NO: 1338220 - protein, 9 aa, Homo Sapiens
DSSMVFLSR

SEQ ID NO: 1338221 - protein, 9 aa, Homo Sapiens
PDCSHQHCL

SEQ ID NO: 1338222 - protein, 9 aa, Homo Sapiens
AYIVESLIQ

SEQ ID NO: 1338223 - protein, 9 aa, Homo Sapiens
CGFQLTEHL

SEQ ID NO: 1338224 - protein, 9 aa, Homo Sapiens
LISIFVVGP

SEQ ID NO: 1338225 - protein, 9 aa, Homo Sapiens
KSSHLKTHL

SEQ ID NO: 1338226 - protein, 9 aa, Homo Sapiens
CQQVLVHLA

SEQ ID NO: 1338227 - protein, 9 aa, Homo Sapiens
ISIWIFFFF

SEQ ID NO: 1338228 - protein, 9 aa, Homo Sapiens
YHEGHVKEA

SEQ ID NO: 1338229 - protein, 9 aa, Homo Sapiens
LAIMRAFQH

SEQ ID NO: 1338230 - protein, 9 aa, Homo Sapiens
NVVEMVPCG

SEQ ID NO: 1338231 - protein, 9 aa, Homo Sapiens
LPAYVISNI

SEQ ID NO: 1338232 - protein, 9 aa, Homo Sapiens
HIVVYHRGH

SEQ ID NO: 1338233 - protein, 9 aa, Homo Sapiens
CAYVAVFVI

SEQ ID NO: 1338234 - protein, 9 aa, Homo Sapiens
EAREEKIRI

SEQ ID NO: 1338235 - protein, 9 aa, Homo Sapiens
SYMILHRRI

SEQ ID NO: 1338236 - protein, 9 aa, Homo Sapiens
KGYRTVVTL

SEQ ID NO: 1338237 - protein, 9 aa, Homo Sapiens
GRDDDASNL

SEQ ID NO: 1338238 - protein, 9 aa, Homo Sapiens
DDVRHQQQE

SEQ ID NO: 1338239 - protein, 9 aa, Homo Sapiens
PGLFVVGLY

SEQ ID NO: 1338240 - protein, 9 aa, Homo Sapiens
IPRCQPKKP

SEQ ID NO: 1338241 - protein, 9 aa, Homo Sapiens
TSLCRLYLN

SEQ ID NO: 1338242 - protein, 9 aa, Homo Sapiens
KQVDFSCYD

SEQ ID NO: 1338243 - protein, 9 aa, Homo Sapiens
PLERKRHEV

SEQ ID NO: 1338244 - protein, 9 aa, Homo Sapiens
HTHYLLTFS

SEQ ID NO: 1338245 - protein, 9 aa, Homo Sapiens
LEALHLSIQ

SEQ ID NO: 1338246 - protein, 9 aa, Homo Sapiens
TSKEAISQR

SEQ ID NO: 1338247 - protein, 9 aa, Homo Sapiens
ASPPAGPNN

SEQ ID NO: 1338248 - protein, 9 aa, Homo Sapiens
VEDTTAIQG

SEQ ID NO: 1338249 - protein, 9 aa, Homo Sapiens
TVASRPPVH

SEQ ID NO: 1338250 - protein, 9 aa, Homo Sapiens
QAECRALCA

SEQ ID NO: 1338251 - protein, 9 aa, Homo Sapiens
VDSLVGPRT

SEQ ID NO: 1338252 - protein, 9 aa, Homo Sapiens
KPHQVADAR

SEQ ID NO: 1338253 - protein, 9 aa, Homo Sapiens
NVQPHHKIL

SEQ ID NO: 1338254 - protein, 9 aa, Homo Sapiens
DDRNQDSTA

SEQ ID NO: 1338255 - protein, 9 aa, Homo Sapiens
NGNMSRTET

SEQ ID NO: 1338256 - protein, 9 aa, Homo Sapiens
VFHYLMTFL

SEQ ID NO: 1338257 - protein, 9 aa, Homo Sapiens
FDVAFVQPV

SEQ ID NO: 1338258 - protein, 9 aa, Homo Sapiens
CNLKDDFEV

SEQ ID NO: 1338259 - protein, 9 aa, Homo Sapiens
GNRLYHEGH

SEQ ID NO: 1338260 - protein, 9 aa, Homo Sapiens
AADDPEVWV

SEQ ID NO: 1338261 - protein, 9 aa, Homo Sapiens
QDIILYWEH

SEQ ID NO: 1338262 - protein, 9 aa, Homo Sapiens
YIVGGVSTS

SEQ ID NO: 1338263 - protein, 9 aa, Homo Sapiens
PPLGLHSSI

SEQ ID NO: 1338264 - protein, 9 aa, Homo Sapiens
KAITTLKRI

SEQ ID NO: 1338265 - protein, 9 aa, Homo Sapiens
VLAMIESTQ

SEQ ID NO: 1338266 - protein, 9 aa, Homo Sapiens
SGQCVTWLQ

SEQ ID NO: 1338267 - protein, 9 aa, Homo Sapiens
MSSMSPPPG

SEQ ID NO: 1338268 - protein, 9 aa, Homo Sapiens
SLELQLNVS

SEQ ID NO: 1338269 - protein, 9 aa, Homo Sapiens
VGWRWIWID

SEQ ID NO: 1338270 - protein, 9 aa, Homo Sapiens
HPFPESKPI

SEQ ID NO: 1338271 - protein, 9 aa, Homo Sapiens
EQRKTVFNR

SEQ ID NO: 1338272 - protein, 9 aa, Homo Sapiens
CGAAPSTVA

SEQ ID NO: 1338273 - protein, 9 aa, Homo Sapiens
LSFISIDHY

SEQ ID NO: 1338274 - protein, 9 aa, Homo Sapiens
HRLLAEEEQ

SEQ ID NO: 1338275 - protein, 9 aa, Homo Sapiens
DAVPPGSPS

SEQ ID NO: 1338276 - protein, 9 aa, Homo Sapiens
MDGEVMSVV

SEQ ID NO: 1338277 - protein, 9 aa, Homo Sapiens
LCHKYLIGM

SEQ ID NO: 1338278 - protein, 9 aa, Homo Sapiens
FVQQKGQHF

SEQ ID NO: 1338279 - protein, 9 aa, Homo Sapiens
LLLLQQLCP

SEQ ID NO: 1338280 - protein, 9 aa, Homo Sapiens
HHDLDRVKK

SEQ ID NO: 1338281 - protein, 9 aa, Homo Sapiens
IYTKLFNWI

SEQ ID NO: 1338282 - protein, 9 aa, Homo Sapiens
CLGSPGSSP

SEQ ID NO: 1338283 - protein, 9 aa, Homo Sapiens
MCPFHHISG

SEQ ID NO: 1338284 - protein, 9 aa, Homo Sapiens
AHEAARSPD

SEQ ID NO: 1338285 - protein, 9 aa, Homo Sapiens
KSLVKEGGD

SEQ ID NO: 1338286 - protein, 9 aa, Homo Sapiens
QPAVSEAFV

SEQ ID NO: 1338287 - protein, 9 aa, Homo Sapiens
LYMACQYVL

SEQ ID NO: 1338288 - protein, 9 aa, Homo Sapiens
VRDWNDMEH

SEQ ID NO: 1338289 - protein, 9 aa, Homo Sapiens
VQGMPVASK

SEQ ID NO: 1338290 - protein, 9 aa, Homo Sapiens
PDACSTKID

SEQ ID NO: 1338291 - protein, 9 aa, Homo Sapiens
NCFLLCKPR

SEQ ID NO: 1338292 - protein, 9 aa, Homo Sapiens
WVEDCNNCR

SEQ ID NO: 1338293 - protein, 9 aa, Homo Sapiens
LADYITAVY

SEQ ID NO: 1338294 - protein, 9 aa, Homo Sapiens
PYSHVSDPY

SEQ ID NO: 1338295 - protein, 9 aa, Homo Sapiens
ALTSHLRIH

SEQ ID NO: 1338296 - protein, 9 aa, Homo Sapiens
VIDGMEKCD

SEQ ID NO: 1338297 - protein, 9 aa, Homo Sapiens
AFLRFMVSI

SEQ ID NO: 1338298 - protein, 9 aa, Homo Sapiens
TVTHLVGAL

SEQ ID NO: 1338299 - protein, 9 aa, Homo Sapiens
KSGDSGRAE

SEQ ID NO: 1338300 - protein, 9 aa, Homo Sapiens
QEYMLKPKY

SEQ ID NO: 1338301 - protein, 9 aa, Homo Sapiens
TGESPPQPL

SEQ ID NO: 1338302 - protein, 9 aa, Homo Sapiens
ITLIGEPAV

SEQ ID NO: 1338303 - protein, 9 aa, Homo Sapiens
LTQCNRTIM

SEQ ID NO: 1338304 - protein, 9 aa, Homo Sapiens
IFPNSYPNL

SEQ ID NO: 1338305 - protein, 9 aa, Homo Sapiens
FLLTSVSLH

SEQ ID NO: 1338306 - protein, 9 aa, Homo Sapiens
FNWGVHRRS

SEQ ID NO: 1338307 - protein, 9 aa, Homo Sapiens
GVREPQPAV

SEQ ID NO: 1338308 - protein, 9 aa, Homo Sapiens
HRHKPTSQW

SEQ ID NO: 1338309 - protein, 9 aa, Homo Sapiens
TPRVSIQAA

SEQ ID NO: 1338310 - protein, 9 aa, Homo Sapiens
ANELHVSCM

SEQ ID NO: 1338311 - protein, 9 aa, Homo Sapiens
IEICSEVGL

SEQ ID NO: 1338312 - protein, 9 aa, Homo Sapiens
MKSMKLERH

SEQ ID NO: 1338313 - protein, 9 aa, Homo Sapiens
VTQLALLDG

SEQ ID NO: 1338314 - protein, 9 aa, Homo Sapiens
RRELDGCLQ

SEQ ID NO: 1338315 - protein, 9 aa, Homo Sapiens
KYHALCSRF

SEQ ID NO: 1338316 - protein, 9 aa, Homo Sapiens
YNWGFSLLI

SEQ ID NO: 1338317 - protein, 9 aa, Homo Sapiens
GINETTFNS

SEQ ID NO: 1338318 - protein, 9 aa, Homo Sapiens
LLKTDDILW

SEQ ID NO: 1338319 - protein, 9 aa, Homo Sapiens
EAWGMHEFL

SEQ ID NO: 1338320 - protein, 9 aa, Homo Sapiens
KYGFFKRAR

SEQ ID NO: 1338321 - protein, 9 aa, Homo Sapiens
MLHFLLGDK

SEQ ID NO: 1338322 - protein, 9 aa, Homo Sapiens
GGDHHVELY

SEQ ID NO: 1338323 - protein, 9 aa, Homo Sapiens
PKPCSDTDS

SEQ ID NO: 1338324 - protein, 9 aa, Homo Sapiens
PDTQQVQVQ

SEQ ID NO: 1338325 - protein, 9 aa, Homo Sapiens
LENGNMSRT

SEQ ID NO: 1338326 - protein, 9 aa, Homo Sapiens
IYKYIEYHG

SEQ ID NO: 1338327 - protein, 9 aa, Homo Sapiens
TLVEAYREI

SEQ ID NO: 1338328 - protein, 9 aa, Homo Sapiens
PEPLSMVFA

SEQ ID NO: 1338329 - protein, 9 aa, Homo Sapiens
RVLYIQANN

SEQ ID NO: 1338330 - protein, 9 aa, Homo Sapiens
LDGCSKKTN

SEQ ID NO: 1338331 - protein, 9 aa, Homo Sapiens
TELQPIDFG

SEQ ID NO: 1338332 - protein, 9 aa, Homo Sapiens
KNNVLSYYK

SEQ ID NO: 1338333 - protein, 9 aa, Homo Sapiens
PDNPYEVTR

SEQ ID NO: 1338334 - protein, 9 aa, Homo Sapiens
MITEYMENE

SEQ ID NO: 1338335 - protein, 9 aa, Homo Sapiens
LWRADDISR

SEQ ID NO: 1338336 - protein, 9 aa, Homo Sapiens
GDWRDDQCP

SEQ ID NO: 1338337 - protein, 9 aa, Homo Sapiens
KEAISQRLC

SEQ ID NO: 1338338 - protein, 9 aa, Homo Sapiens
VFETRQDLN

SEQ ID NO: 1338339 - protein, 9 aa, Homo Sapiens
YLDDLLPLT

SEQ ID NO: 1338340 - protein, 9 aa, Homo Sapiens
VTHLTGIHA

SEQ ID NO: 1338341 - protein, 9 aa, Homo Sapiens
VAPPSAVGS

SEQ ID NO: 1338342 - protein, 9 aa, Homo Sapiens
RHSGRKLMW

SEQ ID NO: 1338343 - protein, 9 aa, Homo Sapiens
SSTLRQHHL

SEQ ID NO: 1338344 - protein, 9 aa, Homo Sapiens
FNARFGLRA

SEQ ID NO: 1338345 - protein, 9 aa, Homo Sapiens
ENEPYHENV

SEQ ID NO: 1338346 - protein, 9 aa, Homo Sapiens
EFETRGKLR

SEQ ID NO: 1338347 - protein, 9 aa, Homo Sapiens
QKDEVCVKL

SEQ ID NO: 1338348 - protein, 9 aa, Homo Sapiens
SDLFQWVVS

SEQ ID NO: 1338349 - protein, 9 aa, Homo Sapiens
YSHITARAE

SEQ ID NO: 1338350 - protein, 9 aa, Homo Sapiens
MYGCELCGK

SEQ ID NO: 1338351 - protein, 9 aa, Homo Sapiens
VHKYALAVC

SEQ ID NO: 1338352 - protein, 9 aa, Homo Sapiens
WLVVVIMGV

SEQ ID NO: 1338353 - protein, 9 aa, Homo Sapiens
EFDNGSMLQ

SEQ ID NO: 1338354 - protein, 9 aa, Homo Sapiens
DPSGWPVFP

SEQ ID NO: 1338355 - protein, 9 aa, Homo Sapiens
VTSCLASLL

SEQ ID NO: 1338356 - protein, 9 aa, Homo Sapiens
VETLENTNR

SEQ ID NO: 1338357 - protein, 9 aa, Homo Sapiens
GLKCGGTIE

SEQ ID NO: 1338358 - protein, 9 aa, Homo Sapiens
ILFHILQTD

SEQ ID NO: 1338359 - protein, 9 aa, Homo Sapiens
CQMKATGKM

SEQ ID NO: 1338360 - protein, 9 aa, Homo Sapiens
EKGCWTELG

SEQ ID NO: 1338361 - protein, 9 aa, Homo Sapiens
CLIRLHGWL

SEQ ID NO: 1338362 - protein, 9 aa, Homo Sapiens
TYASTSGKP

SEQ ID NO: 1338363 - protein, 9 aa, Homo Sapiens
YVQQEVIML

SEQ ID NO: 1338364 - protein, 9 aa, Homo Sapiens
EGALVTTAR

SEQ ID NO: 1338365 - protein, 9 aa, Homo Sapiens
TIPLEIMQG

SEQ ID NO: 1338366 - protein, 9 aa, Homo Sapiens
PTPPAPAPP

SEQ ID NO: 1338367 - protein, 9 aa, Homo Sapiens
TDFTYDSDV

SEQ ID NO: 1338368 - protein, 9 aa, Homo Sapiens
FHSNNIRLI

SEQ ID NO: 1338369 - protein, 9 aa, Homo Sapiens
NRECFLKGE

SEQ ID NO: 1338370 - protein, 9 aa, Homo Sapiens
STSHFAWTF

SEQ ID NO: 1338371 - protein, 9 aa, Homo Sapiens
LPIHLQSSV

SEQ ID NO: 1338372 - protein, 9 aa, Homo Sapiens
FIHNLDQLR

SEQ ID NO: 1338373 - protein, 9 aa, Homo Sapiens
YDDQGDMEK

SEQ ID NO: 1338374 - protein, 9 aa, Homo Sapiens
KKSPKSVSS

SEQ ID NO: 1338375 - protein, 9 aa, Homo Sapiens
DLVCGAEPR

SEQ ID NO: 1338376 - protein, 9 aa, Homo Sapiens
GRINVSDLT

SEQ ID NO: 1338377 - protein, 9 aa, Homo Sapiens
VPSALQLRV

SEQ ID NO: 1338378 - protein, 9 aa, Homo Sapiens
CTALAVLGW

SEQ ID NO: 1338379 - protein, 9 aa, Homo Sapiens
CSKTFSQKT

SEQ ID NO: 1338380 - protein, 9 aa, Homo Sapiens
ACSNGVLIP

SEQ ID NO: 1338381 - protein, 9 aa, Homo Sapiens
STAILPPHL

SEQ ID NO: 1338382 - protein, 9 aa, Homo Sapiens
IISYICSQQ

SEQ ID NO: 1338383 - protein, 9 aa, Homo Sapiens
VSRPHSSPD

SEQ ID NO: 1338384 - protein, 9 aa, Homo Sapiens
PTSSCTGAS

SEQ ID NO: 1338385 - protein, 9 aa, Homo Sapiens
SDVRHTPAE

SEQ ID NO: 1338386 - protein, 9 aa, Homo Sapiens
ITEGPPALP

SEQ ID NO: 1338387 - protein, 9 aa, Homo Sapiens
SEVNQNTSE

SEQ ID NO: 1338388 - protein, 9 aa, Homo Sapiens
RALIGDDIG

SEQ ID NO: 1338389 - protein, 9 aa, Homo Sapiens
KLRKFIFST

SEQ ID NO: 1338390 - protein, 9 aa, Homo Sapiens
VHEEANAAR

SEQ ID NO: 1338391 - protein, 9 aa, Homo Sapiens
DNHISTISS

SEQ ID NO: 1338392 - protein, 9 aa, Homo Sapiens
KHVGLTAVV

SEQ ID NO: 1338393 - protein, 9 aa, Homo Sapiens
ALYKHFFSL

SEQ ID NO: 1338394 - protein, 9 aa, Homo Sapiens
LGYVNFLIN

SEQ ID NO: 1338395 - protein, 9 aa, Homo Sapiens
RLDYEDKFS

SEQ ID NO: 1338396 - protein, 9 aa, Homo Sapiens
HHILSHSEA

SEQ ID NO: 1338397 - protein, 9 aa, Homo Sapiens
PIFSSIFLF

SEQ ID NO: 1338398 - protein, 9 aa, Homo Sapiens
VDDRTGVTG

SEQ ID NO: 1338399 - protein, 9 aa, Homo Sapiens
ECGADTAPT

SEQ ID NO: 1338400 - protein, 9 aa, Homo Sapiens
NKPIALPHC

SEQ ID NO: 1338401 - protein, 9 aa, Homo Sapiens
MYFQPYTYS

SEQ ID NO: 1338402 - protein, 9 aa, Homo Sapiens
SRRRRLEMM

SEQ ID NO: 1338403 - protein, 9 aa, Homo Sapiens
ELKRVICGF

SEQ ID NO: 1338404 - protein, 9 aa, Homo Sapiens
KSCKYHALC

SEQ ID NO: 1338405 - protein, 9 aa, Homo Sapiens
NLTQKKCWE

SEQ ID NO: 1338406 - protein, 9 aa, Homo Sapiens
GLTATPDGH

SEQ ID NO: 1338407 - protein, 9 aa, Homo Sapiens
DKSPLHMTA

SEQ ID NO: 1338408 - protein, 9 aa, Homo Sapiens
PSPEAGRVN

SEQ ID NO: 1338409 - protein, 9 aa, Homo Sapiens
EKEDPEDLQ

SEQ ID NO: 1338410 - protein, 9 aa, Homo Sapiens
QATGQPPAW

SEQ ID NO: 1338411 - protein, 9 aa, Homo Sapiens
PRKPQAVEW

SEQ ID NO: 1338412 - protein, 9 aa, Homo Sapiens
FACEVATGI

SEQ ID NO: 1338413 - protein, 9 aa, Homo Sapiens
QKPGFPKCG

SEQ ID NO: 1338414 - protein, 9 aa, Homo Sapiens
AAETTVVDV

SEQ ID NO: 1338415 - protein, 9 aa, Homo Sapiens
DQQCSCPTC

SEQ ID NO: 1338416 - protein, 9 aa, Homo Sapiens
GGKACAKSK

SEQ ID NO: 1338417 - protein, 9 aa, Homo Sapiens
MKMYGCELC

SEQ ID NO: 1338418 - protein, 9 aa, Homo Sapiens
EGVNMRHLW

SEQ ID NO: 1338419 - protein, 9 aa, Homo Sapiens
DGIKLLYAA

SEQ ID NO: 1338420 - protein, 9 aa, Homo Sapiens
YFRTQIFLD

SEQ ID NO: 1338421 - protein, 9 aa, Homo Sapiens
LREAKGNQA

SEQ ID NO: 1338422 - protein, 9 aa, Homo Sapiens
AVSEAFVKF

SEQ ID NO: 1338423 - protein, 9 aa, Homo Sapiens
KSVVRPRRS

SEQ ID NO: 1338424 - protein, 9 aa, Homo Sapiens
GLSHWDAEY

SEQ ID NO: 1338425 - protein, 9 aa, Homo Sapiens
PCLQQDNNQ

SEQ ID NO: 1338426 - protein, 9 aa, Homo Sapiens
LEAPAEPLG

SEQ ID NO: 1338427 - protein, 9 aa, Homo Sapiens
KRKYCKGNL

SEQ ID NO: 1338428 - protein, 9 aa, Homo Sapiens
ALLMEGFLA

SEQ ID NO: 1338429 - protein, 9 aa, Homo Sapiens
AECRALCAC

SEQ ID NO: 1338430 - protein, 9 aa, Homo Sapiens
KKQGCNKRT

SEQ ID NO: 1338431 - protein, 9 aa, Homo Sapiens
CRNIDSEFS

SEQ ID NO: 1338432 - protein, 9 aa, Homo Sapiens
LTVSVMSAP

SEQ ID NO: 1338433 - protein, 9 aa, Homo Sapiens
AKGICTLLF

SEQ ID NO: 1338434 - protein, 9 aa, Homo Sapiens
RETEFEAEQ

SEQ ID NO: 1338435 - protein, 9 aa, Homo Sapiens
RTQQTPVAA

SEQ ID NO: 1338436 - protein, 9 aa, Homo Sapiens
IHYLYLCQF

SEQ ID NO: 1338437 - protein, 9 aa, Homo Sapiens
YWIFRSWGC

SEQ ID NO: 1338438 - protein, 9 aa, Homo Sapiens
WMVDACASF

SEQ ID NO: 1338439 - protein, 9 aa, Homo Sapiens
HYQRARKEC

SEQ ID NO: 1338440 - protein, 9 aa, Homo Sapiens
WNLLKPCCP

SEQ ID NO: 1338441 - protein, 9 aa, Homo Sapiens
EAYIAMGQH

SEQ ID NO: 1338442 - protein, 9 aa, Homo Sapiens
EKVDKAQCY

SEQ ID NO: 1338443 - protein, 9 aa, Homo Sapiens
SFFARDNTT

SEQ ID NO: 1338444 - protein, 9 aa, Homo Sapiens
AVTVSWFYG

SEQ ID NO: 1338445 - protein, 9 aa, Homo Sapiens
LLILRSPRV

SEQ ID NO: 1338446 - protein, 9 aa, Homo Sapiens
FYAHFFLSY

SEQ ID NO: 1338447 - protein, 9 aa, Homo Sapiens
FPKIMPEKP

SEQ ID NO: 1338448 - protein, 9 aa, Homo Sapiens
LLWAMLIII

SEQ ID NO: 1338449 - protein, 9 aa, Homo Sapiens
VEWMRLDMM

SEQ ID NO: 1338450 - protein, 9 aa, Homo Sapiens
VPSHQGLTC

SEQ ID NO: 1338451 - protein, 9 aa, Homo Sapiens
HISTSPTLR

SEQ ID NO: 1338452 - protein, 9 aa, Homo Sapiens
SSEHGTPDS

SEQ ID NO: 1338453 - protein, 9 aa, Homo Sapiens
DLHRVSEPD

SEQ ID NO: 1338454 - protein, 9 aa, Homo Sapiens
HVREQLSKS

SEQ ID NO: 1338455 - protein, 9 aa, Homo Sapiens
ASTPARSPS

SEQ ID NO: 1338456 - protein, 9 aa, Homo Sapiens
EIKVNLTRD

SEQ ID NO: 1338457 - protein, 9 aa, Homo Sapiens
DGMEKCDDG

SEQ ID NO: 1338458 - protein, 9 aa, Homo Sapiens
GWGFSMGIN

SEQ ID NO: 1338459 - protein, 9 aa, Homo Sapiens
YLCTPQEVR

SEQ ID NO: 1338460 - protein, 9 aa, Homo Sapiens
AANMPNKEM

SEQ ID NO: 1338461 - protein, 9 aa, Homo Sapiens
LAWLCISAS

SEQ ID NO: 1338462 - protein, 9 aa, Homo Sapiens
TLLKEESSI

SEQ ID NO: 1338463 - protein, 9 aa, Homo Sapiens
KQMFSNLTK

SEQ ID NO: 1338464 - protein, 9 aa, Homo Sapiens
NDTFMEVEM

SEQ ID NO: 1338465 - protein, 9 aa, Homo Sapiens
SHYYQGSQG

SEQ ID NO: 1338466 - protein, 9 aa, Homo Sapiens
ANNVPPTAT

SEQ ID NO: 1338467 - protein, 9 aa, Homo Sapiens
SGMQRAVQT

SEQ ID NO: 1338468 - protein, 9 aa, Homo Sapiens
RARTCSPCS

SEQ ID NO: 1338469 - protein, 9 aa, Homo Sapiens
QQRLKKVVP

SEQ ID NO: 1338470 - protein, 9 aa, Homo Sapiens
EPFHSKVLK

SEQ ID NO: 1338471 - protein, 9 aa, Homo Sapiens
INKPWVYSL

SEQ ID NO: 1338472 - protein, 9 aa, Homo Sapiens
MIDAGYYIC

SEQ ID NO: 1338473 - protein, 9 aa, Homo Sapiens
ELEAFNILQ

SEQ ID NO: 1338474 - protein, 9 aa, Homo Sapiens
EVLRAGHQH

SEQ ID NO: 1338475 - protein, 9 aa, Homo Sapiens
SNVTPRPQQ

SEQ ID NO: 1338476 - protein, 9 aa, Homo Sapiens
PENGSITQV

SEQ ID NO: 1338477 - protein, 9 aa, Homo Sapiens
NTGMYILSP

SEQ ID NO: 1338478 - protein, 9 aa, Homo Sapiens
SNDSCKGDS

SEQ ID NO: 1338479 - protein, 9 aa, Homo Sapiens
ASATTGRSR

SEQ ID NO: 1338480 - protein, 9 aa, Homo Sapiens
IYRRNLDIE

SEQ ID NO: 1338481 - protein, 9 aa, Homo Sapiens
CGTLDYLSP

SEQ ID NO: 1338482 - protein, 9 aa, Homo Sapiens
LQFKSHIYF

SEQ ID NO: 1338483 - protein, 9 aa, Homo Sapiens
RLKIHLQSH

SEQ ID NO: 1338484 - protein, 9 aa, Homo Sapiens
VQPFHQGHP

SEQ ID NO: 1338485 - protein, 9 aa, Homo Sapiens
KTPPRQVSQ

SEQ ID NO: 1338486 - protein, 9 aa, Homo Sapiens
DPSVIGPQM

SEQ ID NO: 1338487 - protein, 9 aa, Homo Sapiens
ELMLLCTSF

SEQ ID NO: 1338488 - protein, 9 aa, Homo Sapiens
YHCLQFAYY

SEQ ID NO: 1338489 - protein, 9 aa, Homo Sapiens
LMQSSGHSG

SEQ ID NO: 1338490 - protein, 9 aa, Homo Sapiens
YITAVYVEM

SEQ ID NO: 1338491 - protein, 9 aa, Homo Sapiens
TGISLNVLP

SEQ ID NO: 1338492 - protein, 9 aa, Homo Sapiens
REELNALRE

SEQ ID NO: 1338493 - protein, 9 aa, Homo Sapiens
VSHSSTLDS

SEQ ID NO: 1338494 - protein, 9 aa, Homo Sapiens
VGRITQDLG

SEQ ID NO: 1338495 - protein, 9 aa, Homo Sapiens
TPDNPYEVT

SEQ ID NO: 1338496 - protein, 9 aa, Homo Sapiens
RSITTGKNG

SEQ ID NO: 1338497 - protein, 9 aa, Homo Sapiens
KITHVVLKE

SEQ ID NO: 1338498 - protein, 9 aa, Homo Sapiens
HKRVKEINQ

SEQ ID NO: 1338499 - protein, 9 aa, Homo Sapiens
VDSFIVTFL

SEQ ID NO: 1338500 - protein, 9 aa, Homo Sapiens
KLLLVCKQL

SEQ ID NO: 1338501 - protein, 9 aa, Homo Sapiens
ELTMLRRQQ

SEQ ID NO: 1338502 - protein, 9 aa, Homo Sapiens
NKPCIKYIG

SEQ ID NO: 1338503 - protein, 9 aa, Homo Sapiens
AEHNPLGSG

SEQ ID NO: 1338504 - protein, 9 aa, Homo Sapiens
DRVMTINGI

SEQ ID NO: 1338505 - protein, 9 aa, Homo Sapiens
RFSRSAISE

SEQ ID NO: 1338506 - protein, 9 aa, Homo Sapiens
DPAQKSHFY

SEQ ID NO: 1338507 - protein, 9 aa, Homo Sapiens
ASSSTSRDS

SEQ ID NO: 1338508 - protein, 9 aa, Homo Sapiens
GTPACEVLP

SEQ ID NO: 1338509 - protein, 9 aa, Homo Sapiens
WRSQWKHVF

SEQ ID NO: 1338510 - protein, 9 aa, Homo Sapiens
LDREKQVFT

SEQ ID NO: 1338511 - protein, 9 aa, Homo Sapiens
LQDINKPDC

SEQ ID NO: 1338512 - protein, 9 aa, Homo Sapiens
GSGGHSGDP

SEQ ID NO: 1338513 - protein, 9 aa, Homo Sapiens
REASKSVLS

SEQ ID NO: 1338514 - protein, 9 aa, Homo Sapiens
SALPSPPSP

SEQ ID NO: 1338515 - protein, 9 aa, Homo Sapiens
LGPMMLEVL

SEQ ID NO: 1338516 - protein, 9 aa, Homo Sapiens
AAQQQATGK

SEQ ID NO: 1338517 - protein, 9 aa, Homo Sapiens
FDENLTGCL

SEQ ID NO: 1338518 - protein, 9 aa, Homo Sapiens
PHPREALQV

SEQ ID NO: 1338519 - protein, 9 aa, Homo Sapiens
SGETLKVRY

SEQ ID NO: 1338520 - protein, 9 aa, Homo Sapiens
LTYSLTYRQ

SEQ ID NO: 1338521 - protein, 9 aa, Homo Sapiens
EEKHNQAKE

SEQ ID NO: 1338522 - protein, 9 aa, Homo Sapiens
NKDEYIDLM

SEQ ID NO: 1338523 - protein, 9 aa, Homo Sapiens
PMSVPHNRI

SEQ ID NO: 1338524 - protein, 9 aa, Homo Sapiens
MELKVASQK

SEQ ID NO: 1338525 - protein, 9 aa, Homo Sapiens
HMPTPVIKA

SEQ ID NO: 1338526 - protein, 9 aa, Homo Sapiens
AISYDRYVA

SEQ ID NO: 1338527 - protein, 9 aa, Homo Sapiens
TIEIEHFVD

SEQ ID NO: 1338528 - protein, 9 aa, Homo Sapiens
QKDALLFSA

SEQ ID NO: 1338529 - protein, 9 aa, Homo Sapiens
LRELVLKYH

SEQ ID NO: 1338530 - protein, 9 aa, Homo Sapiens
TISPHCVPS

SEQ ID NO: 1338531 - protein, 9 aa, Homo Sapiens
AFHQEHEVC

SEQ ID NO: 1338532 - protein, 9 aa, Homo Sapiens
SSGWWFDVC

SEQ ID NO: 1338533 - protein, 9 aa, Homo Sapiens
ISSRLNLLT

SEQ ID NO: 1338534 - protein, 9 aa, Homo Sapiens
SDFLSCSFA

SEQ ID NO: 1338535 - protein, 9 aa, Homo Sapiens
KIEEGIDTD

SEQ ID NO: 1338536 - protein, 9 aa, Homo Sapiens
QVFAMAQLR

SEQ ID NO: 1338537 - protein, 9 aa, Homo Sapiens
WLGAFPTPC

SEQ ID NO: 1338538 - protein, 9 aa, Homo Sapiens
LYHTCLASL

SEQ ID NO: 1338539 - protein, 9 aa, Homo Sapiens
CHSIRRQYR

SEQ ID NO: 1338540 - protein, 9 aa, Homo Sapiens
FITFANLLN

SEQ ID NO: 1338541 - protein, 9 aa, Homo Sapiens
YKMDDVEVT

SEQ ID NO: 1338542 - protein, 9 aa, Homo Sapiens
LWYIHALYT

SEQ ID NO: 1338543 - protein, 9 aa, Homo Sapiens
RFLWFTHLK

SEQ ID NO: 1338544 - protein, 9 aa, Homo Sapiens
VGRPRSMLC

SEQ ID NO: 1338545 - protein, 9 aa, Homo Sapiens
MCQAGEVTY

SEQ ID NO: 1338546 - protein, 9 aa, Homo Sapiens
GAVNKVLLK

SEQ ID NO: 1338547 - protein, 9 aa, Homo Sapiens
HSMVRTGEK

SEQ ID NO: 1338548 - protein, 9 aa, Homo Sapiens
RSNFVLYNK

SEQ ID NO: 1338549 - protein, 9 aa, Homo Sapiens
GSQSSPRTQ

SEQ ID NO: 1338550 - protein, 9 aa, Homo Sapiens
RHSMWEEDF

SEQ ID NO: 1338551 - protein, 9 aa, Homo Sapiens
TMARRGSSP

SEQ ID NO: 1338552 - protein, 9 aa, Homo Sapiens
KHCNSEEMW

SEQ ID NO: 1338553 - protein, 9 aa, Homo Sapiens
RKQSCRKVM

SEQ ID NO: 1338554 - protein, 9 aa, Homo Sapiens
EGATPYNSH

SEQ ID NO: 1338555 - protein, 9 aa, Homo Sapiens
FLLLSLALT

SEQ ID NO: 1338556 - protein, 9 aa, Homo Sapiens
VDYDFVSAL

SEQ ID NO: 1338557 - protein, 9 aa, Homo Sapiens
VGESKHHPG

SEQ ID NO: 1338558 - protein, 9 aa, Homo Sapiens
HSSPKRSLL

SEQ ID NO: 1338559 - protein, 9 aa, Homo Sapiens
QVREHVLEE

SEQ ID NO: 1338560 - protein, 9 aa, Homo Sapiens
TQIDLLEPR

SEQ ID NO: 1338561 - protein, 9 aa, Homo Sapiens
NLHEEDTLL

SEQ ID NO: 1338562 - protein, 9 aa, Homo Sapiens
GCGEVINAT

SEQ ID NO: 1338563 - protein, 9 aa, Homo Sapiens
SLIAQYFAS

SEQ ID NO: 1338564 - protein, 9 aa, Homo Sapiens
HGQTQEYML

SEQ ID NO: 1338565 - protein, 9 aa, Homo Sapiens
TAGYIIPEL

SEQ ID NO: 1338566 - protein, 9 aa, Homo Sapiens
ERLDQTMDL

SEQ ID NO: 1338567 - protein, 9 aa, Homo Sapiens
SQSQSVWTL

SEQ ID NO: 1338568 - protein, 9 aa, Homo Sapiens
SSLWKAVKT

SEQ ID NO: 1338569 - protein, 9 aa, Homo Sapiens
ARHITIPLV

SEQ ID NO: 1338570 - protein, 9 aa, Homo Sapiens
PEAGRVNRR

SEQ ID NO: 1338571 - protein, 9 aa, Homo Sapiens
LSKPEFKKT

SEQ ID NO: 1338572 - protein, 9 aa, Homo Sapiens
FLATDINLS

SEQ ID NO: 1338573 - protein, 9 aa, Homo Sapiens
PAGPNNVPK

SEQ ID NO: 1338574 - protein, 9 aa, Homo Sapiens
DRIFRWLGP

SEQ ID NO: 1338575 - protein, 9 aa, Homo Sapiens
ACADPHHVQ

SEQ ID NO: 1338576 - protein, 9 aa, Homo Sapiens
KGVINDWRH

SEQ ID NO: 1338577 - protein, 9 aa, Homo Sapiens
KTDAQGTHI

SEQ ID NO: 1338578 - protein, 9 aa, Homo Sapiens
DENMERRNH

SEQ ID NO: 1338579 - protein, 9 aa, Homo Sapiens
SPDDLTTEN

SEQ ID NO: 1338580 - protein, 9 aa, Homo Sapiens
LHENCRMFF

SEQ ID NO: 1338581 - protein, 9 aa, Homo Sapiens
DLSLPPPPA

SEQ ID NO: 1338582 - protein, 9 aa, Homo Sapiens
PSYLNLIKP

SEQ ID NO: 1338583 - protein, 9 aa, Homo Sapiens
TRANAKMMA

SEQ ID NO: 1338584 - protein, 9 aa, Homo Sapiens
KQEIADACH

SEQ ID NO: 1338585 - protein, 9 aa, Homo Sapiens
TNAHKSKEW

SEQ ID NO: 1338586 - protein, 9 aa, Homo Sapiens
AHRHQGVQV

SEQ ID NO: 1338587 - protein, 9 aa, Homo Sapiens
GFIFFQCLY

SEQ ID NO: 1338588 - protein, 9 aa, Homo Sapiens
QLSLHRLQA

SEQ ID NO: 1338589 - protein, 9 aa, Homo Sapiens
LTISPHCVP

SEQ ID NO: 1338590 - protein, 9 aa, Homo Sapiens
QCQEVLYHI

SEQ ID NO: 1338591 - protein, 9 aa, Homo Sapiens
HDVSSDEMD

SEQ ID NO: 1338592 - protein, 9 aa, Homo Sapiens
LPTGTYKVV

SEQ ID NO: 1338593 - protein, 9 aa, Homo Sapiens
VERIPQGPL

SEQ ID NO: 1338594 - protein, 9 aa, Homo Sapiens
VVWAFRTQA

SEQ ID NO: 1338595 - protein, 9 aa, Homo Sapiens
TCVYITEIA

SEQ ID NO: 1338596 - protein, 9 aa, Homo Sapiens
VAFNLFMLV

SEQ ID NO: 1338597 - protein, 9 aa, Homo Sapiens
SDSDSESDT

SEQ ID NO: 1338598 - protein, 9 aa, Homo Sapiens
GGLDLLMDL

SEQ ID NO: 1338599 - protein, 9 aa, Homo Sapiens
FVDKATARK

SEQ ID NO: 1338600 - protein, 9 aa, Homo Sapiens
LLLTEKDVS

SEQ ID NO: 1338601 - protein, 9 aa, Homo Sapiens
TDTEMKSDN

SEQ ID NO: 1338602 - protein, 9 aa, Homo Sapiens
EDPTLQICC

SEQ ID NO: 1338603 - protein, 9 aa, Homo Sapiens
IMPSFGMLN

SEQ ID NO: 1338604 - protein, 9 aa, Homo Sapiens
DKAEGSVAR

SEQ ID NO: 1338605 - protein, 9 aa, Homo Sapiens
RRKQGTGSL

SEQ ID NO: 1338606 - protein, 9 aa, Homo Sapiens
YITFNPTNN

SEQ ID NO: 1338607 - protein, 9 aa, Homo Sapiens
GIGDKCDDD

SEQ ID NO: 1338608 - protein, 9 aa, Homo Sapiens
CIEQVQHTC

SEQ ID NO: 1338609 - protein, 9 aa, Homo Sapiens
TDDETRKKV

SEQ ID NO: 1338610 - protein, 9 aa, Homo Sapiens
KEEEEDKGI

SEQ ID NO: 1338611 - protein, 9 aa, Homo Sapiens
LKLSEDHNG

SEQ ID NO: 1338612 - protein, 9 aa, Homo Sapiens
FIYEQSCEA

SEQ ID NO: 1338613 - protein, 9 aa, Homo Sapiens
LRHQQFQFY

SEQ ID NO: 1338614 - protein, 9 aa, Homo Sapiens
CHAYHQDCH

SEQ ID NO: 1338615 - protein, 9 aa, Homo Sapiens
GKILWAHQL

SEQ ID NO: 1338616 - protein, 9 aa, Homo Sapiens
HAMNSLSTM

SEQ ID NO: 1338617 - protein, 9 aa, Homo Sapiens
EMLTGCGAG

SEQ ID NO: 1338618 - protein, 9 aa, Homo Sapiens
SGRPRPGTK

SEQ ID NO: 1338619 - protein, 9 aa, Homo Sapiens
KLAALAETL

SEQ ID NO: 1338620 - protein, 9 aa, Homo Sapiens
ALSTVRGCY

SEQ ID NO: 1338621 - protein, 9 aa, Homo Sapiens
NGKQPNMET

SEQ ID NO: 1338622 - protein, 9 aa, Homo Sapiens
APQVDVPKV

SEQ ID NO: 1338623 - protein, 9 aa, Homo Sapiens
RTCSCTGAS

SEQ ID NO: 1338624 - protein, 9 aa, Homo Sapiens
THLTEELNK

SEQ ID NO: 1338625 - protein, 9 aa, Homo Sapiens
ERLHCRNML

SEQ ID NO: 1338626 - protein, 9 aa, Homo Sapiens
MESGYKPLV

SEQ ID NO: 1338627 - protein, 9 aa, Homo Sapiens
QAPEIFQCC

SEQ ID NO: 1338628 - protein, 9 aa, Homo Sapiens
RIREKERCN

SEQ ID NO: 1338629 - protein, 9 aa, Homo Sapiens
MKEKDEFNA

SEQ ID NO: 1338630 - protein, 9 aa, Homo Sapiens
EKHAGGVTC

SEQ ID NO: 1338631 - protein, 9 aa, Homo Sapiens
VNQLWYIHA

SEQ ID NO: 1338632 - protein, 9 aa, Homo Sapiens
EWGRSKERK

SEQ ID NO: 1338633 - protein, 9 aa, Homo Sapiens
MDGNCRYAK

SEQ ID NO: 1338634 - protein, 9 aa, Homo Sapiens
EAPVPSPVP

SEQ ID NO: 1338635 - protein, 9 aa, Homo Sapiens
YHPLQPLMN

SEQ ID NO: 1338636 - protein, 9 aa, Homo Sapiens
DAHRHQGVQ

SEQ ID NO: 1338637 - protein, 9 aa, Homo Sapiens
PIMFPSGGG

SEQ ID NO: 1338638 - protein, 9 aa, Homo Sapiens
AVPSSRFPL

SEQ ID NO: 1338639 - protein, 9 aa, Homo Sapiens
IYPDPLTYD

SEQ ID NO: 1338640 - protein, 9 aa, Homo Sapiens
IKMLEYVLK

SEQ ID NO: 1338641 - protein, 9 aa, Homo Sapiens
KIMSLVRSA

SEQ ID NO: 1338642 - protein, 9 aa, Homo Sapiens
PQEPTFSGE

SEQ ID NO: 1338643 - protein, 9 aa, Homo Sapiens
IAPNDITRD

SEQ ID NO: 1338644 - protein, 9 aa, Homo Sapiens
KMHAAEELY

SEQ ID NO: 1338645 - protein, 9 aa, Homo Sapiens
ITFNKINGL

SEQ ID NO: 1338646 - protein, 9 aa, Homo Sapiens
IRPLWCHYF

SEQ ID NO: 1338647 - protein, 9 aa, Homo Sapiens
IVTDVSPLS

SEQ ID NO: 1338648 - protein, 9 aa, Homo Sapiens
LMIPEISNI

SEQ ID NO: 1338649 - protein, 9 aa, Homo Sapiens
CYGVCVDCA

SEQ ID NO: 1338650 - protein, 9 aa, Homo Sapiens
LKRGKDGLL

SEQ ID NO: 1338651 - protein, 9 aa, Homo Sapiens
LGPQPMVPR

SEQ ID NO: 1338652 - protein, 9 aa, Homo Sapiens
MDPTGLEGG

SEQ ID NO: 1338653 - protein, 9 aa, Homo Sapiens
EEEEDKGIL

SEQ ID NO: 1338654 - protein, 9 aa, Homo Sapiens
CLSWSSRIV

SEQ ID NO: 1338655 - protein, 9 aa, Homo Sapiens
TNLYDIKRA

SEQ ID NO: 1338656 - protein, 9 aa, Homo Sapiens
VAGGVLGAT

SEQ ID NO: 1338657 - protein, 9 aa, Homo Sapiens
VTNDNVSCR

SEQ ID NO: 1338658 - protein, 9 aa, Homo Sapiens
PAGRSCGHT

SEQ ID NO: 1338659 - protein, 9 aa, Homo Sapiens
GVCHHTQDQ

SEQ ID NO: 1338660 - protein, 9 aa, Homo Sapiens
SIRQLLHEK

SEQ ID NO: 1338661 - protein, 9 aa, Homo Sapiens
GLPPGMREL

SEQ ID NO: 1338662 - protein, 9 aa, Homo Sapiens
QHMFEDLFE

SEQ ID NO: 1338663 - protein, 9 aa, Homo Sapiens
PDKMEEMLT

SEQ ID NO: 1338664 - protein, 9 aa, Homo Sapiens
FAGGKVSLW

SEQ ID NO: 1338665 - protein, 9 aa, Homo Sapiens
MLPKITVRD

SEQ ID NO: 1338666 - protein, 9 aa, Homo Sapiens
ASHLIFQVL

SEQ ID NO: 1338667 - protein, 9 aa, Homo Sapiens
GSPWPSSST

SEQ ID NO: 1338668 - protein, 9 aa, Homo Sapiens
SQKTKRMHT

SEQ ID NO: 1338669 - protein, 9 aa, Homo Sapiens
VRQDMEKER

SEQ ID NO: 1338670 - protein, 9 aa, Homo Sapiens
ESLKFSPHP

SEQ ID NO: 1338671 - protein, 9 aa, Homo Sapiens
TFDIDLSVP

SEQ ID NO: 1338672 - protein, 9 aa, Homo Sapiens
AWRKQSCRK

SEQ ID NO: 1338673 - protein, 9 aa, Homo Sapiens
SGWWFDVCL

SEQ ID NO: 1338674 - protein, 9 aa, Homo Sapiens
LTVIVVLMC

SEQ ID NO: 1338675 - protein, 9 aa, Homo Sapiens
LMFEMMTGR

SEQ ID NO: 1338676 - protein, 9 aa, Homo Sapiens
TGLQAQQDA

SEQ ID NO: 1338677 - protein, 9 aa, Homo Sapiens
GLSIPVDEE

SEQ ID NO: 1338678 - protein, 9 aa, Homo Sapiens
LRKFIFSTE

SEQ ID NO: 1338679 - protein, 9 aa, Homo Sapiens
KKSCFLYLP

SEQ ID NO: 1338680 - protein, 9 aa, Homo Sapiens
KLMRSLKRT

SEQ ID NO: 1338681 - protein, 9 aa, Homo Sapiens
LESELKHRS

SEQ ID NO: 1338682 - protein, 9 aa, Homo Sapiens
KSPVEEKDK

SEQ ID NO: 1338683 - protein, 9 aa, Homo Sapiens
DTIKFVLRD

SEQ ID NO: 1338684 - protein, 9 aa, Homo Sapiens
VILIVSHSS

SEQ ID NO: 1338685 - protein, 9 aa, Homo Sapiens
PGMGAQLWG

SEQ ID NO: 1338686 - protein, 9 aa, Homo Sapiens
SSVTADLMD

SEQ ID NO: 1338687 - protein, 9 aa, Homo Sapiens
NECGNIFKS

SEQ ID NO: 1338688 - protein, 9 aa, Homo Sapiens
GDLGNTVIH

SEQ ID NO: 1338689 - protein, 9 aa, Homo Sapiens
AFSSSFSLF

SEQ ID NO: 1338690 - protein, 9 aa, Homo Sapiens
LTKVYCGQR

SEQ ID NO: 1338691 - protein, 9 aa, Homo Sapiens
LLTATLKLQ

SEQ ID NO: 1338692 - protein, 9 aa, Homo Sapiens
STLSIKKCP

SEQ ID NO: 1338693 - protein, 9 aa, Homo Sapiens
VCFRNICKQ

SEQ ID NO: 1338694 - protein, 9 aa, Homo Sapiens
THNFHHFLK

SEQ ID NO: 1338695 - protein, 9 aa, Homo Sapiens
MEDDIMEEK

SEQ ID NO: 1338696 - protein, 9 aa, Homo Sapiens
CRKVMEAFE

SEQ ID NO: 1338697 - protein, 9 aa, Homo Sapiens
SITLLGLVG

SEQ ID NO: 1338698 - protein, 9 aa, Homo Sapiens
SIGEGFKEV

SEQ ID NO: 1338699 - protein, 9 aa, Homo Sapiens
DTVRQETNY

SEQ ID NO: 1338700 - protein, 9 aa, Homo Sapiens
SLISSATSA

SEQ ID NO: 1338701 - protein, 9 aa, Homo Sapiens
VWPEGTCEE

SEQ ID NO: 1338702 - protein, 9 aa, Homo Sapiens
VERYYADIT

SEQ ID NO: 1338703 - protein, 9 aa, Homo Sapiens
RTMHYSIGK

SEQ ID NO: 1338704 - protein, 9 aa, Homo Sapiens
KLNAKLALE

SEQ ID NO: 1338705 - protein, 9 aa, Homo Sapiens
MEQAHYLEP

SEQ ID NO: 1338706 - protein, 9 aa, Homo Sapiens
SVIFSLVKT

SEQ ID NO: 1338707 - protein, 9 aa, Homo Sapiens
ATSTWLEDE

SEQ ID NO: 1338708 - protein, 9 aa, Homo Sapiens
STSTAPDGT

SEQ ID NO: 1338709 - protein, 9 aa, Homo Sapiens
KDDFEVFFF

SEQ ID NO: 1338710 - protein, 9 aa, Homo Sapiens
SMREANMAC

SEQ ID NO: 1338711 - protein, 9 aa, Homo Sapiens
YMNMTPHRP

SEQ ID NO: 1338712 - protein, 9 aa, Homo Sapiens
MVFAGAPLQ

SEQ ID NO: 1338713 - protein, 9 aa, Homo Sapiens
TQQPHHRVA

SEQ ID NO: 1338714 - protein, 9 aa, Homo Sapiens
SYNPQKGIS

SEQ ID NO: 1338715 - protein, 9 aa, Homo Sapiens
KRKHRKRSH

SEQ ID NO: 1338716 - protein, 9 aa, Homo Sapiens
ECRAEEEQL

SEQ ID NO: 1338717 - protein, 9 aa, Homo Sapiens
VVPYNRMKL

SEQ ID NO: 1338718 - protein, 9 aa, Homo Sapiens
RMLGGEEVR

SEQ ID NO: 1338719 - protein, 9 aa, Homo Sapiens
CNGKQPNME

SEQ ID NO: 1338720 - protein, 9 aa, Homo Sapiens
GLLSMVNSG

SEQ ID NO: 1338721 - protein, 9 aa, Homo Sapiens
SHNLQDVVE

SEQ ID NO: 1338722 - protein, 9 aa, Homo Sapiens
LPRPKMTPA

SEQ ID NO: 1338723 - protein, 9 aa, Homo Sapiens
GFSFLLWTG

SEQ ID NO: 1338724 - protein, 9 aa, Homo Sapiens
GIKGKAGPR

SEQ ID NO: 1338725 - protein, 9 aa, Homo Sapiens
SQDTGHLTD

SEQ ID NO: 1338726 - protein, 9 aa, Homo Sapiens
PDLKLTIVM

SEQ ID NO: 1338727 - protein, 9 aa, Homo Sapiens
RVRALQNTL

SEQ ID NO: 1338728 - protein, 9 aa, Homo Sapiens
HNAYVWSQK

SEQ ID NO: 1338729 - protein, 9 aa, Homo Sapiens
QGQDSTQDT

SEQ ID NO: 1338730 - protein, 9 aa, Homo Sapiens
GGQKQRINL

SEQ ID NO: 1338731 - protein, 9 aa, Homo Sapiens
LLRSKQRDV

SEQ ID NO: 1338732 - protein, 9 aa, Homo Sapiens
GPAGPASIM

SEQ ID NO: 1338733 - protein, 9 aa, Homo Sapiens
NCVPRHDKV

SEQ ID NO: 1338734 - protein, 9 aa, Homo Sapiens
VHRCLLACR

SEQ ID NO: 1338735 - protein, 9 aa, Homo Sapiens
MQIWDMAGQ

SEQ ID NO: 1338736 - protein, 9 aa, Homo Sapiens
HYEVDAQWK

SEQ ID NO: 1338737 - protein, 9 aa, Homo Sapiens
SDGITNSPI

SEQ ID NO: 1338738 - protein, 9 aa, Homo Sapiens
VMQARIQHL

SEQ ID NO: 1338739 - protein, 9 aa, Homo Sapiens
TISNDHGYT

SEQ ID NO: 1338740 - protein, 9 aa, Homo Sapiens
VSILKGYRT

SEQ ID NO: 1338741 - protein, 9 aa, Homo Sapiens
LCCITFFIF

SEQ ID NO: 1338742 - protein, 9 aa, Homo Sapiens
TRGCTARGS

SEQ ID NO: 1338743 - protein, 9 aa, Homo Sapiens
KPVSVQLNY

SEQ ID NO: 1338744 - protein, 9 aa, Homo Sapiens
HFSYLTVHK

SEQ ID NO: 1338745 - protein, 9 aa, Homo Sapiens
LNTRPMEVF

SEQ ID NO: 1338746 - protein, 9 aa, Homo Sapiens
FTLLVENRI

SEQ ID NO: 1338747 - protein, 9 aa, Homo Sapiens
MVNSGPSTN

SEQ ID NO: 1338748 - protein, 9 aa, Homo Sapiens
FVSYDIRCT

SEQ ID NO: 1338749 - protein, 9 aa, Homo Sapiens
QPRQSVTDC

SEQ ID NO: 1338750 - protein, 9 aa, Homo Sapiens
CYQPACCVS

SEQ ID NO: 1338751 - protein, 9 aa, Homo Sapiens
TVSIESGTN

SEQ ID NO: 1338752 - protein, 9 aa, Homo Sapiens
TYTIIQERK

SEQ ID NO: 1338753 - protein, 9 aa, Homo Sapiens
DCRLLWIAQ

SEQ ID NO: 1338754 - protein, 9 aa, Homo Sapiens
WVVSRALCS

SEQ ID NO: 1338755 - protein, 9 aa, Homo Sapiens
MLQSQLLKV

SEQ ID NO: 1338756 - protein, 9 aa, Homo Sapiens
HPPRAGEAR

SEQ ID NO: 1338757 - protein, 9 aa, Homo Sapiens
FSFLLWTGA

SEQ ID NO: 1338758 - protein, 9 aa, Homo Sapiens
NRRDFQGKS

SEQ ID NO: 1338759 - protein, 9 aa, Homo Sapiens
HNKMLSNVV

SEQ ID NO: 1338760 - protein, 9 aa, Homo Sapiens
GSDEHGCLL

SEQ ID NO: 1338761 - protein, 9 aa, Homo Sapiens
VTSNAFLWP

SEQ ID NO: 1338762 - protein, 9 aa, Homo Sapiens
KRARNNIVI

SEQ ID NO: 1338763 - protein, 9 aa, Homo Sapiens
VSSRLKELA

SEQ ID NO: 1338764 - protein, 9 aa, Homo Sapiens
GLRLGVEYT

SEQ ID NO: 1338765 - protein, 9 aa, Homo Sapiens
NAIPKHLCL

SEQ ID NO: 1338766 - protein, 9 aa, Homo Sapiens
IYDCQISKQ

SEQ ID NO: 1338767 - protein, 9 aa, Homo Sapiens
LVALLAHVL

SEQ ID NO: 1338768 - protein, 9 aa, Homo Sapiens
ITTANNLLA

SEQ ID NO: 1338769 - protein, 9 aa, Homo Sapiens
NTTFSSTIF

SEQ ID NO: 1338770 - protein, 9 aa, Homo Sapiens
DDVYHSLEE

SEQ ID NO: 1338771 - protein, 9 aa, Homo Sapiens
PKKQQVSAS

SEQ ID NO: 1338772 - protein, 9 aa, Homo Sapiens
HLDLAGRDL

SEQ ID NO: 1338773 - protein, 9 aa, Homo Sapiens
KYQASTSNM

SEQ ID NO: 1338774 - protein, 9 aa, Homo Sapiens
VDEATNYNS

SEQ ID NO: 1338775 - protein, 9 aa, Homo Sapiens
AKMRRRSWQ

SEQ ID NO: 1338776 - protein, 9 aa, Homo Sapiens
PLAKTTSRS

SEQ ID NO: 1338777 - protein, 9 aa, Homo Sapiens
GLTNAPELH

SEQ ID NO: 1338778 - protein, 9 aa, Homo Sapiens
MGLRYSAFW

SEQ ID NO: 1338779 - protein, 9 aa, Homo Sapiens
AMCLWKNHQ

SEQ ID NO: 1338780 - protein, 9 aa, Homo Sapiens
AFTNLTSLC

SEQ ID NO: 1338781 - protein, 9 aa, Homo Sapiens
SSQGTTSDT

SEQ ID NO: 1338782 - protein, 9 aa, Homo Sapiens
LGLRKAVNA

SEQ ID NO: 1338783 - protein, 9 aa, Homo Sapiens
PILDVVDSK

SEQ ID NO: 1338784 - protein, 9 aa, Homo Sapiens
LIKWLDSDV

SEQ ID NO: 1338785 - protein, 9 aa, Homo Sapiens
QSLSHRLDE

SEQ ID NO: 1338786 - protein, 9 aa, Homo Sapiens
KDGKVLHTI

SEQ ID NO: 1338787 - protein, 9 aa, Homo Sapiens
PEKQVSSSR

SEQ ID NO: 1338788 - protein, 9 aa, Homo Sapiens
VGSNIVQLL

SEQ ID NO: 1338789 - protein, 9 aa, Homo Sapiens
YCPCDKYNT

SEQ ID NO: 1338790 - protein, 9 aa, Homo Sapiens
AEKCRLQEL

SEQ ID NO: 1338791 - protein, 9 aa, Homo Sapiens
CRSMSDNGI

SEQ ID NO: 1338792 - protein, 9 aa, Homo Sapiens
EKSPHLAAL

SEQ ID NO: 1338793 - protein, 9 aa, Homo Sapiens
WMTSLISSL

SEQ ID NO: 1338794 - protein, 9 aa, Homo Sapiens
VLEEVIREG

SEQ ID NO: 1338795 - protein, 9 aa, Homo Sapiens
GDIYAKTLP

SEQ ID NO: 1338796 - protein, 9 aa, Homo Sapiens
KDLAPKCDA

SEQ ID NO: 1338797 - protein, 9 aa, Homo Sapiens
MTFANSPWV

SEQ ID NO: 1338798 - protein, 9 aa, Homo Sapiens
DEEWRSQWK

SEQ ID NO: 1338799 - protein, 9 aa, Homo Sapiens
RILMKVTAF

SEQ ID NO: 1338800 - protein, 9 aa, Homo Sapiens
DYITAVYVE

SEQ ID NO: 1338801 - protein, 9 aa, Homo Sapiens
RGFNMRMGE

SEQ ID NO: 1338802 - protein, 9 aa, Homo Sapiens
SFFTSAHPS

SEQ ID NO: 1338803 - protein, 9 aa, Homo Sapiens
DNKEYVVNE

SEQ ID NO: 1338804 - protein, 9 aa, Homo Sapiens
EEKKKNKEL

SEQ ID NO: 1338805 - protein, 9 aa, Homo Sapiens
QGYRTASII

SEQ ID NO: 1338806 - protein, 9 aa, Homo Sapiens
QVWQRGSIT

SEQ ID NO: 1338807 - protein, 9 aa, Homo Sapiens
RKNYGLMCL

SEQ ID NO: 1338808 - protein, 9 aa, Homo Sapiens
LDQTMDLSI

SEQ ID NO: 1338809 - protein, 9 aa, Homo Sapiens
LSEGFTTHL

SEQ ID NO: 1338810 - protein, 9 aa, Homo Sapiens
SQQELRVPC

SEQ ID NO: 1338811 - protein, 9 aa, Homo Sapiens
RNRKSFSSS

SEQ ID NO: 1338812 - protein, 9 aa, Homo Sapiens
WTKEWRVLL

SEQ ID NO: 1338813 - protein, 9 aa, Homo Sapiens
IGYGHTAPG

SEQ ID NO: 1338814 - protein, 9 aa, Homo Sapiens
TLCKHLARL

SEQ ID NO: 1338815 - protein, 9 aa, Homo Sapiens
YLDILTEKE

SEQ ID NO: 1338816 - protein, 9 aa, Homo Sapiens
ELKPDPTKT

SEQ ID NO: 1338817 - protein, 9 aa, Homo Sapiens
MAPQTLLPA

SEQ ID NO: 1338818 - protein, 9 aa, Homo Sapiens
LGHDPVHKL

SEQ ID NO: 1338819 - protein, 9 aa, Homo Sapiens
MEGFLAFPS

SEQ ID NO: 1338820 - protein, 9 aa, Homo Sapiens
SSCIVLTLV

SEQ ID NO: 1338821 - protein, 9 aa, Homo Sapiens
HIAQQGSYT

SEQ ID NO: 1338822 - protein, 9 aa, Homo Sapiens
ASGPCHAAA

SEQ ID NO: 1338823 - protein, 9 aa, Homo Sapiens
PQQDNLITL

SEQ ID NO: 1338824 - protein, 9 aa, Homo Sapiens
EFYLLAAIS

SEQ ID NO: 1338825 - protein, 9 aa, Homo Sapiens
LLASMAYDH

SEQ ID NO: 1338826 - protein, 9 aa, Homo Sapiens
RKMHSWSKL

SEQ ID NO: 1338827 - protein, 9 aa, Homo Sapiens
WLGVFRAES

SEQ ID NO: 1338828 - protein, 9 aa, Homo Sapiens
AAAVMLFCG

SEQ ID NO: 1338829 - protein, 9 aa, Homo Sapiens
SLNEVTMVL

SEQ ID NO: 1338830 - protein, 9 aa, Homo Sapiens
PPSTVGIRQ

SEQ ID NO: 1338831 - protein, 9 aa, Homo Sapiens
KRRNPQLRQ

SEQ ID NO: 1338832 - protein, 9 aa, Homo Sapiens
RSGGNRRSW

SEQ ID NO: 1338833 - protein, 9 aa, Homo Sapiens
EGKNIDDLK

SEQ ID NO: 1338834 - protein, 9 aa, Homo Sapiens
TSVPKNPLL

SEQ ID NO: 1338835 - protein, 9 aa, Homo Sapiens
SHSQYQGGG

SEQ ID NO: 1338836 - protein, 9 aa, Homo Sapiens
GFNMRMGER

SEQ ID NO: 1338837 - protein, 9 aa, Homo Sapiens
FTRSRHSGS

SEQ ID NO: 1338838 - protein, 9 aa, Homo Sapiens
GTLHDPFGH

SEQ ID NO: 1338839 - protein, 9 aa, Homo Sapiens
QCEWCSIDG

SEQ ID NO: 1338840 - protein, 9 aa, Homo Sapiens
GEKLYTCLK

SEQ ID NO: 1338841 - protein, 9 aa, Homo Sapiens
RGSSLTPLL

SEQ ID NO: 1338842 - protein, 9 aa, Homo Sapiens
RLEHAWLTQ

SEQ ID NO: 1338843 - protein, 9 aa, Homo Sapiens
SAKMHLRQA

SEQ ID NO: 1338844 - protein, 9 aa, Homo Sapiens
GVTMVHPLL

SEQ ID NO: 1338845 - protein, 9 aa, Homo Sapiens
AAEPWPENV

SEQ ID NO: 1338846 - protein, 9 aa, Homo Sapiens
EMLKRQHSL

SEQ ID NO: 1338847 - protein, 9 aa, Homo Sapiens
HHWRDRHHQ

SEQ ID NO: 1338848 - protein, 9 aa, Homo Sapiens
AIYTIMCWF

SEQ ID NO: 1338849 - protein, 9 aa, Homo Sapiens
HTPAASQGL

SEQ ID NO: 1338850 - protein, 9 aa, Homo Sapiens
GGSTHNITQ

SEQ ID NO: 1338851 - protein, 9 aa, Homo Sapiens
WLSDSYMAL

SEQ ID NO: 1338852 - protein, 9 aa, Homo Sapiens
REAREEKIR

SEQ ID NO: 1338853 - protein, 9 aa, Homo Sapiens
PKGSLDNAR

SEQ ID NO: 1338854 - protein, 9 aa, Homo Sapiens
ALVAFSEAS

SEQ ID NO: 1338855 - protein, 9 aa, Homo Sapiens
WTPPSITPS

SEQ ID NO: 1338856 - protein, 9 aa, Homo Sapiens
DVIFLVDII

SEQ ID NO: 1338857 - protein, 9 aa, Homo Sapiens
SILHAFLLC

SEQ ID NO: 1338858 - protein, 9 aa, Homo Sapiens
TTTAVTDPQ

SEQ ID NO: 1338859 - protein, 9 aa, Homo Sapiens
QAQAWKEVQ

SEQ ID NO: 1338860 - protein, 9 aa, Homo Sapiens
VHKEAVSAR

SEQ ID NO: 1338861 - protein, 9 aa, Homo Sapiens
FECDCKEAD

SEQ ID NO: 1338862 - protein, 9 aa, Homo Sapiens
ASAYLDELH

SEQ ID NO: 1338863 - protein, 9 aa, Homo Sapiens
HVIRHTMNL

SEQ ID NO: 1338864 - protein, 9 aa, Homo Sapiens
CEQVSKPCA

SEQ ID NO: 1338865 - protein, 9 aa, Homo Sapiens
LSLPPPPAL

SEQ ID NO: 1338866 - protein, 9 aa, Homo Sapiens
EGPLFGRSV

SEQ ID NO: 1338867 - protein, 9 aa, Homo Sapiens
DGSAVSIYV

SEQ ID NO: 1338868 - protein, 9 aa, Homo Sapiens
WERSQQRER

SEQ ID NO: 1338869 - protein, 9 aa, Homo Sapiens
MLKPKYFPA

SEQ ID NO: 1338870 - protein, 9 aa, Homo Sapiens
KTTLLCHRR

SEQ ID NO: 1338871 - protein, 9 aa, Homo Sapiens
AQTQIDLLE

SEQ ID NO: 1338872 - protein, 9 aa, Homo Sapiens
FKLKYGWKK

SEQ ID NO: 1338873 - protein, 9 aa, Homo Sapiens
SEVTDLRHT

SEQ ID NO: 1338874 - protein, 9 aa, Homo Sapiens
LPGDGLTVK

SEQ ID NO: 1338875 - protein, 9 aa, Homo Sapiens
LEIDDIYTP

SEQ ID NO: 1338876 - protein, 9 aa, Homo Sapiens
INDNPPIFR

SEQ ID NO: 1338877 - protein, 9 aa, Homo Sapiens
PGTVALHEI

SEQ ID NO: 1338878 - protein, 9 aa, Homo Sapiens
PRDESLNSL

SEQ ID NO: 1338879 - protein, 9 aa, Homo Sapiens
AHNQQLWEQ

SEQ ID NO: 1338880 - protein, 9 aa, Homo Sapiens
RSSQASRHF

SEQ ID NO: 1338881 - protein, 9 aa, Homo Sapiens
YKLQTYDVS

SEQ ID NO: 1338882 - protein, 9 aa, Homo Sapiens
PKAHTTFEG

SEQ ID NO: 1338883 - protein, 9 aa, Homo Sapiens
SNDCMMDSS

SEQ ID NO: 1338884 - protein, 9 aa, Homo Sapiens
CRPVIPPSI

SEQ ID NO: 1338885 - protein, 9 aa, Homo Sapiens
VRRGTGLPW

SEQ ID NO: 1338886 - protein, 9 aa, Homo Sapiens
AFDRFMAIC

SEQ ID NO: 1338887 - protein, 9 aa, Homo Sapiens
RQAKVWMIA

SEQ ID NO: 1338888 - protein, 9 aa, Homo Sapiens
IRDRRNNMK

SEQ ID NO: 1338889 - protein, 9 aa, Homo Sapiens
GTWQWINPV

SEQ ID NO: 1338890 - protein, 9 aa, Homo Sapiens
PTIDLSQMT

SEQ ID NO: 1338891 - protein, 9 aa, Homo Sapiens
SALPDVAPV

SEQ ID NO: 1338892 - protein, 9 aa, Homo Sapiens
STLQHYYVY

SEQ ID NO: 1338893 - protein, 9 aa, Homo Sapiens
QVPMELVQW

SEQ ID NO: 1338894 - protein, 9 aa, Homo Sapiens
DCCLVVPLL

SEQ ID NO: 1338895 - protein, 9 aa, Homo Sapiens
DSLPQLTSV

SEQ ID NO: 1338896 - protein, 9 aa, Homo Sapiens
GCSSYLMKP

SEQ ID NO: 1338897 - protein, 9 aa, Homo Sapiens
SLHEAVHFS

SEQ ID NO: 1338898 - protein, 9 aa, Homo Sapiens
ELLLCSNMS

SEQ ID NO: 1338899 - protein, 9 aa, Homo Sapiens
RDLGNCMHT

SEQ ID NO: 1338900 - protein, 9 aa, Homo Sapiens
SRRFGSHSC

SEQ ID NO: 1338901 - protein, 9 aa, Homo Sapiens
TATERVIAR

SEQ ID NO: 1338902 - protein, 9 aa, Homo Sapiens
ADSMYDKLR

SEQ ID NO: 1338903 - protein, 9 aa, Homo Sapiens
IPRVGKRHA

SEQ ID NO: 1338904 - protein, 9 aa, Homo Sapiens
NELHVSCME

SEQ ID NO: 1338905 - protein, 9 aa, Homo Sapiens
RVRQGQETP

SEQ ID NO: 1338906 - protein, 9 aa, Homo Sapiens
MIMYNFFIV

SEQ ID NO: 1338907 - protein, 9 aa, Homo Sapiens
LPATATMSP

SEQ ID NO: 1338908 - protein, 9 aa, Homo Sapiens
PRKHLVECG

SEQ ID NO: 1338909 - protein, 9 aa, Homo Sapiens
EFNARFGLR

SEQ ID NO: 1338910 - protein, 9 aa, Homo Sapiens
VLRKHKDLL

SEQ ID NO: 1338911 - protein, 9 aa, Homo Sapiens
REVPEYLYH

SEQ ID NO: 1338912 - protein, 9 aa, Homo Sapiens
NMCKKFEGN

SEQ ID NO: 1338913 - protein, 9 aa, Homo Sapiens
MQRQEEERM

SEQ ID NO: 1338914 - protein, 9 aa, Homo Sapiens
VGYPFHLFD

SEQ ID NO: 1338915 - protein, 9 aa, Homo Sapiens
WCPTNSTGK

SEQ ID NO: 1338916 - protein, 9 aa, Homo Sapiens
LHQLGSKYI

SEQ ID NO: 1338917 - protein, 9 aa, Homo Sapiens
KQRWSEKKA

SEQ ID NO: 1338918 - protein, 9 aa, Homo Sapiens
LPAKQREHL

SEQ ID NO: 1338919 - protein, 9 aa, Homo Sapiens
GPDWHLKIP

SEQ ID NO: 1338920 - protein, 9 aa, Homo Sapiens
FDNQPCVLG

SEQ ID NO: 1338921 - protein, 9 aa, Homo Sapiens
NPYMLAVAN

SEQ ID NO: 1338922 - protein, 9 aa, Homo Sapiens
GIGPLTRDA

SEQ ID NO: 1338923 - protein, 9 aa, Homo Sapiens
TKLVEVMFM

SEQ ID NO: 1338924 - protein, 9 aa, Homo Sapiens
VKQKISFKY

SEQ ID NO: 1338925 - protein, 9 aa, Homo Sapiens
DSQPYMRRM

SEQ ID NO: 1338926 - protein, 9 aa, Homo Sapiens
ERICLARQI

SEQ ID NO: 1338927 - protein, 9 aa, Homo Sapiens
QYRHKMRWL

SEQ ID NO: 1338928 - protein, 9 aa, Homo Sapiens
GTFNNLFNL

SEQ ID NO: 1338929 - protein, 9 aa, Homo Sapiens
EVQRLESTG

SEQ ID NO: 1338930 - protein, 9 aa, Homo Sapiens
ERIPQGPLA

SEQ ID NO: 1338931 - protein, 9 aa, Homo Sapiens
SSSLSSHVS

SEQ ID NO: 1338932 - protein, 9 aa, Homo Sapiens
TKPQVKPGF

SEQ ID NO: 1338933 - protein, 9 aa, Homo Sapiens
TVLLDGCSK

SEQ ID NO: 1338934 - protein, 9 aa, Homo Sapiens
WNLPPHAET

SEQ ID NO: 1338935 - protein, 9 aa, Homo Sapiens
DDLVNVFDI

SEQ ID NO: 1338936 - protein, 9 aa, Homo Sapiens
LIYYKILGL

SEQ ID NO: 1338937 - protein, 9 aa, Homo Sapiens
LLVVHTRHY

SEQ ID NO: 1338938 - protein, 9 aa, Homo Sapiens
AIIQHHHPF

SEQ ID NO: 1338939 - protein, 9 aa, Homo Sapiens
DTLQVSKRN

SEQ ID NO: 1338940 - protein, 9 aa, Homo Sapiens
ETSPKETSM

SEQ ID NO: 1338941 - protein, 9 aa, Homo Sapiens
VDFTPQCLK

SEQ ID NO: 1338942 - protein, 9 aa, Homo Sapiens
VHWKGQVLN

SEQ ID NO: 1338943 - protein, 9 aa, Homo Sapiens
KYLEIEEHN

SEQ ID NO: 1338944 - protein, 9 aa, Homo Sapiens
LHALGELLR

SEQ ID NO: 1338945 - protein, 9 aa, Homo Sapiens
QAWLRLRVL

SEQ ID NO: 1338946 - protein, 9 aa, Homo Sapiens
GPCSDTLVD

SEQ ID NO: 1338947 - protein, 9 aa, Homo Sapiens
VTLLVWYRH

SEQ ID NO: 1338948 - protein, 9 aa, Homo Sapiens
QRAVYDTLM

SEQ ID NO: 1338949 - protein, 9 aa, Homo Sapiens
WNTHHILSH

SEQ ID NO: 1338950 - protein, 9 aa, Homo Sapiens
HTQQIQEEL

SEQ ID NO: 1338951 - protein, 9 aa, Homo Sapiens
QKYLEIEEH

SEQ ID NO: 1338952 - protein, 9 aa, Homo Sapiens
HRDLTARNC

SEQ ID NO: 1338953 - protein, 9 aa, Homo Sapiens
IKRAGSRAG

SEQ ID NO: 1338954 - protein, 9 aa, Homo Sapiens
CTSPEAMRP

SEQ ID NO: 1338955 - protein, 9 aa, Homo Sapiens
GDVWIVRIW

SEQ ID NO: 1338956 - protein, 9 aa, Homo Sapiens
LAHRKMHAA

SEQ ID NO: 1338957 - protein, 9 aa, Homo Sapiens
PASIMSGRC

SEQ ID NO: 1338958 - protein, 9 aa, Homo Sapiens
AQNSSGTLS

SEQ ID NO: 1338959 - protein, 9 aa, Homo Sapiens
YNCRNIDSE

SEQ ID NO: 1338960 - protein, 9 aa, Homo Sapiens
VVFRQRQPG

SEQ ID NO: 1338961 - protein, 9 aa, Homo Sapiens
NEEDTSLKR

SEQ ID NO: 1338962 - protein, 9 aa, Homo Sapiens
VPFCYFIND

SEQ ID NO: 1338963 - protein, 9 aa, Homo Sapiens
HKNQDPGTK

SEQ ID NO: 1338964 - protein, 9 aa, Homo Sapiens
LAAPRGVCY

SEQ ID NO: 1338965 - protein, 9 aa, Homo Sapiens
RFKLQSLSH

SEQ ID NO: 1338966 - protein, 9 aa, Homo Sapiens
ASTLDQPSF

SEQ ID NO: 1338967 - protein, 9 aa, Homo Sapiens
GLLLNLLDV

SEQ ID NO: 1338968 - protein, 9 aa, Homo Sapiens
GEDGTPIIT

SEQ ID NO: 1338969 - protein, 9 aa, Homo Sapiens
WRPLSIGPH

SEQ ID NO: 1338970 - protein, 9 aa, Homo Sapiens
NETKKKKGE

SEQ ID NO: 1338971 - protein, 9 aa, Homo Sapiens
FNQEANIPL

SEQ ID NO: 1338972 - protein, 9 aa, Homo Sapiens
AIKSVLLVV

SEQ ID NO: 1338973 - protein, 9 aa, Homo Sapiens
QSLEGRGTP

SEQ ID NO: 1338974 - protein, 9 aa, Homo Sapiens
RLPARDCTP

SEQ ID NO: 1338975 - protein, 9 aa, Homo Sapiens
QSVFLDDII

SEQ ID NO: 1338976 - protein, 9 aa, Homo Sapiens
DYKYLHWQV

SEQ ID NO: 1338977 - protein, 9 aa, Homo Sapiens
GDTVSVHHP

SEQ ID NO: 1338978 - protein, 9 aa, Homo Sapiens
KSTILCLLF

SEQ ID NO: 1338979 - protein, 9 aa, Homo Sapiens
RAFRCSRWV

SEQ ID NO: 1338980 - protein, 9 aa, Homo Sapiens
LKRVICGFD

SEQ ID NO: 1338981 - protein, 9 aa, Homo Sapiens
LIPEKAFVG

SEQ ID NO: 1338982 - protein, 9 aa, Homo Sapiens
SAKGWRKAF

SEQ ID NO: 1338983 - protein, 9 aa, Homo Sapiens
VTLHWKKDG

SEQ ID NO: 1338984 - protein, 9 aa, Homo Sapiens
PVAYKKEKW

SEQ ID NO: 1338985 - protein, 9 aa, Homo Sapiens
MLRHGWCTG

SEQ ID NO: 1338986 - protein, 9 aa, Homo Sapiens
KITVVEEDG

SEQ ID NO: 1338987 - protein, 9 aa, Homo Sapiens
KSLHLLVAD

SEQ ID NO: 1338988 - protein, 9 aa, Homo Sapiens
WSFPRASED

SEQ ID NO: 1338989 - protein, 9 aa, Homo Sapiens
EEDYEKAFF

SEQ ID NO: 1338990 - protein, 9 aa, Homo Sapiens
EFICLGSLS

SEQ ID NO: 1338991 - protein, 9 aa, Homo Sapiens
CPAGPKGAG

SEQ ID NO: 1338992 - protein, 9 aa, Homo Sapiens
DVYHSLEEL

SEQ ID NO: 1338993 - protein, 9 aa, Homo Sapiens
ALANRHILL

SEQ ID NO: 1338994 - protein, 9 aa, Homo Sapiens
PSAHISAAA

SEQ ID NO: 1338995 - protein, 9 aa, Homo Sapiens
LRLLDGTFK

SEQ ID NO: 1338996 - protein, 9 aa, Homo Sapiens
IWKFQHHDL

SEQ ID NO: 1338997 - protein, 9 aa, Homo Sapiens
NRTMHYSIG

SEQ ID NO: 1338998 - protein, 9 aa, Homo Sapiens
TSGNFFMML

SEQ ID NO: 1338999 - protein, 9 aa, Homo Sapiens
ATYTPRHPR

SEQ ID NO: 1339000 - protein, 9 aa, Homo Sapiens
MCILDQYSY

SEQ ID NO: 1339001 - protein, 9 aa, Homo Sapiens
PTKIGCRSL

SEQ ID NO: 1339002 - protein, 9 aa, Homo Sapiens
QARHQAEKM

SEQ ID NO: 1339003 - protein, 9 aa, Homo Sapiens
YEDKFSDTE

SEQ ID NO: 1339004 - protein, 9 aa, Homo Sapiens
RLKSHSMVR

SEQ ID NO: 1339005 - protein, 9 aa, Homo Sapiens
TANHGEVKC

SEQ ID NO: 1339006 - protein, 9 aa, Homo Sapiens
DNPVNRSLV

SEQ ID NO: 1339007 - protein, 9 aa, Homo Sapiens
GSLPPQDSC

SEQ ID NO: 1339008 - protein, 9 aa, Homo Sapiens
LFNELHNPD

SEQ ID NO: 1339009 - protein, 9 aa, Homo Sapiens
PSNTLSTVL

SEQ ID NO: 1339010 - protein, 9 aa, Homo Sapiens
TGCGAGMCQ

SEQ ID NO: 1339011 - protein, 9 aa, Homo Sapiens
CCPEKICHK

SEQ ID NO: 1339012 - protein, 9 aa, Homo Sapiens
QVCDHYQHI

SEQ ID NO: 1339013 - protein, 9 aa, Homo Sapiens
EIGSSKINA

SEQ ID NO: 1339014 - protein, 9 aa, Homo Sapiens
SADDLHINL

SEQ ID NO: 1339015 - protein, 9 aa, Homo Sapiens
LGAPWGGRG

SEQ ID NO: 1339016 - protein, 9 aa, Homo Sapiens
YLRSLEMDS

SEQ ID NO: 1339017 - protein, 9 aa, Homo Sapiens
IWFYAKIYK

SEQ ID NO: 1339018 - protein, 9 aa, Homo Sapiens
EELLTLWHV

SEQ ID NO: 1339019 - protein, 9 aa, Homo Sapiens
LKDVMLMGD

SEQ ID NO: 1339020 - protein, 9 aa, Homo Sapiens
NAVPSSRFP

SEQ ID NO: 1339021 - protein, 9 aa, Homo Sapiens
TTCVGRNGY

SEQ ID NO: 1339022 - protein, 9 aa, Homo Sapiens
LQPDKNGQN

SEQ ID NO: 1339023 - protein, 9 aa, Homo Sapiens
EVLRHTSLW

SEQ ID NO: 1339024 - protein, 9 aa, Homo Sapiens
SGSETVHTS

SEQ ID NO: 1339025 - protein, 9 aa, Homo Sapiens
EVCDEAAGR

SEQ ID NO: 1339026 - protein, 9 aa, Homo Sapiens
DRSLRKCLH

SEQ ID NO: 1339027 - protein, 9 aa, Homo Sapiens
IVTYHGSYL

SEQ ID NO: 1339028 - protein, 9 aa, Homo Sapiens
TDTTSEIGS

SEQ ID NO: 1339029 - protein, 9 aa, Homo Sapiens
DLAMEHGGS

SEQ ID NO: 1339030 - protein, 9 aa, Homo Sapiens
RNVEDIEQL

SEQ ID NO: 1339031 - protein, 9 aa, Homo Sapiens
MWRINPAHR

SEQ ID NO: 1339032 - protein, 9 aa, Homo Sapiens
QVGGTQEVE

SEQ ID NO: 1339033 - protein, 9 aa, Homo Sapiens
PEESEDIVT

SEQ ID NO: 1339034 - protein, 9 aa, Homo Sapiens
LLLLLLLDL

SEQ ID NO: 1339035 - protein, 9 aa, Homo Sapiens
PPGPTLGTM

SEQ ID NO: 1339036 - protein, 9 aa, Homo Sapiens
HQPLSIQWK

SEQ ID NO: 1339037 - protein, 9 aa, Homo Sapiens
NTNGSSPEP

SEQ ID NO: 1339038 - protein, 9 aa, Homo Sapiens
SRGRAVKKK

SEQ ID NO: 1339039 - protein, 9 aa, Homo Sapiens
ATFSMNASL

SEQ ID NO: 1339040 - protein, 9 aa, Homo Sapiens
LQADMMDVD

SEQ ID NO: 1339041 - protein, 9 aa, Homo Sapiens
EAESNMNNL

SEQ ID NO: 1339042 - protein, 9 aa, Homo Sapiens
MCAHLFTAT

SEQ ID NO: 1339043 - protein, 9 aa, Homo Sapiens
NTANRISGT

SEQ ID NO: 1339044 - protein, 9 aa, Homo Sapiens
QSMEEPQMV

SEQ ID NO: 1339045 - protein, 9 aa, Homo Sapiens
HILVTSFNH

SEQ ID NO: 1339046 - protein, 9 aa, Homo Sapiens
QTLHHFLEQ

SEQ ID NO: 1339047 - protein, 9 aa, Homo Sapiens
HFSKILENL

SEQ ID NO: 1339048 - protein, 9 aa, Homo Sapiens
MAHQFPALT

SEQ ID NO: 1339049 - protein, 9 aa, Homo Sapiens
NDNVPTFTQ

SEQ ID NO: 1339050 - protein, 9 aa, Homo Sapiens
RCCASTWTV

SEQ ID NO: 1339051 - protein, 9 aa, Homo Sapiens
EWDRTYLAA

SEQ ID NO: 1339052 - protein, 9 aa, Homo Sapiens
QQMSYPCFV

SEQ ID NO: 1339053 - protein, 9 aa, Homo Sapiens
GAASTPRDE

SEQ ID NO: 1339054 - protein, 9 aa, Homo Sapiens
KIQEQYHRI

SEQ ID NO: 1339055 - protein, 9 aa, Homo Sapiens
KAPLVPSSP

SEQ ID NO: 1339056 - protein, 9 aa, Homo Sapiens
KDRSNNQFE

SEQ ID NO: 1339057 - protein, 9 aa, Homo Sapiens
CWGGGHPLD

SEQ ID NO: 1339058 - protein, 9 aa, Homo Sapiens
VSELSLQGW

SEQ ID NO: 1339059 - protein, 9 aa, Homo Sapiens
LSRFASTSI

SEQ ID NO: 1339060 - protein, 9 aa, Homo Sapiens
DVTHPRMRH

SEQ ID NO: 1339061 - protein, 9 aa, Homo Sapiens
LTIVRRRGR

SEQ ID NO: 1339062 - protein, 9 aa, Homo Sapiens
FESYQLDSM

SEQ ID NO: 1339063 - protein, 9 aa, Homo Sapiens
THNDNGDLL

SEQ ID NO: 1339064 - protein, 9 aa, Homo Sapiens
ETKKKKGEK

SEQ ID NO: 1339065 - protein, 9 aa, Homo Sapiens
GPRGISSYV

SEQ ID NO: 1339066 - protein, 9 aa, Homo Sapiens
SHSDTYVIR

SEQ ID NO: 1339067 - protein, 9 aa, Homo Sapiens
LSKTKETGK

SEQ ID NO: 1339068 - protein, 9 aa, Homo Sapiens
AEVGSAAGG

SEQ ID NO: 1339069 - protein, 9 aa, Homo Sapiens
SLCVSEQTL

SEQ ID NO: 1339070 - protein, 9 aa, Homo Sapiens
LVQEQELVK

SEQ ID NO: 1339071 - protein, 9 aa, Homo Sapiens
VSDTMVEPY

SEQ ID NO: 1339072 - protein, 9 aa, Homo Sapiens
PQDHLAYRY

SEQ ID NO: 1339073 - protein, 9 aa, Homo Sapiens
IQIPVSFQD

SEQ ID NO: 1339074 - protein, 9 aa, Homo Sapiens
VYDTLMTIN

SEQ ID NO: 1339075 - protein, 9 aa, Homo Sapiens
AVDWCLFRN

SEQ ID NO: 1339076 - protein, 9 aa, Homo Sapiens
HLKIFYCCQ

SEQ ID NO: 1339077 - protein, 9 aa, Homo Sapiens
EQLEGKHSV

SEQ ID NO: 1339078 - protein, 9 aa, Homo Sapiens
AALYTYMLP

SEQ ID NO: 1339079 - protein, 9 aa, Homo Sapiens
HMDYKYLHW

SEQ ID NO: 1339080 - protein, 9 aa, Homo Sapiens
PFVTSIDDV

SEQ ID NO: 1339081 - protein, 9 aa, Homo Sapiens
LQAECRALC

SEQ ID NO: 1339082 - protein, 9 aa, Homo Sapiens
QVFVVEGKA

SEQ ID NO: 1339083 - protein, 9 aa, Homo Sapiens
CSECDKAFS

SEQ ID NO: 1339084 - protein, 9 aa, Homo Sapiens
RCSHLTDAD

SEQ ID NO: 1339085 - protein, 9 aa, Homo Sapiens
EELHARAGE

SEQ ID NO: 1339086 - protein, 9 aa, Homo Sapiens
VDIFTNLGY

SEQ ID NO: 1339087 - protein, 9 aa, Homo Sapiens
MVHVYEQVR

SEQ ID NO: 1339088 - protein, 9 aa, Homo Sapiens
QDSDYVLHN

SEQ ID NO: 1339089 - protein, 9 aa, Homo Sapiens
HPSQSVRKA

SEQ ID NO: 1339090 - protein, 9 aa, Homo Sapiens
DIRTIAEVE

SEQ ID NO: 1339091 - protein, 9 aa, Homo Sapiens
ACLMYDILN

SEQ ID NO: 1339092 - protein, 9 aa, Homo Sapiens
EDAKRIKNQ

SEQ ID NO: 1339093 - protein, 9 aa, Homo Sapiens
LGEFERLHR

SEQ ID NO: 1339094 - protein, 9 aa, Homo Sapiens
IIKRAGSRA

SEQ ID NO: 1339095 - protein, 9 aa, Homo Sapiens
GTYQVTVCI

SEQ ID NO: 1339096 - protein, 9 aa, Homo Sapiens
DTLVIFQLY

SEQ ID NO: 1339097 - protein, 9 aa, Homo Sapiens
PISSSACLN

SEQ ID NO: 1339098 - protein, 9 aa, Homo Sapiens
KLARYRGQY

SEQ ID NO: 1339099 - protein, 9 aa, Homo Sapiens
DRPNTYFRP

SEQ ID NO: 1339100 - protein, 9 aa, Homo Sapiens
QPIRPKSHP

SEQ ID NO: 1339101 - protein, 9 aa, Homo Sapiens
LKTYTQVGL

SEQ ID NO: 1339102 - protein, 9 aa, Homo Sapiens
GGKNRHRGK

SEQ ID NO: 1339103 - protein, 9 aa, Homo Sapiens
NPPYILDLL

SEQ ID NO: 1339104 - protein, 9 aa, Homo Sapiens
LPSAIQAAS

SEQ ID NO: 1339105 - protein, 9 aa, Homo Sapiens
GHPPSFSPQ

SEQ ID NO: 1339106 - protein, 9 aa, Homo Sapiens
HLVHAQHFP

SEQ ID NO: 1339107 - protein, 9 aa, Homo Sapiens
HILCTKSLP

SEQ ID NO: 1339108 - protein, 9 aa, Homo Sapiens
IEKSFLMEG

SEQ ID NO: 1339109 - protein, 9 aa, Homo Sapiens
QFDRQAPGH

SEQ ID NO: 1339110 - protein, 9 aa, Homo Sapiens
VIVIAYIIG

SEQ ID NO: 1339111 - protein, 9 aa, Homo Sapiens
QVARHLRDL

SEQ ID NO: 1339112 - protein, 9 aa, Homo Sapiens
LECLETIFT

SEQ ID NO: 1339113 - protein, 9 aa, Homo Sapiens
TSDSVSLIA

SEQ ID NO: 1339114 - protein, 9 aa, Homo Sapiens
TLWMQSPCW

SEQ ID NO: 1339115 - protein, 9 aa, Homo Sapiens
PSPCLLRFI

SEQ ID NO: 1339116 - protein, 9 aa, Homo Sapiens
DVSTTFLSD

SEQ ID NO: 1339117 - protein, 9 aa, Homo Sapiens
SGCWMLYEC

SEQ ID NO: 1339118 - protein, 9 aa, Homo Sapiens
RAATCSKYI

SEQ ID NO: 1339119 - protein, 9 aa, Homo Sapiens
MQRCCDHMI

SEQ ID NO: 1339120 - protein, 9 aa, Homo Sapiens
VFTTQLGAY

SEQ ID NO: 1339121 - protein, 9 aa, Homo Sapiens
PSASVSRED

SEQ ID NO: 1339122 - protein, 9 aa, Homo Sapiens
SLQNKTKLF

SEQ ID NO: 1339123 - protein, 9 aa, Homo Sapiens
NVLGFALGV

SEQ ID NO: 1339124 - protein, 9 aa, Homo Sapiens
ARVCGRCCA

SEQ ID NO: 1339125 - protein, 9 aa, Homo Sapiens
VLGHSNCCH

SEQ ID NO: 1339126 - protein, 9 aa, Homo Sapiens
SLEYRVSSR

SEQ ID NO: 1339127 - protein, 9 aa, Homo Sapiens
IWLCCITQH

SEQ ID NO: 1339128 - protein, 9 aa, Homo Sapiens
NPKLALKNN

SEQ ID NO: 1339129 - protein, 9 aa, Homo Sapiens
DLKEPTEEQ

SEQ ID NO: 1339130 - protein, 9 aa, Homo Sapiens
EFWALIAEP

SEQ ID NO: 1339131 - protein, 9 aa, Homo Sapiens
LFLSLACTR

SEQ ID NO: 1339132 - protein, 9 aa, Homo Sapiens
NAPGWALTW

SEQ ID NO: 1339133 - protein, 9 aa, Homo Sapiens
TCNFQAIII

SEQ ID NO: 1339134 - protein, 9 aa, Homo Sapiens
LVASMRKFS

SEQ ID NO: 1339135 - protein, 9 aa, Homo Sapiens
YSVPLMSPQ

SEQ ID NO: 1339136 - protein, 9 aa, Homo Sapiens
TFMEVEMAE

SEQ ID NO: 1339137 - protein, 9 aa, Homo Sapiens
VLKYHEDII

SEQ ID NO: 1339138 - protein, 9 aa, Homo Sapiens
ILVIVGLIF

SEQ ID NO: 1339139 - protein, 9 aa, Homo Sapiens
VMYDVVSIM

SEQ ID NO: 1339140 - protein, 9 aa, Homo Sapiens
GAESHRKNH

SEQ ID NO: 1339141 - protein, 9 aa, Homo Sapiens
TVVVDDLHL

SEQ ID NO: 1339142 - protein, 9 aa, Homo Sapiens
NGSSPIYQL

SEQ ID NO: 1339143 - protein, 9 aa, Homo Sapiens
LCKKQGAAR

SEQ ID NO: 1339144 - protein, 9 aa, Homo Sapiens
EPVKDLTLH

SEQ ID NO: 1339145 - protein, 9 aa, Homo Sapiens
AWAKVTMND

SEQ ID NO: 1339146 - protein, 9 aa, Homo Sapiens
TADPTALAA

SEQ ID NO: 1339147 - protein, 9 aa, Homo Sapiens
TARAEEFAV

SEQ ID NO: 1339148 - protein, 9 aa, Homo Sapiens
KDVSHAVGV

SEQ ID NO: 1339149 - protein, 9 aa, Homo Sapiens
SVVSVAERV

SEQ ID NO: 1339150 - protein, 9 aa, Homo Sapiens
KHHPGQSSA

SEQ ID NO: 1339151 - protein, 9 aa, Homo Sapiens
KQKISFKYN

SEQ ID NO: 1339152 - protein, 9 aa, Homo Sapiens
QLLSIPRVG

SEQ ID NO: 1339153 - protein, 9 aa, Homo Sapiens
YSQETRDMF

SEQ ID NO: 1339154 - protein, 9 aa, Homo Sapiens
RPEARRPYL

SEQ ID NO: 1339155 - protein, 9 aa, Homo Sapiens
LNSFQTHEM

SEQ ID NO: 1339156 - protein, 9 aa, Homo Sapiens
LGLVKLSRK

SEQ ID NO: 1339157 - protein, 9 aa, Homo Sapiens
NRPFQSQND

SEQ ID NO: 1339158 - protein, 9 aa, Homo Sapiens
WPEVWKEVR

SEQ ID NO: 1339159 - protein, 9 aa, Homo Sapiens
EKIAYRDVM

SEQ ID NO: 1339160 - protein, 9 aa, Homo Sapiens
LKGWWQKFW

SEQ ID NO: 1339161 - protein, 9 aa, Homo Sapiens
WGPRLGRDT

SEQ ID NO: 1339162 - protein, 9 aa, Homo Sapiens
PTTVAEKPN

SEQ ID NO: 1339163 - protein, 9 aa, Homo Sapiens
VYPGKHFWY

SEQ ID NO: 1339164 - protein, 9 aa, Homo Sapiens
GRGREENLF

SEQ ID NO: 1339165 - protein, 9 aa, Homo Sapiens
HFAYRTGSE

SEQ ID NO: 1339166 - protein, 9 aa, Homo Sapiens
ASAKVLGPR

SEQ ID NO: 1339167 - protein, 9 aa, Homo Sapiens
WEETSQGRT

SEQ ID NO: 1339168 - protein, 9 aa, Homo Sapiens
GIAGPVTMT

SEQ ID NO: 1339169 - protein, 9 aa, Homo Sapiens
FDPKDDTTR

SEQ ID NO: 1339170 - protein, 9 aa, Homo Sapiens
WDFTGVVAV

SEQ ID NO: 1339171 - protein, 9 aa, Homo Sapiens
PAISTLAHS

SEQ ID NO: 1339172 - protein, 9 aa, Homo Sapiens
VCWQAGATP

SEQ ID NO: 1339173 - protein, 9 aa, Homo Sapiens
ALVTTARNF

SEQ ID NO: 1339174 - protein, 9 aa, Homo Sapiens
PPVFIDTAS

SEQ ID NO: 1339175 - protein, 9 aa, Homo Sapiens
EDYHSQNSY

SEQ ID NO: 1339176 - protein, 9 aa, Homo Sapiens
QVQGRGIGP

SEQ ID NO: 1339177 - protein, 9 aa, Homo Sapiens
SFLTPLHNF

SEQ ID NO: 1339178 - protein, 9 aa, Homo Sapiens
TVPLPGSQV

SEQ ID NO: 1339179 - protein, 9 aa, Homo Sapiens
ANRLQRCLS

SEQ ID NO: 1339180 - protein, 9 aa, Homo Sapiens
LGSGEGIAV

SEQ ID NO: 1339181 - protein, 9 aa, Homo Sapiens
PHHSAGCDS

SEQ ID NO: 1339182 - protein, 9 aa, Homo Sapiens
RDCEGRDTH

SEQ ID NO: 1339183 - protein, 9 aa, Homo Sapiens
VQEAKKGLL

SEQ ID NO: 1339184 - protein, 9 aa, Homo Sapiens
NSLVEVHRL

SEQ ID NO: 1339185 - protein, 9 aa, Homo Sapiens
RVSSNSIFD

SEQ ID NO: 1339186 - protein, 9 aa, Homo Sapiens
DFTLWRQFI

SEQ ID NO: 1339187 - protein, 9 aa, Homo Sapiens
PGSREVYTW

SEQ ID NO: 1339188 - protein, 9 aa, Homo Sapiens
GGTCIDDGD

SEQ ID NO: 1339189 - protein, 9 aa, Homo Sapiens
PGFPKCGQK

SEQ ID NO: 1339190 - protein, 9 aa, Homo Sapiens
TEPRNHQGA

SEQ ID NO: 1339191 - protein, 9 aa, Homo Sapiens
RPSMDFNAL

SEQ ID NO: 1339192 - protein, 9 aa, Homo Sapiens
QHFYSCDRF

SEQ ID NO: 1339193 - protein, 9 aa, Homo Sapiens
RAQRMSLWP

SEQ ID NO: 1339194 - protein, 9 aa, Homo Sapiens
LLTQCNRTI

SEQ ID NO: 1339195 - protein, 9 aa, Homo Sapiens
HMQTVRGVA

SEQ ID NO: 1339196 - protein, 9 aa, Homo Sapiens
VKQGSKGSD

SEQ ID NO: 1339197 - protein, 9 aa, Homo Sapiens
QPDKNGQNN

SEQ ID NO: 1339198 - protein, 9 aa, Homo Sapiens
VEGGELVIV

SEQ ID NO: 1339199 - protein, 9 aa, Homo Sapiens
VSQLGIVNT

SEQ ID NO: 1339200 - protein, 9 aa, Homo Sapiens
RHSSSVRNE

SEQ ID NO: 1339201 - protein, 9 aa, Homo Sapiens
APDVHFTVD

SEQ ID NO: 1339202 - protein, 9 aa, Homo Sapiens
CHMTQEEHD

SEQ ID NO: 1339203 - protein, 9 aa, Homo Sapiens
AIRNYSGTP

SEQ ID NO: 1339204 - protein, 9 aa, Homo Sapiens
VCYMLINVP

SEQ ID NO: 1339205 - protein, 9 aa, Homo Sapiens
YNYYVTLLT

SEQ ID NO: 1339206 - protein, 9 aa, Homo Sapiens
GKTQEEIED

SEQ ID NO: 1339207 - protein, 9 aa, Homo Sapiens
TAISPKDVF

SEQ ID NO: 1339208 - protein, 9 aa, Homo Sapiens
IDSKTEQSA

SEQ ID NO: 1339209 - protein, 9 aa, Homo Sapiens
CSHIDVMST

SEQ ID NO: 1339210 - protein, 9 aa, Homo Sapiens
NDGHWHQVD

SEQ ID NO: 1339211 - protein, 9 aa, Homo Sapiens
INSAKGWRK

SEQ ID NO: 1339212 - protein, 9 aa, Homo Sapiens
EIMSRLMLK

SEQ ID NO: 1339213 - protein, 9 aa, Homo Sapiens
KKCSILGLG

SEQ ID NO: 1339214 - protein, 9 aa, Homo Sapiens
RMVDNFHPL

SEQ ID NO: 1339215 - protein, 9 aa, Homo Sapiens
CVKLAGQED

SEQ ID NO: 1339216 - protein, 9 aa, Homo Sapiens
AVRSAVCVG

SEQ ID NO: 1339217 - protein, 9 aa, Homo Sapiens
EMDSSLILD

SEQ ID NO: 1339218 - protein, 9 aa, Homo Sapiens
NVCYMLINV

SEQ ID NO: 1339219 - protein, 9 aa, Homo Sapiens
IGDDIGLTS

SEQ ID NO: 1339220 - protein, 9 aa, Homo Sapiens
DAELLGEAT

SEQ ID NO: 1339221 - protein, 9 aa, Homo Sapiens
VFVEELDKV

SEQ ID NO: 1339222 - protein, 9 aa, Homo Sapiens
SPPLQGTRV

SEQ ID NO: 1339223 - protein, 9 aa, Homo Sapiens
QHYLRMWAK

SEQ ID NO: 1339224 - protein, 9 aa, Homo Sapiens
IDYSENCLL

SEQ ID NO: 1339225 - protein, 9 aa, Homo Sapiens
PEKTHHLHG

SEQ ID NO: 1339226 - protein, 9 aa, Homo Sapiens
LQTTHSTFF

SEQ ID NO: 1339227 - protein, 9 aa, Homo Sapiens
GSNDSCKGD

SEQ ID NO: 1339228 - protein, 9 aa, Homo Sapiens
PEGYATYYC

SEQ ID NO: 1339229 - protein, 9 aa, Homo Sapiens
MTMMGLRYS

SEQ ID NO: 1339230 - protein, 9 aa, Homo Sapiens
LAGDQILQA

SEQ ID NO: 1339231 - protein, 9 aa, Homo Sapiens
IPICLASRA

SEQ ID NO: 1339232 - protein, 9 aa, Homo Sapiens
EHTRTEHSV

SEQ ID NO: 1339233 - protein, 9 aa, Homo Sapiens
LALTLGPSV

SEQ ID NO: 1339234 - protein, 9 aa, Homo Sapiens
TQETAQLLS

SEQ ID NO: 1339235 - protein, 9 aa, Homo Sapiens
SMSAYLQEQ

SEQ ID NO: 1339236 - protein, 9 aa, Homo Sapiens
EHHSSKIRM

SEQ ID NO: 1339237 - protein, 9 aa, Homo Sapiens
YLDLCCIPN

SEQ ID NO: 1339238 - protein, 9 aa, Homo Sapiens
VQPNEMSEN

SEQ ID NO: 1339239 - protein, 9 aa, Homo Sapiens
KKGESGALG

SEQ ID NO: 1339240 - protein, 9 aa, Homo Sapiens
HMLLNLSHG

SEQ ID NO: 1339241 - protein, 9 aa, Homo Sapiens
PYLEQYHID

SEQ ID NO: 1339242 - protein, 9 aa, Homo Sapiens
TARGSPWPS

SEQ ID NO: 1339243 - protein, 9 aa, Homo Sapiens
GRHKSESQR

SEQ ID NO: 1339244 - protein, 9 aa, Homo Sapiens
SSVPSPGIA

SEQ ID NO: 1339245 - protein, 9 aa, Homo Sapiens
TLGTMPEVE

SEQ ID NO: 1339246 - protein, 9 aa, Homo Sapiens
YKTDAQGTH

SEQ ID NO: 1339247 - protein, 9 aa, Homo Sapiens
AAAHFPSVA

SEQ ID NO: 1339248 - protein, 9 aa, Homo Sapiens
VFTFHHPLL

SEQ ID NO: 1339249 - protein, 9 aa, Homo Sapiens
GCDNFGELR

SEQ ID NO: 1339250 - protein, 9 aa, Homo Sapiens
KPDTQQVQV

SEQ ID NO: 1339251 - protein, 9 aa, Homo Sapiens
TVGDTSLHI

SEQ ID NO: 1339252 - protein, 9 aa, Homo Sapiens
RSITRSYYH

SEQ ID NO: 1339253 - protein, 9 aa, Homo Sapiens
VHLGERAQD

SEQ ID NO: 1339254 - protein, 9 aa, Homo Sapiens
GWDHTASGH

SEQ ID NO: 1339255 - protein, 9 aa, Homo Sapiens
MAHRFTQEY

SEQ ID NO: 1339256 - protein, 9 aa, Homo Sapiens
LLGISGLES

SEQ ID NO: 1339257 - protein, 9 aa, Homo Sapiens
QALQDASVA

SEQ ID NO: 1339258 - protein, 9 aa, Homo Sapiens
MAVVIPDAV

SEQ ID NO: 1339259 - protein, 9 aa, Homo Sapiens
DHLSDTSTM

SEQ ID NO: 1339260 - protein, 9 aa, Homo Sapiens
PTPCPLPCS

SEQ ID NO: 1339261 - protein, 9 aa, Homo Sapiens
PSQERKPMG

SEQ ID NO: 1339262 - protein, 9 aa, Homo Sapiens
FLFIGSDTF

SEQ ID NO: 1339263 - protein, 9 aa, Homo Sapiens
HITVELYQG

SEQ ID NO: 1339264 - protein, 9 aa, Homo Sapiens
QTPVAAASG

SEQ ID NO: 1339265 - protein, 9 aa, Homo Sapiens
EKSWVSKLE

SEQ ID NO: 1339266 - protein, 9 aa, Homo Sapiens
EVCDTETVI

SEQ ID NO: 1339267 - protein, 9 aa, Homo Sapiens
LVMTWSMVG

SEQ ID NO: 1339268 - protein, 9 aa, Homo Sapiens
ELKKNKKQC

SEQ ID NO: 1339269 - protein, 9 aa, Homo Sapiens
VSTSWGPTA

SEQ ID NO: 1339270 - protein, 9 aa, Homo Sapiens
ESHAGKAVL

SEQ ID NO: 1339271 - protein, 9 aa, Homo Sapiens
LMSHVIELK

SEQ ID NO: 1339272 - protein, 9 aa, Homo Sapiens
LEVGRIIKC

SEQ ID NO: 1339273 - protein, 9 aa, Homo Sapiens
LWCHYFQNT

SEQ ID NO: 1339274 - protein, 9 aa, Homo Sapiens
PRDEVLPEK

SEQ ID NO: 1339275 - protein, 9 aa, Homo Sapiens
YDNVREYLC

SEQ ID NO: 1339276 - protein, 9 aa, Homo Sapiens
VGALTMGMI

SEQ ID NO: 1339277 - protein, 9 aa, Homo Sapiens
INNKLRWGD

SEQ ID NO: 1339278 - protein, 9 aa, Homo Sapiens
SPGVMVTQA

SEQ ID NO: 1339279 - protein, 9 aa, Homo Sapiens
DPDKDKKCH

SEQ ID NO: 1339280 - protein, 9 aa, Homo Sapiens
YMPSGDVSP

SEQ ID NO: 1339281 - protein, 9 aa, Homo Sapiens
AAFENWEVD

SEQ ID NO: 1339282 - protein, 9 aa, Homo Sapiens
IVAPGHALS

SEQ ID NO: 1339283 - protein, 9 aa, Homo Sapiens
SGQPPPSSG

SEQ ID NO: 1339284 - protein, 9 aa, Homo Sapiens
IEWLCLENT

SEQ ID NO: 1339285 - protein, 9 aa, Homo Sapiens
RVEAGTPSP

SEQ ID NO: 1339286 - protein, 9 aa, Homo Sapiens
GNQLIYYKI

SEQ ID NO: 1339287 - protein, 9 aa, Homo Sapiens
ERVTVSHLD

SEQ ID NO: 1339288 - protein, 9 aa, Homo Sapiens
TGCYSCFAS

SEQ ID NO: 1339289 - protein, 9 aa, Homo Sapiens
CSPPVRLGS

SEQ ID NO: 1339290 - protein, 9 aa, Homo Sapiens
EKIIGRAIT

SEQ ID NO: 1339291 - protein, 9 aa, Homo Sapiens
QMGPWDVIL

SEQ ID NO: 1339292 - protein, 9 aa, Homo Sapiens
TEQSAALAL

SEQ ID NO: 1339293 - protein, 9 aa, Homo Sapiens
AAVMLFCGF

SEQ ID NO: 1339294 - protein, 9 aa, Homo Sapiens
GSIVTRGAL

SEQ ID NO: 1339295 - protein, 9 aa, Homo Sapiens
DNTCILWDI

SEQ ID NO: 1339296 - protein, 9 aa, Homo Sapiens
WKANPHPFT

SEQ ID NO: 1339297 - protein, 9 aa, Homo Sapiens
EDTTAIQGY

SEQ ID NO: 1339298 - protein, 9 aa, Homo Sapiens
VKEEMDVSI

SEQ ID NO: 1339299 - protein, 9 aa, Homo Sapiens
VTIKKIMKR

SEQ ID NO: 1339300 - protein, 9 aa, Homo Sapiens
AHDNSCPQF

SEQ ID NO: 1339301 - protein, 9 aa, Homo Sapiens
MWPHSDPYW

SEQ ID NO: 1339302 - protein, 9 aa, Homo Sapiens
YIFRVKVVN

SEQ ID NO: 1339303 - protein, 9 aa, Homo Sapiens
DKVFWNTRI

SEQ ID NO: 1339304 - protein, 9 aa, Homo Sapiens
WLHTSPEDI

SEQ ID NO: 1339305 - protein, 9 aa, Homo Sapiens
LKFSPHPLK

SEQ ID NO: 1339306 - protein, 9 aa, Homo Sapiens
INMLYQSWE

SEQ ID NO: 1339307 - protein, 9 aa, Homo Sapiens
NSGPLHRLI

SEQ ID NO: 1339308 - protein, 9 aa, Homo Sapiens
YLNEDANGF

SEQ ID NO: 1339309 - protein, 9 aa, Homo Sapiens
EEADAFITF

SEQ ID NO: 1339310 - protein, 9 aa, Homo Sapiens
RGASSSTSR

SEQ ID NO: 1339311 - protein, 9 aa, Homo Sapiens
KDPTDHYHV

SEQ ID NO: 1339312 - protein, 9 aa, Homo Sapiens
LKDKMCKAV

SEQ ID NO: 1339313 - protein, 9 aa, Homo Sapiens
HTELVFGLA

SEQ ID NO: 1339314 - protein, 9 aa, Homo Sapiens
CLDHFFITP

SEQ ID NO: 1339315 - protein, 9 aa, Homo Sapiens
PQGQHWIWF

SEQ ID NO: 1339316 - protein, 9 aa, Homo Sapiens
LCHTLAALT

SEQ ID NO: 1339317 - protein, 9 aa, Homo Sapiens
APHRKRKRK

SEQ ID NO: 1339318 - protein, 9 aa, Homo Sapiens
GILSGEKQH

SEQ ID NO: 1339319 - protein, 9 aa, Homo Sapiens
LPRSPEVQF

SEQ ID NO: 1339320 - protein, 9 aa, Homo Sapiens
FVTEVSHLR

SEQ ID NO: 1339321 - protein, 9 aa, Homo Sapiens
EVQQIHQDI

SEQ ID NO: 1339322 - protein, 9 aa, Homo Sapiens
MSPTLDLSN

SEQ ID NO: 1339323 - protein, 9 aa, Homo Sapiens
FAKKQICLI

SEQ ID NO: 1339324 - protein, 9 aa, Homo Sapiens
FFCFGISQS

SEQ ID NO: 1339325 - protein, 9 aa, Homo Sapiens
AVEPTVDLL

SEQ ID NO: 1339326 - protein, 9 aa, Homo Sapiens
EKLCLRNDW

SEQ ID NO: 1339327 - protein, 9 aa, Homo Sapiens
MQARIQHLS

SEQ ID NO: 1339328 - protein, 9 aa, Homo Sapiens
IMFPSGGGK

SEQ ID NO: 1339329 - protein, 9 aa, Homo Sapiens
KSMLQATTE

SEQ ID NO: 1339330 - protein, 9 aa, Homo Sapiens
GTSTSSLEM

SEQ ID NO: 1339331 - protein, 9 aa, Homo Sapiens
GDDNHWWQV

SEQ ID NO: 1339332 - protein, 9 aa, Homo Sapiens
NVGLCHEHG

SEQ ID NO: 1339333 - protein, 9 aa, Homo Sapiens
ALPRPSLVI

SEQ ID NO: 1339334 - protein, 9 aa, Homo Sapiens
LKTGSSGAM

SEQ ID NO: 1339335 - protein, 9 aa, Homo Sapiens
CKMDGEVMS

SEQ ID NO: 1339336 - protein, 9 aa, Homo Sapiens
QTALYTANT

SEQ ID NO: 1339337 - protein, 9 aa, Homo Sapiens
FEQFKVTMN

SEQ ID NO: 1339338 - protein, 9 aa, Homo Sapiens
TLVPARQQG

SEQ ID NO: 1339339 - protein, 9 aa, Homo Sapiens
GPTSLVLND

SEQ ID NO: 1339340 - protein, 9 aa, Homo Sapiens
QLTSVLTLL

SEQ ID NO: 1339341 - protein, 9 aa, Homo Sapiens
LHHPYGCDV

SEQ ID NO: 1339342 - protein, 9 aa, Homo Sapiens
RVSALLNLY

SEQ ID NO: 1339343 - protein, 9 aa, Homo Sapiens
KMMTTCLIM

SEQ ID NO: 1339344 - protein, 9 aa, Homo Sapiens
QDGPFYVIV

SEQ ID NO: 1339345 - protein, 9 aa, Homo Sapiens
KNPVNSKKS

SEQ ID NO: 1339346 - protein, 9 aa, Homo Sapiens
SVAWNLLKP

SEQ ID NO: 1339347 - protein, 9 aa, Homo Sapiens
TIMVTWYWC

SEQ ID NO: 1339348 - protein, 9 aa, Homo Sapiens
LDGTHWRIY

SEQ ID NO: 1339349 - protein, 9 aa, Homo Sapiens
YDNRIHMYS

SEQ ID NO: 1339350 - protein, 9 aa, Homo Sapiens
VYTPTMESV

SEQ ID NO: 1339351 - protein, 9 aa, Homo Sapiens
NLQGKKKAL

SEQ ID NO: 1339352 - protein, 9 aa, Homo Sapiens
KKRGASSST

SEQ ID NO: 1339353 - protein, 9 aa, Homo Sapiens
IAVIAEKLD

SEQ ID NO: 1339354 - protein, 9 aa, Homo Sapiens
AAVKGDTAE

SEQ ID NO: 1339355 - protein, 9 aa, Homo Sapiens
KLFTVVTWD

SEQ ID NO: 1339356 - protein, 9 aa, Homo Sapiens
FVFNAEFKD

SEQ ID NO: 1339357 - protein, 9 aa, Homo Sapiens
KRGKDGLLD

SEQ ID NO: 1339358 - protein, 9 aa, Homo Sapiens
LIDLNHIST

SEQ ID NO: 1339359 - protein, 9 aa, Homo Sapiens
CVDQWLKIP

SEQ ID NO: 1339360 - protein, 9 aa, Homo Sapiens
QHTCQALAA

SEQ ID NO: 1339361 - protein, 9 aa, Homo Sapiens
DPHFSKILE

SEQ ID NO: 1339362 - protein, 9 aa, Homo Sapiens
PCDKSRRSR

SEQ ID NO: 1339363 - protein, 9 aa, Homo Sapiens
NLIIIIITL

SEQ ID NO: 1339364 - protein, 9 aa, Homo Sapiens
EILQSTSFL

SEQ ID NO: 1339365 - protein, 9 aa, Homo Sapiens
GLTDRLGRR

SEQ ID NO: 1339366 - protein, 9 aa, Homo Sapiens
KMGSAIFVK

SEQ ID NO: 1339367 - protein, 9 aa, Homo Sapiens
RLEAKEGED

SEQ ID NO: 1339368 - protein, 9 aa, Homo Sapiens
ALEVESDNP

SEQ ID NO: 1339369 - protein, 9 aa, Homo Sapiens
YDITLMRLS

SEQ ID NO: 1339370 - protein, 9 aa, Homo Sapiens
HIPKALEVT

SEQ ID NO: 1339371 - protein, 9 aa, Homo Sapiens
NSSHIPQSN

SEQ ID NO: 1339372 - protein, 9 aa, Homo Sapiens
PSAATRPST

SEQ ID NO: 1339373 - protein, 9 aa, Homo Sapiens
PSAATRPSS

SEQ ID NO: 1339374 - protein, 9 aa, Homo Sapiens
EVVKASYPK

SEQ ID NO: 1339375 - protein, 8 aa, Homo Sapiens
TRTAGRAE

SEQ ID NO: 1339376 - protein, 9 aa, Homo Sapiens
FQIGSFVSP

SEQ ID NO: 1339377 - protein, 9 aa, Homo Sapiens
EDGATEIDM

SEQ ID NO: 1339378 - protein, 9 aa, Homo Sapiens
LICGLIIVV

SEQ ID NO: 1339379 - protein, 9 aa, Homo Sapiens
VEVGRYKGH

SEQ ID NO: 1339380 - protein, 9 aa, Homo Sapiens
KEVVQYVLP

SEQ ID NO: 1339381 - protein, 9 aa, Homo Sapiens
RIHTPRASN

SEQ ID NO: 1339382 - protein, 9 aa, Homo Sapiens
IADNTFSRL

SEQ ID NO: 1339383 - protein, 9 aa, Homo Sapiens
DEEDIASHY

SEQ ID NO: 1339384 - protein, 9 aa, Homo Sapiens
CELNINECF

SEQ ID NO: 1339385 - protein, 9 aa, Homo Sapiens
PHVSESPVL

SEQ ID NO: 1339386 - protein, 9 aa, Homo Sapiens
SAEVGSAAG

SEQ ID NO: 1339387 - protein, 9 aa, Homo Sapiens
ETSELWNLP

SEQ ID NO: 1339388 - protein, 9 aa, Homo Sapiens
WHRGSKVLA

SEQ ID NO: 1339389 - protein, 9 aa, Homo Sapiens
PFREHFEEL

SEQ ID NO: 1339390 - protein, 9 aa, Homo Sapiens
KGISVMPKR

SEQ ID NO: 1339391 - protein, 9 aa, Homo Sapiens
AELESDDIL

SEQ ID NO: 1339392 - protein, 9 aa, Homo Sapiens
RNVMILMNP

SEQ ID NO: 1339393 - protein, 9 aa, Homo Sapiens
RSNAQWQLI

SEQ ID NO: 1339394 - protein, 9 aa, Homo Sapiens
QCKAWASFD

SEQ ID NO: 1339395 - protein, 9 aa, Homo Sapiens
SKITPRTVY

SEQ ID NO: 1339396 - protein, 9 aa, Homo Sapiens
CLLQGPCDT

SEQ ID NO: 1339397 - protein, 9 aa, Homo Sapiens
TDTYSSLAV

SEQ ID NO: 1339398 - protein, 9 aa, Homo Sapiens
ILTKCKGTI

SEQ ID NO: 1339399 - protein, 9 aa, Homo Sapiens
LQGPIHIGT

SEQ ID NO: 1339400 - protein, 9 aa, Homo Sapiens
KFRFPRVFL

SEQ ID NO: 1339401 - protein, 9 aa, Homo Sapiens
PPKKCSILG

SEQ ID NO: 1339402 - protein, 9 aa, Homo Sapiens
ERFRSITRT

SEQ ID NO: 1339403 - protein, 9 aa, Homo Sapiens
HDSVRYWVK

SEQ ID NO: 1339404 - protein, 9 aa, Homo Sapiens
EPKDRTVAA

SEQ ID NO: 1339405 - protein, 9 aa, Homo Sapiens
CKAGKGQTG

SEQ ID NO: 1339406 - protein, 9 aa, Homo Sapiens
DMPADEYDQ

SEQ ID NO: 1339407 - protein, 9 aa, Homo Sapiens
DLTTENPER

SEQ ID NO: 1339408 - protein, 9 aa, Homo Sapiens
EKQTITRWP

SEQ ID NO: 1339409 - protein, 9 aa, Homo Sapiens
LVSKDTLVQ

SEQ ID NO: 1339410 - protein, 9 aa, Homo Sapiens
QINDGVSKA

SEQ ID NO: 1339411 - protein, 9 aa, Homo Sapiens
MMSKLRFEV

SEQ ID NO: 1339412 - protein, 9 aa, Homo Sapiens
NDFLSAPQS

SEQ ID NO: 1339413 - protein, 9 aa, Homo Sapiens
YHYNAGVKQ

SEQ ID NO: 1339414 - protein, 9 aa, Homo Sapiens
DREPLHTIF

SEQ ID NO: 1339415 - protein, 9 aa, Homo Sapiens
HTHVKRKNV

SEQ ID NO: 1339416 - protein, 9 aa, Homo Sapiens
DPGSLAPGG

SEQ ID NO: 1339417 - protein, 9 aa, Homo Sapiens
HTSVWILYL

SEQ ID NO: 1339418 - protein, 9 aa, Homo Sapiens
APPKKPEAL

SEQ ID NO: 1339419 - protein, 9 aa, Homo Sapiens
QRRAGTKWS

SEQ ID NO: 1339420 - protein, 9 aa, Homo Sapiens
LTGHLHTHS

SEQ ID NO: 1339421 - protein, 9 aa, Homo Sapiens
GTFPINPGL

SEQ ID NO: 1339422 - protein, 9 aa, Homo Sapiens
RLKYVHLHE

SEQ ID NO: 1339423 - protein, 9 aa, Homo Sapiens
LQDGEKIIS

SEQ ID NO: 1339424 - protein, 9 aa, Homo Sapiens
PSTAARASP

SEQ ID NO: 1339425 - protein, 9 aa, Homo Sapiens
FQHGMRQRG

SEQ ID NO: 1339426 - protein, 9 aa, Homo Sapiens
GSTVVWAFR

SEQ ID NO: 1339427 - protein, 9 aa, Homo Sapiens
EGDSHRNII

SEQ ID NO: 1339428 - protein, 9 aa, Homo Sapiens
RFMVQIPPS

SEQ ID NO: 1339429 - protein, 9 aa, Homo Sapiens
PKRSLLGAV

SEQ ID NO: 1339430 - protein, 9 aa, Homo Sapiens
SPSVPKTST

SEQ ID NO: 1339431 - protein, 9 aa, Homo Sapiens
TLKNRKKSD

SEQ ID NO: 1339432 - protein, 9 aa, Homo Sapiens
CNQEAHQEK

SEQ ID NO: 1339433 - protein, 9 aa, Homo Sapiens
NLNVAQEEY

SEQ ID NO: 1339434 - protein, 9 aa, Homo Sapiens
TSSGGSVTY

SEQ ID NO: 1339435 - protein, 9 aa, Homo Sapiens
KEAKQTLHH

SEQ ID NO: 1339436 - protein, 9 aa, Homo Sapiens
RHDSVRYWV

SEQ ID NO: 1339437 - protein, 9 aa, Homo Sapiens
YQYLLHLNS

SEQ ID NO: 1339438 - protein, 9 aa, Homo Sapiens
CLIKSDQLK

SEQ ID NO: 1339439 - protein, 9 aa, Homo Sapiens
LINTLGIGL

SEQ ID NO: 1339440 - protein, 9 aa, Homo Sapiens
LKIPGLKTG

SEQ ID NO: 1339441 - protein, 9 aa, Homo Sapiens
GTCIDDGDK

SEQ ID NO: 1339442 - protein, 9 aa, Homo Sapiens
DAIIYCNFN

SEQ ID NO: 1339443 - protein, 9 aa, Homo Sapiens
RKNDMIGLS

SEQ ID NO: 1339444 - protein, 9 aa, Homo Sapiens
RKMHAAEEL

SEQ ID NO: 1339445 - protein, 9 aa, Homo Sapiens
RESTLMDIS

SEQ ID NO: 1339446 - protein, 9 aa, Homo Sapiens
FLWMVDACA

SEQ ID NO: 1339447 - protein, 9 aa, Homo Sapiens
TRASGPTSA

SEQ ID NO: 1339448 - protein, 9 aa, Homo Sapiens
KVTHLTEEL

SEQ ID NO: 1339449 - protein, 9 aa, Homo Sapiens
SVPISSSAC

SEQ ID NO: 1339450 - protein, 9 aa, Homo Sapiens
YLMSLPCEN

SEQ ID NO: 1339451 - protein, 9 aa, Homo Sapiens
VQVVLLPQP

SEQ ID NO: 1339452 - protein, 9 aa, Homo Sapiens
SCTYILHSS

SEQ ID NO: 1339453 - protein, 9 aa, Homo Sapiens
VHIHCWLSP

SEQ ID NO: 1339454 - protein, 9 aa, Homo Sapiens
REDDCWPVE

SEQ ID NO: 1339455 - protein, 9 aa, Homo Sapiens
VSRHQTTIW

SEQ ID NO: 1339456 - protein, 9 aa, Homo Sapiens
VTSNIVISV

SEQ ID NO: 1339457 - protein, 9 aa, Homo Sapiens
LPSASVSRE

SEQ ID NO: 1339458 - protein, 9 aa, Homo Sapiens
DTNQYVVGE

SEQ ID NO: 1339459 - protein, 9 aa, Homo Sapiens
MAICNPLNY

SEQ ID NO: 1339460 - protein, 9 aa, Homo Sapiens
CVVYFLSIM

SEQ ID NO: 1339461 - protein, 9 aa, Homo Sapiens
SVTGLTETI

SEQ ID NO: 1339462 - protein, 9 aa, Homo Sapiens
GTKCPVEWA

SEQ ID NO: 1339463 - protein, 9 aa, Homo Sapiens
LILLGVSKG

SEQ ID NO: 1339464 - protein, 9 aa, Homo Sapiens
SKVYDPEDW

SEQ ID NO: 1339465 - protein, 9 aa, Homo Sapiens
KGAKGICTL

SEQ ID NO: 1339466 - protein, 9 aa, Homo Sapiens
RVVRRLQKP

SEQ ID NO: 1339467 - protein, 9 aa, Homo Sapiens
LRSAVDSWG

SEQ ID NO: 1339468 - protein, 9 aa, Homo Sapiens
EVVRSAEEV

SEQ ID NO: 1339469 - protein, 9 aa, Homo Sapiens
MEPPSTVGI

SEQ ID NO: 1339470 - protein, 9 aa, Homo Sapiens
TYTQVGLRG

SEQ ID NO: 1339471 - protein, 9 aa, Homo Sapiens
VLDVRCASA

SEQ ID NO: 1339472 - protein, 9 aa, Homo Sapiens
VVLMCRGKE

SEQ ID NO: 1339473 - protein, 9 aa, Homo Sapiens
SMLDPAQKS

SEQ ID NO: 1339474 - protein, 9 aa, Homo Sapiens
GVEKSPHLA

SEQ ID NO: 1339475 - protein, 9 aa, Homo Sapiens
LLLKMEIGP

SEQ ID NO: 1339476 - protein, 9 aa, Homo Sapiens
KISLRNLVG

SEQ ID NO: 1339477 - protein, 9 aa, Homo Sapiens
VRYALMDGA

SEQ ID NO: 1339478 - protein, 9 aa, Homo Sapiens
GALPYKTSV

SEQ ID NO: 1339479 - protein, 9 aa, Homo Sapiens
NSVSKTRLC

SEQ ID NO: 1339480 - protein, 9 aa, Homo Sapiens
KAFKAIEKP

SEQ ID NO: 1339481 - protein, 9 aa, Homo Sapiens
HNNSPKWSE

SEQ ID NO: 1339482 - protein, 9 aa, Homo Sapiens
CVFKTVNRW

SEQ ID NO: 1339483 - protein, 9 aa, Homo Sapiens
RTWAEWRQF

SEQ ID NO: 1339484 - protein, 9 aa, Homo Sapiens
RCWGQTIFK

SEQ ID NO: 1339485 - protein, 9 aa, Homo Sapiens
AYIAMGQHM

SEQ ID NO: 1339486 - protein, 9 aa, Homo Sapiens
EPHIKAVTQ

SEQ ID NO: 1339487 - protein, 9 aa, Homo Sapiens
NKITTESFD

SEQ ID NO: 1339488 - protein, 9 aa, Homo Sapiens
LEDRLTKFM

SEQ ID NO: 1339489 - protein, 9 aa, Homo Sapiens
RQGHDPEAD

SEQ ID NO: 1339490 - protein, 9 aa, Homo Sapiens
FRSVRAIWI

SEQ ID NO: 1339491 - protein, 9 aa, Homo Sapiens
GDSANCSEF

SEQ ID NO: 1339492 - protein, 9 aa, Homo Sapiens
CEEYAQNVL

SEQ ID NO: 1339493 - protein, 9 aa, Homo Sapiens
PFFPNMYPG

SEQ ID NO: 1339494 - protein, 9 aa, Homo Sapiens
FPSENSFEY

SEQ ID NO: 1339495 - protein, 9 aa, Homo Sapiens
QSKGFTFIS

SEQ ID NO: 1339496 - protein, 9 aa, Homo Sapiens
MDNFNWGVH

SEQ ID NO: 1339497 - protein, 9 aa, Homo Sapiens
LISLDDGLP

SEQ ID NO: 1339498 - protein, 9 aa, Homo Sapiens
DPKNIDTTP

SEQ ID NO: 1339499 - protein, 9 aa, Homo Sapiens
GTWMCYNLQ

SEQ ID NO: 1339500 - protein, 9 aa, Homo Sapiens
PDDVETEDT

SEQ ID NO: 1339501 - protein, 9 aa, Homo Sapiens
RHEVTLKAC

SEQ ID NO: 1339502 - protein, 9 aa, Homo Sapiens
HPRGERRAL

SEQ ID NO: 1339503 - protein, 9 aa, Homo Sapiens
KGSNDYGFY

SEQ ID NO: 1339504 - protein, 9 aa, Homo Sapiens
TQDLTPAMS

SEQ ID NO: 1339505 - protein, 9 aa, Homo Sapiens
EAMLQKCIR

SEQ ID NO: 1339506 - protein, 9 aa, Homo Sapiens
NLRVAKKGI

SEQ ID NO: 1339507 - protein, 9 aa, Homo Sapiens
IERVAFFVA

SEQ ID NO: 1339508 - protein, 9 aa, Homo Sapiens
LDPAQKYLY

SEQ ID NO: 1339509 - protein, 9 aa, Homo Sapiens
LRRDMFNMF

SEQ ID NO: 1339510 - protein, 9 aa, Homo Sapiens
HGDSANCSE

SEQ ID NO: 1339511 - protein, 9 aa, Homo Sapiens
LERVNMCHI

SEQ ID NO: 1339512 - protein, 9 aa, Homo Sapiens
FHRISAMDE

SEQ ID NO: 1339513 - protein, 9 aa, Homo Sapiens
PAVRSPALA

SEQ ID NO: 1339514 - protein, 9 aa, Homo Sapiens
PTVLKHMDK

SEQ ID NO: 1339515 - protein, 9 aa, Homo Sapiens
IFRGVEHAV

SEQ ID NO: 1339516 - protein, 9 aa, Homo Sapiens
IIVSKRKFQ

SEQ ID NO: 1339517 - protein, 9 aa, Homo Sapiens
TSSWAVLSS

SEQ ID NO: 1339518 - protein, 9 aa, Homo Sapiens
FTRELDPVW

SEQ ID NO: 1339519 - protein, 9 aa, Homo Sapiens
KKIQIPVSF

SEQ ID NO: 1339520 - protein, 9 aa, Homo Sapiens
VNIHTRDNK

SEQ ID NO: 1339521 - protein, 9 aa, Homo Sapiens
PSEVDFQLK

SEQ ID NO: 1339522 - protein, 9 aa, Homo Sapiens
KVWPEGTCE

SEQ ID NO: 1339523 - protein, 9 aa, Homo Sapiens
LPALHSKLQ

SEQ ID NO: 1339524 - protein, 9 aa, Homo Sapiens
DLLLPGSQE

SEQ ID NO: 1339525 - protein, 9 aa, Homo Sapiens
EVRMREVDE

SEQ ID NO: 1339526 - protein, 9 aa, Homo Sapiens
RHSFIDGSG

SEQ ID NO: 1339527 - protein, 9 aa, Homo Sapiens
AGKGQTGVM

SEQ ID NO: 1339528 - protein, 9 aa, Homo Sapiens
HIVAPPGGR

SEQ ID NO: 1339529 - protein, 9 aa, Homo Sapiens
IRPKVQVLF

SEQ ID NO: 1339530 - protein, 9 aa, Homo Sapiens
SPSSAASAG

SEQ ID NO: 1339531 - protein, 9 aa, Homo Sapiens
KHLQEEKEK

SEQ ID NO: 1339532 - protein, 9 aa, Homo Sapiens
TLKELNTRP

SEQ ID NO: 1339533 - protein, 9 aa, Homo Sapiens
GSAGRAPGR

SEQ ID NO: 1339534 - protein, 9 aa, Homo Sapiens
RVLRYLETR

SEQ ID NO: 1339535 - protein, 9 aa, Homo Sapiens
EVRVPYVEN

SEQ ID NO: 1339536 - protein, 9 aa, Homo Sapiens
VTGLTETIN

SEQ ID NO: 1339537 - protein, 9 aa, Homo Sapiens
CITQHTLGR

SEQ ID NO: 1339538 - protein, 9 aa, Homo Sapiens
NQKLMAEVL

SEQ ID NO: 1339539 - protein, 9 aa, Homo Sapiens
RLWRPTAIR

SEQ ID NO: 1339540 - protein, 9 aa, Homo Sapiens
MIDYDSAEV

SEQ ID NO: 1339541 - protein, 9 aa, Homo Sapiens
ARVRQGQET

SEQ ID NO: 1339542 - protein, 9 aa, Homo Sapiens
QCCMMAQYN

SEQ ID NO: 1339543 - protein, 9 aa, Homo Sapiens
ELREVTGID

SEQ ID NO: 1339544 - protein, 9 aa, Homo Sapiens
TPHRPGPTR

SEQ ID NO: 1339545 - protein, 9 aa, Homo Sapiens
QGTRVPSSL

SEQ ID NO: 1339546 - protein, 9 aa, Homo Sapiens
PYDDLCYLF

SEQ ID NO: 1339547 - protein, 9 aa, Homo Sapiens
NQMVCNSDH

SEQ ID NO: 1339548 - protein, 9 aa, Homo Sapiens
LQHCIRKRK

SEQ ID NO: 1339549 - protein, 9 aa, Homo Sapiens
KQLVVTLST

SEQ ID NO: 1339550 - protein, 9 aa, Homo Sapiens
IDVYRTGVK

SEQ ID NO: 1339551 - protein, 9 aa, Homo Sapiens
NLTGLNQCR

SEQ ID NO: 1339552 - protein, 9 aa, Homo Sapiens
THFLVFNSK

SEQ ID NO: 1339553 - protein, 9 aa, Homo Sapiens
YVDMLLCTP

SEQ ID NO: 1339554 - protein, 9 aa, Homo Sapiens
HTLPPAPEA

SEQ ID NO: 1339555 - protein, 9 aa, Homo Sapiens
TLNEKCILQ

SEQ ID NO: 1339556 - protein, 9 aa, Homo Sapiens
LVVFIYYAV

SEQ ID NO: 1339557 - protein, 9 aa, Homo Sapiens
PAQKSHFYL

SEQ ID NO: 1339558 - protein, 9 aa, Homo Sapiens
VVNATIPAY

SEQ ID NO: 1339559 - protein, 9 aa, Homo Sapiens
FNGQDPIKG

SEQ ID NO: 1339560 - protein, 9 aa, Homo Sapiens
DARKNDMIG

SEQ ID NO: 1339561 - protein, 9 aa, Homo Sapiens
ASTRARSPT

SEQ ID NO: 1339562 - protein, 9 aa, Homo Sapiens
LSHGKQDFL

SEQ ID NO: 1339563 - protein, 9 aa, Homo Sapiens
FSFSSTSSL

SEQ ID NO: 1339564 - protein, 9 aa, Homo Sapiens
REGIHYARI

SEQ ID NO: 1339565 - protein, 9 aa, Homo Sapiens
TAECEQALR

SEQ ID NO: 1339566 - protein, 9 aa, Homo Sapiens
NEAKQQKCP

SEQ ID NO: 1339567 - protein, 9 aa, Homo Sapiens
IAGKILWAH

SEQ ID NO: 1339568 - protein, 9 aa, Homo Sapiens
NTWGASPAP

SEQ ID NO: 1339569 - protein, 9 aa, Homo Sapiens
LALGMQLLV

SEQ ID NO: 1339570 - protein, 9 aa, Homo Sapiens
VYVHVSRFV

SEQ ID NO: 1339571 - protein, 9 aa, Homo Sapiens
YQCCMMAQY

SEQ ID NO: 1339572 - protein, 9 aa, Homo Sapiens
SRPLRAEPR

SEQ ID NO: 1339573 - protein, 9 aa, Homo Sapiens
PFHSIECYS

SEQ ID NO: 1339574 - protein, 9 aa, Homo Sapiens
SLWEPSLPR

SEQ ID NO: 1339575 - protein, 9 aa, Homo Sapiens
ASTAARSPS

SEQ ID NO: 1339576 - protein, 9 aa, Homo Sapiens
RRDMFNMFC

SEQ ID NO: 1339577 - protein, 9 aa, Homo Sapiens
WALIYYCMC

SEQ ID NO: 1339578 - protein, 9 aa, Homo Sapiens
REDIWNAAW

SEQ ID NO: 1339579 - protein, 9 aa, Homo Sapiens
PLFGRSVLG

SEQ ID NO: 1339580 - protein, 9 aa, Homo Sapiens
STIFPNSYP

SEQ ID NO: 1339581 - protein, 9 aa, Homo Sapiens
KRSRCMPRG

SEQ ID NO: 1339582 - protein, 9 aa, Homo Sapiens
YLQQMSYPC

SEQ ID NO: 1339583 - protein, 9 aa, Homo Sapiens
KMQQKYWEM

SEQ ID NO: 1339584 - protein, 9 aa, Homo Sapiens
PQSRGRPSR

SEQ ID NO: 1339585 - protein, 9 aa, Homo Sapiens
LFAAVIHDV

SEQ ID NO: 1339586 - protein, 9 aa, Homo Sapiens
TCDLVLKDI

SEQ ID NO: 1339587 - protein, 9 aa, Homo Sapiens
LCAPTPQML

SEQ ID NO: 1339588 - protein, 9 aa, Homo Sapiens
DLVTSVDSA

SEQ ID NO: 1339589 - protein, 9 aa, Homo Sapiens
SMLHRWFVE

SEQ ID NO: 1339590 - protein, 9 aa, Homo Sapiens
ERQQAEHCQ

SEQ ID NO: 1339591 - protein, 9 aa, Homo Sapiens
MLKQEGDDG

SEQ ID NO: 1339592 - protein, 9 aa, Homo Sapiens
MYDILNWKR

SEQ ID NO: 1339593 - protein, 9 aa, Homo Sapiens
PHKNICWGT

SEQ ID NO: 1339594 - protein, 9 aa, Homo Sapiens
AEPWPENVT

SEQ ID NO: 1339595 - protein, 9 aa, Homo Sapiens
TLVLMFGLY

SEQ ID NO: 1339596 - protein, 9 aa, Homo Sapiens
VSALLNLYE

SEQ ID NO: 1339597 - protein, 9 aa, Homo Sapiens
ENTHYQLYT

SEQ ID NO: 1339598 - protein, 9 aa, Homo Sapiens
DILNWKRQH

SEQ ID NO: 1339599 - protein, 9 aa, Homo Sapiens
EEFREAKPH

SEQ ID NO: 1339600 - protein, 9 aa, Homo Sapiens
EEERLHCRN

SEQ ID NO: 1339601 - protein, 9 aa, Homo Sapiens
DTAWIFLQG

SEQ ID NO: 1339602 - protein, 9 aa, Homo Sapiens
DFYGQITHN

SEQ ID NO: 1339603 - protein, 9 aa, Homo Sapiens
HTSFKHHQL

SEQ ID NO: 1339604 - protein, 9 aa, Homo Sapiens
RTNKDCKKA

SEQ ID NO: 1339605 - protein, 9 aa, Homo Sapiens
LEKDTADAV

SEQ ID NO: 1339606 - protein, 9 aa, Homo Sapiens
SIHSAMEHT

SEQ ID NO: 1339607 - protein, 9 aa, Homo Sapiens
QPKTCQIRQ

SEQ ID NO: 1339608 - protein, 9 aa, Homo Sapiens
SGDSGRAER

SEQ ID NO: 1339609 - protein, 9 aa, Homo Sapiens
EPKPCSDTD

SEQ ID NO: 1339610 - protein, 9 aa, Homo Sapiens
WRHPITGTH

SEQ ID NO: 1339611 - protein, 9 aa, Homo Sapiens
EEDPTSIEP

SEQ ID NO: 1339612 - protein, 9 aa, Homo Sapiens
GAGKSTILC

SEQ ID NO: 1339613 - protein, 9 aa, Homo Sapiens
LTIEICSEV

SEQ ID NO: 1339614 - protein, 9 aa, Homo Sapiens
LTIFYRTYC

SEQ ID NO: 1339615 - protein, 9 aa, Homo Sapiens
TFVKFQTHA

SEQ ID NO: 1339616 - protein, 9 aa, Homo Sapiens
FDYSYWLHT

SEQ ID NO: 1339617 - protein, 9 aa, Homo Sapiens
SPRSGTSSK

SEQ ID NO: 1339618 - protein, 9 aa, Homo Sapiens
IGHQKNHTG

SEQ ID NO: 1339619 - protein, 9 aa, Homo Sapiens
NYELRIFGF

SEQ ID NO: 1339620 - protein, 9 aa, Homo Sapiens
HPENKQHKQ

SEQ ID NO: 1339621 - protein, 9 aa, Homo Sapiens
KVIIDGVES

SEQ ID NO: 1339622 - protein, 9 aa, Homo Sapiens
LSMGAEAHI

SEQ ID NO: 1339623 - protein, 9 aa, Homo Sapiens
SMRVMIEAM

SEQ ID NO: 1339624 - protein, 9 aa, Homo Sapiens
VVTSLAQAL

SEQ ID NO: 1339625 - protein, 9 aa, Homo Sapiens
YVLYMACQY

SEQ ID NO: 1339626 - protein, 9 aa, Homo Sapiens
NHSIVTNMD

SEQ ID NO: 1339627 - protein, 9 aa, Homo Sapiens
SIRDRRNNM

SEQ ID NO: 1339628 - protein, 9 aa, Homo Sapiens
AQNNPEFWA

SEQ ID NO: 1339629 - protein, 9 aa, Homo Sapiens
TVSTWLHPR

SEQ ID NO: 1339630 - protein, 9 aa, Homo Sapiens
GKLTPEKEG

SEQ ID NO: 1339631 - protein, 9 aa, Homo Sapiens
RITLQEEAD

SEQ ID NO: 1339632 - protein, 9 aa, Homo Sapiens
EGLVTKWYI

SEQ ID NO: 1339633 - protein, 9 aa, Homo Sapiens
GSEEENGWL

SEQ ID NO: 1339634 - protein, 9 aa, Homo Sapiens
LRYERAISM

SEQ ID NO: 1339635 - protein, 9 aa, Homo Sapiens
IMEDDIMEE

SEQ ID NO: 1339636 - protein, 9 aa, Homo Sapiens
FLNSTNSWW

SEQ ID NO: 1339637 - protein, 9 aa, Homo Sapiens
FEGTLHDPF

SEQ ID NO: 1339638 - protein, 9 aa, Homo Sapiens
TVRRSGAII

SEQ ID NO: 1339639 - protein, 9 aa, Homo Sapiens
LFMIHKDGD

SEQ ID NO: 1339640 - protein, 9 aa, Homo Sapiens
LREDTLDDS

SEQ ID NO: 1339641 - protein, 9 aa, Homo Sapiens
YSKAQYNVG

SEQ ID NO: 1339642 - protein, 9 aa, Homo Sapiens
SCMQRLGTK

SEQ ID NO: 1339643 - protein, 9 aa, Homo Sapiens
KVCQKKQDG

SEQ ID NO: 1339644 - protein, 9 aa, Homo Sapiens
LHKKKSVWQ

SEQ ID NO: 1339645 - protein, 9 aa, Homo Sapiens
RKAFKAIEK

SEQ ID NO: 1339646 - protein, 9 aa, Homo Sapiens
GLSLEAAHH

SEQ ID NO: 1339647 - protein, 9 aa, Homo Sapiens
EMEEYPISK

SEQ ID NO: 1339648 - protein, 9 aa, Homo Sapiens
LLLIASLFT

SEQ ID NO: 1339649 - protein, 9 aa, Homo Sapiens
VNKRTVCMP

SEQ ID NO: 1339650 - protein, 9 aa, Homo Sapiens
ASGETVSET

SEQ ID NO: 1339651 - protein, 9 aa, Homo Sapiens
SLLCMHERT

SEQ ID NO: 1339652 - protein, 9 aa, Homo Sapiens
RESLPALHS

SEQ ID NO: 1339653 - protein, 9 aa, Homo Sapiens
SLGSHGVSG

SEQ ID NO: 1339654 - protein, 9 aa, Homo Sapiens
QSQNPNLNA

SEQ ID NO: 1339655 - protein, 9 aa, Homo Sapiens
TGRGFSHDD

SEQ ID NO: 1339656 - protein, 9 aa, Homo Sapiens
SNINDNIYI

SEQ ID NO: 1339657 - protein, 9 aa, Homo Sapiens
KNALNGIHF

SEQ ID NO: 1339658 - protein, 9 aa, Homo Sapiens
QPTQLTQGC

SEQ ID NO: 1339659 - protein, 9 aa, Homo Sapiens
GGETKCAPA

SEQ ID NO: 1339660 - protein, 9 aa, Homo Sapiens
SGHIAHIPL

SEQ ID NO: 1339661 - protein, 9 aa, Homo Sapiens
QAIIISLKE

SEQ ID NO: 1339662 - protein, 9 aa, Homo Sapiens
RQCDMYRIL

SEQ ID NO: 1339663 - protein, 9 aa, Homo Sapiens
LKPCCPCMT

SEQ ID NO: 1339664 - protein, 9 aa, Homo Sapiens
LRLPLGNGI

SEQ ID NO: 1339665 - protein, 9 aa, Homo Sapiens
RKRKRCQPH

SEQ ID NO: 1339666 - protein, 9 aa, Homo Sapiens
SVFLRGSRE

SEQ ID NO: 1339667 - protein, 9 aa, Homo Sapiens
GETPKGISR

SEQ ID NO: 1339668 - protein, 9 aa, Homo Sapiens
YGPSIDLWG

SEQ ID NO: 1339669 - protein, 9 aa, Homo Sapiens
HYLMTFLRE

SEQ ID NO: 1339670 - protein, 9 aa, Homo Sapiens
NNPITMQTV

SEQ ID NO: 1339671 - protein, 9 aa, Homo Sapiens
DIPSTLKFF

SEQ ID NO: 1339672 - protein, 9 aa, Homo Sapiens
ENDDTVSIE

SEQ ID NO: 1339673 - protein, 9 aa, Homo Sapiens
KQDITLLAS

SEQ ID NO: 1339674 - protein, 9 aa, Homo Sapiens
SVSNSEQAS

SEQ ID NO: 1339675 - protein, 9 aa, Homo Sapiens
HLCLSLNEE

SEQ ID NO: 1339676 - protein, 9 aa, Homo Sapiens
LGCMDSIKE

SEQ ID NO: 1339677 - protein, 9 aa, Homo Sapiens
ENDYFTEMQ

SEQ ID NO: 1339678 - protein, 9 aa, Homo Sapiens
KGFRYQSLK

SEQ ID NO: 1339679 - protein, 9 aa, Homo Sapiens
VVGDQVIDV

SEQ ID NO: 1339680 - protein, 9 aa, Homo Sapiens
SASVSREDF

SEQ ID NO: 1339681 - protein, 9 aa, Homo Sapiens
WKHHYIACV

SEQ ID NO: 1339682 - protein, 9 aa, Homo Sapiens
FLRTLEQCH

SEQ ID NO: 1339683 - protein, 9 aa, Homo Sapiens
TPDDRNQDS

SEQ ID NO: 1339684 - protein, 9 aa, Homo Sapiens
SSEEPLVPS

SEQ ID NO: 1339685 - protein, 9 aa, Homo Sapiens
IEESSANNI

SEQ ID NO: 1339686 - protein, 9 aa, Homo Sapiens
QSATMPHGQ

SEQ ID NO: 1339687 - protein, 9 aa, Homo Sapiens
PEFWALIAE

SEQ ID NO: 1339688 - protein, 9 aa, Homo Sapiens
DNTTNFLHW

SEQ ID NO: 1339689 - protein, 9 aa, Homo Sapiens
ISFSSHNLI

SEQ ID NO: 1339690 - protein, 9 aa, Homo Sapiens
YTERDASHL

SEQ ID NO: 1339691 - protein, 9 aa, Homo Sapiens
TTHSTFFLV

SEQ ID NO: 1339692 - protein, 9 aa, Homo Sapiens
ISHGFSMCP

SEQ ID NO: 1339693 - protein, 9 aa, Homo Sapiens
PHRKRKRKK

SEQ ID NO: 1339694 - protein, 9 aa, Homo Sapiens
LHMGFSTPA

SEQ ID NO: 1339695 - protein, 9 aa, Homo Sapiens
MCVPHPRGA

SEQ ID NO: 1339696 - protein, 9 aa, Homo Sapiens
GVRLDTVRQ

SEQ ID NO: 1339697 - protein, 9 aa, Homo Sapiens
KIFCPIPWI

SEQ ID NO: 1339698 - protein, 9 aa, Homo Sapiens
PPGLYHTCL

SEQ ID NO: 1339699 - protein, 9 aa, Homo Sapiens
AQRGHWHSN

SEQ ID NO: 1339700 - protein, 9 aa, Homo Sapiens
IDTVDFEWE

SEQ ID NO: 1339701 - protein, 9 aa, Homo Sapiens
IQSTEHLHE

SEQ ID NO: 1339702 - protein, 9 aa, Homo Sapiens
QPQPPILGY

SEQ ID NO: 1339703 - protein, 9 aa, Homo Sapiens
TCVSNPCHE

SEQ ID NO: 1339704 - protein, 9 aa, Homo Sapiens
GDHQLSALR

SEQ ID NO: 1339705 - protein, 9 aa, Homo Sapiens
SAKEVERVV

SEQ ID NO: 1339706 - protein, 9 aa, Homo Sapiens
ELGHRTQLR

SEQ ID NO: 1339707 - protein, 9 aa, Homo Sapiens
PLEDYYEEA

SEQ ID NO: 1339708 - protein, 9 aa, Homo Sapiens
INVSDLTTK

SEQ ID NO: 1339709 - protein, 9 aa, Homo Sapiens
PRSLVDSKT

SEQ ID NO: 1339710 - protein, 9 aa, Homo Sapiens
LKWRFHGML

SEQ ID NO: 1339711 - protein, 9 aa, Homo Sapiens
FIVLALVEV

SEQ ID NO: 1339712 - protein, 9 aa, Homo Sapiens
LVGGPLEQI

SEQ ID NO: 1339713 - protein, 9 aa, Homo Sapiens
HLTPLFDNP

SEQ ID NO: 1339714 - protein, 9 aa, Homo Sapiens
LHHYLNFIY

SEQ ID NO: 1339715 - protein, 9 aa, Homo Sapiens
PNEMSENEC

SEQ ID NO: 1339716 - protein, 9 aa, Homo Sapiens
VNSILHYLA

SEQ ID NO: 1339717 - protein, 9 aa, Homo Sapiens
MVVDTAWIF

SEQ ID NO: 1339718 - protein, 9 aa, Homo Sapiens
DAFAPVTYL

SEQ ID NO: 1339719 - protein, 9 aa, Homo Sapiens
HKFNESLVF

SEQ ID NO: 1339720 - protein, 9 aa, Homo Sapiens
SQTYSGPIC

SEQ ID NO: 1339721 - protein, 9 aa, Homo Sapiens
PTDFPSQLQ

SEQ ID NO: 1339722 - protein, 9 aa, Homo Sapiens
VYGLSVSPM

SEQ ID NO: 1339723 - protein, 9 aa, Homo Sapiens
IFVSMRVMI

SEQ ID NO: 1339724 - protein, 9 aa, Homo Sapiens
FDTGSDHLR

SEQ ID NO: 1339725 - protein, 9 aa, Homo Sapiens
WKIAASEKT

SEQ ID NO: 1339726 - protein, 9 aa, Homo Sapiens
AVWRPGCFL

SEQ ID NO: 1339727 - protein, 9 aa, Homo Sapiens
VSEMTWRAM

SEQ ID NO: 1339728 - protein, 9 aa, Homo Sapiens
DRELPSSVT

SEQ ID NO: 1339729 - protein, 9 aa, Homo Sapiens
SYDYTTDDI

SEQ ID NO: 1339730 - protein, 9 aa, Homo Sapiens
VTATSHLAH

SEQ ID NO: 1339731 - protein, 9 aa, Homo Sapiens
AELGGFHKP

SEQ ID NO: 1339732 - protein, 9 aa, Homo Sapiens
YKLNVGQWQ

SEQ ID NO: 1339733 - protein, 9 aa, Homo Sapiens
NVQTRWKQG

SEQ ID NO: 1339734 - protein, 9 aa, Homo Sapiens
STNTDALYV

SEQ ID NO: 1339735 - protein, 9 aa, Homo Sapiens
IFQIAANLS

SEQ ID NO: 1339736 - protein, 9 aa, Homo Sapiens
PGGQVTEVT

SEQ ID NO: 1339737 - protein, 9 aa, Homo Sapiens
ECPPLASCG

SEQ ID NO: 1339738 - protein, 9 aa, Homo Sapiens
IRSPVMSGG

SEQ ID NO: 1339739 - protein, 9 aa, Homo Sapiens
ADQTTTEQG

SEQ ID NO: 1339740 - protein, 9 aa, Homo Sapiens
AEALKRLHR

SEQ ID NO: 1339741 - protein, 9 aa, Homo Sapiens
LFPNRQPQV

SEQ ID NO: 1339742 - protein, 9 aa, Homo Sapiens
VMVGLARTL

SEQ ID NO: 1339743 - protein, 9 aa, Homo Sapiens
RRAAWRRCN

SEQ ID NO: 1339744 - protein, 9 aa, Homo Sapiens
EYYLRHLEG

SEQ ID NO: 1339745 - protein, 9 aa, Homo Sapiens
CEDLMYKPP

SEQ ID NO: 1339746 - protein, 9 aa, Homo Sapiens
DLFELDYCL

SEQ ID NO: 1339747 - protein, 9 aa, Homo Sapiens
FIQGAEKFI

SEQ ID NO: 1339748 - protein, 9 aa, Homo Sapiens
SYGPYGYGS

SEQ ID NO: 1339749 - protein, 9 aa, Homo Sapiens
TIVTSNIVI

SEQ ID NO: 1339750 - protein, 9 aa, Homo Sapiens
KPHYPKASV

SEQ ID NO: 1339751 - protein, 9 aa, Homo Sapiens
RGKDVAEIV

SEQ ID NO: 1339752 - protein, 9 aa, Homo Sapiens
IEDPSVIGE

SEQ ID NO: 1339753 - protein, 9 aa, Homo Sapiens
RVPSVIRIN

SEQ ID NO: 1339754 - protein, 9 aa, Homo Sapiens
FPASNIYEK

SEQ ID NO: 1339755 - protein, 9 aa, Homo Sapiens
RSHFTKVEH

SEQ ID NO: 1339756 - protein, 9 aa, Homo Sapiens
DIFTFDRTC

SEQ ID NO: 1339757 - protein, 9 aa, Homo Sapiens
NDKTLSLML

SEQ ID NO: 1339758 - protein, 9 aa, Homo Sapiens
FSLWVMCRR

SEQ ID NO: 1339759 - protein, 9 aa, Homo Sapiens
CCYREELRM

SEQ ID NO: 1339760 - protein, 9 aa, Homo Sapiens
LGTFPINPG

SEQ ID NO: 1339761 - protein, 9 aa, Homo Sapiens
PTFSEVIRF

SEQ ID NO: 1339762 - protein, 9 aa, Homo Sapiens
MAAINVAGL

SEQ ID NO: 1339763 - protein, 9 aa, Homo Sapiens
CVASQCQTA

SEQ ID NO: 1339764 - protein, 9 aa, Homo Sapiens
AFGRYTTLN

SEQ ID NO: 1339765 - protein, 9 aa, Homo Sapiens
QPVQAWLFS

SEQ ID NO: 1339766 - protein, 9 aa, Homo Sapiens
TVVVLRLDG

SEQ ID NO: 1339767 - protein, 9 aa, Homo Sapiens
SMLCSYRQM

SEQ ID NO: 1339768 - protein, 9 aa, Homo Sapiens
LHNAVCTGH

SEQ ID NO: 1339769 - protein, 9 aa, Homo Sapiens
SVHIGLYDS

SEQ ID NO: 1339770 - protein, 9 aa, Homo Sapiens
VPFNGQDPI

SEQ ID NO: 1339771 - protein, 9 aa, Homo Sapiens
EPDYGESSS

SEQ ID NO: 1339772 - protein, 9 aa, Homo Sapiens
CKGTILSPG

SEQ ID NO: 1339773 - protein, 9 aa, Homo Sapiens
AAGTGEDAD

SEQ ID NO: 1339774 - protein, 9 aa, Homo Sapiens
AEWRQFNRE

SEQ ID NO: 1339775 - protein, 9 aa, Homo Sapiens
FFQELREVT

SEQ ID NO: 1339776 - protein, 9 aa, Homo Sapiens
DIVSTQVAT

SEQ ID NO: 1339777 - protein, 9 aa, Homo Sapiens
NANFAKLFL

SEQ ID NO: 1339778 - protein, 9 aa, Homo Sapiens
DTTAIQGYK

SEQ ID NO: 1339779 - protein, 9 aa, Homo Sapiens
INCFLMRKR

SEQ ID NO: 1339780 - protein, 9 aa, Homo Sapiens
TTLLCHRRL

SEQ ID NO: 1339781 - protein, 9 aa, Homo Sapiens
WEEDPTSIE

SEQ ID NO: 1339782 - protein, 9 aa, Homo Sapiens
SASDSVTGT

SEQ ID NO: 1339783 - protein, 9 aa, Homo Sapiens
FTFGPTFQA

SEQ ID NO: 1339784 - protein, 9 aa, Homo Sapiens
VVSGSSDDL

SEQ ID NO: 1339785 - protein, 9 aa, Homo Sapiens
QIVKEDRRF

SEQ ID NO: 1339786 - protein, 9 aa, Homo Sapiens
RLPLRAINL

SEQ ID NO: 1339787 - protein, 9 aa, Homo Sapiens
AAVGPLGST

SEQ ID NO: 1339788 - protein, 9 aa, Homo Sapiens
TGMTAVKKK

SEQ ID NO: 1339789 - protein, 9 aa, Homo Sapiens
GPGPHLSPL

SEQ ID NO: 1339790 - protein, 9 aa, Homo Sapiens
EPQAVFYVA

SEQ ID NO: 1339791 - protein, 9 aa, Homo Sapiens
IFKSSSSLR

SEQ ID NO: 1339792 - protein, 9 aa, Homo Sapiens
HSMLMEQDP

SEQ ID NO: 1339793 - protein, 9 aa, Homo Sapiens
RNGINSVRF

SEQ ID NO: 1339794 - protein, 9 aa, Homo Sapiens
ISHFIHNIP

SEQ ID NO: 1339795 - protein, 9 aa, Homo Sapiens
WKEIKYEVV

SEQ ID NO: 1339796 - protein, 9 aa, Homo Sapiens
LYHISMIPA

SEQ ID NO: 1339797 - protein, 9 aa, Homo Sapiens
FRTWAEWRQ

SEQ ID NO: 1339798 - protein, 9 aa, Homo Sapiens
SVFQAESKV

SEQ ID NO: 1339799 - protein, 9 aa, Homo Sapiens
PREEVTVLQ

SEQ ID NO: 1339800 - protein, 9 aa, Homo Sapiens
WRWGWGQLL

SEQ ID NO: 1339801 - protein, 9 aa, Homo Sapiens
PLHIVIRGR

SEQ ID NO: 1339802 - protein, 9 aa, Homo Sapiens
VIHYFRALA

SEQ ID NO: 1339803 - protein, 9 aa, Homo Sapiens
VKSLLQIEA

SEQ ID NO: 1339804 - protein, 9 aa, Homo Sapiens
VWAVLHLGL

SEQ ID NO: 1339805 - protein, 9 aa, Homo Sapiens
VLEPPVIVV

SEQ ID NO: 1339806 - protein, 9 aa, Homo Sapiens
TPSQSSVQH

SEQ ID NO: 1339807 - protein, 9 aa, Homo Sapiens
GAGNETAAL

SEQ ID NO: 1339808 - protein, 9 aa, Homo Sapiens
LKAKRVKVQ

SEQ ID NO: 1339809 - protein, 9 aa, Homo Sapiens
LQPWCCPGR

SEQ ID NO: 1339810 - protein, 9 aa, Homo Sapiens
IMHIKGLEA

SEQ ID NO: 1339811 - protein, 9 aa, Homo Sapiens
SVVLGPHAG

SEQ ID NO: 1339812 - protein, 9 aa, Homo Sapiens
PHLPSDLHP

SEQ ID NO: 1339813 - protein, 9 aa, Homo Sapiens
TLKDINTSI

SEQ ID NO: 1339814 - protein, 9 aa, Homo Sapiens
ITVELYQGH

SEQ ID NO: 1339815 - protein, 9 aa, Homo Sapiens
FQVAAKWEQ

SEQ ID NO: 1339816 - protein, 9 aa, Homo Sapiens
RNKEVMGAV

SEQ ID NO: 1339817 - protein, 9 aa, Homo Sapiens
AMPLIRPET

SEQ ID NO: 1339818 - protein, 9 aa, Homo Sapiens
YTKVKSKDA

SEQ ID NO: 1339819 - protein, 9 aa, Homo Sapiens
CRELHPRYL

SEQ ID NO: 1339820 - protein, 9 aa, Homo Sapiens
KKIRKTSQV

SEQ ID NO: 1339821 - protein, 9 aa, Homo Sapiens
VVRAKIRNL

SEQ ID NO: 1339822 - protein, 9 aa, Homo Sapiens
MLRMTEQQG

SEQ ID NO: 1339823 - protein, 9 aa, Homo Sapiens
LFGRSVLGF

SEQ ID NO: 1339824 - protein, 9 aa, Homo Sapiens
FVPVRPGPH

SEQ ID NO: 1339825 - protein, 9 aa, Homo Sapiens
VDGRMDQDI

SEQ ID NO: 1339826 - protein, 9 aa, Homo Sapiens
LKNKMSSEF

SEQ ID NO: 1339827 - protein, 9 aa, Homo Sapiens
REANMACLD

SEQ ID NO: 1339828 - protein, 9 aa, Homo Sapiens
TEAISGDCP

SEQ ID NO: 1339829 - protein, 9 aa, Homo Sapiens
RERAARACF

SEQ ID NO: 1339830 - protein, 9 aa, Homo Sapiens
KGQIVISLD

SEQ ID NO: 1339831 - protein, 9 aa, Homo Sapiens
KPSAPTPTS

SEQ ID NO: 1339832 - protein, 9 aa, Homo Sapiens
LSINEEELR

SEQ ID NO: 1339833 - protein, 9 aa, Homo Sapiens
LPVFINANR

SEQ ID NO: 1339834 - protein, 9 aa, Homo Sapiens
QRPGMLKEE

SEQ ID NO: 1339835 - protein, 9 aa, Homo Sapiens
EGHKIYLRP

SEQ ID NO: 1339836 - protein, 9 aa, Homo Sapiens
RALQETMQR

SEQ ID NO: 1339837 - protein, 9 aa, Homo Sapiens
FSSTIFPNS

SEQ ID NO: 1339838 - protein, 9 aa, Homo Sapiens
LLFTGLLQR

SEQ ID NO: 1339839 - protein, 9 aa, Homo Sapiens
EREVKHLKY

SEQ ID NO: 1339840 - protein, 9 aa, Homo Sapiens
CKPRCSLII

SEQ ID NO: 1339841 - protein, 9 aa, Homo Sapiens
PCSRLLPWP

SEQ ID NO: 1339842 - protein, 9 aa, Homo Sapiens
DVVAKRTHQ

SEQ ID NO: 1339843 - protein, 9 aa, Homo Sapiens
GRFRDNHMD

SEQ ID NO: 1339844 - protein, 9 aa, Homo Sapiens
DEEEEERFH

SEQ ID NO: 1339845 - protein, 9 aa, Homo Sapiens
VSLGIYLPD

SEQ ID NO: 1339846 - protein, 9 aa, Homo Sapiens
YIRKVGGQL

SEQ ID NO: 1339847 - protein, 9 aa, Homo Sapiens
HATTASTRA

SEQ ID NO: 1339848 - protein, 9 aa, Homo Sapiens
PCPLPCSPD

SEQ ID NO: 1339849 - protein, 9 aa, Homo Sapiens
CESLPSSSS

SEQ ID NO: 1339850 - protein, 9 aa, Homo Sapiens
IRVKLQLNP

SEQ ID NO: 1339851 - protein, 9 aa, Homo Sapiens
YKDRYEEAV

SEQ ID NO: 1339852 - protein, 9 aa, Homo Sapiens
GAWILTGGI

SEQ ID NO: 1339853 - protein, 9 aa, Homo Sapiens
SSMVIDEVT

SEQ ID NO: 1339854 - protein, 9 aa, Homo Sapiens
HTTIPTRAI

SEQ ID NO: 1339855 - protein, 9 aa, Homo Sapiens
PPPVKSTLI

SEQ ID NO: 1339856 - protein, 9 aa, Homo Sapiens
PTISPEKTH

SEQ ID NO: 1339857 - protein, 9 aa, Homo Sapiens
ASNTTRGFI

SEQ ID NO: 1339858 - protein, 9 aa, Homo Sapiens
KTQTEPRNH

SEQ ID NO: 1339859 - protein, 9 aa, Homo Sapiens
DETTAKTQL

SEQ ID NO: 1339860 - protein, 9 aa, Homo Sapiens
QPPRQNQVP

SEQ ID NO: 1339861 - protein, 9 aa, Homo Sapiens
HDCRHIQYF

SEQ ID NO: 1339862 - protein, 9 aa, Homo Sapiens
TNAKCKLSD

SEQ ID NO: 1339863 - protein, 9 aa, Homo Sapiens
SIYYQLNKH

SEQ ID NO: 1339864 - protein, 9 aa, Homo Sapiens
QLYSGHLQV

SEQ ID NO: 1339865 - protein, 9 aa, Homo Sapiens
NTFSTFTFL

SEQ ID NO: 1339866 - protein, 9 aa, Homo Sapiens
ITTLASGAV

SEQ ID NO: 1339867 - protein, 9 aa, Homo Sapiens
KKIDLQKNK

SEQ ID NO: 1339868 - protein, 9 aa, Homo Sapiens
ECLLFLEEI

SEQ ID NO: 1339869 - protein, 9 aa, Homo Sapiens
LQMQHKHLK

SEQ ID NO: 1339870 - protein, 9 aa, Homo Sapiens
SIIKGDFQN

SEQ ID NO: 1339871 - protein, 9 aa, Homo Sapiens
EENEEDGDK

SEQ ID NO: 1339872 - protein, 9 aa, Homo Sapiens
AGPASIMGP

SEQ ID NO: 1339873 - protein, 9 aa, Homo Sapiens
GAQTTEHIS

SEQ ID NO: 1339874 - protein, 9 aa, Homo Sapiens
VAAHESIIW

SEQ ID NO: 1339875 - protein, 9 aa, Homo Sapiens
SSMMCYDDH

SEQ ID NO: 1339876 - protein, 9 aa, Homo Sapiens
HHLGHPEPN

SEQ ID NO: 1339877 - protein, 9 aa, Homo Sapiens
SPEALHHPY

SEQ ID NO: 1339878 - protein, 9 aa, Homo Sapiens
SMGVLFGGC

SEQ ID NO: 1339879 - protein, 9 aa, Homo Sapiens
PLAVSKNPS

SEQ ID NO: 1339880 - protein, 9 aa, Homo Sapiens
LGYLLVPAR

SEQ ID NO: 1339881 - protein, 9 aa, Homo Sapiens
MSLHSAHNR

SEQ ID NO: 1339882 - protein, 9 aa, Homo Sapiens
LMWYSEAMK

SEQ ID NO: 1339883 - protein, 9 aa, Homo Sapiens
WGPKQPERE

SEQ ID NO: 1339884 - protein, 9 aa, Homo Sapiens
TRSILYVLT

SEQ ID NO: 1339885 - protein, 9 aa, Homo Sapiens
WKEKEAFEK

SEQ ID NO: 1339886 - protein, 9 aa, Homo Sapiens
VKEAVKVVI

SEQ ID NO: 1339887 - protein, 9 aa, Homo Sapiens
FARLVALEP

SEQ ID NO: 1339888 - protein, 9 aa, Homo Sapiens
IAGNNHLVP

SEQ ID NO: 1339889 - protein, 9 aa, Homo Sapiens
SYDEVVLPP

SEQ ID NO: 1339890 - protein, 9 aa, Homo Sapiens
VWGGHEVKQ

SEQ ID NO: 1339891 - protein, 9 aa, Homo Sapiens
LDQQCSCPT

SEQ ID NO: 1339892 - protein, 9 aa, Homo Sapiens
ERELSEIRA

SEQ ID NO: 1339893 - protein, 9 aa, Homo Sapiens
VLDPALPVL

SEQ ID NO: 1339894 - protein, 9 aa, Homo Sapiens
VTSYQMPLV

SEQ ID NO: 1339895 - protein, 9 aa, Homo Sapiens
STLFDVDGI

SEQ ID NO: 1339896 - protein, 9 aa, Homo Sapiens
TTLDPSSTP

SEQ ID NO: 1339897 - protein, 9 aa, Homo Sapiens
GGEIRKMKD

SEQ ID NO: 1339898 - protein, 9 aa, Homo Sapiens
HFQVRGNPE

SEQ ID NO: 1339899 - protein, 9 aa, Homo Sapiens
YKWKKPSIE

SEQ ID NO: 1339900 - protein, 9 aa, Homo Sapiens
FQAIIISLK

SEQ ID NO: 1339901 - protein, 9 aa, Homo Sapiens
DKFTDTYQA

SEQ ID NO: 1339902 - protein, 9 aa, Homo Sapiens
TKVEYMKLL

SEQ ID NO: 1339903 - protein, 9 aa, Homo Sapiens
NPHPFTCSV

SEQ ID NO: 1339904 - protein, 9 aa, Homo Sapiens
TGSVSVTQT

SEQ ID NO: 1339905 - protein, 9 aa, Homo Sapiens
QELVNTGCD

SEQ ID NO: 1339906 - protein, 9 aa, Homo Sapiens
GLEASSVPY

SEQ ID NO: 1339907 - protein, 9 aa, Homo Sapiens
TIFTKSYLK

SEQ ID NO: 1339908 - protein, 9 aa, Homo Sapiens
KKAKRSKPE

SEQ ID NO: 1339909 - protein, 9 aa, Homo Sapiens
CGYVCSEKS

SEQ ID NO: 1339910 - protein, 9 aa, Homo Sapiens
SLADDKQKV

SEQ ID NO: 1339911 - protein, 9 aa, Homo Sapiens
VCMPHQLFI

SEQ ID NO: 1339912 - protein, 9 aa, Homo Sapiens
AATQPTKEG

SEQ ID NO: 1339913 - protein, 9 aa, Homo Sapiens
AFTPCGYVC

SEQ ID NO: 1339914 - protein, 9 aa, Homo Sapiens
YFRFIVRFI

SEQ ID NO: 1339915 - protein, 9 aa, Homo Sapiens
IFCVKEFLS

SEQ ID NO: 1339916 - protein, 9 aa, Homo Sapiens
FPDTSFQVV

SEQ ID NO: 1339917 - protein, 9 aa, Homo Sapiens
IFTNLGYRA

SEQ ID NO: 1339918 - protein, 9 aa, Homo Sapiens
CKKAQVQVS

SEQ ID NO: 1339919 - protein, 9 aa, Homo Sapiens
ERAQEQHNV

SEQ ID NO: 1339920 - protein, 9 aa, Homo Sapiens
DLGSQPCVL

SEQ ID NO: 1339921 - protein, 9 aa, Homo Sapiens
MLLCTSFYM

SEQ ID NO: 1339922 - protein, 9 aa, Homo Sapiens
HIFQKFLQR

SEQ ID NO: 1339923 - protein, 9 aa, Homo Sapiens
LAMLQLSLH

SEQ ID NO: 1339924 - protein, 9 aa, Homo Sapiens
SGDPFHSIE

SEQ ID NO: 1339925 - protein, 9 aa, Homo Sapiens
VDRYMSWFL

SEQ ID NO: 1339926 - protein, 9 aa, Homo Sapiens
LRDGVKCCC

SEQ ID NO: 1339927 - protein, 9 aa, Homo Sapiens
MKIMALMDT

SEQ ID NO: 1339928 - protein, 9 aa, Homo Sapiens
WCALCNSER

SEQ ID NO: 1339929 - protein, 9 aa, Homo Sapiens
LLAYLNSVP

SEQ ID NO: 1339930 - protein, 9 aa, Homo Sapiens
HQHHHFQNG

SEQ ID NO: 1339931 - protein, 9 aa, Homo Sapiens
IRELKATDN

SEQ ID NO: 1339932 - protein, 9 aa, Homo Sapiens
AGSMVHVYE

SEQ ID NO: 1339933 - protein, 9 aa, Homo Sapiens
RPDGLHPLW

SEQ ID NO: 1339934 - protein, 9 aa, Homo Sapiens
GYHTLSQHL

SEQ ID NO: 1339935 - protein, 9 aa, Homo Sapiens
HLHRLNSPI

SEQ ID NO: 1339936 - protein, 9 aa, Homo Sapiens
QTNPTFPGE

SEQ ID NO: 1339937 - protein, 9 aa, Homo Sapiens
CYGDRPGLL

SEQ ID NO: 1339938 - protein, 9 aa, Homo Sapiens
NKHTAAEND

SEQ ID NO: 1339939 - protein, 9 aa, Homo Sapiens
KSEKGCNKF

SEQ ID NO: 1339940 - protein, 9 aa, Homo Sapiens
HEQDTELGS

SEQ ID NO: 1339941 - protein, 9 aa, Homo Sapiens
DSKFQECHM

SEQ ID NO: 1339942 - protein, 9 aa, Homo Sapiens
DGRISHLNG

SEQ ID NO: 1339943 - protein, 9 aa, Homo Sapiens
SWQGRTRQA

SEQ ID NO: 1339944 - protein, 9 aa, Homo Sapiens
IPQAIFVQR

SEQ ID NO: 1339945 - protein, 9 aa, Homo Sapiens
SLVASMRKF

SEQ ID NO: 1339946 - protein, 9 aa, Homo Sapiens
GQHKDMVCI

SEQ ID NO: 1339947 - protein, 9 aa, Homo Sapiens
HFMSVIYHQ

SEQ ID NO: 1339948 - protein, 9 aa, Homo Sapiens
SVNSLVEVH

SEQ ID NO: 1339949 - protein, 9 aa, Homo Sapiens
LKPREEVTV

SEQ ID NO: 1339950 - protein, 9 aa, Homo Sapiens
LSATSTWLE

SEQ ID NO: 1339951 - protein, 9 aa, Homo Sapiens
FKLQSLSHR

SEQ ID NO: 1339952 - protein, 9 aa, Homo Sapiens
LQLKEICIK

SEQ ID NO: 1339953 - protein, 9 aa, Homo Sapiens
KDLGNLCYW

SEQ ID NO: 1339954 - protein, 9 aa, Homo Sapiens
MLNTWPAIS

SEQ ID NO: 1339955 - protein, 9 aa, Homo Sapiens
KGLRGSTKI

SEQ ID NO: 1339956 - protein, 9 aa, Homo Sapiens
VGQINDGVS

SEQ ID NO: 1339957 - protein, 9 aa, Homo Sapiens
NPNSLVIYR

SEQ ID NO: 1339958 - protein, 9 aa, Homo Sapiens
VMNQQHMMP

SEQ ID NO: 1339959 - protein, 9 aa, Homo Sapiens
TTTLVLMFG

SEQ ID NO: 1339960 - protein, 9 aa, Homo Sapiens
SNDCGGIYG

SEQ ID NO: 1339961 - protein, 9 aa, Homo Sapiens
LIWERVKQG

SEQ ID NO: 1339962 - protein, 9 aa, Homo Sapiens
FYNPGDHIQ

SEQ ID NO: 1339963 - protein, 9 aa, Homo Sapiens
LQQLCPQNS

SEQ ID NO: 1339964 - protein, 9 aa, Homo Sapiens
LQEVQQIHQ

SEQ ID NO: 1339965 - protein, 9 aa, Homo Sapiens
AATMAGARA

SEQ ID NO: 1339966 - protein, 9 aa, Homo Sapiens
FLLWTGAIL

SEQ ID NO: 1339967 - protein, 9 aa, Homo Sapiens
RDSGDNRKM

SEQ ID NO: 1339968 - protein, 9 aa, Homo Sapiens
LHLWQPQGA

SEQ ID NO: 1339969 - protein, 9 aa, Homo Sapiens
KVCFFTGQL

SEQ ID NO: 1339970 - protein, 9 aa, Homo Sapiens
QMVLYLQQA

SEQ ID NO: 1339971 - protein, 9 aa, Homo Sapiens
DVVKTGERE

SEQ ID NO: 1339972 - protein, 9 aa, Homo Sapiens
YFAIVTALG

SEQ ID NO: 1339973 - protein, 9 aa, Homo Sapiens
DIEEVKVLL

SEQ ID NO: 1339974 - protein, 9 aa, Homo Sapiens
QTQIKVVKV

SEQ ID NO: 1339975 - protein, 9 aa, Homo Sapiens
ANATSTVVS

SEQ ID NO: 1339976 - protein, 9 aa, Homo Sapiens
KVSLGEGCP

SEQ ID NO: 1339977 - protein, 9 aa, Homo Sapiens
HEAVHFSFA

SEQ ID NO: 1339978 - protein, 9 aa, Homo Sapiens
QVRKLLLFD

SEQ ID NO: 1339979 - protein, 9 aa, Homo Sapiens
QYLVWLGPD

SEQ ID NO: 1339980 - protein, 9 aa, Homo Sapiens
PHPHPHPRE

SEQ ID NO: 1339981 - protein, 9 aa, Homo Sapiens
NSSGTLSSN

SEQ ID NO: 1339982 - protein, 9 aa, Homo Sapiens
QHCIRKRKM

SEQ ID NO: 1339983 - protein, 9 aa, Homo Sapiens
NSEKKQGPC

SEQ ID NO: 1339984 - protein, 9 aa, Homo Sapiens
MTKAAAIGI

SEQ ID NO: 1339985 - protein, 9 aa, Homo Sapiens
AKKKCDEEI

SEQ ID NO: 1339986 - protein, 9 aa, Homo Sapiens
LSQKHISSP

SEQ ID NO: 1339987 - protein, 9 aa, Homo Sapiens
AQAALQVPE

SEQ ID NO: 1339988 - protein, 9 aa, Homo Sapiens
QMYRCYRSP

SEQ ID NO: 1339989 - protein, 9 aa, Homo Sapiens
IVVYHRGHY

SEQ ID NO: 1339990 - protein, 9 aa, Homo Sapiens
SRRWRMSTW

SEQ ID NO: 1339991 - protein, 9 aa, Homo Sapiens
PETSPKETS

SEQ ID NO: 1339992 - protein, 9 aa, Homo Sapiens
DVAVQVVRA

SEQ ID NO: 1339993 - protein, 9 aa, Homo Sapiens
EDTMHFRDN

SEQ ID NO: 1339994 - protein, 9 aa, Homo Sapiens
TDTIGEFIA

SEQ ID NO: 1339995 - protein, 9 aa, Homo Sapiens
VFAQINCFE

SEQ ID NO: 1339996 - protein, 9 aa, Homo Sapiens
TMKKIYYRS

SEQ ID NO: 1339997 - protein, 9 aa, Homo Sapiens
LILCLPFCG

SEQ ID NO: 1339998 - protein, 9 aa, Homo Sapiens
DSNTDKHLD

SEQ ID NO: 1339999 - protein, 9 aa, Homo Sapiens
APKMSNANF

SEQ ID NO: 1340000 - protein, 9 aa, Homo Sapiens
PGREFICLG

SEQ ID NO: 1340001 - protein, 9 aa, Homo Sapiens
SDTEGLIQE

SEQ ID NO: 1340002 - protein, 9 aa, Homo Sapiens
SWPWTRCLR

SEQ ID NO: 1340003 - protein, 9 aa, Homo Sapiens
WCCPGRWGP

SEQ ID NO: 1340004 - protein, 9 aa, Homo Sapiens
KKCCYVAFL

SEQ ID NO: 1340005 - protein, 9 aa, Homo Sapiens
IKGKAGPRG

SEQ ID NO: 1340006 - protein, 9 aa, Homo Sapiens
LQLKTHLDE

SEQ ID NO: 1340007 - protein, 9 aa, Homo Sapiens
PDPLTYDSV

SEQ ID NO: 1340008 - protein, 9 aa, Homo Sapiens
VSYICSHYY

SEQ ID NO: 1340009 - protein, 9 aa, Homo Sapiens
DTPPNIYEG

SEQ ID NO: 1340010 - protein, 9 aa, Homo Sapiens
YPLVCQCLA

SEQ ID NO: 1340011 - protein, 9 aa, Homo Sapiens
PKGISRYIV

SEQ ID NO: 1340012 - protein, 9 aa, Homo Sapiens
PNNVPKFGS

SEQ ID NO: 1340013 - protein, 9 aa, Homo Sapiens
DQSENGRYH

SEQ ID NO: 1340014 - protein, 9 aa, Homo Sapiens
EAYNIHTDS

SEQ ID NO: 1340015 - protein, 9 aa, Homo Sapiens
DAQWKEAIK

SEQ ID NO: 1340016 - protein, 9 aa, Homo Sapiens
GKNRHRGKN

SEQ ID NO: 1340017 - protein, 9 aa, Homo Sapiens
KFISDKDGS

SEQ ID NO: 1340018 - protein, 9 aa, Homo Sapiens
KGTWQWINP

SEQ ID NO: 1340019 - protein, 9 aa, Homo Sapiens
SVPVFQVEP

SEQ ID NO: 1340020 - protein, 9 aa, Homo Sapiens
SRFFSYFRS

SEQ ID NO: 1340021 - protein, 9 aa, Homo Sapiens
NVAQTPRIP

SEQ ID NO: 1340022 - protein, 9 aa, Homo Sapiens
GDDIVSTQV

SEQ ID NO: 1340023 - protein, 9 aa, Homo Sapiens
HCTSPHKMA

SEQ ID NO: 1340024 - protein, 9 aa, Homo Sapiens
LIRPKVQVL

SEQ ID NO: 1340025 - protein, 9 aa, Homo Sapiens
KKPSVMPAP

SEQ ID NO: 1340026 - protein, 9 aa, Homo Sapiens
EEFWERSQQ

SEQ ID NO: 1340027 - protein, 9 aa, Homo Sapiens
HLTGQLFLG

SEQ ID NO: 1340028 - protein, 9 aa, Homo Sapiens
NIKYVFRTE

SEQ ID NO: 1340029 - protein, 9 aa, Homo Sapiens
LYVPLVLKP

SEQ ID NO: 1340030 - protein, 9 aa, Homo Sapiens
KHRSIKKLR

SEQ ID NO: 1340031 - protein, 9 aa, Homo Sapiens
IFLWYPLTD

SEQ ID NO: 1340032 - protein, 9 aa, Homo Sapiens
KRLVHKEAV

SEQ ID NO: 1340033 - protein, 9 aa, Homo Sapiens
NLAVTDDDN

SEQ ID NO: 1340034 - protein, 9 aa, Homo Sapiens
KASEITSLS

SEQ ID NO: 1340035 - protein, 9 aa, Homo Sapiens
PPEELNGSS

SEQ ID NO: 1340036 - protein, 9 aa, Homo Sapiens
SPHTNHPNT

SEQ ID NO: 1340037 - protein, 9 aa, Homo Sapiens
CTHSVSIPA

SEQ ID NO: 1340038 - protein, 9 aa, Homo Sapiens
NQKDSGVLD

SEQ ID NO: 1340039 - protein, 9 aa, Homo Sapiens
NCYHDMTAG

SEQ ID NO: 1340040 - protein, 9 aa, Homo Sapiens
GKPKKQTLE

SEQ ID NO: 1340041 - protein, 9 aa, Homo Sapiens
LQKRKGFVC

SEQ ID NO: 1340042 - protein, 9 aa, Homo Sapiens
PHMRPRHPH

SEQ ID NO: 1340043 - protein, 9 aa, Homo Sapiens
EDFHVKDSK

SEQ ID NO: 1340044 - protein, 9 aa, Homo Sapiens
LSNSVTDFY

SEQ ID NO: 1340045 - protein, 9 aa, Homo Sapiens
ATTGKIFEK

SEQ ID NO: 1340046 - protein, 9 aa, Homo Sapiens
EDHAQYLTS

SEQ ID NO: 1340047 - protein, 9 aa, Homo Sapiens
EGCPPVLTA

SEQ ID NO: 1340048 - protein, 9 aa, Homo Sapiens
QEISRLVHE

SEQ ID NO: 1340049 - protein, 9 aa, Homo Sapiens
LSSHVSSEA

SEQ ID NO: 1340050 - protein, 9 aa, Homo Sapiens
QPEMAAMRL

SEQ ID NO: 1340051 - protein, 9 aa, Homo Sapiens
RMQRQEEER

SEQ ID NO: 1340052 - protein, 9 aa, Homo Sapiens
GIMGSAGGL

SEQ ID NO: 1340053 - protein, 9 aa, Homo Sapiens
LRECFAYPM

SEQ ID NO: 1340054 - protein, 9 aa, Homo Sapiens
AVAEVSGYL

SEQ ID NO: 1340055 - protein, 9 aa, Homo Sapiens
KTDLCKGKS

SEQ ID NO: 1340056 - protein, 9 aa, Homo Sapiens
GGQKPGGNI

SEQ ID NO: 1340057 - protein, 9 aa, Homo Sapiens
HKLTVNGFV

SEQ ID NO: 1340058 - protein, 9 aa, Homo Sapiens
IIGILQLTF

SEQ ID NO: 1340059 - protein, 9 aa, Homo Sapiens
STVSCGNGK

SEQ ID NO: 1340060 - protein, 9 aa, Homo Sapiens
SKSFNFDHV

SEQ ID NO: 1340061 - protein, 9 aa, Homo Sapiens
DQNLKELRE

SEQ ID NO: 1340062 - protein, 9 aa, Homo Sapiens
DEHKILLDS

SEQ ID NO: 1340063 - protein, 9 aa, Homo Sapiens
LHFLAPRLL

SEQ ID NO: 1340064 - protein, 9 aa, Homo Sapiens
RLPSVIPTR

SEQ ID NO: 1340065 - protein, 9 aa, Homo Sapiens
ECKAGAYLD

SEQ ID NO: 1340066 - protein, 9 aa, Homo Sapiens
PGRNGTPAC

SEQ ID NO: 1340067 - protein, 9 aa, Homo Sapiens
WPTVHGLLR

SEQ ID NO: 1340068 - protein, 9 aa, Homo Sapiens
QTIQGGLLP

SEQ ID NO: 1340069 - protein, 9 aa, Homo Sapiens
VVLVGYNTI

SEQ ID NO: 1340070 - protein, 9 aa, Homo Sapiens
TVFDANDNT

SEQ ID NO: 1340071 - protein, 9 aa, Homo Sapiens
LGGMEVWWC

SEQ ID NO: 1340072 - protein, 9 aa, Homo Sapiens
GKKSKIHCE

SEQ ID NO: 1340073 - protein, 9 aa, Homo Sapiens
LSGIPLDQT

SEQ ID NO: 1340074 - protein, 9 aa, Homo Sapiens
VTYEAVLRL

SEQ ID NO: 1340075 - protein, 9 aa, Homo Sapiens
VANQSTSED

SEQ ID NO: 1340076 - protein, 9 aa, Homo Sapiens
PESTVFMYL

SEQ ID NO: 1340077 - protein, 9 aa, Homo Sapiens
GLPTAQQQE

SEQ ID NO: 1340078 - protein, 9 aa, Homo Sapiens
HYTACRPSV

SEQ ID NO: 1340079 - protein, 9 aa, Homo Sapiens
HLLNIPLEL

SEQ ID NO: 1340080 - protein, 9 aa, Homo Sapiens
KKFFGGKQE

SEQ ID NO: 1340081 - protein, 9 aa, Homo Sapiens
AVCIPMHGP

SEQ ID NO: 1340082 - protein, 9 aa, Homo Sapiens
LTEIGPKCD

SEQ ID NO: 1340083 - protein, 9 aa, Homo Sapiens
HVFNEGWGP

SEQ ID NO: 1340084 - protein, 9 aa, Homo Sapiens
TDLEVKIRD

SEQ ID NO: 1340085 - protein, 9 aa, Homo Sapiens
EVLWTVETK

SEQ ID NO: 1340086 - protein, 9 aa, Homo Sapiens
TDTICISTM

SEQ ID NO: 1340087 - protein, 9 aa, Homo Sapiens
YSHTIYPVL

SEQ ID NO: 1340088 - protein, 9 aa, Homo Sapiens
LSGASGLDG

SEQ ID NO: 1340089 - protein, 9 aa, Homo Sapiens
CDSAQAANF

SEQ ID NO: 1340090 - protein, 9 aa, Homo Sapiens
LKMDPTGLE

SEQ ID NO: 1340091 - protein, 9 aa, Homo Sapiens
SYILLTMCH

SEQ ID NO: 1340092 - protein, 9 aa, Homo Sapiens
YSEACTSTL

SEQ ID NO: 1340093 - protein, 9 aa, Homo Sapiens
SYVWNVEPL

SEQ ID NO: 1340094 - protein, 9 aa, Homo Sapiens
ETKPDTQQV

SEQ ID NO: 1340095 - protein, 9 aa, Homo Sapiens
LSKMSEAEE

SEQ ID NO: 1340096 - protein, 9 aa, Homo Sapiens
MVQLEERKV

SEQ ID NO: 1340097 - protein, 9 aa, Homo Sapiens
RPSTSVHTS

SEQ ID NO: 1340098 - protein, 9 aa, Homo Sapiens
RPKDDHHLR

SEQ ID NO: 1340099 - protein, 9 aa, Homo Sapiens
SPRPEELIE

SEQ ID NO: 1340100 - protein, 9 aa, Homo Sapiens
LLNVQPHHK

SEQ ID NO: 1340101 - protein, 9 aa, Homo Sapiens
EARGVTMVH

SEQ ID NO: 1340102 - protein, 9 aa, Homo Sapiens
WRNYGFGIM

SEQ ID NO: 1340103 - protein, 9 aa, Homo Sapiens
ASPAKGELS

SEQ ID NO: 1340104 - protein, 9 aa, Homo Sapiens
MDLLHRIVA

SEQ ID NO: 1340105 - protein, 9 aa, Homo Sapiens
RHVKEMDAY

SEQ ID NO: 1340106 - protein, 9 aa, Homo Sapiens
LTQFHGDSA

SEQ ID NO: 1340107 - protein, 9 aa, Homo Sapiens
KMCNDVSVK

SEQ ID NO: 1340108 - protein, 9 aa, Homo Sapiens
LDLPVSCTS

SEQ ID NO: 1340109 - protein, 9 aa, Homo Sapiens
PAARPSPAT

SEQ ID NO: 1340110 - protein, 9 aa, Homo Sapiens
TVSSPLKLN

SEQ ID NO: 1340111 - protein, 9 aa, Homo Sapiens
SHKSSDASA

SEQ ID NO: 1340112 - protein, 9 aa, Homo Sapiens
KSHRTFGHS

SEQ ID NO: 1340113 - protein, 9 aa, Homo Sapiens
KKIFFKATR

SEQ ID NO: 1340114 - protein, 9 aa, Homo Sapiens
DVCLSANLN

SEQ ID NO: 1340115 - protein, 9 aa, Homo Sapiens
IGMLAYLTE

SEQ ID NO: 1340116 - protein, 9 aa, Homo Sapiens
EFNATLKEE

SEQ ID NO: 1340117 - protein, 9 aa, Homo Sapiens
GHRHSTFVP

SEQ ID NO: 1340118 - protein, 9 aa, Homo Sapiens
GPSSQGSGR

SEQ ID NO: 1340119 - protein, 9 aa, Homo Sapiens
NLCGEESFD

SEQ ID NO: 1340120 - protein, 9 aa, Homo Sapiens
VCGPATFEI

SEQ ID NO: 1340121 - protein, 9 aa, Homo Sapiens
YKGPLDCSE

SEQ ID NO: 1340122 - protein, 9 aa, Homo Sapiens
YIFLSVLWD

SEQ ID NO: 1340123 - protein, 9 aa, Homo Sapiens
TKPEYPCSE

SEQ ID NO: 1340124 - protein, 9 aa, Homo Sapiens
QRVHTKEKP

SEQ ID NO: 1340125 - protein, 9 aa, Homo Sapiens
GTAEWMSFD

SEQ ID NO: 1340126 - protein, 9 aa, Homo Sapiens
FEPGTFDGL

SEQ ID NO: 1340127 - protein, 9 aa, Homo Sapiens
QDAMELAAR

SEQ ID NO: 1340128 - protein, 9 aa, Homo Sapiens
EEDHAQYLT

SEQ ID NO: 1340129 - protein, 9 aa, Homo Sapiens
VSRLETEMR

SEQ ID NO: 1340130 - protein, 9 aa, Homo Sapiens
VLGPRREIE

SEQ ID NO: 1340131 - protein, 9 aa, Homo Sapiens
RGWEPAAHQ

SEQ ID NO: 1340132 - protein, 9 aa, Homo Sapiens
EVKILENAV

SEQ ID NO: 1340133 - protein, 9 aa, Homo Sapiens
FILVDRYMS

SEQ ID NO: 1340134 - protein, 9 aa, Homo Sapiens
DRFKIERRA

SEQ ID NO: 1340135 - protein, 9 aa, Homo Sapiens
SSSRTVHEG

SEQ ID NO: 1340136 - protein, 9 aa, Homo Sapiens
DKAAAEEAS

SEQ ID NO: 1340137 - protein, 9 aa, Homo Sapiens
RNPKDTPFS

SEQ ID NO: 1340138 - protein, 9 aa, Homo Sapiens
KCVHNFTAL

SEQ ID NO: 1340139 - protein, 9 aa, Homo Sapiens
TENDDDVYH

SEQ ID NO: 1340140 - protein, 9 aa, Homo Sapiens
QLRVYGAGL

SEQ ID NO: 1340141 - protein, 9 aa, Homo Sapiens
LLHLNSLAD

SEQ ID NO: 1340142 - protein, 9 aa, Homo Sapiens
PLRKPDIGD

SEQ ID NO: 1340143 - protein, 9 aa, Homo Sapiens
STRGRTRAR

SEQ ID NO: 1340144 - protein, 9 aa, Homo Sapiens
LKRLHRKRP

SEQ ID NO: 1340145 - protein, 9 aa, Homo Sapiens
SSEDLHVFT

SEQ ID NO: 1340146 - protein, 9 aa, Homo Sapiens
GLVKLSRKH

SEQ ID NO: 1340147 - protein, 9 aa, Homo Sapiens
AKYNTATCD

SEQ ID NO: 1340148 - protein, 9 aa, Homo Sapiens
ITQDLGLEL

SEQ ID NO: 1340149 - protein, 9 aa, Homo Sapiens
VKVLRWIIE

SEQ ID NO: 1340150 - protein, 9 aa, Homo Sapiens
DPLYSKHFS

SEQ ID NO: 1340151 - protein, 9 aa, Homo Sapiens
GDTAEMERC

SEQ ID NO: 1340152 - protein, 9 aa, Homo Sapiens
TWNFIESPM

SEQ ID NO: 1340153 - protein, 9 aa, Homo Sapiens
KLMWLYQLS

SEQ ID NO: 1340154 - protein, 9 aa, Homo Sapiens
EAYIIYDED

SEQ ID NO: 1340155 - protein, 9 aa, Homo Sapiens
ELLLKCTVA

SEQ ID NO: 1340156 - protein, 9 aa, Homo Sapiens
SWGVSEAPG

SEQ ID NO: 1340157 - protein, 9 aa, Homo Sapiens
SRFVVPFGG

SEQ ID NO: 1340158 - protein, 9 aa, Homo Sapiens
WRAMGGAVP

SEQ ID NO: 1340159 - protein, 9 aa, Homo Sapiens
NLQKVNTIW

SEQ ID NO: 1340160 - protein, 9 aa, Homo Sapiens
NGFSKTWLL

SEQ ID NO: 1340161 - protein, 9 aa, Homo Sapiens
FLTLELSYA

SEQ ID NO: 1340162 - protein, 9 aa, Homo Sapiens
TICLTVIVV

SEQ ID NO: 1340163 - protein, 9 aa, Homo Sapiens
KQIVPLIKS

SEQ ID NO: 1340164 - protein, 9 aa, Homo Sapiens
ITVGLGVFA

SEQ ID NO: 1340165 - protein, 9 aa, Homo Sapiens
VWLGPDQVP

SEQ ID NO: 1340166 - protein, 9 aa, Homo Sapiens
VRQYVYRVL

SEQ ID NO: 1340167 - protein, 9 aa, Homo Sapiens
NTTVNLIRH

SEQ ID NO: 1340168 - protein, 9 aa, Homo Sapiens
KLQSINNYN

SEQ ID NO: 1340169 - protein, 9 aa, Homo Sapiens
AEDPVRHSS

SEQ ID NO: 1340170 - protein, 9 aa, Homo Sapiens
ALDTRFWMW

SEQ ID NO: 1340171 - protein, 9 aa, Homo Sapiens
YADITKMPA

SEQ ID NO: 1340172 - protein, 9 aa, Homo Sapiens
DIGLTSYKH

SEQ ID NO: 1340173 - protein, 9 aa, Homo Sapiens
GCPPVLTAS

SEQ ID NO: 1340174 - protein, 9 aa, Homo Sapiens
DEGLYTCQT

SEQ ID NO: 1340175 - protein, 9 aa, Homo Sapiens
DQKITSVKS

SEQ ID NO: 1340176 - protein, 9 aa, Homo Sapiens
QRFPTLTVS

SEQ ID NO: 1340177 - protein, 9 aa, Homo Sapiens
AKQKNDVES

SEQ ID NO: 1340178 - protein, 9 aa, Homo Sapiens
QSYAAGFIF

SEQ ID NO: 1340179 - protein, 9 aa, Homo Sapiens
GHISLRLEN

SEQ ID NO: 1340180 - protein, 9 aa, Homo Sapiens
YGFGYGYNS

SEQ ID NO: 1340181 - protein, 9 aa, Homo Sapiens
LLARAVPAF

SEQ ID NO: 1340182 - protein, 9 aa, Homo Sapiens
YIDLMTEWR

SEQ ID NO: 1340183 - protein, 9 aa, Homo Sapiens
HDTLCLTAL

SEQ ID NO: 1340184 - protein, 9 aa, Homo Sapiens
NPDSLHREF

SEQ ID NO: 1340185 - protein, 9 aa, Homo Sapiens
DKPVAYKKE

SEQ ID NO: 1340186 - protein, 9 aa, Homo Sapiens
EYIQSHYNI

SEQ ID NO: 1340187 - protein, 9 aa, Homo Sapiens
KEICIKDEE

SEQ ID NO: 1340188 - protein, 9 aa, Homo Sapiens
VEDMETKIK

SEQ ID NO: 1340189 - protein, 9 aa, Homo Sapiens
EAYPMPTKD

SEQ ID NO: 1340190 - protein, 9 aa, Homo Sapiens
LCPLDHESY

SEQ ID NO: 1340191 - protein, 9 aa, Homo Sapiens
GANRQAINV

SEQ ID NO: 1340192 - protein, 9 aa, Homo Sapiens
GFRHVSHSQ

SEQ ID NO: 1340193 - protein, 9 aa, Homo Sapiens
TSASTLDQP

SEQ ID NO: 1340194 - protein, 9 aa, Homo Sapiens
QEVFVHRCL

SEQ ID NO: 1340195 - protein, 9 aa, Homo Sapiens
DLMTEWRFS

SEQ ID NO: 1340196 - protein, 9 aa, Homo Sapiens
KEWRVLLVM

SEQ ID NO: 1340197 - protein, 9 aa, Homo Sapiens
SSSPSTLSI

SEQ ID NO: 1340198 - protein, 9 aa, Homo Sapiens
HIISIGGAK

SEQ ID NO: 1340199 - protein, 9 aa, Homo Sapiens
LSFAYMEGE

SEQ ID NO: 1340200 - protein, 9 aa, Homo Sapiens
HDPEADVWS

SEQ ID NO: 1340201 - protein, 9 aa, Homo Sapiens
TGSAHTLTA

SEQ ID NO: 1340202 - protein, 9 aa, Homo Sapiens
DKYMQMNHT

SEQ ID NO: 1340203 - protein, 9 aa, Homo Sapiens
FINGEMQFY

SEQ ID NO: 1340204 - protein, 9 aa, Homo Sapiens
MCECSLYRA

SEQ ID NO: 1340205 - protein, 9 aa, Homo Sapiens
SHMHKNGDK

SEQ ID NO: 1340206 - protein, 9 aa, Homo Sapiens
KEVRGEWRQ

SEQ ID NO: 1340207 - protein, 9 aa, Homo Sapiens
VPKYHPLGS

SEQ ID NO: 1340208 - protein, 9 aa, Homo Sapiens
QALHLNRSL

SEQ ID NO: 1340209 - protein, 9 aa, Homo Sapiens
TMVEPYNAT

SEQ ID NO: 1340210 - protein, 9 aa, Homo Sapiens
SLSSCGWAP

SEQ ID NO: 1340211 - protein, 9 aa, Homo Sapiens
DRDTKIFYN

SEQ ID NO: 1340212 - protein, 9 aa, Homo Sapiens
TIEIGNSLP

SEQ ID NO: 1340213 - protein, 9 aa, Homo Sapiens
RLAQHFGPV

SEQ ID NO: 1340214 - protein, 9 aa, Homo Sapiens
MEEKRRRTR

SEQ ID NO: 1340215 - protein, 9 aa, Homo Sapiens
QIILNSLLL

SEQ ID NO: 1340216 - protein, 9 aa, Homo Sapiens
SEITDEIKV

SEQ ID NO: 1340217 - protein, 9 aa, Homo Sapiens
TRALPLNDL

SEQ ID NO: 1340218 - protein, 9 aa, Homo Sapiens
DLKGVHLGE

SEQ ID NO: 1340219 - protein, 9 aa, Homo Sapiens
NLDPSASEI

SEQ ID NO: 1340220 - protein, 9 aa, Homo Sapiens
TIAEGFVKT

SEQ ID NO: 1340221 - protein, 9 aa, Homo Sapiens
AACDLRRGH

SEQ ID NO: 1340222 - protein, 9 aa, Homo Sapiens
NHYDCVVLF

SEQ ID NO: 1340223 - protein, 9 aa, Homo Sapiens
LHFCTPGPP

SEQ ID NO: 1340224 - protein, 9 aa, Homo Sapiens
FGQASMIPQ

SEQ ID NO: 1340225 - protein, 9 aa, Homo Sapiens
ENPEKSISV

SEQ ID NO: 1340226 - protein, 9 aa, Homo Sapiens
TDEHDTILG

SEQ ID NO: 1340227 - protein, 9 aa, Homo Sapiens
SLGIYLPDL

SEQ ID NO: 1340228 - protein, 9 aa, Homo Sapiens
QVLLIKRRR

SEQ ID NO: 1340229 - protein, 9 aa, Homo Sapiens
GKKKSPKSV

SEQ ID NO: 1340230 - protein, 9 aa, Homo Sapiens
PTGFPCSRL

SEQ ID NO: 1340231 - protein, 9 aa, Homo Sapiens
HGQKHQRRG

SEQ ID NO: 1340232 - protein, 9 aa, Homo Sapiens
ELKKAMIMY

SEQ ID NO: 1340233 - protein, 9 aa, Homo Sapiens
KRRWGRKEE

SEQ ID NO: 1340234 - protein, 9 aa, Homo Sapiens
PDQERVLLA

SEQ ID NO: 1340235 - protein, 9 aa, Homo Sapiens
LYKLKELWL

SEQ ID NO: 1340236 - protein, 9 aa, Homo Sapiens
KLCHINSLW

SEQ ID NO: 1340237 - protein, 9 aa, Homo Sapiens
KKYQYIHQK

SEQ ID NO: 1340238 - protein, 9 aa, Homo Sapiens
ERKNLEKVH

SEQ ID NO: 1340239 - protein, 9 aa, Homo Sapiens
VHLFHFYRV

SEQ ID NO: 1340240 - protein, 9 aa, Homo Sapiens
ISEDTLVGD

SEQ ID NO: 1340241 - protein, 9 aa, Homo Sapiens
AVPGLWVVV

SEQ ID NO: 1340242 - protein, 9 aa, Homo Sapiens
FLLIIIIVF

SEQ ID NO: 1340243 - protein, 9 aa, Homo Sapiens
INTLFFFVF

SEQ ID NO: 1340244 - protein, 9 aa, Homo Sapiens
TLGNCGPYC

SEQ ID NO: 1340245 - protein, 9 aa, Homo Sapiens
KVQTCHVTW

SEQ ID NO: 1340246 - protein, 9 aa, Homo Sapiens
KIISYICSQ

SEQ ID NO: 1340247 - protein, 9 aa, Homo Sapiens
DEINVKYFL

SEQ ID NO: 1340248 - protein, 9 aa, Homo Sapiens
PPIHESLNI

SEQ ID NO: 1340249 - protein, 9 aa, Homo Sapiens
GAQSWQQMS

SEQ ID NO: 1340250 - protein, 9 aa, Homo Sapiens
MRDVKIYQI

SEQ ID NO: 1340251 - protein, 9 aa, Homo Sapiens
VVVQVMLNN

SEQ ID NO: 1340252 - protein, 9 aa, Homo Sapiens
IMALDIDEC

SEQ ID NO: 1340253 - protein, 9 aa, Homo Sapiens
HLYSCLDHM

SEQ ID NO: 1340254 - protein, 9 aa, Homo Sapiens
DILDKYRNV

SEQ ID NO: 1340255 - protein, 9 aa, Homo Sapiens
MGINFCDSA

SEQ ID NO: 1340256 - protein, 9 aa, Homo Sapiens
LRNITFKNM

SEQ ID NO: 1340257 - protein, 9 aa, Homo Sapiens
EKPCTLLFF

SEQ ID NO: 1340258 - protein, 9 aa, Homo Sapiens
NAPELHVPL

SEQ ID NO: 1340259 - protein, 9 aa, Homo Sapiens
NAFLWPCGP

SEQ ID NO: 1340260 - protein, 9 aa, Homo Sapiens
GLLCHLDDT

SEQ ID NO: 1340261 - protein, 9 aa, Homo Sapiens
KPGHVLRVK

SEQ ID NO: 1340262 - protein, 9 aa, Homo Sapiens
VYIMSTTGW

SEQ ID NO: 1340263 - protein, 9 aa, Homo Sapiens
EKTRMHLEA

SEQ ID NO: 1340264 - protein, 9 aa, Homo Sapiens
SPNFPEELE

SEQ ID NO: 1340265 - protein, 9 aa, Homo Sapiens
LSEVGAYLV

SEQ ID NO: 1340266 - protein, 9 aa, Homo Sapiens
PDPNIKYVF

SEQ ID NO: 1340267 - protein, 9 aa, Homo Sapiens
RTGGRRGMR

SEQ ID NO: 1340268 - protein, 9 aa, Homo Sapiens
CRGFLCNQA

SEQ ID NO: 1340269 - protein, 9 aa, Homo Sapiens
SGGGGPRGL

SEQ ID NO: 1340270 - protein, 9 aa, Homo Sapiens
SQDMPMRSK

SEQ ID NO: 1340271 - protein, 9 aa, Homo Sapiens
HLCPQQHVL

SEQ ID NO: 1340272 - protein, 9 aa, Homo Sapiens
KWLDSDVRN

SEQ ID NO: 1340273 - protein, 9 aa, Homo Sapiens
CRIRKCIRN

SEQ ID NO: 1340274 - protein, 9 aa, Homo Sapiens
SLYEQSCES

SEQ ID NO: 1340275 - protein, 9 aa, Homo Sapiens
NCSLLLCWG

SEQ ID NO: 1340276 - protein, 9 aa, Homo Sapiens
PLFLLFFSS

SEQ ID NO: 1340277 - protein, 9 aa, Homo Sapiens
VPHNRIGVG

SEQ ID NO: 1340278 - protein, 9 aa, Homo Sapiens
TYIRKVGGQ

SEQ ID NO: 1340279 - protein, 9 aa, Homo Sapiens
QEETQGLPS

SEQ ID NO: 1340280 - protein, 9 aa, Homo Sapiens
IIPGELTDA

SEQ ID NO: 1340281 - protein, 9 aa, Homo Sapiens
LKMMWRINP

SEQ ID NO: 1340282 - protein, 9 aa, Homo Sapiens
REKQVFTEA

SEQ ID NO: 1340283 - protein, 9 aa, Homo Sapiens
IASTPLEVS

SEQ ID NO: 1340284 - protein, 9 aa, Homo Sapiens
QLDPAGLHT

SEQ ID NO: 1340285 - protein, 9 aa, Homo Sapiens
KGEADQSAG

SEQ ID NO: 1340286 - protein, 9 aa, Homo Sapiens
KYTRGRDQI

SEQ ID NO: 1340287 - protein, 9 aa, Homo Sapiens
MTDTICIST

SEQ ID NO: 1340288 - protein, 9 aa, Homo Sapiens
PARRPSAAA

SEQ ID NO: 1340289 - protein, 9 aa, Homo Sapiens
ELSQLRDPH

SEQ ID NO: 1340290 - protein, 9 aa, Homo Sapiens
DLRECFAYP

SEQ ID NO: 1340291 - protein, 9 aa, Homo Sapiens
PHAIMHLDL

SEQ ID NO: 1340292 - protein, 9 aa, Homo Sapiens
DSESDTNSD

SEQ ID NO: 1340293 - protein, 9 aa, Homo Sapiens
TSHQDASLC

SEQ ID NO: 1340294 - protein, 9 aa, Homo Sapiens
CGVINQLAF

SEQ ID NO: 1340295 - protein, 9 aa, Homo Sapiens
DYIFDLCLG

SEQ ID NO: 1340296 - protein, 9 aa, Homo Sapiens
HTLTAVCNH

SEQ ID NO: 1340297 - protein, 9 aa, Homo Sapiens
GQAFELCFK

SEQ ID NO: 1340298 - protein, 9 aa, Homo Sapiens
HYLNELKWS

SEQ ID NO: 1340299 - protein, 9 aa, Homo Sapiens
DNSCPQFIQ

SEQ ID NO: 1340300 - protein, 9 aa, Homo Sapiens
MVGGSVPIF

SEQ ID NO: 1340301 - protein, 9 aa, Homo Sapiens
LGQVVCSIA

SEQ ID NO: 1340302 - protein, 9 aa, Homo Sapiens
LLKPVKHIQ

SEQ ID NO: 1340303 - protein, 9 aa, Homo Sapiens
NLEKVHAEE

SEQ ID NO: 1340304 - protein, 9 aa, Homo Sapiens
RSVRYILKD

SEQ ID NO: 1340305 - protein, 9 aa, Homo Sapiens
AGVKTQKKE

SEQ ID NO: 1340306 - protein, 9 aa, Homo Sapiens
PPKAKATMN

SEQ ID NO: 1340307 - protein, 9 aa, Homo Sapiens
KNKELTLEN

SEQ ID NO: 1340308 - protein, 9 aa, Homo Sapiens
MNIKEDTDF

SEQ ID NO: 1340309 - protein, 9 aa, Homo Sapiens
GKAADMWSL

SEQ ID NO: 1340310 - protein, 9 aa, Homo Sapiens
HATQLLVLE

SEQ ID NO: 1340311 - protein, 9 aa, Homo Sapiens
DGTMLSTHT

SEQ ID NO: 1340312 - protein, 9 aa, Homo Sapiens
ILLGISGLE

SEQ ID NO: 1340313 - protein, 9 aa, Homo Sapiens
CLLFLEEII

SEQ ID NO: 1340314 - protein, 9 aa, Homo Sapiens
FEPFATGDL

SEQ ID NO: 1340315 - protein, 9 aa, Homo Sapiens
NYMLYPITF

SEQ ID NO: 1340316 - protein, 9 aa, Homo Sapiens
NYSIAQKCA

SEQ ID NO: 1340317 - protein, 9 aa, Homo Sapiens
VEDRMSLSH

SEQ ID NO: 1340318 - protein, 9 aa, Homo Sapiens
ALDDHLSRY

SEQ ID NO: 1340319 - protein, 9 aa, Homo Sapiens
LMEQLWLLV

SEQ ID NO: 1340320 - protein, 9 aa, Homo Sapiens
EKAWRKQSC

SEQ ID NO: 1340321 - protein, 9 aa, Homo Sapiens
EFFLLDVMS

SEQ ID NO: 1340322 - protein, 9 aa, Homo Sapiens
LMWLLWLFH

SEQ ID NO: 1340323 - protein, 9 aa, Homo Sapiens
ASVSREDFV

SEQ ID NO: 1340324 - protein, 9 aa, Homo Sapiens
TPSLFLCIS

SEQ ID NO: 1340325 - protein, 9 aa, Homo Sapiens
AVTDVIIKK

SEQ ID NO: 1340326 - protein, 9 aa, Homo Sapiens
FQAAHTLAH

SEQ ID NO: 1340327 - protein, 9 aa, Homo Sapiens
VFYNDPSVL

SEQ ID NO: 1340328 - protein, 9 aa, Homo Sapiens
KDDTAIVGA

SEQ ID NO: 1340329 - protein, 9 aa, Homo Sapiens
SISKVCSSV

SEQ ID NO: 1340330 - protein, 9 aa, Homo Sapiens
QDDGIKLLY

SEQ ID NO: 1340331 - protein, 9 aa, Homo Sapiens
TAALFLATN

SEQ ID NO: 1340332 - protein, 9 aa, Homo Sapiens
TAAWVLPFA

SEQ ID NO: 1340333 - protein, 9 aa, Homo Sapiens
RQFIKGSSN

SEQ ID NO: 1340334 - protein, 9 aa, Homo Sapiens
TYTPRECFQ

SEQ ID NO: 1340335 - protein, 9 aa, Homo Sapiens
LFNSPLKLL

SEQ ID NO: 1340336 - protein, 9 aa, Homo Sapiens
GINSVRFFA

SEQ ID NO: 1340337 - protein, 9 aa, Homo Sapiens
SLHSAHNRN

SEQ ID NO: 1340338 - protein, 9 aa, Homo Sapiens
MVTFSIKMF

SEQ ID NO: 1340339 - protein, 9 aa, Homo Sapiens
RKLMWLYQL

SEQ ID NO: 1340340 - protein, 9 aa, Homo Sapiens
HTTTPVEHP

SEQ ID NO: 1340341 - protein, 9 aa, Homo Sapiens
SSDLEGTEQ

SEQ ID NO: 1340342 - protein, 9 aa, Homo Sapiens
CHHCLELAK

SEQ ID NO: 1340343 - protein, 9 aa, Homo Sapiens
IHNIPFPSP

SEQ ID NO: 1340344 - protein, 9 aa, Homo Sapiens
LIFQVAPLS

SEQ ID NO: 1340345 - protein, 9 aa, Homo Sapiens
CRKQLSGQC

SEQ ID NO: 1340346 - protein, 9 aa, Homo Sapiens
GIIHHTWPW

SEQ ID NO: 1340347 - protein, 9 aa, Homo Sapiens
HAVKNTVGM

SEQ ID NO: 1340348 - protein, 9 aa, Homo Sapiens
IKHMKFWCK

SEQ ID NO: 1340349 - protein, 9 aa, Homo Sapiens
WDMAGQERF

SEQ ID NO: 1340350 - protein, 9 aa, Homo Sapiens
TSKGCTFVK

SEQ ID NO: 1340351 - protein, 9 aa, Homo Sapiens
NDILLVSPS

SEQ ID NO: 1340352 - protein, 9 aa, Homo Sapiens
FILLGISGL

SEQ ID NO: 1340353 - protein, 9 aa, Homo Sapiens
LRFLWFTHL

SEQ ID NO: 1340354 - protein, 9 aa, Homo Sapiens
LLTRTIGDR

SEQ ID NO: 1340355 - protein, 9 aa, Homo Sapiens
IMEAVAFQS

SEQ ID NO: 1340356 - protein, 9 aa, Homo Sapiens
EAVHMTHLL

SEQ ID NO: 1340357 - protein, 9 aa, Homo Sapiens
GKKIIEYYL

SEQ ID NO: 1340358 - protein, 9 aa, Homo Sapiens
YRRNLDIER

SEQ ID NO: 1340359 - protein, 9 aa, Homo Sapiens
LLEERFRVV

SEQ ID NO: 1340360 - protein, 9 aa, Homo Sapiens
MEQCLAQLF

SEQ ID NO: 1340361 - protein, 9 aa, Homo Sapiens
GHSNCCHFC

SEQ ID NO: 1340362 - protein, 9 aa, Homo Sapiens
TKDERIYVT

SEQ ID NO: 1340363 - protein, 9 aa, Homo Sapiens
PPSCRAFRC

SEQ ID NO: 1340364 - protein, 9 aa, Homo Sapiens
TLENTNRTL

SEQ ID NO: 1340365 - protein, 9 aa, Homo Sapiens
GKSNFEEYF

SEQ ID NO: 1340366 - protein, 9 aa, Homo Sapiens
ADHVISVIP

SEQ ID NO: 1340367 - protein, 9 aa, Homo Sapiens
SGRINVSDL

SEQ ID NO: 1340368 - protein, 9 aa, Homo Sapiens
VASVLATSI

SEQ ID NO: 1340369 - protein, 9 aa, Homo Sapiens
DQEMLLMYQ

SEQ ID NO: 1340370 - protein, 9 aa, Homo Sapiens
WFDVCLSAN

SEQ ID NO: 1340371 - protein, 9 aa, Homo Sapiens
STVEVRVPY

SEQ ID NO: 1340372 - protein, 9 aa, Homo Sapiens
EERWAEFYH

SEQ ID NO: 1340373 - protein, 9 aa, Homo Sapiens
EGEEGTYLA

SEQ ID NO: 1340374 - protein, 9 aa, Homo Sapiens
GYCQVQAPV

SEQ ID NO: 1340375 - protein, 9 aa, Homo Sapiens
AKSPWMMVI

SEQ ID NO: 1340376 - protein, 9 aa, Homo Sapiens
GKYEKNDNG

SEQ ID NO: 1340377 - protein, 9 aa, Homo Sapiens
QVSATSEEC

SEQ ID NO: 1340378 - protein, 9 aa, Homo Sapiens
LIVGLTIAC

SEQ ID NO: 1340379 - protein, 9 aa, Homo Sapiens
VWWEISVCG

SEQ ID NO: 1340380 - protein, 9 aa, Homo Sapiens
SPEHPVEEV

SEQ ID NO: 1340381 - protein, 9 aa, Homo Sapiens
HENRNKKTK

SEQ ID NO: 1340382 - protein, 9 aa, Homo Sapiens
HIIVLGLVR

SEQ ID NO: 1340383 - protein, 9 aa, Homo Sapiens
YTHMQTVRG

SEQ ID NO: 1340384 - protein, 9 aa, Homo Sapiens
FVRENNSPT

SEQ ID NO: 1340385 - protein, 9 aa, Homo Sapiens
VEVTVCSIT

SEQ ID NO: 1340386 - protein, 9 aa, Homo Sapiens
GDTSLHIFK

SEQ ID NO: 1340387 - protein, 9 aa, Homo Sapiens
LGPVDKYRM

SEQ ID NO: 1340388 - protein, 9 aa, Homo Sapiens
DQSTLQHYY

SEQ ID NO: 1340389 - protein, 9 aa, Homo Sapiens
RCQCCPTDG

SEQ ID NO: 1340390 - protein, 9 aa, Homo Sapiens
SVMPKRGLD

SEQ ID NO: 1340391 - protein, 9 aa, Homo Sapiens
VSLGEGCPP

SEQ ID NO: 1340392 - protein, 9 aa, Homo Sapiens
TSLRSLHFL

SEQ ID NO: 1340393 - protein, 9 aa, Homo Sapiens
EIEQYLCTP

SEQ ID NO: 1340394 - protein, 9 aa, Homo Sapiens
GITSCVFTR

SEQ ID NO: 1340395 - protein, 9 aa, Homo Sapiens
NHPVSFVKL

SEQ ID NO: 1340396 - protein, 9 aa, Homo Sapiens
CQAGEVTYA

SEQ ID NO: 1340397 - protein, 9 aa, Homo Sapiens
RVSSAVKVE

SEQ ID NO: 1340398 - protein, 9 aa, Homo Sapiens
VMEPPSTVG

SEQ ID NO: 1340399 - protein, 9 aa, Homo Sapiens
CKVCDEAFT

SEQ ID NO: 1340400 - protein, 9 aa, Homo Sapiens
HFWMPISPS

SEQ ID NO: 1340401 - protein, 9 aa, Homo Sapiens
ATMYEMYFV

SEQ ID NO: 1340402 - protein, 9 aa, Homo Sapiens
KLSTAECEQ

SEQ ID NO: 1340403 - protein, 9 aa, Homo Sapiens
DELHLAVAW

SEQ ID NO: 1340404 - protein, 9 aa, Homo Sapiens
ILVLWTTLT

SEQ ID NO: 1340405 - protein, 9 aa, Homo Sapiens
LSWVALGPH

SEQ ID NO: 1340406 - protein, 9 aa, Homo Sapiens
MAVDLHRLH

SEQ ID NO: 1340407 - protein, 9 aa, Homo Sapiens
SMEEPQMVL

SEQ ID NO: 1340408 - protein, 9 aa, Homo Sapiens
ALIDKLLPK

SEQ ID NO: 1340409 - protein, 9 aa, Homo Sapiens
ELPIASRIH

SEQ ID NO: 1340410 - protein, 9 aa, Homo Sapiens
ALDVAVQVV

SEQ ID NO: 1340411 - protein, 9 aa, Homo Sapiens
MVFLSRTSP

SEQ ID NO: 1340412 - protein, 9 aa, Homo Sapiens
MDRVLMERN

SEQ ID NO: 1340413 - protein, 9 aa, Homo Sapiens
SNEQKVLVN

SEQ ID NO: 1340414 - protein, 9 aa, Homo Sapiens
LWAKAMRLL

SEQ ID NO: 1340415 - protein, 9 aa, Homo Sapiens
TSQSLYTGL

SEQ ID NO: 1340416 - protein, 9 aa, Homo Sapiens
ECLAKLQDP

SEQ ID NO: 1340417 - protein, 9 aa, Homo Sapiens
GDPFHSIEC

SEQ ID NO: 1340418 - protein, 9 aa, Homo Sapiens
GTIACLQFS

SEQ ID NO: 1340419 - protein, 9 aa, Homo Sapiens
VMYITSNPM

SEQ ID NO: 1340420 - protein, 9 aa, Homo Sapiens
ALVAQAKAK

SEQ ID NO: 1340421 - protein, 9 aa, Homo Sapiens
REIKLHLLG

SEQ ID NO: 1340422 - protein, 9 aa, Homo Sapiens
VARHLRDLL

SEQ ID NO: 1340423 - protein, 9 aa, Homo Sapiens
LSCNTEAYI

SEQ ID NO: 1340424 - protein, 9 aa, Homo Sapiens
DREKLCNFI

SEQ ID NO: 1340425 - protein, 9 aa, Homo Sapiens
KRVQGMPVA

SEQ ID NO: 1340426 - protein, 9 aa, Homo Sapiens
EAVIVAREF

SEQ ID NO: 1340427 - protein, 9 aa, Homo Sapiens
KCRQIYGQN

SEQ ID NO: 1340428 - protein, 9 aa, Homo Sapiens
GERMEDAPS

SEQ ID NO: 1340429 - protein, 9 aa, Homo Sapiens
IQANTPASL

SEQ ID NO: 1340430 - protein, 9 aa, Homo Sapiens
CCLVREYGS

SEQ ID NO: 1340431 - protein, 9 aa, Homo Sapiens
LDKLDVVCS

SEQ ID NO: 1340432 - protein, 9 aa, Homo Sapiens
AGGAPIQGL

SEQ ID NO: 1340433 - protein, 9 aa, Homo Sapiens
LFLRRLHLW

SEQ ID NO: 1340434 - protein, 9 aa, Homo Sapiens
LRINSAKGW

SEQ ID NO: 1340435 - protein, 9 aa, Homo Sapiens
QTGSGQHSQ

SEQ ID NO: 1340436 - protein, 9 aa, Homo Sapiens
LQATTEANN

SEQ ID NO: 1340437 - protein, 9 aa, Homo Sapiens
HIQEEEAEG

SEQ ID NO: 1340438 - protein, 9 aa, Homo Sapiens
CLSGAQVST

SEQ ID NO: 1340439 - protein, 9 aa, Homo Sapiens
YSGQNSSSG

SEQ ID NO: 1340440 - protein, 9 aa, Homo Sapiens
FRDLQLACV

SEQ ID NO: 1340441 - protein, 9 aa, Homo Sapiens
LLQLDIKTS

SEQ ID NO: 1340442 - protein, 9 aa, Homo Sapiens
EIISDNCVV

SEQ ID NO: 1340443 - protein, 9 aa, Homo Sapiens
NTKVFVWPI

SEQ ID NO: 1340444 - protein, 9 aa, Homo Sapiens
DYGPSIDLW

SEQ ID NO: 1340445 - protein, 9 aa, Homo Sapiens
KIQIPVSFQ

SEQ ID NO: 1340446 - protein, 9 aa, Homo Sapiens
KKSPASTFT

SEQ ID NO: 1340447 - protein, 9 aa, Homo Sapiens
GSHFVAVDG

SEQ ID NO: 1340448 - protein, 9 aa, Homo Sapiens
IADNFKVFD

SEQ ID NO: 1340449 - protein, 9 aa, Homo Sapiens
VDLWYNLAI

SEQ ID NO: 1340450 - protein, 9 aa, Homo Sapiens
MKNQIRKLK

SEQ ID NO: 1340451 - protein, 9 aa, Homo Sapiens
LNTIVQIDL

SEQ ID NO: 1340452 - protein, 9 aa, Homo Sapiens
TRKVGVPKG

SEQ ID NO: 1340453 - protein, 9 aa, Homo Sapiens
PVSEPNTHN

SEQ ID NO: 1340454 - protein, 9 aa, Homo Sapiens
GHALSCRTR

SEQ ID NO: 1340455 - protein, 9 aa, Homo Sapiens
VDISLENPD

SEQ ID NO: 1340456 - protein, 9 aa, Homo Sapiens
SLQKIMMDL

SEQ ID NO: 1340457 - protein, 9 aa, Homo Sapiens
AVRLYRRSR

SEQ ID NO: 1340458 - protein, 9 aa, Homo Sapiens
PEKICHKSL

SEQ ID NO: 1340459 - protein, 9 aa, Homo Sapiens
DAPKKQVLY

SEQ ID NO: 1340460 - protein, 9 aa, Homo Sapiens
AVMSLIQVL

SEQ ID NO: 1340461 - protein, 9 aa, Homo Sapiens
MFHLFDHVT

SEQ ID NO: 1340462 - protein, 9 aa, Homo Sapiens
LFQKRQCRV

SEQ ID NO: 1340463 - protein, 9 aa, Homo Sapiens
IKTHDPKAE

SEQ ID NO: 1340464 - protein, 9 aa, Homo Sapiens
KENAKQLKD

SEQ ID NO: 1340465 - protein, 9 aa, Homo Sapiens
KHILHKTKG

SEQ ID NO: 1340466 - protein, 9 aa, Homo Sapiens
HWHSNVSAN

SEQ ID NO: 1340467 - protein, 9 aa, Homo Sapiens
SCIRGKKQS

SEQ ID NO: 1340468 - protein, 9 aa, Homo Sapiens
FLWYPLTDY

SEQ ID NO: 1340469 - protein, 9 aa, Homo Sapiens
PQAVEWHVL

SEQ ID NO: 1340470 - protein, 9 aa, Homo Sapiens
LQNMEMKSV

SEQ ID NO: 1340471 - protein, 9 aa, Homo Sapiens
GEGSSEATE

SEQ ID NO: 1340472 - protein, 9 aa, Homo Sapiens
RFRSITRTY

SEQ ID NO: 1340473 - protein, 9 aa, Homo Sapiens
YLIVWENSS

SEQ ID NO: 1340474 - protein, 9 aa, Homo Sapiens
GVHLGERAQ

SEQ ID NO: 1340475 - protein, 9 aa, Homo Sapiens
HIGTGCLVT

SEQ ID NO: 1340476 - protein, 9 aa, Homo Sapiens
MTLPSPPTP

SEQ ID NO: 1340477 - protein, 9 aa, Homo Sapiens
KLQKEMTDI

SEQ ID NO: 1340478 - protein, 9 aa, Homo Sapiens
LQIFCSEDE

SEQ ID NO: 1340479 - protein, 9 aa, Homo Sapiens
RIPRGRHIS

SEQ ID NO: 1340480 - protein, 9 aa, Homo Sapiens
VTTDFPSEN

SEQ ID NO: 1340481 - protein, 9 aa, Homo Sapiens
GKVTGETVY

SEQ ID NO: 1340482 - protein, 9 aa, Homo Sapiens
QGHTIIFCE

SEQ ID NO: 1340483 - protein, 9 aa, Homo Sapiens
FEPHMRPRH

SEQ ID NO: 1340484 - protein, 9 aa, Homo Sapiens
STAARSPSS

SEQ ID NO: 1340485 - protein, 9 aa, Homo Sapiens
TTFSSTIFP

SEQ ID NO: 1340486 - protein, 9 aa, Homo Sapiens
PGPYSSVPR

SEQ ID NO: 1340487 - protein, 9 aa, Homo Sapiens
RARKECEKE

SEQ ID NO: 1340488 - protein, 9 aa, Homo Sapiens
YMMPEQRRS

SEQ ID NO: 1340489 - protein, 9 aa, Homo Sapiens
HSMWEEDFI

SEQ ID NO: 1340490 - protein, 9 aa, Homo Sapiens
GLLDYIDRL

SEQ ID NO: 1340491 - protein, 9 aa, Homo Sapiens
VEWAAKAAV

SEQ ID NO: 1340492 - protein, 9 aa, Homo Sapiens
NLDTKVEYM

SEQ ID NO: 1340493 - protein, 9 aa, Homo Sapiens
PHGQLEKSP

SEQ ID NO: 1340494 - protein, 9 aa, Homo Sapiens
GFKKAGVKT

SEQ ID NO: 1340495 - protein, 9 aa, Homo Sapiens
RTDAPQVDV

SEQ ID NO: 1340496 - protein, 9 aa, Homo Sapiens
HNPCAEEDM

SEQ ID NO: 1340497 - protein, 9 aa, Homo Sapiens
QYLVQTLSC

SEQ ID NO: 1340498 - protein, 9 aa, Homo Sapiens
CQFSSGLNK

SEQ ID NO: 1340499 - protein, 9 aa, Homo Sapiens
PRLPVRPWV

SEQ ID NO: 1340500 - protein, 9 aa, Homo Sapiens
YNQFMGGID

SEQ ID NO: 1340501 - protein, 9 aa, Homo Sapiens
QLPSHITPT

SEQ ID NO: 1340502 - protein, 9 aa, Homo Sapiens
RFILFFPSA

SEQ ID NO: 1340503 - protein, 9 aa, Homo Sapiens
MLCDEEPSQ

SEQ ID NO: 1340504 - protein, 9 aa, Homo Sapiens
LGGCTSIVR

SEQ ID NO: 1340505 - protein, 9 aa, Homo Sapiens
RLLLIFHSL

SEQ ID NO: 1340506 - protein, 9 aa, Homo Sapiens
GGHLGVFCF

SEQ ID NO: 1340507 - protein, 9 aa, Homo Sapiens
EQTDFTYDS

SEQ ID NO: 1340508 - protein, 9 aa, Homo Sapiens
VFNLSNTIM

SEQ ID NO: 1340509 - protein, 9 aa, Homo Sapiens
YRGKTQEEI

SEQ ID NO: 1340510 - protein, 9 aa, Homo Sapiens
LHNRSTEDL

SEQ ID NO: 1340511 - protein, 9 aa, Homo Sapiens
NVAYLSNTD

SEQ ID NO: 1340512 - protein, 9 aa, Homo Sapiens
GHHMAVLHG

SEQ ID NO: 1340513 - protein, 9 aa, Homo Sapiens
ASSSGQQGC

SEQ ID NO: 1340514 - protein, 9 aa, Homo Sapiens
LGAFFTGDL

SEQ ID NO: 1340515 - protein, 9 aa, Homo Sapiens
TLCLPPGFP

SEQ ID NO: 1340516 - protein, 9 aa, Homo Sapiens
NRFGKKEFS

SEQ ID NO: 1340517 - protein, 9 aa, Homo Sapiens
LNIAGNNHL

SEQ ID NO: 1340518 - protein, 9 aa, Homo Sapiens
PEKNWNLLF

SEQ ID NO: 1340519 - protein, 9 aa, Homo Sapiens
MNNLMDEDI

SEQ ID NO: 1340520 - protein, 9 aa, Homo Sapiens
YHQMALLTD

SEQ ID NO: 1340521 - protein, 9 aa, Homo Sapiens
TGKIFEKIY

SEQ ID NO: 1340522 - protein, 9 aa, Homo Sapiens
SDSTDAATA

SEQ ID NO: 1340523 - protein, 9 aa, Homo Sapiens
ENIEKTRMH

SEQ ID NO: 1340524 - protein, 9 aa, Homo Sapiens
PTGLEGGPR

SEQ ID NO: 1340525 - protein, 9 aa, Homo Sapiens
QQQKICQNR

SEQ ID NO: 1340526 - protein, 9 aa, Homo Sapiens
LPTGLQAQQ

SEQ ID NO: 1340527 - protein, 9 aa, Homo Sapiens
EGFLAFPSP

SEQ ID NO: 1340528 - protein, 9 aa, Homo Sapiens
SGGRRRRSS

SEQ ID NO: 1340529 - protein, 9 aa, Homo Sapiens
RHYNVLSKN

SEQ ID NO: 1340530 - protein, 9 aa, Homo Sapiens
RILHQPEMA

SEQ ID NO: 1340531 - protein, 9 aa, Homo Sapiens
PVMSGGIFA

SEQ ID NO: 1340532 - protein, 9 aa, Homo Sapiens
YNDLKKKRI

SEQ ID NO: 1340533 - protein, 9 aa, Homo Sapiens
HITIPLVIL

SEQ ID NO: 1340534 - protein, 9 aa, Homo Sapiens
RDTIFDVSV

SEQ ID NO: 1340535 - protein, 9 aa, Homo Sapiens
ARPSDWAPR

SEQ ID NO: 1340536 - protein, 9 aa, Homo Sapiens
QNPNLNANQ

SEQ ID NO: 1340537 - protein, 9 aa, Homo Sapiens
DSKTYADAR

SEQ ID NO: 1340538 - protein, 9 aa, Homo Sapiens
VISFLCGVI

SEQ ID NO: 1340539 - protein, 9 aa, Homo Sapiens
VQVTNTHVL

SEQ ID NO: 1340540 - protein, 9 aa, Homo Sapiens
AEGFISCMQ

SEQ ID NO: 1340541 - protein, 9 aa, Homo Sapiens
SSTSASTLD

SEQ ID NO: 1340542 - protein, 9 aa, Homo Sapiens
PSSCTSAST

SEQ ID NO: 1340543 - protein, 9 aa, Homo Sapiens
PPHDSAGYH

SEQ ID NO: 1340544 - protein, 9 aa, Homo Sapiens
PVSKAKQRW

SEQ ID NO: 1340545 - protein, 9 aa, Homo Sapiens
TILCLLFRF

SEQ ID NO: 1340546 - protein, 9 aa, Homo Sapiens
RGHQLYQPK

SEQ ID NO: 1340547 - protein, 9 aa, Homo Sapiens
RAGTKWSSR

SEQ ID NO: 1340548 - protein, 9 aa, Homo Sapiens
AELQGFTVD

SEQ ID NO: 1340549 - protein, 9 aa, Homo Sapiens
MEWQRYLRQ

SEQ ID NO: 1340550 - protein, 9 aa, Homo Sapiens
HFLVFNSKT

SEQ ID NO: 1340551 - protein, 9 aa, Homo Sapiens
TGCIADLLL

SEQ ID NO: 1340552 - protein, 9 aa, Homo Sapiens
QSAFYGQDC

SEQ ID NO: 1340553 - protein, 9 aa, Homo Sapiens
ATCSSYSGE

SEQ ID NO: 1340554 - protein, 9 aa, Homo Sapiens
FFTLTVASL

SEQ ID NO: 1340555 - protein, 9 aa, Homo Sapiens
KVIEKKTRH

SEQ ID NO: 1340556 - protein, 9 aa, Homo Sapiens
AALVAQAKA

SEQ ID NO: 1340557 - protein, 9 aa, Homo Sapiens
IQPKTCQIR

SEQ ID NO: 1340558 - protein, 9 aa, Homo Sapiens
LCYTPLIQV

SEQ ID NO: 1340559 - protein, 9 aa, Homo Sapiens
TGGAHIPFR

SEQ ID NO: 1340560 - protein, 9 aa, Homo Sapiens
GHYWNIGPQ

SEQ ID NO: 1340561 - protein, 9 aa, Homo Sapiens
YCGQGVQFL

SEQ ID NO: 1340562 - protein, 9 aa, Homo Sapiens
LQLPKLHLD

SEQ ID NO: 1340563 - protein, 9 aa, Homo Sapiens
LRKCLHQEY

SEQ ID NO: 1340564 - protein, 9 aa, Homo Sapiens
TIVMLIVPF

SEQ ID NO: 1340565 - protein, 9 aa, Homo Sapiens
RTRNMFKLQ

SEQ ID NO: 1340566 - protein, 9 aa, Homo Sapiens
GSQLSQKHI

SEQ ID NO: 1340567 - protein, 9 aa, Homo Sapiens
VPDLIQVTT

SEQ ID NO: 1340568 - protein, 9 aa, Homo Sapiens
DCVSEKGGK

SEQ ID NO: 1340569 - protein, 9 aa, Homo Sapiens
ATQKKKADS

SEQ ID NO: 1340570 - protein, 9 aa, Homo Sapiens
KYDLKEPTE

SEQ ID NO: 1340571 - protein, 9 aa, Homo Sapiens
NKLRWGDII

SEQ ID NO: 1340572 - protein, 9 aa, Homo Sapiens
EHRTLNKFG

SEQ ID NO: 1340573 - protein, 9 aa, Homo Sapiens
GGHINCPWK

SEQ ID NO: 1340574 - protein, 9 aa, Homo Sapiens
GGWKVITEK

SEQ ID NO: 1340575 - protein, 9 aa, Homo Sapiens
RSNKNPWVC

SEQ ID NO: 1340576 - protein, 9 aa, Homo Sapiens
LRHHLKTHT

SEQ ID NO: 1340577 - protein, 9 aa, Homo Sapiens
PSLQSAAYN

SEQ ID NO: 1340578 - protein, 9 aa, Homo Sapiens
TFPRMTPWR

SEQ ID NO: 1340579 - protein, 9 aa, Homo Sapiens
NSTIPVEPG

SEQ ID NO: 1340580 - protein, 9 aa, Homo Sapiens
IPSDVVKTG

SEQ ID NO: 1340581 - protein, 9 aa, Homo Sapiens
FSPVVVILE

SEQ ID NO: 1340582 - protein, 9 aa, Homo Sapiens
ENTAEGTSF

SEQ ID NO: 1340583 - protein, 9 aa, Homo Sapiens
PRAETSPSS

SEQ ID NO: 1340584 - protein, 9 aa, Homo Sapiens
ASCSLGAVH

SEQ ID NO: 1340585 - protein, 9 aa, Homo Sapiens
IRCQAIKEL

SEQ ID NO: 1340586 - protein, 9 aa, Homo Sapiens
SLTVSSPLK

SEQ ID NO: 1340587 - protein, 9 aa, Homo Sapiens
EAEPIMFPS

SEQ ID NO: 1340588 - protein, 9 aa, Homo Sapiens
AKERVSSRR

SEQ ID NO: 1340589 - protein, 9 aa, Homo Sapiens
LSPDITLPR

SEQ ID NO: 1340590 - protein, 9 aa, Homo Sapiens
LEIREIRTL

SEQ ID NO: 1340591 - protein, 9 aa, Homo Sapiens
IASTMAASS

SEQ ID NO: 1340592 - protein, 9 aa, Homo Sapiens
LTHDYLSVA

SEQ ID NO: 1340593 - protein, 9 aa, Homo Sapiens
GPTEEKLLK

SEQ ID NO: 1340594 - protein, 9 aa, Homo Sapiens
VLSLPTYFS

SEQ ID NO: 1340595 - protein, 9 aa, Homo Sapiens
VKVFHSSLH

SEQ ID NO: 1340596 - protein, 9 aa, Homo Sapiens
YQYQPHGKC

SEQ ID NO: 1340597 - protein, 9 aa, Homo Sapiens
IDCHMTSIS

SEQ ID NO: 1340598 - protein, 9 aa, Homo Sapiens
WMKDPLTKD

SEQ ID NO: 1340599 - protein, 9 aa, Homo Sapiens
VHRLSTVRA

SEQ ID NO: 1340600 - protein, 9 aa, Homo Sapiens
MPSGDVSPI

SEQ ID NO: 1340601 - protein, 9 aa, Homo Sapiens
HTILSARKT

SEQ ID NO: 1340602 - protein, 9 aa, Homo Sapiens
MPEKPAEEG

SEQ ID NO: 1340603 - protein, 9 aa, Homo Sapiens
IIKKQEEGV

SEQ ID NO: 1340604 - protein, 9 aa, Homo Sapiens
FTIEGLFFH

SEQ ID NO: 1340605 - protein, 9 aa, Homo Sapiens
SQVYSGVDE

SEQ ID NO: 1340606 - protein, 9 aa, Homo Sapiens
GKSLDSALK

SEQ ID NO: 1340607 - protein, 9 aa, Homo Sapiens
MDLAMEHGG

SEQ ID NO: 1340608 - protein, 9 aa, Homo Sapiens
KPDPTKTFD

SEQ ID NO: 1340609 - protein, 9 aa, Homo Sapiens
TKEWRVLLV

SEQ ID NO: 1340610 - protein, 9 aa, Homo Sapiens
FHDTILFLY

SEQ ID NO: 1340611 - protein, 9 aa, Homo Sapiens
TRVPSSLAY

SEQ ID NO: 1340612 - protein, 9 aa, Homo Sapiens
KPNLSKILT

SEQ ID NO: 1340613 - protein, 9 aa, Homo Sapiens
GGITILGGL

SEQ ID NO: 1340614 - protein, 9 aa, Homo Sapiens
VIIPLPTWN

SEQ ID NO: 1340615 - protein, 9 aa, Homo Sapiens
HQGLTCNRS

SEQ ID NO: 1340616 - protein, 9 aa, Homo Sapiens
LTARNCLVS

SEQ ID NO: 1340617 - protein, 9 aa, Homo Sapiens
KQGTGSLQE

SEQ ID NO: 1340618 - protein, 9 aa, Homo Sapiens
WAMLIIICF

SEQ ID NO: 1340619 - protein, 9 aa, Homo Sapiens
HCYIAILSI

SEQ ID NO: 1340620 - protein, 9 aa, Homo Sapiens
HPGYTAVDE

SEQ ID NO: 1340621 - protein, 9 aa, Homo Sapiens
TQLIPALVK

SEQ ID NO: 1340622 - protein, 9 aa, Homo Sapiens
LCYWLEEAE

SEQ ID NO: 1340623 - protein, 9 aa, Homo Sapiens
AGECAHNAT

SEQ ID NO: 1340624 - protein, 9 aa, Homo Sapiens
SPKGKQLTT

SEQ ID NO: 1340625 - protein, 9 aa, Homo Sapiens
STMAASSAH

SEQ ID NO: 1340626 - protein, 9 aa, Homo Sapiens
LNELMQKHN

SEQ ID NO: 1340627 - protein, 9 aa, Homo Sapiens
ELQGFTVDK

SEQ ID NO: 1340628 - protein, 9 aa, Homo Sapiens
QVAAKWEQL

SEQ ID NO: 1340629 - protein, 9 aa, Homo Sapiens
KNDMIGLSD

SEQ ID NO: 1340630 - protein, 9 aa, Homo Sapiens
PPGSREVYT

SEQ ID NO: 1340631 - protein, 9 aa, Homo Sapiens
CQTYVKCPT

SEQ ID NO: 1340632 - protein, 9 aa, Homo Sapiens
DQRKCEHLL

SEQ ID NO: 1340633 - protein, 9 aa, Homo Sapiens
SITHYLYIA

SEQ ID NO: 1340634 - protein, 9 aa, Homo Sapiens
KRKLSTGIT

SEQ ID NO: 1340635 - protein, 9 aa, Homo Sapiens
SYGEFVEYH

SEQ ID NO: 1340636 - protein, 9 aa, Homo Sapiens
SFFSLIVGL

SEQ ID NO: 1340637 - protein, 9 aa, Homo Sapiens
EPLCFFPRK

SEQ ID NO: 1340638 - protein, 9 aa, Homo Sapiens
KMAMGIEDS

SEQ ID NO: 1340639 - protein, 9 aa, Homo Sapiens
NSFPDWEWT

SEQ ID NO: 1340640 - protein, 9 aa, Homo Sapiens
THLVGALRS

SEQ ID NO: 1340641 - protein, 9 aa, Homo Sapiens
WKFLTGLEP

SEQ ID NO: 1340642 - protein, 9 aa, Homo Sapiens
EKWGLKDVM

SEQ ID NO: 1340643 - protein, 9 aa, Homo Sapiens
STDVTVQGN

SEQ ID NO: 1340644 - protein, 9 aa, Homo Sapiens
VMTEAKMKK

SEQ ID NO: 1340645 - protein, 9 aa, Homo Sapiens
DSPASKKKE

SEQ ID NO: 1340646 - protein, 9 aa, Homo Sapiens
ERTAKVAEQ

SEQ ID NO: 1340647 - protein, 9 aa, Homo Sapiens
PILHINSKG

SEQ ID NO: 1340648 - protein, 9 aa, Homo Sapiens
YLLFYECVL

SEQ ID NO: 1340649 - protein, 9 aa, Homo Sapiens
ISLLVVLYK

SEQ ID NO: 1340650 - protein, 9 aa, Homo Sapiens
EYQVNGKMI

SEQ ID NO: 1340651 - protein, 9 aa, Homo Sapiens
CFEHQFKKK

SEQ ID NO: 1340652 - protein, 9 aa, Homo Sapiens
GPADTGRYE

SEQ ID NO: 1340653 - protein, 9 aa, Homo Sapiens
FEFCGYEAN

SEQ ID NO: 1340654 - protein, 9 aa, Homo Sapiens
SIMGPPGLQ

SEQ ID NO: 1340655 - protein, 9 aa, Homo Sapiens
FTLRRMEEL

SEQ ID NO: 1340656 - protein, 9 aa, Homo Sapiens
MFEAITWEM

SEQ ID NO: 1340657 - protein, 9 aa, Homo Sapiens
ITTIGYGHT

SEQ ID NO: 1340658 - protein, 9 aa, Homo Sapiens
SRWVRPRTS

SEQ ID NO: 1340659 - protein, 9 aa, Homo Sapiens
LLGEQHYKD

SEQ ID NO: 1340660 - protein, 9 aa, Homo Sapiens
GKKCRLTII

SEQ ID NO: 1340661 - protein, 9 aa, Homo Sapiens
RFTQEYKKD

SEQ ID NO: 1340662 - protein, 9 aa, Homo Sapiens
QSIRCHYRD

SEQ ID NO: 1340663 - protein, 9 aa, Homo Sapiens
DKLTGRGFS

SEQ ID NO: 1340664 - protein, 9 aa, Homo Sapiens
KMLIMMVVL

SEQ ID NO: 1340665 - protein, 9 aa, Homo Sapiens
PGPHLSPLG

SEQ ID NO: 1340666 - protein, 9 aa, Homo Sapiens
LIQRLEALK

SEQ ID NO: 1340667 - protein, 9 aa, Homo Sapiens
ISSNVIFLI

SEQ ID NO: 1340668 - protein, 9 aa, Homo Sapiens
GITFIEKSS

SEQ ID NO: 1340669 - protein, 9 aa, Homo Sapiens
TELGGCTSI

SEQ ID NO: 1340670 - protein, 9 aa, Homo Sapiens
PRRISVVSV

SEQ ID NO: 1340671 - protein, 9 aa, Homo Sapiens
DCLMAVKEE

SEQ ID NO: 1340672 - protein, 9 aa, Homo Sapiens
PSHLMQYPA

SEQ ID NO: 1340673 - protein, 9 aa, Homo Sapiens
PMSSSGHLF

SEQ ID NO: 1340674 - protein, 9 aa, Homo Sapiens
DLSDMDNLS

SEQ ID NO: 1340675 - protein, 9 aa, Homo Sapiens
WPLEAKRQN

SEQ ID NO: 1340676 - protein, 9 aa, Homo Sapiens
LPKMQAIRN

SEQ ID NO: 1340677 - protein, 9 aa, Homo Sapiens
FDTKAVVAA

SEQ ID NO: 1340678 - protein, 9 aa, Homo Sapiens
ASSKMTTFF

SEQ ID NO: 1340679 - protein, 9 aa, Homo Sapiens
TISKGFFGS

SEQ ID NO: 1340680 - protein, 9 aa, Homo Sapiens
KLQDVFEMC

SEQ ID NO: 1340681 - protein, 9 aa, Homo Sapiens
KQSLNDSYM

SEQ ID NO: 1340682 - protein, 9 aa, Homo Sapiens
PHQVQGRGI

SEQ ID NO: 1340683 - protein, 9 aa, Homo Sapiens
SLTRPGLEL

SEQ ID NO: 1340684 - protein, 9 aa, Homo Sapiens
EFREAKPHS

SEQ ID NO: 1340685 - protein, 9 aa, Homo Sapiens
AEVRHCTWF

SEQ ID NO: 1340686 - protein, 9 aa, Homo Sapiens
SKPRSGGNR

SEQ ID NO: 1340687 - protein, 9 aa, Homo Sapiens
IFENMLSTY

SEQ ID NO: 1340688 - protein, 9 aa, Homo Sapiens
YGYDCGCGS

SEQ ID NO: 1340689 - protein, 9 aa, Homo Sapiens
SGTAVAKTT

SEQ ID NO: 1340690 - protein, 9 aa, Homo Sapiens
DYKSHVYIV

SEQ ID NO: 1340691 - protein, 9 aa, Homo Sapiens
CISASPGGS

SEQ ID NO: 1340692 - protein, 9 aa, Homo Sapiens
EIIQAKDEV

SEQ ID NO: 1340693 - protein, 9 aa, Homo Sapiens
VSDGEADPF

SEQ ID NO: 1340694 - protein, 9 aa, Homo Sapiens
MPLFKLYIV

SEQ ID NO: 1340695 - protein, 9 aa, Homo Sapiens
LMLSSNREC

SEQ ID NO: 1340696 - protein, 9 aa, Homo Sapiens
PQAESGEAV

SEQ ID NO: 1340697 - protein, 9 aa, Homo Sapiens
KLYCLDNPY

SEQ ID NO: 1340698 - protein, 9 aa, Homo Sapiens
TISINHKWV

SEQ ID NO: 1340699 - protein, 9 aa, Homo Sapiens
ESFDTGSDH

SEQ ID NO: 1340700 - protein, 9 aa, Homo Sapiens
QCNRTIMTI

SEQ ID NO: 1340701 - protein, 9 aa, Homo Sapiens
EYNKDGITF

SEQ ID NO: 1340702 - protein, 9 aa, Homo Sapiens
SQQDKHLWV

SEQ ID NO: 1340703 - protein, 9 aa, Homo Sapiens
FNFDHVFHG

SEQ ID NO: 1340704 - protein, 9 aa, Homo Sapiens
THIIFTIEG

SEQ ID NO: 1340705 - protein, 9 aa, Homo Sapiens
RSMPLEENV

SEQ ID NO: 1340706 - protein, 9 aa, Homo Sapiens
RNSLQAAKG

SEQ ID NO: 1340707 - protein, 9 aa, Homo Sapiens
SRLYVCPST

SEQ ID NO: 1340708 - protein, 9 aa, Homo Sapiens
HIDVMSTDF

SEQ ID NO: 1340709 - protein, 9 aa, Homo Sapiens
IGKQPKLMD

SEQ ID NO: 1340710 - protein, 9 aa, Homo Sapiens
ARGSPWPSS

SEQ ID NO: 1340711 - protein, 9 aa, Homo Sapiens
ISGKSFGVF

SEQ ID NO: 1340712 - protein, 9 aa, Homo Sapiens
GPLEALHLS

SEQ ID NO: 1340713 - protein, 9 aa, Homo Sapiens
VVTSKMLVN

SEQ ID NO: 1340714 - protein, 9 aa, Homo Sapiens
PPWTGSLPP

SEQ ID NO: 1340715 - protein, 9 aa, Homo Sapiens
VFYVAEISI

SEQ ID NO: 1340716 - protein, 9 aa, Homo Sapiens
LAPKCDASF

SEQ ID NO: 1340717 - protein, 9 aa, Homo Sapiens
FIWCCYVCC

SEQ ID NO: 1340718 - protein, 9 aa, Homo Sapiens
VKVLLYSLG

SEQ ID NO: 1340719 - protein, 9 aa, Homo Sapiens
SNFTMIMQR

SEQ ID NO: 1340720 - protein, 9 aa, Homo Sapiens
PHVSPSDYP

SEQ ID NO: 1340721 - protein, 9 aa, Homo Sapiens
GKDTLWETI

SEQ ID NO: 1340722 - protein, 9 aa, Homo Sapiens
VSGPSSACN

SEQ ID NO: 1340723 - protein, 9 aa, Homo Sapiens
TKASILKDQ

SEQ ID NO: 1340724 - protein, 9 aa, Homo Sapiens
GYLRETVGE

SEQ ID NO: 1340725 - protein, 9 aa, Homo Sapiens
SGFNPFQHL

SEQ ID NO: 1340726 - protein, 9 aa, Homo Sapiens
HRLGGGEDC

SEQ ID NO: 1340727 - protein, 9 aa, Homo Sapiens
HHPTFTRSN

SEQ ID NO: 1340728 - protein, 9 aa, Homo Sapiens
QPCVLCPAT

SEQ ID NO: 1340729 - protein, 9 aa, Homo Sapiens
LRRLWKKSP

SEQ ID NO: 1340730 - protein, 9 aa, Homo Sapiens
VSLWDCFNL

SEQ ID NO: 1340731 - protein, 9 aa, Homo Sapiens
ILFFFLFPL

SEQ ID NO: 1340732 - protein, 9 aa, Homo Sapiens
GINCYHDMT

SEQ ID NO: 1340733 - protein, 9 aa, Homo Sapiens
GRCKANPQD

SEQ ID NO: 1340734 - protein, 9 aa, Homo Sapiens
NMFYYYNKQ

SEQ ID NO: 1340735 - protein, 9 aa, Homo Sapiens
TILEGKRSG

SEQ ID NO: 1340736 - protein, 9 aa, Homo Sapiens
KMKKIQIPV

SEQ ID NO: 1340737 - protein, 9 aa, Homo Sapiens
SPTTEVPMS

SEQ ID NO: 1340738 - protein, 9 aa, Homo Sapiens
NYITFNPTN

SEQ ID NO: 1340739 - protein, 9 aa, Homo Sapiens
SSPDYQHYL

SEQ ID NO: 1340740 - protein, 9 aa, Homo Sapiens
PREDDIPFT

SEQ ID NO: 1340741 - protein, 9 aa, Homo Sapiens
CSERQLLRL

SEQ ID NO: 1340742 - protein, 9 aa, Homo Sapiens
STTLDTIDN

SEQ ID NO: 1340743 - protein, 9 aa, Homo Sapiens
HNATCTHYT

SEQ ID NO: 1340744 - protein, 9 aa, Homo Sapiens
LNKHLPSTH

SEQ ID NO: 1340745 - protein, 9 aa, Homo Sapiens
IRQLLHEKI

SEQ ID NO: 1340746 - protein, 9 aa, Homo Sapiens
VDMRVAQVA

SEQ ID NO: 1340747 - protein, 9 aa, Homo Sapiens
KYDKMCNDV

SEQ ID NO: 1340748 - protein, 9 aa, Homo Sapiens
SSTGTYMST

SEQ ID NO: 1340749 - protein, 9 aa, Homo Sapiens
RDELYVQWG

SEQ ID NO: 1340750 - protein, 9 aa, Homo Sapiens
FSELSVTER

SEQ ID NO: 1340751 - protein, 9 aa, Homo Sapiens
SEPGLFVVG

SEQ ID NO: 1340752 - protein, 9 aa, Homo Sapiens
CSGARANIQ

SEQ ID NO: 1340753 - protein, 9 aa, Homo Sapiens
EVDQLHLER

SEQ ID NO: 1340754 - protein, 9 aa, Homo Sapiens
QLTAECTIV

SEQ ID NO: 1340755 - protein, 9 aa, Homo Sapiens
RTASIIIAL

SEQ ID NO: 1340756 - protein, 9 aa, Homo Sapiens
MGAVRRLLG

SEQ ID NO: 1340757 - protein, 9 aa, Homo Sapiens
RCVSLHSVP

SEQ ID NO: 1340758 - protein, 9 aa, Homo Sapiens
HDKPGSSLQ

SEQ ID NO: 1340759 - protein, 9 aa, Homo Sapiens
SFRANMGTS

SEQ ID NO: 1340760 - protein, 9 aa, Homo Sapiens
CSRWVRPRT

SEQ ID NO: 1340761 - protein, 9 aa, Homo Sapiens
KSSCIVLTL

SEQ ID NO: 1340762 - protein, 9 aa, Homo Sapiens
DLTDHLPVA

SEQ ID NO: 1340763 - protein, 9 aa, Homo Sapiens
QCTLAALRD

SEQ ID NO: 1340764 - protein, 9 aa, Homo Sapiens
LILSYLAGQ

SEQ ID NO: 1340765 - protein, 9 aa, Homo Sapiens
NGKVYPTVH

SEQ ID NO: 1340766 - protein, 9 aa, Homo Sapiens
TSTIMRDPK

SEQ ID NO: 1340767 - protein, 9 aa, Homo Sapiens
QGDDNHWWQ

SEQ ID NO: 1340768 - protein, 9 aa, Homo Sapiens
LVALEPDLL

SEQ ID NO: 1340769 - protein, 9 aa, Homo Sapiens
VSLLRQGVP

SEQ ID NO: 1340770 - protein, 9 aa, Homo Sapiens
RACCKSVHY

SEQ ID NO: 1340771 - protein, 9 aa, Homo Sapiens
PLPCVLPHV

SEQ ID NO: 1340772 - protein, 9 aa, Homo Sapiens
LSGIGVGEC

SEQ ID NO: 1340773 - protein, 9 aa, Homo Sapiens
IYETGDMCI

SEQ ID NO: 1340774 - protein, 9 aa, Homo Sapiens
LKSVQRITK

SEQ ID NO: 1340775 - protein, 9 aa, Homo Sapiens
NHTGYVHWK

SEQ ID NO: 1340776 - protein, 9 aa, Homo Sapiens
IRIASIPGI

SEQ ID NO: 1340777 - protein, 9 aa, Homo Sapiens
ESFVPHICS

SEQ ID NO: 1340778 - protein, 9 aa, Homo Sapiens
DPFQFSAPG

SEQ ID NO: 1340779 - protein, 9 aa, Homo Sapiens
LGESREPKS

SEQ ID NO: 1340780 - protein, 9 aa, Homo Sapiens
MSTAAAMQG

SEQ ID NO: 1340781 - protein, 9 aa, Homo Sapiens
KILTLRILN

SEQ ID NO: 1340782 - protein, 9 aa, Homo Sapiens
WVPPFPICK

SEQ ID NO: 1340783 - protein, 9 aa, Homo Sapiens
ASNQISRVQ

SEQ ID NO: 1340784 - protein, 9 aa, Homo Sapiens
APGVWWEIS

SEQ ID NO: 1340785 - protein, 9 aa, Homo Sapiens
GDNWNRIMK

SEQ ID NO: 1340786 - protein, 9 aa, Homo Sapiens
SVSHFDFYY

SEQ ID NO: 1340787 - protein, 9 aa, Homo Sapiens
SSLMSVCGW

SEQ ID NO: 1340788 - protein, 9 aa, Homo Sapiens
PAPVQPPHD

SEQ ID NO: 1340789 - protein, 9 aa, Homo Sapiens
KRPKRPRII

SEQ ID NO: 1340790 - protein, 9 aa, Homo Sapiens
SSPTHADST

SEQ ID NO: 1340791 - protein, 9 aa, Homo Sapiens
SKGLEEENA

SEQ ID NO: 1340792 - protein, 9 aa, Homo Sapiens
AIRAYSSHE

SEQ ID NO: 1340793 - protein, 9 aa, Homo Sapiens
LMNGYWGPA

SEQ ID NO: 1340794 - protein, 9 aa, Homo Sapiens
KEENTRQKT

SEQ ID NO: 1340795 - protein, 9 aa, Homo Sapiens
SRHHGRIGR

SEQ ID NO: 1340796 - protein, 9 aa, Homo Sapiens
FRVVIKDKQ

SEQ ID NO: 1340797 - protein, 9 aa, Homo Sapiens
HRTFGHSLS

SEQ ID NO: 1340798 - protein, 9 aa, Homo Sapiens
STSSLSSSS

SEQ ID NO: 1340799 - protein, 9 aa, Homo Sapiens
HLLATNYPH

SEQ ID NO: 1340800 - protein, 9 aa, Homo Sapiens
QVSCFSDGY

SEQ ID NO: 1340801 - protein, 9 aa, Homo Sapiens
DAQVGPLPC

SEQ ID NO: 1340802 - protein, 9 aa, Homo Sapiens
QKCGGTYQI

SEQ ID NO: 1340803 - protein, 9 aa, Homo Sapiens
ATSFEGRHD

SEQ ID NO: 1340804 - protein, 9 aa, Homo Sapiens
TQFEYPIHR

SEQ ID NO: 1340805 - protein, 9 aa, Homo Sapiens
ALANILMAL

SEQ ID NO: 1340806 - protein, 9 aa, Homo Sapiens
LVHKEAVSA

SEQ ID NO: 1340807 - protein, 9 aa, Homo Sapiens
SDLDHFWLE

SEQ ID NO: 1340808 - protein, 9 aa, Homo Sapiens
ARENHYDCV

SEQ ID NO: 1340809 - protein, 9 aa, Homo Sapiens
LATQVDMRV

SEQ ID NO: 1340810 - protein, 9 aa, Homo Sapiens
TQYEPLFHM

SEQ ID NO: 1340811 - protein, 9 aa, Homo Sapiens
LFGGCSYMP

SEQ ID NO: 1340812 - protein, 9 aa, Homo Sapiens
HLKYFRFIV

SEQ ID NO: 1340813 - protein, 9 aa, Homo Sapiens
MDAVPPWKS

SEQ ID NO: 1340814 - protein, 9 aa, Homo Sapiens
YDICKLSYP

SEQ ID NO: 1340815 - protein, 9 aa, Homo Sapiens
KWNLFPRSL

SEQ ID NO: 1340816 - protein, 9 aa, Homo Sapiens
FVFEYVGKK

SEQ ID NO: 1340817 - protein, 9 aa, Homo Sapiens
HRSKSQQVR

SEQ ID NO: 1340818 - protein, 9 aa, Homo Sapiens
ASWFPSYLN

SEQ ID NO: 1340819 - protein, 9 aa, Homo Sapiens
KSNCSHCVL

SEQ ID NO: 1340820 - protein, 9 aa, Homo Sapiens
VDAHVVLEV

SEQ ID NO: 1340821 - protein, 9 aa, Homo Sapiens
QAGGPPRSR

SEQ ID NO: 1340822 - protein, 9 aa, Homo Sapiens
SGNASTMAR

SEQ ID NO: 1340823 - protein, 9 aa, Homo Sapiens
ILCLPFCGH

SEQ ID NO: 1340824 - protein, 9 aa, Homo Sapiens
MMETQPVFD

SEQ ID NO: 1340825 - protein, 9 aa, Homo Sapiens
SILSLKTLF

SEQ ID NO: 1340826 - protein, 9 aa, Homo Sapiens
TSELWNLPP

SEQ ID NO: 1340827 - protein, 9 aa, Homo Sapiens
MQNLNNRLA

SEQ ID NO: 1340828 - protein, 9 aa, Homo Sapiens
LAVLLECLG

SEQ ID NO: 1340829 - protein, 9 aa, Homo Sapiens
DRDTSSGGS

SEQ ID NO: 1340830 - protein, 9 aa, Homo Sapiens
TWEESLLTC

SEQ ID NO: 1340831 - protein, 9 aa, Homo Sapiens
TINCFLMRK

SEQ ID NO: 1340832 - protein, 9 aa, Homo Sapiens
RMFPVFHDM

SEQ ID NO: 1340833 - protein, 9 aa, Homo Sapiens
AIADIKWTV

SEQ ID NO: 1340834 - protein, 9 aa, Homo Sapiens
TATSLIDLW

SEQ ID NO: 1340835 - protein, 9 aa, Homo Sapiens
RERKFHRII

SEQ ID NO: 1340836 - protein, 9 aa, Homo Sapiens
SVDTWLKSV

SEQ ID NO: 1340837 - protein, 9 aa, Homo Sapiens
NQSLLSSER

SEQ ID NO: 1340838 - protein, 9 aa, Homo Sapiens
RRAVVPGVK

SEQ ID NO: 1340839 - protein, 9 aa, Homo Sapiens
GGEDSTTRG

SEQ ID NO: 1340840 - protein, 9 aa, Homo Sapiens
SSLRCCHIR

SEQ ID NO: 1340841 - protein, 9 aa, Homo Sapiens
EIGNSLPQG

SEQ ID NO: 1340842 - protein, 9 aa, Homo Sapiens
SHIYFFRAE

SEQ ID NO: 1340843 - protein, 9 aa, Homo Sapiens
EIVIETGNR

SEQ ID NO: 1340844 - protein, 9 aa, Homo Sapiens
LLAKHLQEE

SEQ ID NO: 1340845 - protein, 9 aa, Homo Sapiens
EWERGWEPA

SEQ ID NO: 1340846 - protein, 9 aa, Homo Sapiens
RNGHKGLQI

SEQ ID NO: 1340847 - protein, 9 aa, Homo Sapiens
QVLYQACEA

SEQ ID NO: 1340848 - protein, 9 aa, Homo Sapiens
CLQQDNNQP

SEQ ID NO: 1340849 - protein, 9 aa, Homo Sapiens
SRRWTWWSA

SEQ ID NO: 1340850 - protein, 9 aa, Homo Sapiens
TGSGQRHPT

SEQ ID NO: 1340851 - protein, 9 aa, Homo Sapiens
VSDPETIHQ

SEQ ID NO: 1340852 - protein, 9 aa, Homo Sapiens
MMKKFLHKR

SEQ ID NO: 1340853 - protein, 9 aa, Homo Sapiens
IDPELAQYL

SEQ ID NO: 1340854 - protein, 9 aa, Homo Sapiens
DLTPTAPSR

SEQ ID NO: 1340855 - protein, 9 aa, Homo Sapiens
HTHSVSSPT

SEQ ID NO: 1340856 - protein, 9 aa, Homo Sapiens
LVCKQLTGQ

SEQ ID NO: 1340857 - protein, 9 aa, Homo Sapiens
PAWGHEVIL

SEQ ID NO: 1340858 - protein, 9 aa, Homo Sapiens
IEVVKASYP

SEQ ID NO: 1340859 - protein, 9 aa, Homo Sapiens
KSSPRCAGS

SEQ ID NO: 1340860 - protein, 9 aa, Homo Sapiens
TSIKGTSLY

SEQ ID NO: 1340861 - protein, 9 aa, Homo Sapiens
MYAYFVMTH

SEQ ID NO: 1340862 - protein, 9 aa, Homo Sapiens
TCGCTPARS

SEQ ID NO: 1340863 - protein, 9 aa, Homo Sapiens
PHQLIASLD

SEQ ID NO: 1340864 - protein, 9 aa, Homo Sapiens
SATMPHGQL

SEQ ID NO: 1340865 - protein, 9 aa, Homo Sapiens
LSVNASRDI

SEQ ID NO: 1340866 - protein, 9 aa, Homo Sapiens
MNSLSTMYN

SEQ ID NO: 1340867 - protein, 9 aa, Homo Sapiens
PFCGPNEIY

SEQ ID NO: 1340868 - protein, 9 aa, Homo Sapiens
NTATVTEED

SEQ ID NO: 1340869 - protein, 9 aa, Homo Sapiens
CLHKLKLCV

SEQ ID NO: 1340870 - protein, 9 aa, Homo Sapiens
SLLSSERMK

SEQ ID NO: 1340871 - protein, 9 aa, Homo Sapiens
ELAARAVAT

SEQ ID NO: 1340872 - protein, 9 aa, Homo Sapiens
LWCSLLSQD

SEQ ID NO: 1340873 - protein, 9 aa, Homo Sapiens
VIDLLPGLR

SEQ ID NO: 1340874 - protein, 9 aa, Homo Sapiens
EKYYILWPE

SEQ ID NO: 1340875 - protein, 9 aa, Homo Sapiens
PPVNYVPQQ

SEQ ID NO: 1340876 - protein, 9 aa, Homo Sapiens
KAIKLQYQS

SEQ ID NO: 1340877 - protein, 9 aa, Homo Sapiens
SSLHVRKQK

SEQ ID NO: 1340878 - protein, 9 aa, Homo Sapiens
LRLKKLWQS

SEQ ID NO: 1340879 - protein, 9 aa, Homo Sapiens
LENMDVAFL

SEQ ID NO: 1340880 - protein, 9 aa, Homo Sapiens
EIMGRALRY

SEQ ID NO: 1340881 - protein, 9 aa, Homo Sapiens
KDCKKAQVQ

SEQ ID NO: 1340882 - protein, 9 aa, Homo Sapiens
AGKAVLRSW

SEQ ID NO: 1340883 - protein, 9 aa, Homo Sapiens
RKNNQIEQL

SEQ ID NO: 1340884 - protein, 9 aa, Homo Sapiens
ASRRWRMST

SEQ ID NO: 1340885 - protein, 9 aa, Homo Sapiens
EVSWLRLRL

SEQ ID NO: 1340886 - protein, 9 aa, Homo Sapiens
RLLDIDERE

SEQ ID NO: 1340887 - protein, 9 aa, Homo Sapiens
DKSIYFHTA

SEQ ID NO: 1340888 - protein, 9 aa, Homo Sapiens
TEAIADIKW

SEQ ID NO: 1340889 - protein, 9 aa, Homo Sapiens
ASRDPAKMR

SEQ ID NO: 1340890 - protein, 9 aa, Homo Sapiens
RHCVCREVG

SEQ ID NO: 1340891 - protein, 9 aa, Homo Sapiens
FKDTNQYVV

SEQ ID NO: 1340892 - protein, 9 aa, Homo Sapiens
HINMLYQSW

SEQ ID NO: 1340893 - protein, 9 aa, Homo Sapiens
QSGTHDYLG

SEQ ID NO: 1340894 - protein, 9 aa, Homo Sapiens
FKRDDSDVI

SEQ ID NO: 1340895 - protein, 9 aa, Homo Sapiens
DGHFSILHA

SEQ ID NO: 1340896 - protein, 9 aa, Homo Sapiens
CGQILLWSG

SEQ ID NO: 1340897 - protein, 9 aa, Homo Sapiens
HMVLISGKA

SEQ ID NO: 1340898 - protein, 9 aa, Homo Sapiens
AHKSSDASA

SEQ ID NO: 1340899 - protein, 9 aa, Homo Sapiens
LVEAFQKIT

SEQ ID NO: 1340900 - protein, 9 aa, Homo Sapiens
KVETLENTN

SEQ ID NO: 1340901 - protein, 9 aa, Homo Sapiens
IGVIVPGRG

SEQ ID NO: 1340902 - protein, 9 aa, Homo Sapiens
LHFFASMWS

SEQ ID NO: 1340903 - protein, 9 aa, Homo Sapiens
PCQQNQQQC

SEQ ID NO: 1340904 - protein, 9 aa, Homo Sapiens
DDIFAGAWI

SEQ ID NO: 1340905 - protein, 9 aa, Homo Sapiens
HHLKTHTTV

SEQ ID NO: 1340906 - protein, 9 aa, Homo Sapiens
RQTDPSCTT

SEQ ID NO: 1340907 - protein, 9 aa, Homo Sapiens
FYLVVGNYR

SEQ ID NO: 1340908 - protein, 9 aa, Homo Sapiens
CALCNSERT

SEQ ID NO: 1340909 - protein, 9 aa, Homo Sapiens
ETIFTKSYL

SEQ ID NO: 1340910 - protein, 9 aa, Homo Sapiens
NKINTGMYI

SEQ ID NO: 1340911 - protein, 9 aa, Homo Sapiens
VISALACLV

SEQ ID NO: 1340912 - protein, 9 aa, Homo Sapiens
SISLAELVV

SEQ ID NO: 1340913 - protein, 9 aa, Homo Sapiens
YHIDFEQFK

SEQ ID NO: 1340914 - protein, 9 aa, Homo Sapiens
CCSEESPRR

SEQ ID NO: 1340915 - protein, 9 aa, Homo Sapiens
RRTQHYLYE

SEQ ID NO: 1340916 - protein, 9 aa, Homo Sapiens
GYWCELTVR

SEQ ID NO: 1340917 - protein, 9 aa, Homo Sapiens
YLVDQWHWG

SEQ ID NO: 1340918 - protein, 9 aa, Homo Sapiens
LEMTFNLSL

SEQ ID NO: 1340919 - protein, 9 aa, Homo Sapiens
NTGCDQEMA

SEQ ID NO: 1340920 - protein, 9 aa, Homo Sapiens
GFTHVLNVA

SEQ ID NO: 1340921 - protein, 9 aa, Homo Sapiens
MWYQTSEDC

SEQ ID NO: 1340922 - protein, 9 aa, Homo Sapiens
GVPDLIQVT

SEQ ID NO: 1340923 - protein, 9 aa, Homo Sapiens
HSSSVRNEG

SEQ ID NO: 1340924 - protein, 9 aa, Homo Sapiens
ICHQDIKPQ

SEQ ID NO: 1340925 - protein, 9 aa, Homo Sapiens
NEIMSRLML

SEQ ID NO: 1340926 - protein, 9 aa, Homo Sapiens
PDAVLKEGL

SEQ ID NO: 1340927 - protein, 9 aa, Homo Sapiens
KQTWWEKPC

SEQ ID NO: 1340928 - protein, 9 aa, Homo Sapiens
LVDDRTGVT

SEQ ID NO: 1340929 - protein, 9 aa, Homo Sapiens
YTAVDEVRV

SEQ ID NO: 1340930 - protein, 9 aa, Homo Sapiens
RSPRLRSIF

SEQ ID NO: 1340931 - protein, 9 aa, Homo Sapiens
KLHESGLFC

SEQ ID NO: 1340932 - protein, 9 aa, Homo Sapiens
DKDAPLHYA

SEQ ID NO: 1340933 - protein, 9 aa, Homo Sapiens
DTYIPLQIN

SEQ ID NO: 1340934 - protein, 9 aa, Homo Sapiens
LKMEMLTGC

SEQ ID NO: 1340935 - protein, 9 aa, Homo Sapiens
AFVQELRKW

SEQ ID NO: 1340936 - protein, 9 aa, Homo Sapiens
FDVDGRMDQ

SEQ ID NO: 1340937 - protein, 9 aa, Homo Sapiens
PRGAGGAPI

SEQ ID NO: 1340938 - protein, 9 aa, Homo Sapiens
TEQKINTMI

SEQ ID NO: 1340939 - protein, 9 aa, Homo Sapiens
QRARMERLT

SEQ ID NO: 1340940 - protein, 9 aa, Homo Sapiens
HFWLETLLC

SEQ ID NO: 1340941 - protein, 9 aa, Homo Sapiens
NSFTHLPDC

SEQ ID NO: 1340942 - protein, 9 aa, Homo Sapiens
EKFSVFIPK

SEQ ID NO: 1340943 - protein, 9 aa, Homo Sapiens
PTGEKIYVC

SEQ ID NO: 1340944 - protein, 9 aa, Homo Sapiens
NTRRTAQNI

SEQ ID NO: 1340945 - protein, 9 aa, Homo Sapiens
GHLGPGRIH

SEQ ID NO: 1340946 - protein, 9 aa, Homo Sapiens
EVWVLHSIG

SEQ ID NO: 1340947 - protein, 9 aa, Homo Sapiens
SLPSECILP

SEQ ID NO: 1340948 - protein, 9 aa, Homo Sapiens
NIDARKNDM

SEQ ID NO: 1340949 - protein, 9 aa, Homo Sapiens
HGSCRGSIS

SEQ ID NO: 1340950 - protein, 9 aa, Homo Sapiens
KVQGPLPNQ

SEQ ID NO: 1340951 - protein, 9 aa, Homo Sapiens
REDPIIVMV

SEQ ID NO: 1340952 - protein, 9 aa, Homo Sapiens
TLVIEDDVC

SEQ ID NO: 1340953 - protein, 9 aa, Homo Sapiens
TIDHFKEVI

SEQ ID NO: 1340954 - protein, 9 aa, Homo Sapiens
VVLRLDGSQ

SEQ ID NO: 1340955 - protein, 9 aa, Homo Sapiens
AAHLLDITM

SEQ ID NO: 1340956 - protein, 9 aa, Homo Sapiens
CQDMWWYQR

SEQ ID NO: 1340957 - protein, 9 aa, Homo Sapiens
FAAHLLDIT

SEQ ID NO: 1340958 - protein, 9 aa, Homo Sapiens
TLNLEEGND

SEQ ID NO: 1340959 - protein, 9 aa, Homo Sapiens
PDVKVLRWI

SEQ ID NO: 1340960 - protein, 9 aa, Homo Sapiens
FQLNSLSGG

SEQ ID NO: 1340961 - protein, 9 aa, Homo Sapiens
QKTKRMHTS

SEQ ID NO: 1340962 - protein, 9 aa, Homo Sapiens
LEEEEEPPP

SEQ ID NO: 1340963 - protein, 9 aa, Homo Sapiens
DIDNQPLVT

SEQ ID NO: 1340964 - protein, 9 aa, Homo Sapiens
TFSQKTTLL

SEQ ID NO: 1340965 - protein, 9 aa, Homo Sapiens
TDFQAHVRE

SEQ ID NO: 1340966 - protein, 9 aa, Homo Sapiens
RIQHLSSLE

SEQ ID NO: 1340967 - protein, 9 aa, Homo Sapiens
QRETVKHRE

SEQ ID NO: 1340968 - protein, 9 aa, Homo Sapiens
ISTPQDIAL

SEQ ID NO: 1340969 - protein, 9 aa, Homo Sapiens
LSDLIAAVI

SEQ ID NO: 1340970 - protein, 9 aa, Homo Sapiens
AGGVLGATE

SEQ ID NO: 1340971 - protein, 9 aa, Homo Sapiens
YQQNCLRSS

SEQ ID NO: 1340972 - protein, 9 aa, Homo Sapiens
AQQGSYTSI

SEQ ID NO: 1340973 - protein, 9 aa, Homo Sapiens
HQVADAREK

SEQ ID NO: 1340974 - protein, 9 aa, Homo Sapiens
KLAGQEDLV

SEQ ID NO: 1340975 - protein, 9 aa, Homo Sapiens
HSRSRSRRR

SEQ ID NO: 1340976 - protein, 9 aa, Homo Sapiens
GSSTREDIM

SEQ ID NO: 1340977 - protein, 9 aa, Homo Sapiens
DVWSVGFIF

SEQ ID NO: 1340978 - protein, 9 aa, Homo Sapiens
GSDFDVHIL

SEQ ID NO: 1340979 - protein, 9 aa, Homo Sapiens
APDPDAWLH

SEQ ID NO: 1340980 - protein, 9 aa, Homo Sapiens
IQFMKHVHQ

SEQ ID NO: 1340981 - protein, 9 aa, Homo Sapiens
HPEQRELRS

SEQ ID NO: 1340982 - protein, 9 aa, Homo Sapiens
ASGRTVGNG

SEQ ID NO: 1340983 - protein, 9 aa, Homo Sapiens
CNARSYQGR

SEQ ID NO: 1340984 - protein, 9 aa, Homo Sapiens
KMRTQVRGI

SEQ ID NO: 1340985 - protein, 9 aa, Homo Sapiens
SLGAPWGGR

SEQ ID NO: 1340986 - protein, 9 aa, Homo Sapiens
QESYEESSK

SEQ ID NO: 1340987 - protein, 9 aa, Homo Sapiens
ELPREYQNR

SEQ ID NO: 1340988 - protein, 9 aa, Homo Sapiens
VQAHVMDRH

SEQ ID NO: 1340989 - protein, 9 aa, Homo Sapiens
QMPTIIGHQ

SEQ ID NO: 1340990 - protein, 9 aa, Homo Sapiens
RGANTFEMI

SEQ ID NO: 1340991 - protein, 9 aa, Homo Sapiens
NERRHMQSI

SEQ ID NO: 1340992 - protein, 9 aa, Homo Sapiens
RNKCIAYKR

SEQ ID NO: 1340993 - protein, 9 aa, Homo Sapiens
CGLGRRQQP

SEQ ID NO: 1340994 - protein, 9 aa, Homo Sapiens
ATATCFDAV

SEQ ID NO: 1340995 - protein, 9 aa, Homo Sapiens
TAYNRHTFE

SEQ ID NO: 1340996 - protein, 9 aa, Homo Sapiens
QSPVGENAD

SEQ ID NO: 1340997 - protein, 9 aa, Homo Sapiens
LCLENTPCY

SEQ ID NO: 1340998 - protein, 9 aa, Homo Sapiens
WCDKDFNMK

SEQ ID NO: 1340999 - protein, 9 aa, Homo Sapiens
RMREVDEEN

SEQ ID NO: 1341000 - protein, 9 aa, Homo Sapiens
DNLSDTLNK

SEQ ID NO: 1341001 - protein, 9 aa, Homo Sapiens
ELCMPQSVF

SEQ ID NO: 1341002 - protein, 9 aa, Homo Sapiens
PESTSMDTP

SEQ ID NO: 1341003 - protein, 9 aa, Homo Sapiens
INVAGLIFY

SEQ ID NO: 1341004 - protein, 9 aa, Homo Sapiens
SHFILHQRG

SEQ ID NO: 1341005 - protein, 9 aa, Homo Sapiens
LHIMEDDIM

SEQ ID NO: 1341006 - protein, 9 aa, Homo Sapiens
HLHTHSVSS

SEQ ID NO: 1341007 - protein, 9 aa, Homo Sapiens
WPKLWVLAR

SEQ ID NO: 1341008 - protein, 9 aa, Homo Sapiens
ADPTALAAA

SEQ ID NO: 1341009 - protein, 9 aa, Homo Sapiens
LCITAKVRR

SEQ ID NO: 1341010 - protein, 9 aa, Homo Sapiens
GYVHWKGQV

SEQ ID NO: 1341011 - protein, 9 aa, Homo Sapiens
LLIDYQLTF

SEQ ID NO: 1341012 - protein, 9 aa, Homo Sapiens
EGALVTATR

SEQ ID NO: 1341013 - protein, 9 aa, Homo Sapiens
GVSCWSGFH

SEQ ID NO: 1341014 - protein, 9 aa, Homo Sapiens
QKYKHTLPV

SEQ ID NO: 1341015 - protein, 9 aa, Homo Sapiens
LVEIDKNML

SEQ ID NO: 1341016 - protein, 9 aa, Homo Sapiens
MQKHNDLIA

SEQ ID NO: 1341017 - protein, 9 aa, Homo Sapiens
VDSKRCSAK

SEQ ID NO: 1341018 - protein, 9 aa, Homo Sapiens
SFILLGISG

SEQ ID NO: 1341019 - protein, 9 aa, Homo Sapiens
TPSPASGST

SEQ ID NO: 1341020 - protein, 9 aa, Homo Sapiens
EVTVLQPPV

SEQ ID NO: 1341021 - protein, 9 aa, Homo Sapiens
LTESCGDGT

SEQ ID NO: 1341022 - protein, 9 aa, Homo Sapiens
LSLADTLII

SEQ ID NO: 1341023 - protein, 9 aa, Homo Sapiens
RTQLRKKPT

SEQ ID NO: 1341024 - protein, 9 aa, Homo Sapiens
VRLPTEHRC

SEQ ID NO: 1341025 - protein, 9 aa, Homo Sapiens
STTAKGDIY

SEQ ID NO: 1341026 - protein, 9 aa, Homo Sapiens
THWCWVESR

SEQ ID NO: 1341027 - protein, 9 aa, Homo Sapiens
ERYNDLKKK

SEQ ID NO: 1341028 - protein, 9 aa, Homo Sapiens
KKFEIPVCL

SEQ ID NO: 1341029 - protein, 9 aa, Homo Sapiens
EIIQEVEDE

SEQ ID NO: 1341030 - protein, 9 aa, Homo Sapiens
SFPQSSSGT

SEQ ID NO: 1341031 - protein, 9 aa, Homo Sapiens
SAEKGSLIL

SEQ ID NO: 1341032 - protein, 9 aa, Homo Sapiens
LIHHFSIHT

SEQ ID NO: 1341033 - protein, 9 aa, Homo Sapiens
VAFMIQEEY

SEQ ID NO: 1341034 - protein, 9 aa, Homo Sapiens
WRFSCSDEL

SEQ ID NO: 1341035 - protein, 9 aa, Homo Sapiens
SSNRECFLK

SEQ ID NO: 1341036 - protein, 9 aa, Homo Sapiens
IINQKWVEL

SEQ ID NO: 1341037 - protein, 9 aa, Homo Sapiens
KKDTLVPAR

SEQ ID NO: 1341038 - protein, 9 aa, Homo Sapiens
GETVVLQCI

SEQ ID NO: 1341039 - protein, 9 aa, Homo Sapiens
NELQHCIRK

SEQ ID NO: 1341040 - protein, 9 aa, Homo Sapiens
KGTHVLIWN

SEQ ID NO: 1341041 - protein, 9 aa, Homo Sapiens
ATERVIARL

SEQ ID NO: 1341042 - protein, 9 aa, Homo Sapiens
EDIDPELAQ

SEQ ID NO: 1341043 - protein, 9 aa, Homo Sapiens
GKAMERADY

SEQ ID NO: 1341044 - protein, 9 aa, Homo Sapiens
ILPTLHSAL

SEQ ID NO: 1341045 - protein, 9 aa, Homo Sapiens
LLPCHPFDT

SEQ ID NO: 1341046 - protein, 9 aa, Homo Sapiens
AGNETAALF

SEQ ID NO: 1341047 - protein, 9 aa, Homo Sapiens
KIHHVDAHA

SEQ ID NO: 1341048 - protein, 9 aa, Homo Sapiens
EEELHKQWD

SEQ ID NO: 1341049 - protein, 9 aa, Homo Sapiens
FVKQPHHHR

SEQ ID NO: 1341050 - protein, 9 aa, Homo Sapiens
PWVYSLLRI

SEQ ID NO: 1341051 - protein, 9 aa, Homo Sapiens
TAEGKNIDD

SEQ ID NO: 1341052 - protein, 9 aa, Homo Sapiens
LDTKVEYMK

SEQ ID NO: 1341053 - protein, 9 aa, Homo Sapiens
TLLQEDPWC

SEQ ID NO: 1341054 - protein, 9 aa, Homo Sapiens
FQVAPLSGR

SEQ ID NO: 1341055 - protein, 9 aa, Homo Sapiens
TLPRSPEVQ

SEQ ID NO: 1341056 - protein, 9 aa, Homo Sapiens
RTRHYNVLS

SEQ ID NO: 1341057 - protein, 9 aa, Homo Sapiens
WITRSPFHV

SEQ ID NO: 1341058 - protein, 9 aa, Homo Sapiens
GNKKFFGGK

SEQ ID NO: 1341059 - protein, 9 aa, Homo Sapiens
IPDAVLKEG

SEQ ID NO: 1341060 - protein, 9 aa, Homo Sapiens
SVVVVQSAT

SEQ ID NO: 1341061 - protein, 9 aa, Homo Sapiens
HVAECPCGP

SEQ ID NO: 1341062 - protein, 9 aa, Homo Sapiens
YNTGQTVVT

SEQ ID NO: 1341063 - protein, 9 aa, Homo Sapiens
RWHRLQVLR

SEQ ID NO: 1341064 - protein, 9 aa, Homo Sapiens
EEPTKPVIA

SEQ ID NO: 1341065 - protein, 9 aa, Homo Sapiens
TGHNLFFKC

SEQ ID NO: 1341066 - protein, 9 aa, Homo Sapiens
TDALVGSHL

SEQ ID NO: 1341067 - protein, 9 aa, Homo Sapiens
AGFPEQVTA

SEQ ID NO: 1341068 - protein, 9 aa, Homo Sapiens
YHPDKDEGT

SEQ ID NO: 1341069 - protein, 9 aa, Homo Sapiens
RMNYEEFAR

SEQ ID NO: 1341070 - protein, 9 aa, Homo Sapiens
HADSTGESP

SEQ ID NO: 1341071 - protein, 9 aa, Homo Sapiens
LRGLGLQLA

SEQ ID NO: 1341072 - protein, 9 aa, Homo Sapiens
IYKKVKDDV

SEQ ID NO: 1341073 - protein, 9 aa, Homo Sapiens
GHMKIMALM

SEQ ID NO: 1341074 - protein, 9 aa, Homo Sapiens
LLPSHVSYL

SEQ ID NO: 1341075 - protein, 9 aa, Homo Sapiens
WQKFWLRSK

SEQ ID NO: 1341076 - protein, 9 aa, Homo Sapiens
NLTKVYCGQ

SEQ ID NO: 1341077 - protein, 9 aa, Homo Sapiens
MFYPADHSF

SEQ ID NO: 1341078 - protein, 9 aa, Homo Sapiens
ATCGAAPST

SEQ ID NO: 1341079 - protein, 9 aa, Homo Sapiens
NNPTTKTTD

SEQ ID NO: 1341080 - protein, 9 aa, Homo Sapiens
VMTYDRYVA

SEQ ID NO: 1341081 - protein, 9 aa, Homo Sapiens
SDVNDNVPT

SEQ ID NO: 1341082 - protein, 9 aa, Homo Sapiens
CHMTSISDL

SEQ ID NO: 1341083 - protein, 9 aa, Homo Sapiens
SLHFCTPGP

SEQ ID NO: 1341084 - protein, 9 aa, Homo Sapiens
LEKCRQIYG

SEQ ID NO: 1341085 - protein, 9 aa, Homo Sapiens
VLKMEPADY

SEQ ID NO: 1341086 - protein, 9 aa, Homo Sapiens
NTQPEDWVE

SEQ ID NO: 1341087 - protein, 9 aa, Homo Sapiens
WCKAGGGLI

SEQ ID NO: 1341088 - protein, 9 aa, Homo Sapiens
KVQLAQLKE

SEQ ID NO: 1341089 - protein, 9 aa, Homo Sapiens
TATCDTVVG

SEQ ID NO: 1341090 - protein, 9 aa, Homo Sapiens
LDRKKKSRT

SEQ ID NO: 1341091 - protein, 9 aa, Homo Sapiens
VPHWTPPSI

SEQ ID NO: 1341092 - protein, 9 aa, Homo Sapiens
RRVSSNSIF

SEQ ID NO: 1341093 - protein, 9 aa, Homo Sapiens
MLLEQEKEP

SEQ ID NO: 1341094 - protein, 9 aa, Homo Sapiens
LNLLCKHQV

SEQ ID NO: 1341095 - protein, 9 aa, Homo Sapiens
TYECPIAFT

SEQ ID NO: 1341096 - protein, 9 aa, Homo Sapiens
DLVCGEFLQ

SEQ ID NO: 1341097 - protein, 9 aa, Homo Sapiens
QPLGMAFIT

SEQ ID NO: 1341098 - protein, 9 aa, Homo Sapiens
TVMTDLVDK

SEQ ID NO: 1341099 - protein, 9 aa, Homo Sapiens
KDEFDRLDS

SEQ ID NO: 1341100 - protein, 9 aa, Homo Sapiens
GALTMGMIF

SEQ ID NO: 1341101 - protein, 9 aa, Homo Sapiens
VTNGGSHAG

SEQ ID NO: 1341102 - protein, 9 aa, Homo Sapiens
WSVGFIFFQ

SEQ ID NO: 1341103 - protein, 9 aa, Homo Sapiens
RGDQVAHIP

SEQ ID NO: 1341104 - protein, 9 aa, Homo Sapiens
GLHTLLPVF

SEQ ID NO: 1341105 - protein, 9 aa, Homo Sapiens
CVSLLRQGV

SEQ ID NO: 1341106 - protein, 9 aa, Homo Sapiens
VVKNYYFNT

SEQ ID NO: 1341107 - protein, 9 aa, Homo Sapiens
WMEAMQDEF

SEQ ID NO: 1341108 - protein, 9 aa, Homo Sapiens
SRFNVCNRY

SEQ ID NO: 1341109 - protein, 9 aa, Homo Sapiens
GYIFGNSFV

SEQ ID NO: 1341110 - protein, 9 aa, Homo Sapiens
KAAIIEELV

SEQ ID NO: 1341111 - protein, 9 aa, Homo Sapiens
MQRWRSSER

SEQ ID NO: 1341112 - protein, 9 aa, Homo Sapiens
EERTAKVAE

SEQ ID NO: 1341113 - protein, 9 aa, Homo Sapiens
VLKNYRTAY

SEQ ID NO: 1341114 - protein, 9 aa, Homo Sapiens
LTAAMCYEP

SEQ ID NO: 1341115 - protein, 9 aa, Homo Sapiens
VNGQLIESL

SEQ ID NO: 1341116 - protein, 9 aa, Homo Sapiens
VGRFRPPEP

SEQ ID NO: 1341117 - protein, 9 aa, Homo Sapiens
LELTISPHC

SEQ ID NO: 1341118 - protein, 9 aa, Homo Sapiens
PLTCDDPHF

SEQ ID NO: 1341119 - protein, 9 aa, Homo Sapiens
GVTLEEEVS

SEQ ID NO: 1341120 - protein, 9 aa, Homo Sapiens
HFLAPRLLS

SEQ ID NO: 1341121 - protein, 9 aa, Homo Sapiens
FCSVFALPL

SEQ ID NO: 1341122 - protein, 9 aa, Homo Sapiens
ACEVATGIW

SEQ ID NO: 1341123 - protein, 9 aa, Homo Sapiens
ITWLRDNRP

SEQ ID NO: 1341124 - protein, 9 aa, Homo Sapiens
TKRLATDKH

SEQ ID NO: 1341125 - protein, 9 aa, Homo Sapiens
EHGLSTEQV

SEQ ID NO: 1341126 - protein, 9 aa, Homo Sapiens
SLPSSTTTD

SEQ ID NO: 1341127 - protein, 9 aa, Homo Sapiens
NCGPYCTSK

SEQ ID NO: 1341128 - protein, 9 aa, Homo Sapiens
AAWVGALTM

SEQ ID NO: 1341129 - protein, 9 aa, Homo Sapiens
HLYLFFCFG

SEQ ID NO: 1341130 - protein, 9 aa, Homo Sapiens
KQEELEVAL

SEQ ID NO: 1341131 - protein, 9 aa, Homo Sapiens
IHILHKREI

SEQ ID NO: 1341132 - protein, 9 aa, Homo Sapiens
SSLTPLLLH

SEQ ID NO: 1341133 - protein, 9 aa, Homo Sapiens
YIFRGVEHA

SEQ ID NO: 1341134 - protein, 9 aa, Homo Sapiens
EIWLDNISV

SEQ ID NO: 1341135 - protein, 9 aa, Homo Sapiens
RGYLQYLAV

SEQ ID NO: 1341136 - protein, 9 aa, Homo Sapiens
SKIRALLHL

SEQ ID NO: 1341137 - protein, 9 aa, Homo Sapiens
LPMTSEAGL

SEQ ID NO: 1341138 - protein, 9 aa, Homo Sapiens
ELYDPKGLM

SEQ ID NO: 1341139 - protein, 9 aa, Homo Sapiens
NSVRFFANP

SEQ ID NO: 1341140 - protein, 9 aa, Homo Sapiens
FLILSYLAG

SEQ ID NO: 1341141 - protein, 9 aa, Homo Sapiens
RKDFRMNMC

SEQ ID NO: 1341142 - protein, 9 aa, Homo Sapiens
LCILQREEE

SEQ ID NO: 1341143 - protein, 9 aa, Homo Sapiens
ATWARTSSR

SEQ ID NO: 1341144 - protein, 9 aa, Homo Sapiens
LFVAVRLYR

SEQ ID NO: 1341145 - protein, 9 aa, Homo Sapiens
DRKCQLSPQ

SEQ ID NO: 1341146 - protein, 9 aa, Homo Sapiens
SAPKKCRAC

SEQ ID NO: 1341147 - protein, 9 aa, Homo Sapiens
GNRGETREN

SEQ ID NO: 1341148 - protein, 9 aa, Homo Sapiens
EKGVLKRRA

SEQ ID NO: 1341149 - protein, 9 aa, Homo Sapiens
AILVPLVQE

SEQ ID NO: 1341150 - protein, 9 aa, Homo Sapiens
LCSPICPPK

SEQ ID NO: 1341151 - protein, 9 aa, Homo Sapiens
KHDVYSFVI

SEQ ID NO: 1341152 - protein, 9 aa, Homo Sapiens
EVDEENRAL

SEQ ID NO: 1341153 - protein, 9 aa, Homo Sapiens
EWAAKAAVN

SEQ ID NO: 1341154 - protein, 9 aa, Homo Sapiens
KGSLILLGV

SEQ ID NO: 1341155 - protein, 9 aa, Homo Sapiens
WERADMWPH

SEQ ID NO: 1341156 - protein, 9 aa, Homo Sapiens
RLPTEHRCL

SEQ ID NO: 1341157 - protein, 9 aa, Homo Sapiens
YSTHLFFSR

SEQ ID NO: 1341158 - protein, 9 aa, Homo Sapiens
KFCLENMAQ

SEQ ID NO: 1341159 - protein, 9 aa, Homo Sapiens
WQCRCDDIE

SEQ ID NO: 1341160 - protein, 9 aa, Homo Sapiens
REEVTVLQP

SEQ ID NO: 1341161 - protein, 9 aa, Homo Sapiens
CILPALSKD

SEQ ID NO: 1341162 - protein, 9 aa, Homo Sapiens
TFRRRLNLT

SEQ ID NO: 1341163 - protein, 9 aa, Homo Sapiens
VGGHVLYVY

SEQ ID NO: 1341164 - protein, 9 aa, Homo Sapiens
NIPYKRVFS

SEQ ID NO: 1341165 - protein, 9 aa, Homo Sapiens
SSTSSLSSS

SEQ ID NO: 1341166 - protein, 9 aa, Homo Sapiens
YAQNNPEFW

SEQ ID NO: 1341167 - protein, 9 aa, Homo Sapiens
FSRAATDLE

SEQ ID NO: 1341168 - protein, 9 aa, Homo Sapiens
DSFKHLIYP

SEQ ID NO: 1341169 - protein, 9 aa, Homo Sapiens
MDTHACPLK

SEQ ID NO: 1341170 - protein, 9 aa, Homo Sapiens
AHIPLLRDS

SEQ ID NO: 1341171 - protein, 9 aa, Homo Sapiens
GHTWHNTCF

SEQ ID NO: 1341172 - protein, 9 aa, Homo Sapiens
DLQARIATL

SEQ ID NO: 1341173 - protein, 9 aa, Homo Sapiens
VGVGSFTDP

SEQ ID NO: 1341174 - protein, 9 aa, Homo Sapiens
SQGGRPSSA

SEQ ID NO: 1341175 - protein, 9 aa, Homo Sapiens
APVPSPVPL

SEQ ID NO: 1341176 - protein, 9 aa, Homo Sapiens
DNCDETEDK

SEQ ID NO: 1341177 - protein, 9 aa, Homo Sapiens
KNACDHLSR

SEQ ID NO: 1341178 - protein, 9 aa, Homo Sapiens
IVLGLVRIR

SEQ ID NO: 1341179 - protein, 9 aa, Homo Sapiens
CGVEPKPEA

SEQ ID NO: 1341180 - protein, 9 aa, Homo Sapiens
AMRPSGHRR

SEQ ID NO: 1341181 - protein, 9 aa, Homo Sapiens
PPVQPNGLG

SEQ ID NO: 1341182 - protein, 9 aa, Homo Sapiens
ANQVSATSE

SEQ ID NO: 1341183 - protein, 9 aa, Homo Sapiens
VFHDMSVKY

SEQ ID NO: 1341184 - protein, 9 aa, Homo Sapiens
MFPVFHDMS

SEQ ID NO: 1341185 - protein, 9 aa, Homo Sapiens
KTIAEVRSS

SEQ ID NO: 1341186 - protein, 9 aa, Homo Sapiens
VLCDMDTNG

SEQ ID NO: 1341187 - protein, 9 aa, Homo Sapiens
MDLSIRTPE

SEQ ID NO: 1341188 - protein, 9 aa, Homo Sapiens
TCFMAYTFE

SEQ ID NO: 1341189 - protein, 9 aa, Homo Sapiens
DLIAAVILR

SEQ ID NO: 1341190 - protein, 9 aa, Homo Sapiens
RIPNEIIDM

SEQ ID NO: 1341191 - protein, 9 aa, Homo Sapiens
VEAEEENTD

SEQ ID NO: 1341192 - protein, 9 aa, Homo Sapiens
PSVCFRNIC

SEQ ID NO: 1341193 - protein, 9 aa, Homo Sapiens
RPSSRHAAH

SEQ ID NO: 1341194 - protein, 9 aa, Homo Sapiens
TSGKIKKVY

SEQ ID NO: 1341195 - protein, 9 aa, Homo Sapiens
RDTDMNKKD

SEQ ID NO: 1341196 - protein, 9 aa, Homo Sapiens
YLVHLFHFY

SEQ ID NO: 1341197 - protein, 9 aa, Homo Sapiens
MDVVKERIC

SEQ ID NO: 1341198 - protein, 9 aa, Homo Sapiens
VISCRWWGS

SEQ ID NO: 1341199 - protein, 9 aa, Homo Sapiens
VWRYLCALY

SEQ ID NO: 1341200 - protein, 9 aa, Homo Sapiens
DGCLQMADQ

SEQ ID NO: 1341201 - protein, 9 aa, Homo Sapiens
QQHIAQQGS

SEQ ID NO: 1341202 - protein, 9 aa, Homo Sapiens
RFNVCNRYL

SEQ ID NO: 1341203 - protein, 9 aa, Homo Sapiens
DEEDDYDIT

SEQ ID NO: 1341204 - protein, 9 aa, Homo Sapiens
EENYQALDT

SEQ ID NO: 1341205 - protein, 9 aa, Homo Sapiens
QKNDVESAK

SEQ ID NO: 1341206 - protein, 9 aa, Homo Sapiens
IMATLTIRS

SEQ ID NO: 1341207 - protein, 9 aa, Homo Sapiens
IMSPNDSPY

SEQ ID NO: 1341208 - protein, 9 aa, Homo Sapiens
MLLPGIETL

SEQ ID NO: 1341209 - protein, 9 aa, Homo Sapiens
RLKVHMKTH

SEQ ID NO: 1341210 - protein, 9 aa, Homo Sapiens
IDSQLADSL

SEQ ID NO: 1341211 - protein, 9 aa, Homo Sapiens
EEVRPNSWP

SEQ ID NO: 1341212 - protein, 9 aa, Homo Sapiens
MHFVNSLHK

SEQ ID NO: 1341213 - protein, 9 aa, Homo Sapiens
QTLDREVIA

SEQ ID NO: 1341214 - protein, 9 aa, Homo Sapiens
LEYHTTRER

SEQ ID NO: 1341215 - protein, 9 aa, Homo Sapiens
RNFNNCMKS

SEQ ID NO: 1341216 - protein, 9 aa, Homo Sapiens
SQLPHIFTS

SEQ ID NO: 1341217 - protein, 9 aa, Homo Sapiens
ISPSRRVQP

SEQ ID NO: 1341218 - protein, 9 aa, Homo Sapiens
GDGTVYFDE

SEQ ID NO: 1341219 - protein, 9 aa, Homo Sapiens
LWAAWVAGG

SEQ ID NO: 1341220 - protein, 9 aa, Homo Sapiens
MENTVLALA

SEQ ID NO: 1341221 - protein, 9 aa, Homo Sapiens
SEIRAPPAA

SEQ ID NO: 1341222 - protein, 9 aa, Homo Sapiens
SLKSHFILH

SEQ ID NO: 1341223 - protein, 9 aa, Homo Sapiens
GLDIWNSQD

SEQ ID NO: 1341224 - protein, 9 aa, Homo Sapiens
SLMLLTQKV

SEQ ID NO: 1341225 - protein, 9 aa, Homo Sapiens
FPRDLNLMV

SEQ ID NO: 1341226 - protein, 9 aa, Homo Sapiens
PGMPSSALS

SEQ ID NO: 1341227 - protein, 9 aa, Homo Sapiens
LRIREKERC

SEQ ID NO: 1341228 - protein, 9 aa, Homo Sapiens
PQDDDMPAD

SEQ ID NO: 1341229 - protein, 9 aa, Homo Sapiens
RLRREEHAD

SEQ ID NO: 1341230 - protein, 9 aa, Homo Sapiens
PASIMGPPG

SEQ ID NO: 1341231 - protein, 9 aa, Homo Sapiens
DHAQYLTSL

SEQ ID NO: 1341232 - protein, 9 aa, Homo Sapiens
LEHLQKQDK

SEQ ID NO: 1341233 - protein, 9 aa, Homo Sapiens
CLLTILMVV

SEQ ID NO: 1341234 - protein, 9 aa, Homo Sapiens
TPAQPPTCP

SEQ ID NO: 1341235 - protein, 9 aa, Homo Sapiens
GLKSLVSKD

SEQ ID NO: 1341236 - protein, 9 aa, Homo Sapiens
TLVNDGKYH

SEQ ID NO: 1341237 - protein, 9 aa, Homo Sapiens
CEAPMLVRL

SEQ ID NO: 1341238 - protein, 9 aa, Homo Sapiens
NCLLACGSL

SEQ ID NO: 1341239 - protein, 9 aa, Homo Sapiens
EDFEEVQCC

SEQ ID NO: 1341240 - protein, 9 aa, Homo Sapiens
FPVTPEAIK

SEQ ID NO: 1341241 - protein, 9 aa, Homo Sapiens
GSTIHIHYR

SEQ ID NO: 1341242 - protein, 9 aa, Homo Sapiens
LIVKKVCQK

SEQ ID NO: 1341243 - protein, 9 aa, Homo Sapiens
DIMEISVTD

SEQ ID NO: 1341244 - protein, 9 aa, Homo Sapiens
DDSSEHGTP

SEQ ID NO: 1341245 - protein, 9 aa, Homo Sapiens
YLPTIVNNV

SEQ ID NO: 1341246 - protein, 9 aa, Homo Sapiens
QNDKPPYSQ

SEQ ID NO: 1341247 - protein, 9 aa, Homo Sapiens
DADVFEVKA

SEQ ID NO: 1341248 - protein, 9 aa, Homo Sapiens
PDIVMLQRW

SEQ ID NO: 1341249 - protein, 9 aa, Homo Sapiens
AGFGTEAEK

SEQ ID NO: 1341250 - protein, 9 aa, Homo Sapiens
SDDILIPEE

SEQ ID NO: 1341251 - protein, 9 aa, Homo Sapiens
TFVNARTDF

SEQ ID NO: 1341252 - protein, 9 aa, Homo Sapiens
VQEQELVKH

SEQ ID NO: 1341253 - protein, 9 aa, Homo Sapiens
LPASLGRGR

SEQ ID NO: 1341254 - protein, 9 aa, Homo Sapiens
IAPKQCLSF

SEQ ID NO: 1341255 - protein, 9 aa, Homo Sapiens
LSDGLVFTT

SEQ ID NO: 1341256 - protein, 9 aa, Homo Sapiens
VCTSLGLAR

SEQ ID NO: 1341257 - protein, 9 aa, Homo Sapiens
VIFLTRQDF

SEQ ID NO: 1341258 - protein, 9 aa, Homo Sapiens
LVERTRDAR

SEQ ID NO: 1341259 - protein, 9 aa, Homo Sapiens
PNMETDSSK

SEQ ID NO: 1341260 - protein, 9 aa, Homo Sapiens
VHSVDFTRP

SEQ ID NO: 1341261 - protein, 9 aa, Homo Sapiens
HHTHDEIVL

SEQ ID NO: 1341262 - protein, 9 aa, Homo Sapiens
NCAPKSIAM

SEQ ID NO: 1341263 - protein, 9 aa, Homo Sapiens
TASGHRTFE

SEQ ID NO: 1341264 - protein, 9 aa, Homo Sapiens
PSENSFEYG

SEQ ID NO: 1341265 - protein, 9 aa, Homo Sapiens
GSRSSSVGG

SEQ ID NO: 1341266 - protein, 9 aa, Homo Sapiens
DGHSGQCVT

SEQ ID NO: 1341267 - protein, 9 aa, Homo Sapiens
TSNLLLYEK

SEQ ID NO: 1341268 - protein, 9 aa, Homo Sapiens
RKVLWLLIT

SEQ ID NO: 1341269 - protein, 9 aa, Homo Sapiens
PPHLNGPWI

SEQ ID NO: 1341270 - protein, 9 aa, Homo Sapiens
LNQSIKVPV

SEQ ID NO: 1341271 - protein, 9 aa, Homo Sapiens
LVVSVDDSG

SEQ ID NO: 1341272 - protein, 9 aa, Homo Sapiens
FSDCYIEYV

SEQ ID NO: 1341273 - protein, 9 aa, Homo Sapiens
LYHRIDVIF

SEQ ID NO: 1341274 - protein, 9 aa, Homo Sapiens
LAVRQVVAQ

SEQ ID NO: 1341275 - protein, 9 aa, Homo Sapiens
IITQRNSSL

SEQ ID NO: 1341276 - protein, 9 aa, Homo Sapiens
RMYNKIFTI

SEQ ID NO: 1341277 - protein, 9 aa, Homo Sapiens
NFEVAFSSV

SEQ ID NO: 1341278 - protein, 9 aa, Homo Sapiens
RMREREPDG

SEQ ID NO: 1341279 - protein, 9 aa, Homo Sapiens
CYHYFCGHN

SEQ ID NO: 1341280 - protein, 9 aa, Homo Sapiens
PTRTARWPR

SEQ ID NO: 1341281 - protein, 9 aa, Homo Sapiens
FYKVQGPLP

SEQ ID NO: 1341282 - protein, 9 aa, Homo Sapiens
KICKTFVQR

SEQ ID NO: 1341283 - protein, 9 aa, Homo Sapiens
QVSQKSSPR

SEQ ID NO: 1341284 - protein, 9 aa, Homo Sapiens
RSILYNLYG

SEQ ID NO: 1341285 - protein, 9 aa, Homo Sapiens
GLCWLHIDA

SEQ ID NO: 1341286 - protein, 9 aa, Homo Sapiens
REPFQMCLV

SEQ ID NO: 1341287 - protein, 9 aa, Homo Sapiens
HYQLYTGAE

SEQ ID NO: 1341288 - protein, 9 aa, Homo Sapiens
KSTQYYDMC

SEQ ID NO: 1341289 - protein, 9 aa, Homo Sapiens
CDCTQTGFY

SEQ ID NO: 1341290 - protein, 9 aa, Homo Sapiens
NVDLWYNLA

SEQ ID NO: 1341291 - protein, 9 aa, Homo Sapiens
DDVLLHHTH

SEQ ID NO: 1341292 - protein, 9 aa, Homo Sapiens
VFGSMQMAI

SEQ ID NO: 1341293 - protein, 9 aa, Homo Sapiens
NNIKPSSHN

SEQ ID NO: 1341294 - protein, 9 aa, Homo Sapiens
DPTDFVRKI

SEQ ID NO: 1341295 - protein, 9 aa, Homo Sapiens
PEPLCFFPR

SEQ ID NO: 1341296 - protein, 9 aa, Homo Sapiens
AHFLTLDTE

SEQ ID NO: 1341297 - protein, 9 aa, Homo Sapiens
RIELDKYIQ

SEQ ID NO: 1341298 - protein, 9 aa, Homo Sapiens
TVSCGNGKL

SEQ ID NO: 1341299 - protein, 9 aa, Homo Sapiens
HCSQASHSE

SEQ ID NO: 1341300 - protein, 9 aa, Homo Sapiens
AAPRGVCYG

SEQ ID NO: 1341301 - protein, 9 aa, Homo Sapiens
YKFKMKQHI

SEQ ID NO: 1341302 - protein, 9 aa, Homo Sapiens
ERGTRMKSV

SEQ ID NO: 1341303 - protein, 9 aa, Homo Sapiens
QGQSTILPS

SEQ ID NO: 1341304 - protein, 9 aa, Homo Sapiens
HVVCGSTCN

SEQ ID NO: 1341305 - protein, 9 aa, Homo Sapiens
TYMSTAAAM

SEQ ID NO: 1341306 - protein, 9 aa, Homo Sapiens
RCQAIKELP

SEQ ID NO: 1341307 - protein, 9 aa, Homo Sapiens
SGGGTADHC

SEQ ID NO: 1341308 - protein, 9 aa, Homo Sapiens
LQAVFFILF

SEQ ID NO: 1341309 - protein, 9 aa, Homo Sapiens
HNAVCTGHH

SEQ ID NO: 1341310 - protein, 9 aa, Homo Sapiens
KTQVLIGVS

SEQ ID NO: 1341311 - protein, 9 aa, Homo Sapiens
VRVLRFFSE

SEQ ID NO: 1341312 - protein, 9 aa, Homo Sapiens
SGLESFQLW

SEQ ID NO: 1341313 - protein, 9 aa, Homo Sapiens
EMQLPIYTP

SEQ ID NO: 1341314 - protein, 9 aa, Homo Sapiens
KGPMTKHPG

SEQ ID NO: 1341315 - protein, 9 aa, Homo Sapiens
AKVLGPRRE

SEQ ID NO: 1341316 - protein, 9 aa, Homo Sapiens
SPMNDNIFA

SEQ ID NO: 1341317 - protein, 9 aa, Homo Sapiens
TAVDEVRVL

SEQ ID NO: 1341318 - protein, 9 aa, Homo Sapiens
QLNYMLCPA

SEQ ID NO: 1341319 - protein, 9 aa, Homo Sapiens
KYVGKFLRV

SEQ ID NO: 1341320 - protein, 9 aa, Homo Sapiens
MKVRKQCTL

SEQ ID NO: 1341321 - protein, 9 aa, Homo Sapiens
SKYFTLYEV

SEQ ID NO: 1341322 - protein, 9 aa, Homo Sapiens
RRRHNLRSF

SEQ ID NO: 1341323 - protein, 9 aa, Homo Sapiens
YHNSVGGFL

SEQ ID NO: 1341324 - protein, 9 aa, Homo Sapiens
VVSRALCSP

SEQ ID NO: 1341325 - protein, 9 aa, Homo Sapiens
FSGRILHQP

SEQ ID NO: 1341326 - protein, 9 aa, Homo Sapiens
VASLHLVFQ

SEQ ID NO: 1341327 - protein, 9 aa, Homo Sapiens
AFFSIPAHK

SEQ ID NO: 1341328 - protein, 9 aa, Homo Sapiens
SGTYQVTVC

SEQ ID NO: 1341329 - protein, 9 aa, Homo Sapiens
ACATCGAAP

SEQ ID NO: 1341330 - protein, 9 aa, Homo Sapiens
TPRPQNKMS

SEQ ID NO: 1341331 - protein, 9 aa, Homo Sapiens
QDVLHHYIE

SEQ ID NO: 1341332 - protein, 9 aa, Homo Sapiens
QQLKQRMFE

SEQ ID NO: 1341333 - protein, 9 aa, Homo Sapiens
DRYVVICFP

SEQ ID NO: 1341334 - protein, 9 aa, Homo Sapiens
GGSKRKYCK

SEQ ID NO: 1341335 - protein, 9 aa, Homo Sapiens
SKWPVDRES

SEQ ID NO: 1341336 - protein, 9 aa, Homo Sapiens
SKDARVCGR

SEQ ID NO: 1341337 - protein, 9 aa, Homo Sapiens
LENTPCYDN

SEQ ID NO: 1341338 - protein, 9 aa, Homo Sapiens
GQDLTIDGL

SEQ ID NO: 1341339 - protein, 9 aa, Homo Sapiens
STVIHGTNS

SEQ ID NO: 1341340 - protein, 9 aa, Homo Sapiens
YPHFTCTVD

SEQ ID NO: 1341341 - protein, 9 aa, Homo Sapiens
IVPSHVIEM

SEQ ID NO: 1341342 - protein, 9 aa, Homo Sapiens
LSRHTQQIQ

SEQ ID NO: 1341343 - protein, 9 aa, Homo Sapiens
STFTLSSQV

SEQ ID NO: 1341344 - protein, 9 aa, Homo Sapiens
GSGNDEDWL

SEQ ID NO: 1341345 - protein, 9 aa, Homo Sapiens
AGHEPHIKA

SEQ ID NO: 1341346 - protein, 9 aa, Homo Sapiens
KRTKVAATA

SEQ ID NO: 1341347 - protein, 9 aa, Homo Sapiens
DHILHPKFI

SEQ ID NO: 1341348 - protein, 9 aa, Homo Sapiens
LFIPCMCHD

SEQ ID NO: 1341349 - protein, 9 aa, Homo Sapiens
RHLSHSDTY

SEQ ID NO: 1341350 - protein, 9 aa, Homo Sapiens
VHVFQIDPN

SEQ ID NO: 1341351 - protein, 9 aa, Homo Sapiens
LLMELKVAS

SEQ ID NO: 1341352 - protein, 9 aa, Homo Sapiens
GVGLAPQLR

SEQ ID NO: 1341353 - protein, 9 aa, Homo Sapiens
SLLETFAHT

SEQ ID NO: 1341354 - protein, 9 aa, Homo Sapiens
VMCRRMGPR

SEQ ID NO: 1341355 - protein, 9 aa, Homo Sapiens
RKEHKNRMK

SEQ ID NO: 1341356 - protein, 9 aa, Homo Sapiens
RPWMMNIKE

SEQ ID NO: 1341357 - protein, 9 aa, Homo Sapiens
LQQTIEEND

SEQ ID NO: 1341358 - protein, 9 aa, Homo Sapiens
EERFRFNRC

SEQ ID NO: 1341359 - protein, 9 aa, Homo Sapiens
LIREMLISW

SEQ ID NO: 1341360 - protein, 9 aa, Homo Sapiens
DGNCRYAKK

SEQ ID NO: 1341361 - protein, 9 aa, Homo Sapiens
ECSLYRAGY

SEQ ID NO: 1341362 - protein, 9 aa, Homo Sapiens
KNETIWYVH

SEQ ID NO: 1341363 - protein, 9 aa, Homo Sapiens
ERGWEPAAH

SEQ ID NO: 1341364 - protein, 9 aa, Homo Sapiens
WTHNFHHFL

SEQ ID NO: 1341365 - protein, 9 aa, Homo Sapiens
TPGIMHTSY

SEQ ID NO: 1341366 - protein, 9 aa, Homo Sapiens
PRLGRDTEG

SEQ ID NO: 1341367 - protein, 9 aa, Homo Sapiens
FNEKHNFIA

SEQ ID NO: 1341368 - protein, 9 aa, Homo Sapiens
CREEGILGF

SEQ ID NO: 1341369 - protein, 9 aa, Homo Sapiens
ARTTVSLNI

SEQ ID NO: 1341370 - protein, 9 aa, Homo Sapiens
AGGGGRDVP

SEQ ID NO: 1341371 - protein, 9 aa, Homo Sapiens
PTAGAARAR

SEQ ID NO: 1341372 - protein, 9 aa, Homo Sapiens
GPYVSMTFI

SEQ ID NO: 1341373 - protein, 9 aa, Homo Sapiens
EAHLISAQQ

SEQ ID NO: 1341374 - protein, 9 aa, Homo Sapiens
ILEELLPST

SEQ ID NO: 1341375 - protein, 9 aa, Homo Sapiens
HKDEIMRNH

SEQ ID NO: 1341376 - protein, 9 aa, Homo Sapiens
LFGKVFGNF

SEQ ID NO: 1341377 - protein, 9 aa, Homo Sapiens
EANTDLEVK

SEQ ID NO: 1341378 - protein, 9 aa, Homo Sapiens
STLEEDHAQ

SEQ ID NO: 1341379 - protein, 9 aa, Homo Sapiens
TREEAKIVM

SEQ ID NO: 1341380 - protein, 9 aa, Homo Sapiens
GGREWGRSK

SEQ ID NO: 1341381 - protein, 9 aa, Homo Sapiens
GHYFNDTLI

SEQ ID NO: 1341382 - protein, 9 aa, Homo Sapiens
KEKDEFNAT

SEQ ID NO: 1341383 - protein, 9 aa, Homo Sapiens
LEGGITFVP

SEQ ID NO: 1341384 - protein, 9 aa, Homo Sapiens
PRSQSRLYV

SEQ ID NO: 1341385 - protein, 9 aa, Homo Sapiens
NSDHVLKRS

SEQ ID NO: 1341386 - protein, 9 aa, Homo Sapiens
NNFQVMIMV

SEQ ID NO: 1341387 - protein, 9 aa, Homo Sapiens
PTAIRQTLY

SEQ ID NO: 1341388 - protein, 9 aa, Homo Sapiens
RTHGQKHQR

SEQ ID NO: 1341389 - protein, 9 aa, Homo Sapiens
KFLEKEVQE

SEQ ID NO: 1341390 - protein, 9 aa, Homo Sapiens
NLGHFTSDM

SEQ ID NO: 1341391 - protein, 9 aa, Homo Sapiens
TPVKLPCLP

SEQ ID NO: 1341392 - protein, 9 aa, Homo Sapiens
IEHFLSKMS

SEQ ID NO: 1341393 - protein, 9 aa, Homo Sapiens
ARHMGKCKV

SEQ ID NO: 1341394 - protein, 9 aa, Homo Sapiens
QCNTTRDNE

SEQ ID NO: 1341395 - protein, 9 aa, Homo Sapiens
FYTHMQTVR

SEQ ID NO: 1341396 - protein, 9 aa, Homo Sapiens
TQFVTSLNF

SEQ ID NO: 1341397 - protein, 9 aa, Homo Sapiens
DTLVGDSVI

SEQ ID NO: 1341398 - protein, 9 aa, Homo Sapiens
SITKGKKSK

SEQ ID NO: 1341399 - protein, 9 aa, Homo Sapiens
EKAHHSKKI

SEQ ID NO: 1341400 - protein, 9 aa, Homo Sapiens
DKGWTYAST

SEQ ID NO: 1341401 - protein, 9 aa, Homo Sapiens
LPSHQASGQ

SEQ ID NO: 1341402 - protein, 9 aa, Homo Sapiens
HPMPVYAFS

SEQ ID NO: 1341403 - protein, 9 aa, Homo Sapiens
QGSGRPRPG

SEQ ID NO: 1341404 - protein, 9 aa, Homo Sapiens
EGWRWGWGQ

SEQ ID NO: 1341405 - protein, 9 aa, Homo Sapiens
VGMPETYQV

SEQ ID NO: 1341406 - protein, 9 aa, Homo Sapiens
TSLSSEGLA

SEQ ID NO: 1341407 - protein, 9 aa, Homo Sapiens
QIDWVALAQ

SEQ ID NO: 1341408 - protein, 9 aa, Homo Sapiens
VEMKKGSND

SEQ ID NO: 1341409 - protein, 9 aa, Homo Sapiens
QLRNAIMKK

SEQ ID NO: 1341410 - protein, 9 aa, Homo Sapiens
RSLIRTGGW

SEQ ID NO: 1341411 - protein, 9 aa, Homo Sapiens
MRYSTSAFG

SEQ ID NO: 1341412 - protein, 9 aa, Homo Sapiens
DLKEDKVTC

SEQ ID NO: 1341413 - protein, 9 aa, Homo Sapiens
LESVDKSVG

SEQ ID NO: 1341414 - protein, 9 aa, Homo Sapiens
DVEVTVCSI

SEQ ID NO: 1341415 - protein, 9 aa, Homo Sapiens
FTEECLAKL

SEQ ID NO: 1341416 - protein, 9 aa, Homo Sapiens
YGLLPSHVS

SEQ ID NO: 1341417 - protein, 9 aa, Homo Sapiens
HYPEESEDI

SEQ ID NO: 1341418 - protein, 9 aa, Homo Sapiens
KLHRVLQAQ

SEQ ID NO: 1341419 - protein, 9 aa, Homo Sapiens
GLYMTTVLT

SEQ ID NO: 1341420 - protein, 9 aa, Homo Sapiens
RLMNSSIYS

SEQ ID NO: 1341421 - protein, 9 aa, Homo Sapiens
SSYWDHCVV

SEQ ID NO: 1341422 - protein, 9 aa, Homo Sapiens
GHISTSPTL

SEQ ID NO: 1341423 - protein, 9 aa, Homo Sapiens
HGHTIISVV

SEQ ID NO: 1341424 - protein, 9 aa, Homo Sapiens
RKQHRSRTT

SEQ ID NO: 1341425 - protein, 9 aa, Homo Sapiens
PPGVATGVV

SEQ ID NO: 1341426 - protein, 9 aa, Homo Sapiens
GEKGPAGEC

SEQ ID NO: 1341427 - protein, 9 aa, Homo Sapiens
CAMGPRVEA

SEQ ID NO: 1341428 - protein, 9 aa, Homo Sapiens
PEAIKSVLL

SEQ ID NO: 1341429 - protein, 9 aa, Homo Sapiens
HMKRVLDAE

SEQ ID NO: 1341430 - protein, 9 aa, Homo Sapiens
SLQRSLFLL

SEQ ID NO: 1341431 - protein, 9 aa, Homo Sapiens
VFENEEHLR

SEQ ID NO: 1341432 - protein, 9 aa, Homo Sapiens
SSTIFPNSY

SEQ ID NO: 1341433 - protein, 9 aa, Homo Sapiens
HQSPSGTRL

SEQ ID NO: 1341434 - protein, 9 aa, Homo Sapiens
RPPIWVIQV

SEQ ID NO: 1341435 - protein, 9 aa, Homo Sapiens
DKSAGENTF

SEQ ID NO: 1341436 - protein, 9 aa, Homo Sapiens
RKELLLKCT

SEQ ID NO: 1341437 - protein, 9 aa, Homo Sapiens
IISLSEPVK

SEQ ID NO: 1341438 - protein, 9 aa, Homo Sapiens
STLRQHHLV

SEQ ID NO: 1341439 - protein, 9 aa, Homo Sapiens
LCVSEQTLQ

SEQ ID NO: 1341440 - protein, 9 aa, Homo Sapiens
ADCKTVVNC

SEQ ID NO: 1341441 - protein, 9 aa, Homo Sapiens
WTWWSAAAT

SEQ ID NO: 1341442 - protein, 9 aa, Homo Sapiens
KPVCVFRLI

SEQ ID NO: 1341443 - protein, 9 aa, Homo Sapiens
EFVEAEDGG

SEQ ID NO: 1341444 - protein, 9 aa, Homo Sapiens
HESGLFCAM

SEQ ID NO: 1341445 - protein, 9 aa, Homo Sapiens
KHNQAKEKL

SEQ ID NO: 1341446 - protein, 9 aa, Homo Sapiens
ELFSVCVQM

SEQ ID NO: 1341447 - protein, 9 aa, Homo Sapiens
LLSEHTTIP

SEQ ID NO: 1341448 - protein, 9 aa, Homo Sapiens
IKDDIIYLT

SEQ ID NO: 1341449 - protein, 9 aa, Homo Sapiens
SMNDGFFLK

SEQ ID NO: 1341450 - protein, 9 aa, Homo Sapiens
KVIEPGCIR

SEQ ID NO: 1341451 - protein, 9 aa, Homo Sapiens
RENHTSLEL

SEQ ID NO: 1341452 - protein, 9 aa, Homo Sapiens
RSFYGGLDD

SEQ ID NO: 1341453 - protein, 9 aa, Homo Sapiens
QNSYHNAVH

SEQ ID NO: 1341454 - protein, 9 aa, Homo Sapiens
SEQYSLDGK

SEQ ID NO: 1341455 - protein, 9 aa, Homo Sapiens
LFKLYIVMS

SEQ ID NO: 1341456 - protein, 9 aa, Homo Sapiens
EGAVNKVLL

SEQ ID NO: 1341457 - protein, 9 aa, Homo Sapiens
CQDVHKNST

SEQ ID NO: 1341458 - protein, 9 aa, Homo Sapiens
IREGWRWGW

SEQ ID NO: 1341459 - protein, 9 aa, Homo Sapiens
RSCMVLRAT

SEQ ID NO: 1341460 - protein, 9 aa, Homo Sapiens
ASKAVVNAT

SEQ ID NO: 1341461 - protein, 9 aa, Homo Sapiens
ITDREEKHN

SEQ ID NO: 1341462 - protein, 9 aa, Homo Sapiens
FTTQLGAYC

SEQ ID NO: 1341463 - protein, 9 aa, Homo Sapiens
TQDLGLELA

SEQ ID NO: 1341464 - protein, 9 aa, Homo Sapiens
LEEVKMTAV

SEQ ID NO: 1341465 - protein, 9 aa, Homo Sapiens
NEDYKSYQV

SEQ ID NO: 1341466 - protein, 9 aa, Homo Sapiens
GCSPPYQLD

SEQ ID NO: 1341467 - protein, 9 aa, Homo Sapiens
ATTSVTIFP

SEQ ID NO: 1341468 - protein, 9 aa, Homo Sapiens
AEEAEPIMF

SEQ ID NO: 1341469 - protein, 9 aa, Homo Sapiens
LHHYIEDER

SEQ ID NO: 1341470 - protein, 9 aa, Homo Sapiens
KQKADKNCA

SEQ ID NO: 1341471 - protein, 9 aa, Homo Sapiens
STQVQQYQQ

SEQ ID NO: 1341472 - protein, 9 aa, Homo Sapiens
RVGKRHAGL

SEQ ID NO: 1341473 - protein, 9 aa, Homo Sapiens
LLFFPSCTY

SEQ ID NO: 1341474 - protein, 9 aa, Homo Sapiens
KAADMWSLG

SEQ ID NO: 1341475 - protein, 9 aa, Homo Sapiens
AAERYTNFC

SEQ ID NO: 1341476 - protein, 9 aa, Homo Sapiens
NQCQEVLYH

SEQ ID NO: 1341477 - protein, 9 aa, Homo Sapiens
CCPTDGTAA

SEQ ID NO: 1341478 - protein, 9 aa, Homo Sapiens
SPKSVSSHS

SEQ ID NO: 1341479 - protein, 9 aa, Homo Sapiens
AHWMWQLVS

SEQ ID NO: 1341480 - protein, 9 aa, Homo Sapiens
AILQQVVNL

SEQ ID NO: 1341481 - protein, 9 aa, Homo Sapiens
PMEQAHYLE

SEQ ID NO: 1341482 - protein, 9 aa, Homo Sapiens
PKHEWKIAA

SEQ ID NO: 1341483 - protein, 9 aa, Homo Sapiens
HRTQLRKKP

SEQ ID NO: 1341484 - protein, 9 aa, Homo Sapiens
LVKNKPPQH

SEQ ID NO: 1341485 - protein, 9 aa, Homo Sapiens
LVSAKTILE

SEQ ID NO: 1341486 - protein, 9 aa, Homo Sapiens
PKSFWICLL

SEQ ID NO: 1341487 - protein, 9 aa, Homo Sapiens
PHLRFTRPL

SEQ ID NO: 1341488 - protein, 9 aa, Homo Sapiens
EDSPSRQSH

SEQ ID NO: 1341489 - protein, 9 aa, Homo Sapiens
NLVAFMIQE

SEQ ID NO: 1341490 - protein, 9 aa, Homo Sapiens
HPITGTHLY

SEQ ID NO: 1341491 - protein, 9 aa, Homo Sapiens
LVLEPPVIV

SEQ ID NO: 1341492 - protein, 9 aa, Homo Sapiens
SFLVFIREV

SEQ ID NO: 1341493 - protein, 9 aa, Homo Sapiens
KKPQGDDNH

SEQ ID NO: 1341494 - protein, 9 aa, Homo Sapiens
IHSSVEILR

SEQ ID NO: 1341495 - protein, 9 aa, Homo Sapiens
LYLPLRADG

SEQ ID NO: 1341496 - protein, 9 aa, Homo Sapiens
KTKLLLFKE

SEQ ID NO: 1341497 - protein, 9 aa, Homo Sapiens
HVYSHTIYP

SEQ ID NO: 1341498 - protein, 9 aa, Homo Sapiens
VVAFLGCMD

SEQ ID NO: 1341499 - protein, 9 aa, Homo Sapiens
SYLLHHQRT

SEQ ID NO: 1341500 - protein, 9 aa, Homo Sapiens
VHWQTYVSG

SEQ ID NO: 1341501 - protein, 9 aa, Homo Sapiens
DPQYRARGS

SEQ ID NO: 1341502 - protein, 9 aa, Homo Sapiens
QLSGFDQAH

SEQ ID NO: 1341503 - protein, 9 aa, Homo Sapiens
FVLEDFKQA

SEQ ID NO: 1341504 - protein, 9 aa, Homo Sapiens
FSLPIILMT

SEQ ID NO: 1341505 - protein, 9 aa, Homo Sapiens
PGLYRLEHA

SEQ ID NO: 1341506 - protein, 9 aa, Homo Sapiens
STMLQGQQQ

SEQ ID NO: 1341507 - protein, 9 aa, Homo Sapiens
DVDVVEIKI

SEQ ID NO: 1341508 - protein, 9 aa, Homo Sapiens
SWIHCIICN

SEQ ID NO: 1341509 - protein, 9 aa, Homo Sapiens
LIMAPSGVE

SEQ ID NO: 1341510 - protein, 9 aa, Homo Sapiens
NKHHPTFTR

SEQ ID NO: 1341511 - protein, 9 aa, Homo Sapiens
WGVHRRSLD

SEQ ID NO: 1341512 - protein, 9 aa, Homo Sapiens
KVAHSILSG

SEQ ID NO: 1341513 - protein, 9 aa, Homo Sapiens
DAVSEMTWR

SEQ ID NO: 1341514 - protein, 9 aa, Homo Sapiens
LPGTIAPLQ

SEQ ID NO: 1341515 - protein, 9 aa, Homo Sapiens
AVELLFRDI

SEQ ID NO: 1341516 - protein, 9 aa, Homo Sapiens
TLNKFGCRP

SEQ ID NO: 1341517 - protein, 9 aa, Homo Sapiens
AGEWGTIGD

SEQ ID NO: 1341518 - protein, 9 aa, Homo Sapiens
KSLSDPSTE

SEQ ID NO: 1341519 - protein, 9 aa, Homo Sapiens
VLYLVMLVN

SEQ ID NO: 1341520 - protein, 9 aa, Homo Sapiens
HRCLLFMKL

SEQ ID NO: 1341521 - protein, 9 aa, Homo Sapiens
QIQLDDIVI

SEQ ID NO: 1341522 - protein, 9 aa, Homo Sapiens
LRNTSGLTA

SEQ ID NO: 1341523 - protein, 9 aa, Homo Sapiens
ALSPNPEVM

SEQ ID NO: 1341524 - protein, 9 aa, Homo Sapiens
GQPQPPILG

SEQ ID NO: 1341525 - protein, 9 aa, Homo Sapiens
TFQGSTVVW

SEQ ID NO: 1341526 - protein, 9 aa, Homo Sapiens
AAIASFDQL

SEQ ID NO: 1341527 - protein, 9 aa, Homo Sapiens
QTDFTYDSD

SEQ ID NO: 1341528 - protein, 9 aa, Homo Sapiens
HVLVKRKPP

SEQ ID NO: 1341529 - protein, 9 aa, Homo Sapiens
LKLILSTQD

SEQ ID NO: 1341530 - protein, 9 aa, Homo Sapiens
EEKFRANAT

SEQ ID NO: 1341531 - protein, 9 aa, Homo Sapiens
YIHKKTRLL

SEQ ID NO: 1341532 - protein, 9 aa, Homo Sapiens
CAHNATCTH

SEQ ID NO: 1341533 - protein, 9 aa, Homo Sapiens
TATSHLAHP

SEQ ID NO: 1341534 - protein, 9 aa, Homo Sapiens
EGTGPSIQL

SEQ ID NO: 1341535 - protein, 9 aa, Homo Sapiens
PQELVLFNC

SEQ ID NO: 1341536 - protein, 9 aa, Homo Sapiens
VSKVLLKPI

SEQ ID NO: 1341537 - protein, 9 aa, Homo Sapiens
SPLKLLADL

SEQ ID NO: 1341538 - protein, 9 aa, Homo Sapiens
EPWSAQLEK

SEQ ID NO: 1341539 - protein, 9 aa, Homo Sapiens
RRSSKKKPL

SEQ ID NO: 1341540 - protein, 9 aa, Homo Sapiens
FGNSTLAMG

SEQ ID NO: 1341541 - protein, 9 aa, Homo Sapiens
VRPAPLIMG

SEQ ID NO: 1341542 - protein, 9 aa, Homo Sapiens
VHISDSHLK

SEQ ID NO: 1341543 - protein, 9 aa, Homo Sapiens
RMGERGVFP

SEQ ID NO: 1341544 - protein, 9 aa, Homo Sapiens
SHVYIVWNL

SEQ ID NO: 1341545 - protein, 9 aa, Homo Sapiens
EKHNIYKRT

SEQ ID NO: 1341546 - protein, 9 aa, Homo Sapiens
GGFSFLLWT

SEQ ID NO: 1341547 - protein, 9 aa, Homo Sapiens
RQKAIHLIA

SEQ ID NO: 1341548 - protein, 9 aa, Homo Sapiens
LWEVWAPPS

SEQ ID NO: 1341549 - protein, 9 aa, Homo Sapiens
EENIIIKLN

SEQ ID NO: 1341550 - protein, 9 aa, Homo Sapiens
YISILLGND

SEQ ID NO: 1341551 - protein, 9 aa, Homo Sapiens
GRRSARAPP

SEQ ID NO: 1341552 - protein, 9 aa, Homo Sapiens
GTWRTEVVF

SEQ ID NO: 1341553 - protein, 9 aa, Homo Sapiens
FEADRHAFI

SEQ ID NO: 1341554 - protein, 9 aa, Homo Sapiens
TLEDTLHCF

SEQ ID NO: 1341555 - protein, 9 aa, Homo Sapiens
APARRPSAA

SEQ ID NO: 1341556 - protein, 9 aa, Homo Sapiens
CFGPDSTGP

SEQ ID NO: 1341557 - protein, 9 aa, Homo Sapiens
HLSANARHL

SEQ ID NO: 1341558 - protein, 9 aa, Homo Sapiens
LSQMYHYNA

SEQ ID NO: 1341559 - protein, 9 aa, Homo Sapiens
EQSLILRQF

SEQ ID NO: 1341560 - protein, 9 aa, Homo Sapiens
NVAGLIFYL

SEQ ID NO: 1341561 - protein, 9 aa, Homo Sapiens
GISGLESFQ

SEQ ID NO: 1341562 - protein, 9 aa, Homo Sapiens
PTSAISSPA

SEQ ID NO: 1341563 - protein, 9 aa, Homo Sapiens
DHIKAHGDW

SEQ ID NO: 1341564 - protein, 9 aa, Homo Sapiens
MLAVYLYEV

SEQ ID NO: 1341565 - protein, 9 aa, Homo Sapiens
VIYCRVWCW

SEQ ID NO: 1341566 - protein, 9 aa, Homo Sapiens
ITAVTVGYF

SEQ ID NO: 1341567 - protein, 9 aa, Homo Sapiens
PKSPANGVV

SEQ ID NO: 1341568 - protein, 9 aa, Homo Sapiens
LGDFTALLH

SEQ ID NO: 1341569 - protein, 9 aa, Homo Sapiens
TKRCSPSLS

SEQ ID NO: 1341570 - protein, 9 aa, Homo Sapiens
ATPNRYHYY

SEQ ID NO: 1341571 - protein, 9 aa, Homo Sapiens
PQGPLFLLF

SEQ ID NO: 1341572 - protein, 9 aa, Homo Sapiens
PAKQREHLL

SEQ ID NO: 1341573 - protein, 9 aa, Homo Sapiens
TRHLGAAVS

SEQ ID NO: 1341574 - protein, 9 aa, Homo Sapiens
TLSPVTQCV

SEQ ID NO: 1341575 - protein, 9 aa, Homo Sapiens
LIYCRLRKP

SEQ ID NO: 1341576 - protein, 9 aa, Homo Sapiens
DTVVGDDQW

SEQ ID NO: 1341577 - protein, 9 aa, Homo Sapiens
PPFPAHVVP

SEQ ID NO: 1341578 - protein, 9 aa, Homo Sapiens
EKHNFIALE

SEQ ID NO: 1341579 - protein, 9 aa, Homo Sapiens
KHLCLSLNE

SEQ ID NO: 1341580 - protein, 9 aa, Homo Sapiens
VDFQLVLPG

SEQ ID NO: 1341581 - protein, 9 aa, Homo Sapiens
DTSTMSLEL

SEQ ID NO: 1341582 - protein, 9 aa, Homo Sapiens
DINYQELTS

SEQ ID NO: 1341583 - protein, 9 aa, Homo Sapiens
LHKLVFSRC

SEQ ID NO: 1341584 - protein, 9 aa, Homo Sapiens
LLSQMYHYN

SEQ ID NO: 1341585 - protein, 9 aa, Homo Sapiens
VKADQIDKL

SEQ ID NO: 1341586 - protein, 9 aa, Homo Sapiens
FKVIIDGVE

SEQ ID NO: 1341587 - protein, 9 aa, Homo Sapiens
LHAMNSLST

SEQ ID NO: 1341588 - protein, 9 aa, Homo Sapiens
KGKKGESGA

SEQ ID NO: 1341589 - protein, 9 aa, Homo Sapiens
VVMVIDRIF

SEQ ID NO: 1341590 - protein, 9 aa, Homo Sapiens
SAPRKKQIV

SEQ ID NO: 1341591 - protein, 9 aa, Homo Sapiens
VKVIEKKTR

SEQ ID NO: 1341592 - protein, 9 aa, Homo Sapiens
HNRQIYPPS

SEQ ID NO: 1341593 - protein, 9 aa, Homo Sapiens
VTAEKCLHK

SEQ ID NO: 1341594 - protein, 9 aa, Homo Sapiens
LINEYRSHQ

SEQ ID NO: 1341595 - protein, 9 aa, Homo Sapiens
TLNNNNISH

SEQ ID NO: 1341596 - protein, 9 aa, Homo Sapiens
NILTQLEMT

SEQ ID NO: 1341597 - protein, 9 aa, Homo Sapiens
ENHTSLELC

SEQ ID NO: 1341598 - protein, 9 aa, Homo Sapiens
SLPSRWDDR

SEQ ID NO: 1341599 - protein, 9 aa, Homo Sapiens
ITLVHWENE

SEQ ID NO: 1341600 - protein, 9 aa, Homo Sapiens
HNLWKFCRD

SEQ ID NO: 1341601 - protein, 9 aa, Homo Sapiens
ACFGLDQQN

SEQ ID NO: 1341602 - protein, 9 aa, Homo Sapiens
KEDPKAMLS

SEQ ID NO: 1341603 - protein, 9 aa, Homo Sapiens
TAKGDIYAK

SEQ ID NO: 1341604 - protein, 9 aa, Homo Sapiens
CQCLAPARG

SEQ ID NO: 1341605 - protein, 9 aa, Homo Sapiens
LGGNSHTIM

SEQ ID NO: 1341606 - protein, 9 aa, Homo Sapiens
EELLKKCSL

SEQ ID NO: 1341607 - protein, 9 aa, Homo Sapiens
LQELSPTEE

SEQ ID NO: 1341608 - protein, 9 aa, Homo Sapiens
KLNAVISFL

SEQ ID NO: 1341609 - protein, 9 aa, Homo Sapiens
AKRVKVQDP

SEQ ID NO: 1341610 - protein, 9 aa, Homo Sapiens
THLVGPVMM

SEQ ID NO: 1341611 - protein, 9 aa, Homo Sapiens
DIINASGYH

SEQ ID NO: 1341612 - protein, 9 aa, Homo Sapiens
IPWQGLLLI

SEQ ID NO: 1341613 - protein, 9 aa, Homo Sapiens
FHSKVLKDL

SEQ ID NO: 1341614 - protein, 9 aa, Homo Sapiens
TVTEEDVKM

SEQ ID NO: 1341615 - protein, 9 aa, Homo Sapiens
CSPHKNPCK

SEQ ID NO: 1341616 - protein, 9 aa, Homo Sapiens
LAEHCFSRG

SEQ ID NO: 1341617 - protein, 9 aa, Homo Sapiens
VPDTHKDHA

SEQ ID NO: 1341618 - protein, 9 aa, Homo Sapiens
LLLLLLDLP

SEQ ID NO: 1341619 - protein, 9 aa, Homo Sapiens
EDLNQFLSR

SEQ ID NO: 1341620 - protein, 9 aa, Homo Sapiens
PPFVPYSQI

SEQ ID NO: 1341621 - protein, 9 aa, Homo Sapiens
LCPEEVKKP

SEQ ID NO: 1341622 - protein, 9 aa, Homo Sapiens
QLLLAKVMC

SEQ ID NO: 1341623 - protein, 9 aa, Homo Sapiens
AVDGVRAFL

SEQ ID NO: 1341624 - protein, 9 aa, Homo Sapiens
EFEKEEDYE

SEQ ID NO: 1341625 - protein, 9 aa, Homo Sapiens
LAAFEVKHF

SEQ ID NO: 1341626 - protein, 9 aa, Homo Sapiens
TILYACRQD

SEQ ID NO: 1341627 - protein, 9 aa, Homo Sapiens
HDMLASFLR

SEQ ID NO: 1341628 - protein, 9 aa, Homo Sapiens
GATLFPRKP

SEQ ID NO: 1341629 - protein, 9 aa, Homo Sapiens
TTVAEKPNN

SEQ ID NO: 1341630 - protein, 9 aa, Homo Sapiens
CKAVAEELA

SEQ ID NO: 1341631 - protein, 9 aa, Homo Sapiens
LRHLEGGIT

SEQ ID NO: 1341632 - protein, 9 aa, Homo Sapiens
VCAGYEAFR

SEQ ID NO: 1341633 - protein, 9 aa, Homo Sapiens
KFMSDRSSN

SEQ ID NO: 1341634 - protein, 9 aa, Homo Sapiens
KEERTLVND

SEQ ID NO: 1341635 - protein, 9 aa, Homo Sapiens
DPWCVAKMV

SEQ ID NO: 1341636 - protein, 9 aa, Homo Sapiens
DKNGQNNSC

SEQ ID NO: 1341637 - protein, 9 aa, Homo Sapiens
SWARGRDTC

SEQ ID NO: 1341638 - protein, 9 aa, Homo Sapiens
QGEPLGYHQ

SEQ ID NO: 1341639 - protein, 9 aa, Homo Sapiens
ILLRRSMAE

SEQ ID NO: 1341640 - protein, 9 aa, Homo Sapiens
LAAYPQTSG

SEQ ID NO: 1341641 - protein, 9 aa, Homo Sapiens
MEPTLQLLR

SEQ ID NO: 1341642 - protein, 9 aa, Homo Sapiens
ATAKTQFLQ

SEQ ID NO: 1341643 - protein, 9 aa, Homo Sapiens
GEKKMLEQI

SEQ ID NO: 1341644 - protein, 9 aa, Homo Sapiens
HILTLQEEE

SEQ ID NO: 1341645 - protein, 9 aa, Homo Sapiens
PSRTWQGNG

SEQ ID NO: 1341646 - protein, 9 aa, Homo Sapiens
IAMCLWKNH

SEQ ID NO: 1341647 - protein, 9 aa, Homo Sapiens
DANPGICDK

SEQ ID NO: 1341648 - protein, 9 aa, Homo Sapiens
VLLLLHLSP

SEQ ID NO: 1341649 - protein, 9 aa, Homo Sapiens
EQQIRLVVS

SEQ ID NO: 1341650 - protein, 9 aa, Homo Sapiens
SHRSEATDL

SEQ ID NO: 1341651 - protein, 9 aa, Homo Sapiens
LIIGTTSHK

SEQ ID NO: 1341652 - protein, 9 aa, Homo Sapiens
DCAHFVCSS

SEQ ID NO: 1341653 - protein, 9 aa, Homo Sapiens
IHINNKLRW

SEQ ID NO: 1341654 - protein, 9 aa, Homo Sapiens
IPSVVRGAY

SEQ ID NO: 1341655 - protein, 9 aa, Homo Sapiens
APSNLKRVS

SEQ ID NO: 1341656 - protein, 9 aa, Homo Sapiens
WRDDQCPAG

SEQ ID NO: 1341657 - protein, 9 aa, Homo Sapiens
TFGFLGNVC

SEQ ID NO: 1341658 - protein, 9 aa, Homo Sapiens
KRIQINFVF

SEQ ID NO: 1341659 - protein, 9 aa, Homo Sapiens
HVSELDTQD

SEQ ID NO: 1341660 - protein, 9 aa, Homo Sapiens
KVWQKSEVD

SEQ ID NO: 1341661 - protein, 9 aa, Homo Sapiens
GLTAVVLSA

SEQ ID NO: 1341662 - protein, 9 aa, Homo Sapiens
MGTRATSTG

SEQ ID NO: 1341663 - protein, 9 aa, Homo Sapiens
PRDARMHLM

SEQ ID NO: 1341664 - protein, 9 aa, Homo Sapiens
GDTYNMRHP

SEQ ID NO: 1341665 - protein, 9 aa, Homo Sapiens
VEKEAPDVH

SEQ ID NO: 1341666 - protein, 9 aa, Homo Sapiens
NHPKGCDNI

SEQ ID NO: 1341667 - protein, 9 aa, Homo Sapiens
CYPHVSPSD

SEQ ID NO: 1341668 - protein, 9 aa, Homo Sapiens
EDDIPFTAR

SEQ ID NO: 1341669 - protein, 9 aa, Homo Sapiens
IFAFATCSS

SEQ ID NO: 1341670 - protein, 9 aa, Homo Sapiens
DDTMVDYFF

SEQ ID NO: 1341671 - protein, 9 aa, Homo Sapiens
ILTEKEIFE

SEQ ID NO: 1341672 - protein, 9 aa, Homo Sapiens
DEMTKLLQD

SEQ ID NO: 1341673 - protein, 9 aa, Homo Sapiens
TCSERQLLR

SEQ ID NO: 1341674 - protein, 9 aa, Homo Sapiens
SQGATCTGA

SEQ ID NO: 1341675 - protein, 9 aa, Homo Sapiens
LPQGAGSPT

SEQ ID NO: 1341676 - protein, 9 aa, Homo Sapiens
VCCEVSTRF

SEQ ID NO: 1341677 - protein, 9 aa, Homo Sapiens
SPPVEQQLV

SEQ ID NO: 1341678 - protein, 9 aa, Homo Sapiens
HIPLLRDSE

SEQ ID NO: 1341679 - protein, 9 aa, Homo Sapiens
CHHPSYAQN

SEQ ID NO: 1341680 - protein, 9 aa, Homo Sapiens
FYLAAPRGV

SEQ ID NO: 1341681 - protein, 9 aa, Homo Sapiens
TATRNFGFI

SEQ ID NO: 1341682 - protein, 9 aa, Homo Sapiens
GGKVSLWDC

SEQ ID NO: 1341683 - protein, 9 aa, Homo Sapiens
CCHFCYPCS

SEQ ID NO: 1341684 - protein, 9 aa, Homo Sapiens
KSVPPQSRL

SEQ ID NO: 1341685 - protein, 9 aa, Homo Sapiens
ICISRRERK

SEQ ID NO: 1341686 - protein, 9 aa, Homo Sapiens
MYVVRGRDG

SEQ ID NO: 1341687 - protein, 9 aa, Homo Sapiens
TLRSFREFS

SEQ ID NO: 1341688 - protein, 9 aa, Homo Sapiens
IAQPVGSSV

SEQ ID NO: 1341689 - protein, 9 aa, Homo Sapiens
REALQVPAV

SEQ ID NO: 1341690 - protein, 9 aa, Homo Sapiens
KSLPSSTTT

SEQ ID NO: 1341691 - protein, 9 aa, Homo Sapiens
YVHIKHAPA

SEQ ID NO: 1341692 - protein, 9 aa, Homo Sapiens
RQKDDLVAN

SEQ ID NO: 1341693 - protein, 9 aa, Homo Sapiens
IWSFGVLLW

SEQ ID NO: 1341694 - protein, 9 aa, Homo Sapiens
VKLHPEVWE

SEQ ID NO: 1341695 - protein, 9 aa, Homo Sapiens
IMAPSGVEA

SEQ ID NO: 1341696 - protein, 9 aa, Homo Sapiens
DVDSLSEYS

SEQ ID NO: 1341697 - protein, 9 aa, Homo Sapiens
TLSPGSTTS

SEQ ID NO: 1341698 - protein, 9 aa, Homo Sapiens
RAILCIEVE

SEQ ID NO: 1341699 - protein, 9 aa, Homo Sapiens
HSRMKHEVS

SEQ ID NO: 1341700 - protein, 9 aa, Homo Sapiens
VAQPPAVAP

SEQ ID NO: 1341701 - protein, 9 aa, Homo Sapiens
LGSAYYLTS

SEQ ID NO: 1341702 - protein, 9 aa, Homo Sapiens
AWRYQLLLK

SEQ ID NO: 1341703 - protein, 9 aa, Homo Sapiens
QYSLDGKKL

SEQ ID NO: 1341704 - protein, 9 aa, Homo Sapiens
LVLIYWVSI

SEQ ID NO: 1341705 - protein, 9 aa, Homo Sapiens
KEGCRPRTF

SEQ ID NO: 1341706 - protein, 9 aa, Homo Sapiens
DVAFLVLDE

SEQ ID NO: 1341707 - protein, 9 aa, Homo Sapiens
KMCILDQYS

SEQ ID NO: 1341708 - protein, 9 aa, Homo Sapiens
FKKAGVKTQ

SEQ ID NO: 1341709 - protein, 9 aa, Homo Sapiens
VVESFVPHI

SEQ ID NO: 1341710 - protein, 9 aa, Homo Sapiens
LPHELGDFT

SEQ ID NO: 1341711 - protein, 9 aa, Homo Sapiens
PLGGLPSHQ

SEQ ID NO: 1341712 - protein, 9 aa, Homo Sapiens
GMSPILTSG

SEQ ID NO: 1341713 - protein, 9 aa, Homo Sapiens
ASPNLDKRQ

SEQ ID NO: 1341714 - protein, 9 aa, Homo Sapiens
PTSAAPAAR

SEQ ID NO: 1341715 - protein, 9 aa, Homo Sapiens
RSGNASTMA

SEQ ID NO: 1341716 - protein, 9 aa, Homo Sapiens
GNSHTIMIA

SEQ ID NO: 1341717 - protein, 9 aa, Homo Sapiens
IKSAFAPFD

SEQ ID NO: 1341718 - protein, 9 aa, Homo Sapiens
KVPSEVPSP

SEQ ID NO: 1341719 - protein, 9 aa, Homo Sapiens
ILKQLVVTL

SEQ ID NO: 1341720 - protein, 9 aa, Homo Sapiens
LEDTLHCFF

SEQ ID NO: 1341721 - protein, 9 aa, Homo Sapiens
ELEVALQRG

SEQ ID NO: 1341722 - protein, 9 aa, Homo Sapiens
TILESSSYL

SEQ ID NO: 1341723 - protein, 9 aa, Homo Sapiens
PSPHMTSPF

SEQ ID NO: 1341724 - protein, 9 aa, Homo Sapiens
FSVGQPEMT

SEQ ID NO: 1341725 - protein, 9 aa, Homo Sapiens
EKCRQIYGQ

SEQ ID NO: 1341726 - protein, 9 aa, Homo Sapiens
WEISVCGNV

SEQ ID NO: 1341727 - protein, 9 aa, Homo Sapiens
LPEDAIIYC

SEQ ID NO: 1341728 - protein, 9 aa, Homo Sapiens
FIHRDLTAR

SEQ ID NO: 1341729 - protein, 9 aa, Homo Sapiens
IQAPAKMSS

SEQ ID NO: 1341730 - protein, 9 aa, Homo Sapiens
HEEDTLLKE

SEQ ID NO: 1341731 - protein, 9 aa, Homo Sapiens
PTDLQLLFV

SEQ ID NO: 1341732 - protein, 9 aa, Homo Sapiens
ITGAVIIST

SEQ ID NO: 1341733 - protein, 9 aa, Homo Sapiens
MFKLQSGTE

SEQ ID NO: 1341734 - protein, 9 aa, Homo Sapiens
GSGPYSAPP

SEQ ID NO: 1341735 - protein, 9 aa, Homo Sapiens
KLKKADVVR

SEQ ID NO: 1341736 - protein, 9 aa, Homo Sapiens
QCGKAFICG

SEQ ID NO: 1341737 - protein, 9 aa, Homo Sapiens
DSHLNLDEM

SEQ ID NO: 1341738 - protein, 9 aa, Homo Sapiens
FINTQLYIH

SEQ ID NO: 1341739 - protein, 9 aa, Homo Sapiens
QQQQQQSEE

SEQ ID NO: 1341740 - protein, 9 aa, Homo Sapiens
AGKTEVSKY

SEQ ID NO: 1341741 - protein, 9 aa, Homo Sapiens
ATQPTKEGM

SEQ ID NO: 1341742 - protein, 9 aa, Homo Sapiens
LTAVVLSAH

SEQ ID NO: 1341743 - protein, 9 aa, Homo Sapiens
AIHSHHTIL

SEQ ID NO: 1341744 - protein, 9 aa, Homo Sapiens
SKSICLITL

SEQ ID NO: 1341745 - protein, 9 aa, Homo Sapiens
IPLLRKCWF

SEQ ID NO: 1341746 - protein, 9 aa, Homo Sapiens
SQLTEHKII

SEQ ID NO: 1341747 - protein, 9 aa, Homo Sapiens
MLKEDVSYI

SEQ ID NO: 1341748 - protein, 9 aa, Homo Sapiens
VEWCWHPYT

SEQ ID NO: 1341749 - protein, 9 aa, Homo Sapiens
IMGFMLVTA

SEQ ID NO: 1341750 - protein, 9 aa, Homo Sapiens
IDLNHISTI

SEQ ID NO: 1341751 - protein, 9 aa, Homo Sapiens
TGAIDDLEE

SEQ ID NO: 1341752 - protein, 9 aa, Homo Sapiens
LNGLSIPVD

SEQ ID NO: 1341753 - protein, 9 aa, Homo Sapiens
RRRRHRSFS

SEQ ID NO: 1341754 - protein, 9 aa, Homo Sapiens
EADLADGAH

SEQ ID NO: 1341755 - protein, 9 aa, Homo Sapiens
PAADWHYLV

SEQ ID NO: 1341756 - protein, 9 aa, Homo Sapiens
YKAETLMQA

SEQ ID NO: 1341757 - protein, 9 aa, Homo Sapiens
GPPRSMPLE

SEQ ID NO: 1341758 - protein, 9 aa, Homo Sapiens
RRLQKPCFF

SEQ ID NO: 1341759 - protein, 9 aa, Homo Sapiens
THKGEIPKD

SEQ ID NO: 1341760 - protein, 9 aa, Homo Sapiens
DPHHVQGKS

SEQ ID NO: 1341761 - protein, 9 aa, Homo Sapiens
RTAVERSLK

SEQ ID NO: 1341762 - protein, 9 aa, Homo Sapiens
QAFELCFKQ

SEQ ID NO: 1341763 - protein, 9 aa, Homo Sapiens
FCGPNEIYN

SEQ ID NO: 1341764 - protein, 9 aa, Homo Sapiens
YQLEKEDTV

SEQ ID NO: 1341765 - protein, 9 aa, Homo Sapiens
DFVPNALRY

SEQ ID NO: 1341766 - protein, 9 aa, Homo Sapiens
NNNPITMQT

SEQ ID NO: 1341767 - protein, 9 aa, Homo Sapiens
SSWTDMDTP

SEQ ID NO: 1341768 - protein, 9 aa, Homo Sapiens
TFRDRLIFL

SEQ ID NO: 1341769 - protein, 9 aa, Homo Sapiens
TWHNTCFIC

SEQ ID NO: 1341770 - protein, 9 aa, Homo Sapiens
YLGHDPVHK

SEQ ID NO: 1341771 - protein, 9 aa, Homo Sapiens
WMMNIKEDT

SEQ ID NO: 1341772 - protein, 9 aa, Homo Sapiens
PKRGRSKSK

SEQ ID NO: 1341773 - protein, 9 aa, Homo Sapiens
CCLEEFSAT

SEQ ID NO: 1341774 - protein, 9 aa, Homo Sapiens
PVVYDFGDT

SEQ ID NO: 1341775 - protein, 9 aa, Homo Sapiens
CWSCEHLIM

SEQ ID NO: 1341776 - protein, 9 aa, Homo Sapiens
ILHQPEMAA

SEQ ID NO: 1341777 - protein, 9 aa, Homo Sapiens
RRQPEQARW

SEQ ID NO: 1341778 - protein, 9 aa, Homo Sapiens
LMAQAFESY

SEQ ID NO: 1341779 - protein, 9 aa, Homo Sapiens
CQATGQPPA

SEQ ID NO: 1341780 - protein, 9 aa, Homo Sapiens
TEAESNMNN

SEQ ID NO: 1341781 - protein, 9 aa, Homo Sapiens
KIIGRAITS

SEQ ID NO: 1341782 - protein, 9 aa, Homo Sapiens
TPVRSPTSA

SEQ ID NO: 1341783 - protein, 9 aa, Homo Sapiens
FFPNMYPGE

SEQ ID NO: 1341784 - protein, 9 aa, Homo Sapiens
STRGPFGGP

SEQ ID NO: 1341785 - protein, 9 aa, Homo Sapiens
TLQGALEQA

SEQ ID NO: 1341786 - protein, 9 aa, Homo Sapiens
KNRFSLALE

SEQ ID NO: 1341787 - protein, 9 aa, Homo Sapiens
KESSKSPKM

SEQ ID NO: 1341788 - protein, 9 aa, Homo Sapiens
RGSGPGRRL

SEQ ID NO: 1341789 - protein, 9 aa, Homo Sapiens
TGCDQEMAG

SEQ ID NO: 1341790 - protein, 9 aa, Homo Sapiens
VETEDTGVL

SEQ ID NO: 1341791 - protein, 9 aa, Homo Sapiens
GITLIGEPA

SEQ ID NO: 1341792 - protein, 9 aa, Homo Sapiens
YIKINQSIQ

SEQ ID NO: 1341793 - protein, 9 aa, Homo Sapiens
KQSCRKVME

SEQ ID NO: 1341794 - protein, 9 aa, Homo Sapiens
GPLLERVTV

SEQ ID NO: 1341795 - protein, 9 aa, Homo Sapiens
EPHEMSALW

SEQ ID NO: 1341796 - protein, 9 aa, Homo Sapiens
CYADFAPSL

SEQ ID NO: 1341797 - protein, 9 aa, Homo Sapiens
DRISTAGYI

SEQ ID NO: 1341798 - protein, 9 aa, Homo Sapiens
RGAVFQHGM

SEQ ID NO: 1341799 - protein, 9 aa, Homo Sapiens
FQVIQPERV

SEQ ID NO: 1341800 - protein, 9 aa, Homo Sapiens
LCSPLRLSE

SEQ ID NO: 1341801 - protein, 9 aa, Homo Sapiens
ALAAQQQAT

SEQ ID NO: 1341802 - protein, 9 aa, Homo Sapiens
KEMPTPQRK

SEQ ID NO: 1341803 - protein, 9 aa, Homo Sapiens
AQRQAKVWM

SEQ ID NO: 1341804 - protein, 9 aa, Homo Sapiens
KKRNRAIMA

SEQ ID NO: 1341805 - protein, 9 aa, Homo Sapiens
MPLLMYTCL

SEQ ID NO: 1341806 - protein, 9 aa, Homo Sapiens
FVTPVIHSN

SEQ ID NO: 1341807 - protein, 9 aa, Homo Sapiens
DGLVMTWSM

SEQ ID NO: 1341808 - protein, 9 aa, Homo Sapiens
PDWHLKIPK

SEQ ID NO: 1341809 - protein, 9 aa, Homo Sapiens
AVKGDTAEM

SEQ ID NO: 1341810 - protein, 9 aa, Homo Sapiens
GPSEALTML

SEQ ID NO: 1341811 - protein, 9 aa, Homo Sapiens
MHNHPPRKI

SEQ ID NO: 1341812 - protein, 9 aa, Homo Sapiens
WGSLGDSDG

SEQ ID NO: 1341813 - protein, 9 aa, Homo Sapiens
SLIQLTQGG

SEQ ID NO: 1341814 - protein, 9 aa, Homo Sapiens
DIESIMALN

SEQ ID NO: 1341815 - protein, 9 aa, Homo Sapiens
LKQKSEEPL

SEQ ID NO: 1341816 - protein, 9 aa, Homo Sapiens
QTTIGYGYH

SEQ ID NO: 1341817 - protein, 9 aa, Homo Sapiens
SSYLLHHQR

SEQ ID NO: 1341818 - protein, 9 aa, Homo Sapiens
QMILMFLLA

SEQ ID NO: 1341819 - protein, 9 aa, Homo Sapiens
YDTVAESEN

SEQ ID NO: 1341820 - protein, 9 aa, Homo Sapiens
IFVTTKSSK

SEQ ID NO: 1341821 - protein, 9 aa, Homo Sapiens
LSLENCRRR

SEQ ID NO: 1341822 - protein, 9 aa, Homo Sapiens
NPHHSQKMS

SEQ ID NO: 1341823 - protein, 9 aa, Homo Sapiens
EPLVSIPFL

SEQ ID NO: 1341824 - protein, 9 aa, Homo Sapiens
WGRSKERKH

SEQ ID NO: 1341825 - protein, 9 aa, Homo Sapiens
LLLKWRFHG

SEQ ID NO: 1341826 - protein, 9 aa, Homo Sapiens
KTNVTSPGV

SEQ ID NO: 1341827 - protein, 9 aa, Homo Sapiens
RGETRENVW

SEQ ID NO: 1341828 - protein, 9 aa, Homo Sapiens
GEGANPQMF

SEQ ID NO: 1341829 - protein, 9 aa, Homo Sapiens
HGKTIEIGN

SEQ ID NO: 1341830 - protein, 9 aa, Homo Sapiens
IFSTEERTQ

SEQ ID NO: 1341831 - protein, 9 aa, Homo Sapiens
VVYVIAFNN

SEQ ID NO: 1341832 - protein, 9 aa, Homo Sapiens
QQVGHPKHL

SEQ ID NO: 1341833 - protein, 9 aa, Homo Sapiens
KYPEVGDLC

SEQ ID NO: 1341834 - protein, 9 aa, Homo Sapiens
TCSSTPCYQ

SEQ ID NO: 1341835 - protein, 9 aa, Homo Sapiens
FALALVAFS

SEQ ID NO: 1341836 - protein, 9 aa, Homo Sapiens
RPSPGAPTF

SEQ ID NO: 1341837 - protein, 9 aa, Homo Sapiens
SQTQHTSGQ

SEQ ID NO: 1341838 - protein, 9 aa, Homo Sapiens
TPPHRSEPI

SEQ ID NO: 1341839 - protein, 9 aa, Homo Sapiens
HKSESQRKS

SEQ ID NO: 1341840 - protein, 9 aa, Homo Sapiens
KRVSALLNL

SEQ ID NO: 1341841 - protein, 9 aa, Homo Sapiens
EKFRANATK

SEQ ID NO: 1341842 - protein, 9 aa, Homo Sapiens
TSGNWELIK

SEQ ID NO: 1341843 - protein, 9 aa, Homo Sapiens
LMQKTTTLV

SEQ ID NO: 1341844 - protein, 9 aa, Homo Sapiens
QAGQRHSPG

SEQ ID NO: 1341845 - protein, 9 aa, Homo Sapiens
PKGISRSQS

SEQ ID NO: 1341846 - protein, 9 aa, Homo Sapiens
TTAACAPTP

SEQ ID NO: 1341847 - protein, 9 aa, Homo Sapiens
DEYHVIRHT

SEQ ID NO: 1341848 - protein, 9 aa, Homo Sapiens
NSQNILATC

SEQ ID NO: 1341849 - protein, 9 aa, Homo Sapiens
EDIQLEAAI

SEQ ID NO: 1341850 - protein, 9 aa, Homo Sapiens
YTKLFNWIV

SEQ ID NO: 1341851 - protein, 9 aa, Homo Sapiens
DEKFSVFIP

SEQ ID NO: 1341852 - protein, 9 aa, Homo Sapiens
KKIIEYYLR

SEQ ID NO: 1341853 - protein, 9 aa, Homo Sapiens
CLGRRITEL

SEQ ID NO: 1341854 - protein, 9 aa, Homo Sapiens
FLLRVGAIC

SEQ ID NO: 1341855 - protein, 9 aa, Homo Sapiens
TDPNGPTHV

SEQ ID NO: 1341856 - protein, 9 aa, Homo Sapiens
LEHHMNPSS

SEQ ID NO: 1341857 - protein, 9 aa, Homo Sapiens
EEEETVGGQ

SEQ ID NO: 1341858 - protein, 9 aa, Homo Sapiens
ATCHHPSYA

SEQ ID NO: 1341859 - protein, 9 aa, Homo Sapiens
LDDTCVSNP

SEQ ID NO: 1341860 - protein, 9 aa, Homo Sapiens
ERFHASVCR

SEQ ID NO: 1341861 - protein, 9 aa, Homo Sapiens
NEMSENECL

SEQ ID NO: 1341862 - protein, 9 aa, Homo Sapiens
QQKYWEMKQ

SEQ ID NO: 1341863 - protein, 9 aa, Homo Sapiens
VNVAFQAET

SEQ ID NO: 1341864 - protein, 9 aa, Homo Sapiens
IVIVIAYII

SEQ ID NO: 1341865 - protein, 9 aa, Homo Sapiens
LKGWKEIKY

SEQ ID NO: 1341866 - protein, 9 aa, Homo Sapiens
PALHSKLQS

SEQ ID NO: 1341867 - protein, 9 aa, Homo Sapiens
GDVEVMYPA

SEQ ID NO: 1341868 - protein, 9 aa, Homo Sapiens
SGYIQSIRC

SEQ ID NO: 1341869 - protein, 9 aa, Homo Sapiens
EWRTALGVI

SEQ ID NO: 1341870 - protein, 9 aa, Homo Sapiens
MDTNGLVRA

SEQ ID NO: 1341871 - protein, 9 aa, Homo Sapiens
VRMHNHPPR

SEQ ID NO: 1341872 - protein, 9 aa, Homo Sapiens
LHFPLSMLP

SEQ ID NO: 1341873 - protein, 9 aa, Homo Sapiens
TSTLTTTYS

SEQ ID NO: 1341874 - protein, 9 aa, Homo Sapiens
ELQKDIEEV

SEQ ID NO: 1341875 - protein, 9 aa, Homo Sapiens
AAEGKSLDS

SEQ ID NO: 1341876 - protein, 9 aa, Homo Sapiens
NASGYHIGP

SEQ ID NO: 1341877 - protein, 9 aa, Homo Sapiens
FHSLPCSGA

SEQ ID NO: 1341878 - protein, 9 aa, Homo Sapiens
MRELTMLRR

SEQ ID NO: 1341879 - protein, 9 aa, Homo Sapiens
NTNQADHDR

SEQ ID NO: 1341880 - protein, 9 aa, Homo Sapiens
ALHHPYGCD

SEQ ID NO: 1341881 - protein, 9 aa, Homo Sapiens
SCLASLLTW

SEQ ID NO: 1341882 - protein, 9 aa, Homo Sapiens
GLMPYGQPQ

SEQ ID NO: 1341883 - protein, 9 aa, Homo Sapiens
LLHAIHSHH

SEQ ID NO: 1341884 - protein, 9 aa, Homo Sapiens
TCDTVVGDD

SEQ ID NO: 1341885 - protein, 9 aa, Homo Sapiens
FSNLTKGSK

SEQ ID NO: 1341886 - protein, 9 aa, Homo Sapiens
HRIQSKHHP

SEQ ID NO: 1341887 - protein, 9 aa, Homo Sapiens
YMCQAGEVT

SEQ ID NO: 1341888 - protein, 9 aa, Homo Sapiens
YAAGDIARK

SEQ ID NO: 1341889 - protein, 9 aa, Homo Sapiens
SFSTATSSS

SEQ ID NO: 1341890 - protein, 9 aa, Homo Sapiens
ARRRTHEFE

SEQ ID NO: 1341891 - protein, 9 aa, Homo Sapiens
LCSQMSTVS

SEQ ID NO: 1341892 - protein, 9 aa, Homo Sapiens
PADTGRYEC

SEQ ID NO: 1341893 - protein, 9 aa, Homo Sapiens
PPMSSMSPP

SEQ ID NO: 1341894 - protein, 9 aa, Homo Sapiens
PRFLSGLLD

SEQ ID NO: 1341895 - protein, 9 aa, Homo Sapiens
DCLESVNDL

SEQ ID NO: 1341896 - protein, 9 aa, Homo Sapiens
PANFWVTSS

SEQ ID NO: 1341897 - protein, 9 aa, Homo Sapiens
SHTVALTRD

SEQ ID NO: 1341898 - protein, 9 aa, Homo Sapiens
YLYHVNKRL

SEQ ID NO: 1341899 - protein, 9 aa, Homo Sapiens
PEDRDQDLF

SEQ ID NO: 1341900 - protein, 9 aa, Homo Sapiens
IVYCLSVFA

SEQ ID NO: 1341901 - protein, 9 aa, Homo Sapiens
DSAQIWQHG

SEQ ID NO: 1341902 - protein, 9 aa, Homo Sapiens
RRWTWWSAA

SEQ ID NO: 1341903 - protein, 9 aa, Homo Sapiens
AYVAVFVIC

SEQ ID NO: 1341904 - protein, 9 aa, Homo Sapiens
MFLSIHHLT

SEQ ID NO: 1341905 - protein, 9 aa, Homo Sapiens
EVIRIEKHQ

SEQ ID NO: 1341906 - protein, 9 aa, Homo Sapiens
VLSAIVSCL

SEQ ID NO: 1341907 - protein, 9 aa, Homo Sapiens
RVQRNIRLV

SEQ ID NO: 1341908 - protein, 9 aa, Homo Sapiens
YKIFHILVP

SEQ ID NO: 1341909 - protein, 9 aa, Homo Sapiens
VFAGAPLQT

SEQ ID NO: 1341910 - protein, 9 aa, Homo Sapiens
GAYIHVPQD

SEQ ID NO: 1341911 - protein, 9 aa, Homo Sapiens
EKDEFNATL

SEQ ID NO: 1341912 - protein, 9 aa, Homo Sapiens
KKEKEKKKR

SEQ ID NO: 1341913 - protein, 9 aa, Homo Sapiens
SMWSITTKL

SEQ ID NO: 1341914 - protein, 9 aa, Homo Sapiens
DDFKEPYQE

SEQ ID NO: 1341915 - protein, 9 aa, Homo Sapiens
SALTFFTAA

SEQ ID NO: 1341916 - protein, 9 aa, Homo Sapiens
IKWLDSDVR

SEQ ID NO: 1341917 - protein, 9 aa, Homo Sapiens
TTVLTGLAI

SEQ ID NO: 1341918 - protein, 9 aa, Homo Sapiens
DSTDAATAK

SEQ ID NO: 1341919 - protein, 9 aa, Homo Sapiens
KGPNPATPM

SEQ ID NO: 1341920 - protein, 9 aa, Homo Sapiens
HQFPCHWSW

SEQ ID NO: 1341921 - protein, 9 aa, Homo Sapiens
VIHGEVQDA

SEQ ID NO: 1341922 - protein, 9 aa, Homo Sapiens
NWPSHRSEA

SEQ ID NO: 1341923 - protein, 9 aa, Homo Sapiens
VKCVPGEAG

SEQ ID NO: 1341924 - protein, 9 aa, Homo Sapiens
YPMIDAERV

SEQ ID NO: 1341925 - protein, 9 aa, Homo Sapiens
DNIRKYWSH

SEQ ID NO: 1341926 - protein, 9 aa, Homo Sapiens
KSDEGRTEQ

SEQ ID NO: 1341927 - protein, 9 aa, Homo Sapiens
DNEAGRERR

SEQ ID NO: 1341928 - protein, 9 aa, Homo Sapiens
VMNQVMEEL

SEQ ID NO: 1341929 - protein, 9 aa, Homo Sapiens
KPVIYKVQC

SEQ ID NO: 1341930 - protein, 9 aa, Homo Sapiens
TTPSKKKLK

SEQ ID NO: 1341931 - protein, 9 aa, Homo Sapiens
DIVLYNNAN

SEQ ID NO: 1341932 - protein, 9 aa, Homo Sapiens
AIKLQYQSS

SEQ ID NO: 1341933 - protein, 9 aa, Homo Sapiens
LQQQHHKEV

SEQ ID NO: 1341934 - protein, 9 aa, Homo Sapiens
CTVLRPSGA

SEQ ID NO: 1341935 - protein, 9 aa, Homo Sapiens
HTVMNGALV

SEQ ID NO: 1341936 - protein, 9 aa, Homo Sapiens
SLNTTVNLI

SEQ ID NO: 1341937 - protein, 9 aa, Homo Sapiens
EKEDTVEVL

SEQ ID NO: 1341938 - protein, 9 aa, Homo Sapiens
AVVPRGQEA

SEQ ID NO: 1341939 - protein, 9 aa, Homo Sapiens
TNEIRPVSR

SEQ ID NO: 1341940 - protein, 9 aa, Homo Sapiens
NPDTSPALE

SEQ ID NO: 1341941 - protein, 9 aa, Homo Sapiens
ARHPVYESD

SEQ ID NO: 1341942 - protein, 9 aa, Homo Sapiens
ETKDHAPQN

SEQ ID NO: 1341943 - protein, 9 aa, Homo Sapiens
HCVLLLLHL

SEQ ID NO: 1341944 - protein, 9 aa, Homo Sapiens
QINTFLNYI

SEQ ID NO: 1341945 - protein, 9 aa, Homo Sapiens
RWRKAHFQY

SEQ ID NO: 1341946 - protein, 9 aa, Homo Sapiens
ANIRKCTDR

SEQ ID NO: 1341947 - protein, 9 aa, Homo Sapiens
PNDITRDLI

SEQ ID NO: 1341948 - protein, 9 aa, Homo Sapiens
IFEYYVRFT

SEQ ID NO: 1341949 - protein, 9 aa, Homo Sapiens
DLCPTGFKV

SEQ ID NO: 1341950 - protein, 9 aa, Homo Sapiens
KVNYLMSLP

SEQ ID NO: 1341951 - protein, 9 aa, Homo Sapiens
ANMACLDLG

SEQ ID NO: 1341952 - protein, 9 aa, Homo Sapiens
FVFLLIIII

SEQ ID NO: 1341953 - protein, 9 aa, Homo Sapiens
ISLDDGLPK

SEQ ID NO: 1341954 - protein, 9 aa, Homo Sapiens
HTIHTAGLA

SEQ ID NO: 1341955 - protein, 9 aa, Homo Sapiens
LPVSDDTCY

SEQ ID NO: 1341956 - protein, 9 aa, Homo Sapiens
TNDSQFFIT

SEQ ID NO: 1341957 - protein, 9 aa, Homo Sapiens
CQCCPTDGT

SEQ ID NO: 1341958 - protein, 9 aa, Homo Sapiens
MSALWFLWY

SEQ ID NO: 1341959 - protein, 9 aa, Homo Sapiens
SMTKKSISL

SEQ ID NO: 1341960 - protein, 9 aa, Homo Sapiens
QMAISRVIR

SEQ ID NO: 1341961 - protein, 9 aa, Homo Sapiens
SSMVFLSRT

SEQ ID NO: 1341962 - protein, 9 aa, Homo Sapiens
VTASTRPQS

SEQ ID NO: 1341963 - protein, 9 aa, Homo Sapiens
SKEGMEASV

SEQ ID NO: 1341964 - protein, 9 aa, Homo Sapiens
EGEEADTPG

SEQ ID NO: 1341965 - protein, 9 aa, Homo Sapiens
MPPFVPSTI

SEQ ID NO: 1341966 - protein, 9 aa, Homo Sapiens
KIDCVECLL

SEQ ID NO: 1341967 - protein, 9 aa, Homo Sapiens
TKARTPLPS

SEQ ID NO: 1341968 - protein, 9 aa, Homo Sapiens
RIADNTFSR

SEQ ID NO: 1341969 - protein, 9 aa, Homo Sapiens
RIDVIFCDK

SEQ ID NO: 1341970 - protein, 9 aa, Homo Sapiens
ATPCTVLRP

SEQ ID NO: 1341971 - protein, 9 aa, Homo Sapiens
PLPARDKRT

SEQ ID NO: 1341972 - protein, 9 aa, Homo Sapiens
LIFTQFLDC

SEQ ID NO: 1341973 - protein, 9 aa, Homo Sapiens
IPENVPVGT

SEQ ID NO: 1341974 - protein, 9 aa, Homo Sapiens
DALAKHIYT

SEQ ID NO: 1341975 - protein, 9 aa, Homo Sapiens
LHTLLPVFL

SEQ ID NO: 1341976 - protein, 9 aa, Homo Sapiens
VSTEVDTRL

SEQ ID NO: 1341977 - protein, 9 aa, Homo Sapiens
SLRYSSGYS

SEQ ID NO: 1341978 - protein, 9 aa, Homo Sapiens
IIEEKTAAY

SEQ ID NO: 1341979 - protein, 9 aa, Homo Sapiens
NDHGYTIYS

SEQ ID NO: 1341980 - protein, 9 aa, Homo Sapiens
SVSLHFCTP

SEQ ID NO: 1341981 - protein, 9 aa, Homo Sapiens
WLLENMDVA

SEQ ID NO: 1341982 - protein, 9 aa, Homo Sapiens
VLQNIHLRG

SEQ ID NO: 1341983 - protein, 9 aa, Homo Sapiens
EGDCNVVKS

SEQ ID NO: 1341984 - protein, 9 aa, Homo Sapiens
KSKIRALLH

SEQ ID NO: 1341985 - protein, 9 aa, Homo Sapiens
KTAVFVLPI

SEQ ID NO: 1341986 - protein, 9 aa, Homo Sapiens
EKLLKNMQS

SEQ ID NO: 1341987 - protein, 9 aa, Homo Sapiens
VTCGADHNA

SEQ ID NO: 1341988 - protein, 9 aa, Homo Sapiens
TPTDFPSQL

SEQ ID NO: 1341989 - protein, 9 aa, Homo Sapiens
WVMCRRMGP

SEQ ID NO: 1341990 - protein, 9 aa, Homo Sapiens
LRELPIVPS

SEQ ID NO: 1341991 - protein, 9 aa, Homo Sapiens
ERCVSLHSV

SEQ ID NO: 1341992 - protein, 9 aa, Homo Sapiens
CLPLHFWVN

SEQ ID NO: 1341993 - protein, 9 aa, Homo Sapiens
GGNSHTIMI

SEQ ID NO: 1341994 - protein, 9 aa, Homo Sapiens
AERCVSLHS

SEQ ID NO: 1341995 - protein, 9 aa, Homo Sapiens
ALQTAIEMK

SEQ ID NO: 1341996 - protein, 9 aa, Homo Sapiens
VTHITDDIC

SEQ ID NO: 1341997 - protein, 9 aa, Homo Sapiens
IGWRWLIRI

SEQ ID NO: 1341998 - protein, 9 aa, Homo Sapiens
AVIHGEVQD

SEQ ID NO: 1341999 - protein, 9 aa, Homo Sapiens
HVKTHNGVK

SEQ ID NO: 1342000 - protein, 9 aa, Homo Sapiens
RESISKVCS

SEQ ID NO: 1342001 - protein, 9 aa, Homo Sapiens
LTAPSLTPP

SEQ ID NO: 1342002 - protein, 9 aa, Homo Sapiens
FVCCIKPND

SEQ ID NO: 1342003 - protein, 9 aa, Homo Sapiens
RLADLIEWD

SEQ ID NO: 1342004 - protein, 9 aa, Homo Sapiens
FASLVEYVV

SEQ ID NO: 1342005 - protein, 9 aa, Homo Sapiens
SHLEITIPN

SEQ ID NO: 1342006 - protein, 9 aa, Homo Sapiens
GALLSCNTE

SEQ ID NO: 1342007 - protein, 9 aa, Homo Sapiens
QREDWLGVP

SEQ ID NO: 1342008 - protein, 9 aa, Homo Sapiens
SLFSGQRYV

SEQ ID NO: 1342009 - protein, 9 aa, Homo Sapiens
HIGHTLTVA

SEQ ID NO: 1342010 - protein, 9 aa, Homo Sapiens
AETLPANFW

SEQ ID NO: 1342011 - protein, 9 aa, Homo Sapiens
IDRIHTPRA

SEQ ID NO: 1342012 - protein, 9 aa, Homo Sapiens
TDHYHVQPL

SEQ ID NO: 1342013 - protein, 9 aa, Homo Sapiens
PPLLLNVQP

SEQ ID NO: 1342014 - protein, 9 aa, Homo Sapiens
GINPNGDSA

SEQ ID NO: 1342015 - protein, 9 aa, Homo Sapiens
EALMWYSEA

SEQ ID NO: 1342016 - protein, 9 aa, Homo Sapiens
GGLLDYIDR

SEQ ID NO: 1342017 - protein, 9 aa, Homo Sapiens
GIETLEECW

SEQ ID NO: 1342018 - protein, 9 aa, Homo Sapiens
GSGPGRRLC

SEQ ID NO: 1342019 - protein, 9 aa, Homo Sapiens
WTTLTILRD

SEQ ID NO: 1342020 - protein, 9 aa, Homo Sapiens
ERYTNFCKD

SEQ ID NO: 1342021 - protein, 9 aa, Homo Sapiens
IQYYTAAPL

SEQ ID NO: 1342022 - protein, 9 aa, Homo Sapiens
HFPLSMLPM

SEQ ID NO: 1342023 - protein, 9 aa, Homo Sapiens
LEEVSAAES

SEQ ID NO: 1342024 - protein, 9 aa, Homo Sapiens
SQKNFILKR

SEQ ID NO: 1342025 - protein, 9 aa, Homo Sapiens
QPLLDVDHI

SEQ ID NO: 1342026 - protein, 9 aa, Homo Sapiens
HTSNSQGQA

SEQ ID NO: 1342027 - protein, 9 aa, Homo Sapiens
FRDMRELTM

SEQ ID NO: 1342028 - protein, 9 aa, Homo Sapiens
RNVIKRTSP

SEQ ID NO: 1342029 - protein, 9 aa, Homo Sapiens
RVLVTVGGH

SEQ ID NO: 1342030 - protein, 9 aa, Homo Sapiens
KAPSGTQLA

SEQ ID NO: 1342031 - protein, 9 aa, Homo Sapiens
INECFSNPC

SEQ ID NO: 1342032 - protein, 9 aa, Homo Sapiens
NTSFIHHWR

SEQ ID NO: 1342033 - protein, 9 aa, Homo Sapiens
NPNLNANQN

SEQ ID NO: 1342034 - protein, 9 aa, Homo Sapiens
SHIPQSNSY

SEQ ID NO: 1342035 - protein, 9 aa, Homo Sapiens
DWKYVVMVI

SEQ ID NO: 1342036 - protein, 9 aa, Homo Sapiens
ITQFVTSLN

SEQ ID NO: 1342037 - protein, 9 aa, Homo Sapiens
AQTGKIECL

SEQ ID NO: 1342038 - protein, 9 aa, Homo Sapiens
SCEKCCHAY

SEQ ID NO: 1342039 - protein, 9 aa, Homo Sapiens
PPQPYPAQW

SEQ ID NO: 1342040 - protein, 9 aa, Homo Sapiens
ESFDPLFVE

SEQ ID NO: 1342041 - protein, 9 aa, Homo Sapiens
VDQDGRMNY

SEQ ID NO: 1342042 - protein, 9 aa, Homo Sapiens
GRSRSKLWS

SEQ ID NO: 1342043 - protein, 9 aa, Homo Sapiens
GGRGWEVVF

SEQ ID NO: 1342044 - protein, 9 aa, Homo Sapiens
PKYALWRTD

SEQ ID NO: 1342045 - protein, 9 aa, Homo Sapiens
QLTQKPLAV

SEQ ID NO: 1342046 - protein, 9 aa, Homo Sapiens
DEDTKIIRN

SEQ ID NO: 1342047 - protein, 9 aa, Homo Sapiens
SIKVPVNTD

SEQ ID NO: 1342048 - protein, 9 aa, Homo Sapiens
HPVNVCCLV

SEQ ID NO: 1342049 - protein, 9 aa, Homo Sapiens
NRKSFSSSD

SEQ ID NO: 1342050 - protein, 9 aa, Homo Sapiens
LTKFMSDRS

SEQ ID NO: 1342051 - protein, 9 aa, Homo Sapiens
GSRPPCSVQ

SEQ ID NO: 1342052 - protein, 9 aa, Homo Sapiens
VIGHMSFQL

SEQ ID NO: 1342053 - protein, 9 aa, Homo Sapiens
GESPNFPEE

SEQ ID NO: 1342054 - protein, 9 aa, Homo Sapiens
RLRERKQLM

SEQ ID NO: 1342055 - protein, 9 aa, Homo Sapiens
GHSSMMCYD

SEQ ID NO: 1342056 - protein, 9 aa, Homo Sapiens
LLCHGFIFK

SEQ ID NO: 1342057 - protein, 9 aa, Homo Sapiens
IIMWLDHRA

SEQ ID NO: 1342058 - protein, 9 aa, Homo Sapiens
SPFVFGHPL

SEQ ID NO: 1342059 - protein, 9 aa, Homo Sapiens
SLVGQYNQP

SEQ ID NO: 1342060 - protein, 9 aa, Homo Sapiens
GPETNPQPG

SEQ ID NO: 1342061 - protein, 9 aa, Homo Sapiens
LALFYQGPG

SEQ ID NO: 1342062 - protein, 9 aa, Homo Sapiens
YNITGPGAD

SEQ ID NO: 1342063 - protein, 9 aa, Homo Sapiens
AKNGSPVSD

SEQ ID NO: 1342064 - protein, 9 aa, Homo Sapiens
ARVDAHVVL

SEQ ID NO: 1342065 - protein, 9 aa, Homo Sapiens
RRTVRAMVF

SEQ ID NO: 1342066 - protein, 9 aa, Homo Sapiens
RHCTWFYKG

SEQ ID NO: 1342067 - protein, 9 aa, Homo Sapiens
AKQREHLLG

SEQ ID NO: 1342068 - protein, 9 aa, Homo Sapiens
AHRLSTVHN

SEQ ID NO: 1342069 - protein, 9 aa, Homo Sapiens
PLPSNTLST

SEQ ID NO: 1342070 - protein, 9 aa, Homo Sapiens
HMTHLLVQG

SEQ ID NO: 1342071 - protein, 9 aa, Homo Sapiens
LDDQLCANE

SEQ ID NO: 1342072 - protein, 9 aa, Homo Sapiens
LGDMIWDDL

SEQ ID NO: 1342073 - protein, 9 aa, Homo Sapiens
LPRLRREEH

SEQ ID NO: 1342074 - protein, 9 aa, Homo Sapiens
DLKLTIVML

SEQ ID NO: 1342075 - protein, 9 aa, Homo Sapiens
NEEAAAELD

SEQ ID NO: 1342076 - protein, 9 aa, Homo Sapiens
SVHGSCRGS

SEQ ID NO: 1342077 - protein, 9 aa, Homo Sapiens
VDVVLHLAT

SEQ ID NO: 1342078 - protein, 9 aa, Homo Sapiens
FDDQNLKEL

SEQ ID NO: 1342079 - protein, 9 aa, Homo Sapiens
HYYAVCDPL

SEQ ID NO: 1342080 - protein, 9 aa, Homo Sapiens
SAEEPVVRA

SEQ ID NO: 1342081 - protein, 9 aa, Homo Sapiens
CSRLQAHER

SEQ ID NO: 1342082 - protein, 9 aa, Homo Sapiens
SITLFNILH

SEQ ID NO: 1342083 - protein, 9 aa, Homo Sapiens
EWERAILST

SEQ ID NO: 1342084 - protein, 9 aa, Homo Sapiens
IGGVTEHMP

SEQ ID NO: 1342085 - protein, 9 aa, Homo Sapiens
ITLMRLSKP

SEQ ID NO: 1342086 - protein, 9 aa, Homo Sapiens
CFNIVGSYS

SEQ ID NO: 1342087 - protein, 9 aa, Homo Sapiens
FYTGLSHVS

SEQ ID NO: 1342088 - protein, 9 aa, Homo Sapiens
PSGTFWLWC

SEQ ID NO: 1342089 - protein, 9 aa, Homo Sapiens
ELNALREEN

SEQ ID NO: 1342090 - protein, 9 aa, Homo Sapiens
AEDLSLPPP

SEQ ID NO: 1342091 - protein, 9 aa, Homo Sapiens
VGCVISALA

SEQ ID NO: 1342092 - protein, 9 aa, Homo Sapiens
ATPSMVAMF

SEQ ID NO: 1342093 - protein, 9 aa, Homo Sapiens
LPENLTNGV

SEQ ID NO: 1342094 - protein, 9 aa, Homo Sapiens
VNMVVFVTY

SEQ ID NO: 1342095 - protein, 9 aa, Homo Sapiens
LSPEMIEGR

SEQ ID NO: 1342096 - protein, 9 aa, Homo Sapiens
YLPSHDRRQ

SEQ ID NO: 1342097 - protein, 9 aa, Homo Sapiens
FFFTIGITW

SEQ ID NO: 1342098 - protein, 9 aa, Homo Sapiens
HLGGGGGQK

SEQ ID NO: 1342099 - protein, 9 aa, Homo Sapiens
LRQFRAAGV

SEQ ID NO: 1342100 - protein, 9 aa, Homo Sapiens
VNMCHIQRA

SEQ ID NO: 1342101 - protein, 9 aa, Homo Sapiens
ATYRQHVQP

SEQ ID NO: 1342102 - protein, 9 aa, Homo Sapiens
DDWTANPHI

SEQ ID NO: 1342103 - protein, 9 aa, Homo Sapiens
PVSFVKLFV

SEQ ID NO: 1342104 - protein, 9 aa, Homo Sapiens
AVVFAAASR

SEQ ID NO: 1342105 - protein, 9 aa, Homo Sapiens
GLKEDEAGT

SEQ ID NO: 1342106 - protein, 9 aa, Homo Sapiens
DNTNDLEKC

SEQ ID NO: 1342107 - protein, 9 aa, Homo Sapiens
RCTHSVSIP

SEQ ID NO: 1342108 - protein, 9 aa, Homo Sapiens
DPDKQDVLN

SEQ ID NO: 1342109 - protein, 9 aa, Homo Sapiens
CTEAEDVLG

SEQ ID NO: 1342110 - protein, 9 aa, Homo Sapiens
MVLVEQQTP

SEQ ID NO: 1342111 - protein, 9 aa, Homo Sapiens
EACTSTLTT

SEQ ID NO: 1342112 - protein, 9 aa, Homo Sapiens
PLIFIFAYL

SEQ ID NO: 1342113 - protein, 9 aa, Homo Sapiens
LTVKASEKP

SEQ ID NO: 1342114 - protein, 9 aa, Homo Sapiens
IYAKTLPPR

SEQ ID NO: 1342115 - protein, 9 aa, Homo Sapiens
EIADACHLT

SEQ ID NO: 1342116 - protein, 9 aa, Homo Sapiens
TPFMSVVSG

SEQ ID NO: 1342117 - protein, 9 aa, Homo Sapiens
SSRDLAFLR

SEQ ID NO: 1342118 - protein, 9 aa, Homo Sapiens
DALTHTKPS

SEQ ID NO: 1342119 - protein, 9 aa, Homo Sapiens
DGDDLERVS

SEQ ID NO: 1342120 - protein, 9 aa, Homo Sapiens
YNKHILHKT

SEQ ID NO: 1342121 - protein, 9 aa, Homo Sapiens
AKHIYTKLF

SEQ ID NO: 1342122 - protein, 9 aa, Homo Sapiens
VVGPGGLLG

SEQ ID NO: 1342123 - protein, 9 aa, Homo Sapiens
LMWINAGTV

SEQ ID NO: 1342124 - protein, 9 aa, Homo Sapiens
YLVMLVNAE

SEQ ID NO: 1342125 - protein, 9 aa, Homo Sapiens
DYVLLPAAD

SEQ ID NO: 1342126 - protein, 9 aa, Homo Sapiens
ELLQPYTEC

SEQ ID NO: 1342127 - protein, 9 aa, Homo Sapiens
WKITHVVLK

SEQ ID NO: 1342128 - protein, 9 aa, Homo Sapiens
PGARMTVLQ

SEQ ID NO: 1342129 - protein, 9 aa, Homo Sapiens
QQEIEFLQN

SEQ ID NO: 1342130 - protein, 9 aa, Homo Sapiens
TVFMYLTGN

SEQ ID NO: 1342131 - protein, 9 aa, Homo Sapiens
PAEPPHPPS

SEQ ID NO: 1342132 - protein, 9 aa, Homo Sapiens
RMQNRFGKK

SEQ ID NO: 1342133 - protein, 9 aa, Homo Sapiens
GDMIWDDLS

SEQ ID NO: 1342134 - protein, 9 aa, Homo Sapiens
VRSRGGHVL

SEQ ID NO: 1342135 - protein, 9 aa, Homo Sapiens
ELERGTRMK

SEQ ID NO: 1342136 - protein, 9 aa, Homo Sapiens
ITLYCHQLN

SEQ ID NO: 1342137 - protein, 9 aa, Homo Sapiens
PRAHTCFNH

SEQ ID NO: 1342138 - protein, 9 aa, Homo Sapiens
KQGGKACAK

SEQ ID NO: 1342139 - protein, 9 aa, Homo Sapiens
TADVEWCWH

SEQ ID NO: 1342140 - protein, 9 aa, Homo Sapiens
TRKRCSASS

SEQ ID NO: 1342141 - protein, 9 aa, Homo Sapiens
VHNADVIAG

SEQ ID NO: 1342142 - protein, 9 aa, Homo Sapiens
IKKQKTNIF

SEQ ID NO: 1342143 - protein, 9 aa, Homo Sapiens
SNQISRVQL

SEQ ID NO: 1342144 - protein, 9 aa, Homo Sapiens
QVAASTHMV

SEQ ID NO: 1342145 - protein, 9 aa, Homo Sapiens
HAMCTLSED

SEQ ID NO: 1342146 - protein, 9 aa, Homo Sapiens
IQGGRPSPC

SEQ ID NO: 1342147 - protein, 9 aa, Homo Sapiens
MVRTGEKPF

SEQ ID NO: 1342148 - protein, 9 aa, Homo Sapiens
VSSPKRQQL

SEQ ID NO: 1342149 - protein, 9 aa, Homo Sapiens
KLVANQSTS

SEQ ID NO: 1342150 - protein, 9 aa, Homo Sapiens
TLLMIWFYA

SEQ ID NO: 1342151 - protein, 9 aa, Homo Sapiens
KLVGWRWIW

SEQ ID NO: 1342152 - protein, 9 aa, Homo Sapiens
LDVENTKLY

SEQ ID NO: 1342153 - protein, 9 aa, Homo Sapiens
RNLHCALCP

SEQ ID NO: 1342154 - protein, 9 aa, Homo Sapiens
CGALLRGYL

SEQ ID NO: 1342155 - protein, 9 aa, Homo Sapiens
GVEGDDIVS

SEQ ID NO: 1342156 - protein, 9 aa, Homo Sapiens
LQRSLFLLF

SEQ ID NO: 1342157 - protein, 9 aa, Homo Sapiens
WPEVMETYM

SEQ ID NO: 1342158 - protein, 9 aa, Homo Sapiens
AHTCFNHLD

SEQ ID NO: 1342159 - protein, 9 aa, Homo Sapiens
DDIVDTGAI

SEQ ID NO: 1342160 - protein, 9 aa, Homo Sapiens
TLGFFCVDE

SEQ ID NO: 1342161 - protein, 9 aa, Homo Sapiens
GSNQFHATC

SEQ ID NO: 1342162 - protein, 9 aa, Homo Sapiens
ELFRGHNKT

SEQ ID NO: 1342163 - protein, 9 aa, Homo Sapiens
RRHVKTHNG

SEQ ID NO: 1342164 - protein, 9 aa, Homo Sapiens
SSYVWNVEP

SEQ ID NO: 1342165 - protein, 9 aa, Homo Sapiens
KTLDGTHWR

SEQ ID NO: 1342166 - protein, 9 aa, Homo Sapiens
LETLFKLFN

SEQ ID NO: 1342167 - protein, 9 aa, Homo Sapiens
RKMKDRFSL

SEQ ID NO: 1342168 - protein, 9 aa, Homo Sapiens
DTTITSRLQ

SEQ ID NO: 1342169 - protein, 9 aa, Homo Sapiens
DRLTKFMKT

SEQ ID NO: 1342170 - protein, 9 aa, Homo Sapiens
WAVLSSSTM

SEQ ID NO: 1342171 - protein, 9 aa, Homo Sapiens
NSGFEPGTF

SEQ ID NO: 1342172 - protein, 9 aa, Homo Sapiens
NVVYVIAFN

SEQ ID NO: 1342173 - protein, 9 aa, Homo Sapiens
HLIFQVLDA

SEQ ID NO: 1342174 - protein, 9 aa, Homo Sapiens
LKMKTSKYW

SEQ ID NO: 1342175 - protein, 9 aa, Homo Sapiens
VKKPPVCSR

SEQ ID NO: 1342176 - protein, 9 aa, Homo Sapiens
TVLVEDRMS

SEQ ID NO: 1342177 - protein, 9 aa, Homo Sapiens
LSNVAPPAF

SEQ ID NO: 1342178 - protein, 9 aa, Homo Sapiens
ETDFEKAHH

SEQ ID NO: 1342179 - protein, 9 aa, Homo Sapiens
FIADFELLD

SEQ ID NO: 1342180 - protein, 9 aa, Homo Sapiens
SHVSDPYSL

SEQ ID NO: 1342181 - protein, 9 aa, Homo Sapiens
NPDKKMCTK

SEQ ID NO: 1342182 - protein, 9 aa, Homo Sapiens
HLLPTEQHI

SEQ ID NO: 1342183 - protein, 9 aa, Homo Sapiens
FDAESPPIS

SEQ ID NO: 1342184 - protein, 9 aa, Homo Sapiens
YGVDMYVVR

SEQ ID NO: 1342185 - protein, 9 aa, Homo Sapiens
MSNDFSNND

SEQ ID NO: 1342186 - protein, 9 aa, Homo Sapiens
VRAVTHMGI

SEQ ID NO: 1342187 - protein, 9 aa, Homo Sapiens
SLTAPTQAL

SEQ ID NO: 1342188 - protein, 9 aa, Homo Sapiens
VDTSVAKIM

SEQ ID NO: 1342189 - protein, 9 aa, Homo Sapiens
CHTSHRLIV

SEQ ID NO: 1342190 - protein, 9 aa, Homo Sapiens
KCVQKDSQP

SEQ ID NO: 1342191 - protein, 9 aa, Homo Sapiens
PLGLHSSIQ

SEQ ID NO: 1342192 - protein, 9 aa, Homo Sapiens
YPEGTHNDN

SEQ ID NO: 1342193 - protein, 9 aa, Homo Sapiens
SWAITYLLG

SEQ ID NO: 1342194 - protein, 9 aa, Homo Sapiens
CEFNARFGL

SEQ ID NO: 1342195 - protein, 9 aa, Homo Sapiens
RHATEKQKK

SEQ ID NO: 1342196 - protein, 9 aa, Homo Sapiens
YRIGKKSHL

SEQ ID NO: 1342197 - protein, 9 aa, Homo Sapiens
SKNLSRGGK

SEQ ID NO: 1342198 - protein, 9 aa, Homo Sapiens
EIRTLFCSS

SEQ ID NO: 1342199 - protein, 9 aa, Homo Sapiens
ALMSNSPSK

SEQ ID NO: 1342200 - protein, 9 aa, Homo Sapiens
GTVTTYWKT

SEQ ID NO: 1342201 - protein, 9 aa, Homo Sapiens
RSKASYDPA

SEQ ID NO: 1342202 - protein, 9 aa, Homo Sapiens
RAPPRSGRG

SEQ ID NO: 1342203 - protein, 9 aa, Homo Sapiens
DGEKIISYI

SEQ ID NO: 1342204 - protein, 9 aa, Homo Sapiens
EMPIISNAM

SEQ ID NO: 1342205 - protein, 9 aa, Homo Sapiens
VNGDNAHPL

SEQ ID NO: 1342206 - protein, 9 aa, Homo Sapiens
FVQRPGDLM

SEQ ID NO: 1342207 - protein, 9 aa, Homo Sapiens
FLDALTHTK

SEQ ID NO: 1342208 - protein, 9 aa, Homo Sapiens
MKHEERALL

SEQ ID NO: 1342209 - protein, 9 aa, Homo Sapiens
VDPGPPGEP

SEQ ID NO: 1342210 - protein, 9 aa, Homo Sapiens
YDPLYSKHF

SEQ ID NO: 1342211 - protein, 9 aa, Homo Sapiens
KQLFGGFSF

SEQ ID NO: 1342212 - protein, 9 aa, Homo Sapiens
QVQDLPLDE

SEQ ID NO: 1342213 - protein, 9 aa, Homo Sapiens
LLTRGRHTA

SEQ ID NO: 1342214 - protein, 9 aa, Homo Sapiens
SVGFIFFQC

SEQ ID NO: 1342215 - protein, 9 aa, Homo Sapiens
SNRECFLKG

SEQ ID NO: 1342216 - protein, 9 aa, Homo Sapiens
GGQLNLVVP

SEQ ID NO: 1342217 - protein, 9 aa, Homo Sapiens
GTFVPLGAA

SEQ ID NO: 1342218 - protein, 9 aa, Homo Sapiens
TCTEAEDVL

SEQ ID NO: 1342219 - protein, 9 aa, Homo Sapiens
QCRGFLCNQ

SEQ ID NO: 1342220 - protein, 9 aa, Homo Sapiens
TQLPSHITP

SEQ ID NO: 1342221 - protein, 9 aa, Homo Sapiens
PTARESKNT

SEQ ID NO: 1342222 - protein, 9 aa, Homo Sapiens
STFYLSYFD

SEQ ID NO: 1342223 - protein, 9 aa, Homo Sapiens
CRLGEVRIH

SEQ ID NO: 1342224 - protein, 9 aa, Homo Sapiens
LPKAHTTFE

SEQ ID NO: 1342225 - protein, 9 aa, Homo Sapiens
YRNVIKRTS

SEQ ID NO: 1342226 - protein, 9 aa, Homo Sapiens
AKEKELHTW

SEQ ID NO: 1342227 - protein, 9 aa, Homo Sapiens
VAKKGIRLE

SEQ ID NO: 1342228 - protein, 9 aa, Homo Sapiens
VFTFGPTFQ

SEQ ID NO: 1342229 - protein, 9 aa, Homo Sapiens
QITTILREI

SEQ ID NO: 1342230 - protein, 9 aa, Homo Sapiens
SAYTGHLSM

SEQ ID NO: 1342231 - protein, 9 aa, Homo Sapiens
LMAVTYTVV

SEQ ID NO: 1342232 - protein, 9 aa, Homo Sapiens
QNHVQTLQI

SEQ ID NO: 1342233 - protein, 9 aa, Homo Sapiens
QQDNNQPGI

SEQ ID NO: 1342234 - protein, 9 aa, Homo Sapiens
ASVDLTPTA

SEQ ID NO: 1342235 - protein, 9 aa, Homo Sapiens
GVILLVIDQ

SEQ ID NO: 1342236 - protein, 9 aa, Homo Sapiens
EERYNDLKK

SEQ ID NO: 1342237 - protein, 9 aa, Homo Sapiens
LAMGPGESL

SEQ ID NO: 1342238 - protein, 9 aa, Homo Sapiens
YKYMLQLCY

SEQ ID NO: 1342239 - protein, 9 aa, Homo Sapiens
RREDPTYTP

SEQ ID NO: 1342240 - protein, 9 aa, Homo Sapiens
KPKCQKSST

SEQ ID NO: 1342241 - protein, 9 aa, Homo Sapiens
WMSVCLSGY

SEQ ID NO: 1342242 - protein, 9 aa, Homo Sapiens
HHSKKILSL

SEQ ID NO: 1342243 - protein, 9 aa, Homo Sapiens
ATVVLGSLS

SEQ ID NO: 1342244 - protein, 9 aa, Homo Sapiens
WSAQLEKRE

SEQ ID NO: 1342245 - protein, 9 aa, Homo Sapiens
SALSPNPEV

SEQ ID NO: 1342246 - protein, 9 aa, Homo Sapiens
SVTEFEQCH

SEQ ID NO: 1342247 - protein, 9 aa, Homo Sapiens
DLIQVTTDM

SEQ ID NO: 1342248 - protein, 9 aa, Homo Sapiens
DGNSEDDIY

SEQ ID NO: 1342249 - protein, 9 aa, Homo Sapiens
KSAGENTFL

SEQ ID NO: 1342250 - protein, 9 aa, Homo Sapiens
ADFFKHLLE

SEQ ID NO: 1342251 - protein, 9 aa, Homo Sapiens
AYLLFYECV

SEQ ID NO: 1342252 - protein, 9 aa, Homo Sapiens
FWLMIFSPV

SEQ ID NO: 1342253 - protein, 9 aa, Homo Sapiens
GIPLDQTLQ

SEQ ID NO: 1342254 - protein, 9 aa, Homo Sapiens
TDAITAALV

SEQ ID NO: 1342255 - protein, 9 aa, Homo Sapiens
AHVNLDQGY

SEQ ID NO: 1342256 - protein, 9 aa, Homo Sapiens
VTKLAGLHD

SEQ ID NO: 1342257 - protein, 9 aa, Homo Sapiens
TLWRQFIKG

SEQ ID NO: 1342258 - protein, 9 aa, Homo Sapiens
EQLPRDEVL

SEQ ID NO: 1342259 - protein, 9 aa, Homo Sapiens
LRQVPVSEP

SEQ ID NO: 1342260 - protein, 9 aa, Homo Sapiens
VICHVGDAL

SEQ ID NO: 1342261 - protein, 9 aa, Homo Sapiens
PPKATRGCL

SEQ ID NO: 1342262 - protein, 9 aa, Homo Sapiens
GYPFPSPGP

SEQ ID NO: 1342263 - protein, 9 aa, Homo Sapiens
ICTYTCPCP

SEQ ID NO: 1342264 - protein, 9 aa, Homo Sapiens
PTAQDPFQF

SEQ ID NO: 1342265 - protein, 9 aa, Homo Sapiens
KQFMCQWCD

SEQ ID NO: 1342266 - protein, 9 aa, Homo Sapiens
QGLPITSYV

SEQ ID NO: 1342267 - protein, 9 aa, Homo Sapiens
YKNVGSKRH

SEQ ID NO: 1342268 - protein, 9 aa, Homo Sapiens
LLIIIIVFF

SEQ ID NO: 1342269 - protein, 9 aa, Homo Sapiens
KEYTYLKGT

SEQ ID NO: 1342270 - protein, 9 aa, Homo Sapiens
RRLHLWMGL

SEQ ID NO: 1342271 - protein, 9 aa, Homo Sapiens
QRIRDVKCV

SEQ ID NO: 1342272 - protein, 9 aa, Homo Sapiens
PPQDSCWQT

SEQ ID NO: 1342273 - protein, 9 aa, Homo Sapiens
ATCKQLTYY

SEQ ID NO: 1342274 - protein, 9 aa, Homo Sapiens
LGTRKVGVP

SEQ ID NO: 1342275 - protein, 9 aa, Homo Sapiens
HLPQLILPD

SEQ ID NO: 1342276 - protein, 9 aa, Homo Sapiens
YKCEECGNT

SEQ ID NO: 1342277 - protein, 9 aa, Homo Sapiens
WGMHEFLTP

SEQ ID NO: 1342278 - protein, 9 aa, Homo Sapiens
LAWGTFAQP

SEQ ID NO: 1342279 - protein, 9 aa, Homo Sapiens
DSLKHFSFS

SEQ ID NO: 1342280 - protein, 9 aa, Homo Sapiens
LQDVFEMCF

SEQ ID NO: 1342281 - protein, 9 aa, Homo Sapiens
AAARCFLMV

SEQ ID NO: 1342282 - protein, 9 aa, Homo Sapiens
PDAVKPVIY

SEQ ID NO: 1342283 - protein, 9 aa, Homo Sapiens
FKNQSLLSS

SEQ ID NO: 1342284 - protein, 9 aa, Homo Sapiens
EKEEDYEKA

SEQ ID NO: 1342285 - protein, 9 aa, Homo Sapiens
DRFAQNPPI

SEQ ID NO: 1342286 - protein, 9 aa, Homo Sapiens
APYKYMLQL

SEQ ID NO: 1342287 - protein, 9 aa, Homo Sapiens
PGSRSSSVG

SEQ ID NO: 1342288 - protein, 9 aa, Homo Sapiens
FISKEWERA

SEQ ID NO: 1342289 - protein, 9 aa, Homo Sapiens
EDFKEMRET

SEQ ID NO: 1342290 - protein, 9 aa, Homo Sapiens
ALPSAIQAA

SEQ ID NO: 1342291 - protein, 9 aa, Homo Sapiens
RLARNVVVG

SEQ ID NO: 1342292 - protein, 9 aa, Homo Sapiens
HYLANVLLE

SEQ ID NO: 1342293 - protein, 9 aa, Homo Sapiens
SVMKQAPQA

SEQ ID NO: 1342294 - protein, 9 aa, Homo Sapiens
VMYPALPPY

SEQ ID NO: 1342295 - protein, 9 aa, Homo Sapiens
SSRHAAHRP

SEQ ID NO: 1342296 - protein, 9 aa, Homo Sapiens
KTSNLLLYE

SEQ ID NO: 1342297 - protein, 9 aa, Homo Sapiens
VRSSLKSGR

SEQ ID NO: 1342298 - protein, 9 aa, Homo Sapiens
EDLQDFNTE

SEQ ID NO: 1342299 - protein, 9 aa, Homo Sapiens
HYPTLWTEQ

SEQ ID NO: 1342300 - protein, 9 aa, Homo Sapiens
GVSELRVGR

SEQ ID NO: 1342301 - protein, 9 aa, Homo Sapiens
GQLLLLLLL

SEQ ID NO: 1342302 - protein, 9 aa, Homo Sapiens
TKNQKDSGV

SEQ ID NO: 1342303 - protein, 9 aa, Homo Sapiens
RTAVDSAQL

SEQ ID NO: 1342304 - protein, 9 aa, Homo Sapiens
SRPVDYDFV

SEQ ID NO: 1342305 - protein, 9 aa, Homo Sapiens
LRIFSLGGS

SEQ ID NO: 1342306 - protein, 9 aa, Homo Sapiens
SPTTQNSPL

SEQ ID NO: 1342307 - protein, 9 aa, Homo Sapiens
DEDAMPLIR

SEQ ID NO: 1342308 - protein, 9 aa, Homo Sapiens
SYLAGQVSV

SEQ ID NO: 1342309 - protein, 9 aa, Homo Sapiens
LGIFYCAKV

SEQ ID NO: 1342310 - protein, 9 aa, Homo Sapiens
PSRRVQPSC

SEQ ID NO: 1342311 - protein, 9 aa, Homo Sapiens
SRFTYTVLL

SEQ ID NO: 1342312 - protein, 9 aa, Homo Sapiens
WKTLLIPPS

SEQ ID NO: 1342313 - protein, 9 aa, Homo Sapiens
LPTEHRCLV

SEQ ID NO: 1342314 - protein, 9 aa, Homo Sapiens
NCVIQRRAK

SEQ ID NO: 1342315 - protein, 9 aa, Homo Sapiens
SRMLGGEEV

SEQ ID NO: 1342316 - protein, 9 aa, Homo Sapiens
QWHWGVFSG

SEQ ID NO: 1342317 - protein, 9 aa, Homo Sapiens
PQRPHLTGQ

SEQ ID NO: 1342318 - protein, 9 aa, Homo Sapiens
EVCRKLNEV

SEQ ID NO: 1342319 - protein, 9 aa, Homo Sapiens
NTQLNEATC

SEQ ID NO: 1342320 - protein, 9 aa, Homo Sapiens
EILKQLVIL

SEQ ID NO: 1342321 - protein, 9 aa, Homo Sapiens
ASTPLEVSF

SEQ ID NO: 1342322 - protein, 9 aa, Homo Sapiens
GSLEVAVHG

SEQ ID NO: 1342323 - protein, 9 aa, Homo Sapiens
KSLNACVSH

SEQ ID NO: 1342324 - protein, 9 aa, Homo Sapiens
FPSIEEAWS

SEQ ID NO: 1342325 - protein, 9 aa, Homo Sapiens
RCLVTAPVA

SEQ ID NO: 1342326 - protein, 9 aa, Homo Sapiens
MFPESASDT

SEQ ID NO: 1342327 - protein, 9 aa, Homo Sapiens
WAFRTQAPF

SEQ ID NO: 1342328 - protein, 9 aa, Homo Sapiens
IVYSGKMNL

SEQ ID NO: 1342329 - protein, 9 aa, Homo Sapiens
NFQALKYVH

SEQ ID NO: 1342330 - protein, 9 aa, Homo Sapiens
DKYRMRKKF

SEQ ID NO: 1342331 - protein, 9 aa, Homo Sapiens
THGYSFTLQ

SEQ ID NO: 1342332 - protein, 9 aa, Homo Sapiens
RSPFHVVWL

SEQ ID NO: 1342333 - protein, 9 aa, Homo Sapiens
IILISDVVM

SEQ ID NO: 1342334 - protein, 9 aa, Homo Sapiens
GFASLVEYV

SEQ ID NO: 1342335 - protein, 9 aa, Homo Sapiens
KTEAISGDC

SEQ ID NO: 1342336 - protein, 9 aa, Homo Sapiens
SKVPSEVPS

SEQ ID NO: 1342337 - protein, 9 aa, Homo Sapiens
KRWILPDSQ

SEQ ID NO: 1342338 - protein, 9 aa, Homo Sapiens
TRGKLRHRH

SEQ ID NO: 1342339 - protein, 9 aa, Homo Sapiens
INAEVKSAI

SEQ ID NO: 1342340 - protein, 9 aa, Homo Sapiens
WQKSEVDIV

SEQ ID NO: 1342341 - protein, 9 aa, Homo Sapiens
HMHGPNLIL

SEQ ID NO: 1342342 - protein, 9 aa, Homo Sapiens
TKFTIPDFK

SEQ ID NO: 1342343 - protein, 9 aa, Homo Sapiens
TNLLIHYGL

SEQ ID NO: 1342344 - protein, 9 aa, Homo Sapiens
ATTEANNLA

SEQ ID NO: 1342345 - protein, 9 aa, Homo Sapiens
NCFESAEES

SEQ ID NO: 1342346 - protein, 9 aa, Homo Sapiens
KGCNKFVTV

SEQ ID NO: 1342347 - protein, 9 aa, Homo Sapiens
CLYKVIRKL

SEQ ID NO: 1342348 - protein, 9 aa, Homo Sapiens
IIYKLGGDE

SEQ ID NO: 1342349 - protein, 9 aa, Homo Sapiens
NFDVDGRMD

SEQ ID NO: 1342350 - protein, 9 aa, Homo Sapiens
WNNSKLPND

SEQ ID NO: 1342351 - protein, 9 aa, Homo Sapiens
HLKYVSITQ

SEQ ID NO: 1342352 - protein, 9 aa, Homo Sapiens
PILSLSVPP

SEQ ID NO: 1342353 - protein, 9 aa, Homo Sapiens
FLPRMIHDL

SEQ ID NO: 1342354 - protein, 9 aa, Homo Sapiens
GVWKPPLVD

SEQ ID NO: 1342355 - protein, 9 aa, Homo Sapiens
TMKGSNQFH

SEQ ID NO: 1342356 - protein, 9 aa, Homo Sapiens
KYATEKKDS

SEQ ID NO: 1342357 - protein, 9 aa, Homo Sapiens
VNKVLLKVI

SEQ ID NO: 1342358 - protein, 9 aa, Homo Sapiens
QRHPTIVLD

SEQ ID NO: 1342359 - protein, 9 aa, Homo Sapiens
FFDVEWAAK

SEQ ID NO: 1342360 - protein, 9 aa, Homo Sapiens
SHSLLRSKQ

SEQ ID NO: 1342361 - protein, 9 aa, Homo Sapiens
EGDNPKESP

SEQ ID NO: 1342362 - protein, 9 aa, Homo Sapiens
KQQVSYKED

SEQ ID NO: 1342363 - protein, 9 aa, Homo Sapiens
EGDDNWANY

SEQ ID NO: 1342364 - protein, 9 aa, Homo Sapiens
VDTEIKFLK

SEQ ID NO: 1342365 - protein, 9 aa, Homo Sapiens
DGLPAPNNN

SEQ ID NO: 1342366 - protein, 9 aa, Homo Sapiens
KWCEEMKYC

SEQ ID NO: 1342367 - protein, 9 aa, Homo Sapiens
ITEQSGTHD

SEQ ID NO: 1342368 - protein, 9 aa, Homo Sapiens
NKQPKRCPI

SEQ ID NO: 1342369 - protein, 9 aa, Homo Sapiens
QAQDALDTL

SEQ ID NO: 1342370 - protein, 9 aa, Homo Sapiens
KVRKCLANS

SEQ ID NO: 1342371 - protein, 9 aa, Homo Sapiens
YTNLVTVSK

SEQ ID NO: 1342372 - protein, 9 aa, Homo Sapiens
YLDREKQVF

SEQ ID NO: 1342373 - protein, 9 aa, Homo Sapiens
EALGHTWHN

SEQ ID NO: 1342374 - protein, 9 aa, Homo Sapiens
LIIICFIFI

SEQ ID NO: 1342375 - protein, 9 aa, Homo Sapiens
IIGTTSHKD

SEQ ID NO: 1342376 - protein, 9 aa, Homo Sapiens
EVCKELHHF

SEQ ID NO: 1342377 - protein, 9 aa, Homo Sapiens
QHNGKKWNL

SEQ ID NO: 1342378 - protein, 9 aa, Homo Sapiens
GKNEELIDL

SEQ ID NO: 1342379 - protein, 9 aa, Homo Sapiens
ESAAERYTN

SEQ ID NO: 1342380 - protein, 9 aa, Homo Sapiens
FCTLTAAMC

SEQ ID NO: 1342381 - protein, 9 aa, Homo Sapiens
HKILLDSVQ

SEQ ID NO: 1342382 - protein, 9 aa, Homo Sapiens
KDVYRHIVE

SEQ ID NO: 1342383 - protein, 9 aa, Homo Sapiens
MEAQMQAEL

SEQ ID NO: 1342384 - protein, 9 aa, Homo Sapiens
TKIEAPALA

SEQ ID NO: 1342385 - protein, 9 aa, Homo Sapiens
MEEPSQHDD

SEQ ID NO: 1342386 - protein, 9 aa, Homo Sapiens
SENIEKERS

SEQ ID NO: 1342387 - protein, 9 aa, Homo Sapiens
SHTEDGIII

SEQ ID NO: 1342388 - protein, 9 aa, Homo Sapiens
MVKQKISFK

SEQ ID NO: 1342389 - protein, 9 aa, Homo Sapiens
RTYFTPHWK

SEQ ID NO: 1342390 - protein, 9 aa, Homo Sapiens
PRPREDDIP

SEQ ID NO: 1342391 - protein, 9 aa, Homo Sapiens
WALLWVLLY

SEQ ID NO: 1342392 - protein, 9 aa, Homo Sapiens
LMPLRVDTL

SEQ ID NO: 1342393 - protein, 9 aa, Homo Sapiens
SGSTSRRTR

SEQ ID NO: 1342394 - protein, 9 aa, Homo Sapiens
RFSKDIGYL

SEQ ID NO: 1342395 - protein, 9 aa, Homo Sapiens
SEGSCPEHI

SEQ ID NO: 1342396 - protein, 9 aa, Homo Sapiens
RKGFVCTAL

SEQ ID NO: 1342397 - protein, 9 aa, Homo Sapiens
IFPPPSLPA

SEQ ID NO: 1342398 - protein, 9 aa, Homo Sapiens
EVLMVRFTS

SEQ ID NO: 1342399 - protein, 9 aa, Homo Sapiens
ITQLTQKPL

SEQ ID NO: 1342400 - protein, 9 aa, Homo Sapiens
ANLLTQILF

SEQ ID NO: 1342401 - protein, 9 aa, Homo Sapiens
VRCIHFLCL

SEQ ID NO: 1342402 - protein, 9 aa, Homo Sapiens
KCSLEAYFA

SEQ ID NO: 1342403 - protein, 9 aa, Homo Sapiens
SSDYIEAIY

SEQ ID NO: 1342404 - protein, 9 aa, Homo Sapiens
HRLIMMIKD

SEQ ID NO: 1342405 - protein, 9 aa, Homo Sapiens
LPHIVYAMA

SEQ ID NO: 1342406 - protein, 9 aa, Homo Sapiens
NPHKNICWG

SEQ ID NO: 1342407 - protein, 9 aa, Homo Sapiens
RTCSPCSPT

SEQ ID NO: 1342408 - protein, 9 aa, Homo Sapiens
PVMLPVIHS

SEQ ID NO: 1342409 - protein, 9 aa, Homo Sapiens
SLLFWLMIF

SEQ ID NO: 1342410 - protein, 9 aa, Homo Sapiens
ENTPCYDNV

SEQ ID NO: 1342411 - protein, 9 aa, Homo Sapiens
RDLTARNCL

SEQ ID NO: 1342412 - protein, 9 aa, Homo Sapiens
ISTLAHSAI

SEQ ID NO: 1342413 - protein, 9 aa, Homo Sapiens
HSNINGKQC

SEQ ID NO: 1342414 - protein, 9 aa, Homo Sapiens
MVAVIVYCL

SEQ ID NO: 1342415 - protein, 9 aa, Homo Sapiens
TSAAYANFF

SEQ ID NO: 1342416 - protein, 9 aa, Homo Sapiens
AITAALVEL

SEQ ID NO: 1342417 - protein, 9 aa, Homo Sapiens
EVCDLVLCE

SEQ ID NO: 1342418 - protein, 9 aa, Homo Sapiens
NIRKCTDRQ

SEQ ID NO: 1342419 - protein, 9 aa, Homo Sapiens
ELTGTCAEK

SEQ ID NO: 1342420 - protein, 9 aa, Homo Sapiens
SLNDSYMRR

SEQ ID NO: 1342421 - protein, 9 aa, Homo Sapiens
AAEPSARTT

SEQ ID NO: 1342422 - protein, 9 aa, Homo Sapiens
LRVLMSVVP

SEQ ID NO: 1342423 - protein, 9 aa, Homo Sapiens
AFLYKDRYE

SEQ ID NO: 1342424 - protein, 9 aa, Homo Sapiens
GSWGVSEAP

SEQ ID NO: 1342425 - protein, 9 aa, Homo Sapiens
PIFHDFSLS

SEQ ID NO: 1342426 - protein, 9 aa, Homo Sapiens
PWSAQLEKR

SEQ ID NO: 1342427 - protein, 9 aa, Homo Sapiens
CDASFLQSE

SEQ ID NO: 1342428 - protein, 9 aa, Homo Sapiens
VTDEHDTIL

SEQ ID NO: 1342429 - protein, 9 aa, Homo Sapiens
RTFDKIFTN

SEQ ID NO: 1342430 - protein, 9 aa, Homo Sapiens
MSSKGSMVL

SEQ ID NO: 1342431 - protein, 9 aa, Homo Sapiens
DCTQTGFYG

SEQ ID NO: 1342432 - protein, 9 aa, Homo Sapiens
FMSDRSSNT

SEQ ID NO: 1342433 - protein, 9 aa, Homo Sapiens
ANIPHAYLK

SEQ ID NO: 1342434 - protein, 9 aa, Homo Sapiens
DVPLVNLTN

SEQ ID NO: 1342435 - protein, 9 aa, Homo Sapiens
PFCMRHVKE

SEQ ID NO: 1342436 - protein, 9 aa, Homo Sapiens
DSGTSVEEA

SEQ ID NO: 1342437 - protein, 9 aa, Homo Sapiens
ISSMMMLEK

SEQ ID NO: 1342438 - protein, 9 aa, Homo Sapiens
TVVPNSPAA

SEQ ID NO: 1342439 - protein, 9 aa, Homo Sapiens
SKQEAYADS

SEQ ID NO: 1342440 - protein, 9 aa, Homo Sapiens
FITFQEKSM

SEQ ID NO: 1342441 - protein, 9 aa, Homo Sapiens
FRVVLVGLD

SEQ ID NO: 1342442 - protein, 9 aa, Homo Sapiens
PARYHITFG

SEQ ID NO: 1342443 - protein, 9 aa, Homo Sapiens
KLASVSEKG

SEQ ID NO: 1342444 - protein, 9 aa, Homo Sapiens
DHMENYNIF

SEQ ID NO: 1342445 - protein, 9 aa, Homo Sapiens
TCGRSGERS

SEQ ID NO: 1342446 - protein, 9 aa, Homo Sapiens
ILNAVLTSL

SEQ ID NO: 1342447 - protein, 9 aa, Homo Sapiens
DRPVSKLVV

SEQ ID NO: 1342448 - protein, 9 aa, Homo Sapiens
MSGETLKVR

SEQ ID NO: 1342449 - protein, 9 aa, Homo Sapiens
LSLLFSLPH

SEQ ID NO: 1342450 - protein, 9 aa, Homo Sapiens
ASRCLHCCD

SEQ ID NO: 1342451 - protein, 9 aa, Homo Sapiens
EPAEVRHCT

SEQ ID NO: 1342452 - protein, 9 aa, Homo Sapiens
LHEELLHLW

SEQ ID NO: 1342453 - protein, 9 aa, Homo Sapiens
QGLILNVTA

SEQ ID NO: 1342454 - protein, 9 aa, Homo Sapiens
LYRLEHAWL

SEQ ID NO: 1342455 - protein, 9 aa, Homo Sapiens
VEIGTVVVL

SEQ ID NO: 1342456 - protein, 9 aa, Homo Sapiens
LPEDKSRLI

SEQ ID NO: 1342457 - protein, 9 aa, Homo Sapiens
HLIVHLLAP

SEQ ID NO: 1342458 - protein, 9 aa, Homo Sapiens
HHFSIHTGE

SEQ ID NO: 1342459 - protein, 9 aa, Homo Sapiens
AHHQHHHFQ

SEQ ID NO: 1342460 - protein, 9 aa, Homo Sapiens
RDHNLQEGN

SEQ ID NO: 1342461 - protein, 9 aa, Homo Sapiens
IPRLLFAEA

SEQ ID NO: 1342462 - protein, 9 aa, Homo Sapiens
RDFVDDDDG

SEQ ID NO: 1342463 - protein, 9 aa, Homo Sapiens
KHMDKNEEE

SEQ ID NO: 1342464 - protein, 9 aa, Homo Sapiens
YQDVETLYK

SEQ ID NO: 1342465 - protein, 9 aa, Homo Sapiens
VFQHGMRQR

SEQ ID NO: 1342466 - protein, 9 aa, Homo Sapiens
DYDQYYERN

SEQ ID NO: 1342467 - protein, 9 aa, Homo Sapiens
CTIWIITQR

SEQ ID NO: 1342468 - protein, 9 aa, Homo Sapiens
CIRVVRGEG

SEQ ID NO: 1342469 - protein, 9 aa, Homo Sapiens
HTYIKTPTH

SEQ ID NO: 1342470 - protein, 9 aa, Homo Sapiens
RNLVSLGIY

SEQ ID NO: 1342471 - protein, 9 aa, Homo Sapiens
PCSLFQPHH

SEQ ID NO: 1342472 - protein, 9 aa, Homo Sapiens
TFQQMLMEK

SEQ ID NO: 1342473 - protein, 9 aa, Homo Sapiens
SLYLSSPCF

SEQ ID NO: 1342474 - protein, 9 aa, Homo Sapiens
NPRRTGHHI

SEQ ID NO: 1342475 - protein, 9 aa, Homo Sapiens
REELRMRER

SEQ ID NO: 1342476 - protein, 9 aa, Homo Sapiens
PILVSAKTI

SEQ ID NO: 1342477 - protein, 9 aa, Homo Sapiens
CPLEIEHIK

SEQ ID NO: 1342478 - protein, 9 aa, Homo Sapiens
QVSATEDEN

SEQ ID NO: 1342479 - protein, 9 aa, Homo Sapiens
HQDAHRHQG

SEQ ID NO: 1342480 - protein, 9 aa, Homo Sapiens
FMTVYKLND

SEQ ID NO: 1342481 - protein, 9 aa, Homo Sapiens
YRSRLRQHS

SEQ ID NO: 1342482 - protein, 9 aa, Homo Sapiens
EGFQRLVLS

SEQ ID NO: 1342483 - protein, 9 aa, Homo Sapiens
IEKLQKEMT

SEQ ID NO: 1342484 - protein, 9 aa, Homo Sapiens
KERRRRRHR

SEQ ID NO: 1342485 - protein, 9 aa, Homo Sapiens
VVQPEKQVS

SEQ ID NO: 1342486 - protein, 9 aa, Homo Sapiens
PPKQKGCVA

SEQ ID NO: 1342487 - protein, 9 aa, Homo Sapiens
SRHQTTIWR

SEQ ID NO: 1342488 - protein, 9 aa, Homo Sapiens
EPGNSSDAG

SEQ ID NO: 1342489 - protein, 9 aa, Homo Sapiens
QTPCGRGPQ

SEQ ID NO: 1342490 - protein, 9 aa, Homo Sapiens
TSTSRTQKS

SEQ ID NO: 1342491 - protein, 9 aa, Homo Sapiens
GHLLFSSCS

SEQ ID NO: 1342492 - protein, 9 aa, Homo Sapiens
RLPPFAELH

SEQ ID NO: 1342493 - protein, 9 aa, Homo Sapiens
EKKTRHLGA

SEQ ID NO: 1342494 - protein, 9 aa, Homo Sapiens
LTRALPLND

SEQ ID NO: 1342495 - protein, 9 aa, Homo Sapiens
QVYNNQEPL

SEQ ID NO: 1342496 - protein, 9 aa, Homo Sapiens
PNYRHSRLE

SEQ ID NO: 1342497 - protein, 9 aa, Homo Sapiens
LTDMFLGLL

SEQ ID NO: 1342498 - protein, 9 aa, Homo Sapiens
LANILMALQ

SEQ ID NO: 1342499 - protein, 9 aa, Homo Sapiens
YTIYNTSTD

SEQ ID NO: 1342500 - protein, 9 aa, Homo Sapiens
EAPHVDGER

SEQ ID NO: 1342501 - protein, 9 aa, Homo Sapiens
GSEVMYDVV

SEQ ID NO: 1342502 - protein, 9 aa, Homo Sapiens
IGHYFITTL

SEQ ID NO: 1342503 - protein, 9 aa, Homo Sapiens
YEMSGETLK

SEQ ID NO: 1342504 - protein, 9 aa, Homo Sapiens
VILNLIFSS

SEQ ID NO: 1342505 - protein, 9 aa, Homo Sapiens
EYKNVGSKR

SEQ ID NO: 1342506 - protein, 9 aa, Homo Sapiens
AMCTLSEDT

SEQ ID NO: 1342507 - protein, 9 aa, Homo Sapiens
QSTNRSLEE

SEQ ID NO: 1342508 - protein, 9 aa, Homo Sapiens
LQSLMHQSK

SEQ ID NO: 1342509 - protein, 9 aa, Homo Sapiens
EEVNNKLIG

SEQ ID NO: 1342510 - protein, 9 aa, Homo Sapiens
HSLSSDPRA

SEQ ID NO: 1342511 - protein, 9 aa, Homo Sapiens
RLGLTRMYF

SEQ ID NO: 1342512 - protein, 9 aa, Homo Sapiens
WNFTGTHSG

SEQ ID NO: 1342513 - protein, 9 aa, Homo Sapiens
CTPANWTLL

SEQ ID NO: 1342514 - protein, 9 aa, Homo Sapiens
DGLESIPSL

SEQ ID NO: 1342515 - protein, 9 aa, Homo Sapiens
ENKDEYIDL

SEQ ID NO: 1342516 - protein, 9 aa, Homo Sapiens
MDIYNCVKT

SEQ ID NO: 1342517 - protein, 9 aa, Homo Sapiens
SAEQLRLPL

SEQ ID NO: 1342518 - protein, 9 aa, Homo Sapiens
SNCVHKVAE

SEQ ID NO: 1342519 - protein, 9 aa, Homo Sapiens
LLSYVGCVI

SEQ ID NO: 1342520 - protein, 9 aa, Homo Sapiens
YVALTVQGH

SEQ ID NO: 1342521 - protein, 9 aa, Homo Sapiens
EFLLIFRKV

SEQ ID NO: 1342522 - protein, 9 aa, Homo Sapiens
QQDVEDTTA

SEQ ID NO: 1342523 - protein, 9 aa, Homo Sapiens
PAAPKILRL

SEQ ID NO: 1342524 - protein, 9 aa, Homo Sapiens
DGCSPHYIL

SEQ ID NO: 1342525 - protein, 9 aa, Homo Sapiens
IAIHMWKGY

SEQ ID NO: 1342526 - protein, 9 aa, Homo Sapiens
AWRKQHQVD

SEQ ID NO: 1342527 - protein, 9 aa, Homo Sapiens
GPAEPPHPP

SEQ ID NO: 1342528 - protein, 9 aa, Homo Sapiens
ELTAATGEC

SEQ ID NO: 1342529 - protein, 9 aa, Homo Sapiens
SRYITIRWK

SEQ ID NO: 1342530 - protein, 9 aa, Homo Sapiens
WLGPDQVPL

SEQ ID NO: 1342531 - protein, 9 aa, Homo Sapiens
ELDPVWLMV

SEQ ID NO: 1342532 - protein, 9 aa, Homo Sapiens
NQEILPVFI

SEQ ID NO: 1342533 - protein, 9 aa, Homo Sapiens
GCIVMTDLK

SEQ ID NO: 1342534 - protein, 9 aa, Homo Sapiens
QGSKGSDDT

SEQ ID NO: 1342535 - protein, 9 aa, Homo Sapiens
NCSHCVLLL

SEQ ID NO: 1342536 - protein, 9 aa, Homo Sapiens
RTRQALASE

SEQ ID NO: 1342537 - protein, 9 aa, Homo Sapiens
VVAVGTGFC

SEQ ID NO: 1342538 - protein, 9 aa, Homo Sapiens
ACSPERARP

SEQ ID NO: 1342539 - protein, 9 aa, Homo Sapiens
QALGQALHL

SEQ ID NO: 1342540 - protein, 9 aa, Homo Sapiens
CDHYQHILQ

SEQ ID NO: 1342541 - protein, 9 aa, Homo Sapiens
PSQSVRKAL

SEQ ID NO: 1342542 - protein, 9 aa, Homo Sapiens
LVQQCQTIH

SEQ ID NO: 1342543 - protein, 9 aa, Homo Sapiens
RTQHYLYEN

SEQ ID NO: 1342544 - protein, 9 aa, Homo Sapiens
EECLKGQLC

SEQ ID NO: 1342545 - protein, 9 aa, Homo Sapiens
EGFVKTTTV

SEQ ID NO: 1342546 - protein, 9 aa, Homo Sapiens
FAPFDKISD

SEQ ID NO: 1342547 - protein, 9 aa, Homo Sapiens
LEMYGVDMY

SEQ ID NO: 1342548 - protein, 9 aa, Homo Sapiens
EKRRRTRVQ

SEQ ID NO: 1342549 - protein, 9 aa, Homo Sapiens
HRGFGLFFF

SEQ ID NO: 1342550 - protein, 9 aa, Homo Sapiens
ELLTLWHVV

SEQ ID NO: 1342551 - protein, 9 aa, Homo Sapiens
SIANVEPKT

SEQ ID NO: 1342552 - protein, 9 aa, Homo Sapiens
RLSTVHNAD

SEQ ID NO: 1342553 - protein, 9 aa, Homo Sapiens
AFLGKDKKF

SEQ ID NO: 1342554 - protein, 9 aa, Homo Sapiens
LDYIDRLFQ

SEQ ID NO: 1342555 - protein, 9 aa, Homo Sapiens
NQNLINVCT

SEQ ID NO: 1342556 - protein, 9 aa, Homo Sapiens
PTFTWNNSK

SEQ ID NO: 1342557 - protein, 9 aa, Homo Sapiens
KGWKEIKYE

SEQ ID NO: 1342558 - protein, 9 aa, Homo Sapiens
ACNVIEEFR

SEQ ID NO: 1342559 - protein, 9 aa, Homo Sapiens
SNMNNLVSE

SEQ ID NO: 1342560 - protein, 9 aa, Homo Sapiens
EKVDIYKLT

SEQ ID NO: 1342561 - protein, 9 aa, Homo Sapiens
TDLMEKSSK

SEQ ID NO: 1342562 - protein, 9 aa, Homo Sapiens
PQCATSNVF

SEQ ID NO: 1342563 - protein, 9 aa, Homo Sapiens
VAIHYINPR

SEQ ID NO: 1342564 - protein, 9 aa, Homo Sapiens
KRKGFVCTA

SEQ ID NO: 1342565 - protein, 9 aa, Homo Sapiens
HPENAVSVQ

SEQ ID NO: 1342566 - protein, 9 aa, Homo Sapiens
HMTSISDLE

SEQ ID NO: 1342567 - protein, 9 aa, Homo Sapiens
QVSPTAIKK

SEQ ID NO: 1342568 - protein, 9 aa, Homo Sapiens
KEDTVEVLA

SEQ ID NO: 1342569 - protein, 9 aa, Homo Sapiens
KVHEIVEKI

SEQ ID NO: 1342570 - protein, 9 aa, Homo Sapiens
APSRTWQGN

SEQ ID NO: 1342571 - protein, 9 aa, Homo Sapiens
DPKDDTTRE

SEQ ID NO: 1342572 - protein, 9 aa, Homo Sapiens
QNGCQDVHK

SEQ ID NO: 1342573 - protein, 9 aa, Homo Sapiens
FRSITRTYY

SEQ ID NO: 1342574 - protein, 9 aa, Homo Sapiens
LTREGLPVR

SEQ ID NO: 1342575 - protein, 9 aa, Homo Sapiens
VSLLMNLPE

SEQ ID NO: 1342576 - protein, 9 aa, Homo Sapiens
CQEFTLSVN

SEQ ID NO: 1342577 - protein, 9 aa, Homo Sapiens
HSLLRSKQR

SEQ ID NO: 1342578 - protein, 9 aa, Homo Sapiens
AFLPHRILS

SEQ ID NO: 1342579 - protein, 9 aa, Homo Sapiens
HFIKRRTAP

SEQ ID NO: 1342580 - protein, 9 aa, Homo Sapiens
FIVANSGFI

SEQ ID NO: 1342581 - protein, 9 aa, Homo Sapiens
TYLCQRARF

SEQ ID NO: 1342582 - protein, 9 aa, Homo Sapiens
VIANSLTCV

SEQ ID NO: 1342583 - protein, 9 aa, Homo Sapiens
LALRTIQVW

SEQ ID NO: 1342584 - protein, 9 aa, Homo Sapiens
ALDYEGDTV

SEQ ID NO: 1342585 - protein, 9 aa, Homo Sapiens
HWKKDGQLL

SEQ ID NO: 1342586 - protein, 9 aa, Homo Sapiens
FPQLGATLF

SEQ ID NO: 1342587 - protein, 9 aa, Homo Sapiens
INDVGPADT

SEQ ID NO: 1342588 - protein, 9 aa, Homo Sapiens
YTVLLDGCS

SEQ ID NO: 1342589 - protein, 9 aa, Homo Sapiens
GNTPKLLPA

SEQ ID NO: 1342590 - protein, 9 aa, Homo Sapiens
FKGFFPVTF

SEQ ID NO: 1342591 - protein, 9 aa, Homo Sapiens
QVARGEDPT

SEQ ID NO: 1342592 - protein, 9 aa, Homo Sapiens
NMGTSFKVY

SEQ ID NO: 1342593 - protein, 9 aa, Homo Sapiens
MQCWCCKRY

SEQ ID NO: 1342594 - protein, 9 aa, Homo Sapiens
FQMVKQKIS

SEQ ID NO: 1342595 - protein, 9 aa, Homo Sapiens
SRYIVSDNT

SEQ ID NO: 1342596 - protein, 9 aa, Homo Sapiens
WCFGPDSTG

SEQ ID NO: 1342597 - protein, 9 aa, Homo Sapiens
FRKVAAGEL

SEQ ID NO: 1342598 - protein, 9 aa, Homo Sapiens
NFVTPVIHS

SEQ ID NO: 1342599 - protein, 9 aa, Homo Sapiens
VDSDSEEEE

SEQ ID NO: 1342600 - protein, 9 aa, Homo Sapiens
PATFTAHTA

SEQ ID NO: 1342601 - protein, 9 aa, Homo Sapiens
AHRAVDVGA

SEQ ID NO: 1342602 - protein, 9 aa, Homo Sapiens
FHSSLATAI

SEQ ID NO: 1342603 - protein, 9 aa, Homo Sapiens
EQYHIDFEQ

SEQ ID NO: 1342604 - protein, 9 aa, Homo Sapiens
VVGIPDNKL

SEQ ID NO: 1342605 - protein, 9 aa, Homo Sapiens
IVANSGFIC

SEQ ID NO: 1342606 - protein, 9 aa, Homo Sapiens
EIQEIHDEQ

SEQ ID NO: 1342607 - protein, 9 aa, Homo Sapiens
KIHRMGAVA

SEQ ID NO: 1342608 - protein, 9 aa, Homo Sapiens
WQRGSITPR

SEQ ID NO: 1342609 - protein, 9 aa, Homo Sapiens
KWCCFDVHI

SEQ ID NO: 1342610 - protein, 9 aa, Homo Sapiens
RHFFCDMSP

SEQ ID NO: 1342611 - protein, 9 aa, Homo Sapiens
RSPSSATSA

SEQ ID NO: 1342612 - protein, 9 aa, Homo Sapiens
DSQEEELEC

SEQ ID NO: 1342613 - protein, 9 aa, Homo Sapiens
HHHRSKSQQ

SEQ ID NO: 1342614 - protein, 9 aa, Homo Sapiens
EVSSPKRQQ

SEQ ID NO: 1342615 - protein, 9 aa, Homo Sapiens
SWIMGSMDA

SEQ ID NO: 1342616 - protein, 9 aa, Homo Sapiens
GCCREDVMV

SEQ ID NO: 1342617 - protein, 9 aa, Homo Sapiens
PEPLQRPGM

SEQ ID NO: 1342618 - protein, 9 aa, Homo Sapiens
SGSSDDLVN

SEQ ID NO: 1342619 - protein, 9 aa, Homo Sapiens
EIQKEDPKA

SEQ ID NO: 1342620 - protein, 9 aa, Homo Sapiens
QLTTAEKSA

SEQ ID NO: 1342621 - protein, 9 aa, Homo Sapiens
PTAAPASTP

SEQ ID NO: 1342622 - protein, 9 aa, Homo Sapiens
LLHENCRMF

SEQ ID NO: 1342623 - protein, 9 aa, Homo Sapiens
LPIFSSIFL

SEQ ID NO: 1342624 - protein, 9 aa, Homo Sapiens
DTSFQVVLD

SEQ ID NO: 1342625 - protein, 9 aa, Homo Sapiens
ILRQFRAAG

SEQ ID NO: 1342626 - protein, 9 aa, Homo Sapiens
CLRWMRQEQ

SEQ ID NO: 1342627 - protein, 9 aa, Homo Sapiens
AQELRALRG

SEQ ID NO: 1342628 - protein, 9 aa, Homo Sapiens
RMTVLTLYT

SEQ ID NO: 1342629 - protein, 9 aa, Homo Sapiens
ALHLNRSLT

SEQ ID NO: 1342630 - protein, 9 aa, Homo Sapiens
EHHMNPSSN

SEQ ID NO: 1342631 - protein, 9 aa, Homo Sapiens
HEVSAHFHE

SEQ ID NO: 1342632 - protein, 9 aa, Homo Sapiens
CEDGNHFIN

SEQ ID NO: 1342633 - protein, 9 aa, Homo Sapiens
SSVFYTNVM

SEQ ID NO: 1342634 - protein, 9 aa, Homo Sapiens
YITEIAPQH

SEQ ID NO: 1342635 - protein, 9 aa, Homo Sapiens
CPYFSPYAV

SEQ ID NO: 1342636 - protein, 9 aa, Homo Sapiens
AIPGKKGTH

SEQ ID NO: 1342637 - protein, 9 aa, Homo Sapiens
TVASLHLVF

SEQ ID NO: 1342638 - protein, 9 aa, Homo Sapiens
VRKYVGSNI

SEQ ID NO: 1342639 - protein, 9 aa, Homo Sapiens
RRRKERRRR

SEQ ID NO: 1342640 - protein, 9 aa, Homo Sapiens
GAEQYLVQT

SEQ ID NO: 1342641 - protein, 9 aa, Homo Sapiens
GVHPATFTA

SEQ ID NO: 1342642 - protein, 9 aa, Homo Sapiens
QYLTYHCRC

SEQ ID NO: 1342643 - protein, 9 aa, Homo Sapiens
MNQRLCCTL

SEQ ID NO: 1342644 - protein, 9 aa, Homo Sapiens
SHSIYPAQV

SEQ ID NO: 1342645 - protein, 9 aa, Homo Sapiens
RRSLSPKPC

SEQ ID NO: 1342646 - protein, 9 aa, Homo Sapiens
SNRDELRCR

SEQ ID NO: 1342647 - protein, 9 aa, Homo Sapiens
LGMKDTAEL

SEQ ID NO: 1342648 - protein, 9 aa, Homo Sapiens
ATPDDRNQD

SEQ ID NO: 1342649 - protein, 9 aa, Homo Sapiens
AKEKNEKGV

SEQ ID NO: 1342650 - protein, 9 aa, Homo Sapiens
TYHAEGGWP

SEQ ID NO: 1342651 - protein, 9 aa, Homo Sapiens
GSKGSDDTQ

SEQ ID NO: 1342652 - protein, 9 aa, Homo Sapiens
RWTRDASII

SEQ ID NO: 1342653 - protein, 9 aa, Homo Sapiens
QRLKVHMKT

SEQ ID NO: 1342654 - protein, 9 aa, Homo Sapiens
GQPLRKPDI

SEQ ID NO: 1342655 - protein, 9 aa, Homo Sapiens
KTDDILWQW

SEQ ID NO: 1342656 - protein, 9 aa, Homo Sapiens
REEAALVAQ

SEQ ID NO: 1342657 - protein, 9 aa, Homo Sapiens
NCKELEWLT

SEQ ID NO: 1342658 - protein, 9 aa, Homo Sapiens
HKAAVKGDT

SEQ ID NO: 1342659 - protein, 9 aa, Homo Sapiens
MREREPDGE

SEQ ID NO: 1342660 - protein, 9 aa, Homo Sapiens
YLIPHDVGS

SEQ ID NO: 1342661 - protein, 9 aa, Homo Sapiens
MVCNSDHVL

SEQ ID NO: 1342662 - protein, 9 aa, Homo Sapiens
FENEEHLRQ

SEQ ID NO: 1342663 - protein, 9 aa, Homo Sapiens
IQINFVFAL

SEQ ID NO: 1342664 - protein, 9 aa, Homo Sapiens
QSSQTHSLI

SEQ ID NO: 1342665 - protein, 9 aa, Homo Sapiens
TFNVTVLHD

SEQ ID NO: 1342666 - protein, 9 aa, Homo Sapiens
DGIIIATKN

SEQ ID NO: 1342667 - protein, 9 aa, Homo Sapiens
HIFTSIGED

SEQ ID NO: 1342668 - protein, 9 aa, Homo Sapiens
NESSREELL

SEQ ID NO: 1342669 - protein, 9 aa, Homo Sapiens
WRWGSTAGG

SEQ ID NO: 1342670 - protein, 9 aa, Homo Sapiens
DTGNRALEL

SEQ ID NO: 1342671 - protein, 9 aa, Homo Sapiens
LIKMACDGT

SEQ ID NO: 1342672 - protein, 9 aa, Homo Sapiens
AQHHSYMRL

SEQ ID NO: 1342673 - protein, 9 aa, Homo Sapiens
CTTFGSFNS

SEQ ID NO: 1342674 - protein, 9 aa, Homo Sapiens
PIHAAKLNV

SEQ ID NO: 1342675 - protein, 9 aa, Homo Sapiens
RVAMKEVLK

SEQ ID NO: 1342676 - protein, 9 aa, Homo Sapiens
LEVLDGFFF

SEQ ID NO: 1342677 - protein, 9 aa, Homo Sapiens
VIAEYANDS

SEQ ID NO: 1342678 - protein, 9 aa, Homo Sapiens
RFRFNRCDL

SEQ ID NO: 1342679 - protein, 9 aa, Homo Sapiens
YEELHARAG

SEQ ID NO: 1342680 - protein, 9 aa, Homo Sapiens
LNLVDNEIE

SEQ ID NO: 1342681 - protein, 9 aa, Homo Sapiens
GIGAGMDSY

SEQ ID NO: 1342682 - protein, 9 aa, Homo Sapiens
LLMYTCLLW

SEQ ID NO: 1342683 - protein, 9 aa, Homo Sapiens
GYMPSGDVS

SEQ ID NO: 1342684 - protein, 9 aa, Homo Sapiens
RIYPSAYHI

SEQ ID NO: 1342685 - protein, 9 aa, Homo Sapiens
LANRHILLS

SEQ ID NO: 1342686 - protein, 9 aa, Homo Sapiens
DKLDVVCSF

SEQ ID NO: 1342687 - protein, 9 aa, Homo Sapiens
CDSIITICR

SEQ ID NO: 1342688 - protein, 9 aa, Homo Sapiens
ITPWNYPLN

SEQ ID NO: 1342689 - protein, 9 aa, Homo Sapiens
ALQDASVAC

SEQ ID NO: 1342690 - protein, 9 aa, Homo Sapiens
VDSLSEYSP

SEQ ID NO: 1342691 - protein, 9 aa, Homo Sapiens
EKQYPPHCP

SEQ ID NO: 1342692 - protein, 9 aa, Homo Sapiens
RINLARAVY

SEQ ID NO: 1342693 - protein, 9 aa, Homo Sapiens
AHAFGPAVV

SEQ ID NO: 1342694 - protein, 9 aa, Homo Sapiens
SVDDSGTFE

SEQ ID NO: 1342695 - protein, 9 aa, Homo Sapiens
WLLLCDGCD

SEQ ID NO: 1342696 - protein, 9 aa, Homo Sapiens
PEPVVGIPD

SEQ ID NO: 1342697 - protein, 9 aa, Homo Sapiens
GSYDKEVNS

SEQ ID NO: 1342698 - protein, 9 aa, Homo Sapiens
TYDVSSLPL

SEQ ID NO: 1342699 - protein, 9 aa, Homo Sapiens
MFEMMTGRS

SEQ ID NO: 1342700 - protein, 9 aa, Homo Sapiens
YRTVVTLDK

SEQ ID NO: 1342701 - protein, 9 aa, Homo Sapiens
TGVDAGETA

SEQ ID NO: 1342702 - protein, 9 aa, Homo Sapiens
TYILHSSPK

SEQ ID NO: 1342703 - protein, 9 aa, Homo Sapiens
AEFQKMWRD

SEQ ID NO: 1342704 - protein, 9 aa, Homo Sapiens
KNCARVEEN

SEQ ID NO: 1342705 - protein, 9 aa, Homo Sapiens
FENGNSDNK

SEQ ID NO: 1342706 - protein, 9 aa, Homo Sapiens
QIIRHEQLT

SEQ ID NO: 1342707 - protein, 9 aa, Homo Sapiens
TLVLYLVML

SEQ ID NO: 1342708 - protein, 9 aa, Homo Sapiens
PKKAVEPTV

SEQ ID NO: 1342709 - protein, 9 aa, Homo Sapiens
KVRCGVEPK

SEQ ID NO: 1342710 - protein, 9 aa, Homo Sapiens
LYVCPSTQD

SEQ ID NO: 1342711 - protein, 9 aa, Homo Sapiens
PDVIMLLEQ

SEQ ID NO: 1342712 - protein, 9 aa, Homo Sapiens
YKGIHPAPG

SEQ ID NO: 1342713 - protein, 9 aa, Homo Sapiens
RRCGWLDLI

SEQ ID NO: 1342714 - protein, 9 aa, Homo Sapiens
WGDIIGVQG

SEQ ID NO: 1342715 - protein, 9 aa, Homo Sapiens
KALLVLLSF

SEQ ID NO: 1342716 - protein, 9 aa, Homo Sapiens
PTLRNHRSS

SEQ ID NO: 1342717 - protein, 9 aa, Homo Sapiens
KPEFKKTTE

SEQ ID NO: 1342718 - protein, 9 aa, Homo Sapiens
TTTDGESVM

SEQ ID NO: 1342719 - protein, 9 aa, Homo Sapiens
WKEAANGDK

SEQ ID NO: 1342720 - protein, 9 aa, Homo Sapiens
YPADHSFIL

SEQ ID NO: 1342721 - protein, 9 aa, Homo Sapiens
AARSAMITD

SEQ ID NO: 1342722 - protein, 9 aa, Homo Sapiens
HQGHPLPAS

SEQ ID NO: 1342723 - protein, 9 aa, Homo Sapiens
MRGVGLGPV

SEQ ID NO: 1342724 - protein, 9 aa, Homo Sapiens
QDCAHFVCS

SEQ ID NO: 1342725 - protein, 9 aa, Homo Sapiens
QNDPHFIGN

SEQ ID NO: 1342726 - protein, 9 aa, Homo Sapiens
QIWDMAGQE

SEQ ID NO: 1342727 - protein, 9 aa, Homo Sapiens
DHYRTALRS

SEQ ID NO: 1342728 - protein, 9 aa, Homo Sapiens
STSRDSRSF

SEQ ID NO: 1342729 - protein, 9 aa, Homo Sapiens
KLQKKKNKE

SEQ ID NO: 1342730 - protein, 9 aa, Homo Sapiens
EVCPQDTVS

SEQ ID NO: 1342731 - protein, 9 aa, Homo Sapiens
RQLGEQQRL

SEQ ID NO: 1342732 - protein, 9 aa, Homo Sapiens
YQLCKPDVI

SEQ ID NO: 1342733 - protein, 9 aa, Homo Sapiens
TVCFNIVGS

SEQ ID NO: 1342734 - protein, 9 aa, Homo Sapiens
LRTANEIYK

SEQ ID NO: 1342735 - protein, 9 aa, Homo Sapiens
AKATMNVKQ

SEQ ID NO: 1342736 - protein, 9 aa, Homo Sapiens
ITQRNSSLL

SEQ ID NO: 1342737 - protein, 9 aa, Homo Sapiens
LERHWHYFD

SEQ ID NO: 1342738 - protein, 9 aa, Homo Sapiens
VVPNSPAAI

SEQ ID NO: 1342739 - protein, 9 aa, Homo Sapiens
TFLLAEAWD

SEQ ID NO: 1342740 - protein, 9 aa, Homo Sapiens
LLGQKSQHY

SEQ ID NO: 1342741 - protein, 9 aa, Homo Sapiens
SIALFFYFR

SEQ ID NO: 1342742 - protein, 9 aa, Homo Sapiens
TIVSGKKCR

SEQ ID NO: 1342743 - protein, 9 aa, Homo Sapiens
EQGVTHITD

SEQ ID NO: 1342744 - protein, 9 aa, Homo Sapiens
CWFQLGHSM

SEQ ID NO: 1342745 - protein, 9 aa, Homo Sapiens
HASVCRLTP

SEQ ID NO: 1342746 - protein, 9 aa, Homo Sapiens
KEVQEAKKG

SEQ ID NO: 1342747 - protein, 9 aa, Homo Sapiens
QFVDLCPTG

SEQ ID NO: 1342748 - protein, 9 aa, Homo Sapiens
QMLQELVNT

SEQ ID NO: 1342749 - protein, 9 aa, Homo Sapiens
PHSCRDVPD

SEQ ID NO: 1342750 - protein, 9 aa, Homo Sapiens
YAWGRAAAV

SEQ ID NO: 1342751 - protein, 9 aa, Homo Sapiens
LSITVDGKT

SEQ ID NO: 1342752 - protein, 9 aa, Homo Sapiens
CRTFDKIFT

SEQ ID NO: 1342753 - protein, 9 aa, Homo Sapiens
PSVKSLHLL

SEQ ID NO: 1342754 - protein, 9 aa, Homo Sapiens
FKSFVILFI

SEQ ID NO: 1342755 - protein, 9 aa, Homo Sapiens
KEVILLRRS

SEQ ID NO: 1342756 - protein, 9 aa, Homo Sapiens
VSPSRECSP

SEQ ID NO: 1342757 - protein, 9 aa, Homo Sapiens
SGGHSGDPS

SEQ ID NO: 1342758 - protein, 9 aa, Homo Sapiens
DLLEEECHT

SEQ ID NO: 1342759 - protein, 9 aa, Homo Sapiens
YYNKHILHK

SEQ ID NO: 1342760 - protein, 9 aa, Homo Sapiens
KWGLKDVML

SEQ ID NO: 1342761 - protein, 9 aa, Homo Sapiens
KICVNGDNA

SEQ ID NO: 1342762 - protein, 9 aa, Homo Sapiens
EFWERSQQR

SEQ ID NO: 1342763 - protein, 9 aa, Homo Sapiens
HTDQEIKIL

SEQ ID NO: 1342764 - protein, 9 aa, Homo Sapiens
TREDIMEIS

SEQ ID NO: 1342765 - protein, 9 aa, Homo Sapiens
PQSNSYCSL

SEQ ID NO: 1342766 - protein, 9 aa, Homo Sapiens
GEPSPWQGS

SEQ ID NO: 1342767 - protein, 9 aa, Homo Sapiens
EVFFVDYDN

SEQ ID NO: 1342768 - protein, 9 aa, Homo Sapiens
TVGQLMEFC

SEQ ID NO: 1342769 - protein, 9 aa, Homo Sapiens
LGVFATGRF

SEQ ID NO: 1342770 - protein, 9 aa, Homo Sapiens
CENKCGAHM

SEQ ID NO: 1342771 - protein, 9 aa, Homo Sapiens
SEVMYDVVS

SEQ ID NO: 1342772 - protein, 9 aa, Homo Sapiens
FAQINCFES

SEQ ID NO: 1342773 - protein, 9 aa, Homo Sapiens
HGVSCWSGF

SEQ ID NO: 1342774 - protein, 9 aa, Homo Sapiens
DMAYCLISA

SEQ ID NO: 1342775 - protein, 9 aa, Homo Sapiens
LGKVRCGVE

SEQ ID NO: 1342776 - protein, 9 aa, Homo Sapiens
CIPACVIGA

SEQ ID NO: 1342777 - protein, 9 aa, Homo Sapiens
FCMRHVKEM

SEQ ID NO: 1342778 - protein, 9 aa, Homo Sapiens
QVQFYEMIA

SEQ ID NO: 1342779 - protein, 9 aa, Homo Sapiens
LVCGEFLQL

SEQ ID NO: 1342780 - protein, 9 aa, Homo Sapiens
QDYSMSSAH

SEQ ID NO: 1342781 - protein, 9 aa, Homo Sapiens
MLGTKIKAM

SEQ ID NO: 1342782 - protein, 9 aa, Homo Sapiens
LDFSIIITE

SEQ ID NO: 1342783 - protein, 9 aa, Homo Sapiens
KHIDCHMTS

SEQ ID NO: 1342784 - protein, 9 aa, Homo Sapiens
LSDPITDKP

SEQ ID NO: 1342785 - protein, 9 aa, Homo Sapiens
ITQMMVYVP

SEQ ID NO: 1342786 - protein, 9 aa, Homo Sapiens
AITIFHDTI

SEQ ID NO: 1342787 - protein, 9 aa, Homo Sapiens
LDGHSGQCV

SEQ ID NO: 1342788 - protein, 9 aa, Homo Sapiens
EHNIILYEN

SEQ ID NO: 1342789 - protein, 9 aa, Homo Sapiens
YLAHRKMHA

SEQ ID NO: 1342790 - protein, 9 aa, Homo Sapiens
GGHTEPVML

SEQ ID NO: 1342791 - protein, 9 aa, Homo Sapiens
LKKAMIMYN

SEQ ID NO: 1342792 - protein, 9 aa, Homo Sapiens
TRNVYHIIS

SEQ ID NO: 1342793 - protein, 9 aa, Homo Sapiens
SLSSHVSSE

SEQ ID NO: 1342794 - protein, 9 aa, Homo Sapiens
AKKARGKSV

SEQ ID NO: 1342795 - protein, 9 aa, Homo Sapiens
DHLPQLILP

SEQ ID NO: 1342796 - protein, 9 aa, Homo Sapiens
QEEIEDPSV

SEQ ID NO: 1342797 - protein, 9 aa, Homo Sapiens
TYSLTYRQE

SEQ ID NO: 1342798 - protein, 9 aa, Homo Sapiens
CQQLLLAEE

SEQ ID NO: 1342799 - protein, 9 aa, Homo Sapiens
FPDPNIKYV

SEQ ID NO: 1342800 - protein, 9 aa, Homo Sapiens
HGDPGVQLC

SEQ ID NO: 1342801 - protein, 9 aa, Homo Sapiens
DLIFGLNVL

SEQ ID NO: 1342802 - protein, 9 aa, Homo Sapiens
GEKTVSRRS

SEQ ID NO: 1342803 - protein, 9 aa, Homo Sapiens
CCLFLQMNL

SEQ ID NO: 1342804 - protein, 9 aa, Homo Sapiens
FRMSTHLNV

SEQ ID NO: 1342805 - protein, 9 aa, Homo Sapiens
PVLSRLLSC

SEQ ID NO: 1342806 - protein, 9 aa, Homo Sapiens
TNTWNFIES

SEQ ID NO: 1342807 - protein, 9 aa, Homo Sapiens
KGQIWRGQQ

SEQ ID NO: 1342808 - protein, 9 aa, Homo Sapiens
MKDPLTKDE

SEQ ID NO: 1342809 - protein, 9 aa, Homo Sapiens
LKNMQSLWE

SEQ ID NO: 1342810 - protein, 9 aa, Homo Sapiens
DIRFVYTPT

SEQ ID NO: 1342811 - protein, 9 aa, Homo Sapiens
GKAVLRSWY

SEQ ID NO: 1342812 - protein, 9 aa, Homo Sapiens
SSIVSCKWR

SEQ ID NO: 1342813 - protein, 9 aa, Homo Sapiens
RMTFTQSSH

SEQ ID NO: 1342814 - protein, 9 aa, Homo Sapiens
DCFLKTYTQ

SEQ ID NO: 1342815 - protein, 9 aa, Homo Sapiens
TRGNRPVAS

SEQ ID NO: 1342816 - protein, 9 aa, Homo Sapiens
LQGQKCGGT

SEQ ID NO: 1342817 - protein, 9 aa, Homo Sapiens
VPPFPICKS

SEQ ID NO: 1342818 - protein, 9 aa, Homo Sapiens
VTFIRSIGL

SEQ ID NO: 1342819 - protein, 9 aa, Homo Sapiens
INDGVSKAN

SEQ ID NO: 1342820 - protein, 9 aa, Homo Sapiens
LITLEEHLH

SEQ ID NO: 1342821 - protein, 9 aa, Homo Sapiens
VFAAASRGE

SEQ ID NO: 1342822 - protein, 9 aa, Homo Sapiens
TLGLFIVAN

SEQ ID NO: 1342823 - protein, 9 aa, Homo Sapiens
DTRGCSPPY

SEQ ID NO: 1342824 - protein, 9 aa, Homo Sapiens
AKRARNNIV

SEQ ID NO: 1342825 - protein, 9 aa, Homo Sapiens
GNRDGFNMR

SEQ ID NO: 1342826 - protein, 9 aa, Homo Sapiens
AHAALFGSY

SEQ ID NO: 1342827 - protein, 9 aa, Homo Sapiens
GSVYAITDV

SEQ ID NO: 1342828 - protein, 9 aa, Homo Sapiens
CVNTLFLCF

SEQ ID NO: 1342829 - protein, 9 aa, Homo Sapiens
LWQSPASRA

SEQ ID NO: 1342830 - protein, 9 aa, Homo Sapiens
QYDPLYSKH

SEQ ID NO: 1342831 - protein, 9 aa, Homo Sapiens
SSSPIVPMS

SEQ ID NO: 1342832 - protein, 9 aa, Homo Sapiens
DLPLKRKQH

SEQ ID NO: 1342833 - protein, 9 aa, Homo Sapiens
QTPHAEKRS

SEQ ID NO: 1342834 - protein, 9 aa, Homo Sapiens
LLCCALCIG

SEQ ID NO: 1342835 - protein, 9 aa, Homo Sapiens
LISSATSAA

SEQ ID NO: 1342836 - protein, 9 aa, Homo Sapiens
VMIMVSGFG

SEQ ID NO: 1342837 - protein, 9 aa, Homo Sapiens
EFITVITSM

SEQ ID NO: 1342838 - protein, 9 aa, Homo Sapiens
FQDYSSMVI

SEQ ID NO: 1342839 - protein, 9 aa, Homo Sapiens
KCDCTQTGF

SEQ ID NO: 1342840 - protein, 9 aa, Homo Sapiens
GKLLVKKIM

SEQ ID NO: 1342841 - protein, 9 aa, Homo Sapiens
HQVDYILAT

SEQ ID NO: 1342842 - protein, 9 aa, Homo Sapiens
KKWNLFPRS

SEQ ID NO: 1342843 - protein, 9 aa, Homo Sapiens
GVMDIYNCV

SEQ ID NO: 1342844 - protein, 9 aa, Homo Sapiens
MGGNRSICL

SEQ ID NO: 1342845 - protein, 9 aa, Homo Sapiens
MISKQIHQH

SEQ ID NO: 1342846 - protein, 9 aa, Homo Sapiens
VLVPPSVPH

SEQ ID NO: 1342847 - protein, 9 aa, Homo Sapiens
PWLHHPKAG

SEQ ID NO: 1342848 - protein, 9 aa, Homo Sapiens
KKARGKSVR

SEQ ID NO: 1342849 - protein, 9 aa, Homo Sapiens
QEVNGPRAI

SEQ ID NO: 1342850 - protein, 9 aa, Homo Sapiens
ATARKVLSR

SEQ ID NO: 1342851 - protein, 9 aa, Homo Sapiens
IYHGSTKHM

SEQ ID NO: 1342852 - protein, 9 aa, Homo Sapiens
HITRLYGEP

SEQ ID NO: 1342853 - protein, 9 aa, Homo Sapiens
AMVFTLKHR

SEQ ID NO: 1342854 - protein, 9 aa, Homo Sapiens
RPYLRVPCP

SEQ ID NO: 1342855 - protein, 9 aa, Homo Sapiens
WCCFDVHIS

SEQ ID NO: 1342856 - protein, 9 aa, Homo Sapiens
GMRELLGGP

SEQ ID NO: 1342857 - protein, 9 aa, Homo Sapiens
RWPGDILAY

SEQ ID NO: 1342858 - protein, 9 aa, Homo Sapiens
YSRSWSRGW

SEQ ID NO: 1342859 - protein, 9 aa, Homo Sapiens
DSPCIHCLR

SEQ ID NO: 1342860 - protein, 9 aa, Homo Sapiens
CHHDKAISA

SEQ ID NO: 1342861 - protein, 9 aa, Homo Sapiens
FTCSVEDPT

SEQ ID NO: 1342862 - protein, 9 aa, Homo Sapiens
ICVNGDNAH

SEQ ID NO: 1342863 - protein, 9 aa, Homo Sapiens
THLKYVSIT

SEQ ID NO: 1342864 - protein, 9 aa, Homo Sapiens
PSTVATPPR

SEQ ID NO: 1342865 - protein, 9 aa, Homo Sapiens
NTEELCTLC

SEQ ID NO: 1342866 - protein, 9 aa, Homo Sapiens
PWDPQMSGQ

SEQ ID NO: 1342867 - protein, 9 aa, Homo Sapiens
AVKDGAIMT

SEQ ID NO: 1342868 - protein, 9 aa, Homo Sapiens
FTLKSDGTR

SEQ ID NO: 1342869 - protein, 9 aa, Homo Sapiens
QEFTLSVNA

SEQ ID NO: 1342870 - protein, 9 aa, Homo Sapiens
HYPYEYLGG

SEQ ID NO: 1342871 - protein, 9 aa, Homo Sapiens
GTLGFFCVD

SEQ ID NO: 1342872 - protein, 9 aa, Homo Sapiens
IFTIEGLFF

SEQ ID NO: 1342873 - protein, 9 aa, Homo Sapiens
REYIIRLVG

SEQ ID NO: 1342874 - protein, 9 aa, Homo Sapiens
ILIWKWGQS

SEQ ID NO: 1342875 - protein, 9 aa, Homo Sapiens
KHMKFWCKA

SEQ ID NO: 1342876 - protein, 9 aa, Homo Sapiens
SLIVGLTIA

SEQ ID NO: 1342877 - protein, 9 aa, Homo Sapiens
LDPSASEIR

SEQ ID NO: 1342878 - protein, 9 aa, Homo Sapiens
AGYLEKVCQ

SEQ ID NO: 1342879 - protein, 9 aa, Homo Sapiens
NTSYEGYAV

SEQ ID NO: 1342880 - protein, 9 aa, Homo Sapiens
PSTDVTVQG

SEQ ID NO: 1342881 - protein, 9 aa, Homo Sapiens
FLAYLCNTQ

SEQ ID NO: 1342882 - protein, 9 aa, Homo Sapiens
QDCAHACPA

SEQ ID NO: 1342883 - protein, 9 aa, Homo Sapiens
DFKRSRITY

SEQ ID NO: 1342884 - protein, 9 aa, Homo Sapiens
RKRKRKKKK

SEQ ID NO: 1342885 - protein, 9 aa, Homo Sapiens
WETIKFMYT

SEQ ID NO: 1342886 - protein, 9 aa, Homo Sapiens
THTKELKTS

SEQ ID NO: 1342887 - protein, 9 aa, Homo Sapiens
SRKGQKKIR

SEQ ID NO: 1342888 - protein, 9 aa, Homo Sapiens
RRRGVAEGT

SEQ ID NO: 1342889 - protein, 9 aa, Homo Sapiens
CWPRDARMH

SEQ ID NO: 1342890 - protein, 9 aa, Homo Sapiens
CFAYPMPFC

SEQ ID NO: 1342891 - protein, 9 aa, Homo Sapiens
NIKKGKKII

SEQ ID NO: 1342892 - protein, 9 aa, Homo Sapiens
PTSISCSYS

SEQ ID NO: 1342893 - protein, 9 aa, Homo Sapiens
FSLSPNLGA

SEQ ID NO: 1342894 - protein, 9 aa, Homo Sapiens
QKLEWETQA

SEQ ID NO: 1342895 - protein, 9 aa, Homo Sapiens
VNETATTSD

SEQ ID NO: 1342896 - protein, 9 aa, Homo Sapiens
LFRHYLRAY

SEQ ID NO: 1342897 - protein, 9 aa, Homo Sapiens
SNSSHMCMP

SEQ ID NO: 1342898 - protein, 9 aa, Homo Sapiens
KLRWGDIIG

SEQ ID NO: 1342899 - protein, 9 aa, Homo Sapiens
VIVGLIFAV

SEQ ID NO: 1342900 - protein, 9 aa, Homo Sapiens
SMVHVYEQV

SEQ ID NO: 1342901 - protein, 9 aa, Homo Sapiens
KKSIRARLV

SEQ ID NO: 1342902 - protein, 9 aa, Homo Sapiens
LHRVLQAQR

SEQ ID NO: 1342903 - protein, 9 aa, Homo Sapiens
QLSHQPHLR

SEQ ID NO: 1342904 - protein, 9 aa, Homo Sapiens
RETVKRIQI

SEQ ID NO: 1342905 - protein, 9 aa, Homo Sapiens
GGPLFNELH

SEQ ID NO: 1342906 - protein, 9 aa, Homo Sapiens
APPQPTAAP

SEQ ID NO: 1342907 - protein, 9 aa, Homo Sapiens
WARTSSRRW

SEQ ID NO: 1342908 - protein, 9 aa, Homo Sapiens
KLSFIIQPS

SEQ ID NO: 1342909 - protein, 9 aa, Homo Sapiens
SDLLVPKVD

SEQ ID NO: 1342910 - protein, 9 aa, Homo Sapiens
LKLYWGTAT

SEQ ID NO: 1342911 - protein, 9 aa, Homo Sapiens
RSLRARNII

SEQ ID NO: 1342912 - protein, 9 aa, Homo Sapiens
LDTDFRKLR

SEQ ID NO: 1342913 - protein, 9 aa, Homo Sapiens
AGAMTEKWT

SEQ ID NO: 1342914 - protein, 9 aa, Homo Sapiens
HSDYAHYSG

SEQ ID NO: 1342915 - protein, 9 aa, Homo Sapiens
TGMAFINTQ

SEQ ID NO: 1342916 - protein, 9 aa, Homo Sapiens
RWGDIIGVQ

SEQ ID NO: 1342917 - protein, 9 aa, Homo Sapiens
LLDVMSYDR

SEQ ID NO: 1342918 - protein, 9 aa, Homo Sapiens
EKVAHSILS

SEQ ID NO: 1342919 - protein, 9 aa, Homo Sapiens
HNVQCRPTQ

SEQ ID NO: 1342920 - protein, 9 aa, Homo Sapiens
KVNSAVTHL

SEQ ID NO: 1342921 - protein, 9 aa, Homo Sapiens
DDTCYRETC

SEQ ID NO: 1342922 - protein, 9 aa, Homo Sapiens
CPDACSTKI

SEQ ID NO: 1342923 - protein, 9 aa, Homo Sapiens
DHFWLETLL

SEQ ID NO: 1342924 - protein, 9 aa, Homo Sapiens
PYISNTNQA

SEQ ID NO: 1342925 - protein, 9 aa, Homo Sapiens
DNVRIVSGS

SEQ ID NO: 1342926 - protein, 9 aa, Homo Sapiens
GKLGVSELR

SEQ ID NO: 1342927 - protein, 9 aa, Homo Sapiens
SRHLGGGGG

SEQ ID NO: 1342928 - protein, 9 aa, Homo Sapiens
QALMSNSPS

SEQ ID NO: 1342929 - protein, 9 aa, Homo Sapiens
GKHFWYLPS

SEQ ID NO: 1342930 - protein, 9 aa, Homo Sapiens
SHKSGRRCW

SEQ ID NO: 1342931 - protein, 9 aa, Homo Sapiens
ICVQAHCGA

SEQ ID NO: 1342932 - protein, 9 aa, Homo Sapiens
CCLRTFIGH

SEQ ID NO: 1342933 - protein, 9 aa, Homo Sapiens
QNADMALQN

SEQ ID NO: 1342934 - protein, 9 aa, Homo Sapiens
SVEKQRVRE

SEQ ID NO: 1342935 - protein, 9 aa, Homo Sapiens
KRMVDNFHP

SEQ ID NO: 1342936 - protein, 9 aa, Homo Sapiens
VDEEGCMPF

SEQ ID NO: 1342937 - protein, 9 aa, Homo Sapiens
PAPEDLHRV

SEQ ID NO: 1342938 - protein, 9 aa, Homo Sapiens
PMNTGVDAG

SEQ ID NO: 1342939 - protein, 9 aa, Homo Sapiens
PLDWQLRCT

SEQ ID NO: 1342940 - protein, 9 aa, Homo Sapiens
KITSVKSLL

SEQ ID NO: 1342941 - protein, 9 aa, Homo Sapiens
TCFCSVFAL

SEQ ID NO: 1342942 - protein, 9 aa, Homo Sapiens
RDRQGQSTI

SEQ ID NO: 1342943 - protein, 9 aa, Homo Sapiens
AKCQCAKLE

SEQ ID NO: 1342944 - protein, 9 aa, Homo Sapiens
RLPLGIVRS

SEQ ID NO: 1342945 - protein, 9 aa, Homo Sapiens
TRESNSDRV

SEQ ID NO: 1342946 - protein, 9 aa, Homo Sapiens
RHLGGRTII

SEQ ID NO: 1342947 - protein, 9 aa, Homo Sapiens
LHRVTLSMA

SEQ ID NO: 1342948 - protein, 9 aa, Homo Sapiens
GTSFRLERA

SEQ ID NO: 1342949 - protein, 9 aa, Homo Sapiens
VVPFGGFFS

SEQ ID NO: 1342950 - protein, 9 aa, Homo Sapiens
PRHLGGRTI

SEQ ID NO: 1342951 - protein, 9 aa, Homo Sapiens
YCKGNLKSR

SEQ ID NO: 1342952 - protein, 9 aa, Homo Sapiens
QHKHLKSNQ

SEQ ID NO: 1342953 - protein, 9 aa, Homo Sapiens
PTYFSPYNG

SEQ ID NO: 1342954 - protein, 9 aa, Homo Sapiens
EVCMSHLED

SEQ ID NO: 1342955 - protein, 9 aa, Homo Sapiens
RPTILKSTV

SEQ ID NO: 1342956 - protein, 9 aa, Homo Sapiens
MGNRFVQVH

SEQ ID NO: 1342957 - protein, 9 aa, Homo Sapiens
VEMLVDCVP

SEQ ID NO: 1342958 - protein, 9 aa, Homo Sapiens
IHQEIQELK

SEQ ID NO: 1342959 - protein, 9 aa, Homo Sapiens
QNRSRTNGS

SEQ ID NO: 1342960 - protein, 9 aa, Homo Sapiens
DEKVEAGEA

SEQ ID NO: 1342961 - protein, 9 aa, Homo Sapiens
CLISAKMPE

SEQ ID NO: 1342962 - protein, 9 aa, Homo Sapiens
LLLVCTSLG

SEQ ID NO: 1342963 - protein, 9 aa, Homo Sapiens
LDGSQRPPR

SEQ ID NO: 1342964 - protein, 9 aa, Homo Sapiens
GGILTKCKG

SEQ ID NO: 1342965 - protein, 9 aa, Homo Sapiens
CQPKKPALV

SEQ ID NO: 1342966 - protein, 9 aa, Homo Sapiens
LGPCTMESA

SEQ ID NO: 1342967 - protein, 9 aa, Homo Sapiens
EPQPAVSEA

SEQ ID NO: 1342968 - protein, 9 aa, Homo Sapiens
KRVFSSFVT

SEQ ID NO: 1342969 - protein, 9 aa, Homo Sapiens
SVPENEEDT

SEQ ID NO: 1342970 - protein, 9 aa, Homo Sapiens
QDFLPSGRI

SEQ ID NO: 1342971 - protein, 9 aa, Homo Sapiens
ILQFLPEQI

SEQ ID NO: 1342972 - protein, 9 aa, Homo Sapiens
NSFSFSSTS

SEQ ID NO: 1342973 - protein, 9 aa, Homo Sapiens
CLGLAGEFL

SEQ ID NO: 1342974 - protein, 9 aa, Homo Sapiens
PEVQRLEST

SEQ ID NO: 1342975 - protein, 9 aa, Homo Sapiens
WAKAMRLLY

SEQ ID NO: 1342976 - protein, 9 aa, Homo Sapiens
PSVIGPQML

SEQ ID NO: 1342977 - protein, 9 aa, Homo Sapiens
GLIFAVYVR

SEQ ID NO: 1342978 - protein, 9 aa, Homo Sapiens
SYLYNHHHT

SEQ ID NO: 1342979 - protein, 9 aa, Homo Sapiens
VAHGRWNVD

SEQ ID NO: 1342980 - protein, 9 aa, Homo Sapiens
DHFFCEAPM

SEQ ID NO: 1342981 - protein, 9 aa, Homo Sapiens
MTEQQGEYF

SEQ ID NO: 1342982 - protein, 9 aa, Homo Sapiens
IKMACDGTF

SEQ ID NO: 1342983 - protein, 9 aa, Homo Sapiens
FSMGINYHF

SEQ ID NO: 1342984 - protein, 9 aa, Homo Sapiens
LIIAGNPAY

SEQ ID NO: 1342985 - protein, 9 aa, Homo Sapiens
DSAPGVWWE

SEQ ID NO: 1342986 - protein, 9 aa, Homo Sapiens
TFEIEREAF

SEQ ID NO: 1342987 - protein, 9 aa, Homo Sapiens
ERCWEFFPT

SEQ ID NO: 1342988 - protein, 9 aa, Homo Sapiens
WLSPDITLP

SEQ ID NO: 1342989 - protein, 9 aa, Homo Sapiens
RRLPLRAIN

SEQ ID NO: 1342990 - protein, 9 aa, Homo Sapiens
RARKAATKT

SEQ ID NO: 1342991 - protein, 9 aa, Homo Sapiens
THICCLNCR

SEQ ID NO: 1342992 - protein, 9 aa, Homo Sapiens
FQKMWRDLE

SEQ ID NO: 1342993 - protein, 9 aa, Homo Sapiens
LCFHYGTED

SEQ ID NO: 1342994 - protein, 9 aa, Homo Sapiens
TGGRRGMRA

SEQ ID NO: 1342995 - protein, 9 aa, Homo Sapiens
GTKWSSRSS

SEQ ID NO: 1342996 - protein, 9 aa, Homo Sapiens
PDTPPNIYE

SEQ ID NO: 1342997 - protein, 9 aa, Homo Sapiens
RTREASDNS

SEQ ID NO: 1342998 - protein, 9 aa, Homo Sapiens
SPDRPEKRV

SEQ ID NO: 1342999 - protein, 9 aa, Homo Sapiens
KVLATMCGQ

SEQ ID NO: 1343000 - protein, 9 aa, Homo Sapiens
KKCHKKRGI

SEQ ID NO: 1343001 - protein, 9 aa, Homo Sapiens
ASKVQTDVT

SEQ ID NO: 1343002 - protein, 9 aa, Homo Sapiens
PSESLTVSS

SEQ ID NO: 1343003 - protein, 9 aa, Homo Sapiens
KFLGSFLLA

SEQ ID NO: 1343004 - protein, 9 aa, Homo Sapiens
PSHQASGQP

SEQ ID NO: 1343005 - protein, 9 aa, Homo Sapiens
SLEVAVHGR

SEQ ID NO: 1343006 - protein, 9 aa, Homo Sapiens
HLLDITMGF

SEQ ID NO: 1343007 - protein, 9 aa, Homo Sapiens
ATGAHWMWQ

SEQ ID NO: 1343008 - protein, 9 aa, Homo Sapiens
HTDSWTTVT

SEQ ID NO: 1343009 - protein, 9 aa, Homo Sapiens
GQSLEGRGT

SEQ ID NO: 1343010 - protein, 9 aa, Homo Sapiens
IERAQEQHN

SEQ ID NO: 1343011 - protein, 9 aa, Homo Sapiens
VSTLEEDHA

SEQ ID NO: 1343012 - protein, 9 aa, Homo Sapiens
ISALACLVT

SEQ ID NO: 1343013 - protein, 9 aa, Homo Sapiens
RGKYKCVFS

SEQ ID NO: 1343014 - protein, 9 aa, Homo Sapiens
LIDKITTVQ

SEQ ID NO: 1343015 - protein, 9 aa, Homo Sapiens
QNVISFFNV

SEQ ID NO: 1343016 - protein, 9 aa, Homo Sapiens
VNLLLMEAQ

SEQ ID NO: 1343017 - protein, 9 aa, Homo Sapiens
GITILGGLD

SEQ ID NO: 1343018 - protein, 9 aa, Homo Sapiens
CHACALGSE

SEQ ID NO: 1343019 - protein, 9 aa, Homo Sapiens
ASFLQSEDG

SEQ ID NO: 1343020 - protein, 9 aa, Homo Sapiens
SAKALEELW

SEQ ID NO: 1343021 - protein, 9 aa, Homo Sapiens
AQAPEIFQC

SEQ ID NO: 1343022 - protein, 9 aa, Homo Sapiens
RPVDIDGSN

SEQ ID NO: 1343023 - protein, 9 aa, Homo Sapiens
KVKLVEKWA

SEQ ID NO: 1343024 - protein, 9 aa, Homo Sapiens
MSNKYTQAV

SEQ ID NO: 1343025 - protein, 9 aa, Homo Sapiens
GVTCGWDNL

SEQ ID NO: 1343026 - protein, 9 aa, Homo Sapiens
DMTLLKLAS

SEQ ID NO: 1343027 - protein, 9 aa, Homo Sapiens
SAVISEDTL

SEQ ID NO: 1343028 - protein, 9 aa, Homo Sapiens
VLALSVEID

SEQ ID NO: 1343029 - protein, 9 aa, Homo Sapiens
LPFASGGFL

SEQ ID NO: 1343030 - protein, 9 aa, Homo Sapiens
HSNCKEPVI

SEQ ID NO: 1343031 - protein, 9 aa, Homo Sapiens
TLTAGQLTF

SEQ ID NO: 1343032 - protein, 9 aa, Homo Sapiens
GESREPKSK

SEQ ID NO: 1343033 - protein, 9 aa, Homo Sapiens
KSLVSKDTL

SEQ ID NO: 1343034 - protein, 9 aa, Homo Sapiens
ISQRLCELL

SEQ ID NO: 1343035 - protein, 9 aa, Homo Sapiens
PKDDTTREL

SEQ ID NO: 1343036 - protein, 9 aa, Homo Sapiens
TTASTRARS

SEQ ID NO: 1343037 - protein, 9 aa, Homo Sapiens
ESCGDGTVT

SEQ ID NO: 1343038 - protein, 9 aa, Homo Sapiens
HLLQGARRI

SEQ ID NO: 1343039 - protein, 9 aa, Homo Sapiens
VCLELKPDP

SEQ ID NO: 1343040 - protein, 9 aa, Homo Sapiens
PEKLIFEFC

SEQ ID NO: 1343041 - protein, 9 aa, Homo Sapiens
PFDKISDAR

SEQ ID NO: 1343042 - protein, 9 aa, Homo Sapiens
KFQYEEEVK

SEQ ID NO: 1343043 - protein, 9 aa, Homo Sapiens
PHARVDAHV

SEQ ID NO: 1343044 - protein, 9 aa, Homo Sapiens
DAVPPWKSS

SEQ ID NO: 1343045 - protein, 9 aa, Homo Sapiens
VLMFGLYED

SEQ ID NO: 1343046 - protein, 9 aa, Homo Sapiens
GSGDPFHSI

SEQ ID NO: 1343047 - protein, 9 aa, Homo Sapiens
NRPLSPILH

SEQ ID NO: 1343048 - protein, 9 aa, Homo Sapiens
ATAMTTQAH

SEQ ID NO: 1343049 - protein, 9 aa, Homo Sapiens
CVPRHDKVT

SEQ ID NO: 1343050 - protein, 9 aa, Homo Sapiens
KPLSCDSAQ

SEQ ID NO: 1343051 - protein, 9 aa, Homo Sapiens
PVMQLYQPG

SEQ ID NO: 1343052 - protein, 9 aa, Homo Sapiens
WSSRIVAPG

SEQ ID NO: 1343053 - protein, 9 aa, Homo Sapiens
IGPLTRDAH

SEQ ID NO: 1343054 - protein, 9 aa, Homo Sapiens
MIKMFFALG

SEQ ID NO: 1343055 - protein, 9 aa, Homo Sapiens
EHILCTKSL

SEQ ID NO: 1343056 - protein, 9 aa, Homo Sapiens
VNSMGSRSS

SEQ ID NO: 1343057 - protein, 9 aa, Homo Sapiens
IGEDAACIT

SEQ ID NO: 1343058 - protein, 9 aa, Homo Sapiens
DYQPPAKKQ

SEQ ID NO: 1343059 - protein, 9 aa, Homo Sapiens
EVKCAVEEI

SEQ ID NO: 1343060 - protein, 9 aa, Homo Sapiens
MILMNPVAA

SEQ ID NO: 1343061 - protein, 9 aa, Homo Sapiens
WNSREKGSK

SEQ ID NO: 1343062 - protein, 9 aa, Homo Sapiens
QEEAKSLNA

SEQ ID NO: 1343063 - protein, 9 aa, Homo Sapiens
EFTLSVNAS

SEQ ID NO: 1343064 - protein, 9 aa, Homo Sapiens
PTSHVVAVL

SEQ ID NO: 1343065 - protein, 9 aa, Homo Sapiens
RTELFLLFT

SEQ ID NO: 1343066 - protein, 9 aa, Homo Sapiens
LTEEGLFRI

SEQ ID NO: 1343067 - protein, 9 aa, Homo Sapiens
INTSHIKVS

SEQ ID NO: 1343068 - protein, 9 aa, Homo Sapiens
DNNCSALSA

SEQ ID NO: 1343069 - protein, 9 aa, Homo Sapiens
LVLRHSYHL

SEQ ID NO: 1343070 - protein, 9 aa, Homo Sapiens
DLLTDTVPL

SEQ ID NO: 1343071 - protein, 9 aa, Homo Sapiens
EWTKLDLPL

SEQ ID NO: 1343072 - protein, 9 aa, Homo Sapiens
YLDQWAIRA

SEQ ID NO: 1343073 - protein, 9 aa, Homo Sapiens
MHMVGKWHL

SEQ ID NO: 1343074 - protein, 9 aa, Homo Sapiens
CTSTLTTTY

SEQ ID NO: 1343075 - protein, 9 aa, Homo Sapiens
LPALTVHMT

SEQ ID NO: 1343076 - protein, 9 aa, Homo Sapiens
PSRECSPAP

SEQ ID NO: 1343077 - protein, 9 aa, Homo Sapiens
NALRYAVDG

SEQ ID NO: 1343078 - protein, 9 aa, Homo Sapiens
STIVSTQRS

SEQ ID NO: 1343079 - protein, 9 aa, Homo Sapiens
RRGVSTWRS

SEQ ID NO: 1343080 - protein, 9 aa, Homo Sapiens
NSYTYPRLP

SEQ ID NO: 1343081 - protein, 9 aa, Homo Sapiens
AIVNHPSAV

SEQ ID NO: 1343082 - protein, 9 aa, Homo Sapiens
MKQAFIKAT

SEQ ID NO: 1343083 - protein, 9 aa, Homo Sapiens
HIVERESGH

SEQ ID NO: 1343084 - protein, 9 aa, Homo Sapiens
ILAVSRPHS

SEQ ID NO: 1343085 - protein, 9 aa, Homo Sapiens
FALSEPGNS

SEQ ID NO: 1343086 - protein, 9 aa, Homo Sapiens
CFFTGQLLN

SEQ ID NO: 1343087 - protein, 9 aa, Homo Sapiens
YRMRKKFPL

SEQ ID NO: 1343088 - protein, 9 aa, Homo Sapiens
FCDMSPILA

SEQ ID NO: 1343089 - protein, 9 aa, Homo Sapiens
TGIESHSEL

SEQ ID NO: 1343090 - protein, 9 aa, Homo Sapiens
QGRPYPMID

SEQ ID NO: 1343091 - protein, 9 aa, Homo Sapiens
LVVLDTSWV

SEQ ID NO: 1343092 - protein, 9 aa, Homo Sapiens
THHLHGKTH

SEQ ID NO: 1343093 - protein, 9 aa, Homo Sapiens
SPTGAASAA

SEQ ID NO: 1343094 - protein, 9 aa, Homo Sapiens
SILHYLARV

SEQ ID NO: 1343095 - protein, 9 aa, Homo Sapiens
RGSIVTRGA

SEQ ID NO: 1343096 - protein, 9 aa, Homo Sapiens
LLKPREEVT

SEQ ID NO: 1343097 - protein, 9 aa, Homo Sapiens
HIYFFRAES

SEQ ID NO: 1343098 - protein, 9 aa, Homo Sapiens
DKTRWTHNF

SEQ ID NO: 1343099 - protein, 9 aa, Homo Sapiens
EGIDEVIIP

SEQ ID NO: 1343100 - protein, 9 aa, Homo Sapiens
LPILDDQIQ

SEQ ID NO: 1343101 - protein, 9 aa, Homo Sapiens
CGRPLMRHT

SEQ ID NO: 1343102 - protein, 9 aa, Homo Sapiens
ASTDHTTPL

SEQ ID NO: 1343103 - protein, 9 aa, Homo Sapiens
DIDWGKHCV

SEQ ID NO: 1343104 - protein, 9 aa, Homo Sapiens
GIKHIDCHM

SEQ ID NO: 1343105 - protein, 9 aa, Homo Sapiens
FPVKVRLGT

SEQ ID NO: 1343106 - protein, 9 aa, Homo Sapiens
QTQHTSGQK

SEQ ID NO: 1343107 - protein, 9 aa, Homo Sapiens
ILVDRYMSW

SEQ ID NO: 1343108 - protein, 9 aa, Homo Sapiens
EEELQKGMR

SEQ ID NO: 1343109 - protein, 9 aa, Homo Sapiens
RAFQHNTVL

SEQ ID NO: 1343110 - protein, 9 aa, Homo Sapiens
QRYLTALWK

SEQ ID NO: 1343111 - protein, 9 aa, Homo Sapiens
DPSTEFDKI

SEQ ID NO: 1343112 - protein, 9 aa, Homo Sapiens
DTYNKLTLK

SEQ ID NO: 1343113 - protein, 9 aa, Homo Sapiens
RRRLEMMSR

SEQ ID NO: 1343114 - protein, 9 aa, Homo Sapiens
QNIFVSMRV

SEQ ID NO: 1343115 - protein, 9 aa, Homo Sapiens
TQMEFPDTS

SEQ ID NO: 1343116 - protein, 9 aa, Homo Sapiens
HSVLAKELV

SEQ ID NO: 1343117 - protein, 9 aa, Homo Sapiens
EDFLIILPL

SEQ ID NO: 1343118 - protein, 9 aa, Homo Sapiens
HFFACPSKT

SEQ ID NO: 1343119 - protein, 9 aa, Homo Sapiens
DGISIILRF

SEQ ID NO: 1343120 - protein, 9 aa, Homo Sapiens
ITDFRKDSK

SEQ ID NO: 1343121 - protein, 9 aa, Homo Sapiens
VLNILIGVV

SEQ ID NO: 1343122 - protein, 9 aa, Homo Sapiens
LLGNDTLLF

SEQ ID NO: 1343123 - protein, 9 aa, Homo Sapiens
GHDVSSDEM

SEQ ID NO: 1343124 - protein, 9 aa, Homo Sapiens
SISLLVVLY

SEQ ID NO: 1343125 - protein, 9 aa, Homo Sapiens
MLQELVNTG

SEQ ID NO: 1343126 - protein, 9 aa, Homo Sapiens
CKGNLKSRK

SEQ ID NO: 1343127 - protein, 9 aa, Homo Sapiens
AWKEVQLHK

SEQ ID NO: 1343128 - protein, 9 aa, Homo Sapiens
PETYQVRLQ

SEQ ID NO: 1343129 - protein, 9 aa, Homo Sapiens
KLKKMCAHL

SEQ ID NO: 1343130 - protein, 9 aa, Homo Sapiens
AIVPQELVL

SEQ ID NO: 1343131 - protein, 9 aa, Homo Sapiens
VKGAKGICT

SEQ ID NO: 1343132 - protein, 9 aa, Homo Sapiens
SCRTRRRWS

SEQ ID NO: 1343133 - protein, 9 aa, Homo Sapiens
TEVSHLRTL

SEQ ID NO: 1343134 - protein, 9 aa, Homo Sapiens
TLQHYYVYN

SEQ ID NO: 1343135 - protein, 9 aa, Homo Sapiens
SIKLNWTGT

SEQ ID NO: 1343136 - protein, 9 aa, Homo Sapiens
QLPGPHDDF

SEQ ID NO: 1343137 - protein, 9 aa, Homo Sapiens
GCWMLYECP

SEQ ID NO: 1343138 - protein, 9 aa, Homo Sapiens
NIIMWLDHR

SEQ ID NO: 1343139 - protein, 9 aa, Homo Sapiens
RDATPLPRP

SEQ ID NO: 1343140 - protein, 9 aa, Homo Sapiens
ANAFFSIPA

SEQ ID NO: 1343141 - protein, 9 aa, Homo Sapiens
LQETHKGEI

SEQ ID NO: 1343142 - protein, 9 aa, Homo Sapiens
GVKVDSPLP

SEQ ID NO: 1343143 - protein, 9 aa, Homo Sapiens
STGTYMSTA

SEQ ID NO: 1343144 - protein, 9 aa, Homo Sapiens
NHPENKPMF

SEQ ID NO: 1343145 - protein, 9 aa, Homo Sapiens
LSVPPRRVG

SEQ ID NO: 1343146 - protein, 9 aa, Homo Sapiens
SALGELRQR

SEQ ID NO: 1343147 - protein, 9 aa, Homo Sapiens
TDKPYVPLL

SEQ ID NO: 1343148 - protein, 9 aa, Homo Sapiens
AYANFFIGA

SEQ ID NO: 1343149 - protein, 9 aa, Homo Sapiens
GIRLSIMRV

SEQ ID NO: 1343150 - protein, 9 aa, Homo Sapiens
KEFLSFLIT

SEQ ID NO: 1343151 - protein, 9 aa, Homo Sapiens
MALPVRQTA

SEQ ID NO: 1343152 - protein, 9 aa, Homo Sapiens
LQDASVACQ

SEQ ID NO: 1343153 - protein, 9 aa, Homo Sapiens
YQPPAKKQR

SEQ ID NO: 1343154 - protein, 9 aa, Homo Sapiens
VRWTGSRTH

SEQ ID NO: 1343155 - protein, 9 aa, Homo Sapiens
QMRREGIHY

SEQ ID NO: 1343156 - protein, 9 aa, Homo Sapiens
LQGWRRRQQ

SEQ ID NO: 1343157 - protein, 9 aa, Homo Sapiens
AFEEDTGCY

SEQ ID NO: 1343158 - protein, 9 aa, Homo Sapiens
RVRKLKTTP

SEQ ID NO: 1343159 - protein, 9 aa, Homo Sapiens
EVRSSLKSG

SEQ ID NO: 1343160 - protein, 9 aa, Homo Sapiens
RTWEESLLT

SEQ ID NO: 1343161 - protein, 9 aa, Homo Sapiens
ERYEFPPDL

SEQ ID NO: 1343162 - protein, 9 aa, Homo Sapiens
SSLSSHVSS

SEQ ID NO: 1343163 - protein, 9 aa, Homo Sapiens
PGMRELLGG

SEQ ID NO: 1343164 - protein, 9 aa, Homo Sapiens
LNVGQWQAR

SEQ ID NO: 1343165 - protein, 9 aa, Homo Sapiens
FKCDRCGKR

SEQ ID NO: 1343166 - protein, 9 aa, Homo Sapiens
NFKLKYGWK

SEQ ID NO: 1343167 - protein, 9 aa, Homo Sapiens
WQSPASRAP

SEQ ID NO: 1343168 - protein, 9 aa, Homo Sapiens
FSIPAHKAH

SEQ ID NO: 1343169 - protein, 9 aa, Homo Sapiens
DGTIRDLVF

SEQ ID NO: 1343170 - protein, 9 aa, Homo Sapiens
VQGRITVQA

SEQ ID NO: 1343171 - protein, 9 aa, Homo Sapiens
DTVQSYAAG

SEQ ID NO: 1343172 - protein, 9 aa, Homo Sapiens
VMAIGTHSG

SEQ ID NO: 1343173 - protein, 9 aa, Homo Sapiens
VTVICRNKQ

SEQ ID NO: 1343174 - protein, 9 aa, Homo Sapiens
SPLSFSLAS

SEQ ID NO: 1343175 - protein, 9 aa, Homo Sapiens
TKLYLDFIV

SEQ ID NO: 1343176 - protein, 9 aa, Homo Sapiens
SCFLYLPLR

SEQ ID NO: 1343177 - protein, 9 aa, Homo Sapiens
DEAAGRYPS

SEQ ID NO: 1343178 - protein, 9 aa, Homo Sapiens
PQAFPALHF

SEQ ID NO: 1343179 - protein, 9 aa, Homo Sapiens
TSCVFTRHG

SEQ ID NO: 1343180 - protein, 9 aa, Homo Sapiens
DTFHHLHHL

SEQ ID NO: 1343181 - protein, 9 aa, Homo Sapiens
HEPRSCPET

SEQ ID NO: 1343182 - protein, 9 aa, Homo Sapiens
GNDQSENGR

SEQ ID NO: 1343183 - protein, 9 aa, Homo Sapiens
WHHHDKDGW

SEQ ID NO: 1343184 - protein, 9 aa, Homo Sapiens
FSALAKEER

SEQ ID NO: 1343185 - protein, 9 aa, Homo Sapiens
YSFTLQIML

SEQ ID NO: 1343186 - protein, 9 aa, Homo Sapiens
FKLYIVMSA

SEQ ID NO: 1343187 - protein, 9 aa, Homo Sapiens
WCRTTLPAS

SEQ ID NO: 1343188 - protein, 9 aa, Homo Sapiens
GKVGDTRSI

SEQ ID NO: 1343189 - protein, 9 aa, Homo Sapiens
APRGSSLTP

SEQ ID NO: 1343190 - protein, 9 aa, Homo Sapiens
KLEKDTADA

SEQ ID NO: 1343191 - protein, 9 aa, Homo Sapiens
KAEHIKIPS

SEQ ID NO: 1343192 - protein, 9 aa, Homo Sapiens
LELMLLCTS

SEQ ID NO: 1343193 - protein, 9 aa, Homo Sapiens
VLADDLEKN

SEQ ID NO: 1343194 - protein, 9 aa, Homo Sapiens
MMPEQRRSR

SEQ ID NO: 1343195 - protein, 9 aa, Homo Sapiens
SHFVFVLSP

SEQ ID NO: 1343196 - protein, 9 aa, Homo Sapiens
KMVILNLIF

SEQ ID NO: 1343197 - protein, 9 aa, Homo Sapiens
GGGTFMFPY

SEQ ID NO: 1343198 - protein, 9 aa, Homo Sapiens
LVHSVDFTR

SEQ ID NO: 1343199 - protein, 9 aa, Homo Sapiens
LLAGILICI

SEQ ID NO: 1343200 - protein, 9 aa, Homo Sapiens
AKSSVPGVD

SEQ ID NO: 1343201 - protein, 9 aa, Homo Sapiens
IESIMALNP

SEQ ID NO: 1343202 - protein, 9 aa, Homo Sapiens
VEIDKNMLD

SEQ ID NO: 1343203 - protein, 9 aa, Homo Sapiens
AVHFSFAFS

SEQ ID NO: 1343204 - protein, 9 aa, Homo Sapiens
GSTFLNPEG

SEQ ID NO: 1343205 - protein, 9 aa, Homo Sapiens
EVDMAHRFT

SEQ ID NO: 1343206 - protein, 9 aa, Homo Sapiens
RDAHLCPQQ

SEQ ID NO: 1343207 - protein, 9 aa, Homo Sapiens
LGPDPRWCS

SEQ ID NO: 1343208 - protein, 9 aa, Homo Sapiens
RYMSWFLPT

SEQ ID NO: 1343209 - protein, 9 aa, Homo Sapiens
PPSESQNVP

SEQ ID NO: 1343210 - protein, 9 aa, Homo Sapiens
STIPVHILF

SEQ ID NO: 1343211 - protein, 9 aa, Homo Sapiens
CGNTFYRSS

SEQ ID NO: 1343212 - protein, 9 aa, Homo Sapiens
LRPRPRTYY

SEQ ID NO: 1343213 - protein, 9 aa, Homo Sapiens
VEDLATTSV

SEQ ID NO: 1343214 - protein, 9 aa, Homo Sapiens
RQVVAQTVE

SEQ ID NO: 1343215 - protein, 9 aa, Homo Sapiens
EIANREKQC

SEQ ID NO: 1343216 - protein, 9 aa, Homo Sapiens
RLCTGEDVA

SEQ ID NO: 1343217 - protein, 9 aa, Homo Sapiens
TAGRRLTSA

SEQ ID NO: 1343218 - protein, 9 aa, Homo Sapiens
LPDEVISIR

SEQ ID NO: 1343219 - protein, 9 aa, Homo Sapiens
AAPASTPLM

SEQ ID NO: 1343220 - protein, 9 aa, Homo Sapiens
ISAMDENLS

SEQ ID NO: 1343221 - protein, 9 aa, Homo Sapiens
GPYSSVPRL

SEQ ID NO: 1343222 - protein, 9 aa, Homo Sapiens
ISTIPVHIL

SEQ ID NO: 1343223 - protein, 9 aa, Homo Sapiens
RDESLNSLL

SEQ ID NO: 1343224 - protein, 9 aa, Homo Sapiens
VDNIFIKNL

SEQ ID NO: 1343225 - protein, 9 aa, Homo Sapiens
VLPPPPPYV

SEQ ID NO: 1343226 - protein, 9 aa, Homo Sapiens
QNNPEFWAL

SEQ ID NO: 1343227 - protein, 9 aa, Homo Sapiens
HEPHIKAVT

SEQ ID NO: 1343228 - protein, 9 aa, Homo Sapiens
KECEKEDYL

SEQ ID NO: 1343229 - protein, 9 aa, Homo Sapiens
LNKYGKAHF

SEQ ID NO: 1343230 - protein, 9 aa, Homo Sapiens
LTSIANVEP

SEQ ID NO: 1343231 - protein, 9 aa, Homo Sapiens
WPVEPLFVP

SEQ ID NO: 1343232 - protein, 9 aa, Homo Sapiens
STRASGPTS

SEQ ID NO: 1343233 - protein, 9 aa, Homo Sapiens
VQWGKGLAQ

SEQ ID NO: 1343234 - protein, 9 aa, Homo Sapiens
MWSLGVMLY

SEQ ID NO: 1343235 - protein, 9 aa, Homo Sapiens
SGINETTFN

SEQ ID NO: 1343236 - protein, 9 aa, Homo Sapiens
VMASFYSMS

SEQ ID NO: 1343237 - protein, 9 aa, Homo Sapiens
PLTQVMYRS

SEQ ID NO: 1343238 - protein, 9 aa, Homo Sapiens
IHSNINDNI

SEQ ID NO: 1343239 - protein, 9 aa, Homo Sapiens
IPRGDCLNV

SEQ ID NO: 1343240 - protein, 9 aa, Homo Sapiens
PSLVINGSN

SEQ ID NO: 1343241 - protein, 9 aa, Homo Sapiens
PNIKYVFRT

SEQ ID NO: 1343242 - protein, 9 aa, Homo Sapiens
VDGIFGGIL

SEQ ID NO: 1343243 - protein, 9 aa, Homo Sapiens
SRYVSNHVF

SEQ ID NO: 1343244 - protein, 9 aa, Homo Sapiens
ASDLAHLHM

SEQ ID NO: 1343245 - protein, 9 aa, Homo Sapiens
ACAPTPLSM

SEQ ID NO: 1343246 - protein, 9 aa, Homo Sapiens
ISNTNQADH

SEQ ID NO: 1343247 - protein, 9 aa, Homo Sapiens
SEDFEEVQC

SEQ ID NO: 1343248 - protein, 9 aa, Homo Sapiens
THECDTCGE

SEQ ID NO: 1343249 - protein, 9 aa, Homo Sapiens
NIYETGDMC

SEQ ID NO: 1343250 - protein, 9 aa, Homo Sapiens
IVRILHGGM

SEQ ID NO: 1343251 - protein, 9 aa, Homo Sapiens
GDYSGRLIV

SEQ ID NO: 1343252 - protein, 9 aa, Homo Sapiens
ASVQGQPLK

SEQ ID NO: 1343253 - protein, 9 aa, Homo Sapiens
HYHELYYDT

SEQ ID NO: 1343254 - protein, 9 aa, Homo Sapiens
VHIFLADLY

SEQ ID NO: 1343255 - protein, 9 aa, Homo Sapiens
YSIPLSQAE

SEQ ID NO: 1343256 - protein, 9 aa, Homo Sapiens
HGYSFTLQI

SEQ ID NO: 1343257 - protein, 9 aa, Homo Sapiens
KKAMIMYNF

SEQ ID NO: 1343258 - protein, 9 aa, Homo Sapiens
GSQQELRVP

SEQ ID NO: 1343259 - protein, 9 aa, Homo Sapiens
GGALARKST

SEQ ID NO: 1343260 - protein, 9 aa, Homo Sapiens
NRSLLTFIF

SEQ ID NO: 1343261 - protein, 9 aa, Homo Sapiens
IVLALVEVY

SEQ ID NO: 1343262 - protein, 9 aa, Homo Sapiens
SDELASCGH

SEQ ID NO: 1343263 - protein, 9 aa, Homo Sapiens
AIHYINPRT

SEQ ID NO: 1343264 - protein, 9 aa, Homo Sapiens
VPSNAHFLT

SEQ ID NO: 1343265 - protein, 9 aa, Homo Sapiens
YEQSCESHK

SEQ ID NO: 1343266 - protein, 9 aa, Homo Sapiens
AGDIARKGR

SEQ ID NO: 1343267 - protein, 9 aa, Homo Sapiens
MWPDDINPR

SEQ ID NO: 1343268 - protein, 9 aa, Homo Sapiens
NLIQDQNVQ

SEQ ID NO: 1343269 - protein, 9 aa, Homo Sapiens
QYYTAAPLP

SEQ ID NO: 1343270 - protein, 9 aa, Homo Sapiens
SVVSGRAYP

SEQ ID NO: 1343271 - protein, 9 aa, Homo Sapiens
SNTDKHLDP

SEQ ID NO: 1343272 - protein, 9 aa, Homo Sapiens
KTFDAESPP

SEQ ID NO: 1343273 - protein, 9 aa, Homo Sapiens
FTKDLDRIF

SEQ ID NO: 1343274 - protein, 9 aa, Homo Sapiens
QLSRFASTS

SEQ ID NO: 1343275 - protein, 9 aa, Homo Sapiens
INGASRSLD

SEQ ID NO: 1343276 - protein, 9 aa, Homo Sapiens
CEKWILAAV

SEQ ID NO: 1343277 - protein, 9 aa, Homo Sapiens
IQRAISLSP

SEQ ID NO: 1343278 - protein, 9 aa, Homo Sapiens
ICQSLAWRK

SEQ ID NO: 1343279 - protein, 9 aa, Homo Sapiens
MIPLCNHPV

SEQ ID NO: 1343280 - protein, 9 aa, Homo Sapiens
VIETGNRGE

SEQ ID NO: 1343281 - protein, 9 aa, Homo Sapiens
IIRIHSLQG

SEQ ID NO: 1343282 - protein, 9 aa, Homo Sapiens
VVHTRHYLN

SEQ ID NO: 1343283 - protein, 9 aa, Homo Sapiens
DREKQVFTE

SEQ ID NO: 1343284 - protein, 9 aa, Homo Sapiens
SRLLPWPFF

SEQ ID NO: 1343285 - protein, 9 aa, Homo Sapiens
AFTKNQKDS

SEQ ID NO: 1343286 - protein, 9 aa, Homo Sapiens
PNDLKLKEA

SEQ ID NO: 1343287 - protein, 9 aa, Homo Sapiens
TGASTPARS

SEQ ID NO: 1343288 - protein, 9 aa, Homo Sapiens
DNWANYNTF

SEQ ID NO: 1343289 - protein, 9 aa, Homo Sapiens
DIHTILSAR

SEQ ID NO: 1343290 - protein, 9 aa, Homo Sapiens
PRGRGIMPS

SEQ ID NO: 1343291 - protein, 9 aa, Homo Sapiens
GVNMRHLWR

SEQ ID NO: 1343292 - protein, 9 aa, Homo Sapiens
EGKYYNVPV

SEQ ID NO: 1343293 - protein, 9 aa, Homo Sapiens
LHPRYLPVH

SEQ ID NO: 1343294 - protein, 9 aa, Homo Sapiens
PLITLKWLL

SEQ ID NO: 1343295 - protein, 9 aa, Homo Sapiens
LQVCDHYQH

SEQ ID NO: 1343296 - protein, 9 aa, Homo Sapiens
HFGLGSLAH

SEQ ID NO: 1343297 - protein, 9 aa, Homo Sapiens
VGPADTGRY

SEQ ID NO: 1343298 - protein, 9 aa, Homo Sapiens
HPIIQWFWK

SEQ ID NO: 1343299 - protein, 9 aa, Homo Sapiens
NLLKTDDIL

SEQ ID NO: 1343300 - protein, 9 aa, Homo Sapiens
QESTCGRSG

SEQ ID NO: 1343301 - protein, 9 aa, Homo Sapiens
HTIISVVHR

SEQ ID NO: 1343302 - protein, 9 aa, Homo Sapiens
IQHHHPFIE

SEQ ID NO: 1343303 - protein, 9 aa, Homo Sapiens
SVSSKSDEG

SEQ ID NO: 1343304 - protein, 9 aa, Homo Sapiens
CVGSIAELS

SEQ ID NO: 1343305 - protein, 9 aa, Homo Sapiens
KNDKEEVTV

SEQ ID NO: 1343306 - protein, 9 aa, Homo Sapiens
QDITDVLGT

SEQ ID NO: 1343307 - protein, 9 aa, Homo Sapiens
SLNACVSHI

SEQ ID NO: 1343308 - protein, 9 aa, Homo Sapiens
MPKFLNSTN

SEQ ID NO: 1343309 - protein, 9 aa, Homo Sapiens
MCPDLCAQD

SEQ ID NO: 1343310 - protein, 9 aa, Homo Sapiens
LALETALYY

SEQ ID NO: 1343311 - protein, 9 aa, Homo Sapiens
KWLLSTYIC

SEQ ID NO: 1343312 - protein, 9 aa, Homo Sapiens
VSDPYSLNP

SEQ ID NO: 1343313 - protein, 9 aa, Homo Sapiens
RIQPKTCQI

SEQ ID NO: 1343314 - protein, 9 aa, Homo Sapiens
GTFVGRITQ

SEQ ID NO: 1343315 - protein, 9 aa, Homo Sapiens
FELCFKQYL

SEQ ID NO: 1343316 - protein, 9 aa, Homo Sapiens
ILTGGINTG

SEQ ID NO: 1343317 - protein, 9 aa, Homo Sapiens
VRLARNVVV

SEQ ID NO: 1343318 - protein, 9 aa, Homo Sapiens
DLKMFEAIT

SEQ ID NO: 1343319 - protein, 9 aa, Homo Sapiens
ILPYLALPL

SEQ ID NO: 1343320 - protein, 9 aa, Homo Sapiens
KVMRPLRSC

SEQ ID NO: 1343321 - protein, 9 aa, Homo Sapiens
IFFFFLFPD

SEQ ID NO: 1343322 - protein, 9 aa, Homo Sapiens
ESIDTMSHM

SEQ ID NO: 1343323 - protein, 9 aa, Homo Sapiens
GDPMWGGPM

SEQ ID NO: 1343324 - protein, 9 aa, Homo Sapiens
CLEKLCLRN

SEQ ID NO: 1343325 - protein, 9 aa, Homo Sapiens
LLTTEGTGL

SEQ ID NO: 1343326 - protein, 9 aa, Homo Sapiens
QLVSDFRQQ

SEQ ID NO: 1343327 - protein, 9 aa, Homo Sapiens
ALTMGMIFF

SEQ ID NO: 1343328 - protein, 9 aa, Homo Sapiens
ARMRQISDW

SEQ ID NO: 1343329 - protein, 9 aa, Homo Sapiens
TFFFLHKEF

SEQ ID NO: 1343330 - protein, 9 aa, Homo Sapiens
TSLVVWHRG

SEQ ID NO: 1343331 - protein, 9 aa, Homo Sapiens
STVSGPLLQ

SEQ ID NO: 1343332 - protein, 9 aa, Homo Sapiens
SRDPPASHE

SEQ ID NO: 1343333 - protein, 9 aa, Homo Sapiens
HIALPQTEI

SEQ ID NO: 1343334 - protein, 9 aa, Homo Sapiens
NNLVSEYQQ

SEQ ID NO: 1343335 - protein, 9 aa, Homo Sapiens
TYMLPQSYH

SEQ ID NO: 1343336 - protein, 9 aa, Homo Sapiens
IEVDKVFWN

SEQ ID NO: 1343337 - protein, 9 aa, Homo Sapiens
PKRPDTCFM

SEQ ID NO: 1343338 - protein, 9 aa, Homo Sapiens
IHVRSRGGH

SEQ ID NO: 1343339 - protein, 9 aa, Homo Sapiens
IHTQERHYE

SEQ ID NO: 1343340 - protein, 9 aa, Homo Sapiens
QCVGIIPPK

SEQ ID NO: 1343341 - protein, 9 aa, Homo Sapiens
AISMHNAAR

SEQ ID NO: 1343342 - protein, 9 aa, Homo Sapiens
AYNRHTFET

SEQ ID NO: 1343343 - protein, 9 aa, Homo Sapiens
LGRNTVAGL

SEQ ID NO: 1343344 - protein, 9 aa, Homo Sapiens
AIAADPRGI

SEQ ID NO: 1343345 - protein, 9 aa, Homo Sapiens
VSSEAGNMV

SEQ ID NO: 1343346 - protein, 9 aa, Homo Sapiens
EKCSLEAYF

SEQ ID NO: 1343347 - protein, 9 aa, Homo Sapiens
HITEHYSTC

SEQ ID NO: 1343348 - protein, 9 aa, Homo Sapiens
PDVWAVLHL

SEQ ID NO: 1343349 - protein, 9 aa, Homo Sapiens
LTSSLMSVC

SEQ ID NO: 1343350 - protein, 9 aa, Homo Sapiens
RDALTGHLH

SEQ ID NO: 1343351 - protein, 9 aa, Homo Sapiens
ARNVMKDQH

SEQ ID NO: 1343352 - protein, 9 aa, Homo Sapiens
QSTSFLTAN

SEQ ID NO: 1343353 - protein, 9 aa, Homo Sapiens
PALDPSSPT

SEQ ID NO: 1343354 - protein, 9 aa, Homo Sapiens
PRGSSYWDH

SEQ ID NO: 1343355 - protein, 9 aa, Homo Sapiens
LHFGHHDIF

SEQ ID NO: 1343356 - protein, 9 aa, Homo Sapiens
GWLERAYGR

SEQ ID NO: 1343357 - protein, 9 aa, Homo Sapiens
YEETMFHCQ

SEQ ID NO: 1343358 - protein, 9 aa, Homo Sapiens
ASQGLHYIT

SEQ ID NO: 1343359 - protein, 9 aa, Homo Sapiens
HFGPVFTLY

SEQ ID NO: 1343360 - protein, 9 aa, Homo Sapiens
DMALQNLRV

SEQ ID NO: 1343361 - protein, 9 aa, Homo Sapiens
NQINTFLNY

SEQ ID NO: 1343362 - protein, 9 aa, Homo Sapiens
HERDAYKEK

SEQ ID NO: 1343363 - protein, 9 aa, Homo Sapiens
QPEMTPQSE

SEQ ID NO: 1343364 - protein, 9 aa, Homo Sapiens
QFTSCSKDC

SEQ ID NO: 1343365 - protein, 9 aa, Homo Sapiens
EKNLCQDMW

SEQ ID NO: 1343366 - protein, 9 aa, Homo Sapiens
LGQMDTNGL

SEQ ID NO: 1343367 - protein, 9 aa, Homo Sapiens
CFLRGYRQD

SEQ ID NO: 1343368 - protein, 9 aa, Homo Sapiens
VPVLPAVRS

SEQ ID NO: 1343369 - protein, 9 aa, Homo Sapiens
INLSGAVDW

SEQ ID NO: 1343370 - protein, 9 aa, Homo Sapiens
PHLNHPPMG

SEQ ID NO: 1343371 - protein, 9 aa, Homo Sapiens
LSRSDLQCC

SEQ ID NO: 1343372 - protein, 9 aa, Homo Sapiens
KDEKFSVFI

SEQ ID NO: 1343373 - protein, 9 aa, Homo Sapiens
GQHSQTSSI

SEQ ID NO: 1343374 - protein, 9 aa, Homo Sapiens
KADKNCARV

SEQ ID NO: 1343375 - protein, 9 aa, Homo Sapiens
IHGEVQDAE

SEQ ID NO: 1343376 - protein, 9 aa, Homo Sapiens
VGQAFELCF

SEQ ID NO: 1343377 - protein, 9 aa, Homo Sapiens
SRAATDLER

SEQ ID NO: 1343378 - protein, 9 aa, Homo Sapiens
NIENTLWAS

SEQ ID NO: 1343379 - protein, 9 aa, Homo Sapiens
LPHAIMHLD

SEQ ID NO: 1343380 - protein, 9 aa, Homo Sapiens
ALRYERAIS

SEQ ID NO: 1343381 - protein, 9 aa, Homo Sapiens
EGIGEELTI

SEQ ID NO: 1343382 - protein, 9 aa, Homo Sapiens
GGGMVRLEP

SEQ ID NO: 1343383 - protein, 9 aa, Homo Sapiens
CKLSGGQKV

SEQ ID NO: 1343384 - protein, 9 aa, Homo Sapiens
NRRQRRRKE

SEQ ID NO: 1343385 - protein, 9 aa, Homo Sapiens
GKQKADKNC

SEQ ID NO: 1343386 - protein, 9 aa, Homo Sapiens
VIATPSMVA

SEQ ID NO: 1343387 - protein, 9 aa, Homo Sapiens
PPSTCSLPC

SEQ ID NO: 1343388 - protein, 9 aa, Homo Sapiens
GSGNTPKLL

SEQ ID NO: 1343389 - protein, 9 aa, Homo Sapiens
TSGLTAADI

SEQ ID NO: 1343390 - protein, 9 aa, Homo Sapiens
EAAHQNNVG

SEQ ID NO: 1343391 - protein, 9 aa, Homo Sapiens
RWDVAHFGI

SEQ ID NO: 1343392 - protein, 9 aa, Homo Sapiens
QTNAHKSKE

SEQ ID NO: 1343393 - protein, 9 aa, Homo Sapiens
RGCLLHNCF

SEQ ID NO: 1343394 - protein, 9 aa, Homo Sapiens
AIKTISLLF

SEQ ID NO: 1343395 - protein, 9 aa, Homo Sapiens
FWIICLASK

SEQ ID NO: 1343396 - protein, 9 aa, Homo Sapiens
IIFTIEGLF

SEQ ID NO: 1343397 - protein, 9 aa, Homo Sapiens
LWVCCFFFM

SEQ ID NO: 1343398 - protein, 9 aa, Homo Sapiens
ISFIAPKQC

SEQ ID NO: 1343399 - protein, 9 aa, Homo Sapiens
AVLRSWYEK

SEQ ID NO: 1343400 - protein, 9 aa, Homo Sapiens
TASAVTVTV

SEQ ID NO: 1343401 - protein, 9 aa, Homo Sapiens
MILDLCHKP

SEQ ID NO: 1343402 - protein, 9 aa, Homo Sapiens
SFEGYREPL

SEQ ID NO: 1343403 - protein, 9 aa, Homo Sapiens
SSPEDRDQD

SEQ ID NO: 1343404 - protein, 9 aa, Homo Sapiens
HYYRAPELI

SEQ ID NO: 1343405 - protein, 9 aa, Homo Sapiens
KVTTMSIES

SEQ ID NO: 1343406 - protein, 9 aa, Homo Sapiens
GVIAILSTM

SEQ ID NO: 1343407 - protein, 9 aa, Homo Sapiens
PSGITARDV

SEQ ID NO: 1343408 - protein, 9 aa, Homo Sapiens
KPVRALLGP

SEQ ID NO: 1343409 - protein, 9 aa, Homo Sapiens
TGTYMSTAA

SEQ ID NO: 1343410 - protein, 9 aa, Homo Sapiens
LNARVQAPR

SEQ ID NO: 1343411 - protein, 9 aa, Homo Sapiens
FEGRHDSVR

SEQ ID NO: 1343412 - protein, 9 aa, Homo Sapiens
TPWNYPLNL

SEQ ID NO: 1343413 - protein, 9 aa, Homo Sapiens
PKFRFPRVF

SEQ ID NO: 1343414 - protein, 9 aa, Homo Sapiens
SQVAFDSFI

SEQ ID NO: 1343415 - protein, 9 aa, Homo Sapiens
GDYDLPMDA

SEQ ID NO: 1343416 - protein, 9 aa, Homo Sapiens
NYLMSLPCE

SEQ ID NO: 1343417 - protein, 9 aa, Homo Sapiens
GHSGQCVTW

SEQ ID NO: 1343418 - protein, 9 aa, Homo Sapiens
WCANDTPLT

SEQ ID NO: 1343419 - protein, 9 aa, Homo Sapiens
MTMFYPADH

SEQ ID NO: 1343420 - protein, 9 aa, Homo Sapiens
RDSTSCKLT

SEQ ID NO: 1343421 - protein, 9 aa, Homo Sapiens
ACTLSAISI

SEQ ID NO: 1343422 - protein, 9 aa, Homo Sapiens
TDESPRSHF

SEQ ID NO: 1343423 - protein, 9 aa, Homo Sapiens
HYTNLYDIK

SEQ ID NO: 1343424 - protein, 9 aa, Homo Sapiens
MLPFSPLWV

SEQ ID NO: 1343425 - protein, 9 aa, Homo Sapiens
LWRPDVKVL

SEQ ID NO: 1343426 - protein, 9 aa, Homo Sapiens
LYFSRAEVV

SEQ ID NO: 1343427 - protein, 9 aa, Homo Sapiens
EDSAEITWY

SEQ ID NO: 1343428 - protein, 9 aa, Homo Sapiens
LGDIVKRVY

SEQ ID NO: 1343429 - protein, 9 aa, Homo Sapiens
TVLGGMEVW

SEQ ID NO: 1343430 - protein, 9 aa, Homo Sapiens
KITDLMEKS

SEQ ID NO: 1343431 - protein, 9 aa, Homo Sapiens
TNAPELHVP

SEQ ID NO: 1343432 - protein, 9 aa, Homo Sapiens
IGEHHDVVS

SEQ ID NO: 1343433 - protein, 9 aa, Homo Sapiens
HRRSRSCRE

SEQ ID NO: 1343434 - protein, 9 aa, Homo Sapiens
KCGMWGRVL

SEQ ID NO: 1343435 - protein, 9 aa, Homo Sapiens
GPHTLNPDS

SEQ ID NO: 1343436 - protein, 9 aa, Homo Sapiens
ATGGIIYKL

SEQ ID NO: 1343437 - protein, 9 aa, Homo Sapiens
DEKHIQAEV

SEQ ID NO: 1343438 - protein, 9 aa, Homo Sapiens
EVISIRGLS

SEQ ID NO: 1343439 - protein, 9 aa, Homo Sapiens
AGRVNRRQR

SEQ ID NO: 1343440 - protein, 9 aa, Homo Sapiens
KPRSGGNRR

SEQ ID NO: 1343441 - protein, 9 aa, Homo Sapiens
CEQALRLKS

SEQ ID NO: 1343442 - protein, 9 aa, Homo Sapiens
EINVKYFLH

SEQ ID NO: 1343443 - protein, 9 aa, Homo Sapiens
FRMNMCVPH

SEQ ID NO: 1343444 - protein, 9 aa, Homo Sapiens
NMFSIAGAD

SEQ ID NO: 1343445 - protein, 9 aa, Homo Sapiens
VSLYEQGMI

SEQ ID NO: 1343446 - protein, 9 aa, Homo Sapiens
SKFTGGLKN

SEQ ID NO: 1343447 - protein, 9 aa, Homo Sapiens
MDGILEIIT

SEQ ID NO: 1343448 - protein, 9 aa, Homo Sapiens
EGTKMLAVY

SEQ ID NO: 1343449 - protein, 9 aa, Homo Sapiens
TLQLLRTFM

SEQ ID NO: 1343450 - protein, 9 aa, Homo Sapiens
DWAPKSHAF

SEQ ID NO: 1343451 - protein, 9 aa, Homo Sapiens
HVHQHTGEK

SEQ ID NO: 1343452 - protein, 9 aa, Homo Sapiens
DEGFQAAHT

SEQ ID NO: 1343453 - protein, 9 aa, Homo Sapiens
IVVIHCKGG

SEQ ID NO: 1343454 - protein, 9 aa, Homo Sapiens
QVAPLSGRQ

SEQ ID NO: 1343455 - protein, 9 aa, Homo Sapiens
DVLEHHMNP

SEQ ID NO: 1343456 - protein, 9 aa, Homo Sapiens
LTGGINTGV

SEQ ID NO: 1343457 - protein, 9 aa, Homo Sapiens
LQRPDDRFC

SEQ ID NO: 1343458 - protein, 9 aa, Homo Sapiens
QRPDRQAYE

SEQ ID NO: 1343459 - protein, 9 aa, Homo Sapiens
YWSREDGLP

SEQ ID NO: 1343460 - protein, 9 aa, Homo Sapiens
DPVRHSSSV

SEQ ID NO: 1343461 - protein, 9 aa, Homo Sapiens
AIHAKCVTI

SEQ ID NO: 1343462 - protein, 9 aa, Homo Sapiens
PALVKVLLY

SEQ ID NO: 1343463 - protein, 9 aa, Homo Sapiens
KDLSHEVIR

SEQ ID NO: 1343464 - protein, 9 aa, Homo Sapiens
YETLISLDD

SEQ ID NO: 1343465 - protein, 9 aa, Homo Sapiens
EKDMAATGE

SEQ ID NO: 1343466 - protein, 9 aa, Homo Sapiens
INAAKSLLF

SEQ ID NO: 1343467 - protein, 9 aa, Homo Sapiens
RCGQILLWS

SEQ ID NO: 1343468 - protein, 9 aa, Homo Sapiens
FSTEALRCH

SEQ ID NO: 1343469 - protein, 9 aa, Homo Sapiens
GEDSGLMHD

SEQ ID NO: 1343470 - protein, 9 aa, Homo Sapiens
SPLHIVASA

SEQ ID NO: 1343471 - protein, 9 aa, Homo Sapiens
SGKAADMWS

SEQ ID NO: 1343472 - protein, 9 aa, Homo Sapiens
ENTVLALAQ

SEQ ID NO: 1343473 - protein, 9 aa, Homo Sapiens
RNVVVGKRQ

SEQ ID NO: 1343474 - protein, 9 aa, Homo Sapiens
QDNLITLEE

SEQ ID NO: 1343475 - protein, 9 aa, Homo Sapiens
QLGLLQKPR

SEQ ID NO: 1343476 - protein, 9 aa, Homo Sapiens
QEVNMCKKC

SEQ ID NO: 1343477 - protein, 9 aa, Homo Sapiens
FSWCSRLQA

SEQ ID NO: 1343478 - protein, 9 aa, Homo Sapiens
LKYGWKKEA

SEQ ID NO: 1343479 - protein, 9 aa, Homo Sapiens
DLLPCHPFD

SEQ ID NO: 1343480 - protein, 9 aa, Homo Sapiens
TAASVGRPS

SEQ ID NO: 1343481 - protein, 9 aa, Homo Sapiens
ATSLRSLHF

SEQ ID NO: 1343482 - protein, 9 aa, Homo Sapiens
RQMKTTKES

SEQ ID NO: 1343483 - protein, 9 aa, Homo Sapiens
KNQDPGTKG

SEQ ID NO: 1343484 - protein, 9 aa, Homo Sapiens
LLICGFRQV

SEQ ID NO: 1343485 - protein, 9 aa, Homo Sapiens
CFLYLPLRA

SEQ ID NO: 1343486 - protein, 9 aa, Homo Sapiens
MFSNLTKGS

SEQ ID NO: 1343487 - protein, 9 aa, Homo Sapiens
RGHWHSNVS

SEQ ID NO: 1343488 - protein, 9 aa, Homo Sapiens
SRHRGFGLF

SEQ ID NO: 1343489 - protein, 9 aa, Homo Sapiens
YLAKDLSEA

SEQ ID NO: 1343490 - protein, 9 aa, Homo Sapiens
WVSICFPVC

SEQ ID NO: 1343491 - protein, 9 aa, Homo Sapiens
RRMHSQPQS

SEQ ID NO: 1343492 - protein, 9 aa, Homo Sapiens
TSVLPSASV

SEQ ID NO: 1343493 - protein, 9 aa, Homo Sapiens
RRCWARCCA

SEQ ID NO: 1343494 - protein, 9 aa, Homo Sapiens
FMVQIPPSQ

SEQ ID NO: 1343495 - protein, 9 aa, Homo Sapiens
RHGSRCYGV

SEQ ID NO: 1343496 - protein, 9 aa, Homo Sapiens
ELERNYYRL

SEQ ID NO: 1343497 - protein, 9 aa, Homo Sapiens
HCMHAIFTN

SEQ ID NO: 1343498 - protein, 9 aa, Homo Sapiens
AIQAPAKMS

SEQ ID NO: 1343499 - protein, 9 aa, Homo Sapiens
PDIMHIKGL

SEQ ID NO: 1343500 - protein, 9 aa, Homo Sapiens
THVYASGNN

SEQ ID NO: 1343501 - protein, 9 aa, Homo Sapiens
QVVAQTVEE

SEQ ID NO: 1343502 - protein, 9 aa, Homo Sapiens
QCNNGILEI

SEQ ID NO: 1343503 - protein, 9 aa, Homo Sapiens
ETEWSFPRA

SEQ ID NO: 1343504 - protein, 9 aa, Homo Sapiens
TRRTAQNIS

SEQ ID NO: 1343505 - protein, 9 aa, Homo Sapiens
TFALSEEVC

SEQ ID NO: 1343506 - protein, 9 aa, Homo Sapiens
TSGGLPIPH

SEQ ID NO: 1343507 - protein, 9 aa, Homo Sapiens
SQVAASTHM

SEQ ID NO: 1343508 - protein, 9 aa, Homo Sapiens
LTPGIMHTS

SEQ ID NO: 1343509 - protein, 9 aa, Homo Sapiens
MCRRMGPRS

SEQ ID NO: 1343510 - protein, 9 aa, Homo Sapiens
EGQGWQVFK

SEQ ID NO: 1343511 - protein, 9 aa, Homo Sapiens
YPPSTCSLP

SEQ ID NO: 1343512 - protein, 9 aa, Homo Sapiens
HARASWAFS

SEQ ID NO: 1343513 - protein, 9 aa, Homo Sapiens
QMVEKIIGR

SEQ ID NO: 1343514 - protein, 9 aa, Homo Sapiens
RCRVTQLAL

SEQ ID NO: 1343515 - protein, 9 aa, Homo Sapiens
PVFMASGVK

SEQ ID NO: 1343516 - protein, 9 aa, Homo Sapiens
THGCFLNAK

SEQ ID NO: 1343517 - protein, 9 aa, Homo Sapiens
PVVRAKIRN

SEQ ID NO: 1343518 - protein, 9 aa, Homo Sapiens
FPTLTVSRW

SEQ ID NO: 1343519 - protein, 9 aa, Homo Sapiens
YNGDNDHIT

SEQ ID NO: 1343520 - protein, 9 aa, Homo Sapiens
TLEEDHAQY

SEQ ID NO: 1343521 - protein, 9 aa, Homo Sapiens
SNSVTDFYG

SEQ ID NO: 1343522 - protein, 9 aa, Homo Sapiens
CLLGLRANK

SEQ ID NO: 1343523 - protein, 9 aa, Homo Sapiens
GKVSLWDCF

SEQ ID NO: 1343524 - protein, 9 aa, Homo Sapiens
YTRFQKLEW

SEQ ID NO: 1343525 - protein, 9 aa, Homo Sapiens
HLRLLDGTF

SEQ ID NO: 1343526 - protein, 9 aa, Homo Sapiens
VESAKMHLR

SEQ ID NO: 1343527 - protein, 9 aa, Homo Sapiens
AFSENHQDY

SEQ ID NO: 1343528 - protein, 9 aa, Homo Sapiens
CTSFYMKRN

SEQ ID NO: 1343529 - protein, 9 aa, Homo Sapiens
EHFWMPISP

SEQ ID NO: 1343530 - protein, 9 aa, Homo Sapiens
SHTIYPVLS

SEQ ID NO: 1343531 - protein, 9 aa, Homo Sapiens
RKILISLAT

SEQ ID NO: 1343532 - protein, 9 aa, Homo Sapiens
ETEMRRRTP

SEQ ID NO: 1343533 - protein, 9 aa, Homo Sapiens
TLRLDLAGW

SEQ ID NO: 1343534 - protein, 9 aa, Homo Sapiens
HVLIWNIRR

SEQ ID NO: 1343535 - protein, 9 aa, Homo Sapiens
SVCAFYTHM

SEQ ID NO: 1343536 - protein, 9 aa, Homo Sapiens
STAAAMQGA

SEQ ID NO: 1343537 - protein, 9 aa, Homo Sapiens
WMQTCNTLF

SEQ ID NO: 1343538 - protein, 9 aa, Homo Sapiens
KKPLLLTFI

SEQ ID NO: 1343539 - protein, 9 aa, Homo Sapiens
LYTSLTTLP

SEQ ID NO: 1343540 - protein, 9 aa, Homo Sapiens
RSLRQDRMA

SEQ ID NO: 1343541 - protein, 9 aa, Homo Sapiens
RDRLIFLHS

SEQ ID NO: 1343542 - protein, 9 aa, Homo Sapiens
VTVDVISVE

SEQ ID NO: 1343543 - protein, 9 aa, Homo Sapiens
AETWEGTGP

SEQ ID NO: 1343544 - protein, 9 aa, Homo Sapiens
SACTRSTLM

SEQ ID NO: 1343545 - protein, 9 aa, Homo Sapiens
APIQGLPDL

SEQ ID NO: 1343546 - protein, 9 aa, Homo Sapiens
CECSLYRAG

SEQ ID NO: 1343547 - protein, 9 aa, Homo Sapiens
DDQNLKELR

SEQ ID NO: 1343548 - protein, 9 aa, Homo Sapiens
KGNPHTRNN

SEQ ID NO: 1343549 - protein, 9 aa, Homo Sapiens
SIVGSYDEV

SEQ ID NO: 1343550 - protein, 9 aa, Homo Sapiens
TGKILSNNP

SEQ ID NO: 1343551 - protein, 9 aa, Homo Sapiens
LPSVIPTRT

SEQ ID NO: 1343552 - protein, 9 aa, Homo Sapiens
KAQYNVGLC

SEQ ID NO: 1343553 - protein, 9 aa, Homo Sapiens
ALLFSASRP

SEQ ID NO: 1343554 - protein, 9 aa, Homo Sapiens
TYAEAKVVC

SEQ ID NO: 1343555 - protein, 9 aa, Homo Sapiens
AWGARCQCC

SEQ ID NO: 1343556 - protein, 9 aa, Homo Sapiens
IEWDRTYLA

SEQ ID NO: 1343557 - protein, 9 aa, Homo Sapiens
EKEVILLRR

SEQ ID NO: 1343558 - protein, 9 aa, Homo Sapiens
TRELKTPSA

SEQ ID NO: 1343559 - protein, 9 aa, Homo Sapiens
GPDPRWCSF

SEQ ID NO: 1343560 - protein, 9 aa, Homo Sapiens
IILMKACVS

SEQ ID NO: 1343561 - protein, 9 aa, Homo Sapiens
LHGWLQETH

SEQ ID NO: 1343562 - protein, 9 aa, Homo Sapiens
GPDPGTPVK

SEQ ID NO: 1343563 - protein, 9 aa, Homo Sapiens
NSYHNAVHA

SEQ ID NO: 1343564 - protein, 9 aa, Homo Sapiens
AYGIKENML

SEQ ID NO: 1343565 - protein, 9 aa, Homo Sapiens
TTIGYGYHC

SEQ ID NO: 1343566 - protein, 9 aa, Homo Sapiens
MHDLKDQGG

SEQ ID NO: 1343567 - protein, 9 aa, Homo Sapiens
LLLDPPRKH

SEQ ID NO: 1343568 - protein, 9 aa, Homo Sapiens
VSKPCAHQC

SEQ ID NO: 1343569 - protein, 9 aa, Homo Sapiens
FRGFNMRMG

SEQ ID NO: 1343570 - protein, 9 aa, Homo Sapiens
IQRLEALKR

SEQ ID NO: 1343571 - protein, 9 aa, Homo Sapiens
LHIVIRGRS

SEQ ID NO: 1343572 - protein, 9 aa, Homo Sapiens
FMAICNPLN

SEQ ID NO: 1343573 - protein, 9 aa, Homo Sapiens
TTTKHWLAQ

SEQ ID NO: 1343574 - protein, 9 aa, Homo Sapiens
PLILWPQAA

SEQ ID NO: 1343575 - protein, 9 aa, Homo Sapiens
NKCPDEGVR

SEQ ID NO: 1343576 - protein, 9 aa, Homo Sapiens
VVIPDAVLK

SEQ ID NO: 1343577 - protein, 9 aa, Homo Sapiens
GMASPGLTA

SEQ ID NO: 1343578 - protein, 9 aa, Homo Sapiens
AATAKTQFL

SEQ ID NO: 1343579 - protein, 9 aa, Homo Sapiens
TRTMVPSPE

SEQ ID NO: 1343580 - protein, 9 aa, Homo Sapiens
RTMILVVFK

SEQ ID NO: 1343581 - protein, 9 aa, Homo Sapiens
AHYSGSYND

SEQ ID NO: 1343582 - protein, 9 aa, Homo Sapiens
HSGRKLMWL

SEQ ID NO: 1343583 - protein, 9 aa, Homo Sapiens
IKNQRLNRA

SEQ ID NO: 1343584 - protein, 9 aa, Homo Sapiens
LHRIVAPGV

SEQ ID NO: 1343585 - protein, 9 aa, Homo Sapiens
WPRDARMHL

SEQ ID NO: 1343586 - protein, 9 aa, Homo Sapiens
ELGGCTSIV

SEQ ID NO: 1343587 - protein, 9 aa, Homo Sapiens
GHRLGGGED

SEQ ID NO: 1343588 - protein, 9 aa, Homo Sapiens
GLMIFAGRK

SEQ ID NO: 1343589 - protein, 9 aa, Homo Sapiens
NACDHLSRF

SEQ ID NO: 1343590 - protein, 9 aa, Homo Sapiens
NVVKSKHGS

SEQ ID NO: 1343591 - protein, 9 aa, Homo Sapiens
HLAHPNKPK

SEQ ID NO: 1343592 - protein, 9 aa, Homo Sapiens
WRKAHFQYL

SEQ ID NO: 1343593 - protein, 9 aa, Homo Sapiens
KLALVIEIA

SEQ ID NO: 1343594 - protein, 9 aa, Homo Sapiens
LFIALTLVE

SEQ ID NO: 1343595 - protein, 9 aa, Homo Sapiens
CQKKLYCLD

SEQ ID NO: 1343596 - protein, 9 aa, Homo Sapiens
NVNVSAMYK

SEQ ID NO: 1343597 - protein, 9 aa, Homo Sapiens
HFFASMWSE

SEQ ID NO: 1343598 - protein, 9 aa, Homo Sapiens
VAWNLLKPC

SEQ ID NO: 1343599 - protein, 9 aa, Homo Sapiens
SQVRDLLSK

SEQ ID NO: 1343600 - protein, 9 aa, Homo Sapiens
KERKAFKAI

SEQ ID NO: 1343601 - protein, 9 aa, Homo Sapiens
FTDVSHGHL

SEQ ID NO: 1343602 - protein, 9 aa, Homo Sapiens
RIPQGPLAV

SEQ ID NO: 1343603 - protein, 9 aa, Homo Sapiens
FDIDEDERN

SEQ ID NO: 1343604 - protein, 9 aa, Homo Sapiens
KYKVTGWGA

SEQ ID NO: 1343605 - protein, 9 aa, Homo Sapiens
IPHAYLKGD

SEQ ID NO: 1343606 - protein, 9 aa, Homo Sapiens
FPMDTHACP

SEQ ID NO: 1343607 - protein, 9 aa, Homo Sapiens
TGMSPILTS

SEQ ID NO: 1343608 - protein, 9 aa, Homo Sapiens
FASGGFLYI

SEQ ID NO: 1343609 - protein, 9 aa, Homo Sapiens
RPVLLPPVF

SEQ ID NO: 1343610 - protein, 9 aa, Homo Sapiens
MALGETSMF

SEQ ID NO: 1343611 - protein, 9 aa, Homo Sapiens
EGDTVTFTN

SEQ ID NO: 1343612 - protein, 9 aa, Homo Sapiens
CEIRDQEML

SEQ ID NO: 1343613 - protein, 9 aa, Homo Sapiens
LHRVSEPDL

SEQ ID NO: 1343614 - protein, 9 aa, Homo Sapiens
KCSTAPFNG

SEQ ID NO: 1343615 - protein, 9 aa, Homo Sapiens
AQGEPLGYH

SEQ ID NO: 1343616 - protein, 9 aa, Homo Sapiens
HWIDREKLC

SEQ ID NO: 1343617 - protein, 9 aa, Homo Sapiens
NDFMHGPPS

SEQ ID NO: 1343618 - protein, 9 aa, Homo Sapiens
NQRPGRAGR

SEQ ID NO: 1343619 - protein, 9 aa, Homo Sapiens
EESGVKVDS

SEQ ID NO: 1343620 - protein, 9 aa, Homo Sapiens
DTLLFVHYL

SEQ ID NO: 1343621 - protein, 9 aa, Homo Sapiens
KGNGFSKTW

SEQ ID NO: 1343622 - protein, 9 aa, Homo Sapiens
VGSQQELRV

SEQ ID NO: 1343623 - protein, 9 aa, Homo Sapiens
QSVRHAMWK

SEQ ID NO: 1343624 - protein, 9 aa, Homo Sapiens
GERHMEDEG

SEQ ID NO: 1343625 - protein, 9 aa, Homo Sapiens
ELLCKVDSD

SEQ ID NO: 1343626 - protein, 9 aa, Homo Sapiens
VFVICWLPY

SEQ ID NO: 1343627 - protein, 9 aa, Homo Sapiens
TDHTTPLPV

SEQ ID NO: 1343628 - protein, 9 aa, Homo Sapiens
EEEKSEPDI

SEQ ID NO: 1343629 - protein, 9 aa, Homo Sapiens
VSIPSDVVK

SEQ ID NO: 1343630 - protein, 9 aa, Homo Sapiens
MKIEEMWRL

SEQ ID NO: 1343631 - protein, 9 aa, Homo Sapiens
GLTAADTVL

SEQ ID NO: 1343632 - protein, 9 aa, Homo Sapiens
VPRQLPGPH

SEQ ID NO: 1343633 - protein, 9 aa, Homo Sapiens
CKDNVIKYL

SEQ ID NO: 1343634 - protein, 9 aa, Homo Sapiens
EHRCLVTAP

SEQ ID NO: 1343635 - protein, 9 aa, Homo Sapiens
NHGHSVLVD

SEQ ID NO: 1343636 - protein, 9 aa, Homo Sapiens
TVGPQGPPH

SEQ ID NO: 1343637 - protein, 9 aa, Homo Sapiens
AGMDSYFEY

SEQ ID NO: 1343638 - protein, 9 aa, Homo Sapiens
QEARGVTMV

SEQ ID NO: 1343639 - protein, 9 aa, Homo Sapiens
GGMVRLEPE

SEQ ID NO: 1343640 - protein, 9 aa, Homo Sapiens
LSLSVPPRR

SEQ ID NO: 1343641 - protein, 9 aa, Homo Sapiens
NIACDGDKE

SEQ ID NO: 1343642 - protein, 9 aa, Homo Sapiens
RATFVSHVQ

SEQ ID NO: 1343643 - protein, 9 aa, Homo Sapiens
FPIWFEYPV

SEQ ID NO: 1343644 - protein, 9 aa, Homo Sapiens
ESSVRLKLT

SEQ ID NO: 1343645 - protein, 9 aa, Homo Sapiens
YLQPWCCPG

SEQ ID NO: 1343646 - protein, 9 aa, Homo Sapiens
YVGQITLMD

SEQ ID NO: 1343647 - protein, 9 aa, Homo Sapiens
DIIYLTRHL

SEQ ID NO: 1343648 - protein, 9 aa, Homo Sapiens
GNPHTRNNI

SEQ ID NO: 1343649 - protein, 9 aa, Homo Sapiens
EKDTEGKKS

SEQ ID NO: 1343650 - protein, 9 aa, Homo Sapiens
GPLDCSERA

SEQ ID NO: 1343651 - protein, 9 aa, Homo Sapiens
VDAYCQALP

SEQ ID NO: 1343652 - protein, 9 aa, Homo Sapiens
IRGFTMPKK

SEQ ID NO: 1343653 - protein, 9 aa, Homo Sapiens
PPPSASACL

SEQ ID NO: 1343654 - protein, 9 aa, Homo Sapiens
RWLIRIASI

SEQ ID NO: 1343655 - protein, 9 aa, Homo Sapiens
IKKKCCYVA

SEQ ID NO: 1343656 - protein, 9 aa, Homo Sapiens
PELCQKKLY

SEQ ID NO: 1343657 - protein, 9 aa, Homo Sapiens
QDFVESVMV

SEQ ID NO: 1343658 - protein, 9 aa, Homo Sapiens
DISDPQRPH

SEQ ID NO: 1343659 - protein, 9 aa, Homo Sapiens
YLACQNIKY

SEQ ID NO: 1343660 - protein, 9 aa, Homo Sapiens
GKVIEPGCI

SEQ ID NO: 1343661 - protein, 9 aa, Homo Sapiens
PYGSPWWSC

SEQ ID NO: 1343662 - protein, 9 aa, Homo Sapiens
DAHVVLEVV

SEQ ID NO: 1343663 - protein, 9 aa, Homo Sapiens
TLYEVAGVG

SEQ ID NO: 1343664 - protein, 9 aa, Homo Sapiens
HGHSVLVDE

SEQ ID NO: 1343665 - protein, 9 aa, Homo Sapiens
WKPPLVDNP

SEQ ID NO: 1343666 - protein, 9 aa, Homo Sapiens
ESFHCTSPH

SEQ ID NO: 1343667 - protein, 9 aa, Homo Sapiens
YTQVGLRGF

SEQ ID NO: 1343668 - protein, 9 aa, Homo Sapiens
LCRLYLNGN

SEQ ID NO: 1343669 - protein, 9 aa, Homo Sapiens
ATLKEEGQC

SEQ ID NO: 1343670 - protein, 9 aa, Homo Sapiens
TDLSTIILT

SEQ ID NO: 1343671 - protein, 9 aa, Homo Sapiens
VIVCACWKP

SEQ ID NO: 1343672 - protein, 9 aa, Homo Sapiens
HTWVPPFPI

SEQ ID NO: 1343673 - protein, 9 aa, Homo Sapiens
KERFHASVC

SEQ ID NO: 1343674 - protein, 9 aa, Homo Sapiens
MVEDMETKI

SEQ ID NO: 1343675 - protein, 9 aa, Homo Sapiens
LAELVVFIY

SEQ ID NO: 1343676 - protein, 9 aa, Homo Sapiens
KEQHDLHNR

SEQ ID NO: 1343677 - protein, 9 aa, Homo Sapiens
WQTKLEVAQ

SEQ ID NO: 1343678 - protein, 9 aa, Homo Sapiens
YWKTLVQEW

SEQ ID NO: 1343679 - protein, 9 aa, Homo Sapiens
EFQVSKLGP

SEQ ID NO: 1343680 - protein, 9 aa, Homo Sapiens
LILNVTALP

SEQ ID NO: 1343681 - protein, 9 aa, Homo Sapiens
EKQKRKKKE

SEQ ID NO: 1343682 - protein, 9 aa, Homo Sapiens
GIFVHRYCD

SEQ ID NO: 1343683 - protein, 9 aa, Homo Sapiens
ARTDAPQVD

SEQ ID NO: 1343684 - protein, 9 aa, Homo Sapiens
DTSLHIFKW

SEQ ID NO: 1343685 - protein, 9 aa, Homo Sapiens
DMAHRFTQE

SEQ ID NO: 1343686 - protein, 9 aa, Homo Sapiens
QNTSENIEK

SEQ ID NO: 1343687 - protein, 9 aa, Homo Sapiens
ADMWSLGVM

SEQ ID NO: 1343688 - protein, 9 aa, Homo Sapiens
VATATLTAG

SEQ ID NO: 1343689 - protein, 9 aa, Homo Sapiens
TSIANVEPK

SEQ ID NO: 1343690 - protein, 9 aa, Homo Sapiens
SVIGPQMLL

SEQ ID NO: 1343691 - protein, 9 aa, Homo Sapiens
NHGEVKCAV

SEQ ID NO: 1343692 - protein, 9 aa, Homo Sapiens
FEIWLDNIS

SEQ ID NO: 1343693 - protein, 9 aa, Homo Sapiens
YWSLDPVSQ

SEQ ID NO: 1343694 - protein, 9 aa, Homo Sapiens
HRCIPRGDC

SEQ ID NO: 1343695 - protein, 9 aa, Homo Sapiens
QKRKKKEMP

SEQ ID NO: 1343696 - protein, 9 aa, Homo Sapiens
LGGLPSHQA

SEQ ID NO: 1343697 - protein, 9 aa, Homo Sapiens
VLYNKSHNE

SEQ ID NO: 1343698 - protein, 9 aa, Homo Sapiens
SAALLSSGA

SEQ ID NO: 1343699 - protein, 9 aa, Homo Sapiens
GAPTFWSTG

SEQ ID NO: 1343700 - protein, 9 aa, Homo Sapiens
DVKIYQIYE

SEQ ID NO: 1343701 - protein, 9 aa, Homo Sapiens
NLDQGYLQL

SEQ ID NO: 1343702 - protein, 9 aa, Homo Sapiens
IFTRKEDLA

SEQ ID NO: 1343703 - protein, 9 aa, Homo Sapiens
RKDYLQPWC

SEQ ID NO: 1343704 - protein, 9 aa, Homo Sapiens
QRQKAIHLI

SEQ ID NO: 1343705 - protein, 9 aa, Homo Sapiens
HSVNEGAYI

SEQ ID NO: 1343706 - protein, 9 aa, Homo Sapiens
MMATRNVVC

SEQ ID NO: 1343707 - protein, 9 aa, Homo Sapiens
IKCNYVDMG

SEQ ID NO: 1343708 - protein, 9 aa, Homo Sapiens
GWRKAFGTC

SEQ ID NO: 1343709 - protein, 9 aa, Homo Sapiens
AEEPVVRAK

SEQ ID NO: 1343710 - protein, 9 aa, Homo Sapiens
ECKECRMTF

SEQ ID NO: 1343711 - protein, 9 aa, Homo Sapiens
STDGLVMTW

SEQ ID NO: 1343712 - protein, 9 aa, Homo Sapiens
FSFRVKWLV

SEQ ID NO: 1343713 - protein, 9 aa, Homo Sapiens
ILVRCIHFL

SEQ ID NO: 1343714 - protein, 9 aa, Homo Sapiens
VQQVWLDPG

SEQ ID NO: 1343715 - protein, 9 aa, Homo Sapiens
CVSQVAFDS

SEQ ID NO: 1343716 - protein, 9 aa, Homo Sapiens
NITFKNMQR

SEQ ID NO: 1343717 - protein, 9 aa, Homo Sapiens
MCYNLQSAL

SEQ ID NO: 1343718 - protein, 9 aa, Homo Sapiens
AERTLVLYL

SEQ ID NO: 1343719 - protein, 9 aa, Homo Sapiens
HITLRASNG

SEQ ID NO: 1343720 - protein, 9 aa, Homo Sapiens
HEAARSPDK

SEQ ID NO: 1343721 - protein, 9 aa, Homo Sapiens
PFEFETRGK

SEQ ID NO: 1343722 - protein, 9 aa, Homo Sapiens
QANQVSATS

SEQ ID NO: 1343723 - protein, 9 aa, Homo Sapiens
WILSHTVAL

SEQ ID NO: 1343724 - protein, 9 aa, Homo Sapiens
SCEKNDFLS

SEQ ID NO: 1343725 - protein, 9 aa, Homo Sapiens
TDSHLRFNS

SEQ ID NO: 1343726 - protein, 9 aa, Homo Sapiens
ATQLFNSLS

SEQ ID NO: 1343727 - protein, 9 aa, Homo Sapiens
HYFNDTLIF

SEQ ID NO: 1343728 - protein, 9 aa, Homo Sapiens
TFPGEKLPL

SEQ ID NO: 1343729 - protein, 9 aa, Homo Sapiens
VCYAPSCAK

SEQ ID NO: 1343730 - protein, 9 aa, Homo Sapiens
VLELEKDMA

SEQ ID NO: 1343731 - protein, 9 aa, Homo Sapiens
YFRDLYHRI

SEQ ID NO: 1343732 - protein, 9 aa, Homo Sapiens
LENCRRRSE

SEQ ID NO: 1343733 - protein, 9 aa, Homo Sapiens
EKTQVLIGV

SEQ ID NO: 1343734 - protein, 9 aa, Homo Sapiens
NCFLMRKRL

SEQ ID NO: 1343735 - protein, 9 aa, Homo Sapiens
NHSEHHDHV

SEQ ID NO: 1343736 - protein, 9 aa, Homo Sapiens
RAYLAHFLI

SEQ ID NO: 1343737 - protein, 9 aa, Homo Sapiens
YQSSQTHSL

SEQ ID NO: 1343738 - protein, 9 aa, Homo Sapiens
VTAFQEQEI

SEQ ID NO: 1343739 - protein, 9 aa, Homo Sapiens
ENVCYMLIN

SEQ ID NO: 1343740 - protein, 9 aa, Homo Sapiens
TGEKKMPHG

SEQ ID NO: 1343741 - protein, 9 aa, Homo Sapiens
HYECAACGK

SEQ ID NO: 1343742 - protein, 9 aa, Homo Sapiens
KDEFNATLK

SEQ ID NO: 1343743 - protein, 9 aa, Homo Sapiens
QNDVYSELS

SEQ ID NO: 1343744 - protein, 9 aa, Homo Sapiens
GRCAQTREK

SEQ ID NO: 1343745 - protein, 9 aa, Homo Sapiens
IIAPEGYAT

SEQ ID NO: 1343746 - protein, 9 aa, Homo Sapiens
MRSYTGQMT

SEQ ID NO: 1343747 - protein, 9 aa, Homo Sapiens
SDLQCCSEE

SEQ ID NO: 1343748 - protein, 9 aa, Homo Sapiens
GRNTVAGLN

SEQ ID NO: 1343749 - protein, 9 aa, Homo Sapiens
RRYLAHRKM

SEQ ID NO: 1343750 - protein, 9 aa, Homo Sapiens
TKEHHVVVS

SEQ ID NO: 1343751 - protein, 9 aa, Homo Sapiens
YIFDLCLGG

SEQ ID NO: 1343752 - protein, 9 aa, Homo Sapiens
KYYQHLYII

SEQ ID NO: 1343753 - protein, 9 aa, Homo Sapiens
HPQFCLSKS

SEQ ID NO: 1343754 - protein, 9 aa, Homo Sapiens
YYDNRIHMY

SEQ ID NO: 1343755 - protein, 9 aa, Homo Sapiens
SCGAFGYRR

SEQ ID NO: 1343756 - protein, 9 aa, Homo Sapiens
HGEVKCAVE

SEQ ID NO: 1343757 - protein, 9 aa, Homo Sapiens
CGADHNAYV

SEQ ID NO: 1343758 - protein, 9 aa, Homo Sapiens
EENKDEYID

SEQ ID NO: 1343759 - protein, 9 aa, Homo Sapiens
PSAIQAASQ

SEQ ID NO: 1343760 - protein, 9 aa, Homo Sapiens
ALCHFIVDK

SEQ ID NO: 1343761 - protein, 9 aa, Homo Sapiens
TGGSMMMSE

SEQ ID NO: 1343762 - protein, 9 aa, Homo Sapiens
KMKQSVNIS

SEQ ID NO: 1343763 - protein, 9 aa, Homo Sapiens
KEAWGMHEF

SEQ ID NO: 1343764 - protein, 9 aa, Homo Sapiens
LKWQIAQLK

SEQ ID NO: 1343765 - protein, 9 aa, Homo Sapiens
SRLISGVSR

SEQ ID NO: 1343766 - protein, 9 aa, Homo Sapiens
SSKSPKMMK

SEQ ID NO: 1343767 - protein, 9 aa, Homo Sapiens
LQIINQKWV

SEQ ID NO: 1343768 - protein, 9 aa, Homo Sapiens
IVTCGADHN

SEQ ID NO: 1343769 - protein, 9 aa, Homo Sapiens
IWPKLWVLA

SEQ ID NO: 1343770 - protein, 9 aa, Homo Sapiens
EGDSSLATN

SEQ ID NO: 1343771 - protein, 9 aa, Homo Sapiens
VRCHMNKGE

SEQ ID NO: 1343772 - protein, 9 aa, Homo Sapiens
KAVKTAVMS

SEQ ID NO: 1343773 - protein, 9 aa, Homo Sapiens
SIKEERTLV

SEQ ID NO: 1343774 - protein, 9 aa, Homo Sapiens
ATDLERFFN

SEQ ID NO: 1343775 - protein, 9 aa, Homo Sapiens
RLTSAMNAA

SEQ ID NO: 1343776 - protein, 9 aa, Homo Sapiens
CDMDTNGGG

SEQ ID NO: 1343777 - protein, 9 aa, Homo Sapiens
KTMEIKGMV

SEQ ID NO: 1343778 - protein, 9 aa, Homo Sapiens
LLWMCLHAE

SEQ ID NO: 1343779 - protein, 9 aa, Homo Sapiens
LYRLCWSLH

SEQ ID NO: 1343780 - protein, 9 aa, Homo Sapiens
FFSLPDGET

SEQ ID NO: 1343781 - protein, 9 aa, Homo Sapiens
SPHQEKLEK

SEQ ID NO: 1343782 - protein, 9 aa, Homo Sapiens
RALLHLYQE

SEQ ID NO: 1343783 - protein, 9 aa, Homo Sapiens
NKVLLKVIE

SEQ ID NO: 1343784 - protein, 9 aa, Homo Sapiens
ATDNIVEVL

SEQ ID NO: 1343785 - protein, 9 aa, Homo Sapiens
SSTLDSCTR

SEQ ID NO: 1343786 - protein, 9 aa, Homo Sapiens
EGDDIVSTQ

SEQ ID NO: 1343787 - protein, 9 aa, Homo Sapiens
FPTGDCFRK

SEQ ID NO: 1343788 - protein, 9 aa, Homo Sapiens
GQLVSIKSE

SEQ ID NO: 1343789 - protein, 9 aa, Homo Sapiens
GLQAQQDAV

SEQ ID NO: 1343790 - protein, 9 aa, Homo Sapiens
SVYAITDVA

SEQ ID NO: 1343791 - protein, 9 aa, Homo Sapiens
KFHAVKNTV

SEQ ID NO: 1343792 - protein, 9 aa, Homo Sapiens
SDIWSFGVL

SEQ ID NO: 1343793 - protein, 9 aa, Homo Sapiens
FLLPGPAPR

SEQ ID NO: 1343794 - protein, 9 aa, Homo Sapiens
NSTRGPFGG

SEQ ID NO: 1343795 - protein, 9 aa, Homo Sapiens
HRQLNFDSP

SEQ ID NO: 1343796 - protein, 9 aa, Homo Sapiens
RCGKRFYMN

SEQ ID NO: 1343797 - protein, 9 aa, Homo Sapiens
AESRVQRNI

SEQ ID NO: 1343798 - protein, 9 aa, Homo Sapiens
VELLSPAPK

SEQ ID NO: 1343799 - protein, 9 aa, Homo Sapiens
SLSEQESPR

SEQ ID NO: 1343800 - protein, 9 aa, Homo Sapiens
TMFHCQFSA

SEQ ID NO: 1343801 - protein, 9 aa, Homo Sapiens
VCVQMEELS

SEQ ID NO: 1343802 - protein, 9 aa, Homo Sapiens
GSICLLSVF

SEQ ID NO: 1343803 - protein, 9 aa, Homo Sapiens
GLKLRRTRH

SEQ ID NO: 1343804 - protein, 9 aa, Homo Sapiens
MHASLYLSS

SEQ ID NO: 1343805 - protein, 9 aa, Homo Sapiens
TAICAPASA

SEQ ID NO: 1343806 - protein, 9 aa, Homo Sapiens
LAGQEDLVE

SEQ ID NO: 1343807 - protein, 9 aa, Homo Sapiens
TWSMVGKYE

SEQ ID NO: 1343808 - protein, 9 aa, Homo Sapiens
LTLGPSVAA

SEQ ID NO: 1343809 - protein, 9 aa, Homo Sapiens
YVRYNSMND

SEQ ID NO: 1343810 - protein, 9 aa, Homo Sapiens
MRICVQAHC

SEQ ID NO: 1343811 - protein, 9 aa, Homo Sapiens
GRRVLYVDS

SEQ ID NO: 1343812 - protein, 9 aa, Homo Sapiens
VTGESPPQP

SEQ ID NO: 1343813 - protein, 9 aa, Homo Sapiens
GHMLLNLSH

SEQ ID NO: 1343814 - protein, 9 aa, Homo Sapiens
WCPYTKHQT

SEQ ID NO: 1343815 - protein, 9 aa, Homo Sapiens
IGYLDDLLP

SEQ ID NO: 1343816 - protein, 9 aa, Homo Sapiens
NALVEKTLW

SEQ ID NO: 1343817 - protein, 9 aa, Homo Sapiens
YIPELWGPM

SEQ ID NO: 1343818 - protein, 9 aa, Homo Sapiens
LEGHIYLKN

SEQ ID NO: 1343819 - protein, 9 aa, Homo Sapiens
KRVLRYLET

SEQ ID NO: 1343820 - protein, 9 aa, Homo Sapiens
LVIEIATYR

SEQ ID NO: 1343821 - protein, 9 aa, Homo Sapiens
CSNGVLIPG

SEQ ID NO: 1343822 - protein, 9 aa, Homo Sapiens
WQTVITTMT

SEQ ID NO: 1343823 - protein, 9 aa, Homo Sapiens
IGLTSYKHR

SEQ ID NO: 1343824 - protein, 9 aa, Homo Sapiens
RSLIQFMKH

SEQ ID NO: 1343825 - protein, 9 aa, Homo Sapiens
KQDVLNSIE

SEQ ID NO: 1343826 - protein, 9 aa, Homo Sapiens
HSPEKLGAF

SEQ ID NO: 1343827 - protein, 9 aa, Homo Sapiens
TRCGQILLW

SEQ ID NO: 1343828 - protein, 9 aa, Homo Sapiens
LLQTAQTEG

SEQ ID NO: 1343829 - protein, 9 aa, Homo Sapiens
ILDKYRNVI

SEQ ID NO: 1343830 - protein, 9 aa, Homo Sapiens
VSVTQTLDR

SEQ ID NO: 1343831 - protein, 9 aa, Homo Sapiens
TPRPTKART

SEQ ID NO: 1343832 - protein, 9 aa, Homo Sapiens
PHIVEHPSD

SEQ ID NO: 1343833 - protein, 9 aa, Homo Sapiens
PLMSPQSSK

SEQ ID NO: 1343834 - protein, 9 aa, Homo Sapiens
DLVAIHTDS

SEQ ID NO: 1343835 - protein, 9 aa, Homo Sapiens
YTDHILHPK

SEQ ID NO: 1343836 - protein, 9 aa, Homo Sapiens
NAYHPQFCL

SEQ ID NO: 1343837 - protein, 9 aa, Homo Sapiens
QLMEFCRLY

SEQ ID NO: 1343838 - protein, 9 aa, Homo Sapiens
ILKERELKL

SEQ ID NO: 1343839 - protein, 9 aa, Homo Sapiens
RWVVLKNNV

SEQ ID NO: 1343840 - protein, 9 aa, Homo Sapiens
RRIKMLEYV

SEQ ID NO: 1343841 - protein, 9 aa, Homo Sapiens
LVLWRADDI

SEQ ID NO: 1343842 - protein, 9 aa, Homo Sapiens
VAKLCESCR

SEQ ID NO: 1343843 - protein, 9 aa, Homo Sapiens
RRELHTTTP

SEQ ID NO: 1343844 - protein, 9 aa, Homo Sapiens
SLHLSVVPG

SEQ ID NO: 1343845 - protein, 9 aa, Homo Sapiens
ITVVAAHVL

SEQ ID NO: 1343846 - protein, 9 aa, Homo Sapiens
LREVTGIDL

SEQ ID NO: 1343847 - protein, 9 aa, Homo Sapiens
STTTDGNIL

SEQ ID NO: 1343848 - protein, 9 aa, Homo Sapiens
INTSCHPAT

SEQ ID NO: 1343849 - protein, 9 aa, Homo Sapiens
QQSAHTRLQ

SEQ ID NO: 1343850 - protein, 9 aa, Homo Sapiens
MDNLSSESS

SEQ ID NO: 1343851 - protein, 9 aa, Homo Sapiens
CWPVEPLFV

SEQ ID NO: 1343852 - protein, 9 aa, Homo Sapiens
CLGNSFTHL

SEQ ID NO: 1343853 - protein, 9 aa, Homo Sapiens
HQHTGEKPY

SEQ ID NO: 1343854 - protein, 9 aa, Homo Sapiens
VATSGVKKL

SEQ ID NO: 1343855 - protein, 9 aa, Homo Sapiens
PRTCPTTWP

SEQ ID NO: 1343856 - protein, 9 aa, Homo Sapiens
LVDSIVRQC

SEQ ID NO: 1343857 - protein, 9 aa, Homo Sapiens
LSGYLRETV

SEQ ID NO: 1343858 - protein, 9 aa, Homo Sapiens
PYKRVFSSF

SEQ ID NO: 1343859 - protein, 9 aa, Homo Sapiens
CIKYIGHYF

SEQ ID NO: 1343860 - protein, 9 aa, Homo Sapiens
LNKLKITAV

SEQ ID NO: 1343861 - protein, 9 aa, Homo Sapiens
DYALARLEL

SEQ ID NO: 1343862 - protein, 9 aa, Homo Sapiens
IPLDQTLQV

SEQ ID NO: 1343863 - protein, 9 aa, Homo Sapiens
EDALNLKDE

SEQ ID NO: 1343864 - protein, 9 aa, Homo Sapiens
NRPVLAGTD

SEQ ID NO: 1343865 - protein, 9 aa, Homo Sapiens
PSNESTDTT

SEQ ID NO: 1343866 - protein, 9 aa, Homo Sapiens
GLLDTSCQA

SEQ ID NO: 1343867 - protein, 9 aa, Homo Sapiens
AHRPLCQRF

SEQ ID NO: 1343868 - protein, 9 aa, Homo Sapiens
RLDQTMDLS

SEQ ID NO: 1343869 - protein, 9 aa, Homo Sapiens
KCPRTASPH

SEQ ID NO: 1343870 - protein, 9 aa, Homo Sapiens
VFRATPLLR

SEQ ID NO: 1343871 - protein, 9 aa, Homo Sapiens
GTDVKDTKV

SEQ ID NO: 1343872 - protein, 9 aa, Homo Sapiens
SPGAPTFWS

SEQ ID NO: 1343873 - protein, 9 aa, Homo Sapiens
RRQQPQGQG

SEQ ID NO: 1343874 - protein, 9 aa, Homo Sapiens
WKVITEKPP

SEQ ID NO: 1343875 - protein, 9 aa, Homo Sapiens
VQKDSQPYM

SEQ ID NO: 1343876 - protein, 9 aa, Homo Sapiens
GHLEEPMSN

SEQ ID NO: 1343877 - protein, 9 aa, Homo Sapiens
CSSYSGELQ

SEQ ID NO: 1343878 - protein, 9 aa, Homo Sapiens
SPICPPKYY

SEQ ID NO: 1343879 - protein, 9 aa, Homo Sapiens
ARSPTGAAS

SEQ ID NO: 1343880 - protein, 9 aa, Homo Sapiens
FQECHMKRE

SEQ ID NO: 1343881 - protein, 9 aa, Homo Sapiens
NNPRRTGHH

SEQ ID NO: 1343882 - protein, 9 aa, Homo Sapiens
SQLLSTCFC

SEQ ID NO: 1343883 - protein, 9 aa, Homo Sapiens
MKTTKESLA

SEQ ID NO: 1343884 - protein, 9 aa, Homo Sapiens
AWVIPVPQS

SEQ ID NO: 1343885 - protein, 9 aa, Homo Sapiens
IRALQETMQ

SEQ ID NO: 1343886 - protein, 9 aa, Homo Sapiens
SGNQEKAIT

SEQ ID NO: 1343887 - protein, 9 aa, Homo Sapiens
HKQLYMYGV

SEQ ID NO: 1343888 - protein, 9 aa, Homo Sapiens
LKCTVAKEL

SEQ ID NO: 1343889 - protein, 9 aa, Homo Sapiens
NCLMYATSQ

SEQ ID NO: 1343890 - protein, 9 aa, Homo Sapiens
SEVIRFNAD

SEQ ID NO: 1343891 - protein, 9 aa, Homo Sapiens
LVRCIHFLC

SEQ ID NO: 1343892 - protein, 9 aa, Homo Sapiens
CSHLTDADF

SEQ ID NO: 1343893 - protein, 9 aa, Homo Sapiens
DDASNLVGE

SEQ ID NO: 1343894 - protein, 9 aa, Homo Sapiens
ESGLHRTLR

SEQ ID NO: 1343895 - protein, 9 aa, Homo Sapiens
VVQYVLPRL

SEQ ID NO: 1343896 - protein, 9 aa, Homo Sapiens
LPGSRHRPL

SEQ ID NO: 1343897 - protein, 9 aa, Homo Sapiens
TAAISTPKL

SEQ ID NO: 1343898 - protein, 9 aa, Homo Sapiens
LDTRSSGRR

SEQ ID NO: 1343899 - protein, 9 aa, Homo Sapiens
LTGCLTHKE

SEQ ID NO: 1343900 - protein, 9 aa, Homo Sapiens
ELFLLFTGL

SEQ ID NO: 1343901 - protein, 9 aa, Homo Sapiens
VSQHLLPPF

SEQ ID NO: 1343902 - protein, 9 aa, Homo Sapiens
MVKETLQVM

SEQ ID NO: 1343903 - protein, 9 aa, Homo Sapiens
SVQLNYMLC

SEQ ID NO: 1343904 - protein, 9 aa, Homo Sapiens
TLLVENRIK

SEQ ID NO: 1343905 - protein, 9 aa, Homo Sapiens
DDTCVSNPC

SEQ ID NO: 1343906 - protein, 9 aa, Homo Sapiens
TSSLMSVCG

SEQ ID NO: 1343907 - protein, 9 aa, Homo Sapiens
EYVIRGEFS

SEQ ID NO: 1343908 - protein, 9 aa, Homo Sapiens
GALTVGLVQ

SEQ ID NO: 1343909 - protein, 9 aa, Homo Sapiens
RVNRRQRRR

SEQ ID NO: 1343910 - protein, 9 aa, Homo Sapiens
HSHIPLHPK

SEQ ID NO: 1343911 - protein, 9 aa, Homo Sapiens
SVKNVTQMP

SEQ ID NO: 1343912 - protein, 9 aa, Homo Sapiens
CIPNHSNSK

SEQ ID NO: 1343913 - protein, 9 aa, Homo Sapiens
PKSGVKLDA

SEQ ID NO: 1343914 - protein, 9 aa, Homo Sapiens
ALELDRNNV

SEQ ID NO: 1343915 - protein, 9 aa, Homo Sapiens
SEFSSKQES

SEQ ID NO: 1343916 - protein, 9 aa, Homo Sapiens
CDLVLKDIL

SEQ ID NO: 1343917 - protein, 9 aa, Homo Sapiens
MNRLANIRK

SEQ ID NO: 1343918 - protein, 9 aa, Homo Sapiens
LLDGCSKKT

SEQ ID NO: 1343919 - protein, 9 aa, Homo Sapiens
TVTTLRVSV

SEQ ID NO: 1343920 - protein, 9 aa, Homo Sapiens
ELQKYSVLS

SEQ ID NO: 1343921 - protein, 9 aa, Homo Sapiens
GTISQQTVP

SEQ ID NO: 1343922 - protein, 9 aa, Homo Sapiens
ASLTREVIH

SEQ ID NO: 1343923 - protein, 9 aa, Homo Sapiens
AANGDKAAA

SEQ ID NO: 1343924 - protein, 9 aa, Homo Sapiens
DRQAPGHIS

SEQ ID NO: 1343925 - protein, 9 aa, Homo Sapiens
RYNSMNDGF

SEQ ID NO: 1343926 - protein, 9 aa, Homo Sapiens
GKVETLTIQ

SEQ ID NO: 1343927 - protein, 9 aa, Homo Sapiens
TAGENSEKK

SEQ ID NO: 1343928 - protein, 9 aa, Homo Sapiens
EVATRTVSS

SEQ ID NO: 1343929 - protein, 9 aa, Homo Sapiens
YMLNAIPKH

SEQ ID NO: 1343930 - protein, 9 aa, Homo Sapiens
LKVVHTESL

SEQ ID NO: 1343931 - protein, 9 aa, Homo Sapiens
MVSIRGFTM

SEQ ID NO: 1343932 - protein, 9 aa, Homo Sapiens
QKADKNCAR

SEQ ID NO: 1343933 - protein, 9 aa, Homo Sapiens
NFNNCMKSV

SEQ ID NO: 1343934 - protein, 9 aa, Homo Sapiens
HKTIHTGKQ

SEQ ID NO: 1343935 - protein, 9 aa, Homo Sapiens
EKLQTTIEK

SEQ ID NO: 1343936 - protein, 9 aa, Homo Sapiens
SKAYNNQPT

SEQ ID NO: 1343937 - protein, 9 aa, Homo Sapiens
HLQKPTLTI

SEQ ID NO: 1343938 - protein, 9 aa, Homo Sapiens
EWVGYPFHL

SEQ ID NO: 1343939 - protein, 9 aa, Homo Sapiens
NSLSGEGYL

SEQ ID NO: 1343940 - protein, 9 aa, Homo Sapiens
TQKPLAVSK

SEQ ID NO: 1343941 - protein, 9 aa, Homo Sapiens
VEYVVVQVM

SEQ ID NO: 1343942 - protein, 9 aa, Homo Sapiens
CLSLNEEGQ

SEQ ID NO: 1343943 - protein, 9 aa, Homo Sapiens
CARVEENFL

SEQ ID NO: 1343944 - protein, 9 aa, Homo Sapiens
VEEDEKNET

SEQ ID NO: 1343945 - protein, 9 aa, Homo Sapiens
RTLNKFGCR

SEQ ID NO: 1343946 - protein, 9 aa, Homo Sapiens
GMLDLKGKS

SEQ ID NO: 1343947 - protein, 9 aa, Homo Sapiens
GHSLSSDPR

SEQ ID NO: 1343948 - protein, 9 aa, Homo Sapiens
ETFAHTDLS

SEQ ID NO: 1343949 - protein, 9 aa, Homo Sapiens
TRNFGFIFK

SEQ ID NO: 1343950 - protein, 9 aa, Homo Sapiens
HIDCHMTSI

SEQ ID NO: 1343951 - protein, 9 aa, Homo Sapiens
AVDAQVGPL

SEQ ID NO: 1343952 - protein, 9 aa, Homo Sapiens
IDCHYPYEY

SEQ ID NO: 1343953 - protein, 9 aa, Homo Sapiens
NVRHIAEVA

SEQ ID NO: 1343954 - protein, 9 aa, Homo Sapiens
CPDLCAQDN

SEQ ID NO: 1343955 - protein, 9 aa, Homo Sapiens
VPPLTPCPY

SEQ ID NO: 1343956 - protein, 9 aa, Homo Sapiens
AIEAAGAKA

SEQ ID NO: 1343957 - protein, 9 aa, Homo Sapiens
AYSGEKKML

SEQ ID NO: 1343958 - protein, 9 aa, Homo Sapiens
RVPCLPVTY

SEQ ID NO: 1343959 - protein, 9 aa, Homo Sapiens
KLYEYGECG

SEQ ID NO: 1343960 - protein, 9 aa, Homo Sapiens
RLIDTVAQV

SEQ ID NO: 1343961 - protein, 9 aa, Homo Sapiens
FIAMELTGT

SEQ ID NO: 1343962 - protein, 9 aa, Homo Sapiens
RPLSHQPGS

SEQ ID NO: 1343963 - protein, 9 aa, Homo Sapiens
VCIEAYTSY

SEQ ID NO: 1343964 - protein, 9 aa, Homo Sapiens
PATHPSPCM

SEQ ID NO: 1343965 - protein, 9 aa, Homo Sapiens
EGEEWNKVK

SEQ ID NO: 1343966 - protein, 9 aa, Homo Sapiens
RQRRRKERR

SEQ ID NO: 1343967 - protein, 9 aa, Homo Sapiens
VHMTQPKDG

SEQ ID NO: 1343968 - protein, 9 aa, Homo Sapiens
KQEEERLHC

SEQ ID NO: 1343969 - protein, 9 aa, Homo Sapiens
GSIVGFFDD

SEQ ID NO: 1343970 - protein, 9 aa, Homo Sapiens
IAHVHQHTG

SEQ ID NO: 1343971 - protein, 9 aa, Homo Sapiens
FEITQETAQ

SEQ ID NO: 1343972 - protein, 9 aa, Homo Sapiens
FCHLADHGQ

SEQ ID NO: 1343973 - protein, 9 aa, Homo Sapiens
RSLHFLQIL

SEQ ID NO: 1343974 - protein, 9 aa, Homo Sapiens
VKKCSKGNG

SEQ ID NO: 1343975 - protein, 9 aa, Homo Sapiens
GGPKPLSPV

SEQ ID NO: 1343976 - protein, 9 aa, Homo Sapiens
PDNEAGRER

SEQ ID NO: 1343977 - protein, 9 aa, Homo Sapiens
NRMSPGMAQ

SEQ ID NO: 1343978 - protein, 9 aa, Homo Sapiens
LFGNTIIIT

SEQ ID NO: 1343979 - protein, 9 aa, Homo Sapiens
PCHPFDTVF

SEQ ID NO: 1343980 - protein, 9 aa, Homo Sapiens
KYLKSVHYI

SEQ ID NO: 1343981 - protein, 9 aa, Homo Sapiens
KKKLEKKNK

SEQ ID NO: 1343982 - protein, 9 aa, Homo Sapiens
FPGWRRRHR

SEQ ID NO: 1343983 - protein, 9 aa, Homo Sapiens
HAALFGSYR

SEQ ID NO: 1343984 - protein, 9 aa, Homo Sapiens
PNTTFSSTI

SEQ ID NO: 1343985 - protein, 9 aa, Homo Sapiens
SPFLKRGKD

SEQ ID NO: 1343986 - protein, 9 aa, Homo Sapiens
PLEIEHIKI

SEQ ID NO: 1343987 - protein, 9 aa, Homo Sapiens
VWILYLFLA

SEQ ID NO: 1343988 - protein, 9 aa, Homo Sapiens
TSLRSEQSN

SEQ ID NO: 1343989 - protein, 9 aa, Homo Sapiens
NVDNKEYVV

SEQ ID NO: 1343990 - protein, 9 aa, Homo Sapiens
FWEERDIMT

SEQ ID NO: 1343991 - protein, 9 aa, Homo Sapiens
PVALSMYQL

SEQ ID NO: 1343992 - protein, 9 aa, Homo Sapiens
QCRVQKFTF

SEQ ID NO: 1343993 - protein, 9 aa, Homo Sapiens
QNSPLSSSP

SEQ ID NO: 1343994 - protein, 9 aa, Homo Sapiens
MGQYYLPNS

SEQ ID NO: 1343995 - protein, 9 aa, Homo Sapiens
KVVHTESLL

SEQ ID NO: 1343996 - protein, 9 aa, Homo Sapiens
QSHYNIEDF

SEQ ID NO: 1343997 - protein, 9 aa, Homo Sapiens
DLYHRIDVI

SEQ ID NO: 1343998 - protein, 9 aa, Homo Sapiens
ATADVEWCW

SEQ ID NO: 1343999 - protein, 9 aa, Homo Sapiens
TMCGQESTD

SEQ ID NO: 1344000 - protein, 9 aa, Homo Sapiens
TVKRIQINF

SEQ ID NO: 1344001 - protein, 9 aa, Homo Sapiens
NDGVDEGIC

SEQ ID NO: 1344002 - protein, 9 aa, Homo Sapiens
KRWAKQDCA

SEQ ID NO: 1344003 - protein, 9 aa, Homo Sapiens
DVGGPTEEK

SEQ ID NO: 1344004 - protein, 9 aa, Homo Sapiens
VFDSVMARG

SEQ ID NO: 1344005 - protein, 9 aa, Homo Sapiens
KAQTPLFTD

SEQ ID NO: 1344006 - protein, 9 aa, Homo Sapiens
KMLSNVVER

SEQ ID NO: 1344007 - protein, 9 aa, Homo Sapiens
HILFFSFLE

SEQ ID NO: 1344008 - protein, 9 aa, Homo Sapiens
YGQPQPPIL

SEQ ID NO: 1344009 - protein, 9 aa, Homo Sapiens
LIQFMKHVH

SEQ ID NO: 1344010 - protein, 9 aa, Homo Sapiens
GYWGPANGF

SEQ ID NO: 1344011 - protein, 9 aa, Homo Sapiens
TAQQQEGSG

SEQ ID NO: 1344012 - protein, 9 aa, Homo Sapiens
SATGGIIYK

SEQ ID NO: 1344013 - protein, 9 aa, Homo Sapiens
LSPNPEVMC

SEQ ID NO: 1344014 - protein, 9 aa, Homo Sapiens
GTGPSEALT

SEQ ID NO: 1344015 - protein, 9 aa, Homo Sapiens
HKVDWLTEK

SEQ ID NO: 1344016 - protein, 9 aa, Homo Sapiens
SSQIKYKER

SEQ ID NO: 1344017 - protein, 9 aa, Homo Sapiens
HHFEKLMEY

SEQ ID NO: 1344018 - protein, 9 aa, Homo Sapiens
ILYACRQDD

SEQ ID NO: 1344019 - protein, 9 aa, Homo Sapiens
HTSYRQISG

SEQ ID NO: 1344020 - protein, 9 aa, Homo Sapiens
SCSYSVPLM

SEQ ID NO: 1344021 - protein, 9 aa, Homo Sapiens
IEQEVCDLV

SEQ ID NO: 1344022 - protein, 9 aa, Homo Sapiens
ELIDLCQKS

SEQ ID NO: 1344023 - protein, 9 aa, Homo Sapiens
ADSAHQDAH

SEQ ID NO: 1344024 - protein, 9 aa, Homo Sapiens
ANQSTSEDQ

SEQ ID NO: 1344025 - protein, 9 aa, Homo Sapiens
VFAWEHNEY

SEQ ID NO: 1344026 - protein, 9 aa, Homo Sapiens
LSHPQVQDL

SEQ ID NO: 1344027 - protein, 9 aa, Homo Sapiens
DRPHYNYYV

SEQ ID NO: 1344028 - protein, 9 aa, Homo Sapiens
GGQKVRVVF

SEQ ID NO: 1344029 - protein, 9 aa, Homo Sapiens
PPPMSSMSP

SEQ ID NO: 1344030 - protein, 9 aa, Homo Sapiens
ITNGITKAC

SEQ ID NO: 1344031 - protein, 9 aa, Homo Sapiens
HHVELYKVL

SEQ ID NO: 1344032 - protein, 9 aa, Homo Sapiens
MSPRTGLLQ

SEQ ID NO: 1344033 - protein, 9 aa, Homo Sapiens
GGAPIQGLP

SEQ ID NO: 1344034 - protein, 9 aa, Homo Sapiens
RLRQVPVSE

SEQ ID NO: 1344035 - protein, 9 aa, Homo Sapiens
VTEPSHLVR

SEQ ID NO: 1344036 - protein, 9 aa, Homo Sapiens
TKHMKITRR

SEQ ID NO: 1344037 - protein, 9 aa, Homo Sapiens
VRWISGGGR

SEQ ID NO: 1344038 - protein, 9 aa, Homo Sapiens
LGAVHASVI

SEQ ID NO: 1344039 - protein, 9 aa, Homo Sapiens
EHCGDSPNS

SEQ ID NO: 1344040 - protein, 9 aa, Homo Sapiens
LIQVLKKRR

SEQ ID NO: 1344041 - protein, 9 aa, Homo Sapiens
SRSYSRSWS

SEQ ID NO: 1344042 - protein, 9 aa, Homo Sapiens
GSELEEFMN

SEQ ID NO: 1344043 - protein, 9 aa, Homo Sapiens
QVYSGVDEQ

SEQ ID NO: 1344044 - protein, 9 aa, Homo Sapiens
VARAFLRAH

SEQ ID NO: 1344045 - protein, 9 aa, Homo Sapiens
DTGCYSCFA

SEQ ID NO: 1344046 - protein, 9 aa, Homo Sapiens
VKKSLIEDK

SEQ ID NO: 1344047 - protein, 9 aa, Homo Sapiens
LETEMRRRT

SEQ ID NO: 1344048 - protein, 9 aa, Homo Sapiens
QTHSRSRSR

SEQ ID NO: 1344049 - protein, 9 aa, Homo Sapiens
GATCTGAAS

SEQ ID NO: 1344050 - protein, 9 aa, Homo Sapiens
HKMRMVIGV

SEQ ID NO: 1344051 - protein, 9 aa, Homo Sapiens
KVTMNYLQL

SEQ ID NO: 1344052 - protein, 9 aa, Homo Sapiens
QVHRRMNNL

SEQ ID NO: 1344053 - protein, 9 aa, Homo Sapiens
YGPAVIITL

SEQ ID NO: 1344054 - protein, 9 aa, Homo Sapiens
SSCDSSPSR

SEQ ID NO: 1344055 - protein, 9 aa, Homo Sapiens
LCRAAAMLP

SEQ ID NO: 1344056 - protein, 9 aa, Homo Sapiens
VHVSRFVTW

SEQ ID NO: 1344057 - protein, 9 aa, Homo Sapiens
SGTFEVVLH

SEQ ID NO: 1344058 - protein, 9 aa, Homo Sapiens
PAKVAHMRL

SEQ ID NO: 1344059 - protein, 9 aa, Homo Sapiens
GPFYVIVEY

SEQ ID NO: 1344060 - protein, 9 aa, Homo Sapiens
NLLLMEAQM

SEQ ID NO: 1344061 - protein, 9 aa, Homo Sapiens
TFCLADSDE

SEQ ID NO: 1344062 - protein, 9 aa, Homo Sapiens
CQLSPQSKS

SEQ ID NO: 1344063 - protein, 9 aa, Homo Sapiens
TSHIKVSVS

SEQ ID NO: 1344064 - protein, 9 aa, Homo Sapiens
PSATPCRKL

SEQ ID NO: 1344065 - protein, 9 aa, Homo Sapiens
FHDMSVKYQ

SEQ ID NO: 1344066 - protein, 9 aa, Homo Sapiens
DDDMPADEY

SEQ ID NO: 1344067 - protein, 9 aa, Homo Sapiens
MVPSNAHFL

SEQ ID NO: 1344068 - protein, 9 aa, Homo Sapiens
AKIVMEKLS

SEQ ID NO: 1344069 - protein, 9 aa, Homo Sapiens
PLFNELHNP

SEQ ID NO: 1344070 - protein, 9 aa, Homo Sapiens
WWQKFWLRS

SEQ ID NO: 1344071 - protein, 9 aa, Homo Sapiens
SAIKTISLL

SEQ ID NO: 1344072 - protein, 9 aa, Homo Sapiens
AKEAKQTLH

SEQ ID NO: 1344073 - protein, 9 aa, Homo Sapiens
AGPNNVPKF

SEQ ID NO: 1344074 - protein, 9 aa, Homo Sapiens
LHTIRMTID

SEQ ID NO: 1344075 - protein, 9 aa, Homo Sapiens
KITGIKDQF

SEQ ID NO: 1344076 - protein, 9 aa, Homo Sapiens
KEDAKRIKN

SEQ ID NO: 1344077 - protein, 9 aa, Homo Sapiens
TPPRQVSQK

SEQ ID NO: 1344078 - protein, 9 aa, Homo Sapiens
NTEGGVCAL

SEQ ID NO: 1344079 - protein, 9 aa, Homo Sapiens
DTQKTASYY

SEQ ID NO: 1344080 - protein, 9 aa, Homo Sapiens
SRLGLTRMY

SEQ ID NO: 1344081 - protein, 9 aa, Homo Sapiens
QEVQQIHQD

SEQ ID NO: 1344082 - protein, 9 aa, Homo Sapiens
LEHLNTIVQ

SEQ ID NO: 1344083 - protein, 9 aa, Homo Sapiens
LPQLILPDS

SEQ ID NO: 1344084 - protein, 9 aa, Homo Sapiens
RTLGSGEGI

SEQ ID NO: 1344085 - protein, 9 aa, Homo Sapiens
PGASRRWRM

SEQ ID NO: 1344086 - protein, 9 aa, Homo Sapiens
LPLRAINLN

SEQ ID NO: 1344087 - protein, 9 aa, Homo Sapiens
VAKTMWNLE

SEQ ID NO: 1344088 - protein, 9 aa, Homo Sapiens
VRENNSPTL

SEQ ID NO: 1344089 - protein, 9 aa, Homo Sapiens
PGLWVVVSD

SEQ ID NO: 1344090 - protein, 9 aa, Homo Sapiens
KKDVYRHIV

SEQ ID NO: 1344091 - protein, 9 aa, Homo Sapiens
PHKGLAHCP

SEQ ID NO: 1344092 - protein, 9 aa, Homo Sapiens
GSEVNTAAK

SEQ ID NO: 1344093 - protein, 9 aa, Homo Sapiens
RPSSCTSAS

SEQ ID NO: 1344094 - protein, 9 aa, Homo Sapiens
VEKEKKVQE

SEQ ID NO: 1344095 - protein, 9 aa, Homo Sapiens
GYHIGPAEV

SEQ ID NO: 1344096 - protein, 9 aa, Homo Sapiens
PYGLNGMLT

SEQ ID NO: 1344097 - protein, 9 aa, Homo Sapiens
CSYHDKPGS

SEQ ID NO: 1344098 - protein, 9 aa, Homo Sapiens
NSAKGWRKA

SEQ ID NO: 1344099 - protein, 9 aa, Homo Sapiens
RHTFETARH

SEQ ID NO: 1344100 - protein, 9 aa, Homo Sapiens
LRVYGAGLL

SEQ ID NO: 1344101 - protein, 9 aa, Homo Sapiens
EVKKPPVCS

SEQ ID NO: 1344102 - protein, 9 aa, Homo Sapiens
RAKEKELHT

SEQ ID NO: 1344103 - protein, 9 aa, Homo Sapiens
DSVIYIINI

SEQ ID NO: 1344104 - protein, 9 aa, Homo Sapiens
IEVVTPTTF

SEQ ID NO: 1344105 - protein, 9 aa, Homo Sapiens
DVLLHHTHD

SEQ ID NO: 1344106 - protein, 9 aa, Homo Sapiens
HHRSKSQQV

SEQ ID NO: 1344107 - protein, 9 aa, Homo Sapiens
AHCMKREVD

SEQ ID NO: 1344108 - protein, 9 aa, Homo Sapiens
SGSRFFITS

SEQ ID NO: 1344109 - protein, 9 aa, Homo Sapiens
RVAFFVALD

SEQ ID NO: 1344110 - protein, 9 aa, Homo Sapiens
WCWVESRGP

SEQ ID NO: 1344111 - protein, 9 aa, Homo Sapiens
AAGAGNETA

SEQ ID NO: 1344112 - protein, 9 aa, Homo Sapiens
KLVMIVGIN

SEQ ID NO: 1344113 - protein, 9 aa, Homo Sapiens
AARPSTSVH

SEQ ID NO: 1344114 - protein, 9 aa, Homo Sapiens
NNCRCLDGR

SEQ ID NO: 1344115 - protein, 9 aa, Homo Sapiens
LARTLSILI

SEQ ID NO: 1344116 - protein, 9 aa, Homo Sapiens
KGRLIDTVA

SEQ ID NO: 1344117 - protein, 9 aa, Homo Sapiens
RLGTKLGFV

SEQ ID NO: 1344118 - protein, 9 aa, Homo Sapiens
QVDVPKVPV

SEQ ID NO: 1344119 - protein, 9 aa, Homo Sapiens
WKSELAANL

SEQ ID NO: 1344120 - protein, 9 aa, Homo Sapiens
RSPRVFPVL

SEQ ID NO: 1344121 - protein, 9 aa, Homo Sapiens
PAMKWPRLL

SEQ ID NO: 1344122 - protein, 9 aa, Homo Sapiens
RYLDFSIII

SEQ ID NO: 1344123 - protein, 9 aa, Homo Sapiens
SYICSHYYR

SEQ ID NO: 1344124 - protein, 9 aa, Homo Sapiens
LRQRAPHLL

SEQ ID NO: 1344125 - protein, 9 aa, Homo Sapiens
VLTTTVTMT

SEQ ID NO: 1344126 - protein, 9 aa, Homo Sapiens
AGMYKQCLP

SEQ ID NO: 1344127 - protein, 9 aa, Homo Sapiens
ETSSSSCKK

SEQ ID NO: 1344128 - protein, 9 aa, Homo Sapiens
LDGTFKLSA

SEQ ID NO: 1344129 - protein, 9 aa, Homo Sapiens
RPHIALPQT

SEQ ID NO: 1344130 - protein, 9 aa, Homo Sapiens
SKVVQGLMR

SEQ ID NO: 1344131 - protein, 9 aa, Homo Sapiens
SPSFTPTHL

SEQ ID NO: 1344132 - protein, 9 aa, Homo Sapiens
VVERVTVPR

SEQ ID NO: 1344133 - protein, 9 aa, Homo Sapiens
SSPSPPTPR

SEQ ID NO: 1344134 - protein, 9 aa, Homo Sapiens
TPKEMPTPQ

SEQ ID NO: 1344135 - protein, 9 aa, Homo Sapiens
YTNVMPMLN

SEQ ID NO: 1344136 - protein, 9 aa, Homo Sapiens
WRFHGMLLP

SEQ ID NO: 1344137 - protein, 9 aa, Homo Sapiens
QKQRMSLAR

SEQ ID NO: 1344138 - protein, 9 aa, Homo Sapiens
IQPSNTCEN

SEQ ID NO: 1344139 - protein, 9 aa, Homo Sapiens
GRLPPFAEL

SEQ ID NO: 1344140 - protein, 9 aa, Homo Sapiens
FATCSSHVT

SEQ ID NO: 1344141 - protein, 9 aa, Homo Sapiens
FTIPDFKVG

SEQ ID NO: 1344142 - protein, 9 aa, Homo Sapiens
SSYGPYGYG

SEQ ID NO: 1344143 - protein, 9 aa, Homo Sapiens
QDPIKGQVS

SEQ ID NO: 1344144 - protein, 9 aa, Homo Sapiens
APAPATYHA

SEQ ID NO: 1344145 - protein, 9 aa, Homo Sapiens
LRGFSWWSG

SEQ ID NO: 1344146 - protein, 9 aa, Homo Sapiens
PKGALKKPI

SEQ ID NO: 1344147 - protein, 9 aa, Homo Sapiens
VRPVNTYVR

SEQ ID NO: 1344148 - protein, 9 aa, Homo Sapiens
LLKVFVRDT

SEQ ID NO: 1344149 - protein, 9 aa, Homo Sapiens
LNAVISFLC

SEQ ID NO: 1344150 - protein, 9 aa, Homo Sapiens
KDLPKAHTT

SEQ ID NO: 1344151 - protein, 9 aa, Homo Sapiens
LRYHHIMTV

SEQ ID NO: 1344152 - protein, 9 aa, Homo Sapiens
SVPKTSTSR

SEQ ID NO: 1344153 - protein, 9 aa, Homo Sapiens
KYHEDIINV

SEQ ID NO: 1344154 - protein, 9 aa, Homo Sapiens
NVTLKELNT

SEQ ID NO: 1344155 - protein, 9 aa, Homo Sapiens
EKKQGPCMS

SEQ ID NO: 1344156 - protein, 9 aa, Homo Sapiens
KYLRIPNEI

SEQ ID NO: 1344157 - protein, 9 aa, Homo Sapiens
ALPQTEISD

SEQ ID NO: 1344158 - protein, 9 aa, Homo Sapiens
SILCYKFCK

SEQ ID NO: 1344159 - protein, 9 aa, Homo Sapiens
CSKFGQVRK

SEQ ID NO: 1344160 - protein, 9 aa, Homo Sapiens
CMPRGGAGE

SEQ ID NO: 1344161 - protein, 9 aa, Homo Sapiens
FNSLMTYWQ

SEQ ID NO: 1344162 - protein, 9 aa, Homo Sapiens
CANATCLHK

SEQ ID NO: 1344163 - protein, 9 aa, Homo Sapiens
EELCLCCLV

SEQ ID NO: 1344164 - protein, 9 aa, Homo Sapiens
NGVVTLPAP

SEQ ID NO: 1344165 - protein, 9 aa, Homo Sapiens
ECRPVIPPS

SEQ ID NO: 1344166 - protein, 9 aa, Homo Sapiens
DMCWSCEHL

SEQ ID NO: 1344167 - protein, 9 aa, Homo Sapiens
LLPSTSSEE

SEQ ID NO: 1344168 - protein, 9 aa, Homo Sapiens
ADSYIEELT

SEQ ID NO: 1344169 - protein, 9 aa, Homo Sapiens
KEAYPMPTK

SEQ ID NO: 1344170 - protein, 9 aa, Homo Sapiens
VSNKINTGM

SEQ ID NO: 1344171 - protein, 9 aa, Homo Sapiens
KALEVESDN

SEQ ID NO: 1344172 - protein, 9 aa, Homo Sapiens
EALLARDAD

SEQ ID NO: 1344173 - protein, 9 aa, Homo Sapiens
GGRSLYNWG

SEQ ID NO: 1344174 - protein, 9 aa, Homo Sapiens
PDACTISND

SEQ ID NO: 1344175 - protein, 9 aa, Homo Sapiens
NGMHRWWQD

SEQ ID NO: 1344176 - protein, 9 aa, Homo Sapiens
MHGPPSSPT

SEQ ID NO: 1344177 - protein, 9 aa, Homo Sapiens
NPATPMTSA

SEQ ID NO: 1344178 - protein, 9 aa, Homo Sapiens
DLGYGYDCG

SEQ ID NO: 1344179 - protein, 9 aa, Homo Sapiens
IFDEDTKII

SEQ ID NO: 1344180 - protein, 9 aa, Homo Sapiens
HVKEMDAYG

SEQ ID NO: 1344181 - protein, 9 aa, Homo Sapiens
AVVLSAHTQ

SEQ ID NO: 1344182 - protein, 9 aa, Homo Sapiens
LRAREKCRK

SEQ ID NO: 1344183 - protein, 9 aa, Homo Sapiens
PPGTSSVAY

SEQ ID NO: 1344184 - protein, 9 aa, Homo Sapiens
PSSLSQEVQ

SEQ ID NO: 1344185 - protein, 9 aa, Homo Sapiens
KLEWETQAL

SEQ ID NO: 1344186 - protein, 9 aa, Homo Sapiens
KQRMFEYFQ

SEQ ID NO: 1344187 - protein, 9 aa, Homo Sapiens
RGTRLKYVH

SEQ ID NO: 1344188 - protein, 9 aa, Homo Sapiens
LSLPTFSEV

SEQ ID NO: 1344189 - protein, 9 aa, Homo Sapiens
VEVFILSSN

SEQ ID NO: 1344190 - protein, 9 aa, Homo Sapiens
TVPGSLCSM

SEQ ID NO: 1344191 - protein, 9 aa, Homo Sapiens
PHICSLVID

SEQ ID NO: 1344192 - protein, 9 aa, Homo Sapiens
LWTTCVDAG

SEQ ID NO: 1344193 - protein, 9 aa, Homo Sapiens
THDYLGLNS

SEQ ID NO: 1344194 - protein, 9 aa, Homo Sapiens
NRDGFNMRV

SEQ ID NO: 1344195 - protein, 9 aa, Homo Sapiens
VMSNSFSPP

SEQ ID NO: 1344196 - protein, 9 aa, Homo Sapiens
PNKEMMETL

SEQ ID NO: 1344197 - protein, 9 aa, Homo Sapiens
MRICLRDLI

SEQ ID NO: 1344198 - protein, 9 aa, Homo Sapiens
CLSSLNDER

SEQ ID NO: 1344199 - protein, 9 aa, Homo Sapiens
CPPWLHHPK

SEQ ID NO: 1344200 - protein, 9 aa, Homo Sapiens
IFSSIFLFV

SEQ ID NO: 1344201 - protein, 9 aa, Homo Sapiens
ECSSIGSGG

SEQ ID NO: 1344202 - protein, 9 aa, Homo Sapiens
SLDQQCSCP

SEQ ID NO: 1344203 - protein, 9 aa, Homo Sapiens
IQPLAKTTS

SEQ ID NO: 1344204 - protein, 9 aa, Homo Sapiens
VDYIFRGVE

SEQ ID NO: 1344205 - protein, 9 aa, Homo Sapiens
TSAEVGSAA

SEQ ID NO: 1344206 - protein, 9 aa, Homo Sapiens
SSEEDKKKK

SEQ ID NO: 1344207 - protein, 9 aa, Homo Sapiens
TGAGIYTYL

SEQ ID NO: 1344208 - protein, 9 aa, Homo Sapiens
LTICLTVIV

SEQ ID NO: 1344209 - protein, 9 aa, Homo Sapiens
GYGSGWSSS

SEQ ID NO: 1344210 - protein, 9 aa, Homo Sapiens
AVERSLKTL

SEQ ID NO: 1344211 - protein, 9 aa, Homo Sapiens
RGSLRKWRP

SEQ ID NO: 1344212 - protein, 9 aa, Homo Sapiens
HISLRLENI

SEQ ID NO: 1344213 - protein, 9 aa, Homo Sapiens
CQCDKKRGA

SEQ ID NO: 1344214 - protein, 9 aa, Homo Sapiens
LSPKGERHM

SEQ ID NO: 1344215 - protein, 9 aa, Homo Sapiens
SYHDKPGSS

SEQ ID NO: 1344216 - protein, 9 aa, Homo Sapiens
ILQWEPYCR

SEQ ID NO: 1344217 - protein, 9 aa, Homo Sapiens
IPGLKTGTI

SEQ ID NO: 1344218 - protein, 9 aa, Homo Sapiens
DLEYVNDNH

SEQ ID NO: 1344219 - protein, 9 aa, Homo Sapiens
GGPLPPTNF

SEQ ID NO: 1344220 - protein, 9 aa, Homo Sapiens
LGIGLCGAI

SEQ ID NO: 1344221 - protein, 9 aa, Homo Sapiens
VFFFTIGIT

SEQ ID NO: 1344222 - protein, 9 aa, Homo Sapiens
QHYLYENLE

SEQ ID NO: 1344223 - protein, 9 aa, Homo Sapiens
GLSLCIAVC

SEQ ID NO: 1344224 - protein, 9 aa, Homo Sapiens
TDFPSENSF

SEQ ID NO: 1344225 - protein, 9 aa, Homo Sapiens
KTVSRRSST

SEQ ID NO: 1344226 - protein, 9 aa, Homo Sapiens
FSVEPKIGV

SEQ ID NO: 1344227 - protein, 9 aa, Homo Sapiens
LCGASATTG

SEQ ID NO: 1344228 - protein, 9 aa, Homo Sapiens
VHEASVPAS

SEQ ID NO: 1344229 - protein, 9 aa, Homo Sapiens
CQYVVQVIF

SEQ ID NO: 1344230 - protein, 9 aa, Homo Sapiens
KSPTTQNSP

SEQ ID NO: 1344231 - protein, 9 aa, Homo Sapiens
FEGINFKWK

SEQ ID NO: 1344232 - protein, 9 aa, Homo Sapiens
SVLPSASVS

SEQ ID NO: 1344233 - protein, 9 aa, Homo Sapiens
WIMGSMDAI

SEQ ID NO: 1344234 - protein, 9 aa, Homo Sapiens
QQLCPQNSL

SEQ ID NO: 1344235 - protein, 9 aa, Homo Sapiens
SIGPHLHGH

SEQ ID NO: 1344236 - protein, 9 aa, Homo Sapiens
RPRGGRCAQ

SEQ ID NO: 1344237 - protein, 9 aa, Homo Sapiens
LTAADTVLC

SEQ ID NO: 1344238 - protein, 9 aa, Homo Sapiens
VPPAIINPQ

SEQ ID NO: 1344239 - protein, 9 aa, Homo Sapiens
VCAWESRWR

SEQ ID NO: 1344240 - protein, 9 aa, Homo Sapiens
AVRAVTHMG

SEQ ID NO: 1344241 - protein, 9 aa, Homo Sapiens
VFGNFNLLH

SEQ ID NO: 1344242 - protein, 9 aa, Homo Sapiens
GQDSPIPTL

SEQ ID NO: 1344243 - protein, 9 aa, Homo Sapiens
VVILVLQSV

SEQ ID NO: 1344244 - protein, 9 aa, Homo Sapiens
SRRGPHAPV

SEQ ID NO: 1344245 - protein, 9 aa, Homo Sapiens
EPSRRVRRA

SEQ ID NO: 1344246 - protein, 9 aa, Homo Sapiens
PCIPDVLFW

SEQ ID NO: 1344247 - protein, 9 aa, Homo Sapiens
CHYPYEYLG

SEQ ID NO: 1344248 - protein, 9 aa, Homo Sapiens
DGEGSSEAT

SEQ ID NO: 1344249 - protein, 9 aa, Homo Sapiens
PRSPEVQFI

SEQ ID NO: 1344250 - protein, 9 aa, Homo Sapiens
IFLNTRHKV

SEQ ID NO: 1344251 - protein, 9 aa, Homo Sapiens
ILLYLQPYN

SEQ ID NO: 1344252 - protein, 9 aa, Homo Sapiens
DMSVKYQNV

SEQ ID NO: 1344253 - protein, 9 aa, Homo Sapiens
THYQLYTGA

SEQ ID NO: 1344254 - protein, 9 aa, Homo Sapiens
FTLDGHFLL

SEQ ID NO: 1344255 - protein, 9 aa, Homo Sapiens
VYHGHLSSL

SEQ ID NO: 1344256 - protein, 9 aa, Homo Sapiens
GWKGNELQH

SEQ ID NO: 1344257 - protein, 9 aa, Homo Sapiens
AKSLHIVER

SEQ ID NO: 1344258 - protein, 9 aa, Homo Sapiens
PIQVLTYEW

SEQ ID NO: 1344259 - protein, 9 aa, Homo Sapiens
YGVQNYITF

SEQ ID NO: 1344260 - protein, 9 aa, Homo Sapiens
APASTPLML

SEQ ID NO: 1344261 - protein, 9 aa, Homo Sapiens
VDMAHRFTQ

SEQ ID NO: 1344262 - protein, 9 aa, Homo Sapiens
VIHLAQDAE

SEQ ID NO: 1344263 - protein, 9 aa, Homo Sapiens
ISKQVIILN

SEQ ID NO: 1344264 - protein, 9 aa, Homo Sapiens
LSLPPKKCS

SEQ ID NO: 1344265 - protein, 9 aa, Homo Sapiens
KNSIRHSLS

SEQ ID NO: 1344266 - protein, 9 aa, Homo Sapiens
LHTIHTAGL

SEQ ID NO: 1344267 - protein, 9 aa, Homo Sapiens
ISILLGNDT

SEQ ID NO: 1344268 - protein, 9 aa, Homo Sapiens
LQVMILQLQ

SEQ ID NO: 1344269 - protein, 9 aa, Homo Sapiens
MRCLREWEE

SEQ ID NO: 1344270 - protein, 9 aa, Homo Sapiens
VLSINEEEL

SEQ ID NO: 1344271 - protein, 9 aa, Homo Sapiens
KAVSYHTSG

SEQ ID NO: 1344272 - protein, 9 aa, Homo Sapiens
AAPEKCSLE

SEQ ID NO: 1344273 - protein, 9 aa, Homo Sapiens
PKFTNTHIT

SEQ ID NO: 1344274 - protein, 9 aa, Homo Sapiens
NYSLIPAEI

SEQ ID NO: 1344275 - protein, 9 aa, Homo Sapiens
GIIYKLGGD

SEQ ID NO: 1344276 - protein, 9 aa, Homo Sapiens
WKEDLAVFV

SEQ ID NO: 1344277 - protein, 9 aa, Homo Sapiens
YVISNILLA

SEQ ID NO: 1344278 - protein, 9 aa, Homo Sapiens
EFLRSGLKQ

SEQ ID NO: 1344279 - protein, 9 aa, Homo Sapiens
SRFFDVWCQ

SEQ ID NO: 1344280 - protein, 9 aa, Homo Sapiens
IHESLNIEN

SEQ ID NO: 1344281 - protein, 9 aa, Homo Sapiens
QHYSDASKL

SEQ ID NO: 1344282 - protein, 9 aa, Homo Sapiens
QPMVPRELP

SEQ ID NO: 1344283 - protein, 9 aa, Homo Sapiens
FVQLIQANT

SEQ ID NO: 1344284 - protein, 9 aa, Homo Sapiens
HIDFEQFKG

SEQ ID NO: 1344285 - protein, 9 aa, Homo Sapiens
SMWEEDFIQ

SEQ ID NO: 1344286 - protein, 9 aa, Homo Sapiens
RRWGRKEEP

SEQ ID NO: 1344287 - protein, 9 aa, Homo Sapiens
TVCEKTFKH

SEQ ID NO: 1344288 - protein, 9 aa, Homo Sapiens
SFCTSPPSC

SEQ ID NO: 1344289 - protein, 9 aa, Homo Sapiens
TVAIPMLSP

SEQ ID NO: 1344290 - protein, 9 aa, Homo Sapiens
ASFYSMSTP

SEQ ID NO: 1344291 - protein, 9 aa, Homo Sapiens
RLLSRKDIS

SEQ ID NO: 1344292 - protein, 9 aa, Homo Sapiens
NIHTFSAGL

SEQ ID NO: 1344293 - protein, 9 aa, Homo Sapiens
TYMSADDLH

SEQ ID NO: 1344294 - protein, 9 aa, Homo Sapiens
GILEELLPS

SEQ ID NO: 1344295 - protein, 9 aa, Homo Sapiens
LLIFRKVAA

SEQ ID NO: 1344296 - protein, 9 aa, Homo Sapiens
GVSTSWGPT

SEQ ID NO: 1344297 - protein, 9 aa, Homo Sapiens
QKTAVWGGH

SEQ ID NO: 1344298 - protein, 9 aa, Homo Sapiens
RMSTHLNVH

SEQ ID NO: 1344299 - protein, 9 aa, Homo Sapiens
VPTFGWVMF

SEQ ID NO: 1344300 - protein, 9 aa, Homo Sapiens
SKEHHSSKI

SEQ ID NO: 1344301 - protein, 9 aa, Homo Sapiens
EGPRPAHMV

SEQ ID NO: 1344302 - protein, 9 aa, Homo Sapiens
CSQMSTVSG

SEQ ID NO: 1344303 - protein, 9 aa, Homo Sapiens
NSVWEETSQ

SEQ ID NO: 1344304 - protein, 9 aa, Homo Sapiens
VVTPVMVVD

SEQ ID NO: 1344305 - protein, 9 aa, Homo Sapiens
VNTIWAHDN

SEQ ID NO: 1344306 - protein, 9 aa, Homo Sapiens
THFETPCDD

SEQ ID NO: 1344307 - protein, 9 aa, Homo Sapiens
PDYACPITF

SEQ ID NO: 1344308 - protein, 9 aa, Homo Sapiens
RCYGVCVDC

SEQ ID NO: 1344309 - protein, 9 aa, Homo Sapiens
PPRKRHATE

SEQ ID NO: 1344310 - protein, 9 aa, Homo Sapiens
SMDFNALVE

SEQ ID NO: 1344311 - protein, 9 aa, Homo Sapiens
RGLLMAMRC

SEQ ID NO: 1344312 - protein, 9 aa, Homo Sapiens
TSRSALPDV

SEQ ID NO: 1344313 - protein, 9 aa, Homo Sapiens
CSDTLVDAN

SEQ ID NO: 1344314 - protein, 9 aa, Homo Sapiens
GLYTCQTCS

SEQ ID NO: 1344315 - protein, 9 aa, Homo Sapiens
DRFSLPIIL

SEQ ID NO: 1344316 - protein, 9 aa, Homo Sapiens
AMKWPRLLS

SEQ ID NO: 1344317 - protein, 9 aa, Homo Sapiens
CSNTPLGAV

SEQ ID NO: 1344318 - protein, 9 aa, Homo Sapiens
QNRFLHMHE

SEQ ID NO: 1344319 - protein, 9 aa, Homo Sapiens
LSVMGSTSI

SEQ ID NO: 1344320 - protein, 9 aa, Homo Sapiens
GNLRVAKKG

SEQ ID NO: 1344321 - protein, 9 aa, Homo Sapiens
GQRKNFTMT

SEQ ID NO: 1344322 - protein, 9 aa, Homo Sapiens
AYETREYII

SEQ ID NO: 1344323 - protein, 9 aa, Homo Sapiens
IQQDTSETL

SEQ ID NO: 1344324 - protein, 9 aa, Homo Sapiens
ISENMVVPL

SEQ ID NO: 1344325 - protein, 9 aa, Homo Sapiens
SEVNITQFL

SEQ ID NO: 1344326 - protein, 9 aa, Homo Sapiens
LHRDVLLGE

SEQ ID NO: 1344327 - protein, 9 aa, Homo Sapiens
KKGLSLSYG

SEQ ID NO: 1344328 - protein, 9 aa, Homo Sapiens
HDTVPKPPL

SEQ ID NO: 1344329 - protein, 9 aa, Homo Sapiens
FKPSLDQQC

SEQ ID NO: 1344330 - protein, 9 aa, Homo Sapiens
DMIQQPRVP

SEQ ID NO: 1344331 - protein, 9 aa, Homo Sapiens
YHSQNSYHN

SEQ ID NO: 1344332 - protein, 9 aa, Homo Sapiens
EEHLRQAVE

SEQ ID NO: 1344333 - protein, 9 aa, Homo Sapiens
LIQLRKTRP

SEQ ID NO: 1344334 - protein, 9 aa, Homo Sapiens
PRQVSQKSS

SEQ ID NO: 1344335 - protein, 9 aa, Homo Sapiens
HSQNSSISS

SEQ ID NO: 1344336 - protein, 9 aa, Homo Sapiens
SPKSTGSIR

SEQ ID NO: 1344337 - protein, 9 aa, Homo Sapiens
PYERPPLPR

SEQ ID NO: 1344338 - protein, 9 aa, Homo Sapiens
LLCMHERTH

SEQ ID NO: 1344339 - protein, 9 aa, Homo Sapiens
GQKSQHYKA

SEQ ID NO: 1344340 - protein, 9 aa, Homo Sapiens
EDEEELWFN

SEQ ID NO: 1344341 - protein, 9 aa, Homo Sapiens
DGTFVKEYT

SEQ ID NO: 1344342 - protein, 9 aa, Homo Sapiens
ASVKSKKTK

SEQ ID NO: 1344343 - protein, 9 aa, Homo Sapiens
TFNNLFNLR

SEQ ID NO: 1344344 - protein, 9 aa, Homo Sapiens
RDESALFLH

SEQ ID NO: 1344345 - protein, 9 aa, Homo Sapiens
VCLSANLNG

SEQ ID NO: 1344346 - protein, 9 aa, Homo Sapiens
PSAAARCSA

SEQ ID NO: 1344347 - protein, 9 aa, Homo Sapiens
VAMAFDRFM

SEQ ID NO: 1344348 - protein, 9 aa, Homo Sapiens
KIHILHKRE

SEQ ID NO: 1344349 - protein, 9 aa, Homo Sapiens
CNDVSVKLK

SEQ ID NO: 1344350 - protein, 9 aa, Homo Sapiens
NYYFNTYEG

SEQ ID NO: 1344351 - protein, 9 aa, Homo Sapiens
NYLKSGIRI

SEQ ID NO: 1344352 - protein, 9 aa, Homo Sapiens
TSLRSLNLV

SEQ ID NO: 1344353 - protein, 9 aa, Homo Sapiens
TQRDCSFPG

SEQ ID NO: 1344354 - protein, 9 aa, Homo Sapiens
GISENMVVP

SEQ ID NO: 1344355 - protein, 9 aa, Homo Sapiens
ESYPLRQFH

SEQ ID NO: 1344356 - protein, 9 aa, Homo Sapiens
ANARHLIVH

SEQ ID NO: 1344357 - protein, 9 aa, Homo Sapiens
GKHCVDKFD

SEQ ID NO: 1344358 - protein, 9 aa, Homo Sapiens
DIYFSELSV

SEQ ID NO: 1344359 - protein, 9 aa, Homo Sapiens
SRSASDSVT

SEQ ID NO: 1344360 - protein, 9 aa, Homo Sapiens
YVRCTHSVS

SEQ ID NO: 1344361 - protein, 9 aa, Homo Sapiens
QALHRPPNS

SEQ ID NO: 1344362 - protein, 9 aa, Homo Sapiens
HLHGKTHHP

SEQ ID NO: 1344363 - protein, 9 aa, Homo Sapiens
EFYNCRNID

SEQ ID NO: 1344364 - protein, 9 aa, Homo Sapiens
QIFLDNCFL

SEQ ID NO: 1344365 - protein, 9 aa, Homo Sapiens
FTDVNSILH

SEQ ID NO: 1344366 - protein, 9 aa, Homo Sapiens
DTYQAFKAL

SEQ ID NO: 1344367 - protein, 9 aa, Homo Sapiens
YQMAVELLF

SEQ ID NO: 1344368 - protein, 9 aa, Homo Sapiens
AGSQLPFDP

SEQ ID NO: 1344369 - protein, 9 aa, Homo Sapiens
LEKEVQEAK

SEQ ID NO: 1344370 - protein, 9 aa, Homo Sapiens
TIEESSANN

SEQ ID NO: 1344371 - protein, 9 aa, Homo Sapiens
FHYHLCGLH

SEQ ID NO: 1344372 - protein, 9 aa, Homo Sapiens
SPSVKSLHL

SEQ ID NO: 1344373 - protein, 9 aa, Homo Sapiens
CEKCCHAYH

SEQ ID NO: 1344374 - protein, 9 aa, Homo Sapiens
REVDEATNY

SEQ ID NO: 1344375 - protein, 9 aa, Homo Sapiens
GMDAVPPWK

SEQ ID NO: 1344376 - protein, 9 aa, Homo Sapiens
GAHLVLRHS

SEQ ID NO: 1344377 - protein, 9 aa, Homo Sapiens
MEMKSVNRF

SEQ ID NO: 1344378 - protein, 9 aa, Homo Sapiens
ASMIPQLFG

SEQ ID NO: 1344379 - protein, 9 aa, Homo Sapiens
VTVQAHVMD

SEQ ID NO: 1344380 - protein, 9 aa, Homo Sapiens
NNIRLIPEK

SEQ ID NO: 1344381 - protein, 9 aa, Homo Sapiens
LYCGQGVQF

SEQ ID NO: 1344382 - protein, 9 aa, Homo Sapiens
LITLKWLLG

SEQ ID NO: 1344383 - protein, 9 aa, Homo Sapiens
ALADTQVAL

SEQ ID NO: 1344384 - protein, 9 aa, Homo Sapiens
CYSTVVTSK

SEQ ID NO: 1344385 - protein, 9 aa, Homo Sapiens
RPTQRDCSF

SEQ ID NO: 1344386 - protein, 9 aa, Homo Sapiens
AARCSACTC

SEQ ID NO: 1344387 - protein, 9 aa, Homo Sapiens
VSVFRPMDL

SEQ ID NO: 1344388 - protein, 9 aa, Homo Sapiens
RLCCTLVAL

SEQ ID NO: 1344389 - protein, 9 aa, Homo Sapiens
NSTHFLVFN

SEQ ID NO: 1344390 - protein, 9 aa, Homo Sapiens
SLTQPELDK

SEQ ID NO: 1344391 - protein, 9 aa, Homo Sapiens
VLICGLIIV

SEQ ID NO: 1344392 - protein, 9 aa, Homo Sapiens
AVFQHGMRQ

SEQ ID NO: 1344393 - protein, 9 aa, Homo Sapiens
VDRTSSKKT

SEQ ID NO: 1344394 - protein, 9 aa, Homo Sapiens
GQRYVHETQ

SEQ ID NO: 1344395 - protein, 9 aa, Homo Sapiens
LLIIGTTSH

SEQ ID NO: 1344396 - protein, 9 aa, Homo Sapiens
RIPLDESTI

SEQ ID NO: 1344397 - protein, 9 aa, Homo Sapiens
SCWQTSNDC

SEQ ID NO: 1344398 - protein, 9 aa, Homo Sapiens
VDIDGSNVA

SEQ ID NO: 1344399 - protein, 9 aa, Homo Sapiens
DLCCRSQFL

SEQ ID NO: 1344400 - protein, 9 aa, Homo Sapiens
EEPDYGESS

SEQ ID NO: 1344401 - protein, 9 aa, Homo Sapiens
PGRSRLSVR

SEQ ID NO: 1344402 - protein, 9 aa, Homo Sapiens
SFDYSYWLH

SEQ ID NO: 1344403 - protein, 9 aa, Homo Sapiens
RSSKKKPLL

SEQ ID NO: 1344404 - protein, 9 aa, Homo Sapiens
EGDMWICME

SEQ ID NO: 1344405 - protein, 9 aa, Homo Sapiens
SVFQVIRCP

SEQ ID NO: 1344406 - protein, 9 aa, Homo Sapiens
DEDGEKEVR

SEQ ID NO: 1344407 - protein, 9 aa, Homo Sapiens
YLHQIHANH

SEQ ID NO: 1344408 - protein, 9 aa, Homo Sapiens
MKRNSRRSS

SEQ ID NO: 1344409 - protein, 9 aa, Homo Sapiens
DQWLKIPGL

SEQ ID NO: 1344410 - protein, 9 aa, Homo Sapiens
ALTLVEAYR

SEQ ID NO: 1344411 - protein, 9 aa, Homo Sapiens
YMGAPLCNY

SEQ ID NO: 1344412 - protein, 9 aa, Homo Sapiens
VTALPLPDK

SEQ ID NO: 1344413 - protein, 9 aa, Homo Sapiens
QHAVLSGHR

SEQ ID NO: 1344414 - protein, 9 aa, Homo Sapiens
TAIILIAFL

SEQ ID NO: 1344415 - protein, 9 aa, Homo Sapiens
NLRLFYDIC

SEQ ID NO: 1344416 - protein, 9 aa, Homo Sapiens
EGINFKWKF

SEQ ID NO: 1344417 - protein, 9 aa, Homo Sapiens
SRVFLLLKW

SEQ ID NO: 1344418 - protein, 9 aa, Homo Sapiens
MPPPMSSMS

SEQ ID NO: 1344419 - protein, 9 aa, Homo Sapiens
FGLNVLLRT

SEQ ID NO: 1344420 - protein, 9 aa, Homo Sapiens
EHNEYLNED

SEQ ID NO: 1344421 - protein, 9 aa, Homo Sapiens
VDKAQCYAD

SEQ ID NO: 1344422 - protein, 9 aa, Homo Sapiens
AIFVQRVLC

SEQ ID NO: 1344423 - protein, 9 aa, Homo Sapiens
RELRSRLCT

SEQ ID NO: 1344424 - protein, 9 aa, Homo Sapiens
RALAAGASS

SEQ ID NO: 1344425 - protein, 9 aa, Homo Sapiens
HLGQSLLEN

SEQ ID NO: 1344426 - protein, 9 aa, Homo Sapiens
IHSKEHILE

SEQ ID NO: 1344427 - protein, 9 aa, Homo Sapiens
YMSTAAAMQ

SEQ ID NO: 1344428 - protein, 9 aa, Homo Sapiens
IADIKWTVL

SEQ ID NO: 1344429 - protein, 9 aa, Homo Sapiens
LLTLWHVVD

SEQ ID NO: 1344430 - protein, 9 aa, Homo Sapiens
KARTPLPSA

SEQ ID NO: 1344431 - protein, 9 aa, Homo Sapiens
VREHVLEEV

SEQ ID NO: 1344432 - protein, 9 aa, Homo Sapiens
QASSSVQAV

SEQ ID NO: 1344433 - protein, 9 aa, Homo Sapiens
SCGHTRAPQ

SEQ ID NO: 1344434 - protein, 9 aa, Homo Sapiens
AALTSPTPP

SEQ ID NO: 1344435 - protein, 9 aa, Homo Sapiens
ALTDMFLGL

SEQ ID NO: 1344436 - protein, 9 aa, Homo Sapiens
YFIQLSFVE

SEQ ID NO: 1344437 - protein, 9 aa, Homo Sapiens
RGEDGTPII

SEQ ID NO: 1344438 - protein, 9 aa, Homo Sapiens
QQVWLDPGA

SEQ ID NO: 1344439 - protein, 9 aa, Homo Sapiens
KEDKVTCHD

SEQ ID NO: 1344440 - protein, 9 aa, Homo Sapiens
SGRIVSWWM

SEQ ID NO: 1344441 - protein, 9 aa, Homo Sapiens
ADTGFGGHR

SEQ ID NO: 1344442 - protein, 9 aa, Homo Sapiens
EVQQLKVSV

SEQ ID NO: 1344443 - protein, 9 aa, Homo Sapiens
ELPIVPSHV

SEQ ID NO: 1344444 - protein, 9 aa, Homo Sapiens
SDISTQVQQ

SEQ ID NO: 1344445 - protein, 9 aa, Homo Sapiens
SNMSCCRCF

SEQ ID NO: 1344446 - protein, 9 aa, Homo Sapiens
LQGPHTALL

SEQ ID NO: 1344447 - protein, 9 aa, Homo Sapiens
SIIQGEVDP

SEQ ID NO: 1344448 - protein, 9 aa, Homo Sapiens
DNKHILSEF

SEQ ID NO: 1344449 - protein, 9 aa, Homo Sapiens
DAVVTYYLY

SEQ ID NO: 1344450 - protein, 9 aa, Homo Sapiens
EPRPREDDI

SEQ ID NO: 1344451 - protein, 9 aa, Homo Sapiens
TYMRSFGLS

SEQ ID NO: 1344452 - protein, 9 aa, Homo Sapiens
KVHEEANAA

SEQ ID NO: 1344453 - protein, 9 aa, Homo Sapiens
LFSLWVMCR

SEQ ID NO: 1344454 - protein, 9 aa, Homo Sapiens
PHHDLDRVK

SEQ ID NO: 1344455 - protein, 9 aa, Homo Sapiens
DEYIDLMTE

SEQ ID NO: 1344456 - protein, 9 aa, Homo Sapiens
GLGPCTMES

SEQ ID NO: 1344457 - protein, 9 aa, Homo Sapiens
RSEVTDLRH

SEQ ID NO: 1344458 - protein, 9 aa, Homo Sapiens
QQCQTIHGR

SEQ ID NO: 1344459 - protein, 9 aa, Homo Sapiens
MHTMGYMPT

SEQ ID NO: 1344460 - protein, 9 aa, Homo Sapiens
TSHRLIVVL

SEQ ID NO: 1344461 - protein, 9 aa, Homo Sapiens
WMVIIFTRK

SEQ ID NO: 1344462 - protein, 9 aa, Homo Sapiens
TVVKQNADM

SEQ ID NO: 1344463 - protein, 9 aa, Homo Sapiens
QKEKIWEQE

SEQ ID NO: 1344464 - protein, 9 aa, Homo Sapiens
IWNAAWHKH

SEQ ID NO: 1344465 - protein, 9 aa, Homo Sapiens
RAGGGGRDV

SEQ ID NO: 1344466 - protein, 9 aa, Homo Sapiens
VEEMETTTE

SEQ ID NO: 1344467 - protein, 9 aa, Homo Sapiens
HDDFVADGA

SEQ ID NO: 1344468 - protein, 9 aa, Homo Sapiens
EGSVMSNSF

SEQ ID NO: 1344469 - protein, 9 aa, Homo Sapiens
TIKVYCQHM

SEQ ID NO: 1344470 - protein, 9 aa, Homo Sapiens
TRSWATPRR

SEQ ID NO: 1344471 - protein, 9 aa, Homo Sapiens
EKKNKTPKE

SEQ ID NO: 1344472 - protein, 9 aa, Homo Sapiens
QQLWEQSEQ

SEQ ID NO: 1344473 - protein, 9 aa, Homo Sapiens
TSETLPGHT

SEQ ID NO: 1344474 - protein, 9 aa, Homo Sapiens
PSVLVVSVP

SEQ ID NO: 1344475 - protein, 9 aa, Homo Sapiens
PFHLFDFTA

SEQ ID NO: 1344476 - protein, 9 aa, Homo Sapiens
IAEKDANWT

SEQ ID NO: 1344477 - protein, 9 aa, Homo Sapiens
KSSLENSLE

SEQ ID NO: 1344478 - protein, 9 aa, Homo Sapiens
MPKNKHKLR

SEQ ID NO: 1344479 - protein, 9 aa, Homo Sapiens
FKMKQHILK

SEQ ID NO: 1344480 - protein, 9 aa, Homo Sapiens
TPGVIPGIV

SEQ ID NO: 1344481 - protein, 9 aa, Homo Sapiens
LILNKHKRI

SEQ ID NO: 1344482 - protein, 9 aa, Homo Sapiens
LQNTDSNFT

SEQ ID NO: 1344483 - protein, 9 aa, Homo Sapiens
QLTFFNIPL

SEQ ID NO: 1344484 - protein, 9 aa, Homo Sapiens
QPFLTSTNK

SEQ ID NO: 1344485 - protein, 9 aa, Homo Sapiens
WTVRSAACP

SEQ ID NO: 1344486 - protein, 9 aa, Homo Sapiens
HFLKFTSVF

SEQ ID NO: 1344487 - protein, 9 aa, Homo Sapiens
DIIPNGVKY

SEQ ID NO: 1344488 - protein, 9 aa, Homo Sapiens
FLLLCVVYF

SEQ ID NO: 1344489 - protein, 9 aa, Homo Sapiens
GLLRRYHQD

SEQ ID NO: 1344490 - protein, 9 aa, Homo Sapiens
CDEEIEAER

SEQ ID NO: 1344491 - protein, 9 aa, Homo Sapiens
GRGIGPLTR

SEQ ID NO: 1344492 - protein, 9 aa, Homo Sapiens
LKVASQKNF

SEQ ID NO: 1344493 - protein, 9 aa, Homo Sapiens
LLLLLDLPI

SEQ ID NO: 1344494 - protein, 9 aa, Homo Sapiens
TFKCDRCGK

SEQ ID NO: 1344495 - protein, 9 aa, Homo Sapiens
FLSIHHLTL

SEQ ID NO: 1344496 - protein, 9 aa, Homo Sapiens
VHIEELIEK

SEQ ID NO: 1344497 - protein, 9 aa, Homo Sapiens
WIPRLLFAE

SEQ ID NO: 1344498 - protein, 9 aa, Homo Sapiens
FWMPISPSR

SEQ ID NO: 1344499 - protein, 9 aa, Homo Sapiens
SKLDQDLLR

SEQ ID NO: 1344500 - protein, 9 aa, Homo Sapiens
GRTVGNGKV

SEQ ID NO: 1344501 - protein, 9 aa, Homo Sapiens
ANATKMLSW

SEQ ID NO: 1344502 - protein, 9 aa, Homo Sapiens
RVEQFLTIV

SEQ ID NO: 1344503 - protein, 9 aa, Homo Sapiens
SRVWRVSVA

SEQ ID NO: 1344504 - protein, 9 aa, Homo Sapiens
WEKCTDPRG

SEQ ID NO: 1344505 - protein, 9 aa, Homo Sapiens
SEVCDTETV

SEQ ID NO: 1344506 - protein, 9 aa, Homo Sapiens
LRPNGIIII

SEQ ID NO: 1344507 - protein, 9 aa, Homo Sapiens
TTFKCDRCG

SEQ ID NO: 1344508 - protein, 9 aa, Homo Sapiens
QDAFDIYTN

SEQ ID NO: 1344509 - protein, 9 aa, Homo Sapiens
DTLVQTKGT

SEQ ID NO: 1344510 - protein, 9 aa, Homo Sapiens
CAQCRTYFT

SEQ ID NO: 1344511 - protein, 9 aa, Homo Sapiens
QLVTENPEK

SEQ ID NO: 1344512 - protein, 9 aa, Homo Sapiens
LSQEVQLEA

SEQ ID NO: 1344513 - protein, 9 aa, Homo Sapiens
IVTFQLTAF

SEQ ID NO: 1344514 - protein, 9 aa, Homo Sapiens
QLFNSLSGE

SEQ ID NO: 1344515 - protein, 9 aa, Homo Sapiens
KSTLKTRLS

SEQ ID NO: 1344516 - protein, 9 aa, Homo Sapiens
VWKEVRGEW

SEQ ID NO: 1344517 - protein, 9 aa, Homo Sapiens
SPRSTPWAC

SEQ ID NO: 1344518 - protein, 9 aa, Homo Sapiens
QRESLMSHV

SEQ ID NO: 1344519 - protein, 9 aa, Homo Sapiens
EDILFFLSK

SEQ ID NO: 1344520 - protein, 9 aa, Homo Sapiens
DPYSHVSDP

SEQ ID NO: 1344521 - protein, 9 aa, Homo Sapiens
KLQRVFDSI

SEQ ID NO: 1344522 - protein, 9 aa, Homo Sapiens
KLYDELEQI

SEQ ID NO: 1344523 - protein, 9 aa, Homo Sapiens
LAALTSPTP

SEQ ID NO: 1344524 - protein, 9 aa, Homo Sapiens
YRLHHYLNF

SEQ ID NO: 1344525 - protein, 9 aa, Homo Sapiens
NMVVPLMPD

SEQ ID NO: 1344526 - protein, 9 aa, Homo Sapiens
VTPVMVVDT

SEQ ID NO: 1344527 - protein, 9 aa, Homo Sapiens
RCWARCCAS

SEQ ID NO: 1344528 - protein, 9 aa, Homo Sapiens
YFDQISFMK

SEQ ID NO: 1344529 - protein, 9 aa, Homo Sapiens
QALQATRQL

SEQ ID NO: 1344530 - protein, 9 aa, Homo Sapiens
LRIPNEIID

SEQ ID NO: 1344531 - protein, 9 aa, Homo Sapiens
PVASQLPHI

SEQ ID NO: 1344532 - protein, 9 aa, Homo Sapiens
FEARDHNLQ

SEQ ID NO: 1344533 - protein, 9 aa, Homo Sapiens
LCMLRLGQM

SEQ ID NO: 1344534 - protein, 9 aa, Homo Sapiens
LFVISSIVS

SEQ ID NO: 1344535 - protein, 9 aa, Homo Sapiens
PPAQDGKKE

SEQ ID NO: 1344536 - protein, 9 aa, Homo Sapiens
ISPKEIEWM

SEQ ID NO: 1344537 - protein, 9 aa, Homo Sapiens
LNEATCNDF

SEQ ID NO: 1344538 - protein, 9 aa, Homo Sapiens
FINGQNLGH

SEQ ID NO: 1344539 - protein, 9 aa, Homo Sapiens
FTNTATVTE

SEQ ID NO: 1344540 - protein, 9 aa, Homo Sapiens
LSLELQLNV

SEQ ID NO: 1344541 - protein, 9 aa, Homo Sapiens
EVVFRQRQP

SEQ ID NO: 1344542 - protein, 9 aa, Homo Sapiens
ERMWADVSH

SEQ ID NO: 1344543 - protein, 9 aa, Homo Sapiens
LRWGDIIGV

SEQ ID NO: 1344544 - protein, 9 aa, Homo Sapiens
LWDCFNLFT

SEQ ID NO: 1344545 - protein, 9 aa, Homo Sapiens
SPHARALVH

SEQ ID NO: 1344546 - protein, 9 aa, Homo Sapiens
AARPSPGAP

SEQ ID NO: 1344547 - protein, 9 aa, Homo Sapiens
LDVAVQVVR

SEQ ID NO: 1344548 - protein, 9 aa, Homo Sapiens
TVAGAMTEK

SEQ ID NO: 1344549 - protein, 9 aa, Homo Sapiens
FSWIMGSMD

SEQ ID NO: 1344550 - protein, 9 aa, Homo Sapiens
YGWGFSMGI

SEQ ID NO: 1344551 - protein, 9 aa, Homo Sapiens
PNLDKRQSL

SEQ ID NO: 1344552 - protein, 9 aa, Homo Sapiens
LADYLHAMC

SEQ ID NO: 1344553 - protein, 9 aa, Homo Sapiens
SAPPTSLQR

SEQ ID NO: 1344554 - protein, 9 aa, Homo Sapiens
ISNDHGYTI

SEQ ID NO: 1344555 - protein, 9 aa, Homo Sapiens
HRLHMHGPN

SEQ ID NO: 1344556 - protein, 9 aa, Homo Sapiens
AGSAGRAPG

SEQ ID NO: 1344557 - protein, 9 aa, Homo Sapiens
HIPVIRRVL

SEQ ID NO: 1344558 - protein, 9 aa, Homo Sapiens
QYLLHLNSL

SEQ ID NO: 1344559 - protein, 9 aa, Homo Sapiens
FSLGGSQGG

SEQ ID NO: 1344560 - protein, 9 aa, Homo Sapiens
ALVTATRNF

SEQ ID NO: 1344561 - protein, 9 aa, Homo Sapiens
EVDTRLSFD

SEQ ID NO: 1344562 - protein, 9 aa, Homo Sapiens
GGTMQLVSD

SEQ ID NO: 1344563 - protein, 9 aa, Homo Sapiens
EEVIREGWR

SEQ ID NO: 1344564 - protein, 9 aa, Homo Sapiens
SLALTDMFL

SEQ ID NO: 1344565 - protein, 9 aa, Homo Sapiens
TDLERFFNF

SEQ ID NO: 1344566 - protein, 9 aa, Homo Sapiens
SHLRFNSTM

SEQ ID NO: 1344567 - protein, 9 aa, Homo Sapiens
IASVQGSAP

SEQ ID NO: 1344568 - protein, 9 aa, Homo Sapiens
IQNVNVSAM

SEQ ID NO: 1344569 - protein, 9 aa, Homo Sapiens
YTFQVSSEG

SEQ ID NO: 1344570 - protein, 9 aa, Homo Sapiens
YQYIHQKSF

SEQ ID NO: 1344571 - protein, 9 aa, Homo Sapiens
HSKVWQKSE

SEQ ID NO: 1344572 - protein, 9 aa, Homo Sapiens
DQPNERHVR

SEQ ID NO: 1344573 - protein, 9 aa, Homo Sapiens
PGLPLTHTQ

SEQ ID NO: 1344574 - protein, 9 aa, Homo Sapiens
RVLRKAIAD

SEQ ID NO: 1344575 - protein, 9 aa, Homo Sapiens
GNGTQQVFY

SEQ ID NO: 1344576 - protein, 9 aa, Homo Sapiens
DLTMKHRIL

SEQ ID NO: 1344577 - protein, 9 aa, Homo Sapiens
EVRYALMDG

SEQ ID NO: 1344578 - protein, 9 aa, Homo Sapiens
DRDSDGKLQ

SEQ ID NO: 1344579 - protein, 9 aa, Homo Sapiens
CDTCGEAFN

SEQ ID NO: 1344580 - protein, 9 aa, Homo Sapiens
KNVTQMPRE

SEQ ID NO: 1344581 - protein, 9 aa, Homo Sapiens
CHTPLAEHC

SEQ ID NO: 1344582 - protein, 9 aa, Homo Sapiens
TVSRWMTSL

SEQ ID NO: 1344583 - protein, 9 aa, Homo Sapiens
PVSEVNITQ

SEQ ID NO: 1344584 - protein, 9 aa, Homo Sapiens
KSHRRSVSQ

SEQ ID NO: 1344585 - protein, 9 aa, Homo Sapiens
DMGFTMSNS

SEQ ID NO: 1344586 - protein, 9 aa, Homo Sapiens
SVCRSNKNP

SEQ ID NO: 1344587 - protein, 9 aa, Homo Sapiens
AKRMAVDLH

SEQ ID NO: 1344588 - protein, 9 aa, Homo Sapiens
GFSPRKKSR

SEQ ID NO: 1344589 - protein, 9 aa, Homo Sapiens
SPSSGTGIM

SEQ ID NO: 1344590 - protein, 9 aa, Homo Sapiens
ILNTNSISV

SEQ ID NO: 1344591 - protein, 9 aa, Homo Sapiens
EIKFLKLVA

SEQ ID NO: 1344592 - protein, 9 aa, Homo Sapiens
NNMKLQHAA

SEQ ID NO: 1344593 - protein, 9 aa, Homo Sapiens
YAACDTTYN

SEQ ID NO: 1344594 - protein, 9 aa, Homo Sapiens
NHNGASCFS

SEQ ID NO: 1344595 - protein, 9 aa, Homo Sapiens
RIHSLQGRL

SEQ ID NO: 1344596 - protein, 9 aa, Homo Sapiens
QCDMYRILL

SEQ ID NO: 1344597 - protein, 9 aa, Homo Sapiens
YGFLITRHS

SEQ ID NO: 1344598 - protein, 9 aa, Homo Sapiens
FMDHTHYLL

SEQ ID NO: 1344599 - protein, 9 aa, Homo Sapiens
SIPSIKYYL

SEQ ID NO: 1344600 - protein, 9 aa, Homo Sapiens
YAEYLAHHQ

SEQ ID NO: 1344601 - protein, 9 aa, Homo Sapiens
PNPATPMTS

SEQ ID NO: 1344602 - protein, 9 aa, Homo Sapiens
VDLTPTAPS

SEQ ID NO: 1344603 - protein, 9 aa, Homo Sapiens
LVTAEKCLH

SEQ ID NO: 1344604 - protein, 9 aa, Homo Sapiens
PSNAHFLTL

SEQ ID NO: 1344605 - protein, 9 aa, Homo Sapiens
NPQKGISVM

SEQ ID NO: 1344606 - protein, 9 aa, Homo Sapiens
TVLTGLRLG

SEQ ID NO: 1344607 - protein, 9 aa, Homo Sapiens
VELIQTFLP

SEQ ID NO: 1344608 - protein, 9 aa, Homo Sapiens
PNRYHYYQN

SEQ ID NO: 1344609 - protein, 9 aa, Homo Sapiens
NERAKVCLR

SEQ ID NO: 1344610 - protein, 9 aa, Homo Sapiens
SSVIFSLVK

SEQ ID NO: 1344611 - protein, 9 aa, Homo Sapiens
VAVSVIMMI

SEQ ID NO: 1344612 - protein, 9 aa, Homo Sapiens
LNFIYYRSA

SEQ ID NO: 1344613 - protein, 9 aa, Homo Sapiens
EWGTIGDDD

SEQ ID NO: 1344614 - protein, 9 aa, Homo Sapiens
CLLFRFYDI

SEQ ID NO: 1344615 - protein, 9 aa, Homo Sapiens
SISLTKASI

SEQ ID NO: 1344616 - protein, 9 aa, Homo Sapiens
GPWDVILKA

SEQ ID NO: 1344617 - protein, 9 aa, Homo Sapiens
IDGMEKCDD

SEQ ID NO: 1344618 - protein, 9 aa, Homo Sapiens
GSFQAWLRL

SEQ ID NO: 1344619 - protein, 9 aa, Homo Sapiens
LYIVMSACF

SEQ ID NO: 1344620 - protein, 9 aa, Homo Sapiens
AMSHKIGRI

SEQ ID NO: 1344621 - protein, 9 aa, Homo Sapiens
KTYTECRNA

SEQ ID NO: 1344622 - protein, 9 aa, Homo Sapiens
LDGHFLLPE

SEQ ID NO: 1344623 - protein, 9 aa, Homo Sapiens
FSLCMKSTL

SEQ ID NO: 1344624 - protein, 9 aa, Homo Sapiens
SLEVLLSNE

SEQ ID NO: 1344625 - protein, 9 aa, Homo Sapiens
RGFSHDDTL

SEQ ID NO: 1344626 - protein, 9 aa, Homo Sapiens
PGGKGTWQW

SEQ ID NO: 1344627 - protein, 9 aa, Homo Sapiens
LVEKVQMYR

SEQ ID NO: 1344628 - protein, 9 aa, Homo Sapiens
VRHVIFGDD

SEQ ID NO: 1344629 - protein, 9 aa, Homo Sapiens
IFSLGGSQG

SEQ ID NO: 1344630 - protein, 9 aa, Homo Sapiens
SEALTMLLQ

SEQ ID NO: 1344631 - protein, 9 aa, Homo Sapiens
QAFESYQLD

SEQ ID NO: 1344632 - protein, 9 aa, Homo Sapiens
SSASTDHTT

SEQ ID NO: 1344633 - protein, 9 aa, Homo Sapiens
IVIETGNRG

SEQ ID NO: 1344634 - protein, 9 aa, Homo Sapiens
QPEKQVSSS

SEQ ID NO: 1344635 - protein, 9 aa, Homo Sapiens
PHPCQMESG

SEQ ID NO: 1344636 - protein, 9 aa, Homo Sapiens
LAQELRALR

SEQ ID NO: 1344637 - protein, 9 aa, Homo Sapiens
EASQVGGTQ

SEQ ID NO: 1344638 - protein, 9 aa, Homo Sapiens
EKEVQEAKK

SEQ ID NO: 1344639 - protein, 9 aa, Homo Sapiens
SQIPPPLPT

SEQ ID NO: 1344640 - protein, 9 aa, Homo Sapiens
ARPSPGAPT

SEQ ID NO: 1344641 - protein, 9 aa, Homo Sapiens
HPPMGIPAL

SEQ ID NO: 1344642 - protein, 9 aa, Homo Sapiens
KIYVCIECG

SEQ ID NO: 1344643 - protein, 9 aa, Homo Sapiens
AHHHENSSR

SEQ ID NO: 1344644 - protein, 9 aa, Homo Sapiens
EESGSGFNP

SEQ ID NO: 1344645 - protein, 9 aa, Homo Sapiens
FYLLAAISY

SEQ ID NO: 1344646 - protein, 9 aa, Homo Sapiens
NPVISCRWW

SEQ ID NO: 1344647 - protein, 9 aa, Homo Sapiens
DLPYQFANS

SEQ ID NO: 1344648 - protein, 9 aa, Homo Sapiens
TDLTFKVAS

SEQ ID NO: 1344649 - protein, 9 aa, Homo Sapiens
AIQAASQAG

SEQ ID NO: 1344650 - protein, 9 aa, Homo Sapiens
NVTFLEEVT

SEQ ID NO: 1344651 - protein, 9 aa, Homo Sapiens
CDMYRILLS

SEQ ID NO: 1344652 - protein, 9 aa, Homo Sapiens
SLAELVVFI

SEQ ID NO: 1344653 - protein, 9 aa, Homo Sapiens
SLHGVSCWS

SEQ ID NO: 1344654 - protein, 9 aa, Homo Sapiens
QKEERCRVE

SEQ ID NO: 1344655 - protein, 9 aa, Homo Sapiens
NKPPLEDYY

SEQ ID NO: 1344656 - protein, 9 aa, Homo Sapiens
HFPSVALPA

SEQ ID NO: 1344657 - protein, 9 aa, Homo Sapiens
QPNMETDSS

SEQ ID NO: 1344658 - protein, 9 aa, Homo Sapiens
VRTGEKPFR

SEQ ID NO: 1344659 - protein, 9 aa, Homo Sapiens
CLRNDWEIV

SEQ ID NO: 1344660 - protein, 9 aa, Homo Sapiens
LAETVVKCD

SEQ ID NO: 1344661 - protein, 9 aa, Homo Sapiens
PPARHITIP

SEQ ID NO: 1344662 - protein, 9 aa, Homo Sapiens
GEKPHACTQ

SEQ ID NO: 1344663 - protein, 9 aa, Homo Sapiens
GPCTMESAP

SEQ ID NO: 1344664 - protein, 9 aa, Homo Sapiens
HSRTMILVV

SEQ ID NO: 1344665 - protein, 9 aa, Homo Sapiens
WREDDCWPV

SEQ ID NO: 1344666 - protein, 9 aa, Homo Sapiens
CCLGYTDHI

SEQ ID NO: 1344667 - protein, 9 aa, Homo Sapiens
QQDGDAAMY

SEQ ID NO: 1344668 - protein, 9 aa, Homo Sapiens
VIFLNTRHK

SEQ ID NO: 1344669 - protein, 9 aa, Homo Sapiens
KDDLVANME

SEQ ID NO: 1344670 - protein, 9 aa, Homo Sapiens
PPPGPLSQA

SEQ ID NO: 1344671 - protein, 9 aa, Homo Sapiens
FETPCDDIK

SEQ ID NO: 1344672 - protein, 9 aa, Homo Sapiens
PRTYYLEPL

SEQ ID NO: 1344673 - protein, 9 aa, Homo Sapiens
YQVNGKMIL

SEQ ID NO: 1344674 - protein, 9 aa, Homo Sapiens
TTAVTDPQY

SEQ ID NO: 1344675 - protein, 9 aa, Homo Sapiens
ILMFLLAIC

SEQ ID NO: 1344676 - protein, 9 aa, Homo Sapiens
ELKVASQKN

SEQ ID NO: 1344677 - protein, 9 aa, Homo Sapiens
LDRRARKTE

SEQ ID NO: 1344678 - protein, 9 aa, Homo Sapiens
TNKSRGFTF

SEQ ID NO: 1344679 - protein, 9 aa, Homo Sapiens
LQESSVRLK

SEQ ID NO: 1344680 - protein, 9 aa, Homo Sapiens
PVEPGCQAE

SEQ ID NO: 1344681 - protein, 9 aa, Homo Sapiens
TTIGYGHTA

SEQ ID NO: 1344682 - protein, 9 aa, Homo Sapiens
SLCIAVCIP

SEQ ID NO: 1344683 - protein, 9 aa, Homo Sapiens
NKKLFTVVT

SEQ ID NO: 1344684 - protein, 9 aa, Homo Sapiens
EAAKNGSPV

SEQ ID NO: 1344685 - protein, 9 aa, Homo Sapiens
FAATADPTA

SEQ ID NO: 1344686 - protein, 9 aa, Homo Sapiens
LMSMPNVLT

SEQ ID NO: 1344687 - protein, 9 aa, Homo Sapiens
NFYHMPFGF

SEQ ID NO: 1344688 - protein, 9 aa, Homo Sapiens
RWTNKENAK

SEQ ID NO: 1344689 - protein, 9 aa, Homo Sapiens
PVDQRKCEH

SEQ ID NO: 1344690 - protein, 9 aa, Homo Sapiens
MTPQSEPRE

SEQ ID NO: 1344691 - protein, 9 aa, Homo Sapiens
QRDYVFYLV

SEQ ID NO: 1344692 - protein, 9 aa, Homo Sapiens
MRRRSWQRR

SEQ ID NO: 1344693 - protein, 9 aa, Homo Sapiens
KWFLYKMHD

SEQ ID NO: 1344694 - protein, 9 aa, Homo Sapiens
GLAPGTNPP

SEQ ID NO: 1344695 - protein, 9 aa, Homo Sapiens
MSMPNVLTT

SEQ ID NO: 1344696 - protein, 9 aa, Homo Sapiens
VSHVQPGQY

SEQ ID NO: 1344697 - protein, 9 aa, Homo Sapiens
HDTRGCSPP

SEQ ID NO: 1344698 - protein, 9 aa, Homo Sapiens
DLNMALPVR

SEQ ID NO: 1344699 - protein, 9 aa, Homo Sapiens
PQGAHSPAH

SEQ ID NO: 1344700 - protein, 9 aa, Homo Sapiens
MLTGCGAGM

SEQ ID NO: 1344701 - protein, 9 aa, Homo Sapiens
ATVAGAMTE

SEQ ID NO: 1344702 - protein, 9 aa, Homo Sapiens
VTYPSVGAQ

SEQ ID NO: 1344703 - protein, 9 aa, Homo Sapiens
PGWFFKKNP

SEQ ID NO: 1344704 - protein, 9 aa, Homo Sapiens
ALFIPCMCH

SEQ ID NO: 1344705 - protein, 9 aa, Homo Sapiens
VDDLHLCTV

SEQ ID NO: 1344706 - protein, 9 aa, Homo Sapiens
AFAPFDKIS

SEQ ID NO: 1344707 - protein, 9 aa, Homo Sapiens
PLRQQILPV

SEQ ID NO: 1344708 - protein, 9 aa, Homo Sapiens
DLEVIKNPD

SEQ ID NO: 1344709 - protein, 9 aa, Homo Sapiens
RKQLSGQCF

SEQ ID NO: 1344710 - protein, 9 aa, Homo Sapiens
ELVPKYHPL

SEQ ID NO: 1344711 - protein, 9 aa, Homo Sapiens
GHHGPCIPD

SEQ ID NO: 1344712 - protein, 9 aa, Homo Sapiens
SEHGTPDSK

SEQ ID NO: 1344713 - protein, 9 aa, Homo Sapiens
DHYQHILQL

SEQ ID NO: 1344714 - protein, 9 aa, Homo Sapiens
IAADPRGID

SEQ ID NO: 1344715 - protein, 9 aa, Homo Sapiens
HKNICWGTQ

SEQ ID NO: 1344716 - protein, 9 aa, Homo Sapiens
KRLGRLLIL

SEQ ID NO: 1344717 - protein, 9 aa, Homo Sapiens
MLQGQQQAA

SEQ ID NO: 1344718 - protein, 9 aa, Homo Sapiens
TTKSSKNQG

SEQ ID NO: 1344719 - protein, 9 aa, Homo Sapiens
FSDSLRWDV

SEQ ID NO: 1344720 - protein, 9 aa, Homo Sapiens
PTSQSYSYH

SEQ ID NO: 1344721 - protein, 9 aa, Homo Sapiens
VRSHFDALF

SEQ ID NO: 1344722 - protein, 9 aa, Homo Sapiens
QATIMSPND

SEQ ID NO: 1344723 - protein, 9 aa, Homo Sapiens
NICVVDCRA

SEQ ID NO: 1344724 - protein, 9 aa, Homo Sapiens
NIDDLKRIN

SEQ ID NO: 1344725 - protein, 9 aa, Homo Sapiens
DWRDDQCPA

SEQ ID NO: 1344726 - protein, 9 aa, Homo Sapiens
VIHSNINGK

SEQ ID NO: 1344727 - protein, 9 aa, Homo Sapiens
NGTGPLKDM

SEQ ID NO: 1344728 - protein, 9 aa, Homo Sapiens
LGRLEAKEG

SEQ ID NO: 1344729 - protein, 9 aa, Homo Sapiens
EKAQLKTGK

SEQ ID NO: 1344730 - protein, 9 aa, Homo Sapiens
CLWLHEAQR

SEQ ID NO: 1344731 - protein, 9 aa, Homo Sapiens
NNSHMILRK

SEQ ID NO: 1344732 - protein, 9 aa, Homo Sapiens
PGHPDTPPN

SEQ ID NO: 1344733 - protein, 9 aa, Homo Sapiens
SHWILSHTV

SEQ ID NO: 1344734 - protein, 9 aa, Homo Sapiens
SIFLFVFLL

SEQ ID NO: 1344735 - protein, 9 aa, Homo Sapiens
MSPGRHKSE

SEQ ID NO: 1344736 - protein, 9 aa, Homo Sapiens
STVTSNAFL

SEQ ID NO: 1344737 - protein, 9 aa, Homo Sapiens
KCSLTLRDD

SEQ ID NO: 1344738 - protein, 9 aa, Homo Sapiens
LLCKHQVVV

SEQ ID NO: 1344739 - protein, 9 aa, Homo Sapiens
TAEKLCKSE

SEQ ID NO: 1344740 - protein, 9 aa, Homo Sapiens
RCGVEPKPE

SEQ ID NO: 1344741 - protein, 9 aa, Homo Sapiens
LLKNMQSLW

SEQ ID NO: 1344742 - protein, 9 aa, Homo Sapiens
PTASAGASL

SEQ ID NO: 1344743 - protein, 9 aa, Homo Sapiens
QRPLVIISD

SEQ ID NO: 1344744 - protein, 9 aa, Homo Sapiens
VGIRQDGSQ

SEQ ID NO: 1344745 - protein, 9 aa, Homo Sapiens
HPSYLYNHH

SEQ ID NO: 1344746 - protein, 9 aa, Homo Sapiens
VLRAGHQHN

SEQ ID NO: 1344747 - protein, 9 aa, Homo Sapiens
VYVIAFNNP

SEQ ID NO: 1344748 - protein, 9 aa, Homo Sapiens
KYLYRSVML

SEQ ID NO: 1344749 - protein, 9 aa, Homo Sapiens
LKDDRQHMW

SEQ ID NO: 1344750 - protein, 9 aa, Homo Sapiens
VSGSLPFDD

SEQ ID NO: 1344751 - protein, 9 aa, Homo Sapiens
PQQEISVVH

SEQ ID NO: 1344752 - protein, 9 aa, Homo Sapiens
MRVHTGEKL

SEQ ID NO: 1344753 - protein, 9 aa, Homo Sapiens
FLIFGETNQ

SEQ ID NO: 1344754 - protein, 9 aa, Homo Sapiens
QSAFLHHIR

SEQ ID NO: 1344755 - protein, 9 aa, Homo Sapiens
NTGEKKMPH

SEQ ID NO: 1344756 - protein, 9 aa, Homo Sapiens
MTLAQEPSM

SEQ ID NO: 1344757 - protein, 9 aa, Homo Sapiens
TMIMQRVSL

SEQ ID NO: 1344758 - protein, 9 aa, Homo Sapiens
SSNVEVFIL

SEQ ID NO: 1344759 - protein, 9 aa, Homo Sapiens
RREAREEKI

SEQ ID NO: 1344760 - protein, 9 aa, Homo Sapiens
IRNPSIQKL

SEQ ID NO: 1344761 - protein, 9 aa, Homo Sapiens
KQKGCVASQ

SEQ ID NO: 1344762 - protein, 9 aa, Homo Sapiens
VGLPAEVYI

SEQ ID NO: 1344763 - protein, 9 aa, Homo Sapiens
HIIFTIEGL

SEQ ID NO: 1344764 - protein, 9 aa, Homo Sapiens
LNRLDQHEQ

SEQ ID NO: 1344765 - protein, 9 aa, Homo Sapiens
EDGEKEVRL

SEQ ID NO: 1344766 - protein, 9 aa, Homo Sapiens
NFTMTRTMV

SEQ ID NO: 1344767 - protein, 9 aa, Homo Sapiens
YVIDCHYPY

SEQ ID NO: 1344768 - protein, 9 aa, Homo Sapiens
PPRDESLNS

SEQ ID NO: 1344769 - protein, 9 aa, Homo Sapiens
LGRDTEGTE

SEQ ID NO: 1344770 - protein, 9 aa, Homo Sapiens
HRPGSGQHD

SEQ ID NO: 1344771 - protein, 9 aa, Homo Sapiens
INSQLVTQQ

SEQ ID NO: 1344772 - protein, 9 aa, Homo Sapiens
ENNTGYINT

SEQ ID NO: 1344773 - protein, 9 aa, Homo Sapiens
PDDWYGHRL

SEQ ID NO: 1344774 - protein, 9 aa, Homo Sapiens
LWRPTAIRQ

SEQ ID NO: 1344775 - protein, 9 aa, Homo Sapiens
PRKMRHMYN

SEQ ID NO: 1344776 - protein, 9 aa, Homo Sapiens
NLCQDMWWY

SEQ ID NO: 1344777 - protein, 9 aa, Homo Sapiens
RFTLPVPSF

SEQ ID NO: 1344778 - protein, 9 aa, Homo Sapiens
DTEMKSDNV

SEQ ID NO: 1344779 - protein, 9 aa, Homo Sapiens
GRPDGLHPL

SEQ ID NO: 1344780 - protein, 9 aa, Homo Sapiens
ESLNSLLQG

SEQ ID NO: 1344781 - protein, 9 aa, Homo Sapiens
LKAAGQSTT

SEQ ID NO: 1344782 - protein, 9 aa, Homo Sapiens
TLIQLPELY

SEQ ID NO: 1344783 - protein, 9 aa, Homo Sapiens
KPNNIKKNR

SEQ ID NO: 1344784 - protein, 9 aa, Homo Sapiens
KFVATMYHC

SEQ ID NO: 1344785 - protein, 9 aa, Homo Sapiens
FVEYHKIKA

SEQ ID NO: 1344786 - protein, 9 aa, Homo Sapiens
SPRPQGQHW

SEQ ID NO: 1344787 - protein, 9 aa, Homo Sapiens
HESIDTMSH

SEQ ID NO: 1344788 - protein, 9 aa, Homo Sapiens
VLRAYPIQV

SEQ ID NO: 1344789 - protein, 9 aa, Homo Sapiens
DASDELASC

SEQ ID NO: 1344790 - protein, 9 aa, Homo Sapiens
MLLAKHLQE

SEQ ID NO: 1344791 - protein, 9 aa, Homo Sapiens
NETADLPYQ

SEQ ID NO: 1344792 - protein, 9 aa, Homo Sapiens
EEKHITFTP

SEQ ID NO: 1344793 - protein, 9 aa, Homo Sapiens
RAVGFEAHY

SEQ ID NO: 1344794 - protein, 9 aa, Homo Sapiens
IVADNCDET

SEQ ID NO: 1344795 - protein, 9 aa, Homo Sapiens
KRQCLSHSV

SEQ ID NO: 1344796 - protein, 9 aa, Homo Sapiens
NNCSWFMHC

SEQ ID NO: 1344797 - protein, 9 aa, Homo Sapiens
IWVIQVQLR

SEQ ID NO: 1344798 - protein, 9 aa, Homo Sapiens
SIKYYLDNG

SEQ ID NO: 1344799 - protein, 9 aa, Homo Sapiens
MFSYAGWMQ

SEQ ID NO: 1344800 - protein, 9 aa, Homo Sapiens
YSQDMPMRS

SEQ ID NO: 1344801 - protein, 9 aa, Homo Sapiens
APLQVTTTL

SEQ ID NO: 1344802 - protein, 9 aa, Homo Sapiens
GRPRSMLCS

SEQ ID NO: 1344803 - protein, 9 aa, Homo Sapiens
ALWKEKEAF

SEQ ID NO: 1344804 - protein, 9 aa, Homo Sapiens
FWMWINHFV

SEQ ID NO: 1344805 - protein, 9 aa, Homo Sapiens
TLPEDLVRM

SEQ ID NO: 1344806 - protein, 9 aa, Homo Sapiens
LGLDGTFVP

SEQ ID NO: 1344807 - protein, 9 aa, Homo Sapiens
RYTTLNQHK

SEQ ID NO: 1344808 - protein, 9 aa, Homo Sapiens
VLVCAGYEA

SEQ ID NO: 1344809 - protein, 9 aa, Homo Sapiens
CPKGFTRFR

SEQ ID NO: 1344810 - protein, 9 aa, Homo Sapiens
NQPLPSNTL

SEQ ID NO: 1344811 - protein, 9 aa, Homo Sapiens
EQLWRTAMR

SEQ ID NO: 1344812 - protein, 9 aa, Homo Sapiens
VDSKTYADA

SEQ ID NO: 1344813 - protein, 9 aa, Homo Sapiens
VRFFANPVS

SEQ ID NO: 1344814 - protein, 9 aa, Homo Sapiens
TQEYMLKPK

SEQ ID NO: 1344815 - protein, 9 aa, Homo Sapiens
KPHSLRFTW

SEQ ID NO: 1344816 - protein, 9 aa, Homo Sapiens
NTAQQNKLK

SEQ ID NO: 1344817 - protein, 9 aa, Homo Sapiens
PLLERVTVS

SEQ ID NO: 1344818 - protein, 9 aa, Homo Sapiens
VFVWPISSW

SEQ ID NO: 1344819 - protein, 9 aa, Homo Sapiens
RELLGGPKP

SEQ ID NO: 1344820 - protein, 9 aa, Homo Sapiens
PEIVSTVHA

SEQ ID NO: 1344821 - protein, 9 aa, Homo Sapiens
DLTFKVASR

SEQ ID NO: 1344822 - protein, 9 aa, Homo Sapiens
RLQRCLSQA

SEQ ID NO: 1344823 - protein, 9 aa, Homo Sapiens
LSSTGTYMS

SEQ ID NO: 1344824 - protein, 9 aa, Homo Sapiens
MSGYTIYNT

SEQ ID NO: 1344825 - protein, 9 aa, Homo Sapiens
EDKFSDTEG

SEQ ID NO: 1344826 - protein, 9 aa, Homo Sapiens
GGGQKPGGN

SEQ ID NO: 1344827 - protein, 9 aa, Homo Sapiens
LLADLDPVV

SEQ ID NO: 1344828 - protein, 9 aa, Homo Sapiens
YQEARGVTM

SEQ ID NO: 1344829 - protein, 9 aa, Homo Sapiens
KSHQFPCHW

SEQ ID NO: 1344830 - protein, 9 aa, Homo Sapiens
WTRLQQLLL

SEQ ID NO: 1344831 - protein, 9 aa, Homo Sapiens
AFPSPQGPL

SEQ ID NO: 1344832 - protein, 9 aa, Homo Sapiens
PEWRTALGV

SEQ ID NO: 1344833 - protein, 9 aa, Homo Sapiens
DEQTRITLQ

SEQ ID NO: 1344834 - protein, 9 aa, Homo Sapiens
RVTSYQMPL

SEQ ID NO: 1344835 - protein, 9 aa, Homo Sapiens
LIFLHSADH

SEQ ID NO: 1344836 - protein, 9 aa, Homo Sapiens
YGDPHMIDY

SEQ ID NO: 1344837 - protein, 9 aa, Homo Sapiens
FLCAWDFNI

SEQ ID NO: 1344838 - protein, 9 aa, Homo Sapiens
GALFREGDM

SEQ ID NO: 1344839 - protein, 9 aa, Homo Sapiens
VSTLLGDIV

SEQ ID NO: 1344840 - protein, 9 aa, Homo Sapiens
EKCILQAVN

SEQ ID NO: 1344841 - protein, 9 aa, Homo Sapiens
IACDGDKES

SEQ ID NO: 1344842 - protein, 9 aa, Homo Sapiens
PSSDINIIP

SEQ ID NO: 1344843 - protein, 9 aa, Homo Sapiens
KTHWYSGET

SEQ ID NO: 1344844 - protein, 9 aa, Homo Sapiens
YKHATFVDG

SEQ ID NO: 1344845 - protein, 9 aa, Homo Sapiens
KNYSIAQKC

SEQ ID NO: 1344846 - protein, 9 aa, Homo Sapiens
DTGRYECVA

SEQ ID NO: 1344847 - protein, 9 aa, Homo Sapiens
APHVDGERS

SEQ ID NO: 1344848 - protein, 9 aa, Homo Sapiens
GHMLGMQHD

SEQ ID NO: 1344849 - protein, 9 aa, Homo Sapiens
TEIIIVVNQ

SEQ ID NO: 1344850 - protein, 9 aa, Homo Sapiens
KRFTRVEMD

SEQ ID NO: 1344851 - protein, 9 aa, Homo Sapiens
LTQQWVVFP

SEQ ID NO: 1344852 - protein, 9 aa, Homo Sapiens
GSSSDSSTS

SEQ ID NO: 1344853 - protein, 9 aa, Homo Sapiens
KELHSMLME

SEQ ID NO: 1344854 - protein, 9 aa, Homo Sapiens
PFPAHVVPA

SEQ ID NO: 1344855 - protein, 9 aa, Homo Sapiens
FISLIRGGR

SEQ ID NO: 1344856 - protein, 9 aa, Homo Sapiens
VNDNTPAFA

SEQ ID NO: 1344857 - protein, 9 aa, Homo Sapiens
DDKNEEHED

SEQ ID NO: 1344858 - protein, 9 aa, Homo Sapiens
MVRFTSLFD

SEQ ID NO: 1344859 - protein, 9 aa, Homo Sapiens
TVFQILTDE

SEQ ID NO: 1344860 - protein, 9 aa, Homo Sapiens
THVPWLLAH

SEQ ID NO: 1344861 - protein, 9 aa, Homo Sapiens
AQVFAFLKG

SEQ ID NO: 1344862 - protein, 9 aa, Homo Sapiens
NGDNDHITV

SEQ ID NO: 1344863 - protein, 9 aa, Homo Sapiens
NQLAMGNSS

SEQ ID NO: 1344864 - protein, 9 aa, Homo Sapiens
LRGRLRAQG

SEQ ID NO: 1344865 - protein, 9 aa, Homo Sapiens
RHDKVTFVF

SEQ ID NO: 1344866 - protein, 9 aa, Homo Sapiens
LRVGHPNHN

SEQ ID NO: 1344867 - protein, 9 aa, Homo Sapiens
VRAKIRNLA

SEQ ID NO: 1344868 - protein, 9 aa, Homo Sapiens
GLFLQCTIS

SEQ ID NO: 1344869 - protein, 9 aa, Homo Sapiens
KDAAEMLGT

SEQ ID NO: 1344870 - protein, 9 aa, Homo Sapiens
KCPTPCQMT

SEQ ID NO: 1344871 - protein, 9 aa, Homo Sapiens
NTYLCQRAR

SEQ ID NO: 1344872 - protein, 9 aa, Homo Sapiens
TAEMERCLA

SEQ ID NO: 1344873 - protein, 9 aa, Homo Sapiens
RKLYECKEY

SEQ ID NO: 1344874 - protein, 9 aa, Homo Sapiens
QVYMADLGS

SEQ ID NO: 1344875 - protein, 9 aa, Homo Sapiens
YLDLLPCHP

SEQ ID NO: 1344876 - protein, 9 aa, Homo Sapiens
RKQLMIYEE

SEQ ID NO: 1344877 - protein, 9 aa, Homo Sapiens
ITDVAFCMG

SEQ ID NO: 1344878 - protein, 9 aa, Homo Sapiens
AWYGNQNPV

SEQ ID NO: 1344879 - protein, 9 aa, Homo Sapiens
DDACKLMRE

SEQ ID NO: 1344880 - protein, 9 aa, Homo Sapiens
AEERYNDLK

SEQ ID NO: 1344881 - protein, 9 aa, Homo Sapiens
EPSHLVRES

SEQ ID NO: 1344882 - protein, 9 aa, Homo Sapiens
SAASAGRPS

SEQ ID NO: 1344883 - protein, 9 aa, Homo Sapiens
KCRIRKCIR

SEQ ID NO: 1344884 - protein, 9 aa, Homo Sapiens
SYKQHSSLE

SEQ ID NO: 1344885 - protein, 9 aa, Homo Sapiens
LPGMGPHVP

SEQ ID NO: 1344886 - protein, 9 aa, Homo Sapiens
HADSAHQDA

SEQ ID NO: 1344887 - protein, 9 aa, Homo Sapiens
RQQPQGQGE

SEQ ID NO: 1344888 - protein, 9 aa, Homo Sapiens
KQHSSLEEH

SEQ ID NO: 1344889 - protein, 9 aa, Homo Sapiens
WISGGGRGA

SEQ ID NO: 1344890 - protein, 9 aa, Homo Sapiens
TDSNEQISV

SEQ ID NO: 1344891 - protein, 9 aa, Homo Sapiens
LINVCTKDM

SEQ ID NO: 1344892 - protein, 9 aa, Homo Sapiens
ILCLLFRFY

SEQ ID NO: 1344893 - protein, 9 aa, Homo Sapiens
KRKKQICIQ

SEQ ID NO: 1344894 - protein, 9 aa, Homo Sapiens
DKNLRWRKA

SEQ ID NO: 1344895 - protein, 9 aa, Homo Sapiens
YERELSEIR

SEQ ID NO: 1344896 - protein, 9 aa, Homo Sapiens
GVCYGADHD

SEQ ID NO: 1344897 - protein, 9 aa, Homo Sapiens
NVTLYQQLK

SEQ ID NO: 1344898 - protein, 9 aa, Homo Sapiens
QDASVACQN

SEQ ID NO: 1344899 - protein, 9 aa, Homo Sapiens
DGPDDKNEE

SEQ ID NO: 1344900 - protein, 9 aa, Homo Sapiens
HPKSLPSEC

SEQ ID NO: 1344901 - protein, 9 aa, Homo Sapiens
ACWVQGMLD

SEQ ID NO: 1344902 - protein, 9 aa, Homo Sapiens
PEQQVGHPK

SEQ ID NO: 1344903 - protein, 9 aa, Homo Sapiens
PQPAVSEAF

SEQ ID NO: 1344904 - protein, 9 aa, Homo Sapiens
PLSCDSAQI

SEQ ID NO: 1344905 - protein, 9 aa, Homo Sapiens
VVPSALQLR

SEQ ID NO: 1344906 - protein, 9 aa, Homo Sapiens
IQGGLLPLV

SEQ ID NO: 1344907 - protein, 9 aa, Homo Sapiens
ELRQHKFYL

SEQ ID NO: 1344908 - protein, 9 aa, Homo Sapiens
TANPHIGDV

SEQ ID NO: 1344909 - protein, 9 aa, Homo Sapiens
PLCMLRLGQ

SEQ ID NO: 1344910 - protein, 9 aa, Homo Sapiens
YEAFRTPAM

SEQ ID NO: 1344911 - protein, 9 aa, Homo Sapiens
FEVLMVRFT

SEQ ID NO: 1344912 - protein, 9 aa, Homo Sapiens
GGTFMFPYF

SEQ ID NO: 1344913 - protein, 9 aa, Homo Sapiens
SSMNRLTDA

SEQ ID NO: 1344914 - protein, 9 aa, Homo Sapiens
GYRTASIII

SEQ ID NO: 1344915 - protein, 9 aa, Homo Sapiens
LVMLEIVTE

SEQ ID NO: 1344916 - protein, 9 aa, Homo Sapiens
CVFDSANVA

SEQ ID NO: 1344917 - protein, 9 aa, Homo Sapiens
STLKFFHSL

SEQ ID NO: 1344918 - protein, 9 aa, Homo Sapiens
PGAQVFVVE

SEQ ID NO: 1344919 - protein, 9 aa, Homo Sapiens
HWQATIMSP

SEQ ID NO: 1344920 - protein, 9 aa, Homo Sapiens
ELLHLWQPQ

SEQ ID NO: 1344921 - protein, 9 aa, Homo Sapiens
PTDHYHVQP

SEQ ID NO: 1344922 - protein, 9 aa, Homo Sapiens
KLSEDHNGK

SEQ ID NO: 1344923 - protein, 9 aa, Homo Sapiens
INLYVDSDS

SEQ ID NO: 1344924 - protein, 9 aa, Homo Sapiens
VAEKPNNIK

SEQ ID NO: 1344925 - protein, 9 aa, Homo Sapiens
THSRSRSRR

SEQ ID NO: 1344926 - protein, 9 aa, Homo Sapiens
PSPATHPSP

SEQ ID NO: 1344927 - protein, 9 aa, Homo Sapiens
LKLRRTRHY

SEQ ID NO: 1344928 - protein, 9 aa, Homo Sapiens
RGLMNGYWG

SEQ ID NO: 1344929 - protein, 9 aa, Homo Sapiens
WGYSEAAKN

SEQ ID NO: 1344930 - protein, 9 aa, Homo Sapiens
CWCCKRYGH

SEQ ID NO: 1344931 - protein, 9 aa, Homo Sapiens
PVSCHDIRK

SEQ ID NO: 1344932 - protein, 9 aa, Homo Sapiens
FNMRVPLPG

SEQ ID NO: 1344933 - protein, 9 aa, Homo Sapiens
LQVLYQACE

SEQ ID NO: 1344934 - protein, 9 aa, Homo Sapiens
IRCPLQIIL

SEQ ID NO: 1344935 - protein, 9 aa, Homo Sapiens
SDPITDKPY

SEQ ID NO: 1344936 - protein, 9 aa, Homo Sapiens
ARAGSTFLN

SEQ ID NO: 1344937 - protein, 9 aa, Homo Sapiens
AVIHYLYLC

SEQ ID NO: 1344938 - protein, 9 aa, Homo Sapiens
ERQLHEAAH

SEQ ID NO: 1344939 - protein, 9 aa, Homo Sapiens
QSTTDTSTD

SEQ ID NO: 1344940 - protein, 9 aa, Homo Sapiens
FDRFMAICN

SEQ ID NO: 1344941 - protein, 9 aa, Homo Sapiens
VQQRLTEPQ

SEQ ID NO: 1344942 - protein, 9 aa, Homo Sapiens
DKDFNMKQY

SEQ ID NO: 1344943 - protein, 9 aa, Homo Sapiens
VFPKTNVTS

SEQ ID NO: 1344944 - protein, 9 aa, Homo Sapiens
LRGHVAVWG

SEQ ID NO: 1344945 - protein, 9 aa, Homo Sapiens
KIMALMDTY

SEQ ID NO: 1344946 - protein, 9 aa, Homo Sapiens
DGKWRDYDQ

SEQ ID NO: 1344947 - protein, 9 aa, Homo Sapiens
SVMPAPPEG

SEQ ID NO: 1344948 - protein, 9 aa, Homo Sapiens
CPCMTLAQE

SEQ ID NO: 1344949 - protein, 9 aa, Homo Sapiens
YHFKIFCPI

SEQ ID NO: 1344950 - protein, 9 aa, Homo Sapiens
CNHPVSFVK

SEQ ID NO: 1344951 - protein, 9 aa, Homo Sapiens
ISSWTCLAD

SEQ ID NO: 1344952 - protein, 9 aa, Homo Sapiens
INTLGIGLS

SEQ ID NO: 1344953 - protein, 9 aa, Homo Sapiens
VCKQLTGQA

SEQ ID NO: 1344954 - protein, 9 aa, Homo Sapiens
RCVAAHESI

SEQ ID NO: 1344955 - protein, 9 aa, Homo Sapiens
CIPHPEVPR

SEQ ID NO: 1344956 - protein, 9 aa, Homo Sapiens
GMAFITFQE

SEQ ID NO: 1344957 - protein, 9 aa, Homo Sapiens
VIRHTMNLE

SEQ ID NO: 1344958 - protein, 9 aa, Homo Sapiens
DYGFYLRAG

SEQ ID NO: 1344959 - protein, 9 aa, Homo Sapiens
WRTALGVIF

SEQ ID NO: 1344960 - protein, 9 aa, Homo Sapiens
RGSGNTPKL

SEQ ID NO: 1344961 - protein, 9 aa, Homo Sapiens
ISPLLPSPP

SEQ ID NO: 1344962 - protein, 9 aa, Homo Sapiens
PDTVAYACN

SEQ ID NO: 1344963 - protein, 9 aa, Homo Sapiens
KGTEVPWPE

SEQ ID NO: 1344964 - protein, 9 aa, Homo Sapiens
LGLTMGTTE

SEQ ID NO: 1344965 - protein, 9 aa, Homo Sapiens
YNQVQTCSA

SEQ ID NO: 1344966 - protein, 9 aa, Homo Sapiens
IDDVLGITK

SEQ ID NO: 1344967 - protein, 9 aa, Homo Sapiens
FYECVLSRM

SEQ ID NO: 1344968 - protein, 9 aa, Homo Sapiens
GRRITELEM

SEQ ID NO: 1344969 - protein, 9 aa, Homo Sapiens
LRGSREHVY

SEQ ID NO: 1344970 - protein, 9 aa, Homo Sapiens
AKVCLRRLW

SEQ ID NO: 1344971 - protein, 9 aa, Homo Sapiens
ENDKAKLSF

SEQ ID NO: 1344972 - protein, 9 aa, Homo Sapiens
YGLSVSPMN

SEQ ID NO: 1344973 - protein, 9 aa, Homo Sapiens
MDGILFGGI

SEQ ID NO: 1344974 - protein, 9 aa, Homo Sapiens
TDVKDTKVI

SEQ ID NO: 1344975 - protein, 9 aa, Homo Sapiens
AITYLLGLI

SEQ ID NO: 1344976 - protein, 9 aa, Homo Sapiens
HILKEDMLK

SEQ ID NO: 1344977 - protein, 9 aa, Homo Sapiens
ADSSYLLHH

SEQ ID NO: 1344978 - protein, 9 aa, Homo Sapiens
RHAAHRPLC

SEQ ID NO: 1344979 - protein, 9 aa, Homo Sapiens
VPSSPEPPV

SEQ ID NO: 1344980 - protein, 9 aa, Homo Sapiens
TLSRFFSYF

SEQ ID NO: 1344981 - protein, 9 aa, Homo Sapiens
ALDPSGWPV

SEQ ID NO: 1344982 - protein, 9 aa, Homo Sapiens
ADQEQVSPT

SEQ ID NO: 1344983 - protein, 9 aa, Homo Sapiens
VAECPCGPS

SEQ ID NO: 1344984 - protein, 9 aa, Homo Sapiens
QVKEALMWY

SEQ ID NO: 1344985 - protein, 9 aa, Homo Sapiens
QVFKNDATE

SEQ ID NO: 1344986 - protein, 9 aa, Homo Sapiens
LHIPPAYTK

SEQ ID NO: 1344987 - protein, 9 aa, Homo Sapiens
RRMVPSNAH

SEQ ID NO: 1344988 - protein, 9 aa, Homo Sapiens
VAVKDSCGK

SEQ ID NO: 1344989 - protein, 9 aa, Homo Sapiens
VMARTKMKH

SEQ ID NO: 1344990 - protein, 9 aa, Homo Sapiens
TIPTRAITA

SEQ ID NO: 1344991 - protein, 9 aa, Homo Sapiens
NNSPQELCM

SEQ ID NO: 1344992 - protein, 9 aa, Homo Sapiens
AEIEVDKVF

SEQ ID NO: 1344993 - protein, 9 aa, Homo Sapiens
PRCVCSTAR

SEQ ID NO: 1344994 - protein, 9 aa, Homo Sapiens
VAEVSGYLG

SEQ ID NO: 1344995 - protein, 9 aa, Homo Sapiens
MAEEEWRLH

SEQ ID NO: 1344996 - protein, 9 aa, Homo Sapiens
AQEPSMTSV

SEQ ID NO: 1344997 - protein, 9 aa, Homo Sapiens
VGFIFFQCL

SEQ ID NO: 1344998 - protein, 9 aa, Homo Sapiens
DDIMEEKPL

SEQ ID NO: 1344999 - protein, 9 aa, Homo Sapiens
FPVFHDMSV

SEQ ID NO: 1345000 - protein, 9 aa, Homo Sapiens
YMLLITIAI

SEQ ID NO: 1345001 - protein, 9 aa, Homo Sapiens
VCPKKIHIL

SEQ ID NO: 1345002 - protein, 9 aa, Homo Sapiens
EQKEKIWEQ

SEQ ID NO: 1345003 - protein, 9 aa, Homo Sapiens
TQLSDLTDH

SEQ ID NO: 1345004 - protein, 9 aa, Homo Sapiens
HHQHHHFQN

SEQ ID NO: 1345005 - protein, 9 aa, Homo Sapiens
ILNSLLLFG

SEQ ID NO: 1345006 - protein, 9 aa, Homo Sapiens
SAEEVASVL

SEQ ID NO: 1345007 - protein, 9 aa, Homo Sapiens
PGFPGIKGK

SEQ ID NO: 1345008 - protein, 9 aa, Homo Sapiens
LYINCIACY

SEQ ID NO: 1345009 - protein, 9 aa, Homo Sapiens
ADDISRHET

SEQ ID NO: 1345010 - protein, 9 aa, Homo Sapiens
EPSAHISAA

SEQ ID NO: 1345011 - protein, 9 aa, Homo Sapiens
FHAVKNTVG

SEQ ID NO: 1345012 - protein, 9 aa, Homo Sapiens
FKANRSFLV

SEQ ID NO: 1345013 - protein, 9 aa, Homo Sapiens
LISDVVMFI

SEQ ID NO: 1345014 - protein, 9 aa, Homo Sapiens
QSSGHSGSS

SEQ ID NO: 1345015 - protein, 9 aa, Homo Sapiens
YVVMVIDRI

SEQ ID NO: 1345016 - protein, 9 aa, Homo Sapiens
SGPHRQLNF

SEQ ID NO: 1345017 - protein, 9 aa, Homo Sapiens
MLQLSLHRL

SEQ ID NO: 1345018 - protein, 9 aa, Homo Sapiens
MTTFFTENS

SEQ ID NO: 1345019 - protein, 9 aa, Homo Sapiens
CTCGCTPAR

SEQ ID NO: 1345020 - protein, 9 aa, Homo Sapiens
GSGGGGGDT

SEQ ID NO: 1345021 - protein, 9 aa, Homo Sapiens
LRFISSRQT

SEQ ID NO: 1345022 - protein, 9 aa, Homo Sapiens
TCGAAPSTV

SEQ ID NO: 1345023 - protein, 9 aa, Homo Sapiens
TPEQGLSTF

SEQ ID NO: 1345024 - protein, 9 aa, Homo Sapiens
SLSDPSTEF

SEQ ID NO: 1345025 - protein, 9 aa, Homo Sapiens
ENMDVAFLV

SEQ ID NO: 1345026 - protein, 9 aa, Homo Sapiens
KSNCMQTTI

SEQ ID NO: 1345027 - protein, 9 aa, Homo Sapiens
YALPHAIMH

SEQ ID NO: 1345028 - protein, 9 aa, Homo Sapiens
PIMFSPEHP

SEQ ID NO: 1345029 - protein, 9 aa, Homo Sapiens
GKMNLNWPQ

SEQ ID NO: 1345030 - protein, 9 aa, Homo Sapiens
NVSSVRQEN

SEQ ID NO: 1345031 - protein, 9 aa, Homo Sapiens
VIVRNVEDI

SEQ ID NO: 1345032 - protein, 9 aa, Homo Sapiens
TIDLSQMTV

SEQ ID NO: 1345033 - protein, 9 aa, Homo Sapiens
LEKTFAEAH

SEQ ID NO: 1345034 - protein, 9 aa, Homo Sapiens
IVSTQRSQD

SEQ ID NO: 1345035 - protein, 9 aa, Homo Sapiens
DIMCGGVQC

SEQ ID NO: 1345036 - protein, 9 aa, Homo Sapiens
VVRRTQHYL

SEQ ID NO: 1345037 - protein, 9 aa, Homo Sapiens
WVLLNQCRG

SEQ ID NO: 1345038 - protein, 9 aa, Homo Sapiens
DFKDALTRV

SEQ ID NO: 1345039 - protein, 9 aa, Homo Sapiens
RKVGVPKGG

SEQ ID NO: 1345040 - protein, 9 aa, Homo Sapiens
VMVIDRIFL

SEQ ID NO: 1345041 - protein, 9 aa, Homo Sapiens
WNSHASWVT

SEQ ID NO: 1345042 - protein, 9 aa, Homo Sapiens
QQGFRHVSH

SEQ ID NO: 1345043 - protein, 9 aa, Homo Sapiens
RPRPRTYYL

SEQ ID NO: 1345044 - protein, 9 aa, Homo Sapiens
KLSGGQKVR

SEQ ID NO: 1345045 - protein, 9 aa, Homo Sapiens
NDNTPVFTL

SEQ ID NO: 1345046 - protein, 9 aa, Homo Sapiens
VTQTLDREV

SEQ ID NO: 1345047 - protein, 9 aa, Homo Sapiens
TVPIQMTQE

SEQ ID NO: 1345048 - protein, 9 aa, Homo Sapiens
HAGGVTCGW

SEQ ID NO: 1345049 - protein, 9 aa, Homo Sapiens
VTTLDGHSG

SEQ ID NO: 1345050 - protein, 9 aa, Homo Sapiens
CTNKNLFKV

SEQ ID NO: 1345051 - protein, 9 aa, Homo Sapiens
VGRYKGHRP

SEQ ID NO: 1345052 - protein, 9 aa, Homo Sapiens
QCRALTQVC

SEQ ID NO: 1345053 - protein, 9 aa, Homo Sapiens
LKDYMCQAG

SEQ ID NO: 1345054 - protein, 9 aa, Homo Sapiens
RDDDASNLV

SEQ ID NO: 1345055 - protein, 9 aa, Homo Sapiens
FCDSAQAAN

SEQ ID NO: 1345056 - protein, 9 aa, Homo Sapiens
AQVGPLPCV

SEQ ID NO: 1345057 - protein, 9 aa, Homo Sapiens
LRNATHEQT

SEQ ID NO: 1345058 - protein, 9 aa, Homo Sapiens
MQVEDECRH

SEQ ID NO: 1345059 - protein, 9 aa, Homo Sapiens
YTQAVFLEV

SEQ ID NO: 1345060 - protein, 9 aa, Homo Sapiens
FILFFPSAL

SEQ ID NO: 1345061 - protein, 9 aa, Homo Sapiens
VPVSEPNTH

SEQ ID NO: 1345062 - protein, 9 aa, Homo Sapiens
HSHHTILYP

SEQ ID NO: 1345063 - protein, 9 aa, Homo Sapiens
RYIKINQSI

SEQ ID NO: 1345064 - protein, 9 aa, Homo Sapiens
PSPVEEHCG

SEQ ID NO: 1345065 - protein, 9 aa, Homo Sapiens
IITTLLMLN

SEQ ID NO: 1345066 - protein, 9 aa, Homo Sapiens
IVMTDLKDA

SEQ ID NO: 1345067 - protein, 9 aa, Homo Sapiens
ITFQEKSMA

SEQ ID NO: 1345068 - protein, 9 aa, Homo Sapiens
MAATGEQHS

SEQ ID NO: 1345069 - protein, 9 aa, Homo Sapiens
SGHHEQDTE

SEQ ID NO: 1345070 - protein, 9 aa, Homo Sapiens
VFLILCLPF

SEQ ID NO: 1345071 - protein, 9 aa, Homo Sapiens
HVLWIWRYQ

SEQ ID NO: 1345072 - protein, 9 aa, Homo Sapiens
RAAQRGHWH

SEQ ID NO: 1345073 - protein, 9 aa, Homo Sapiens
PEPPGPVPQ

SEQ ID NO: 1345074 - protein, 9 aa, Homo Sapiens
CSWFMHCNS

SEQ ID NO: 1345075 - protein, 9 aa, Homo Sapiens
WGLFDKSAG

SEQ ID NO: 1345076 - protein, 9 aa, Homo Sapiens
KPNAPGWAL

SEQ ID NO: 1345077 - protein, 9 aa, Homo Sapiens
WTRCLRMRP

SEQ ID NO: 1345078 - protein, 9 aa, Homo Sapiens
NVKLVFDPK

SEQ ID NO: 1345079 - protein, 9 aa, Homo Sapiens
TTKDSLPMT

SEQ ID NO: 1345080 - protein, 9 aa, Homo Sapiens
LDWIFNHPE

SEQ ID NO: 1345081 - protein, 9 aa, Homo Sapiens
GTRANAKMM

SEQ ID NO: 1345082 - protein, 9 aa, Homo Sapiens
IRWKSELAA

SEQ ID NO: 1345083 - protein, 9 aa, Homo Sapiens
LGQVIHKWC

SEQ ID NO: 1345084 - protein, 9 aa, Homo Sapiens
QRLHIPRFY

SEQ ID NO: 1345085 - protein, 9 aa, Homo Sapiens
ALHNNFQAL

SEQ ID NO: 1345086 - protein, 9 aa, Homo Sapiens
GSCKKAPLV

SEQ ID NO: 1345087 - protein, 9 aa, Homo Sapiens
KEKELHTWE

SEQ ID NO: 1345088 - protein, 9 aa, Homo Sapiens
SPLRTSLTS

SEQ ID NO: 1345089 - protein, 9 aa, Homo Sapiens
KCIRNPSIQ

SEQ ID NO: 1345090 - protein, 9 aa, Homo Sapiens
AEHGLSTEQ

SEQ ID NO: 1345091 - protein, 9 aa, Homo Sapiens
CCLRATHPN

SEQ ID NO: 1345092 - protein, 9 aa, Homo Sapiens
PWRPLSIGP

SEQ ID NO: 1345093 - protein, 9 aa, Homo Sapiens
IAEGHISLR

SEQ ID NO: 1345094 - protein, 9 aa, Homo Sapiens
TTDDETRKK

SEQ ID NO: 1345095 - protein, 9 aa, Homo Sapiens
KTFTTGMTA

SEQ ID NO: 1345096 - protein, 9 aa, Homo Sapiens
KLLYAALTH

SEQ ID NO: 1345097 - protein, 9 aa, Homo Sapiens
WEPSLPRRL

SEQ ID NO: 1345098 - protein, 9 aa, Homo Sapiens
LFSGQRYVH

SEQ ID NO: 1345099 - protein, 9 aa, Homo Sapiens
GAGLQFWEG

SEQ ID NO: 1345100 - protein, 9 aa, Homo Sapiens
CPQDTVSVI

SEQ ID NO: 1345101 - protein, 9 aa, Homo Sapiens
WLRDNRPLS

SEQ ID NO: 1345102 - protein, 9 aa, Homo Sapiens
RYRKPLELF

SEQ ID NO: 1345103 - protein, 9 aa, Homo Sapiens
LLSRAERER

SEQ ID NO: 1345104 - protein, 9 aa, Homo Sapiens
YMLLAKHLQ

SEQ ID NO: 1345105 - protein, 9 aa, Homo Sapiens
LPCMENTVL

SEQ ID NO: 1345106 - protein, 9 aa, Homo Sapiens
DLYLMSGSH

SEQ ID NO: 1345107 - protein, 9 aa, Homo Sapiens
QYIQFISGE

SEQ ID NO: 1345108 - protein, 9 aa, Homo Sapiens
IKGTSLYMS

SEQ ID NO: 1345109 - protein, 9 aa, Homo Sapiens
GNVFYVKAR

SEQ ID NO: 1345110 - protein, 9 aa, Homo Sapiens
NVLRKHKDL

SEQ ID NO: 1345111 - protein, 9 aa, Homo Sapiens
IFFYEWSIK

SEQ ID NO: 1345112 - protein, 9 aa, Homo Sapiens
KLMDGILEI

SEQ ID NO: 1345113 - protein, 9 aa, Homo Sapiens
EIPKDEHIL

SEQ ID NO: 1345114 - protein, 9 aa, Homo Sapiens
VIVYCLSVF

SEQ ID NO: 1345115 - protein, 9 aa, Homo Sapiens
TSVFQPPLP

SEQ ID NO: 1345116 - protein, 9 aa, Homo Sapiens
GPHTALLAA

SEQ ID NO: 1345117 - protein, 9 aa, Homo Sapiens
EGGELVIVR

SEQ ID NO: 1345118 - protein, 9 aa, Homo Sapiens
MVTEFKHPG

SEQ ID NO: 1345119 - protein, 9 aa, Homo Sapiens
EGTHNDNGD

SEQ ID NO: 1345120 - protein, 9 aa, Homo Sapiens
HREPVSDYQ

SEQ ID NO: 1345121 - protein, 9 aa, Homo Sapiens
GMSRCEDLM

SEQ ID NO: 1345122 - protein, 9 aa, Homo Sapiens
HSRQYLPYF

SEQ ID NO: 1345123 - protein, 9 aa, Homo Sapiens
CFGLDQQNN

SEQ ID NO: 1345124 - protein, 9 aa, Homo Sapiens
AENVCYMLI

SEQ ID NO: 1345125 - protein, 9 aa, Homo Sapiens
WFSDLLVPK

SEQ ID NO: 1345126 - protein, 9 aa, Homo Sapiens
KCAPAACFC

SEQ ID NO: 1345127 - protein, 9 aa, Homo Sapiens
ERRRVSSNS

SEQ ID NO: 1345128 - protein, 9 aa, Homo Sapiens
VLISDINDN

SEQ ID NO: 1345129 - protein, 9 aa, Homo Sapiens
TYRSRLRQH

SEQ ID NO: 1345130 - protein, 9 aa, Homo Sapiens
LEDCRQLAR

SEQ ID NO: 1345131 - protein, 9 aa, Homo Sapiens
IIPVKWGEE

SEQ ID NO: 1345132 - protein, 9 aa, Homo Sapiens
IEKLYINCI

SEQ ID NO: 1345133 - protein, 9 aa, Homo Sapiens
LKCGGTIEE

SEQ ID NO: 1345134 - protein, 9 aa, Homo Sapiens
ILAIMRAFQ

SEQ ID NO: 1345135 - protein, 9 aa, Homo Sapiens
PHCPSPYSC

SEQ ID NO: 1345136 - protein, 9 aa, Homo Sapiens
VALYKHFFS

SEQ ID NO: 1345137 - protein, 9 aa, Homo Sapiens
SGVKVDSPL

SEQ ID NO: 1345138 - protein, 9 aa, Homo Sapiens
SERPYKCTV

SEQ ID NO: 1345139 - protein, 9 aa, Homo Sapiens
DPVWLMVDT

SEQ ID NO: 1345140 - protein, 9 aa, Homo Sapiens
ITIEIEHFV

SEQ ID NO: 1345141 - protein, 9 aa, Homo Sapiens
HLKTHLRTH

SEQ ID NO: 1345142 - protein, 9 aa, Homo Sapiens
CEKQTITRW

SEQ ID NO: 1345143 - protein, 9 aa, Homo Sapiens
ILVAVFKYC

SEQ ID NO: 1345144 - protein, 9 aa, Homo Sapiens
KVEEPKITQ

SEQ ID NO: 1345145 - protein, 9 aa, Homo Sapiens
PGLNKSQLV

SEQ ID NO: 1345146 - protein, 9 aa, Homo Sapiens
SEDFHVKDS

SEQ ID NO: 1345147 - protein, 9 aa, Homo Sapiens
TKSHRTFGH

SEQ ID NO: 1345148 - protein, 9 aa, Homo Sapiens
DPSYGNSTR

SEQ ID NO: 1345149 - protein, 9 aa, Homo Sapiens
SMGAEAHIN

SEQ ID NO: 1345150 - protein, 9 aa, Homo Sapiens
HPQVQDLPL

SEQ ID NO: 1345151 - protein, 9 aa, Homo Sapiens
APPAFSGRI

SEQ ID NO: 1345152 - protein, 9 aa, Homo Sapiens
QHKMRMVIG

SEQ ID NO: 1345153 - protein, 9 aa, Homo Sapiens
RETVKHREF

SEQ ID NO: 1345154 - protein, 9 aa, Homo Sapiens
HIVASAGRD

SEQ ID NO: 1345155 - protein, 9 aa, Homo Sapiens
YEEPDYGES

SEQ ID NO: 1345156 - protein, 9 aa, Homo Sapiens
NPHLPSDLH

SEQ ID NO: 1345157 - protein, 9 aa, Homo Sapiens
DLKKKRIVE

SEQ ID NO: 1345158 - protein, 9 aa, Homo Sapiens
SHRKNHSIV

SEQ ID NO: 1345159 - protein, 9 aa, Homo Sapiens
PNIQDTQAH

SEQ ID NO: 1345160 - protein, 9 aa, Homo Sapiens
TEFEQCHHC

SEQ ID NO: 1345161 - protein, 9 aa, Homo Sapiens
TLHIGSVSA

SEQ ID NO: 1345162 - protein, 9 aa, Homo Sapiens
FNYLKSGIR

SEQ ID NO: 1345163 - protein, 9 aa, Homo Sapiens
VRHLTGEVA

SEQ ID NO: 1345164 - protein, 9 aa, Homo Sapiens
VPWLLAHKI

SEQ ID NO: 1345165 - protein, 9 aa, Homo Sapiens
DMRVAQVAQ

SEQ ID NO: 1345166 - protein, 9 aa, Homo Sapiens
KSAWSSVFL

SEQ ID NO: 1345167 - protein, 9 aa, Homo Sapiens
SICFPVCVE

SEQ ID NO: 1345168 - protein, 9 aa, Homo Sapiens
YIRNPYLVT

SEQ ID NO: 1345169 - protein, 9 aa, Homo Sapiens
VRQCDMYRI

SEQ ID NO: 1345170 - protein, 9 aa, Homo Sapiens
AMFLEANIP

SEQ ID NO: 1345171 - protein, 9 aa, Homo Sapiens
ASAIVQAHS

SEQ ID NO: 1345172 - protein, 9 aa, Homo Sapiens
KSYQVPKED

SEQ ID NO: 1345173 - protein, 9 aa, Homo Sapiens
NYYRLKEAL

SEQ ID NO: 1345174 - protein, 9 aa, Homo Sapiens
EQYHRIGGG

SEQ ID NO: 1345175 - protein, 9 aa, Homo Sapiens
GCFLRGYRQ

SEQ ID NO: 1345176 - protein, 9 aa, Homo Sapiens
EGTYLALED

SEQ ID NO: 1345177 - protein, 9 aa, Homo Sapiens
CLPEPPLPY

SEQ ID NO: 1345178 - protein, 9 aa, Homo Sapiens
FPRVFLSPK

SEQ ID NO: 1345179 - protein, 9 aa, Homo Sapiens
KDRPVMQLY

SEQ ID NO: 1345180 - protein, 9 aa, Homo Sapiens
VLRYLETRR

SEQ ID NO: 1345181 - protein, 9 aa, Homo Sapiens
RRVRRAPLG

SEQ ID NO: 1345182 - protein, 9 aa, Homo Sapiens
YDTIKYKGE

SEQ ID NO: 1345183 - protein, 9 aa, Homo Sapiens
FKRHSMWEE

SEQ ID NO: 1345184 - protein, 9 aa, Homo Sapiens
GLEITCTAL

SEQ ID NO: 1345185 - protein, 9 aa, Homo Sapiens
DESLNSLLQ

SEQ ID NO: 1345186 - protein, 9 aa, Homo Sapiens
RNGGGTFMF

SEQ ID NO: 1345187 - protein, 9 aa, Homo Sapiens
TMVMNMFYA

SEQ ID NO: 1345188 - protein, 9 aa, Homo Sapiens
REKLCNFIL

SEQ ID NO: 1345189 - protein, 9 aa, Homo Sapiens
SDGLVFTTQ

SEQ ID NO: 1345190 - protein, 9 aa, Homo Sapiens
WNEDYKSYQ

SEQ ID NO: 1345191 - protein, 9 aa, Homo Sapiens
SPSGEDFIF

SEQ ID NO: 1345192 - protein, 9 aa, Homo Sapiens
CGRRLSEEE

SEQ ID NO: 1345193 - protein, 9 aa, Homo Sapiens
VLLDGCSKK

SEQ ID NO: 1345194 - protein, 9 aa, Homo Sapiens
GLPVHGDPG

SEQ ID NO: 1345195 - protein, 9 aa, Homo Sapiens
TSGHFRKIL

SEQ ID NO: 1345196 - protein, 9 aa, Homo Sapiens
DRRARKTEN

SEQ ID NO: 1345197 - protein, 9 aa, Homo Sapiens
QLRKIGRWR

SEQ ID NO: 1345198 - protein, 9 aa, Homo Sapiens
MEVLQERMD

SEQ ID NO: 1345199 - protein, 9 aa, Homo Sapiens
TPLHVAVRL

SEQ ID NO: 1345200 - protein, 9 aa, Homo Sapiens
CNTTRDNEV

SEQ ID NO: 1345201 - protein, 9 aa, Homo Sapiens
VDTGAIDDL

SEQ ID NO: 1345202 - protein, 9 aa, Homo Sapiens
RWTGSRTHG

SEQ ID NO: 1345203 - protein, 9 aa, Homo Sapiens
HEGHVKEAA

SEQ ID NO: 1345204 - protein, 9 aa, Homo Sapiens
KSHIQVRLG

SEQ ID NO: 1345205 - protein, 9 aa, Homo Sapiens
SVFGMCVNT

SEQ ID NO: 1345206 - protein, 9 aa, Homo Sapiens
MRGEGTFTA

SEQ ID NO: 1345207 - protein, 9 aa, Homo Sapiens
KKFRENMLD

SEQ ID NO: 1345208 - protein, 9 aa, Homo Sapiens
TFHHPLLSS

SEQ ID NO: 1345209 - protein, 9 aa, Homo Sapiens
HTKDIPFTC

SEQ ID NO: 1345210 - protein, 9 aa, Homo Sapiens
VSLIFTQFL

SEQ ID NO: 1345211 - protein, 9 aa, Homo Sapiens
EASKSVLSA

SEQ ID NO: 1345212 - protein, 9 aa, Homo Sapiens
DIWNAAWHK

SEQ ID NO: 1345213 - protein, 9 aa, Homo Sapiens
MQLLVVNAT

SEQ ID NO: 1345214 - protein, 9 aa, Homo Sapiens
LALSTASDL

SEQ ID NO: 1345215 - protein, 9 aa, Homo Sapiens
ERVAMKEVL

SEQ ID NO: 1345216 - protein, 9 aa, Homo Sapiens
RIIKCTHCG

SEQ ID NO: 1345217 - protein, 9 aa, Homo Sapiens
NEATCNDFL

SEQ ID NO: 1345218 - protein, 9 aa, Homo Sapiens
AWVGALTMG

SEQ ID NO: 1345219 - protein, 9 aa, Homo Sapiens
EASGRTVGN

SEQ ID NO: 1345220 - protein, 9 aa, Homo Sapiens
RNQIVPDTH

SEQ ID NO: 1345221 - protein, 9 aa, Homo Sapiens
VIVVGFPAT

SEQ ID NO: 1345222 - protein, 9 aa, Homo Sapiens
LWQPQGAHS

SEQ ID NO: 1345223 - protein, 9 aa, Homo Sapiens
RKRCQPHPT

SEQ ID NO: 1345224 - protein, 9 aa, Homo Sapiens
PVINITSML

SEQ ID NO: 1345225 - protein, 9 aa, Homo Sapiens
TALFIYIRS

SEQ ID NO: 1345226 - protein, 9 aa, Homo Sapiens
GCLTHKEFR

SEQ ID NO: 1345227 - protein, 9 aa, Homo Sapiens
PKKPTSMDG

SEQ ID NO: 1345228 - protein, 9 aa, Homo Sapiens
GKKLVKISE

SEQ ID NO: 1345229 - protein, 9 aa, Homo Sapiens
LKMFEAITW

SEQ ID NO: 1345230 - protein, 9 aa, Homo Sapiens
GRPKDDHHL

SEQ ID NO: 1345231 - protein, 9 aa, Homo Sapiens
HHVDAHATL

SEQ ID NO: 1345232 - protein, 9 aa, Homo Sapiens
QKGCVASQC

SEQ ID NO: 1345233 - protein, 9 aa, Homo Sapiens
LRRIQRANL

SEQ ID NO: 1345234 - protein, 9 aa, Homo Sapiens
YANQEVSPP

SEQ ID NO: 1345235 - protein, 9 aa, Homo Sapiens
IVTALGDGP

SEQ ID NO: 1345236 - protein, 9 aa, Homo Sapiens
NKHKLRKME

SEQ ID NO: 1345237 - protein, 9 aa, Homo Sapiens
FHILSVEPR

SEQ ID NO: 1345238 - protein, 9 aa, Homo Sapiens
KRCYSFRVP

SEQ ID NO: 1345239 - protein, 9 aa, Homo Sapiens
CPSMFAHGG

SEQ ID NO: 1345240 - protein, 9 aa, Homo Sapiens
ETHKGEIPK

SEQ ID NO: 1345241 - protein, 9 aa, Homo Sapiens
GMPETYQVR

SEQ ID NO: 1345242 - protein, 9 aa, Homo Sapiens
YFCGHNESK

SEQ ID NO: 1345243 - protein, 9 aa, Homo Sapiens
KYFTLYEVA

SEQ ID NO: 1345244 - protein, 9 aa, Homo Sapiens
RSKLWSAIP

SEQ ID NO: 1345245 - protein, 9 aa, Homo Sapiens
PVRLTNILK

SEQ ID NO: 1345246 - protein, 9 aa, Homo Sapiens
GSQSDRGGG

SEQ ID NO: 1345247 - protein, 9 aa, Homo Sapiens
QGQKCGGTY

SEQ ID NO: 1345248 - protein, 9 aa, Homo Sapiens
TQLTQGCML

SEQ ID NO: 1345249 - protein, 9 aa, Homo Sapiens
AQDALDTLC

SEQ ID NO: 1345250 - protein, 9 aa, Homo Sapiens
KTKPEYPCS

SEQ ID NO: 1345251 - protein, 9 aa, Homo Sapiens
WQESKMACV

SEQ ID NO: 1345252 - protein, 9 aa, Homo Sapiens
NGGRGHASQ

SEQ ID NO: 1345253 - protein, 9 aa, Homo Sapiens
EHMPTPVIK

SEQ ID NO: 1345254 - protein, 9 aa, Homo Sapiens
MPYKRNPMC

SEQ ID NO: 1345255 - protein, 9 aa, Homo Sapiens
TQITTILRE

SEQ ID NO: 1345256 - protein, 9 aa, Homo Sapiens
PAKMSSLPE

SEQ ID NO: 1345257 - protein, 9 aa, Homo Sapiens
RSVSLLMNL

SEQ ID NO: 1345258 - protein, 9 aa, Homo Sapiens
DVNSILHYL

SEQ ID NO: 1345259 - protein, 9 aa, Homo Sapiens
TGSLCVSEQ

SEQ ID NO: 1345260 - protein, 9 aa, Homo Sapiens
NCETRCGQI

SEQ ID NO: 1345261 - protein, 9 aa, Homo Sapiens
GLVDPNFGF

SEQ ID NO: 1345262 - protein, 9 aa, Homo Sapiens
IEEHNFAEF

SEQ ID NO: 1345263 - protein, 9 aa, Homo Sapiens
LRNLSKPYD

SEQ ID NO: 1345264 - protein, 9 aa, Homo Sapiens
VTMQNLNNR

SEQ ID NO: 1345265 - protein, 9 aa, Homo Sapiens
NLDQLRFSG

SEQ ID NO: 1345266 - protein, 9 aa, Homo Sapiens
SPGLTAPSL

SEQ ID NO: 1345267 - protein, 9 aa, Homo Sapiens
RVLIVTFLT

SEQ ID NO: 1345268 - protein, 9 aa, Homo Sapiens
CRSNKNPWV

SEQ ID NO: 1345269 - protein, 9 aa, Homo Sapiens
ITAVYVEMR

SEQ ID NO: 1345270 - protein, 9 aa, Homo Sapiens
LRFILFFPS

SEQ ID NO: 1345271 - protein, 9 aa, Homo Sapiens
KRVLAHLTP

SEQ ID NO: 1345272 - protein, 9 aa, Homo Sapiens
MRAILCIEV

SEQ ID NO: 1345273 - protein, 9 aa, Homo Sapiens
ALGQALHLN

SEQ ID NO: 1345274 - protein, 9 aa, Homo Sapiens
ARTILVLVA

SEQ ID NO: 1345275 - protein, 9 aa, Homo Sapiens
MFCAQLQCF

SEQ ID NO: 1345276 - protein, 9 aa, Homo Sapiens
GQVFDSVMA

SEQ ID NO: 1345277 - protein, 9 aa, Homo Sapiens
CNIDRTPES

SEQ ID NO: 1345278 - protein, 9 aa, Homo Sapiens
GICDKQGYN

SEQ ID NO: 1345279 - protein, 9 aa, Homo Sapiens
IYISMAVTF

SEQ ID NO: 1345280 - protein, 9 aa, Homo Sapiens
GYQCCMMAQ

SEQ ID NO: 1345281 - protein, 9 aa, Homo Sapiens
DHFAWQSPT

SEQ ID NO: 1345282 - protein, 9 aa, Homo Sapiens
EQCHHCLEL

SEQ ID NO: 1345283 - protein, 9 aa, Homo Sapiens
EPVSPSREC

SEQ ID NO: 1345284 - protein, 9 aa, Homo Sapiens
PPSVPHCQI

SEQ ID NO: 1345285 - protein, 9 aa, Homo Sapiens
QGPLFLLFF

SEQ ID NO: 1345286 - protein, 9 aa, Homo Sapiens
KPESSAEQL

SEQ ID NO: 1345287 - protein, 9 aa, Homo Sapiens
YLAELMIYI

SEQ ID NO: 1345288 - protein, 9 aa, Homo Sapiens
TRLASRSQG

SEQ ID NO: 1345289 - protein, 9 aa, Homo Sapiens
QHVQPPKPS

SEQ ID NO: 1345290 - protein, 9 aa, Homo Sapiens
GGQVTEVTL

SEQ ID NO: 1345291 - protein, 9 aa, Homo Sapiens
HVYASGNNL

SEQ ID NO: 1345292 - protein, 9 aa, Homo Sapiens
CCCIAVCVH

SEQ ID NO: 1345293 - protein, 9 aa, Homo Sapiens
DKVYLIRPK

SEQ ID NO: 1345294 - protein, 9 aa, Homo Sapiens
QKELQIINQ

SEQ ID NO: 1345295 - protein, 9 aa, Homo Sapiens
LSDSYMALG

SEQ ID NO: 1345296 - protein, 9 aa, Homo Sapiens
NKCIAYKRC

SEQ ID NO: 1345297 - protein, 9 aa, Homo Sapiens
HDIRTIAEV

SEQ ID NO: 1345298 - protein, 9 aa, Homo Sapiens
HMPMWSAHL

SEQ ID NO: 1345299 - protein, 9 aa, Homo Sapiens
ITTPSKKKL

SEQ ID NO: 1345300 - protein, 9 aa, Homo Sapiens
MSPQSSKNL

SEQ ID NO: 1345301 - protein, 9 aa, Homo Sapiens
RELDGCLQM

SEQ ID NO: 1345302 - protein, 9 aa, Homo Sapiens
NTFEMILGP

SEQ ID NO: 1345303 - protein, 9 aa, Homo Sapiens
ITTLLMLNL

SEQ ID NO: 1345304 - protein, 9 aa, Homo Sapiens
CHLTLDEMD

SEQ ID NO: 1345305 - protein, 9 aa, Homo Sapiens
LSGGGMVRL

SEQ ID NO: 1345306 - protein, 9 aa, Homo Sapiens
SNLLLYEKL

SEQ ID NO: 1345307 - protein, 9 aa, Homo Sapiens
LFVQLIQAN

SEQ ID NO: 1345308 - protein, 9 aa, Homo Sapiens
LKGKLGVSE

SEQ ID NO: 1345309 - protein, 9 aa, Homo Sapiens
AIIKRAGSR

SEQ ID NO: 1345310 - protein, 9 aa, Homo Sapiens
SFFTLTVAS

SEQ ID NO: 1345311 - protein, 9 aa, Homo Sapiens
DTVTFTNAE

SEQ ID NO: 1345312 - protein, 9 aa, Homo Sapiens
YKPRPKCTC

SEQ ID NO: 1345313 - protein, 9 aa, Homo Sapiens
LWATVVLGS

SEQ ID NO: 1345314 - protein, 9 aa, Homo Sapiens
AFNILQKSG

SEQ ID NO: 1345315 - protein, 9 aa, Homo Sapiens
TRMYFQPYT

SEQ ID NO: 1345316 - protein, 9 aa, Homo Sapiens
QFQRRQNQC

SEQ ID NO: 1345317 - protein, 9 aa, Homo Sapiens
QYPPHCPSP

SEQ ID NO: 1345318 - protein, 9 aa, Homo Sapiens
FNRPFQSQN

SEQ ID NO: 1345319 - protein, 9 aa, Homo Sapiens
WSPHPPRAG

SEQ ID NO: 1345320 - protein, 9 aa, Homo Sapiens
QDINYQELT

SEQ ID NO: 1345321 - protein, 9 aa, Homo Sapiens
SEFKRKHGK

SEQ ID NO: 1345322 - protein, 9 aa, Homo Sapiens
QPYITNHTF

SEQ ID NO: 1345323 - protein, 9 aa, Homo Sapiens
RFTCVRHWH

SEQ ID NO: 1345324 - protein, 9 aa, Homo Sapiens
QTCQCHHGE

SEQ ID NO: 1345325 - protein, 9 aa, Homo Sapiens
RHTHVKRKN

SEQ ID NO: 1345326 - protein, 9 aa, Homo Sapiens
SRLVHERDA

SEQ ID NO: 1345327 - protein, 9 aa, Homo Sapiens
IILFVEKLP

SEQ ID NO: 1345328 - protein, 9 aa, Homo Sapiens
FKGKHSLDI

SEQ ID NO: 1345329 - protein, 9 aa, Homo Sapiens
NEAILVPLV

SEQ ID NO: 1345330 - protein, 9 aa, Homo Sapiens
EPLGQVKLT

SEQ ID NO: 1345331 - protein, 9 aa, Homo Sapiens
RCVSACCAP

SEQ ID NO: 1345332 - protein, 9 aa, Homo Sapiens
QLHVKEPHL

SEQ ID NO: 1345333 - protein, 9 aa, Homo Sapiens
FQKFPVKVR

SEQ ID NO: 1345334 - protein, 9 aa, Homo Sapiens
WMMVIGFPI

SEQ ID NO: 1345335 - protein, 9 aa, Homo Sapiens
AVYIIVDEI

SEQ ID NO: 1345336 - protein, 9 aa, Homo Sapiens
FTQEYKKDP

SEQ ID NO: 1345337 - protein, 9 aa, Homo Sapiens
KYIEYHGAE

SEQ ID NO: 1345338 - protein, 9 aa, Homo Sapiens
TSLGLARMF

SEQ ID NO: 1345339 - protein, 9 aa, Homo Sapiens
PPTHHPISH

SEQ ID NO: 1345340 - protein, 9 aa, Homo Sapiens
RDPKRLRPE

SEQ ID NO: 1345341 - protein, 9 aa, Homo Sapiens
DTLLADLTR

SEQ ID NO: 1345342 - protein, 9 aa, Homo Sapiens
LCHFIVDKL

SEQ ID NO: 1345343 - protein, 9 aa, Homo Sapiens
LFPRSLSLQ

SEQ ID NO: 1345344 - protein, 9 aa, Homo Sapiens
LCSLFHQCY

SEQ ID NO: 1345345 - protein, 9 aa, Homo Sapiens
QWTNAGDHQ

SEQ ID NO: 1345346 - protein, 9 aa, Homo Sapiens
GWEKCTDPR

SEQ ID NO: 1345347 - protein, 9 aa, Homo Sapiens
SGDENDDTV

SEQ ID NO: 1345348 - protein, 9 aa, Homo Sapiens
SLSQEVQLE

SEQ ID NO: 1345349 - protein, 9 aa, Homo Sapiens
PRIILTTQQ

SEQ ID NO: 1345350 - protein, 9 aa, Homo Sapiens
ALPGPPLPT

SEQ ID NO: 1345351 - protein, 9 aa, Homo Sapiens
LEEPMSNPI

SEQ ID NO: 1345352 - protein, 9 aa, Homo Sapiens
IFAGAWIAI

SEQ ID NO: 1345353 - protein, 9 aa, Homo Sapiens
RHVIFGDDH

SEQ ID NO: 1345354 - protein, 9 aa, Homo Sapiens
KPKRANCVI

SEQ ID NO: 1345355 - protein, 9 aa, Homo Sapiens
NEKHNFIAL

SEQ ID NO: 1345356 - protein, 9 aa, Homo Sapiens
ENTKPQVKP

SEQ ID NO: 1345357 - protein, 9 aa, Homo Sapiens
DIKWTVLRV

SEQ ID NO: 1345358 - protein, 9 aa, Homo Sapiens
RGAGGAPIQ

SEQ ID NO: 1345359 - protein, 9 aa, Homo Sapiens
CCDHMIRSL

SEQ ID NO: 1345360 - protein, 9 aa, Homo Sapiens
PAVAPPSAV

SEQ ID NO: 1345361 - protein, 9 aa, Homo Sapiens
DSLTRPGLE

SEQ ID NO: 1345362 - protein, 9 aa, Homo Sapiens
KVDKAQCYA

SEQ ID NO: 1345363 - protein, 9 aa, Homo Sapiens
WPSHRSEAT

SEQ ID NO: 1345364 - protein, 9 aa, Homo Sapiens
KINTGMYIL

SEQ ID NO: 1345365 - protein, 9 aa, Homo Sapiens
VKNTQPEDW

SEQ ID NO: 1345366 - protein, 9 aa, Homo Sapiens
PQGQDSTQD

SEQ ID NO: 1345367 - protein, 9 aa, Homo Sapiens
HMILRKGSF

SEQ ID NO: 1345368 - protein, 9 aa, Homo Sapiens
QGLLHENCR

SEQ ID NO: 1345369 - protein, 9 aa, Homo Sapiens
HQRVHTKEK

SEQ ID NO: 1345370 - protein, 9 aa, Homo Sapiens
KAREEKKKN

SEQ ID NO: 1345371 - protein, 9 aa, Homo Sapiens
ARALVHYDN

SEQ ID NO: 1345372 - protein, 9 aa, Homo Sapiens
GVWLRLRPC

SEQ ID NO: 1345373 - protein, 9 aa, Homo Sapiens
LNSQCLSAP

SEQ ID NO: 1345374 - protein, 9 aa, Homo Sapiens
GAHVWLLPG

SEQ ID NO: 1345375 - protein, 9 aa, Homo Sapiens
AVFVEELDK

SEQ ID NO: 1345376 - protein, 9 aa, Homo Sapiens
FVLYNKSHN

SEQ ID NO: 1345377 - protein, 9 aa, Homo Sapiens
FDFYYGTCV

SEQ ID NO: 1345378 - protein, 9 aa, Homo Sapiens
VPDCSDFLS

SEQ ID NO: 1345379 - protein, 9 aa, Homo Sapiens
GGVLGATEA

SEQ ID NO: 1345380 - protein, 9 aa, Homo Sapiens
TTARNFGFV

SEQ ID NO: 1345381 - protein, 9 aa, Homo Sapiens
LEQIRALQE

SEQ ID NO: 1345382 - protein, 9 aa, Homo Sapiens
NVIKYLAKD

SEQ ID NO: 1345383 - protein, 9 aa, Homo Sapiens
RPLRAEPRP

SEQ ID NO: 1345384 - protein, 9 aa, Homo Sapiens
YCTDPSTVD

SEQ ID NO: 1345385 - protein, 9 aa, Homo Sapiens
HMNPSSNFC

SEQ ID NO: 1345386 - protein, 9 aa, Homo Sapiens
YLKKHQVLS

SEQ ID NO: 1345387 - protein, 9 aa, Homo Sapiens
LTGMAFINT

SEQ ID NO: 1345388 - protein, 9 aa, Homo Sapiens
LARRPPAHR

SEQ ID NO: 1345389 - protein, 9 aa, Homo Sapiens
ENHYDCVVL

SEQ ID NO: 1345390 - protein, 9 aa, Homo Sapiens
NDRNKPHYP

SEQ ID NO: 1345391 - protein, 9 aa, Homo Sapiens
LKPDPTKTF

SEQ ID NO: 1345392 - protein, 9 aa, Homo Sapiens
ANTDLEVKI

SEQ ID NO: 1345393 - protein, 9 aa, Homo Sapiens
EISESEYCK

SEQ ID NO: 1345394 - protein, 9 aa, Homo Sapiens
LVYIMSTTG

SEQ ID NO: 1345395 - protein, 9 aa, Homo Sapiens
SQEAWHPEA

SEQ ID NO: 1345396 - protein, 9 aa, Homo Sapiens
WVDLNIPDA

SEQ ID NO: 1345397 - protein, 9 aa, Homo Sapiens
TVRVIFTDT

SEQ ID NO: 1345398 - protein, 9 aa, Homo Sapiens
YWSHYYQGS

SEQ ID NO: 1345399 - protein, 9 aa, Homo Sapiens
LDQGYLQLK

SEQ ID NO: 1345400 - protein, 9 aa, Homo Sapiens
PSHFLRGAP

SEQ ID NO: 1345401 - protein, 9 aa, Homo Sapiens
TCSLEHWRQ

SEQ ID NO: 1345402 - protein, 9 aa, Homo Sapiens
IDTMSHMHK

SEQ ID NO: 1345403 - protein, 9 aa, Homo Sapiens
LKNNVLSYY

SEQ ID NO: 1345404 - protein, 9 aa, Homo Sapiens
RRASQMILM

SEQ ID NO: 1345405 - protein, 9 aa, Homo Sapiens
GTSSDLNSQ

SEQ ID NO: 1345406 - protein, 9 aa, Homo Sapiens
LFSVCVQME

SEQ ID NO: 1345407 - protein, 9 aa, Homo Sapiens
MFCVLLKMK

SEQ ID NO: 1345408 - protein, 9 aa, Homo Sapiens
CGADTAPTL

SEQ ID NO: 1345409 - protein, 9 aa, Homo Sapiens
PSLHVPHPA

SEQ ID NO: 1345410 - protein, 9 aa, Homo Sapiens
PDNPVNRSL

SEQ ID NO: 1345411 - protein, 9 aa, Homo Sapiens
KLWVLARSS

SEQ ID NO: 1345412 - protein, 9 aa, Homo Sapiens
GLNTGTTIQ

SEQ ID NO: 1345413 - protein, 9 aa, Homo Sapiens
LMRSLKRTA

SEQ ID NO: 1345414 - protein, 9 aa, Homo Sapiens
PLNVIDLME

SEQ ID NO: 1345415 - protein, 9 aa, Homo Sapiens
HLCRELHPR

SEQ ID NO: 1345416 - protein, 9 aa, Homo Sapiens
VVLHEWYLL

SEQ ID NO: 1345417 - protein, 9 aa, Homo Sapiens
STMTPYGSP

SEQ ID NO: 1345418 - protein, 9 aa, Homo Sapiens
IKDDTLLVC

SEQ ID NO: 1345419 - protein, 9 aa, Homo Sapiens
MQLPIYTPL

SEQ ID NO: 1345420 - protein, 9 aa, Homo Sapiens
VGSKRHAKL

SEQ ID NO: 1345421 - protein, 9 aa, Homo Sapiens
RKQKTINCF

SEQ ID NO: 1345422 - protein, 9 aa, Homo Sapiens
GFHQSVRHA

SEQ ID NO: 1345423 - protein, 9 aa, Homo Sapiens
KSEEPLVSI

SEQ ID NO: 1345424 - protein, 9 aa, Homo Sapiens
LMSPGRHKS

SEQ ID NO: 1345425 - protein, 9 aa, Homo Sapiens
REHILELST

SEQ ID NO: 1345426 - protein, 9 aa, Homo Sapiens
ISELAQAMR

SEQ ID NO: 1345427 - protein, 9 aa, Homo Sapiens
PHRSEPIYN

SEQ ID NO: 1345428 - protein, 9 aa, Homo Sapiens
VFILSSNFL

SEQ ID NO: 1345429 - protein, 9 aa, Homo Sapiens
EHLTREVEA

SEQ ID NO: 1345430 - protein, 9 aa, Homo Sapiens
IADLGLVVK

SEQ ID NO: 1345431 - protein, 9 aa, Homo Sapiens
NKNPWVCLT

SEQ ID NO: 1345432 - protein, 9 aa, Homo Sapiens
EVTGIDLEN

SEQ ID NO: 1345433 - protein, 9 aa, Homo Sapiens
ASMAVVIPD

SEQ ID NO: 1345434 - protein, 9 aa, Homo Sapiens
TAAPASTPL

SEQ ID NO: 1345435 - protein, 9 aa, Homo Sapiens
AGLNTGTTI

SEQ ID NO: 1345436 - protein, 9 aa, Homo Sapiens
LNLSHGKQD

SEQ ID NO: 1345437 - protein, 9 aa, Homo Sapiens
DAGSRDEKV

SEQ ID NO: 1345438 - protein, 9 aa, Homo Sapiens
VIVIWGVLT

SEQ ID NO: 1345439 - protein, 9 aa, Homo Sapiens
VVLPHSLDF

SEQ ID NO: 1345440 - protein, 9 aa, Homo Sapiens
TGWDEKTLR

SEQ ID NO: 1345441 - protein, 9 aa, Homo Sapiens
IQMTVKDYM

SEQ ID NO: 1345442 - protein, 9 aa, Homo Sapiens
VSVQDQLSA

SEQ ID NO: 1345443 - protein, 9 aa, Homo Sapiens
HYRTALRSC

SEQ ID NO: 1345444 - protein, 9 aa, Homo Sapiens
LHRKRPPRQ

SEQ ID NO: 1345445 - protein, 9 aa, Homo Sapiens
YIWTADMVP

SEQ ID NO: 1345446 - protein, 9 aa, Homo Sapiens
TGKGGKTKF

SEQ ID NO: 1345447 - protein, 9 aa, Homo Sapiens
FNQFLILNK

SEQ ID NO: 1345448 - protein, 9 aa, Homo Sapiens
GIVDAYCQA

SEQ ID NO: 1345449 - protein, 9 aa, Homo Sapiens
KDEYIDLMT

SEQ ID NO: 1345450 - protein, 9 aa, Homo Sapiens
EPSLPRRLW

SEQ ID NO: 1345451 - protein, 9 aa, Homo Sapiens
REICISRNF

SEQ ID NO: 1345452 - protein, 9 aa, Homo Sapiens
LNRSKHLEK

SEQ ID NO: 1345453 - protein, 9 aa, Homo Sapiens
MDASGETVS

SEQ ID NO: 1345454 - protein, 9 aa, Homo Sapiens
VMVRTILPK

SEQ ID NO: 1345455 - protein, 9 aa, Homo Sapiens
DEFNATLKE

SEQ ID NO: 1345456 - protein, 9 aa, Homo Sapiens
HSQKMSQLH

SEQ ID NO: 1345457 - protein, 9 aa, Homo Sapiens
KNIQGGRPS

SEQ ID NO: 1345458 - protein, 9 aa, Homo Sapiens
LFARLVALE

SEQ ID NO: 1345459 - protein, 9 aa, Homo Sapiens
VISIRGLSN

SEQ ID NO: 1345460 - protein, 9 aa, Homo Sapiens
HRPSYDVYN

SEQ ID NO: 1345461 - protein, 9 aa, Homo Sapiens
HDPVHKLLT

SEQ ID NO: 1345462 - protein, 9 aa, Homo Sapiens
RGSSPSVLV

SEQ ID NO: 1345463 - protein, 9 aa, Homo Sapiens
FGQVFDSVM

SEQ ID NO: 1345464 - protein, 9 aa, Homo Sapiens
LNDIRNPVF

SEQ ID NO: 1345465 - protein, 9 aa, Homo Sapiens
LLLCVVYFL

SEQ ID NO: 1345466 - protein, 9 aa, Homo Sapiens
VRSLRQDRM

SEQ ID NO: 1345467 - protein, 9 aa, Homo Sapiens
LTGEVAKEW

SEQ ID NO: 1345468 - protein, 9 aa, Homo Sapiens
QKIMMDLNH

SEQ ID NO: 1345469 - protein, 9 aa, Homo Sapiens
SRCTGAGTA

SEQ ID NO: 1345470 - protein, 9 aa, Homo Sapiens
ITSRETYNV

SEQ ID NO: 1345471 - protein, 9 aa, Homo Sapiens
DSPLEAPAE

SEQ ID NO: 1345472 - protein, 9 aa, Homo Sapiens
NDPSIHLYK

SEQ ID NO: 1345473 - protein, 9 aa, Homo Sapiens
RAHTCFNHL

SEQ ID NO: 1345474 - protein, 9 aa, Homo Sapiens
VLYHNNSPK

SEQ ID NO: 1345475 - protein, 9 aa, Homo Sapiens
TKVEHIPKA

SEQ ID NO: 1345476 - protein, 9 aa, Homo Sapiens
ALRRIQRAN

SEQ ID NO: 1345477 - protein, 9 aa, Homo Sapiens
CHKLGNISK

SEQ ID NO: 1345478 - protein, 9 aa, Homo Sapiens
RDEVLPEKE

SEQ ID NO: 1345479 - protein, 9 aa, Homo Sapiens
LRAGHQHNA

SEQ ID NO: 1345480 - protein, 9 aa, Homo Sapiens
MWQAGQRHS

SEQ ID NO: 1345481 - protein, 9 aa, Homo Sapiens
DPDEKIAYR

SEQ ID NO: 1345482 - protein, 9 aa, Homo Sapiens
AVLSGHRFL

SEQ ID NO: 1345483 - protein, 9 aa, Homo Sapiens
HHPGDSDLL

SEQ ID NO: 1345484 - protein, 9 aa, Homo Sapiens
QYPARAIKV

SEQ ID NO: 1345485 - protein, 9 aa, Homo Sapiens
NLRELPIVP

SEQ ID NO: 1345486 - protein, 9 aa, Homo Sapiens
MGPRVEAGT

SEQ ID NO: 1345487 - protein, 9 aa, Homo Sapiens
VTYQGRVQS

SEQ ID NO: 1345488 - protein, 9 aa, Homo Sapiens
WSKGVRVPV

SEQ ID NO: 1345489 - protein, 9 aa, Homo Sapiens
KGCWTELGA

SEQ ID NO: 1345490 - protein, 9 aa, Homo Sapiens
MILGRKTKW

SEQ ID NO: 1345491 - protein, 9 aa, Homo Sapiens
ETTISSQKY

SEQ ID NO: 1345492 - protein, 9 aa, Homo Sapiens
VSLLNPPEA

SEQ ID NO: 1345493 - protein, 9 aa, Homo Sapiens
KKFYAKNEW

SEQ ID NO: 1345494 - protein, 9 aa, Homo Sapiens
SSVQQRLTE

SEQ ID NO: 1345495 - protein, 9 aa, Homo Sapiens
PSNGDLGAM

SEQ ID NO: 1345496 - protein, 9 aa, Homo Sapiens
LDFAGLVQE

SEQ ID NO: 1345497 - protein, 9 aa, Homo Sapiens
QQQALQATR

SEQ ID NO: 1345498 - protein, 9 aa, Homo Sapiens
TNETQRQKA

SEQ ID NO: 1345499 - protein, 9 aa, Homo Sapiens
PCGPLEGNA

SEQ ID NO: 1345500 - protein, 9 aa, Homo Sapiens
TLISELAQA

SEQ ID NO: 1345501 - protein, 9 aa, Homo Sapiens
ADFELLDGI

SEQ ID NO: 1345502 - protein, 9 aa, Homo Sapiens
RPSHRKPTS

SEQ ID NO: 1345503 - protein, 9 aa, Homo Sapiens
VVKERICLA

SEQ ID NO: 1345504 - protein, 9 aa, Homo Sapiens
DKQCTYTFG

SEQ ID NO: 1345505 - protein, 9 aa, Homo Sapiens
TQLGTVIAL

SEQ ID NO: 1345506 - protein, 9 aa, Homo Sapiens
YDCQISKQG

SEQ ID NO: 1345507 - protein, 9 aa, Homo Sapiens
VHLTPSLDV

SEQ ID NO: 1345508 - protein, 9 aa, Homo Sapiens
LTSTIMRDP

SEQ ID NO: 1345509 - protein, 9 aa, Homo Sapiens
YCFVREDRV

SEQ ID NO: 1345510 - protein, 9 aa, Homo Sapiens
FHINPHLPS

SEQ ID NO: 1345511 - protein, 9 aa, Homo Sapiens
TCPCPSMFA

SEQ ID NO: 1345512 - protein, 9 aa, Homo Sapiens
SQYVPAFWY

SEQ ID NO: 1345513 - protein, 9 aa, Homo Sapiens
TIFDVSVER

SEQ ID NO: 1345514 - protein, 9 aa, Homo Sapiens
EVMSVVVVQ

SEQ ID NO: 1345515 - protein, 9 aa, Homo Sapiens
RAWRPHNAI

SEQ ID NO: 1345516 - protein, 9 aa, Homo Sapiens
SEGCGSTFA

SEQ ID NO: 1345517 - protein, 9 aa, Homo Sapiens
YDTACTLGA

SEQ ID NO: 1345518 - protein, 9 aa, Homo Sapiens
CDLIGFEFT

SEQ ID NO: 1345519 - protein, 9 aa, Homo Sapiens
APALDTTIT

SEQ ID NO: 1345520 - protein, 9 aa, Homo Sapiens
LLITIAIFQ

SEQ ID NO: 1345521 - protein, 9 aa, Homo Sapiens
FRFNRCDLI

SEQ ID NO: 1345522 - protein, 9 aa, Homo Sapiens
IKLQYQSSQ

SEQ ID NO: 1345523 - protein, 9 aa, Homo Sapiens
IMMVVLVGY

SEQ ID NO: 1345524 - protein, 9 aa, Homo Sapiens
DISGKSFGV

SEQ ID NO: 1345525 - protein, 9 aa, Homo Sapiens
ERNQNLINV

SEQ ID NO: 1345526 - protein, 9 aa, Homo Sapiens
PSPMDPSNF

SEQ ID NO: 1345527 - protein, 9 aa, Homo Sapiens
VITNVVEMV

SEQ ID NO: 1345528 - protein, 9 aa, Homo Sapiens
QGKYSDMHT

SEQ ID NO: 1345529 - protein, 9 aa, Homo Sapiens
KFRANATKM

SEQ ID NO: 1345530 - protein, 9 aa, Homo Sapiens
LPYLEQYHI

SEQ ID NO: 1345531 - protein, 9 aa, Homo Sapiens
QDNNQPGIL

SEQ ID NO: 1345532 - protein, 9 aa, Homo Sapiens
SRSALIPHH

SEQ ID NO: 1345533 - protein, 9 aa, Homo Sapiens
YYLDNGAKA

SEQ ID NO: 1345534 - protein, 9 aa, Homo Sapiens
YIEYHGAEK

SEQ ID NO: 1345535 - protein, 9 aa, Homo Sapiens
KQHISRGYD

SEQ ID NO: 1345536 - protein, 9 aa, Homo Sapiens
QILPPRLLE

SEQ ID NO: 1345537 - protein, 9 aa, Homo Sapiens
ASCLSSGFT

SEQ ID NO: 1345538 - protein, 9 aa, Homo Sapiens
YATINTSCH

SEQ ID NO: 1345539 - protein, 9 aa, Homo Sapiens
VIVAREFGV

SEQ ID NO: 1345540 - protein, 9 aa, Homo Sapiens
RKKDTLVPA

SEQ ID NO: 1345541 - protein, 9 aa, Homo Sapiens
PVYLDLCCI

SEQ ID NO: 1345542 - protein, 9 aa, Homo Sapiens
FGPLEALHL

SEQ ID NO: 1345543 - protein, 9 aa, Homo Sapiens
ARIQHLSSL

SEQ ID NO: 1345544 - protein, 9 aa, Homo Sapiens
DTEIKFLKL

SEQ ID NO: 1345545 - protein, 9 aa, Homo Sapiens
LSTDTLCKR

SEQ ID NO: 1345546 - protein, 9 aa, Homo Sapiens
YREETTRIH

SEQ ID NO: 1345547 - protein, 9 aa, Homo Sapiens
RHVRIQLKD

SEQ ID NO: 1345548 - protein, 9 aa, Homo Sapiens
GDKPSISAA

SEQ ID NO: 1345549 - protein, 9 aa, Homo Sapiens
PPQPTAAPA

SEQ ID NO: 1345550 - protein, 9 aa, Homo Sapiens
LCVAVIVTF

SEQ ID NO: 1345551 - protein, 9 aa, Homo Sapiens
HGTEVNKAD

SEQ ID NO: 1345552 - protein, 9 aa, Homo Sapiens
SNHNGASCF

SEQ ID NO: 1345553 - protein, 9 aa, Homo Sapiens
KPFACDECD

SEQ ID NO: 1345554 - protein, 9 aa, Homo Sapiens
WSAAATMAG

SEQ ID NO: 1345555 - protein, 9 aa, Homo Sapiens
SVAPKGISQ

SEQ ID NO: 1345556 - protein, 9 aa, Homo Sapiens
CVHWQTYVS

SEQ ID NO: 1345557 - protein, 9 aa, Homo Sapiens
GAPIQGLPD

SEQ ID NO: 1345558 - protein, 9 aa, Homo Sapiens
ASVCRLTPS

SEQ ID NO: 1345559 - protein, 9 aa, Homo Sapiens
THFTKRVRI

SEQ ID NO: 1345560 - protein, 9 aa, Homo Sapiens
LHYITVGLL

SEQ ID NO: 1345561 - protein, 9 aa, Homo Sapiens
ARWPLSVAT

SEQ ID NO: 1345562 - protein, 9 aa, Homo Sapiens
NFLCILQRE

SEQ ID NO: 1345563 - protein, 9 aa, Homo Sapiens
KKCRIRKCI

SEQ ID NO: 1345564 - protein, 9 aa, Homo Sapiens
ASQHKGGHE

SEQ ID NO: 1345565 - protein, 9 aa, Homo Sapiens
YRKELLLKC

SEQ ID NO: 1345566 - protein, 9 aa, Homo Sapiens
ATGDLGNTV

SEQ ID NO: 1345567 - protein, 9 aa, Homo Sapiens
GPTLGTMPE

SEQ ID NO: 1345568 - protein, 9 aa, Homo Sapiens
AWNTHHILS

SEQ ID NO: 1345569 - protein, 9 aa, Homo Sapiens
KQLYMYGVS

SEQ ID NO: 1345570 - protein, 9 aa, Homo Sapiens
ADHCIRFWN

SEQ ID NO: 1345571 - protein, 9 aa, Homo Sapiens
LEWETQALE

SEQ ID NO: 1345572 - protein, 9 aa, Homo Sapiens
ETYQVRLQQ

SEQ ID NO: 1345573 - protein, 9 aa, Homo Sapiens
KGELSLPEK

SEQ ID NO: 1345574 - protein, 9 aa, Homo Sapiens
SPVTKRCSP

SEQ ID NO: 1345575 - protein, 9 aa, Homo Sapiens
LGLENTHYQ

SEQ ID NO: 1345576 - protein, 9 aa, Homo Sapiens
TSVHTSHAT

SEQ ID NO: 1345577 - protein, 9 aa, Homo Sapiens
DGKQLVKQG

SEQ ID NO: 1345578 - protein, 9 aa, Homo Sapiens
FPKCGQKRK

SEQ ID NO: 1345579 - protein, 9 aa, Homo Sapiens
TPPKITSPL

SEQ ID NO: 1345580 - protein, 9 aa, Homo Sapiens
SQEHRCIPR

SEQ ID NO: 1345581 - protein, 9 aa, Homo Sapiens
AARNGHMRI

SEQ ID NO: 1345582 - protein, 9 aa, Homo Sapiens
KILISLATG

SEQ ID NO: 1345583 - protein, 9 aa, Homo Sapiens
KRTALQRPG

SEQ ID NO: 1345584 - protein, 9 aa, Homo Sapiens
FTGDLPPPL

SEQ ID NO: 1345585 - protein, 9 aa, Homo Sapiens
HKYALAVCL

SEQ ID NO: 1345586 - protein, 9 aa, Homo Sapiens
KQPKRCPIL

SEQ ID NO: 1345587 - protein, 9 aa, Homo Sapiens
VYLDLCCIP

SEQ ID NO: 1345588 - protein, 9 aa, Homo Sapiens
HPISELIYI

SEQ ID NO: 1345589 - protein, 9 aa, Homo Sapiens
TSAASAAEP

SEQ ID NO: 1345590 - protein, 9 aa, Homo Sapiens
TLARTQQLI

SEQ ID NO: 1345591 - protein, 9 aa, Homo Sapiens
MKVGALEGV

SEQ ID NO: 1345592 - protein, 9 aa, Homo Sapiens
EFGDVELIQ

SEQ ID NO: 1345593 - protein, 9 aa, Homo Sapiens
CIPHIIVLG

SEQ ID NO: 1345594 - protein, 9 aa, Homo Sapiens
SHYSQDMPM

SEQ ID NO: 1345595 - protein, 9 aa, Homo Sapiens
VPQQEISVV

SEQ ID NO: 1345596 - protein, 9 aa, Homo Sapiens
CQRRILLRS

SEQ ID NO: 1345597 - protein, 9 aa, Homo Sapiens
KMEGTYIAS

SEQ ID NO: 1345598 - protein, 9 aa, Homo Sapiens
QGAGVESLY

SEQ ID NO: 1345599 - protein, 9 aa, Homo Sapiens
EDLAVFVEE

SEQ ID NO: 1345600 - protein, 9 aa, Homo Sapiens
ASMAYDHYA

SEQ ID NO: 1345601 - protein, 9 aa, Homo Sapiens
DYEIGSSKI

SEQ ID NO: 1345602 - protein, 9 aa, Homo Sapiens
SAISIIMIS

SEQ ID NO: 1345603 - protein, 9 aa, Homo Sapiens
LDPSSTPVI

SEQ ID NO: 1345604 - protein, 9 aa, Homo Sapiens
GWKVITEKP

SEQ ID NO: 1345605 - protein, 9 aa, Homo Sapiens
AKAIFENML

SEQ ID NO: 1345606 - protein, 9 aa, Homo Sapiens
LVFKWDYMM

SEQ ID NO: 1345607 - protein, 9 aa, Homo Sapiens
SDDIEEAVI

SEQ ID NO: 1345608 - protein, 9 aa, Homo Sapiens
KFQHHDLIE

SEQ ID NO: 1345609 - protein, 9 aa, Homo Sapiens
TIRSLQIDS

SEQ ID NO: 1345610 - protein, 9 aa, Homo Sapiens
VLASAYTGH

SEQ ID NO: 1345611 - protein, 9 aa, Homo Sapiens
GCGWRFSCS

SEQ ID NO: 1345612 - protein, 9 aa, Homo Sapiens
SLIILMWTY

SEQ ID NO: 1345613 - protein, 9 aa, Homo Sapiens
EPGTFNNLF

SEQ ID NO: 1345614 - protein, 9 aa, Homo Sapiens
ARACFRSCK

SEQ ID NO: 1345615 - protein, 9 aa, Homo Sapiens
PVPCTEVWT

SEQ ID NO: 1345616 - protein, 9 aa, Homo Sapiens
HHFLEQHER

SEQ ID NO: 1345617 - protein, 9 aa, Homo Sapiens
IYFHTAQKS

SEQ ID NO: 1345618 - protein, 9 aa, Homo Sapiens
CYIAILSII

SEQ ID NO: 1345619 - protein, 9 aa, Homo Sapiens
DDVETEDTG

SEQ ID NO: 1345620 - protein, 9 aa, Homo Sapiens
KIGGVTEHM

SEQ ID NO: 1345621 - protein, 9 aa, Homo Sapiens
RFLTSMWRL

SEQ ID NO: 1345622 - protein, 9 aa, Homo Sapiens
KIMVYKIFH

SEQ ID NO: 1345623 - protein, 9 aa, Homo Sapiens
WQQMSLQGM

SEQ ID NO: 1345624 - protein, 9 aa, Homo Sapiens
DAASSSGQQ

SEQ ID NO: 1345625 - protein, 9 aa, Homo Sapiens
TIVYSGKMN

SEQ ID NO: 1345626 - protein, 9 aa, Homo Sapiens
KCATILDII

SEQ ID NO: 1345627 - protein, 9 aa, Homo Sapiens
DSENMLCDE

SEQ ID NO: 1345628 - protein, 9 aa, Homo Sapiens
KANRSFLVF

SEQ ID NO: 1345629 - protein, 9 aa, Homo Sapiens
PYFRTQIFL

SEQ ID NO: 1345630 - protein, 9 aa, Homo Sapiens
SPVFTFHHP

SEQ ID NO: 1345631 - protein, 9 aa, Homo Sapiens
AKCVTIMPK

SEQ ID NO: 1345632 - protein, 9 aa, Homo Sapiens
VTHLVGFPV

SEQ ID NO: 1345633 - protein, 9 aa, Homo Sapiens
LNSNTWMND

SEQ ID NO: 1345634 - protein, 9 aa, Homo Sapiens
VDSIVRQCD

SEQ ID NO: 1345635 - protein, 9 aa, Homo Sapiens
YICEYCDRA

SEQ ID NO: 1345636 - protein, 9 aa, Homo Sapiens
KWKGTANAR

SEQ ID NO: 1345637 - protein, 9 aa, Homo Sapiens
YSSVPRLLL

SEQ ID NO: 1345638 - protein, 9 aa, Homo Sapiens
APLAFQYFR

SEQ ID NO: 1345639 - protein, 9 aa, Homo Sapiens
LATDAITAA

SEQ ID NO: 1345640 - protein, 9 aa, Homo Sapiens
LRAYPIQVL

SEQ ID NO: 1345641 - protein, 9 aa, Homo Sapiens
LEKSPFKWV

SEQ ID NO: 1345642 - protein, 9 aa, Homo Sapiens
DHITVELYQ

SEQ ID NO: 1345643 - protein, 9 aa, Homo Sapiens
FVVPFGGFF

SEQ ID NO: 1345644 - protein, 9 aa, Homo Sapiens
VNMCKKCGA

SEQ ID NO: 1345645 - protein, 9 aa, Homo Sapiens
HESIIWCWS

SEQ ID NO: 1345646 - protein, 9 aa, Homo Sapiens
IVVIVFFVI

SEQ ID NO: 1345647 - protein, 9 aa, Homo Sapiens
EEVPIEPYS

SEQ ID NO: 1345648 - protein, 9 aa, Homo Sapiens
EMSTMNIDR

SEQ ID NO: 1345649 - protein, 9 aa, Homo Sapiens
PSGTVMAIG

SEQ ID NO: 1345650 - protein, 9 aa, Homo Sapiens
SRHRVHFQS

SEQ ID NO: 1345651 - protein, 9 aa, Homo Sapiens
DITLPRRDE

SEQ ID NO: 1345652 - protein, 9 aa, Homo Sapiens
SVSREDFVI

SEQ ID NO: 1345653 - protein, 9 aa, Homo Sapiens
KVGVPKGGP

SEQ ID NO: 1345654 - protein, 9 aa, Homo Sapiens
WKLLSAAGP

SEQ ID NO: 1345655 - protein, 9 aa, Homo Sapiens
PGTWMCYNL

SEQ ID NO: 1345656 - protein, 9 aa, Homo Sapiens
TSIDDVLGI

SEQ ID NO: 1345657 - protein, 9 aa, Homo Sapiens
VDKVLADDL

SEQ ID NO: 1345658 - protein, 9 aa, Homo Sapiens
RESLMSHVI

SEQ ID NO: 1345659 - protein, 9 aa, Homo Sapiens
KYSDMHTMK

SEQ ID NO: 1345660 - protein, 9 aa, Homo Sapiens
SGWNKKSVV

SEQ ID NO: 1345661 - protein, 9 aa, Homo Sapiens
SRSSQASRH

SEQ ID NO: 1345662 - protein, 9 aa, Homo Sapiens
AAQGVSQHL

SEQ ID NO: 1345663 - protein, 9 aa, Homo Sapiens
LISGLCYDS

SEQ ID NO: 1345664 - protein, 9 aa, Homo Sapiens
NARHLIVHL

SEQ ID NO: 1345665 - protein, 9 aa, Homo Sapiens
FLCISSFTP

SEQ ID NO: 1345666 - protein, 9 aa, Homo Sapiens
VKASYPKRL

SEQ ID NO: 1345667 - protein, 9 aa, Homo Sapiens
VPARYRKPL

SEQ ID NO: 1345668 - protein, 9 aa, Homo Sapiens
VMTWSMVGK

SEQ ID NO: 1345669 - protein, 9 aa, Homo Sapiens
PPAWYGNQN

SEQ ID NO: 1345670 - protein, 9 aa, Homo Sapiens
HVFAWEHNE

SEQ ID NO: 1345671 - protein, 9 aa, Homo Sapiens
QMESGYKPL

SEQ ID NO: 1345672 - protein, 9 aa, Homo Sapiens
GPSDLLTDT

SEQ ID NO: 1345673 - protein, 9 aa, Homo Sapiens
PDLNMALPV

SEQ ID NO: 1345674 - protein, 9 aa, Homo Sapiens
MVPARDSTS

SEQ ID NO: 1345675 - protein, 9 aa, Homo Sapiens
CSDFLSCSF

SEQ ID NO: 1345676 - protein, 9 aa, Homo Sapiens
TRFFAKKQI

SEQ ID NO: 1345677 - protein, 9 aa, Homo Sapiens
ASIMSGRCK

SEQ ID NO: 1345678 - protein, 9 aa, Homo Sapiens
VCGEFLQLG

SEQ ID NO: 1345679 - protein, 9 aa, Homo Sapiens
RKDLRVKMM

SEQ ID NO: 1345680 - protein, 9 aa, Homo Sapiens
SIFQQKRVC

SEQ ID NO: 1345681 - protein, 9 aa, Homo Sapiens
LGKLQPLVT

SEQ ID NO: 1345682 - protein, 9 aa, Homo Sapiens
ATDSPCIHC

SEQ ID NO: 1345683 - protein, 9 aa, Homo Sapiens
GLHRDVLLG

SEQ ID NO: 1345684 - protein, 9 aa, Homo Sapiens
SPHMTSPFI

SEQ ID NO: 1345685 - protein, 9 aa, Homo Sapiens
PRKKQIVPL

SEQ ID NO: 1345686 - protein, 9 aa, Homo Sapiens
ENDDDVYHS

SEQ ID NO: 1345687 - protein, 9 aa, Homo Sapiens
PSGTEISGQ

SEQ ID NO: 1345688 - protein, 9 aa, Homo Sapiens
GHSTPQMSA

SEQ ID NO: 1345689 - protein, 9 aa, Homo Sapiens
AGKILWAHQ

SEQ ID NO: 1345690 - protein, 9 aa, Homo Sapiens
NETIWYVHF

SEQ ID NO: 1345691 - protein, 9 aa, Homo Sapiens
TFAHTDLSG

SEQ ID NO: 1345692 - protein, 9 aa, Homo Sapiens
VLAWGTFAQ

SEQ ID NO: 1345693 - protein, 9 aa, Homo Sapiens
KDQLMAVTY

SEQ ID NO: 1345694 - protein, 9 aa, Homo Sapiens
TVSHLDWTA

SEQ ID NO: 1345695 - protein, 9 aa, Homo Sapiens
GCRCAPVMS

SEQ ID NO: 1345696 - protein, 9 aa, Homo Sapiens
ESSANNIVW

SEQ ID NO: 1345697 - protein, 9 aa, Homo Sapiens
GLAPFTLKS

SEQ ID NO: 1345698 - protein, 9 aa, Homo Sapiens
GPEENSTYE

SEQ ID NO: 1345699 - protein, 9 aa, Homo Sapiens
SCPSQLGAV

SEQ ID NO: 1345700 - protein, 9 aa, Homo Sapiens
SLVRETSHI

SEQ ID NO: 1345701 - protein, 9 aa, Homo Sapiens
SFTSLAALS

SEQ ID NO: 1345702 - protein, 9 aa, Homo Sapiens
QMAVELLFR

SEQ ID NO: 1345703 - protein, 9 aa, Homo Sapiens
NAKCKLSDD

SEQ ID NO: 1345704 - protein, 9 aa, Homo Sapiens
IMMIYLLPR

SEQ ID NO: 1345705 - protein, 9 aa, Homo Sapiens
PVTIILISD

SEQ ID NO: 1345706 - protein, 9 aa, Homo Sapiens
TTVTMTRAT

SEQ ID NO: 1345707 - protein, 9 aa, Homo Sapiens
DVARGIAIH

SEQ ID NO: 1345708 - protein, 9 aa, Homo Sapiens
GLMNGYWGP

SEQ ID NO: 1345709 - protein, 9 aa, Homo Sapiens
KNNDSKLEE

SEQ ID NO: 1345710 - protein, 9 aa, Homo Sapiens
CNTLQLHRY

SEQ ID NO: 1345711 - protein, 9 aa, Homo Sapiens
LAFSSSFSL

SEQ ID NO: 1345712 - protein, 9 aa, Homo Sapiens
VTCLERWHR

SEQ ID NO: 1345713 - protein, 9 aa, Homo Sapiens
PGTVLVGSQ

SEQ ID NO: 1345714 - protein, 9 aa, Homo Sapiens
IYYCMCCGD

SEQ ID NO: 1345715 - protein, 9 aa, Homo Sapiens
DSLTSQQSV

SEQ ID NO: 1345716 - protein, 9 aa, Homo Sapiens
EGNMCKKFE

SEQ ID NO: 1345717 - protein, 9 aa, Homo Sapiens
YVTLLTLLI

SEQ ID NO: 1345718 - protein, 9 aa, Homo Sapiens
AWGMHEFLT

SEQ ID NO: 1345719 - protein, 9 aa, Homo Sapiens
PWNTASLIF

SEQ ID NO: 1345720 - protein, 9 aa, Homo Sapiens
TGEVAKEWQ

SEQ ID NO: 1345721 - protein, 9 aa, Homo Sapiens
HKEAVSARG

SEQ ID NO: 1345722 - protein, 9 aa, Homo Sapiens
VAGLIFYLI

SEQ ID NO: 1345723 - protein, 9 aa, Homo Sapiens
VYDNVREYL

SEQ ID NO: 1345724 - protein, 9 aa, Homo Sapiens
DVSESPELS

SEQ ID NO: 1345725 - protein, 9 aa, Homo Sapiens
ISQSSSNEY

SEQ ID NO: 1345726 - protein, 9 aa, Homo Sapiens
HDYRIQYHK

SEQ ID NO: 1345727 - protein, 9 aa, Homo Sapiens
YPEVGDLCV

SEQ ID NO: 1345728 - protein, 9 aa, Homo Sapiens
KSLDSALKP

SEQ ID NO: 1345729 - protein, 9 aa, Homo Sapiens
LPVLVSCGS

SEQ ID NO: 1345730 - protein, 9 aa, Homo Sapiens
WRPTAIRQT

SEQ ID NO: 1345731 - protein, 9 aa, Homo Sapiens
LGHNDPTDF

SEQ ID NO: 1345732 - protein, 9 aa, Homo Sapiens
WVLLYVQGV

SEQ ID NO: 1345733 - protein, 9 aa, Homo Sapiens
KDAPLHYAG

SEQ ID NO: 1345734 - protein, 9 aa, Homo Sapiens
TDVAFCMGF

SEQ ID NO: 1345735 - protein, 9 aa, Homo Sapiens
PEPFHSKVL

SEQ ID NO: 1345736 - protein, 9 aa, Homo Sapiens
TAVMSLIQV

SEQ ID NO: 1345737 - protein, 9 aa, Homo Sapiens
QELRKWGSP

SEQ ID NO: 1345738 - protein, 9 aa, Homo Sapiens
RACPPDVYA

SEQ ID NO: 1345739 - protein, 9 aa, Homo Sapiens
EELLHLWQP

SEQ ID NO: 1345740 - protein, 9 aa, Homo Sapiens
LLPTEQHIL

SEQ ID NO: 1345741 - protein, 9 aa, Homo Sapiens
RKIMGVEED

SEQ ID NO: 1345742 - protein, 9 aa, Homo Sapiens
HFFSLPDGE

SEQ ID NO: 1345743 - protein, 9 aa, Homo Sapiens
TSSCTGAST

SEQ ID NO: 1345744 - protein, 9 aa, Homo Sapiens
SQHTQFEYP

SEQ ID NO: 1345745 - protein, 9 aa, Homo Sapiens
PHNIFKRDD

SEQ ID NO: 1345746 - protein, 9 aa, Homo Sapiens
MHILVRCIH

SEQ ID NO: 1345747 - protein, 9 aa, Homo Sapiens
LFNSLSGEG

SEQ ID NO: 1345748 - protein, 9 aa, Homo Sapiens
TRGCLLHNC

SEQ ID NO: 1345749 - protein, 9 aa, Homo Sapiens
GPNEVDSFI

SEQ ID NO: 1345750 - protein, 9 aa, Homo Sapiens
FQSFFSLIV

SEQ ID NO: 1345751 - protein, 9 aa, Homo Sapiens
MQPVVLVGP

SEQ ID NO: 1345752 - protein, 9 aa, Homo Sapiens
ASFYAHFFL

SEQ ID NO: 1345753 - protein, 9 aa, Homo Sapiens
SHHTILYPF

SEQ ID NO: 1345754 - protein, 9 aa, Homo Sapiens
CKANPQDKV

SEQ ID NO: 1345755 - protein, 9 aa, Homo Sapiens
RRHRSFSGA

SEQ ID NO: 1345756 - protein, 9 aa, Homo Sapiens
ARDNPHSHH

SEQ ID NO: 1345757 - protein, 9 aa, Homo Sapiens
LHVTYEGII

SEQ ID NO: 1345758 - protein, 9 aa, Homo Sapiens
RWIIEVVKA

SEQ ID NO: 1345759 - protein, 9 aa, Homo Sapiens
KGKAGGHVK

SEQ ID NO: 1345760 - protein, 9 aa, Homo Sapiens
HFIHRDLTA

SEQ ID NO: 1345761 - protein, 9 aa, Homo Sapiens
WLHIDAHLL

SEQ ID NO: 1345762 - protein, 9 aa, Homo Sapiens
IETVVPNSP

SEQ ID NO: 1345763 - protein, 9 aa, Homo Sapiens
PRESHPSTL

SEQ ID NO: 1345764 - protein, 9 aa, Homo Sapiens
RTANEIYKK

SEQ ID NO: 1345765 - protein, 9 aa, Homo Sapiens
EESKQLQIQ

SEQ ID NO: 1345766 - protein, 9 aa, Homo Sapiens
QLKVSVKNY

SEQ ID NO: 1345767 - protein, 9 aa, Homo Sapiens
SPQCIPATA

SEQ ID NO: 1345768 - protein, 9 aa, Homo Sapiens
HDSGIKANI

SEQ ID NO: 1345769 - protein, 9 aa, Homo Sapiens
KSFLMEGYK

SEQ ID NO: 1345770 - protein, 9 aa, Homo Sapiens
KLQSLSHRL

SEQ ID NO: 1345771 - protein, 9 aa, Homo Sapiens
KCEECGNTF

SEQ ID NO: 1345772 - protein, 9 aa, Homo Sapiens
AVIHDVDHP

SEQ ID NO: 1345773 - protein, 9 aa, Homo Sapiens
EHYTNLYDI

SEQ ID NO: 1345774 - protein, 9 aa, Homo Sapiens
AQCRTYFTP

SEQ ID NO: 1345775 - protein, 9 aa, Homo Sapiens
SFLITHIIF

SEQ ID NO: 1345776 - protein, 9 aa, Homo Sapiens
ALLTTGSLC

SEQ ID NO: 1345777 - protein, 9 aa, Homo Sapiens
IHDEQANPQ

SEQ ID NO: 1345778 - protein, 9 aa, Homo Sapiens
VHMKTHNGE

SEQ ID NO: 1345779 - protein, 9 aa, Homo Sapiens
GEFVEYHKI

SEQ ID NO: 1345780 - protein, 9 aa, Homo Sapiens
LMIYISMAV

SEQ ID NO: 1345781 - protein, 9 aa, Homo Sapiens
AHMRLETRT

SEQ ID NO: 1345782 - protein, 9 aa, Homo Sapiens
NRSLEESPY

SEQ ID NO: 1345783 - protein, 9 aa, Homo Sapiens
INDNIYIAQ

SEQ ID NO: 1345784 - protein, 9 aa, Homo Sapiens
RLLDGTFKL

SEQ ID NO: 1345785 - protein, 9 aa, Homo Sapiens
SKTKETGKI

SEQ ID NO: 1345786 - protein, 9 aa, Homo Sapiens
VLIFALALV

SEQ ID NO: 1345787 - protein, 9 aa, Homo Sapiens
GDLKLRKFI

SEQ ID NO: 1345788 - protein, 9 aa, Homo Sapiens
NPVVYTLIN

SEQ ID NO: 1345789 - protein, 9 aa, Homo Sapiens
CVAAHESII

SEQ ID NO: 1345790 - protein, 9 aa, Homo Sapiens
HFCYPCSLF

SEQ ID NO: 1345791 - protein, 9 aa, Homo Sapiens
YILATWAVP

SEQ ID NO: 1345792 - protein, 9 aa, Homo Sapiens
QEQTDFTYD

SEQ ID NO: 1345793 - protein, 9 aa, Homo Sapiens
GKSVRLRLS

SEQ ID NO: 1345794 - protein, 9 aa, Homo Sapiens
PTVHGLLRQ

SEQ ID NO: 1345795 - protein, 9 aa, Homo Sapiens
NYRTIEESS

SEQ ID NO: 1345796 - protein, 9 aa, Homo Sapiens
CQLQKATCH

SEQ ID NO: 1345797 - protein, 9 aa, Homo Sapiens
SYSQIPRCQ

SEQ ID NO: 1345798 - protein, 9 aa, Homo Sapiens
IFLDNCFLL

SEQ ID NO: 1345799 - protein, 9 aa, Homo Sapiens
TWEGTGPSI

SEQ ID NO: 1345800 - protein, 9 aa, Homo Sapiens
VVTFHSPYW

SEQ ID NO: 1345801 - protein, 9 aa, Homo Sapiens
FHLYLFFCF

SEQ ID NO: 1345802 - protein, 9 aa, Homo Sapiens
FMVSILKGY

SEQ ID NO: 1345803 - protein, 9 aa, Homo Sapiens
TRARSPSSA

SEQ ID NO: 1345804 - protein, 9 aa, Homo Sapiens
WTSSSKINV

SEQ ID NO: 1345805 - protein, 9 aa, Homo Sapiens
PKNMLVTLC

SEQ ID NO: 1345806 - protein, 9 aa, Homo Sapiens
NEEHLRQAV

SEQ ID NO: 1345807 - protein, 9 aa, Homo Sapiens
KLALKNNPP

SEQ ID NO: 1345808 - protein, 9 aa, Homo Sapiens
VSRPHRCEL

SEQ ID NO: 1345809 - protein, 9 aa, Homo Sapiens
RVDLPIKLA

SEQ ID NO: 1345810 - protein, 9 aa, Homo Sapiens
QWPTVHGLL

SEQ ID NO: 1345811 - protein, 9 aa, Homo Sapiens
SSCTSASTP

SEQ ID NO: 1345812 - protein, 9 aa, Homo Sapiens
WLTSLYKGG

SEQ ID NO: 1345813 - protein, 9 aa, Homo Sapiens
LCKVDSDLN

SEQ ID NO: 1345814 - protein, 9 aa, Homo Sapiens
GPEATIQIA

SEQ ID NO: 1345815 - protein, 9 aa, Homo Sapiens
GFQRLVLSR

SEQ ID NO: 1345816 - protein, 9 aa, Homo Sapiens
LLQAVFFIL

SEQ ID NO: 1345817 - protein, 9 aa, Homo Sapiens
HFFLSYLPF

SEQ ID NO: 1345818 - protein, 9 aa, Homo Sapiens
LGRGRGREE

SEQ ID NO: 1345819 - protein, 9 aa, Homo Sapiens
LCDEEPSQL

SEQ ID NO: 1345820 - protein, 9 aa, Homo Sapiens
VGFTVLSAE

SEQ ID NO: 1345821 - protein, 9 aa, Homo Sapiens
ERAKVCLRR

SEQ ID NO: 1345822 - protein, 9 aa, Homo Sapiens
CGWLDLILL

SEQ ID NO: 1345823 - protein, 9 aa, Homo Sapiens
KQDSKEANT

SEQ ID NO: 1345824 - protein, 9 aa, Homo Sapiens
PTEHRCLVT

SEQ ID NO: 1345825 - protein, 9 aa, Homo Sapiens
KGLYTDTEM

SEQ ID NO: 1345826 - protein, 9 aa, Homo Sapiens
KEKKNDKEE

SEQ ID NO: 1345827 - protein, 9 aa, Homo Sapiens
IFLEKNKMY

SEQ ID NO: 1345828 - protein, 9 aa, Homo Sapiens
PGPPHPHPH

SEQ ID NO: 1345829 - protein, 9 aa, Homo Sapiens
FMCAAVSFI

SEQ ID NO: 1345830 - protein, 9 aa, Homo Sapiens
AHKVYPLVC

SEQ ID NO: 1345831 - protein, 9 aa, Homo Sapiens
FKYLCITAK

SEQ ID NO: 1345832 - protein, 9 aa, Homo Sapiens
LPQEFGDVE

SEQ ID NO: 1345833 - protein, 9 aa, Homo Sapiens
TQKPGFPKC

SEQ ID NO: 1345834 - protein, 9 aa, Homo Sapiens
CLRMRPPRS

SEQ ID NO: 1345835 - protein, 9 aa, Homo Sapiens
FDEDRFRFV

SEQ ID NO: 1345836 - protein, 9 aa, Homo Sapiens
IRARLVFRV

SEQ ID NO: 1345837 - protein, 9 aa, Homo Sapiens
MLRFEPSAH

SEQ ID NO: 1345838 - protein, 9 aa, Homo Sapiens
STAASVGRP

SEQ ID NO: 1345839 - protein, 9 aa, Homo Sapiens
NHQQNTIQK

SEQ ID NO: 1345840 - protein, 9 aa, Homo Sapiens
CVFSVGTHA

SEQ ID NO: 1345841 - protein, 9 aa, Homo Sapiens
GIPDGVCSK

SEQ ID NO: 1345842 - protein, 9 aa, Homo Sapiens
SGQHDLDLR

SEQ ID NO: 1345843 - protein, 9 aa, Homo Sapiens
HIGCRFDDI

SEQ ID NO: 1345844 - protein, 9 aa, Homo Sapiens
QVFYNDPSV

SEQ ID NO: 1345845 - protein, 9 aa, Homo Sapiens
PGTFLIQAH

SEQ ID NO: 1345846 - protein, 9 aa, Homo Sapiens
RWLLYNLEM

SEQ ID NO: 1345847 - protein, 9 aa, Homo Sapiens
HRKDLEIMQ

SEQ ID NO: 1345848 - protein, 9 aa, Homo Sapiens
RAHTGEKTY

SEQ ID NO: 1345849 - protein, 9 aa, Homo Sapiens
AAEHIQVGY

SEQ ID NO: 1345850 - protein, 9 aa, Homo Sapiens
RNIWVGDGD

SEQ ID NO: 1345851 - protein, 9 aa, Homo Sapiens
PLPPTNFLD

SEQ ID NO: 1345852 - protein, 9 aa, Homo Sapiens
HKDVLQEME

SEQ ID NO: 1345853 - protein, 9 aa, Homo Sapiens
MSHVIELKS

SEQ ID NO: 1345854 - protein, 9 aa, Homo Sapiens
FALLTQCNR

SEQ ID NO: 1345855 - protein, 9 aa, Homo Sapiens
TKIFYNITG

SEQ ID NO: 1345856 - protein, 9 aa, Homo Sapiens
AAELEDCRQ

SEQ ID NO: 1345857 - protein, 9 aa, Homo Sapiens
LMAEVLAMI

SEQ ID NO: 1345858 - protein, 9 aa, Homo Sapiens
IVIRGRSRK

SEQ ID NO: 1345859 - protein, 9 aa, Homo Sapiens
PGPPLPTRG

SEQ ID NO: 1345860 - protein, 9 aa, Homo Sapiens
RRRAPPRSG

SEQ ID NO: 1345861 - protein, 9 aa, Homo Sapiens
EKYDKMCND

SEQ ID NO: 1345862 - protein, 9 aa, Homo Sapiens
QEAKKGLLR

SEQ ID NO: 1345863 - protein, 9 aa, Homo Sapiens
TGKVPEVVA

SEQ ID NO: 1345864 - protein, 9 aa, Homo Sapiens
YSPNSSPGP

SEQ ID NO: 1345865 - protein, 9 aa, Homo Sapiens
LHGKTIEIG

SEQ ID NO: 1345866 - protein, 9 aa, Homo Sapiens
RRGMRALQG

SEQ ID NO: 1345867 - protein, 9 aa, Homo Sapiens
GCVASQCQT

SEQ ID NO: 1345868 - protein, 9 aa, Homo Sapiens
LHTSSSTMY

SEQ ID NO: 1345869 - protein, 9 aa, Homo Sapiens
PSRLVGQIN

SEQ ID NO: 1345870 - protein, 9 aa, Homo Sapiens
GGINTGVAK

SEQ ID NO: 1345871 - protein, 9 aa, Homo Sapiens
RHRQVKHYH

SEQ ID NO: 1345872 - protein, 9 aa, Homo Sapiens
TDVLGTEAY

SEQ ID NO: 1345873 - protein, 9 aa, Homo Sapiens
HRVSEPDLT

SEQ ID NO: 1345874 - protein, 9 aa, Homo Sapiens
TILKRFFLL

SEQ ID NO: 1345875 - protein, 9 aa, Homo Sapiens
GVICHVGDA

SEQ ID NO: 1345876 - protein, 9 aa, Homo Sapiens
ETRKSQILK

SEQ ID NO: 1345877 - protein, 9 aa, Homo Sapiens
YYGWDGGKV

SEQ ID NO: 1345878 - protein, 9 aa, Homo Sapiens
SSSDSSTSS

SEQ ID NO: 1345879 - protein, 9 aa, Homo Sapiens
QEDPWCVAK

SEQ ID NO: 1345880 - protein, 9 aa, Homo Sapiens
IPKNMLVTL

SEQ ID NO: 1345881 - protein, 9 aa, Homo Sapiens
GLLVNEISH

SEQ ID NO: 1345882 - protein, 9 aa, Homo Sapiens
WALIAEPRM

SEQ ID NO: 1345883 - protein, 9 aa, Homo Sapiens
ATGVVGPGG

SEQ ID NO: 1345884 - protein, 9 aa, Homo Sapiens
PQPHLCREL

SEQ ID NO: 1345885 - protein, 9 aa, Homo Sapiens
DPKRLRPED

SEQ ID NO: 1345886 - protein, 9 aa, Homo Sapiens
RTHGRWKYS

SEQ ID NO: 1345887 - protein, 9 aa, Homo Sapiens
VCRSNKNPW

SEQ ID NO: 1345888 - protein, 9 aa, Homo Sapiens
SASTSVPKN

SEQ ID NO: 1345889 - protein, 9 aa, Homo Sapiens
KNLSRGGKA

SEQ ID NO: 1345890 - protein, 9 aa, Homo Sapiens
DKDEGTFDR

SEQ ID NO: 1345891 - protein, 9 aa, Homo Sapiens
NLTQQWVVF

SEQ ID NO: 1345892 - protein, 9 aa, Homo Sapiens
SGKAMERAD

SEQ ID NO: 1345893 - protein, 9 aa, Homo Sapiens
QDFEEMKHE

SEQ ID NO: 1345894 - protein, 9 aa, Homo Sapiens
WPPGPRYPP

SEQ ID NO: 1345895 - protein, 9 aa, Homo Sapiens
SVRKALDSN

SEQ ID NO: 1345896 - protein, 9 aa, Homo Sapiens
KVLHTIRMT

SEQ ID NO: 1345897 - protein, 9 aa, Homo Sapiens
HTGYVHWKG

SEQ ID NO: 1345898 - protein, 9 aa, Homo Sapiens
WHNTCFICA

SEQ ID NO: 1345899 - protein, 9 aa, Homo Sapiens
TANRISGTR

SEQ ID NO: 1345900 - protein, 9 aa, Homo Sapiens
FNLFMLVLG

SEQ ID NO: 1345901 - protein, 9 aa, Homo Sapiens
KKKSPKSVS

SEQ ID NO: 1345902 - protein, 9 aa, Homo Sapiens
KMCAHLFTA

SEQ ID NO: 1345903 - protein, 9 aa, Homo Sapiens
AIRHRPSLY

SEQ ID NO: 1345904 - protein, 9 aa, Homo Sapiens
TSVQNMLNW

SEQ ID NO: 1345905 - protein, 9 aa, Homo Sapiens
CSILPYLAL

SEQ ID NO: 1345906 - protein, 9 aa, Homo Sapiens
TGSLHIGHT

SEQ ID NO: 1345907 - protein, 9 aa, Homo Sapiens
GNETAALFL

SEQ ID NO: 1345908 - protein, 9 aa, Homo Sapiens
SSSPVFTFH

SEQ ID NO: 1345909 - protein, 9 aa, Homo Sapiens
GSGGRRRRS

SEQ ID NO: 1345910 - protein, 9 aa, Homo Sapiens
DTQLGTVIA

SEQ ID NO: 1345911 - protein, 9 aa, Homo Sapiens
PDTLPLRSA

SEQ ID NO: 1345912 - protein, 9 aa, Homo Sapiens
SHYYRAPEL

SEQ ID NO: 1345913 - protein, 9 aa, Homo Sapiens
TCEVSYCDC

SEQ ID NO: 1345914 - protein, 9 aa, Homo Sapiens
ILNFHTTFV

SEQ ID NO: 1345915 - protein, 9 aa, Homo Sapiens
KPMPKNKHK

SEQ ID NO: 1345916 - protein, 9 aa, Homo Sapiens
SPCSPTTPS

SEQ ID NO: 1345917 - protein, 9 aa, Homo Sapiens
ENNSPTLHI

SEQ ID NO: 1345918 - protein, 9 aa, Homo Sapiens
PIEPYSIPL

SEQ ID NO: 1345919 - protein, 9 aa, Homo Sapiens
YSRKGFCSV

SEQ ID NO: 1345920 - protein, 9 aa, Homo Sapiens
SIMALNPRT

SEQ ID NO: 1345921 - protein, 9 aa, Homo Sapiens
DAKSLHIVE

SEQ ID NO: 1345922 - protein, 9 aa, Homo Sapiens
GIKANISMK

SEQ ID NO: 1345923 - protein, 9 aa, Homo Sapiens
AFQHNTVLT

SEQ ID NO: 1345924 - protein, 9 aa, Homo Sapiens
GMGNLRVAK

SEQ ID NO: 1345925 - protein, 9 aa, Homo Sapiens
PKRQCLSHS

SEQ ID NO: 1345926 - protein, 9 aa, Homo Sapiens
DNKSHVDLH

SEQ ID NO: 1345927 - protein, 9 aa, Homo Sapiens
DPQMSGQPP

SEQ ID NO: 1345928 - protein, 9 aa, Homo Sapiens
TEKQKKKTV

SEQ ID NO: 1345929 - protein, 9 aa, Homo Sapiens
PRMIHDLTK

SEQ ID NO: 1345930 - protein, 9 aa, Homo Sapiens
LEKRYLRMT

SEQ ID NO: 1345931 - protein, 9 aa, Homo Sapiens
QTHEMIHTG

SEQ ID NO: 1345932 - protein, 9 aa, Homo Sapiens
EDEGFQAAH

SEQ ID NO: 1345933 - protein, 9 aa, Homo Sapiens
AGVLEHLNT

SEQ ID NO: 1345934 - protein, 9 aa, Homo Sapiens
HQTTIWRRL

SEQ ID NO: 1345935 - protein, 9 aa, Homo Sapiens
GICHQDIKP

SEQ ID NO: 1345936 - protein, 9 aa, Homo Sapiens
AAGECAHNA

SEQ ID NO: 1345937 - protein, 9 aa, Homo Sapiens
FKHLLELRK

SEQ ID NO: 1345938 - protein, 9 aa, Homo Sapiens
MGLSNPEEV

SEQ ID NO: 1345939 - protein, 9 aa, Homo Sapiens
ASRPPVHIE

SEQ ID NO: 1345940 - protein, 9 aa, Homo Sapiens
ADTLQGALE

SEQ ID NO: 1345941 - protein, 9 aa, Homo Sapiens
GLSTFYLSY

SEQ ID NO: 1345942 - protein, 9 aa, Homo Sapiens
QEVCDLVLC

SEQ ID NO: 1345943 - protein, 9 aa, Homo Sapiens
DGTSKGCTF

SEQ ID NO: 1345944 - protein, 9 aa, Homo Sapiens
KHLEKVHVV

SEQ ID NO: 1345945 - protein, 9 aa, Homo Sapiens
APLGYPFPS

SEQ ID NO: 1345946 - protein, 9 aa, Homo Sapiens
GKLNAVISF

SEQ ID NO: 1345947 - protein, 9 aa, Homo Sapiens
LMSCTEASR

SEQ ID NO: 1345948 - protein, 9 aa, Homo Sapiens
FIDRPNTYF

SEQ ID NO: 1345949 - protein, 9 aa, Homo Sapiens
DWGLFDKSA

SEQ ID NO: 1345950 - protein, 9 aa, Homo Sapiens
PHELGDFTA

SEQ ID NO: 1345951 - protein, 9 aa, Homo Sapiens
EEEDGEAGT

SEQ ID NO: 1345952 - protein, 9 aa, Homo Sapiens
LWKEKEAFE

SEQ ID NO: 1345953 - protein, 9 aa, Homo Sapiens
EGTYIASEH

SEQ ID NO: 1345954 - protein, 9 aa, Homo Sapiens
VMYRSNRMN

SEQ ID NO: 1345955 - protein, 9 aa, Homo Sapiens
NRPSMDFNA

SEQ ID NO: 1345956 - protein, 9 aa, Homo Sapiens
TKHNQVEAA

SEQ ID NO: 1345957 - protein, 9 aa, Homo Sapiens
LLVSPSSAF

SEQ ID NO: 1345958 - protein, 9 aa, Homo Sapiens
MTAEAHRRM

SEQ ID NO: 1345959 - protein, 9 aa, Homo Sapiens
INTGVAKHV

SEQ ID NO: 1345960 - protein, 9 aa, Homo Sapiens
CMKREVDEA

SEQ ID NO: 1345961 - protein, 9 aa, Homo Sapiens
VKTAVMSLI

SEQ ID NO: 1345962 - protein, 9 aa, Homo Sapiens
PEKDTMDIE

SEQ ID NO: 1345963 - protein, 9 aa, Homo Sapiens
LRNAIMKKQ

SEQ ID NO: 1345964 - protein, 9 aa, Homo Sapiens
AVDPNDLYL

SEQ ID NO: 1345965 - protein, 9 aa, Homo Sapiens
GQKHQRRGR

SEQ ID NO: 1345966 - protein, 9 aa, Homo Sapiens
ECYPDNPVN

SEQ ID NO: 1345967 - protein, 9 aa, Homo Sapiens
YYDTIKYKG

SEQ ID NO: 1345968 - protein, 9 aa, Homo Sapiens
QAVTVTVMG

SEQ ID NO: 1345969 - protein, 9 aa, Homo Sapiens
LTETINEVS

SEQ ID NO: 1345970 - protein, 9 aa, Homo Sapiens
GCMLQIRNM

SEQ ID NO: 1345971 - protein, 9 aa, Homo Sapiens
GGKLRTHIC

SEQ ID NO: 1345972 - protein, 9 aa, Homo Sapiens
YFSELSVTE

SEQ ID NO: 1345973 - protein, 9 aa, Homo Sapiens
RGSCVVALH

SEQ ID NO: 1345974 - protein, 9 aa, Homo Sapiens
AQAEARHPV

SEQ ID NO: 1345975 - protein, 9 aa, Homo Sapiens
WERAILSTK

SEQ ID NO: 1345976 - protein, 9 aa, Homo Sapiens
QRELERNYY

SEQ ID NO: 1345977 - protein, 9 aa, Homo Sapiens
GGAHIPFRV

SEQ ID NO: 1345978 - protein, 9 aa, Homo Sapiens
VTIDHFKEV

SEQ ID NO: 1345979 - protein, 9 aa, Homo Sapiens
CLCVTTKTH

SEQ ID NO: 1345980 - protein, 9 aa, Homo Sapiens
TGQGTNTSE

SEQ ID NO: 1345981 - protein, 9 aa, Homo Sapiens
NIDKAREII

SEQ ID NO: 1345982 - protein, 9 aa, Homo Sapiens
LKSVMNQVM

SEQ ID NO: 1345983 - protein, 9 aa, Homo Sapiens
GIQEPGSEV

SEQ ID NO: 1345984 - protein, 9 aa, Homo Sapiens
TVEDFEMID

SEQ ID NO: 1345985 - protein, 9 aa, Homo Sapiens
NYMCQQLLL

SEQ ID NO: 1345986 - protein, 9 aa, Homo Sapiens
GLAHCPGMP

SEQ ID NO: 1345987 - protein, 9 aa, Homo Sapiens
TINTSCHPA

SEQ ID NO: 1345988 - protein, 9 aa, Homo Sapiens
YSILSLKTL

SEQ ID NO: 1345989 - protein, 9 aa, Homo Sapiens
LCSVSNSEQ

SEQ ID NO: 1345990 - protein, 9 aa, Homo Sapiens
KHYHIFRLP

SEQ ID NO: 1345991 - protein, 9 aa, Homo Sapiens
DSMYDKLRM

SEQ ID NO: 1345992 - protein, 9 aa, Homo Sapiens
VGQLSLADT

SEQ ID NO: 1345993 - protein, 9 aa, Homo Sapiens
CKKIPSNNI

SEQ ID NO: 1345994 - protein, 9 aa, Homo Sapiens
WKNYELRIF

SEQ ID NO: 1345995 - protein, 9 aa, Homo Sapiens
SLYSGQNSS

SEQ ID NO: 1345996 - protein, 9 aa, Homo Sapiens
YVSMTFITV

SEQ ID NO: 1345997 - protein, 9 aa, Homo Sapiens
YNTEGGVCA

SEQ ID NO: 1345998 - protein, 9 aa, Homo Sapiens
NKLKKMCAH

SEQ ID NO: 1345999 - protein, 9 aa, Homo Sapiens
TLMRLSKPL

SEQ ID NO: 1346000 - protein, 9 aa, Homo Sapiens
VVSGRAYPA

SEQ ID NO: 1346001 - protein, 9 aa, Homo Sapiens
EDDCWPVEP

SEQ ID NO: 1346002 - protein, 9 aa, Homo Sapiens
GDGLTVKAS

SEQ ID NO: 1346003 - protein, 9 aa, Homo Sapiens
DVVDSKRCS

SEQ ID NO: 1346004 - protein, 9 aa, Homo Sapiens
LFLCISSFT

SEQ ID NO: 1346005 - protein, 9 aa, Homo Sapiens
IGRAITSLR

SEQ ID NO: 1346006 - protein, 9 aa, Homo Sapiens
IYPVLSRLL

SEQ ID NO: 1346007 - protein, 9 aa, Homo Sapiens
RRQNQCRFS

SEQ ID NO: 1346008 - protein, 9 aa, Homo Sapiens
RHPTIVLDL

SEQ ID NO: 1346009 - protein, 9 aa, Homo Sapiens
SKLNRSKHL

SEQ ID NO: 1346010 - protein, 9 aa, Homo Sapiens
LMHQSKGLE

SEQ ID NO: 1346011 - protein, 9 aa, Homo Sapiens
EKMRTQVRG

SEQ ID NO: 1346012 - protein, 9 aa, Homo Sapiens
RGFDEDKDD

SEQ ID NO: 1346013 - protein, 9 aa, Homo Sapiens
EEGVPDLVH

SEQ ID NO: 1346014 - protein, 9 aa, Homo Sapiens
HDYRDCEGR

SEQ ID NO: 1346015 - protein, 9 aa, Homo Sapiens
RQHSVNEGA

SEQ ID NO: 1346016 - protein, 9 aa, Homo Sapiens
KLILSTQDG

SEQ ID NO: 1346017 - protein, 9 aa, Homo Sapiens
PQLTSVLTL

SEQ ID NO: 1346018 - protein, 9 aa, Homo Sapiens
EPLPAWGHE

SEQ ID NO: 1346019 - protein, 9 aa, Homo Sapiens
ELEEFMNKF

SEQ ID NO: 1346020 - protein, 9 aa, Homo Sapiens
QHTSGQKLA

SEQ ID NO: 1346021 - protein, 9 aa, Homo Sapiens
AHVVPASVP

SEQ ID NO: 1346022 - protein, 9 aa, Homo Sapiens
SENSFEYGP

SEQ ID NO: 1346023 - protein, 9 aa, Homo Sapiens
SLLENGIIH

SEQ ID NO: 1346024 - protein, 9 aa, Homo Sapiens
ANQEVSPPV

SEQ ID NO: 1346025 - protein, 9 aa, Homo Sapiens
DTECCLLTA

SEQ ID NO: 1346026 - protein, 9 aa, Homo Sapiens
PVSQDMFDN

SEQ ID NO: 1346027 - protein, 9 aa, Homo Sapiens
DLDQVRKHL

SEQ ID NO: 1346028 - protein, 9 aa, Homo Sapiens
SCKKQAASM

SEQ ID NO: 1346029 - protein, 9 aa, Homo Sapiens
LIILLLWKY

SEQ ID NO: 1346030 - protein, 9 aa, Homo Sapiens
KDLTLHNRS

SEQ ID NO: 1346031 - protein, 9 aa, Homo Sapiens
NHTSLELCW

SEQ ID NO: 1346032 - protein, 9 aa, Homo Sapiens
FTRTYEPDS

SEQ ID NO: 1346033 - protein, 9 aa, Homo Sapiens
LFPVVNTQL

SEQ ID NO: 1346034 - protein, 9 aa, Homo Sapiens
MPHGQLEKS

SEQ ID NO: 1346035 - protein, 9 aa, Homo Sapiens
YTAAPLPGF

SEQ ID NO: 1346036 - protein, 9 aa, Homo Sapiens
SNPSSCDSS

SEQ ID NO: 1346037 - protein, 9 aa, Homo Sapiens
PAKGELSLP

SEQ ID NO: 1346038 - protein, 9 aa, Homo Sapiens
ALDTLCKHL

SEQ ID NO: 1346039 - protein, 9 aa, Homo Sapiens
ETIYIVGGV

SEQ ID NO: 1346040 - protein, 9 aa, Homo Sapiens
ELTAEKLDF

SEQ ID NO: 1346041 - protein, 9 aa, Homo Sapiens
VYPLVCQCL

SEQ ID NO: 1346042 - protein, 9 aa, Homo Sapiens
ISENCEMST

SEQ ID NO: 1346043 - protein, 9 aa, Homo Sapiens
ELPVRLTNI

SEQ ID NO: 1346044 - protein, 9 aa, Homo Sapiens
YCVDENMER

SEQ ID NO: 1346045 - protein, 9 aa, Homo Sapiens
MFVDSYDMI

SEQ ID NO: 1346046 - protein, 9 aa, Homo Sapiens
QVSSNLLAL

SEQ ID NO: 1346047 - protein, 9 aa, Homo Sapiens
YVDTEIKFL

SEQ ID NO: 1346048 - protein, 9 aa, Homo Sapiens
IKDEDQTSL

SEQ ID NO: 1346049 - protein, 9 aa, Homo Sapiens
QLGMLMEII

SEQ ID NO: 1346050 - protein, 9 aa, Homo Sapiens
CGAPGPAGP

SEQ ID NO: 1346051 - protein, 9 aa, Homo Sapiens
HLTQFHGDS

SEQ ID NO: 1346052 - protein, 9 aa, Homo Sapiens
YTLLNCRGV

SEQ ID NO: 1346053 - protein, 9 aa, Homo Sapiens
CHINSLWTT

SEQ ID NO: 1346054 - protein, 9 aa, Homo Sapiens
MDRDSDGKL

SEQ ID NO: 1346055 - protein, 9 aa, Homo Sapiens
SKVLLKPIT

SEQ ID NO: 1346056 - protein, 9 aa, Homo Sapiens
VTAMMSKLR

SEQ ID NO: 1346057 - protein, 9 aa, Homo Sapiens
HEDNPKGRQ

SEQ ID NO: 1346058 - protein, 9 aa, Homo Sapiens
PEDKSRLIS

SEQ ID NO: 1346059 - protein, 9 aa, Homo Sapiens
WAAAAHKVK

SEQ ID NO: 1346060 - protein, 9 aa, Homo Sapiens
PVRSPTSAA

SEQ ID NO: 1346061 - protein, 9 aa, Homo Sapiens
PCLSWSSRI

SEQ ID NO: 1346062 - protein, 9 aa, Homo Sapiens
QCHHCLELA

SEQ ID NO: 1346063 - protein, 9 aa, Homo Sapiens
DAHINMLYQ

SEQ ID NO: 1346064 - protein, 9 aa, Homo Sapiens
LRYKGIHPA

SEQ ID NO: 1346065 - protein, 9 aa, Homo Sapiens
PRVYEFASD

SEQ ID NO: 1346066 - protein, 9 aa, Homo Sapiens
LEKVIHIIF

SEQ ID NO: 1346067 - protein, 9 aa, Homo Sapiens
EDVGEYQCE

SEQ ID NO: 1346068 - protein, 9 aa, Homo Sapiens
HIEELIEKP

SEQ ID NO: 1346069 - protein, 9 aa, Homo Sapiens
CKVDSDLNQ

SEQ ID NO: 1346070 - protein, 9 aa, Homo Sapiens
AVAFQSGSL

SEQ ID NO: 1346071 - protein, 9 aa, Homo Sapiens
VNLNSKDLS

SEQ ID NO: 1346072 - protein, 9 aa, Homo Sapiens
GEQWPYRVF

SEQ ID NO: 1346073 - protein, 9 aa, Homo Sapiens
MWRLWQKFL

SEQ ID NO: 1346074 - protein, 9 aa, Homo Sapiens
GGDISKITP

SEQ ID NO: 1346075 - protein, 9 aa, Homo Sapiens
SSLRVERSP

SEQ ID NO: 1346076 - protein, 9 aa, Homo Sapiens
FWQCGCHVF

SEQ ID NO: 1346077 - protein, 9 aa, Homo Sapiens
NVKKAKRSK

SEQ ID NO: 1346078 - protein, 9 aa, Homo Sapiens
DTFNCCTFL

SEQ ID NO: 1346079 - protein, 9 aa, Homo Sapiens
NKKSVVRPR

SEQ ID NO: 1346080 - protein, 9 aa, Homo Sapiens
RSHSRSRER

SEQ ID NO: 1346081 - protein, 9 aa, Homo Sapiens
GQWQARHYH

SEQ ID NO: 1346082 - protein, 9 aa, Homo Sapiens
FSLRHCCLP

SEQ ID NO: 1346083 - protein, 9 aa, Homo Sapiens
PFGLVLIIT

SEQ ID NO: 1346084 - protein, 9 aa, Homo Sapiens
TFVPTRSYP

SEQ ID NO: 1346085 - protein, 9 aa, Homo Sapiens
NWRWGSTAG

SEQ ID NO: 1346086 - protein, 9 aa, Homo Sapiens
NINECFSNP

SEQ ID NO: 1346087 - protein, 9 aa, Homo Sapiens
HEYVRHLTG

SEQ ID NO: 1346088 - protein, 9 aa, Homo Sapiens
EKVFCVNVE

SEQ ID NO: 1346089 - protein, 9 aa, Homo Sapiens
PLPPPFPAH

SEQ ID NO: 1346090 - protein, 9 aa, Homo Sapiens
SKLNSTFVT

SEQ ID NO: 1346091 - protein, 9 aa, Homo Sapiens
FTGQGTNTS

SEQ ID NO: 1346092 - protein, 9 aa, Homo Sapiens
ICDEAEKPL

SEQ ID NO: 1346093 - protein, 9 aa, Homo Sapiens
GGIGHQKCK

SEQ ID NO: 1346094 - protein, 9 aa, Homo Sapiens
RCSPSLSSK

SEQ ID NO: 1346095 - protein, 9 aa, Homo Sapiens
YVYVKEICR

SEQ ID NO: 1346096 - protein, 9 aa, Homo Sapiens
YSGVDEQLG

SEQ ID NO: 1346097 - protein, 9 aa, Homo Sapiens
DLIEWDRTY

SEQ ID NO: 1346098 - protein, 9 aa, Homo Sapiens
VSPSDYPCL

SEQ ID NO: 1346099 - protein, 9 aa, Homo Sapiens
MSQSSQDTG

SEQ ID NO: 1346100 - protein, 9 aa, Homo Sapiens
IIIIVFFFI

SEQ ID NO: 1346101 - protein, 9 aa, Homo Sapiens
EEENGWLLG

SEQ ID NO: 1346102 - protein, 9 aa, Homo Sapiens
RPPLPRLRY

SEQ ID NO: 1346103 - protein, 9 aa, Homo Sapiens
HHPYGCDVE

SEQ ID NO: 1346104 - protein, 9 aa, Homo Sapiens
EMWRLWQKF

SEQ ID NO: 1346105 - protein, 9 aa, Homo Sapiens
NMSRTETAS

SEQ ID NO: 1346106 - protein, 9 aa, Homo Sapiens
YSTKDQQFK

SEQ ID NO: 1346107 - protein, 9 aa, Homo Sapiens
FEMIDAGYY

SEQ ID NO: 1346108 - protein, 9 aa, Homo Sapiens
CTLCRRLQI

SEQ ID NO: 1346109 - protein, 9 aa, Homo Sapiens
ENAKQLKDG

SEQ ID NO: 1346110 - protein, 9 aa, Homo Sapiens
EKVIHIIFT

SEQ ID NO: 1346111 - protein, 9 aa, Homo Sapiens
SRIFKLAQD

SEQ ID NO: 1346112 - protein, 9 aa, Homo Sapiens
ILLILWRIL

SEQ ID NO: 1346113 - protein, 9 aa, Homo Sapiens
NKKQLCGRH

SEQ ID NO: 1346114 - protein, 9 aa, Homo Sapiens
HQLHPNTFS

SEQ ID NO: 1346115 - protein, 9 aa, Homo Sapiens
HMAANMPNK

SEQ ID NO: 1346116 - protein, 9 aa, Homo Sapiens
TRNMFKLQS

SEQ ID NO: 1346117 - protein, 9 aa, Homo Sapiens
IKKVYPGKH

SEQ ID NO: 1346118 - protein, 9 aa, Homo Sapiens
VFLLHMVDQ

SEQ ID NO: 1346119 - protein, 9 aa, Homo Sapiens
PEKSISVFI

SEQ ID NO: 1346120 - protein, 9 aa, Homo Sapiens
SSGHSGSSL

SEQ ID NO: 1346121 - protein, 9 aa, Homo Sapiens
RSYDRSLQC

SEQ ID NO: 1346122 - protein, 9 aa, Homo Sapiens
AGRAPGRAS

SEQ ID NO: 1346123 - protein, 9 aa, Homo Sapiens
VIAQPVGSS

SEQ ID NO: 1346124 - protein, 9 aa, Homo Sapiens
YNTQEGAVQ

SEQ ID NO: 1346125 - protein, 9 aa, Homo Sapiens
ALNIHTFSA

SEQ ID NO: 1346126 - protein, 9 aa, Homo Sapiens
QEKWGLKDV

SEQ ID NO: 1346127 - protein, 9 aa, Homo Sapiens
HDPNSNRIA

SEQ ID NO: 1346128 - protein, 9 aa, Homo Sapiens
QILPVKIRP

SEQ ID NO: 1346129 - protein, 9 aa, Homo Sapiens
VDENMERRN

SEQ ID NO: 1346130 - protein, 9 aa, Homo Sapiens
RGATCHNFI

SEQ ID NO: 1346131 - protein, 9 aa, Homo Sapiens
SREEAAKWN

SEQ ID NO: 1346132 - protein, 9 aa, Homo Sapiens
SQMYHYNAG

SEQ ID NO: 1346133 - protein, 9 aa, Homo Sapiens
GLLHENCRM

SEQ ID NO: 1346134 - protein, 9 aa, Homo Sapiens
WKSHRRSVS

SEQ ID NO: 1346135 - protein, 9 aa, Homo Sapiens
CYDDHTVCK

SEQ ID NO: 1346136 - protein, 9 aa, Homo Sapiens
QTSLATFHE

SEQ ID NO: 1346137 - protein, 9 aa, Homo Sapiens
LYNWGFSLL

SEQ ID NO: 1346138 - protein, 9 aa, Homo Sapiens
IHIHYREPR

SEQ ID NO: 1346139 - protein, 9 aa, Homo Sapiens
TVIVVLMCR

SEQ ID NO: 1346140 - protein, 9 aa, Homo Sapiens
ETTFKCDRC

SEQ ID NO: 1346141 - protein, 9 aa, Homo Sapiens
TIMGSGILG

SEQ ID NO: 1346142 - protein, 9 aa, Homo Sapiens
SLNEMEEFV

SEQ ID NO: 1346143 - protein, 9 aa, Homo Sapiens
PTPRTCPTT

SEQ ID NO: 1346144 - protein, 9 aa, Homo Sapiens
DVLNILIGV

SEQ ID NO: 1346145 - protein, 9 aa, Homo Sapiens
AQVFVVEGK

SEQ ID NO: 1346146 - protein, 9 aa, Homo Sapiens
ASDTIKFVL

SEQ ID NO: 1346147 - protein, 9 aa, Homo Sapiens
LVSCEKCCH

SEQ ID NO: 1346148 - protein, 9 aa, Homo Sapiens
NLRNAVELV

SEQ ID NO: 1346149 - protein, 9 aa, Homo Sapiens
RVLNQYTYT

SEQ ID NO: 1346150 - protein, 9 aa, Homo Sapiens
IQLSFVESR

SEQ ID NO: 1346151 - protein, 9 aa, Homo Sapiens
IEIFYELCR

SEQ ID NO: 1346152 - protein, 9 aa, Homo Sapiens
ECEQALRLK

SEQ ID NO: 1346153 - protein, 9 aa, Homo Sapiens
LKEEEKRVL

SEQ ID NO: 1346154 - protein, 9 aa, Homo Sapiens
PTLGRVPHQ

SEQ ID NO: 1346155 - protein, 9 aa, Homo Sapiens
GTMLTYSLT

SEQ ID NO: 1346156 - protein, 9 aa, Homo Sapiens
HSKEHILEM

SEQ ID NO: 1346157 - protein, 9 aa, Homo Sapiens
EYHVIRHTM

SEQ ID NO: 1346158 - protein, 9 aa, Homo Sapiens
GDWFPGSPQ

SEQ ID NO: 1346159 - protein, 9 aa, Homo Sapiens
TYTECRNAL

SEQ ID NO: 1346160 - protein, 9 aa, Homo Sapiens
LRKHRRKIT

SEQ ID NO: 1346161 - protein, 9 aa, Homo Sapiens
SSNTLSLWS

SEQ ID NO: 1346162 - protein, 9 aa, Homo Sapiens
FRDLYHRID

SEQ ID NO: 1346163 - protein, 9 aa, Homo Sapiens
DLQCCSEES

SEQ ID NO: 1346164 - protein, 9 aa, Homo Sapiens
MWCHTSVKP

SEQ ID NO: 1346165 - protein, 9 aa, Homo Sapiens
HSGIGRTVM

SEQ ID NO: 1346166 - protein, 9 aa, Homo Sapiens
DINECEQVS

SEQ ID NO: 1346167 - protein, 9 aa, Homo Sapiens
PSWIHCIIC

SEQ ID NO: 1346168 - protein, 9 aa, Homo Sapiens
PKMQAIRNY

SEQ ID NO: 1346169 - protein, 9 aa, Homo Sapiens
ITDEIKVNL

SEQ ID NO: 1346170 - protein, 9 aa, Homo Sapiens
CDCRLLWIA

SEQ ID NO: 1346171 - protein, 9 aa, Homo Sapiens
VGFLFQKVG

SEQ ID NO: 1346172 - protein, 9 aa, Homo Sapiens
CDHLSRFNV

SEQ ID NO: 1346173 - protein, 9 aa, Homo Sapiens
PLGYPFPSP

SEQ ID NO: 1346174 - protein, 9 aa, Homo Sapiens
SLGSIVVIV

SEQ ID NO: 1346175 - protein, 9 aa, Homo Sapiens
QNDQSPMAA

SEQ ID NO: 1346176 - protein, 9 aa, Homo Sapiens
HIFLADLYV

SEQ ID NO: 1346177 - protein, 9 aa, Homo Sapiens
IILFFFLFP

SEQ ID NO: 1346178 - protein, 9 aa, Homo Sapiens
DGLKSSCIV

SEQ ID NO: 1346179 - protein, 9 aa, Homo Sapiens
NLIVAKSWT

SEQ ID NO: 1346180 - protein, 9 aa, Homo Sapiens
PELCPGVTI

SEQ ID NO: 1346181 - protein, 9 aa, Homo Sapiens
SIKGTSLYM

SEQ ID NO: 1346182 - protein, 9 aa, Homo Sapiens
EPVDPGPPG

SEQ ID NO: 1346183 - protein, 9 aa, Homo Sapiens
IRRELDGCL

SEQ ID NO: 1346184 - protein, 9 aa, Homo Sapiens
TQLQDGRTL

SEQ ID NO: 1346185 - protein, 9 aa, Homo Sapiens
AEDSDLFEL

SEQ ID NO: 1346186 - protein, 9 aa, Homo Sapiens
WSDFHRNRK

SEQ ID NO: 1346187 - protein, 9 aa, Homo Sapiens
GTIRDLVFM

SEQ ID NO: 1346188 - protein, 9 aa, Homo Sapiens
GPLFGRSVL

SEQ ID NO: 1346189 - protein, 9 aa, Homo Sapiens
FIIGILQLT

SEQ ID NO: 1346190 - protein, 9 aa, Homo Sapiens
VYLIPHDVG

SEQ ID NO: 1346191 - protein, 9 aa, Homo Sapiens
VKQALATLS

SEQ ID NO: 1346192 - protein, 9 aa, Homo Sapiens
GSECLCIPA

SEQ ID NO: 1346193 - protein, 9 aa, Homo Sapiens
LVRVCGRPL

SEQ ID NO: 1346194 - protein, 9 aa, Homo Sapiens
DLTTKNLDY

SEQ ID NO: 1346195 - protein, 9 aa, Homo Sapiens
GEEEKSEPD

SEQ ID NO: 1346196 - protein, 9 aa, Homo Sapiens
EENTKVFVW

SEQ ID NO: 1346197 - protein, 9 aa, Homo Sapiens
YMLQLCYRV

SEQ ID NO: 1346198 - protein, 9 aa, Homo Sapiens
VPGLWVVVS

SEQ ID NO: 1346199 - protein, 9 aa, Homo Sapiens
NHVQTLQIR

SEQ ID NO: 1346200 - protein, 9 aa, Homo Sapiens
GKEGCRPRT

SEQ ID NO: 1346201 - protein, 9 aa, Homo Sapiens
GNSCRVDIF

SEQ ID NO: 1346202 - protein, 9 aa, Homo Sapiens
HNPLGSGAY

SEQ ID NO: 1346203 - protein, 9 aa, Homo Sapiens
QTDPSCTTF

SEQ ID NO: 1346204 - protein, 9 aa, Homo Sapiens
KDTAELLGH

SEQ ID NO: 1346205 - protein, 9 aa, Homo Sapiens
EQKMWDQEE

SEQ ID NO: 1346206 - protein, 9 aa, Homo Sapiens
PSLRASLVE

SEQ ID NO: 1346207 - protein, 9 aa, Homo Sapiens
SAFAPFDKI

SEQ ID NO: 1346208 - protein, 9 aa, Homo Sapiens
GMCPFHHIS

SEQ ID NO: 1346209 - protein, 9 aa, Homo Sapiens
YDLPMDADE

SEQ ID NO: 1346210 - protein, 9 aa, Homo Sapiens
QRGIIGLPG

SEQ ID NO: 1346211 - protein, 9 aa, Homo Sapiens
EPGAVVPRG

SEQ ID NO: 1346212 - protein, 9 aa, Homo Sapiens
KHHDKFTDT

SEQ ID NO: 1346213 - protein, 9 aa, Homo Sapiens
ADDKQKVKN

SEQ ID NO: 1346214 - protein, 9 aa, Homo Sapiens
AYSSVTADL

SEQ ID NO: 1346215 - protein, 9 aa, Homo Sapiens
NMSLSGHYL

SEQ ID NO: 1346216 - protein, 9 aa, Homo Sapiens
KNNSHMILR

SEQ ID NO: 1346217 - protein, 9 aa, Homo Sapiens
ARFRATFVS

SEQ ID NO: 1346218 - protein, 9 aa, Homo Sapiens
SPTAQTQID

SEQ ID NO: 1346219 - protein, 9 aa, Homo Sapiens
IKYLAKDLS

SEQ ID NO: 1346220 - protein, 9 aa, Homo Sapiens
HFLLYGHDV

SEQ ID NO: 1346221 - protein, 9 aa, Homo Sapiens
RDFFLANVS

SEQ ID NO: 1346222 - protein, 9 aa, Homo Sapiens
ERASVRIHS

SEQ ID NO: 1346223 - protein, 9 aa, Homo Sapiens
FNKINGLRK

SEQ ID NO: 1346224 - protein, 9 aa, Homo Sapiens
AGWSPLHIV

SEQ ID NO: 1346225 - protein, 9 aa, Homo Sapiens
LVGPHARVD

SEQ ID NO: 1346226 - protein, 9 aa, Homo Sapiens
EYFRVPTFG

SEQ ID NO: 1346227 - protein, 9 aa, Homo Sapiens
YMEGESLLM

SEQ ID NO: 1346228 - protein, 9 aa, Homo Sapiens
PPSQVADTG

SEQ ID NO: 1346229 - protein, 9 aa, Homo Sapiens
FATQLFNSL

SEQ ID NO: 1346230 - protein, 9 aa, Homo Sapiens
IVVFVAVME

SEQ ID NO: 1346231 - protein, 9 aa, Homo Sapiens
GIRGIIHHT

SEQ ID NO: 1346232 - protein, 9 aa, Homo Sapiens
QKSQHYKAE

SEQ ID NO: 1346233 - protein, 9 aa, Homo Sapiens
ILMKVTAFS

SEQ ID NO: 1346234 - protein, 9 aa, Homo Sapiens
FIVRFIAMA

SEQ ID NO: 1346235 - protein, 9 aa, Homo Sapiens
ELLSRVFLL

SEQ ID NO: 1346236 - protein, 9 aa, Homo Sapiens
AGSSSDLSM

SEQ ID NO: 1346237 - protein, 9 aa, Homo Sapiens
KHFWYLPSH

SEQ ID NO: 1346238 - protein, 9 aa, Homo Sapiens
ASLMLKEDV

SEQ ID NO: 1346239 - protein, 9 aa, Homo Sapiens
NYVCRELLR

SEQ ID NO: 1346240 - protein, 9 aa, Homo Sapiens
RGISSYVLR

SEQ ID NO: 1346241 - protein, 9 aa, Homo Sapiens
QVIHKWCEE

SEQ ID NO: 1346242 - protein, 9 aa, Homo Sapiens
NREKQCLIK

SEQ ID NO: 1346243 - protein, 9 aa, Homo Sapiens
TFAEAHLIS

SEQ ID NO: 1346244 - protein, 9 aa, Homo Sapiens
MVVEYLRAV

SEQ ID NO: 1346245 - protein, 9 aa, Homo Sapiens
NDPHFIGNW

SEQ ID NO: 1346246 - protein, 9 aa, Homo Sapiens
SVVHRLSTV

SEQ ID NO: 1346247 - protein, 9 aa, Homo Sapiens
AAGDIARKG

SEQ ID NO: 1346248 - protein, 9 aa, Homo Sapiens
GGFHKPNNQ

SEQ ID NO: 1346249 - protein, 9 aa, Homo Sapiens
RELVLKYHE

SEQ ID NO: 1346250 - protein, 9 aa, Homo Sapiens
LRNHRSSPY

SEQ ID NO: 1346251 - protein, 9 aa, Homo Sapiens
NCHVIATPS

SEQ ID NO: 1346252 - protein, 9 aa, Homo Sapiens
RNIGVIVVG

SEQ ID NO: 1346253 - protein, 9 aa, Homo Sapiens
KHLDPLKSL

SEQ ID NO: 1346254 - protein, 9 aa, Homo Sapiens
SLMLKEDVS

SEQ ID NO: 1346255 - protein, 9 aa, Homo Sapiens
AICAPASAS

SEQ ID NO: 1346256 - protein, 9 aa, Homo Sapiens
SLAVDPNDL

SEQ ID NO: 1346257 - protein, 9 aa, Homo Sapiens
DAACITYIR

SEQ ID NO: 1346258 - protein, 9 aa, Homo Sapiens
TLAMIYDDQ

SEQ ID NO: 1346259 - protein, 9 aa, Homo Sapiens
QSKGLEEEN

SEQ ID NO: 1346260 - protein, 9 aa, Homo Sapiens
IPVCLHAGG

SEQ ID NO: 1346261 - protein, 9 aa, Homo Sapiens
PSRYVSNHV

SEQ ID NO: 1346262 - protein, 9 aa, Homo Sapiens
IHDLTKQET

SEQ ID NO: 1346263 - protein, 9 aa, Homo Sapiens
DANWTRLQQ

SEQ ID NO: 1346264 - protein, 9 aa, Homo Sapiens
TSMDTPPDI

SEQ ID NO: 1346265 - protein, 9 aa, Homo Sapiens
HVPQDHLAY

SEQ ID NO: 1346266 - protein, 9 aa, Homo Sapiens
HSIYPAQVE

SEQ ID NO: 1346267 - protein, 9 aa, Homo Sapiens
SLPPKKCSI

SEQ ID NO: 1346268 - protein, 9 aa, Homo Sapiens
NSSVLQNIH

SEQ ID NO: 1346269 - protein, 9 aa, Homo Sapiens
KWPRLLSTK

SEQ ID NO: 1346270 - protein, 9 aa, Homo Sapiens
QMVGGSLSS

SEQ ID NO: 1346271 - protein, 9 aa, Homo Sapiens
LIVTFLTLE

SEQ ID NO: 1346272 - protein, 9 aa, Homo Sapiens
MWPRLPGVG

SEQ ID NO: 1346273 - protein, 9 aa, Homo Sapiens
QMQHKHLKS

SEQ ID NO: 1346274 - protein, 9 aa, Homo Sapiens
RKCWFQLGH

SEQ ID NO: 1346275 - protein, 9 aa, Homo Sapiens
ELGSRFVVP

SEQ ID NO: 1346276 - protein, 9 aa, Homo Sapiens
DIYKLTGAV

SEQ ID NO: 1346277 - protein, 9 aa, Homo Sapiens
LKTLEDTLH

SEQ ID NO: 1346278 - protein, 9 aa, Homo Sapiens
LHAFLLCAS

SEQ ID NO: 1346279 - protein, 9 aa, Homo Sapiens
STFQMSKDV

SEQ ID NO: 1346280 - protein, 9 aa, Homo Sapiens
MMTGRSPFD

SEQ ID NO: 1346281 - protein, 9 aa, Homo Sapiens
CNKKQLCGR

SEQ ID NO: 1346282 - protein, 9 aa, Homo Sapiens
LNSSATGHC

SEQ ID NO: 1346283 - protein, 9 aa, Homo Sapiens
KPEFHSCFP

SEQ ID NO: 1346284 - protein, 9 aa, Homo Sapiens
IRVVRGEGM

SEQ ID NO: 1346285 - protein, 9 aa, Homo Sapiens
VAHTKDIPF

SEQ ID NO: 1346286 - protein, 9 aa, Homo Sapiens
IGNSLPQGA

SEQ ID NO: 1346287 - protein, 9 aa, Homo Sapiens
RKLLEKYCV

SEQ ID NO: 1346288 - protein, 9 aa, Homo Sapiens
GSFLLAGIL

SEQ ID NO: 1346289 - protein, 9 aa, Homo Sapiens
MHAASSSDL

SEQ ID NO: 1346290 - protein, 9 aa, Homo Sapiens
QQEISVVHI

SEQ ID NO: 1346291 - protein, 9 aa, Homo Sapiens
GHIAHIPLL

SEQ ID NO: 1346292 - protein, 9 aa, Homo Sapiens
HENCRMFFI

SEQ ID NO: 1346293 - protein, 9 aa, Homo Sapiens
VESLMCEKW

SEQ ID NO: 1346294 - protein, 9 aa, Homo Sapiens
QLIWERVKQ

SEQ ID NO: 1346295 - protein, 9 aa, Homo Sapiens
GHVVFLLQQ

SEQ ID NO: 1346296 - protein, 9 aa, Homo Sapiens
NTPCYDNVP

SEQ ID NO: 1346297 - protein, 9 aa, Homo Sapiens
SRSGRRVLY

SEQ ID NO: 1346298 - protein, 9 aa, Homo Sapiens
ENPVTSDSY

SEQ ID NO: 1346299 - protein, 9 aa, Homo Sapiens
SGKIDVKMP

SEQ ID NO: 1346300 - protein, 9 aa, Homo Sapiens
KCNARSYQG

SEQ ID NO: 1346301 - protein, 9 aa, Homo Sapiens
LTMKGSNQF

SEQ ID NO: 1346302 - protein, 9 aa, Homo Sapiens
VVDMKKSGG

SEQ ID NO: 1346303 - protein, 9 aa, Homo Sapiens
QGIVDAYCQ

SEQ ID NO: 1346304 - protein, 9 aa, Homo Sapiens
INITSMLGS

SEQ ID NO: 1346305 - protein, 9 aa, Homo Sapiens
PENLALGMQ

SEQ ID NO: 1346306 - protein, 9 aa, Homo Sapiens
RPPAHRAVD

SEQ ID NO: 1346307 - protein, 9 aa, Homo Sapiens
HRVLQAQRG

SEQ ID NO: 1346308 - protein, 9 aa, Homo Sapiens
KELQPDKNG

SEQ ID NO: 1346309 - protein, 9 aa, Homo Sapiens
VIILGASVV

SEQ ID NO: 1346310 - protein, 9 aa, Homo Sapiens
WNQVRKDLC

SEQ ID NO: 1346311 - protein, 9 aa, Homo Sapiens
LGQTNPTFP

SEQ ID NO: 1346312 - protein, 9 aa, Homo Sapiens
CLQMADQIA

SEQ ID NO: 1346313 - protein, 9 aa, Homo Sapiens
KKAVEPTVD

SEQ ID NO: 1346314 - protein, 9 aa, Homo Sapiens
KRVTSYQMP

SEQ ID NO: 1346315 - protein, 9 aa, Homo Sapiens
PYEITLVHW

SEQ ID NO: 1346316 - protein, 9 aa, Homo Sapiens
HSWRGKYKC

SEQ ID NO: 1346317 - protein, 9 aa, Homo Sapiens
VITNCPKGF

SEQ ID NO: 1346318 - protein, 9 aa, Homo Sapiens
YMLCPAPIL

SEQ ID NO: 1346319 - protein, 9 aa, Homo Sapiens
LKLVTEMVI

SEQ ID NO: 1346320 - protein, 9 aa, Homo Sapiens
EIPWKLDKR

SEQ ID NO: 1346321 - protein, 9 aa, Homo Sapiens
AEVFFVDYD

SEQ ID NO: 1346322 - protein, 9 aa, Homo Sapiens
SHADAENAM

SEQ ID NO: 1346323 - protein, 9 aa, Homo Sapiens
KTKRMHTSF

SEQ ID NO: 1346324 - protein, 9 aa, Homo Sapiens
TPLHNFLEG

SEQ ID NO: 1346325 - protein, 9 aa, Homo Sapiens
ELWGPMDTS

SEQ ID NO: 1346326 - protein, 9 aa, Homo Sapiens
IDTVRVIFT

SEQ ID NO: 1346327 - protein, 9 aa, Homo Sapiens
PVPPLTPCP

SEQ ID NO: 1346328 - protein, 9 aa, Homo Sapiens
TIKYKGEKD

SEQ ID NO: 1346329 - protein, 9 aa, Homo Sapiens
CVGIIPPKG

SEQ ID NO: 1346330 - protein, 9 aa, Homo Sapiens
LEAFNILQK

SEQ ID NO: 1346331 - protein, 9 aa, Homo Sapiens
LSSINQEER

SEQ ID NO: 1346332 - protein, 9 aa, Homo Sapiens
PVSSQDKLP

SEQ ID NO: 1346333 - protein, 9 aa, Homo Sapiens
DALNLKDEF

SEQ ID NO: 1346334 - protein, 9 aa, Homo Sapiens
TEDKRSQEE

SEQ ID NO: 1346335 - protein, 9 aa, Homo Sapiens
RPTKARTPL

SEQ ID NO: 1346336 - protein, 9 aa, Homo Sapiens
GGEMFSRLH

SEQ ID NO: 1346337 - protein, 9 aa, Homo Sapiens
DSKLEEVNL

SEQ ID NO: 1346338 - protein, 9 aa, Homo Sapiens
KMWRDLEEA

SEQ ID NO: 1346339 - protein, 9 aa, Homo Sapiens
FKMHKKGWG

SEQ ID NO: 1346340 - protein, 9 aa, Homo Sapiens
CTEPEIWDP

SEQ ID NO: 1346341 - protein, 9 aa, Homo Sapiens
GLPLTHTQD

SEQ ID NO: 1346342 - protein, 9 aa, Homo Sapiens
LLFSASRPG

SEQ ID NO: 1346343 - protein, 9 aa, Homo Sapiens
WKWGQSPSP

SEQ ID NO: 1346344 - protein, 9 aa, Homo Sapiens
ALREENANL

SEQ ID NO: 1346345 - protein, 9 aa, Homo Sapiens
RKILKILLH

SEQ ID NO: 1346346 - protein, 9 aa, Homo Sapiens
LYRRSRAAS

SEQ ID NO: 1346347 - protein, 9 aa, Homo Sapiens
DKAKLSFQC

SEQ ID NO: 1346348 - protein, 9 aa, Homo Sapiens
SWGQRKNFT

SEQ ID NO: 1346349 - protein, 9 aa, Homo Sapiens
RSSAATARR

SEQ ID NO: 1346350 - protein, 9 aa, Homo Sapiens
EWRSQWKHV

SEQ ID NO: 1346351 - protein, 9 aa, Homo Sapiens
KPCCPCMTL

SEQ ID NO: 1346352 - protein, 9 aa, Homo Sapiens
GSVTESIQV

SEQ ID NO: 1346353 - protein, 9 aa, Homo Sapiens
IQDDWKYVV

SEQ ID NO: 1346354 - protein, 9 aa, Homo Sapiens
PKPMPKNKH

SEQ ID NO: 1346355 - protein, 9 aa, Homo Sapiens
HMGQYYLPN

SEQ ID NO: 1346356 - protein, 9 aa, Homo Sapiens
FQVIRCPLQ

SEQ ID NO: 1346357 - protein, 9 aa, Homo Sapiens
KAKRSKPES

SEQ ID NO: 1346358 - protein, 9 aa, Homo Sapiens
SVERVQPFY

SEQ ID NO: 1346359 - protein, 9 aa, Homo Sapiens
FTPCGYVCS

SEQ ID NO: 1346360 - protein, 9 aa, Homo Sapiens
SHSDSLTSQ

SEQ ID NO: 1346361 - protein, 9 aa, Homo Sapiens
RRSWLNNFR

SEQ ID NO: 1346362 - protein, 9 aa, Homo Sapiens
NRVTCRFKH

SEQ ID NO: 1346363 - protein, 9 aa, Homo Sapiens
HPFDTVFIF

SEQ ID NO: 1346364 - protein, 9 aa, Homo Sapiens
ENVDLWSLG

SEQ ID NO: 1346365 - protein, 9 aa, Homo Sapiens
LSHSDTYVI

SEQ ID NO: 1346366 - protein, 9 aa, Homo Sapiens
EGDQHVDDV

SEQ ID NO: 1346367 - protein, 9 aa, Homo Sapiens
NPHIGDVIQ

SEQ ID NO: 1346368 - protein, 9 aa, Homo Sapiens
QKLQMSPCS

SEQ ID NO: 1346369 - protein, 9 aa, Homo Sapiens
SPEEVYAVT

SEQ ID NO: 1346370 - protein, 9 aa, Homo Sapiens
PNCFRSHNL

SEQ ID NO: 1346371 - protein, 9 aa, Homo Sapiens
IMCIYKGDL

SEQ ID NO: 1346372 - protein, 9 aa, Homo Sapiens
PFVFGHPLS

SEQ ID NO: 1346373 - protein, 9 aa, Homo Sapiens
VQPHHKILD

SEQ ID NO: 1346374 - protein, 9 aa, Homo Sapiens
VMGDFLKRI

SEQ ID NO: 1346375 - protein, 9 aa, Homo Sapiens
VPSHVIEMS

SEQ ID NO: 1346376 - protein, 9 aa, Homo Sapiens
SLYVKRHRN

SEQ ID NO: 1346377 - protein, 9 aa, Homo Sapiens
KSLRFSVFD

SEQ ID NO: 1346378 - protein, 9 aa, Homo Sapiens
DLQLACVAL

SEQ ID NO: 1346379 - protein, 9 aa, Homo Sapiens
FLSIIRSCM

SEQ ID NO: 1346380 - protein, 9 aa, Homo Sapiens
DNEVISVMN

SEQ ID NO: 1346381 - protein, 9 aa, Homo Sapiens
LRQDRPVSK

SEQ ID NO: 1346382 - protein, 9 aa, Homo Sapiens
PGCIVMTDL

SEQ ID NO: 1346383 - protein, 9 aa, Homo Sapiens
AVASKVQTD

SEQ ID NO: 1346384 - protein, 9 aa, Homo Sapiens
WGCVGTVIG

SEQ ID NO: 1346385 - protein, 9 aa, Homo Sapiens
QATHLQKSP

SEQ ID NO: 1346386 - protein, 9 aa, Homo Sapiens
TNSVFQAES

SEQ ID NO: 1346387 - protein, 9 aa, Homo Sapiens
EMTWRAMGG

SEQ ID NO: 1346388 - protein, 9 aa, Homo Sapiens
SASTDHTTP

SEQ ID NO: 1346389 - protein, 9 aa, Homo Sapiens
AHGDWRDDQ

SEQ ID NO: 1346390 - protein, 9 aa, Homo Sapiens
ISATTGKIF

SEQ ID NO: 1346391 - protein, 9 aa, Homo Sapiens
SRPHSSPDD

SEQ ID NO: 1346392 - protein, 9 aa, Homo Sapiens
NKKTKIINL

SEQ ID NO: 1346393 - protein, 9 aa, Homo Sapiens
LTLYVDMLL

SEQ ID NO: 1346394 - protein, 9 aa, Homo Sapiens
FAQLTMKGS

SEQ ID NO: 1346395 - protein, 9 aa, Homo Sapiens
EPPLPYEFS

SEQ ID NO: 1346396 - protein, 9 aa, Homo Sapiens
ALIMVVAGS

SEQ ID NO: 1346397 - protein, 9 aa, Homo Sapiens
TEVWTGLTE

SEQ ID NO: 1346398 - protein, 9 aa, Homo Sapiens
KTFPVRSEK

SEQ ID NO: 1346399 - protein, 9 aa, Homo Sapiens
ANQPSPHMT

SEQ ID NO: 1346400 - protein, 9 aa, Homo Sapiens
WTLFLELIR

SEQ ID NO: 1346401 - protein, 9 aa, Homo Sapiens
SDCSYHDKP

SEQ ID NO: 1346402 - protein, 9 aa, Homo Sapiens
MEEFVEAED

SEQ ID NO: 1346403 - protein, 9 aa, Homo Sapiens
KVHAEEREL

SEQ ID NO: 1346404 - protein, 9 aa, Homo Sapiens
STPNYCDQM

SEQ ID NO: 1346405 - protein, 9 aa, Homo Sapiens
ECWCPTNST

SEQ ID NO: 1346406 - protein, 9 aa, Homo Sapiens
TDSRPVSRH

SEQ ID NO: 1346407 - protein, 9 aa, Homo Sapiens
SVNPIIYVF

SEQ ID NO: 1346408 - protein, 9 aa, Homo Sapiens
LCWLHIDAH

SEQ ID NO: 1346409 - protein, 9 aa, Homo Sapiens
AFINTQLYI

SEQ ID NO: 1346410 - protein, 9 aa, Homo Sapiens
VGLHMGFST

SEQ ID NO: 1346411 - protein, 9 aa, Homo Sapiens
SIKWQTVIT

SEQ ID NO: 1346412 - protein, 9 aa, Homo Sapiens
TFWSTGAST

SEQ ID NO: 1346413 - protein, 9 aa, Homo Sapiens
WIEDVRKYV

SEQ ID NO: 1346414 - protein, 9 aa, Homo Sapiens
FLFPLGYLL

SEQ ID NO: 1346415 - protein, 9 aa, Homo Sapiens
YQFTSCSKD

SEQ ID NO: 1346416 - protein, 9 aa, Homo Sapiens
QAHYLEPGI

SEQ ID NO: 1346417 - protein, 9 aa, Homo Sapiens
RGSSYWDHC

SEQ ID NO: 1346418 - protein, 9 aa, Homo Sapiens
HDDSLNTTV

SEQ ID NO: 1346419 - protein, 9 aa, Homo Sapiens
CADPHHVQG

SEQ ID NO: 1346420 - protein, 9 aa, Homo Sapiens
VTSKMLVNF

SEQ ID NO: 1346421 - protein, 9 aa, Homo Sapiens
LSFCLSHPQ

SEQ ID NO: 1346422 - protein, 9 aa, Homo Sapiens
DIVTAGSSV

SEQ ID NO: 1346423 - protein, 9 aa, Homo Sapiens
VKMMTTCLI

SEQ ID NO: 1346424 - protein, 9 aa, Homo Sapiens
LPSFYHPYS

SEQ ID NO: 1346425 - protein, 9 aa, Homo Sapiens
IYVCIECGR

SEQ ID NO: 1346426 - protein, 9 aa, Homo Sapiens
KMQAIRNYS

SEQ ID NO: 1346427 - protein, 9 aa, Homo Sapiens
ENVPVGTSV

SEQ ID NO: 1346428 - protein, 9 aa, Homo Sapiens
RCLLFMKLA

SEQ ID NO: 1346429 - protein, 9 aa, Homo Sapiens
RKSTPGRSR

SEQ ID NO: 1346430 - protein, 9 aa, Homo Sapiens
LQTREDIWN

SEQ ID NO: 1346431 - protein, 9 aa, Homo Sapiens
ACNLVATAT

SEQ ID NO: 1346432 - protein, 9 aa, Homo Sapiens
LPEQQVGHP

SEQ ID NO: 1346433 - protein, 9 aa, Homo Sapiens
ERYMQKSSS

SEQ ID NO: 1346434 - protein, 9 aa, Homo Sapiens
MYDVVSIMN

SEQ ID NO: 1346435 - protein, 9 aa, Homo Sapiens
KQIKVTIKK

SEQ ID NO: 1346436 - protein, 9 aa, Homo Sapiens
QLNSLSGGI

SEQ ID NO: 1346437 - protein, 9 aa, Homo Sapiens
CDLRRGHYL

SEQ ID NO: 1346438 - protein, 9 aa, Homo Sapiens
LRWIIEVVK

SEQ ID NO: 1346439 - protein, 9 aa, Homo Sapiens
HKHQRVHMG

SEQ ID NO: 1346440 - protein, 9 aa, Homo Sapiens
EKCRLQELC

SEQ ID NO: 1346441 - protein, 9 aa, Homo Sapiens
LIKNALNLR

SEQ ID NO: 1346442 - protein, 9 aa, Homo Sapiens
AATRPSSCT

SEQ ID NO: 1346443 - protein, 9 aa, Homo Sapiens
EHVLEEVIR

SEQ ID NO: 1346444 - protein, 9 aa, Homo Sapiens
DISLENPDT

SEQ ID NO: 1346445 - protein, 9 aa, Homo Sapiens
SLLTWLAGT

SEQ ID NO: 1346446 - protein, 9 aa, Homo Sapiens
VTLYQQLKG

SEQ ID NO: 1346447 - protein, 9 aa, Homo Sapiens
SGEVQQVWL

SEQ ID NO: 1346448 - protein, 9 aa, Homo Sapiens
SPSRLMWLL

SEQ ID NO: 1346449 - protein, 9 aa, Homo Sapiens
RLVHVDKCP

SEQ ID NO: 1346450 - protein, 9 aa, Homo Sapiens
IFDELFKLA

SEQ ID NO: 1346451 - protein, 9 aa, Homo Sapiens
PTLQICCHP

SEQ ID NO: 1346452 - protein, 9 aa, Homo Sapiens
TCLERWHRL

SEQ ID NO: 1346453 - protein, 9 aa, Homo Sapiens
GCRPPQILR

SEQ ID NO: 1346454 - protein, 9 aa, Homo Sapiens
RSGTSSKGP

SEQ ID NO: 1346455 - protein, 9 aa, Homo Sapiens
LKKFVYALK

SEQ ID NO: 1346456 - protein, 9 aa, Homo Sapiens
GTFQQMLME

SEQ ID NO: 1346457 - protein, 9 aa, Homo Sapiens
ETAQLLSKL

SEQ ID NO: 1346458 - protein, 9 aa, Homo Sapiens
KEHHVVVSG

SEQ ID NO: 1346459 - protein, 9 aa, Homo Sapiens
ISGITSCVF

SEQ ID NO: 1346460 - protein, 9 aa, Homo Sapiens
LPRNDTNLC

SEQ ID NO: 1346461 - protein, 9 aa, Homo Sapiens
LNIPLELML

SEQ ID NO: 1346462 - protein, 9 aa, Homo Sapiens
CLERWHRLQ

SEQ ID NO: 1346463 - protein, 9 aa, Homo Sapiens
QPYPAQWPP

SEQ ID NO: 1346464 - protein, 9 aa, Homo Sapiens
RSKPKCQKS

SEQ ID NO: 1346465 - protein, 9 aa, Homo Sapiens
LMSNSPSKP

SEQ ID NO: 1346466 - protein, 9 aa, Homo Sapiens
KTLPRNDTN

SEQ ID NO: 1346467 - protein, 9 aa, Homo Sapiens
EDQTSLATF

SEQ ID NO: 1346468 - protein, 9 aa, Homo Sapiens
GFPTSAISS

SEQ ID NO: 1346469 - protein, 9 aa, Homo Sapiens
VGLTAVVLS

SEQ ID NO: 1346470 - protein, 9 aa, Homo Sapiens
RHSRLEGIL

SEQ ID NO: 1346471 - protein, 9 aa, Homo Sapiens
TSNSQGQAS

SEQ ID NO: 1346472 - protein, 9 aa, Homo Sapiens
WKFQHHDLI

SEQ ID NO: 1346473 - protein, 9 aa, Homo Sapiens
ENRNKKTKI

SEQ ID NO: 1346474 - protein, 9 aa, Homo Sapiens
SVLEYTIKC

SEQ ID NO: 1346475 - protein, 9 aa, Homo Sapiens
EESLLTCTS

SEQ ID NO: 1346476 - protein, 9 aa, Homo Sapiens
FKELQPDKN

SEQ ID NO: 1346477 - protein, 9 aa, Homo Sapiens
ARGVTMVHP

SEQ ID NO: 1346478 - protein, 9 aa, Homo Sapiens
GGPLEQILP

SEQ ID NO: 1346479 - protein, 9 aa, Homo Sapiens
EQIKKQKTN

SEQ ID NO: 1346480 - protein, 9 aa, Homo Sapiens
QKMWDQEER

SEQ ID NO: 1346481 - protein, 9 aa, Homo Sapiens
GTTPPGRSL

SEQ ID NO: 1346482 - protein, 9 aa, Homo Sapiens
LISSLRVER

SEQ ID NO: 1346483 - protein, 9 aa, Homo Sapiens
TFTQSSHLS

SEQ ID NO: 1346484 - protein, 9 aa, Homo Sapiens
LKQLLHRKS

SEQ ID NO: 1346485 - protein, 9 aa, Homo Sapiens
SSAASAEGF

SEQ ID NO: 1346486 - protein, 9 aa, Homo Sapiens
ETLDEITQM

SEQ ID NO: 1346487 - protein, 9 aa, Homo Sapiens
VIIIILMYR

SEQ ID NO: 1346488 - protein, 9 aa, Homo Sapiens
FRENMLDKG

SEQ ID NO: 1346489 - protein, 9 aa, Homo Sapiens
PFSVGLHMG

SEQ ID NO: 1346490 - protein, 9 aa, Homo Sapiens
PGPHQLIAS

SEQ ID NO: 1346491 - protein, 9 aa, Homo Sapiens
SQLQGLWHR

SEQ ID NO: 1346492 - protein, 9 aa, Homo Sapiens
PERNGINSV

SEQ ID NO: 1346493 - protein, 9 aa, Homo Sapiens
WPYRVFADL

SEQ ID NO: 1346494 - protein, 9 aa, Homo Sapiens
NSCRVDIFT

SEQ ID NO: 1346495 - protein, 9 aa, Homo Sapiens
MFSIAGADH

SEQ ID NO: 1346496 - protein, 9 aa, Homo Sapiens
TDREEKHNQ

SEQ ID NO: 1346497 - protein, 9 aa, Homo Sapiens
DSDLFELDY

SEQ ID NO: 1346498 - protein, 9 aa, Homo Sapiens
EEDGEAGTE

SEQ ID NO: 1346499 - protein, 9 aa, Homo Sapiens
TIKCNYVDM

SEQ ID NO: 1346500 - protein, 9 aa, Homo Sapiens
KDIRQSYAN

SEQ ID NO: 1346501 - protein, 9 aa, Homo Sapiens
HSGREDTRA

SEQ ID NO: 1346502 - protein, 9 aa, Homo Sapiens
ALRYYYNKH

SEQ ID NO: 1346503 - protein, 9 aa, Homo Sapiens
NYSIDTVRV

SEQ ID NO: 1346504 - protein, 9 aa, Homo Sapiens
LQHYYVYNS

SEQ ID NO: 1346505 - protein, 9 aa, Homo Sapiens
IHSSSRIFK

SEQ ID NO: 1346506 - protein, 9 aa, Homo Sapiens
YKVGEQVTY

SEQ ID NO: 1346507 - protein, 9 aa, Homo Sapiens
TANNLLAAA

SEQ ID NO: 1346508 - protein, 9 aa, Homo Sapiens
PRRLWRSSS

SEQ ID NO: 1346509 - protein, 9 aa, Homo Sapiens
KIHTQERHY

SEQ ID NO: 1346510 - protein, 9 aa, Homo Sapiens
YFKCVQKDS

SEQ ID NO: 1346511 - protein, 9 aa, Homo Sapiens
QVNGKMILG

SEQ ID NO: 1346512 - protein, 9 aa, Homo Sapiens
GVLAWGTFA

SEQ ID NO: 1346513 - protein, 9 aa, Homo Sapiens
LNCAPKSIA

SEQ ID NO: 1346514 - protein, 9 aa, Homo Sapiens
PNDKTLSLM

SEQ ID NO: 1346515 - protein, 9 aa, Homo Sapiens
ELDSGTSVE

SEQ ID NO: 1346516 - protein, 9 aa, Homo Sapiens
MAKELAILL

SEQ ID NO: 1346517 - protein, 9 aa, Homo Sapiens
EKSSKALPV

SEQ ID NO: 1346518 - protein, 9 aa, Homo Sapiens
HRTQYEPLF

SEQ ID NO: 1346519 - protein, 9 aa, Homo Sapiens
CHHTQDQVA

SEQ ID NO: 1346520 - protein, 9 aa, Homo Sapiens
LPYFLEEPK

SEQ ID NO: 1346521 - protein, 9 aa, Homo Sapiens
VVRHFFCDM

SEQ ID NO: 1346522 - protein, 9 aa, Homo Sapiens
ISCIRGKKQ

SEQ ID NO: 1346523 - protein, 9 aa, Homo Sapiens
DKGPRAPHP

SEQ ID NO: 1346524 - protein, 9 aa, Homo Sapiens
GLTAPSLTP

SEQ ID NO: 1346525 - protein, 9 aa, Homo Sapiens
RTRDARVVG

SEQ ID NO: 1346526 - protein, 9 aa, Homo Sapiens
AFTLDGHFL

SEQ ID NO: 1346527 - protein, 9 aa, Homo Sapiens
VPQTCPRSN

SEQ ID NO: 1346528 - protein, 9 aa, Homo Sapiens
ERGCTFVNA

SEQ ID NO: 1346529 - protein, 9 aa, Homo Sapiens
VLLLGDTYN

SEQ ID NO: 1346530 - protein, 9 aa, Homo Sapiens
KKKDVYRHI

SEQ ID NO: 1346531 - protein, 9 aa, Homo Sapiens
AMRRPSSRH

SEQ ID NO: 1346532 - protein, 9 aa, Homo Sapiens
RVPTFGWVM

SEQ ID NO: 1346533 - protein, 9 aa, Homo Sapiens
FNETADLPY

SEQ ID NO: 1346534 - protein, 9 aa, Homo Sapiens
RWWGSALHF

SEQ ID NO: 1346535 - protein, 9 aa, Homo Sapiens
HISTIPVHI

SEQ ID NO: 1346536 - protein, 9 aa, Homo Sapiens
TLDEITQMM

SEQ ID NO: 1346537 - protein, 9 aa, Homo Sapiens
NSVRFHIAW

SEQ ID NO: 1346538 - protein, 9 aa, Homo Sapiens
SLPECVEPD

SEQ ID NO: 1346539 - protein, 9 aa, Homo Sapiens
RRAGTKWSS

SEQ ID NO: 1346540 - protein, 9 aa, Homo Sapiens
SQLSQKHIS

SEQ ID NO: 1346541 - protein, 9 aa, Homo Sapiens
QQLTASDHK

SEQ ID NO: 1346542 - protein, 9 aa, Homo Sapiens
SMDGPGQDA

SEQ ID NO: 1346543 - protein, 9 aa, Homo Sapiens
TAKVRRLVE

SEQ ID NO: 1346544 - protein, 9 aa, Homo Sapiens
MSADDLHIN

SEQ ID NO: 1346545 - protein, 9 aa, Homo Sapiens
VKDSEGNVS

SEQ ID NO: 1346546 - protein, 9 aa, Homo Sapiens
PAGPKGAGL

SEQ ID NO: 1346547 - protein, 9 aa, Homo Sapiens
DFDTKAVVA

SEQ ID NO: 1346548 - protein, 9 aa, Homo Sapiens
KINGLRKDF

SEQ ID NO: 1346549 - protein, 9 aa, Homo Sapiens
QFSAPGVSL

SEQ ID NO: 1346550 - protein, 9 aa, Homo Sapiens
SSLKSMVER

SEQ ID NO: 1346551 - protein, 9 aa, Homo Sapiens
AFHMYLVLV

SEQ ID NO: 1346552 - protein, 9 aa, Homo Sapiens
TALQRPGIR

SEQ ID NO: 1346553 - protein, 9 aa, Homo Sapiens
QVQVVLLPQ

SEQ ID NO: 1346554 - protein, 9 aa, Homo Sapiens
KLRAREKCR

SEQ ID NO: 1346555 - protein, 9 aa, Homo Sapiens
LIVAKSWTD

SEQ ID NO: 1346556 - protein, 9 aa, Homo Sapiens
LMAWLGVFR

SEQ ID NO: 1346557 - protein, 9 aa, Homo Sapiens
KNETKKKKG

SEQ ID NO: 1346558 - protein, 9 aa, Homo Sapiens
KLRDFITLC

SEQ ID NO: 1346559 - protein, 9 aa, Homo Sapiens
HFSKYMPSV

SEQ ID NO: 1346560 - protein, 9 aa, Homo Sapiens
EKHYECEEC

SEQ ID NO: 1346561 - protein, 9 aa, Homo Sapiens
RAAWRRCNT

SEQ ID NO: 1346562 - protein, 9 aa, Homo Sapiens
KSLPLWDDL

SEQ ID NO: 1346563 - protein, 9 aa, Homo Sapiens
VTAQDTTRH

SEQ ID NO: 1346564 - protein, 9 aa, Homo Sapiens
CVSEQTLQS

SEQ ID NO: 1346565 - protein, 9 aa, Homo Sapiens
VSELDTQDA

SEQ ID NO: 1346566 - protein, 9 aa, Homo Sapiens
KEAVKVVID

SEQ ID NO: 1346567 - protein, 9 aa, Homo Sapiens
LVNKHHPTF

SEQ ID NO: 1346568 - protein, 9 aa, Homo Sapiens
HFFCDMSPI

SEQ ID NO: 1346569 - protein, 9 aa, Homo Sapiens
DPIGPDTVA

SEQ ID NO: 1346570 - protein, 9 aa, Homo Sapiens
ILLGNDTLL

SEQ ID NO: 1346571 - protein, 9 aa, Homo Sapiens
NTTRDNEVI

SEQ ID NO: 1346572 - protein, 9 aa, Homo Sapiens
NKRPTKIGC

SEQ ID NO: 1346573 - protein, 9 aa, Homo Sapiens
LYHTATKIE

SEQ ID NO: 1346574 - protein, 9 aa, Homo Sapiens
RSKKAVDWC

SEQ ID NO: 1346575 - protein, 9 aa, Homo Sapiens
LLTFILVVQ

SEQ ID NO: 1346576 - protein, 9 aa, Homo Sapiens
VVRAREALV

SEQ ID NO: 1346577 - protein, 9 aa, Homo Sapiens
GSYDEVVLP

SEQ ID NO: 1346578 - protein, 9 aa, Homo Sapiens
PVPEKNWNL

SEQ ID NO: 1346579 - protein, 9 aa, Homo Sapiens
EKDKSPVPK

SEQ ID NO: 1346580 - protein, 9 aa, Homo Sapiens
GLLLIASLF

SEQ ID NO: 1346581 - protein, 9 aa, Homo Sapiens
ETDTYSSLA

SEQ ID NO: 1346582 - protein, 9 aa, Homo Sapiens
PETPKEMPT

SEQ ID NO: 1346583 - protein, 9 aa, Homo Sapiens
VDLCPTGFK

SEQ ID NO: 1346584 - protein, 9 aa, Homo Sapiens
DNYEELYSA

SEQ ID NO: 1346585 - protein, 9 aa, Homo Sapiens
IGEFIALYQ

SEQ ID NO: 1346586 - protein, 9 aa, Homo Sapiens
CSHYYRAPE

SEQ ID NO: 1346587 - protein, 9 aa, Homo Sapiens
PGLYHTCLA

SEQ ID NO: 1346588 - protein, 9 aa, Homo Sapiens
AYLQEQRRE

SEQ ID NO: 1346589 - protein, 9 aa, Homo Sapiens
IVEVVSKWV

SEQ ID NO: 1346590 - protein, 9 aa, Homo Sapiens
ACTGEGNII

SEQ ID NO: 1346591 - protein, 9 aa, Homo Sapiens
MWRDLEEAT

SEQ ID NO: 1346592 - protein, 9 aa, Homo Sapiens
SDNKNDFWW

SEQ ID NO: 1346593 - protein, 9 aa, Homo Sapiens
IHAITTANN

SEQ ID NO: 1346594 - protein, 9 aa, Homo Sapiens
GDLLRQMKT

SEQ ID NO: 1346595 - protein, 9 aa, Homo Sapiens
WIVADNCDE

SEQ ID NO: 1346596 - protein, 9 aa, Homo Sapiens
ENSLITLRE

SEQ ID NO: 1346597 - protein, 9 aa, Homo Sapiens
EAYADSWSG

SEQ ID NO: 1346598 - protein, 9 aa, Homo Sapiens
SSTSRDSRS

SEQ ID NO: 1346599 - protein, 9 aa, Homo Sapiens
EVRQDVEAL

SEQ ID NO: 1346600 - protein, 9 aa, Homo Sapiens
GTIIPPTSI

SEQ ID NO: 1346601 - protein, 9 aa, Homo Sapiens
LTNSVFQAE

SEQ ID NO: 1346602 - protein, 9 aa, Homo Sapiens
ICSGHDIHT

SEQ ID NO: 1346603 - protein, 9 aa, Homo Sapiens
PYLPSYYPP

SEQ ID NO: 1346604 - protein, 9 aa, Homo Sapiens
NLSHGKQDF

SEQ ID NO: 1346605 - protein, 9 aa, Homo Sapiens
MTFNLSLLV

SEQ ID NO: 1346606 - protein, 9 aa, Homo Sapiens
ELRMREREP

SEQ ID NO: 1346607 - protein, 9 aa, Homo Sapiens
LTPSLDVTP

SEQ ID NO: 1346608 - protein, 9 aa, Homo Sapiens
LSIMDLMLI

SEQ ID NO: 1346609 - protein, 9 aa, Homo Sapiens
LPHIFTSIG

SEQ ID NO: 1346610 - protein, 9 aa, Homo Sapiens
FSKDIGYLD

SEQ ID NO: 1346611 - protein, 9 aa, Homo Sapiens
DHTTPLPVT

SEQ ID NO: 1346612 - protein, 9 aa, Homo Sapiens
QHHLVEKIT

SEQ ID NO: 1346613 - protein, 9 aa, Homo Sapiens
YFLEEPKDR

SEQ ID NO: 1346614 - protein, 9 aa, Homo Sapiens
RFNPCLMEL

SEQ ID NO: 1346615 - protein, 9 aa, Homo Sapiens
ITPNDKTLS

SEQ ID NO: 1346616 - protein, 9 aa, Homo Sapiens
QKASMTKKS

SEQ ID NO: 1346617 - protein, 9 aa, Homo Sapiens
SMIPQLFGH

SEQ ID NO: 1346618 - protein, 9 aa, Homo Sapiens
PNMYPGERT

SEQ ID NO: 1346619 - protein, 9 aa, Homo Sapiens
CLTDFQAHV

SEQ ID NO: 1346620 - protein, 9 aa, Homo Sapiens
GEFQVSKLG

SEQ ID NO: 1346621 - protein, 9 aa, Homo Sapiens
GRGRGREEN

SEQ ID NO: 1346622 - protein, 9 aa, Homo Sapiens
IIVVFVAVM

SEQ ID NO: 1346623 - protein, 9 aa, Homo Sapiens
LDPVSQDMF

SEQ ID NO: 1346624 - protein, 9 aa, Homo Sapiens
VKRHRNVSI

SEQ ID NO: 1346625 - protein, 9 aa, Homo Sapiens
GRDTEGTEL

SEQ ID NO: 1346626 - protein, 9 aa, Homo Sapiens
RLQAITAAH

SEQ ID NO: 1346627 - protein, 9 aa, Homo Sapiens
DTQNVLKNY

SEQ ID NO: 1346628 - protein, 9 aa, Homo Sapiens
KFYVHIKHA

SEQ ID NO: 1346629 - protein, 9 aa, Homo Sapiens
PLEVSFPQS

SEQ ID NO: 1346630 - protein, 9 aa, Homo Sapiens
LHWQVVDTP

SEQ ID NO: 1346631 - protein, 9 aa, Homo Sapiens
LFIVANSGF

SEQ ID NO: 1346632 - protein, 9 aa, Homo Sapiens
IPSYLITCC

SEQ ID NO: 1346633 - protein, 9 aa, Homo Sapiens
LHYAGEICG

SEQ ID NO: 1346634 - protein, 9 aa, Homo Sapiens
PPAMRRPSS

SEQ ID NO: 1346635 - protein, 9 aa, Homo Sapiens
QPSLGDGLE

SEQ ID NO: 1346636 - protein, 9 aa, Homo Sapiens
GSKYFTLYE

SEQ ID NO: 1346637 - protein, 9 aa, Homo Sapiens
DAPQVDVPK

SEQ ID NO: 1346638 - protein, 9 aa, Homo Sapiens
KTNIFVPSS

SEQ ID NO: 1346639 - protein, 9 aa, Homo Sapiens
CYSFRVPEE

SEQ ID NO: 1346640 - protein, 9 aa, Homo Sapiens
KILTNESSR

SEQ ID NO: 1346641 - protein, 9 aa, Homo Sapiens
SYEAITKHN

SEQ ID NO: 1346642 - protein, 9 aa, Homo Sapiens
LQATRQLLL

SEQ ID NO: 1346643 - protein, 9 aa, Homo Sapiens
ELSLPEKDE

SEQ ID NO: 1346644 - protein, 9 aa, Homo Sapiens
IVLTSQSLF

SEQ ID NO: 1346645 - protein, 9 aa, Homo Sapiens
THSVSIPAP

SEQ ID NO: 1346646 - protein, 9 aa, Homo Sapiens
CMCCGDLLA

SEQ ID NO: 1346647 - protein, 9 aa, Homo Sapiens
WPSSDINII

SEQ ID NO: 1346648 - protein, 9 aa, Homo Sapiens
KHTAAENDF

SEQ ID NO: 1346649 - protein, 9 aa, Homo Sapiens
VAEIVLEAF

SEQ ID NO: 1346650 - protein, 9 aa, Homo Sapiens
ETSPSSAAV

SEQ ID NO: 1346651 - protein, 9 aa, Homo Sapiens
WRVLLVMSK

SEQ ID NO: 1346652 - protein, 9 aa, Homo Sapiens
CSTGARTSL

SEQ ID NO: 1346653 - protein, 9 aa, Homo Sapiens
INTQLYIHQ

SEQ ID NO: 1346654 - protein, 9 aa, Homo Sapiens
WEFCLQWLR

SEQ ID NO: 1346655 - protein, 9 aa, Homo Sapiens
VDDKCEKAC

SEQ ID NO: 1346656 - protein, 9 aa, Homo Sapiens
RAGREFHKS

SEQ ID NO: 1346657 - protein, 9 aa, Homo Sapiens
LIFNQSPSM

SEQ ID NO: 1346658 - protein, 9 aa, Homo Sapiens
LTPEDAVST

SEQ ID NO: 1346659 - protein, 9 aa, Homo Sapiens
LGFALGVGT

SEQ ID NO: 1346660 - protein, 9 aa, Homo Sapiens
WMIAAEAEK

SEQ ID NO: 1346661 - protein, 9 aa, Homo Sapiens
DINLSGAVD

SEQ ID NO: 1346662 - protein, 9 aa, Homo Sapiens
VRETSHITV

SEQ ID NO: 1346663 - protein, 9 aa, Homo Sapiens
EQSGTHDYL

SEQ ID NO: 1346664 - protein, 9 aa, Homo Sapiens
IDSMLQMLE

SEQ ID NO: 1346665 - protein, 9 aa, Homo Sapiens
IESSGINET

SEQ ID NO: 1346666 - protein, 9 aa, Homo Sapiens
GLDRRARKT

SEQ ID NO: 1346667 - protein, 9 aa, Homo Sapiens
PEENIIIKL

SEQ ID NO: 1346668 - protein, 9 aa, Homo Sapiens
GISQLITMA

SEQ ID NO: 1346669 - protein, 9 aa, Homo Sapiens
LKAVTREHL

SEQ ID NO: 1346670 - protein, 9 aa, Homo Sapiens
NQCRFSMEV

SEQ ID NO: 1346671 - protein, 9 aa, Homo Sapiens
TTSATEAWC

SEQ ID NO: 1346672 - protein, 9 aa, Homo Sapiens
SLNDSFKHL

SEQ ID NO: 1346673 - protein, 9 aa, Homo Sapiens
LLRSQLRVG

SEQ ID NO: 1346674 - protein, 9 aa, Homo Sapiens
GNLCYWLEE

SEQ ID NO: 1346675 - protein, 9 aa, Homo Sapiens
YCQVQAPVA

SEQ ID NO: 1346676 - protein, 9 aa, Homo Sapiens
KPKLKEKVW

SEQ ID NO: 1346677 - protein, 9 aa, Homo Sapiens
LLKWRFHGM

SEQ ID NO: 1346678 - protein, 9 aa, Homo Sapiens
YCMTCHETK

SEQ ID NO: 1346679 - protein, 9 aa, Homo Sapiens
IMTVRRSGA

SEQ ID NO: 1346680 - protein, 9 aa, Homo Sapiens
DASRDYISM

SEQ ID NO: 1346681 - protein, 9 aa, Homo Sapiens
KPPQHLTWL

SEQ ID NO: 1346682 - protein, 9 aa, Homo Sapiens
NIGVIVVGF

SEQ ID NO: 1346683 - protein, 9 aa, Homo Sapiens
SLSSVMKQA

SEQ ID NO: 1346684 - protein, 9 aa, Homo Sapiens
HLDTFAMEG

SEQ ID NO: 1346685 - protein, 9 aa, Homo Sapiens
LGMQLLVVN

SEQ ID NO: 1346686 - protein, 9 aa, Homo Sapiens
RMAVDLHRL

SEQ ID NO: 1346687 - protein, 9 aa, Homo Sapiens
RSPASTSVA

SEQ ID NO: 1346688 - protein, 9 aa, Homo Sapiens
VQCALHFAI

SEQ ID NO: 1346689 - protein, 9 aa, Homo Sapiens
AHNRNNSGD

SEQ ID NO: 1346690 - protein, 9 aa, Homo Sapiens
TVITEGPPA

SEQ ID NO: 1346691 - protein, 9 aa, Homo Sapiens
DDDAPKKQV

SEQ ID NO: 1346692 - protein, 9 aa, Homo Sapiens
KHNFIALEI

SEQ ID NO: 1346693 - protein, 9 aa, Homo Sapiens
AVLPRLRRE

SEQ ID NO: 1346694 - protein, 9 aa, Homo Sapiens
DVKVLRWII

SEQ ID NO: 1346695 - protein, 9 aa, Homo Sapiens
DFEVFFFTI

SEQ ID NO: 1346696 - protein, 9 aa, Homo Sapiens
LEMAGWPET

SEQ ID NO: 1346697 - protein, 9 aa, Homo Sapiens
PNPEVMCSD

SEQ ID NO: 1346698 - protein, 9 aa, Homo Sapiens
LCAIHAKCV

SEQ ID NO: 1346699 - protein, 9 aa, Homo Sapiens
TRPQRRHTW

SEQ ID NO: 1346700 - protein, 9 aa, Homo Sapiens
LYYDTACTL

SEQ ID NO: 1346701 - protein, 9 aa, Homo Sapiens
LERNYYRLK

SEQ ID NO: 1346702 - protein, 9 aa, Homo Sapiens
EYENKLYDE

SEQ ID NO: 1346703 - protein, 9 aa, Homo Sapiens
CFLDLLELP

SEQ ID NO: 1346704 - protein, 9 aa, Homo Sapiens
IVMVLNATK

SEQ ID NO: 1346705 - protein, 9 aa, Homo Sapiens
KKDVCIEAY

SEQ ID NO: 1346706 - protein, 9 aa, Homo Sapiens
HTTRERVLQ

SEQ ID NO: 1346707 - protein, 9 aa, Homo Sapiens
RVANHVLDE

SEQ ID NO: 1346708 - protein, 9 aa, Homo Sapiens
YYTWKKIMW

SEQ ID NO: 1346709 - protein, 9 aa, Homo Sapiens
AGRSQDDTM

SEQ ID NO: 1346710 - protein, 9 aa, Homo Sapiens
ECGRRLSEE

SEQ ID NO: 1346711 - protein, 9 aa, Homo Sapiens
IVVHSKQNS

SEQ ID NO: 1346712 - protein, 9 aa, Homo Sapiens
PRAVGCTEP

SEQ ID NO: 1346713 - protein, 9 aa, Homo Sapiens
HQSVSLKSQ

SEQ ID NO: 1346714 - protein, 9 aa, Homo Sapiens
SRGTLWRLW

SEQ ID NO: 1346715 - protein, 9 aa, Homo Sapiens
TPSMVAMFE

SEQ ID NO: 1346716 - protein, 8 aa, Homo Sapiens
KLHYVAVL

SEQ ID NO: 1346717 - protein, 9 aa, Homo Sapiens
SKLRAREKC

SEQ ID NO: 1346718 - protein, 9 aa, Homo Sapiens
ASSLIAHVH

SEQ ID NO: 1346719 - protein, 9 aa, Homo Sapiens
EDTLHCFFQ

SEQ ID NO: 1346720 - protein, 9 aa, Homo Sapiens
PPKKPEALI

SEQ ID NO: 1346721 - protein, 9 aa, Homo Sapiens
CGVTPTDFP

SEQ ID NO: 1346722 - protein, 9 aa, Homo Sapiens
YVPQTNTWN

SEQ ID NO: 1346723 - protein, 9 aa, Homo Sapiens
QALEHYTNL

SEQ ID NO: 1346724 - protein, 9 aa, Homo Sapiens
IHCIICNHC

SEQ ID NO: 1346725 - protein, 9 aa, Homo Sapiens
HITPTTGVP

SEQ ID NO: 1346726 - protein, 9 aa, Homo Sapiens
GPQLWARHM

SEQ ID NO: 1346727 - protein, 9 aa, Homo Sapiens
MPLPVISPL

SEQ ID NO: 1346728 - protein, 9 aa, Homo Sapiens
PLSHQPGSE

SEQ ID NO: 1346729 - protein, 9 aa, Homo Sapiens
EGKKSGDSG

SEQ ID NO: 1346730 - protein, 9 aa, Homo Sapiens
TQKWFPELP

SEQ ID NO: 1346731 - protein, 9 aa, Homo Sapiens
GVCALLCGV

SEQ ID NO: 1346732 - protein, 9 aa, Homo Sapiens
HHGPCIPDV

SEQ ID NO: 1346733 - protein, 9 aa, Homo Sapiens
RGPCSDTLV

SEQ ID NO: 1346734 - protein, 9 aa, Homo Sapiens
TGIRLSIMR

SEQ ID NO: 1346735 - protein, 9 aa, Homo Sapiens
AGNPEEERW

SEQ ID NO: 1346736 - protein, 9 aa, Homo Sapiens
LHIGHTLTV

SEQ ID NO: 1346737 - protein, 9 aa, Homo Sapiens
AFLWPCGPV

SEQ ID NO: 1346738 - protein, 9 aa, Homo Sapiens
PVSVQLNYM

SEQ ID NO: 1346739 - protein, 9 aa, Homo Sapiens
AADWHYLVS

SEQ ID NO: 1346740 - protein, 9 aa, Homo Sapiens
YGYNSCGAF

SEQ ID NO: 1346741 - protein, 9 aa, Homo Sapiens
GATCHNFIY

SEQ ID NO: 1346742 - protein, 9 aa, Homo Sapiens
HIGPAEVES

SEQ ID NO: 1346743 - protein, 9 aa, Homo Sapiens
DPGLPKMQA

SEQ ID NO: 1346744 - protein, 9 aa, Homo Sapiens
QYGFVLEDF

SEQ ID NO: 1346745 - protein, 9 aa, Homo Sapiens
QRRRKERRR

SEQ ID NO: 1346746 - protein, 9 aa, Homo Sapiens
RSRSYSRSW

SEQ ID NO: 1346747 - protein, 9 aa, Homo Sapiens
PHRPGPTRK

SEQ ID NO: 1346748 - protein, 9 aa, Homo Sapiens
SDNPEFNIG

SEQ ID NO: 1346749 - protein, 9 aa, Homo Sapiens
STSVHTSHA

SEQ ID NO: 1346750 - protein, 9 aa, Homo Sapiens
YGERCCLRT

SEQ ID NO: 1346751 - protein, 9 aa, Homo Sapiens
DRGPLGLSG

SEQ ID NO: 1346752 - protein, 9 aa, Homo Sapiens
DHLSRFNVC

SEQ ID NO: 1346753 - protein, 9 aa, Homo Sapiens
KPCSDTDSD

SEQ ID NO: 1346754 - protein, 9 aa, Homo Sapiens
DQILQANNY

SEQ ID NO: 1346755 - protein, 9 aa, Homo Sapiens
TDFYGQITH

SEQ ID NO: 1346756 - protein, 9 aa, Homo Sapiens
ITHYLYIAP

SEQ ID NO: 1346757 - protein, 9 aa, Homo Sapiens
NETQRQKAI

SEQ ID NO: 1346758 - protein, 9 aa, Homo Sapiens
LSQAPQAVH

SEQ ID NO: 1346759 - protein, 9 aa, Homo Sapiens
GPLFLLFFS

SEQ ID NO: 1346760 - protein, 9 aa, Homo Sapiens
EFSSKQESY

SEQ ID NO: 1346761 - protein, 9 aa, Homo Sapiens
SQIVKEDRR

SEQ ID NO: 1346762 - protein, 9 aa, Homo Sapiens
VPPGATYTV

SEQ ID NO: 1346763 - protein, 9 aa, Homo Sapiens
DIFDELFKL

SEQ ID NO: 1346764 - protein, 9 aa, Homo Sapiens
KTQVSSNLL

SEQ ID NO: 1346765 - protein, 9 aa, Homo Sapiens
GTERGCTFV

SEQ ID NO: 1346766 - protein, 9 aa, Homo Sapiens
IAASEKTSN

SEQ ID NO: 1346767 - protein, 9 aa, Homo Sapiens
MAYDHYAAV

SEQ ID NO: 1346768 - protein, 9 aa, Homo Sapiens
VLNQYTYTI

SEQ ID NO: 1346769 - protein, 9 aa, Homo Sapiens
DYGESSSLV

SEQ ID NO: 1346770 - protein, 9 aa, Homo Sapiens
SYLLKSVQR

SEQ ID NO: 1346771 - protein, 9 aa, Homo Sapiens
YSQIPPPLP

SEQ ID NO: 1346772 - protein, 9 aa, Homo Sapiens
NRKKSDYSL

SEQ ID NO: 1346773 - protein, 9 aa, Homo Sapiens
DSGIKANIS

SEQ ID NO: 1346774 - protein, 9 aa, Homo Sapiens
QATGKEEKS

SEQ ID NO: 1346775 - protein, 9 aa, Homo Sapiens
ALNIPFMLV

SEQ ID NO: 1346776 - protein, 9 aa, Homo Sapiens
WVALPETMK

SEQ ID NO: 1346777 - protein, 9 aa, Homo Sapiens
YSSPFYIWT

SEQ ID NO: 1346778 - protein, 9 aa, Homo Sapiens
LLHHTLPPA

SEQ ID NO: 1346779 - protein, 9 aa, Homo Sapiens
QLFKDYEIC

SEQ ID NO: 1346780 - protein, 9 aa, Homo Sapiens
ISGLHATIE

SEQ ID NO: 1346781 - protein, 9 aa, Homo Sapiens
IQLYLGTKL

SEQ ID NO: 1346782 - protein, 9 aa, Homo Sapiens
EQGRPYPMI

SEQ ID NO: 1346783 - protein, 9 aa, Homo Sapiens
STSRTQKSA

SEQ ID NO: 1346784 - protein, 9 aa, Homo Sapiens
AFGNALIQR

SEQ ID NO: 1346785 - protein, 9 aa, Homo Sapiens
YVDSDSEEE

SEQ ID NO: 1346786 - protein, 9 aa, Homo Sapiens
TPIITFPEF

SEQ ID NO: 1346787 - protein, 9 aa, Homo Sapiens
AMMSKLRFE

SEQ ID NO: 1346788 - protein, 9 aa, Homo Sapiens
ANGNTGTSP

SEQ ID NO: 1346789 - protein, 9 aa, Homo Sapiens
YQERANKKQ

SEQ ID NO: 1346790 - protein, 9 aa, Homo Sapiens
MAGARAKGS

SEQ ID NO: 1346791 - protein, 9 aa, Homo Sapiens
QLVQEQELV

SEQ ID NO: 1346792 - protein, 9 aa, Homo Sapiens
TTLVMVEAE

SEQ ID NO: 1346793 - protein, 9 aa, Homo Sapiens
SAVLMALRR

SEQ ID NO: 1346794 - protein, 9 aa, Homo Sapiens
ILHAFLLCA

SEQ ID NO: 1346795 - protein, 9 aa, Homo Sapiens
ITGRTHQLR

SEQ ID NO: 1346796 - protein, 9 aa, Homo Sapiens
MCTLSEDTI

SEQ ID NO: 1346797 - protein, 9 aa, Homo Sapiens
PGGPLFNEL

SEQ ID NO: 1346798 - protein, 9 aa, Homo Sapiens
GKYYNVPVA

SEQ ID NO: 1346799 - protein, 9 aa, Homo Sapiens
EPYSIPLSQ

SEQ ID NO: 1346800 - protein, 9 aa, Homo Sapiens
DTCVSNPCH

SEQ ID NO: 1346801 - protein, 9 aa, Homo Sapiens
KQHRSRTTF

SEQ ID NO: 1346802 - protein, 9 aa, Homo Sapiens
TLRRMEELG

SEQ ID NO: 1346803 - protein, 9 aa, Homo Sapiens
WPPPHWLEV

SEQ ID NO: 1346804 - protein, 9 aa, Homo Sapiens
CHTKIHHVD

SEQ ID NO: 1346805 - protein, 9 aa, Homo Sapiens
IVMEKLSGH

SEQ ID NO: 1346806 - protein, 9 aa, Homo Sapiens
GQRIRDVKC

SEQ ID NO: 1346807 - protein, 9 aa, Homo Sapiens
YAYRHIFQK

SEQ ID NO: 1346808 - protein, 9 aa, Homo Sapiens
SLGAFFTGD

SEQ ID NO: 1346809 - protein, 9 aa, Homo Sapiens
CIDWNCEVL

SEQ ID NO: 1346810 - protein, 9 aa, Homo Sapiens
PLAWLCISA

SEQ ID NO: 1346811 - protein, 9 aa, Homo Sapiens
QCATSNVFA

SEQ ID NO: 1346812 - protein, 9 aa, Homo Sapiens
LDNVRIVSG

SEQ ID NO: 1346813 - protein, 9 aa, Homo Sapiens
LETALYYTH

SEQ ID NO: 1346814 - protein, 9 aa, Homo Sapiens
CGTRYKKRD

SEQ ID NO: 1346815 - protein, 9 aa, Homo Sapiens
SIKTHDPKA

SEQ ID NO: 1346816 - protein, 9 aa, Homo Sapiens
ITSTYGWTA

SEQ ID NO: 1346817 - protein, 9 aa, Homo Sapiens
TSEMVLADD

SEQ ID NO: 1346818 - protein, 9 aa, Homo Sapiens
TQAHLGVSD

SEQ ID NO: 1346819 - protein, 9 aa, Homo Sapiens
RQVKHYHIF

SEQ ID NO: 1346820 - protein, 9 aa, Homo Sapiens
SDSYMALGI

SEQ ID NO: 1346821 - protein, 9 aa, Homo Sapiens
GMQLVLPCW

SEQ ID NO: 1346822 - protein, 9 aa, Homo Sapiens
LVIQNVNVS

SEQ ID NO: 1346823 - protein, 9 aa, Homo Sapiens
ISIDHYYAV

SEQ ID NO: 1346824 - protein, 9 aa, Homo Sapiens
LYQSWELRP

SEQ ID NO: 1346825 - protein, 9 aa, Homo Sapiens
KLWRHPITG

SEQ ID NO: 1346826 - protein, 9 aa, Homo Sapiens
CTLTAAMCY

SEQ ID NO: 1346827 - protein, 9 aa, Homo Sapiens
AQALGQALH

SEQ ID NO: 1346828 - protein, 9 aa, Homo Sapiens
YEWSIKLNW

SEQ ID NO: 1346829 - protein, 9 aa, Homo Sapiens
YLIRPKVQV

SEQ ID NO: 1346830 - protein, 9 aa, Homo Sapiens
NSSDAGAAS

SEQ ID NO: 1346831 - protein, 9 aa, Homo Sapiens
LDLILLKYA

SEQ ID NO: 1346832 - protein, 9 aa, Homo Sapiens
SVISDCTEI

SEQ ID NO: 1346833 - protein, 9 aa, Homo Sapiens
NGAEQYLVQ

SEQ ID NO: 1346834 - protein, 9 aa, Homo Sapiens
HQYWPAEHS

SEQ ID NO: 1346835 - protein, 9 aa, Homo Sapiens
EGFTTHLED

SEQ ID NO: 1346836 - protein, 9 aa, Homo Sapiens
LTSTNKSES

SEQ ID NO: 1346837 - protein, 9 aa, Homo Sapiens
RGCTFVNAR

SEQ ID NO: 1346838 - protein, 9 aa, Homo Sapiens
KNWNLLFLR

SEQ ID NO: 1346839 - protein, 9 aa, Homo Sapiens
RHTMNLEAV

SEQ ID NO: 1346840 - protein, 9 aa, Homo Sapiens
AGLAQGLHK

SEQ ID NO: 1346841 - protein, 9 aa, Homo Sapiens
KAKATMNVK

SEQ ID NO: 1346842 - protein, 9 aa, Homo Sapiens
EEPGTEEEC

SEQ ID NO: 1346843 - protein, 9 aa, Homo Sapiens
MMATVMGSL

SEQ ID NO: 1346844 - protein, 9 aa, Homo Sapiens
ENVMGDFLK

SEQ ID NO: 1346845 - protein, 9 aa, Homo Sapiens
EHISIHQPG

SEQ ID NO: 1346846 - protein, 9 aa, Homo Sapiens
RHILLSSTE

SEQ ID NO: 1346847 - protein, 9 aa, Homo Sapiens
KGMVTEFKH

SEQ ID NO: 1346848 - protein, 9 aa, Homo Sapiens
RPVNWCAND

SEQ ID NO: 1346849 - protein, 9 aa, Homo Sapiens
TWSKGVRVP

SEQ ID NO: 1346850 - protein, 9 aa, Homo Sapiens
ECPNYQGQQ

SEQ ID NO: 1346851 - protein, 9 aa, Homo Sapiens
YLLVPARYR

SEQ ID NO: 1346852 - protein, 9 aa, Homo Sapiens
RLHQSPSGT

SEQ ID NO: 1346853 - protein, 9 aa, Homo Sapiens
GELKRVICG

SEQ ID NO: 1346854 - protein, 9 aa, Homo Sapiens
SLVSKDTLV

SEQ ID NO: 1346855 - protein, 9 aa, Homo Sapiens
HQAEKMGID

SEQ ID NO: 1346856 - protein, 9 aa, Homo Sapiens
PGSLAPLGY

SEQ ID NO: 1346857 - protein, 9 aa, Homo Sapiens
GKDKSSVNW

SEQ ID NO: 1346858 - protein, 9 aa, Homo Sapiens
VVAGSLSQY

SEQ ID NO: 1346859 - protein, 9 aa, Homo Sapiens
ISGLCYDSK

SEQ ID NO: 1346860 - protein, 9 aa, Homo Sapiens
RESIPAKSS

SEQ ID NO: 1346861 - protein, 9 aa, Homo Sapiens
SVNDLIRYL

SEQ ID NO: 1346862 - protein, 9 aa, Homo Sapiens
VQSCIDWNC

SEQ ID NO: 1346863 - protein, 9 aa, Homo Sapiens
DTVSVHHPG

SEQ ID NO: 1346864 - protein, 9 aa, Homo Sapiens
SSQDTGHLT

SEQ ID NO: 1346865 - protein, 9 aa, Homo Sapiens
LWRTDRPKI

SEQ ID NO: 1346866 - protein, 9 aa, Homo Sapiens
ILCIEVEAV

SEQ ID NO: 1346867 - protein, 9 aa, Homo Sapiens
LLSIPRVGK

SEQ ID NO: 1346868 - protein, 9 aa, Homo Sapiens
NDQEQASWV

SEQ ID NO: 1346869 - protein, 9 aa, Homo Sapiens
SYLMKPYIK

SEQ ID NO: 1346870 - protein, 9 aa, Homo Sapiens
CGTKCPVEW

SEQ ID NO: 1346871 - protein, 9 aa, Homo Sapiens
ASASQVSCF

SEQ ID NO: 1346872 - protein, 9 aa, Homo Sapiens
PSPCLSWSS

SEQ ID NO: 1346873 - protein, 9 aa, Homo Sapiens
YTLINAEVK

SEQ ID NO: 1346874 - protein, 9 aa, Homo Sapiens
DCSYHDKPG

SEQ ID NO: 1346875 - protein, 9 aa, Homo Sapiens
TKKIEGKYE

SEQ ID NO: 1346876 - protein, 9 aa, Homo Sapiens
LSMVFAGAP

SEQ ID NO: 1346877 - protein, 9 aa, Homo Sapiens
GMQRAVQTP

SEQ ID NO: 1346878 - protein, 9 aa, Homo Sapiens
SRHQVLTRI

SEQ ID NO: 1346879 - protein, 9 aa, Homo Sapiens
QKEEVRQDV

SEQ ID NO: 1346880 - protein, 9 aa, Homo Sapiens
HHTWPWVNF

SEQ ID NO: 1346881 - protein, 9 aa, Homo Sapiens
QAHLYSCLD

SEQ ID NO: 1346882 - protein, 9 aa, Homo Sapiens
SVLEHLKIF

SEQ ID NO: 1346883 - protein, 9 aa, Homo Sapiens
IGQKKPVCV

SEQ ID NO: 1346884 - protein, 9 aa, Homo Sapiens
CRTVGECRS

SEQ ID NO: 1346885 - protein, 9 aa, Homo Sapiens
KRISSNPVT

SEQ ID NO: 1346886 - protein, 9 aa, Homo Sapiens
NITKTQKVC

SEQ ID NO: 1346887 - protein, 9 aa, Homo Sapiens
SDINIIPGE

SEQ ID NO: 1346888 - protein, 9 aa, Homo Sapiens
AQKLKYKVI

SEQ ID NO: 1346889 - protein, 9 aa, Homo Sapiens
DLAFLRAKV

SEQ ID NO: 1346890 - protein, 9 aa, Homo Sapiens
VAHMRLETR

SEQ ID NO: 1346891 - protein, 9 aa, Homo Sapiens
FRFIVRFIA

SEQ ID NO: 1346892 - protein, 9 aa, Homo Sapiens
VFNDCFSLN

SEQ ID NO: 1346893 - protein, 9 aa, Homo Sapiens
MGWHDTEDA

SEQ ID NO: 1346894 - protein, 9 aa, Homo Sapiens
VVGAAVATV

SEQ ID NO: 1346895 - protein, 9 aa, Homo Sapiens
TVGLGVFAT

SEQ ID NO: 1346896 - protein, 9 aa, Homo Sapiens
LMHASLYLS

SEQ ID NO: 1346897 - protein, 9 aa, Homo Sapiens
QQLYHLDTY

SEQ ID NO: 1346898 - protein, 9 aa, Homo Sapiens
STAECEQAL

SEQ ID NO: 1346899 - protein, 9 aa, Homo Sapiens
KIKETYFDT

SEQ ID NO: 1346900 - protein, 9 aa, Homo Sapiens
QASMIPQLF

SEQ ID NO: 1346901 - protein, 9 aa, Homo Sapiens
ASPGLTAPS

SEQ ID NO: 1346902 - protein, 9 aa, Homo Sapiens
ELLQVYYDT

SEQ ID NO: 1346903 - protein, 9 aa, Homo Sapiens
LTWLAGTII

SEQ ID NO: 1346904 - protein, 9 aa, Homo Sapiens
IILVFIFLW

SEQ ID NO: 1346905 - protein, 9 aa, Homo Sapiens
PRALAAGAS

SEQ ID NO: 1346906 - protein, 9 aa, Homo Sapiens
AQTSLTNSV

SEQ ID NO: 1346907 - protein, 9 aa, Homo Sapiens
YKDRSNNQF

SEQ ID NO: 1346908 - protein, 9 aa, Homo Sapiens
LFFVLVNLE

SEQ ID NO: 1346909 - protein, 9 aa, Homo Sapiens
IRAYSSHED

SEQ ID NO: 1346910 - protein, 9 aa, Homo Sapiens
RVRPVNTYV

SEQ ID NO: 1346911 - protein, 9 aa, Homo Sapiens
KPIALPHCS

SEQ ID NO: 1346912 - protein, 9 aa, Homo Sapiens
AGEKVWQIH

SEQ ID NO: 1346913 - protein, 9 aa, Homo Sapiens
DFKEMRETH

SEQ ID NO: 1346914 - protein, 9 aa, Homo Sapiens
FSLPDGETC

SEQ ID NO: 1346915 - protein, 9 aa, Homo Sapiens
ELWITYGQG

SEQ ID NO: 1346916 - protein, 9 aa, Homo Sapiens
LLYGHDVSS

SEQ ID NO: 1346917 - protein, 9 aa, Homo Sapiens
SNERRHMQS

SEQ ID NO: 1346918 - protein, 9 aa, Homo Sapiens
WTADMVPNG

SEQ ID NO: 1346919 - protein, 9 aa, Homo Sapiens
SNYCKKIPS

SEQ ID NO: 1346920 - protein, 9 aa, Homo Sapiens
CHHGETCHP

SEQ ID NO: 1346921 - protein, 9 aa, Homo Sapiens
FEVSVDKAH

SEQ ID NO: 1346922 - protein, 9 aa, Homo Sapiens
YHIDSSNFN

SEQ ID NO: 1346923 - protein, 9 aa, Homo Sapiens
AFSSVEMLV

SEQ ID NO: 1346924 - protein, 9 aa, Homo Sapiens
RLGEVRIHI

SEQ ID NO: 1346925 - protein, 9 aa, Homo Sapiens
DMPKDAKYL

SEQ ID NO: 1346926 - protein, 9 aa, Homo Sapiens
GAWSHFVFV

SEQ ID NO: 1346927 - protein, 9 aa, Homo Sapiens
HWTPPSITP

SEQ ID NO: 1346928 - protein, 9 aa, Homo Sapiens
CKSEECGKG

SEQ ID NO: 1346929 - protein, 9 aa, Homo Sapiens
FTPTHLHPC

SEQ ID NO: 1346930 - protein, 9 aa, Homo Sapiens
SEVPSPMPT

SEQ ID NO: 1346931 - protein, 9 aa, Homo Sapiens
NSPLKLLAD

SEQ ID NO: 1346932 - protein, 9 aa, Homo Sapiens
LLNLLDVIF

SEQ ID NO: 1346933 - protein, 9 aa, Homo Sapiens
TMHQQDIND

SEQ ID NO: 1346934 - protein, 9 aa, Homo Sapiens
CSYGQILLA

SEQ ID NO: 1346935 - protein, 9 aa, Homo Sapiens
ENMLCDEEP

SEQ ID NO: 1346936 - protein, 9 aa, Homo Sapiens
PPSRCTGAG

SEQ ID NO: 1346937 - protein, 9 aa, Homo Sapiens
FEPSAHISA

SEQ ID NO: 1346938 - protein, 9 aa, Homo Sapiens
AQPPAVAPP

SEQ ID NO: 1346939 - protein, 9 aa, Homo Sapiens
ECWAMRSYT

SEQ ID NO: 1346940 - protein, 9 aa, Homo Sapiens
LRLDGSQRP

SEQ ID NO: 1346941 - protein, 9 aa, Homo Sapiens
APTFWSTGA

SEQ ID NO: 1346942 - protein, 9 aa, Homo Sapiens
CLSQAEERA

SEQ ID NO: 1346943 - protein, 9 aa, Homo Sapiens
MKSNCMQTT

SEQ ID NO: 1346944 - protein, 9 aa, Homo Sapiens
HCLGLGVRA

SEQ ID NO: 1346945 - protein, 9 aa, Homo Sapiens
MGFISKEWE

SEQ ID NO: 1346946 - protein, 9 aa, Homo Sapiens
YPCGTCDLV

SEQ ID NO: 1346947 - protein, 9 aa, Homo Sapiens
CQIPSHLMQ

SEQ ID NO: 1346948 - protein, 9 aa, Homo Sapiens
SRQSHRYDW

SEQ ID NO: 1346949 - protein, 9 aa, Homo Sapiens
RSSLEKPNG

SEQ ID NO: 1346950 - protein, 9 aa, Homo Sapiens
SSLKWQIAQ

SEQ ID NO: 1346951 - protein, 9 aa, Homo Sapiens
LALVAFSEA

SEQ ID NO: 1346952 - protein, 9 aa, Homo Sapiens
FWVTSSMSS

SEQ ID NO: 1346953 - protein, 9 aa, Homo Sapiens
PKLVSHSGR

SEQ ID NO: 1346954 - protein, 9 aa, Homo Sapiens
QEAYETREY

SEQ ID NO: 1346955 - protein, 9 aa, Homo Sapiens
TLHHFLEQH

SEQ ID NO: 1346956 - protein, 9 aa, Homo Sapiens
QVTTTLKLI

SEQ ID NO: 1346957 - protein, 9 aa, Homo Sapiens
LRIRQDPNR

SEQ ID NO: 1346958 - protein, 9 aa, Homo Sapiens
SGRCKANPQ

SEQ ID NO: 1346959 - protein, 9 aa, Homo Sapiens
YLVERTRDA

SEQ ID NO: 1346960 - protein, 9 aa, Homo Sapiens
TPQYNLMIE

SEQ ID NO: 1346961 - protein, 9 aa, Homo Sapiens
RASDLLQGP

SEQ ID NO: 1346962 - protein, 9 aa, Homo Sapiens
AKVAHMRLE

SEQ ID NO: 1346963 - protein, 9 aa, Homo Sapiens
AAMRYVQFM

SEQ ID NO: 1346964 - protein, 9 aa, Homo Sapiens
KPSSVVKCS

SEQ ID NO: 1346965 - protein, 9 aa, Homo Sapiens
TPFIIGVNV

SEQ ID NO: 1346966 - protein, 9 aa, Homo Sapiens
AAAVLMAWL

SEQ ID NO: 1346967 - protein, 9 aa, Homo Sapiens
VAIRHRPSL

SEQ ID NO: 1346968 - protein, 9 aa, Homo Sapiens
ESEGCGSTF

SEQ ID NO: 1346969 - protein, 9 aa, Homo Sapiens
GKLSFIIQP

SEQ ID NO: 1346970 - protein, 9 aa, Homo Sapiens
RLLILRSPR

SEQ ID NO: 1346971 - protein, 9 aa, Homo Sapiens
CTGHHHIVK

SEQ ID NO: 1346972 - protein, 9 aa, Homo Sapiens
NEDTVRFTL

SEQ ID NO: 1346973 - protein, 9 aa, Homo Sapiens
NTDGAACHF

SEQ ID NO: 1346974 - protein, 9 aa, Homo Sapiens
LSKVPSEVP

SEQ ID NO: 1346975 - protein, 9 aa, Homo Sapiens
MNNLVSEYQ

SEQ ID NO: 1346976 - protein, 9 aa, Homo Sapiens
KLKEEEKRV

SEQ ID NO: 1346977 - protein, 9 aa, Homo Sapiens
PSPEQLPRD

SEQ ID NO: 1346978 - protein, 9 aa, Homo Sapiens
GATEIDMVI

SEQ ID NO: 1346979 - protein, 9 aa, Homo Sapiens
YDSIKDEDQ

SEQ ID NO: 1346980 - protein, 9 aa, Homo Sapiens
KNIDTTPVV

SEQ ID NO: 1346981 - protein, 9 aa, Homo Sapiens
GALLRGLGL

SEQ ID NO: 1346982 - protein, 9 aa, Homo Sapiens
FNESAAERY

SEQ ID NO: 1346983 - protein, 9 aa, Homo Sapiens
EICQYVVQV

SEQ ID NO: 1346984 - protein, 9 aa, Homo Sapiens
GNGTSSDLN

SEQ ID NO: 1346985 - protein, 9 aa, Homo Sapiens
TEKDVSHAV

SEQ ID NO: 1346986 - protein, 9 aa, Homo Sapiens
LVVTCLERW

SEQ ID NO: 1346987 - protein, 9 aa, Homo Sapiens
DSDAKSLHI

SEQ ID NO: 1346988 - protein, 9 aa, Homo Sapiens
RPELLWMCL

SEQ ID NO: 1346989 - protein, 9 aa, Homo Sapiens
SAMAAVIHY

SEQ ID NO: 1346990 - protein, 9 aa, Homo Sapiens
ALEYHTTRE

SEQ ID NO: 1346991 - protein, 9 aa, Homo Sapiens
PPDCSHQHC

SEQ ID NO: 1346992 - protein, 9 aa, Homo Sapiens
RYHYYQNVC

SEQ ID NO: 1346993 - protein, 9 aa, Homo Sapiens
LYKMHDILN

SEQ ID NO: 1346994 - protein, 9 aa, Homo Sapiens
MDVAFLVLD

SEQ ID NO: 1346995 - protein, 9 aa, Homo Sapiens
PPEAAQNDQ

SEQ ID NO: 1346996 - protein, 9 aa, Homo Sapiens
AAQMVHREF

SEQ ID NO: 1346997 - protein, 9 aa, Homo Sapiens
LWHRTQYEP

SEQ ID NO: 1346998 - protein, 9 aa, Homo Sapiens
LHIFKWVPV

SEQ ID NO: 1346999 - protein, 9 aa, Homo Sapiens
EHIFELAKS

SEQ ID NO: 1347000 - protein, 9 aa, Homo Sapiens
HFSFSPTGM

SEQ ID NO: 1347001 - protein, 9 aa, Homo Sapiens
LKKPIHAAK

SEQ ID NO: 1347002 - protein, 9 aa, Homo Sapiens
QLNEATCND

SEQ ID NO: 1347003 - protein, 9 aa, Homo Sapiens
FGFTIDNTC

SEQ ID NO: 1347004 - protein, 9 aa, Homo Sapiens
VWHVSELDT

SEQ ID NO: 1347005 - protein, 9 aa, Homo Sapiens
DSFQIILNS

SEQ ID NO: 1347006 - protein, 9 aa, Homo Sapiens
EIRILEHLQ

SEQ ID NO: 1347007 - protein, 9 aa, Homo Sapiens
TKSKDARVC

SEQ ID NO: 1347008 - protein, 9 aa, Homo Sapiens
INCYHDMTA

SEQ ID NO: 1347009 - protein, 9 aa, Homo Sapiens
PAKMRRRSW

SEQ ID NO: 1347010 - protein, 9 aa, Homo Sapiens
MQHKHLKSN

SEQ ID NO: 1347011 - protein, 9 aa, Homo Sapiens
GSALTFFTA

SEQ ID NO: 1347012 - protein, 9 aa, Homo Sapiens
SALTSHLRI

SEQ ID NO: 1347013 - protein, 9 aa, Homo Sapiens
TYHVLMCGG

SEQ ID NO: 1347014 - protein, 9 aa, Homo Sapiens
PHFQDSSSS

SEQ ID NO: 1347015 - protein, 9 aa, Homo Sapiens
PFLAVRQVV

SEQ ID NO: 1347016 - protein, 9 aa, Homo Sapiens
ILQANNYNI

SEQ ID NO: 1347017 - protein, 9 aa, Homo Sapiens
QVIDLLPGL

SEQ ID NO: 1347018 - protein, 9 aa, Homo Sapiens
QQQATGKEE

SEQ ID NO: 1347019 - protein, 9 aa, Homo Sapiens
SFTHLPDCK

SEQ ID NO: 1347020 - protein, 9 aa, Homo Sapiens
IPPNNQSPP

SEQ ID NO: 1347021 - protein, 9 aa, Homo Sapiens
ECGKAFRLC

SEQ ID NO: 1347022 - protein, 9 aa, Homo Sapiens
IQEGAHNIS

SEQ ID NO: 1347023 - protein, 9 aa, Homo Sapiens
AEMLGTKIK

SEQ ID NO: 1347024 - protein, 9 aa, Homo Sapiens
ASPSTRGRT

SEQ ID NO: 1347025 - protein, 9 aa, Homo Sapiens
EYSPNSSPG

SEQ ID NO: 1347026 - protein, 9 aa, Homo Sapiens
SSGFTGVYF

SEQ ID NO: 1347027 - protein, 9 aa, Homo Sapiens
DWQLRCTIW

SEQ ID NO: 1347028 - protein, 9 aa, Homo Sapiens
YHGSTKHMK

SEQ ID NO: 1347029 - protein, 9 aa, Homo Sapiens
KECLNRILC

SEQ ID NO: 1347030 - protein, 9 aa, Homo Sapiens
YRCNIDRTP

SEQ ID NO: 1347031 - protein, 9 aa, Homo Sapiens
AIVTALGDG

SEQ ID NO: 1347032 - protein, 9 aa, Homo Sapiens
VISEDTLVG

SEQ ID NO: 1347033 - protein, 9 aa, Homo Sapiens
FNVTVLHDS

SEQ ID NO: 1347034 - protein, 9 aa, Homo Sapiens
GITNSPIQK

SEQ ID NO: 1347035 - protein, 9 aa, Homo Sapiens
GWPGAPCVP

SEQ ID NO: 1347036 - protein, 9 aa, Homo Sapiens
GGITFVPHW

SEQ ID NO: 1347037 - protein, 9 aa, Homo Sapiens
EEVYAVTKL

SEQ ID NO: 1347038 - protein, 9 aa, Homo Sapiens
RVEMDRVLM

SEQ ID NO: 1347039 - protein, 9 aa, Homo Sapiens
GSSFSSGSS

SEQ ID NO: 1347040 - protein, 9 aa, Homo Sapiens
NFSNRPVLA

SEQ ID NO: 1347041 - protein, 9 aa, Homo Sapiens
EKICHKSLS

SEQ ID NO: 1347042 - protein, 9 aa, Homo Sapiens
TRCTKFTLL

SEQ ID NO: 1347043 - protein, 9 aa, Homo Sapiens
PRTLMAPQM

SEQ ID NO: 1347044 - protein, 9 aa, Homo Sapiens
VQGQPLKVI

SEQ ID NO: 1347045 - protein, 9 aa, Homo Sapiens
NEEEVDIIS

SEQ ID NO: 1347046 - protein, 9 aa, Homo Sapiens
IKKGKKIIE

SEQ ID NO: 1347047 - protein, 9 aa, Homo Sapiens
LISDINDNP

SEQ ID NO: 1347048 - protein, 9 aa, Homo Sapiens
LNSVPLGHT

SEQ ID NO: 1347049 - protein, 9 aa, Homo Sapiens
TLGSGEGIA

SEQ ID NO: 1347050 - protein, 9 aa, Homo Sapiens
LDPLKSLGG

SEQ ID NO: 1347051 - protein, 9 aa, Homo Sapiens
IIEYYLRHL

SEQ ID NO: 1347052 - protein, 9 aa, Homo Sapiens
WHSNVSANN

SEQ ID NO: 1347053 - protein, 9 aa, Homo Sapiens
KHITFTPES

SEQ ID NO: 1347054 - protein, 9 aa, Homo Sapiens
CTARGSPWP

SEQ ID NO: 1347055 - protein, 9 aa, Homo Sapiens
PGVHPATFT

SEQ ID NO: 1347056 - protein, 9 aa, Homo Sapiens
NMRHLWRPD

SEQ ID NO: 1347057 - protein, 9 aa, Homo Sapiens
CGKNEELID

SEQ ID NO: 1347058 - protein, 9 aa, Homo Sapiens
GVYVHVSRF

SEQ ID NO: 1347059 - protein, 9 aa, Homo Sapiens
RSPTMVLRH

SEQ ID NO: 1347060 - protein, 9 aa, Homo Sapiens
LESVNDLIR

SEQ ID NO: 1347061 - protein, 9 aa, Homo Sapiens
VADGALLRG

SEQ ID NO: 1347062 - protein, 9 aa, Homo Sapiens
GFLLSVMTY

SEQ ID NO: 1347063 - protein, 9 aa, Homo Sapiens
ILIGTVPSD

SEQ ID NO: 1347064 - protein, 9 aa, Homo Sapiens
RNDTNLCDA

SEQ ID NO: 1347065 - protein, 9 aa, Homo Sapiens
EDTSLKRHL

SEQ ID NO: 1347066 - protein, 9 aa, Homo Sapiens
QATKCATIL

SEQ ID NO: 1347067 - protein, 9 aa, Homo Sapiens
YYLRHLEGG

SEQ ID NO: 1347068 - protein, 9 aa, Homo Sapiens
CPASSRHRG

SEQ ID NO: 1347069 - protein, 9 aa, Homo Sapiens
RRLRYKGIH

SEQ ID NO: 1347070 - protein, 9 aa, Homo Sapiens
KEALMWYSE

SEQ ID NO: 1347071 - protein, 9 aa, Homo Sapiens
CPFVQENQS

SEQ ID NO: 1347072 - protein, 9 aa, Homo Sapiens
VEEPKITQL

SEQ ID NO: 1347073 - protein, 9 aa, Homo Sapiens
YECVLSRMQ

SEQ ID NO: 1347074 - protein, 9 aa, Homo Sapiens
ESGLEGRLP

SEQ ID NO: 1347075 - protein, 9 aa, Homo Sapiens
PVQPNGLGG

SEQ ID NO: 1347076 - protein, 9 aa, Homo Sapiens
VRSAVCVGI

SEQ ID NO: 1347077 - protein, 9 aa, Homo Sapiens
RQEDFPPHI

SEQ ID NO: 1347078 - protein, 9 aa, Homo Sapiens
TMPCTWVMT

SEQ ID NO: 1347079 - protein, 9 aa, Homo Sapiens
FCVKEFLSF

SEQ ID NO: 1347080 - protein, 9 aa, Homo Sapiens
LVAIHTDSN

SEQ ID NO: 1347081 - protein, 9 aa, Homo Sapiens
DCFSLRHCC

SEQ ID NO: 1347082 - protein, 9 aa, Homo Sapiens
MEWLSPDIT

SEQ ID NO: 1347083 - protein, 9 aa, Homo Sapiens
KMKDRFSLP

SEQ ID NO: 1347084 - protein, 9 aa, Homo Sapiens
LHNSKEERI

SEQ ID NO: 1347085 - protein, 9 aa, Homo Sapiens
LPVPSGTQQ

SEQ ID NO: 1347086 - protein, 9 aa, Homo Sapiens
DWYGHRLGG

SEQ ID NO: 1347087 - protein, 9 aa, Homo Sapiens
MALRGKDVA

SEQ ID NO: 1347088 - protein, 9 aa, Homo Sapiens
KFGCRPPQI

SEQ ID NO: 1347089 - protein, 9 aa, Homo Sapiens
IIQAKDEVI

SEQ ID NO: 1347090 - protein, 9 aa, Homo Sapiens
RKTVFNRHK

SEQ ID NO: 1347091 - protein, 9 aa, Homo Sapiens
RSVRAIWID

SEQ ID NO: 1347092 - protein, 9 aa, Homo Sapiens
ARTSLSTRG

SEQ ID NO: 1347093 - protein, 9 aa, Homo Sapiens
PHFTCTVDT

SEQ ID NO: 1347094 - protein, 9 aa, Homo Sapiens
TIILTLLAL

SEQ ID NO: 1347095 - protein, 9 aa, Homo Sapiens
DPYLPSYYP

SEQ ID NO: 1347096 - protein, 9 aa, Homo Sapiens
TYQMAVELL

SEQ ID NO: 1347097 - protein, 9 aa, Homo Sapiens
KVWMIAAEA

SEQ ID NO: 1347098 - protein, 9 aa, Homo Sapiens
IQSSTGEYV

SEQ ID NO: 1347099 - protein, 9 aa, Homo Sapiens
HHHATAYRV

SEQ ID NO: 1347100 - protein, 9 aa, Homo Sapiens
SANQRPGRA

SEQ ID NO: 1347101 - protein, 9 aa, Homo Sapiens
ANTKYPGSY

SEQ ID NO: 1347102 - protein, 9 aa, Homo Sapiens
CLASLLTWL

SEQ ID NO: 1347103 - protein, 9 aa, Homo Sapiens
LFPLGYLLV

SEQ ID NO: 1347104 - protein, 9 aa, Homo Sapiens
DVVLHLATL

SEQ ID NO: 1347105 - protein, 9 aa, Homo Sapiens
MQVPFSGCC

SEQ ID NO: 1347106 - protein, 9 aa, Homo Sapiens
LAYLNSVPL

SEQ ID NO: 1347107 - protein, 9 aa, Homo Sapiens
AQVLSQEGK

SEQ ID NO: 1347108 - protein, 9 aa, Homo Sapiens
QCCPTDGTA

SEQ ID NO: 1347109 - protein, 9 aa, Homo Sapiens
ESFHSSLAT

SEQ ID NO: 1347110 - protein, 9 aa, Homo Sapiens
KQQVSASTD

SEQ ID NO: 1347111 - protein, 9 aa, Homo Sapiens
SKDTLVQTK

SEQ ID NO: 1347112 - protein, 9 aa, Homo Sapiens
NSFQTHEMI

SEQ ID NO: 1347113 - protein, 9 aa, Homo Sapiens
EFVPQTCPR

SEQ ID NO: 1347114 - protein, 9 aa, Homo Sapiens
WRPGASRRW

SEQ ID NO: 1347115 - protein, 9 aa, Homo Sapiens
TYHCRCHTG

SEQ ID NO: 1347116 - protein, 9 aa, Homo Sapiens
DRPFDDTCH

SEQ ID NO: 1347117 - protein, 9 aa, Homo Sapiens
QDVLNSIEN

SEQ ID NO: 1347118 - protein, 9 aa, Homo Sapiens
ATATMSPGK

SEQ ID NO: 1347119 - protein, 9 aa, Homo Sapiens
WQLIVKEYQ

SEQ ID NO: 1347120 - protein, 9 aa, Homo Sapiens
KDTNQYVVG

SEQ ID NO: 1347121 - protein, 9 aa, Homo Sapiens
HTASGHRTF

SEQ ID NO: 1347122 - protein, 9 aa, Homo Sapiens
NSTGNKREQ

SEQ ID NO: 1347123 - protein, 9 aa, Homo Sapiens
TMAASSAHA

SEQ ID NO: 1347124 - protein, 9 aa, Homo Sapiens
LQPYTECVE

SEQ ID NO: 1347125 - protein, 9 aa, Homo Sapiens
MWYSEAMKL

SEQ ID NO: 1347126 - protein, 9 aa, Homo Sapiens
DKRTKVCGE

SEQ ID NO: 1347127 - protein, 9 aa, Homo Sapiens
QQLQINKII

SEQ ID NO: 1347128 - protein, 9 aa, Homo Sapiens
MRRRVIAQP

SEQ ID NO: 1347129 - protein, 9 aa, Homo Sapiens
QLLKAGLPH

SEQ ID NO: 1347130 - protein, 9 aa, Homo Sapiens
LVPKRPDTC

SEQ ID NO: 1347131 - protein, 9 aa, Homo Sapiens
PPSKLAFSS

SEQ ID NO: 1347132 - protein, 9 aa, Homo Sapiens
VGPVMMVLQ

SEQ ID NO: 1347133 - protein, 9 aa, Homo Sapiens
HGESQYVPA

SEQ ID NO: 1347134 - protein, 9 aa, Homo Sapiens
GWRWGWGQL

SEQ ID NO: 1347135 - protein, 9 aa, Homo Sapiens
ASSSVQAVT

SEQ ID NO: 1347136 - protein, 9 aa, Homo Sapiens
CFLLLIREI

SEQ ID NO: 1347137 - protein, 9 aa, Homo Sapiens
PKEDIPEHY

SEQ ID NO: 1347138 - protein, 9 aa, Homo Sapiens
PQLILPDSL

SEQ ID NO: 1347139 - protein, 9 aa, Homo Sapiens
MQKSSSLLH

SEQ ID NO: 1347140 - protein, 9 aa, Homo Sapiens
LRAFEARDH

SEQ ID NO: 1347141 - protein, 9 aa, Homo Sapiens
SPQGLILNV

SEQ ID NO: 1347142 - protein, 9 aa, Homo Sapiens
RRRVIAQPV

SEQ ID NO: 1347143 - protein, 9 aa, Homo Sapiens
FKVKADQID

SEQ ID NO: 1347144 - protein, 9 aa, Homo Sapiens
AWLCISASP

SEQ ID NO: 1347145 - protein, 9 aa, Homo Sapiens
GASPTSQSY

SEQ ID NO: 1347146 - protein, 9 aa, Homo Sapiens
VSSPLKLNE

SEQ ID NO: 1347147 - protein, 9 aa, Homo Sapiens
NQNTSENIE

SEQ ID NO: 1347148 - protein, 9 aa, Homo Sapiens
STLHDGHTD

SEQ ID NO: 1347149 - protein, 9 aa, Homo Sapiens
VVVILEKMR

SEQ ID NO: 1347150 - protein, 9 aa, Homo Sapiens
LLYQEGTKM

SEQ ID NO: 1347151 - protein, 9 aa, Homo Sapiens
LGKGTEVPW

SEQ ID NO: 1347152 - protein, 9 aa, Homo Sapiens
SNDYGFYLR

SEQ ID NO: 1347153 - protein, 9 aa, Homo Sapiens
TQITEEVWD

SEQ ID NO: 1347154 - protein, 9 aa, Homo Sapiens
TCDDPHFQD

SEQ ID NO: 1347155 - protein, 9 aa, Homo Sapiens
DTYSSLAVC

SEQ ID NO: 1347156 - protein, 9 aa, Homo Sapiens
QKKIFFKAT

SEQ ID NO: 1347157 - protein, 9 aa, Homo Sapiens
SQERVEYIK

SEQ ID NO: 1347158 - protein, 9 aa, Homo Sapiens
CRLQELCSK

SEQ ID NO: 1347159 - protein, 9 aa, Homo Sapiens
IFVKKELQL

SEQ ID NO: 1347160 - protein, 9 aa, Homo Sapiens
QTSESYPLR

SEQ ID NO: 1347161 - protein, 9 aa, Homo Sapiens
NLLCKHQVV

SEQ ID NO: 1347162 - protein, 9 aa, Homo Sapiens
HISQHAPSI

SEQ ID NO: 1347163 - protein, 9 aa, Homo Sapiens
KGGMCPFHH

SEQ ID NO: 1347164 - protein, 9 aa, Homo Sapiens
FSRSAISEQ

SEQ ID NO: 1347165 - protein, 9 aa, Homo Sapiens
DCNVVKSKH

SEQ ID NO: 1347166 - protein, 9 aa, Homo Sapiens
HADYSGSSE

SEQ ID NO: 1347167 - protein, 9 aa, Homo Sapiens
HSLYVKRHR

SEQ ID NO: 1347168 - protein, 9 aa, Homo Sapiens
DHVISVIPA

SEQ ID NO: 1347169 - protein, 9 aa, Homo Sapiens
SGCPPWLHH

SEQ ID NO: 1347170 - protein, 9 aa, Homo Sapiens
MRKFSLLKR

SEQ ID NO: 1347171 - protein, 9 aa, Homo Sapiens
VPPTATSLI

SEQ ID NO: 1347172 - protein, 9 aa, Homo Sapiens
YGGLDDQLC

SEQ ID NO: 1347173 - protein, 9 aa, Homo Sapiens
FTDPDDLPG

SEQ ID NO: 1347174 - protein, 9 aa, Homo Sapiens
LDLIFGLNV

SEQ ID NO: 1347175 - protein, 9 aa, Homo Sapiens
MGPWDVILK

SEQ ID NO: 1347176 - protein, 9 aa, Homo Sapiens
DLKLWDTKI

SEQ ID NO: 1347177 - protein, 9 aa, Homo Sapiens
RMTVLQALR

SEQ ID NO: 1347178 - protein, 9 aa, Homo Sapiens
TKTKKRPQC

SEQ ID NO: 1347179 - protein, 9 aa, Homo Sapiens
MHFLPDGRS

SEQ ID NO: 1347180 - protein, 9 aa, Homo Sapiens
QKPLAVSKN

SEQ ID NO: 1347181 - protein, 9 aa, Homo Sapiens
LPEKDTMDI

SEQ ID NO: 1347182 - protein, 9 aa, Homo Sapiens
DHTSTLVAQ

SEQ ID NO: 1347183 - protein, 9 aa, Homo Sapiens
IFEFCGYEA

SEQ ID NO: 1347184 - protein, 9 aa, Homo Sapiens
NVCNWVVNT

SEQ ID NO: 1347185 - protein, 9 aa, Homo Sapiens
PNTFSTFTF

SEQ ID NO: 1347186 - protein, 9 aa, Homo Sapiens
IKEERTLVN

SEQ ID NO: 1347187 - protein, 9 aa, Homo Sapiens
MPVYAFSIK

SEQ ID NO: 1347188 - protein, 9 aa, Homo Sapiens
RREQQSAHT

SEQ ID NO: 1347189 - protein, 9 aa, Homo Sapiens
NPQPMMPPW

SEQ ID NO: 1347190 - protein, 9 aa, Homo Sapiens
PLVSIVATA

SEQ ID NO: 1347191 - protein, 9 aa, Homo Sapiens
ERQAEDSDL

SEQ ID NO: 1347192 - protein, 9 aa, Homo Sapiens
GKAFNQFLI

SEQ ID NO: 1347193 - protein, 9 aa, Homo Sapiens
YYILWPEVM

SEQ ID NO: 1347194 - protein, 9 aa, Homo Sapiens
VDQLHLERL

SEQ ID NO: 1347195 - protein, 9 aa, Homo Sapiens
GMIQMTVKD

SEQ ID NO: 1347196 - protein, 9 aa, Homo Sapiens
LIQVTTDMY

SEQ ID NO: 1347197 - protein, 9 aa, Homo Sapiens
SFSADNLAV

SEQ ID NO: 1347198 - protein, 9 aa, Homo Sapiens
TPCRKLCHT

SEQ ID NO: 1347199 - protein, 9 aa, Homo Sapiens
LPVRLTNIL

SEQ ID NO: 1347200 - protein, 9 aa, Homo Sapiens
ESLNIENTL

SEQ ID NO: 1347201 - protein, 9 aa, Homo Sapiens
AEKQYPPHC

SEQ ID NO: 1347202 - protein, 9 aa, Homo Sapiens
QHWIWFNLE

SEQ ID NO: 1347203 - protein, 9 aa, Homo Sapiens
VSPPVEQQL

SEQ ID NO: 1347204 - protein, 9 aa, Homo Sapiens
PMTKIKKID

SEQ ID NO: 1347205 - protein, 9 aa, Homo Sapiens
KPVAYKKEK

SEQ ID NO: 1347206 - protein, 9 aa, Homo Sapiens
PHLCRELHP

SEQ ID NO: 1347207 - protein, 9 aa, Homo Sapiens
SSKGSMVLA

SEQ ID NO: 1347208 - protein, 9 aa, Homo Sapiens
INHPENKPM

SEQ ID NO: 1347209 - protein, 9 aa, Homo Sapiens
LSHLLSVLG

SEQ ID NO: 1347210 - protein, 9 aa, Homo Sapiens
YGHRLGGGE

SEQ ID NO: 1347211 - protein, 9 aa, Homo Sapiens
KYLPTIVNN

SEQ ID NO: 1347212 - protein, 9 aa, Homo Sapiens
VNQIQEIIS

SEQ ID NO: 1347213 - protein, 9 aa, Homo Sapiens
SQDDTMVDY

SEQ ID NO: 1347214 - protein, 9 aa, Homo Sapiens
VKDEKNRFS

SEQ ID NO: 1347215 - protein, 9 aa, Homo Sapiens
YAVTKLAGL

SEQ ID NO: 1347216 - protein, 9 aa, Homo Sapiens
PRLPEPTMC

SEQ ID NO: 1347217 - protein, 9 aa, Homo Sapiens
RGEGGQFFS

SEQ ID NO: 1347218 - protein, 9 aa, Homo Sapiens
CVSFSYAGL

SEQ ID NO: 1347219 - protein, 9 aa, Homo Sapiens
TSPLNVIDL

SEQ ID NO: 1347220 - protein, 9 aa, Homo Sapiens
DTHACPLKF

SEQ ID NO: 1347221 - protein, 9 aa, Homo Sapiens
HHYLNFIYY

SEQ ID NO: 1347222 - protein, 9 aa, Homo Sapiens
LWKEDLAVF

SEQ ID NO: 1347223 - protein, 9 aa, Homo Sapiens
LTIKDDIIY

SEQ ID NO: 1347224 - protein, 9 aa, Homo Sapiens
QNLQGKKKA

SEQ ID NO: 1347225 - protein, 9 aa, Homo Sapiens
AAVLMAWLG

SEQ ID NO: 1347226 - protein, 9 aa, Homo Sapiens
KKFVYALKA

SEQ ID NO: 1347227 - protein, 9 aa, Homo Sapiens
KTRFLIFGE

SEQ ID NO: 1347228 - protein, 9 aa, Homo Sapiens
ARCQCCPTD

SEQ ID NO: 1347229 - protein, 9 aa, Homo Sapiens
EEALANRHI

SEQ ID NO: 1347230 - protein, 9 aa, Homo Sapiens
VLFARLVAL

SEQ ID NO: 1347231 - protein, 9 aa, Homo Sapiens
SPEPPVQPN

SEQ ID NO: 1347232 - protein, 9 aa, Homo Sapiens
VQRPGDLMW

SEQ ID NO: 1347233 - protein, 9 aa, Homo Sapiens
FPTCFSSFR

SEQ ID NO: 1347234 - protein, 9 aa, Homo Sapiens
TIRWKSELA

SEQ ID NO: 1347235 - protein, 9 aa, Homo Sapiens
ARDHNLQEG

SEQ ID NO: 1347236 - protein, 9 aa, Homo Sapiens
PGDPMWGGP

SEQ ID NO: 1347237 - protein, 9 aa, Homo Sapiens
RENHYDCVV

SEQ ID NO: 1347238 - protein, 9 aa, Homo Sapiens
PKCSLFFNR

SEQ ID NO: 1347239 - protein, 9 aa, Homo Sapiens
QIKYKERFD

SEQ ID NO: 1347240 - protein, 9 aa, Homo Sapiens
VPLVLKPNV

SEQ ID NO: 1347241 - protein, 9 aa, Homo Sapiens
SPTPPYNKV

SEQ ID NO: 1347242 - protein, 9 aa, Homo Sapiens
QQVVNLNSK

SEQ ID NO: 1347243 - protein, 9 aa, Homo Sapiens
LLHLWQPQG

SEQ ID NO: 1347244 - protein, 9 aa, Homo Sapiens
VLLKVIESE

SEQ ID NO: 1347245 - protein, 9 aa, Homo Sapiens
TTTPHPTTL

SEQ ID NO: 1347246 - protein, 9 aa, Homo Sapiens
LRVAKKGIR

SEQ ID NO: 1347247 - protein, 9 aa, Homo Sapiens
RVQYLHQIH

SEQ ID NO: 1347248 - protein, 9 aa, Homo Sapiens
VTEVSHLRT

SEQ ID NO: 1347249 - protein, 9 aa, Homo Sapiens
LKASQVRDL

SEQ ID NO: 1347250 - protein, 9 aa, Homo Sapiens
LLMEAQMQA

SEQ ID NO: 1347251 - protein, 9 aa, Homo Sapiens
RPTGDAFTL

SEQ ID NO: 1347252 - protein, 9 aa, Homo Sapiens
GVLEHLNTI

SEQ ID NO: 1347253 - protein, 9 aa, Homo Sapiens
PEPDLGDAV

SEQ ID NO: 1347254 - protein, 9 aa, Homo Sapiens
NIHSMSCNK

SEQ ID NO: 1347255 - protein, 9 aa, Homo Sapiens
TIHNRGKEG

SEQ ID NO: 1347256 - protein, 9 aa, Homo Sapiens
EESRRRHKM

SEQ ID NO: 1347257 - protein, 9 aa, Homo Sapiens
TQTGFYGEN

SEQ ID NO: 1347258 - protein, 9 aa, Homo Sapiens
VFSSFVTLD

SEQ ID NO: 1347259 - protein, 9 aa, Homo Sapiens
TVLFARLVA

SEQ ID NO: 1347260 - protein, 9 aa, Homo Sapiens
QSKHPMTNI

SEQ ID NO: 1347261 - protein, 9 aa, Homo Sapiens
QAGLNTGTT

SEQ ID NO: 1347262 - protein, 9 aa, Homo Sapiens
SYNLTQQWV

SEQ ID NO: 1347263 - protein, 9 aa, Homo Sapiens
DDPIGPDTV

SEQ ID NO: 1347264 - protein, 9 aa, Homo Sapiens
AHSILSGAS

SEQ ID NO: 1347265 - protein, 9 aa, Homo Sapiens
VGVRKWSVT

SEQ ID NO: 1347266 - protein, 9 aa, Homo Sapiens
GNSVSKTRL

SEQ ID NO: 1347267 - protein, 9 aa, Homo Sapiens
KQSLNQFMT

SEQ ID NO: 1347268 - protein, 9 aa, Homo Sapiens
NLLFLFPSS

SEQ ID NO: 1347269 - protein, 9 aa, Homo Sapiens
LKELNTRPM

SEQ ID NO: 1347270 - protein, 9 aa, Homo Sapiens
RHSQNSSIS

SEQ ID NO: 1347271 - protein, 9 aa, Homo Sapiens
EHRKDLEIM

SEQ ID NO: 1347272 - protein, 9 aa, Homo Sapiens
RHMEDEGGF

SEQ ID NO: 1347273 - protein, 9 aa, Homo Sapiens
SGYTIYNTS

SEQ ID NO: 1347274 - protein, 9 aa, Homo Sapiens
IIRHEQLTR

SEQ ID NO: 1347275 - protein, 9 aa, Homo Sapiens
FLSLACTRG

SEQ ID NO: 1347276 - protein, 9 aa, Homo Sapiens
VTAERCVSL

SEQ ID NO: 1347277 - protein, 9 aa, Homo Sapiens
QDWRSGKAE

SEQ ID NO: 1347278 - protein, 9 aa, Homo Sapiens
EPLQRPGML

SEQ ID NO: 1347279 - protein, 9 aa, Homo Sapiens
LPCHPFDTV

SEQ ID NO: 1347280 - protein, 9 aa, Homo Sapiens
SVPSLHVPH

SEQ ID NO: 1347281 - protein, 9 aa, Homo Sapiens
IILNSLLLF

SEQ ID NO: 1347282 - protein, 9 aa, Homo Sapiens
RSLRLPPTP

SEQ ID NO: 1347283 - protein, 9 aa, Homo Sapiens
HNFHHFLKL

SEQ ID NO: 1347284 - protein, 9 aa, Homo Sapiens
QQLVTENPE

SEQ ID NO: 1347285 - protein, 9 aa, Homo Sapiens
IKRMLAYSG

SEQ ID NO: 1347286 - protein, 9 aa, Homo Sapiens
GWKNSIRHS

SEQ ID NO: 1347287 - protein, 9 aa, Homo Sapiens
VWPGHQEVS

SEQ ID NO: 1347288 - protein, 9 aa, Homo Sapiens
CRKDYLQPW

SEQ ID NO: 1347289 - protein, 9 aa, Homo Sapiens
IFRKVAAGE

SEQ ID NO: 1347290 - protein, 9 aa, Homo Sapiens
LGGFHKPNN

SEQ ID NO: 1347291 - protein, 9 aa, Homo Sapiens
PGPTLGTMP

SEQ ID NO: 1347292 - protein, 9 aa, Homo Sapiens
MKRVLDAEP

SEQ ID NO: 1347293 - protein, 9 aa, Homo Sapiens
FLICEDGNH

SEQ ID NO: 1347294 - protein, 9 aa, Homo Sapiens
AGRVAFKLH

SEQ ID NO: 1347295 - protein, 9 aa, Homo Sapiens
EKANRLQRC

SEQ ID NO: 1347296 - protein, 9 aa, Homo Sapiens
DPITDKPYV

SEQ ID NO: 1347297 - protein, 9 aa, Homo Sapiens
APKVLDGTH

SEQ ID NO: 1347298 - protein, 9 aa, Homo Sapiens
ENWEVDVTF

SEQ ID NO: 1347299 - protein, 9 aa, Homo Sapiens
GNLQLSHQP

SEQ ID NO: 1347300 - protein, 9 aa, Homo Sapiens
KIVVHSKQN

SEQ ID NO: 1347301 - protein, 9 aa, Homo Sapiens
EEWLSEGFT

SEQ ID NO: 1347302 - protein, 9 aa, Homo Sapiens
KLWQSPASR

SEQ ID NO: 1347303 - protein, 9 aa, Homo Sapiens
HSEPLVSFS

SEQ ID NO: 1347304 - protein, 9 aa, Homo Sapiens
HGSDEHGCL

SEQ ID NO: 1347305 - protein, 9 aa, Homo Sapiens
IADLLLPGS

SEQ ID NO: 1347306 - protein, 9 aa, Homo Sapiens
MAFTLDGHF

SEQ ID NO: 1347307 - protein, 9 aa, Homo Sapiens
FAVSAVVHK

SEQ ID NO: 1347308 - protein, 9 aa, Homo Sapiens
FISIDHYYA

SEQ ID NO: 1347309 - protein, 9 aa, Homo Sapiens
QETITEFLY

SEQ ID NO: 1347310 - protein, 9 aa, Homo Sapiens
LVGLDIWNS

SEQ ID NO: 1347311 - protein, 9 aa, Homo Sapiens
REIICQSLA

SEQ ID NO: 1347312 - protein, 9 aa, Homo Sapiens
NIQLFLTLA

SEQ ID NO: 1347313 - protein, 9 aa, Homo Sapiens
HTPLAEHCF

SEQ ID NO: 1347314 - protein, 9 aa, Homo Sapiens
WRADDISRH

SEQ ID NO: 1347315 - protein, 9 aa, Homo Sapiens
FAQNPPIFP

SEQ ID NO: 1347316 - protein, 9 aa, Homo Sapiens
AVTVTVMGA

SEQ ID NO: 1347317 - protein, 9 aa, Homo Sapiens
PFGFEGNNC

SEQ ID NO: 1347318 - protein, 9 aa, Homo Sapiens
RRPSQNVIS

SEQ ID NO: 1347319 - protein, 9 aa, Homo Sapiens
PASGSTSRR

SEQ ID NO: 1347320 - protein, 9 aa, Homo Sapiens
ISVKTCSER

SEQ ID NO: 1347321 - protein, 9 aa, Homo Sapiens
TVTMTRATN

SEQ ID NO: 1347322 - protein, 9 aa, Homo Sapiens
HYPALDDHL

SEQ ID NO: 1347323 - protein, 9 aa, Homo Sapiens
DTHKDHALK

SEQ ID NO: 1347324 - protein, 9 aa, Homo Sapiens
LVPRLVQFE

SEQ ID NO: 1347325 - protein, 9 aa, Homo Sapiens
IPKTQVSSN

SEQ ID NO: 1347326 - protein, 9 aa, Homo Sapiens
TDGEMSVQE

SEQ ID NO: 1347327 - protein, 9 aa, Homo Sapiens
LHLLEKLGD

SEQ ID NO: 1347328 - protein, 9 aa, Homo Sapiens
RLSFNRPFQ

SEQ ID NO: 1347329 - protein, 9 aa, Homo Sapiens
DLDRIFRWL

SEQ ID NO: 1347330 - protein, 9 aa, Homo Sapiens
VVMNKKKCQ

SEQ ID NO: 1347331 - protein, 9 aa, Homo Sapiens
SPEAMRPSG

SEQ ID NO: 1347332 - protein, 9 aa, Homo Sapiens
PDEQVRQFL

SEQ ID NO: 1347333 - protein, 9 aa, Homo Sapiens
LSRDPPASH

SEQ ID NO: 1347334 - protein, 9 aa, Homo Sapiens
ITAYNRHTF

SEQ ID NO: 1347335 - protein, 9 aa, Homo Sapiens
AKHLCLSLN

SEQ ID NO: 1347336 - protein, 9 aa, Homo Sapiens
LSDIAPNDI

SEQ ID NO: 1347337 - protein, 9 aa, Homo Sapiens
KRRFECDCK

SEQ ID NO: 1347338 - protein, 9 aa, Homo Sapiens
TCSVCTKAP

SEQ ID NO: 1347339 - protein, 9 aa, Homo Sapiens
LFSSLSSVM

SEQ ID NO: 1347340 - protein, 9 aa, Homo Sapiens
VRKHLGTGL

SEQ ID NO: 1347341 - protein, 9 aa, Homo Sapiens
DSLYSGQNS

SEQ ID NO: 1347342 - protein, 9 aa, Homo Sapiens
ITHVPENPI

SEQ ID NO: 1347343 - protein, 9 aa, Homo Sapiens
CMQNTKTCT

SEQ ID NO: 1347344 - protein, 9 aa, Homo Sapiens
NLVVSVDDS

SEQ ID NO: 1347345 - protein, 9 aa, Homo Sapiens
LQIGDRVMT

SEQ ID NO: 1347346 - protein, 9 aa, Homo Sapiens
PQELCMPQS

SEQ ID NO: 1347347 - protein, 9 aa, Homo Sapiens
KKMARETEF

SEQ ID NO: 1347348 - protein, 9 aa, Homo Sapiens
CYDFFLLVS

SEQ ID NO: 1347349 - protein, 9 aa, Homo Sapiens
GPTAGAARA

SEQ ID NO: 1347350 - protein, 9 aa, Homo Sapiens
VQSYAAGFI

SEQ ID NO: 1347351 - protein, 9 aa, Homo Sapiens
ADAFITFAN

SEQ ID NO: 1347352 - protein, 9 aa, Homo Sapiens
EAPKMSNAN

SEQ ID NO: 1347353 - protein, 9 aa, Homo Sapiens
SDTSLWTPP

SEQ ID NO: 1347354 - protein, 9 aa, Homo Sapiens
GIHPAPGYP

SEQ ID NO: 1347355 - protein, 9 aa, Homo Sapiens
WIDREKLCN

SEQ ID NO: 1347356 - protein, 9 aa, Homo Sapiens
SFMKGKMMF

SEQ ID NO: 1347357 - protein, 9 aa, Homo Sapiens
DIYMMDIFS

SEQ ID NO: 1347358 - protein, 9 aa, Homo Sapiens
KRGRSKSKE

SEQ ID NO: 1347359 - protein, 9 aa, Homo Sapiens
HLTEELNKE

SEQ ID NO: 1347360 - protein, 9 aa, Homo Sapiens
TYYCEGECA

SEQ ID NO: 1347361 - protein, 9 aa, Homo Sapiens
SPLIYSLRN

SEQ ID NO: 1347362 - protein, 9 aa, Homo Sapiens
CWVESRGPD

SEQ ID NO: 1347363 - protein, 9 aa, Homo Sapiens
NERQQAEHC

SEQ ID NO: 1347364 - protein, 9 aa, Homo Sapiens
SDTMVEPYN

SEQ ID NO: 1347365 - protein, 9 aa, Homo Sapiens
PFKIPKTQV

SEQ ID NO: 1347366 - protein, 9 aa, Homo Sapiens
NASSKTFIA

SEQ ID NO: 1347367 - protein, 9 aa, Homo Sapiens
WDGGKVAQL

SEQ ID NO: 1347368 - protein, 9 aa, Homo Sapiens
KEVSLIFTQ

SEQ ID NO: 1347369 - protein, 9 aa, Homo Sapiens
PGIKGKAGP

SEQ ID NO: 1347370 - protein, 9 aa, Homo Sapiens
GCFLLLIRE

SEQ ID NO: 1347371 - protein, 9 aa, Homo Sapiens
YHTTRERVL

SEQ ID NO: 1347372 - protein, 9 aa, Homo Sapiens
TNGGGWTVF

SEQ ID NO: 1347373 - protein, 9 aa, Homo Sapiens
DKAFRVHVH

SEQ ID NO: 1347374 - protein, 9 aa, Homo Sapiens
NALPSAIQA

SEQ ID NO: 1347375 - protein, 9 aa, Homo Sapiens
IASEVKVLN

SEQ ID NO: 1347376 - protein, 9 aa, Homo Sapiens
DECHLLRLG

SEQ ID NO: 1347377 - protein, 9 aa, Homo Sapiens
GSVPIFDEI

SEQ ID NO: 1347378 - protein, 9 aa, Homo Sapiens
PLVTSYLCS

SEQ ID NO: 1347379 - protein, 9 aa, Homo Sapiens
EEAYIIYDE

SEQ ID NO: 1347380 - protein, 9 aa, Homo Sapiens
AVRDIDAFL

SEQ ID NO: 1347381 - protein, 9 aa, Homo Sapiens
NTKPQVKPG

SEQ ID NO: 1347382 - protein, 9 aa, Homo Sapiens
IEYVIRGEF

SEQ ID NO: 1347383 - protein, 9 aa, Homo Sapiens
FGGCSYMPS

SEQ ID NO: 1347384 - protein, 9 aa, Homo Sapiens
VQQPGHILL

SEQ ID NO: 1347385 - protein, 9 aa, Homo Sapiens
GVHKNKTIT

SEQ ID NO: 1347386 - protein, 9 aa, Homo Sapiens
AGTEDKRSQ

SEQ ID NO: 1347387 - protein, 9 aa, Homo Sapiens
KRSQDVLHH

SEQ ID NO: 1347388 - protein, 9 aa, Homo Sapiens
LVRETSHIT

SEQ ID NO: 1347389 - protein, 9 aa, Homo Sapiens
VHILPPSQL

SEQ ID NO: 1347390 - protein, 9 aa, Homo Sapiens
LRLGVEYTV

SEQ ID NO: 1347391 - protein, 9 aa, Homo Sapiens
SVKLALVIE

SEQ ID NO: 1347392 - protein, 9 aa, Homo Sapiens
YKVKLVEKW

SEQ ID NO: 1347393 - protein, 9 aa, Homo Sapiens
ANPGICDKQ

SEQ ID NO: 1347394 - protein, 9 aa, Homo Sapiens
LCISASPGG

SEQ ID NO: 1347395 - protein, 9 aa, Homo Sapiens
SKQSLNDSY

SEQ ID NO: 1347396 - protein, 9 aa, Homo Sapiens
IAWRYQLLL

SEQ ID NO: 1347397 - protein, 9 aa, Homo Sapiens
DTSMRGGHL

SEQ ID NO: 1347398 - protein, 9 aa, Homo Sapiens
PNLNANQNL

SEQ ID NO: 1347399 - protein, 9 aa, Homo Sapiens
MRREGIHYA

SEQ ID NO: 1347400 - protein, 9 aa, Homo Sapiens
TLWETIKFM

SEQ ID NO: 1347401 - protein, 9 aa, Homo Sapiens
RAREALVAE

SEQ ID NO: 1347402 - protein, 9 aa, Homo Sapiens
TPPGMPSSA

SEQ ID NO: 1347403 - protein, 9 aa, Homo Sapiens
LWARHMGKC

SEQ ID NO: 1347404 - protein, 9 aa, Homo Sapiens
NMCHIQRAD

SEQ ID NO: 1347405 - protein, 9 aa, Homo Sapiens
CAPTPQMLR

SEQ ID NO: 1347406 - protein, 9 aa, Homo Sapiens
EISLYDTVA

SEQ ID NO: 1347407 - protein, 9 aa, Homo Sapiens
ADGEQWPYR

SEQ ID NO: 1347408 - protein, 9 aa, Homo Sapiens
RTHEFEDRD

SEQ ID NO: 1347409 - protein, 9 aa, Homo Sapiens
VQAPVAAVL

SEQ ID NO: 1347410 - protein, 9 aa, Homo Sapiens
QKKLYCLDN

SEQ ID NO: 1347411 - protein, 9 aa, Homo Sapiens
GVFATGRFA

SEQ ID NO: 1347412 - protein, 9 aa, Homo Sapiens
RKHIVLEKL

SEQ ID NO: 1347413 - protein, 9 aa, Homo Sapiens
MTHQEYVYP

SEQ ID NO: 1347414 - protein, 9 aa, Homo Sapiens
PTLLMIWFY

SEQ ID NO: 1347415 - protein, 9 aa, Homo Sapiens
DIEYIQSHY

SEQ ID NO: 1347416 - protein, 9 aa, Homo Sapiens
VVARYEETM

SEQ ID NO: 1347417 - protein, 9 aa, Homo Sapiens
MDYIQIDAT

SEQ ID NO: 1347418 - protein, 9 aa, Homo Sapiens
QDDDMPADE

SEQ ID NO: 1347419 - protein, 9 aa, Homo Sapiens
APAEPLGQV

SEQ ID NO: 1347420 - protein, 9 aa, Homo Sapiens
LTILMVVME

SEQ ID NO: 1347421 - protein, 9 aa, Homo Sapiens
MCRAAAGGL

SEQ ID NO: 1347422 - protein, 9 aa, Homo Sapiens
GYSMHMVGK

SEQ ID NO: 1347423 - protein, 9 aa, Homo Sapiens
VVNTCLHKG

SEQ ID NO: 1347424 - protein, 9 aa, Homo Sapiens
LSKPYDAAK

SEQ ID NO: 1347425 - protein, 9 aa, Homo Sapiens
DKKDHDASP

SEQ ID NO: 1347426 - protein, 9 aa, Homo Sapiens
RTGHHIVAP

SEQ ID NO: 1347427 - protein, 9 aa, Homo Sapiens
IKGVFYRRA

SEQ ID NO: 1347428 - protein, 9 aa, Homo Sapiens
NPPKAKATM

SEQ ID NO: 1347429 - protein, 9 aa, Homo Sapiens
VGQRIRDVK

SEQ ID NO: 1347430 - protein, 9 aa, Homo Sapiens
EELNALREE

SEQ ID NO: 1347431 - protein, 9 aa, Homo Sapiens
DGKDKSSVN

SEQ ID NO: 1347432 - protein, 9 aa, Homo Sapiens
NNCSALSAA

SEQ ID NO: 1347433 - protein, 9 aa, Homo Sapiens
VNNVKLVFD

SEQ ID NO: 1347434 - protein, 9 aa, Homo Sapiens
PPDSKLDQD

SEQ ID NO: 1347435 - protein, 9 aa, Homo Sapiens
LLMEGFLAF

SEQ ID NO: 1347436 - protein, 9 aa, Homo Sapiens
IRYAVMQIS

SEQ ID NO: 1347437 - protein, 9 aa, Homo Sapiens
EVSAAESAG

SEQ ID NO: 1347438 - protein, 9 aa, Homo Sapiens
KQLTTAEKS

SEQ ID NO: 1347439 - protein, 9 aa, Homo Sapiens
STSIPLSSP

SEQ ID NO: 1347440 - protein, 9 aa, Homo Sapiens
ILICIMKNQ

SEQ ID NO: 1347441 - protein, 9 aa, Homo Sapiens
TACMTTLVM

SEQ ID NO: 1347442 - protein, 9 aa, Homo Sapiens
GSSATTAAC

SEQ ID NO: 1347443 - protein, 9 aa, Homo Sapiens
RDASIIKGD

SEQ ID NO: 1347444 - protein, 9 aa, Homo Sapiens
TVTVGAVTA

SEQ ID NO: 1347445 - protein, 9 aa, Homo Sapiens
AICKGPMTK

SEQ ID NO: 1347446 - protein, 9 aa, Homo Sapiens
ARKNDMIGL

SEQ ID NO: 1347447 - protein, 9 aa, Homo Sapiens
GIIAWPFIT

SEQ ID NO: 1347448 - protein, 9 aa, Homo Sapiens
PDMAFEVIV

SEQ ID NO: 1347449 - protein, 9 aa, Homo Sapiens
FKTIAEVRS

SEQ ID NO: 1347450 - protein, 9 aa, Homo Sapiens
DLCQKSLKC

SEQ ID NO: 1347451 - protein, 9 aa, Homo Sapiens
YYCMCCGDL

SEQ ID NO: 1347452 - protein, 9 aa, Homo Sapiens
LPARDKRTL

SEQ ID NO: 1347453 - protein, 9 aa, Homo Sapiens
HRDVLLGEC

SEQ ID NO: 1347454 - protein, 9 aa, Homo Sapiens
WERLDQTMD

SEQ ID NO: 1347455 - protein, 9 aa, Homo Sapiens
HHDKDGWPL

SEQ ID NO: 1347456 - protein, 9 aa, Homo Sapiens
HAFIITLNS

SEQ ID NO: 1347457 - protein, 9 aa, Homo Sapiens
FLRSGLKQC

SEQ ID NO: 1347458 - protein, 9 aa, Homo Sapiens
PKLALKNNP

SEQ ID NO: 1347459 - protein, 9 aa, Homo Sapiens
SSSTMTPYG

SEQ ID NO: 1347460 - protein, 9 aa, Homo Sapiens
YLHWQVVDT

SEQ ID NO: 1347461 - protein, 9 aa, Homo Sapiens
VNTQLLPFE

SEQ ID NO: 1347462 - protein, 9 aa, Homo Sapiens
QHRSRTTFT

SEQ ID NO: 1347463 - protein, 9 aa, Homo Sapiens
LAHVLVKRK

SEQ ID NO: 1347464 - protein, 9 aa, Homo Sapiens
CCMMAQYNR

SEQ ID NO: 1347465 - protein, 9 aa, Homo Sapiens
SAATARRPS

SEQ ID NO: 1347466 - protein, 9 aa, Homo Sapiens
LPLGGFQIH

SEQ ID NO: 1347467 - protein, 9 aa, Homo Sapiens
HHDVVSKAN

SEQ ID NO: 1347468 - protein, 9 aa, Homo Sapiens
LDRNNVDLW

SEQ ID NO: 1347469 - protein, 9 aa, Homo Sapiens
KDKKFLEKE

SEQ ID NO: 1347470 - protein, 9 aa, Homo Sapiens
PLLRKCWFQ

SEQ ID NO: 1347471 - protein, 9 aa, Homo Sapiens
NCLPLHFWV

SEQ ID NO: 1347472 - protein, 9 aa, Homo Sapiens
RPPPGSQSS

SEQ ID NO: 1347473 - protein, 9 aa, Homo Sapiens
ASLHLVFQM

SEQ ID NO: 1347474 - protein, 9 aa, Homo Sapiens
YLTPMLGLD

SEQ ID NO: 1347475 - protein, 9 aa, Homo Sapiens
GVIIIILMY

SEQ ID NO: 1347476 - protein, 9 aa, Homo Sapiens
RPKTIKQCH

SEQ ID NO: 1347477 - protein, 9 aa, Homo Sapiens
IDPIRQEDV

SEQ ID NO: 1347478 - protein, 9 aa, Homo Sapiens
FVPLDTPHQ

SEQ ID NO: 1347479 - protein, 9 aa, Homo Sapiens
ALVLCVLLL

SEQ ID NO: 1347480 - protein, 9 aa, Homo Sapiens
SQIDWVALA

SEQ ID NO: 1347481 - protein, 9 aa, Homo Sapiens
YSHVSDPYS

SEQ ID NO: 1347482 - protein, 9 aa, Homo Sapiens
ELWLYHTAT

SEQ ID NO: 1347483 - protein, 9 aa, Homo Sapiens
AWSSVFLRG

SEQ ID NO: 1347484 - protein, 9 aa, Homo Sapiens
SGSSFSSGS

SEQ ID NO: 1347485 - protein, 9 aa, Homo Sapiens
EAVQAKVMR

SEQ ID NO: 1347486 - protein, 9 aa, Homo Sapiens
TKVYCGQRM

SEQ ID NO: 1347487 - protein, 9 aa, Homo Sapiens
AMRLMPKFL

SEQ ID NO: 1347488 - protein, 9 aa, Homo Sapiens
HEHREHILE

SEQ ID NO: 1347489 - protein, 9 aa, Homo Sapiens
AWVLCLLKL

SEQ ID NO: 1347490 - protein, 9 aa, Homo Sapiens
KLEPIPECP

SEQ ID NO: 1347491 - protein, 9 aa, Homo Sapiens
STTSSSLGQ

SEQ ID NO: 1347492 - protein, 9 aa, Homo Sapiens
KPRVYEFAS

SEQ ID NO: 1347493 - protein, 9 aa, Homo Sapiens
STKHMKITR

SEQ ID NO: 1347494 - protein, 9 aa, Homo Sapiens
ENPILSELT

SEQ ID NO: 1347495 - protein, 9 aa, Homo Sapiens
GQRHSPGVM

SEQ ID NO: 1347496 - protein, 9 aa, Homo Sapiens
EALHVAECP

SEQ ID NO: 1347497 - protein, 9 aa, Homo Sapiens
DISSNVIFL

SEQ ID NO: 1347498 - protein, 9 aa, Homo Sapiens
IFQCCDCGP

SEQ ID NO: 1347499 - protein, 9 aa, Homo Sapiens
FFEPGTWMC

SEQ ID NO: 1347500 - protein, 9 aa, Homo Sapiens
ATLTIRSLQ

SEQ ID NO: 1347501 - protein, 9 aa, Homo Sapiens
EVAKTMWNL

SEQ ID NO: 1347502 - protein, 9 aa, Homo Sapiens
CSSLTKHRR

SEQ ID NO: 1347503 - protein, 9 aa, Homo Sapiens
CGKAFICGF

SEQ ID NO: 1347504 - protein, 9 aa, Homo Sapiens
WEARSITTG

SEQ ID NO: 1347505 - protein, 9 aa, Homo Sapiens
LSDIPSSTT

SEQ ID NO: 1347506 - protein, 9 aa, Homo Sapiens
LHNNFQALK

SEQ ID NO: 1347507 - protein, 9 aa, Homo Sapiens
TYEGIIEEN

SEQ ID NO: 1347508 - protein, 9 aa, Homo Sapiens
LPDSQEEEL

SEQ ID NO: 1347509 - protein, 9 aa, Homo Sapiens
LYTPVVLPH

SEQ ID NO: 1347510 - protein, 9 aa, Homo Sapiens
YHIGPAEVE

SEQ ID NO: 1347511 - protein, 9 aa, Homo Sapiens
TRFGNTDGA

SEQ ID NO: 1347512 - protein, 9 aa, Homo Sapiens
VTSISLLVV

SEQ ID NO: 1347513 - protein, 9 aa, Homo Sapiens
TFQMSKDVI

SEQ ID NO: 1347514 - protein, 9 aa, Homo Sapiens
LYAALTHPK

SEQ ID NO: 1347515 - protein, 9 aa, Homo Sapiens
LLLLLLPSL

SEQ ID NO: 1347516 - protein, 9 aa, Homo Sapiens
KDEPPKDIF

SEQ ID NO: 1347517 - protein, 9 aa, Homo Sapiens
FSQKTTLLC

SEQ ID NO: 1347518 - protein, 9 aa, Homo Sapiens
SRGILEELL

SEQ ID NO: 1347519 - protein, 9 aa, Homo Sapiens
GVAQPTMEE

SEQ ID NO: 1347520 - protein, 9 aa, Homo Sapiens
RDKLKFFLK

SEQ ID NO: 1347521 - protein, 9 aa, Homo Sapiens
IEIGNSLPQ

SEQ ID NO: 1347522 - protein, 9 aa, Homo Sapiens
SSTMTPYGS

SEQ ID NO: 1347523 - protein, 9 aa, Homo Sapiens
AMRYVQFMG

SEQ ID NO: 1347524 - protein, 9 aa, Homo Sapiens
RPKCTCIVD

SEQ ID NO: 1347525 - protein, 9 aa, Homo Sapiens
STSAFGFAF

SEQ ID NO: 1347526 - protein, 9 aa, Homo Sapiens
ENATVTHLV

SEQ ID NO: 1347527 - protein, 9 aa, Homo Sapiens
IKRSLLVCQ

SEQ ID NO: 1347528 - protein, 9 aa, Homo Sapiens
SERDELYVQ

SEQ ID NO: 1347529 - protein, 9 aa, Homo Sapiens
TSIKIAPPE

SEQ ID NO: 1347530 - protein, 9 aa, Homo Sapiens
TGLSDISTQ

SEQ ID NO: 1347531 - protein, 9 aa, Homo Sapiens
GGERMEDAP

SEQ ID NO: 1347532 - protein, 9 aa, Homo Sapiens
SEDVRHVIF

SEQ ID NO: 1347533 - protein, 9 aa, Homo Sapiens
EEELRRCEE

SEQ ID NO: 1347534 - protein, 9 aa, Homo Sapiens
TYTVIEAPK

SEQ ID NO: 1347535 - protein, 9 aa, Homo Sapiens
GKATLKAAG

SEQ ID NO: 1347536 - protein, 9 aa, Homo Sapiens
VFYSQETRD

SEQ ID NO: 1347537 - protein, 9 aa, Homo Sapiens
PPAYTKVKS

SEQ ID NO: 1347538 - protein, 9 aa, Homo Sapiens
AQDTTLICP

SEQ ID NO: 1347539 - protein, 9 aa, Homo Sapiens
LDIDECHLL

SEQ ID NO: 1347540 - protein, 9 aa, Homo Sapiens
IFLADLYVL

SEQ ID NO: 1347541 - protein, 9 aa, Homo Sapiens
YVGEDIVDV

SEQ ID NO: 1347542 - protein, 9 aa, Homo Sapiens
GVLPLPEDN

SEQ ID NO: 1347543 - protein, 9 aa, Homo Sapiens
DVDEFKKFR

SEQ ID NO: 1347544 - protein, 9 aa, Homo Sapiens
SAYLLFYEC

SEQ ID NO: 1347545 - protein, 9 aa, Homo Sapiens
ETEFEAEQE

SEQ ID NO: 1347546 - protein, 9 aa, Homo Sapiens
LKITLGVQL

SEQ ID NO: 1347547 - protein, 9 aa, Homo Sapiens
AILPPHLNG

SEQ ID NO: 1347548 - protein, 9 aa, Homo Sapiens
LFKDYEICQ

SEQ ID NO: 1347549 - protein, 9 aa, Homo Sapiens
YIRSLIRTG

SEQ ID NO: 1347550 - protein, 9 aa, Homo Sapiens
PHDSAGYHL

SEQ ID NO: 1347551 - protein, 9 aa, Homo Sapiens
WDAEYFLFI

SEQ ID NO: 1347552 - protein, 9 aa, Homo Sapiens
GAIMTFFKK

SEQ ID NO: 1347553 - protein, 9 aa, Homo Sapiens
GKSTILCLL

SEQ ID NO: 1347554 - protein, 9 aa, Homo Sapiens
CLFRNIFMA

SEQ ID NO: 1347555 - protein, 9 aa, Homo Sapiens
PKGRHSFQY

SEQ ID NO: 1347556 - protein, 9 aa, Homo Sapiens
NDITRDLIL

SEQ ID NO: 1347557 - protein, 9 aa, Homo Sapiens
DNIFIKNLE

SEQ ID NO: 1347558 - protein, 9 aa, Homo Sapiens
PQDSIRINV

SEQ ID NO: 1347559 - protein, 9 aa, Homo Sapiens
EGKQILFPK

SEQ ID NO: 1347560 - protein, 9 aa, Homo Sapiens
SKEANTNGS

SEQ ID NO: 1347561 - protein, 9 aa, Homo Sapiens
DRRNNMKLQ

SEQ ID NO: 1347562 - protein, 9 aa, Homo Sapiens
CTALQHGAH

SEQ ID NO: 1347563 - protein, 9 aa, Homo Sapiens
LVMIVGINC

SEQ ID NO: 1347564 - protein, 9 aa, Homo Sapiens
PTADCKTVV

SEQ ID NO: 1347565 - protein, 9 aa, Homo Sapiens
ERHWHYFDQ

SEQ ID NO: 1347566 - protein, 9 aa, Homo Sapiens
PSLGSYSSS

SEQ ID NO: 1347567 - protein, 9 aa, Homo Sapiens
IKSVLLVVL

SEQ ID NO: 1347568 - protein, 9 aa, Homo Sapiens
AIMARRQHL

SEQ ID NO: 1347569 - protein, 9 aa, Homo Sapiens
FSYFRSWDV

SEQ ID NO: 1347570 - protein, 9 aa, Homo Sapiens
FVLFIALTL

SEQ ID NO: 1347571 - protein, 9 aa, Homo Sapiens
DPPIHESLN

SEQ ID NO: 1347572 - protein, 9 aa, Homo Sapiens
LSNVEQITN

SEQ ID NO: 1347573 - protein, 9 aa, Homo Sapiens
PLIMGFMLV

SEQ ID NO: 1347574 - protein, 9 aa, Homo Sapiens
CELISQLCA

SEQ ID NO: 1347575 - protein, 9 aa, Homo Sapiens
LTTPIMFSP

SEQ ID NO: 1347576 - protein, 9 aa, Homo Sapiens
CLQDGEKII

SEQ ID NO: 1347577 - protein, 9 aa, Homo Sapiens
KEKKFFVKT

SEQ ID NO: 1347578 - protein, 9 aa, Homo Sapiens
VAVFKYCHF

SEQ ID NO: 1347579 - protein, 9 aa, Homo Sapiens
DTKIIRNNS

SEQ ID NO: 1347580 - protein, 9 aa, Homo Sapiens
IYEKLLCGM

SEQ ID NO: 1347581 - protein, 9 aa, Homo Sapiens
SGVDNIFIK

SEQ ID NO: 1347582 - protein, 9 aa, Homo Sapiens
HGLGSRPPC

SEQ ID NO: 1347583 - protein, 9 aa, Homo Sapiens
TRGRHTASV

SEQ ID NO: 1347584 - protein, 9 aa, Homo Sapiens
ITIPNDLKL

SEQ ID NO: 1347585 - protein, 9 aa, Homo Sapiens
QLHEAAHQN

SEQ ID NO: 1347586 - protein, 9 aa, Homo Sapiens
QFHFQVFKM

SEQ ID NO: 1347587 - protein, 9 aa, Homo Sapiens
RHIFQKFLQ

SEQ ID NO: 1347588 - protein, 9 aa, Homo Sapiens
YQESDHKVV

SEQ ID NO: 1347589 - protein, 9 aa, Homo Sapiens
RPRLESEMV

SEQ ID NO: 1347590 - protein, 9 aa, Homo Sapiens
GRNFNYLKS

SEQ ID NO: 1347591 - protein, 9 aa, Homo Sapiens
SSACLNPAL

SEQ ID NO: 1347592 - protein, 9 aa, Homo Sapiens
AQRMSLWPQ

SEQ ID NO: 1347593 - protein, 9 aa, Homo Sapiens
PTRGHALLR

SEQ ID NO: 1347594 - protein, 9 aa, Homo Sapiens
HSAIFSVTY

SEQ ID NO: 1347595 - protein, 9 aa, Homo Sapiens
KPLWGVWLR

SEQ ID NO: 1347596 - protein, 9 aa, Homo Sapiens
CVPCPVDRT

SEQ ID NO: 1347597 - protein, 9 aa, Homo Sapiens
LLLKPREEV

SEQ ID NO: 1347598 - protein, 9 aa, Homo Sapiens
LARNVVVGK

SEQ ID NO: 1347599 - protein, 9 aa, Homo Sapiens
TNTCSAHTT

SEQ ID NO: 1347600 - protein, 9 aa, Homo Sapiens
NLEIREIRT

SEQ ID NO: 1347601 - protein, 9 aa, Homo Sapiens
NVCTKDMPP

SEQ ID NO: 1347602 - protein, 9 aa, Homo Sapiens
ATRQLLLQQ

SEQ ID NO: 1347603 - protein, 9 aa, Homo Sapiens
SVQDQLSAL

SEQ ID NO: 1347604 - protein, 9 aa, Homo Sapiens
SSKKKPLLL

SEQ ID NO: 1347605 - protein, 9 aa, Homo Sapiens
DASLCLMVV

SEQ ID NO: 1347606 - protein, 9 aa, Homo Sapiens
KIQPLAKTT

SEQ ID NO: 1347607 - protein, 9 aa, Homo Sapiens
VPTLMSLAK

SEQ ID NO: 1347608 - protein, 9 aa, Homo Sapiens
HLLSGCHVN

SEQ ID NO: 1347609 - protein, 9 aa, Homo Sapiens
RTAKVAEQQ

SEQ ID NO: 1347610 - protein, 9 aa, Homo Sapiens
VQAVTVTVM

SEQ ID NO: 1347611 - protein, 9 aa, Homo Sapiens
IESLQIFPR

SEQ ID NO: 1347612 - protein, 9 aa, Homo Sapiens
PEAAQNDQS

SEQ ID NO: 1347613 - protein, 9 aa, Homo Sapiens
AELVPKYHP

SEQ ID NO: 1347614 - protein, 9 aa, Homo Sapiens
EYAAGDIAR

SEQ ID NO: 1347615 - protein, 9 aa, Homo Sapiens
GLAGQRGII

SEQ ID NO: 1347616 - protein, 9 aa, Homo Sapiens
MAALYGRLY

SEQ ID NO: 1347617 - protein, 9 aa, Homo Sapiens
GGRCAQTRE

SEQ ID NO: 1347618 - protein, 9 aa, Homo Sapiens
CCASTWTVR

SEQ ID NO: 1347619 - protein, 9 aa, Homo Sapiens
CQAQRACCK

SEQ ID NO: 1347620 - protein, 9 aa, Homo Sapiens
RKFMMQSRL

SEQ ID NO: 1347621 - protein, 9 aa, Homo Sapiens
CVPNAYHPQ

SEQ ID NO: 1347622 - protein, 9 aa, Homo Sapiens
HMHKNGDKE

SEQ ID NO: 1347623 - protein, 9 aa, Homo Sapiens
ASDKDQLMA

SEQ ID NO: 1347624 - protein, 9 aa, Homo Sapiens
RKGTTMKGL

SEQ ID NO: 1347625 - protein, 9 aa, Homo Sapiens
NMHFLPDGR

SEQ ID NO: 1347626 - protein, 9 aa, Homo Sapiens
SFCLSHPQV

SEQ ID NO: 1347627 - protein, 9 aa, Homo Sapiens
RESSEEPLV

SEQ ID NO: 1347628 - protein, 9 aa, Homo Sapiens
EGFISCMQY

SEQ ID NO: 1347629 - protein, 9 aa, Homo Sapiens
GHTAPGTDA

SEQ ID NO: 1347630 - protein, 9 aa, Homo Sapiens
KRITIQEAL

SEQ ID NO: 1347631 - protein, 9 aa, Homo Sapiens
MGGRHPSWP

SEQ ID NO: 1347632 - protein, 9 aa, Homo Sapiens
VFNAEFKDK

SEQ ID NO: 1347633 - protein, 9 aa, Homo Sapiens
SAFYGQDCQ

SEQ ID NO: 1347634 - protein, 9 aa, Homo Sapiens
LQEIYKAET

SEQ ID NO: 1347635 - protein, 9 aa, Homo Sapiens
SEVVATEAQ

SEQ ID NO: 1347636 - protein, 9 aa, Homo Sapiens
LLWIAQRRK

SEQ ID NO: 1347637 - protein, 9 aa, Homo Sapiens
KSYFEHIST

SEQ ID NO: 1347638 - protein, 9 aa, Homo Sapiens
VYPVALSMY

SEQ ID NO: 1347639 - protein, 9 aa, Homo Sapiens
REEKHNQAK

SEQ ID NO: 1347640 - protein, 9 aa, Homo Sapiens
KGPRAPHPP

SEQ ID NO: 1347641 - protein, 9 aa, Homo Sapiens
VPAEAPVPS

SEQ ID NO: 1347642 - protein, 9 aa, Homo Sapiens
NERHVRIQL

SEQ ID NO: 1347643 - protein, 9 aa, Homo Sapiens
GAAAHFPSV

SEQ ID NO: 1347644 - protein, 9 aa, Homo Sapiens
CHFIVDKLN

SEQ ID NO: 1347645 - protein, 9 aa, Homo Sapiens
LNVSSVRQE

SEQ ID NO: 1347646 - protein, 9 aa, Homo Sapiens
TAELPEDKS

SEQ ID NO: 1347647 - protein, 9 aa, Homo Sapiens
GQAWVQLGT

SEQ ID NO: 1347648 - protein, 9 aa, Homo Sapiens
LAGGSGGHS

SEQ ID NO: 1347649 - protein, 9 aa, Homo Sapiens
QGELKRVIC

SEQ ID NO: 1347650 - protein, 9 aa, Homo Sapiens
RCAPVMSWA

SEQ ID NO: 1347651 - protein, 9 aa, Homo Sapiens
KIKHGNLLF

SEQ ID NO: 1347652 - protein, 9 aa, Homo Sapiens
LMSWRVYTV

SEQ ID NO: 1347653 - protein, 9 aa, Homo Sapiens
RPRSMLCSY

SEQ ID NO: 1347654 - protein, 9 aa, Homo Sapiens
RGHVAVWGL

SEQ ID NO: 1347655 - protein, 9 aa, Homo Sapiens
SHGVSGGGK

SEQ ID NO: 1347656 - protein, 9 aa, Homo Sapiens
GRQFAQHPA

SEQ ID NO: 1347657 - protein, 9 aa, Homo Sapiens
GKLQPLVTS

SEQ ID NO: 1347658 - protein, 9 aa, Homo Sapiens
GQSKGFTFI

SEQ ID NO: 1347659 - protein, 9 aa, Homo Sapiens
AQEQHNVFL

SEQ ID NO: 1347660 - protein, 9 aa, Homo Sapiens
DPCWTHART

SEQ ID NO: 1347661 - protein, 9 aa, Homo Sapiens
FWRLCRTFD

SEQ ID NO: 1347662 - protein, 9 aa, Homo Sapiens
VLPHSLDFT

SEQ ID NO: 1347663 - protein, 9 aa, Homo Sapiens
CAPAACFCI

SEQ ID NO: 1347664 - protein, 9 aa, Homo Sapiens
HFLTLDTEG

SEQ ID NO: 1347665 - protein, 9 aa, Homo Sapiens
YVPQQEISV

SEQ ID NO: 1347666 - protein, 9 aa, Homo Sapiens
FVVGLYTGE

SEQ ID NO: 1347667 - protein, 9 aa, Homo Sapiens
AWEWEEDPT

SEQ ID NO: 1347668 - protein, 9 aa, Homo Sapiens
CQHSPAFTS

SEQ ID NO: 1347669 - protein, 9 aa, Homo Sapiens
AMGPGESLP

SEQ ID NO: 1347670 - protein, 9 aa, Homo Sapiens
NPIIYVFLS

SEQ ID NO: 1347671 - protein, 9 aa, Homo Sapiens
TFLNPEGDS

SEQ ID NO: 1347672 - protein, 9 aa, Homo Sapiens
STHLNCAPK

SEQ ID NO: 1347673 - protein, 9 aa, Homo Sapiens
AHVMDRHHG

SEQ ID NO: 1347674 - protein, 9 aa, Homo Sapiens
PQNRSRTNG

SEQ ID NO: 1347675 - protein, 9 aa, Homo Sapiens
NAEFGGGTR

SEQ ID NO: 1347676 - protein, 9 aa, Homo Sapiens
TVFRATPLL

SEQ ID NO: 1347677 - protein, 9 aa, Homo Sapiens
CGSGNDEDW

SEQ ID NO: 1347678 - protein, 9 aa, Homo Sapiens
EYAQNVLRK

SEQ ID NO: 1347679 - protein, 9 aa, Homo Sapiens
FILFVLSVH

SEQ ID NO: 1347680 - protein, 9 aa, Homo Sapiens
FVSNKINTG

SEQ ID NO: 1347681 - protein, 9 aa, Homo Sapiens
QSSVQHQLY

SEQ ID NO: 1347682 - protein, 9 aa, Homo Sapiens
PTGTYKVVP

SEQ ID NO: 1347683 - protein, 9 aa, Homo Sapiens
AASYSTVTR

SEQ ID NO: 1347684 - protein, 9 aa, Homo Sapiens
PDKKMCTKI

SEQ ID NO: 1347685 - protein, 9 aa, Homo Sapiens
KADQIDKLT

SEQ ID NO: 1347686 - protein, 9 aa, Homo Sapiens
YRDVSYLSK

SEQ ID NO: 1347687 - protein, 9 aa, Homo Sapiens
NATPCTVLR

SEQ ID NO: 1347688 - protein, 9 aa, Homo Sapiens
LLLTFILVV

SEQ ID NO: 1347689 - protein, 9 aa, Homo Sapiens
TKLLDSQGK

SEQ ID NO: 1347690 - protein, 9 aa, Homo Sapiens
EISRVANHV

SEQ ID NO: 1347691 - protein, 9 aa, Homo Sapiens
RCKTEEERQ

SEQ ID NO: 1347692 - protein, 9 aa, Homo Sapiens
AVKMEMPII

SEQ ID NO: 1347693 - protein, 9 aa, Homo Sapiens
LGTQKVAIS

SEQ ID NO: 1347694 - protein, 9 aa, Homo Sapiens
TFKDFILSK

SEQ ID NO: 1347695 - protein, 9 aa, Homo Sapiens
PSHITPTTG

SEQ ID NO: 1347696 - protein, 9 aa, Homo Sapiens
KSQHYKAEE

SEQ ID NO: 1347697 - protein, 9 aa, Homo Sapiens
QEDLVEMVL

SEQ ID NO: 1347698 - protein, 9 aa, Homo Sapiens
TTLASGAVA

SEQ ID NO: 1347699 - protein, 9 aa, Homo Sapiens
LHLCTVKLC

SEQ ID NO: 1347700 - protein, 9 aa, Homo Sapiens
VYNNQEPLR

SEQ ID NO: 1347701 - protein, 9 aa, Homo Sapiens
LLKMKTSKY

SEQ ID NO: 1347702 - protein, 9 aa, Homo Sapiens
SEAPESNGM

SEQ ID NO: 1347703 - protein, 9 aa, Homo Sapiens
ALTQVCGYS

SEQ ID NO: 1347704 - protein, 9 aa, Homo Sapiens
ILHYLARVA

SEQ ID NO: 1347705 - protein, 9 aa, Homo Sapiens
SAARPSTSV

SEQ ID NO: 1347706 - protein, 9 aa, Homo Sapiens
SPKRQQLSA

SEQ ID NO: 1347707 - protein, 9 aa, Homo Sapiens
NANGTYEVS

SEQ ID NO: 1347708 - protein, 9 aa, Homo Sapiens
DSNFTLLVE

SEQ ID NO: 1347709 - protein, 9 aa, Homo Sapiens
AAENVCYML

SEQ ID NO: 1347710 - protein, 9 aa, Homo Sapiens
LSSLNDERI

SEQ ID NO: 1347711 - protein, 9 aa, Homo Sapiens
EPLSNPDGP

SEQ ID NO: 1347712 - protein, 9 aa, Homo Sapiens
FHVVDGDHL

SEQ ID NO: 1347713 - protein, 9 aa, Homo Sapiens
VSEGNPYVS

SEQ ID NO: 1347714 - protein, 9 aa, Homo Sapiens
PAILPNIPI

SEQ ID NO: 1347715 - protein, 9 aa, Homo Sapiens
SSVLEYTIK

SEQ ID NO: 1347716 - protein, 9 aa, Homo Sapiens
KIRTAVDSA

SEQ ID NO: 1347717 - protein, 9 aa, Homo Sapiens
NISQSSSNE

SEQ ID NO: 1347718 - protein, 9 aa, Homo Sapiens
TWPPSRNPS

SEQ ID NO: 1347719 - protein, 9 aa, Homo Sapiens
GGFWLSLLY

SEQ ID NO: 1347720 - protein, 9 aa, Homo Sapiens
WWSAAATMA

SEQ ID NO: 1347721 - protein, 9 aa, Homo Sapiens
ATKCATILD

SEQ ID NO: 1347722 - protein, 9 aa, Homo Sapiens
GYLLVPARY

SEQ ID NO: 1347723 - protein, 9 aa, Homo Sapiens
RCVCSTARL

SEQ ID NO: 1347724 - protein, 9 aa, Homo Sapiens
RWTHNFHHF

SEQ ID NO: 1347725 - protein, 9 aa, Homo Sapiens
SMEWFTGIE

SEQ ID NO: 1347726 - protein, 9 aa, Homo Sapiens
KHVHQGVRG

SEQ ID NO: 1347727 - protein, 9 aa, Homo Sapiens
VPVLHEELL

SEQ ID NO: 1347728 - protein, 9 aa, Homo Sapiens
SNTANRISG

SEQ ID NO: 1347729 - protein, 9 aa, Homo Sapiens
VRHFFCDMS

SEQ ID NO: 1347730 - protein, 9 aa, Homo Sapiens
PSNLKRVSA

SEQ ID NO: 1347731 - protein, 9 aa, Homo Sapiens
ITHIIFTIE

SEQ ID NO: 1347732 - protein, 9 aa, Homo Sapiens
APPRSGRGS

SEQ ID NO: 1347733 - protein, 9 aa, Homo Sapiens
YFGSNYMSI

SEQ ID NO: 1347734 - protein, 9 aa, Homo Sapiens
IGGFWLSLL

SEQ ID NO: 1347735 - protein, 9 aa, Homo Sapiens
SSQASRHFG

SEQ ID NO: 1347736 - protein, 9 aa, Homo Sapiens
EECGADTAP

SEQ ID NO: 1347737 - protein, 9 aa, Homo Sapiens
VFTPTSSWA

SEQ ID NO: 1347738 - protein, 9 aa, Homo Sapiens
KVLNANLST

SEQ ID NO: 1347739 - protein, 9 aa, Homo Sapiens
KLDKRTKVC

SEQ ID NO: 1347740 - protein, 9 aa, Homo Sapiens
EGGYWCELT

SEQ ID NO: 1347741 - protein, 9 aa, Homo Sapiens
VLLLTEKDV

SEQ ID NO: 1347742 - protein, 9 aa, Homo Sapiens
NNCMKSVLI

SEQ ID NO: 1347743 - protein, 9 aa, Homo Sapiens
GCGHAWNTH

SEQ ID NO: 1347744 - protein, 9 aa, Homo Sapiens
SVMGSTSIP

SEQ ID NO: 1347745 - protein, 9 aa, Homo Sapiens
EALKRLHRK

SEQ ID NO: 1347746 - protein, 9 aa, Homo Sapiens
PLQIILFFF

SEQ ID NO: 1347747 - protein, 9 aa, Homo Sapiens
QQKCPFAYH

SEQ ID NO: 1347748 - protein, 9 aa, Homo Sapiens
RNNIKPSSH

SEQ ID NO: 1347749 - protein, 9 aa, Homo Sapiens
SQKSSPRCA

SEQ ID NO: 1347750 - protein, 9 aa, Homo Sapiens
RNKKTKIIN

SEQ ID NO: 1347751 - protein, 9 aa, Homo Sapiens
CQIRQYHIK

SEQ ID NO: 1347752 - protein, 9 aa, Homo Sapiens
GGRGEDGTP

SEQ ID NO: 1347753 - protein, 9 aa, Homo Sapiens
ARNVVVGKR

SEQ ID NO: 1347754 - protein, 9 aa, Homo Sapiens
QIATDKQYK

SEQ ID NO: 1347755 - protein, 9 aa, Homo Sapiens
VTVGDTSLH

SEQ ID NO: 1347756 - protein, 9 aa, Homo Sapiens
ISGLISGLC

SEQ ID NO: 1347757 - protein, 9 aa, Homo Sapiens
YGFTELPDV

SEQ ID NO: 1347758 - protein, 9 aa, Homo Sapiens
NSLNEVTMV

SEQ ID NO: 1347759 - protein, 9 aa, Homo Sapiens
MLLTQKVTS

SEQ ID NO: 1347760 - protein, 9 aa, Homo Sapiens
NVTVLHDSK

SEQ ID NO: 1347761 - protein, 9 aa, Homo Sapiens
VSNLLAEHN

SEQ ID NO: 1347762 - protein, 9 aa, Homo Sapiens
GSMWSITTK

SEQ ID NO: 1347763 - protein, 9 aa, Homo Sapiens
WRDRHHQKT

SEQ ID NO: 1347764 - protein, 9 aa, Homo Sapiens
DLVNVFDIN

SEQ ID NO: 1347765 - protein, 9 aa, Homo Sapiens
YFEVQSVLL

SEQ ID NO: 1347766 - protein, 9 aa, Homo Sapiens
DRSILVDGE

SEQ ID NO: 1347767 - protein, 9 aa, Homo Sapiens
MVLAYSGGL

SEQ ID NO: 1347768 - protein, 9 aa, Homo Sapiens
GMKMYGCEL

SEQ ID NO: 1347769 - protein, 9 aa, Homo Sapiens
CGHNESKAD

SEQ ID NO: 1347770 - protein, 9 aa, Homo Sapiens
QLYHLDTYI

SEQ ID NO: 1347771 - protein, 9 aa, Homo Sapiens
AARAVVFAA

SEQ ID NO: 1347772 - protein, 9 aa, Homo Sapiens
RLHGWLQET

SEQ ID NO: 1347773 - protein, 9 aa, Homo Sapiens
RSKPESQGI

SEQ ID NO: 1347774 - protein, 9 aa, Homo Sapiens
VKNYYFNTY

SEQ ID NO: 1347775 - protein, 9 aa, Homo Sapiens
VSLSQEAWH

SEQ ID NO: 1347776 - protein, 9 aa, Homo Sapiens
VDAQVGPLP

SEQ ID NO: 1347777 - protein, 9 aa, Homo Sapiens
ARLGLLVPR

SEQ ID NO: 1347778 - protein, 9 aa, Homo Sapiens
YKVISEELD

SEQ ID NO: 1347779 - protein, 9 aa, Homo Sapiens
DDDDIVDTG

SEQ ID NO: 1347780 - protein, 9 aa, Homo Sapiens
LIDTVQSYA

SEQ ID NO: 1347781 - protein, 9 aa, Homo Sapiens
SFENGNSDN

SEQ ID NO: 1347782 - protein, 9 aa, Homo Sapiens
QINCFESAE

SEQ ID NO: 1347783 - protein, 9 aa, Homo Sapiens
LRAAGVLCH

SEQ ID NO: 1347784 - protein, 9 aa, Homo Sapiens
TGEDVAALL

SEQ ID NO: 1347785 - protein, 9 aa, Homo Sapiens
NVAHGRWNV

SEQ ID NO: 1347786 - protein, 9 aa, Homo Sapiens
HSQLAESNQ

SEQ ID NO: 1347787 - protein, 9 aa, Homo Sapiens
GRCVTVFST

SEQ ID NO: 1347788 - protein, 9 aa, Homo Sapiens
IFALALVAF

SEQ ID NO: 1347789 - protein, 9 aa, Homo Sapiens
YCDAIAEIR

SEQ ID NO: 1347790 - protein, 9 aa, Homo Sapiens
SGEKKMLEQ

SEQ ID NO: 1347791 - protein, 9 aa, Homo Sapiens
LVNDGKYHV

SEQ ID NO: 1347792 - protein, 9 aa, Homo Sapiens
RRQRRRKER

SEQ ID NO: 1347793 - protein, 9 aa, Homo Sapiens
VTTGKVPEV

SEQ ID NO: 1347794 - protein, 9 aa, Homo Sapiens
VVAELQGFT

SEQ ID NO: 1347795 - protein, 9 aa, Homo Sapiens
SHSGYQFTS

SEQ ID NO: 1347796 - protein, 9 aa, Homo Sapiens
TSQWSQYLA

SEQ ID NO: 1347797 - protein, 9 aa, Homo Sapiens
SPIPTLKGY

SEQ ID NO: 1347798 - protein, 9 aa, Homo Sapiens
EGRPKDDHH

SEQ ID NO: 1347799 - protein, 9 aa, Homo Sapiens
SPSPPTPRP

SEQ ID NO: 1347800 - protein, 9 aa, Homo Sapiens
ICLTVIVVL

SEQ ID NO: 1347801 - protein, 9 aa, Homo Sapiens
IDNTCILWD

SEQ ID NO: 1347802 - protein, 9 aa, Homo Sapiens
LMRTKSDTS

SEQ ID NO: 1347803 - protein, 9 aa, Homo Sapiens
ESLYFRLHL

SEQ ID NO: 1347804 - protein, 9 aa, Homo Sapiens
LNCRGVIAN

SEQ ID NO: 1347805 - protein, 9 aa, Homo Sapiens
ITEFLYIAR

SEQ ID NO: 1347806 - protein, 9 aa, Homo Sapiens
SNSTRGPFG

SEQ ID NO: 1347807 - protein, 9 aa, Homo Sapiens
CKQEGQLRV

SEQ ID NO: 1347808 - protein, 9 aa, Homo Sapiens
IDHFKEVIC

SEQ ID NO: 1347809 - protein, 9 aa, Homo Sapiens
PDTSFQVVL

SEQ ID NO: 1347810 - protein, 9 aa, Homo Sapiens
EGRLPPFAE

SEQ ID NO: 1347811 - protein, 9 aa, Homo Sapiens
KIYYRSALM

SEQ ID NO: 1347812 - protein, 9 aa, Homo Sapiens
NFEPFATGD

SEQ ID NO: 1347813 - protein, 9 aa, Homo Sapiens
DVGFGRSST

SEQ ID NO: 1347814 - protein, 9 aa, Homo Sapiens
LVEKWAFRE

SEQ ID NO: 1347815 - protein, 9 aa, Homo Sapiens
LPQQDNLIT

SEQ ID NO: 1347816 - protein, 9 aa, Homo Sapiens
KLRRTRHYN

SEQ ID NO: 1347817 - protein, 9 aa, Homo Sapiens
ICFYIDITK

SEQ ID NO: 1347818 - protein, 9 aa, Homo Sapiens
KVSADGHPG

SEQ ID NO: 1347819 - protein, 9 aa, Homo Sapiens
KEVLKGAIQ

SEQ ID NO: 1347820 - protein, 9 aa, Homo Sapiens
QMKATGKMY

SEQ ID NO: 1347821 - protein, 9 aa, Homo Sapiens
FNQCNTTRD

SEQ ID NO: 1347822 - protein, 9 aa, Homo Sapiens
LMPPFVPST

SEQ ID NO: 1347823 - protein, 9 aa, Homo Sapiens
KYSDSDSDS

SEQ ID NO: 1347824 - protein, 9 aa, Homo Sapiens
KLKELHSML

SEQ ID NO: 1347825 - protein, 9 aa, Homo Sapiens
SEDIQLEAA

SEQ ID NO: 1347826 - protein, 9 aa, Homo Sapiens
KEALIRYAV

SEQ ID NO: 1347827 - protein, 9 aa, Homo Sapiens
TKLFNWIVD

SEQ ID NO: 1347828 - protein, 9 aa, Homo Sapiens
PPNEPGTFL

SEQ ID NO: 1347829 - protein, 9 aa, Homo Sapiens
DFPSENSFE

SEQ ID NO: 1347830 - protein, 9 aa, Homo Sapiens
GGGGQKPGG

SEQ ID NO: 1347831 - protein, 9 aa, Homo Sapiens
VGHALHNNF

SEQ ID NO: 1347832 - protein, 9 aa, Homo Sapiens
TISLVFSLV

SEQ ID NO: 1347833 - protein, 9 aa, Homo Sapiens
TDHILHPKF

SEQ ID NO: 1347834 - protein, 9 aa, Homo Sapiens
MKRKKQICI

SEQ ID NO: 1347835 - protein, 9 aa, Homo Sapiens
RNLSRMQNR

SEQ ID NO: 1347836 - protein, 9 aa, Homo Sapiens
AIASFDQLY

SEQ ID NO: 1347837 - protein, 9 aa, Homo Sapiens
REIQILLHF

SEQ ID NO: 1347838 - protein, 9 aa, Homo Sapiens
TRHYNVLSK

SEQ ID NO: 1347839 - protein, 9 aa, Homo Sapiens
THDPKAEEK

SEQ ID NO: 1347840 - protein, 9 aa, Homo Sapiens
IGTYCGQSV

SEQ ID NO: 1347841 - protein, 9 aa, Homo Sapiens
GDKAAAEEA

SEQ ID NO: 1347842 - protein, 9 aa, Homo Sapiens
RGEDPTLQI

SEQ ID NO: 1347843 - protein, 9 aa, Homo Sapiens
YHEDIINVR

SEQ ID NO: 1347844 - protein, 9 aa, Homo Sapiens
PDSQEEELE

SEQ ID NO: 1347845 - protein, 9 aa, Homo Sapiens
ATRPSSCTS

SEQ ID NO: 1347846 - protein, 9 aa, Homo Sapiens
KVLPPARHI

SEQ ID NO: 1347847 - protein, 9 aa, Homo Sapiens
GGFGCFLLL

SEQ ID NO: 1347848 - protein, 9 aa, Homo Sapiens
QRAPHLLQG

SEQ ID NO: 1347849 - protein, 9 aa, Homo Sapiens
QTLQIRGMM

SEQ ID NO: 1347850 - protein, 9 aa, Homo Sapiens
WIHCIICNH

SEQ ID NO: 1347851 - protein, 9 aa, Homo Sapiens
SLTNSVFQA

SEQ ID NO: 1347852 - protein, 9 aa, Homo Sapiens
GDGLESIPS

SEQ ID NO: 1347853 - protein, 9 aa, Homo Sapiens
HPPQPKKSK

SEQ ID NO: 1347854 - protein, 9 aa, Homo Sapiens
FLQPLRQQA

SEQ ID NO: 1347855 - protein, 9 aa, Homo Sapiens
SSETSSSSC

SEQ ID NO: 1347856 - protein, 9 aa, Homo Sapiens
KGGYKHATF

SEQ ID NO: 1347857 - protein, 9 aa, Homo Sapiens
LATCVGSIA

SEQ ID NO: 1347858 - protein, 9 aa, Homo Sapiens
KNLRWRKAH

SEQ ID NO: 1347859 - protein, 9 aa, Homo Sapiens
HNWKITHVV

SEQ ID NO: 1347860 - protein, 9 aa, Homo Sapiens
YNKDGITFI

SEQ ID NO: 1347861 - protein, 9 aa, Homo Sapiens
KWRDYDQYY

SEQ ID NO: 1347862 - protein, 9 aa, Homo Sapiens
CLSVFATFA

SEQ ID NO: 1347863 - protein, 9 aa, Homo Sapiens
PFMSVVSGR

SEQ ID NO: 1347864 - protein, 9 aa, Homo Sapiens
PQEGFVPLD

SEQ ID NO: 1347865 - protein, 9 aa, Homo Sapiens
MSRLMLKQE

SEQ ID NO: 1347866 - protein, 9 aa, Homo Sapiens
RSFLGHVVF

SEQ ID NO: 1347867 - protein, 9 aa, Homo Sapiens
KCGQKRKSG

SEQ ID NO: 1347868 - protein, 9 aa, Homo Sapiens
SPSTVIHGT

SEQ ID NO: 1347869 - protein, 9 aa, Homo Sapiens
ASTLSHLHR

SEQ ID NO: 1347870 - protein, 9 aa, Homo Sapiens
LRLFYDICK

SEQ ID NO: 1347871 - protein, 9 aa, Homo Sapiens
AINASYVVW

SEQ ID NO: 1347872 - protein, 9 aa, Homo Sapiens
LWKNHQQNT

SEQ ID NO: 1347873 - protein, 9 aa, Homo Sapiens
PLRVLMSVV

SEQ ID NO: 1347874 - protein, 9 aa, Homo Sapiens
PDVYAIMRG

SEQ ID NO: 1347875 - protein, 9 aa, Homo Sapiens
AAVSFICFT

SEQ ID NO: 1347876 - protein, 9 aa, Homo Sapiens
GHLEMPKTS

SEQ ID NO: 1347877 - protein, 9 aa, Homo Sapiens
LLFECYRIP

SEQ ID NO: 1347878 - protein, 9 aa, Homo Sapiens
ARDSTSCKL

SEQ ID NO: 1347879 - protein, 9 aa, Homo Sapiens
DFEWECGVG

SEQ ID NO: 1347880 - protein, 9 aa, Homo Sapiens
PEKLGAFLA

SEQ ID NO: 1347881 - protein, 9 aa, Homo Sapiens
IYPEGTHND

SEQ ID NO: 1347882 - protein, 9 aa, Homo Sapiens
LLHFRHENV

SEQ ID NO: 1347883 - protein, 9 aa, Homo Sapiens
TAKRARNNI

SEQ ID NO: 1347884 - protein, 9 aa, Homo Sapiens
TNILKEIDI

SEQ ID NO: 1347885 - protein, 9 aa, Homo Sapiens
SCLQGLHLG

SEQ ID NO: 1347886 - protein, 9 aa, Homo Sapiens
GGGKETLKD

SEQ ID NO: 1347887 - protein, 9 aa, Homo Sapiens
QGAMAEEEW

SEQ ID NO: 1347888 - protein, 9 aa, Homo Sapiens
SAKVLGPRR

SEQ ID NO: 1347889 - protein, 9 aa, Homo Sapiens
STVDDKCEK

SEQ ID NO: 1347890 - protein, 9 aa, Homo Sapiens
EDEEEEERF

SEQ ID NO: 1347891 - protein, 9 aa, Homo Sapiens
GHFRKILIS

SEQ ID NO: 1347892 - protein, 9 aa, Homo Sapiens
TYEKFVEWM

SEQ ID NO: 1347893 - protein, 9 aa, Homo Sapiens
LHIVERESG

SEQ ID NO: 1347894 - protein, 9 aa, Homo Sapiens
NLFPRSLSL

SEQ ID NO: 1347895 - protein, 9 aa, Homo Sapiens
FLPREVVTR

SEQ ID NO: 1347896 - protein, 9 aa, Homo Sapiens
KTLSLMLIG

SEQ ID NO: 1347897 - protein, 9 aa, Homo Sapiens
VFYRRAQRL

SEQ ID NO: 1347898 - protein, 9 aa, Homo Sapiens
NLHKLVFSR

SEQ ID NO: 1347899 - protein, 9 aa, Homo Sapiens
LTQQPHHRV

SEQ ID NO: 1347900 - protein, 9 aa, Homo Sapiens
SASAEKGSL

SEQ ID NO: 1347901 - protein, 9 aa, Homo Sapiens
ILVSAKTIL

SEQ ID NO: 1347902 - protein, 9 aa, Homo Sapiens
SHFAWTFHS

SEQ ID NO: 1347903 - protein, 9 aa, Homo Sapiens
HSLQGRLKA

SEQ ID NO: 1347904 - protein, 9 aa, Homo Sapiens
YEITLVHWE

SEQ ID NO: 1347905 - protein, 9 aa, Homo Sapiens
VWSEAMTHG

SEQ ID NO: 1347906 - protein, 9 aa, Homo Sapiens
WQQDVEDTT

SEQ ID NO: 1347907 - protein, 9 aa, Homo Sapiens
TKTQKVCFF

SEQ ID NO: 1347908 - protein, 9 aa, Homo Sapiens
SELDTQDAE

SEQ ID NO: 1347909 - protein, 9 aa, Homo Sapiens
CGMWGRVLR

SEQ ID NO: 1347910 - protein, 9 aa, Homo Sapiens
FKAEHIKIP

SEQ ID NO: 1347911 - protein, 9 aa, Homo Sapiens
NIRLVSVLE

SEQ ID NO: 1347912 - protein, 9 aa, Homo Sapiens
YSAVISEDT

SEQ ID NO: 1347913 - protein, 9 aa, Homo Sapiens
PDELALWRG

SEQ ID NO: 1347914 - protein, 9 aa, Homo Sapiens
KRLKRRDDV

SEQ ID NO: 1347915 - protein, 9 aa, Homo Sapiens
KWKKPSIEV

SEQ ID NO: 1347916 - protein, 9 aa, Homo Sapiens
HLCGLHTVL

SEQ ID NO: 1347917 - protein, 9 aa, Homo Sapiens
VDGVLALCC

SEQ ID NO: 1347918 - protein, 9 aa, Homo Sapiens
VLPVMRLTC

SEQ ID NO: 1347919 - protein, 9 aa, Homo Sapiens
CGKMYGWSS

SEQ ID NO: 1347920 - protein, 9 aa, Homo Sapiens
KQYPPHCPS

SEQ ID NO: 1347921 - protein, 9 aa, Homo Sapiens
TQCNRTIMT

SEQ ID NO: 1347922 - protein, 9 aa, Homo Sapiens
EIYNFFCDV

SEQ ID NO: 1347923 - protein, 9 aa, Homo Sapiens
GIWMWYVPH

SEQ ID NO: 1347924 - protein, 9 aa, Homo Sapiens
RRRKQGTGS

SEQ ID NO: 1347925 - protein, 9 aa, Homo Sapiens
LKLSNVEQI

SEQ ID NO: 1347926 - protein, 9 aa, Homo Sapiens
STPCYQPAC

SEQ ID NO: 1347927 - protein, 9 aa, Homo Sapiens
LRESISKVC

SEQ ID NO: 1347928 - protein, 9 aa, Homo Sapiens
GNGFSKTWL

SEQ ID NO: 1347929 - protein, 9 aa, Homo Sapiens
EELFSVCVQ

SEQ ID NO: 1347930 - protein, 9 aa, Homo Sapiens
SCRWWGSAL

SEQ ID NO: 1347931 - protein, 9 aa, Homo Sapiens
VMIEAMERL

SEQ ID NO: 1347932 - protein, 9 aa, Homo Sapiens
YIIGRRKSY

SEQ ID NO: 1347933 - protein, 9 aa, Homo Sapiens
MKGKMMFCV

SEQ ID NO: 1347934 - protein, 9 aa, Homo Sapiens
LSTMYNLHQ

SEQ ID NO: 1347935 - protein, 9 aa, Homo Sapiens
NNRVGFVEA

SEQ ID NO: 1347936 - protein, 9 aa, Homo Sapiens
QNEIISQVY

SEQ ID NO: 1347937 - protein, 9 aa, Homo Sapiens
IDYCTSKVS

SEQ ID NO: 1347938 - protein, 9 aa, Homo Sapiens
AEVLAMIES

SEQ ID NO: 1347939 - protein, 9 aa, Homo Sapiens
LKVSVKNYE

SEQ ID NO: 1347940 - protein, 9 aa, Homo Sapiens
KNEKGVLKR

SEQ ID NO: 1347941 - protein, 9 aa, Homo Sapiens
PCMENTVLA

SEQ ID NO: 1347942 - protein, 9 aa, Homo Sapiens
AHLQKPTLT

SEQ ID NO: 1347943 - protein, 9 aa, Homo Sapiens
CCNNHNVQC

SEQ ID NO: 1347944 - protein, 9 aa, Homo Sapiens
FSSFRVVGE

SEQ ID NO: 1347945 - protein, 9 aa, Homo Sapiens
GGHPGLTEK

SEQ ID NO: 1347946 - protein, 9 aa, Homo Sapiens
DNQPCVLGW

SEQ ID NO: 1347947 - protein, 9 aa, Homo Sapiens
QHRPSYDVY

SEQ ID NO: 1347948 - protein, 9 aa, Homo Sapiens
NFSYMGAPL

SEQ ID NO: 1347949 - protein, 9 aa, Homo Sapiens
HREGDVGFG

SEQ ID NO: 1347950 - protein, 9 aa, Homo Sapiens
RKERLGLVK

SEQ ID NO: 1347951 - protein, 9 aa, Homo Sapiens
GSNYMSIDA

SEQ ID NO: 1347952 - protein, 9 aa, Homo Sapiens
QYPLTGMSP

SEQ ID NO: 1347953 - protein, 9 aa, Homo Sapiens
LFLEEIIGS

SEQ ID NO: 1347954 - protein, 9 aa, Homo Sapiens
PKITVRDNQ

SEQ ID NO: 1347955 - protein, 9 aa, Homo Sapiens
ELLVNMGGN

SEQ ID NO: 1347956 - protein, 9 aa, Homo Sapiens
QYYLPNSVE

SEQ ID NO: 1347957 - protein, 9 aa, Homo Sapiens
KNTVGMHLL

SEQ ID NO: 1347958 - protein, 9 aa, Homo Sapiens
AGEYECHTS

SEQ ID NO: 1347959 - protein, 9 aa, Homo Sapiens
WVALAQAWI

SEQ ID NO: 1347960 - protein, 9 aa, Homo Sapiens
TRPSTCTSA

SEQ ID NO: 1347961 - protein, 9 aa, Homo Sapiens
TALGCQQYI

SEQ ID NO: 1347962 - protein, 9 aa, Homo Sapiens
RPTTRSWAT

SEQ ID NO: 1347963 - protein, 9 aa, Homo Sapiens
GVIQYYTAA

SEQ ID NO: 1347964 - protein, 9 aa, Homo Sapiens
EKPNNIKKN

SEQ ID NO: 1347965 - protein, 9 aa, Homo Sapiens
STLLGDIVK

SEQ ID NO: 1347966 - protein, 9 aa, Homo Sapiens
LPVAASYST

SEQ ID NO: 1347967 - protein, 9 aa, Homo Sapiens
FSSNSHLVH

SEQ ID NO: 1347968 - protein, 9 aa, Homo Sapiens
DDLVCGAEP

SEQ ID NO: 1347969 - protein, 9 aa, Homo Sapiens
EVLLSNEQK

SEQ ID NO: 1347970 - protein, 9 aa, Homo Sapiens
SIMDLMLIC

SEQ ID NO: 1347971 - protein, 9 aa, Homo Sapiens
VDLPIKLAR

SEQ ID NO: 1347972 - protein, 9 aa, Homo Sapiens
YSTCTKGGS

SEQ ID NO: 1347973 - protein, 9 aa, Homo Sapiens
RKEHTRSDS

SEQ ID NO: 1347974 - protein, 9 aa, Homo Sapiens
SGSELEEFM

SEQ ID NO: 1347975 - protein, 9 aa, Homo Sapiens
HSKKLTKKK

SEQ ID NO: 1347976 - protein, 9 aa, Homo Sapiens
ELNTAQQNK

SEQ ID NO: 1347977 - protein, 9 aa, Homo Sapiens
RHKVDWLTE

SEQ ID NO: 1347978 - protein, 9 aa, Homo Sapiens
NSVSVATCK

SEQ ID NO: 1347979 - protein, 9 aa, Homo Sapiens
AYIIYDEDY

SEQ ID NO: 1347980 - protein, 9 aa, Homo Sapiens
AIYDIYRRN

SEQ ID NO: 1347981 - protein, 9 aa, Homo Sapiens
LGQIIKIPD

SEQ ID NO: 1347982 - protein, 9 aa, Homo Sapiens
MKCMFNQLR

SEQ ID NO: 1347983 - protein, 9 aa, Homo Sapiens
KHDLLLTRT

SEQ ID NO: 1347984 - protein, 9 aa, Homo Sapiens
PPNSAAQYL

SEQ ID NO: 1347985 - protein, 9 aa, Homo Sapiens
YGQITHNTS

SEQ ID NO: 1347986 - protein, 9 aa, Homo Sapiens
HIKRSLLVC

SEQ ID NO: 1347987 - protein, 9 aa, Homo Sapiens
CPCPSMFAH

SEQ ID NO: 1347988 - protein, 9 aa, Homo Sapiens
YSDSDSDSE

SEQ ID NO: 1347989 - protein, 9 aa, Homo Sapiens
ALLTDQRSP

SEQ ID NO: 1347990 - protein, 9 aa, Homo Sapiens
KRLPGGHIN

SEQ ID NO: 1347991 - protein, 9 aa, Homo Sapiens
CTISLVFSL

SEQ ID NO: 1347992 - protein, 9 aa, Homo Sapiens
NSTYEQLLS

SEQ ID NO: 1347993 - protein, 9 aa, Homo Sapiens
LPSSTTTDG

SEQ ID NO: 1347994 - protein, 9 aa, Homo Sapiens
SSHSIYPAQ

SEQ ID NO: 1347995 - protein, 9 aa, Homo Sapiens
CLLKLVTEM

SEQ ID NO: 1347996 - protein, 9 aa, Homo Sapiens
ETILNLLCK

SEQ ID NO: 1347997 - protein, 9 aa, Homo Sapiens
FWYLPSHDR

SEQ ID NO: 1347998 - protein, 9 aa, Homo Sapiens
LGKDKKFLE

SEQ ID NO: 1347999 - protein, 9 aa, Homo Sapiens
VHYTSKDML

SEQ ID NO: 1348000 - protein, 9 aa, Homo Sapiens
QPSSETRAF

SEQ ID NO: 1348001 - protein, 9 aa, Homo Sapiens
AVDEEGCMP

SEQ ID NO: 1348002 - protein, 9 aa, Homo Sapiens
SFLIDKITT

SEQ ID NO: 1348003 - protein, 9 aa, Homo Sapiens
SPTAIKKTI

SEQ ID NO: 1348004 - protein, 9 aa, Homo Sapiens
AVSLVDTLL

SEQ ID NO: 1348005 - protein, 9 aa, Homo Sapiens
HEPHCLCIP

SEQ ID NO: 1348006 - protein, 9 aa, Homo Sapiens
NWGFSLLIM

SEQ ID NO: 1348007 - protein, 9 aa, Homo Sapiens
MRVPLPGPL

SEQ ID NO: 1348008 - protein, 9 aa, Homo Sapiens
PVTFGFLGN

SEQ ID NO: 1348009 - protein, 9 aa, Homo Sapiens
TRVTNDNVS

SEQ ID NO: 1348010 - protein, 9 aa, Homo Sapiens
EKVHAEERE

SEQ ID NO: 1348011 - protein, 9 aa, Homo Sapiens
QQLIREMLI

SEQ ID NO: 1348012 - protein, 9 aa, Homo Sapiens
MRPLRSCDE

SEQ ID NO: 1348013 - protein, 9 aa, Homo Sapiens
NEDLNQFLS

SEQ ID NO: 1348014 - protein, 9 aa, Homo Sapiens
GWMQTCNTL

SEQ ID NO: 1348015 - protein, 9 aa, Homo Sapiens
PALDDHLSR

SEQ ID NO: 1348016 - protein, 9 aa, Homo Sapiens
SCHACALGS

SEQ ID NO: 1348017 - protein, 9 aa, Homo Sapiens
QTITRWPGD

SEQ ID NO: 1348018 - protein, 9 aa, Homo Sapiens
YGDRPGLLN

SEQ ID NO: 1348019 - protein, 9 aa, Homo Sapiens
GPHDDFVAD

SEQ ID NO: 1348020 - protein, 9 aa, Homo Sapiens
LCYRNGGGT

SEQ ID NO: 1348021 - protein, 9 aa, Homo Sapiens
CRLNLSSNQ

SEQ ID NO: 1348022 - protein, 9 aa, Homo Sapiens
LKLWDTKIV

SEQ ID NO: 1348023 - protein, 9 aa, Homo Sapiens
PGTLEEVSA

SEQ ID NO: 1348024 - protein, 9 aa, Homo Sapiens
SSEKQHFYS

SEQ ID NO: 1348025 - protein, 9 aa, Homo Sapiens
YIGHYFITT

SEQ ID NO: 1348026 - protein, 9 aa, Homo Sapiens
TLCKRLYRI

SEQ ID NO: 1348027 - protein, 9 aa, Homo Sapiens
CCKSVHYDL

SEQ ID NO: 1348028 - protein, 9 aa, Homo Sapiens
EANTKYPGS

SEQ ID NO: 1348029 - protein, 9 aa, Homo Sapiens
VIRCPLQII

SEQ ID NO: 1348030 - protein, 9 aa, Homo Sapiens
KSSPSNYVC

SEQ ID NO: 1348031 - protein, 9 aa, Homo Sapiens
HFVAVDGVR

SEQ ID NO: 1348032 - protein, 9 aa, Homo Sapiens
SYCDCCLRA

SEQ ID NO: 1348033 - protein, 9 aa, Homo Sapiens
AFENWEVDV

SEQ ID NO: 1348034 - protein, 9 aa, Homo Sapiens
IYNRTRFYV

SEQ ID NO: 1348035 - protein, 9 aa, Homo Sapiens
TDKSKAAPA

SEQ ID NO: 1348036 - protein, 9 aa, Homo Sapiens
LGLCRILSQ

SEQ ID NO: 1348037 - protein, 9 aa, Homo Sapiens
QPGILTSDI

SEQ ID NO: 1348038 - protein, 9 aa, Homo Sapiens
STATERVIA

SEQ ID NO: 1348039 - protein, 9 aa, Homo Sapiens
CSIALFFYF

SEQ ID NO: 1348040 - protein, 9 aa, Homo Sapiens
TNLNPEFIQ

SEQ ID NO: 1348041 - protein, 9 aa, Homo Sapiens
LQLYSGHLQ

SEQ ID NO: 1348042 - protein, 9 aa, Homo Sapiens
TSTGKSKSP

SEQ ID NO: 1348043 - protein, 9 aa, Homo Sapiens
RIHIRVGVV

SEQ ID NO: 1348044 - protein, 9 aa, Homo Sapiens
GVTPTDFPS

SEQ ID NO: 1348045 - protein, 9 aa, Homo Sapiens
ESGVKVDSP

SEQ ID NO: 1348046 - protein, 9 aa, Homo Sapiens
EPNVRYSAI

SEQ ID NO: 1348047 - protein, 9 aa, Homo Sapiens
GYSEAAKNG

SEQ ID NO: 1348048 - protein, 9 aa, Homo Sapiens
ARELWITYG

SEQ ID NO: 1348049 - protein, 9 aa, Homo Sapiens
GEICWPGTK

SEQ ID NO: 1348050 - protein, 9 aa, Homo Sapiens
CHDALYVVG

SEQ ID NO: 1348051 - protein, 9 aa, Homo Sapiens
GRNFYHMPF

SEQ ID NO: 1348052 - protein, 9 aa, Homo Sapiens
LKACSPLWS

SEQ ID NO: 1348053 - protein, 9 aa, Homo Sapiens
NRHRGKNEN

SEQ ID NO: 1348054 - protein, 9 aa, Homo Sapiens
GMTFSHFMS

SEQ ID NO: 1348055 - protein, 9 aa, Homo Sapiens
PGAPTFWST

SEQ ID NO: 1348056 - protein, 9 aa, Homo Sapiens
LHLNRSLTS

SEQ ID NO: 1348057 - protein, 9 aa, Homo Sapiens
KDEVCVKLG

SEQ ID NO: 1348058 - protein, 9 aa, Homo Sapiens
CYSTHLFFS

SEQ ID NO: 1348059 - protein, 9 aa, Homo Sapiens
RKLKMWYQT

SEQ ID NO: 1348060 - protein, 9 aa, Homo Sapiens
RPTHLSVVV

SEQ ID NO: 1348061 - protein, 9 aa, Homo Sapiens
FLQSAFLHH

SEQ ID NO: 1348062 - protein, 9 aa, Homo Sapiens
YSGHLQVRL

SEQ ID NO: 1348063 - protein, 9 aa, Homo Sapiens
DMDTNGGGW

SEQ ID NO: 1348064 - protein, 9 aa, Homo Sapiens
FGDVELIQT

SEQ ID NO: 1348065 - protein, 9 aa, Homo Sapiens
VMMVLQGGP

SEQ ID NO: 1348066 - protein, 9 aa, Homo Sapiens
MDVSVLRLT

SEQ ID NO: 1348067 - protein, 9 aa, Homo Sapiens
DKAREIICQ

SEQ ID NO: 1348068 - protein, 9 aa, Homo Sapiens
AAFEVKHFN

SEQ ID NO: 1348069 - protein, 9 aa, Homo Sapiens
KAQGVTIKF

SEQ ID NO: 1348070 - protein, 9 aa, Homo Sapiens
YALTSQFIN

SEQ ID NO: 1348071 - protein, 9 aa, Homo Sapiens
LTSKDVTLH

SEQ ID NO: 1348072 - protein, 9 aa, Homo Sapiens
GAVDEEGCM

SEQ ID NO: 1348073 - protein, 9 aa, Homo Sapiens
YDLGNTLEK

SEQ ID NO: 1348074 - protein, 9 aa, Homo Sapiens
LAMGNSSAE

SEQ ID NO: 1348075 - protein, 9 aa, Homo Sapiens
ITMQTVYVQ

SEQ ID NO: 1348076 - protein, 9 aa, Homo Sapiens
GVVLESEEM

SEQ ID NO: 1348077 - protein, 9 aa, Homo Sapiens
VASQLPHIF

SEQ ID NO: 1348078 - protein, 9 aa, Homo Sapiens
KADSYIEEL

SEQ ID NO: 1348079 - protein, 9 aa, Homo Sapiens
YYDMCWSCE

SEQ ID NO: 1348080 - protein, 9 aa, Homo Sapiens
RKCLHQEYG

SEQ ID NO: 1348081 - protein, 9 aa, Homo Sapiens
ARSPSTAAS

SEQ ID NO: 1348082 - protein, 9 aa, Homo Sapiens
CAIADLGLV

SEQ ID NO: 1348083 - protein, 9 aa, Homo Sapiens
RPEKRVTSY

SEQ ID NO: 1348084 - protein, 9 aa, Homo Sapiens
AVQAKVMRP

SEQ ID NO: 1348085 - protein, 9 aa, Homo Sapiens
KRKKKEMPE

SEQ ID NO: 1348086 - protein, 9 aa, Homo Sapiens
GEGGQFFSP

SEQ ID NO: 1348087 - protein, 9 aa, Homo Sapiens
ALGSITLLG

SEQ ID NO: 1348088 - protein, 9 aa, Homo Sapiens
TRETEWSFP

SEQ ID NO: 1348089 - protein, 9 aa, Homo Sapiens
PENVTLYQQ

SEQ ID NO: 1348090 - protein, 9 aa, Homo Sapiens
ENMVVPLMP

SEQ ID NO: 1348091 - protein, 9 aa, Homo Sapiens
CYREELRMR

SEQ ID NO: 1348092 - protein, 9 aa, Homo Sapiens
FQTHEMIHT

SEQ ID NO: 1348093 - protein, 9 aa, Homo Sapiens
VYHIISIGG

SEQ ID NO: 1348094 - protein, 9 aa, Homo Sapiens
PASSRHRGF

SEQ ID NO: 1348095 - protein, 9 aa, Homo Sapiens
KFSTEALRC

SEQ ID NO: 1348096 - protein, 9 aa, Homo Sapiens
ISRLVHERD

SEQ ID NO: 1348097 - protein, 9 aa, Homo Sapiens
RGAGPGGSQ

SEQ ID NO: 1348098 - protein, 9 aa, Homo Sapiens
NHIEMTWKC

SEQ ID NO: 1348099 - protein, 9 aa, Homo Sapiens
FEEMKHEER

SEQ ID NO: 1348100 - protein, 9 aa, Homo Sapiens
RRGTGLPWL

SEQ ID NO: 1348101 - protein, 9 aa, Homo Sapiens
CIPVGSRET

SEQ ID NO: 1348102 - protein, 9 aa, Homo Sapiens
ADYITAVYV

SEQ ID NO: 1348103 - protein, 9 aa, Homo Sapiens
DYEDKFSDT

SEQ ID NO: 1348104 - protein, 9 aa, Homo Sapiens
PNQALPGTI

SEQ ID NO: 1348105 - protein, 9 aa, Homo Sapiens
PAGLHTLLP

SEQ ID NO: 1348106 - protein, 9 aa, Homo Sapiens
VVKESTRAS

SEQ ID NO: 1348107 - protein, 9 aa, Homo Sapiens
LSNEQKVLV

SEQ ID NO: 1348108 - protein, 9 aa, Homo Sapiens
STRPQSPVG

SEQ ID NO: 1348109 - protein, 9 aa, Homo Sapiens
TRTYEPDSV

SEQ ID NO: 1348110 - protein, 9 aa, Homo Sapiens
HPRPFCMRH

SEQ ID NO: 1348111 - protein, 9 aa, Homo Sapiens
YMRCDHKME

SEQ ID NO: 1348112 - protein, 9 aa, Homo Sapiens
IIEENGQGM

SEQ ID NO: 1348113 - protein, 9 aa, Homo Sapiens
TQDFEEMKH

SEQ ID NO: 1348114 - protein, 9 aa, Homo Sapiens
LRTQQTPVA

SEQ ID NO: 1348115 - protein, 9 aa, Homo Sapiens
NTDALYVRG

SEQ ID NO: 1348116 - protein, 9 aa, Homo Sapiens
MKDRFSLPI

SEQ ID NO: 1348117 - protein, 9 aa, Homo Sapiens
QLWEFCLQW

SEQ ID NO: 1348118 - protein, 9 aa, Homo Sapiens
PFVPYSQIP

SEQ ID NO: 1348119 - protein, 9 aa, Homo Sapiens
PTRGTAEWM

SEQ ID NO: 1348120 - protein, 9 aa, Homo Sapiens
YRTALRSCS

SEQ ID NO: 1348121 - protein, 9 aa, Homo Sapiens
SLFCYSTHL

SEQ ID NO: 1348122 - protein, 9 aa, Homo Sapiens
QKSWEHQSV

SEQ ID NO: 1348123 - protein, 9 aa, Homo Sapiens
LEVITNCPK

SEQ ID NO: 1348124 - protein, 9 aa, Homo Sapiens
VSKTRLCRS

SEQ ID NO: 1348125 - protein, 9 aa, Homo Sapiens
SLPLWDDLC

SEQ ID NO: 1348126 - protein, 9 aa, Homo Sapiens
WQDLKDYMC

SEQ ID NO: 1348127 - protein, 9 aa, Homo Sapiens
ATFVTHVYA

SEQ ID NO: 1348128 - protein, 9 aa, Homo Sapiens
CCYVAFLPE

SEQ ID NO: 1348129 - protein, 9 aa, Homo Sapiens
NPVTKIIYG

SEQ ID NO: 1348130 - protein, 9 aa, Homo Sapiens
VQNMLNWAQ

SEQ ID NO: 1348131 - protein, 9 aa, Homo Sapiens
HIQSSRAFD

SEQ ID NO: 1348132 - protein, 9 aa, Homo Sapiens
EQLLQEPHL

SEQ ID NO: 1348133 - protein, 9 aa, Homo Sapiens
GSIVVIVFF

SEQ ID NO: 1348134 - protein, 9 aa, Homo Sapiens
TAAMCYEPA

SEQ ID NO: 1348135 - protein, 9 aa, Homo Sapiens
DENSTGNKR

SEQ ID NO: 1348136 - protein, 9 aa, Homo Sapiens
APTPLSMTC

SEQ ID NO: 1348137 - protein, 9 aa, Homo Sapiens
MYGAHMDSP

SEQ ID NO: 1348138 - protein, 9 aa, Homo Sapiens
QKLLRRVSH

SEQ ID NO: 1348139 - protein, 9 aa, Homo Sapiens
VVLCMDMGF

SEQ ID NO: 1348140 - protein, 9 aa, Homo Sapiens
VISSIVSCK

SEQ ID NO: 1348141 - protein, 9 aa, Homo Sapiens
FRYNTSFIH

SEQ ID NO: 1348142 - protein, 9 aa, Homo Sapiens
DYVGEDIVD

SEQ ID NO: 1348143 - protein, 9 aa, Homo Sapiens
IFLSVLWDP

SEQ ID NO: 1348144 - protein, 9 aa, Homo Sapiens
AAHQNNVGR

SEQ ID NO: 1348145 - protein, 9 aa, Homo Sapiens
LYFNSLMTY

SEQ ID NO: 1348146 - protein, 9 aa, Homo Sapiens
ATQVDMRVA

SEQ ID NO: 1348147 - protein, 9 aa, Homo Sapiens
PIHQTYIPV

SEQ ID NO: 1348148 - protein, 9 aa, Homo Sapiens
EVFVHRCLL

SEQ ID NO: 1348149 - protein, 9 aa, Homo Sapiens
RLREFIECR

SEQ ID NO: 1348150 - protein, 9 aa, Homo Sapiens
YRNSPSREL

SEQ ID NO: 1348151 - protein, 9 aa, Homo Sapiens
CVLSRMQHQ

SEQ ID NO: 1348152 - protein, 9 aa, Homo Sapiens
AVHMTHLLV

SEQ ID NO: 1348153 - protein, 9 aa, Homo Sapiens
DRTTISAGA

SEQ ID NO: 1348154 - protein, 9 aa, Homo Sapiens
TSHITVLEA

SEQ ID NO: 1348155 - protein, 9 aa, Homo Sapiens
RCLRMRPPR

SEQ ID NO: 1348156 - protein, 9 aa, Homo Sapiens
LGRKGQIWR

SEQ ID NO: 1348157 - protein, 9 aa, Homo Sapiens
IRKSTPGRS

SEQ ID NO: 1348158 - protein, 9 aa, Homo Sapiens
DDSGTFEVV

SEQ ID NO: 1348159 - protein, 9 aa, Homo Sapiens
WSGKAMERA

SEQ ID NO: 1348160 - protein, 9 aa, Homo Sapiens
NRFQNRVHE

SEQ ID NO: 1348161 - protein, 9 aa, Homo Sapiens
QCCTADMNI

SEQ ID NO: 1348162 - protein, 9 aa, Homo Sapiens
VVTLDKVPE

SEQ ID NO: 1348163 - protein, 9 aa, Homo Sapiens
KMLEYVLKQ

SEQ ID NO: 1348164 - protein, 9 aa, Homo Sapiens
LGMGQLLLW

SEQ ID NO: 1348165 - protein, 9 aa, Homo Sapiens
HLGAAVSRH

SEQ ID NO: 1348166 - protein, 9 aa, Homo Sapiens
CRRPTHLSV

SEQ ID NO: 1348167 - protein, 9 aa, Homo Sapiens
MKNCTEVTK

SEQ ID NO: 1348168 - protein, 9 aa, Homo Sapiens
PDAWLHALG

SEQ ID NO: 1348169 - protein, 9 aa, Homo Sapiens
QKHNDLIAQ

SEQ ID NO: 1348170 - protein, 9 aa, Homo Sapiens
EAATTMYFP

SEQ ID NO: 1348171 - protein, 9 aa, Homo Sapiens
LIDASEDIQ

SEQ ID NO: 1348172 - protein, 9 aa, Homo Sapiens
QRRPSQNVI

SEQ ID NO: 1348173 - protein, 9 aa, Homo Sapiens
ASAIDMMEL

SEQ ID NO: 1348174 - protein, 9 aa, Homo Sapiens
ASLYPTQRA

SEQ ID NO: 1348175 - protein, 9 aa, Homo Sapiens
KVAHMRLET

SEQ ID NO: 1348176 - protein, 9 aa, Homo Sapiens
VAKTTSEMV

SEQ ID NO: 1348177 - protein, 9 aa, Homo Sapiens
TETKDHAPQ

SEQ ID NO: 1348178 - protein, 9 aa, Homo Sapiens
VCHKLGNIS

SEQ ID NO: 1348179 - protein, 9 aa, Homo Sapiens
PPLPTRGHA

SEQ ID NO: 1348180 - protein, 9 aa, Homo Sapiens
IHYINPRTP

SEQ ID NO: 1348181 - protein, 9 aa, Homo Sapiens
FVNQLWYIH

SEQ ID NO: 1348182 - protein, 9 aa, Homo Sapiens
NIWVGDGDA

SEQ ID NO: 1348183 - protein, 9 aa, Homo Sapiens
NLVESLCSE

SEQ ID NO: 1348184 - protein, 9 aa, Homo Sapiens
TPVAAASGP

SEQ ID NO: 1348185 - protein, 9 aa, Homo Sapiens
FDEDTKIIR

SEQ ID NO: 1348186 - protein, 9 aa, Homo Sapiens
DLKEALIRY

SEQ ID NO: 1348187 - protein, 9 aa, Homo Sapiens
LQMSPCSEC

SEQ ID NO: 1348188 - protein, 9 aa, Homo Sapiens
WECKQCMLA

SEQ ID NO: 1348189 - protein, 9 aa, Homo Sapiens
SPTLHIGSV

SEQ ID NO: 1348190 - protein, 9 aa, Homo Sapiens
LEKQIWLCC

SEQ ID NO: 1348191 - protein, 9 aa, Homo Sapiens
CGVGVRKWS

SEQ ID NO: 1348192 - protein, 9 aa, Homo Sapiens
FNLSKSTQK

SEQ ID NO: 1348193 - protein, 9 aa, Homo Sapiens
EDPIIVMVL

SEQ ID NO: 1348194 - protein, 9 aa, Homo Sapiens
LLVLEPPVI

SEQ ID NO: 1348195 - protein, 9 aa, Homo Sapiens
PCEREKHNI

SEQ ID NO: 1348196 - protein, 9 aa, Homo Sapiens
VGDTSLHIF

SEQ ID NO: 1348197 - protein, 9 aa, Homo Sapiens
NQPSPHMTS

SEQ ID NO: 1348198 - protein, 9 aa, Homo Sapiens
QLMQSSGHS

SEQ ID NO: 1348199 - protein, 9 aa, Homo Sapiens
SPSQERKPM

SEQ ID NO: 1348200 - protein, 9 aa, Homo Sapiens
ETITEFLYI

SEQ ID NO: 1348201 - protein, 9 aa, Homo Sapiens
ICQNRARKY

SEQ ID NO: 1348202 - protein, 9 aa, Homo Sapiens
VLFIALTLV

SEQ ID NO: 1348203 - protein, 9 aa, Homo Sapiens
MIEVSDKDF

SEQ ID NO: 1348204 - protein, 9 aa, Homo Sapiens
WMGFPQGFP

SEQ ID NO: 1348205 - protein, 9 aa, Homo Sapiens
TVRSAACPT

SEQ ID NO: 1348206 - protein, 9 aa, Homo Sapiens
RHIAEVAKL

SEQ ID NO: 1348207 - protein, 9 aa, Homo Sapiens
WSLVQFHIP

SEQ ID NO: 1348208 - protein, 9 aa, Homo Sapiens
KFTIPDFKV

SEQ ID NO: 1348209 - protein, 9 aa, Homo Sapiens
DIDEEEDDD

SEQ ID NO: 1348210 - protein, 9 aa, Homo Sapiens
ASVRIHSSV

SEQ ID NO: 1348211 - protein, 9 aa, Homo Sapiens
HIFRLPNNW

SEQ ID NO: 1348212 - protein, 9 aa, Homo Sapiens
PLFMDRDSD

SEQ ID NO: 1348213 - protein, 9 aa, Homo Sapiens
CVSEKGGKV

SEQ ID NO: 1348214 - protein, 9 aa, Homo Sapiens
LHDPFGHGY

SEQ ID NO: 1348215 - protein, 9 aa, Homo Sapiens
CRALCACWP

SEQ ID NO: 1348216 - protein, 9 aa, Homo Sapiens
EEIEDPSVI

SEQ ID NO: 1348217 - protein, 9 aa, Homo Sapiens
NGCQDVHKN

SEQ ID NO: 1348218 - protein, 9 aa, Homo Sapiens
TTQLGAYCP

SEQ ID NO: 1348219 - protein, 9 aa, Homo Sapiens
PRGRHISVI

SEQ ID NO: 1348220 - protein, 9 aa, Homo Sapiens
DDMPKDAKY

SEQ ID NO: 1348221 - protein, 9 aa, Homo Sapiens
WAVPQVLQN

SEQ ID NO: 1348222 - protein, 9 aa, Homo Sapiens
SPCSECEVK

SEQ ID NO: 1348223 - protein, 9 aa, Homo Sapiens
WDSNGKRLN

SEQ ID NO: 1348224 - protein, 9 aa, Homo Sapiens
SSCGWAPFS

SEQ ID NO: 1348225 - protein, 9 aa, Homo Sapiens
IECQANQVS

SEQ ID NO: 1348226 - protein, 9 aa, Homo Sapiens
CSDCSYHDK

SEQ ID NO: 1348227 - protein, 9 aa, Homo Sapiens
VPSVCFRNI

SEQ ID NO: 1348228 - protein, 9 aa, Homo Sapiens
SALAKEERR

SEQ ID NO: 1348229 - protein, 9 aa, Homo Sapiens
EWVQCALHF

SEQ ID NO: 1348230 - protein, 9 aa, Homo Sapiens
FVTTKSSKN

SEQ ID NO: 1348231 - protein, 9 aa, Homo Sapiens
AGKAPSGTQ

SEQ ID NO: 1348232 - protein, 9 aa, Homo Sapiens
ASVSEKGTV

SEQ ID NO: 1348233 - protein, 9 aa, Homo Sapiens
MSNGYHTLS

SEQ ID NO: 1348234 - protein, 9 aa, Homo Sapiens
ALRLEATEM

SEQ ID NO: 1348235 - protein, 9 aa, Homo Sapiens
FSRFFDVWC

SEQ ID NO: 1348236 - protein, 9 aa, Homo Sapiens
TKFSYLGHD

SEQ ID NO: 1348237 - protein, 9 aa, Homo Sapiens
NIGALLRGS

SEQ ID NO: 1348238 - protein, 9 aa, Homo Sapiens
LNTNSISVF

SEQ ID NO: 1348239 - protein, 9 aa, Homo Sapiens
SRLSSGLVM

SEQ ID NO: 1348240 - protein, 9 aa, Homo Sapiens
EMSENECLG

SEQ ID NO: 1348241 - protein, 9 aa, Homo Sapiens
EYITHSCDV

SEQ ID NO: 1348242 - protein, 9 aa, Homo Sapiens
CQALPQVRL

SEQ ID NO: 1348243 - protein, 9 aa, Homo Sapiens
QLPRPKMTP

SEQ ID NO: 1348244 - protein, 9 aa, Homo Sapiens
AKQLKDGIS

SEQ ID NO: 1348245 - protein, 9 aa, Homo Sapiens
LLARDADLT

SEQ ID NO: 1348246 - protein, 9 aa, Homo Sapiens
LDVVCSFLH

SEQ ID NO: 1348247 - protein, 9 aa, Homo Sapiens
GHAWNTHHI

SEQ ID NO: 1348248 - protein, 9 aa, Homo Sapiens
SWNMGTILE

SEQ ID NO: 1348249 - protein, 9 aa, Homo Sapiens
VYSGVDEQL

SEQ ID NO: 1348250 - protein, 9 aa, Homo Sapiens
AAGPEEQAG

SEQ ID NO: 1348251 - protein, 9 aa, Homo Sapiens
QRRESLILQ

SEQ ID NO: 1348252 - protein, 9 aa, Homo Sapiens
YIVIAPNGA

SEQ ID NO: 1348253 - protein, 9 aa, Homo Sapiens
NTWMNDTVI

SEQ ID NO: 1348254 - protein, 9 aa, Homo Sapiens
CVGVGSFTD

SEQ ID NO: 1348255 - protein, 9 aa, Homo Sapiens
HLMSPRTGL

SEQ ID NO: 1348256 - protein, 9 aa, Homo Sapiens
QPRSVRYIL

SEQ ID NO: 1348257 - protein, 9 aa, Homo Sapiens
VIEDLVCGE

SEQ ID NO: 1348258 - protein, 9 aa, Homo Sapiens
ALLQTAQTE

SEQ ID NO: 1348259 - protein, 9 aa, Homo Sapiens
LIGTVPSDY

SEQ ID NO: 1348260 - protein, 9 aa, Homo Sapiens
SCTASNAQD

SEQ ID NO: 1348261 - protein, 9 aa, Homo Sapiens
RDCTPANWT

SEQ ID NO: 1348262 - protein, 9 aa, Homo Sapiens
DYDLPMDAD

SEQ ID NO: 1348263 - protein, 9 aa, Homo Sapiens
WRDYDQYYE

SEQ ID NO: 1348264 - protein, 9 aa, Homo Sapiens
AGAGNETAA

SEQ ID NO: 1348265 - protein, 9 aa, Homo Sapiens
NNLVLSCPY

SEQ ID NO: 1348266 - protein, 9 aa, Homo Sapiens
PTGDAFTLF

SEQ ID NO: 1348267 - protein, 9 aa, Homo Sapiens
HRIVAPGVR

SEQ ID NO: 1348268 - protein, 9 aa, Homo Sapiens
EENEKERLK

SEQ ID NO: 1348269 - protein, 9 aa, Homo Sapiens
SRLFQLKNG

SEQ ID NO: 1348270 - protein, 9 aa, Homo Sapiens
FSAAQHHSY

SEQ ID NO: 1348271 - protein, 9 aa, Homo Sapiens
DVLNSIENS

SEQ ID NO: 1348272 - protein, 9 aa, Homo Sapiens
DIYAKTLPP

SEQ ID NO: 1348273 - protein, 9 aa, Homo Sapiens
REFIECRPV

SEQ ID NO: 1348274 - protein, 9 aa, Homo Sapiens
PLTSSGHHE

SEQ ID NO: 1348275 - protein, 9 aa, Homo Sapiens
PSIHLYKEN

SEQ ID NO: 1348276 - protein, 9 aa, Homo Sapiens
SKVPHLHST

SEQ ID NO: 1348277 - protein, 9 aa, Homo Sapiens
PSEGPHKGL

SEQ ID NO: 1348278 - protein, 9 aa, Homo Sapiens
HCVTEECSV

SEQ ID NO: 1348279 - protein, 9 aa, Homo Sapiens
NKESLPELN

SEQ ID NO: 1348280 - protein, 9 aa, Homo Sapiens
LFQCVGIIP

SEQ ID NO: 1348281 - protein, 9 aa, Homo Sapiens
LSSDSENML

SEQ ID NO: 1348282 - protein, 9 aa, Homo Sapiens
PNAFSENHQ

SEQ ID NO: 1348283 - protein, 9 aa, Homo Sapiens
ATCVYITEI

SEQ ID NO: 1348284 - protein, 9 aa, Homo Sapiens
YSTSAFGFA

SEQ ID NO: 1348285 - protein, 9 aa, Homo Sapiens
ASTRPQSPV

SEQ ID NO: 1348286 - protein, 9 aa, Homo Sapiens
TCPTTWPPS

SEQ ID NO: 1348287 - protein, 9 aa, Homo Sapiens
LVPPSVPHC

SEQ ID NO: 1348288 - protein, 9 aa, Homo Sapiens
FNNCMKSVL

SEQ ID NO: 1348289 - protein, 9 aa, Homo Sapiens
SSSIPSVVR

SEQ ID NO: 1348290 - protein, 9 aa, Homo Sapiens
EVGSAAGGA

SEQ ID NO: 1348291 - protein, 9 aa, Homo Sapiens
EALRDGVKC

SEQ ID NO: 1348292 - protein, 9 aa, Homo Sapiens
PQKINNENA

SEQ ID NO: 1348293 - protein, 9 aa, Homo Sapiens
AHSAIFSVT

SEQ ID NO: 1348294 - protein, 9 aa, Homo Sapiens
FRSWGCVGT

SEQ ID NO: 1348295 - protein, 9 aa, Homo Sapiens
ESALFLHQN

SEQ ID NO: 1348296 - protein, 9 aa, Homo Sapiens
NLSILDRVN

SEQ ID NO: 1348297 - protein, 9 aa, Homo Sapiens
DHIPPAKKC

SEQ ID NO: 1348298 - protein, 9 aa, Homo Sapiens
SATTYKHDV

SEQ ID NO: 1348299 - protein, 9 aa, Homo Sapiens
LFNLLDEDK

SEQ ID NO: 1348300 - protein, 9 aa, Homo Sapiens
ANRGKDTND

SEQ ID NO: 1348301 - protein, 9 aa, Homo Sapiens
DVCFEHQFK

SEQ ID NO: 1348302 - protein, 9 aa, Homo Sapiens
TCLHKLKLC

SEQ ID NO: 1348303 - protein, 9 aa, Homo Sapiens
VAQNVLLCK

SEQ ID NO: 1348304 - protein, 9 aa, Homo Sapiens
MMHWLKGER

SEQ ID NO: 1348305 - protein, 9 aa, Homo Sapiens
KHLVECGSL

SEQ ID NO: 1348306 - protein, 9 aa, Homo Sapiens
AELVVFIYY

SEQ ID NO: 1348307 - protein, 9 aa, Homo Sapiens
STTSLCSRK

SEQ ID NO: 1348308 - protein, 9 aa, Homo Sapiens
KTHLDEART

SEQ ID NO: 1348309 - protein, 9 aa, Homo Sapiens
TIAPLQGPP

SEQ ID NO: 1348310 - protein, 9 aa, Homo Sapiens
GKQLTTAEK

SEQ ID NO: 1348311 - protein, 9 aa, Homo Sapiens
IGKPDMAYC

SEQ ID NO: 1348312 - protein, 9 aa, Homo Sapiens
AISGLISGL

SEQ ID NO: 1348313 - protein, 9 aa, Homo Sapiens
QRQAIKGVF

SEQ ID NO: 1348314 - protein, 9 aa, Homo Sapiens
EKIISYICS

SEQ ID NO: 1348315 - protein, 9 aa, Homo Sapiens
CWPDLQSHH

SEQ ID NO: 1348316 - protein, 9 aa, Homo Sapiens
AHKHNMCGE

SEQ ID NO: 1348317 - protein, 9 aa, Homo Sapiens
VWLLPGMGP

SEQ ID NO: 1348318 - protein, 9 aa, Homo Sapiens
KGEDLFPAS

SEQ ID NO: 1348319 - protein, 9 aa, Homo Sapiens
SSIIADRIT

SEQ ID NO: 1348320 - protein, 9 aa, Homo Sapiens
EDISGLHAT

SEQ ID NO: 1348321 - protein, 9 aa, Homo Sapiens
VEMDRVLME

SEQ ID NO: 1348322 - protein, 9 aa, Homo Sapiens
LQDVIGAVN

SEQ ID NO: 1348323 - protein, 9 aa, Homo Sapiens
LYTCQTCSV

SEQ ID NO: 1348324 - protein, 9 aa, Homo Sapiens
IPAKSSVPG

SEQ ID NO: 1348325 - protein, 9 aa, Homo Sapiens
PLCFFPRKG

SEQ ID NO: 1348326 - protein, 9 aa, Homo Sapiens
SLQSSVQQR

SEQ ID NO: 1348327 - protein, 9 aa, Homo Sapiens
DVSHAVGVL

SEQ ID NO: 1348328 - protein, 9 aa, Homo Sapiens
KMLCLRLPN

SEQ ID NO: 1348329 - protein, 9 aa, Homo Sapiens
LGPHSLEGA

SEQ ID NO: 1348330 - protein, 9 aa, Homo Sapiens
CDRCGKRFY

SEQ ID NO: 1348331 - protein, 9 aa, Homo Sapiens
IKICAQTEG

SEQ ID NO: 1348332 - protein, 9 aa, Homo Sapiens
TQHTSGQKL

SEQ ID NO: 1348333 - protein, 9 aa, Homo Sapiens
RPFCMRHVK

SEQ ID NO: 1348334 - protein, 9 aa, Homo Sapiens
RMKIEEMWR

SEQ ID NO: 1348335 - protein, 9 aa, Homo Sapiens
KKKNKELTL

SEQ ID NO: 1348336 - protein, 9 aa, Homo Sapiens
KKSGDSGRA

SEQ ID NO: 1348337 - protein, 9 aa, Homo Sapiens
ETAALFLAT

SEQ ID NO: 1348338 - protein, 9 aa, Homo Sapiens
FLRFMVSIL

SEQ ID NO: 1348339 - protein, 9 aa, Homo Sapiens
ATGIWGFVN

SEQ ID NO: 1348340 - protein, 9 aa, Homo Sapiens
VCVHQCLRL

SEQ ID NO: 1348341 - protein, 9 aa, Homo Sapiens
EIEWMVSII

SEQ ID NO: 1348342 - protein, 9 aa, Homo Sapiens
FFITPRQST

SEQ ID NO: 1348343 - protein, 9 aa, Homo Sapiens
GGRQFAQHP

SEQ ID NO: 1348344 - protein, 9 aa, Homo Sapiens
TWMCYNLQS

SEQ ID NO: 1348345 - protein, 9 aa, Homo Sapiens
TDPEVVVSS

SEQ ID NO: 1348346 - protein, 9 aa, Homo Sapiens
LVVGNYRLK

SEQ ID NO: 1348347 - protein, 9 aa, Homo Sapiens
IGCDNFGEL

SEQ ID NO: 1348348 - protein, 9 aa, Homo Sapiens
VDVTFRVTG

SEQ ID NO: 1348349 - protein, 9 aa, Homo Sapiens
LHCRNMLSQ

SEQ ID NO: 1348350 - protein, 9 aa, Homo Sapiens
VTVSHLDWT

SEQ ID NO: 1348351 - protein, 9 aa, Homo Sapiens
VVFIYYAVW

SEQ ID NO: 1348352 - protein, 9 aa, Homo Sapiens
AHLYSCLDH

SEQ ID NO: 1348353 - protein, 9 aa, Homo Sapiens
NFAKLFLRK

SEQ ID NO: 1348354 - protein, 9 aa, Homo Sapiens
CLLMVTFSI

SEQ ID NO: 1348355 - protein, 9 aa, Homo Sapiens
QEEVSWLRL

SEQ ID NO: 1348356 - protein, 9 aa, Homo Sapiens
TTTLKLILV

SEQ ID NO: 1348357 - protein, 9 aa, Homo Sapiens
RSGRGSLRK

SEQ ID NO: 1348358 - protein, 9 aa, Homo Sapiens
NAGSQLPFD

SEQ ID NO: 1348359 - protein, 9 aa, Homo Sapiens
LLNLSHGKQ

SEQ ID NO: 1348360 - protein, 9 aa, Homo Sapiens
PSTCSLPCR

SEQ ID NO: 1348361 - protein, 9 aa, Homo Sapiens
AAQNDQSPM

SEQ ID NO: 1348362 - protein, 9 aa, Homo Sapiens
AYGERYIAS

SEQ ID NO: 1348363 - protein, 9 aa, Homo Sapiens
RGSPFLKRG

SEQ ID NO: 1348364 - protein, 9 aa, Homo Sapiens
TLESGHPIN

SEQ ID NO: 1348365 - protein, 9 aa, Homo Sapiens
HEIRRYQKS

SEQ ID NO: 1348366 - protein, 9 aa, Homo Sapiens
SLVEIAGRL

SEQ ID NO: 1348367 - protein, 9 aa, Homo Sapiens
TFTWNNSKL

SEQ ID NO: 1348368 - protein, 9 aa, Homo Sapiens
TQVVKKVET

SEQ ID NO: 1348369 - protein, 9 aa, Homo Sapiens
DEDNKPDNE

SEQ ID NO: 1348370 - protein, 9 aa, Homo Sapiens
LACVSLLRQ

SEQ ID NO: 1348371 - protein, 9 aa, Homo Sapiens
CHQDIKPQN

SEQ ID NO: 1348372 - protein, 9 aa, Homo Sapiens
DGLLDTSCQ

SEQ ID NO: 1348373 - protein, 9 aa, Homo Sapiens
GMEVWWCAT

SEQ ID NO: 1348374 - protein, 9 aa, Homo Sapiens
EYFCDYTED

SEQ ID NO: 1348375 - protein, 9 aa, Homo Sapiens
LMEKSSKAL

SEQ ID NO: 1348376 - protein, 9 aa, Homo Sapiens
MVIGVIVPG

SEQ ID NO: 1348377 - protein, 9 aa, Homo Sapiens
QIACRCQAT

SEQ ID NO: 1348378 - protein, 9 aa, Homo Sapiens
QFMKHVHQG

SEQ ID NO: 1348379 - protein, 9 aa, Homo Sapiens
ATMCGQEST

SEQ ID NO: 1348380 - protein, 9 aa, Homo Sapiens
AFTNTATVT

SEQ ID NO: 1348381 - protein, 9 aa, Homo Sapiens
RFLIFGETN

SEQ ID NO: 1348382 - protein, 9 aa, Homo Sapiens
EERCRVEEQ

SEQ ID NO: 1348383 - protein, 9 aa, Homo Sapiens
SLHLLVADQ

SEQ ID NO: 1348384 - protein, 9 aa, Homo Sapiens
PHPHPREAL

SEQ ID NO: 1348385 - protein, 9 aa, Homo Sapiens
EASVSSKSD

SEQ ID NO: 1348386 - protein, 9 aa, Homo Sapiens
ITNVVEMVP

SEQ ID NO: 1348387 - protein, 9 aa, Homo Sapiens
QNMLNWAQA

SEQ ID NO: 1348388 - protein, 9 aa, Homo Sapiens
RLGRDTEGT

SEQ ID NO: 1348389 - protein, 9 aa, Homo Sapiens
QLCGRHKCN

SEQ ID NO: 1348390 - protein, 9 aa, Homo Sapiens
GVRPAPLIM

SEQ ID NO: 1348391 - protein, 9 aa, Homo Sapiens
VKLDAAGLH

SEQ ID NO: 1348392 - protein, 9 aa, Homo Sapiens
SKMFLSIHH

SEQ ID NO: 1348393 - protein, 9 aa, Homo Sapiens
QQPHHRVAC

SEQ ID NO: 1348394 - protein, 9 aa, Homo Sapiens
VISNILLAY

SEQ ID NO: 1348395 - protein, 9 aa, Homo Sapiens
LHGSECLCI

SEQ ID NO: 1348396 - protein, 9 aa, Homo Sapiens
AMAIIRIHS

SEQ ID NO: 1348397 - protein, 9 aa, Homo Sapiens
IQYFDLESY

SEQ ID NO: 1348398 - protein, 9 aa, Homo Sapiens
FKQQVSYKE

SEQ ID NO: 1348399 - protein, 9 aa, Homo Sapiens
SKLEEVNLN

SEQ ID NO: 1348400 - protein, 9 aa, Homo Sapiens
GSLRKWRPG

SEQ ID NO: 1348401 - protein, 9 aa, Homo Sapiens
HPREALQVP

SEQ ID NO: 1348402 - protein, 9 aa, Homo Sapiens
GTPDSKEKT

SEQ ID NO: 1348403 - protein, 9 aa, Homo Sapiens
VHRRSLDSL

SEQ ID NO: 1348404 - protein, 9 aa, Homo Sapiens
SATTGKIFE

SEQ ID NO: 1348405 - protein, 9 aa, Homo Sapiens
FNATLKEEM

SEQ ID NO: 1348406 - protein, 9 aa, Homo Sapiens
PGENGKITG

SEQ ID NO: 1348407 - protein, 9 aa, Homo Sapiens
EMDVSIKKM

SEQ ID NO: 1348408 - protein, 9 aa, Homo Sapiens
KVYCGQRMP

SEQ ID NO: 1348409 - protein, 9 aa, Homo Sapiens
EVDTDIHTL

SEQ ID NO: 1348410 - protein, 9 aa, Homo Sapiens
SATYRQHVQ

SEQ ID NO: 1348411 - protein, 9 aa, Homo Sapiens
QGLHLGTDT

SEQ ID NO: 1348412 - protein, 9 aa, Homo Sapiens
LLIKGNSVS

SEQ ID NO: 1348413 - protein, 9 aa, Homo Sapiens
VTRHRSRSR

SEQ ID NO: 1348414 - protein, 9 aa, Homo Sapiens
SFWSDFHRN

SEQ ID NO: 1348415 - protein, 9 aa, Homo Sapiens
IHTGEKHYE

SEQ ID NO: 1348416 - protein, 9 aa, Homo Sapiens
VTNDGISII

SEQ ID NO: 1348417 - protein, 9 aa, Homo Sapiens
SIVATANAL

SEQ ID NO: 1348418 - protein, 9 aa, Homo Sapiens
IFGLNVLLR

SEQ ID NO: 1348419 - protein, 9 aa, Homo Sapiens
KYQLEKEDT

SEQ ID NO: 1348420 - protein, 9 aa, Homo Sapiens
QEGNRLYHE

SEQ ID NO: 1348421 - protein, 9 aa, Homo Sapiens
TAQLLSKLD

SEQ ID NO: 1348422 - protein, 9 aa, Homo Sapiens
KRRKLGMQL

SEQ ID NO: 1348423 - protein, 9 aa, Homo Sapiens
FADSSYLLH

SEQ ID NO: 1348424 - protein, 9 aa, Homo Sapiens
WVSKLEEEL

SEQ ID NO: 1348425 - protein, 9 aa, Homo Sapiens
WSKLCHINS

SEQ ID NO: 1348426 - protein, 9 aa, Homo Sapiens
HRPSLYIIN

SEQ ID NO: 1348427 - protein, 9 aa, Homo Sapiens
VGTMLTYSL

SEQ ID NO: 1348428 - protein, 9 aa, Homo Sapiens
EDEAGTPYD

SEQ ID NO: 1348429 - protein, 9 aa, Homo Sapiens
HSALLHLLA

SEQ ID NO: 1348430 - protein, 9 aa, Homo Sapiens
LWVLARSSP

SEQ ID NO: 1348431 - protein, 9 aa, Homo Sapiens
ATYHAEGGW

SEQ ID NO: 1348432 - protein, 9 aa, Homo Sapiens
EFCRLYHRA

SEQ ID NO: 1348433 - protein, 9 aa, Homo Sapiens
FLWGGLTDR

SEQ ID NO: 1348434 - protein, 9 aa, Homo Sapiens
GSNDYGFYL

SEQ ID NO: 1348435 - protein, 9 aa, Homo Sapiens
QAVEWHVLP

SEQ ID NO: 1348436 - protein, 9 aa, Homo Sapiens
LTRVYGVIP

SEQ ID NO: 1348437 - protein, 9 aa, Homo Sapiens
CIVLTLVND

SEQ ID NO: 1348438 - protein, 9 aa, Homo Sapiens
FKIPKTQVS

SEQ ID NO: 1348439 - protein, 9 aa, Homo Sapiens
EHFSKYMPS

SEQ ID NO: 1348440 - protein, 9 aa, Homo Sapiens
QGFRHVSHS

SEQ ID NO: 1348441 - protein, 9 aa, Homo Sapiens
EEANTDLEV

SEQ ID NO: 1348442 - protein, 9 aa, Homo Sapiens
TDFRKDSKN

SEQ ID NO: 1348443 - protein, 9 aa, Homo Sapiens
SNIHDYYWN

SEQ ID NO: 1348444 - protein, 9 aa, Homo Sapiens
KVTGIESHS

SEQ ID NO: 1348445 - protein, 9 aa, Homo Sapiens
DCRQLARML

SEQ ID NO: 1348446 - protein, 9 aa, Homo Sapiens
EEEEPPPSA

SEQ ID NO: 1348447 - protein, 9 aa, Homo Sapiens
DNCFLLCKP

SEQ ID NO: 1348448 - protein, 9 aa, Homo Sapiens
PKAKATMNV

SEQ ID NO: 1348449 - protein, 9 aa, Homo Sapiens
EEPAEVRHC

SEQ ID NO: 1348450 - protein, 9 aa, Homo Sapiens
MSLARAVYS

SEQ ID NO: 1348451 - protein, 9 aa, Homo Sapiens
EELIDLCQK

SEQ ID NO: 1348452 - protein, 9 aa, Homo Sapiens
KQTLEGKAG

SEQ ID NO: 1348453 - protein, 9 aa, Homo Sapiens
LCMPQSVFL

SEQ ID NO: 1348454 - protein, 9 aa, Homo Sapiens
VQKEEVRQD

SEQ ID NO: 1348455 - protein, 9 aa, Homo Sapiens
VMAEALQME

SEQ ID NO: 1348456 - protein, 9 aa, Homo Sapiens
LQSINNYNP

SEQ ID NO: 1348457 - protein, 9 aa, Homo Sapiens
CTALSVRPD

SEQ ID NO: 1348458 - protein, 9 aa, Homo Sapiens
ACQYVLSNQ

SEQ ID NO: 1348459 - protein, 9 aa, Homo Sapiens
ANRHILLSS

SEQ ID NO: 1348460 - protein, 9 aa, Homo Sapiens
EHQSVSLKS

SEQ ID NO: 1348461 - protein, 9 aa, Homo Sapiens
TGCPASSRH

SEQ ID NO: 1348462 - protein, 9 aa, Homo Sapiens
EEAKSLNAC

SEQ ID NO: 1348463 - protein, 9 aa, Homo Sapiens
PKNKHKLRK

SEQ ID NO: 1348464 - protein, 9 aa, Homo Sapiens
APLHYAGEI

SEQ ID NO: 1348465 - protein, 9 aa, Homo Sapiens
LLLYQEGTK

SEQ ID NO: 1348466 - protein, 9 aa, Homo Sapiens
GHDIHTILS

SEQ ID NO: 1348467 - protein, 9 aa, Homo Sapiens
CGWDNLLAV

SEQ ID NO: 1348468 - protein, 9 aa, Homo Sapiens
MSEHPSQSV

SEQ ID NO: 1348469 - protein, 9 aa, Homo Sapiens
DVVVLDHVY

SEQ ID NO: 1348470 - protein, 9 aa, Homo Sapiens
LLAAEHIQV

SEQ ID NO: 1348471 - protein, 9 aa, Homo Sapiens
VVSKWVGIP

SEQ ID NO: 1348472 - protein, 9 aa, Homo Sapiens
SRRCWARCC

SEQ ID NO: 1348473 - protein, 9 aa, Homo Sapiens
AARFRATFV

SEQ ID NO: 1348474 - protein, 9 aa, Homo Sapiens
VHTAEKLCK

SEQ ID NO: 1348475 - protein, 9 aa, Homo Sapiens
VAEGTGAEL

SEQ ID NO: 1348476 - protein, 9 aa, Homo Sapiens
RPVPPLTPC

SEQ ID NO: 1348477 - protein, 9 aa, Homo Sapiens
MATVAKLCE

SEQ ID NO: 1348478 - protein, 9 aa, Homo Sapiens
PKWKNYELR

SEQ ID NO: 1348479 - protein, 9 aa, Homo Sapiens
GGKETLKDI

SEQ ID NO: 1348480 - protein, 9 aa, Homo Sapiens
WSCGEKTVS

SEQ ID NO: 1348481 - protein, 9 aa, Homo Sapiens
KKKPSVMPA

SEQ ID NO: 1348482 - protein, 9 aa, Homo Sapiens
KVGDTRSIL

SEQ ID NO: 1348483 - protein, 9 aa, Homo Sapiens
FPCNCWVSI

SEQ ID NO: 1348484 - protein, 9 aa, Homo Sapiens
EAADGYQCC

SEQ ID NO: 1348485 - protein, 9 aa, Homo Sapiens
ALLCHLCKK

SEQ ID NO: 1348486 - protein, 9 aa, Homo Sapiens
SAVDSWGLG

SEQ ID NO: 1348487 - protein, 9 aa, Homo Sapiens
SALRSLHFL

SEQ ID NO: 1348488 - protein, 9 aa, Homo Sapiens
HPKYALWRT

SEQ ID NO: 1348489 - protein, 9 aa, Homo Sapiens
NGNTGTSPY

SEQ ID NO: 1348490 - protein, 9 aa, Homo Sapiens
VTFHSPYWM

SEQ ID NO: 1348491 - protein, 9 aa, Homo Sapiens
PEIFTMHQQ

SEQ ID NO: 1348492 - protein, 9 aa, Homo Sapiens
ADFKDALTR

SEQ ID NO: 1348493 - protein, 9 aa, Homo Sapiens
VDLRECFAY

SEQ ID NO: 1348494 - protein, 9 aa, Homo Sapiens
TSYSQIPRC

SEQ ID NO: 1348495 - protein, 9 aa, Homo Sapiens
SYQSISHPH

SEQ ID NO: 1348496 - protein, 9 aa, Homo Sapiens
STSMDTPPD

SEQ ID NO: 1348497 - protein, 9 aa, Homo Sapiens
LAHFLIKLE

SEQ ID NO: 1348498 - protein, 9 aa, Homo Sapiens
HKHNMCGET

SEQ ID NO: 1348499 - protein, 9 aa, Homo Sapiens
QSYNLTQQW

SEQ ID NO: 1348500 - protein, 9 aa, Homo Sapiens
RVTHLTGIH

SEQ ID NO: 1348501 - protein, 9 aa, Homo Sapiens
GPLSDPITD

SEQ ID NO: 1348502 - protein, 9 aa, Homo Sapiens
DTVAYACNT

SEQ ID NO: 1348503 - protein, 9 aa, Homo Sapiens
DDFVADGAL

SEQ ID NO: 1348504 - protein, 9 aa, Homo Sapiens
PALQPFPVP

SEQ ID NO: 1348505 - protein, 9 aa, Homo Sapiens
NGDGTVYFD

SEQ ID NO: 1348506 - protein, 9 aa, Homo Sapiens
PQCTFFFLH

SEQ ID NO: 1348507 - protein, 9 aa, Homo Sapiens
SIEGKDCIA

SEQ ID NO: 1348508 - protein, 9 aa, Homo Sapiens
RHVKTHNGV

SEQ ID NO: 1348509 - protein, 9 aa, Homo Sapiens
EAKIVMEKL

SEQ ID NO: 1348510 - protein, 9 aa, Homo Sapiens
SRAQRMSLW

SEQ ID NO: 1348511 - protein, 9 aa, Homo Sapiens
LEQLWRTAM

SEQ ID NO: 1348512 - protein, 9 aa, Homo Sapiens
CLEDHTWVP

SEQ ID NO: 1348513 - protein, 9 aa, Homo Sapiens
VSAAESAGP

SEQ ID NO: 1348514 - protein, 9 aa, Homo Sapiens
VCYGADHDL

SEQ ID NO: 1348515 - protein, 9 aa, Homo Sapiens
MLNVTLLRS

SEQ ID NO: 1348516 - protein, 9 aa, Homo Sapiens
DLQLLFVFE

SEQ ID NO: 1348517 - protein, 9 aa, Homo Sapiens
HFIGNWWSG

SEQ ID NO: 1348518 - protein, 9 aa, Homo Sapiens
LYNKFIILF

SEQ ID NO: 1348519 - protein, 9 aa, Homo Sapiens
SEKERLEVQ

SEQ ID NO: 1348520 - protein, 9 aa, Homo Sapiens
LPTLLMIWF

SEQ ID NO: 1348521 - protein, 9 aa, Homo Sapiens
TSSLPWLCI

SEQ ID NO: 1348522 - protein, 9 aa, Homo Sapiens
KGLLRRYHQ

SEQ ID NO: 1348523 - protein, 9 aa, Homo Sapiens
TAFSWIMGS

SEQ ID NO: 1348524 - protein, 9 aa, Homo Sapiens
ESPRSHFEQ

SEQ ID NO: 1348525 - protein, 9 aa, Homo Sapiens
RCTKFTLLQ

SEQ ID NO: 1348526 - protein, 9 aa, Homo Sapiens
LDHIKAHGD

SEQ ID NO: 1348527 - protein, 9 aa, Homo Sapiens
YAHYSGSYN

SEQ ID NO: 1348528 - protein, 9 aa, Homo Sapiens
LAKKARGKS

SEQ ID NO: 1348529 - protein, 9 aa, Homo Sapiens
VTVGGHPGL

SEQ ID NO: 1348530 - protein, 9 aa, Homo Sapiens
EKTFAEAHL

SEQ ID NO: 1348531 - protein, 9 aa, Homo Sapiens
GGHEPRSCP

SEQ ID NO: 1348532 - protein, 9 aa, Homo Sapiens
TNQKICKTF

SEQ ID NO: 1348533 - protein, 9 aa, Homo Sapiens
VTPTTFSEC

SEQ ID NO: 1348534 - protein, 9 aa, Homo Sapiens
YVVWKCCED

SEQ ID NO: 1348535 - protein, 9 aa, Homo Sapiens
QAGATPWNI

SEQ ID NO: 1348536 - protein, 9 aa, Homo Sapiens
PWCVAKMVK

SEQ ID NO: 1348537 - protein, 9 aa, Homo Sapiens
HPDTPPNIY

SEQ ID NO: 1348538 - protein, 9 aa, Homo Sapiens
QAHSSYLAS

SEQ ID NO: 1348539 - protein, 9 aa, Homo Sapiens
YFTFYIIMK

SEQ ID NO: 1348540 - protein, 9 aa, Homo Sapiens
LTHRRKLWA

SEQ ID NO: 1348541 - protein, 9 aa, Homo Sapiens
KVISEELDH

SEQ ID NO: 1348542 - protein, 9 aa, Homo Sapiens
DPAGLHTLL

SEQ ID NO: 1348543 - protein, 9 aa, Homo Sapiens
SRNPSATPC

SEQ ID NO: 1348544 - protein, 9 aa, Homo Sapiens
AAHHHENSS

SEQ ID NO: 1348545 - protein, 9 aa, Homo Sapiens
TRHSALHLA

SEQ ID NO: 1348546 - protein, 9 aa, Homo Sapiens
TYQIGTTAN

SEQ ID NO: 1348547 - protein, 9 aa, Homo Sapiens
STAPDGTAL

SEQ ID NO: 1348548 - protein, 9 aa, Homo Sapiens
MLGFPTSAI

SEQ ID NO: 1348549 - protein, 9 aa, Homo Sapiens
CNHTSGLIT

SEQ ID NO: 1348550 - protein, 9 aa, Homo Sapiens
SGLITTGYN

SEQ ID NO: 1348551 - protein, 9 aa, Homo Sapiens
SGTTGTPKC

SEQ ID NO: 1348552 - protein, 9 aa, Homo Sapiens
LHQIHANHE

SEQ ID NO: 1348553 - protein, 9 aa, Homo Sapiens
PDNPERFDN

SEQ ID NO: 1348554 - protein, 9 aa, Homo Sapiens
LVTDEHDTI

SEQ ID NO: 1348555 - protein, 9 aa, Homo Sapiens
KTCTKEPGT

SEQ ID NO: 1348556 - protein, 9 aa, Homo Sapiens
ESQYVPAFW

SEQ ID NO: 1348557 - protein, 9 aa, Homo Sapiens
SKKPQGDDN

SEQ ID NO: 1348558 - protein, 9 aa, Homo Sapiens
KHHYIACVS

SEQ ID NO: 1348559 - protein, 9 aa, Homo Sapiens
PDAKGEPGE

SEQ ID NO: 1348560 - protein, 9 aa, Homo Sapiens
NQCTGKCSA

SEQ ID NO: 1348561 - protein, 9 aa, Homo Sapiens
LVKDIRQSY

SEQ ID NO: 1348562 - protein, 9 aa, Homo Sapiens
DADSYDPGE

SEQ ID NO: 1348563 - protein, 9 aa, Homo Sapiens
VKEPHLRFT

SEQ ID NO: 1348564 - protein, 9 aa, Homo Sapiens
HQVLTRIGV

SEQ ID NO: 1348565 - protein, 9 aa, Homo Sapiens
HTQDLTPAM

SEQ ID NO: 1348566 - protein, 9 aa, Homo Sapiens
CRSLSRSIS

SEQ ID NO: 1348567 - protein, 9 aa, Homo Sapiens
LHLGTDTLR

SEQ ID NO: 1348568 - protein, 9 aa, Homo Sapiens
AARCFLMVC

SEQ ID NO: 1348569 - protein, 9 aa, Homo Sapiens
KLHLLRHQR

SEQ ID NO: 1348570 - protein, 9 aa, Homo Sapiens
HNDNGDLLP

SEQ ID NO: 1348571 - protein, 9 aa, Homo Sapiens
SLLIDTLLK

SEQ ID NO: 1348572 - protein, 9 aa, Homo Sapiens
SWRQNDKPP

SEQ ID NO: 1348573 - protein, 9 aa, Homo Sapiens
FLDIYFSEL

SEQ ID NO: 1348574 - protein, 9 aa, Homo Sapiens
KSVHYIEEL

SEQ ID NO: 1348575 - protein, 9 aa, Homo Sapiens
VEDALNLKD

SEQ ID NO: 1348576 - protein, 9 aa, Homo Sapiens
WRLCRTFDK

SEQ ID NO: 1348577 - protein, 9 aa, Homo Sapiens
QILTDEDWN

SEQ ID NO: 1348578 - protein, 9 aa, Homo Sapiens
VRPNSWPWQ

SEQ ID NO: 1348579 - protein, 9 aa, Homo Sapiens
SHSMVRTGE

SEQ ID NO: 1348580 - protein, 9 aa, Homo Sapiens
LHFRHENVI

SEQ ID NO: 1348581 - protein, 9 aa, Homo Sapiens
LGPPGPVGP

SEQ ID NO: 1348582 - protein, 9 aa, Homo Sapiens
KHQHFGYVQ

SEQ ID NO: 1348583 - protein, 9 aa, Homo Sapiens
SSHHLDAVA

SEQ ID NO: 1348584 - protein, 9 aa, Homo Sapiens
RGGSGDPFH

SEQ ID NO: 1348585 - protein, 9 aa, Homo Sapiens
ETINEVSKL

SEQ ID NO: 1348586 - protein, 9 aa, Homo Sapiens
APPTSLQRS

SEQ ID NO: 1348587 - protein, 9 aa, Homo Sapiens
ERYLEEEDT

SEQ ID NO: 1348588 - protein, 9 aa, Homo Sapiens
KELHHFEKL

SEQ ID NO: 1348589 - protein, 9 aa, Homo Sapiens
IVERIPQGP

SEQ ID NO: 1348590 - protein, 9 aa, Homo Sapiens
LCMDMGFTM

SEQ ID NO: 1348591 - protein, 9 aa, Homo Sapiens
FHGMLLPGI

SEQ ID NO: 1348592 - protein, 9 aa, Homo Sapiens
AEVWAAAAH

SEQ ID NO: 1348593 - protein, 9 aa, Homo Sapiens
KRMAVDLHR

SEQ ID NO: 1348594 - protein, 9 aa, Homo Sapiens
KQLLHRKSK

SEQ ID NO: 1348595 - protein, 9 aa, Homo Sapiens
GKPFNHFSY

SEQ ID NO: 1348596 - protein, 9 aa, Homo Sapiens
TISSLSKVV

SEQ ID NO: 1348597 - protein, 9 aa, Homo Sapiens
SVEMLVDCV

SEQ ID NO: 1348598 - protein, 9 aa, Homo Sapiens
KMRAILCIE

SEQ ID NO: 1348599 - protein, 9 aa, Homo Sapiens
ILATCLSGA

SEQ ID NO: 1348600 - protein, 9 aa, Homo Sapiens
EFVDFTPQC

SEQ ID NO: 1348601 - protein, 9 aa, Homo Sapiens
PPWKSSAVP

SEQ ID NO: 1348602 - protein, 9 aa, Homo Sapiens
HISSRLNLL

SEQ ID NO: 1348603 - protein, 9 aa, Homo Sapiens
VTSQRFMVQ

SEQ ID NO: 1348604 - protein, 9 aa, Homo Sapiens
AHTTFEGAL

SEQ ID NO: 1348605 - protein, 9 aa, Homo Sapiens
PEAAQMVHR

SEQ ID NO: 1348606 - protein, 9 aa, Homo Sapiens
HPLKFTEKP

SEQ ID NO: 1348607 - protein, 9 aa, Homo Sapiens
LVSIVATAN

SEQ ID NO: 1348608 - protein, 9 aa, Homo Sapiens
DEAMLQKCI

SEQ ID NO: 1348609 - protein, 9 aa, Homo Sapiens
IHNLDQLRF

SEQ ID NO: 1348610 - protein, 9 aa, Homo Sapiens
KEPQAVFYV

SEQ ID NO: 1348611 - protein, 9 aa, Homo Sapiens
VLLPAADWH

SEQ ID NO: 1348612 - protein, 9 aa, Homo Sapiens
CEKEDYLHL

SEQ ID NO: 1348613 - protein, 9 aa, Homo Sapiens
AHVVLEVVV

SEQ ID NO: 1348614 - protein, 9 aa, Homo Sapiens
DKKDIPVRT

SEQ ID NO: 1348615 - protein, 9 aa, Homo Sapiens
PINLTCSVP

SEQ ID NO: 1348616 - protein, 9 aa, Homo Sapiens
VGATTTQHY

SEQ ID NO: 1348617 - protein, 9 aa, Homo Sapiens
HCTHCLCTV

SEQ ID NO: 1348618 - protein, 9 aa, Homo Sapiens
AFITFQEKS

SEQ ID NO: 1348619 - protein, 9 aa, Homo Sapiens
LSYLAGQVS

SEQ ID NO: 1348620 - protein, 9 aa, Homo Sapiens
SSLIAHVHQ

SEQ ID NO: 1348621 - protein, 9 aa, Homo Sapiens
SVTDFYGQI

SEQ ID NO: 1348622 - protein, 9 aa, Homo Sapiens
AFANGRFTG

SEQ ID NO: 1348623 - protein, 9 aa, Homo Sapiens
RMVIGVIVP

SEQ ID NO: 1348624 - protein, 9 aa, Homo Sapiens
FTMTRTMVP

SEQ ID NO: 1348625 - protein, 9 aa, Homo Sapiens
AFKAIEKPR

SEQ ID NO: 1348626 - protein, 9 aa, Homo Sapiens
YVRHLTGEV

SEQ ID NO: 1348627 - protein, 9 aa, Homo Sapiens
SAACPTASR

SEQ ID NO: 1348628 - protein, 9 aa, Homo Sapiens
QLVILLMSE

SEQ ID NO: 1348629 - protein, 9 aa, Homo Sapiens
YSQIPRCQP

SEQ ID NO: 1348630 - protein, 9 aa, Homo Sapiens
EEGNDQSEN

SEQ ID NO: 1348631 - protein, 9 aa, Homo Sapiens
PHCSEMVPG

SEQ ID NO: 1348632 - protein, 9 aa, Homo Sapiens
VSVMSAPAS

SEQ ID NO: 1348633 - protein, 9 aa, Homo Sapiens
QKRKGFVCT

SEQ ID NO: 1348634 - protein, 9 aa, Homo Sapiens
MKSSLENSL

SEQ ID NO: 1348635 - protein, 9 aa, Homo Sapiens
EDREENVRH

SEQ ID NO: 1348636 - protein, 9 aa, Homo Sapiens
QFAGKAPSG

SEQ ID NO: 1348637 - protein, 9 aa, Homo Sapiens
GLLLLLLPS

SEQ ID NO: 1348638 - protein, 9 aa, Homo Sapiens
YQKYWLNFY

SEQ ID NO: 1348639 - protein, 9 aa, Homo Sapiens
PKDEHILQF

SEQ ID NO: 1348640 - protein, 9 aa, Homo Sapiens
REVRSRVSI

SEQ ID NO: 1348641 - protein, 9 aa, Homo Sapiens
ANFKLKYGW

SEQ ID NO: 1348642 - protein, 9 aa, Homo Sapiens
RSNYETLIS

SEQ ID NO: 1348643 - protein, 9 aa, Homo Sapiens
REKGSKEHH

SEQ ID NO: 1348644 - protein, 9 aa, Homo Sapiens
SLENTKPQV

SEQ ID NO: 1348645 - protein, 9 aa, Homo Sapiens
WIYPEGTHN

SEQ ID NO: 1348646 - protein, 9 aa, Homo Sapiens
CRQLARMLV

SEQ ID NO: 1348647 - protein, 9 aa, Homo Sapiens
MDVSIKKMK

SEQ ID NO: 1348648 - protein, 9 aa, Homo Sapiens
HSFTDVIFD

SEQ ID NO: 1348649 - protein, 9 aa, Homo Sapiens
PTTKTTDDE

SEQ ID NO: 1348650 - protein, 9 aa, Homo Sapiens
MRTKSDTSC

SEQ ID NO: 1348651 - protein, 9 aa, Homo Sapiens
ETDALVGSH

SEQ ID NO: 1348652 - protein, 9 aa, Homo Sapiens
NSISVFQVI

SEQ ID NO: 1348653 - protein, 9 aa, Homo Sapiens
CTYNQVQTC

SEQ ID NO: 1348654 - protein, 9 aa, Homo Sapiens
FRVKWLVVV

SEQ ID NO: 1348655 - protein, 9 aa, Homo Sapiens
EGLFRIPGQ

SEQ ID NO: 1348656 - protein, 9 aa, Homo Sapiens
QLGIVNTSI

SEQ ID NO: 1348657 - protein, 9 aa, Homo Sapiens
ENYVSRPHR

SEQ ID NO: 1348658 - protein, 9 aa, Homo Sapiens
VIHCKGGTD

SEQ ID NO: 1348659 - protein, 9 aa, Homo Sapiens
VSEKGGKVL

SEQ ID NO: 1348660 - protein, 9 aa, Homo Sapiens
RFPRVFLSP

SEQ ID NO: 1348661 - protein, 9 aa, Homo Sapiens
ATPCRKLCH

SEQ ID NO: 1348662 - protein, 9 aa, Homo Sapiens
IMGSMDAII

SEQ ID NO: 1348663 - protein, 9 aa, Homo Sapiens
RCVSILCYK

SEQ ID NO: 1348664 - protein, 9 aa, Homo Sapiens
IAVFWCLLM

SEQ ID NO: 1348665 - protein, 9 aa, Homo Sapiens
FQYFRELFG

SEQ ID NO: 1348666 - protein, 9 aa, Homo Sapiens
CHTYVRCTH

SEQ ID NO: 1348667 - protein, 9 aa, Homo Sapiens
HARVDAHVV

SEQ ID NO: 1348668 - protein, 9 aa, Homo Sapiens
FFFFLFPDS

SEQ ID NO: 1348669 - protein, 9 aa, Homo Sapiens
QRANLVESL

SEQ ID NO: 1348670 - protein, 9 aa, Homo Sapiens
QKPRVYEFA

SEQ ID NO: 1348671 - protein, 9 aa, Homo Sapiens
CTYTFGKEV

SEQ ID NO: 1348672 - protein, 9 aa, Homo Sapiens
TSFRLERAQ

SEQ ID NO: 1348673 - protein, 9 aa, Homo Sapiens
LTQLWATVV

SEQ ID NO: 1348674 - protein, 9 aa, Homo Sapiens
PSQNRKCLY

SEQ ID NO: 1348675 - protein, 9 aa, Homo Sapiens
HVSDHKHHP

SEQ ID NO: 1348676 - protein, 9 aa, Homo Sapiens
SRHRPLPAA

SEQ ID NO: 1348677 - protein, 9 aa, Homo Sapiens
TGTSPYRLR

SEQ ID NO: 1348678 - protein, 9 aa, Homo Sapiens
SMSPPPGMM

SEQ ID NO: 1348679 - protein, 9 aa, Homo Sapiens
VLVGYNTIL

SEQ ID NO: 1348680 - protein, 9 aa, Homo Sapiens
DRAGRMGGR

SEQ ID NO: 1348681 - protein, 9 aa, Homo Sapiens
QRRLPLRAI

SEQ ID NO: 1348682 - protein, 9 aa, Homo Sapiens
CDDPHFQDS

SEQ ID NO: 1348683 - protein, 9 aa, Homo Sapiens
PVYPVALSM

SEQ ID NO: 1348684 - protein, 9 aa, Homo Sapiens
VVQGLMRLA

SEQ ID NO: 1348685 - protein, 9 aa, Homo Sapiens
NLSLHTSVW

SEQ ID NO: 1348686 - protein, 9 aa, Homo Sapiens
TTLLPPLRF

SEQ ID NO: 1348687 - protein, 9 aa, Homo Sapiens
DNPERFDNQ

SEQ ID NO: 1348688 - protein, 9 aa, Homo Sapiens
DACKLMRER

SEQ ID NO: 1348689 - protein, 9 aa, Homo Sapiens
SEPGNSSDA

SEQ ID NO: 1348690 - protein, 9 aa, Homo Sapiens
SVTYCVGDA

SEQ ID NO: 1348691 - protein, 9 aa, Homo Sapiens
HGELGGHPI

SEQ ID NO: 1348692 - protein, 9 aa, Homo Sapiens
VTSDSYEAA

SEQ ID NO: 1348693 - protein, 9 aa, Homo Sapiens
FNKPIALPH

SEQ ID NO: 1348694 - protein, 9 aa, Homo Sapiens
ISVFQVIRC

SEQ ID NO: 1348695 - protein, 9 aa, Homo Sapiens
NGTQQVFYN

SEQ ID NO: 1348696 - protein, 9 aa, Homo Sapiens
VTVLHDSKI

SEQ ID NO: 1348697 - protein, 9 aa, Homo Sapiens
VEIDDNFLL

SEQ ID NO: 1348698 - protein, 9 aa, Homo Sapiens
KYYILWPEV

SEQ ID NO: 1348699 - protein, 9 aa, Homo Sapiens
RRHMQSINA

SEQ ID NO: 1348700 - protein, 9 aa, Homo Sapiens
MEKCTALSV

SEQ ID NO: 1348701 - protein, 9 aa, Homo Sapiens
RDDQCPAGP

SEQ ID NO: 1348702 - protein, 9 aa, Homo Sapiens
PAPSLGSYS

SEQ ID NO: 1348703 - protein, 9 aa, Homo Sapiens
AFITFANLL

SEQ ID NO: 1348704 - protein, 9 aa, Homo Sapiens
AFKLHINKT

SEQ ID NO: 1348705 - protein, 9 aa, Homo Sapiens
EKMGHFQVR

SEQ ID NO: 1348706 - protein, 9 aa, Homo Sapiens
AQASKHIPE

SEQ ID NO: 1348707 - protein, 9 aa, Homo Sapiens
AFYGPAVII

SEQ ID NO: 1348708 - protein, 9 aa, Homo Sapiens
WPRLPGVGL

SEQ ID NO: 1348709 - protein, 9 aa, Homo Sapiens
SGEDFIFHP

SEQ ID NO: 1348710 - protein, 9 aa, Homo Sapiens
LKNVVAVGT

SEQ ID NO: 1348711 - protein, 9 aa, Homo Sapiens
EKTHHLHGK

SEQ ID NO: 1348712 - protein, 9 aa, Homo Sapiens
CVTIMPKDI

SEQ ID NO: 1348713 - protein, 9 aa, Homo Sapiens
VPSEVPSPM

SEQ ID NO: 1348714 - protein, 9 aa, Homo Sapiens
KQYLTYHCR

SEQ ID NO: 1348715 - protein, 9 aa, Homo Sapiens
GATYTPRHP

SEQ ID NO: 1348716 - protein, 9 aa, Homo Sapiens
EKELHTWEE

SEQ ID NO: 1348717 - protein, 9 aa, Homo Sapiens
PATYHAEGG

SEQ ID NO: 1348718 - protein, 9 aa, Homo Sapiens
SLSEYSPNS

SEQ ID NO: 1348719 - protein, 9 aa, Homo Sapiens
GCLRWMRQE

SEQ ID NO: 1348720 - protein, 9 aa, Homo Sapiens
SAEFVDFTP

SEQ ID NO: 1348721 - protein, 9 aa, Homo Sapiens
DNRPLSPIL

SEQ ID NO: 1348722 - protein, 9 aa, Homo Sapiens
TGVPDLIQV

SEQ ID NO: 1348723 - protein, 9 aa, Homo Sapiens
PVDIDGSNV

SEQ ID NO: 1348724 - protein, 9 aa, Homo Sapiens
ADETTAKTQ

SEQ ID NO: 1348725 - protein, 9 aa, Homo Sapiens
LVTEMVISM

SEQ ID NO: 1348726 - protein, 9 aa, Homo Sapiens
GHDMLASFL

SEQ ID NO: 1348727 - protein, 9 aa, Homo Sapiens
SEDFLIILP

SEQ ID NO: 1348728 - protein, 9 aa, Homo Sapiens
FKCVQKDSQ

SEQ ID NO: 1348729 - protein, 9 aa, Homo Sapiens
GCRSLSRSI

SEQ ID NO: 1348730 - protein, 9 aa, Homo Sapiens
VPREGLSRH

SEQ ID NO: 1348731 - protein, 9 aa, Homo Sapiens
MSYPMHSVQ

SEQ ID NO: 1348732 - protein, 9 aa, Homo Sapiens
CVSEDKHIS

SEQ ID NO: 1348733 - protein, 9 aa, Homo Sapiens
AGRANGEIL

SEQ ID NO: 1348734 - protein, 9 aa, Homo Sapiens
RDLNLMVLV

SEQ ID NO: 1348735 - protein, 9 aa, Homo Sapiens
FQIHPTLLW

SEQ ID NO: 1348736 - protein, 9 aa, Homo Sapiens
VCKELHHFE

SEQ ID NO: 1348737 - protein, 9 aa, Homo Sapiens
THYLYIAPI

SEQ ID NO: 1348738 - protein, 9 aa, Homo Sapiens
TEEGLFRIP

SEQ ID NO: 1348739 - protein, 9 aa, Homo Sapiens
ILNARVQAP

SEQ ID NO: 1348740 - protein, 9 aa, Homo Sapiens
YSRHRVHFQ

SEQ ID NO: 1348741 - protein, 9 aa, Homo Sapiens
TLFACEELA

SEQ ID NO: 1348742 - protein, 9 aa, Homo Sapiens
HSVQHRHFR

SEQ ID NO: 1348743 - protein, 9 aa, Homo Sapiens
LEERFRVVI

SEQ ID NO: 1348744 - protein, 9 aa, Homo Sapiens
VPEGDPCWT

SEQ ID NO: 1348745 - protein, 9 aa, Homo Sapiens
FKLGNKVKK

SEQ ID NO: 1348746 - protein, 9 aa, Homo Sapiens
VRVTVQAHV

SEQ ID NO: 1348747 - protein, 9 aa, Homo Sapiens
ISSVNSLVE

SEQ ID NO: 1348748 - protein, 9 aa, Homo Sapiens
EDRRREDPT

SEQ ID NO: 1348749 - protein, 9 aa, Homo Sapiens
RPVSRHLVS

SEQ ID NO: 1348750 - protein, 9 aa, Homo Sapiens
SSGRRQWQS

SEQ ID NO: 1348751 - protein, 9 aa, Homo Sapiens
SAASAEGFS

SEQ ID NO: 1348752 - protein, 9 aa, Homo Sapiens
KRKHGKSLY

SEQ ID NO: 1348753 - protein, 9 aa, Homo Sapiens
IATCVYITE

SEQ ID NO: 1348754 - protein, 9 aa, Homo Sapiens
DNVPTFTQT

SEQ ID NO: 1348755 - protein, 9 aa, Homo Sapiens
DQIDKLTLK

SEQ ID NO: 1348756 - protein, 9 aa, Homo Sapiens
LWLATWLGI

SEQ ID NO: 1348757 - protein, 9 aa, Homo Sapiens
LRLDLAGWE

SEQ ID NO: 1348758 - protein, 9 aa, Homo Sapiens
CLSGYLRET

SEQ ID NO: 1348759 - protein, 9 aa, Homo Sapiens
FITLVFFLY

SEQ ID NO: 1348760 - protein, 9 aa, Homo Sapiens
FATGDLGNT

SEQ ID NO: 1348761 - protein, 9 aa, Homo Sapiens
AKQAVHCMH

SEQ ID NO: 1348762 - protein, 9 aa, Homo Sapiens
APSTKEHHV

SEQ ID NO: 1348763 - protein, 9 aa, Homo Sapiens
MYATSQYMW

SEQ ID NO: 1348764 - protein, 9 aa, Homo Sapiens
KFTVSQYVQ

SEQ ID NO: 1348765 - protein, 9 aa, Homo Sapiens
LRLDDNHIS

SEQ ID NO: 1348766 - protein, 9 aa, Homo Sapiens
FVDYDNKSH

SEQ ID NO: 1348767 - protein, 9 aa, Homo Sapiens
LANIRKCTD

SEQ ID NO: 1348768 - protein, 9 aa, Homo Sapiens
KREDDEKHI

SEQ ID NO: 1348769 - protein, 9 aa, Homo Sapiens
MPAAVTGPD

SEQ ID NO: 1348770 - protein, 9 aa, Homo Sapiens
AVKVVIDAE

SEQ ID NO: 1348771 - protein, 9 aa, Homo Sapiens
DLPVSCTSF

SEQ ID NO: 1348772 - protein, 9 aa, Homo Sapiens
EVQLEAILS

SEQ ID NO: 1348773 - protein, 9 aa, Homo Sapiens
ITNHTFMLA

SEQ ID NO: 1348774 - protein, 9 aa, Homo Sapiens
SLMSHVIEL

SEQ ID NO: 1348775 - protein, 9 aa, Homo Sapiens
VTGIESHSE

SEQ ID NO: 1348776 - protein, 9 aa, Homo Sapiens
LRQGVPQAQ

SEQ ID NO: 1348777 - protein, 9 aa, Homo Sapiens
PRVSSAVKV

SEQ ID NO: 1348778 - protein, 9 aa, Homo Sapiens
GMELQSWCP

SEQ ID NO: 1348779 - protein, 9 aa, Homo Sapiens
TLFDVDGIF

SEQ ID NO: 1348780 - protein, 9 aa, Homo Sapiens
VLYNNANGT

SEQ ID NO: 1348781 - protein, 9 aa, Homo Sapiens
NPVQQPGHI

SEQ ID NO: 1348782 - protein, 9 aa, Homo Sapiens
MRLMPKFLN

SEQ ID NO: 1348783 - protein, 9 aa, Homo Sapiens
WRLSSIKRD

SEQ ID NO: 1348784 - protein, 9 aa, Homo Sapiens
WGSTAGGCR

SEQ ID NO: 1348785 - protein, 9 aa, Homo Sapiens
PHEMSALWF

SEQ ID NO: 1348786 - protein, 9 aa, Homo Sapiens
TLRIRQDPN

SEQ ID NO: 1348787 - protein, 9 aa, Homo Sapiens
VYSLLRICA

SEQ ID NO: 1348788 - protein, 9 aa, Homo Sapiens
EAELQKYSV

SEQ ID NO: 1348789 - protein, 9 aa, Homo Sapiens
FYVHIKHAP

SEQ ID NO: 1348790 - protein, 9 aa, Homo Sapiens
VMRPLRSCD

SEQ ID NO: 1348791 - protein, 9 aa, Homo Sapiens
PGCGWRFSC

SEQ ID NO: 1348792 - protein, 9 aa, Homo Sapiens
TYIPLQINS

SEQ ID NO: 1348793 - protein, 9 aa, Homo Sapiens
QLGEQQRLI

SEQ ID NO: 1348794 - protein, 9 aa, Homo Sapiens
TLDGHSGQC

SEQ ID NO: 1348795 - protein, 9 aa, Homo Sapiens
VEQITNVQI

SEQ ID NO: 1348796 - protein, 9 aa, Homo Sapiens
FQHHDLIEE

SEQ ID NO: 1348797 - protein, 9 aa, Homo Sapiens
NGNSDNKDL

SEQ ID NO: 1348798 - protein, 9 aa, Homo Sapiens
SLAPLGYPF

SEQ ID NO: 1348799 - protein, 9 aa, Homo Sapiens
NQRLCCTLV

SEQ ID NO: 1348800 - protein, 9 aa, Homo Sapiens
PLKRKQHRS

SEQ ID NO: 1348801 - protein, 9 aa, Homo Sapiens
IVANTMSTH

SEQ ID NO: 1348802 - protein, 9 aa, Homo Sapiens
FLGKDKKFL

SEQ ID NO: 1348803 - protein, 9 aa, Homo Sapiens
QAENSQSRR

SEQ ID NO: 1348804 - protein, 9 aa, Homo Sapiens
GPMTKHPGK

SEQ ID NO: 1348805 - protein, 9 aa, Homo Sapiens
VAVWGLSKG

SEQ ID NO: 1348806 - protein, 9 aa, Homo Sapiens
SRLMWLLWL

SEQ ID NO: 1348807 - protein, 9 aa, Homo Sapiens
KGVWKPPLV

SEQ ID NO: 1348808 - protein, 9 aa, Homo Sapiens
LVCAGYEAF

SEQ ID NO: 1348809 - protein, 9 aa, Homo Sapiens
LKYVHLHEL

SEQ ID NO: 1348810 - protein, 9 aa, Homo Sapiens
KRRRTRVQG

SEQ ID NO: 1348811 - protein, 9 aa, Homo Sapiens
RHCSTFQMS

SEQ ID NO: 1348812 - protein, 9 aa, Homo Sapiens
CMLRLGQMD

SEQ ID NO: 1348813 - protein, 9 aa, Homo Sapiens
MRTQVRGIK

SEQ ID NO: 1348814 - protein, 9 aa, Homo Sapiens
EEVQHLRFE

SEQ ID NO: 1348815 - protein, 9 aa, Homo Sapiens
HFRLWQGWC

SEQ ID NO: 1348816 - protein, 9 aa, Homo Sapiens
KCGRPSGTT

SEQ ID NO: 1348817 - protein, 9 aa, Homo Sapiens
MVPMNQSQV

SEQ ID NO: 1348818 - protein, 9 aa, Homo Sapiens
LAMIYDDQG

SEQ ID NO: 1348819 - protein, 9 aa, Homo Sapiens
CIWAVAWVI

SEQ ID NO: 1348820 - protein, 9 aa, Homo Sapiens
KYYNVPVAD

SEQ ID NO: 1348821 - protein, 9 aa, Homo Sapiens
EARKDLRVK

SEQ ID NO: 1348822 - protein, 9 aa, Homo Sapiens
PAVSEAFVK

SEQ ID NO: 1348823 - protein, 9 aa, Homo Sapiens
SHDNAFFKD

SEQ ID NO: 1348824 - protein, 9 aa, Homo Sapiens
KTPKEKDTE

SEQ ID NO: 1348825 - protein, 9 aa, Homo Sapiens
GVSLVRVCG

SEQ ID NO: 1348826 - protein, 9 aa, Homo Sapiens
MAFDRFMAI

SEQ ID NO: 1348827 - protein, 9 aa, Homo Sapiens
CTGKCSACN

SEQ ID NO: 1348828 - protein, 9 aa, Homo Sapiens
ISAFASEPR

SEQ ID NO: 1348829 - protein, 9 aa, Homo Sapiens
GLISGLCYD

SEQ ID NO: 1348830 - protein, 9 aa, Homo Sapiens
DPFGHGYGE

SEQ ID NO: 1348831 - protein, 9 aa, Homo Sapiens
LHRPGSGQH

SEQ ID NO: 1348832 - protein, 9 aa, Homo Sapiens
HIQAEVEAQ

SEQ ID NO: 1348833 - protein, 9 aa, Homo Sapiens
IWLKQEWID

SEQ ID NO: 1348834 - protein, 9 aa, Homo Sapiens
GKVRCGVEP

SEQ ID NO: 1348835 - protein, 9 aa, Homo Sapiens
TTITSRLQL

SEQ ID NO: 1348836 - protein, 9 aa, Homo Sapiens
AAPAPEWCH

SEQ ID NO: 1348837 - protein, 9 aa, Homo Sapiens
LIVSHSSTL

SEQ ID NO: 1348838 - protein, 9 aa, Homo Sapiens
LTSIKGTSL

SEQ ID NO: 1348839 - protein, 9 aa, Homo Sapiens
SLSQEAWHP

SEQ ID NO: 1348840 - protein, 9 aa, Homo Sapiens
DVGHCPVKT

SEQ ID NO: 1348841 - protein, 9 aa, Homo Sapiens
IFGETNQGC

SEQ ID NO: 1348842 - protein, 9 aa, Homo Sapiens
DIMTFANSP

SEQ ID NO: 1348843 - protein, 9 aa, Homo Sapiens
PEQVTAFQE

SEQ ID NO: 1348844 - protein, 9 aa, Homo Sapiens
DVHKNSTKA

SEQ ID NO: 1348845 - protein, 9 aa, Homo Sapiens
SPCIHCLRP

SEQ ID NO: 1348846 - protein, 9 aa, Homo Sapiens
HKKKSVWQR

SEQ ID NO: 1348847 - protein, 9 aa, Homo Sapiens
TDEKMGKNS

SEQ ID NO: 1348848 - protein, 9 aa, Homo Sapiens
GATPYNSHT

SEQ ID NO: 1348849 - protein, 9 aa, Homo Sapiens
KKCDEEIEA

SEQ ID NO: 1348850 - protein, 9 aa, Homo Sapiens
QSPSPTPVP

SEQ ID NO: 1348851 - protein, 9 aa, Homo Sapiens
EVVTPTTFS

SEQ ID NO: 1348852 - protein, 9 aa, Homo Sapiens
SMDSWNRKL

SEQ ID NO: 1348853 - protein, 9 aa, Homo Sapiens
MTQVVKKVE

SEQ ID NO: 1348854 - protein, 9 aa, Homo Sapiens
ASSCAASAG

SEQ ID NO: 1348855 - protein, 9 aa, Homo Sapiens
GDRGPLGLS

SEQ ID NO: 1348856 - protein, 9 aa, Homo Sapiens
LNKFGCRPP

SEQ ID NO: 1348857 - protein, 9 aa, Homo Sapiens
RLAAELEDC

SEQ ID NO: 1348858 - protein, 9 aa, Homo Sapiens
VSRRSSTPS

SEQ ID NO: 1348859 - protein, 9 aa, Homo Sapiens
WGGGHPLDL

SEQ ID NO: 1348860 - protein, 9 aa, Homo Sapiens
GHLQVRLVL

SEQ ID NO: 1348861 - protein, 9 aa, Homo Sapiens
MHSVQHRHF

SEQ ID NO: 1348862 - protein, 9 aa, Homo Sapiens
RRRKCPHAH

SEQ ID NO: 1348863 - protein, 9 aa, Homo Sapiens
PLFKLYIVM

SEQ ID NO: 1348864 - protein, 9 aa, Homo Sapiens
QSLNSSSSS

SEQ ID NO: 1348865 - protein, 9 aa, Homo Sapiens
GQTGSGQHS

SEQ ID NO: 1348866 - protein, 9 aa, Homo Sapiens
QLVLPGEAD

SEQ ID NO: 1348867 - protein, 9 aa, Homo Sapiens
SIDTVRVIF

SEQ ID NO: 1348868 - protein, 9 aa, Homo Sapiens
SIWIFFFFL

SEQ ID NO: 1348869 - protein, 9 aa, Homo Sapiens
ELFQCVGII

SEQ ID NO: 1348870 - protein, 9 aa, Homo Sapiens
ANKLKKMCA

SEQ ID NO: 1348871 - protein, 9 aa, Homo Sapiens
PHHSQKMSQ

SEQ ID NO: 1348872 - protein, 9 aa, Homo Sapiens
ENDQQVTEI

SEQ ID NO: 1348873 - protein, 9 aa, Homo Sapiens
PAVIAHPGC

SEQ ID NO: 1348874 - protein, 9 aa, Homo Sapiens
SNPVTKIIY

SEQ ID NO: 1348875 - protein, 9 aa, Homo Sapiens
GMKDTAELL

SEQ ID NO: 1348876 - protein, 9 aa, Homo Sapiens
IKKTFDAES

SEQ ID NO: 1348877 - protein, 9 aa, Homo Sapiens
DEYPILSLS

SEQ ID NO: 1348878 - protein, 9 aa, Homo Sapiens
MCLVLIIYN

SEQ ID NO: 1348879 - protein, 9 aa, Homo Sapiens
MCEKWILAA

SEQ ID NO: 1348880 - protein, 9 aa, Homo Sapiens
IEFPGGKGT

SEQ ID NO: 1348881 - protein, 9 aa, Homo Sapiens
DNITQIEDV

SEQ ID NO: 1348882 - protein, 9 aa, Homo Sapiens
WPALDPSSP

SEQ ID NO: 1348883 - protein, 9 aa, Homo Sapiens
IFHILVPGN

SEQ ID NO: 1348884 - protein, 9 aa, Homo Sapiens
IVVKDSEGN

SEQ ID NO: 1348885 - protein, 9 aa, Homo Sapiens
YGFFKRART

SEQ ID NO: 1348886 - protein, 9 aa, Homo Sapiens
GNFNLLHGK

SEQ ID NO: 1348887 - protein, 9 aa, Homo Sapiens
GPAVIITLV

SEQ ID NO: 1348888 - protein, 9 aa, Homo Sapiens
VISVETPQD

SEQ ID NO: 1348889 - protein, 9 aa, Homo Sapiens
PPEPHFTLD

SEQ ID NO: 1348890 - protein, 9 aa, Homo Sapiens
YEKFVEWMR

SEQ ID NO: 1348891 - protein, 9 aa, Homo Sapiens
TTYKHDVLT

SEQ ID NO: 1348892 - protein, 9 aa, Homo Sapiens
LVPKYHPLG

SEQ ID NO: 1348893 - protein, 9 aa, Homo Sapiens
KIKSSVSHK

SEQ ID NO: 1348894 - protein, 9 aa, Homo Sapiens
PLWCHYFQN

SEQ ID NO: 1348895 - protein, 9 aa, Homo Sapiens
HLEIDDIYT

SEQ ID NO: 1348896 - protein, 9 aa, Homo Sapiens
SEAMTHGCF

SEQ ID NO: 1348897 - protein, 9 aa, Homo Sapiens
PVGDVGLGV

SEQ ID NO: 1348898 - protein, 9 aa, Homo Sapiens
IPECPPLAS

SEQ ID NO: 1348899 - protein, 9 aa, Homo Sapiens
CSPERARPS

SEQ ID NO: 1348900 - protein, 9 aa, Homo Sapiens
FFDVWCQQR

SEQ ID NO: 1348901 - protein, 9 aa, Homo Sapiens
TQYYDMCWS

SEQ ID NO: 1348902 - protein, 9 aa, Homo Sapiens
DMMDVDMYI

SEQ ID NO: 1348903 - protein, 9 aa, Homo Sapiens
AKGDIYAKT

SEQ ID NO: 1348904 - protein, 9 aa, Homo Sapiens
TFGPTFQAE

SEQ ID NO: 1348905 - protein, 9 aa, Homo Sapiens
STWKDDMND

SEQ ID NO: 1348906 - protein, 9 aa, Homo Sapiens
LNHPPMGIP

SEQ ID NO: 1348907 - protein, 9 aa, Homo Sapiens
HLVECGSLF

SEQ ID NO: 1348908 - protein, 9 aa, Homo Sapiens
TVRGCYEAV

SEQ ID NO: 1348909 - protein, 9 aa, Homo Sapiens
QKQDKDNTM

SEQ ID NO: 1348910 - protein, 9 aa, Homo Sapiens
LFFPSCTYI

SEQ ID NO: 1348911 - protein, 9 aa, Homo Sapiens
GRHMGIGKW

SEQ ID NO: 1348912 - protein, 9 aa, Homo Sapiens
HMENYNIFN

SEQ ID NO: 1348913 - protein, 9 aa, Homo Sapiens
QLEKVMTEA

SEQ ID NO: 1348914 - protein, 9 aa, Homo Sapiens
DGEKEVRLI

SEQ ID NO: 1348915 - protein, 9 aa, Homo Sapiens
HAIHSHHTI

SEQ ID NO: 1348916 - protein, 9 aa, Homo Sapiens
VGGTQEVEI

SEQ ID NO: 1348917 - protein, 9 aa, Homo Sapiens
FVHRYCDAI

SEQ ID NO: 1348918 - protein, 9 aa, Homo Sapiens
MCTRKRRKM

SEQ ID NO: 1348919 - protein, 9 aa, Homo Sapiens
MWKLLSAAG

SEQ ID NO: 1348920 - protein, 9 aa, Homo Sapiens
HNGASCFSG

SEQ ID NO: 1348921 - protein, 9 aa, Homo Sapiens
VCRKLNEVI

SEQ ID NO: 1348922 - protein, 9 aa, Homo Sapiens
SILPYLALP

SEQ ID NO: 1348923 - protein, 9 aa, Homo Sapiens
TFVEVKPGH

SEQ ID NO: 1348924 - protein, 9 aa, Homo Sapiens
DTVAESENI

SEQ ID NO: 1348925 - protein, 9 aa, Homo Sapiens
LRTRTQLRN

SEQ ID NO: 1348926 - protein, 9 aa, Homo Sapiens
DTSGHFRKI

SEQ ID NO: 1348927 - protein, 9 aa, Homo Sapiens
LNACVSHIS

SEQ ID NO: 1348928 - protein, 9 aa, Homo Sapiens
SVASGSETV

SEQ ID NO: 1348929 - protein, 9 aa, Homo Sapiens
QVMIMVSGF

SEQ ID NO: 1348930 - protein, 9 aa, Homo Sapiens
VATRTVSSS

SEQ ID NO: 1348931 - protein, 9 aa, Homo Sapiens
TVMAIGTHS

SEQ ID NO: 1348932 - protein, 9 aa, Homo Sapiens
FELKKAMIM

SEQ ID NO: 1348933 - protein, 9 aa, Homo Sapiens
CLTVIVVLM

SEQ ID NO: 1348934 - protein, 9 aa, Homo Sapiens
RSYYHNSVG

SEQ ID NO: 1348935 - protein, 9 aa, Homo Sapiens
CYKFCKQVL

SEQ ID NO: 1348936 - protein, 9 aa, Homo Sapiens
IRKCTDRQN

SEQ ID NO: 1348937 - protein, 9 aa, Homo Sapiens
RRLWKKSPT

SEQ ID NO: 1348938 - protein, 9 aa, Homo Sapiens
VSADGHPGA

SEQ ID NO: 1348939 - protein, 9 aa, Homo Sapiens
MRKQKTINC

SEQ ID NO: 1348940 - protein, 9 aa, Homo Sapiens
RLVHKEAVS

SEQ ID NO: 1348941 - protein, 9 aa, Homo Sapiens
DGFCLFFTS

SEQ ID NO: 1348942 - protein, 9 aa, Homo Sapiens
TPKLLPAGH

SEQ ID NO: 1348943 - protein, 9 aa, Homo Sapiens
TSRKQRKEH

SEQ ID NO: 1348944 - protein, 9 aa, Homo Sapiens
LLCSPLRLS

SEQ ID NO: 1348945 - protein, 9 aa, Homo Sapiens
TREVIHLAQ

SEQ ID NO: 1348946 - protein, 9 aa, Homo Sapiens
SVQGQPLKV

SEQ ID NO: 1348947 - protein, 9 aa, Homo Sapiens
ESLPALHSK

SEQ ID NO: 1348948 - protein, 9 aa, Homo Sapiens
MSTMNIDRN

SEQ ID NO: 1348949 - protein, 9 aa, Homo Sapiens
GERCCLRTF

SEQ ID NO: 1348950 - protein, 9 aa, Homo Sapiens
TPPGRSLPA

SEQ ID NO: 1348951 - protein, 9 aa, Homo Sapiens
ERRALACVS

SEQ ID NO: 1348952 - protein, 9 aa, Homo Sapiens
CNVVKSKHG

SEQ ID NO: 1348953 - protein, 9 aa, Homo Sapiens
QRNSSLLMF

SEQ ID NO: 1348954 - protein, 9 aa, Homo Sapiens
KSKVPHLHS

SEQ ID NO: 1348955 - protein, 9 aa, Homo Sapiens
VCDEAAGRY

SEQ ID NO: 1348956 - protein, 9 aa, Homo Sapiens
MIQADTFHH

SEQ ID NO: 1348957 - protein, 9 aa, Homo Sapiens
EYHGAEKEW

SEQ ID NO: 1348958 - protein, 9 aa, Homo Sapiens
MLEVLDGFF

SEQ ID NO: 1348959 - protein, 9 aa, Homo Sapiens
LRGPMDSND

SEQ ID NO: 1348960 - protein, 9 aa, Homo Sapiens
HLWRPDVKV

SEQ ID NO: 1348961 - protein, 9 aa, Homo Sapiens
GVIVVGFPA

SEQ ID NO: 1348962 - protein, 9 aa, Homo Sapiens
FLLIFRKVA

SEQ ID NO: 1348963 - protein, 9 aa, Homo Sapiens
IFNHPEFEE

SEQ ID NO: 1348964 - protein, 9 aa, Homo Sapiens
DLRRGHYLT

SEQ ID NO: 1348965 - protein, 9 aa, Homo Sapiens
MILHRRIHT

SEQ ID NO: 1348966 - protein, 9 aa, Homo Sapiens
ILVDGEEAS

SEQ ID NO: 1348967 - protein, 9 aa, Homo Sapiens
QTHSLILIT

SEQ ID NO: 1348968 - protein, 9 aa, Homo Sapiens
ISSKTGISL

SEQ ID NO: 1348969 - protein, 9 aa, Homo Sapiens
FCHECGTKC

SEQ ID NO: 1348970 - protein, 9 aa, Homo Sapiens
RVPHQVQGR

SEQ ID NO: 1348971 - protein, 9 aa, Homo Sapiens
NKIFTIPLE

SEQ ID NO: 1348972 - protein, 9 aa, Homo Sapiens
LFFSSVISD

SEQ ID NO: 1348973 - protein, 9 aa, Homo Sapiens
YRHIVESDV

SEQ ID NO: 1348974 - protein, 9 aa, Homo Sapiens
PLLMYTCLL

SEQ ID NO: 1348975 - protein, 9 aa, Homo Sapiens
SLPTYFSPY

SEQ ID NO: 1348976 - protein, 9 aa, Homo Sapiens
VWDQLLEAS

SEQ ID NO: 1348977 - protein, 9 aa, Homo Sapiens
MMDSSQILT

SEQ ID NO: 1348978 - protein, 9 aa, Homo Sapiens
WLLYNLEME

SEQ ID NO: 1348979 - protein, 9 aa, Homo Sapiens
SSHLLTVSV

SEQ ID NO: 1348980 - protein, 9 aa, Homo Sapiens
PSFEGYREP

SEQ ID NO: 1348981 - protein, 9 aa, Homo Sapiens
MSFASVHIG

SEQ ID NO: 1348982 - protein, 9 aa, Homo Sapiens
PEELIEHVT

SEQ ID NO: 1348983 - protein, 9 aa, Homo Sapiens
DHIQHHLVE

SEQ ID NO: 1348984 - protein, 9 aa, Homo Sapiens
HPKAEAVFF

SEQ ID NO: 1348985 - protein, 9 aa, Homo Sapiens
RTRCTKFTL

SEQ ID NO: 1348986 - protein, 9 aa, Homo Sapiens
GRVQSILRE

SEQ ID NO: 1348987 - protein, 9 aa, Homo Sapiens
ALDIDECHL

SEQ ID NO: 1348988 - protein, 9 aa, Homo Sapiens
AEKLCKSEE

SEQ ID NO: 1348989 - protein, 9 aa, Homo Sapiens
RDADLTTEA

SEQ ID NO: 1348990 - protein, 9 aa, Homo Sapiens
CELQEEVSW

SEQ ID NO: 1348991 - protein, 9 aa, Homo Sapiens
CLSFVFFQG

SEQ ID NO: 1348992 - protein, 9 aa, Homo Sapiens
DCYIEYVIR

SEQ ID NO: 1348993 - protein, 9 aa, Homo Sapiens
EHKNRMKKV

SEQ ID NO: 1348994 - protein, 9 aa, Homo Sapiens
IAYIIGRRK

SEQ ID NO: 1348995 - protein, 9 aa, Homo Sapiens
QITEEVWDQ

SEQ ID NO: 1348996 - protein, 9 aa, Homo Sapiens
FIVDKLNAK

SEQ ID NO: 1348997 - protein, 9 aa, Homo Sapiens
FLSPKARSG

SEQ ID NO: 1348998 - protein, 9 aa, Homo Sapiens
TVLHHLGHP

SEQ ID NO: 1348999 - protein, 9 aa, Homo Sapiens
TPGPGPHLS

SEQ ID NO: 1349000 - protein, 9 aa, Homo Sapiens
MIINYGKKC

SEQ ID NO: 1349001 - protein, 9 aa, Homo Sapiens
KNDFVFLLH

SEQ ID NO: 1349002 - protein, 9 aa, Homo Sapiens
DLMRHQEEL

SEQ ID NO: 1349003 - protein, 9 aa, Homo Sapiens
KTHSHIPLH

SEQ ID NO: 1349004 - protein, 9 aa, Homo Sapiens
GSEAPALPK

SEQ ID NO: 1349005 - protein, 9 aa, Homo Sapiens
SHAGKAVLR

SEQ ID NO: 1349006 - protein, 9 aa, Homo Sapiens
TIIPPTSIS

SEQ ID NO: 1349007 - protein, 9 aa, Homo Sapiens
YPLWEVWAP

SEQ ID NO: 1349008 - protein, 9 aa, Homo Sapiens
NGHKGLQIF

SEQ ID NO: 1349009 - protein, 9 aa, Homo Sapiens
FRSHNLMDR

SEQ ID NO: 1349010 - protein, 9 aa, Homo Sapiens
LGIFNHIPP

SEQ ID NO: 1349011 - protein, 9 aa, Homo Sapiens
TLAALTSPT

SEQ ID NO: 1349012 - protein, 9 aa, Homo Sapiens
WSLTLSPGW

SEQ ID NO: 1349013 - protein, 9 aa, Homo Sapiens
ETREAHEAA

SEQ ID NO: 1349014 - protein, 9 aa, Homo Sapiens
QFFSPKEKD

SEQ ID NO: 1349015 - protein, 9 aa, Homo Sapiens
IIKDNMAQE

SEQ ID NO: 1349016 - protein, 9 aa, Homo Sapiens
SREHVYSHT

SEQ ID NO: 1349017 - protein, 9 aa, Homo Sapiens
EDGLTTPAQ

SEQ ID NO: 1349018 - protein, 9 aa, Homo Sapiens
VPSPGIAGP

SEQ ID NO: 1349019 - protein, 9 aa, Homo Sapiens
AVYVEMRRE

SEQ ID NO: 1349020 - protein, 9 aa, Homo Sapiens
CMDSIKENK

SEQ ID NO: 1349021 - protein, 9 aa, Homo Sapiens
IDDREESFR

SEQ ID NO: 1349022 - protein, 9 aa, Homo Sapiens
AFEKLQTTI

SEQ ID NO: 1349023 - protein, 9 aa, Homo Sapiens
HISDSHLKN

SEQ ID NO: 1349024 - protein, 9 aa, Homo Sapiens
SGVPFCYFI

SEQ ID NO: 1349025 - protein, 9 aa, Homo Sapiens
EDWVEMDTR

SEQ ID NO: 1349026 - protein, 9 aa, Homo Sapiens
PEQARWPLS

SEQ ID NO: 1349027 - protein, 9 aa, Homo Sapiens
KGISRKQFE

SEQ ID NO: 1349028 - protein, 9 aa, Homo Sapiens
YVHLHELSC

SEQ ID NO: 1349029 - protein, 9 aa, Homo Sapiens
YSSGWWFDV

SEQ ID NO: 1349030 - protein, 9 aa, Homo Sapiens
KLLKLLDQC

SEQ ID NO: 1349031 - protein, 9 aa, Homo Sapiens
ADTLIIGNC

SEQ ID NO: 1349032 - protein, 9 aa, Homo Sapiens
EAWHPEAPT

SEQ ID NO: 1349033 - protein, 9 aa, Homo Sapiens
WLKIPGLKT

SEQ ID NO: 1349034 - protein, 9 aa, Homo Sapiens
SKTLDGTHW

SEQ ID NO: 1349035 - protein, 9 aa, Homo Sapiens
TNIIDSMLQ

SEQ ID NO: 1349036 - protein, 9 aa, Homo Sapiens
DTLLKNYGL

SEQ ID NO: 1349037 - protein, 9 aa, Homo Sapiens
DLARWKSHR

SEQ ID NO: 1349038 - protein, 9 aa, Homo Sapiens
ALPHAIMHL

SEQ ID NO: 1349039 - protein, 9 aa, Homo Sapiens
KNLCSQMST

SEQ ID NO: 1349040 - protein, 9 aa, Homo Sapiens
TLPRNDTNL

SEQ ID NO: 1349041 - protein, 9 aa, Homo Sapiens
HRCELAAAL

SEQ ID NO: 1349042 - protein, 9 aa, Homo Sapiens
EECLAKLQD

SEQ ID NO: 1349043 - protein, 9 aa, Homo Sapiens
GRFTGLVLD

SEQ ID NO: 1349044 - protein, 9 aa, Homo Sapiens
SLWPLEAKR

SEQ ID NO: 1349045 - protein, 9 aa, Homo Sapiens
IYWVSICFP

SEQ ID NO: 1349046 - protein, 9 aa, Homo Sapiens
IEFEKEEDY

SEQ ID NO: 1349047 - protein, 9 aa, Homo Sapiens
VMSWARGRD

SEQ ID NO: 1349048 - protein, 9 aa, Homo Sapiens
EMGLSNPEE

SEQ ID NO: 1349049 - protein, 9 aa, Homo Sapiens
SSAPDNEAG

SEQ ID NO: 1349050 - protein, 9 aa, Homo Sapiens
QPRVVSREE

SEQ ID NO: 1349051 - protein, 9 aa, Homo Sapiens
HLLLYLYCH

SEQ ID NO: 1349052 - protein, 9 aa, Homo Sapiens
PTPLSMTCC

SEQ ID NO: 1349053 - protein, 9 aa, Homo Sapiens
VSTLFGNIE

SEQ ID NO: 1349054 - protein, 9 aa, Homo Sapiens
IINNTIEMV

SEQ ID NO: 1349055 - protein, 9 aa, Homo Sapiens
FIRNTRRTA

SEQ ID NO: 1349056 - protein, 9 aa, Homo Sapiens
KFVYALKAP

SEQ ID NO: 1349057 - protein, 9 aa, Homo Sapiens
SSLKMDPTG

SEQ ID NO: 1349058 - protein, 9 aa, Homo Sapiens
ATLKLQDQL

SEQ ID NO: 1349059 - protein, 9 aa, Homo Sapiens
AFFTGDLPP

SEQ ID NO: 1349060 - protein, 9 aa, Homo Sapiens
LPRMIHDLT

SEQ ID NO: 1349061 - protein, 9 aa, Homo Sapiens
KHFLLYGHD

SEQ ID NO: 1349062 - protein, 9 aa, Homo Sapiens
CIIAITFIV

SEQ ID NO: 1349063 - protein, 9 aa, Homo Sapiens
PDCLESVND

SEQ ID NO: 1349064 - protein, 9 aa, Homo Sapiens
RFRFVWLEL

SEQ ID NO: 1349065 - protein, 9 aa, Homo Sapiens
QHKGGHEPR

SEQ ID NO: 1349066 - protein, 9 aa, Homo Sapiens
IVHLCTISL

SEQ ID NO: 1349067 - protein, 9 aa, Homo Sapiens
LRDFTRTYE

SEQ ID NO: 1349068 - protein, 9 aa, Homo Sapiens
NSPPLQGTR

SEQ ID NO: 1349069 - protein, 9 aa, Homo Sapiens
IFLFVFLLI

SEQ ID NO: 1349070 - protein, 9 aa, Homo Sapiens
ELGKVRCGV

SEQ ID NO: 1349071 - protein, 9 aa, Homo Sapiens
RLCYFDPLR

SEQ ID NO: 1349072 - protein, 9 aa, Homo Sapiens
TALAAAMDS

SEQ ID NO: 1349073 - protein, 9 aa, Homo Sapiens
DKHHEVNVQ

SEQ ID NO: 1349074 - protein, 9 aa, Homo Sapiens
PCTLLFFLH

SEQ ID NO: 1349075 - protein, 9 aa, Homo Sapiens
LFILEEEQQ

SEQ ID NO: 1349076 - protein, 9 aa, Homo Sapiens
CRRFCWSCH

SEQ ID NO: 1349077 - protein, 9 aa, Homo Sapiens
VFVSNKINT

SEQ ID NO: 1349078 - protein, 9 aa, Homo Sapiens
QCSCPTCTD

SEQ ID NO: 1349079 - protein, 9 aa, Homo Sapiens
TDKQYKGIV

SEQ ID NO: 1349080 - protein, 9 aa, Homo Sapiens
TQDGSCTEQ

SEQ ID NO: 1349081 - protein, 9 aa, Homo Sapiens
MADMLQRDG

SEQ ID NO: 1349082 - protein, 9 aa, Homo Sapiens
YECHTSNSQ

SEQ ID NO: 1349083 - protein, 9 aa, Homo Sapiens
TYIKTPTHR

SEQ ID NO: 1349084 - protein, 9 aa, Homo Sapiens
LYIAPIFSE

SEQ ID NO: 1349085 - protein, 9 aa, Homo Sapiens
RACFRSCKP

SEQ ID NO: 1349086 - protein, 9 aa, Homo Sapiens
KRNIGVIVV

SEQ ID NO: 1349087 - protein, 9 aa, Homo Sapiens
NARFLTSMW

SEQ ID NO: 1349088 - protein, 9 aa, Homo Sapiens
KEEPTKPVI

SEQ ID NO: 1349089 - protein, 9 aa, Homo Sapiens
EMRTSCLIK

SEQ ID NO: 1349090 - protein, 9 aa, Homo Sapiens
DTYERCIMV

SEQ ID NO: 1349091 - protein, 9 aa, Homo Sapiens
LREFIECRP

SEQ ID NO: 1349092 - protein, 9 aa, Homo Sapiens
YWGPANGFR

SEQ ID NO: 1349093 - protein, 9 aa, Homo Sapiens
IPGQANLVR

SEQ ID NO: 1349094 - protein, 9 aa, Homo Sapiens
KNIDDLKRI

SEQ ID NO: 1349095 - protein, 9 aa, Homo Sapiens
PVRSEKQKS

SEQ ID NO: 1349096 - protein, 9 aa, Homo Sapiens
PRTSLHTSS

SEQ ID NO: 1349097 - protein, 9 aa, Homo Sapiens
EQGMIQMTV

SEQ ID NO: 1349098 - protein, 9 aa, Homo Sapiens
RAVVFAAAS

SEQ ID NO: 1349099 - protein, 9 aa, Homo Sapiens
DTKNYDCDS

SEQ ID NO: 1349100 - protein, 9 aa, Homo Sapiens
RKNVTFLEE

SEQ ID NO: 1349101 - protein, 9 aa, Homo Sapiens
LNTGTTIQC

SEQ ID NO: 1349102 - protein, 9 aa, Homo Sapiens
LKVQLAQLK

SEQ ID NO: 1349103 - protein, 9 aa, Homo Sapiens
KKMLEQIRA

SEQ ID NO: 1349104 - protein, 9 aa, Homo Sapiens
HVSRFVTWI

SEQ ID NO: 1349105 - protein, 9 aa, Homo Sapiens
KAIEGYTKS

SEQ ID NO: 1349106 - protein, 9 aa, Homo Sapiens
KTFAEAHLI

SEQ ID NO: 1349107 - protein, 9 aa, Homo Sapiens
QWTPWGDCS

SEQ ID NO: 1349108 - protein, 9 aa, Homo Sapiens
LMRCLREWE

SEQ ID NO: 1349109 - protein, 9 aa, Homo Sapiens
QELFRGHNK

SEQ ID NO: 1349110 - protein, 9 aa, Homo Sapiens
PVMRLTCAD

SEQ ID NO: 1349111 - protein, 9 aa, Homo Sapiens
HLTLERPAL

SEQ ID NO: 1349112 - protein, 9 aa, Homo Sapiens
VPVGTSVIQ

SEQ ID NO: 1349113 - protein, 9 aa, Homo Sapiens
SSSEKQHFY

SEQ ID NO: 1349114 - protein, 9 aa, Homo Sapiens
RLMRICVQA

SEQ ID NO: 1349115 - protein, 9 aa, Homo Sapiens
PYQVVRAHL

SEQ ID NO: 1349116 - protein, 9 aa, Homo Sapiens
SLVEYVVVQ

SEQ ID NO: 1349117 - protein, 9 aa, Homo Sapiens
PKKKKEAYS

SEQ ID NO: 1349118 - protein, 9 aa, Homo Sapiens
YIQSIRCHY

SEQ ID NO: 1349119 - protein, 9 aa, Homo Sapiens
RHTQQIQEE

SEQ ID NO: 1349120 - protein, 9 aa, Homo Sapiens
REVKHLKYV

SEQ ID NO: 1349121 - protein, 9 aa, Homo Sapiens
TSENIEKER

SEQ ID NO: 1349122 - protein, 9 aa, Homo Sapiens
KQIWLCCIT

SEQ ID NO: 1349123 - protein, 9 aa, Homo Sapiens
STVKAHDNS

SEQ ID NO: 1349124 - protein, 9 aa, Homo Sapiens
AVELVKKSL

SEQ ID NO: 1349125 - protein, 9 aa, Homo Sapiens
SSDINIIPG

SEQ ID NO: 1349126 - protein, 9 aa, Homo Sapiens
LSAHTIKHA

SEQ ID NO: 1349127 - protein, 9 aa, Homo Sapiens
CGGIYGEWI

SEQ ID NO: 1349128 - protein, 9 aa, Homo Sapiens
PPGMPSSAL

SEQ ID NO: 1349129 - protein, 9 aa, Homo Sapiens
FQGSTVVWA

SEQ ID NO: 1349130 - protein, 9 aa, Homo Sapiens
LPVSCTSFW

SEQ ID NO: 1349131 - protein, 9 aa, Homo Sapiens
AFALAFLQH

SEQ ID NO: 1349132 - protein, 9 aa, Homo Sapiens
PSHQGLTCN

SEQ ID NO: 1349133 - protein, 9 aa, Homo Sapiens
SSLATNLQE

SEQ ID NO: 1349134 - protein, 9 aa, Homo Sapiens
VCVFRLITD

SEQ ID NO: 1349135 - protein, 9 aa, Homo Sapiens
NSLMTYWQE

SEQ ID NO: 1349136 - protein, 9 aa, Homo Sapiens
FRVIKVNKG

SEQ ID NO: 1349137 - protein, 9 aa, Homo Sapiens
QSLSRHAQV

SEQ ID NO: 1349138 - protein, 9 aa, Homo Sapiens
VGGPLEQIL

SEQ ID NO: 1349139 - protein, 9 aa, Homo Sapiens
CGLHTVLSK

SEQ ID NO: 1349140 - protein, 9 aa, Homo Sapiens
LTGLRLGVE

SEQ ID NO: 1349141 - protein, 9 aa, Homo Sapiens
RWKSELAAN

SEQ ID NO: 1349142 - protein, 9 aa, Homo Sapiens
THLFFSRSE

SEQ ID NO: 1349143 - protein, 9 aa, Homo Sapiens
GTHDYLGLN

SEQ ID NO: 1349144 - protein, 9 aa, Homo Sapiens
TKVFVWPIS

SEQ ID NO: 1349145 - protein, 9 aa, Homo Sapiens
EWKIAASEK

SEQ ID NO: 1349146 - protein, 9 aa, Homo Sapiens
TMWNLENRL

SEQ ID NO: 1349147 - protein, 9 aa, Homo Sapiens
LGDGLESIP

SEQ ID NO: 1349148 - protein, 9 aa, Homo Sapiens
SWGSLGDSD

SEQ ID NO: 1349149 - protein, 9 aa, Homo Sapiens
AETREAHEA

SEQ ID NO: 1349150 - protein, 9 aa, Homo Sapiens
RSLRKCLHQ

SEQ ID NO: 1349151 - protein, 9 aa, Homo Sapiens
RIVAPGVRM

SEQ ID NO: 1349152 - protein, 9 aa, Homo Sapiens
KSGARLEAE

SEQ ID NO: 1349153 - protein, 9 aa, Homo Sapiens
IQYFAIVTA

SEQ ID NO: 1349154 - protein, 9 aa, Homo Sapiens
MLQRDGLAA

SEQ ID NO: 1349155 - protein, 9 aa, Homo Sapiens
VSFPQSSSG

SEQ ID NO: 1349156 - protein, 9 aa, Homo Sapiens
TSLWPLEAK

SEQ ID NO: 1349157 - protein, 9 aa, Homo Sapiens
GVKCCCQLF

SEQ ID NO: 1349158 - protein, 9 aa, Homo Sapiens
KCTALSVRP

SEQ ID NO: 1349159 - protein, 9 aa, Homo Sapiens
LEEILKQLV

SEQ ID NO: 1349160 - protein, 9 aa, Homo Sapiens
QAITAAHGH

SEQ ID NO: 1349161 - protein, 9 aa, Homo Sapiens
IPCMCHDLD

SEQ ID NO: 1349162 - protein, 9 aa, Homo Sapiens
ERADMWPHS

SEQ ID NO: 1349163 - protein, 9 aa, Homo Sapiens
RFNRCDLIG

SEQ ID NO: 1349164 - protein, 9 aa, Homo Sapiens
EHDTILGID

SEQ ID NO: 1349165 - protein, 9 aa, Homo Sapiens
NKLKEMCSD

SEQ ID NO: 1349166 - protein, 9 aa, Homo Sapiens
KNCCALITE

SEQ ID NO: 1349167 - protein, 9 aa, Homo Sapiens
QKYVGKFLR

SEQ ID NO: 1349168 - protein, 9 aa, Homo Sapiens
IFDVSVERV

SEQ ID NO: 1349169 - protein, 9 aa, Homo Sapiens
KCQSSVTVV

SEQ ID NO: 1349170 - protein, 9 aa, Homo Sapiens
ETVSETLQF

SEQ ID NO: 1349171 - protein, 9 aa, Homo Sapiens
DEDTKAPRV

SEQ ID NO: 1349172 - protein, 9 aa, Homo Sapiens
LIVPVPEAQ

SEQ ID NO: 1349173 - protein, 9 aa, Homo Sapiens
IGEELTIHN

SEQ ID NO: 1349174 - protein, 9 aa, Homo Sapiens
LLLGDTYNM

SEQ ID NO: 1349175 - protein, 9 aa, Homo Sapiens
NRLQRCLSQ

SEQ ID NO: 1349176 - protein, 9 aa, Homo Sapiens
GIYLQQMSY

SEQ ID NO: 1349177 - protein, 9 aa, Homo Sapiens
KTYTQVGLR

SEQ ID NO: 1349178 - protein, 9 aa, Homo Sapiens
QFHVVDGDH

SEQ ID NO: 1349179 - protein, 9 aa, Homo Sapiens
DVENTKLYL

SEQ ID NO: 1349180 - protein, 9 aa, Homo Sapiens
PPGLQRPDD

SEQ ID NO: 1349181 - protein, 9 aa, Homo Sapiens
QPPAVAPPS

SEQ ID NO: 1349182 - protein, 9 aa, Homo Sapiens
ICEHIKQFQ

SEQ ID NO: 1349183 - protein, 9 aa, Homo Sapiens
NHMDRREHG

SEQ ID NO: 1349184 - protein, 9 aa, Homo Sapiens
LGGTAIILI

SEQ ID NO: 1349185 - protein, 9 aa, Homo Sapiens
EFMRNAVDK

SEQ ID NO: 1349186 - protein, 9 aa, Homo Sapiens
QVPVLHEEL

SEQ ID NO: 1349187 - protein, 9 aa, Homo Sapiens
PRNIWVGDG

SEQ ID NO: 1349188 - protein, 9 aa, Homo Sapiens
ELDVENTKL

SEQ ID NO: 1349189 - protein, 9 aa, Homo Sapiens
GVPESTSMD

SEQ ID NO: 1349190 - protein, 9 aa, Homo Sapiens
LLKMVILNL

SEQ ID NO: 1349191 - protein, 9 aa, Homo Sapiens
LENSSRDLA

SEQ ID NO: 1349192 - protein, 9 aa, Homo Sapiens
YNNQPTMET

SEQ ID NO: 1349193 - protein, 9 aa, Homo Sapiens
KRNSRRSSK

SEQ ID NO: 1349194 - protein, 9 aa, Homo Sapiens
CDMRFTRQY

SEQ ID NO: 1349195 - protein, 9 aa, Homo Sapiens
KLKTTPTPR

SEQ ID NO: 1349196 - protein, 9 aa, Homo Sapiens
TKKRRKLGM

SEQ ID NO: 1349197 - protein, 9 aa, Homo Sapiens
RELSEIRAP

SEQ ID NO: 1349198 - protein, 9 aa, Homo Sapiens
TVGGQTLAA

SEQ ID NO: 1349199 - protein, 9 aa, Homo Sapiens
VIMMIYLLP

SEQ ID NO: 1349200 - protein, 9 aa, Homo Sapiens
LCIEVEAVR

SEQ ID NO: 1349201 - protein, 9 aa, Homo Sapiens
DAVQGKTRT

SEQ ID NO: 1349202 - protein, 9 aa, Homo Sapiens
KAREIICQS

SEQ ID NO: 1349203 - protein, 9 aa, Homo Sapiens
RKCQLSPQS

SEQ ID NO: 1349204 - protein, 9 aa, Homo Sapiens
IYPPSTCSL

SEQ ID NO: 1349205 - protein, 9 aa, Homo Sapiens
TQLTQKPLA

SEQ ID NO: 1349206 - protein, 9 aa, Homo Sapiens
YNFFCDVHP

SEQ ID NO: 1349207 - protein, 9 aa, Homo Sapiens
TSLCSRKTG

SEQ ID NO: 1349208 - protein, 9 aa, Homo Sapiens
ACDGTFVKE

SEQ ID NO: 1349209 - protein, 9 aa, Homo Sapiens
VAEGFISCM

SEQ ID NO: 1349210 - protein, 9 aa, Homo Sapiens
KYNTATCDT

SEQ ID NO: 1349211 - protein, 9 aa, Homo Sapiens
APKKCRACF

SEQ ID NO: 1349212 - protein, 9 aa, Homo Sapiens
EVHQEPGAV

SEQ ID NO: 1349213 - protein, 9 aa, Homo Sapiens
RSQSRLYVC

SEQ ID NO: 1349214 - protein, 9 aa, Homo Sapiens
TGVYFEKIL

SEQ ID NO: 1349215 - protein, 9 aa, Homo Sapiens
SPFYIWTAD

SEQ ID NO: 1349216 - protein, 9 aa, Homo Sapiens
MTWKCLVRV

SEQ ID NO: 1349217 - protein, 9 aa, Homo Sapiens
HSFHTDKLG

SEQ ID NO: 1349218 - protein, 9 aa, Homo Sapiens
TLPRRDEWT

SEQ ID NO: 1349219 - protein, 9 aa, Homo Sapiens
SHLEIDDIY

SEQ ID NO: 1349220 - protein, 9 aa, Homo Sapiens
DVPSGITAR

SEQ ID NO: 1349221 - protein, 9 aa, Homo Sapiens
EYIRVKLQL

SEQ ID NO: 1349222 - protein, 9 aa, Homo Sapiens
TLSSNVILH

SEQ ID NO: 1349223 - protein, 9 aa, Homo Sapiens
RDDVRHQQQ

SEQ ID NO: 1349224 - protein, 9 aa, Homo Sapiens
ILSIIQGEV

SEQ ID NO: 1349225 - protein, 9 aa, Homo Sapiens
YYQHLYIIH

SEQ ID NO: 1349226 - protein, 9 aa, Homo Sapiens
GTRATSTGK

SEQ ID NO: 1349227 - protein, 9 aa, Homo Sapiens
HSSSRIFKL

SEQ ID NO: 1349228 - protein, 9 aa, Homo Sapiens
LLLQHHVSS

SEQ ID NO: 1349229 - protein, 9 aa, Homo Sapiens
QSTLVIAEY

SEQ ID NO: 1349230 - protein, 9 aa, Homo Sapiens
TVVLSLPEC

SEQ ID NO: 1349231 - protein, 9 aa, Homo Sapiens
TMVTRGHQL

SEQ ID NO: 1349232 - protein, 9 aa, Homo Sapiens
SDRSSNTFP

SEQ ID NO: 1349233 - protein, 9 aa, Homo Sapiens
VCGKLTPEK

SEQ ID NO: 1349234 - protein, 9 aa, Homo Sapiens
PELNTAQQN

SEQ ID NO: 1349235 - protein, 9 aa, Homo Sapiens
MHGPNLILC

SEQ ID NO: 1349236 - protein, 9 aa, Homo Sapiens
LPHPCQMES

SEQ ID NO: 1349237 - protein, 9 aa, Homo Sapiens
YLPYFRTQI

SEQ ID NO: 1349238 - protein, 9 aa, Homo Sapiens
VIIETVVPN

SEQ ID NO: 1349239 - protein, 9 aa, Homo Sapiens
RKHRKRSHS

SEQ ID NO: 1349240 - protein, 9 aa, Homo Sapiens
IYPSAYHID

SEQ ID NO: 1349241 - protein, 9 aa, Homo Sapiens
KSEDEQKLI

SEQ ID NO: 1349242 - protein, 9 aa, Homo Sapiens
TFHSVAEEE

SEQ ID NO: 1349243 - protein, 9 aa, Homo Sapiens
GQDSTQDTT

SEQ ID NO: 1349244 - protein, 9 aa, Homo Sapiens
TGPEEPSHF

SEQ ID NO: 1349245 - protein, 9 aa, Homo Sapiens
IEFLQNMEM

SEQ ID NO: 1349246 - protein, 9 aa, Homo Sapiens
LQVTTTLKL

SEQ ID NO: 1349247 - protein, 9 aa, Homo Sapiens
QLQEEIRAA

SEQ ID NO: 1349248 - protein, 9 aa, Homo Sapiens
IINPQTALY

SEQ ID NO: 1349249 - protein, 9 aa, Homo Sapiens
LRSVSLLMN

SEQ ID NO: 1349250 - protein, 9 aa, Homo Sapiens
NQNPVNQFA

SEQ ID NO: 1349251 - protein, 9 aa, Homo Sapiens
HAEGGWPQV

SEQ ID NO: 1349252 - protein, 9 aa, Homo Sapiens
CVHFFDVEW

SEQ ID NO: 1349253 - protein, 9 aa, Homo Sapiens
LILCSVSNS

SEQ ID NO: 1349254 - protein, 9 aa, Homo Sapiens
HPHSCRDVP

SEQ ID NO: 1349255 - protein, 9 aa, Homo Sapiens
GLLMAMRCL

SEQ ID NO: 1349256 - protein, 9 aa, Homo Sapiens
CRLETIRNP

SEQ ID NO: 1349257 - protein, 9 aa, Homo Sapiens
MCISILHPP

SEQ ID NO: 1349258 - protein, 9 aa, Homo Sapiens
PSRRRAPPR

SEQ ID NO: 1349259 - protein, 9 aa, Homo Sapiens
QAAWVGALT

SEQ ID NO: 1349260 - protein, 9 aa, Homo Sapiens
AYLIFALGN

SEQ ID NO: 1349261 - protein, 9 aa, Homo Sapiens
RLEMMSRGR

SEQ ID NO: 1349262 - protein, 9 aa, Homo Sapiens
HKRVQGMPV

SEQ ID NO: 1349263 - protein, 9 aa, Homo Sapiens
THVVLKEEQ

SEQ ID NO: 1349264 - protein, 9 aa, Homo Sapiens
GSCPFRHCE

SEQ ID NO: 1349265 - protein, 9 aa, Homo Sapiens
QRIADNTFS

SEQ ID NO: 1349266 - protein, 9 aa, Homo Sapiens
KTEICDEAE

SEQ ID NO: 1349267 - protein, 9 aa, Homo Sapiens
RNALTSIAN

SEQ ID NO: 1349268 - protein, 9 aa, Homo Sapiens
TFYFGSNYM

SEQ ID NO: 1349269 - protein, 9 aa, Homo Sapiens
INTGMYILS

SEQ ID NO: 1349270 - protein, 9 aa, Homo Sapiens
AASVGRPSA

SEQ ID NO: 1349271 - protein, 9 aa, Homo Sapiens
PPRSRLAAA

SEQ ID NO: 1349272 - protein, 9 aa, Homo Sapiens
EEKSEPDIS

SEQ ID NO: 1349273 - protein, 9 aa, Homo Sapiens
PSNYVCREL

SEQ ID NO: 1349274 - protein, 9 aa, Homo Sapiens
FSTATSSSS

SEQ ID NO: 1349275 - protein, 9 aa, Homo Sapiens
FFPTGDCFR

SEQ ID NO: 1349276 - protein, 9 aa, Homo Sapiens
TSKVSAFAF

SEQ ID NO: 1349277 - protein, 9 aa, Homo Sapiens
QSTLQHYYV

SEQ ID NO: 1349278 - protein, 9 aa, Homo Sapiens
ASNPRESHP

SEQ ID NO: 1349279 - protein, 9 aa, Homo Sapiens
DVYRVWKWG

SEQ ID NO: 1349280 - protein, 9 aa, Homo Sapiens
NVAPPAFSG

SEQ ID NO: 1349281 - protein, 9 aa, Homo Sapiens
YSFVIVIWG

SEQ ID NO: 1349282 - protein, 9 aa, Homo Sapiens
LFDKSAGEN

SEQ ID NO: 1349283 - protein, 9 aa, Homo Sapiens
SRRVRRAPL

SEQ ID NO: 1349284 - protein, 9 aa, Homo Sapiens
VRVRMHNHP

SEQ ID NO: 1349285 - protein, 9 aa, Homo Sapiens
ETRDMFHLR

SEQ ID NO: 1349286 - protein, 9 aa, Homo Sapiens
EEIPFEFET

SEQ ID NO: 1349287 - protein, 9 aa, Homo Sapiens
LELEKDMAA

SEQ ID NO: 1349288 - protein, 9 aa, Homo Sapiens
RTKTPIITT

SEQ ID NO: 1349289 - protein, 9 aa, Homo Sapiens
SPLWVCCFF

SEQ ID NO: 1349290 - protein, 9 aa, Homo Sapiens
VTTKSSKNQ

SEQ ID NO: 1349291 - protein, 9 aa, Homo Sapiens
KRSHSRSRE

SEQ ID NO: 1349292 - protein, 9 aa, Homo Sapiens
QPEQARWPL

SEQ ID NO: 1349293 - protein, 9 aa, Homo Sapiens
CWSLHNSKE

SEQ ID NO: 1349294 - protein, 9 aa, Homo Sapiens
HKGLQIFCS

SEQ ID NO: 1349295 - protein, 9 aa, Homo Sapiens
YLYIAPIFS

SEQ ID NO: 1349296 - protein, 9 aa, Homo Sapiens
SLAVLIVIF

SEQ ID NO: 1349297 - protein, 9 aa, Homo Sapiens
DPTKTFDYK

SEQ ID NO: 1349298 - protein, 9 aa, Homo Sapiens
MYEMYFVSY

SEQ ID NO: 1349299 - protein, 9 aa, Homo Sapiens
SVSEGNPYV

SEQ ID NO: 1349300 - protein, 9 aa, Homo Sapiens
TGLLLNLLD

SEQ ID NO: 1349301 - protein, 9 aa, Homo Sapiens
ISAHNQQLW

SEQ ID NO: 1349302 - protein, 9 aa, Homo Sapiens
STNKSESNE

SEQ ID NO: 1349303 - protein, 9 aa, Homo Sapiens
AQQQDINYQ

SEQ ID NO: 1349304 - protein, 9 aa, Homo Sapiens
LCMHERTHT

SEQ ID NO: 1349305 - protein, 9 aa, Homo Sapiens
TSDSYEAAV

SEQ ID NO: 1349306 - protein, 9 aa, Homo Sapiens
PSTVGIRQD

SEQ ID NO: 1349307 - protein, 9 aa, Homo Sapiens
IIISLKEEF

SEQ ID NO: 1349308 - protein, 9 aa, Homo Sapiens
YTSHEHREH

SEQ ID NO: 1349309 - protein, 9 aa, Homo Sapiens
NCEMSTMNI

SEQ ID NO: 1349310 - protein, 9 aa, Homo Sapiens
NPKYKGVWK

SEQ ID NO: 1349311 - protein, 9 aa, Homo Sapiens
PGIETLEEC

SEQ ID NO: 1349312 - protein, 9 aa, Homo Sapiens
TWLGIFYCA

SEQ ID NO: 1349313 - protein, 9 aa, Homo Sapiens
ALVGPHARV

SEQ ID NO: 1349314 - protein, 9 aa, Homo Sapiens
SLNFFKTIA

SEQ ID NO: 1349315 - protein, 9 aa, Homo Sapiens
NLKDDFEVF

SEQ ID NO: 1349316 - protein, 9 aa, Homo Sapiens
IPIYSFGIF

SEQ ID NO: 1349317 - protein, 9 aa, Homo Sapiens
RCQPHPTAS

SEQ ID NO: 1349318 - protein, 9 aa, Homo Sapiens
CSTARLARA

SEQ ID NO: 1349319 - protein, 9 aa, Homo Sapiens
MYSYPAHVP

SEQ ID NO: 1349320 - protein, 9 aa, Homo Sapiens
GFISCMQYA

SEQ ID NO: 1349321 - protein, 9 aa, Homo Sapiens
KRTIQFVDL

SEQ ID NO: 1349322 - protein, 9 aa, Homo Sapiens
VRAIRHSFI

SEQ ID NO: 1349323 - protein, 9 aa, Homo Sapiens
CCANATCLH

SEQ ID NO: 1349324 - protein, 9 aa, Homo Sapiens
SPRIPMLSR

SEQ ID NO: 1349325 - protein, 9 aa, Homo Sapiens
PAHMVVGDV

SEQ ID NO: 1349326 - protein, 9 aa, Homo Sapiens
VPCGVGQRI

SEQ ID NO: 1349327 - protein, 9 aa, Homo Sapiens
HIAHIPLLR

SEQ ID NO: 1349328 - protein, 9 aa, Homo Sapiens
SFEQFKVTM

SEQ ID NO: 1349329 - protein, 9 aa, Homo Sapiens
ELGLRKAVN

SEQ ID NO: 1349330 - protein, 9 aa, Homo Sapiens
IEKEYQPHI

SEQ ID NO: 1349331 - protein, 9 aa, Homo Sapiens
KKVQEAEAQ

SEQ ID NO: 1349332 - protein, 9 aa, Homo Sapiens
VTQPRRISV

SEQ ID NO: 1349333 - protein, 9 aa, Homo Sapiens
ESKHHPGQS

SEQ ID NO: 1349334 - protein, 9 aa, Homo Sapiens
FRYQSLKQF

SEQ ID NO: 1349335 - protein, 9 aa, Homo Sapiens
VYYDTIKYK

SEQ ID NO: 1349336 - protein, 9 aa, Homo Sapiens
LKHSGIGRT

SEQ ID NO: 1349337 - protein, 9 aa, Homo Sapiens
KIIRNNSWL

SEQ ID NO: 1349338 - protein, 9 aa, Homo Sapiens
LIQAHTVTP

SEQ ID NO: 1349339 - protein, 9 aa, Homo Sapiens
NMKLQHAAS

SEQ ID NO: 1349340 - protein, 9 aa, Homo Sapiens
PSDHYHSFH

SEQ ID NO: 1349341 - protein, 9 aa, Homo Sapiens
RTAQNISED

SEQ ID NO: 1349342 - protein, 9 aa, Homo Sapiens
RTNGSVTTS

SEQ ID NO: 1349343 - protein, 9 aa, Homo Sapiens
LAVFVEELD

SEQ ID NO: 1349344 - protein, 9 aa, Homo Sapiens
FVKDEKNRF

SEQ ID NO: 1349345 - protein, 9 aa, Homo Sapiens
LIPHDVGSS

SEQ ID NO: 1349346 - protein, 9 aa, Homo Sapiens
QVLGESREP

SEQ ID NO: 1349347 - protein, 9 aa, Homo Sapiens
NTWPAISAF

SEQ ID NO: 1349348 - protein, 9 aa, Homo Sapiens
DILWQWAIW

SEQ ID NO: 1349349 - protein, 9 aa, Homo Sapiens
PGVTIWGVA

SEQ ID NO: 1349350 - protein, 9 aa, Homo Sapiens
QRAIIQHHH

SEQ ID NO: 1349351 - protein, 9 aa, Homo Sapiens
KVMYITSNP

SEQ ID NO: 1349352 - protein, 9 aa, Homo Sapiens
RKGQKKIRK

SEQ ID NO: 1349353 - protein, 9 aa, Homo Sapiens
SDTFNCCTF

SEQ ID NO: 1349354 - protein, 9 aa, Homo Sapiens
ESTGSGQRH

SEQ ID NO: 1349355 - protein, 9 aa, Homo Sapiens
VQQIHQDIL

SEQ ID NO: 1349356 - protein, 9 aa, Homo Sapiens
WEVWAPPSP

SEQ ID NO: 1349357 - protein, 9 aa, Homo Sapiens
WPQGELLSR

SEQ ID NO: 1349358 - protein, 9 aa, Homo Sapiens
IVSCKWRMN

SEQ ID NO: 1349359 - protein, 9 aa, Homo Sapiens
MSWRVYTVL

SEQ ID NO: 1349360 - protein, 9 aa, Homo Sapiens
PSTRPPPGS

SEQ ID NO: 1349361 - protein, 9 aa, Homo Sapiens
GILNDFHKC

SEQ ID NO: 1349362 - protein, 9 aa, Homo Sapiens
SHKNAKYLL

SEQ ID NO: 1349363 - protein, 9 aa, Homo Sapiens
SLKARMRQI

SEQ ID NO: 1349364 - protein, 9 aa, Homo Sapiens
KNGMGLECG

SEQ ID NO: 1349365 - protein, 9 aa, Homo Sapiens
TQFHGDSAN

SEQ ID NO: 1349366 - protein, 9 aa, Homo Sapiens
YLVQTLSCL

SEQ ID NO: 1349367 - protein, 9 aa, Homo Sapiens
QKGISVMPK

SEQ ID NO: 1349368 - protein, 9 aa, Homo Sapiens
LESLKFSPH

SEQ ID NO: 1349369 - protein, 9 aa, Homo Sapiens
FLSGLLDAG

SEQ ID NO: 1349370 - protein, 9 aa, Homo Sapiens
NSSWTDMDT

SEQ ID NO: 1349371 - protein, 9 aa, Homo Sapiens
AKSIVGSKF

SEQ ID NO: 1349372 - protein, 9 aa, Homo Sapiens
KCLANSSWT

SEQ ID NO: 1349373 - protein, 9 aa, Homo Sapiens
DDIRHIRAD

SEQ ID NO: 1349374 - protein, 9 aa, Homo Sapiens
EKLDFAGLV

SEQ ID NO: 1349375 - protein, 9 aa, Homo Sapiens
SVLSAIVSC

SEQ ID NO: 1349376 - protein, 9 aa, Homo Sapiens
STKIDCVEC

SEQ ID NO: 1349377 - protein, 9 aa, Homo Sapiens
ETARLEERC

SEQ ID NO: 1349378 - protein, 9 aa, Homo Sapiens
HLFISQVTP

SEQ ID NO: 1349379 - protein, 9 aa, Homo Sapiens
HSAHNRNNS

SEQ ID NO: 1349380 - protein, 9 aa, Homo Sapiens
EFYKVQGPL

SEQ ID NO: 1349381 - protein, 9 aa, Homo Sapiens
VEPKIGVIK

SEQ ID NO: 1349382 - protein, 9 aa, Homo Sapiens
QLTGHNLFF

SEQ ID NO: 1349383 - protein, 9 aa, Homo Sapiens
RHKMRWLKA

SEQ ID NO: 1349384 - protein, 9 aa, Homo Sapiens
INNKRCYSF

SEQ ID NO: 1349385 - protein, 9 aa, Homo Sapiens
PSGEDFIFH

SEQ ID NO: 1349386 - protein, 9 aa, Homo Sapiens
MRSFGLSIG

SEQ ID NO: 1349387 - protein, 9 aa, Homo Sapiens
VASGSETVH

SEQ ID NO: 1349388 - protein, 9 aa, Homo Sapiens
HHGETCHPQ

SEQ ID NO: 1349389 - protein, 9 aa, Homo Sapiens
GGRTIITKS

SEQ ID NO: 1349390 - protein, 9 aa, Homo Sapiens
GTSSPDYQH

SEQ ID NO: 1349391 - protein, 9 aa, Homo Sapiens
RQHRQFMDH

SEQ ID NO: 1349392 - protein, 9 aa, Homo Sapiens
APADRKCQL

SEQ ID NO: 1349393 - protein, 9 aa, Homo Sapiens
TRTNAKCKL

SEQ ID NO: 1349394 - protein, 9 aa, Homo Sapiens
HGRTAKDTV

SEQ ID NO: 1349395 - protein, 9 aa, Homo Sapiens
LYECKEYGK

SEQ ID NO: 1349396 - protein, 9 aa, Homo Sapiens
SCVSEDKHI

SEQ ID NO: 1349397 - protein, 9 aa, Homo Sapiens
PCSDTLVDA

SEQ ID NO: 1349398 - protein, 9 aa, Homo Sapiens
LESDDILIP

SEQ ID NO: 1349399 - protein, 9 aa, Homo Sapiens
PVNQFAGKA

SEQ ID NO: 1349400 - protein, 9 aa, Homo Sapiens
QGPSDHYHS

SEQ ID NO: 1349401 - protein, 9 aa, Homo Sapiens
VRYNSMNDG

SEQ ID NO: 1349402 - protein, 9 aa, Homo Sapiens
NSHMILRKG

SEQ ID NO: 1349403 - protein, 9 aa, Homo Sapiens
VPQIGVVNV

SEQ ID NO: 1349404 - protein, 9 aa, Homo Sapiens
LEIEHIKIE

SEQ ID NO: 1349405 - protein, 9 aa, Homo Sapiens
TKMCILDQY

SEQ ID NO: 1349406 - protein, 9 aa, Homo Sapiens
PGAQQQDIN

SEQ ID NO: 1349407 - protein, 9 aa, Homo Sapiens
YSLLRICAI

SEQ ID NO: 1349408 - protein, 9 aa, Homo Sapiens
MKPNAPGWA

SEQ ID NO: 1349409 - protein, 9 aa, Homo Sapiens
HIQNVVTSF

SEQ ID NO: 1349410 - protein, 9 aa, Homo Sapiens
AACITYIRL

SEQ ID NO: 1349411 - protein, 9 aa, Homo Sapiens
RHSQTTTIP

SEQ ID NO: 1349412 - protein, 9 aa, Homo Sapiens
SLDDVRNRQ

SEQ ID NO: 1349413 - protein, 9 aa, Homo Sapiens
TVQAHVMDR

SEQ ID NO: 1349414 - protein, 9 aa, Homo Sapiens
TAIQGYKLY

SEQ ID NO: 1349415 - protein, 9 aa, Homo Sapiens
IFTIPLEIM

SEQ ID NO: 1349416 - protein, 9 aa, Homo Sapiens
VLSSSTMTP

SEQ ID NO: 1349417 - protein, 9 aa, Homo Sapiens
NKFAISENS

SEQ ID NO: 1349418 - protein, 9 aa, Homo Sapiens
FEKEEDYEK

SEQ ID NO: 1349419 - protein, 9 aa, Homo Sapiens
RDQAREQDC

SEQ ID NO: 1349420 - protein, 9 aa, Homo Sapiens
LVCCEVSTR

SEQ ID NO: 1349421 - protein, 9 aa, Homo Sapiens
TLTIQRLHI

SEQ ID NO: 1349422 - protein, 9 aa, Homo Sapiens
SPEDLEVIK

SEQ ID NO: 1349423 - protein, 9 aa, Homo Sapiens
ALEGSRVWR

SEQ ID NO: 1349424 - protein, 9 aa, Homo Sapiens
ACTSQSLYT

SEQ ID NO: 1349425 - protein, 9 aa, Homo Sapiens
TKMKHMRES

SEQ ID NO: 1349426 - protein, 9 aa, Homo Sapiens
TLINAEVKS

SEQ ID NO: 1349427 - protein, 9 aa, Homo Sapiens
NTIMGSGIL

SEQ ID NO: 1349428 - protein, 9 aa, Homo Sapiens
GHYFKVWLY

SEQ ID NO: 1349429 - protein, 9 aa, Homo Sapiens
KLRDFTRTY

SEQ ID NO: 1349430 - protein, 9 aa, Homo Sapiens
VNVPSHQGL

SEQ ID NO: 1349431 - protein, 9 aa, Homo Sapiens
LNEMEEFVE

SEQ ID NO: 1349432 - protein, 9 aa, Homo Sapiens
DSIKDEDQT

SEQ ID NO: 1349433 - protein, 9 aa, Homo Sapiens
VIMLLEQEK

SEQ ID NO: 1349434 - protein, 9 aa, Homo Sapiens
PSCTTFGSF

SEQ ID NO: 1349435 - protein, 9 aa, Homo Sapiens
DTLIDEVER

SEQ ID NO: 1349436 - protein, 9 aa, Homo Sapiens
CPPLASCGV

SEQ ID NO: 1349437 - protein, 9 aa, Homo Sapiens
LMVLVEQQT

SEQ ID NO: 1349438 - protein, 9 aa, Homo Sapiens
LHSSPKRSL

SEQ ID NO: 1349439 - protein, 9 aa, Homo Sapiens
EAMRPSGHR

SEQ ID NO: 1349440 - protein, 9 aa, Homo Sapiens
GESSSLVTD

SEQ ID NO: 1349441 - protein, 9 aa, Homo Sapiens
TNVMPMLNP

SEQ ID NO: 1349442 - protein, 9 aa, Homo Sapiens
VYGERCCLR

SEQ ID NO: 1349443 - protein, 9 aa, Homo Sapiens
LIVWENSSV

SEQ ID NO: 1349444 - protein, 9 aa, Homo Sapiens
SVPGVDPVV

SEQ ID NO: 1349445 - protein, 9 aa, Homo Sapiens
VGGHSSMMC

SEQ ID NO: 1349446 - protein, 9 aa, Homo Sapiens
DTGYQWLDL

SEQ ID NO: 1349447 - protein, 9 aa, Homo Sapiens
EWPLVDDRT

SEQ ID NO: 1349448 - protein, 9 aa, Homo Sapiens
CMPHQLFIG

SEQ ID NO: 1349449 - protein, 9 aa, Homo Sapiens
NTRHKVDWL

SEQ ID NO: 1349450 - protein, 9 aa, Homo Sapiens
ACPTASRPT

SEQ ID NO: 1349451 - protein, 9 aa, Homo Sapiens
TDICFYIDI

SEQ ID NO: 1349452 - protein, 9 aa, Homo Sapiens
KCRKAREET

SEQ ID NO: 1349453 - protein, 9 aa, Homo Sapiens
LARDADLTT

SEQ ID NO: 1349454 - protein, 9 aa, Homo Sapiens
VPHCQIQGS

SEQ ID NO: 1349455 - protein, 9 aa, Homo Sapiens
SVTTGKVPE

SEQ ID NO: 1349456 - protein, 9 aa, Homo Sapiens
LVCGAEPRS

SEQ ID NO: 1349457 - protein, 9 aa, Homo Sapiens
AFDSFILCK

SEQ ID NO: 1349458 - protein, 9 aa, Homo Sapiens
VRRRKCPHA

SEQ ID NO: 1349459 - protein, 9 aa, Homo Sapiens
VGQPEMTPQ

SEQ ID NO: 1349460 - protein, 9 aa, Homo Sapiens
DTYNMRHPL

SEQ ID NO: 1349461 - protein, 9 aa, Homo Sapiens
SHYPTLWTE

SEQ ID NO: 1349462 - protein, 9 aa, Homo Sapiens
QAAKGGLED

SEQ ID NO: 1349463 - protein, 9 aa, Homo Sapiens
ADLGSRAQQ

SEQ ID NO: 1349464 - protein, 9 aa, Homo Sapiens
NIQTSESYP

SEQ ID NO: 1349465 - protein, 9 aa, Homo Sapiens
HKNRMKKVR

SEQ ID NO: 1349466 - protein, 9 aa, Homo Sapiens
EGKDCIASL

SEQ ID NO: 1349467 - protein, 9 aa, Homo Sapiens
FFFLFPDSF

SEQ ID NO: 1349468 - protein, 9 aa, Homo Sapiens
SRENPVTSD

SEQ ID NO: 1349469 - protein, 9 aa, Homo Sapiens
VKTTTVGQM

SEQ ID NO: 1349470 - protein, 9 aa, Homo Sapiens
TGEGNIIEI

SEQ ID NO: 1349471 - protein, 9 aa, Homo Sapiens
LGSIVVIVF

SEQ ID NO: 1349472 - protein, 9 aa, Homo Sapiens
AQTGACALI

SEQ ID NO: 1349473 - protein, 9 aa, Homo Sapiens
DDLCYLFGE

SEQ ID NO: 1349474 - protein, 9 aa, Homo Sapiens
VCGYSEAET

SEQ ID NO: 1349475 - protein, 9 aa, Homo Sapiens
DKNCARVEE

SEQ ID NO: 1349476 - protein, 9 aa, Homo Sapiens
HFDPTVFAA

SEQ ID NO: 1349477 - protein, 9 aa, Homo Sapiens
IDLSVPQIG

SEQ ID NO: 1349478 - protein, 9 aa, Homo Sapiens
ASLIFNQSP

SEQ ID NO: 1349479 - protein, 9 aa, Homo Sapiens
VSQHTELVF

SEQ ID NO: 1349480 - protein, 9 aa, Homo Sapiens
CSYRQMSII

SEQ ID NO: 1349481 - protein, 9 aa, Homo Sapiens
WERVKQGLT

SEQ ID NO: 1349482 - protein, 9 aa, Homo Sapiens
PCPVDRTTI

SEQ ID NO: 1349483 - protein, 9 aa, Homo Sapiens
CITYIRLTQ

SEQ ID NO: 1349484 - protein, 9 aa, Homo Sapiens
RSSPVTKRC

SEQ ID NO: 1349485 - protein, 9 aa, Homo Sapiens
SLHIFKWVP

SEQ ID NO: 1349486 - protein, 9 aa, Homo Sapiens
FIQSATMPH

SEQ ID NO: 1349487 - protein, 9 aa, Homo Sapiens
RRNITVGLG

SEQ ID NO: 1349488 - protein, 9 aa, Homo Sapiens
FDVHILPPS

SEQ ID NO: 1349489 - protein, 9 aa, Homo Sapiens
LSIHHLTLE

SEQ ID NO: 1349490 - protein, 9 aa, Homo Sapiens
RRSTAGTSR

SEQ ID NO: 1349491 - protein, 9 aa, Homo Sapiens
RIHVRSRGG

SEQ ID NO: 1349492 - protein, 9 aa, Homo Sapiens
QDGRMNYEE

SEQ ID NO: 1349493 - protein, 9 aa, Homo Sapiens
RITGKGGKT

SEQ ID NO: 1349494 - protein, 9 aa, Homo Sapiens
GWHDTEDAG

SEQ ID NO: 1349495 - protein, 9 aa, Homo Sapiens
QATTEANNL

SEQ ID NO: 1349496 - protein, 9 aa, Homo Sapiens
HFLIKLEVP

SEQ ID NO: 1349497 - protein, 9 aa, Homo Sapiens
RVQGMPVAS

SEQ ID NO: 1349498 - protein, 9 aa, Homo Sapiens
FKHLIYPLL

SEQ ID NO: 1349499 - protein, 9 aa, Homo Sapiens
ANATCLHKL

SEQ ID NO: 1349500 - protein, 9 aa, Homo Sapiens
RESKNTQDM

SEQ ID NO: 1349501 - protein, 9 aa, Homo Sapiens
PLSIGPHLH

SEQ ID NO: 1349502 - protein, 9 aa, Homo Sapiens
SGKAEFPDE

SEQ ID NO: 1349503 - protein, 9 aa, Homo Sapiens
PPTATSLID

SEQ ID NO: 1349504 - protein, 9 aa, Homo Sapiens
GAVHASVIL

SEQ ID NO: 1349505 - protein, 9 aa, Homo Sapiens
KNQVKEALM

SEQ ID NO: 1349506 - protein, 9 aa, Homo Sapiens
VEANTKYPG

SEQ ID NO: 1349507 - protein, 9 aa, Homo Sapiens
TPTSSCTGA

SEQ ID NO: 1349508 - protein, 9 aa, Homo Sapiens
LHEAAHQNN

SEQ ID NO: 1349509 - protein, 9 aa, Homo Sapiens
IHHCAKYVS

SEQ ID NO: 1349510 - protein, 9 aa, Homo Sapiens
TLHDPFGHG

SEQ ID NO: 1349511 - protein, 9 aa, Homo Sapiens
LKVHMKTHN

SEQ ID NO: 1349512 - protein, 9 aa, Homo Sapiens
SLPGSRHRP

SEQ ID NO: 1349513 - protein, 9 aa, Homo Sapiens
LIKGNSVSK

SEQ ID NO: 1349514 - protein, 9 aa, Homo Sapiens
PGEVDNMDG

SEQ ID NO: 1349515 - protein, 9 aa, Homo Sapiens
LADTQVALT

SEQ ID NO: 1349516 - protein, 9 aa, Homo Sapiens
FNHFSYLTV

SEQ ID NO: 1349517 - protein, 9 aa, Homo Sapiens
RPETLVCHE

SEQ ID NO: 1349518 - protein, 9 aa, Homo Sapiens
VTENPEKSI

SEQ ID NO: 1349519 - protein, 9 aa, Homo Sapiens
RPEIHSKEH

SEQ ID NO: 1349520 - protein, 9 aa, Homo Sapiens
IDSNSTIPV

SEQ ID NO: 1349521 - protein, 9 aa, Homo Sapiens
LKKVVPYNR

SEQ ID NO: 1349522 - protein, 9 aa, Homo Sapiens
APRAETSPS

SEQ ID NO: 1349523 - protein, 9 aa, Homo Sapiens
EVIMLFCET

SEQ ID NO: 1349524 - protein, 9 aa, Homo Sapiens
ENEFVFNAE

SEQ ID NO: 1349525 - protein, 9 aa, Homo Sapiens
MKQIQDAKK

SEQ ID NO: 1349526 - protein, 9 aa, Homo Sapiens
KSLADDKQK

SEQ ID NO: 1349527 - protein, 9 aa, Homo Sapiens
VAALLMEGF

SEQ ID NO: 1349528 - protein, 9 aa, Homo Sapiens
ILPIPWAYI

SEQ ID NO: 1349529 - protein, 9 aa, Homo Sapiens
KRSKPESQG

SEQ ID NO: 1349530 - protein, 9 aa, Homo Sapiens
GYGYHCVTE

SEQ ID NO: 1349531 - protein, 9 aa, Homo Sapiens
MSVFNLSNT

SEQ ID NO: 1349532 - protein, 9 aa, Homo Sapiens
NKHILHKTK

SEQ ID NO: 1349533 - protein, 9 aa, Homo Sapiens
IYEDILFFL

SEQ ID NO: 1349534 - protein, 9 aa, Homo Sapiens
GVTCSHIDV

SEQ ID NO: 1349535 - protein, 9 aa, Homo Sapiens
QITNVQILI

SEQ ID NO: 1349536 - protein, 9 aa, Homo Sapiens
TTSSSLGQQ

SEQ ID NO: 1349537 - protein, 9 aa, Homo Sapiens
GASSAATWA

SEQ ID NO: 1349538 - protein, 9 aa, Homo Sapiens
HYHVQPLED

SEQ ID NO: 1349539 - protein, 9 aa, Homo Sapiens
RARPSEGPH

SEQ ID NO: 1349540 - protein, 9 aa, Homo Sapiens
NHQDYFDYE

SEQ ID NO: 1349541 - protein, 9 aa, Homo Sapiens
SEFSKWLLS

SEQ ID NO: 1349542 - protein, 9 aa, Homo Sapiens
LCWSLHNSK

SEQ ID NO: 1349543 - protein, 9 aa, Homo Sapiens
SYYHNSVGG

SEQ ID NO: 1349544 - protein, 9 aa, Homo Sapiens
IIVFFFIFI

SEQ ID NO: 1349545 - protein, 9 aa, Homo Sapiens
EATYQMAVE

SEQ ID NO: 1349546 - protein, 9 aa, Homo Sapiens
LNPPEALNL

SEQ ID NO: 1349547 - protein, 9 aa, Homo Sapiens
RPSSEKIAV

SEQ ID NO: 1349548 - protein, 9 aa, Homo Sapiens
VITSMNPVY

SEQ ID NO: 1349549 - protein, 9 aa, Homo Sapiens
AEAHVNLDQ

SEQ ID NO: 1349550 - protein, 9 aa, Homo Sapiens
ILEKMRTQV

SEQ ID NO: 1349551 - protein, 9 aa, Homo Sapiens
LGNLCYWLE

SEQ ID NO: 1349552 - protein, 9 aa, Homo Sapiens
LDTLCKHLA

SEQ ID NO: 1349553 - protein, 9 aa, Homo Sapiens
LSPPNEPGT

SEQ ID NO: 1349554 - protein, 9 aa, Homo Sapiens
RSKHLEKVH

SEQ ID NO: 1349555 - protein, 9 aa, Homo Sapiens
LRDLLEEEC

SEQ ID NO: 1349556 - protein, 9 aa, Homo Sapiens
RFSRAATDL

SEQ ID NO: 1349557 - protein, 9 aa, Homo Sapiens
NKARAGSTF

SEQ ID NO: 1349558 - protein, 9 aa, Homo Sapiens
TSLISSLRV

SEQ ID NO: 1349559 - protein, 9 aa, Homo Sapiens
PYMLAVANT

SEQ ID NO: 1349560 - protein, 9 aa, Homo Sapiens
VIIPVKWGE

SEQ ID NO: 1349561 - protein, 9 aa, Homo Sapiens
LSQMTVPIQ

SEQ ID NO: 1349562 - protein, 9 aa, Homo Sapiens
GFNLMNKFL

SEQ ID NO: 1349563 - protein, 9 aa, Homo Sapiens
SPCIEQVQH

SEQ ID NO: 1349564 - protein, 9 aa, Homo Sapiens
VPQELVLFN

SEQ ID NO: 1349565 - protein, 9 aa, Homo Sapiens
PQLGATLFP

SEQ ID NO: 1349566 - protein, 9 aa, Homo Sapiens
IILIKNALN

SEQ ID NO: 1349567 - protein, 9 aa, Homo Sapiens
VLGFALGVG

SEQ ID NO: 1349568 - protein, 9 aa, Homo Sapiens
VQGHPPGSP

SEQ ID NO: 1349569 - protein, 9 aa, Homo Sapiens
AWHFETRKS

SEQ ID NO: 1349570 - protein, 9 aa, Homo Sapiens
HTTPAVEQV

SEQ ID NO: 1349571 - protein, 9 aa, Homo Sapiens
EPGTEEECG

SEQ ID NO: 1349572 - protein, 9 aa, Homo Sapiens
PEEVKKPPV

SEQ ID NO: 1349573 - protein, 9 aa, Homo Sapiens
DECWCPTNS

SEQ ID NO: 1349574 - protein, 9 aa, Homo Sapiens
DTTYNEIVT

SEQ ID NO: 1349575 - protein, 9 aa, Homo Sapiens
QQQRQRQRQ

SEQ ID NO: 1349576 - protein, 9 aa, Homo Sapiens
SPENGSITQ

SEQ ID NO: 1349577 - protein, 9 aa, Homo Sapiens
DESQSQSVW

SEQ ID NO: 1349578 - protein, 9 aa, Homo Sapiens
MALDIDECH

SEQ ID NO: 1349579 - protein, 9 aa, Homo Sapiens
YCMCCGDLL

SEQ ID NO: 1349580 - protein, 9 aa, Homo Sapiens
SLFLLFHSR

SEQ ID NO: 1349581 - protein, 9 aa, Homo Sapiens
QDGLGPCTM

SEQ ID NO: 1349582 - protein, 9 aa, Homo Sapiens
HVLNVAHGR

SEQ ID NO: 1349583 - protein, 9 aa, Homo Sapiens
AVIVAREFG

SEQ ID NO: 1349584 - protein, 9 aa, Homo Sapiens
PLRAEPRPP

SEQ ID NO: 1349585 - protein, 9 aa, Homo Sapiens
LNPDKKMCT

SEQ ID NO: 1349586 - protein, 9 aa, Homo Sapiens
PAVFVRPYP

SEQ ID NO: 1349587 - protein, 9 aa, Homo Sapiens
LSDQGFNLM

SEQ ID NO: 1349588 - protein, 9 aa, Homo Sapiens
REPQPAVSE

SEQ ID NO: 1349589 - protein, 9 aa, Homo Sapiens
ASIMGPPGL

SEQ ID NO: 1349590 - protein, 9 aa, Homo Sapiens
AASLSSRAE

SEQ ID NO: 1349591 - protein, 9 aa, Homo Sapiens
MVMRGEGTF

SEQ ID NO: 1349592 - protein, 9 aa, Homo Sapiens
PIGPDTVAY

SEQ ID NO: 1349593 - protein, 9 aa, Homo Sapiens
LHRLQADYA

SEQ ID NO: 1349594 - protein, 9 aa, Homo Sapiens
QDQLSCSWT

SEQ ID NO: 1349595 - protein, 9 aa, Homo Sapiens
DSYDMILAG

SEQ ID NO: 1349596 - protein, 9 aa, Homo Sapiens
TYAPLAFQY

SEQ ID NO: 1349597 - protein, 9 aa, Homo Sapiens
SSVSHKNAK

SEQ ID NO: 1349598 - protein, 9 aa, Homo Sapiens
DNMFCAQLQ

SEQ ID NO: 1349599 - protein, 9 aa, Homo Sapiens
IHTPRASNE

SEQ ID NO: 1349600 - protein, 9 aa, Homo Sapiens
IFSLFMLTF

SEQ ID NO: 1349601 - protein, 9 aa, Homo Sapiens
KHSVLAKEL

SEQ ID NO: 1349602 - protein, 9 aa, Homo Sapiens
PSQVADTGF

SEQ ID NO: 1349603 - protein, 9 aa, Homo Sapiens
FMCIEDISG

SEQ ID NO: 1349604 - protein, 9 aa, Homo Sapiens
QVPAVLPRL

SEQ ID NO: 1349605 - protein, 9 aa, Homo Sapiens
PCVLPHVDF

SEQ ID NO: 1349606 - protein, 9 aa, Homo Sapiens
AAWRRCNTL

SEQ ID NO: 1349607 - protein, 9 aa, Homo Sapiens
LFRIELDKY

SEQ ID NO: 1349608 - protein, 9 aa, Homo Sapiens
LVLGVQWAI

SEQ ID NO: 1349609 - protein, 9 aa, Homo Sapiens
QPPAWYGNQ

SEQ ID NO: 1349610 - protein, 9 aa, Homo Sapiens
GSKKKSIRA

SEQ ID NO: 1349611 - protein, 9 aa, Homo Sapiens
QHKSNSIKW

SEQ ID NO: 1349612 - protein, 9 aa, Homo Sapiens
DLVLKDILH

SEQ ID NO: 1349613 - protein, 9 aa, Homo Sapiens
PPPSPMDPS

SEQ ID NO: 1349614 - protein, 9 aa, Homo Sapiens
RLWKKSPTT

SEQ ID NO: 1349615 - protein, 9 aa, Homo Sapiens
SLGQPSSET

SEQ ID NO: 1349616 - protein, 9 aa, Homo Sapiens
HTDSNEQIS

SEQ ID NO: 1349617 - protein, 9 aa, Homo Sapiens
LQIILFFFL

SEQ ID NO: 1349618 - protein, 9 aa, Homo Sapiens
GLPELQPAV

SEQ ID NO: 1349619 - protein, 9 aa, Homo Sapiens
FFARDNTTN

SEQ ID NO: 1349620 - protein, 9 aa, Homo Sapiens
LVNLTNLLI

SEQ ID NO: 1349621 - protein, 9 aa, Homo Sapiens
VLMALRRGS

SEQ ID NO: 1349622 - protein, 9 aa, Homo Sapiens
YFSRAEVVE

SEQ ID NO: 1349623 - protein, 9 aa, Homo Sapiens
IPENDRLAS

SEQ ID NO: 1349624 - protein, 9 aa, Homo Sapiens
GCRPRTFCL

SEQ ID NO: 1349625 - protein, 9 aa, Homo Sapiens
YNSRRVLYA

SEQ ID NO: 1349626 - protein, 9 aa, Homo Sapiens
SYTANLVAF

SEQ ID NO: 1349627 - protein, 9 aa, Homo Sapiens
ICEYCDRAF

SEQ ID NO: 1349628 - protein, 9 aa, Homo Sapiens
NQYIHISSS

SEQ ID NO: 1349629 - protein, 9 aa, Homo Sapiens
CRMFFIPLC

SEQ ID NO: 1349630 - protein, 9 aa, Homo Sapiens
RQKVHEEAN

SEQ ID NO: 1349631 - protein, 9 aa, Homo Sapiens
AEEVASVLA

SEQ ID NO: 1349632 - protein, 9 aa, Homo Sapiens
WKFCRDIQP

SEQ ID NO: 1349633 - protein, 9 aa, Homo Sapiens
VVKASYPKR

SEQ ID NO: 1349634 - protein, 9 aa, Homo Sapiens
CDEAAGRYP

SEQ ID NO: 1349635 - protein, 9 aa, Homo Sapiens
PVISCRWWG

SEQ ID NO: 1349636 - protein, 9 aa, Homo Sapiens
GPAGECGAP

SEQ ID NO: 1349637 - protein, 9 aa, Homo Sapiens
VHISQHAPS

SEQ ID NO: 1349638 - protein, 9 aa, Homo Sapiens
VTCHDGASS

SEQ ID NO: 1349639 - protein, 9 aa, Homo Sapiens
GAILQQVVN

SEQ ID NO: 1349640 - protein, 9 aa, Homo Sapiens
RSSNTFPVW

SEQ ID NO: 1349641 - protein, 9 aa, Homo Sapiens
EEMECIVTT

SEQ ID NO: 1349642 - protein, 9 aa, Homo Sapiens
AEYANDSLA

SEQ ID NO: 1349643 - protein, 9 aa, Homo Sapiens
IIHLAEQPE

SEQ ID NO: 1349644 - protein, 9 aa, Homo Sapiens
LAEGEEEKS

SEQ ID NO: 1349645 - protein, 9 aa, Homo Sapiens
EQLSLVLID

SEQ ID NO: 1349646 - protein, 9 aa, Homo Sapiens
CPPKYYTYK

SEQ ID NO: 1349647 - protein, 9 aa, Homo Sapiens
KKKKTKPEY

SEQ ID NO: 1349648 - protein, 9 aa, Homo Sapiens
RSAISEQII

SEQ ID NO: 1349649 - protein, 9 aa, Homo Sapiens
CGRGFSNKL

SEQ ID NO: 1349650 - protein, 9 aa, Homo Sapiens
KAHDNSCPQ

SEQ ID NO: 1349651 - protein, 9 aa, Homo Sapiens
GDGSSTTYN

SEQ ID NO: 1349652 - protein, 9 aa, Homo Sapiens
VLHNMMVTG

SEQ ID NO: 1349653 - protein, 9 aa, Homo Sapiens
LEVESDNPE

SEQ ID NO: 1349654 - protein, 9 aa, Homo Sapiens
SNSQVQVVL

SEQ ID NO: 1349655 - protein, 9 aa, Homo Sapiens
GQKCGGTYQ

SEQ ID NO: 1349656 - protein, 9 aa, Homo Sapiens
DTSSSTIVS

SEQ ID NO: 1349657 - protein, 9 aa, Homo Sapiens
TLAMGPGES

SEQ ID NO: 1349658 - protein, 9 aa, Homo Sapiens
SGGGMVRLE

SEQ ID NO: 1349659 - protein, 9 aa, Homo Sapiens
CLNRILCLI

SEQ ID NO: 1349660 - protein, 9 aa, Homo Sapiens
VSASTDGVD

SEQ ID NO: 1349661 - protein, 9 aa, Homo Sapiens
HKITGDHLI

SEQ ID NO: 1349662 - protein, 9 aa, Homo Sapiens
EITAYNRHT

SEQ ID NO: 1349663 - protein, 9 aa, Homo Sapiens
HDTILFLYC

SEQ ID NO: 1349664 - protein, 9 aa, Homo Sapiens
LCVGVGSFT

SEQ ID NO: 1349665 - protein, 9 aa, Homo Sapiens
KPFRMSTHL

SEQ ID NO: 1349666 - protein, 9 aa, Homo Sapiens
KDYLQPWCC

SEQ ID NO: 1349667 - protein, 9 aa, Homo Sapiens
LAYLQRITL

SEQ ID NO: 1349668 - protein, 9 aa, Homo Sapiens
DRTKTPIIT

SEQ ID NO: 1349669 - protein, 9 aa, Homo Sapiens
RLNLTQHIR

SEQ ID NO: 1349670 - protein, 9 aa, Homo Sapiens
YGAWKHHYI

SEQ ID NO: 1349671 - protein, 9 aa, Homo Sapiens
ENCICVNMS

SEQ ID NO: 1349672 - protein, 9 aa, Homo Sapiens
DVHILPPSQ

SEQ ID NO: 1349673 - protein, 9 aa, Homo Sapiens
EVYTWNLDT

SEQ ID NO: 1349674 - protein, 9 aa, Homo Sapiens
MCLWKNHQQ

SEQ ID NO: 1349675 - protein, 9 aa, Homo Sapiens
DTPPWTGSL

SEQ ID NO: 1349676 - protein, 9 aa, Homo Sapiens
RSLGLDQKM

SEQ ID NO: 1349677 - protein, 9 aa, Homo Sapiens
HCWLSPPLG

SEQ ID NO: 1349678 - protein, 9 aa, Homo Sapiens
VRALQNTLK

SEQ ID NO: 1349679 - protein, 9 aa, Homo Sapiens
QIHVDLHLL

SEQ ID NO: 1349680 - protein, 9 aa, Homo Sapiens
PWTGSLPPT

SEQ ID NO: 1349681 - protein, 9 aa, Homo Sapiens
TWDPRGYGH

SEQ ID NO: 1349682 - protein, 9 aa, Homo Sapiens
STLDQPSFV

SEQ ID NO: 1349683 - protein, 9 aa, Homo Sapiens
PAKKQRKPK

SEQ ID NO: 1349684 - protein, 9 aa, Homo Sapiens
EELKQLLHR

SEQ ID NO: 1349685 - protein, 9 aa, Homo Sapiens
GQDCQMCSS

SEQ ID NO: 1349686 - protein, 9 aa, Homo Sapiens
ETQRQKAIH

SEQ ID NO: 1349687 - protein, 9 aa, Homo Sapiens
PSCRAFRCS

SEQ ID NO: 1349688 - protein, 9 aa, Homo Sapiens
AVWGLSKGF

SEQ ID NO: 1349689 - protein, 9 aa, Homo Sapiens
KKCQRRILL

SEQ ID NO: 1349690 - protein, 9 aa, Homo Sapiens
DQCPAGPKG

SEQ ID NO: 1349691 - protein, 9 aa, Homo Sapiens
ERVIARLAV

SEQ ID NO: 1349692 - protein, 9 aa, Homo Sapiens
QAHVREQLS

SEQ ID NO: 1349693 - protein, 9 aa, Homo Sapiens
DSTSCKLTD

SEQ ID NO: 1349694 - protein, 9 aa, Homo Sapiens
TIIITLSWL

SEQ ID NO: 1349695 - protein, 9 aa, Homo Sapiens
FSMNASLEI

SEQ ID NO: 1349696 - protein, 9 aa, Homo Sapiens
EGECSPHKN

SEQ ID NO: 1349697 - protein, 9 aa, Homo Sapiens
GEKIYVCIE

SEQ ID NO: 1349698 - protein, 9 aa, Homo Sapiens
EAAKWNQVR

SEQ ID NO: 1349699 - protein, 9 aa, Homo Sapiens
SLRNLSKPY

SEQ ID NO: 1349700 - protein, 9 aa, Homo Sapiens
DGQEMGLSN

SEQ ID NO: 1349701 - protein, 9 aa, Homo Sapiens
HDPFGHGYG

SEQ ID NO: 1349702 - protein, 9 aa, Homo Sapiens
EERTLVNDG

SEQ ID NO: 1349703 - protein, 9 aa, Homo Sapiens
YHTCLASLS

SEQ ID NO: 1349704 - protein, 9 aa, Homo Sapiens
LCWGGGHPL

SEQ ID NO: 1349705 - protein, 9 aa, Homo Sapiens
YCYNTEGGV

SEQ ID NO: 1349706 - protein, 9 aa, Homo Sapiens
TNSISVFQV

SEQ ID NO: 1349707 - protein, 9 aa, Homo Sapiens
LLNIPLELM

SEQ ID NO: 1349708 - protein, 9 aa, Homo Sapiens
LPELNTAQQ

SEQ ID NO: 1349709 - protein, 9 aa, Homo Sapiens
TPRDEEPWP

SEQ ID NO: 1349710 - protein, 9 aa, Homo Sapiens
LRLPPTPPA

SEQ ID NO: 1349711 - protein, 9 aa, Homo Sapiens
QLSMKSSLE

SEQ ID NO: 1349712 - protein, 9 aa, Homo Sapiens
LNAVLTSLL

SEQ ID NO: 1349713 - protein, 9 aa, Homo Sapiens
ANNYNISNV

SEQ ID NO: 1349714 - protein, 9 aa, Homo Sapiens
VADNCDETE

SEQ ID NO: 1349715 - protein, 9 aa, Homo Sapiens
AERYTNFCK

SEQ ID NO: 1349716 - protein, 9 aa, Homo Sapiens
HLDPLKSLG

SEQ ID NO: 1349717 - protein, 9 aa, Homo Sapiens
PFCYFINDL

SEQ ID NO: 1349718 - protein, 9 aa, Homo Sapiens
IVGDDCGHI

SEQ ID NO: 1349719 - protein, 9 aa, Homo Sapiens
CWAMRSYTG

SEQ ID NO: 1349720 - protein, 9 aa, Homo Sapiens
RHIDDREES

SEQ ID NO: 1349721 - protein, 9 aa, Homo Sapiens
PCAPMSVPH

SEQ ID NO: 1349722 - protein, 9 aa, Homo Sapiens
PKKCPLLLV

SEQ ID NO: 1349723 - protein, 9 aa, Homo Sapiens
GDYIIPKNM

SEQ ID NO: 1349724 - protein, 9 aa, Homo Sapiens
YTWNLDTLA

SEQ ID NO: 1349725 - protein, 9 aa, Homo Sapiens
LDRIFRWLG

SEQ ID NO: 1349726 - protein, 9 aa, Homo Sapiens
GIVRSRGHV

SEQ ID NO: 1349727 - protein, 9 aa, Homo Sapiens
CGTCDLVLK

SEQ ID NO: 1349728 - protein, 9 aa, Homo Sapiens
EVWELFPNQ

SEQ ID NO: 1349729 - protein, 9 aa, Homo Sapiens
PKGISRKQF

SEQ ID NO: 1349730 - protein, 9 aa, Homo Sapiens
HEQTAAALK

SEQ ID NO: 1349731 - protein, 9 aa, Homo Sapiens
EDIRKKKDV

SEQ ID NO: 1349732 - protein, 9 aa, Homo Sapiens
SVPPRRVGI

SEQ ID NO: 1349733 - protein, 9 aa, Homo Sapiens
CLMYDILNW

SEQ ID NO: 1349734 - protein, 9 aa, Homo Sapiens
PQAELGGFH

SEQ ID NO: 1349735 - protein, 9 aa, Homo Sapiens
SKMSEAEEN

SEQ ID NO: 1349736 - protein, 9 aa, Homo Sapiens
QTNTWNFIE

SEQ ID NO: 1349737 - protein, 9 aa, Homo Sapiens
QMLLAHLAR

SEQ ID NO: 1349738 - protein, 9 aa, Homo Sapiens
PPGLPLTHT

SEQ ID NO: 1349739 - protein, 9 aa, Homo Sapiens
FTSCSKDCT

SEQ ID NO: 1349740 - protein, 9 aa, Homo Sapiens
GGGGDTGST

SEQ ID NO: 1349741 - protein, 9 aa, Homo Sapiens
HVHIFLADL

SEQ ID NO: 1349742 - protein, 9 aa, Homo Sapiens
TSLFANRWG

SEQ ID NO: 1349743 - protein, 9 aa, Homo Sapiens
TIITKSFAR

SEQ ID NO: 1349744 - protein, 9 aa, Homo Sapiens
EYHTTRERV

SEQ ID NO: 1349745 - protein, 9 aa, Homo Sapiens
KPSVMPAPP

SEQ ID NO: 1349746 - protein, 9 aa, Homo Sapiens
DLEDRLTKF

SEQ ID NO: 1349747 - protein, 9 aa, Homo Sapiens
NEGIPDGVC

SEQ ID NO: 1349748 - protein, 9 aa, Homo Sapiens
KSEKKKRRW

SEQ ID NO: 1349749 - protein, 9 aa, Homo Sapiens
LEDEPHDTV

SEQ ID NO: 1349750 - protein, 9 aa, Homo Sapiens
KFRNWINEA

SEQ ID NO: 1349751 - protein, 9 aa, Homo Sapiens
AIMTFFKKS

SEQ ID NO: 1349752 - protein, 9 aa, Homo Sapiens
PIKLARYRG

SEQ ID NO: 1349753 - protein, 9 aa, Homo Sapiens
SKRKLGCHV

SEQ ID NO: 1349754 - protein, 9 aa, Homo Sapiens
MSRTETAST

SEQ ID NO: 1349755 - protein, 9 aa, Homo Sapiens
KDEEGVTLE

SEQ ID NO: 1349756 - protein, 9 aa, Homo Sapiens
VSKYIMQYI

SEQ ID NO: 1349757 - protein, 9 aa, Homo Sapiens
LVTNDGISI

SEQ ID NO: 1349758 - protein, 9 aa, Homo Sapiens
TDRLGRRQC

SEQ ID NO: 1349759 - protein, 9 aa, Homo Sapiens
YELRIFGFI

SEQ ID NO: 1349760 - protein, 9 aa, Homo Sapiens
ERFSRAATD

SEQ ID NO: 1349761 - protein, 9 aa, Homo Sapiens
IPNEIIDMV

SEQ ID NO: 1349762 - protein, 9 aa, Homo Sapiens
GLQQVVDMK

SEQ ID NO: 1349763 - protein, 9 aa, Homo Sapiens
RDSLKHFSF

SEQ ID NO: 1349764 - protein, 9 aa, Homo Sapiens
IAWPFITVP

SEQ ID NO: 1349765 - protein, 9 aa, Homo Sapiens
DKMCKAVAE

SEQ ID NO: 1349766 - protein, 9 aa, Homo Sapiens
CDKVHISDS

SEQ ID NO: 1349767 - protein, 9 aa, Homo Sapiens
DESALFLHQ

SEQ ID NO: 1349768 - protein, 9 aa, Homo Sapiens
SSFCTSPPS

SEQ ID NO: 1349769 - protein, 9 aa, Homo Sapiens
QDLFLLRKD

SEQ ID NO: 1349770 - protein, 9 aa, Homo Sapiens
GPPHDTLCL

SEQ ID NO: 1349771 - protein, 9 aa, Homo Sapiens
EQLWLLVCE

SEQ ID NO: 1349772 - protein, 9 aa, Homo Sapiens
SGPGDDFFS

SEQ ID NO: 1349773 - protein, 9 aa, Homo Sapiens
ATLARTQQL

SEQ ID NO: 1349774 - protein, 9 aa, Homo Sapiens
KDVCIEAYT

SEQ ID NO: 1349775 - protein, 9 aa, Homo Sapiens
PSFGMLNVT

SEQ ID NO: 1349776 - protein, 9 aa, Homo Sapiens
VSIKKMKQA

SEQ ID NO: 1349777 - protein, 9 aa, Homo Sapiens
FLPFTSTLP

SEQ ID NO: 1349778 - protein, 9 aa, Homo Sapiens
SKMACVAQN

SEQ ID NO: 1349779 - protein, 9 aa, Homo Sapiens
KVQMYRCYR

SEQ ID NO: 1349780 - protein, 9 aa, Homo Sapiens
FSEVIRFNA

SEQ ID NO: 1349781 - protein, 9 aa, Homo Sapiens
SNKCVVAFY

SEQ ID NO: 1349782 - protein, 9 aa, Homo Sapiens
HAFTPCGYV

SEQ ID NO: 1349783 - protein, 9 aa, Homo Sapiens
AIMRAFQHN

SEQ ID NO: 1349784 - protein, 9 aa, Homo Sapiens
ATAQEKQFP

SEQ ID NO: 1349785 - protein, 9 aa, Homo Sapiens
DRSNNQFEN

SEQ ID NO: 1349786 - protein, 9 aa, Homo Sapiens
SLKRTALQR

SEQ ID NO: 1349787 - protein, 9 aa, Homo Sapiens
DSLNTTVNL

SEQ ID NO: 1349788 - protein, 9 aa, Homo Sapiens
RLHVTYEGI

SEQ ID NO: 1349789 - protein, 9 aa, Homo Sapiens
SFQIILNSL

SEQ ID NO: 1349790 - protein, 9 aa, Homo Sapiens
SKDVIISPH

SEQ ID NO: 1349791 - protein, 9 aa, Homo Sapiens
DLSVPQIGV

SEQ ID NO: 1349792 - protein, 9 aa, Homo Sapiens
LWRSSSLWK

SEQ ID NO: 1349793 - protein, 9 aa, Homo Sapiens
LTQPELDKE

SEQ ID NO: 1349794 - protein, 9 aa, Homo Sapiens
PTELGGCTS

SEQ ID NO: 1349795 - protein, 9 aa, Homo Sapiens
QQNCLRSST

SEQ ID NO: 1349796 - protein, 9 aa, Homo Sapiens
ELDGCLQMA

SEQ ID NO: 1349797 - protein, 9 aa, Homo Sapiens
AVLHRLAAS

SEQ ID NO: 1349798 - protein, 9 aa, Homo Sapiens
FTLTVASLH

SEQ ID NO: 1349799 - protein, 9 aa, Homo Sapiens
LGGHPISEL

SEQ ID NO: 1349800 - protein, 9 aa, Homo Sapiens
KGCDNIIDL

SEQ ID NO: 1349801 - protein, 9 aa, Homo Sapiens
MQSPCWQAV

SEQ ID NO: 1349802 - protein, 9 aa, Homo Sapiens
PKDVFETRQ

SEQ ID NO: 1349803 - protein, 9 aa, Homo Sapiens
VRYACNVIE

SEQ ID NO: 1349804 - protein, 9 aa, Homo Sapiens
GIIIATKNG

SEQ ID NO: 1349805 - protein, 9 aa, Homo Sapiens
THPCDLKDI

SEQ ID NO: 1349806 - protein, 9 aa, Homo Sapiens
FRTQIFLDN

SEQ ID NO: 1349807 - protein, 9 aa, Homo Sapiens
GRAITSLRA

SEQ ID NO: 1349808 - protein, 9 aa, Homo Sapiens
NDERIQASK

SEQ ID NO: 1349809 - protein, 9 aa, Homo Sapiens
AVFWCLLMV

SEQ ID NO: 1349810 - protein, 9 aa, Homo Sapiens
PFLTSTNKS

SEQ ID NO: 1349811 - protein, 9 aa, Homo Sapiens
RQRQQQQRR

SEQ ID NO: 1349812 - protein, 9 aa, Homo Sapiens
KRIARTILV

SEQ ID NO: 1349813 - protein, 9 aa, Homo Sapiens
HTISSLSKV

SEQ ID NO: 1349814 - protein, 9 aa, Homo Sapiens
IWLDNISVT

SEQ ID NO: 1349815 - protein, 9 aa, Homo Sapiens
PSQLGAVCA

SEQ ID NO: 1349816 - protein, 9 aa, Homo Sapiens
TRARSPTSA

SEQ ID NO: 1349817 - protein, 9 aa, Homo Sapiens
QMVCNSDHV

SEQ ID NO: 1349818 - protein, 9 aa, Homo Sapiens
LHVAECPCG

SEQ ID NO: 1349819 - protein, 9 aa, Homo Sapiens
IIFTRKEDL

SEQ ID NO: 1349820 - protein, 9 aa, Homo Sapiens
TREDIWNAA

SEQ ID NO: 1349821 - protein, 9 aa, Homo Sapiens
HSLPCSGAR

SEQ ID NO: 1349822 - protein, 9 aa, Homo Sapiens
CCIPNHSNS

SEQ ID NO: 1349823 - protein, 9 aa, Homo Sapiens
DVIGAVNSL

SEQ ID NO: 1349824 - protein, 9 aa, Homo Sapiens
MLPIHLQSS

SEQ ID NO: 1349825 - protein, 9 aa, Homo Sapiens
RLRGHVAVW

SEQ ID NO: 1349826 - protein, 9 aa, Homo Sapiens
QELRDVWGN

SEQ ID NO: 1349827 - protein, 9 aa, Homo Sapiens
SPSFTELQP

SEQ ID NO: 1349828 - protein, 9 aa, Homo Sapiens
ASCFSGMTG

SEQ ID NO: 1349829 - protein, 9 aa, Homo Sapiens
QYLHQIHAN

SEQ ID NO: 1349830 - protein, 9 aa, Homo Sapiens
MRMVIGVIV

SEQ ID NO: 1349831 - protein, 9 aa, Homo Sapiens
HCEIRDQEM

SEQ ID NO: 1349832 - protein, 9 aa, Homo Sapiens
LDSGTSVEE

SEQ ID NO: 1349833 - protein, 9 aa, Homo Sapiens
TRSRTNLMD

SEQ ID NO: 1349834 - protein, 9 aa, Homo Sapiens
SCMQYAPNT

SEQ ID NO: 1349835 - protein, 9 aa, Homo Sapiens
SPFFPNMYP

SEQ ID NO: 1349836 - protein, 9 aa, Homo Sapiens
EETSQGRTK

SEQ ID NO: 1349837 - protein, 9 aa, Homo Sapiens
DRILMKVTA

SEQ ID NO: 1349838 - protein, 9 aa, Homo Sapiens
SSLEKPNGA

SEQ ID NO: 1349839 - protein, 9 aa, Homo Sapiens
GHCPVKTCA

SEQ ID NO: 1349840 - protein, 9 aa, Homo Sapiens
GKQPKEDIP

SEQ ID NO: 1349841 - protein, 9 aa, Homo Sapiens
ASVASGSET

SEQ ID NO: 1349842 - protein, 9 aa, Homo Sapiens
TPGAQQQDI

SEQ ID NO: 1349843 - protein, 9 aa, Homo Sapiens
HTAQKSGDG

SEQ ID NO: 1349844 - protein, 9 aa, Homo Sapiens
YPYGDPHMI

SEQ ID NO: 1349845 - protein, 9 aa, Homo Sapiens
WGFSMGINY

SEQ ID NO: 1349846 - protein, 9 aa, Homo Sapiens
NSSRDLAFL

SEQ ID NO: 1349847 - protein, 9 aa, Homo Sapiens
RKRHATEKQ

SEQ ID NO: 1349848 - protein, 9 aa, Homo Sapiens
SSSSLSSHV

SEQ ID NO: 1349849 - protein, 9 aa, Homo Sapiens
ATINTSCHP

SEQ ID NO: 1349850 - protein, 9 aa, Homo Sapiens
VHTESLLGL

SEQ ID NO: 1349851 - protein, 9 aa, Homo Sapiens
ALAAGASSA

SEQ ID NO: 1349852 - protein, 9 aa, Homo Sapiens
QGTHIGCRF

SEQ ID NO: 1349853 - protein, 9 aa, Homo Sapiens
LNYMLCPAP

SEQ ID NO: 1349854 - protein, 9 aa, Homo Sapiens
EKIRIRDRG

SEQ ID NO: 1349855 - protein, 9 aa, Homo Sapiens
PASHEDNPK

SEQ ID NO: 1349856 - protein, 9 aa, Homo Sapiens
GAARARTCS

SEQ ID NO: 1349857 - protein, 9 aa, Homo Sapiens
EENVRHIAE

SEQ ID NO: 1349858 - protein, 9 aa, Homo Sapiens
GFGYGYNSC

SEQ ID NO: 1349859 - protein, 9 aa, Homo Sapiens
VSNRSLLTF

SEQ ID NO: 1349860 - protein, 9 aa, Homo Sapiens
LRCCHIRFT

SEQ ID NO: 1349861 - protein, 9 aa, Homo Sapiens
QLIPKRSSL

SEQ ID NO: 1349862 - protein, 9 aa, Homo Sapiens
LAVTDDDNE

SEQ ID NO: 1349863 - protein, 9 aa, Homo Sapiens
TGLVNGAVA

SEQ ID NO: 1349864 - protein, 9 aa, Homo Sapiens
AGARAKGSS

SEQ ID NO: 1349865 - protein, 9 aa, Homo Sapiens
SEFYKVQGP

SEQ ID NO: 1349866 - protein, 9 aa, Homo Sapiens
SFYHPYSPA

SEQ ID NO: 1349867 - protein, 9 aa, Homo Sapiens
CEENTKVFV

SEQ ID NO: 1349868 - protein, 9 aa, Homo Sapiens
YKQCLPPRT

SEQ ID NO: 1349869 - protein, 9 aa, Homo Sapiens
IQPYEITLV

SEQ ID NO: 1349870 - protein, 9 aa, Homo Sapiens
SHCFRTHEM

SEQ ID NO: 1349871 - protein, 9 aa, Homo Sapiens
TLSTDTLCK

SEQ ID NO: 1349872 - protein, 9 aa, Homo Sapiens
MMCYDDHTV

SEQ ID NO: 1349873 - protein, 9 aa, Homo Sapiens
IDLSQMTVP

SEQ ID NO: 1349874 - protein, 9 aa, Homo Sapiens
QLLLKMEIG

SEQ ID NO: 1349875 - protein, 9 aa, Homo Sapiens
NPQTALYTA

SEQ ID NO: 1349876 - protein, 9 aa, Homo Sapiens
RKEENTRQK

SEQ ID NO: 1349877 - protein, 9 aa, Homo Sapiens
WALQMQHKH

SEQ ID NO: 1349878 - protein, 9 aa, Homo Sapiens
APKILRLVQ

SEQ ID NO: 1349879 - protein, 9 aa, Homo Sapiens
DMALNIHTF

SEQ ID NO: 1349880 - protein, 9 aa, Homo Sapiens
AMLQLSLHR

SEQ ID NO: 1349881 - protein, 9 aa, Homo Sapiens
RHRIQSKHH

SEQ ID NO: 1349882 - protein, 9 aa, Homo Sapiens
REFKSEKGC

SEQ ID NO: 1349883 - protein, 9 aa, Homo Sapiens
HTWEEELTR

SEQ ID NO: 1349884 - protein, 9 aa, Homo Sapiens
IVSTVHADY

SEQ ID NO: 1349885 - protein, 9 aa, Homo Sapiens
IAPLQGPPF

SEQ ID NO: 1349886 - protein, 9 aa, Homo Sapiens
VPVNTDLFG

SEQ ID NO: 1349887 - protein, 9 aa, Homo Sapiens
SSSILPIPW

SEQ ID NO: 1349888 - protein, 9 aa, Homo Sapiens
ELAQYLNRN

SEQ ID NO: 1349889 - protein, 9 aa, Homo Sapiens
EHILQFLCA

SEQ ID NO: 1349890 - protein, 9 aa, Homo Sapiens
IPNLVGIHG

SEQ ID NO: 1349891 - protein, 9 aa, Homo Sapiens
HTKAGLYWG

SEQ ID NO: 1349892 - protein, 9 aa, Homo Sapiens
CVSILCYKF

SEQ ID NO: 1349893 - protein, 9 aa, Homo Sapiens
TMILDLCHK

SEQ ID NO: 1349894 - protein, 9 aa, Homo Sapiens
DVMSYDRYV

SEQ ID NO: 1349895 - protein, 9 aa, Homo Sapiens
PPGMGAQLW

SEQ ID NO: 1349896 - protein, 9 aa, Homo Sapiens
VSRPVDYDF

SEQ ID NO: 1349897 - protein, 9 aa, Homo Sapiens
WRLHSVQGL

SEQ ID NO: 1349898 - protein, 9 aa, Homo Sapiens
VMCFERFGR

SEQ ID NO: 1349899 - protein, 9 aa, Homo Sapiens
TLSIKKCPI

SEQ ID NO: 1349900 - protein, 9 aa, Homo Sapiens
MPMRSKAKR

SEQ ID NO: 1349901 - protein, 9 aa, Homo Sapiens
HLINEYRSH

SEQ ID NO: 1349902 - protein, 9 aa, Homo Sapiens
SENTAEGTS

SEQ ID NO: 1349903 - protein, 9 aa, Homo Sapiens
HLYPGPMVT

SEQ ID NO: 1349904 - protein, 9 aa, Homo Sapiens
PKCTCIVDG

SEQ ID NO: 1349905 - protein, 9 aa, Homo Sapiens
VLPLPEDNY

SEQ ID NO: 1349906 - protein, 9 aa, Homo Sapiens
SPAFHILSV

SEQ ID NO: 1349907 - protein, 9 aa, Homo Sapiens
SSPLLCCAL

SEQ ID NO: 1349908 - protein, 9 aa, Homo Sapiens
YMEEPSQHD

SEQ ID NO: 1349909 - protein, 9 aa, Homo Sapiens
YYKNHYHQS

SEQ ID NO: 1349910 - protein, 9 aa, Homo Sapiens
VSFICFTPY

SEQ ID NO: 1349911 - protein, 9 aa, Homo Sapiens
EQQVQFYEM

SEQ ID NO: 1349912 - protein, 9 aa, Homo Sapiens
VPARQQGLR

SEQ ID NO: 1349913 - protein, 9 aa, Homo Sapiens
QGGKACAKS

SEQ ID NO: 1349914 - protein, 9 aa, Homo Sapiens
THIGCRFDD

SEQ ID NO: 1349915 - protein, 9 aa, Homo Sapiens
VWAAAAHKV

SEQ ID NO: 1349916 - protein, 9 aa, Homo Sapiens
LGGRTIITK

SEQ ID NO: 1349917 - protein, 9 aa, Homo Sapiens
DDLGYGYDC

SEQ ID NO: 1349918 - protein, 9 aa, Homo Sapiens
ILRMDSTNT

SEQ ID NO: 1349919 - protein, 9 aa, Homo Sapiens
RSAMITDYM

SEQ ID NO: 1349920 - protein, 9 aa, Homo Sapiens
SNLKRVSAL

SEQ ID NO: 1349921 - protein, 9 aa, Homo Sapiens
FEKQCNNGI

SEQ ID NO: 1349922 - protein, 9 aa, Homo Sapiens
FIPAVRDID

SEQ ID NO: 1349923 - protein, 9 aa, Homo Sapiens
FTHLKYVSI

SEQ ID NO: 1349924 - protein, 9 aa, Homo Sapiens
IAHPGCVNL

SEQ ID NO: 1349925 - protein, 9 aa, Homo Sapiens
VVKKVETER

SEQ ID NO: 1349926 - protein, 9 aa, Homo Sapiens
GDKCDDDDD

SEQ ID NO: 1349927 - protein, 9 aa, Homo Sapiens
HEIMPGGNM

SEQ ID NO: 1349928 - protein, 9 aa, Homo Sapiens
SFIHHWRSY

SEQ ID NO: 1349929 - protein, 9 aa, Homo Sapiens
EIGTVVVLR

SEQ ID NO: 1349930 - protein, 9 aa, Homo Sapiens
QKINNENAD

SEQ ID NO: 1349931 - protein, 9 aa, Homo Sapiens
FGCFLLLIR

SEQ ID NO: 1349932 - protein, 9 aa, Homo Sapiens
MEVWWCATS

SEQ ID NO: 1349933 - protein, 9 aa, Homo Sapiens
LTAFANGRF

SEQ ID NO: 1349934 - protein, 9 aa, Homo Sapiens
RNRAIMARR

SEQ ID NO: 1349935 - protein, 9 aa, Homo Sapiens
NDKPPYSQK

SEQ ID NO: 1349936 - protein, 9 aa, Homo Sapiens
TFQVSSEGK

SEQ ID NO: 1349937 - protein, 9 aa, Homo Sapiens
RIHSSVEIL

SEQ ID NO: 1349938 - protein, 9 aa, Homo Sapiens
RAINLNLRA

SEQ ID NO: 1349939 - protein, 9 aa, Homo Sapiens
SSVNSLVEV

SEQ ID NO: 1349940 - protein, 9 aa, Homo Sapiens
MTKKSISLT

SEQ ID NO: 1349941 - protein, 9 aa, Homo Sapiens
ILSKKKGED

SEQ ID NO: 1349942 - protein, 9 aa, Homo Sapiens
KVSRMRCLH

SEQ ID NO: 1349943 - protein, 9 aa, Homo Sapiens
EHDLQVFDL

SEQ ID NO: 1349944 - protein, 9 aa, Homo Sapiens
DSYLLKSVQ

SEQ ID NO: 1349945 - protein, 9 aa, Homo Sapiens
PQPVQAWLF

SEQ ID NO: 1349946 - protein, 9 aa, Homo Sapiens
PPPHWLEVW

SEQ ID NO: 1349947 - protein, 9 aa, Homo Sapiens
QCCSEESPR

SEQ ID NO: 1349948 - protein, 9 aa, Homo Sapiens
APMLVRLAC

SEQ ID NO: 1349949 - protein, 9 aa, Homo Sapiens
ELYRIGKKS

SEQ ID NO: 1349950 - protein, 9 aa, Homo Sapiens
NITQIEDVT

SEQ ID NO: 1349951 - protein, 9 aa, Homo Sapiens
VDYVTVKQS

SEQ ID NO: 1349952 - protein, 9 aa, Homo Sapiens
GNKREQTKN

SEQ ID NO: 1349953 - protein, 9 aa, Homo Sapiens
LHDISSNVI

SEQ ID NO: 1349954 - protein, 9 aa, Homo Sapiens
MWINHFVIW

SEQ ID NO: 1349955 - protein, 9 aa, Homo Sapiens
HLEASKLNE

SEQ ID NO: 1349956 - protein, 9 aa, Homo Sapiens
LSHQPHLRC

SEQ ID NO: 1349957 - protein, 9 aa, Homo Sapiens
DLSDGLVFT

SEQ ID NO: 1349958 - protein, 9 aa, Homo Sapiens
GGKIKETYF

SEQ ID NO: 1349959 - protein, 9 aa, Homo Sapiens
GFGCFLLLI

SEQ ID NO: 1349960 - protein, 9 aa, Homo Sapiens
WSSFCTSPP

SEQ ID NO: 1349961 - protein, 9 aa, Homo Sapiens
YHSLEELAD

SEQ ID NO: 1349962 - protein, 9 aa, Homo Sapiens
SSTSPQPKC

SEQ ID NO: 1349963 - protein, 9 aa, Homo Sapiens
HYAGEICGF

SEQ ID NO: 1349964 - protein, 9 aa, Homo Sapiens
CLEGRPDGL

SEQ ID NO: 1349965 - protein, 9 aa, Homo Sapiens
EALLLKICG

SEQ ID NO: 1349966 - protein, 9 aa, Homo Sapiens
CAQTREKTL

SEQ ID NO: 1349967 - protein, 9 aa, Homo Sapiens
TTTPVEHPN

SEQ ID NO: 1349968 - protein, 9 aa, Homo Sapiens
SLDSALKPG

SEQ ID NO: 1349969 - protein, 9 aa, Homo Sapiens
VKETRKRIT

SEQ ID NO: 1349970 - protein, 9 aa, Homo Sapiens
CSLFQPHHL

SEQ ID NO: 1349971 - protein, 9 aa, Homo Sapiens
DPPEDVLAS

SEQ ID NO: 1349972 - protein, 9 aa, Homo Sapiens
LDETQITTI

SEQ ID NO: 1349973 - protein, 9 aa, Homo Sapiens
KYQDVETLY

SEQ ID NO: 1349974 - protein, 9 aa, Homo Sapiens
LWVMCRRMG

SEQ ID NO: 1349975 - protein, 9 aa, Homo Sapiens
QINGASRSL

SEQ ID NO: 1349976 - protein, 9 aa, Homo Sapiens
VEFITVITS

SEQ ID NO: 1349977 - protein, 9 aa, Homo Sapiens
VSDLTTKNL

SEQ ID NO: 1349978 - protein, 9 aa, Homo Sapiens
EELPAMKWP

SEQ ID NO: 1349979 - protein, 9 aa, Homo Sapiens
MNIMVPEDY

SEQ ID NO: 1349980 - protein, 9 aa, Homo Sapiens
EHILELSTQ

SEQ ID NO: 1349981 - protein, 9 aa, Homo Sapiens
HYNYYVTLL

SEQ ID NO: 1349982 - protein, 9 aa, Homo Sapiens
GRIFLQDIN

SEQ ID NO: 1349983 - protein, 9 aa, Homo Sapiens
CVTTKTHWY

SEQ ID NO: 1349984 - protein, 9 aa, Homo Sapiens
LQTFNYMLY

SEQ ID NO: 1349985 - protein, 9 aa, Homo Sapiens
PRCAGSAGR

SEQ ID NO: 1349986 - protein, 9 aa, Homo Sapiens
GKKLYEYGE

SEQ ID NO: 1349987 - protein, 9 aa, Homo Sapiens
PLNPSPSKK

SEQ ID NO: 1349988 - protein, 9 aa, Homo Sapiens
GTVMAIGTH

SEQ ID NO: 1349989 - protein, 9 aa, Homo Sapiens
NHNVQCRPT

SEQ ID NO: 1349990 - protein, 9 aa, Homo Sapiens
QTKLEVAQN

SEQ ID NO: 1349991 - protein, 9 aa, Homo Sapiens
QLFGGFSFL

SEQ ID NO: 1349992 - protein, 9 aa, Homo Sapiens
TSRETYNVL

SEQ ID NO: 1349993 - protein, 9 aa, Homo Sapiens
TTPIMFSPE

SEQ ID NO: 1349994 - protein, 9 aa, Homo Sapiens
AFEGTLHDP

SEQ ID NO: 1349995 - protein, 9 aa, Homo Sapiens
TEANNLAAV

SEQ ID NO: 1349996 - protein, 9 aa, Homo Sapiens
LAVLIVIFS

SEQ ID NO: 1349997 - protein, 9 aa, Homo Sapiens
KDMAATGEQ

SEQ ID NO: 1349998 - protein, 9 aa, Homo Sapiens
PYNKVCTYH

SEQ ID NO: 1349999 - protein, 9 aa, Homo Sapiens
FMIHKDGDD

SEQ ID NO: 1350000 - protein, 9 aa, Homo Sapiens
GSSLSSLHV

SEQ ID NO: 1350001 - protein, 9 aa, Homo Sapiens
VLMFEMMTG

SEQ ID NO: 1350002 - protein, 9 aa, Homo Sapiens
LSKVVQGLM

SEQ ID NO: 1350003 - protein, 9 aa, Homo Sapiens
RTVMYLYKH

SEQ ID NO: 1350004 - protein, 9 aa, Homo Sapiens
RWHFIKRRT

SEQ ID NO: 1350005 - protein, 9 aa, Homo Sapiens
GVLFGGCSY

SEQ ID NO: 1350006 - protein, 9 aa, Homo Sapiens
IQGAEKFIS

SEQ ID NO: 1350007 - protein, 9 aa, Homo Sapiens
KKAQVQVSV

SEQ ID NO: 1350008 - protein, 9 aa, Homo Sapiens
NFIESPMID

SEQ ID NO: 1350009 - protein, 9 aa, Homo Sapiens
IPEARYRLD

SEQ ID NO: 1350010 - protein, 9 aa, Homo Sapiens
QKMWRDLEE

SEQ ID NO: 1350011 - protein, 9 aa, Homo Sapiens
GHTEPVMLP

SEQ ID NO: 1350012 - protein, 9 aa, Homo Sapiens
ERHVRIQLK

SEQ ID NO: 1350013 - protein, 9 aa, Homo Sapiens
SFLLAGILI

SEQ ID NO: 1350014 - protein, 9 aa, Homo Sapiens
MNMTPHRPG

SEQ ID NO: 1350015 - protein, 9 aa, Homo Sapiens
QFLSIIRSC

SEQ ID NO: 1350016 - protein, 9 aa, Homo Sapiens
IGVGECSSI

SEQ ID NO: 1350017 - protein, 9 aa, Homo Sapiens
DDWYGHRLG

SEQ ID NO: 1350018 - protein, 9 aa, Homo Sapiens
SPRTGLLQN

SEQ ID NO: 1350019 - protein, 9 aa, Homo Sapiens
ESTLMDISD

SEQ ID NO: 1350020 - protein, 9 aa, Homo Sapiens
RCVTVFSTP

SEQ ID NO: 1350021 - protein, 9 aa, Homo Sapiens
VVNEVVAGI

SEQ ID NO: 1350022 - protein, 9 aa, Homo Sapiens
LLTPGIMHT

SEQ ID NO: 1350023 - protein, 9 aa, Homo Sapiens
YVCPCTLVR

SEQ ID NO: 1350024 - protein, 9 aa, Homo Sapiens
QDLAPPCAG

SEQ ID NO: 1350025 - protein, 9 aa, Homo Sapiens
KQEISRLVH

SEQ ID NO: 1350026 - protein, 9 aa, Homo Sapiens
LQTYDVSSL

SEQ ID NO: 1350027 - protein, 9 aa, Homo Sapiens
GSDTFNCCT

SEQ ID NO: 1350028 - protein, 9 aa, Homo Sapiens
IRQKRQTRE

SEQ ID NO: 1350029 - protein, 9 aa, Homo Sapiens
LTSAMNAAR

SEQ ID NO: 1350030 - protein, 9 aa, Homo Sapiens
RYTNFCKDQ

SEQ ID NO: 1350031 - protein, 9 aa, Homo Sapiens
RSLFLLFHS

SEQ ID NO: 1350032 - protein, 9 aa, Homo Sapiens
GEDVAALLM

SEQ ID NO: 1350033 - protein, 9 aa, Homo Sapiens
SPPPGMMFP

SEQ ID NO: 1350034 - protein, 9 aa, Homo Sapiens
TLQQTIEEN

SEQ ID NO: 1350035 - protein, 9 aa, Homo Sapiens
SAVCVGIAD

SEQ ID NO: 1350036 - protein, 9 aa, Homo Sapiens
WSPDQERVL

SEQ ID NO: 1350037 - protein, 9 aa, Homo Sapiens
CASTWTVRS

SEQ ID NO: 1350038 - protein, 9 aa, Homo Sapiens
KCDRCGKRF

SEQ ID NO: 1350039 - protein, 9 aa, Homo Sapiens
KCTVAKELA

SEQ ID NO: 1350040 - protein, 9 aa, Homo Sapiens
DAAMYGAHM

SEQ ID NO: 1350041 - protein, 9 aa, Homo Sapiens
LKSCKYHAL

SEQ ID NO: 1350042 - protein, 9 aa, Homo Sapiens
VTAQASKHI

SEQ ID NO: 1350043 - protein, 9 aa, Homo Sapiens
ETVGGQTLA

SEQ ID NO: 1350044 - protein, 9 aa, Homo Sapiens
DYSYWLHTS

SEQ ID NO: 1350045 - protein, 9 aa, Homo Sapiens
SEIEQYLCT

SEQ ID NO: 1350046 - protein, 9 aa, Homo Sapiens
YSTLECLET

SEQ ID NO: 1350047 - protein, 9 aa, Homo Sapiens
TYQKYWLNF

SEQ ID NO: 1350048 - protein, 9 aa, Homo Sapiens
GNNHLVPVE

SEQ ID NO: 1350049 - protein, 9 aa, Homo Sapiens
EGTLHDPFG

SEQ ID NO: 1350050 - protein, 9 aa, Homo Sapiens
KQSPLIFIF

SEQ ID NO: 1350051 - protein, 9 aa, Homo Sapiens
LSLYPTDNE

SEQ ID NO: 1350052 - protein, 9 aa, Homo Sapiens
WIWIDTSCV

SEQ ID NO: 1350053 - protein, 9 aa, Homo Sapiens
LWDMCNHTS

SEQ ID NO: 1350054 - protein, 9 aa, Homo Sapiens
QGGSPVGDV

SEQ ID NO: 1350055 - protein, 9 aa, Homo Sapiens
SNSIKWQTV

SEQ ID NO: 1350056 - protein, 9 aa, Homo Sapiens
TAGAARART

SEQ ID NO: 1350057 - protein, 9 aa, Homo Sapiens
LDITMGFKT

SEQ ID NO: 1350058 - protein, 9 aa, Homo Sapiens
NRSGKCGRP

SEQ ID NO: 1350059 - protein, 9 aa, Homo Sapiens
IYSILSLKT

SEQ ID NO: 1350060 - protein, 9 aa, Homo Sapiens
LLAKVMCFE

SEQ ID NO: 1350061 - protein, 9 aa, Homo Sapiens
SFYMKRNSR

SEQ ID NO: 1350062 - protein, 9 aa, Homo Sapiens
AETTVVDVE

SEQ ID NO: 1350063 - protein, 9 aa, Homo Sapiens
VPWTVFRAT

SEQ ID NO: 1350064 - protein, 9 aa, Homo Sapiens
HFDALFCWF

SEQ ID NO: 1350065 - protein, 9 aa, Homo Sapiens
PSAPTPTSS

SEQ ID NO: 1350066 - protein, 9 aa, Homo Sapiens
QDYMSPTLD

SEQ ID NO: 1350067 - protein, 9 aa, Homo Sapiens
NTATCDTVV

SEQ ID NO: 1350068 - protein, 9 aa, Homo Sapiens
LSHRLDELE

SEQ ID NO: 1350069 - protein, 9 aa, Homo Sapiens
IAILSIIQG

SEQ ID NO: 1350070 - protein, 9 aa, Homo Sapiens
HLEMPKTSR

SEQ ID NO: 1350071 - protein, 9 aa, Homo Sapiens
IVSGKKCRL

SEQ ID NO: 1350072 - protein, 9 aa, Homo Sapiens
KNYDCDSGY

SEQ ID NO: 1350073 - protein, 9 aa, Homo Sapiens
DRVLMERNQ

SEQ ID NO: 1350074 - protein, 9 aa, Homo Sapiens
YDQKVNHFA

SEQ ID NO: 1350075 - protein, 9 aa, Homo Sapiens
TGGINTGVA

SEQ ID NO: 1350076 - protein, 9 aa, Homo Sapiens
PWMMVIGFP

SEQ ID NO: 1350077 - protein, 9 aa, Homo Sapiens
CSVCTKAPK

SEQ ID NO: 1350078 - protein, 9 aa, Homo Sapiens
VNQLAMGNS

SEQ ID NO: 1350079 - protein, 9 aa, Homo Sapiens
DQGYLQLKG

SEQ ID NO: 1350080 - protein, 9 aa, Homo Sapiens
SQELRSGPH

SEQ ID NO: 1350081 - protein, 9 aa, Homo Sapiens
LTDADFTLL

SEQ ID NO: 1350082 - protein, 9 aa, Homo Sapiens
RSHQARETL

SEQ ID NO: 1350083 - protein, 9 aa, Homo Sapiens
FPQAMQRCC

SEQ ID NO: 1350084 - protein, 9 aa, Homo Sapiens
ICCLNCRST

SEQ ID NO: 1350085 - protein, 9 aa, Homo Sapiens
VYAITDVAF

SEQ ID NO: 1350086 - protein, 9 aa, Homo Sapiens
YLAGQVSVV

SEQ ID NO: 1350087 - protein, 9 aa, Homo Sapiens
RSTLMSCTE

SEQ ID NO: 1350088 - protein, 9 aa, Homo Sapiens
WGFSLLIMK

SEQ ID NO: 1350089 - protein, 9 aa, Homo Sapiens
VSFILLGIS

SEQ ID NO: 1350090 - protein, 9 aa, Homo Sapiens
YQFANSQNQ

SEQ ID NO: 1350091 - protein, 9 aa, Homo Sapiens
GLGLGIGLC

SEQ ID NO: 1350092 - protein, 9 aa, Homo Sapiens
RRPSSRHAA

SEQ ID NO: 1350093 - protein, 9 aa, Homo Sapiens
ITIPLVILR

SEQ ID NO: 1350094 - protein, 9 aa, Homo Sapiens
QPEDWVEMD

SEQ ID NO: 1350095 - protein, 9 aa, Homo Sapiens
NKMSSEFQC

SEQ ID NO: 1350096 - protein, 9 aa, Homo Sapiens
PPGNWSPHP

SEQ ID NO: 1350097 - protein, 9 aa, Homo Sapiens
STPSQSSVQ

SEQ ID NO: 1350098 - protein, 9 aa, Homo Sapiens
GTGFCDGLG

SEQ ID NO: 1350099 - protein, 9 aa, Homo Sapiens
VALEDDGFC

SEQ ID NO: 1350100 - protein, 9 aa, Homo Sapiens
QVLVHLAQL

SEQ ID NO: 1350101 - protein, 9 aa, Homo Sapiens
CYMLINVPM

SEQ ID NO: 1350102 - protein, 9 aa, Homo Sapiens
ILTDEDWNE

SEQ ID NO: 1350103 - protein, 9 aa, Homo Sapiens
DPETIHQGI

SEQ ID NO: 1350104 - protein, 9 aa, Homo Sapiens
NEQKPSRIT

SEQ ID NO: 1350105 - protein, 9 aa, Homo Sapiens
RKTLPRNDT

SEQ ID NO: 1350106 - protein, 9 aa, Homo Sapiens
MDKRRKIVV

SEQ ID NO: 1350107 - protein, 9 aa, Homo Sapiens
RHYLRAYFP

SEQ ID NO: 1350108 - protein, 9 aa, Homo Sapiens
CMRRSTAGT

SEQ ID NO: 1350109 - protein, 9 aa, Homo Sapiens
ECDERHKTK

SEQ ID NO: 1350110 - protein, 9 aa, Homo Sapiens
RHFKQLETE

SEQ ID NO: 1350111 - protein, 9 aa, Homo Sapiens
ANLVAFMIQ

SEQ ID NO: 1350112 - protein, 9 aa, Homo Sapiens
LAEAWDFTG

SEQ ID NO: 1350113 - protein, 9 aa, Homo Sapiens
QDMPMRSKA

SEQ ID NO: 1350114 - protein, 9 aa, Homo Sapiens
VTPTDFPSQ

SEQ ID NO: 1350115 - protein, 9 aa, Homo Sapiens
VGSHGMPKR

SEQ ID NO: 1350116 - protein, 9 aa, Homo Sapiens
MTYWQELID

SEQ ID NO: 1350117 - protein, 9 aa, Homo Sapiens
LQAITAAHG

SEQ ID NO: 1350118 - protein, 9 aa, Homo Sapiens
THGQKHQRR

SEQ ID NO: 1350119 - protein, 9 aa, Homo Sapiens
SLVRVCGRP

SEQ ID NO: 1350120 - protein, 9 aa, Homo Sapiens
PSLFLCISS

SEQ ID NO: 1350121 - protein, 9 aa, Homo Sapiens
PLHMAANMP

SEQ ID NO: 1350122 - protein, 9 aa, Homo Sapiens
GMTPFMSVV

SEQ ID NO: 1350123 - protein, 9 aa, Homo Sapiens
TPCDDIKNI

SEQ ID NO: 1350124 - protein, 9 aa, Homo Sapiens
PASNHNGAS

SEQ ID NO: 1350125 - protein, 9 aa, Homo Sapiens
RHYIKNPRI

SEQ ID NO: 1350126 - protein, 9 aa, Homo Sapiens
VTVTVGAVT

SEQ ID NO: 1350127 - protein, 9 aa, Homo Sapiens
PRNLLKTDD

SEQ ID NO: 1350128 - protein, 9 aa, Homo Sapiens
ERSLKTLEA

SEQ ID NO: 1350129 - protein, 9 aa, Homo Sapiens
YTGLVNGAV

SEQ ID NO: 1350130 - protein, 9 aa, Homo Sapiens
CLTALPDYT

SEQ ID NO: 1350131 - protein, 9 aa, Homo Sapiens
GSRVWRVSV

SEQ ID NO: 1350132 - protein, 9 aa, Homo Sapiens
QLLSKLDSE

SEQ ID NO: 1350133 - protein, 9 aa, Homo Sapiens
DYCVHNEST

SEQ ID NO: 1350134 - protein, 9 aa, Homo Sapiens
THMGIYVGA

SEQ ID NO: 1350135 - protein, 9 aa, Homo Sapiens
TDLQLLFVF

SEQ ID NO: 1350136 - protein, 9 aa, Homo Sapiens
CKPDIMLPL

SEQ ID NO: 1350137 - protein, 9 aa, Homo Sapiens
MLSTHTKCK

SEQ ID NO: 1350138 - protein, 9 aa, Homo Sapiens
CKVSAFVMG

SEQ ID NO: 1350139 - protein, 9 aa, Homo Sapiens
AIFENMLST

SEQ ID NO: 1350140 - protein, 9 aa, Homo Sapiens
TLVALSWRG

SEQ ID NO: 1350141 - protein, 9 aa, Homo Sapiens
SVRFFANPV

SEQ ID NO: 1350142 - protein, 9 aa, Homo Sapiens
EIRKILKIL

SEQ ID NO: 1350143 - protein, 9 aa, Homo Sapiens
YYDTACTLG

SEQ ID NO: 1350144 - protein, 9 aa, Homo Sapiens
YAHFFLSYL

SEQ ID NO: 1350145 - protein, 9 aa, Homo Sapiens
KVELRQYFR

SEQ ID NO: 1350146 - protein, 9 aa, Homo Sapiens
ESRHLGGGG

SEQ ID NO: 1350147 - protein, 9 aa, Homo Sapiens
DMILAGSPT

SEQ ID NO: 1350148 - protein, 9 aa, Homo Sapiens
GNSSAEDEK

SEQ ID NO: 1350149 - protein, 9 aa, Homo Sapiens
KEDEAGTPY

SEQ ID NO: 1350150 - protein, 9 aa, Homo Sapiens
IYDIYRRNL

SEQ ID NO: 1350151 - protein, 9 aa, Homo Sapiens
LKRRDDVRH

SEQ ID NO: 1350152 - protein, 9 aa, Homo Sapiens
GLVTKWYIS

SEQ ID NO: 1350153 - protein, 9 aa, Homo Sapiens
SNNQFENET

SEQ ID NO: 1350154 - protein, 9 aa, Homo Sapiens
SHGFSMCPD

SEQ ID NO: 1350155 - protein, 9 aa, Homo Sapiens
PLVSIPFLQ

SEQ ID NO: 1350156 - protein, 9 aa, Homo Sapiens
HKLVFSRCH

SEQ ID NO: 1350157 - protein, 9 aa, Homo Sapiens
EETRCKTEE

SEQ ID NO: 1350158 - protein, 9 aa, Homo Sapiens
HQDWRSGKA

SEQ ID NO: 1350159 - protein, 9 aa, Homo Sapiens
ELHHFEKLM

SEQ ID NO: 1350160 - protein, 9 aa, Homo Sapiens
GSREVYTWN

SEQ ID NO: 1350161 - protein, 9 aa, Homo Sapiens
CREVGLELG

SEQ ID NO: 1350162 - protein, 9 aa, Homo Sapiens
LKTHLDEAR

SEQ ID NO: 1350163 - protein, 9 aa, Homo Sapiens
HMSFQLPGG

SEQ ID NO: 1350164 - protein, 9 aa, Homo Sapiens
GWPVFPIGL

SEQ ID NO: 1350165 - protein, 9 aa, Homo Sapiens
VEWHVLPIL

SEQ ID NO: 1350166 - protein, 9 aa, Homo Sapiens
LNIPDAPEA

SEQ ID NO: 1350167 - protein, 9 aa, Homo Sapiens
AVSRHQTTI

SEQ ID NO: 1350168 - protein, 9 aa, Homo Sapiens
GPHLHGHLI

SEQ ID NO: 1350169 - protein, 9 aa, Homo Sapiens
GKHSLDIDE

SEQ ID NO: 1350170 - protein, 9 aa, Homo Sapiens
KTRWTHNFH

SEQ ID NO: 1350171 - protein, 9 aa, Homo Sapiens
QCIPATAAP

SEQ ID NO: 1350172 - protein, 9 aa, Homo Sapiens
PSPPTPPAQ

SEQ ID NO: 1350173 - protein, 9 aa, Homo Sapiens
DWRSGKAEF

SEQ ID NO: 1350174 - protein, 9 aa, Homo Sapiens
KEDIPEHYP

SEQ ID NO: 1350175 - protein, 9 aa, Homo Sapiens
VMDIYNCVK

SEQ ID NO: 1350176 - protein, 9 aa, Homo Sapiens
RSPLCRAAA

SEQ ID NO: 1350177 - protein, 9 aa, Homo Sapiens
LHLSVVPGK

SEQ ID NO: 1350178 - protein, 9 aa, Homo Sapiens
LAQELRDVW

SEQ ID NO: 1350179 - protein, 9 aa, Homo Sapiens
RKCEHLLLY

SEQ ID NO: 1350180 - protein, 9 aa, Homo Sapiens
VTSYLCSDV

SEQ ID NO: 1350181 - protein, 9 aa, Homo Sapiens
LNMMKFFFD

SEQ ID NO: 1350182 - protein, 9 aa, Homo Sapiens
ATTHFETPC

SEQ ID NO: 1350183 - protein, 9 aa, Homo Sapiens
DTTTSLKGI

SEQ ID NO: 1350184 - protein, 9 aa, Homo Sapiens
LLDHMENYN

SEQ ID NO: 1350185 - protein, 9 aa, Homo Sapiens
SYPCFVDDS

SEQ ID NO: 1350186 - protein, 9 aa, Homo Sapiens
HGTRPQRRH

SEQ ID NO: 1350187 - protein, 9 aa, Homo Sapiens
PISTLHDGH

SEQ ID NO: 1350188 - protein, 9 aa, Homo Sapiens
SRALDVPSG

SEQ ID NO: 1350189 - protein, 9 aa, Homo Sapiens
NMTPHRPGP

SEQ ID NO: 1350190 - protein, 9 aa, Homo Sapiens
VDVINENVK

SEQ ID NO: 1350191 - protein, 9 aa, Homo Sapiens
VISVIPASV

SEQ ID NO: 1350192 - protein, 9 aa, Homo Sapiens
HLEDFPMDT

SEQ ID NO: 1350193 - protein, 9 aa, Homo Sapiens
EIDDIYTPA

SEQ ID NO: 1350194 - protein, 9 aa, Homo Sapiens
LYGVILLVI

SEQ ID NO: 1350195 - protein, 9 aa, Homo Sapiens
DHLSRYQNP

SEQ ID NO: 1350196 - protein, 9 aa, Homo Sapiens
EIVCPKKIH

SEQ ID NO: 1350197 - protein, 9 aa, Homo Sapiens
SLKAVTREH

SEQ ID NO: 1350198 - protein, 9 aa, Homo Sapiens
IKTPTHREP

SEQ ID NO: 1350199 - protein, 9 aa, Homo Sapiens
TNPELFQCV

SEQ ID NO: 1350200 - protein, 9 aa, Homo Sapiens
AIMDLLLHL

SEQ ID NO: 1350201 - protein, 9 aa, Homo Sapiens
KNVVAVGTG

SEQ ID NO: 1350202 - protein, 9 aa, Homo Sapiens
YVTVKQSGE

SEQ ID NO: 1350203 - protein, 9 aa, Homo Sapiens
HINSKGCVE

SEQ ID NO: 1350204 - protein, 9 aa, Homo Sapiens
ATCTGAAST

SEQ ID NO: 1350205 - protein, 9 aa, Homo Sapiens
KEVGYSMHM

SEQ ID NO: 1350206 - protein, 9 aa, Homo Sapiens
TMHFRDNTP

SEQ ID NO: 1350207 - protein, 9 aa, Homo Sapiens
IYKGPLDCS

SEQ ID NO: 1350208 - protein, 9 aa, Homo Sapiens
LAILLCDGS

SEQ ID NO: 1350209 - protein, 9 aa, Homo Sapiens
IKTFPVRSE

SEQ ID NO: 1350210 - protein, 9 aa, Homo Sapiens
DTLQGALEQ

SEQ ID NO: 1350211 - protein, 9 aa, Homo Sapiens
AFAVLTIFY

SEQ ID NO: 1350212 - protein, 9 aa, Homo Sapiens
GHEVILESF

SEQ ID NO: 1350213 - protein, 9 aa, Homo Sapiens
NDCGGIYGE

SEQ ID NO: 1350214 - protein, 9 aa, Homo Sapiens
LSTQDGSCT

SEQ ID NO: 1350215 - protein, 9 aa, Homo Sapiens
AEAHRRMVV

SEQ ID NO: 1350216 - protein, 9 aa, Homo Sapiens
VIKNPDSIT

SEQ ID NO: 1350217 - protein, 9 aa, Homo Sapiens
VMRYSTSAF

SEQ ID NO: 1350218 - protein, 9 aa, Homo Sapiens
GSEHCYVIY

SEQ ID NO: 1350219 - protein, 9 aa, Homo Sapiens
RNWPSHRSE

SEQ ID NO: 1350220 - protein, 9 aa, Homo Sapiens
PEFKKTTEL

SEQ ID NO: 1350221 - protein, 9 aa, Homo Sapiens
QHTQFEYPI

SEQ ID NO: 1350222 - protein, 9 aa, Homo Sapiens
TTPSSVIFS

SEQ ID NO: 1350223 - protein, 9 aa, Homo Sapiens
LCLCCLVGT

SEQ ID NO: 1350224 - protein, 9 aa, Homo Sapiens
ARDIEHMVE

SEQ ID NO: 1350225 - protein, 9 aa, Homo Sapiens
MATGGFGCF

SEQ ID NO: 1350226 - protein, 9 aa, Homo Sapiens
EGSRQLGEQ

SEQ ID NO: 1350227 - protein, 9 aa, Homo Sapiens
AHCPGMPLE

SEQ ID NO: 1350228 - protein, 9 aa, Homo Sapiens
REENLKMMW

SEQ ID NO: 1350229 - protein, 9 aa, Homo Sapiens
PPLPRLRYS

SEQ ID NO: 1350230 - protein, 9 aa, Homo Sapiens
PAEAPVPSP

SEQ ID NO: 1350231 - protein, 9 aa, Homo Sapiens
LIRDPKGRH

SEQ ID NO: 1350232 - protein, 9 aa, Homo Sapiens
EVQLHKTTW

SEQ ID NO: 1350233 - protein, 9 aa, Homo Sapiens
WPRLLSTKG

SEQ ID NO: 1350234 - protein, 9 aa, Homo Sapiens
APLLNPYML

SEQ ID NO: 1350235 - protein, 9 aa, Homo Sapiens
LRDKTRWTH

SEQ ID NO: 1350236 - protein, 9 aa, Homo Sapiens
DWIFNHPEF

SEQ ID NO: 1350237 - protein, 9 aa, Homo Sapiens
DGDHLITEP

SEQ ID NO: 1350238 - protein, 9 aa, Homo Sapiens
HNLITFLRE

SEQ ID NO: 1350239 - protein, 9 aa, Homo Sapiens
DEECLYLNI

SEQ ID NO: 1350240 - protein, 9 aa, Homo Sapiens
DEQVRQFLI

SEQ ID NO: 1350241 - protein, 9 aa, Homo Sapiens
FTTIFQNFS

SEQ ID NO: 1350242 - protein, 9 aa, Homo Sapiens
DRNQDSTAV

SEQ ID NO: 1350243 - protein, 9 aa, Homo Sapiens
IQRFNPCLM

SEQ ID NO: 1350244 - protein, 9 aa, Homo Sapiens
ESCLIRLHG

SEQ ID NO: 1350245 - protein, 9 aa, Homo Sapiens
DSRGILEEL

SEQ ID NO: 1350246 - protein, 9 aa, Homo Sapiens
GRIIKCTHC

SEQ ID NO: 1350247 - protein, 9 aa, Homo Sapiens
IPELWGPMD

SEQ ID NO: 1350248 - protein, 9 aa, Homo Sapiens
GPLLTPAFL

SEQ ID NO: 1350249 - protein, 9 aa, Homo Sapiens
KTLRSFREF

SEQ ID NO: 1350250 - protein, 9 aa, Homo Sapiens
KYKHTLPVG

SEQ ID NO: 1350251 - protein, 9 aa, Homo Sapiens
MGLDEDNKP

SEQ ID NO: 1350252 - protein, 9 aa, Homo Sapiens
VEVVSKWVG

SEQ ID NO: 1350253 - protein, 9 aa, Homo Sapiens
TFNKINGLR

SEQ ID NO: 1350254 - protein, 9 aa, Homo Sapiens
SCDVVTEAI

SEQ ID NO: 1350255 - protein, 9 aa, Homo Sapiens
IREIRTLFC

SEQ ID NO: 1350256 - protein, 9 aa, Homo Sapiens
KLEKKNKTP

SEQ ID NO: 1350257 - protein, 9 aa, Homo Sapiens
HMRPRHPHQ

SEQ ID NO: 1350258 - protein, 9 aa, Homo Sapiens
AFATCSSYS

SEQ ID NO: 1350259 - protein, 9 aa, Homo Sapiens
LEKEDTVEV

SEQ ID NO: 1350260 - protein, 9 aa, Homo Sapiens
PEELNGSSP

SEQ ID NO: 1350261 - protein, 9 aa, Homo Sapiens
IQVLTYEWR

SEQ ID NO: 1350262 - protein, 9 aa, Homo Sapiens
DGHLLFSSC

SEQ ID NO: 1350263 - protein, 9 aa, Homo Sapiens
RMAFCVTSF

SEQ ID NO: 1350264 - protein, 9 aa, Homo Sapiens
AQTEGIFGM

SEQ ID NO: 1350265 - protein, 9 aa, Homo Sapiens
RGRGIMPSF

SEQ ID NO: 1350266 - protein, 9 aa, Homo Sapiens
GNWELIKIL

SEQ ID NO: 1350267 - protein, 9 aa, Homo Sapiens
EPRHLGGRT

SEQ ID NO: 1350268 - protein, 9 aa, Homo Sapiens
RTFGHSLSS

SEQ ID NO: 1350269 - protein, 9 aa, Homo Sapiens
IIIEATKHC

SEQ ID NO: 1350270 - protein, 9 aa, Homo Sapiens
VIEKKTRHL

SEQ ID NO: 1350271 - protein, 9 aa, Homo Sapiens
QPQGAHSPA

SEQ ID NO: 1350272 - protein, 9 aa, Homo Sapiens
GSPVGDVGL

SEQ ID NO: 1350273 - protein, 9 aa, Homo Sapiens
AGWPETPLG

SEQ ID NO: 1350274 - protein, 9 aa, Homo Sapiens
KLNRSKHLE

SEQ ID NO: 1350275 - protein, 9 aa, Homo Sapiens
HIKIESLLY

SEQ ID NO: 1350276 - protein, 9 aa, Homo Sapiens
DTMADMLQR

SEQ ID NO: 1350277 - protein, 9 aa, Homo Sapiens
LLFFWQCGC

SEQ ID NO: 1350278 - protein, 9 aa, Homo Sapiens
KLKEKVWPE

SEQ ID NO: 1350279 - protein, 9 aa, Homo Sapiens
PAPLIMGFM

SEQ ID NO: 1350280 - protein, 9 aa, Homo Sapiens
RPPLPQKDH

SEQ ID NO: 1350281 - protein, 9 aa, Homo Sapiens
SGLPSGTEI

SEQ ID NO: 1350282 - protein, 9 aa, Homo Sapiens
HMGTMPRPG

SEQ ID NO: 1350283 - protein, 9 aa, Homo Sapiens
MLIIICFIF

SEQ ID NO: 1350284 - protein, 9 aa, Homo Sapiens
RQTGIPARG

SEQ ID NO: 1350285 - protein, 9 aa, Homo Sapiens
FFKYLCITA

SEQ ID NO: 1350286 - protein, 9 aa, Homo Sapiens
GTMQLVSDF

SEQ ID NO: 1350287 - protein, 9 aa, Homo Sapiens
RAFLRAHAA

SEQ ID NO: 1350288 - protein, 9 aa, Homo Sapiens
MGIEDSELR

SEQ ID NO: 1350289 - protein, 9 aa, Homo Sapiens
KKVETERIR

SEQ ID NO: 1350290 - protein, 9 aa, Homo Sapiens
SVCRLTPSC

SEQ ID NO: 1350291 - protein, 9 aa, Homo Sapiens
IHLSAHTIK

SEQ ID NO: 1350292 - protein, 9 aa, Homo Sapiens
TTLKRIATE

SEQ ID NO: 1350293 - protein, 9 aa, Homo Sapiens
VWMIAAEAE

SEQ ID NO: 1350294 - protein, 9 aa, Homo Sapiens
RKHGKSLYY

SEQ ID NO: 1350295 - protein, 9 aa, Homo Sapiens
SVFNLSNTI

SEQ ID NO: 1350296 - protein, 9 aa, Homo Sapiens
SLPYLEQYH

SEQ ID NO: 1350297 - protein, 9 aa, Homo Sapiens
SSNPSSCDS

SEQ ID NO: 1350298 - protein, 9 aa, Homo Sapiens
AVGTGFCDG

SEQ ID NO: 1350299 - protein, 9 aa, Homo Sapiens
DKATARKVL

SEQ ID NO: 1350300 - protein, 9 aa, Homo Sapiens
PVGPTGEKG

SEQ ID NO: 1350301 - protein, 9 aa, Homo Sapiens
AYNCSLHGV

SEQ ID NO: 1350302 - protein, 9 aa, Homo Sapiens
QHILMKSVR

SEQ ID NO: 1350303 - protein, 9 aa, Homo Sapiens
EEPMSNPID

SEQ ID NO: 1350304 - protein, 9 aa, Homo Sapiens
SLFSAVGHV

SEQ ID NO: 1350305 - protein, 9 aa, Homo Sapiens
MAVLHGAVF

SEQ ID NO: 1350306 - protein, 9 aa, Homo Sapiens
FSSMSNKYT

SEQ ID NO: 1350307 - protein, 9 aa, Homo Sapiens
TGLEGGPRD

SEQ ID NO: 1350308 - protein, 9 aa, Homo Sapiens
RGLMPLRVD

SEQ ID NO: 1350309 - protein, 9 aa, Homo Sapiens
FPGIKGKAG

SEQ ID NO: 1350310 - protein, 9 aa, Homo Sapiens
DRTPESALE

SEQ ID NO: 1350311 - protein, 9 aa, Homo Sapiens
EEGATLART

SEQ ID NO: 1350312 - protein, 9 aa, Homo Sapiens
NGDGNCLMY

SEQ ID NO: 1350313 - protein, 9 aa, Homo Sapiens
DIEEAVIVA

SEQ ID NO: 1350314 - protein, 9 aa, Homo Sapiens
RNINNKRCY

SEQ ID NO: 1350315 - protein, 9 aa, Homo Sapiens
RDYGPSIDL

SEQ ID NO: 1350316 - protein, 9 aa, Homo Sapiens
SKPEFKKTT

SEQ ID NO: 1350317 - protein, 9 aa, Homo Sapiens
IRSAEGRSK

SEQ ID NO: 1350318 - protein, 9 aa, Homo Sapiens
SCSDELSRH

SEQ ID NO: 1350319 - protein, 9 aa, Homo Sapiens
RQLLSIPRV

SEQ ID NO: 1350320 - protein, 9 aa, Homo Sapiens
CDLREDTLD

SEQ ID NO: 1350321 - protein, 9 aa, Homo Sapiens
DQDAAIASF

SEQ ID NO: 1350322 - protein, 9 aa, Homo Sapiens
VHYIEELQK

SEQ ID NO: 1350323 - protein, 9 aa, Homo Sapiens
FLAHVLNTH

SEQ ID NO: 1350324 - protein, 9 aa, Homo Sapiens
PTTFSECPS

SEQ ID NO: 1350325 - protein, 9 aa, Homo Sapiens
FNEGWGPKQ

SEQ ID NO: 1350326 - protein, 9 aa, Homo Sapiens
KRKFQYEEE

SEQ ID NO: 1350327 - protein, 9 aa, Homo Sapiens
SFEEIKMAM

SEQ ID NO: 1350328 - protein, 9 aa, Homo Sapiens
PHWTPPSIT

SEQ ID NO: 1350329 - protein, 9 aa, Homo Sapiens
NSYGEFVEY

SEQ ID NO: 1350330 - protein, 9 aa, Homo Sapiens
LLKAGLPHP

SEQ ID NO: 1350331 - protein, 9 aa, Homo Sapiens
PPGPLSQAP

SEQ ID NO: 1350332 - protein, 9 aa, Homo Sapiens
TVKASEKPP

SEQ ID NO: 1350333 - protein, 9 aa, Homo Sapiens
GCVISALAC

SEQ ID NO: 1350334 - protein, 9 aa, Homo Sapiens
NIKKLKELH

SEQ ID NO: 1350335 - protein, 9 aa, Homo Sapiens
RGSTKIWSK

SEQ ID NO: 1350336 - protein, 9 aa, Homo Sapiens
RCCLRTFIG

SEQ ID NO: 1350337 - protein, 9 aa, Homo Sapiens
PEILQSTSF

SEQ ID NO: 1350338 - protein, 9 aa, Homo Sapiens
LASMAYDHY

SEQ ID NO: 1350339 - protein, 9 aa, Homo Sapiens
TASAIDMME

SEQ ID NO: 1350340 - protein, 9 aa, Homo Sapiens
KVTAFSPHF

SEQ ID NO: 1350341 - protein, 9 aa, Homo Sapiens
RPGDLMWIN

SEQ ID NO: 1350342 - protein, 9 aa, Homo Sapiens
AEYLAHHQH

SEQ ID NO: 1350343 - protein, 9 aa, Homo Sapiens
HCSEMVPGT

SEQ ID NO: 1350344 - protein, 9 aa, Homo Sapiens
PERASVRIH

SEQ ID NO: 1350345 - protein, 9 aa, Homo Sapiens
VTSPGVNSS

SEQ ID NO: 1350346 - protein, 9 aa, Homo Sapiens
IEDEDTKAP

SEQ ID NO: 1350347 - protein, 9 aa, Homo Sapiens
EDFPMDTHA

SEQ ID NO: 1350348 - protein, 9 aa, Homo Sapiens
SKASANQRP

SEQ ID NO: 1350349 - protein, 9 aa, Homo Sapiens
HTIYPVLSR

SEQ ID NO: 1350350 - protein, 9 aa, Homo Sapiens
PLIKMACDG

SEQ ID NO: 1350351 - protein, 9 aa, Homo Sapiens
EELCLQVID

SEQ ID NO: 1350352 - protein, 9 aa, Homo Sapiens
LMRERKFHR

SEQ ID NO: 1350353 - protein, 9 aa, Homo Sapiens
LKSLVSKDT

SEQ ID NO: 1350354 - protein, 9 aa, Homo Sapiens
KSSKNQGIE

SEQ ID NO: 1350355 - protein, 9 aa, Homo Sapiens
MERKDFEIW

SEQ ID NO: 1350356 - protein, 9 aa, Homo Sapiens
HQEGNRLYH

SEQ ID NO: 1350357 - protein, 9 aa, Homo Sapiens
TPPSITPSS

SEQ ID NO: 1350358 - protein, 9 aa, Homo Sapiens
FFCEAPMLV

SEQ ID NO: 1350359 - protein, 9 aa, Homo Sapiens
MDNCKELEW

SEQ ID NO: 1350360 - protein, 9 aa, Homo Sapiens
GFEGNNCEL

SEQ ID NO: 1350361 - protein, 9 aa, Homo Sapiens
KTGSSGAMG

SEQ ID NO: 1350362 - protein, 9 aa, Homo Sapiens
VLQDYMSPT

SEQ ID NO: 1350363 - protein, 9 aa, Homo Sapiens
EEHRKDLEI

SEQ ID NO: 1350364 - protein, 9 aa, Homo Sapiens
DDHNWKITH

SEQ ID NO: 1350365 - protein, 9 aa, Homo Sapiens
QDIMEDTMH

SEQ ID NO: 1350366 - protein, 9 aa, Homo Sapiens
YHGAEKEWG

SEQ ID NO: 1350367 - protein, 9 aa, Homo Sapiens
TEPVMLPVI

SEQ ID NO: 1350368 - protein, 9 aa, Homo Sapiens
YGAVKDGAI

SEQ ID NO: 1350369 - protein, 9 aa, Homo Sapiens
DGEQWPYRV

SEQ ID NO: 1350370 - protein, 9 aa, Homo Sapiens
GRVDVAQDT

SEQ ID NO: 1350371 - protein, 9 aa, Homo Sapiens
MAFEVIVKK

SEQ ID NO: 1350372 - protein, 9 aa, Homo Sapiens
VELRQYFRN

SEQ ID NO: 1350373 - protein, 9 aa, Homo Sapiens
ISGPKRGER

SEQ ID NO: 1350374 - protein, 9 aa, Homo Sapiens
ELHTHTKEL

SEQ ID NO: 1350375 - protein, 9 aa, Homo Sapiens
DDLHINLWH

SEQ ID NO: 1350376 - protein, 9 aa, Homo Sapiens
INVALTQAT

SEQ ID NO: 1350377 - protein, 9 aa, Homo Sapiens
DEEANATST

SEQ ID NO: 1350378 - protein, 9 aa, Homo Sapiens
DYEEPDYGE

SEQ ID NO: 1350379 - protein, 9 aa, Homo Sapiens
QISRSFFLW

SEQ ID NO: 1350380 - protein, 9 aa, Homo Sapiens
NKKFFGGKQ

SEQ ID NO: 1350381 - protein, 9 aa, Homo Sapiens
PPIWVIQVQ

SEQ ID NO: 1350382 - protein, 9 aa, Homo Sapiens
MSSLPETPI

SEQ ID NO: 1350383 - protein, 9 aa, Homo Sapiens
NGVSSITNP

SEQ ID NO: 1350384 - protein, 9 aa, Homo Sapiens
AKLVANMFS

SEQ ID NO: 1350385 - protein, 9 aa, Homo Sapiens
PHPPQPKKS

SEQ ID NO: 1350386 - protein, 9 aa, Homo Sapiens
KKKQKEEEQ

SEQ ID NO: 1350387 - protein, 9 aa, Homo Sapiens
TLRQHHLVH

SEQ ID NO: 1350388 - protein, 9 aa, Homo Sapiens
DDFEVFFFT

SEQ ID NO: 1350389 - protein, 9 aa, Homo Sapiens
DLQTREDIW

SEQ ID NO: 1350390 - protein, 9 aa, Homo Sapiens
MRNQIVPDT

SEQ ID NO: 1350391 - protein, 9 aa, Homo Sapiens
NVVTSLAQA

SEQ ID NO: 1350392 - protein, 9 aa, Homo Sapiens
ILSRDATPL

SEQ ID NO: 1350393 - protein, 9 aa, Homo Sapiens
PSPAALPPR

SEQ ID NO: 1350394 - protein, 9 aa, Homo Sapiens
DMDNLSSES

SEQ ID NO: 1350395 - protein, 9 aa, Homo Sapiens
GCTFVNART

SEQ ID NO: 1350396 - protein, 9 aa, Homo Sapiens
TGHHHIVKF

SEQ ID NO: 1350397 - protein, 9 aa, Homo Sapiens
PTHADSTGE

SEQ ID NO: 1350398 - protein, 9 aa, Homo Sapiens
LLISLSSVM

SEQ ID NO: 1350399 - protein, 9 aa, Homo Sapiens
VVLGSLSGT

SEQ ID NO: 1350400 - protein, 9 aa, Homo Sapiens
KRVKLTGSI

SEQ ID NO: 1350401 - protein, 9 aa, Homo Sapiens
MVELHDPNS

SEQ ID NO: 1350402 - protein, 9 aa, Homo Sapiens
FDNGSMLQS

SEQ ID NO: 1350403 - protein, 9 aa, Homo Sapiens
TKIGCRSLS

SEQ ID NO: 1350404 - protein, 9 aa, Homo Sapiens
NHVFNQSAE

SEQ ID NO: 1350405 - protein, 9 aa, Homo Sapiens
LVANQSTSE

SEQ ID NO: 1350406 - protein, 9 aa, Homo Sapiens
RIQINFVFA

SEQ ID NO: 1350407 - protein, 9 aa, Homo Sapiens
LLGEKTQVL

SEQ ID NO: 1350408 - protein, 9 aa, Homo Sapiens
GAFLWGGLT

SEQ ID NO: 1350409 - protein, 9 aa, Homo Sapiens
GKNIDDLKR

SEQ ID NO: 1350410 - protein, 9 aa, Homo Sapiens
HLSVVVCVL

SEQ ID NO: 1350411 - protein, 9 aa, Homo Sapiens
RSRKMHSWS

SEQ ID NO: 1350412 - protein, 9 aa, Homo Sapiens
PAMRRPSSR

SEQ ID NO: 1350413 - protein, 9 aa, Homo Sapiens
AMGTRATST

SEQ ID NO: 1350414 - protein, 9 aa, Homo Sapiens
GISVMPKRG

SEQ ID NO: 1350415 - protein, 9 aa, Homo Sapiens
THTCTPTFS

SEQ ID NO: 1350416 - protein, 9 aa, Homo Sapiens
YIELPYGRE

SEQ ID NO: 1350417 - protein, 9 aa, Homo Sapiens
ISSRQTGIP

SEQ ID NO: 1350418 - protein, 9 aa, Homo Sapiens
FDVLEHHMN

SEQ ID NO: 1350419 - protein, 9 aa, Homo Sapiens
ALLKVQLAQ

SEQ ID NO: 1350420 - protein, 9 aa, Homo Sapiens
VICSILPYL

SEQ ID NO: 1350421 - protein, 9 aa, Homo Sapiens
GSRSHSLLR

SEQ ID NO: 1350422 - protein, 9 aa, Homo Sapiens
KMSSLPETP

SEQ ID NO: 1350423 - protein, 9 aa, Homo Sapiens
WKAVKTAVM

SEQ ID NO: 1350424 - protein, 9 aa, Homo Sapiens
VVPTRFGNT

SEQ ID NO: 1350425 - protein, 9 aa, Homo Sapiens
DIVMLQRWM

SEQ ID NO: 1350426 - protein, 9 aa, Homo Sapiens
AASSSGQQG

SEQ ID NO: 1350427 - protein, 9 aa, Homo Sapiens
PSRQSHRYD

SEQ ID NO: 1350428 - protein, 9 aa, Homo Sapiens
FIFSTEERT

SEQ ID NO: 1350429 - protein, 9 aa, Homo Sapiens
SKWVGIPAA

SEQ ID NO: 1350430 - protein, 9 aa, Homo Sapiens
VFLLFFWQC

SEQ ID NO: 1350431 - protein, 9 aa, Homo Sapiens
ALPSPRIPM

SEQ ID NO: 1350432 - protein, 9 aa, Homo Sapiens
SESYPLRQF

SEQ ID NO: 1350433 - protein, 9 aa, Homo Sapiens
TPEFQQTDS

SEQ ID NO: 1350434 - protein, 9 aa, Homo Sapiens
LSFIIQPSN

SEQ ID NO: 1350435 - protein, 9 aa, Homo Sapiens
EELKGLAPG

SEQ ID NO: 1350436 - protein, 9 aa, Homo Sapiens
EEFYAGDWH

SEQ ID NO: 1350437 - protein, 9 aa, Homo Sapiens
LMSVVPSAL

SEQ ID NO: 1350438 - protein, 9 aa, Homo Sapiens
HINKFTILH

SEQ ID NO: 1350439 - protein, 9 aa, Homo Sapiens
PGDDFFSSA

SEQ ID NO: 1350440 - protein, 9 aa, Homo Sapiens
NTLGIGLSL

SEQ ID NO: 1350441 - protein, 9 aa, Homo Sapiens
LRTSKEAIS

SEQ ID NO: 1350442 - protein, 9 aa, Homo Sapiens
WPETPLGHL

SEQ ID NO: 1350443 - protein, 9 aa, Homo Sapiens
MVQIPPSQS

SEQ ID NO: 1350444 - protein, 9 aa, Homo Sapiens
GPRREIENW

SEQ ID NO: 1350445 - protein, 9 aa, Homo Sapiens
DQKVNHFAY

SEQ ID NO: 1350446 - protein, 9 aa, Homo Sapiens
WEESLLTCT

SEQ ID NO: 1350447 - protein, 9 aa, Homo Sapiens
SVWILYLFL

SEQ ID NO: 1350448 - protein, 9 aa, Homo Sapiens
MGHFQVRGN

SEQ ID NO: 1350449 - protein, 9 aa, Homo Sapiens
QVLKKRRNP

SEQ ID NO: 1350450 - protein, 9 aa, Homo Sapiens
AHLSANARH

SEQ ID NO: 1350451 - protein, 9 aa, Homo Sapiens
PLIFQVAPL

SEQ ID NO: 1350452 - protein, 9 aa, Homo Sapiens
PRHPHQIAD

SEQ ID NO: 1350453 - protein, 9 aa, Homo Sapiens
QKRVCGWWP

SEQ ID NO: 1350454 - protein, 9 aa, Homo Sapiens
PATATMSPG

SEQ ID NO: 1350455 - protein, 9 aa, Homo Sapiens
VRAREALVA

SEQ ID NO: 1350456 - protein, 9 aa, Homo Sapiens
TTDESPRSH

SEQ ID NO: 1350457 - protein, 9 aa, Homo Sapiens
PVDMGSLVS

SEQ ID NO: 1350458 - protein, 9 aa, Homo Sapiens
RPSLVINGS

SEQ ID NO: 1350459 - protein, 9 aa, Homo Sapiens
KPIHAAKLN

SEQ ID NO: 1350460 - protein, 9 aa, Homo Sapiens
NFCDKASAK

SEQ ID NO: 1350461 - protein, 9 aa, Homo Sapiens
EDGWTTVRH

SEQ ID NO: 1350462 - protein, 9 aa, Homo Sapiens
IFHPENAVS

SEQ ID NO: 1350463 - protein, 9 aa, Homo Sapiens
AWLGVFRAE

SEQ ID NO: 1350464 - protein, 9 aa, Homo Sapiens
LEDFPMDTH

SEQ ID NO: 1350465 - protein, 9 aa, Homo Sapiens
DTSWVGWGS

SEQ ID NO: 1350466 - protein, 9 aa, Homo Sapiens
DYEGDTVTF

SEQ ID NO: 1350467 - protein, 9 aa, Homo Sapiens
WLCCITQHT

SEQ ID NO: 1350468 - protein, 9 aa, Homo Sapiens
AREIICQSL

SEQ ID NO: 1350469 - protein, 9 aa, Homo Sapiens
DASHLIFQV

SEQ ID NO: 1350470 - protein, 9 aa, Homo Sapiens
TAVYVEMRR

SEQ ID NO: 1350471 - protein, 9 aa, Homo Sapiens
GRVNRRQRR

SEQ ID NO: 1350472 - protein, 9 aa, Homo Sapiens
TVVKCDILP

SEQ ID NO: 1350473 - protein, 9 aa, Homo Sapiens
CVICDSYVC

SEQ ID NO: 1350474 - protein, 9 aa, Homo Sapiens
NNDSKLEEV

SEQ ID NO: 1350475 - protein, 9 aa, Homo Sapiens
GLVMTWSMV

SEQ ID NO: 1350476 - protein, 9 aa, Homo Sapiens
LYSKHFSIF

SEQ ID NO: 1350477 - protein, 9 aa, Homo Sapiens
FFVPFPYLY

SEQ ID NO: 1350478 - protein, 9 aa, Homo Sapiens
QVVCSIALF

SEQ ID NO: 1350479 - protein, 9 aa, Homo Sapiens
QPQKINNEN

SEQ ID NO: 1350480 - protein, 9 aa, Homo Sapiens
RYNDMPIVR

SEQ ID NO: 1350481 - protein, 9 aa, Homo Sapiens
GRTRQALAS

SEQ ID NO: 1350482 - protein, 9 aa, Homo Sapiens
PRPFCMRHV

SEQ ID NO: 1350483 - protein, 9 aa, Homo Sapiens
SHRSQTHSR

SEQ ID NO: 1350484 - protein, 9 aa, Homo Sapiens
LGNSFTHLP

SEQ ID NO: 1350485 - protein, 9 aa, Homo Sapiens
LTFSLSQED

SEQ ID NO: 1350486 - protein, 9 aa, Homo Sapiens
QNQYIHISS

SEQ ID NO: 1350487 - protein, 9 aa, Homo Sapiens
QTTHSTFFL

SEQ ID NO: 1350488 - protein, 9 aa, Homo Sapiens
KYLIGMLAY

SEQ ID NO: 1350489 - protein, 9 aa, Homo Sapiens
VVFAAASRG

SEQ ID NO: 1350490 - protein, 9 aa, Homo Sapiens
SFELVVHFF

SEQ ID NO: 1350491 - protein, 9 aa, Homo Sapiens
KEDRRFNID

SEQ ID NO: 1350492 - protein, 9 aa, Homo Sapiens
EEETVGGQT

SEQ ID NO: 1350493 - protein, 9 aa, Homo Sapiens
DWCLFRNIF

SEQ ID NO: 1350494 - protein, 9 aa, Homo Sapiens
ADLPYQFAN

SEQ ID NO: 1350495 - protein, 9 aa, Homo Sapiens
RMSLWPQDS

SEQ ID NO: 1350496 - protein, 9 aa, Homo Sapiens
LEEEQQIRL

SEQ ID NO: 1350497 - protein, 9 aa, Homo Sapiens
EDGTVCIWH

SEQ ID NO: 1350498 - protein, 9 aa, Homo Sapiens
LDIVAMFHQ

SEQ ID NO: 1350499 - protein, 9 aa, Homo Sapiens
ACRQDDMEI

SEQ ID NO: 1350500 - protein, 9 aa, Homo Sapiens
PDVHFTVDK

SEQ ID NO: 1350501 - protein, 9 aa, Homo Sapiens
AKERKEENT

SEQ ID NO: 1350502 - protein, 9 aa, Homo Sapiens
SGSLPFDDQ

SEQ ID NO: 1350503 - protein, 9 aa, Homo Sapiens
LSVEIDDNF

SEQ ID NO: 1350504 - protein, 9 aa, Homo Sapiens
LLTPAFLPH

SEQ ID NO: 1350505 - protein, 9 aa, Homo Sapiens
RVDAHVVLE

SEQ ID NO: 1350506 - protein, 9 aa, Homo Sapiens
QYIHISSSP

SEQ ID NO: 1350507 - protein, 9 aa, Homo Sapiens
ITIRGEIQD

SEQ ID NO: 1350508 - protein, 9 aa, Homo Sapiens
RLGVLPLPE

SEQ ID NO: 1350509 - protein, 9 aa, Homo Sapiens
ASSPSPPTP

SEQ ID NO: 1350510 - protein, 9 aa, Homo Sapiens
EHHVVVSGD

SEQ ID NO: 1350511 - protein, 9 aa, Homo Sapiens
WLDPSKKVL

SEQ ID NO: 1350512 - protein, 9 aa, Homo Sapiens
SPKHVGFVT

SEQ ID NO: 1350513 - protein, 9 aa, Homo Sapiens
FVEVKPGHV

SEQ ID NO: 1350514 - protein, 9 aa, Homo Sapiens
QCLSHSVFD

SEQ ID NO: 1350515 - protein, 9 aa, Homo Sapiens
ALEKYHDSI

SEQ ID NO: 1350516 - protein, 9 aa, Homo Sapiens
TVAGLNQVN

SEQ ID NO: 1350517 - protein, 9 aa, Homo Sapiens
NYEMSGETL

SEQ ID NO: 1350518 - protein, 9 aa, Homo Sapiens
AYLCNTQIT

SEQ ID NO: 1350519 - protein, 9 aa, Homo Sapiens
HECGTKCPV

SEQ ID NO: 1350520 - protein, 9 aa, Homo Sapiens
FPESASDTI

SEQ ID NO: 1350521 - protein, 9 aa, Homo Sapiens
GLTESCGDG

SEQ ID NO: 1350522 - protein, 9 aa, Homo Sapiens
YPEPLCFFP

SEQ ID NO: 1350523 - protein, 9 aa, Homo Sapiens
GKCQSSVTV

SEQ ID NO: 1350524 - protein, 9 aa, Homo Sapiens
EFVKQPHHH

SEQ ID NO: 1350525 - protein, 9 aa, Homo Sapiens
MAVVLQRVE

SEQ ID NO: 1350526 - protein, 9 aa, Homo Sapiens
VQVVRAREA

SEQ ID NO: 1350527 - protein, 9 aa, Homo Sapiens
IPEHYPGLG

SEQ ID NO: 1350528 - protein, 9 aa, Homo Sapiens
EGGQFFSPK

SEQ ID NO: 1350529 - protein, 9 aa, Homo Sapiens
YRRSRAASV

SEQ ID NO: 1350530 - protein, 9 aa, Homo Sapiens
SLSNATPCT

SEQ ID NO: 1350531 - protein, 9 aa, Homo Sapiens
LAVPGLWVV

SEQ ID NO: 1350532 - protein, 9 aa, Homo Sapiens
QTRITLQEE

SEQ ID NO: 1350533 - protein, 9 aa, Homo Sapiens
LHLLVADQD

SEQ ID NO: 1350534 - protein, 9 aa, Homo Sapiens
IKVYCQHMQ

SEQ ID NO: 1350535 - protein, 9 aa, Homo Sapiens
GANTFEMIL

SEQ ID NO: 1350536 - protein, 9 aa, Homo Sapiens
MELQSWCPV

SEQ ID NO: 1350537 - protein, 9 aa, Homo Sapiens
PLSNPDGPV

SEQ ID NO: 1350538 - protein, 9 aa, Homo Sapiens
VIFSLVKTP

SEQ ID NO: 1350539 - protein, 9 aa, Homo Sapiens
TWTVRSAAC

SEQ ID NO: 1350540 - protein, 9 aa, Homo Sapiens
CNNHNVQCR

SEQ ID NO: 1350541 - protein, 9 aa, Homo Sapiens
TDDILWQWA

SEQ ID NO: 1350542 - protein, 9 aa, Homo Sapiens
CGSTCNNES

SEQ ID NO: 1350543 - protein, 9 aa, Homo Sapiens
VFIDTASYK

SEQ ID NO: 1350544 - protein, 9 aa, Homo Sapiens
LGLLVPRLV

SEQ ID NO: 1350545 - protein, 9 aa, Homo Sapiens
TRKPEELKG

SEQ ID NO: 1350546 - protein, 9 aa, Homo Sapiens
DLLEGQEKN

SEQ ID NO: 1350547 - protein, 9 aa, Homo Sapiens
KFRTWAEWR

SEQ ID NO: 1350548 - protein, 9 aa, Homo Sapiens
VSLHFCTPG

SEQ ID NO: 1350549 - protein, 9 aa, Homo Sapiens
YGNIHSWMN

SEQ ID NO: 1350550 - protein, 9 aa, Homo Sapiens
GGKATLKAA

SEQ ID NO: 1350551 - protein, 9 aa, Homo Sapiens
LTPMLGLDE

SEQ ID NO: 1350552 - protein, 9 aa, Homo Sapiens
CVSLHSVPG

SEQ ID NO: 1350553 - protein, 9 aa, Homo Sapiens
TGNKREQTK

SEQ ID NO: 1350554 - protein, 9 aa, Homo Sapiens
TSTLPLPPA

SEQ ID NO: 1350555 - protein, 9 aa, Homo Sapiens
SWCSRLQAH

SEQ ID NO: 1350556 - protein, 9 aa, Homo Sapiens
VGLAPQLRR

SEQ ID NO: 1350557 - protein, 9 aa, Homo Sapiens
LVVKTTLKL

SEQ ID NO: 1350558 - protein, 9 aa, Homo Sapiens
NQDFLPSGR

SEQ ID NO: 1350559 - protein, 9 aa, Homo Sapiens
RQHSLYIDL

SEQ ID NO: 1350560 - protein, 9 aa, Homo Sapiens
THVLNVAHG

SEQ ID NO: 1350561 - protein, 9 aa, Homo Sapiens
HQEIQELKA

SEQ ID NO: 1350562 - protein, 9 aa, Homo Sapiens
VSIYVPFLI

SEQ ID NO: 1350563 - protein, 9 aa, Homo Sapiens
LCTISLDRY

SEQ ID NO: 1350564 - protein, 9 aa, Homo Sapiens
IASIPGIIL

SEQ ID NO: 1350565 - protein, 9 aa, Homo Sapiens
GRGEDGTPI

SEQ ID NO: 1350566 - protein, 9 aa, Homo Sapiens
AASAARPST

SEQ ID NO: 1350567 - protein, 9 aa, Homo Sapiens
HPATFTAHT

SEQ ID NO: 1350568 - protein, 9 aa, Homo Sapiens
YDRSLQCSP

SEQ ID NO: 1350569 - protein, 9 aa, Homo Sapiens
YGPITFKDF

SEQ ID NO: 1350570 - protein, 9 aa, Homo Sapiens
GALTPPGTV

SEQ ID NO: 1350571 - protein, 9 aa, Homo Sapiens
SEQARVRAA

SEQ ID NO: 1350572 - protein, 9 aa, Homo Sapiens
EGIAVSHRN

SEQ ID NO: 1350573 - protein, 9 aa, Homo Sapiens
DLHVFTPTS

SEQ ID NO: 1350574 - protein, 9 aa, Homo Sapiens
PKSVSSHSD

SEQ ID NO: 1350575 - protein, 9 aa, Homo Sapiens
FRLWQGWCL

SEQ ID NO: 1350576 - protein, 9 aa, Homo Sapiens
FQNRVHEKQ

SEQ ID NO: 1350577 - protein, 9 aa, Homo Sapiens
IIPLPTWNA

SEQ ID NO: 1350578 - protein, 9 aa, Homo Sapiens
WDVAHFGIR

SEQ ID NO: 1350579 - protein, 9 aa, Homo Sapiens
LNTEELCTL

SEQ ID NO: 1350580 - protein, 9 aa, Homo Sapiens
DCHYPYEYL

SEQ ID NO: 1350581 - protein, 9 aa, Homo Sapiens
GIAVIHGEV

SEQ ID NO: 1350582 - protein, 9 aa, Homo Sapiens
NHFRLWQGW

SEQ ID NO: 1350583 - protein, 9 aa, Homo Sapiens
VKWLVVVIM

SEQ ID NO: 1350584 - protein, 9 aa, Homo Sapiens
TFITVLKMV

SEQ ID NO: 1350585 - protein, 9 aa, Homo Sapiens
QEKQFPMKK

SEQ ID NO: 1350586 - protein, 9 aa, Homo Sapiens
ADYSGSSES

SEQ ID NO: 1350587 - protein, 9 aa, Homo Sapiens
PSLCRLNLS

SEQ ID NO: 1350588 - protein, 9 aa, Homo Sapiens
QAQAALQVP

SEQ ID NO: 1350589 - protein, 9 aa, Homo Sapiens
SYFTGDYTP

SEQ ID NO: 1350590 - protein, 9 aa, Homo Sapiens
GIGVGECSS

SEQ ID NO: 1350591 - protein, 9 aa, Homo Sapiens
NSLNDSFKH

SEQ ID NO: 1350592 - protein, 9 aa, Homo Sapiens
CCTLVALSW

SEQ ID NO: 1350593 - protein, 9 aa, Homo Sapiens
GPKSNHGHS

SEQ ID NO: 1350594 - protein, 9 aa, Homo Sapiens
LQLTFFNIP

SEQ ID NO: 1350595 - protein, 9 aa, Homo Sapiens
QNAFGDHWG

SEQ ID NO: 1350596 - protein, 9 aa, Homo Sapiens
RFRATFVSH

SEQ ID NO: 1350597 - protein, 9 aa, Homo Sapiens
VLQERMDKL

SEQ ID NO: 1350598 - protein, 9 aa, Homo Sapiens
HLGGRTIIT

SEQ ID NO: 1350599 - protein, 9 aa, Homo Sapiens
LAHCMKREV

SEQ ID NO: 1350600 - protein, 9 aa, Homo Sapiens
LAFPSPQGP

SEQ ID NO: 1350601 - protein, 9 aa, Homo Sapiens
LVGQYNQPE

SEQ ID NO: 1350602 - protein, 9 aa, Homo Sapiens
EEGLFRIPG

SEQ ID NO: 1350603 - protein, 9 aa, Homo Sapiens
QEIHDEQAN

SEQ ID NO: 1350604 - protein, 9 aa, Homo Sapiens
AWGHEVILE

SEQ ID NO: 1350605 - protein, 9 aa, Homo Sapiens
GMLLPGIET

SEQ ID NO: 1350606 - protein, 9 aa, Homo Sapiens
RAEPRPPRD

SEQ ID NO: 1350607 - protein, 9 aa, Homo Sapiens
IIPIYSFGI

SEQ ID NO: 1350608 - protein, 9 aa, Homo Sapiens
GNIREEVNN

SEQ ID NO: 1350609 - protein, 9 aa, Homo Sapiens
SYFEHISTY

SEQ ID NO: 1350610 - protein, 9 aa, Homo Sapiens
RQPTQLTQG

SEQ ID NO: 1350611 - protein, 9 aa, Homo Sapiens
SMRKFSLLK

SEQ ID NO: 1350612 - protein, 9 aa, Homo Sapiens
AHVPPPPPI

SEQ ID NO: 1350613 - protein, 9 aa, Homo Sapiens
CKGKSLVNK

SEQ ID NO: 1350614 - protein, 9 aa, Homo Sapiens
KEKAAIIEE

SEQ ID NO: 1350615 - protein, 9 aa, Homo Sapiens
APHLLQGAR

SEQ ID NO: 1350616 - protein, 9 aa, Homo Sapiens
IREMLISWL

SEQ ID NO: 1350617 - protein, 9 aa, Homo Sapiens
YTSDSAEKC

SEQ ID NO: 1350618 - protein, 9 aa, Homo Sapiens
EIEHIFELA

SEQ ID NO: 1350619 - protein, 9 aa, Homo Sapiens
LSRHQVLTR

SEQ ID NO: 1350620 - protein, 9 aa, Homo Sapiens
DEVRAIRHS

SEQ ID NO: 1350621 - protein, 9 aa, Homo Sapiens
VVKQNADMA

SEQ ID NO: 1350622 - protein, 9 aa, Homo Sapiens
MTHLKRLVK

SEQ ID NO: 1350623 - protein, 9 aa, Homo Sapiens
IGPDTVAYA

SEQ ID NO: 1350624 - protein, 9 aa, Homo Sapiens
SSAATARRP

SEQ ID NO: 1350625 - protein, 9 aa, Homo Sapiens
PFSPLCDHT

SEQ ID NO: 1350626 - protein, 9 aa, Homo Sapiens
SSNSHLVHH

SEQ ID NO: 1350627 - protein, 9 aa, Homo Sapiens
LIIVTSISL

SEQ ID NO: 1350628 - protein, 9 aa, Homo Sapiens
VDKATARKV

SEQ ID NO: 1350629 - protein, 9 aa, Homo Sapiens
RLGLSEARM

SEQ ID NO: 1350630 - protein, 9 aa, Homo Sapiens
SPEQLPRDE

SEQ ID NO: 1350631 - protein, 9 aa, Homo Sapiens
FRNPHHSQK

SEQ ID NO: 1350632 - protein, 9 aa, Homo Sapiens
LTEKDVSHA

SEQ ID NO: 1350633 - protein, 9 aa, Homo Sapiens
VIARLAVHP

SEQ ID NO: 1350634 - protein, 9 aa, Homo Sapiens
IKLNWTGTS

SEQ ID NO: 1350635 - protein, 9 aa, Homo Sapiens
DDDGDDLER

SEQ ID NO: 1350636 - protein, 9 aa, Homo Sapiens
RLSRIVFCH

SEQ ID NO: 1350637 - protein, 9 aa, Homo Sapiens
KKDIPVRTM

SEQ ID NO: 1350638 - protein, 9 aa, Homo Sapiens
FDCMHGYIF

SEQ ID NO: 1350639 - protein, 9 aa, Homo Sapiens
GNTQLNEAT

SEQ ID NO: 1350640 - protein, 9 aa, Homo Sapiens
CPFGFEGNN

SEQ ID NO: 1350641 - protein, 9 aa, Homo Sapiens
VVKVFHSSL

SEQ ID NO: 1350642 - protein, 9 aa, Homo Sapiens
TGYQWLDLC

SEQ ID NO: 1350643 - protein, 9 aa, Homo Sapiens
TVIHGTNSE

SEQ ID NO: 1350644 - protein, 9 aa, Homo Sapiens
TGAEWNSPL

SEQ ID NO: 1350645 - protein, 9 aa, Homo Sapiens
KTHDPKAEE

SEQ ID NO: 1350646 - protein, 9 aa, Homo Sapiens
RTHQWRTST

SEQ ID NO: 1350647 - protein, 9 aa, Homo Sapiens
IVNHPSAVL

SEQ ID NO: 1350648 - protein, 9 aa, Homo Sapiens
LCVSFSYAG

SEQ ID NO: 1350649 - protein, 9 aa, Homo Sapiens
LCAWDFNID

SEQ ID NO: 1350650 - protein, 9 aa, Homo Sapiens
SCRAFRCSR

SEQ ID NO: 1350651 - protein, 9 aa, Homo Sapiens
SWTCLADLE

SEQ ID NO: 1350652 - protein, 9 aa, Homo Sapiens
RPLSIGPHL

SEQ ID NO: 1350653 - protein, 9 aa, Homo Sapiens
NILMALQMG

SEQ ID NO: 1350654 - protein, 9 aa, Homo Sapiens
LTPSQIKFM

SEQ ID NO: 1350655 - protein, 9 aa, Homo Sapiens
VSKLVVTKE

SEQ ID NO: 1350656 - protein, 9 aa, Homo Sapiens
LSHVSDHKH

SEQ ID NO: 1350657 - protein, 9 aa, Homo Sapiens
FMDRDSDGK

SEQ ID NO: 1350658 - protein, 9 aa, Homo Sapiens
WTTPLLSMT

SEQ ID NO: 1350659 - protein, 9 aa, Homo Sapiens
HVDKCPRTA

SEQ ID NO: 1350660 - protein, 9 aa, Homo Sapiens
ANYSLIPAE

SEQ ID NO: 1350661 - protein, 9 aa, Homo Sapiens
LSAPYGFAL

SEQ ID NO: 1350662 - protein, 9 aa, Homo Sapiens
GLEEQGRPD

SEQ ID NO: 1350663 - protein, 9 aa, Homo Sapiens
ADMALQNLR

SEQ ID NO: 1350664 - protein, 9 aa, Homo Sapiens
QPKEDIPEH

SEQ ID NO: 1350665 - protein, 9 aa, Homo Sapiens
QGLWHRFNR

SEQ ID NO: 1350666 - protein, 9 aa, Homo Sapiens
VQLGTQKVA

SEQ ID NO: 1350667 - protein, 9 aa, Homo Sapiens
VPSVIRINQ

SEQ ID NO: 1350668 - protein, 9 aa, Homo Sapiens
GSNMTFLAE

SEQ ID NO: 1350669 - protein, 9 aa, Homo Sapiens
LGHLEMPKT

SEQ ID NO: 1350670 - protein, 9 aa, Homo Sapiens
PQPKCWQQD

SEQ ID NO: 1350671 - protein, 9 aa, Homo Sapiens
KVGTFQQML

SEQ ID NO: 1350672 - protein, 9 aa, Homo Sapiens
GEGFKEVVQ

SEQ ID NO: 1350673 - protein, 9 aa, Homo Sapiens
IFYNITGPG

SEQ ID NO: 1350674 - protein, 9 aa, Homo Sapiens
EHKKEETRC

SEQ ID NO: 1350675 - protein, 9 aa, Homo Sapiens
FLHIMEDDI

SEQ ID NO: 1350676 - protein, 9 aa, Homo Sapiens
HLPSTHQIS

SEQ ID NO: 1350677 - protein, 9 aa, Homo Sapiens
SLATTDCIL

SEQ ID NO: 1350678 - protein, 9 aa, Homo Sapiens
LEDHTWVPP

SEQ ID NO: 1350679 - protein, 9 aa, Homo Sapiens
HSHCTHCLC

SEQ ID NO: 1350680 - protein, 9 aa, Homo Sapiens
SNTFPIWFE

SEQ ID NO: 1350681 - protein, 9 aa, Homo Sapiens
YDNKSHVDL

SEQ ID NO: 1350682 - protein, 9 aa, Homo Sapiens
MVDNFHPLQ

SEQ ID NO: 1350683 - protein, 9 aa, Homo Sapiens
QQTQALGIT

SEQ ID NO: 1350684 - protein, 9 aa, Homo Sapiens
VSHFDFYYG

SEQ ID NO: 1350685 - protein, 9 aa, Homo Sapiens
QLLQEPHLF

SEQ ID NO: 1350686 - protein, 9 aa, Homo Sapiens
FWEGPVVHH

SEQ ID NO: 1350687 - protein, 9 aa, Homo Sapiens
QPHIIVSTT

SEQ ID NO: 1350688 - protein, 9 aa, Homo Sapiens
EDSGLMHDL

SEQ ID NO: 1350689 - protein, 9 aa, Homo Sapiens
AMIYDDQGD

SEQ ID NO: 1350690 - protein, 9 aa, Homo Sapiens
SFGRNMELE

SEQ ID NO: 1350691 - protein, 9 aa, Homo Sapiens
GEDFIFHPV

SEQ ID NO: 1350692 - protein, 9 aa, Homo Sapiens
LDVMSYDRY

SEQ ID NO: 1350693 - protein, 9 aa, Homo Sapiens
EVKVMQCWC

SEQ ID NO: 1350694 - protein, 9 aa, Homo Sapiens
EVSGYLGKS

SEQ ID NO: 1350695 - protein, 9 aa, Homo Sapiens
NHLVPVERV

SEQ ID NO: 1350696 - protein, 9 aa, Homo Sapiens
GGRHPSWPW

SEQ ID NO: 1350697 - protein, 9 aa, Homo Sapiens
PVKWGEENT

SEQ ID NO: 1350698 - protein, 9 aa, Homo Sapiens
IHSHHTILY

SEQ ID NO: 1350699 - protein, 9 aa, Homo Sapiens
ITGKGGKTK

SEQ ID NO: 1350700 - protein, 9 aa, Homo Sapiens
IWAVAWVIP

SEQ ID NO: 1350701 - protein, 9 aa, Homo Sapiens
WGRVLRKAI

SEQ ID NO: 1350702 - protein, 9 aa, Homo Sapiens
KQYMGNRFV

SEQ ID NO: 1350703 - protein, 9 aa, Homo Sapiens
GDLGAMTSE

SEQ ID NO: 1350704 - protein, 9 aa, Homo Sapiens
VRHWHLWKH

SEQ ID NO: 1350705 - protein, 9 aa, Homo Sapiens
CEQVLLIKR

SEQ ID NO: 1350706 - protein, 9 aa, Homo Sapiens
RKGQIWRGQ

SEQ ID NO: 1350707 - protein, 9 aa, Homo Sapiens
NETTFNSIM

SEQ ID NO: 1350708 - protein, 9 aa, Homo Sapiens
YDPKGSLDN

SEQ ID NO: 1350709 - protein, 9 aa, Homo Sapiens
GNISKPIMG

SEQ ID NO: 1350710 - protein, 9 aa, Homo Sapiens
DLFQWVVSR

SEQ ID NO: 1350711 - protein, 9 aa, Homo Sapiens
VEAGTPSPR

SEQ ID NO: 1350712 - protein, 9 aa, Homo Sapiens
RPRHPHQIA

SEQ ID NO: 1350713 - protein, 9 aa, Homo Sapiens
GFIKKTFDA

SEQ ID NO: 1350714 - protein, 9 aa, Homo Sapiens
EDEHKILLD

SEQ ID NO: 1350715 - protein, 9 aa, Homo Sapiens
ENMLAKLYI

SEQ ID NO: 1350716 - protein, 9 aa, Homo Sapiens
LAATHGYSF

SEQ ID NO: 1350717 - protein, 9 aa, Homo Sapiens
NDGEGSSEA

SEQ ID NO: 1350718 - protein, 9 aa, Homo Sapiens
CIRYVVDLY

SEQ ID NO: 1350719 - protein, 9 aa, Homo Sapiens
VLFAIGAFS

SEQ ID NO: 1350720 - protein, 9 aa, Homo Sapiens
FVFGHPLSF

SEQ ID NO: 1350721 - protein, 9 aa, Homo Sapiens
DRYPQAGPR

SEQ ID NO: 1350722 - protein, 9 aa, Homo Sapiens
QTYIPVLCI

SEQ ID NO: 1350723 - protein, 9 aa, Homo Sapiens
HPHQIADLF

SEQ ID NO: 1350724 - protein, 9 aa, Homo Sapiens
RFRVVIKDK

SEQ ID NO: 1350725 - protein, 9 aa, Homo Sapiens
DSGVLDRMM

SEQ ID NO: 1350726 - protein, 9 aa, Homo Sapiens
KGAGLQFWE

SEQ ID NO: 1350727 - protein, 9 aa, Homo Sapiens
DLCCIPNHS

SEQ ID NO: 1350728 - protein, 9 aa, Homo Sapiens
MYNKIFTIP

SEQ ID NO: 1350729 - protein, 9 aa, Homo Sapiens
STEFFLLDV

SEQ ID NO: 1350730 - protein, 9 aa, Homo Sapiens
KRNRAIMAR

SEQ ID NO: 1350731 - protein, 9 aa, Homo Sapiens
VLWDSNGKR

SEQ ID NO: 1350732 - protein, 9 aa, Homo Sapiens
KAIFENMLS

SEQ ID NO: 1350733 - protein, 9 aa, Homo Sapiens
KNMLVTLCH

SEQ ID NO: 1350734 - protein, 9 aa, Homo Sapiens
PRLPGVGLA

SEQ ID NO: 1350735 - protein, 9 aa, Homo Sapiens
DGRRRRHNL

SEQ ID NO: 1350736 - protein, 9 aa, Homo Sapiens
ATHTCTPTF

SEQ ID NO: 1350737 - protein, 9 aa, Homo Sapiens
HYYQGSQGV

SEQ ID NO: 1350738 - protein, 9 aa, Homo Sapiens
PQGELLSRV

SEQ ID NO: 1350739 - protein, 9 aa, Homo Sapiens
AFLGCMDSI

SEQ ID NO: 1350740 - protein, 9 aa, Homo Sapiens
DHIPDYTPL

SEQ ID NO: 1350741 - protein, 9 aa, Homo Sapiens
TSSSTIVST

SEQ ID NO: 1350742 - protein, 9 aa, Homo Sapiens
YASTSGKPR

SEQ ID NO: 1350743 - protein, 9 aa, Homo Sapiens
VKEALMWYS

SEQ ID NO: 1350744 - protein, 9 aa, Homo Sapiens
KDIPVRTMV

SEQ ID NO: 1350745 - protein, 9 aa, Homo Sapiens
KRCSASSGS

SEQ ID NO: 1350746 - protein, 9 aa, Homo Sapiens
NHKQYLTYH

SEQ ID NO: 1350747 - protein, 9 aa, Homo Sapiens
SRIVAPGHA

SEQ ID NO: 1350748 - protein, 9 aa, Homo Sapiens
LPSECILPA

SEQ ID NO: 1350749 - protein, 9 aa, Homo Sapiens
TGFCDGLGF

SEQ ID NO: 1350750 - protein, 9 aa, Homo Sapiens
LSSVPSLHV

SEQ ID NO: 1350751 - protein, 9 aa, Homo Sapiens
PPRDCVQGK

SEQ ID NO: 1350752 - protein, 9 aa, Homo Sapiens
GPSLTQPEL

SEQ ID NO: 1350753 - protein, 9 aa, Homo Sapiens
SALLHLLAT

SEQ ID NO: 1350754 - protein, 9 aa, Homo Sapiens
TRVEMDRVL

SEQ ID NO: 1350755 - protein, 9 aa, Homo Sapiens
GPDGHYTMD

SEQ ID NO: 1350756 - protein, 9 aa, Homo Sapiens
KEYVVNEVV

SEQ ID NO: 1350757 - protein, 9 aa, Homo Sapiens
EVDRTSSKK

SEQ ID NO: 1350758 - protein, 9 aa, Homo Sapiens
RQDRMAFCV

SEQ ID NO: 1350759 - protein, 9 aa, Homo Sapiens
QKFLGSFLL

SEQ ID NO: 1350760 - protein, 9 aa, Homo Sapiens
KVDFILQWE

SEQ ID NO: 1350761 - protein, 9 aa, Homo Sapiens
RFCWSCHHD

SEQ ID NO: 1350762 - protein, 9 aa, Homo Sapiens
PDAHSDYAH

SEQ ID NO: 1350763 - protein, 9 aa, Homo Sapiens
GLHMGFSTP

SEQ ID NO: 1350764 - protein, 9 aa, Homo Sapiens
SLLFQKRQC

SEQ ID NO: 1350765 - protein, 9 aa, Homo Sapiens
QDIKPQNLL

SEQ ID NO: 1350766 - protein, 9 aa, Homo Sapiens
FQEMCDKVH

SEQ ID NO: 1350767 - protein, 9 aa, Homo Sapiens
YWDHCVVGG

SEQ ID NO: 1350768 - protein, 9 aa, Homo Sapiens
TILPTLHSA

SEQ ID NO: 1350769 - protein, 9 aa, Homo Sapiens
WLEVWRVSP

SEQ ID NO: 1350770 - protein, 9 aa, Homo Sapiens
LRRGHYLTV

SEQ ID NO: 1350771 - protein, 9 aa, Homo Sapiens
GSLDEDEEE

SEQ ID NO: 1350772 - protein, 9 aa, Homo Sapiens
LCNHPVSFV

SEQ ID NO: 1350773 - protein, 9 aa, Homo Sapiens
SNGDLGAMT

SEQ ID NO: 1350774 - protein, 9 aa, Homo Sapiens
NDGVSKANF

SEQ ID NO: 1350775 - protein, 9 aa, Homo Sapiens
KTILESSSY

SEQ ID NO: 1350776 - protein, 9 aa, Homo Sapiens
SGGNTDMLM

SEQ ID NO: 1350777 - protein, 9 aa, Homo Sapiens
SHQDASLCL

SEQ ID NO: 1350778 - protein, 9 aa, Homo Sapiens
TEIFRRVYY

SEQ ID NO: 1350779 - protein, 9 aa, Homo Sapiens
IRNPKDTPF

SEQ ID NO: 1350780 - protein, 9 aa, Homo Sapiens
PGDSDLLRC

SEQ ID NO: 1350781 - protein, 9 aa, Homo Sapiens
PCTSPEAMR

SEQ ID NO: 1350782 - protein, 9 aa, Homo Sapiens
SAGENTFLR

SEQ ID NO: 1350783 - protein, 9 aa, Homo Sapiens
YQGRDDDAS

SEQ ID NO: 1350784 - protein, 9 aa, Homo Sapiens
SPRVFPVLW

SEQ ID NO: 1350785 - protein, 9 aa, Homo Sapiens
KFIWCCYVC

SEQ ID NO: 1350786 - protein, 9 aa, Homo Sapiens
PGEADLADG

SEQ ID NO: 1350787 - protein, 9 aa, Homo Sapiens
GSTTSSSLG

SEQ ID NO: 1350788 - protein, 9 aa, Homo Sapiens
LEGRGTPCT

SEQ ID NO: 1350789 - protein, 9 aa, Homo Sapiens
ISVVHRLST

SEQ ID NO: 1350790 - protein, 9 aa, Homo Sapiens
CSPSLSSKH

SEQ ID NO: 1350791 - protein, 9 aa, Homo Sapiens
SLRLPPTPP

SEQ ID NO: 1350792 - protein, 9 aa, Homo Sapiens
EIKLHLLGT

SEQ ID NO: 1350793 - protein, 9 aa, Homo Sapiens
IQSHYNIED

SEQ ID NO: 1350794 - protein, 9 aa, Homo Sapiens
NKAIKLQYQ

SEQ ID NO: 1350795 - protein, 9 aa, Homo Sapiens
QESCLIRLH

SEQ ID NO: 1350796 - protein, 9 aa, Homo Sapiens
AAHFPSVAL

SEQ ID NO: 1350797 - protein, 9 aa, Homo Sapiens
VLTSIKGTS

SEQ ID NO: 1350798 - protein, 9 aa, Homo Sapiens
PSSVIFSLV

SEQ ID NO: 1350799 - protein, 9 aa, Homo Sapiens
QNLTQKKCW

SEQ ID NO: 1350800 - protein, 9 aa, Homo Sapiens
HRAVDVGAF

SEQ ID NO: 1350801 - protein, 9 aa, Homo Sapiens
RLANIRKCT

SEQ ID NO: 1350802 - protein, 9 aa, Homo Sapiens
HISIHQPGV

SEQ ID NO: 1350803 - protein, 9 aa, Homo Sapiens
IFLPPVGSE

SEQ ID NO: 1350804 - protein, 9 aa, Homo Sapiens
SIMSGRCKA

SEQ ID NO: 1350805 - protein, 9 aa, Homo Sapiens
KADQPNNRM

SEQ ID NO: 1350806 - protein, 9 aa, Homo Sapiens
KETRKRITI

SEQ ID NO: 1350807 - protein, 9 aa, Homo Sapiens
FFEDLKQCL

SEQ ID NO: 1350808 - protein, 9 aa, Homo Sapiens
ICKLSYPQE

SEQ ID NO: 1350809 - protein, 9 aa, Homo Sapiens
LIYWVSICF

SEQ ID NO: 1350810 - protein, 9 aa, Homo Sapiens
VTTADFLDA

SEQ ID NO: 1350811 - protein, 9 aa, Homo Sapiens
RLLFRHYLR

SEQ ID NO: 1350812 - protein, 9 aa, Homo Sapiens
EYYVRFTLF

SEQ ID NO: 1350813 - protein, 9 aa, Homo Sapiens
TALWKEKEA

SEQ ID NO: 1350814 - protein, 9 aa, Homo Sapiens
AYDPKGSLD

SEQ ID NO: 1350815 - protein, 9 aa, Homo Sapiens
VGPLPCVLP

SEQ ID NO: 1350816 - protein, 9 aa, Homo Sapiens
RGKTQEEIE

SEQ ID NO: 1350817 - protein, 9 aa, Homo Sapiens
DFKRLPGGH

SEQ ID NO: 1350818 - protein, 9 aa, Homo Sapiens
ARMERLTKQ

SEQ ID NO: 1350819 - protein, 9 aa, Homo Sapiens
GTTSDTSLW

SEQ ID NO: 1350820 - protein, 9 aa, Homo Sapiens
STHTKCKLC

SEQ ID NO: 1350821 - protein, 9 aa, Homo Sapiens
VRHIAEVAK

SEQ ID NO: 1350822 - protein, 9 aa, Homo Sapiens
FFYQERANK

SEQ ID NO: 1350823 - protein, 9 aa, Homo Sapiens
LGLQETITE

SEQ ID NO: 1350824 - protein, 9 aa, Homo Sapiens
STCPLANSQ

SEQ ID NO: 1350825 - protein, 9 aa, Homo Sapiens
KLCESCRAR

SEQ ID NO: 1350826 - protein, 9 aa, Homo Sapiens
EHILEMLVL

SEQ ID NO: 1350827 - protein, 9 aa, Homo Sapiens
TKVAATAGG

SEQ ID NO: 1350828 - protein, 9 aa, Homo Sapiens
IPPLLLNVQ

SEQ ID NO: 1350829 - protein, 9 aa, Homo Sapiens
HDMSVKYQN

SEQ ID NO: 1350830 - protein, 9 aa, Homo Sapiens
DLTVSQTYS

SEQ ID NO: 1350831 - protein, 9 aa, Homo Sapiens
VQHLRFEVH

SEQ ID NO: 1350832 - protein, 9 aa, Homo Sapiens
SLMSWRVYT

SEQ ID NO: 1350833 - protein, 9 aa, Homo Sapiens
PPTSLQRSL

SEQ ID NO: 1350834 - protein, 9 aa, Homo Sapiens
LVPSDPFSL

SEQ ID NO: 1350835 - protein, 9 aa, Homo Sapiens
SMTCCRFSP

SEQ ID NO: 1350836 - protein, 9 aa, Homo Sapiens
TLKAAGQST

SEQ ID NO: 1350837 - protein, 9 aa, Homo Sapiens
HYHIFRLPN

SEQ ID NO: 1350838 - protein, 9 aa, Homo Sapiens
PIITTLASG

SEQ ID NO: 1350839 - protein, 9 aa, Homo Sapiens
FACDECDMR

SEQ ID NO: 1350840 - protein, 9 aa, Homo Sapiens
LHDNYEELY

SEQ ID NO: 1350841 - protein, 9 aa, Homo Sapiens
SLHYTACRP

SEQ ID NO: 1350842 - protein, 9 aa, Homo Sapiens
QAQSLSRHA

SEQ ID NO: 1350843 - protein, 9 aa, Homo Sapiens
GVSDKNLRW

SEQ ID NO: 1350844 - protein, 9 aa, Homo Sapiens
YHELYYDTA

SEQ ID NO: 1350845 - protein, 9 aa, Homo Sapiens
LPSSVTESD

SEQ ID NO: 1350846 - protein, 9 aa, Homo Sapiens
NKDCKKAQV

SEQ ID NO: 1350847 - protein, 9 aa, Homo Sapiens
VPVPGTQPP

SEQ ID NO: 1350848 - protein, 9 aa, Homo Sapiens
LAYNNIFCV

SEQ ID NO: 1350849 - protein, 9 aa, Homo Sapiens
WRPGCFLCR

SEQ ID NO: 1350850 - protein, 9 aa, Homo Sapiens
GGLLPLVKR

SEQ ID NO: 1350851 - protein, 9 aa, Homo Sapiens
YYSRCLAPK

SEQ ID NO: 1350852 - protein, 9 aa, Homo Sapiens
TEWSFPRAS

SEQ ID NO: 1350853 - protein, 9 aa, Homo Sapiens
YACPITFSS

SEQ ID NO: 1350854 - protein, 9 aa, Homo Sapiens
SYERIHHSN

SEQ ID NO: 1350855 - protein, 9 aa, Homo Sapiens
CMDMGFTMS

SEQ ID NO: 1350856 - protein, 9 aa, Homo Sapiens
CHLADHGQL

SEQ ID NO: 1350857 - protein, 9 aa, Homo Sapiens
LKPVKHIQE

SEQ ID NO: 1350858 - protein, 9 aa, Homo Sapiens
QENSLYTIS

SEQ ID NO: 1350859 - protein, 9 aa, Homo Sapiens
HRRKITVVE

SEQ ID NO: 1350860 - protein, 9 aa, Homo Sapiens
PFRKKDTLV

SEQ ID NO: 1350861 - protein, 9 aa, Homo Sapiens
QYNLMIEVS

SEQ ID NO: 1350862 - protein, 9 aa, Homo Sapiens
KHQRRGRGK

SEQ ID NO: 1350863 - protein, 9 aa, Homo Sapiens
IREQKEKIW

SEQ ID NO: 1350864 - protein, 9 aa, Homo Sapiens
GMLAYLTEL

SEQ ID NO: 1350865 - protein, 9 aa, Homo Sapiens
IIQSTEHLH

SEQ ID NO: 1350866 - protein, 9 aa, Homo Sapiens
VLATFVTHV

SEQ ID NO: 1350867 - protein, 9 aa, Homo Sapiens
ELQSWCPVI

SEQ ID NO: 1350868 - protein, 9 aa, Homo Sapiens
PHWYKLQTY

SEQ ID NO: 1350869 - protein, 9 aa, Homo Sapiens
HFQDSSSSK

SEQ ID NO: 1350870 - protein, 9 aa, Homo Sapiens
LLLYFTFYI

SEQ ID NO: 1350871 - protein, 9 aa, Homo Sapiens
SRHFGTMSS

SEQ ID NO: 1350872 - protein, 9 aa, Homo Sapiens
KKQLCGRHK

SEQ ID NO: 1350873 - protein, 9 aa, Homo Sapiens
AQWKEAIKA

SEQ ID NO: 1350874 - protein, 9 aa, Homo Sapiens
MEGPLFGRS

SEQ ID NO: 1350875 - protein, 9 aa, Homo Sapiens
PVLGPDPRW

SEQ ID NO: 1350876 - protein, 9 aa, Homo Sapiens
NLILCSVSN

SEQ ID NO: 1350877 - protein, 9 aa, Homo Sapiens
DENDDTVSI

SEQ ID NO: 1350878 - protein, 9 aa, Homo Sapiens
SLLVVLYKI

SEQ ID NO: 1350879 - protein, 9 aa, Homo Sapiens
VGLGPVLPP

SEQ ID NO: 1350880 - protein, 9 aa, Homo Sapiens
LLAEHNPLG

SEQ ID NO: 1350881 - protein, 9 aa, Homo Sapiens
DNCPYISNT

SEQ ID NO: 1350882 - protein, 9 aa, Homo Sapiens
KNWCALCNS

SEQ ID NO: 1350883 - protein, 9 aa, Homo Sapiens
PLLLNVQPH

SEQ ID NO: 1350884 - protein, 9 aa, Homo Sapiens
LNYSIDTVR

SEQ ID NO: 1350885 - protein, 9 aa, Homo Sapiens
FDEDKDDDE

SEQ ID NO: 1350886 - protein, 9 aa, Homo Sapiens
SGEDLYILI

SEQ ID NO: 1350887 - protein, 9 aa, Homo Sapiens
VAEISIGLF

SEQ ID NO: 1350888 - protein, 9 aa, Homo Sapiens
LHEAVHFSF

SEQ ID NO: 1350889 - protein, 9 aa, Homo Sapiens
GTELSVCAK

SEQ ID NO: 1350890 - protein, 9 aa, Homo Sapiens
TASIIIALT

SEQ ID NO: 1350891 - protein, 9 aa, Homo Sapiens
LVSLGIYLP

SEQ ID NO: 1350892 - protein, 9 aa, Homo Sapiens
GVTIWGVAM

SEQ ID NO: 1350893 - protein, 9 aa, Homo Sapiens
RHGHDAASS

SEQ ID NO: 1350894 - protein, 9 aa, Homo Sapiens
MGQHMFEDL

SEQ ID NO: 1350895 - protein, 9 aa, Homo Sapiens
TPPEAAQND

SEQ ID NO: 1350896 - protein, 9 aa, Homo Sapiens
AARAVATAT

SEQ ID NO: 1350897 - protein, 9 aa, Homo Sapiens
KKKCDEEIE

SEQ ID NO: 1350898 - protein, 9 aa, Homo Sapiens
YRNGGGTFM

SEQ ID NO: 1350899 - protein, 9 aa, Homo Sapiens
YLKSGIRIK

SEQ ID NO: 1350900 - protein, 9 aa, Homo Sapiens
CKELHHFEK

SEQ ID NO: 1350901 - protein, 9 aa, Homo Sapiens
SRAEVDLEH

SEQ ID NO: 1350902 - protein, 9 aa, Homo Sapiens
NTSENIEKE

SEQ ID NO: 1350903 - protein, 9 aa, Homo Sapiens
LDSLDGGMK

SEQ ID NO: 1350904 - protein, 9 aa, Homo Sapiens
EMKNLHKLV

SEQ ID NO: 1350905 - protein, 9 aa, Homo Sapiens
HSSMNRLTD

SEQ ID NO: 1350906 - protein, 9 aa, Homo Sapiens
KGNSVSKTR

SEQ ID NO: 1350907 - protein, 9 aa, Homo Sapiens
IDEEEDDDD

SEQ ID NO: 1350908 - protein, 9 aa, Homo Sapiens
PVDRVMKQL

SEQ ID NO: 1350909 - protein, 9 aa, Homo Sapiens
TRGETVVLQ

SEQ ID NO: 1350910 - protein, 9 aa, Homo Sapiens
RQQILPVKI

SEQ ID NO: 1350911 - protein, 9 aa, Homo Sapiens
NRNALTSIA

SEQ ID NO: 1350912 - protein, 9 aa, Homo Sapiens
KMHDILNME

SEQ ID NO: 1350913 - protein, 9 aa, Homo Sapiens
PGLQRPDDR

SEQ ID NO: 1350914 - protein, 9 aa, Homo Sapiens
RQKVGTFQQ

SEQ ID NO: 1350915 - protein, 9 aa, Homo Sapiens
TGSGQHSQT

SEQ ID NO: 1350916 - protein, 9 aa, Homo Sapiens
LGLFPPSKL

SEQ ID NO: 1350917 - protein, 9 aa, Homo Sapiens
FSTLAMIYD

SEQ ID NO: 1350918 - protein, 9 aa, Homo Sapiens
WQARHYHQQ

SEQ ID NO: 1350919 - protein, 9 aa, Homo Sapiens
GVAEGTGAE

SEQ ID NO: 1350920 - protein, 9 aa, Homo Sapiens
TGAELSLCY

SEQ ID NO: 1350921 - protein, 9 aa, Homo Sapiens
SLQCSPPVR

SEQ ID NO: 1350922 - protein, 9 aa, Homo Sapiens
HYYHYYSRC

SEQ ID NO: 1350923 - protein, 9 aa, Homo Sapiens
SPQGPLFLL

SEQ ID NO: 1350924 - protein, 9 aa, Homo Sapiens
VILLRRSMA

SEQ ID NO: 1350925 - protein, 9 aa, Homo Sapiens
GKLSATSTW

SEQ ID NO: 1350926 - protein, 9 aa, Homo Sapiens
QMLEQYSSN

SEQ ID NO: 1350927 - protein, 9 aa, Homo Sapiens
RWILPDSQE

SEQ ID NO: 1350928 - protein, 9 aa, Homo Sapiens
QVIDVGSEW

SEQ ID NO: 1350929 - protein, 9 aa, Homo Sapiens
KNYGLMCLG

SEQ ID NO: 1350930 - protein, 9 aa, Homo Sapiens
GTRLKYVHL

SEQ ID NO: 1350931 - protein, 9 aa, Homo Sapiens
ATWAVPQVL

SEQ ID NO: 1350932 - protein, 9 aa, Homo Sapiens
EPGLFVVGL

SEQ ID NO: 1350933 - protein, 9 aa, Homo Sapiens
LFSRQGKLW

SEQ ID NO: 1350934 - protein, 9 aa, Homo Sapiens
PYVENPGYF

SEQ ID NO: 1350935 - protein, 9 aa, Homo Sapiens
TLKWLLGRI

SEQ ID NO: 1350936 - protein, 9 aa, Homo Sapiens
ESPELSQKS

SEQ ID NO: 1350937 - protein, 9 aa, Homo Sapiens
HMPFGFGMR

SEQ ID NO: 1350938 - protein, 9 aa, Homo Sapiens
EMSVQEEDR

SEQ ID NO: 1350939 - protein, 9 aa, Homo Sapiens
LSVWPGHQE

SEQ ID NO: 1350940 - protein, 9 aa, Homo Sapiens
LLVPRLVQF

SEQ ID NO: 1350941 - protein, 9 aa, Homo Sapiens
CFLKTYTQV

SEQ ID NO: 1350942 - protein, 9 aa, Homo Sapiens
SEPVPEKNW

SEQ ID NO: 1350943 - protein, 9 aa, Homo Sapiens
CHLLRLGHG

SEQ ID NO: 1350944 - protein, 9 aa, Homo Sapiens
KFRENMLDK

SEQ ID NO: 1350945 - protein, 9 aa, Homo Sapiens
DDGSKPTPM

SEQ ID NO: 1350946 - protein, 9 aa, Homo Sapiens
ILQELVLMM

SEQ ID NO: 1350947 - protein, 9 aa, Homo Sapiens
HMQEENITR

SEQ ID NO: 1350948 - protein, 9 aa, Homo Sapiens
QQTIEENDQ

SEQ ID NO: 1350949 - protein, 9 aa, Homo Sapiens
PNEPGTFLI

SEQ ID NO: 1350950 - protein, 9 aa, Homo Sapiens
AHSGVSVQD

SEQ ID NO: 1350951 - protein, 9 aa, Homo Sapiens
VSCWSGFHI

SEQ ID NO: 1350952 - protein, 9 aa, Homo Sapiens
KMRHMYNSE

SEQ ID NO: 1350953 - protein, 9 aa, Homo Sapiens
RWVRPRTST

SEQ ID NO: 1350954 - protein, 9 aa, Homo Sapiens
LEKKKQKEE

SEQ ID NO: 1350955 - protein, 9 aa, Homo Sapiens
CGEKTVSRR

SEQ ID NO: 1350956 - protein, 9 aa, Homo Sapiens
TLQLIWERV

SEQ ID NO: 1350957 - protein, 9 aa, Homo Sapiens
VMVLNATKV

SEQ ID NO: 1350958 - protein, 9 aa, Homo Sapiens
KRQCRVQKF

SEQ ID NO: 1350959 - protein, 9 aa, Homo Sapiens
SVTASTRPQ

SEQ ID NO: 1350960 - protein, 9 aa, Homo Sapiens
QTGACALIL

SEQ ID NO: 1350961 - protein, 9 aa, Homo Sapiens
VEQFLTIVR

SEQ ID NO: 1350962 - protein, 9 aa, Homo Sapiens
NAARPSPGA

SEQ ID NO: 1350963 - protein, 9 aa, Homo Sapiens
NKDGITFIE

SEQ ID NO: 1350964 - protein, 9 aa, Homo Sapiens
ESEDIVTDV

SEQ ID NO: 1350965 - protein, 9 aa, Homo Sapiens
MYVDNNCSW

SEQ ID NO: 1350966 - protein, 9 aa, Homo Sapiens
VKRVAKELD

SEQ ID NO: 1350967 - protein, 9 aa, Homo Sapiens
CMHTMGYMP

SEQ ID NO: 1350968 - protein, 9 aa, Homo Sapiens
EDWAPKSHA

SEQ ID NO: 1350969 - protein, 9 aa, Homo Sapiens
PEATYQMAV

SEQ ID NO: 1350970 - protein, 9 aa, Homo Sapiens
SDGPDDKNE

SEQ ID NO: 1350971 - protein, 9 aa, Homo Sapiens
KEPVIAGLM

SEQ ID NO: 1350972 - protein, 9 aa, Homo Sapiens
IKFHAVKNT

SEQ ID NO: 1350973 - protein, 9 aa, Homo Sapiens
KRSLLGAVN

SEQ ID NO: 1350974 - protein, 9 aa, Homo Sapiens
IVVLMCRGK

SEQ ID NO: 1350975 - protein, 9 aa, Homo Sapiens
SDIVGFTVL

SEQ ID NO: 1350976 - protein, 9 aa, Homo Sapiens
TFVGRITQD

SEQ ID NO: 1350977 - protein, 9 aa, Homo Sapiens
KPSWIHCII

SEQ ID NO: 1350978 - protein, 9 aa, Homo Sapiens
LKETAGENS

SEQ ID NO: 1350979 - protein, 9 aa, Homo Sapiens
VQKYLKSVH

SEQ ID NO: 1350980 - protein, 9 aa, Homo Sapiens
LPIHQTYIP

SEQ ID NO: 1350981 - protein, 9 aa, Homo Sapiens
TICYHYFCG

SEQ ID NO: 1350982 - protein, 9 aa, Homo Sapiens
LKMWYQTSE

SEQ ID NO: 1350983 - protein, 9 aa, Homo Sapiens
SKSDEGRTE

SEQ ID NO: 1350984 - protein, 9 aa, Homo Sapiens
KARAGSTFL

SEQ ID NO: 1350985 - protein, 9 aa, Homo Sapiens
ECDRSKKIL

SEQ ID NO: 1350986 - protein, 9 aa, Homo Sapiens
YSKDGLYTS

SEQ ID NO: 1350987 - protein, 9 aa, Homo Sapiens
QMFLGLTMG

SEQ ID NO: 1350988 - protein, 9 aa, Homo Sapiens
EEVCPQDTV

SEQ ID NO: 1350989 - protein, 9 aa, Homo Sapiens
EWCHLAAQP

SEQ ID NO: 1350990 - protein, 9 aa, Homo Sapiens
PKRCPILSA

SEQ ID NO: 1350991 - protein, 9 aa, Homo Sapiens
REVDEENRA

SEQ ID NO: 1350992 - protein, 9 aa, Homo Sapiens
CGSGGNTDM

SEQ ID NO: 1350993 - protein, 9 aa, Homo Sapiens
ITDVLGTEA

SEQ ID NO: 1350994 - protein, 9 aa, Homo Sapiens
EERFRVVIK

SEQ ID NO: 1350995 - protein, 9 aa, Homo Sapiens
ITGWDEKTL

SEQ ID NO: 1350996 - protein, 9 aa, Homo Sapiens
PLISAFASE

SEQ ID NO: 1350997 - protein, 9 aa, Homo Sapiens
IAAVILRYT

SEQ ID NO: 1350998 - protein, 9 aa, Homo Sapiens
EGHRNVVYV

SEQ ID NO: 1350999 - protein, 9 aa, Homo Sapiens
GGNRRSWLN

SEQ ID NO: 1351000 - protein, 9 aa, Homo Sapiens
ISMSAYLQE

SEQ ID NO: 1351001 - protein, 9 aa, Homo Sapiens
KDKKDIPVR

SEQ ID NO: 1351002 - protein, 9 aa, Homo Sapiens
INFQRDVFL

SEQ ID NO: 1351003 - protein, 9 aa, Homo Sapiens
ERKPMGVSV

SEQ ID NO: 1351004 - protein, 9 aa, Homo Sapiens
RRRHRAVKM

SEQ ID NO: 1351005 - protein, 9 aa, Homo Sapiens
DQIKMLSTS

SEQ ID NO: 1351006 - protein, 9 aa, Homo Sapiens
MQRVSLSIA

SEQ ID NO: 1351007 - protein, 9 aa, Homo Sapiens
LEDEEELWF

SEQ ID NO: 1351008 - protein, 9 aa, Homo Sapiens
WLGRKHRTR

SEQ ID NO: 1351009 - protein, 9 aa, Homo Sapiens
TKHDVYSFV

SEQ ID NO: 1351010 - protein, 9 aa, Homo Sapiens
LKSDGTRVL

SEQ ID NO: 1351011 - protein, 9 aa, Homo Sapiens
LFDEDRFRF

SEQ ID NO: 1351012 - protein, 9 aa, Homo Sapiens
ETQITTILR

SEQ ID NO: 1351013 - protein, 9 aa, Homo Sapiens
GRICISRRE

SEQ ID NO: 1351014 - protein, 9 aa, Homo Sapiens
GLENTHYQL

SEQ ID NO: 1351015 - protein, 9 aa, Homo Sapiens
VKEDRRFNI

SEQ ID NO: 1351016 - protein, 9 aa, Homo Sapiens
RVTFKANRS

SEQ ID NO: 1351017 - protein, 9 aa, Homo Sapiens
GDPHMIDYD

SEQ ID NO: 1351018 - protein, 9 aa, Homo Sapiens
DSAGYHLPT

SEQ ID NO: 1351019 - protein, 9 aa, Homo Sapiens
MSPGSSLSS

SEQ ID NO: 1351020 - protein, 9 aa, Homo Sapiens
QPGSCSVGP

SEQ ID NO: 1351021 - protein, 9 aa, Homo Sapiens
MLQIRNMHF

SEQ ID NO: 1351022 - protein, 9 aa, Homo Sapiens
APILHINSK

SEQ ID NO: 1351023 - protein, 9 aa, Homo Sapiens
CKLSDDPCP

SEQ ID NO: 1351024 - protein, 9 aa, Homo Sapiens
PAPEWCHLA

SEQ ID NO: 1351025 - protein, 9 aa, Homo Sapiens
MARRGSSPG

SEQ ID NO: 1351026 - protein, 9 aa, Homo Sapiens
SFPDWEWTK

SEQ ID NO: 1351027 - protein, 9 aa, Homo Sapiens
QKVTHLTEE

SEQ ID NO: 1351028 - protein, 9 aa, Homo Sapiens
ESPLGLCRI

SEQ ID NO: 1351029 - protein, 9 aa, Homo Sapiens
LIRAPWNLT

SEQ ID NO: 1351030 - protein, 9 aa, Homo Sapiens
NKYTQAVFL

SEQ ID NO: 1351031 - protein, 9 aa, Homo Sapiens
EALTMLLQE

SEQ ID NO: 1351032 - protein, 9 aa, Homo Sapiens
EETKPDTQQ

SEQ ID NO: 1351033 - protein, 9 aa, Homo Sapiens
VVNTQLLPF

SEQ ID NO: 1351034 - protein, 9 aa, Homo Sapiens
KHAGGVTCG

SEQ ID NO: 1351035 - protein, 9 aa, Homo Sapiens
TSYEGYAVF

SEQ ID NO: 1351036 - protein, 9 aa, Homo Sapiens
SGTEISGQA

SEQ ID NO: 1351037 - protein, 9 aa, Homo Sapiens
CVEHLSEFL

SEQ ID NO: 1351038 - protein, 9 aa, Homo Sapiens
CRGSISSMS

SEQ ID NO: 1351039 - protein, 9 aa, Homo Sapiens
SEEPLVSIP

SEQ ID NO: 1351040 - protein, 9 aa, Homo Sapiens
PMLSREGRT

SEQ ID NO: 1351041 - protein, 9 aa, Homo Sapiens
YECSECDKA

SEQ ID NO: 1351042 - protein, 9 aa, Homo Sapiens
PAISAFAND

SEQ ID NO: 1351043 - protein, 9 aa, Homo Sapiens
RSTPWACAT

SEQ ID NO: 1351044 - protein, 9 aa, Homo Sapiens
VKTTLKLLL

SEQ ID NO: 1351045 - protein, 9 aa, Homo Sapiens
LNTWPAISA

SEQ ID NO: 1351046 - protein, 9 aa, Homo Sapiens
MSTVSGPLL

SEQ ID NO: 1351047 - protein, 9 aa, Homo Sapiens
THMVLISGK

SEQ ID NO: 1351048 - protein, 9 aa, Homo Sapiens
CHVNIIPNP

SEQ ID NO: 1351049 - protein, 9 aa, Homo Sapiens
GLRYSAFWL

SEQ ID NO: 1351050 - protein, 9 aa, Homo Sapiens
LTGRGFSHD

SEQ ID NO: 1351051 - protein, 9 aa, Homo Sapiens
LSYVRHLKG

SEQ ID NO: 1351052 - protein, 9 aa, Homo Sapiens
CTSLGLARM

SEQ ID NO: 1351053 - protein, 9 aa, Homo Sapiens
LIFFFITLV

SEQ ID NO: 1351054 - protein, 9 aa, Homo Sapiens
MLDLKGKSK

SEQ ID NO: 1351055 - protein, 9 aa, Homo Sapiens
CCREDVMVA

SEQ ID NO: 1351056 - protein, 9 aa, Homo Sapiens
TQSNIHDYY

SEQ ID NO: 1351057 - protein, 9 aa, Homo Sapiens
VVSREEPGS

SEQ ID NO: 1351058 - protein, 9 aa, Homo Sapiens
GISRKELVM

SEQ ID NO: 1351059 - protein, 9 aa, Homo Sapiens
VKKVETERI

SEQ ID NO: 1351060 - protein, 9 aa, Homo Sapiens
VLKQERAKY

SEQ ID NO: 1351061 - protein, 9 aa, Homo Sapiens
KASHNLQDV

SEQ ID NO: 1351062 - protein, 9 aa, Homo Sapiens
LKDTGYQWL

SEQ ID NO: 1351063 - protein, 9 aa, Homo Sapiens
IFQQKRVCG

SEQ ID NO: 1351064 - protein, 9 aa, Homo Sapiens
RADDISRHE

SEQ ID NO: 1351065 - protein, 9 aa, Homo Sapiens
WRHFKQLET

SEQ ID NO: 1351066 - protein, 9 aa, Homo Sapiens
PTSAASAAE

SEQ ID NO: 1351067 - protein, 9 aa, Homo Sapiens
CTQDGPFYV

SEQ ID NO: 1351068 - protein, 9 aa, Homo Sapiens
RKIVVHSKQ

SEQ ID NO: 1351069 - protein, 9 aa, Homo Sapiens
NLNGVSSIT

SEQ ID NO: 1351070 - protein, 9 aa, Homo Sapiens
SRITLVLME

SEQ ID NO: 1351071 - protein, 9 aa, Homo Sapiens
PSAVLMALR

SEQ ID NO: 1351072 - protein, 9 aa, Homo Sapiens
CTLSAISII

SEQ ID NO: 1351073 - protein, 9 aa, Homo Sapiens
AHQFPALTQ

SEQ ID NO: 1351074 - protein, 9 aa, Homo Sapiens
TLKLILVML

SEQ ID NO: 1351075 - protein, 9 aa, Homo Sapiens
PVHGDPGVQ

SEQ ID NO: 1351076 - protein, 9 aa, Homo Sapiens
SLTPSQIKF

SEQ ID NO: 1351077 - protein, 9 aa, Homo Sapiens
AFQYFRELF

SEQ ID NO: 1351078 - protein, 9 aa, Homo Sapiens
MGYIMDKAE

SEQ ID NO: 1351079 - protein, 9 aa, Homo Sapiens
HLLVADQDF

SEQ ID NO: 1351080 - protein, 9 aa, Homo Sapiens
TLGRVPHQV

SEQ ID NO: 1351081 - protein, 9 aa, Homo Sapiens
DALTRVYGV

SEQ ID NO: 1351082 - protein, 9 aa, Homo Sapiens
QELREVTGI

SEQ ID NO: 1351083 - protein, 9 aa, Homo Sapiens
IHHWRSYHT

SEQ ID NO: 1351084 - protein, 9 aa, Homo Sapiens
VHASVILTR

SEQ ID NO: 1351085 - protein, 9 aa, Homo Sapiens
LFAAINASY

SEQ ID NO: 1351086 - protein, 9 aa, Homo Sapiens
PSMKTERSP

SEQ ID NO: 1351087 - protein, 9 aa, Homo Sapiens
TRPQSPVGE

SEQ ID NO: 1351088 - protein, 9 aa, Homo Sapiens
SFITWLRDN

SEQ ID NO: 1351089 - protein, 9 aa, Homo Sapiens
GDWHYQDID

SEQ ID NO: 1351090 - protein, 9 aa, Homo Sapiens
LLYLTPMLG

SEQ ID NO: 1351091 - protein, 9 aa, Homo Sapiens
VWENSSVPV

SEQ ID NO: 1351092 - protein, 9 aa, Homo Sapiens
DKIRPLWCH

SEQ ID NO: 1351093 - protein, 9 aa, Homo Sapiens
DTGVTSEDF

SEQ ID NO: 1351094 - protein, 9 aa, Homo Sapiens
MDSYFEYLV

SEQ ID NO: 1351095 - protein, 9 aa, Homo Sapiens
ERTHTGEKS

SEQ ID NO: 1351096 - protein, 9 aa, Homo Sapiens
PLQGTRVPS

SEQ ID NO: 1351097 - protein, 9 aa, Homo Sapiens
SKKTKLLLF

SEQ ID NO: 1351098 - protein, 9 aa, Homo Sapiens
TPVIHSNIN

SEQ ID NO: 1351099 - protein, 9 aa, Homo Sapiens
FCGYEANYL

SEQ ID NO: 1351100 - protein, 9 aa, Homo Sapiens
SQLGAVCAW

SEQ ID NO: 1351101 - protein, 9 aa, Homo Sapiens
HQCYADFAP

SEQ ID NO: 1351102 - protein, 9 aa, Homo Sapiens
LRGKDVAEI

SEQ ID NO: 1351103 - protein, 9 aa, Homo Sapiens
MPLIRPETL

SEQ ID NO: 1351104 - protein, 9 aa, Homo Sapiens
LDCSERASI

SEQ ID NO: 1351105 - protein, 9 aa, Homo Sapiens
AKWNQVRKD

SEQ ID NO: 1351106 - protein, 9 aa, Homo Sapiens
DLCFKNGIL

SEQ ID NO: 1351107 - protein, 9 aa, Homo Sapiens
PDIGDHQAG

SEQ ID NO: 1351108 - protein, 9 aa, Homo Sapiens
QLDIKTSNL

SEQ ID NO: 1351109 - protein, 9 aa, Homo Sapiens
SLEERRSSG

SEQ ID NO: 1351110 - protein, 9 aa, Homo Sapiens
YGERYIASV

SEQ ID NO: 1351111 - protein, 9 aa, Homo Sapiens
QWCDKDFNM

SEQ ID NO: 1351112 - protein, 9 aa, Homo Sapiens
RVFLSPKAR

SEQ ID NO: 1351113 - protein, 9 aa, Homo Sapiens
WGPANGFRG

SEQ ID NO: 1351114 - protein, 9 aa, Homo Sapiens
IPKFTNTHI

SEQ ID NO: 1351115 - protein, 9 aa, Homo Sapiens
PLVPKRPDT

SEQ ID NO: 1351116 - protein, 9 aa, Homo Sapiens
EKGMDAVPP

SEQ ID NO: 1351117 - protein, 9 aa, Homo Sapiens
LNLTQHIRT

SEQ ID NO: 1351118 - protein, 9 aa, Homo Sapiens
TYIASEHSY

SEQ ID NO: 1351119 - protein, 9 aa, Homo Sapiens
TSRPLRAEP

SEQ ID NO: 1351120 - protein, 9 aa, Homo Sapiens
GPASIMGPP

SEQ ID NO: 1351121 - protein, 9 aa, Homo Sapiens
SAAYANFFI

SEQ ID NO: 1351122 - protein, 9 aa, Homo Sapiens
AAFSAAQHH

SEQ ID NO: 1351123 - protein, 9 aa, Homo Sapiens
CALHFAISE

SEQ ID NO: 1351124 - protein, 9 aa, Homo Sapiens
RDMRELTML

SEQ ID NO: 1351125 - protein, 9 aa, Homo Sapiens
TPSSVIFSL

SEQ ID NO: 1351126 - protein, 9 aa, Homo Sapiens
WIFFFFLFP

SEQ ID NO: 1351127 - protein, 9 aa, Homo Sapiens
GRVSTEVDT

SEQ ID NO: 1351128 - protein, 9 aa, Homo Sapiens
KDRYPQAGP

SEQ ID NO: 1351129 - protein, 9 aa, Homo Sapiens
LIGMLAYLT

SEQ ID NO: 1351130 - protein, 9 aa, Homo Sapiens
ILVVFKSAP

SEQ ID NO: 1351131 - protein, 9 aa, Homo Sapiens
LWKKGLSLS

SEQ ID NO: 1351132 - protein, 9 aa, Homo Sapiens
CGEFLQLGS

SEQ ID NO: 1351133 - protein, 9 aa, Homo Sapiens
DHCIRFWNT

SEQ ID NO: 1351134 - protein, 9 aa, Homo Sapiens
DSVIYLQFV

SEQ ID NO: 1351135 - protein, 9 aa, Homo Sapiens
PMLSPLIYS

SEQ ID NO: 1351136 - protein, 9 aa, Homo Sapiens
ATIQIAINN

SEQ ID NO: 1351137 - protein, 9 aa, Homo Sapiens
TFATQLFNS

SEQ ID NO: 1351138 - protein, 9 aa, Homo Sapiens
PFGYLDILT

SEQ ID NO: 1351139 - protein, 9 aa, Homo Sapiens
WADVSHLKR

SEQ ID NO: 1351140 - protein, 9 aa, Homo Sapiens
MKCGMWGRV

SEQ ID NO: 1351141 - protein, 9 aa, Homo Sapiens
GHRTQLRKK

SEQ ID NO: 1351142 - protein, 9 aa, Homo Sapiens
GEPSASLGE

SEQ ID NO: 1351143 - protein, 9 aa, Homo Sapiens
LREENANLG

SEQ ID NO: 1351144 - protein, 9 aa, Homo Sapiens
ALAETLKEV

SEQ ID NO: 1351145 - protein, 9 aa, Homo Sapiens
RYSTSAFGF

SEQ ID NO: 1351146 - protein, 9 aa, Homo Sapiens
NILQKSGKP

SEQ ID NO: 1351147 - protein, 9 aa, Homo Sapiens
DTSSNTLSL

SEQ ID NO: 1351148 - protein, 9 aa, Homo Sapiens
CWTHARTSR

SEQ ID NO: 1351149 - protein, 9 aa, Homo Sapiens
PGATYTVIE

SEQ ID NO: 1351150 - protein, 9 aa, Homo Sapiens
WIDTSCVCA

SEQ ID NO: 1351151 - protein, 9 aa, Homo Sapiens
LLQLYSGHL

SEQ ID NO: 1351152 - protein, 9 aa, Homo Sapiens
LFDPKDDTT

SEQ ID NO: 1351153 - protein, 9 aa, Homo Sapiens
ILSTMDADS

SEQ ID NO: 1351154 - protein, 9 aa, Homo Sapiens
DESPRSHFE

SEQ ID NO: 1351155 - protein, 9 aa, Homo Sapiens
FTGLLQRYR

SEQ ID NO: 1351156 - protein, 9 aa, Homo Sapiens
AASEKTSNN

SEQ ID NO: 1351157 - protein, 9 aa, Homo Sapiens
DAITAALVE

SEQ ID NO: 1351158 - protein, 9 aa, Homo Sapiens
GMHRWWQDL

SEQ ID NO: 1351159 - protein, 9 aa, Homo Sapiens
PTPDNPYEV

SEQ ID NO: 1351160 - protein, 9 aa, Homo Sapiens
QRLCCTLVA

SEQ ID NO: 1351161 - protein, 9 aa, Homo Sapiens
GARAKGSSA

SEQ ID NO: 1351162 - protein, 9 aa, Homo Sapiens
VPNALRYAV

SEQ ID NO: 1351163 - protein, 9 aa, Homo Sapiens
MHFIHRDLT

SEQ ID NO: 1351164 - protein, 9 aa, Homo Sapiens
HSLYIDLGA

SEQ ID NO: 1351165 - protein, 9 aa, Homo Sapiens
LWLYHTATK

SEQ ID NO: 1351166 - protein, 9 aa, Homo Sapiens
TGVEGDDIV

SEQ ID NO: 1351167 - protein, 9 aa, Homo Sapiens
STMSLELDS

SEQ ID NO: 1351168 - protein, 9 aa, Homo Sapiens
KTQKVCFFT

SEQ ID NO: 1351169 - protein, 9 aa, Homo Sapiens
EIREIRTLF

SEQ ID NO: 1351170 - protein, 9 aa, Homo Sapiens
RIATLESAK

SEQ ID NO: 1351171 - protein, 9 aa, Homo Sapiens
SIDHYYAVC

SEQ ID NO: 1351172 - protein, 9 aa, Homo Sapiens
FVCTALQHG

SEQ ID NO: 1351173 - protein, 9 aa, Homo Sapiens
VAPLSGRQW

SEQ ID NO: 1351174 - protein, 9 aa, Homo Sapiens
PELAQYLNR

SEQ ID NO: 1351175 - protein, 9 aa, Homo Sapiens
NMALPVRQT

SEQ ID NO: 1351176 - protein, 9 aa, Homo Sapiens
SAGRPSAAT

SEQ ID NO: 1351177 - protein, 9 aa, Homo Sapiens
CQANQVSAT

SEQ ID NO: 1351178 - protein, 9 aa, Homo Sapiens
IADFELLDG

SEQ ID NO: 1351179 - protein, 9 aa, Homo Sapiens
QELCMPQSV

SEQ ID NO: 1351180 - protein, 9 aa, Homo Sapiens
KGKPDLNMA

SEQ ID NO: 1351181 - protein, 9 aa, Homo Sapiens
EFPGGKGTW

SEQ ID NO: 1351182 - protein, 9 aa, Homo Sapiens
VELVKKSLI

SEQ ID NO: 1351183 - protein, 9 aa, Homo Sapiens
LSALNEECL

SEQ ID NO: 1351184 - protein, 9 aa, Homo Sapiens
HVDLRNTSG

SEQ ID NO: 1351185 - protein, 9 aa, Homo Sapiens
AEARHPVYE

SEQ ID NO: 1351186 - protein, 9 aa, Homo Sapiens
TVVTWDPRG

SEQ ID NO: 1351187 - protein, 9 aa, Homo Sapiens
QDMALNIHT

SEQ ID NO: 1351188 - protein, 9 aa, Homo Sapiens
HIYTKLFNW

SEQ ID NO: 1351189 - protein, 9 aa, Homo Sapiens
FILSSNFLR

SEQ ID NO: 1351190 - protein, 9 aa, Homo Sapiens
AIICYGDRP

SEQ ID NO: 1351191 - protein, 9 aa, Homo Sapiens
GCHVFEILS

SEQ ID NO: 1351192 - protein, 9 aa, Homo Sapiens
HHTILYPFV

SEQ ID NO: 1351193 - protein, 9 aa, Homo Sapiens
VEAENTYLC

SEQ ID NO: 1351194 - protein, 9 aa, Homo Sapiens
VRHFHSPPI

SEQ ID NO: 1351195 - protein, 9 aa, Homo Sapiens
RAMVFTLKH

SEQ ID NO: 1351196 - protein, 9 aa, Homo Sapiens
SKEAISQRL

SEQ ID NO: 1351197 - protein, 9 aa, Homo Sapiens
LSHTVALTR

SEQ ID NO: 1351198 - protein, 9 aa, Homo Sapiens
CPEHITTIT

SEQ ID NO: 1351199 - protein, 9 aa, Homo Sapiens
VVICFPLHY

SEQ ID NO: 1351200 - protein, 9 aa, Homo Sapiens
QLGKGTEVP

SEQ ID NO: 1351201 - protein, 9 aa, Homo Sapiens
PWAVKTEAI

SEQ ID NO: 1351202 - protein, 9 aa, Homo Sapiens
LSHEVIRIE

SEQ ID NO: 1351203 - protein, 9 aa, Homo Sapiens
SLLDVVMWD

SEQ ID NO: 1351204 - protein, 9 aa, Homo Sapiens
DPFVNGCCY

SEQ ID NO: 1351205 - protein, 9 aa, Homo Sapiens
LQKFTVSQY

SEQ ID NO: 1351206 - protein, 9 aa, Homo Sapiens
TTPLLSMTP

SEQ ID NO: 1351207 - protein, 9 aa, Homo Sapiens
FFKNQSLLS

SEQ ID NO: 1351208 - protein, 9 aa, Homo Sapiens
DNVIKYLAK

SEQ ID NO: 1351209 - protein, 9 aa, Homo Sapiens
KCWQQDMST

SEQ ID NO: 1351210 - protein, 9 aa, Homo Sapiens
GPHRQLNFD

SEQ ID NO: 1351211 - protein, 9 aa, Homo Sapiens
WKKSPTTQN

SEQ ID NO: 1351212 - protein, 9 aa, Homo Sapiens
QFSNHTGYV

SEQ ID NO: 1351213 - protein, 9 aa, Homo Sapiens
GHVLWIWRY

SEQ ID NO: 1351214 - protein, 9 aa, Homo Sapiens
HSRLEGILR

SEQ ID NO: 1351215 - protein, 9 aa, Homo Sapiens
KFTGGLKNS

SEQ ID NO: 1351216 - protein, 9 aa, Homo Sapiens
VTSLAQALQ

SEQ ID NO: 1351217 - protein, 9 aa, Homo Sapiens
HHLHGKTHH

SEQ ID NO: 1351218 - protein, 9 aa, Homo Sapiens
HNEYLNEDV

SEQ ID NO: 1351219 - protein, 9 aa, Homo Sapiens
ICIGMYVLH

SEQ ID NO: 1351220 - protein, 9 aa, Homo Sapiens
LLDRLLSVW

SEQ ID NO: 1351221 - protein, 9 aa, Homo Sapiens
VFMASGVKL

SEQ ID NO: 1351222 - protein, 9 aa, Homo Sapiens
RQELPVRLT

SEQ ID NO: 1351223 - protein, 9 aa, Homo Sapiens
KDTLVPARQ

SEQ ID NO: 1351224 - protein, 9 aa, Homo Sapiens
PVNTYVRVL

SEQ ID NO: 1351225 - protein, 9 aa, Homo Sapiens
SSSSEKQHF

SEQ ID NO: 1351226 - protein, 9 aa, Homo Sapiens
AHIPFRVGL

SEQ ID NO: 1351227 - protein, 9 aa, Homo Sapiens
LHSALFSRY

SEQ ID NO: 1351228 - protein, 9 aa, Homo Sapiens
ETGNRGETR

SEQ ID NO: 1351229 - protein, 9 aa, Homo Sapiens
GRWKTLLIP

SEQ ID NO: 1351230 - protein, 9 aa, Homo Sapiens
APLIMGFML

SEQ ID NO: 1351231 - protein, 9 aa, Homo Sapiens
AFIMDGNCR

SEQ ID NO: 1351232 - protein, 9 aa, Homo Sapiens
GPNMAILFH

SEQ ID NO: 1351233 - protein, 9 aa, Homo Sapiens
AGECGAPGP

SEQ ID NO: 1351234 - protein, 9 aa, Homo Sapiens
AYLNSVPLG

SEQ ID NO: 1351235 - protein, 9 aa, Homo Sapiens
VIQYFAIVT

SEQ ID NO: 1351236 - protein, 9 aa, Homo Sapiens
TTVNLIRHK

SEQ ID NO: 1351237 - protein, 9 aa, Homo Sapiens
TYSQLGQEI

SEQ ID NO: 1351238 - protein, 9 aa, Homo Sapiens
LTDFQAHVR

SEQ ID NO: 1351239 - protein, 9 aa, Homo Sapiens
MCYDDHTVC

SEQ ID NO: 1351240 - protein, 9 aa, Homo Sapiens
LVMVEAEYP

SEQ ID NO: 1351241 - protein, 9 aa, Homo Sapiens
SGHQGHTII

SEQ ID NO: 1351242 - protein, 9 aa, Homo Sapiens
SAVGLNIFL

SEQ ID NO: 1351243 - protein, 9 aa, Homo Sapiens
FVQVHPITK

SEQ ID NO: 1351244 - protein, 9 aa, Homo Sapiens
TGPLKDMPS

SEQ ID NO: 1351245 - protein, 9 aa, Homo Sapiens
RPLPLHFLQ

SEQ ID NO: 1351246 - protein, 9 aa, Homo Sapiens
VMILQLQPA

SEQ ID NO: 1351247 - protein, 9 aa, Homo Sapiens
IQVCKLAQS

SEQ ID NO: 1351248 - protein, 9 aa, Homo Sapiens
MSTVSCGNG

SEQ ID NO: 1351249 - protein, 9 aa, Homo Sapiens
VAELQGFTV

SEQ ID NO: 1351250 - protein, 9 aa, Homo Sapiens
IQDAKKAET

SEQ ID NO: 1351251 - protein, 9 aa, Homo Sapiens
PDDLTTENP

SEQ ID NO: 1351252 - protein, 9 aa, Homo Sapiens
GRSQDDTMV

SEQ ID NO: 1351253 - protein, 9 aa, Homo Sapiens
SDSDSDSES

SEQ ID NO: 1351254 - protein, 9 aa, Homo Sapiens
VAPEFLVLL

SEQ ID NO: 1351255 - protein, 9 aa, Homo Sapiens
PAGLQVDYI

SEQ ID NO: 1351256 - protein, 9 aa, Homo Sapiens
YFRVPTFGW

SEQ ID NO: 1351257 - protein, 9 aa, Homo Sapiens
DALLFSASR

SEQ ID NO: 1351258 - protein, 9 aa, Homo Sapiens
GTGLPWLLA

SEQ ID NO: 1351259 - protein, 9 aa, Homo Sapiens
FFKHLLELR

SEQ ID NO: 1351260 - protein, 9 aa, Homo Sapiens
GNKLPPLAL

SEQ ID NO: 1351261 - protein, 9 aa, Homo Sapiens
DVSVLRLTV

SEQ ID NO: 1351262 - protein, 9 aa, Homo Sapiens
NCFRSHNLM

SEQ ID NO: 1351263 - protein, 9 aa, Homo Sapiens
HDSAGYHLP

SEQ ID NO: 1351264 - protein, 9 aa, Homo Sapiens
VAFQAETQE

SEQ ID NO: 1351265 - protein, 9 aa, Homo Sapiens
PDDRFCGTY

SEQ ID NO: 1351266 - protein, 9 aa, Homo Sapiens
EQIRALQET

SEQ ID NO: 1351267 - protein, 9 aa, Homo Sapiens
WPSQERVEY

SEQ ID NO: 1351268 - protein, 9 aa, Homo Sapiens
VLESEEMNQ

SEQ ID NO: 1351269 - protein, 9 aa, Homo Sapiens
NNYHPLQPL

SEQ ID NO: 1351270 - protein, 9 aa, Homo Sapiens
RGTVGALLV

SEQ ID NO: 1351271 - protein, 9 aa, Homo Sapiens
GMLNVTLLR

SEQ ID NO: 1351272 - protein, 9 aa, Homo Sapiens
PPQLMEKCT

SEQ ID NO: 1351273 - protein, 9 aa, Homo Sapiens
PEARRPYLR

SEQ ID NO: 1351274 - protein, 9 aa, Homo Sapiens
CWQQDMSTS

SEQ ID NO: 1351275 - protein, 9 aa, Homo Sapiens
ATFSQRAVY

SEQ ID NO: 1351276 - protein, 9 aa, Homo Sapiens
SPTSPSWLL

SEQ ID NO: 1351277 - protein, 9 aa, Homo Sapiens
VSWAITYLL

SEQ ID NO: 1351278 - protein, 9 aa, Homo Sapiens
SAATRPSSC

SEQ ID NO: 1351279 - protein, 9 aa, Homo Sapiens
NASYVVWKC

SEQ ID NO: 1351280 - protein, 9 aa, Homo Sapiens
SSPRTQASR

SEQ ID NO: 1351281 - protein, 9 aa, Homo Sapiens
VSRRFGSHS

SEQ ID NO: 1351282 - protein, 9 aa, Homo Sapiens
APSPGSVPV

SEQ ID NO: 1351283 - protein, 9 aa, Homo Sapiens
TEDENVTKD

SEQ ID NO: 1351284 - protein, 9 aa, Homo Sapiens
VKDSKPSSD

SEQ ID NO: 1351285 - protein, 9 aa, Homo Sapiens
YVLLPAADW

SEQ ID NO: 1351286 - protein, 9 aa, Homo Sapiens
PKSHAFVGS

SEQ ID NO: 1351287 - protein, 9 aa, Homo Sapiens
SYDKEVNSM

SEQ ID NO: 1351288 - protein, 9 aa, Homo Sapiens
VLQAQRGAG

SEQ ID NO: 1351289 - protein, 9 aa, Homo Sapiens
PHYPKASVQ

SEQ ID NO: 1351290 - protein, 9 aa, Homo Sapiens
TKYIFKITV

SEQ ID NO: 1351291 - protein, 9 aa, Homo Sapiens
ELMQKHNDL

SEQ ID NO: 1351292 - protein, 9 aa, Homo Sapiens
VAMKEVLKG

SEQ ID NO: 1351293 - protein, 9 aa, Homo Sapiens
AKASEITSL

SEQ ID NO: 1351294 - protein, 9 aa, Homo Sapiens
RTAAISTPK

SEQ ID NO: 1351295 - protein, 9 aa, Homo Sapiens
ELNERQQAE

SEQ ID NO: 1351296 - protein, 9 aa, Homo Sapiens
HTQDQVAGE

SEQ ID NO: 1351297 - protein, 9 aa, Homo Sapiens
VCLRRLWKK

SEQ ID NO: 1351298 - protein, 9 aa, Homo Sapiens
ITTLKRIAT

SEQ ID NO: 1351299 - protein, 9 aa, Homo Sapiens
FEKLQTTIE

SEQ ID NO: 1351300 - protein, 9 aa, Homo Sapiens
GTRYKKRDN

SEQ ID NO: 1351301 - protein, 9 aa, Homo Sapiens
SQPQSRGRP

SEQ ID NO: 1351302 - protein, 9 aa, Homo Sapiens
TTPAQPPTC

SEQ ID NO: 1351303 - protein, 9 aa, Homo Sapiens
RFPNCFRSH

SEQ ID NO: 1351304 - protein, 9 aa, Homo Sapiens
DLNHISTIV

SEQ ID NO: 1351305 - protein, 9 aa, Homo Sapiens
ADITKMPAI

SEQ ID NO: 1351306 - protein, 9 aa, Homo Sapiens
TQVQQYQQF

SEQ ID NO: 1351307 - protein, 9 aa, Homo Sapiens
CTEIIIVVN

SEQ ID NO: 1351308 - protein, 9 aa, Homo Sapiens
IRQEDVGEY

SEQ ID NO: 1351309 - protein, 9 aa, Homo Sapiens
LSLPECVEP

SEQ ID NO: 1351310 - protein, 9 aa, Homo Sapiens
DAFVEHRCL

SEQ ID NO: 1351311 - protein, 9 aa, Homo Sapiens
KYEVVRDAY

SEQ ID NO: 1351312 - protein, 9 aa, Homo Sapiens
GPEEQAGGP

SEQ ID NO: 1351313 - protein, 9 aa, Homo Sapiens
KLGCHVRAL

SEQ ID NO: 1351314 - protein, 9 aa, Homo Sapiens
GLGAWSHFV

SEQ ID NO: 1351315 - protein, 9 aa, Homo Sapiens
DWEWTKLDL

SEQ ID NO: 1351316 - protein, 9 aa, Homo Sapiens
ENCVPRHDK

SEQ ID NO: 1351317 - protein, 9 aa, Homo Sapiens
HGTFVGRIT

SEQ ID NO: 1351318 - protein, 9 aa, Homo Sapiens
MALNIHTFS

SEQ ID NO: 1351319 - protein, 9 aa, Homo Sapiens
KVYDPEDWL

SEQ ID NO: 1351320 - protein, 9 aa, Homo Sapiens
WGNQQALRA

SEQ ID NO: 1351321 - protein, 9 aa, Homo Sapiens
NVEVFILSS

SEQ ID NO: 1351322 - protein, 9 aa, Homo Sapiens
NPFNNITVV

SEQ ID NO: 1351323 - protein, 9 aa, Homo Sapiens
DVSIKKMKQ

SEQ ID NO: 1351324 - protein, 9 aa, Homo Sapiens
QACRKTQSN

SEQ ID NO: 1351325 - protein, 9 aa, Homo Sapiens
IFLHSADHN

SEQ ID NO: 1351326 - protein, 9 aa, Homo Sapiens
PSSSTNTCS

SEQ ID NO: 1351327 - protein, 9 aa, Homo Sapiens
SQSDRGGGR

SEQ ID NO: 1351328 - protein, 9 aa, Homo Sapiens
FHQCYADFA

SEQ ID NO: 1351329 - protein, 9 aa, Homo Sapiens
SYSSEFSKW

SEQ ID NO: 1351330 - protein, 9 aa, Homo Sapiens
KICHKSLSL

SEQ ID NO: 1351331 - protein, 9 aa, Homo Sapiens
PGPAGPASI

SEQ ID NO: 1351332 - protein, 9 aa, Homo Sapiens
GLFIVANSG

SEQ ID NO: 1351333 - protein, 9 aa, Homo Sapiens
SVIRINQEP

SEQ ID NO: 1351334 - protein, 9 aa, Homo Sapiens
IYKDGKVLH

SEQ ID NO: 1351335 - protein, 9 aa, Homo Sapiens
ATYYCEGEC

SEQ ID NO: 1351336 - protein, 9 aa, Homo Sapiens
PEVSNYWMN

SEQ ID NO: 1351337 - protein, 9 aa, Homo Sapiens
ATHGYSFTL

SEQ ID NO: 1351338 - protein, 9 aa, Homo Sapiens
ADEEKCHSI

SEQ ID NO: 1351339 - protein, 9 aa, Homo Sapiens
DDFFSSAFQ

SEQ ID NO: 1351340 - protein, 9 aa, Homo Sapiens
GIYLPDLSV

SEQ ID NO: 1351341 - protein, 9 aa, Homo Sapiens
GPYSAPPQP

SEQ ID NO: 1351342 - protein, 9 aa, Homo Sapiens
TGNRDGFNM

SEQ ID NO: 1351343 - protein, 9 aa, Homo Sapiens
ANDGEGSSE

SEQ ID NO: 1351344 - protein, 9 aa, Homo Sapiens
EEHCKVSAF

SEQ ID NO: 1351345 - protein, 9 aa, Homo Sapiens
KEAADGYQC

SEQ ID NO: 1351346 - protein, 9 aa, Homo Sapiens
GPAGEVRYA

SEQ ID NO: 1351347 - protein, 9 aa, Homo Sapiens
IEPYSIPLS

SEQ ID NO: 1351348 - protein, 9 aa, Homo Sapiens
KGGSCPFRH

SEQ ID NO: 1351349 - protein, 9 aa, Homo Sapiens
ISLHEAVHF

SEQ ID NO: 1351350 - protein, 9 aa, Homo Sapiens
REFICLGSL

SEQ ID NO: 1351351 - protein, 9 aa, Homo Sapiens
SEDIVTDVS

SEQ ID NO: 1351352 - protein, 9 aa, Homo Sapiens
LDQHEQICM

SEQ ID NO: 1351353 - protein, 9 aa, Homo Sapiens
LTSQQSVAS

SEQ ID NO: 1351354 - protein, 9 aa, Homo Sapiens
SRHAQVSQP

SEQ ID NO: 1351355 - protein, 9 aa, Homo Sapiens
TFKANRSFL

SEQ ID NO: 1351356 - protein, 9 aa, Homo Sapiens
VTMNYLQLY

SEQ ID NO: 1351357 - protein, 9 aa, Homo Sapiens
DHHIQRAIS

SEQ ID NO: 1351358 - protein, 9 aa, Homo Sapiens
FKIGGVTEH

SEQ ID NO: 1351359 - protein, 9 aa, Homo Sapiens
TFMFPYFIM

SEQ ID NO: 1351360 - protein, 9 aa, Homo Sapiens
LQRVKIISI

SEQ ID NO: 1351361 - protein, 9 aa, Homo Sapiens
EARRPYLRV

SEQ ID NO: 1351362 - protein, 9 aa, Homo Sapiens
LTTAEKSAT

SEQ ID NO: 1351363 - protein, 9 aa, Homo Sapiens
ALHEIRRYQ

SEQ ID NO: 1351364 - protein, 9 aa, Homo Sapiens
HYFDQISFM

SEQ ID NO: 1351365 - protein, 9 aa, Homo Sapiens
CWGQTIFKS

SEQ ID NO: 1351366 - protein, 9 aa, Homo Sapiens
LGTMFGGDF

SEQ ID NO: 1351367 - protein, 9 aa, Homo Sapiens
KEEVTVSTW

SEQ ID NO: 1351368 - protein, 9 aa, Homo Sapiens
YIFKITVSP

SEQ ID NO: 1351369 - protein, 9 aa, Homo Sapiens
RVTLSMALP

SEQ ID NO: 1351370 - protein, 9 aa, Homo Sapiens
FPDWEWTKL

SEQ ID NO: 1351371 - protein, 9 aa, Homo Sapiens
SGRGSLRKW

SEQ ID NO: 1351372 - protein, 9 aa, Homo Sapiens
QTRVVRRLQ

SEQ ID NO: 1351373 - protein, 9 aa, Homo Sapiens
CIRGKKQSP

SEQ ID NO: 1351374 - protein, 9 aa, Homo Sapiens
GPVGPTGEK

SEQ ID NO: 1351375 - protein, 9 aa, Homo Sapiens
SVSSATKMC

SEQ ID NO: 1351376 - protein, 9 aa, Homo Sapiens
TIEERAQRL

SEQ ID NO: 1351377 - protein, 9 aa, Homo Sapiens
ALYCGQGVQ

SEQ ID NO: 1351378 - protein, 9 aa, Homo Sapiens
ESYEESSKV

SEQ ID NO: 1351379 - protein, 9 aa, Homo Sapiens
LHNMMVTGQ

SEQ ID NO: 1351380 - protein, 9 aa, Homo Sapiens
KSHSMVRTG

SEQ ID NO: 1351381 - protein, 9 aa, Homo Sapiens
KECDKAFRV

SEQ ID NO: 1351382 - protein, 9 aa, Homo Sapiens
VAMQEMEEY

SEQ ID NO: 1351383 - protein, 9 aa, Homo Sapiens
SGSKLASVS

SEQ ID NO: 1351384 - protein, 9 aa, Homo Sapiens
VGGTSAVEV

SEQ ID NO: 1351385 - protein, 9 aa, Homo Sapiens
DTISINHKW

SEQ ID NO: 1351386 - protein, 9 aa, Homo Sapiens
QTPHINKFT

SEQ ID NO: 1351387 - protein, 9 aa, Homo Sapiens
PAQWPPGPR

SEQ ID NO: 1351388 - protein, 9 aa, Homo Sapiens
SWHHPGDSD

SEQ ID NO: 1351389 - protein, 9 aa, Homo Sapiens
RCHMNKGET

SEQ ID NO: 1351390 - protein, 9 aa, Homo Sapiens
SGGQKQRIN

SEQ ID NO: 1351391 - protein, 9 aa, Homo Sapiens
HVLMCGGDG

SEQ ID NO: 1351392 - protein, 9 aa, Homo Sapiens
IRCHYRDKH

SEQ ID NO: 1351393 - protein, 9 aa, Homo Sapiens
QHDLDLRVC

SEQ ID NO: 1351394 - protein, 9 aa, Homo Sapiens
SLDNARRLT

SEQ ID NO: 1351395 - protein, 9 aa, Homo Sapiens
AGDQSTLQH

SEQ ID NO: 1351396 - protein, 9 aa, Homo Sapiens
LTDLSTIIL

SEQ ID NO: 1351397 - protein, 9 aa, Homo Sapiens
RPKRPRIIL

SEQ ID NO: 1351398 - protein, 9 aa, Homo Sapiens
AYIHVPQDH

SEQ ID NO: 1351399 - protein, 9 aa, Homo Sapiens
VSVVRRTQH

SEQ ID NO: 1351400 - protein, 9 aa, Homo Sapiens
QVDFSCYDF

SEQ ID NO: 1351401 - protein, 9 aa, Homo Sapiens
DKCPRTASP

SEQ ID NO: 1351402 - protein, 9 aa, Homo Sapiens
DFSCYDFFL

SEQ ID NO: 1351403 - protein, 9 aa, Homo Sapiens
VATVLSFSL

SEQ ID NO: 1351404 - protein, 9 aa, Homo Sapiens
ETRCGQILL

SEQ ID NO: 1351405 - protein, 9 aa, Homo Sapiens
EHIKQFQTI

SEQ ID NO: 1351406 - protein, 9 aa, Homo Sapiens
KDCIASLPF

SEQ ID NO: 1351407 - protein, 9 aa, Homo Sapiens
STAGYIIPE

SEQ ID NO: 1351408 - protein, 9 aa, Homo Sapiens
LEKYHDSIE

SEQ ID NO: 1351409 - protein, 9 aa, Homo Sapiens
VEEELFSVC

SEQ ID NO: 1351410 - protein, 9 aa, Homo Sapiens
HKNAKYLLK

SEQ ID NO: 1351411 - protein, 9 aa, Homo Sapiens
DSANCSEFL

SEQ ID NO: 1351412 - protein, 9 aa, Homo Sapiens
ANLFQFLWM

SEQ ID NO: 1351413 - protein, 9 aa, Homo Sapiens
LLKCTVAKE

SEQ ID NO: 1351414 - protein, 9 aa, Homo Sapiens
ETNPQPGSC

SEQ ID NO: 1351415 - protein, 9 aa, Homo Sapiens
EDDYDITLM

SEQ ID NO: 1351416 - protein, 9 aa, Homo Sapiens
ECDCKEADR

SEQ ID NO: 1351417 - protein, 9 aa, Homo Sapiens
FEEVQCCTA

SEQ ID NO: 1351418 - protein, 9 aa, Homo Sapiens
SAAKPSAPT

SEQ ID NO: 1351419 - protein, 9 aa, Homo Sapiens
EAPAEPLGQ

SEQ ID NO: 1351420 - protein, 9 aa, Homo Sapiens
PMIDAERVD

SEQ ID NO: 1351421 - protein, 9 aa, Homo Sapiens
PPDAVKPVI

SEQ ID NO: 1351422 - protein, 9 aa, Homo Sapiens
SRAWRPHNA

SEQ ID NO: 1351423 - protein, 9 aa, Homo Sapiens
EVVVVHELG

SEQ ID NO: 1351424 - protein, 9 aa, Homo Sapiens
SKAQYNVGL

SEQ ID NO: 1351425 - protein, 9 aa, Homo Sapiens
QQMLMEKEG

SEQ ID NO: 1351426 - protein, 9 aa, Homo Sapiens
RKSLADDKQ

SEQ ID NO: 1351427 - protein, 9 aa, Homo Sapiens
CFLCLGWGL

SEQ ID NO: 1351428 - protein, 9 aa, Homo Sapiens
RTIEESSAN

SEQ ID NO: 1351429 - protein, 9 aa, Homo Sapiens
NVFYVKARL

SEQ ID NO: 1351430 - protein, 9 aa, Homo Sapiens
MEGSNMTFL

SEQ ID NO: 1351431 - protein, 9 aa, Homo Sapiens
AGEYIRVKL

SEQ ID NO: 1351432 - protein, 9 aa, Homo Sapiens
QEVIMLFCE

SEQ ID NO: 1351433 - protein, 9 aa, Homo Sapiens
ERNYYRLKE

SEQ ID NO: 1351434 - protein, 9 aa, Homo Sapiens
GNASTMARR

SEQ ID NO: 1351435 - protein, 9 aa, Homo Sapiens
REGLSRHQV

SEQ ID NO: 1351436 - protein, 9 aa, Homo Sapiens
GAVLRQARH

SEQ ID NO: 1351437 - protein, 9 aa, Homo Sapiens
PHWQTKLEV

SEQ ID NO: 1351438 - protein, 9 aa, Homo Sapiens
PPSRNPSAT

SEQ ID NO: 1351439 - protein, 9 aa, Homo Sapiens
EDSDLFELD

SEQ ID NO: 1351440 - protein, 9 aa, Homo Sapiens
LEVIKNPDS

SEQ ID NO: 1351441 - protein, 9 aa, Homo Sapiens
ASAKRTKVA

SEQ ID NO: 1351442 - protein, 9 aa, Homo Sapiens
TVRDNQAIE

SEQ ID NO: 1351443 - protein, 9 aa, Homo Sapiens
AARENHYDC

SEQ ID NO: 1351444 - protein, 9 aa, Homo Sapiens
WWGSALHFE

SEQ ID NO: 1351445 - protein, 9 aa, Homo Sapiens
LSASSATEK

SEQ ID NO: 1351446 - protein, 9 aa, Homo Sapiens
QVFTLHLFG

SEQ ID NO: 1351447 - protein, 9 aa, Homo Sapiens
ASAAEPSAR

SEQ ID NO: 1351448 - protein, 9 aa, Homo Sapiens
FSSTSSLSS

SEQ ID NO: 1351449 - protein, 9 aa, Homo Sapiens
EENDVNASS

SEQ ID NO: 1351450 - protein, 9 aa, Homo Sapiens
LSNATPCTV

SEQ ID NO: 1351451 - protein, 9 aa, Homo Sapiens
SHMPMWSAH

SEQ ID NO: 1351452 - protein, 9 aa, Homo Sapiens
ERKYDLKEP

SEQ ID NO: 1351453 - protein, 9 aa, Homo Sapiens
LEPIPECPP

SEQ ID NO: 1351454 - protein, 9 aa, Homo Sapiens
MKACVSFWK

SEQ ID NO: 1351455 - protein, 9 aa, Homo Sapiens
RGPQLWARH

SEQ ID NO: 1351456 - protein, 9 aa, Homo Sapiens
RRRKEIMVQ

SEQ ID NO: 1351457 - protein, 9 aa, Homo Sapiens
QHGTEVNKA

SEQ ID NO: 1351458 - protein, 9 aa, Homo Sapiens
SKSKCNDLV

SEQ ID NO: 1351459 - protein, 9 aa, Homo Sapiens
SPRNIWVGD

SEQ ID NO: 1351460 - protein, 9 aa, Homo Sapiens
DFLSCSFAP

SEQ ID NO: 1351461 - protein, 9 aa, Homo Sapiens
VCCSWRQND

SEQ ID NO: 1351462 - protein, 9 aa, Homo Sapiens
DALYTVLHH

SEQ ID NO: 1351463 - protein, 9 aa, Homo Sapiens
CTGASTQAR

SEQ ID NO: 1351464 - protein, 9 aa, Homo Sapiens
SATSAALLS

SEQ ID NO: 1351465 - protein, 9 aa, Homo Sapiens
SVVCWTPGQ

SEQ ID NO: 1351466 - protein, 9 aa, Homo Sapiens
TPLFTDVSH

SEQ ID NO: 1351467 - protein, 9 aa, Homo Sapiens
IRTRLIRKC

SEQ ID NO: 1351468 - protein, 9 aa, Homo Sapiens
QRSLWEPSL

SEQ ID NO: 1351469 - protein, 9 aa, Homo Sapiens
MSLAKQQPI

SEQ ID NO: 1351470 - protein, 9 aa, Homo Sapiens
DGSNDSCKG

SEQ ID NO: 1351471 - protein, 9 aa, Homo Sapiens
VQLNKCPDE

SEQ ID NO: 1351472 - protein, 9 aa, Homo Sapiens
YEELHTHTK

SEQ ID NO: 1351473 - protein, 9 aa, Homo Sapiens
EDCRQLARM

SEQ ID NO: 1351474 - protein, 9 aa, Homo Sapiens
LYVQWGKGL

SEQ ID NO: 1351475 - protein, 9 aa, Homo Sapiens
KEKNEKGVL

SEQ ID NO: 1351476 - protein, 9 aa, Homo Sapiens
LSTHTKCKL

SEQ ID NO: 1351477 - protein, 9 aa, Homo Sapiens
LTQMVEIGT

SEQ ID NO: 1351478 - protein, 9 aa, Homo Sapiens
VSCKWRMNK

SEQ ID NO: 1351479 - protein, 9 aa, Homo Sapiens
VCQLEQENA

SEQ ID NO: 1351480 - protein, 9 aa, Homo Sapiens
ICLASKDHT

SEQ ID NO: 1351481 - protein, 9 aa, Homo Sapiens
QDSPIPTLK

SEQ ID NO: 1351482 - protein, 9 aa, Homo Sapiens
VYLYEVSQL

SEQ ID NO: 1351483 - protein, 9 aa, Homo Sapiens
LHKHQRVHM

SEQ ID NO: 1351484 - protein, 9 aa, Homo Sapiens
TSSKGPWSS

SEQ ID NO: 1351485 - protein, 9 aa, Homo Sapiens
RAYPIQVLT

SEQ ID NO: 1351486 - protein, 9 aa, Homo Sapiens
VDTRLSFDK

SEQ ID NO: 1351487 - protein, 9 aa, Homo Sapiens
LEELLPSTS

SEQ ID NO: 1351488 - protein, 9 aa, Homo Sapiens
LNTAQQNKL

SEQ ID NO: 1351489 - protein, 9 aa, Homo Sapiens
LHLERLQID

SEQ ID NO: 1351490 - protein, 9 aa, Homo Sapiens
TILPSEPAD

SEQ ID NO: 1351491 - protein, 9 aa, Homo Sapiens
KGALKKPIH

SEQ ID NO: 1351492 - protein, 9 aa, Homo Sapiens
TADCKTVVN

SEQ ID NO: 1351493 - protein, 9 aa, Homo Sapiens
PNTKYIFKI

SEQ ID NO: 1351494 - protein, 9 aa, Homo Sapiens
ITQLQDGRT

SEQ ID NO: 1351495 - protein, 9 aa, Homo Sapiens
IEHIKIESL

SEQ ID NO: 1351496 - protein, 9 aa, Homo Sapiens
LPLKRKQHR

SEQ ID NO: 1351497 - protein, 9 aa, Homo Sapiens
SMQMAISRV

SEQ ID NO: 1351498 - protein, 9 aa, Homo Sapiens
QIQDAKKAE

SEQ ID NO: 1351499 - protein, 9 aa, Homo Sapiens
LTCDDPHFQ

SEQ ID NO: 1351500 - protein, 9 aa, Homo Sapiens
LLPGPAPRR

SEQ ID NO: 1351501 - protein, 9 aa, Homo Sapiens
FSRDKLKFF

SEQ ID NO: 1351502 - protein, 9 aa, Homo Sapiens
NTLFFFVFT

SEQ ID NO: 1351503 - protein, 9 aa, Homo Sapiens
DITKEENSA

SEQ ID NO: 1351504 - protein, 9 aa, Homo Sapiens
DFFLANVSR

SEQ ID NO: 1351505 - protein, 9 aa, Homo Sapiens
VTIVYSGKM

SEQ ID NO: 1351506 - protein, 9 aa, Homo Sapiens
SGSYDKEVN

SEQ ID NO: 1351507 - protein, 9 aa, Homo Sapiens
QLVEIDKNM

SEQ ID NO: 1351508 - protein, 9 aa, Homo Sapiens
KVCTYHTPA

SEQ ID NO: 1351509 - protein, 9 aa, Homo Sapiens
VDHISSRLN

SEQ ID NO: 1351510 - protein, 9 aa, Homo Sapiens
APPCAGFLF

SEQ ID NO: 1351511 - protein, 9 aa, Homo Sapiens
HFTKRVRII

SEQ ID NO: 1351512 - protein, 9 aa, Homo Sapiens
RLRHIDDRE

SEQ ID NO: 1351513 - protein, 9 aa, Homo Sapiens
RDKLTGRGF

SEQ ID NO: 1351514 - protein, 9 aa, Homo Sapiens
PMAQSAAVG

SEQ ID NO: 1351515 - protein, 9 aa, Homo Sapiens
HEMPHTREK

SEQ ID NO: 1351516 - protein, 9 aa, Homo Sapiens
AWRRCNTLQ

SEQ ID NO: 1351517 - protein, 9 aa, Homo Sapiens
LCSPPSPQN

SEQ ID NO: 1351518 - protein, 9 aa, Homo Sapiens
RRMNNLMDE

SEQ ID NO: 1351519 - protein, 9 aa, Homo Sapiens
LHNCETRCG

SEQ ID NO: 1351520 - protein, 9 aa, Homo Sapiens
INGQNLGHY

SEQ ID NO: 1351521 - protein, 9 aa, Homo Sapiens
QEEERLHCR

SEQ ID NO: 1351522 - protein, 9 aa, Homo Sapiens
EKGSLILLG

SEQ ID NO: 1351523 - protein, 9 aa, Homo Sapiens
LVLLSFAML

SEQ ID NO: 1351524 - protein, 9 aa, Homo Sapiens
PKVSDTMVE

SEQ ID NO: 1351525 - protein, 9 aa, Homo Sapiens
IHTILSARK

SEQ ID NO: 1351526 - protein, 9 aa, Homo Sapiens
HTYMRSFGL

SEQ ID NO: 1351527 - protein, 9 aa, Homo Sapiens
LLHHQRTHS

SEQ ID NO: 1351528 - protein, 9 aa, Homo Sapiens
FIRSIGLMF

SEQ ID NO: 1351529 - protein, 9 aa, Homo Sapiens
CFKNGILDE

SEQ ID NO: 1351530 - protein, 9 aa, Homo Sapiens
REVYTWNLD

SEQ ID NO: 1351531 - protein, 9 aa, Homo Sapiens
AQPVGSSVR

SEQ ID NO: 1351532 - protein, 9 aa, Homo Sapiens
FYTNVMPML

SEQ ID NO: 1351533 - protein, 9 aa, Homo Sapiens
KGEIPKDEH

SEQ ID NO: 1351534 - protein, 9 aa, Homo Sapiens
AEVESFHSS

SEQ ID NO: 1351535 - protein, 9 aa, Homo Sapiens
FYLRLSFNR

SEQ ID NO: 1351536 - protein, 9 aa, Homo Sapiens
TRDNEVISV

SEQ ID NO: 1351537 - protein, 9 aa, Homo Sapiens
SIAISLCGA

SEQ ID NO: 1351538 - protein, 9 aa, Homo Sapiens
VLTPRGSIV

SEQ ID NO: 1351539 - protein, 9 aa, Homo Sapiens
TSLAQALQE

SEQ ID NO: 1351540 - protein, 9 aa, Homo Sapiens
LLTNLEYHR

SEQ ID NO: 1351541 - protein, 9 aa, Homo Sapiens
EDAWARCEG

SEQ ID NO: 1351542 - protein, 9 aa, Homo Sapiens
ENDNRVQHK

SEQ ID NO: 1351543 - protein, 9 aa, Homo Sapiens
VSSDLEGTE

SEQ ID NO: 1351544 - protein, 9 aa, Homo Sapiens
TPQQTQALG

SEQ ID NO: 1351545 - protein, 9 aa, Homo Sapiens
KQLCGRHKC

SEQ ID NO: 1351546 - protein, 9 aa, Homo Sapiens
DQGFNLMNK

SEQ ID NO: 1351547 - protein, 9 aa, Homo Sapiens
AARARTCSP

SEQ ID NO: 1351548 - protein, 9 aa, Homo Sapiens
HGYIFGNSF

SEQ ID NO: 1351549 - protein, 9 aa, Homo Sapiens
RTLGNCGPY

SEQ ID NO: 1351550 - protein, 9 aa, Homo Sapiens
IHQTYIPVL

SEQ ID NO: 1351551 - protein, 9 aa, Homo Sapiens
RTVGECRSP

SEQ ID NO: 1351552 - protein, 9 aa, Homo Sapiens
HKWCEEMKY

SEQ ID NO: 1351553 - protein, 9 aa, Homo Sapiens
DTFAMEGLK

SEQ ID NO: 1351554 - protein, 9 aa, Homo Sapiens
GPCDTGNRA

SEQ ID NO: 1351555 - protein, 9 aa, Homo Sapiens
SRCYGVCVD

SEQ ID NO: 1351556 - protein, 9 aa, Homo Sapiens
GTKYKVTGW

SEQ ID NO: 1351557 - protein, 9 aa, Homo Sapiens
SPSPPHRRR

SEQ ID NO: 1351558 - protein, 9 aa, Homo Sapiens
PPFVPSTIF

SEQ ID NO: 1351559 - protein, 9 aa, Homo Sapiens
SILVIHYFR

SEQ ID NO: 1351560 - protein, 9 aa, Homo Sapiens
GQYIVIAPN

SEQ ID NO: 1351561 - protein, 9 aa, Homo Sapiens
QMSTVSGPL

SEQ ID NO: 1351562 - protein, 9 aa, Homo Sapiens
LDATFSMNA

SEQ ID NO: 1351563 - protein, 9 aa, Homo Sapiens
RLATDKHFN

SEQ ID NO: 1351564 - protein, 9 aa, Homo Sapiens
ASTRASGPT

SEQ ID NO: 1351565 - protein, 9 aa, Homo Sapiens
PEENSTYEQ

SEQ ID NO: 1351566 - protein, 9 aa, Homo Sapiens
ERLTKQLKL

SEQ ID NO: 1351567 - protein, 9 aa, Homo Sapiens
SLYDTVAES

SEQ ID NO: 1351568 - protein, 9 aa, Homo Sapiens
YLYKLKELW

SEQ ID NO: 1351569 - protein, 9 aa, Homo Sapiens
GTKLGFVSG

SEQ ID NO: 1351570 - protein, 9 aa, Homo Sapiens
GGCMNPAHA

SEQ ID NO: 1351571 - protein, 9 aa, Homo Sapiens
CIACYSNMG

SEQ ID NO: 1351572 - protein, 9 aa, Homo Sapiens
LVKHADVAG

SEQ ID NO: 1351573 - protein, 9 aa, Homo Sapiens
VLVEAFQKI

SEQ ID NO: 1351574 - protein, 9 aa, Homo Sapiens
EEGVTLEEE

SEQ ID NO: 1351575 - protein, 9 aa, Homo Sapiens
RFFPGSEEI

SEQ ID NO: 1351576 - protein, 9 aa, Homo Sapiens
GPLSQAPQA

SEQ ID NO: 1351577 - protein, 9 aa, Homo Sapiens
WYSEACTST

SEQ ID NO: 1351578 - protein, 9 aa, Homo Sapiens
KEKIWEQEE

SEQ ID NO: 1351579 - protein, 9 aa, Homo Sapiens
TSVSEGNPY

SEQ ID NO: 1351580 - protein, 9 aa, Homo Sapiens
LFHFYRVLT

SEQ ID NO: 1351581 - protein, 9 aa, Homo Sapiens
REVDKVLAD

SEQ ID NO: 1351582 - protein, 9 aa, Homo Sapiens
LNAEQSEVV

SEQ ID NO: 1351583 - protein, 9 aa, Homo Sapiens
KGISRSQSS

SEQ ID NO: 1351584 - protein, 9 aa, Homo Sapiens
TEMRTSCLI

SEQ ID NO: 1351585 - protein, 9 aa, Homo Sapiens
SKKKLKLAP

SEQ ID NO: 1351586 - protein, 9 aa, Homo Sapiens
CQMESGYKP

SEQ ID NO: 1351587 - protein, 9 aa, Homo Sapiens
ILFFSFLED

SEQ ID NO: 1351588 - protein, 9 aa, Homo Sapiens
AVCAWESRW

SEQ ID NO: 1351589 - protein, 9 aa, Homo Sapiens
SSCAASAGR

SEQ ID NO: 1351590 - protein, 9 aa, Homo Sapiens
RFFAKKQIC

SEQ ID NO: 1351591 - protein, 9 aa, Homo Sapiens
YMSWFLPTE

SEQ ID NO: 1351592 - protein, 9 aa, Homo Sapiens
QGATCTGAA

SEQ ID NO: 1351593 - protein, 9 aa, Homo Sapiens
NHVVQVLLN

SEQ ID NO: 1351594 - protein, 9 aa, Homo Sapiens
EFFPTGDCF

SEQ ID NO: 1351595 - protein, 9 aa, Homo Sapiens
YGKAHFLQL

SEQ ID NO: 1351596 - protein, 9 aa, Homo Sapiens
SWVSKLEEE

SEQ ID NO: 1351597 - protein, 9 aa, Homo Sapiens
EGNHLLGGS

SEQ ID NO: 1351598 - protein, 9 aa, Homo Sapiens
PCAGFLFGV

SEQ ID NO: 1351599 - protein, 9 aa, Homo Sapiens
CTGASTAAR

SEQ ID NO: 1351600 - protein, 9 aa, Homo Sapiens
VDMYVVRGR

SEQ ID NO: 1351601 - protein, 9 aa, Homo Sapiens
SRDSRSFFT

SEQ ID NO: 1351602 - protein, 9 aa, Homo Sapiens
PREALQVPA

SEQ ID NO: 1351603 - protein, 9 aa, Homo Sapiens
AAELDAELL

SEQ ID NO: 1351604 - protein, 9 aa, Homo Sapiens
DEVISIRGL

SEQ ID NO: 1351605 - protein, 9 aa, Homo Sapiens
LSRMQNRFG

SEQ ID NO: 1351606 - protein, 9 aa, Homo Sapiens
QQTPVAAAS

SEQ ID NO: 1351607 - protein, 9 aa, Homo Sapiens
HNFTALNGT

SEQ ID NO: 1351608 - protein, 9 aa, Homo Sapiens
TVIEAPKGE

SEQ ID NO: 1351609 - protein, 9 aa, Homo Sapiens
AAVFPEVVV

SEQ ID NO: 1351610 - protein, 9 aa, Homo Sapiens
ANFFIGAVN

SEQ ID NO: 1351611 - protein, 9 aa, Homo Sapiens
TIRDRENHT

SEQ ID NO: 1351612 - protein, 9 aa, Homo Sapiens
NDSMSQSSQ

SEQ ID NO: 1351613 - protein, 9 aa, Homo Sapiens
YVVRGRDGC

SEQ ID NO: 1351614 - protein, 9 aa, Homo Sapiens
TIPAYHLRD

SEQ ID NO: 1351615 - protein, 9 aa, Homo Sapiens
STSPKGKQL

SEQ ID NO: 1351616 - protein, 9 aa, Homo Sapiens
DFQLVLPGE

SEQ ID NO: 1351617 - protein, 9 aa, Homo Sapiens
VVPKDKKDI

SEQ ID NO: 1351618 - protein, 9 aa, Homo Sapiens
FFGQAVQYQ

SEQ ID NO: 1351619 - protein, 9 aa, Homo Sapiens
GLGLPPGMR

SEQ ID NO: 1351620 - protein, 9 aa, Homo Sapiens
VIHIIFTLF

SEQ ID NO: 1351621 - protein, 9 aa, Homo Sapiens
DTILGIDLL

SEQ ID NO: 1351622 - protein, 9 aa, Homo Sapiens
EFEADRHAF

SEQ ID NO: 1351623 - protein, 9 aa, Homo Sapiens
NGHMRISEI

SEQ ID NO: 1351624 - protein, 9 aa, Homo Sapiens
IQILLHFRH

SEQ ID NO: 1351625 - protein, 9 aa, Homo Sapiens
IRSLIRTGG

SEQ ID NO: 1351626 - protein, 9 aa, Homo Sapiens
RTPLPSAYV

SEQ ID NO: 1351627 - protein, 9 aa, Homo Sapiens
YYRSALMTA

SEQ ID NO: 1351628 - protein, 9 aa, Homo Sapiens
VCVLRAVVI

SEQ ID NO: 1351629 - protein, 9 aa, Homo Sapiens
LEYVLKQER

SEQ ID NO: 1351630 - protein, 9 aa, Homo Sapiens
NCLLSCTGP

SEQ ID NO: 1351631 - protein, 9 aa, Homo Sapiens
PGPNDILLV

SEQ ID NO: 1351632 - protein, 9 aa, Homo Sapiens
LHMLTDLST

SEQ ID NO: 1351633 - protein, 9 aa, Homo Sapiens
IPNDLKLKE

SEQ ID NO: 1351634 - protein, 9 aa, Homo Sapiens
CVISALACL

SEQ ID NO: 1351635 - protein, 9 aa, Homo Sapiens
SSSGSSFSS

SEQ ID NO: 1351636 - protein, 9 aa, Homo Sapiens
HNVFLATDR

SEQ ID NO: 1351637 - protein, 9 aa, Homo Sapiens
HYLYENLEE

SEQ ID NO: 1351638 - protein, 9 aa, Homo Sapiens
QYIVIAPNG

SEQ ID NO: 1351639 - protein, 9 aa, Homo Sapiens
KAVTREHLE

SEQ ID NO: 1351640 - protein, 9 aa, Homo Sapiens
SMMMLEKLS

SEQ ID NO: 1351641 - protein, 9 aa, Homo Sapiens
VQLAQLKES

SEQ ID NO: 1351642 - protein, 9 aa, Homo Sapiens
VGQWQARHY

SEQ ID NO: 1351643 - protein, 9 aa, Homo Sapiens
VHTGEKSFK

SEQ ID NO: 1351644 - protein, 9 aa, Homo Sapiens
SIVRQCDMY

SEQ ID NO: 1351645 - protein, 9 aa, Homo Sapiens
YEEFYNCRN

SEQ ID NO: 1351646 - protein, 9 aa, Homo Sapiens
NRKMVCSIP

SEQ ID NO: 1351647 - protein, 9 aa, Homo Sapiens
TECCLLTAM

SEQ ID NO: 1351648 - protein, 9 aa, Homo Sapiens
LRYAVDGRQ

SEQ ID NO: 1351649 - protein, 9 aa, Homo Sapiens
DNRKMVCSI

SEQ ID NO: 1351650 - protein, 9 aa, Homo Sapiens
RGVLLLGDT

SEQ ID NO: 1351651 - protein, 9 aa, Homo Sapiens
KKIMWLGRK

SEQ ID NO: 1351652 - protein, 9 aa, Homo Sapiens
KICQNRARK

SEQ ID NO: 1351653 - protein, 9 aa, Homo Sapiens
ETLEECWAM

SEQ ID NO: 1351654 - protein, 9 aa, Homo Sapiens
FSPTHPGRP

SEQ ID NO: 1351655 - protein, 9 aa, Homo Sapiens
GRFNEKHNF

SEQ ID NO: 1351656 - protein, 9 aa, Homo Sapiens
KLSNVEQIT

SEQ ID NO: 1351657 - protein, 9 aa, Homo Sapiens
MDSSLILDV

SEQ ID NO: 1351658 - protein, 9 aa, Homo Sapiens
NPYEVTRAR

SEQ ID NO: 1351659 - protein, 9 aa, Homo Sapiens
IPHHSAGCD

SEQ ID NO: 1351660 - protein, 9 aa, Homo Sapiens
RNITFKNMQ

SEQ ID NO: 1351661 - protein, 9 aa, Homo Sapiens
QYHIDFEQF

SEQ ID NO: 1351662 - protein, 9 aa, Homo Sapiens
RMAYGIKEN

SEQ ID NO: 1351663 - protein, 9 aa, Homo Sapiens
SHGMPKRIV

SEQ ID NO: 1351664 - protein, 9 aa, Homo Sapiens
LGSRFVVPF

SEQ ID NO: 1351665 - protein, 9 aa, Homo Sapiens
EPGCIRVVR

SEQ ID NO: 1351666 - protein, 9 aa, Homo Sapiens
NDIVTAGSS

SEQ ID NO: 1351667 - protein, 9 aa, Homo Sapiens
YLETAEEVV

SEQ ID NO: 1351668 - protein, 9 aa, Homo Sapiens
GTVLFARLV

SEQ ID NO: 1351669 - protein, 9 aa, Homo Sapiens
KKIHRMGAV

SEQ ID NO: 1351670 - protein, 9 aa, Homo Sapiens
SRLMLKQEG

SEQ ID NO: 1351671 - protein, 9 aa, Homo Sapiens
DTTSEIGSA

SEQ ID NO: 1351672 - protein, 9 aa, Homo Sapiens
IPNLRRFDF

SEQ ID NO: 1351673 - protein, 9 aa, Homo Sapiens
TCRTVGECR

SEQ ID NO: 1351674 - protein, 9 aa, Homo Sapiens
SLPRRLWRS

SEQ ID NO: 1351675 - protein, 9 aa, Homo Sapiens
APVSEVNIT

SEQ ID NO: 1351676 - protein, 9 aa, Homo Sapiens
SPFTIVTSN

SEQ ID NO: 1351677 - protein, 9 aa, Homo Sapiens
NAVELVKKS

SEQ ID NO: 1351678 - protein, 9 aa, Homo Sapiens
QWVVSRALC

SEQ ID NO: 1351679 - protein, 9 aa, Homo Sapiens
FLCILQREE

SEQ ID NO: 1351680 - protein, 9 aa, Homo Sapiens
FKLWRHPIT

SEQ ID NO: 1351681 - protein, 9 aa, Homo Sapiens
GIKENMLAK

SEQ ID NO: 1351682 - protein, 9 aa, Homo Sapiens
CHQLGCGQA

SEQ ID NO: 1351683 - protein, 9 aa, Homo Sapiens
SLKSMVERA

SEQ ID NO: 1351684 - protein, 9 aa, Homo Sapiens
RCAVHEASV

SEQ ID NO: 1351685 - protein, 9 aa, Homo Sapiens
DEAFTYNSY

SEQ ID NO: 1351686 - protein, 9 aa, Homo Sapiens
HRIGGGSPI

SEQ ID NO: 1351687 - protein, 9 aa, Homo Sapiens
RMMRKGTTM

SEQ ID NO: 1351688 - protein, 9 aa, Homo Sapiens
EQARWPLSV

SEQ ID NO: 1351689 - protein, 9 aa, Homo Sapiens
DTTRELKTP

SEQ ID NO: 1351690 - protein, 9 aa, Homo Sapiens
SVEPKIGVI

SEQ ID NO: 1351691 - protein, 9 aa, Homo Sapiens
DYTYISVTG

SEQ ID NO: 1351692 - protein, 9 aa, Homo Sapiens
YGWKKEAIS

SEQ ID NO: 1351693 - protein, 9 aa, Homo Sapiens
HKLRKMELL

SEQ ID NO: 1351694 - protein, 9 aa, Homo Sapiens
NGYCPNHPI

SEQ ID NO: 1351695 - protein, 9 aa, Homo Sapiens
LENAVPSSR

SEQ ID NO: 1351696 - protein, 9 aa, Homo Sapiens
YQRARKECE

SEQ ID NO: 1351697 - protein, 9 aa, Homo Sapiens
DGESVMFHL

SEQ ID NO: 1351698 - protein, 9 aa, Homo Sapiens
PGGSQSDRG

SEQ ID NO: 1351699 - protein, 9 aa, Homo Sapiens
DFSDCYIEY

SEQ ID NO: 1351700 - protein, 9 aa, Homo Sapiens
AQNITGGSM

SEQ ID NO: 1351701 - protein, 9 aa, Homo Sapiens
DSETLQRVK

SEQ ID NO: 1351702 - protein, 9 aa, Homo Sapiens
TEEKLLKLL

SEQ ID NO: 1351703 - protein, 9 aa, Homo Sapiens
ELLSALGEL

SEQ ID NO: 1351704 - protein, 9 aa, Homo Sapiens
HYINPRTPP

SEQ ID NO: 1351705 - protein, 9 aa, Homo Sapiens
RFEPSAHIS

SEQ ID NO: 1351706 - protein, 9 aa, Homo Sapiens
PLAFQYFRE

SEQ ID NO: 1351707 - protein, 9 aa, Homo Sapiens
LNERQQAEH

SEQ ID NO: 1351708 - protein, 9 aa, Homo Sapiens
FQQQQLQIN

SEQ ID NO: 1351709 - protein, 9 aa, Homo Sapiens
LSCKHSPST

SEQ ID NO: 1351710 - protein, 9 aa, Homo Sapiens
LSTFYLSYF

SEQ ID NO: 1351711 - protein, 9 aa, Homo Sapiens
GELGGHPIS

SEQ ID NO: 1351712 - protein, 9 aa, Homo Sapiens
PYKRNPMCS

SEQ ID NO: 1351713 - protein, 9 aa, Homo Sapiens
QESCEKNDF

SEQ ID NO: 1351714 - protein, 9 aa, Homo Sapiens
VLTTQQQQQ

SEQ ID NO: 1351715 - protein, 9 aa, Homo Sapiens
IYTIMCWFR

SEQ ID NO: 1351716 - protein, 9 aa, Homo Sapiens
MAEVLAMIE

SEQ ID NO: 1351717 - protein, 9 aa, Homo Sapiens
QCRFSMEVR

SEQ ID NO: 1351718 - protein, 9 aa, Homo Sapiens
NLMNKFLTY

SEQ ID NO: 1351719 - protein, 9 aa, Homo Sapiens
VCDHYQHIL

SEQ ID NO: 1351720 - protein, 9 aa, Homo Sapiens
KGHRPESHA

SEQ ID NO: 1351721 - protein, 9 aa, Homo Sapiens
FILEEEQQI

SEQ ID NO: 1351722 - protein, 9 aa, Homo Sapiens
QIVISLDLY

SEQ ID NO: 1351723 - protein, 9 aa, Homo Sapiens
FTDVIFDEW

SEQ ID NO: 1351724 - protein, 9 aa, Homo Sapiens
MNDLEDNYG

SEQ ID NO: 1351725 - protein, 9 aa, Homo Sapiens
DESTIVVKI

SEQ ID NO: 1351726 - protein, 9 aa, Homo Sapiens
PGRKRKRCQ

SEQ ID NO: 1351727 - protein, 9 aa, Homo Sapiens
QKICKTFVQ

SEQ ID NO: 1351728 - protein, 9 aa, Homo Sapiens
WTTCVDAGR

SEQ ID NO: 1351729 - protein, 9 aa, Homo Sapiens
GSVTVICRN

SEQ ID NO: 1351730 - protein, 9 aa, Homo Sapiens
ALRYAVDGR

SEQ ID NO: 1351731 - protein, 9 aa, Homo Sapiens
WTGSRTHGR

SEQ ID NO: 1351732 - protein, 9 aa, Homo Sapiens
TWLPVSDDT

SEQ ID NO: 1351733 - protein, 9 aa, Homo Sapiens
SSLIDTVQS

SEQ ID NO: 1351734 - protein, 9 aa, Homo Sapiens
DAVACSTTI

SEQ ID NO: 1351735 - protein, 9 aa, Homo Sapiens
DPPVNYVPQ

SEQ ID NO: 1351736 - protein, 9 aa, Homo Sapiens
MTGTSTSSL

SEQ ID NO: 1351737 - protein, 9 aa, Homo Sapiens
LSSCGWAPF

SEQ ID NO: 1351738 - protein, 9 aa, Homo Sapiens
TADAVHPFF

SEQ ID NO: 1351739 - protein, 9 aa, Homo Sapiens
VVLQCIAGG

SEQ ID NO: 1351740 - protein, 9 aa, Homo Sapiens
DKEVNSMGS

SEQ ID NO: 1351741 - protein, 9 aa, Homo Sapiens
YKKVKDDVD

SEQ ID NO: 1351742 - protein, 9 aa, Homo Sapiens
QHSLYIDLG

SEQ ID NO: 1351743 - protein, 9 aa, Homo Sapiens
AMGNSSAED

SEQ ID NO: 1351744 - protein, 9 aa, Homo Sapiens
MIYEEISDP

SEQ ID NO: 1351745 - protein, 9 aa, Homo Sapiens
FNILHFPLS

SEQ ID NO: 1351746 - protein, 9 aa, Homo Sapiens
ERVLYIQAN

SEQ ID NO: 1351747 - protein, 9 aa, Homo Sapiens
LISQLCALE

SEQ ID NO: 1351748 - protein, 9 aa, Homo Sapiens
ARSAMITDY

SEQ ID NO: 1351749 - protein, 9 aa, Homo Sapiens
GWELPDYLM

SEQ ID NO: 1351750 - protein, 9 aa, Homo Sapiens
KDGLLDTSC

SEQ ID NO: 1351751 - protein, 9 aa, Homo Sapiens
DKSPVPKSP

SEQ ID NO: 1351752 - protein, 9 aa, Homo Sapiens
EAKKGLLRR

SEQ ID NO: 1351753 - protein, 9 aa, Homo Sapiens
NWPQGELLS

SEQ ID NO: 1351754 - protein, 9 aa, Homo Sapiens
EAVMNWVMS

SEQ ID NO: 1351755 - protein, 9 aa, Homo Sapiens
EVLDENLNK

SEQ ID NO: 1351756 - protein, 9 aa, Homo Sapiens
CRVQKFTFE

SEQ ID NO: 1351757 - protein, 9 aa, Homo Sapiens
GNCMHTMGY

SEQ ID NO: 1351758 - protein, 9 aa, Homo Sapiens
HMDKNEEEN

SEQ ID NO: 1351759 - protein, 9 aa, Homo Sapiens
YWWDYFEDQ

SEQ ID NO: 1351760 - protein, 9 aa, Homo Sapiens
SSILPIPWA

SEQ ID NO: 1351761 - protein, 9 aa, Homo Sapiens
DMFNMFCYL

SEQ ID NO: 1351762 - protein, 9 aa, Homo Sapiens
PYFSVEPKI

SEQ ID NO: 1351763 - protein, 9 aa, Homo Sapiens
KRHEVTLKA

SEQ ID NO: 1351764 - protein, 9 aa, Homo Sapiens
FWPSLLCMH

SEQ ID NO: 1351765 - protein, 9 aa, Homo Sapiens
GASSSTSRD

SEQ ID NO: 1351766 - protein, 9 aa, Homo Sapiens
DPSTVDDKC

SEQ ID NO: 1351767 - protein, 9 aa, Homo Sapiens
LGLVNDIVT

SEQ ID NO: 1351768 - protein, 9 aa, Homo Sapiens
SMVRTGEKP

SEQ ID NO: 1351769 - protein, 9 aa, Homo Sapiens
LGENDDMPK

SEQ ID NO: 1351770 - protein, 9 aa, Homo Sapiens
ANRSFLVFI

SEQ ID NO: 1351771 - protein, 9 aa, Homo Sapiens
DDQIQWPTV

SEQ ID NO: 1351772 - protein, 9 aa, Homo Sapiens
YVCSEKSAK

SEQ ID NO: 1351773 - protein, 9 aa, Homo Sapiens
IDLCQKSLK

SEQ ID NO: 1351774 - protein, 9 aa, Homo Sapiens
TIEICSEVG

SEQ ID NO: 1351775 - protein, 9 aa, Homo Sapiens
PMMETQPVF

SEQ ID NO: 1351776 - protein, 9 aa, Homo Sapiens
SGRILHQPE

SEQ ID NO: 1351777 - protein, 9 aa, Homo Sapiens
KSVQRITKY

SEQ ID NO: 1351778 - protein, 9 aa, Homo Sapiens
YMGNRFVQV

SEQ ID NO: 1351779 - protein, 9 aa, Homo Sapiens
LGDTYNMRH

SEQ ID NO: 1351780 - protein, 9 aa, Homo Sapiens
SSGLVMAAL

SEQ ID NO: 1351781 - protein, 9 aa, Homo Sapiens
DYDNKSHVD

SEQ ID NO: 1351782 - protein, 9 aa, Homo Sapiens
ERAPSRQGL

SEQ ID NO: 1351783 - protein, 9 aa, Homo Sapiens
WNMGTILEG

SEQ ID NO: 1351784 - protein, 9 aa, Homo Sapiens
DDAPKKQVL

SEQ ID NO: 1351785 - protein, 9 aa, Homo Sapiens
GETVYNMLR

SEQ ID NO: 1351786 - protein, 9 aa, Homo Sapiens
GCKTDLCKG

SEQ ID NO: 1351787 - protein, 9 aa, Homo Sapiens
LKDMPSSSM

SEQ ID NO: 1351788 - protein, 9 aa, Homo Sapiens
FGRNMELEH

SEQ ID NO: 1351789 - protein, 9 aa, Homo Sapiens
PKRPRIILT

SEQ ID NO: 1351790 - protein, 9 aa, Homo Sapiens
GMHLLNIPL

SEQ ID NO: 1351791 - protein, 9 aa, Homo Sapiens
IHSFGICHQ

SEQ ID NO: 1351792 - protein, 9 aa, Homo Sapiens
SASLGEYLK

SEQ ID NO: 1351793 - protein, 9 aa, Homo Sapiens
RQARHQAEK

SEQ ID NO: 1351794 - protein, 9 aa, Homo Sapiens
RFMAICNPL

SEQ ID NO: 1351795 - protein, 9 aa, Homo Sapiens
HGYSISHMK

SEQ ID NO: 1351796 - protein, 9 aa, Homo Sapiens
EAEVESFHS

SEQ ID NO: 1351797 - protein, 9 aa, Homo Sapiens
RTLFCSSDD

SEQ ID NO: 1351798 - protein, 9 aa, Homo Sapiens
TALSVRPDT

SEQ ID NO: 1351799 - protein, 9 aa, Homo Sapiens
GGLPSHQAS

SEQ ID NO: 1351800 - protein, 9 aa, Homo Sapiens
TSQHRRKSL

SEQ ID NO: 1351801 - protein, 9 aa, Homo Sapiens
PLHKKKSVW

SEQ ID NO: 1351802 - protein, 9 aa, Homo Sapiens
PPGATYTVI

SEQ ID NO: 1351803 - protein, 9 aa, Homo Sapiens
SESEYCKCK

SEQ ID NO: 1351804 - protein, 9 aa, Homo Sapiens
EVPIFHDFS

SEQ ID NO: 1351805 - protein, 9 aa, Homo Sapiens
VVFVAVMEF

SEQ ID NO: 1351806 - protein, 9 aa, Homo Sapiens
LPYLALPLN

SEQ ID NO: 1351807 - protein, 9 aa, Homo Sapiens
RHLGGGGGQ

SEQ ID NO: 1351808 - protein, 9 aa, Homo Sapiens
HFKQLETEQ

SEQ ID NO: 1351809 - protein, 9 aa, Homo Sapiens
CVTAERCVS

SEQ ID NO: 1351810 - protein, 9 aa, Homo Sapiens
ITRLYGEPV

SEQ ID NO: 1351811 - protein, 9 aa, Homo Sapiens
KVHISDSHL

SEQ ID NO: 1351812 - protein, 9 aa, Homo Sapiens
ADNFKVFDF

SEQ ID NO: 1351813 - protein, 9 aa, Homo Sapiens
ATKNSVRFH

SEQ ID NO: 1351814 - protein, 9 aa, Homo Sapiens
LWITYGQGS

SEQ ID NO: 1351815 - protein, 9 aa, Homo Sapiens
ATPEQGLST

SEQ ID NO: 1351816 - protein, 9 aa, Homo Sapiens
EIKMAMGIE

SEQ ID NO: 1351817 - protein, 9 aa, Homo Sapiens
ILVLVALFA

SEQ ID NO: 1351818 - protein, 9 aa, Homo Sapiens
THKGYHPLA

SEQ ID NO: 1351819 - protein, 9 aa, Homo Sapiens
MPATSDSVS

SEQ ID NO: 1351820 - protein, 9 aa, Homo Sapiens
GAGVESLYF

SEQ ID NO: 1351821 - protein, 9 aa, Homo Sapiens
WVGDGDAAA

SEQ ID NO: 1351822 - protein, 9 aa, Homo Sapiens
RQTPIQTPC

SEQ ID NO: 1351823 - protein, 9 aa, Homo Sapiens
ETKCAPAAC

SEQ ID NO: 1351824 - protein, 9 aa, Homo Sapiens
FRQSKHPMT

SEQ ID NO: 1351825 - protein, 9 aa, Homo Sapiens
KKKTKPEYP

SEQ ID NO: 1351826 - protein, 9 aa, Homo Sapiens
EKLQSINNY

SEQ ID NO: 1351827 - protein, 9 aa, Homo Sapiens
KDEWLEAIS

SEQ ID NO: 1351828 - protein, 9 aa, Homo Sapiens
PHDDFVADG

SEQ ID NO: 1351829 - protein, 9 aa, Homo Sapiens
ATRTVSSSS

SEQ ID NO: 1351830 - protein, 9 aa, Homo Sapiens
AESYERIHH

SEQ ID NO: 1351831 - protein, 9 aa, Homo Sapiens
AADTVLCAY

SEQ ID NO: 1351832 - protein, 9 aa, Homo Sapiens
SRTHGRWKY

SEQ ID NO: 1351833 - protein, 9 aa, Homo Sapiens
WNLFPRSLS

SEQ ID NO: 1351834 - protein, 9 aa, Homo Sapiens
KSKCNDLVT

SEQ ID NO: 1351835 - protein, 9 aa, Homo Sapiens
RKFQYEEEV

SEQ ID NO: 1351836 - protein, 9 aa, Homo Sapiens
VVCLWLHEA

SEQ ID NO: 1351837 - protein, 9 aa, Homo Sapiens
INECEQVSK

SEQ ID NO: 1351838 - protein, 9 aa, Homo Sapiens
CAWESRWRA

SEQ ID NO: 1351839 - protein, 9 aa, Homo Sapiens
GTSVEEALE

SEQ ID NO: 1351840 - protein, 9 aa, Homo Sapiens
GTADHCIRF

SEQ ID NO: 1351841 - protein, 9 aa, Homo Sapiens
LQTPHINKF

SEQ ID NO: 1351842 - protein, 9 aa, Homo Sapiens
GERINQLIC

SEQ ID NO: 1351843 - protein, 9 aa, Homo Sapiens
LIIIIITLL

SEQ ID NO: 1351844 - protein, 9 aa, Homo Sapiens
PDKPTTPVS

SEQ ID NO: 1351845 - protein, 9 aa, Homo Sapiens
IAQRRKTLN

SEQ ID NO: 1351846 - protein, 9 aa, Homo Sapiens
VVTGFYAEP

SEQ ID NO: 1351847 - protein, 9 aa, Homo Sapiens
VRIWALKML

SEQ ID NO: 1351848 - protein, 9 aa, Homo Sapiens
KDIFDELFK

SEQ ID NO: 1351849 - protein, 9 aa, Homo Sapiens
RKQCTLAAL

SEQ ID NO: 1351850 - protein, 9 aa, Homo Sapiens
PPAAMMTQS

SEQ ID NO: 1351851 - protein, 9 aa, Homo Sapiens
ARIATLESA

SEQ ID NO: 1351852 - protein, 9 aa, Homo Sapiens
WVALGPHSL

SEQ ID NO: 1351853 - protein, 9 aa, Homo Sapiens
PVSKLVVTK

SEQ ID NO: 1351854 - protein, 9 aa, Homo Sapiens
PSASLGEYL

SEQ ID NO: 1351855 - protein, 9 aa, Homo Sapiens
PVKEDTQLG

SEQ ID NO: 1351856 - protein, 9 aa, Homo Sapiens
NNQPTMETH

SEQ ID NO: 1351857 - protein, 9 aa, Homo Sapiens
DVAEIVLEA

SEQ ID NO: 1351858 - protein, 9 aa, Homo Sapiens
CQWCDKDFN

SEQ ID NO: 1351859 - protein, 9 aa, Homo Sapiens
EEKDKSPVP

SEQ ID NO: 1351860 - protein, 9 aa, Homo Sapiens
CEVATGIWG

SEQ ID NO: 1351861 - protein, 9 aa, Homo Sapiens
AWSSFCTSP

SEQ ID NO: 1351862 - protein, 9 aa, Homo Sapiens
MRPRHPHQI

SEQ ID NO: 1351863 - protein, 9 aa, Homo Sapiens
IYGCALPLE

SEQ ID NO: 1351864 - protein, 9 aa, Homo Sapiens
QGTNSTHFL

SEQ ID NO: 1351865 - protein, 9 aa, Homo Sapiens
PVIAKKENG

SEQ ID NO: 1351866 - protein, 9 aa, Homo Sapiens
DVTEKLKAN

SEQ ID NO: 1351867 - protein, 9 aa, Homo Sapiens
TREYIIRLV

SEQ ID NO: 1351868 - protein, 9 aa, Homo Sapiens
RPTKIGCRS

SEQ ID NO: 1351869 - protein, 9 aa, Homo Sapiens
APGCVGVSG

SEQ ID NO: 1351870 - protein, 9 aa, Homo Sapiens
LKQLVVTLS

SEQ ID NO: 1351871 - protein, 9 aa, Homo Sapiens
ATYQKYWLN

SEQ ID NO: 1351872 - protein, 9 aa, Homo Sapiens
PHDTVPKPP

SEQ ID NO: 1351873 - protein, 9 aa, Homo Sapiens
GDVELIQTF

SEQ ID NO: 1351874 - protein, 9 aa, Homo Sapiens
FGKVTGETV

SEQ ID NO: 1351875 - protein, 9 aa, Homo Sapiens
FTYNSYLAK

SEQ ID NO: 1351876 - protein, 9 aa, Homo Sapiens
RRKLGMQLV

SEQ ID NO: 1351877 - protein, 9 aa, Homo Sapiens
RLEERCGII

SEQ ID NO: 1351878 - protein, 9 aa, Homo Sapiens
LLVTDEHDT

SEQ ID NO: 1351879 - protein, 9 aa, Homo Sapiens
TPWACATCG

SEQ ID NO: 1351880 - protein, 9 aa, Homo Sapiens
SHQFPCHWS

SEQ ID NO: 1351881 - protein, 9 aa, Homo Sapiens
EIKGMVTEF

SEQ ID NO: 1351882 - protein, 9 aa, Homo Sapiens
LCQNTQTFN

SEQ ID NO: 1351883 - protein, 9 aa, Homo Sapiens
EDAIIYCNF

SEQ ID NO: 1351884 - protein, 9 aa, Homo Sapiens
NSHTIMIAC

SEQ ID NO: 1351885 - protein, 9 aa, Homo Sapiens
VILCHFRKL

SEQ ID NO: 1351886 - protein, 9 aa, Homo Sapiens
VHIKHAPAR

SEQ ID NO: 1351887 - protein, 9 aa, Homo Sapiens
SQVSCFSDG

SEQ ID NO: 1351888 - protein, 9 aa, Homo Sapiens
HMWCHTSVK

SEQ ID NO: 1351889 - protein, 9 aa, Homo Sapiens
GARCQCCPT

SEQ ID NO: 1351890 - protein, 9 aa, Homo Sapiens
SRFGGSTHN

SEQ ID NO: 1351891 - protein, 9 aa, Homo Sapiens
RLLSCKHSP

SEQ ID NO: 1351892 - protein, 9 aa, Homo Sapiens
MMISKQIHQ

SEQ ID NO: 1351893 - protein, 9 aa, Homo Sapiens
TCTALAVLG

SEQ ID NO: 1351894 - protein, 9 aa, Homo Sapiens
CCIKPNDDR

SEQ ID NO: 1351895 - protein, 9 aa, Homo Sapiens
QDVPLVNLT

SEQ ID NO: 1351896 - protein, 9 aa, Homo Sapiens
LEMPKTSRR

SEQ ID NO: 1351897 - protein, 9 aa, Homo Sapiens
YINPRTPPK

SEQ ID NO: 1351898 - protein, 9 aa, Homo Sapiens
RSDLDHFWL

SEQ ID NO: 1351899 - protein, 9 aa, Homo Sapiens
ANIVTYHGS

SEQ ID NO: 1351900 - protein, 9 aa, Homo Sapiens
DSRKERLGL

SEQ ID NO: 1351901 - protein, 9 aa, Homo Sapiens
RSSLKSGRK

SEQ ID NO: 1351902 - protein, 9 aa, Homo Sapiens
HITFNKING

SEQ ID NO: 1351903 - protein, 9 aa, Homo Sapiens
IHELGYNMY

SEQ ID NO: 1351904 - protein, 9 aa, Homo Sapiens
CKAGGGLIG

SEQ ID NO: 1351905 - protein, 9 aa, Homo Sapiens
KPQAVEWHV

SEQ ID NO: 1351906 - protein, 9 aa, Homo Sapiens
ERHSQNSSI

SEQ ID NO: 1351907 - protein, 9 aa, Homo Sapiens
WEGTGPSIQ

SEQ ID NO: 1351908 - protein, 9 aa, Homo Sapiens
WDHTASGHR

SEQ ID NO: 1351909 - protein, 9 aa, Homo Sapiens
LQMKPCRLL

SEQ ID NO: 1351910 - protein, 9 aa, Homo Sapiens
SCGEKTVSR

SEQ ID NO: 1351911 - protein, 9 aa, Homo Sapiens
RPTPDNPYE

SEQ ID NO: 1351912 - protein, 9 aa, Homo Sapiens
TARLEERCG

SEQ ID NO: 1351913 - protein, 9 aa, Homo Sapiens
LDLNYSIDT

SEQ ID NO: 1351914 - protein, 9 aa, Homo Sapiens
YTNFCKDQS

SEQ ID NO: 1351915 - protein, 9 aa, Homo Sapiens
WGLKDVMLM

SEQ ID NO: 1351916 - protein, 9 aa, Homo Sapiens
GCQDVHKNS

SEQ ID NO: 1351917 - protein, 9 aa, Homo Sapiens
TGSLQELAP

SEQ ID NO: 1351918 - protein, 9 aa, Homo Sapiens
VAGSLSQYQ

SEQ ID NO: 1351919 - protein, 9 aa, Homo Sapiens
HNGVKPYQC

SEQ ID NO: 1351920 - protein, 9 aa, Homo Sapiens
IVAPGVRMA

SEQ ID NO: 1351921 - protein, 9 aa, Homo Sapiens
QHIAQQGSY

SEQ ID NO: 1351922 - protein, 9 aa, Homo Sapiens
QHLYIIHLA

SEQ ID NO: 1351923 - protein, 9 aa, Homo Sapiens
RYAVDGRQE

SEQ ID NO: 1351924 - protein, 9 aa, Homo Sapiens
RPAPLIMGF

SEQ ID NO: 1351925 - protein, 9 aa, Homo Sapiens
EDDIYMMDI

SEQ ID NO: 1351926 - protein, 9 aa, Homo Sapiens
QGCNKRTAR

SEQ ID NO: 1351927 - protein, 9 aa, Homo Sapiens
WVVNTCLHK

SEQ ID NO: 1351928 - protein, 9 aa, Homo Sapiens
TSPSWLLPA

SEQ ID NO: 1351929 - protein, 9 aa, Homo Sapiens
PYSSPFYIW

SEQ ID NO: 1351930 - protein, 9 aa, Homo Sapiens
KAVNAEFGG

SEQ ID NO: 1351931 - protein, 9 aa, Homo Sapiens
LGNVVTSLA

SEQ ID NO: 1351932 - protein, 9 aa, Homo Sapiens
SSVFLRGSR

SEQ ID NO: 1351933 - protein, 9 aa, Homo Sapiens
DSTQDTTSE

SEQ ID NO: 1351934 - protein, 9 aa, Homo Sapiens
SSACNVAAA

SEQ ID NO: 1351935 - protein, 9 aa, Homo Sapiens
DNLSSESSE

SEQ ID NO: 1351936 - protein, 9 aa, Homo Sapiens
FANGRFTGL

SEQ ID NO: 1351937 - protein, 9 aa, Homo Sapiens
ATMAGARAK

SEQ ID NO: 1351938 - protein, 9 aa, Homo Sapiens
QSEDGLTTP

SEQ ID NO: 1351939 - protein, 9 aa, Homo Sapiens
NVIDLMEPT

SEQ ID NO: 1351940 - protein, 9 aa, Homo Sapiens
AFLQHMDMK

SEQ ID NO: 1351941 - protein, 9 aa, Homo Sapiens
VPESTSMDT

SEQ ID NO: 1351942 - protein, 9 aa, Homo Sapiens
LLKPCCPCM

SEQ ID NO: 1351943 - protein, 9 aa, Homo Sapiens
LAHCPGMPL

SEQ ID NO: 1351944 - protein, 9 aa, Homo Sapiens
EAPVLDVRC

SEQ ID NO: 1351945 - protein, 9 aa, Homo Sapiens
DSGDNRKMV

SEQ ID NO: 1351946 - protein, 9 aa, Homo Sapiens
EKDTADAVH

SEQ ID NO: 1351947 - protein, 9 aa, Homo Sapiens
MSMGLEITC

SEQ ID NO: 1351948 - protein, 9 aa, Homo Sapiens
RTLVNDGKY

SEQ ID NO: 1351949 - protein, 9 aa, Homo Sapiens
SATEAWCRT

SEQ ID NO: 1351950 - protein, 9 aa, Homo Sapiens
GMSPPACAD

SEQ ID NO: 1351951 - protein, 9 aa, Homo Sapiens
MLTYSLTYR

SEQ ID NO: 1351952 - protein, 9 aa, Homo Sapiens
RLVHERDAY

SEQ ID NO: 1351953 - protein, 9 aa, Homo Sapiens
NGIHFDPEN

SEQ ID NO: 1351954 - protein, 9 aa, Homo Sapiens
DPGASVQGQ

SEQ ID NO: 1351955 - protein, 9 aa, Homo Sapiens
FWLWCSLLS

SEQ ID NO: 1351956 - protein, 9 aa, Homo Sapiens
EKCTKEPGG

SEQ ID NO: 1351957 - protein, 9 aa, Homo Sapiens
QVCRNKCIA

SEQ ID NO: 1351958 - protein, 9 aa, Homo Sapiens
FLLFHSRQY

SEQ ID NO: 1351959 - protein, 9 aa, Homo Sapiens
PYGPSSLGQ

SEQ ID NO: 1351960 - protein, 9 aa, Homo Sapiens
PMPLPVISP

SEQ ID NO: 1351961 - protein, 9 aa, Homo Sapiens
PQHLTWLTV

SEQ ID NO: 1351962 - protein, 9 aa, Homo Sapiens
MSWFLPTEG

SEQ ID NO: 1351963 - protein, 9 aa, Homo Sapiens
QYFAIVTAL

SEQ ID NO: 1351964 - protein, 9 aa, Homo Sapiens
AYNNQPTME

SEQ ID NO: 1351965 - protein, 9 aa, Homo Sapiens
TNADIDLKY

SEQ ID NO: 1351966 - protein, 9 aa, Homo Sapiens
VLNDIRNPV

SEQ ID NO: 1351967 - protein, 9 aa, Homo Sapiens
RSEFKRKHG

SEQ ID NO: 1351968 - protein, 9 aa, Homo Sapiens
ALWRGDVVK

SEQ ID NO: 1351969 - protein, 9 aa, Homo Sapiens
LFYECVLSR

SEQ ID NO: 1351970 - protein, 9 aa, Homo Sapiens
STILCLLFR

SEQ ID NO: 1351971 - protein, 9 aa, Homo Sapiens
PKEIEWMVS

SEQ ID NO: 1351972 - protein, 9 aa, Homo Sapiens
RDRRNNMKL

SEQ ID NO: 1351973 - protein, 9 aa, Homo Sapiens
ASKEGMEAS

SEQ ID NO: 1351974 - protein, 9 aa, Homo Sapiens
TMPRPGIKK

SEQ ID NO: 1351975 - protein, 9 aa, Homo Sapiens
EADQSAGHP

SEQ ID NO: 1351976 - protein, 9 aa, Homo Sapiens
SFTDVIFDE

SEQ ID NO: 1351977 - protein, 9 aa, Homo Sapiens
KDNLTMHMW

SEQ ID NO: 1351978 - protein, 9 aa, Homo Sapiens
SSFLIDKIT

SEQ ID NO: 1351979 - protein, 9 aa, Homo Sapiens
RTSLHTSSS

SEQ ID NO: 1351980 - protein, 9 aa, Homo Sapiens
VNWCANDTP

SEQ ID NO: 1351981 - protein, 9 aa, Homo Sapiens
LRQQAFLRS

SEQ ID NO: 1351982 - protein, 9 aa, Homo Sapiens
SHVIELKSG

SEQ ID NO: 1351983 - protein, 9 aa, Homo Sapiens
DWWEARSIT

SEQ ID NO: 1351984 - protein, 9 aa, Homo Sapiens
VSPKWKNYE

SEQ ID NO: 1351985 - protein, 9 aa, Homo Sapiens
ELDRNNVDL

SEQ ID NO: 1351986 - protein, 9 aa, Homo Sapiens
KSEPDISSE

SEQ ID NO: 1351987 - protein, 9 aa, Homo Sapiens
HLNRSLTSL

SEQ ID NO: 1351988 - protein, 9 aa, Homo Sapiens
ILSYLAGQV

SEQ ID NO: 1351989 - protein, 9 aa, Homo Sapiens
SMQPPEIPA

SEQ ID NO: 1351990 - protein, 9 aa, Homo Sapiens
QRAISLSPM

SEQ ID NO: 1351991 - protein, 9 aa, Homo Sapiens
RVSTEVDTR

SEQ ID NO: 1351992 - protein, 9 aa, Homo Sapiens
IPMLSPLIY

SEQ ID NO: 1351993 - protein, 9 aa, Homo Sapiens
AQMAKRQKV

SEQ ID NO: 1351994 - protein, 9 aa, Homo Sapiens
RKWRPGASR

SEQ ID NO: 1351995 - protein, 9 aa, Homo Sapiens
ENEEHLRQA

SEQ ID NO: 1351996 - protein, 9 aa, Homo Sapiens
FGRSVLGFM

SEQ ID NO: 1351997 - protein, 9 aa, Homo Sapiens
LQKNKLKEM

SEQ ID NO: 1351998 - protein, 9 aa, Homo Sapiens
LKRKQHRSR

SEQ ID NO: 1351999 - protein, 9 aa, Homo Sapiens
EKERCNQEA

SEQ ID NO: 1352000 - protein, 9 aa, Homo Sapiens
KRQTRESNS

SEQ ID NO: 1352001 - protein, 9 aa, Homo Sapiens
RIILTTQQR

SEQ ID NO: 1352002 - protein, 9 aa, Homo Sapiens
WRSGKAEFP

SEQ ID NO: 1352003 - protein, 9 aa, Homo Sapiens
VHAVDRDTS

SEQ ID NO: 1352004 - protein, 9 aa, Homo Sapiens
QSKVMYITS

SEQ ID NO: 1352005 - protein, 9 aa, Homo Sapiens
CLSNTPAHK

SEQ ID NO: 1352006 - protein, 9 aa, Homo Sapiens
TEVVFSEEA

SEQ ID NO: 1352007 - protein, 9 aa, Homo Sapiens
NPDEQVRQF

SEQ ID NO: 1352008 - protein, 9 aa, Homo Sapiens
GHIYLKNKM

SEQ ID NO: 1352009 - protein, 9 aa, Homo Sapiens
VKEFLSFLI

SEQ ID NO: 1352010 - protein, 9 aa, Homo Sapiens
IKENMLAKL

SEQ ID NO: 1352011 - protein, 9 aa, Homo Sapiens
ALTSPTPPY

SEQ ID NO: 1352012 - protein, 9 aa, Homo Sapiens
IIDSMLQML

SEQ ID NO: 1352013 - protein, 9 aa, Homo Sapiens
KECRMTFTQ

SEQ ID NO: 1352014 - protein, 9 aa, Homo Sapiens
INSVRFFAN

SEQ ID NO: 1352015 - protein, 9 aa, Homo Sapiens
KKSKSKCND

SEQ ID NO: 1352016 - protein, 9 aa, Homo Sapiens
SITVDGKTA

SEQ ID NO: 1352017 - protein, 9 aa, Homo Sapiens
SIIITEVRA

SEQ ID NO: 1352018 - protein, 9 aa, Homo Sapiens
IKSEDEQKL

SEQ ID NO: 1352019 - protein, 9 aa, Homo Sapiens
SPLGLCRIL

SEQ ID NO: 1352020 - protein, 9 aa, Homo Sapiens
QIKFMEKGE

SEQ ID NO: 1352021 - protein, 9 aa, Homo Sapiens
PTTRSWATP

SEQ ID NO: 1352022 - protein, 9 aa, Homo Sapiens
YEAIARAKH

SEQ ID NO: 1352023 - protein, 9 aa, Homo Sapiens
EALEMSCNR

SEQ ID NO: 1352024 - protein, 9 aa, Homo Sapiens
LCVTTKTHW

SEQ ID NO: 1352025 - protein, 9 aa, Homo Sapiens
HRKRKRKKK

SEQ ID NO: 1352026 - protein, 9 aa, Homo Sapiens
EEEDKGILN

SEQ ID NO: 1352027 - protein, 9 aa, Homo Sapiens
RKLGCHVRA

SEQ ID NO: 1352028 - protein, 9 aa, Homo Sapiens
PEVLDENLN

SEQ ID NO: 1352029 - protein, 9 aa, Homo Sapiens
PRGGRCAQT

SEQ ID NO: 1352030 - protein, 9 aa, Homo Sapiens
YSPRNIWVG

SEQ ID NO: 1352031 - protein, 9 aa, Homo Sapiens
FTGDYTPRV

SEQ ID NO: 1352032 - protein, 9 aa, Homo Sapiens
GNCRYAKKC

SEQ ID NO: 1352033 - protein, 9 aa, Homo Sapiens
NFLHPINTL

SEQ ID NO: 1352034 - protein, 9 aa, Homo Sapiens
ATCDTVVGD

SEQ ID NO: 1352035 - protein, 9 aa, Homo Sapiens
MNAARPSPG

SEQ ID NO: 1352036 - protein, 9 aa, Homo Sapiens
GETCHPQDG

SEQ ID NO: 1352037 - protein, 9 aa, Homo Sapiens
KKTRSRTNL

SEQ ID NO: 1352038 - protein, 9 aa, Homo Sapiens
GSVTTSATE

SEQ ID NO: 1352039 - protein, 9 aa, Homo Sapiens
HLNTIVQID

SEQ ID NO: 1352040 - protein, 9 aa, Homo Sapiens
YKQHSSLEE

SEQ ID NO: 1352041 - protein, 9 aa, Homo Sapiens
LFVTEVSHL

SEQ ID NO: 1352042 - protein, 9 aa, Homo Sapiens
PYRGTRYPD

SEQ ID NO: 1352043 - protein, 9 aa, Homo Sapiens
LGGGEDSTT

SEQ ID NO: 1352044 - protein, 9 aa, Homo Sapiens
HDLRFISSR

SEQ ID NO: 1352045 - protein, 9 aa, Homo Sapiens
LPLEKVIHI

SEQ ID NO: 1352046 - protein, 9 aa, Homo Sapiens
GVATGVVGP

SEQ ID NO: 1352047 - protein, 9 aa, Homo Sapiens
GLPVRLQWM

SEQ ID NO: 1352048 - protein, 9 aa, Homo Sapiens
SQNPNLNAN

SEQ ID NO: 1352049 - protein, 9 aa, Homo Sapiens
KMPFVVEIA

SEQ ID NO: 1352050 - protein, 9 aa, Homo Sapiens
DCVQGKTPP

SEQ ID NO: 1352051 - protein, 9 aa, Homo Sapiens
SYQRRGKSQ

SEQ ID NO: 1352052 - protein, 9 aa, Homo Sapiens
IEYAACDTT

SEQ ID NO: 1352053 - protein, 9 aa, Homo Sapiens
DTLLKEESS

SEQ ID NO: 1352054 - protein, 9 aa, Homo Sapiens
SEITSLSSE

SEQ ID NO: 1352055 - protein, 9 aa, Homo Sapiens
EHLLLYLYC

SEQ ID NO: 1352056 - protein, 9 aa, Homo Sapiens
SLCRLNLSS

SEQ ID NO: 1352057 - protein, 9 aa, Homo Sapiens
CRCVAAHES

SEQ ID NO: 1352058 - protein, 9 aa, Homo Sapiens
VGKFLRVHG

SEQ ID NO: 1352059 - protein, 9 aa, Homo Sapiens
QADMMDVDM

SEQ ID NO: 1352060 - protein, 9 aa, Homo Sapiens
AISGDCPLQ

SEQ ID NO: 1352061 - protein, 9 aa, Homo Sapiens
IHYPALDDH

SEQ ID NO: 1352062 - protein, 9 aa, Homo Sapiens
SPNDSPYQG

SEQ ID NO: 1352063 - protein, 9 aa, Homo Sapiens
EEPLISAFA

SEQ ID NO: 1352064 - protein, 9 aa, Homo Sapiens
HQIHANHET

SEQ ID NO: 1352065 - protein, 9 aa, Homo Sapiens
LVATATLTA

SEQ ID NO: 1352066 - protein, 9 aa, Homo Sapiens
CDAIAEIRA

SEQ ID NO: 1352067 - protein, 9 aa, Homo Sapiens
GHQHNASDL

SEQ ID NO: 1352068 - protein, 9 aa, Homo Sapiens
PGTVTTLTD

SEQ ID NO: 1352069 - protein, 9 aa, Homo Sapiens
FCYSTHLFF

SEQ ID NO: 1352070 - protein, 9 aa, Homo Sapiens
AMGQHMFED

SEQ ID NO: 1352071 - protein, 9 aa, Homo Sapiens
AKKQRKPKR

SEQ ID NO: 1352072 - protein, 9 aa, Homo Sapiens
KWGEENTDY

SEQ ID NO: 1352073 - protein, 9 aa, Homo Sapiens
WMCYNLQSA

SEQ ID NO: 1352074 - protein, 9 aa, Homo Sapiens
TMEIKGMVT

SEQ ID NO: 1352075 - protein, 9 aa, Homo Sapiens
EDEISKLCK

SEQ ID NO: 1352076 - protein, 9 aa, Homo Sapiens
PVSPSRECS

SEQ ID NO: 1352077 - protein, 9 aa, Homo Sapiens
SSVNWMRYV

SEQ ID NO: 1352078 - protein, 9 aa, Homo Sapiens
RISHGFSMC

SEQ ID NO: 1352079 - protein, 9 aa, Homo Sapiens
ESEYCKCKA

SEQ ID NO: 1352080 - protein, 9 aa, Homo Sapiens
RLEAESVPM

SEQ ID NO: 1352081 - protein, 9 aa, Homo Sapiens
ETVKRIQIN

SEQ ID NO: 1352082 - protein, 9 aa, Homo Sapiens
MAASSAHAK

SEQ ID NO: 1352083 - protein, 9 aa, Homo Sapiens
RHYEELHAR

SEQ ID NO: 1352084 - protein, 9 aa, Homo Sapiens
TVTFIRSIG

SEQ ID NO: 1352085 - protein, 9 aa, Homo Sapiens
LYVQGVALA

SEQ ID NO: 1352086 - protein, 9 aa, Homo Sapiens
EVIHLAQDA

SEQ ID NO: 1352087 - protein, 9 aa, Homo Sapiens
SQSLYTGLV

SEQ ID NO: 1352088 - protein, 9 aa, Homo Sapiens
WCLLMVTFS

SEQ ID NO: 1352089 - protein, 9 aa, Homo Sapiens
TCCRFSPTR

SEQ ID NO: 1352090 - protein, 9 aa, Homo Sapiens
NVASEKQRW

SEQ ID NO: 1352091 - protein, 9 aa, Homo Sapiens
WALADTQVA

SEQ ID NO: 1352092 - protein, 9 aa, Homo Sapiens
CRLKIHLQS

SEQ ID NO: 1352093 - protein, 9 aa, Homo Sapiens
NTKYPGSYL

SEQ ID NO: 1352094 - protein, 9 aa, Homo Sapiens
RGRAVKKKA

SEQ ID NO: 1352095 - protein, 9 aa, Homo Sapiens
SDTLVDANS

SEQ ID NO: 1352096 - protein, 9 aa, Homo Sapiens
RSPTGAASA

SEQ ID NO: 1352097 - protein, 9 aa, Homo Sapiens
MGAVAHACN

SEQ ID NO: 1352098 - protein, 9 aa, Homo Sapiens
PAGSFQAWL

SEQ ID NO: 1352099 - protein, 9 aa, Homo Sapiens
LHKYIMTRI

SEQ ID NO: 1352100 - protein, 9 aa, Homo Sapiens
TLRNHRSSP

SEQ ID NO: 1352101 - protein, 9 aa, Homo Sapiens
EVRGEWRQG

SEQ ID NO: 1352102 - protein, 9 aa, Homo Sapiens
DRHHQKTHH

SEQ ID NO: 1352103 - protein, 9 aa, Homo Sapiens
EAFEEDTGC

SEQ ID NO: 1352104 - protein, 9 aa, Homo Sapiens
DFPCNCWVS

SEQ ID NO: 1352105 - protein, 9 aa, Homo Sapiens
PVRLARNVV

SEQ ID NO: 1352106 - protein, 9 aa, Homo Sapiens
WNRIMKDTL

SEQ ID NO: 1352107 - protein, 9 aa, Homo Sapiens
DTIDNLPVN

SEQ ID NO: 1352108 - protein, 9 aa, Homo Sapiens
TTTVRRRKC

SEQ ID NO: 1352109 - protein, 9 aa, Homo Sapiens
LAGILICIM

SEQ ID NO: 1352110 - protein, 9 aa, Homo Sapiens
AVSYHTSGH

SEQ ID NO: 1352111 - protein, 9 aa, Homo Sapiens
NRSLALAMS

SEQ ID NO: 1352112 - protein, 9 aa, Homo Sapiens
VQGNTEVIH

SEQ ID NO: 1352113 - protein, 9 aa, Homo Sapiens
LCYFDPLRN

SEQ ID NO: 1352114 - protein, 9 aa, Homo Sapiens
LVLPDEVIS

SEQ ID NO: 1352115 - protein, 9 aa, Homo Sapiens
NNVLSYYKS

SEQ ID NO: 1352116 - protein, 9 aa, Homo Sapiens
YGTCVLLGR

SEQ ID NO: 1352117 - protein, 9 aa, Homo Sapiens
HITFGPVVD

SEQ ID NO: 1352118 - protein, 9 aa, Homo Sapiens
GLYYDNRIH

SEQ ID NO: 1352119 - protein, 9 aa, Homo Sapiens
FENWEVDVT

SEQ ID NO: 1352120 - protein, 9 aa, Homo Sapiens
NAVLHENRN

SEQ ID NO: 1352121 - protein, 9 aa, Homo Sapiens
VWRPGCFLC

SEQ ID NO: 1352122 - protein, 9 aa, Homo Sapiens
MDLLRDPRA

SEQ ID NO: 1352123 - protein, 9 aa, Homo Sapiens
YGECGKAFT

SEQ ID NO: 1352124 - protein, 9 aa, Homo Sapiens
VPMELVQWG

SEQ ID NO: 1352125 - protein, 9 aa, Homo Sapiens
GAVIMAVWR

SEQ ID NO: 1352126 - protein, 9 aa, Homo Sapiens
NLEYHRTES

SEQ ID NO: 1352127 - protein, 9 aa, Homo Sapiens
HMTSPFISL

SEQ ID NO: 1352128 - protein, 9 aa, Homo Sapiens
IKVTIKKIM

SEQ ID NO: 1352129 - protein, 9 aa, Homo Sapiens
PCYQPACCV

SEQ ID NO: 1352130 - protein, 9 aa, Homo Sapiens
HRTLRLQRF

SEQ ID NO: 1352131 - protein, 9 aa, Homo Sapiens
IFDCLEGRP

SEQ ID NO: 1352132 - protein, 9 aa, Homo Sapiens
QWQLIVKEY

SEQ ID NO: 1352133 - protein, 9 aa, Homo Sapiens
VIIRDLQTT

SEQ ID NO: 1352134 - protein, 9 aa, Homo Sapiens
YLMTFLREL

SEQ ID NO: 1352135 - protein, 9 aa, Homo Sapiens
ALLAHVLVK

SEQ ID NO: 1352136 - protein, 9 aa, Homo Sapiens
HEERALLAE

SEQ ID NO: 1352137 - protein, 9 aa, Homo Sapiens
IDLLPGLRK

SEQ ID NO: 1352138 - protein, 9 aa, Homo Sapiens
RLIVVLALF

SEQ ID NO: 1352139 - protein, 9 aa, Homo Sapiens
NPEHFWMPI

SEQ ID NO: 1352140 - protein, 9 aa, Homo Sapiens
SVTTSATEA

SEQ ID NO: 1352141 - protein, 9 aa, Homo Sapiens
VLTSQSLFT

SEQ ID NO: 1352142 - protein, 9 aa, Homo Sapiens
FVWPISSWT

SEQ ID NO: 1352143 - protein, 9 aa, Homo Sapiens
SSSLGQQST

SEQ ID NO: 1352144 - protein, 9 aa, Homo Sapiens
CGIIEFHVI

SEQ ID NO: 1352145 - protein, 9 aa, Homo Sapiens
RDYISMAVV

SEQ ID NO: 1352146 - protein, 9 aa, Homo Sapiens
GAEWNSPLS

SEQ ID NO: 1352147 - protein, 9 aa, Homo Sapiens
AKKCSLTLR

SEQ ID NO: 1352148 - protein, 9 aa, Homo Sapiens
DLHTSVRKC

SEQ ID NO: 1352149 - protein, 9 aa, Homo Sapiens
VLSPEDLEV

SEQ ID NO: 1352150 - protein, 9 aa, Homo Sapiens
PKEMPTPQR

SEQ ID NO: 1352151 - protein, 9 aa, Homo Sapiens
SIQMPTIIG

SEQ ID NO: 1352152 - protein, 9 aa, Homo Sapiens
VPVKEDTQL

SEQ ID NO: 1352153 - protein, 9 aa, Homo Sapiens
MKKGSNDYG

SEQ ID NO: 1352154 - protein, 9 aa, Homo Sapiens
SWATPRRSP

SEQ ID NO: 1352155 - protein, 9 aa, Homo Sapiens
VLQLLGRNT

SEQ ID NO: 1352156 - protein, 9 aa, Homo Sapiens
KAAAEEAST

SEQ ID NO: 1352157 - protein, 9 aa, Homo Sapiens
VKDIRQSYA

SEQ ID NO: 1352158 - protein, 9 aa, Homo Sapiens
QKVGTFQQM

SEQ ID NO: 1352159 - protein, 9 aa, Homo Sapiens
PRFTLPVPS

SEQ ID NO: 1352160 - protein, 9 aa, Homo Sapiens
VCSTARLAR

SEQ ID NO: 1352161 - protein, 9 aa, Homo Sapiens
GLLRQLGKG

SEQ ID NO: 1352162 - protein, 9 aa, Homo Sapiens
FRPPEPHFT

SEQ ID NO: 1352163 - protein, 9 aa, Homo Sapiens
SVRFHIAWS

SEQ ID NO: 1352164 - protein, 9 aa, Homo Sapiens
TTTQHYSDA

SEQ ID NO: 1352165 - protein, 9 aa, Homo Sapiens
DISGITSCV

SEQ ID NO: 1352166 - protein, 9 aa, Homo Sapiens
IHVDLHLLN

SEQ ID NO: 1352167 - protein, 9 aa, Homo Sapiens
FAISENSLI

SEQ ID NO: 1352168 - protein, 9 aa, Homo Sapiens
NSPLSFSLA

SEQ ID NO: 1352169 - protein, 9 aa, Homo Sapiens
LSPEDLEVI

SEQ ID NO: 1352170 - protein, 9 aa, Homo Sapiens
WNKVKRVAK

SEQ ID NO: 1352171 - protein, 9 aa, Homo Sapiens
VLSKTKETG

SEQ ID NO: 1352172 - protein, 9 aa, Homo Sapiens
QLREAKGNQ

SEQ ID NO: 1352173 - protein, 9 aa, Homo Sapiens
WEALHVAEC

SEQ ID NO: 1352174 - protein, 9 aa, Homo Sapiens
RSSTPSMCY

SEQ ID NO: 1352175 - protein, 9 aa, Homo Sapiens
DGTVTTYWK

SEQ ID NO: 1352176 - protein, 9 aa, Homo Sapiens
DGPHTLNPD

SEQ ID NO: 1352177 - protein, 9 aa, Homo Sapiens
DQESCWKQY

SEQ ID NO: 1352178 - protein, 9 aa, Homo Sapiens
YACRQDDME

SEQ ID NO: 1352179 - protein, 9 aa, Homo Sapiens
QRPDDRFCG

SEQ ID NO: 1352180 - protein, 9 aa, Homo Sapiens
ANILMALQM

SEQ ID NO: 1352181 - protein, 9 aa, Homo Sapiens
KWMKTEGDA

SEQ ID NO: 1352182 - protein, 9 aa, Homo Sapiens
ESDHKVVGL

SEQ ID NO: 1352183 - protein, 9 aa, Homo Sapiens
TYRSNFVLY

SEQ ID NO: 1352184 - protein, 9 aa, Homo Sapiens
SLVFYSILV

SEQ ID NO: 1352185 - protein, 9 aa, Homo Sapiens
PGSVPVPGT

SEQ ID NO: 1352186 - protein, 9 aa, Homo Sapiens
KEHKNRMKK

SEQ ID NO: 1352187 - protein, 9 aa, Homo Sapiens
LSRKDISVK

SEQ ID NO: 1352188 - protein, 9 aa, Homo Sapiens
NGDKAAAEE

SEQ ID NO: 1352189 - protein, 9 aa, Homo Sapiens
PRLLLPHQR

SEQ ID NO: 1352190 - protein, 9 aa, Homo Sapiens
VPIFHDFSL

SEQ ID NO: 1352191 - protein, 9 aa, Homo Sapiens
CMPFYAEEC

SEQ ID NO: 1352192 - protein, 9 aa, Homo Sapiens
NLCAIHAKC

SEQ ID NO: 1352193 - protein, 9 aa, Homo Sapiens
RPKKNNSHM

SEQ ID NO: 1352194 - protein, 9 aa, Homo Sapiens
IKGLEASSV

SEQ ID NO: 1352195 - protein, 9 aa, Homo Sapiens
LQKQDKDNT

SEQ ID NO: 1352196 - protein, 9 aa, Homo Sapiens
LLSMTPISW

SEQ ID NO: 1352197 - protein, 9 aa, Homo Sapiens
NYDCDSGYT

SEQ ID NO: 1352198 - protein, 9 aa, Homo Sapiens
MKSRRGPHA

SEQ ID NO: 1352199 - protein, 9 aa, Homo Sapiens
QKIYKGPLD

SEQ ID NO: 1352200 - protein, 9 aa, Homo Sapiens
STVHNADVI

SEQ ID NO: 1352201 - protein, 9 aa, Homo Sapiens
APVTYLRFL

SEQ ID NO: 1352202 - protein, 9 aa, Homo Sapiens
GQTGVMICA

SEQ ID NO: 1352203 - protein, 9 aa, Homo Sapiens
GHPGYTAVD

SEQ ID NO: 1352204 - protein, 9 aa, Homo Sapiens
CPRTASPHF

SEQ ID NO: 1352205 - protein, 9 aa, Homo Sapiens
LLFTIYSIL

SEQ ID NO: 1352206 - protein, 9 aa, Homo Sapiens
QAVWPVWQP

SEQ ID NO: 1352207 - protein, 9 aa, Homo Sapiens
VPPQSRLSR

SEQ ID NO: 1352208 - protein, 9 aa, Homo Sapiens
MHQSKGLEE

SEQ ID NO: 1352209 - protein, 9 aa, Homo Sapiens
DIYRRNLDI

SEQ ID NO: 1352210 - protein, 9 aa, Homo Sapiens
SSHMCMPLS

SEQ ID NO: 1352211 - protein, 9 aa, Homo Sapiens
ILNWKRQHQ

SEQ ID NO: 1352212 - protein, 9 aa, Homo Sapiens
SSVPRLLLP

SEQ ID NO: 1352213 - protein, 9 aa, Homo Sapiens
QNSSSGITS

SEQ ID NO: 1352214 - protein, 9 aa, Homo Sapiens
SQDFVESVM

SEQ ID NO: 1352215 - protein, 9 aa, Homo Sapiens
QKVNTIWAH

SEQ ID NO: 1352216 - protein, 9 aa, Homo Sapiens
AVSRPHSSP

SEQ ID NO: 1352217 - protein, 9 aa, Homo Sapiens
SAIDMMELY

SEQ ID NO: 1352218 - protein, 9 aa, Homo Sapiens
KWKFLTGLE

SEQ ID NO: 1352219 - protein, 9 aa, Homo Sapiens
KTYADARVL

SEQ ID NO: 1352220 - protein, 9 aa, Homo Sapiens
LRSGLKQCY

SEQ ID NO: 1352221 - protein, 9 aa, Homo Sapiens
RQAPGHIST

SEQ ID NO: 1352222 - protein, 9 aa, Homo Sapiens
FLTPLHNFL

SEQ ID NO: 1352223 - protein, 9 aa, Homo Sapiens
VSRLCLLPT

SEQ ID NO: 1352224 - protein, 9 aa, Homo Sapiens
AWCRTTLPA

SEQ ID NO: 1352225 - protein, 9 aa, Homo Sapiens
SAAARCSAC

SEQ ID NO: 1352226 - protein, 9 aa, Homo Sapiens
EKEERMWAD

SEQ ID NO: 1352227 - protein, 9 aa, Homo Sapiens
PCDDIKNIY

SEQ ID NO: 1352228 - protein, 9 aa, Homo Sapiens
RSLEMDSSL

SEQ ID NO: 1352229 - protein, 9 aa, Homo Sapiens
TAATGECHD

SEQ ID NO: 1352230 - protein, 9 aa, Homo Sapiens
PNQGYLSEV

SEQ ID NO: 1352231 - protein, 9 aa, Homo Sapiens
CTRTVRTRL

SEQ ID NO: 1352232 - protein, 9 aa, Homo Sapiens
EKQCNNGIL

SEQ ID NO: 1352233 - protein, 9 aa, Homo Sapiens
LPAGPSALP

SEQ ID NO: 1352234 - protein, 9 aa, Homo Sapiens
SPLNVIDLM

SEQ ID NO: 1352235 - protein, 9 aa, Homo Sapiens
DAKRIKNQR

SEQ ID NO: 1352236 - protein, 9 aa, Homo Sapiens
LLLLPSLPG

SEQ ID NO: 1352237 - protein, 9 aa, Homo Sapiens
APYPSTCSL

SEQ ID NO: 1352238 - protein, 9 aa, Homo Sapiens
GLFFHLPIF

SEQ ID NO: 1352239 - protein, 9 aa, Homo Sapiens
QRRDNMFYY

SEQ ID NO: 1352240 - protein, 9 aa, Homo Sapiens
WETASAIDM

SEQ ID NO: 1352241 - protein, 9 aa, Homo Sapiens
LPYQFANSQ

SEQ ID NO: 1352242 - protein, 9 aa, Homo Sapiens
QVRQFLILK

SEQ ID NO: 1352243 - protein, 9 aa, Homo Sapiens
SIITICREE

SEQ ID NO: 1352244 - protein, 9 aa, Homo Sapiens
GPSIDLWGA

SEQ ID NO: 1352245 - protein, 9 aa, Homo Sapiens
PITGAVIIS

SEQ ID NO: 1352246 - protein, 9 aa, Homo Sapiens
RIKMLEYVL

SEQ ID NO: 1352247 - protein, 9 aa, Homo Sapiens
LDHFFITPR

SEQ ID NO: 1352248 - protein, 9 aa, Homo Sapiens
IIEQEVCDL

SEQ ID NO: 1352249 - protein, 9 aa, Homo Sapiens
SGEGIAVSH

SEQ ID NO: 1352250 - protein, 9 aa, Homo Sapiens
GATELYRIG

SEQ ID NO: 1352251 - protein, 9 aa, Homo Sapiens
ADMWPHSDP

SEQ ID NO: 1352252 - protein, 9 aa, Homo Sapiens
LGEGCPPVL

SEQ ID NO: 1352253 - protein, 9 aa, Homo Sapiens
PLSMTCCRF

SEQ ID NO: 1352254 - protein, 9 aa, Homo Sapiens
SGKADETTA

SEQ ID NO: 1352255 - protein, 9 aa, Homo Sapiens
NIWLKQEWI

SEQ ID NO: 1352256 - protein, 9 aa, Homo Sapiens
GWKEIKYEV

SEQ ID NO: 1352257 - protein, 9 aa, Homo Sapiens
KKRRKLGMQ

SEQ ID NO: 1352258 - protein, 9 aa, Homo Sapiens
LLPGMGPHV

SEQ ID NO: 1352259 - protein, 9 aa, Homo Sapiens
TSAALLSSG

SEQ ID NO: 1352260 - protein, 9 aa, Homo Sapiens
VSAFVMGLS

SEQ ID NO: 1352261 - protein, 9 aa, Homo Sapiens
RNHRSSPYP

SEQ ID NO: 1352262 - protein, 9 aa, Homo Sapiens
CIDDGDKTK

SEQ ID NO: 1352263 - protein, 9 aa, Homo Sapiens
TLHNRSTED

SEQ ID NO: 1352264 - protein, 9 aa, Homo Sapiens
QHFGPVFTL

SEQ ID NO: 1352265 - protein, 9 aa, Homo Sapiens
TFISFHRRE

SEQ ID NO: 1352266 - protein, 9 aa, Homo Sapiens
SKSVLSAIV

SEQ ID NO: 1352267 - protein, 9 aa, Homo Sapiens
GFHTEEDIS

SEQ ID NO: 1352268 - protein, 9 aa, Homo Sapiens
ECDVSAVRD

SEQ ID NO: 1352269 - protein, 9 aa, Homo Sapiens
LIFRKVAAG

SEQ ID NO: 1352270 - protein, 9 aa, Homo Sapiens
GLCAPTPQM

SEQ ID NO: 1352271 - protein, 9 aa, Homo Sapiens
LKHRSIKKL

SEQ ID NO: 1352272 - protein, 9 aa, Homo Sapiens
CKKSLHLSV

SEQ ID NO: 1352273 - protein, 9 aa, Homo Sapiens
KHGNLLFLF

SEQ ID NO: 1352274 - protein, 9 aa, Homo Sapiens
EQQSAHTRL

SEQ ID NO: 1352275 - protein, 9 aa, Homo Sapiens
LWDTKIVID

SEQ ID NO: 1352276 - protein, 9 aa, Homo Sapiens
GPPHPHPHP

SEQ ID NO: 1352277 - protein, 9 aa, Homo Sapiens
VYRTGVKCV

SEQ ID NO: 1352278 - protein, 9 aa, Homo Sapiens
SDTSGHFRK

SEQ ID NO: 1352279 - protein, 9 aa, Homo Sapiens
QVVKKVETE

SEQ ID NO: 1352280 - protein, 9 aa, Homo Sapiens
FGPQPRHHF

SEQ ID NO: 1352281 - protein, 9 aa, Homo Sapiens
GTSKGCTFV

SEQ ID NO: 1352282 - protein, 9 aa, Homo Sapiens
VITVEDFEM

SEQ ID NO: 1352283 - protein, 9 aa, Homo Sapiens
PFNNITVVY

SEQ ID NO: 1352284 - protein, 9 aa, Homo Sapiens
PKGKQLTTA

SEQ ID NO: 1352285 - protein, 9 aa, Homo Sapiens
LVLKYHEDI

SEQ ID NO: 1352286 - protein, 9 aa, Homo Sapiens
AMRCLGLAG

SEQ ID NO: 1352287 - protein, 9 aa, Homo Sapiens
LLQVYYDTI

SEQ ID NO: 1352288 - protein, 9 aa, Homo Sapiens
LGAQVFAFL

SEQ ID NO: 1352289 - protein, 9 aa, Homo Sapiens
DTQQVQVQQ

SEQ ID NO: 1352290 - protein, 9 aa, Homo Sapiens
RPGLNKSQL

SEQ ID NO: 1352291 - protein, 9 aa, Homo Sapiens
TRHYLNELK

SEQ ID NO: 1352292 - protein, 9 aa, Homo Sapiens
TCSPCSPTT

SEQ ID NO: 1352293 - protein, 9 aa, Homo Sapiens
DCMMDSSQI

SEQ ID NO: 1352294 - protein, 9 aa, Homo Sapiens
ITSCVFTRH

SEQ ID NO: 1352295 - protein, 9 aa, Homo Sapiens
IDEREYHAD

SEQ ID NO: 1352296 - protein, 9 aa, Homo Sapiens
ASLMSPGRH

SEQ ID NO: 1352297 - protein, 9 aa, Homo Sapiens
VRLELGHRT

SEQ ID NO: 1352298 - protein, 9 aa, Homo Sapiens
VSLVDTLLF

SEQ ID NO: 1352299 - protein, 9 aa, Homo Sapiens
GWWFDVCLS

SEQ ID NO: 1352300 - protein, 9 aa, Homo Sapiens
QLEKSPFKW

SEQ ID NO: 1352301 - protein, 9 aa, Homo Sapiens
SHYYGSEVT

SEQ ID NO: 1352302 - protein, 9 aa, Homo Sapiens
AYGRLWRPT

SEQ ID NO: 1352303 - protein, 9 aa, Homo Sapiens
IRSCMVLRA

SEQ ID NO: 1352304 - protein, 9 aa, Homo Sapiens
NIDSEFSNA

SEQ ID NO: 1352305 - protein, 9 aa, Homo Sapiens
PGSEAPALP

SEQ ID NO: 1352306 - protein, 9 aa, Homo Sapiens
LSANARHLI

SEQ ID NO: 1352307 - protein, 9 aa, Homo Sapiens
LEDYFSEVS

SEQ ID NO: 1352308 - protein, 9 aa, Homo Sapiens
HELGYNMYA

SEQ ID NO: 1352309 - protein, 9 aa, Homo Sapiens
DYIQIDATI

SEQ ID NO: 1352310 - protein, 9 aa, Homo Sapiens
WDCFNLFTK

SEQ ID NO: 1352311 - protein, 9 aa, Homo Sapiens
RLMLKQEGD

SEQ ID NO: 1352312 - protein, 9 aa, Homo Sapiens
TVELYQGHV

SEQ ID NO: 1352313 - protein, 9 aa, Homo Sapiens
RAISMHNAA

SEQ ID NO: 1352314 - protein, 9 aa, Homo Sapiens
SLRKCLHQE

SEQ ID NO: 1352315 - protein, 9 aa, Homo Sapiens
RKKWCPYTK

SEQ ID NO: 1352316 - protein, 9 aa, Homo Sapiens
LPSHITPTT

SEQ ID NO: 1352317 - protein, 9 aa, Homo Sapiens
TKLFPSIEE

SEQ ID NO: 1352318 - protein, 9 aa, Homo Sapiens
FLYCYPPDP

SEQ ID NO: 1352319 - protein, 9 aa, Homo Sapiens
GYAYRHIFQ

SEQ ID NO: 1352320 - protein, 9 aa, Homo Sapiens
LNNRLASYL

SEQ ID NO: 1352321 - protein, 9 aa, Homo Sapiens
SSVEAYNIH

SEQ ID NO: 1352322 - protein, 9 aa, Homo Sapiens
PHPFTCSVE

SEQ ID NO: 1352323 - protein, 9 aa, Homo Sapiens
VPQKPHQVA

SEQ ID NO: 1352324 - protein, 9 aa, Homo Sapiens
HTLQGLEIE

SEQ ID NO: 1352325 - protein, 9 aa, Homo Sapiens
LTQKWFPEL

SEQ ID NO: 1352326 - protein, 9 aa, Homo Sapiens
DRTCTEAED

SEQ ID NO: 1352327 - protein, 9 aa, Homo Sapiens
NEIYGNKLP

SEQ ID NO: 1352328 - protein, 9 aa, Homo Sapiens
GRGFSHDDT

SEQ ID NO: 1352329 - protein, 9 aa, Homo Sapiens
KYFEVQSVL

SEQ ID NO: 1352330 - protein, 9 aa, Homo Sapiens
AYGFLITRH

SEQ ID NO: 1352331 - protein, 9 aa, Homo Sapiens
SYHTSGHSV

SEQ ID NO: 1352332 - protein, 9 aa, Homo Sapiens
SDNTETKDH

SEQ ID NO: 1352333 - protein, 9 aa, Homo Sapiens
SIFTKDLDR

SEQ ID NO: 1352334 - protein, 9 aa, Homo Sapiens
SKWEAWNLK

SEQ ID NO: 1352335 - protein, 9 aa, Homo Sapiens
DHEERPTQR

SEQ ID NO: 1352336 - protein, 9 aa, Homo Sapiens
LQEDPWCVA

SEQ ID NO: 1352337 - protein, 9 aa, Homo Sapiens
AVPPWKSSA

SEQ ID NO: 1352338 - protein, 9 aa, Homo Sapiens
FTTGMTAVK

SEQ ID NO: 1352339 - protein, 9 aa, Homo Sapiens
FAPVTYLRF

SEQ ID NO: 1352340 - protein, 9 aa, Homo Sapiens
PNGIIIIKD

SEQ ID NO: 1352341 - protein, 9 aa, Homo Sapiens
CPLDHESYE

SEQ ID NO: 1352342 - protein, 9 aa, Homo Sapiens
AFPTPCPLP

SEQ ID NO: 1352343 - protein, 9 aa, Homo Sapiens
LHNETYSAL

SEQ ID NO: 1352344 - protein, 9 aa, Homo Sapiens
ILHFPLSML

SEQ ID NO: 1352345 - protein, 9 aa, Homo Sapiens
VELFLRRLH

SEQ ID NO: 1352346 - protein, 9 aa, Homo Sapiens
SDNKDLEVE

SEQ ID NO: 1352347 - protein, 9 aa, Homo Sapiens
ASVACQNEP

SEQ ID NO: 1352348 - protein, 9 aa, Homo Sapiens
TCLAACWVQ

SEQ ID NO: 1352349 - protein, 9 aa, Homo Sapiens
PRGSSGVPP

SEQ ID NO: 1352350 - protein, 9 aa, Homo Sapiens
KCSTPSTDV

SEQ ID NO: 1352351 - protein, 9 aa, Homo Sapiens
TPELCPGVT

SEQ ID NO: 1352352 - protein, 9 aa, Homo Sapiens
NIHTRDNKV

SEQ ID NO: 1352353 - protein, 9 aa, Homo Sapiens
EKGRKVLWL

SEQ ID NO: 1352354 - protein, 9 aa, Homo Sapiens
VPMLQDFPC

SEQ ID NO: 1352355 - protein, 9 aa, Homo Sapiens
VPIEPYSIP

SEQ ID NO: 1352356 - protein, 9 aa, Homo Sapiens
NTQPVGNWS

SEQ ID NO: 1352357 - protein, 9 aa, Homo Sapiens
HVHQGVRGF

SEQ ID NO: 1352358 - protein, 9 aa, Homo Sapiens
VKKAKRSKP

SEQ ID NO: 1352359 - protein, 9 aa, Homo Sapiens
EPFLLFFPS

SEQ ID NO: 1352360 - protein, 9 aa, Homo Sapiens
LLWGENDTF

SEQ ID NO: 1352361 - protein, 9 aa, Homo Sapiens
GPFGGPNYH

SEQ ID NO: 1352362 - protein, 9 aa, Homo Sapiens
HFSILHAFL

SEQ ID NO: 1352363 - protein, 9 aa, Homo Sapiens
LTSSGHHEQ

SEQ ID NO: 1352364 - protein, 9 aa, Homo Sapiens
PLHFWVNVI

SEQ ID NO: 1352365 - protein, 9 aa, Homo Sapiens
KIRPQFLLP

SEQ ID NO: 1352366 - protein, 9 aa, Homo Sapiens
QMVHREFQL

SEQ ID NO: 1352367 - protein, 9 aa, Homo Sapiens
AMTEKWTHS

SEQ ID NO: 1352368 - protein, 9 aa, Homo Sapiens
GSPGSSPTV

SEQ ID NO: 1352369 - protein, 9 aa, Homo Sapiens
ALPDVAPVT

SEQ ID NO: 1352370 - protein, 9 aa, Homo Sapiens
CIGMYVLHL

SEQ ID NO: 1352371 - protein, 9 aa, Homo Sapiens
FQVSKLGPK

SEQ ID NO: 1352372 - protein, 9 aa, Homo Sapiens
SCRKVMEAF

SEQ ID NO: 1352373 - protein, 9 aa, Homo Sapiens
YLFFCFGIS

SEQ ID NO: 1352374 - protein, 9 aa, Homo Sapiens
CRQIYGQNF

SEQ ID NO: 1352375 - protein, 9 aa, Homo Sapiens
LDALLQTAQ

SEQ ID NO: 1352376 - protein, 9 aa, Homo Sapiens
YLLEDEPHD

SEQ ID NO: 1352377 - protein, 9 aa, Homo Sapiens
GVVGPGGLL

SEQ ID NO: 1352378 - protein, 9 aa, Homo Sapiens
ECDTMADML

SEQ ID NO: 1352379 - protein, 9 aa, Homo Sapiens
GFALGVGTA

SEQ ID NO: 1352380 - protein, 9 aa, Homo Sapiens
GVCSKDSDC

SEQ ID NO: 1352381 - protein, 9 aa, Homo Sapiens
AGSCESLPS

SEQ ID NO: 1352382 - protein, 9 aa, Homo Sapiens
RFSLPIILM

SEQ ID NO: 1352383 - protein, 9 aa, Homo Sapiens
DVNRRIERL

SEQ ID NO: 1352384 - protein, 9 aa, Homo Sapiens
GDSGRAERA

SEQ ID NO: 1352385 - protein, 9 aa, Homo Sapiens
PQAMQRCCD

SEQ ID NO: 1352386 - protein, 9 aa, Homo Sapiens
QLWGPMDVQ

SEQ ID NO: 1352387 - protein, 9 aa, Homo Sapiens
ESIPAKSSV

SEQ ID NO: 1352388 - protein, 9 aa, Homo Sapiens
IIEKLYINC

SEQ ID NO: 1352389 - protein, 9 aa, Homo Sapiens
GNTFYRSSH

SEQ ID NO: 1352390 - protein, 9 aa, Homo Sapiens
HIVYAMAAD

SEQ ID NO: 1352391 - protein, 9 aa, Homo Sapiens
VPGEVDNMD

SEQ ID NO: 1352392 - protein, 9 aa, Homo Sapiens
VLEDFKQAA

SEQ ID NO: 1352393 - protein, 9 aa, Homo Sapiens
NGVLSLPTY

SEQ ID NO: 1352394 - protein, 9 aa, Homo Sapiens
NMAQKFKEF

SEQ ID NO: 1352395 - protein, 9 aa, Homo Sapiens
KCCCQLFRN

SEQ ID NO: 1352396 - protein, 9 aa, Homo Sapiens
GTSPYRLRR

SEQ ID NO: 1352397 - protein, 9 aa, Homo Sapiens
IMSGRCKAN

SEQ ID NO: 1352398 - protein, 9 aa, Homo Sapiens
QHLVFHSKV

SEQ ID NO: 1352399 - protein, 9 aa, Homo Sapiens
LSTIILTLL

SEQ ID NO: 1352400 - protein, 9 aa, Homo Sapiens
TQKVCFFTG

SEQ ID NO: 1352401 - protein, 9 aa, Homo Sapiens
HILMKSVRT

SEQ ID NO: 1352402 - protein, 9 aa, Homo Sapiens
LMISIWIFF

SEQ ID NO: 1352403 - protein, 9 aa, Homo Sapiens
TRPMEVFMC

SEQ ID NO: 1352404 - protein, 9 aa, Homo Sapiens
QGSKPREHP

SEQ ID NO: 1352405 - protein, 9 aa, Homo Sapiens
YRTIEESSA

SEQ ID NO: 1352406 - protein, 9 aa, Homo Sapiens
TPNRYHYYQ

SEQ ID NO: 1352407 - protein, 9 aa, Homo Sapiens
ACSTTINRN

SEQ ID NO: 1352408 - protein, 9 aa, Homo Sapiens
TRVVRRLQK

SEQ ID NO: 1352409 - protein, 9 aa, Homo Sapiens
IIIIITLLD

SEQ ID NO: 1352410 - protein, 9 aa, Homo Sapiens
CQTCSVLGC

SEQ ID NO: 1352411 - protein, 9 aa, Homo Sapiens
NLSRGGKAT

SEQ ID NO: 1352412 - protein, 9 aa, Homo Sapiens
LLLWGENDT

SEQ ID NO: 1352413 - protein, 9 aa, Homo Sapiens
RNTRRTAQN

SEQ ID NO: 1352414 - protein, 9 aa, Homo Sapiens
DGLYGPITF

SEQ ID NO: 1352415 - protein, 9 aa, Homo Sapiens
SPLSKVVRH

SEQ ID NO: 1352416 - protein, 9 aa, Homo Sapiens
VIAFNNPYG

SEQ ID NO: 1352417 - protein, 9 aa, Homo Sapiens
LFGGFSFLL

SEQ ID NO: 1352418 - protein, 9 aa, Homo Sapiens
AEGFSKRKL

SEQ ID NO: 1352419 - protein, 9 aa, Homo Sapiens
ADRMQRQEE

SEQ ID NO: 1352420 - protein, 9 aa, Homo Sapiens
STKSGGKCV

SEQ ID NO: 1352421 - protein, 9 aa, Homo Sapiens
MSVIYHQRL

SEQ ID NO: 1352422 - protein, 9 aa, Homo Sapiens
HLWQPQGAH

SEQ ID NO: 1352423 - protein, 9 aa, Homo Sapiens
NNFCAFNLM

SEQ ID NO: 1352424 - protein, 9 aa, Homo Sapiens
NTQDMQVDE

SEQ ID NO: 1352425 - protein, 9 aa, Homo Sapiens
VDEENRALR

SEQ ID NO: 1352426 - protein, 9 aa, Homo Sapiens
GYLEKVCQL

SEQ ID NO: 1352427 - protein, 9 aa, Homo Sapiens
GHFTSDMSS

SEQ ID NO: 1352428 - protein, 9 aa, Homo Sapiens
LKMLLTIST

SEQ ID NO: 1352429 - protein, 9 aa, Homo Sapiens
NFTGTHSGH

SEQ ID NO: 1352430 - protein, 9 aa, Homo Sapiens
IPVKWGEEN

SEQ ID NO: 1352431 - protein, 9 aa, Homo Sapiens
MQMNHTLFS

SEQ ID NO: 1352432 - protein, 9 aa, Homo Sapiens
FMLVLGVQW

SEQ ID NO: 1352433 - protein, 9 aa, Homo Sapiens
RQKRQTRES

SEQ ID NO: 1352434 - protein, 9 aa, Homo Sapiens
QDINKPDCD

SEQ ID NO: 1352435 - protein, 9 aa, Homo Sapiens
RVLKGSHAR

SEQ ID NO: 1352436 - protein, 9 aa, Homo Sapiens
ILVFIFLWY

SEQ ID NO: 1352437 - protein, 9 aa, Homo Sapiens
KLEVGRIIK

SEQ ID NO: 1352438 - protein, 9 aa, Homo Sapiens
HWLEVWRVS

SEQ ID NO: 1352439 - protein, 9 aa, Homo Sapiens
MTYFIQLSF

SEQ ID NO: 1352440 - protein, 9 aa, Homo Sapiens
EITIPNDLK

SEQ ID NO: 1352441 - protein, 9 aa, Homo Sapiens
LCMKSTLTS

SEQ ID NO: 1352442 - protein, 9 aa, Homo Sapiens
TSLTTLPSE

SEQ ID NO: 1352443 - protein, 9 aa, Homo Sapiens
YLEKVCQLE

SEQ ID NO: 1352444 - protein, 9 aa, Homo Sapiens
VAIHTDSNE

SEQ ID NO: 1352445 - protein, 9 aa, Homo Sapiens
DLNLMVLVE

SEQ ID NO: 1352446 - protein, 9 aa, Homo Sapiens
EWRQFNREM

SEQ ID NO: 1352447 - protein, 9 aa, Homo Sapiens
KEIHFQDYS

SEQ ID NO: 1352448 - protein, 9 aa, Homo Sapiens
DGATEIDMV

SEQ ID NO: 1352449 - protein, 9 aa, Homo Sapiens
VLSYYKSED

SEQ ID NO: 1352450 - protein, 9 aa, Homo Sapiens
SCPEHITTI

SEQ ID NO: 1352451 - protein, 9 aa, Homo Sapiens
YNKVCTYHT

SEQ ID NO: 1352452 - protein, 9 aa, Homo Sapiens
KSLHLSVVP

SEQ ID NO: 1352453 - protein, 9 aa, Homo Sapiens
LDTSCQATG

SEQ ID NO: 1352454 - protein, 9 aa, Homo Sapiens
DVYKVGEQV

SEQ ID NO: 1352455 - protein, 9 aa, Homo Sapiens
PTTPSPASG

SEQ ID NO: 1352456 - protein, 9 aa, Homo Sapiens
RREELLKKC

SEQ ID NO: 1352457 - protein, 9 aa, Homo Sapiens
NGMLTGQAY

SEQ ID NO: 1352458 - protein, 9 aa, Homo Sapiens
ETYNVLTNW

SEQ ID NO: 1352459 - protein, 9 aa, Homo Sapiens
EKQTWWEKP

SEQ ID NO: 1352460 - protein, 9 aa, Homo Sapiens
SSGAMGPPE

SEQ ID NO: 1352461 - protein, 9 aa, Homo Sapiens
KQLMIYEEI

SEQ ID NO: 1352462 - protein, 9 aa, Homo Sapiens
LQDVRDVST

SEQ ID NO: 1352463 - protein, 9 aa, Homo Sapiens
YVRFTLFQT

SEQ ID NO: 1352464 - protein, 9 aa, Homo Sapiens
TCSKYIELP

SEQ ID NO: 1352465 - protein, 9 aa, Homo Sapiens
FQISKEYEH

SEQ ID NO: 1352466 - protein, 9 aa, Homo Sapiens
KKQCMMVRA

SEQ ID NO: 1352467 - protein, 9 aa, Homo Sapiens
TIKFVLRDA

SEQ ID NO: 1352468 - protein, 9 aa, Homo Sapiens
LPSQHTQFE

SEQ ID NO: 1352469 - protein, 9 aa, Homo Sapiens
LHNFLCILQ

SEQ ID NO: 1352470 - protein, 9 aa, Homo Sapiens
APAARPSPA

SEQ ID NO: 1352471 - protein, 9 aa, Homo Sapiens
WTDVVKLGA

SEQ ID NO: 1352472 - protein, 9 aa, Homo Sapiens
AAMCYEPAN

SEQ ID NO: 1352473 - protein, 9 aa, Homo Sapiens
IHCLRPIWG

SEQ ID NO: 1352474 - protein, 9 aa, Homo Sapiens
ITVEDFEMI

SEQ ID NO: 1352475 - protein, 9 aa, Homo Sapiens
AASAEGFSK

SEQ ID NO: 1352476 - protein, 9 aa, Homo Sapiens
KIGPNMAIL

SEQ ID NO: 1352477 - protein, 9 aa, Homo Sapiens
PRTSGKVHA

SEQ ID NO: 1352478 - protein, 9 aa, Homo Sapiens
NINDNIYIA

SEQ ID NO: 1352479 - protein, 9 aa, Homo Sapiens
VIEAPKGEF

SEQ ID NO: 1352480 - protein, 9 aa, Homo Sapiens
ECRSPPLCA

SEQ ID NO: 1352481 - protein, 9 aa, Homo Sapiens
MTKLLQDLH

SEQ ID NO: 1352482 - protein, 9 aa, Homo Sapiens
PVNRSLVLP

SEQ ID NO: 1352483 - protein, 9 aa, Homo Sapiens
SAFLHHIRQ

SEQ ID NO: 1352484 - protein, 9 aa, Homo Sapiens
LSDISTQVQ

SEQ ID NO: 1352485 - protein, 9 aa, Homo Sapiens
PKLWVLARS

SEQ ID NO: 1352486 - protein, 9 aa, Homo Sapiens
RHANIVTYH

SEQ ID NO: 1352487 - protein, 9 aa, Homo Sapiens
ASYAWHFET

SEQ ID NO: 1352488 - protein, 9 aa, Homo Sapiens
TYRSKCLMK

SEQ ID NO: 1352489 - protein, 9 aa, Homo Sapiens
PLRESTLMD

SEQ ID NO: 1352490 - protein, 9 aa, Homo Sapiens
CLGLGVRAL

SEQ ID NO: 1352491 - protein, 9 aa, Homo Sapiens
LGVEYTVHV

SEQ ID NO: 1352492 - protein, 9 aa, Homo Sapiens
IVLYNNANG

SEQ ID NO: 1352493 - protein, 9 aa, Homo Sapiens
CDKAFSRSK

SEQ ID NO: 1352494 - protein, 9 aa, Homo Sapiens
LPLGIVRSR

SEQ ID NO: 1352495 - protein, 9 aa, Homo Sapiens
SWSMREANM

SEQ ID NO: 1352496 - protein, 9 aa, Homo Sapiens
EGYTKSGVQ

SEQ ID NO: 1352497 - protein, 9 aa, Homo Sapiens
QEEGVPDLV

SEQ ID NO: 1352498 - protein, 9 aa, Homo Sapiens
ERAYGRLWR

SEQ ID NO: 1352499 - protein, 9 aa, Homo Sapiens
HRRMVVEYL

SEQ ID NO: 1352500 - protein, 9 aa, Homo Sapiens
EKKNDKEEV

SEQ ID NO: 1352501 - protein, 9 aa, Homo Sapiens
AGNSCRVDI

SEQ ID NO: 1352502 - protein, 9 aa, Homo Sapiens
FNLLHGKTI

SEQ ID NO: 1352503 - protein, 9 aa, Homo Sapiens
GRHISVICR

SEQ ID NO: 1352504 - protein, 9 aa, Homo Sapiens
DVTFRVTGR

SEQ ID NO: 1352505 - protein, 9 aa, Homo Sapiens
CHNLITFLR

SEQ ID NO: 1352506 - protein, 9 aa, Homo Sapiens
YHVLMCGGD

SEQ ID NO: 1352507 - protein, 9 aa, Homo Sapiens
MSHKIGRII

SEQ ID NO: 1352508 - protein, 9 aa, Homo Sapiens
DEKVDIYKL

SEQ ID NO: 1352509 - protein, 9 aa, Homo Sapiens
LHINLWHLA

SEQ ID NO: 1352510 - protein, 9 aa, Homo Sapiens
LRQEDFPPH

SEQ ID NO: 1352511 - protein, 9 aa, Homo Sapiens
LRIPLDEST

SEQ ID NO: 1352512 - protein, 9 aa, Homo Sapiens
RQVREHVLE

SEQ ID NO: 1352513 - protein, 9 aa, Homo Sapiens
LWIQFQEGF

SEQ ID NO: 1352514 - protein, 9 aa, Homo Sapiens
FSFEPLSNP

SEQ ID NO: 1352515 - protein, 9 aa, Homo Sapiens
PSSQGSGRP

SEQ ID NO: 1352516 - protein, 9 aa, Homo Sapiens
RGIKTFPVR

SEQ ID NO: 1352517 - protein, 9 aa, Homo Sapiens
ELCDFTYRD

SEQ ID NO: 1352518 - protein, 9 aa, Homo Sapiens
SLPALHSKL

SEQ ID NO: 1352519 - protein, 9 aa, Homo Sapiens
EQHNVFLAT

SEQ ID NO: 1352520 - protein, 9 aa, Homo Sapiens
VVKLLGEQH

SEQ ID NO: 1352521 - protein, 9 aa, Homo Sapiens
VGSAAGGAQ

SEQ ID NO: 1352522 - protein, 9 aa, Homo Sapiens
NMLCDEEPS

SEQ ID NO: 1352523 - protein, 9 aa, Homo Sapiens
EERQDECDV

SEQ ID NO: 1352524 - protein, 9 aa, Homo Sapiens
AGKLALIDK

SEQ ID NO: 1352525 - protein, 9 aa, Homo Sapiens
DGDSKEVSL

SEQ ID NO: 1352526 - protein, 9 aa, Homo Sapiens
FFIDRPNTY

SEQ ID NO: 1352527 - protein, 9 aa, Homo Sapiens
YTVLAVASW

SEQ ID NO: 1352528 - protein, 9 aa, Homo Sapiens
KLTGSILPP

SEQ ID NO: 1352529 - protein, 9 aa, Homo Sapiens
DDNHWWQVS

SEQ ID NO: 1352530 - protein, 9 aa, Homo Sapiens
LVLDPALPV

SEQ ID NO: 1352531 - protein, 9 aa, Homo Sapiens
PGAHKGQIV

SEQ ID NO: 1352532 - protein, 9 aa, Homo Sapiens
AQGELKRVI

SEQ ID NO: 1352533 - protein, 9 aa, Homo Sapiens
RRGHYLTVA

SEQ ID NO: 1352534 - protein, 9 aa, Homo Sapiens
RRKEIMVQL

SEQ ID NO: 1352535 - protein, 9 aa, Homo Sapiens
ANRISGTRD

SEQ ID NO: 1352536 - protein, 9 aa, Homo Sapiens
NGSMLQSQL

SEQ ID NO: 1352537 - protein, 9 aa, Homo Sapiens
LHGAVFAFL

SEQ ID NO: 1352538 - protein, 9 aa, Homo Sapiens
VPSPPRIHV

SEQ ID NO: 1352539 - protein, 9 aa, Homo Sapiens
WEEDFIQPS

SEQ ID NO: 1352540 - protein, 9 aa, Homo Sapiens
TFHSPYWMV

SEQ ID NO: 1352541 - protein, 9 aa, Homo Sapiens
STSPQPKCW

SEQ ID NO: 1352542 - protein, 9 aa, Homo Sapiens
QQIRLVVSR

SEQ ID NO: 1352543 - protein, 9 aa, Homo Sapiens
AGREFHKSL

SEQ ID NO: 1352544 - protein, 9 aa, Homo Sapiens
DDEKHIQAE

SEQ ID NO: 1352545 - protein, 9 aa, Homo Sapiens
HIMTVRRSG

SEQ ID NO: 1352546 - protein, 9 aa, Homo Sapiens
PYNSHTVMN

SEQ ID NO: 1352547 - protein, 9 aa, Homo Sapiens
DDRVDYVTV

SEQ ID NO: 1352548 - protein, 9 aa, Homo Sapiens
QLVVTLSTS

SEQ ID NO: 1352549 - protein, 9 aa, Homo Sapiens
DKIWPKLWV

SEQ ID NO: 1352550 - protein, 9 aa, Homo Sapiens
WCAKVQGTV

SEQ ID NO: 1352551 - protein, 9 aa, Homo Sapiens
PTALAAAMD

SEQ ID NO: 1352552 - protein, 9 aa, Homo Sapiens
CLCCLVGTT

SEQ ID NO: 1352553 - protein, 9 aa, Homo Sapiens
GNLRHKCVH

SEQ ID NO: 1352554 - protein, 9 aa, Homo Sapiens
PLTKDERIY

SEQ ID NO: 1352555 - protein, 9 aa, Homo Sapiens
HFYRVLTCI

SEQ ID NO: 1352556 - protein, 9 aa, Homo Sapiens
QIRKHIVLE

SEQ ID NO: 1352557 - protein, 9 aa, Homo Sapiens
VRAGVSPGR

SEQ ID NO: 1352558 - protein, 9 aa, Homo Sapiens
SPLKSCKYH

SEQ ID NO: 1352559 - protein, 9 aa, Homo Sapiens
HYYQNVCTQ

SEQ ID NO: 1352560 - protein, 9 aa, Homo Sapiens
NMPNKEMME

SEQ ID NO: 1352561 - protein, 9 aa, Homo Sapiens
PAATPVVPI

SEQ ID NO: 1352562 - protein, 9 aa, Homo Sapiens
MSKDVIISP

SEQ ID NO: 1352563 - protein, 9 aa, Homo Sapiens
LTLSPGWSA

SEQ ID NO: 1352564 - protein, 9 aa, Homo Sapiens
VCRNKCIAY

SEQ ID NO: 1352565 - protein, 9 aa, Homo Sapiens
GTFMFPYFI

SEQ ID NO: 1352566 - protein, 9 aa, Homo Sapiens
PGLRKSGVD

SEQ ID NO: 1352567 - protein, 9 aa, Homo Sapiens
VMKDQHLVF

SEQ ID NO: 1352568 - protein, 9 aa, Homo Sapiens
DIPNLRRFD

SEQ ID NO: 1352569 - protein, 9 aa, Homo Sapiens
VTVGYFIFY

SEQ ID NO: 1352570 - protein, 9 aa, Homo Sapiens
LDLCCIPNH

SEQ ID NO: 1352571 - protein, 9 aa, Homo Sapiens
KSWVSKLEE

SEQ ID NO: 1352572 - protein, 9 aa, Homo Sapiens
YTVIEAPKG

SEQ ID NO: 1352573 - protein, 9 aa, Homo Sapiens
RGETVVLQC

SEQ ID NO: 1352574 - protein, 9 aa, Homo Sapiens
CYSCFASNI

SEQ ID NO: 1352575 - protein, 9 aa, Homo Sapiens
HHSYMRLTE

SEQ ID NO: 1352576 - protein, 9 aa, Homo Sapiens
MKIFVTTKS

SEQ ID NO: 1352577 - protein, 9 aa, Homo Sapiens
ALPVLVSCG

SEQ ID NO: 1352578 - protein, 9 aa, Homo Sapiens
FLLSRGTNP

SEQ ID NO: 1352579 - protein, 9 aa, Homo Sapiens
AWKTYTECR

SEQ ID NO: 1352580 - protein, 9 aa, Homo Sapiens
CGAEPRSCP

SEQ ID NO: 1352581 - protein, 9 aa, Homo Sapiens
SQLSIMDLM

SEQ ID NO: 1352582 - protein, 9 aa, Homo Sapiens
KMDDVEVTV

SEQ ID NO: 1352583 - protein, 9 aa, Homo Sapiens
LEVQTRPFD

SEQ ID NO: 1352584 - protein, 9 aa, Homo Sapiens
SLVINGSNL

SEQ ID NO: 1352585 - protein, 9 aa, Homo Sapiens
TGHDMLASF

SEQ ID NO: 1352586 - protein, 9 aa, Homo Sapiens
GQPHFVCCI

SEQ ID NO: 1352587 - protein, 9 aa, Homo Sapiens
LRFPTCFSS

SEQ ID NO: 1352588 - protein, 9 aa, Homo Sapiens
PLRAINLNL

SEQ ID NO: 1352589 - protein, 9 aa, Homo Sapiens
PRIPMLSRE

SEQ ID NO: 1352590 - protein, 9 aa, Homo Sapiens
RNHKRVKEI

SEQ ID NO: 1352591 - protein, 9 aa, Homo Sapiens
TYLALEDEG

SEQ ID NO: 1352592 - protein, 9 aa, Homo Sapiens
HAWLTQHQP

SEQ ID NO: 1352593 - protein, 9 aa, Homo Sapiens
KAGGHVKPQ

SEQ ID NO: 1352594 - protein, 9 aa, Homo Sapiens
LHSQLAESN

SEQ ID NO: 1352595 - protein, 9 aa, Homo Sapiens
MKQSVNISL

SEQ ID NO: 1352596 - protein, 9 aa, Homo Sapiens
NHFSYLTVH

SEQ ID NO: 1352597 - protein, 9 aa, Homo Sapiens
RPRIMRICL

SEQ ID NO: 1352598 - protein, 9 aa, Homo Sapiens
IPEDTVTFI

SEQ ID NO: 1352599 - protein, 9 aa, Homo Sapiens
SLTREVIHL

SEQ ID NO: 1352600 - protein, 9 aa, Homo Sapiens
FPPHIVEHP

SEQ ID NO: 1352601 - protein, 9 aa, Homo Sapiens
LQCTISLVF

SEQ ID NO: 1352602 - protein, 9 aa, Homo Sapiens
IVGSYDEVV

SEQ ID NO: 1352603 - protein, 9 aa, Homo Sapiens
APQEPTFSG

SEQ ID NO: 1352604 - protein, 9 aa, Homo Sapiens
MEEYPISKK

SEQ ID NO: 1352605 - protein, 9 aa, Homo Sapiens
GGHSGDPSL

SEQ ID NO: 1352606 - protein, 9 aa, Homo Sapiens
ILNVTALPL

SEQ ID NO: 1352607 - protein, 9 aa, Homo Sapiens
EREKEVILL

SEQ ID NO: 1352608 - protein, 9 aa, Homo Sapiens
SSRNWPSHR

SEQ ID NO: 1352609 - protein, 9 aa, Homo Sapiens
GTSQHRRKS

SEQ ID NO: 1352610 - protein, 9 aa, Homo Sapiens
ASMTKKSIS

SEQ ID NO: 1352611 - protein, 9 aa, Homo Sapiens
NPVTSDSYE

SEQ ID NO: 1352612 - protein, 9 aa, Homo Sapiens
MLGHVRCHM

SEQ ID NO: 1352613 - protein, 9 aa, Homo Sapiens
HNRCPVKCL

SEQ ID NO: 1352614 - protein, 9 aa, Homo Sapiens
PNIYETGDM

SEQ ID NO: 1352615 - protein, 9 aa, Homo Sapiens
DPIRQEDVG

SEQ ID NO: 1352616 - protein, 9 aa, Homo Sapiens
NHTFMLAKE

SEQ ID NO: 1352617 - protein, 9 aa, Homo Sapiens
KTVTRGETV

SEQ ID NO: 1352618 - protein, 9 aa, Homo Sapiens
PGHILLILW

SEQ ID NO: 1352619 - protein, 9 aa, Homo Sapiens
IQSMLHRWF

SEQ ID NO: 1352620 - protein, 9 aa, Homo Sapiens
RMATAEDLS

SEQ ID NO: 1352621 - protein, 9 aa, Homo Sapiens
RAISLSPMS

SEQ ID NO: 1352622 - protein, 9 aa, Homo Sapiens
AHNNTHSNL

SEQ ID NO: 1352623 - protein, 9 aa, Homo Sapiens
RSGKAEFPD

SEQ ID NO: 1352624 - protein, 9 aa, Homo Sapiens
MLLITIAIF

SEQ ID NO: 1352625 - protein, 9 aa, Homo Sapiens
GGDNPNSLV

SEQ ID NO: 1352626 - protein, 9 aa, Homo Sapiens
LGTKIKAME

SEQ ID NO: 1352627 - protein, 9 aa, Homo Sapiens
RTVIQRGSL

SEQ ID NO: 1352628 - protein, 9 aa, Homo Sapiens
LQSHTGERP

SEQ ID NO: 1352629 - protein, 9 aa, Homo Sapiens
ESISKVCSS

SEQ ID NO: 1352630 - protein, 9 aa, Homo Sapiens
SPEAGRVNR

SEQ ID NO: 1352631 - protein, 9 aa, Homo Sapiens
GEKEVRLIR

SEQ ID NO: 1352632 - protein, 9 aa, Homo Sapiens
SLKGWKEIK

SEQ ID NO: 1352633 - protein, 9 aa, Homo Sapiens
AIVQAHSIY

SEQ ID NO: 1352634 - protein, 9 aa, Homo Sapiens
LTKQLKLEK

SEQ ID NO: 1352635 - protein, 9 aa, Homo Sapiens
TTVTTLRVS

SEQ ID NO: 1352636 - protein, 9 aa, Homo Sapiens
EVTLWMQSP

SEQ ID NO: 1352637 - protein, 9 aa, Homo Sapiens
LVHYDNVIC

SEQ ID NO: 1352638 - protein, 9 aa, Homo Sapiens
ECSKFGQVR

SEQ ID NO: 1352639 - protein, 9 aa, Homo Sapiens
IQGEAVHMT

SEQ ID NO: 1352640 - protein, 9 aa, Homo Sapiens
NLITLEEHL

SEQ ID NO: 1352641 - protein, 9 aa, Homo Sapiens
QKYLKSVHY

SEQ ID NO: 1352642 - protein, 9 aa, Homo Sapiens
YIMDKAEGS

SEQ ID NO: 1352643 - protein, 9 aa, Homo Sapiens
LLLIFHSLD

SEQ ID NO: 1352644 - protein, 9 aa, Homo Sapiens
GRLPLGIVR

SEQ ID NO: 1352645 - protein, 9 aa, Homo Sapiens
RQDRPVSKL

SEQ ID NO: 1352646 - protein, 9 aa, Homo Sapiens
SPSRQSHRY

SEQ ID NO: 1352647 - protein, 9 aa, Homo Sapiens
KVMCFERFG

SEQ ID NO: 1352648 - protein, 9 aa, Homo Sapiens
CPFHHISGE

SEQ ID NO: 1352649 - protein, 9 aa, Homo Sapiens
ADHNAYVWS

SEQ ID NO: 1352650 - protein, 9 aa, Homo Sapiens
CYEPANSHF

SEQ ID NO: 1352651 - protein, 9 aa, Homo Sapiens
PAADNHSLI

SEQ ID NO: 1352652 - protein, 9 aa, Homo Sapiens
MQTVYVQHP

SEQ ID NO: 1352653 - protein, 9 aa, Homo Sapiens
CCITQHTLG

SEQ ID NO: 1352654 - protein, 9 aa, Homo Sapiens
SQETRDMFH

SEQ ID NO: 1352655 - protein, 9 aa, Homo Sapiens
NCSALSAAS

SEQ ID NO: 1352656 - protein, 9 aa, Homo Sapiens
RRRYLVERT

SEQ ID NO: 1352657 - protein, 9 aa, Homo Sapiens
LSNPDGPVI

SEQ ID NO: 1352658 - protein, 9 aa, Homo Sapiens
VWQKSEVDI

SEQ ID NO: 1352659 - protein, 9 aa, Homo Sapiens
ITSAYYRGT

SEQ ID NO: 1352660 - protein, 9 aa, Homo Sapiens
NEEHEDEVE

SEQ ID NO: 1352661 - protein, 9 aa, Homo Sapiens
TDSPDDLTT

SEQ ID NO: 1352662 - protein, 9 aa, Homo Sapiens
KGLAPGTNP

SEQ ID NO: 1352663 - protein, 9 aa, Homo Sapiens
ARVMEQCLA

SEQ ID NO: 1352664 - protein, 9 aa, Homo Sapiens
WDRVVAIFV

SEQ ID NO: 1352665 - protein, 9 aa, Homo Sapiens
TGDADISIT

SEQ ID NO: 1352666 - protein, 9 aa, Homo Sapiens
WIVAISGLI

SEQ ID NO: 1352667 - protein, 9 aa, Homo Sapiens
TNGITKACR

SEQ ID NO: 1352668 - protein, 9 aa, Homo Sapiens
FVIVERIPQ

SEQ ID NO: 1352669 - protein, 9 aa, Homo Sapiens
QAETREAHE

SEQ ID NO: 1352670 - protein, 9 aa, Homo Sapiens
AKTKALQTA

SEQ ID NO: 1352671 - protein, 9 aa, Homo Sapiens
TSIPLSSPL

SEQ ID NO: 1352672 - protein, 9 aa, Homo Sapiens
PEYKLQTPH

SEQ ID NO: 1352673 - protein, 9 aa, Homo Sapiens
WEKPCTLLF

SEQ ID NO: 1352674 - protein, 9 aa, Homo Sapiens
DCSDFLSCS

SEQ ID NO: 1352675 - protein, 9 aa, Homo Sapiens
DRNKPHYPK

SEQ ID NO: 1352676 - protein, 9 aa, Homo Sapiens
QSQITPPGM

SEQ ID NO: 1352677 - protein, 9 aa, Homo Sapiens
VAPENTGTQ

SEQ ID NO: 1352678 - protein, 9 aa, Homo Sapiens
HPCQMESGY

SEQ ID NO: 1352679 - protein, 9 aa, Homo Sapiens
DLCVSFSYA

SEQ ID NO: 1352680 - protein, 9 aa, Homo Sapiens
SNSEQASHH

SEQ ID NO: 1352681 - protein, 9 aa, Homo Sapiens
FLILCLPFC

SEQ ID NO: 1352682 - protein, 9 aa, Homo Sapiens
KDVLNILIG

SEQ ID NO: 1352683 - protein, 9 aa, Homo Sapiens
QVPVSEPNT

SEQ ID NO: 1352684 - protein, 9 aa, Homo Sapiens
TTIFQNFSM

SEQ ID NO: 1352685 - protein, 9 aa, Homo Sapiens
FYHMPFGFG

SEQ ID NO: 1352686 - protein, 9 aa, Homo Sapiens
PSPKRQCLS

SEQ ID NO: 1352687 - protein, 9 aa, Homo Sapiens
SSSACLNPA

SEQ ID NO: 1352688 - protein, 9 aa, Homo Sapiens
NFTMIMQRV

SEQ ID NO: 1352689 - protein, 9 aa, Homo Sapiens
DMWICMELM

SEQ ID NO: 1352690 - protein, 9 aa, Homo Sapiens
CSIDGSIVL

SEQ ID NO: 1352691 - protein, 9 aa, Homo Sapiens
GTFWLWCSL

SEQ ID NO: 1352692 - protein, 9 aa, Homo Sapiens
EPPGPVPQL

SEQ ID NO: 1352693 - protein, 9 aa, Homo Sapiens
YQALDTDFR

SEQ ID NO: 1352694 - protein, 9 aa, Homo Sapiens
TTHLEDVFW

SEQ ID NO: 1352695 - protein, 9 aa, Homo Sapiens
SSLSKVVQG

SEQ ID NO: 1352696 - protein, 9 aa, Homo Sapiens
MGPEATIQI

SEQ ID NO: 1352697 - protein, 9 aa, Homo Sapiens
ACVSHISCV

SEQ ID NO: 1352698 - protein, 9 aa, Homo Sapiens
LRSLHYTAC

SEQ ID NO: 1352699 - protein, 9 aa, Homo Sapiens
QAEHCQKMY

SEQ ID NO: 1352700 - protein, 9 aa, Homo Sapiens
LEEPKDRTV

SEQ ID NO: 1352701 - protein, 9 aa, Homo Sapiens
TPRIDSQLA

SEQ ID NO: 1352702 - protein, 9 aa, Homo Sapiens
EQVTAFQEQ

SEQ ID NO: 1352703 - protein, 9 aa, Homo Sapiens
EGRHDSVRY

SEQ ID NO: 1352704 - protein, 9 aa, Homo Sapiens
WTCLADLEG

SEQ ID NO: 1352705 - protein, 9 aa, Homo Sapiens
IHTDSNEQI

SEQ ID NO: 1352706 - protein, 9 aa, Homo Sapiens
YIVMSACFL

SEQ ID NO: 1352707 - protein, 9 aa, Homo Sapiens
VSTFEIERE

SEQ ID NO: 1352708 - protein, 9 aa, Homo Sapiens
VLWDPTISW

SEQ ID NO: 1352709 - protein, 9 aa, Homo Sapiens
TRELDPVWL

SEQ ID NO: 1352710 - protein, 9 aa, Homo Sapiens
EHFLKFTSV

SEQ ID NO: 1352711 - protein, 9 aa, Homo Sapiens
TVGAVTAAS

SEQ ID NO: 1352712 - protein, 9 aa, Homo Sapiens
DNLAVTDDD

SEQ ID NO: 1352713 - protein, 9 aa, Homo Sapiens
KGYHPLAEE

SEQ ID NO: 1352714 - protein, 9 aa, Homo Sapiens
KLWLQKWYI

SEQ ID NO: 1352715 - protein, 9 aa, Homo Sapiens
PGIMHTSYR

SEQ ID NO: 1352716 - protein, 9 aa, Homo Sapiens
QKPETDTYS

SEQ ID NO: 1352717 - protein, 9 aa, Homo Sapiens
EHLQKQDKD

SEQ ID NO: 1352718 - protein, 9 aa, Homo Sapiens
RYERAISMH

SEQ ID NO: 1352719 - protein, 9 aa, Homo Sapiens
DYLQPWCCP

SEQ ID NO: 1352720 - protein, 9 aa, Homo Sapiens
SKSPKMMKK

SEQ ID NO: 1352721 - protein, 9 aa, Homo Sapiens
DAEYFLFIA

SEQ ID NO: 1352722 - protein, 9 aa, Homo Sapiens
GLRKSGVDN

SEQ ID NO: 1352723 - protein, 9 aa, Homo Sapiens
LYHVNKRLE

SEQ ID NO: 1352724 - protein, 9 aa, Homo Sapiens
SSSLGAFFT

SEQ ID NO: 1352725 - protein, 9 aa, Homo Sapiens
ITFTPESQR

SEQ ID NO: 1352726 - protein, 9 aa, Homo Sapiens
FNHIPPHTF

SEQ ID NO: 1352727 - protein, 9 aa, Homo Sapiens
NSPLSSSPI

SEQ ID NO: 1352728 - protein, 9 aa, Homo Sapiens
NLRGTRLKY

SEQ ID NO: 1352729 - protein, 9 aa, Homo Sapiens
AVQGKTRTL

SEQ ID NO: 1352730 - protein, 9 aa, Homo Sapiens
AKQEELEVA

SEQ ID NO: 1352731 - protein, 9 aa, Homo Sapiens
LTSMWRLSS

SEQ ID NO: 1352732 - protein, 9 aa, Homo Sapiens
ENDDMPKDA

SEQ ID NO: 1352733 - protein, 9 aa, Homo Sapiens
SIDTMSHMH

SEQ ID NO: 1352734 - protein, 9 aa, Homo Sapiens
GKDVAEIVL

SEQ ID NO: 1352735 - protein, 9 aa, Homo Sapiens
EAALVAQAK

SEQ ID NO: 1352736 - protein, 9 aa, Homo Sapiens
LVKGAKGIC

SEQ ID NO: 1352737 - protein, 9 aa, Homo Sapiens
KSIVGSKFT

SEQ ID NO: 1352738 - protein, 9 aa, Homo Sapiens
KCQRRILLR

SEQ ID NO: 1352739 - protein, 9 aa, Homo Sapiens
HLCSLFHQC

SEQ ID NO: 1352740 - protein, 9 aa, Homo Sapiens
ASKTKGKNK

SEQ ID NO: 1352741 - protein, 9 aa, Homo Sapiens
GAFYGPAVI

SEQ ID NO: 1352742 - protein, 9 aa, Homo Sapiens
PRNDTNLCD

SEQ ID NO: 1352743 - protein, 9 aa, Homo Sapiens
GGHVKPQGV

SEQ ID NO: 1352744 - protein, 9 aa, Homo Sapiens
NIQDLAPPC

SEQ ID NO: 1352745 - protein, 9 aa, Homo Sapiens
VSVQLNYML

SEQ ID NO: 1352746 - protein, 9 aa, Homo Sapiens
YLEEEDTET

SEQ ID NO: 1352747 - protein, 9 aa, Homo Sapiens
RHKMISTLQ

SEQ ID NO: 1352748 - protein, 9 aa, Homo Sapiens
KGGHEPRSC

SEQ ID NO: 1352749 - protein, 9 aa, Homo Sapiens
RGAGLHRDV

SEQ ID NO: 1352750 - protein, 9 aa, Homo Sapiens
VFWCLLMVT

SEQ ID NO: 1352751 - protein, 9 aa, Homo Sapiens
CGKPFRMST

SEQ ID NO: 1352752 - protein, 9 aa, Homo Sapiens
TMNVKQAAK

SEQ ID NO: 1352753 - protein, 9 aa, Homo Sapiens
VSVHHPGFY

SEQ ID NO: 1352754 - protein, 9 aa, Homo Sapiens
HLPLAWLCI

SEQ ID NO: 1352755 - protein, 9 aa, Homo Sapiens
KDDTTTKHW

SEQ ID NO: 1352756 - protein, 9 aa, Homo Sapiens
EKKLEDAWA

SEQ ID NO: 1352757 - protein, 9 aa, Homo Sapiens
LVFVESTYS

SEQ ID NO: 1352758 - protein, 9 aa, Homo Sapiens
ELHNFLCIL

SEQ ID NO: 1352759 - protein, 9 aa, Homo Sapiens
GFSYQVTNG

SEQ ID NO: 1352760 - protein, 9 aa, Homo Sapiens
SPPSPQNRS

SEQ ID NO: 1352761 - protein, 9 aa, Homo Sapiens
LKEMKNLHK

SEQ ID NO: 1352762 - protein, 9 aa, Homo Sapiens
DADISITSE

SEQ ID NO: 1352763 - protein, 9 aa, Homo Sapiens
IEWMVSIIH

SEQ ID NO: 1352764 - protein, 9 aa, Homo Sapiens
RWPLSVATD

SEQ ID NO: 1352765 - protein, 9 aa, Homo Sapiens
TSTSSLEMA

SEQ ID NO: 1352766 - protein, 9 aa, Homo Sapiens
AATWARTSS

SEQ ID NO: 1352767 - protein, 9 aa, Homo Sapiens
MPIISNAML

SEQ ID NO: 1352768 - protein, 9 aa, Homo Sapiens
WRNLSRMQN

SEQ ID NO: 1352769 - protein, 9 aa, Homo Sapiens
RYLLEDEPH

SEQ ID NO: 1352770 - protein, 9 aa, Homo Sapiens
RAKIRNLAS

SEQ ID NO: 1352771 - protein, 9 aa, Homo Sapiens
PAAVTGPDP

SEQ ID NO: 1352772 - protein, 9 aa, Homo Sapiens
CLETIFTKS

SEQ ID NO: 1352773 - protein, 9 aa, Homo Sapiens
DSLLKVFVR

SEQ ID NO: 1352774 - protein, 9 aa, Homo Sapiens
FLSCSFAPK

SEQ ID NO: 1352775 - protein, 9 aa, Homo Sapiens
DSVIPHVLK

SEQ ID NO: 1352776 - protein, 9 aa, Homo Sapiens
TGKEEKSNG

SEQ ID NO: 1352777 - protein, 9 aa, Homo Sapiens
RFTLFQTHD

SEQ ID NO: 1352778 - protein, 9 aa, Homo Sapiens
QSEELLAER

SEQ ID NO: 1352779 - protein, 9 aa, Homo Sapiens
QVVNLNSKD

SEQ ID NO: 1352780 - protein, 9 aa, Homo Sapiens
IAARENHYD

SEQ ID NO: 1352781 - protein, 9 aa, Homo Sapiens
KSTQKKLAD

SEQ ID NO: 1352782 - protein, 9 aa, Homo Sapiens
LQKPTLTII

SEQ ID NO: 1352783 - protein, 9 aa, Homo Sapiens
ELGQYGFVL

SEQ ID NO: 1352784 - protein, 9 aa, Homo Sapiens
GELLSRVFL

SEQ ID NO: 1352785 - protein, 9 aa, Homo Sapiens
DACTISNDH

SEQ ID NO: 1352786 - protein, 9 aa, Homo Sapiens
GWRRRQQER

SEQ ID NO: 1352787 - protein, 9 aa, Homo Sapiens
LQEQTECGR

SEQ ID NO: 1352788 - protein, 9 aa, Homo Sapiens
FIDCVSEKG

SEQ ID NO: 1352789 - protein, 9 aa, Homo Sapiens
GLGDSSMVF

SEQ ID NO: 1352790 - protein, 9 aa, Homo Sapiens
EGKHSVLAK

SEQ ID NO: 1352791 - protein, 9 aa, Homo Sapiens
FVLYNKFII

SEQ ID NO: 1352792 - protein, 9 aa, Homo Sapiens
ACMTTLVMV

SEQ ID NO: 1352793 - protein, 9 aa, Homo Sapiens
GYGYDCGCG

SEQ ID NO: 1352794 - protein, 9 aa, Homo Sapiens
ALQVPAVLP

SEQ ID NO: 1352795 - protein, 9 aa, Homo Sapiens
NKVCTYHTP

SEQ ID NO: 1352796 - protein, 9 aa, Homo Sapiens
KGKKSKIHC

SEQ ID NO: 1352797 - protein, 9 aa, Homo Sapiens
KHPMTNITW

SEQ ID NO: 1352798 - protein, 9 aa, Homo Sapiens
MTVLQALRH

SEQ ID NO: 1352799 - protein, 9 aa, Homo Sapiens
ETASAIDMM

SEQ ID NO: 1352800 - protein, 9 aa, Homo Sapiens
VQCCTADMN

SEQ ID NO: 1352801 - protein, 9 aa, Homo Sapiens
QLTMKGSNQ

SEQ ID NO: 1352802 - protein, 9 aa, Homo Sapiens
VLRSSSIPS

SEQ ID NO: 1352803 - protein, 9 aa, Homo Sapiens
VIMAVWRPG

SEQ ID NO: 1352804 - protein, 9 aa, Homo Sapiens
YSIDTVRVI

SEQ ID NO: 1352805 - protein, 9 aa, Homo Sapiens
PNTEMRTSC

SEQ ID NO: 1352806 - protein, 9 aa, Homo Sapiens
ALNTEELCT

SEQ ID NO: 1352807 - protein, 9 aa, Homo Sapiens
NPSSCDSSP

SEQ ID NO: 1352808 - protein, 9 aa, Homo Sapiens
PISSRDFRD

SEQ ID NO: 1352809 - protein, 9 aa, Homo Sapiens
EDVHIKGRL

SEQ ID NO: 1352810 - protein, 9 aa, Homo Sapiens
KEEEKRVLR

SEQ ID NO: 1352811 - protein, 9 aa, Homo Sapiens
VASAGRDEI

SEQ ID NO: 1352812 - protein, 9 aa, Homo Sapiens
VPLIKSHSF

SEQ ID NO: 1352813 - protein, 9 aa, Homo Sapiens
EVPEYLYHV

SEQ ID NO: 1352814 - protein, 9 aa, Homo Sapiens
RTHEMPHTR

SEQ ID NO: 1352815 - protein, 9 aa, Homo Sapiens
SYDMILAGS

SEQ ID NO: 1352816 - protein, 9 aa, Homo Sapiens
LHGGSLLTT

SEQ ID NO: 1352817 - protein, 9 aa, Homo Sapiens
RYLTALWKE

SEQ ID NO: 1352818 - protein, 9 aa, Homo Sapiens
GGVSTSWGP

SEQ ID NO: 1352819 - protein, 9 aa, Homo Sapiens
GIIIIKDNM

SEQ ID NO: 1352820 - protein, 9 aa, Homo Sapiens
THTKCKLCY

SEQ ID NO: 1352821 - protein, 9 aa, Homo Sapiens
VRIHSSVEI

SEQ ID NO: 1352822 - protein, 9 aa, Homo Sapiens
FMKHVHQGV

SEQ ID NO: 1352823 - protein, 9 aa, Homo Sapiens
QLTEHKIIH

SEQ ID NO: 1352824 - protein, 9 aa, Homo Sapiens
AQLKTGKNT

SEQ ID NO: 1352825 - protein, 9 aa, Homo Sapiens
GVLGATEAQ

SEQ ID NO: 1352826 - protein, 9 aa, Homo Sapiens
LPSPPSPSR

SEQ ID NO: 1352827 - protein, 9 aa, Homo Sapiens
GHRPESHAP

SEQ ID NO: 1352828 - protein, 9 aa, Homo Sapiens
LEKEKSWVS

SEQ ID NO: 1352829 - protein, 9 aa, Homo Sapiens
ALCPLDHES

SEQ ID NO: 1352830 - protein, 9 aa, Homo Sapiens
GKMILGRKT

SEQ ID NO: 1352831 - protein, 9 aa, Homo Sapiens
TSAPPTSLQ

SEQ ID NO: 1352832 - protein, 9 aa, Homo Sapiens
GEDPTLQIC

SEQ ID NO: 1352833 - protein, 9 aa, Homo Sapiens
STLAMIYDD

SEQ ID NO: 1352834 - protein, 9 aa, Homo Sapiens
PWWSCGEKT

SEQ ID NO: 1352835 - protein, 9 aa, Homo Sapiens
CVKLGLCRC

SEQ ID NO: 1352836 - protein, 9 aa, Homo Sapiens
SLWPQDSRG

SEQ ID NO: 1352837 - protein, 9 aa, Homo Sapiens
GLPHPQLRE

SEQ ID NO: 1352838 - protein, 9 aa, Homo Sapiens
IRIRDRGRS

SEQ ID NO: 1352839 - protein, 9 aa, Homo Sapiens
GSSDDLVNV

SEQ ID NO: 1352840 - protein, 9 aa, Homo Sapiens
AFESYQLDS

SEQ ID NO: 1352841 - protein, 9 aa, Homo Sapiens
SPSRRVQPS

SEQ ID NO: 1352842 - protein, 9 aa, Homo Sapiens
LITLLPFMQ

SEQ ID NO: 1352843 - protein, 9 aa, Homo Sapiens
SSNPTASAG

SEQ ID NO: 1352844 - protein, 9 aa, Homo Sapiens
AACWVQGML

SEQ ID NO: 1352845 - protein, 9 aa, Homo Sapiens
GCWTELGAL

SEQ ID NO: 1352846 - protein, 9 aa, Homo Sapiens
GYRTVVTLD

SEQ ID NO: 1352847 - protein, 9 aa, Homo Sapiens
KKVYPGKHF

SEQ ID NO: 1352848 - protein, 9 aa, Homo Sapiens
RWMTSLISS

SEQ ID NO: 1352849 - protein, 9 aa, Homo Sapiens
KHQRVHMGK

SEQ ID NO: 1352850 - protein, 9 aa, Homo Sapiens
TFALPDDVE

SEQ ID NO: 1352851 - protein, 9 aa, Homo Sapiens
QAKCNARSY

SEQ ID NO: 1352852 - protein, 9 aa, Homo Sapiens
ISPKDVFET

SEQ ID NO: 1352853 - protein, 9 aa, Homo Sapiens
LRLGLDGTF

SEQ ID NO: 1352854 - protein, 9 aa, Homo Sapiens
MADLGSRAQ

SEQ ID NO: 1352855 - protein, 9 aa, Homo Sapiens
HGGSLLTTE

SEQ ID NO: 1352856 - protein, 9 aa, Homo Sapiens
TWPAISAFA

SEQ ID NO: 1352857 - protein, 9 aa, Homo Sapiens
RTAPINSKS

SEQ ID NO: 1352858 - protein, 9 aa, Homo Sapiens
CRCDDIERD

SEQ ID NO: 1352859 - protein, 9 aa, Homo Sapiens
DFDVHILPP

SEQ ID NO: 1352860 - protein, 9 aa, Homo Sapiens
VRAGRDHFA

SEQ ID NO: 1352861 - protein, 9 aa, Homo Sapiens
MDSIKENKC

SEQ ID NO: 1352862 - protein, 9 aa, Homo Sapiens
SAISSPALS

SEQ ID NO: 1352863 - protein, 9 aa, Homo Sapiens
GAGIYTYLL

SEQ ID NO: 1352864 - protein, 9 aa, Homo Sapiens
RSPSTAASV

SEQ ID NO: 1352865 - protein, 9 aa, Homo Sapiens
ATPYNSHTV

SEQ ID NO: 1352866 - protein, 9 aa, Homo Sapiens
PFSLPGTIA

SEQ ID NO: 1352867 - protein, 9 aa, Homo Sapiens
KRTARKAPA

SEQ ID NO: 1352868 - protein, 9 aa, Homo Sapiens
LDVVMWDYS

SEQ ID NO: 1352869 - protein, 9 aa, Homo Sapiens
DVDQDGRMN

SEQ ID NO: 1352870 - protein, 9 aa, Homo Sapiens
GEKVWQIHV

SEQ ID NO: 1352871 - protein, 9 aa, Homo Sapiens
TADFLDALT

SEQ ID NO: 1352872 - protein, 9 aa, Homo Sapiens
EGGVCALLC

SEQ ID NO: 1352873 - protein, 9 aa, Homo Sapiens
DIMHIKGLE

SEQ ID NO: 1352874 - protein, 9 aa, Homo Sapiens
DSAEKCRLQ

SEQ ID NO: 1352875 - protein, 9 aa, Homo Sapiens
LCLSLNEEG

SEQ ID NO: 1352876 - protein, 9 aa, Homo Sapiens
AKIMSDRNL

SEQ ID NO: 1352877 - protein, 9 aa, Homo Sapiens
PSTVDDKCE

SEQ ID NO: 1352878 - protein, 9 aa, Homo Sapiens
KHMKITRRR

SEQ ID NO: 1352879 - protein, 9 aa, Homo Sapiens
RCTPQHIGP

SEQ ID NO: 1352880 - protein, 9 aa, Homo Sapiens
HITARAEEF

SEQ ID NO: 1352881 - protein, 9 aa, Homo Sapiens
CTIVTLVYL

SEQ ID NO: 1352882 - protein, 9 aa, Homo Sapiens
VTQQVAQQY

SEQ ID NO: 1352883 - protein, 9 aa, Homo Sapiens
YDMNGRYSV

SEQ ID NO: 1352884 - protein, 9 aa, Homo Sapiens
WCVAKMVKS

SEQ ID NO: 1352885 - protein, 9 aa, Homo Sapiens
IQGIVDAYC

SEQ ID NO: 1352886 - protein, 9 aa, Homo Sapiens
QDKIRPLWC

SEQ ID NO: 1352887 - protein, 9 aa, Homo Sapiens
TGDLGNTVI

SEQ ID NO: 1352888 - protein, 9 aa, Homo Sapiens
DDLVANMEP

SEQ ID NO: 1352889 - protein, 9 aa, Homo Sapiens
ERRAVVPGV

SEQ ID NO: 1352890 - protein, 9 aa, Homo Sapiens
NVEQITNVQ

SEQ ID NO: 1352891 - protein, 9 aa, Homo Sapiens
LRMTEQQGE

SEQ ID NO: 1352892 - protein, 9 aa, Homo Sapiens
WKSNCLPLH

SEQ ID NO: 1352893 - protein, 9 aa, Homo Sapiens
IYIVGGVST

SEQ ID NO: 1352894 - protein, 9 aa, Homo Sapiens
AHTKDIPFT

SEQ ID NO: 1352895 - protein, 9 aa, Homo Sapiens
NPVFMASGV

SEQ ID NO: 1352896 - protein, 9 aa, Homo Sapiens
LRRMTLEIG

SEQ ID NO: 1352897 - protein, 9 aa, Homo Sapiens
KDMPSSSMS

SEQ ID NO: 1352898 - protein, 9 aa, Homo Sapiens
DVSLVEVCR

SEQ ID NO: 1352899 - protein, 9 aa, Homo Sapiens
MWDQEERMW

SEQ ID NO: 1352900 - protein, 9 aa, Homo Sapiens
TGASTAARS

SEQ ID NO: 1352901 - protein, 9 aa, Homo Sapiens
THVTLLIYC

SEQ ID NO: 1352902 - protein, 9 aa, Homo Sapiens
HLTWLTVST

SEQ ID NO: 1352903 - protein, 9 aa, Homo Sapiens
PDLGDAVPP

SEQ ID NO: 1352904 - protein, 9 aa, Homo Sapiens
NLYGLLVNE

SEQ ID NO: 1352905 - protein, 9 aa, Homo Sapiens
AAEQKYVGK

SEQ ID NO: 1352906 - protein, 9 aa, Homo Sapiens
RLLLPHQRS

SEQ ID NO: 1352907 - protein, 9 aa, Homo Sapiens
TSLNFFKTI

SEQ ID NO: 1352908 - protein, 9 aa, Homo Sapiens
KEIEWMVSI

SEQ ID NO: 1352909 - protein, 9 aa, Homo Sapiens
NRGETRENV

SEQ ID NO: 1352910 - protein, 9 aa, Homo Sapiens
NTSCHPATL

SEQ ID NO: 1352911 - protein, 9 aa, Homo Sapiens
FLDLLELPI

SEQ ID NO: 1352912 - protein, 9 aa, Homo Sapiens
HARFNCTVS

SEQ ID NO: 1352913 - protein, 9 aa, Homo Sapiens
EYHPDKDEG

SEQ ID NO: 1352914 - protein, 9 aa, Homo Sapiens
HLGHPEPNH

SEQ ID NO: 1352915 - protein, 9 aa, Homo Sapiens
QTPQPHLCR

SEQ ID NO: 1352916 - protein, 9 aa, Homo Sapiens
RLGLVNDIV

SEQ ID NO: 1352917 - protein, 9 aa, Homo Sapiens
LSHKSSDAS

SEQ ID NO: 1352918 - protein, 9 aa, Homo Sapiens
ILDRKKKSR

SEQ ID NO: 1352919 - protein, 9 aa, Homo Sapiens
SDTPPWTGS

SEQ ID NO: 1352920 - protein, 9 aa, Homo Sapiens
NLNRSGKCG

SEQ ID NO: 1352921 - protein, 9 aa, Homo Sapiens
VQGPLPNQH

SEQ ID NO: 1352922 - protein, 9 aa, Homo Sapiens
CRFSPTRTR

SEQ ID NO: 1352923 - protein, 9 aa, Homo Sapiens
NLTTYRSKC

SEQ ID NO: 1352924 - protein, 9 aa, Homo Sapiens
VTVQGNYED

SEQ ID NO: 1352925 - protein, 9 aa, Homo Sapiens
AVLWDSNGK

SEQ ID NO: 1352926 - protein, 9 aa, Homo Sapiens
YIASVQGSA

SEQ ID NO: 1352927 - protein, 9 aa, Homo Sapiens
SGWPVFPIG

SEQ ID NO: 1352928 - protein, 9 aa, Homo Sapiens
ITLKWLLGR

SEQ ID NO: 1352929 - protein, 9 aa, Homo Sapiens
RSYQRRGKS

SEQ ID NO: 1352930 - protein, 9 aa, Homo Sapiens
HCFRTHEMP

SEQ ID NO: 1352931 - protein, 9 aa, Homo Sapiens
EMSCNRIAE

SEQ ID NO: 1352932 - protein, 9 aa, Homo Sapiens
KYVVMVIDR

SEQ ID NO: 1352933 - protein, 9 aa, Homo Sapiens
QEIEFLQNM

SEQ ID NO: 1352934 - protein, 9 aa, Homo Sapiens
QVWLDPGAG

SEQ ID NO: 1352935 - protein, 9 aa, Homo Sapiens
LKQVDFSCY

SEQ ID NO: 1352936 - protein, 9 aa, Homo Sapiens
SQHDDISRL

SEQ ID NO: 1352937 - protein, 9 aa, Homo Sapiens
VINGSNLPR

SEQ ID NO: 1352938 - protein, 9 aa, Homo Sapiens
GQDILDDLY

SEQ ID NO: 1352939 - protein, 9 aa, Homo Sapiens
RRMVVEYLR

SEQ ID NO: 1352940 - protein, 9 aa, Homo Sapiens
WESRWRAWS

SEQ ID NO: 1352941 - protein, 9 aa, Homo Sapiens
PTIVNNVKL

SEQ ID NO: 1352942 - protein, 9 aa, Homo Sapiens
FCLFFTSVP

SEQ ID NO: 1352943 - protein, 9 aa, Homo Sapiens
LWETIKFMY

SEQ ID NO: 1352944 - protein, 9 aa, Homo Sapiens
RLLIKGNSV

SEQ ID NO: 1352945 - protein, 9 aa, Homo Sapiens
FQRLVLSRQ

SEQ ID NO: 1352946 - protein, 9 aa, Homo Sapiens
HQSTAVAGG

SEQ ID NO: 1352947 - protein, 9 aa, Homo Sapiens
TPKEKDTEG

SEQ ID NO: 1352948 - protein, 9 aa, Homo Sapiens
TWRAMGGAV

SEQ ID NO: 1352949 - protein, 9 aa, Homo Sapiens
TTSVLEHLK

SEQ ID NO: 1352950 - protein, 9 aa, Homo Sapiens
VLSGHRFLY

SEQ ID NO: 1352951 - protein, 9 aa, Homo Sapiens
RHSALHLAA

SEQ ID NO: 1352952 - protein, 9 aa, Homo Sapiens
KDQQEKEKK

SEQ ID NO: 1352953 - protein, 9 aa, Homo Sapiens
VSVATCKQL

SEQ ID NO: 1352954 - protein, 9 aa, Homo Sapiens
SRTLGNCGP

SEQ ID NO: 1352955 - protein, 9 aa, Homo Sapiens
LEKVMTEAK

SEQ ID NO: 1352956 - protein, 9 aa, Homo Sapiens
PTKSKDARV

SEQ ID NO: 1352957 - protein, 9 aa, Homo Sapiens
ATGGFGCFL

SEQ ID NO: 1352958 - protein, 9 aa, Homo Sapiens
NARVLKGSH

SEQ ID NO: 1352959 - protein, 9 aa, Homo Sapiens
EIDKNMLDS

SEQ ID NO: 1352960 - protein, 9 aa, Homo Sapiens
KDHFAWQSP

SEQ ID NO: 1352961 - protein, 9 aa, Homo Sapiens
GNWRWGSTA

SEQ ID NO: 1352962 - protein, 9 aa, Homo Sapiens
HFLENSSRD

SEQ ID NO: 1352963 - protein, 9 aa, Homo Sapiens
LPMEQAHYL

SEQ ID NO: 1352964 - protein, 9 aa, Homo Sapiens
IDKIWPKLW

SEQ ID NO: 1352965 - protein, 9 aa, Homo Sapiens
YGEKEDPED

SEQ ID NO: 1352966 - protein, 9 aa, Homo Sapiens
KNYELRIFG

SEQ ID NO: 1352967 - protein, 9 aa, Homo Sapiens
TLYCHQLNI

SEQ ID NO: 1352968 - protein, 9 aa, Homo Sapiens
DMCNHTSGL

SEQ ID NO: 1352969 - protein, 9 aa, Homo Sapiens
EETVGGQTL

SEQ ID NO: 1352970 - protein, 9 aa, Homo Sapiens
IEHQRVHTK

SEQ ID NO: 1352971 - protein, 9 aa, Homo Sapiens
DLQDFNTES

SEQ ID NO: 1352972 - protein, 9 aa, Homo Sapiens
CTPPHRSEP

SEQ ID NO: 1352973 - protein, 9 aa, Homo Sapiens
QNILATCLS

SEQ ID NO: 1352974 - protein, 9 aa, Homo Sapiens
GYCPNHPII

SEQ ID NO: 1352975 - protein, 9 aa, Homo Sapiens
DECDVSAVR

SEQ ID NO: 1352976 - protein, 9 aa, Homo Sapiens
QEEMEVCDE

SEQ ID NO: 1352977 - protein, 9 aa, Homo Sapiens
AEVVELQLR

SEQ ID NO: 1352978 - protein, 9 aa, Homo Sapiens
FKEVICSSL

SEQ ID NO: 1352979 - protein, 9 aa, Homo Sapiens
LYTDTEMKS

SEQ ID NO: 1352980 - protein, 9 aa, Homo Sapiens
ITRNRDDPA

SEQ ID NO: 1352981 - protein, 9 aa, Homo Sapiens
LHPSYLYNH

SEQ ID NO: 1352982 - protein, 9 aa, Homo Sapiens
VQAHCGAGD

SEQ ID NO: 1352983 - protein, 9 aa, Homo Sapiens
STSRRTRPN

SEQ ID NO: 1352984 - protein, 9 aa, Homo Sapiens
VIINCDRFY

SEQ ID NO: 1352985 - protein, 9 aa, Homo Sapiens
EFKSEKGCN

SEQ ID NO: 1352986 - protein, 9 aa, Homo Sapiens
CQQYIQFIS

SEQ ID NO: 1352987 - protein, 9 aa, Homo Sapiens
SLWTTPLLS

SEQ ID NO: 1352988 - protein, 9 aa, Homo Sapiens
DIDLSVPQI

SEQ ID NO: 1352989 - protein, 9 aa, Homo Sapiens
YFTGDYTPR

SEQ ID NO: 1352990 - protein, 9 aa, Homo Sapiens
FRVPTFGWV

SEQ ID NO: 1352991 - protein, 9 aa, Homo Sapiens
SEPHEMSAL

SEQ ID NO: 1352992 - protein, 9 aa, Homo Sapiens
SEAPALPKT

SEQ ID NO: 1352993 - protein, 9 aa, Homo Sapiens
ENCLLACGS

SEQ ID NO: 1352994 - protein, 9 aa, Homo Sapiens
TLNSNTWMN

SEQ ID NO: 1352995 - protein, 9 aa, Homo Sapiens
AVRHPIFRP

SEQ ID NO: 1352996 - protein, 9 aa, Homo Sapiens
LHYLARVAT

SEQ ID NO: 1352997 - protein, 9 aa, Homo Sapiens
GLDFDTKAV

SEQ ID NO: 1352998 - protein, 9 aa, Homo Sapiens
HPVNVPRDE

SEQ ID NO: 1352999 - protein, 9 aa, Homo Sapiens
GVASSCHAC

SEQ ID NO: 1353000 - protein, 9 aa, Homo Sapiens
RHGWCTGAI

SEQ ID NO: 1353001 - protein, 9 aa, Homo Sapiens
PPLILWPQA

SEQ ID NO: 1353002 - protein, 9 aa, Homo Sapiens
LNQFMTVYK

SEQ ID NO: 1353003 - protein, 9 aa, Homo Sapiens
YWPAEHSAR

SEQ ID NO: 1353004 - protein, 9 aa, Homo Sapiens
IGAVDEEGC

SEQ ID NO: 1353005 - protein, 9 aa, Homo Sapiens
GSGQHDLDL

SEQ ID NO: 1353006 - protein, 9 aa, Homo Sapiens
YPDVNRRIE

SEQ ID NO: 1353007 - protein, 9 aa, Homo Sapiens
EAMTHGCFL

SEQ ID NO: 1353008 - protein, 9 aa, Homo Sapiens
NVLLELRQL

SEQ ID NO: 1353009 - protein, 9 aa, Homo Sapiens
CEIPWKLDK

SEQ ID NO: 1353010 - protein, 9 aa, Homo Sapiens
RLQKGLDRR

SEQ ID NO: 1353011 - protein, 9 aa, Homo Sapiens
PAMQRTMCT

SEQ ID NO: 1353012 - protein, 9 aa, Homo Sapiens
QHLLKPVKH

SEQ ID NO: 1353013 - protein, 9 aa, Homo Sapiens
CSEVGLPAE

SEQ ID NO: 1353014 - protein, 9 aa, Homo Sapiens
SVALPAPAF

SEQ ID NO: 1353015 - protein, 9 aa, Homo Sapiens
MPSSSMSSP

SEQ ID NO: 1353016 - protein, 9 aa, Homo Sapiens
VRIVSGSHD

SEQ ID NO: 1353017 - protein, 9 aa, Homo Sapiens
NHPEFEEDS

SEQ ID NO: 1353018 - protein, 9 aa, Homo Sapiens
EVDKVFWNT

SEQ ID NO: 1353019 - protein, 9 aa, Homo Sapiens
SENMLCDEE

SEQ ID NO: 1353020 - protein, 9 aa, Homo Sapiens
NAVCTGHHH

SEQ ID NO: 1353021 - protein, 9 aa, Homo Sapiens
KESKLVANQ

SEQ ID NO: 1353022 - protein, 9 aa, Homo Sapiens
TVSERKNCC

SEQ ID NO: 1353023 - protein, 9 aa, Homo Sapiens
NFWVTSSMS

SEQ ID NO: 1353024 - protein, 9 aa, Homo Sapiens
LSKILTLRI

SEQ ID NO: 1353025 - protein, 9 aa, Homo Sapiens
GVLCHQLGC

SEQ ID NO: 1353026 - protein, 9 aa, Homo Sapiens
VNRRQRRRK

SEQ ID NO: 1353027 - protein, 9 aa, Homo Sapiens
KVVRHFHSP

SEQ ID NO: 1353028 - protein, 9 aa, Homo Sapiens
QLGLDWQCR

SEQ ID NO: 1353029 - protein, 9 aa, Homo Sapiens
QQIHQDILA

SEQ ID NO: 1353030 - protein, 9 aa, Homo Sapiens
FEDLKQCLG

SEQ ID NO: 1353031 - protein, 9 aa, Homo Sapiens
FTYHVLMCG

SEQ ID NO: 1353032 - protein, 9 aa, Homo Sapiens
WWYQRCCQT

SEQ ID NO: 1353033 - protein, 9 aa, Homo Sapiens
IHSLQGRLK

SEQ ID NO: 1353034 - protein, 9 aa, Homo Sapiens
KLRTHICCL

SEQ ID NO: 1353035 - protein, 9 aa, Homo Sapiens
KELAILLCD

SEQ ID NO: 1353036 - protein, 9 aa, Homo Sapiens
KAVLRSWYE

SEQ ID NO: 1353037 - protein, 9 aa, Homo Sapiens
YYYNKHILH

SEQ ID NO: 1353038 - protein, 9 aa, Homo Sapiens
VWYRHYFRL

SEQ ID NO: 1353039 - protein, 9 aa, Homo Sapiens
TGNLYLWGP

SEQ ID NO: 1353040 - protein, 9 aa, Homo Sapiens
GETKCAPAA

SEQ ID NO: 1353041 - protein, 9 aa, Homo Sapiens
IMSLVRSAC

SEQ ID NO: 1353042 - protein, 9 aa, Homo Sapiens
RRSWQRRRL

SEQ ID NO: 1353043 - protein, 9 aa, Homo Sapiens
SERKNCCAL

SEQ ID NO: 1353044 - protein, 9 aa, Homo Sapiens
KFTDTYQAF

SEQ ID NO: 1353045 - protein, 9 aa, Homo Sapiens
EELRMRERE

SEQ ID NO: 1353046 - protein, 9 aa, Homo Sapiens
EGQLRVYGA

SEQ ID NO: 1353047 - protein, 9 aa, Homo Sapiens
YLHNCETRC

SEQ ID NO: 1353048 - protein, 9 aa, Homo Sapiens
KSKEWYHAS

SEQ ID NO: 1353049 - protein, 9 aa, Homo Sapiens
VPGAHPMPV

SEQ ID NO: 1353050 - protein, 9 aa, Homo Sapiens
VEHRCLLFM

SEQ ID NO: 1353051 - protein, 9 aa, Homo Sapiens
PVQWHSKVW

SEQ ID NO: 1353052 - protein, 9 aa, Homo Sapiens
SSQKTKRMH

SEQ ID NO: 1353053 - protein, 9 aa, Homo Sapiens
YGLLVNEIS

SEQ ID NO: 1353054 - protein, 9 aa, Homo Sapiens
QLKQRMFEY

SEQ ID NO: 1353055 - protein, 9 aa, Homo Sapiens
GVHFVNQLW

SEQ ID NO: 1353056 - protein, 9 aa, Homo Sapiens
EYFLFIAEH

SEQ ID NO: 1353057 - protein, 9 aa, Homo Sapiens
PTPMMETQP

SEQ ID NO: 1353058 - protein, 9 aa, Homo Sapiens
VHLVSEFPY

SEQ ID NO: 1353059 - protein, 9 aa, Homo Sapiens
IFAVYVRRK

SEQ ID NO: 1353060 - protein, 9 aa, Homo Sapiens
SGVSVQDQL

SEQ ID NO: 1353061 - protein, 9 aa, Homo Sapiens
TLIFLPPVG

SEQ ID NO: 1353062 - protein, 9 aa, Homo Sapiens
IIITLSWLD

SEQ ID NO: 1353063 - protein, 9 aa, Homo Sapiens
GPDLEDLKH

SEQ ID NO: 1353064 - protein, 9 aa, Homo Sapiens
GSMVHVYEQ

SEQ ID NO: 1353065 - protein, 9 aa, Homo Sapiens
SLEESPYTP

SEQ ID NO: 1353066 - protein, 9 aa, Homo Sapiens
DSAKERVSS

SEQ ID NO: 1353067 - protein, 9 aa, Homo Sapiens
RNKDRPVMQ

SEQ ID NO: 1353068 - protein, 9 aa, Homo Sapiens
VLKILTNES

SEQ ID NO: 1353069 - protein, 9 aa, Homo Sapiens
QYHRIGGGS

SEQ ID NO: 1353070 - protein, 9 aa, Homo Sapiens
KMDGEVMSV

SEQ ID NO: 1353071 - protein, 9 aa, Homo Sapiens
HVLKMEPAD

SEQ ID NO: 1353072 - protein, 9 aa, Homo Sapiens
IILMWTYLK

SEQ ID NO: 1353073 - protein, 9 aa, Homo Sapiens
GGIIYKLGG

SEQ ID NO: 1353074 - protein, 9 aa, Homo Sapiens
DKPTTPVSP

SEQ ID NO: 1353075 - protein, 9 aa, Homo Sapiens
CLGHRLQLT

SEQ ID NO: 1353076 - protein, 9 aa, Homo Sapiens
KLQPLVTSY

SEQ ID NO: 1353077 - protein, 9 aa, Homo Sapiens
VETLTIQRL

SEQ ID NO: 1353078 - protein, 9 aa, Homo Sapiens
KASYPKRLG

SEQ ID NO: 1353079 - protein, 9 aa, Homo Sapiens
QETTYVSSL

SEQ ID NO: 1353080 - protein, 9 aa, Homo Sapiens
KVMTEAKMK

SEQ ID NO: 1353081 - protein, 9 aa, Homo Sapiens
QAPGHISTS

SEQ ID NO: 1353082 - protein, 9 aa, Homo Sapiens
YNLMIEVSD

SEQ ID NO: 1353083 - protein, 9 aa, Homo Sapiens
AVSAVVHKY

SEQ ID NO: 1353084 - protein, 9 aa, Homo Sapiens
LLEEILKQL

SEQ ID NO: 1353085 - protein, 9 aa, Homo Sapiens
EIIGSLDTE

SEQ ID NO: 1353086 - protein, 9 aa, Homo Sapiens
PAATQPTKE

SEQ ID NO: 1353087 - protein, 9 aa, Homo Sapiens
AIDFIDCVS

SEQ ID NO: 1353088 - protein, 9 aa, Homo Sapiens
EFERLHRLL

SEQ ID NO: 1353089 - protein, 9 aa, Homo Sapiens
AYNQVERHT

SEQ ID NO: 1353090 - protein, 9 aa, Homo Sapiens
LLDIDEREY

SEQ ID NO: 1353091 - protein, 9 aa, Homo Sapiens
TAVERSLKT

SEQ ID NO: 1353092 - protein, 9 aa, Homo Sapiens
ELSTLFDVD

SEQ ID NO: 1353093 - protein, 9 aa, Homo Sapiens
LIMMIKDKQ

SEQ ID NO: 1353094 - protein, 9 aa, Homo Sapiens
QVKTETVGP

SEQ ID NO: 1353095 - protein, 9 aa, Homo Sapiens
EAVTVSWFY

SEQ ID NO: 1353096 - protein, 9 aa, Homo Sapiens
WLDLILLKY

SEQ ID NO: 1353097 - protein, 9 aa, Homo Sapiens
WPGHQEVSV

SEQ ID NO: 1353098 - protein, 9 aa, Homo Sapiens
TMSLELDSR

SEQ ID NO: 1353099 - protein, 9 aa, Homo Sapiens
TLAIQRFNP

SEQ ID NO: 1353100 - protein, 9 aa, Homo Sapiens
WSIKLNWTG

SEQ ID NO: 1353101 - protein, 9 aa, Homo Sapiens
VSDAVVTYY

SEQ ID NO: 1353102 - protein, 9 aa, Homo Sapiens
HCVVGGYLS

SEQ ID NO: 1353103 - protein, 9 aa, Homo Sapiens
DRSPLCRAA

SEQ ID NO: 1353104 - protein, 9 aa, Homo Sapiens
LKEHMRVYD

SEQ ID NO: 1353105 - protein, 9 aa, Homo Sapiens
GRKRKRCQP

SEQ ID NO: 1353106 - protein, 9 aa, Homo Sapiens
KDKEKAAII

SEQ ID NO: 1353107 - protein, 9 aa, Homo Sapiens
SVPVKEDTQ

SEQ ID NO: 1353108 - protein, 9 aa, Homo Sapiens
IVIAYIIGR

SEQ ID NO: 1353109 - protein, 9 aa, Homo Sapiens
QHHLVHAQH

SEQ ID NO: 1353110 - protein, 9 aa, Homo Sapiens
DDPADIWPL

SEQ ID NO: 1353111 - protein, 9 aa, Homo Sapiens
EPSHFLRGA

SEQ ID NO: 1353112 - protein, 9 aa, Homo Sapiens
NVIENCICV

SEQ ID NO: 1353113 - protein, 9 aa, Homo Sapiens
TASTRPQSP

SEQ ID NO: 1353114 - protein, 9 aa, Homo Sapiens
LKQRRESLI

SEQ ID NO: 1353115 - protein, 9 aa, Homo Sapiens
RLVLSRQLC

SEQ ID NO: 1353116 - protein, 9 aa, Homo Sapiens
HTAEKLCKS

SEQ ID NO: 1353117 - protein, 9 aa, Homo Sapiens
ERCNQEAHQ

SEQ ID NO: 1353118 - protein, 9 aa, Homo Sapiens
EEPSHFLRG

SEQ ID NO: 1353119 - protein, 9 aa, Homo Sapiens
FWWLVDSAE

SEQ ID NO: 1353120 - protein, 9 aa, Homo Sapiens
ICLGNSFTH

SEQ ID NO: 1353121 - protein, 9 aa, Homo Sapiens
DLLELPIAS

SEQ ID NO: 1353122 - protein, 9 aa, Homo Sapiens
SNNIRLIPE

SEQ ID NO: 1353123 - protein, 9 aa, Homo Sapiens
GPVDKYRMR

SEQ ID NO: 1353124 - protein, 9 aa, Homo Sapiens
LAEASASQV

SEQ ID NO: 1353125 - protein, 9 aa, Homo Sapiens
EYGKAFNQG

SEQ ID NO: 1353126 - protein, 9 aa, Homo Sapiens
TPTTFSECP

SEQ ID NO: 1353127 - protein, 9 aa, Homo Sapiens
PSEVPSPMP

SEQ ID NO: 1353128 - protein, 9 aa, Homo Sapiens
EVQSEIEHI

SEQ ID NO: 1353129 - protein, 9 aa, Homo Sapiens
LVLQSVPVF

SEQ ID NO: 1353130 - protein, 9 aa, Homo Sapiens
GAKGICTLL

SEQ ID NO: 1353131 - protein, 9 aa, Homo Sapiens
GGRDVPEAA

SEQ ID NO: 1353132 - protein, 9 aa, Homo Sapiens
EELWASLET

SEQ ID NO: 1353133 - protein, 9 aa, Homo Sapiens
GFVTIPRNY

SEQ ID NO: 1353134 - protein, 9 aa, Homo Sapiens
LLFKELQPD

SEQ ID NO: 1353135 - protein, 9 aa, Homo Sapiens
LRGSGNTPK

SEQ ID NO: 1353136 - protein, 9 aa, Homo Sapiens
ELSSNPTAS

SEQ ID NO: 1353137 - protein, 9 aa, Homo Sapiens
WLQADMMDV

SEQ ID NO: 1353138 - protein, 9 aa, Homo Sapiens
LLGKCTYTS

SEQ ID NO: 1353139 - protein, 9 aa, Homo Sapiens
YAPYKYMLQ

SEQ ID NO: 1353140 - protein, 9 aa, Homo Sapiens
RFHASVCRL

SEQ ID NO: 1353141 - protein, 9 aa, Homo Sapiens
IQLDDIVIP

SEQ ID NO: 1353142 - protein, 9 aa, Homo Sapiens
QVTNGMEFL

SEQ ID NO: 1353143 - protein, 9 aa, Homo Sapiens
LWHLARASR

SEQ ID NO: 1353144 - protein, 9 aa, Homo Sapiens
DFVVKNYYF

SEQ ID NO: 1353145 - protein, 9 aa, Homo Sapiens
IGVRAGRDH

SEQ ID NO: 1353146 - protein, 9 aa, Homo Sapiens
ADTFHHLHH

SEQ ID NO: 1353147 - protein, 9 aa, Homo Sapiens
NQELHSQLA

SEQ ID NO: 1353148 - protein, 9 aa, Homo Sapiens
SRAERERAA

SEQ ID NO: 1353149 - protein, 9 aa, Homo Sapiens
KNLCQDMWW

SEQ ID NO: 1353150 - protein, 9 aa, Homo Sapiens
GRLLGNVVT

SEQ ID NO: 1353151 - protein, 9 aa, Homo Sapiens
KCIPHIIVL

SEQ ID NO: 1353152 - protein, 9 aa, Homo Sapiens
DRRFMLRMT

SEQ ID NO: 1353153 - protein, 9 aa, Homo Sapiens
TRAPQACSP

SEQ ID NO: 1353154 - protein, 9 aa, Homo Sapiens
QCAEGPKGK

SEQ ID NO: 1353155 - protein, 9 aa, Homo Sapiens
YKDKEKAAI

SEQ ID NO: 1353156 - protein, 9 aa, Homo Sapiens
RHITLRASN

SEQ ID NO: 1353157 - protein, 9 aa, Homo Sapiens
LDTYNKLTL

SEQ ID NO: 1353158 - protein, 9 aa, Homo Sapiens
NLINVCTKD

SEQ ID NO: 1353159 - protein, 9 aa, Homo Sapiens
IVCACWKPS

SEQ ID NO: 1353160 - protein, 9 aa, Homo Sapiens
VCFFTGQLL

SEQ ID NO: 1353161 - protein, 9 aa, Homo Sapiens
RPQGQHWIW

SEQ ID NO: 1353162 - protein, 9 aa, Homo Sapiens
GHHIVAPPG

SEQ ID NO: 1353163 - protein, 9 aa, Homo Sapiens
ISRVANHVL

SEQ ID NO: 1353164 - protein, 9 aa, Homo Sapiens
TIACLQFSV

SEQ ID NO: 1353165 - protein, 9 aa, Homo Sapiens
QFAVSLVDT

SEQ ID NO: 1353166 - protein, 9 aa, Homo Sapiens
LNEECLKGQ

SEQ ID NO: 1353167 - protein, 9 aa, Homo Sapiens
IPNNNPITM

SEQ ID NO: 1353168 - protein, 9 aa, Homo Sapiens
MTLEIGALH

SEQ ID NO: 1353169 - protein, 9 aa, Homo Sapiens
PNHPIIQWF

SEQ ID NO: 1353170 - protein, 9 aa, Homo Sapiens
QAINVALTQ

SEQ ID NO: 1353171 - protein, 9 aa, Homo Sapiens
TSSSSGSSF

SEQ ID NO: 1353172 - protein, 9 aa, Homo Sapiens
KDLRVKMMT

SEQ ID NO: 1353173 - protein, 9 aa, Homo Sapiens
NLDKRQSLN

SEQ ID NO: 1353174 - protein, 9 aa, Homo Sapiens
KYDLGNTLE

SEQ ID NO: 1353175 - protein, 9 aa, Homo Sapiens
SPCLLRFIL

SEQ ID NO: 1353176 - protein, 9 aa, Homo Sapiens
QQVVDMKKS

SEQ ID NO: 1353177 - protein, 9 aa, Homo Sapiens
LSKSGPGDD

SEQ ID NO: 1353178 - protein, 9 aa, Homo Sapiens
SFVPHICSL

SEQ ID NO: 1353179 - protein, 9 aa, Homo Sapiens
WSVTCRGER

SEQ ID NO: 1353180 - protein, 9 aa, Homo Sapiens
ICFGLSGLL

SEQ ID NO: 1353181 - protein, 9 aa, Homo Sapiens
DPHMIDYDS

SEQ ID NO: 1353182 - protein, 9 aa, Homo Sapiens
DISITSEVS

SEQ ID NO: 1353183 - protein, 9 aa, Homo Sapiens
HPVSQTQHT

SEQ ID NO: 1353184 - protein, 9 aa, Homo Sapiens
SWAVLSSST

SEQ ID NO: 1353185 - protein, 9 aa, Homo Sapiens
MFLEANIPH

SEQ ID NO: 1353186 - protein, 9 aa, Homo Sapiens
QAQRACCKS

SEQ ID NO: 1353187 - protein, 9 aa, Homo Sapiens
MRRRTPWSC

SEQ ID NO: 1353188 - protein, 9 aa, Homo Sapiens
EITCTALAV

SEQ ID NO: 1353189 - protein, 9 aa, Homo Sapiens
NGKMILGRK

SEQ ID NO: 1353190 - protein, 9 aa, Homo Sapiens
RSQWKHVFV

SEQ ID NO: 1353191 - protein, 9 aa, Homo Sapiens
FMYLTGNNI

SEQ ID NO: 1353192 - protein, 9 aa, Homo Sapiens
ESTVFMYLT

SEQ ID NO: 1353193 - protein, 9 aa, Homo Sapiens
ISFKYNRPV

SEQ ID NO: 1353194 - protein, 9 aa, Homo Sapiens
NNFQALKYV

SEQ ID NO: 1353195 - protein, 9 aa, Homo Sapiens
LQKGMRTVE

SEQ ID NO: 1353196 - protein, 9 aa, Homo Sapiens
LTRDAHLCP

SEQ ID NO: 1353197 - protein, 9 aa, Homo Sapiens
TASTRARSP

SEQ ID NO: 1353198 - protein, 9 aa, Homo Sapiens
LQEERAAGT

SEQ ID NO: 1353199 - protein, 9 aa, Homo Sapiens
GDNPNSLVI

SEQ ID NO: 1353200 - protein, 9 aa, Homo Sapiens
DTRSSGRRQ

SEQ ID NO: 1353201 - protein, 9 aa, Homo Sapiens
VHKNKTITC

SEQ ID NO: 1353202 - protein, 9 aa, Homo Sapiens
QTECGRRLS

SEQ ID NO: 1353203 - protein, 9 aa, Homo Sapiens
LGQKSQHYK

SEQ ID NO: 1353204 - protein, 9 aa, Homo Sapiens
QGSTVVWAF

SEQ ID NO: 1353205 - protein, 9 aa, Homo Sapiens
LGLFLQCTI

SEQ ID NO: 1353206 - protein, 9 aa, Homo Sapiens
KWGQSPSPT

SEQ ID NO: 1353207 - protein, 9 aa, Homo Sapiens
LTSHLRIHT

SEQ ID NO: 1353208 - protein, 9 aa, Homo Sapiens
PYPAQWPPG

SEQ ID NO: 1353209 - protein, 9 aa, Homo Sapiens
HKVDFILQW

SEQ ID NO: 1353210 - protein, 9 aa, Homo Sapiens
FTFVTFESP

SEQ ID NO: 1353211 - protein, 9 aa, Homo Sapiens
HLGTGLSPT

SEQ ID NO: 1353212 - protein, 9 aa, Homo Sapiens
GVLTPRGSI

SEQ ID NO: 1353213 - protein, 9 aa, Homo Sapiens
SVKSLHLLV

SEQ ID NO: 1353214 - protein, 9 aa, Homo Sapiens
LLIFHSLDR

SEQ ID NO: 1353215 - protein, 9 aa, Homo Sapiens
EPLHTIFLK

SEQ ID NO: 1353216 - protein, 9 aa, Homo Sapiens
NDLIRYLRH

SEQ ID NO: 1353217 - protein, 9 aa, Homo Sapiens
HRRSVSQDL

SEQ ID NO: 1353218 - protein, 9 aa, Homo Sapiens
KGLSLSYGP

SEQ ID NO: 1353219 - protein, 9 aa, Homo Sapiens
HLSFISIDH

SEQ ID NO: 1353220 - protein, 9 aa, Homo Sapiens
GSLVSAWEV

SEQ ID NO: 1353221 - protein, 9 aa, Homo Sapiens
YTVAIPMLS

SEQ ID NO: 1353222 - protein, 9 aa, Homo Sapiens
LMIFAGRKK

SEQ ID NO: 1353223 - protein, 9 aa, Homo Sapiens
SLLQGYRIY

SEQ ID NO: 1353224 - protein, 9 aa, Homo Sapiens
LNVQPHHKI

SEQ ID NO: 1353225 - protein, 9 aa, Homo Sapiens
AGDWHYQDI

SEQ ID NO: 1353226 - protein, 9 aa, Homo Sapiens
MWLLWLFHP

SEQ ID NO: 1353227 - protein, 9 aa, Homo Sapiens
SIRCHYRDK

SEQ ID NO: 1353228 - protein, 9 aa, Homo Sapiens
TPQCLKKNS

SEQ ID NO: 1353229 - protein, 9 aa, Homo Sapiens
QGPLKDYIF

SEQ ID NO: 1353230 - protein, 9 aa, Homo Sapiens
PVTKRCSPS

SEQ ID NO: 1353231 - protein, 9 aa, Homo Sapiens
GLMCLGFLR

SEQ ID NO: 1353232 - protein, 9 aa, Homo Sapiens
LQSQLSMKS

SEQ ID NO: 1353233 - protein, 9 aa, Homo Sapiens
ETAGENSEK

SEQ ID NO: 1353234 - protein, 9 aa, Homo Sapiens
HYYSRCLAP

SEQ ID NO: 1353235 - protein, 9 aa, Homo Sapiens
SGMELQSWC

SEQ ID NO: 1353236 - protein, 9 aa, Homo Sapiens
KEGNHLLGG

SEQ ID NO: 1353237 - protein, 9 aa, Homo Sapiens
VPPGSREVY

SEQ ID NO: 1353238 - protein, 9 aa, Homo Sapiens
SYWDHCVVG

SEQ ID NO: 1353239 - protein, 9 aa, Homo Sapiens
YLMHASLYL

SEQ ID NO: 1353240 - protein, 9 aa, Homo Sapiens
DVVKERICL

SEQ ID NO: 1353241 - protein, 9 aa, Homo Sapiens
VTVCIENME

SEQ ID NO: 1353242 - protein, 9 aa, Homo Sapiens
EKGSKEHHS

SEQ ID NO: 1353243 - protein, 9 aa, Homo Sapiens
DGLTTPAQP

SEQ ID NO: 1353244 - protein, 9 aa, Homo Sapiens
RPDAKDVLI

SEQ ID NO: 1353245 - protein, 9 aa, Homo Sapiens
RCSASSGSS

SEQ ID NO: 1353246 - protein, 9 aa, Homo Sapiens
GLQFWEGPV

SEQ ID NO: 1353247 - protein, 9 aa, Homo Sapiens
GLEGSVMSN

SEQ ID NO: 1353248 - protein, 9 aa, Homo Sapiens
PLLNPYMLA

SEQ ID NO: 1353249 - protein, 9 aa, Homo Sapiens
MCKAVAEEL

SEQ ID NO: 1353250 - protein, 9 aa, Homo Sapiens
KHQVQQHKV

SEQ ID NO: 1353251 - protein, 9 aa, Homo Sapiens
SLAGGSGGH

SEQ ID NO: 1353252 - protein, 9 aa, Homo Sapiens
IEQVQHTCQ

SEQ ID NO: 1353253 - protein, 9 aa, Homo Sapiens
FSVFGMCVN

SEQ ID NO: 1353254 - protein, 9 aa, Homo Sapiens
LKGSHARFN

SEQ ID NO: 1353255 - protein, 9 aa, Homo Sapiens
PQDRPFDDT

SEQ ID NO: 1353256 - protein, 9 aa, Homo Sapiens
PACLKVSAD

SEQ ID NO: 1353257 - protein, 9 aa, Homo Sapiens
ACSTKIDCV

SEQ ID NO: 1353258 - protein, 9 aa, Homo Sapiens
VCIPMHGPL

SEQ ID NO: 1353259 - protein, 9 aa, Homo Sapiens
WVQLGTQKV

SEQ ID NO: 1353260 - protein, 9 aa, Homo Sapiens
NRFVQVHPI

SEQ ID NO: 1353261 - protein, 9 aa, Homo Sapiens
LDTYIPLQI

SEQ ID NO: 1353262 - protein, 9 aa, Homo Sapiens
VEISRVANH

SEQ ID NO: 1353263 - protein, 9 aa, Homo Sapiens
SDTIKFVLR

SEQ ID NO: 1353264 - protein, 9 aa, Homo Sapiens
GMSGCGSFA

SEQ ID NO: 1353265 - protein, 9 aa, Homo Sapiens
GHQGSWGVS

SEQ ID NO: 1353266 - protein, 9 aa, Homo Sapiens
MEGESLLMA

SEQ ID NO: 1353267 - protein, 9 aa, Homo Sapiens
KQVIILNSS

SEQ ID NO: 1353268 - protein, 9 aa, Homo Sapiens
TRSDSENWR

SEQ ID NO: 1353269 - protein, 9 aa, Homo Sapiens
RSPPLCALH

SEQ ID NO: 1353270 - protein, 9 aa, Homo Sapiens
RLETEMRRR

SEQ ID NO: 1353271 - protein, 9 aa, Homo Sapiens
GTALTPPSP

SEQ ID NO: 1353272 - protein, 9 aa, Homo Sapiens
LDPSSPTSP

SEQ ID NO: 1353273 - protein, 9 aa, Homo Sapiens
QIKFHAVKN

SEQ ID NO: 1353274 - protein, 9 aa, Homo Sapiens
LSVRNVGRC

SEQ ID NO: 1353275 - protein, 9 aa, Homo Sapiens
SHQESTCGR

SEQ ID NO: 1353276 - protein, 9 aa, Homo Sapiens
WQAGQRHSP

SEQ ID NO: 1353277 - protein, 9 aa, Homo Sapiens
DASVACQNE

SEQ ID NO: 1353278 - protein, 9 aa, Homo Sapiens
RARNIIQST

SEQ ID NO: 1353279 - protein, 9 aa, Homo Sapiens
TESIQVCKL

SEQ ID NO: 1353280 - protein, 9 aa, Homo Sapiens
PYPSTCSLE

SEQ ID NO: 1353281 - protein, 9 aa, Homo Sapiens
GGKGTWQWI

SEQ ID NO: 1353282 - protein, 9 aa, Homo Sapiens
LRVERSPSP

SEQ ID NO: 1353283 - protein, 9 aa, Homo Sapiens
DTEGTELSR

SEQ ID NO: 1353284 - protein, 9 aa, Homo Sapiens
RHYECAACG

SEQ ID NO: 1353285 - protein, 9 aa, Homo Sapiens
RKQGTGSLQ

SEQ ID NO: 1353286 - protein, 9 aa, Homo Sapiens
TPTMESVCG

SEQ ID NO: 1353287 - protein, 9 aa, Homo Sapiens
ATARRPSTA

SEQ ID NO: 1353288 - protein, 9 aa, Homo Sapiens
YLTSSPEVE

SEQ ID NO: 1353289 - protein, 9 aa, Homo Sapiens
ILEEHRKDL

SEQ ID NO: 1353290 - protein, 9 aa, Homo Sapiens
VAVRLYRRS

SEQ ID NO: 1353291 - protein, 9 aa, Homo Sapiens
INELFVTEV

SEQ ID NO: 1353292 - protein, 9 aa, Homo Sapiens
VHKVAERLD

SEQ ID NO: 1353293 - protein, 9 aa, Homo Sapiens
WVVFPNNSI

SEQ ID NO: 1353294 - protein, 9 aa, Homo Sapiens
DGFNMRVPL

SEQ ID NO: 1353295 - protein, 9 aa, Homo Sapiens
KFMMQSRLE

SEQ ID NO: 1353296 - protein, 9 aa, Homo Sapiens
QRASKIGEV

SEQ ID NO: 1353297 - protein, 9 aa, Homo Sapiens
VLKWMVIIF

SEQ ID NO: 1353298 - protein, 9 aa, Homo Sapiens
GALGTRKVG

SEQ ID NO: 1353299 - protein, 9 aa, Homo Sapiens
PCHAAALAL

SEQ ID NO: 1353300 - protein, 9 aa, Homo Sapiens
LCHINSLWT

SEQ ID NO: 1353301 - protein, 9 aa, Homo Sapiens
KWQTVITTM

SEQ ID NO: 1353302 - protein, 9 aa, Homo Sapiens
VRSAACPTA

SEQ ID NO: 1353303 - protein, 9 aa, Homo Sapiens
SALMTAIDG

SEQ ID NO: 1353304 - protein, 9 aa, Homo Sapiens
QEQKMWDQE

SEQ ID NO: 1353305 - protein, 9 aa, Homo Sapiens
ALRDGVKCC

SEQ ID NO: 1353306 - protein, 9 aa, Homo Sapiens
GDDWHCLQR

SEQ ID NO: 1353307 - protein, 9 aa, Homo Sapiens
QDGSCTEQK

SEQ ID NO: 1353308 - protein, 9 aa, Homo Sapiens
EGIPDGVCS

SEQ ID NO: 1353309 - protein, 9 aa, Homo Sapiens
LKRTALQRP

SEQ ID NO: 1353310 - protein, 9 aa, Homo Sapiens
GIMCIYKGD

SEQ ID NO: 1353311 - protein, 9 aa, Homo Sapiens
FNSLNEVTM

SEQ ID NO: 1353312 - protein, 9 aa, Homo Sapiens
IFFKATRQN

SEQ ID NO: 1353313 - protein, 9 aa, Homo Sapiens
SPEENIIIK

SEQ ID NO: 1353314 - protein, 9 aa, Homo Sapiens
QACSPERAR

SEQ ID NO: 1353315 - protein, 9 aa, Homo Sapiens
IDNKHILSE

SEQ ID NO: 1353316 - protein, 9 aa, Homo Sapiens
ADHLPQLIL

SEQ ID NO: 1353317 - protein, 9 aa, Homo Sapiens
RTGAEWNSP

SEQ ID NO: 1353318 - protein, 9 aa, Homo Sapiens
TLSHLHRLN

SEQ ID NO: 1353319 - protein, 9 aa, Homo Sapiens
VDPNDLYLM

SEQ ID NO: 1353320 - protein, 9 aa, Homo Sapiens
KIEEMWRLW

SEQ ID NO: 1353321 - protein, 9 aa, Homo Sapiens
AHWQVHHHA

SEQ ID NO: 1353322 - protein, 9 aa, Homo Sapiens
GPELDADSY

SEQ ID NO: 1353323 - protein, 9 aa, Homo Sapiens
VEYIKSFGF

SEQ ID NO: 1353324 - protein, 9 aa, Homo Sapiens
PHGKTHHPH

SEQ ID NO: 1353325 - protein, 9 aa, Homo Sapiens
YHRGHYFKV

SEQ ID NO: 1353326 - protein, 9 aa, Homo Sapiens
TTVSLNIRK

SEQ ID NO: 1353327 - protein, 9 aa, Homo Sapiens
AQAWKEVQL

SEQ ID NO: 1353328 - protein, 9 aa, Homo Sapiens
VLLIKRRRL

SEQ ID NO: 1353329 - protein, 9 aa, Homo Sapiens
AALSNVTPR

SEQ ID NO: 1353330 - protein, 9 aa, Homo Sapiens
DEISKLCKL

SEQ ID NO: 1353331 - protein, 9 aa, Homo Sapiens
YTSLTTLPS

SEQ ID NO: 1353332 - protein, 9 aa, Homo Sapiens
NCICVNMSV

SEQ ID NO: 1353333 - protein, 9 aa, Homo Sapiens
DPLTYDSVR

SEQ ID NO: 1353334 - protein, 9 aa, Homo Sapiens
PTTWPPSRN

SEQ ID NO: 1353335 - protein, 9 aa, Homo Sapiens
IIQSSTGEY

SEQ ID NO: 1353336 - protein, 9 aa, Homo Sapiens
QDMWWYQRC

SEQ ID NO: 1353337 - protein, 9 aa, Homo Sapiens
SLGHNDPTD

SEQ ID NO: 1353338 - protein, 9 aa, Homo Sapiens
KIFEKIYLA

SEQ ID NO: 1353339 - protein, 9 aa, Homo Sapiens
KFWWERADM

SEQ ID NO: 1353340 - protein, 9 aa, Homo Sapiens
DMLQRDGLA

SEQ ID NO: 1353341 - protein, 9 aa, Homo Sapiens
TMQNLNNRL

SEQ ID NO: 1353342 - protein, 9 aa, Homo Sapiens
LLKPITGRT

SEQ ID NO: 1353343 - protein, 9 aa, Homo Sapiens
TVVEEDGRE

SEQ ID NO: 1353344 - protein, 9 aa, Homo Sapiens
TTGWLERAY

SEQ ID NO: 1353345 - protein, 9 aa, Homo Sapiens
SKGNNKHIK

SEQ ID NO: 1353346 - protein, 9 aa, Homo Sapiens
DTKVEYMKL

SEQ ID NO: 1353347 - protein, 9 aa, Homo Sapiens
THAFTPCGY

SEQ ID NO: 1353348 - protein, 9 aa, Homo Sapiens
DYTTDDIEF

SEQ ID NO: 1353349 - protein, 9 aa, Homo Sapiens
NEQKVLVNV

SEQ ID NO: 1353350 - protein, 9 aa, Homo Sapiens
AARACFRSC

SEQ ID NO: 1353351 - protein, 9 aa, Homo Sapiens
GRGVSIGSI

SEQ ID NO: 1353352 - protein, 9 aa, Homo Sapiens
SPWMMVIGF

SEQ ID NO: 1353353 - protein, 9 aa, Homo Sapiens
PTEEKLLKL

SEQ ID NO: 1353354 - protein, 9 aa, Homo Sapiens
QAPAKMSSL

SEQ ID NO: 1353355 - protein, 9 aa, Homo Sapiens
NCRVRRGTG

SEQ ID NO: 1353356 - protein, 9 aa, Homo Sapiens
SVVVYVYVK

SEQ ID NO: 1353357 - protein, 9 aa, Homo Sapiens
LILRSPRVF

SEQ ID NO: 1353358 - protein, 9 aa, Homo Sapiens
SSTTYNTQE

SEQ ID NO: 1353359 - protein, 9 aa, Homo Sapiens
AATHGYSFT

SEQ ID NO: 1353360 - protein, 9 aa, Homo Sapiens
WAHQLFHRI

SEQ ID NO: 1353361 - protein, 9 aa, Homo Sapiens
GDSWKEYFC

SEQ ID NO: 1353362 - protein, 9 aa, Homo Sapiens
DRVVAIFVQ

SEQ ID NO: 1353363 - protein, 9 aa, Homo Sapiens
EKGRQCEWC

SEQ ID NO: 1353364 - protein, 9 aa, Homo Sapiens
IIPELLTKL

SEQ ID NO: 1353365 - protein, 9 aa, Homo Sapiens
ITQIEDVTE

SEQ ID NO: 1353366 - protein, 9 aa, Homo Sapiens
QVISPQCIP

SEQ ID NO: 1353367 - protein, 9 aa, Homo Sapiens
AHSIYPITR

SEQ ID NO: 1353368 - protein, 9 aa, Homo Sapiens
DSKRCSAKE

SEQ ID NO: 1353369 - protein, 9 aa, Homo Sapiens
EATAARAVV

SEQ ID NO: 1353370 - protein, 9 aa, Homo Sapiens
KDLDRIFRW

SEQ ID NO: 1353371 - protein, 9 aa, Homo Sapiens
HVDGERSFR

SEQ ID NO: 1353372 - protein, 9 aa, Homo Sapiens
TQVLIGVSE

SEQ ID NO: 1353373 - protein, 9 aa, Homo Sapiens
AAVIHYLYL

SEQ ID NO: 1353374 - protein, 9 aa, Homo Sapiens
SCHHDKAIS

SEQ ID NO: 1353375 - protein, 9 aa, Homo Sapiens
QEEVELLSP

SEQ ID NO: 1353376 - protein, 9 aa, Homo Sapiens
CLGFLRLQA

SEQ ID NO: 1353377 - protein, 9 aa, Homo Sapiens
EKMMVNNYH

SEQ ID NO: 1353378 - protein, 9 aa, Homo Sapiens
NENLQEIYK

SEQ ID NO: 1353379 - protein, 9 aa, Homo Sapiens
ISNYCKKIP

SEQ ID NO: 1353380 - protein, 9 aa, Homo Sapiens
LNLEDIFPS

SEQ ID NO: 1353381 - protein, 9 aa, Homo Sapiens
MSATFAKLC

SEQ ID NO: 1353382 - protein, 9 aa, Homo Sapiens
SPTMVLRHQ

SEQ ID NO: 1353383 - protein, 9 aa, Homo Sapiens
GFFPVTFGF

SEQ ID NO: 1353384 - protein, 9 aa, Homo Sapiens
YIAHKHNMC

SEQ ID NO: 1353385 - protein, 9 aa, Homo Sapiens
PAAPSPGSV

SEQ ID NO: 1353386 - protein, 9 aa, Homo Sapiens
GCTPARSPT

SEQ ID NO: 1353387 - protein, 9 aa, Homo Sapiens
DVRHTPAEE

SEQ ID NO: 1353388 - protein, 9 aa, Homo Sapiens
GGIYGEWIP

SEQ ID NO: 1353389 - protein, 9 aa, Homo Sapiens
RIPMLSREG

SEQ ID NO: 1353390 - protein, 9 aa, Homo Sapiens
CVNMSVSRL

SEQ ID NO: 1353391 - protein, 9 aa, Homo Sapiens
KLNVGQWQA

SEQ ID NO: 1353392 - protein, 9 aa, Homo Sapiens
DHVLKRSAE

SEQ ID NO: 1353393 - protein, 9 aa, Homo Sapiens
FSPLWVCCF

SEQ ID NO: 1353394 - protein, 9 aa, Homo Sapiens
ALRHGVCVL

SEQ ID NO: 1353395 - protein, 9 aa, Homo Sapiens
GVLSGIPLD

SEQ ID NO: 1353396 - protein, 9 aa, Homo Sapiens
LALIDKLLP

SEQ ID NO: 1353397 - protein, 9 aa, Homo Sapiens
DGDTVSVHH

SEQ ID NO: 1353398 - protein, 9 aa, Homo Sapiens
SKINVLMHA

SEQ ID NO: 1353399 - protein, 9 aa, Homo Sapiens
TRQKTRESE

SEQ ID NO: 1353400 - protein, 9 aa, Homo Sapiens
WRDRHITLR

SEQ ID NO: 1353401 - protein, 9 aa, Homo Sapiens
TSYLCSDVT

SEQ ID NO: 1353402 - protein, 9 aa, Homo Sapiens
TMDNITRQN

SEQ ID NO: 1353403 - protein, 9 aa, Homo Sapiens
QCSPPVRLG

SEQ ID NO: 1353404 - protein, 9 aa, Homo Sapiens
PSSAPTAGR

SEQ ID NO: 1353405 - protein, 9 aa, Homo Sapiens
AWLSDSYMA

SEQ ID NO: 1353406 - protein, 9 aa, Homo Sapiens
DAGLAQGLH

SEQ ID NO: 1353407 - protein, 9 aa, Homo Sapiens
GKCTYTSSE

SEQ ID NO: 1353408 - protein, 9 aa, Homo Sapiens
GNIFKSSSS

SEQ ID NO: 1353409 - protein, 9 aa, Homo Sapiens
GTSRSSAAT

SEQ ID NO: 1353410 - protein, 9 aa, Homo Sapiens
VNGINPNGD

SEQ ID NO: 1353411 - protein, 9 aa, Homo Sapiens
TLDGTHWRI

SEQ ID NO: 1353412 - protein, 9 aa, Homo Sapiens
VPPPGQSGL

SEQ ID NO: 1353413 - protein, 9 aa, Homo Sapiens
AQCYADFTL

SEQ ID NO: 1353414 - protein, 9 aa, Homo Sapiens
TYEPDSVLP

SEQ ID NO: 1353415 - protein, 9 aa, Homo Sapiens
HVIIETVVP

SEQ ID NO: 1353416 - protein, 9 aa, Homo Sapiens
EQVLLIKRR

SEQ ID NO: 1353417 - protein, 9 aa, Homo Sapiens
RCGWLDLIL

SEQ ID NO: 1353418 - protein, 9 aa, Homo Sapiens
VSKDTLVQT

SEQ ID NO: 1353419 - protein, 9 aa, Homo Sapiens
MKQHILKED

SEQ ID NO: 1353420 - protein, 9 aa, Homo Sapiens
CCLEKLCLR

SEQ ID NO: 1353421 - protein, 9 aa, Homo Sapiens
VESLIQLTQ

SEQ ID NO: 1353422 - protein, 9 aa, Homo Sapiens
GSQLPFDPE

SEQ ID NO: 1353423 - protein, 9 aa, Homo Sapiens
KVLRWIIEV

SEQ ID NO: 1353424 - protein, 9 aa, Homo Sapiens
SFTQVSRRF

SEQ ID NO: 1353425 - protein, 9 aa, Homo Sapiens
MHAAEELYL

SEQ ID NO: 1353426 - protein, 9 aa, Homo Sapiens
KIAASEKTS

SEQ ID NO: 1353427 - protein, 9 aa, Homo Sapiens
QSAAVGPLG

SEQ ID NO: 1353428 - protein, 9 aa, Homo Sapiens
RDSLRYSSG

SEQ ID NO: 1353429 - protein, 9 aa, Homo Sapiens
QLCKPDVIA

SEQ ID NO: 1353430 - protein, 9 aa, Homo Sapiens
SPVVAEYAH

SEQ ID NO: 1353431 - protein, 9 aa, Homo Sapiens
KELVMAEAL

SEQ ID NO: 1353432 - protein, 9 aa, Homo Sapiens
LKNKPGWFF

SEQ ID NO: 1353433 - protein, 9 aa, Homo Sapiens
LWTTLTILR

SEQ ID NO: 1353434 - protein, 9 aa, Homo Sapiens
LTSLTQKWF

SEQ ID NO: 1353435 - protein, 9 aa, Homo Sapiens
SHFTKVEHI

SEQ ID NO: 1353436 - protein, 9 aa, Homo Sapiens
GSYVRYNSM

SEQ ID NO: 1353437 - protein, 9 aa, Homo Sapiens
HCTWFYKGD

SEQ ID NO: 1353438 - protein, 9 aa, Homo Sapiens
HGKCQSSVT

SEQ ID NO: 1353439 - protein, 9 aa, Homo Sapiens
RCSLIILMW

SEQ ID NO: 1353440 - protein, 9 aa, Homo Sapiens
DDDEEESGV

SEQ ID NO: 1353441 - protein, 9 aa, Homo Sapiens
NSVTDFYGQ

SEQ ID NO: 1353442 - protein, 9 aa, Homo Sapiens
SPPHRRRLA

SEQ ID NO: 1353443 - protein, 9 aa, Homo Sapiens
NVLNKAIKL

SEQ ID NO: 1353444 - protein, 9 aa, Homo Sapiens
VCSFLHARL

SEQ ID NO: 1353445 - protein, 9 aa, Homo Sapiens
CLPPGFPVK

SEQ ID NO: 1353446 - protein, 9 aa, Homo Sapiens
GHYLEELSQ

SEQ ID NO: 1353447 - protein, 9 aa, Homo Sapiens
EVANHVVQV

SEQ ID NO: 1353448 - protein, 9 aa, Homo Sapiens
HSGMKMYGC

SEQ ID NO: 1353449 - protein, 9 aa, Homo Sapiens
RGTGLPWLL

SEQ ID NO: 1353450 - protein, 9 aa, Homo Sapiens
AAGKLALID

SEQ ID NO: 1353451 - protein, 9 aa, Homo Sapiens
YLMKPYIKC

SEQ ID NO: 1353452 - protein, 9 aa, Homo Sapiens
CLHQEYGVQ

SEQ ID NO: 1353453 - protein, 9 aa, Homo Sapiens
RFFIDRPNT

SEQ ID NO: 1353454 - protein, 9 aa, Homo Sapiens
SLYTISKGF

SEQ ID NO: 1353455 - protein, 9 aa, Homo Sapiens
LSRAERERA

SEQ ID NO: 1353456 - protein, 9 aa, Homo Sapiens
LAPLGYPFP

SEQ ID NO: 1353457 - protein, 9 aa, Homo Sapiens
LKLLADLDP

SEQ ID NO: 1353458 - protein, 9 aa, Homo Sapiens
QHTELVFGL

SEQ ID NO: 1353459 - protein, 9 aa, Homo Sapiens
SRPPCSVQP

SEQ ID NO: 1353460 - protein, 9 aa, Homo Sapiens
HNIILYENP

SEQ ID NO: 1353461 - protein, 9 aa, Homo Sapiens
KRHRTWSKG

SEQ ID NO: 1353462 - protein, 9 aa, Homo Sapiens
NDSFKHLIY

SEQ ID NO: 1353463 - protein, 9 aa, Homo Sapiens
LGDSSMVFL

SEQ ID NO: 1353464 - protein, 9 aa, Homo Sapiens
LVVTLSTSK

SEQ ID NO: 1353465 - protein, 9 aa, Homo Sapiens
RAISWQGRT

SEQ ID NO: 1353466 - protein, 9 aa, Homo Sapiens
MEDTMHFRD

SEQ ID NO: 1353467 - protein, 9 aa, Homo Sapiens
VMSVVVVQS

SEQ ID NO: 1353468 - protein, 9 aa, Homo Sapiens
DEEGVTLEE

SEQ ID NO: 1353469 - protein, 9 aa, Homo Sapiens
CSRLLPWPF

SEQ ID NO: 1353470 - protein, 9 aa, Homo Sapiens
SPPTPRPER

SEQ ID NO: 1353471 - protein, 9 aa, Homo Sapiens
KGSMVLAYS

SEQ ID NO: 1353472 - protein, 9 aa, Homo Sapiens
ERCGIIEFH

SEQ ID NO: 1353473 - protein, 9 aa, Homo Sapiens
IISSMMMLE

SEQ ID NO: 1353474 - protein, 9 aa, Homo Sapiens
DVPFKVKAD

SEQ ID NO: 1353475 - protein, 9 aa, Homo Sapiens
EDISGKSFG

SEQ ID NO: 1353476 - protein, 9 aa, Homo Sapiens
VTTLTDLTN

SEQ ID NO: 1353477 - protein, 9 aa, Homo Sapiens
SPAFTSLKR

SEQ ID NO: 1353478 - protein, 9 aa, Homo Sapiens
RAERPRGGR

SEQ ID NO: 1353479 - protein, 9 aa, Homo Sapiens
VAVGTGFCD

SEQ ID NO: 1353480 - protein, 9 aa, Homo Sapiens
AHFLIKLEV

SEQ ID NO: 1353481 - protein, 9 aa, Homo Sapiens
DWQCRCDDI

SEQ ID NO: 1353482 - protein, 9 aa, Homo Sapiens
ALLRGYLQY

SEQ ID NO: 1353483 - protein, 9 aa, Homo Sapiens
REEEETVGG

SEQ ID NO: 1353484 - protein, 9 aa, Homo Sapiens
AYFVMTHQE

SEQ ID NO: 1353485 - protein, 9 aa, Homo Sapiens
IWVGDGDAA

SEQ ID NO: 1353486 - protein, 9 aa, Homo Sapiens
RLIHHCAKY

SEQ ID NO: 1353487 - protein, 9 aa, Homo Sapiens
DTEEVDRTS

SEQ ID NO: 1353488 - protein, 9 aa, Homo Sapiens
RNNMKLQHA

SEQ ID NO: 1353489 - protein, 9 aa, Homo Sapiens
ECFAYPMPF

SEQ ID NO: 1353490 - protein, 9 aa, Homo Sapiens
MQVWFQNRR

SEQ ID NO: 1353491 - protein, 9 aa, Homo Sapiens
PSMDFNALV

SEQ ID NO: 1353492 - protein, 9 aa, Homo Sapiens
TAARAVVFA

SEQ ID NO: 1353493 - protein, 9 aa, Homo Sapiens
EKDLHLLEK

SEQ ID NO: 1353494 - protein, 9 aa, Homo Sapiens
SQRAVYDTL

SEQ ID NO: 1353495 - protein, 9 aa, Homo Sapiens
AAMYGAHMD

SEQ ID NO: 1353496 - protein, 9 aa, Homo Sapiens
GNIIEIFYE

SEQ ID NO: 1353497 - protein, 9 aa, Homo Sapiens
QGGRPSPCL

SEQ ID NO: 1353498 - protein, 9 aa, Homo Sapiens
VVRRLQKPC

SEQ ID NO: 1353499 - protein, 9 aa, Homo Sapiens
SVGAQGVNN

SEQ ID NO: 1353500 - protein, 9 aa, Homo Sapiens
HLSDTHWCW

SEQ ID NO: 1353501 - protein, 9 aa, Homo Sapiens
TMGMIFFCS

SEQ ID NO: 1353502 - protein, 9 aa, Homo Sapiens
LSRVFLLLK

SEQ ID NO: 1353503 - protein, 9 aa, Homo Sapiens
MALLTDQRS

SEQ ID NO: 1353504 - protein, 9 aa, Homo Sapiens
VTLLIYCRL

SEQ ID NO: 1353505 - protein, 9 aa, Homo Sapiens
GNIFIADFE

SEQ ID NO: 1353506 - protein, 9 aa, Homo Sapiens
RHRNVSILY

SEQ ID NO: 1353507 - protein, 9 aa, Homo Sapiens
HPCDLKDIG

SEQ ID NO: 1353508 - protein, 9 aa, Homo Sapiens
SFRSVRAIW

SEQ ID NO: 1353509 - protein, 9 aa, Homo Sapiens
VVDDLHLCT

SEQ ID NO: 1353510 - protein, 9 aa, Homo Sapiens
CCPCMTLAQ

SEQ ID NO: 1353511 - protein, 9 aa, Homo Sapiens
RELKATDNI

SEQ ID NO: 1353512 - protein, 9 aa, Homo Sapiens
VSGYLGKSL

SEQ ID NO: 1353513 - protein, 9 aa, Homo Sapiens
YHVQPLEDN

SEQ ID NO: 1353514 - protein, 9 aa, Homo Sapiens
AIGRITGKG

SEQ ID NO: 1353515 - protein, 9 aa, Homo Sapiens
FYPADHSFI

SEQ ID NO: 1353516 - protein, 9 aa, Homo Sapiens
ATRGCLLHN

SEQ ID NO: 1353517 - protein, 9 aa, Homo Sapiens
VIGNQINTF

SEQ ID NO: 1353518 - protein, 9 aa, Homo Sapiens
HLKTHTTVI

SEQ ID NO: 1353519 - protein, 9 aa, Homo Sapiens
FSAYSSVTA

SEQ ID NO: 1353520 - protein, 9 aa, Homo Sapiens
RFQNRVHEK

SEQ ID NO: 1353521 - protein, 9 aa, Homo Sapiens
QSNRDELRC

SEQ ID NO: 1353522 - protein, 9 aa, Homo Sapiens
IPKHLCLVC

SEQ ID NO: 1353523 - protein, 9 aa, Homo Sapiens
PPDTLPLRS

SEQ ID NO: 1353524 - protein, 9 aa, Homo Sapiens
SNLQFKAEH

SEQ ID NO: 1353525 - protein, 9 aa, Homo Sapiens
IVASAGRDE

SEQ ID NO: 1353526 - protein, 9 aa, Homo Sapiens
PDQPRSVRY

SEQ ID NO: 1353527 - protein, 9 aa, Homo Sapiens
SPHPLKFTE

SEQ ID NO: 1353528 - protein, 9 aa, Homo Sapiens
SPVTRHRSR

SEQ ID NO: 1353529 - protein, 9 aa, Homo Sapiens
RLPVRPWVL

SEQ ID NO: 1353530 - protein, 9 aa, Homo Sapiens
PQCLCVTTK

SEQ ID NO: 1353531 - protein, 9 aa, Homo Sapiens
YTPLCSPPS

SEQ ID NO: 1353532 - protein, 9 aa, Homo Sapiens
LFAHDDSVI

SEQ ID NO: 1353533 - protein, 9 aa, Homo Sapiens
ILREVDKVL

SEQ ID NO: 1353534 - protein, 9 aa, Homo Sapiens
QLAMGNSSA

SEQ ID NO: 1353535 - protein, 9 aa, Homo Sapiens
LNHKFNESL

SEQ ID NO: 1353536 - protein, 9 aa, Homo Sapiens
TLSAPYGFA

SEQ ID NO: 1353537 - protein, 9 aa, Homo Sapiens
RWAKQDCAH

SEQ ID NO: 1353538 - protein, 9 aa, Homo Sapiens
VREICISRN

SEQ ID NO: 1353539 - protein, 9 aa, Homo Sapiens
LGVSELRVG

SEQ ID NO: 1353540 - protein, 9 aa, Homo Sapiens
LAARAVATA

SEQ ID NO: 1353541 - protein, 9 aa, Homo Sapiens
GAQQKIPKG

SEQ ID NO: 1353542 - protein, 9 aa, Homo Sapiens
GNTDMLMEG

SEQ ID NO: 1353543 - protein, 9 aa, Homo Sapiens
SLSSVMDKE

SEQ ID NO: 1353544 - protein, 9 aa, Homo Sapiens
MRLTCADTW

SEQ ID NO: 1353545 - protein, 9 aa, Homo Sapiens
VNGKMILGR

SEQ ID NO: 1353546 - protein, 9 aa, Homo Sapiens
TAIVGAVRL

SEQ ID NO: 1353547 - protein, 9 aa, Homo Sapiens
FSNRKDLIH

SEQ ID NO: 1353548 - protein, 9 aa, Homo Sapiens
HASVQPNEM

SEQ ID NO: 1353549 - protein, 9 aa, Homo Sapiens
VICWLPYHV

SEQ ID NO: 1353550 - protein, 9 aa, Homo Sapiens
PANGVVTLP

SEQ ID NO: 1353551 - protein, 9 aa, Homo Sapiens
VTAFSPHFS

SEQ ID NO: 1353552 - protein, 9 aa, Homo Sapiens
DTLVDANSN

SEQ ID NO: 1353553 - protein, 9 aa, Homo Sapiens
LPVKIRPQF

SEQ ID NO: 1353554 - protein, 9 aa, Homo Sapiens
EEERLQAIT

SEQ ID NO: 1353555 - protein, 9 aa, Homo Sapiens
LIDLCQKSL

SEQ ID NO: 1353556 - protein, 9 aa, Homo Sapiens
AKTILESSS

SEQ ID NO: 1353557 - protein, 9 aa, Homo Sapiens
RKLCHTLAA

SEQ ID NO: 1353558 - protein, 9 aa, Homo Sapiens
QHISFSSHN

SEQ ID NO: 1353559 - protein, 9 aa, Homo Sapiens
VPSSSAAQL

SEQ ID NO: 1353560 - protein, 9 aa, Homo Sapiens
DIISLSEPV

SEQ ID NO: 1353561 - protein, 9 aa, Homo Sapiens
GQGWQVFKN

SEQ ID NO: 1353562 - protein, 9 aa, Homo Sapiens
LGYHQDDPS

SEQ ID NO: 1353563 - protein, 9 aa, Homo Sapiens
AAHESIIWC

SEQ ID NO: 1353564 - protein, 9 aa, Homo Sapiens
TAPVSEVNI

SEQ ID NO: 1353565 - protein, 9 aa, Homo Sapiens
EERLHCRNM

SEQ ID NO: 1353566 - protein, 9 aa, Homo Sapiens
KEEDYEKAF

SEQ ID NO: 1353567 - protein, 9 aa, Homo Sapiens
LSSHDNAFF

SEQ ID NO: 1353568 - protein, 9 aa, Homo Sapiens
LQKEMTDIV

SEQ ID NO: 1353569 - protein, 9 aa, Homo Sapiens
ASIIKGDFQ

SEQ ID NO: 1353570 - protein, 9 aa, Homo Sapiens
KWTVLRVIE

SEQ ID NO: 1353571 - protein, 9 aa, Homo Sapiens
NKPDNEGCN

SEQ ID NO: 1353572 - protein, 9 aa, Homo Sapiens
IVGATTTQH

SEQ ID NO: 1353573 - protein, 9 aa, Homo Sapiens
PLDGQDSPI

SEQ ID NO: 1353574 - protein, 9 aa, Homo Sapiens
TKVISVSTG

SEQ ID NO: 1353575 - protein, 9 aa, Homo Sapiens
DLGRKGQIW

SEQ ID NO: 1353576 - protein, 9 aa, Homo Sapiens
PMLQDFPCN

SEQ ID NO: 1353577 - protein, 9 aa, Homo Sapiens
CSYMPSTHR

SEQ ID NO: 1353578 - protein, 9 aa, Homo Sapiens
DIPVRTMVQ

SEQ ID NO: 1353579 - protein, 9 aa, Homo Sapiens
LPHPQLREA

SEQ ID NO: 1353580 - protein, 9 aa, Homo Sapiens
LRVPCLPVT

SEQ ID NO: 1353581 - protein, 9 aa, Homo Sapiens
TYEAVLRLA

SEQ ID NO: 1353582 - protein, 9 aa, Homo Sapiens
TYNVLTNWL

SEQ ID NO: 1353583 - protein, 9 aa, Homo Sapiens
HSSFSTATS

SEQ ID NO: 1353584 - protein, 9 aa, Homo Sapiens
HHMNPSSNF

SEQ ID NO: 1353585 - protein, 9 aa, Homo Sapiens
KEKVWPEGT

SEQ ID NO: 1353586 - protein, 9 aa, Homo Sapiens
FSGMTGTST

SEQ ID NO: 1353587 - protein, 9 aa, Homo Sapiens
AYRHIFQKF

SEQ ID NO: 1353588 - protein, 9 aa, Homo Sapiens
ETVVLQCIA

SEQ ID NO: 1353589 - protein, 9 aa, Homo Sapiens
NEENDVNAS

SEQ ID NO: 1353590 - protein, 9 aa, Homo Sapiens
DIMEEKPLK

SEQ ID NO: 1353591 - protein, 9 aa, Homo Sapiens
KAKRWIHDI

SEQ ID NO: 1353592 - protein, 9 aa, Homo Sapiens
VILFFVPFP

SEQ ID NO: 1353593 - protein, 9 aa, Homo Sapiens
YGEDSGLMH

SEQ ID NO: 1353594 - protein, 9 aa, Homo Sapiens
GETDTIGEF

SEQ ID NO: 1353595 - protein, 9 aa, Homo Sapiens
NITVGLGVF

SEQ ID NO: 1353596 - protein, 9 aa, Homo Sapiens
ETPLGHLEM

SEQ ID NO: 1353597 - protein, 9 aa, Homo Sapiens
RAVPAFLKG

SEQ ID NO: 1353598 - protein, 9 aa, Homo Sapiens
EILPVFINA

SEQ ID NO: 1353599 - protein, 9 aa, Homo Sapiens
VMSGGIFAI

SEQ ID NO: 1353600 - protein, 9 aa, Homo Sapiens
LYKHFFSLP

SEQ ID NO: 1353601 - protein, 9 aa, Homo Sapiens
KCHKKRGIF

SEQ ID NO: 1353602 - protein, 9 aa, Homo Sapiens
PVCVFRLIT

SEQ ID NO: 1353603 - protein, 9 aa, Homo Sapiens
NFLPGGRRD

SEQ ID NO: 1353604 - protein, 9 aa, Homo Sapiens
RGSYVRYNS

SEQ ID NO: 1353605 - protein, 9 aa, Homo Sapiens
RALACVSLL

SEQ ID NO: 1353606 - protein, 9 aa, Homo Sapiens
CFDVHISQH

SEQ ID NO: 1353607 - protein, 9 aa, Homo Sapiens
YLSSPCFLS

SEQ ID NO: 1353608 - protein, 9 aa, Homo Sapiens
ISLCGASAT

SEQ ID NO: 1353609 - protein, 9 aa, Homo Sapiens
NSHLVHHQR

SEQ ID NO: 1353610 - protein, 9 aa, Homo Sapiens
EILPTPGQE

SEQ ID NO: 1353611 - protein, 9 aa, Homo Sapiens
CFLMRKRLL

SEQ ID NO: 1353612 - protein, 9 aa, Homo Sapiens
VIVANTMST

SEQ ID NO: 1353613 - protein, 9 aa, Homo Sapiens
FTKVEHIPK

SEQ ID NO: 1353614 - protein, 9 aa, Homo Sapiens
ALDPSSPTS

SEQ ID NO: 1353615 - protein, 9 aa, Homo Sapiens
HDASPSKEE

SEQ ID NO: 1353616 - protein, 9 aa, Homo Sapiens
CGRSYKQHS

SEQ ID NO: 1353617 - protein, 9 aa, Homo Sapiens
ISQVYSGVD

SEQ ID NO: 1353618 - protein, 9 aa, Homo Sapiens
MSDPYLPSY

SEQ ID NO: 1353619 - protein, 9 aa, Homo Sapiens
HNQQLWEQS

SEQ ID NO: 1353620 - protein, 9 aa, Homo Sapiens
RDDEGWPLD

SEQ ID NO: 1353621 - protein, 9 aa, Homo Sapiens
GQGTNTSET

SEQ ID NO: 1353622 - protein, 9 aa, Homo Sapiens
QGTNTSETP

SEQ ID NO: 1353623 - protein, 9 aa, Homo Sapiens
LEVQQLKVS

SEQ ID NO: 1353624 - protein, 9 aa, Homo Sapiens
VPVFQVEPQ

SEQ ID NO: 1353625 - protein, 9 aa, Homo Sapiens
LPVRPWVLL

SEQ ID NO: 1353626 - protein, 9 aa, Homo Sapiens
IEPGCIRVV

SEQ ID NO: 1353627 - protein, 9 aa, Homo Sapiens
GSFQIPRGV

SEQ ID NO: 1353628 - protein, 9 aa, Homo Sapiens
KLALSTASD

SEQ ID NO: 1353629 - protein, 9 aa, Homo Sapiens
DATFSMNAS

SEQ ID NO: 1353630 - protein, 9 aa, Homo Sapiens
WTVLRVIEQ

SEQ ID NO: 1353631 - protein, 9 aa, Homo Sapiens
QETHKGEIP

SEQ ID NO: 1353632 - protein, 9 aa, Homo Sapiens
VTTCVGRNG

SEQ ID NO: 1353633 - protein, 9 aa, Homo Sapiens
PGWEKCTDP

SEQ ID NO: 1353634 - protein, 9 aa, Homo Sapiens
RHRTWSKGV

SEQ ID NO: 1353635 - protein, 9 aa, Homo Sapiens
LATLSAPYG

SEQ ID NO: 1353636 - protein, 9 aa, Homo Sapiens
VSLVRVCGR

SEQ ID NO: 1353637 - protein, 9 aa, Homo Sapiens
ILFVEKLPN

SEQ ID NO: 1353638 - protein, 9 aa, Homo Sapiens
VKPVIYKVQ

SEQ ID NO: 1353639 - protein, 9 aa, Homo Sapiens
PSFSPQSSS

SEQ ID NO: 1353640 - protein, 9 aa, Homo Sapiens
LEVLLSNEQ

SEQ ID NO: 1353641 - protein, 9 aa, Homo Sapiens
GLMPLRVDT

SEQ ID NO: 1353642 - protein, 9 aa, Homo Sapiens
TEGDAPAKL

SEQ ID NO: 1353643 - protein, 9 aa, Homo Sapiens
IVDKLNAKL

SEQ ID NO: 1353644 - protein, 9 aa, Homo Sapiens
RNVMKDQHL

SEQ ID NO: 1353645 - protein, 9 aa, Homo Sapiens
LFHQCYADF

SEQ ID NO: 1353646 - protein, 9 aa, Homo Sapiens
HVPHPAQTQ

SEQ ID NO: 1353647 - protein, 9 aa, Homo Sapiens
HSPAFTSLK

SEQ ID NO: 1353648 - protein, 9 aa, Homo Sapiens
IITLSWLDL

SEQ ID NO: 1353649 - protein, 9 aa, Homo Sapiens
EDMVSQEET

SEQ ID NO: 1353650 - protein, 9 aa, Homo Sapiens
GPLHRLIMM

SEQ ID NO: 1353651 - protein, 9 aa, Homo Sapiens
MTKIKKIDG

SEQ ID NO: 1353652 - protein, 9 aa, Homo Sapiens
PVSRPVDYD

SEQ ID NO: 1353653 - protein, 9 aa, Homo Sapiens
KMCTKIDYC

SEQ ID NO: 1353654 - protein, 9 aa, Homo Sapiens
SLTLSPGWS

SEQ ID NO: 1353655 - protein, 9 aa, Homo Sapiens
RPTKSKDAR

SEQ ID NO: 1353656 - protein, 9 aa, Homo Sapiens
NYKAVSYHT

SEQ ID NO: 1353657 - protein, 9 aa, Homo Sapiens
PAHKAHQKQ

SEQ ID NO: 1353658 - protein, 9 aa, Homo Sapiens
ILGPEDLRT

SEQ ID NO: 1353659 - protein, 9 aa, Homo Sapiens
IEAAGAKAG

SEQ ID NO: 1353660 - protein, 9 aa, Homo Sapiens
DVETEDTGV

SEQ ID NO: 1353661 - protein, 9 aa, Homo Sapiens
AKCNARSYQ

SEQ ID NO: 1353662 - protein, 9 aa, Homo Sapiens
KWKHSRTMI

SEQ ID NO: 1353663 - protein, 9 aa, Homo Sapiens
LLKIKHGNL

SEQ ID NO: 1353664 - protein, 9 aa, Homo Sapiens
NYMLCPAPI

SEQ ID NO: 1353665 - protein, 9 aa, Homo Sapiens
CFRSHNLMD

SEQ ID NO: 1353666 - protein, 9 aa, Homo Sapiens
VHELGVAVD

SEQ ID NO: 1353667 - protein, 9 aa, Homo Sapiens
NLLLYQEGT

SEQ ID NO: 1353668 - protein, 9 aa, Homo Sapiens
SRQYLPYFR

SEQ ID NO: 1353669 - protein, 9 aa, Homo Sapiens
VWLMVDTVI

SEQ ID NO: 1353670 - protein, 9 aa, Homo Sapiens
MDMGFTMSN

SEQ ID NO: 1353671 - protein, 9 aa, Homo Sapiens
MHYVLSWCV

SEQ ID NO: 1353672 - protein, 9 aa, Homo Sapiens
TCLSGAQVS

SEQ ID NO: 1353673 - protein, 9 aa, Homo Sapiens
QRQRQRQQQ

SEQ ID NO: 1353674 - protein, 9 aa, Homo Sapiens
VYNQFMGGI

SEQ ID NO: 1353675 - protein, 9 aa, Homo Sapiens
SSLTRSMSL

SEQ ID NO: 1353676 - protein, 9 aa, Homo Sapiens
TMESVCGYF

SEQ ID NO: 1353677 - protein, 9 aa, Homo Sapiens
QMSLQGMPG

SEQ ID NO: 1353678 - protein, 9 aa, Homo Sapiens
EQVSTLFGN

SEQ ID NO: 1353679 - protein, 9 aa, Homo Sapiens
QKYWEMKQA

SEQ ID NO: 1353680 - protein, 9 aa, Homo Sapiens
LDWPNLVDA

SEQ ID NO: 1353681 - protein, 9 aa, Homo Sapiens
GSKEHHSSK

SEQ ID NO: 1353682 - protein, 9 aa, Homo Sapiens
WCSLLSQDK

SEQ ID NO: 1353683 - protein, 9 aa, Homo Sapiens
CRVDIFTNL

SEQ ID NO: 1353684 - protein, 9 aa, Homo Sapiens
HQQFQFYQP

SEQ ID NO: 1353685 - protein, 9 aa, Homo Sapiens
AHINTCYKH

SEQ ID NO: 1353686 - protein, 9 aa, Homo Sapiens
RLIMMIKDK

SEQ ID NO: 1353687 - protein, 9 aa, Homo Sapiens
RKGEKGEPV

SEQ ID NO: 1353688 - protein, 9 aa, Homo Sapiens
CCLNCRSTS

SEQ ID NO: 1353689 - protein, 9 aa, Homo Sapiens
LYTECLYRM

SEQ ID NO: 1353690 - protein, 9 aa, Homo Sapiens
HKVLMPKLK

SEQ ID NO: 1353691 - protein, 9 aa, Homo Sapiens
IVGSKFTGG

SEQ ID NO: 1353692 - protein, 9 aa, Homo Sapiens
PQAVFYVAE

SEQ ID NO: 1353693 - protein, 9 aa, Homo Sapiens
GFSMGINYH

SEQ ID NO: 1353694 - protein, 9 aa, Homo Sapiens
KIGRWREES

SEQ ID NO: 1353695 - protein, 9 aa, Homo Sapiens
CLMVVMNKK

SEQ ID NO: 1353696 - protein, 9 aa, Homo Sapiens
VDIYKLTGA

SEQ ID NO: 1353697 - protein, 9 aa, Homo Sapiens
LVEIAGRLG

SEQ ID NO: 1353698 - protein, 9 aa, Homo Sapiens
GDENDDTVS

SEQ ID NO: 1353699 - protein, 9 aa, Homo Sapiens
PSARTTVSL

SEQ ID NO: 1353700 - protein, 9 aa, Homo Sapiens
STVFMYLTG

SEQ ID NO: 1353701 - protein, 9 aa, Homo Sapiens
TSATEAWCR

SEQ ID NO: 1353702 - protein, 9 aa, Homo Sapiens
DLMEPTLQL

SEQ ID NO: 1353703 - protein, 9 aa, Homo Sapiens
KKFFVKTAE

SEQ ID NO: 1353704 - protein, 9 aa, Homo Sapiens
CYYKNHYHQ

SEQ ID NO: 1353705 - protein, 9 aa, Homo Sapiens
RNTVAGLNQ

SEQ ID NO: 1353706 - protein, 9 aa, Homo Sapiens
VKERICLAR

SEQ ID NO: 1353707 - protein, 9 aa, Homo Sapiens
TLLERRRIL

SEQ ID NO: 1353708 - protein, 9 aa, Homo Sapiens
APSTVATPP

SEQ ID NO: 1353709 - protein, 9 aa, Homo Sapiens
TPCYQPACC

SEQ ID NO: 1353710 - protein, 9 aa, Homo Sapiens
FVCAQCRTY

SEQ ID NO: 1353711 - protein, 9 aa, Homo Sapiens
HPVSFVKLF

SEQ ID NO: 1353712 - protein, 9 aa, Homo Sapiens
IRKYQESDH

SEQ ID NO: 1353713 - protein, 9 aa, Homo Sapiens
NMLYKKIEK

SEQ ID NO: 1353714 - protein, 9 aa, Homo Sapiens
TIKHAKAYC

SEQ ID NO: 1353715 - protein, 9 aa, Homo Sapiens
NHYLKSHQF

SEQ ID NO: 1353716 - protein, 9 aa, Homo Sapiens
RVGKKIGCD

SEQ ID NO: 1353717 - protein, 9 aa, Homo Sapiens
IIVIVIAYI

SEQ ID NO: 1353718 - protein, 9 aa, Homo Sapiens
GSDGCFLRG

SEQ ID NO: 1353719 - protein, 9 aa, Homo Sapiens
AQAMRWDQA

SEQ ID NO: 1353720 - protein, 9 aa, Homo Sapiens
VPISSSACL

SEQ ID NO: 1353721 - protein, 9 aa, Homo Sapiens
ENSFEYGPL

SEQ ID NO: 1353722 - protein, 9 aa, Homo Sapiens
IYDDQGDME

SEQ ID NO: 1353723 - protein, 9 aa, Homo Sapiens
CEREKHNIY

SEQ ID NO: 1353724 - protein, 9 aa, Homo Sapiens
QSLKQFNVD

SEQ ID NO: 1353725 - protein, 9 aa, Homo Sapiens
VKKVCQKKQ

SEQ ID NO: 1353726 - protein, 9 aa, Homo Sapiens
EKNEKGVLK

SEQ ID NO: 1353727 - protein, 9 aa, Homo Sapiens
RLGVEYTVH

SEQ ID NO: 1353728 - protein, 9 aa, Homo Sapiens
ASAGRRSAR

SEQ ID NO: 1353729 - protein, 9 aa, Homo Sapiens
AVIAEKLDL

SEQ ID NO: 1353730 - protein, 9 aa, Homo Sapiens
RFTRVEMDR

SEQ ID NO: 1353731 - protein, 9 aa, Homo Sapiens
SDSLTSQQS

SEQ ID NO: 1353732 - protein, 9 aa, Homo Sapiens
LLLVTDEHD

SEQ ID NO: 1353733 - protein, 9 aa, Homo Sapiens
LLFSLPHIV

SEQ ID NO: 1353734 - protein, 9 aa, Homo Sapiens
LQNTLKAKL

SEQ ID NO: 1353735 - protein, 9 aa, Homo Sapiens
AECEGVMDI

SEQ ID NO: 1353736 - protein, 9 aa, Homo Sapiens
FEIPVCLHA

SEQ ID NO: 1353737 - protein, 9 aa, Homo Sapiens
AAIICYGDR

SEQ ID NO: 1353738 - protein, 9 aa, Homo Sapiens
MIMVSGFGP

SEQ ID NO: 1353739 - protein, 9 aa, Homo Sapiens
IVAISGLIS

SEQ ID NO: 1353740 - protein, 9 aa, Homo Sapiens
VYIVWNLPL

SEQ ID NO: 1353741 - protein, 9 aa, Homo Sapiens
AICFGLSGL

SEQ ID NO: 1353742 - protein, 9 aa, Homo Sapiens
GEDEDEDED

SEQ ID NO: 1353743 - protein, 9 aa, Homo Sapiens
NKSQLVEIV

SEQ ID NO: 1353744 - protein, 9 aa, Homo Sapiens
KCSKGNGFS

SEQ ID NO: 1353745 - protein, 9 aa, Homo Sapiens
PELDADSYD

SEQ ID NO: 1353746 - protein, 9 aa, Homo Sapiens
SEGFTTHLE

SEQ ID NO: 1353747 - protein, 9 aa, Homo Sapiens
CNNCRCLDG

SEQ ID NO: 1353748 - protein, 9 aa, Homo Sapiens
ATCLHKLKL

SEQ ID NO: 1353749 - protein, 9 aa, Homo Sapiens
AFVQPVCPT

SEQ ID NO: 1353750 - protein, 9 aa, Homo Sapiens
AATCSKYIE

SEQ ID NO: 1353751 - protein, 9 aa, Homo Sapiens
RRMKIEEMW

SEQ ID NO: 1353752 - protein, 9 aa, Homo Sapiens
GSFTDPDDL

SEQ ID NO: 1353753 - protein, 9 aa, Homo Sapiens
VTVFSTPNY

SEQ ID NO: 1353754 - protein, 9 aa, Homo Sapiens
IVAWTLPRS

SEQ ID NO: 1353755 - protein, 9 aa, Homo Sapiens
PSMSDPYLP

SEQ ID NO: 1353756 - protein, 9 aa, Homo Sapiens
DGDITYCEF

SEQ ID NO: 1353757 - protein, 9 aa, Homo Sapiens
RLHCRNMLS

SEQ ID NO: 1353758 - protein, 9 aa, Homo Sapiens
IMGVEEDDD

SEQ ID NO: 1353759 - protein, 9 aa, Homo Sapiens
LFRGHNKTR

SEQ ID NO: 1353760 - protein, 9 aa, Homo Sapiens
RDPPEDVLA

SEQ ID NO: 1353761 - protein, 9 aa, Homo Sapiens
DSAEITWYH

SEQ ID NO: 1353762 - protein, 9 aa, Homo Sapiens
GNNCELDVT

SEQ ID NO: 1353763 - protein, 9 aa, Homo Sapiens
WPLCMLRLG

SEQ ID NO: 1353764 - protein, 9 aa, Homo Sapiens
IVTSNIVIS

SEQ ID NO: 1353765 - protein, 9 aa, Homo Sapiens
GGYWCELTV

SEQ ID NO: 1353766 - protein, 9 aa, Homo Sapiens
VGHVLWIWR

SEQ ID NO: 1353767 - protein, 9 aa, Homo Sapiens
YLKLSEDHN

SEQ ID NO: 1353768 - protein, 9 aa, Homo Sapiens
HSNNIRLIP

SEQ ID NO: 1353769 - protein, 9 aa, Homo Sapiens
DFLPTGLQA

SEQ ID NO: 1353770 - protein, 9 aa, Homo Sapiens
EHGTPDSKE

SEQ ID NO: 1353771 - protein, 9 aa, Homo Sapiens
RLVLSYVRH

SEQ ID NO: 1353772 - protein, 9 aa, Homo Sapiens
PKKCSILGL

SEQ ID NO: 1353773 - protein, 9 aa, Homo Sapiens
PLSIQWKIQ

SEQ ID NO: 1353774 - protein, 9 aa, Homo Sapiens
DVFAQINCF

SEQ ID NO: 1353775 - protein, 9 aa, Homo Sapiens
KCCHAYHQD

SEQ ID NO: 1353776 - protein, 9 aa, Homo Sapiens
KKEAYSAAT

SEQ ID NO: 1353777 - protein, 9 aa, Homo Sapiens
GALLRGSCV

SEQ ID NO: 1353778 - protein, 9 aa, Homo Sapiens
CSATGGIIY

SEQ ID NO: 1353779 - protein, 9 aa, Homo Sapiens
ILMKACVSF

SEQ ID NO: 1353780 - protein, 9 aa, Homo Sapiens
AVPPQYHKV

SEQ ID NO: 1353781 - protein, 9 aa, Homo Sapiens
VQNYITFNP

SEQ ID NO: 1353782 - protein, 9 aa, Homo Sapiens
LTREVIHLA

SEQ ID NO: 1353783 - protein, 9 aa, Homo Sapiens
IHMYSERRI

SEQ ID NO: 1353784 - protein, 9 aa, Homo Sapiens
KAHHSKKIL

SEQ ID NO: 1353785 - protein, 9 aa, Homo Sapiens
TCVRHWHLW

SEQ ID NO: 1353786 - protein, 9 aa, Homo Sapiens
PKYHPLGSF

SEQ ID NO: 1353787 - protein, 9 aa, Homo Sapiens
HQEYVYPEA

SEQ ID NO: 1353788 - protein, 9 aa, Homo Sapiens
INEEELRRC

SEQ ID NO: 1353789 - protein, 9 aa, Homo Sapiens
TPLGHLEMP

SEQ ID NO: 1353790 - protein, 9 aa, Homo Sapiens
ACKKLQKKK

SEQ ID NO: 1353791 - protein, 9 aa, Homo Sapiens
CIHFLCLRF

SEQ ID NO: 1353792 - protein, 9 aa, Homo Sapiens
FIFLWYPLT

SEQ ID NO: 1353793 - protein, 9 aa, Homo Sapiens
IKGRLIDTV

SEQ ID NO: 1353794 - protein, 9 aa, Homo Sapiens
FRDRLIFLH

SEQ ID NO: 1353795 - protein, 9 aa, Homo Sapiens
DGLYTSLTT

SEQ ID NO: 1353796 - protein, 9 aa, Homo Sapiens
HANIVTYHG

SEQ ID NO: 1353797 - protein, 9 aa, Homo Sapiens
ALPLEARKD

SEQ ID NO: 1353798 - protein, 9 aa, Homo Sapiens
VKSKKTKLL

SEQ ID NO: 1353799 - protein, 9 aa, Homo Sapiens
PEIFQCCDC

SEQ ID NO: 1353800 - protein, 9 aa, Homo Sapiens
ECRMTFTQS

SEQ ID NO: 1353801 - protein, 9 aa, Homo Sapiens
TYFSPYNGG

SEQ ID NO: 1353802 - protein, 9 aa, Homo Sapiens
AFDYAYIVL

SEQ ID NO: 1353803 - protein, 9 aa, Homo Sapiens
AYPQTSGGV

SEQ ID NO: 1353804 - protein, 9 aa, Homo Sapiens
LPKSALVTL

SEQ ID NO: 1353805 - protein, 9 aa, Homo Sapiens
DLLGLEGSV

SEQ ID NO: 1353806 - protein, 9 aa, Homo Sapiens
GKPDKMEEM

SEQ ID NO: 1353807 - protein, 9 aa, Homo Sapiens
TEGKKSGDS

SEQ ID NO: 1353808 - protein, 9 aa, Homo Sapiens
AFTYNSYLA

SEQ ID NO: 1353809 - protein, 9 aa, Homo Sapiens
EDEDTKAPR

SEQ ID NO: 1353810 - protein, 9 aa, Homo Sapiens
AIIISLKEE

SEQ ID NO: 1353811 - protein, 9 aa, Homo Sapiens
RHSTFVPTR

SEQ ID NO: 1353812 - protein, 9 aa, Homo Sapiens
RINVSDLTT

SEQ ID NO: 1353813 - protein, 9 aa, Homo Sapiens
RPREDDIPF

SEQ ID NO: 1353814 - protein, 9 aa, Homo Sapiens
VEKWAFREI

SEQ ID NO: 1353815 - protein, 9 aa, Homo Sapiens
NVNMLYKKI

SEQ ID NO: 1353816 - protein, 9 aa, Homo Sapiens
LLTFIFFFS

SEQ ID NO: 1353817 - protein, 9 aa, Homo Sapiens
ELCLCCLVG

SEQ ID NO: 1353818 - protein, 9 aa, Homo Sapiens
KQIQEECDE

SEQ ID NO: 1353819 - protein, 9 aa, Homo Sapiens
RCYSFRVPE

SEQ ID NO: 1353820 - protein, 9 aa, Homo Sapiens
SQITPPGMP

SEQ ID NO: 1353821 - protein, 9 aa, Homo Sapiens
LMVVMNKKK

SEQ ID NO: 1353822 - protein, 9 aa, Homo Sapiens
YYFNTYEGL

SEQ ID NO: 1353823 - protein, 9 aa, Homo Sapiens
APVQPPHDS

SEQ ID NO: 1353824 - protein, 9 aa, Homo Sapiens
GDAVPPGSP

SEQ ID NO: 1353825 - protein, 9 aa, Homo Sapiens
GIDTDTIEA

SEQ ID NO: 1353826 - protein, 9 aa, Homo Sapiens
LIPKRSSLE

SEQ ID NO: 1353827 - protein, 9 aa, Homo Sapiens
KWAFREIQL

SEQ ID NO: 1353828 - protein, 9 aa, Homo Sapiens
GVGSFTDPD

SEQ ID NO: 1353829 - protein, 9 aa, Homo Sapiens
SPVRVRMHN

SEQ ID NO: 1353830 - protein, 9 aa, Homo Sapiens
DKEEVTVST

SEQ ID NO: 1353831 - protein, 9 aa, Homo Sapiens
HMYLVLVKV

SEQ ID NO: 1353832 - protein, 9 aa, Homo Sapiens
TQITCGRWH

SEQ ID NO: 1353833 - protein, 9 aa, Homo Sapiens
EGQHKDMVC

SEQ ID NO: 1353834 - protein, 9 aa, Homo Sapiens
PVDPGPPGE

SEQ ID NO: 1353835 - protein, 9 aa, Homo Sapiens
PVNMVVFVT

SEQ ID NO: 1353836 - protein, 9 aa, Homo Sapiens
VLYVYAACE

SEQ ID NO: 1353837 - protein, 9 aa, Homo Sapiens
SSPSRLMWL

SEQ ID NO: 1353838 - protein, 9 aa, Homo Sapiens
VGHPKHLEQ

SEQ ID NO: 1353839 - protein, 9 aa, Homo Sapiens
KFIFSTEER

SEQ ID NO: 1353840 - protein, 9 aa, Homo Sapiens
RLTVMTDLV

SEQ ID NO: 1353841 - protein, 9 aa, Homo Sapiens
NTSHIKVSV

SEQ ID NO: 1353842 - protein, 9 aa, Homo Sapiens
TKGGNKKFF

SEQ ID NO: 1353843 - protein, 9 aa, Homo Sapiens
IKGYRTVVT

SEQ ID NO: 1353844 - protein, 9 aa, Homo Sapiens
KSMLDPAQK

SEQ ID NO: 1353845 - protein, 9 aa, Homo Sapiens
PEAELQKYS

SEQ ID NO: 1353846 - protein, 9 aa, Homo Sapiens
TSPVTRHRS

SEQ ID NO: 1353847 - protein, 9 aa, Homo Sapiens
HCYVIYRLY

SEQ ID NO: 1353848 - protein, 9 aa, Homo Sapiens
YLCFHYGTE

SEQ ID NO: 1353849 - protein, 9 aa, Homo Sapiens
IDRADENID

SEQ ID NO: 1353850 - protein, 9 aa, Homo Sapiens
HVPEELKQL

SEQ ID NO: 1353851 - protein, 9 aa, Homo Sapiens
HKGEIPKDE

SEQ ID NO: 1353852 - protein, 9 aa, Homo Sapiens
TTRGFICKC

SEQ ID NO: 1353853 - protein, 9 aa, Homo Sapiens
RLGQMDTNG

SEQ ID NO: 1353854 - protein, 9 aa, Homo Sapiens
EQYLVQTLS

SEQ ID NO: 1353855 - protein, 9 aa, Homo Sapiens
EDFEMIDAG

SEQ ID NO: 1353856 - protein, 9 aa, Homo Sapiens
FRSCKPWAT

SEQ ID NO: 1353857 - protein, 9 aa, Homo Sapiens
IMALNPRTQ

SEQ ID NO: 1353858 - protein, 9 aa, Homo Sapiens
SYSGKAADM

SEQ ID NO: 1353859 - protein, 9 aa, Homo Sapiens
TKGGSCPFR

SEQ ID NO: 1353860 - protein, 9 aa, Homo Sapiens
DTLIFLPPV

SEQ ID NO: 1353861 - protein, 9 aa, Homo Sapiens
VSIGSICLL

SEQ ID NO: 1353862 - protein, 9 aa, Homo Sapiens
NITGPGADS

SEQ ID NO: 1353863 - protein, 9 aa, Homo Sapiens
MKTEGDAPA

SEQ ID NO: 1353864 - protein, 9 aa, Homo Sapiens
CGKTFGSGS

SEQ ID NO: 1353865 - protein, 9 aa, Homo Sapiens
SSWVEDCNN

SEQ ID NO: 1353866 - protein, 9 aa, Homo Sapiens
PIQGLPDLP

SEQ ID NO: 1353867 - protein, 9 aa, Homo Sapiens
EEDEKNETK

SEQ ID NO: 1353868 - protein, 9 aa, Homo Sapiens
AVIISTPQD

SEQ ID NO: 1353869 - protein, 9 aa, Homo Sapiens
SDVVMFITI

SEQ ID NO: 1353870 - protein, 9 aa, Homo Sapiens
DGAWGQWTP

SEQ ID NO: 1353871 - protein, 9 aa, Homo Sapiens
LPELQPAVP

SEQ ID NO: 1353872 - protein, 9 aa, Homo Sapiens
DSMSQSSQD

SEQ ID NO: 1353873 - protein, 9 aa, Homo Sapiens
GPAKVAHMR

SEQ ID NO: 1353874 - protein, 9 aa, Homo Sapiens
LVCTSLGLA

SEQ ID NO: 1353875 - protein, 9 aa, Homo Sapiens
EMYFVSYDI

SEQ ID NO: 1353876 - protein, 9 aa, Homo Sapiens
PNALRYAVD

SEQ ID NO: 1353877 - protein, 9 aa, Homo Sapiens
IHHVDAHAT

SEQ ID NO: 1353878 - protein, 9 aa, Homo Sapiens
GQLMEFCRL

SEQ ID NO: 1353879 - protein, 9 aa, Homo Sapiens
IVGVHLVSE

SEQ ID NO: 1353880 - protein, 9 aa, Homo Sapiens
TSLAALSNG

SEQ ID NO: 1353881 - protein, 9 aa, Homo Sapiens
NVPVGTSVI

SEQ ID NO: 1353882 - protein, 9 aa, Homo Sapiens
ILYNLYGLL

SEQ ID NO: 1353883 - protein, 9 aa, Homo Sapiens
QPHHKILDM

SEQ ID NO: 1353884 - protein, 9 aa, Homo Sapiens
SSVTESDGS

SEQ ID NO: 1353885 - protein, 9 aa, Homo Sapiens
VNMLYKKIE

SEQ ID NO: 1353886 - protein, 9 aa, Homo Sapiens
HTRLQEMER

SEQ ID NO: 1353887 - protein, 9 aa, Homo Sapiens
LTSFSILMP

SEQ ID NO: 1353888 - protein, 9 aa, Homo Sapiens
ELWFNTDED

SEQ ID NO: 1353889 - protein, 9 aa, Homo Sapiens
DMPMRSKAK

SEQ ID NO: 1353890 - protein, 9 aa, Homo Sapiens
VLHEWYLLN

SEQ ID NO: 1353891 - protein, 9 aa, Homo Sapiens
RSNNQFENE

SEQ ID NO: 1353892 - protein, 9 aa, Homo Sapiens
PPGPAGPAS

SEQ ID NO: 1353893 - protein, 9 aa, Homo Sapiens
LTVPGSLCS

SEQ ID NO: 1353894 - protein, 9 aa, Homo Sapiens
MEDAPSEVD

SEQ ID NO: 1353895 - protein, 9 aa, Homo Sapiens
ILMYRRKSK

SEQ ID NO: 1353896 - protein, 9 aa, Homo Sapiens
LADDKQKVK

SEQ ID NO: 1353897 - protein, 9 aa, Homo Sapiens
EISGKLSAT

SEQ ID NO: 1353898 - protein, 9 aa, Homo Sapiens
NQFMGGIDR

SEQ ID NO: 1353899 - protein, 9 aa, Homo Sapiens
KDYMCQAGE

SEQ ID NO: 1353900 - protein, 9 aa, Homo Sapiens
DPNIKYVFR

SEQ ID NO: 1353901 - protein, 9 aa, Homo Sapiens
IHKDGDDFK

SEQ ID NO: 1353902 - protein, 9 aa, Homo Sapiens
IQDTQAHLG

SEQ ID NO: 1353903 - protein, 9 aa, Homo Sapiens
YVSNHVFNQ

SEQ ID NO: 1353904 - protein, 9 aa, Homo Sapiens
DGTHCYTES

SEQ ID NO: 1353905 - protein, 9 aa, Homo Sapiens
LMNLPEDKL

SEQ ID NO: 1353906 - protein, 9 aa, Homo Sapiens
VHGSDEHGC

SEQ ID NO: 1353907 - protein, 9 aa, Homo Sapiens
NRSRTNGSV

SEQ ID NO: 1353908 - protein, 9 aa, Homo Sapiens
AEPSRGENV

SEQ ID NO: 1353909 - protein, 9 aa, Homo Sapiens
CGPYCTSKA

SEQ ID NO: 1353910 - protein, 9 aa, Homo Sapiens
GKGQTGVMI

SEQ ID NO: 1353911 - protein, 9 aa, Homo Sapiens
WNDMEHIWQ

SEQ ID NO: 1353912 - protein, 9 aa, Homo Sapiens
ATRNFGFIF

SEQ ID NO: 1353913 - protein, 9 aa, Homo Sapiens
YGSGWSSSR

SEQ ID NO: 1353914 - protein, 9 aa, Homo Sapiens
CCSWRQNDK

SEQ ID NO: 1353915 - protein, 9 aa, Homo Sapiens
LPLPGYKVH

SEQ ID NO: 1353916 - protein, 9 aa, Homo Sapiens
RGWDHTASG

SEQ ID NO: 1353917 - protein, 9 aa, Homo Sapiens
VPAMQRTMC

SEQ ID NO: 1353918 - protein, 9 aa, Homo Sapiens
PPGPVGPTG

SEQ ID NO: 1353919 - protein, 9 aa, Homo Sapiens
RSGRRVLYV

SEQ ID NO: 1353920 - protein, 9 aa, Homo Sapiens
NQRLNRAVT

SEQ ID NO: 1353921 - protein, 9 aa, Homo Sapiens
PMLVRLACA

SEQ ID NO: 1353922 - protein, 9 aa, Homo Sapiens
KTVFNRHKM

SEQ ID NO: 1353923 - protein, 9 aa, Homo Sapiens
KKTTELTEA

SEQ ID NO: 1353924 - protein, 9 aa, Homo Sapiens
WMSFDVTDT

SEQ ID NO: 1353925 - protein, 9 aa, Homo Sapiens
TATLTAGQL

SEQ ID NO: 1353926 - protein, 9 aa, Homo Sapiens
QGRDDDASN

SEQ ID NO: 1353927 - protein, 9 aa, Homo Sapiens
IEDISGKSF

SEQ ID NO: 1353928 - protein, 9 aa, Homo Sapiens
ELKATDNIV

SEQ ID NO: 1353929 - protein, 9 aa, Homo Sapiens
RCELISQLC

SEQ ID NO: 1353930 - protein, 9 aa, Homo Sapiens
FISSRQTGI

SEQ ID NO: 1353931 - protein, 9 aa, Homo Sapiens
MLGGEEVRP

SEQ ID NO: 1353932 - protein, 9 aa, Homo Sapiens
YREGRRPPT

SEQ ID NO: 1353933 - protein, 9 aa, Homo Sapiens
ACHLTLDEM

SEQ ID NO: 1353934 - protein, 9 aa, Homo Sapiens
RKSGVDNIF

SEQ ID NO: 1353935 - protein, 9 aa, Homo Sapiens
TECGRRLSE

SEQ ID NO: 1353936 - protein, 9 aa, Homo Sapiens
VKVELRQYF

SEQ ID NO: 1353937 - protein, 9 aa, Homo Sapiens
NATHEQTAA

SEQ ID NO: 1353938 - protein, 9 aa, Homo Sapiens
LITIAIFQI

SEQ ID NO: 1353939 - protein, 9 aa, Homo Sapiens
EGQEKNLLE

SEQ ID NO: 1353940 - protein, 9 aa, Homo Sapiens
LVLVKVFNT

SEQ ID NO: 1353941 - protein, 9 aa, Homo Sapiens
VFSLKKFVY

SEQ ID NO: 1353942 - protein, 9 aa, Homo Sapiens
DTRFWMWIN

SEQ ID NO: 1353943 - protein, 9 aa, Homo Sapiens
DQQEKEKKF

SEQ ID NO: 1353944 - protein, 9 aa, Homo Sapiens
ITVDGKTAN

SEQ ID NO: 1353945 - protein, 9 aa, Homo Sapiens
VPEYLYHVN

SEQ ID NO: 1353946 - protein, 9 aa, Homo Sapiens
HYQHILQLR

SEQ ID NO: 1353947 - protein, 9 aa, Homo Sapiens
EEADLNHKF

SEQ ID NO: 1353948 - protein, 9 aa, Homo Sapiens
IHISSSPQN

SEQ ID NO: 1353949 - protein, 9 aa, Homo Sapiens
ILNEENDVN

SEQ ID NO: 1353950 - protein, 9 aa, Homo Sapiens
GATLARTQQ

SEQ ID NO: 1353951 - protein, 9 aa, Homo Sapiens
LLKLVTEMV

SEQ ID NO: 1353952 - protein, 9 aa, Homo Sapiens
FTFDRTCTE

SEQ ID NO: 1353953 - protein, 9 aa, Homo Sapiens
LQPIDFGAM

SEQ ID NO: 1353954 - protein, 9 aa, Homo Sapiens
AILCIEVEA

SEQ ID NO: 1353955 - protein, 9 aa, Homo Sapiens
HVPPPPPIA

SEQ ID NO: 1353956 - protein, 9 aa, Homo Sapiens
KKWFHGLGS

SEQ ID NO: 1353957 - protein, 9 aa, Homo Sapiens
GKTHHPHGK

SEQ ID NO: 1353958 - protein, 9 aa, Homo Sapiens
WLERAYGRL

SEQ ID NO: 1353959 - protein, 9 aa, Homo Sapiens
LPLTHTQDL

SEQ ID NO: 1353960 - protein, 9 aa, Homo Sapiens
KDIDWGKHC

SEQ ID NO: 1353961 - protein, 9 aa, Homo Sapiens
YIDRLFQIS

SEQ ID NO: 1353962 - protein, 9 aa, Homo Sapiens
VLASNGHIP

SEQ ID NO: 1353963 - protein, 9 aa, Homo Sapiens
KGLTLNSNT

SEQ ID NO: 1353964 - protein, 9 aa, Homo Sapiens
ESRGPCSDT

SEQ ID NO: 1353965 - protein, 9 aa, Homo Sapiens
VYDPEDWLQ

SEQ ID NO: 1353966 - protein, 9 aa, Homo Sapiens
FRDNHMDRR

SEQ ID NO: 1353967 - protein, 9 aa, Homo Sapiens
MVVMNKKKC

SEQ ID NO: 1353968 - protein, 9 aa, Homo Sapiens
YPISKKRAT

SEQ ID NO: 1353969 - protein, 9 aa, Homo Sapiens
PARSPSPPH

SEQ ID NO: 1353970 - protein, 9 aa, Homo Sapiens
ATIMSPNDS

SEQ ID NO: 1353971 - protein, 9 aa, Homo Sapiens
HPSRPCRMR

SEQ ID NO: 1353972 - protein, 9 aa, Homo Sapiens
TTQLIPALV

SEQ ID NO: 1353973 - protein, 9 aa, Homo Sapiens
MRLPHMFKQ

SEQ ID NO: 1353974 - protein, 9 aa, Homo Sapiens
HTLGLFIVA

SEQ ID NO: 1353975 - protein, 9 aa, Homo Sapiens
YRNVESLCV

SEQ ID NO: 1353976 - protein, 9 aa, Homo Sapiens
YTIKCNYVD

SEQ ID NO: 1353977 - protein, 9 aa, Homo Sapiens
LKRVSALLN

SEQ ID NO: 1353978 - protein, 9 aa, Homo Sapiens
AGVSLVRVC

SEQ ID NO: 1353979 - protein, 9 aa, Homo Sapiens
GFNMRVPLP

SEQ ID NO: 1353980 - protein, 9 aa, Homo Sapiens
NTGSVSVTQ

SEQ ID NO: 1353981 - protein, 9 aa, Homo Sapiens
LVNPFNNIT

SEQ ID NO: 1353982 - protein, 9 aa, Homo Sapiens
LVFYSQETR

SEQ ID NO: 1353983 - protein, 9 aa, Homo Sapiens
TGVCHHTQD

SEQ ID NO: 1353984 - protein, 9 aa, Homo Sapiens
HDYLGLNSQ

SEQ ID NO: 1353985 - protein, 9 aa, Homo Sapiens
RCTGAGTAG

SEQ ID NO: 1353986 - protein, 9 aa, Homo Sapiens
YLRETVGEP

SEQ ID NO: 1353987 - protein, 9 aa, Homo Sapiens
RCDLIGFEF

SEQ ID NO: 1353988 - protein, 9 aa, Homo Sapiens
WQLRCTIWI

SEQ ID NO: 1353989 - protein, 9 aa, Homo Sapiens
NQSQNPNLN

SEQ ID NO: 1353990 - protein, 9 aa, Homo Sapiens
NYMLLAKHL

SEQ ID NO: 1353991 - protein, 9 aa, Homo Sapiens
ISYICSQQD

SEQ ID NO: 1353992 - protein, 9 aa, Homo Sapiens
EDDIMEEKP

SEQ ID NO: 1353993 - protein, 9 aa, Homo Sapiens
DVLGITKHL

SEQ ID NO: 1353994 - protein, 9 aa, Homo Sapiens
KCKPDIMLP

SEQ ID NO: 1353995 - protein, 9 aa, Homo Sapiens
YLRAYFPDA

SEQ ID NO: 1353996 - protein, 9 aa, Homo Sapiens
PEAMRPSGH

SEQ ID NO: 1353997 - protein, 9 aa, Homo Sapiens
TRDASIIKG

SEQ ID NO: 1353998 - protein, 9 aa, Homo Sapiens
QEVQLEAIL

SEQ ID NO: 1353999 - protein, 9 aa, Homo Sapiens
TLWRLWSLP

SEQ ID NO: 1354000 - protein, 9 aa, Homo Sapiens
VALTQATRT

SEQ ID NO: 1354001 - protein, 9 aa, Homo Sapiens
HVFNQSAEL

SEQ ID NO: 1354002 - protein, 9 aa, Homo Sapiens
KTVFDNFFY

SEQ ID NO: 1354003 - protein, 9 aa, Homo Sapiens
INFLICEDG

SEQ ID NO: 1354004 - protein, 9 aa, Homo Sapiens
IKHAPARAP

SEQ ID NO: 1354005 - protein, 9 aa, Homo Sapiens
TALEKYHDS

SEQ ID NO: 1354006 - protein, 9 aa, Homo Sapiens
TIWYVHFLW

SEQ ID NO: 1354007 - protein, 9 aa, Homo Sapiens
EEFVEAEDG

SEQ ID NO: 1354008 - protein, 9 aa, Homo Sapiens
FRSIRDPPE

SEQ ID NO: 1354009 - protein, 9 aa, Homo Sapiens
SLVDSKTYA

SEQ ID NO: 1354010 - protein, 9 aa, Homo Sapiens
SGRKLMWLY

SEQ ID NO: 1354011 - protein, 9 aa, Homo Sapiens
KFKYAHEYD

SEQ ID NO: 1354012 - protein, 9 aa, Homo Sapiens
SLRFSVFDI

SEQ ID NO: 1354013 - protein, 9 aa, Homo Sapiens
KCPDEGVRG

SEQ ID NO: 1354014 - protein, 9 aa, Homo Sapiens
FLQDINKPD

SEQ ID NO: 1354015 - protein, 9 aa, Homo Sapiens
QLTRALPLN

SEQ ID NO: 1354016 - protein, 9 aa, Homo Sapiens
LKEVDQLHL

SEQ ID NO: 1354017 - protein, 9 aa, Homo Sapiens
FLSFLITHI

SEQ ID NO: 1354018 - protein, 9 aa, Homo Sapiens
PISSWTCLA

SEQ ID NO: 1354019 - protein, 9 aa, Homo Sapiens
LAVLLKVVH

SEQ ID NO: 1354020 - protein, 9 aa, Homo Sapiens
AQAQDALDT

SEQ ID NO: 1354021 - protein, 9 aa, Homo Sapiens
PMTNITWMA

SEQ ID NO: 1354022 - protein, 9 aa, Homo Sapiens
NLLDEDKDG

SEQ ID NO: 1354023 - protein, 9 aa, Homo Sapiens
LLHLLTCVE

SEQ ID NO: 1354024 - protein, 9 aa, Homo Sapiens
VTTKTHWYS

SEQ ID NO: 1354025 - protein, 9 aa, Homo Sapiens
NDSKLEEVN

SEQ ID NO: 1354026 - protein, 9 aa, Homo Sapiens
ISSFTPQGH

SEQ ID NO: 1354027 - protein, 9 aa, Homo Sapiens
CEVLPRSAE

SEQ ID NO: 1354028 - protein, 9 aa, Homo Sapiens
MDKAEGSVA

SEQ ID NO: 1354029 - protein, 9 aa, Homo Sapiens
PARDKRTLK

SEQ ID NO: 1354030 - protein, 9 aa, Homo Sapiens
PLPYEFSCS

SEQ ID NO: 1354031 - protein, 9 aa, Homo Sapiens
PPRSMPLEE

SEQ ID NO: 1354032 - protein, 9 aa, Homo Sapiens
SIKDEDQTS

SEQ ID NO: 1354033 - protein, 9 aa, Homo Sapiens
HSAFTPEFQ

SEQ ID NO: 1354034 - protein, 9 aa, Homo Sapiens
ASDELASCG

SEQ ID NO: 1354035 - protein, 9 aa, Homo Sapiens
HTMNLEAVN

SEQ ID NO: 1354036 - protein, 9 aa, Homo Sapiens
NVLTTQQQQ

SEQ ID NO: 1354037 - protein, 9 aa, Homo Sapiens
HDILNMEKT

SEQ ID NO: 1354038 - protein, 9 aa, Homo Sapiens
LSWGQRKNF

SEQ ID NO: 1354039 - protein, 9 aa, Homo Sapiens
LTATLKLQD

SEQ ID NO: 1354040 - protein, 9 aa, Homo Sapiens
ISPLVKDIR

SEQ ID NO: 1354041 - protein, 9 aa, Homo Sapiens
CMTTLVMVE

SEQ ID NO: 1354042 - protein, 9 aa, Homo Sapiens
WRQFIKGSS

SEQ ID NO: 1354043 - protein, 9 aa, Homo Sapiens
CLAQLFMMS

SEQ ID NO: 1354044 - protein, 9 aa, Homo Sapiens
VKESTRASF

SEQ ID NO: 1354045 - protein, 9 aa, Homo Sapiens
QTLEDFKEM

SEQ ID NO: 1354046 - protein, 9 aa, Homo Sapiens
HLYEDTLID

SEQ ID NO: 1354047 - protein, 9 aa, Homo Sapiens
WKKEAISDL

SEQ ID NO: 1354048 - protein, 9 aa, Homo Sapiens
CVEPDRLLS

SEQ ID NO: 1354049 - protein, 9 aa, Homo Sapiens
GWNFTGTHS

SEQ ID NO: 1354050 - protein, 9 aa, Homo Sapiens
MLQGVAQPT

SEQ ID NO: 1354051 - protein, 9 aa, Homo Sapiens
FEVAFSSVE

SEQ ID NO: 1354052 - protein, 9 aa, Homo Sapiens
YDVGHCPVK

SEQ ID NO: 1354053 - protein, 9 aa, Homo Sapiens
WCSRLQAHE

SEQ ID NO: 1354054 - protein, 9 aa, Homo Sapiens
DGALLRGLG

SEQ ID NO: 1354055 - protein, 9 aa, Homo Sapiens
EAITKHNQV

SEQ ID NO: 1354056 - protein, 9 aa, Homo Sapiens
SGPLHRLIM

SEQ ID NO: 1354057 - protein, 9 aa, Homo Sapiens
IFYCAKVAS

SEQ ID NO: 1354058 - protein, 9 aa, Homo Sapiens
LDWQCRCDD

SEQ ID NO: 1354059 - protein, 9 aa, Homo Sapiens
ETLTIQRLH

SEQ ID NO: 1354060 - protein, 9 aa, Homo Sapiens
TLQVLYQAC

SEQ ID NO: 1354061 - protein, 9 aa, Homo Sapiens
TLLADLTRS

SEQ ID NO: 1354062 - protein, 9 aa, Homo Sapiens
GTGHSSLNM

SEQ ID NO: 1354063 - protein, 9 aa, Homo Sapiens
LELFRIELD

SEQ ID NO: 1354064 - protein, 9 aa, Homo Sapiens
MVRTILPKN

SEQ ID NO: 1354065 - protein, 9 aa, Homo Sapiens
RANLVESLC

SEQ ID NO: 1354066 - protein, 9 aa, Homo Sapiens
DSTGPNILT

SEQ ID NO: 1354067 - protein, 9 aa, Homo Sapiens
KRRDDVRHQ

SEQ ID NO: 1354068 - protein, 9 aa, Homo Sapiens
QRKPKRANC

SEQ ID NO: 1354069 - protein, 9 aa, Homo Sapiens
CPVIKQEGD

SEQ ID NO: 1354070 - protein, 9 aa, Homo Sapiens
RALVHYDNV

SEQ ID NO: 1354071 - protein, 9 aa, Homo Sapiens
GWETASAID

SEQ ID NO: 1354072 - protein, 9 aa, Homo Sapiens
KDVSAETLI

SEQ ID NO: 1354073 - protein, 9 aa, Homo Sapiens
PRSHFEQWG

SEQ ID NO: 1354074 - protein, 9 aa, Homo Sapiens
NVVAVGTGF

SEQ ID NO: 1354075 - protein, 9 aa, Homo Sapiens
HHLINEYRS

SEQ ID NO: 1354076 - protein, 9 aa, Homo Sapiens
KGCVRGLWA

SEQ ID NO: 1354077 - protein, 9 aa, Homo Sapiens
KLKASQVRD

SEQ ID NO: 1354078 - protein, 9 aa, Homo Sapiens
VIGAVNSLH

SEQ ID NO: 1354079 - protein, 9 aa, Homo Sapiens
KMFLSIHHL

SEQ ID NO: 1354080 - protein, 9 aa, Homo Sapiens
SSPEPPVQP

SEQ ID NO: 1354081 - protein, 9 aa, Homo Sapiens
LKQDTQNVL

SEQ ID NO: 1354082 - protein, 9 aa, Homo Sapiens
GGGIGHQKC

SEQ ID NO: 1354083 - protein, 9 aa, Homo Sapiens
APRSQSRLY

SEQ ID NO: 1354084 - protein, 9 aa, Homo Sapiens
QTAIEMKDT

SEQ ID NO: 1354085 - protein, 9 aa, Homo Sapiens
GGMCPFHHI

SEQ ID NO: 1354086 - protein, 9 aa, Homo Sapiens
INCDRFYLI

SEQ ID NO: 1354087 - protein, 9 aa, Homo Sapiens
LLHQLHPNT

SEQ ID NO: 1354088 - protein, 9 aa, Homo Sapiens
EECDKAFTW

SEQ ID NO: 1354089 - protein, 9 aa, Homo Sapiens
QAHVMDRHH

SEQ ID NO: 1354090 - protein, 9 aa, Homo Sapiens
MIWFYAKIY

SEQ ID NO: 1354091 - protein, 9 aa, Homo Sapiens
LMLKQEGDD

SEQ ID NO: 1354092 - protein, 9 aa, Homo Sapiens
DDYTYISVT

SEQ ID NO: 1354093 - protein, 9 aa, Homo Sapiens
CQEVLYHIS

SEQ ID NO: 1354094 - protein, 9 aa, Homo Sapiens
NLLLGKCTY

SEQ ID NO: 1354095 - protein, 9 aa, Homo Sapiens
LGALINTLG

SEQ ID NO: 1354096 - protein, 9 aa, Homo Sapiens
ETTAKTQLY

SEQ ID NO: 1354097 - protein, 9 aa, Homo Sapiens
TEQGMRQLE

SEQ ID NO: 1354098 - protein, 9 aa, Homo Sapiens
RDTKIFYNI

SEQ ID NO: 1354099 - protein, 9 aa, Homo Sapiens
CGWWPFSKS

SEQ ID NO: 1354100 - protein, 9 aa, Homo Sapiens
TRFQKLEWE

SEQ ID NO: 1354101 - protein, 9 aa, Homo Sapiens
QGLCWLHID

SEQ ID NO: 1354102 - protein, 9 aa, Homo Sapiens
SQLRDPHHD

SEQ ID NO: 1354103 - protein, 9 aa, Homo Sapiens
KCTVCEKTF

SEQ ID NO: 1354104 - protein, 9 aa, Homo Sapiens
IGTVVVLRL

SEQ ID NO: 1354105 - protein, 9 aa, Homo Sapiens
KELNERQQA

SEQ ID NO: 1354106 - protein, 9 aa, Homo Sapiens
TFLIQAHTV

SEQ ID NO: 1354107 - protein, 9 aa, Homo Sapiens
AFRRGCLRW

SEQ ID NO: 1354108 - protein, 9 aa, Homo Sapiens
LSSIASTMA

SEQ ID NO: 1354109 - protein, 9 aa, Homo Sapiens
CLMKRHVHE

SEQ ID NO: 1354110 - protein, 9 aa, Homo Sapiens
MSPCSECEV

SEQ ID NO: 1354111 - protein, 9 aa, Homo Sapiens
DLSDTLVIF

SEQ ID NO: 1354112 - protein, 9 aa, Homo Sapiens
SGQRYVHET

SEQ ID NO: 1354113 - protein, 9 aa, Homo Sapiens
KITHVPENP

SEQ ID NO: 1354114 - protein, 9 aa, Homo Sapiens
KKCGCENVQ

SEQ ID NO: 1354115 - protein, 9 aa, Homo Sapiens
NGINSVRFF

SEQ ID NO: 1354116 - protein, 9 aa, Homo Sapiens
RTLEDEEEL

SEQ ID NO: 1354117 - protein, 9 aa, Homo Sapiens
MYLVLVKVF

SEQ ID NO: 1354118 - protein, 9 aa, Homo Sapiens
LVMAALYGR

SEQ ID NO: 1354119 - protein, 9 aa, Homo Sapiens
SQMTVPIQM

SEQ ID NO: 1354120 - protein, 9 aa, Homo Sapiens
MGGIDRADE

SEQ ID NO: 1354121 - protein, 9 aa, Homo Sapiens
LLLQLYSGH

SEQ ID NO: 1354122 - protein, 9 aa, Homo Sapiens
LPSPRIPML

SEQ ID NO: 1354123 - protein, 9 aa, Homo Sapiens
SVQQRLTEP

SEQ ID NO: 1354124 - protein, 9 aa, Homo Sapiens
AKSLNACVS

SEQ ID NO: 1354125 - protein, 9 aa, Homo Sapiens
IVNTSISLH

SEQ ID NO: 1354126 - protein, 9 aa, Homo Sapiens
LPSPVEEHC

SEQ ID NO: 1354127 - protein, 9 aa, Homo Sapiens
KHTLPVGGM

SEQ ID NO: 1354128 - protein, 9 aa, Homo Sapiens
MWQLVSFQK

SEQ ID NO: 1354129 - protein, 9 aa, Homo Sapiens
DRENHTSLE

SEQ ID NO: 1354130 - protein, 9 aa, Homo Sapiens
RYQSLKQFN

SEQ ID NO: 1354131 - protein, 9 aa, Homo Sapiens
DPSLQSAAY

SEQ ID NO: 1354132 - protein, 9 aa, Homo Sapiens
GQKKPVCVF

SEQ ID NO: 1354133 - protein, 9 aa, Homo Sapiens
FFPSYLSSK

SEQ ID NO: 1354134 - protein, 9 aa, Homo Sapiens
ATADPTALA

SEQ ID NO: 1354135 - protein, 9 aa, Homo Sapiens
RGGSKRKYC

SEQ ID NO: 1354136 - protein, 9 aa, Homo Sapiens
GRGWEVVFR

SEQ ID NO: 1354137 - protein, 9 aa, Homo Sapiens
EDVEAAMRY

SEQ ID NO: 1354138 - protein, 9 aa, Homo Sapiens
DKWFLYKMH

SEQ ID NO: 1354139 - protein, 9 aa, Homo Sapiens
GLALTLGPS

SEQ ID NO: 1354140 - protein, 9 aa, Homo Sapiens
LWEQSEQLE

SEQ ID NO: 1354141 - protein, 9 aa, Homo Sapiens
SKHHPGQSS

SEQ ID NO: 1354142 - protein, 9 aa, Homo Sapiens
SPEKGCWTE

SEQ ID NO: 1354143 - protein, 9 aa, Homo Sapiens
RARMERLTK

SEQ ID NO: 1354144 - protein, 9 aa, Homo Sapiens
PRPRTYYLE

SEQ ID NO: 1354145 - protein, 9 aa, Homo Sapiens
VGFEAHYVW

SEQ ID NO: 1354146 - protein, 9 aa, Homo Sapiens
HFVNSLHKY

SEQ ID NO: 1354147 - protein, 9 aa, Homo Sapiens
WLWCSLLSQ

SEQ ID NO: 1354148 - protein, 9 aa, Homo Sapiens
VASQKNFIL

SEQ ID NO: 1354149 - protein, 9 aa, Homo Sapiens
KKRLVHKEA

SEQ ID NO: 1354150 - protein, 9 aa, Homo Sapiens
FWLDPSKKV

SEQ ID NO: 1354151 - protein, 9 aa, Homo Sapiens
SSAASAGRP

SEQ ID NO: 1354152 - protein, 9 aa, Homo Sapiens
INETTFNSI

SEQ ID NO: 1354153 - protein, 9 aa, Homo Sapiens
LQKYSVLST

SEQ ID NO: 1354154 - protein, 9 aa, Homo Sapiens
FIALYQSQR

SEQ ID NO: 1354155 - protein, 9 aa, Homo Sapiens
DDDEGSPGG

SEQ ID NO: 1354156 - protein, 9 aa, Homo Sapiens
EQREEEETV

SEQ ID NO: 1354157 - protein, 9 aa, Homo Sapiens
VRRTQHYLY

SEQ ID NO: 1354158 - protein, 9 aa, Homo Sapiens
QGRYSFEDE

SEQ ID NO: 1354159 - protein, 9 aa, Homo Sapiens
GYVCSEKSA

SEQ ID NO: 1354160 - protein, 9 aa, Homo Sapiens
FETRGKLRH

SEQ ID NO: 1354161 - protein, 9 aa, Homo Sapiens
AMTTQAHSS

SEQ ID NO: 1354162 - protein, 9 aa, Homo Sapiens
VMILMNPVA

SEQ ID NO: 1354163 - protein, 9 aa, Homo Sapiens
VLMEDTGWY

SEQ ID NO: 1354164 - protein, 9 aa, Homo Sapiens
IVISLDLYT

SEQ ID NO: 1354165 - protein, 9 aa, Homo Sapiens
HKSKEWYHA

SEQ ID NO: 1354166 - protein, 9 aa, Homo Sapiens
GTHWRIYRP

SEQ ID NO: 1354167 - protein, 9 aa, Homo Sapiens
VQQLKVSVK

SEQ ID NO: 1354168 - protein, 9 aa, Homo Sapiens
ISTAGYIIP

SEQ ID NO: 1354169 - protein, 9 aa, Homo Sapiens
YPDDIRHIR

SEQ ID NO: 1354170 - protein, 9 aa, Homo Sapiens
KDRFSLPII

SEQ ID NO: 1354171 - protein, 9 aa, Homo Sapiens
QLSRHTQQI

SEQ ID NO: 1354172 - protein, 9 aa, Homo Sapiens
LVLYLVMLV

SEQ ID NO: 1354173 - protein, 9 aa, Homo Sapiens
SIGSICLLS

SEQ ID NO: 1354174 - protein, 9 aa, Homo Sapiens
DDVEVTVCS

SEQ ID NO: 1354175 - protein, 9 aa, Homo Sapiens
ANGVLSLPT

SEQ ID NO: 1354176 - protein, 9 aa, Homo Sapiens
YGSVYAITD

SEQ ID NO: 1354177 - protein, 9 aa, Homo Sapiens
KQAKCNARS

SEQ ID NO: 1354178 - protein, 9 aa, Homo Sapiens
ILALCVISY

SEQ ID NO: 1354179 - protein, 9 aa, Homo Sapiens
KMEEMLTCI

SEQ ID NO: 1354180 - protein, 9 aa, Homo Sapiens
RNTSGLTAA

SEQ ID NO: 1354181 - protein, 9 aa, Homo Sapiens
DTVDFEWEC

SEQ ID NO: 1354182 - protein, 9 aa, Homo Sapiens
DRFMAICNP

SEQ ID NO: 1354183 - protein, 9 aa, Homo Sapiens
KDTMDIEWL

SEQ ID NO: 1354184 - protein, 9 aa, Homo Sapiens
ITLEEHLHA

SEQ ID NO: 1354185 - protein, 9 aa, Homo Sapiens
VCAKPSAPV

SEQ ID NO: 1354186 - protein, 9 aa, Homo Sapiens
DFTGVVAVL

SEQ ID NO: 1354187 - protein, 9 aa, Homo Sapiens
SFDTGSDHL

SEQ ID NO: 1354188 - protein, 9 aa, Homo Sapiens
ICIACSYGQ

SEQ ID NO: 1354189 - protein, 9 aa, Homo Sapiens
QRCCDHMIR

SEQ ID NO: 1354190 - protein, 9 aa, Homo Sapiens
VPPWKSSAV

SEQ ID NO: 1354191 - protein, 9 aa, Homo Sapiens
TAAALKRAG

SEQ ID NO: 1354192 - protein, 9 aa, Homo Sapiens
SKCQFSSGL

SEQ ID NO: 1354193 - protein, 9 aa, Homo Sapiens
LEAIERVAF

SEQ ID NO: 1354194 - protein, 9 aa, Homo Sapiens
LREVDKVLA

SEQ ID NO: 1354195 - protein, 9 aa, Homo Sapiens
DSEGNVSFL

SEQ ID NO: 1354196 - protein, 9 aa, Homo Sapiens
YTISKGFFG

SEQ ID NO: 1354197 - protein, 9 aa, Homo Sapiens
PTILPTLHS

SEQ ID NO: 1354198 - protein, 9 aa, Homo Sapiens
PESASDTIK

SEQ ID NO: 1354199 - protein, 9 aa, Homo Sapiens
GDADISITS

SEQ ID NO: 1354200 - protein, 9 aa, Homo Sapiens
SLNKKVQTC

SEQ ID NO: 1354201 - protein, 9 aa, Homo Sapiens
SGALPPPSP

SEQ ID NO: 1354202 - protein, 9 aa, Homo Sapiens
ALACVSLLR

SEQ ID NO: 1354203 - protein, 9 aa, Homo Sapiens
KYISENCEM

SEQ ID NO: 1354204 - protein, 9 aa, Homo Sapiens
KMLEQIRAL

SEQ ID NO: 1354205 - protein, 9 aa, Homo Sapiens
NAAVRAVTH

SEQ ID NO: 1354206 - protein, 9 aa, Homo Sapiens
KDCLKIIEE

SEQ ID NO: 1354207 - protein, 9 aa, Homo Sapiens
SWWSGRIVS

SEQ ID NO: 1354208 - protein, 9 aa, Homo Sapiens
MEYMLEVKN

SEQ ID NO: 1354209 - protein, 9 aa, Homo Sapiens
IAAPILHIN

SEQ ID NO: 1354210 - protein, 9 aa, Homo Sapiens
LVWLGPDQV

SEQ ID NO: 1354211 - protein, 9 aa, Homo Sapiens
TLCLTALPD

SEQ ID NO: 1354212 - protein, 9 aa, Homo Sapiens
QLHRPRIMR

SEQ ID NO: 1354213 - protein, 9 aa, Homo Sapiens
GHSAFTPEF

SEQ ID NO: 1354214 - protein, 9 aa, Homo Sapiens
AMMTQSQPS

SEQ ID NO: 1354215 - protein, 9 aa, Homo Sapiens
PVPVGPFDA

SEQ ID NO: 1354216 - protein, 9 aa, Homo Sapiens
DIARKGRKK

SEQ ID NO: 1354217 - protein, 9 aa, Homo Sapiens
VFYWWDYFE

SEQ ID NO: 1354218 - protein, 9 aa, Homo Sapiens
MTFITVLKM

SEQ ID NO: 1354219 - protein, 9 aa, Homo Sapiens
PPSFSPQSS

SEQ ID NO: 1354220 - protein, 9 aa, Homo Sapiens
LFCIIAITF

SEQ ID NO: 1354221 - protein, 9 aa, Homo Sapiens
HDYLSVAPF

SEQ ID NO: 1354222 - protein, 9 aa, Homo Sapiens
PHPPRAGEA

SEQ ID NO: 1354223 - protein, 9 aa, Homo Sapiens
AAVAAQGVS

SEQ ID NO: 1354224 - protein, 9 aa, Homo Sapiens
YLPLRADGF

SEQ ID NO: 1354225 - protein, 9 aa, Homo Sapiens
EDECRHADQ

SEQ ID NO: 1354226 - protein, 9 aa, Homo Sapiens
EFHSCFPGR

SEQ ID NO: 1354227 - protein, 9 aa, Homo Sapiens
CNKAFVNYM

SEQ ID NO: 1354228 - protein, 9 aa, Homo Sapiens
GYVDTEIKF

SEQ ID NO: 1354229 - protein, 9 aa, Homo Sapiens
EGWPLDPED

SEQ ID NO: 1354230 - protein, 9 aa, Homo Sapiens
PFQLCSPIC

SEQ ID NO: 1354231 - protein, 9 aa, Homo Sapiens
DWNCEVLKR

SEQ ID NO: 1354232 - protein, 9 aa, Homo Sapiens
IQLRKTRPI

SEQ ID NO: 1354233 - protein, 9 aa, Homo Sapiens
AQTTEHISI

SEQ ID NO: 1354234 - protein, 9 aa, Homo Sapiens
PGNLQLSHQ

SEQ ID NO: 1354235 - protein, 9 aa, Homo Sapiens
DVVRVITFT

SEQ ID NO: 1354236 - protein, 9 aa, Homo Sapiens
QNQIRKHIV

SEQ ID NO: 1354237 - protein, 9 aa, Homo Sapiens
LPLAWLCIS

SEQ ID NO: 1354238 - protein, 9 aa, Homo Sapiens
TRTVRTRLF

SEQ ID NO: 1354239 - protein, 9 aa, Homo Sapiens
PVWLMVDTV

SEQ ID NO: 1354240 - protein, 9 aa, Homo Sapiens
ETALYYTHM

SEQ ID NO: 1354241 - protein, 9 aa, Homo Sapiens
LGPRREIEN

SEQ ID NO: 1354242 - protein, 9 aa, Homo Sapiens
MQPDLTVSQ

SEQ ID NO: 1354243 - protein, 9 aa, Homo Sapiens
PHFIGNWWS

SEQ ID NO: 1354244 - protein, 9 aa, Homo Sapiens
DNKNDFWWL

SEQ ID NO: 1354245 - protein, 9 aa, Homo Sapiens
SARSPRLRS

SEQ ID NO: 1354246 - protein, 9 aa, Homo Sapiens
TIQFVDLCP

SEQ ID NO: 1354247 - protein, 9 aa, Homo Sapiens
VVPPEWRTA

SEQ ID NO: 1354248 - protein, 9 aa, Homo Sapiens
ELLWHLARA

SEQ ID NO: 1354249 - protein, 9 aa, Homo Sapiens
YLLHLNSLA

SEQ ID NO: 1354250 - protein, 9 aa, Homo Sapiens
RYSAIKTIS

SEQ ID NO: 1354251 - protein, 9 aa, Homo Sapiens
SFYGGLDDQ

SEQ ID NO: 1354252 - protein, 9 aa, Homo Sapiens
ADSTGESPW

SEQ ID NO: 1354253 - protein, 9 aa, Homo Sapiens
LRALRGRLR

SEQ ID NO: 1354254 - protein, 9 aa, Homo Sapiens
WAAKAAVNK

SEQ ID NO: 1354255 - protein, 9 aa, Homo Sapiens
AFFPSYLSS

SEQ ID NO: 1354256 - protein, 9 aa, Homo Sapiens
GTKMLAVYL

SEQ ID NO: 1354257 - protein, 9 aa, Homo Sapiens
FDAVQGKTR

SEQ ID NO: 1354258 - protein, 9 aa, Homo Sapiens
SFMLPIHLQ

SEQ ID NO: 1354259 - protein, 9 aa, Homo Sapiens
ENVTKDSNV

SEQ ID NO: 1354260 - protein, 9 aa, Homo Sapiens
MAQSAAVGP

SEQ ID NO: 1354261 - protein, 9 aa, Homo Sapiens
VGYSMHMVG

SEQ ID NO: 1354262 - protein, 9 aa, Homo Sapiens
LGAWSHFVF

SEQ ID NO: 1354263 - protein, 9 aa, Homo Sapiens
SAPGVWWEI

SEQ ID NO: 1354264 - protein, 9 aa, Homo Sapiens
QDTGHLTDS

SEQ ID NO: 1354265 - protein, 9 aa, Homo Sapiens
VPASSLTVM

SEQ ID NO: 1354266 - protein, 9 aa, Homo Sapiens
YKRVFSSFV

SEQ ID NO: 1354267 - protein, 9 aa, Homo Sapiens
GLGRRQQPQ

SEQ ID NO: 1354268 - protein, 9 aa, Homo Sapiens
YNTATCDTV

SEQ ID NO: 1354269 - protein, 9 aa, Homo Sapiens
GPRTSGKVH

SEQ ID NO: 1354270 - protein, 9 aa, Homo Sapiens
RITLVLMED

SEQ ID NO: 1354271 - protein, 9 aa, Homo Sapiens
GPVLPPPPP

SEQ ID NO: 1354272 - protein, 9 aa, Homo Sapiens
VMLPVIHSC

SEQ ID NO: 1354273 - protein, 9 aa, Homo Sapiens
HAITTANNL

SEQ ID NO: 1354274 - protein, 9 aa, Homo Sapiens
FIGSDTFNC

SEQ ID NO: 1354275 - protein, 9 aa, Homo Sapiens
GTKFSYLGH

SEQ ID NO: 1354276 - protein, 9 aa, Homo Sapiens
LWLLVCERA

SEQ ID NO: 1354277 - protein, 9 aa, Homo Sapiens
HHSQKMSQL

SEQ ID NO: 1354278 - protein, 9 aa, Homo Sapiens
ATSHLAHPN

SEQ ID NO: 1354279 - protein, 9 aa, Homo Sapiens
KSQQDKHLW

SEQ ID NO: 1354280 - protein, 9 aa, Homo Sapiens
VQGTNSTHF

SEQ ID NO: 1354281 - protein, 9 aa, Homo Sapiens
FLDNCFLLC

SEQ ID NO: 1354282 - protein, 9 aa, Homo Sapiens
LSVPVKEDT

SEQ ID NO: 1354283 - protein, 9 aa, Homo Sapiens
RVWRVSVAH

SEQ ID NO: 1354284 - protein, 9 aa, Homo Sapiens
SMHMVGKWH

SEQ ID NO: 1354285 - protein, 9 aa, Homo Sapiens
YAQKLKYKV

SEQ ID NO: 1354286 - protein, 9 aa, Homo Sapiens
SEAAKNGSP

SEQ ID NO: 1354287 - protein, 9 aa, Homo Sapiens
FIALTLVEA

SEQ ID NO: 1354288 - protein, 9 aa, Homo Sapiens
GDEEDIASH

SEQ ID NO: 1354289 - protein, 9 aa, Homo Sapiens
APEDLHRVS

SEQ ID NO: 1354290 - protein, 9 aa, Homo Sapiens
QQRVPEGDP

SEQ ID NO: 1354291 - protein, 9 aa, Homo Sapiens
KSAFAPFDK

SEQ ID NO: 1354292 - protein, 9 aa, Homo Sapiens
CDTTYNEIV

SEQ ID NO: 1354293 - protein, 9 aa, Homo Sapiens
MSKQSLNDS

SEQ ID NO: 1354294 - protein, 9 aa, Homo Sapiens
HDVYSFVIV

SEQ ID NO: 1354295 - protein, 9 aa, Homo Sapiens
CLQGLHLGT

SEQ ID NO: 1354296 - protein, 9 aa, Homo Sapiens
HQQPNRAHN

SEQ ID NO: 1354297 - protein, 9 aa, Homo Sapiens
HQHNASDLL

SEQ ID NO: 1354298 - protein, 9 aa, Homo Sapiens
QLDATFSMN

SEQ ID NO: 1354299 - protein, 9 aa, Homo Sapiens
MLIMMVVLV

SEQ ID NO: 1354300 - protein, 9 aa, Homo Sapiens
CFERFGRRR

SEQ ID NO: 1354301 - protein, 9 aa, Homo Sapiens
PIILMTIAR

SEQ ID NO: 1354302 - protein, 9 aa, Homo Sapiens
EAHYVWDYT

SEQ ID NO: 1354303 - protein, 9 aa, Homo Sapiens
DVKDTKVIS

SEQ ID NO: 1354304 - protein, 9 aa, Homo Sapiens
PPQYHKVLM

SEQ ID NO: 1354305 - protein, 9 aa, Homo Sapiens
MAEDPVRHS

SEQ ID NO: 1354306 - protein, 9 aa, Homo Sapiens
LKVPTGEKI

SEQ ID NO: 1354307 - protein, 9 aa, Homo Sapiens
GHFLLPETK

SEQ ID NO: 1354308 - protein, 9 aa, Homo Sapiens
QFHIPNYGA

SEQ ID NO: 1354309 - protein, 9 aa, Homo Sapiens
TSMWRLSSI

SEQ ID NO: 1354310 - protein, 9 aa, Homo Sapiens
KYMLQLCYR

SEQ ID NO: 1354311 - protein, 9 aa, Homo Sapiens
KDARVCGRC

SEQ ID NO: 1354312 - protein, 9 aa, Homo Sapiens
WSREDGLPV

SEQ ID NO: 1354313 - protein, 9 aa, Homo Sapiens
IRPVSRCTP

SEQ ID NO: 1354314 - protein, 9 aa, Homo Sapiens
QAIRNYSGT

SEQ ID NO: 1354315 - protein, 9 aa, Homo Sapiens
QKAIHLIAV

SEQ ID NO: 1354316 - protein, 9 aa, Homo Sapiens
SQKHISSPL

SEQ ID NO: 1354317 - protein, 9 aa, Homo Sapiens
NWINEAILV

SEQ ID NO: 1354318 - protein, 9 aa, Homo Sapiens
GNQINTFLN

SEQ ID NO: 1354319 - protein, 9 aa, Homo Sapiens
TCVGSIAEL

SEQ ID NO: 1354320 - protein, 9 aa, Homo Sapiens
EQPIFTTRV

SEQ ID NO: 1354321 - protein, 9 aa, Homo Sapiens
ARHLRDLLE

SEQ ID NO: 1354322 - protein, 9 aa, Homo Sapiens
RVYEFASDI

SEQ ID NO: 1354323 - protein, 9 aa, Homo Sapiens
FNHPKGCDN

SEQ ID NO: 1354324 - protein, 9 aa, Homo Sapiens
PKLHLDTFA

SEQ ID NO: 1354325 - protein, 9 aa, Homo Sapiens
SGGLPIPHV

SEQ ID NO: 1354326 - protein, 9 aa, Homo Sapiens
LMDLLRDPR

SEQ ID NO: 1354327 - protein, 9 aa, Homo Sapiens
EEDIASHYP

SEQ ID NO: 1354328 - protein, 9 aa, Homo Sapiens
LQLSLHRLQ

SEQ ID NO: 1354329 - protein, 9 aa, Homo Sapiens
HLLSVLGHS

SEQ ID NO: 1354330 - protein, 9 aa, Homo Sapiens
LSPAPKGKG

SEQ ID NO: 1354331 - protein, 9 aa, Homo Sapiens
LNQEEGKYY

SEQ ID NO: 1354332 - protein, 9 aa, Homo Sapiens
KDTLVQTKG

SEQ ID NO: 1354333 - protein, 9 aa, Homo Sapiens
GERSFRGSG

SEQ ID NO: 1354334 - protein, 9 aa, Homo Sapiens
VAISGLISG

SEQ ID NO: 1354335 - protein, 9 aa, Homo Sapiens
KLQFKSHIY

SEQ ID NO: 1354336 - protein, 9 aa, Homo Sapiens
IFMQVEDEC

SEQ ID NO: 1354337 - protein, 9 aa, Homo Sapiens
PKMTPANDT

SEQ ID NO: 1354338 - protein, 9 aa, Homo Sapiens
FEISLYDTV

SEQ ID NO: 1354339 - protein, 9 aa, Homo Sapiens
VKNVTQMPR

SEQ ID NO: 1354340 - protein, 9 aa, Homo Sapiens
TGRSPFDII

SEQ ID NO: 1354341 - protein, 9 aa, Homo Sapiens
TSDSKGTSN

SEQ ID NO: 1354342 - protein, 9 aa, Homo Sapiens
SHKHRGNPS

SEQ ID NO: 1354343 - protein, 9 aa, Homo Sapiens
REEKKKNKE

SEQ ID NO: 1354344 - protein, 9 aa, Homo Sapiens
ASGSETVHT

SEQ ID NO: 1354345 - protein, 9 aa, Homo Sapiens
EEMETTTEL

SEQ ID NO: 1354346 - protein, 9 aa, Homo Sapiens
LYYVKDIPS

SEQ ID NO: 1354347 - protein, 9 aa, Homo Sapiens
DNSGTRSRA

SEQ ID NO: 1354348 - protein, 9 aa, Homo Sapiens
VLIYWVSIC

SEQ ID NO: 1354349 - protein, 9 aa, Homo Sapiens
SQNSYHNAV

SEQ ID NO: 1354350 - protein, 9 aa, Homo Sapiens
LPARDCTPA

SEQ ID NO: 1354351 - protein, 9 aa, Homo Sapiens
VICEHIKQF

SEQ ID NO: 1354352 - protein, 9 aa, Homo Sapiens
YVCRELLRR

SEQ ID NO: 1354353 - protein, 9 aa, Homo Sapiens
GEKEDPEDL

SEQ ID NO: 1354354 - protein, 9 aa, Homo Sapiens
VIDVYRTGV

SEQ ID NO: 1354355 - protein, 9 aa, Homo Sapiens
IKQLLWHRT

SEQ ID NO: 1354356 - protein, 9 aa, Homo Sapiens
DDKCEKACR

SEQ ID NO: 1354357 - protein, 9 aa, Homo Sapiens
EELEVALQR

SEQ ID NO: 1354358 - protein, 9 aa, Homo Sapiens
MRQISDWTG

SEQ ID NO: 1354359 - protein, 9 aa, Homo Sapiens
SSTTSLCSR

SEQ ID NO: 1354360 - protein, 9 aa, Homo Sapiens
MVGGSLSSC

SEQ ID NO: 1354361 - protein, 9 aa, Homo Sapiens
LHKRVQGMP

SEQ ID NO: 1354362 - protein, 9 aa, Homo Sapiens
EDVLASPEP

SEQ ID NO: 1354363 - protein, 9 aa, Homo Sapiens
ARGEDPTLQ

SEQ ID NO: 1354364 - protein, 9 aa, Homo Sapiens
SNKINTGMY

SEQ ID NO: 1354365 - protein, 9 aa, Homo Sapiens
QDQNVQTRW

SEQ ID NO: 1354366 - protein, 9 aa, Homo Sapiens
FLHHIRQNV

SEQ ID NO: 1354367 - protein, 9 aa, Homo Sapiens
HDSIEKAAE

SEQ ID NO: 1354368 - protein, 9 aa, Homo Sapiens
QRLVLSRQL

SEQ ID NO: 1354369 - protein, 9 aa, Homo Sapiens
VSPSTSRPS

SEQ ID NO: 1354370 - protein, 9 aa, Homo Sapiens
PIDHGVRLN

SEQ ID NO: 1354371 - protein, 9 aa, Homo Sapiens
PGSEVNTAA

SEQ ID NO: 1354372 - protein, 9 aa, Homo Sapiens
LKEDKVTCH

SEQ ID NO: 1354373 - protein, 9 aa, Homo Sapiens
DFLDALTHT

SEQ ID NO: 1354374 - protein, 9 aa, Homo Sapiens
SPLSSSPIV

SEQ ID NO: 1354375 - protein, 9 aa, Homo Sapiens
PQAIFVQRV

SEQ ID NO: 1354376 - protein, 9 aa, Homo Sapiens
FNPCLMELC

SEQ ID NO: 1354377 - protein, 9 aa, Homo Sapiens
ALIGDDIGL

SEQ ID NO: 1354378 - protein, 9 aa, Homo Sapiens
TDGAACHFP

SEQ ID NO: 1354379 - protein, 9 aa, Homo Sapiens
SLFSSLSSV

SEQ ID NO: 1354380 - protein, 9 aa, Homo Sapiens
LANEQKPSR

SEQ ID NO: 1354381 - protein, 9 aa, Homo Sapiens
ELWASLETQ

SEQ ID NO: 1354382 - protein, 9 aa, Homo Sapiens
HAAHRPLCQ

SEQ ID NO: 1354383 - protein, 9 aa, Homo Sapiens
HHDKFTDTY

SEQ ID NO: 1354384 - protein, 9 aa, Homo Sapiens
IIVDEINVK

SEQ ID NO: 1354385 - protein, 9 aa, Homo Sapiens
SSINQEERD

SEQ ID NO: 1354386 - protein, 9 aa, Homo Sapiens
RSRITYSDE

SEQ ID NO: 1354387 - protein, 9 aa, Homo Sapiens
MMLEKLSDT

SEQ ID NO: 1354388 - protein, 9 aa, Homo Sapiens
GDMSSEREP

SEQ ID NO: 1354389 - protein, 9 aa, Homo Sapiens
TGDMCISIL

SEQ ID NO: 1354390 - protein, 9 aa, Homo Sapiens
DSALKPGEG

SEQ ID NO: 1354391 - protein, 9 aa, Homo Sapiens
GVSVQDQLS

SEQ ID NO: 1354392 - protein, 9 aa, Homo Sapiens
MKTERSPAS

SEQ ID NO: 1354393 - protein, 9 aa, Homo Sapiens
LYMTCAKCN

SEQ ID NO: 1354394 - protein, 9 aa, Homo Sapiens
SPMDPSNFV

SEQ ID NO: 1354395 - protein, 9 aa, Homo Sapiens
PGRRLCTGE

SEQ ID NO: 1354396 - protein, 9 aa, Homo Sapiens
SYEESSKVV

SEQ ID NO: 1354397 - protein, 9 aa, Homo Sapiens
RWSRSRSRD

SEQ ID NO: 1354398 - protein, 9 aa, Homo Sapiens
LIMMVVLVG

SEQ ID NO: 1354399 - protein, 9 aa, Homo Sapiens
EMTFNLSLL

SEQ ID NO: 1354400 - protein, 9 aa, Homo Sapiens
IEEVEVTPP

SEQ ID NO: 1354401 - protein, 9 aa, Homo Sapiens
AISENSLIT

SEQ ID NO: 1354402 - protein, 9 aa, Homo Sapiens
RDNTTNFLH

SEQ ID NO: 1354403 - protein, 9 aa, Homo Sapiens
IEDVRKYVG

SEQ ID NO: 1354404 - protein, 9 aa, Homo Sapiens
TVGLVQQCQ

SEQ ID NO: 1354405 - protein, 9 aa, Homo Sapiens
MIMQRVSLS

SEQ ID NO: 1354406 - protein, 9 aa, Homo Sapiens
AEVEELRKC

SEQ ID NO: 1354407 - protein, 9 aa, Homo Sapiens
LLLKCTVAK

SEQ ID NO: 1354408 - protein, 9 aa, Homo Sapiens
KILWAHQLF

SEQ ID NO: 1354409 - protein, 9 aa, Homo Sapiens
PSNVVKEST

SEQ ID NO: 1354410 - protein, 9 aa, Homo Sapiens
DDCWPVEPL

SEQ ID NO: 1354411 - protein, 9 aa, Homo Sapiens
DGNWRWGST

SEQ ID NO: 1354412 - protein, 9 aa, Homo Sapiens
SIVSCKWRM

SEQ ID NO: 1354413 - protein, 9 aa, Homo Sapiens
IVAMFHQYS

SEQ ID NO: 1354414 - protein, 9 aa, Homo Sapiens
GGCQAQRAC

SEQ ID NO: 1354415 - protein, 9 aa, Homo Sapiens
LGLHSSIQA

SEQ ID NO: 1354416 - protein, 9 aa, Homo Sapiens
MIYISMAVT

SEQ ID NO: 1354417 - protein, 9 aa, Homo Sapiens
LWPCGPVMT

SEQ ID NO: 1354418 - protein, 9 aa, Homo Sapiens
ASDNSGTRS

SEQ ID NO: 1354419 - protein, 9 aa, Homo Sapiens
PERWLLHHT

SEQ ID NO: 1354420 - protein, 9 aa, Homo Sapiens
DMYVVRGRD

SEQ ID NO: 1354421 - protein, 9 aa, Homo Sapiens
QWPPGPRYP

SEQ ID NO: 1354422 - protein, 9 aa, Homo Sapiens
MNASLEIFE

SEQ ID NO: 1354423 - protein, 9 aa, Homo Sapiens
GLYGPITFK

SEQ ID NO: 1354424 - protein, 9 aa, Homo Sapiens
ADGCSPHYI

SEQ ID NO: 1354425 - protein, 9 aa, Homo Sapiens
ATKMCILDQ

SEQ ID NO: 1354426 - protein, 9 aa, Homo Sapiens
SLSGEGYLE

SEQ ID NO: 1354427 - protein, 9 aa, Homo Sapiens
KHRKRSHSR

SEQ ID NO: 1354428 - protein, 9 aa, Homo Sapiens
QYIFRVKVV

SEQ ID NO: 1354429 - protein, 9 aa, Homo Sapiens
DTSSGGSVT

SEQ ID NO: 1354430 - protein, 9 aa, Homo Sapiens
DDPEVWVLH

SEQ ID NO: 1354431 - protein, 9 aa, Homo Sapiens
LALDTRFWM

SEQ ID NO: 1354432 - protein, 9 aa, Homo Sapiens
LEYAAGDIA

SEQ ID NO: 1354433 - protein, 9 aa, Homo Sapiens
SPSPKRQCL

SEQ ID NO: 1354434 - protein, 9 aa, Homo Sapiens
LETIRNPKD

SEQ ID NO: 1354435 - protein, 9 aa, Homo Sapiens
NKLKASQVR

SEQ ID NO: 1354436 - protein, 9 aa, Homo Sapiens
HVQPLEDNL

SEQ ID NO: 1354437 - protein, 9 aa, Homo Sapiens
QHKDMVCIP

SEQ ID NO: 1354438 - protein, 9 aa, Homo Sapiens
PSPPRIHVR

SEQ ID NO: 1354439 - protein, 9 aa, Homo Sapiens
AMQDEFLLK

SEQ ID NO: 1354440 - protein, 9 aa, Homo Sapiens
YKPKRGRSK

SEQ ID NO: 1354441 - protein, 9 aa, Homo Sapiens
DGTVYFDEF

SEQ ID NO: 1354442 - protein, 9 aa, Homo Sapiens
DLEVITNCP

SEQ ID NO: 1354443 - protein, 9 aa, Homo Sapiens
MCGQESTDT

SEQ ID NO: 1354444 - protein, 9 aa, Homo Sapiens
DAQELLCKV

SEQ ID NO: 1354445 - protein, 9 aa, Homo Sapiens
FLITHIIFT

SEQ ID NO: 1354446 - protein, 9 aa, Homo Sapiens
VVAEGPFIT

SEQ ID NO: 1354447 - protein, 9 aa, Homo Sapiens
SLSHRLDEL

SEQ ID NO: 1354448 - protein, 9 aa, Homo Sapiens
IGTERYQKL

SEQ ID NO: 1354449 - protein, 9 aa, Homo Sapiens
ACSYGQILL

SEQ ID NO: 1354450 - protein, 9 aa, Homo Sapiens
TRATSTGKS

SEQ ID NO: 1354451 - protein, 9 aa, Homo Sapiens
TPIMFSPEH

SEQ ID NO: 1354452 - protein, 9 aa, Homo Sapiens
RGPETNPQP

SEQ ID NO: 1354453 - protein, 9 aa, Homo Sapiens
DGNHFINVM

SEQ ID NO: 1354454 - protein, 9 aa, Homo Sapiens
ELYVQWGKG

SEQ ID NO: 1354455 - protein, 9 aa, Homo Sapiens
KYWLNFYIQ

SEQ ID NO: 1354456 - protein, 9 aa, Homo Sapiens
TPSKKKLKL

SEQ ID NO: 1354457 - protein, 9 aa, Homo Sapiens
LVGQINDGV

SEQ ID NO: 1354458 - protein, 9 aa, Homo Sapiens
PQYNLMIEV

SEQ ID NO: 1354459 - protein, 9 aa, Homo Sapiens
DYACPITFS

SEQ ID NO: 1354460 - protein, 9 aa, Homo Sapiens
DTTTKHWLA

SEQ ID NO: 1354461 - protein, 9 aa, Homo Sapiens
EAFLRFMVS

SEQ ID NO: 1354462 - protein, 9 aa, Homo Sapiens
YVKRHRNVS

SEQ ID NO: 1354463 - protein, 9 aa, Homo Sapiens
VAPVTKDNG

SEQ ID NO: 1354464 - protein, 9 aa, Homo Sapiens
HRFTQEYKK

SEQ ID NO: 1354465 - protein, 9 aa, Homo Sapiens
EPVVRAKIR

SEQ ID NO: 1354466 - protein, 9 aa, Homo Sapiens
LSSNPTASA

SEQ ID NO: 1354467 - protein, 9 aa, Homo Sapiens
LVFYSILVI

SEQ ID NO: 1354468 - protein, 9 aa, Homo Sapiens
KQLHRPRIM

SEQ ID NO: 1354469 - protein, 9 aa, Homo Sapiens
GWRWIWIDT

SEQ ID NO: 1354470 - protein, 9 aa, Homo Sapiens
CDTETVIKP

SEQ ID NO: 1354471 - protein, 9 aa, Homo Sapiens
EIEEHNFAE

SEQ ID NO: 1354472 - protein, 9 aa, Homo Sapiens
LATTDCILF

SEQ ID NO: 1354473 - protein, 9 aa, Homo Sapiens
FLHDNYEEL

SEQ ID NO: 1354474 - protein, 9 aa, Homo Sapiens
MVFNDCFSL

SEQ ID NO: 1354475 - protein, 9 aa, Homo Sapiens
AMTSECHPP

SEQ ID NO: 1354476 - protein, 9 aa, Homo Sapiens
NYYVTLLTL

SEQ ID NO: 1354477 - protein, 9 aa, Homo Sapiens
YTKSGVQLR

SEQ ID NO: 1354478 - protein, 9 aa, Homo Sapiens
PGVATGVVG

SEQ ID NO: 1354479 - protein, 9 aa, Homo Sapiens
GPLTRDAHL

SEQ ID NO: 1354480 - protein, 9 aa, Homo Sapiens
NSSTVKAHD

SEQ ID NO: 1354481 - protein, 9 aa, Homo Sapiens
ISASPGGSG

SEQ ID NO: 1354482 - protein, 9 aa, Homo Sapiens
DVSSAPDNE

SEQ ID NO: 1354483 - protein, 9 aa, Homo Sapiens
YTCQTCSVL

SEQ ID NO: 1354484 - protein, 9 aa, Homo Sapiens
GEVQDAESD

SEQ ID NO: 1354485 - protein, 9 aa, Homo Sapiens
QGVQVPVLH

SEQ ID NO: 1354486 - protein, 9 aa, Homo Sapiens
VVTYYLYMK

SEQ ID NO: 1354487 - protein, 9 aa, Homo Sapiens
KVFVWPISS

SEQ ID NO: 1354488 - protein, 9 aa, Homo Sapiens
LAVSRPHSS

SEQ ID NO: 1354489 - protein, 9 aa, Homo Sapiens
LLWHLARAS

SEQ ID NO: 1354490 - protein, 9 aa, Homo Sapiens
ALALVAFSE

SEQ ID NO: 1354491 - protein, 9 aa, Homo Sapiens
LYQACEAAL

SEQ ID NO: 1354492 - protein, 9 aa, Homo Sapiens
EQILPPRLL

SEQ ID NO: 1354493 - protein, 9 aa, Homo Sapiens
LLSLALTDM

SEQ ID NO: 1354494 - protein, 9 aa, Homo Sapiens
VTVGAVTAA

SEQ ID NO: 1354495 - protein, 9 aa, Homo Sapiens
RISSKTGIS

SEQ ID NO: 1354496 - protein, 9 aa, Homo Sapiens
QWYKMDDVE

SEQ ID NO: 1354497 - protein, 9 aa, Homo Sapiens
TEWVGYPFH

SEQ ID NO: 1354498 - protein, 9 aa, Homo Sapiens
ITWEMAFSG

SEQ ID NO: 1354499 - protein, 9 aa, Homo Sapiens
CWALQMQHK

SEQ ID NO: 1354500 - protein, 9 aa, Homo Sapiens
QLSVKKAER

SEQ ID NO: 1354501 - protein, 9 aa, Homo Sapiens
GENDTFMEV

SEQ ID NO: 1354502 - protein, 9 aa, Homo Sapiens
AMITDYMFW

SEQ ID NO: 1354503 - protein, 9 aa, Homo Sapiens
GEFVPQTCP

SEQ ID NO: 1354504 - protein, 9 aa, Homo Sapiens
APEGYATYY

SEQ ID NO: 1354505 - protein, 9 aa, Homo Sapiens
TLLVCCEVS

SEQ ID NO: 1354506 - protein, 9 aa, Homo Sapiens
MVVFVTYEA

SEQ ID NO: 1354507 - protein, 9 aa, Homo Sapiens
REASDNSGT

SEQ ID NO: 1354508 - protein, 9 aa, Homo Sapiens
YILHSSPKR

SEQ ID NO: 1354509 - protein, 9 aa, Homo Sapiens
LIITPWNYP

SEQ ID NO: 1354510 - protein, 9 aa, Homo Sapiens
NVSRARSEQ

SEQ ID NO: 1354511 - protein, 9 aa, Homo Sapiens
WHSKVWQKS

SEQ ID NO: 1354512 - protein, 9 aa, Homo Sapiens
EIDDNFLLA

SEQ ID NO: 1354513 - protein, 9 aa, Homo Sapiens
DVNDNTPAF

SEQ ID NO: 1354514 - protein, 9 aa, Homo Sapiens
DTLNKLKIT

SEQ ID NO: 1354515 - protein, 9 aa, Homo Sapiens
AISPKDVFE

SEQ ID NO: 1354516 - protein, 9 aa, Homo Sapiens
LRVSVFRPM

SEQ ID NO: 1354517 - protein, 9 aa, Homo Sapiens
CTPQEVRDF

SEQ ID NO: 1354518 - protein, 9 aa, Homo Sapiens
SFETTDESP

SEQ ID NO: 1354519 - protein, 9 aa, Homo Sapiens
PVSPSTSRP

SEQ ID NO: 1354520 - protein, 9 aa, Homo Sapiens
KVNKGCVRG

SEQ ID NO: 1354521 - protein, 9 aa, Homo Sapiens
NPSHSDSLT

SEQ ID NO: 1354522 - protein, 9 aa, Homo Sapiens
GSGKTAVFV

SEQ ID NO: 1354523 - protein, 9 aa, Homo Sapiens
GNSEDDIYM

SEQ ID NO: 1354524 - protein, 9 aa, Homo Sapiens
QWLKIPGLK

SEQ ID NO: 1354525 - protein, 9 aa, Homo Sapiens
TRLIRKCFL

SEQ ID NO: 1354526 - protein, 9 aa, Homo Sapiens
ENWTTECKQ

SEQ ID NO: 1354527 - protein, 9 aa, Homo Sapiens
HDVLTRKTH

SEQ ID NO: 1354528 - protein, 9 aa, Homo Sapiens
VVLSAHTQK

SEQ ID NO: 1354529 - protein, 9 aa, Homo Sapiens
FGHLPYKGC

SEQ ID NO: 1354530 - protein, 9 aa, Homo Sapiens
ALNEECLKG

SEQ ID NO: 1354531 - protein, 9 aa, Homo Sapiens
AAALALDVA

SEQ ID NO: 1354532 - protein, 9 aa, Homo Sapiens
TNSTGKFCH

SEQ ID NO: 1354533 - protein, 9 aa, Homo Sapiens
QADHLPQLI

SEQ ID NO: 1354534 - protein, 9 aa, Homo Sapiens
KVASQKNFI

SEQ ID NO: 1354535 - protein, 9 aa, Homo Sapiens
ISDCTEIII

SEQ ID NO: 1354536 - protein, 9 aa, Homo Sapiens
TFFIFVLQL

SEQ ID NO: 1354537 - protein, 9 aa, Homo Sapiens
SYPKRLGRL

SEQ ID NO: 1354538 - protein, 9 aa, Homo Sapiens
SAYEYYVSC

SEQ ID NO: 1354539 - protein, 9 aa, Homo Sapiens
RECFAYPMP

SEQ ID NO: 1354540 - protein, 9 aa, Homo Sapiens
QEQTECGRR

SEQ ID NO: 1354541 - protein, 9 aa, Homo Sapiens
KDKSPVPKS

SEQ ID NO: 1354542 - protein, 9 aa, Homo Sapiens
QELPVRLTN

SEQ ID NO: 1354543 - protein, 9 aa, Homo Sapiens
SHRLDELEE

SEQ ID NO: 1354544 - protein, 9 aa, Homo Sapiens
DRSLQCSPP

SEQ ID NO: 1354545 - protein, 9 aa, Homo Sapiens
RGGKATLKA

SEQ ID NO: 1354546 - protein, 9 aa, Homo Sapiens
AVSIYVPFL

SEQ ID NO: 1354547 - protein, 9 aa, Homo Sapiens
RKELVMAEA

SEQ ID NO: 1354548 - protein, 9 aa, Homo Sapiens
LSQLWEFCL

SEQ ID NO: 1354549 - protein, 9 aa, Homo Sapiens
VNDLIRYLR

SEQ ID NO: 1354550 - protein, 9 aa, Homo Sapiens
RHQAEKMGI

SEQ ID NO: 1354551 - protein, 9 aa, Homo Sapiens
LVLSRQLCE

SEQ ID NO: 1354552 - protein, 9 aa, Homo Sapiens
VTFKANRSF

SEQ ID NO: 1354553 - protein, 9 aa, Homo Sapiens
LMTYFIQLS

SEQ ID NO: 1354554 - protein, 9 aa, Homo Sapiens
EEDTSLKRH

SEQ ID NO: 1354555 - protein, 9 aa, Homo Sapiens
CAAVSFICF

SEQ ID NO: 1354556 - protein, 9 aa, Homo Sapiens
CFFPRKGPP

SEQ ID NO: 1354557 - protein, 9 aa, Homo Sapiens
YDYTTDDIE

SEQ ID NO: 1354558 - protein, 9 aa, Homo Sapiens
FYQGPGWEE

SEQ ID NO: 1354559 - protein, 9 aa, Homo Sapiens
LQNKTKLFP

SEQ ID NO: 1354560 - protein, 9 aa, Homo Sapiens
HQSVKNVTQ

SEQ ID NO: 1354561 - protein, 9 aa, Homo Sapiens
DPNFVTAMM

SEQ ID NO: 1354562 - protein, 9 aa, Homo Sapiens
FGFHQSVRH

SEQ ID NO: 1354563 - protein, 9 aa, Homo Sapiens
SLGAVHASV

SEQ ID NO: 1354564 - protein, 9 aa, Homo Sapiens
LEKKNKTPK

SEQ ID NO: 1354565 - protein, 9 aa, Homo Sapiens
RGTLWRLWS

SEQ ID NO: 1354566 - protein, 9 aa, Homo Sapiens
NTPAFAQPE

SEQ ID NO: 1354567 - protein, 9 aa, Homo Sapiens
ITIPESDLE

SEQ ID NO: 1354568 - protein, 9 aa, Homo Sapiens
EGTSFRLER

SEQ ID NO: 1354569 - protein, 9 aa, Homo Sapiens
AQLSRHTQQ

SEQ ID NO: 1354570 - protein, 9 aa, Homo Sapiens
SPAPSLGSY

SEQ ID NO: 1354571 - protein, 9 aa, Homo Sapiens
KGSLDNARR

SEQ ID NO: 1354572 - protein, 9 aa, Homo Sapiens
LGHMLGMQH

SEQ ID NO: 1354573 - protein, 9 aa, Homo Sapiens
PENEEDTSL

SEQ ID NO: 1354574 - protein, 9 aa, Homo Sapiens
HKCVHNFTA

SEQ ID NO: 1354575 - protein, 9 aa, Homo Sapiens
DSTGVPDLI

SEQ ID NO: 1354576 - protein, 9 aa, Homo Sapiens
VALAQAWIA

SEQ ID NO: 1354577 - protein, 9 aa, Homo Sapiens
QSGHRDGRW

SEQ ID NO: 1354578 - protein, 9 aa, Homo Sapiens
VDRVMKQLE

SEQ ID NO: 1354579 - protein, 9 aa, Homo Sapiens
SISAATVEL

SEQ ID NO: 1354580 - protein, 9 aa, Homo Sapiens
KWSSRSSHR

SEQ ID NO: 1354581 - protein, 9 aa, Homo Sapiens
NMLVTLCHY

SEQ ID NO: 1354582 - protein, 9 aa, Homo Sapiens
KQQKCPFAY

SEQ ID NO: 1354583 - protein, 9 aa, Homo Sapiens
KSNSIKWQT

SEQ ID NO: 1354584 - protein, 9 aa, Homo Sapiens
LRWDVAHFG

SEQ ID NO: 1354585 - protein, 9 aa, Homo Sapiens
VLLLLVCTS

SEQ ID NO: 1354586 - protein, 9 aa, Homo Sapiens
VDKCPRTAS

SEQ ID NO: 1354587 - protein, 9 aa, Homo Sapiens
PKKCRACFG

SEQ ID NO: 1354588 - protein, 9 aa, Homo Sapiens
HNIFKRDDS

SEQ ID NO: 1354589 - protein, 9 aa, Homo Sapiens
EVLQERMDK

SEQ ID NO: 1354590 - protein, 9 aa, Homo Sapiens
GVTIKFGKF

SEQ ID NO: 1354591 - protein, 9 aa, Homo Sapiens
QSDFPYLGT

SEQ ID NO: 1354592 - protein, 9 aa, Homo Sapiens
YSDMHTMKH

SEQ ID NO: 1354593 - protein, 9 aa, Homo Sapiens
NTFYRSSHL

SEQ ID NO: 1354594 - protein, 9 aa, Homo Sapiens
TSSSLGQQS

SEQ ID NO: 1354595 - protein, 9 aa, Homo Sapiens
DAGFHSLPC

SEQ ID NO: 1354596 - protein, 9 aa, Homo Sapiens
RGVTMVHPL

SEQ ID NO: 1354597 - protein, 9 aa, Homo Sapiens
RPKKCPLLL

SEQ ID NO: 1354598 - protein, 9 aa, Homo Sapiens
PAEVRHCTW

SEQ ID NO: 1354599 - protein, 9 aa, Homo Sapiens
FANDQEQAS

SEQ ID NO: 1354600 - protein, 9 aa, Homo Sapiens
SEFALEYHT

SEQ ID NO: 1354601 - protein, 9 aa, Homo Sapiens
PSTVIHGTN

SEQ ID NO: 1354602 - protein, 9 aa, Homo Sapiens
CIVTTHIRE

SEQ ID NO: 1354603 - protein, 9 aa, Homo Sapiens
GESVMFHLF

SEQ ID NO: 1354604 - protein, 9 aa, Homo Sapiens
CVDSLVGPR

SEQ ID NO: 1354605 - protein, 9 aa, Homo Sapiens
PALDTTITS

SEQ ID NO: 1354606 - protein, 9 aa, Homo Sapiens
NNITVVYGF

SEQ ID NO: 1354607 - protein, 9 aa, Homo Sapiens
YGLMCLGFL

SEQ ID NO: 1354608 - protein, 9 aa, Homo Sapiens
DVVMWDYSS

SEQ ID NO: 1354609 - protein, 9 aa, Homo Sapiens
LLRGYLQYL

SEQ ID NO: 1354610 - protein, 9 aa, Homo Sapiens
DQKMCPFGR

SEQ ID NO: 1354611 - protein, 9 aa, Homo Sapiens
RSLKRTALQ

SEQ ID NO: 1354612 - protein, 9 aa, Homo Sapiens
SSPSFTELQ

SEQ ID NO: 1354613 - protein, 9 aa, Homo Sapiens
DLRFISSRQ

SEQ ID NO: 1354614 - protein, 9 aa, Homo Sapiens
SILMPPFVP

SEQ ID NO: 1354615 - protein, 9 aa, Homo Sapiens
DVTMKSLPF

SEQ ID NO: 1354616 - protein, 9 aa, Homo Sapiens
NTCFICAVC

SEQ ID NO: 1354617 - protein, 9 aa, Homo Sapiens
NALREENAN

SEQ ID NO: 1354618 - protein, 9 aa, Homo Sapiens
FLDDIIPNG

SEQ ID NO: 1354619 - protein, 9 aa, Homo Sapiens
CSTFQMSKD

SEQ ID NO: 1354620 - protein, 9 aa, Homo Sapiens
YDVVSIMNA

SEQ ID NO: 1354621 - protein, 9 aa, Homo Sapiens
ANHVVQVLL

SEQ ID NO: 1354622 - protein, 9 aa, Homo Sapiens
TATVTEEDV

SEQ ID NO: 1354623 - protein, 9 aa, Homo Sapiens
TQVCGYSEA

SEQ ID NO: 1354624 - protein, 9 aa, Homo Sapiens
FGGFSFLLW

SEQ ID NO: 1354625 - protein, 9 aa, Homo Sapiens
LMCEKWILA

SEQ ID NO: 1354626 - protein, 9 aa, Homo Sapiens
QNHYTVAWF

SEQ ID NO: 1354627 - protein, 9 aa, Homo Sapiens
LLMDLLRDP

SEQ ID NO: 1354628 - protein, 9 aa, Homo Sapiens
SCIDWNCEV

SEQ ID NO: 1354629 - protein, 9 aa, Homo Sapiens
HILVPGNTD

SEQ ID NO: 1354630 - protein, 9 aa, Homo Sapiens
WDTKIVIDG

SEQ ID NO: 1354631 - protein, 9 aa, Homo Sapiens
SQNILATCL

SEQ ID NO: 1354632 - protein, 9 aa, Homo Sapiens
VNKHHPTFT

SEQ ID NO: 1354633 - protein, 9 aa, Homo Sapiens
EEEWRLHSV

SEQ ID NO: 1354634 - protein, 9 aa, Homo Sapiens
YMREWCAKV

SEQ ID NO: 1354635 - protein, 9 aa, Homo Sapiens
SRDFRDLQL

SEQ ID NO: 1354636 - protein, 9 aa, Homo Sapiens
QLFLTLAAL

SEQ ID NO: 1354637 - protein, 9 aa, Homo Sapiens
IYMVPMNQS

SEQ ID NO: 1354638 - protein, 9 aa, Homo Sapiens
QSQSVWTLF

SEQ ID NO: 1354639 - protein, 9 aa, Homo Sapiens
LQHHVSSDL

SEQ ID NO: 1354640 - protein, 9 aa, Homo Sapiens
ASTSIKIAP

SEQ ID NO: 1354641 - protein, 9 aa, Homo Sapiens
GWRFSCSDE

SEQ ID NO: 1354642 - protein, 9 aa, Homo Sapiens
SNCCHFCYP

SEQ ID NO: 1354643 - protein, 9 aa, Homo Sapiens
PRGARPSDW

SEQ ID NO: 1354644 - protein, 9 aa, Homo Sapiens
EQHILMKSV

SEQ ID NO: 1354645 - protein, 9 aa, Homo Sapiens
SAKERVSSR

SEQ ID NO: 1354646 - protein, 9 aa, Homo Sapiens
NYMMSSHSN

SEQ ID NO: 1354647 - protein, 9 aa, Homo Sapiens
VAATAGGQG

SEQ ID NO: 1354648 - protein, 9 aa, Homo Sapiens
DAHDYRDCE

SEQ ID NO: 1354649 - protein, 9 aa, Homo Sapiens
LIRQKRQTR

SEQ ID NO: 1354650 - protein, 9 aa, Homo Sapiens
EFNDRNKPH

SEQ ID NO: 1354651 - protein, 9 aa, Homo Sapiens
CEKNDFLSA

SEQ ID NO: 1354652 - protein, 9 aa, Homo Sapiens
PRLGVLPLP

SEQ ID NO: 1354653 - protein, 9 aa, Homo Sapiens
EKNWNLLFL

SEQ ID NO: 1354654 - protein, 9 aa, Homo Sapiens
QTRESNSDR

SEQ ID NO: 1354655 - protein, 9 aa, Homo Sapiens
SIASTMAAS

SEQ ID NO: 1354656 - protein, 9 aa, Homo Sapiens
CAVASNTTR

SEQ ID NO: 1354657 - protein, 9 aa, Homo Sapiens
AAEKPVRAL

SEQ ID NO: 1354658 - protein, 9 aa, Homo Sapiens
TRPPPGSQS

SEQ ID NO: 1354659 - protein, 9 aa, Homo Sapiens
VFYTNVMPM

SEQ ID NO: 1354660 - protein, 9 aa, Homo Sapiens
EHCFSRGES

SEQ ID NO: 1354661 - protein, 9 aa, Homo Sapiens
ELLFECYRI

SEQ ID NO: 1354662 - protein, 9 aa, Homo Sapiens
NMDVAFLVL

SEQ ID NO: 1354663 - protein, 9 aa, Homo Sapiens
GYLVDQWHW

SEQ ID NO: 1354664 - protein, 9 aa, Homo Sapiens
DCEGRDTHR

SEQ ID NO: 1354665 - protein, 9 aa, Homo Sapiens
SAMNAARPS

SEQ ID NO: 1354666 - protein, 9 aa, Homo Sapiens
FFISLATTD

SEQ ID NO: 1354667 - protein, 9 aa, Homo Sapiens
NGYWGPANG

SEQ ID NO: 1354668 - protein, 9 aa, Homo Sapiens
AASVKSKKT

SEQ ID NO: 1354669 - protein, 9 aa, Homo Sapiens
PETDTYSSL

SEQ ID NO: 1354670 - protein, 9 aa, Homo Sapiens
GYPFHLFDF

SEQ ID NO: 1354671 - protein, 9 aa, Homo Sapiens
RGRSKSKEM

SEQ ID NO: 1354672 - protein, 9 aa, Homo Sapiens
GSSSILPIP

SEQ ID NO: 1354673 - protein, 9 aa, Homo Sapiens
AVSCLQGLH

SEQ ID NO: 1354674 - protein, 9 aa, Homo Sapiens
HQLYQPKLA

SEQ ID NO: 1354675 - protein, 9 aa, Homo Sapiens
ILSLKTLFR

SEQ ID NO: 1354676 - protein, 9 aa, Homo Sapiens
LLHNCFDYS

SEQ ID NO: 1354677 - protein, 9 aa, Homo Sapiens
MGERGVFPA

SEQ ID NO: 1354678 - protein, 9 aa, Homo Sapiens
FTFISFHRR

SEQ ID NO: 1354679 - protein, 9 aa, Homo Sapiens
RKKKVRSLH

SEQ ID NO: 1354680 - protein, 9 aa, Homo Sapiens
SPTEEEALR

SEQ ID NO: 1354681 - protein, 9 aa, Homo Sapiens
SYKEDKPQV

SEQ ID NO: 1354682 - protein, 9 aa, Homo Sapiens
LHEIRRYQK

SEQ ID NO: 1354683 - protein, 9 aa, Homo Sapiens
LTIIGLIKP

SEQ ID NO: 1354684 - protein, 9 aa, Homo Sapiens
NVQLRKYCK

SEQ ID NO: 1354685 - protein, 9 aa, Homo Sapiens
SAAQHHSYM

SEQ ID NO: 1354686 - protein, 9 aa, Homo Sapiens
TLGIGLSLY

SEQ ID NO: 1354687 - protein, 9 aa, Homo Sapiens
TSVLEHLKI

SEQ ID NO: 1354688 - protein, 9 aa, Homo Sapiens
ESSHSIYPA

SEQ ID NO: 1354689 - protein, 9 aa, Homo Sapiens
KADPGMTDR

SEQ ID NO: 1354690 - protein, 9 aa, Homo Sapiens
NCCALITET

SEQ ID NO: 1354691 - protein, 9 aa, Homo Sapiens
LLEDEPHDT

SEQ ID NO: 1354692 - protein, 9 aa, Homo Sapiens
RKSQEPDFH

SEQ ID NO: 1354693 - protein, 9 aa, Homo Sapiens
TQVMYRSNR

SEQ ID NO: 1354694 - protein, 9 aa, Homo Sapiens
QQRRSDLDH

SEQ ID NO: 1354695 - protein, 9 aa, Homo Sapiens
FDASDELAS

SEQ ID NO: 1354696 - protein, 9 aa, Homo Sapiens
EEYAQNVLR

SEQ ID NO: 1354697 - protein, 9 aa, Homo Sapiens
HLAVAWNRV

SEQ ID NO: 1354698 - protein, 9 aa, Homo Sapiens
GNMNITCVA

SEQ ID NO: 1354699 - protein, 9 aa, Homo Sapiens
GEADPFVNG

SEQ ID NO: 1354700 - protein, 9 aa, Homo Sapiens
VATCKQLTY

SEQ ID NO: 1354701 - protein, 9 aa, Homo Sapiens
EKLCNFILA

SEQ ID NO: 1354702 - protein, 9 aa, Homo Sapiens
IRRWVRSHF

SEQ ID NO: 1354703 - protein, 9 aa, Homo Sapiens
CRVEEQQRR

SEQ ID NO: 1354704 - protein, 9 aa, Homo Sapiens
AVAAQGVSQ

SEQ ID NO: 1354705 - protein, 9 aa, Homo Sapiens
WIFRSWGCV

SEQ ID NO: 1354706 - protein, 9 aa, Homo Sapiens
EVNITQFLP

SEQ ID NO: 1354707 - protein, 9 aa, Homo Sapiens
AIHTDSNEQ

SEQ ID NO: 1354708 - protein, 9 aa, Homo Sapiens
LRKPDIGDH

SEQ ID NO: 1354709 - protein, 9 aa, Homo Sapiens
NTIEMVKPG

SEQ ID NO: 1354710 - protein, 9 aa, Homo Sapiens
FQEERQDEC

SEQ ID NO: 1354711 - protein, 9 aa, Homo Sapiens
HHKEVKAKP

SEQ ID NO: 1354712 - protein, 9 aa, Homo Sapiens
SYLNLIKPT

SEQ ID NO: 1354713 - protein, 9 aa, Homo Sapiens
VIAKKENGI

SEQ ID NO: 1354714 - protein, 9 aa, Homo Sapiens
SPSTPSQSS

SEQ ID NO: 1354715 - protein, 9 aa, Homo Sapiens
GEDFYCMTC

SEQ ID NO: 1354716 - protein, 9 aa, Homo Sapiens
SLNIRKSTP

SEQ ID NO: 1354717 - protein, 9 aa, Homo Sapiens
SCSLGAVHA

SEQ ID NO: 1354718 - protein, 9 aa, Homo Sapiens
PFHPSIKTH

SEQ ID NO: 1354719 - protein, 9 aa, Homo Sapiens
GKACAKSKS

SEQ ID NO: 1354720 - protein, 9 aa, Homo Sapiens
SMVNSGPST

SEQ ID NO: 1354721 - protein, 9 aa, Homo Sapiens
EIMKQIQDA

SEQ ID NO: 1354722 - protein, 9 aa, Homo Sapiens
GHVIIETVV

SEQ ID NO: 1354723 - protein, 9 aa, Homo Sapiens
LALFLYCYP

SEQ ID NO: 1354724 - protein, 9 aa, Homo Sapiens
AAVIHDVDH

SEQ ID NO: 1354725 - protein, 9 aa, Homo Sapiens
ACALILSPT

SEQ ID NO: 1354726 - protein, 9 aa, Homo Sapiens
TNCPKGFTR

SEQ ID NO: 1354727 - protein, 9 aa, Homo Sapiens
TLNHIEMTW

SEQ ID NO: 1354728 - protein, 9 aa, Homo Sapiens
GRMHDENVD

SEQ ID NO: 1354729 - protein, 9 aa, Homo Sapiens
VLQNYYTGG

SEQ ID NO: 1354730 - protein, 9 aa, Homo Sapiens
GWDGGKVAQ

SEQ ID NO: 1354731 - protein, 9 aa, Homo Sapiens
CPQNSLLRL

SEQ ID NO: 1354732 - protein, 9 aa, Homo Sapiens
LNPYMLAVA

SEQ ID NO: 1354733 - protein, 9 aa, Homo Sapiens
KDTKVISVS

SEQ ID NO: 1354734 - protein, 9 aa, Homo Sapiens
SCNTEAYIL

SEQ ID NO: 1354735 - protein, 9 aa, Homo Sapiens
CRHIQYFDL

SEQ ID NO: 1354736 - protein, 9 aa, Homo Sapiens
CGNIFKSSS

SEQ ID NO: 1354737 - protein, 9 aa, Homo Sapiens
IKYVFRTEN

SEQ ID NO: 1354738 - protein, 9 aa, Homo Sapiens
PHQVADARE

SEQ ID NO: 1354739 - protein, 9 aa, Homo Sapiens
WTFHSVAEE

SEQ ID NO: 1354740 - protein, 9 aa, Homo Sapiens
GISRKQFEE

SEQ ID NO: 1354741 - protein, 9 aa, Homo Sapiens
YGHDVSSDE

SEQ ID NO: 1354742 - protein, 9 aa, Homo Sapiens
LFANRWGSD

SEQ ID NO: 1354743 - protein, 9 aa, Homo Sapiens
VFYSILVIH

SEQ ID NO: 1354744 - protein, 9 aa, Homo Sapiens
ELRVPCLPV

SEQ ID NO: 1354745 - protein, 9 aa, Homo Sapiens
STPWACATC

SEQ ID NO: 1354746 - protein, 9 aa, Homo Sapiens
KPTPMMETQ

SEQ ID NO: 1354747 - protein, 9 aa, Homo Sapiens
DMAFEVIVK

SEQ ID NO: 1354748 - protein, 9 aa, Homo Sapiens
VFFILFVLS

SEQ ID NO: 1354749 - protein, 9 aa, Homo Sapiens
QKEKIREQK

SEQ ID NO: 1354750 - protein, 9 aa, Homo Sapiens
PSQERVEYI

SEQ ID NO: 1354751 - protein, 9 aa, Homo Sapiens
MLQDFPCNC

SEQ ID NO: 1354752 - protein, 9 aa, Homo Sapiens
TEATPNRYH

SEQ ID NO: 1354753 - protein, 9 aa, Homo Sapiens
KSPKMMKKF

SEQ ID NO: 1354754 - protein, 9 aa, Homo Sapiens
KPGVYVHVS

SEQ ID NO: 1354755 - protein, 9 aa, Homo Sapiens
YSEAAKNGS

SEQ ID NO: 1354756 - protein, 9 aa, Homo Sapiens
PQTLLPALV

SEQ ID NO: 1354757 - protein, 9 aa, Homo Sapiens
QRAVQTPRP

SEQ ID NO: 1354758 - protein, 9 aa, Homo Sapiens
ASDTPPWTG

SEQ ID NO: 1354759 - protein, 9 aa, Homo Sapiens
SPCMRRSTA

SEQ ID NO: 1354760 - protein, 9 aa, Homo Sapiens
QGVQFLEAQ

SEQ ID NO: 1354761 - protein, 9 aa, Homo Sapiens
ICFIFISMI

SEQ ID NO: 1354762 - protein, 9 aa, Homo Sapiens
LTSVSLHFC

SEQ ID NO: 1354763 - protein, 9 aa, Homo Sapiens
DHQTPQPHL

SEQ ID NO: 1354764 - protein, 9 aa, Homo Sapiens
TVLCAYNSN

SEQ ID NO: 1354765 - protein, 9 aa, Homo Sapiens
GEKIISYIC

SEQ ID NO: 1354766 - protein, 9 aa, Homo Sapiens
MCFERFGRR

SEQ ID NO: 1354767 - protein, 9 aa, Homo Sapiens
HLVRESSGG

SEQ ID NO: 1354768 - protein, 9 aa, Homo Sapiens
ICHVGDALK

SEQ ID NO: 1354769 - protein, 9 aa, Homo Sapiens
CNTQITMLQ

SEQ ID NO: 1354770 - protein, 9 aa, Homo Sapiens
RQSAYIHKK

SEQ ID NO: 1354771 - protein, 9 aa, Homo Sapiens
TIKQCHVRK

SEQ ID NO: 1354772 - protein, 9 aa, Homo Sapiens
MAFITFQEK

SEQ ID NO: 1354773 - protein, 9 aa, Homo Sapiens
FTTHLEDVF

SEQ ID NO: 1354774 - protein, 9 aa, Homo Sapiens
QPIFTTRVH

SEQ ID NO: 1354775 - protein, 9 aa, Homo Sapiens
PHLHGHLIK

SEQ ID NO: 1354776 - protein, 9 aa, Homo Sapiens
QPHHRVACV

SEQ ID NO: 1354777 - protein, 9 aa, Homo Sapiens
RRLTAEGKN

SEQ ID NO: 1354778 - protein, 9 aa, Homo Sapiens
SGVMQARIQ

SEQ ID NO: 1354779 - protein, 9 aa, Homo Sapiens
QLPRDEVLP

SEQ ID NO: 1354780 - protein, 9 aa, Homo Sapiens
TMYFPSEAF

SEQ ID NO: 1354781 - protein, 9 aa, Homo Sapiens
TSVWILYLF

SEQ ID NO: 1354782 - protein, 9 aa, Homo Sapiens
IHVPQDHLA

SEQ ID NO: 1354783 - protein, 9 aa, Homo Sapiens
NILHFPLSM

SEQ ID NO: 1354784 - protein, 9 aa, Homo Sapiens
MKDTAELLG

SEQ ID NO: 1354785 - protein, 9 aa, Homo Sapiens
VVIKDKQEG

SEQ ID NO: 1354786 - protein, 9 aa, Homo Sapiens
PDNKLDADY

SEQ ID NO: 1354787 - protein, 9 aa, Homo Sapiens
GNANGGLVD

SEQ ID NO: 1354788 - protein, 9 aa, Homo Sapiens
EITQMMVYV

SEQ ID NO: 1354789 - protein, 9 aa, Homo Sapiens
VNSGPSTNG

SEQ ID NO: 1354790 - protein, 9 aa, Homo Sapiens
HKMAFAKMD

SEQ ID NO: 1354791 - protein, 9 aa, Homo Sapiens
NTHITEHYS

SEQ ID NO: 1354792 - protein, 9 aa, Homo Sapiens
ARDCTPANW

SEQ ID NO: 1354793 - protein, 9 aa, Homo Sapiens
AGLPTAQQQ

SEQ ID NO: 1354794 - protein, 9 aa, Homo Sapiens
TPPPLILWP

SEQ ID NO: 1354795 - protein, 9 aa, Homo Sapiens
ILNLIFSSH

SEQ ID NO: 1354796 - protein, 9 aa, Homo Sapiens
GTPSGSSSD

SEQ ID NO: 1354797 - protein, 9 aa, Homo Sapiens
RGSSGVPPP

SEQ ID NO: 1354798 - protein, 9 aa, Homo Sapiens
TIYPVLSRL

SEQ ID NO: 1354799 - protein, 9 aa, Homo Sapiens
SGSGFNPFQ

SEQ ID NO: 1354800 - protein, 9 aa, Homo Sapiens
HGKTHHPHG

SEQ ID NO: 1354801 - protein, 9 aa, Homo Sapiens
SNVIFLIFQ

SEQ ID NO: 1354802 - protein, 9 aa, Homo Sapiens
ADQNNPHKN

SEQ ID NO: 1354803 - protein, 9 aa, Homo Sapiens
TTSVTIFPN

SEQ ID NO: 1354804 - protein, 9 aa, Homo Sapiens
VKHYHIFRL

SEQ ID NO: 1354805 - protein, 9 aa, Homo Sapiens
RCNKKQLCG

SEQ ID NO: 1354806 - protein, 9 aa, Homo Sapiens
RWRSSERYM

SEQ ID NO: 1354807 - protein, 9 aa, Homo Sapiens
DPAQKYLYR

SEQ ID NO: 1354808 - protein, 9 aa, Homo Sapiens
LVCWQAGAT

SEQ ID NO: 1354809 - protein, 9 aa, Homo Sapiens
VQSILREVA

SEQ ID NO: 1354810 - protein, 9 aa, Homo Sapiens
ELSKCQFSS

SEQ ID NO: 1354811 - protein, 9 aa, Homo Sapiens
NMRVPLPGP

SEQ ID NO: 1354812 - protein, 9 aa, Homo Sapiens
LKVLHKLTV

SEQ ID NO: 1354813 - protein, 9 aa, Homo Sapiens
PKGKQDITL

SEQ ID NO: 1354814 - protein, 9 aa, Homo Sapiens
GYKVHEIVE

SEQ ID NO: 1354815 - protein, 9 aa, Homo Sapiens
ISSRDFRDL

SEQ ID NO: 1354816 - protein, 9 aa, Homo Sapiens
NVVCLWLHE

SEQ ID NO: 1354817 - protein, 9 aa, Homo Sapiens
CTKSLPCRQ

SEQ ID NO: 1354818 - protein, 9 aa, Homo Sapiens
RVPYVENPG

SEQ ID NO: 1354819 - protein, 9 aa, Homo Sapiens
TYPRLPEPT

SEQ ID NO: 1354820 - protein, 9 aa, Homo Sapiens
TNTDALYVR

SEQ ID NO: 1354821 - protein, 9 aa, Homo Sapiens
HALSCRTRR

SEQ ID NO: 1354822 - protein, 9 aa, Homo Sapiens
ALTESEMEY

SEQ ID NO: 1354823 - protein, 9 aa, Homo Sapiens
DAGIGAGMD

SEQ ID NO: 1354824 - protein, 9 aa, Homo Sapiens
FLATHKGYH

SEQ ID NO: 1354825 - protein, 9 aa, Homo Sapiens
VTLWMQSPC

SEQ ID NO: 1354826 - protein, 9 aa, Homo Sapiens
VLDGTHCYT

SEQ ID NO: 1354827 - protein, 9 aa, Homo Sapiens
RNSTWKDDM

SEQ ID NO: 1354828 - protein, 9 aa, Homo Sapiens
FYWWDYFED

SEQ ID NO: 1354829 - protein, 9 aa, Homo Sapiens
MRVMIEAME

SEQ ID NO: 1354830 - protein, 9 aa, Homo Sapiens
TTYNTQEGA

SEQ ID NO: 1354831 - protein, 9 aa, Homo Sapiens
MHKKGWGLR

SEQ ID NO: 1354832 - protein, 9 aa, Homo Sapiens
CPRSNTLPK

SEQ ID NO: 1354833 - protein, 9 aa, Homo Sapiens
TRTYYRNSV

SEQ ID NO: 1354834 - protein, 9 aa, Homo Sapiens
FLQQRLKKV

SEQ ID NO: 1354835 - protein, 9 aa, Homo Sapiens
LTGMSPILT

SEQ ID NO: 1354836 - protein, 9 aa, Homo Sapiens
TSHKDVLQE

SEQ ID NO: 1354837 - protein, 9 aa, Homo Sapiens
KQKNDVESA

SEQ ID NO: 1354838 - protein, 9 aa, Homo Sapiens
TPLAVPGLW

SEQ ID NO: 1354839 - protein, 9 aa, Homo Sapiens
YKYKPRPKC

SEQ ID NO: 1354840 - protein, 9 aa, Homo Sapiens
KEKEKKKRW

SEQ ID NO: 1354841 - protein, 9 aa, Homo Sapiens
NCSLHGVSC

SEQ ID NO: 1354842 - protein, 9 aa, Homo Sapiens
KSHVYIVWN

SEQ ID NO: 1354843 - protein, 9 aa, Homo Sapiens
SPANGVVTL

SEQ ID NO: 1354844 - protein, 9 aa, Homo Sapiens
RMHSQPQSR

SEQ ID NO: 1354845 - protein, 9 aa, Homo Sapiens
ILPNIPICL

SEQ ID NO: 1354846 - protein, 9 aa, Homo Sapiens
LCKHQVVVI

SEQ ID NO: 1354847 - protein, 9 aa, Homo Sapiens
WPLSVATDN

SEQ ID NO: 1354848 - protein, 9 aa, Homo Sapiens
KPEALIVPV

SEQ ID NO: 1354849 - protein, 9 aa, Homo Sapiens
WARCEGQEM

SEQ ID NO: 1354850 - protein, 9 aa, Homo Sapiens
AEVSGYLGK

SEQ ID NO: 1354851 - protein, 9 aa, Homo Sapiens
PYECSECDK

SEQ ID NO: 1354852 - protein, 9 aa, Homo Sapiens
VPQVLQNYY

SEQ ID NO: 1354853 - protein, 9 aa, Homo Sapiens
DWHYLVSWY

SEQ ID NO: 1354854 - protein, 9 aa, Homo Sapiens
PGCVGVSGA

SEQ ID NO: 1354855 - protein, 9 aa, Homo Sapiens
MCGTLDYLS

SEQ ID NO: 1354856 - protein, 9 aa, Homo Sapiens
KKCSLTLRD

SEQ ID NO: 1354857 - protein, 9 aa, Homo Sapiens
DDIGLTSYK

SEQ ID NO: 1354858 - protein, 9 aa, Homo Sapiens
VLYLQQAKE

SEQ ID NO: 1354859 - protein, 9 aa, Homo Sapiens
GQNLGHYWN

SEQ ID NO: 1354860 - protein, 9 aa, Homo Sapiens
LALTTHFTK

SEQ ID NO: 1354861 - protein, 9 aa, Homo Sapiens
SQSRLYVCP

SEQ ID NO: 1354862 - protein, 9 aa, Homo Sapiens
KVGGQLNLV

SEQ ID NO: 1354863 - protein, 9 aa, Homo Sapiens
EGEDEDEDE

SEQ ID NO: 1354864 - protein, 9 aa, Homo Sapiens
TSSVAYGFL

SEQ ID NO: 1354865 - protein, 9 aa, Homo Sapiens
CNVIEEFRR

SEQ ID NO: 1354866 - protein, 9 aa, Homo Sapiens
EQPSSTMLQ

SEQ ID NO: 1354867 - protein, 9 aa, Homo Sapiens
RVMEQCLAQ

SEQ ID NO: 1354868 - protein, 9 aa, Homo Sapiens
LCDMDTNGG

SEQ ID NO: 1354869 - protein, 9 aa, Homo Sapiens
ITLFNILHF

SEQ ID NO: 1354870 - protein, 9 aa, Homo Sapiens
SSPKRSLLG

SEQ ID NO: 1354871 - protein, 9 aa, Homo Sapiens
DDWHCLQRE

SEQ ID NO: 1354872 - protein, 9 aa, Homo Sapiens
REQRKRRKF

SEQ ID NO: 1354873 - protein, 9 aa, Homo Sapiens
SMAVVDGQL

SEQ ID NO: 1354874 - protein, 9 aa, Homo Sapiens
PGPSESLTV

SEQ ID NO: 1354875 - protein, 9 aa, Homo Sapiens
HQEKLEKAR

SEQ ID NO: 1354876 - protein, 9 aa, Homo Sapiens
SKRHAKLIT

SEQ ID NO: 1354877 - protein, 9 aa, Homo Sapiens
GLTVKASEK

SEQ ID NO: 1354878 - protein, 9 aa, Homo Sapiens
FAQTGKIEC

SEQ ID NO: 1354879 - protein, 9 aa, Homo Sapiens
EGATYQKYW

SEQ ID NO: 1354880 - protein, 9 aa, Homo Sapiens
KEELLTLWH

SEQ ID NO: 1354881 - protein, 9 aa, Homo Sapiens
CAKLEAAVA

SEQ ID NO: 1354882 - protein, 9 aa, Homo Sapiens
ERHMEDEGG

SEQ ID NO: 1354883 - protein, 9 aa, Homo Sapiens
SPKKAVEPT

SEQ ID NO: 1354884 - protein, 9 aa, Homo Sapiens
WLKLGLTIT

SEQ ID NO: 1354885 - protein, 9 aa, Homo Sapiens
RANATKMLS

SEQ ID NO: 1354886 - protein, 9 aa, Homo Sapiens
MPLSMHYLF

SEQ ID NO: 1354887 - protein, 9 aa, Homo Sapiens
GFSMCPDLC

SEQ ID NO: 1354888 - protein, 9 aa, Homo Sapiens
HPATLDTAH

SEQ ID NO: 1354889 - protein, 9 aa, Homo Sapiens
LNKKVQTCH

SEQ ID NO: 1354890 - protein, 9 aa, Homo Sapiens
PTGDCFRKQ

SEQ ID NO: 1354891 - protein, 9 aa, Homo Sapiens
ITDYMFWLG

SEQ ID NO: 1354892 - protein, 9 aa, Homo Sapiens
QHNASDLLD

SEQ ID NO: 1354893 - protein, 9 aa, Homo Sapiens
FNNITVVYG

SEQ ID NO: 1354894 - protein, 9 aa, Homo Sapiens
EDKSRLISG

SEQ ID NO: 1354895 - protein, 9 aa, Homo Sapiens
QETHECDTC

SEQ ID NO: 1354896 - protein, 9 aa, Homo Sapiens
CDKAFTWSS

SEQ ID NO: 1354897 - protein, 9 aa, Homo Sapiens
DNEYGAWKH

SEQ ID NO: 1354898 - protein, 9 aa, Homo Sapiens
SSGDPPVNY

SEQ ID NO: 1354899 - protein, 9 aa, Homo Sapiens
NRTRFYVYN

SEQ ID NO: 1354900 - protein, 9 aa, Homo Sapiens
PSYLYNHHH

SEQ ID NO: 1354901 - protein, 9 aa, Homo Sapiens
SVTVICRNK

SEQ ID NO: 1354902 - protein, 9 aa, Homo Sapiens
NDGISIILR

SEQ ID NO: 1354903 - protein, 9 aa, Homo Sapiens
DKYRNVIKR

SEQ ID NO: 1354904 - protein, 9 aa, Homo Sapiens
KHSPSTPSQ

SEQ ID NO: 1354905 - protein, 9 aa, Homo Sapiens
KGLQIFCSE

SEQ ID NO: 1354906 - protein, 9 aa, Homo Sapiens
VIDCHYPYE

SEQ ID NO: 1354907 - protein, 9 aa, Homo Sapiens
VVFVTYEAV

SEQ ID NO: 1354908 - protein, 9 aa, Homo Sapiens
VGDQVIDVG

SEQ ID NO: 1354909 - protein, 9 aa, Homo Sapiens
VDDACKLMR

SEQ ID NO: 1354910 - protein, 9 aa, Homo Sapiens
VWAPPSPHL

SEQ ID NO: 1354911 - protein, 9 aa, Homo Sapiens
LKDYIFDLC

SEQ ID NO: 1354912 - protein, 9 aa, Homo Sapiens
LMSPQSSKN

SEQ ID NO: 1354913 - protein, 9 aa, Homo Sapiens
CRQLGCGEV

SEQ ID NO: 1354914 - protein, 9 aa, Homo Sapiens
GGSQGGRPS

SEQ ID NO: 1354915 - protein, 9 aa, Homo Sapiens
HVNLDQGYL

SEQ ID NO: 1354916 - protein, 9 aa, Homo Sapiens
SKSGPGDDF

SEQ ID NO: 1354917 - protein, 9 aa, Homo Sapiens
AVNGATGHI

SEQ ID NO: 1354918 - protein, 9 aa, Homo Sapiens
FIYIRSKAS

SEQ ID NO: 1354919 - protein, 9 aa, Homo Sapiens
LCKGKSLVN

SEQ ID NO: 1354920 - protein, 9 aa, Homo Sapiens
CSTKIDCVE

SEQ ID NO: 1354921 - protein, 9 aa, Homo Sapiens
VGHCPVKTC

SEQ ID NO: 1354922 - protein, 9 aa, Homo Sapiens
CMVKKSRTT

SEQ ID NO: 1354923 - protein, 9 aa, Homo Sapiens
CRHANIVTY

SEQ ID NO: 1354924 - protein, 9 aa, Homo Sapiens
AITTLKRIA

SEQ ID NO: 1354925 - protein, 9 aa, Homo Sapiens
KHEVSAHFH

SEQ ID NO: 1354926 - protein, 9 aa, Homo Sapiens
NEYRSHQAR

SEQ ID NO: 1354927 - protein, 9 aa, Homo Sapiens
QPDKPTTPV

SEQ ID NO: 1354928 - protein, 9 aa, Homo Sapiens
SNTIMGSGI

SEQ ID NO: 1354929 - protein, 9 aa, Homo Sapiens
IWCFGPDST

SEQ ID NO: 1354930 - protein, 9 aa, Homo Sapiens
CCALITETA

SEQ ID NO: 1354931 - protein, 9 aa, Homo Sapiens
VDLEHTFTF

SEQ ID NO: 1354932 - protein, 9 aa, Homo Sapiens
IARKGRKKD

SEQ ID NO: 1354933 - protein, 9 aa, Homo Sapiens
ISQLEHDLQ

SEQ ID NO: 1354934 - protein, 9 aa, Homo Sapiens
TYSDEVRNE

SEQ ID NO: 1354935 - protein, 9 aa, Homo Sapiens
FSVFIPKKL

SEQ ID NO: 1354936 - protein, 9 aa, Homo Sapiens
STQDGSCTE

SEQ ID NO: 1354937 - protein, 9 aa, Homo Sapiens
NPRTPPKIT

SEQ ID NO: 1354938 - protein, 9 aa, Homo Sapiens
VCQCLAPAR

SEQ ID NO: 1354939 - protein, 9 aa, Homo Sapiens
ALRTQLDLC

SEQ ID NO: 1354940 - protein, 9 aa, Homo Sapiens
ECEKEDYLH

SEQ ID NO: 1354941 - protein, 9 aa, Homo Sapiens
EVCVKLGLC

SEQ ID NO: 1354942 - protein, 9 aa, Homo Sapiens
PKIQEQYHR

SEQ ID NO: 1354943 - protein, 9 aa, Homo Sapiens
TDEPEKELD

SEQ ID NO: 1354944 - protein, 9 aa, Homo Sapiens
FLWFTHLKY

SEQ ID NO: 1354945 - protein, 9 aa, Homo Sapiens
LKQLVPASS

SEQ ID NO: 1354946 - protein, 9 aa, Homo Sapiens
SLSWGQRKN

SEQ ID NO: 1354947 - protein, 9 aa, Homo Sapiens
TAGTSRSSA

SEQ ID NO: 1354948 - protein, 9 aa, Homo Sapiens
NRIMKDTLR

SEQ ID NO: 1354949 - protein, 9 aa, Homo Sapiens
LAEAHVNLD

SEQ ID NO: 1354950 - protein, 9 aa, Homo Sapiens
LGSFLLAGI

SEQ ID NO: 1354951 - protein, 9 aa, Homo Sapiens
TQQVQVQQQ

SEQ ID NO: 1354952 - protein, 9 aa, Homo Sapiens
GTGAELSLC

SEQ ID NO: 1354953 - protein, 9 aa, Homo Sapiens
CLFFTSVPG

SEQ ID NO: 1354954 - protein, 9 aa, Homo Sapiens
QQQLIREML

SEQ ID NO: 1354955 - protein, 9 aa, Homo Sapiens
VDGKDKSSV

SEQ ID NO: 1354956 - protein, 9 aa, Homo Sapiens
FALNPDKKM

SEQ ID NO: 1354957 - protein, 9 aa, Homo Sapiens
EYEMLTSLT

SEQ ID NO: 1354958 - protein, 9 aa, Homo Sapiens
KGFFPVTFG

SEQ ID NO: 1354959 - protein, 9 aa, Homo Sapiens
NIHSWMNSE

SEQ ID NO: 1354960 - protein, 9 aa, Homo Sapiens
SMCPDLCAQ

SEQ ID NO: 1354961 - protein, 9 aa, Homo Sapiens
TCPRSNTLP

SEQ ID NO: 1354962 - protein, 9 aa, Homo Sapiens
KCSLFFNRD

SEQ ID NO: 1354963 - protein, 9 aa, Homo Sapiens
LTMCHNLIT

SEQ ID NO: 1354964 - protein, 9 aa, Homo Sapiens
SVMRYSTSA

SEQ ID NO: 1354965 - protein, 9 aa, Homo Sapiens
TNQADHDRD

SEQ ID NO: 1354966 - protein, 9 aa, Homo Sapiens
QGTTSDTSL

SEQ ID NO: 1354967 - protein, 9 aa, Homo Sapiens
KKQVLYLMF

SEQ ID NO: 1354968 - protein, 9 aa, Homo Sapiens
QGPCDTGNR

SEQ ID NO: 1354969 - protein, 9 aa, Homo Sapiens
LYVDMLLCT

SEQ ID NO: 1354970 - protein, 9 aa, Homo Sapiens
FLSLIRAPW

SEQ ID NO: 1354971 - protein, 9 aa, Homo Sapiens
TVHGLLRQL

SEQ ID NO: 1354972 - protein, 9 aa, Homo Sapiens
SKTFSQKTT

SEQ ID NO: 1354973 - protein, 9 aa, Homo Sapiens
MCFDCMHGY

SEQ ID NO: 1354974 - protein, 9 aa, Homo Sapiens
ASVVCWTPG

SEQ ID NO: 1354975 - protein, 9 aa, Homo Sapiens
MYGWSSSLH

SEQ ID NO: 1354976 - protein, 9 aa, Homo Sapiens
FVCAMGPRV

SEQ ID NO: 1354977 - protein, 9 aa, Homo Sapiens
DTMVEPYNA

SEQ ID NO: 1354978 - protein, 9 aa, Homo Sapiens
GIDEVIIPL

SEQ ID NO: 1354979 - protein, 9 aa, Homo Sapiens
LTQVMYRSN

SEQ ID NO: 1354980 - protein, 9 aa, Homo Sapiens
AGASSAATW

SEQ ID NO: 1354981 - protein, 9 aa, Homo Sapiens
ELQPAVPSS

SEQ ID NO: 1354982 - protein, 9 aa, Homo Sapiens
QKATCHHPS

SEQ ID NO: 1354983 - protein, 9 aa, Homo Sapiens
PFPACLKVS

SEQ ID NO: 1354984 - protein, 9 aa, Homo Sapiens
DLLLHLLTC

SEQ ID NO: 1354985 - protein, 9 aa, Homo Sapiens
YSILVIHYF

SEQ ID NO: 1354986 - protein, 9 aa, Homo Sapiens
HHPISHHIP

SEQ ID NO: 1354987 - protein, 9 aa, Homo Sapiens
AAPHRKRKR

SEQ ID NO: 1354988 - protein, 9 aa, Homo Sapiens
SWSPDQERV

SEQ ID NO: 1354989 - protein, 9 aa, Homo Sapiens
LIFAVYVRR

SEQ ID NO: 1354990 - protein, 9 aa, Homo Sapiens
KIRIRDRGR

SEQ ID NO: 1354991 - protein, 9 aa, Homo Sapiens
IEGRMHDEN

SEQ ID NO: 1354992 - protein, 9 aa, Homo Sapiens
KDDSILSIT

SEQ ID NO: 1354993 - protein, 9 aa, Homo Sapiens
GVMQARIQH

SEQ ID NO: 1354994 - protein, 9 aa, Homo Sapiens
GKSKWEAWN

SEQ ID NO: 1354995 - protein, 9 aa, Homo Sapiens
LFNILHFPL

SEQ ID NO: 1354996 - protein, 9 aa, Homo Sapiens
NNANGTYEV

SEQ ID NO: 1354997 - protein, 9 aa, Homo Sapiens
GTHIGCRFD

SEQ ID NO: 1354998 - protein, 9 aa, Homo Sapiens
QKDIEEVKV

SEQ ID NO: 1354999 - protein, 9 aa, Homo Sapiens
SPSRECSPA

SEQ ID NO: 1355000 - protein, 9 aa, Homo Sapiens
NLYDIKRAV

SEQ ID NO: 1355001 - protein, 9 aa, Homo Sapiens
FSPRKKSRH

SEQ ID NO: 1355002 - protein, 9 aa, Homo Sapiens
YIQSHYNIE

SEQ ID NO: 1355003 - protein, 9 aa, Homo Sapiens
GSKLASVSE

SEQ ID NO: 1355004 - protein, 9 aa, Homo Sapiens
FCRLYHRAD

SEQ ID NO: 1355005 - protein, 9 aa, Homo Sapiens
CNLVATATL

SEQ ID NO: 1355006 - protein, 9 aa, Homo Sapiens
EEHCGDSPN

SEQ ID NO: 1355007 - protein, 9 aa, Homo Sapiens
SELKHRSIK

SEQ ID NO: 1355008 - protein, 9 aa, Homo Sapiens
DRKQLFQKF

SEQ ID NO: 1355009 - protein, 9 aa, Homo Sapiens
QDHLAYRYE

SEQ ID NO: 1355010 - protein, 9 aa, Homo Sapiens
ICVVDCRAF

SEQ ID NO: 1355011 - protein, 9 aa, Homo Sapiens
CDSSPSRDP

SEQ ID NO: 1355012 - protein, 9 aa, Homo Sapiens
IKLARYRGQ

SEQ ID NO: 1355013 - protein, 9 aa, Homo Sapiens
PGGHINCPW

SEQ ID NO: 1355014 - protein, 9 aa, Homo Sapiens
MDVDMYINL

SEQ ID NO: 1355015 - protein, 9 aa, Homo Sapiens
LMLKEDVSY

SEQ ID NO: 1355016 - protein, 9 aa, Homo Sapiens
QLVCWQAGA

SEQ ID NO: 1355017 - protein, 9 aa, Homo Sapiens
FNHVNGLTL

SEQ ID NO: 1355018 - protein, 9 aa, Homo Sapiens
MAMRCLGLA

SEQ ID NO: 1355019 - protein, 9 aa, Homo Sapiens
DTKKIEGKY

SEQ ID NO: 1355020 - protein, 9 aa, Homo Sapiens
FHILVPGNT

SEQ ID NO: 1355021 - protein, 9 aa, Homo Sapiens
FFTSAHPSR

SEQ ID NO: 1355022 - protein, 9 aa, Homo Sapiens
PYTFQVSSE

SEQ ID NO: 1355023 - protein, 9 aa, Homo Sapiens
ELTHTTPAV

SEQ ID NO: 1355024 - protein, 9 aa, Homo Sapiens
LDDLYWTAT

SEQ ID NO: 1355025 - protein, 9 aa, Homo Sapiens
QGPCMSVAW

SEQ ID NO: 1355026 - protein, 9 aa, Homo Sapiens
TRNNIKPSS

SEQ ID NO: 1355027 - protein, 9 aa, Homo Sapiens
KIERRAVVP

SEQ ID NO: 1355028 - protein, 9 aa, Homo Sapiens
IPNIQDTQA

SEQ ID NO: 1355029 - protein, 9 aa, Homo Sapiens
EMSALWFLW

SEQ ID NO: 1355030 - protein, 9 aa, Homo Sapiens
PRPPRDCVQ

SEQ ID NO: 1355031 - protein, 9 aa, Homo Sapiens
TGFPCSRLL

SEQ ID NO: 1355032 - protein, 9 aa, Homo Sapiens
TCSSHVTVV

SEQ ID NO: 1355033 - protein, 9 aa, Homo Sapiens
ECAHRGSPF

SEQ ID NO: 1355034 - protein, 9 aa, Homo Sapiens
ESCGLGRRQ

SEQ ID NO: 1355035 - protein, 9 aa, Homo Sapiens
HAKEGECSP

SEQ ID NO: 1355036 - protein, 9 aa, Homo Sapiens
SSGGSVTYF

SEQ ID NO: 1355037 - protein, 9 aa, Homo Sapiens
NDPTDFVRK

SEQ ID NO: 1355038 - protein, 9 aa, Homo Sapiens
KENMLAKLY

SEQ ID NO: 1355039 - protein, 9 aa, Homo Sapiens
ITNSPIQKR

SEQ ID NO: 1355040 - protein, 9 aa, Homo Sapiens
RHQTTIWRR

SEQ ID NO: 1355041 - protein, 9 aa, Homo Sapiens
RHTSLWPLE

SEQ ID NO: 1355042 - protein, 9 aa, Homo Sapiens
EGCLYMTCA

SEQ ID NO: 1355043 - protein, 9 aa, Homo Sapiens
YNSCGAFGY

SEQ ID NO: 1355044 - protein, 9 aa, Homo Sapiens
KATDNIVEV

SEQ ID NO: 1355045 - protein, 9 aa, Homo Sapiens
KSRGRAVKK

SEQ ID NO: 1355046 - protein, 9 aa, Homo Sapiens
ASSLKMDPT

SEQ ID NO: 1355047 - protein, 9 aa, Homo Sapiens
PRGERRALA

SEQ ID NO: 1355048 - protein, 9 aa, Homo Sapiens
YVVNEVVAG

SEQ ID NO: 1355049 - protein, 9 aa, Homo Sapiens
LCYLFGEIM

SEQ ID NO: 1355050 - protein, 9 aa, Homo Sapiens
YNLTQQWVV

SEQ ID NO: 1355051 - protein, 9 aa, Homo Sapiens
PPSPSRRRA

SEQ ID NO: 1355052 - protein, 9 aa, Homo Sapiens
KVIISKQVI

SEQ ID NO: 1355053 - protein, 9 aa, Homo Sapiens
KEMTDIVEA

SEQ ID NO: 1355054 - protein, 9 aa, Homo Sapiens
QYIHQKSFS

SEQ ID NO: 1355055 - protein, 9 aa, Homo Sapiens
AKQMFSNLT

SEQ ID NO: 1355056 - protein, 9 aa, Homo Sapiens
WTNKENAKQ

SEQ ID NO: 1355057 - protein, 9 aa, Homo Sapiens
LLCHLCKKQ

SEQ ID NO: 1355058 - protein, 9 aa, Homo Sapiens
RTVRAMVFT

SEQ ID NO: 1355059 - protein, 9 aa, Homo Sapiens
LGGSQGGRP

SEQ ID NO: 1355060 - protein, 9 aa, Homo Sapiens
AGPRKEHTR

SEQ ID NO: 1355061 - protein, 9 aa, Homo Sapiens
GKKIGCDNF

SEQ ID NO: 1355062 - protein, 9 aa, Homo Sapiens
LYDTVAESE

SEQ ID NO: 1355063 - protein, 9 aa, Homo Sapiens
LLRVGAICF

SEQ ID NO: 1355064 - protein, 9 aa, Homo Sapiens
ANSSWTDMD

SEQ ID NO: 1355065 - protein, 9 aa, Homo Sapiens
QQSHYYGSE

SEQ ID NO: 1355066 - protein, 9 aa, Homo Sapiens
GCNKFVTVQ

SEQ ID NO: 1355067 - protein, 9 aa, Homo Sapiens
GPIQLQTPH

SEQ ID NO: 1355068 - protein, 9 aa, Homo Sapiens
CYAPSCAKC

SEQ ID NO: 1355069 - protein, 9 aa, Homo Sapiens
SAEKCRLQE

SEQ ID NO: 1355070 - protein, 9 aa, Homo Sapiens
KDASRDYIS

SEQ ID NO: 1355071 - protein, 9 aa, Homo Sapiens
TARESKNTQ

SEQ ID NO: 1355072 - protein, 9 aa, Homo Sapiens
LAQLKESFQ

SEQ ID NO: 1355073 - protein, 9 aa, Homo Sapiens
DRQGQSTIL

SEQ ID NO: 1355074 - protein, 9 aa, Homo Sapiens
FSNNDGVDE

SEQ ID NO: 1355075 - protein, 9 aa, Homo Sapiens
TSLAVDPND

SEQ ID NO: 1355076 - protein, 9 aa, Homo Sapiens
HGKPKKQTL

SEQ ID NO: 1355077 - protein, 9 aa, Homo Sapiens
KDWLQADMM

SEQ ID NO: 1355078 - protein, 9 aa, Homo Sapiens
ALPHCSEMV

SEQ ID NO: 1355079 - protein, 9 aa, Homo Sapiens
FAQHPAGRS

SEQ ID NO: 1355080 - protein, 9 aa, Homo Sapiens
EEVWDQLLE

SEQ ID NO: 1355081 - protein, 9 aa, Homo Sapiens
HDTEDAGAP

SEQ ID NO: 1355082 - protein, 9 aa, Homo Sapiens
SSPQGASPT

SEQ ID NO: 1355083 - protein, 9 aa, Homo Sapiens
CTSIVRNLH

SEQ ID NO: 1355084 - protein, 9 aa, Homo Sapiens
SSIVHLCTI

SEQ ID NO: 1355085 - protein, 9 aa, Homo Sapiens
FSSKQESYE

SEQ ID NO: 1355086 - protein, 9 aa, Homo Sapiens
FEVQSVLLA

SEQ ID NO: 1355087 - protein, 9 aa, Homo Sapiens
NVDLWSLGV

SEQ ID NO: 1355088 - protein, 9 aa, Homo Sapiens
YGLTESCGD

SEQ ID NO: 1355089 - protein, 9 aa, Homo Sapiens
SLRARNIIQ

SEQ ID NO: 1355090 - protein, 9 aa, Homo Sapiens
TQHYLYENL

SEQ ID NO: 1355091 - protein, 9 aa, Homo Sapiens
LHVSCMERK

SEQ ID NO: 1355092 - protein, 9 aa, Homo Sapiens
AEETKPDTQ

SEQ ID NO: 1355093 - protein, 9 aa, Homo Sapiens
GLDEDNKPD

SEQ ID NO: 1355094 - protein, 9 aa, Homo Sapiens
CMFNQLRET

SEQ ID NO: 1355095 - protein, 9 aa, Homo Sapiens
HYFKVWLYH

SEQ ID NO: 1355096 - protein, 9 aa, Homo Sapiens
LEKVHAEER

SEQ ID NO: 1355097 - protein, 9 aa, Homo Sapiens
DCQISKQGM

SEQ ID NO: 1355098 - protein, 9 aa, Homo Sapiens
VIYRLPTLD

SEQ ID NO: 1355099 - protein, 9 aa, Homo Sapiens
HSQYQGGGL

SEQ ID NO: 1355100 - protein, 9 aa, Homo Sapiens
TRLYGEPVL

SEQ ID NO: 1355101 - protein, 9 aa, Homo Sapiens
RGIGPLTRD

SEQ ID NO: 1355102 - protein, 9 aa, Homo Sapiens
PSVPKTSTS

SEQ ID NO: 1355103 - protein, 9 aa, Homo Sapiens
DFILQWEPY

SEQ ID NO: 1355104 - protein, 9 aa, Homo Sapiens
KEANTNGSS

SEQ ID NO: 1355105 - protein, 9 aa, Homo Sapiens
RIMKDTLRD

SEQ ID NO: 1355106 - protein, 9 aa, Homo Sapiens
RRKIVVHSK

SEQ ID NO: 1355107 - protein, 9 aa, Homo Sapiens
TGEKLYTCL

SEQ ID NO: 1355108 - protein, 9 aa, Homo Sapiens
MGFTMSNSI

SEQ ID NO: 1355109 - protein, 9 aa, Homo Sapiens
VPYDDLCYL

SEQ ID NO: 1355110 - protein, 9 aa, Homo Sapiens
AEPRPPRDC

SEQ ID NO: 1355111 - protein, 9 aa, Homo Sapiens
VGSYDEVVL

SEQ ID NO: 1355112 - protein, 9 aa, Homo Sapiens
LERAYGRLW

SEQ ID NO: 1355113 - protein, 9 aa, Homo Sapiens
LSLAVLIVI

SEQ ID NO: 1355114 - protein, 9 aa, Homo Sapiens
PNKPGVYVH

SEQ ID NO: 1355115 - protein, 9 aa, Homo Sapiens
VSPSSAFQP

SEQ ID NO: 1355116 - protein, 9 aa, Homo Sapiens
AFPQDRPFD

SEQ ID NO: 1355117 - protein, 9 aa, Homo Sapiens
PGHRHSTFV

SEQ ID NO: 1355118 - protein, 9 aa, Homo Sapiens
GTIAPLQGP

SEQ ID NO: 1355119 - protein, 9 aa, Homo Sapiens
REHFEELLV

SEQ ID NO: 1355120 - protein, 9 aa, Homo Sapiens
TRWTHNFHH

SEQ ID NO: 1355121 - protein, 9 aa, Homo Sapiens
GFPKCGQKR

SEQ ID NO: 1355122 - protein, 9 aa, Homo Sapiens
IEQSLLATC

SEQ ID NO: 1355123 - protein, 9 aa, Homo Sapiens
EVVELQLRA

SEQ ID NO: 1355124 - protein, 9 aa, Homo Sapiens
HYNVLSKNC

SEQ ID NO: 1355125 - protein, 9 aa, Homo Sapiens
ASEITSLSS

SEQ ID NO: 1355126 - protein, 9 aa, Homo Sapiens
SSMSKNVRH

SEQ ID NO: 1355127 - protein, 9 aa, Homo Sapiens
PALPVLVSC

SEQ ID NO: 1355128 - protein, 9 aa, Homo Sapiens
RAPPSRCTG

SEQ ID NO: 1355129 - protein, 9 aa, Homo Sapiens
GLGIGLCGA

SEQ ID NO: 1355130 - protein, 9 aa, Homo Sapiens
VTPEEYVGQ

SEQ ID NO: 1355131 - protein, 9 aa, Homo Sapiens
NQEEGKYYN

SEQ ID NO: 1355132 - protein, 9 aa, Homo Sapiens
PRPSLVING

SEQ ID NO: 1355133 - protein, 9 aa, Homo Sapiens
RICISRRER

SEQ ID NO: 1355134 - protein, 9 aa, Homo Sapiens
GVSGALPPP

SEQ ID NO: 1355135 - protein, 9 aa, Homo Sapiens
KGEYEELHT

SEQ ID NO: 1355136 - protein, 9 aa, Homo Sapiens
SNRPVLAGT

SEQ ID NO: 1355137 - protein, 9 aa, Homo Sapiens
LTIMVTWYW

SEQ ID NO: 1355138 - protein, 9 aa, Homo Sapiens
LLWHRTQYE

SEQ ID NO: 1355139 - protein, 9 aa, Homo Sapiens
ESELSSNPT

SEQ ID NO: 1355140 - protein, 9 aa, Homo Sapiens
SWSSRIVAP

SEQ ID NO: 1355141 - protein, 9 aa, Homo Sapiens
LALCCLEEF

SEQ ID NO: 1355142 - protein, 9 aa, Homo Sapiens
QNYYTGGWH

SEQ ID NO: 1355143 - protein, 9 aa, Homo Sapiens
LGGGGGQKP

SEQ ID NO: 1355144 - protein, 9 aa, Homo Sapiens
QESKKFRLP

SEQ ID NO: 1355145 - protein, 9 aa, Homo Sapiens
LLCHLDDTC

SEQ ID NO: 1355146 - protein, 9 aa, Homo Sapiens
HVELYKVLS

SEQ ID NO: 1355147 - protein, 9 aa, Homo Sapiens
LTRGRHTAS

SEQ ID NO: 1355148 - protein, 9 aa, Homo Sapiens
ALISIFVVG

SEQ ID NO: 1355149 - protein, 9 aa, Homo Sapiens
ILLHFRHEN

SEQ ID NO: 1355150 - protein, 9 aa, Homo Sapiens
NIIEIFYEL

SEQ ID NO: 1355151 - protein, 9 aa, Homo Sapiens
HPEAPTGPN

SEQ ID NO: 1355152 - protein, 9 aa, Homo Sapiens
VFLILSYLA

SEQ ID NO: 1355153 - protein, 9 aa, Homo Sapiens
EFRKNWCAL

SEQ ID NO: 1355154 - protein, 9 aa, Homo Sapiens
SSKNLSRGG

SEQ ID NO: 1355155 - protein, 9 aa, Homo Sapiens
ELPAKQREH

SEQ ID NO: 1355156 - protein, 9 aa, Homo Sapiens
RDLQTTHST

SEQ ID NO: 1355157 - protein, 9 aa, Homo Sapiens
LSEHTTIPT

SEQ ID NO: 1355158 - protein, 9 aa, Homo Sapiens
CPDAKGEPG

SEQ ID NO: 1355159 - protein, 9 aa, Homo Sapiens
EGHISLRLE

SEQ ID NO: 1355160 - protein, 9 aa, Homo Sapiens
TLAQEPSMT

SEQ ID NO: 1355161 - protein, 9 aa, Homo Sapiens
NVLKILTNE

SEQ ID NO: 1355162 - protein, 9 aa, Homo Sapiens
QAKVMRPLR

SEQ ID NO: 1355163 - protein, 9 aa, Homo Sapiens
DADGEQWPY

SEQ ID NO: 1355164 - protein, 9 aa, Homo Sapiens
IHGTNSEPA

SEQ ID NO: 1355165 - protein, 9 aa, Homo Sapiens
IPLNPSPSK

SEQ ID NO: 1355166 - protein, 9 aa, Homo Sapiens
TPSTDVTVQ

SEQ ID NO: 1355167 - protein, 9 aa, Homo Sapiens
VAYLSNTDL

SEQ ID NO: 1355168 - protein, 9 aa, Homo Sapiens
RDRENHTSL

SEQ ID NO: 1355169 - protein, 9 aa, Homo Sapiens
GLQRPDDRF

SEQ ID NO: 1355170 - protein, 9 aa, Homo Sapiens
LVSHSGRED

SEQ ID NO: 1355171 - protein, 9 aa, Homo Sapiens
SLPGDGLTV

SEQ ID NO: 1355172 - protein, 9 aa, Homo Sapiens
LSYNTKFTI

SEQ ID NO: 1355173 - protein, 9 aa, Homo Sapiens
AKKGLLRRY

SEQ ID NO: 1355174 - protein, 9 aa, Homo Sapiens
SIVHLCTIS

SEQ ID NO: 1355175 - protein, 9 aa, Homo Sapiens
PDPGTPVKL

SEQ ID NO: 1355176 - protein, 9 aa, Homo Sapiens
NLVDNEIEL

SEQ ID NO: 1355177 - protein, 9 aa, Homo Sapiens
VPIDHGVRL

SEQ ID NO: 1355178 - protein, 9 aa, Homo Sapiens
VMVEAEYPF

SEQ ID NO: 1355179 - protein, 9 aa, Homo Sapiens
EKKVQEAEA

SEQ ID NO: 1355180 - protein, 9 aa, Homo Sapiens
KKNRGAVFQ

SEQ ID NO: 1355181 - protein, 9 aa, Homo Sapiens
QSAYIHKKT

SEQ ID NO: 1355182 - protein, 9 aa, Homo Sapiens
TTLVLMFGL

SEQ ID NO: 1355183 - protein, 9 aa, Homo Sapiens
QIRRELDGC

SEQ ID NO: 1355184 - protein, 9 aa, Homo Sapiens
GRDVPEAAA

SEQ ID NO: 1355185 - protein, 9 aa, Homo Sapiens
CCALCIGGM

SEQ ID NO: 1355186 - protein, 9 aa, Homo Sapiens
ICREEGILG

SEQ ID NO: 1355187 - protein, 9 aa, Homo Sapiens
FYFGSNYMS

SEQ ID NO: 1355188 - protein, 9 aa, Homo Sapiens
ERDASHLIF

SEQ ID NO: 1355189 - protein, 9 aa, Homo Sapiens
HLSHSDTYV

SEQ ID NO: 1355190 - protein, 9 aa, Homo Sapiens
IQTVPTLMS

SEQ ID NO: 1355191 - protein, 9 aa, Homo Sapiens
PLEARKDLR

SEQ ID NO: 1355192 - protein, 9 aa, Homo Sapiens
EWYLLNIFT

SEQ ID NO: 1355193 - protein, 9 aa, Homo Sapiens
TKDPPAMRR

SEQ ID NO: 1355194 - protein, 9 aa, Homo Sapiens
AVEPGTFNN

SEQ ID NO: 1355195 - protein, 9 aa, Homo Sapiens
YKCTVCEKT

SEQ ID NO: 1355196 - protein, 9 aa, Homo Sapiens
ASGGFLYIA

SEQ ID NO: 1355197 - protein, 9 aa, Homo Sapiens
PSPPHRRRL

SEQ ID NO: 1355198 - protein, 9 aa, Homo Sapiens
EVINATGSA

SEQ ID NO: 1355199 - protein, 9 aa, Homo Sapiens
LAKVMCFER

SEQ ID NO: 1355200 - protein, 9 aa, Homo Sapiens
RSGTKYKVT

SEQ ID NO: 1355201 - protein, 9 aa, Homo Sapiens
LGAQTTEHI

SEQ ID NO: 1355202 - protein, 9 aa, Homo Sapiens
SNCSHCVLL

SEQ ID NO: 1355203 - protein, 9 aa, Homo Sapiens
KLRLKKLWQ

SEQ ID NO: 1355204 - protein, 9 aa, Homo Sapiens
MKVTAFSPH

SEQ ID NO: 1355205 - protein, 9 aa, Homo Sapiens
FIMDGNCRY

SEQ ID NO: 1355206 - protein, 9 aa, Homo Sapiens
LTFIFFFSL

SEQ ID NO: 1355207 - protein, 9 aa, Homo Sapiens
NQIVPDTHK

SEQ ID NO: 1355208 - protein, 9 aa, Homo Sapiens
CFAKMPDEP

SEQ ID NO: 1355209 - protein, 9 aa, Homo Sapiens
WYLLNIFTC

SEQ ID NO: 1355210 - protein, 9 aa, Homo Sapiens
TVTIVYSGK

SEQ ID NO: 1355211 - protein, 9 aa, Homo Sapiens
AMCYEPANS

SEQ ID NO: 1355212 - protein, 9 aa, Homo Sapiens
KEYLNEDAN

SEQ ID NO: 1355213 - protein, 9 aa, Homo Sapiens
GADSMYDKL

SEQ ID NO: 1355214 - protein, 9 aa, Homo Sapiens
FTQVSRRFG

SEQ ID NO: 1355215 - protein, 9 aa, Homo Sapiens
NLLDVIFMK

SEQ ID NO: 1355216 - protein, 9 aa, Homo Sapiens
QQILPVKIR

SEQ ID NO: 1355217 - protein, 9 aa, Homo Sapiens
FPGKLLLVC

SEQ ID NO: 1355218 - protein, 9 aa, Homo Sapiens
FFYEWSIKL

SEQ ID NO: 1355219 - protein, 9 aa, Homo Sapiens
SDGVLAWGT

SEQ ID NO: 1355220 - protein, 9 aa, Homo Sapiens
EIMVQLEER

SEQ ID NO: 1355221 - protein, 9 aa, Homo Sapiens
GGYKHATFV

SEQ ID NO: 1355222 - protein, 9 aa, Homo Sapiens
MGADSMYDK

SEQ ID NO: 1355223 - protein, 9 aa, Homo Sapiens
TLFGNIENI

SEQ ID NO: 1355224 - protein, 9 aa, Homo Sapiens
VLPFASGGF

SEQ ID NO: 1355225 - protein, 9 aa, Homo Sapiens
TPLIIAGNP

SEQ ID NO: 1355226 - protein, 9 aa, Homo Sapiens
YSTKSGGKC

SEQ ID NO: 1355227 - protein, 9 aa, Homo Sapiens
SLHKYIMTR

SEQ ID NO: 1355228 - protein, 9 aa, Homo Sapiens
ISLSREAIA

SEQ ID NO: 1355229 - protein, 9 aa, Homo Sapiens
LVGWRWIWI

SEQ ID NO: 1355230 - protein, 9 aa, Homo Sapiens
DLGNCMHTM

SEQ ID NO: 1355231 - protein, 9 aa, Homo Sapiens
EPEPPGPVP

SEQ ID NO: 1355232 - protein, 9 aa, Homo Sapiens
MLVLGVQWA

SEQ ID NO: 1355233 - protein, 9 aa, Homo Sapiens
VAICKGPMT

SEQ ID NO: 1355234 - protein, 9 aa, Homo Sapiens
APGHALSCR

SEQ ID NO: 1355235 - protein, 9 aa, Homo Sapiens
EKDVSHAVG

SEQ ID NO: 1355236 - protein, 9 aa, Homo Sapiens
DCGHIISLK

SEQ ID NO: 1355237 - protein, 9 aa, Homo Sapiens
RECQQSHYY

SEQ ID NO: 1355238 - protein, 9 aa, Homo Sapiens
QFIKGSSNQ

SEQ ID NO: 1355239 - protein, 9 aa, Homo Sapiens
NECMTQVFT

SEQ ID NO: 1355240 - protein, 9 aa, Homo Sapiens
LQRPGMLKE

SEQ ID NO: 1355241 - protein, 9 aa, Homo Sapiens
SLIDTVQSY

SEQ ID NO: 1355242 - protein, 9 aa, Homo Sapiens
FMQVEDECR

SEQ ID NO: 1355243 - protein, 9 aa, Homo Sapiens
APEKCSLEA

SEQ ID NO: 1355244 - protein, 9 aa, Homo Sapiens
WCWPDLQSH

SEQ ID NO: 1355245 - protein, 9 aa, Homo Sapiens
DGSEEENGW

SEQ ID NO: 1355246 - protein, 9 aa, Homo Sapiens
TIDNTCILW

SEQ ID NO: 1355247 - protein, 9 aa, Homo Sapiens
WVGRFRPPE

SEQ ID NO: 1355248 - protein, 9 aa, Homo Sapiens
DGSQRPPRQ

SEQ ID NO: 1355249 - protein, 9 aa, Homo Sapiens
KTKETGKIL

SEQ ID NO: 1355250 - protein, 9 aa, Homo Sapiens
NTIVQIDLN

SEQ ID NO: 1355251 - protein, 9 aa, Homo Sapiens
FKVTMNYLQ

SEQ ID NO: 1355252 - protein, 9 aa, Homo Sapiens
IIQWFWKAV

SEQ ID NO: 1355253 - protein, 9 aa, Homo Sapiens
KHSGIGRTV

SEQ ID NO: 1355254 - protein, 9 aa, Homo Sapiens
ISLSEPVKI

SEQ ID NO: 1355255 - protein, 9 aa, Homo Sapiens
FINANRNWN

SEQ ID NO: 1355256 - protein, 9 aa, Homo Sapiens
FQQKRVCGW

SEQ ID NO: 1355257 - protein, 9 aa, Homo Sapiens
LDPAQKSHF

SEQ ID NO: 1355258 - protein, 9 aa, Homo Sapiens
CELCDFTYR

SEQ ID NO: 1355259 - protein, 9 aa, Homo Sapiens
KPVSIPSDV

SEQ ID NO: 1355260 - protein, 9 aa, Homo Sapiens
LYDPKGLMI

SEQ ID NO: 1355261 - protein, 9 aa, Homo Sapiens
SVMSNSFSP

SEQ ID NO: 1355262 - protein, 9 aa, Homo Sapiens
ETVVPNSPA

SEQ ID NO: 1355263 - protein, 9 aa, Homo Sapiens
TILNLLCKH

SEQ ID NO: 1355264 - protein, 9 aa, Homo Sapiens
FSSMSKNVR

SEQ ID NO: 1355265 - protein, 9 aa, Homo Sapiens
CTSASTPVR

SEQ ID NO: 1355266 - protein, 9 aa, Homo Sapiens
DEEESGVKV

SEQ ID NO: 1355267 - protein, 9 aa, Homo Sapiens
SGGNRRSWL

SEQ ID NO: 1355268 - protein, 9 aa, Homo Sapiens
CSVIEDEGF

SEQ ID NO: 1355269 - protein, 9 aa, Homo Sapiens
ISISLAELV

SEQ ID NO: 1355270 - protein, 9 aa, Homo Sapiens
STPATSLHP

SEQ ID NO: 1355271 - protein, 9 aa, Homo Sapiens
VRAMVFTLK

SEQ ID NO: 1355272 - protein, 9 aa, Homo Sapiens
KGVHLGERA

SEQ ID NO: 1355273 - protein, 9 aa, Homo Sapiens
SLYGGSDYA

SEQ ID NO: 1355274 - protein, 9 aa, Homo Sapiens
RREIENWTT

SEQ ID NO: 1355275 - protein, 9 aa, Homo Sapiens
SSHLKTHLR

SEQ ID NO: 1355276 - protein, 9 aa, Homo Sapiens
DTPQYNLMI

SEQ ID NO: 1355277 - protein, 9 aa, Homo Sapiens
KQLSGQCFT

SEQ ID NO: 1355278 - protein, 9 aa, Homo Sapiens
IVNCAIITN

SEQ ID NO: 1355279 - protein, 9 aa, Homo Sapiens
THQQSASTS

SEQ ID NO: 1355280 - protein, 9 aa, Homo Sapiens
RLGLVKLSR

SEQ ID NO: 1355281 - protein, 9 aa, Homo Sapiens
TMSIESPFN

SEQ ID NO: 1355282 - protein, 9 aa, Homo Sapiens
LKLRLKKLW

SEQ ID NO: 1355283 - protein, 9 aa, Homo Sapiens
IQAVADRMQ

SEQ ID NO: 1355284 - protein, 9 aa, Homo Sapiens
PQEVAEQFL

SEQ ID NO: 1355285 - protein, 9 aa, Homo Sapiens
VYIIVDEIN

SEQ ID NO: 1355286 - protein, 9 aa, Homo Sapiens
ENEDLNQFL

SEQ ID NO: 1355287 - protein, 9 aa, Homo Sapiens
CALCPLDHE

SEQ ID NO: 1355288 - protein, 9 aa, Homo Sapiens
PDKDEGTFD

SEQ ID NO: 1355289 - protein, 9 aa, Homo Sapiens
TLDDDQQME

SEQ ID NO: 1355290 - protein, 9 aa, Homo Sapiens
ATFVSHVQP

SEQ ID NO: 1355291 - protein, 9 aa, Homo Sapiens
EIICQSLAW

SEQ ID NO: 1355292 - protein, 9 aa, Homo Sapiens
DPALPVLVS

SEQ ID NO: 1355293 - protein, 9 aa, Homo Sapiens
FLKRPKCSL

SEQ ID NO: 1355294 - protein, 9 aa, Homo Sapiens
HVIYCRVWC

SEQ ID NO: 1355295 - protein, 9 aa, Homo Sapiens
LEKMRTQVR

SEQ ID NO: 1355296 - protein, 9 aa, Homo Sapiens
PILALCVIS

SEQ ID NO: 1355297 - protein, 9 aa, Homo Sapiens
QEQRKTVFN

SEQ ID NO: 1355298 - protein, 9 aa, Homo Sapiens
GCGSFAPGG

SEQ ID NO: 1355299 - protein, 9 aa, Homo Sapiens
VTTTLKLIL

SEQ ID NO: 1355300 - protein, 9 aa, Homo Sapiens
AEYFLFIAE

SEQ ID NO: 1355301 - protein, 9 aa, Homo Sapiens
VICLGNSFT

SEQ ID NO: 1355302 - protein, 9 aa, Homo Sapiens
SSFSSGSSS

SEQ ID NO: 1355303 - protein, 9 aa, Homo Sapiens
SHRNIIMWL

SEQ ID NO: 1355304 - protein, 9 aa, Homo Sapiens
NLFQFLWMV

SEQ ID NO: 1355305 - protein, 9 aa, Homo Sapiens
GHCYKSHIQ

SEQ ID NO: 1355306 - protein, 9 aa, Homo Sapiens
KTRMHLEAS

SEQ ID NO: 1355307 - protein, 9 aa, Homo Sapiens
TTENPERLI

SEQ ID NO: 1355308 - protein, 9 aa, Homo Sapiens
YECKECRMT

SEQ ID NO: 1355309 - protein, 9 aa, Homo Sapiens
ISGKLSATS

SEQ ID NO: 1355310 - protein, 9 aa, Homo Sapiens
SMKSSLENS

SEQ ID NO: 1355311 - protein, 9 aa, Homo Sapiens
VINDWRHFK

SEQ ID NO: 1355312 - protein, 9 aa, Homo Sapiens
SVWEETSQG

SEQ ID NO: 1355313 - protein, 9 aa, Homo Sapiens
NECFSNPCI

SEQ ID NO: 1355314 - protein, 9 aa, Homo Sapiens
TGVHKNKTI

SEQ ID NO: 1355315 - protein, 9 aa, Homo Sapiens
NNLMDEDIA

SEQ ID NO: 1355316 - protein, 9 aa, Homo Sapiens
YPQAGPRER

SEQ ID NO: 1355317 - protein, 9 aa, Homo Sapiens
FGLTIMVTW

SEQ ID NO: 1355318 - protein, 9 aa, Homo Sapiens
QGGCCREDV

SEQ ID NO: 1355319 - protein, 9 aa, Homo Sapiens
KKREDDEKH

SEQ ID NO: 1355320 - protein, 9 aa, Homo Sapiens
VSTWRSAYA

SEQ ID NO: 1355321 - protein, 9 aa, Homo Sapiens
HTTFEGALN

SEQ ID NO: 1355322 - protein, 9 aa, Homo Sapiens
HLPSDLHPI

SEQ ID NO: 1355323 - protein, 9 aa, Homo Sapiens
QCRCDDIER

SEQ ID NO: 1355324 - protein, 9 aa, Homo Sapiens
SVPLMSPQS

SEQ ID NO: 1355325 - protein, 9 aa, Homo Sapiens
STDHTTPLP

SEQ ID NO: 1355326 - protein, 9 aa, Homo Sapiens
HQMALLTDQ

SEQ ID NO: 1355327 - protein, 9 aa, Homo Sapiens
TPPKAKEVR

SEQ ID NO: 1355328 - protein, 9 aa, Homo Sapiens
LLSRKDISV

SEQ ID NO: 1355329 - protein, 9 aa, Homo Sapiens
MDPDKQDVL

SEQ ID NO: 1355330 - protein, 9 aa, Homo Sapiens
WAMYVDNNC

SEQ ID NO: 1355331 - protein, 9 aa, Homo Sapiens
MYRCYRSPW

SEQ ID NO: 1355332 - protein, 9 aa, Homo Sapiens
ALLWVLLYV

SEQ ID NO: 1355333 - protein, 9 aa, Homo Sapiens
NVEDIEQLY

SEQ ID NO: 1355334 - protein, 9 aa, Homo Sapiens
GPDSTGPNI

SEQ ID NO: 1355335 - protein, 9 aa, Homo Sapiens
NCAIITNGI

SEQ ID NO: 1355336 - protein, 9 aa, Homo Sapiens
DELKCSAMR

SEQ ID NO: 1355337 - protein, 9 aa, Homo Sapiens
ILCSVSNSE

SEQ ID NO: 1355338 - protein, 9 aa, Homo Sapiens
KAGEYIRVK

SEQ ID NO: 1355339 - protein, 9 aa, Homo Sapiens
EVPSPMPTH

SEQ ID NO: 1355340 - protein, 9 aa, Homo Sapiens
LQKCIRYVV

SEQ ID NO: 1355341 - protein, 9 aa, Homo Sapiens
WDGPGDPMW

SEQ ID NO: 1355342 - protein, 9 aa, Homo Sapiens
GPCPLEIEH

SEQ ID NO: 1355343 - protein, 9 aa, Homo Sapiens
VDQWLKIPG

SEQ ID NO: 1355344 - protein, 9 aa, Homo Sapiens
LWEPSLPRR

SEQ ID NO: 1355345 - protein, 9 aa, Homo Sapiens
AYLDELHLA

SEQ ID NO: 1355346 - protein, 9 aa, Homo Sapiens
GQKKIRKTS

SEQ ID NO: 1355347 - protein, 9 aa, Homo Sapiens
KYYLDNGAK

SEQ ID NO: 1355348 - protein, 9 aa, Homo Sapiens
LNSLLLFGQ

SEQ ID NO: 1355349 - protein, 9 aa, Homo Sapiens
TRQESKKFR

SEQ ID NO: 1355350 - protein, 9 aa, Homo Sapiens
ISDALEQLS

SEQ ID NO: 1355351 - protein, 9 aa, Homo Sapiens
ERELEAFNI

SEQ ID NO: 1355352 - protein, 9 aa, Homo Sapiens
PVLDVRCAS

SEQ ID NO: 1355353 - protein, 9 aa, Homo Sapiens
ITFVPHWTP

SEQ ID NO: 1355354 - protein, 9 aa, Homo Sapiens
SLDIDEEED

SEQ ID NO: 1355355 - protein, 9 aa, Homo Sapiens
AMATVAGAM

SEQ ID NO: 1355356 - protein, 9 aa, Homo Sapiens
ALPAYVISN

SEQ ID NO: 1355357 - protein, 9 aa, Homo Sapiens
SMTFITVLK

SEQ ID NO: 1355358 - protein, 9 aa, Homo Sapiens
NTKYIFKIT

SEQ ID NO: 1355359 - protein, 9 aa, Homo Sapiens
QERHSQNSS

SEQ ID NO: 1355360 - protein, 9 aa, Homo Sapiens
AFNRNSYMI

SEQ ID NO: 1355361 - protein, 9 aa, Homo Sapiens
ECPIAFTAR

SEQ ID NO: 1355362 - protein, 9 aa, Homo Sapiens
VLMRCLREW

SEQ ID NO: 1355363 - protein, 9 aa, Homo Sapiens
TLVNPFNNI

SEQ ID NO: 1355364 - protein, 9 aa, Homo Sapiens
SLPFDDQNL

SEQ ID NO: 1355365 - protein, 9 aa, Homo Sapiens
GASCFSGMT

SEQ ID NO: 1355366 - protein, 9 aa, Homo Sapiens
LGHRTQLRK

SEQ ID NO: 1355367 - protein, 9 aa, Homo Sapiens
GPELDSGTS

SEQ ID NO: 1355368 - protein, 9 aa, Homo Sapiens
GLKSSCIVL

SEQ ID NO: 1355369 - protein, 9 aa, Homo Sapiens
CQAIKELPQ

SEQ ID NO: 1355370 - protein, 9 aa, Homo Sapiens
THQEYVYPE

SEQ ID NO: 1355371 - protein, 9 aa, Homo Sapiens
RPGPHQLIA

SEQ ID NO: 1355372 - protein, 9 aa, Homo Sapiens
KLVSHSGRE

SEQ ID NO: 1355373 - protein, 9 aa, Homo Sapiens
SQVADTGFG

SEQ ID NO: 1355374 - protein, 9 aa, Homo Sapiens
KGNELQHCI

SEQ ID NO: 1355375 - protein, 9 aa, Homo Sapiens
GHKIYLRPA

SEQ ID NO: 1355376 - protein, 9 aa, Homo Sapiens
IVFFFIFIF

SEQ ID NO: 1355377 - protein, 9 aa, Homo Sapiens
ADMMDVDMY

SEQ ID NO: 1355378 - protein, 9 aa, Homo Sapiens
SPEMIEGRM

SEQ ID NO: 1355379 - protein, 9 aa, Homo Sapiens
GMDSYFEYL

SEQ ID NO: 1355380 - protein, 9 aa, Homo Sapiens
PNAGSQLPF

SEQ ID NO: 1355381 - protein, 9 aa, Homo Sapiens
DIQKQIHKT

SEQ ID NO: 1355382 - protein, 9 aa, Homo Sapiens
FGRPTSFTS

SEQ ID NO: 1355383 - protein, 9 aa, Homo Sapiens
HKHDLLLTR

SEQ ID NO: 1355384 - protein, 9 aa, Homo Sapiens
PCMSVAWNL

SEQ ID NO: 1355385 - protein, 9 aa, Homo Sapiens
GFVPLDTPH

SEQ ID NO: 1355386 - protein, 9 aa, Homo Sapiens
VVRSAEEVA

SEQ ID NO: 1355387 - protein, 9 aa, Homo Sapiens
FALEYHTTR

SEQ ID NO: 1355388 - protein, 9 aa, Homo Sapiens
SPAPKGKGR

SEQ ID NO: 1355389 - protein, 9 aa, Homo Sapiens
PGNWSPHPP

SEQ ID NO: 1355390 - protein, 9 aa, Homo Sapiens
TYHTPAASQ

SEQ ID NO: 1355391 - protein, 9 aa, Homo Sapiens
SLVSGSRFF

SEQ ID NO: 1355392 - protein, 9 aa, Homo Sapiens
AKQRGLTPA

SEQ ID NO: 1355393 - protein, 9 aa, Homo Sapiens
GQTQEYMLK

SEQ ID NO: 1355394 - protein, 9 aa, Homo Sapiens
IIICFIFIS

SEQ ID NO: 1355395 - protein, 9 aa, Homo Sapiens
TWRSAYAFS

SEQ ID NO: 1355396 - protein, 9 aa, Homo Sapiens
SDNLRPVDI

SEQ ID NO: 1355397 - protein, 9 aa, Homo Sapiens
FHQEHEVCM

SEQ ID NO: 1355398 - protein, 9 aa, Homo Sapiens
LYFRLHLRY

SEQ ID NO: 1355399 - protein, 9 aa, Homo Sapiens
TRGGDHHVE

SEQ ID NO: 1355400 - protein, 9 aa, Homo Sapiens
DQLHLERLQ

SEQ ID NO: 1355401 - protein, 9 aa, Homo Sapiens
RILSRDATP

SEQ ID NO: 1355402 - protein, 9 aa, Homo Sapiens
LTMLLQETT

SEQ ID NO: 1355403 - protein, 9 aa, Homo Sapiens
ARGKSVRLR

SEQ ID NO: 1355404 - protein, 9 aa, Homo Sapiens
LAETLKEVS

SEQ ID NO: 1355405 - protein, 9 aa, Homo Sapiens
YGLPEDAII

SEQ ID NO: 1355406 - protein, 9 aa, Homo Sapiens
VVVYVYVKE

SEQ ID NO: 1355407 - protein, 9 aa, Homo Sapiens
SGSRSHSLL

SEQ ID NO: 1355408 - protein, 9 aa, Homo Sapiens
PPTPPAQDG

SEQ ID NO: 1355409 - protein, 9 aa, Homo Sapiens
HSCDVVTEA

SEQ ID NO: 1355410 - protein, 9 aa, Homo Sapiens
REGWRWGWG

SEQ ID NO: 1355411 - protein, 9 aa, Homo Sapiens
HLNAQQVSQ

SEQ ID NO: 1355412 - protein, 9 aa, Homo Sapiens
EQQFHYHLC

SEQ ID NO: 1355413 - protein, 9 aa, Homo Sapiens
VSESPELSQ

SEQ ID NO: 1355414 - protein, 9 aa, Homo Sapiens
EENLKMMWR

SEQ ID NO: 1355415 - protein, 9 aa, Homo Sapiens
DTVEVLAID

SEQ ID NO: 1355416 - protein, 9 aa, Homo Sapiens
AHVDLRNTS

SEQ ID NO: 1355417 - protein, 9 aa, Homo Sapiens
LEDLKHQVQ

SEQ ID NO: 1355418 - protein, 9 aa, Homo Sapiens
YLRLSFNRP

SEQ ID NO: 1355419 - protein, 9 aa, Homo Sapiens
AHVREQLSK

SEQ ID NO: 1355420 - protein, 9 aa, Homo Sapiens
QSIKVPVNT

SEQ ID NO: 1355421 - protein, 9 aa, Homo Sapiens
ISSNPVTKI

SEQ ID NO: 1355422 - protein, 9 aa, Homo Sapiens
DWTANPHIG

SEQ ID NO: 1355423 - protein, 9 aa, Homo Sapiens
RFASTSIKI

SEQ ID NO: 1355424 - protein, 9 aa, Homo Sapiens
KDRYEEAVG

SEQ ID NO: 1355425 - protein, 9 aa, Homo Sapiens
KPASLSGGG

SEQ ID NO: 1355426 - protein, 9 aa, Homo Sapiens
LRHKCVHNF

SEQ ID NO: 1355427 - protein, 9 aa, Homo Sapiens
HLDTYIPLQ

SEQ ID NO: 1355428 - protein, 9 aa, Homo Sapiens
RIQSKHHPL

SEQ ID NO: 1355429 - protein, 9 aa, Homo Sapiens
WVGALTMGM

SEQ ID NO: 1355430 - protein, 9 aa, Homo Sapiens
ETCHPQDGS

SEQ ID NO: 1355431 - protein, 9 aa, Homo Sapiens
GTPVKLPCL

SEQ ID NO: 1355432 - protein, 9 aa, Homo Sapiens
KKFCLENMA

SEQ ID NO: 1355433 - protein, 9 aa, Homo Sapiens
QQASVTTGK

SEQ ID NO: 1355434 - protein, 9 aa, Homo Sapiens
YRVTQITCG

SEQ ID NO: 1355435 - protein, 9 aa, Homo Sapiens
FIFHPVSVL

SEQ ID NO: 1355436 - protein, 9 aa, Homo Sapiens
NDVESAKMH

SEQ ID NO: 1355437 - protein, 9 aa, Homo Sapiens
GFHSLPCSG

SEQ ID NO: 1355438 - protein, 9 aa, Homo Sapiens
GWEEASQVG

SEQ ID NO: 1355439 - protein, 9 aa, Homo Sapiens
GQERQEVFV

SEQ ID NO: 1355440 - protein, 9 aa, Homo Sapiens
PAYSGEKKM

SEQ ID NO: 1355441 - protein, 9 aa, Homo Sapiens
LGAFYGPAV

SEQ ID NO: 1355442 - protein, 9 aa, Homo Sapiens
CWQTSNDCG

SEQ ID NO: 1355443 - protein, 9 aa, Homo Sapiens
GFKDTNQYV

SEQ ID NO: 1355444 - protein, 9 aa, Homo Sapiens
GCMDSIKEN

SEQ ID NO: 1355445 - protein, 9 aa, Homo Sapiens
MVWSEAMTH

SEQ ID NO: 1355446 - protein, 9 aa, Homo Sapiens
MEFPDTSFQ

SEQ ID NO: 1355447 - protein, 9 aa, Homo Sapiens
RRGVAEGTG

SEQ ID NO: 1355448 - protein, 9 aa, Homo Sapiens
PDVIAQLEL

SEQ ID NO: 1355449 - protein, 9 aa, Homo Sapiens
LPFTSTLPL

SEQ ID NO: 1355450 - protein, 9 aa, Homo Sapiens
WGLSKGFGL

SEQ ID NO: 1355451 - protein, 9 aa, Homo Sapiens
PHLTGQLFL

SEQ ID NO: 1355452 - protein, 9 aa, Homo Sapiens
LLCWGGGHP

SEQ ID NO: 1355453 - protein, 9 aa, Homo Sapiens
TDPDDLPGL

SEQ ID NO: 1355454 - protein, 9 aa, Homo Sapiens
EAITWEMAF

SEQ ID NO: 1355455 - protein, 9 aa, Homo Sapiens
QFYEMIAEK

SEQ ID NO: 1355456 - protein, 9 aa, Homo Sapiens
EPDCLESVN

SEQ ID NO: 1355457 - protein, 9 aa, Homo Sapiens
QEKKVHPPQ

SEQ ID NO: 1355458 - protein, 9 aa, Homo Sapiens
DMLKYIKMT

SEQ ID NO: 1355459 - protein, 9 aa, Homo Sapiens
GKLLENLLH

SEQ ID NO: 1355460 - protein, 9 aa, Homo Sapiens
LLACSQCSE

SEQ ID NO: 1355461 - protein, 9 aa, Homo Sapiens
VGQIFYCRL

SEQ ID NO: 1355462 - protein, 9 aa, Homo Sapiens
STPSKGSTP

SEQ ID NO: 1355463 - protein, 9 aa, Homo Sapiens
EVTSLPGSE

SEQ ID NO: 1355464 - protein, 9 aa, Homo Sapiens
LDLAKGFPL

SEQ ID NO: 1355465 - protein, 9 aa, Homo Sapiens
LFTYVGKAL

SEQ ID NO: 1355466 - protein, 9 aa, Homo Sapiens
CFGGRSPKS

SEQ ID NO: 1355467 - protein, 9 aa, Homo Sapiens
MDRRAKSKA

SEQ ID NO: 1355468 - protein, 9 aa, Homo Sapiens
LLLAFPHGY

SEQ ID NO: 1355469 - protein, 9 aa, Homo Sapiens
WQEFEVAEK

SEQ ID NO: 1355470 - protein, 9 aa, Homo Sapiens
PMGIIPFSP

SEQ ID NO: 1355471 - protein, 9 aa, Homo Sapiens
VVLAGDTMG

SEQ ID NO: 1355472 - protein, 9 aa, Homo Sapiens
TKATRAYIQ

SEQ ID NO: 1355473 - protein, 9 aa, Homo Sapiens
GHLPSDVID

SEQ ID NO: 1355474 - protein, 9 aa, Homo Sapiens
SKAWEVDVE

SEQ ID NO: 1355475 - protein, 9 aa, Homo Sapiens
SASPLASKS

SEQ ID NO: 1355476 - protein, 9 aa, Homo Sapiens
AALDKYANK

SEQ ID NO: 1355477 - protein, 9 aa, Homo Sapiens
RCDQACVII

SEQ ID NO: 1355478 - protein, 9 aa, Homo Sapiens
GRRESTQTY

SEQ ID NO: 1355479 - protein, 9 aa, Homo Sapiens
YALKYVKIP

SEQ ID NO: 1355480 - protein, 9 aa, Homo Sapiens
EDLPGHVKD

SEQ ID NO: 1355481 - protein, 9 aa, Homo Sapiens
MYICLLVMG

SEQ ID NO: 1355482 - protein, 9 aa, Homo Sapiens
IMAGSNRSW

SEQ ID NO: 1355483 - protein, 9 aa, Homo Sapiens
FVTYEDQRD

SEQ ID NO: 1355484 - protein, 9 aa, Homo Sapiens
AEIENEDEV

SEQ ID NO: 1355485 - protein, 9 aa, Homo Sapiens
DKLARKCEQ

SEQ ID NO: 1355486 - protein, 9 aa, Homo Sapiens
VVVDYRLPT

SEQ ID NO: 1355487 - protein, 9 aa, Homo Sapiens
SCLSVQGLA

SEQ ID NO: 1355488 - protein, 9 aa, Homo Sapiens
KLPTHTHHA

SEQ ID NO: 1355489 - protein, 9 aa, Homo Sapiens
EYKEWNPEL

SEQ ID NO: 1355490 - protein, 9 aa, Homo Sapiens
CQDFKKTKS

SEQ ID NO: 1355491 - protein, 9 aa, Homo Sapiens
GKALEVNKG

SEQ ID NO: 1355492 - protein, 9 aa, Homo Sapiens
EFEVAEKEI

SEQ ID NO: 1355493 - protein, 9 aa, Homo Sapiens
FTIVGFIWL

SEQ ID NO: 1355494 - protein, 9 aa, Homo Sapiens
EWKQLVINV

SEQ ID NO: 1355495 - protein, 9 aa, Homo Sapiens
QNLKVFRHP

SEQ ID NO: 1355496 - protein, 9 aa, Homo Sapiens
EVHESLLQI

SEQ ID NO: 1355497 - protein, 9 aa, Homo Sapiens
VELTHLGSL

SEQ ID NO: 1355498 - protein, 9 aa, Homo Sapiens
VAVVGVFYG

SEQ ID NO: 1355499 - protein, 9 aa, Homo Sapiens
VVDPDSAAG

SEQ ID NO: 1355500 - protein, 9 aa, Homo Sapiens
TPPNFVLAI

SEQ ID NO: 1355501 - protein, 9 aa, Homo Sapiens
WNFKKFLIG

SEQ ID NO: 1355502 - protein, 9 aa, Homo Sapiens
PLGRYFSHA

SEQ ID NO: 1355503 - protein, 9 aa, Homo Sapiens
ITKLNTDLE

SEQ ID NO: 1355504 - protein, 9 aa, Homo Sapiens
CGDITAILK

SEQ ID NO: 1355505 - protein, 9 aa, Homo Sapiens
NGEIYNHKN

SEQ ID NO: 1355506 - protein, 9 aa, Homo Sapiens
QVALQSLDS

SEQ ID NO: 1355507 - protein, 9 aa, Homo Sapiens
LDEDAQAME

SEQ ID NO: 1355508 - protein, 9 aa, Homo Sapiens
LESKHNVTK

SEQ ID NO: 1355509 - protein, 9 aa, Homo Sapiens
AAEKVKADV

SEQ ID NO: 1355510 - protein, 9 aa, Homo Sapiens
QKVEVQYET

SEQ ID NO: 1355511 - protein, 9 aa, Homo Sapiens
KLPNPPTES

SEQ ID NO: 1355512 - protein, 9 aa, Homo Sapiens
LAVRRPGYH

SEQ ID NO: 1355513 - protein, 9 aa, Homo Sapiens
SRRAEENIK

SEQ ID NO: 1355514 - protein, 9 aa, Homo Sapiens
PTSTPSKGS

SEQ ID NO: 1355515 - protein, 9 aa, Homo Sapiens
AKVENALQE

SEQ ID NO: 1355516 - protein, 9 aa, Homo Sapiens
LGLEPLELA

SEQ ID NO: 1355517 - protein, 9 aa, Homo Sapiens
YPENNYAKE

SEQ ID NO: 1355518 - protein, 9 aa, Homo Sapiens
NAFSGEYIP

SEQ ID NO: 1355519 - protein, 9 aa, Homo Sapiens
IAVSSQLYP

SEQ ID NO: 1355520 - protein, 9 aa, Homo Sapiens
PEYVWTFNW

SEQ ID NO: 1355521 - protein, 9 aa, Homo Sapiens
DYALGQTGL

SEQ ID NO: 1355522 - protein, 9 aa, Homo Sapiens
HRSTRTEEK

SEQ ID NO: 1355523 - protein, 9 aa, Homo Sapiens
GLGSPRVFR

SEQ ID NO: 1355524 - protein, 9 aa, Homo Sapiens
LSGYIKRPQ

SEQ ID NO: 1355525 - protein, 9 aa, Homo Sapiens
ALFKNPTLQ

SEQ ID NO: 1355526 - protein, 9 aa, Homo Sapiens
VFSRVYELR

SEQ ID NO: 1355527 - protein, 9 aa, Homo Sapiens
AKMPQTRVT

SEQ ID NO: 1355528 - protein, 9 aa, Homo Sapiens
PDSVSNTPD

SEQ ID NO: 1355529 - protein, 9 aa, Homo Sapiens
LTITVVQRQ

SEQ ID NO: 1355530 - protein, 9 aa, Homo Sapiens
GSLTFSDVA

SEQ ID NO: 1355531 - protein, 9 aa, Homo Sapiens
SRELLRPSL

SEQ ID NO: 1355532 - protein, 9 aa, Homo Sapiens
LQIQKKIFS

SEQ ID NO: 1355533 - protein, 9 aa, Homo Sapiens
LLPDSFYYS

SEQ ID NO: 1355534 - protein, 9 aa, Homo Sapiens
PGEHASCWN

SEQ ID NO: 1355535 - protein, 9 aa, Homo Sapiens
KTANELASD

SEQ ID NO: 1355536 - protein, 9 aa, Homo Sapiens
PKTLLGSNT

SEQ ID NO: 1355537 - protein, 9 aa, Homo Sapiens
KTIQIEIKK

SEQ ID NO: 1355538 - protein, 9 aa, Homo Sapiens
NKSVKVIVV

SEQ ID NO: 1355539 - protein, 9 aa, Homo Sapiens
PKQEGLAAA

SEQ ID NO: 1355540 - protein, 9 aa, Homo Sapiens
LNHIIYTLR

SEQ ID NO: 1355541 - protein, 9 aa, Homo Sapiens
LEMKLADFL

SEQ ID NO: 1355542 - protein, 9 aa, Homo Sapiens
GTSAEQLDA

SEQ ID NO: 1355543 - protein, 9 aa, Homo Sapiens
QDNQSLAED

SEQ ID NO: 1355544 - protein, 9 aa, Homo Sapiens
RLKGANKVA

SEQ ID NO: 1355545 - protein, 9 aa, Homo Sapiens
FQLPENLTE

SEQ ID NO: 1355546 - protein, 9 aa, Homo Sapiens
IINWEDHLR

SEQ ID NO: 1355547 - protein, 9 aa, Homo Sapiens
ECCKAFNQS

SEQ ID NO: 1355548 - protein, 9 aa, Homo Sapiens
HPNIKMVME

SEQ ID NO: 1355549 - protein, 9 aa, Homo Sapiens
AFRLRSAKF

SEQ ID NO: 1355550 - protein, 9 aa, Homo Sapiens
TECEKRFCK

SEQ ID NO: 1355551 - protein, 9 aa, Homo Sapiens
GYIKRPQLI

SEQ ID NO: 1355552 - protein, 9 aa, Homo Sapiens
IQDFENSST

SEQ ID NO: 1355553 - protein, 9 aa, Homo Sapiens
DSDSNSSEE

SEQ ID NO: 1355554 - protein, 9 aa, Homo Sapiens
PTMVLDDFA

SEQ ID NO: 1355555 - protein, 9 aa, Homo Sapiens
PNPPTESAP

SEQ ID NO: 1355556 - protein, 9 aa, Homo Sapiens
FVLDGTSSK

SEQ ID NO: 1355557 - protein, 9 aa, Homo Sapiens
LMKGVFTFV

SEQ ID NO: 1355558 - protein, 9 aa, Homo Sapiens
CAADVLKTF

SEQ ID NO: 1355559 - protein, 9 aa, Homo Sapiens
RGWALSSWQ

SEQ ID NO: 1355560 - protein, 9 aa, Homo Sapiens
PVHFIQHCK

SEQ ID NO: 1355561 - protein, 9 aa, Homo Sapiens
TQLVLTGKM

SEQ ID NO: 1355562 - protein, 9 aa, Homo Sapiens
WRWNLPGDR

SEQ ID NO: 1355563 - protein, 9 aa, Homo Sapiens
KGRANGTPV

SEQ ID NO: 1355564 - protein, 9 aa, Homo Sapiens
TFTKDFHHI

SEQ ID NO: 1355565 - protein, 9 aa, Homo Sapiens
RSHHCRCQS

SEQ ID NO: 1355566 - protein, 9 aa, Homo Sapiens
LVMGALCLY

SEQ ID NO: 1355567 - protein, 9 aa, Homo Sapiens
GTNDLREFV

SEQ ID NO: 1355568 - protein, 9 aa, Homo Sapiens
QGLDYLGSV

SEQ ID NO: 1355569 - protein, 9 aa, Homo Sapiens
CLLVMGALC

SEQ ID NO: 1355570 - protein, 9 aa, Homo Sapiens
HMELLGVCS

SEQ ID NO: 1355571 - protein, 9 aa, Homo Sapiens
HLGSLVHQD

SEQ ID NO: 1355572 - protein, 9 aa, Homo Sapiens
DKGRANGTP

SEQ ID NO: 1355573 - protein, 9 aa, Homo Sapiens
YSFVLFNSH

SEQ ID NO: 1355574 - protein, 9 aa, Homo Sapiens
DDGDATRSK

SEQ ID NO: 1355575 - protein, 9 aa, Homo Sapiens
LTLEDKDMN

SEQ ID NO: 1355576 - protein, 9 aa, Homo Sapiens
ALKYVKIPV

SEQ ID NO: 1355577 - protein, 9 aa, Homo Sapiens
ENEDEVERV

SEQ ID NO: 1355578 - protein, 9 aa, Homo Sapiens
SLIVFPRRI

SEQ ID NO: 1355579 - protein, 9 aa, Homo Sapiens
FTEKSMGAS

SEQ ID NO: 1355580 - protein, 9 aa, Homo Sapiens
VDSAQQLPK

SEQ ID NO: 1355581 - protein, 9 aa, Homo Sapiens
VACIAANVC

SEQ ID NO: 1355582 - protein, 9 aa, Homo Sapiens
LRLKGANKV

SEQ ID NO: 1355583 - protein, 9 aa, Homo Sapiens
RRQRDLAAE

SEQ ID NO: 1355584 - protein, 9 aa, Homo Sapiens
NSGHKITPV

SEQ ID NO: 1355585 - protein, 9 aa, Homo Sapiens
ELKLLCAAD

SEQ ID NO: 1355586 - protein, 9 aa, Homo Sapiens
AGDTMGPER

SEQ ID NO: 1355587 - protein, 9 aa, Homo Sapiens
DPEMVENQI

SEQ ID NO: 1355588 - protein, 9 aa, Homo Sapiens
HFPNPNKLH

SEQ ID NO: 1355589 - protein, 9 aa, Homo Sapiens
TVSVGEASS

SEQ ID NO: 1355590 - protein, 9 aa, Homo Sapiens
RSVSEEVES

SEQ ID NO: 1355591 - protein, 9 aa, Homo Sapiens
WIHTQLVLT

SEQ ID NO: 1355592 - protein, 9 aa, Homo Sapiens
ISHPKQEGL

SEQ ID NO: 1355593 - protein, 9 aa, Homo Sapiens
KCPFEPAER

SEQ ID NO: 1355594 - protein, 9 aa, Homo Sapiens
SHSTQSKAG

SEQ ID NO: 1355595 - protein, 9 aa, Homo Sapiens
SHLSVPRDW

SEQ ID NO: 1355596 - protein, 9 aa, Homo Sapiens
EKDYSQKDT

SEQ ID NO: 1355597 - protein, 9 aa, Homo Sapiens
FGSFCQGGS

SEQ ID NO: 1355598 - protein, 9 aa, Homo Sapiens
GNALFGQGS

SEQ ID NO: 1355599 - protein, 9 aa, Homo Sapiens
VNMSNHYRG

SEQ ID NO: 1355600 - protein, 9 aa, Homo Sapiens
HRQLAVFKR

SEQ ID NO: 1355601 - protein, 9 aa, Homo Sapiens
YQDVHKDIH

SEQ ID NO: 1355602 - protein, 9 aa, Homo Sapiens
KAPAISSAI

SEQ ID NO: 1355603 - protein, 9 aa, Homo Sapiens
ESKHNVTKL

SEQ ID NO: 1355604 - protein, 9 aa, Homo Sapiens
PEAAKGLCW

SEQ ID NO: 1355605 - protein, 9 aa, Homo Sapiens
WQYGECVEV

SEQ ID NO: 1355606 - protein, 9 aa, Homo Sapiens
KCKFYTQDV

SEQ ID NO: 1355607 - protein, 9 aa, Homo Sapiens
PLQGERPRQ

SEQ ID NO: 1355608 - protein, 9 aa, Homo Sapiens
DTLCEGAFG

SEQ ID NO: 1355609 - protein, 9 aa, Homo Sapiens
YNEEFNIKL

SEQ ID NO: 1355610 - protein, 9 aa, Homo Sapiens
KAPDPGHQD

SEQ ID NO: 1355611 - protein, 9 aa, Homo Sapiens
GYHIDLFMV

SEQ ID NO: 1355612 - protein, 9 aa, Homo Sapiens
LLQRFCWQL

SEQ ID NO: 1355613 - protein, 9 aa, Homo Sapiens
GHSVDVMSL

SEQ ID NO: 1355614 - protein, 9 aa, Homo Sapiens
TAVQMEIAQ

SEQ ID NO: 1355615 - protein, 9 aa, Homo Sapiens
WVLEMDAAS

SEQ ID NO: 1355616 - protein, 9 aa, Homo Sapiens
MKVNPVSWI

SEQ ID NO: 1355617 - protein, 9 aa, Homo Sapiens
EIGRCISTL

SEQ ID NO: 1355618 - protein, 9 aa, Homo Sapiens
VSDAANVIV

SEQ ID NO: 1355619 - protein, 9 aa, Homo Sapiens
HAVLCVRIN

SEQ ID NO: 1355620 - protein, 9 aa, Homo Sapiens
GSPASIRTA

SEQ ID NO: 1355621 - protein, 9 aa, Homo Sapiens
SIHMELLGV

SEQ ID NO: 1355622 - protein, 9 aa, Homo Sapiens
SHLFGVTIF

SEQ ID NO: 1355623 - protein, 9 aa, Homo Sapiens
ARPEYKEWN

SEQ ID NO: 1355624 - protein, 9 aa, Homo Sapiens
AKTIQIEIK

SEQ ID NO: 1355625 - protein, 9 aa, Homo Sapiens
LCRVRRTNS

SEQ ID NO: 1355626 - protein, 9 aa, Homo Sapiens
HESTQDKLA

SEQ ID NO: 1355627 - protein, 9 aa, Homo Sapiens
GGAWEQVYL

SEQ ID NO: 1355628 - protein, 9 aa, Homo Sapiens
TDIVCSDLN

SEQ ID NO: 1355629 - protein, 9 aa, Homo Sapiens
LGPCGSVKA

SEQ ID NO: 1355630 - protein, 9 aa, Homo Sapiens
KLEKKELER

SEQ ID NO: 1355631 - protein, 9 aa, Homo Sapiens
TVERPYECN

SEQ ID NO: 1355632 - protein, 9 aa, Homo Sapiens
RGHDDKIHS

SEQ ID NO: 1355633 - protein, 9 aa, Homo Sapiens
GEKLAAPWR

SEQ ID NO: 1355634 - protein, 9 aa, Homo Sapiens
QIALVESLE

SEQ ID NO: 1355635 - protein, 9 aa, Homo Sapiens
EDEVERVLF

SEQ ID NO: 1355636 - protein, 9 aa, Homo Sapiens
SAEQLDATF

SEQ ID NO: 1355637 - protein, 9 aa, Homo Sapiens
RSDVAWNFK

SEQ ID NO: 1355638 - protein, 9 aa, Homo Sapiens
HQMRNHSKP

SEQ ID NO: 1355639 - protein, 9 aa, Homo Sapiens
RDVMWKNYS

SEQ ID NO: 1355640 - protein, 9 aa, Homo Sapiens
TRQIEDLKG

SEQ ID NO: 1355641 - protein, 9 aa, Homo Sapiens
ALHNITPGM

SEQ ID NO: 1355642 - protein, 9 aa, Homo Sapiens
KRINSNPGS

SEQ ID NO: 1355643 - protein, 9 aa, Homo Sapiens
TFSDVAIEF

SEQ ID NO: 1355644 - protein, 9 aa, Homo Sapiens
QDVHAATVL

SEQ ID NO: 1355645 - protein, 9 aa, Homo Sapiens
VIEYVNPAF

SEQ ID NO: 1355646 - protein, 9 aa, Homo Sapiens
VFPRRISVQ

SEQ ID NO: 1355647 - protein, 9 aa, Homo Sapiens
VSSKRSNEE

SEQ ID NO: 1355648 - protein, 9 aa, Homo Sapiens
LMNILKPIA

SEQ ID NO: 1355649 - protein, 9 aa, Homo Sapiens
GQVYFLHTH

SEQ ID NO: 1355650 - protein, 9 aa, Homo Sapiens
HIQVVSKNM

SEQ ID NO: 1355651 - protein, 9 aa, Homo Sapiens
SSHGGSSFS

SEQ ID NO: 1355652 - protein, 9 aa, Homo Sapiens
ANNIPLSDG

SEQ ID NO: 1355653 - protein, 9 aa, Homo Sapiens
QVLSAIFEG

SEQ ID NO: 1355654 - protein, 9 aa, Homo Sapiens
ERNFTFRSS

SEQ ID NO: 1355655 - protein, 9 aa, Homo Sapiens
LRAIRYKIS

SEQ ID NO: 1355656 - protein, 9 aa, Homo Sapiens
FWQYGECVE

SEQ ID NO: 1355657 - protein, 9 aa, Homo Sapiens
QPGLFSASS

SEQ ID NO: 1355658 - protein, 9 aa, Homo Sapiens
SHRDGCSTE

SEQ ID NO: 1355659 - protein, 9 aa, Homo Sapiens
LAAPWRIVW

SEQ ID NO: 1355660 - protein, 9 aa, Homo Sapiens
RNAEEKANK

SEQ ID NO: 1355661 - protein, 9 aa, Homo Sapiens
CGAECFLLA

SEQ ID NO: 1355662 - protein, 9 aa, Homo Sapiens
FTVAGKHFT

SEQ ID NO: 1355663 - protein, 9 aa, Homo Sapiens
AQDLAMKDK

SEQ ID NO: 1355664 - protein, 9 aa, Homo Sapiens
LRSQEPQRK

SEQ ID NO: 1355665 - protein, 9 aa, Homo Sapiens
IKRPQLIRA

SEQ ID NO: 1355666 - protein, 9 aa, Homo Sapiens
DSAAGEIEY

SEQ ID NO: 1355667 - protein, 9 aa, Homo Sapiens
PDSFYYSVL

SEQ ID NO: 1355668 - protein, 9 aa, Homo Sapiens
ACSQCSECY

SEQ ID NO: 1355669 - protein, 9 aa, Homo Sapiens
FILISELNV

SEQ ID NO: 1355670 - protein, 9 aa, Homo Sapiens
EERHNAYLK

SEQ ID NO: 1355671 - protein, 9 aa, Homo Sapiens
FSVLCKIKE

SEQ ID NO: 1355672 - protein, 9 aa, Homo Sapiens
LHQLKNSCT

SEQ ID NO: 1355673 - protein, 9 aa, Homo Sapiens
YKKLWWADQ

SEQ ID NO: 1355674 - protein, 9 aa, Homo Sapiens
HNAYLKPFR

SEQ ID NO: 1355675 - protein, 9 aa, Homo Sapiens
DPNDPLGPI

SEQ ID NO: 1355676 - protein, 9 aa, Homo Sapiens
EPTWESSGL

SEQ ID NO: 1355677 - protein, 9 aa, Homo Sapiens
TDDQIAKYD

SEQ ID NO: 1355678 - protein, 9 aa, Homo Sapiens
LMQSAVLSD

SEQ ID NO: 1355679 - protein, 9 aa, Homo Sapiens
HFLYLCLCG

SEQ ID NO: 1355680 - protein, 9 aa, Homo Sapiens
EYDKLAEKR

SEQ ID NO: 1355681 - protein, 9 aa, Homo Sapiens
QEMGRLNKL

SEQ ID NO: 1355682 - protein, 9 aa, Homo Sapiens
LFDALTSLV

SEQ ID NO: 1355683 - protein, 9 aa, Homo Sapiens
KRLLQLLRA

SEQ ID NO: 1355684 - protein, 9 aa, Homo Sapiens
YELVNRAIA

SEQ ID NO: 1355685 - protein, 9 aa, Homo Sapiens
EAVKLVGGK

SEQ ID NO: 1355686 - protein, 9 aa, Homo Sapiens
SATYVATKK

SEQ ID NO: 1355687 - protein, 9 aa, Homo Sapiens
QKLTYSIWD

SEQ ID NO: 1355688 - protein, 9 aa, Homo Sapiens
CPIINWEDH

SEQ ID NO: 1355689 - protein, 9 aa, Homo Sapiens
LNLSLDSSY

SEQ ID NO: 1355690 - protein, 9 aa, Homo Sapiens
CEDGVLTLL

SEQ ID NO: 1355691 - protein, 9 aa, Homo Sapiens
KGEGSVLQA

SEQ ID NO: 1355692 - protein, 9 aa, Homo Sapiens
KNAMLATVE

SEQ ID NO: 1355693 - protein, 9 aa, Homo Sapiens
RAAYGTALS

SEQ ID NO: 1355694 - protein, 9 aa, Homo Sapiens
FEDAAPEEN

SEQ ID NO: 1355695 - protein, 9 aa, Homo Sapiens
TCARAGATA

SEQ ID NO: 1355696 - protein, 9 aa, Homo Sapiens
IHPQPTSLE

SEQ ID NO: 1355697 - protein, 9 aa, Homo Sapiens
QQLTQYSQV

SEQ ID NO: 1355698 - protein, 9 aa, Homo Sapiens
IIHLRVHTV

SEQ ID NO: 1355699 - protein, 9 aa, Homo Sapiens
QAYNETFSN

SEQ ID NO: 1355700 - protein, 9 aa, Homo Sapiens
IYSSDSDDG

SEQ ID NO: 1355701 - protein, 9 aa, Homo Sapiens
ASDVFLRRL

SEQ ID NO: 1355702 - protein, 9 aa, Homo Sapiens
VLLRCSLLQ

SEQ ID NO: 1355703 - protein, 9 aa, Homo Sapiens
ERSAAVMAG

SEQ ID NO: 1355704 - protein, 9 aa, Homo Sapiens
RNIISFIRG

SEQ ID NO: 1355705 - protein, 9 aa, Homo Sapiens
ALQSLDSVA

SEQ ID NO: 1355706 - protein, 9 aa, Homo Sapiens
IIKDVKLLE

SEQ ID NO: 1355707 - protein, 9 aa, Homo Sapiens
GRRNVADNK

SEQ ID NO: 1355708 - protein, 9 aa, Homo Sapiens
PVSRNIISF

SEQ ID NO: 1355709 - protein, 9 aa, Homo Sapiens
VHTVEKPYE

SEQ ID NO: 1355710 - protein, 9 aa, Homo Sapiens
THCPLCRGN

SEQ ID NO: 1355711 - protein, 9 aa, Homo Sapiens
DVFLRRLCS

SEQ ID NO: 1355712 - protein, 9 aa, Homo Sapiens
ARHSTSQPW

SEQ ID NO: 1355713 - protein, 9 aa, Homo Sapiens
HTQLVLTGK

SEQ ID NO: 1355714 - protein, 9 aa, Homo Sapiens
GGLSEGFHK

SEQ ID NO: 1355715 - protein, 9 aa, Homo Sapiens
AITNIKLAV

SEQ ID NO: 1355716 - protein, 9 aa, Homo Sapiens
VFVESLLND

SEQ ID NO: 1355717 - protein, 9 aa, Homo Sapiens
QSLLMLTLQ

SEQ ID NO: 1355718 - protein, 9 aa, Homo Sapiens
SKIEIPPRR

SEQ ID NO: 1355719 - protein, 9 aa, Homo Sapiens
FWFDSQEIS

SEQ ID NO: 1355720 - protein, 9 aa, Homo Sapiens
RDLAAEAKE

SEQ ID NO: 1355721 - protein, 9 aa, Homo Sapiens
YNQRRMSFV

SEQ ID NO: 1355722 - protein, 9 aa, Homo Sapiens
PDPAKSAHA

SEQ ID NO: 1355723 - protein, 9 aa, Homo Sapiens
NTNIAVDES

SEQ ID NO: 1355724 - protein, 9 aa, Homo Sapiens
PGMDCLWSL

SEQ ID NO: 1355725 - protein, 9 aa, Homo Sapiens
GSMKDRISV

SEQ ID NO: 1355726 - protein, 9 aa, Homo Sapiens
VVYAGWPIY

SEQ ID NO: 1355727 - protein, 9 aa, Homo Sapiens
DAAPEENGL

SEQ ID NO: 1355728 - protein, 9 aa, Homo Sapiens
YGIPQLSLR

SEQ ID NO: 1355729 - protein, 9 aa, Homo Sapiens
VYQMKFPDL

SEQ ID NO: 1355730 - protein, 9 aa, Homo Sapiens
WESSGLQLL

SEQ ID NO: 1355731 - protein, 9 aa, Homo Sapiens
LSRRLSMSE

SEQ ID NO: 1355732 - protein, 9 aa, Homo Sapiens
NHLIYSLRN

SEQ ID NO: 1355733 - protein, 9 aa, Homo Sapiens
IVDKDFSHT

SEQ ID NO: 1355734 - protein, 9 aa, Homo Sapiens
SNGGFPYTT

SEQ ID NO: 1355735 - protein, 9 aa, Homo Sapiens
TIQIEIKKR

SEQ ID NO: 1355736 - protein, 9 aa, Homo Sapiens
QVEFDVHVG

SEQ ID NO: 1355737 - protein, 9 aa, Homo Sapiens
RTALEAVKL

SEQ ID NO: 1355738 - protein, 9 aa, Homo Sapiens
GRLNKLLKT

SEQ ID NO: 1355739 - protein, 9 aa, Homo Sapiens
VCVHVSACA

SEQ ID NO: 1355740 - protein, 9 aa, Homo Sapiens
TKTERKEVD

SEQ ID NO: 1355741 - protein, 9 aa, Homo Sapiens
SEVRCFGGR

SEQ ID NO: 1355742 - protein, 9 aa, Homo Sapiens
ETLKKRKQD

SEQ ID NO: 1355743 - protein, 9 aa, Homo Sapiens
VAADGREPG

SEQ ID NO: 1355744 - protein, 9 aa, Homo Sapiens
CEECCKAFN

SEQ ID NO: 1355745 - protein, 9 aa, Homo Sapiens
KLLCAADVL

SEQ ID NO: 1355746 - protein, 9 aa, Homo Sapiens
RLQKMLASS

SEQ ID NO: 1355747 - protein, 9 aa, Homo Sapiens
LHNCGVPEG

SEQ ID NO: 1355748 - protein, 9 aa, Homo Sapiens
VRRPGYHID

SEQ ID NO: 1355749 - protein, 9 aa, Homo Sapiens
KLGHSGERF

SEQ ID NO: 1355750 - protein, 9 aa, Homo Sapiens
KHLWPEQNI

SEQ ID NO: 1355751 - protein, 9 aa, Homo Sapiens
QPAQAWTTF

SEQ ID NO: 1355752 - protein, 9 aa, Homo Sapiens
DSNSSEEGT

SEQ ID NO: 1355753 - protein, 9 aa, Homo Sapiens
EGTQEGGEE

SEQ ID NO: 1355754 - protein, 9 aa, Homo Sapiens
DSYFQSLRT

SEQ ID NO: 1355755 - protein, 9 aa, Homo Sapiens
VPELKLLCA

SEQ ID NO: 1355756 - protein, 9 aa, Homo Sapiens
SLSSQEVHE

SEQ ID NO: 1355757 - protein, 9 aa, Homo Sapiens
TWRYSYYLN

SEQ ID NO: 1355758 - protein, 9 aa, Homo Sapiens
QSKAGSLPA

SEQ ID NO: 1355759 - protein, 9 aa, Homo Sapiens
VKECKTHLP

SEQ ID NO: 1355760 - protein, 9 aa, Homo Sapiens
KGPPPALPE

SEQ ID NO: 1355761 - protein, 9 aa, Homo Sapiens
EWCFINSNL

SEQ ID NO: 1355762 - protein, 9 aa, Homo Sapiens
LLTLPLQRL

SEQ ID NO: 1355763 - protein, 9 aa, Homo Sapiens
ADVEERHNA

SEQ ID NO: 1355764 - protein, 9 aa, Homo Sapiens
MKDVTVPER

SEQ ID NO: 1355765 - protein, 9 aa, Homo Sapiens
KWSKVENTW

SEQ ID NO: 1355766 - protein, 9 aa, Homo Sapiens
TVVLAGDTM

SEQ ID NO: 1355767 - protein, 9 aa, Homo Sapiens
NDISMKSEG

SEQ ID NO: 1355768 - protein, 9 aa, Homo Sapiens
DTDDQIAKY

SEQ ID NO: 1355769 - protein, 9 aa, Homo Sapiens
KAWEVDVEQ

SEQ ID NO: 1355770 - protein, 9 aa, Homo Sapiens
QYSQVHICL

SEQ ID NO: 1355771 - protein, 9 aa, Homo Sapiens
PYKRINSNP

SEQ ID NO: 1355772 - protein, 9 aa, Homo Sapiens
KDIEELVEP

SEQ ID NO: 1355773 - protein, 9 aa, Homo Sapiens
SHYSTVSVA

SEQ ID NO: 1355774 - protein, 9 aa, Homo Sapiens
HKDIHDYEF

SEQ ID NO: 1355775 - protein, 9 aa, Homo Sapiens
YWVLEMDAA

SEQ ID NO: 1355776 - protein, 9 aa, Homo Sapiens
CTLWSRLNL

SEQ ID NO: 1355777 - protein, 9 aa, Homo Sapiens
DMEQRETTS

SEQ ID NO: 1355778 - protein, 9 aa, Homo Sapiens
VVQEKKVHP

SEQ ID NO: 1355779 - protein, 9 aa, Homo Sapiens
KVVWNKRLK

SEQ ID NO: 1355780 - protein, 9 aa, Homo Sapiens
HPDRGITFN

SEQ ID NO: 1355781 - protein, 9 aa, Homo Sapiens
EGYSLSSQR

SEQ ID NO: 1355782 - protein, 9 aa, Homo Sapiens
SLINLKYLY

SEQ ID NO: 1355783 - protein, 9 aa, Homo Sapiens
EKSYKPQIN

SEQ ID NO: 1355784 - protein, 9 aa, Homo Sapiens
VALVTLQSV

SEQ ID NO: 1355785 - protein, 9 aa, Homo Sapiens
LVITWTTEP

SEQ ID NO: 1355786 - protein, 9 aa, Homo Sapiens
MAEVNVEQD

SEQ ID NO: 1355787 - protein, 9 aa, Homo Sapiens
QTGPPANSA

SEQ ID NO: 1355788 - protein, 9 aa, Homo Sapiens
ATKNSKLVE

SEQ ID NO: 1355789 - protein, 9 aa, Homo Sapiens
WQALKNGQD

SEQ ID NO: 1355790 - protein, 9 aa, Homo Sapiens
SGTNDLREF

SEQ ID NO: 1355791 - protein, 9 aa, Homo Sapiens
PPRSAPRQA

SEQ ID NO: 1355792 - protein, 9 aa, Homo Sapiens
KQLHIDTLD

SEQ ID NO: 1355793 - protein, 9 aa, Homo Sapiens
KEVQVISEH

SEQ ID NO: 1355794 - protein, 9 aa, Homo Sapiens
RRPKAPYSY

SEQ ID NO: 1355795 - protein, 9 aa, Homo Sapiens
LQSVKEMVF

SEQ ID NO: 1355796 - protein, 9 aa, Homo Sapiens
THYMAEAKA

SEQ ID NO: 1355797 - protein, 9 aa, Homo Sapiens
EEILRLREL

SEQ ID NO: 1355798 - protein, 9 aa, Homo Sapiens
KITDFCEPR

SEQ ID NO: 1355799 - protein, 9 aa, Homo Sapiens
MVREDAQRT

SEQ ID NO: 1355800 - protein, 9 aa, Homo Sapiens
VLQVVKHSV

SEQ ID NO: 1355801 - protein, 9 aa, Homo Sapiens
NIVKLLDTR

SEQ ID NO: 1355802 - protein, 9 aa, Homo Sapiens
AFESLTKLQ

SEQ ID NO: 1355803 - protein, 9 aa, Homo Sapiens
SLLPVVIGG

SEQ ID NO: 1355804 - protein, 9 aa, Homo Sapiens
NRRALHLLT

SEQ ID NO: 1355805 - protein, 9 aa, Homo Sapiens
GAKQSLLML

SEQ ID NO: 1355806 - protein, 9 aa, Homo Sapiens
GVLQVVKHS

SEQ ID NO: 1355807 - protein, 9 aa, Homo Sapiens
LCKFHNQVE

SEQ ID NO: 1355808 - protein, 9 aa, Homo Sapiens
SAAALLPMS

SEQ ID NO: 1355809 - protein, 9 aa, Homo Sapiens
PGPPAPPGP

SEQ ID NO: 1355810 - protein, 9 aa, Homo Sapiens
HRDGCSTEF

SEQ ID NO: 1355811 - protein, 9 aa, Homo Sapiens
CRVRRTNSG

SEQ ID NO: 1355812 - protein, 9 aa, Homo Sapiens
PARHSTSQP

SEQ ID NO: 1355813 - protein, 9 aa, Homo Sapiens
HCKLVRKQS

SEQ ID NO: 1355814 - protein, 9 aa, Homo Sapiens
CKAFNQSST

SEQ ID NO: 1355815 - protein, 9 aa, Homo Sapiens
LSCLILKNN

SEQ ID NO: 1355816 - protein, 9 aa, Homo Sapiens
ETRLAVSLV

SEQ ID NO: 1355817 - protein, 9 aa, Homo Sapiens
PIINQGCLK

SEQ ID NO: 1355818 - protein, 9 aa, Homo Sapiens
LSYKDMEIN

SEQ ID NO: 1355819 - protein, 9 aa, Homo Sapiens
LIPVSRNII

SEQ ID NO: 1355820 - protein, 9 aa, Homo Sapiens
DEVERVLFS

SEQ ID NO: 1355821 - protein, 9 aa, Homo Sapiens
SPPLGFLLN

SEQ ID NO: 1355822 - protein, 9 aa, Homo Sapiens
FLRRLCSSG

SEQ ID NO: 1355823 - protein, 9 aa, Homo Sapiens
HVIEYVNPA

SEQ ID NO: 1355824 - protein, 9 aa, Homo Sapiens
MTTFSTGEK

SEQ ID NO: 1355825 - protein, 9 aa, Homo Sapiens
VDPTSERLL

SEQ ID NO: 1355826 - protein, 9 aa, Homo Sapiens
LQLHCLQLR

SEQ ID NO: 1355827 - protein, 9 aa, Homo Sapiens
VFLRRLCSS

SEQ ID NO: 1355828 - protein, 9 aa, Homo Sapiens
EDGTVMWFD

SEQ ID NO: 1355829 - protein, 9 aa, Homo Sapiens
LGYHIYVSP

SEQ ID NO: 1355830 - protein, 9 aa, Homo Sapiens
QWEEIDKIM

SEQ ID NO: 1355831 - protein, 9 aa, Homo Sapiens
SRTLSRNKC

SEQ ID NO: 1355832 - protein, 9 aa, Homo Sapiens
HNNNVRRLI

SEQ ID NO: 1355833 - protein, 9 aa, Homo Sapiens
ADPEMVENQ

SEQ ID NO: 1355834 - protein, 9 aa, Homo Sapiens
EITKLNTDL

SEQ ID NO: 1355835 - protein, 9 aa, Homo Sapiens
VVTHRPLDR

SEQ ID NO: 1355836 - protein, 9 aa, Homo Sapiens
LLELSEAEV

SEQ ID NO: 1355837 - protein, 9 aa, Homo Sapiens
VALSYKDME

SEQ ID NO: 1355838 - protein, 9 aa, Homo Sapiens
GKKFDVKTV

SEQ ID NO: 1355839 - protein, 9 aa, Homo Sapiens
FGFQQATRE

SEQ ID NO: 1355840 - protein, 9 aa, Homo Sapiens
TCMYKIPVG

SEQ ID NO: 1355841 - protein, 9 aa, Homo Sapiens
RTADFHNPG

SEQ ID NO: 1355842 - protein, 9 aa, Homo Sapiens
VCICVCVHV

SEQ ID NO: 1355843 - protein, 9 aa, Homo Sapiens
KEYRGSFCY

SEQ ID NO: 1355844 - protein, 9 aa, Homo Sapiens
INICYLPRM

SEQ ID NO: 1355845 - protein, 9 aa, Homo Sapiens
KDLLTMEQV

SEQ ID NO: 1355846 - protein, 9 aa, Homo Sapiens
GDAIQAIII

SEQ ID NO: 1355847 - protein, 9 aa, Homo Sapiens
ARELHQKHG

SEQ ID NO: 1355848 - protein, 9 aa, Homo Sapiens
FGYKNPDQV

SEQ ID NO: 1355849 - protein, 9 aa, Homo Sapiens
DAARAFECL

SEQ ID NO: 1355850 - protein, 9 aa, Homo Sapiens
VVNHLIYSL

SEQ ID NO: 1355851 - protein, 9 aa, Homo Sapiens
SHSSDEPAE

SEQ ID NO: 1355852 - protein, 9 aa, Homo Sapiens
AHSCCLQCN

SEQ ID NO: 1355853 - protein, 9 aa, Homo Sapiens
DPGCPDCFN

SEQ ID NO: 1355854 - protein, 9 aa, Homo Sapiens
VMGALCLYF

SEQ ID NO: 1355855 - protein, 9 aa, Homo Sapiens
DCRKGKLLA

SEQ ID NO: 1355856 - protein, 9 aa, Homo Sapiens
ITFNLIGES

SEQ ID NO: 1355857 - protein, 9 aa, Homo Sapiens
YKTAFYSLY

SEQ ID NO: 1355858 - protein, 9 aa, Homo Sapiens
RPALFKNPT

SEQ ID NO: 1355859 - protein, 9 aa, Homo Sapiens
LLERVFTLL

SEQ ID NO: 1355860 - protein, 9 aa, Homo Sapiens
SETRLAVSL

SEQ ID NO: 1355861 - protein, 9 aa, Homo Sapiens
ESIAYLFRN

SEQ ID NO: 1355862 - protein, 9 aa, Homo Sapiens
EKCTKATRA

SEQ ID NO: 1355863 - protein, 9 aa, Homo Sapiens
VKFEAEGVP

SEQ ID NO: 1355864 - protein, 9 aa, Homo Sapiens
PNRCKECWK

SEQ ID NO: 1355865 - protein, 9 aa, Homo Sapiens
MITLTQLKC

SEQ ID NO: 1355866 - protein, 9 aa, Homo Sapiens
LCAADVLKT

SEQ ID NO: 1355867 - protein, 9 aa, Homo Sapiens
CCGGCAILV

SEQ ID NO: 1355868 - protein, 9 aa, Homo Sapiens
SFTLRGPPW

SEQ ID NO: 1355869 - protein, 9 aa, Homo Sapiens
ALQKVFNFC

SEQ ID NO: 1355870 - protein, 9 aa, Homo Sapiens
HFTVLKVLN

SEQ ID NO: 1355871 - protein, 9 aa, Homo Sapiens
DVALSYKDM

SEQ ID NO: 1355872 - protein, 9 aa, Homo Sapiens
NILFMLLNG

SEQ ID NO: 1355873 - protein, 9 aa, Homo Sapiens
GPPAPPGPP

SEQ ID NO: 1355874 - protein, 9 aa, Homo Sapiens
PKLVFSKEG

SEQ ID NO: 1355875 - protein, 9 aa, Homo Sapiens
RRKEAEGTQ

SEQ ID NO: 1355876 - protein, 9 aa, Homo Sapiens
LYKLKKASQ

SEQ ID NO: 1355877 - protein, 9 aa, Homo Sapiens
FTCTTKKIR

SEQ ID NO: 1355878 - protein, 9 aa, Homo Sapiens
IVMQGTVIT

SEQ ID NO: 1355879 - protein, 9 aa, Homo Sapiens
GAAFSKTKF

SEQ ID NO: 1355880 - protein, 9 aa, Homo Sapiens
SCAFAGWEV

SEQ ID NO: 1355881 - protein, 9 aa, Homo Sapiens
PPGPPAPPG

SEQ ID NO: 1355882 - protein, 9 aa, Homo Sapiens
IYSLIGKGS

SEQ ID NO: 1355883 - protein, 9 aa, Homo Sapiens
DPDSAAGEI

SEQ ID NO: 1355884 - protein, 9 aa, Homo Sapiens
MKGDGKTMT

SEQ ID NO: 1355885 - protein, 9 aa, Homo Sapiens
EQNLSVAKG

SEQ ID NO: 1355886 - protein, 9 aa, Homo Sapiens
EQDVKVSND

SEQ ID NO: 1355887 - protein, 9 aa, Homo Sapiens
LQCVVPLGV

SEQ ID NO: 1355888 - protein, 9 aa, Homo Sapiens
NHIIYTLRN

SEQ ID NO: 1355889 - protein, 9 aa, Homo Sapiens
MEQKIIDFI

SEQ ID NO: 1355890 - protein, 9 aa, Homo Sapiens
SLHQLKNSC

SEQ ID NO: 1355891 - protein, 9 aa, Homo Sapiens
QLGPQGGAQ

SEQ ID NO: 1355892 - protein, 9 aa, Homo Sapiens
LDGHNVSLL

SEQ ID NO: 1355893 - protein, 9 aa, Homo Sapiens
KTMTNDYVV

SEQ ID NO: 1355894 - protein, 9 aa, Homo Sapiens
SCCLQCNGR

SEQ ID NO: 1355895 - protein, 9 aa, Homo Sapiens
GLGPCGSVK

SEQ ID NO: 1355896 - protein, 9 aa, Homo Sapiens
GHDDKIHSI

SEQ ID NO: 1355897 - protein, 9 aa, Homo Sapiens
VFFLVLMLA

SEQ ID NO: 1355898 - protein, 9 aa, Homo Sapiens
EPQRKFLEE

SEQ ID NO: 1355899 - protein, 9 aa, Homo Sapiens
QPELSYGIP

SEQ ID NO: 1355900 - protein, 9 aa, Homo Sapiens
AEDHSIQQV

SEQ ID NO: 1355901 - protein, 9 aa, Homo Sapiens
HSYKEGTDP

SEQ ID NO: 1355902 - protein, 9 aa, Homo Sapiens
MLLNGYESP

SEQ ID NO: 1355903 - protein, 9 aa, Homo Sapiens
SVIHNNNVR

SEQ ID NO: 1355904 - protein, 9 aa, Homo Sapiens
FTIEVDRLK

SEQ ID NO: 1355905 - protein, 9 aa, Homo Sapiens
QEVQVPPTS

SEQ ID NO: 1355906 - protein, 9 aa, Homo Sapiens
ILEKLHNCG

SEQ ID NO: 1355907 - protein, 9 aa, Homo Sapiens
EAKTIQIEI

SEQ ID NO: 1355908 - protein, 9 aa, Homo Sapiens
TTSFQAPSP

SEQ ID NO: 1355909 - protein, 9 aa, Homo Sapiens
GCNPELRDF

SEQ ID NO: 1355910 - protein, 9 aa, Homo Sapiens
YIILLGVIG

SEQ ID NO: 1355911 - protein, 9 aa, Homo Sapiens
DPQVLNQLS

SEQ ID NO: 1355912 - protein, 9 aa, Homo Sapiens
HIVDNQSFP

SEQ ID NO: 1355913 - protein, 9 aa, Homo Sapiens
LKVQVADSR

SEQ ID NO: 1355914 - protein, 9 aa, Homo Sapiens
RFLYTEQLL

SEQ ID NO: 1355915 - protein, 9 aa, Homo Sapiens
VQVISEHYL

SEQ ID NO: 1355916 - protein, 9 aa, Homo Sapiens
KVFLLAINQ

SEQ ID NO: 1355917 - protein, 9 aa, Homo Sapiens
RAEAARIKG

SEQ ID NO: 1355918 - protein, 9 aa, Homo Sapiens
DCNSFYKII

SEQ ID NO: 1355919 - protein, 9 aa, Homo Sapiens
PAYQIAKTA

SEQ ID NO: 1355920 - protein, 9 aa, Homo Sapiens
SHAFGESHA

SEQ ID NO: 1355921 - protein, 9 aa, Homo Sapiens
FDVKTVSGK

SEQ ID NO: 1355922 - protein, 9 aa, Homo Sapiens
MGRRSTKKR

SEQ ID NO: 1355923 - protein, 9 aa, Homo Sapiens
VPMKDVTVP

SEQ ID NO: 1355924 - protein, 9 aa, Homo Sapiens
CHDLAPTCR

SEQ ID NO: 1355925 - protein, 9 aa, Homo Sapiens
VNRAIAQLF

SEQ ID NO: 1355926 - protein, 9 aa, Homo Sapiens
FEGYSLSSQ

SEQ ID NO: 1355927 - protein, 9 aa, Homo Sapiens
QAEQAALRH

SEQ ID NO: 1355928 - protein, 9 aa, Homo Sapiens
LTAMRESGT

SEQ ID NO: 1355929 - protein, 9 aa, Homo Sapiens
STLCGEALR

SEQ ID NO: 1355930 - protein, 9 aa, Homo Sapiens
PKAELLIKI

SEQ ID NO: 1355931 - protein, 9 aa, Homo Sapiens
IEKPYKCEE

SEQ ID NO: 1355932 - protein, 9 aa, Homo Sapiens
VRKFPFAAN

SEQ ID NO: 1355933 - protein, 9 aa, Homo Sapiens
APGNALFGQ

SEQ ID NO: 1355934 - protein, 9 aa, Homo Sapiens
IELEDLSDK

SEQ ID NO: 1355935 - protein, 9 aa, Homo Sapiens
DNVVLVVPV

SEQ ID NO: 1355936 - protein, 9 aa, Homo Sapiens
TTCTKHPNI

SEQ ID NO: 1355937 - protein, 9 aa, Homo Sapiens
EIKALNEKY

SEQ ID NO: 1355938 - protein, 9 aa, Homo Sapiens
LHLLTAERG

SEQ ID NO: 1355939 - protein, 9 aa, Homo Sapiens
VQVPYKRIN

SEQ ID NO: 1355940 - protein, 9 aa, Homo Sapiens
HVREHSLIE

SEQ ID NO: 1355941 - protein, 9 aa, Homo Sapiens
NRGLKKKKQ

SEQ ID NO: 1355942 - protein, 9 aa, Homo Sapiens
GEKAYRCSD

SEQ ID NO: 1355943 - protein, 9 aa, Homo Sapiens
GDRCFRLHN

SEQ ID NO: 1355944 - protein, 9 aa, Homo Sapiens
KAYRCSDCK

SEQ ID NO: 1355945 - protein, 9 aa, Homo Sapiens
AVSTLWEII

SEQ ID NO: 1355946 - protein, 9 aa, Homo Sapiens
MAFSIHSYK

SEQ ID NO: 1355947 - protein, 9 aa, Homo Sapiens
LPPRSAPRQ

SEQ ID NO: 1355948 - protein, 9 aa, Homo Sapiens
QLFLPHSRG

SEQ ID NO: 1355949 - protein, 9 aa, Homo Sapiens
KEYLPKNNN

SEQ ID NO: 1355950 - protein, 9 aa, Homo Sapiens
VPDHLMPDP

SEQ ID NO: 1355951 - protein, 9 aa, Homo Sapiens
CLMVERCCE

SEQ ID NO: 1355952 - protein, 9 aa, Homo Sapiens
ARLLDIPCV

SEQ ID NO: 1355953 - protein, 9 aa, Homo Sapiens
CCLQCNGRS

SEQ ID NO: 1355954 - protein, 9 aa, Homo Sapiens
RHSTSQPWR

SEQ ID NO: 1355955 - protein, 9 aa, Homo Sapiens
SHSHLSVPR

SEQ ID NO: 1355956 - protein, 9 aa, Homo Sapiens
NNNKINLKQ

SEQ ID NO: 1355957 - protein, 9 aa, Homo Sapiens
FTSEDHLDD

SEQ ID NO: 1355958 - protein, 9 aa, Homo Sapiens
KFCIQSRLP

SEQ ID NO: 1355959 - protein, 9 aa, Homo Sapiens
DTQRQRKLI

SEQ ID NO: 1355960 - protein, 9 aa, Homo Sapiens
GMTKTERKE

SEQ ID NO: 1355961 - protein, 9 aa, Homo Sapiens
KGPNGENGV

SEQ ID NO: 1355962 - protein, 9 aa, Homo Sapiens
LPGPPGPPA

SEQ ID NO: 1355963 - protein, 9 aa, Homo Sapiens
FKNRAKMID

SEQ ID NO: 1355964 - protein, 9 aa, Homo Sapiens
TERRYNLRY

SEQ ID NO: 1355965 - protein, 9 aa, Homo Sapiens
ESSYYLEKA

SEQ ID NO: 1355966 - protein, 9 aa, Homo Sapiens
AAVPEVELL

SEQ ID NO: 1355967 - protein, 9 aa, Homo Sapiens
GECVEVVID

SEQ ID NO: 1355968 - protein, 9 aa, Homo Sapiens
IQSRLPSTV

SEQ ID NO: 1355969 - protein, 9 aa, Homo Sapiens
LKNADPEMV

SEQ ID NO: 1355970 - protein, 9 aa, Homo Sapiens
CHRCGKQFN

SEQ ID NO: 1355971 - protein, 9 aa, Homo Sapiens
LWEIIAEDE

SEQ ID NO: 1355972 - protein, 9 aa, Homo Sapiens
QQKTNYIND

SEQ ID NO: 1355973 - protein, 9 aa, Homo Sapiens
KLYFLGLEH

SEQ ID NO: 1355974 - protein, 9 aa, Homo Sapiens
IILKDTSKD

SEQ ID NO: 1355975 - protein, 9 aa, Homo Sapiens
CWKNFSNGH

SEQ ID NO: 1355976 - protein, 9 aa, Homo Sapiens
KLTYSIWDP

SEQ ID NO: 1355977 - protein, 9 aa, Homo Sapiens
VISEHYLRR

SEQ ID NO: 1355978 - protein, 9 aa, Homo Sapiens
APDPGCPDC

SEQ ID NO: 1355979 - protein, 9 aa, Homo Sapiens
SLSCLILKN

SEQ ID NO: 1355980 - protein, 9 aa, Homo Sapiens
ADSRVISTT

SEQ ID NO: 1355981 - protein, 9 aa, Homo Sapiens
EVVQEKKVH

SEQ ID NO: 1355982 - protein, 9 aa, Homo Sapiens
RDSQIALVE

SEQ ID NO: 1355983 - protein, 9 aa, Homo Sapiens
RFGAPVSAV

SEQ ID NO: 1355984 - protein, 9 aa, Homo Sapiens
RPALQDTPP

SEQ ID NO: 1355985 - protein, 9 aa, Homo Sapiens
HNGESIAYL

SEQ ID NO: 1355986 - protein, 9 aa, Homo Sapiens
LKRGAEILP

SEQ ID NO: 1355987 - protein, 9 aa, Homo Sapiens
YLIRIPTMV

SEQ ID NO: 1355988 - protein, 9 aa, Homo Sapiens
ILCVVETGI

SEQ ID NO: 1355989 - protein, 9 aa, Homo Sapiens
AFECLDSDE

SEQ ID NO: 1355990 - protein, 9 aa, Homo Sapiens
INHNADKSL

SEQ ID NO: 1355991 - protein, 9 aa, Homo Sapiens
DDNVVGATP

SEQ ID NO: 1355992 - protein, 9 aa, Homo Sapiens
RGLKKKKQY

SEQ ID NO: 1355993 - protein, 9 aa, Homo Sapiens
EYKVRKFPF

SEQ ID NO: 1355994 - protein, 9 aa, Homo Sapiens
CSQCSECYH

SEQ ID NO: 1355995 - protein, 9 aa, Homo Sapiens
GIAVLNITS

SEQ ID NO: 1355996 - protein, 9 aa, Homo Sapiens
GLLTEPLWR

SEQ ID NO: 1355997 - protein, 9 aa, Homo Sapiens
VRGDPGSER

SEQ ID NO: 1355998 - protein, 9 aa, Homo Sapiens
YSYKVQDKK

SEQ ID NO: 1355999 - protein, 9 aa, Homo Sapiens
QPNLEINHN

SEQ ID NO: 1356000 - protein, 9 aa, Homo Sapiens
YLPKNNNKI

SEQ ID NO: 1356001 - protein, 9 aa, Homo Sapiens
KEGLKETSV

SEQ ID NO: 1356002 - protein, 9 aa, Homo Sapiens
IMTNPHNHL

SEQ ID NO: 1356003 - protein, 9 aa, Homo Sapiens
LHLQVPLQT

SEQ ID NO: 1356004 - protein, 9 aa, Homo Sapiens
TPSHFVKDL

SEQ ID NO: 1356005 - protein, 9 aa, Homo Sapiens
TCTTKKIRN

SEQ ID NO: 1356006 - protein, 9 aa, Homo Sapiens
FIVIIAQLR

SEQ ID NO: 1356007 - protein, 9 aa, Homo Sapiens
PEAGDWRPD

SEQ ID NO: 1356008 - protein, 9 aa, Homo Sapiens
IRSNAEKKQ

SEQ ID NO: 1356009 - protein, 9 aa, Homo Sapiens
YKYRGPQSG

SEQ ID NO: 1356010 - protein, 9 aa, Homo Sapiens
RCKNALSNP

SEQ ID NO: 1356011 - protein, 9 aa, Homo Sapiens
PNIKMVMES

SEQ ID NO: 1356012 - protein, 9 aa, Homo Sapiens
ALWLEQKHC

SEQ ID NO: 1356013 - protein, 9 aa, Homo Sapiens
NIDARKNCM

SEQ ID NO: 1356014 - protein, 9 aa, Homo Sapiens
CLAVLALLC

SEQ ID NO: 1356015 - protein, 9 aa, Homo Sapiens
PAERSAAVM

SEQ ID NO: 1356016 - protein, 9 aa, Homo Sapiens
WKKQFKYGN

SEQ ID NO: 1356017 - protein, 9 aa, Homo Sapiens
HIRHHAKYM

SEQ ID NO: 1356018 - protein, 9 aa, Homo Sapiens
LNSIEQYKA

SEQ ID NO: 1356019 - protein, 9 aa, Homo Sapiens
CERVTNVLN

SEQ ID NO: 1356020 - protein, 9 aa, Homo Sapiens
DAQRTVTIE

SEQ ID NO: 1356021 - protein, 9 aa, Homo Sapiens
CAFGTEYIR

SEQ ID NO: 1356022 - protein, 9 aa, Homo Sapiens
NSHGKFIAR

SEQ ID NO: 1356023 - protein, 9 aa, Homo Sapiens
SFSSHGGSS

SEQ ID NO: 1356024 - protein, 9 aa, Homo Sapiens
VAEKEIGNV

SEQ ID NO: 1356025 - protein, 9 aa, Homo Sapiens
LFHKEPTWE

SEQ ID NO: 1356026 - protein, 9 aa, Homo Sapiens
SKEEIDILI

SEQ ID NO: 1356027 - protein, 9 aa, Homo Sapiens
LYRDVMWKN

SEQ ID NO: 1356028 - protein, 9 aa, Homo Sapiens
GESIAYLFR

SEQ ID NO: 1356029 - protein, 9 aa, Homo Sapiens
TGTSAEQLD

SEQ ID NO: 1356030 - protein, 9 aa, Homo Sapiens
SLQLHCLQL

SEQ ID NO: 1356031 - protein, 9 aa, Homo Sapiens
PMFITVVDS

SEQ ID NO: 1356032 - protein, 9 aa, Homo Sapiens
ADEALDRIN

SEQ ID NO: 1356033 - protein, 9 aa, Homo Sapiens
DLREFVLEM

SEQ ID NO: 1356034 - protein, 9 aa, Homo Sapiens
KQIAGLQKT

SEQ ID NO: 1356035 - protein, 9 aa, Homo Sapiens
AEKVKADVQ

SEQ ID NO: 1356036 - protein, 9 aa, Homo Sapiens
FLSAQEPSN

SEQ ID NO: 1356037 - protein, 9 aa, Homo Sapiens
ALQVLSAIF

SEQ ID NO: 1356038 - protein, 9 aa, Homo Sapiens
DSNGYHVLQ

SEQ ID NO: 1356039 - protein, 9 aa, Homo Sapiens
EFDVHVGSR

SEQ ID NO: 1356040 - protein, 9 aa, Homo Sapiens
DALTSLVPD

SEQ ID NO: 1356041 - protein, 9 aa, Homo Sapiens
RELLRPSLH

SEQ ID NO: 1356042 - protein, 9 aa, Homo Sapiens
AVEHLRICP

SEQ ID NO: 1356043 - protein, 9 aa, Homo Sapiens
QQLQSVIHN

SEQ ID NO: 1356044 - protein, 9 aa, Homo Sapiens
YQFGEILTI

SEQ ID NO: 1356045 - protein, 9 aa, Homo Sapiens
LDQPENTFL

SEQ ID NO: 1356046 - protein, 9 aa, Homo Sapiens
DPAKSAHAP

SEQ ID NO: 1356047 - protein, 9 aa, Homo Sapiens
GIAPSYDQP

SEQ ID NO: 1356048 - protein, 9 aa, Homo Sapiens
HNNSLLGTY

SEQ ID NO: 1356049 - protein, 9 aa, Homo Sapiens
LMIRLFNLI

SEQ ID NO: 1356050 - protein, 9 aa, Homo Sapiens
PHSTTIIMR

SEQ ID NO: 1356051 - protein, 9 aa, Homo Sapiens
LMRSVSEEV

SEQ ID NO: 1356052 - protein, 9 aa, Homo Sapiens
GTHCPLCRG

SEQ ID NO: 1356053 - protein, 9 aa, Homo Sapiens
PPALPEYDL

SEQ ID NO: 1356054 - protein, 9 aa, Homo Sapiens
VRVCACTGR

SEQ ID NO: 1356055 - protein, 9 aa, Homo Sapiens
NICYLPRMA

SEQ ID NO: 1356056 - protein, 9 aa, Homo Sapiens
LTLCKFHNQ

SEQ ID NO: 1356057 - protein, 9 aa, Homo Sapiens
VSAVYFFTF

SEQ ID NO: 1356058 - protein, 9 aa, Homo Sapiens
CFAVPDHLM

SEQ ID NO: 1356059 - protein, 9 aa, Homo Sapiens
QVLNQLSKN

SEQ ID NO: 1356060 - protein, 9 aa, Homo Sapiens
ATHLAALRA

SEQ ID NO: 1356061 - protein, 9 aa, Homo Sapiens
KALIVLQKG

SEQ ID NO: 1356062 - protein, 9 aa, Homo Sapiens
VYATYDVKV

SEQ ID NO: 1356063 - protein, 9 aa, Homo Sapiens
NASRDLDRI

SEQ ID NO: 1356064 - protein, 9 aa, Homo Sapiens
QGSFSSHGG

SEQ ID NO: 1356065 - protein, 9 aa, Homo Sapiens
PGPVRFQDR

SEQ ID NO: 1356066 - protein, 9 aa, Homo Sapiens
VLNQLSKNI

SEQ ID NO: 1356067 - protein, 9 aa, Homo Sapiens
QRFCWQLVK

SEQ ID NO: 1356068 - protein, 9 aa, Homo Sapiens
GYSLSSQRN

SEQ ID NO: 1356069 - protein, 9 aa, Homo Sapiens
LSAQEPSNK

SEQ ID NO: 1356070 - protein, 9 aa, Homo Sapiens
IVKLLDTRS

SEQ ID NO: 1356071 - protein, 9 aa, Homo Sapiens
TGEKLAAPW

SEQ ID NO: 1356072 - protein, 9 aa, Homo Sapiens
TSERLLPLA

SEQ ID NO: 1356073 - protein, 9 aa, Homo Sapiens
QTESCWLMV

SEQ ID NO: 1356074 - protein, 9 aa, Homo Sapiens
AFGFQQATR

SEQ ID NO: 1356075 - protein, 9 aa, Homo Sapiens
RDLATLGDK

SEQ ID NO: 1356076 - protein, 9 aa, Homo Sapiens
ITDDSRLCS

SEQ ID NO: 1356077 - protein, 9 aa, Homo Sapiens
IKCVGNATA

SEQ ID NO: 1356078 - protein, 9 aa, Homo Sapiens
TGTLTMNIM

SEQ ID NO: 1356079 - protein, 9 aa, Homo Sapiens
KANKAITDA

SEQ ID NO: 1356080 - protein, 9 aa, Homo Sapiens
IHNGESIAY

SEQ ID NO: 1356081 - protein, 9 aa, Homo Sapiens
MKDRISVSS

SEQ ID NO: 1356082 - protein, 9 aa, Homo Sapiens
QAVELYKKG

SEQ ID NO: 1356083 - protein, 9 aa, Homo Sapiens
LACSQCSEC

SEQ ID NO: 1356084 - protein, 9 aa, Homo Sapiens
PATAATNSQ

SEQ ID NO: 1356085 - protein, 9 aa, Homo Sapiens
QVGLDTTRS

SEQ ID NO: 1356086 - protein, 9 aa, Homo Sapiens
VKDLLTMEQ

SEQ ID NO: 1356087 - protein, 9 aa, Homo Sapiens
MHTKNRLLG

SEQ ID NO: 1356088 - protein, 9 aa, Homo Sapiens
GERGAKGPN

SEQ ID NO: 1356089 - protein, 9 aa, Homo Sapiens
PNGENGVVG

SEQ ID NO: 1356090 - protein, 9 aa, Homo Sapiens
LTMNIMTVV

SEQ ID NO: 1356091 - protein, 9 aa, Homo Sapiens
HRCRRSHHC

SEQ ID NO: 1356092 - protein, 9 aa, Homo Sapiens
QMKFPDLCV

SEQ ID NO: 1356093 - protein, 9 aa, Homo Sapiens
ITTNQKTLR

SEQ ID NO: 1356094 - protein, 9 aa, Homo Sapiens
CKDGCRNGV

SEQ ID NO: 1356095 - protein, 9 aa, Homo Sapiens
FYWSQESII

SEQ ID NO: 1356096 - protein, 9 aa, Homo Sapiens
CQGGSIKQI

SEQ ID NO: 1356097 - protein, 9 aa, Homo Sapiens
LNLLMIRLF

SEQ ID NO: 1356098 - protein, 9 aa, Homo Sapiens
NFTGKFCIQ

SEQ ID NO: 1356099 - protein, 9 aa, Homo Sapiens
MLQDNQSLA

SEQ ID NO: 1356100 - protein, 9 aa, Homo Sapiens
HSTQSKAGS

SEQ ID NO: 1356101 - protein, 9 aa, Homo Sapiens
NHPAQLSNT

SEQ ID NO: 1356102 - protein, 9 aa, Homo Sapiens
MRESGTHCP

SEQ ID NO: 1356103 - protein, 9 aa, Homo Sapiens
RERTLHIQA

SEQ ID NO: 1356104 - protein, 9 aa, Homo Sapiens
LKKPISDVT

SEQ ID NO: 1356105 - protein, 9 aa, Homo Sapiens
RLNKLLKTI

SEQ ID NO: 1356106 - protein, 9 aa, Homo Sapiens
MKDKLLCQL

SEQ ID NO: 1356107 - protein, 9 aa, Homo Sapiens
AVYFFTFSM

SEQ ID NO: 1356108 - protein, 9 aa, Homo Sapiens
ISRELLRPS

SEQ ID NO: 1356109 - protein, 9 aa, Homo Sapiens
DSRVISTTD

SEQ ID NO: 1356110 - protein, 9 aa, Homo Sapiens
NFYWSQESI

SEQ ID NO: 1356111 - protein, 9 aa, Homo Sapiens
SSYYLEKAK

SEQ ID NO: 1356112 - protein, 9 aa, Homo Sapiens
VFACLAVLA

SEQ ID NO: 1356113 - protein, 9 aa, Homo Sapiens
FNQPLDQNF

SEQ ID NO: 1356114 - protein, 9 aa, Homo Sapiens
LMYICLLVM

SEQ ID NO: 1356115 - protein, 9 aa, Homo Sapiens
HIQAYNETF

SEQ ID NO: 1356116 - protein, 9 aa, Homo Sapiens
YTTAPKIAA

SEQ ID NO: 1356117 - protein, 9 aa, Homo Sapiens
GLASIVAPL

SEQ ID NO: 1356118 - protein, 9 aa, Homo Sapiens
IYTNENPNN

SEQ ID NO: 1356119 - protein, 9 aa, Homo Sapiens
NWQALKNGQ

SEQ ID NO: 1356120 - protein, 9 aa, Homo Sapiens
IFNPSSGGI

SEQ ID NO: 1356121 - protein, 9 aa, Homo Sapiens
YRGPQSGLP

SEQ ID NO: 1356122 - protein, 9 aa, Homo Sapiens
LSLSSQEVH

SEQ ID NO: 1356123 - protein, 9 aa, Homo Sapiens
TCKVHFPNP

SEQ ID NO: 1356124 - protein, 9 aa, Homo Sapiens
VVFACLAVL

SEQ ID NO: 1356125 - protein, 9 aa, Homo Sapiens
QGTVITTTL

SEQ ID NO: 1356126 - protein, 9 aa, Homo Sapiens
IAVLNITSY

SEQ ID NO: 1356127 - protein, 9 aa, Homo Sapiens
TIEVDRLKN

SEQ ID NO: 1356128 - protein, 9 aa, Homo Sapiens
QLVLTGKME

SEQ ID NO: 1356129 - protein, 9 aa, Homo Sapiens
KDITSIQLL

SEQ ID NO: 1356130 - protein, 9 aa, Homo Sapiens
PVHFQEIES

SEQ ID NO: 1356131 - protein, 9 aa, Homo Sapiens
DAIQAIIIT

SEQ ID NO: 1356132 - protein, 9 aa, Homo Sapiens
SCWLMVFFL

SEQ ID NO: 1356133 - protein, 9 aa, Homo Sapiens
ADLCDQHKG

SEQ ID NO: 1356134 - protein, 9 aa, Homo Sapiens
GQDTFRYSH

SEQ ID NO: 1356135 - protein, 9 aa, Homo Sapiens
FGGEWSIMT

SEQ ID NO: 1356136 - protein, 9 aa, Homo Sapiens
QRHSKRKTA

SEQ ID NO: 1356137 - protein, 9 aa, Homo Sapiens
FSTVYTPNT

SEQ ID NO: 1356138 - protein, 9 aa, Homo Sapiens
RSHSTQSKA

SEQ ID NO: 1356139 - protein, 9 aa, Homo Sapiens
WLTQNEFEV

SEQ ID NO: 1356140 - protein, 9 aa, Homo Sapiens
PMLVPYDTL

SEQ ID NO: 1356141 - protein, 9 aa, Homo Sapiens
EALREVVQE

SEQ ID NO: 1356142 - protein, 9 aa, Homo Sapiens
QEQRAKMPQ

SEQ ID NO: 1356143 - protein, 9 aa, Homo Sapiens
RQQLGTAVQ

SEQ ID NO: 1356144 - protein, 9 aa, Homo Sapiens
NTPDMEQRE

SEQ ID NO: 1356145 - protein, 9 aa, Homo Sapiens
KGLCWFQVL

SEQ ID NO: 1356146 - protein, 9 aa, Homo Sapiens
PPLGFLLNS

SEQ ID NO: 1356147 - protein, 9 aa, Homo Sapiens
EYYNDSNGY

SEQ ID NO: 1356148 - protein, 9 aa, Homo Sapiens
HVQSSSHSS

SEQ ID NO: 1356149 - protein, 9 aa, Homo Sapiens
NAQDFWAQG

SEQ ID NO: 1356150 - protein, 9 aa, Homo Sapiens
TTVILAGVK

SEQ ID NO: 1356151 - protein, 9 aa, Homo Sapiens
KMPQTRVTI

SEQ ID NO: 1356152 - protein, 9 aa, Homo Sapiens
KKQLCFDDE

SEQ ID NO: 1356153 - protein, 9 aa, Homo Sapiens
DLNKKTQSK

SEQ ID NO: 1356154 - protein, 9 aa, Homo Sapiens
ESLVSEIHS

SEQ ID NO: 1356155 - protein, 9 aa, Homo Sapiens
QGTDPGTFS

SEQ ID NO: 1356156 - protein, 9 aa, Homo Sapiens
NNKINLKQQ

SEQ ID NO: 1356157 - protein, 9 aa, Homo Sapiens
AVDMHEIEK

SEQ ID NO: 1356158 - protein, 9 aa, Homo Sapiens
AFGTEYIRT

SEQ ID NO: 1356159 - protein, 9 aa, Homo Sapiens
MEAFVNQPN

SEQ ID NO: 1356160 - protein, 9 aa, Homo Sapiens
DDGFCVFDS

SEQ ID NO: 1356161 - protein, 9 aa, Homo Sapiens
LFLKDDFTI

SEQ ID NO: 1356162 - protein, 9 aa, Homo Sapiens
VSGEVYGTN

SEQ ID NO: 1356163 - protein, 9 aa, Homo Sapiens
QLAQHQMIH

SEQ ID NO: 1356164 - protein, 9 aa, Homo Sapiens
KFQLPENLT

SEQ ID NO: 1356165 - protein, 9 aa, Homo Sapiens
TIIHKRFKS

SEQ ID NO: 1356166 - protein, 9 aa, Homo Sapiens
KDFHHIVFG

SEQ ID NO: 1356167 - protein, 9 aa, Homo Sapiens
KYMQLMNIL

SEQ ID NO: 1356168 - protein, 9 aa, Homo Sapiens
TLRGPPWAA

SEQ ID NO: 1356169 - protein, 9 aa, Homo Sapiens
AKLENQESL

SEQ ID NO: 1356170 - protein, 9 aa, Homo Sapiens
SGGKHYDSR

SEQ ID NO: 1356171 - protein, 9 aa, Homo Sapiens
KKALQGFFH

SEQ ID NO: 1356172 - protein, 9 aa, Homo Sapiens
RCKECWKNF

SEQ ID NO: 1356173 - protein, 9 aa, Homo Sapiens
VILSILFYG

SEQ ID NO: 1356174 - protein, 9 aa, Homo Sapiens
LFFGLWHLG

SEQ ID NO: 1356175 - protein, 9 aa, Homo Sapiens
NSDNVNHAV

SEQ ID NO: 1356176 - protein, 9 aa, Homo Sapiens
SPATGPSAA

SEQ ID NO: 1356177 - protein, 9 aa, Homo Sapiens
FYSLYLPIA

SEQ ID NO: 1356178 - protein, 9 aa, Homo Sapiens
FKRNELHSI

SEQ ID NO: 1356179 - protein, 9 aa, Homo Sapiens
SKKFSLFVL

SEQ ID NO: 1356180 - protein, 9 aa, Homo Sapiens
AKQSLLMLT

SEQ ID NO: 1356181 - protein, 9 aa, Homo Sapiens
QEEILRLRE

SEQ ID NO: 1356182 - protein, 9 aa, Homo Sapiens
AMVAFESLD

SEQ ID NO: 1356183 - protein, 9 aa, Homo Sapiens
PLGFLLNSK

SEQ ID NO: 1356184 - protein, 9 aa, Homo Sapiens
KAKDNQSIS

SEQ ID NO: 1356185 - protein, 9 aa, Homo Sapiens
KLSNVKRTR

SEQ ID NO: 1356186 - protein, 9 aa, Homo Sapiens
ISELNVIAP

SEQ ID NO: 1356187 - protein, 9 aa, Homo Sapiens
QACVIIVGN

SEQ ID NO: 1356188 - protein, 9 aa, Homo Sapiens
WRLLSVAES

SEQ ID NO: 1356189 - protein, 9 aa, Homo Sapiens
NNTLLLLEH

SEQ ID NO: 1356190 - protein, 9 aa, Homo Sapiens
PSNNDFNTT

SEQ ID NO: 1356191 - protein, 9 aa, Homo Sapiens
GIRIDNVVL

SEQ ID NO: 1356192 - protein, 9 aa, Homo Sapiens
FVESLLNDA

SEQ ID NO: 1356193 - protein, 9 aa, Homo Sapiens
DDSEEKVNN

SEQ ID NO: 1356194 - protein, 9 aa, Homo Sapiens
EALDRINRF

SEQ ID NO: 1356195 - protein, 9 aa, Homo Sapiens
NMAFAEADY

SEQ ID NO: 1356196 - protein, 9 aa, Homo Sapiens
ENALQEKKT

SEQ ID NO: 1356197 - protein, 9 aa, Homo Sapiens
ISGCTPIHL

SEQ ID NO: 1356198 - protein, 9 aa, Homo Sapiens
LLRFNPLDT

SEQ ID NO: 1356199 - protein, 9 aa, Homo Sapiens
VKRTRNLES

SEQ ID NO: 1356200 - protein, 9 aa, Homo Sapiens
VSHPQVALQ

SEQ ID NO: 1356201 - protein, 9 aa, Homo Sapiens
TALTIMYKK

SEQ ID NO: 1356202 - protein, 9 aa, Homo Sapiens
LLMLTLQDN

SEQ ID NO: 1356203 - protein, 9 aa, Homo Sapiens
SLQSRWNYR

SEQ ID NO: 1356204 - protein, 9 aa, Homo Sapiens
APPGPPGYK

SEQ ID NO: 1356205 - protein, 9 aa, Homo Sapiens
RSNAEKKQL

SEQ ID NO: 1356206 - protein, 9 aa, Homo Sapiens
VTDCVLYYY

SEQ ID NO: 1356207 - protein, 9 aa, Homo Sapiens
NALQEKKTL

SEQ ID NO: 1356208 - protein, 9 aa, Homo Sapiens
IGDFEFALV

SEQ ID NO: 1356209 - protein, 9 aa, Homo Sapiens
SSCVIQFMS

SEQ ID NO: 1356210 - protein, 9 aa, Homo Sapiens
HEWSESSQH

SEQ ID NO: 1356211 - protein, 9 aa, Homo Sapiens
CDQPLGYHI

SEQ ID NO: 1356212 - protein, 9 aa, Homo Sapiens
ICLLVMGAL

SEQ ID NO: 1356213 - protein, 9 aa, Homo Sapiens
LQIVYGNYD

SEQ ID NO: 1356214 - protein, 9 aa, Homo Sapiens
GLQLQDLLT

SEQ ID NO: 1356215 - protein, 9 aa, Homo Sapiens
VKAPSPRSS

SEQ ID NO: 1356216 - protein, 9 aa, Homo Sapiens
SCTVEVNFQ

SEQ ID NO: 1356217 - protein, 9 aa, Homo Sapiens
AFAFAGAVR

SEQ ID NO: 1356218 - protein, 9 aa, Homo Sapiens
VDPDSAAGE

SEQ ID NO: 1356219 - protein, 9 aa, Homo Sapiens
FYLNTWPIF

SEQ ID NO: 1356220 - protein, 9 aa, Homo Sapiens
ILLKMEQKI

SEQ ID NO: 1356221 - protein, 9 aa, Homo Sapiens
ILLDEDAQA

SEQ ID NO: 1356222 - protein, 9 aa, Homo Sapiens
QILNFFHHS

SEQ ID NO: 1356223 - protein, 9 aa, Homo Sapiens
EGFERDLAT

SEQ ID NO: 1356224 - protein, 9 aa, Homo Sapiens
TGRDRRTEE

SEQ ID NO: 1356225 - protein, 9 aa, Homo Sapiens
AQDFWAQGV

SEQ ID NO: 1356226 - protein, 9 aa, Homo Sapiens
LPMSAATLG

SEQ ID NO: 1356227 - protein, 9 aa, Homo Sapiens
SREINYCIG

SEQ ID NO: 1356228 - protein, 9 aa, Homo Sapiens
SSRPNLRVI

SEQ ID NO: 1356229 - protein, 9 aa, Homo Sapiens
SNHYRGLAS

SEQ ID NO: 1356230 - protein, 9 aa, Homo Sapiens
VQSHRDGCS

SEQ ID NO: 1356231 - protein, 9 aa, Homo Sapiens
FSDFIMLRN

SEQ ID NO: 1356232 - protein, 9 aa, Homo Sapiens
KDRISVSSK

SEQ ID NO: 1356233 - protein, 9 aa, Homo Sapiens
LGFILISEL

SEQ ID NO: 1356234 - protein, 9 aa, Homo Sapiens
NVGMVVVTD

SEQ ID NO: 1356235 - protein, 9 aa, Homo Sapiens
VPSWQIMAV

SEQ ID NO: 1356236 - protein, 9 aa, Homo Sapiens
HSHLSVPRD

SEQ ID NO: 1356237 - protein, 9 aa, Homo Sapiens
CRHGDRCFR

SEQ ID NO: 1356238 - protein, 9 aa, Homo Sapiens
LPDSFYYSV

SEQ ID NO: 1356239 - protein, 9 aa, Homo Sapiens
KEWNPELIK

SEQ ID NO: 1356240 - protein, 9 aa, Homo Sapiens
GMVTQEGTL

SEQ ID NO: 1356241 - protein, 9 aa, Homo Sapiens
IVKSQHSCN

SEQ ID NO: 1356242 - protein, 9 aa, Homo Sapiens
TYRNPFVQE

SEQ ID NO: 1356243 - protein, 9 aa, Homo Sapiens
QPHSTTIIM

SEQ ID NO: 1356244 - protein, 9 aa, Homo Sapiens
LNKLKVLHP

SEQ ID NO: 1356245 - protein, 9 aa, Homo Sapiens
LDTSNDPGQ

SEQ ID NO: 1356246 - protein, 9 aa, Homo Sapiens
CRKGKLLAS

SEQ ID NO: 1356247 - protein, 9 aa, Homo Sapiens
VKDSCNTAL

SEQ ID NO: 1356248 - protein, 9 aa, Homo Sapiens
LHWHIVDNQ

SEQ ID NO: 1356249 - protein, 9 aa, Homo Sapiens
TQLAQHQMI

SEQ ID NO: 1356250 - protein, 9 aa, Homo Sapiens
RLQEEEVTP

SEQ ID NO: 1356251 - protein, 9 aa, Homo Sapiens
SAFPHGGEN

SEQ ID NO: 1356252 - protein, 9 aa, Homo Sapiens
LQDTPPKRH

SEQ ID NO: 1356253 - protein, 9 aa, Homo Sapiens
IPPSSRYLA

SEQ ID NO: 1356254 - protein, 9 aa, Homo Sapiens
KNSLKENLQ

SEQ ID NO: 1356255 - protein, 9 aa, Homo Sapiens
QESLVSEIH

SEQ ID NO: 1356256 - protein, 9 aa, Homo Sapiens
LYVAGAHFN

SEQ ID NO: 1356257 - protein, 9 aa, Homo Sapiens
PASIRTADF

SEQ ID NO: 1356258 - protein, 9 aa, Homo Sapiens
GGLSANNIP

SEQ ID NO: 1356259 - protein, 9 aa, Homo Sapiens
GCQDVHAAT

SEQ ID NO: 1356260 - protein, 9 aa, Homo Sapiens
GCAILVAKF

SEQ ID NO: 1356261 - protein, 9 aa, Homo Sapiens
VETGIGKST

SEQ ID NO: 1356262 - protein, 9 aa, Homo Sapiens
LKEYLPKNN

SEQ ID NO: 1356263 - protein, 9 aa, Homo Sapiens
SGTCSCAFA

SEQ ID NO: 1356264 - protein, 9 aa, Homo Sapiens
TNSGHKITP

SEQ ID NO: 1356265 - protein, 9 aa, Homo Sapiens
GTCSCAFAG

SEQ ID NO: 1356266 - protein, 9 aa, Homo Sapiens
QWDPKGEMA

SEQ ID NO: 1356267 - protein, 9 aa, Homo Sapiens
FYTVVTHRP

SEQ ID NO: 1356268 - protein, 9 aa, Homo Sapiens
TSYIWTFDP

SEQ ID NO: 1356269 - protein, 9 aa, Homo Sapiens
VQYETLPGW

SEQ ID NO: 1356270 - protein, 9 aa, Homo Sapiens
QLFQKEHQQ

SEQ ID NO: 1356271 - protein, 9 aa, Homo Sapiens
IMTTFSTGE

SEQ ID NO: 1356272 - protein, 9 aa, Homo Sapiens
EFIYYECLA

SEQ ID NO: 1356273 - protein, 9 aa, Homo Sapiens
LRVYLRNKS

SEQ ID NO: 1356274 - protein, 9 aa, Homo Sapiens
QNILFMLLN

SEQ ID NO: 1356275 - protein, 9 aa, Homo Sapiens
VQEKKVHPP

SEQ ID NO: 1356276 - protein, 9 aa, Homo Sapiens
NSASLIPSV

SEQ ID NO: 1356277 - protein, 9 aa, Homo Sapiens
DDDNVVGAT

SEQ ID NO: 1356278 - protein, 9 aa, Homo Sapiens
ETSVTSPLA

SEQ ID NO: 1356279 - protein, 9 aa, Homo Sapiens
QSHRDGCST

SEQ ID NO: 1356280 - protein, 9 aa, Homo Sapiens
MFITVVDSR

SEQ ID NO: 1356281 - protein, 9 aa, Homo Sapiens
LLAIRTVRV

SEQ ID NO: 1356282 - protein, 9 aa, Homo Sapiens
DPTSERLLP

SEQ ID NO: 1356283 - protein, 9 aa, Homo Sapiens
QDGVLDPSS

SEQ ID NO: 1356284 - protein, 9 aa, Homo Sapiens
VQPGLFSAS

SEQ ID NO: 1356285 - protein, 9 aa, Homo Sapiens
YSQKDTSKK

SEQ ID NO: 1356286 - protein, 9 aa, Homo Sapiens
DVKTVSGKL

SEQ ID NO: 1356287 - protein, 9 aa, Homo Sapiens
QKMLASSVL

SEQ ID NO: 1356288 - protein, 9 aa, Homo Sapiens
LSNTISRVP

SEQ ID NO: 1356289 - protein, 9 aa, Homo Sapiens
RTPSFTSQW

SEQ ID NO: 1356290 - protein, 9 aa, Homo Sapiens
VVGVFYGAA

SEQ ID NO: 1356291 - protein, 9 aa, Homo Sapiens
TSQWEEIDK

SEQ ID NO: 1356292 - protein, 9 aa, Homo Sapiens
EDEEGKVGQ

SEQ ID NO: 1356293 - protein, 9 aa, Homo Sapiens
VMQGTVITT

SEQ ID NO: 1356294 - protein, 9 aa, Homo Sapiens
ADLLAADFL

SEQ ID NO: 1356295 - protein, 9 aa, Homo Sapiens
LFNLIEARP

SEQ ID NO: 1356296 - protein, 9 aa, Homo Sapiens
ALEVNKGTN

SEQ ID NO: 1356297 - protein, 9 aa, Homo Sapiens
TFYRKTTTV

SEQ ID NO: 1356298 - protein, 9 aa, Homo Sapiens
SVYGPRAAE

SEQ ID NO: 1356299 - protein, 9 aa, Homo Sapiens
LTAVHGGSF

SEQ ID NO: 1356300 - protein, 9 aa, Homo Sapiens
FRASSPEGR

SEQ ID NO: 1356301 - protein, 9 aa, Homo Sapiens
NSLPQHMKE

SEQ ID NO: 1356302 - protein, 9 aa, Homo Sapiens
NQQLSVVRY

SEQ ID NO: 1356303 - protein, 9 aa, Homo Sapiens
EVQYETLPG

SEQ ID NO: 1356304 - protein, 9 aa, Homo Sapiens
NSLKENLQN

SEQ ID NO: 1356305 - protein, 9 aa, Homo Sapiens
LLLLEHLEC

SEQ ID NO: 1356306 - protein, 9 aa, Homo Sapiens
QIDFTEKSM

SEQ ID NO: 1356307 - protein, 9 aa, Homo Sapiens
EVRVCACTG

SEQ ID NO: 1356308 - protein, 9 aa, Homo Sapiens
KYALFLESV

SEQ ID NO: 1356309 - protein, 9 aa, Homo Sapiens
QDKLARKCE

SEQ ID NO: 1356310 - protein, 9 aa, Homo Sapiens
STQTYGKLR

SEQ ID NO: 1356311 - protein, 9 aa, Homo Sapiens
FDAEADQIC

SEQ ID NO: 1356312 - protein, 9 aa, Homo Sapiens
VGVFYGAAI

SEQ ID NO: 1356313 - protein, 9 aa, Homo Sapiens
NTVKTPTTL

SEQ ID NO: 1356314 - protein, 9 aa, Homo Sapiens
PGLGPCGSV

SEQ ID NO: 1356315 - protein, 9 aa, Homo Sapiens
NPSLLPVVI

SEQ ID NO: 1356316 - protein, 9 aa, Homo Sapiens
YMQLMNILK

SEQ ID NO: 1356317 - protein, 9 aa, Homo Sapiens
LIIFCFGTA

SEQ ID NO: 1356318 - protein, 9 aa, Homo Sapiens
KCQTESCWL

SEQ ID NO: 1356319 - protein, 9 aa, Homo Sapiens
SYYLNGNLH

SEQ ID NO: 1356320 - protein, 9 aa, Homo Sapiens
CVIQFMSRA

SEQ ID NO: 1356321 - protein, 9 aa, Homo Sapiens
GIIILSYKQ

SEQ ID NO: 1356322 - protein, 9 aa, Homo Sapiens
ELERGSNLA

SEQ ID NO: 1356323 - protein, 9 aa, Homo Sapiens
PSLLPVVIG

SEQ ID NO: 1356324 - protein, 9 aa, Homo Sapiens
IWTTKDEEF

SEQ ID NO: 1356325 - protein, 9 aa, Homo Sapiens
TVGFAGHSV

SEQ ID NO: 1356326 - protein, 9 aa, Homo Sapiens
RSAPRQAAL

SEQ ID NO: 1356327 - protein, 9 aa, Homo Sapiens
PIANMIKCV

SEQ ID NO: 1356328 - protein, 9 aa, Homo Sapiens
PDLNKKTQS

SEQ ID NO: 1356329 - protein, 9 aa, Homo Sapiens
KLCERVTNV

SEQ ID NO: 1356330 - protein, 9 aa, Homo Sapiens
VALQSLDSV

SEQ ID NO: 1356331 - protein, 9 aa, Homo Sapiens
SAGGLKAKG

SEQ ID NO: 1356332 - protein, 9 aa, Homo Sapiens
DNIVKLLDT

SEQ ID NO: 1356333 - protein, 9 aa, Homo Sapiens
DLKLDEVED

SEQ ID NO: 1356334 - protein, 9 aa, Homo Sapiens
VLDSYFQSL

SEQ ID NO: 1356335 - protein, 9 aa, Homo Sapiens
FDVHVGSRG

SEQ ID NO: 1356336 - protein, 9 aa, Homo Sapiens
RALAGIARN

SEQ ID NO: 1356337 - protein, 9 aa, Homo Sapiens
DHTIENNTD

SEQ ID NO: 1356338 - protein, 9 aa, Homo Sapiens
LGRTYRVVA

SEQ ID NO: 1356339 - protein, 9 aa, Homo Sapiens
AATNSQRVN

SEQ ID NO: 1356340 - protein, 9 aa, Homo Sapiens
TNKPDGYRV

SEQ ID NO: 1356341 - protein, 9 aa, Homo Sapiens
PWRIVWNVR

SEQ ID NO: 1356342 - protein, 9 aa, Homo Sapiens
TNAQDFWAQ

SEQ ID NO: 1356343 - protein, 9 aa, Homo Sapiens
IAKTANELA

SEQ ID NO: 1356344 - protein, 9 aa, Homo Sapiens
DNKKGAKKA

SEQ ID NO: 1356345 - protein, 9 aa, Homo Sapiens
HLPSDVIDQ

SEQ ID NO: 1356346 - protein, 9 aa, Homo Sapiens
VQEMGRLNK

SEQ ID NO: 1356347 - protein, 9 aa, Homo Sapiens
FRQNVHIVS

SEQ ID NO: 1356348 - protein, 9 aa, Homo Sapiens
SLDEATAAV

SEQ ID NO: 1356349 - protein, 9 aa, Homo Sapiens
KAFNEKTGF

SEQ ID NO: 1356350 - protein, 9 aa, Homo Sapiens
LKRKFNILT

SEQ ID NO: 1356351 - protein, 9 aa, Homo Sapiens
SKWGRTCHV

SEQ ID NO: 1356352 - protein, 9 aa, Homo Sapiens
DSSLVGLSR

SEQ ID NO: 1356353 - protein, 9 aa, Homo Sapiens
SAHAPKKGS

SEQ ID NO: 1356354 - protein, 9 aa, Homo Sapiens
FTRQIEDLK

SEQ ID NO: 1356355 - protein, 9 aa, Homo Sapiens
MQLMNILKP

SEQ ID NO: 1356356 - protein, 9 aa, Homo Sapiens
QQLSVVRYS

SEQ ID NO: 1356357 - protein, 9 aa, Homo Sapiens
IRTADFHNP

SEQ ID NO: 1356358 - protein, 9 aa, Homo Sapiens
VLTLLFFGL

SEQ ID NO: 1356359 - protein, 9 aa, Homo Sapiens
LTKCQLADT

SEQ ID NO: 1356360 - protein, 9 aa, Homo Sapiens
EVALVTLQS

SEQ ID NO: 1356361 - protein, 9 aa, Homo Sapiens
QYKVCNNNG

SEQ ID NO: 1356362 - protein, 9 aa, Homo Sapiens
NNRDSIKNF

SEQ ID NO: 1356363 - protein, 9 aa, Homo Sapiens
YRQQEEILR

SEQ ID NO: 1356364 - protein, 9 aa, Homo Sapiens
GEILTITVV

SEQ ID NO: 1356365 - protein, 9 aa, Homo Sapiens
QFWQYGECV

SEQ ID NO: 1356366 - protein, 9 aa, Homo Sapiens
GWKFNHLEL

SEQ ID NO: 1356367 - protein, 9 aa, Homo Sapiens
IVVLLHTDH

SEQ ID NO: 1356368 - protein, 9 aa, Homo Sapiens
KQKESLKNI

SEQ ID NO: 1356369 - protein, 9 aa, Homo Sapiens
LDQSLEMSN

SEQ ID NO: 1356370 - protein, 9 aa, Homo Sapiens
ALCGAFTGF

SEQ ID NO: 1356371 - protein, 9 aa, Homo Sapiens
NLLFGYKNP

SEQ ID NO: 1356372 - protein, 9 aa, Homo Sapiens
EVEFNVSQA

SEQ ID NO: 1356373 - protein, 9 aa, Homo Sapiens
WLEQKHCWL

SEQ ID NO: 1356374 - protein, 9 aa, Homo Sapiens
RYSYYLNGN

SEQ ID NO: 1356375 - protein, 9 aa, Homo Sapiens
HKEPTWESS

SEQ ID NO: 1356376 - protein, 9 aa, Homo Sapiens
YLHESTQDK

SEQ ID NO: 1356377 - protein, 9 aa, Homo Sapiens
PTWRYSYYL

SEQ ID NO: 1356378 - protein, 9 aa, Homo Sapiens
SIEQYKAHV

SEQ ID NO: 1356379 - protein, 9 aa, Homo Sapiens
HHCRCQSSN

SEQ ID NO: 1356380 - protein, 9 aa, Homo Sapiens
SKHNVTKLL

SEQ ID NO: 1356381 - protein, 9 aa, Homo Sapiens
TISRVPAGL

SEQ ID NO: 1356382 - protein, 9 aa, Homo Sapiens
VSVDPTSER

SEQ ID NO: 1356383 - protein, 9 aa, Homo Sapiens
TQRQRKLIT

SEQ ID NO: 1356384 - protein, 9 aa, Homo Sapiens
VQLLELSEA

SEQ ID NO: 1356385 - protein, 9 aa, Homo Sapiens
LTESPYSDA

SEQ ID NO: 1356386 - protein, 9 aa, Homo Sapiens
QGKQISKGN

SEQ ID NO: 1356387 - protein, 9 aa, Homo Sapiens
MTYAAIFAV

SEQ ID NO: 1356388 - protein, 9 aa, Homo Sapiens
IEIPPRRRP

SEQ ID NO: 1356389 - protein, 9 aa, Homo Sapiens
PKAKSTRNI

SEQ ID NO: 1356390 - protein, 9 aa, Homo Sapiens
MLSPNNTIV

SEQ ID NO: 1356391 - protein, 9 aa, Homo Sapiens
NSSTHGPIL

SEQ ID NO: 1356392 - protein, 9 aa, Homo Sapiens
QKVFNFCTS

SEQ ID NO: 1356393 - protein, 9 aa, Homo Sapiens
SCGEDGTVM

SEQ ID NO: 1356394 - protein, 9 aa, Homo Sapiens
DVGQIFYCR

SEQ ID NO: 1356395 - protein, 9 aa, Homo Sapiens
GELFDEPMF

SEQ ID NO: 1356396 - protein, 9 aa, Homo Sapiens
NTCSVFGQA

SEQ ID NO: 1356397 - protein, 9 aa, Homo Sapiens
KLQIQKKIF

SEQ ID NO: 1356398 - protein, 9 aa, Homo Sapiens
EIVQLVGNA

SEQ ID NO: 1356399 - protein, 9 aa, Homo Sapiens
WRLGASVIG

SEQ ID NO: 1356400 - protein, 9 aa, Homo Sapiens
TNDLREFVL

SEQ ID NO: 1356401 - protein, 9 aa, Homo Sapiens
ENDLDLFSD

SEQ ID NO: 1356402 - protein, 9 aa, Homo Sapiens
SKEGRYVKN

SEQ ID NO: 1356403 - protein, 9 aa, Homo Sapiens
GYTYRNPFV

SEQ ID NO: 1356404 - protein, 9 aa, Homo Sapiens
VEERHNAYL

SEQ ID NO: 1356405 - protein, 9 aa, Homo Sapiens
THILLDEDA

SEQ ID NO: 1356406 - protein, 9 aa, Homo Sapiens
HYNEEFNIK

SEQ ID NO: 1356407 - protein, 9 aa, Homo Sapiens
KEQNFYWSQ

SEQ ID NO: 1356408 - protein, 9 aa, Homo Sapiens
PCGSVKAPS

SEQ ID NO: 1356409 - protein, 9 aa, Homo Sapiens
FPHGYYSTT

SEQ ID NO: 1356410 - protein, 9 aa, Homo Sapiens
FDVHTTLKL

SEQ ID NO: 1356411 - protein, 9 aa, Homo Sapiens
TDQCYNYIR

SEQ ID NO: 1356412 - protein, 9 aa, Homo Sapiens
FCVFDSNAI

SEQ ID NO: 1356413 - protein, 9 aa, Homo Sapiens
RPSLHQLKN

SEQ ID NO: 1356414 - protein, 9 aa, Homo Sapiens
ANCVNIHMM

SEQ ID NO: 1356415 - protein, 9 aa, Homo Sapiens
NSETSSVAK

SEQ ID NO: 1356416 - protein, 9 aa, Homo Sapiens
SGAKQSLLM

SEQ ID NO: 1356417 - protein, 9 aa, Homo Sapiens
LFALDTSND

SEQ ID NO: 1356418 - protein, 9 aa, Homo Sapiens
CTCKVHFPN

SEQ ID NO: 1356419 - protein, 9 aa, Homo Sapiens
NYDSKKHKQ

SEQ ID NO: 1356420 - protein, 9 aa, Homo Sapiens
IDGQIFLLF

SEQ ID NO: 1356421 - protein, 9 aa, Homo Sapiens
THTGVSTWH

SEQ ID NO: 1356422 - protein, 9 aa, Homo Sapiens
YYLNGNLHL

SEQ ID NO: 1356423 - protein, 9 aa, Homo Sapiens
CSCAFAGWE

SEQ ID NO: 1356424 - protein, 9 aa, Homo Sapiens
KKWSKVENT

SEQ ID NO: 1356425 - protein, 9 aa, Homo Sapiens
KLLIELEDL

SEQ ID NO: 1356426 - protein, 9 aa, Homo Sapiens
VQVKFDWNH

SEQ ID NO: 1356427 - protein, 9 aa, Homo Sapiens
LTLPLQRLQ

SEQ ID NO: 1356428 - protein, 9 aa, Homo Sapiens
KVFNFCTSH

SEQ ID NO: 1356429 - protein, 9 aa, Homo Sapiens
CSVSHHRPR

SEQ ID NO: 1356430 - protein, 9 aa, Homo Sapiens
LTEPLWRLG

SEQ ID NO: 1356431 - protein, 9 aa, Homo Sapiens
LNTDLEKKS

SEQ ID NO: 1356432 - protein, 9 aa, Homo Sapiens
RKFNILTRP

SEQ ID NO: 1356433 - protein, 9 aa, Homo Sapiens
RKKRGIPMT

SEQ ID NO: 1356434 - protein, 9 aa, Homo Sapiens
YKDGMKLGH

SEQ ID NO: 1356435 - protein, 9 aa, Homo Sapiens
AGSNRSWDL

SEQ ID NO: 1356436 - protein, 9 aa, Homo Sapiens
AALRAARSP

SEQ ID NO: 1356437 - protein, 9 aa, Homo Sapiens
KNYSNFISL

SEQ ID NO: 1356438 - protein, 9 aa, Homo Sapiens
RLQGTDPGT

SEQ ID NO: 1356439 - protein, 9 aa, Homo Sapiens
KALQGFFHR

SEQ ID NO: 1356440 - protein, 9 aa, Homo Sapiens
HTGVSTWHD

SEQ ID NO: 1356441 - protein, 9 aa, Homo Sapiens
CEPRIQQEE

SEQ ID NO: 1356442 - protein, 9 aa, Homo Sapiens
LCGGLSANN

SEQ ID NO: 1356443 - protein, 9 aa, Homo Sapiens
AAFAFAGAV

SEQ ID NO: 1356444 - protein, 9 aa, Homo Sapiens
GTREASNTD

SEQ ID NO: 1356445 - protein, 9 aa, Homo Sapiens
IRHHAKYMN

SEQ ID NO: 1356446 - protein, 9 aa, Homo Sapiens
RMHTAEKPY

SEQ ID NO: 1356447 - protein, 9 aa, Homo Sapiens
AVPMKDVTV

SEQ ID NO: 1356448 - protein, 9 aa, Homo Sapiens
FESLTKLQH

SEQ ID NO: 1356449 - protein, 9 aa, Homo Sapiens
KDWVFTAAH

SEQ ID NO: 1356450 - protein, 9 aa, Homo Sapiens
LSKLEKKEL

SEQ ID NO: 1356451 - protein, 9 aa, Homo Sapiens
QGIAVLNIT

SEQ ID NO: 1356452 - protein, 9 aa, Homo Sapiens
QDTFRYSHN

SEQ ID NO: 1356453 - protein, 9 aa, Homo Sapiens
HCRCQSSNS

SEQ ID NO: 1356454 - protein, 9 aa, Homo Sapiens
MMSLLALFN

SEQ ID NO: 1356455 - protein, 9 aa, Homo Sapiens
QDDELWKKQ

SEQ ID NO: 1356456 - protein, 9 aa, Homo Sapiens
GVACIAANV

SEQ ID NO: 1356457 - protein, 9 aa, Homo Sapiens
HSSDEPAEK

SEQ ID NO: 1356458 - protein, 9 aa, Homo Sapiens
SNVKRTRNL

SEQ ID NO: 1356459 - protein, 9 aa, Homo Sapiens
EILRLRELL

SEQ ID NO: 1356460 - protein, 9 aa, Homo Sapiens
YKSKSQKLS

SEQ ID NO: 1356461 - protein, 9 aa, Homo Sapiens
IQDFVRHVE

SEQ ID NO: 1356462 - protein, 9 aa, Homo Sapiens
TGPSAAQEV

SEQ ID NO: 1356463 - protein, 9 aa, Homo Sapiens
QLPENLTEL

SEQ ID NO: 1356464 - protein, 9 aa, Homo Sapiens
LARGVKIRF

SEQ ID NO: 1356465 - protein, 9 aa, Homo Sapiens
ELINLKQHL

SEQ ID NO: 1356466 - protein, 9 aa, Homo Sapiens
TNNTGNIIT

SEQ ID NO: 1356467 - protein, 9 aa, Homo Sapiens
DWEHSQGLK

SEQ ID NO: 1356468 - protein, 9 aa, Homo Sapiens
GGIAPSYDQ

SEQ ID NO: 1356469 - protein, 9 aa, Homo Sapiens
VDDIHQRFL

SEQ ID NO: 1356470 - protein, 9 aa, Homo Sapiens
IEQYKAHVS

SEQ ID NO: 1356471 - protein, 9 aa, Homo Sapiens
ALQWDPKGE

SEQ ID NO: 1356472 - protein, 9 aa, Homo Sapiens
GQLDCILPH

SEQ ID NO: 1356473 - protein, 9 aa, Homo Sapiens
LLYKTLCLH

SEQ ID NO: 1356474 - protein, 9 aa, Homo Sapiens
FFHREGEEL

SEQ ID NO: 1356475 - protein, 9 aa, Homo Sapiens
YQEIAVEHL

SEQ ID NO: 1356476 - protein, 9 aa, Homo Sapiens
PPALRPALQ

SEQ ID NO: 1356477 - protein, 9 aa, Homo Sapiens
YRDVMWKNY

SEQ ID NO: 1356478 - protein, 9 aa, Homo Sapiens
LFETSEHKV

SEQ ID NO: 1356479 - protein, 9 aa, Homo Sapiens
LSELCPNLN

SEQ ID NO: 1356480 - protein, 9 aa, Homo Sapiens
FYYSVLLQK

SEQ ID NO: 1356481 - protein, 9 aa, Homo Sapiens
HTHHASLIC

SEQ ID NO: 1356482 - protein, 9 aa, Homo Sapiens
FESLDEATA

SEQ ID NO: 1356483 - protein, 9 aa, Homo Sapiens
KRILLLEQL

SEQ ID NO: 1356484 - protein, 9 aa, Homo Sapiens
QGFFHREGE

SEQ ID NO: 1356485 - protein, 9 aa, Homo Sapiens
WTFNWQALK

SEQ ID NO: 1356486 - protein, 9 aa, Homo Sapiens
SPAFRLRSA

SEQ ID NO: 1356487 - protein, 9 aa, Homo Sapiens
DSQEISFEA

SEQ ID NO: 1356488 - protein, 9 aa, Homo Sapiens
RIPTMVLDD

SEQ ID NO: 1356489 - protein, 9 aa, Homo Sapiens
HKRTHTVER

SEQ ID NO: 1356490 - protein, 9 aa, Homo Sapiens
PALFKNPTL

SEQ ID NO: 1356491 - protein, 9 aa, Homo Sapiens
ETSAAALLP

SEQ ID NO: 1356492 - protein, 9 aa, Homo Sapiens
LATKNSKLV

SEQ ID NO: 1356493 - protein, 9 aa, Homo Sapiens
DNQSFPYQS

SEQ ID NO: 1356494 - protein, 9 aa, Homo Sapiens
ARPCSPISR

SEQ ID NO: 1356495 - protein, 9 aa, Homo Sapiens
PFEPAERSA

SEQ ID NO: 1356496 - protein, 9 aa, Homo Sapiens
QEPQRKFLE

SEQ ID NO: 1356497 - protein, 9 aa, Homo Sapiens
SDDGSEEDK

SEQ ID NO: 1356498 - protein, 9 aa, Homo Sapiens
SIMTTFSTG

SEQ ID NO: 1356499 - protein, 9 aa, Homo Sapiens
LPGHVKDSC

SEQ ID NO: 1356500 - protein, 9 aa, Homo Sapiens
FIFMCHRCG

SEQ ID NO: 1356501 - protein, 9 aa, Homo Sapiens
NVHIVSHLR

SEQ ID NO: 1356502 - protein, 9 aa, Homo Sapiens
LASIVAPLL

SEQ ID NO: 1356503 - protein, 9 aa, Homo Sapiens
NTEEKPYKC

SEQ ID NO: 1356504 - protein, 9 aa, Homo Sapiens
SAAGEIEYE

SEQ ID NO: 1356505 - protein, 9 aa, Homo Sapiens
NSTASVSKA

SEQ ID NO: 1356506 - protein, 9 aa, Homo Sapiens
LDHIIYFFL

SEQ ID NO: 1356507 - protein, 9 aa, Homo Sapiens
NDWEHSQGL

SEQ ID NO: 1356508 - protein, 9 aa, Homo Sapiens
ELHELEEET

SEQ ID NO: 1356509 - protein, 9 aa, Homo Sapiens
PGNHCPGDL

SEQ ID NO: 1356510 - protein, 9 aa, Homo Sapiens
CIPFLTSLL

SEQ ID NO: 1356511 - protein, 9 aa, Homo Sapiens
YQSVPVYQM

SEQ ID NO: 1356512 - protein, 9 aa, Homo Sapiens
PPEAFGFQQ

SEQ ID NO: 1356513 - protein, 9 aa, Homo Sapiens
QGKEPWPLQ

SEQ ID NO: 1356514 - protein, 9 aa, Homo Sapiens
GRFGAPVSA

SEQ ID NO: 1356515 - protein, 9 aa, Homo Sapiens
DLWVPARHS

SEQ ID NO: 1356516 - protein, 9 aa, Homo Sapiens
VAKGPNYLT

SEQ ID NO: 1356517 - protein, 9 aa, Homo Sapiens
NIISFIRGT

SEQ ID NO: 1356518 - protein, 9 aa, Homo Sapiens
LCSQVKLGS

SEQ ID NO: 1356519 - protein, 9 aa, Homo Sapiens
TSAEQLDAT

SEQ ID NO: 1356520 - protein, 9 aa, Homo Sapiens
PFNQPLDQN

SEQ ID NO: 1356521 - protein, 9 aa, Homo Sapiens
KNDNKNILT

SEQ ID NO: 1356522 - protein, 9 aa, Homo Sapiens
QISRQPLGA

SEQ ID NO: 1356523 - protein, 9 aa, Homo Sapiens
KHKIIHTIE

SEQ ID NO: 1356524 - protein, 9 aa, Homo Sapiens
LVQEMGRLN

SEQ ID NO: 1356525 - protein, 9 aa, Homo Sapiens
FKREVHLDP

SEQ ID NO: 1356526 - protein, 9 aa, Homo Sapiens
LAFPHGYYS

SEQ ID NO: 1356527 - protein, 9 aa, Homo Sapiens
TIQDLETEN

SEQ ID NO: 1356528 - protein, 9 aa, Homo Sapiens
EFYQDDELW

SEQ ID NO: 1356529 - protein, 9 aa, Homo Sapiens
VEKPYECTE

SEQ ID NO: 1356530 - protein, 9 aa, Homo Sapiens
VEQDFIDLT

SEQ ID NO: 1356531 - protein, 9 aa, Homo Sapiens
ELYKKGIEE

SEQ ID NO: 1356532 - protein, 9 aa, Homo Sapiens
KEDFYLNTW

SEQ ID NO: 1356533 - protein, 9 aa, Homo Sapiens
ELSSIQSTL

SEQ ID NO: 1356534 - protein, 9 aa, Homo Sapiens
TEENKHVAK

SEQ ID NO: 1356535 - protein, 9 aa, Homo Sapiens
FQDKLEGLQ

SEQ ID NO: 1356536 - protein, 9 aa, Homo Sapiens
NNFPAGSHE

SEQ ID NO: 1356537 - protein, 9 aa, Homo Sapiens
SWGWSRTLS

SEQ ID NO: 1356538 - protein, 9 aa, Homo Sapiens
FFSRRAEEN

SEQ ID NO: 1356539 - protein, 9 aa, Homo Sapiens
AGSGGQLDC

SEQ ID NO: 1356540 - protein, 9 aa, Homo Sapiens
SRLNLLMIR

SEQ ID NO: 1356541 - protein, 9 aa, Homo Sapiens
KVKECKTHL

SEQ ID NO: 1356542 - protein, 9 aa, Homo Sapiens
RNVADNKKG

SEQ ID NO: 1356543 - protein, 9 aa, Homo Sapiens
VEFDVHVGS

SEQ ID NO: 1356544 - protein, 9 aa, Homo Sapiens
AKTANELAS

SEQ ID NO: 1356545 - protein, 9 aa, Homo Sapiens
RCRRSHHCR

SEQ ID NO: 1356546 - protein, 9 aa, Homo Sapiens
QSLEMSNTL

SEQ ID NO: 1356547 - protein, 9 aa, Homo Sapiens
MCHRCGKQF

SEQ ID NO: 1356548 - protein, 9 aa, Homo Sapiens
QRLHHGEKA

SEQ ID NO: 1356549 - protein, 9 aa, Homo Sapiens
LSAQPHCQQ

SEQ ID NO: 1356550 - protein, 9 aa, Homo Sapiens
YYFAKHLWP

SEQ ID NO: 1356551 - protein, 9 aa, Homo Sapiens
EDDGDATRS

SEQ ID NO: 1356552 - protein, 9 aa, Homo Sapiens
NAYLKPFRV

SEQ ID NO: 1356553 - protein, 9 aa, Homo Sapiens
LFKQKESLK

SEQ ID NO: 1356554 - protein, 9 aa, Homo Sapiens
HYQFGMTKT

SEQ ID NO: 1356555 - protein, 9 aa, Homo Sapiens
NWEDHLRLL

SEQ ID NO: 1356556 - protein, 9 aa, Homo Sapiens
KNGSLVHVN

SEQ ID NO: 1356557 - protein, 9 aa, Homo Sapiens
ILDGLDKCR

SEQ ID NO: 1356558 - protein, 9 aa, Homo Sapiens
VQVADSRVI

SEQ ID NO: 1356559 - protein, 9 aa, Homo Sapiens
QIQKKIFSK

SEQ ID NO: 1356560 - protein, 9 aa, Homo Sapiens
RSFFNLFHL

SEQ ID NO: 1356561 - protein, 9 aa, Homo Sapiens
SNTPDMEQR

SEQ ID NO: 1356562 - protein, 9 aa, Homo Sapiens
LTSYIWTFD

SEQ ID NO: 1356563 - protein, 9 aa, Homo Sapiens
LMMSLLALF

SEQ ID NO: 1356564 - protein, 9 aa, Homo Sapiens
KGCDMFAGH

SEQ ID NO: 1356565 - protein, 9 aa, Homo Sapiens
QIAKYDGKW

SEQ ID NO: 1356566 - protein, 9 aa, Homo Sapiens
IQAIIITMH

SEQ ID NO: 1356567 - protein, 9 aa, Homo Sapiens
IEIKKRSPI

SEQ ID NO: 1356568 - protein, 9 aa, Homo Sapiens
CLSVTSEQI

SEQ ID NO: 1356569 - protein, 9 aa, Homo Sapiens
SVLCKIKEK

SEQ ID NO: 1356570 - protein, 9 aa, Homo Sapiens
HLDLVPKTE

SEQ ID NO: 1356571 - protein, 9 aa, Homo Sapiens
HFESKIEIP

SEQ ID NO: 1356572 - protein, 9 aa, Homo Sapiens
FTAAHCNLN

SEQ ID NO: 1356573 - protein, 9 aa, Homo Sapiens
LRLQKMLAS

SEQ ID NO: 1356574 - protein, 9 aa, Homo Sapiens
TNVLNWVRE

SEQ ID NO: 1356575 - protein, 9 aa, Homo Sapiens
KNRLLGTFF

SEQ ID NO: 1356576 - protein, 9 aa, Homo Sapiens
YGPRAAEEE

SEQ ID NO: 1356577 - protein, 9 aa, Homo Sapiens
TLNDAVSYK

SEQ ID NO: 1356578 - protein, 9 aa, Homo Sapiens
PVNISDNCG

SEQ ID NO: 1356579 - protein, 9 aa, Homo Sapiens
ASKAWEVDV

SEQ ID NO: 1356580 - protein, 9 aa, Homo Sapiens
KKQEVDSAQ

SEQ ID NO: 1356581 - protein, 9 aa, Homo Sapiens
EQEMIASPK

SEQ ID NO: 1356582 - protein, 9 aa, Homo Sapiens
VLATHLAAL

SEQ ID NO: 1356583 - protein, 9 aa, Homo Sapiens
QHFIFMCHR

SEQ ID NO: 1356584 - protein, 9 aa, Homo Sapiens
DNFYTVVTH

SEQ ID NO: 1356585 - protein, 9 aa, Homo Sapiens
KRMGRRSTK

SEQ ID NO: 1356586 - protein, 9 aa, Homo Sapiens
KKRLLQLLR

SEQ ID NO: 1356587 - protein, 9 aa, Homo Sapiens
DDKIHSIAW

SEQ ID NO: 1356588 - protein, 9 aa, Homo Sapiens
AKSSSFIVI

SEQ ID NO: 1356589 - protein, 9 aa, Homo Sapiens
WGRTCHVNL

SEQ ID NO: 1356590 - protein, 9 aa, Homo Sapiens
GESEPATAA

SEQ ID NO: 1356591 - protein, 9 aa, Homo Sapiens
ASAIMQCST

SEQ ID NO: 1356592 - protein, 9 aa, Homo Sapiens
LTHLGSLVH

SEQ ID NO: 1356593 - protein, 9 aa, Homo Sapiens
SHPRAAYGT

SEQ ID NO: 1356594 - protein, 9 aa, Homo Sapiens
SVVYAGWPI

SEQ ID NO: 1356595 - protein, 9 aa, Homo Sapiens
LSAIFEGSK

SEQ ID NO: 1356596 - protein, 9 aa, Homo Sapiens
IVLPSIVIL

SEQ ID NO: 1356597 - protein, 9 aa, Homo Sapiens
KNMYSQDNQ

SEQ ID NO: 1356598 - protein, 9 aa, Homo Sapiens
LDKYANKSV

SEQ ID NO: 1356599 - protein, 9 aa, Homo Sapiens
VTLQSVKEM

SEQ ID NO: 1356600 - protein, 9 aa, Homo Sapiens
QVYFLHTHT

SEQ ID NO: 1356601 - protein, 9 aa, Homo Sapiens
HILLDEDAQ

SEQ ID NO: 1356602 - protein, 9 aa, Homo Sapiens
SKAGSLPAF

SEQ ID NO: 1356603 - protein, 9 aa, Homo Sapiens
MMVCQVGCI

SEQ ID NO: 1356604 - protein, 9 aa, Homo Sapiens
VDYRLPTKN

SEQ ID NO: 1356605 - protein, 9 aa, Homo Sapiens
TFNWQALKN

SEQ ID NO: 1356606 - protein, 9 aa, Homo Sapiens
GSPELINLK

SEQ ID NO: 1356607 - protein, 9 aa, Homo Sapiens
STTIIMRDP

SEQ ID NO: 1356608 - protein, 9 aa, Homo Sapiens
AVSYKAQIN

SEQ ID NO: 1356609 - protein, 9 aa, Homo Sapiens
DARKNCMIG

SEQ ID NO: 1356610 - protein, 9 aa, Homo Sapiens
HNGFCMFDM

SEQ ID NO: 1356611 - protein, 9 aa, Homo Sapiens
DKFERTCLH

SEQ ID NO: 1356612 - protein, 9 aa, Homo Sapiens
VKSQHSCNA

SEQ ID NO: 1356613 - protein, 9 aa, Homo Sapiens
VHESLLQIP

SEQ ID NO: 1356614 - protein, 9 aa, Homo Sapiens
LFDKVVWNK

SEQ ID NO: 1356615 - protein, 9 aa, Homo Sapiens
IFGQTIINH

SEQ ID NO: 1356616 - protein, 9 aa, Homo Sapiens
LKYVKIPVR

SEQ ID NO: 1356617 - protein, 9 aa, Homo Sapiens
EQRAKMPQT

SEQ ID NO: 1356618 - protein, 9 aa, Homo Sapiens
HYRGLASAN

SEQ ID NO: 1356619 - protein, 9 aa, Homo Sapiens
LLDQPENTF

SEQ ID NO: 1356620 - protein, 9 aa, Homo Sapiens
DFLNTTPLP

SEQ ID NO: 1356621 - protein, 9 aa, Homo Sapiens
LQLQDLLTL

SEQ ID NO: 1356622 - protein, 9 aa, Homo Sapiens
GNHCPGDLI

SEQ ID NO: 1356623 - protein, 9 aa, Homo Sapiens
QDLLTLPLQ

SEQ ID NO: 1356624 - protein, 9 aa, Homo Sapiens
AALLPMSAA

SEQ ID NO: 1356625 - protein, 9 aa, Homo Sapiens
QKDNAEIRV

SEQ ID NO: 1356626 - protein, 9 aa, Homo Sapiens
GVWQEFEVA

SEQ ID NO: 1356627 - protein, 9 aa, Homo Sapiens
CGEDGTVMW

SEQ ID NO: 1356628 - protein, 9 aa, Homo Sapiens
AVSSQLYPP

SEQ ID NO: 1356629 - protein, 9 aa, Homo Sapiens
RYTIRSPVL

SEQ ID NO: 1356630 - protein, 9 aa, Homo Sapiens
PSDVIDQNL

SEQ ID NO: 1356631 - protein, 9 aa, Homo Sapiens
TKKIRNIIY

SEQ ID NO: 1356632 - protein, 9 aa, Homo Sapiens
LIELEDLSD

SEQ ID NO: 1356633 - protein, 9 aa, Homo Sapiens
RNADLKLDE

SEQ ID NO: 1356634 - protein, 9 aa, Homo Sapiens
KIIQDFENS

SEQ ID NO: 1356635 - protein, 9 aa, Homo Sapiens
RESGTHCPL

SEQ ID NO: 1356636 - protein, 9 aa, Homo Sapiens
TWPIFIFEI

SEQ ID NO: 1356637 - protein, 9 aa, Homo Sapiens
RCTLWSRLN

SEQ ID NO: 1356638 - protein, 9 aa, Homo Sapiens
LSDYEPKVK

SEQ ID NO: 1356639 - protein, 9 aa, Homo Sapiens
SPISRELLR

SEQ ID NO: 1356640 - protein, 9 aa, Homo Sapiens
FLIAVSSQL

SEQ ID NO: 1356641 - protein, 9 aa, Homo Sapiens
WNKRLKEAT

SEQ ID NO: 1356642 - protein, 9 aa, Homo Sapiens
SGFGSSNTC

SEQ ID NO: 1356643 - protein, 9 aa, Homo Sapiens
KQLVINVSK

SEQ ID NO: 1356644 - protein, 9 aa, Homo Sapiens
HQRMHTAEK

SEQ ID NO: 1356645 - protein, 9 aa, Homo Sapiens
ESGTHCPLC

SEQ ID NO: 1356646 - protein, 9 aa, Homo Sapiens
FTFRSSAQI

SEQ ID NO: 1356647 - protein, 9 aa, Homo Sapiens
NIVVLLHTD

SEQ ID NO: 1356648 - protein, 9 aa, Homo Sapiens
SLVSEIHSL

SEQ ID NO: 1356649 - protein, 9 aa, Homo Sapiens
CKFYTQDVG

SEQ ID NO: 1356650 - protein, 9 aa, Homo Sapiens
EDKDMNGFS

SEQ ID NO: 1356651 - protein, 9 aa, Homo Sapiens
LKLMRSVSE

SEQ ID NO: 1356652 - protein, 9 aa, Homo Sapiens
PELSYGIPQ

SEQ ID NO: 1356653 - protein, 9 aa, Homo Sapiens
NTDLEKKSI

SEQ ID NO: 1356654 - protein, 9 aa, Homo Sapiens
SSHAFGESH

SEQ ID NO: 1356655 - protein, 9 aa, Homo Sapiens
EQSHQQSIP

SEQ ID NO: 1356656 - protein, 9 aa, Homo Sapiens
FLYKLKKAS

SEQ ID NO: 1356657 - protein, 9 aa, Homo Sapiens
PMNCDCELY

SEQ ID NO: 1356658 - protein, 9 aa, Homo Sapiens
DGNQQLSVV

SEQ ID NO: 1356659 - protein, 9 aa, Homo Sapiens
TQGDSFTSE

SEQ ID NO: 1356660 - protein, 9 aa, Homo Sapiens
DSVSNTPDM

SEQ ID NO: 1356661 - protein, 9 aa, Homo Sapiens
EDEAIVMQG

SEQ ID NO: 1356662 - protein, 9 aa, Homo Sapiens
PVEWALCGA

SEQ ID NO: 1356663 - protein, 9 aa, Homo Sapiens
FGKLLMEAD

SEQ ID NO: 1356664 - protein, 9 aa, Homo Sapiens
LSVAKGPNY

SEQ ID NO: 1356665 - protein, 9 aa, Homo Sapiens
QHGSGQIQI

SEQ ID NO: 1356666 - protein, 9 aa, Homo Sapiens
EMSNTLTNE

SEQ ID NO: 1356667 - protein, 9 aa, Homo Sapiens
NGCRKAFNE

SEQ ID NO: 1356668 - protein, 9 aa, Homo Sapiens
GDDGFCVFD

SEQ ID NO: 1356669 - protein, 9 aa, Homo Sapiens
YFLHTHTGV

SEQ ID NO: 1356670 - protein, 9 aa, Homo Sapiens
LCETTVILS

SEQ ID NO: 1356671 - protein, 9 aa, Homo Sapiens
YIEVKDVND

SEQ ID NO: 1356672 - protein, 9 aa, Homo Sapiens
MSFVGLASG

SEQ ID NO: 1356673 - protein, 9 aa, Homo Sapiens
HPKLVFSKE

SEQ ID NO: 1356674 - protein, 9 aa, Homo Sapiens
SVSNTPDME

SEQ ID NO: 1356675 - protein, 9 aa, Homo Sapiens
ILNFFHHSC

SEQ ID NO: 1356676 - protein, 9 aa, Homo Sapiens
AASAPPAFS

SEQ ID NO: 1356677 - protein, 9 aa, Homo Sapiens
EFWLACQDF

SEQ ID NO: 1356678 - protein, 9 aa, Homo Sapiens
LFGVTIFYS

SEQ ID NO: 1356679 - protein, 9 aa, Homo Sapiens
QDLYALKYV

SEQ ID NO: 1356680 - protein, 9 aa, Homo Sapiens
DIVCSDLNK

SEQ ID NO: 1356681 - protein, 9 aa, Homo Sapiens
YTLSQEKYH

SEQ ID NO: 1356682 - protein, 9 aa, Homo Sapiens
PDTQRQRKL

SEQ ID NO: 1356683 - protein, 9 aa, Homo Sapiens
LYALKYVKI

SEQ ID NO: 1356684 - protein, 9 aa, Homo Sapiens
AGCNPELRD

SEQ ID NO: 1356685 - protein, 9 aa, Homo Sapiens
SLLGLIIFC

SEQ ID NO: 1356686 - protein, 9 aa, Homo Sapiens
NGSLVHVNI

SEQ ID NO: 1356687 - protein, 9 aa, Homo Sapiens
NDNKNILTT

SEQ ID NO: 1356688 - protein, 9 aa, Homo Sapiens
HKNMQQHFE

SEQ ID NO: 1356689 - protein, 9 aa, Homo Sapiens
LFDEPMFIT

SEQ ID NO: 1356690 - protein, 9 aa, Homo Sapiens
SNAEKKQLC

SEQ ID NO: 1356691 - protein, 9 aa, Homo Sapiens
KQLCFDDEL

SEQ ID NO: 1356692 - protein, 9 aa, Homo Sapiens
LLDTRSCKA

SEQ ID NO: 1356693 - protein, 9 aa, Homo Sapiens
YRIHLDLVP

SEQ ID NO: 1356694 - protein, 9 aa, Homo Sapiens
FESKIEIPP

SEQ ID NO: 1356695 - protein, 9 aa, Homo Sapiens
WYKDGMKLG

SEQ ID NO: 1356696 - protein, 9 aa, Homo Sapiens
LVAASAPPA

SEQ ID NO: 1356697 - protein, 9 aa, Homo Sapiens
VEAYGKKFD

SEQ ID NO: 1356698 - protein, 9 aa, Homo Sapiens
LCEGAFGKV

SEQ ID NO: 1356699 - protein, 9 aa, Homo Sapiens
GPPPALPEY

SEQ ID NO: 1356700 - protein, 9 aa, Homo Sapiens
LAALRAARS

SEQ ID NO: 1356701 - protein, 9 aa, Homo Sapiens
PLGVPASAT

SEQ ID NO: 1356702 - protein, 9 aa, Homo Sapiens
QDFWAQGVL

SEQ ID NO: 1356703 - protein, 9 aa, Homo Sapiens
AQDPQVLNQ

SEQ ID NO: 1356704 - protein, 9 aa, Homo Sapiens
VERPYECNE

SEQ ID NO: 1356705 - protein, 9 aa, Homo Sapiens
CFGTAFMNS

SEQ ID NO: 1356706 - protein, 9 aa, Homo Sapiens
AVKTTPTQR

SEQ ID NO: 1356707 - protein, 9 aa, Homo Sapiens
LFNSHESAA

SEQ ID NO: 1356708 - protein, 9 aa, Homo Sapiens
VNTRFLIYT

SEQ ID NO: 1356709 - protein, 9 aa, Homo Sapiens
NRAKMIDFN

SEQ ID NO: 1356710 - protein, 9 aa, Homo Sapiens
TPVVNHLIY

SEQ ID NO: 1356711 - protein, 9 aa, Homo Sapiens
KFYTQDVGT

SEQ ID NO: 1356712 - protein, 9 aa, Homo Sapiens
KEWSLIIMK

SEQ ID NO: 1356713 - protein, 9 aa, Homo Sapiens
VLKLYFLGL

SEQ ID NO: 1356714 - protein, 9 aa, Homo Sapiens
KNSCTFALT

SEQ ID NO: 1356715 - protein, 9 aa, Homo Sapiens
LTLLDLAKG

SEQ ID NO: 1356716 - protein, 9 aa, Homo Sapiens
FVKLENKSK

SEQ ID NO: 1356717 - protein, 9 aa, Homo Sapiens
SKTKVSVQD

SEQ ID NO: 1356718 - protein, 9 aa, Homo Sapiens
SQPFNQPLD

SEQ ID NO: 1356719 - protein, 9 aa, Homo Sapiens
TPDMEQRET

SEQ ID NO: 1356720 - protein, 9 aa, Homo Sapiens
SVPVYQMKF

SEQ ID NO: 1356721 - protein, 9 aa, Homo Sapiens
DYLSTLIPK

SEQ ID NO: 1356722 - protein, 9 aa, Homo Sapiens
QLCRVRRTN

SEQ ID NO: 1356723 - protein, 9 aa, Homo Sapiens
DKLEGLQLV

SEQ ID NO: 1356724 - protein, 9 aa, Homo Sapiens
MDLWVPARH

SEQ ID NO: 1356725 - protein, 9 aa, Homo Sapiens
QYGECVEVV

SEQ ID NO: 1356726 - protein, 9 aa, Homo Sapiens
WNHLLEIEI

SEQ ID NO: 1356727 - protein, 9 aa, Homo Sapiens
AQPLCPLDE

SEQ ID NO: 1356728 - protein, 9 aa, Homo Sapiens
CPFEPAERS

SEQ ID NO: 1356729 - protein, 9 aa, Homo Sapiens
RVLQPELSY

SEQ ID NO: 1356730 - protein, 9 aa, Homo Sapiens
RFHWIHTQL

SEQ ID NO: 1356731 - protein, 9 aa, Homo Sapiens
LGQTGLDAI

SEQ ID NO: 1356732 - protein, 9 aa, Homo Sapiens
IPYQEIAVE

SEQ ID NO: 1356733 - protein, 9 aa, Homo Sapiens
AVDSGTCSC

SEQ ID NO: 1356734 - protein, 9 aa, Homo Sapiens
VLEDIRIHP

SEQ ID NO: 1356735 - protein, 9 aa, Homo Sapiens
VTSLPGSES

SEQ ID NO: 1356736 - protein, 9 aa, Homo Sapiens
NDFNTTEKR

SEQ ID NO: 1356737 - protein, 9 aa, Homo Sapiens
ALVTLQSVK

SEQ ID NO: 1356738 - protein, 9 aa, Homo Sapiens
GYSAPKVLV

SEQ ID NO: 1356739 - protein, 9 aa, Homo Sapiens
ILFMLLNGY

SEQ ID NO: 1356740 - protein, 9 aa, Homo Sapiens
ESCWLMVFF

SEQ ID NO: 1356741 - protein, 9 aa, Homo Sapiens
IPFSPKNAG

SEQ ID NO: 1356742 - protein, 9 aa, Homo Sapiens
SHPKQEGLA

SEQ ID NO: 1356743 - protein, 9 aa, Homo Sapiens
PGWKFNHLE

SEQ ID NO: 1356744 - protein, 9 aa, Homo Sapiens
PTMAEVNVE

SEQ ID NO: 1356745 - protein, 9 aa, Homo Sapiens
MVTQEGTLI

SEQ ID NO: 1356746 - protein, 9 aa, Homo Sapiens
IAPSYDQPD

SEQ ID NO: 1356747 - protein, 9 aa, Homo Sapiens
AMLATVEHQ

SEQ ID NO: 1356748 - protein, 9 aa, Homo Sapiens
YLRNKSRRY

SEQ ID NO: 1356749 - protein, 9 aa, Homo Sapiens
YSVARELHQ

SEQ ID NO: 1356750 - protein, 9 aa, Homo Sapiens
ELSYGIPQL

SEQ ID NO: 1356751 - protein, 9 aa, Homo Sapiens
DADVEERHN

SEQ ID NO: 1356752 - protein, 9 aa, Homo Sapiens
EVKDVNDNA

SEQ ID NO: 1356753 - protein, 9 aa, Homo Sapiens
PPPALPEYD

SEQ ID NO: 1356754 - protein, 9 aa, Homo Sapiens
KCVGNATAC

SEQ ID NO: 1356755 - protein, 9 aa, Homo Sapiens
ALHLLTAER

SEQ ID NO: 1356756 - protein, 9 aa, Homo Sapiens
LTIMYKKLW

SEQ ID NO: 1356757 - protein, 9 aa, Homo Sapiens
FAVPDHLMP

SEQ ID NO: 1356758 - protein, 9 aa, Homo Sapiens
GSFCQGGSI

SEQ ID NO: 1356759 - protein, 9 aa, Homo Sapiens
LALANMVCS

SEQ ID NO: 1356760 - protein, 9 aa, Homo Sapiens
SQVQITTNQ

SEQ ID NO: 1356761 - protein, 9 aa, Homo Sapiens
QLKNSCTFA

SEQ ID NO: 1356762 - protein, 9 aa, Homo Sapiens
PELRALAGI

SEQ ID NO: 1356763 - protein, 9 aa, Homo Sapiens
YDKLAEKRL

SEQ ID NO: 1356764 - protein, 9 aa, Homo Sapiens
KHLAEKVKR

SEQ ID NO: 1356765 - protein, 9 aa, Homo Sapiens
KLLLYWVLE

SEQ ID NO: 1356766 - protein, 9 aa, Homo Sapiens
AAFCLEELI

SEQ ID NO: 1356767 - protein, 9 aa, Homo Sapiens
AMEGPLGVL

SEQ ID NO: 1356768 - protein, 9 aa, Homo Sapiens
CLQLRIATR

SEQ ID NO: 1356769 - protein, 9 aa, Homo Sapiens
RAGATAPGA

SEQ ID NO: 1356770 - protein, 9 aa, Homo Sapiens
CEKRFCKKT

SEQ ID NO: 1356771 - protein, 9 aa, Homo Sapiens
YNLRYYKTG

SEQ ID NO: 1356772 - protein, 9 aa, Homo Sapiens
QHLQLVVTD

SEQ ID NO: 1356773 - protein, 9 aa, Homo Sapiens
YTLRVGIRT

SEQ ID NO: 1356774 - protein, 9 aa, Homo Sapiens
RPDLNKKTQ

SEQ ID NO: 1356775 - protein, 9 aa, Homo Sapiens
GVVQVGLDT

SEQ ID NO: 1356776 - protein, 9 aa, Homo Sapiens
TKVSVQDQV

SEQ ID NO: 1356777 - protein, 9 aa, Homo Sapiens
NAFFKDITS

SEQ ID NO: 1356778 - protein, 9 aa, Homo Sapiens
VHIVSHLRI

SEQ ID NO: 1356779 - protein, 9 aa, Homo Sapiens
VRHVEQRKI

SEQ ID NO: 1356780 - protein, 9 aa, Homo Sapiens
ENNYAKELK

SEQ ID NO: 1356781 - protein, 9 aa, Homo Sapiens
LRNYYYYAS

SEQ ID NO: 1356782 - protein, 9 aa, Homo Sapiens
DFGGEWSIM

SEQ ID NO: 1356783 - protein, 9 aa, Homo Sapiens
KKRGIPMTK

SEQ ID NO: 1356784 - protein, 9 aa, Homo Sapiens
YGECVEVVI

SEQ ID NO: 1356785 - protein, 9 aa, Homo Sapiens
LHIQAYNET

SEQ ID NO: 1356786 - protein, 9 aa, Homo Sapiens
PEDSTIKSS

SEQ ID NO: 1356787 - protein, 9 aa, Homo Sapiens
CVVETGIGK

SEQ ID NO: 1356788 - protein, 9 aa, Homo Sapiens
IDGQDGPIP

SEQ ID NO: 1356789 - protein, 9 aa, Homo Sapiens
SNTCSVFGQ

SEQ ID NO: 1356790 - protein, 9 aa, Homo Sapiens
WSDFALWLE

SEQ ID NO: 1356791 - protein, 9 aa, Homo Sapiens
ADVQKVKDR

SEQ ID NO: 1356792 - protein, 9 aa, Homo Sapiens
VVLILAYCY

SEQ ID NO: 1356793 - protein, 9 aa, Homo Sapiens
QEKYHALCS

SEQ ID NO: 1356794 - protein, 9 aa, Homo Sapiens
KHLRVYLRN

SEQ ID NO: 1356795 - protein, 9 aa, Homo Sapiens
NYKSKSQKL

SEQ ID NO: 1356796 - protein, 9 aa, Homo Sapiens
AVRGDPGSE

SEQ ID NO: 1356797 - protein, 9 aa, Homo Sapiens
FERDLATLG

SEQ ID NO: 1356798 - protein, 9 aa, Homo Sapiens
ATMPLNVSL

SEQ ID NO: 1356799 - protein, 9 aa, Homo Sapiens
QPFNQPLDQ

SEQ ID NO: 1356800 - protein, 9 aa, Homo Sapiens
IMQCSTSEL

SEQ ID NO: 1356801 - protein, 9 aa, Homo Sapiens
AKLLLNTGT

SEQ ID NO: 1356802 - protein, 9 aa, Homo Sapiens
NDLAKVENA

SEQ ID NO: 1356803 - protein, 9 aa, Homo Sapiens
LHYNEEFNI

SEQ ID NO: 1356804 - protein, 9 aa, Homo Sapiens
SLVITWTTE

SEQ ID NO: 1356805 - protein, 9 aa, Homo Sapiens
TVLEDIRIH

SEQ ID NO: 1356806 - protein, 9 aa, Homo Sapiens
RHGDRCFRL

SEQ ID NO: 1356807 - protein, 9 aa, Homo Sapiens
FLMQSAVLS

SEQ ID NO: 1356808 - protein, 9 aa, Homo Sapiens
DWVFTAAHC

SEQ ID NO: 1356809 - protein, 9 aa, Homo Sapiens
FCWQLVKRQ

SEQ ID NO: 1356810 - protein, 9 aa, Homo Sapiens
EDAQRTVTI

SEQ ID NO: 1356811 - protein, 9 aa, Homo Sapiens
NTVCIWDCR

SEQ ID NO: 1356812 - protein, 9 aa, Homo Sapiens
TQLKCLADA

SEQ ID NO: 1356813 - protein, 9 aa, Homo Sapiens
INHPAQLSN

SEQ ID NO: 1356814 - protein, 9 aa, Homo Sapiens
TLLDLAKGF

SEQ ID NO: 1356815 - protein, 9 aa, Homo Sapiens
QNFYWSQES

SEQ ID NO: 1356816 - protein, 9 aa, Homo Sapiens
SLLQGSPQR

SEQ ID NO: 1356817 - protein, 9 aa, Homo Sapiens
NGSLMKVNY

SEQ ID NO: 1356818 - protein, 9 aa, Homo Sapiens
SHFVKDLLT

SEQ ID NO: 1356819 - protein, 9 aa, Homo Sapiens
SLAIHRSTR

SEQ ID NO: 1356820 - protein, 9 aa, Homo Sapiens
TNQKTLRRS

SEQ ID NO: 1356821 - protein, 9 aa, Homo Sapiens
EEGKVGQGN

SEQ ID NO: 1356822 - protein, 9 aa, Homo Sapiens
EYIRTSGGY

SEQ ID NO: 1356823 - protein, 9 aa, Homo Sapiens
THLAALRAA

SEQ ID NO: 1356824 - protein, 9 aa, Homo Sapiens
TCSVFGQAA

SEQ ID NO: 1356825 - protein, 9 aa, Homo Sapiens
LERGSNLAF

SEQ ID NO: 1356826 - protein, 9 aa, Homo Sapiens
AYCYIILLG

SEQ ID NO: 1356827 - protein, 9 aa, Homo Sapiens
DEAIVMQGT

SEQ ID NO: 1356828 - protein, 9 aa, Homo Sapiens
GSFCYKPGA

SEQ ID NO: 1356829 - protein, 9 aa, Homo Sapiens
EDGTWLTQN

SEQ ID NO: 1356830 - protein, 9 aa, Homo Sapiens
LFKNAMLAT

SEQ ID NO: 1356831 - protein, 9 aa, Homo Sapiens
LLCAADVLK

SEQ ID NO: 1356832 - protein, 9 aa, Homo Sapiens
YNGCRKAFN

SEQ ID NO: 1356833 - protein, 9 aa, Homo Sapiens
EPHFTLDCN

SEQ ID NO: 1356834 - protein, 9 aa, Homo Sapiens
PYQEIAVEH

SEQ ID NO: 1356835 - protein, 9 aa, Homo Sapiens
YFMRNADLK

SEQ ID NO: 1356836 - protein, 9 aa, Homo Sapiens
VEVALVTLQ

SEQ ID NO: 1356837 - protein, 9 aa, Homo Sapiens
NPFVQEKTK

SEQ ID NO: 1356838 - protein, 9 aa, Homo Sapiens
SQEKYHALC

SEQ ID NO: 1356839 - protein, 9 aa, Homo Sapiens
QGNHGTEGS

SEQ ID NO: 1356840 - protein, 9 aa, Homo Sapiens
FSTCVSHLF

SEQ ID NO: 1356841 - protein, 9 aa, Homo Sapiens
YQDGVLDPS

SEQ ID NO: 1356842 - protein, 9 aa, Homo Sapiens
TTVVFWQWV

SEQ ID NO: 1356843 - protein, 9 aa, Homo Sapiens
FRKQVLHVK

SEQ ID NO: 1356844 - protein, 9 aa, Homo Sapiens
RWNLPGDRI

SEQ ID NO: 1356845 - protein, 9 aa, Homo Sapiens
GLIIFCFGT

SEQ ID NO: 1356846 - protein, 9 aa, Homo Sapiens
EPVRKKRGI

SEQ ID NO: 1356847 - protein, 9 aa, Homo Sapiens
TTPTQRSPL

SEQ ID NO: 1356848 - protein, 9 aa, Homo Sapiens
DGGPGGKAV

SEQ ID NO: 1356849 - protein, 9 aa, Homo Sapiens
EIKKRSPIS

SEQ ID NO: 1356850 - protein, 9 aa, Homo Sapiens
IKMTATCLL

SEQ ID NO: 1356851 - protein, 9 aa, Homo Sapiens
GVQVKFDWN

SEQ ID NO: 1356852 - protein, 9 aa, Homo Sapiens
LNSSHHVST

SEQ ID NO: 1356853 - protein, 9 aa, Homo Sapiens
ALDRINRFL

SEQ ID NO: 1356854 - protein, 9 aa, Homo Sapiens
TIMDNWIFG

SEQ ID NO: 1356855 - protein, 9 aa, Homo Sapiens
SVLTLLFFG

SEQ ID NO: 1356856 - protein, 9 aa, Homo Sapiens
AMSVYTLSQ

SEQ ID NO: 1356857 - protein, 9 aa, Homo Sapiens
NRELKAALQ

SEQ ID NO: 1356858 - protein, 9 aa, Homo Sapiens
VKDFQVDCK

SEQ ID NO: 1356859 - protein, 9 aa, Homo Sapiens
KAETLYTIG

SEQ ID NO: 1356860 - protein, 9 aa, Homo Sapiens
VAGAHFNLV

SEQ ID NO: 1356861 - protein, 9 aa, Homo Sapiens
SSLLSHERI

SEQ ID NO: 1356862 - protein, 9 aa, Homo Sapiens
VNVEQDFID

SEQ ID NO: 1356863 - protein, 9 aa, Homo Sapiens
DRSCQDLCD

SEQ ID NO: 1356864 - protein, 9 aa, Homo Sapiens
LRKIATEKD

SEQ ID NO: 1356865 - protein, 9 aa, Homo Sapiens
YRNFTEKIN

SEQ ID NO: 1356866 - protein, 9 aa, Homo Sapiens
KKTYHNLKL

SEQ ID NO: 1356867 - protein, 9 aa, Homo Sapiens
LQKMLASSV

SEQ ID NO: 1356868 - protein, 9 aa, Homo Sapiens
KGVVQVGLD

SEQ ID NO: 1356869 - protein, 9 aa, Homo Sapiens
AKAPDPGHQ

SEQ ID NO: 1356870 - protein, 9 aa, Homo Sapiens
PGGKAVGSD

SEQ ID NO: 1356871 - protein, 9 aa, Homo Sapiens
VRRTNSGHK

SEQ ID NO: 1356872 - protein, 9 aa, Homo Sapiens
ENYGSAFPH

SEQ ID NO: 1356873 - protein, 9 aa, Homo Sapiens
YLGSVRLLG

SEQ ID NO: 1356874 - protein, 9 aa, Homo Sapiens
QMWLNASRD

SEQ ID NO: 1356875 - protein, 9 aa, Homo Sapiens
ELESHSHLS

SEQ ID NO: 1356876 - protein, 9 aa, Homo Sapiens
ALLPMSAAT

SEQ ID NO: 1356877 - protein, 9 aa, Homo Sapiens
MLKLARDYS

SEQ ID NO: 1356878 - protein, 9 aa, Homo Sapiens
ELCITAQEN

SEQ ID NO: 1356879 - protein, 9 aa, Homo Sapiens
SIQSTLSLN

SEQ ID NO: 1356880 - protein, 9 aa, Homo Sapiens
DSFYYSVLL

SEQ ID NO: 1356881 - protein, 9 aa, Homo Sapiens
SFVLFNSHE

SEQ ID NO: 1356882 - protein, 9 aa, Homo Sapiens
SQKLTYSIW

SEQ ID NO: 1356883 - protein, 9 aa, Homo Sapiens
GGFPYTTAP

SEQ ID NO: 1356884 - protein, 9 aa, Homo Sapiens
ALFWFDSQE

SEQ ID NO: 1356885 - protein, 9 aa, Homo Sapiens
NLEINHNAD

SEQ ID NO: 1356886 - protein, 9 aa, Homo Sapiens
ATGAQVQQH

SEQ ID NO: 1356887 - protein, 9 aa, Homo Sapiens
GLVQGISCS

SEQ ID NO: 1356888 - protein, 9 aa, Homo Sapiens
VSLVITWTT

SEQ ID NO: 1356889 - protein, 9 aa, Homo Sapiens
EQGLEKCTK

SEQ ID NO: 1356890 - protein, 9 aa, Homo Sapiens
ELKRKFNIL

SEQ ID NO: 1356891 - protein, 9 aa, Homo Sapiens
YTQGDSFTS

SEQ ID NO: 1356892 - protein, 9 aa, Homo Sapiens
GYHIYVSPL

SEQ ID NO: 1356893 - protein, 9 aa, Homo Sapiens
LTFYRKTTT

SEQ ID NO: 1356894 - protein, 9 aa, Homo Sapiens
RHNAYLKPF

SEQ ID NO: 1356895 - protein, 9 aa, Homo Sapiens
LGHNSHGKF

SEQ ID NO: 1356896 - protein, 9 aa, Homo Sapiens
FLFETSEHK

SEQ ID NO: 1356897 - protein, 9 aa, Homo Sapiens
SHQQSIPMA

SEQ ID NO: 1356898 - protein, 9 aa, Homo Sapiens
IDFTEKSMG

SEQ ID NO: 1356899 - protein, 9 aa, Homo Sapiens
EEMDVALSY

SEQ ID NO: 1356900 - protein, 9 aa, Homo Sapiens
NPNKLHCFQ

SEQ ID NO: 1356901 - protein, 9 aa, Homo Sapiens
SVGDAIQAI

SEQ ID NO: 1356902 - protein, 9 aa, Homo Sapiens
TYVATKKTV

SEQ ID NO: 1356903 - protein, 9 aa, Homo Sapiens
FLKMFTIQL

SEQ ID NO: 1356904 - protein, 9 aa, Homo Sapiens
AANVCLDHI

SEQ ID NO: 1356905 - protein, 9 aa, Homo Sapiens
DFTIEVDRL

SEQ ID NO: 1356906 - protein, 9 aa, Homo Sapiens
KLVFSKEGR

SEQ ID NO: 1356907 - protein, 9 aa, Homo Sapiens
RKTTTVVFW

SEQ ID NO: 1356908 - protein, 9 aa, Homo Sapiens
AALHQLFQK

SEQ ID NO: 1356909 - protein, 9 aa, Homo Sapiens
PYSDAEDHS

SEQ ID NO: 1356910 - protein, 9 aa, Homo Sapiens
KVEVQYETL

SEQ ID NO: 1356911 - protein, 9 aa, Homo Sapiens
GPPWAAPSA

SEQ ID NO: 1356912 - protein, 9 aa, Homo Sapiens
SNRSWDLKD

SEQ ID NO: 1356913 - protein, 9 aa, Homo Sapiens
GTGYSAPKV

SEQ ID NO: 1356914 - protein, 9 aa, Homo Sapiens
RHHAKYMNA

SEQ ID NO: 1356915 - protein, 9 aa, Homo Sapiens
GKCPFEPAE

SEQ ID NO: 1356916 - protein, 9 aa, Homo Sapiens
LEKGYIKDQ

SEQ ID NO: 1356917 - protein, 9 aa, Homo Sapiens
SKNMYSQDN

SEQ ID NO: 1356918 - protein, 9 aa, Homo Sapiens
GRCISTLMS

SEQ ID NO: 1356919 - protein, 9 aa, Homo Sapiens
HFYQFGEIL

SEQ ID NO: 1356920 - protein, 9 aa, Homo Sapiens
LDSYFQSLR

SEQ ID NO: 1356921 - protein, 9 aa, Homo Sapiens
YHVLQGRFG

SEQ ID NO: 1356922 - protein, 9 aa, Homo Sapiens
DNVVGATPP

SEQ ID NO: 1356923 - protein, 9 aa, Homo Sapiens
AFGESHAFS

SEQ ID NO: 1356924 - protein, 9 aa, Homo Sapiens
AEKVKRVYL

SEQ ID NO: 1356925 - protein, 9 aa, Homo Sapiens
IPVSRNIIS

SEQ ID NO: 1356926 - protein, 9 aa, Homo Sapiens
KTSGKLLEN

SEQ ID NO: 1356927 - protein, 9 aa, Homo Sapiens
VQLVGNASL

SEQ ID NO: 1356928 - protein, 9 aa, Homo Sapiens
NKAITDAAM

SEQ ID NO: 1356929 - protein, 9 aa, Homo Sapiens
KPNRCKECW

SEQ ID NO: 1356930 - protein, 9 aa, Homo Sapiens
KKFSDFLMQ

SEQ ID NO: 1356931 - protein, 9 aa, Homo Sapiens
EMVREDAQR

SEQ ID NO: 1356932 - protein, 9 aa, Homo Sapiens
AGIARNSRL

SEQ ID NO: 1356933 - protein, 9 aa, Homo Sapiens
MQSAVLSDS

SEQ ID NO: 1356934 - protein, 9 aa, Homo Sapiens
GAQVQQHGS

SEQ ID NO: 1356935 - protein, 9 aa, Homo Sapiens
DDDDNVVGA

SEQ ID NO: 1356936 - protein, 9 aa, Homo Sapiens
GMFAIRALR

SEQ ID NO: 1356937 - protein, 9 aa, Homo Sapiens
EENIKSVGG

SEQ ID NO: 1356938 - protein, 9 aa, Homo Sapiens
KNPSIEPSS

SEQ ID NO: 1356939 - protein, 9 aa, Homo Sapiens
DPGHQDPLT

SEQ ID NO: 1356940 - protein, 9 aa, Homo Sapiens
QRDLAAEAK

SEQ ID NO: 1356941 - protein, 9 aa, Homo Sapiens
ELTKCQLAD

SEQ ID NO: 1356942 - protein, 9 aa, Homo Sapiens
DFSVSTTVI

SEQ ID NO: 1356943 - protein, 9 aa, Homo Sapiens
VERCCEILF

SEQ ID NO: 1356944 - protein, 9 aa, Homo Sapiens
LPQVSFVKF

SEQ ID NO: 1356945 - protein, 9 aa, Homo Sapiens
DRTASDGKA

SEQ ID NO: 1356946 - protein, 9 aa, Homo Sapiens
GSLMKVNYN

SEQ ID NO: 1356947 - protein, 9 aa, Homo Sapiens
NTSLAPIIV

SEQ ID NO: 1356948 - protein, 9 aa, Homo Sapiens
CKKTHLIRH

SEQ ID NO: 1356949 - protein, 9 aa, Homo Sapiens
EYVWTFNWQ

SEQ ID NO: 1356950 - protein, 9 aa, Homo Sapiens
DVKVSNDIS

SEQ ID NO: 1356951 - protein, 9 aa, Homo Sapiens
KKINTEEKP

SEQ ID NO: 1356952 - protein, 9 aa, Homo Sapiens
QEGTLIVRE

SEQ ID NO: 1356953 - protein, 9 aa, Homo Sapiens
MKVNYNQTA

SEQ ID NO: 1356954 - protein, 9 aa, Homo Sapiens
NAEEKANKA

SEQ ID NO: 1356955 - protein, 9 aa, Homo Sapiens
PPTTSFQAP

SEQ ID NO: 1356956 - protein, 9 aa, Homo Sapiens
YIVKSQHSC

SEQ ID NO: 1356957 - protein, 9 aa, Homo Sapiens
YQMKFPDLC

SEQ ID NO: 1356958 - protein, 9 aa, Homo Sapiens
HALMKGVFT

SEQ ID NO: 1356959 - protein, 9 aa, Homo Sapiens
DFTEKSMGA

SEQ ID NO: 1356960 - protein, 9 aa, Homo Sapiens
PKNNNKINL

SEQ ID NO: 1356961 - protein, 9 aa, Homo Sapiens
VHFIQHCKL

SEQ ID NO: 1356962 - protein, 9 aa, Homo Sapiens
KQEDKGRAN

SEQ ID NO: 1356963 - protein, 9 aa, Homo Sapiens
SGRRLQGTD

SEQ ID NO: 1356964 - protein, 9 aa, Homo Sapiens
EEGIEYKVR

SEQ ID NO: 1356965 - protein, 9 aa, Homo Sapiens
CYIILLGVI

SEQ ID NO: 1356966 - protein, 9 aa, Homo Sapiens
FNFCTSHIF

SEQ ID NO: 1356967 - protein, 9 aa, Homo Sapiens
PVRDYLSTL

SEQ ID NO: 1356968 - protein, 9 aa, Homo Sapiens
ESTQTYGKL

SEQ ID NO: 1356969 - protein, 9 aa, Homo Sapiens
GEDEAIVMQ

SEQ ID NO: 1356970 - protein, 9 aa, Homo Sapiens
LQSRWNYRC

SEQ ID NO: 1356971 - protein, 9 aa, Homo Sapiens
RCFRLHNKP

SEQ ID NO: 1356972 - protein, 9 aa, Homo Sapiens
HLLTAERGG

SEQ ID NO: 1356973 - protein, 9 aa, Homo Sapiens
AVPEVELLD

SEQ ID NO: 1356974 - protein, 9 aa, Homo Sapiens
MYKIPVGSE

SEQ ID NO: 1356975 - protein, 9 aa, Homo Sapiens
GKFCIQSRL

SEQ ID NO: 1356976 - protein, 9 aa, Homo Sapiens
FVVEVSQKL

SEQ ID NO: 1356977 - protein, 9 aa, Homo Sapiens
TWLTQNEFE

SEQ ID NO: 1356978 - protein, 9 aa, Homo Sapiens
PLQPEVYAG

SEQ ID NO: 1356979 - protein, 9 aa, Homo Sapiens
QTAASWWPM

SEQ ID NO: 1356980 - protein, 9 aa, Homo Sapiens
NFTITNLLY

SEQ ID NO: 1356981 - protein, 9 aa, Homo Sapiens
ERVFTLLHP

SEQ ID NO: 1356982 - protein, 9 aa, Homo Sapiens
LDFSVSTTV

SEQ ID NO: 1356983 - protein, 9 aa, Homo Sapiens
CSECYHPYC

SEQ ID NO: 1356984 - protein, 9 aa, Homo Sapiens
PPAPPGPPG

SEQ ID NO: 1356985 - protein, 9 aa, Homo Sapiens
KDMNGFSWA

SEQ ID NO: 1356986 - protein, 9 aa, Homo Sapiens
VDVMSLSLA

SEQ ID NO: 1356987 - protein, 9 aa, Homo Sapiens
VSHYSTVSV

SEQ ID NO: 1356988 - protein, 9 aa, Homo Sapiens
VVDYRLPTK

SEQ ID NO: 1356989 - protein, 9 aa, Homo Sapiens
MGRKDSVDL

SEQ ID NO: 1356990 - protein, 9 aa, Homo Sapiens
EDEASSKTD

SEQ ID NO: 1356991 - protein, 9 aa, Homo Sapiens
HGDRCFRLH

SEQ ID NO: 1356992 - protein, 9 aa, Homo Sapiens
QDISGCTPI

SEQ ID NO: 1356993 - protein, 9 aa, Homo Sapiens
SVKAPSPRS

SEQ ID NO: 1356994 - protein, 9 aa, Homo Sapiens
IINHHIPFN

SEQ ID NO: 1356995 - protein, 9 aa, Homo Sapiens
HNSHGKFIA

SEQ ID NO: 1356996 - protein, 9 aa, Homo Sapiens
DNMEQNEQK

SEQ ID NO: 1356997 - protein, 9 aa, Homo Sapiens
IQTHFESKI

SEQ ID NO: 1356998 - protein, 9 aa, Homo Sapiens
EENKHVAKL

SEQ ID NO: 1356999 - protein, 9 aa, Homo Sapiens
LPIIRCKNA

SEQ ID NO: 1357000 - protein, 9 aa, Homo Sapiens
GAGGCSVSH

SEQ ID NO: 1357001 - protein, 9 aa, Homo Sapiens
ETLISDKKW

SEQ ID NO: 1357002 - protein, 9 aa, Homo Sapiens
HRLRGHDDK

SEQ ID NO: 1357003 - protein, 9 aa, Homo Sapiens
SKYVMDQEL

SEQ ID NO: 1357004 - protein, 9 aa, Homo Sapiens
VLQAARLLD

SEQ ID NO: 1357005 - protein, 9 aa, Homo Sapiens
WALSSWQPQ

SEQ ID NO: 1357006 - protein, 9 aa, Homo Sapiens
ILISELNVI

SEQ ID NO: 1357007 - protein, 9 aa, Homo Sapiens
AHAPKKGSK

SEQ ID NO: 1357008 - protein, 9 aa, Homo Sapiens
DGSPSLRLG

SEQ ID NO: 1357009 - protein, 9 aa, Homo Sapiens
AILVAKFSQ

SEQ ID NO: 1357010 - protein, 9 aa, Homo Sapiens
HAQDPQVLN

SEQ ID NO: 1357011 - protein, 9 aa, Homo Sapiens
VDALNSSHH

SEQ ID NO: 1357012 - protein, 9 aa, Homo Sapiens
PTNDVQPGL

SEQ ID NO: 1357013 - protein, 9 aa, Homo Sapiens
DLYFGSFCQ

SEQ ID NO: 1357014 - protein, 9 aa, Homo Sapiens
ESCDVVMLD

SEQ ID NO: 1357015 - protein, 9 aa, Homo Sapiens
SLNYPGNHC

SEQ ID NO: 1357016 - protein, 9 aa, Homo Sapiens
SESSLKAVD

SEQ ID NO: 1357017 - protein, 9 aa, Homo Sapiens
RRPKLQIQK

SEQ ID NO: 1357018 - protein, 9 aa, Homo Sapiens
TVCPIINWE

SEQ ID NO: 1357019 - protein, 9 aa, Homo Sapiens
LHQKHGEPV

SEQ ID NO: 1357020 - protein, 9 aa, Homo Sapiens
KHYDSRISG

SEQ ID NO: 1357021 - protein, 9 aa, Homo Sapiens
PVILEKLHN

SEQ ID NO: 1357022 - protein, 9 aa, Homo Sapiens
NCMIGLSDF

SEQ ID NO: 1357023 - protein, 9 aa, Homo Sapiens
VEVQYETLP

SEQ ID NO: 1357024 - protein, 9 aa, Homo Sapiens
IASDLTRPE

SEQ ID NO: 1357025 - protein, 9 aa, Homo Sapiens
GFERDLATL

SEQ ID NO: 1357026 - protein, 9 aa, Homo Sapiens
DLAKVENAL

SEQ ID NO: 1357027 - protein, 9 aa, Homo Sapiens
LLIELEDLS

SEQ ID NO: 1357028 - protein, 9 aa, Homo Sapiens
KAELLIKIK

SEQ ID NO: 1357029 - protein, 9 aa, Homo Sapiens
KSAHAPKKG

SEQ ID NO: 1357030 - protein, 9 aa, Homo Sapiens
EGLKETSVT

SEQ ID NO: 1357031 - protein, 9 aa, Homo Sapiens
SKTKFIDRL

SEQ ID NO: 1357032 - protein, 9 aa, Homo Sapiens
ASDDDDDNV

SEQ ID NO: 1357033 - protein, 9 aa, Homo Sapiens
QAIIITMHQ

SEQ ID NO: 1357034 - protein, 9 aa, Homo Sapiens
LTIIIFTIV

SEQ ID NO: 1357035 - protein, 9 aa, Homo Sapiens
EMGRLNKLL

SEQ ID NO: 1357036 - protein, 9 aa, Homo Sapiens
AAKGLCWFQ

SEQ ID NO: 1357037 - protein, 9 aa, Homo Sapiens
MDQELSRRL

SEQ ID NO: 1357038 - protein, 9 aa, Homo Sapiens
RFCTVSVGE

SEQ ID NO: 1357039 - protein, 9 aa, Homo Sapiens
CNSFYKIIS

SEQ ID NO: 1357040 - protein, 9 aa, Homo Sapiens
VELYKKGIE

SEQ ID NO: 1357041 - protein, 9 aa, Homo Sapiens
DALNSSHHV

SEQ ID NO: 1357042 - protein, 9 aa, Homo Sapiens
ALRHKQAAD

SEQ ID NO: 1357043 - protein, 9 aa, Homo Sapiens
DFVRHVEQR

SEQ ID NO: 1357044 - protein, 9 aa, Homo Sapiens
KRKFNILTR

SEQ ID NO: 1357045 - protein, 9 aa, Homo Sapiens
VNISDNCGH

SEQ ID NO: 1357046 - protein, 9 aa, Homo Sapiens
VSGKLSNVK

SEQ ID NO: 1357047 - protein, 9 aa, Homo Sapiens
VWNVRCTLW

SEQ ID NO: 1357048 - protein, 9 aa, Homo Sapiens
TTVMTYAAI

SEQ ID NO: 1357049 - protein, 9 aa, Homo Sapiens
DQPLGYHIY

SEQ ID NO: 1357050 - protein, 9 aa, Homo Sapiens
STCVSHLFG

SEQ ID NO: 1357051 - protein, 9 aa, Homo Sapiens
RRASKAWEV

SEQ ID NO: 1357052 - protein, 9 aa, Homo Sapiens
LGLEVEDNV

SEQ ID NO: 1357053 - protein, 9 aa, Homo Sapiens
TQMPKKVED

SEQ ID NO: 1357054 - protein, 9 aa, Homo Sapiens
KEFPYRIHL

SEQ ID NO: 1357055 - protein, 9 aa, Homo Sapiens
WETVILKCN

SEQ ID NO: 1357056 - protein, 9 aa, Homo Sapiens
QQEEILRLR

SEQ ID NO: 1357057 - protein, 9 aa, Homo Sapiens
LTQGLIGSV

SEQ ID NO: 1357058 - protein, 9 aa, Homo Sapiens
PVSDFYTLR

SEQ ID NO: 1357059 - protein, 9 aa, Homo Sapiens
LACQDFKKT

SEQ ID NO: 1357060 - protein, 9 aa, Homo Sapiens
LAIVLPSIV

SEQ ID NO: 1357061 - protein, 9 aa, Homo Sapiens
GQGNHGTEG

SEQ ID NO: 1357062 - protein, 9 aa, Homo Sapiens
TLDCNSFYK

SEQ ID NO: 1357063 - protein, 9 aa, Homo Sapiens
RRYTLAEKW

SEQ ID NO: 1357064 - protein, 9 aa, Homo Sapiens
LSEGFHKAG

SEQ ID NO: 1357065 - protein, 9 aa, Homo Sapiens
FNEKTGFVR

SEQ ID NO: 1357066 - protein, 9 aa, Homo Sapiens
TKITDFCEP

SEQ ID NO: 1357067 - protein, 9 aa, Homo Sapiens
DLYRDVMWK

SEQ ID NO: 1357068 - protein, 9 aa, Homo Sapiens
VLDDFANGA

SEQ ID NO: 1357069 - protein, 9 aa, Homo Sapiens
SGTHCPLCR

SEQ ID NO: 1357070 - protein, 9 aa, Homo Sapiens
QQKLERKII

SEQ ID NO: 1357071 - protein, 9 aa, Homo Sapiens
SLTKLQHLC

SEQ ID NO: 1357072 - protein, 9 aa, Homo Sapiens
QDQEEEMDY

SEQ ID NO: 1357073 - protein, 9 aa, Homo Sapiens
KAFRQNVHI

SEQ ID NO: 1357074 - protein, 9 aa, Homo Sapiens
TGDTERRYN

SEQ ID NO: 1357075 - protein, 9 aa, Homo Sapiens
GAFGIRIDN

SEQ ID NO: 1357076 - protein, 9 aa, Homo Sapiens
FSPDSHHND

SEQ ID NO: 1357077 - protein, 9 aa, Homo Sapiens
RPGYHIDLF

SEQ ID NO: 1357078 - protein, 9 aa, Homo Sapiens
SGKLLENLL

SEQ ID NO: 1357079 - protein, 9 aa, Homo Sapiens
NCIGMRFAI

SEQ ID NO: 1357080 - protein, 9 aa, Homo Sapiens
AAPEENGLA

SEQ ID NO: 1357081 - protein, 9 aa, Homo Sapiens
FDWNHLLEI

SEQ ID NO: 1357082 - protein, 9 aa, Homo Sapiens
QRLKFKREV

SEQ ID NO: 1357083 - protein, 9 aa, Homo Sapiens
PLQLGPQGG

SEQ ID NO: 1357084 - protein, 9 aa, Homo Sapiens
IFEGSKQFL

SEQ ID NO: 1357085 - protein, 9 aa, Homo Sapiens
QPKLPNPPT

SEQ ID NO: 1357086 - protein, 9 aa, Homo Sapiens
LLPMSAATL

SEQ ID NO: 1357087 - protein, 9 aa, Homo Sapiens
RQAALRVLP

SEQ ID NO: 1357088 - protein, 9 aa, Homo Sapiens
VTTAVIITD

SEQ ID NO: 1357089 - protein, 9 aa, Homo Sapiens
TLRILKCSY

SEQ ID NO: 1357090 - protein, 9 aa, Homo Sapiens
ALHQLFQKE

SEQ ID NO: 1357091 - protein, 9 aa, Homo Sapiens
PGVLSSSPA

SEQ ID NO: 1357092 - protein, 9 aa, Homo Sapiens
KIKDLQEQQ

SEQ ID NO: 1357093 - protein, 9 aa, Homo Sapiens
TKLNTDLEK

SEQ ID NO: 1357094 - protein, 9 aa, Homo Sapiens
SRYLASQKG

SEQ ID NO: 1357095 - protein, 9 aa, Homo Sapiens
RISVSSKRS

SEQ ID NO: 1357096 - protein, 9 aa, Homo Sapiens
DYWTFLKMF

SEQ ID NO: 1357097 - protein, 9 aa, Homo Sapiens
AFSGAAFVK

SEQ ID NO: 1357098 - protein, 9 aa, Homo Sapiens
DVIDQNLLN

SEQ ID NO: 1357099 - protein, 9 aa, Homo Sapiens
LTLLFFGLW

SEQ ID NO: 1357100 - protein, 9 aa, Homo Sapiens
EDMLKYIKM

SEQ ID NO: 1357101 - protein, 9 aa, Homo Sapiens
QDKNEKDYS

SEQ ID NO: 1357102 - protein, 9 aa, Homo Sapiens
SSYVERLER

SEQ ID NO: 1357103 - protein, 9 aa, Homo Sapiens
VHWYKDGMK

SEQ ID NO: 1357104 - protein, 9 aa, Homo Sapiens
TSDDHVIEY

SEQ ID NO: 1357105 - protein, 9 aa, Homo Sapiens
SQAFVPLTT

SEQ ID NO: 1357106 - protein, 9 aa, Homo Sapiens
FALDTSNDP

SEQ ID NO: 1357107 - protein, 9 aa, Homo Sapiens
EKVKADVQK

SEQ ID NO: 1357108 - protein, 9 aa, Homo Sapiens
TRGWALSSW

SEQ ID NO: 1357109 - protein, 9 aa, Homo Sapiens
DGHNVSLLA

SEQ ID NO: 1357110 - protein, 9 aa, Homo Sapiens
VEDNVAFLI

SEQ ID NO: 1357111 - protein, 9 aa, Homo Sapiens
SLAFLVGVV

SEQ ID NO: 1357112 - protein, 9 aa, Homo Sapiens
NPLDTFVLS

SEQ ID NO: 1357113 - protein, 9 aa, Homo Sapiens
GPQYEITQS

SEQ ID NO: 1357114 - protein, 9 aa, Homo Sapiens
DAANVIVYV

SEQ ID NO: 1357115 - protein, 9 aa, Homo Sapiens
LNGYESPEI

SEQ ID NO: 1357116 - protein, 9 aa, Homo Sapiens
KAAQQLQEG

SEQ ID NO: 1357117 - protein, 9 aa, Homo Sapiens
EPKVKECKT

SEQ ID NO: 1357118 - protein, 9 aa, Homo Sapiens
WKNGSLVHV

SEQ ID NO: 1357119 - protein, 9 aa, Homo Sapiens
CIQSRLPST

SEQ ID NO: 1357120 - protein, 9 aa, Homo Sapiens
RCLSVTSEQ

SEQ ID NO: 1357121 - protein, 9 aa, Homo Sapiens
PLDQNFSPP

SEQ ID NO: 1357122 - protein, 9 aa, Homo Sapiens
LEDKDMNGF

SEQ ID NO: 1357123 - protein, 9 aa, Homo Sapiens
ELLDQPENT

SEQ ID NO: 1357124 - protein, 9 aa, Homo Sapiens
PQYEITQSL

SEQ ID NO: 1357125 - protein, 9 aa, Homo Sapiens
HIYVSPLTT

SEQ ID NO: 1357126 - protein, 9 aa, Homo Sapiens
CQDVHAATV

SEQ ID NO: 1357127 - protein, 9 aa, Homo Sapiens
SCAFGTEYI

SEQ ID NO: 1357128 - protein, 9 aa, Homo Sapiens
LKVRKHAEA

SEQ ID NO: 1357129 - protein, 9 aa, Homo Sapiens
SILMAVIAT

SEQ ID NO: 1357130 - protein, 9 aa, Homo Sapiens
ALSSWQPQP

SEQ ID NO: 1357131 - protein, 9 aa, Homo Sapiens
SLVGLSRSS

SEQ ID NO: 1357132 - protein, 9 aa, Homo Sapiens
GTQEGGEEE

SEQ ID NO: 1357133 - protein, 9 aa, Homo Sapiens
AKDNQSISA

SEQ ID NO: 1357134 - protein, 9 aa, Homo Sapiens
PIIRCKNAL

SEQ ID NO: 1357135 - protein, 9 aa, Homo Sapiens
DQELSRRLS

SEQ ID NO: 1357136 - protein, 9 aa, Homo Sapiens
ITNIKLAVI

SEQ ID NO: 1357137 - protein, 9 aa, Homo Sapiens
AKSYNQQRI

SEQ ID NO: 1357138 - protein, 9 aa, Homo Sapiens
KQDQEEEMD

SEQ ID NO: 1357139 - protein, 9 aa, Homo Sapiens
GFHKAGISD

SEQ ID NO: 1357140 - protein, 9 aa, Homo Sapiens
HNNPMNCDC

SEQ ID NO: 1357141 - protein, 9 aa, Homo Sapiens
HIDLFMVEI

SEQ ID NO: 1357142 - protein, 9 aa, Homo Sapiens
VNPVSWIQK

SEQ ID NO: 1357143 - protein, 9 aa, Homo Sapiens
QIAGLQKTI

SEQ ID NO: 1357144 - protein, 9 aa, Homo Sapiens
SYIWTFDPG

SEQ ID NO: 1357145 - protein, 9 aa, Homo Sapiens
SGCTPIHLA

SEQ ID NO: 1357146 - protein, 9 aa, Homo Sapiens
QDLAMKDKL

SEQ ID NO: 1357147 - protein, 9 aa, Homo Sapiens
IYEQRHSKR

SEQ ID NO: 1357148 - protein, 9 aa, Homo Sapiens
YLFHKEPTW

SEQ ID NO: 1357149 - protein, 9 aa, Homo Sapiens
LYEENMHHP

SEQ ID NO: 1357150 - protein, 9 aa, Homo Sapiens
FGAPVSAVY

SEQ ID NO: 1357151 - protein, 9 aa, Homo Sapiens
LQKVEVQYE

SEQ ID NO: 1357152 - protein, 9 aa, Homo Sapiens
GGRDSDSNS

SEQ ID NO: 1357153 - protein, 9 aa, Homo Sapiens
VGSDCGGSS

SEQ ID NO: 1357154 - protein, 9 aa, Homo Sapiens
KSSSFIVII

SEQ ID NO: 1357155 - protein, 9 aa, Homo Sapiens
YRNPFVQEK

SEQ ID NO: 1357156 - protein, 9 aa, Homo Sapiens
TDFCEPRIQ

SEQ ID NO: 1357157 - protein, 9 aa, Homo Sapiens
CNPELRDFR

SEQ ID NO: 1357158 - protein, 9 aa, Homo Sapiens
KSVDSSLVG

SEQ ID NO: 1357159 - protein, 9 aa, Homo Sapiens
LHIDTLDNR

SEQ ID NO: 1357160 - protein, 9 aa, Homo Sapiens
ILKDTSKDI

SEQ ID NO: 1357161 - protein, 9 aa, Homo Sapiens
REKLKKIKT

SEQ ID NO: 1357162 - protein, 9 aa, Homo Sapiens
WQFSIDGQI

SEQ ID NO: 1357163 - protein, 9 aa, Homo Sapiens
EDGVLTLLD

SEQ ID NO: 1357164 - protein, 9 aa, Homo Sapiens
EDLFKQKES

SEQ ID NO: 1357165 - protein, 9 aa, Homo Sapiens
MGAKNPSIE

SEQ ID NO: 1357166 - protein, 9 aa, Homo Sapiens
ASCWNPLEQ

SEQ ID NO: 1357167 - protein, 9 aa, Homo Sapiens
SAPRQAALR

SEQ ID NO: 1357168 - protein, 9 aa, Homo Sapiens
VLCKIKEKT

SEQ ID NO: 1357169 - protein, 9 aa, Homo Sapiens
PIDGQDGPI

SEQ ID NO: 1357170 - protein, 9 aa, Homo Sapiens
GIFNPSSGG

SEQ ID NO: 1357171 - protein, 9 aa, Homo Sapiens
LQRFCWQLV

SEQ ID NO: 1357172 - protein, 9 aa, Homo Sapiens
KFIDRLNKH

SEQ ID NO: 1357173 - protein, 9 aa, Homo Sapiens
QTLPIIRCK

SEQ ID NO: 1357174 - protein, 9 aa, Homo Sapiens
EDLKGQLEK

SEQ ID NO: 1357175 - protein, 9 aa, Homo Sapiens
IENNTDIVC

SEQ ID NO: 1357176 - protein, 9 aa, Homo Sapiens
NDAVSYKAQ

SEQ ID NO: 1357177 - protein, 9 aa, Homo Sapiens
KQVLHVKDF

SEQ ID NO: 1357178 - protein, 9 aa, Homo Sapiens
LATGTSAEQ

SEQ ID NO: 1357179 - protein, 9 aa, Homo Sapiens
YSAPKVLVT

SEQ ID NO: 1357180 - protein, 9 aa, Homo Sapiens
THLGSLVHQ

SEQ ID NO: 1357181 - protein, 9 aa, Homo Sapiens
AFYSLYLPI

SEQ ID NO: 1357182 - protein, 9 aa, Homo Sapiens
NVLNWVREQ

SEQ ID NO: 1357183 - protein, 9 aa, Homo Sapiens
LAADFLGKS

SEQ ID NO: 1357184 - protein, 9 aa, Homo Sapiens
KGDVHKALI

SEQ ID NO: 1357185 - protein, 9 aa, Homo Sapiens
LWLEQKHCW

SEQ ID NO: 1357186 - protein, 9 aa, Homo Sapiens
LLNGYESPE

SEQ ID NO: 1357187 - protein, 9 aa, Homo Sapiens
FSDFLMQSA

SEQ ID NO: 1357188 - protein, 9 aa, Homo Sapiens
KEGRYVKNT

SEQ ID NO: 1357189 - protein, 9 aa, Homo Sapiens
QLKVQVADS

SEQ ID NO: 1357190 - protein, 9 aa, Homo Sapiens
WNGTPVRDY

SEQ ID NO: 1357191 - protein, 9 aa, Homo Sapiens
STGEKLAAP

SEQ ID NO: 1357192 - protein, 9 aa, Homo Sapiens
CVHVSACAC

SEQ ID NO: 1357193 - protein, 9 aa, Homo Sapiens
NTSDSDIIM

SEQ ID NO: 1357194 - protein, 9 aa, Homo Sapiens
GEHASCWNP

SEQ ID NO: 1357195 - protein, 9 aa, Homo Sapiens
LTLKRGAEI

SEQ ID NO: 1357196 - protein, 9 aa, Homo Sapiens
FERTCLHAA

SEQ ID NO: 1357197 - protein, 9 aa, Homo Sapiens
LKKTYHNLK

SEQ ID NO: 1357198 - protein, 9 aa, Homo Sapiens
AIRALRKIA

SEQ ID NO: 1357199 - protein, 9 aa, Homo Sapiens
VARELHQKH

SEQ ID NO: 1357200 - protein, 9 aa, Homo Sapiens
RAQMNLYVA

SEQ ID NO: 1357201 - protein, 9 aa, Homo Sapiens
AVYATYDVK

SEQ ID NO: 1357202 - protein, 9 aa, Homo Sapiens
SCNSDNVNH

SEQ ID NO: 1357203 - protein, 9 aa, Homo Sapiens
ARIKGEGSV

SEQ ID NO: 1357204 - protein, 9 aa, Homo Sapiens
GMVVVTDLK

SEQ ID NO: 1357205 - protein, 9 aa, Homo Sapiens
PPANSASLI

SEQ ID NO: 1357206 - protein, 9 aa, Homo Sapiens
YSDAEDHSI

SEQ ID NO: 1357207 - protein, 9 aa, Homo Sapiens
PTWESSGLQ

SEQ ID NO: 1357208 - protein, 9 aa, Homo Sapiens
LFKIIDFLN

SEQ ID NO: 1357209 - protein, 9 aa, Homo Sapiens
QTSDGIFNP

SEQ ID NO: 1357210 - protein, 9 aa, Homo Sapiens
DSEVRCFGG

SEQ ID NO: 1357211 - protein, 9 aa, Homo Sapiens
VELLDQPEN

SEQ ID NO: 1357212 - protein, 9 aa, Homo Sapiens
WDLKDAQKS

SEQ ID NO: 1357213 - protein, 9 aa, Homo Sapiens
FCFNILCVV

SEQ ID NO: 1357214 - protein, 9 aa, Homo Sapiens
KMRHVPSWQ

SEQ ID NO: 1357215 - protein, 9 aa, Homo Sapiens
VSWIQKVCQ

SEQ ID NO: 1357216 - protein, 9 aa, Homo Sapiens
QPLQLGPQG

SEQ ID NO: 1357217 - protein, 9 aa, Homo Sapiens
LEAVKLVGG

SEQ ID NO: 1357218 - protein, 9 aa, Homo Sapiens
SYVERLERF

SEQ ID NO: 1357219 - protein, 9 aa, Homo Sapiens
GNHPMLVPY

SEQ ID NO: 1357220 - protein, 9 aa, Homo Sapiens
VHKDIHDYE

SEQ ID NO: 1357221 - protein, 9 aa, Homo Sapiens
YVWTFNWQA

SEQ ID NO: 1357222 - protein, 9 aa, Homo Sapiens
LEVEDNVAF

SEQ ID NO: 1357223 - protein, 9 aa, Homo Sapiens
IPIANMIKC

SEQ ID NO: 1357224 - protein, 9 aa, Homo Sapiens
DNCGHYEQR

SEQ ID NO: 1357225 - protein, 9 aa, Homo Sapiens
PNQEELHEL

SEQ ID NO: 1357226 - protein, 9 aa, Homo Sapiens
DEQEMIASP

SEQ ID NO: 1357227 - protein, 9 aa, Homo Sapiens
EYGSVDIVE

SEQ ID NO: 1357228 - protein, 9 aa, Homo Sapiens
PDKGYSFVL

SEQ ID NO: 1357229 - protein, 9 aa, Homo Sapiens
CPRMKGDGK

SEQ ID NO: 1357230 - protein, 9 aa, Homo Sapiens
HVKDSCNTA

SEQ ID NO: 1357231 - protein, 9 aa, Homo Sapiens
KRGGRDSDS

SEQ ID NO: 1357232 - protein, 9 aa, Homo Sapiens
RFLIYTNEN

SEQ ID NO: 1357233 - protein, 9 aa, Homo Sapiens
PQDLAVAKY

SEQ ID NO: 1357234 - protein, 9 aa, Homo Sapiens
ERKSVTDCV

SEQ ID NO: 1357235 - protein, 9 aa, Homo Sapiens
AFRQNVHIV

SEQ ID NO: 1357236 - protein, 9 aa, Homo Sapiens
FRYSHNNSL

SEQ ID NO: 1357237 - protein, 9 aa, Homo Sapiens
GCLKFLLTF

SEQ ID NO: 1357238 - protein, 9 aa, Homo Sapiens
DHVIEYVNP

SEQ ID NO: 1357239 - protein, 9 aa, Homo Sapiens
FEAEGVPEV

SEQ ID NO: 1357240 - protein, 9 aa, Homo Sapiens
KLSELCPNL

SEQ ID NO: 1357241 - protein, 9 aa, Homo Sapiens
VKDVNDNAP

SEQ ID NO: 1357242 - protein, 9 aa, Homo Sapiens
GGKHYDSRI

SEQ ID NO: 1357243 - protein, 9 aa, Homo Sapiens
VMKLSELCP

SEQ ID NO: 1357244 - protein, 9 aa, Homo Sapiens
ALREVVQEK

SEQ ID NO: 1357245 - protein, 9 aa, Homo Sapiens
IMTVVQAYI

SEQ ID NO: 1357246 - protein, 9 aa, Homo Sapiens
GYHVLQGRF

SEQ ID NO: 1357247 - protein, 9 aa, Homo Sapiens
ELTHLGSLV

SEQ ID NO: 1357248 - protein, 9 aa, Homo Sapiens
TWESSGLQL

SEQ ID NO: 1357249 - protein, 9 aa, Homo Sapiens
PGDYALGQT

SEQ ID NO: 1357250 - protein, 9 aa, Homo Sapiens
WQLVKRQHP

SEQ ID NO: 1357251 - protein, 9 aa, Homo Sapiens
SLQSSQEVQ

SEQ ID NO: 1357252 - protein, 9 aa, Homo Sapiens
DLCDQHKGL

SEQ ID NO: 1357253 - protein, 9 aa, Homo Sapiens
GADRYTIRS

SEQ ID NO: 1357254 - protein, 9 aa, Homo Sapiens
YMSEALGVG

SEQ ID NO: 1357255 - protein, 9 aa, Homo Sapiens
AVLCVRINN

SEQ ID NO: 1357256 - protein, 9 aa, Homo Sapiens
KFNILTRPS

SEQ ID NO: 1357257 - protein, 9 aa, Homo Sapiens
SEEDEASSK

SEQ ID NO: 1357258 - protein, 9 aa, Homo Sapiens
RIWTTKDEE

SEQ ID NO: 1357259 - protein, 9 aa, Homo Sapiens
YIKRPQLIR

SEQ ID NO: 1357260 - protein, 9 aa, Homo Sapiens
AIFEGSKQF

SEQ ID NO: 1357261 - protein, 9 aa, Homo Sapiens
LQLLRAPDT

SEQ ID NO: 1357262 - protein, 9 aa, Homo Sapiens
LPVLQGLGP

SEQ ID NO: 1357263 - protein, 9 aa, Homo Sapiens
RYLASQKGN

SEQ ID NO: 1357264 - protein, 9 aa, Homo Sapiens
SAQQLPKVD

SEQ ID NO: 1357265 - protein, 9 aa, Homo Sapiens
MRVTHVREH

SEQ ID NO: 1357266 - protein, 9 aa, Homo Sapiens
IIIFTIVGF

SEQ ID NO: 1357267 - protein, 9 aa, Homo Sapiens
LDRINRFLP

SEQ ID NO: 1357268 - protein, 9 aa, Homo Sapiens
PPAFSGAAF

SEQ ID NO: 1357269 - protein, 9 aa, Homo Sapiens
WSRTLSRNK

SEQ ID NO: 1357270 - protein, 9 aa, Homo Sapiens
GDSFTSEDH

SEQ ID NO: 1357271 - protein, 9 aa, Homo Sapiens
FLKDDFTIE

SEQ ID NO: 1357272 - protein, 9 aa, Homo Sapiens
FSPKNAGYK

SEQ ID NO: 1357273 - protein, 9 aa, Homo Sapiens
YQFGMTKTE

SEQ ID NO: 1357274 - protein, 9 aa, Homo Sapiens
VHTTLKLHQ

SEQ ID NO: 1357275 - protein, 9 aa, Homo Sapiens
DDGSEEDKA

SEQ ID NO: 1357276 - protein, 9 aa, Homo Sapiens
SAQEPSNKI

SEQ ID NO: 1357277 - protein, 9 aa, Homo Sapiens
TVVTHRPLD

SEQ ID NO: 1357278 - protein, 9 aa, Homo Sapiens
FNPSSGGIT

SEQ ID NO: 1357279 - protein, 9 aa, Homo Sapiens
TLKRGAEIL

SEQ ID NO: 1357280 - protein, 9 aa, Homo Sapiens
SSLVGLSRS

SEQ ID NO: 1357281 - protein, 9 aa, Homo Sapiens
PGSESSLKA

SEQ ID NO: 1357282 - protein, 9 aa, Homo Sapiens
KGSTPLTNM

SEQ ID NO: 1357283 - protein, 9 aa, Homo Sapiens
LLMEADEMD

SEQ ID NO: 1357284 - protein, 9 aa, Homo Sapiens
SLTNRNYDL

SEQ ID NO: 1357285 - protein, 9 aa, Homo Sapiens
VMLQDNQSL

SEQ ID NO: 1357286 - protein, 9 aa, Homo Sapiens
GSHERLQDL

SEQ ID NO: 1357287 - protein, 9 aa, Homo Sapiens
ALRAAPCDS

SEQ ID NO: 1357288 - protein, 9 aa, Homo Sapiens
NHPMLVPYD

SEQ ID NO: 1357289 - protein, 9 aa, Homo Sapiens
QIEDLKGQL

SEQ ID NO: 1357290 - protein, 9 aa, Homo Sapiens
VSFPSLQAA

SEQ ID NO: 1357291 - protein, 9 aa, Homo Sapiens
EMDRRAKSK

SEQ ID NO: 1357292 - protein, 9 aa, Homo Sapiens
MQAVKTTPT

SEQ ID NO: 1357293 - protein, 9 aa, Homo Sapiens
CFFQLGNMA

SEQ ID NO: 1357294 - protein, 9 aa, Homo Sapiens
PPLQPEVYA

SEQ ID NO: 1357295 - protein, 9 aa, Homo Sapiens
ALPEYDLVC

SEQ ID NO: 1357296 - protein, 9 aa, Homo Sapiens
KTIQDLETE

SEQ ID NO: 1357297 - protein, 9 aa, Homo Sapiens
KKFQLPENL

SEQ ID NO: 1357298 - protein, 9 aa, Homo Sapiens
HIIYFFLCQ

SEQ ID NO: 1357299 - protein, 9 aa, Homo Sapiens
RTHTVERPY

SEQ ID NO: 1357300 - protein, 9 aa, Homo Sapiens
DWSDFALWL

SEQ ID NO: 1357301 - protein, 9 aa, Homo Sapiens
EDDRSFFNL

SEQ ID NO: 1357302 - protein, 9 aa, Homo Sapiens
SVLLFALDT

SEQ ID NO: 1357303 - protein, 9 aa, Homo Sapiens
LSVYGPRAA

SEQ ID NO: 1357304 - protein, 9 aa, Homo Sapiens
IKIKDLQEQ

SEQ ID NO: 1357305 - protein, 9 aa, Homo Sapiens
RFVTYEDQR

SEQ ID NO: 1357306 - protein, 9 aa, Homo Sapiens
LEPLELAKR

SEQ ID NO: 1357307 - protein, 9 aa, Homo Sapiens
FTITNLLYE

SEQ ID NO: 1357308 - protein, 9 aa, Homo Sapiens
AAQQLQEGQ

SEQ ID NO: 1357309 - protein, 9 aa, Homo Sapiens
LGHLPSDVI

SEQ ID NO: 1357310 - protein, 9 aa, Homo Sapiens
VYTIMDNWI

SEQ ID NO: 1357311 - protein, 9 aa, Homo Sapiens
AEKKQLCFD

SEQ ID NO: 1357312 - protein, 9 aa, Homo Sapiens
YSSDSDDGS

SEQ ID NO: 1357313 - protein, 9 aa, Homo Sapiens
WVSVDPTSE

SEQ ID NO: 1357314 - protein, 9 aa, Homo Sapiens
ASPHWPPKV

SEQ ID NO: 1357315 - protein, 9 aa, Homo Sapiens
VSKNMYSQD

SEQ ID NO: 1357316 - protein, 9 aa, Homo Sapiens
ESKIEIPPR

SEQ ID NO: 1357317 - protein, 9 aa, Homo Sapiens
PDMSPCSNV

SEQ ID NO: 1357318 - protein, 9 aa, Homo Sapiens
LGLGSPRVF

SEQ ID NO: 1357319 - protein, 9 aa, Homo Sapiens
TLWSRLNLL

SEQ ID NO: 1357320 - protein, 9 aa, Homo Sapiens
SSLGSDWEA

SEQ ID NO: 1357321 - protein, 9 aa, Homo Sapiens
DSSYVERLE

SEQ ID NO: 1357322 - protein, 9 aa, Homo Sapiens
KNTVCIWDC

SEQ ID NO: 1357323 - protein, 9 aa, Homo Sapiens
QGDSFTSED

SEQ ID NO: 1357324 - protein, 9 aa, Homo Sapiens
EIFGQTIIN

SEQ ID NO: 1357325 - protein, 9 aa, Homo Sapiens
VIDGNQQLS

SEQ ID NO: 1357326 - protein, 9 aa, Homo Sapiens
LQAARLLDI

SEQ ID NO: 1357327 - protein, 9 aa, Homo Sapiens
QGLIGSVGT

SEQ ID NO: 1357328 - protein, 9 aa, Homo Sapiens
QVKFDWNHL

SEQ ID NO: 1357329 - protein, 9 aa, Homo Sapiens
VSICEDHQM

SEQ ID NO: 1357330 - protein, 9 aa, Homo Sapiens
YLYLGKNQI

SEQ ID NO: 1357331 - protein, 9 aa, Homo Sapiens
NAQIIVMLQ

SEQ ID NO: 1357332 - protein, 9 aa, Homo Sapiens
RPDMSPCSN

SEQ ID NO: 1357333 - protein, 9 aa, Homo Sapiens
TPAVYATYD

SEQ ID NO: 1357334 - protein, 9 aa, Homo Sapiens
GTEQSLLDS

SEQ ID NO: 1357335 - protein, 9 aa, Homo Sapiens
YNAKSSSFI

SEQ ID NO: 1357336 - protein, 9 aa, Homo Sapiens
TLRVGIRTV

SEQ ID NO: 1357337 - protein, 9 aa, Homo Sapiens
PELINLKQH

SEQ ID NO: 1357338 - protein, 9 aa, Homo Sapiens
RSWQGDGFP

SEQ ID NO: 1357339 - protein, 9 aa, Homo Sapiens
CIRFVTYED

SEQ ID NO: 1357340 - protein, 9 aa, Homo Sapiens
RCLVKTYAA

SEQ ID NO: 1357341 - protein, 9 aa, Homo Sapiens
RYTLAEKWE

SEQ ID NO: 1357342 - protein, 9 aa, Homo Sapiens
QEIESLHLS

SEQ ID NO: 1357343 - protein, 9 aa, Homo Sapiens
ISDKKWSKV

SEQ ID NO: 1357344 - protein, 9 aa, Homo Sapiens
ALEAVKLVG

SEQ ID NO: 1357345 - protein, 9 aa, Homo Sapiens
RMKGDGKTM

SEQ ID NO: 1357346 - protein, 9 aa, Homo Sapiens
TKHKKINTE

SEQ ID NO: 1357347 - protein, 9 aa, Homo Sapiens
SSKYEDKKL

SEQ ID NO: 1357348 - protein, 9 aa, Homo Sapiens
LFNDWEHSQ

SEQ ID NO: 1357349 - protein, 9 aa, Homo Sapiens
VIHNNNVRR

SEQ ID NO: 1357350 - protein, 9 aa, Homo Sapiens
VEHLRICPQ

SEQ ID NO: 1357351 - protein, 9 aa, Homo Sapiens
NHNADKSLD

SEQ ID NO: 1357352 - protein, 9 aa, Homo Sapiens
ITDKSVRNM

SEQ ID NO: 1357353 - protein, 9 aa, Homo Sapiens
GSESSLKAV

SEQ ID NO: 1357354 - protein, 9 aa, Homo Sapiens
SSHVAVVGV

SEQ ID NO: 1357355 - protein, 9 aa, Homo Sapiens
ATYDVKVQA

SEQ ID NO: 1357356 - protein, 9 aa, Homo Sapiens
SVDIVEEVL

SEQ ID NO: 1357357 - protein, 9 aa, Homo Sapiens
INSNPGSVI

SEQ ID NO: 1357358 - protein, 9 aa, Homo Sapiens
EDQDGSPSL

SEQ ID NO: 1357359 - protein, 9 aa, Homo Sapiens
QSVISRFLY

SEQ ID NO: 1357360 - protein, 9 aa, Homo Sapiens
CCKAFNQSS

SEQ ID NO: 1357361 - protein, 9 aa, Homo Sapiens
FDSQEISFE

SEQ ID NO: 1357362 - protein, 9 aa, Homo Sapiens
KSKSQKLSA

SEQ ID NO: 1357363 - protein, 9 aa, Homo Sapiens
VDTLCEGAF

SEQ ID NO: 1357364 - protein, 9 aa, Homo Sapiens
FVHAPWKNG

SEQ ID NO: 1357365 - protein, 9 aa, Homo Sapiens
AGIEGVLDS

SEQ ID NO: 1357366 - protein, 9 aa, Homo Sapiens
PDKFERTCL

SEQ ID NO: 1357367 - protein, 9 aa, Homo Sapiens
FLYTEQLLS

SEQ ID NO: 1357368 - protein, 9 aa, Homo Sapiens
LINLKYLYL

SEQ ID NO: 1357369 - protein, 9 aa, Homo Sapiens
WMDRYEIYS

SEQ ID NO: 1357370 - protein, 9 aa, Homo Sapiens
DWNHLLEIE

SEQ ID NO: 1357371 - protein, 9 aa, Homo Sapiens
LLYEENMHH

SEQ ID NO: 1357372 - protein, 9 aa, Homo Sapiens
NIERMKEKD

SEQ ID NO: 1357373 - protein, 9 aa, Homo Sapiens
YRVVAGEEE

SEQ ID NO: 1357374 - protein, 9 aa, Homo Sapiens
NHCQHGATC

SEQ ID NO: 1357375 - protein, 9 aa, Homo Sapiens
SHALMKGVF

SEQ ID NO: 1357376 - protein, 9 aa, Homo Sapiens
VFRASSPEG

SEQ ID NO: 1357377 - protein, 9 aa, Homo Sapiens
FLCGGLSAN

SEQ ID NO: 1357378 - protein, 9 aa, Homo Sapiens
AQAWTTFRV

SEQ ID NO: 1357379 - protein, 9 aa, Homo Sapiens
LFVLDGTSS

SEQ ID NO: 1357380 - protein, 9 aa, Homo Sapiens
DLGLEPLEL

SEQ ID NO: 1357381 - protein, 9 aa, Homo Sapiens
LKETVYNLI

SEQ ID NO: 1357382 - protein, 9 aa, Homo Sapiens
ASATYVATK

SEQ ID NO: 1357383 - protein, 9 aa, Homo Sapiens
KDVNDNAPL

SEQ ID NO: 1357384 - protein, 9 aa, Homo Sapiens
ALMMSLLAL

SEQ ID NO: 1357385 - protein, 9 aa, Homo Sapiens
IRFVTYEDQ

SEQ ID NO: 1357386 - protein, 9 aa, Homo Sapiens
RVTNVLNWV

SEQ ID NO: 1357387 - protein, 9 aa, Homo Sapiens
DHDHALAQA

SEQ ID NO: 1357388 - protein, 9 aa, Homo Sapiens
VVETGIGKS

SEQ ID NO: 1357389 - protein, 9 aa, Homo Sapiens
VSSQLYPPV

SEQ ID NO: 1357390 - protein, 9 aa, Homo Sapiens
FVKQYMSEA

SEQ ID NO: 1357391 - protein, 9 aa, Homo Sapiens
WEVDVEQHT

SEQ ID NO: 1357392 - protein, 9 aa, Homo Sapiens
SGGQLDCIL

SEQ ID NO: 1357393 - protein, 9 aa, Homo Sapiens
ADARNWDLL

SEQ ID NO: 1357394 - protein, 9 aa, Homo Sapiens
YGSVDIVEE

SEQ ID NO: 1357395 - protein, 9 aa, Homo Sapiens
HHQPSNNDF

SEQ ID NO: 1357396 - protein, 9 aa, Homo Sapiens
LLAINQYAD

SEQ ID NO: 1357397 - protein, 9 aa, Homo Sapiens
VPVYQMKFP

SEQ ID NO: 1357398 - protein, 9 aa, Homo Sapiens
TYRNFTEKI

SEQ ID NO: 1357399 - protein, 9 aa, Homo Sapiens
EWSIMTTFS

SEQ ID NO: 1357400 - protein, 9 aa, Homo Sapiens
ADNKKGAKK

SEQ ID NO: 1357401 - protein, 9 aa, Homo Sapiens
RYKISPDRE

SEQ ID NO: 1357402 - protein, 9 aa, Homo Sapiens
YTVVTHRPL

SEQ ID NO: 1357403 - protein, 9 aa, Homo Sapiens
DGTWLTQNE

SEQ ID NO: 1357404 - protein, 9 aa, Homo Sapiens
DKLAEKRLT

SEQ ID NO: 1357405 - protein, 9 aa, Homo Sapiens
WAQGVLIYP

SEQ ID NO: 1357406 - protein, 9 aa, Homo Sapiens
LKQHLQIQS

SEQ ID NO: 1357407 - protein, 9 aa, Homo Sapiens
KGARCDQAC

SEQ ID NO: 1357408 - protein, 9 aa, Homo Sapiens
LKDTSKDIE

SEQ ID NO: 1357409 - protein, 9 aa, Homo Sapiens
SLSSQRNIA

SEQ ID NO: 1357410 - protein, 9 aa, Homo Sapiens
ITVENKVDL

SEQ ID NO: 1357411 - protein, 9 aa, Homo Sapiens
VAKGVVQVG

SEQ ID NO: 1357412 - protein, 9 aa, Homo Sapiens
LENKSKSGV

SEQ ID NO: 1357413 - protein, 9 aa, Homo Sapiens
YRTGYTYRN

SEQ ID NO: 1357414 - protein, 9 aa, Homo Sapiens
RIKRCLSVT

SEQ ID NO: 1357415 - protein, 9 aa, Homo Sapiens
RVRRTNSGH

SEQ ID NO: 1357416 - protein, 9 aa, Homo Sapiens
QSLLDSQME

SEQ ID NO: 1357417 - protein, 9 aa, Homo Sapiens
IEWKQLVIN

SEQ ID NO: 1357418 - protein, 9 aa, Homo Sapiens
LGLFDALTS

SEQ ID NO: 1357419 - protein, 9 aa, Homo Sapiens
DLAAEAKER

SEQ ID NO: 1357420 - protein, 9 aa, Homo Sapiens
LWRLGASVI

SEQ ID NO: 1357421 - protein, 9 aa, Homo Sapiens
VQGVKAERF

SEQ ID NO: 1357422 - protein, 9 aa, Homo Sapiens
SAPGNALFG

SEQ ID NO: 1357423 - protein, 9 aa, Homo Sapiens
YALGQTGLD

SEQ ID NO: 1357424 - protein, 9 aa, Homo Sapiens
DLYALKYVK

SEQ ID NO: 1357425 - protein, 9 aa, Homo Sapiens
NKIGTSLSS

SEQ ID NO: 1357426 - protein, 9 aa, Homo Sapiens
ASAPPAFSG

SEQ ID NO: 1357427 - protein, 9 aa, Homo Sapiens
KVSNDISMR

SEQ ID NO: 1357428 - protein, 9 aa, Homo Sapiens
GTWLTQNEF

SEQ ID NO: 1357429 - protein, 9 aa, Homo Sapiens
RYNLRYYKT

SEQ ID NO: 1357430 - protein, 9 aa, Homo Sapiens
NADPEMVEN

SEQ ID NO: 1357431 - protein, 9 aa, Homo Sapiens
PFSPKNAGY

SEQ ID NO: 1357432 - protein, 9 aa, Homo Sapiens
GDGDIDHDH

SEQ ID NO: 1357433 - protein, 9 aa, Homo Sapiens
HESLLQIPE

SEQ ID NO: 1357434 - protein, 9 aa, Homo Sapiens
LNDLAKVEN

SEQ ID NO: 1357435 - protein, 9 aa, Homo Sapiens
HNCGVPEGH

SEQ ID NO: 1357436 - protein, 9 aa, Homo Sapiens
KKLRNESVT

SEQ ID NO: 1357437 - protein, 9 aa, Homo Sapiens
LRVHTVEKP

SEQ ID NO: 1357438 - protein, 9 aa, Homo Sapiens
RGVKIRFYF

SEQ ID NO: 1357439 - protein, 9 aa, Homo Sapiens
QMNLYVAGA

SEQ ID NO: 1357440 - protein, 9 aa, Homo Sapiens
NWDLLRTLN

SEQ ID NO: 1357441 - protein, 9 aa, Homo Sapiens
KHNVTKLLT

SEQ ID NO: 1357442 - protein, 9 aa, Homo Sapiens
NYCIGGTVL

SEQ ID NO: 1357443 - protein, 9 aa, Homo Sapiens
SHHCRCQSS

SEQ ID NO: 1357444 - protein, 9 aa, Homo Sapiens
DPNQEELHE

SEQ ID NO: 1357445 - protein, 9 aa, Homo Sapiens
KFSLFVLDG

SEQ ID NO: 1357446 - protein, 9 aa, Homo Sapiens
EEDEASSKT

SEQ ID NO: 1357447 - protein, 9 aa, Homo Sapiens
NQELKRKFN

SEQ ID NO: 1357448 - protein, 9 aa, Homo Sapiens
AQVQQHGSG

SEQ ID NO: 1357449 - protein, 9 aa, Homo Sapiens
QHKGLYCDY

SEQ ID NO: 1357450 - protein, 9 aa, Homo Sapiens
PVRKKRGIP

SEQ ID NO: 1357451 - protein, 9 aa, Homo Sapiens
QKIIDFIAD

SEQ ID NO: 1357452 - protein, 9 aa, Homo Sapiens
ESEPATAAA

SEQ ID NO: 1357453 - protein, 9 aa, Homo Sapiens
TLLHPQYSF

SEQ ID NO: 1357454 - protein, 9 aa, Homo Sapiens
RKQDQEEEM

SEQ ID NO: 1357455 - protein, 9 aa, Homo Sapiens
IFTIVGFIW

SEQ ID NO: 1357456 - protein, 9 aa, Homo Sapiens
REASNTDRT

SEQ ID NO: 1357457 - protein, 9 aa, Homo Sapiens
YSLMKVNPV

SEQ ID NO: 1357458 - protein, 9 aa, Homo Sapiens
YSLYLPIAA

SEQ ID NO: 1357459 - protein, 9 aa, Homo Sapiens
FEDLFKQKE

SEQ ID NO: 1357460 - protein, 9 aa, Homo Sapiens
ANKSVKVIV

SEQ ID NO: 1357461 - protein, 9 aa, Homo Sapiens
TLCEGAFGK

SEQ ID NO: 1357462 - protein, 9 aa, Homo Sapiens
PQHMKEFLG

SEQ ID NO: 1357463 - protein, 9 aa, Homo Sapiens
VDNQSFPYQ

SEQ ID NO: 1357464 - protein, 9 aa, Homo Sapiens
LKSDSVVQT

SEQ ID NO: 1357465 - protein, 9 aa, Homo Sapiens
RPSGAKQSL

SEQ ID NO: 1357466 - protein, 9 aa, Homo Sapiens
AVHGGSFIL

SEQ ID NO: 1357467 - protein, 9 aa, Homo Sapiens
KKFDVKTVS

SEQ ID NO: 1357468 - protein, 9 aa, Homo Sapiens
SFTSQWEEI

SEQ ID NO: 1357469 - protein, 9 aa, Homo Sapiens
STQSKAGSL

SEQ ID NO: 1357470 - protein, 9 aa, Homo Sapiens
EPSNKIGTS

SEQ ID NO: 1357471 - protein, 9 aa, Homo Sapiens
IRLFNLIEA

SEQ ID NO: 1357472 - protein, 9 aa, Homo Sapiens
EVTFVKLEN

SEQ ID NO: 1357473 - protein, 9 aa, Homo Sapiens
YPGNHCPGD

SEQ ID NO: 1357474 - protein, 9 aa, Homo Sapiens
VWTFNWQAL

SEQ ID NO: 1357475 - protein, 9 aa, Homo Sapiens
ILSYKQECK

SEQ ID NO: 1357476 - protein, 9 aa, Homo Sapiens
VDSNAIIKD

SEQ ID NO: 1357477 - protein, 9 aa, Homo Sapiens
CQTESCWLM

SEQ ID NO: 1357478 - protein, 9 aa, Homo Sapiens
FIIILMIQY

SEQ ID NO: 1357479 - protein, 9 aa, Homo Sapiens
SDAANVIVY

SEQ ID NO: 1357480 - protein, 9 aa, Homo Sapiens
IHNNNVRRL

SEQ ID NO: 1357481 - protein, 9 aa, Homo Sapiens
AREDLPGHV

SEQ ID NO: 1357482 - protein, 9 aa, Homo Sapiens
LQQQAVTGI

SEQ ID NO: 1357483 - protein, 9 aa, Homo Sapiens
MILLKMEQK

SEQ ID NO: 1357484 - protein, 9 aa, Homo Sapiens
VNVVVDYRL

SEQ ID NO: 1357485 - protein, 9 aa, Homo Sapiens
FNILCVVET

SEQ ID NO: 1357486 - protein, 9 aa, Homo Sapiens
VMEAFVNQP

SEQ ID NO: 1357487 - protein, 9 aa, Homo Sapiens
NQLSKNITR

SEQ ID NO: 1357488 - protein, 9 aa, Homo Sapiens
YLHNNPMNC

SEQ ID NO: 1357489 - protein, 9 aa, Homo Sapiens
LMIQYKVCN

SEQ ID NO: 1357490 - protein, 9 aa, Homo Sapiens
DKLLCQLTQ

SEQ ID NO: 1357491 - protein, 9 aa, Homo Sapiens
LKKIKTGRS

SEQ ID NO: 1357492 - protein, 9 aa, Homo Sapiens
GRDSDSNSS

SEQ ID NO: 1357493 - protein, 9 aa, Homo Sapiens
AKSKAPAIS

SEQ ID NO: 1357494 - protein, 9 aa, Homo Sapiens
VKHSVQIPV

SEQ ID NO: 1357495 - protein, 9 aa, Homo Sapiens
KYLYLGKNQ

SEQ ID NO: 1357496 - protein, 9 aa, Homo Sapiens
NGYESPEIA

SEQ ID NO: 1357497 - protein, 9 aa, Homo Sapiens
LSNTSLAPI

SEQ ID NO: 1357498 - protein, 9 aa, Homo Sapiens
FSKEGRYVK

SEQ ID NO: 1357499 - protein, 9 aa, Homo Sapiens
MDYHEIGRC

SEQ ID NO: 1357500 - protein, 9 aa, Homo Sapiens
NKLKVLHPL

SEQ ID NO: 1357501 - protein, 9 aa, Homo Sapiens
GDFCYQDVH

SEQ ID NO: 1357502 - protein, 9 aa, Homo Sapiens
AESSYYLEK

SEQ ID NO: 1357503 - protein, 9 aa, Homo Sapiens
LGNMAFAEA

SEQ ID NO: 1357504 - protein, 9 aa, Homo Sapiens
TPLLNHIIY

SEQ ID NO: 1357505 - protein, 9 aa, Homo Sapiens
RFCWQLVKR

SEQ ID NO: 1357506 - protein, 9 aa, Homo Sapiens
VFNFCTSHI

SEQ ID NO: 1357507 - protein, 9 aa, Homo Sapiens
TSKIIQDFE

SEQ ID NO: 1357508 - protein, 9 aa, Homo Sapiens
GFCKLLLYW

SEQ ID NO: 1357509 - protein, 9 aa, Homo Sapiens
SVDPTSERL

SEQ ID NO: 1357510 - protein, 9 aa, Homo Sapiens
GAKGPNGEN

SEQ ID NO: 1357511 - protein, 9 aa, Homo Sapiens
SAIMQCSTS

SEQ ID NO: 1357512 - protein, 9 aa, Homo Sapiens
CWLMVFFLV

SEQ ID NO: 1357513 - protein, 9 aa, Homo Sapiens
PENNYAKEL

SEQ ID NO: 1357514 - protein, 9 aa, Homo Sapiens
LEFDINICY

SEQ ID NO: 1357515 - protein, 9 aa, Homo Sapiens
HDDKIHSIA

SEQ ID NO: 1357516 - protein, 9 aa, Homo Sapiens
WKQLVINVS

SEQ ID NO: 1357517 - protein, 9 aa, Homo Sapiens
NLKVFRHPH

SEQ ID NO: 1357518 - protein, 9 aa, Homo Sapiens
DIVEEVLKK

SEQ ID NO: 1357519 - protein, 9 aa, Homo Sapiens
LRPALQDTP

SEQ ID NO: 1357520 - protein, 9 aa, Homo Sapiens
KDVLNKLKV

SEQ ID NO: 1357521 - protein, 9 aa, Homo Sapiens
CSLLQGSPQ

SEQ ID NO: 1357522 - protein, 9 aa, Homo Sapiens
IIAQNHEAP

SEQ ID NO: 1357523 - protein, 9 aa, Homo Sapiens
SGGAWEQVY

SEQ ID NO: 1357524 - protein, 9 aa, Homo Sapiens
KGGGNHPML

SEQ ID NO: 1357525 - protein, 9 aa, Homo Sapiens
KCEECCKAF

SEQ ID NO: 1357526 - protein, 9 aa, Homo Sapiens
EEFNIKLAR

SEQ ID NO: 1357527 - protein, 9 aa, Homo Sapiens
ELELKAQKD

SEQ ID NO: 1357528 - protein, 9 aa, Homo Sapiens
SPNNTIVTE

SEQ ID NO: 1357529 - protein, 9 aa, Homo Sapiens
TTVILSILF

SEQ ID NO: 1357530 - protein, 9 aa, Homo Sapiens
RRPGYHIDL

SEQ ID NO: 1357531 - protein, 9 aa, Homo Sapiens
IDILINNIE

SEQ ID NO: 1357532 - protein, 9 aa, Homo Sapiens
LLQLLRAPD

SEQ ID NO: 1357533 - protein, 9 aa, Homo Sapiens
RHVAQDVLK

SEQ ID NO: 1357534 - protein, 9 aa, Homo Sapiens
QVQITTNQK

SEQ ID NO: 1357535 - protein, 9 aa, Homo Sapiens
QQLLEWCFI

SEQ ID NO: 1357536 - protein, 9 aa, Homo Sapiens
HKSYLTQGL

SEQ ID NO: 1357537 - protein, 9 aa, Homo Sapiens
KTERKEVDE

SEQ ID NO: 1357538 - protein, 9 aa, Homo Sapiens
KSYLTQGLI

SEQ ID NO: 1357539 - protein, 9 aa, Homo Sapiens
NNPATAATN

SEQ ID NO: 1357540 - protein, 9 aa, Homo Sapiens
VDAARAFEC

SEQ ID NO: 1357541 - protein, 9 aa, Homo Sapiens
SDDDDDNVV

SEQ ID NO: 1357542 - protein, 9 aa, Homo Sapiens
VDIVEEVLK

SEQ ID NO: 1357543 - protein, 9 aa, Homo Sapiens
HVKRPDLNK

SEQ ID NO: 1357544 - protein, 9 aa, Homo Sapiens
APPAFSGAA

SEQ ID NO: 1357545 - protein, 9 aa, Homo Sapiens
LGSVRLLGP

SEQ ID NO: 1357546 - protein, 9 aa, Homo Sapiens
SIAYLFRNI

SEQ ID NO: 1357547 - protein, 9 aa, Homo Sapiens
LCGEALRAA

SEQ ID NO: 1357548 - protein, 9 aa, Homo Sapiens
RTYRVVAGE

SEQ ID NO: 1357549 - protein, 9 aa, Homo Sapiens
TSDFGGEWS

SEQ ID NO: 1357550 - protein, 9 aa, Homo Sapiens
KDTSKDIEE

SEQ ID NO: 1357551 - protein, 9 aa, Homo Sapiens
ENSTASVSK

SEQ ID NO: 1357552 - protein, 9 aa, Homo Sapiens
TYVGKALEV

SEQ ID NO: 1357553 - protein, 9 aa, Homo Sapiens
HEPLGKSLA

SEQ ID NO: 1357554 - protein, 9 aa, Homo Sapiens
IFCFGTAFM

SEQ ID NO: 1357555 - protein, 9 aa, Homo Sapiens
CKLVRKQSR

SEQ ID NO: 1357556 - protein, 9 aa, Homo Sapiens
NADKSLDSF

SEQ ID NO: 1357557 - protein, 9 aa, Homo Sapiens
SNSSCLSLQ

SEQ ID NO: 1357558 - protein, 9 aa, Homo Sapiens
IIYEQRHSK

SEQ ID NO: 1357559 - protein, 9 aa, Homo Sapiens
RVQLLELSE

SEQ ID NO: 1357560 - protein, 9 aa, Homo Sapiens
FPRRISVQL

SEQ ID NO: 1357561 - protein, 9 aa, Homo Sapiens
CLDHIIYFF

SEQ ID NO: 1357562 - protein, 9 aa, Homo Sapiens
CMYKIPVGS

SEQ ID NO: 1357563 - protein, 9 aa, Homo Sapiens
RASKAWEVD

SEQ ID NO: 1357564 - protein, 9 aa, Homo Sapiens
NVAFLITVP

SEQ ID NO: 1357565 - protein, 9 aa, Homo Sapiens
EARIKRCLS

SEQ ID NO: 1357566 - protein, 9 aa, Homo Sapiens
AVPDHLMPD

SEQ ID NO: 1357567 - protein, 9 aa, Homo Sapiens
MSNHYRGLA

SEQ ID NO: 1357568 - protein, 9 aa, Homo Sapiens
LAINQYADM

SEQ ID NO: 1357569 - protein, 9 aa, Homo Sapiens
NAKSSSFIV

SEQ ID NO: 1357570 - protein, 9 aa, Homo Sapiens
LHELEEETG

SEQ ID NO: 1357571 - protein, 9 aa, Homo Sapiens
TLDNRIRTL

SEQ ID NO: 1357572 - protein, 9 aa, Homo Sapiens
VEAQPLCPL

SEQ ID NO: 1357573 - protein, 9 aa, Homo Sapiens
YLGKNQIKK

SEQ ID NO: 1357574 - protein, 9 aa, Homo Sapiens
MILQQPLQL

SEQ ID NO: 1357575 - protein, 9 aa, Homo Sapiens
DTERRYNLR

SEQ ID NO: 1357576 - protein, 9 aa, Homo Sapiens
GLTSYIWTF

SEQ ID NO: 1357577 - protein, 9 aa, Homo Sapiens
ISRVPAGLA

SEQ ID NO: 1357578 - protein, 9 aa, Homo Sapiens
AVELYKKGI

SEQ ID NO: 1357579 - protein, 9 aa, Homo Sapiens
IQKFKEEIS

SEQ ID NO: 1357580 - protein, 9 aa, Homo Sapiens
GSTRGWALS

SEQ ID NO: 1357581 - protein, 9 aa, Homo Sapiens
SVAKGPNYL

SEQ ID NO: 1357582 - protein, 9 aa, Homo Sapiens
QLLERVFTL

SEQ ID NO: 1357583 - protein, 9 aa, Homo Sapiens
NGFSWAIVP

SEQ ID NO: 1357584 - protein, 9 aa, Homo Sapiens
DEDMLKYIK

SEQ ID NO: 1357585 - protein, 9 aa, Homo Sapiens
DPLGPIDGQ

SEQ ID NO: 1357586 - protein, 9 aa, Homo Sapiens
QEGGEEEDD

SEQ ID NO: 1357587 - protein, 9 aa, Homo Sapiens
TVMTYAAIF

SEQ ID NO: 1357588 - protein, 9 aa, Homo Sapiens
WKRQQQKLE

SEQ ID NO: 1357589 - protein, 9 aa, Homo Sapiens
LIIYEQRHS

SEQ ID NO: 1357590 - protein, 9 aa, Homo Sapiens
SAPPAFSGA

SEQ ID NO: 1357591 - protein, 9 aa, Homo Sapiens
DFWAQGVLI

SEQ ID NO: 1357592 - protein, 9 aa, Homo Sapiens
ESIQKFKEE

SEQ ID NO: 1357593 - protein, 9 aa, Homo Sapiens
TNYINDNME

SEQ ID NO: 1357594 - protein, 9 aa, Homo Sapiens
PMSLGKAKD

SEQ ID NO: 1357595 - protein, 9 aa, Homo Sapiens
LQQVVFACL

SEQ ID NO: 1357596 - protein, 9 aa, Homo Sapiens
SRERTLHIQ

SEQ ID NO: 1357597 - protein, 9 aa, Homo Sapiens
TGKFCIQSR

SEQ ID NO: 1357598 - protein, 9 aa, Homo Sapiens
ATSRVHPAL

SEQ ID NO: 1357599 - protein, 9 aa, Homo Sapiens
MKSEGLSGR

SEQ ID NO: 1357600 - protein, 9 aa, Homo Sapiens
VLAKSYNQQ

SEQ ID NO: 1357601 - protein, 9 aa, Homo Sapiens
ANKAITDAA

SEQ ID NO: 1357602 - protein, 9 aa, Homo Sapiens
QVGCIEALV

SEQ ID NO: 1357603 - protein, 9 aa, Homo Sapiens
YRGLASANV

SEQ ID NO: 1357604 - protein, 9 aa, Homo Sapiens
SECYHPYCV

SEQ ID NO: 1357605 - protein, 9 aa, Homo Sapiens
FHKAGISDT

SEQ ID NO: 1357606 - protein, 9 aa, Homo Sapiens
PRSAPRQAA

SEQ ID NO: 1357607 - protein, 9 aa, Homo Sapiens
TLISDKKWS

SEQ ID NO: 1357608 - protein, 9 aa, Homo Sapiens
NRRQRDLAA

SEQ ID NO: 1357609 - protein, 9 aa, Homo Sapiens
LAEKWETVI

SEQ ID NO: 1357610 - protein, 9 aa, Homo Sapiens
FTLRGPPWA

SEQ ID NO: 1357611 - protein, 9 aa, Homo Sapiens
SSKTDLSQT

SEQ ID NO: 1357612 - protein, 9 aa, Homo Sapiens
SLMKVNYNQ

SEQ ID NO: 1357613 - protein, 9 aa, Homo Sapiens
IVMLQDNQS

SEQ ID NO: 1357614 - protein, 9 aa, Homo Sapiens
IKEDHNFHE

SEQ ID NO: 1357615 - protein, 9 aa, Homo Sapiens
VSYKAQINQ

SEQ ID NO: 1357616 - protein, 9 aa, Homo Sapiens
SEQSHQQSI

SEQ ID NO: 1357617 - protein, 9 aa, Homo Sapiens
SEPHFTLDC

SEQ ID NO: 1357618 - protein, 9 aa, Homo Sapiens
VCQVGCIEA

SEQ ID NO: 1357619 - protein, 9 aa, Homo Sapiens
FDIMRVTHV

SEQ ID NO: 1357620 - protein, 9 aa, Homo Sapiens
NRSWDLKDA

SEQ ID NO: 1357621 - protein, 9 aa, Homo Sapiens
AADEALDRI

SEQ ID NO: 1357622 - protein, 9 aa, Homo Sapiens
GSQEQRAKM

SEQ ID NO: 1357623 - protein, 9 aa, Homo Sapiens
LLRCSLLQG

SEQ ID NO: 1357624 - protein, 9 aa, Homo Sapiens
TLTPGPSAP

SEQ ID NO: 1357625 - protein, 9 aa, Homo Sapiens
SDAEDHSIQ

SEQ ID NO: 1357626 - protein, 9 aa, Homo Sapiens
FAVPMKDVT

SEQ ID NO: 1357627 - protein, 9 aa, Homo Sapiens
ILKKDSSCV

SEQ ID NO: 1357628 - protein, 9 aa, Homo Sapiens
LLGAGCNPE

SEQ ID NO: 1357629 - protein, 9 aa, Homo Sapiens
IGVQVKFDW

SEQ ID NO: 1357630 - protein, 9 aa, Homo Sapiens
KQAFTCTTK

SEQ ID NO: 1357631 - protein, 9 aa, Homo Sapiens
LTLNDAVSY

SEQ ID NO: 1357632 - protein, 9 aa, Homo Sapiens
KGGVRPALF

SEQ ID NO: 1357633 - protein, 9 aa, Homo Sapiens
QELKRKFNI

SEQ ID NO: 1357634 - protein, 9 aa, Homo Sapiens
KMLASSVLR

SEQ ID NO: 1357635 - protein, 9 aa, Homo Sapiens
KWGRTCHVN

SEQ ID NO: 1357636 - protein, 9 aa, Homo Sapiens
MPQTRVTIR

SEQ ID NO: 1357637 - protein, 9 aa, Homo Sapiens
AFSGEYIPT

SEQ ID NO: 1357638 - protein, 9 aa, Homo Sapiens
VILEKLHNC

SEQ ID NO: 1357639 - protein, 9 aa, Homo Sapiens
WKNYSNFIS

SEQ ID NO: 1357640 - protein, 9 aa, Homo Sapiens
SPASIRTAD

SEQ ID NO: 1357641 - protein, 9 aa, Homo Sapiens
AQLLERVFT

SEQ ID NO: 1357642 - protein, 9 aa, Homo Sapiens
LVNRAIAQL

SEQ ID NO: 1357643 - protein, 9 aa, Homo Sapiens
PKCNGSLMK

SEQ ID NO: 1357644 - protein, 9 aa, Homo Sapiens
DKGYSFVLF

SEQ ID NO: 1357645 - protein, 9 aa, Homo Sapiens
LWLTLCKFH

SEQ ID NO: 1357646 - protein, 9 aa, Homo Sapiens
VEWALCGAF

SEQ ID NO: 1357647 - protein, 9 aa, Homo Sapiens
WHIVDNQSF

SEQ ID NO: 1357648 - protein, 9 aa, Homo Sapiens
HLMPDPSKQ

SEQ ID NO: 1357649 - protein, 9 aa, Homo Sapiens
RAKSKAPAI

SEQ ID NO: 1357650 - protein, 9 aa, Homo Sapiens
MEADEMDSI

SEQ ID NO: 1357651 - protein, 9 aa, Homo Sapiens
FENFEDAAP

SEQ ID NO: 1357652 - protein, 9 aa, Homo Sapiens
LTIIHKRFK

SEQ ID NO: 1357653 - protein, 9 aa, Homo Sapiens
AADGREPGD

SEQ ID NO: 1357654 - protein, 9 aa, Homo Sapiens
LRRLCSSGR

SEQ ID NO: 1357655 - protein, 9 aa, Homo Sapiens
WSGGKHYDS

SEQ ID NO: 1357656 - protein, 9 aa, Homo Sapiens
PDGYRVSQA

SEQ ID NO: 1357657 - protein, 9 aa, Homo Sapiens
RRAKSKAPA

SEQ ID NO: 1357658 - protein, 9 aa, Homo Sapiens
NGGFPYTTA

SEQ ID NO: 1357659 - protein, 9 aa, Homo Sapiens
DLAMKDKLL

SEQ ID NO: 1357660 - protein, 9 aa, Homo Sapiens
YWTFLKMFT

SEQ ID NO: 1357661 - protein, 9 aa, Homo Sapiens
RELHQKHGE

SEQ ID NO: 1357662 - protein, 9 aa, Homo Sapiens
LRNKSRRYN

SEQ ID NO: 1357663 - protein, 9 aa, Homo Sapiens
APDPGHQDP

SEQ ID NO: 1357664 - protein, 9 aa, Homo Sapiens
RPKAPYSYK

SEQ ID NO: 1357665 - protein, 9 aa, Homo Sapiens
NSSCLSLQS

SEQ ID NO: 1357666 - protein, 9 aa, Homo Sapiens
YTQDVGTFV

SEQ ID NO: 1357667 - protein, 9 aa, Homo Sapiens
EQGKEPWPL

SEQ ID NO: 1357668 - protein, 9 aa, Homo Sapiens
IKNDNKNIL

SEQ ID NO: 1357669 - protein, 9 aa, Homo Sapiens
SKGDVHKAL

SEQ ID NO: 1357670 - protein, 9 aa, Homo Sapiens
KYVMDQELS

SEQ ID NO: 1357671 - protein, 9 aa, Homo Sapiens
GNILSYHNG

SEQ ID NO: 1357672 - protein, 9 aa, Homo Sapiens
SVVQTAASW

SEQ ID NO: 1357673 - protein, 9 aa, Homo Sapiens
SNAIIKDVK

SEQ ID NO: 1357674 - protein, 9 aa, Homo Sapiens
ALVPMLKLA

SEQ ID NO: 1357675 - protein, 9 aa, Homo Sapiens
SANNIPLSD

SEQ ID NO: 1357676 - protein, 9 aa, Homo Sapiens
EINYCIGGT

SEQ ID NO: 1357677 - protein, 9 aa, Homo Sapiens
SSQRNIALR

SEQ ID NO: 1357678 - protein, 9 aa, Homo Sapiens
QDPQVLNQL

SEQ ID NO: 1357679 - protein, 9 aa, Homo Sapiens
LPGQISRQP

SEQ ID NO: 1357680 - protein, 9 aa, Homo Sapiens
ERTLHIQAY

SEQ ID NO: 1357681 - protein, 9 aa, Homo Sapiens
PLGKSLAFL

SEQ ID NO: 1357682 - protein, 9 aa, Homo Sapiens
FIDRLNKHG

SEQ ID NO: 1357683 - protein, 9 aa, Homo Sapiens
GVFYGAAIF

SEQ ID NO: 1357684 - protein, 9 aa, Homo Sapiens
HGSGQIQII

SEQ ID NO: 1357685 - protein, 9 aa, Homo Sapiens
EILWLTLCK

SEQ ID NO: 1357686 - protein, 9 aa, Homo Sapiens
NVRCTLWSR

SEQ ID NO: 1357687 - protein, 9 aa, Homo Sapiens
VYNLIEENR

SEQ ID NO: 1357688 - protein, 9 aa, Homo Sapiens
IDNVVLVVP

SEQ ID NO: 1357689 - protein, 9 aa, Homo Sapiens
QRTVTIENG

SEQ ID NO: 1357690 - protein, 9 aa, Homo Sapiens
NTDIVCSDL

SEQ ID NO: 1357691 - protein, 9 aa, Homo Sapiens
ATLGDKVNS

SEQ ID NO: 1357692 - protein, 9 aa, Homo Sapiens
QGLGPSLGG

SEQ ID NO: 1357693 - protein, 9 aa, Homo Sapiens
TFRSSAQIL

SEQ ID NO: 1357694 - protein, 9 aa, Homo Sapiens
TTIIAQNHE

SEQ ID NO: 1357695 - protein, 9 aa, Homo Sapiens
FVGLASGKR

SEQ ID NO: 1357696 - protein, 9 aa, Homo Sapiens
VAQDVLKLQ

SEQ ID NO: 1357697 - protein, 9 aa, Homo Sapiens
ATNSQRVNN

SEQ ID NO: 1357698 - protein, 9 aa, Homo Sapiens
PLGAAQPAQ

SEQ ID NO: 1357699 - protein, 9 aa, Homo Sapiens
PVRFQDRRQ

SEQ ID NO: 1357700 - protein, 9 aa, Homo Sapiens
HWIHTQLVL

SEQ ID NO: 1357701 - protein, 9 aa, Homo Sapiens
CDQHKGLYC

SEQ ID NO: 1357702 - protein, 9 aa, Homo Sapiens
APWRIVWNV

SEQ ID NO: 1357703 - protein, 9 aa, Homo Sapiens
FYTQDVGTF

SEQ ID NO: 1357704 - protein, 9 aa, Homo Sapiens
SHVAVVGVF

SEQ ID NO: 1357705 - protein, 9 aa, Homo Sapiens
AAVEPIDFQ

SEQ ID NO: 1357706 - protein, 9 aa, Homo Sapiens
VWIEQFERH

SEQ ID NO: 1357707 - protein, 9 aa, Homo Sapiens
EAAKGLCWF

SEQ ID NO: 1357708 - protein, 9 aa, Homo Sapiens
QEENRELKA

SEQ ID NO: 1357709 - protein, 9 aa, Homo Sapiens
AIIKDVKLL

SEQ ID NO: 1357710 - protein, 9 aa, Homo Sapiens
AAPDPGCPD

SEQ ID NO: 1357711 - protein, 9 aa, Homo Sapiens
EDLSDKKVY

SEQ ID NO: 1357712 - protein, 9 aa, Homo Sapiens
DQNNFQDKL

SEQ ID NO: 1357713 - protein, 9 aa, Homo Sapiens
TSVGDAIQA

SEQ ID NO: 1357714 - protein, 9 aa, Homo Sapiens
QCSECYHPY

SEQ ID NO: 1357715 - protein, 9 aa, Homo Sapiens
NVADNKKGA

SEQ ID NO: 1357716 - protein, 9 aa, Homo Sapiens
NELSSIQST

SEQ ID NO: 1357717 - protein, 9 aa, Homo Sapiens
RNYYYYASR

SEQ ID NO: 1357718 - protein, 9 aa, Homo Sapiens
SNNDFNTTE

SEQ ID NO: 1357719 - protein, 9 aa, Homo Sapiens
EKMRHVPSW

SEQ ID NO: 1357720 - protein, 9 aa, Homo Sapiens
HVPSWQIMA

SEQ ID NO: 1357721 - protein, 9 aa, Homo Sapiens
SSQEVHESL

SEQ ID NO: 1357722 - protein, 9 aa, Homo Sapiens
RVPAGLASL

SEQ ID NO: 1357723 - protein, 9 aa, Homo Sapiens
VLLHTDHLI

SEQ ID NO: 1357724 - protein, 9 aa, Homo Sapiens
KGANKVAEL

SEQ ID NO: 1357725 - protein, 9 aa, Homo Sapiens
IKTGRSALV

SEQ ID NO: 1357726 - protein, 9 aa, Homo Sapiens
YANKSVKVI

SEQ ID NO: 1357727 - protein, 9 aa, Homo Sapiens
KVRKHAEAL

SEQ ID NO: 1357728 - protein, 9 aa, Homo Sapiens
QAALRHKQA

SEQ ID NO: 1357729 - protein, 9 aa, Homo Sapiens
MRNADLKLD

SEQ ID NO: 1357730 - protein, 9 aa, Homo Sapiens
FPYTTAPKI

SEQ ID NO: 1357731 - protein, 9 aa, Homo Sapiens
TESCWLMVF

SEQ ID NO: 1357732 - protein, 9 aa, Homo Sapiens
IQKKIFSKQ

SEQ ID NO: 1357733 - protein, 9 aa, Homo Sapiens
ELLRPSLHQ

SEQ ID NO: 1357734 - protein, 9 aa, Homo Sapiens
YSVVYAGWP

SEQ ID NO: 1357735 - protein, 9 aa, Homo Sapiens
SGTVQGKQI

SEQ ID NO: 1357736 - protein, 9 aa, Homo Sapiens
MIRLFNLIE

SEQ ID NO: 1357737 - protein, 9 aa, Homo Sapiens
LQPLVSFPS

SEQ ID NO: 1357738 - protein, 9 aa, Homo Sapiens
MRHVPSWQI

SEQ ID NO: 1357739 - protein, 9 aa, Homo Sapiens
THRPLDRET

SEQ ID NO: 1357740 - protein, 9 aa, Homo Sapiens
INNIERYLK

SEQ ID NO: 1357741 - protein, 9 aa, Homo Sapiens
TVYNLIEEN

SEQ ID NO: 1357742 - protein, 9 aa, Homo Sapiens
PRQAALRVL

SEQ ID NO: 1357743 - protein, 9 aa, Homo Sapiens
HHRCRRSHH

SEQ ID NO: 1357744 - protein, 9 aa, Homo Sapiens
VIVYVGIPK

SEQ ID NO: 1357745 - protein, 9 aa, Homo Sapiens
TNAFSGEYI

SEQ ID NO: 1357746 - protein, 9 aa, Homo Sapiens
LVHQDGLEP

SEQ ID NO: 1357747 - protein, 9 aa, Homo Sapiens
HLELKGVPI

SEQ ID NO: 1357748 - protein, 9 aa, Homo Sapiens
IQAYNETFS

SEQ ID NO: 1357749 - protein, 9 aa, Homo Sapiens
SDVAWNFKK

SEQ ID NO: 1357750 - protein, 9 aa, Homo Sapiens
FPNPNKLHC

SEQ ID NO: 1357751 - protein, 9 aa, Homo Sapiens
FEEFGKLLM

SEQ ID NO: 1357752 - protein, 9 aa, Homo Sapiens
TAILKSKKN

SEQ ID NO: 1357753 - protein, 9 aa, Homo Sapiens
PTLQSLLEK

SEQ ID NO: 1357754 - protein, 9 aa, Homo Sapiens
LNEKYNKSV

SEQ ID NO: 1357755 - protein, 9 aa, Homo Sapiens
CRNGVACIA

SEQ ID NO: 1357756 - protein, 9 aa, Homo Sapiens
LESHSHLSV

SEQ ID NO: 1357757 - protein, 9 aa, Homo Sapiens
YLNTWPIFI

SEQ ID NO: 1357758 - protein, 9 aa, Homo Sapiens
SKYEDKKLR

SEQ ID NO: 1357759 - protein, 9 aa, Homo Sapiens
MLRLQKMLA

SEQ ID NO: 1357760 - protein, 9 aa, Homo Sapiens
FCYKPGACV

SEQ ID NO: 1357761 - protein, 9 aa, Homo Sapiens
GKAKDNQSI

SEQ ID NO: 1357762 - protein, 9 aa, Homo Sapiens
DILINNIER

SEQ ID NO: 1357763 - protein, 9 aa, Homo Sapiens
LCGAECFLL

SEQ ID NO: 1357764 - protein, 9 aa, Homo Sapiens
FMCHRCGKQ

SEQ ID NO: 1357765 - protein, 9 aa, Homo Sapiens
DIPYQEIAV

SEQ ID NO: 1357766 - protein, 9 aa, Homo Sapiens
MYKKLWWAD

SEQ ID NO: 1357767 - protein, 9 aa, Homo Sapiens
NLQNVSLPS

SEQ ID NO: 1357768 - protein, 9 aa, Homo Sapiens
AVSLVITWT

SEQ ID NO: 1357769 - protein, 9 aa, Homo Sapiens
YEDKKLRNE

SEQ ID NO: 1357770 - protein, 9 aa, Homo Sapiens
YEKLPTHTH

SEQ ID NO: 1357771 - protein, 9 aa, Homo Sapiens
QVVSKNMYS

SEQ ID NO: 1357772 - protein, 9 aa, Homo Sapiens
PGNALFGQG

SEQ ID NO: 1357773 - protein, 9 aa, Homo Sapiens
LYFLGLEHP

SEQ ID NO: 1357774 - protein, 9 aa, Homo Sapiens
ITSDDHVIE

SEQ ID NO: 1357775 - protein, 9 aa, Homo Sapiens
IDHDHALAQ

SEQ ID NO: 1357776 - protein, 9 aa, Homo Sapiens
RNKCQTESC

SEQ ID NO: 1357777 - protein, 9 aa, Homo Sapiens
VIRLQEEEV

SEQ ID NO: 1357778 - protein, 9 aa, Homo Sapiens
CNAQVTQTK

SEQ ID NO: 1357779 - protein, 9 aa, Homo Sapiens
LRPSLHQLK

SEQ ID NO: 1357780 - protein, 9 aa, Homo Sapiens
SPGSPPLGF

SEQ ID NO: 1357781 - protein, 9 aa, Homo Sapiens
FCFGTAFMN

SEQ ID NO: 1357782 - protein, 9 aa, Homo Sapiens
MSILMAVIA

SEQ ID NO: 1357783 - protein, 9 aa, Homo Sapiens
CPASPHWPP

SEQ ID NO: 1357784 - protein, 9 aa, Homo Sapiens
AELLIKIKD

SEQ ID NO: 1357785 - protein, 9 aa, Homo Sapiens
MELLGVCSD

SEQ ID NO: 1357786 - protein, 9 aa, Homo Sapiens
ISMKSEGLS

SEQ ID NO: 1357787 - protein, 9 aa, Homo Sapiens
PPSSRYLAS

SEQ ID NO: 1357788 - protein, 9 aa, Homo Sapiens
SIADLRLKV

SEQ ID NO: 1357789 - protein, 9 aa, Homo Sapiens
GARCDQACV

SEQ ID NO: 1357790 - protein, 9 aa, Homo Sapiens
YVERLERFF

SEQ ID NO: 1357791 - protein, 9 aa, Homo Sapiens
RHVEQRKIL

SEQ ID NO: 1357792 - protein, 9 aa, Homo Sapiens
GLDKCRTPL

SEQ ID NO: 1357793 - protein, 9 aa, Homo Sapiens
LKVLHPLPG

SEQ ID NO: 1357794 - protein, 9 aa, Homo Sapiens
GTDSEVRCF

SEQ ID NO: 1357795 - protein, 9 aa, Homo Sapiens
LMARPEYKE

SEQ ID NO: 1357796 - protein, 9 aa, Homo Sapiens
DQIAKYDGK

SEQ ID NO: 1357797 - protein, 9 aa, Homo Sapiens
IMQMWLNAS

SEQ ID NO: 1357798 - protein, 9 aa, Homo Sapiens
PEENGLAVI

SEQ ID NO: 1357799 - protein, 9 aa, Homo Sapiens
EELHELEEE

SEQ ID NO: 1357800 - protein, 9 aa, Homo Sapiens
PLSMTSTPK

SEQ ID NO: 1357801 - protein, 9 aa, Homo Sapiens
TLRNYYYYA

SEQ ID NO: 1357802 - protein, 9 aa, Homo Sapiens
LREKRFCTV

SEQ ID NO: 1357803 - protein, 9 aa, Homo Sapiens
AKSGSESKV

SEQ ID NO: 1357804 - protein, 9 aa, Homo Sapiens
QENDLDLFS

SEQ ID NO: 1357805 - protein, 9 aa, Homo Sapiens
GGTEQSLLD

SEQ ID NO: 1357806 - protein, 9 aa, Homo Sapiens
AMRESGTHC

SEQ ID NO: 1357807 - protein, 9 aa, Homo Sapiens
AEVNVEQDF

SEQ ID NO: 1357808 - protein, 9 aa, Homo Sapiens
QNKVFLLAI

SEQ ID NO: 1357809 - protein, 9 aa, Homo Sapiens
MQCSTSELT

SEQ ID NO: 1357810 - protein, 9 aa, Homo Sapiens
TTNQKTLRR

SEQ ID NO: 1357811 - protein, 9 aa, Homo Sapiens
FKIIDFLNT

SEQ ID NO: 1357812 - protein, 9 aa, Homo Sapiens
YGQLGHNSH

SEQ ID NO: 1357813 - protein, 9 aa, Homo Sapiens
PALFSVLCK

SEQ ID NO: 1357814 - protein, 9 aa, Homo Sapiens
SERLLPLAT

SEQ ID NO: 1357815 - protein, 9 aa, Homo Sapiens
APPCPASPH

SEQ ID NO: 1357816 - protein, 9 aa, Homo Sapiens
IYISHPKQE

SEQ ID NO: 1357817 - protein, 9 aa, Homo Sapiens
MWKRQQQKL

SEQ ID NO: 1357818 - protein, 9 aa, Homo Sapiens
FVNVGMVVV

SEQ ID NO: 1357819 - protein, 9 aa, Homo Sapiens
HEIGRCIST

SEQ ID NO: 1357820 - protein, 9 aa, Homo Sapiens
GPNGENGVV

SEQ ID NO: 1357821 - protein, 9 aa, Homo Sapiens
AGSHERLQD

SEQ ID NO: 1357822 - protein, 9 aa, Homo Sapiens
GSAFPHGGE

SEQ ID NO: 1357823 - protein, 9 aa, Homo Sapiens
SGSQGGIAP

SEQ ID NO: 1357824 - protein, 9 aa, Homo Sapiens
LDNRIRTLS

SEQ ID NO: 1357825 - protein, 9 aa, Homo Sapiens
KLKKASQSQ

SEQ ID NO: 1357826 - protein, 9 aa, Homo Sapiens
IYYECLAKK

SEQ ID NO: 1357827 - protein, 9 aa, Homo Sapiens
RNFTFRSSA

SEQ ID NO: 1357828 - protein, 9 aa, Homo Sapiens
ALGQTGLDA

SEQ ID NO: 1357829 - protein, 9 aa, Homo Sapiens
VAKYALFLE

SEQ ID NO: 1357830 - protein, 9 aa, Homo Sapiens
TQGLIGSVG

SEQ ID NO: 1357831 - protein, 9 aa, Homo Sapiens
GGVRPALFK

SEQ ID NO: 1357832 - protein, 9 aa, Homo Sapiens
DSLPGQISR

SEQ ID NO: 1357833 - protein, 9 aa, Homo Sapiens
DLFKQKESL

SEQ ID NO: 1357834 - protein, 9 aa, Homo Sapiens
TDSLPGQIS

SEQ ID NO: 1357835 - protein, 9 aa, Homo Sapiens
IKGEGSVLQ

SEQ ID NO: 1357836 - protein, 9 aa, Homo Sapiens
IIMKTLIVA

SEQ ID NO: 1357837 - protein, 9 aa, Homo Sapiens
PIEWKQLVI

SEQ ID NO: 1357838 - protein, 9 aa, Homo Sapiens
AVGSDCGGS

SEQ ID NO: 1357839 - protein, 9 aa, Homo Sapiens
PELKLLCAA

SEQ ID NO: 1357840 - protein, 9 aa, Homo Sapiens
SFQAPSPLL

SEQ ID NO: 1357841 - protein, 9 aa, Homo Sapiens
CAFAGWEVH

SEQ ID NO: 1357842 - protein, 9 aa, Homo Sapiens
FLTAVHGGS

SEQ ID NO: 1357843 - protein, 9 aa, Homo Sapiens
LCPLDERAN

SEQ ID NO: 1357844 - protein, 9 aa, Homo Sapiens
EKKQLCFDD

SEQ ID NO: 1357845 - protein, 9 aa, Homo Sapiens
DDQIAKYDG

SEQ ID NO: 1357846 - protein, 9 aa, Homo Sapiens
LQVVKHSVQ

SEQ ID NO: 1357847 - protein, 9 aa, Homo Sapiens
IAYLFRNIT

SEQ ID NO: 1357848 - protein, 9 aa, Homo Sapiens
KLLDTRSCK

SEQ ID NO: 1357849 - protein, 9 aa, Homo Sapiens
SLLEKGYIK

SEQ ID NO: 1357850 - protein, 9 aa, Homo Sapiens
SSNTCSVFG

SEQ ID NO: 1357851 - protein, 9 aa, Homo Sapiens
NCGHYEQRF

SEQ ID NO: 1357852 - protein, 9 aa, Homo Sapiens
SMLRLQKML

SEQ ID NO: 1357853 - protein, 9 aa, Homo Sapiens
AILKSKKNF

SEQ ID NO: 1357854 - protein, 9 aa, Homo Sapiens
RPPALRPAL

SEQ ID NO: 1357855 - protein, 9 aa, Homo Sapiens
GKLSNVKRT

SEQ ID NO: 1357856 - protein, 9 aa, Homo Sapiens
KVFRHPHII

SEQ ID NO: 1357857 - protein, 9 aa, Homo Sapiens
QCVVPLGVP

SEQ ID NO: 1357858 - protein, 9 aa, Homo Sapiens
DARNWDLLR

SEQ ID NO: 1357859 - protein, 9 aa, Homo Sapiens
IEGVLDSYF

SEQ ID NO: 1357860 - protein, 9 aa, Homo Sapiens
LDEATAAVI

SEQ ID NO: 1357861 - protein, 9 aa, Homo Sapiens
MFYYFAKHL

SEQ ID NO: 1357862 - protein, 9 aa, Homo Sapiens
SCVIQFMSR

SEQ ID NO: 1357863 - protein, 9 aa, Homo Sapiens
PPPLQPEVY

SEQ ID NO: 1357864 - protein, 9 aa, Homo Sapiens
RIKGEGSVL

SEQ ID NO: 1357865 - protein, 9 aa, Homo Sapiens
KRTRNLESN

SEQ ID NO: 1357866 - protein, 9 aa, Homo Sapiens
DRYTIRSPV

SEQ ID NO: 1357867 - protein, 9 aa, Homo Sapiens
RRSHHCRCQ

SEQ ID NO: 1357868 - protein, 9 aa, Homo Sapiens
NVIVYVGIP

SEQ ID NO: 1357869 - protein, 9 aa, Homo Sapiens
TLAEKWETV

SEQ ID NO: 1357870 - protein, 9 aa, Homo Sapiens
LHGFPELWY

SEQ ID NO: 1357871 - protein, 9 aa, Homo Sapiens
LPTHTHHAS

SEQ ID NO: 1357872 - protein, 9 aa, Homo Sapiens
DLKSPGSPP

SEQ ID NO: 1357873 - protein, 9 aa, Homo Sapiens
SDFLMQSAV

SEQ ID NO: 1357874 - protein, 9 aa, Homo Sapiens
HLFGVTIFY

SEQ ID NO: 1357875 - protein, 9 aa, Homo Sapiens
SVAESSYYL

SEQ ID NO: 1357876 - protein, 9 aa, Homo Sapiens
QYELVNRAI

SEQ ID NO: 1357877 - protein, 9 aa, Homo Sapiens
IITDKSVRN

SEQ ID NO: 1357878 - protein, 9 aa, Homo Sapiens
FPELWYSWR

SEQ ID NO: 1357879 - protein, 9 aa, Homo Sapiens
SLLNYQDGV

SEQ ID NO: 1357880 - protein, 9 aa, Homo Sapiens
ETTVILSIL

SEQ ID NO: 1357881 - protein, 9 aa, Homo Sapiens
PQPGPVRFQ

SEQ ID NO: 1357882 - protein, 9 aa, Homo Sapiens
EDAQAMECE

SEQ ID NO: 1357883 - protein, 9 aa, Homo Sapiens
ATLRNYYYY

SEQ ID NO: 1357884 - protein, 9 aa, Homo Sapiens
FVKDLLTME

SEQ ID NO: 1357885 - protein, 9 aa, Homo Sapiens
PISRELLRP

SEQ ID NO: 1357886 - protein, 9 aa, Homo Sapiens
SQKLSAVEK

SEQ ID NO: 1357887 - protein, 9 aa, Homo Sapiens
HSNPGDYAL

SEQ ID NO: 1357888 - protein, 9 aa, Homo Sapiens
ENFEDAAPE

SEQ ID NO: 1357889 - protein, 9 aa, Homo Sapiens
QSNGGFPYT

SEQ ID NO: 1357890 - protein, 9 aa, Homo Sapiens
SDVTDGAFF

SEQ ID NO: 1357891 - protein, 9 aa, Homo Sapiens
FHFLTIIHK

SEQ ID NO: 1357892 - protein, 9 aa, Homo Sapiens
RGSFCYKPG

SEQ ID NO: 1357893 - protein, 9 aa, Homo Sapiens
HASCWNPLE

SEQ ID NO: 1357894 - protein, 9 aa, Homo Sapiens
RGPQSGLPE

SEQ ID NO: 1357895 - protein, 9 aa, Homo Sapiens
KFHNQVEIE

SEQ ID NO: 1357896 - protein, 9 aa, Homo Sapiens
LYFGSFCQG

SEQ ID NO: 1357897 - protein, 9 aa, Homo Sapiens
QLGHNSHGK

SEQ ID NO: 1357898 - protein, 9 aa, Homo Sapiens
ALQEENREL

SEQ ID NO: 1357899 - protein, 9 aa, Homo Sapiens
WTFLKMFTI

SEQ ID NO: 1357900 - protein, 9 aa, Homo Sapiens
SYLTQGLIG

SEQ ID NO: 1357901 - protein, 9 aa, Homo Sapiens
LWSKGDVHK

SEQ ID NO: 1357902 - protein, 9 aa, Homo Sapiens
QCGDITAIL

SEQ ID NO: 1357903 - protein, 9 aa, Homo Sapiens
LELTKCQLA

SEQ ID NO: 1357904 - protein, 9 aa, Homo Sapiens
VISRFLYTE

SEQ ID NO: 1357905 - protein, 9 aa, Homo Sapiens
GAVAADGRE

SEQ ID NO: 1357906 - protein, 9 aa, Homo Sapiens
TYEDQRDFI

SEQ ID NO: 1357907 - protein, 9 aa, Homo Sapiens
ALSYKDMEI

SEQ ID NO: 1357908 - protein, 9 aa, Homo Sapiens
EIVDTLCEG

SEQ ID NO: 1357909 - protein, 9 aa, Homo Sapiens
DRCFRLHNK

SEQ ID NO: 1357910 - protein, 9 aa, Homo Sapiens
QAALHQLFQ

SEQ ID NO: 1357911 - protein, 9 aa, Homo Sapiens
AALRHKQAA

SEQ ID NO: 1357912 - protein, 9 aa, Homo Sapiens
LKENLQNVS

SEQ ID NO: 1357913 - protein, 9 aa, Homo Sapiens
FSRRAEENI

SEQ ID NO: 1357914 - protein, 9 aa, Homo Sapiens
QIVYGNYDS

SEQ ID NO: 1357915 - protein, 9 aa, Homo Sapiens
ERHLTRAQM

SEQ ID NO: 1357916 - protein, 9 aa, Homo Sapiens
LLEQLFLPH

SEQ ID NO: 1357917 - protein, 9 aa, Homo Sapiens
KEILEKSYK

SEQ ID NO: 1357918 - protein, 9 aa, Homo Sapiens
VRSKTKVSV

SEQ ID NO: 1357919 - protein, 9 aa, Homo Sapiens
QQATREYTL

SEQ ID NO: 1357920 - protein, 9 aa, Homo Sapiens
CPLDERANA

SEQ ID NO: 1357921 - protein, 9 aa, Homo Sapiens
CKLLLYWVL

SEQ ID NO: 1357922 - protein, 9 aa, Homo Sapiens
QDKGGVRPA

SEQ ID NO: 1357923 - protein, 9 aa, Homo Sapiens
IAQNHEAPM

SEQ ID NO: 1357924 - protein, 9 aa, Homo Sapiens
FWLACQDFK

SEQ ID NO: 1357925 - protein, 9 aa, Homo Sapiens
VIDQNLLNF

SEQ ID NO: 1357926 - protein, 9 aa, Homo Sapiens
VEEVLKKGF

SEQ ID NO: 1357927 - protein, 9 aa, Homo Sapiens
KKELERGSN

SEQ ID NO: 1357928 - protein, 9 aa, Homo Sapiens
GIHKRTHTV

SEQ ID NO: 1357929 - protein, 9 aa, Homo Sapiens
WDPKGEMAA

SEQ ID NO: 1357930 - protein, 9 aa, Homo Sapiens
YRKTTTVVF

SEQ ID NO: 1357931 - protein, 9 aa, Homo Sapiens
LVINVSKML

SEQ ID NO: 1357932 - protein, 9 aa, Homo Sapiens
MPASDVFLR

SEQ ID NO: 1357933 - protein, 9 aa, Homo Sapiens
SVSTTVILA

SEQ ID NO: 1357934 - protein, 9 aa, Homo Sapiens
VKLLDTRSC

SEQ ID NO: 1357935 - protein, 9 aa, Homo Sapiens
FGTEYIRTS

SEQ ID NO: 1357936 - protein, 9 aa, Homo Sapiens
NGESIAYLF

SEQ ID NO: 1357937 - protein, 9 aa, Homo Sapiens
YTYRNPFVQ

SEQ ID NO: 1357938 - protein, 9 aa, Homo Sapiens
QATSSRPNL

SEQ ID NO: 1357939 - protein, 9 aa, Homo Sapiens
ENNTDIVCS

SEQ ID NO: 1357940 - protein, 9 aa, Homo Sapiens
LCLHLQVPL

SEQ ID NO: 1357941 - protein, 9 aa, Homo Sapiens
VYAGWPIYP

SEQ ID NO: 1357942 - protein, 9 aa, Homo Sapiens
NVKRTRNLE

SEQ ID NO: 1357943 - protein, 9 aa, Homo Sapiens
PLVSFPSLQ

SEQ ID NO: 1357944 - protein, 9 aa, Homo Sapiens
PQVSFVKFE

SEQ ID NO: 1357945 - protein, 9 aa, Homo Sapiens
EFPDTQRQR

SEQ ID NO: 1357946 - protein, 9 aa, Homo Sapiens
ESLTKLQHL

SEQ ID NO: 1357947 - protein, 9 aa, Homo Sapiens
SCDQPLGYH

SEQ ID NO: 1357948 - protein, 9 aa, Homo Sapiens
PAVYATYDV

SEQ ID NO: 1357949 - protein, 9 aa, Homo Sapiens
QNNFQDKLE

SEQ ID NO: 1357950 - protein, 9 aa, Homo Sapiens
LGGFLYKLK

SEQ ID NO: 1357951 - protein, 9 aa, Homo Sapiens
NQRRMSFVG

SEQ ID NO: 1357952 - protein, 9 aa, Homo Sapiens
VCPIINWED

SEQ ID NO: 1357953 - protein, 9 aa, Homo Sapiens
QAAEKVKAD

SEQ ID NO: 1357954 - protein, 9 aa, Homo Sapiens
SLDRSCQDL

SEQ ID NO: 1357955 - protein, 9 aa, Homo Sapiens
YNLIEENRQ

SEQ ID NO: 1357956 - protein, 9 aa, Homo Sapiens
LHQSKTKSQ

SEQ ID NO: 1357957 - protein, 9 aa, Homo Sapiens
LEQKHCWLL

SEQ ID NO: 1357958 - protein, 9 aa, Homo Sapiens
PPGIKNDNK

SEQ ID NO: 1357959 - protein, 9 aa, Homo Sapiens
TLWEIIAED

SEQ ID NO: 1357960 - protein, 9 aa, Homo Sapiens
MVENQIEKV

SEQ ID NO: 1357961 - protein, 9 aa, Homo Sapiens
TEQSLLDSQ

SEQ ID NO: 1357962 - protein, 9 aa, Homo Sapiens
EHVYFSELD

SEQ ID NO: 1357963 - protein, 9 aa, Homo Sapiens
MDVALSYKD

SEQ ID NO: 1357964 - protein, 9 aa, Homo Sapiens
AEAARIKGE

SEQ ID NO: 1357965 - protein, 9 aa, Homo Sapiens
AQPHCQQGL

SEQ ID NO: 1357966 - protein, 9 aa, Homo Sapiens
NILSYHNGF

SEQ ID NO: 1357967 - protein, 9 aa, Homo Sapiens
QKLERKIIG

SEQ ID NO: 1357968 - protein, 9 aa, Homo Sapiens
LMVFFLVLM

SEQ ID NO: 1357969 - protein, 9 aa, Homo Sapiens
QFGEILTIT

SEQ ID NO: 1357970 - protein, 9 aa, Homo Sapiens
GPIDGQDGP

SEQ ID NO: 1357971 - protein, 9 aa, Homo Sapiens
EIQNLKVFR

SEQ ID NO: 1357972 - protein, 9 aa, Homo Sapiens
KKIKTGRSA

SEQ ID NO: 1357973 - protein, 9 aa, Homo Sapiens
EDEDDGDAT

SEQ ID NO: 1357974 - protein, 9 aa, Homo Sapiens
DGCRNGVAC

SEQ ID NO: 1357975 - protein, 9 aa, Homo Sapiens
KEQAVELYK

SEQ ID NO: 1357976 - protein, 9 aa, Homo Sapiens
AACQSHALM

SEQ ID NO: 1357977 - protein, 9 aa, Homo Sapiens
LLLKALVPM

SEQ ID NO: 1357978 - protein, 9 aa, Homo Sapiens
TFALTSWGW

SEQ ID NO: 1357979 - protein, 9 aa, Homo Sapiens
CTVSVGEAS

SEQ ID NO: 1357980 - protein, 9 aa, Homo Sapiens
AFSIHSYKE

SEQ ID NO: 1357981 - protein, 9 aa, Homo Sapiens
SVSHHRPRL

SEQ ID NO: 1357982 - protein, 9 aa, Homo Sapiens
RRLHYNEEF

SEQ ID NO: 1357983 - protein, 9 aa, Homo Sapiens
QNHEAPMIE

SEQ ID NO: 1357984 - protein, 9 aa, Homo Sapiens
DVMWKNYSN

SEQ ID NO: 1357985 - protein, 9 aa, Homo Sapiens
KVENALQEK

SEQ ID NO: 1357986 - protein, 9 aa, Homo Sapiens
DSVLIIYEQ

SEQ ID NO: 1357987 - protein, 9 aa, Homo Sapiens
LASKSSYSL

SEQ ID NO: 1357988 - protein, 9 aa, Homo Sapiens
VTQEGTLIV

SEQ ID NO: 1357989 - protein, 9 aa, Homo Sapiens
IVSHLRIHT

SEQ ID NO: 1357990 - protein, 9 aa, Homo Sapiens
IMDNWIFGE

SEQ ID NO: 1357991 - protein, 9 aa, Homo Sapiens
QSSQEVQVP

SEQ ID NO: 1357992 - protein, 9 aa, Homo Sapiens
IYKQLQQQA

SEQ ID NO: 1357993 - protein, 9 aa, Homo Sapiens
VGFAGHSVD

SEQ ID NO: 1357994 - protein, 9 aa, Homo Sapiens
LHNNPMNCD

SEQ ID NO: 1357995 - protein, 9 aa, Homo Sapiens
NISDNCGHY

SEQ ID NO: 1357996 - protein, 9 aa, Homo Sapiens
YEQRHSKRK

SEQ ID NO: 1357997 - protein, 9 aa, Homo Sapiens
KNADPEMVE

SEQ ID NO: 1357998 - protein, 9 aa, Homo Sapiens
WEANGFAER

SEQ ID NO: 1357999 - protein, 9 aa, Homo Sapiens
QIFYCRLQD

SEQ ID NO: 1358000 - protein, 9 aa, Homo Sapiens
PEMVENQIE

SEQ ID NO: 1358001 - protein, 9 aa, Homo Sapiens
RSCQDLCDR

SEQ ID NO: 1358002 - protein, 9 aa, Homo Sapiens
VSGADRYTI

SEQ ID NO: 1358003 - protein, 9 aa, Homo Sapiens
KSQHSCNAQ

SEQ ID NO: 1358004 - protein, 9 aa, Homo Sapiens
RMATVVLAG

SEQ ID NO: 1358005 - protein, 9 aa, Homo Sapiens
PLGPIDGQD

SEQ ID NO: 1358006 - protein, 9 aa, Homo Sapiens
LVSEIHSLV

SEQ ID NO: 1358007 - protein, 9 aa, Homo Sapiens
KQLQQQAVT

SEQ ID NO: 1358008 - protein, 9 aa, Homo Sapiens
CYLPRMARL

SEQ ID NO: 1358009 - protein, 9 aa, Homo Sapiens
GELFDKVVW

SEQ ID NO: 1358010 - protein, 9 aa, Homo Sapiens
SLLALFNIG

SEQ ID NO: 1358011 - protein, 9 aa, Homo Sapiens
VADNKKGAK

SEQ ID NO: 1358012 - protein, 9 aa, Homo Sapiens
LAVSLEKLQ

SEQ ID NO: 1358013 - protein, 9 aa, Homo Sapiens
YHIYVSPLT

SEQ ID NO: 1358014 - protein, 9 aa, Homo Sapiens
EDQRDFISI

SEQ ID NO: 1358015 - protein, 9 aa, Homo Sapiens
VSGGAWEQV

SEQ ID NO: 1358016 - protein, 9 aa, Homo Sapiens
HNDHWFSPG

SEQ ID NO: 1358017 - protein, 9 aa, Homo Sapiens
PHLYTLTPG

SEQ ID NO: 1358018 - protein, 9 aa, Homo Sapiens
LGPIDGQDG

SEQ ID NO: 1358019 - protein, 9 aa, Homo Sapiens
NNTIVTEFI

SEQ ID NO: 1358020 - protein, 9 aa, Homo Sapiens
VHFQEIESL

SEQ ID NO: 1358021 - protein, 9 aa, Homo Sapiens
RQNVHIVSH

SEQ ID NO: 1358022 - protein, 9 aa, Homo Sapiens
KKGKGKKRM

SEQ ID NO: 1358023 - protein, 9 aa, Homo Sapiens
KFNHLELKG

SEQ ID NO: 1358024 - protein, 9 aa, Homo Sapiens
TRPEDSTIK

SEQ ID NO: 1358025 - protein, 9 aa, Homo Sapiens
AFPHGYYST

SEQ ID NO: 1358026 - protein, 9 aa, Homo Sapiens
YTEQLLSVL

SEQ ID NO: 1358027 - protein, 9 aa, Homo Sapiens
PAGSHERLQ

SEQ ID NO: 1358028 - protein, 9 aa, Homo Sapiens
VKEWSLIIM

SEQ ID NO: 1358029 - protein, 9 aa, Homo Sapiens
EEVTPFTAI

SEQ ID NO: 1358030 - protein, 9 aa, Homo Sapiens
PLNVSLTNR

SEQ ID NO: 1358031 - protein, 9 aa, Homo Sapiens
SIRTADFHN

SEQ ID NO: 1358032 - protein, 9 aa, Homo Sapiens
KGYSFVLFN

SEQ ID NO: 1358033 - protein, 9 aa, Homo Sapiens
FSGEYIPTV

SEQ ID NO: 1358034 - protein, 9 aa, Homo Sapiens
TQDKLARKC

SEQ ID NO: 1358035 - protein, 9 aa, Homo Sapiens
ARAGATAPG

SEQ ID NO: 1358036 - protein, 9 aa, Homo Sapiens
FYTQGDSFT

SEQ ID NO: 1358037 - protein, 9 aa, Homo Sapiens
FMLKLMRSV

SEQ ID NO: 1358038 - protein, 9 aa, Homo Sapiens
LHLDQSLEM

SEQ ID NO: 1358039 - protein, 9 aa, Homo Sapiens
LGVPASATV

SEQ ID NO: 1358040 - protein, 9 aa, Homo Sapiens
EVERVLFSY

SEQ ID NO: 1358041 - protein, 9 aa, Homo Sapiens
CAILVAKFS

SEQ ID NO: 1358042 - protein, 9 aa, Homo Sapiens
SKIIQDFEN

SEQ ID NO: 1358043 - protein, 9 aa, Homo Sapiens
RNFTEKIND

SEQ ID NO: 1358044 - protein, 9 aa, Homo Sapiens
FYQDDELWK

SEQ ID NO: 1358045 - protein, 9 aa, Homo Sapiens
SDFALWLEQ

SEQ ID NO: 1358046 - protein, 9 aa, Homo Sapiens
SPHWPPKVL

SEQ ID NO: 1358047 - protein, 9 aa, Homo Sapiens
HTDHLITEN

SEQ ID NO: 1358048 - protein, 9 aa, Homo Sapiens
DISMKSEGL

SEQ ID NO: 1358049 - protein, 9 aa, Homo Sapiens
ERGAKGPNG

SEQ ID NO: 1358050 - protein, 9 aa, Homo Sapiens
QNVHIVSHL

SEQ ID NO: 1358051 - protein, 9 aa, Homo Sapiens
RVVAGEEEQ

SEQ ID NO: 1358052 - protein, 9 aa, Homo Sapiens
LRFNPLDTF

SEQ ID NO: 1358053 - protein, 9 aa, Homo Sapiens
AGLQKTIQD

SEQ ID NO: 1358054 - protein, 9 aa, Homo Sapiens
LLKALVPML

SEQ ID NO: 1358055 - protein, 9 aa, Homo Sapiens
AQQLPKVDL

SEQ ID NO: 1358056 - protein, 9 aa, Homo Sapiens
EGWRWNLPG

SEQ ID NO: 1358057 - protein, 9 aa, Homo Sapiens
FFSVLLFAL

SEQ ID NO: 1358058 - protein, 9 aa, Homo Sapiens
MHTAEKPYK

SEQ ID NO: 1358059 - protein, 9 aa, Homo Sapiens
STSQQLTQY

SEQ ID NO: 1358060 - protein, 9 aa, Homo Sapiens
QDLAVAKYA

SEQ ID NO: 1358061 - protein, 9 aa, Homo Sapiens
FLHTHTGVS

SEQ ID NO: 1358062 - protein, 9 aa, Homo Sapiens
AKLIKNKVV

SEQ ID NO: 1358063 - protein, 9 aa, Homo Sapiens
QRIIVANIE

SEQ ID NO: 1358064 - protein, 9 aa, Homo Sapiens
IKNKVVVNE

SEQ ID NO: 1358065 - protein, 9 aa, Homo Sapiens
KRFCTVSVG

SEQ ID NO: 1358066 - protein, 9 aa, Homo Sapiens
FAIRALRKI

SEQ ID NO: 1358067 - protein, 9 aa, Homo Sapiens
KTLLGSNTV

SEQ ID NO: 1358068 - protein, 9 aa, Homo Sapiens
SCDWVRLEH

SEQ ID NO: 1358069 - protein, 9 aa, Homo Sapiens
DMNGFSWAI

SEQ ID NO: 1358070 - protein, 9 aa, Homo Sapiens
KVGQGNHGT

SEQ ID NO: 1358071 - protein, 9 aa, Homo Sapiens
KAERKAQVY

SEQ ID NO: 1358072 - protein, 9 aa, Homo Sapiens
APVSAVYFF

SEQ ID NO: 1358073 - protein, 9 aa, Homo Sapiens
FVLFNSHES

SEQ ID NO: 1358074 - protein, 9 aa, Homo Sapiens
TIIMRDPDE

SEQ ID NO: 1358075 - protein, 9 aa, Homo Sapiens
EESIQKFKE

SEQ ID NO: 1358076 - protein, 9 aa, Homo Sapiens
GLMEGLGTT

SEQ ID NO: 1358077 - protein, 9 aa, Homo Sapiens
MQGTVITTT

SEQ ID NO: 1358078 - protein, 9 aa, Homo Sapiens
KCTKATRAY

SEQ ID NO: 1358079 - protein, 9 aa, Homo Sapiens
MNLYVAGAH

SEQ ID NO: 1358080 - protein, 9 aa, Homo Sapiens
IISFIRGTS

SEQ ID NO: 1358081 - protein, 9 aa, Homo Sapiens
LQEENRELK

SEQ ID NO: 1358082 - protein, 9 aa, Homo Sapiens
GPGGKAVGS

SEQ ID NO: 1358083 - protein, 9 aa, Homo Sapiens
QKAETLYTI

SEQ ID NO: 1358084 - protein, 9 aa, Homo Sapiens
MLATVEHQE

SEQ ID NO: 1358085 - protein, 9 aa, Homo Sapiens
GLSEGFHKA

SEQ ID NO: 1358086 - protein, 9 aa, Homo Sapiens
ACRHGDRCF

SEQ ID NO: 1358087 - protein, 9 aa, Homo Sapiens
PQSKNGNPS

SEQ ID NO: 1358088 - protein, 9 aa, Homo Sapiens
RLAWVSHYS

SEQ ID NO: 1358089 - protein, 9 aa, Homo Sapiens
LEDLSDKKV

SEQ ID NO: 1358090 - protein, 9 aa, Homo Sapiens
SIDGQIFLL

SEQ ID NO: 1358091 - protein, 9 aa, Homo Sapiens
VNHLIYSLR

SEQ ID NO: 1358092 - protein, 9 aa, Homo Sapiens
YKVRKFPFA

SEQ ID NO: 1358093 - protein, 9 aa, Homo Sapiens
AEIKALNEK

SEQ ID NO: 1358094 - protein, 9 aa, Homo Sapiens
FGMTKTERK

SEQ ID NO: 1358095 - protein, 9 aa, Homo Sapiens
MLLNRYSEQ

SEQ ID NO: 1358096 - protein, 9 aa, Homo Sapiens
FLQQVVFAC

SEQ ID NO: 1358097 - protein, 9 aa, Homo Sapiens
KLHQSKTKS

SEQ ID NO: 1358098 - protein, 9 aa, Homo Sapiens
MAEAKAVCD

SEQ ID NO: 1358099 - protein, 9 aa, Homo Sapiens
KKDSSCVIQ

SEQ ID NO: 1358100 - protein, 9 aa, Homo Sapiens
AYSVARELH

SEQ ID NO: 1358101 - protein, 9 aa, Homo Sapiens
KHPNIKMVM

SEQ ID NO: 1358102 - protein, 9 aa, Homo Sapiens
PEALREVVQ

SEQ ID NO: 1358103 - protein, 9 aa, Homo Sapiens
ATALTIMYK

SEQ ID NO: 1358104 - protein, 9 aa, Homo Sapiens
TAATNSQRV

SEQ ID NO: 1358105 - protein, 9 aa, Homo Sapiens
LLRPSLHQL

SEQ ID NO: 1358106 - protein, 9 aa, Homo Sapiens
LCWFQVLGA

SEQ ID NO: 1358107 - protein, 9 aa, Homo Sapiens
ATYVATKKT

SEQ ID NO: 1358108 - protein, 9 aa, Homo Sapiens
LIYTNENPN

SEQ ID NO: 1358109 - protein, 9 aa, Homo Sapiens
KLSAVEKSM

SEQ ID NO: 1358110 - protein, 9 aa, Homo Sapiens
FGSSNTCSV

SEQ ID NO: 1358111 - protein, 9 aa, Homo Sapiens
KPDGYRVSQ

SEQ ID NO: 1358112 - protein, 9 aa, Homo Sapiens
VDMHEIEKY

SEQ ID NO: 1358113 - protein, 9 aa, Homo Sapiens
IVIIAQLRN

SEQ ID NO: 1358114 - protein, 9 aa, Homo Sapiens
GDGFPMANG

SEQ ID NO: 1358115 - protein, 9 aa, Homo Sapiens
KVDLDGPPR

SEQ ID NO: 1358116 - protein, 9 aa, Homo Sapiens
SAVYFFTFS

SEQ ID NO: 1358117 - protein, 9 aa, Homo Sapiens
CTTKKIRNI

SEQ ID NO: 1358118 - protein, 9 aa, Homo Sapiens
YINDNMEQN

SEQ ID NO: 1358119 - protein, 9 aa, Homo Sapiens
LCYKYRGPQ

SEQ ID NO: 1358120 - protein, 9 aa, Homo Sapiens
FQAPSPLLS

SEQ ID NO: 1358121 - protein, 9 aa, Homo Sapiens
QKTIQDLET

SEQ ID NO: 1358122 - protein, 9 aa, Homo Sapiens
YSLSSQRNI

SEQ ID NO: 1358123 - protein, 9 aa, Homo Sapiens
AASDDDDDN

SEQ ID NO: 1358124 - protein, 9 aa, Homo Sapiens
NGTPVRDYL

SEQ ID NO: 1358125 - protein, 9 aa, Homo Sapiens
FHREGEELE

SEQ ID NO: 1358126 - protein, 9 aa, Homo Sapiens
LQSLLEKGY

SEQ ID NO: 1358127 - protein, 9 aa, Homo Sapiens
VMTYAAIFA

SEQ ID NO: 1358128 - protein, 9 aa, Homo Sapiens
GSPRVFRAS

SEQ ID NO: 1358129 - protein, 9 aa, Homo Sapiens
PNTNIAVDE

SEQ ID NO: 1358130 - protein, 9 aa, Homo Sapiens
LRGHDDKIH

SEQ ID NO: 1358131 - protein, 9 aa, Homo Sapiens
FEVAEKEIG

SEQ ID NO: 1358132 - protein, 9 aa, Homo Sapiens
YIWTFDPGE

SEQ ID NO: 1358133 - protein, 9 aa, Homo Sapiens
NTDRTASDG

SEQ ID NO: 1358134 - protein, 9 aa, Homo Sapiens
IQVVSKNMY

SEQ ID NO: 1358135 - protein, 9 aa, Homo Sapiens
VSLLAIRTV

SEQ ID NO: 1358136 - protein, 9 aa, Homo Sapiens
VSHHRPRLF

SEQ ID NO: 1358137 - protein, 9 aa, Homo Sapiens
LGAGCNPEL

SEQ ID NO: 1358138 - protein, 9 aa, Homo Sapiens
GSLVHQDGL

SEQ ID NO: 1358139 - protein, 9 aa, Homo Sapiens
LGAAQPAQA

SEQ ID NO: 1358140 - protein, 9 aa, Homo Sapiens
IHMMRQQEL

SEQ ID NO: 1358141 - protein, 9 aa, Homo Sapiens
KKFLIGPEG

SEQ ID NO: 1358142 - protein, 9 aa, Homo Sapiens
QKESLKNIK

SEQ ID NO: 1358143 - protein, 9 aa, Homo Sapiens
TQSKAGSLP

SEQ ID NO: 1358144 - protein, 9 aa, Homo Sapiens
HQLKNSCTF

SEQ ID NO: 1358145 - protein, 9 aa, Homo Sapiens
HALAQAIRE

SEQ ID NO: 1358146 - protein, 9 aa, Homo Sapiens
LRLRELLTQ

SEQ ID NO: 1358147 - protein, 9 aa, Homo Sapiens
TIEKPYKCE

SEQ ID NO: 1358148 - protein, 9 aa, Homo Sapiens
ENLTELSCY

SEQ ID NO: 1358149 - protein, 9 aa, Homo Sapiens
FELFKNAML

SEQ ID NO: 1358150 - protein, 9 aa, Homo Sapiens
HFVKDLLTM

SEQ ID NO: 1358151 - protein, 9 aa, Homo Sapiens
IKALNEKYN

SEQ ID NO: 1358152 - protein, 9 aa, Homo Sapiens
KNNNKINLK

SEQ ID NO: 1358153 - protein, 9 aa, Homo Sapiens
LYKKGIEEL

SEQ ID NO: 1358154 - protein, 9 aa, Homo Sapiens
SKGSTPLTN

SEQ ID NO: 1358155 - protein, 9 aa, Homo Sapiens
VLHPLPGLI

SEQ ID NO: 1358156 - protein, 9 aa, Homo Sapiens
TPVRDYLST

SEQ ID NO: 1358157 - protein, 9 aa, Homo Sapiens
VTPLLNHII

SEQ ID NO: 1358158 - protein, 9 aa, Homo Sapiens
KIIDFIADN

SEQ ID NO: 1358159 - protein, 9 aa, Homo Sapiens
HLAALRAAR

SEQ ID NO: 1358160 - protein, 9 aa, Homo Sapiens
LFALMMSLL

SEQ ID NO: 1358161 - protein, 9 aa, Homo Sapiens
PMKDVTVPE

SEQ ID NO: 1358162 - protein, 9 aa, Homo Sapiens
WVSHYSTVS

SEQ ID NO: 1358163 - protein, 9 aa, Homo Sapiens
PLASKSSYS

SEQ ID NO: 1358164 - protein, 9 aa, Homo Sapiens
HVSTPVENP

SEQ ID NO: 1358165 - protein, 9 aa, Homo Sapiens
HDLAPTCRD

SEQ ID NO: 1358166 - protein, 9 aa, Homo Sapiens
LVTLQSVKE

SEQ ID NO: 1358167 - protein, 9 aa, Homo Sapiens
CAGIEGVLD

SEQ ID NO: 1358168 - protein, 9 aa, Homo Sapiens
WIESTNNTG

SEQ ID NO: 1358169 - protein, 9 aa, Homo Sapiens
MDRYEIYSL

SEQ ID NO: 1358170 - protein, 9 aa, Homo Sapiens
KVMEAFVNQ

SEQ ID NO: 1358171 - protein, 9 aa, Homo Sapiens
AWEVDVEQH

SEQ ID NO: 1358172 - protein, 9 aa, Homo Sapiens
HHGEKAYRC

SEQ ID NO: 1358173 - protein, 9 aa, Homo Sapiens
NSRRPKAPY

SEQ ID NO: 1358174 - protein, 9 aa, Homo Sapiens
RPPEAFGFQ

SEQ ID NO: 1358175 - protein, 9 aa, Homo Sapiens
AVGESEPAT

SEQ ID NO: 1358176 - protein, 9 aa, Homo Sapiens
CKNALSNPK

SEQ ID NO: 1358177 - protein, 9 aa, Homo Sapiens
HFIQHCKLV

SEQ ID NO: 1358178 - protein, 9 aa, Homo Sapiens
FSSHGGSSF

SEQ ID NO: 1358179 - protein, 9 aa, Homo Sapiens
IFYCRLQDT

SEQ ID NO: 1358180 - protein, 9 aa, Homo Sapiens
LNRGLKKKK

SEQ ID NO: 1358181 - protein, 9 aa, Homo Sapiens
EFNVSQAFV

SEQ ID NO: 1358182 - protein, 9 aa, Homo Sapiens
LERKIIGIF

SEQ ID NO: 1358183 - protein, 9 aa, Homo Sapiens
GATAPGAMK

SEQ ID NO: 1358184 - protein, 9 aa, Homo Sapiens
YSLIGKGSF

SEQ ID NO: 1358185 - protein, 9 aa, Homo Sapiens
DRIQDFVRH

SEQ ID NO: 1358186 - protein, 9 aa, Homo Sapiens
WCGSGTVQG

SEQ ID NO: 1358187 - protein, 9 aa, Homo Sapiens
LTELSCYNY

SEQ ID NO: 1358188 - protein, 9 aa, Homo Sapiens
CLKFLLTFL

SEQ ID NO: 1358189 - protein, 9 aa, Homo Sapiens
KRYYSVVYA

SEQ ID NO: 1358190 - protein, 9 aa, Homo Sapiens
QAFTCTTKK

SEQ ID NO: 1358191 - protein, 9 aa, Homo Sapiens
GKNAFFKDI

SEQ ID NO: 1358192 - protein, 9 aa, Homo Sapiens
VAFESLDEA

SEQ ID NO: 1358193 - protein, 9 aa, Homo Sapiens
ARGVKIRFY

SEQ ID NO: 1358194 - protein, 9 aa, Homo Sapiens
GEALRAAPC

SEQ ID NO: 1358195 - protein, 9 aa, Homo Sapiens
AAGFDALQW

SEQ ID NO: 1358196 - protein, 9 aa, Homo Sapiens
TPVEWALCG

SEQ ID NO: 1358197 - protein, 9 aa, Homo Sapiens
QSSPKGCDM

SEQ ID NO: 1358198 - protein, 9 aa, Homo Sapiens
ARCDQACVI

SEQ ID NO: 1358199 - protein, 9 aa, Homo Sapiens
KVHFPNPNK

SEQ ID NO: 1358200 - protein, 9 aa, Homo Sapiens
AVSLEKLQY

SEQ ID NO: 1358201 - protein, 9 aa, Homo Sapiens
KDGMKLGHS

SEQ ID NO: 1358202 - protein, 9 aa, Homo Sapiens
VGKALEVNK

SEQ ID NO: 1358203 - protein, 9 aa, Homo Sapiens
HWHIVDNQS

SEQ ID NO: 1358204 - protein, 9 aa, Homo Sapiens
GWRWNLPGD

SEQ ID NO: 1358205 - protein, 9 aa, Homo Sapiens
LWYSWRYQL

SEQ ID NO: 1358206 - protein, 9 aa, Homo Sapiens
TTAVIITDK

SEQ ID NO: 1358207 - protein, 9 aa, Homo Sapiens
FNVSQAFVP

SEQ ID NO: 1358208 - protein, 9 aa, Homo Sapiens
ISYTTNAFS

SEQ ID NO: 1358209 - protein, 9 aa, Homo Sapiens
DAYVRIWTT

SEQ ID NO: 1358210 - protein, 9 aa, Homo Sapiens
EKINDASSQ

SEQ ID NO: 1358211 - protein, 9 aa, Homo Sapiens
AEGTQEGGE

SEQ ID NO: 1358212 - protein, 9 aa, Homo Sapiens
LHTDHLITE

SEQ ID NO: 1358213 - protein, 9 aa, Homo Sapiens
FSTGEKLAA

SEQ ID NO: 1358214 - protein, 9 aa, Homo Sapiens
LTQLAQHQM

SEQ ID NO: 1358215 - protein, 9 aa, Homo Sapiens
WNVRCTLWS

SEQ ID NO: 1358216 - protein, 9 aa, Homo Sapiens
VYFLHTHTG

SEQ ID NO: 1358217 - protein, 9 aa, Homo Sapiens
QSCTVEVNF

SEQ ID NO: 1358218 - protein, 9 aa, Homo Sapiens
LLHTDHLIT

SEQ ID NO: 1358219 - protein, 9 aa, Homo Sapiens
LRNESVTTV

SEQ ID NO: 1358220 - protein, 9 aa, Homo Sapiens
TLSQEKYHA

SEQ ID NO: 1358221 - protein, 9 aa, Homo Sapiens
PGHVKDSCN

SEQ ID NO: 1358222 - protein, 9 aa, Homo Sapiens
YPHSRYCDW

SEQ ID NO: 1358223 - protein, 9 aa, Homo Sapiens
LSRNKCQTE

SEQ ID NO: 1358224 - protein, 9 aa, Homo Sapiens
ILWLTLCKF

SEQ ID NO: 1358225 - protein, 9 aa, Homo Sapiens
SFFNLFHLV

SEQ ID NO: 1358226 - protein, 9 aa, Homo Sapiens
KVKEWSLII

SEQ ID NO: 1358227 - protein, 9 aa, Homo Sapiens
FLYLCLCGA

SEQ ID NO: 1358228 - protein, 9 aa, Homo Sapiens
EAFSTTFKT

SEQ ID NO: 1358229 - protein, 9 aa, Homo Sapiens
CICVCVHVS

SEQ ID NO: 1358230 - protein, 9 aa, Homo Sapiens
LITLFNDWE

SEQ ID NO: 1358231 - protein, 9 aa, Homo Sapiens
AEIVQLVGN

SEQ ID NO: 1358232 - protein, 9 aa, Homo Sapiens
IQIEIKKRS

SEQ ID NO: 1358233 - protein, 9 aa, Homo Sapiens
MPLNVSLTN

SEQ ID NO: 1358234 - protein, 9 aa, Homo Sapiens
FERHLTRAQ

SEQ ID NO: 1358235 - protein, 9 aa, Homo Sapiens
CTKATRAYI

SEQ ID NO: 1358236 - protein, 9 aa, Homo Sapiens
LVMFYYFAK

SEQ ID NO: 1358237 - protein, 9 aa, Homo Sapiens
GAGCNPELR

SEQ ID NO: 1358238 - protein, 9 aa, Homo Sapiens
NFCTSHIFE

SEQ ID NO: 1358239 - protein, 9 aa, Homo Sapiens
AEAKAVCDR

SEQ ID NO: 1358240 - protein, 9 aa, Homo Sapiens
EEKVNNRDS

SEQ ID NO: 1358241 - protein, 9 aa, Homo Sapiens
HVRSKTKVS

SEQ ID NO: 1358242 - protein, 9 aa, Homo Sapiens
RYEIYSLIG

SEQ ID NO: 1358243 - protein, 9 aa, Homo Sapiens
PAPPGPPGY

SEQ ID NO: 1358244 - protein, 9 aa, Homo Sapiens
VRLEHVYFS

SEQ ID NO: 1358245 - protein, 9 aa, Homo Sapiens
QLMNILKPI

SEQ ID NO: 1358246 - protein, 9 aa, Homo Sapiens
RFVHAPWKN

SEQ ID NO: 1358247 - protein, 9 aa, Homo Sapiens
KEEIDILIN

SEQ ID NO: 1358248 - protein, 9 aa, Homo Sapiens
KSGSESKVE

SEQ ID NO: 1358249 - protein, 9 aa, Homo Sapiens
GKYMQLMNI

SEQ ID NO: 1358250 - protein, 9 aa, Homo Sapiens
GVLKLYFLG

SEQ ID NO: 1358251 - protein, 9 aa, Homo Sapiens
QLEGWRWNL

SEQ ID NO: 1358252 - protein, 9 aa, Homo Sapiens
DYHEIGRCI

SEQ ID NO: 1358253 - protein, 9 aa, Homo Sapiens
LTQLKCLAD

SEQ ID NO: 1358254 - protein, 9 aa, Homo Sapiens
WSIMTTFST

SEQ ID NO: 1358255 - protein, 9 aa, Homo Sapiens
NGTKITDFC

SEQ ID NO: 1358256 - protein, 9 aa, Homo Sapiens
YLSTLIPKE

SEQ ID NO: 1358257 - protein, 9 aa, Homo Sapiens
VSDFYTLRV

SEQ ID NO: 1358258 - protein, 9 aa, Homo Sapiens
SRDLDRINA

SEQ ID NO: 1358259 - protein, 9 aa, Homo Sapiens
QLTQYSQVH

SEQ ID NO: 1358260 - protein, 9 aa, Homo Sapiens
DQDYEFIYY

SEQ ID NO: 1358261 - protein, 9 aa, Homo Sapiens
EYRGSFCYK

SEQ ID NO: 1358262 - protein, 9 aa, Homo Sapiens
VHKALIVLQ

SEQ ID NO: 1358263 - protein, 9 aa, Homo Sapiens
GGKAVGSDC

SEQ ID NO: 1358264 - protein, 9 aa, Homo Sapiens
IRCKNALSN

SEQ ID NO: 1358265 - protein, 9 aa, Homo Sapiens
WDCRKGKLL

SEQ ID NO: 1358266 - protein, 9 aa, Homo Sapiens
KAGISDTLW

SEQ ID NO: 1358267 - protein, 9 aa, Homo Sapiens
MYSQDNQHA

SEQ ID NO: 1358268 - protein, 9 aa, Homo Sapiens
SNLTLNDAV

SEQ ID NO: 1358269 - protein, 9 aa, Homo Sapiens
TMAEVNVEQ

SEQ ID NO: 1358270 - protein, 9 aa, Homo Sapiens
IMVSDKSNT

SEQ ID NO: 1358271 - protein, 9 aa, Homo Sapiens
TRFLIYTNE

SEQ ID NO: 1358272 - protein, 9 aa, Homo Sapiens
PEYKEWNPE

SEQ ID NO: 1358273 - protein, 9 aa, Homo Sapiens
SFVGLASGK

SEQ ID NO: 1358274 - protein, 9 aa, Homo Sapiens
SSCLSLQSR

SEQ ID NO: 1358275 - protein, 9 aa, Homo Sapiens
TNIAVDESL

SEQ ID NO: 1358276 - protein, 9 aa, Homo Sapiens
SQGKVFSRV

SEQ ID NO: 1358277 - protein, 9 aa, Homo Sapiens
AAQPAQAWT

SEQ ID NO: 1358278 - protein, 9 aa, Homo Sapiens
QEEEVTPFT

SEQ ID NO: 1358279 - protein, 9 aa, Homo Sapiens
SQQLTQYSQ

SEQ ID NO: 1358280 - protein, 9 aa, Homo Sapiens
IESLHLSEE

SEQ ID NO: 1358281 - protein, 9 aa, Homo Sapiens
MLKLMRSVS

SEQ ID NO: 1358282 - protein, 9 aa, Homo Sapiens
NGYHVLQGR

SEQ ID NO: 1358283 - protein, 9 aa, Homo Sapiens
VYGPRAAEE

SEQ ID NO: 1358284 - protein, 9 aa, Homo Sapiens
PPTESAPAQ

SEQ ID NO: 1358285 - protein, 9 aa, Homo Sapiens
HQLFQKEHQ

SEQ ID NO: 1358286 - protein, 9 aa, Homo Sapiens
MFAIRALRK

SEQ ID NO: 1358287 - protein, 9 aa, Homo Sapiens
EENRELKAA

SEQ ID NO: 1358288 - protein, 9 aa, Homo Sapiens
GWALSSWQP

SEQ ID NO: 1358289 - protein, 9 aa, Homo Sapiens
QNPMGIIPF

SEQ ID NO: 1358290 - protein, 9 aa, Homo Sapiens
PCSPISREL

SEQ ID NO: 1358291 - protein, 9 aa, Homo Sapiens
YKLKKASQS

SEQ ID NO: 1358292 - protein, 9 aa, Homo Sapiens
INDASSQEY

SEQ ID NO: 1358293 - protein, 9 aa, Homo Sapiens
QLQDLLTLP

SEQ ID NO: 1358294 - protein, 9 aa, Homo Sapiens
GIEGVLDSY

SEQ ID NO: 1358295 - protein, 9 aa, Homo Sapiens
PATAAAMAL

SEQ ID NO: 1358296 - protein, 9 aa, Homo Sapiens
QLYQRLKFK

SEQ ID NO: 1358297 - protein, 9 aa, Homo Sapiens
CVNIHMMRQ

SEQ ID NO: 1358298 - protein, 9 aa, Homo Sapiens
KEQYELVNR

SEQ ID NO: 1358299 - protein, 9 aa, Homo Sapiens
VRDYLSTLI

SEQ ID NO: 1358300 - protein, 9 aa, Homo Sapiens
CLSVQGLAS

SEQ ID NO: 1358301 - protein, 9 aa, Homo Sapiens
CASNHCQHG

SEQ ID NO: 1358302 - protein, 9 aa, Homo Sapiens
IQSTLSLNS

SEQ ID NO: 1358303 - protein, 9 aa, Homo Sapiens
EMDVALSYK

SEQ ID NO: 1358304 - protein, 9 aa, Homo Sapiens
AANVIVYVG

SEQ ID NO: 1358305 - protein, 9 aa, Homo Sapiens
DVAKGVVQV

SEQ ID NO: 1358306 - protein, 9 aa, Homo Sapiens
ERRYNLRYY

SEQ ID NO: 1358307 - protein, 9 aa, Homo Sapiens
KFKREVHLD

SEQ ID NO: 1358308 - protein, 9 aa, Homo Sapiens
LPKNNNKIN

SEQ ID NO: 1358309 - protein, 9 aa, Homo Sapiens
HTVERPYEC

SEQ ID NO: 1358310 - protein, 9 aa, Homo Sapiens
MEALEMKLA

SEQ ID NO: 1358311 - protein, 9 aa, Homo Sapiens
TFVLSIKVF

SEQ ID NO: 1358312 - protein, 9 aa, Homo Sapiens
PVEVALVTL

SEQ ID NO: 1358313 - protein, 9 aa, Homo Sapiens
VGCIEALVR

SEQ ID NO: 1358314 - protein, 9 aa, Homo Sapiens
KVQVADSRV

SEQ ID NO: 1358315 - protein, 9 aa, Homo Sapiens
IPINSSTHG

SEQ ID NO: 1358316 - protein, 9 aa, Homo Sapiens
KISPDREYA

SEQ ID NO: 1358317 - protein, 9 aa, Homo Sapiens
PPLRAPQSK

SEQ ID NO: 1358318 - protein, 9 aa, Homo Sapiens
LSYHNGFCM

SEQ ID NO: 1358319 - protein, 9 aa, Homo Sapiens
TDGTGYSAP

SEQ ID NO: 1358320 - protein, 9 aa, Homo Sapiens
LEETGLTLK

SEQ ID NO: 1358321 - protein, 9 aa, Homo Sapiens
STLWEIIAE

SEQ ID NO: 1358322 - protein, 9 aa, Homo Sapiens
EPTRSLSCL

SEQ ID NO: 1358323 - protein, 9 aa, Homo Sapiens
KRGIPMTKN

SEQ ID NO: 1358324 - protein, 9 aa, Homo Sapiens
ERVTNVLNW

SEQ ID NO: 1358325 - protein, 9 aa, Homo Sapiens
FPAGSHERL

SEQ ID NO: 1358326 - protein, 9 aa, Homo Sapiens
VAGEEEQKF

SEQ ID NO: 1358327 - protein, 9 aa, Homo Sapiens
SKAERKAQV

SEQ ID NO: 1358328 - protein, 9 aa, Homo Sapiens
YAACQSHAL

SEQ ID NO: 1358329 - protein, 9 aa, Homo Sapiens
IPFLTSLLE

SEQ ID NO: 1358330 - protein, 9 aa, Homo Sapiens
TRTEEKLHA

SEQ ID NO: 1358331 - protein, 9 aa, Homo Sapiens
INYCIGGTV

SEQ ID NO: 1358332 - protein, 9 aa, Homo Sapiens
DHAVLCVRI

SEQ ID NO: 1358333 - protein, 9 aa, Homo Sapiens
EHKVIENIR

SEQ ID NO: 1358334 - protein, 9 aa, Homo Sapiens
MLFKIIDFL

SEQ ID NO: 1358335 - protein, 9 aa, Homo Sapiens
INFTITNLL

SEQ ID NO: 1358336 - protein, 9 aa, Homo Sapiens
FKKFLIGPE

SEQ ID NO: 1358337 - protein, 9 aa, Homo Sapiens
GDYALGQTG

SEQ ID NO: 1358338 - protein, 9 aa, Homo Sapiens
DVQRIIVAN

SEQ ID NO: 1358339 - protein, 9 aa, Homo Sapiens
SQLALANMV

SEQ ID NO: 1358340 - protein, 9 aa, Homo Sapiens
PYSYKVQDK

SEQ ID NO: 1358341 - protein, 9 aa, Homo Sapiens
KEGTDPEIF

SEQ ID NO: 1358342 - protein, 9 aa, Homo Sapiens
LWVPARHST

SEQ ID NO: 1358343 - protein, 9 aa, Homo Sapiens
KYRGPQSGL

SEQ ID NO: 1358344 - protein, 9 aa, Homo Sapiens
GRITVENKV

SEQ ID NO: 1358345 - protein, 9 aa, Homo Sapiens
KEKDFTILQ

SEQ ID NO: 1358346 - protein, 9 aa, Homo Sapiens
SNTSLAPII

SEQ ID NO: 1358347 - protein, 9 aa, Homo Sapiens
GNQQLSVVR

SEQ ID NO: 1358348 - protein, 9 aa, Homo Sapiens
KHFTVLKVL

SEQ ID NO: 1358349 - protein, 9 aa, Homo Sapiens
GMDCLWSLE

SEQ ID NO: 1358350 - protein, 9 aa, Homo Sapiens
KAGSLPAFT

SEQ ID NO: 1358351 - protein, 9 aa, Homo Sapiens
SRFLYTEQL

SEQ ID NO: 1358352 - protein, 9 aa, Homo Sapiens
ALRCLVKTY

SEQ ID NO: 1358353 - protein, 9 aa, Homo Sapiens
SQEPQRKFL

SEQ ID NO: 1358354 - protein, 9 aa, Homo Sapiens
VMTPAVYAT

SEQ ID NO: 1358355 - protein, 9 aa, Homo Sapiens
AGLLQRFCW

SEQ ID NO: 1358356 - protein, 9 aa, Homo Sapiens
KNEKDYSQK

SEQ ID NO: 1358357 - protein, 9 aa, Homo Sapiens
LGKSLAFLV

SEQ ID NO: 1358358 - protein, 9 aa, Homo Sapiens
DSNAIIKDV

SEQ ID NO: 1358359 - protein, 9 aa, Homo Sapiens
DGLDKCRTP

SEQ ID NO: 1358360 - protein, 9 aa, Homo Sapiens
SSQHLQLVV

SEQ ID NO: 1358361 - protein, 9 aa, Homo Sapiens
IRALRKIAT

SEQ ID NO: 1358362 - protein, 9 aa, Homo Sapiens
EAFGFQQAT

SEQ ID NO: 1358363 - protein, 9 aa, Homo Sapiens
HHASLICNT

SEQ ID NO: 1358364 - protein, 9 aa, Homo Sapiens
KRPQLIRAK

SEQ ID NO: 1358365 - protein, 9 aa, Homo Sapiens
FLTIIHKRF

SEQ ID NO: 1358366 - protein, 9 aa, Homo Sapiens
MKEKDFTIL

SEQ ID NO: 1358367 - protein, 9 aa, Homo Sapiens
CGFHIRSVL

SEQ ID NO: 1358368 - protein, 9 aa, Homo Sapiens
GTKITDFCE

SEQ ID NO: 1358369 - protein, 9 aa, Homo Sapiens
GTSKIIQDF

SEQ ID NO: 1358370 - protein, 9 aa, Homo Sapiens
LCGAFTGFQ

SEQ ID NO: 1358371 - protein, 9 aa, Homo Sapiens
QMRNHSKPT

SEQ ID NO: 1358372 - protein, 9 aa, Homo Sapiens
RYSHNNSLL

SEQ ID NO: 1358373 - protein, 9 aa, Homo Sapiens
RLHYNEEFN

SEQ ID NO: 1358374 - protein, 9 aa, Homo Sapiens
IHTIEKPYK

SEQ ID NO: 1358375 - protein, 9 aa, Homo Sapiens
LYTIGDFEF

SEQ ID NO: 1358376 - protein, 9 aa, Homo Sapiens
QEISFEACL

SEQ ID NO: 1358377 - protein, 9 aa, Homo Sapiens
KGDGKTMTN

SEQ ID NO: 1358378 - protein, 9 aa, Homo Sapiens
RWLSQGKVF

SEQ ID NO: 1358379 - protein, 9 aa, Homo Sapiens
QHCKLVRKQ

SEQ ID NO: 1358380 - protein, 9 aa, Homo Sapiens
SPGWKFNHL

SEQ ID NO: 1358381 - protein, 9 aa, Homo Sapiens
DTSKDIEEL

SEQ ID NO: 1358382 - protein, 9 aa, Homo Sapiens
GFPYTTAPK

SEQ ID NO: 1358383 - protein, 9 aa, Homo Sapiens
TAFYSLYLP

SEQ ID NO: 1358384 - protein, 9 aa, Homo Sapiens
AYGTALSMT

SEQ ID NO: 1358385 - protein, 9 aa, Homo Sapiens
LFSSHAFGE

SEQ ID NO: 1358386 - protein, 9 aa, Homo Sapiens
CTGRDRRTE

SEQ ID NO: 1358387 - protein, 9 aa, Homo Sapiens
RMGRRSTKK

SEQ ID NO: 1358388 - protein, 9 aa, Homo Sapiens
EMLQKVEVQ

SEQ ID NO: 1358389 - protein, 9 aa, Homo Sapiens
RCFGGRSPK

SEQ ID NO: 1358390 - protein, 9 aa, Homo Sapiens
HVAKLLLNT

SEQ ID NO: 1358391 - protein, 9 aa, Homo Sapiens
ANMIKCVGN

SEQ ID NO: 1358392 - protein, 9 aa, Homo Sapiens
WTFDPGELC

SEQ ID NO: 1358393 - protein, 9 aa, Homo Sapiens
EEFPDTQRQ

SEQ ID NO: 1358394 - protein, 9 aa, Homo Sapiens
TLWIESTNN

SEQ ID NO: 1358395 - protein, 9 aa, Homo Sapiens
FFQLGNMAF

SEQ ID NO: 1358396 - protein, 9 aa, Homo Sapiens
GGQLDCILP

SEQ ID NO: 1358397 - protein, 9 aa, Homo Sapiens
DFALWLEQK

SEQ ID NO: 1358398 - protein, 9 aa, Homo Sapiens
LATSRVHPA

SEQ ID NO: 1358399 - protein, 9 aa, Homo Sapiens
SYNQQRIRQ

SEQ ID NO: 1358400 - protein, 9 aa, Homo Sapiens
EDSQVQITT

SEQ ID NO: 1358401 - protein, 9 aa, Homo Sapiens
APKVLVTVP

SEQ ID NO: 1358402 - protein, 9 aa, Homo Sapiens
KLTDQCYNY

SEQ ID NO: 1358403 - protein, 9 aa, Homo Sapiens
EAQPLCPLD

SEQ ID NO: 1358404 - protein, 9 aa, Homo Sapiens
GKPGTPGVG

SEQ ID NO: 1358405 - protein, 9 aa, Homo Sapiens
SSPKGCDMF

SEQ ID NO: 1358406 - protein, 9 aa, Homo Sapiens
PHSRYCDWT

SEQ ID NO: 1358407 - protein, 9 aa, Homo Sapiens
CTSHIFETR

SEQ ID NO: 1358408 - protein, 9 aa, Homo Sapiens
SNGYHVLQG

SEQ ID NO: 1358409 - protein, 9 aa, Homo Sapiens
EFGKLLMEA

SEQ ID NO: 1358410 - protein, 9 aa, Homo Sapiens
DKGGVRPAL

SEQ ID NO: 1358411 - protein, 9 aa, Homo Sapiens
LQNRFESSK

SEQ ID NO: 1358412 - protein, 9 aa, Homo Sapiens
PGSPGSPPL

SEQ ID NO: 1358413 - protein, 9 aa, Homo Sapiens
TKFIDRLNK

SEQ ID NO: 1358414 - protein, 9 aa, Homo Sapiens
FGVTIFYST

SEQ ID NO: 1358415 - protein, 9 aa, Homo Sapiens
RTLHIQAYN

SEQ ID NO: 1358416 - protein, 9 aa, Homo Sapiens
VQTAASWWP

SEQ ID NO: 1358417 - protein, 9 aa, Homo Sapiens
TSVLTLLFF

SEQ ID NO: 1358418 - protein, 9 aa, Homo Sapiens
LCITAQEND

SEQ ID NO: 1358419 - protein, 9 aa, Homo Sapiens
CFINSNLKF

SEQ ID NO: 1358420 - protein, 9 aa, Homo Sapiens
LSAVEKSMN

SEQ ID NO: 1358421 - protein, 9 aa, Homo Sapiens
KSDSVVQTA

SEQ ID NO: 1358422 - protein, 9 aa, Homo Sapiens
SIPTSTPSK

SEQ ID NO: 1358423 - protein, 9 aa, Homo Sapiens
RAEENIKSV

SEQ ID NO: 1358424 - protein, 9 aa, Homo Sapiens
IVANIEEVL

SEQ ID NO: 1358425 - protein, 9 aa, Homo Sapiens
VFKRNELHS

SEQ ID NO: 1358426 - protein, 9 aa, Homo Sapiens
GPSAAQEVP

SEQ ID NO: 1358427 - protein, 9 aa, Homo Sapiens
KFSDFLMQS

SEQ ID NO: 1358428 - protein, 9 aa, Homo Sapiens
TLTMNIMTV

SEQ ID NO: 1358429 - protein, 9 aa, Homo Sapiens
WLNASRDLD

SEQ ID NO: 1358430 - protein, 9 aa, Homo Sapiens
NFVLAIVLP

SEQ ID NO: 1358431 - protein, 9 aa, Homo Sapiens
FYFNMIEGQ

SEQ ID NO: 1358432 - protein, 9 aa, Homo Sapiens
LLSHERIHT

SEQ ID NO: 1358433 - protein, 9 aa, Homo Sapiens
CYQDVHKDI

SEQ ID NO: 1358434 - protein, 9 aa, Homo Sapiens
NLLYEENMH

SEQ ID NO: 1358435 - protein, 9 aa, Homo Sapiens
TDHLITENF

SEQ ID NO: 1358436 - protein, 9 aa, Homo Sapiens
LISDKKWSK

SEQ ID NO: 1358437 - protein, 9 aa, Homo Sapiens
ILSIWLATS

SEQ ID NO: 1358438 - protein, 9 aa, Homo Sapiens
TLLLLEHLE

SEQ ID NO: 1358439 - protein, 9 aa, Homo Sapiens
KTLCLHLQV

SEQ ID NO: 1358440 - protein, 9 aa, Homo Sapiens
ELFKNAMLA

SEQ ID NO: 1358441 - protein, 9 aa, Homo Sapiens
DVTDGAFFD

SEQ ID NO: 1358442 - protein, 9 aa, Homo Sapiens
EETGLTLKR

SEQ ID NO: 1358443 - protein, 9 aa, Homo Sapiens
VQVGLDTTR

SEQ ID NO: 1358444 - protein, 9 aa, Homo Sapiens
LNTTPLPLI

SEQ ID NO: 1358445 - protein, 9 aa, Homo Sapiens
DAEAVSTLW

SEQ ID NO: 1358446 - protein, 9 aa, Homo Sapiens
RLEHVYFSE

SEQ ID NO: 1358447 - protein, 9 aa, Homo Sapiens
RWCGSGTVQ

SEQ ID NO: 1358448 - protein, 9 aa, Homo Sapiens
INLKYLYLG

SEQ ID NO: 1358449 - protein, 9 aa, Homo Sapiens
KEEISNITG

SEQ ID NO: 1358450 - protein, 9 aa, Homo Sapiens
HIDTLDNRI

SEQ ID NO: 1358451 - protein, 9 aa, Homo Sapiens
EADQICGFH

SEQ ID NO: 1358452 - protein, 9 aa, Homo Sapiens
AARAFECLD

SEQ ID NO: 1358453 - protein, 9 aa, Homo Sapiens
TQEGTLIVR

SEQ ID NO: 1358454 - protein, 9 aa, Homo Sapiens
NITSYAGGT

SEQ ID NO: 1358455 - protein, 9 aa, Homo Sapiens
IMDQNNFQD

SEQ ID NO: 1358456 - protein, 9 aa, Homo Sapiens
YVATKKTVQ

SEQ ID NO: 1358457 - protein, 9 aa, Homo Sapiens
GDWRPDMSP

SEQ ID NO: 1358458 - protein, 9 aa, Homo Sapiens
GLGTTTDRS

SEQ ID NO: 1358459 - protein, 9 aa, Homo Sapiens
NLTELSCYN

SEQ ID NO: 1358460 - protein, 9 aa, Homo Sapiens
LAVSLVITW

SEQ ID NO: 1358461 - protein, 9 aa, Homo Sapiens
SFPSLQAAV

SEQ ID NO: 1358462 - protein, 9 aa, Homo Sapiens
HLRVHTVEK

SEQ ID NO: 1358463 - protein, 9 aa, Homo Sapiens
GREKLKKIK

SEQ ID NO: 1358464 - protein, 9 aa, Homo Sapiens
MNCDCELYQ

SEQ ID NO: 1358465 - protein, 9 aa, Homo Sapiens
AAALLPMSA

SEQ ID NO: 1358466 - protein, 9 aa, Homo Sapiens
RAIRYKISP

SEQ ID NO: 1358467 - protein, 9 aa, Homo Sapiens
AFTCTTKKI

SEQ ID NO: 1358468 - protein, 9 aa, Homo Sapiens
VSNTPDMEQ

SEQ ID NO: 1358469 - protein, 9 aa, Homo Sapiens
EKLPTHTHH

SEQ ID NO: 1358470 - protein, 9 aa, Homo Sapiens
QCEKCKFYT

SEQ ID NO: 1358471 - protein, 9 aa, Homo Sapiens
RGITFNLIG

SEQ ID NO: 1358472 - protein, 9 aa, Homo Sapiens
KRKQDQEEE

SEQ ID NO: 1358473 - protein, 9 aa, Homo Sapiens
HKALIVLQK

SEQ ID NO: 1358474 - protein, 9 aa, Homo Sapiens
RLFNLIEAR

SEQ ID NO: 1358475 - protein, 9 aa, Homo Sapiens
GPPANSASL

SEQ ID NO: 1358476 - protein, 9 aa, Homo Sapiens
LISELNVIA

SEQ ID NO: 1358477 - protein, 9 aa, Homo Sapiens
GGFLYKLKK

SEQ ID NO: 1358478 - protein, 9 aa, Homo Sapiens
ATFTKDFHH

SEQ ID NO: 1358479 - protein, 9 aa, Homo Sapiens
PKVLVTVPL

SEQ ID NO: 1358480 - protein, 9 aa, Homo Sapiens
ASNHCQHGA

SEQ ID NO: 1358481 - protein, 9 aa, Homo Sapiens
IFMCHRCGK

SEQ ID NO: 1358482 - protein, 9 aa, Homo Sapiens
LKQAFTCTT

SEQ ID NO: 1358483 - protein, 9 aa, Homo Sapiens
KVKADVQKV

SEQ ID NO: 1358484 - protein, 9 aa, Homo Sapiens
CLQCNGRSF

SEQ ID NO: 1358485 - protein, 9 aa, Homo Sapiens
SICFAVPDH

SEQ ID NO: 1358486 - protein, 9 aa, Homo Sapiens
ITPGMDCLW

SEQ ID NO: 1358487 - protein, 9 aa, Homo Sapiens
KLLLNTGTC

SEQ ID NO: 1358488 - protein, 9 aa, Homo Sapiens
ELCPNLNYL

SEQ ID NO: 1358489 - protein, 9 aa, Homo Sapiens
IQQLLEWCF

SEQ ID NO: 1358490 - protein, 9 aa, Homo Sapiens
HNADKSLDS

SEQ ID NO: 1358491 - protein, 9 aa, Homo Sapiens
AVQMEIAQM

SEQ ID NO: 1358492 - protein, 9 aa, Homo Sapiens
KLQHLCVAH

SEQ ID NO: 1358493 - protein, 9 aa, Homo Sapiens
LIKNKVVVN

SEQ ID NO: 1358494 - protein, 9 aa, Homo Sapiens
VRKHAEALG

SEQ ID NO: 1358495 - protein, 9 aa, Homo Sapiens
LTSWGWSRT

SEQ ID NO: 1358496 - protein, 9 aa, Homo Sapiens
VSTLWEIIA

SEQ ID NO: 1358497 - protein, 9 aa, Homo Sapiens
REINYCIGG

SEQ ID NO: 1358498 - protein, 9 aa, Homo Sapiens
FSKTKFIDR

SEQ ID NO: 1358499 - protein, 9 aa, Homo Sapiens
VHFPNPNKL

SEQ ID NO: 1358500 - protein, 9 aa, Homo Sapiens
DVEERHNAY

SEQ ID NO: 1358501 - protein, 9 aa, Homo Sapiens
GVRPALFKN

SEQ ID NO: 1358502 - protein, 9 aa, Homo Sapiens
KYKTAFYSL

SEQ ID NO: 1358503 - protein, 9 aa, Homo Sapiens
IWDCRKGKL

SEQ ID NO: 1358504 - protein, 9 aa, Homo Sapiens
QGISCSHRD

SEQ ID NO: 1358505 - protein, 9 aa, Homo Sapiens
NPATAATNS

SEQ ID NO: 1358506 - protein, 9 aa, Homo Sapiens
GMRFAITNI

SEQ ID NO: 1358507 - protein, 9 aa, Homo Sapiens
MKLSELCPN

SEQ ID NO: 1358508 - protein, 9 aa, Homo Sapiens
VIMDSHGVY

SEQ ID NO: 1358509 - protein, 9 aa, Homo Sapiens
NKKGAKKAR

SEQ ID NO: 1358510 - protein, 9 aa, Homo Sapiens
CTKHPNIKM

SEQ ID NO: 1358511 - protein, 9 aa, Homo Sapiens
QYEITQSLV

SEQ ID NO: 1358512 - protein, 9 aa, Homo Sapiens
VLSSSPAFR

SEQ ID NO: 1358513 - protein, 9 aa, Homo Sapiens
YGTALSMTH

SEQ ID NO: 1358514 - protein, 9 aa, Homo Sapiens
VTPFTAIRE

SEQ ID NO: 1358515 - protein, 9 aa, Homo Sapiens
TILTPVVNH

SEQ ID NO: 1358516 - protein, 9 aa, Homo Sapiens
HFIFMCHRC

SEQ ID NO: 1358517 - protein, 9 aa, Homo Sapiens
TLEDKDMNG

SEQ ID NO: 1358518 - protein, 9 aa, Homo Sapiens
PYPHSRYCD

SEQ ID NO: 1358519 - protein, 9 aa, Homo Sapiens
ADRYTIRSP

SEQ ID NO: 1358520 - protein, 9 aa, Homo Sapiens
QEVDSAQQL

SEQ ID NO: 1358521 - protein, 9 aa, Homo Sapiens
STNNTGNII

SEQ ID NO: 1358522 - protein, 9 aa, Homo Sapiens
ERHNAYLKP

SEQ ID NO: 1358523 - protein, 9 aa, Homo Sapiens
QLHIDTLDN

SEQ ID NO: 1358524 - protein, 9 aa, Homo Sapiens
FKNAMLATV

SEQ ID NO: 1358525 - protein, 9 aa, Homo Sapiens
NLRYYKTGI

SEQ ID NO: 1358526 - protein, 9 aa, Homo Sapiens
AKSAHAPKK

SEQ ID NO: 1358527 - protein, 9 aa, Homo Sapiens
NFTEKINDA

SEQ ID NO: 1358528 - protein, 9 aa, Homo Sapiens
WLSQGKVFS

SEQ ID NO: 1358529 - protein, 9 aa, Homo Sapiens
HCHDLAPTC

SEQ ID NO: 1358530 - protein, 9 aa, Homo Sapiens
LERNFTFRS

SEQ ID NO: 1358531 - protein, 9 aa, Homo Sapiens
CVEVVIDDR

SEQ ID NO: 1358532 - protein, 9 aa, Homo Sapiens
KDVNTRFLI

SEQ ID NO: 1358533 - protein, 9 aa, Homo Sapiens
ENRELKAAL

SEQ ID NO: 1358534 - protein, 9 aa, Homo Sapiens
EALQEENRE

SEQ ID NO: 1358535 - protein, 9 aa, Homo Sapiens
QYKAHVSGF

SEQ ID NO: 1358536 - protein, 9 aa, Homo Sapiens
ILKKPISDV

SEQ ID NO: 1358537 - protein, 9 aa, Homo Sapiens
AKGQLKLLL

SEQ ID NO: 1358538 - protein, 9 aa, Homo Sapiens
LTDQCYNYI

SEQ ID NO: 1358539 - protein, 9 aa, Homo Sapiens
LTSLVPDSR

SEQ ID NO: 1358540 - protein, 9 aa, Homo Sapiens
MVFFLVLML

SEQ ID NO: 1358541 - protein, 9 aa, Homo Sapiens
WEESIQKFK

SEQ ID NO: 1358542 - protein, 9 aa, Homo Sapiens
SYKDMEINE

SEQ ID NO: 1358543 - protein, 9 aa, Homo Sapiens
IEENRQLRK

SEQ ID NO: 1358544 - protein, 9 aa, Homo Sapiens
PPCPASPHW

SEQ ID NO: 1358545 - protein, 9 aa, Homo Sapiens
SLIFLMSIL

SEQ ID NO: 1358546 - protein, 9 aa, Homo Sapiens
KREVHLDPY

SEQ ID NO: 1358547 - protein, 9 aa, Homo Sapiens
VREDAQRTV

SEQ ID NO: 1358548 - protein, 9 aa, Homo Sapiens
SDYEPKVKE

SEQ ID NO: 1358549 - protein, 9 aa, Homo Sapiens
LMSILMAVI

SEQ ID NO: 1358550 - protein, 9 aa, Homo Sapiens
PASIHMELL

SEQ ID NO: 1358551 - protein, 9 aa, Homo Sapiens
LLKTLRILK

SEQ ID NO: 1358552 - protein, 9 aa, Homo Sapiens
VLLFALDTS

SEQ ID NO: 1358553 - protein, 9 aa, Homo Sapiens
LSSSPAFRL

SEQ ID NO: 1358554 - protein, 9 aa, Homo Sapiens
NATDYWTFL

SEQ ID NO: 1358555 - protein, 9 aa, Homo Sapiens
VRGKLTDQC

SEQ ID NO: 1358556 - protein, 9 aa, Homo Sapiens
LNQLSKNIT

SEQ ID NO: 1358557 - protein, 9 aa, Homo Sapiens
PSGAKQSLL

SEQ ID NO: 1358558 - protein, 9 aa, Homo Sapiens
DKCRTPLDF

SEQ ID NO: 1358559 - protein, 9 aa, Homo Sapiens
CTPIHLAAR

SEQ ID NO: 1358560 - protein, 9 aa, Homo Sapiens
FVKFEAEGV

SEQ ID NO: 1358561 - protein, 9 aa, Homo Sapiens
PALRPALQD

SEQ ID NO: 1358562 - protein, 9 aa, Homo Sapiens
SGAGGCSVS

SEQ ID NO: 1358563 - protein, 9 aa, Homo Sapiens
DDIHQRFLV

SEQ ID NO: 1358564 - protein, 9 aa, Homo Sapiens
EPWPLQGER

SEQ ID NO: 1358565 - protein, 9 aa, Homo Sapiens
WPIFIFEIY

SEQ ID NO: 1358566 - protein, 9 aa, Homo Sapiens
LKKDSSCVI

SEQ ID NO: 1358567 - protein, 9 aa, Homo Sapiens
QVISEHYLR

SEQ ID NO: 1358568 - protein, 9 aa, Homo Sapiens
ASNTDRTAS

SEQ ID NO: 1358569 - protein, 9 aa, Homo Sapiens
SRRPKAPYS

SEQ ID NO: 1358570 - protein, 9 aa, Homo Sapiens
CTFALTSWG

SEQ ID NO: 1358571 - protein, 9 aa, Homo Sapiens
EQPGSPERA

SEQ ID NO: 1358572 - protein, 9 aa, Homo Sapiens
SESAIPDLT

SEQ ID NO: 1358573 - protein, 9 aa, Homo Sapiens
YLPRMARLC

SEQ ID NO: 1358574 - protein, 9 aa, Homo Sapiens
LLEWCFINS

SEQ ID NO: 1358575 - protein, 9 aa, Homo Sapiens
NHYRGLASA

SEQ ID NO: 1358576 - protein, 9 aa, Homo Sapiens
IKRCLSVTS

SEQ ID NO: 1358577 - protein, 9 aa, Homo Sapiens
ETGLTLKRG

SEQ ID NO: 1358578 - protein, 9 aa, Homo Sapiens
KLPPPLQPE

SEQ ID NO: 1358579 - protein, 9 aa, Homo Sapiens
PSFTSQWEE

SEQ ID NO: 1358580 - protein, 9 aa, Homo Sapiens
GITFNLIGE

SEQ ID NO: 1358581 - protein, 9 aa, Homo Sapiens
DIPINSSTH

SEQ ID NO: 1358582 - protein, 9 aa, Homo Sapiens
NSWEELDQR

SEQ ID NO: 1358583 - protein, 9 aa, Homo Sapiens
FTGKFCIQS

SEQ ID NO: 1358584 - protein, 9 aa, Homo Sapiens
KDDFTIEVD

SEQ ID NO: 1358585 - protein, 9 aa, Homo Sapiens
QLLEWCFIN

SEQ ID NO: 1358586 - protein, 9 aa, Homo Sapiens
FIQHCKLVR

SEQ ID NO: 1358587 - protein, 9 aa, Homo Sapiens
LKLDEVEDF

SEQ ID NO: 1358588 - protein, 9 aa, Homo Sapiens
YLERKSVTD

SEQ ID NO: 1358589 - protein, 9 aa, Homo Sapiens
CSQIDFTEK

SEQ ID NO: 1358590 - protein, 9 aa, Homo Sapiens
DVCKMSCAG

SEQ ID NO: 1358591 - protein, 9 aa, Homo Sapiens
KVSVQDQVL

SEQ ID NO: 1358592 - protein, 9 aa, Homo Sapiens
LKLCERVTN

SEQ ID NO: 1358593 - protein, 9 aa, Homo Sapiens
AVYTIMDNW

SEQ ID NO: 1358594 - protein, 9 aa, Homo Sapiens
HSSVASATY

SEQ ID NO: 1358595 - protein, 9 aa, Homo Sapiens
SHGVYGLQR

SEQ ID NO: 1358596 - protein, 9 aa, Homo Sapiens
AEQLDATFS

SEQ ID NO: 1358597 - protein, 9 aa, Homo Sapiens
PNPNKLHCF

SEQ ID NO: 1358598 - protein, 9 aa, Homo Sapiens
KLMRSVSEE

SEQ ID NO: 1358599 - protein, 9 aa, Homo Sapiens
DEPTRSLSC

SEQ ID NO: 1358600 - protein, 9 aa, Homo Sapiens
YAKELKRIL

SEQ ID NO: 1358601 - protein, 9 aa, Homo Sapiens
GKWSGGKHY

SEQ ID NO: 1358602 - protein, 9 aa, Homo Sapiens
HSCNAQVTQ

SEQ ID NO: 1358603 - protein, 9 aa, Homo Sapiens
VSELCITAQ

SEQ ID NO: 1358604 - protein, 9 aa, Homo Sapiens
LKTSGKLLE

SEQ ID NO: 1358605 - protein, 9 aa, Homo Sapiens
SRVISTTDA

SEQ ID NO: 1358606 - protein, 9 aa, Homo Sapiens
FDALTSLVP

SEQ ID NO: 1358607 - protein, 9 aa, Homo Sapiens
EINHNADKS

SEQ ID NO: 1358608 - protein, 9 aa, Homo Sapiens
GEVYGTNSE

SEQ ID NO: 1358609 - protein, 9 aa, Homo Sapiens
LSIWLATSR

SEQ ID NO: 1358610 - protein, 9 aa, Homo Sapiens
TPNTNIAVD

SEQ ID NO: 1358611 - protein, 9 aa, Homo Sapiens
KVNPVSWIQ

SEQ ID NO: 1358612 - protein, 9 aa, Homo Sapiens
KRVQLLELS

SEQ ID NO: 1358613 - protein, 9 aa, Homo Sapiens
SIWLATSRV

SEQ ID NO: 1358614 - protein, 9 aa, Homo Sapiens
AVKLVGGKA

SEQ ID NO: 1358615 - protein, 9 aa, Homo Sapiens
QHSCNAQVT

SEQ ID NO: 1358616 - protein, 9 aa, Homo Sapiens
TVEVNFQKI

SEQ ID NO: 1358617 - protein, 9 aa, Homo Sapiens
YDSKKHKQG

SEQ ID NO: 1358618 - protein, 9 aa, Homo Sapiens
PVVLFPQSN

SEQ ID NO: 1358619 - protein, 9 aa, Homo Sapiens
DVIDGNQQL

SEQ ID NO: 1358620 - protein, 9 aa, Homo Sapiens
EKAYRCSDC

SEQ ID NO: 1358621 - protein, 9 aa, Homo Sapiens
YKQLQQQAV

SEQ ID NO: 1358622 - protein, 9 aa, Homo Sapiens
KTYHNLKLL

SEQ ID NO: 1358623 - protein, 9 aa, Homo Sapiens
VPAGLASLR

SEQ ID NO: 1358624 - protein, 9 aa, Homo Sapiens
RALRKIATE

SEQ ID NO: 1358625 - protein, 9 aa, Homo Sapiens
FNHLELKGV

SEQ ID NO: 1358626 - protein, 9 aa, Homo Sapiens
NMLSEQSHQ

SEQ ID NO: 1358627 - protein, 9 aa, Homo Sapiens
ALRAARSPT

SEQ ID NO: 1358628 - protein, 9 aa, Homo Sapiens
KSYNQQRIR

SEQ ID NO: 1358629 - protein, 9 aa, Homo Sapiens
VKLENKSKS

SEQ ID NO: 1358630 - protein, 9 aa, Homo Sapiens
ESLDEATAA

SEQ ID NO: 1358631 - protein, 9 aa, Homo Sapiens
EVYGTNSEW

SEQ ID NO: 1358632 - protein, 9 aa, Homo Sapiens
DEDEDDGDA

SEQ ID NO: 1358633 - protein, 9 aa, Homo Sapiens
KQYMSEALG

SEQ ID NO: 1358634 - protein, 9 aa, Homo Sapiens
AEKWETVIL

SEQ ID NO: 1358635 - protein, 9 aa, Homo Sapiens
SSRYLASQK

SEQ ID NO: 1358636 - protein, 9 aa, Homo Sapiens
SQRNIALRN

SEQ ID NO: 1358637 - protein, 9 aa, Homo Sapiens
ERCCEILFE

SEQ ID NO: 1358638 - protein, 9 aa, Homo Sapiens
YKTLCLHLQ

SEQ ID NO: 1358639 - protein, 9 aa, Homo Sapiens
SETPSHFVK

SEQ ID NO: 1358640 - protein, 9 aa, Homo Sapiens
LERVFTLLH

SEQ ID NO: 1358641 - protein, 9 aa, Homo Sapiens
KTTPTQRSP

SEQ ID NO: 1358642 - protein, 9 aa, Homo Sapiens
EVQVISEHY

SEQ ID NO: 1358643 - protein, 9 aa, Homo Sapiens
NNFQDKLEG

SEQ ID NO: 1358644 - protein, 9 aa, Homo Sapiens
YFAKHLWPE

SEQ ID NO: 1358645 - protein, 9 aa, Homo Sapiens
ALREAFSTT

SEQ ID NO: 1358646 - protein, 9 aa, Homo Sapiens
VPMLKLARD

SEQ ID NO: 1358647 - protein, 9 aa, Homo Sapiens
DFAVPMKDV

SEQ ID NO: 1358648 - protein, 9 aa, Homo Sapiens
TTIIMRDPD

SEQ ID NO: 1358649 - protein, 9 aa, Homo Sapiens
FETSEHKVI

SEQ ID NO: 1358650 - protein, 9 aa, Homo Sapiens
KTNYINDNM

SEQ ID NO: 1358651 - protein, 9 aa, Homo Sapiens
LDKCRTPLD

SEQ ID NO: 1358652 - protein, 9 aa, Homo Sapiens
LHNITPGMD

SEQ ID NO: 1358653 - protein, 9 aa, Homo Sapiens
LQVLSAIFE

SEQ ID NO: 1358654 - protein, 9 aa, Homo Sapiens
NYAKELKRI

SEQ ID NO: 1358655 - protein, 9 aa, Homo Sapiens
SKTDLSQTI

SEQ ID NO: 1358656 - protein, 9 aa, Homo Sapiens
WVRLEHVYF

SEQ ID NO: 1358657 - protein, 9 aa, Homo Sapiens
FTHILLDED

SEQ ID NO: 1358658 - protein, 9 aa, Homo Sapiens
EALEMKLAD

SEQ ID NO: 1358659 - protein, 9 aa, Homo Sapiens
MAGSNRSWD

SEQ ID NO: 1358660 - protein, 9 aa, Homo Sapiens
LDNIVKLLD

SEQ ID NO: 1358661 - protein, 9 aa, Homo Sapiens
PTESAPAQC

SEQ ID NO: 1358662 - protein, 9 aa, Homo Sapiens
IHLDLVPKT

SEQ ID NO: 1358663 - protein, 9 aa, Homo Sapiens
NTLWIESTN

SEQ ID NO: 1358664 - protein, 9 aa, Homo Sapiens
CSTNKPDGY

SEQ ID NO: 1358665 - protein, 9 aa, Homo Sapiens
CSEISLIVF

SEQ ID NO: 1358666 - protein, 9 aa, Homo Sapiens
VAKFSQVAI

SEQ ID NO: 1358667 - protein, 9 aa, Homo Sapiens
GAKNPSIEP

SEQ ID NO: 1358668 - protein, 9 aa, Homo Sapiens
SCLSLQSRW

SEQ ID NO: 1358669 - protein, 9 aa, Homo Sapiens
RIDNVVLVV

SEQ ID NO: 1358670 - protein, 9 aa, Homo Sapiens
SFVKFEAEG

SEQ ID NO: 1358671 - protein, 9 aa, Homo Sapiens
LYTLTPGPS

SEQ ID NO: 1358672 - protein, 9 aa, Homo Sapiens
SSSHSSDEP

SEQ ID NO: 1358673 - protein, 9 aa, Homo Sapiens
LPQDLAVAK

SEQ ID NO: 1358674 - protein, 9 aa, Homo Sapiens
MPITKQATS

SEQ ID NO: 1358675 - protein, 9 aa, Homo Sapiens
VTSPLACLN

SEQ ID NO: 1358676 - protein, 9 aa, Homo Sapiens
VPEVELLDQ

SEQ ID NO: 1358677 - protein, 9 aa, Homo Sapiens
KNKVVVNED

SEQ ID NO: 1358678 - protein, 9 aa, Homo Sapiens
SQEISFEAC

SEQ ID NO: 1358679 - protein, 9 aa, Homo Sapiens
GLEKCTKAT

SEQ ID NO: 1358680 - protein, 9 aa, Homo Sapiens
KECWKNFSN

SEQ ID NO: 1358681 - protein, 9 aa, Homo Sapiens
LKAQKDNAE

SEQ ID NO: 1358682 - protein, 9 aa, Homo Sapiens
SSVAKSGSE

SEQ ID NO: 1358683 - protein, 9 aa, Homo Sapiens
ELHQKHGEP

SEQ ID NO: 1358684 - protein, 9 aa, Homo Sapiens
YSEQPGSPE

SEQ ID NO: 1358685 - protein, 9 aa, Homo Sapiens
WDKDEYDKL

SEQ ID NO: 1358686 - protein, 9 aa, Homo Sapiens
PHFTLDCNS

SEQ ID NO: 1358687 - protein, 9 aa, Homo Sapiens
SQGGIAPSY

SEQ ID NO: 1358688 - protein, 9 aa, Homo Sapiens
MVVVTDLKV

SEQ ID NO: 1358689 - protein, 9 aa, Homo Sapiens
TIEVYIEVK

SEQ ID NO: 1358690 - protein, 9 aa, Homo Sapiens
HKRFKSSEN

SEQ ID NO: 1358691 - protein, 9 aa, Homo Sapiens
LSANNIPLS

SEQ ID NO: 1358692 - protein, 9 aa, Homo Sapiens
SDKKWSKVE

SEQ ID NO: 1358693 - protein, 9 aa, Homo Sapiens
LKRVQLLEL

SEQ ID NO: 1358694 - protein, 9 aa, Homo Sapiens
RMKEKDFTI

SEQ ID NO: 1358695 - protein, 9 aa, Homo Sapiens
LLIKEDHNF

SEQ ID NO: 1358696 - protein, 9 aa, Homo Sapiens
RIIVANIEE

SEQ ID NO: 1358697 - protein, 9 aa, Homo Sapiens
SGKLSNVKR

SEQ ID NO: 1358698 - protein, 9 aa, Homo Sapiens
FHWIHTQLV

SEQ ID NO: 1358699 - protein, 9 aa, Homo Sapiens
SNDISMRLH

SEQ ID NO: 1358700 - protein, 9 aa, Homo Sapiens
CKIKEKTVV

SEQ ID NO: 1358701 - protein, 9 aa, Homo Sapiens
SHHVSTPVE

SEQ ID NO: 1358702 - protein, 9 aa, Homo Sapiens
EWSESSQHL

SEQ ID NO: 1358703 - protein, 9 aa, Homo Sapiens
EKVNNRDSI

SEQ ID NO: 1358704 - protein, 9 aa, Homo Sapiens
IDAYVRIWT

SEQ ID NO: 1358705 - protein, 9 aa, Homo Sapiens
VCSQIDFTE

SEQ ID NO: 1358706 - protein, 9 aa, Homo Sapiens
GIKNDNKNI

SEQ ID NO: 1358707 - protein, 9 aa, Homo Sapiens
FQLGNMAFA

SEQ ID NO: 1358708 - protein, 9 aa, Homo Sapiens
EGLGMVTQE

SEQ ID NO: 1358709 - protein, 9 aa, Homo Sapiens
LAPTCRDFA

SEQ ID NO: 1358710 - protein, 9 aa, Homo Sapiens
GCSTEFVDH

SEQ ID NO: 1358711 - protein, 9 aa, Homo Sapiens
ALRPALQDT

SEQ ID NO: 1358712 - protein, 9 aa, Homo Sapiens
SQHLQLVVT

SEQ ID NO: 1358713 - protein, 9 aa, Homo Sapiens
VSQKLTYSI

SEQ ID NO: 1358714 - protein, 9 aa, Homo Sapiens
HYCDVCKMS

SEQ ID NO: 1358715 - protein, 9 aa, Homo Sapiens
KGKGKKRMG

SEQ ID NO: 1358716 - protein, 9 aa, Homo Sapiens
MSEALGVGE

SEQ ID NO: 1358717 - protein, 9 aa, Homo Sapiens
FPMANGAGA

SEQ ID NO: 1358718 - protein, 9 aa, Homo Sapiens
VKLVGGKAL

SEQ ID NO: 1358719 - protein, 9 aa, Homo Sapiens
AEAVSTLWE

SEQ ID NO: 1358720 - protein, 9 aa, Homo Sapiens
TSRVHPALD

SEQ ID NO: 1358721 - protein, 9 aa, Homo Sapiens
FTEKINDAS

SEQ ID NO: 1358722 - protein, 9 aa, Homo Sapiens
WVNVVVDYR

SEQ ID NO: 1358723 - protein, 9 aa, Homo Sapiens
PNLEINHNA

SEQ ID NO: 1358724 - protein, 9 aa, Homo Sapiens
CVCVHVSAC

SEQ ID NO: 1358725 - protein, 9 aa, Homo Sapiens
GFILISELN

SEQ ID NO: 1358726 - protein, 9 aa, Homo Sapiens
FGEEFPDTQ

SEQ ID NO: 1358727 - protein, 9 aa, Homo Sapiens
GFPMANGAG

SEQ ID NO: 1358728 - protein, 9 aa, Homo Sapiens
PASDVFLRR

SEQ ID NO: 1358729 - protein, 9 aa, Homo Sapiens
SCLMVERCC

SEQ ID NO: 1358730 - protein, 9 aa, Homo Sapiens
HNITPGMDC

SEQ ID NO: 1358731 - protein, 9 aa, Homo Sapiens
AKKDDTDDQ

SEQ ID NO: 1358732 - protein, 9 aa, Homo Sapiens
IHSYKEGTD

SEQ ID NO: 1358733 - protein, 9 aa, Homo Sapiens
ASDLTRPED

SEQ ID NO: 1358734 - protein, 9 aa, Homo Sapiens
REVVQEKKV

SEQ ID NO: 1358735 - protein, 9 aa, Homo Sapiens
RPEYKEWNP

SEQ ID NO: 1358736 - protein, 9 aa, Homo Sapiens
GDGKTMTND

SEQ ID NO: 1358737 - protein, 9 aa, Homo Sapiens
LELKGVPIR

SEQ ID NO: 1358738 - protein, 9 aa, Homo Sapiens
VFYGAAIFT

SEQ ID NO: 1358739 - protein, 9 aa, Homo Sapiens
ASVSKAERK

SEQ ID NO: 1358740 - protein, 9 aa, Homo Sapiens
TVQGKQISK

SEQ ID NO: 1358741 - protein, 9 aa, Homo Sapiens
QYQSVPVYQ

SEQ ID NO: 1358742 - protein, 9 aa, Homo Sapiens
IINQGCLKF

SEQ ID NO: 1358743 - protein, 9 aa, Homo Sapiens
AERSAAVMA

SEQ ID NO: 1358744 - protein, 9 aa, Homo Sapiens
FALMMSLLA

SEQ ID NO: 1358745 - protein, 9 aa, Homo Sapiens
VSLEKLQYA

SEQ ID NO: 1358746 - protein, 9 aa, Homo Sapiens
GSDWEANGF

SEQ ID NO: 1358747 - protein, 9 aa, Homo Sapiens
TYAAIFAVM

SEQ ID NO: 1358748 - protein, 9 aa, Homo Sapiens
TDEDMLKYI

SEQ ID NO: 1358749 - protein, 9 aa, Homo Sapiens
VGLDTTRSA

SEQ ID NO: 1358750 - protein, 9 aa, Homo Sapiens
NPMGIIPFS

SEQ ID NO: 1358751 - protein, 9 aa, Homo Sapiens
SLEKLQYAT

SEQ ID NO: 1358752 - protein, 9 aa, Homo Sapiens
NDLREFVLE

SEQ ID NO: 1358753 - protein, 9 aa, Homo Sapiens
YGKKFDVKT

SEQ ID NO: 1358754 - protein, 9 aa, Homo Sapiens
VGKYMQLMN

SEQ ID NO: 1358755 - protein, 9 aa, Homo Sapiens
EEIDILINN

SEQ ID NO: 1358756 - protein, 9 aa, Homo Sapiens
IKEARIKRC

SEQ ID NO: 1358757 - protein, 9 aa, Homo Sapiens
QPLDQNFSP

SEQ ID NO: 1358758 - protein, 9 aa, Homo Sapiens
STTVILAGV

SEQ ID NO: 1358759 - protein, 9 aa, Homo Sapiens
NKKRLLQLL

SEQ ID NO: 1358760 - protein, 9 aa, Homo Sapiens
CKVHFPNPN

SEQ ID NO: 1358761 - protein, 9 aa, Homo Sapiens
RHVPSWQIM

SEQ ID NO: 1358762 - protein, 9 aa, Homo Sapiens
WSKVENTWI

SEQ ID NO: 1358763 - protein, 9 aa, Homo Sapiens
LTPVVNHLI

SEQ ID NO: 1358764 - protein, 9 aa, Homo Sapiens
RVCICVCVH

SEQ ID NO: 1358765 - protein, 9 aa, Homo Sapiens
QAARLLDIP

SEQ ID NO: 1358766 - protein, 9 aa, Homo Sapiens
DMHEIEKYQ

SEQ ID NO: 1358767 - protein, 9 aa, Homo Sapiens
FIIVFVESL

SEQ ID NO: 1358768 - protein, 9 aa, Homo Sapiens
VAKLLLNTG

SEQ ID NO: 1358769 - protein, 9 aa, Homo Sapiens
VVKHSVQIP

SEQ ID NO: 1358770 - protein, 9 aa, Homo Sapiens
IDQNLLNFL

SEQ ID NO: 1358771 - protein, 9 aa, Homo Sapiens
RTCHVNLKD

SEQ ID NO: 1358772 - protein, 9 aa, Homo Sapiens
KAVGSDCGG

SEQ ID NO: 1358773 - protein, 9 aa, Homo Sapiens
NLYVAGAHF

SEQ ID NO: 1358774 - protein, 9 aa, Homo Sapiens
ILQQPLQLG

SEQ ID NO: 1358775 - protein, 9 aa, Homo Sapiens
IKAANLLFG

SEQ ID NO: 1358776 - protein, 9 aa, Homo Sapiens
CYKLCETTV

SEQ ID NO: 1358777 - protein, 9 aa, Homo Sapiens
KCQLADTQL

SEQ ID NO: 1358778 - protein, 9 aa, Homo Sapiens
ENSWEELDQ

SEQ ID NO: 1358779 - protein, 9 aa, Homo Sapiens
VNQPNYTVW

SEQ ID NO: 1358780 - protein, 9 aa, Homo Sapiens
EKLHNCGVP

SEQ ID NO: 1358781 - protein, 9 aa, Homo Sapiens
HVYFSELDE

SEQ ID NO: 1358782 - protein, 9 aa, Homo Sapiens
LNDISMKSE

SEQ ID NO: 1358783 - protein, 9 aa, Homo Sapiens
ADLKLDEVE

SEQ ID NO: 1358784 - protein, 9 aa, Homo Sapiens
DDDDDNVVG

SEQ ID NO: 1358785 - protein, 9 aa, Homo Sapiens
SLKENLQNV

SEQ ID NO: 1358786 - protein, 9 aa, Homo Sapiens
WAAPSATQI

SEQ ID NO: 1358787 - protein, 9 aa, Homo Sapiens
ELKAQKDNA

SEQ ID NO: 1358788 - protein, 9 aa, Homo Sapiens
SCSHRDEDR

SEQ ID NO: 1358789 - protein, 9 aa, Homo Sapiens
QFKGVQGVK

SEQ ID NO: 1358790 - protein, 9 aa, Homo Sapiens
GDIDHDHAL

SEQ ID NO: 1358791 - protein, 9 aa, Homo Sapiens
DKVVWNKRL

SEQ ID NO: 1358792 - protein, 9 aa, Homo Sapiens
RTEEKLHAC

SEQ ID NO: 1358793 - protein, 9 aa, Homo Sapiens
VTHVREHSL

SEQ ID NO: 1358794 - protein, 9 aa, Homo Sapiens
EDHNFHEPM

SEQ ID NO: 1358795 - protein, 9 aa, Homo Sapiens
DQICGFHIR

SEQ ID NO: 1358796 - protein, 9 aa, Homo Sapiens
EELIMTNPH

SEQ ID NO: 1358797 - protein, 9 aa, Homo Sapiens
PGKHLAEKV

SEQ ID NO: 1358798 - protein, 9 aa, Homo Sapiens
NFEDAAPEE

SEQ ID NO: 1358799 - protein, 9 aa, Homo Sapiens
LIMTNPHNH

SEQ ID NO: 1358800 - protein, 9 aa, Homo Sapiens
PGYHIDLFM

SEQ ID NO: 1358801 - protein, 9 aa, Homo Sapiens
ALTSWGWSR

SEQ ID NO: 1358802 - protein, 9 aa, Homo Sapiens
DAEADQICG

SEQ ID NO: 1358803 - protein, 9 aa, Homo Sapiens
EPLGKSLAF

SEQ ID NO: 1358804 - protein, 9 aa, Homo Sapiens
AIQAIIITM

SEQ ID NO: 1358805 - protein, 9 aa, Homo Sapiens
LSSQEVHES

SEQ ID NO: 1358806 - protein, 9 aa, Homo Sapiens
LVFSKEGRY

SEQ ID NO: 1358807 - protein, 9 aa, Homo Sapiens
LSDKKVYAE

SEQ ID NO: 1358808 - protein, 9 aa, Homo Sapiens
CSTEFVDHD

SEQ ID NO: 1358809 - protein, 9 aa, Homo Sapiens
KVVVNEDTQ

SEQ ID NO: 1358810 - protein, 9 aa, Homo Sapiens
TLLFFGLWH

SEQ ID NO: 1358811 - protein, 9 aa, Homo Sapiens
RLAVSLVIT

SEQ ID NO: 1358812 - protein, 9 aa, Homo Sapiens
LFMLLNGYE

SEQ ID NO: 1358813 - protein, 9 aa, Homo Sapiens
AEADQICGF

SEQ ID NO: 1358814 - protein, 9 aa, Homo Sapiens
RSQEPQRKF

SEQ ID NO: 1358815 - protein, 9 aa, Homo Sapiens
WKFNHLELK

SEQ ID NO: 1358816 - protein, 9 aa, Homo Sapiens
MASAIMQCS

SEQ ID NO: 1358817 - protein, 9 aa, Homo Sapiens
LINLKQHLQ

SEQ ID NO: 1358818 - protein, 9 aa, Homo Sapiens
SRAEAARIK

SEQ ID NO: 1358819 - protein, 9 aa, Homo Sapiens
IWTFDPGEL

SEQ ID NO: 1358820 - protein, 9 aa, Homo Sapiens
ERTCLHAAA

SEQ ID NO: 1358821 - protein, 9 aa, Homo Sapiens
NIKSVGGAC

SEQ ID NO: 1358822 - protein, 9 aa, Homo Sapiens
KVRKFPFAA

SEQ ID NO: 1358823 - protein, 9 aa, Homo Sapiens
RKEFPYRIH

SEQ ID NO: 1358824 - protein, 9 aa, Homo Sapiens
FPYRIHLDL

SEQ ID NO: 1358825 - protein, 9 aa, Homo Sapiens
KETLESKHN

SEQ ID NO: 1358826 - protein, 9 aa, Homo Sapiens
VGNASLAET

SEQ ID NO: 1358827 - protein, 9 aa, Homo Sapiens
ESCNSDNVN

SEQ ID NO: 1358828 - protein, 9 aa, Homo Sapiens
STQDKLARK

SEQ ID NO: 1358829 - protein, 9 aa, Homo Sapiens
HVAVVGVFY

SEQ ID NO: 1358830 - protein, 9 aa, Homo Sapiens
SDFYTLRVG

SEQ ID NO: 1358831 - protein, 9 aa, Homo Sapiens
RPGEHASCW

SEQ ID NO: 1358832 - protein, 9 aa, Homo Sapiens
IALVESLEY

SEQ ID NO: 1358833 - protein, 9 aa, Homo Sapiens
YSTVSVADA

SEQ ID NO: 1358834 - protein, 9 aa, Homo Sapiens
NCTSGRRLQ

SEQ ID NO: 1358835 - protein, 9 aa, Homo Sapiens
TLNSLQLHC

SEQ ID NO: 1358836 - protein, 9 aa, Homo Sapiens
KDFSHTQMP

SEQ ID NO: 1358837 - protein, 9 aa, Homo Sapiens
DKDMNGFSW

SEQ ID NO: 1358838 - protein, 9 aa, Homo Sapiens
FRSSAQILW

SEQ ID NO: 1358839 - protein, 9 aa, Homo Sapiens
SFCQGGSIK

SEQ ID NO: 1358840 - protein, 9 aa, Homo Sapiens
ELWYSWRYQ

SEQ ID NO: 1358841 - protein, 9 aa, Homo Sapiens
NLITLFNDW

SEQ ID NO: 1358842 - protein, 9 aa, Homo Sapiens
WSESSQHLQ

SEQ ID NO: 1358843 - protein, 9 aa, Homo Sapiens
SLDNIVKLL

SEQ ID NO: 1358844 - protein, 9 aa, Homo Sapiens
LPPPLQPEV

SEQ ID NO: 1358845 - protein, 9 aa, Homo Sapiens
GGCSVSHHR

SEQ ID NO: 1358846 - protein, 9 aa, Homo Sapiens
WALCGAFTG

SEQ ID NO: 1358847 - protein, 9 aa, Homo Sapiens
PTTSFQAPS

SEQ ID NO: 1358848 - protein, 9 aa, Homo Sapiens
HCQHGATCS

SEQ ID NO: 1358849 - protein, 9 aa, Homo Sapiens
YKISPDREY

SEQ ID NO: 1358850 - protein, 9 aa, Homo Sapiens
AVRRPGYHI

SEQ ID NO: 1358851 - protein, 9 aa, Homo Sapiens
AETLYTIGD

SEQ ID NO: 1358852 - protein, 9 aa, Homo Sapiens
FDSNAIAYY

SEQ ID NO: 1358853 - protein, 9 aa, Homo Sapiens
CPDCFNSGV

SEQ ID NO: 1358854 - protein, 9 aa, Homo Sapiens
TQYSQVHIC

SEQ ID NO: 1358855 - protein, 9 aa, Homo Sapiens
VLAGDTMGP

SEQ ID NO: 1358856 - protein, 9 aa, Homo Sapiens
AFSTTFKTQ

SEQ ID NO: 1358857 - protein, 9 aa, Homo Sapiens
DFNTTEKRA

SEQ ID NO: 1358858 - protein, 9 aa, Homo Sapiens
EAKAVCDRV

SEQ ID NO: 1358859 - protein, 9 aa, Homo Sapiens
VMFYYFAKH

SEQ ID NO: 1358860 - protein, 9 aa, Homo Sapiens
LLKTCARAG

SEQ ID NO: 1358861 - protein, 9 aa, Homo Sapiens
TRLAVSLVI

SEQ ID NO: 1358862 - protein, 9 aa, Homo Sapiens
NHHIPFNWD

SEQ ID NO: 1358863 - protein, 9 aa, Homo Sapiens
KLLCQLTQS

SEQ ID NO: 1358864 - protein, 9 aa, Homo Sapiens
FQCEKCKFY

SEQ ID NO: 1358865 - protein, 9 aa, Homo Sapiens
QQLGTAVQM

SEQ ID NO: 1358866 - protein, 9 aa, Homo Sapiens
QLAVFKRNE

SEQ ID NO: 1358867 - protein, 9 aa, Homo Sapiens
EGIEYKVRK

SEQ ID NO: 1358868 - protein, 9 aa, Homo Sapiens
AVRGKLTDQ

SEQ ID NO: 1358869 - protein, 9 aa, Homo Sapiens
REIQNLKVF

SEQ ID NO: 1358870 - protein, 9 aa, Homo Sapiens
LALFWFDSQ

SEQ ID NO: 1358871 - protein, 9 aa, Homo Sapiens
SYKEGTDPE

SEQ ID NO: 1358872 - protein, 9 aa, Homo Sapiens
AGEIEYEVQ

SEQ ID NO: 1358873 - protein, 9 aa, Homo Sapiens
LFIIVFVES

SEQ ID NO: 1358874 - protein, 9 aa, Homo Sapiens
TCVDDIHQR

SEQ ID NO: 1358875 - protein, 9 aa, Homo Sapiens
LAWVSHYST

SEQ ID NO: 1358876 - protein, 9 aa, Homo Sapiens
NFQKIIDKE

SEQ ID NO: 1358877 - protein, 9 aa, Homo Sapiens
VMLDENLLK

SEQ ID NO: 1358878 - protein, 9 aa, Homo Sapiens
DLTRPEDST

SEQ ID NO: 1358879 - protein, 9 aa, Homo Sapiens
FCEPRIQQE

SEQ ID NO: 1358880 - protein, 9 aa, Homo Sapiens
VHQRMHTAE

SEQ ID NO: 1358881 - protein, 9 aa, Homo Sapiens
RSWDLKDAQ

SEQ ID NO: 1358882 - protein, 9 aa, Homo Sapiens
TGLTLKRGA

SEQ ID NO: 1358883 - protein, 9 aa, Homo Sapiens
RDSDSNSSE

SEQ ID NO: 1358884 - protein, 9 aa, Homo Sapiens
CGGLSANNI

SEQ ID NO: 1358885 - protein, 9 aa, Homo Sapiens
HLKRVQLLE

SEQ ID NO: 1358886 - protein, 9 aa, Homo Sapiens
RGDPGSERG

SEQ ID NO: 1358887 - protein, 9 aa, Homo Sapiens
GSPPLGFLL

SEQ ID NO: 1358888 - protein, 9 aa, Homo Sapiens
GTALSMTHG

SEQ ID NO: 1358889 - protein, 9 aa, Homo Sapiens
VAKSGSESK

SEQ ID NO: 1358890 - protein, 9 aa, Homo Sapiens
QQPLQLGPQ

SEQ ID NO: 1358891 - protein, 9 aa, Homo Sapiens
DEEMEALEM

SEQ ID NO: 1358892 - protein, 9 aa, Homo Sapiens
CVVPLGVPA

SEQ ID NO: 1358893 - protein, 9 aa, Homo Sapiens
LGLEHPLFP

SEQ ID NO: 1358894 - protein, 9 aa, Homo Sapiens
DSDDGSEED

SEQ ID NO: 1358895 - protein, 9 aa, Homo Sapiens
AFNEKTGFV

SEQ ID NO: 1358896 - protein, 9 aa, Homo Sapiens
ADFHNPGYP

SEQ ID NO: 1358897 - protein, 9 aa, Homo Sapiens
LREAFSTTF

SEQ ID NO: 1358898 - protein, 9 aa, Homo Sapiens
FEPAERSAA

SEQ ID NO: 1358899 - protein, 9 aa, Homo Sapiens
FKKFSDFLM

SEQ ID NO: 1358900 - protein, 9 aa, Homo Sapiens
LEMVREDAQ

SEQ ID NO: 1358901 - protein, 9 aa, Homo Sapiens
KIKTGRSAL

SEQ ID NO: 1358902 - protein, 9 aa, Homo Sapiens
FNPLDTFVL

SEQ ID NO: 1358903 - protein, 9 aa, Homo Sapiens
NRCKECWKN

SEQ ID NO: 1358904 - protein, 9 aa, Homo Sapiens
RCSLLQGSP

SEQ ID NO: 1358905 - protein, 9 aa, Homo Sapiens
KSYKPQINS

SEQ ID NO: 1358906 - protein, 9 aa, Homo Sapiens
FTSQWEEID

SEQ ID NO: 1358907 - protein, 9 aa, Homo Sapiens
GKHLAEKVK

SEQ ID NO: 1358908 - protein, 9 aa, Homo Sapiens
TIMYKKLWW

SEQ ID NO: 1358909 - protein, 9 aa, Homo Sapiens
IHMELLGVC

SEQ ID NO: 1358910 - protein, 9 aa, Homo Sapiens
DELESHSHL

SEQ ID NO: 1358911 - protein, 9 aa, Homo Sapiens
MTKTERKEV

SEQ ID NO: 1358912 - protein, 9 aa, Homo Sapiens
NVELELKAQ

SEQ ID NO: 1358913 - protein, 9 aa, Homo Sapiens
ETSEHKVIE

SEQ ID NO: 1358914 - protein, 9 aa, Homo Sapiens
SVQGLASIV

SEQ ID NO: 1358915 - protein, 9 aa, Homo Sapiens
KKETLESKH

SEQ ID NO: 1358916 - protein, 9 aa, Homo Sapiens
SHEWSESSQ

SEQ ID NO: 1358917 - protein, 9 aa, Homo Sapiens
NQPNYTVWS

SEQ ID NO: 1358918 - protein, 9 aa, Homo Sapiens
LRVGIRTVA

SEQ ID NO: 1358919 - protein, 9 aa, Homo Sapiens
GKESCDVVM

SEQ ID NO: 1358920 - protein, 9 aa, Homo Sapiens
RQQEEILRL

SEQ ID NO: 1358921 - protein, 9 aa, Homo Sapiens
ETVYNLIEE

SEQ ID NO: 1358922 - protein, 9 aa, Homo Sapiens
GMKLGHSGE

SEQ ID NO: 1358923 - protein, 9 aa, Homo Sapiens
QAVKTTPTQ

SEQ ID NO: 1358924 - protein, 9 aa, Homo Sapiens
ALGFILISE

SEQ ID NO: 1358925 - protein, 9 aa, Homo Sapiens
VDSSLVGLS

SEQ ID NO: 1358926 - protein, 9 aa, Homo Sapiens
TCVSHLFGV

SEQ ID NO: 1358927 - protein, 9 aa, Homo Sapiens
TLCGEALRA

SEQ ID NO: 1358928 - protein, 9 aa, Homo Sapiens
ETTVMTYAA

SEQ ID NO: 1358929 - protein, 9 aa, Homo Sapiens
IRSPVLFSN

SEQ ID NO: 1358930 - protein, 9 aa, Homo Sapiens
LGKAKDNQS

SEQ ID NO: 1358931 - protein, 9 aa, Homo Sapiens
MSMLRLQKM

SEQ ID NO: 1358932 - protein, 9 aa, Homo Sapiens
CVFDSNAIA

SEQ ID NO: 1358933 - protein, 9 aa, Homo Sapiens
LENLLHGAL

SEQ ID NO: 1358934 - protein, 9 aa, Homo Sapiens
DFCYQDVHK

SEQ ID NO: 1358935 - protein, 9 aa, Homo Sapiens
TSTPKAKST

SEQ ID NO: 1358936 - protein, 9 aa, Homo Sapiens
WLATSRVHP

SEQ ID NO: 1358937 - protein, 9 aa, Homo Sapiens
RRNVADNKK

SEQ ID NO: 1358938 - protein, 9 aa, Homo Sapiens
FYTLRVGIR

SEQ ID NO: 1358939 - protein, 9 aa, Homo Sapiens
QLGNMAFAE

SEQ ID NO: 1358940 - protein, 9 aa, Homo Sapiens
YLASQKGNI

SEQ ID NO: 1358941 - protein, 9 aa, Homo Sapiens
YVQKVNPSL

SEQ ID NO: 1358942 - protein, 9 aa, Homo Sapiens
FECLDSDEE

SEQ ID NO: 1358943 - protein, 9 aa, Homo Sapiens
TSVTSPLAC

SEQ ID NO: 1358944 - protein, 9 aa, Homo Sapiens
GSSNTCSVF

SEQ ID NO: 1358945 - protein, 9 aa, Homo Sapiens
LFGYKNPDQ

SEQ ID NO: 1358946 - protein, 9 aa, Homo Sapiens
PKVKECKTH

SEQ ID NO: 1358947 - protein, 9 aa, Homo Sapiens
DHNFHEPMY

SEQ ID NO: 1358948 - protein, 9 aa, Homo Sapiens
MRSVSEEVE

SEQ ID NO: 1358949 - protein, 9 aa, Homo Sapiens
HVEQRKILL

SEQ ID NO: 1358950 - protein, 9 aa, Homo Sapiens
LPNKEILEK

SEQ ID NO: 1358951 - protein, 9 aa, Homo Sapiens
KMMVCQVGC

SEQ ID NO: 1358952 - protein, 9 aa, Homo Sapiens
LNYPGNHCP

SEQ ID NO: 1358953 - protein, 9 aa, Homo Sapiens
KRFCKKTHL

SEQ ID NO: 1358954 - protein, 9 aa, Homo Sapiens
EETLKKRKQ

SEQ ID NO: 1358955 - protein, 9 aa, Homo Sapiens
EVTPFTAIR

SEQ ID NO: 1358956 - protein, 9 aa, Homo Sapiens
NQQGSFSSH

SEQ ID NO: 1358957 - protein, 9 aa, Homo Sapiens
QLALANMVC

SEQ ID NO: 1358958 - protein, 9 aa, Homo Sapiens
AFESLDEAT

SEQ ID NO: 1358959 - protein, 9 aa, Homo Sapiens
EALLGAGCN

SEQ ID NO: 1358960 - protein, 9 aa, Homo Sapiens
PWPLQGERP

SEQ ID NO: 1358961 - protein, 9 aa, Homo Sapiens
PGLFSASSL

SEQ ID NO: 1358962 - protein, 9 aa, Homo Sapiens
IIILKDTSK

SEQ ID NO: 1358963 - protein, 9 aa, Homo Sapiens
INQGCLKFL

SEQ ID NO: 1358964 - protein, 9 aa, Homo Sapiens
SLRAIRYKI

SEQ ID NO: 1358965 - protein, 9 aa, Homo Sapiens
LYLPIAAAM

SEQ ID NO: 1358966 - protein, 9 aa, Homo Sapiens
VLCVRINNI

SEQ ID NO: 1358967 - protein, 9 aa, Homo Sapiens
HAADEALDR

SEQ ID NO: 1358968 - protein, 9 aa, Homo Sapiens
CARAGATAP

SEQ ID NO: 1358969 - protein, 9 aa, Homo Sapiens
SVARELHQK

SEQ ID NO: 1358970 - protein, 9 aa, Homo Sapiens
EQGLDYLGS

SEQ ID NO: 1358971 - protein, 9 aa, Homo Sapiens
LLLNDISMK

SEQ ID NO: 1358972 - protein, 9 aa, Homo Sapiens
LEELIMTNP

SEQ ID NO: 1358973 - protein, 9 aa, Homo Sapiens
DMSPCSNVV

SEQ ID NO: 1358974 - protein, 9 aa, Homo Sapiens
FSIHSYKEG

SEQ ID NO: 1358975 - protein, 9 aa, Homo Sapiens
SRNIISFIR

SEQ ID NO: 1358976 - protein, 9 aa, Homo Sapiens
GETSAAALL

SEQ ID NO: 1358977 - protein, 9 aa, Homo Sapiens
VLNKLKVLH

SEQ ID NO: 1358978 - protein, 9 aa, Homo Sapiens
FACLAVLAL

SEQ ID NO: 1358979 - protein, 9 aa, Homo Sapiens
RTGYTYRNP

SEQ ID NO: 1358980 - protein, 9 aa, Homo Sapiens
PWKNGSLVH

SEQ ID NO: 1358981 - protein, 9 aa, Homo Sapiens
SDNCGHYEQ

SEQ ID NO: 1358982 - protein, 9 aa, Homo Sapiens
HFQEIESLH

SEQ ID NO: 1358983 - protein, 9 aa, Homo Sapiens
DNKNILTTW

SEQ ID NO: 1358984 - protein, 9 aa, Homo Sapiens
LREFVLEMQ

SEQ ID NO: 1358985 - protein, 9 aa, Homo Sapiens
IIPFSPKNA

SEQ ID NO: 1358986 - protein, 9 aa, Homo Sapiens
CWFQVLGAE

SEQ ID NO: 1358987 - protein, 9 aa, Homo Sapiens
IDTPDKFER

SEQ ID NO: 1358988 - protein, 9 aa, Homo Sapiens
HYSTVSVAD

SEQ ID NO: 1358989 - protein, 9 aa, Homo Sapiens
GSNRSWDLK

SEQ ID NO: 1358990 - protein, 9 aa, Homo Sapiens
NHLELKGVP

SEQ ID NO: 1358991 - protein, 9 aa, Homo Sapiens
LRALAGIAR

SEQ ID NO: 1358992 - protein, 9 aa, Homo Sapiens
KKFSLFVLD

SEQ ID NO: 1358993 - protein, 9 aa, Homo Sapiens
REDLPGHVK

SEQ ID NO: 1358994 - protein, 9 aa, Homo Sapiens
CIWDCRKGK

SEQ ID NO: 1358995 - protein, 9 aa, Homo Sapiens
TCTKHPNIK

SEQ ID NO: 1358996 - protein, 9 aa, Homo Sapiens
QDPNQEELH

SEQ ID NO: 1358997 - protein, 9 aa, Homo Sapiens
HHVSTPVEN

SEQ ID NO: 1358998 - protein, 9 aa, Homo Sapiens
SCDVVMLDE

SEQ ID NO: 1358999 - protein, 9 aa, Homo Sapiens
LQQPLQLGP

SEQ ID NO: 1359000 - protein, 9 aa, Homo Sapiens
RILLLEQLF

SEQ ID NO: 1359001 - protein, 9 aa, Homo Sapiens
WVPARHSTS

SEQ ID NO: 1359002 - protein, 9 aa, Homo Sapiens
TVENKVDLD

SEQ ID NO: 1359003 - protein, 9 aa, Homo Sapiens
NIKMVMESG

SEQ ID NO: 1359004 - protein, 9 aa, Homo Sapiens
EIESLHLSE

SEQ ID NO: 1359005 - protein, 9 aa, Homo Sapiens
DIDHDHALA

SEQ ID NO: 1359006 - protein, 9 aa, Homo Sapiens
LELAKRGVR

SEQ ID NO: 1359007 - protein, 9 aa, Homo Sapiens
ISLIVFPRR

SEQ ID NO: 1359008 - protein, 9 aa, Homo Sapiens
DVSDAANVI

SEQ ID NO: 1359009 - protein, 9 aa, Homo Sapiens
RNSLPQHMK

SEQ ID NO: 1359010 - protein, 9 aa, Homo Sapiens
KAQKDNAEI

SEQ ID NO: 1359011 - protein, 9 aa, Homo Sapiens
EKRFCTVSV

SEQ ID NO: 1359012 - protein, 9 aa, Homo Sapiens
SNSSEEGTA

SEQ ID NO: 1359013 - protein, 9 aa, Homo Sapiens
PPNFVLAIV

SEQ ID NO: 1359014 - protein, 9 aa, Homo Sapiens
VQKVNPSLL

SEQ ID NO: 1359015 - protein, 9 aa, Homo Sapiens
VGVWQEFEV

SEQ ID NO: 1359016 - protein, 9 aa, Homo Sapiens
GLQCVVPLG

SEQ ID NO: 1359017 - protein, 9 aa, Homo Sapiens
LKTCARAGA

SEQ ID NO: 1359018 - protein, 9 aa, Homo Sapiens
WAKEVQVIS

SEQ ID NO: 1359019 - protein, 9 aa, Homo Sapiens
STASVSKAE

SEQ ID NO: 1359020 - protein, 9 aa, Homo Sapiens
LRLKVRKHA

SEQ ID NO: 1359021 - protein, 9 aa, Homo Sapiens
EAGDWRPDM

SEQ ID NO: 1359022 - protein, 9 aa, Homo Sapiens
FSLFVLDGT

SEQ ID NO: 1359023 - protein, 9 aa, Homo Sapiens
ASCAFGTEY

SEQ ID NO: 1359024 - protein, 9 aa, Homo Sapiens
IVDTLCEGA

SEQ ID NO: 1359025 - protein, 9 aa, Homo Sapiens
RLSGYIKRP

SEQ ID NO: 1359026 - protein, 9 aa, Homo Sapiens
GLGMVTQEG

SEQ ID NO: 1359027 - protein, 9 aa, Homo Sapiens
DNRIRTLSL

SEQ ID NO: 1359028 - protein, 9 aa, Homo Sapiens
PMLKLARDY

SEQ ID NO: 1359029 - protein, 9 aa, Homo Sapiens
EKCKFYTQD

SEQ ID NO: 1359030 - protein, 9 aa, Homo Sapiens
LWSRLNLLM

SEQ ID NO: 1359031 - protein, 9 aa, Homo Sapiens
NPSIEPSSS

SEQ ID NO: 1359032 - protein, 9 aa, Homo Sapiens
LSSWQPQPP

SEQ ID NO: 1359033 - protein, 9 aa, Homo Sapiens
SPELINLKQ

SEQ ID NO: 1359034 - protein, 9 aa, Homo Sapiens
VQGLASIVA

SEQ ID NO: 1359035 - protein, 9 aa, Homo Sapiens
RPTLQSLLE

SEQ ID NO: 1359036 - protein, 9 aa, Homo Sapiens
SKCNDLKSP

SEQ ID NO: 1359037 - protein, 9 aa, Homo Sapiens
LLKMEQKII

SEQ ID NO: 1359038 - protein, 9 aa, Homo Sapiens
SLPGQISRQ

SEQ ID NO: 1359039 - protein, 9 aa, Homo Sapiens
SMKSEGLSG

SEQ ID NO: 1359040 - protein, 9 aa, Homo Sapiens
LCVVETGIG

SEQ ID NO: 1359041 - protein, 9 aa, Homo Sapiens
PVVNHLIYS

SEQ ID NO: 1359042 - protein, 9 aa, Homo Sapiens
DVHKALIVL

SEQ ID NO: 1359043 - protein, 9 aa, Homo Sapiens
EAENSWEEL

SEQ ID NO: 1359044 - protein, 9 aa, Homo Sapiens
TYDVKVQAI

SEQ ID NO: 1359045 - protein, 9 aa, Homo Sapiens
VLSAIFEGS

SEQ ID NO: 1359046 - protein, 9 aa, Homo Sapiens
SNTISRVPA

SEQ ID NO: 1359047 - protein, 9 aa, Homo Sapiens
DLPGHVKDS

SEQ ID NO: 1359048 - protein, 9 aa, Homo Sapiens
LTQNEFEVE

SEQ ID NO: 1359049 - protein, 9 aa, Homo Sapiens
VEVNFQKII

SEQ ID NO: 1359050 - protein, 9 aa, Homo Sapiens
AGATAPGAM

SEQ ID NO: 1359051 - protein, 9 aa, Homo Sapiens
CVSHLFGVT

SEQ ID NO: 1359052 - protein, 9 aa, Homo Sapiens
NLSVAKGPN

SEQ ID NO: 1359053 - protein, 9 aa, Homo Sapiens
KWDKDEYDK

SEQ ID NO: 1359054 - protein, 9 aa, Homo Sapiens
IDGNQQLSV

SEQ ID NO: 1359055 - protein, 9 aa, Homo Sapiens
NFQDKLEGL

SEQ ID NO: 1359056 - protein, 9 aa, Homo Sapiens
FTLLHPQYS

SEQ ID NO: 1359057 - protein, 9 aa, Homo Sapiens
GEEFPDTQR

SEQ ID NO: 1359058 - protein, 9 aa, Homo Sapiens
QCNGRSFSV

SEQ ID NO: 1359059 - protein, 9 aa, Homo Sapiens
QEVHESLLQ

SEQ ID NO: 1359060 - protein, 9 aa, Homo Sapiens
EVSQKLTYS

SEQ ID NO: 1359061 - protein, 9 aa, Homo Sapiens
VYLRNKSRR

SEQ ID NO: 1359062 - protein, 9 aa, Homo Sapiens
QKTNYINDN

SEQ ID NO: 1359063 - protein, 9 aa, Homo Sapiens
IRIHPQPTS

SEQ ID NO: 1359064 - protein, 9 aa, Homo Sapiens
QLVINVSKM

SEQ ID NO: 1359065 - protein, 9 aa, Homo Sapiens
RFQDRRQEH

SEQ ID NO: 1359066 - protein, 9 aa, Homo Sapiens
LDRSCQDLC

SEQ ID NO: 1359067 - protein, 9 aa, Homo Sapiens
VHGGSFILS

SEQ ID NO: 1359068 - protein, 9 aa, Homo Sapiens
EDFYLNTWP

SEQ ID NO: 1359069 - protein, 9 aa, Homo Sapiens
FKEQLKKTY

SEQ ID NO: 1359070 - protein, 9 aa, Homo Sapiens
VGLASGKRR

SEQ ID NO: 1359071 - protein, 9 aa, Homo Sapiens
AKGPNYLTA

SEQ ID NO: 1359072 - protein, 9 aa, Homo Sapiens
YLERNFTFR

SEQ ID NO: 1359073 - protein, 9 aa, Homo Sapiens
WEELDQRYS

SEQ ID NO: 1359074 - protein, 9 aa, Homo Sapiens
EVEQRDSQI

SEQ ID NO: 1359075 - protein, 9 aa, Homo Sapiens
KHKKINTEE

SEQ ID NO: 1359076 - protein, 9 aa, Homo Sapiens
EPMFITVVD

SEQ ID NO: 1359077 - protein, 9 aa, Homo Sapiens
AGMFAIRAL

SEQ ID NO: 1359078 - protein, 9 aa, Homo Sapiens
EAIVMQGTV

SEQ ID NO: 1359079 - protein, 9 aa, Homo Sapiens
WSRLNLLMI

SEQ ID NO: 1359080 - protein, 9 aa, Homo Sapiens
HMMRQQELI

SEQ ID NO: 1359081 - protein, 9 aa, Homo Sapiens
NKGLTSYIW

SEQ ID NO: 1359082 - protein, 9 aa, Homo Sapiens
RMSFVGLAS

SEQ ID NO: 1359083 - protein, 9 aa, Homo Sapiens
EEMEALEMK

SEQ ID NO: 1359084 - protein, 9 aa, Homo Sapiens
DVLNKLKVL

SEQ ID NO: 1359085 - protein, 9 aa, Homo Sapiens
AIHRSTRTE

SEQ ID NO: 1359086 - protein, 9 aa, Homo Sapiens
PPMSLGKAK

SEQ ID NO: 1359087 - protein, 9 aa, Homo Sapiens
VKFDWNHLL

SEQ ID NO: 1359088 - protein, 9 aa, Homo Sapiens
ELRALAGIA

SEQ ID NO: 1359089 - protein, 9 aa, Homo Sapiens
TPIHLAARN

SEQ ID NO: 1359090 - protein, 9 aa, Homo Sapiens
QDKLEGLQL

SEQ ID NO: 1359091 - protein, 9 aa, Homo Sapiens
GKLLMEADE

SEQ ID NO: 1359092 - protein, 9 aa, Homo Sapiens
LISLLNYQD

SEQ ID NO: 1359093 - protein, 9 aa, Homo Sapiens
CLILKNNVK

SEQ ID NO: 1359094 - protein, 9 aa, Homo Sapiens
LAMKDKLLC

SEQ ID NO: 1359095 - protein, 9 aa, Homo Sapiens
QEPSNKIGT

SEQ ID NO: 1359096 - protein, 9 aa, Homo Sapiens
WLACQDFKK

SEQ ID NO: 1359097 - protein, 9 aa, Homo Sapiens
GQIFYCRLQ

SEQ ID NO: 1359098 - protein, 9 aa, Homo Sapiens
ATTLPVLQG

SEQ ID NO: 1359099 - protein, 9 aa, Homo Sapiens
SSGAGGCSV

SEQ ID NO: 1359100 - protein, 9 aa, Homo Sapiens
STVYTPNTN

SEQ ID NO: 1359101 - protein, 9 aa, Homo Sapiens
PALQDTPPK

SEQ ID NO: 1359102 - protein, 9 aa, Homo Sapiens
CTECEKRFC

SEQ ID NO: 1359103 - protein, 9 aa, Homo Sapiens
SAAQEVPGP

SEQ ID NO: 1359104 - protein, 9 aa, Homo Sapiens
EDKKLRNES

SEQ ID NO: 1359105 - protein, 9 aa, Homo Sapiens
REPGDMLLQ

SEQ ID NO: 1359106 - protein, 9 aa, Homo Sapiens
QSKNGNPSA

SEQ ID NO: 1359107 - protein, 9 aa, Homo Sapiens
SCWNPLEQE

SEQ ID NO: 1359108 - protein, 9 aa, Homo Sapiens
ELSSLGSDW

SEQ ID NO: 1359109 - protein, 9 aa, Homo Sapiens
IRVCICVCV

SEQ ID NO: 1359110 - protein, 9 aa, Homo Sapiens
YVRIWTTKD

SEQ ID NO: 1359111 - protein, 9 aa, Homo Sapiens
NLLMIRLFN

SEQ ID NO: 1359112 - protein, 9 aa, Homo Sapiens
RGGTEQSLL

SEQ ID NO: 1359113 - protein, 9 aa, Homo Sapiens
ELLIKIKDL

SEQ ID NO: 1359114 - protein, 9 aa, Homo Sapiens
SPRVFRASS

SEQ ID NO: 1359115 - protein, 9 aa, Homo Sapiens
YIYISHPKQ

SEQ ID NO: 1359116 - protein, 9 aa, Homo Sapiens
ESTQDKLAR

SEQ ID NO: 1359117 - protein, 9 aa, Homo Sapiens
LGSLVHQDG

SEQ ID NO: 1359118 - protein, 9 aa, Homo Sapiens
EASSKTDLS

SEQ ID NO: 1359119 - protein, 9 aa, Homo Sapiens
DFHHIVFGA

SEQ ID NO: 1359120 - protein, 9 aa, Homo Sapiens
KQEVDSAQQ

SEQ ID NO: 1359121 - protein, 9 aa, Homo Sapiens
DSVVQTAAS

SEQ ID NO: 1359122 - protein, 9 aa, Homo Sapiens
AGFDALQWD

SEQ ID NO: 1359123 - protein, 9 aa, Homo Sapiens
QAKKETLES

SEQ ID NO: 1359124 - protein, 9 aa, Homo Sapiens
CMIGLSDFF

SEQ ID NO: 1359125 - protein, 9 aa, Homo Sapiens
SQHSCNAQV

SEQ ID NO: 1359126 - protein, 9 aa, Homo Sapiens
LIRIPTMVL

SEQ ID NO: 1359127 - protein, 9 aa, Homo Sapiens
SEPATAAAM

SEQ ID NO: 1359128 - protein, 9 aa, Homo Sapiens
ENKHVAKLL

SEQ ID NO: 1359129 - protein, 9 aa, Homo Sapiens
LKAKGQLKL

SEQ ID NO: 1359130 - protein, 9 aa, Homo Sapiens
KAKGQLKLL

SEQ ID NO: 1359131 - protein, 9 aa, Homo Sapiens
MDSHGVYGL

SEQ ID NO: 1359132 - protein, 9 aa, Homo Sapiens
FLGKSDPFC

SEQ ID NO: 1359133 - protein, 9 aa, Homo Sapiens
NMVCSDSPF

SEQ ID NO: 1359134 - protein, 9 aa, Homo Sapiens
TLHIQAYNE

SEQ ID NO: 1359135 - protein, 9 aa, Homo Sapiens
EEEVTPFTA

SEQ ID NO: 1359136 - protein, 9 aa, Homo Sapiens
LLDIPCVIA

SEQ ID NO: 1359137 - protein, 9 aa, Homo Sapiens
DYLGSVRLL

SEQ ID NO: 1359138 - protein, 9 aa, Homo Sapiens
KTAFYSLYL

SEQ ID NO: 1359139 - protein, 9 aa, Homo Sapiens
MVSDKSNTD

SEQ ID NO: 1359140 - protein, 9 aa, Homo Sapiens
FKNRRQRDL

SEQ ID NO: 1359141 - protein, 9 aa, Homo Sapiens
LDECASNHC

SEQ ID NO: 1359142 - protein, 9 aa, Homo Sapiens
SMTSTPKAK

SEQ ID NO: 1359143 - protein, 9 aa, Homo Sapiens
FCQGGSIKQ

SEQ ID NO: 1359144 - protein, 9 aa, Homo Sapiens
AEGLGMVTQ

SEQ ID NO: 1359145 - protein, 9 aa, Homo Sapiens
TIGDFEFAL

SEQ ID NO: 1359146 - protein, 9 aa, Homo Sapiens
AHPKLVFSK

SEQ ID NO: 1359147 - protein, 9 aa, Homo Sapiens
AYVRIWTTK

SEQ ID NO: 1359148 - protein, 9 aa, Homo Sapiens
TTHYMAEAK

SEQ ID NO: 1359149 - protein, 9 aa, Homo Sapiens
DRGITFNLI

SEQ ID NO: 1359150 - protein, 9 aa, Homo Sapiens
LLDSQMEFS

SEQ ID NO: 1359151 - protein, 9 aa, Homo Sapiens
CGSGTVQGK

SEQ ID NO: 1359152 - protein, 9 aa, Homo Sapiens
SLLDSQMEF

SEQ ID NO: 1359153 - protein, 9 aa, Homo Sapiens
LKGANKVAE

SEQ ID NO: 1359154 - protein, 9 aa, Homo Sapiens
KPPASIHME

SEQ ID NO: 1359155 - protein, 9 aa, Homo Sapiens
NPVSWIQKV

SEQ ID NO: 1359156 - protein, 9 aa, Homo Sapiens
LLEALQEEN

SEQ ID NO: 1359157 - protein, 9 aa, Homo Sapiens
VLVSGEVYG

SEQ ID NO: 1359158 - protein, 9 aa, Homo Sapiens
FEVRVCACT

SEQ ID NO: 1359159 - protein, 9 aa, Homo Sapiens
QVVKHSVQI

SEQ ID NO: 1359160 - protein, 9 aa, Homo Sapiens
NIEFWLACQ

SEQ ID NO: 1359161 - protein, 9 aa, Homo Sapiens
MKLGHSGER

SEQ ID NO: 1359162 - protein, 9 aa, Homo Sapiens
DDRSFFNLF

SEQ ID NO: 1359163 - protein, 9 aa, Homo Sapiens
ATVVLAGDT

SEQ ID NO: 1359164 - protein, 9 aa, Homo Sapiens
GCDMFAGHA

SEQ ID NO: 1359165 - protein, 9 aa, Homo Sapiens
LAIRTVRVL

SEQ ID NO: 1359166 - protein, 9 aa, Homo Sapiens
RFAITNIKL

SEQ ID NO: 1359167 - protein, 9 aa, Homo Sapiens
TSWGWSRTL

SEQ ID NO: 1359168 - protein, 9 aa, Homo Sapiens
GKHYDSRIS

SEQ ID NO: 1359169 - protein, 9 aa, Homo Sapiens
QAFVPLTTP

SEQ ID NO: 1359170 - protein, 9 aa, Homo Sapiens
YLTQGLIGS

SEQ ID NO: 1359171 - protein, 9 aa, Homo Sapiens
MDQNNFQDK

SEQ ID NO: 1359172 - protein, 9 aa, Homo Sapiens
KTKFIDRLN

SEQ ID NO: 1359173 - protein, 9 aa, Homo Sapiens
RLRGHDDKI

SEQ ID NO: 1359174 - protein, 9 aa, Homo Sapiens
DITAILKSK

SEQ ID NO: 1359175 - protein, 9 aa, Homo Sapiens
VVLAKSYNQ

SEQ ID NO: 1359176 - protein, 9 aa, Homo Sapiens
SVLIIYEQR

SEQ ID NO: 1359177 - protein, 9 aa, Homo Sapiens
GLYLHNNPM

SEQ ID NO: 1359178 - protein, 9 aa, Homo Sapiens
LCLCGAECF

SEQ ID NO: 1359179 - protein, 9 aa, Homo Sapiens
FFLVLMLAG

SEQ ID NO: 1359180 - protein, 9 aa, Homo Sapiens
FTVLKVLNS

SEQ ID NO: 1359181 - protein, 9 aa, Homo Sapiens
LRRASKAWE

SEQ ID NO: 1359182 - protein, 9 aa, Homo Sapiens
HQRFLVALI

SEQ ID NO: 1359183 - protein, 9 aa, Homo Sapiens
RKWDKDEYD

SEQ ID NO: 1359184 - protein, 9 aa, Homo Sapiens
EILKKPISD

SEQ ID NO: 1359185 - protein, 9 aa, Homo Sapiens
RRALHLLTA

SEQ ID NO: 1359186 - protein, 9 aa, Homo Sapiens
CGSVKAPSP

SEQ ID NO: 1359187 - protein, 9 aa, Homo Sapiens
DVHKDIHDY

SEQ ID NO: 1359188 - protein, 9 aa, Homo Sapiens
SKDIEELVE

SEQ ID NO: 1359189 - protein, 9 aa, Homo Sapiens
TPTQRSPLL

SEQ ID NO: 1359190 - protein, 9 aa, Homo Sapiens
NEKYNKSVE

SEQ ID NO: 1359191 - protein, 9 aa, Homo Sapiens
TSKDIEELV

SEQ ID NO: 1359192 - protein, 9 aa, Homo Sapiens
SDSVVQTAA

SEQ ID NO: 1359193 - protein, 9 aa, Homo Sapiens
YFRKQVLHV

SEQ ID NO: 1359194 - protein, 9 aa, Homo Sapiens
CTSGRRLQG

SEQ ID NO: 1359195 - protein, 9 aa, Homo Sapiens
ESRHVAQDV

SEQ ID NO: 1359196 - protein, 9 aa, Homo Sapiens
CYPENNYAK

SEQ ID NO: 1359197 - protein, 9 aa, Homo Sapiens
TQRSPLLNQ

SEQ ID NO: 1359198 - protein, 9 aa, Homo Sapiens
QSTLSLNSE

SEQ ID NO: 1359199 - protein, 9 aa, Homo Sapiens
QVADSRVIS

SEQ ID NO: 1359200 - protein, 9 aa, Homo Sapiens
MSLGKAKDN

SEQ ID NO: 1359201 - protein, 9 aa, Homo Sapiens
ISLLNYQDG

SEQ ID NO: 1359202 - protein, 9 aa, Homo Sapiens
AQIIVMLQD

SEQ ID NO: 1359203 - protein, 9 aa, Homo Sapiens
SVPLGRYFS

SEQ ID NO: 1359204 - protein, 9 aa, Homo Sapiens
SDVIDQNLL

SEQ ID NO: 1359205 - protein, 9 aa, Homo Sapiens
LYLHNNPMN

SEQ ID NO: 1359206 - protein, 9 aa, Homo Sapiens
HVKDFQVDC

SEQ ID NO: 1359207 - protein, 9 aa, Homo Sapiens
VTYEDQRDF

SEQ ID NO: 1359208 - protein, 9 aa, Homo Sapiens
NAEKKQLCF

SEQ ID NO: 1359209 - protein, 9 aa, Homo Sapiens
AFSKTKFID

SEQ ID NO: 1359210 - protein, 9 aa, Homo Sapiens
FHKEPTWES

SEQ ID NO: 1359211 - protein, 9 aa, Homo Sapiens
MLASSVLRC

SEQ ID NO: 1359212 - protein, 9 aa, Homo Sapiens
DFCEPRIQQ

SEQ ID NO: 1359213 - protein, 9 aa, Homo Sapiens
GIPMTKNLD

SEQ ID NO: 1359214 - protein, 9 aa, Homo Sapiens
ASVMKLSEL

SEQ ID NO: 1359215 - protein, 9 aa, Homo Sapiens
AFFKDITSI

SEQ ID NO: 1359216 - protein, 9 aa, Homo Sapiens
AVAADGREP

SEQ ID NO: 1359217 - protein, 9 aa, Homo Sapiens
IDARKNCMI

SEQ ID NO: 1359218 - protein, 9 aa, Homo Sapiens
SEEKVNNRD

SEQ ID NO: 1359219 - protein, 9 aa, Homo Sapiens
RDYLSTLIP

SEQ ID NO: 1359220 - protein, 9 aa, Homo Sapiens
KAEIKALNE

SEQ ID NO: 1359221 - protein, 9 aa, Homo Sapiens
GREPGDMLL

SEQ ID NO: 1359222 - protein, 9 aa, Homo Sapiens
AAANCVNIH

SEQ ID NO: 1359223 - protein, 9 aa, Homo Sapiens
RDGCSTEFV

SEQ ID NO: 1359224 - protein, 9 aa, Homo Sapiens
PIINWEDHL

SEQ ID NO: 1359225 - protein, 9 aa, Homo Sapiens
SVQDQVLLL

SEQ ID NO: 1359226 - protein, 9 aa, Homo Sapiens
IENADARNW

SEQ ID NO: 1359227 - protein, 9 aa, Homo Sapiens
NDSNGYHVL

SEQ ID NO: 1359228 - protein, 9 aa, Homo Sapiens
RVHTVEKPY

SEQ ID NO: 1359229 - protein, 9 aa, Homo Sapiens
IRYKISPDR

SEQ ID NO: 1359230 - protein, 9 aa, Homo Sapiens
SAIFEGSKQ

SEQ ID NO: 1359231 - protein, 9 aa, Homo Sapiens
SDDHVIEYV

SEQ ID NO: 1359232 - protein, 9 aa, Homo Sapiens
RQQQKLERK

SEQ ID NO: 1359233 - protein, 9 aa, Homo Sapiens
VNIVVLLHT

SEQ ID NO: 1359234 - protein, 9 aa, Homo Sapiens
FLGLEHPLF

SEQ ID NO: 1359235 - protein, 9 aa, Homo Sapiens
DYEFIYYEC

SEQ ID NO: 1359236 - protein, 9 aa, Homo Sapiens
GFLYKLKKA

SEQ ID NO: 1359237 - protein, 9 aa, Homo Sapiens
LDGLDKCRT

SEQ ID NO: 1359238 - protein, 9 aa, Homo Sapiens
LTCMYKIPV

SEQ ID NO: 1359239 - protein, 9 aa, Homo Sapiens
HAFGESHAF

SEQ ID NO: 1359240 - protein, 9 aa, Homo Sapiens
QITTNQKTL

SEQ ID NO: 1359241 - protein, 9 aa, Homo Sapiens
GSEVTFVKL

SEQ ID NO: 1359242 - protein, 9 aa, Homo Sapiens
IPMTKNLDP

SEQ ID NO: 1359243 - protein, 9 aa, Homo Sapiens
NMIKCVGNA

SEQ ID NO: 1359244 - protein, 9 aa, Homo Sapiens
ESSQHLQLV

SEQ ID NO: 1359245 - protein, 9 aa, Homo Sapiens
AKGLCWFQV

SEQ ID NO: 1359246 - protein, 9 aa, Homo Sapiens
GLQKTIQDL

SEQ ID NO: 1359247 - protein, 9 aa, Homo Sapiens
PKLPNPPTE

SEQ ID NO: 1359248 - protein, 9 aa, Homo Sapiens
LSLDSSYVE

SEQ ID NO: 1359249 - protein, 9 aa, Homo Sapiens
VGESEPATA

SEQ ID NO: 1359250 - protein, 9 aa, Homo Sapiens
YKDMEINEE

SEQ ID NO: 1359251 - protein, 9 aa, Homo Sapiens
KLVEVDTWE

SEQ ID NO: 1359252 - protein, 9 aa, Homo Sapiens
LYKTLCLHL

SEQ ID NO: 1359253 - protein, 9 aa, Homo Sapiens
EKWETVILK

SEQ ID NO: 1359254 - protein, 9 aa, Homo Sapiens
DSQVQITTN

SEQ ID NO: 1359255 - protein, 9 aa, Homo Sapiens
IIILSYKQE

SEQ ID NO: 1359256 - protein, 9 aa, Homo Sapiens
VLVQEMGRL

SEQ ID NO: 1359257 - protein, 9 aa, Homo Sapiens
MNGFSWAIV

SEQ ID NO: 1359258 - protein, 9 aa, Homo Sapiens
EHASCWNPL

SEQ ID NO: 1359259 - protein, 9 aa, Homo Sapiens
GCIEALVRT

SEQ ID NO: 1359260 - protein, 9 aa, Homo Sapiens
VAGKHFTVL

SEQ ID NO: 1359261 - protein, 9 aa, Homo Sapiens
QRNIALRND

SEQ ID NO: 1359262 - protein, 9 aa, Homo Sapiens
AVFKRNELH

SEQ ID NO: 1359263 - protein, 9 aa, Homo Sapiens
SVVDPDSAA

SEQ ID NO: 1359264 - protein, 9 aa, Homo Sapiens
IQSCTVEVN

SEQ ID NO: 1359265 - protein, 9 aa, Homo Sapiens
ALGGFLYKL

SEQ ID NO: 1359266 - protein, 9 aa, Homo Sapiens
KDNQSISAE

SEQ ID NO: 1359267 - protein, 9 aa, Homo Sapiens
AARIKGEGS

SEQ ID NO: 1359268 - protein, 9 aa, Homo Sapiens
YLCLCGAEC

SEQ ID NO: 1359269 - protein, 9 aa, Homo Sapiens
KCNGSLMKV

SEQ ID NO: 1359270 - protein, 9 aa, Homo Sapiens
QQEITKLNT

SEQ ID NO: 1359271 - protein, 9 aa, Homo Sapiens
IMRDPDELD

SEQ ID NO: 1359272 - protein, 9 aa, Homo Sapiens
SDVFLRRLC

SEQ ID NO: 1359273 - protein, 9 aa, Homo Sapiens
FLLAINQYA

SEQ ID NO: 1359274 - protein, 9 aa, Homo Sapiens
AENSWEELD

SEQ ID NO: 1359275 - protein, 9 aa, Homo Sapiens
EVRCFGGRS

SEQ ID NO: 1359276 - protein, 9 aa, Homo Sapiens
SVMKLSELC

SEQ ID NO: 1359277 - protein, 9 aa, Homo Sapiens
IHQRFLVAL

SEQ ID NO: 1359278 - protein, 9 aa, Homo Sapiens
YTIGDFEFA

SEQ ID NO: 1359279 - protein, 9 aa, Homo Sapiens
GEWSIMTTF

SEQ ID NO: 1359280 - protein, 9 aa, Homo Sapiens
KAANLLFGY

SEQ ID NO: 1359281 - protein, 9 aa, Homo Sapiens
SKSQKLSAV

SEQ ID NO: 1359282 - protein, 9 aa, Homo Sapiens
VTDLKVATS

SEQ ID NO: 1359283 - protein, 9 aa, Homo Sapiens
RSKTKVSVQ

SEQ ID NO: 1359284 - protein, 9 aa, Homo Sapiens
LGMIFLIAV

SEQ ID NO: 1359285 - protein, 9 aa, Homo Sapiens
EKLKKIKTG

SEQ ID NO: 1359286 - protein, 9 aa, Homo Sapiens
KIRFYFNMI

SEQ ID NO: 1359287 - protein, 9 aa, Homo Sapiens
LDFAVPMKD

SEQ ID NO: 1359288 - protein, 9 aa, Homo Sapiens
KADVQKVKD

SEQ ID NO: 1359289 - protein, 9 aa, Homo Sapiens
NEADLCDQH

SEQ ID NO: 1359290 - protein, 9 aa, Homo Sapiens
NMYSQDNQH

SEQ ID NO: 1359291 - protein, 9 aa, Homo Sapiens
AAEHCIPFL

SEQ ID NO: 1359292 - protein, 9 aa, Homo Sapiens
NVCLDHIIY

SEQ ID NO: 1359293 - protein, 9 aa, Homo Sapiens
HFTLDCNSF

SEQ ID NO: 1359294 - protein, 9 aa, Homo Sapiens
IHVQSSSHS

SEQ ID NO: 1359295 - protein, 9 aa, Homo Sapiens
ARRISKCND

SEQ ID NO: 1359296 - protein, 9 aa, Homo Sapiens
IIFCFGTAF

SEQ ID NO: 1359297 - protein, 9 aa, Homo Sapiens
VQMEIAQML

SEQ ID NO: 1359298 - protein, 9 aa, Homo Sapiens
APQSKNGNP

SEQ ID NO: 1359299 - protein, 9 aa, Homo Sapiens
LHVKDFQVD

SEQ ID NO: 1359300 - protein, 9 aa, Homo Sapiens
QAALRVLPR

SEQ ID NO: 1359301 - protein, 9 aa, Homo Sapiens
DRISVSSKR

SEQ ID NO: 1359302 - protein, 9 aa, Homo Sapiens
ESSLKAVDI

SEQ ID NO: 1359303 - protein, 9 aa, Homo Sapiens
SQWEEIDKI

SEQ ID NO: 1359304 - protein, 9 aa, Homo Sapiens
FNLIEARPC

SEQ ID NO: 1359305 - protein, 9 aa, Homo Sapiens
TLESKHNVT

SEQ ID NO: 1359306 - protein, 9 aa, Homo Sapiens
LLNDISMKS

SEQ ID NO: 1359307 - protein, 9 aa, Homo Sapiens
QNEFEVEGK

SEQ ID NO: 1359308 - protein, 9 aa, Homo Sapiens
NNYAKELKR

SEQ ID NO: 1359309 - protein, 9 aa, Homo Sapiens
CPHLYTLTP

SEQ ID NO: 1359310 - protein, 9 aa, Homo Sapiens
VDSGTCSCA

SEQ ID NO: 1359311 - protein, 9 aa, Homo Sapiens
TCSCAFAGW

SEQ ID NO: 1359312 - protein, 9 aa, Homo Sapiens
LKETSVTSP

SEQ ID NO: 1359313 - protein, 9 aa, Homo Sapiens
WEDHLRLLN

SEQ ID NO: 1359314 - protein, 9 aa, Homo Sapiens
GDHAVLCVR

SEQ ID NO: 1359315 - protein, 9 aa, Homo Sapiens
FNDWEHSQG

SEQ ID NO: 1359316 - protein, 9 aa, Homo Sapiens
ISKCNDLKS

SEQ ID NO: 1359317 - protein, 9 aa, Homo Sapiens
ELIMTNPHN

SEQ ID NO: 1359318 - protein, 9 aa, Homo Sapiens
DIKAANLLF

SEQ ID NO: 1359319 - protein, 9 aa, Homo Sapiens
SLGSDWEAN

SEQ ID NO: 1359320 - protein, 9 aa, Homo Sapiens
EASNTDRTA

SEQ ID NO: 1359321 - protein, 9 aa, Homo Sapiens
LRSHSTQSK

SEQ ID NO: 1359322 - protein, 9 aa, Homo Sapiens
LHESTQDKL

SEQ ID NO: 1359323 - protein, 9 aa, Homo Sapiens
SDWEANGFA

SEQ ID NO: 1359324 - protein, 9 aa, Homo Sapiens
FAKHLWPEQ

SEQ ID NO: 1359325 - protein, 9 aa, Homo Sapiens
EEFGKLLME

SEQ ID NO: 1359326 - protein, 9 aa, Homo Sapiens
LPSDVIDQN

SEQ ID NO: 1359327 - protein, 9 aa, Homo Sapiens
ENQESLVSE

SEQ ID NO: 1359328 - protein, 9 aa, Homo Sapiens
AGGLKAKGQ

SEQ ID NO: 1359329 - protein, 9 aa, Homo Sapiens
LEQDVKVSN

SEQ ID NO: 1359330 - protein, 9 aa, Homo Sapiens
RNKSRRYNE

SEQ ID NO: 1359331 - protein, 9 aa, Homo Sapiens
RCISTLMSD

SEQ ID NO: 1359332 - protein, 9 aa, Homo Sapiens
LFGQGSGPI

SEQ ID NO: 1359333 - protein, 9 aa, Homo Sapiens
LIEARPCSP

SEQ ID NO: 1359334 - protein, 9 aa, Homo Sapiens
QKEHQQYQQ

SEQ ID NO: 1359335 - protein, 9 aa, Homo Sapiens
VFDSNAIAY

SEQ ID NO: 1359336 - protein, 9 aa, Homo Sapiens
TGYTYRNPF

SEQ ID NO: 1359337 - protein, 9 aa, Homo Sapiens
QSVIHNNNV

SEQ ID NO: 1359338 - protein, 9 aa, Homo Sapiens
SCTFALTSW

SEQ ID NO: 1359339 - protein, 9 aa, Homo Sapiens
WNPLEQESG

SEQ ID NO: 1359340 - protein, 9 aa, Homo Sapiens
KTLRILKCS

SEQ ID NO: 1359341 - protein, 9 aa, Homo Sapiens
ITSYAGGTN

SEQ ID NO: 1359342 - protein, 9 aa, Homo Sapiens
ETSSVAKSG

SEQ ID NO: 1359343 - protein, 9 aa, Homo Sapiens
GIEYKVRKF

SEQ ID NO: 1359344 - protein, 9 aa, Homo Sapiens
KYEDKKLRN

SEQ ID NO: 1359345 - protein, 9 aa, Homo Sapiens
CFGEEFPDT

SEQ ID NO: 1359346 - protein, 9 aa, Homo Sapiens
NVSQAFVPL

SEQ ID NO: 1359347 - protein, 9 aa, Homo Sapiens
HVLLKTLRI

SEQ ID NO: 1359348 - protein, 9 aa, Homo Sapiens
DGTVMWFDT

SEQ ID NO: 1359349 - protein, 9 aa, Homo Sapiens
DCILPHQSP

SEQ ID NO: 1359350 - protein, 9 aa, Homo Sapiens
EQNFYWSQE

SEQ ID NO: 1359351 - protein, 9 aa, Homo Sapiens
QQVCSQIDF

SEQ ID NO: 1359352 - protein, 9 aa, Homo Sapiens
FVLAIVLPS

SEQ ID NO: 1359353 - protein, 9 aa, Homo Sapiens
VPKCNGSLM

SEQ ID NO: 1359354 - protein, 9 aa, Homo Sapiens
PANSASLIP

SEQ ID NO: 1359355 - protein, 9 aa, Homo Sapiens
HFSPDSHHN

SEQ ID NO: 1359356 - protein, 9 aa, Homo Sapiens
LAEKVKRVY

SEQ ID NO: 1359357 - protein, 9 aa, Homo Sapiens
IQHCKLVRK

SEQ ID NO: 1359358 - protein, 9 aa, Homo Sapiens
IIHKRFKSS

SEQ ID NO: 1359359 - protein, 9 aa, Homo Sapiens
TDCVLYYYL

SEQ ID NO: 1359360 - protein, 9 aa, Homo Sapiens
KFDVKTVSG

SEQ ID NO: 1359361 - protein, 9 aa, Homo Sapiens
GHPVHFQEI

SEQ ID NO: 1359362 - protein, 9 aa, Homo Sapiens
VVVTDLKVA

SEQ ID NO: 1359363 - protein, 9 aa, Homo Sapiens
TVCIWDCRK

SEQ ID NO: 1359364 - protein, 9 aa, Homo Sapiens
AVIITDKSV

SEQ ID NO: 1359365 - protein, 9 aa, Homo Sapiens
TIIAQNHEA

SEQ ID NO: 1359366 - protein, 9 aa, Homo Sapiens
LELSEAEVR

SEQ ID NO: 1359367 - protein, 9 aa, Homo Sapiens
AVLNITSYA

SEQ ID NO: 1359368 - protein, 9 aa, Homo Sapiens
EFHGDHAVL

SEQ ID NO: 1359369 - protein, 9 aa, Homo Sapiens
QHQMIHTGE

SEQ ID NO: 1359370 - protein, 9 aa, Homo Sapiens
EPATAAAMA

SEQ ID NO: 1359371 - protein, 9 aa, Homo Sapiens
KWSGGKHYD

SEQ ID NO: 1359372 - protein, 9 aa, Homo Sapiens
KIKEKTVVS

SEQ ID NO: 1359373 - protein, 9 aa, Homo Sapiens
RGAKGPNGE

SEQ ID NO: 1359374 - protein, 9 aa, Homo Sapiens
SNTDRTASD

SEQ ID NO: 1359375 - protein, 9 aa, Homo Sapiens
KDSVDLEEE

SEQ ID NO: 1359376 - protein, 9 aa, Homo Sapiens
EEKANKAIT

SEQ ID NO: 1359377 - protein, 9 aa, Homo Sapiens
HPQVALQSL

SEQ ID NO: 1359378 - protein, 9 aa, Homo Sapiens
MESRHVAQD

SEQ ID NO: 1359379 - protein, 9 aa, Homo Sapiens
DWEANGFAE

SEQ ID NO: 1359380 - protein, 9 aa, Homo Sapiens
EVYIEVKDV

SEQ ID NO: 1359381 - protein, 9 aa, Homo Sapiens
WQGDGFPMA

SEQ ID NO: 1359382 - protein, 9 aa, Homo Sapiens
IMYKKLWWA

SEQ ID NO: 1359383 - protein, 9 aa, Homo Sapiens
ERLLPLATT

SEQ ID NO: 1359384 - protein, 9 aa, Homo Sapiens
LVGNASLAE

SEQ ID NO: 1359385 - protein, 9 aa, Homo Sapiens
PKLQIQKKI

SEQ ID NO: 1359386 - protein, 9 aa, Homo Sapiens
FDALQWDPK

SEQ ID NO: 1359387 - protein, 9 aa, Homo Sapiens
KRNELHSIF

SEQ ID NO: 1359388 - protein, 9 aa, Homo Sapiens
LAVFKRNEL

SEQ ID NO: 1359389 - protein, 9 aa, Homo Sapiens
DESCNSDNV

SEQ ID NO: 1359390 - protein, 9 aa, Homo Sapiens
WLMVFFLVL

SEQ ID NO: 1359391 - protein, 9 aa, Homo Sapiens
KRFKSSENI

SEQ ID NO: 1359392 - protein, 9 aa, Homo Sapiens
MIKQFKGVQ

SEQ ID NO: 1359393 - protein, 9 aa, Homo Sapiens
NKSRRYNES

SEQ ID NO: 1359394 - protein, 9 aa, Homo Sapiens
KEDHNFHEP

SEQ ID NO: 1359395 - protein, 9 aa, Homo Sapiens
FSVSTTVIL

SEQ ID NO: 1359396 - protein, 9 aa, Homo Sapiens
EVAEKEIGN

SEQ ID NO: 1359397 - protein, 9 aa, Homo Sapiens
EECCKAFNQ

SEQ ID NO: 1359398 - protein, 9 aa, Homo Sapiens
VILAGVKMS

SEQ ID NO: 1359399 - protein, 9 aa, Homo Sapiens
KNTLWIEST

SEQ ID NO: 1359400 - protein, 9 aa, Homo Sapiens
KDLLTKMSG

SEQ ID NO: 1359401 - protein, 9 aa, Homo Sapiens
LSYKQECKD

SEQ ID NO: 1359402 - protein, 9 aa, Homo Sapiens
FSHTQMPKK

SEQ ID NO: 1359403 - protein, 9 aa, Homo Sapiens
TMNIMTVVQ

SEQ ID NO: 1359404 - protein, 9 aa, Homo Sapiens
TLCKFHNQV

SEQ ID NO: 1359405 - protein, 9 aa, Homo Sapiens
LKMEQKIID

SEQ ID NO: 1359406 - protein, 9 aa, Homo Sapiens
LINNIERYL

SEQ ID NO: 1359407 - protein, 9 aa, Homo Sapiens
EQSNGGFPY

SEQ ID NO: 1359408 - protein, 9 aa, Homo Sapiens
PGCPDCFNS

SEQ ID NO: 1359409 - protein, 9 aa, Homo Sapiens
WLSVYGPRA

SEQ ID NO: 1359410 - protein, 9 aa, Homo Sapiens
KLLENLLHG

SEQ ID NO: 1359411 - protein, 9 aa, Homo Sapiens
LHQLFQKEH

SEQ ID NO: 1359412 - protein, 9 aa, Homo Sapiens
THFESKIEI

SEQ ID NO: 1359413 - protein, 9 aa, Homo Sapiens
HDHALAQAI

SEQ ID NO: 1359414 - protein, 9 aa, Homo Sapiens
QSSSHSSDE

SEQ ID NO: 1359415 - protein, 9 aa, Homo Sapiens
SFLTAVHGG

SEQ ID NO: 1359416 - protein, 9 aa, Homo Sapiens
GWSRTLSRN

SEQ ID NO: 1359417 - protein, 9 aa, Homo Sapiens
VSCLSVQGL

SEQ ID NO: 1359418 - protein, 9 aa, Homo Sapiens
QVVFACLAV

SEQ ID NO: 1359419 - protein, 9 aa, Homo Sapiens
QVQQHGSGQ

SEQ ID NO: 1359420 - protein, 9 aa, Homo Sapiens
GHNVSLLAI

SEQ ID NO: 1359421 - protein, 9 aa, Homo Sapiens
NKVAELVHI

SEQ ID NO: 1359422 - protein, 9 aa, Homo Sapiens
FQEIESLHL

SEQ ID NO: 1359423 - protein, 9 aa, Homo Sapiens
RKQVLHVKD

SEQ ID NO: 1359424 - protein, 9 aa, Homo Sapiens
LRCLVKTYA

SEQ ID NO: 1359425 - protein, 9 aa, Homo Sapiens
ISCYPENNY

SEQ ID NO: 1359426 - protein, 9 aa, Homo Sapiens
RLCSQVKLG

SEQ ID NO: 1359427 - protein, 9 aa, Homo Sapiens
FTLDCNSFY

SEQ ID NO: 1359428 - protein, 9 aa, Homo Sapiens
NIMTVVQAY

SEQ ID NO: 1359429 - protein, 9 aa, Homo Sapiens
AAPWRIVWN

SEQ ID NO: 1359430 - protein, 9 aa, Homo Sapiens
ISDNCGHYE

SEQ ID NO: 1359431 - protein, 9 aa, Homo Sapiens
DSNAIAYYV

SEQ ID NO: 1359432 - protein, 9 aa, Homo Sapiens
CPVHFIQHC

SEQ ID NO: 1359433 - protein, 9 aa, Homo Sapiens
KSQKLSAVE

SEQ ID NO: 1359434 - protein, 9 aa, Homo Sapiens
KNRRQRDLA

SEQ ID NO: 1359435 - protein, 9 aa, Homo Sapiens
KEARIKRCL

SEQ ID NO: 1359436 - protein, 9 aa, Homo Sapiens
FEGSKQFLS

SEQ ID NO: 1359437 - protein, 9 aa, Homo Sapiens
CCEILFENP

SEQ ID NO: 1359438 - protein, 9 aa, Homo Sapiens
AKAVCDRVA

SEQ ID NO: 1359439 - protein, 9 aa, Homo Sapiens
DSEEKVNNR

SEQ ID NO: 1359440 - protein, 9 aa, Homo Sapiens
IRLQEEEVT

SEQ ID NO: 1359441 - protein, 9 aa, Homo Sapiens
EQDLYALKY

SEQ ID NO: 1359442 - protein, 9 aa, Homo Sapiens
IVQLLPDSF

SEQ ID NO: 1359443 - protein, 9 aa, Homo Sapiens
IEYVNPAFE

SEQ ID NO: 1359444 - protein, 9 aa, Homo Sapiens
ILVAKFSQV

SEQ ID NO: 1359445 - protein, 9 aa, Homo Sapiens
QDVKVSNDI

SEQ ID NO: 1359446 - protein, 9 aa, Homo Sapiens
AQMNLYVAG

SEQ ID NO: 1359447 - protein, 9 aa, Homo Sapiens
MEEFVKQYM

SEQ ID NO: 1359448 - protein, 9 aa, Homo Sapiens
KALVPMLKL

SEQ ID NO: 1359449 - protein, 9 aa, Homo Sapiens
LALRCLVKT

SEQ ID NO: 1359450 - protein, 9 aa, Homo Sapiens
CTEASESAI

SEQ ID NO: 1359451 - protein, 9 aa, Homo Sapiens
GCTPIHLAA

SEQ ID NO: 1359452 - protein, 9 aa, Homo Sapiens
AMSAPGNAL

SEQ ID NO: 1359453 - protein, 9 aa, Homo Sapiens
KENLQNVSL

SEQ ID NO: 1359454 - protein, 9 aa, Homo Sapiens
RESTQTYGK

SEQ ID NO: 1359455 - protein, 9 aa, Homo Sapiens
DGDATRSKD

SEQ ID NO: 1359456 - protein, 9 aa, Homo Sapiens
LMEGLGTTT

SEQ ID NO: 1359457 - protein, 9 aa, Homo Sapiens
SHTQMPKKV

SEQ ID NO: 1359458 - protein, 9 aa, Homo Sapiens
QGKVFSRVY

SEQ ID NO: 1359459 - protein, 9 aa, Homo Sapiens
MEGLGTTTD

SEQ ID NO: 1359460 - protein, 9 aa, Homo Sapiens
GDPGSERGP

SEQ ID NO: 1359461 - protein, 9 aa, Homo Sapiens
PSNKIGTSL

SEQ ID NO: 1359462 - protein, 9 aa, Homo Sapiens
NVSLTNRNY

SEQ ID NO: 1359463 - protein, 9 aa, Homo Sapiens
VEVSQKLTY

SEQ ID NO: 1359464 - protein, 9 aa, Homo Sapiens
KALEVNKGT

SEQ ID NO: 1359465 - protein, 9 aa, Homo Sapiens
SLGKAKDNQ

SEQ ID NO: 1359466 - protein, 9 aa, Homo Sapiens
VQSSSHSSD

SEQ ID NO: 1359467 - protein, 9 aa, Homo Sapiens
TNLLYEENM

SEQ ID NO: 1359468 - protein, 9 aa, Homo Sapiens
VPYKRINSN

SEQ ID NO: 1359469 - protein, 9 aa, Homo Sapiens
LLILDGLDK

SEQ ID NO: 1359470 - protein, 9 aa, Homo Sapiens
LVSGEVYGT

SEQ ID NO: 1359471 - protein, 9 aa, Homo Sapiens
FCYQDVHKD

SEQ ID NO: 1359472 - protein, 9 aa, Homo Sapiens
LGKSDPFCL

SEQ ID NO: 1359473 - protein, 9 aa, Homo Sapiens
HLELTKCQL

SEQ ID NO: 1359474 - protein, 9 aa, Homo Sapiens
GSFSSHGGS

SEQ ID NO: 1359475 - protein, 9 aa, Homo Sapiens
EFPYRIHLD

SEQ ID NO: 1359476 - protein, 9 aa, Homo Sapiens
NPPTESAPA

SEQ ID NO: 1359477 - protein, 9 aa, Homo Sapiens
LGRITVENK

SEQ ID NO: 1359478 - protein, 9 aa, Homo Sapiens
SQIALVESL

SEQ ID NO: 1359479 - protein, 9 aa, Homo Sapiens
FCKKTHLIR

SEQ ID NO: 1359480 - protein, 9 aa, Homo Sapiens
NSSHHVSTP

SEQ ID NO: 1359481 - protein, 9 aa, Homo Sapiens
NPELRDFRG

SEQ ID NO: 1359482 - protein, 9 aa, Homo Sapiens
SCNAQVTQT

SEQ ID NO: 1359483 - protein, 9 aa, Homo Sapiens
KSKAPAISS

SEQ ID NO: 1359484 - protein, 9 aa, Homo Sapiens
VLILAYCYI

SEQ ID NO: 1359485 - protein, 9 aa, Homo Sapiens
KLENKSKSG

SEQ ID NO: 1359486 - protein, 9 aa, Homo Sapiens
KDEYDKLAE

SEQ ID NO: 1359487 - protein, 9 aa, Homo Sapiens
VPIINQGCL

SEQ ID NO: 1359488 - protein, 9 aa, Homo Sapiens
FYQFGEILT

SEQ ID NO: 1359489 - protein, 9 aa, Homo Sapiens
EILTITVVQ

SEQ ID NO: 1359490 - protein, 9 aa, Homo Sapiens
VEFNVSQAF

SEQ ID NO: 1359491 - protein, 9 aa, Homo Sapiens
DLLAADFLG

SEQ ID NO: 1359492 - protein, 9 aa, Homo Sapiens
NGFCMFDME

SEQ ID NO: 1359493 - protein, 9 aa, Homo Sapiens
PHPDRGITF

SEQ ID NO: 1359494 - protein, 9 aa, Homo Sapiens
FGGRSPKSQ

SEQ ID NO: 1359495 - protein, 9 aa, Homo Sapiens
MVLDDFANG

SEQ ID NO: 1359496 - protein, 9 aa, Homo Sapiens
LQGSPQRIA

SEQ ID NO: 1359497 - protein, 9 aa, Homo Sapiens
EVLFIIVFV

SEQ ID NO: 1359498 - protein, 9 aa, Homo Sapiens
RINSNPGSV

SEQ ID NO: 1359499 - protein, 9 aa, Homo Sapiens
GSGTVQGKQ

SEQ ID NO: 1359500 - protein, 9 aa, Homo Sapiens
MRFAITNIK

SEQ ID NO: 1359501 - protein, 9 aa, Homo Sapiens
SMKDRISVS

SEQ ID NO: 1359502 - protein, 9 aa, Homo Sapiens
HSTSQPWRG

SEQ ID NO: 1359503 - protein, 9 aa, Homo Sapiens
PGQISRQPL

SEQ ID NO: 1359504 - protein, 9 aa, Homo Sapiens
LRHKQAADA

SEQ ID NO: 1359505 - protein, 9 aa, Homo Sapiens
ADFLGKSDP

SEQ ID NO: 1359506 - protein, 9 aa, Homo Sapiens
VREHSLIED

SEQ ID NO: 1359507 - protein, 9 aa, Homo Sapiens
CFNILCVVE

SEQ ID NO: 1359508 - protein, 9 aa, Homo Sapiens
EQYELVNRA

SEQ ID NO: 1359509 - protein, 9 aa, Homo Sapiens
IHYCDVCKM

SEQ ID NO: 1359510 - protein, 9 aa, Homo Sapiens
SLLFSSHAF

SEQ ID NO: 1359511 - protein, 9 aa, Homo Sapiens
KWETVILKC

SEQ ID NO: 1359512 - protein, 9 aa, Homo Sapiens
NDPLGPIDG

SEQ ID NO: 1359513 - protein, 9 aa, Homo Sapiens
QVPYKRINS

SEQ ID NO: 1359514 - protein, 9 aa, Homo Sapiens
DGCSTEFVD

SEQ ID NO: 1359515 - protein, 9 aa, Homo Sapiens
ARNAEEKAN

SEQ ID NO: 1359516 - protein, 9 aa, Homo Sapiens
TYRVVAGEE

SEQ ID NO: 1359517 - protein, 9 aa, Homo Sapiens
NLTLNDAVS

SEQ ID NO: 1359518 - protein, 9 aa, Homo Sapiens
NTIVTEFIL

SEQ ID NO: 1359519 - protein, 9 aa, Homo Sapiens
GFQQATREY

SEQ ID NO: 1359520 - protein, 9 aa, Homo Sapiens
WRIVWNVRC

SEQ ID NO: 1359521 - protein, 9 aa, Homo Sapiens
YGSAFPHGG

SEQ ID NO: 1359522 - protein, 9 aa, Homo Sapiens
GQLGHNSHG

SEQ ID NO: 1359523 - protein, 9 aa, Homo Sapiens
PFLTSLLEE

SEQ ID NO: 1359524 - protein, 9 aa, Homo Sapiens
MAVDMHEIE

SEQ ID NO: 1359525 - protein, 9 aa, Homo Sapiens
HKAGISDTL

SEQ ID NO: 1359526 - protein, 9 aa, Homo Sapiens
MNIMTVVQA

SEQ ID NO: 1359527 - protein, 9 aa, Homo Sapiens
PQSGLPEAQ

SEQ ID NO: 1359528 - protein, 9 aa, Homo Sapiens
IILMIQYKV

SEQ ID NO: 1359529 - protein, 9 aa, Homo Sapiens
VVWNKRLKE

SEQ ID NO: 1359530 - protein, 9 aa, Homo Sapiens
GLTLKRGAE

SEQ ID NO: 1359531 - protein, 9 aa, Homo Sapiens
NSKLVEVDT

SEQ ID NO: 1359532 - protein, 9 aa, Homo Sapiens
QKVNPSLLP

SEQ ID NO: 1359533 - protein, 9 aa, Homo Sapiens
ICFAVPDHL

SEQ ID NO: 1359534 - protein, 9 aa, Homo Sapiens
KESCDVVML

SEQ ID NO: 1359535 - protein, 9 aa, Homo Sapiens
PSLHQLKNS

SEQ ID NO: 1359536 - protein, 9 aa, Homo Sapiens
DSKKHKQGF

SEQ ID NO: 1359537 - protein, 9 aa, Homo Sapiens
GLDYLGSVR

SEQ ID NO: 1359538 - protein, 9 aa, Homo Sapiens
NYPGNHCPG

SEQ ID NO: 1359539 - protein, 9 aa, Homo Sapiens
PALPEYDLV

SEQ ID NO: 1359540 - protein, 9 aa, Homo Sapiens
YAGWPIYPR

SEQ ID NO: 1359541 - protein, 9 aa, Homo Sapiens
EVMHTKNRL

SEQ ID NO: 1359542 - protein, 9 aa, Homo Sapiens
EPAERSAAV

SEQ ID NO: 1359543 - protein, 9 aa, Homo Sapiens
NLEETGLTL

SEQ ID NO: 1359544 - protein, 9 aa, Homo Sapiens
ICGFHIRSV

SEQ ID NO: 1359545 - protein, 9 aa, Homo Sapiens
LKNSCTFAL

SEQ ID NO: 1359546 - protein, 9 aa, Homo Sapiens
SAANVCLDH

SEQ ID NO: 1359547 - protein, 9 aa, Homo Sapiens
DSGTCSCAF

SEQ ID NO: 1359548 - protein, 9 aa, Homo Sapiens
QLLELSEAE

SEQ ID NO: 1359549 - protein, 9 aa, Homo Sapiens
VFTAAHCNL

SEQ ID NO: 1359550 - protein, 9 aa, Homo Sapiens
DQDGSPSLR

SEQ ID NO: 1359551 - protein, 9 aa, Homo Sapiens
LSHERIHTG

SEQ ID NO: 1359552 - protein, 9 aa, Homo Sapiens
TTKKIRNII

SEQ ID NO: 1359553 - protein, 9 aa, Homo Sapiens
RAKMIDFNI

SEQ ID NO: 1359554 - protein, 9 aa, Homo Sapiens
ALTIMYKKL

SEQ ID NO: 1359555 - protein, 9 aa, Homo Sapiens
IRFYFNMIE

SEQ ID NO: 1359556 - protein, 9 aa, Homo Sapiens
YYYYASRVP

SEQ ID NO: 1359557 - protein, 9 aa, Homo Sapiens
CGYAGFGPQ

SEQ ID NO: 1359558 - protein, 9 aa, Homo Sapiens
DSAQQLPKV

SEQ ID NO: 1359559 - protein, 9 aa, Homo Sapiens
EKAFWLSVY

SEQ ID NO: 1359560 - protein, 9 aa, Homo Sapiens
AGVLKLYFL

SEQ ID NO: 1359561 - protein, 9 aa, Homo Sapiens
CTVEVNFQK

SEQ ID NO: 1359562 - protein, 9 aa, Homo Sapiens
NLSREINYC

SEQ ID NO: 1359563 - protein, 9 aa, Homo Sapiens
ALDKYANKS

SEQ ID NO: 1359564 - protein, 9 aa, Homo Sapiens
MDCLWSLEV

SEQ ID NO: 1359565 - protein, 9 aa, Homo Sapiens
AKDWVFTAA

SEQ ID NO: 1359566 - protein, 9 aa, Homo Sapiens
LTKLQHLCV

SEQ ID NO: 1359567 - protein, 9 aa, Homo Sapiens
LGNILSYHN

SEQ ID NO: 1359568 - protein, 9 aa, Homo Sapiens
DGTGYSAPK

SEQ ID NO: 1359569 - protein, 9 aa, Homo Sapiens
KALNEKYNK

SEQ ID NO: 1359570 - protein, 9 aa, Homo Sapiens
HCIPFLTSL

SEQ ID NO: 1359571 - protein, 9 aa, Homo Sapiens
KKPISDVTD

SEQ ID NO: 1359572 - protein, 9 aa, Homo Sapiens
SELCPNLNY

SEQ ID NO: 1359573 - protein, 9 aa, Homo Sapiens
AFWLSVYGP

SEQ ID NO: 1359574 - protein, 9 aa, Homo Sapiens
ANSASLIPS

SEQ ID NO: 1359575 - protein, 9 aa, Homo Sapiens
GVKIRFYFN

SEQ ID NO: 1359576 - protein, 9 aa, Homo Sapiens
TLPVLQGLG

SEQ ID NO: 1359577 - protein, 9 aa, Homo Sapiens
HKIIHTIEK

SEQ ID NO: 1359578 - protein, 9 aa, Homo Sapiens
NASLAETDK

SEQ ID NO: 1359579 - protein, 9 aa, Homo Sapiens
ALANMVCSD

SEQ ID NO: 1359580 - protein, 9 aa, Homo Sapiens
TANELASDV

SEQ ID NO: 1359581 - protein, 9 aa, Homo Sapiens
HPVHFQEIE

SEQ ID NO: 1359582 - protein, 9 aa, Homo Sapiens
GNYDSKKHK

SEQ ID NO: 1359583 - protein, 9 aa, Homo Sapiens
EHEPLGKSL

SEQ ID NO: 1359584 - protein, 9 aa, Homo Sapiens
LEHVYFSEL

SEQ ID NO: 1359585 - protein, 9 aa, Homo Sapiens
VDLEEEAAS

SEQ ID NO: 1359586 - protein, 9 aa, Homo Sapiens
LKVFRHPHI

SEQ ID NO: 1359587 - protein, 9 aa, Homo Sapiens
PTSERLLPL

SEQ ID NO: 1359588 - protein, 9 aa, Homo Sapiens
QGGSIKQIQ

SEQ ID NO: 1359589 - protein, 9 aa, Homo Sapiens
CKFHNQVEI

SEQ ID NO: 1359590 - protein, 9 aa, Homo Sapiens
YCYIILLGV

SEQ ID NO: 1359591 - protein, 9 aa, Homo Sapiens
PAQLSNTSL

SEQ ID NO: 1359592 - protein, 9 aa, Homo Sapiens
TRLSGYIKR

SEQ ID NO: 1359593 - protein, 9 aa, Homo Sapiens
HYMAEAKAV

SEQ ID NO: 1359594 - protein, 9 aa, Homo Sapiens
GRKDSVDLE

SEQ ID NO: 1359595 - protein, 9 aa, Homo Sapiens
EDIRIHPQP

SEQ ID NO: 1359596 - protein, 9 aa, Homo Sapiens
SEDEDEDDG

SEQ ID NO: 1359597 - protein, 9 aa, Homo Sapiens
ELRSQEPQR

SEQ ID NO: 1359598 - protein, 9 aa, Homo Sapiens
SPDSHHNDH

SEQ ID NO: 1359599 - protein, 9 aa, Homo Sapiens
LAQHQMIHT

SEQ ID NO: 1359600 - protein, 9 aa, Homo Sapiens
TNDVQPGLF

SEQ ID NO: 1359601 - protein, 9 aa, Homo Sapiens
AKGVVQVGL

SEQ ID NO: 1359602 - protein, 9 aa, Homo Sapiens
HNIERMKEK

SEQ ID NO: 1359603 - protein, 9 aa, Homo Sapiens
KSEDEDEDD

SEQ ID NO: 1359604 - protein, 9 aa, Homo Sapiens
CQSHALMKG

SEQ ID NO: 1359605 - protein, 9 aa, Homo Sapiens
TEKINDASS

SEQ ID NO: 1359606 - protein, 9 aa, Homo Sapiens
VSHLFGVTI

SEQ ID NO: 1359607 - protein, 9 aa, Homo Sapiens
ESSGSQGGI

SEQ ID NO: 1359608 - protein, 9 aa, Homo Sapiens
RSSLLSHER

SEQ ID NO: 1359609 - protein, 9 aa, Homo Sapiens
SVDSSLVGL

SEQ ID NO: 1359610 - protein, 9 aa, Homo Sapiens
IWLATSRVH

SEQ ID NO: 1359611 - protein, 9 aa, Homo Sapiens
DRSFFNLFH

SEQ ID NO: 1359612 - protein, 9 aa, Homo Sapiens
AKMIDFNIR

SEQ ID NO: 1359613 - protein, 9 aa, Homo Sapiens
ASKSSYSLL

SEQ ID NO: 1359614 - protein, 9 aa, Homo Sapiens
CDVCKMSCA

SEQ ID NO: 1359615 - protein, 9 aa, Homo Sapiens
NTWPIFIFE

SEQ ID NO: 1359616 - protein, 9 aa, Homo Sapiens
SLYLPIAAA

SEQ ID NO: 1359617 - protein, 9 aa, Homo Sapiens
IEVYIEVKD

SEQ ID NO: 1359618 - protein, 9 aa, Homo Sapiens
QDYEFIYYE

SEQ ID NO: 1359619 - protein, 9 aa, Homo Sapiens
RRTNSGHKI

SEQ ID NO: 1359620 - protein, 9 aa, Homo Sapiens
SEVTFVKLE

SEQ ID NO: 1359621 - protein, 9 aa, Homo Sapiens
ATSSRPNLR

SEQ ID NO: 1359622 - protein, 9 aa, Homo Sapiens
EEVEFNVSQ

SEQ ID NO: 1359623 - protein, 9 aa, Homo Sapiens
DQVEFDVHV

SEQ ID NO: 1359624 - protein, 9 aa, Homo Sapiens
RLLSVAESS

SEQ ID NO: 1359625 - protein, 9 aa, Homo Sapiens
EGLQCVVPL

SEQ ID NO: 1359626 - protein, 9 aa, Homo Sapiens
ENIDARKNC

SEQ ID NO: 1359627 - protein, 9 aa, Homo Sapiens
RYFSHATAL

SEQ ID NO: 1359628 - protein, 9 aa, Homo Sapiens
ARNWDLLRT

SEQ ID NO: 1359629 - protein, 9 aa, Homo Sapiens
HLPELRALA

SEQ ID NO: 1359630 - protein, 9 aa, Homo Sapiens
ESAIPDLTD

SEQ ID NO: 1359631 - protein, 9 aa, Homo Sapiens
AQHQMIHTG

SEQ ID NO: 1359632 - protein, 9 aa, Homo Sapiens
YLATGTSAE

SEQ ID NO: 1359633 - protein, 9 aa, Homo Sapiens
VCKMSCAGP

SEQ ID NO: 1359634 - protein, 9 aa, Homo Sapiens
KLRNESVTT

SEQ ID NO: 1359635 - protein, 9 aa, Homo Sapiens
NFHEPMYFF

SEQ ID NO: 1359636 - protein, 9 aa, Homo Sapiens
EEQNLSVAK

SEQ ID NO: 1359637 - protein, 9 aa, Homo Sapiens
EIYNHKNMQ

SEQ ID NO: 1359638 - protein, 9 aa, Homo Sapiens
CNELSSIQS

SEQ ID NO: 1359639 - protein, 9 aa, Homo Sapiens
SQTLPIIRC

SEQ ID NO: 1359640 - protein, 9 aa, Homo Sapiens
VRSWQGDGF

SEQ ID NO: 1359641 - protein, 9 aa, Homo Sapiens
AKYALFLES

SEQ ID NO: 1359642 - protein, 9 aa, Homo Sapiens
SPKGCDMFA

SEQ ID NO: 1359643 - protein, 9 aa, Homo Sapiens
AVHVLLKTL

SEQ ID NO: 1359644 - protein, 9 aa, Homo Sapiens
QTYGKLRPI

SEQ ID NO: 1359645 - protein, 9 aa, Homo Sapiens
NKPDGYRVS

SEQ ID NO: 1359646 - protein, 9 aa, Homo Sapiens
TLALTCMYK

SEQ ID NO: 1359647 - protein, 9 aa, Homo Sapiens
SVTDCVLYY

SEQ ID NO: 1359648 - protein, 9 aa, Homo Sapiens
TAVIITDKS

SEQ ID NO: 1359649 - protein, 9 aa, Homo Sapiens
ETLESKHNV

SEQ ID NO: 1359650 - protein, 9 aa, Homo Sapiens
CWQLVKRQH

SEQ ID NO: 1359651 - protein, 9 aa, Homo Sapiens
TIRSPVLFS

SEQ ID NO: 1359652 - protein, 9 aa, Homo Sapiens
PAKSAHAPK

SEQ ID NO: 1359653 - protein, 9 aa, Homo Sapiens
INDNPPVVL

SEQ ID NO: 1359654 - protein, 9 aa, Homo Sapiens
LSSLGSDWE

SEQ ID NO: 1359655 - protein, 9 aa, Homo Sapiens
DAQAMECET

SEQ ID NO: 1359656 - protein, 9 aa, Homo Sapiens
RHLTRAQMV

SEQ ID NO: 1359657 - protein, 9 aa, Homo Sapiens
RYYSVVYAG

SEQ ID NO: 1359658 - protein, 9 aa, Homo Sapiens
DFENSSTYA

SEQ ID NO: 1359659 - protein, 9 aa, Homo Sapiens
TSDGIFNPS

SEQ ID NO: 1359660 - protein, 9 aa, Homo Sapiens
EQAALRHKQ

SEQ ID NO: 1359661 - protein, 9 aa, Homo Sapiens
YKEGTDPEI

SEQ ID NO: 1359662 - protein, 9 aa, Homo Sapiens
FLMSILMAV

SEQ ID NO: 1359663 - protein, 9 aa, Homo Sapiens
LLNRYSEQP

SEQ ID NO: 1359664 - protein, 9 aa, Homo Sapiens
QVLHVKDFQ

SEQ ID NO: 1359665 - protein, 9 aa, Homo Sapiens
QLLPDSFYY

SEQ ID NO: 1359666 - protein, 9 aa, Homo Sapiens
MLTFYRKTT

SEQ ID NO: 1359667 - protein, 9 aa, Homo Sapiens
SWQIMAVKR

SEQ ID NO: 1359668 - protein, 9 aa, Homo Sapiens
LRAARSPTS

SEQ ID NO: 1359669 - protein, 9 aa, Homo Sapiens
QDRRQEHFI

SEQ ID NO: 1359670 - protein, 9 aa, Homo Sapiens
LNASRDLDR

SEQ ID NO: 1359671 - protein, 9 aa, Homo Sapiens
RKNCMIGLS

SEQ ID NO: 1359672 - protein, 9 aa, Homo Sapiens
ASIHMELLG

SEQ ID NO: 1359673 - protein, 9 aa, Homo Sapiens
GMAVDMHEI

SEQ ID NO: 1359674 - protein, 9 aa, Homo Sapiens
AVAVKAAQQ

SEQ ID NO: 1359675 - protein, 9 aa, Homo Sapiens
HFLTIIHKR

SEQ ID NO: 1359676 - protein, 9 aa, Homo Sapiens
YTIMDNWIF

SEQ ID NO: 1359677 - protein, 9 aa, Homo Sapiens
VSKAERKAQ

SEQ ID NO: 1359678 - protein, 9 aa, Homo Sapiens
QPLVSFPSL

SEQ ID NO: 1359679 - protein, 9 aa, Homo Sapiens
SCLILKNNV

SEQ ID NO: 1359680 - protein, 9 aa, Homo Sapiens
KDDTDDQIA

SEQ ID NO: 1359681 - protein, 9 aa, Homo Sapiens
ERTPSFTSQ

SEQ ID NO: 1359682 - protein, 9 aa, Homo Sapiens
DKDFSHTQM

SEQ ID NO: 1359683 - protein, 9 aa, Homo Sapiens
YQRLKFKRE

SEQ ID NO: 1359684 - protein, 9 aa, Homo Sapiens
PCEYKDLLT

SEQ ID NO: 1359685 - protein, 9 aa, Homo Sapiens
SPYEAENSW

SEQ ID NO: 1359686 - protein, 9 aa, Homo Sapiens
FCIQSRLPS

SEQ ID NO: 1359687 - protein, 9 aa, Homo Sapiens
PVLQGLGPS

SEQ ID NO: 1359688 - protein, 9 aa, Homo Sapiens
GANKVAELV

SEQ ID NO: 1359689 - protein, 9 aa, Homo Sapiens
LLFSSHAFG

SEQ ID NO: 1359690 - protein, 9 aa, Homo Sapiens
KRCLSVTSE

SEQ ID NO: 1359691 - protein, 9 aa, Homo Sapiens
KQSLLMLTL

SEQ ID NO: 1359692 - protein, 9 aa, Homo Sapiens
KRPDLNKKT

SEQ ID NO: 1359693 - protein, 9 aa, Homo Sapiens
HAPWKNGSL

SEQ ID NO: 1359694 - protein, 9 aa, Homo Sapiens
HGYYSTTET

SEQ ID NO: 1359695 - protein, 9 aa, Homo Sapiens
DGKTMTNDY

SEQ ID NO: 1359696 - protein, 9 aa, Homo Sapiens
ILKSKKNFC

SEQ ID NO: 1359697 - protein, 9 aa, Homo Sapiens
KIIHTIEKP

SEQ ID NO: 1359698 - protein, 9 aa, Homo Sapiens
DVLKLQGLN

SEQ ID NO: 1359699 - protein, 9 aa, Homo Sapiens
LLFFGLWHL

SEQ ID NO: 1359700 - protein, 9 aa, Homo Sapiens
KLLMEADEM

SEQ ID NO: 1359701 - protein, 9 aa, Homo Sapiens
PGELFDEPM

SEQ ID NO: 1359702 - protein, 9 aa, Homo Sapiens
LGMVTQEGT

SEQ ID NO: 1359703 - protein, 9 aa, Homo Sapiens
IEARPCSPI

SEQ ID NO: 1359704 - protein, 9 aa, Homo Sapiens
GNFTGKFCI

SEQ ID NO: 1359705 - protein, 9 aa, Homo Sapiens
TKHPNIKMV

SEQ ID NO: 1359706 - protein, 9 aa, Homo Sapiens
GMIFLIAVS

SEQ ID NO: 1359707 - protein, 9 aa, Homo Sapiens
NQSFPYQSI

SEQ ID NO: 1359708 - protein, 9 aa, Homo Sapiens
DSRLCSQVK

SEQ ID NO: 1359709 - protein, 9 aa, Homo Sapiens
GNMAFAEAD

SEQ ID NO: 1359710 - protein, 9 aa, Homo Sapiens
VLDGTSSKD

SEQ ID NO: 1359711 - protein, 9 aa, Homo Sapiens
SPYSDAEDH

SEQ ID NO: 1359712 - protein, 9 aa, Homo Sapiens
TDSEVRCFG

SEQ ID NO: 1359713 - protein, 9 aa, Homo Sapiens
HWPPKVLGL

SEQ ID NO: 1359714 - protein, 9 aa, Homo Sapiens
HKVIENIRD

SEQ ID NO: 1359715 - protein, 9 aa, Homo Sapiens
QSRWNYRCP

SEQ ID NO: 1359716 - protein, 9 aa, Homo Sapiens
WSKGDVHKA

SEQ ID NO: 1359717 - protein, 9 aa, Homo Sapiens
CTRLSGYIK

SEQ ID NO: 1359718 - protein, 9 aa, Homo Sapiens
DLLTKMSGK

SEQ ID NO: 1359719 - protein, 9 aa, Homo Sapiens
LRILKCSYP

SEQ ID NO: 1359720 - protein, 9 aa, Homo Sapiens
LSTSLQSSQ

SEQ ID NO: 1359721 - protein, 9 aa, Homo Sapiens
QIEIKKRSP

SEQ ID NO: 1359722 - protein, 9 aa, Homo Sapiens
DHALAQAIR

SEQ ID NO: 1359723 - protein, 9 aa, Homo Sapiens
AQRTVTIEN

SEQ ID NO: 1359724 - protein, 9 aa, Homo Sapiens
ASASPLASK

SEQ ID NO: 1359725 - protein, 9 aa, Homo Sapiens
ILTPVVNHL

SEQ ID NO: 1359726 - protein, 9 aa, Homo Sapiens
LYLCLCGAE

SEQ ID NO: 1359727 - protein, 9 aa, Homo Sapiens
FAITNIKLA

SEQ ID NO: 1359728 - protein, 9 aa, Homo Sapiens
RNWDLLRTL

SEQ ID NO: 1359729 - protein, 9 aa, Homo Sapiens
SCQDLCDRK

SEQ ID NO: 1359730 - protein, 9 aa, Homo Sapiens
CNGRSFSVW

SEQ ID NO: 1359731 - protein, 9 aa, Homo Sapiens
YKEWNPELI

SEQ ID NO: 1359732 - protein, 9 aa, Homo Sapiens
SLLMLTLQD

SEQ ID NO: 1359733 - protein, 9 aa, Homo Sapiens
KVNNRDSIK

SEQ ID NO: 1359734 - protein, 9 aa, Homo Sapiens
INTEEKPYK

SEQ ID NO: 1359735 - protein, 9 aa, Homo Sapiens
LCPNLNYLS

SEQ ID NO: 1359736 - protein, 9 aa, Homo Sapiens
GPQSGLPEA

SEQ ID NO: 1359737 - protein, 9 aa, Homo Sapiens
ELWKKQFKY

SEQ ID NO: 1359738 - protein, 9 aa, Homo Sapiens
HPMLVPYDT

SEQ ID NO: 1359739 - protein, 9 aa, Homo Sapiens
QRFLVALIS

SEQ ID NO: 1359740 - protein, 9 aa, Homo Sapiens
GFGPQYEIT

SEQ ID NO: 1359741 - protein, 9 aa, Homo Sapiens
GEDGTVMWF

SEQ ID NO: 1359742 - protein, 9 aa, Homo Sapiens
NAMLATVEH

SEQ ID NO: 1359743 - protein, 9 aa, Homo Sapiens
WLGLFDALT

SEQ ID NO: 1359744 - protein, 9 aa, Homo Sapiens
PQVALQSLD

SEQ ID NO: 1359745 - protein, 9 aa, Homo Sapiens
FNNPATAAT

SEQ ID NO: 1359746 - protein, 9 aa, Homo Sapiens
TKNRLLGTF

SEQ ID NO: 1359747 - protein, 9 aa, Homo Sapiens
RRERDEKKK

SEQ ID NO: 1359748 - protein, 9 aa, Homo Sapiens
WFQVLGAEC

SEQ ID NO: 1359749 - protein, 9 aa, Homo Sapiens
LSVAESSYY

SEQ ID NO: 1359750 - protein, 9 aa, Homo Sapiens
NYQDGVLDP

SEQ ID NO: 1359751 - protein, 9 aa, Homo Sapiens
CACTGRDRR

SEQ ID NO: 1359752 - protein, 9 aa, Homo Sapiens
GVLSSSPAF

SEQ ID NO: 1359753 - protein, 9 aa, Homo Sapiens
DPHPDRGIT

SEQ ID NO: 1359754 - protein, 9 aa, Homo Sapiens
IVWNVRCTL

SEQ ID NO: 1359755 - protein, 9 aa, Homo Sapiens
AEHCIPFLT

SEQ ID NO: 1359756 - protein, 9 aa, Homo Sapiens
DYRLPTKND

SEQ ID NO: 1359757 - protein, 9 aa, Homo Sapiens
DWVRLEHVY

SEQ ID NO: 1359758 - protein, 9 aa, Homo Sapiens
TLCLHLQVP

SEQ ID NO: 1359759 - protein, 9 aa, Homo Sapiens
STPKAKSTR

SEQ ID NO: 1359760 - protein, 9 aa, Homo Sapiens
NDNPPVVLF

SEQ ID NO: 1359761 - protein, 9 aa, Homo Sapiens
YTIRSPVLF

SEQ ID NO: 1359762 - protein, 9 aa, Homo Sapiens
LAKSYNQQR

SEQ ID NO: 1359763 - protein, 9 aa, Homo Sapiens
SHPQVALQS

SEQ ID NO: 1359764 - protein, 9 aa, Homo Sapiens
VAESSYYLE

SEQ ID NO: 1359765 - protein, 9 aa, Homo Sapiens
NHCPGDLIE

SEQ ID NO: 1359766 - protein, 9 aa, Homo Sapiens
FNLFHLVHA

SEQ ID NO: 1359767 - protein, 9 aa, Homo Sapiens
QIAPVYAAS

SEQ ID NO: 1359768 - protein, 9 aa, Homo Sapiens
SKEQARAVQ

SEQ ID NO: 1359769 - protein, 9 aa, Homo Sapiens
QGRRESTQT

SEQ ID NO: 1359770 - protein, 9 aa, Homo Sapiens
NDNMEQNEQ

SEQ ID NO: 1359771 - protein, 9 aa, Homo Sapiens
TLSRNKCQT

SEQ ID NO: 1359772 - protein, 9 aa, Homo Sapiens
RERDEKKKC

SEQ ID NO: 1359773 - protein, 9 aa, Homo Sapiens
TLGDKVNSL

SEQ ID NO: 1359774 - protein, 9 aa, Homo Sapiens
ESSKEQARA

SEQ ID NO: 1359775 - protein, 9 aa, Homo Sapiens
AANLLFGYK

SEQ ID NO: 1359776 - protein, 9 aa, Homo Sapiens
KNMQQHFEF

SEQ ID NO: 1359777 - protein, 9 aa, Homo Sapiens
ESEQGLDYL

SEQ ID NO: 1359778 - protein, 9 aa, Homo Sapiens
LLSAQPHCQ

SEQ ID NO: 1359779 - protein, 9 aa, Homo Sapiens
EDNVAFLIT

SEQ ID NO: 1359780 - protein, 9 aa, Homo Sapiens
LGRYFSHAT

SEQ ID NO: 1359781 - protein, 9 aa, Homo Sapiens
DISGCTPIH

SEQ ID NO: 1359782 - protein, 9 aa, Homo Sapiens
GAAQPAQAW

SEQ ID NO: 1359783 - protein, 9 aa, Homo Sapiens
DSVDLEEEA

SEQ ID NO: 1359784 - protein, 9 aa, Homo Sapiens
QEELHELEE

SEQ ID NO: 1359785 - protein, 9 aa, Homo Sapiens
LQDNQSLAE

SEQ ID NO: 1359786 - protein, 9 aa, Homo Sapiens
FFNLFHLVH

SEQ ID NO: 1359787 - protein, 9 aa, Homo Sapiens
THTVERPYE

SEQ ID NO: 1359788 - protein, 9 aa, Homo Sapiens
DVQPGLFSA

SEQ ID NO: 1359789 - protein, 9 aa, Homo Sapiens
KLCETTVIL

SEQ ID NO: 1359790 - protein, 9 aa, Homo Sapiens
LNSLQLHCL

SEQ ID NO: 1359791 - protein, 9 aa, Homo Sapiens
TIENNTDIV

SEQ ID NO: 1359792 - protein, 9 aa, Homo Sapiens
YFSHATALE

SEQ ID NO: 1359793 - protein, 9 aa, Homo Sapiens
SVYTLSQEK

SEQ ID NO: 1359794 - protein, 9 aa, Homo Sapiens
RYEIVDTLC

SEQ ID NO: 1359795 - protein, 9 aa, Homo Sapiens
FYYFAKHLW

SEQ ID NO: 1359796 - protein, 9 aa, Homo Sapiens
VNNRDSIKN

SEQ ID NO: 1359797 - protein, 9 aa, Homo Sapiens
LVLVSGEVY

SEQ ID NO: 1359798 - protein, 9 aa, Homo Sapiens
AVAKYALFL

SEQ ID NO: 1359799 - protein, 9 aa, Homo Sapiens
SWDLKDAQK

SEQ ID NO: 1359800 - protein, 9 aa, Homo Sapiens
SLDSSYVER

SEQ ID NO: 1359801 - protein, 9 aa, Homo Sapiens
GSVKAPSPR

SEQ ID NO: 1359802 - protein, 9 aa, Homo Sapiens
LCKIKEKTV

SEQ ID NO: 1359803 - protein, 9 aa, Homo Sapiens
VENKVDLDG

SEQ ID NO: 1359804 - protein, 9 aa, Homo Sapiens
AMKDKLLCQ

SEQ ID NO: 1359805 - protein, 9 aa, Homo Sapiens
VCACTGRDR

SEQ ID NO: 1359806 - protein, 9 aa, Homo Sapiens
EVNVEQDFI

SEQ ID NO: 1359807 - protein, 9 aa, Homo Sapiens
YVAGAHFNL

SEQ ID NO: 1359808 - protein, 9 aa, Homo Sapiens
LGLIIFCFG

SEQ ID NO: 1359809 - protein, 9 aa, Homo Sapiens
RLNLLMIRL

SEQ ID NO: 1359810 - protein, 9 aa, Homo Sapiens
KMEQKIIDF

SEQ ID NO: 1359811 - protein, 9 aa, Homo Sapiens
THGPILEQL

SEQ ID NO: 1359812 - protein, 9 aa, Homo Sapiens
GDVHKALIV

SEQ ID NO: 1359813 - protein, 9 aa, Homo Sapiens
YICLLVMGA

SEQ ID NO: 1359814 - protein, 9 aa, Homo Sapiens
DEEGKVGQG

SEQ ID NO: 1359815 - protein, 9 aa, Homo Sapiens
LALLLAFPH

SEQ ID NO: 1359816 - protein, 9 aa, Homo Sapiens
EAMVAFESL

SEQ ID NO: 1359817 - protein, 9 aa, Homo Sapiens
QLVGNASLA

SEQ ID NO: 1359818 - protein, 9 aa, Homo Sapiens
ALTCMYKIP

SEQ ID NO: 1359819 - protein, 9 aa, Homo Sapiens
LKYLYLGKN

SEQ ID NO: 1359820 - protein, 9 aa, Homo Sapiens
MHEIEKYQE

SEQ ID NO: 1359821 - protein, 9 aa, Homo Sapiens
KGKKRMGRR

SEQ ID NO: 1359822 - protein, 9 aa, Homo Sapiens
PIDFQIAPV

SEQ ID NO: 1359823 - protein, 9 aa, Homo Sapiens
KATRAYIQE

SEQ ID NO: 1359824 - protein, 9 aa, Homo Sapiens
KGQLEKETK

SEQ ID NO: 1359825 - protein, 9 aa, Homo Sapiens
KNAFFKDIT

SEQ ID NO: 1359826 - protein, 9 aa, Homo Sapiens
FLCPHLYTL

SEQ ID NO: 1359827 - protein, 9 aa, Homo Sapiens
MVAFESLDE

SEQ ID NO: 1359828 - protein, 9 aa, Homo Sapiens
LDQNFSPPS

SEQ ID NO: 1359829 - protein, 9 aa, Homo Sapiens
FHHIVFGAP

SEQ ID NO: 1359830 - protein, 9 aa, Homo Sapiens
APRQAALRV

SEQ ID NO: 1359831 - protein, 9 aa, Homo Sapiens
VEHAADEAL

SEQ ID NO: 1359832 - protein, 9 aa, Homo Sapiens
STSDFGGEW

SEQ ID NO: 1359833 - protein, 9 aa, Homo Sapiens
NGENGVVGP

SEQ ID NO: 1359834 - protein, 9 aa, Homo Sapiens
TFVKLENKS

SEQ ID NO: 1359835 - protein, 9 aa, Homo Sapiens
KEPWPLQGE

SEQ ID NO: 1359836 - protein, 9 aa, Homo Sapiens
HEIEKYQEV

SEQ ID NO: 1359837 - protein, 9 aa, Homo Sapiens
QLHCLQLRI

SEQ ID NO: 1359838 - protein, 9 aa, Homo Sapiens
AGGCSVSHH

SEQ ID NO: 1359839 - protein, 9 aa, Homo Sapiens
THVREHSLI

SEQ ID NO: 1359840 - protein, 9 aa, Homo Sapiens
HIVSHLRIH

SEQ ID NO: 1359841 - protein, 9 aa, Homo Sapiens
VVLLHTDHL

SEQ ID NO: 1359842 - protein, 9 aa, Homo Sapiens
LKLYFLGLE

SEQ ID NO: 1359843 - protein, 9 aa, Homo Sapiens
EAFESLTKL

SEQ ID NO: 1359844 - protein, 9 aa, Homo Sapiens
QEIAVEHLR

SEQ ID NO: 1359845 - protein, 9 aa, Homo Sapiens
FKEEISNIT

SEQ ID NO: 1359846 - protein, 9 aa, Homo Sapiens
CDQACVIIV

SEQ ID NO: 1359847 - protein, 9 aa, Homo Sapiens
CIEALVRTV

SEQ ID NO: 1359848 - protein, 9 aa, Homo Sapiens
SVSKAERKA

SEQ ID NO: 1359849 - protein, 9 aa, Homo Sapiens
NRLLGTFFR

SEQ ID NO: 1359850 - protein, 9 aa, Homo Sapiens
DQNFSPPSG

SEQ ID NO: 1359851 - protein, 9 aa, Homo Sapiens
CGHYEQRFR

SEQ ID NO: 1359852 - protein, 9 aa, Homo Sapiens
GTLTMNIMT

SEQ ID NO: 1359853 - protein, 9 aa, Homo Sapiens
LPENLTELS

SEQ ID NO: 1359854 - protein, 9 aa, Homo Sapiens
LLQGSPQRI

SEQ ID NO: 1359855 - protein, 9 aa, Homo Sapiens
EPIDFQIAP

SEQ ID NO: 1359856 - protein, 9 aa, Homo Sapiens
FQFWQYGEC

SEQ ID NO: 1359857 - protein, 9 aa, Homo Sapiens
YKDLLTKMS

SEQ ID NO: 1359858 - protein, 9 aa, Homo Sapiens
QDGSPSLRL

SEQ ID NO: 1359859 - protein, 9 aa, Homo Sapiens
DHLMPDPSK

SEQ ID NO: 1359860 - protein, 9 aa, Homo Sapiens
DLALRCLVK

SEQ ID NO: 1359861 - protein, 9 aa, Homo Sapiens
HGFPELWYS

SEQ ID NO: 1359862 - protein, 9 aa, Homo Sapiens
GGPGGKAVG

SEQ ID NO: 1359863 - protein, 9 aa, Homo Sapiens
QYMSEALGV

SEQ ID NO: 1359864 - protein, 9 aa, Homo Sapiens
YQDDELWKK

SEQ ID NO: 1359865 - protein, 9 aa, Homo Sapiens
YHNGFCMFD

SEQ ID NO: 1359866 - protein, 9 aa, Homo Sapiens
SIHSYKEGT

SEQ ID NO: 1359867 - protein, 9 aa, Homo Sapiens
LANMVCSDS

SEQ ID NO: 1359868 - protein, 9 aa, Homo Sapiens
VNFQKIIDK

SEQ ID NO: 1359869 - protein, 9 aa, Homo Sapiens
DECASNHCQ

SEQ ID NO: 1359870 - protein, 9 aa, Homo Sapiens
HELEEETGN

SEQ ID NO: 1359871 - protein, 9 aa, Homo Sapiens
CEGAFGKVV

SEQ ID NO: 1359872 - protein, 9 aa, Homo Sapiens
LQWDPKGEM

SEQ ID NO: 1359873 - protein, 9 aa, Homo Sapiens
NHKNMQQHF

SEQ ID NO: 1359874 - protein, 9 aa, Homo Sapiens
LLPVVIGGL

SEQ ID NO: 1359875 - protein, 9 aa, Homo Sapiens
MLISLLNYQ

SEQ ID NO: 1359876 - protein, 9 aa, Homo Sapiens
INMLSEQSH

SEQ ID NO: 1359877 - protein, 9 aa, Homo Sapiens
YEIVDTLCE

SEQ ID NO: 1359878 - protein, 9 aa, Homo Sapiens
AYRCSDCKK

SEQ ID NO: 1359879 - protein, 9 aa, Homo Sapiens
TLTQLKCLA

SEQ ID NO: 1359880 - protein, 9 aa, Homo Sapiens
HGDHAVLCV

SEQ ID NO: 1359881 - protein, 9 aa, Homo Sapiens
SHHNDHWFS

SEQ ID NO: 1359882 - protein, 9 aa, Homo Sapiens
ADQICGFHI

SEQ ID NO: 1359883 - protein, 9 aa, Homo Sapiens
LEALQEENR

SEQ ID NO: 1359884 - protein, 9 aa, Homo Sapiens
KHSVQIPVF

SEQ ID NO: 1359885 - protein, 9 aa, Homo Sapiens
DGREPGDML

SEQ ID NO: 1359886 - protein, 9 aa, Homo Sapiens
LYWVLEMDA

SEQ ID NO: 1359887 - protein, 9 aa, Homo Sapiens
YVNMSNHYR

SEQ ID NO: 1359888 - protein, 9 aa, Homo Sapiens
DAVSYKAQI

SEQ ID NO: 1359889 - protein, 9 aa, Homo Sapiens
DSTSQQLTQ

SEQ ID NO: 1359890 - protein, 9 aa, Homo Sapiens
IFLMSILMA

SEQ ID NO: 1359891 - protein, 9 aa, Homo Sapiens
LNKLLKTIR

SEQ ID NO: 1359892 - protein, 9 aa, Homo Sapiens
DQACVIIVG

SEQ ID NO: 1359893 - protein, 9 aa, Homo Sapiens
LQSSQEVQV

SEQ ID NO: 1359894 - protein, 9 aa, Homo Sapiens
KCRTPLDFS

SEQ ID NO: 1359895 - protein, 9 aa, Homo Sapiens
LPGSESSLK

SEQ ID NO: 1359896 - protein, 9 aa, Homo Sapiens
LIAKDWVFT

SEQ ID NO: 1359897 - protein, 9 aa, Homo Sapiens
LREVVQEKK

SEQ ID NO: 1359898 - protein, 9 aa, Homo Sapiens
NVNHAVLAV

SEQ ID NO: 1359899 - protein, 9 aa, Homo Sapiens
EVELLDQPE

SEQ ID NO: 1359900 - protein, 9 aa, Homo Sapiens
TGAQVQQHG

SEQ ID NO: 1359901 - protein, 9 aa, Homo Sapiens
VERVLFSYG

SEQ ID NO: 1359902 - protein, 9 aa, Homo Sapiens
RSTRTEEKL

SEQ ID NO: 1359903 - protein, 9 aa, Homo Sapiens
DYSQKDTSK

SEQ ID NO: 1359904 - protein, 9 aa, Homo Sapiens
AFPHGGENR

SEQ ID NO: 1359905 - protein, 9 aa, Homo Sapiens
HLIYSLRNK

SEQ ID NO: 1359906 - protein, 9 aa, Homo Sapiens
QEGLAAAKK

SEQ ID NO: 1359907 - protein, 9 aa, Homo Sapiens
QDVQRIIVA

SEQ ID NO: 1359908 - protein, 9 aa, Homo Sapiens
MALGGFLYK

SEQ ID NO: 1359909 - protein, 9 aa, Homo Sapiens
VVTDLKVAT

SEQ ID NO: 1359910 - protein, 9 aa, Homo Sapiens
RKDSVDLEE

SEQ ID NO: 1359911 - protein, 9 aa, Homo Sapiens
ARIKRCLSV

SEQ ID NO: 1359912 - protein, 9 aa, Homo Sapiens
APPTTSFQA

SEQ ID NO: 1359913 - protein, 9 aa, Homo Sapiens
LKFLLTFLV

SEQ ID NO: 1359914 - protein, 9 aa, Homo Sapiens
AQQLQEGQR

SEQ ID NO: 1359915 - protein, 9 aa, Homo Sapiens
ALGLEVEDN

SEQ ID NO: 1359916 - protein, 9 aa, Homo Sapiens
DQHKGLYCD

SEQ ID NO: 1359917 - protein, 9 aa, Homo Sapiens
EGLGTTTDR

SEQ ID NO: 1359918 - protein, 9 aa, Homo Sapiens
FLIYTNENP

SEQ ID NO: 1359919 - protein, 9 aa, Homo Sapiens
LTSVGDAIQ

SEQ ID NO: 1359920 - protein, 9 aa, Homo Sapiens
RIVWNVRCT

SEQ ID NO: 1359921 - protein, 9 aa, Homo Sapiens
EYVNPAFER

SEQ ID NO: 1359922 - protein, 9 aa, Homo Sapiens
GLCWFQVLG

SEQ ID NO: 1359923 - protein, 9 aa, Homo Sapiens
DTLDNRIRT

SEQ ID NO: 1359924 - protein, 9 aa, Homo Sapiens
GDITAILKS

SEQ ID NO: 1359925 - protein, 9 aa, Homo Sapiens
LLLEQLFLP

SEQ ID NO: 1359926 - protein, 9 aa, Homo Sapiens
KWMDRYEIY

SEQ ID NO: 1359927 - protein, 9 aa, Homo Sapiens
EGKVGQGNH

SEQ ID NO: 1359928 - protein, 9 aa, Homo Sapiens
SGADRYTIR

SEQ ID NO: 1359929 - protein, 9 aa, Homo Sapiens
YKLCETTVI

SEQ ID NO: 1359930 - protein, 9 aa, Homo Sapiens
HSSVPLGRY

SEQ ID NO: 1359931 - protein, 9 aa, Homo Sapiens
VCIWDCRKG

SEQ ID NO: 1359932 - protein, 9 aa, Homo Sapiens
EQYKAHVSG

SEQ ID NO: 1359933 - protein, 9 aa, Homo Sapiens
TAMRESGTH

SEQ ID NO: 1359934 - protein, 9 aa, Homo Sapiens
DFEDLFKQK

SEQ ID NO: 1359935 - protein, 9 aa, Homo Sapiens
MGALCLYFS

SEQ ID NO: 1359936 - protein, 9 aa, Homo Sapiens
KAVCDRVAI

SEQ ID NO: 1359937 - protein, 9 aa, Homo Sapiens
ITLTQLKCL

SEQ ID NO: 1359938 - protein, 9 aa, Homo Sapiens
YTTNAFSGE

SEQ ID NO: 1359939 - protein, 9 aa, Homo Sapiens
GFPELWYSW

SEQ ID NO: 1359940 - protein, 9 aa, Homo Sapiens
ADLRLKVRK

SEQ ID NO: 1359941 - protein, 9 aa, Homo Sapiens
AERNNTLLL

SEQ ID NO: 1359942 - protein, 9 aa, Homo Sapiens
GHYQFGMTK

SEQ ID NO: 1359943 - protein, 9 aa, Homo Sapiens
LTVCPIINW

SEQ ID NO: 1359944 - protein, 9 aa, Homo Sapiens
RGKLTDQCY

SEQ ID NO: 1359945 - protein, 9 aa, Homo Sapiens
LKAEIKALN

SEQ ID NO: 1359946 - protein, 9 aa, Homo Sapiens
NSCTFALTS

SEQ ID NO: 1359947 - protein, 9 aa, Homo Sapiens
QQRIRQNVQ

SEQ ID NO: 1359948 - protein, 9 aa, Homo Sapiens
VHAPWKNGS

SEQ ID NO: 1359949 - protein, 9 aa, Homo Sapiens
IIVFVESLL

SEQ ID NO: 1359950 - protein, 9 aa, Homo Sapiens
HLYTLTPGP

SEQ ID NO: 1359951 - protein, 9 aa, Homo Sapiens
SLRLGLLKL

SEQ ID NO: 1359952 - protein, 9 aa, Homo Sapiens
PDRGITFNL

SEQ ID NO: 1359953 - protein, 9 aa, Homo Sapiens
LKLLCAADV

SEQ ID NO: 1359954 - protein, 9 aa, Homo Sapiens
LVAKFSQVA

SEQ ID NO: 1359955 - protein, 9 aa, Homo Sapiens
VGMVVVTDL

SEQ ID NO: 1359956 - protein, 9 aa, Homo Sapiens
TKEQYELVN

SEQ ID NO: 1359957 - protein, 9 aa, Homo Sapiens
EDSTIKSSQ

SEQ ID NO: 1359958 - protein, 9 aa, Homo Sapiens
SKGGGNHPM

SEQ ID NO: 1359959 - protein, 9 aa, Homo Sapiens
LATHLAALR

SEQ ID NO: 1359960 - protein, 9 aa, Homo Sapiens
TVYTPNTNI

SEQ ID NO: 1359961 - protein, 9 aa, Homo Sapiens
FSIDGQIFL

SEQ ID NO: 1359962 - protein, 9 aa, Homo Sapiens
LLAADFLGK

SEQ ID NO: 1359963 - protein, 9 aa, Homo Sapiens
GSPGSPPLG

SEQ ID NO: 1359964 - protein, 9 aa, Homo Sapiens
CDPHPDRGI

SEQ ID NO: 1359965 - protein, 9 aa, Homo Sapiens
HQKHGEPVA

SEQ ID NO: 1359966 - protein, 9 aa, Homo Sapiens
GSNTVKTPT

SEQ ID NO: 1359967 - protein, 9 aa, Homo Sapiens
ASPLASKSS

SEQ ID NO: 1359968 - protein, 9 aa, Homo Sapiens
IEFWLACQD

SEQ ID NO: 1359969 - protein, 9 aa, Homo Sapiens
CLEELIMTN

SEQ ID NO: 1359970 - protein, 9 aa, Homo Sapiens
MDNWIFGET

SEQ ID NO: 1359971 - protein, 9 aa, Homo Sapiens
KETSVTSPL

SEQ ID NO: 1359972 - protein, 9 aa, Homo Sapiens
EVIMDSHGV

SEQ ID NO: 1359973 - protein, 9 aa, Homo Sapiens
ESTNNTGNI

SEQ ID NO: 1359974 - protein, 9 aa, Homo Sapiens
VEPIDFQIA

SEQ ID NO: 1359975 - protein, 9 aa, Homo Sapiens
TCHVNLKDG

SEQ ID NO: 1359976 - protein, 9 aa, Homo Sapiens
RLKFKREVH

SEQ ID NO: 1359977 - protein, 9 aa, Homo Sapiens
IKQFKGVQG

SEQ ID NO: 1359978 - protein, 9 aa, Homo Sapiens
PGSPPLGFL

SEQ ID NO: 1359979 - protein, 9 aa, Homo Sapiens
SPSLRLGLL

SEQ ID NO: 1359980 - protein, 9 aa, Homo Sapiens
VYTPNTNIA

SEQ ID NO: 1359981 - protein, 9 aa, Homo Sapiens
LSPNNTIVT

SEQ ID NO: 1359982 - protein, 9 aa, Homo Sapiens
FVNQPNYTV

SEQ ID NO: 1359983 - protein, 9 aa, Homo Sapiens
TSSRPNLRV

SEQ ID NO: 1359984 - protein, 9 aa, Homo Sapiens
HSAPPTTSF

SEQ ID NO: 1359985 - protein, 9 aa, Homo Sapiens
VRIWTTKDE

SEQ ID NO: 1359986 - protein, 9 aa, Homo Sapiens
AIPDLTDHF

SEQ ID NO: 1359987 - protein, 9 aa, Homo Sapiens
PPWAAPSAT

SEQ ID NO: 1359988 - protein, 9 aa, Homo Sapiens
QVSFVKFEA

SEQ ID NO: 1359989 - protein, 9 aa, Homo Sapiens
GCRKAFNEK

SEQ ID NO: 1359990 - protein, 9 aa, Homo Sapiens
NSLQLHCLQ

SEQ ID NO: 1359991 - protein, 9 aa, Homo Sapiens
TGYSAPKVL

SEQ ID NO: 1359992 - protein, 9 aa, Homo Sapiens
LHLELTKCQ

SEQ ID NO: 1359993 - protein, 9 aa, Homo Sapiens
GYAGFGPQY

SEQ ID NO: 1359994 - protein, 9 aa, Homo Sapiens
LENQESLVS

SEQ ID NO: 1359995 - protein, 9 aa, Homo Sapiens
VQITTNQKT

SEQ ID NO: 1359996 - protein, 9 aa, Homo Sapiens
LHCLQLRIA

SEQ ID NO: 1359997 - protein, 9 aa, Homo Sapiens
KNGNPSASE

SEQ ID NO: 1359998 - protein, 9 aa, Homo Sapiens
MLSEQSHQQ

SEQ ID NO: 1359999 - protein, 9 aa, Homo Sapiens
LLVMGALCL

SEQ ID NO: 1360000 - protein, 9 aa, Homo Sapiens
ENLQNVSLP

SEQ ID NO: 1360001 - protein, 9 aa, Homo Sapiens
DKIHSIAWC

SEQ ID NO: 1360002 - protein, 9 aa, Homo Sapiens
MGCQDVHAA

SEQ ID NO: 1360003 - protein, 9 aa, Homo Sapiens
LDCILPHQS

SEQ ID NO: 1360004 - protein, 9 aa, Homo Sapiens
LKTLRILKC

SEQ ID NO: 1360005 - protein, 9 aa, Homo Sapiens
GAALDKYAN

SEQ ID NO: 1360006 - protein, 9 aa, Homo Sapiens
PHGYYSTTE

SEQ ID NO: 1360007 - protein, 9 aa, Homo Sapiens
VPLGVPASA

SEQ ID NO: 1360008 - protein, 9 aa, Homo Sapiens
SQGRRESTQ

SEQ ID NO: 1360009 - protein, 9 aa, Homo Sapiens
VATTLPVLQ

SEQ ID NO: 1360010 - protein, 9 aa, Homo Sapiens
ISVSSKRSN

SEQ ID NO: 1360011 - protein, 9 aa, Homo Sapiens
VLFNSHESA

SEQ ID NO: 1360012 - protein, 9 aa, Homo Sapiens
TYSFLTAVH

SEQ ID NO: 1360013 - protein, 9 aa, Homo Sapiens
PSAAQEVPG

SEQ ID NO: 1360014 - protein, 9 aa, Homo Sapiens
SMGLMEGLG

SEQ ID NO: 1360015 - protein, 9 aa, Homo Sapiens
NTISRVPAG

SEQ ID NO: 1360016 - protein, 9 aa, Homo Sapiens
ERMKEKDFT

SEQ ID NO: 1360017 - protein, 9 aa, Homo Sapiens
YIRTSGGYF

SEQ ID NO: 1360018 - protein, 9 aa, Homo Sapiens
SVAKSGSES

SEQ ID NO: 1360019 - protein, 9 aa, Homo Sapiens
STCVDDIHQ

SEQ ID NO: 1360020 - protein, 9 aa, Homo Sapiens
AADFLGKSD

SEQ ID NO: 1360021 - protein, 9 aa, Homo Sapiens
LFWFDSQEI

SEQ ID NO: 1360022 - protein, 9 aa, Homo Sapiens
TSLPGSESS

SEQ ID NO: 1360023 - protein, 9 aa, Homo Sapiens
TMVLDDFAN

SEQ ID NO: 1360024 - protein, 9 aa, Homo Sapiens
QFSIDGQIF

SEQ ID NO: 1360025 - protein, 9 aa, Homo Sapiens
VKQYMSEAL

SEQ ID NO: 1360026 - protein, 9 aa, Homo Sapiens
QFGMTKTER

SEQ ID NO: 1360027 - protein, 9 aa, Homo Sapiens
AAQEVPGPA

SEQ ID NO: 1360028 - protein, 9 aa, Homo Sapiens
GGGNHPMLV

SEQ ID NO: 1360029 - protein, 9 aa, Homo Sapiens
KLDEVEDFL

SEQ ID NO: 1360030 - protein, 9 aa, Homo Sapiens
IHRSTRTEE

SEQ ID NO: 1360031 - protein, 9 aa, Homo Sapiens
MCHGKPGTP

SEQ ID NO: 1360032 - protein, 9 aa, Homo Sapiens
NCVNIHMMR

SEQ ID NO: 1360033 - protein, 9 aa, Homo Sapiens
QTIINHHIP

SEQ ID NO: 1360034 - protein, 9 aa, Homo Sapiens
EARPCSPIS

SEQ ID NO: 1360035 - protein, 9 aa, Homo Sapiens
PLQPLVSFP

SEQ ID NO: 1360036 - protein, 9 aa, Homo Sapiens
KDEQEMIAS

SEQ ID NO: 1360037 - protein, 9 aa, Homo Sapiens
LPNPPTESA

SEQ ID NO: 1360038 - protein, 9 aa, Homo Sapiens
IEVKDVNDN

SEQ ID NO: 1360039 - protein, 9 aa, Homo Sapiens
LLEKGYIKD

SEQ ID NO: 1360040 - protein, 9 aa, Homo Sapiens
YHIDLFMVE

SEQ ID NO: 1360041 - protein, 9 aa, Homo Sapiens
SQEQRAKMP

SEQ ID NO: 1360042 - protein, 9 aa, Homo Sapiens
RRISKCNDL

SEQ ID NO: 1360043 - protein, 9 aa, Homo Sapiens
KDLGLEPLE

SEQ ID NO: 1360044 - protein, 9 aa, Homo Sapiens
SFYYSVLLQ

SEQ ID NO: 1360045 - protein, 9 aa, Homo Sapiens
ATAATNSQR

SEQ ID NO: 1360046 - protein, 9 aa, Homo Sapiens
PTCRDFAKE

SEQ ID NO: 1360047 - protein, 9 aa, Homo Sapiens
HNVSLLAIR

SEQ ID NO: 1360048 - protein, 9 aa, Homo Sapiens
AFCLEELIM

SEQ ID NO: 1360049 - protein, 9 aa, Homo Sapiens
LYTEQLLSV

SEQ ID NO: 1360050 - protein, 9 aa, Homo Sapiens
ICVCVHVSA

SEQ ID NO: 1360051 - protein, 9 aa, Homo Sapiens
GRRLQGTDP

SEQ ID NO: 1360052 - protein, 9 aa, Homo Sapiens
QQLQEGQRC

SEQ ID NO: 1360053 - protein, 9 aa, Homo Sapiens
MQMWLNASR

SEQ ID NO: 1360054 - protein, 9 aa, Homo Sapiens
LKDEQEMIA

SEQ ID NO: 1360055 - protein, 9 aa, Homo Sapiens
TAVYTIMDN

SEQ ID NO: 1360056 - protein, 9 aa, Homo Sapiens
FHEPMYFFL

SEQ ID NO: 1360057 - protein, 9 aa, Homo Sapiens
KLKVLHPLP

SEQ ID NO: 1360058 - protein, 9 aa, Homo Sapiens
GEIYNHKNM

SEQ ID NO: 1360059 - protein, 9 aa, Homo Sapiens
LEKSYKPQI

SEQ ID NO: 1360060 - protein, 9 aa, Homo Sapiens
AGDWRPDMS

SEQ ID NO: 1360061 - protein, 9 aa, Homo Sapiens
VLAIVLPSI

SEQ ID NO: 1360062 - protein, 9 aa, Homo Sapiens
ERGIIILSY

SEQ ID NO: 1360063 - protein, 9 aa, Homo Sapiens
SEGFHKAGI

SEQ ID NO: 1360064 - protein, 9 aa, Homo Sapiens
QGSPQRIAS

SEQ ID NO: 1360065 - protein, 9 aa, Homo Sapiens
RNNTLLLLE

SEQ ID NO: 1360066 - protein, 9 aa, Homo Sapiens
VVSKNMYSQ

SEQ ID NO: 1360067 - protein, 9 aa, Homo Sapiens
MVERCCEIL

SEQ ID NO: 1360068 - protein, 9 aa, Homo Sapiens
QIIVMLQDN

SEQ ID NO: 1360069 - protein, 9 aa, Homo Sapiens
CILPHQSPA

SEQ ID NO: 1360070 - protein, 9 aa, Homo Sapiens
QEMIASPKI

SEQ ID NO: 1360071 - protein, 9 aa, Homo Sapiens
EYLPKNNNK

SEQ ID NO: 1360072 - protein, 9 aa, Homo Sapiens
MGRLNKLLK

SEQ ID NO: 1360073 - protein, 9 aa, Homo Sapiens
HTQMPKKVE

SEQ ID NO: 1360074 - protein, 9 aa, Homo Sapiens
PKGCDMFAG

SEQ ID NO: 1360075 - protein, 9 aa, Homo Sapiens
QPGSPERAA

SEQ ID NO: 1360076 - protein, 9 aa, Homo Sapiens
TLTKHKKIN

SEQ ID NO: 1360077 - protein, 9 aa, Homo Sapiens
SDSNSSEEG

SEQ ID NO: 1360078 - protein, 9 aa, Homo Sapiens
IKKRSPIST

SEQ ID NO: 1360079 - protein, 9 aa, Homo Sapiens
SGEYIPTVF

SEQ ID NO: 1360080 - protein, 9 aa, Homo Sapiens
CLCGAECFL

SEQ ID NO: 1360081 - protein, 9 aa, Homo Sapiens
GGCAILVAK

SEQ ID NO: 1360082 - protein, 9 aa, Homo Sapiens
SHGKFIARA

SEQ ID NO: 1360083 - protein, 9 aa, Homo Sapiens
DAEDHSIQQ

SEQ ID NO: 1360084 - protein, 9 aa, Homo Sapiens
LQGTDPGTF

SEQ ID NO: 1360085 - protein, 9 aa, Homo Sapiens
RRLQGTDPG

SEQ ID NO: 1360086 - protein, 9 aa, Homo Sapiens
MKEFLGHPH

SEQ ID NO: 1360087 - protein, 9 aa, Homo Sapiens
QQQKLERKI

SEQ ID NO: 1360088 - protein, 9 aa, Homo Sapiens
SDVIDGNQQ

SEQ ID NO: 1360089 - protein, 9 aa, Homo Sapiens
LIFLMSILM

SEQ ID NO: 1360090 - protein, 9 aa, Homo Sapiens
NKKTQSKHS

SEQ ID NO: 1360091 - protein, 9 aa, Homo Sapiens
GLKETSVTS

SEQ ID NO: 1360092 - protein, 9 aa, Homo Sapiens
INHHIPFNW

SEQ ID NO: 1360093 - protein, 9 aa, Homo Sapiens
RAKLIKNKV

SEQ ID NO: 1360094 - protein, 9 aa, Homo Sapiens
TSFQAPSPL

SEQ ID NO: 1360095 - protein, 9 aa, Homo Sapiens
FFVVEVSQK

SEQ ID NO: 1360096 - protein, 9 aa, Homo Sapiens
YVMDQELSR

SEQ ID NO: 1360097 - protein, 9 aa, Homo Sapiens
ELQDVQRII

SEQ ID NO: 1360098 - protein, 9 aa, Homo Sapiens
SVDLEEEAA

SEQ ID NO: 1360099 - protein, 9 aa, Homo Sapiens
QELSRRLSM

SEQ ID NO: 1360100 - protein, 9 aa, Homo Sapiens
YHEIGRCIS

SEQ ID NO: 1360101 - protein, 9 aa, Homo Sapiens
SDNVNHAVL

SEQ ID NO: 1360102 - protein, 9 aa, Homo Sapiens
ECEKRFCKK

SEQ ID NO: 1360103 - protein, 9 aa, Homo Sapiens
VLHWHIVDN

SEQ ID NO: 1360104 - protein, 9 aa, Homo Sapiens
NKCQTESCW

SEQ ID NO: 1360105 - protein, 9 aa, Homo Sapiens
IALGFILIS

SEQ ID NO: 1360106 - protein, 9 aa, Homo Sapiens
AYQIAKTAN

SEQ ID NO: 1360107 - protein, 9 aa, Homo Sapiens
KETVYNLIE

SEQ ID NO: 1360108 - protein, 9 aa, Homo Sapiens
EQLDATFST

SEQ ID NO: 1360109 - protein, 9 aa, Homo Sapiens
MAAFAFAGA

SEQ ID NO: 1360110 - protein, 9 aa, Homo Sapiens
RLLDIPCVI

SEQ ID NO: 1360111 - protein, 9 aa, Homo Sapiens
VRCFGGRSP

SEQ ID NO: 1360112 - protein, 9 aa, Homo Sapiens
RQLAVFKRN

SEQ ID NO: 1360113 - protein, 9 aa, Homo Sapiens
ELVNRAIAQ

SEQ ID NO: 1360114 - protein, 9 aa, Homo Sapiens
HGPILEQLQ

SEQ ID NO: 1360115 - protein, 9 aa, Homo Sapiens
CVDDIHQRF

SEQ ID NO: 1360116 - protein, 9 aa, Homo Sapiens
PVSICEDHQ

SEQ ID NO: 1360117 - protein, 9 aa, Homo Sapiens
MSAPGNALF

SEQ ID NO: 1360118 - protein, 9 aa, Homo Sapiens
KINDASSQE

SEQ ID NO: 1360119 - protein, 9 aa, Homo Sapiens
VKADVQKVK

SEQ ID NO: 1360120 - protein, 9 aa, Homo Sapiens
KDVKLLEEL

SEQ ID NO: 1360121 - protein, 9 aa, Homo Sapiens
RGSTRGWAL

SEQ ID NO: 1360122 - protein, 9 aa, Homo Sapiens
NQPLDQNFS

SEQ ID NO: 1360123 - protein, 9 aa, Homo Sapiens
KTKVSVQDQ

SEQ ID NO: 1360124 - protein, 9 aa, Homo Sapiens
EEFVKQYMS

SEQ ID NO: 1360125 - protein, 9 aa, Homo Sapiens
GKVFSRVYE

SEQ ID NO: 1360126 - protein, 9 aa, Homo Sapiens
IEVDRLKNR

SEQ ID NO: 1360127 - protein, 9 aa, Homo Sapiens
LLTEPLWRL

SEQ ID NO: 1360128 - protein, 9 aa, Homo Sapiens
ACSTNKPDG

SEQ ID NO: 1360129 - protein, 9 aa, Homo Sapiens
SYGIPQLSL

SEQ ID NO: 1360130 - protein, 9 aa, Homo Sapiens
LSTSDFGGE

SEQ ID NO: 1360131 - protein, 9 aa, Homo Sapiens
PRAAYGTAL

SEQ ID NO: 1360132 - protein, 9 aa, Homo Sapiens
AQKDNAEIR

SEQ ID NO: 1360133 - protein, 9 aa, Homo Sapiens
KAERNNTLL

SEQ ID NO: 1360134 - protein, 9 aa, Homo Sapiens
NLKQHLQIQ

SEQ ID NO: 1360135 - protein, 9 aa, Homo Sapiens
RRAEENIKS

SEQ ID NO: 1360136 - protein, 9 aa, Homo Sapiens
VRPALFKNP

SEQ ID NO: 1360137 - protein, 9 aa, Homo Sapiens
DLAVAKYAL

SEQ ID NO: 1360138 - protein, 9 aa, Homo Sapiens
CEYKDLLTK

SEQ ID NO: 1360139 - protein, 9 aa, Homo Sapiens
ILTITVVQR

SEQ ID NO: 1360140 - protein, 9 aa, Homo Sapiens
NKVVVNEDT

SEQ ID NO: 1360141 - protein, 9 aa, Homo Sapiens
GKGKKRMGR

SEQ ID NO: 1360142 - protein, 9 aa, Homo Sapiens
GHVKDSCNT

SEQ ID NO: 1360143 - protein, 9 aa, Homo Sapiens
RKEAEGTQE

SEQ ID NO: 1360144 - protein, 9 aa, Homo Sapiens
DDELWKKQF

SEQ ID NO: 1360145 - protein, 9 aa, Homo Sapiens
HPYPHSRYC

SEQ ID NO: 1360146 - protein, 9 aa, Homo Sapiens
HKKINTEEK

SEQ ID NO: 1360147 - protein, 9 aa, Homo Sapiens
PRVFRASSP

SEQ ID NO: 1360148 - protein, 9 aa, Homo Sapiens
NQEELHELE

SEQ ID NO: 1360149 - protein, 9 aa, Homo Sapiens
QLKCLADAQ

SEQ ID NO: 1360150 - protein, 9 aa, Homo Sapiens
EMIASPKIS

SEQ ID NO: 1360151 - protein, 9 aa, Homo Sapiens
YWSQESIIA

SEQ ID NO: 1360152 - protein, 9 aa, Homo Sapiens
LEQGKEPWP

SEQ ID NO: 1360153 - protein, 9 aa, Homo Sapiens
FSTTFKTQK

SEQ ID NO: 1360154 - protein, 9 aa, Homo Sapiens
DEAFESLTK

SEQ ID NO: 1360155 - protein, 9 aa, Homo Sapiens
TEASESAIP

SEQ ID NO: 1360156 - protein, 9 aa, Homo Sapiens
PQVLNQLSK

SEQ ID NO: 1360157 - protein, 9 aa, Homo Sapiens
FGEILTITV

SEQ ID NO: 1360158 - protein, 9 aa, Homo Sapiens
GGNHPMLVP

SEQ ID NO: 1360159 - protein, 9 aa, Homo Sapiens
IAAEHCIPF

SEQ ID NO: 1360160 - protein, 9 aa, Homo Sapiens
FNILTRPSG

SEQ ID NO: 1360161 - protein, 9 aa, Homo Sapiens
LERKSVTDC

SEQ ID NO: 1360162 - protein, 9 aa, Homo Sapiens
HEVIMDSHG

SEQ ID NO: 1360163 - protein, 9 aa, Homo Sapiens
GFCVFDSNA

SEQ ID NO: 1360164 - protein, 9 aa, Homo Sapiens
GAPVSAVYF

SEQ ID NO: 1360165 - protein, 9 aa, Homo Sapiens
MWFDTRIKT

SEQ ID NO: 1360166 - protein, 9 aa, Homo Sapiens
ITTIIAQNH

SEQ ID NO: 1360167 - protein, 9 aa, Homo Sapiens
FCTSHIFET

SEQ ID NO: 1360168 - protein, 9 aa, Homo Sapiens
TLQSVKEMV

SEQ ID NO: 1360169 - protein, 9 aa, Homo Sapiens
VELELKAQK

SEQ ID NO: 1360170 - protein, 9 aa, Homo Sapiens
CLHLQVPLQ

SEQ ID NO: 1360171 - protein, 9 aa, Homo Sapiens
AEENIKSVG

SEQ ID NO: 1360172 - protein, 9 aa, Homo Sapiens
ESHSHLSVP

SEQ ID NO: 1360173 - protein, 9 aa, Homo Sapiens
RFCKKTHLI

SEQ ID NO: 1360174 - protein, 9 aa, Homo Sapiens
VFLLAINQY

SEQ ID NO: 1360175 - protein, 9 aa, Homo Sapiens
IERMKEKDF

SEQ ID NO: 1360176 - protein, 9 aa, Homo Sapiens
ALIAKDWVF

SEQ ID NO: 1360177 - protein, 9 aa, Homo Sapiens
LLDEDAQAM

SEQ ID NO: 1360178 - protein, 9 aa, Homo Sapiens
QLDECASNH

SEQ ID NO: 1360179 - protein, 9 aa, Homo Sapiens
LALFNIGLL

SEQ ID NO: 1360180 - protein, 9 aa, Homo Sapiens
ESKEQNFYW

SEQ ID NO: 1360181 - protein, 9 aa, Homo Sapiens
ITKQATSSR

SEQ ID NO: 1360182 - protein, 9 aa, Homo Sapiens
ACTGRDRRT

SEQ ID NO: 1360183 - protein, 9 aa, Homo Sapiens
YSFLTAVHG

SEQ ID NO: 1360184 - protein, 9 aa, Homo Sapiens
YEDQRDFIS

SEQ ID NO: 1360185 - protein, 9 aa, Homo Sapiens
DTPDKFERT

SEQ ID NO: 1360186 - protein, 9 aa, Homo Sapiens
RIHPQPTSL

SEQ ID NO: 1360187 - protein, 9 aa, Homo Sapiens
REAFSTTFK

SEQ ID NO: 1360188 - protein, 9 aa, Homo Sapiens
YATYDVKVQ

SEQ ID NO: 1360189 - protein, 9 aa, Homo Sapiens
LQLGPQGGA

SEQ ID NO: 1360190 - protein, 9 aa, Homo Sapiens
LEMSNTLTN

SEQ ID NO: 1360191 - protein, 9 aa, Homo Sapiens
IERRPKLQI

SEQ ID NO: 1360192 - protein, 9 aa, Homo Sapiens
CEDHQMRNH

SEQ ID NO: 1360193 - protein, 9 aa, Homo Sapiens
QPLGYHIYV

SEQ ID NO: 1360194 - protein, 9 aa, Homo Sapiens
MTSTPKAKS

SEQ ID NO: 1360195 - protein, 9 aa, Homo Sapiens
DKKLRNESV

SEQ ID NO: 1360196 - protein, 9 aa, Homo Sapiens
HSCCLQCNG

SEQ ID NO: 1360197 - protein, 9 aa, Homo Sapiens
VTHRPLDRE

SEQ ID NO: 1360198 - protein, 9 aa, Homo Sapiens
LSSIQSTLS

SEQ ID NO: 1360199 - protein, 9 aa, Homo Sapiens
SKLVEVDTW

SEQ ID NO: 1360200 - protein, 9 aa, Homo Sapiens
LIKIKDLQE

SEQ ID NO: 1360201 - protein, 9 aa, Homo Sapiens
ENIKSVGGA

SEQ ID NO: 1360202 - protein, 9 aa, Homo Sapiens
IVQLVGNAS

SEQ ID NO: 1360203 - protein, 9 aa, Homo Sapiens
FYRQQEEIL

SEQ ID NO: 1360204 - protein, 9 aa, Homo Sapiens
FTDEEMEAL

SEQ ID NO: 1360205 - protein, 9 aa, Homo Sapiens
TVEKPYECT

SEQ ID NO: 1360206 - protein, 9 aa, Homo Sapiens
QLDCILPHQ

SEQ ID NO: 1360207 - protein, 9 aa, Homo Sapiens
LSAAPDPGC

SEQ ID NO: 1360208 - protein, 9 aa, Homo Sapiens
DGMKLGHSG

SEQ ID NO: 1360209 - protein, 9 aa, Homo Sapiens
FPDTQRQRK

SEQ ID NO: 1360210 - protein, 9 aa, Homo Sapiens
MWKNYSNFI

SEQ ID NO: 1360211 - protein, 9 aa, Homo Sapiens
CSVFGQAAS

SEQ ID NO: 1360212 - protein, 9 aa, Homo Sapiens
YEPKVKECK

SEQ ID NO: 1360213 - protein, 9 aa, Homo Sapiens
LLIKIKDLQ

SEQ ID NO: 1360214 - protein, 9 aa, Homo Sapiens
CDMFAGHAN

SEQ ID NO: 1360215 - protein, 9 aa, Homo Sapiens
NPPVVLFPQ

SEQ ID NO: 1360216 - protein, 9 aa, Homo Sapiens
EKRFCKKTH

SEQ ID NO: 1360217 - protein, 9 aa, Homo Sapiens
DEALDRINR

SEQ ID NO: 1360218 - protein, 9 aa, Homo Sapiens
LLTKMSGKH

SEQ ID NO: 1360219 - protein, 9 aa, Homo Sapiens
QGDGFPMAN

SEQ ID NO: 1360220 - protein, 9 aa, Homo Sapiens
SSTHGPILE

SEQ ID NO: 1360221 - protein, 9 aa, Homo Sapiens
LVGKYMQLM

SEQ ID NO: 1360222 - protein, 9 aa, Homo Sapiens
SICEDHQMR

SEQ ID NO: 1360223 - protein, 9 aa, Homo Sapiens
NLIEENRQL

SEQ ID NO: 1360224 - protein, 9 aa, Homo Sapiens
LGSNTVKTP

SEQ ID NO: 1360225 - protein, 9 aa, Homo Sapiens
RFESSKEQA

SEQ ID NO: 1360226 - protein, 9 aa, Homo Sapiens
DSSCVIQFM

SEQ ID NO: 1360227 - protein, 9 aa, Homo Sapiens
IAVEHLRIC

SEQ ID NO: 1360228 - protein, 9 aa, Homo Sapiens
TAAAMALAL

SEQ ID NO: 1360229 - protein, 9 aa, Homo Sapiens
DGIFNPSSG

SEQ ID NO: 1360230 - protein, 9 aa, Homo Sapiens
DIIMVSDKS

SEQ ID NO: 1360231 - protein, 9 aa, Homo Sapiens
AADVLKTFQ

SEQ ID NO: 1360232 - protein, 9 aa, Homo Sapiens
LFSASSLTA

SEQ ID NO: 1360233 - protein, 9 aa, Homo Sapiens
CYKYRGPQS

SEQ ID NO: 1360234 - protein, 9 aa, Homo Sapiens
FMLLNGYES

SEQ ID NO: 1360235 - protein, 9 aa, Homo Sapiens
HCLQLRIAT

SEQ ID NO: 1360236 - protein, 9 aa, Homo Sapiens
CITAQENDM

SEQ ID NO: 1360237 - protein, 9 aa, Homo Sapiens
DASGTNDLR

SEQ ID NO: 1360238 - protein, 9 aa, Homo Sapiens
YLNGNLHLL

SEQ ID NO: 1360239 - protein, 9 aa, Homo Sapiens
YCRLQDTNN

SEQ ID NO: 1360240 - protein, 9 aa, Homo Sapiens
FDINICYLP

SEQ ID NO: 1360241 - protein, 9 aa, Homo Sapiens
QLGTAVQME

SEQ ID NO: 1360242 - protein, 9 aa, Homo Sapiens
GLLQRFCWQ

SEQ ID NO: 1360243 - protein, 9 aa, Homo Sapiens
LQNRRALHL

SEQ ID NO: 1360244 - protein, 9 aa, Homo Sapiens
KEQLKKTYH

SEQ ID NO: 1360245 - protein, 9 aa, Homo Sapiens
SNKIGTSLS

SEQ ID NO: 1360246 - protein, 9 aa, Homo Sapiens
EDEDEDDGD

SEQ ID NO: 1360247 - protein, 9 aa, Homo Sapiens
RNNFPAGSH

SEQ ID NO: 1360248 - protein, 9 aa, Homo Sapiens
MIVALREAF

SEQ ID NO: 1360249 - protein, 9 aa, Homo Sapiens
VAASAPPAF

SEQ ID NO: 1360250 - protein, 9 aa, Homo Sapiens
NKEILEKSY

SEQ ID NO: 1360251 - protein, 9 aa, Homo Sapiens
IELDFAVPM

SEQ ID NO: 1360252 - protein, 9 aa, Homo Sapiens
CDWVRLEHV

SEQ ID NO: 1360253 - protein, 9 aa, Homo Sapiens
RFNPLDTFV

SEQ ID NO: 1360254 - protein, 9 aa, Homo Sapiens
TLFNDWEHS

SEQ ID NO: 1360255 - protein, 9 aa, Homo Sapiens
MPDPAKSAH

SEQ ID NO: 1360256 - protein, 9 aa, Homo Sapiens
TFRYSHNNS

SEQ ID NO: 1360257 - protein, 9 aa, Homo Sapiens
NAIIKDVKL

SEQ ID NO: 1360258 - protein, 9 aa, Homo Sapiens
VPPGIKNDN

SEQ ID NO: 1360259 - protein, 9 aa, Homo Sapiens
KQENDLDLF

SEQ ID NO: 1360260 - protein, 9 aa, Homo Sapiens
DGVLTLLDL

SEQ ID NO: 1360261 - protein, 9 aa, Homo Sapiens
LNFFHHSCN

SEQ ID NO: 1360262 - protein, 9 aa, Homo Sapiens
LSEQSHQQS

SEQ ID NO: 1360263 - protein, 9 aa, Homo Sapiens
LEVNKGTNC

SEQ ID NO: 1360264 - protein, 9 aa, Homo Sapiens
QSVPVYQMK

SEQ ID NO: 1360265 - protein, 9 aa, Homo Sapiens
FTKDFHHIV

SEQ ID NO: 1360266 - protein, 9 aa, Homo Sapiens
DIHQRFLVA

SEQ ID NO: 1360267 - protein, 9 aa, Homo Sapiens
HIVFGAPGT

SEQ ID NO: 1360268 - protein, 9 aa, Homo Sapiens
HLSVPRDWK

SEQ ID NO: 1360269 - protein, 9 aa, Homo Sapiens
WFDSQEISF

SEQ ID NO: 1360270 - protein, 9 aa, Homo Sapiens
KFERTCLHA

SEQ ID NO: 1360271 - protein, 9 aa, Homo Sapiens
LVKTYAASF

SEQ ID NO: 1360272 - protein, 9 aa, Homo Sapiens
LNRYSEQPG

SEQ ID NO: 1360273 - protein, 9 aa, Homo Sapiens
YDSRISGGY

SEQ ID NO: 1360274 - protein, 9 aa, Homo Sapiens
HIIYTLRNK

SEQ ID NO: 1360275 - protein, 9 aa, Homo Sapiens
VVVNEDTQG

SEQ ID NO: 1360276 - protein, 9 aa, Homo Sapiens
DELWKKQFK

SEQ ID NO: 1360277 - protein, 9 aa, Homo Sapiens
APEENGLAV

SEQ ID NO: 1360278 - protein, 9 aa, Homo Sapiens
LNVSLTNRN

SEQ ID NO: 1360279 - protein, 9 aa, Homo Sapiens
ECASNHCQH

SEQ ID NO: 1360280 - protein, 9 aa, Homo Sapiens
QRRMSFVGL

SEQ ID NO: 1360281 - protein, 9 aa, Homo Sapiens
ECLDSDEEL

SEQ ID NO: 1360282 - protein, 9 aa, Homo Sapiens
TSEHKVIEN

SEQ ID NO: 1360283 - protein, 9 aa, Homo Sapiens
ATDYWTFLK

SEQ ID NO: 1360284 - protein, 9 aa, Homo Sapiens
WNLPGDRIL

SEQ ID NO: 1360285 - protein, 9 aa, Homo Sapiens
HWYKDGMKL

SEQ ID NO: 1360286 - protein, 9 aa, Homo Sapiens
MGLMEGLGT

SEQ ID NO: 1360287 - protein, 9 aa, Homo Sapiens
MFAGHANKH

SEQ ID NO: 1360288 - protein, 9 aa, Homo Sapiens
ALRKIATEK

SEQ ID NO: 1360289 - protein, 9 aa, Homo Sapiens
NMSNHYRGL

SEQ ID NO: 1360290 - protein, 9 aa, Homo Sapiens
LRGPPWAAP

SEQ ID NO: 1360291 - protein, 9 aa, Homo Sapiens
SNHCQHGAT

SEQ ID NO: 1360292 - protein, 9 aa, Homo Sapiens
DEDDGDATR

SEQ ID NO: 1360293 - protein, 9 aa, Homo Sapiens
FLNTTPLPL

SEQ ID NO: 1360294 - protein, 9 aa, Homo Sapiens
VSFVKFEAE

SEQ ID NO: 1360295 - protein, 9 aa, Homo Sapiens
ALMKGVFTF

SEQ ID NO: 1360296 - protein, 9 aa, Homo Sapiens
LKGQLEKET

SEQ ID NO: 1360297 - protein, 9 aa, Homo Sapiens
LSQEKYHAL

SEQ ID NO: 1360298 - protein, 9 aa, Homo Sapiens
IKDVKLLEE

SEQ ID NO: 1360299 - protein, 9 aa, Homo Sapiens
TFLFETSEH

SEQ ID NO: 1360300 - protein, 9 aa, Homo Sapiens
GLEVEDNVA

SEQ ID NO: 1360301 - protein, 9 aa, Homo Sapiens
KKRMGRRST

SEQ ID NO: 1360302 - protein, 9 aa, Homo Sapiens
LCERVTNVL

SEQ ID NO: 1360303 - protein, 9 aa, Homo Sapiens
HVNLKDGNI

SEQ ID NO: 1360304 - protein, 9 aa, Homo Sapiens
PIHLAARNG

SEQ ID NO: 1360305 - protein, 9 aa, Homo Sapiens
DQSLEMSNT

SEQ ID NO: 1360306 - protein, 9 aa, Homo Sapiens
DEASSKTDL

SEQ ID NO: 1360307 - protein, 9 aa, Homo Sapiens
NDVQPGLFS

SEQ ID NO: 1360308 - protein, 9 aa, Homo Sapiens
GNASLAETD

SEQ ID NO: 1360309 - protein, 9 aa, Homo Sapiens
LQNVSLPSI

SEQ ID NO: 1360310 - protein, 9 aa, Homo Sapiens
DGFPMANGA

SEQ ID NO: 1360311 - protein, 9 aa, Homo Sapiens
PLRAPQSKN

SEQ ID NO: 1360312 - protein, 9 aa, Homo Sapiens
KDSSCVIQF

SEQ ID NO: 1360313 - protein, 9 aa, Homo Sapiens
LAIHRSTRT

SEQ ID NO: 1360314 - protein, 9 aa, Homo Sapiens
ILINNIERY

SEQ ID NO: 1360315 - protein, 9 aa, Homo Sapiens
VQQHGSGQI

SEQ ID NO: 1360316 - protein, 9 aa, Homo Sapiens
KKRKQDQEE

SEQ ID NO: 1360317 - protein, 9 aa, Homo Sapiens
EAVSTLWEI

SEQ ID NO: 1360318 - protein, 9 aa, Homo Sapiens
CDVVMLDEN

SEQ ID NO: 1360319 - protein, 9 aa, Homo Sapiens
NNPMNCDCE

SEQ ID NO: 1360320 - protein, 9 aa, Homo Sapiens
TALSMTHGS

SEQ ID NO: 1360321 - protein, 9 aa, Homo Sapiens
HVAQDVLKL

SEQ ID NO: 1360322 - protein, 9 aa, Homo Sapiens
MVCQVGCIE

SEQ ID NO: 1360323 - protein, 9 aa, Homo Sapiens
VGQGNHGTE

SEQ ID NO: 1360324 - protein, 9 aa, Homo Sapiens
PAFSGAAFV

SEQ ID NO: 1360325 - protein, 9 aa, Homo Sapiens
SQEVQVPPT

SEQ ID NO: 1360326 - protein, 9 aa, Homo Sapiens
LQCNGRSFS

SEQ ID NO: 1360327 - protein, 9 aa, Homo Sapiens
RPEDSTIKS

SEQ ID NO: 1360328 - protein, 9 aa, Homo Sapiens
KTGTLTMNI

SEQ ID NO: 1360329 - protein, 9 aa, Homo Sapiens
WCFINSNLK

SEQ ID NO: 1360330 - protein, 9 aa, Homo Sapiens
GKSLAFLVG

SEQ ID NO: 1360331 - protein, 9 aa, Homo Sapiens
TRSLSCLIL

SEQ ID NO: 1360332 - protein, 9 aa, Homo Sapiens
NEEFNIKLA

SEQ ID NO: 1360333 - protein, 9 aa, Homo Sapiens
DGYRVSQAL

SEQ ID NO: 1360334 - protein, 9 aa, Homo Sapiens
SVSEEVESS

SEQ ID NO: 1360335 - protein, 9 aa, Homo Sapiens
SRVHPALDT

SEQ ID NO: 1360336 - protein, 9 aa, Homo Sapiens
FDEPMFITV

SEQ ID NO: 1360337 - protein, 9 aa, Homo Sapiens
QLKKTYHNL

SEQ ID NO: 1360338 - protein, 9 aa, Homo Sapiens
DEDDRSFFN

SEQ ID NO: 1360339 - protein, 9 aa, Homo Sapiens
PITKQATSS

SEQ ID NO: 1360340 - protein, 9 aa, Homo Sapiens
TLYTIGDFE

SEQ ID NO: 1360341 - protein, 9 aa, Homo Sapiens
QLSNTSLAP

SEQ ID NO: 1360342 - protein, 9 aa, Homo Sapiens
RGGRDSDSN

SEQ ID NO: 1360343 - protein, 9 aa, Homo Sapiens
RYSEQPGSP

SEQ ID NO: 1360344 - protein, 9 aa, Homo Sapiens
IVFVESLLN

SEQ ID NO: 1360345 - protein, 9 aa, Homo Sapiens
IMRVTHVRE

SEQ ID NO: 1360346 - protein, 9 aa, Homo Sapiens
GLFDALTSL

SEQ ID NO: 1360347 - protein, 9 aa, Homo Sapiens
ERRPKLQIQ

SEQ ID NO: 1360348 - protein, 9 aa, Homo Sapiens
LLSVAESSY

SEQ ID NO: 1360349 - protein, 9 aa, Homo Sapiens
RAKMPQTRV

SEQ ID NO: 1360350 - protein, 9 aa, Homo Sapiens
EHCIPFLTS

SEQ ID NO: 1360351 - protein, 9 aa, Homo Sapiens
RRMSFVGLA

SEQ ID NO: 1360352 - protein, 9 aa, Homo Sapiens
PSKGSTPLT

SEQ ID NO: 1360353 - protein, 9 aa, Homo Sapiens
AEYGSVDIV

SEQ ID NO: 1360354 - protein, 9 aa, Homo Sapiens
QGLEKCTKA

SEQ ID NO: 1360355 - protein, 9 aa, Homo Sapiens
FSSHAFGES

SEQ ID NO: 1360356 - protein, 9 aa, Homo Sapiens
RPTWRYSYY

SEQ ID NO: 1360357 - protein, 9 aa, Homo Sapiens
QWVNVVVDY

SEQ ID NO: 1360358 - protein, 9 aa, Homo Sapiens
QHFLYLCLC

SEQ ID NO: 1360359 - protein, 9 aa, Homo Sapiens
FDKVVWNKR

SEQ ID NO: 1360360 - protein, 9 aa, Homo Sapiens
DVVMLDENL

SEQ ID NO: 1360361 - protein, 9 aa, Homo Sapiens
HAPKKGSKK

SEQ ID NO: 1360362 - protein, 9 aa, Homo Sapiens
HGEKAYRCS

SEQ ID NO: 1360363 - protein, 9 aa, Homo Sapiens
IIDFLNTTP

SEQ ID NO: 1360364 - protein, 9 aa, Homo Sapiens
NDLDLFSDF

SEQ ID NO: 1360365 - protein, 9 aa, Homo Sapiens
PSLRLGLLK

SEQ ID NO: 1360366 - protein, 9 aa, Homo Sapiens
IILSYKQEC

SEQ ID NO: 1360367 - protein, 9 aa, Homo Sapiens
LVSFPSLQA

SEQ ID NO: 1360368 - protein, 9 aa, Homo Sapiens
GFDALQWDP

SEQ ID NO: 1360369 - protein, 9 aa, Homo Sapiens
VASATYVAT

SEQ ID NO: 1360370 - protein, 9 aa, Homo Sapiens
DLSNTISRV

SEQ ID NO: 1360371 - protein, 9 aa, Homo Sapiens
RLHHGEKAY

SEQ ID NO: 1360372 - protein, 9 aa, Homo Sapiens
ALAGIARNS

SEQ ID NO: 1360373 - protein, 9 aa, Homo Sapiens
GSGGQLDCI

SEQ ID NO: 1360374 - protein, 9 aa, Homo Sapiens
SLLSHERIH

SEQ ID NO: 1360375 - protein, 9 aa, Homo Sapiens
IVALREAFS

SEQ ID NO: 1360376 - protein, 9 aa, Homo Sapiens
YFGSFCQGG

SEQ ID NO: 1360377 - protein, 9 aa, Homo Sapiens
DVNTRFLIY

SEQ ID NO: 1360378 - protein, 9 aa, Homo Sapiens
TITNLLYEE

SEQ ID NO: 1360379 - protein, 9 aa, Homo Sapiens
EPLWRLGAS

SEQ ID NO: 1360380 - protein, 9 aa, Homo Sapiens
DLRLKVRKH

SEQ ID NO: 1360381 - protein, 9 aa, Homo Sapiens
TSGKLLENL

SEQ ID NO: 1360382 - protein, 9 aa, Homo Sapiens
LIAVSSQLY

SEQ ID NO: 1360383 - protein, 9 aa, Homo Sapiens
SSHSSDEPA

SEQ ID NO: 1360384 - protein, 9 aa, Homo Sapiens
TIQQLLEWC

SEQ ID NO: 1360385 - protein, 9 aa, Homo Sapiens
RIHLDLVPK

SEQ ID NO: 1360386 - protein, 9 aa, Homo Sapiens
NFTFRSSAQ

SEQ ID NO: 1360387 - protein, 9 aa, Homo Sapiens
KQEGLAAAK

SEQ ID NO: 1360388 - protein, 9 aa, Homo Sapiens
YKIPVGSEE

SEQ ID NO: 1360389 - protein, 9 aa, Homo Sapiens
GIIPFSPKN

SEQ ID NO: 1360390 - protein, 9 aa, Homo Sapiens
QQGSFSSHG

SEQ ID NO: 1360391 - protein, 9 aa, Homo Sapiens
HQPSNNDFN

SEQ ID NO: 1360392 - protein, 9 aa, Homo Sapiens
DINDNPPVV

SEQ ID NO: 1360393 - protein, 9 aa, Homo Sapiens
SLTFSDVAI

SEQ ID NO: 1360394 - protein, 9 aa, Homo Sapiens
YQIAKTANE

SEQ ID NO: 1360395 - protein, 9 aa, Homo Sapiens
SESSQHLQL

SEQ ID NO: 1360396 - protein, 9 aa, Homo Sapiens
IVYGNYDSK

SEQ ID NO: 1360397 - protein, 9 aa, Homo Sapiens
PVSWIQKVC

SEQ ID NO: 1360398 - protein, 9 aa, Homo Sapiens
PGIKNDNKN

SEQ ID NO: 1360399 - protein, 9 aa, Homo Sapiens
FLRRASKAW

SEQ ID NO: 1360400 - protein, 9 aa, Homo Sapiens
KGQLKLLLS

SEQ ID NO: 1360401 - protein, 9 aa, Homo Sapiens
LCPHLYTLT

SEQ ID NO: 1360402 - protein, 9 aa, Homo Sapiens
AKNPSIEPS

SEQ ID NO: 1360403 - protein, 9 aa, Homo Sapiens
WIEQFERHL

SEQ ID NO: 1360404 - protein, 9 aa, Homo Sapiens
GTEYIRTSG

SEQ ID NO: 1360405 - protein, 9 aa, Homo Sapiens
YRLPTKNDK

SEQ ID NO: 1360406 - protein, 9 aa, Homo Sapiens
GVLTLLDLA

SEQ ID NO: 1360407 - protein, 9 aa, Homo Sapiens
AAGEIEYEV

SEQ ID NO: 1360408 - protein, 9 aa, Homo Sapiens
KVLHPLPGL

SEQ ID NO: 1360409 - protein, 9 aa, Homo Sapiens
PDPGCPDCF

SEQ ID NO: 1360410 - protein, 9 aa, Homo Sapiens
PQTGPPANS

SEQ ID NO: 1360411 - protein, 9 aa, Homo Sapiens
TREASNTDR

SEQ ID NO: 1360412 - protein, 9 aa, Homo Sapiens
DHQMRNHSK

SEQ ID NO: 1360413 - protein, 9 aa, Homo Sapiens
LAVAKYALF

SEQ ID NO: 1360414 - protein, 9 aa, Homo Sapiens
VRKKRGIPM

SEQ ID NO: 1360415 - protein, 9 aa, Homo Sapiens
KYVKIPVRN

SEQ ID NO: 1360416 - protein, 9 aa, Homo Sapiens
EQLFLPHSR

SEQ ID NO: 1360417 - protein, 9 aa, Homo Sapiens
VLATLRNYY

SEQ ID NO: 1360418 - protein, 9 aa, Homo Sapiens
PAQAWTTFR

SEQ ID NO: 1360419 - protein, 9 aa, Homo Sapiens
ECWKNFSNG

SEQ ID NO: 1360420 - protein, 9 aa, Homo Sapiens
LIIMKTLIV

SEQ ID NO: 1360421 - protein, 9 aa, Homo Sapiens
LGFLLNSKF

SEQ ID NO: 1360422 - protein, 9 aa, Homo Sapiens
LPGDRILDI

SEQ ID NO: 1360423 - protein, 9 aa, Homo Sapiens
LYLGKNQIK

SEQ ID NO: 1360424 - protein, 9 aa, Homo Sapiens
ILAYCYIIL

SEQ ID NO: 1360425 - protein, 9 aa, Homo Sapiens
DITSIQLLP

SEQ ID NO: 1360426 - protein, 9 aa, Homo Sapiens
LIKEDHNFH

SEQ ID NO: 1360427 - protein, 9 aa, Homo Sapiens
SKLEKKELE

SEQ ID NO: 1360428 - protein, 9 aa, Homo Sapiens
SDIIMVSDK

SEQ ID NO: 1360429 - protein, 9 aa, Homo Sapiens
LQDVQRIIV

SEQ ID NO: 1360430 - protein, 9 aa, Homo Sapiens
EGVLDSYFQ

SEQ ID NO: 1360431 - protein, 9 aa, Homo Sapiens
NQGCLKFLL

SEQ ID NO: 1360432 - protein, 9 aa, Homo Sapiens
SEISLIVFP

SEQ ID NO: 1360433 - protein, 9 aa, Homo Sapiens
LTRPEDSTI

SEQ ID NO: 1360434 - protein, 9 aa, Homo Sapiens
KDKLLCQLT

SEQ ID NO: 1360435 - protein, 9 aa, Homo Sapiens
GDTERRYNL

SEQ ID NO: 1360436 - protein, 9 aa, Homo Sapiens
LHTHTGVST

SEQ ID NO: 1360437 - protein, 9 aa, Homo Sapiens
LEGWRWNLP

SEQ ID NO: 1360438 - protein, 9 aa, Homo Sapiens
LQKVFNFCT

SEQ ID NO: 1360439 - protein, 9 aa, Homo Sapiens
ERNKKRLLQ

SEQ ID NO: 1360440 - protein, 9 aa, Homo Sapiens
LDYLGSVRL

SEQ ID NO: 1360441 - protein, 9 aa, Homo Sapiens
EKLQYATNY

SEQ ID NO: 1360442 - protein, 9 aa, Homo Sapiens
IENEDEVER

SEQ ID NO: 1360443 - protein, 9 aa, Homo Sapiens
GQISRQPLG

SEQ ID NO: 1360444 - protein, 9 aa, Homo Sapiens
RPCSPISRE

SEQ ID NO: 1360445 - protein, 9 aa, Homo Sapiens
TALEAVKLV

SEQ ID NO: 1360446 - protein, 9 aa, Homo Sapiens
FALWLEQKH

SEQ ID NO: 1360447 - protein, 9 aa, Homo Sapiens
STRTEEKLH

SEQ ID NO: 1360448 - protein, 9 aa, Homo Sapiens
FQDRRQEHF

SEQ ID NO: 1360449 - protein, 9 aa, Homo Sapiens
DLDLFSDFI

SEQ ID NO: 1360450 - protein, 9 aa, Homo Sapiens
ARAFECLDS

SEQ ID NO: 1360451 - protein, 9 aa, Homo Sapiens
FWLSVYGPR

SEQ ID NO: 1360452 - protein, 9 aa, Homo Sapiens
SRNKCQTES

SEQ ID NO: 1360453 - protein, 9 aa, Homo Sapiens
SHNNSLLGT

SEQ ID NO: 1360454 - protein, 9 aa, Homo Sapiens
GTTCTKHPN

SEQ ID NO: 1360455 - protein, 9 aa, Homo Sapiens
FALTSWGWS

SEQ ID NO: 1360456 - protein, 9 aa, Homo Sapiens
KMSCAGPQT

SEQ ID NO: 1360457 - protein, 9 aa, Homo Sapiens
TEPLWRLGA

SEQ ID NO: 1360458 - protein, 9 aa, Homo Sapiens
MARPEYKEW

SEQ ID NO: 1360459 - protein, 9 aa, Homo Sapiens
INSSTHGPI

SEQ ID NO: 1360460 - protein, 9 aa, Homo Sapiens
DNVNHAVLA

SEQ ID NO: 1360461 - protein, 9 aa, Homo Sapiens
EDKGRANGT

SEQ ID NO: 1360462 - protein, 9 aa, Homo Sapiens
TDKSVRNMS

SEQ ID NO: 1360463 - protein, 9 aa, Homo Sapiens
PLGYHIYVS

SEQ ID NO: 1360464 - protein, 9 aa, Homo Sapiens
KSLAFLVGV

SEQ ID NO: 1360465 - protein, 9 aa, Homo Sapiens
LIVFPRRIS

SEQ ID NO: 1360466 - protein, 9 aa, Homo Sapiens
ALDTSNDPG

SEQ ID NO: 1360467 - protein, 9 aa, Homo Sapiens
LEDIRIHPQ

SEQ ID NO: 1360468 - protein, 9 aa, Homo Sapiens
YEIYSLIGK

SEQ ID NO: 1360469 - protein, 9 aa, Homo Sapiens
CVGNATACV

SEQ ID NO: 1360470 - protein, 9 aa, Homo Sapiens
AWVSHYSTV

SEQ ID NO: 1360471 - protein, 9 aa, Homo Sapiens
ECVEVVIDD

SEQ ID NO: 1360472 - protein, 9 aa, Homo Sapiens
NPMNCDCEL

SEQ ID NO: 1360473 - protein, 9 aa, Homo Sapiens
KVTNAQDFW

SEQ ID NO: 1360474 - protein, 9 aa, Homo Sapiens
YTLAEKWET

SEQ ID NO: 1360475 - protein, 9 aa, Homo Sapiens
IQNLKVFRH

SEQ ID NO: 1360476 - protein, 9 aa, Homo Sapiens
MGIIPFSPK

SEQ ID NO: 1360477 - protein, 9 aa, Homo Sapiens
ELSRRLSMS

SEQ ID NO: 1360478 - protein, 9 aa, Homo Sapiens
HRPLDRETQ

SEQ ID NO: 1360479 - protein, 9 aa, Homo Sapiens
FQKEHQQYQ

SEQ ID NO: 1360480 - protein, 9 aa, Homo Sapiens
KLIKNKVVV

SEQ ID NO: 1360481 - protein, 9 aa, Homo Sapiens
RGPPWAAPS

SEQ ID NO: 1360482 - protein, 9 aa, Homo Sapiens
SWQGDGFPM

SEQ ID NO: 1360483 - protein, 9 aa, Homo Sapiens
GPVRFQDRR

SEQ ID NO: 1360484 - protein, 9 aa, Homo Sapiens
GGRRNVADN

SEQ ID NO: 1360485 - protein, 9 aa, Homo Sapiens
GKEPWPLQG

SEQ ID NO: 1360486 - protein, 9 aa, Homo Sapiens
ELEDLSDKK

SEQ ID NO: 1360487 - protein, 9 aa, Homo Sapiens
AYGKKFDVK

SEQ ID NO: 1360488 - protein, 9 aa, Homo Sapiens
KVFSRVYEL

SEQ ID NO: 1360489 - protein, 9 aa, Homo Sapiens
TQNEFEVEG

SEQ ID NO: 1360490 - protein, 9 aa, Homo Sapiens
LGTAVQMEI

SEQ ID NO: 1360491 - protein, 9 aa, Homo Sapiens
LAAEAKERE

SEQ ID NO: 1360492 - protein, 9 aa, Homo Sapiens
SKSVDSSLV

SEQ ID NO: 1360493 - protein, 9 aa, Homo Sapiens
YEAENSWEE

SEQ ID NO: 1360494 - protein, 9 aa, Homo Sapiens
DINICYLPR

SEQ ID NO: 1360495 - protein, 9 aa, Homo Sapiens
KLNTDLEKK

SEQ ID NO: 1360496 - protein, 9 aa, Homo Sapiens
GSPSLRLGL

SEQ ID NO: 1360497 - protein, 9 aa, Homo Sapiens
DSHGVYGLQ

SEQ ID NO: 1360498 - protein, 9 aa, Homo Sapiens
TTLPVLQGL

SEQ ID NO: 1360499 - protein, 9 aa, Homo Sapiens
DDHVIEYVN

SEQ ID NO: 1360500 - protein, 9 aa, Homo Sapiens
RVGMAVDMH

SEQ ID NO: 1360501 - protein, 9 aa, Homo Sapiens
LQSVIHNNN

SEQ ID NO: 1360502 - protein, 9 aa, Homo Sapiens
VQNKVFLLA

SEQ ID NO: 1360503 - protein, 9 aa, Homo Sapiens
LKDDFTIEV

SEQ ID NO: 1360504 - protein, 9 aa, Homo Sapiens
NFKKFLIGP

SEQ ID NO: 1360505 - protein, 9 aa, Homo Sapiens
IIFTIVGFI

SEQ ID NO: 1360506 - protein, 9 aa, Homo Sapiens
SYLERKSVT

SEQ ID NO: 1360507 - protein, 9 aa, Homo Sapiens
QYETLPGWK

SEQ ID NO: 1360508 - protein, 9 aa, Homo Sapiens
VYGNYDSKK

SEQ ID NO: 1360509 - protein, 9 aa, Homo Sapiens
IHLRVHTVE

SEQ ID NO: 1360510 - protein, 9 aa, Homo Sapiens
YSHNNSLLG

SEQ ID NO: 1360511 - protein, 9 aa, Homo Sapiens
ISRFLYTEQ

SEQ ID NO: 1360512 - protein, 9 aa, Homo Sapiens
VIITDKSVR

SEQ ID NO: 1360513 - protein, 9 aa, Homo Sapiens
KAFWLSVYG

SEQ ID NO: 1360514 - protein, 9 aa, Homo Sapiens
LKFKREVHL

SEQ ID NO: 1360515 - protein, 9 aa, Homo Sapiens
YNQQRIRQN

SEQ ID NO: 1360516 - protein, 9 aa, Homo Sapiens
DLATLGDKV

SEQ ID NO: 1360517 - protein, 9 aa, Homo Sapiens
DNVAFLITV

SEQ ID NO: 1360518 - protein, 9 aa, Homo Sapiens
LGSPELINL

SEQ ID NO: 1360519 - protein, 9 aa, Homo Sapiens
SDSDIIMVS

SEQ ID NO: 1360520 - protein, 9 aa, Homo Sapiens
YRFHWIHTQ

SEQ ID NO: 1360521 - protein, 9 aa, Homo Sapiens
VHVLLKTLR

SEQ ID NO: 1360522 - protein, 9 aa, Homo Sapiens
DFLMQSAVL

SEQ ID NO: 1360523 - protein, 9 aa, Homo Sapiens
GSQGGIAPS

SEQ ID NO: 1360524 - protein, 9 aa, Homo Sapiens
MLDENLLKM

SEQ ID NO: 1360525 - protein, 9 aa, Homo Sapiens
CKECWKNFS

SEQ ID NO: 1360526 - protein, 9 aa, Homo Sapiens
EILKKDSSC

SEQ ID NO: 1360527 - protein, 9 aa, Homo Sapiens
RTLSRNKCQ

SEQ ID NO: 1360528 - protein, 9 aa, Homo Sapiens
FVRHVEQRK

SEQ ID NO: 1360529 - protein, 9 aa, Homo Sapiens
LDLFSDFIM

SEQ ID NO: 1360530 - protein, 9 aa, Homo Sapiens
AIMQCSTSE

SEQ ID NO: 1360531 - protein, 9 aa, Homo Sapiens
GKAVGSDCG

SEQ ID NO: 1360532 - protein, 9 aa, Homo Sapiens
RHKQAADAE

SEQ ID NO: 1360533 - protein, 9 aa, Homo Sapiens
KIHVQSSSH

SEQ ID NO: 1360534 - protein, 9 aa, Homo Sapiens
TQEGGEEED

SEQ ID NO: 1360535 - protein, 9 aa, Homo Sapiens
VNPSLLPVV

SEQ ID NO: 1360536 - protein, 9 aa, Homo Sapiens
GGEWSIMTT

SEQ ID NO: 1360537 - protein, 9 aa, Homo Sapiens
RYCDWTITV

SEQ ID NO: 1360538 - protein, 9 aa, Homo Sapiens
AGHSVDVMS

SEQ ID NO: 1360539 - protein, 9 aa, Homo Sapiens
MIQYKVCNN

SEQ ID NO: 1360540 - protein, 9 aa, Homo Sapiens
PDMEQRETT

SEQ ID NO: 1360541 - protein, 9 aa, Homo Sapiens
KMIDFNIRI

SEQ ID NO: 1360542 - protein, 9 aa, Homo Sapiens
TAVHGGSFI

SEQ ID NO: 1360543 - protein, 9 aa, Homo Sapiens
ALQGFFHRE

SEQ ID NO: 1360544 - protein, 9 aa, Homo Sapiens
DSHHNDHWF

SEQ ID NO: 1360545 - protein, 9 aa, Homo Sapiens
DDFTIEVDR

SEQ ID NO: 1360546 - protein, 9 aa, Homo Sapiens
VDKDFSHTQ

SEQ ID NO: 1360547 - protein, 9 aa, Homo Sapiens
QSLLEKGYI

SEQ ID NO: 1360548 - protein, 9 aa, Homo Sapiens
LWIESTNNT

SEQ ID NO: 1360549 - protein, 9 aa, Homo Sapiens
SLMKVNPVS

SEQ ID NO: 1360550 - protein, 9 aa, Homo Sapiens
IVTPLLNHI

SEQ ID NO: 1360551 - protein, 9 aa, Homo Sapiens
VVPLGVPAS

SEQ ID NO: 1360552 - protein, 9 aa, Homo Sapiens
RRIHNGESI

SEQ ID NO: 1360553 - protein, 9 aa, Homo Sapiens
SMQTSDGIF

SEQ ID NO: 1360554 - protein, 9 aa, Homo Sapiens
TSTPSKGST

SEQ ID NO: 1360555 - protein, 9 aa, Homo Sapiens
PLELAKRGV

SEQ ID NO: 1360556 - protein, 9 aa, Homo Sapiens
YISHPKQEG

SEQ ID NO: 1360557 - protein, 9 aa, Homo Sapiens
IPDLTDHFA

SEQ ID NO: 1360558 - protein, 9 aa, Homo Sapiens
PLLNHIIYT

SEQ ID NO: 1360559 - protein, 9 aa, Homo Sapiens
ENADARNWD

SEQ ID NO: 1360560 - protein, 9 aa, Homo Sapiens
EIDILINNI

SEQ ID NO: 1360561 - protein, 9 aa, Homo Sapiens
HFLCPHLYT

SEQ ID NO: 1360562 - protein, 9 aa, Homo Sapiens
VALREAFST

SEQ ID NO: 1360563 - protein, 9 aa, Homo Sapiens
FAGHSVDVM

SEQ ID NO: 1360564 - protein, 9 aa, Homo Sapiens
ANLLFGYKN

SEQ ID NO: 1360565 - protein, 9 aa, Homo Sapiens
LILAYCYII

SEQ ID NO: 1360566 - protein, 9 aa, Homo Sapiens
DTFRYSHNN

SEQ ID NO: 1360567 - protein, 9 aa, Homo Sapiens
DIMRVTHVR

SEQ ID NO: 1360568 - protein, 9 aa, Homo Sapiens
FKGVQGVKA

SEQ ID NO: 1360569 - protein, 9 aa, Homo Sapiens
SEHKVIENI

SEQ ID NO: 1360570 - protein, 9 aa, Homo Sapiens
ETPSHFVKD

SEQ ID NO: 1360571 - protein, 9 aa, Homo Sapiens
KGPNYLTAC

SEQ ID NO: 1360572 - protein, 9 aa, Homo Sapiens
TASVSKAER

SEQ ID NO: 1360573 - protein, 9 aa, Homo Sapiens
FTYVGKALE

SEQ ID NO: 1360574 - protein, 9 aa, Homo Sapiens
YVKIPVRNH

SEQ ID NO: 1360575 - protein, 9 aa, Homo Sapiens
FCKLLLYWV

SEQ ID NO: 1360576 - protein, 9 aa, Homo Sapiens
IGMRFAITN

SEQ ID NO: 1360577 - protein, 9 aa, Homo Sapiens
LVGGKALPP

SEQ ID NO: 1360578 - protein, 9 aa, Homo Sapiens
DVHVGSRGD

SEQ ID NO: 1360579 - protein, 9 aa, Homo Sapiens
RRYNLRYYK

SEQ ID NO: 1360580 - protein, 9 aa, Homo Sapiens
QDFVRHVEQ

SEQ ID NO: 1360581 - protein, 9 aa, Homo Sapiens
LPQHMKEFL

SEQ ID NO: 1360582 - protein, 9 aa, Homo Sapiens
KLAAPWRIV

SEQ ID NO: 1360583 - protein, 9 aa, Homo Sapiens
DALQWDPKG

SEQ ID NO: 1360584 - protein, 9 aa, Homo Sapiens
LTQYSQVHI

SEQ ID NO: 1360585 - protein, 9 aa, Homo Sapiens
IIVMLQDNQ

SEQ ID NO: 1360586 - protein, 9 aa, Homo Sapiens
ERDLATLGD

SEQ ID NO: 1360587 - protein, 9 aa, Homo Sapiens
DLKGQLEKE

SEQ ID NO: 1360588 - protein, 9 aa, Homo Sapiens
LTNRNYDLD

SEQ ID NO: 1360589 - protein, 9 aa, Homo Sapiens
ILMIQYKVC

SEQ ID NO: 1360590 - protein, 9 aa, Homo Sapiens
QKVKEWSLI

SEQ ID NO: 1360591 - protein, 9 aa, Homo Sapiens
LALTCMYKI

SEQ ID NO: 1360592 - protein, 9 aa, Homo Sapiens
KPISDVTDG

SEQ ID NO: 1360593 - protein, 9 aa, Homo Sapiens
GKTMTNDYV

SEQ ID NO: 1360594 - protein, 9 aa, Homo Sapiens
GTPVRDYLS

SEQ ID NO: 1360595 - protein, 9 aa, Homo Sapiens
PEAFGFQQA

SEQ ID NO: 1360596 - protein, 9 aa, Homo Sapiens
GKHFTVLKV

SEQ ID NO: 1360597 - protein, 9 aa, Homo Sapiens
ACQDFKKTK

SEQ ID NO: 1360598 - protein, 9 aa, Homo Sapiens
DCFFQLGNM

SEQ ID NO: 1360599 - protein, 9 aa, Homo Sapiens
SFCYKPGAC

SEQ ID NO: 1360600 - protein, 9 aa, Homo Sapiens
TTLKLHQSK

SEQ ID NO: 1360601 - protein, 9 aa, Homo Sapiens
VIPPSSRYL

SEQ ID NO: 1360602 - protein, 9 aa, Homo Sapiens
GISCSHRDE

SEQ ID NO: 1360603 - protein, 9 aa, Homo Sapiens
KNRAKMIDF

SEQ ID NO: 1360604 - protein, 9 aa, Homo Sapiens
DKDEYDKLA

SEQ ID NO: 1360605 - protein, 9 aa, Homo Sapiens
YCIGGTVLN

SEQ ID NO: 1360606 - protein, 9 aa, Homo Sapiens
NVSLLAIRT

SEQ ID NO: 1360607 - protein, 9 aa, Homo Sapiens
RNGVACIAA

SEQ ID NO: 1360608 - protein, 9 aa, Homo Sapiens
RSLSCLILK

SEQ ID NO: 1360609 - protein, 9 aa, Homo Sapiens
RMSTVSELC

SEQ ID NO: 1360610 - protein, 9 aa, Homo Sapiens
IYNHKNMQQ

SEQ ID NO: 1360611 - protein, 9 aa, Homo Sapiens
DMFAGHANK

SEQ ID NO: 1360612 - protein, 9 aa, Homo Sapiens
PQRKFLEEE

SEQ ID NO: 1360613 - protein, 9 aa, Homo Sapiens
MSCAGPQTY

SEQ ID NO: 1360614 - protein, 9 aa, Homo Sapiens
SLVHQDGLE

SEQ ID NO: 1360615 - protein, 9 aa, Homo Sapiens
QHLKRVQLL

SEQ ID NO: 1360616 - protein, 9 aa, Homo Sapiens
YNHKNMQQH

SEQ ID NO: 1360617 - protein, 9 aa, Homo Sapiens
TQQLQSVIH

SEQ ID NO: 1360618 - protein, 9 aa, Homo Sapiens
FNTTEKRAA

SEQ ID NO: 1360619 - protein, 9 aa, Homo Sapiens
FSVLLFALD

SEQ ID NO: 1360620 - protein, 9 aa, Homo Sapiens
EISLIVFPR

SEQ ID NO: 1360621 - protein, 9 aa, Homo Sapiens
VLKTSGKLL

SEQ ID NO: 1360622 - protein, 9 aa, Homo Sapiens
PATGPSAAQ

SEQ ID NO: 1360623 - protein, 9 aa, Homo Sapiens
RQIEDLKGQ

SEQ ID NO: 1360624 - protein, 9 aa, Homo Sapiens
DDSRLCSQV

SEQ ID NO: 1360625 - protein, 9 aa, Homo Sapiens
DHIIYFFLC

SEQ ID NO: 1360626 - protein, 9 aa, Homo Sapiens
IIMVSDKSN

SEQ ID NO: 1360627 - protein, 9 aa, Homo Sapiens
APLQPLVSF

SEQ ID NO: 1360628 - protein, 9 aa, Homo Sapiens
RTNSGHKIT

SEQ ID NO: 1360629 - protein, 9 aa, Homo Sapiens
VHVGSRGDC

SEQ ID NO: 1360630 - protein, 9 aa, Homo Sapiens
ELFDKVVWN

SEQ ID NO: 1360631 - protein, 9 aa, Homo Sapiens
ITNLLYEEN

SEQ ID NO: 1360632 - protein, 9 aa, Homo Sapiens
RSKWGRTCH

SEQ ID NO: 1360633 - protein, 9 aa, Homo Sapiens
SRHVAQDVL

SEQ ID NO: 1360634 - protein, 9 aa, Homo Sapiens
EIYSLIGKG

SEQ ID NO: 1360635 - protein, 9 aa, Homo Sapiens
LEQLFLPHS

SEQ ID NO: 1360636 - protein, 9 aa, Homo Sapiens
ALNSSHHVS

SEQ ID NO: 1360637 - protein, 9 aa, Homo Sapiens
NTRFLIYTN

SEQ ID NO: 1360638 - protein, 9 aa, Homo Sapiens
EWSLIIMKT

SEQ ID NO: 1360639 - protein, 9 aa, Homo Sapiens
LATLGDKVN

SEQ ID NO: 1360640 - protein, 9 aa, Homo Sapiens
ELDFAVPMK

SEQ ID NO: 1360641 - protein, 9 aa, Homo Sapiens
HTIEKPYKC

SEQ ID NO: 1360642 - protein, 9 aa, Homo Sapiens
GCPDCFNSG

SEQ ID NO: 1360643 - protein, 9 aa, Homo Sapiens
HEAPMIECG

SEQ ID NO: 1360644 - protein, 9 aa, Homo Sapiens
WDLLRTLND

SEQ ID NO: 1360645 - protein, 9 aa, Homo Sapiens
DFYTLRVGI

SEQ ID NO: 1360646 - protein, 9 aa, Homo Sapiens
RGIIILSYK

SEQ ID NO: 1360647 - protein, 9 aa, Homo Sapiens
CRHEVIMDS

SEQ ID NO: 1360648 - protein, 9 aa, Homo Sapiens
TCIRFVTYE

SEQ ID NO: 1360649 - protein, 9 aa, Homo Sapiens
KCNDLKSPG

SEQ ID NO: 1360650 - protein, 9 aa, Homo Sapiens
CLVKTYAAS

SEQ ID NO: 1360651 - protein, 9 aa, Homo Sapiens
SERGPWRRE

SEQ ID NO: 1360652 - protein, 9 aa, Homo Sapiens
NNIPLSDGW

SEQ ID NO: 1360653 - protein, 9 aa, Homo Sapiens
STHGPILEQ

SEQ ID NO: 1360654 - protein, 9 aa, Homo Sapiens
HGKPGTPGV

SEQ ID NO: 1360655 - protein, 9 aa, Homo Sapiens
LMKVNPVSW

SEQ ID NO: 1360656 - protein, 9 aa, Homo Sapiens
PINSSTHGP

SEQ ID NO: 1360657 - protein, 9 aa, Homo Sapiens
LSVQGLASI

SEQ ID NO: 1360658 - protein, 9 aa, Homo Sapiens
ANVIVYVGI

SEQ ID NO: 1360659 - protein, 9 aa, Homo Sapiens
HMKEFLGHP

SEQ ID NO: 1360660 - protein, 9 aa, Homo Sapiens
VENALQEKK

SEQ ID NO: 1360661 - protein, 9 aa, Homo Sapiens
VLFIIVFVE

SEQ ID NO: 1360662 - protein, 9 aa, Homo Sapiens
LPTMAEVNV

SEQ ID NO: 1360663 - protein, 9 aa, Homo Sapiens
DIPCVIAAC

SEQ ID NO: 1360664 - protein, 9 aa, Homo Sapiens
TSSVAKSGS

SEQ ID NO: 1360665 - protein, 9 aa, Homo Sapiens
EHAADEALD

SEQ ID NO: 1360666 - protein, 9 aa, Homo Sapiens
NTLLLLEHL

SEQ ID NO: 1360667 - protein, 9 aa, Homo Sapiens
TLLHLELTK

SEQ ID NO: 1360668 - protein, 9 aa, Homo Sapiens
TIINHHIPF

SEQ ID NO: 1360669 - protein, 9 aa, Homo Sapiens
VSTTVILAG

SEQ ID NO: 1360670 - protein, 9 aa, Homo Sapiens
AWNFKKFLI

SEQ ID NO: 1360671 - protein, 9 aa, Homo Sapiens
FNWQALKNG

SEQ ID NO: 1360672 - protein, 9 aa, Homo Sapiens
SVASATYVA

SEQ ID NO: 1360673 - protein, 9 aa, Homo Sapiens
LSSQLALAN

SEQ ID NO: 1360674 - protein, 9 aa, Homo Sapiens
VVLFPQSNM

SEQ ID NO: 1360675 - protein, 9 aa, Homo Sapiens
LSLQSRWNY

SEQ ID NO: 1360676 - protein, 9 aa, Homo Sapiens
SVIPPSSRY

SEQ ID NO: 1360677 - protein, 9 aa, Homo Sapiens
SGYIKRPQL

SEQ ID NO: 1360678 - protein, 9 aa, Homo Sapiens
SSVPLGRYF

SEQ ID NO: 1360679 - protein, 9 aa, Homo Sapiens
SLLLNDISM

SEQ ID NO: 1360680 - protein, 9 aa, Homo Sapiens
SELCITAQE

SEQ ID NO: 1360681 - protein, 9 aa, Homo Sapiens
ELATKNSKL

SEQ ID NO: 1360682 - protein, 9 aa, Homo Sapiens
TLLGSNTVK

SEQ ID NO: 1360683 - protein, 9 aa, Homo Sapiens
VNIHMMRQQ

SEQ ID NO: 1360684 - protein, 9 aa, Homo Sapiens
LGTTTDRSI

SEQ ID NO: 1360685 - protein, 9 aa, Homo Sapiens
LKAERNNTL

SEQ ID NO: 1360686 - protein, 9 aa, Homo Sapiens
GQKEQAVEL

SEQ ID NO: 1360687 - protein, 9 aa, Homo Sapiens
LKYIKMTAT

SEQ ID NO: 1360688 - protein, 9 aa, Homo Sapiens
AARLLDIPC

SEQ ID NO: 1360689 - protein, 9 aa, Homo Sapiens
LQPELSYGI

SEQ ID NO: 1360690 - protein, 9 aa, Homo Sapiens
LVQSHRDGC

SEQ ID NO: 1360691 - protein, 9 aa, Homo Sapiens
LLDLAKGFP

SEQ ID NO: 1360692 - protein, 9 aa, Homo Sapiens
HTTLKLHQS

SEQ ID NO: 1360693 - protein, 9 aa, Homo Sapiens
DVHTTLKLH

SEQ ID NO: 1360694 - protein, 9 aa, Homo Sapiens
CKGPPPALP

SEQ ID NO: 1360695 - protein, 9 aa, Homo Sapiens
IVYVGIPKG

SEQ ID NO: 1360696 - protein, 9 aa, Homo Sapiens
INDNMEQNE

SEQ ID NO: 1360697 - protein, 9 aa, Homo Sapiens
CISTLMSDK

SEQ ID NO: 1360698 - protein, 9 aa, Homo Sapiens
EVDSAQQLP

SEQ ID NO: 1360699 - protein, 9 aa, Homo Sapiens
ECYHPYCVN

SEQ ID NO: 1360700 - protein, 9 aa, Homo Sapiens
HTIENNTDI

SEQ ID NO: 1360701 - protein, 9 aa, Homo Sapiens
PLKDEQEMI

SEQ ID NO: 1360702 - protein, 9 aa, Homo Sapiens
GHNSHGKFI

SEQ ID NO: 1360703 - protein, 9 aa, Homo Sapiens
YKCEECCKA

SEQ ID NO: 1360704 - protein, 9 aa, Homo Sapiens
TSLQSSQEV

SEQ ID NO: 1360705 - protein, 9 aa, Homo Sapiens
CFRLHNKPT

SEQ ID NO: 1360706 - protein, 9 aa, Homo Sapiens
GDVGQIFYC

SEQ ID NO: 1360707 - protein, 9 aa, Homo Sapiens
IFLIAVSSQ

SEQ ID NO: 1360708 - protein, 9 aa, Homo Sapiens
ILRLRELLT

SEQ ID NO: 1360709 - protein, 9 aa, Homo Sapiens
AQDVLKLQG

SEQ ID NO: 1360710 - protein, 9 aa, Homo Sapiens
RLVGKYMQL

SEQ ID NO: 1360711 - protein, 9 aa, Homo Sapiens
APVILEKLH

SEQ ID NO: 1360712 - protein, 9 aa, Homo Sapiens
KESLKNIKD

SEQ ID NO: 1360713 - protein, 9 aa, Homo Sapiens
CETTVILSI

SEQ ID NO: 1360714 - protein, 9 aa, Homo Sapiens
FQQATREYT

SEQ ID NO: 1360715 - protein, 9 aa, Homo Sapiens
FGPQYEITQ

SEQ ID NO: 1360716 - protein, 9 aa, Homo Sapiens
CIGMRFAIT

SEQ ID NO: 1360717 - protein, 9 aa, Homo Sapiens
LKSKKNFCH

SEQ ID NO: 1360718 - protein, 9 aa, Homo Sapiens
KGLTSYIWT

SEQ ID NO: 1360719 - protein, 9 aa, Homo Sapiens
IKDLQEQQE

SEQ ID NO: 1360720 - protein, 9 aa, Homo Sapiens
HCPGDLIEV

SEQ ID NO: 1360721 - protein, 9 aa, Homo Sapiens
YYSVVYAGW

SEQ ID NO: 1360722 - protein, 9 aa, Homo Sapiens
EAFVNQPNY

SEQ ID NO: 1360723 - protein, 9 aa, Homo Sapiens
SQCSECYHP

SEQ ID NO: 1360724 - protein, 9 aa, Homo Sapiens
QPLCPLDER

SEQ ID NO: 1360725 - protein, 9 aa, Homo Sapiens
NITPGMDCL

SEQ ID NO: 1360726 - protein, 9 aa, Homo Sapiens
KAPYSYKVQ

SEQ ID NO: 1360727 - protein, 9 aa, Homo Sapiens
AIRYKISPD

SEQ ID NO: 1360728 - protein, 9 aa, Homo Sapiens
SEQPGSPER

SEQ ID NO: 1360729 - protein, 9 aa, Homo Sapiens
VVQTAASWW

SEQ ID NO: 1360730 - protein, 9 aa, Homo Sapiens
MSLLALFNI

SEQ ID NO: 1360731 - protein, 9 aa, Homo Sapiens
KNLSREINY

SEQ ID NO: 1360732 - protein, 9 aa, Homo Sapiens
FGIRIDNVV

SEQ ID NO: 1360733 - protein, 9 aa, Homo Sapiens
LYLERNFTF

SEQ ID NO: 1360734 - protein, 9 aa, Homo Sapiens
NAHSCCLQC

SEQ ID NO: 1360735 - protein, 9 aa, Homo Sapiens
QKLSAVEKS

SEQ ID NO: 1360736 - protein, 9 aa, Homo Sapiens
EADLCDQHK

SEQ ID NO: 1360737 - protein, 9 aa, Homo Sapiens
AFGIRIDNV

SEQ ID NO: 1360738 - protein, 9 aa, Homo Sapiens
IASPKISRK

SEQ ID NO: 1360739 - protein, 9 aa, Homo Sapiens
HSRYCDWTI

SEQ ID NO: 1360740 - protein, 9 aa, Homo Sapiens
VFIIILMIQ

SEQ ID NO: 1360741 - protein, 9 aa, Homo Sapiens
PSAGGLKAK

SEQ ID NO: 1360742 - protein, 9 aa, Homo Sapiens
LEKKELERG

SEQ ID NO: 1360743 - protein, 9 aa, Homo Sapiens
IDQDYEFIY

SEQ ID NO: 1360744 - protein, 9 aa, Homo Sapiens
IPTSTPSKG

SEQ ID NO: 1360745 - protein, 9 aa, Homo Sapiens
LIEENRQLR

SEQ ID NO: 1360746 - protein, 9 aa, Homo Sapiens
FMRNADLKL

SEQ ID NO: 1360747 - protein, 9 aa, Homo Sapiens
TSLIFLMSI

SEQ ID NO: 1360748 - protein, 9 aa, Homo Sapiens
VVAGEEEQK

SEQ ID NO: 1360749 - protein, 9 aa, Homo Sapiens
DDTDDQIAK

SEQ ID NO: 1360750 - protein, 9 aa, Homo Sapiens
RVTHVREHS

SEQ ID NO: 1360751 - protein, 9 aa, Homo Sapiens
KEQARAVQM

SEQ ID NO: 1360752 - protein, 9 aa, Homo Sapiens
LLNYQDGVL

SEQ ID NO: 1360753 - protein, 9 aa, Homo Sapiens
FAFAGAVRA

SEQ ID NO: 1360754 - protein, 9 aa, Homo Sapiens
KINTEEKPY

SEQ ID NO: 1360755 - protein, 9 aa, Homo Sapiens
DLAPTCRDF

SEQ ID NO: 1360756 - protein, 9 aa, Homo Sapiens
NDISMRLHK

SEQ ID NO: 1360757 - protein, 9 aa, Homo Sapiens
SLPQHMKEF

SEQ ID NO: 1360758 - protein, 9 aa, Homo Sapiens
QEFEVAEKE

SEQ ID NO: 1360759 - protein, 9 aa, Homo Sapiens
TIVTPLLNH

SEQ ID NO: 1360760 - protein, 9 aa, Homo Sapiens
QGVKAERFE

SEQ ID NO: 1360761 - protein, 9 aa, Homo Sapiens
RAFECLDSD

SEQ ID NO: 1360762 - protein, 9 aa, Homo Sapiens
PSWQIMAVK

SEQ ID NO: 1360763 - protein, 9 aa, Homo Sapiens
TFLKMFTIQ

SEQ ID NO: 1360764 - protein, 9 aa, Homo Sapiens
KGVQGVKAE

SEQ ID NO: 1360765 - protein, 9 aa, Homo Sapiens
KQFKGVQGV

SEQ ID NO: 1360766 - protein, 9 aa, Homo Sapiens
MIASPKISR

SEQ ID NO: 1360767 - protein, 9 aa, Homo Sapiens
QICGFHIRS

SEQ ID NO: 1360768 - protein, 9 aa, Homo Sapiens
GQTIINHHI

SEQ ID NO: 1360769 - protein, 9 aa, Homo Sapiens
VMWKNYSNF

SEQ ID NO: 1360770 - protein, 9 aa, Homo Sapiens
SSKEQARAV

SEQ ID NO: 1360771 - protein, 9 aa, Homo Sapiens
VLQGLGPSL

SEQ ID NO: 1360772 - protein, 9 aa, Homo Sapiens
CQVGCIEAL

SEQ ID NO: 1360773 - protein, 9 aa, Homo Sapiens
SVTSPLACL

SEQ ID NO: 1360774 - protein, 9 aa, Homo Sapiens
ESLRAIRYK

SEQ ID NO: 1360775 - protein, 9 aa, Homo Sapiens
CEKCKFYTQ

SEQ ID NO: 1360776 - protein, 9 aa, Homo Sapiens
EIDTPDKFE

SEQ ID NO: 1360777 - protein, 9 aa, Homo Sapiens
WPLQGERPR

SEQ ID NO: 1360778 - protein, 9 aa, Homo Sapiens
LILDGLDKC

SEQ ID NO: 1360779 - protein, 9 aa, Homo Sapiens
GTVMWFDTR

SEQ ID NO: 1360780 - protein, 9 aa, Homo Sapiens
GKVGQGNHG

SEQ ID NO: 1360781 - protein, 9 aa, Homo Sapiens
NRAIAQLFE

SEQ ID NO: 1360782 - protein, 9 aa, Homo Sapiens
FSLNYPGNH

SEQ ID NO: 1360783 - protein, 9 aa, Homo Sapiens
YYYASRVPE

SEQ ID NO: 1360784 - protein, 9 aa, Homo Sapiens
HNFHEPMYF

SEQ ID NO: 1360785 - protein, 9 aa, Homo Sapiens
TPGMDCLWS

SEQ ID NO: 1360786 - protein, 9 aa, Homo Sapiens
RRPTLQSLL

SEQ ID NO: 1360787 - protein, 9 aa, Homo Sapiens
DSDIIMVSD

SEQ ID NO: 1360788 - protein, 9 aa, Homo Sapiens
ASSKTDLSQ

SEQ ID NO: 1360789 - protein, 9 aa, Homo Sapiens
HPQPTSLEH

SEQ ID NO: 1360790 - protein, 9 aa, Homo Sapiens
MSNTLTNEK

SEQ ID NO: 1360791 - protein, 9 aa, Homo Sapiens
IPTMVLDDF

SEQ ID NO: 1360792 - protein, 9 aa, Homo Sapiens
ANMVCSDSP

SEQ ID NO: 1360793 - protein, 9 aa, Homo Sapiens
ALLGAGCNP

SEQ ID NO: 1360794 - protein, 9 aa, Homo Sapiens
FPSLQAAVD

SEQ ID NO: 1360795 - protein, 9 aa, Homo Sapiens
HQQSIPMAF

SEQ ID NO: 1360796 - protein, 9 aa, Homo Sapiens
HLQVPLQTY

SEQ ID NO: 1360797 - protein, 9 aa, Homo Sapiens
TPVNISDNC

SEQ ID NO: 1360798 - protein, 9 aa, Homo Sapiens
FYCRLQDTN

SEQ ID NO: 1360799 - protein, 9 aa, Homo Sapiens
PGREKLKKI

SEQ ID NO: 1360800 - protein, 9 aa, Homo Sapiens
HQQEITKLN

SEQ ID NO: 1360801 - protein, 9 aa, Homo Sapiens
DSQIALVES

SEQ ID NO: 1360802 - protein, 9 aa, Homo Sapiens
TKPPASIHM

SEQ ID NO: 1360803 - protein, 9 aa, Homo Sapiens
EQFERHLTR

SEQ ID NO: 1360804 - protein, 9 aa, Homo Sapiens
PFYTQGDSF

SEQ ID NO: 1360805 - protein, 9 aa, Homo Sapiens
FESSKEQAR

SEQ ID NO: 1360806 - protein, 9 aa, Homo Sapiens
WSLIIMKTL

SEQ ID NO: 1360807 - protein, 9 aa, Homo Sapiens
ISDVTDGAF

SEQ ID NO: 1360808 - protein, 9 aa, Homo Sapiens
HTKNRLLGT

SEQ ID NO: 1360809 - protein, 9 aa, Homo Sapiens
LEKLQYATN

SEQ ID NO: 1360810 - protein, 9 aa, Homo Sapiens
LEKLHNCGV

SEQ ID NO: 1360811 - protein, 9 aa, Homo Sapiens
MSTVSELCI

SEQ ID NO: 1360812 - protein, 9 aa, Homo Sapiens
PDPGHQDPL

SEQ ID NO: 1360813 - protein, 9 aa, Homo Sapiens
SVSSKRSNE

SEQ ID NO: 1360814 - protein, 9 aa, Homo Sapiens
PTQRSPLLN

SEQ ID NO: 1360815 - protein, 9 aa, Homo Sapiens
EFVKQYMSE

SEQ ID NO: 1360816 - protein, 9 aa, Homo Sapiens
ILSYHNGFC

SEQ ID NO: 1360817 - protein, 9 aa, Homo Sapiens
ERNNTLLLL

SEQ ID NO: 1360818 - protein, 9 aa, Homo Sapiens
AFVNQPNYT

SEQ ID NO: 1360819 - protein, 9 aa, Homo Sapiens
LAYCYIILL

SEQ ID NO: 1360820 - protein, 9 aa, Homo Sapiens
LGPQGGAQR

SEQ ID NO: 1360821 - protein, 9 aa, Homo Sapiens
SGLVQGISC

SEQ ID NO: 1360822 - protein, 9 aa, Homo Sapiens
FLTSLLEER

SEQ ID NO: 1360823 - protein, 9 aa, Homo Sapiens
CHVNLKDGN

SEQ ID NO: 1360824 - protein, 9 aa, Homo Sapiens
VFSKEGRYV

SEQ ID NO: 1360825 - protein, 9 aa, Homo Sapiens
ITAILKSKK

SEQ ID NO: 1360826 - protein, 9 aa, Homo Sapiens
IVEEVLKKG

SEQ ID NO: 1360827 - protein, 9 aa, Homo Sapiens
KTYAASFEE

SEQ ID NO: 1360828 - protein, 9 aa, Homo Sapiens
LQDLLTLPL

SEQ ID NO: 1360829 - protein, 9 aa, Homo Sapiens
WLTLCKFHN

SEQ ID NO: 1360830 - protein, 9 aa, Homo Sapiens
LVQGISCSH

SEQ ID NO: 1360831 - protein, 9 aa, Homo Sapiens
KLENQESLV

SEQ ID NO: 1360832 - protein, 9 aa, Homo Sapiens
TDYWTFLKM

SEQ ID NO: 1360833 - protein, 9 aa, Homo Sapiens
PPASIHMEL

SEQ ID NO: 1360834 - protein, 9 aa, Homo Sapiens
LLKSDSVVQ

SEQ ID NO: 1360835 - protein, 9 aa, Homo Sapiens
FGLWHLGLT

SEQ ID NO: 1360836 - protein, 9 aa, Homo Sapiens
MWLNASRDL

SEQ ID NO: 1360837 - protein, 9 aa, Homo Sapiens
RFYFNMIEG

SEQ ID NO: 1360838 - protein, 9 aa, Homo Sapiens
LGSDWEANG

SEQ ID NO: 1360839 - protein, 9 aa, Homo Sapiens
QMEIAQMLE

SEQ ID NO: 1360840 - protein, 9 aa, Homo Sapiens
IIVANIEEV

SEQ ID NO: 1360841 - protein, 9 aa, Homo Sapiens
CNSDNVNHA

SEQ ID NO: 1360842 - protein, 9 aa, Homo Sapiens
HPAQLSNTS

SEQ ID NO: 1360843 - protein, 9 aa, Homo Sapiens
TSGRRLQGT

SEQ ID NO: 1360844 - protein, 9 aa, Homo Sapiens
EWALCGAFT

SEQ ID NO: 1360845 - protein, 9 aa, Homo Sapiens
LRAAPCDSP

SEQ ID NO: 1360846 - protein, 9 aa, Homo Sapiens
SSTDSLPGQ

SEQ ID NO: 1360847 - protein, 9 aa, Homo Sapiens
SSQEVQVPP

SEQ ID NO: 1360848 - protein, 9 aa, Homo Sapiens
WACSTNKPD

SEQ ID NO: 1360849 - protein, 9 aa, Homo Sapiens
AVKAAQQLQ

SEQ ID NO: 1360850 - protein, 9 aa, Homo Sapiens
QGCLKFLLT

SEQ ID NO: 1360851 - protein, 9 aa, Homo Sapiens
VFTLLHPQY

SEQ ID NO: 1360852 - protein, 9 aa, Homo Sapiens
NKHVAKLLL

SEQ ID NO: 1360853 - protein, 9 aa, Homo Sapiens
EAARIKGEG

SEQ ID NO: 1360854 - protein, 9 aa, Homo Sapiens
RAPQSKNGN

SEQ ID NO: 1360855 - protein, 9 aa, Homo Sapiens
PISDVTDGA

SEQ ID NO: 1360856 - protein, 9 aa, Homo Sapiens
VADSRVIST

SEQ ID NO: 1360857 - protein, 9 aa, Homo Sapiens
NEDGTWLTQ

SEQ ID NO: 1360858 - protein, 9 aa, Homo Sapiens
TYHNLKLLQ

SEQ ID NO: 1360859 - protein, 9 aa, Homo Sapiens
VESLLNDAV

SEQ ID NO: 1360860 - protein, 9 aa, Homo Sapiens
YAGFGPQYE

SEQ ID NO: 1360861 - protein, 9 aa, Homo Sapiens
VSDVIDGNQ

SEQ ID NO: 1360862 - protein, 9 aa, Homo Sapiens
DFYLNTWPI

SEQ ID NO: 1360863 - protein, 9 aa, Homo Sapiens
KVEAQPLCP

SEQ ID NO: 1360864 - protein, 9 aa, Homo Sapiens
QNLSVAKGP

SEQ ID NO: 1360865 - protein, 9 aa, Homo Sapiens
ENKVDLDGP

SEQ ID NO: 1360866 - protein, 9 aa, Homo Sapiens
LSMTSTPKA

SEQ ID NO: 1360867 - protein, 9 aa, Homo Sapiens
PPCEYKDLL

SEQ ID NO: 1360868 - protein, 9 aa, Homo Sapiens
QPNYTVWSD

SEQ ID NO: 1360869 - protein, 9 aa, Homo Sapiens
RALHLLTAE

SEQ ID NO: 1360870 - protein, 9 aa, Homo Sapiens
RIYSSDSDD

SEQ ID NO: 1360871 - protein, 9 aa, Homo Sapiens
LYQRLKFKR

SEQ ID NO: 1360872 - protein, 9 aa, Homo Sapiens
IANMIKCVG

SEQ ID NO: 1360873 - protein, 9 aa, Homo Sapiens
IMDSHGVYG

SEQ ID NO: 1360874 - protein, 9 aa, Homo Sapiens
CYKPGACVP

SEQ ID NO: 1360875 - protein, 9 aa, Homo Sapiens
MGSLTFSDV

SEQ ID NO: 1360876 - protein, 9 aa, Homo Sapiens
KMGRKDSVD

SEQ ID NO: 1360877 - protein, 9 aa, Homo Sapiens
LVEVDTWES

SEQ ID NO: 1360878 - protein, 9 aa, Homo Sapiens
HLRVYLRNK

SEQ ID NO: 1360879 - protein, 9 aa, Homo Sapiens
NPGDYALGQ

SEQ ID NO: 1360880 - protein, 9 aa, Homo Sapiens
RVCACTGRD

SEQ ID NO: 1360881 - protein, 9 aa, Homo Sapiens
YHNLKLLQE

SEQ ID NO: 1360882 - protein, 9 aa, Homo Sapiens
LQSLDSVAH

SEQ ID NO: 1360883 - protein, 9 aa, Homo Sapiens
VQRIIVANI

SEQ ID NO: 1360884 - protein, 9 aa, Homo Sapiens
LLMIRLFNL

SEQ ID NO: 1360885 - protein, 9 aa, Homo Sapiens
ALQDTPPKR

SEQ ID NO: 1360886 - protein, 9 aa, Homo Sapiens
FCTVSVGEA

SEQ ID NO: 1360887 - protein, 9 aa, Homo Sapiens
QSHALMKGV

SEQ ID NO: 1360888 - protein, 9 aa, Homo Sapiens
TGPPANSAS

SEQ ID NO: 1360889 - protein, 9 aa, Homo Sapiens
YNDSNGYHV

SEQ ID NO: 1360890 - protein, 9 aa, Homo Sapiens
ALNEKYNKS

SEQ ID NO: 1360891 - protein, 9 aa, Homo Sapiens
LQEEEVTPF

SEQ ID NO: 1360892 - protein, 9 aa, Homo Sapiens
QSHQQSIPM

SEQ ID NO: 1360893 - protein, 9 aa, Homo Sapiens
HRSSLLSHE

SEQ ID NO: 1360894 - protein, 9 aa, Homo Sapiens
HREGEELEY

SEQ ID NO: 1360895 - protein, 9 aa, Homo Sapiens
CGGCAILVA

SEQ ID NO: 1360896 - protein, 9 aa, Homo Sapiens
YFLGLEHPL

SEQ ID NO: 1360897 - protein, 9 aa, Homo Sapiens
TPSFTSQWE

SEQ ID NO: 1360898 - protein, 9 aa, Homo Sapiens
TMPLNVSLT

SEQ ID NO: 1360899 - protein, 9 aa, Homo Sapiens
KITDDSRLC

SEQ ID NO: 1360900 - protein, 9 aa, Homo Sapiens
LLALFNIGL

SEQ ID NO: 1360901 - protein, 9 aa, Homo Sapiens
VWNKRLKEA

SEQ ID NO: 1360902 - protein, 9 aa, Homo Sapiens
TADFHNPGY

SEQ ID NO: 1360903 - protein, 9 aa, Homo Sapiens
LPELRALAG

SEQ ID NO: 1360904 - protein, 9 aa, Homo Sapiens
GDFKNRAKM

SEQ ID NO: 1360905 - protein, 9 aa, Homo Sapiens
DEYDKLAEK

SEQ ID NO: 1360906 - protein, 9 aa, Homo Sapiens
LCDRKQHWL

SEQ ID NO: 1360907 - protein, 9 aa, Homo Sapiens
CHGKPGTPG

SEQ ID NO: 1360908 - protein, 9 aa, Homo Sapiens
YKAHVSGFK

SEQ ID NO: 1360909 - protein, 9 aa, Homo Sapiens
LWKKQFKYG

SEQ ID NO: 1360910 - protein, 9 aa, Homo Sapiens
YTPNTNIAV

SEQ ID NO: 1360911 - protein, 9 aa, Homo Sapiens
NKNILTTWG

SEQ ID NO: 1360912 - protein, 9 aa, Homo Sapiens
TPSKGSTPL

SEQ ID NO: 1360913 - protein, 9 aa, Homo Sapiens
SSMGLMEGL

SEQ ID NO: 1360914 - protein, 9 aa, Homo Sapiens
HGGSSFSVP

SEQ ID NO: 1360915 - protein, 9 aa, Homo Sapiens
EVNFQKIID

SEQ ID NO: 1360916 - protein, 9 aa, Homo Sapiens
TPKAKSTRN

SEQ ID NO: 1360917 - protein, 9 aa, Homo Sapiens
RLKVRKHAE

SEQ ID NO: 1360918 - protein, 9 aa, Homo Sapiens
AGFGPQYEI

SEQ ID NO: 1360919 - protein, 9 aa, Homo Sapiens
PKHKSYLTQ

SEQ ID NO: 1360920 - protein, 9 aa, Homo Sapiens
VQLLPDSFY

SEQ ID NO: 1360921 - protein, 9 aa, Homo Sapiens
FGESHAFSE

SEQ ID NO: 1360922 - protein, 9 aa, Homo Sapiens
CLDSDEELG

SEQ ID NO: 1360923 - protein, 9 aa, Homo Sapiens
WKNFSNGHQ

SEQ ID NO: 1360924 - protein, 9 aa, Homo Sapiens
KKDDTDDQI

SEQ ID NO: 1360925 - protein, 9 aa, Homo Sapiens
LQAKKETLE

SEQ ID NO: 1360926 - protein, 9 aa, Homo Sapiens
FFGLWHLGL

SEQ ID NO: 1360927 - protein, 9 aa, Homo Sapiens
QVCSQIDFT

SEQ ID NO: 1360928 - protein, 9 aa, Homo Sapiens
GRTYRVVAG

SEQ ID NO: 1360929 - protein, 9 aa, Homo Sapiens
SPQTGPPAN

SEQ ID NO: 1360930 - protein, 9 aa, Homo Sapiens
AVEPIDFQI

SEQ ID NO: 1360931 - protein, 9 aa, Homo Sapiens
ALEMKLADF

SEQ ID NO: 1360932 - protein, 9 aa, Homo Sapiens
TLPLQRLQQ

SEQ ID NO: 1360933 - protein, 9 aa, Homo Sapiens
IHKRTHTVE

SEQ ID NO: 1360934 - protein, 9 aa, Homo Sapiens
ANKVAELVH

SEQ ID NO: 1360935 - protein, 9 aa, Homo Sapiens
DGDIDHDHA

SEQ ID NO: 1360936 - protein, 9 aa, Homo Sapiens
KIEIPPRRR

SEQ ID NO: 1360937 - protein, 9 aa, Homo Sapiens
LDSQMEFSK

SEQ ID NO: 1360938 - protein, 9 aa, Homo Sapiens
TKHKIIHTI

SEQ ID NO: 1360939 - protein, 9 aa, Homo Sapiens
LQKTIQDLE

SEQ ID NO: 1360940 - protein, 9 aa, Homo Sapiens
CRKAFNEKT

SEQ ID NO: 1360941 - protein, 9 aa, Homo Sapiens
QLLRAPDTG

SEQ ID NO: 1360942 - protein, 9 aa, Homo Sapiens
SNWAKEVQV

SEQ ID NO: 1360943 - protein, 9 aa, Homo Sapiens
DFQIAPVYA

SEQ ID NO: 1360944 - protein, 9 aa, Homo Sapiens
NWIFGETLC

SEQ ID NO: 1360945 - protein, 9 aa, Homo Sapiens
EQRDSQIAL

SEQ ID NO: 1360946 - protein, 9 aa, Homo Sapiens
NQQRIRQNV

SEQ ID NO: 1360947 - protein, 9 aa, Homo Sapiens
GFGSSNTCS

SEQ ID NO: 1360948 - protein, 9 aa, Homo Sapiens
IQDKNEKDY

SEQ ID NO: 1360949 - protein, 9 aa, Homo Sapiens
LATLRNYYY

SEQ ID NO: 1360950 - protein, 9 aa, Homo Sapiens
VKMGRKDSV

SEQ ID NO: 1360951 - protein, 9 aa, Homo Sapiens
LSYGIPQLS

SEQ ID NO: 1360952 - protein, 9 aa, Homo Sapiens
VIDAYVRIW

SEQ ID NO: 1360953 - protein, 9 aa, Homo Sapiens
KELERGSNL

SEQ ID NO: 1360954 - protein, 9 aa, Homo Sapiens
RVFTLLHPQ

SEQ ID NO: 1360955 - protein, 9 aa, Homo Sapiens
IDTLDNRIR

SEQ ID NO: 1360956 - protein, 9 aa, Homo Sapiens
VRCTLWSRL

SEQ ID NO: 1360957 - protein, 9 aa, Homo Sapiens
STNKPDGYR

SEQ ID NO: 1360958 - protein, 9 aa, Homo Sapiens
IHTQLVLTG

SEQ ID NO: 1360959 - protein, 9 aa, Homo Sapiens
DLKNADPEM

SEQ ID NO: 1360960 - protein, 9 aa, Homo Sapiens
SAPPTTSFQ

SEQ ID NO: 1360961 - protein, 9 aa, Homo Sapiens
QDFENSSTY

SEQ ID NO: 1360962 - protein, 9 aa, Homo Sapiens
VQGISCSHR

SEQ ID NO: 1360963 - protein, 9 aa, Homo Sapiens
QFERHLTRA

SEQ ID NO: 1360964 - protein, 9 aa, Homo Sapiens
PDSHHNDHW

SEQ ID NO: 1360965 - protein, 9 aa, Homo Sapiens
SYHNGFCMF

SEQ ID NO: 1360966 - protein, 9 aa, Homo Sapiens
NNTDIVCSD

SEQ ID NO: 1360967 - protein, 9 aa, Homo Sapiens
NVVVDYRLP

SEQ ID NO: 1360968 - protein, 9 aa, Homo Sapiens
ACQSHALMK

SEQ ID NO: 1360969 - protein, 9 aa, Homo Sapiens
TESPYSDAE

SEQ ID NO: 1360970 - protein, 9 aa, Homo Sapiens
SQIDFTEKS

SEQ ID NO: 1360971 - protein, 9 aa, Homo Sapiens
YKRINSNPG

SEQ ID NO: 1360972 - protein, 9 aa, Homo Sapiens
HRCGKQFNH

SEQ ID NO: 1360973 - protein, 9 aa, Homo Sapiens
EDAAPEENG

SEQ ID NO: 1360974 - protein, 9 aa, Homo Sapiens
GYSFVLFNS

SEQ ID NO: 1360975 - protein, 9 aa, Homo Sapiens
SELNVIAPI

SEQ ID NO: 1360976 - protein, 9 aa, Homo Sapiens
LFQKEHQQY

SEQ ID NO: 1360977 - protein, 9 aa, Homo Sapiens
KHKSYLTQG

SEQ ID NO: 1360978 - protein, 9 aa, Homo Sapiens
CWNPLEQES

SEQ ID NO: 1360979 - protein, 9 aa, Homo Sapiens
LLAFPHGYY

SEQ ID NO: 1360980 - protein, 9 aa, Homo Sapiens
NLPGDRILD

SEQ ID NO: 1360981 - protein, 9 aa, Homo Sapiens
CEILFENPD

SEQ ID NO: 1360982 - protein, 9 aa, Homo Sapiens
PHPYPHSRY

SEQ ID NO: 1360983 - protein, 9 aa, Homo Sapiens
VKRPDLNKK

SEQ ID NO: 1360984 - protein, 9 aa, Homo Sapiens
QELRSQEPQ

SEQ ID NO: 1360985 - protein, 9 aa, Homo Sapiens
EKLAAPWRI

SEQ ID NO: 1360986 - protein, 9 aa, Homo Sapiens
SRVPAGLAS

SEQ ID NO: 1360987 - protein, 9 aa, Homo Sapiens
DLFSDFIML

SEQ ID NO: 1360988 - protein, 9 aa, Homo Sapiens
NLKYLYLGK

SEQ ID NO: 1360989 - protein, 9 aa, Homo Sapiens
ILAVSLEKL

SEQ ID NO: 1360990 - protein, 9 aa, Homo Sapiens
YVGKALEVN

SEQ ID NO: 1360991 - protein, 9 aa, Homo Sapiens
ILMAVIATA

SEQ ID NO: 1360992 - protein, 9 aa, Homo Sapiens
HSVDVMSLS

SEQ ID NO: 1360993 - protein, 9 aa, Homo Sapiens
LMVERCCEI

SEQ ID NO: 1360994 - protein, 9 aa, Homo Sapiens
IIRCKNALS

SEQ ID NO: 1360995 - protein, 9 aa, Homo Sapiens
FENSSTYAF

SEQ ID NO: 1360996 - protein, 9 aa, Homo Sapiens
RVFRASSPE

SEQ ID NO: 1360997 - protein, 9 aa, Homo Sapiens
YAAIFAVMS

SEQ ID NO: 1360998 - protein, 9 aa, Homo Sapiens
GKLTDQCYN

SEQ ID NO: 1360999 - protein, 9 aa, Homo Sapiens
WVFTAAHCN

SEQ ID NO: 1361000 - protein, 9 aa, Homo Sapiens
LFLPHSRGS

SEQ ID NO: 1361001 - protein, 9 aa, Homo Sapiens
AQPAQAWTT

SEQ ID NO: 1361002 - protein, 9 aa, Homo Sapiens
NHEAPMIEC

SEQ ID NO: 1361003 - protein, 9 aa, Homo Sapiens
VKAAQQLQE

SEQ ID NO: 1361004 - protein, 9 aa, Homo Sapiens
LEINHNADK

SEQ ID NO: 1361005 - protein, 9 aa, Homo Sapiens
KLHNCGVPE

SEQ ID NO: 1361006 - protein, 9 aa, Homo Sapiens
KAHVSGFKH

SEQ ID NO: 1361007 - protein, 9 aa, Homo Sapiens
LIYKQLQQQ

SEQ ID NO: 1361008 - protein, 9 aa, Homo Sapiens
VEQRDSQIA

SEQ ID NO: 1361009 - protein, 9 aa, Homo Sapiens
NRYSEQPGS

SEQ ID NO: 1361010 - protein, 9 aa, Homo Sapiens
HYDSRISGG

SEQ ID NO: 1361011 - protein, 9 aa, Homo Sapiens
TDRTASDGK

SEQ ID NO: 1361012 - protein, 9 aa, Homo Sapiens
QKEQAVELY

SEQ ID NO: 1361013 - protein, 9 aa, Homo Sapiens
TVILAGVKM

SEQ ID NO: 1361014 - protein, 9 aa, Homo Sapiens
PYEAENSWE

SEQ ID NO: 1361015 - protein, 9 aa, Homo Sapiens
RQRDLAAEA

SEQ ID NO: 1361016 - protein, 9 aa, Homo Sapiens
WSQESIIAL

SEQ ID NO: 1361017 - protein, 9 aa, Homo Sapiens
LLGSNTVKT

SEQ ID NO: 1361018 - protein, 9 aa, Homo Sapiens
LSNVKRTRN

SEQ ID NO: 1361019 - protein, 9 aa, Homo Sapiens
TLKKRKQDQ

SEQ ID NO: 1361020 - protein, 9 aa, Homo Sapiens
LAVRGDPGS

SEQ ID NO: 1361021 - protein, 9 aa, Homo Sapiens
SLPGSESSL

SEQ ID NO: 1361022 - protein, 9 aa, Homo Sapiens
FRLHNKPTF

SEQ ID NO: 1361023 - protein, 9 aa, Homo Sapiens
DFSHTQMPK

SEQ ID NO: 1361024 - protein, 9 aa, Homo Sapiens
PPVVLFPQS

SEQ ID NO: 1361025 - protein, 9 aa, Homo Sapiens
ETLYTIGDF

SEQ ID NO: 1361026 - protein, 9 aa, Homo Sapiens
TKQATSSRP

SEQ ID NO: 1361027 - protein, 9 aa, Homo Sapiens
EQAVELYKK

SEQ ID NO: 1361028 - protein, 9 aa, Homo Sapiens
AAFSKTKFI

SEQ ID NO: 1361029 - protein, 9 aa, Homo Sapiens
LNDAVSYKA

SEQ ID NO: 1361030 - protein, 9 aa, Homo Sapiens
KATALTIMY

SEQ ID NO: 1361031 - protein, 9 aa, Homo Sapiens
SDFGGEWSI

SEQ ID NO: 1361032 - protein, 9 aa, Homo Sapiens
AKGPNGENG

SEQ ID NO: 1361033 - protein, 9 aa, Homo Sapiens
LLFALDTSN

SEQ ID NO: 1361034 - protein, 9 aa, Homo Sapiens
VQGKQISKG

SEQ ID NO: 1361035 - protein, 9 aa, Homo Sapiens
EFNIKLARQ

SEQ ID NO: 1361036 - protein, 9 aa, Homo Sapiens
SPLASKSSY

SEQ ID NO: 1361037 - protein, 9 aa, Homo Sapiens
TSQQLTQYS

SEQ ID NO: 1361038 - protein, 9 aa, Homo Sapiens
LFSDFIMLR

SEQ ID NO: 1361039 - protein, 9 aa, Homo Sapiens
FQIAPVYAA

SEQ ID NO: 1361040 - protein, 9 aa, Homo Sapiens
LDGTSSKDI

SEQ ID NO: 1361041 - protein, 9 aa, Homo Sapiens
SKVEAQPLC

SEQ ID NO: 1361042 - protein, 9 aa, Homo Sapiens
ALTSLVPDS

SEQ ID NO: 1361043 - protein, 9 aa, Homo Sapiens
SDLTRPEDS

SEQ ID NO: 1361044 - protein, 9 aa, Homo Sapiens
KTCARAGAT

SEQ ID NO: 1361045 - protein, 9 aa, Homo Sapiens
FFKDITSIQ

SEQ ID NO: 1361046 - protein, 9 aa, Homo Sapiens
HGGENRNEN

SEQ ID NO: 1361047 - protein, 9 aa, Homo Sapiens
VDELESHSH

SEQ ID NO: 1361048 - protein, 9 aa, Homo Sapiens
DSFTSEDHL

SEQ ID NO: 1361049 - protein, 9 aa, Homo Sapiens
RAAPCDSPL

SEQ ID NO: 1361050 - protein, 9 aa, Homo Sapiens
SCYPENNYA

SEQ ID NO: 1361051 - protein, 9 aa, Homo Sapiens
RVGIRTVAV

SEQ ID NO: 1361052 - protein, 9 aa, Homo Sapiens
VAVKAAQQL

SEQ ID NO: 1361053 - protein, 9 aa, Homo Sapiens
APWKNGSLV

SEQ ID NO: 1361054 - protein, 9 aa, Homo Sapiens
IDFLNTTPL

SEQ ID NO: 1361055 - protein, 9 aa, Homo Sapiens
SSSFIVIIA

SEQ ID NO: 1361056 - protein, 9 aa, Homo Sapiens
SVISRFLYT

SEQ ID NO: 1361057 - protein, 9 aa, Homo Sapiens
LCDQHKGLY

SEQ ID NO: 1361058 - protein, 9 aa, Homo Sapiens
QQLPKVDLL

SEQ ID NO: 1361059 - protein, 9 aa, Homo Sapiens
LNTWPIFIF

SEQ ID NO: 1361060 - protein, 9 aa, Homo Sapiens
TDAEAVSTL

SEQ ID NO: 1361061 - protein, 9 aa, Homo Sapiens
GTVQGKQIS

SEQ ID NO: 1361062 - protein, 9 aa, Homo Sapiens
SGEVYGTNS

SEQ ID NO: 1361063 - protein, 9 aa, Homo Sapiens
IAKDWVFTA

SEQ ID NO: 1361064 - protein, 9 aa, Homo Sapiens
EFDINICYL

SEQ ID NO: 1361065 - protein, 9 aa, Homo Sapiens
QNRFESSKE

SEQ ID NO: 1361066 - protein, 9 aa, Homo Sapiens
PENLTELSC

SEQ ID NO: 1361067 - protein, 9 aa, Homo Sapiens
IEYKVRKFP

SEQ ID NO: 1361068 - protein, 9 aa, Homo Sapiens
LLGLIIFCF

SEQ ID NO: 1361069 - protein, 9 aa, Homo Sapiens
SSSPAFRLR

SEQ ID NO: 1361070 - protein, 9 aa, Homo Sapiens
TFLRLKGAN

SEQ ID NO: 1361071 - protein, 9 aa, Homo Sapiens
TPAYQIAKT

SEQ ID NO: 1361072 - protein, 9 aa, Homo Sapiens
CIRVCICVC

SEQ ID NO: 1361073 - protein, 9 aa, Homo Sapiens
QDFKKTKSP

SEQ ID NO: 1361074 - protein, 9 aa, Homo Sapiens
KDGCRNGVA

SEQ ID NO: 1361075 - protein, 9 aa, Homo Sapiens
IILTIIIFT

SEQ ID NO: 1361076 - protein, 9 aa, Homo Sapiens
TSAAALLPM

SEQ ID NO: 1361077 - protein, 9 aa, Homo Sapiens
QKFKEEISN

SEQ ID NO: 1361078 - protein, 9 aa, Homo Sapiens
TDEEMEALE

SEQ ID NO: 1361079 - protein, 9 aa, Homo Sapiens
DKNEKDYSQ

SEQ ID NO: 1361080 - protein, 9 aa, Homo Sapiens
GIETTVMTY

SEQ ID NO: 1361081 - protein, 9 aa, Homo Sapiens
PKAPYSYKV

SEQ ID NO: 1361082 - protein, 9 aa, Homo Sapiens
AQEPSNKIG

SEQ ID NO: 1361083 - protein, 9 aa, Homo Sapiens
LEVMHTKNR

SEQ ID NO: 1361084 - protein, 9 aa, Homo Sapiens
LMEADEMDS

SEQ ID NO: 1361085 - protein, 9 aa, Homo Sapiens
TCRDFAKEV

SEQ ID NO: 1361086 - protein, 9 aa, Homo Sapiens
MQTSDGIFN

SEQ ID NO: 1361087 - protein, 9 aa, Homo Sapiens
NVVGATPPA

SEQ ID NO: 1361088 - protein, 9 aa, Homo Sapiens
QRDSQIALV

SEQ ID NO: 1361089 - protein, 9 aa, Homo Sapiens
GTAVQMEIA

SEQ ID NO: 1361090 - protein, 9 aa, Homo Sapiens
DRRAKSKAP

SEQ ID NO: 1361091 - protein, 9 aa, Homo Sapiens
QDLCDRKQH

SEQ ID NO: 1361092 - protein, 9 aa, Homo Sapiens
VVMLDENLL

SEQ ID NO: 1361093 - protein, 9 aa, Homo Sapiens
ASGTNDLRE

SEQ ID NO: 1361094 - protein, 9 aa, Homo Sapiens
HPRAAYGTA

SEQ ID NO: 1361095 - protein, 9 aa, Homo Sapiens
LRCSLLQGS

SEQ ID NO: 1361096 - protein, 9 aa, Homo Sapiens
VKIRFYFNM

SEQ ID NO: 1361097 - protein, 9 aa, Homo Sapiens
MSVYTLSQE

SEQ ID NO: 1361098 - protein, 9 aa, Homo Sapiens
QPGPVRFQD

SEQ ID NO: 1361099 - protein, 9 aa, Homo Sapiens
LNKKTQSKH

SEQ ID NO: 1361100 - protein, 9 aa, Homo Sapiens
MIKCVGNAT

SEQ ID NO: 1361101 - protein, 9 aa, Homo Sapiens
ELFDEPMFI

SEQ ID NO: 1361102 - protein, 9 aa, Homo Sapiens
MLKYIKMTA

SEQ ID NO: 1361103 - protein, 9 aa, Homo Sapiens
REDAQRTVT

SEQ ID NO: 1361104 - protein, 9 aa, Homo Sapiens
PTHTHHASL

SEQ ID NO: 1361105 - protein, 9 aa, Homo Sapiens
THHASLICN

SEQ ID NO: 1361106 - protein, 9 aa, Homo Sapiens
ASIRTADFH

SEQ ID NO: 1361107 - protein, 9 aa, Homo Sapiens
WGWSRTLSR

SEQ ID NO: 1361108 - protein, 9 aa, Homo Sapiens
IVHQRMHTA

SEQ ID NO: 1361109 - protein, 9 aa, Homo Sapiens
AQHFIFMCH

SEQ ID NO: 1361110 - protein, 9 aa, Homo Sapiens
AQLSNTSLA

SEQ ID NO: 1361111 - protein, 9 aa, Homo Sapiens
AKEYRGSFC

SEQ ID NO: 1361112 - protein, 9 aa, Homo Sapiens
ESPYSDAED

SEQ ID NO: 1361113 - protein, 9 aa, Homo Sapiens
VTNAQDFWA

SEQ ID NO: 1361114 - protein, 9 aa, Homo Sapiens
PSHFVKDLL

SEQ ID NO: 1361115 - protein, 9 aa, Homo Sapiens
DQCYNYIRV

SEQ ID NO: 1361116 - protein, 9 aa, Homo Sapiens
ENQELKRKF

SEQ ID NO: 1361117 - protein, 9 aa, Homo Sapiens
LATVEHQEN

SEQ ID NO: 1361118 - protein, 9 aa, Homo Sapiens
DKKWSKVEN

SEQ ID NO: 1361119 - protein, 9 aa, Homo Sapiens
ARMATVVLA

SEQ ID NO: 1361120 - protein, 9 aa, Homo Sapiens
SRYCDWTIT

SEQ ID NO: 1361121 - protein, 9 aa, Homo Sapiens
SVDVMSLSL

SEQ ID NO: 1361122 - protein, 9 aa, Homo Sapiens
LRLGLLKLE

SEQ ID NO: 1361123 - protein, 9 aa, Homo Sapiens
MATVVLAGD

SEQ ID NO: 1361124 - protein, 9 aa, Homo Sapiens
EKANKAITD

SEQ ID NO: 1361125 - protein, 9 aa, Homo Sapiens
QIAKTANEL

SEQ ID NO: 1361126 - protein, 9 aa, Homo Sapiens
RCCEILFEN

SEQ ID NO: 1361127 - protein, 9 aa, Homo Sapiens
LLHGFPELW

SEQ ID NO: 1361128 - protein, 9 aa, Homo Sapiens
GLFSASSLT

SEQ ID NO: 1361129 - protein, 9 aa, Homo Sapiens
YCDWTITVN

SEQ ID NO: 1361130 - protein, 9 aa, Homo Sapiens
SQEVHESLL

SEQ ID NO: 1361131 - protein, 9 aa, Homo Sapiens
TTFSTGEKL

SEQ ID NO: 1361132 - protein, 9 aa, Homo Sapiens
VLIIYEQRH

SEQ ID NO: 1361133 - protein, 9 aa, Homo Sapiens
ISCSHRDED

SEQ ID NO: 1361134 - protein, 9 aa, Homo Sapiens
LKALVPMLK

SEQ ID NO: 1361135 - protein, 9 aa, Homo Sapiens
LELKAQKDN

SEQ ID NO: 1361136 - protein, 9 aa, Homo Sapiens
PCPASPHWP

SEQ ID NO: 1361137 - protein, 9 aa, Homo Sapiens
SAIPDLTDH

SEQ ID NO: 1361138 - protein, 9 aa, Homo Sapiens
TKCQLADTQ

SEQ ID NO: 1361139 - protein, 9 aa, Homo Sapiens
IGRCISTLM

SEQ ID NO: 1361140 - protein, 9 aa, Homo Sapiens
KDYSQKDTS

SEQ ID NO: 1361141 - protein, 9 aa, Homo Sapiens
SKSSYSLLS

SEQ ID NO: 1361142 - protein, 9 aa, Homo Sapiens
SRLCSQVKL

SEQ ID NO: 1361143 - protein, 9 aa, Homo Sapiens
VTFVKLENK

SEQ ID NO: 1361144 - protein, 9 aa, Homo Sapiens
NSNPGSVII

SEQ ID NO: 1361145 - protein, 9 aa, Homo Sapiens
YGNYDSKKH

SEQ ID NO: 1361146 - protein, 9 aa, Homo Sapiens
KNSKLVEVD

SEQ ID NO: 1361147 - protein, 9 aa, Homo Sapiens
EKVKRVYLF

SEQ ID NO: 1361148 - protein, 9 aa, Homo Sapiens
PLDTFVLSI

SEQ ID NO: 1361149 - protein, 9 aa, Homo Sapiens
AIVLPSIVI

SEQ ID NO: 1361150 - protein, 9 aa, Homo Sapiens
FNIKLARQL

SEQ ID NO: 1361151 - protein, 9 aa, Homo Sapiens
SDSDDGSEE

SEQ ID NO: 1361152 - protein, 9 aa, Homo Sapiens
NFYTVVTHR

SEQ ID NO: 1361153 - protein, 9 aa, Homo Sapiens
NKVDLDGPP

SEQ ID NO: 1361154 - protein, 9 aa, Homo Sapiens
YMAEAKAVC

SEQ ID NO: 1361155 - protein, 9 aa, Homo Sapiens
LSREINYCI

SEQ ID NO: 1361156 - protein, 9 aa, Homo Sapiens
RLLQLLRAP

SEQ ID NO: 1361157 - protein, 9 aa, Homo Sapiens
SDASGTNDL

SEQ ID NO: 1361158 - protein, 9 aa, Homo Sapiens
LDTFVLSIK

SEQ ID NO: 1361159 - protein, 9 aa, Homo Sapiens
PSSRYLASQ

SEQ ID NO: 1361160 - protein, 9 aa, Homo Sapiens
VLNSIEQYK

SEQ ID NO: 1361161 - protein, 9 aa, Homo Sapiens
WTTKDEEFI

SEQ ID NO: 1361162 - protein, 9 aa, Homo Sapiens
KEPTWESSG

SEQ ID NO: 1361163 - protein, 9 aa, Homo Sapiens
RPKLQIQKK

SEQ ID NO: 1361164 - protein, 9 aa, Homo Sapiens
VLLKTLRIL

SEQ ID NO: 1361165 - protein, 9 aa, Homo Sapiens
DNPPVVLFP

SEQ ID NO: 1361166 - protein, 9 aa, Homo Sapiens
VLHVKDFQV

SEQ ID NO: 1361167 - protein, 9 aa, Homo Sapiens
EIAVEHLRI

SEQ ID NO: 1361168 - protein, 9 aa, Homo Sapiens
IDFQIAPVY

SEQ ID NO: 1361169 - protein, 9 aa, Homo Sapiens
NYINDNMEQ

SEQ ID NO: 1361170 - protein, 9 aa, Homo Sapiens
PRMKGDGKT

SEQ ID NO: 1361171 - protein, 9 aa, Homo Sapiens
ANVCLDHII

SEQ ID NO: 1361172 - protein, 9 aa, Homo Sapiens
PASPHWPPK

SEQ ID NO: 1361173 - protein, 9 aa, Homo Sapiens
FEFHGDHAV

SEQ ID NO: 1361174 - protein, 9 aa, Homo Sapiens
TLKLHQSKT

SEQ ID NO: 1361175 - protein, 9 aa, Homo Sapiens
LPEYDLVCI

SEQ ID NO: 1361176 - protein, 9 aa, Homo Sapiens
GLSANNIPL

SEQ ID NO: 1361177 - protein, 9 aa, Homo Sapiens
SPKTLLGSN

SEQ ID NO: 1361178 - protein, 9 aa, Homo Sapiens
LGSPRVFRA

SEQ ID NO: 1361179 - protein, 9 aa, Homo Sapiens
HLTRAQMVE

SEQ ID NO: 1361180 - protein, 9 aa, Homo Sapiens
ATGPSAAQE

SEQ ID NO: 1361181 - protein, 9 aa, Homo Sapiens
SSPAFRLRS

SEQ ID NO: 1361182 - protein, 9 aa, Homo Sapiens
EASESAIPD

SEQ ID NO: 1361183 - protein, 9 aa, Homo Sapiens
YCDVCKMSC

SEQ ID NO: 1361184 - protein, 9 aa, Homo Sapiens
GFFHREGEE

SEQ ID NO: 1361185 - protein, 9 aa, Homo Sapiens
PEVELLDQP

SEQ ID NO: 1361186 - protein, 9 aa, Homo Sapiens
RGIPMTKNL

SEQ ID NO: 1361187 - protein, 9 aa, Homo Sapiens
INVSKMLRA

SEQ ID NO: 1361188 - protein, 9 aa, Homo Sapiens
RISKCNDLK

SEQ ID NO: 1361189 - protein, 9 aa, Homo Sapiens
KYANKSVKV

SEQ ID NO: 1361190 - protein, 9 aa, Homo Sapiens
MLQKVEVQY

SEQ ID NO: 1361191 - protein, 9 aa, Homo Sapiens
VGDAIQAII

SEQ ID NO: 1361192 - protein, 9 aa, Homo Sapiens
GCSVSHHRP

SEQ ID NO: 1361193 - protein, 9 aa, Homo Sapiens
APTCRDFAK

SEQ ID NO: 1361194 - protein, 9 aa, Homo Sapiens
NEKTGFVRR

SEQ ID NO: 1361195 - protein, 9 aa, Homo Sapiens
LDIPCVIAA

SEQ ID NO: 1361196 - protein, 9 aa, Homo Sapiens
SSIQSTLSL

SEQ ID NO: 1361197 - protein, 9 aa, Homo Sapiens
SFIVIIAQL

SEQ ID NO: 1361198 - protein, 9 aa, Homo Sapiens
PYRIHLDLV

SEQ ID NO: 1361199 - protein, 9 aa, Homo Sapiens
KLKKIKTGR

SEQ ID NO: 1361200 - protein, 9 aa, Homo Sapiens
SDGIFNPSS

SEQ ID NO: 1361201 - protein, 9 aa, Homo Sapiens
LKKRKQDQE

SEQ ID NO: 1361202 - protein, 9 aa, Homo Sapiens
LHHGEKAYR

SEQ ID NO: 1361203 - protein, 9 aa, Homo Sapiens
LDTRSCKAP

SEQ ID NO: 1361204 - protein, 9 aa, Homo Sapiens
LLFGYKNPD

SEQ ID NO: 1361205 - protein, 9 aa, Homo Sapiens
EQRHSKRKT

SEQ ID NO: 1361206 - protein, 9 aa, Homo Sapiens
NDLKSPGSP

SEQ ID NO: 1361207 - protein, 9 aa, Homo Sapiens
YDQVEFDVH

SEQ ID NO: 1361208 - protein, 9 aa, Homo Sapiens
AGEEEQKFE

SEQ ID NO: 1361209 - protein, 9 aa, Homo Sapiens
ILLLEQLFL

SEQ ID NO: 1361210 - protein, 9 aa, Homo Sapiens
PVYQMKFPD

SEQ ID NO: 1361211 - protein, 9 aa, Homo Sapiens
TPDKFERTC

SEQ ID NO: 1361212 - protein, 9 aa, Homo Sapiens
QNVSLPSIK

SEQ ID NO: 1361213 - protein, 9 aa, Homo Sapiens
SLIIMKTLI

SEQ ID NO: 1361214 - protein, 9 aa, Homo Sapiens
EVEDNVAFL

SEQ ID NO: 1361215 - protein, 9 aa, Homo Sapiens
IEDLKGQLE

SEQ ID NO: 1361216 - protein, 9 aa, Homo Sapiens
KNCMIGLSD

SEQ ID NO: 1361217 - protein, 9 aa, Homo Sapiens
SAPKVLVTV

SEQ ID NO: 1361218 - protein, 9 aa, Homo Sapiens
VKTTPTQRS

SEQ ID NO: 1361219 - protein, 9 aa, Homo Sapiens
GCRNGVACI

SEQ ID NO: 1361220 - protein, 9 aa, Homo Sapiens
KFEAEGVPE

SEQ ID NO: 1361221 - protein, 9 aa, Homo Sapiens
AANCVNIHM

SEQ ID NO: 1361222 - protein, 9 aa, Homo Sapiens
DRYEIYSLI

SEQ ID NO: 1361223 - protein, 9 aa, Homo Sapiens
VINVSKMLR

SEQ ID NO: 1361224 - protein, 9 aa, Homo Sapiens
LFSVLCKIK

SEQ ID NO: 1361225 - protein, 9 aa, Homo Sapiens
DVQKVKDRA

SEQ ID NO: 1361226 - protein, 9 aa, Homo Sapiens
STSLQSSQE

SEQ ID NO: 1361227 - protein, 9 aa, Homo Sapiens
YSYYLNGNL

SEQ ID NO: 1361228 - protein, 9 aa, Homo Sapiens
EMEALEMKL

SEQ ID NO: 1361229 - protein, 9 aa, Homo Sapiens
QAWTTFRVG

SEQ ID NO: 1361230 - protein, 9 aa, Homo Sapiens
EAEGTQEGG

SEQ ID NO: 1361231 - protein, 9 aa, Homo Sapiens
IQYKVCNNN

SEQ ID NO: 1361232 - protein, 9 aa, Homo Sapiens
EQSLLDSQM

SEQ ID NO: 1361233 - protein, 9 aa, Homo Sapiens
QDVHKDIHD

SEQ ID NO: 1361234 - protein, 9 aa, Homo Sapiens
FCLEELIMT

SEQ ID NO: 1361235 - protein, 9 aa, Homo Sapiens
HGGSFILSS

SEQ ID NO: 1361236 - protein, 9 aa, Homo Sapiens
VTNVLNWVR

SEQ ID NO: 1361237 - protein, 9 aa, Homo Sapiens
HSTTIIMRD

SEQ ID NO: 1361238 - protein, 9 aa, Homo Sapiens
SKNGNPSAS

SEQ ID NO: 1361239 - protein, 9 aa, Homo Sapiens
EGFHKAGIS

SEQ ID NO: 1361240 - protein, 9 aa, Homo Sapiens
VSLTNRNYD

SEQ ID NO: 1361241 - protein, 9 aa, Homo Sapiens
IHLAARNGQ

SEQ ID NO: 1361242 - protein, 9 aa, Homo Sapiens
FKDITSIQL

SEQ ID NO: 1361243 - protein, 9 aa, Homo Sapiens
SIQKFKEEI

SEQ ID NO: 1361244 - protein, 9 aa, Homo Sapiens
TVAGKHFTV

SEQ ID NO: 1361245 - protein, 9 aa, Homo Sapiens
NGVACIAAN

SEQ ID NO: 1361246 - protein, 9 aa, Homo Sapiens
QEITKLNTD

SEQ ID NO: 1361247 - protein, 9 aa, Homo Sapiens
SLEMSNTLT

SEQ ID NO: 1361248 - protein, 9 aa, Homo Sapiens
DWRPDMSPC

SEQ ID NO: 1361249 - protein, 9 aa, Homo Sapiens
AEEKANKAI

SEQ ID NO: 1361250 - protein, 9 aa, Homo Sapiens
STDSLPGQI

SEQ ID NO: 1361251 - protein, 9 aa, Homo Sapiens
ALFGQGSGP

SEQ ID NO: 1361252 - protein, 9 aa, Homo Sapiens
TTTVVFWQW

SEQ ID NO: 1361253 - protein, 9 aa, Homo Sapiens
ITLFNDWEH

SEQ ID NO: 1361254 - protein, 9 aa, Homo Sapiens
SEQGLDYLG

SEQ ID NO: 1361255 - protein, 9 aa, Homo Sapiens
YTLTPGPSA

SEQ ID NO: 1361256 - protein, 9 aa, Homo Sapiens
QLQSVIHNN

SEQ ID NO: 1361257 - protein, 9 aa, Homo Sapiens
VWQEFEVAE

SEQ ID NO: 1361258 - protein, 9 aa, Homo Sapiens
GGLLTEPLW

SEQ ID NO: 1361259 - protein, 9 aa, Homo Sapiens
LVSHPQVAL

SEQ ID NO: 1361260 - protein, 9 aa, Homo Sapiens
AHRQLAVFK

SEQ ID NO: 1361261 - protein, 9 aa, Homo Sapiens
CNDLKSPGS

SEQ ID NO: 1361262 - protein, 9 aa, Homo Sapiens
ATGTSAEQL

SEQ ID NO: 1361263 - protein, 9 aa, Homo Sapiens
FLRLKGANK

SEQ ID NO: 1361264 - protein, 9 aa, Homo Sapiens
TSYAGGTNF

SEQ ID NO: 1361265 - protein, 9 aa, Homo Sapiens
FHGDHAVLC

SEQ ID NO: 1361266 - protein, 9 aa, Homo Sapiens
GFAGHSVDV

SEQ ID NO: 1361267 - protein, 9 aa, Homo Sapiens
ITSIQLLPS

SEQ ID NO: 1361268 - protein, 9 aa, Homo Sapiens
PAFRLRSAK

SEQ ID NO: 1361269 - protein, 9 aa, Homo Sapiens
LMKVNYNQT

SEQ ID NO: 1361270 - protein, 9 aa, Homo Sapiens
SHERLQDLK

SEQ ID NO: 1361271 - protein, 9 aa, Homo Sapiens
ASRDLDRIN

SEQ ID NO: 1361272 - protein, 9 aa, Homo Sapiens
CNEADLCDQ

SEQ ID NO: 1361273 - protein, 9 aa, Homo Sapiens
ACVIIVGNL

SEQ ID NO: 1361274 - protein, 9 aa, Homo Sapiens
HTHTGVSTW

SEQ ID NO: 1361275 - protein, 9 aa, Homo Sapiens
GGDVGQIFY

SEQ ID NO: 1361276 - protein, 9 aa, Homo Sapiens
SLLAIRTVR

SEQ ID NO: 1361277 - protein, 9 aa, Homo Sapiens
MTPAVYATY

SEQ ID NO: 1361278 - protein, 9 aa, Homo Sapiens
NNDFNTTEK

SEQ ID NO: 1361279 - protein, 9 aa, Homo Sapiens
PHGGENRNE

SEQ ID NO: 1361280 - protein, 9 aa, Homo Sapiens
NRFESSKEQ

SEQ ID NO: 1361281 - protein, 9 aa, Homo Sapiens
ILEVMHTKN

SEQ ID NO: 1361282 - protein, 9 aa, Homo Sapiens
LNYQDGVLD

SEQ ID NO: 1361283 - protein, 9 aa, Homo Sapiens
VMDQELSRR

SEQ ID NO: 1361284 - protein, 9 aa, Homo Sapiens
VGMAVDMHE

SEQ ID NO: 1361285 - protein, 9 aa, Homo Sapiens
DGSEEDKAQ

SEQ ID NO: 1361286 - protein, 9 aa, Homo Sapiens
AKKETLESK

SEQ ID NO: 1361287 - protein, 9 aa, Homo Sapiens
LVPMLKLAR

SEQ ID NO: 1361288 - protein, 9 aa, Homo Sapiens
LAGIARNSR

SEQ ID NO: 1361289 - protein, 9 aa, Homo Sapiens
YIILTIIIF

SEQ ID NO: 1361290 - protein, 9 aa, Homo Sapiens
NALFGQGSG

SEQ ID NO: 1361291 - protein, 9 aa, Homo Sapiens
LDCNSFYKI

SEQ ID NO: 1361292 - protein, 9 aa, Homo Sapiens
TEYIRTSGG

SEQ ID NO: 1361293 - protein, 9 aa, Homo Sapiens
QNRRALHLL

SEQ ID NO: 1361294 - protein, 9 aa, Homo Sapiens
KLERKIIGI

SEQ ID NO: 1361295 - protein, 9 aa, Homo Sapiens
CGEALRAAP

SEQ ID NO: 1361296 - protein, 9 aa, Homo Sapiens
WRYSYYLNG

SEQ ID NO: 1361297 - protein, 9 aa, Homo Sapiens
VAWNFKKFL

SEQ ID NO: 1361298 - protein, 9 aa, Homo Sapiens
QQHGSGQIQ

SEQ ID NO: 1361299 - protein, 9 aa, Homo Sapiens
TDDSRLCSQ

SEQ ID NO: 1361300 - protein, 9 aa, Homo Sapiens
TKNSKLVEV

SEQ ID NO: 1361301 - protein, 9 aa, Homo Sapiens
SHGGSSFSV

SEQ ID NO: 1361302 - protein, 9 aa, Homo Sapiens
FKQKESLKN

SEQ ID NO: 1361303 - protein, 9 aa, Homo Sapiens
GAWEQVYLS

SEQ ID NO: 1361304 - protein, 9 aa, Homo Sapiens
SDVAIEFSL

SEQ ID NO: 1361305 - protein, 9 aa, Homo Sapiens
APPCEYKDL

SEQ ID NO: 1361306 - protein, 9 aa, Homo Sapiens
RKSVTDCVL

SEQ ID NO: 1361307 - protein, 9 aa, Homo Sapiens
YIKMTATCL

SEQ ID NO: 1361308 - protein, 9 aa, Homo Sapiens
GSVDIVEEV

SEQ ID NO: 1361309 - protein, 9 aa, Homo Sapiens
DVDSNAIIK

SEQ ID NO: 1361310 - protein, 9 aa, Homo Sapiens
QGDFKNRAK

SEQ ID NO: 1361311 - protein, 9 aa, Homo Sapiens
ADGREPGDM

SEQ ID NO: 1361312 - protein, 9 aa, Homo Sapiens
SNTVKTPTT

SEQ ID NO: 1361313 - protein, 9 aa, Homo Sapiens
RIHNGESIA

SEQ ID NO: 1361314 - protein, 9 aa, Homo Sapiens
LCNELSSIQ

SEQ ID NO: 1361315 - protein, 9 aa, Homo Sapiens
EYKDLLTKM

SEQ ID NO: 1361316 - protein, 9 aa, Homo Sapiens
TVSELCITA

SEQ ID NO: 1361317 - protein, 9 aa, Homo Sapiens
REKRFCTVS

SEQ ID NO: 1361318 - protein, 9 aa, Homo Sapiens
LKMFTIQLA

SEQ ID NO: 1361319 - protein, 9 aa, Homo Sapiens
PNDPLGPID

SEQ ID NO: 1361320 - protein, 9 aa, Homo Sapiens
FIYYECLAK

SEQ ID NO: 1361321 - protein, 9 aa, Homo Sapiens
PRNSLPQHM

SEQ ID NO: 1361322 - protein, 9 aa, Homo Sapiens
GLKAKGQLK

SEQ ID NO: 1361323 - protein, 9 aa, Homo Sapiens
VNVGMVVVT

SEQ ID NO: 1361324 - protein, 9 aa, Homo Sapiens
VSNDISMRL

SEQ ID NO: 1361325 - protein, 9 aa, Homo Sapiens
LRAPQSKNG

SEQ ID NO: 1361326 - protein, 9 aa, Homo Sapiens
TVMWFDTRI

SEQ ID NO: 1361327 - protein, 9 aa, Homo Sapiens
IWLGLFDAL

SEQ ID NO: 1361328 - protein, 9 aa, Homo Sapiens
MLVPYDTLT

SEQ ID NO: 1361329 - protein, 9 aa, Homo Sapiens
RKAFNEKTG

SEQ ID NO: 1361330 - protein, 9 aa, Homo Sapiens
VPARHSTSQ

SEQ ID NO: 1361331 - protein, 9 aa, Homo Sapiens
QEDKGRANG

SEQ ID NO: 1361332 - protein, 9 aa, Homo Sapiens
VYGTNSEWE

SEQ ID NO: 1361333 - protein, 9 aa, Homo Sapiens
PELWYSWRY

SEQ ID NO: 1361334 - protein, 9 aa, Homo Sapiens
ILIPVSRNI

SEQ ID NO: 1361335 - protein, 9 aa, Homo Sapiens
ILEKSYKPQ

SEQ ID NO: 1361336 - protein, 9 aa, Homo Sapiens
STVSELCIT

SEQ ID NO: 1361337 - protein, 9 aa, Homo Sapiens
DLSDKKVYA

SEQ ID NO: 1361338 - protein, 9 aa, Homo Sapiens
FLVLMLAGA

SEQ ID NO: 1361339 - protein, 9 aa, Homo Sapiens
KVNPSLLPV

SEQ ID NO: 1361340 - protein, 9 aa, Homo Sapiens
NFPAGSHER

SEQ ID NO: 1361341 - protein, 9 aa, Homo Sapiens
RREIQNLKV

SEQ ID NO: 1361342 - protein, 9 aa, Homo Sapiens
SSHHVSTPV

SEQ ID NO: 1361343 - protein, 9 aa, Homo Sapiens
NADARNWDL

SEQ ID NO: 1361344 - protein, 9 aa, Homo Sapiens
TKLQHLCVA

SEQ ID NO: 1361345 - protein, 9 aa, Homo Sapiens
VRFQDRRQE

SEQ ID NO: 1361346 - protein, 9 aa, Homo Sapiens
EQKIIDFIA

SEQ ID NO: 1361347 - protein, 9 aa, Homo Sapiens
AGKHFTVLK

SEQ ID NO: 1361348 - protein, 9 aa, Homo Sapiens
EIENEDEVE

SEQ ID NO: 1361349 - protein, 9 aa, Homo Sapiens
SSQLALANM

SEQ ID NO: 1361350 - protein, 9 aa, Homo Sapiens
NLIEARPCS

SEQ ID NO: 1361351 - protein, 9 aa, Homo Sapiens
TVILSILFY

SEQ ID NO: 1361352 - protein, 9 aa, Homo Sapiens
TKDFHHIVF

SEQ ID NO: 1361353 - protein, 9 aa, Homo Sapiens
QCYNYIRVL

SEQ ID NO: 1361354 - protein, 9 aa, Homo Sapiens
SKAPAISSA

SEQ ID NO: 1361355 - protein, 9 aa, Homo Sapiens
DEPMFITVV

SEQ ID NO: 1361356 - protein, 9 aa, Homo Sapiens
PDHLMPDPS

SEQ ID NO: 1361357 - protein, 9 aa, Homo Sapiens
PYTTAPKIA

SEQ ID NO: 1361358 - protein, 9 aa, Homo Sapiens
MVTTAVIIT

SEQ ID NO: 1361359 - protein, 9 aa, Homo Sapiens
CCKGPPPAL

SEQ ID NO: 1361360 - protein, 9 aa, Homo Sapiens
SNPGDYALG

SEQ ID NO: 1361361 - protein, 9 aa, Homo Sapiens
QFTVAGKHF

SEQ ID NO: 1361362 - protein, 9 aa, Homo Sapiens
HVGSRGDCY

SEQ ID NO: 1361363 - protein, 9 aa, Homo Sapiens
PDSAAGEIE

SEQ ID NO: 1361364 - protein, 9 aa, Homo Sapiens
IADLRLKVR

SEQ ID NO: 1361365 - protein, 9 aa, Homo Sapiens
RNKKRLLQL

SEQ ID NO: 1361366 - protein, 9 aa, Homo Sapiens
IESTNNTGN

SEQ ID NO: 1361367 - protein, 9 aa, Homo Sapiens
SLFVLDGTS

SEQ ID NO: 1361368 - protein, 9 aa, Homo Sapiens
QTHFESKIE

SEQ ID NO: 1361369 - protein, 9 aa, Homo Sapiens
TFSTGEKLA

SEQ ID NO: 1361370 - protein, 9 aa, Homo Sapiens
IVDNQSFPY

SEQ ID NO: 1361371 - protein, 9 aa, Homo Sapiens
SYTTNAFSG

SEQ ID NO: 1361372 - protein, 9 aa, Homo Sapiens
AYVNMSNHY

SEQ ID NO: 1361373 - protein, 9 aa, Homo Sapiens
INWEDHLRL

SEQ ID NO: 1361374 - protein, 9 aa, Homo Sapiens
EPLELAKRG

SEQ ID NO: 1361375 - protein, 9 aa, Homo Sapiens
CLSLQSRWN

SEQ ID NO: 1361376 - protein, 9 aa, Homo Sapiens
YRGSFCYKP

SEQ ID NO: 1361377 - protein, 9 aa, Homo Sapiens
IETTVMTYA

SEQ ID NO: 1361378 - protein, 9 aa, Homo Sapiens
TSDSDIIMV

SEQ ID NO: 1361379 - protein, 9 aa, Homo Sapiens
INLKQHLQI

SEQ ID NO: 1361380 - protein, 9 aa, Homo Sapiens
PHWPPKVLG

SEQ ID NO: 1361381 - protein, 9 aa, Homo Sapiens
EALRAAPCD

SEQ ID NO: 1361382 - protein, 9 aa, Homo Sapiens
HHIVFGAPG

SEQ ID NO: 1361383 - protein, 9 aa, Homo Sapiens
RRESTQTYG

SEQ ID NO: 1361384 - protein, 9 aa, Homo Sapiens
PLCPLDERA

SEQ ID NO: 1361385 - protein, 9 aa, Homo Sapiens
NSIEQYKAH

SEQ ID NO: 1361386 - protein, 9 aa, Homo Sapiens
DGFCVFDSN

SEQ ID NO: 1361387 - protein, 9 aa, Homo Sapiens
LSSQRNIAL

SEQ ID NO: 1361388 - protein, 9 aa, Homo Sapiens
QLCFDDELV

SEQ ID NO: 1361389 - protein, 9 aa, Homo Sapiens
TIIIFTIVG

SEQ ID NO: 1361390 - protein, 9 aa, Homo Sapiens
HPKQEGLAA

SEQ ID NO: 1361391 - protein, 9 aa, Homo Sapiens
QQVVFACLA

SEQ ID NO: 1361392 - protein, 9 aa, Homo Sapiens
DSGLVQGIS

SEQ ID NO: 1361393 - protein, 9 aa, Homo Sapiens
EILEKSYKP

SEQ ID NO: 1361394 - protein, 9 aa, Homo Sapiens
VKTYAASFE

SEQ ID NO: 1361395 - protein, 9 aa, Homo Sapiens
DKYANKSVK

SEQ ID NO: 1361396 - protein, 9 aa, Homo Sapiens
VYTLSQEKY

SEQ ID NO: 1361397 - protein, 9 aa, Homo Sapiens
IIILMIQYK

SEQ ID NO: 1361398 - protein, 9 aa, Homo Sapiens
CKMSCAGPQ

SEQ ID NO: 1361399 - protein, 9 aa, Homo Sapiens
AHVKRPDLN

SEQ ID NO: 1361400 - protein, 9 aa, Homo Sapiens
NEDEVERVL

SEQ ID NO: 1361401 - protein, 9 aa, Homo Sapiens
IIMRDPDEL

SEQ ID NO: 1361402 - protein, 9 aa, Homo Sapiens
VSEEVESSE

SEQ ID NO: 1361403 - protein, 9 aa, Homo Sapiens
SKDLGLEPL

SEQ ID NO: 1361404 - protein, 9 aa, Homo Sapiens
THTHHASLI

SEQ ID NO: 1361405 - protein, 9 aa, Homo Sapiens
ASESAIPDL

SEQ ID NO: 1361406 - protein, 9 aa, Homo Sapiens
STRGWALSS

SEQ ID NO: 1361407 - protein, 9 aa, Homo Sapiens
NLSLDSSYV

SEQ ID NO: 1361408 - protein, 9 aa, Homo Sapiens
DLCDRKQHW

SEQ ID NO: 1361409 - protein, 9 aa, Homo Sapiens
VFRHPHIIK

SEQ ID NO: 1361410 - protein, 9 aa, Homo Sapiens
DFKNRAKMI

SEQ ID NO: 1361411 - protein, 9 aa, Homo Sapiens
ILTIIIFTI

SEQ ID NO: 1361412 - protein, 9 aa, Homo Sapiens
KRQQQKLER

SEQ ID NO: 1361413 - protein, 9 aa, Homo Sapiens
NVEQDFIDL

SEQ ID NO: 1361414 - protein, 9 aa, Homo Sapiens
KIHSIAWCP

SEQ ID NO: 1361415 - protein, 9 aa, Homo Sapiens
LTFSDVAIE

SEQ ID NO: 1361416 - protein, 9 aa, Homo Sapiens
NEKDYSQKD

SEQ ID NO: 1361417 - protein, 9 aa, Homo Sapiens
RIQDFVRHV

SEQ ID NO: 1361418 - protein, 9 aa, Homo Sapiens
FSRVYELRN

SEQ ID NO: 1361419 - protein, 9 aa, Homo Sapiens
IVFPRRISV

SEQ ID NO: 1361420 - protein, 9 aa, Homo Sapiens
LSQGKVFSR

SEQ ID NO: 1361421 - protein, 9 aa, Homo Sapiens
AKEVQVISE

SEQ ID NO: 1361422 - protein, 9 aa, Homo Sapiens
VSRNIISFI

SEQ ID NO: 1361423 - protein, 9 aa, Homo Sapiens
LQGFFHREG

SEQ ID NO: 1361424 - protein, 9 aa, Homo Sapiens
LTKHKKINT

SEQ ID NO: 1361425 - protein, 9 aa, Homo Sapiens
GRYFSHATA

SEQ ID NO: 1361426 - protein, 9 aa, Homo Sapiens
MIFLIAVSS

SEQ ID NO: 1361427 - protein, 9 aa, Homo Sapiens
VVQVGLDTT

SEQ ID NO: 1361428 - protein, 9 aa, Homo Sapiens
IHKRFKSSE

SEQ ID NO: 1361429 - protein, 9 aa, Homo Sapiens
LLLHGFPEL

SEQ ID NO: 1361430 - protein, 9 aa, Homo Sapiens
PTRSLSCLI

SEQ ID NO: 1361431 - protein, 9 aa, Homo Sapiens
KQATSSRPN

SEQ ID NO: 1361432 - protein, 9 aa, Homo Sapiens
TESAPAQCK

SEQ ID NO: 1361433 - protein, 9 aa, Homo Sapiens
KTDLSQTIS

SEQ ID NO: 1361434 - protein, 9 aa, Homo Sapiens
IRIPTMVLD

SEQ ID NO: 1361435 - protein, 9 aa, Homo Sapiens
VSQAFVPLT

SEQ ID NO: 1361436 - protein, 9 aa, Homo Sapiens
AIVMQGTVI

SEQ ID NO: 1361437 - protein, 9 aa, Homo Sapiens
ALLLAFPHG

SEQ ID NO: 1361438 - protein, 9 aa, Homo Sapiens
KFDWNHLLE

SEQ ID NO: 1361439 - protein, 9 aa, Homo Sapiens
VLQNRRALH

SEQ ID NO: 1361440 - protein, 9 aa, Homo Sapiens
SAAPDPGCP

SEQ ID NO: 1361441 - protein, 9 aa, Homo Sapiens
GERILKCFN

SEQ ID NO: 1361442 - protein, 9 aa, Homo Sapiens
GVQGVKAER

SEQ ID NO: 1361443 - protein, 9 aa, Homo Sapiens
QRAKMPQTR

SEQ ID NO: 1361444 - protein, 9 aa, Homo Sapiens
ICEDHQMRN

SEQ ID NO: 1361445 - protein, 9 aa, Homo Sapiens
LLLYWVLEM

SEQ ID NO: 1361446 - protein, 9 aa, Homo Sapiens
AEQAALRHK

SEQ ID NO: 1361447 - protein, 9 aa, Homo Sapiens
RKFPFAANS

SEQ ID NO: 1361448 - protein, 9 aa, Homo Sapiens
QLQQQAVTG

SEQ ID NO: 1361449 - protein, 9 aa, Homo Sapiens
HGKFIARAQ

SEQ ID NO: 1361450 - protein, 9 aa, Homo Sapiens
APYSYKVQD

SEQ ID NO: 1361451 - protein, 9 aa, Homo Sapiens
WRAQMNLYV

SEQ ID NO: 1361452 - protein, 9 aa, Homo Sapiens
KHVAKLLLN

SEQ ID NO: 1361453 - protein, 9 aa, Homo Sapiens
DTFVLSIKV

SEQ ID NO: 1361454 - protein, 9 aa, Homo Sapiens
KLARKCEQV

SEQ ID NO: 1361455 - protein, 9 aa, Homo Sapiens
HLDQSLEMS

SEQ ID NO: 1361456 - protein, 9 aa, Homo Sapiens
QLQEGQRCV

SEQ ID NO: 1361457 - protein, 9 aa, Homo Sapiens
YYNDSNGYH

SEQ ID NO: 1361458 - protein, 9 aa, Homo Sapiens
NMQQHFEFE

SEQ ID NO: 1361459 - protein, 9 aa, Homo Sapiens
VMHTKNRLL

SEQ ID NO: 1361460 - protein, 9 aa, Homo Sapiens
VYIEVKDVN

SEQ ID NO: 1361461 - protein, 9 aa, Homo Sapiens
IIQDFENSS

SEQ ID NO: 1361462 - protein, 9 aa, Homo Sapiens
EDHQMRNHS

SEQ ID NO: 1361463 - protein, 9 aa, Homo Sapiens
KSSYSLLSP

SEQ ID NO: 1361464 - protein, 9 aa, Homo Sapiens
QGGIAPSYD

SEQ ID NO: 1361465 - protein, 9 aa, Homo Sapiens
SSVASATYV

SEQ ID NO: 1361466 - protein, 9 aa, Homo Sapiens
TTNAFSGEY

SEQ ID NO: 1361467 - protein, 9 aa, Homo Sapiens
QRKFLEEEQ

SEQ ID NO: 1361468 - protein, 9 aa, Homo Sapiens
CNGSLMKVN

SEQ ID NO: 1361469 - protein, 9 aa, Homo Sapiens
FYRKTTTVV

SEQ ID NO: 1361470 - protein, 9 aa, Homo Sapiens
VLQPELSYG

SEQ ID NO: 1361471 - protein, 9 aa, Homo Sapiens
LEWCFINSN

SEQ ID NO: 1361472 - protein, 9 aa, Homo Sapiens
KTPVEWALC

SEQ ID NO: 1361473 - protein, 9 aa, Homo Sapiens
CRRSHHCRC

SEQ ID NO: 1361474 - protein, 9 aa, Homo Sapiens
EKKELERGS

SEQ ID NO: 1361475 - protein, 9 aa, Homo Sapiens
HSVQIPVFV

SEQ ID NO: 1361476 - protein, 9 aa, Homo Sapiens
SWEELDQRY

SEQ ID NO: 1361477 - protein, 9 aa, Homo Sapiens
LLENLLHGA

SEQ ID NO: 1361478 - protein, 9 aa, Homo Sapiens
SAQPHCQQG

SEQ ID NO: 1361479 - protein, 9 aa, Homo Sapiens
FPHGGENRN

SEQ ID NO: 1361480 - protein, 9 aa, Homo Sapiens
FGQTIINHH

SEQ ID NO: 1361481 - protein, 9 aa, Homo Sapiens
DEDAQAMEC

SEQ ID NO: 1361482 - protein, 9 aa, Homo Sapiens
PWAAPSATQ

SEQ ID NO: 1361483 - protein, 9 aa, Homo Sapiens
RNPFVQEKT

SEQ ID NO: 1361484 - protein, 9 aa, Homo Sapiens
NQESLVSEI

SEQ ID NO: 1361485 - protein, 9 aa, Homo Sapiens
CSPISRELL

SEQ ID NO: 1361486 - protein, 9 aa, Homo Sapiens
MAFAEADYQ

SEQ ID NO: 1361487 - protein, 9 aa, Homo Sapiens
FWAQGVLIY

SEQ ID NO: 1361488 - protein, 9 aa, Homo Sapiens
PNKEILEKS

SEQ ID NO: 1361489 - protein, 9 aa, Homo Sapiens
EQLKKTYHN

SEQ ID NO: 1361490 - protein, 9 aa, Homo Sapiens
DYEPKVKEC

SEQ ID NO: 1361491 - protein, 9 aa, Homo Sapiens
QSGLPEAQH

SEQ ID NO: 1361492 - protein, 9 aa, Homo Sapiens
IAGLQKTIQ

SEQ ID NO: 1361493 - protein, 9 aa, Homo Sapiens
VPLGRYFSH

SEQ ID NO: 1361494 - protein, 9 aa, Homo Sapiens
ALFSVLCKI

SEQ ID NO: 1361495 - protein, 9 aa, Homo Sapiens
WRPDMSPCS

SEQ ID NO: 1361496 - protein, 9 aa, Homo Sapiens
VMWFDTRIK

SEQ ID NO: 1361497 - protein, 9 aa, Homo Sapiens
SSDSDDGSE

SEQ ID NO: 1361498 - protein, 9 aa, Homo Sapiens
LDSSYVERL

SEQ ID NO: 1361499 - protein, 9 aa, Homo Sapiens
TLQSLLEKG

SEQ ID NO: 1361500 - protein, 9 aa, Homo Sapiens
RVYLRNKSR

SEQ ID NO: 1361501 - protein, 9 aa, Homo Sapiens
IEQFERHLT

SEQ ID NO: 1361502 - protein, 9 aa, Homo Sapiens
LKLHQSKTK

SEQ ID NO: 1361503 - protein, 9 aa, Homo Sapiens
EAYGKKFDV

SEQ ID NO: 1361504 - protein, 9 aa, Homo Sapiens
DIRIHPQPT

SEQ ID NO: 1361505 - protein, 9 aa, Homo Sapiens
QDVLKLQGL

SEQ ID NO: 1361506 - protein, 9 aa, Homo Sapiens
SKEQNFYWS

SEQ ID NO: 1361507 - protein, 9 aa, Homo Sapiens
SSGSQGGIA

SEQ ID NO: 1361508 - protein, 9 aa, Homo Sapiens
LAFLVGVVV

SEQ ID NO: 1361509 - protein, 9 aa, Homo Sapiens
SETSSVAKS

SEQ ID NO: 1361510 - protein, 9 aa, Homo Sapiens
LEKCTKATR

SEQ ID NO: 1361511 - protein, 9 aa, Homo Sapiens
EVSGGAWEQ

SEQ ID NO: 1361512 - protein, 9 aa, Homo Sapiens
QGLASIVAP

SEQ ID NO: 1361513 - protein, 9 aa, Homo Sapiens
NADLKLDEV

SEQ ID NO: 1361514 - protein, 9 aa, Homo Sapiens
NKVFLLAIN

SEQ ID NO: 1361515 - protein, 9 aa, Homo Sapiens
KTTTVVFWQ

SEQ ID NO: 1361516 - protein, 9 aa, Homo Sapiens
MGVLQVVKH

SEQ ID NO: 1361517 - protein, 9 aa, Homo Sapiens
AQNHEAPMI

SEQ ID NO: 1361518 - protein, 9 aa, Homo Sapiens
AKHLWPEQN

SEQ ID NO: 1361519 - protein, 9 aa, Homo Sapiens
QRMHTAEKP

SEQ ID NO: 1361520 - protein, 9 aa, Homo Sapiens
DGAFGIRID

SEQ ID NO: 1361521 - protein, 9 aa, Homo Sapiens
GVLDSYFQS

SEQ ID NO: 1361522 - protein, 9 aa, Homo Sapiens
WQIMAVKRI

SEQ ID NO: 1361523 - protein, 9 aa, Homo Sapiens
DLLTLPLQR

SEQ ID NO: 1361524 - protein, 9 aa, Homo Sapiens
LPLSMTSTP

SEQ ID NO: 1361525 - protein, 9 aa, Homo Sapiens
WEHSQGLKN

SEQ ID NO: 1361526 - protein, 9 aa, Homo Sapiens
RSPATGPSA

SEQ ID NO: 1361527 - protein, 9 aa, Homo Sapiens
GKKRMGRRS

SEQ ID NO: 1361528 - protein, 9 aa, Homo Sapiens
RDEDDRSFF

SEQ ID NO: 1361529 - protein, 9 aa, Homo Sapiens
CRDFAKEVD

SEQ ID NO: 1361530 - protein, 9 aa, Homo Sapiens
KYIKMTATC

SEQ ID NO: 1361531 - protein, 9 aa, Homo Sapiens
KFKEEISNI

SEQ ID NO: 1361532 - protein, 9 aa, Homo Sapiens
VLTLLDLAK

SEQ ID NO: 1361533 - protein, 9 aa, Homo Sapiens
KECKTHLPT

SEQ ID NO: 1361534 - protein, 9 aa, Homo Sapiens
KEAEGTQEG

SEQ ID NO: 1361535 - protein, 9 aa, Homo Sapiens
VKVSNDISM

SEQ ID NO: 1361536 - protein, 9 aa, Homo Sapiens
SFTSEDHLD

SEQ ID NO: 1361537 - protein, 9 aa, Homo Sapiens
GLMARPEYK

SEQ ID NO: 1361538 - protein, 9 aa, Homo Sapiens
KRTHTVERP

SEQ ID NO: 1361539 - protein, 9 aa, Homo Sapiens
RITVENKVD

SEQ ID NO: 1361540 - protein, 9 aa, Homo Sapiens
MVQNKVFLL

SEQ ID NO: 1361541 - protein, 9 aa, Homo Sapiens
MRDPDELDR

SEQ ID NO: 1361542 - protein, 9 aa, Homo Sapiens
NDHWFSPGA

SEQ ID NO: 1361543 - protein, 9 aa, Homo Sapiens
NIHMMRQQE

SEQ ID NO: 1361544 - protein, 9 aa, Homo Sapiens
YEFIYYECL

SEQ ID NO: 1361545 - protein, 9 aa, Homo Sapiens
PVSAVYFFT

SEQ ID NO: 1361546 - protein, 9 aa, Homo Sapiens
LLYWVLEMD

SEQ ID NO: 1361547 - protein, 9 aa, Homo Sapiens
AKITDDSRL

SEQ ID NO: 1361548 - protein, 9 aa, Homo Sapiens
TNSQRVNNS

SEQ ID NO: 1361549 - protein, 9 aa, Homo Sapiens
SRLAWVSHY

SEQ ID NO: 1361550 - protein, 9 aa, Homo Sapiens
ARKNCMIGL

SEQ ID NO: 1361551 - protein, 9 aa, Homo Sapiens
LAKVENALQ

SEQ ID NO: 1361552 - protein, 9 aa, Homo Sapiens
TQTYGKLRP

SEQ ID NO: 1361553 - protein, 9 aa, Homo Sapiens
KSVTDCVLY

SEQ ID NO: 1361554 - protein, 9 aa, Homo Sapiens
AVVGVFYGA

SEQ ID NO: 1361555 - protein, 9 aa, Homo Sapiens
TLPIIRCKN

SEQ ID NO: 1361556 - protein, 9 aa, Homo Sapiens
VCLDHIIYF

SEQ ID NO: 1361557 - protein, 9 aa, Homo Sapiens
EMVENQIEK

SEQ ID NO: 1361558 - protein, 9 aa, Homo Sapiens
PNFVLAIVL

SEQ ID NO: 1361559 - protein, 9 aa, Homo Sapiens
GPCGSVKAP

SEQ ID NO: 1361560 - protein, 9 aa, Homo Sapiens
GRTCHVNLK

SEQ ID NO: 1361561 - protein, 9 aa, Homo Sapiens
RHEVIMDSH

SEQ ID NO: 1361562 - protein, 9 aa, Homo Sapiens
CGAFTGFQL

SEQ ID NO: 1361563 - protein, 9 aa, Homo Sapiens
DNWIFGETL

SEQ ID NO: 1361564 - protein, 9 aa, Homo Sapiens
KIIDFLNTT

SEQ ID NO: 1361565 - protein, 9 aa, Homo Sapiens
VVEVSQKLT

SEQ ID NO: 1361566 - protein, 9 aa, Homo Sapiens
LAGDTMGPE

SEQ ID NO: 1361567 - protein, 9 aa, Homo Sapiens
HLAEKVKRV

SEQ ID NO: 1361568 - protein, 9 aa, Homo Sapiens
LLNHIIYTL

SEQ ID NO: 1361569 - protein, 9 aa, Homo Sapiens
LDDSEEKVN

SEQ ID NO: 1361570 - protein, 9 aa, Homo Sapiens
GGLKAKGQL

SEQ ID NO: 1361571 - protein, 9 aa, Homo Sapiens
PNNTIVTEF

SEQ ID NO: 1361572 - protein, 9 aa, Homo Sapiens
VSVQDQVLL

SEQ ID NO: 1361573 - protein, 9 aa, Homo Sapiens
MLVLVSGEV

SEQ ID NO: 1361574 - protein, 9 aa, Homo Sapiens
NWAKEVQVI

SEQ ID NO: 1361575 - protein, 9 aa, Homo Sapiens
QHMKEFLGH

SEQ ID NO: 1361576 - protein, 9 aa, Homo Sapiens
NILCVVETG

SEQ ID NO: 1361577 - protein, 9 aa, Homo Sapiens
CVIIVGNLN

SEQ ID NO: 1361578 - protein, 9 aa, Homo Sapiens
HHNDHWFSP

SEQ ID NO: 1361579 - protein, 9 aa, Homo Sapiens
IRIDNVVLV

SEQ ID NO: 1361580 - protein, 9 aa, Homo Sapiens
HKQAADAEM

SEQ ID NO: 1361581 - protein, 9 aa, Homo Sapiens
KLVGGKALP

SEQ ID NO: 1361582 - protein, 9 aa, Homo Sapiens
QPSNNDFNT

SEQ ID NO: 1361583 - protein, 9 aa, Homo Sapiens
GLEPLELAK

SEQ ID NO: 1361584 - protein, 9 aa, Homo Sapiens
ITDFCEPRI

SEQ ID NO: 1361585 - protein, 9 aa, Homo Sapiens
NYYYYASRV

SEQ ID NO: 1361586 - protein, 9 aa, Homo Sapiens
AAYGTALSM

SEQ ID NO: 1361587 - protein, 9 aa, Homo Sapiens
LLHLELTKC

SEQ ID NO: 1361588 - protein, 9 aa, Homo Sapiens
CQDLCDRKQ

SEQ ID NO: 1361589 - protein, 9 aa, Homo Sapiens
ICYLPRMAR

SEQ ID NO: 1361590 - protein, 9 aa, Homo Sapiens
AGWPIYPRN

SEQ ID NO: 1361591 - protein, 9 aa, Homo Sapiens
LQGLGPSLG

SEQ ID NO: 1361592 - protein, 9 aa, Homo Sapiens
DVAWNFKKF

SEQ ID NO: 1361593 - protein, 9 aa, Homo Sapiens
ACLAVLALL

SEQ ID NO: 1361594 - protein, 9 aa, Homo Sapiens
SSFIVIIAQ

SEQ ID NO: 1361595 - protein, 9 aa, Homo Sapiens
NYGSAFPHG

SEQ ID NO: 1361596 - protein, 9 aa, Homo Sapiens
PLWRLGASV

SEQ ID NO: 1361597 - protein, 9 aa, Homo Sapiens
CNCNLSHCP

SEQ ID NO: 1361598 - protein, 9 aa, Homo Sapiens
EARRLIVSK

SEQ ID NO: 1361599 - protein, 9 aa, Homo Sapiens
YNDDDVYLF

SEQ ID NO: 1361600 - protein, 9 aa, Homo Sapiens
TYEEPTQAV

SEQ ID NO: 1361601 - protein, 9 aa, Homo Sapiens
PGQGCRETM

SEQ ID NO: 1361602 - protein, 9 aa, Homo Sapiens
DPHTYEEPT

SEQ ID NO: 1361603 - protein, 9 aa, Homo Sapiens
VDRYIGESA

SEQ ID NO: 1361604 - protein, 9 aa, Homo Sapiens
HGTDEWFLL

SEQ ID NO: 1361605 - protein, 9 aa, Homo Sapiens
QQAREIEAF

SEQ ID NO: 1361606 - protein, 9 aa, Homo Sapiens
INHSFVLTL

SEQ ID NO: 1361607 - protein, 9 aa, Homo Sapiens
SNSSKIDRH

SEQ ID NO: 1361608 - protein, 9 aa, Homo Sapiens
IQLRKRDQY

SEQ ID NO: 1361609 - protein, 9 aa, Homo Sapiens
AGACNCNLS

SEQ ID NO: 1361610 - protein, 9 aa, Homo Sapiens
ILDTAGREE

SEQ ID NO: 1361611 - protein, 9 aa, Homo Sapiens
EYTRTLRKG

SEQ ID NO: 1361612 - protein, 9 aa, Homo Sapiens
SPVFCIAHA

SEQ ID NO: 1361613 - protein, 9 aa, Homo Sapiens
QLRKRDQYL

SEQ ID NO: 1361614 - protein, 9 aa, Homo Sapiens
LKKDKLNTH

SEQ ID NO: 1361615 - protein, 9 aa, Homo Sapiens
GIMKQEPFY

SEQ ID NO: 1361616 - protein, 9 aa, Homo Sapiens
LEYLTKAII

SEQ ID NO: 1361617 - protein, 9 aa, Homo Sapiens
MSLQGEDEC

SEQ ID NO: 1361618 - protein, 9 aa, Homo Sapiens
KHLTCVIPI

SEQ ID NO: 1361619 - protein, 9 aa, Homo Sapiens
IQGEYTRTL

SEQ ID NO: 1361620 - protein, 9 aa, Homo Sapiens
LNTHSTYSE

SEQ ID NO: 1361621 - protein, 9 aa, Homo Sapiens
SVPPCLTAT

SEQ ID NO: 1361622 - protein, 9 aa, Homo Sapiens
EEAPEPDEA

SEQ ID NO: 1361623 - protein, 9 aa, Homo Sapiens
CGSAAAPVI

SEQ ID NO: 1361624 - protein, 9 aa, Homo Sapiens
HSFVLTLFG

SEQ ID NO: 1361625 - protein, 9 aa, Homo Sapiens
LASYNDDDV

SEQ ID NO: 1361626 - protein, 9 aa, Homo Sapiens
KLLIMGENA

SEQ ID NO: 1361627 - protein, 9 aa, Homo Sapiens
ALFKHLTCV

SEQ ID NO: 1361628 - protein, 9 aa, Homo Sapiens
RETMPITFL

SEQ ID NO: 1361629 - protein, 9 aa, Homo Sapiens
RLPPQNIPN

SEQ ID NO: 1361630 - protein, 9 aa, Homo Sapiens
YTRTLRKGG

SEQ ID NO: 1361631 - protein, 9 aa, Homo Sapiens
NRMALFKHL

SEQ ID NO: 1361632 - protein, 9 aa, Homo Sapiens
VFRSQEENT

SEQ ID NO: 1361633 - protein, 9 aa, Homo Sapiens
YLVEESVEH

SEQ ID NO: 1361634 - protein, 9 aa, Homo Sapiens
LPPQNIPNP

SEQ ID NO: 1361635 - protein, 9 aa, Homo Sapiens
MALFKHLTC

SEQ ID NO: 1361636 - protein, 9 aa, Homo Sapiens
QGEDECDVY

SEQ ID NO: 1361637 - protein, 9 aa, Homo Sapiens
IVSKNAGET

SEQ ID NO: 1361638 - protein, 9 aa, Homo Sapiens
DLDKAKTKP

SEQ ID NO: 1361639 - protein, 9 aa, Homo Sapiens
PPPSYRLPP

SEQ ID NO: 1361640 - protein, 9 aa, Homo Sapiens
LGASFSRYL

SEQ ID NO: 1361641 - protein, 9 aa, Homo Sapiens
FISNSSKID

SEQ ID NO: 1361642 - protein, 9 aa, Homo Sapiens
QEENTKPVK

SEQ ID NO: 1361643 - protein, 9 aa, Homo Sapiens
SKDVDECET

SEQ ID NO: 1361644 - protein, 9 aa, Homo Sapiens
TLNVSTGIM

SEQ ID NO: 1361645 - protein, 9 aa, Homo Sapiens
EPDEAELDY

SEQ ID NO: 1361646 - protein, 9 aa, Homo Sapiens
VLTLFGYGK

SEQ ID NO: 1361647 - protein, 9 aa, Homo Sapiens
KDVDECETQ

SEQ ID NO: 1361648 - protein, 9 aa, Homo Sapiens
VEMSLQGED

SEQ ID NO: 1361649 - protein, 9 aa, Homo Sapiens
YVPPPSYRL

SEQ ID NO: 1361650 - protein, 9 aa, Homo Sapiens
PDEAELDYL

SEQ ID NO: 1361651 - protein, 9 aa, Homo Sapiens
RKRDQYLMW

SEQ ID NO: 1361652 - protein, 9 aa, Homo Sapiens
KGHGTDEWF

SEQ ID NO: 1361653 - protein, 9 aa, Homo Sapiens
SWHPGQGCR

SEQ ID NO: 1361654 - protein, 9 aa, Homo Sapiens
PEPDEAELD

SEQ ID NO: 1361655 - protein, 9 aa, Homo Sapiens
EMSLQGEDE

SEQ ID NO: 1361656 - protein, 9 aa, Homo Sapiens
RSQEENTKP

SEQ ID NO: 1361657 - protein, 9 aa, Homo Sapiens
ARRLIVSKN

SEQ ID NO: 1361658 - protein, 9 aa, Homo Sapiens
SFISNSSKI

SEQ ID NO: 1361659 - protein, 9 aa, Homo Sapiens
QKEIRRKFG

SEQ ID NO: 1361660 - protein, 9 aa, Homo Sapiens
KGPEEEQQK

SEQ ID NO: 1361661 - protein, 9 aa, Homo Sapiens
SQEENTKPV

SEQ ID NO: 1361662 - protein, 9 aa, Homo Sapiens
GSGGIGKSA

SEQ ID NO: 1361663 - protein, 9 aa, Homo Sapiens
TPRGVHIQA

SEQ ID NO: 1361664 - protein, 9 aa, Homo Sapiens
ASFSRYLVE

SEQ ID NO: 1361665 - protein, 9 aa, Homo Sapiens
ERIRSLLEQ

SEQ ID NO: 1361666 - protein, 9 aa, Homo Sapiens
IVDRYIGES

SEQ ID NO: 1361667 - protein, 9 aa, Homo Sapiens
VSSSIVDRY

SEQ ID NO: 1361668 - protein, 9 aa, Homo Sapiens
GCRETMPIT

SEQ ID NO: 1361669 - protein, 9 aa, Homo Sapiens
GPEEEQQKQ

SEQ ID NO: 1361670 - protein, 9 aa, Homo Sapiens
PGKEEAPEP

SEQ ID NO: 1361671 - protein, 9 aa, Homo Sapiens
GASFSRYLV

SEQ ID NO: 1361672 - protein, 9 aa, Homo Sapiens
RKFGSFIWE

SEQ ID NO: 1361673 - protein, 9 aa, Homo Sapiens
STGIMKQEP

SEQ ID NO: 1361674 - protein, 9 aa, Homo Sapiens
LFKHLTCVI

SEQ ID NO: 1361675 - protein, 9 aa, Homo Sapiens
GKLLIMGEN

SEQ ID NO: 1361676 - protein, 9 aa, Homo Sapiens
EIRRKFGSF

SEQ ID NO: 1361677 - protein, 9 aa, Homo Sapiens
NTKPVKETE

SEQ ID NO: 1361678 - protein, 9 aa, Homo Sapiens
MSFISNSSK

SEQ ID NO: 1361679 - protein, 9 aa, Homo Sapiens
SFVLTLFGY

SEQ ID NO: 1361680 - protein, 9 aa, Homo Sapiens
FRSQEENTK

SEQ ID NO: 1361681 - protein, 9 aa, Homo Sapiens
REEYSAMRD

SEQ ID NO: 1361682 - protein, 9 aa, Homo Sapiens
SRLQKGHGT

SEQ ID NO: 1361683 - protein, 9 aa, Homo Sapiens
GWDCSKDVD

SEQ ID NO: 1361684 - protein, 9 aa, Homo Sapiens
LDILDTAGR

SEQ ID NO: 1361685 - protein, 9 aa, Homo Sapiens
KRDQYLMWL

SEQ ID NO: 1361686 - protein, 9 aa, Homo Sapiens
LIVSKNAGE

SEQ ID NO: 1361687 - protein, 9 aa, Homo Sapiens
NSLEYLTKA

SEQ ID NO: 1361688 - protein, 9 aa, Homo Sapiens
QGCRETMPI

SEQ ID NO: 1361689 - protein, 9 aa, Homo Sapiens
SRYLVEESV

SEQ ID NO: 1361690 - protein, 9 aa, Homo Sapiens
ADLSHVFCG

SEQ ID NO: 1361691 - protein, 9 aa, Homo Sapiens
GACNCNLSH

SEQ ID NO: 1361692 - protein, 9 aa, Homo Sapiens
PPSYRLPPQ

SEQ ID NO: 1361693 - protein, 9 aa, Homo Sapiens
LIMGENATA

SEQ ID NO: 1361694 - protein, 9 aa, Homo Sapiens
RKNRMALFK

SEQ ID NO: 1361695 - protein, 9 aa, Homo Sapiens
ENTKPVKET

SEQ ID NO: 1361696 - protein, 9 aa, Homo Sapiens
FAGGKLLIM

SEQ ID NO: 1361697 - protein, 9 aa, Homo Sapiens
LQGEDECDV

SEQ ID NO: 1361698 - protein, 9 aa, Homo Sapiens
SYRLPPQNI

SEQ ID NO: 1361699 - protein, 9 aa, Homo Sapiens
EAPEPDEAE

SEQ ID NO: 1361700 - protein, 9 aa, Homo Sapiens
VFCGSAAAP

SEQ ID NO: 1361701 - protein, 9 aa, Homo Sapiens
TKPVKETEV

SEQ ID NO: 1361702 - protein, 9 aa, Homo Sapiens
EPTQAVHEF

SEQ ID NO: 1361703 - protein, 9 aa, Homo Sapiens
LSHVFCGSA

SEQ ID NO: 1361704 - protein, 9 aa, Homo Sapiens
IAHAGSCRP

SEQ ID NO: 1361705 - protein, 9 aa, Homo Sapiens
SAGENSLEY

SEQ ID NO: 1361706 - protein, 9 aa, Homo Sapiens
SLEYLTKAI

SEQ ID NO: 1361707 - protein, 9 aa, Homo Sapiens
GREEYSAMR

SEQ ID NO: 1361708 - protein, 9 aa, Homo Sapiens
IMGENATAH

SEQ ID NO: 1361709 - protein, 9 aa, Homo Sapiens
YLTKAIIED

SEQ ID NO: 1361710 - protein, 9 aa, Homo Sapiens
MVGSGGIGK

SEQ ID NO: 1361711 - protein, 9 aa, Homo Sapiens
LQKEIRRKF

SEQ ID NO: 1361712 - protein, 9 aa, Homo Sapiens
TWTGWDCSK

SEQ ID NO: 1361713 - protein, 9 aa, Homo Sapiens
FSRYLVEES

SEQ ID NO: 1361714 - protein, 9 aa, Homo Sapiens
VYLFNSSHS

SEQ ID NO: 1361715 - protein, 9 aa, Homo Sapiens
QQVEMSLQG

SEQ ID NO: 1361716 - protein, 9 aa, Homo Sapiens
LIQLRKRDQ

SEQ ID NO: 1361717 - protein, 9 aa, Homo Sapiens
LNVSTGIMK

SEQ ID NO: 1361718 - protein, 9 aa, Homo Sapiens
KPTDTFLQI

SEQ ID NO: 1361719 - protein, 9 aa, Homo Sapiens
GHGTDEWFL

SEQ ID NO: 1361720 - protein, 9 aa, Homo Sapiens
RIRSLLEQQ

SEQ ID NO: 1361721 - protein, 9 aa, Homo Sapiens
ISNSSKIDR

SEQ ID NO: 1361722 - protein, 9 aa, Homo Sapiens
TKPTDTFLQ

SEQ ID NO: 1361723 - protein, 9 aa, Homo Sapiens
LDTAGREEY

SEQ ID NO: 1361724 - protein, 9 aa, Homo Sapiens
KEIRRKFGS

SEQ ID NO: 1361725 - protein, 9 aa, Homo Sapiens
LDKAKTKPT

SEQ ID NO: 1361726 - protein, 9 aa, Homo Sapiens
LSMDTPRGV

SEQ ID NO: 1361727 - protein, 9 aa, Homo Sapiens
KNDLDKAKT

SEQ ID NO: 1361728 - protein, 9 aa, Homo Sapiens
HPGQGCRET

SEQ ID NO: 1361729 - protein, 9 aa, Homo Sapiens
ITCASAGAC

SEQ ID NO: 1361730 - protein, 9 aa, Homo Sapiens
TCSVPPCLT

SEQ ID NO: 1361731 - protein, 9 aa, Homo Sapiens
DRYIGESAR

SEQ ID NO: 1361732 - protein, 9 aa, Homo Sapiens
TAGREEYSA

SEQ ID NO: 1361733 - protein, 9 aa, Homo Sapiens
WTGWDCSKD

SEQ ID NO: 1361734 - protein, 9 aa, Homo Sapiens
KFGSFIWEQ

SEQ ID NO: 1361735 - protein, 9 aa, Homo Sapiens
VSTGIMKQE

SEQ ID NO: 1361736 - protein, 9 aa, Homo Sapiens
EMSFISNSS

SEQ ID NO: 1361737 - protein, 9 aa, Homo Sapiens
YVDPHTYEE

SEQ ID NO: 1361738 - protein, 9 aa, Homo Sapiens
CASAGACNC

SEQ ID NO: 1361739 - protein, 9 aa, Homo Sapiens
FCIAHAGSC

SEQ ID NO: 1361740 - protein, 9 aa, Homo Sapiens
VGSGGIGKS

SEQ ID NO: 1361741 - protein, 9 aa, Homo Sapiens
MLQKGPEEE

SEQ ID NO: 1361742 - protein, 9 aa, Homo Sapiens
WPEEMSFIS

SEQ ID NO: 1361743 - protein, 9 aa, Homo Sapiens
LEQQAREIE

SEQ ID NO: 1361744 - protein, 9 aa, Homo Sapiens
YRLPPQNIP

SEQ ID NO: 1361745 - protein, 9 aa, Homo Sapiens
RRKFGSFIW

SEQ ID NO: 1361746 - protein, 9 aa, Homo Sapiens
GEYTRTLRK

SEQ ID NO: 1361747 - protein, 9 aa, Homo Sapiens
TDTFLQILR

SEQ ID NO: 1361748 - protein, 9 aa, Homo Sapiens
SMDTPRGVH

SEQ ID NO: 1361749 - protein, 9 aa, Homo Sapiens
QGQMLQKGP

SEQ ID NO: 1361750 - protein, 9 aa, Homo Sapiens
YEEPTQAVH

SEQ ID NO: 1361751 - protein, 9 aa, Homo Sapiens
DVYLFNSSH

SEQ ID NO: 1361752 - protein, 9 aa, Homo Sapiens
IHGINHSFV

SEQ ID NO: 1361753 - protein, 9 aa, Homo Sapiens
EEPTQAVHE

SEQ ID NO: 1361754 - protein, 9 aa, Homo Sapiens
LRKRDQYLM

SEQ ID NO: 1361755 - protein, 9 aa, Homo Sapiens
IRRKFGSFI

SEQ ID NO: 1361756 - protein, 9 aa, Homo Sapiens
DKAKTKPTD

SEQ ID NO: 1361757 - protein, 9 aa, Homo Sapiens
QVEMSLQGE

SEQ ID NO: 1361758 - protein, 9 aa, Homo Sapiens
KKDKLNTHS

SEQ ID NO: 1361759 - protein, 9 aa, Homo Sapiens
TRSLSMDTP

SEQ ID NO: 1361760 - protein, 9 aa, Homo Sapiens
CSKDVDECE

SEQ ID NO: 1361761 - protein, 9 aa, Homo Sapiens
TGWDCSKDV

SEQ ID NO: 1361762 - protein, 9 aa, Homo Sapiens
FKHLTCVIP

SEQ ID NO: 1361763 - protein, 9 aa, Homo Sapiens
QKGPEEEQQ

SEQ ID NO: 1361764 - protein, 9 aa, Homo Sapiens
PHTYEEPTQ

SEQ ID NO: 1361765 - protein, 9 aa, Homo Sapiens
SDYSEWDLS

SEQ ID NO: 1361766 - protein, 9 aa, Homo Sapiens
VSINSDYSE

SEQ ID NO: 1361767 - protein, 9 aa, Homo Sapiens
TRTLRKGGN

SEQ ID NO: 1361768 - protein, 9 aa, Homo Sapiens
HTYEEPTQA

SEQ ID NO: 1361769 - protein, 9 aa, Homo Sapiens
EQQAREIEA

SEQ ID NO: 1361770 - protein, 9 aa, Homo Sapiens
RYLVEESVE

SEQ ID NO: 1361771 - protein, 9 aa, Homo Sapiens
APEPDEAEL

SEQ ID NO: 1361772 - protein, 9 aa, Homo Sapiens
FCGSAAAPV

SEQ ID NO: 1361773 - protein, 9 aa, Homo Sapiens
PDLIQLRKR

SEQ ID NO: 1361774 - protein, 9 aa, Homo Sapiens
RYIGESARL

SEQ ID NO: 1361775 - protein, 9 aa, Homo Sapiens
KIQGEYTRT

SEQ ID NO: 1361776 - protein, 9 aa, Homo Sapiens
PSYRLPPQN

SEQ ID NO: 1361777 - protein, 9 aa, Homo Sapiens
EEMSFISNS

SEQ ID NO: 1361778 - protein, 9 aa, Homo Sapiens
GTDEWFLLS

SEQ ID NO: 1361779 - protein, 9 aa, Homo Sapiens
CSVPPCLTA

SEQ ID NO: 1361780 - protein, 9 aa, Homo Sapiens
AGGKLLIMG

SEQ ID NO: 1361781 - protein, 9 aa, Homo Sapiens
CIAHAGSCR

SEQ ID NO: 1361782 - protein, 9 aa, Homo Sapiens
TKNDLDKAK

SEQ ID NO: 1361783 - protein, 9 aa, Homo Sapiens
SLSMDTPRG

SEQ ID NO: 1361784 - protein, 9 aa, Homo Sapiens
GTCSVPPCL

SEQ ID NO: 1361785 - protein, 9 aa, Homo Sapiens
KNRMALFKH

SEQ ID NO: 1361786 - protein, 9 aa, Homo Sapiens
EYLTKAIIE

SEQ ID NO: 1361787 - protein, 9 aa, Homo Sapiens
SKIQGEYTR

SEQ ID NO: 1361788 - protein, 9 aa, Homo Sapiens
NDLDKAKTK

SEQ ID NO: 1361789 - protein, 9 aa, Homo Sapiens
DTPRGVHIQ

SEQ ID NO: 1361790 - protein, 9 aa, Homo Sapiens
RMALFKHLT

SEQ ID NO: 1361791 - protein, 9 aa, Homo Sapiens
SINSDYSEW

SEQ ID NO: 1361792 - protein, 9 aa, Homo Sapiens
GSAAAPVIK

SEQ ID NO: 1361793 - protein, 9 aa, Homo Sapiens
ASAGACNCN

SEQ ID NO: 1361794 - protein, 9 aa, Homo Sapiens
GGIGKSALT

SEQ ID NO: 1361795 - protein, 9 aa, Homo Sapiens
VDPHTYEEP

SEQ ID NO: 1361796 - protein, 9 aa, Homo Sapiens
DCSKDVDEC

SEQ ID NO: 1361797 - protein, 9 aa, Homo Sapiens
GEDECDVYI

SEQ ID NO: 1361798 - protein, 9 aa, Homo Sapiens
WQGQMLQKG

SEQ ID NO: 1361799 - protein, 9 aa, Homo Sapiens
RSLSMDTPR

SEQ ID NO: 1361800 - protein, 9 aa, Homo Sapiens
KAKTKPTDT

SEQ ID NO: 1361801 - protein, 9 aa, Homo Sapiens
VVSSSIVDR

SEQ ID NO: 1361802 - protein, 9 aa, Homo Sapiens
RSLLEQQAR

SEQ ID NO: 1361803 - protein, 9 aa, Homo Sapiens
SLLEQQARE

SEQ ID NO: 1361804 - protein, 9 aa, Homo Sapiens
MGENATAHI

SEQ ID NO: 1361805 - protein, 9 aa, Homo Sapiens
QMLQKGPEE

SEQ ID NO: 1361806 - protein, 9 aa, Homo Sapiens
DDDVYLFNS

SEQ ID NO: 1361807 - protein, 9 aa, Homo Sapiens
QGEYTRTLR

SEQ ID NO: 1361808 - protein, 9 aa, Homo Sapiens
EENTKPVKE

SEQ ID NO: 1361809 - protein, 9 aa, Homo Sapiens
SKNAGETLL

SEQ ID NO: 1361810 - protein, 9 aa, Homo Sapiens
DTAGREEYS

SEQ ID NO: 1361811 - protein, 9 aa, Homo Sapiens
KLNTHSTYS

SEQ ID NO: 1361812 - protein, 9 aa, Homo Sapiens
KDKLNTHST

SEQ ID NO: 1361813 - protein, 9 aa, Homo Sapiens
GQMLQKGPE

SEQ ID NO: 1361814 - protein, 9 aa, Homo Sapiens
DLSHVFCGS

SEQ ID NO: 1361815 - protein, 9 aa, Homo Sapiens
GKEEAPEPD

SEQ ID NO: 1361816 - protein, 9 aa, Homo Sapiens
WHPGQGCRE

SEQ ID NO: 1361817 - protein, 9 aa, Homo Sapiens
VPPPSYRLP

SEQ ID NO: 1361818 - protein, 9 aa, Homo Sapiens
NSDYSEWDL

SEQ ID NO: 1361819 - protein, 9 aa, Homo Sapiens
SYNDDDVYL

SEQ ID NO: 1361820 - protein, 9 aa, Homo Sapiens
KEEAPEPDE

SEQ ID NO: 1361821 - protein, 9 aa, Homo Sapiens
HGINHSFVL

SEQ ID NO: 1361822 - protein, 9 aa, Homo Sapiens
RRLIVSKNA

SEQ ID NO: 1361823 - protein, 9 aa, Homo Sapiens
RLQKGHGTD

SEQ ID NO: 1361824 - protein, 9 aa, Homo Sapiens
FVLTLFGYG

SEQ ID NO: 1361825 - protein, 9 aa, Homo Sapiens
QVSINSDYS

SEQ ID NO: 1361826 - protein, 9 aa, Homo Sapiens
LSRLQKGHG

SEQ ID NO: 1361827 - protein, 9 aa, Homo Sapiens
LLEQQAREI

SEQ ID NO: 1361828 - protein, 9 aa, Homo Sapiens
LQKGHGTDE

SEQ ID NO: 1361829 - protein, 9 aa, Homo Sapiens
ITLNVSTGI

SEQ ID NO: 1361830 - protein, 9 aa, Homo Sapiens
INSDYSEWD

SEQ ID NO: 1361831 - protein, 9 aa, Homo Sapiens
GENSLEYLT

SEQ ID NO: 1361832 - protein, 9 aa, Homo Sapiens
AKTKPTDTF

SEQ ID NO: 1361833 - protein, 9 aa, Homo Sapiens
SGGIGKSAL

SEQ ID NO: 1361834 - protein, 9 aa, Homo Sapiens
IRSLLEQQA

SEQ ID NO: 1361835 - protein, 9 aa, Homo Sapiens
SSSIVDRYI

SEQ ID NO: 1361836 - protein, 9 aa, Homo Sapiens
KTKPTDTFL

SEQ ID NO: 1361837 - protein, 9 aa, Homo Sapiens
LVEESVEHL

SEQ ID NO: 1361838 - protein, 9 aa, Homo Sapiens
NHSFVLTLF

SEQ ID NO: 1361839 - protein, 9 aa, Homo Sapiens
LLIMGENAT

SEQ ID NO: 1361840 - protein, 9 aa, Homo Sapiens
CRETMPITF

SEQ ID NO: 1361841 - protein, 9 aa, Homo Sapiens
RTLRKGGNN

SEQ ID NO: 1361842 - protein, 9 aa, Homo Sapiens
AGENSLEYL

SEQ ID NO: 1361843 - protein, 9 aa, Homo Sapiens
DDVYLFNSS

SEQ ID NO: 1361844 - protein, 9 aa, Homo Sapiens
SSIVDRYIG

SEQ ID NO: 1361845 - protein, 9 aa, Homo Sapiens
TGIMKQEPF

SEQ ID NO: 1361846 - protein, 9 aa, Homo Sapiens
DILDTAGRE

SEQ ID NO: 1361847 - protein, 9 aa, Homo Sapiens
MQKSPVFCI

SEQ ID NO: 1361848 - protein, 9 aa, Homo Sapiens
PVFCIAHAG

SEQ ID NO: 1361849 - protein, 9 aa, Homo Sapiens
LQKGPEEEQ

SEQ ID NO: 1361850 - protein, 9 aa, Homo Sapiens
SHVFCGSAA

SEQ ID NO: 1361851 - protein, 9 aa, Homo Sapiens
MAQVSINSD

SEQ ID NO: 1361852 - protein, 9 aa, Homo Sapiens
FGSFIWEQD

SEQ ID NO: 1361853 - protein, 9 aa, Homo Sapiens
SIVDRYIGE

SEQ ID NO: 1361854 - protein, 9 aa, Homo Sapiens
SFSRYLVEE

SEQ ID NO: 1361855 - protein, 9 aa, Homo Sapiens
ACNCNLSHC

SEQ ID NO: 1361856 - protein, 9 aa, Homo Sapiens
PEARRLIVS

SEQ ID NO: 1361857 - protein, 9 aa, Homo Sapiens
DKLNTHSTY

SEQ ID NO: 1361858 - protein, 9 aa, Homo Sapiens
VIMVGSGGI

SEQ ID NO: 1361859 - protein, 9 aa, Homo Sapiens
PTRSLSMDT

SEQ ID NO: 1361860 - protein, 9 aa, Homo Sapiens
IMKQEPFYL

SEQ ID NO: 1361861 - protein, 9 aa, Homo Sapiens
GINHSFVLT

SEQ ID NO: 1361862 - protein, 9 aa, Homo Sapiens
GIGKSALTL

SEQ ID NO: 1361863 - protein, 9 aa, Homo Sapiens
SAGACNCNL

SEQ ID NO: 1361864 - protein, 9 aa, Homo Sapiens
SLQGEDECD

SEQ ID NO: 1361865 - protein, 9 aa, Homo Sapiens
KSPVFCIAH

SEQ ID NO: 1361866 - protein, 9 aa, Homo Sapiens
DLIQLRKRD

SEQ ID NO: 1361867 - protein, 9 aa, Homo Sapiens
NDDDVYLFN

SEQ ID NO: 1361868 - protein, 9 aa, Homo Sapiens
VFCIAHAGS

SEQ ID NO: 1361869 - protein, 9 aa, Homo Sapiens
MDTPRGVHI

SEQ ID NO: 1361870 - protein, 9 aa, Homo Sapiens
NTHSTYSEA

SEQ ID NO: 1361871 - protein, 9 aa, Homo Sapiens
PTDTFLQIL

SEQ ID NO: 1361872 - protein, 9 aa, Homo Sapiens
TCASAGACN

SEQ ID NO: 1361873 - protein, 9 aa, Homo Sapiens
RLIVSKNAG

SEQ ID NO: 1361874 - protein, 9 aa, Homo Sapiens
WDCSKDVDE

SEQ ID NO: 1361875 - protein, 9 aa, Homo Sapiens
ENSLEYLTK

SEQ ID NO: 1361876 - protein, 9 aa, Homo Sapiens
QKSPVFCIA

SEQ ID NO: 1361877 - protein, 9 aa, Homo Sapiens
ASYNDDDVY

SEQ ID NO: 1361878 - protein, 9 aa, Homo Sapiens
IGKSALTLQ

SEQ ID NO: 1361879 - protein, 9 aa, Homo Sapiens
HVFCGSAAA

SEQ ID NO: 1361880 - protein, 9 aa, Homo Sapiens
GGKLLIMGE

SEQ ID NO: 1361881 - protein, 9 aa, Homo Sapiens
AGREEYSAM

SEQ ID NO: 1361882 - protein, 9 aa, Homo Sapiens
AQVSINSDY

SEQ ID NO: 1361883 - protein, 9 aa, Homo Sapiens
QKGHGTDEW

SEQ ID NO: 1361884 - protein, 9 aa, Homo Sapiens
LGTCSVPPC

SEQ ID NO: 1361885 - protein, 9 aa, Homo Sapiens
NVSTGIMKQ

SEQ ID NO: 1361886 - protein, 9 aa, Homo Sapiens
GQGCRETMP

SEQ ID NO: 1361887 - protein, 9 aa, Homo Sapiens
VSKNAGETL

SEQ ID NO: 1361888 - protein, 9 aa, Homo Sapiens
IMVGSGGIG

SEQ ID NO: 1361889 - protein, 9 aa, Homo Sapiens
PEEMSFISN

SEQ ID NO: 1361890 - protein, 9 aa, Homo Sapiens
GGNSCRAKN

SEQ ID NO: 1361891 - protein, 9 aa, Homo Sapiens
LWGVHSGGN

SEQ ID NO: 1361892 - protein, 9 aa, Homo Sapiens
HGREPLCDN

SEQ ID NO: 1361893 - protein, 9 aa, Homo Sapiens
VGWVQKFCG

SEQ ID NO: 1361894 - protein, 9 aa, Homo Sapiens
RWKQLWGVH

SEQ ID NO: 1361895 - protein, 9 aa, Homo Sapiens
QQIADIILP

SEQ ID NO: 1361896 - protein, 9 aa, Homo Sapiens
LVRKLYQAL

SEQ ID NO: 1361897 - protein, 9 aa, Homo Sapiens
QKFCGKGIF

SEQ ID NO: 1361898 - protein, 9 aa, Homo Sapiens
VQKFCGKGI

SEQ ID NO: 1361899 - protein, 9 aa, Homo Sapiens
RKVNTSTRR

SEQ ID NO: 1361900 - protein, 9 aa, Homo Sapiens
DLQVKMGTA

SEQ ID NO: 1361901 - protein, 9 aa, Homo Sapiens
CTAIRVVSL

SEQ ID NO: 1361902 - protein, 9 aa, Homo Sapiens
PELKGQVEP

SEQ ID NO: 1361903 - protein, 9 aa, Homo Sapiens
VVLSLSRGQ

SEQ ID NO: 1361904 - protein, 9 aa, Homo Sapiens
RLDSTIAQE

SEQ ID NO: 1361905 - protein, 9 aa, Homo Sapiens
EGYDTKSDI

SEQ ID NO: 1361906 - protein, 9 aa, Homo Sapiens
GLGGYGSGN

SEQ ID NO: 1361907 - protein, 9 aa, Homo Sapiens
WRKVNTSTR

SEQ ID NO: 1361908 - protein, 9 aa, Homo Sapiens
LDSTIAQEL

SEQ ID NO: 1361909 - protein, 9 aa, Homo Sapiens
YSFVVLSLS

SEQ ID NO: 1361910 - protein, 9 aa, Homo Sapiens
ACLRLDSTI

SEQ ID NO: 1361911 - protein, 9 aa, Homo Sapiens
GNSCRAKNC

SEQ ID NO: 1361912 - protein, 9 aa, Homo Sapiens
PDSQDRRWK

SEQ ID NO: 1361913 - protein, 9 aa, Homo Sapiens
HEGYDTKSD

SEQ ID NO: 1361914 - protein, 9 aa, Homo Sapiens
IQQLVRKLY

SEQ ID NO: 1361915 - protein, 9 aa, Homo Sapiens
MSPEALKHE

SEQ ID NO: 1361916 - protein, 9 aa, Homo Sapiens
EMIAKLEAE

SEQ ID NO: 1361917 - protein, 9 aa, Homo Sapiens
CLPMDCGVP

SEQ ID NO: 1361918 - protein, 9 aa, Homo Sapiens
DKWKRLSQQ

SEQ ID NO: 1361919 - protein, 9 aa, Homo Sapiens
DSQDRRWKQ

SEQ ID NO: 1361920 - protein, 9 aa, Homo Sapiens
CFDLQVKMG

SEQ ID NO: 1361921 - protein, 9 aa, Homo Sapiens
PCTAIRVVS

SEQ ID NO: 1361922 - protein, 9 aa, Homo Sapiens
DQNVSCLPM

SEQ ID NO: 1361923 - protein, 9 aa, Homo Sapiens
IACLRLDST

SEQ ID NO: 1361924 - protein, 9 aa, Homo Sapiens
WAAIHSHAG

SEQ ID NO: 1361925 - protein, 9 aa, Homo Sapiens
ICFPDHFIN

SEQ ID NO: 1361926 - protein, 9 aa, Homo Sapiens
PDHFINFFI

SEQ ID NO: 1361927 - protein, 9 aa, Homo Sapiens
WNLSNSAQT

SEQ ID NO: 1361928 - protein, 9 aa, Homo Sapiens
QNVSCLPMD

SEQ ID NO: 1361929 - protein, 9 aa, Homo Sapiens
KAQKEMIAK

SEQ ID NO: 1361930 - protein, 9 aa, Homo Sapiens
SLGEVGGPE

SEQ ID NO: 1361931 - protein, 9 aa, Homo Sapiens
TKAQKEMIA

SEQ ID NO: 1361932 - protein, 9 aa, Homo Sapiens
LSQQIADII

SEQ ID NO: 1361933 - protein, 9 aa, Homo Sapiens
LPIILHHQK

SEQ ID NO: 1361934 - protein, 9 aa, Homo Sapiens
LTFWNLSNS

SEQ ID NO: 1361935 - protein, 9 aa, Homo Sapiens
GSGNSEDER

SEQ ID NO: 1361936 - protein, 9 aa, Homo Sapiens
QQLVRKLYQ

SEQ ID NO: 1361937 - protein, 9 aa, Homo Sapiens
PMDCGVPDP

SEQ ID NO: 1361938 - protein, 9 aa, Homo Sapiens
PSCNNRHFW

SEQ ID NO: 1361939 - protein, 9 aa, Homo Sapiens
EKVGWVQKF

SEQ ID NO: 1361940 - protein, 9 aa, Homo Sapiens
STIAQELIY

SEQ ID NO: 1361941 - protein, 9 aa, Homo Sapiens
RVVSLLKDL

SEQ ID NO: 1361942 - protein, 9 aa, Homo Sapiens
GEVGGPELK

SEQ ID NO: 1361943 - protein, 9 aa, Homo Sapiens
SFVVLSLSR

SEQ ID NO: 1361944 - protein, 9 aa, Homo Sapiens
GWVQKFCGK

SEQ ID NO: 1361945 - protein, 9 aa, Homo Sapiens
VVSLLKDLK

SEQ ID NO: 1361946 - protein, 9 aa, Homo Sapiens
PIILHHQKQ

SEQ ID NO: 1361947 - protein, 9 aa, Homo Sapiens
GVHSGGNSC

SEQ ID NO: 1361948 - protein, 9 aa, Homo Sapiens
LTITINICF

SEQ ID NO: 1361949 - protein, 9 aa, Homo Sapiens
KWKRLSQQI

SEQ ID NO: 1361950 - protein, 9 aa, Homo Sapiens
ALPIILHHQ

SEQ ID NO: 1361951 - protein, 9 aa, Homo Sapiens
KVNTSTRRK

SEQ ID NO: 1361952 - protein, 9 aa, Homo Sapiens
NVLLTALPI

SEQ ID NO: 1361953 - protein, 9 aa, Homo Sapiens
ATTNQNHKV

SEQ ID NO: 1361954 - protein, 9 aa, Homo Sapiens
ELKGQVEPW

SEQ ID NO: 1361955 - protein, 9 aa, Homo Sapiens
IYHGREPLC

SEQ ID NO: 1361956 - protein, 9 aa, Homo Sapiens
QLWGVHSGG

SEQ ID NO: 1361957 - protein, 9 aa, Homo Sapiens
FVVLSLSRG

SEQ ID NO: 1361958 - protein, 9 aa, Homo Sapiens
NVSCLPMDC

SEQ ID NO: 1361959 - protein, 9 aa, Homo Sapiens
TTNQNHKVQ

SEQ ID NO: 1361960 - protein, 9 aa, Homo Sapiens
RFGGKYCTG

SEQ ID NO: 1361961 - protein, 9 aa, Homo Sapiens
LGGYGSGNS

SEQ ID NO: 1361962 - protein, 9 aa, Homo Sapiens
NLSNSAQTN

SEQ ID NO: 1361963 - protein, 9 aa, Homo Sapiens
WGVHSGGNS

SEQ ID NO: 1361964 - protein, 9 aa, Homo Sapiens
RRWKQLWGV

SEQ ID NO: 1361965 - protein, 9 aa, Homo Sapiens
NQNHKVQAR

SEQ ID NO: 1361966 - protein, 9 aa, Homo Sapiens
CNNPEPRFG

SEQ ID NO: 1361967 - protein, 9 aa, Homo Sapiens
VGGPELKGQ

SEQ ID NO: 1361968 - protein, 9 aa, Homo Sapiens
LKHEGYDTK

SEQ ID NO: 1361969 - protein, 9 aa, Homo Sapiens
FSALLSPIS

SEQ ID NO: 1361970 - protein, 9 aa, Homo Sapiens
GGYGSGNSE

SEQ ID NO: 1361971 - protein, 9 aa, Homo Sapiens
VSCLPMDCG

SEQ ID NO: 1361972 - protein, 9 aa, Homo Sapiens
QVKMGTAPD

SEQ ID NO: 1361973 - protein, 9 aa, Homo Sapiens
TAIRVVSLL

SEQ ID NO: 1361974 - protein, 9 aa, Homo Sapiens
LRLDSTIAQ

SEQ ID NO: 1361975 - protein, 9 aa, Homo Sapiens
IRVVSLLKD

SEQ ID NO: 1361976 - protein, 9 aa, Homo Sapiens
VNTSTRRKS

SEQ ID NO: 1361977 - protein, 9 aa, Homo Sapiens
FIVYLTITI

SEQ ID NO: 1361978 - protein, 9 aa, Homo Sapiens
TSTRRKSGR

SEQ ID NO: 1361979 - protein, 9 aa, Homo Sapiens
FDLQVKMGT

SEQ ID NO: 1361980 - protein, 9 aa, Homo Sapiens
PRFGGKYCT

SEQ ID NO: 1361981 - protein, 9 aa, Homo Sapiens
GREPLCDNV

SEQ ID NO: 1361982 - protein, 9 aa, Homo Sapiens
LPMDCGVPD

SEQ ID NO: 1361983 - protein, 9 aa, Homo Sapiens
KVQARTEAL

SEQ ID NO: 1361984 - protein, 9 aa, Homo Sapiens
STRRKSGRF

SEQ ID NO: 1361985 - protein, 9 aa, Homo Sapiens
VKMGTAPDS

SEQ ID NO: 1361986 - protein, 9 aa, Homo Sapiens
YGSGNSEDE

SEQ ID NO: 1361987 - protein, 9 aa, Homo Sapiens
DHFINFFIC

SEQ ID NO: 1361988 - protein, 9 aa, Homo Sapiens
AIRVVSLLK

SEQ ID NO: 1361989 - protein, 9 aa, Homo Sapiens
HKVQARTEA

SEQ ID NO: 1361990 - protein, 9 aa, Homo Sapiens
SYSFVVLSL

SEQ ID NO: 1361991 - protein, 9 aa, Homo Sapiens
LCNNPEPRF

SEQ ID NO: 1361992 - protein, 9 aa, Homo Sapiens
MIAKLEAEL

SEQ ID NO: 1361993 - protein, 9 aa, Homo Sapiens
QDRRWKQLW

SEQ ID NO: 1361994 - protein, 9 aa, Homo Sapiens
EPRFGGKYC

SEQ ID NO: 1361995 - protein, 9 aa, Homo Sapiens
SCLPSCNNR

SEQ ID NO: 1361996 - protein, 9 aa, Homo Sapiens
NNPEPRFGG

SEQ ID NO: 1361997 - protein, 9 aa, Homo Sapiens
RTGIYHGRE

SEQ ID NO: 1361998 - protein, 9 aa, Homo Sapiens
QNHKVQART

SEQ ID NO: 1361999 - protein, 9 aa, Homo Sapiens
REPLCDNVN

SEQ ID NO: 1362000 - protein, 9 aa, Homo Sapiens
LPSCNNRHF

SEQ ID NO: 1362001 - protein, 9 aa, Homo Sapiens
SQDRRWKQL

SEQ ID NO: 1362002 - protein, 9 aa, Homo Sapiens
KRLSQQIAD

SEQ ID NO: 1362003 - protein, 9 aa, Homo Sapiens
YCWAAIHSH

SEQ ID NO: 1362004 - protein, 9 aa, Homo Sapiens
TITINICFP

SEQ ID NO: 1362005 - protein, 9 aa, Homo Sapiens
TALPIILHH

SEQ ID NO: 1362006 - protein, 9 aa, Homo Sapiens
SGNSEDERS

SEQ ID NO: 1362007 - protein, 9 aa, Homo Sapiens
WVQKFCGKG

SEQ ID NO: 1362008 - protein, 9 aa, Homo Sapiens
GIYHGREPL

SEQ ID NO: 1362009 - protein, 9 aa, Homo Sapiens
LLTFWNLSN

SEQ ID NO: 1362010 - protein, 9 aa, Homo Sapiens
GAPCTAIRV

SEQ ID NO: 1362011 - protein, 9 aa, Homo Sapiens
DRRWKQLWG

SEQ ID NO: 1362012 - protein, 9 aa, Homo Sapiens
IILHHQKQL

SEQ ID NO: 1362013 - protein, 9 aa, Homo Sapiens
YWTKSYSFV

SEQ ID NO: 1362014 - protein, 9 aa, Homo Sapiens
NTSTRRKSG

SEQ ID NO: 1362015 - protein, 9 aa, Homo Sapiens
ALKHEGYDT

SEQ ID NO: 1362016 - protein, 9 aa, Homo Sapiens
GPELKGQVE

SEQ ID NO: 1362017 - protein, 9 aa, Homo Sapiens
VQARTEALY

SEQ ID NO: 1362018 - protein, 9 aa, Homo Sapiens
SHAGREFHK

SEQ ID NO: 1362019 - protein, 9 aa, Homo Sapiens
VHSGGNSCR

SEQ ID NO: 1362020 - protein, 9 aa, Homo Sapiens
KQLWGVHSG

SEQ ID NO: 1362021 - protein, 9 aa, Homo Sapiens
VRKLYQALA

SEQ ID NO: 1362022 - protein, 9 aa, Homo Sapiens
TAPDSQDRR

SEQ ID NO: 1362023 - protein, 9 aa, Homo Sapiens
KLYQALALW

SEQ ID NO: 1362024 - protein, 9 aa, Homo Sapiens
EVGGPELKG

SEQ ID NO: 1362025 - protein, 9 aa, Homo Sapiens
TGIYHGREP

SEQ ID NO: 1362026 - protein, 9 aa, Homo Sapiens
DFSALLSPI

SEQ ID NO: 1362027 - protein, 9 aa, Homo Sapiens
GTAPDSQDR

SEQ ID NO: 1362028 - protein, 9 aa, Homo Sapiens
KSYSFVVLS

SEQ ID NO: 1362029 - protein, 9 aa, Homo Sapiens
KTKAQKEMI

SEQ ID NO: 1362030 - protein, 9 aa, Homo Sapiens
TKSYSFVVL

SEQ ID NO: 1362031 - protein, 9 aa, Homo Sapiens
MGTAPDSQD

SEQ ID NO: 1362032 - protein, 9 aa, Homo Sapiens
YKLFIVYLT

SEQ ID NO: 1362033 - protein, 9 aa, Homo Sapiens
CLPSCNNRH

SEQ ID NO: 1362034 - protein, 9 aa, Homo Sapiens
INICFPDHF

SEQ ID NO: 1362035 - protein, 9 aa, Homo Sapiens
VRTGIYHGR

SEQ ID NO: 1362036 - protein, 9 aa, Homo Sapiens
GYGSGNSED

SEQ ID NO: 1362037 - protein, 9 aa, Homo Sapiens
RKLYQALAL

SEQ ID NO: 1362038 - protein, 9 aa, Homo Sapiens
LLTALPIIL

SEQ ID NO: 1362039 - protein, 9 aa, Homo Sapiens
YLTITINIC

SEQ ID NO: 1362040 - protein, 9 aa, Homo Sapiens
VYLTITINI

SEQ ID NO: 1362041 - protein, 9 aa, Homo Sapiens
FPDHFINFF

SEQ ID NO: 1362042 - protein, 9 aa, Homo Sapiens
HSGGNSCRA

SEQ ID NO: 1362043 - protein, 9 aa, Homo Sapiens
TIAQELIYT

SEQ ID NO: 1362044 - protein, 9 aa, Homo Sapiens
EALKHEGYD

SEQ ID NO: 1362045 - protein, 9 aa, Homo Sapiens
DSTIAQELI

SEQ ID NO: 1362046 - protein, 9 aa, Homo Sapiens
SQQIADIIL

SEQ ID NO: 1362047 - protein, 9 aa, Homo Sapiens
KLFIVYLTI

SEQ ID NO: 1362048 - protein, 9 aa, Homo Sapiens
QKEMIAKLE

SEQ ID NO: 1362049 - protein, 9 aa, Homo Sapiens
KHEGYDTKS

SEQ ID NO: 1362050 - protein, 9 aa, Homo Sapiens
TRRKSGRFS

SEQ ID NO: 1362051 - protein, 9 aa, Homo Sapiens
TFWNLSNSA

SEQ ID NO: 1362052 - protein, 9 aa, Homo Sapiens
RLCNNPEPR

SEQ ID NO: 1362053 - protein, 9 aa, Homo Sapiens
NPEPRFGGK

SEQ ID NO: 1362054 - protein, 9 aa, Homo Sapiens
AWRKVNTST

SEQ ID NO: 1362055 - protein, 9 aa, Homo Sapiens
EKTKAQKEM

SEQ ID NO: 1362056 - protein, 9 aa, Homo Sapiens
LYQALALWK

SEQ ID NO: 1362057 - protein, 9 aa, Homo Sapiens
MDCGVPDPS

SEQ ID NO: 1362058 - protein, 9 aa, Homo Sapiens
YHGREPLCD

SEQ ID NO: 1362059 - protein, 9 aa, Homo Sapiens
GNSEDERSD

SEQ ID NO: 1362060 - protein, 9 aa, Homo Sapiens
GGPELKGQV

SEQ ID NO: 1362061 - protein, 9 aa, Homo Sapiens
KEMIAKLEA

SEQ ID NO: 1362062 - protein, 9 aa, Homo Sapiens
APCTAIRVV

SEQ ID NO: 1362063 - protein, 9 aa, Homo Sapiens
PEKVGWVQK

SEQ ID NO: 1362064 - protein, 9 aa, Homo Sapiens
IHSHAGREF

SEQ ID NO: 1362065 - protein, 9 aa, Homo Sapiens
WKRLSQQIA

SEQ ID NO: 1362066 - protein, 9 aa, Homo Sapiens
CFPDHFINF

SEQ ID NO: 1362067 - protein, 9 aa, Homo Sapiens
LTALPIILH

SEQ ID NO: 1362068 - protein, 9 aa, Homo Sapiens
ITINICFPD

SEQ ID NO: 1362069 - protein, 9 aa, Homo Sapiens
QLVRKLYQA

SEQ ID NO: 1362070 - protein, 9 aa, Homo Sapiens
SALLSPISS

SEQ ID NO: 1362071 - protein, 9 aa, Homo Sapiens
AIHSHAGRE

SEQ ID NO: 1362072 - protein, 9 aa, Homo Sapiens
WKQLWGVHS

SEQ ID NO: 1362073 - protein, 9 aa, Homo Sapiens
MDFSALLSP

SEQ ID NO: 1362074 - protein, 9 aa, Homo Sapiens
PEPRFGGKY

SEQ ID NO: 1362075 - protein, 9 aa, Homo Sapiens
ILHHQKQLL

SEQ ID NO: 1362076 - protein, 9 aa, Homo Sapiens
AAAREEILC

SEQ ID NO: 1362077 - protein, 9 aa, Homo Sapiens
LSNSAQTNI

SEQ ID NO: 1362078 - protein, 9 aa, Homo Sapiens
TINICFPDH

SEQ ID NO: 1362079 - protein, 9 aa, Homo Sapiens
LGEVGGPEL

SEQ ID NO: 1362080 - protein, 9 aa, Homo Sapiens
APDSQDRRW

SEQ ID NO: 1362081 - protein, 9 aa, Homo Sapiens
LYKLFIVYL

SEQ ID NO: 1362082 - protein, 9 aa, Homo Sapiens
VLLTALPII

SEQ ID NO: 1362083 - protein, 9 aa, Homo Sapiens
RLSQQIADI

SEQ ID NO: 1362084 - protein, 9 aa, Homo Sapiens
NSEDERSDR

SEQ ID NO: 1362085 - protein, 9 aa, Homo Sapiens
AAIHSHAGR

SEQ ID NO: 1362086 - protein, 9 aa, Homo Sapiens
SLLTFWNLS

SEQ ID NO: 1362087 - protein, 9 aa, Homo Sapiens
LFIVYLTIT

SEQ ID NO: 1362088 - protein, 9 aa, Homo Sapiens
WTKSYSFVV

SEQ ID NO: 1362089 - protein, 9 aa, Homo Sapiens
KMGTAPDSQ

SEQ ID NO: 1362090 - protein, 9 aa, Homo Sapiens
TNQNHKVQA

SEQ ID NO: 1362091 - protein, 9 aa, Homo Sapiens
AIQQLVRKL

SEQ ID NO: 1362092 - protein, 9 aa, Homo Sapiens
SPEALKHEG

SEQ ID NO: 1362093 - protein, 9 aa, Homo Sapiens
FWNLSNSAQ

SEQ ID NO: 1362094 - protein, 9 aa, Homo Sapiens
CLRLDSTIA

SEQ ID NO: 1362095 - protein, 9 aa, Homo Sapiens
IVYLTITIN

SEQ ID NO: 1362096 - protein, 9 aa, Homo Sapiens
NICFPDHFI

SEQ ID NO: 1362097 - protein, 9 aa, Homo Sapiens
PEALKHEGY

SEQ ID NO: 1362098 - protein, 9 aa, Homo Sapiens
PPEKVGWVQ

SEQ ID NO: 1362099 - protein, 9 aa, Homo Sapiens
NHKVQARTE

SEQ ID NO: 1362100 - protein, 9 aa, Homo Sapiens
HAGREFHKP

SEQ ID NO: 1362101 - protein, 9 aa, Homo Sapiens
SCLPMDCGV

SEQ ID NO: 1362102 - protein, 9 aa, Homo Sapiens
AQKEMIAKL

SEQ ID NO: 1362103 - protein, 9 aa, Homo Sapiens
SNSAQTNID

SEQ ID NO: 1362104 - protein, 9 aa, Homo Sapiens
HSHAGREFH

SEQ ID NO: 1362105 - protein, 9 aa, Homo Sapiens
CWAAIHSHA

SEQ ID NO: 1362106 - protein, 9 aa, Homo Sapiens
EDKWKRLSQ

SEQ ID NO: 1362107 - protein, 9 aa, Homo Sapiens
SGGNSCRAK

SEQ ID NO: 1362108 - protein, 9 aa, Homo Sapiens
LQVKMGTAP

SEQ ID NO: 1362109 - protein, 9 aa, Homo Sapiens
KVGWVQKFC

SEQ ID NO: 1362110 - protein, 9 aa, Homo Sapiens
ELPKYLCGF

SEQ ID NO: 1362111 - protein, 9 aa, Homo Sapiens
FGIQRQNSV

SEQ ID NO: 1362112 - protein, 9 aa, Homo Sapiens
HLCAAEVVT

SEQ ID NO: 1362113 - protein, 9 aa, Homo Sapiens
RFKLREIEA

SEQ ID NO: 1362114 - protein, 9 aa, Homo Sapiens
LAKSLSTLS

SEQ ID NO: 1362115 - protein, 9 aa, Homo Sapiens
SCFGIQRQN

SEQ ID NO: 1362116 - protein, 9 aa, Homo Sapiens
REYFHHGSV

SEQ ID NO: 1362117 - protein, 9 aa, Homo Sapiens
EYFHHGSVV

SEQ ID NO: 1362118 - protein, 9 aa, Homo Sapiens
KNSEVKGAQ

SEQ ID NO: 1362119 - protein, 9 aa, Homo Sapiens
PLFEAVRGS

SEQ ID NO: 1362120 - protein, 9 aa, Homo Sapiens
MGPMSSTWE

SEQ ID NO: 1362121 - protein, 9 aa, Homo Sapiens
LKQVTKVFL

SEQ ID NO: 1362122 - protein, 9 aa, Homo Sapiens
DTFRINNIT

SEQ ID NO: 1362123 - protein, 9 aa, Homo Sapiens
KFIPAMVCP

SEQ ID NO: 1362124 - protein, 9 aa, Homo Sapiens
RINNITGVI

SEQ ID NO: 1362125 - protein, 9 aa, Homo Sapiens
MNDQLIFLE

SEQ ID NO: 1362126 - protein, 9 aa, Homo Sapiens
PYAWKIWNV

SEQ ID NO: 1362127 - protein, 9 aa, Homo Sapiens
EAQRLANSP

SEQ ID NO: 1362128 - protein, 9 aa, Homo Sapiens
FKLREIEAI

SEQ ID NO: 1362129 - protein, 9 aa, Homo Sapiens
SSLPNPWPG

SEQ ID NO: 1362130 - protein, 9 aa, Homo Sapiens
TFDGKKCLD

SEQ ID NO: 1362131 - protein, 9 aa, Homo Sapiens
AQKLGPRRI

SEQ ID NO: 1362132 - protein, 9 aa, Homo Sapiens
KCLDLSKMG

SEQ ID NO: 1362133 - protein, 9 aa, Homo Sapiens
PRRIRGPRN

SEQ ID NO: 1362134 - protein, 9 aa, Homo Sapiens
AAEDKFWRV

SEQ ID NO: 1362135 - protein, 9 aa, Homo Sapiens
MVVEAASLA

SEQ ID NO: 1362136 - protein, 9 aa, Homo Sapiens
DKFWRVRYM

SEQ ID NO: 1362137 - protein, 9 aa, Homo Sapiens
EEPITVAHM

SEQ ID NO: 1362138 - protein, 9 aa, Homo Sapiens
EARLECDEE

SEQ ID NO: 1362139 - protein, 9 aa, Homo Sapiens
QKRWLGTCV

SEQ ID NO: 1362140 - protein, 9 aa, Homo Sapiens
HIRSLQLLQ

SEQ ID NO: 1362141 - protein, 9 aa, Homo Sapiens
LHPGLPENH

SEQ ID NO: 1362142 - protein, 9 aa, Homo Sapiens
LRTSEKAGL

SEQ ID NO: 1362143 - protein, 9 aa, Homo Sapiens
TGYKGPYAW

SEQ ID NO: 1362144 - protein, 9 aa, Homo Sapiens
VSQQAAKFI

SEQ ID NO: 1362145 - protein, 9 aa, Homo Sapiens
LRLAWQIRE

SEQ ID NO: 1362146 - protein, 9 aa, Homo Sapiens
TSRHEISNV

SEQ ID NO: 1362147 - protein, 9 aa, Homo Sapiens
FIMVMHIRS

SEQ ID NO: 1362148 - protein, 9 aa, Homo Sapiens
RVPNPPFST

SEQ ID NO: 1362149 - protein, 9 aa, Homo Sapiens
AQRLANSPP

SEQ ID NO: 1362150 - protein, 9 aa, Homo Sapiens
QGPGAGTPV

SEQ ID NO: 1362151 - protein, 9 aa, Homo Sapiens
ISNVVREMA

SEQ ID NO: 1362152 - protein, 9 aa, Homo Sapiens
GVLELLKRV

SEQ ID NO: 1362153 - protein, 9 aa, Homo Sapiens
VLELLKRVD

SEQ ID NO: 1362154 - protein, 9 aa, Homo Sapiens
VMDLLAQAN

SEQ ID NO: 1362155 - protein, 9 aa, Homo Sapiens
GAQPLRPEQ

SEQ ID NO: 1362156 - protein, 9 aa, Homo Sapiens
AEDKFWRVR

SEQ ID NO: 1362157 - protein, 9 aa, Homo Sapiens
KRRYSREGG

SEQ ID NO: 1362158 - protein, 9 aa, Homo Sapiens
EQMQGATLG

SEQ ID NO: 1362159 - protein, 9 aa, Homo Sapiens
PEHFCGTCN

SEQ ID NO: 1362160 - protein, 9 aa, Homo Sapiens
ATLGRKDFW

SEQ ID NO: 1362161 - protein, 9 aa, Homo Sapiens
PGAGTPVPW

SEQ ID NO: 1362162 - protein, 9 aa, Homo Sapiens
LIFLERAFI

SEQ ID NO: 1362163 - protein, 9 aa, Homo Sapiens
TIRDSFSNQ

SEQ ID NO: 1362164 - protein, 9 aa, Homo Sapiens
REKEEILAL

SEQ ID NO: 1362165 - protein, 9 aa, Homo Sapiens
SLSTLSAHV

SEQ ID NO: 1362166 - protein, 9 aa, Homo Sapiens
ANSPPPQVW

SEQ ID NO: 1362167 - protein, 9 aa, Homo Sapiens
RSSGAQPLR

SEQ ID NO: 1362168 - protein, 9 aa, Homo Sapiens
IRSLQLLQD

SEQ ID NO: 1362169 - protein, 9 aa, Homo Sapiens
TDTITVHVA

SEQ ID NO: 1362170 - protein, 9 aa, Homo Sapiens
EVHEARLEC

SEQ ID NO: 1362171 - protein, 9 aa, Homo Sapiens
EDKFWRVRY

SEQ ID NO: 1362172 - protein, 9 aa, Homo Sapiens
MLLPIKPGE

SEQ ID NO: 1362173 - protein, 9 aa, Homo Sapiens
RIRGPRNWK

SEQ ID NO: 1362174 - protein, 9 aa, Homo Sapiens
PITVAHMVV

SEQ ID NO: 1362175 - protein, 9 aa, Homo Sapiens
YLCGFHKCS

SEQ ID NO: 1362176 - protein, 9 aa, Homo Sapiens
CDALSKLFV

SEQ ID NO: 1362177 - protein, 9 aa, Homo Sapiens
RTSEKAGLC

SEQ ID NO: 1362178 - protein, 9 aa, Homo Sapiens
PFLCSVTAL

SEQ ID NO: 1362179 - protein, 9 aa, Homo Sapiens
KLREIEAIQ

SEQ ID NO: 1362180 - protein, 9 aa, Homo Sapiens
SKRRYSREG

SEQ ID NO: 1362181 - protein, 9 aa, Homo Sapiens
IRELLMDWG

SEQ ID NO: 1362182 - protein, 9 aa, Homo Sapiens
AWQIRELLM

SEQ ID NO: 1362183 - protein, 9 aa, Homo Sapiens
LAQANYTFE

SEQ ID NO: 1362184 - protein, 9 aa, Homo Sapiens
VTNYTVRVP

SEQ ID NO: 1362185 - protein, 9 aa, Homo Sapiens
ASAMGPMSS

SEQ ID NO: 1362186 - protein, 9 aa, Homo Sapiens
DIMVHLVAV

SEQ ID NO: 1362187 - protein, 9 aa, Homo Sapiens
NEEDTFRIN

SEQ ID NO: 1362188 - protein, 9 aa, Homo Sapiens
SSGGLAKSL

SEQ ID NO: 1362189 - protein, 9 aa, Homo Sapiens
SLQLLQDGN

SEQ ID NO: 1362190 - protein, 9 aa, Homo Sapiens
HRHYNSRAP

SEQ ID NO: 1362191 - protein, 9 aa, Homo Sapiens
DEQMQGATL

SEQ ID NO: 1362192 - protein, 9 aa, Homo Sapiens
WKPFLCSVT

SEQ ID NO: 1362193 - protein, 9 aa, Homo Sapiens
RQAAEDKFW

SEQ ID NO: 1362194 - protein, 9 aa, Homo Sapiens
ASSGTCFTR

SEQ ID NO: 1362195 - protein, 9 aa, Homo Sapiens
ALRLAWQIR

SEQ ID NO: 1362196 - protein, 9 aa, Homo Sapiens
PGLPENHFG

SEQ ID NO: 1362197 - protein, 9 aa, Homo Sapiens
LANSPPPQV

SEQ ID NO: 1362198 - protein, 9 aa, Homo Sapiens
EVSQQAAKF

SEQ ID NO: 1362199 - protein, 9 aa, Homo Sapiens
HSSGGLAKS

SEQ ID NO: 1362200 - protein, 9 aa, Homo Sapiens
VTVMDLLAQ

SEQ ID NO: 1362201 - protein, 9 aa, Homo Sapiens
SEKAGLCFI

SEQ ID NO: 1362202 - protein, 9 aa, Homo Sapiens
LLPIKPGET

SEQ ID NO: 1362203 - protein, 9 aa, Homo Sapiens
PCRLVGTTN

SEQ ID NO: 1362204 - protein, 9 aa, Homo Sapiens
VDIMVHLVA

SEQ ID NO: 1362205 - protein, 9 aa, Homo Sapiens
GGLAKSLST

SEQ ID NO: 1362206 - protein, 9 aa, Homo Sapiens
DLKEGFHGR

SEQ ID NO: 1362207 - protein, 9 aa, Homo Sapiens
LVAVRSRQR

SEQ ID NO: 1362208 - protein, 9 aa, Homo Sapiens
TRKRISSKS

SEQ ID NO: 1362209 - protein, 9 aa, Homo Sapiens
YKGPYAWKI

SEQ ID NO: 1362210 - protein, 9 aa, Homo Sapiens
ISREYFHHG

SEQ ID NO: 1362211 - protein, 9 aa, Homo Sapiens
IFLERAFID

SEQ ID NO: 1362212 - protein, 9 aa, Homo Sapiens
LRQAAEDKF

SEQ ID NO: 1362213 - protein, 9 aa, Homo Sapiens
EVVTIRDSF

SEQ ID NO: 1362214 - protein, 9 aa, Homo Sapiens
TLGRKDFWR

SEQ ID NO: 1362215 - protein, 9 aa, Homo Sapiens
AGTPVPWFS

SEQ ID NO: 1362216 - protein, 9 aa, Homo Sapiens
ITHKGEIRG

SEQ ID NO: 1362217 - protein, 9 aa, Homo Sapiens
GPCRLVGTT

SEQ ID NO: 1362218 - protein, 9 aa, Homo Sapiens
HLVAVRSRQ

SEQ ID NO: 1362219 - protein, 9 aa, Homo Sapiens
LLAQANYTF

SEQ ID NO: 1362220 - protein, 9 aa, Homo Sapiens
QIRELLMDW

SEQ ID NO: 1362221 - protein, 9 aa, Homo Sapiens
VVTIRDSFS

SEQ ID NO: 1362222 - protein, 9 aa, Homo Sapiens
PRRRPGPCR

SEQ ID NO: 1362223 - protein, 9 aa, Homo Sapiens
QDLKEGFHG

SEQ ID NO: 1362224 - protein, 9 aa, Homo Sapiens
EPITVAHMV

SEQ ID NO: 1362225 - protein, 9 aa, Homo Sapiens
KKEVHEARL

SEQ ID NO: 1362226 - protein, 9 aa, Homo Sapiens
NVVREMAWG

SEQ ID NO: 1362227 - protein, 9 aa, Homo Sapiens
PVPWFSSAL

SEQ ID NO: 1362228 - protein, 9 aa, Homo Sapiens
QLREKEEIL

SEQ ID NO: 1362229 - protein, 9 aa, Homo Sapiens
HPGLPENHF

SEQ ID NO: 1362230 - protein, 9 aa, Homo Sapiens
HEARLECDE

SEQ ID NO: 1362231 - protein, 9 aa, Homo Sapiens
FITSMPEHF

SEQ ID NO: 1362232 - protein, 9 aa, Homo Sapiens
WQIRELLMD

SEQ ID NO: 1362233 - protein, 9 aa, Homo Sapiens
RGVLELLKR

SEQ ID NO: 1362234 - protein, 9 aa, Homo Sapiens
GAGTPVPWF

SEQ ID NO: 1362235 - protein, 9 aa, Homo Sapiens
FNDCQNMLL

SEQ ID NO: 1362236 - protein, 9 aa, Homo Sapiens
GLCFIRTDQ

SEQ ID NO: 1362237 - protein, 9 aa, Homo Sapiens
NDCQNMLLP

SEQ ID NO: 1362238 - protein, 9 aa, Homo Sapiens
EGEAQRLAN

SEQ ID NO: 1362239 - protein, 9 aa, Homo Sapiens
AQPLRPEQC

SEQ ID NO: 1362240 - protein, 9 aa, Homo Sapiens
QFCYITHKG

SEQ ID NO: 1362241 - protein, 9 aa, Homo Sapiens
ITFDGKKCL

SEQ ID NO: 1362242 - protein, 9 aa, Homo Sapiens
EFYQFCYIT

SEQ ID NO: 1362243 - protein, 9 aa, Homo Sapiens
EKAGLCFIR

SEQ ID NO: 1362244 - protein, 9 aa, Homo Sapiens
PNPPFSTWI

SEQ ID NO: 1362245 - protein, 9 aa, Homo Sapiens
LKKRFKLRE

SEQ ID NO: 1362246 - protein, 9 aa, Homo Sapiens
RPRCDALSK

SEQ ID NO: 1362247 - protein, 9 aa, Homo Sapiens
RRPRCDALS

SEQ ID NO: 1362248 - protein, 9 aa, Homo Sapiens
ITVAHMVVE

SEQ ID NO: 1362249 - protein, 9 aa, Homo Sapiens
GNEEDTFRI

SEQ ID NO: 1362250 - protein, 9 aa, Homo Sapiens
RGSGGKTLE

SEQ ID NO: 1362251 - protein, 9 aa, Homo Sapiens
RCDALSKLF

SEQ ID NO: 1362252 - protein, 9 aa, Homo Sapiens
PKYLCGFHK

SEQ ID NO: 1362253 - protein, 9 aa, Homo Sapiens
YQFCYITHK

SEQ ID NO: 1362254 - protein, 9 aa, Homo Sapiens
TNYTVRVPN

SEQ ID NO: 1362255 - protein, 9 aa, Homo Sapiens
TKKEVHEAR

SEQ ID NO: 1362256 - protein, 9 aa, Homo Sapiens
LKEGFHGRP

SEQ ID NO: 1362257 - protein, 9 aa, Homo Sapiens
CLDLSKMGI

SEQ ID NO: 1362258 - protein, 9 aa, Homo Sapiens
AGLCFIRTD

SEQ ID NO: 1362259 - protein, 9 aa, Homo Sapiens
SGAQPLRPE

SEQ ID NO: 1362260 - protein, 9 aa, Homo Sapiens
CSVTALRLA

SEQ ID NO: 1362261 - protein, 9 aa, Homo Sapiens
DQGPGAGTP

SEQ ID NO: 1362262 - protein, 9 aa, Homo Sapiens
HQELPKYLC

SEQ ID NO: 1362263 - protein, 9 aa, Homo Sapiens
KRFKLREIE

SEQ ID NO: 1362264 - protein, 9 aa, Homo Sapiens
SPWHADHRH

SEQ ID NO: 1362265 - protein, 9 aa, Homo Sapiens
ADHRHYNSR

SEQ ID NO: 1362266 - protein, 9 aa, Homo Sapiens
PNPWPGKCL

SEQ ID NO: 1362267 - protein, 9 aa, Homo Sapiens
KGAQKRWLG

SEQ ID NO: 1362268 - protein, 9 aa, Homo Sapiens
TLKQVTKVF

SEQ ID NO: 1362269 - protein, 9 aa, Homo Sapiens
AEVVTIRDS

SEQ ID NO: 1362270 - protein, 9 aa, Homo Sapiens
GGRRSSGAQ

SEQ ID NO: 1362271 - protein, 9 aa, Homo Sapiens
GTDTITVHV

SEQ ID NO: 1362272 - protein, 9 aa, Homo Sapiens
RSPWHADHR

SEQ ID NO: 1362273 - protein, 9 aa, Homo Sapiens
ARGSCFGIQ

SEQ ID NO: 1362274 - protein, 9 aa, Homo Sapiens
MVHLVAVRS

SEQ ID NO: 1362275 - protein, 9 aa, Homo Sapiens
EGFHGRPLC

SEQ ID NO: 1362276 - protein, 9 aa, Homo Sapiens
QASSGTCFT

SEQ ID NO: 1362277 - protein, 9 aa, Homo Sapiens
EAVRGSGGK

SEQ ID NO: 1362278 - protein, 9 aa, Homo Sapiens
LAWQIRELL

SEQ ID NO: 1362279 - protein, 9 aa, Homo Sapiens
QAAEDKFWR

SEQ ID NO: 1362280 - protein, 9 aa, Homo Sapiens
SMPEHFCGT

SEQ ID NO: 1362281 - protein, 9 aa, Homo Sapiens
KPFLCSVTA

SEQ ID NO: 1362282 - protein, 9 aa, Homo Sapiens
TSEKAGLCF

SEQ ID NO: 1362283 - protein, 9 aa, Homo Sapiens
RMMNDQLIF

SEQ ID NO: 1362284 - protein, 9 aa, Homo Sapiens
QISFITSMP

SEQ ID NO: 1362285 - protein, 9 aa, Homo Sapiens
VHEARLECD

SEQ ID NO: 1362286 - protein, 9 aa, Homo Sapiens
LPKYLCGFH

SEQ ID NO: 1362287 - protein, 9 aa, Homo Sapiens
CTLKQVTKV

SEQ ID NO: 1362288 - protein, 9 aa, Homo Sapiens
SFITSMPEH

SEQ ID NO: 1362289 - protein, 9 aa, Homo Sapiens
DCTLKQVTK

SEQ ID NO: 1362290 - protein, 9 aa, Homo Sapiens
LITKKEVHE

SEQ ID NO: 1362291 - protein, 9 aa, Homo Sapiens
AKFIPAMVC

SEQ ID NO: 1362292 - protein, 9 aa, Homo Sapiens
ALSKLFVEA

SEQ ID NO: 1362293 - protein, 9 aa, Homo Sapiens
ELAQKLGPR

SEQ ID NO: 1362294 - protein, 9 aa, Homo Sapiens
IRGPRNWKP

SEQ ID NO: 1362295 - protein, 9 aa, Homo Sapiens
FHHGSVVTY

SEQ ID NO: 1362296 - protein, 9 aa, Homo Sapiens
EKEEILALE

SEQ ID NO: 1362297 - protein, 9 aa, Homo Sapiens
SSGTCFTRK

SEQ ID NO: 1362298 - protein, 9 aa, Homo Sapiens
HSVGSKRRY

SEQ ID NO: 1362299 - protein, 9 aa, Homo Sapiens
LPIKPGETQ

SEQ ID NO: 1362300 - protein, 9 aa, Homo Sapiens
KFWRVRYMV

SEQ ID NO: 1362301 - protein, 9 aa, Homo Sapiens
KKRFKLREI

SEQ ID NO: 1362302 - protein, 9 aa, Homo Sapiens
AQKRWLGTC

SEQ ID NO: 1362303 - protein, 9 aa, Homo Sapiens
ITSMPEHFC

SEQ ID NO: 1362304 - protein, 9 aa, Homo Sapiens
TPRRRPGPC

SEQ ID NO: 1362305 - protein, 9 aa, Homo Sapiens
SAMGPMSST

SEQ ID NO: 1362306 - protein, 9 aa, Homo Sapiens
PGPCRLVGT

SEQ ID NO: 1362307 - protein, 9 aa, Homo Sapiens
YAWKIWNVI

SEQ ID NO: 1362308 - protein, 9 aa, Homo Sapiens
FRINNITGV

SEQ ID NO: 1362309 - protein, 9 aa, Homo Sapiens
GIQRQNSVN

SEQ ID NO: 1362310 - protein, 9 aa, Homo Sapiens
SGTCFTRKR

SEQ ID NO: 1362311 - protein, 9 aa, Homo Sapiens
RHEISNVVR

SEQ ID NO: 1362312 - protein, 9 aa, Homo Sapiens
NWKPFLCSV

SEQ ID NO: 1362313 - protein, 9 aa, Homo Sapiens
HSSLPNPWP

SEQ ID NO: 1362314 - protein, 9 aa, Homo Sapiens
VDQGPGAGT

SEQ ID NO: 1362315 - protein, 9 aa, Homo Sapiens
YTVRVPNPP

SEQ ID NO: 1362316 - protein, 9 aa, Homo Sapiens
QMQGATLGR

SEQ ID NO: 1362317 - protein, 9 aa, Homo Sapiens
DQLIFLERA

SEQ ID NO: 1362318 - protein, 9 aa, Homo Sapiens
VHVAAGNAL

SEQ ID NO: 1362319 - protein, 9 aa, Homo Sapiens
NSEVKGAQK

SEQ ID NO: 1362320 - protein, 9 aa, Homo Sapiens
GKKCLDLSK

SEQ ID NO: 1362321 - protein, 9 aa, Homo Sapiens
NDQLIFLER

SEQ ID NO: 1362322 - protein, 9 aa, Homo Sapiens
QLIFLERAF

SEQ ID NO: 1362323 - protein, 9 aa, Homo Sapiens
AALTLRGVL

SEQ ID NO: 1362324 - protein, 9 aa, Homo Sapiens
VPNPPFSTW

SEQ ID NO: 1362325 - protein, 9 aa, Homo Sapiens
RGSCFGIQR

SEQ ID NO: 1362326 - protein, 9 aa, Homo Sapiens
LRMMNDQLI

SEQ ID NO: 1362327 - protein, 9 aa, Homo Sapiens
LSKLFVEAG

SEQ ID NO: 1362328 - protein, 9 aa, Homo Sapiens
QRLANSPPP

SEQ ID NO: 1362329 - protein, 9 aa, Homo Sapiens
VKGAQKRWL

SEQ ID NO: 1362330 - protein, 9 aa, Homo Sapiens
TCFTRKRIS

SEQ ID NO: 1362331 - protein, 9 aa, Homo Sapiens
EISNVVREM

SEQ ID NO: 1362332 - protein, 9 aa, Homo Sapiens
MDLLAQANY

SEQ ID NO: 1362333 - protein, 9 aa, Homo Sapiens
HEISNVVRE

SEQ ID NO: 1362334 - protein, 9 aa, Homo Sapiens
KQVTKVFLA

SEQ ID NO: 1362335 - protein, 9 aa, Homo Sapiens
GPMSSTWEP

SEQ ID NO: 1362336 - protein, 9 aa, Homo Sapiens
EGTDTITVH

SEQ ID NO: 1362337 - protein, 9 aa, Homo Sapiens
FEAVRGSGG

SEQ ID NO: 1362338 - protein, 9 aa, Homo Sapiens
SSGAQPLRP

SEQ ID NO: 1362339 - protein, 9 aa, Homo Sapiens
QKLGPRRIR

SEQ ID NO: 1362340 - protein, 9 aa, Homo Sapiens
SLKKRFKLR

SEQ ID NO: 1362341 - protein, 9 aa, Homo Sapiens
VRVPNPPFS

SEQ ID NO: 1362342 - protein, 9 aa, Homo Sapiens
RELLMDWGP

SEQ ID NO: 1362343 - protein, 9 aa, Homo Sapiens
GSKRRYSRE

SEQ ID NO: 1362344 - protein, 9 aa, Homo Sapiens
AAEVVTIRD

SEQ ID NO: 1362345 - protein, 9 aa, Homo Sapiens
SGGLAKSLS

SEQ ID NO: 1362346 - protein, 9 aa, Homo Sapiens
EQLREKEEI

SEQ ID NO: 1362347 - protein, 9 aa, Homo Sapiens
RSLQLLQDG

SEQ ID NO: 1362348 - protein, 9 aa, Homo Sapiens
VVREMAWGV

SEQ ID NO: 1362349 - protein, 9 aa, Homo Sapiens
IMVMHIRSL

SEQ ID NO: 1362350 - protein, 9 aa, Homo Sapiens
WPGKCLPDQ

SEQ ID NO: 1362351 - protein, 9 aa, Homo Sapiens
KHSVGSKRR

SEQ ID NO: 1362352 - protein, 9 aa, Homo Sapiens
VTIRDSFSN

SEQ ID NO: 1362353 - protein, 9 aa, Homo Sapiens
YKPLFEAVR

SEQ ID NO: 1362354 - protein, 9 aa, Homo Sapiens
DTITVHVAA

SEQ ID NO: 1362355 - protein, 9 aa, Homo Sapiens
FIPAMVCPE

SEQ ID NO: 1362356 - protein, 9 aa, Homo Sapiens
PSKHSVGSK

SEQ ID NO: 1362357 - protein, 9 aa, Homo Sapiens
RRSSGAQPL

SEQ ID NO: 1362358 - protein, 9 aa, Homo Sapiens
SKLFVEAGR

SEQ ID NO: 1362359 - protein, 9 aa, Homo Sapiens
NPWPGKCLP

SEQ ID NO: 1362360 - protein, 9 aa, Homo Sapiens
PENHFGLGT

SEQ ID NO: 1362361 - protein, 9 aa, Homo Sapiens
FLCSVTALR

SEQ ID NO: 1362362 - protein, 9 aa, Homo Sapiens
FYQFCYITH

SEQ ID NO: 1362363 - protein, 9 aa, Homo Sapiens
LREIEAIQC

SEQ ID NO: 1362364 - protein, 9 aa, Homo Sapiens
VMHIRSLQL

SEQ ID NO: 1362365 - protein, 9 aa, Homo Sapiens
HHGSVVTYH

SEQ ID NO: 1362366 - protein, 9 aa, Homo Sapiens
EEILALEAD

SEQ ID NO: 1362367 - protein, 9 aa, Homo Sapiens
FCYITHKGE

SEQ ID NO: 1362368 - protein, 9 aa, Homo Sapiens
GTCFTRKRI

SEQ ID NO: 1362369 - protein, 9 aa, Homo Sapiens
HFGLGTPEK

SEQ ID NO: 1362370 - protein, 9 aa, Homo Sapiens
FWRVRYMVA

SEQ ID NO: 1362371 - protein, 9 aa, Homo Sapiens
CGFHKCSRE

SEQ ID NO: 1362372 - protein, 9 aa, Homo Sapiens
QELAQKLGP

SEQ ID NO: 1362373 - protein, 9 aa, Homo Sapiens
TVMDLLAQA

SEQ ID NO: 1362374 - protein, 9 aa, Homo Sapiens
RRIRGPRNW

SEQ ID NO: 1362375 - protein, 9 aa, Homo Sapiens
GLPENHFGL

SEQ ID NO: 1362376 - protein, 9 aa, Homo Sapiens
TVAHMVVEA

SEQ ID NO: 1362377 - protein, 9 aa, Homo Sapiens
TPVPWFSSA

SEQ ID NO: 1362378 - protein, 9 aa, Homo Sapiens
QANYTFEVE

SEQ ID NO: 1362379 - protein, 9 aa, Homo Sapiens
TSMPEHFCG

SEQ ID NO: 1362380 - protein, 9 aa, Homo Sapiens
DHRHYNSRA

SEQ ID NO: 1362381 - protein, 9 aa, Homo Sapiens
MSSTWEPGA

SEQ ID NO: 1362382 - protein, 9 aa, Homo Sapiens
RLAWQIREL

SEQ ID NO: 1362383 - protein, 9 aa, Homo Sapiens
YFHHGSVVT

SEQ ID NO: 1362384 - protein, 9 aa, Homo Sapiens
AAKFIPAMV

SEQ ID NO: 1362385 - protein, 9 aa, Homo Sapiens
LTLRGVLEL

SEQ ID NO: 1362386 - protein, 9 aa, Homo Sapiens
DGKKCLDLS

SEQ ID NO: 1362387 - protein, 9 aa, Homo Sapiens
FTRKRISSK

SEQ ID NO: 1362388 - protein, 9 aa, Homo Sapiens
GEAQRLANS

SEQ ID NO: 1362389 - protein, 9 aa, Homo Sapiens
YITHKGEIR

SEQ ID NO: 1362390 - protein, 9 aa, Homo Sapiens
HDEQMQGAT

SEQ ID NO: 1362391 - protein, 9 aa, Homo Sapiens
RLANSPPPQ

SEQ ID NO: 1362392 - protein, 9 aa, Homo Sapiens
LFEAVRGSG

SEQ ID NO: 1362393 - protein, 9 aa, Homo Sapiens
AHMVVEAAS

SEQ ID NO: 1362394 - protein, 9 aa, Homo Sapiens
RPGPCRLVG

SEQ ID NO: 1362395 - protein, 9 aa, Homo Sapiens
LAQKLGPRR

SEQ ID NO: 1362396 - protein, 9 aa, Homo Sapiens
TITVHVAAG

SEQ ID NO: 1362397 - protein, 9 aa, Homo Sapiens
SGNEEDTFR

SEQ ID NO: 1362398 - protein, 9 aa, Homo Sapiens
SNVVREMAW

SEQ ID NO: 1362399 - protein, 9 aa, Homo Sapiens
AKSLSTLSA

SEQ ID NO: 1362400 - protein, 9 aa, Homo Sapiens
EILALEADM

SEQ ID NO: 1362401 - protein, 9 aa, Homo Sapiens
CQNMLLPIK

SEQ ID NO: 1362402 - protein, 9 aa, Homo Sapiens
AVRGSGGKT

SEQ ID NO: 1362403 - protein, 9 aa, Homo Sapiens
KYLCGFHKC

SEQ ID NO: 1362404 - protein, 9 aa, Homo Sapiens
SEVKGAQKR

SEQ ID NO: 1362405 - protein, 9 aa, Homo Sapiens
VAHMVVEAA

SEQ ID NO: 1362406 - protein, 9 aa, Homo Sapiens
MPEHFCGTC

SEQ ID NO: 1362407 - protein, 9 aa, Homo Sapiens
YHSSLPNPW

SEQ ID NO: 1362408 - protein, 9 aa, Homo Sapiens
HADHRHYNS

SEQ ID NO: 1362409 - protein, 9 aa, Homo Sapiens
RYTGYKGPY

SEQ ID NO: 1362410 - protein, 9 aa, Homo Sapiens
CAAEVVTIR

SEQ ID NO: 1362411 - protein, 9 aa, Homo Sapiens
TALRLAWQI

SEQ ID NO: 1362412 - protein, 9 aa, Homo Sapiens
KGPYAWKIW

SEQ ID NO: 1362413 - protein, 9 aa, Homo Sapiens
MHIRSLQLL

SEQ ID NO: 1362414 - protein, 9 aa, Homo Sapiens
SSTWEPGAQ

SEQ ID NO: 1362415 - protein, 9 aa, Homo Sapiens
QAAKFIPAM

SEQ ID NO: 1362416 - protein, 9 aa, Homo Sapiens
DCQNMLLPI

SEQ ID NO: 1362417 - protein, 9 aa, Homo Sapiens
WHADHRHYN

SEQ ID NO: 1362418 - protein, 9 aa, Homo Sapiens
NMLLPIKPG

SEQ ID NO: 1362419 - protein, 9 aa, Homo Sapiens
KLGPRRIRG

SEQ ID NO: 1362420 - protein, 9 aa, Homo Sapiens
ITVHVAAGN

SEQ ID NO: 1362421 - protein, 9 aa, Homo Sapiens
CRLVGTTNQ

SEQ ID NO: 1362422 - protein, 9 aa, Homo Sapiens
GPGAGTPVP

SEQ ID NO: 1362423 - protein, 9 aa, Homo Sapiens
QVTKVFLAT

SEQ ID NO: 1362424 - protein, 9 aa, Homo Sapiens
KFIDCTLKQ

SEQ ID NO: 1362425 - protein, 9 aa, Homo Sapiens
LCGFHKCSR

SEQ ID NO: 1362426 - protein, 9 aa, Homo Sapiens
CFTRKRISS

SEQ ID NO: 1362427 - protein, 9 aa, Homo Sapiens
DLLAQANYT

SEQ ID NO: 1362428 - protein, 9 aa, Homo Sapiens
PMSSTWEPG

SEQ ID NO: 1362429 - protein, 9 aa, Homo Sapiens
RGPRNWKPF

SEQ ID NO: 1362430 - protein, 9 aa, Homo Sapiens
LVDIMVHLV

SEQ ID NO: 1362431 - protein, 9 aa, Homo Sapiens
KKCLDLSKM

SEQ ID NO: 1362432 - protein, 9 aa, Homo Sapiens
KPLFEAVRG

SEQ ID NO: 1362433 - protein, 9 aa, Homo Sapiens
IQRQNSVNS

SEQ ID NO: 1362434 - protein, 9 aa, Homo Sapiens
ITKKEVHEA

SEQ ID NO: 1362435 - protein, 9 aa, Homo Sapiens
LPNPWPGKC

SEQ ID NO: 1362436 - protein, 9 aa, Homo Sapiens
VTALRLAWQ

SEQ ID NO: 1362437 - protein, 9 aa, Homo Sapiens
HVAAGNALI

SEQ ID NO: 1362438 - protein, 9 aa, Homo Sapiens
TFRINNITG

SEQ ID NO: 1362439 - protein, 9 aa, Homo Sapiens
SVTALRLAW

SEQ ID NO: 1362440 - protein, 9 aa, Homo Sapiens
KSLSTLSAH

SEQ ID NO: 1362441 - protein, 9 aa, Homo Sapiens
GATLGRKDF

SEQ ID NO: 1362442 - protein, 9 aa, Homo Sapiens
PRCDALSKL

SEQ ID NO: 1362443 - protein, 9 aa, Homo Sapiens
SISREYFHH

SEQ ID NO: 1362444 - protein, 9 aa, Homo Sapiens
QPLRPEQCP

SEQ ID NO: 1362445 - protein, 9 aa, Homo Sapiens
CYITHKGEI

SEQ ID NO: 1362446 - protein, 9 aa, Homo Sapiens
VGSKRRYSR

SEQ ID NO: 1362447 - protein, 9 aa, Homo Sapiens
KEGFHGRPL

SEQ ID NO: 1362448 - protein, 9 aa, Homo Sapiens
GPYAWKIWN

SEQ ID NO: 1362449 - protein, 9 aa, Homo Sapiens
KEVHEARLE

SEQ ID NO: 1362450 - protein, 9 aa, Homo Sapiens
VTKVFLATD

SEQ ID NO: 1362451 - protein, 9 aa, Homo Sapiens
IMVHLVAVR

SEQ ID NO: 1362452 - protein, 9 aa, Homo Sapiens
KEEILALEA

SEQ ID NO: 1362453 - protein, 9 aa, Homo Sapiens
TVRVPNPPF

SEQ ID NO: 1362454 - protein, 9 aa, Homo Sapiens
EVKGAQKRW

SEQ ID NO: 1362455 - protein, 9 aa, Homo Sapiens
EDTFRINNI

SEQ ID NO: 1362456 - protein, 9 aa, Homo Sapiens
LREKEEILA

SEQ ID NO: 1362457 - protein, 9 aa, Homo Sapiens
SQQAAKFIP

SEQ ID NO: 1362458 - protein, 9 aa, Homo Sapiens
LGPRRIRGP

SEQ ID NO: 1362459 - protein, 9 aa, Homo Sapiens
RRRPGPCRL

SEQ ID NO: 1362460 - protein, 9 aa, Homo Sapiens
FDGKKCLDL

SEQ ID NO: 1362461 - protein, 9 aa, Homo Sapiens
SSLKKRFKL

SEQ ID NO: 1362462 - protein, 9 aa, Homo Sapiens
GPRNWKPFL

SEQ ID NO: 1362463 - protein, 9 aa, Homo Sapiens
NSPPPQVWQ

SEQ ID NO: 1362464 - protein, 9 aa, Homo Sapiens
LCFIRTDQL

SEQ ID NO: 1362465 - protein, 9 aa, Homo Sapiens
QGATLGRKD

SEQ ID NO: 1362466 - protein, 9 aa, Homo Sapiens
DALSKLFVE

SEQ ID NO: 1362467 - protein, 9 aa, Homo Sapiens
LRGVLELLK

SEQ ID NO: 1362468 - protein, 9 aa, Homo Sapiens
TLRGVLELL

SEQ ID NO: 1362469 - protein, 9 aa, Homo Sapiens
NYTVRVPNP

SEQ ID NO: 1362470 - protein, 9 aa, Homo Sapiens
AMGPMSSTW

SEQ ID NO: 1362471 - protein, 9 aa, Homo Sapiens
RRPGPCRLV

SEQ ID NO: 1362472 - protein, 9 aa, Homo Sapiens
YTGYKGPYA

SEQ ID NO: 1362473 - protein, 9 aa, Homo Sapiens
QNMLLPIKP

SEQ ID NO: 1362474 - protein, 9 aa, Homo Sapiens
VRGSGGKTL

SEQ ID NO: 1362475 - protein, 9 aa, Homo Sapiens
ALTLRGVLE

SEQ ID NO: 1362476 - protein, 9 aa, Homo Sapiens
MQGATLGRK

SEQ ID NO: 1362477 - protein, 9 aa, Homo Sapiens
FIDCTLKQV

SEQ ID NO: 1362478 - protein, 9 aa, Homo Sapiens
PRNWKPFLC

SEQ ID NO: 1362479 - protein, 9 aa, Homo Sapiens
SREYFHHGS

SEQ ID NO: 1362480 - protein, 9 aa, Homo Sapiens
AQANYTFEV

SEQ ID NO: 1362481 - protein, 9 aa, Homo Sapiens
VHLVAVRSR

SEQ ID NO: 1362482 - protein, 9 aa, Homo Sapiens
HMVVEAASL

SEQ ID NO: 1362483 - protein, 9 aa, Homo Sapiens
TVHVAAGNA

SEQ ID NO: 1362484 - protein, 9 aa, Homo Sapiens
SRHEISNVV

SEQ ID NO: 1362485 - protein, 9 aa, Homo Sapiens
PWPGKCLPD

SEQ ID NO: 1362486 - protein, 9 aa, Homo Sapiens
GYKGPYAWK

SEQ ID NO: 1362487 - protein, 9 aa, Homo Sapiens
SVGSKRRYS

SEQ ID NO: 1362488 - protein, 9 aa, Homo Sapiens
HGSVVTYHC

SEQ ID NO: 1362489 - protein, 9 aa, Homo Sapiens
EEDTFRINN

SEQ ID NO: 1362490 - protein, 9 aa, Homo Sapiens
GAQKRWLGT

SEQ ID NO: 1362491 - protein, 9 aa, Homo Sapiens
NHFGLGTPE

SEQ ID NO: 1362492 - protein, 9 aa, Homo Sapiens
KITFDGKKC

SEQ ID NO: 1362493 - protein, 9 aa, Homo Sapiens
GSCFGIQRQ

SEQ ID NO: 1362494 - protein, 9 aa, Homo Sapiens
IDCTLKQVT

SEQ ID NO: 1362495 - protein, 9 aa, Homo Sapiens
RNWKPFLCS

SEQ ID NO: 1362496 - protein, 9 aa, Homo Sapiens
QRQNSVNSG

SEQ ID NO: 1362497 - protein, 9 aa, Homo Sapiens
LELLKRVDL

SEQ ID NO: 1362498 - protein, 9 aa, Homo Sapiens
GPRRIRGPR

SEQ ID NO: 1362499 - protein, 9 aa, Homo Sapiens
PWHADHRHY

SEQ ID NO: 1362500 - protein, 9 aa, Homo Sapiens
GTPVPWFSS

SEQ ID NO: 1362501 - protein, 9 aa, Homo Sapiens
MVMHIRSLQ

SEQ ID NO: 1362502 - protein, 9 aa, Homo Sapiens
GEFYQFCYI

SEQ ID NO: 1362503 - protein, 9 aa, Homo Sapiens
LCAAEVVTI

SEQ ID NO: 1362504 - protein, 9 aa, Homo Sapiens
QRSPWHADH

SEQ ID NO: 1362505 - protein, 9 aa, Homo Sapiens
LPENHFGLG

SEQ ID NO: 1362506 - protein, 9 aa, Homo Sapiens
QQAAKFIPA

SEQ ID NO: 1362507 - protein, 9 aa, Homo Sapiens
GRRSSGAQP

SEQ ID NO: 1362508 - protein, 9 aa, Homo Sapiens
MMNDQLIFL

SEQ ID NO: 1362509 - protein, 9 aa, Homo Sapiens
SLPNPWPGK

SEQ ID NO: 1362510 - protein, 9 aa, Homo Sapiens
ISFITSMPE

SEQ ID NO: 1362511 - protein, 9 aa, Homo Sapiens
GLAKSLSTL

SEQ ID NO: 1362512 - protein, 9 aa, Homo Sapiens
LCSVTALRL

SEQ ID NO: 1362513 - protein, 9 aa, Homo Sapiens
CFGIQRQNS

SEQ ID NO: 1362514 - protein, 9 aa, Homo Sapiens
KAGLCFIRT

SEQ ID NO: 1362515 - protein, 9 aa, Homo Sapiens
SKHSVGSKR

SEQ ID NO: 1362516 - protein, 9 aa, Homo Sapiens
VAVRSRQRA

SEQ ID NO: 1362517 - protein, 9 aa, Homo Sapiens
ENHFGLGTP

SEQ ID NO: 1362518 - protein, 9 aa, Homo Sapiens
QELPKYLCG

SEQ ID NO: 1362519 - protein, 9 aa, Homo Sapiens
PTQTAAGRP

SEQ ID NO: 1362520 - protein, 9 aa, Homo Sapiens
MCCLFVNLA

SEQ ID NO: 1362521 - protein, 9 aa, Homo Sapiens
YLEQLHQLH

SEQ ID NO: 1362522 - protein, 9 aa, Homo Sapiens
PLRNLPGHC

SEQ ID NO: 1362523 - protein, 9 aa, Homo Sapiens
LCSCCIPDP

SEQ ID NO: 1362524 - protein, 9 aa, Homo Sapiens
APHEAHYLH

SEQ ID NO: 1362525 - protein, 9 aa, Homo Sapiens
SFFWTYGSC

SEQ ID NO: 1362526 - protein, 9 aa, Homo Sapiens
SSLTTHRVI

SEQ ID NO: 1362527 - protein, 9 aa, Homo Sapiens
MPQYSSPSP

SEQ ID NO: 1362528 - protein, 9 aa, Homo Sapiens
LSESETGHM

SEQ ID NO: 1362529 - protein, 9 aa, Homo Sapiens
CDGCEEDNA

SEQ ID NO: 1362530 - protein, 9 aa, Homo Sapiens
EKGLLPVSA

SEQ ID NO: 1362531 - protein, 9 aa, Homo Sapiens
LDRGILKTY

SEQ ID NO: 1362532 - protein, 9 aa, Homo Sapiens
SLQVTPRAG

SEQ ID NO: 1362533 - protein, 9 aa, Homo Sapiens
LQRQKMELD

SEQ ID NO: 1362534 - protein, 9 aa, Homo Sapiens
TGAIHIGGR

SEQ ID NO: 1362535 - protein, 9 aa, Homo Sapiens
HHSPRQWLR

SEQ ID NO: 1362536 - protein, 9 aa, Homo Sapiens
YFKITIYGR

SEQ ID NO: 1362537 - protein, 9 aa, Homo Sapiens
IGRSWFPSA

SEQ ID NO: 1362538 - protein, 9 aa, Homo Sapiens
SVPDEIDIA

SEQ ID NO: 1362539 - protein, 9 aa, Homo Sapiens
RKVPLDSPP

SEQ ID NO: 1362540 - protein, 9 aa, Homo Sapiens
GPLVLENQH

SEQ ID NO: 1362541 - protein, 9 aa, Homo Sapiens
LSLQRLSRP

SEQ ID NO: 1362542 - protein, 9 aa, Homo Sapiens
LVLEMCNTD

SEQ ID NO: 1362543 - protein, 9 aa, Homo Sapiens
FAALQCHIS

SEQ ID NO: 1362544 - protein, 9 aa, Homo Sapiens
SVDLFHVQE

SEQ ID NO: 1362545 - protein, 9 aa, Homo Sapiens
HAHAAEIKN

SEQ ID NO: 1362546 - protein, 9 aa, Homo Sapiens
RVQELQAVS

SEQ ID NO: 1362547 - protein, 9 aa, Homo Sapiens
QVTQKRTEE

SEQ ID NO: 1362548 - protein, 9 aa, Homo Sapiens
VLGLAGRGR

SEQ ID NO: 1362549 - protein, 9 aa, Homo Sapiens
VECDGCEED

SEQ ID NO: 1362550 - protein, 9 aa, Homo Sapiens
NSSNLVALP

SEQ ID NO: 1362551 - protein, 9 aa, Homo Sapiens
CSGAISLQP

SEQ ID NO: 1362552 - protein, 9 aa, Homo Sapiens
QLQQDGLQL

SEQ ID NO: 1362553 - protein, 9 aa, Homo Sapiens
DSRLRIQDL

SEQ ID NO: 1362554 - protein, 9 aa, Homo Sapiens
PWNPCQVPC

SEQ ID NO: 1362555 - protein, 9 aa, Homo Sapiens
FAGDTNLGD

SEQ ID NO: 1362556 - protein, 9 aa, Homo Sapiens
LWESSKKVR

SEQ ID NO: 1362557 - protein, 9 aa, Homo Sapiens
SVRQIYSEH

SEQ ID NO: 1362558 - protein, 9 aa, Homo Sapiens
KLLPTLPPT

SEQ ID NO: 1362559 - protein, 9 aa, Homo Sapiens
HSLDFYQGH

SEQ ID NO: 1362560 - protein, 9 aa, Homo Sapiens
AGVLLVMHN

SEQ ID NO: 1362561 - protein, 9 aa, Homo Sapiens
FKRFFCLPS

SEQ ID NO: 1362562 - protein, 9 aa, Homo Sapiens
EEAVEEPQS

SEQ ID NO: 1362563 - protein, 9 aa, Homo Sapiens
LGSLNPCPF

SEQ ID NO: 1362564 - protein, 9 aa, Homo Sapiens
NDYSVRELQ

SEQ ID NO: 1362565 - protein, 9 aa, Homo Sapiens
AKHVSSAHH

SEQ ID NO: 1362566 - protein, 9 aa, Homo Sapiens
KKGCSKYGG

SEQ ID NO: 1362567 - protein, 9 aa, Homo Sapiens
LNEKSEGTG

SEQ ID NO: 1362568 - protein, 9 aa, Homo Sapiens
IWPVAVTLL

SEQ ID NO: 1362569 - protein, 9 aa, Homo Sapiens
KRPLGMQQN

SEQ ID NO: 1362570 - protein, 9 aa, Homo Sapiens
VRHNLSLKE

SEQ ID NO: 1362571 - protein, 9 aa, Homo Sapiens
GERPHGRGE

SEQ ID NO: 1362572 - protein, 9 aa, Homo Sapiens
RIFPEVAAQ

SEQ ID NO: 1362573 - protein, 9 aa, Homo Sapiens
LAFIAHPKA

SEQ ID NO: 1362574 - protein, 9 aa, Homo Sapiens
TKLACLGGG

SEQ ID NO: 1362575 - protein, 9 aa, Homo Sapiens
HWHSGDRPF

SEQ ID NO: 1362576 - protein, 9 aa, Homo Sapiens
SGGPCTCLP

SEQ ID NO: 1362577 - protein, 9 aa, Homo Sapiens
AVVHYDRSG

SEQ ID NO: 1362578 - protein, 9 aa, Homo Sapiens
QLHQDLVLR

SEQ ID NO: 1362579 - protein, 9 aa, Homo Sapiens
KLQPIPPGS

SEQ ID NO: 1362580 - protein, 9 aa, Homo Sapiens
VLLLGVPQT

SEQ ID NO: 1362581 - protein, 9 aa, Homo Sapiens
LSDNCTILE

SEQ ID NO: 1362582 - protein, 9 aa, Homo Sapiens
AGTAQKSQR

SEQ ID NO: 1362583 - protein, 9 aa, Homo Sapiens
KVREEFKEP

SEQ ID NO: 1362584 - protein, 9 aa, Homo Sapiens
LEGATKLAC

SEQ ID NO: 1362585 - protein, 9 aa, Homo Sapiens
LSGPRPASS

SEQ ID NO: 1362586 - protein, 9 aa, Homo Sapiens
RECMLASLW

SEQ ID NO: 1362587 - protein, 9 aa, Homo Sapiens
EQANKIRKS

SEQ ID NO: 1362588 - protein, 9 aa, Homo Sapiens
NNSARNILV

SEQ ID NO: 1362589 - protein, 9 aa, Homo Sapiens
HEELSGSFT

SEQ ID NO: 1362590 - protein, 9 aa, Homo Sapiens
STAQHVVGL

SEQ ID NO: 1362591 - protein, 9 aa, Homo Sapiens
QAERGEPGR

SEQ ID NO: 1362592 - protein, 9 aa, Homo Sapiens
YHSGKPPAM

SEQ ID NO: 1362593 - protein, 9 aa, Homo Sapiens
LDGHSHLVV

SEQ ID NO: 1362594 - protein, 9 aa, Homo Sapiens
SPCWSLAGL

SEQ ID NO: 1362595 - protein, 9 aa, Homo Sapiens
VLGEDEVGG

SEQ ID NO: 1362596 - protein, 9 aa, Homo Sapiens
DFLIDVVPR

SEQ ID NO: 1362597 - protein, 9 aa, Homo Sapiens
KPSCRWSGF

SEQ ID NO: 1362598 - protein, 9 aa, Homo Sapiens
MLELGSNCI

SEQ ID NO: 1362599 - protein, 9 aa, Homo Sapiens
RRSTRPAAL

SEQ ID NO: 1362600 - protein, 9 aa, Homo Sapiens
VKDTNDSPP

SEQ ID NO: 1362601 - protein, 9 aa, Homo Sapiens
HLPGQDTVS

SEQ ID NO: 1362602 - protein, 9 aa, Homo Sapiens
SPLVQPLAF

SEQ ID NO: 1362603 - protein, 9 aa, Homo Sapiens
PVPCVNAVD

SEQ ID NO: 1362604 - protein, 9 aa, Homo Sapiens
FARAGYERF

SEQ ID NO: 1362605 - protein, 9 aa, Homo Sapiens
SVALPAPAF

SEQ ID NO: 1362606 - protein, 9 aa, Homo Sapiens
VTRLLAELP

SEQ ID NO: 1362607 - protein, 9 aa, Homo Sapiens
CPFLHFIQL

SEQ ID NO: 1362608 - protein, 9 aa, Homo Sapiens
APVGPVQVG

SEQ ID NO: 1362609 - protein, 9 aa, Homo Sapiens
RGTIILTAE

SEQ ID NO: 1362610 - protein, 9 aa, Homo Sapiens
LKLTPDLQR

SEQ ID NO: 1362611 - protein, 9 aa, Homo Sapiens
YPRPGAHSP

SEQ ID NO: 1362612 - protein, 9 aa, Homo Sapiens
AEGQVADQE

SEQ ID NO: 1362613 - protein, 9 aa, Homo Sapiens
QEQRSAQVD

SEQ ID NO: 1362614 - protein, 9 aa, Homo Sapiens
AVECDGCEE

SEQ ID NO: 1362615 - protein, 9 aa, Homo Sapiens
WAPLVSGYV

SEQ ID NO: 1362616 - protein, 9 aa, Homo Sapiens
SFSRCGPGS

SEQ ID NO: 1362617 - protein, 9 aa, Homo Sapiens
MSSPRRMRG

SEQ ID NO: 1362618 - protein, 9 aa, Homo Sapiens
SPRRMRGTA

SEQ ID NO: 1362619 - protein, 9 aa, Homo Sapiens
GPMGVQARE

SEQ ID NO: 1362620 - protein, 9 aa, Homo Sapiens
MYRRRSQRC

SEQ ID NO: 1362621 - protein, 9 aa, Homo Sapiens
DKFSPSSPE

SEQ ID NO: 1362622 - protein, 9 aa, Homo Sapiens
AGLSTSSNF

SEQ ID NO: 1362623 - protein, 9 aa, Homo Sapiens
GDSCDGEEP

SEQ ID NO: 1362624 - protein, 9 aa, Homo Sapiens
GAVKFGRMS

SEQ ID NO: 1362625 - protein, 9 aa, Homo Sapiens
SARTSIIDS

SEQ ID NO: 1362626 - protein, 9 aa, Homo Sapiens
TATTAPSVL

SEQ ID NO: 1362627 - protein, 9 aa, Homo Sapiens
IHCIAGVGR

SEQ ID NO: 1362628 - protein, 9 aa, Homo Sapiens
NVENQEYLQ

SEQ ID NO: 1362629 - protein, 9 aa, Homo Sapiens
SPVRAPQTP

SEQ ID NO: 1362630 - protein, 9 aa, Homo Sapiens
GRGCCLRIH

SEQ ID NO: 1362631 - protein, 9 aa, Homo Sapiens
APQTPPQPQ

SEQ ID NO: 1362632 - protein, 9 aa, Homo Sapiens
ALLRVTVLT

SEQ ID NO: 1362633 - protein, 9 aa, Homo Sapiens
HDSREDPVG

SEQ ID NO: 1362634 - protein, 9 aa, Homo Sapiens
RGVSMAHKV

SEQ ID NO: 1362635 - protein, 9 aa, Homo Sapiens
LLDNLLALG

SEQ ID NO: 1362636 - protein, 9 aa, Homo Sapiens
LQIRGYVFK

SEQ ID NO: 1362637 - protein, 9 aa, Homo Sapiens
WCTSTEMGA

SEQ ID NO: 1362638 - protein, 9 aa, Homo Sapiens
EISLCGWRS

SEQ ID NO: 1362639 - protein, 9 aa, Homo Sapiens
PLVGSFIRS

SEQ ID NO: 1362640 - protein, 9 aa, Homo Sapiens
DLDPLDYAG

SEQ ID NO: 1362641 - protein, 9 aa, Homo Sapiens
HPPRGGFGG

SEQ ID NO: 1362642 - protein, 9 aa, Homo Sapiens
PVVAIYVNP

SEQ ID NO: 1362643 - protein, 9 aa, Homo Sapiens
VSMAHKVAT

SEQ ID NO: 1362644 - protein, 9 aa, Homo Sapiens
EPQESDTGA

SEQ ID NO: 1362645 - protein, 9 aa, Homo Sapiens
QGLQDSSKG

SEQ ID NO: 1362646 - protein, 9 aa, Homo Sapiens
TISHAGHVL

SEQ ID NO: 1362647 - protein, 9 aa, Homo Sapiens
RRPDRRECM

SEQ ID NO: 1362648 - protein, 9 aa, Homo Sapiens
MAPVGPVQV

SEQ ID NO: 1362649 - protein, 9 aa, Homo Sapiens
GRACARPAC

SEQ ID NO: 1362650 - protein, 9 aa, Homo Sapiens
LVSGYVTED

SEQ ID NO: 1362651 - protein, 9 aa, Homo Sapiens
GLYITTIVE

SEQ ID NO: 1362652 - protein, 9 aa, Homo Sapiens
GRNRVGRQE

SEQ ID NO: 1362653 - protein, 9 aa, Homo Sapiens
PRVDPSPQD

SEQ ID NO: 1362654 - protein, 9 aa, Homo Sapiens
CGIPTSLQK

SEQ ID NO: 1362655 - protein, 9 aa, Homo Sapiens
LEPVLERRT

SEQ ID NO: 1362656 - protein, 9 aa, Homo Sapiens
LGRLRGRRA

SEQ ID NO: 1362657 - protein, 9 aa, Homo Sapiens
SPSHSPPTT

SEQ ID NO: 1362658 - protein, 9 aa, Homo Sapiens
VHMADMEAK

SEQ ID NO: 1362659 - protein, 9 aa, Homo Sapiens
IQSYRDCQA

SEQ ID NO: 1362660 - protein, 9 aa, Homo Sapiens
LEVVEEENL

SEQ ID NO: 1362661 - protein, 9 aa, Homo Sapiens
LLPVSANDL

SEQ ID NO: 1362662 - protein, 9 aa, Homo Sapiens
GGAGEGAQE

SEQ ID NO: 1362663 - protein, 9 aa, Homo Sapiens
KVPDSIADT

SEQ ID NO: 1362664 - protein, 9 aa, Homo Sapiens
HKNLIMDHM

SEQ ID NO: 1362665 - protein, 9 aa, Homo Sapiens
YPKHMETFD

SEQ ID NO: 1362666 - protein, 9 aa, Homo Sapiens
VSLFVGGLS

SEQ ID NO: 1362667 - protein, 9 aa, Homo Sapiens
GNGMRSDVW

SEQ ID NO: 1362668 - protein, 9 aa, Homo Sapiens
PVPQVILHV

SEQ ID NO: 1362669 - protein, 9 aa, Homo Sapiens
KPSPHSTRS

SEQ ID NO: 1362670 - protein, 9 aa, Homo Sapiens
LQHRGRELR

SEQ ID NO: 1362671 - protein, 9 aa, Homo Sapiens
FADCGCMLQ

SEQ ID NO: 1362672 - protein, 9 aa, Homo Sapiens
LSSGRNIAL

SEQ ID NO: 1362673 - protein, 9 aa, Homo Sapiens
YAMRLGIGL

SEQ ID NO: 1362674 - protein, 9 aa, Homo Sapiens
SLDCSKGSL

SEQ ID NO: 1362675 - protein, 9 aa, Homo Sapiens
FVKDFVMMS

SEQ ID NO: 1362676 - protein, 9 aa, Homo Sapiens
TMSSPRRMR

SEQ ID NO: 1362677 - protein, 9 aa, Homo Sapiens
RHGYPLSWM

SEQ ID NO: 1362678 - protein, 9 aa, Homo Sapiens
PYLRVSLPE

SEQ ID NO: 1362679 - protein, 9 aa, Homo Sapiens
LCPKTILSS

SEQ ID NO: 1362680 - protein, 9 aa, Homo Sapiens
SSASPASTA

SEQ ID NO: 1362681 - protein, 9 aa, Homo Sapiens
QGRLFLDVV

SEQ ID NO: 1362682 - protein, 9 aa, Homo Sapiens
SHRSQPERQ

SEQ ID NO: 1362683 - protein, 9 aa, Homo Sapiens
MKCLTAVDC

SEQ ID NO: 1362684 - protein, 9 aa, Homo Sapiens
ASSELFKFT

SEQ ID NO: 1362685 - protein, 9 aa, Homo Sapiens
HLLPLWNEG

SEQ ID NO: 1362686 - protein, 9 aa, Homo Sapiens
TLSIPPVQA

SEQ ID NO: 1362687 - protein, 9 aa, Homo Sapiens
CAICHRGFL

SEQ ID NO: 1362688 - protein, 9 aa, Homo Sapiens
ELHYAALSF

SEQ ID NO: 1362689 - protein, 9 aa, Homo Sapiens
PAIAAVGEP

SEQ ID NO: 1362690 - protein, 9 aa, Homo Sapiens
SLFRTEPTA

SEQ ID NO: 1362691 - protein, 9 aa, Homo Sapiens
ILRCTHLAA

SEQ ID NO: 1362692 - protein, 9 aa, Homo Sapiens
KSLCYPSKL

SEQ ID NO: 1362693 - protein, 9 aa, Homo Sapiens
SGRNIALRN

SEQ ID NO: 1362694 - protein, 9 aa, Homo Sapiens
EHSLEVHCP

SEQ ID NO: 1362695 - protein, 9 aa, Homo Sapiens
QCVASSIQQ

SEQ ID NO: 1362696 - protein, 9 aa, Homo Sapiens
ERLRNSPVR

SEQ ID NO: 1362697 - protein, 9 aa, Homo Sapiens
SATTPNVCS

SEQ ID NO: 1362698 - protein, 9 aa, Homo Sapiens
HQMPQQPQV

SEQ ID NO: 1362699 - protein, 9 aa, Homo Sapiens
HFPSVALPA

SEQ ID NO: 1362700 - protein, 9 aa, Homo Sapiens
KPNLQALRA

SEQ ID NO: 1362701 - protein, 9 aa, Homo Sapiens
GASSPTSCS

SEQ ID NO: 1362702 - protein, 9 aa, Homo Sapiens
EETYTMATA

SEQ ID NO: 1362703 - protein, 9 aa, Homo Sapiens
LGDREVTRC

SEQ ID NO: 1362704 - protein, 9 aa, Homo Sapiens
PNPEQGLAL

SEQ ID NO: 1362705 - protein, 9 aa, Homo Sapiens
RWEPQPGRD

SEQ ID NO: 1362706 - protein, 9 aa, Homo Sapiens
ANVVPTMHS

SEQ ID NO: 1362707 - protein, 9 aa, Homo Sapiens
NHCRNPDGD

SEQ ID NO: 1362708 - protein, 9 aa, Homo Sapiens
CVTVGDAAT

SEQ ID NO: 1362709 - protein, 9 aa, Homo Sapiens
KKPWGFLQI

SEQ ID NO: 1362710 - protein, 9 aa, Homo Sapiens
HQAHSPLGS

SEQ ID NO: 1362711 - protein, 9 aa, Homo Sapiens
EVMERIKGD

SEQ ID NO: 1362712 - protein, 9 aa, Homo Sapiens
GMSLPPRSP

SEQ ID NO: 1362713 - protein, 9 aa, Homo Sapiens
NNPNHRNCI

SEQ ID NO: 1362714 - protein, 9 aa, Homo Sapiens
KAPKKTLLK

SEQ ID NO: 1362715 - protein, 9 aa, Homo Sapiens
FQCLFHRPL

SEQ ID NO: 1362716 - protein, 9 aa, Homo Sapiens
VTWFKISLE

SEQ ID NO: 1362717 - protein, 9 aa, Homo Sapiens
ETCQKKKEL

SEQ ID NO: 1362718 - protein, 9 aa, Homo Sapiens
ATMQARSFS

SEQ ID NO: 1362719 - protein, 9 aa, Homo Sapiens
RLRGRRADH

SEQ ID NO: 1362720 - protein, 9 aa, Homo Sapiens
ATVTEEILE

SEQ ID NO: 1362721 - protein, 9 aa, Homo Sapiens
RGFLREHPQ

SEQ ID NO: 1362722 - protein, 9 aa, Homo Sapiens
VLDLAQALR

SEQ ID NO: 1362723 - protein, 9 aa, Homo Sapiens
LDRYWSTTQ

SEQ ID NO: 1362724 - protein, 9 aa, Homo Sapiens
LNIKSDSAL

SEQ ID NO: 1362725 - protein, 9 aa, Homo Sapiens
ADSTMLQAI

SEQ ID NO: 1362726 - protein, 9 aa, Homo Sapiens
DDWARKVQR

SEQ ID NO: 1362727 - protein, 9 aa, Homo Sapiens
CKPVYCMPV

SEQ ID NO: 1362728 - protein, 9 aa, Homo Sapiens
DRCQTCPMN

SEQ ID NO: 1362729 - protein, 9 aa, Homo Sapiens
LGLLLPLAP

SEQ ID NO: 1362730 - protein, 9 aa, Homo Sapiens
FSWEDVKTD

SEQ ID NO: 1362731 - protein, 9 aa, Homo Sapiens
RAGYERFMP

SEQ ID NO: 1362732 - protein, 9 aa, Homo Sapiens
LSIPPVQAR

SEQ ID NO: 1362733 - protein, 9 aa, Homo Sapiens
ACARPACAP

SEQ ID NO: 1362734 - protein, 9 aa, Homo Sapiens
HSAPERPSA

SEQ ID NO: 1362735 - protein, 9 aa, Homo Sapiens
SRGDVHVGL

SEQ ID NO: 1362736 - protein, 9 aa, Homo Sapiens
GDGKKMDLD

SEQ ID NO: 1362737 - protein, 9 aa, Homo Sapiens
AKIEKKREV

SEQ ID NO: 1362738 - protein, 9 aa, Homo Sapiens
IIIRKTEYD

SEQ ID NO: 1362739 - protein, 9 aa, Homo Sapiens
MRKQGSRVQ

SEQ ID NO: 1362740 - protein, 9 aa, Homo Sapiens
HFYCELPAV

SEQ ID NO: 1362741 - protein, 9 aa, Homo Sapiens
TKITALPNV

SEQ ID NO: 1362742 - protein, 9 aa, Homo Sapiens
TVEDMCPDT

SEQ ID NO: 1362743 - protein, 9 aa, Homo Sapiens
SRKTWQRRL

SEQ ID NO: 1362744 - protein, 9 aa, Homo Sapiens
EESGIHKVA

SEQ ID NO: 1362745 - protein, 9 aa, Homo Sapiens
IDFAADESG

SEQ ID NO: 1362746 - protein, 9 aa, Homo Sapiens
KRMLSVSTK

SEQ ID NO: 1362747 - protein, 9 aa, Homo Sapiens
PTRSYEIAS

SEQ ID NO: 1362748 - protein, 9 aa, Homo Sapiens
FSCHSHTAV

SEQ ID NO: 1362749 - protein, 9 aa, Homo Sapiens
FPQCTFFFL

SEQ ID NO: 1362750 - protein, 9 aa, Homo Sapiens
VSSAHLPGQ

SEQ ID NO: 1362751 - protein, 9 aa, Homo Sapiens
CTAQDGGPC

SEQ ID NO: 1362752 - protein, 9 aa, Homo Sapiens
PLPSPPGPH

SEQ ID NO: 1362753 - protein, 9 aa, Homo Sapiens
DQPLLVRRD

SEQ ID NO: 1362754 - protein, 9 aa, Homo Sapiens
SAVAIANGG

SEQ ID NO: 1362755 - protein, 9 aa, Homo Sapiens
RLDCINGSE

SEQ ID NO: 1362756 - protein, 9 aa, Homo Sapiens
SRDQGFCQA

SEQ ID NO: 1362757 - protein, 9 aa, Homo Sapiens
DQPLLVRRN

SEQ ID NO: 1362758 - protein, 9 aa, Homo Sapiens
PLAQVPLSC

SEQ ID NO: 1362759 - protein, 9 aa, Homo Sapiens
LKDVQSKQL

SEQ ID NO: 1362760 - protein, 9 aa, Homo Sapiens
SVSAPQATM

SEQ ID NO: 1362761 - protein, 9 aa, Homo Sapiens
QSYRDCQAA

SEQ ID NO: 1362762 - protein, 9 aa, Homo Sapiens
QKAQFSLEE

SEQ ID NO: 1362763 - protein, 9 aa, Homo Sapiens
RPARTPPGG

SEQ ID NO: 1362764 - protein, 9 aa, Homo Sapiens
SKVTSEVTR

SEQ ID NO: 1362765 - protein, 9 aa, Homo Sapiens
GAMVPRGVS

SEQ ID NO: 1362766 - protein, 9 aa, Homo Sapiens
NKETIRHIT

SEQ ID NO: 1362767 - protein, 9 aa, Homo Sapiens
GVEVTVRIS

SEQ ID NO: 1362768 - protein, 9 aa, Homo Sapiens
YSLEFIKMT

SEQ ID NO: 1362769 - protein, 9 aa, Homo Sapiens
APGAPWRHG

SEQ ID NO: 1362770 - protein, 9 aa, Homo Sapiens
NAKTLSINT

SEQ ID NO: 1362771 - protein, 9 aa, Homo Sapiens
PQAGERGQK

SEQ ID NO: 1362772 - protein, 9 aa, Homo Sapiens
TVALILKAK

SEQ ID NO: 1362773 - protein, 9 aa, Homo Sapiens
VGGELFDRI

SEQ ID NO: 1362774 - protein, 9 aa, Homo Sapiens
RSFNQNRDG

SEQ ID NO: 1362775 - protein, 9 aa, Homo Sapiens
FSCGGNLLQ

SEQ ID NO: 1362776 - protein, 9 aa, Homo Sapiens
DNCLCYFEF

SEQ ID NO: 1362777 - protein, 9 aa, Homo Sapiens
KACRKQQVA

SEQ ID NO: 1362778 - protein, 9 aa, Homo Sapiens
ISNHGDLSL

SEQ ID NO: 1362779 - protein, 9 aa, Homo Sapiens
EGCVPSNFV

SEQ ID NO: 1362780 - protein, 9 aa, Homo Sapiens
TYMEMHYGH

SEQ ID NO: 1362781 - protein, 9 aa, Homo Sapiens
PSSNGRPAI

SEQ ID NO: 1362782 - protein, 9 aa, Homo Sapiens
IRNCKSKEV

SEQ ID NO: 1362783 - protein, 9 aa, Homo Sapiens
TSWISPAIN

SEQ ID NO: 1362784 - protein, 9 aa, Homo Sapiens
PGFVWLWFR

SEQ ID NO: 1362785 - protein, 9 aa, Homo Sapiens
PFPFSLRGN

SEQ ID NO: 1362786 - protein, 9 aa, Homo Sapiens
PSGSPPGSL

SEQ ID NO: 1362787 - protein, 9 aa, Homo Sapiens
RQEDAHMLD

SEQ ID NO: 1362788 - protein, 9 aa, Homo Sapiens
GMWSPKERW

SEQ ID NO: 1362789 - protein, 9 aa, Homo Sapiens
NCHRYINGR

SEQ ID NO: 1362790 - protein, 9 aa, Homo Sapiens
NFSSMLELS

SEQ ID NO: 1362791 - protein, 9 aa, Homo Sapiens
LQDSEEDIS

SEQ ID NO: 1362792 - protein, 9 aa, Homo Sapiens
HYVRKVLEL

SEQ ID NO: 1362793 - protein, 9 aa, Homo Sapiens
PGVTAVIDN

SEQ ID NO: 1362794 - protein, 9 aa, Homo Sapiens
DCVRLEGRD

SEQ ID NO: 1362795 - protein, 9 aa, Homo Sapiens
EKQGIGMKQ

SEQ ID NO: 1362796 - protein, 9 aa, Homo Sapiens
PLRVKPLKE

SEQ ID NO: 1362797 - protein, 9 aa, Homo Sapiens
REAQTLQQC

SEQ ID NO: 1362798 - protein, 9 aa, Homo Sapiens
CEHQAHQAD

SEQ ID NO: 1362799 - protein, 9 aa, Homo Sapiens
MKAVLRTSL

SEQ ID NO: 1362800 - protein, 9 aa, Homo Sapiens
QLFSGKDQP

SEQ ID NO: 1362801 - protein, 9 aa, Homo Sapiens
IALLNNRNS

SEQ ID NO: 1362802 - protein, 9 aa, Homo Sapiens
PTADEEEPV

SEQ ID NO: 1362803 - protein, 9 aa, Homo Sapiens
QVARFNGLR

SEQ ID NO: 1362804 - protein, 9 aa, Homo Sapiens
PIIGFVCGI

SEQ ID NO: 1362805 - protein, 9 aa, Homo Sapiens
GVTLRMVLL

SEQ ID NO: 1362806 - protein, 9 aa, Homo Sapiens
GAWIITGGP

SEQ ID NO: 1362807 - protein, 9 aa, Homo Sapiens
DTDGIHPLS

SEQ ID NO: 1362808 - protein, 9 aa, Homo Sapiens
VPVPQVILH

SEQ ID NO: 1362809 - protein, 9 aa, Homo Sapiens
RRRAFTYQS

SEQ ID NO: 1362810 - protein, 9 aa, Homo Sapiens
PLYHSALGV

SEQ ID NO: 1362811 - protein, 9 aa, Homo Sapiens
EATVECGVT

SEQ ID NO: 1362812 - protein, 9 aa, Homo Sapiens
IKNVLLLWI

SEQ ID NO: 1362813 - protein, 9 aa, Homo Sapiens
LGLAGRGRP

SEQ ID NO: 1362814 - protein, 9 aa, Homo Sapiens
ESQESHMAS

SEQ ID NO: 1362815 - protein, 9 aa, Homo Sapiens
VQGTKIILH

SEQ ID NO: 1362816 - protein, 9 aa, Homo Sapiens
VSLDIFQMH

SEQ ID NO: 1362817 - protein, 9 aa, Homo Sapiens
AQTTVPDGE

SEQ ID NO: 1362818 - protein, 9 aa, Homo Sapiens
RDMSIHDVS

SEQ ID NO: 1362819 - protein, 9 aa, Homo Sapiens
GFVALEIYF

SEQ ID NO: 1362820 - protein, 9 aa, Homo Sapiens
NVVAFDVHN

SEQ ID NO: 1362821 - protein, 9 aa, Homo Sapiens
QKRSRAQER

SEQ ID NO: 1362822 - protein, 9 aa, Homo Sapiens
RRNLARVVV

SEQ ID NO: 1362823 - protein, 9 aa, Homo Sapiens
APAFYELQH

SEQ ID NO: 1362824 - protein, 9 aa, Homo Sapiens
HLTMCFLSL

SEQ ID NO: 1362825 - protein, 9 aa, Homo Sapiens
EIVNLLLDA

SEQ ID NO: 1362826 - protein, 9 aa, Homo Sapiens
TIDIQATNA

SEQ ID NO: 1362827 - protein, 9 aa, Homo Sapiens
AIQQIMKEL

SEQ ID NO: 1362828 - protein, 9 aa, Homo Sapiens
SSMEQLTRE

SEQ ID NO: 1362829 - protein, 9 aa, Homo Sapiens
SDLYSSGRN

SEQ ID NO: 1362830 - protein, 9 aa, Homo Sapiens
PDESSDQNS

SEQ ID NO: 1362831 - protein, 9 aa, Homo Sapiens
GRMTFPCEM

SEQ ID NO: 1362832 - protein, 9 aa, Homo Sapiens
NQEYLQSKN

SEQ ID NO: 1362833 - protein, 9 aa, Homo Sapiens
KSGKIKSYK

SEQ ID NO: 1362834 - protein, 9 aa, Homo Sapiens
CKSCPVAQS

SEQ ID NO: 1362835 - protein, 9 aa, Homo Sapiens
SQRCPGYYE

SEQ ID NO: 1362836 - protein, 9 aa, Homo Sapiens
KQRKPKRAN

SEQ ID NO: 1362837 - protein, 9 aa, Homo Sapiens
DSPPLQDGS

SEQ ID NO: 1362838 - protein, 9 aa, Homo Sapiens
SNPSLHETS

SEQ ID NO: 1362839 - protein, 9 aa, Homo Sapiens
IQEESGIHK

SEQ ID NO: 1362840 - protein, 9 aa, Homo Sapiens
VNLLLDADV

SEQ ID NO: 1362841 - protein, 9 aa, Homo Sapiens
LIPEECGAV

SEQ ID NO: 1362842 - protein, 9 aa, Homo Sapiens
SSPGFSHWH

SEQ ID NO: 1362843 - protein, 9 aa, Homo Sapiens
HGSHAKDDA

SEQ ID NO: 1362844 - protein, 9 aa, Homo Sapiens
YEESKTRIS

SEQ ID NO: 1362845 - protein, 9 aa, Homo Sapiens
SPLPSPPGP

SEQ ID NO: 1362846 - protein, 9 aa, Homo Sapiens
GCRPLCPAQ

SEQ ID NO: 1362847 - protein, 9 aa, Homo Sapiens
NQDNASALN

SEQ ID NO: 1362848 - protein, 9 aa, Homo Sapiens
TPTLRARDQ

SEQ ID NO: 1362849 - protein, 9 aa, Homo Sapiens
EMTPYYISL

SEQ ID NO: 1362850 - protein, 9 aa, Homo Sapiens
PAAPAAARP

SEQ ID NO: 1362851 - protein, 9 aa, Homo Sapiens
TTTTRLPPC

SEQ ID NO: 1362852 - protein, 9 aa, Homo Sapiens
AMAEVSTPG

SEQ ID NO: 1362853 - protein, 9 aa, Homo Sapiens
STASSSTCS

SEQ ID NO: 1362854 - protein, 9 aa, Homo Sapiens
TYQCGIPTS

SEQ ID NO: 1362855 - protein, 9 aa, Homo Sapiens
ATSTATLSC

SEQ ID NO: 1362856 - protein, 9 aa, Homo Sapiens
RHSAPERPS

SEQ ID NO: 1362857 - protein, 9 aa, Homo Sapiens
HEVYLDPTD

SEQ ID NO: 1362858 - protein, 9 aa, Homo Sapiens
SDLENLAGE

SEQ ID NO: 1362859 - protein, 9 aa, Homo Sapiens
TTKATQKRE

SEQ ID NO: 1362860 - protein, 9 aa, Homo Sapiens
FLREHPQPH

SEQ ID NO: 1362861 - protein, 9 aa, Homo Sapiens
DLLLVILHF

SEQ ID NO: 1362862 - protein, 9 aa, Homo Sapiens
SSPRISVCG

SEQ ID NO: 1362863 - protein, 9 aa, Homo Sapiens
QKPHKCNDC

SEQ ID NO: 1362864 - protein, 9 aa, Homo Sapiens
DMHMTVSKP

SEQ ID NO: 1362865 - protein, 9 aa, Homo Sapiens
PGLPHGYPE

SEQ ID NO: 1362866 - protein, 9 aa, Homo Sapiens
TTLKLILVM

SEQ ID NO: 1362867 - protein, 9 aa, Homo Sapiens
PAAAFPPPG

SEQ ID NO: 1362868 - protein, 9 aa, Homo Sapiens
QDSLTRWHH

SEQ ID NO: 1362869 - protein, 9 aa, Homo Sapiens
RRPPAAAAP

SEQ ID NO: 1362870 - protein, 9 aa, Homo Sapiens
PALPHAGPP

SEQ ID NO: 1362871 - protein, 9 aa, Homo Sapiens
AHNTYHHCE

SEQ ID NO: 1362872 - protein, 9 aa, Homo Sapiens
IGPGCCHVV

SEQ ID NO: 1362873 - protein, 9 aa, Homo Sapiens
EDERQWQEE

SEQ ID NO: 1362874 - protein, 9 aa, Homo Sapiens
EWGHLDLAR

SEQ ID NO: 1362875 - protein, 9 aa, Homo Sapiens
NAGYLERVK

SEQ ID NO: 1362876 - protein, 9 aa, Homo Sapiens
LTADVHHYL

SEQ ID NO: 1362877 - protein, 9 aa, Homo Sapiens
AQFEDGLAV

SEQ ID NO: 1362878 - protein, 9 aa, Homo Sapiens
LESIERDGA

SEQ ID NO: 1362879 - protein, 9 aa, Homo Sapiens
PQPHRHLRR

SEQ ID NO: 1362880 - protein, 9 aa, Homo Sapiens
DQKDQLSPR

SEQ ID NO: 1362881 - protein, 9 aa, Homo Sapiens
LQGQDWCQE

SEQ ID NO: 1362882 - protein, 9 aa, Homo Sapiens
FNQLAPENP

SEQ ID NO: 1362883 - protein, 9 aa, Homo Sapiens
AQGETKRAR

SEQ ID NO: 1362884 - protein, 9 aa, Homo Sapiens
KAHLHWHSG

SEQ ID NO: 1362885 - protein, 9 aa, Homo Sapiens
GEGQGAMEE

SEQ ID NO: 1362886 - protein, 9 aa, Homo Sapiens
MLSVSTKDT

SEQ ID NO: 1362887 - protein, 9 aa, Homo Sapiens
CSGSFLYQV

SEQ ID NO: 1362888 - protein, 9 aa, Homo Sapiens
QEESGIHKV

SEQ ID NO: 1362889 - protein, 9 aa, Homo Sapiens
NLPGHCSDY

SEQ ID NO: 1362890 - protein, 9 aa, Homo Sapiens
LCCCNRHSI

SEQ ID NO: 1362891 - protein, 9 aa, Homo Sapiens
VEDASGDES

SEQ ID NO: 1362892 - protein, 9 aa, Homo Sapiens
SGFCGGWLP

SEQ ID NO: 1362893 - protein, 9 aa, Homo Sapiens
KTYMEMHYG

SEQ ID NO: 1362894 - protein, 9 aa, Homo Sapiens
FIIFRIIGI

SEQ ID NO: 1362895 - protein, 9 aa, Homo Sapiens
MPGEFPVSV

SEQ ID NO: 1362896 - protein, 9 aa, Homo Sapiens
PGWPEDPVL

SEQ ID NO: 1362897 - protein, 9 aa, Homo Sapiens
QNVVAFDVH

SEQ ID NO: 1362898 - protein, 9 aa, Homo Sapiens
TMCDVTVVV

SEQ ID NO: 1362899 - protein, 9 aa, Homo Sapiens
PFTQSILTR

SEQ ID NO: 1362900 - protein, 9 aa, Homo Sapiens
PIPTPARTL

SEQ ID NO: 1362901 - protein, 9 aa, Homo Sapiens
PSRWNYRHT

SEQ ID NO: 1362902 - protein, 9 aa, Homo Sapiens
PQVAMLPKL

SEQ ID NO: 1362903 - protein, 9 aa, Homo Sapiens
YSAICKKCG

SEQ ID NO: 1362904 - protein, 9 aa, Homo Sapiens
GQTGGTIGP

SEQ ID NO: 1362905 - protein, 9 aa, Homo Sapiens
CNKWEIVSM

SEQ ID NO: 1362906 - protein, 9 aa, Homo Sapiens
GVSPCWSLA

SEQ ID NO: 1362907 - protein, 9 aa, Homo Sapiens
ELFNSTYWV

SEQ ID NO: 1362908 - protein, 9 aa, Homo Sapiens
RSAGELEIV

SEQ ID NO: 1362909 - protein, 9 aa, Homo Sapiens
VGEPGFFSS

SEQ ID NO: 1362910 - protein, 9 aa, Homo Sapiens
RDGQGHGQQ

SEQ ID NO: 1362911 - protein, 9 aa, Homo Sapiens
SCSVLIKNM

SEQ ID NO: 1362912 - protein, 9 aa, Homo Sapiens
STTTLSWGS

SEQ ID NO: 1362913 - protein, 9 aa, Homo Sapiens
IGNGMRSDV

SEQ ID NO: 1362914 - protein, 9 aa, Homo Sapiens
PESRYTSDC

SEQ ID NO: 1362915 - protein, 9 aa, Homo Sapiens
RESDNHSPA

SEQ ID NO: 1362916 - protein, 9 aa, Homo Sapiens
LHDLYDKFE

SEQ ID NO: 1362917 - protein, 9 aa, Homo Sapiens
CGGNLLQVL

SEQ ID NO: 1362918 - protein, 9 aa, Homo Sapiens
QVEAPHQKV

SEQ ID NO: 1362919 - protein, 9 aa, Homo Sapiens
PMNFVHLAH

SEQ ID NO: 1362920 - protein, 9 aa, Homo Sapiens
GNQPKAASG

SEQ ID NO: 1362921 - protein, 9 aa, Homo Sapiens
VSSCWPGRS

SEQ ID NO: 1362922 - protein, 9 aa, Homo Sapiens
GGSKLALPM

SEQ ID NO: 1362923 - protein, 9 aa, Homo Sapiens
SPGLSPEEY

SEQ ID NO: 1362924 - protein, 9 aa, Homo Sapiens
LRPGACGPV

SEQ ID NO: 1362925 - protein, 9 aa, Homo Sapiens
DVLGTKLPR

SEQ ID NO: 1362926 - protein, 9 aa, Homo Sapiens
ENQWETPQR

SEQ ID NO: 1362927 - protein, 9 aa, Homo Sapiens
QLMFTLHFV

SEQ ID NO: 1362928 - protein, 9 aa, Homo Sapiens
EEVVVHAEG

SEQ ID NO: 1362929 - protein, 9 aa, Homo Sapiens
TSTATLSCL

SEQ ID NO: 1362930 - protein, 9 aa, Homo Sapiens
IFRKDPLQL

SEQ ID NO: 1362931 - protein, 9 aa, Homo Sapiens
LVYSDDKPE

SEQ ID NO: 1362932 - protein, 9 aa, Homo Sapiens
FCAWPSAIS

SEQ ID NO: 1362933 - protein, 9 aa, Homo Sapiens
RLLDPDSMD

SEQ ID NO: 1362934 - protein, 9 aa, Homo Sapiens
LRAHPVAEA

SEQ ID NO: 1362935 - protein, 9 aa, Homo Sapiens
EARAAHRRP

SEQ ID NO: 1362936 - protein, 9 aa, Homo Sapiens
PSRWPSSQG

SEQ ID NO: 1362937 - protein, 9 aa, Homo Sapiens
YQTPGLGSK

SEQ ID NO: 1362938 - protein, 9 aa, Homo Sapiens
GYFRLTADV

SEQ ID NO: 1362939 - protein, 9 aa, Homo Sapiens
PERNCYFTL

SEQ ID NO: 1362940 - protein, 9 aa, Homo Sapiens
NLGDREVTR

SEQ ID NO: 1362941 - protein, 9 aa, Homo Sapiens
KPVYCMPVC

SEQ ID NO: 1362942 - protein, 9 aa, Homo Sapiens
YVSAGTVEC

SEQ ID NO: 1362943 - protein, 9 aa, Homo Sapiens
QDSEEDISH

SEQ ID NO: 1362944 - protein, 9 aa, Homo Sapiens
KGDHSNNDR

SEQ ID NO: 1362945 - protein, 9 aa, Homo Sapiens
VSTYQYVET

SEQ ID NO: 1362946 - protein, 9 aa, Homo Sapiens
KAVFDEALL

SEQ ID NO: 1362947 - protein, 9 aa, Homo Sapiens
APENPFLSV

SEQ ID NO: 1362948 - protein, 9 aa, Homo Sapiens
QSERWPSGR

SEQ ID NO: 1362949 - protein, 9 aa, Homo Sapiens
QPKAASGCL

SEQ ID NO: 1362950 - protein, 9 aa, Homo Sapiens
APPALPHAG

SEQ ID NO: 1362951 - protein, 9 aa, Homo Sapiens
LLRVTVLTS

SEQ ID NO: 1362952 - protein, 9 aa, Homo Sapiens
WWGRGCCLR

SEQ ID NO: 1362953 - protein, 9 aa, Homo Sapiens
VFLGFAGVG

SEQ ID NO: 1362954 - protein, 9 aa, Homo Sapiens
LEPWLRKNY

SEQ ID NO: 1362955 - protein, 9 aa, Homo Sapiens
GTWTPCDRP

SEQ ID NO: 1362956 - protein, 9 aa, Homo Sapiens
TWQRRLRAC

SEQ ID NO: 1362957 - protein, 9 aa, Homo Sapiens
NNTKLKEWL

SEQ ID NO: 1362958 - protein, 9 aa, Homo Sapiens
MIIHCIAGV

SEQ ID NO: 1362959 - protein, 9 aa, Homo Sapiens
AHSLGAVQI

SEQ ID NO: 1362960 - protein, 9 aa, Homo Sapiens
SFNQNRDGT

SEQ ID NO: 1362961 - protein, 9 aa, Homo Sapiens
RNFEEVCTF

SEQ ID NO: 1362962 - protein, 9 aa, Homo Sapiens
LNTNMNVNM

SEQ ID NO: 1362963 - protein, 9 aa, Homo Sapiens
IHQTQYRPI

SEQ ID NO: 1362964 - protein, 9 aa, Homo Sapiens
VGKRNRNED

SEQ ID NO: 1362965 - protein, 9 aa, Homo Sapiens
TTHRVIHTG

SEQ ID NO: 1362966 - protein, 9 aa, Homo Sapiens
GPEQQAERG

SEQ ID NO: 1362967 - protein, 9 aa, Homo Sapiens
FAELCRKQG

SEQ ID NO: 1362968 - protein, 9 aa, Homo Sapiens
LELFSKVPP

SEQ ID NO: 1362969 - protein, 9 aa, Homo Sapiens
CGLCKPPPQ

SEQ ID NO: 1362970 - protein, 9 aa, Homo Sapiens
CIRGPWPPG

SEQ ID NO: 1362971 - protein, 9 aa, Homo Sapiens
VYVYRSGVP

SEQ ID NO: 1362972 - protein, 9 aa, Homo Sapiens
MVNAGASVV

SEQ ID NO: 1362973 - protein, 9 aa, Homo Sapiens
GIEHMYQND

SEQ ID NO: 1362974 - protein, 9 aa, Homo Sapiens
EEERHLEAE

SEQ ID NO: 1362975 - protein, 9 aa, Homo Sapiens
PNVCSLCGA

SEQ ID NO: 1362976 - protein, 9 aa, Homo Sapiens
KGLLPVSAN

SEQ ID NO: 1362977 - protein, 9 aa, Homo Sapiens
ECAGGCECG

SEQ ID NO: 1362978 - protein, 9 aa, Homo Sapiens
WKKPWGFLQ

SEQ ID NO: 1362979 - protein, 9 aa, Homo Sapiens
PRISVCGCL

SEQ ID NO: 1362980 - protein, 9 aa, Homo Sapiens
TEMDSSGES

SEQ ID NO: 1362981 - protein, 9 aa, Homo Sapiens
TAIDATPSA

SEQ ID NO: 1362982 - protein, 9 aa, Homo Sapiens
EAVGVRPYR

SEQ ID NO: 1362983 - protein, 9 aa, Homo Sapiens
MGNYMLDKF

SEQ ID NO: 1362984 - protein, 9 aa, Homo Sapiens
SFIRIHKVT

SEQ ID NO: 1362985 - protein, 9 aa, Homo Sapiens
APRRRTPPR

SEQ ID NO: 1362986 - protein, 9 aa, Homo Sapiens
MPKSDTDKT

SEQ ID NO: 1362987 - protein, 9 aa, Homo Sapiens
PGLEAIYLL

SEQ ID NO: 1362988 - protein, 9 aa, Homo Sapiens
QPPMHSGTF

SEQ ID NO: 1362989 - protein, 9 aa, Homo Sapiens
FSLSEEIGK

SEQ ID NO: 1362990 - protein, 9 aa, Homo Sapiens
LDSQCLVEA

SEQ ID NO: 1362991 - protein, 9 aa, Homo Sapiens
ADTHPFFND

SEQ ID NO: 1362992 - protein, 9 aa, Homo Sapiens
IITRVSNET

SEQ ID NO: 1362993 - protein, 9 aa, Homo Sapiens
SYKKHILVS

SEQ ID NO: 1362994 - protein, 9 aa, Homo Sapiens
HLRNEPCAV

SEQ ID NO: 1362995 - protein, 9 aa, Homo Sapiens
GLRAHPVAE

SEQ ID NO: 1362996 - protein, 9 aa, Homo Sapiens
KKKLMSLFV

SEQ ID NO: 1362997 - protein, 9 aa, Homo Sapiens
ECEKGFSWR

SEQ ID NO: 1362998 - protein, 9 aa, Homo Sapiens
RNAEEKANK

SEQ ID NO: 1362999 - protein, 9 aa, Homo Sapiens
GTHPGGSLN

SEQ ID NO: 1363000 - protein, 9 aa, Homo Sapiens
HQDLVLRPP

SEQ ID NO: 1363001 - protein, 9 aa, Homo Sapiens
SYLPRDLST

SEQ ID NO: 1363002 - protein, 9 aa, Homo Sapiens
KINNQIIVN

SEQ ID NO: 1363003 - protein, 9 aa, Homo Sapiens
TVTIPNGDI

SEQ ID NO: 1363004 - protein, 9 aa, Homo Sapiens
NVLRPPHIA

SEQ ID NO: 1363005 - protein, 9 aa, Homo Sapiens
PQMQYPDSP

SEQ ID NO: 1363006 - protein, 9 aa, Homo Sapiens
AVFSVTVPH

SEQ ID NO: 1363007 - protein, 9 aa, Homo Sapiens
LCMMVANIL

SEQ ID NO: 1363008 - protein, 9 aa, Homo Sapiens
LQDVSHNGL

SEQ ID NO: 1363009 - protein, 9 aa, Homo Sapiens
GAPIIGFVC

SEQ ID NO: 1363010 - protein, 9 aa, Homo Sapiens
PSSGRGSGG

SEQ ID NO: 1363011 - protein, 9 aa, Homo Sapiens
PKRANCVIQ

SEQ ID NO: 1363012 - protein, 9 aa, Homo Sapiens
PWRHGDEGP

SEQ ID NO: 1363013 - protein, 9 aa, Homo Sapiens
IEKKREVIL

SEQ ID NO: 1363014 - protein, 9 aa, Homo Sapiens
TCASHIGWK

SEQ ID NO: 1363015 - protein, 9 aa, Homo Sapiens
SERLLRPNG

SEQ ID NO: 1363016 - protein, 9 aa, Homo Sapiens
CSSTSAHTP

SEQ ID NO: 1363017 - protein, 9 aa, Homo Sapiens
EAVEEPQSR

SEQ ID NO: 1363018 - protein, 9 aa, Homo Sapiens
EETYDEDDA

SEQ ID NO: 1363019 - protein, 9 aa, Homo Sapiens
KELNIKSDS

SEQ ID NO: 1363020 - protein, 9 aa, Homo Sapiens
GAGSSVGDT

SEQ ID NO: 1363021 - protein, 9 aa, Homo Sapiens
AGLIQAQRD

SEQ ID NO: 1363022 - protein, 9 aa, Homo Sapiens
TALGRSQGL

SEQ ID NO: 1363023 - protein, 9 aa, Homo Sapiens
GYGAGAIRP

SEQ ID NO: 1363024 - protein, 9 aa, Homo Sapiens
LPKLLCRQM

SEQ ID NO: 1363025 - protein, 9 aa, Homo Sapiens
YGHYNERDE

SEQ ID NO: 1363026 - protein, 9 aa, Homo Sapiens
WLQVTPKVI

SEQ ID NO: 1363027 - protein, 9 aa, Homo Sapiens
AGVGIALGG

SEQ ID NO: 1363028 - protein, 9 aa, Homo Sapiens
STLQQRHPQ

SEQ ID NO: 1363029 - protein, 9 aa, Homo Sapiens
SPTPDESSD

SEQ ID NO: 1363030 - protein, 9 aa, Homo Sapiens
VPCHLSDNC

SEQ ID NO: 1363031 - protein, 9 aa, Homo Sapiens
LTRVGRTLS

SEQ ID NO: 1363032 - protein, 9 aa, Homo Sapiens
HNTYHHCEQ

SEQ ID NO: 1363033 - protein, 9 aa, Homo Sapiens
DLHVGIELG

SEQ ID NO: 1363034 - protein, 9 aa, Homo Sapiens
NGSPPPLPA

SEQ ID NO: 1363035 - protein, 9 aa, Homo Sapiens
FTHNECIAC

SEQ ID NO: 1363036 - protein, 9 aa, Homo Sapiens
RAFTYQSGS

SEQ ID NO: 1363037 - protein, 9 aa, Homo Sapiens
LMFEYQTLP

SEQ ID NO: 1363038 - protein, 9 aa, Homo Sapiens
DFKIRCTEP

SEQ ID NO: 1363039 - protein, 9 aa, Homo Sapiens
VVGNHPMHQ

SEQ ID NO: 1363040 - protein, 9 aa, Homo Sapiens
AAICPQLLQ

SEQ ID NO: 1363041 - protein, 9 aa, Homo Sapiens
ECGVTSRCV

SEQ ID NO: 1363042 - protein, 9 aa, Homo Sapiens
HFIQLMLLF

SEQ ID NO: 1363043 - protein, 9 aa, Homo Sapiens
HVSSAHHVL

SEQ ID NO: 1363044 - protein, 9 aa, Homo Sapiens
ASSGGARWG

SEQ ID NO: 1363045 - protein, 9 aa, Homo Sapiens
QTHSAGRMT

SEQ ID NO: 1363046 - protein, 9 aa, Homo Sapiens
SCCVSVSCK

SEQ ID NO: 1363047 - protein, 9 aa, Homo Sapiens
SLKEAADMT

SEQ ID NO: 1363048 - protein, 9 aa, Homo Sapiens
AQCKTCASH

SEQ ID NO: 1363049 - protein, 9 aa, Homo Sapiens
RATSQGLWN

SEQ ID NO: 1363050 - protein, 9 aa, Homo Sapiens
KNKETIRHI

SEQ ID NO: 1363051 - protein, 9 aa, Homo Sapiens
CGKHNSPEM

SEQ ID NO: 1363052 - protein, 9 aa, Homo Sapiens
SMILRIDLT

SEQ ID NO: 1363053 - protein, 9 aa, Homo Sapiens
MARHSAPER

SEQ ID NO: 1363054 - protein, 9 aa, Homo Sapiens
SHAGHVLAP

SEQ ID NO: 1363055 - protein, 9 aa, Homo Sapiens
VLDSQCLVE

SEQ ID NO: 1363056 - protein, 9 aa, Homo Sapiens
EDTYNSFIV

SEQ ID NO: 1363057 - protein, 9 aa, Homo Sapiens
GSNAHVGGN

SEQ ID NO: 1363058 - protein, 9 aa, Homo Sapiens
PASTASSST

SEQ ID NO: 1363059 - protein, 9 aa, Homo Sapiens
GRGRWVTSG

SEQ ID NO: 1363060 - protein, 9 aa, Homo Sapiens
LSVHKLPQC

SEQ ID NO: 1363061 - protein, 9 aa, Homo Sapiens
DAQKSLTVC

SEQ ID NO: 1363062 - protein, 9 aa, Homo Sapiens
DCPYHVFTH

SEQ ID NO: 1363063 - protein, 9 aa, Homo Sapiens
NLLLEYPKH

SEQ ID NO: 1363064 - protein, 9 aa, Homo Sapiens
DQEEVSGHQ

SEQ ID NO: 1363065 - protein, 9 aa, Homo Sapiens
LLVMHNFEH

SEQ ID NO: 1363066 - protein, 9 aa, Homo Sapiens
RVDEYHIED

SEQ ID NO: 1363067 - protein, 9 aa, Homo Sapiens
PERMETKWR

SEQ ID NO: 1363068 - protein, 9 aa, Homo Sapiens
KLAYKKAIM

SEQ ID NO: 1363069 - protein, 9 aa, Homo Sapiens
ESRKFDPLL

SEQ ID NO: 1363070 - protein, 9 aa, Homo Sapiens
VMERIKGDQ

SEQ ID NO: 1363071 - protein, 9 aa, Homo Sapiens
KLQGQDWCQ

SEQ ID NO: 1363072 - protein, 9 aa, Homo Sapiens
VCDGMGQRA

SEQ ID NO: 1363073 - protein, 9 aa, Homo Sapiens
GGEIYPKMH

SEQ ID NO: 1363074 - protein, 9 aa, Homo Sapiens
RYSAKGPCV

SEQ ID NO: 1363075 - protein, 9 aa, Homo Sapiens
VASSIQQEL

SEQ ID NO: 1363076 - protein, 9 aa, Homo Sapiens
GKFLAFYQC

SEQ ID NO: 1363077 - protein, 9 aa, Homo Sapiens
SPKAPGLME

SEQ ID NO: 1363078 - protein, 9 aa, Homo Sapiens
PHAGPPGPQ

SEQ ID NO: 1363079 - protein, 9 aa, Homo Sapiens
ATPSNCTPG

SEQ ID NO: 1363080 - protein, 9 aa, Homo Sapiens
PVLFDVALP

SEQ ID NO: 1363081 - protein, 9 aa, Homo Sapiens
LIVSVLSPR

SEQ ID NO: 1363082 - protein, 9 aa, Homo Sapiens
VVQPDSVYC

SEQ ID NO: 1363083 - protein, 9 aa, Homo Sapiens
RNWQHSPVP

SEQ ID NO: 1363084 - protein, 9 aa, Homo Sapiens
HGYTRVSSA

SEQ ID NO: 1363085 - protein, 9 aa, Homo Sapiens
VVVGSRSFP

SEQ ID NO: 1363086 - protein, 9 aa, Homo Sapiens
GEPQPPPPP

SEQ ID NO: 1363087 - protein, 9 aa, Homo Sapiens
DVIHSGGAL

SEQ ID NO: 1363088 - protein, 9 aa, Homo Sapiens
RRVELILER

SEQ ID NO: 1363089 - protein, 9 aa, Homo Sapiens
KQPETSNMS

SEQ ID NO: 1363090 - protein, 9 aa, Homo Sapiens
VKAMVVRTG

SEQ ID NO: 1363091 - protein, 9 aa, Homo Sapiens
FDEDDNLEE

SEQ ID NO: 1363092 - protein, 9 aa, Homo Sapiens
DPNFVTAVL

SEQ ID NO: 1363093 - protein, 9 aa, Homo Sapiens
FYELQHRGR

SEQ ID NO: 1363094 - protein, 9 aa, Homo Sapiens
RLTIKKIKG

SEQ ID NO: 1363095 - protein, 9 aa, Homo Sapiens
SGPRPASSA

SEQ ID NO: 1363096 - protein, 9 aa, Homo Sapiens
PHGSTAQHV

SEQ ID NO: 1363097 - protein, 9 aa, Homo Sapiens
QEDVTLEQL

SEQ ID NO: 1363098 - protein, 9 aa, Homo Sapiens
KQLIEPVQC

SEQ ID NO: 1363099 - protein, 9 aa, Homo Sapiens
LCLDILDGV

SEQ ID NO: 1363100 - protein, 9 aa, Homo Sapiens
MESMHKEKR

SEQ ID NO: 1363101 - protein, 9 aa, Homo Sapiens
SHWHTSTGP

SEQ ID NO: 1363102 - protein, 9 aa, Homo Sapiens
LSKDTISII

SEQ ID NO: 1363103 - protein, 9 aa, Homo Sapiens
EWEKNIEIT

SEQ ID NO: 1363104 - protein, 9 aa, Homo Sapiens
ELQQVQCLV

SEQ ID NO: 1363105 - protein, 9 aa, Homo Sapiens
SHACRRFLS

SEQ ID NO: 1363106 - protein, 9 aa, Homo Sapiens
CFTASHIDI

SEQ ID NO: 1363107 - protein, 9 aa, Homo Sapiens
KPMGVTWFK

SEQ ID NO: 1363108 - protein, 9 aa, Homo Sapiens
PYCWKGMTL

SEQ ID NO: 1363109 - protein, 9 aa, Homo Sapiens
GCCHVVQPD

SEQ ID NO: 1363110 - protein, 9 aa, Homo Sapiens
LYEAYSKAC

SEQ ID NO: 1363111 - protein, 9 aa, Homo Sapiens
MSNTSVFLL

SEQ ID NO: 1363112 - protein, 9 aa, Homo Sapiens
RNARVADLA

SEQ ID NO: 1363113 - protein, 9 aa, Homo Sapiens
QLHSDSFPM

SEQ ID NO: 1363114 - protein, 9 aa, Homo Sapiens
LGRRILHEN

SEQ ID NO: 1363115 - protein, 9 aa, Homo Sapiens
TRRPPAAAA

SEQ ID NO: 1363116 - protein, 9 aa, Homo Sapiens
SKVSDPLLT

SEQ ID NO: 1363117 - protein, 9 aa, Homo Sapiens
MRLSKYAAH

SEQ ID NO: 1363118 - protein, 9 aa, Homo Sapiens
VSGYVTEDG

SEQ ID NO: 1363119 - protein, 9 aa, Homo Sapiens
GSSPKAPGL

SEQ ID NO: 1363120 - protein, 9 aa, Homo Sapiens
RRVLPVCSR

SEQ ID NO: 1363121 - protein, 9 aa, Homo Sapiens
IGVVVCNCF

SEQ ID NO: 1363122 - protein, 9 aa, Homo Sapiens
NMKTFSLSE

SEQ ID NO: 1363123 - protein, 9 aa, Homo Sapiens
NLQALRARF

SEQ ID NO: 1363124 - protein, 9 aa, Homo Sapiens
NSEVKRIRN

SEQ ID NO: 1363125 - protein, 9 aa, Homo Sapiens
NGIPNPSVT

SEQ ID NO: 1363126 - protein, 9 aa, Homo Sapiens
DGAKSLIER

SEQ ID NO: 1363127 - protein, 9 aa, Homo Sapiens
LCRQMLPTL

SEQ ID NO: 1363128 - protein, 9 aa, Homo Sapiens
RCTEPSPAL

SEQ ID NO: 1363129 - protein, 9 aa, Homo Sapiens
DYIGSRTFE

SEQ ID NO: 1363130 - protein, 9 aa, Homo Sapiens
LPPTRSSPR

SEQ ID NO: 1363131 - protein, 9 aa, Homo Sapiens
RYDSATGYY

SEQ ID NO: 1363132 - protein, 9 aa, Homo Sapiens
AVSLFAQVR

SEQ ID NO: 1363133 - protein, 9 aa, Homo Sapiens
QMHASGTSV

SEQ ID NO: 1363134 - protein, 9 aa, Homo Sapiens
VQSHRDLPS

SEQ ID NO: 1363135 - protein, 9 aa, Homo Sapiens
LRHPLGRPP

SEQ ID NO: 1363136 - protein, 9 aa, Homo Sapiens
DVVVRQGTT

SEQ ID NO: 1363137 - protein, 9 aa, Homo Sapiens
HGILTEQRM

SEQ ID NO: 1363138 - protein, 9 aa, Homo Sapiens
DESEKKSSG

SEQ ID NO: 1363139 - protein, 9 aa, Homo Sapiens
WRKSWGRWC

SEQ ID NO: 1363140 - protein, 9 aa, Homo Sapiens
GPWPPGPVA

SEQ ID NO: 1363141 - protein, 9 aa, Homo Sapiens
SPRWTLCGA

SEQ ID NO: 1363142 - protein, 9 aa, Homo Sapiens
GHQAPQVAM

SEQ ID NO: 1363143 - protein, 9 aa, Homo Sapiens
LTTRRCDFQ

SEQ ID NO: 1363144 - protein, 9 aa, Homo Sapiens
GNKTEVERA

SEQ ID NO: 1363145 - protein, 9 aa, Homo Sapiens
MLTRTMLSV

SEQ ID NO: 1363146 - protein, 9 aa, Homo Sapiens
TPRDPLLHK

SEQ ID NO: 1363147 - protein, 9 aa, Homo Sapiens
LRGQEQRSA

SEQ ID NO: 1363148 - protein, 9 aa, Homo Sapiens
LEGRDPAAA

SEQ ID NO: 1363149 - protein, 9 aa, Homo Sapiens
TAAPPGQAV

SEQ ID NO: 1363150 - protein, 9 aa, Homo Sapiens
PSCSPCSSF

SEQ ID NO: 1363151 - protein, 9 aa, Homo Sapiens
DNNYNLAMR

SEQ ID NO: 1363152 - protein, 9 aa, Homo Sapiens
ATSLFPRHI

SEQ ID NO: 1363153 - protein, 9 aa, Homo Sapiens
GDRCHRAQE

SEQ ID NO: 1363154 - protein, 9 aa, Homo Sapiens
LRHQAFMAG

SEQ ID NO: 1363155 - protein, 9 aa, Homo Sapiens
GSNLWGDTG

SEQ ID NO: 1363156 - protein, 9 aa, Homo Sapiens
CLCYFEFTT

SEQ ID NO: 1363157 - protein, 9 aa, Homo Sapiens
LNIAIPNGE

SEQ ID NO: 1363158 - protein, 9 aa, Homo Sapiens
NHCAVLEKR

SEQ ID NO: 1363159 - protein, 9 aa, Homo Sapiens
QEELLHQLR

SEQ ID NO: 1363160 - protein, 9 aa, Homo Sapiens
LEIRKPCPV

SEQ ID NO: 1363161 - protein, 9 aa, Homo Sapiens
DAPLEALTG

SEQ ID NO: 1363162 - protein, 9 aa, Homo Sapiens
VLQKAQFSL

SEQ ID NO: 1363163 - protein, 9 aa, Homo Sapiens
IYPKMHHIC

SEQ ID NO: 1363164 - protein, 9 aa, Homo Sapiens
KHFAHLQYA

SEQ ID NO: 1363165 - protein, 9 aa, Homo Sapiens
PHKDLILQC

SEQ ID NO: 1363166 - protein, 9 aa, Homo Sapiens
TGHPEPGVE

SEQ ID NO: 1363167 - protein, 9 aa, Homo Sapiens
IPQQCIILS

SEQ ID NO: 1363168 - protein, 9 aa, Homo Sapiens
VEETREEPT

SEQ ID NO: 1363169 - protein, 9 aa, Homo Sapiens
CWSLAGLVL

SEQ ID NO: 1363170 - protein, 9 aa, Homo Sapiens
FPPDEKHWN

SEQ ID NO: 1363171 - protein, 9 aa, Homo Sapiens
GLIAVDVFL

SEQ ID NO: 1363172 - protein, 9 aa, Homo Sapiens
DEANGLISM

SEQ ID NO: 1363173 - protein, 9 aa, Homo Sapiens
TILEWLKLT

SEQ ID NO: 1363174 - protein, 9 aa, Homo Sapiens
TFILCQLEV

SEQ ID NO: 1363175 - protein, 9 aa, Homo Sapiens
TLRALRPLH

SEQ ID NO: 1363176 - protein, 9 aa, Homo Sapiens
QDTVEVGEG

SEQ ID NO: 1363177 - protein, 9 aa, Homo Sapiens
YGGQLAALT

SEQ ID NO: 1363178 - protein, 9 aa, Homo Sapiens
TGHLSLPQM

SEQ ID NO: 1363179 - protein, 9 aa, Homo Sapiens
ETGSRSVTQ

SEQ ID NO: 1363180 - protein, 9 aa, Homo Sapiens
QEMVADYQQ

SEQ ID NO: 1363181 - protein, 9 aa, Homo Sapiens
VEEQPAQLR

SEQ ID NO: 1363182 - protein, 9 aa, Homo Sapiens
EGCHKKKPV

SEQ ID NO: 1363183 - protein, 9 aa, Homo Sapiens
HGSKWTLSR

SEQ ID NO: 1363184 - protein, 9 aa, Homo Sapiens
AISRTHEIK

SEQ ID NO: 1363185 - protein, 9 aa, Homo Sapiens
MNWSCRTLE

SEQ ID NO: 1363186 - protein, 9 aa, Homo Sapiens
LPFLNSVSK

SEQ ID NO: 1363187 - protein, 9 aa, Homo Sapiens
CIVAQRRGQ

SEQ ID NO: 1363188 - protein, 9 aa, Homo Sapiens
AGPVTRRSQ

SEQ ID NO: 1363189 - protein, 9 aa, Homo Sapiens
QESHMASIK

SEQ ID NO: 1363190 - protein, 9 aa, Homo Sapiens
TSETEHQVQ

SEQ ID NO: 1363191 - protein, 9 aa, Homo Sapiens
AAAAPSPEK

SEQ ID NO: 1363192 - protein, 9 aa, Homo Sapiens
ARLEEETRH

SEQ ID NO: 1363193 - protein, 9 aa, Homo Sapiens
LGNNHLSQN

SEQ ID NO: 1363194 - protein, 9 aa, Homo Sapiens
SRTSSIYQT

SEQ ID NO: 1363195 - protein, 9 aa, Homo Sapiens
RQWQEELQQ

SEQ ID NO: 1363196 - protein, 9 aa, Homo Sapiens
RQVTQKRTE

SEQ ID NO: 1363197 - protein, 9 aa, Homo Sapiens
DFTNLLPSL

SEQ ID NO: 1363198 - protein, 9 aa, Homo Sapiens
STVMKRKVV

SEQ ID NO: 1363199 - protein, 9 aa, Homo Sapiens
AAARGLLLA

SEQ ID NO: 1363200 - protein, 9 aa, Homo Sapiens
TPWGAMVPR

SEQ ID NO: 1363201 - protein, 9 aa, Homo Sapiens
VGLGRLLAP

SEQ ID NO: 1363202 - protein, 9 aa, Homo Sapiens
CSQRRLRHS

SEQ ID NO: 1363203 - protein, 9 aa, Homo Sapiens
DKRDALLLS

SEQ ID NO: 1363204 - protein, 9 aa, Homo Sapiens
SIVCMFLAD

SEQ ID NO: 1363205 - protein, 9 aa, Homo Sapiens
VSVWREVLT

SEQ ID NO: 1363206 - protein, 9 aa, Homo Sapiens
GHLDLARRT

SEQ ID NO: 1363207 - protein, 9 aa, Homo Sapiens
TARGGGNPS

SEQ ID NO: 1363208 - protein, 9 aa, Homo Sapiens
ASKVSDPLL

SEQ ID NO: 1363209 - protein, 9 aa, Homo Sapiens
SSEALVCLL

SEQ ID NO: 1363210 - protein, 9 aa, Homo Sapiens
TTGSFLSCA

SEQ ID NO: 1363211 - protein, 9 aa, Homo Sapiens
SRAAFPTGR

SEQ ID NO: 1363212 - protein, 9 aa, Homo Sapiens
GISVLRPQQ

SEQ ID NO: 1363213 - protein, 9 aa, Homo Sapiens
GQLSLQVTP

SEQ ID NO: 1363214 - protein, 9 aa, Homo Sapiens
SEAAINSQI

SEQ ID NO: 1363215 - protein, 9 aa, Homo Sapiens
TGQSLVVFP

SEQ ID NO: 1363216 - protein, 9 aa, Homo Sapiens
KFGTSILSY

SEQ ID NO: 1363217 - protein, 9 aa, Homo Sapiens
LTASRGHVH

SEQ ID NO: 1363218 - protein, 9 aa, Homo Sapiens
GKAVPVPQV

SEQ ID NO: 1363219 - protein, 9 aa, Homo Sapiens
LCNVLRPPH

SEQ ID NO: 1363220 - protein, 9 aa, Homo Sapiens
AKIKKKTGS

SEQ ID NO: 1363221 - protein, 9 aa, Homo Sapiens
EYQVQGGLF

SEQ ID NO: 1363222 - protein, 9 aa, Homo Sapiens
PHEVYLDPT

SEQ ID NO: 1363223 - protein, 9 aa, Homo Sapiens
GTSRLVASQ

SEQ ID NO: 1363224 - protein, 9 aa, Homo Sapiens
VNDQFWIYD

SEQ ID NO: 1363225 - protein, 9 aa, Homo Sapiens
TESGRLISH

SEQ ID NO: 1363226 - protein, 9 aa, Homo Sapiens
LMSSKDDMG

SEQ ID NO: 1363227 - protein, 9 aa, Homo Sapiens
EVVVEEELV

SEQ ID NO: 1363228 - protein, 9 aa, Homo Sapiens
VSRGDVHVG

SEQ ID NO: 1363229 - protein, 9 aa, Homo Sapiens
TFGPAKIEA

SEQ ID NO: 1363230 - protein, 9 aa, Homo Sapiens
SAVSCFSTT

SEQ ID NO: 1363231 - protein, 9 aa, Homo Sapiens
HALQPLDHE

SEQ ID NO: 1363232 - protein, 9 aa, Homo Sapiens
FSYPSSQFR

SEQ ID NO: 1363233 - protein, 9 aa, Homo Sapiens
QRRAPAPQG

SEQ ID NO: 1363234 - protein, 9 aa, Homo Sapiens
SSQSAGITG

SEQ ID NO: 1363235 - protein, 9 aa, Homo Sapiens
GNRQEDAHM

SEQ ID NO: 1363236 - protein, 9 aa, Homo Sapiens
SARNILVEK

SEQ ID NO: 1363237 - protein, 9 aa, Homo Sapiens
TARQPSRWP

SEQ ID NO: 1363238 - protein, 9 aa, Homo Sapiens
HSIVFLEWK

SEQ ID NO: 1363239 - protein, 9 aa, Homo Sapiens
VNKSKQNLN

SEQ ID NO: 1363240 - protein, 9 aa, Homo Sapiens
RRHCGATVD

SEQ ID NO: 1363241 - protein, 9 aa, Homo Sapiens
LKDILRPPR

SEQ ID NO: 1363242 - protein, 9 aa, Homo Sapiens
GQRVIHVTQ

SEQ ID NO: 1363243 - protein, 9 aa, Homo Sapiens
VSGGSRVSQ

SEQ ID NO: 1363244 - protein, 9 aa, Homo Sapiens
HGPLRACLP

SEQ ID NO: 1363245 - protein, 9 aa, Homo Sapiens
GTLKKAVVH

SEQ ID NO: 1363246 - protein, 9 aa, Homo Sapiens
LLKLETTAN

SEQ ID NO: 1363247 - protein, 9 aa, Homo Sapiens
PPPLPLSAV

SEQ ID NO: 1363248 - protein, 9 aa, Homo Sapiens
TEVHTNTNK

SEQ ID NO: 1363249 - protein, 9 aa, Homo Sapiens
VLLLWIRGT

SEQ ID NO: 1363250 - protein, 9 aa, Homo Sapiens
ADCMSLLNT

SEQ ID NO: 1363251 - protein, 9 aa, Homo Sapiens
AMAPAHVPA

SEQ ID NO: 1363252 - protein, 9 aa, Homo Sapiens
FYVGWAEAT

SEQ ID NO: 1363253 - protein, 9 aa, Homo Sapiens
PEPSTVRLD

SEQ ID NO: 1363254 - protein, 9 aa, Homo Sapiens
SNWSWGVCF

SEQ ID NO: 1363255 - protein, 9 aa, Homo Sapiens
VQPKLQRQA

SEQ ID NO: 1363256 - protein, 9 aa, Homo Sapiens
FHLFDENND

SEQ ID NO: 1363257 - protein, 9 aa, Homo Sapiens
KVMAPVLSD

SEQ ID NO: 1363258 - protein, 9 aa, Homo Sapiens
WQEGLGEDE

SEQ ID NO: 1363259 - protein, 9 aa, Homo Sapiens
ESVGDVYIK

SEQ ID NO: 1363260 - protein, 9 aa, Homo Sapiens
SLLSSGTAR

SEQ ID NO: 1363261 - protein, 9 aa, Homo Sapiens
NLNAKTLSI

SEQ ID NO: 1363262 - protein, 9 aa, Homo Sapiens
HLLQRGNLH

SEQ ID NO: 1363263 - protein, 9 aa, Homo Sapiens
VQPHKDLIL

SEQ ID NO: 1363264 - protein, 9 aa, Homo Sapiens
AQVDVGRDG

SEQ ID NO: 1363265 - protein, 9 aa, Homo Sapiens
SSNSSKPRP

SEQ ID NO: 1363266 - protein, 9 aa, Homo Sapiens
TRMAGRRST

SEQ ID NO: 1363267 - protein, 9 aa, Homo Sapiens
TPFPETQPG

SEQ ID NO: 1363268 - protein, 9 aa, Homo Sapiens
EEYFATNFN

SEQ ID NO: 1363269 - protein, 9 aa, Homo Sapiens
MKTFSLSEE

SEQ ID NO: 1363270 - protein, 9 aa, Homo Sapiens
ALGLGQYRA

SEQ ID NO: 1363271 - protein, 9 aa, Homo Sapiens
SPPSCSPCS

SEQ ID NO: 1363272 - protein, 9 aa, Homo Sapiens
LQPLPTRFK

SEQ ID NO: 1363273 - protein, 9 aa, Homo Sapiens
LDHRRPWEG

SEQ ID NO: 1363274 - protein, 9 aa, Homo Sapiens
GYLERVKRQ

SEQ ID NO: 1363275 - protein, 9 aa, Homo Sapiens
FRFDMNDAT

SEQ ID NO: 1363276 - protein, 9 aa, Homo Sapiens
RPASSASPA

SEQ ID NO: 1363277 - protein, 9 aa, Homo Sapiens
RLDLQCAKL

SEQ ID NO: 1363278 - protein, 9 aa, Homo Sapiens
VTLGLLLPL

SEQ ID NO: 1363279 - protein, 9 aa, Homo Sapiens
SEVKRIRNI

SEQ ID NO: 1363280 - protein, 9 aa, Homo Sapiens
MPQQPQVPL

SEQ ID NO: 1363281 - protein, 9 aa, Homo Sapiens
RSTRPAALG

SEQ ID NO: 1363282 - protein, 9 aa, Homo Sapiens
PTAWNETAD

SEQ ID NO: 1363283 - protein, 9 aa, Homo Sapiens
NIGNVCHAK

SEQ ID NO: 1363284 - protein, 9 aa, Homo Sapiens
GAGLGCVAE

SEQ ID NO: 1363285 - protein, 9 aa, Homo Sapiens
FGWAPEPST

SEQ ID NO: 1363286 - protein, 9 aa, Homo Sapiens
RRHQCEEVA

SEQ ID NO: 1363287 - protein, 9 aa, Homo Sapiens
LPKRAIQEV

SEQ ID NO: 1363288 - protein, 9 aa, Homo Sapiens
IEDCSVSQT

SEQ ID NO: 1363289 - protein, 9 aa, Homo Sapiens
NQEARSLLA

SEQ ID NO: 1363290 - protein, 9 aa, Homo Sapiens
DPLDYAGLA

SEQ ID NO: 1363291 - protein, 9 aa, Homo Sapiens
SETRAVGKS

SEQ ID NO: 1363292 - protein, 9 aa, Homo Sapiens
ASGRASRKT

SEQ ID NO: 1363293 - protein, 9 aa, Homo Sapiens
ITLLRNITW

SEQ ID NO: 1363294 - protein, 9 aa, Homo Sapiens
LFSKVPPLV

SEQ ID NO: 1363295 - protein, 9 aa, Homo Sapiens
KAFALRIFP

SEQ ID NO: 1363296 - protein, 9 aa, Homo Sapiens
VKDFVMMSR

SEQ ID NO: 1363297 - protein, 9 aa, Homo Sapiens
PASGRASRK

SEQ ID NO: 1363298 - protein, 9 aa, Homo Sapiens
QKEVLDSQC

SEQ ID NO: 1363299 - protein, 9 aa, Homo Sapiens
QSRTSSIYQ

SEQ ID NO: 1363300 - protein, 9 aa, Homo Sapiens
PRGFLREHP

SEQ ID NO: 1363301 - protein, 9 aa, Homo Sapiens
TVTQLINSI

SEQ ID NO: 1363302 - protein, 9 aa, Homo Sapiens
AATVTEEIL

SEQ ID NO: 1363303 - protein, 9 aa, Homo Sapiens
GERVEHYSR

SEQ ID NO: 1363304 - protein, 9 aa, Homo Sapiens
AGGEVKSST

SEQ ID NO: 1363305 - protein, 9 aa, Homo Sapiens
KLVDAIVSR

SEQ ID NO: 1363306 - protein, 9 aa, Homo Sapiens
DQSSLVLAE

SEQ ID NO: 1363307 - protein, 9 aa, Homo Sapiens
LDPDTANPC

SEQ ID NO: 1363308 - protein, 9 aa, Homo Sapiens
EVLKMTYTN

SEQ ID NO: 1363309 - protein, 9 aa, Homo Sapiens
ETVAMDRPL

SEQ ID NO: 1363310 - protein, 9 aa, Homo Sapiens
DFTVDLEAF

SEQ ID NO: 1363311 - protein, 9 aa, Homo Sapiens
SLIGHLHLA

SEQ ID NO: 1363312 - protein, 9 aa, Homo Sapiens
VFDLCMMVA

SEQ ID NO: 1363313 - protein, 9 aa, Homo Sapiens
LRKAQLQVG

SEQ ID NO: 1363314 - protein, 9 aa, Homo Sapiens
TPLPQSPAT

SEQ ID NO: 1363315 - protein, 9 aa, Homo Sapiens
EDTTSMILR

SEQ ID NO: 1363316 - protein, 9 aa, Homo Sapiens
ELLGKYLST

SEQ ID NO: 1363317 - protein, 9 aa, Homo Sapiens
INGSEEPSS

SEQ ID NO: 1363318 - protein, 9 aa, Homo Sapiens
KTVTQLINS

SEQ ID NO: 1363319 - protein, 9 aa, Homo Sapiens
RKAFRRFSS

SEQ ID NO: 1363320 - protein, 9 aa, Homo Sapiens
KIEVNNAAA

SEQ ID NO: 1363321 - protein, 9 aa, Homo Sapiens
PGELKPLPM

SEQ ID NO: 1363322 - protein, 9 aa, Homo Sapiens
CDVTVVVGS

SEQ ID NO: 1363323 - protein, 9 aa, Homo Sapiens
MGTDQASHC

SEQ ID NO: 1363324 - protein, 9 aa, Homo Sapiens
LATSLFPRH

SEQ ID NO: 1363325 - protein, 9 aa, Homo Sapiens
RRFSSPRIS

SEQ ID NO: 1363326 - protein, 9 aa, Homo Sapiens
EVAEAAAVV

SEQ ID NO: 1363327 - protein, 9 aa, Homo Sapiens
SCCHSSGGP

SEQ ID NO: 1363328 - protein, 9 aa, Homo Sapiens
IVGNQPKAA

SEQ ID NO: 1363329 - protein, 9 aa, Homo Sapiens
VTGLDLKGD

SEQ ID NO: 1363330 - protein, 9 aa, Homo Sapiens
QPAQLRCEM

SEQ ID NO: 1363331 - protein, 9 aa, Homo Sapiens
QVQGRLFLD

SEQ ID NO: 1363332 - protein, 9 aa, Homo Sapiens
EGGAPHEAH

SEQ ID NO: 1363333 - protein, 9 aa, Homo Sapiens
LRSTANMDN

SEQ ID NO: 1363334 - protein, 9 aa, Homo Sapiens
LKPEDLLLD

SEQ ID NO: 1363335 - protein, 9 aa, Homo Sapiens
LPTLSTLQQ

SEQ ID NO: 1363336 - protein, 9 aa, Homo Sapiens
EFSQQAISR

SEQ ID NO: 1363337 - protein, 9 aa, Homo Sapiens
RSQPERQDR

SEQ ID NO: 1363338 - protein, 9 aa, Homo Sapiens
TNTNKIEEF

SEQ ID NO: 1363339 - protein, 9 aa, Homo Sapiens
RKTWQRRLR

SEQ ID NO: 1363340 - protein, 9 aa, Homo Sapiens
HHICFFLVT

SEQ ID NO: 1363341 - protein, 9 aa, Homo Sapiens
EILGKMSFL

SEQ ID NO: 1363342 - protein, 9 aa, Homo Sapiens
KRVQELQAV

SEQ ID NO: 1363343 - protein, 9 aa, Homo Sapiens
TERKDHRPE

SEQ ID NO: 1363344 - protein, 9 aa, Homo Sapiens
VTFPELLRY

SEQ ID NO: 1363345 - protein, 9 aa, Homo Sapiens
VMLNNGAGV

SEQ ID NO: 1363346 - protein, 9 aa, Homo Sapiens
KAGTKYTSS

SEQ ID NO: 1363347 - protein, 9 aa, Homo Sapiens
SHTAVRPAA

SEQ ID NO: 1363348 - protein, 9 aa, Homo Sapiens
GHSHLVVYL

SEQ ID NO: 1363349 - protein, 9 aa, Homo Sapiens
MSTITMSSP

SEQ ID NO: 1363350 - protein, 9 aa, Homo Sapiens
AHTGQLQST

SEQ ID NO: 1363351 - protein, 9 aa, Homo Sapiens
PGRGAAVGA

SEQ ID NO: 1363352 - protein, 9 aa, Homo Sapiens
MFTLHFVRG

SEQ ID NO: 1363353 - protein, 9 aa, Homo Sapiens
QQAISRTHE

SEQ ID NO: 1363354 - protein, 9 aa, Homo Sapiens
ELCRKQGME

SEQ ID NO: 1363355 - protein, 9 aa, Homo Sapiens
SVITIDRIE

SEQ ID NO: 1363356 - protein, 9 aa, Homo Sapiens
SKDTISIIN

SEQ ID NO: 1363357 - protein, 9 aa, Homo Sapiens
KATQKREME

SEQ ID NO: 1363358 - protein, 9 aa, Homo Sapiens
FVARVHNRC

SEQ ID NO: 1363359 - protein, 9 aa, Homo Sapiens
NNPRFDEVF

SEQ ID NO: 1363360 - protein, 9 aa, Homo Sapiens
AAPAAARPF

SEQ ID NO: 1363361 - protein, 9 aa, Homo Sapiens
TTTARQPSR

SEQ ID NO: 1363362 - protein, 9 aa, Homo Sapiens
AGGVDDEDS

SEQ ID NO: 1363363 - protein, 9 aa, Homo Sapiens
AEVSTPGTR

SEQ ID NO: 1363364 - protein, 9 aa, Homo Sapiens
TLLRNITWT

SEQ ID NO: 1363365 - protein, 9 aa, Homo Sapiens
GDKTIHIWD

SEQ ID NO: 1363366 - protein, 9 aa, Homo Sapiens
IPNGEIPDC

SEQ ID NO: 1363367 - protein, 9 aa, Homo Sapiens
KAPGLMEEV

SEQ ID NO: 1363368 - protein, 9 aa, Homo Sapiens
AVSCQSRTS

SEQ ID NO: 1363369 - protein, 9 aa, Homo Sapiens
FPCALKSVF

SEQ ID NO: 1363370 - protein, 9 aa, Homo Sapiens
FTAVRLSDS

SEQ ID NO: 1363371 - protein, 9 aa, Homo Sapiens
PPLPPPGQR

SEQ ID NO: 1363372 - protein, 9 aa, Homo Sapiens
YLPRDLSTY

SEQ ID NO: 1363373 - protein, 9 aa, Homo Sapiens
ECSQRFRKS

SEQ ID NO: 1363374 - protein, 9 aa, Homo Sapiens
ASGDKTIHI

SEQ ID NO: 1363375 - protein, 9 aa, Homo Sapiens
SVWCYYCQA

SEQ ID NO: 1363376 - protein, 9 aa, Homo Sapiens
SACFLEETE

SEQ ID NO: 1363377 - protein, 9 aa, Homo Sapiens
ALERFRSFS

SEQ ID NO: 1363378 - protein, 9 aa, Homo Sapiens
EQSLTEHSD

SEQ ID NO: 1363379 - protein, 9 aa, Homo Sapiens
IFKYGHYNE

SEQ ID NO: 1363380 - protein, 9 aa, Homo Sapiens
WWLQVTPKV

SEQ ID NO: 1363381 - protein, 9 aa, Homo Sapiens
NKHKEAAHL

SEQ ID NO: 1363382 - protein, 9 aa, Homo Sapiens
VSNGDGSIS

SEQ ID NO: 1363383 - protein, 9 aa, Homo Sapiens
LRPGAENNP

SEQ ID NO: 1363384 - protein, 9 aa, Homo Sapiens
AVQAFKAAC

SEQ ID NO: 1363385 - protein, 9 aa, Homo Sapiens
NMDNDSGGS

SEQ ID NO: 1363386 - protein, 9 aa, Homo Sapiens
TISIINNVF

SEQ ID NO: 1363387 - protein, 9 aa, Homo Sapiens
LPLPRTSAS

SEQ ID NO: 1363388 - protein, 9 aa, Homo Sapiens
RRSLLDGSG

SEQ ID NO: 1363389 - protein, 9 aa, Homo Sapiens
IGQGLVGMT

SEQ ID NO: 1363390 - protein, 9 aa, Homo Sapiens
EEKREVGAM

SEQ ID NO: 1363391 - protein, 9 aa, Homo Sapiens
QVQCLVPAE

SEQ ID NO: 1363392 - protein, 9 aa, Homo Sapiens
SIPPVQARD

SEQ ID NO: 1363393 - protein, 9 aa, Homo Sapiens
EERTESELR

SEQ ID NO: 1363394 - protein, 9 aa, Homo Sapiens
LKTYSDSQE

SEQ ID NO: 1363395 - protein, 9 aa, Homo Sapiens
ARRPDRREC

SEQ ID NO: 1363396 - protein, 9 aa, Homo Sapiens
FSSTPPLIL

SEQ ID NO: 1363397 - protein, 9 aa, Homo Sapiens
CPRVGCLHS

SEQ ID NO: 1363398 - protein, 9 aa, Homo Sapiens
EARAPLESV

SEQ ID NO: 1363399 - protein, 9 aa, Homo Sapiens
EAEQHQGPV

SEQ ID NO: 1363400 - protein, 9 aa, Homo Sapiens
ITTPSKKKL

SEQ ID NO: 1363401 - protein, 9 aa, Homo Sapiens
PQIIITRVS

SEQ ID NO: 1363402 - protein, 9 aa, Homo Sapiens
QPHRHLRRR

SEQ ID NO: 1363403 - protein, 9 aa, Homo Sapiens
PTIHQTQYR

SEQ ID NO: 1363404 - protein, 9 aa, Homo Sapiens
PTMHSWYEF

SEQ ID NO: 1363405 - protein, 9 aa, Homo Sapiens
LRPAVQLID

SEQ ID NO: 1363406 - protein, 9 aa, Homo Sapiens
VATPGVKKD

SEQ ID NO: 1363407 - protein, 9 aa, Homo Sapiens
ALFKSFSST

SEQ ID NO: 1363408 - protein, 9 aa, Homo Sapiens
TLEQQAAIR

SEQ ID NO: 1363409 - protein, 9 aa, Homo Sapiens
QTIMPCPMP

SEQ ID NO: 1363410 - protein, 9 aa, Homo Sapiens
NLTLSLTTG

SEQ ID NO: 1363411 - protein, 9 aa, Homo Sapiens
KIKSYKREC

SEQ ID NO: 1363412 - protein, 9 aa, Homo Sapiens
WGAEEGAAA

SEQ ID NO: 1363413 - protein, 9 aa, Homo Sapiens
MWKLWGAEE

SEQ ID NO: 1363414 - protein, 9 aa, Homo Sapiens
HQRGQHDDD

SEQ ID NO: 1363415 - protein, 9 aa, Homo Sapiens
PSENDTHCV

SEQ ID NO: 1363416 - protein, 9 aa, Homo Sapiens
ESSKENLQP

SEQ ID NO: 1363417 - protein, 9 aa, Homo Sapiens
GPPSPGYTQ

SEQ ID NO: 1363418 - protein, 9 aa, Homo Sapiens
RCQTCPMNS

SEQ ID NO: 1363419 - protein, 9 aa, Homo Sapiens
DSEAAINSQ

SEQ ID NO: 1363420 - protein, 9 aa, Homo Sapiens
STFSFFIGH

SEQ ID NO: 1363421 - protein, 9 aa, Homo Sapiens
VRYVASSLF

SEQ ID NO: 1363422 - protein, 9 aa, Homo Sapiens
GLPFPRVDP

SEQ ID NO: 1363423 - protein, 9 aa, Homo Sapiens
SGGDWLAPV

SEQ ID NO: 1363424 - protein, 9 aa, Homo Sapiens
PKRLRGHRA

SEQ ID NO: 1363425 - protein, 9 aa, Homo Sapiens
LWIRGTEIS

SEQ ID NO: 1363426 - protein, 9 aa, Homo Sapiens
RSSPRLRFC

SEQ ID NO: 1363427 - protein, 9 aa, Homo Sapiens
SLCVVRYVA

SEQ ID NO: 1363428 - protein, 9 aa, Homo Sapiens
SSPPPPLPL

SEQ ID NO: 1363429 - protein, 9 aa, Homo Sapiens
FEVIEFDGG

SEQ ID NO: 1363430 - protein, 9 aa, Homo Sapiens
GGRILAINS

SEQ ID NO: 1363431 - protein, 9 aa, Homo Sapiens
AQKSLTVCL

SEQ ID NO: 1363432 - protein, 9 aa, Homo Sapiens
TASHIDICL

SEQ ID NO: 1363433 - protein, 9 aa, Homo Sapiens
RKRYEAQKP

SEQ ID NO: 1363434 - protein, 9 aa, Homo Sapiens
RGHRAASAL

SEQ ID NO: 1363435 - protein, 9 aa, Homo Sapiens
LSRELGGRA

SEQ ID NO: 1363436 - protein, 9 aa, Homo Sapiens
FRVGLSGPL

SEQ ID NO: 1363437 - protein, 9 aa, Homo Sapiens
CSMANCLLL

SEQ ID NO: 1363438 - protein, 9 aa, Homo Sapiens
SWMTPTLRA

SEQ ID NO: 1363439 - protein, 9 aa, Homo Sapiens
GTVECLYSQ

SEQ ID NO: 1363440 - protein, 9 aa, Homo Sapiens
SLPLPRTSA

SEQ ID NO: 1363441 - protein, 9 aa, Homo Sapiens
GFYCTKATE

SEQ ID NO: 1363442 - protein, 9 aa, Homo Sapiens
RRRVTPRDP

SEQ ID NO: 1363443 - protein, 9 aa, Homo Sapiens
YEPASPHWF

SEQ ID NO: 1363444 - protein, 9 aa, Homo Sapiens
GAFAAIGSA

SEQ ID NO: 1363445 - protein, 9 aa, Homo Sapiens
DDKPERNCY

SEQ ID NO: 1363446 - protein, 9 aa, Homo Sapiens
KTILSSLWN

SEQ ID NO: 1363447 - protein, 9 aa, Homo Sapiens
AGPSASLHP

SEQ ID NO: 1363448 - protein, 9 aa, Homo Sapiens
PSSLPASQN

SEQ ID NO: 1363449 - protein, 9 aa, Homo Sapiens
KDDAGQEAD

SEQ ID NO: 1363450 - protein, 9 aa, Homo Sapiens
DGGLCSEFL

SEQ ID NO: 1363451 - protein, 9 aa, Homo Sapiens
PFSTTPVVS

SEQ ID NO: 1363452 - protein, 9 aa, Homo Sapiens
RRLDFQEEP

SEQ ID NO: 1363453 - protein, 9 aa, Homo Sapiens
INSQINLEL

SEQ ID NO: 1363454 - protein, 9 aa, Homo Sapiens
KIRCTEPSP

SEQ ID NO: 1363455 - protein, 9 aa, Homo Sapiens
VSCQSRTSS

SEQ ID NO: 1363456 - protein, 9 aa, Homo Sapiens
YNLLRCICK

SEQ ID NO: 1363457 - protein, 9 aa, Homo Sapiens
HRLRKRETR

SEQ ID NO: 1363458 - protein, 9 aa, Homo Sapiens
CTFFFLHKE

SEQ ID NO: 1363459 - protein, 9 aa, Homo Sapiens
GASSGGARW

SEQ ID NO: 1363460 - protein, 9 aa, Homo Sapiens
LDSGSPEGV

SEQ ID NO: 1363461 - protein, 9 aa, Homo Sapiens
PPPAAPAAA

SEQ ID NO: 1363462 - protein, 9 aa, Homo Sapiens
LTALGRSQG

SEQ ID NO: 1363463 - protein, 9 aa, Homo Sapiens
IEAEPWQRR

SEQ ID NO: 1363464 - protein, 9 aa, Homo Sapiens
MHSGTFDCF

SEQ ID NO: 1363465 - protein, 9 aa, Homo Sapiens
PQATMQARS

SEQ ID NO: 1363466 - protein, 9 aa, Homo Sapiens
SVTVWCCRA

SEQ ID NO: 1363467 - protein, 9 aa, Homo Sapiens
PRTPRGTQP

SEQ ID NO: 1363468 - protein, 9 aa, Homo Sapiens
FAHLQYASF

SEQ ID NO: 1363469 - protein, 9 aa, Homo Sapiens
NTVKKIKII

SEQ ID NO: 1363470 - protein, 9 aa, Homo Sapiens
KPKRANCVI

SEQ ID NO: 1363471 - protein, 9 aa, Homo Sapiens
FKDPNNVLI

SEQ ID NO: 1363472 - protein, 9 aa, Homo Sapiens
TVECGVTSR

SEQ ID NO: 1363473 - protein, 9 aa, Homo Sapiens
LLLLKATST

SEQ ID NO: 1363474 - protein, 9 aa, Homo Sapiens
ISRLVHIQK

SEQ ID NO: 1363475 - protein, 9 aa, Homo Sapiens
CHRYINGRN

SEQ ID NO: 1363476 - protein, 9 aa, Homo Sapiens
LEITRSFNQ

SEQ ID NO: 1363477 - protein, 9 aa, Homo Sapiens
TPQRIYRQI

SEQ ID NO: 1363478 - protein, 9 aa, Homo Sapiens
FSLTCPLDS

SEQ ID NO: 1363479 - protein, 9 aa, Homo Sapiens
SQINLELYA

SEQ ID NO: 1363480 - protein, 9 aa, Homo Sapiens
RHLDLLLVI

SEQ ID NO: 1363481 - protein, 9 aa, Homo Sapiens
LSWTVPGGQ

SEQ ID NO: 1363482 - protein, 9 aa, Homo Sapiens
QIYSEHNYC

SEQ ID NO: 1363483 - protein, 9 aa, Homo Sapiens
KRREENSRN

SEQ ID NO: 1363484 - protein, 9 aa, Homo Sapiens
EYVVGGELF

SEQ ID NO: 1363485 - protein, 9 aa, Homo Sapiens
FIDLRFCHL

SEQ ID NO: 1363486 - protein, 9 aa, Homo Sapiens
KKINNQIIV

SEQ ID NO: 1363487 - protein, 9 aa, Homo Sapiens
DVYRADKCA

SEQ ID NO: 1363488 - protein, 9 aa, Homo Sapiens
NRSLCGLEV

SEQ ID NO: 1363489 - protein, 9 aa, Homo Sapiens
KPWGFLQIP

SEQ ID NO: 1363490 - protein, 9 aa, Homo Sapiens
GKDSRGLGT

SEQ ID NO: 1363491 - protein, 9 aa, Homo Sapiens
ARRHRALSQ

SEQ ID NO: 1363492 - protein, 9 aa, Homo Sapiens
DLARRTLYQ

SEQ ID NO: 1363493 - protein, 9 aa, Homo Sapiens
ENRTMQLVV

SEQ ID NO: 1363494 - protein, 9 aa, Homo Sapiens
EATVAAARG

SEQ ID NO: 1363495 - protein, 9 aa, Homo Sapiens
NLDFERSEG

SEQ ID NO: 1363496 - protein, 9 aa, Homo Sapiens
VGSSQKRYR

SEQ ID NO: 1363497 - protein, 9 aa, Homo Sapiens
IEPASVVDR

SEQ ID NO: 1363498 - protein, 9 aa, Homo Sapiens
LRSKQKVSE

SEQ ID NO: 1363499 - protein, 9 aa, Homo Sapiens
SQKALFLEP

SEQ ID NO: 1363500 - protein, 9 aa, Homo Sapiens
TLHDEEANN

SEQ ID NO: 1363501 - protein, 9 aa, Homo Sapiens
GRGSGGKWR

SEQ ID NO: 1363502 - protein, 9 aa, Homo Sapiens
VIPEAIVDL

SEQ ID NO: 1363503 - protein, 9 aa, Homo Sapiens
APKKTLLKC

SEQ ID NO: 1363504 - protein, 9 aa, Homo Sapiens
PKHLTMCFL

SEQ ID NO: 1363505 - protein, 9 aa, Homo Sapiens
DLRFCHLCP

SEQ ID NO: 1363506 - protein, 9 aa, Homo Sapiens
LKMTYTNSV

SEQ ID NO: 1363507 - protein, 9 aa, Homo Sapiens
PPGDCPRTM

SEQ ID NO: 1363508 - protein, 9 aa, Homo Sapiens
GMEFGQIHH

SEQ ID NO: 1363509 - protein, 9 aa, Homo Sapiens
VLGTKLPRL

SEQ ID NO: 1363510 - protein, 9 aa, Homo Sapiens
FEGYSLSSG

SEQ ID NO: 1363511 - protein, 9 aa, Homo Sapiens
IRAHTLAVY

SEQ ID NO: 1363512 - protein, 9 aa, Homo Sapiens
ENDLGPACT

SEQ ID NO: 1363513 - protein, 9 aa, Homo Sapiens
LQCHISKLS

SEQ ID NO: 1363514 - protein, 9 aa, Homo Sapiens
MLTVIGQGL

SEQ ID NO: 1363515 - protein, 9 aa, Homo Sapiens
RRRRAEGGA

SEQ ID NO: 1363516 - protein, 9 aa, Homo Sapiens
DHEKLGFPG

SEQ ID NO: 1363517 - protein, 9 aa, Homo Sapiens
LRVQSVLLL

SEQ ID NO: 1363518 - protein, 9 aa, Homo Sapiens
RQGAPIFQL

SEQ ID NO: 1363519 - protein, 9 aa, Homo Sapiens
NSSKPRPSA

SEQ ID NO: 1363520 - protein, 9 aa, Homo Sapiens
TPKVSSLAR

SEQ ID NO: 1363521 - protein, 9 aa, Homo Sapiens
EDMCPDTPQ

SEQ ID NO: 1363522 - protein, 9 aa, Homo Sapiens
SPGFSHWHT

SEQ ID NO: 1363523 - protein, 9 aa, Homo Sapiens
LCQIADSTM

SEQ ID NO: 1363524 - protein, 9 aa, Homo Sapiens
DLSFVDICF

SEQ ID NO: 1363525 - protein, 9 aa, Homo Sapiens
SLQQQRERK

SEQ ID NO: 1363526 - protein, 9 aa, Homo Sapiens
DADCVVGSS

SEQ ID NO: 1363527 - protein, 9 aa, Homo Sapiens
QFLSSSSRS

SEQ ID NO: 1363528 - protein, 9 aa, Homo Sapiens
RSGPWGKSF

SEQ ID NO: 1363529 - protein, 9 aa, Homo Sapiens
GKVHALQPL

SEQ ID NO: 1363530 - protein, 9 aa, Homo Sapiens
LSSGTARGG

SEQ ID NO: 1363531 - protein, 9 aa, Homo Sapiens
KSSSFSRCG

SEQ ID NO: 1363532 - protein, 9 aa, Homo Sapiens
MQYPDSPHP

SEQ ID NO: 1363533 - protein, 9 aa, Homo Sapiens
TQRRLEGIE

SEQ ID NO: 1363534 - protein, 9 aa, Homo Sapiens
GVKPYECQQ

SEQ ID NO: 1363535 - protein, 9 aa, Homo Sapiens
MAGPSASLH

SEQ ID NO: 1363536 - protein, 9 aa, Homo Sapiens
RDPERRWFG

SEQ ID NO: 1363537 - protein, 9 aa, Homo Sapiens
VIESQEELL

SEQ ID NO: 1363538 - protein, 9 aa, Homo Sapiens
AGMVIGQEV

SEQ ID NO: 1363539 - protein, 9 aa, Homo Sapiens
VGAGPIPIS

SEQ ID NO: 1363540 - protein, 9 aa, Homo Sapiens
EAIVDLQML

SEQ ID NO: 1363541 - protein, 9 aa, Homo Sapiens
GCLHSQLPH

SEQ ID NO: 1363542 - protein, 9 aa, Homo Sapiens
VALPFPHAA

SEQ ID NO: 1363543 - protein, 9 aa, Homo Sapiens
GRVMCSMAN

SEQ ID NO: 1363544 - protein, 9 aa, Homo Sapiens
PGGQFDSFI

SEQ ID NO: 1363545 - protein, 9 aa, Homo Sapiens
TEKGNIKWN

SEQ ID NO: 1363546 - protein, 9 aa, Homo Sapiens
YCCVVRNSS

SEQ ID NO: 1363547 - protein, 9 aa, Homo Sapiens
PRTSASRQT

SEQ ID NO: 1363548 - protein, 9 aa, Homo Sapiens
VKHLKAIPC

SEQ ID NO: 1363549 - protein, 9 aa, Homo Sapiens
WARKVQRRN

SEQ ID NO: 1363550 - protein, 9 aa, Homo Sapiens
EHRGGSPQT

SEQ ID NO: 1363551 - protein, 9 aa, Homo Sapiens
VDPTVGNNK

SEQ ID NO: 1363552 - protein, 9 aa, Homo Sapiens
TILWVQAAM

SEQ ID NO: 1363553 - protein, 9 aa, Homo Sapiens
GDDFGTVKL

SEQ ID NO: 1363554 - protein, 9 aa, Homo Sapiens
SPPPPLPLS

SEQ ID NO: 1363555 - protein, 9 aa, Homo Sapiens
GVPLLCKRC

SEQ ID NO: 1363556 - protein, 9 aa, Homo Sapiens
NCTILEWLK

SEQ ID NO: 1363557 - protein, 9 aa, Homo Sapiens
SLQEREATI

SEQ ID NO: 1363558 - protein, 9 aa, Homo Sapiens
TTQLPCLQS

SEQ ID NO: 1363559 - protein, 9 aa, Homo Sapiens
SLRMFLKRD

SEQ ID NO: 1363560 - protein, 9 aa, Homo Sapiens
TVSKPEQWV

SEQ ID NO: 1363561 - protein, 9 aa, Homo Sapiens
VLAQTVASF

SEQ ID NO: 1363562 - protein, 9 aa, Homo Sapiens
HSVKMGRGP

SEQ ID NO: 1363563 - protein, 9 aa, Homo Sapiens
KGCSKYGGN

SEQ ID NO: 1363564 - protein, 9 aa, Homo Sapiens
GECGKSLKK

SEQ ID NO: 1363565 - protein, 9 aa, Homo Sapiens
GRGGVAGPS

SEQ ID NO: 1363566 - protein, 9 aa, Homo Sapiens
NLRPAVQLI

SEQ ID NO: 1363567 - protein, 9 aa, Homo Sapiens
GDFGDGHHS

SEQ ID NO: 1363568 - protein, 9 aa, Homo Sapiens
SVLAACSQH

SEQ ID NO: 1363569 - protein, 9 aa, Homo Sapiens
YSFQKACMT

SEQ ID NO: 1363570 - protein, 9 aa, Homo Sapiens
MTLEQQAAI

SEQ ID NO: 1363571 - protein, 9 aa, Homo Sapiens
KDVPVERVT

SEQ ID NO: 1363572 - protein, 9 aa, Homo Sapiens
TFSRNGVSP

SEQ ID NO: 1363573 - protein, 9 aa, Homo Sapiens
PDFLKQPEM

SEQ ID NO: 1363574 - protein, 9 aa, Homo Sapiens
SHGGPPKAR

SEQ ID NO: 1363575 - protein, 9 aa, Homo Sapiens
ISLCGWRST

SEQ ID NO: 1363576 - protein, 9 aa, Homo Sapiens
PCPASFCTF

SEQ ID NO: 1363577 - protein, 9 aa, Homo Sapiens
SEEIGKARC

SEQ ID NO: 1363578 - protein, 9 aa, Homo Sapiens
LPRGPPQLP

SEQ ID NO: 1363579 - protein, 9 aa, Homo Sapiens
HRTITGAKP

SEQ ID NO: 1363580 - protein, 9 aa, Homo Sapiens
ERVSAETTE

SEQ ID NO: 1363581 - protein, 9 aa, Homo Sapiens
VGAPPQNPR

SEQ ID NO: 1363582 - protein, 9 aa, Homo Sapiens
QKDQSPICA

SEQ ID NO: 1363583 - protein, 9 aa, Homo Sapiens
GRGPGPRQP

SEQ ID NO: 1363584 - protein, 9 aa, Homo Sapiens
CCSMGQTWG

SEQ ID NO: 1363585 - protein, 9 aa, Homo Sapiens
MYVIDSKNK

SEQ ID NO: 1363586 - protein, 9 aa, Homo Sapiens
VSVSACFLE

SEQ ID NO: 1363587 - protein, 9 aa, Homo Sapiens
GHGGLRSGP

SEQ ID NO: 1363588 - protein, 9 aa, Homo Sapiens
RYFFRTEKG

SEQ ID NO: 1363589 - protein, 9 aa, Homo Sapiens
VRLEGRDPA

SEQ ID NO: 1363590 - protein, 9 aa, Homo Sapiens
LCFDVLDSV

SEQ ID NO: 1363591 - protein, 9 aa, Homo Sapiens
ALRIFPEVA

SEQ ID NO: 1363592 - protein, 9 aa, Homo Sapiens
CTFSRNGVS

SEQ ID NO: 1363593 - protein, 9 aa, Homo Sapiens
AIDATPSAP

SEQ ID NO: 1363594 - protein, 9 aa, Homo Sapiens
VPLSCETSL

SEQ ID NO: 1363595 - protein, 9 aa, Homo Sapiens
LFNSTYWVS

SEQ ID NO: 1363596 - protein, 9 aa, Homo Sapiens
VGASEARLD

SEQ ID NO: 1363597 - protein, 9 aa, Homo Sapiens
GATPLHHSP

SEQ ID NO: 1363598 - protein, 9 aa, Homo Sapiens
IMSSYGLIL

SEQ ID NO: 1363599 - protein, 9 aa, Homo Sapiens
AITFILILP

SEQ ID NO: 1363600 - protein, 9 aa, Homo Sapiens
PWGFLQIPT

SEQ ID NO: 1363601 - protein, 9 aa, Homo Sapiens
GLPGQAFEY

SEQ ID NO: 1363602 - protein, 9 aa, Homo Sapiens
FSLIMSSYG

SEQ ID NO: 1363603 - protein, 9 aa, Homo Sapiens
VFQMPQSAY

SEQ ID NO: 1363604 - protein, 9 aa, Homo Sapiens
LTESGRLIS

SEQ ID NO: 1363605 - protein, 9 aa, Homo Sapiens
VQLAGDKRD

SEQ ID NO: 1363606 - protein, 9 aa, Homo Sapiens
GLGEDEGGE

SEQ ID NO: 1363607 - protein, 9 aa, Homo Sapiens
VDGHHHGQH

SEQ ID NO: 1363608 - protein, 9 aa, Homo Sapiens
TITRSTGKD

SEQ ID NO: 1363609 - protein, 9 aa, Homo Sapiens
HLAHIGSGE

SEQ ID NO: 1363610 - protein, 9 aa, Homo Sapiens
LPVCSRCRR

SEQ ID NO: 1363611 - protein, 9 aa, Homo Sapiens
HPTSETEHQ

SEQ ID NO: 1363612 - protein, 9 aa, Homo Sapiens
VDGGLCSEF

SEQ ID NO: 1363613 - protein, 9 aa, Homo Sapiens
PIFQLLSGK

SEQ ID NO: 1363614 - protein, 9 aa, Homo Sapiens
GKIKSYKRE

SEQ ID NO: 1363615 - protein, 9 aa, Homo Sapiens
IELGYDILG

SEQ ID NO: 1363616 - protein, 9 aa, Homo Sapiens
GDSDGPLMC

SEQ ID NO: 1363617 - protein, 9 aa, Homo Sapiens
KFDPLLDLS

SEQ ID NO: 1363618 - protein, 9 aa, Homo Sapiens
CSQCQCTAQ

SEQ ID NO: 1363619 - protein, 9 aa, Homo Sapiens
QFDFLIDVV

SEQ ID NO: 1363620 - protein, 9 aa, Homo Sapiens
VEVAAGPPM

SEQ ID NO: 1363621 - protein, 9 aa, Homo Sapiens
PSSSQSAGI

SEQ ID NO: 1363622 - protein, 9 aa, Homo Sapiens
TAIAVDCYV

SEQ ID NO: 1363623 - protein, 9 aa, Homo Sapiens
DELVKVKDN

SEQ ID NO: 1363624 - protein, 9 aa, Homo Sapiens
AEYWATLQE

SEQ ID NO: 1363625 - protein, 9 aa, Homo Sapiens
RKVGRPGRR

SEQ ID NO: 1363626 - protein, 9 aa, Homo Sapiens
SNLVKCKSC

SEQ ID NO: 1363627 - protein, 9 aa, Homo Sapiens
VLAPKDKKI

SEQ ID NO: 1363628 - protein, 9 aa, Homo Sapiens
IFAGDTNLG

SEQ ID NO: 1363629 - protein, 9 aa, Homo Sapiens
VNFRRAHNA

SEQ ID NO: 1363630 - protein, 9 aa, Homo Sapiens
RMELPVGCR

SEQ ID NO: 1363631 - protein, 9 aa, Homo Sapiens
TAAVSTATK

SEQ ID NO: 1363632 - protein, 9 aa, Homo Sapiens
LRRYRDTKG

SEQ ID NO: 1363633 - protein, 9 aa, Homo Sapiens
ITEELLGKY

SEQ ID NO: 1363634 - protein, 9 aa, Homo Sapiens
YQKKKEDFA

SEQ ID NO: 1363635 - protein, 9 aa, Homo Sapiens
GHMEEVERQ

SEQ ID NO: 1363636 - protein, 9 aa, Homo Sapiens
QEREATITR

SEQ ID NO: 1363637 - protein, 9 aa, Homo Sapiens
HLLHCLLST

SEQ ID NO: 1363638 - protein, 9 aa, Homo Sapiens
GESARIQRA

SEQ ID NO: 1363639 - protein, 9 aa, Homo Sapiens
CPEVTRKQT

SEQ ID NO: 1363640 - protein, 9 aa, Homo Sapiens
WDVPAHSLG

SEQ ID NO: 1363641 - protein, 9 aa, Homo Sapiens
VVVHAEGQV

SEQ ID NO: 1363642 - protein, 9 aa, Homo Sapiens
ATITRSTGK

SEQ ID NO: 1363643 - protein, 9 aa, Homo Sapiens
EPVVAIYVN

SEQ ID NO: 1363644 - protein, 9 aa, Homo Sapiens
DGNRQEDAH

SEQ ID NO: 1363645 - protein, 9 aa, Homo Sapiens
GQACEQLAR

SEQ ID NO: 1363646 - protein, 9 aa, Homo Sapiens
LLTHQVFNS

SEQ ID NO: 1363647 - protein, 9 aa, Homo Sapiens
GSVGAGPIP

SEQ ID NO: 1363648 - protein, 9 aa, Homo Sapiens
HPQGPCPPP

SEQ ID NO: 1363649 - protein, 9 aa, Homo Sapiens
STSGKRPRE

SEQ ID NO: 1363650 - protein, 9 aa, Homo Sapiens
RRRQRRAPA

SEQ ID NO: 1363651 - protein, 9 aa, Homo Sapiens
MVLKVVGPA

SEQ ID NO: 1363652 - protein, 9 aa, Homo Sapiens
TLLDTILHQ

SEQ ID NO: 1363653 - protein, 9 aa, Homo Sapiens
TRVSNETLV

SEQ ID NO: 1363654 - protein, 9 aa, Homo Sapiens
RDGGIMYAK

SEQ ID NO: 1363655 - protein, 9 aa, Homo Sapiens
PKTLNNHED

SEQ ID NO: 1363656 - protein, 9 aa, Homo Sapiens
WNWREMMGC

SEQ ID NO: 1363657 - protein, 9 aa, Homo Sapiens
VATPGSQTI

SEQ ID NO: 1363658 - protein, 9 aa, Homo Sapiens
LAGDKRDAL

SEQ ID NO: 1363659 - protein, 9 aa, Homo Sapiens
STVACYYYL

SEQ ID NO: 1363660 - protein, 9 aa, Homo Sapiens
SAPQATMQA

SEQ ID NO: 1363661 - protein, 9 aa, Homo Sapiens
NTKTRENHL

SEQ ID NO: 1363662 - protein, 9 aa, Homo Sapiens
RSSPPRRPL

SEQ ID NO: 1363663 - protein, 9 aa, Homo Sapiens
RLEEETRHL

SEQ ID NO: 1363664 - protein, 9 aa, Homo Sapiens
DIICVTVGD

SEQ ID NO: 1363665 - protein, 9 aa, Homo Sapiens
GAPIFQLLS

SEQ ID NO: 1363666 - protein, 9 aa, Homo Sapiens
AGSVGAGPI

SEQ ID NO: 1363667 - protein, 9 aa, Homo Sapiens
PEYQNRKLN

SEQ ID NO: 1363668 - protein, 9 aa, Homo Sapiens
WPEDPVLGE

SEQ ID NO: 1363669 - protein, 9 aa, Homo Sapiens
RAQERRREG

SEQ ID NO: 1363670 - protein, 9 aa, Homo Sapiens
GAELKDVQS

SEQ ID NO: 1363671 - protein, 9 aa, Homo Sapiens
NAPLGTHPG

SEQ ID NO: 1363672 - protein, 9 aa, Homo Sapiens
SLRHPLGRP

SEQ ID NO: 1363673 - protein, 9 aa, Homo Sapiens
ANYTDSQRP

SEQ ID NO: 1363674 - protein, 9 aa, Homo Sapiens
VTRLHLESD

SEQ ID NO: 1363675 - protein, 9 aa, Homo Sapiens
TFGFRNALE

SEQ ID NO: 1363676 - protein, 9 aa, Homo Sapiens
EDEGGEPAG

SEQ ID NO: 1363677 - protein, 9 aa, Homo Sapiens
WRRQPVLQA

SEQ ID NO: 1363678 - protein, 9 aa, Homo Sapiens
GWWQGEEDR

SEQ ID NO: 1363679 - protein, 9 aa, Homo Sapiens
AALGGVALR

SEQ ID NO: 1363680 - protein, 9 aa, Homo Sapiens
TVKPKWCNV

SEQ ID NO: 1363681 - protein, 9 aa, Homo Sapiens
EDVTLEQLP

SEQ ID NO: 1363682 - protein, 9 aa, Homo Sapiens
GLLVNRNVV

SEQ ID NO: 1363683 - protein, 9 aa, Homo Sapiens
RTMQLVVLV

SEQ ID NO: 1363684 - protein, 9 aa, Homo Sapiens
TACLTEKGA

SEQ ID NO: 1363685 - protein, 9 aa, Homo Sapiens
EPASVVDRS

SEQ ID NO: 1363686 - protein, 9 aa, Homo Sapiens
AARVMTNKK

SEQ ID NO: 1363687 - protein, 9 aa, Homo Sapiens
NNGAGVDVI

SEQ ID NO: 1363688 - protein, 9 aa, Homo Sapiens
ATPLHHSPR

SEQ ID NO: 1363689 - protein, 9 aa, Homo Sapiens
PQCPAIPHG

SEQ ID NO: 1363690 - protein, 9 aa, Homo Sapiens
RGTEISLCG

SEQ ID NO: 1363691 - protein, 9 aa, Homo Sapiens
PNAHNSKED

SEQ ID NO: 1363692 - protein, 9 aa, Homo Sapiens
RRRAEGGAP

SEQ ID NO: 1363693 - protein, 9 aa, Homo Sapiens
PVAILRHNL

SEQ ID NO: 1363694 - protein, 9 aa, Homo Sapiens
IAYVECITS

SEQ ID NO: 1363695 - protein, 9 aa, Homo Sapiens
EAAINSQIN

SEQ ID NO: 1363696 - protein, 9 aa, Homo Sapiens
MLPTLSTLQ

SEQ ID NO: 1363697 - protein, 9 aa, Homo Sapiens
VSANDLEST

SEQ ID NO: 1363698 - protein, 9 aa, Homo Sapiens
GVVLPSPAK

SEQ ID NO: 1363699 - protein, 9 aa, Homo Sapiens
DSRGLGTEL

SEQ ID NO: 1363700 - protein, 9 aa, Homo Sapiens
ESKTRISQF

SEQ ID NO: 1363701 - protein, 9 aa, Homo Sapiens
TLMDGSGGD

SEQ ID NO: 1363702 - protein, 9 aa, Homo Sapiens
SLVNAQQVA

SEQ ID NO: 1363703 - protein, 9 aa, Homo Sapiens
RWLQNALDG

SEQ ID NO: 1363704 - protein, 9 aa, Homo Sapiens
HQGPVHLVQ

SEQ ID NO: 1363705 - protein, 9 aa, Homo Sapiens
VVVGVIATL

SEQ ID NO: 1363706 - protein, 9 aa, Homo Sapiens
PLGSGGPCT

SEQ ID NO: 1363707 - protein, 9 aa, Homo Sapiens
LVIHHALSR

SEQ ID NO: 1363708 - protein, 9 aa, Homo Sapiens
QRQRKRMLS

SEQ ID NO: 1363709 - protein, 9 aa, Homo Sapiens
SFSKQCEST

SEQ ID NO: 1363710 - protein, 9 aa, Homo Sapiens
DGYESDAPC

SEQ ID NO: 1363711 - protein, 9 aa, Homo Sapiens
VPVRNPTPI

SEQ ID NO: 1363712 - protein, 9 aa, Homo Sapiens
PEAPLHPPR

SEQ ID NO: 1363713 - protein, 9 aa, Homo Sapiens
VVAIYVNPF

SEQ ID NO: 1363714 - protein, 9 aa, Homo Sapiens
ICILAGDRC

SEQ ID NO: 1363715 - protein, 9 aa, Homo Sapiens
VVPIVIGLT

SEQ ID NO: 1363716 - protein, 9 aa, Homo Sapiens
YAVNRRLRT

SEQ ID NO: 1363717 - protein, 9 aa, Homo Sapiens
QSSQAGGEV

SEQ ID NO: 1363718 - protein, 9 aa, Homo Sapiens
ETRHLKDEM

SEQ ID NO: 1363719 - protein, 9 aa, Homo Sapiens
CDEDGYYQK

SEQ ID NO: 1363720 - protein, 9 aa, Homo Sapiens
HLWGRSGPW

SEQ ID NO: 1363721 - protein, 9 aa, Homo Sapiens
GGRKSGNPP

SEQ ID NO: 1363722 - protein, 9 aa, Homo Sapiens
SKENLQPEG

SEQ ID NO: 1363723 - protein, 9 aa, Homo Sapiens
TPGHTPFAS

SEQ ID NO: 1363724 - protein, 9 aa, Homo Sapiens
QPYLRVSLP

SEQ ID NO: 1363725 - protein, 9 aa, Homo Sapiens
WWGQLSLQV

SEQ ID NO: 1363726 - protein, 9 aa, Homo Sapiens
NFKDGYESD

SEQ ID NO: 1363727 - protein, 9 aa, Homo Sapiens
QTVPHQAQD

SEQ ID NO: 1363728 - protein, 9 aa, Homo Sapiens
LAGLVLLTS

SEQ ID NO: 1363729 - protein, 9 aa, Homo Sapiens
PCIRGPWPP

SEQ ID NO: 1363730 - protein, 9 aa, Homo Sapiens
ETTQQLKRS

SEQ ID NO: 1363731 - protein, 9 aa, Homo Sapiens
SGLRLQDVS

SEQ ID NO: 1363732 - protein, 9 aa, Homo Sapiens
TKTRMLYHS

SEQ ID NO: 1363733 - protein, 9 aa, Homo Sapiens
SVQFIWKKT

SEQ ID NO: 1363734 - protein, 9 aa, Homo Sapiens
PLAESPFKV

SEQ ID NO: 1363735 - protein, 9 aa, Homo Sapiens
DVPVERVTH

SEQ ID NO: 1363736 - protein, 9 aa, Homo Sapiens
RARPALGRL

SEQ ID NO: 1363737 - protein, 9 aa, Homo Sapiens
HRPASPAPA

SEQ ID NO: 1363738 - protein, 9 aa, Homo Sapiens
HCMGPAEDR

SEQ ID NO: 1363739 - protein, 9 aa, Homo Sapiens
NSFIVSGIL

SEQ ID NO: 1363740 - protein, 9 aa, Homo Sapiens
CKTWWTMST

SEQ ID NO: 1363741 - protein, 9 aa, Homo Sapiens
RHPKHEGIF

SEQ ID NO: 1363742 - protein, 9 aa, Homo Sapiens
NRGMKWKKD

SEQ ID NO: 1363743 - protein, 9 aa, Homo Sapiens
DVLKKTRNV

SEQ ID NO: 1363744 - protein, 9 aa, Homo Sapiens
TFTDSAPTV

SEQ ID NO: 1363745 - protein, 9 aa, Homo Sapiens
HNECIACCP

SEQ ID NO: 1363746 - protein, 9 aa, Homo Sapiens
EASPLRVIC

SEQ ID NO: 1363747 - protein, 9 aa, Homo Sapiens
KRWLQKSTE

SEQ ID NO: 1363748 - protein, 9 aa, Homo Sapiens
TIHIWDVRT

SEQ ID NO: 1363749 - protein, 9 aa, Homo Sapiens
VQKLVKVRT

SEQ ID NO: 1363750 - protein, 9 aa, Homo Sapiens
DHRRPWEGG

SEQ ID NO: 1363751 - protein, 9 aa, Homo Sapiens
EVTVRISHT

SEQ ID NO: 1363752 - protein, 9 aa, Homo Sapiens
KEAELIIQV

SEQ ID NO: 1363753 - protein, 9 aa, Homo Sapiens
APAHFLDYY

SEQ ID NO: 1363754 - protein, 9 aa, Homo Sapiens
VKSSTPAQL

SEQ ID NO: 1363755 - protein, 9 aa, Homo Sapiens
EEYLGAFDK

SEQ ID NO: 1363756 - protein, 9 aa, Homo Sapiens
QPHKDLILQ

SEQ ID NO: 1363757 - protein, 9 aa, Homo Sapiens
PSAVSCFST

SEQ ID NO: 1363758 - protein, 9 aa, Homo Sapiens
NQPKAASGC

SEQ ID NO: 1363759 - protein, 9 aa, Homo Sapiens
ERARLLGLH

SEQ ID NO: 1363760 - protein, 9 aa, Homo Sapiens
NTHNLLFKP

SEQ ID NO: 1363761 - protein, 9 aa, Homo Sapiens
VHLFSYPSS

SEQ ID NO: 1363762 - protein, 9 aa, Homo Sapiens
LSLPQMQYP

SEQ ID NO: 1363763 - protein, 9 aa, Homo Sapiens
MPRGAEADC

SEQ ID NO: 1363764 - protein, 9 aa, Homo Sapiens
HPLGLCSAQ

SEQ ID NO: 1363765 - protein, 9 aa, Homo Sapiens
SMLKDFDGT

SEQ ID NO: 1363766 - protein, 9 aa, Homo Sapiens
EHDVLRDGG

SEQ ID NO: 1363767 - protein, 9 aa, Homo Sapiens
AHDIIAEDI

SEQ ID NO: 1363768 - protein, 9 aa, Homo Sapiens
DASCDRKLG

SEQ ID NO: 1363769 - protein, 9 aa, Homo Sapiens
ALGTCSIWS

SEQ ID NO: 1363770 - protein, 9 aa, Homo Sapiens
RKNARAEQK

SEQ ID NO: 1363771 - protein, 9 aa, Homo Sapiens
GTLAARALR

SEQ ID NO: 1363772 - protein, 9 aa, Homo Sapiens
PFGREEEPP

SEQ ID NO: 1363773 - protein, 9 aa, Homo Sapiens
AFALRIFPE

SEQ ID NO: 1363774 - protein, 9 aa, Homo Sapiens
IFQLFSGKD

SEQ ID NO: 1363775 - protein, 9 aa, Homo Sapiens
EQPRGVVLP

SEQ ID NO: 1363776 - protein, 9 aa, Homo Sapiens
HSSSSSNSN

SEQ ID NO: 1363777 - protein, 9 aa, Homo Sapiens
SIVFLEWKR

SEQ ID NO: 1363778 - protein, 9 aa, Homo Sapiens
RRAAGGCGP

SEQ ID NO: 1363779 - protein, 9 aa, Homo Sapiens
VSSLARRLD

SEQ ID NO: 1363780 - protein, 9 aa, Homo Sapiens
RAGATAGPV

SEQ ID NO: 1363781 - protein, 9 aa, Homo Sapiens
VRGEAELTD

SEQ ID NO: 1363782 - protein, 9 aa, Homo Sapiens
NSTSFFWTY

SEQ ID NO: 1363783 - protein, 9 aa, Homo Sapiens
GMLTVIGQG

SEQ ID NO: 1363784 - protein, 9 aa, Homo Sapiens
CIGSFFASC

SEQ ID NO: 1363785 - protein, 9 aa, Homo Sapiens
RSLCGLEVA

SEQ ID NO: 1363786 - protein, 9 aa, Homo Sapiens
QMQYPDSPH

SEQ ID NO: 1363787 - protein, 9 aa, Homo Sapiens
HSHTAVQDY

SEQ ID NO: 1363788 - protein, 9 aa, Homo Sapiens
RWCWWGRGC

SEQ ID NO: 1363789 - protein, 9 aa, Homo Sapiens
KVQRRNLGV

SEQ ID NO: 1363790 - protein, 9 aa, Homo Sapiens
THPQQPSPR

SEQ ID NO: 1363791 - protein, 9 aa, Homo Sapiens
HKGGHFQDT

SEQ ID NO: 1363792 - protein, 9 aa, Homo Sapiens
TEAAAHSLP

SEQ ID NO: 1363793 - protein, 9 aa, Homo Sapiens
RHIVDEANG

SEQ ID NO: 1363794 - protein, 9 aa, Homo Sapiens
LSWAPLVSG

SEQ ID NO: 1363795 - protein, 9 aa, Homo Sapiens
KARCPRVGC

SEQ ID NO: 1363796 - protein, 9 aa, Homo Sapiens
IQERRSLLD

SEQ ID NO: 1363797 - protein, 9 aa, Homo Sapiens
FRDTLNLML

SEQ ID NO: 1363798 - protein, 9 aa, Homo Sapiens
ATMLCAANG

SEQ ID NO: 1363799 - protein, 9 aa, Homo Sapiens
RSKQKVSEE

SEQ ID NO: 1363800 - protein, 9 aa, Homo Sapiens
VMLTLSNIH

SEQ ID NO: 1363801 - protein, 9 aa, Homo Sapiens
HIQLADGLS

SEQ ID NO: 1363802 - protein, 9 aa, Homo Sapiens
RDGFEVMER

SEQ ID NO: 1363803 - protein, 9 aa, Homo Sapiens
MSATTTARQ

SEQ ID NO: 1363804 - protein, 9 aa, Homo Sapiens
GGVALRCDT

SEQ ID NO: 1363805 - protein, 9 aa, Homo Sapiens
AGTVECLYS

SEQ ID NO: 1363806 - protein, 9 aa, Homo Sapiens
FRRAHNAKH

SEQ ID NO: 1363807 - protein, 9 aa, Homo Sapiens
IMPCPMPTT

SEQ ID NO: 1363808 - protein, 9 aa, Homo Sapiens
PEQFTAVRL

SEQ ID NO: 1363809 - protein, 9 aa, Homo Sapiens
PRVKALKRQ

SEQ ID NO: 1363810 - protein, 9 aa, Homo Sapiens
PGPRVDAED

SEQ ID NO: 1363811 - protein, 9 aa, Homo Sapiens
VRTDSDRWS

SEQ ID NO: 1363812 - protein, 9 aa, Homo Sapiens
FPPPGTKQG

SEQ ID NO: 1363813 - protein, 9 aa, Homo Sapiens
SDNLQVWGS

SEQ ID NO: 1363814 - protein, 9 aa, Homo Sapiens
GFRSQFVLK

SEQ ID NO: 1363815 - protein, 9 aa, Homo Sapiens
KLETTANYT

SEQ ID NO: 1363816 - protein, 9 aa, Homo Sapiens
GPAKIEAEP

SEQ ID NO: 1363817 - protein, 9 aa, Homo Sapiens
TTPVQAWLE

SEQ ID NO: 1363818 - protein, 9 aa, Homo Sapiens
RPWEGGNRE

SEQ ID NO: 1363819 - protein, 9 aa, Homo Sapiens
VDCHQLAAS

SEQ ID NO: 1363820 - protein, 9 aa, Homo Sapiens
LAEFAKQQS

SEQ ID NO: 1363821 - protein, 9 aa, Homo Sapiens
RVPSSDEEA

SEQ ID NO: 1363822 - protein, 9 aa, Homo Sapiens
TQHPATTED

SEQ ID NO: 1363823 - protein, 9 aa, Homo Sapiens
GRPGRRRKH

SEQ ID NO: 1363824 - protein, 9 aa, Homo Sapiens
PSKDQPLLV

SEQ ID NO: 1363825 - protein, 9 aa, Homo Sapiens
KANKAITDA

SEQ ID NO: 1363826 - protein, 9 aa, Homo Sapiens
YIDFDEDDN

SEQ ID NO: 1363827 - protein, 9 aa, Homo Sapiens
LWNEGCIMG

SEQ ID NO: 1363828 - protein, 9 aa, Homo Sapiens
FENGQRIAE

SEQ ID NO: 1363829 - protein, 9 aa, Homo Sapiens
PTNRVKVSS

SEQ ID NO: 1363830 - protein, 9 aa, Homo Sapiens
YERFMPKSD

SEQ ID NO: 1363831 - protein, 9 aa, Homo Sapiens
EREKVLKNI

SEQ ID NO: 1363832 - protein, 9 aa, Homo Sapiens
TSGIYLAFI

SEQ ID NO: 1363833 - protein, 9 aa, Homo Sapiens
ARALRARGP

SEQ ID NO: 1363834 - protein, 9 aa, Homo Sapiens
VPCVNAVDS

SEQ ID NO: 1363835 - protein, 9 aa, Homo Sapiens
PQRIDRLSS

SEQ ID NO: 1363836 - protein, 9 aa, Homo Sapiens
NGPSSGRGS

SEQ ID NO: 1363837 - protein, 9 aa, Homo Sapiens
CCIPDPMGL

SEQ ID NO: 1363838 - protein, 9 aa, Homo Sapiens
CGYCSAVFD

SEQ ID NO: 1363839 - protein, 9 aa, Homo Sapiens
EEPPLEKLQ

SEQ ID NO: 1363840 - protein, 9 aa, Homo Sapiens
SQAVANGPS

SEQ ID NO: 1363841 - protein, 9 aa, Homo Sapiens
FKADQLMFT

SEQ ID NO: 1363842 - protein, 9 aa, Homo Sapiens
SKQQFLSSS

SEQ ID NO: 1363843 - protein, 9 aa, Homo Sapiens
FLKQPEMSI

SEQ ID NO: 1363844 - protein, 9 aa, Homo Sapiens
RKFDPLLDL

SEQ ID NO: 1363845 - protein, 9 aa, Homo Sapiens
QRGRGGVAG

SEQ ID NO: 1363846 - protein, 9 aa, Homo Sapiens
LLEKQGIGM

SEQ ID NO: 1363847 - protein, 9 aa, Homo Sapiens
TSSLSSCKT

SEQ ID NO: 1363848 - protein, 9 aa, Homo Sapiens
GRHCGNSFP

SEQ ID NO: 1363849 - protein, 9 aa, Homo Sapiens
LESVRQIYS

SEQ ID NO: 1363850 - protein, 9 aa, Homo Sapiens
SRGRVSRPP

SEQ ID NO: 1363851 - protein, 9 aa, Homo Sapiens
IKLETGIRE

SEQ ID NO: 1363852 - protein, 9 aa, Homo Sapiens
RKFCLTPRL

SEQ ID NO: 1363853 - protein, 9 aa, Homo Sapiens
GLRFVGRSG

SEQ ID NO: 1363854 - protein, 9 aa, Homo Sapiens
FCQEDFLYS

SEQ ID NO: 1363855 - protein, 9 aa, Homo Sapiens
IVSMGTDQA

SEQ ID NO: 1363856 - protein, 9 aa, Homo Sapiens
VGKTFDSVV

SEQ ID NO: 1363857 - protein, 9 aa, Homo Sapiens
ALPMENGSG

SEQ ID NO: 1363858 - protein, 9 aa, Homo Sapiens
GLFWMLTRT

SEQ ID NO: 1363859 - protein, 9 aa, Homo Sapiens
LRNEPCAVV

SEQ ID NO: 1363860 - protein, 9 aa, Homo Sapiens
RMIFIPSSI

SEQ ID NO: 1363861 - protein, 9 aa, Homo Sapiens
DDDDAHFFS

SEQ ID NO: 1363862 - protein, 9 aa, Homo Sapiens
DEEGQTVPH

SEQ ID NO: 1363863 - protein, 9 aa, Homo Sapiens
TVVGTSRLH

SEQ ID NO: 1363864 - protein, 9 aa, Homo Sapiens
SVHNPDLCG

SEQ ID NO: 1363865 - protein, 9 aa, Homo Sapiens
RRLEGIEHM

SEQ ID NO: 1363866 - protein, 9 aa, Homo Sapiens
DSHRSQPER

SEQ ID NO: 1363867 - protein, 9 aa, Homo Sapiens
MGRGPLSDD

SEQ ID NO: 1363868 - protein, 9 aa, Homo Sapiens
SPATPVSGP

SEQ ID NO: 1363869 - protein, 9 aa, Homo Sapiens
FFLMCCLFV

SEQ ID NO: 1363870 - protein, 9 aa, Homo Sapiens
VVGTSRLHD

SEQ ID NO: 1363871 - protein, 9 aa, Homo Sapiens
ILEVSFNPD

SEQ ID NO: 1363872 - protein, 9 aa, Homo Sapiens
EEETRHLKD

SEQ ID NO: 1363873 - protein, 9 aa, Homo Sapiens
MMSAVAIAN

SEQ ID NO: 1363874 - protein, 9 aa, Homo Sapiens
LLLWIRGTE

SEQ ID NO: 1363875 - protein, 9 aa, Homo Sapiens
WMAPEVTEQ

SEQ ID NO: 1363876 - protein, 9 aa, Homo Sapiens
SCSAHPCDS

SEQ ID NO: 1363877 - protein, 9 aa, Homo Sapiens
QPPRVCRRR

SEQ ID NO: 1363878 - protein, 9 aa, Homo Sapiens
PFRKVGSFD

SEQ ID NO: 1363879 - protein, 9 aa, Homo Sapiens
PPQPRPRRS

SEQ ID NO: 1363880 - protein, 9 aa, Homo Sapiens
GLTSQGLHE

SEQ ID NO: 1363881 - protein, 9 aa, Homo Sapiens
LICGGVCSS

SEQ ID NO: 1363882 - protein, 9 aa, Homo Sapiens
LVKCKSCPV

SEQ ID NO: 1363883 - protein, 9 aa, Homo Sapiens
TLEPNPVTG

SEQ ID NO: 1363884 - protein, 9 aa, Homo Sapiens
EYHIEDTPI

SEQ ID NO: 1363885 - protein, 9 aa, Homo Sapiens
FLCALAISE

SEQ ID NO: 1363886 - protein, 9 aa, Homo Sapiens
KWEIVSMGT

SEQ ID NO: 1363887 - protein, 9 aa, Homo Sapiens
RFCHLCPFL

SEQ ID NO: 1363888 - protein, 9 aa, Homo Sapiens
LSAMHFLTA

SEQ ID NO: 1363889 - protein, 9 aa, Homo Sapiens
VVEGGTLIW

SEQ ID NO: 1363890 - protein, 9 aa, Homo Sapiens
LDPTDAADP

SEQ ID NO: 1363891 - protein, 9 aa, Homo Sapiens
LYMPRGAEA

SEQ ID NO: 1363892 - protein, 9 aa, Homo Sapiens
SDLNTHNLL

SEQ ID NO: 1363893 - protein, 9 aa, Homo Sapiens
QAAGTAQKS

SEQ ID NO: 1363894 - protein, 9 aa, Homo Sapiens
TPIKRRHVS

SEQ ID NO: 1363895 - protein, 9 aa, Homo Sapiens
VRNTVKKIK

SEQ ID NO: 1363896 - protein, 9 aa, Homo Sapiens
GRAVGGQHE

SEQ ID NO: 1363897 - protein, 9 aa, Homo Sapiens
SLCYPSKLA

SEQ ID NO: 1363898 - protein, 9 aa, Homo Sapiens
SHCRCATTL

SEQ ID NO: 1363899 - protein, 9 aa, Homo Sapiens
QNRRAKFRT

SEQ ID NO: 1363900 - protein, 9 aa, Homo Sapiens
FSHWHTSTG

SEQ ID NO: 1363901 - protein, 9 aa, Homo Sapiens
CKNNPNMSD

SEQ ID NO: 1363902 - protein, 9 aa, Homo Sapiens
MRGTAATGR

SEQ ID NO: 1363903 - protein, 9 aa, Homo Sapiens
RCSQNFCPE

SEQ ID NO: 1363904 - protein, 9 aa, Homo Sapiens
VDSMCLESV

SEQ ID NO: 1363905 - protein, 9 aa, Homo Sapiens
LDDTHNVSV

SEQ ID NO: 1363906 - protein, 9 aa, Homo Sapiens
PSNLVKCKS

SEQ ID NO: 1363907 - protein, 9 aa, Homo Sapiens
RMTFPCEMT

SEQ ID NO: 1363908 - protein, 9 aa, Homo Sapiens
QTPVDQLQQ

SEQ ID NO: 1363909 - protein, 9 aa, Homo Sapiens
SQGLWNRSP

SEQ ID NO: 1363910 - protein, 9 aa, Homo Sapiens
RHNSSCAPV

SEQ ID NO: 1363911 - protein, 9 aa, Homo Sapiens
FKRFLRKKI

SEQ ID NO: 1363912 - protein, 9 aa, Homo Sapiens
NERDSLEFE

SEQ ID NO: 1363913 - protein, 9 aa, Homo Sapiens
QVGSVGGLQ

SEQ ID NO: 1363914 - protein, 9 aa, Homo Sapiens
GSLDRNLGS

SEQ ID NO: 1363915 - protein, 9 aa, Homo Sapiens
LFVDVGVYT

SEQ ID NO: 1363916 - protein, 9 aa, Homo Sapiens
LSVRPCSVT

SEQ ID NO: 1363917 - protein, 9 aa, Homo Sapiens
GHRGEMGPL

SEQ ID NO: 1363918 - protein, 9 aa, Homo Sapiens
LGPAGRPGL

SEQ ID NO: 1363919 - protein, 9 aa, Homo Sapiens
GLRLQDVSH

SEQ ID NO: 1363920 - protein, 9 aa, Homo Sapiens
EEEVVVEEE

SEQ ID NO: 1363921 - protein, 9 aa, Homo Sapiens
PVYCMPVCC

SEQ ID NO: 1363922 - protein, 9 aa, Homo Sapiens
GCMAEGHGG

SEQ ID NO: 1363923 - protein, 9 aa, Homo Sapiens
PMLCPLSTW

SEQ ID NO: 1363924 - protein, 9 aa, Homo Sapiens
HTHGPLRAC

SEQ ID NO: 1363925 - protein, 9 aa, Homo Sapiens
SISESFSKQ

SEQ ID NO: 1363926 - protein, 9 aa, Homo Sapiens
QTVLSPLVQ

SEQ ID NO: 1363927 - protein, 9 aa, Homo Sapiens
KKKISQKKP

SEQ ID NO: 1363928 - protein, 9 aa, Homo Sapiens
EELETSMDR

SEQ ID NO: 1363929 - protein, 9 aa, Homo Sapiens
SSQRLLRER

SEQ ID NO: 1363930 - protein, 9 aa, Homo Sapiens
HSPRQWLRP

SEQ ID NO: 1363931 - protein, 9 aa, Homo Sapiens
SVVISTKDT

SEQ ID NO: 1363932 - protein, 9 aa, Homo Sapiens
GACGPVKEP

SEQ ID NO: 1363933 - protein, 9 aa, Homo Sapiens
GNWWRKSWG

SEQ ID NO: 1363934 - protein, 9 aa, Homo Sapiens
DVGVYTRNR

SEQ ID NO: 1363935 - protein, 9 aa, Homo Sapiens
DKVHFSHIT

SEQ ID NO: 1363936 - protein, 9 aa, Homo Sapiens
VCHAKGKQL

SEQ ID NO: 1363937 - protein, 9 aa, Homo Sapiens
LFQSERWPS

SEQ ID NO: 1363938 - protein, 9 aa, Homo Sapiens
LAICCCHCL

SEQ ID NO: 1363939 - protein, 9 aa, Homo Sapiens
LGTHPGGSL

SEQ ID NO: 1363940 - protein, 9 aa, Homo Sapiens
TGQTDNIIY

SEQ ID NO: 1363941 - protein, 9 aa, Homo Sapiens
PGLHPLPGE

SEQ ID NO: 1363942 - protein, 9 aa, Homo Sapiens
PQVVKECRA

SEQ ID NO: 1363943 - protein, 9 aa, Homo Sapiens
PLASMPFST

SEQ ID NO: 1363944 - protein, 9 aa, Homo Sapiens
CAPVFLQFC

SEQ ID NO: 1363945 - protein, 9 aa, Homo Sapiens
YQNQNQLSV

SEQ ID NO: 1363946 - protein, 9 aa, Homo Sapiens
QSVASVLLC

SEQ ID NO: 1363947 - protein, 9 aa, Homo Sapiens
SITNTKTRE

SEQ ID NO: 1363948 - protein, 9 aa, Homo Sapiens
IDRQTVELR

SEQ ID NO: 1363949 - protein, 9 aa, Homo Sapiens
IIDSTVTMK

SEQ ID NO: 1363950 - protein, 9 aa, Homo Sapiens
QAFAEQPRG

SEQ ID NO: 1363951 - protein, 9 aa, Homo Sapiens
PVERVTHAD

SEQ ID NO: 1363952 - protein, 9 aa, Homo Sapiens
HYRQNRSSL

SEQ ID NO: 1363953 - protein, 9 aa, Homo Sapiens
TCSIWSTCC

SEQ ID NO: 1363954 - protein, 9 aa, Homo Sapiens
TETTQQLKR

SEQ ID NO: 1363955 - protein, 9 aa, Homo Sapiens
DFAMQISFL

SEQ ID NO: 1363956 - protein, 9 aa, Homo Sapiens
NTKLKEWLP

SEQ ID NO: 1363957 - protein, 9 aa, Homo Sapiens
TRLLAELPA

SEQ ID NO: 1363958 - protein, 9 aa, Homo Sapiens
LGSKGKIAQ

SEQ ID NO: 1363959 - protein, 9 aa, Homo Sapiens
DCVVGSSQK

SEQ ID NO: 1363960 - protein, 9 aa, Homo Sapiens
CTPGHTPFA

SEQ ID NO: 1363961 - protein, 9 aa, Homo Sapiens
EVHTNTNKI

SEQ ID NO: 1363962 - protein, 9 aa, Homo Sapiens
AQERRREGR

SEQ ID NO: 1363963 - protein, 9 aa, Homo Sapiens
NQLSVMYRS

SEQ ID NO: 1363964 - protein, 9 aa, Homo Sapiens
QWVITLALA

SEQ ID NO: 1363965 - protein, 9 aa, Homo Sapiens
REKVLKNIF

SEQ ID NO: 1363966 - protein, 9 aa, Homo Sapiens
DEYHIEDTP

SEQ ID NO: 1363967 - protein, 9 aa, Homo Sapiens
EALVCLLVL

SEQ ID NO: 1363968 - protein, 9 aa, Homo Sapiens
GEKLFMEMA

SEQ ID NO: 1363969 - protein, 9 aa, Homo Sapiens
STQRSVWHR

SEQ ID NO: 1363970 - protein, 9 aa, Homo Sapiens
SLSKDTISI

SEQ ID NO: 1363971 - protein, 9 aa, Homo Sapiens
RELRELQRK

SEQ ID NO: 1363972 - protein, 9 aa, Homo Sapiens
NRRAKFRTQ

SEQ ID NO: 1363973 - protein, 9 aa, Homo Sapiens
TAVQDYSYF

SEQ ID NO: 1363974 - protein, 9 aa, Homo Sapiens
GLPHGYPEP

SEQ ID NO: 1363975 - protein, 9 aa, Homo Sapiens
VTEQVRGYD

SEQ ID NO: 1363976 - protein, 9 aa, Homo Sapiens
SWNLCLPAP

SEQ ID NO: 1363977 - protein, 9 aa, Homo Sapiens
QMKCLTAVD

SEQ ID NO: 1363978 - protein, 9 aa, Homo Sapiens
LEGASKDLQ

SEQ ID NO: 1363979 - protein, 9 aa, Homo Sapiens
PPPPPWGLQ

SEQ ID NO: 1363980 - protein, 9 aa, Homo Sapiens
ENQTHTLEK

SEQ ID NO: 1363981 - protein, 9 aa, Homo Sapiens
STVEILLKM

SEQ ID NO: 1363982 - protein, 9 aa, Homo Sapiens
TREEPTEIK

SEQ ID NO: 1363983 - protein, 9 aa, Homo Sapiens
SRLRNEMKF

SEQ ID NO: 1363984 - protein, 9 aa, Homo Sapiens
TGRAAPAMA

SEQ ID NO: 1363985 - protein, 9 aa, Homo Sapiens
FSLEEKYTT

SEQ ID NO: 1363986 - protein, 9 aa, Homo Sapiens
KRREMEKER

SEQ ID NO: 1363987 - protein, 9 aa, Homo Sapiens
VPAFSHYMG

SEQ ID NO: 1363988 - protein, 9 aa, Homo Sapiens
AEGYPTYTN

SEQ ID NO: 1363989 - protein, 9 aa, Homo Sapiens
RLRACQEQI

SEQ ID NO: 1363990 - protein, 9 aa, Homo Sapiens
GTKQGANAQ

SEQ ID NO: 1363991 - protein, 9 aa, Homo Sapiens
EYLGAFDKK

SEQ ID NO: 1363992 - protein, 9 aa, Homo Sapiens
HLHLAKQEW

SEQ ID NO: 1363993 - protein, 9 aa, Homo Sapiens
CAKSFNSDD

SEQ ID NO: 1363994 - protein, 9 aa, Homo Sapiens
FDYAFTAIS

SEQ ID NO: 1363995 - protein, 9 aa, Homo Sapiens
QANVVPTMH

SEQ ID NO: 1363996 - protein, 9 aa, Homo Sapiens
RKTEYDSRL

SEQ ID NO: 1363997 - protein, 9 aa, Homo Sapiens
PASFCTFSR

SEQ ID NO: 1363998 - protein, 9 aa, Homo Sapiens
LCGWRSTGP

SEQ ID NO: 1363999 - protein, 9 aa, Homo Sapiens
YDDCRDYDS

SEQ ID NO: 1364000 - protein, 9 aa, Homo Sapiens
ARASPAWRT

SEQ ID NO: 1364001 - protein, 9 aa, Homo Sapiens
DSKNKPQSD

SEQ ID NO: 1364002 - protein, 9 aa, Homo Sapiens
AHLQYASFK

SEQ ID NO: 1364003 - protein, 9 aa, Homo Sapiens
SVRHRSLHR

SEQ ID NO: 1364004 - protein, 9 aa, Homo Sapiens
KRAGGPPGN

SEQ ID NO: 1364005 - protein, 9 aa, Homo Sapiens
TKSLALSPR

SEQ ID NO: 1364006 - protein, 9 aa, Homo Sapiens
KQGIGMKQE

SEQ ID NO: 1364007 - protein, 9 aa, Homo Sapiens
LPSLAYEKA

SEQ ID NO: 1364008 - protein, 9 aa, Homo Sapiens
GAEADCMSL

SEQ ID NO: 1364009 - protein, 9 aa, Homo Sapiens
APRDQVALD

SEQ ID NO: 1364010 - protein, 9 aa, Homo Sapiens
FAADESGLW

SEQ ID NO: 1364011 - protein, 9 aa, Homo Sapiens
YNASTQRSV

SEQ ID NO: 1364012 - protein, 9 aa, Homo Sapiens
PTLDPIIAV

SEQ ID NO: 1364013 - protein, 9 aa, Homo Sapiens
LQCAKLLNS

SEQ ID NO: 1364014 - protein, 9 aa, Homo Sapiens
QPPKSFQLH

SEQ ID NO: 1364015 - protein, 9 aa, Homo Sapiens
QIRNWQHSP

SEQ ID NO: 1364016 - protein, 9 aa, Homo Sapiens
KHINNSARN

SEQ ID NO: 1364017 - protein, 9 aa, Homo Sapiens
PSTSAAAWC

SEQ ID NO: 1364018 - protein, 9 aa, Homo Sapiens
ISLDGGAIY

SEQ ID NO: 1364019 - protein, 9 aa, Homo Sapiens
EANGLISMY

SEQ ID NO: 1364020 - protein, 9 aa, Homo Sapiens
VGWAEATVA

SEQ ID NO: 1364021 - protein, 9 aa, Homo Sapiens
LCTGHPEPG

SEQ ID NO: 1364022 - protein, 9 aa, Homo Sapiens
KVIRGRCLV

SEQ ID NO: 1364023 - protein, 9 aa, Homo Sapiens
FPRPNYRLQ

SEQ ID NO: 1364024 - protein, 9 aa, Homo Sapiens
SVFQMPQSA

SEQ ID NO: 1364025 - protein, 9 aa, Homo Sapiens
DLHPTSKTE

SEQ ID NO: 1364026 - protein, 9 aa, Homo Sapiens
LERLQAQQS

SEQ ID NO: 1364027 - protein, 9 aa, Homo Sapiens
GQRALRGYV

SEQ ID NO: 1364028 - protein, 9 aa, Homo Sapiens
TIWKSTVMK

SEQ ID NO: 1364029 - protein, 9 aa, Homo Sapiens
LPITLLRNI

SEQ ID NO: 1364030 - protein, 9 aa, Homo Sapiens
PLGNSSGSD

SEQ ID NO: 1364031 - protein, 9 aa, Homo Sapiens
CLPLGLHLF

SEQ ID NO: 1364032 - protein, 9 aa, Homo Sapiens
RPPEAPLHP

SEQ ID NO: 1364033 - protein, 9 aa, Homo Sapiens
ATPVSGPVR

SEQ ID NO: 1364034 - protein, 9 aa, Homo Sapiens
GSGRWNDAS

SEQ ID NO: 1364035 - protein, 9 aa, Homo Sapiens
IAVFCIMDY

SEQ ID NO: 1364036 - protein, 9 aa, Homo Sapiens
KLAPLQVTT

SEQ ID NO: 1364037 - protein, 9 aa, Homo Sapiens
VGFWPEVLK

SEQ ID NO: 1364038 - protein, 9 aa, Homo Sapiens
KQTVKQCGY

SEQ ID NO: 1364039 - protein, 9 aa, Homo Sapiens
KALEAAKIE

SEQ ID NO: 1364040 - protein, 9 aa, Homo Sapiens
RRDAFLVLD

SEQ ID NO: 1364041 - protein, 9 aa, Homo Sapiens
VLLTSGHLP

SEQ ID NO: 1364042 - protein, 9 aa, Homo Sapiens
SFFFFFFFF

SEQ ID NO: 1364043 - protein, 9 aa, Homo Sapiens
PYMTGRIAC

SEQ ID NO: 1364044 - protein, 9 aa, Homo Sapiens
SDDDDAHFF

SEQ ID NO: 1364045 - protein, 9 aa, Homo Sapiens
LRGRRADHP

SEQ ID NO: 1364046 - protein, 9 aa, Homo Sapiens
SGRFLGCAG

SEQ ID NO: 1364047 - protein, 9 aa, Homo Sapiens
FGMYVIDSK

SEQ ID NO: 1364048 - protein, 9 aa, Homo Sapiens
LLALSFASL

SEQ ID NO: 1364049 - protein, 9 aa, Homo Sapiens
GDWIDSVLA

SEQ ID NO: 1364050 - protein, 9 aa, Homo Sapiens
ISPTLPITL

SEQ ID NO: 1364051 - protein, 9 aa, Homo Sapiens
EALNTKEVV

SEQ ID NO: 1364052 - protein, 9 aa, Homo Sapiens
GCPLQVEKN

SEQ ID NO: 1364053 - protein, 9 aa, Homo Sapiens
SRKCPPHLV

SEQ ID NO: 1364054 - protein, 9 aa, Homo Sapiens
DPVGTELIY

SEQ ID NO: 1364055 - protein, 9 aa, Homo Sapiens
PLLNHIAAG

SEQ ID NO: 1364056 - protein, 9 aa, Homo Sapiens
YDECLCKYG

SEQ ID NO: 1364057 - protein, 9 aa, Homo Sapiens
GGLTASRGH

SEQ ID NO: 1364058 - protein, 9 aa, Homo Sapiens
KAGQNTRPG

SEQ ID NO: 1364059 - protein, 9 aa, Homo Sapiens
FFRYMKLAY

SEQ ID NO: 1364060 - protein, 9 aa, Homo Sapiens
KDQIVDPTV

SEQ ID NO: 1364061 - protein, 9 aa, Homo Sapiens
SHPPPPPPP

SEQ ID NO: 1364062 - protein, 9 aa, Homo Sapiens
PPDIDRQTV

SEQ ID NO: 1364063 - protein, 9 aa, Homo Sapiens
EARLDTLTI

SEQ ID NO: 1364064 - protein, 9 aa, Homo Sapiens
MGPEPAAPQ

SEQ ID NO: 1364065 - protein, 9 aa, Homo Sapiens
GAIRPAVPT

SEQ ID NO: 1364066 - protein, 9 aa, Homo Sapiens
LSTEMTPYY

SEQ ID NO: 1364067 - protein, 9 aa, Homo Sapiens
PQTPPQPQS

SEQ ID NO: 1364068 - protein, 9 aa, Homo Sapiens
GMKQEMEKR

SEQ ID NO: 1364069 - protein, 9 aa, Homo Sapiens
LPLWNEGCI

SEQ ID NO: 1364070 - protein, 9 aa, Homo Sapiens
GQPDQPRSV

SEQ ID NO: 1364071 - protein, 9 aa, Homo Sapiens
PLLVRRNAF

SEQ ID NO: 1364072 - protein, 9 aa, Homo Sapiens
PSLHETSSV

SEQ ID NO: 1364073 - protein, 9 aa, Homo Sapiens
WQEELQQVQ

SEQ ID NO: 1364074 - protein, 9 aa, Homo Sapiens
VVTSLCKPS

SEQ ID NO: 1364075 - protein, 9 aa, Homo Sapiens
LAVYVYRSG

SEQ ID NO: 1364076 - protein, 9 aa, Homo Sapiens
EHQVQGRLF

SEQ ID NO: 1364077 - protein, 9 aa, Homo Sapiens
KSDSALQAY

SEQ ID NO: 1364078 - protein, 9 aa, Homo Sapiens
HFSHITHPT

SEQ ID NO: 1364079 - protein, 9 aa, Homo Sapiens
ASGDESIPI

SEQ ID NO: 1364080 - protein, 9 aa, Homo Sapiens
QPIPPGSQK

SEQ ID NO: 1364081 - protein, 9 aa, Homo Sapiens
LSQQVANEN

SEQ ID NO: 1364082 - protein, 9 aa, Homo Sapiens
MCQLCKSLD

SEQ ID NO: 1364083 - protein, 9 aa, Homo Sapiens
LCWTPCHLS

SEQ ID NO: 1364084 - protein, 9 aa, Homo Sapiens
QDDGSDAPL

SEQ ID NO: 1364085 - protein, 9 aa, Homo Sapiens
FVWLWFRDT

SEQ ID NO: 1364086 - protein, 9 aa, Homo Sapiens
GLCFRHLDL

SEQ ID NO: 1364087 - protein, 9 aa, Homo Sapiens
EHQVQGRLW

SEQ ID NO: 1364088 - protein, 9 aa, Homo Sapiens
KEHHPEGSS

SEQ ID NO: 1364089 - protein, 9 aa, Homo Sapiens
GRAAPAMAE

SEQ ID NO: 1364090 - protein, 9 aa, Homo Sapiens
KHLTMCFLS

SEQ ID NO: 1364091 - protein, 9 aa, Homo Sapiens
RQTVELRLG

SEQ ID NO: 1364092 - protein, 9 aa, Homo Sapiens
ELAEKLRCM

SEQ ID NO: 1364093 - protein, 9 aa, Homo Sapiens
PSGRRPKRL

SEQ ID NO: 1364094 - protein, 9 aa, Homo Sapiens
LTSSETGGC

SEQ ID NO: 1364095 - protein, 9 aa, Homo Sapiens
PLLCKRCWD

SEQ ID NO: 1364096 - protein, 9 aa, Homo Sapiens
HTGERPHGR

SEQ ID NO: 1364097 - protein, 9 aa, Homo Sapiens
QAGRSRKEA

SEQ ID NO: 1364098 - protein, 9 aa, Homo Sapiens
RKQLPKRAI

SEQ ID NO: 1364099 - protein, 9 aa, Homo Sapiens
TAVEDASGD

SEQ ID NO: 1364100 - protein, 9 aa, Homo Sapiens
YSEVYLDCL

SEQ ID NO: 1364101 - protein, 9 aa, Homo Sapiens
ATPDRVLFM

SEQ ID NO: 1364102 - protein, 9 aa, Homo Sapiens
KSVQSRVKT

SEQ ID NO: 1364103 - protein, 9 aa, Homo Sapiens
AATGRAAPA

SEQ ID NO: 1364104 - protein, 9 aa, Homo Sapiens
SGHYCCVVR

SEQ ID NO: 1364105 - protein, 9 aa, Homo Sapiens
IPEAIVDLQ

SEQ ID NO: 1364106 - protein, 9 aa, Homo Sapiens
RPRRSSPPR

SEQ ID NO: 1364107 - protein, 9 aa, Homo Sapiens
MSLFVKDFV

SEQ ID NO: 1364108 - protein, 9 aa, Homo Sapiens
FTELNHDQM

SEQ ID NO: 1364109 - protein, 9 aa, Homo Sapiens
PRPGAHSPR

SEQ ID NO: 1364110 - protein, 9 aa, Homo Sapiens
KERKGDHSN

SEQ ID NO: 1364111 - protein, 9 aa, Homo Sapiens
CQNHVSRGD

SEQ ID NO: 1364112 - protein, 9 aa, Homo Sapiens
LYKYLATSL

SEQ ID NO: 1364113 - protein, 9 aa, Homo Sapiens
VSIQVNVSF

SEQ ID NO: 1364114 - protein, 9 aa, Homo Sapiens
GSKGKIAQT

SEQ ID NO: 1364115 - protein, 9 aa, Homo Sapiens
IYNSVFMQR

SEQ ID NO: 1364116 - protein, 9 aa, Homo Sapiens
MPTPGVNSS

SEQ ID NO: 1364117 - protein, 9 aa, Homo Sapiens
NVQVFTLPT

SEQ ID NO: 1364118 - protein, 9 aa, Homo Sapiens
KLRHIVDEA

SEQ ID NO: 1364119 - protein, 9 aa, Homo Sapiens
GVDGHHHGQ

SEQ ID NO: 1364120 - protein, 9 aa, Homo Sapiens
TKEPFLLVR

SEQ ID NO: 1364121 - protein, 9 aa, Homo Sapiens
VFTLPTPFP

SEQ ID NO: 1364122 - protein, 9 aa, Homo Sapiens
LQPRARHFL

SEQ ID NO: 1364123 - protein, 9 aa, Homo Sapiens
GGHAAICPQ

SEQ ID NO: 1364124 - protein, 9 aa, Homo Sapiens
ALLNNRNSL

SEQ ID NO: 1364125 - protein, 9 aa, Homo Sapiens
HPHPTPTSD

SEQ ID NO: 1364126 - protein, 9 aa, Homo Sapiens
DIKPDNVLV

SEQ ID NO: 1364127 - protein, 9 aa, Homo Sapiens
CDEQGMAFS

SEQ ID NO: 1364128 - protein, 9 aa, Homo Sapiens
AFKRPSHLA

SEQ ID NO: 1364129 - protein, 9 aa, Homo Sapiens
RVSRPPRRR

SEQ ID NO: 1364130 - protein, 9 aa, Homo Sapiens
LRPQEGPGR

SEQ ID NO: 1364131 - protein, 9 aa, Homo Sapiens
FWIYDNQRQ

SEQ ID NO: 1364132 - protein, 9 aa, Homo Sapiens
CLTAVDCLQ

SEQ ID NO: 1364133 - protein, 9 aa, Homo Sapiens
FTDSAPTVS

SEQ ID NO: 1364134 - protein, 9 aa, Homo Sapiens
EHNYCRLIL

SEQ ID NO: 1364135 - protein, 9 aa, Homo Sapiens
PTSKTEHQV

SEQ ID NO: 1364136 - protein, 9 aa, Homo Sapiens
YGPPSPGYT

SEQ ID NO: 1364137 - protein, 9 aa, Homo Sapiens
SIYQTPGLG

SEQ ID NO: 1364138 - protein, 9 aa, Homo Sapiens
EKQNNQTWN

SEQ ID NO: 1364139 - protein, 9 aa, Homo Sapiens
ITVAVMNEH

SEQ ID NO: 1364140 - protein, 9 aa, Homo Sapiens
RKGDHSNND

SEQ ID NO: 1364141 - protein, 9 aa, Homo Sapiens
SSSSSGPMG

SEQ ID NO: 1364142 - protein, 9 aa, Homo Sapiens
QIADSTMLQ

SEQ ID NO: 1364143 - protein, 9 aa, Homo Sapiens
GLGCVAELG

SEQ ID NO: 1364144 - protein, 9 aa, Homo Sapiens
GRILAINSS

SEQ ID NO: 1364145 - protein, 9 aa, Homo Sapiens
GSPEEASVH

SEQ ID NO: 1364146 - protein, 9 aa, Homo Sapiens
IDVVPRDEL

SEQ ID NO: 1364147 - protein, 9 aa, Homo Sapiens
WAPYRQKMH

SEQ ID NO: 1364148 - protein, 9 aa, Homo Sapiens
QADGREEEE

SEQ ID NO: 1364149 - protein, 9 aa, Homo Sapiens
VVSGVSQPD

SEQ ID NO: 1364150 - protein, 9 aa, Homo Sapiens
AFPPPGTKQ

SEQ ID NO: 1364151 - protein, 9 aa, Homo Sapiens
AGPPGPQAL

SEQ ID NO: 1364152 - protein, 9 aa, Homo Sapiens
NMDRSWKIA

SEQ ID NO: 1364153 - protein, 9 aa, Homo Sapiens
FSKVPPLVG

SEQ ID NO: 1364154 - protein, 9 aa, Homo Sapiens
KDILRPPRT

SEQ ID NO: 1364155 - protein, 9 aa, Homo Sapiens
HRGFLSSSS

SEQ ID NO: 1364156 - protein, 9 aa, Homo Sapiens
SRPHAVLRG

SEQ ID NO: 1364157 - protein, 9 aa, Homo Sapiens
DAGSLYEPA

SEQ ID NO: 1364158 - protein, 9 aa, Homo Sapiens
SNGDGSISY

SEQ ID NO: 1364159 - protein, 9 aa, Homo Sapiens
VGIPQQCII

SEQ ID NO: 1364160 - protein, 9 aa, Homo Sapiens
KVTSVKHLK

SEQ ID NO: 1364161 - protein, 9 aa, Homo Sapiens
ISLRDGYVL

SEQ ID NO: 1364162 - protein, 9 aa, Homo Sapiens
KKIMHYMCQ

SEQ ID NO: 1364163 - protein, 9 aa, Homo Sapiens
KSQRKRQKQ

SEQ ID NO: 1364164 - protein, 9 aa, Homo Sapiens
AHDLASREW

SEQ ID NO: 1364165 - protein, 9 aa, Homo Sapiens
EGELHYAAL

SEQ ID NO: 1364166 - protein, 9 aa, Homo Sapiens
LHVCQNHVS

SEQ ID NO: 1364167 - protein, 9 aa, Homo Sapiens
SAICKKCGL

SEQ ID NO: 1364168 - protein, 9 aa, Homo Sapiens
GMNWSCRTL

SEQ ID NO: 1364169 - protein, 9 aa, Homo Sapiens
PSIPVSQPL

SEQ ID NO: 1364170 - protein, 9 aa, Homo Sapiens
GAPHEAHYL

SEQ ID NO: 1364171 - protein, 9 aa, Homo Sapiens
LVLRPPAQC

SEQ ID NO: 1364172 - protein, 9 aa, Homo Sapiens
MKQRHENQT

SEQ ID NO: 1364173 - protein, 9 aa, Homo Sapiens
VGRHCGNSF

SEQ ID NO: 1364174 - protein, 9 aa, Homo Sapiens
NPGPGTWTP

SEQ ID NO: 1364175 - protein, 9 aa, Homo Sapiens
LPAPAHFLD

SEQ ID NO: 1364176 - protein, 9 aa, Homo Sapiens
LSMFFLMCC

SEQ ID NO: 1364177 - protein, 9 aa, Homo Sapiens
TLGLLLPLA

SEQ ID NO: 1364178 - protein, 9 aa, Homo Sapiens
PLTHLAPKC

SEQ ID NO: 1364179 - protein, 9 aa, Homo Sapiens
SLLNHRHSH

SEQ ID NO: 1364180 - protein, 9 aa, Homo Sapiens
HSGGALLAP

SEQ ID NO: 1364181 - protein, 9 aa, Homo Sapiens
YLPGIHGPP

SEQ ID NO: 1364182 - protein, 9 aa, Homo Sapiens
IDSTVTMKG

SEQ ID NO: 1364183 - protein, 9 aa, Homo Sapiens
LASECLHED

SEQ ID NO: 1364184 - protein, 9 aa, Homo Sapiens
QGPVHLVQQ

SEQ ID NO: 1364185 - protein, 9 aa, Homo Sapiens
HWHTSTGPA

SEQ ID NO: 1364186 - protein, 9 aa, Homo Sapiens
LRFKRPQPT

SEQ ID NO: 1364187 - protein, 9 aa, Homo Sapiens
YEAQKPERM

SEQ ID NO: 1364188 - protein, 9 aa, Homo Sapiens
VYRDQNKHK

SEQ ID NO: 1364189 - protein, 9 aa, Homo Sapiens
MYFFLATLS

SEQ ID NO: 1364190 - protein, 9 aa, Homo Sapiens
KSKEVEIKR

SEQ ID NO: 1364191 - protein, 9 aa, Homo Sapiens
RDSLEFEMR

SEQ ID NO: 1364192 - protein, 9 aa, Homo Sapiens
SGPGMHLFQ

SEQ ID NO: 1364193 - protein, 9 aa, Homo Sapiens
TGPAQDCVR

SEQ ID NO: 1364194 - protein, 9 aa, Homo Sapiens
HDIIAEDIQ

SEQ ID NO: 1364195 - protein, 9 aa, Homo Sapiens
LPQSPATPV

SEQ ID NO: 1364196 - protein, 9 aa, Homo Sapiens
LCDRQRELR

SEQ ID NO: 1364197 - protein, 9 aa, Homo Sapiens
RPGTPPPLI

SEQ ID NO: 1364198 - protein, 9 aa, Homo Sapiens
NGSEEPSSF

SEQ ID NO: 1364199 - protein, 9 aa, Homo Sapiens
AICPQLLQR

SEQ ID NO: 1364200 - protein, 9 aa, Homo Sapiens
NMVLAHDLA

SEQ ID NO: 1364201 - protein, 9 aa, Homo Sapiens
TRTHLKEKP

SEQ ID NO: 1364202 - protein, 9 aa, Homo Sapiens
IAPRRAALH

SEQ ID NO: 1364203 - protein, 9 aa, Homo Sapiens
SGYLSPEVL

SEQ ID NO: 1364204 - protein, 9 aa, Homo Sapiens
HHHGQHTHG

SEQ ID NO: 1364205 - protein, 9 aa, Homo Sapiens
HVRFINPGL

SEQ ID NO: 1364206 - protein, 9 aa, Homo Sapiens
VNAGASVVT

SEQ ID NO: 1364207 - protein, 9 aa, Homo Sapiens
ASQTEHIQT

SEQ ID NO: 1364208 - protein, 9 aa, Homo Sapiens
NIITPPPHQ

SEQ ID NO: 1364209 - protein, 9 aa, Homo Sapiens
KDRKETVAL

SEQ ID NO: 1364210 - protein, 9 aa, Homo Sapiens
RRASWPRGG

SEQ ID NO: 1364211 - protein, 9 aa, Homo Sapiens
DQCPASAVS

SEQ ID NO: 1364212 - protein, 9 aa, Homo Sapiens
SPGGIGSCI

SEQ ID NO: 1364213 - protein, 9 aa, Homo Sapiens
DEIQAPHLW

SEQ ID NO: 1364214 - protein, 9 aa, Homo Sapiens
GLCKPPPQE

SEQ ID NO: 1364215 - protein, 9 aa, Homo Sapiens
CRRFLSLEQ

SEQ ID NO: 1364216 - protein, 9 aa, Homo Sapiens
FSVTVPHDE

SEQ ID NO: 1364217 - protein, 9 aa, Homo Sapiens
MSRVMSVGM

SEQ ID NO: 1364218 - protein, 9 aa, Homo Sapiens
PAGTLKAGQ

SEQ ID NO: 1364219 - protein, 9 aa, Homo Sapiens
RVCRRRWRR

SEQ ID NO: 1364220 - protein, 9 aa, Homo Sapiens
HNLSLKECF

SEQ ID NO: 1364221 - protein, 9 aa, Homo Sapiens
PIAGALRDS

SEQ ID NO: 1364222 - protein, 9 aa, Homo Sapiens
RVMSVGMYM

SEQ ID NO: 1364223 - protein, 9 aa, Homo Sapiens
ARDQTHSAG

SEQ ID NO: 1364224 - protein, 9 aa, Homo Sapiens
VAIYVNPFG

SEQ ID NO: 1364225 - protein, 9 aa, Homo Sapiens
FIVSGILNI

SEQ ID NO: 1364226 - protein, 9 aa, Homo Sapiens
KRLGMGVGS

SEQ ID NO: 1364227 - protein, 9 aa, Homo Sapiens
TVEVGEGQG

SEQ ID NO: 1364228 - protein, 9 aa, Homo Sapiens
NGAGVDVIA

SEQ ID NO: 1364229 - protein, 9 aa, Homo Sapiens
QRVIHVTQD

SEQ ID NO: 1364230 - protein, 9 aa, Homo Sapiens
KDQPLLIRR

SEQ ID NO: 1364231 - protein, 9 aa, Homo Sapiens
KKLMSLFVK

SEQ ID NO: 1364232 - protein, 9 aa, Homo Sapiens
GRWCWWGRG

SEQ ID NO: 1364233 - protein, 9 aa, Homo Sapiens
FASLRPRSV

SEQ ID NO: 1364234 - protein, 9 aa, Homo Sapiens
HKGFLNGLY

SEQ ID NO: 1364235 - protein, 9 aa, Homo Sapiens
LVCLLVLDA

SEQ ID NO: 1364236 - protein, 9 aa, Homo Sapiens
ETSVGTARI

SEQ ID NO: 1364237 - protein, 9 aa, Homo Sapiens
QTEHIQTPE

SEQ ID NO: 1364238 - protein, 9 aa, Homo Sapiens
SGPKTPCVH

SEQ ID NO: 1364239 - protein, 9 aa, Homo Sapiens
ILGKMSFLR

SEQ ID NO: 1364240 - protein, 9 aa, Homo Sapiens
SVWREVLTG

SEQ ID NO: 1364241 - protein, 9 aa, Homo Sapiens
GKNFTQGNC

SEQ ID NO: 1364242 - protein, 9 aa, Homo Sapiens
CRWSGFCGG

SEQ ID NO: 1364243 - protein, 9 aa, Homo Sapiens
TLALAALLV

SEQ ID NO: 1364244 - protein, 9 aa, Homo Sapiens
SDTPKVSSL

SEQ ID NO: 1364245 - protein, 9 aa, Homo Sapiens
GRPGAGPEE

SEQ ID NO: 1364246 - protein, 9 aa, Homo Sapiens
DPDDNARKK

SEQ ID NO: 1364247 - protein, 9 aa, Homo Sapiens
HTGQLQSTR

SEQ ID NO: 1364248 - protein, 9 aa, Homo Sapiens
LICELSCYV

SEQ ID NO: 1364249 - protein, 9 aa, Homo Sapiens
CLSDEYMGT

SEQ ID NO: 1364250 - protein, 9 aa, Homo Sapiens
PSDIICVTV

SEQ ID NO: 1364251 - protein, 9 aa, Homo Sapiens
NPCQVPCSG

SEQ ID NO: 1364252 - protein, 9 aa, Homo Sapiens
ERTESELRT

SEQ ID NO: 1364253 - protein, 9 aa, Homo Sapiens
LADTHPFFN

SEQ ID NO: 1364254 - protein, 9 aa, Homo Sapiens
RKAQLQVGR

SEQ ID NO: 1364255 - protein, 9 aa, Homo Sapiens
RKKIKAQKM

SEQ ID NO: 1364256 - protein, 9 aa, Homo Sapiens
RAVGKSQDK

SEQ ID NO: 1364257 - protein, 9 aa, Homo Sapiens
LSLTTGSFL

SEQ ID NO: 1364258 - protein, 9 aa, Homo Sapiens
RKEAELIIQ

SEQ ID NO: 1364259 - protein, 9 aa, Homo Sapiens
MKVFGVDLA

SEQ ID NO: 1364260 - protein, 9 aa, Homo Sapiens
PHRHLRRRP

SEQ ID NO: 1364261 - protein, 9 aa, Homo Sapiens
RTGAIHIGG

SEQ ID NO: 1364262 - protein, 9 aa, Homo Sapiens
VERAFGYYG

SEQ ID NO: 1364263 - protein, 9 aa, Homo Sapiens
FDVLDSVTG

SEQ ID NO: 1364264 - protein, 9 aa, Homo Sapiens
EIFRTLQRV

SEQ ID NO: 1364265 - protein, 9 aa, Homo Sapiens
RVIHVTQDL

SEQ ID NO: 1364266 - protein, 9 aa, Homo Sapiens
IYLRWMTPD

SEQ ID NO: 1364267 - protein, 9 aa, Homo Sapiens
SATTTARQP

SEQ ID NO: 1364268 - protein, 9 aa, Homo Sapiens
CPMPTTPVQ

SEQ ID NO: 1364269 - protein, 9 aa, Homo Sapiens
SPHIALLGS

SEQ ID NO: 1364270 - protein, 9 aa, Homo Sapiens
HRRPTQTAA

SEQ ID NO: 1364271 - protein, 9 aa, Homo Sapiens
MPSAVSCFS

SEQ ID NO: 1364272 - protein, 9 aa, Homo Sapiens
GASTPARSF

SEQ ID NO: 1364273 - protein, 9 aa, Homo Sapiens
VDAEDEEGQ

SEQ ID NO: 1364274 - protein, 9 aa, Homo Sapiens
QVWSAGLAP

SEQ ID NO: 1364275 - protein, 9 aa, Homo Sapiens
QDVLKKTRN

SEQ ID NO: 1364276 - protein, 9 aa, Homo Sapiens
TVCKNNPNM

SEQ ID NO: 1364277 - protein, 9 aa, Homo Sapiens
PDRLRACQE

SEQ ID NO: 1364278 - protein, 9 aa, Homo Sapiens
RPLCPAQMC

SEQ ID NO: 1364279 - protein, 9 aa, Homo Sapiens
SRWPSSQGT

SEQ ID NO: 1364280 - protein, 9 aa, Homo Sapiens
LKDQIVDPT

SEQ ID NO: 1364281 - protein, 9 aa, Homo Sapiens
NLGNNTKLK

SEQ ID NO: 1364282 - protein, 9 aa, Homo Sapiens
FRLSGPGMH

SEQ ID NO: 1364283 - protein, 9 aa, Homo Sapiens
RVGRTLSKV

SEQ ID NO: 1364284 - protein, 9 aa, Homo Sapiens
GVARVEVAA

SEQ ID NO: 1364285 - protein, 9 aa, Homo Sapiens
LYISVLRKL

SEQ ID NO: 1364286 - protein, 9 aa, Homo Sapiens
FKTKTKSWP

SEQ ID NO: 1364287 - protein, 9 aa, Homo Sapiens
ARKQLPKRA

SEQ ID NO: 1364288 - protein, 9 aa, Homo Sapiens
DRGDVRRHP

SEQ ID NO: 1364289 - protein, 9 aa, Homo Sapiens
RCFVLSPRD

SEQ ID NO: 1364290 - protein, 9 aa, Homo Sapiens
DLSLQEASS

SEQ ID NO: 1364291 - protein, 9 aa, Homo Sapiens
HEDVIHSGG

SEQ ID NO: 1364292 - protein, 9 aa, Homo Sapiens
SYPSSQFRA

SEQ ID NO: 1364293 - protein, 9 aa, Homo Sapiens
ADPSRGVPI

SEQ ID NO: 1364294 - protein, 9 aa, Homo Sapiens
IQNNQKKQG

SEQ ID NO: 1364295 - protein, 9 aa, Homo Sapiens
LKVVGPACA

SEQ ID NO: 1364296 - protein, 9 aa, Homo Sapiens
PPQLPSIPV

SEQ ID NO: 1364297 - protein, 9 aa, Homo Sapiens
QPLLVRRDA

SEQ ID NO: 1364298 - protein, 9 aa, Homo Sapiens
LENLAGEIV

SEQ ID NO: 1364299 - protein, 9 aa, Homo Sapiens
QNNQKKQGN

SEQ ID NO: 1364300 - protein, 9 aa, Homo Sapiens
NSSCAPVFL

SEQ ID NO: 1364301 - protein, 9 aa, Homo Sapiens
KKKEDFAMQ

SEQ ID NO: 1364302 - protein, 9 aa, Homo Sapiens
PRASQTEHI

SEQ ID NO: 1364303 - protein, 9 aa, Homo Sapiens
QHSSSSSNS

SEQ ID NO: 1364304 - protein, 9 aa, Homo Sapiens
PPPPLPLSA

SEQ ID NO: 1364305 - protein, 9 aa, Homo Sapiens
GAAVAAARA

SEQ ID NO: 1364306 - protein, 9 aa, Homo Sapiens
RAEVSIQVN

SEQ ID NO: 1364307 - protein, 9 aa, Homo Sapiens
APPHRLLGP

SEQ ID NO: 1364308 - protein, 9 aa, Homo Sapiens
RWNYRHTPP

SEQ ID NO: 1364309 - protein, 9 aa, Homo Sapiens
TRCSSTSAH

SEQ ID NO: 1364310 - protein, 9 aa, Homo Sapiens
PGQSPIGSV

SEQ ID NO: 1364311 - protein, 9 aa, Homo Sapiens
KRNRNEDDE

SEQ ID NO: 1364312 - protein, 9 aa, Homo Sapiens
HGYPLSWMK

SEQ ID NO: 1364313 - protein, 9 aa, Homo Sapiens
HLAEPALGA

SEQ ID NO: 1364314 - protein, 9 aa, Homo Sapiens
DFHIQQVEW

SEQ ID NO: 1364315 - protein, 9 aa, Homo Sapiens
VAVKPLAES

SEQ ID NO: 1364316 - protein, 9 aa, Homo Sapiens
SMEEQRQEE

SEQ ID NO: 1364317 - protein, 9 aa, Homo Sapiens
ESETGHMEE

SEQ ID NO: 1364318 - protein, 9 aa, Homo Sapiens
DRKETVALI

SEQ ID NO: 1364319 - protein, 9 aa, Homo Sapiens
VDLCSMSNT

SEQ ID NO: 1364320 - protein, 9 aa, Homo Sapiens
SASTKITAL

SEQ ID NO: 1364321 - protein, 9 aa, Homo Sapiens
NGAYAMRLG

SEQ ID NO: 1364322 - protein, 9 aa, Homo Sapiens
MVVRTGFST

SEQ ID NO: 1364323 - protein, 9 aa, Homo Sapiens
DGLTSQGLH

SEQ ID NO: 1364324 - protein, 9 aa, Homo Sapiens
CLPSRWNYR

SEQ ID NO: 1364325 - protein, 9 aa, Homo Sapiens
HYCCVVRNS

SEQ ID NO: 1364326 - protein, 9 aa, Homo Sapiens
GRGLRAHPV

SEQ ID NO: 1364327 - protein, 9 aa, Homo Sapiens
DRVLFMLLN

SEQ ID NO: 1364328 - protein, 9 aa, Homo Sapiens
DVSTYQYVE

SEQ ID NO: 1364329 - protein, 9 aa, Homo Sapiens
TENGQWKGR

SEQ ID NO: 1364330 - protein, 9 aa, Homo Sapiens
PAVHFPQVV

SEQ ID NO: 1364331 - protein, 9 aa, Homo Sapiens
RPQQIWHGP

SEQ ID NO: 1364332 - protein, 9 aa, Homo Sapiens
SPPVFSRDE

SEQ ID NO: 1364333 - protein, 9 aa, Homo Sapiens
LSINTIWKS

SEQ ID NO: 1364334 - protein, 9 aa, Homo Sapiens
TAQHVVGLH

SEQ ID NO: 1364335 - protein, 9 aa, Homo Sapiens
HHMRGETTL

SEQ ID NO: 1364336 - protein, 9 aa, Homo Sapiens
PMALYSLEF

SEQ ID NO: 1364337 - protein, 9 aa, Homo Sapiens
SAGTVECLY

SEQ ID NO: 1364338 - protein, 9 aa, Homo Sapiens
VFGPTMVAH

SEQ ID NO: 1364339 - protein, 9 aa, Homo Sapiens
MRSGGDWLA

SEQ ID NO: 1364340 - protein, 9 aa, Homo Sapiens
WGGACFIVS

SEQ ID NO: 1364341 - protein, 9 aa, Homo Sapiens
DLGTVAGAT

SEQ ID NO: 1364342 - protein, 9 aa, Homo Sapiens
RFQKTVTQL

SEQ ID NO: 1364343 - protein, 9 aa, Homo Sapiens
QQQHSSSSS

SEQ ID NO: 1364344 - protein, 9 aa, Homo Sapiens
SRVSQRPFR

SEQ ID NO: 1364345 - protein, 9 aa, Homo Sapiens
GGQDQFSWE

SEQ ID NO: 1364346 - protein, 9 aa, Homo Sapiens
YQQELKKSY

SEQ ID NO: 1364347 - protein, 9 aa, Homo Sapiens
LGMGDQKAS

SEQ ID NO: 1364348 - protein, 9 aa, Homo Sapiens
PQCLLSAPT

SEQ ID NO: 1364349 - protein, 9 aa, Homo Sapiens
KKKKLMSLF

SEQ ID NO: 1364350 - protein, 9 aa, Homo Sapiens
NENDFDEKK

SEQ ID NO: 1364351 - protein, 9 aa, Homo Sapiens
AGGQPESHH

SEQ ID NO: 1364352 - protein, 9 aa, Homo Sapiens
KDSEDEIQA

SEQ ID NO: 1364353 - protein, 9 aa, Homo Sapiens
ISIPAAKPA

SEQ ID NO: 1364354 - protein, 9 aa, Homo Sapiens
RDQTHSAGR

SEQ ID NO: 1364355 - protein, 9 aa, Homo Sapiens
TAATVEDML

SEQ ID NO: 1364356 - protein, 9 aa, Homo Sapiens
SWGSPTRMA

SEQ ID NO: 1364357 - protein, 9 aa, Homo Sapiens
RVSAETTED

SEQ ID NO: 1364358 - protein, 9 aa, Homo Sapiens
FFQNSTFGF

SEQ ID NO: 1364359 - protein, 9 aa, Homo Sapiens
EKKINNQII

SEQ ID NO: 1364360 - protein, 9 aa, Homo Sapiens
TGHLVGRHC

SEQ ID NO: 1364361 - protein, 9 aa, Homo Sapiens
LIRRNAFLI

SEQ ID NO: 1364362 - protein, 9 aa, Homo Sapiens
TSQGLHEDL

SEQ ID NO: 1364363 - protein, 9 aa, Homo Sapiens
GGLCSEFLW

SEQ ID NO: 1364364 - protein, 9 aa, Homo Sapiens
KNRHRGKNE

SEQ ID NO: 1364365 - protein, 9 aa, Homo Sapiens
QRRNLGVSG

SEQ ID NO: 1364366 - protein, 9 aa, Homo Sapiens
DYEVKKEGG

SEQ ID NO: 1364367 - protein, 9 aa, Homo Sapiens
WSLIGHLHL

SEQ ID NO: 1364368 - protein, 9 aa, Homo Sapiens
IFYYVTGFF

SEQ ID NO: 1364369 - protein, 9 aa, Homo Sapiens
RSVRYILKD

SEQ ID NO: 1364370 - protein, 9 aa, Homo Sapiens
ASSEKASAK

SEQ ID NO: 1364371 - protein, 9 aa, Homo Sapiens
RPPRRRVTP

SEQ ID NO: 1364372 - protein, 9 aa, Homo Sapiens
KGGKNRHRG

SEQ ID NO: 1364373 - protein, 9 aa, Homo Sapiens
TITMYMKGG

SEQ ID NO: 1364374 - protein, 9 aa, Homo Sapiens
YEAPIFTTP

SEQ ID NO: 1364375 - protein, 9 aa, Homo Sapiens
MAACPGAPE

SEQ ID NO: 1364376 - protein, 9 aa, Homo Sapiens
VMMSRVMSV

SEQ ID NO: 1364377 - protein, 9 aa, Homo Sapiens
PVRRHQCEE

SEQ ID NO: 1364378 - protein, 9 aa, Homo Sapiens
RYKLTFVLG

SEQ ID NO: 1364379 - protein, 9 aa, Homo Sapiens
LYKPQAGER

SEQ ID NO: 1364380 - protein, 9 aa, Homo Sapiens
LVPAERGRG

SEQ ID NO: 1364381 - protein, 9 aa, Homo Sapiens
TSDCFISYG

SEQ ID NO: 1364382 - protein, 9 aa, Homo Sapiens
GKMSFLRRI

SEQ ID NO: 1364383 - protein, 9 aa, Homo Sapiens
CQLEVAGKE

SEQ ID NO: 1364384 - protein, 9 aa, Homo Sapiens
LLLNGEVAM

SEQ ID NO: 1364385 - protein, 9 aa, Homo Sapiens
EPWLRKNYL

SEQ ID NO: 1364386 - protein, 9 aa, Homo Sapiens
EDGYYQKMQ

SEQ ID NO: 1364387 - protein, 9 aa, Homo Sapiens
GRKSGNPPS

SEQ ID NO: 1364388 - protein, 9 aa, Homo Sapiens
RFMPKSDTD

SEQ ID NO: 1364389 - protein, 9 aa, Homo Sapiens
RLRTLEEQG

SEQ ID NO: 1364390 - protein, 9 aa, Homo Sapiens
ESSDQNSRS

SEQ ID NO: 1364391 - protein, 9 aa, Homo Sapiens
EESKTRISQ

SEQ ID NO: 1364392 - protein, 9 aa, Homo Sapiens
LKLILVMLE

SEQ ID NO: 1364393 - protein, 9 aa, Homo Sapiens
TLEQLPESV

SEQ ID NO: 1364394 - protein, 9 aa, Homo Sapiens
GIGSCIPCP

SEQ ID NO: 1364395 - protein, 9 aa, Homo Sapiens
VNRRLRTLE

SEQ ID NO: 1364396 - protein, 9 aa, Homo Sapiens
SFRSTRATS

SEQ ID NO: 1364397 - protein, 9 aa, Homo Sapiens
SEGGCSRYS

SEQ ID NO: 1364398 - protein, 9 aa, Homo Sapiens
AARALRARG

SEQ ID NO: 1364399 - protein, 9 aa, Homo Sapiens
SDPGDDDVK

SEQ ID NO: 1364400 - protein, 9 aa, Homo Sapiens
KKPVNWTNS

SEQ ID NO: 1364401 - protein, 9 aa, Homo Sapiens
SHRPPEAPL

SEQ ID NO: 1364402 - protein, 9 aa, Homo Sapiens
KQPEMSIKY

SEQ ID NO: 1364403 - protein, 9 aa, Homo Sapiens
VRRSAAAPG

SEQ ID NO: 1364404 - protein, 9 aa, Homo Sapiens
YAALSFHKV

SEQ ID NO: 1364405 - protein, 9 aa, Homo Sapiens
LQQVQCLVP

SEQ ID NO: 1364406 - protein, 9 aa, Homo Sapiens
IHIWDVRTT

SEQ ID NO: 1364407 - protein, 9 aa, Homo Sapiens
CSCCIPDPM

SEQ ID NO: 1364408 - protein, 9 aa, Homo Sapiens
LQKEVLDSQ

SEQ ID NO: 1364409 - protein, 9 aa, Homo Sapiens
PPDFKIRCT

SEQ ID NO: 1364410 - protein, 9 aa, Homo Sapiens
NFLLASVGS

SEQ ID NO: 1364411 - protein, 9 aa, Homo Sapiens
TSTGPAQDC

SEQ ID NO: 1364412 - protein, 9 aa, Homo Sapiens
SEADLRKKV

SEQ ID NO: 1364413 - protein, 9 aa, Homo Sapiens
VYCMPVCCG

SEQ ID NO: 1364414 - protein, 9 aa, Homo Sapiens
AMEELCAEV

SEQ ID NO: 1364415 - protein, 9 aa, Homo Sapiens
GVGIALGGY

SEQ ID NO: 1364416 - protein, 9 aa, Homo Sapiens
CMLGKKRSL

SEQ ID NO: 1364417 - protein, 9 aa, Homo Sapiens
QALPEKGLV

SEQ ID NO: 1364418 - protein, 9 aa, Homo Sapiens
KTEVERAFG

SEQ ID NO: 1364419 - protein, 9 aa, Homo Sapiens
EHPQPHKLQ

SEQ ID NO: 1364420 - protein, 9 aa, Homo Sapiens
DSPAAAQKV

SEQ ID NO: 1364421 - protein, 9 aa, Homo Sapiens
ELEKEQEKR

SEQ ID NO: 1364422 - protein, 9 aa, Homo Sapiens
ASLHPASGR

SEQ ID NO: 1364423 - protein, 9 aa, Homo Sapiens
GPWGKSFRS

SEQ ID NO: 1364424 - protein, 9 aa, Homo Sapiens
ATKLACLGG

SEQ ID NO: 1364425 - protein, 9 aa, Homo Sapiens
RAPHGPVTC

SEQ ID NO: 1364426 - protein, 9 aa, Homo Sapiens
VTRLHFESD

SEQ ID NO: 1364427 - protein, 9 aa, Homo Sapiens
HSPVPCHLS

SEQ ID NO: 1364428 - protein, 9 aa, Homo Sapiens
QGKRNKDGL

SEQ ID NO: 1364429 - protein, 9 aa, Homo Sapiens
ITGMLNSRI

SEQ ID NO: 1364430 - protein, 9 aa, Homo Sapiens
ITGINHKNL

SEQ ID NO: 1364431 - protein, 9 aa, Homo Sapiens
MMTHQLPSR

SEQ ID NO: 1364432 - protein, 9 aa, Homo Sapiens
GQVADQEEV

SEQ ID NO: 1364433 - protein, 9 aa, Homo Sapiens
TSRDVNRRF

SEQ ID NO: 1364434 - protein, 9 aa, Homo Sapiens
VHIQKNADC

SEQ ID NO: 1364435 - protein, 9 aa, Homo Sapiens
LMAQRRHKR

SEQ ID NO: 1364436 - protein, 9 aa, Homo Sapiens
SSVSGDFGD

SEQ ID NO: 1364437 - protein, 9 aa, Homo Sapiens
LWASSKVEA

SEQ ID NO: 1364438 - protein, 9 aa, Homo Sapiens
WTPCHLSTV

SEQ ID NO: 1364439 - protein, 9 aa, Homo Sapiens
VALILKAKL

SEQ ID NO: 1364440 - protein, 9 aa, Homo Sapiens
SFQLHPQPV

SEQ ID NO: 1364441 - protein, 9 aa, Homo Sapiens
EPRRRLWPP

SEQ ID NO: 1364442 - protein, 9 aa, Homo Sapiens
CMMVANILN

SEQ ID NO: 1364443 - protein, 9 aa, Homo Sapiens
SMGTDQASH

SEQ ID NO: 1364444 - protein, 9 aa, Homo Sapiens
NGVTRLHLE

SEQ ID NO: 1364445 - protein, 9 aa, Homo Sapiens
PRLGFADLF

SEQ ID NO: 1364446 - protein, 9 aa, Homo Sapiens
PQPTRLVAE

SEQ ID NO: 1364447 - protein, 9 aa, Homo Sapiens
FYNVGEKVF

SEQ ID NO: 1364448 - protein, 9 aa, Homo Sapiens
PEKRLGMGV

SEQ ID NO: 1364449 - protein, 9 aa, Homo Sapiens
ITLALAALL

SEQ ID NO: 1364450 - protein, 9 aa, Homo Sapiens
FLAAVPARR

SEQ ID NO: 1364451 - protein, 9 aa, Homo Sapiens
QRRLRACRA

SEQ ID NO: 1364452 - protein, 9 aa, Homo Sapiens
LPRTSASRQ

SEQ ID NO: 1364453 - protein, 9 aa, Homo Sapiens
YTFQLTATD

SEQ ID NO: 1364454 - protein, 9 aa, Homo Sapiens
KVAVDGSVI

SEQ ID NO: 1364455 - protein, 9 aa, Homo Sapiens
CFDVLDSVT

SEQ ID NO: 1364456 - protein, 9 aa, Homo Sapiens
LLPPDFKIR

SEQ ID NO: 1364457 - protein, 9 aa, Homo Sapiens
ADLCLPALG

SEQ ID NO: 1364458 - protein, 9 aa, Homo Sapiens
FLNSVSKNP

SEQ ID NO: 1364459 - protein, 9 aa, Homo Sapiens
APAQGQATL

SEQ ID NO: 1364460 - protein, 9 aa, Homo Sapiens
GAEEATVEC

SEQ ID NO: 1364461 - protein, 9 aa, Homo Sapiens
SLNPCPFPF

SEQ ID NO: 1364462 - protein, 9 aa, Homo Sapiens
VTPKVIFFW

SEQ ID NO: 1364463 - protein, 9 aa, Homo Sapiens
TSVKHLKAI

SEQ ID NO: 1364464 - protein, 9 aa, Homo Sapiens
RGPWPPGPV

SEQ ID NO: 1364465 - protein, 9 aa, Homo Sapiens
VLEMCNTDS

SEQ ID NO: 1364466 - protein, 9 aa, Homo Sapiens
WLVLVMDCP

SEQ ID NO: 1364467 - protein, 9 aa, Homo Sapiens
HKEKRVYSR

SEQ ID NO: 1364468 - protein, 9 aa, Homo Sapiens
GLSESQESH

SEQ ID NO: 1364469 - protein, 9 aa, Homo Sapiens
GFGGRRRQR

SEQ ID NO: 1364470 - protein, 9 aa, Homo Sapiens
DTLNIAIPN

SEQ ID NO: 1364471 - protein, 9 aa, Homo Sapiens
VLVMDCPYH

SEQ ID NO: 1364472 - protein, 9 aa, Homo Sapiens
LTLVLTEDS

SEQ ID NO: 1364473 - protein, 9 aa, Homo Sapiens
FGTLKKAVV

SEQ ID NO: 1364474 - protein, 9 aa, Homo Sapiens
PKVIFFWLL

SEQ ID NO: 1364475 - protein, 9 aa, Homo Sapiens
KHKEAAHLL

SEQ ID NO: 1364476 - protein, 9 aa, Homo Sapiens
SILTRVGRT

SEQ ID NO: 1364477 - protein, 9 aa, Homo Sapiens
RNFVQHACF

SEQ ID NO: 1364478 - protein, 9 aa, Homo Sapiens
TTPLASMPF

SEQ ID NO: 1364479 - protein, 9 aa, Homo Sapiens
VASFNITSS

SEQ ID NO: 1364480 - protein, 9 aa, Homo Sapiens
TSFAPRRRA

SEQ ID NO: 1364481 - protein, 9 aa, Homo Sapiens
HSHETGQYS

SEQ ID NO: 1364482 - protein, 9 aa, Homo Sapiens
GAAPRAGRG

SEQ ID NO: 1364483 - protein, 9 aa, Homo Sapiens
GGPPKARCP

SEQ ID NO: 1364484 - protein, 9 aa, Homo Sapiens
VSDPLLTSK

SEQ ID NO: 1364485 - protein, 9 aa, Homo Sapiens
YKPQAGERG

SEQ ID NO: 1364486 - protein, 9 aa, Homo Sapiens
DSIRGVVTA

SEQ ID NO: 1364487 - protein, 9 aa, Homo Sapiens
TAISTVEIL

SEQ ID NO: 1364488 - protein, 9 aa, Homo Sapiens
MERIKGDQY

SEQ ID NO: 1364489 - protein, 9 aa, Homo Sapiens
RTPWGAMVP

SEQ ID NO: 1364490 - protein, 9 aa, Homo Sapiens
KCAICHRGF

SEQ ID NO: 1364491 - protein, 9 aa, Homo Sapiens
MTPRDLGTV

SEQ ID NO: 1364492 - protein, 9 aa, Homo Sapiens
VGGLSPGLS

SEQ ID NO: 1364493 - protein, 9 aa, Homo Sapiens
SKEQHYVRK

SEQ ID NO: 1364494 - protein, 9 aa, Homo Sapiens
EAGVEVTVR

SEQ ID NO: 1364495 - protein, 9 aa, Homo Sapiens
ALEVVEEEN

SEQ ID NO: 1364496 - protein, 9 aa, Homo Sapiens
EGIEHMYQN

SEQ ID NO: 1364497 - protein, 9 aa, Homo Sapiens
LLGKYLSTT

SEQ ID NO: 1364498 - protein, 9 aa, Homo Sapiens
MLDKFSPSS

SEQ ID NO: 1364499 - protein, 9 aa, Homo Sapiens
QGASIFQLF

SEQ ID NO: 1364500 - protein, 9 aa, Homo Sapiens
GHGQQGQAG

SEQ ID NO: 1364501 - protein, 9 aa, Homo Sapiens
KSFQLHPQP

SEQ ID NO: 1364502 - protein, 9 aa, Homo Sapiens
DWCQEGRHQ

SEQ ID NO: 1364503 - protein, 9 aa, Homo Sapiens
EEYDSIIVI

SEQ ID NO: 1364504 - protein, 9 aa, Homo Sapiens
GREEEERHL

SEQ ID NO: 1364505 - protein, 9 aa, Homo Sapiens
VELRGQEQR

SEQ ID NO: 1364506 - protein, 9 aa, Homo Sapiens
NSKVTSEVT

SEQ ID NO: 1364507 - protein, 9 aa, Homo Sapiens
LHLLCEKDG

SEQ ID NO: 1364508 - protein, 9 aa, Homo Sapiens
TAFDKVHFS

SEQ ID NO: 1364509 - protein, 9 aa, Homo Sapiens
VDVDCHQLA

SEQ ID NO: 1364510 - protein, 9 aa, Homo Sapiens
STGPAQDCV

SEQ ID NO: 1364511 - protein, 9 aa, Homo Sapiens
PQLSVTPTV

SEQ ID NO: 1364512 - protein, 9 aa, Homo Sapiens
HSHCLYYLG

SEQ ID NO: 1364513 - protein, 9 aa, Homo Sapiens
LAHDLASRE

SEQ ID NO: 1364514 - protein, 9 aa, Homo Sapiens
LMPQSFFFF

SEQ ID NO: 1364515 - protein, 9 aa, Homo Sapiens
LSVWEKPID

SEQ ID NO: 1364516 - protein, 9 aa, Homo Sapiens
ELGLLGPPG

SEQ ID NO: 1364517 - protein, 9 aa, Homo Sapiens
DTGASTPAR

SEQ ID NO: 1364518 - protein, 9 aa, Homo Sapiens
IVSGILNIA

SEQ ID NO: 1364519 - protein, 9 aa, Homo Sapiens
GKKKKLMSL

SEQ ID NO: 1364520 - protein, 9 aa, Homo Sapiens
ETKSPHEAA

SEQ ID NO: 1364521 - protein, 9 aa, Homo Sapiens
LELQPPGDC

SEQ ID NO: 1364522 - protein, 9 aa, Homo Sapiens
KIAQTTHQQ

SEQ ID NO: 1364523 - protein, 9 aa, Homo Sapiens
GQEVRMPVL

SEQ ID NO: 1364524 - protein, 9 aa, Homo Sapiens
FQRAVKKVR

SEQ ID NO: 1364525 - protein, 9 aa, Homo Sapiens
PAAARPFGR

SEQ ID NO: 1364526 - protein, 9 aa, Homo Sapiens
NAGASVVTS

SEQ ID NO: 1364527 - protein, 9 aa, Homo Sapiens
KSLKKVMAP

SEQ ID NO: 1364528 - protein, 9 aa, Homo Sapiens
IRPAVPTGG

SEQ ID NO: 1364529 - protein, 9 aa, Homo Sapiens
ASPSSAASR

SEQ ID NO: 1364530 - protein, 9 aa, Homo Sapiens
DLNTHNLLF

SEQ ID NO: 1364531 - protein, 9 aa, Homo Sapiens
KISQKKPKK

SEQ ID NO: 1364532 - protein, 9 aa, Homo Sapiens
HVSSDEEHT

SEQ ID NO: 1364533 - protein, 9 aa, Homo Sapiens
IPLSDSPPL

SEQ ID NO: 1364534 - protein, 9 aa, Homo Sapiens
ITSLKEAAD

SEQ ID NO: 1364535 - protein, 9 aa, Homo Sapiens
SREIYRGPS

SEQ ID NO: 1364536 - protein, 9 aa, Homo Sapiens
RGQKSRDEE

SEQ ID NO: 1364537 - protein, 9 aa, Homo Sapiens
MDRAPRSGR

SEQ ID NO: 1364538 - protein, 9 aa, Homo Sapiens
TAEQDDPKQ

SEQ ID NO: 1364539 - protein, 9 aa, Homo Sapiens
SGLCRRLET

SEQ ID NO: 1364540 - protein, 9 aa, Homo Sapiens
IVCMFLADL

SEQ ID NO: 1364541 - protein, 9 aa, Homo Sapiens
IAGALRDSP

SEQ ID NO: 1364542 - protein, 9 aa, Homo Sapiens
KNYLREVSI

SEQ ID NO: 1364543 - protein, 9 aa, Homo Sapiens
KWYHNDVGL

SEQ ID NO: 1364544 - protein, 9 aa, Homo Sapiens
PAGLIQAQR

SEQ ID NO: 1364545 - protein, 9 aa, Homo Sapiens
YMDSCSVLI

SEQ ID NO: 1364546 - protein, 9 aa, Homo Sapiens
DCYRYDSAT

SEQ ID NO: 1364547 - protein, 9 aa, Homo Sapiens
KGRAPHGPV

SEQ ID NO: 1364548 - protein, 9 aa, Homo Sapiens
YVVGGELFD

SEQ ID NO: 1364549 - protein, 9 aa, Homo Sapiens
VSEGTKAGT

SEQ ID NO: 1364550 - protein, 9 aa, Homo Sapiens
FLNGLYITT

SEQ ID NO: 1364551 - protein, 9 aa, Homo Sapiens
SIIVIYNSV

SEQ ID NO: 1364552 - protein, 9 aa, Homo Sapiens
VVHYDRSGR

SEQ ID NO: 1364553 - protein, 9 aa, Homo Sapiens
PKSFQLHPQ

SEQ ID NO: 1364554 - protein, 9 aa, Homo Sapiens
AGRSRKEAE

SEQ ID NO: 1364555 - protein, 9 aa, Homo Sapiens
IGSVEEQPA

SEQ ID NO: 1364556 - protein, 9 aa, Homo Sapiens
EESDLENLA

SEQ ID NO: 1364557 - protein, 9 aa, Homo Sapiens
GNKREEQGM

SEQ ID NO: 1364558 - protein, 9 aa, Homo Sapiens
WKSTVMKRK

SEQ ID NO: 1364559 - protein, 9 aa, Homo Sapiens
PPGSQKALF

SEQ ID NO: 1364560 - protein, 9 aa, Homo Sapiens
TIDVCNAVD

SEQ ID NO: 1364561 - protein, 9 aa, Homo Sapiens
TTVPDGEPN

SEQ ID NO: 1364562 - protein, 9 aa, Homo Sapiens
THNLLFKPP

SEQ ID NO: 1364563 - protein, 9 aa, Homo Sapiens
VSNETLVSC

SEQ ID NO: 1364564 - protein, 9 aa, Homo Sapiens
PSLAYEKAQ

SEQ ID NO: 1364565 - protein, 9 aa, Homo Sapiens
LSTSASVSG

SEQ ID NO: 1364566 - protein, 9 aa, Homo Sapiens
PGLFSLGMR

SEQ ID NO: 1364567 - protein, 9 aa, Homo Sapiens
LGVCTFLQL

SEQ ID NO: 1364568 - protein, 9 aa, Homo Sapiens
MRFVAAFGM

SEQ ID NO: 1364569 - protein, 9 aa, Homo Sapiens
EGVLINSTR

SEQ ID NO: 1364570 - protein, 9 aa, Homo Sapiens
LVLALPLRL

SEQ ID NO: 1364571 - protein, 9 aa, Homo Sapiens
QVPVEEQDA

SEQ ID NO: 1364572 - protein, 9 aa, Homo Sapiens
RKKVQIQRI

SEQ ID NO: 1364573 - protein, 9 aa, Homo Sapiens
SAGVGIALG

SEQ ID NO: 1364574 - protein, 9 aa, Homo Sapiens
RDGAKSLIE

SEQ ID NO: 1364575 - protein, 9 aa, Homo Sapiens
VRFINPGLL

SEQ ID NO: 1364576 - protein, 9 aa, Homo Sapiens
ELTQHPATT

SEQ ID NO: 1364577 - protein, 9 aa, Homo Sapiens
QQDGLQLRS

SEQ ID NO: 1364578 - protein, 9 aa, Homo Sapiens
PRRKPGCAR

SEQ ID NO: 1364579 - protein, 9 aa, Homo Sapiens
CHRGFLSSS

SEQ ID NO: 1364580 - protein, 9 aa, Homo Sapiens
KAMVVRTGF

SEQ ID NO: 1364581 - protein, 9 aa, Homo Sapiens
HRETVAPTS

SEQ ID NO: 1364582 - protein, 9 aa, Homo Sapiens
DLKGDGLAS

SEQ ID NO: 1364583 - protein, 9 aa, Homo Sapiens
DLVLRPPAQ

SEQ ID NO: 1364584 - protein, 9 aa, Homo Sapiens
VTLLDTILH

SEQ ID NO: 1364585 - protein, 9 aa, Homo Sapiens
TVPDGEPNA

SEQ ID NO: 1364586 - protein, 9 aa, Homo Sapiens
GPAGRPGLP

SEQ ID NO: 1364587 - protein, 9 aa, Homo Sapiens
FLQEFSQQA

SEQ ID NO: 1364588 - protein, 9 aa, Homo Sapiens
QRIAETGVS

SEQ ID NO: 1364589 - protein, 9 aa, Homo Sapiens
PGSLLSSGT

SEQ ID NO: 1364590 - protein, 9 aa, Homo Sapiens
DARTGQSLV

SEQ ID NO: 1364591 - protein, 9 aa, Homo Sapiens
LARRLDFQE

SEQ ID NO: 1364592 - protein, 9 aa, Homo Sapiens
ECLCKYGSV

SEQ ID NO: 1364593 - protein, 9 aa, Homo Sapiens
EPWLPAKAL

SEQ ID NO: 1364594 - protein, 9 aa, Homo Sapiens
IATLLFCLL

SEQ ID NO: 1364595 - protein, 9 aa, Homo Sapiens
RREENSRNS

SEQ ID NO: 1364596 - protein, 9 aa, Homo Sapiens
DQIPLELPL

SEQ ID NO: 1364597 - protein, 9 aa, Homo Sapiens
LRVICSLYS

SEQ ID NO: 1364598 - protein, 9 aa, Homo Sapiens
SDPSDIICV

SEQ ID NO: 1364599 - protein, 9 aa, Homo Sapiens
FEKTHHCLL

SEQ ID NO: 1364600 - protein, 9 aa, Homo Sapiens
SLWGPWNPC

SEQ ID NO: 1364601 - protein, 9 aa, Homo Sapiens
HFQGPMHGS

SEQ ID NO: 1364602 - protein, 9 aa, Homo Sapiens
ASHCRCATT

SEQ ID NO: 1364603 - protein, 9 aa, Homo Sapiens
GSHAKDDAG

SEQ ID NO: 1364604 - protein, 9 aa, Homo Sapiens
WVPDVGSTW

SEQ ID NO: 1364605 - protein, 9 aa, Homo Sapiens
NRSIVPTSR

SEQ ID NO: 1364606 - protein, 9 aa, Homo Sapiens
QLSLQVTPR

SEQ ID NO: 1364607 - protein, 9 aa, Homo Sapiens
HLFDENNDA

SEQ ID NO: 1364608 - protein, 9 aa, Homo Sapiens
FVKGCAERF

SEQ ID NO: 1364609 - protein, 9 aa, Homo Sapiens
RTESELRTS

SEQ ID NO: 1364610 - protein, 9 aa, Homo Sapiens
DSPLPVQPR

SEQ ID NO: 1364611 - protein, 9 aa, Homo Sapiens
SSLFRTEPT

SEQ ID NO: 1364612 - protein, 9 aa, Homo Sapiens
VQSRVKTWY

SEQ ID NO: 1364613 - protein, 9 aa, Homo Sapiens
EVTGRTAQR

SEQ ID NO: 1364614 - protein, 9 aa, Homo Sapiens
RDQGFCQAL

SEQ ID NO: 1364615 - protein, 9 aa, Homo Sapiens
LLSERLLRP

SEQ ID NO: 1364616 - protein, 9 aa, Homo Sapiens
PNAANTVLR

SEQ ID NO: 1364617 - protein, 9 aa, Homo Sapiens
EVSFNPDCE

SEQ ID NO: 1364618 - protein, 9 aa, Homo Sapiens
ITLHDEEAN

SEQ ID NO: 1364619 - protein, 9 aa, Homo Sapiens
ACLGGGRRV

SEQ ID NO: 1364620 - protein, 9 aa, Homo Sapiens
STKLTQSVD

SEQ ID NO: 1364621 - protein, 9 aa, Homo Sapiens
LADLLSVVW

SEQ ID NO: 1364622 - protein, 9 aa, Homo Sapiens
SNTSVFLLS

SEQ ID NO: 1364623 - protein, 9 aa, Homo Sapiens
TSSIYQTPG

SEQ ID NO: 1364624 - protein, 9 aa, Homo Sapiens
ILDGVTGLH

SEQ ID NO: 1364625 - protein, 9 aa, Homo Sapiens
TSVGTARIW

SEQ ID NO: 1364626 - protein, 9 aa, Homo Sapiens
TARVVPTRG

SEQ ID NO: 1364627 - protein, 9 aa, Homo Sapiens
VVPTMHSWY

SEQ ID NO: 1364628 - protein, 9 aa, Homo Sapiens
EDLLLDEKN

SEQ ID NO: 1364629 - protein, 9 aa, Homo Sapiens
ELRQVTQKR

SEQ ID NO: 1364630 - protein, 9 aa, Homo Sapiens
HSLGAVQIS

SEQ ID NO: 1364631 - protein, 9 aa, Homo Sapiens
LIEPVQCDE

SEQ ID NO: 1364632 - protein, 9 aa, Homo Sapiens
LCPAQMCAS

SEQ ID NO: 1364633 - protein, 9 aa, Homo Sapiens
GVCTFLQLA

SEQ ID NO: 1364634 - protein, 9 aa, Homo Sapiens
QLAPENPFL

SEQ ID NO: 1364635 - protein, 9 aa, Homo Sapiens
HSTLRPWPR

SEQ ID NO: 1364636 - protein, 9 aa, Homo Sapiens
EPIPGLEAI

SEQ ID NO: 1364637 - protein, 9 aa, Homo Sapiens
SGSQQAWGM

SEQ ID NO: 1364638 - protein, 9 aa, Homo Sapiens
ILKTYSDSQ

SEQ ID NO: 1364639 - protein, 9 aa, Homo Sapiens
NQTHTLEKQ

SEQ ID NO: 1364640 - protein, 9 aa, Homo Sapiens
QEKRREMEK

SEQ ID NO: 1364641 - protein, 9 aa, Homo Sapiens
RRAEGGAPH

SEQ ID NO: 1364642 - protein, 9 aa, Homo Sapiens
WREMMGCLS

SEQ ID NO: 1364643 - protein, 9 aa, Homo Sapiens
AGTLAARAL

SEQ ID NO: 1364644 - protein, 9 aa, Homo Sapiens
SLPEDRYTQ

SEQ ID NO: 1364645 - protein, 9 aa, Homo Sapiens
FQKACMTQL

SEQ ID NO: 1364646 - protein, 9 aa, Homo Sapiens
ACRPTLCPW

SEQ ID NO: 1364647 - protein, 9 aa, Homo Sapiens
NFVHLAHIG

SEQ ID NO: 1364648 - protein, 9 aa, Homo Sapiens
SAAAWCPCI

SEQ ID NO: 1364649 - protein, 9 aa, Homo Sapiens
AQLVRSLVN

SEQ ID NO: 1364650 - protein, 9 aa, Homo Sapiens
SGPLGNSSG

SEQ ID NO: 1364651 - protein, 9 aa, Homo Sapiens
KERWEPQPG

SEQ ID NO: 1364652 - protein, 9 aa, Homo Sapiens
LPSDPLTHL

SEQ ID NO: 1364653 - protein, 9 aa, Homo Sapiens
QQVQRRGAG

SEQ ID NO: 1364654 - protein, 9 aa, Homo Sapiens
FHEPQGLQD

SEQ ID NO: 1364655 - protein, 9 aa, Homo Sapiens
GKHNSPEMK

SEQ ID NO: 1364656 - protein, 9 aa, Homo Sapiens
WKGMTLEQQ

SEQ ID NO: 1364657 - protein, 9 aa, Homo Sapiens
EVVVHAEGQ

SEQ ID NO: 1364658 - protein, 9 aa, Homo Sapiens
LLSSGTARG

SEQ ID NO: 1364659 - protein, 9 aa, Homo Sapiens
GATVDVVMN

SEQ ID NO: 1364660 - protein, 9 aa, Homo Sapiens
TAQIQRPIQ

SEQ ID NO: 1364661 - protein, 9 aa, Homo Sapiens
AFYQCAKSF

SEQ ID NO: 1364662 - protein, 9 aa, Homo Sapiens
HKKLLWFYV

SEQ ID NO: 1364663 - protein, 9 aa, Homo Sapiens
VPPDIDRQT

SEQ ID NO: 1364664 - protein, 9 aa, Homo Sapiens
KRARGCWWG

SEQ ID NO: 1364665 - protein, 9 aa, Homo Sapiens
TATKKVFRV

SEQ ID NO: 1364666 - protein, 9 aa, Homo Sapiens
QRQAQTQTS

SEQ ID NO: 1364667 - protein, 9 aa, Homo Sapiens
GYERIPVPC

SEQ ID NO: 1364668 - protein, 9 aa, Homo Sapiens
GILKTYSDS

SEQ ID NO: 1364669 - protein, 9 aa, Homo Sapiens
STPARSFLA

SEQ ID NO: 1364670 - protein, 9 aa, Homo Sapiens
LMEEVVVHA

SEQ ID NO: 1364671 - protein, 9 aa, Homo Sapiens
LEFIKMTFI

SEQ ID NO: 1364672 - protein, 9 aa, Homo Sapiens
AASRRASWP

SEQ ID NO: 1364673 - protein, 9 aa, Homo Sapiens
SGSLNEKSE

SEQ ID NO: 1364674 - protein, 9 aa, Homo Sapiens
LPHHLPEVC

SEQ ID NO: 1364675 - protein, 9 aa, Homo Sapiens
GLAGRGRPG

SEQ ID NO: 1364676 - protein, 9 aa, Homo Sapiens
FRNEGREGL

SEQ ID NO: 1364677 - protein, 9 aa, Homo Sapiens
CPLDSGSPE

SEQ ID NO: 1364678 - protein, 9 aa, Homo Sapiens
ELSCYVVVN

SEQ ID NO: 1364679 - protein, 9 aa, Homo Sapiens
VLKVAVDGS

SEQ ID NO: 1364680 - protein, 9 aa, Homo Sapiens
GRDPAAAFP

SEQ ID NO: 1364681 - protein, 9 aa, Homo Sapiens
NSAICNKWE

SEQ ID NO: 1364682 - protein, 9 aa, Homo Sapiens
PWTPSPSHS

SEQ ID NO: 1364683 - protein, 9 aa, Homo Sapiens
DSSFSISAP

SEQ ID NO: 1364684 - protein, 9 aa, Homo Sapiens
EHYSRKVFV

SEQ ID NO: 1364685 - protein, 9 aa, Homo Sapiens
WSRGRVSRP

SEQ ID NO: 1364686 - protein, 9 aa, Homo Sapiens
EDFARAEGW

SEQ ID NO: 1364687 - protein, 9 aa, Homo Sapiens
CMFLADLIE

SEQ ID NO: 1364688 - protein, 9 aa, Homo Sapiens
YLATSLFPR

SEQ ID NO: 1364689 - protein, 9 aa, Homo Sapiens
SIIDSTVTM

SEQ ID NO: 1364690 - protein, 9 aa, Homo Sapiens
TCLPPPSLP

SEQ ID NO: 1364691 - protein, 9 aa, Homo Sapiens
MTGFYVGWA

SEQ ID NO: 1364692 - protein, 9 aa, Homo Sapiens
TNLGDREVT

SEQ ID NO: 1364693 - protein, 9 aa, Homo Sapiens
AKLRKDIHQ

SEQ ID NO: 1364694 - protein, 9 aa, Homo Sapiens
SSPRLRFCA

SEQ ID NO: 1364695 - protein, 9 aa, Homo Sapiens
IHIQLADGL

SEQ ID NO: 1364696 - protein, 9 aa, Homo Sapiens
HQAQDKLQG

SEQ ID NO: 1364697 - protein, 9 aa, Homo Sapiens
RNSPVRDEY

SEQ ID NO: 1364698 - protein, 9 aa, Homo Sapiens
RLSDSRIAL

SEQ ID NO: 1364699 - protein, 9 aa, Homo Sapiens
KLILVMLEI

SEQ ID NO: 1364700 - protein, 9 aa, Homo Sapiens
DRFKHINNS

SEQ ID NO: 1364701 - protein, 9 aa, Homo Sapiens
EQEKRREME

SEQ ID NO: 1364702 - protein, 9 aa, Homo Sapiens
TILHQRGQH

SEQ ID NO: 1364703 - protein, 9 aa, Homo Sapiens
SHTRTHLKE

SEQ ID NO: 1364704 - protein, 9 aa, Homo Sapiens
EEPMTGFYV

SEQ ID NO: 1364705 - protein, 9 aa, Homo Sapiens
RFDMNDATG

SEQ ID NO: 1364706 - protein, 9 aa, Homo Sapiens
LEAFLAAVP

SEQ ID NO: 1364707 - protein, 9 aa, Homo Sapiens
VDTIAKRRV

SEQ ID NO: 1364708 - protein, 9 aa, Homo Sapiens
VSSPERPKR

SEQ ID NO: 1364709 - protein, 9 aa, Homo Sapiens
LLLVLDEDL

SEQ ID NO: 1364710 - protein, 9 aa, Homo Sapiens
MCSMANCLL

SEQ ID NO: 1364711 - protein, 9 aa, Homo Sapiens
ASFKVDSSA

SEQ ID NO: 1364712 - protein, 9 aa, Homo Sapiens
SHRARPFTC

SEQ ID NO: 1364713 - protein, 9 aa, Homo Sapiens
STTRRAVLV

SEQ ID NO: 1364714 - protein, 9 aa, Homo Sapiens
EVAELYEES

SEQ ID NO: 1364715 - protein, 9 aa, Homo Sapiens
ARGLRVLTA

SEQ ID NO: 1364716 - protein, 9 aa, Homo Sapiens
LPTDLDVAG

SEQ ID NO: 1364717 - protein, 9 aa, Homo Sapiens
DVHNHRWRS

SEQ ID NO: 1364718 - protein, 9 aa, Homo Sapiens
LLPSLAYEK

SEQ ID NO: 1364719 - protein, 9 aa, Homo Sapiens
PPLQDGSLD

SEQ ID NO: 1364720 - protein, 9 aa, Homo Sapiens
SDNCTILEW

SEQ ID NO: 1364721 - protein, 9 aa, Homo Sapiens
AEEATVECG

SEQ ID NO: 1364722 - protein, 9 aa, Homo Sapiens
YQCAKSFNS

SEQ ID NO: 1364723 - protein, 9 aa, Homo Sapiens
VPDEIDIAD

SEQ ID NO: 1364724 - protein, 9 aa, Homo Sapiens
DQKASSRGT

SEQ ID NO: 1364725 - protein, 9 aa, Homo Sapiens
QPEMSIKYG

SEQ ID NO: 1364726 - protein, 9 aa, Homo Sapiens
GVAGPSRGP

SEQ ID NO: 1364727 - protein, 9 aa, Homo Sapiens
SHLVVYLGT

SEQ ID NO: 1364728 - protein, 9 aa, Homo Sapiens
LESYKKHIL

SEQ ID NO: 1364729 - protein, 9 aa, Homo Sapiens
EPAPSLPCP

SEQ ID NO: 1364730 - protein, 9 aa, Homo Sapiens
KVYHFYCEL

SEQ ID NO: 1364731 - protein, 9 aa, Homo Sapiens
PGEGRGYPR

SEQ ID NO: 1364732 - protein, 9 aa, Homo Sapiens
YVETKSPHE

SEQ ID NO: 1364733 - protein, 9 aa, Homo Sapiens
ICNKWEIVS

SEQ ID NO: 1364734 - protein, 9 aa, Homo Sapiens
PCLILSLDL

SEQ ID NO: 1364735 - protein, 9 aa, Homo Sapiens
PGFSHWHTS

SEQ ID NO: 1364736 - protein, 9 aa, Homo Sapiens
SETGGCCCW

SEQ ID NO: 1364737 - protein, 9 aa, Homo Sapiens
TVTHRMAPA

SEQ ID NO: 1364738 - protein, 9 aa, Homo Sapiens
RNLGSPLMS

SEQ ID NO: 1364739 - protein, 9 aa, Homo Sapiens
HSTRSGPFF

SEQ ID NO: 1364740 - protein, 9 aa, Homo Sapiens
AMMKLPFCK

SEQ ID NO: 1364741 - protein, 9 aa, Homo Sapiens
LEAEGAHHW

SEQ ID NO: 1364742 - protein, 9 aa, Homo Sapiens
GPRPASSAS

SEQ ID NO: 1364743 - protein, 9 aa, Homo Sapiens
VDEANGLIS

SEQ ID NO: 1364744 - protein, 9 aa, Homo Sapiens
RKSWGRWCW

SEQ ID NO: 1364745 - protein, 9 aa, Homo Sapiens
AHPESPGHP

SEQ ID NO: 1364746 - protein, 9 aa, Homo Sapiens
LTNIPAIQE

SEQ ID NO: 1364747 - protein, 9 aa, Homo Sapiens
EPQGLQDSS

SEQ ID NO: 1364748 - protein, 9 aa, Homo Sapiens
TGKDQCPAS

SEQ ID NO: 1364749 - protein, 9 aa, Homo Sapiens
SPAINNSDF

SEQ ID NO: 1364750 - protein, 9 aa, Homo Sapiens
IAPNSHFHV

SEQ ID NO: 1364751 - protein, 9 aa, Homo Sapiens
NFEFIDLRF

SEQ ID NO: 1364752 - protein, 9 aa, Homo Sapiens
KRNVTERKD

SEQ ID NO: 1364753 - protein, 9 aa, Homo Sapiens
RPLCTGHPE

SEQ ID NO: 1364754 - protein, 9 aa, Homo Sapiens
PWPPGPVAA

SEQ ID NO: 1364755 - protein, 9 aa, Homo Sapiens
QHSPVPCHL

SEQ ID NO: 1364756 - protein, 9 aa, Homo Sapiens
VAQCKTCAS

SEQ ID NO: 1364757 - protein, 9 aa, Homo Sapiens
NRSSLYRRE

SEQ ID NO: 1364758 - protein, 9 aa, Homo Sapiens
KRKSLQLPA

SEQ ID NO: 1364759 - protein, 9 aa, Homo Sapiens
PAINNSDFW

SEQ ID NO: 1364760 - protein, 9 aa, Homo Sapiens
GQKPHKCND

SEQ ID NO: 1364761 - protein, 9 aa, Homo Sapiens
LSPRWTLCG

SEQ ID NO: 1364762 - protein, 9 aa, Homo Sapiens
LDMSLCVVR

SEQ ID NO: 1364763 - protein, 9 aa, Homo Sapiens
PAIQEKLHQ

SEQ ID NO: 1364764 - protein, 9 aa, Homo Sapiens
RQWVITLAL

SEQ ID NO: 1364765 - protein, 9 aa, Homo Sapiens
CVVRYVASS

SEQ ID NO: 1364766 - protein, 9 aa, Homo Sapiens
RSGRFLGCA

SEQ ID NO: 1364767 - protein, 9 aa, Homo Sapiens
EIYPKMHHI

SEQ ID NO: 1364768 - protein, 9 aa, Homo Sapiens
GLVLLTSGH

SEQ ID NO: 1364769 - protein, 9 aa, Homo Sapiens
DCLQAFWDM

SEQ ID NO: 1364770 - protein, 9 aa, Homo Sapiens
SFKQGNFPR

SEQ ID NO: 1364771 - protein, 9 aa, Homo Sapiens
TALSWPDQH

SEQ ID NO: 1364772 - protein, 9 aa, Homo Sapiens
FFETKSLAL

SEQ ID NO: 1364773 - protein, 9 aa, Homo Sapiens
PAKSMLKDF

SEQ ID NO: 1364774 - protein, 9 aa, Homo Sapiens
YSGHLKGAF

SEQ ID NO: 1364775 - protein, 9 aa, Homo Sapiens
LRRMESMHK

SEQ ID NO: 1364776 - protein, 9 aa, Homo Sapiens
VTITMYMKG

SEQ ID NO: 1364777 - protein, 9 aa, Homo Sapiens
VRSLRCSRE

SEQ ID NO: 1364778 - protein, 9 aa, Homo Sapiens
VQQCVLLLV

SEQ ID NO: 1364779 - protein, 9 aa, Homo Sapiens
EQHYVRKVL

SEQ ID NO: 1364780 - protein, 9 aa, Homo Sapiens
LDCSKGSLV

SEQ ID NO: 1364781 - protein, 9 aa, Homo Sapiens
LPLTFTDSA

SEQ ID NO: 1364782 - protein, 9 aa, Homo Sapiens
KGVILFSIL

SEQ ID NO: 1364783 - protein, 9 aa, Homo Sapiens
DFGTVKLFD

SEQ ID NO: 1364784 - protein, 9 aa, Homo Sapiens
QNLNAKTLS

SEQ ID NO: 1364785 - protein, 9 aa, Homo Sapiens
DVTVMEPAH

SEQ ID NO: 1364786 - protein, 9 aa, Homo Sapiens
DAAESCIQD

SEQ ID NO: 1364787 - protein, 9 aa, Homo Sapiens
NPAVHFPQV

SEQ ID NO: 1364788 - protein, 9 aa, Homo Sapiens
RPFGREEEP

SEQ ID NO: 1364789 - protein, 9 aa, Homo Sapiens
VKGCAERFV

SEQ ID NO: 1364790 - protein, 9 aa, Homo Sapiens
KRPSHLAGH

SEQ ID NO: 1364791 - protein, 9 aa, Homo Sapiens
PSTTRRAVL

SEQ ID NO: 1364792 - protein, 9 aa, Homo Sapiens
ETLQQFDKK

SEQ ID NO: 1364793 - protein, 9 aa, Homo Sapiens
ANTVLRQLD

SEQ ID NO: 1364794 - protein, 9 aa, Homo Sapiens
LSSEALVCL

SEQ ID NO: 1364795 - protein, 9 aa, Homo Sapiens
LFRTEPTAW

SEQ ID NO: 1364796 - protein, 9 aa, Homo Sapiens
AVGVRPYRA

SEQ ID NO: 1364797 - protein, 9 aa, Homo Sapiens
LGIEDCSVS

SEQ ID NO: 1364798 - protein, 9 aa, Homo Sapiens
QQSCCVSVS

SEQ ID NO: 1364799 - protein, 9 aa, Homo Sapiens
PPPAAPAGP

SEQ ID NO: 1364800 - protein, 9 aa, Homo Sapiens
ENLQPEGRS

SEQ ID NO: 1364801 - protein, 9 aa, Homo Sapiens
LEPVVAIYV

SEQ ID NO: 1364802 - protein, 9 aa, Homo Sapiens
ARIAERNLS

SEQ ID NO: 1364803 - protein, 9 aa, Homo Sapiens
QLQEKLTGA

SEQ ID NO: 1364804 - protein, 9 aa, Homo Sapiens
CEKYVETKS

SEQ ID NO: 1364805 - protein, 9 aa, Homo Sapiens
VARFNGLRF

SEQ ID NO: 1364806 - protein, 9 aa, Homo Sapiens
TLPYTATTA

SEQ ID NO: 1364807 - protein, 9 aa, Homo Sapiens
RSEGNTIAN

SEQ ID NO: 1364808 - protein, 9 aa, Homo Sapiens
CRDKAGMAT

SEQ ID NO: 1364809 - protein, 9 aa, Homo Sapiens
KQFDPVEIK

SEQ ID NO: 1364810 - protein, 9 aa, Homo Sapiens
TLGVCTFLQ

SEQ ID NO: 1364811 - protein, 9 aa, Homo Sapiens
TSDTPKVSS

SEQ ID NO: 1364812 - protein, 9 aa, Homo Sapiens
MCDVTVVVG

SEQ ID NO: 1364813 - protein, 9 aa, Homo Sapiens
NLANRGHAE

SEQ ID NO: 1364814 - protein, 9 aa, Homo Sapiens
HCLLSTSAS

SEQ ID NO: 1364815 - protein, 9 aa, Homo Sapiens
VATLSPGEA

SEQ ID NO: 1364816 - protein, 9 aa, Homo Sapiens
LPTPFPETQ

SEQ ID NO: 1364817 - protein, 9 aa, Homo Sapiens
LLRNITWTL

SEQ ID NO: 1364818 - protein, 9 aa, Homo Sapiens
CASLSLLIA

SEQ ID NO: 1364819 - protein, 9 aa, Homo Sapiens
KVPAKSMLK

SEQ ID NO: 1364820 - protein, 9 aa, Homo Sapiens
MSFAAGVIR

SEQ ID NO: 1364821 - protein, 9 aa, Homo Sapiens
LNHDQMQKV

SEQ ID NO: 1364822 - protein, 9 aa, Homo Sapiens
GEPGFFSSM

SEQ ID NO: 1364823 - protein, 9 aa, Homo Sapiens
KVVEEEQKN

SEQ ID NO: 1364824 - protein, 9 aa, Homo Sapiens
QGTLSLQRL

SEQ ID NO: 1364825 - protein, 9 aa, Homo Sapiens
SYYVSEDLN

SEQ ID NO: 1364826 - protein, 9 aa, Homo Sapiens
TLVVLSGVP

SEQ ID NO: 1364827 - protein, 9 aa, Homo Sapiens
GQTWGPRTP

SEQ ID NO: 1364828 - protein, 9 aa, Homo Sapiens
AADTLPYTA

SEQ ID NO: 1364829 - protein, 9 aa, Homo Sapiens
TLQASMREP

SEQ ID NO: 1364830 - protein, 9 aa, Homo Sapiens
TDNCLCYFE

SEQ ID NO: 1364831 - protein, 9 aa, Homo Sapiens
SGVLGIEDC

SEQ ID NO: 1364832 - protein, 9 aa, Homo Sapiens
PSASTKITA

SEQ ID NO: 1364833 - protein, 9 aa, Homo Sapiens
DYQPPAKKQ

SEQ ID NO: 1364834 - protein, 9 aa, Homo Sapiens
LKKYNVENQ

SEQ ID NO: 1364835 - protein, 9 aa, Homo Sapiens
YSESGVISS

SEQ ID NO: 1364836 - protein, 9 aa, Homo Sapiens
RPNPDGVET

SEQ ID NO: 1364837 - protein, 9 aa, Homo Sapiens
FLSKKGCSK

SEQ ID NO: 1364838 - protein, 9 aa, Homo Sapiens
AGALRDSPS

SEQ ID NO: 1364839 - protein, 9 aa, Homo Sapiens
AESGSSDTE

SEQ ID NO: 1364840 - protein, 9 aa, Homo Sapiens
TGMSATTTA

SEQ ID NO: 1364841 - protein, 9 aa, Homo Sapiens
TPCVHGYTR

SEQ ID NO: 1364842 - protein, 9 aa, Homo Sapiens
LKAVFDEAL

SEQ ID NO: 1364843 - protein, 9 aa, Homo Sapiens
TVAMDRPLR

SEQ ID NO: 1364844 - protein, 9 aa, Homo Sapiens
SPRASQTEH

SEQ ID NO: 1364845 - protein, 9 aa, Homo Sapiens
LIFAALQCH

SEQ ID NO: 1364846 - protein, 9 aa, Homo Sapiens
KVTSEVTRL

SEQ ID NO: 1364847 - protein, 9 aa, Homo Sapiens
VKRNVTERK

SEQ ID NO: 1364848 - protein, 9 aa, Homo Sapiens
KQDGKNFTQ

SEQ ID NO: 1364849 - protein, 9 aa, Homo Sapiens
QKTLSQRSA

SEQ ID NO: 1364850 - protein, 9 aa, Homo Sapiens
TNNPRFDEV

SEQ ID NO: 1364851 - protein, 9 aa, Homo Sapiens
LRPQCPAIP

SEQ ID NO: 1364852 - protein, 9 aa, Homo Sapiens
DEDDAAFCL

SEQ ID NO: 1364853 - protein, 9 aa, Homo Sapiens
SGWSQSVVG

SEQ ID NO: 1364854 - protein, 9 aa, Homo Sapiens
RWEPVPRVQ

SEQ ID NO: 1364855 - protein, 9 aa, Homo Sapiens
ACYYYLLPG

SEQ ID NO: 1364856 - protein, 9 aa, Homo Sapiens
KTRMLYHSG

SEQ ID NO: 1364857 - protein, 9 aa, Homo Sapiens
LKSLKILQI

SEQ ID NO: 1364858 - protein, 9 aa, Homo Sapiens
EPFLLVRYS

SEQ ID NO: 1364859 - protein, 9 aa, Homo Sapiens
EQDAHPESP

SEQ ID NO: 1364860 - protein, 9 aa, Homo Sapiens
DCFISYGIE

SEQ ID NO: 1364861 - protein, 9 aa, Homo Sapiens
IPKSVQSRV

SEQ ID NO: 1364862 - protein, 9 aa, Homo Sapiens
GLMEEVVVH

SEQ ID NO: 1364863 - protein, 9 aa, Homo Sapiens
VRRHQCEEV

SEQ ID NO: 1364864 - protein, 9 aa, Homo Sapiens
QVADQEEVS

SEQ ID NO: 1364865 - protein, 9 aa, Homo Sapiens
HRAASALRT

SEQ ID NO: 1364866 - protein, 9 aa, Homo Sapiens
PWEGGNRED

SEQ ID NO: 1364867 - protein, 9 aa, Homo Sapiens
AHLHWHSGD

SEQ ID NO: 1364868 - protein, 9 aa, Homo Sapiens
ALPHHLPEV

SEQ ID NO: 1364869 - protein, 9 aa, Homo Sapiens
GEPNAHNSK

SEQ ID NO: 1364870 - protein, 9 aa, Homo Sapiens
MLREAAIGT

SEQ ID NO: 1364871 - protein, 9 aa, Homo Sapiens
TVPGGQFDS

SEQ ID NO: 1364872 - protein, 9 aa, Homo Sapiens
YGQKQILKR

SEQ ID NO: 1364873 - protein, 9 aa, Homo Sapiens
EQKTLSQRS

SEQ ID NO: 1364874 - protein, 9 aa, Homo Sapiens
FQEEPMTGF

SEQ ID NO: 1364875 - protein, 9 aa, Homo Sapiens
GSCPHGSTA

SEQ ID NO: 1364876 - protein, 9 aa, Homo Sapiens
AADMTCHGE

SEQ ID NO: 1364877 - protein, 9 aa, Homo Sapiens
QMHDEGVLI

SEQ ID NO: 1364878 - protein, 9 aa, Homo Sapiens
TPEDHEKLG

SEQ ID NO: 1364879 - protein, 9 aa, Homo Sapiens
EQGMGPEPA

SEQ ID NO: 1364880 - protein, 9 aa, Homo Sapiens
CSLCGATPS

SEQ ID NO: 1364881 - protein, 9 aa, Homo Sapiens
PGMHLFQSE

SEQ ID NO: 1364882 - protein, 9 aa, Homo Sapiens
IQAEGYPTY

SEQ ID NO: 1364883 - protein, 9 aa, Homo Sapiens
EKDLWEHIE

SEQ ID NO: 1364884 - protein, 9 aa, Homo Sapiens
GNAPLGTHP

SEQ ID NO: 1364885 - protein, 9 aa, Homo Sapiens
CLFVNLACA

SEQ ID NO: 1364886 - protein, 9 aa, Homo Sapiens
HALSRLHLV

SEQ ID NO: 1364887 - protein, 9 aa, Homo Sapiens
LEGDGLTSQ

SEQ ID NO: 1364888 - protein, 9 aa, Homo Sapiens
ICELSCYVV

SEQ ID NO: 1364889 - protein, 9 aa, Homo Sapiens
AYGKEGVKT

SEQ ID NO: 1364890 - protein, 9 aa, Homo Sapiens
TASGDKTIH

SEQ ID NO: 1364891 - protein, 9 aa, Homo Sapiens
WSQRHLPKL

SEQ ID NO: 1364892 - protein, 9 aa, Homo Sapiens
MAEVSTPGT

SEQ ID NO: 1364893 - protein, 9 aa, Homo Sapiens
ATAQIQRPI

SEQ ID NO: 1364894 - protein, 9 aa, Homo Sapiens
VPGGQFDSF

SEQ ID NO: 1364895 - protein, 9 aa, Homo Sapiens
HGADVLTCL

SEQ ID NO: 1364896 - protein, 9 aa, Homo Sapiens
ATPSAPLDL

SEQ ID NO: 1364897 - protein, 9 aa, Homo Sapiens
GCVPSNFVA

SEQ ID NO: 1364898 - protein, 9 aa, Homo Sapiens
ASYAPVMRT

SEQ ID NO: 1364899 - protein, 9 aa, Homo Sapiens
EIQNNQKKQ

SEQ ID NO: 1364900 - protein, 9 aa, Homo Sapiens
HPEPGVEEP

SEQ ID NO: 1364901 - protein, 9 aa, Homo Sapiens
FLKRDMSIH

SEQ ID NO: 1364902 - protein, 9 aa, Homo Sapiens
CLLSTSASV

SEQ ID NO: 1364903 - protein, 9 aa, Homo Sapiens
SQRRLRHST

SEQ ID NO: 1364904 - protein, 9 aa, Homo Sapiens
SAHLPGQDT

SEQ ID NO: 1364905 - protein, 9 aa, Homo Sapiens
PYHFQGPMH

SEQ ID NO: 1364906 - protein, 9 aa, Homo Sapiens
TPQLEGLMK

SEQ ID NO: 1364907 - protein, 9 aa, Homo Sapiens
GGACFIVSG

SEQ ID NO: 1364908 - protein, 9 aa, Homo Sapiens
PSKKKLKLA

SEQ ID NO: 1364909 - protein, 9 aa, Homo Sapiens
VCKRAGGPP

SEQ ID NO: 1364910 - protein, 9 aa, Homo Sapiens
RRRESYSTN

SEQ ID NO: 1364911 - protein, 9 aa, Homo Sapiens
VTRRSQQPQ

SEQ ID NO: 1364912 - protein, 9 aa, Homo Sapiens
VSFNPDCER

SEQ ID NO: 1364913 - protein, 9 aa, Homo Sapiens
PKDDPAIAL

SEQ ID NO: 1364914 - protein, 9 aa, Homo Sapiens
VANDQDLQG

SEQ ID NO: 1364915 - protein, 9 aa, Homo Sapiens
FGTSILSYF

SEQ ID NO: 1364916 - protein, 9 aa, Homo Sapiens
VDLEAFLAA

SEQ ID NO: 1364917 - protein, 9 aa, Homo Sapiens
LFVAIAITF

SEQ ID NO: 1364918 - protein, 9 aa, Homo Sapiens
VVGPACAVV

SEQ ID NO: 1364919 - protein, 9 aa, Homo Sapiens
RITEELLGK

SEQ ID NO: 1364920 - protein, 9 aa, Homo Sapiens
AVPAFSHYM

SEQ ID NO: 1364921 - protein, 9 aa, Homo Sapiens
SLNISGLLV

SEQ ID NO: 1364922 - protein, 9 aa, Homo Sapiens
YFSCHSHTA

SEQ ID NO: 1364923 - protein, 9 aa, Homo Sapiens
VPQVILHVC

SEQ ID NO: 1364924 - protein, 9 aa, Homo Sapiens
KEKAFTHNE

SEQ ID NO: 1364925 - protein, 9 aa, Homo Sapiens
KKRFRNAEV

SEQ ID NO: 1364926 - protein, 9 aa, Homo Sapiens
LRNFEEVCT

SEQ ID NO: 1364927 - protein, 9 aa, Homo Sapiens
KSPHEAAYD

SEQ ID NO: 1364928 - protein, 9 aa, Homo Sapiens
DPHRGTPSL

SEQ ID NO: 1364929 - protein, 9 aa, Homo Sapiens
IWFQNRGMK

SEQ ID NO: 1364930 - protein, 9 aa, Homo Sapiens
RCRRRRCFV

SEQ ID NO: 1364931 - protein, 9 aa, Homo Sapiens
GGIMYAKRL

SEQ ID NO: 1364932 - protein, 9 aa, Homo Sapiens
EALLTIFHP

SEQ ID NO: 1364933 - protein, 9 aa, Homo Sapiens
QPKLQRQAQ

SEQ ID NO: 1364934 - protein, 9 aa, Homo Sapiens
SWEVIFGYI

SEQ ID NO: 1364935 - protein, 9 aa, Homo Sapiens
TQLINSILL

SEQ ID NO: 1364936 - protein, 9 aa, Homo Sapiens
GVKAPPGLH

SEQ ID NO: 1364937 - protein, 9 aa, Homo Sapiens
TQDVLKKTR

SEQ ID NO: 1364938 - protein, 9 aa, Homo Sapiens
RAGGPPGNE

SEQ ID NO: 1364939 - protein, 9 aa, Homo Sapiens
DGHHHGQHT

SEQ ID NO: 1364940 - protein, 9 aa, Homo Sapiens
TDISILPLQ

SEQ ID NO: 1364941 - protein, 9 aa, Homo Sapiens
TMYRRRSQR

SEQ ID NO: 1364942 - protein, 9 aa, Homo Sapiens
TKQIRDRVM

SEQ ID NO: 1364943 - protein, 9 aa, Homo Sapiens
HRRPWEGGN

SEQ ID NO: 1364944 - protein, 9 aa, Homo Sapiens
AIQAALSLY

SEQ ID NO: 1364945 - protein, 9 aa, Homo Sapiens
PICAVCRES

SEQ ID NO: 1364946 - protein, 9 aa, Homo Sapiens
KPKTLNNHE

SEQ ID NO: 1364947 - protein, 9 aa, Homo Sapiens
AKIEAEPWQ

SEQ ID NO: 1364948 - protein, 9 aa, Homo Sapiens
FFLATLSCS

SEQ ID NO: 1364949 - protein, 9 aa, Homo Sapiens
APADLCLPA

SEQ ID NO: 1364950 - protein, 9 aa, Homo Sapiens
RITKESETR

SEQ ID NO: 1364951 - protein, 9 aa, Homo Sapiens
SLQPLPTRF

SEQ ID NO: 1364952 - protein, 9 aa, Homo Sapiens
RPSSDRLKE

SEQ ID NO: 1364953 - protein, 9 aa, Homo Sapiens
MLQKRVENY

SEQ ID NO: 1364954 - protein, 9 aa, Homo Sapiens
GEKHLFVDV

SEQ ID NO: 1364955 - protein, 9 aa, Homo Sapiens
LNSVSKNPV

SEQ ID NO: 1364956 - protein, 9 aa, Homo Sapiens
VANENRLSM

SEQ ID NO: 1364957 - protein, 9 aa, Homo Sapiens
TMHSWYEFG

SEQ ID NO: 1364958 - protein, 9 aa, Homo Sapiens
NQIIVNTVN

SEQ ID NO: 1364959 - protein, 9 aa, Homo Sapiens
SMAHKVATP

SEQ ID NO: 1364960 - protein, 9 aa, Homo Sapiens
GLGVTGRIV

SEQ ID NO: 1364961 - protein, 9 aa, Homo Sapiens
TPRLCQTDP

SEQ ID NO: 1364962 - protein, 9 aa, Homo Sapiens
PCVHGYTRV

SEQ ID NO: 1364963 - protein, 9 aa, Homo Sapiens
TGVWLCLVG

SEQ ID NO: 1364964 - protein, 9 aa, Homo Sapiens
SPPQQTPNG

SEQ ID NO: 1364965 - protein, 9 aa, Homo Sapiens
QEQLRDREK

SEQ ID NO: 1364966 - protein, 9 aa, Homo Sapiens
HKLPQCLLS

SEQ ID NO: 1364967 - protein, 9 aa, Homo Sapiens
SAVFDPFWD

SEQ ID NO: 1364968 - protein, 9 aa, Homo Sapiens
HDEGVLINS

SEQ ID NO: 1364969 - protein, 9 aa, Homo Sapiens
SPTLPITLL

SEQ ID NO: 1364970 - protein, 9 aa, Homo Sapiens
RHGLSPRWT

SEQ ID NO: 1364971 - protein, 9 aa, Homo Sapiens
QQIWHGPVQ

SEQ ID NO: 1364972 - protein, 9 aa, Homo Sapiens
DMNDATGDL

SEQ ID NO: 1364973 - protein, 9 aa, Homo Sapiens
FPNPEQGLA

SEQ ID NO: 1364974 - protein, 9 aa, Homo Sapiens
SEDLNDKKG

SEQ ID NO: 1364975 - protein, 9 aa, Homo Sapiens
TPPQPQSVL

SEQ ID NO: 1364976 - protein, 9 aa, Homo Sapiens
LQRVGVYGQ

SEQ ID NO: 1364977 - protein, 9 aa, Homo Sapiens
TQPCTSVPS

SEQ ID NO: 1364978 - protein, 9 aa, Homo Sapiens
AIVTLGLLL

SEQ ID NO: 1364979 - protein, 9 aa, Homo Sapiens
DVKMAIQQI

SEQ ID NO: 1364980 - protein, 9 aa, Homo Sapiens
LSQRSAGEL

SEQ ID NO: 1364981 - protein, 9 aa, Homo Sapiens
VIHSGGALL

SEQ ID NO: 1364982 - protein, 9 aa, Homo Sapiens
PCHLSTVVA

SEQ ID NO: 1364983 - protein, 9 aa, Homo Sapiens
THGPLRACL

SEQ ID NO: 1364984 - protein, 9 aa, Homo Sapiens
YSEHNYCRL

SEQ ID NO: 1364985 - protein, 9 aa, Homo Sapiens
PGHPGSCPH

SEQ ID NO: 1364986 - protein, 9 aa, Homo Sapiens
VACYYYLLP

SEQ ID NO: 1364987 - protein, 9 aa, Homo Sapiens
HRGTPSLIM

SEQ ID NO: 1364988 - protein, 9 aa, Homo Sapiens
PVDQLQQDG

SEQ ID NO: 1364989 - protein, 9 aa, Homo Sapiens
LQERLDCIN

SEQ ID NO: 1364990 - protein, 9 aa, Homo Sapiens
QTWGPRTPR

SEQ ID NO: 1364991 - protein, 9 aa, Homo Sapiens
GRTCTVRTA

SEQ ID NO: 1364992 - protein, 9 aa, Homo Sapiens
SNSSKPRPS

SEQ ID NO: 1364993 - protein, 9 aa, Homo Sapiens
KAFTHNECI

SEQ ID NO: 1364994 - protein, 9 aa, Homo Sapiens
RRSQQPQPH

SEQ ID NO: 1364995 - protein, 9 aa, Homo Sapiens
PSSTSSSSL

SEQ ID NO: 1364996 - protein, 9 aa, Homo Sapiens
STITMSSPR

SEQ ID NO: 1364997 - protein, 9 aa, Homo Sapiens
PRGGFGGRR

SEQ ID NO: 1364998 - protein, 9 aa, Homo Sapiens
CSQAVANGP

SEQ ID NO: 1364999 - protein, 9 aa, Homo Sapiens
LKEAADMTC

SEQ ID NO: 1365000 - protein, 9 aa, Homo Sapiens
NKVPVEKQV

SEQ ID NO: 1365001 - protein, 9 aa, Homo Sapiens
ENLANRGHA

SEQ ID NO: 1365002 - protein, 9 aa, Homo Sapiens
QSVDLLGLL

SEQ ID NO: 1365003 - protein, 9 aa, Homo Sapiens
TGHMEEVER

SEQ ID NO: 1365004 - protein, 9 aa, Homo Sapiens
CFFRYMKLA

SEQ ID NO: 1365005 - protein, 9 aa, Homo Sapiens
EMSVENCVY

SEQ ID NO: 1365006 - protein, 9 aa, Homo Sapiens
IGHLHLAKQ

SEQ ID NO: 1365007 - protein, 9 aa, Homo Sapiens
WKGRAPHGP

SEQ ID NO: 1365008 - protein, 9 aa, Homo Sapiens
AMDRPLRIG

SEQ ID NO: 1365009 - protein, 9 aa, Homo Sapiens
SVVLQHEIE

SEQ ID NO: 1365010 - protein, 9 aa, Homo Sapiens
IVIGLTLTT

SEQ ID NO: 1365011 - protein, 9 aa, Homo Sapiens
GDGHHSVST

SEQ ID NO: 1365012 - protein, 9 aa, Homo Sapiens
QDMKVFGVD

SEQ ID NO: 1365013 - protein, 9 aa, Homo Sapiens
GTSRPSHYR

SEQ ID NO: 1365014 - protein, 9 aa, Homo Sapiens
LAPGRGAAV

SEQ ID NO: 1365015 - protein, 9 aa, Homo Sapiens
YSFKQGNFP

SEQ ID NO: 1365016 - protein, 9 aa, Homo Sapiens
EERIRHSQR

SEQ ID NO: 1365017 - protein, 9 aa, Homo Sapiens
GSGPKTPCV

SEQ ID NO: 1365018 - protein, 9 aa, Homo Sapiens
ICAVCRESR

SEQ ID NO: 1365019 - protein, 9 aa, Homo Sapiens
ASSPTSCSG

SEQ ID NO: 1365020 - protein, 9 aa, Homo Sapiens
FRHLDLLLV

SEQ ID NO: 1365021 - protein, 9 aa, Homo Sapiens
SLDGGAIYE

SEQ ID NO: 1365022 - protein, 9 aa, Homo Sapiens
AYFNTPAAE

SEQ ID NO: 1365023 - protein, 9 aa, Homo Sapiens
KDGKKRERS

SEQ ID NO: 1365024 - protein, 9 aa, Homo Sapiens
LTACFEKTH

SEQ ID NO: 1365025 - protein, 9 aa, Homo Sapiens
FKDGYESDA

SEQ ID NO: 1365026 - protein, 9 aa, Homo Sapiens
DWARKVQRR

SEQ ID NO: 1365027 - protein, 9 aa, Homo Sapiens
MGVGSGLCK

SEQ ID NO: 1365028 - protein, 9 aa, Homo Sapiens
ANGLISMYS

SEQ ID NO: 1365029 - protein, 9 aa, Homo Sapiens
IILHQKREV

SEQ ID NO: 1365030 - protein, 9 aa, Homo Sapiens
VCSLCGATP

SEQ ID NO: 1365031 - protein, 9 aa, Homo Sapiens
LASMPFSTT

SEQ ID NO: 1365032 - protein, 9 aa, Homo Sapiens
AGMAPVGPV

SEQ ID NO: 1365033 - protein, 9 aa, Homo Sapiens
KPPAMRSGG

SEQ ID NO: 1365034 - protein, 9 aa, Homo Sapiens
SRLVASQIQ

SEQ ID NO: 1365035 - protein, 9 aa, Homo Sapiens
CVSASCRHG

SEQ ID NO: 1365036 - protein, 9 aa, Homo Sapiens
YRATLINEY

SEQ ID NO: 1365037 - protein, 9 aa, Homo Sapiens
EMRDKMRKR

SEQ ID NO: 1365038 - protein, 9 aa, Homo Sapiens
YAFTAISTV

SEQ ID NO: 1365039 - protein, 9 aa, Homo Sapiens
VYHFYCELP

SEQ ID NO: 1365040 - protein, 9 aa, Homo Sapiens
GGGPEQQAE

SEQ ID NO: 1365041 - protein, 9 aa, Homo Sapiens
VWGHPSSNG

SEQ ID NO: 1365042 - protein, 9 aa, Homo Sapiens
PCHLSDNCT

SEQ ID NO: 1365043 - protein, 9 aa, Homo Sapiens
CWKGMTLEQ

SEQ ID NO: 1365044 - protein, 9 aa, Homo Sapiens
GFGDWIDSV

SEQ ID NO: 1365045 - protein, 9 aa, Homo Sapiens
QPPGDCPRT

SEQ ID NO: 1365046 - protein, 9 aa, Homo Sapiens
VPQIIITRV

SEQ ID NO: 1365047 - protein, 9 aa, Homo Sapiens
RGQEQRSAQ

SEQ ID NO: 1365048 - protein, 9 aa, Homo Sapiens
CALAISEIL

SEQ ID NO: 1365049 - protein, 9 aa, Homo Sapiens
FAELTGLSP

SEQ ID NO: 1365050 - protein, 9 aa, Homo Sapiens
PPVTPLRVQ

SEQ ID NO: 1365051 - protein, 9 aa, Homo Sapiens
CKKNYSSNW

SEQ ID NO: 1365052 - protein, 9 aa, Homo Sapiens
NYRCTTSNF

SEQ ID NO: 1365053 - protein, 9 aa, Homo Sapiens
HCLLTSSET

SEQ ID NO: 1365054 - protein, 9 aa, Homo Sapiens
LATLSCSEI

SEQ ID NO: 1365055 - protein, 9 aa, Homo Sapiens
DMGKNVHEL

SEQ ID NO: 1365056 - protein, 9 aa, Homo Sapiens
ARRLDFQEE

SEQ ID NO: 1365057 - protein, 9 aa, Homo Sapiens
FEDGLAVVK

SEQ ID NO: 1365058 - protein, 9 aa, Homo Sapiens
KKDGKKRER

SEQ ID NO: 1365059 - protein, 9 aa, Homo Sapiens
FEELETSMD

SEQ ID NO: 1365060 - protein, 9 aa, Homo Sapiens
RGRACARPA

SEQ ID NO: 1365061 - protein, 9 aa, Homo Sapiens
KDDMGKNVH

SEQ ID NO: 1365062 - protein, 9 aa, Homo Sapiens
VQVGKEQHP

SEQ ID NO: 1365063 - protein, 9 aa, Homo Sapiens
GNYRCTTSN

SEQ ID NO: 1365064 - protein, 9 aa, Homo Sapiens
CCKPVYCMP

SEQ ID NO: 1365065 - protein, 9 aa, Homo Sapiens
NPNHRNCII

SEQ ID NO: 1365066 - protein, 9 aa, Homo Sapiens
HINNSARNI

SEQ ID NO: 1365067 - protein, 9 aa, Homo Sapiens
AGLAPSLVT

SEQ ID NO: 1365068 - protein, 9 aa, Homo Sapiens
EDRHPKHEG

SEQ ID NO: 1365069 - protein, 9 aa, Homo Sapiens
GMLNSRIIE

SEQ ID NO: 1365070 - protein, 9 aa, Homo Sapiens
KKDSEDEIQ

SEQ ID NO: 1365071 - protein, 9 aa, Homo Sapiens
ASCLIMGLV

SEQ ID NO: 1365072 - protein, 9 aa, Homo Sapiens
TLKQAFTCT

SEQ ID NO: 1365073 - protein, 9 aa, Homo Sapiens
RGAVKFGRM

SEQ ID NO: 1365074 - protein, 9 aa, Homo Sapiens
EKPIDLKDR

SEQ ID NO: 1365075 - protein, 9 aa, Homo Sapiens
RVQSVLLLG

SEQ ID NO: 1365076 - protein, 9 aa, Homo Sapiens
PMREVAEAA

SEQ ID NO: 1365077 - protein, 9 aa, Homo Sapiens
GPLELQPPG

SEQ ID NO: 1365078 - protein, 9 aa, Homo Sapiens
SSCKTWWTM

SEQ ID NO: 1365079 - protein, 9 aa, Homo Sapiens
HACFGLFGI

SEQ ID NO: 1365080 - protein, 9 aa, Homo Sapiens
LLKKYNVEN

SEQ ID NO: 1365081 - protein, 9 aa, Homo Sapiens
LPVSANDLE

SEQ ID NO: 1365082 - protein, 9 aa, Homo Sapiens
EAAGPTADE

SEQ ID NO: 1365083 - protein, 9 aa, Homo Sapiens
AHRESKVIQ

SEQ ID NO: 1365084 - protein, 9 aa, Homo Sapiens
GKAFKRPSH

SEQ ID NO: 1365085 - protein, 9 aa, Homo Sapiens
RIQSYRDCQ

SEQ ID NO: 1365086 - protein, 9 aa, Homo Sapiens
RSGPFFYIG

SEQ ID NO: 1365087 - protein, 9 aa, Homo Sapiens
DLFHVQESG

SEQ ID NO: 1365088 - protein, 9 aa, Homo Sapiens
PHIIKKQKE

SEQ ID NO: 1365089 - protein, 9 aa, Homo Sapiens
FQNRGMKWK

SEQ ID NO: 1365090 - protein, 9 aa, Homo Sapiens
RRMESMHKE

SEQ ID NO: 1365091 - protein, 9 aa, Homo Sapiens
SKLALPMEN

SEQ ID NO: 1365092 - protein, 9 aa, Homo Sapiens
VTSEVTRLL

SEQ ID NO: 1365093 - protein, 9 aa, Homo Sapiens
VGLHHLQVA

SEQ ID NO: 1365094 - protein, 9 aa, Homo Sapiens
IHPLSSLLL

SEQ ID NO: 1365095 - protein, 9 aa, Homo Sapiens
SEDEIQAPH

SEQ ID NO: 1365096 - protein, 9 aa, Homo Sapiens
WIDSVLAFS

SEQ ID NO: 1365097 - protein, 9 aa, Homo Sapiens
YDSIIVIYN

SEQ ID NO: 1365098 - protein, 9 aa, Homo Sapiens
ATQKEVSLT

SEQ ID NO: 1365099 - protein, 9 aa, Homo Sapiens
PGQPLVGRT

SEQ ID NO: 1365100 - protein, 9 aa, Homo Sapiens
FDRTTRLIL

SEQ ID NO: 1365101 - protein, 9 aa, Homo Sapiens
AMFDRTTRL

SEQ ID NO: 1365102 - protein, 9 aa, Homo Sapiens
GDPELQPTR

SEQ ID NO: 1365103 - protein, 9 aa, Homo Sapiens
NRGHAELET

SEQ ID NO: 1365104 - protein, 9 aa, Homo Sapiens
GLPLLGKAV

SEQ ID NO: 1365105 - protein, 9 aa, Homo Sapiens
RSTGKDQCP

SEQ ID NO: 1365106 - protein, 9 aa, Homo Sapiens
WSLWGPWNP

SEQ ID NO: 1365107 - protein, 9 aa, Homo Sapiens
VQAFKAACE

SEQ ID NO: 1365108 - protein, 9 aa, Homo Sapiens
QMEKNQEAR

SEQ ID NO: 1365109 - protein, 9 aa, Homo Sapiens
LRPWPRLSL

SEQ ID NO: 1365110 - protein, 9 aa, Homo Sapiens
GANAQGETK

SEQ ID NO: 1365111 - protein, 9 aa, Homo Sapiens
DRPLRIGKK

SEQ ID NO: 1365112 - protein, 9 aa, Homo Sapiens
LTVCLLFFS

SEQ ID NO: 1365113 - protein, 9 aa, Homo Sapiens
EKNQEARSL

SEQ ID NO: 1365114 - protein, 9 aa, Homo Sapiens
SRQNLHEIE

SEQ ID NO: 1365115 - protein, 9 aa, Homo Sapiens
TDYIGSRTF

SEQ ID NO: 1365116 - protein, 9 aa, Homo Sapiens
ALYNIGNVC

SEQ ID NO: 1365117 - protein, 9 aa, Homo Sapiens
LDLKGDGLA

SEQ ID NO: 1365118 - protein, 9 aa, Homo Sapiens
WPSSQGTLS

SEQ ID NO: 1365119 - protein, 9 aa, Homo Sapiens
YKKHILVSL

SEQ ID NO: 1365120 - protein, 9 aa, Homo Sapiens
PLPRTSASR

SEQ ID NO: 1365121 - protein, 9 aa, Homo Sapiens
AKALRTLRI

SEQ ID NO: 1365122 - protein, 9 aa, Homo Sapiens
VDASSCLGI

SEQ ID NO: 1365123 - protein, 9 aa, Homo Sapiens
TQKEVSLTL

SEQ ID NO: 1365124 - protein, 9 aa, Homo Sapiens
QVAMLPKLL

SEQ ID NO: 1365125 - protein, 9 aa, Homo Sapiens
KGNYRCTTS

SEQ ID NO: 1365126 - protein, 9 aa, Homo Sapiens
LWFYVAFFT

SEQ ID NO: 1365127 - protein, 9 aa, Homo Sapiens
CSPPSCSPC

SEQ ID NO: 1365128 - protein, 9 aa, Homo Sapiens
HSALGVGMP

SEQ ID NO: 1365129 - protein, 9 aa, Homo Sapiens
ELPAVVKLV

SEQ ID NO: 1365130 - protein, 9 aa, Homo Sapiens
KRPQPTRLV

SEQ ID NO: 1365131 - protein, 9 aa, Homo Sapiens
IDVCNAVDI

SEQ ID NO: 1365132 - protein, 9 aa, Homo Sapiens
QMPQQPQVP

SEQ ID NO: 1365133 - protein, 9 aa, Homo Sapiens
QRLGRTSCL

SEQ ID NO: 1365134 - protein, 9 aa, Homo Sapiens
HVESASSME

SEQ ID NO: 1365135 - protein, 9 aa, Homo Sapiens
PLLRWSRGR

SEQ ID NO: 1365136 - protein, 9 aa, Homo Sapiens
RMRGTAATG

SEQ ID NO: 1365137 - protein, 9 aa, Homo Sapiens
DVCNAVDIK

SEQ ID NO: 1365138 - protein, 9 aa, Homo Sapiens
PYRQKMHPQ

SEQ ID NO: 1365139 - protein, 9 aa, Homo Sapiens
QVDVKMAIQ

SEQ ID NO: 1365140 - protein, 9 aa, Homo Sapiens
NPMVNAGAS

SEQ ID NO: 1365141 - protein, 9 aa, Homo Sapiens
AEDEEGQTV

SEQ ID NO: 1365142 - protein, 9 aa, Homo Sapiens
THRMAPAIV

SEQ ID NO: 1365143 - protein, 9 aa, Homo Sapiens
DTRRPPAAA

SEQ ID NO: 1365144 - protein, 9 aa, Homo Sapiens
ILTYQCGIP

SEQ ID NO: 1365145 - protein, 9 aa, Homo Sapiens
ATEAGVEVT

SEQ ID NO: 1365146 - protein, 9 aa, Homo Sapiens
GCEEDNAGR

SEQ ID NO: 1365147 - protein, 9 aa, Homo Sapiens
LSAALVREV

SEQ ID NO: 1365148 - protein, 9 aa, Homo Sapiens
GSVEETREE

SEQ ID NO: 1365149 - protein, 9 aa, Homo Sapiens
YLGAFDKKA

SEQ ID NO: 1365150 - protein, 9 aa, Homo Sapiens
HLQFYAGMV

SEQ ID NO: 1365151 - protein, 9 aa, Homo Sapiens
GRFAMELEQ

SEQ ID NO: 1365152 - protein, 9 aa, Homo Sapiens
EGAHHWQEG

SEQ ID NO: 1365153 - protein, 9 aa, Homo Sapiens
SAQVDVGRD

SEQ ID NO: 1365154 - protein, 9 aa, Homo Sapiens
RVGCLHSQL

SEQ ID NO: 1365155 - protein, 9 aa, Homo Sapiens
RPGAENNPG

SEQ ID NO: 1365156 - protein, 9 aa, Homo Sapiens
CPFPFSLRG

SEQ ID NO: 1365157 - protein, 9 aa, Homo Sapiens
QLFPSKDQP

SEQ ID NO: 1365158 - protein, 9 aa, Homo Sapiens
LSGRGRWVT

SEQ ID NO: 1365159 - protein, 9 aa, Homo Sapiens
PDSEAAINS

SEQ ID NO: 1365160 - protein, 9 aa, Homo Sapiens
RSAVVDSMC

SEQ ID NO: 1365161 - protein, 9 aa, Homo Sapiens
SVLLCLDTV

SEQ ID NO: 1365162 - protein, 9 aa, Homo Sapiens
PDVSTYQYV

SEQ ID NO: 1365163 - protein, 9 aa, Homo Sapiens
AQEADAISL

SEQ ID NO: 1365164 - protein, 9 aa, Homo Sapiens
ASGTSVMRS

SEQ ID NO: 1365165 - protein, 9 aa, Homo Sapiens
LVVLVNDSD

SEQ ID NO: 1365166 - protein, 9 aa, Homo Sapiens
EPELPADTA

SEQ ID NO: 1365167 - protein, 9 aa, Homo Sapiens
PGIHGPPLR

SEQ ID NO: 1365168 - protein, 9 aa, Homo Sapiens
LCGLEVATL

SEQ ID NO: 1365169 - protein, 9 aa, Homo Sapiens
LVGRHCGNS

SEQ ID NO: 1365170 - protein, 9 aa, Homo Sapiens
RATSRDVNR

SEQ ID NO: 1365171 - protein, 9 aa, Homo Sapiens
NNHLSQNSH

SEQ ID NO: 1365172 - protein, 9 aa, Homo Sapiens
KTFILCQLE

SEQ ID NO: 1365173 - protein, 9 aa, Homo Sapiens
CFLSLPRTT

SEQ ID NO: 1365174 - protein, 9 aa, Homo Sapiens
LTVIGQGLV

SEQ ID NO: 1365175 - protein, 9 aa, Homo Sapiens
MCPDTPQLE

SEQ ID NO: 1365176 - protein, 9 aa, Homo Sapiens
YCTKATETF

SEQ ID NO: 1365177 - protein, 9 aa, Homo Sapiens
GRTSCLPPF

SEQ ID NO: 1365178 - protein, 9 aa, Homo Sapiens
GNYPSNMDR

SEQ ID NO: 1365179 - protein, 9 aa, Homo Sapiens
MHFLTAVNL

SEQ ID NO: 1365180 - protein, 9 aa, Homo Sapiens
PFRRRAAGG

SEQ ID NO: 1365181 - protein, 9 aa, Homo Sapiens
PTDAADPRV

SEQ ID NO: 1365182 - protein, 9 aa, Homo Sapiens
ILPLQASEF

SEQ ID NO: 1365183 - protein, 9 aa, Homo Sapiens
RMLSVSTKD

SEQ ID NO: 1365184 - protein, 9 aa, Homo Sapiens
VGVIATLLF

SEQ ID NO: 1365185 - protein, 9 aa, Homo Sapiens
FLAFYQCAK

SEQ ID NO: 1365186 - protein, 9 aa, Homo Sapiens
GPLWKKPWG

SEQ ID NO: 1365187 - protein, 9 aa, Homo Sapiens
KRVENYIRT

SEQ ID NO: 1365188 - protein, 9 aa, Homo Sapiens
FNGGVTLRM

SEQ ID NO: 1365189 - protein, 9 aa, Homo Sapiens
VKPLAESPF

SEQ ID NO: 1365190 - protein, 9 aa, Homo Sapiens
FHVRFINPG

SEQ ID NO: 1365191 - protein, 9 aa, Homo Sapiens
QLAASWLVC

SEQ ID NO: 1365192 - protein, 9 aa, Homo Sapiens
WHPLGLCSA

SEQ ID NO: 1365193 - protein, 9 aa, Homo Sapiens
WGPRTPRGT

SEQ ID NO: 1365194 - protein, 9 aa, Homo Sapiens
LSLSIMPAQ

SEQ ID NO: 1365195 - protein, 9 aa, Homo Sapiens
VQHACFGLF

SEQ ID NO: 1365196 - protein, 9 aa, Homo Sapiens
SDGDGECGK

SEQ ID NO: 1365197 - protein, 9 aa, Homo Sapiens
HSQLPHPHP

SEQ ID NO: 1365198 - protein, 9 aa, Homo Sapiens
LRFCAWPSA

SEQ ID NO: 1365199 - protein, 9 aa, Homo Sapiens
VITLALAAL

SEQ ID NO: 1365200 - protein, 9 aa, Homo Sapiens
GETGSRSVT

SEQ ID NO: 1365201 - protein, 9 aa, Homo Sapiens
NSNSSNSSK

SEQ ID NO: 1365202 - protein, 9 aa, Homo Sapiens
RQRKRMLSV

SEQ ID NO: 1365203 - protein, 9 aa, Homo Sapiens
QYSSPSPAQ

SEQ ID NO: 1365204 - protein, 9 aa, Homo Sapiens
TNLLPSLAY

SEQ ID NO: 1365205 - protein, 9 aa, Homo Sapiens
PNPDGVETV

SEQ ID NO: 1365206 - protein, 9 aa, Homo Sapiens
GAAAHFPSV

SEQ ID NO: 1365207 - protein, 9 aa, Homo Sapiens
GIPGKKRGT

SEQ ID NO: 1365208 - protein, 9 aa, Homo Sapiens
ASVALPTDL

SEQ ID NO: 1365209 - protein, 9 aa, Homo Sapiens
MDDEFELST

SEQ ID NO: 1365210 - protein, 9 aa, Homo Sapiens
TPRAGATAG

SEQ ID NO: 1365211 - protein, 9 aa, Homo Sapiens
KVVASLKAN

SEQ ID NO: 1365212 - protein, 9 aa, Homo Sapiens
HVHEASPPT

SEQ ID NO: 1365213 - protein, 9 aa, Homo Sapiens
RDREARAAH

SEQ ID NO: 1365214 - protein, 9 aa, Homo Sapiens
VIQQPPSPL

SEQ ID NO: 1365215 - protein, 9 aa, Homo Sapiens
NISGLLVNR

SEQ ID NO: 1365216 - protein, 9 aa, Homo Sapiens
WEGGNREDG

SEQ ID NO: 1365217 - protein, 9 aa, Homo Sapiens
ELEKKTEAA

SEQ ID NO: 1365218 - protein, 9 aa, Homo Sapiens
GTLIWPVAV

SEQ ID NO: 1365219 - protein, 9 aa, Homo Sapiens
SGPFFYIGG

SEQ ID NO: 1365220 - protein, 9 aa, Homo Sapiens
GGDIPGQPL

SEQ ID NO: 1365221 - protein, 9 aa, Homo Sapiens
IPEEEKREV

SEQ ID NO: 1365222 - protein, 9 aa, Homo Sapiens
LAQVPLSCE

SEQ ID NO: 1365223 - protein, 9 aa, Homo Sapiens
VSGSHKGGH

SEQ ID NO: 1365224 - protein, 9 aa, Homo Sapiens
ADLRKKVVE

SEQ ID NO: 1365225 - protein, 9 aa, Homo Sapiens
RIAETGVSG

SEQ ID NO: 1365226 - protein, 9 aa, Homo Sapiens
EERHLEAEG

SEQ ID NO: 1365227 - protein, 9 aa, Homo Sapiens
VALDSPTST

SEQ ID NO: 1365228 - protein, 9 aa, Homo Sapiens
DETHKLEPW

SEQ ID NO: 1365229 - protein, 9 aa, Homo Sapiens
AVVDSMCLE

SEQ ID NO: 1365230 - protein, 9 aa, Homo Sapiens
QTPGLGSKG

SEQ ID NO: 1365231 - protein, 9 aa, Homo Sapiens
ALLTIFHPK

SEQ ID NO: 1365232 - protein, 9 aa, Homo Sapiens
TALVAGPST

SEQ ID NO: 1365233 - protein, 9 aa, Homo Sapiens
QGAYSQILL

SEQ ID NO: 1365234 - protein, 9 aa, Homo Sapiens
CLSSTVKQA

SEQ ID NO: 1365235 - protein, 9 aa, Homo Sapiens
STARPSPSQ

SEQ ID NO: 1365236 - protein, 9 aa, Homo Sapiens
WGLQRTSQA

SEQ ID NO: 1365237 - protein, 9 aa, Homo Sapiens
FRSQFVLKF

SEQ ID NO: 1365238 - protein, 9 aa, Homo Sapiens
KKISQKKPK

SEQ ID NO: 1365239 - protein, 9 aa, Homo Sapiens
FERSEGNTI

SEQ ID NO: 1365240 - protein, 9 aa, Homo Sapiens
FFVNDQFWI

SEQ ID NO: 1365241 - protein, 9 aa, Homo Sapiens
CCVVRNSSY

SEQ ID NO: 1365242 - protein, 9 aa, Homo Sapiens
DGFADQSPG

SEQ ID NO: 1365243 - protein, 9 aa, Homo Sapiens
LFFVLVNLE

SEQ ID NO: 1365244 - protein, 9 aa, Homo Sapiens
NYMLDKFSP

SEQ ID NO: 1365245 - protein, 9 aa, Homo Sapiens
SSWSGDSCD

SEQ ID NO: 1365246 - protein, 9 aa, Homo Sapiens
QTAAGRPPR

SEQ ID NO: 1365247 - protein, 9 aa, Homo Sapiens
EENDLGPAC

SEQ ID NO: 1365248 - protein, 9 aa, Homo Sapiens
PPSPLPPQL

SEQ ID NO: 1365249 - protein, 9 aa, Homo Sapiens
TSPLLTHQV

SEQ ID NO: 1365250 - protein, 9 aa, Homo Sapiens
NYPSNMDRS

SEQ ID NO: 1365251 - protein, 9 aa, Homo Sapiens
TLSTLQQRH

SEQ ID NO: 1365252 - protein, 9 aa, Homo Sapiens
ETEYQVQGG

SEQ ID NO: 1365253 - protein, 9 aa, Homo Sapiens
YRYDSATGY

SEQ ID NO: 1365254 - protein, 9 aa, Homo Sapiens
KKQRKPKRA

SEQ ID NO: 1365255 - protein, 9 aa, Homo Sapiens
SISIPAAKP

SEQ ID NO: 1365256 - protein, 9 aa, Homo Sapiens
PRVQGFLLH

SEQ ID NO: 1365257 - protein, 9 aa, Homo Sapiens
SGTARGGGN

SEQ ID NO: 1365258 - protein, 9 aa, Homo Sapiens
IFTTPGRTY

SEQ ID NO: 1365259 - protein, 9 aa, Homo Sapiens
RLVHIQKNA

SEQ ID NO: 1365260 - protein, 9 aa, Homo Sapiens
LCEKDGKAL

SEQ ID NO: 1365261 - protein, 9 aa, Homo Sapiens
SSFSRCGPG

SEQ ID NO: 1365262 - protein, 9 aa, Homo Sapiens
AEADCMSLL

SEQ ID NO: 1365263 - protein, 9 aa, Homo Sapiens
CVLLLVLDE

SEQ ID NO: 1365264 - protein, 9 aa, Homo Sapiens
TKIATGQTD

SEQ ID NO: 1365265 - protein, 9 aa, Homo Sapiens
ENRLLMRDP

SEQ ID NO: 1365266 - protein, 9 aa, Homo Sapiens
SHLRSLRPG

SEQ ID NO: 1365267 - protein, 9 aa, Homo Sapiens
IIVNTVNQK

SEQ ID NO: 1365268 - protein, 9 aa, Homo Sapiens
KKTYMEMHY

SEQ ID NO: 1365269 - protein, 9 aa, Homo Sapiens
VSKNPVCKL

SEQ ID NO: 1365270 - protein, 9 aa, Homo Sapiens
ALNTKEVVV

SEQ ID NO: 1365271 - protein, 9 aa, Homo Sapiens
GSLYEPASP

SEQ ID NO: 1365272 - protein, 9 aa, Homo Sapiens
GHPPPPPWG

SEQ ID NO: 1365273 - protein, 9 aa, Homo Sapiens
FAVGIPQQC

SEQ ID NO: 1365274 - protein, 9 aa, Homo Sapiens
PSDPLTHLA

SEQ ID NO: 1365275 - protein, 9 aa, Homo Sapiens
RLAKLRQKR

SEQ ID NO: 1365276 - protein, 9 aa, Homo Sapiens
TATMLCAAN

SEQ ID NO: 1365277 - protein, 9 aa, Homo Sapiens
PVGPVQVGK

SEQ ID NO: 1365278 - protein, 9 aa, Homo Sapiens
FPFPNPEQG

SEQ ID NO: 1365279 - protein, 9 aa, Homo Sapiens
SPAQPYLRV

SEQ ID NO: 1365280 - protein, 9 aa, Homo Sapiens
QGTTIFQLF

SEQ ID NO: 1365281 - protein, 9 aa, Homo Sapiens
EKDRKERKG

SEQ ID NO: 1365282 - protein, 9 aa, Homo Sapiens
KCPPHLVEV

SEQ ID NO: 1365283 - protein, 9 aa, Homo Sapiens
RVEHYSRKV

SEQ ID NO: 1365284 - protein, 9 aa, Homo Sapiens
SSKPRPSAH

SEQ ID NO: 1365285 - protein, 9 aa, Homo Sapiens
DGMGQRALR

SEQ ID NO: 1365286 - protein, 9 aa, Homo Sapiens
GFVHDLVPY

SEQ ID NO: 1365287 - protein, 9 aa, Homo Sapiens
ALQPGEKKS

SEQ ID NO: 1365288 - protein, 9 aa, Homo Sapiens
TAVRLSDSR

SEQ ID NO: 1365289 - protein, 9 aa, Homo Sapiens
PELLRYLVD

SEQ ID NO: 1365290 - protein, 9 aa, Homo Sapiens
SQTEHIQTP

SEQ ID NO: 1365291 - protein, 9 aa, Homo Sapiens
DFGDGHHSV

SEQ ID NO: 1365292 - protein, 9 aa, Homo Sapiens
YNMVLAHDL

SEQ ID NO: 1365293 - protein, 9 aa, Homo Sapiens
GKRPREGEA

SEQ ID NO: 1365294 - protein, 9 aa, Homo Sapiens
PPEQFTAVR

SEQ ID NO: 1365295 - protein, 9 aa, Homo Sapiens
SPEEASVHN

SEQ ID NO: 1365296 - protein, 9 aa, Homo Sapiens
VLEPVLERR

SEQ ID NO: 1365297 - protein, 9 aa, Homo Sapiens
PTLPITLLR

SEQ ID NO: 1365298 - protein, 9 aa, Homo Sapiens
ALVYSDDKP

SEQ ID NO: 1365299 - protein, 9 aa, Homo Sapiens
HTLLTEEVA

SEQ ID NO: 1365300 - protein, 9 aa, Homo Sapiens
GSRVSQRPF

SEQ ID NO: 1365301 - protein, 9 aa, Homo Sapiens
ADIKPDNVL

SEQ ID NO: 1365302 - protein, 9 aa, Homo Sapiens
HTRGASGRD

SEQ ID NO: 1365303 - protein, 9 aa, Homo Sapiens
KKSSGALEK

SEQ ID NO: 1365304 - protein, 9 aa, Homo Sapiens
TGSRSVTQA

SEQ ID NO: 1365305 - protein, 9 aa, Homo Sapiens
IKSYKRECI

SEQ ID NO: 1365306 - protein, 9 aa, Homo Sapiens
KLETGIREL

SEQ ID NO: 1365307 - protein, 9 aa, Homo Sapiens
EPAHAWFEC

SEQ ID NO: 1365308 - protein, 9 aa, Homo Sapiens
RQGGLKYSR

SEQ ID NO: 1365309 - protein, 9 aa, Homo Sapiens
SPHSTRSGP

SEQ ID NO: 1365310 - protein, 9 aa, Homo Sapiens
WCVAGPSVT

SEQ ID NO: 1365311 - protein, 9 aa, Homo Sapiens
SRTFEHFCD

SEQ ID NO: 1365312 - protein, 9 aa, Homo Sapiens
RRMRGTAAT

SEQ ID NO: 1365313 - protein, 9 aa, Homo Sapiens
LNALLLICG

SEQ ID NO: 1365314 - protein, 9 aa, Homo Sapiens
SCPHGSTAQ

SEQ ID NO: 1365315 - protein, 9 aa, Homo Sapiens
TDVMRKQGS

SEQ ID NO: 1365316 - protein, 9 aa, Homo Sapiens
SRIIEIMQK

SEQ ID NO: 1365317 - protein, 9 aa, Homo Sapiens
ADRLLRGLG

SEQ ID NO: 1365318 - protein, 9 aa, Homo Sapiens
PLPLSAVTA

SEQ ID NO: 1365319 - protein, 9 aa, Homo Sapiens
GSRSVTQAG

SEQ ID NO: 1365320 - protein, 9 aa, Homo Sapiens
AKTIACYGG

SEQ ID NO: 1365321 - protein, 9 aa, Homo Sapiens
LCHRPGLGG

SEQ ID NO: 1365322 - protein, 9 aa, Homo Sapiens
SALSGPRPA

SEQ ID NO: 1365323 - protein, 9 aa, Homo Sapiens
PTVGNNKTL

SEQ ID NO: 1365324 - protein, 9 aa, Homo Sapiens
GWKRKRWEM

SEQ ID NO: 1365325 - protein, 9 aa, Homo Sapiens
VANGPSHSL

SEQ ID NO: 1365326 - protein, 9 aa, Homo Sapiens
EEGEEEEDD

SEQ ID NO: 1365327 - protein, 9 aa, Homo Sapiens
SFADCGCML

SEQ ID NO: 1365328 - protein, 9 aa, Homo Sapiens
EQPAQLRCE

SEQ ID NO: 1365329 - protein, 9 aa, Homo Sapiens
PHSTRSGPF

SEQ ID NO: 1365330 - protein, 9 aa, Homo Sapiens
DGVTGLHLE

SEQ ID NO: 1365331 - protein, 9 aa, Homo Sapiens
ENFKDGYES

SEQ ID NO: 1365332 - protein, 9 aa, Homo Sapiens
ITIYGRTKE

SEQ ID NO: 1365333 - protein, 9 aa, Homo Sapiens
FFDGVKDVT

SEQ ID NO: 1365334 - protein, 9 aa, Homo Sapiens
AQVPLSCET

SEQ ID NO: 1365335 - protein, 9 aa, Homo Sapiens
LYGTEVHTN

SEQ ID NO: 1365336 - protein, 9 aa, Homo Sapiens
LVHSDALHF

SEQ ID NO: 1365337 - protein, 9 aa, Homo Sapiens
ISCVWNCHR

SEQ ID NO: 1365338 - protein, 9 aa, Homo Sapiens
RCLVALGHA

SEQ ID NO: 1365339 - protein, 9 aa, Homo Sapiens
SQSEEHSLE

SEQ ID NO: 1365340 - protein, 9 aa, Homo Sapiens
IVSGSLSVA

SEQ ID NO: 1365341 - protein, 9 aa, Homo Sapiens
SCHSHTAVQ

SEQ ID NO: 1365342 - protein, 9 aa, Homo Sapiens
IQLGQRSLW

SEQ ID NO: 1365343 - protein, 9 aa, Homo Sapiens
SICILAGDR

SEQ ID NO: 1365344 - protein, 9 aa, Homo Sapiens
SSNWSWGVC

SEQ ID NO: 1365345 - protein, 9 aa, Homo Sapiens
SSSFSRCGP

SEQ ID NO: 1365346 - protein, 9 aa, Homo Sapiens
LQVGRFAME

SEQ ID NO: 1365347 - protein, 9 aa, Homo Sapiens
HYAALSFHK

SEQ ID NO: 1365348 - protein, 9 aa, Homo Sapiens
KMMSAVAIA

SEQ ID NO: 1365349 - protein, 9 aa, Homo Sapiens
EWLKLTPDL

SEQ ID NO: 1365350 - protein, 9 aa, Homo Sapiens
LGKKKKLMS

SEQ ID NO: 1365351 - protein, 9 aa, Homo Sapiens
GPGPRVDAE

SEQ ID NO: 1365352 - protein, 9 aa, Homo Sapiens
KCDECGNTF

SEQ ID NO: 1365353 - protein, 9 aa, Homo Sapiens
VVHAEGQVA

SEQ ID NO: 1365354 - protein, 9 aa, Homo Sapiens
DGDGECGKS

SEQ ID NO: 1365355 - protein, 9 aa, Homo Sapiens
WEKNIEITP

SEQ ID NO: 1365356 - protein, 9 aa, Homo Sapiens
DRTTRLILE

SEQ ID NO: 1365357 - protein, 9 aa, Homo Sapiens
RDRQGGLKY

SEQ ID NO: 1365358 - protein, 9 aa, Homo Sapiens
LFLILGKVL

SEQ ID NO: 1365359 - protein, 9 aa, Homo Sapiens
QVGKEQHPA

SEQ ID NO: 1365360 - protein, 9 aa, Homo Sapiens
VKVFRNEGR

SEQ ID NO: 1365361 - protein, 9 aa, Homo Sapiens
RTCTVRTAC

SEQ ID NO: 1365362 - protein, 9 aa, Homo Sapiens
ERKGDHSNN

SEQ ID NO: 1365363 - protein, 9 aa, Homo Sapiens
VKRIRNILD

SEQ ID NO: 1365364 - protein, 9 aa, Homo Sapiens
VKKRRVDMP

SEQ ID NO: 1365365 - protein, 9 aa, Homo Sapiens
SGLLVNRNV

SEQ ID NO: 1365366 - protein, 9 aa, Homo Sapiens
PHKFYVHIK

SEQ ID NO: 1365367 - protein, 9 aa, Homo Sapiens
KQRHENQTH

SEQ ID NO: 1365368 - protein, 9 aa, Homo Sapiens
VVAFDVHNH

SEQ ID NO: 1365369 - protein, 9 aa, Homo Sapiens
STQSSGSQQ

SEQ ID NO: 1365370 - protein, 9 aa, Homo Sapiens
IKEHHPEGS

SEQ ID NO: 1365371 - protein, 9 aa, Homo Sapiens
HPASCLGAP

SEQ ID NO: 1365372 - protein, 9 aa, Homo Sapiens
ETFKLTEMQ

SEQ ID NO: 1365373 - protein, 9 aa, Homo Sapiens
FGREEEPPL

SEQ ID NO: 1365374 - protein, 9 aa, Homo Sapiens
RPIFPPHSY

SEQ ID NO: 1365375 - protein, 9 aa, Homo Sapiens
RLRFTHPQQ

SEQ ID NO: 1365376 - protein, 9 aa, Homo Sapiens
GTDQASHCR

SEQ ID NO: 1365377 - protein, 9 aa, Homo Sapiens
VGNQPKAAS

SEQ ID NO: 1365378 - protein, 9 aa, Homo Sapiens
GTELIYRQV

SEQ ID NO: 1365379 - protein, 9 aa, Homo Sapiens
VQPRLEGTG

SEQ ID NO: 1365380 - protein, 9 aa, Homo Sapiens
PRRDPPGQP

SEQ ID NO: 1365381 - protein, 9 aa, Homo Sapiens
LHLESDGLT

SEQ ID NO: 1365382 - protein, 9 aa, Homo Sapiens
PRDRLRFTH

SEQ ID NO: 1365383 - protein, 9 aa, Homo Sapiens
CPCIRGPWP

SEQ ID NO: 1365384 - protein, 9 aa, Homo Sapiens
LGPACTVDS

SEQ ID NO: 1365385 - protein, 9 aa, Homo Sapiens
SPPATCHNN

SEQ ID NO: 1365386 - protein, 9 aa, Homo Sapiens
LEKNHCRNP

SEQ ID NO: 1365387 - protein, 9 aa, Homo Sapiens
MSVRLPQRI

SEQ ID NO: 1365388 - protein, 9 aa, Homo Sapiens
RCSSTSAHT

SEQ ID NO: 1365389 - protein, 9 aa, Homo Sapiens
SPRVKALKR

SEQ ID NO: 1365390 - protein, 9 aa, Homo Sapiens
RRPTALVAG

SEQ ID NO: 1365391 - protein, 9 aa, Homo Sapiens
TPLRNLPGH

SEQ ID NO: 1365392 - protein, 9 aa, Homo Sapiens
PLRVICSLY

SEQ ID NO: 1365393 - protein, 9 aa, Homo Sapiens
RFDEVFYFE

SEQ ID NO: 1365394 - protein, 9 aa, Homo Sapiens
LMPTVPKHL

SEQ ID NO: 1365395 - protein, 9 aa, Homo Sapiens
GKKRSLAPL

SEQ ID NO: 1365396 - protein, 9 aa, Homo Sapiens
LVLDEDLAK

SEQ ID NO: 1365397 - protein, 9 aa, Homo Sapiens
VLLVMHNFE

SEQ ID NO: 1365398 - protein, 9 aa, Homo Sapiens
SRLPRGPPQ

SEQ ID NO: 1365399 - protein, 9 aa, Homo Sapiens
KLTGAQRQL

SEQ ID NO: 1365400 - protein, 9 aa, Homo Sapiens
EVEIKRINK

SEQ ID NO: 1365401 - protein, 9 aa, Homo Sapiens
HRNCIIDQI

SEQ ID NO: 1365402 - protein, 9 aa, Homo Sapiens
LQKRVENYI

SEQ ID NO: 1365403 - protein, 9 aa, Homo Sapiens
GCPHWPARI

SEQ ID NO: 1365404 - protein, 9 aa, Homo Sapiens
CLYSQDGSF

SEQ ID NO: 1365405 - protein, 9 aa, Homo Sapiens
HAESGKVHA

SEQ ID NO: 1365406 - protein, 9 aa, Homo Sapiens
EYFMKQIND

SEQ ID NO: 1365407 - protein, 9 aa, Homo Sapiens
GNMPMLCPL

SEQ ID NO: 1365408 - protein, 9 aa, Homo Sapiens
NCIRAIENI

SEQ ID NO: 1365409 - protein, 9 aa, Homo Sapiens
EDASGDESI

SEQ ID NO: 1365410 - protein, 9 aa, Homo Sapiens
SDRGDVRRH

SEQ ID NO: 1365411 - protein, 9 aa, Homo Sapiens
TLIWPVAVT

SEQ ID NO: 1365412 - protein, 9 aa, Homo Sapiens
WQRRLRACR

SEQ ID NO: 1365413 - protein, 9 aa, Homo Sapiens
PEEEKREVG

SEQ ID NO: 1365414 - protein, 9 aa, Homo Sapiens
RNCKSKEVE

SEQ ID NO: 1365415 - protein, 9 aa, Homo Sapiens
QGLVGMTPR

SEQ ID NO: 1365416 - protein, 9 aa, Homo Sapiens
SRESVAEHG

SEQ ID NO: 1365417 - protein, 9 aa, Homo Sapiens
YQGAYSQIL

SEQ ID NO: 1365418 - protein, 9 aa, Homo Sapiens
RPRSPSPPQ

SEQ ID NO: 1365419 - protein, 9 aa, Homo Sapiens
PSSWCVAGP

SEQ ID NO: 1365420 - protein, 9 aa, Homo Sapiens
VYLDPTDAA

SEQ ID NO: 1365421 - protein, 9 aa, Homo Sapiens
EVSGHQADQ

SEQ ID NO: 1365422 - protein, 9 aa, Homo Sapiens
ALGGVALRC

SEQ ID NO: 1365423 - protein, 9 aa, Homo Sapiens
GYYMAVGTS

SEQ ID NO: 1365424 - protein, 9 aa, Homo Sapiens
GRRRQRRAP

SEQ ID NO: 1365425 - protein, 9 aa, Homo Sapiens
AVFCIMDYD

SEQ ID NO: 1365426 - protein, 9 aa, Homo Sapiens
IRLRFKRPQ

SEQ ID NO: 1365427 - protein, 9 aa, Homo Sapiens
ISSRLRNEM

SEQ ID NO: 1365428 - protein, 9 aa, Homo Sapiens
SQESHMASI

SEQ ID NO: 1365429 - protein, 9 aa, Homo Sapiens
SQDAPSCSA

SEQ ID NO: 1365430 - protein, 9 aa, Homo Sapiens
GWAPEPSTV

SEQ ID NO: 1365431 - protein, 9 aa, Homo Sapiens
QATPDRVLF

SEQ ID NO: 1365432 - protein, 9 aa, Homo Sapiens
CLLVLDAND

SEQ ID NO: 1365433 - protein, 9 aa, Homo Sapiens
APWRHGDEG

SEQ ID NO: 1365434 - protein, 9 aa, Homo Sapiens
LLPLAPADL

SEQ ID NO: 1365435 - protein, 9 aa, Homo Sapiens
TIRVVGHMP

SEQ ID NO: 1365436 - protein, 9 aa, Homo Sapiens
HTQQGHVHR

SEQ ID NO: 1365437 - protein, 9 aa, Homo Sapiens
TPAAEDRTS

SEQ ID NO: 1365438 - protein, 9 aa, Homo Sapiens
GPAQDCVRL

SEQ ID NO: 1365439 - protein, 9 aa, Homo Sapiens
GPWNPCQVP

SEQ ID NO: 1365440 - protein, 9 aa, Homo Sapiens
GEEYLGAFD

SEQ ID NO: 1365441 - protein, 9 aa, Homo Sapiens
GFLREHPQP

SEQ ID NO: 1365442 - protein, 9 aa, Homo Sapiens
REMMGCLSL

SEQ ID NO: 1365443 - protein, 9 aa, Homo Sapiens
ALSFHKVKP

SEQ ID NO: 1365444 - protein, 9 aa, Homo Sapiens
QVRRSAAAP

SEQ ID NO: 1365445 - protein, 9 aa, Homo Sapiens
GEMFFITND

SEQ ID NO: 1365446 - protein, 9 aa, Homo Sapiens
SPPGSLLSS

SEQ ID NO: 1365447 - protein, 9 aa, Homo Sapiens
ATLFKSARM

SEQ ID NO: 1365448 - protein, 9 aa, Homo Sapiens
TAWMNVLPY

SEQ ID NO: 1365449 - protein, 9 aa, Homo Sapiens
ILSSLWNWR

SEQ ID NO: 1365450 - protein, 9 aa, Homo Sapiens
HTSTGPAQD

SEQ ID NO: 1365451 - protein, 9 aa, Homo Sapiens
RHQVHLIYV

SEQ ID NO: 1365452 - protein, 9 aa, Homo Sapiens
TRTAAPPGQ

SEQ ID NO: 1365453 - protein, 9 aa, Homo Sapiens
VKTNFIDRI

SEQ ID NO: 1365454 - protein, 9 aa, Homo Sapiens
TANPCLILS

SEQ ID NO: 1365455 - protein, 9 aa, Homo Sapiens
RHVVMQKLL

SEQ ID NO: 1365456 - protein, 9 aa, Homo Sapiens
VVLSGVPLL

SEQ ID NO: 1365457 - protein, 9 aa, Homo Sapiens
DIHQEYRED

SEQ ID NO: 1365458 - protein, 9 aa, Homo Sapiens
RREGGGTNI

SEQ ID NO: 1365459 - protein, 9 aa, Homo Sapiens
AAARAGAAR

SEQ ID NO: 1365460 - protein, 9 aa, Homo Sapiens
TVNTPAMYV

SEQ ID NO: 1365461 - protein, 9 aa, Homo Sapiens
ELKPLPMVL

SEQ ID NO: 1365462 - protein, 9 aa, Homo Sapiens
RNAEVHQTS

SEQ ID NO: 1365463 - protein, 9 aa, Homo Sapiens
VQRRNLGVS

SEQ ID NO: 1365464 - protein, 9 aa, Homo Sapiens
KKIGVVVCN

SEQ ID NO: 1365465 - protein, 9 aa, Homo Sapiens
GELVKAMVV

SEQ ID NO: 1365466 - protein, 9 aa, Homo Sapiens
LSLQVTPRA

SEQ ID NO: 1365467 - protein, 9 aa, Homo Sapiens
RVHMADMEA

SEQ ID NO: 1365468 - protein, 9 aa, Homo Sapiens
VYRRHCGAT

SEQ ID NO: 1365469 - protein, 9 aa, Homo Sapiens
HCDEHRGGS

SEQ ID NO: 1365470 - protein, 9 aa, Homo Sapiens
YMTGRIACA

SEQ ID NO: 1365471 - protein, 9 aa, Homo Sapiens
TNAGYLERV

SEQ ID NO: 1365472 - protein, 9 aa, Homo Sapiens
FETKSLALS

SEQ ID NO: 1365473 - protein, 9 aa, Homo Sapiens
VPPLVGSFI

SEQ ID NO: 1365474 - protein, 9 aa, Homo Sapiens
HWSYSSNYL

SEQ ID NO: 1365475 - protein, 9 aa, Homo Sapiens
FALRIFPEV

SEQ ID NO: 1365476 - protein, 9 aa, Homo Sapiens
NWSWGVCFM

SEQ ID NO: 1365477 - protein, 9 aa, Homo Sapiens
EAESGSSDT

SEQ ID NO: 1365478 - protein, 9 aa, Homo Sapiens
EGSPGGIGS

SEQ ID NO: 1365479 - protein, 9 aa, Homo Sapiens
DGQGHGQQG

SEQ ID NO: 1365480 - protein, 9 aa, Homo Sapiens
LFLDVVVRQ

SEQ ID NO: 1365481 - protein, 9 aa, Homo Sapiens
YYNASTQRS

SEQ ID NO: 1365482 - protein, 9 aa, Homo Sapiens
SRGHVHEAS

SEQ ID NO: 1365483 - protein, 9 aa, Homo Sapiens
IVGIPGKKR

SEQ ID NO: 1365484 - protein, 9 aa, Homo Sapiens
FRTLQRVGV

SEQ ID NO: 1365485 - protein, 9 aa, Homo Sapiens
LEPRRRLWP

SEQ ID NO: 1365486 - protein, 9 aa, Homo Sapiens
FLEWKRWLQ

SEQ ID NO: 1365487 - protein, 9 aa, Homo Sapiens
PEGSPGGIG

SEQ ID NO: 1365488 - protein, 9 aa, Homo Sapiens
LPGQPPMHS

SEQ ID NO: 1365489 - protein, 9 aa, Homo Sapiens
FQSERWPSG

SEQ ID NO: 1365490 - protein, 9 aa, Homo Sapiens
PQLPSIPVS

SEQ ID NO: 1365491 - protein, 9 aa, Homo Sapiens
QTNAGYLER

SEQ ID NO: 1365492 - protein, 9 aa, Homo Sapiens
PALGAYRTN

SEQ ID NO: 1365493 - protein, 9 aa, Homo Sapiens
QFASRQNLH

SEQ ID NO: 1365494 - protein, 9 aa, Homo Sapiens
RRLGVEIHD

SEQ ID NO: 1365495 - protein, 9 aa, Homo Sapiens
LAQTVASFN

SEQ ID NO: 1365496 - protein, 9 aa, Homo Sapiens
RVADLAHIL

SEQ ID NO: 1365497 - protein, 9 aa, Homo Sapiens
SELFKFTIG

SEQ ID NO: 1365498 - protein, 9 aa, Homo Sapiens
VGKIERVSA

SEQ ID NO: 1365499 - protein, 9 aa, Homo Sapiens
GPVTRRSQQ

SEQ ID NO: 1365500 - protein, 9 aa, Homo Sapiens
NKAITDAAM

SEQ ID NO: 1365501 - protein, 9 aa, Homo Sapiens
AGFRSQFVL

SEQ ID NO: 1365502 - protein, 9 aa, Homo Sapiens
MGISTRVNN

SEQ ID NO: 1365503 - protein, 9 aa, Homo Sapiens
SVFRLSGPG

SEQ ID NO: 1365504 - protein, 9 aa, Homo Sapiens
EVNNAAARV

SEQ ID NO: 1365505 - protein, 9 aa, Homo Sapiens
PPGPQALPE

SEQ ID NO: 1365506 - protein, 9 aa, Homo Sapiens
ARRCRNGFV

SEQ ID NO: 1365507 - protein, 9 aa, Homo Sapiens
LTCPLDSGS

SEQ ID NO: 1365508 - protein, 9 aa, Homo Sapiens
KIKAQKMCE

SEQ ID NO: 1365509 - protein, 9 aa, Homo Sapiens
GGQPESHHG

SEQ ID NO: 1365510 - protein, 9 aa, Homo Sapiens
VVLPSPAKE

SEQ ID NO: 1365511 - protein, 9 aa, Homo Sapiens
LSYIDLSVW

SEQ ID NO: 1365512 - protein, 9 aa, Homo Sapiens
AADESGLWV

SEQ ID NO: 1365513 - protein, 9 aa, Homo Sapiens
DCYVAVRHP

SEQ ID NO: 1365514 - protein, 9 aa, Homo Sapiens
VTGLCHRPG

SEQ ID NO: 1365515 - protein, 9 aa, Homo Sapiens
QSSSDCYRY

SEQ ID NO: 1365516 - protein, 9 aa, Homo Sapiens
SLSEEIGKA

SEQ ID NO: 1365517 - protein, 9 aa, Homo Sapiens
QKRVENYIR

SEQ ID NO: 1365518 - protein, 9 aa, Homo Sapiens
QWKDVPVER

SEQ ID NO: 1365519 - protein, 9 aa, Homo Sapiens
SLDIFQMHD

SEQ ID NO: 1365520 - protein, 9 aa, Homo Sapiens
PAPAHFLDY

SEQ ID NO: 1365521 - protein, 9 aa, Homo Sapiens
GPGTWTPCD

SEQ ID NO: 1365522 - protein, 9 aa, Homo Sapiens
RNRNEDDEV

SEQ ID NO: 1365523 - protein, 9 aa, Homo Sapiens
SGDKTIHIW

SEQ ID NO: 1365524 - protein, 9 aa, Homo Sapiens
PGHTPFASQ

SEQ ID NO: 1365525 - protein, 9 aa, Homo Sapiens
LQVTTTLKL

SEQ ID NO: 1365526 - protein, 9 aa, Homo Sapiens
VPVEKQVFK

SEQ ID NO: 1365527 - protein, 9 aa, Homo Sapiens
PHLWGRSGP

SEQ ID NO: 1365528 - protein, 9 aa, Homo Sapiens
QQRERKNAR

SEQ ID NO: 1365529 - protein, 9 aa, Homo Sapiens
VRRNGERVN

SEQ ID NO: 1365530 - protein, 9 aa, Homo Sapiens
HLKGAFAAI

SEQ ID NO: 1365531 - protein, 9 aa, Homo Sapiens
YQPPAKKQR

SEQ ID NO: 1365532 - protein, 9 aa, Homo Sapiens
PQMALELMR

SEQ ID NO: 1365533 - protein, 9 aa, Homo Sapiens
YYVSEDLND

SEQ ID NO: 1365534 - protein, 9 aa, Homo Sapiens
RQRRAPAPQ

SEQ ID NO: 1365535 - protein, 9 aa, Homo Sapiens
ERLQAQQSR

SEQ ID NO: 1365536 - protein, 9 aa, Homo Sapiens
QKTAFDKVH

SEQ ID NO: 1365537 - protein, 9 aa, Homo Sapiens
QTKQAQVLP

SEQ ID NO: 1365538 - protein, 9 aa, Homo Sapiens
IRNHVVQRL

SEQ ID NO: 1365539 - protein, 9 aa, Homo Sapiens
VAFDVHNHR

SEQ ID NO: 1365540 - protein, 9 aa, Homo Sapiens
GKDQPLLVR

SEQ ID NO: 1365541 - protein, 9 aa, Homo Sapiens
QCGIPTSLQ

SEQ ID NO: 1365542 - protein, 9 aa, Homo Sapiens
LPLAPADLC

SEQ ID NO: 1365543 - protein, 9 aa, Homo Sapiens
LQQFDKKMS

SEQ ID NO: 1365544 - protein, 9 aa, Homo Sapiens
REHPQPHKL

SEQ ID NO: 1365545 - protein, 9 aa, Homo Sapiens
PARTPPGGG

SEQ ID NO: 1365546 - protein, 9 aa, Homo Sapiens
LSEEEREKV

SEQ ID NO: 1365547 - protein, 9 aa, Homo Sapiens
GMATHFQQL

SEQ ID NO: 1365548 - protein, 9 aa, Homo Sapiens
GRVSRPPRR

SEQ ID NO: 1365549 - protein, 9 aa, Homo Sapiens
RDGYVLPKH

SEQ ID NO: 1365550 - protein, 9 aa, Homo Sapiens
RPLRIGKKN

SEQ ID NO: 1365551 - protein, 9 aa, Homo Sapiens
PHQMKCLTA

SEQ ID NO: 1365552 - protein, 9 aa, Homo Sapiens
ALVREVTGR

SEQ ID NO: 1365553 - protein, 9 aa, Homo Sapiens
SLAYEKAQE

SEQ ID NO: 1365554 - protein, 9 aa, Homo Sapiens
LEKKTEAAA

SEQ ID NO: 1365555 - protein, 9 aa, Homo Sapiens
DTTKSVVIS

SEQ ID NO: 1365556 - protein, 9 aa, Homo Sapiens
VEQKTLSQR

SEQ ID NO: 1365557 - protein, 9 aa, Homo Sapiens
MPFSTTPVV

SEQ ID NO: 1365558 - protein, 9 aa, Homo Sapiens
IIFRIIGIM

SEQ ID NO: 1365559 - protein, 9 aa, Homo Sapiens
TVTGLCHRP

SEQ ID NO: 1365560 - protein, 9 aa, Homo Sapiens
DDFGTVKLF

SEQ ID NO: 1365561 - protein, 9 aa, Homo Sapiens
AAGGCGPSR

SEQ ID NO: 1365562 - protein, 9 aa, Homo Sapiens
DFSHFHLFD

SEQ ID NO: 1365563 - protein, 9 aa, Homo Sapiens
LTATDTAGQ

SEQ ID NO: 1365564 - protein, 9 aa, Homo Sapiens
ETRAVGKSQ

SEQ ID NO: 1365565 - protein, 9 aa, Homo Sapiens
EEDTYNSFI

SEQ ID NO: 1365566 - protein, 9 aa, Homo Sapiens
IPLELPLLL

SEQ ID NO: 1365567 - protein, 9 aa, Homo Sapiens
RRQPGLLLQ

SEQ ID NO: 1365568 - protein, 9 aa, Homo Sapiens
SSTSAHTPT

SEQ ID NO: 1365569 - protein, 9 aa, Homo Sapiens
PCPFPFSLR

SEQ ID NO: 1365570 - protein, 9 aa, Homo Sapiens
SFCTFSRNG

SEQ ID NO: 1365571 - protein, 9 aa, Homo Sapiens
SKEDERQWQ

SEQ ID NO: 1365572 - protein, 9 aa, Homo Sapiens
KVSDPLLTS

SEQ ID NO: 1365573 - protein, 9 aa, Homo Sapiens
SGPLVLENQ

SEQ ID NO: 1365574 - protein, 9 aa, Homo Sapiens
PMVNAGASV

SEQ ID NO: 1365575 - protein, 9 aa, Homo Sapiens
SHTAVQDYS

SEQ ID NO: 1365576 - protein, 9 aa, Homo Sapiens
EQLARILQY

SEQ ID NO: 1365577 - protein, 9 aa, Homo Sapiens
PIDLKDRGD

SEQ ID NO: 1365578 - protein, 9 aa, Homo Sapiens
EQHPAAEEA

SEQ ID NO: 1365579 - protein, 9 aa, Homo Sapiens
LAEKLRCMY

SEQ ID NO: 1365580 - protein, 9 aa, Homo Sapiens
CHVVQPDSV

SEQ ID NO: 1365581 - protein, 9 aa, Homo Sapiens
MQKGWWQGE

SEQ ID NO: 1365582 - protein, 9 aa, Homo Sapiens
GPNRKLIYS

SEQ ID NO: 1365583 - protein, 9 aa, Homo Sapiens
VVIFIIFRI

SEQ ID NO: 1365584 - protein, 9 aa, Homo Sapiens
VTLEQLPES

SEQ ID NO: 1365585 - protein, 9 aa, Homo Sapiens
AQHVVGLHH

SEQ ID NO: 1365586 - protein, 9 aa, Homo Sapiens
VLDSVTGLD

SEQ ID NO: 1365587 - protein, 9 aa, Homo Sapiens
SSGSQQAWG

SEQ ID NO: 1365588 - protein, 9 aa, Homo Sapiens
QERVEHCAK

SEQ ID NO: 1365589 - protein, 9 aa, Homo Sapiens
SGHLPPSSS

SEQ ID NO: 1365590 - protein, 9 aa, Homo Sapiens
EEREKVLKN

SEQ ID NO: 1365591 - protein, 9 aa, Homo Sapiens
GAHHWQEGL

SEQ ID NO: 1365592 - protein, 9 aa, Homo Sapiens
FLKNQIGRT

SEQ ID NO: 1365593 - protein, 9 aa, Homo Sapiens
DGKKMDLDG

SEQ ID NO: 1365594 - protein, 9 aa, Homo Sapiens
YCMPVCCGP

SEQ ID NO: 1365595 - protein, 9 aa, Homo Sapiens
YLERVKRQR

SEQ ID NO: 1365596 - protein, 9 aa, Homo Sapiens
DKEPLIHIQ

SEQ ID NO: 1365597 - protein, 9 aa, Homo Sapiens
FLHFIQLML

SEQ ID NO: 1365598 - protein, 9 aa, Homo Sapiens
MENRLLMRD

SEQ ID NO: 1365599 - protein, 9 aa, Homo Sapiens
RGRGLRAHP

SEQ ID NO: 1365600 - protein, 9 aa, Homo Sapiens
GDVRRHPAS

SEQ ID NO: 1365601 - protein, 9 aa, Homo Sapiens
NVCSLCGAT

SEQ ID NO: 1365602 - protein, 9 aa, Homo Sapiens
GRWVTSGIY

SEQ ID NO: 1365603 - protein, 9 aa, Homo Sapiens
FVHLAHIGS

SEQ ID NO: 1365604 - protein, 9 aa, Homo Sapiens
LTDTAIDAT

SEQ ID NO: 1365605 - protein, 9 aa, Homo Sapiens
RWRRVLPVC

SEQ ID NO: 1365606 - protein, 9 aa, Homo Sapiens
SCRHGYPLS

SEQ ID NO: 1365607 - protein, 9 aa, Homo Sapiens
YYQKMQCDQ

SEQ ID NO: 1365608 - protein, 9 aa, Homo Sapiens
SDGLTSQGL

SEQ ID NO: 1365609 - protein, 9 aa, Homo Sapiens
VLAASAPVL

SEQ ID NO: 1365610 - protein, 9 aa, Homo Sapiens
HHGSHAKDD

SEQ ID NO: 1365611 - protein, 9 aa, Homo Sapiens
VVGVIATLL

SEQ ID NO: 1365612 - protein, 9 aa, Homo Sapiens
VSQVTITMY

SEQ ID NO: 1365613 - protein, 9 aa, Homo Sapiens
TIMPCPMPT

SEQ ID NO: 1365614 - protein, 9 aa, Homo Sapiens
HPGSCPHGS

SEQ ID NO: 1365615 - protein, 9 aa, Homo Sapiens
PLCCCNRHS

SEQ ID NO: 1365616 - protein, 9 aa, Homo Sapiens
FLATLSCSE

SEQ ID NO: 1365617 - protein, 9 aa, Homo Sapiens
EEGQTVPHQ

SEQ ID NO: 1365618 - protein, 9 aa, Homo Sapiens
FKPLAQVPL

SEQ ID NO: 1365619 - protein, 9 aa, Homo Sapiens
PLGMQQNPA

SEQ ID NO: 1365620 - protein, 9 aa, Homo Sapiens
AGKTDANSS

SEQ ID NO: 1365621 - protein, 9 aa, Homo Sapiens
VRDEYEFTE

SEQ ID NO: 1365622 - protein, 9 aa, Homo Sapiens
GMVAFKMGF

SEQ ID NO: 1365623 - protein, 9 aa, Homo Sapiens
PRGNRSLCG

SEQ ID NO: 1365624 - protein, 9 aa, Homo Sapiens
KIPKIETAH

SEQ ID NO: 1365625 - protein, 9 aa, Homo Sapiens
VDDIPDRPT

SEQ ID NO: 1365626 - protein, 9 aa, Homo Sapiens
NNNLNDYSV

SEQ ID NO: 1365627 - protein, 9 aa, Homo Sapiens
DHTRVDEYH

SEQ ID NO: 1365628 - protein, 9 aa, Homo Sapiens
VTHRMAPAI

SEQ ID NO: 1365629 - protein, 9 aa, Homo Sapiens
IITPPPHQM

SEQ ID NO: 1365630 - protein, 9 aa, Homo Sapiens
AGLWSQRHL

SEQ ID NO: 1365631 - protein, 9 aa, Homo Sapiens
TVIGQGLVG

SEQ ID NO: 1365632 - protein, 9 aa, Homo Sapiens
IDSVLAFSR

SEQ ID NO: 1365633 - protein, 9 aa, Homo Sapiens
TSQAFAEQP

SEQ ID NO: 1365634 - protein, 9 aa, Homo Sapiens
TKQAQVLPF

SEQ ID NO: 1365635 - protein, 9 aa, Homo Sapiens
AALERFRSF

SEQ ID NO: 1365636 - protein, 9 aa, Homo Sapiens
AMRSGGDWL

SEQ ID NO: 1365637 - protein, 9 aa, Homo Sapiens
QLSPRVKAL

SEQ ID NO: 1365638 - protein, 9 aa, Homo Sapiens
NVLLLWIRG

SEQ ID NO: 1365639 - protein, 9 aa, Homo Sapiens
LHKCCPSSW

SEQ ID NO: 1365640 - protein, 9 aa, Homo Sapiens
QESGWEHVS

SEQ ID NO: 1365641 - protein, 9 aa, Homo Sapiens
RQMLPTLST

SEQ ID NO: 1365642 - protein, 9 aa, Homo Sapiens
VVLAQTVAS

SEQ ID NO: 1365643 - protein, 9 aa, Homo Sapiens
ELTDTRRPP

SEQ ID NO: 1365644 - protein, 9 aa, Homo Sapiens
GARQVGSVG

SEQ ID NO: 1365645 - protein, 9 aa, Homo Sapiens
TLPPTRSSP

SEQ ID NO: 1365646 - protein, 9 aa, Homo Sapiens
RPTALVAGP

SEQ ID NO: 1365647 - protein, 9 aa, Homo Sapiens
PQYSSPSPA

SEQ ID NO: 1365648 - protein, 9 aa, Homo Sapiens
PSHRETVAP

SEQ ID NO: 1365649 - protein, 9 aa, Homo Sapiens
ALPSTSFFP

SEQ ID NO: 1365650 - protein, 9 aa, Homo Sapiens
EPEHSKEGK

SEQ ID NO: 1365651 - protein, 9 aa, Homo Sapiens
PRGTQPCTS

SEQ ID NO: 1365652 - protein, 9 aa, Homo Sapiens
CQTDPSGTY

SEQ ID NO: 1365653 - protein, 9 aa, Homo Sapiens
QVVVFCMHH

SEQ ID NO: 1365654 - protein, 9 aa, Homo Sapiens
GRSAVVDSM

SEQ ID NO: 1365655 - protein, 9 aa, Homo Sapiens
GIRAHTLAV

SEQ ID NO: 1365656 - protein, 9 aa, Homo Sapiens
NYRLQVSES

SEQ ID NO: 1365657 - protein, 9 aa, Homo Sapiens
VSTQSSGSQ

SEQ ID NO: 1365658 - protein, 9 aa, Homo Sapiens
SWGVCFMWN

SEQ ID NO: 1365659 - protein, 9 aa, Homo Sapiens
SVASVLLCL

SEQ ID NO: 1365660 - protein, 9 aa, Homo Sapiens
SAGGQPESH

SEQ ID NO: 1365661 - protein, 9 aa, Homo Sapiens
VSTATKKVF

SEQ ID NO: 1365662 - protein, 9 aa, Homo Sapiens
GAGPIPISS

SEQ ID NO: 1365663 - protein, 9 aa, Homo Sapiens
GHVHEASPP

SEQ ID NO: 1365664 - protein, 9 aa, Homo Sapiens
CRRRRCFVL

SEQ ID NO: 1365665 - protein, 9 aa, Homo Sapiens
REMSVENCV

SEQ ID NO: 1365666 - protein, 9 aa, Homo Sapiens
GLSQRLFSV

SEQ ID NO: 1365667 - protein, 9 aa, Homo Sapiens
QPRGVVLPS

SEQ ID NO: 1365668 - protein, 9 aa, Homo Sapiens
ACDQPGIAV

SEQ ID NO: 1365669 - protein, 9 aa, Homo Sapiens
AAKLSKAYT

SEQ ID NO: 1365670 - protein, 9 aa, Homo Sapiens
GPSVTSSLS

SEQ ID NO: 1365671 - protein, 9 aa, Homo Sapiens
CDQPGIAVF

SEQ ID NO: 1365672 - protein, 9 aa, Homo Sapiens
TLNCLGKKK

SEQ ID NO: 1365673 - protein, 9 aa, Homo Sapiens
HVVGLHHLQ

SEQ ID NO: 1365674 - protein, 9 aa, Homo Sapiens
QVANENRLS

SEQ ID NO: 1365675 - protein, 9 aa, Homo Sapiens
TSCSGRSST

SEQ ID NO: 1365676 - protein, 9 aa, Homo Sapiens
QLPHPHPTP

SEQ ID NO: 1365677 - protein, 9 aa, Homo Sapiens
EEPGGGPEQ

SEQ ID NO: 1365678 - protein, 9 aa, Homo Sapiens
RRNAFLILD

SEQ ID NO: 1365679 - protein, 9 aa, Homo Sapiens
LVPDLDPLD

SEQ ID NO: 1365680 - protein, 9 aa, Homo Sapiens
SFNITSSTC

SEQ ID NO: 1365681 - protein, 9 aa, Homo Sapiens
APGPLLRWS

SEQ ID NO: 1365682 - protein, 9 aa, Homo Sapiens
EKSLRRSVV

SEQ ID NO: 1365683 - protein, 9 aa, Homo Sapiens
KRFFDGVKD

SEQ ID NO: 1365684 - protein, 9 aa, Homo Sapiens
VVAFGVELT

SEQ ID NO: 1365685 - protein, 9 aa, Homo Sapiens
GQAVSLFAQ

SEQ ID NO: 1365686 - protein, 9 aa, Homo Sapiens
IHIGGRILA

SEQ ID NO: 1365687 - protein, 9 aa, Homo Sapiens
SYIDLSVWC

SEQ ID NO: 1365688 - protein, 9 aa, Homo Sapiens
PGEARAPLE

SEQ ID NO: 1365689 - protein, 9 aa, Homo Sapiens
SSGSLNEKS

SEQ ID NO: 1365690 - protein, 9 aa, Homo Sapiens
FLVLDLCLD

SEQ ID NO: 1365691 - protein, 9 aa, Homo Sapiens
TKSVVISTK

SEQ ID NO: 1365692 - protein, 9 aa, Homo Sapiens
IPGHRGEMG

SEQ ID NO: 1365693 - protein, 9 aa, Homo Sapiens
RVEAAQEMV

SEQ ID NO: 1365694 - protein, 9 aa, Homo Sapiens
MAIQQIMKE

SEQ ID NO: 1365695 - protein, 9 aa, Homo Sapiens
NAQGETKRA

SEQ ID NO: 1365696 - protein, 9 aa, Homo Sapiens
RSPLPSPPG

SEQ ID NO: 1365697 - protein, 9 aa, Homo Sapiens
VYLPGIHGP

SEQ ID NO: 1365698 - protein, 9 aa, Homo Sapiens
EHCAKEAEK

SEQ ID NO: 1365699 - protein, 9 aa, Homo Sapiens
VDFAGSSPK

SEQ ID NO: 1365700 - protein, 9 aa, Homo Sapiens
CTCLPPPSL

SEQ ID NO: 1365701 - protein, 9 aa, Homo Sapiens
KNFVANTCR

SEQ ID NO: 1365702 - protein, 9 aa, Homo Sapiens
KLIYSFKQG

SEQ ID NO: 1365703 - protein, 9 aa, Homo Sapiens
NQIGRTVAS

SEQ ID NO: 1365704 - protein, 9 aa, Homo Sapiens
ESLQACVSK

SEQ ID NO: 1365705 - protein, 9 aa, Homo Sapiens
VGTEGLPLL

SEQ ID NO: 1365706 - protein, 9 aa, Homo Sapiens
ARTPPGGGR

SEQ ID NO: 1365707 - protein, 9 aa, Homo Sapiens
HGLSPRWTL

SEQ ID NO: 1365708 - protein, 9 aa, Homo Sapiens
GGRRRQRRA

SEQ ID NO: 1365709 - protein, 9 aa, Homo Sapiens
AAAVVMVVR

SEQ ID NO: 1365710 - protein, 9 aa, Homo Sapiens
LSSLVVQVL

SEQ ID NO: 1365711 - protein, 9 aa, Homo Sapiens
THPFFNDLE

SEQ ID NO: 1365712 - protein, 9 aa, Homo Sapiens
LTTGSFLSC

SEQ ID NO: 1365713 - protein, 9 aa, Homo Sapiens
PGSGVSVVL

SEQ ID NO: 1365714 - protein, 9 aa, Homo Sapiens
LHQDLVLRP

SEQ ID NO: 1365715 - protein, 9 aa, Homo Sapiens
LGSNCIRAI

SEQ ID NO: 1365716 - protein, 9 aa, Homo Sapiens
PRRPLQTLL

SEQ ID NO: 1365717 - protein, 9 aa, Homo Sapiens
ARAGYERFM

SEQ ID NO: 1365718 - protein, 9 aa, Homo Sapiens
TPVQAWLEA

SEQ ID NO: 1365719 - protein, 9 aa, Homo Sapiens
GHGSKWTLS

SEQ ID NO: 1365720 - protein, 9 aa, Homo Sapiens
VSPCWSLAG

SEQ ID NO: 1365721 - protein, 9 aa, Homo Sapiens
APGLMEEVV

SEQ ID NO: 1365722 - protein, 9 aa, Homo Sapiens
SHSVPDEID

SEQ ID NO: 1365723 - protein, 9 aa, Homo Sapiens
AFAAIGSAV

SEQ ID NO: 1365724 - protein, 9 aa, Homo Sapiens
VWGSDYSHS

SEQ ID NO: 1365725 - protein, 9 aa, Homo Sapiens
TCFFRYMKL

SEQ ID NO: 1365726 - protein, 9 aa, Homo Sapiens
PLQASEFPS

SEQ ID NO: 1365727 - protein, 9 aa, Homo Sapiens
EADLRKKVV

SEQ ID NO: 1365728 - protein, 9 aa, Homo Sapiens
DQSPICAVC

SEQ ID NO: 1365729 - protein, 9 aa, Homo Sapiens
VIFQSPSEN

SEQ ID NO: 1365730 - protein, 9 aa, Homo Sapiens
NRKLIYSFK

SEQ ID NO: 1365731 - protein, 9 aa, Homo Sapiens
DALVSVSAC

SEQ ID NO: 1365732 - protein, 9 aa, Homo Sapiens
STSFFWTYG

SEQ ID NO: 1365733 - protein, 9 aa, Homo Sapiens
RESREIYRG

SEQ ID NO: 1365734 - protein, 9 aa, Homo Sapiens
VVGHMPGEF

SEQ ID NO: 1365735 - protein, 9 aa, Homo Sapiens
TDCGYCSAV

SEQ ID NO: 1365736 - protein, 9 aa, Homo Sapiens
PHGHPPPPP

SEQ ID NO: 1365737 - protein, 9 aa, Homo Sapiens
SPGNSEPLT

SEQ ID NO: 1365738 - protein, 9 aa, Homo Sapiens
VDGSVIRQV

SEQ ID NO: 1365739 - protein, 9 aa, Homo Sapiens
AFYELQHRG

SEQ ID NO: 1365740 - protein, 9 aa, Homo Sapiens
LVNRNVVLV

SEQ ID NO: 1365741 - protein, 9 aa, Homo Sapiens
IDTCQGDSD

SEQ ID NO: 1365742 - protein, 9 aa, Homo Sapiens
KSLTVCLLF

SEQ ID NO: 1365743 - protein, 9 aa, Homo Sapiens
AALSFHKVK

SEQ ID NO: 1365744 - protein, 9 aa, Homo Sapiens
GPTMVAHAV

SEQ ID NO: 1365745 - protein, 9 aa, Homo Sapiens
LSDPSDIIC

SEQ ID NO: 1365746 - protein, 9 aa, Homo Sapiens
MDSCSVLIK

SEQ ID NO: 1365747 - protein, 9 aa, Homo Sapiens
DHEELSGSF

SEQ ID NO: 1365748 - protein, 9 aa, Homo Sapiens
CAGPSCFST

SEQ ID NO: 1365749 - protein, 9 aa, Homo Sapiens
IPAYHPEFI

SEQ ID NO: 1365750 - protein, 9 aa, Homo Sapiens
EPGGGPEQQ

SEQ ID NO: 1365751 - protein, 9 aa, Homo Sapiens
PKKQKLMAR

SEQ ID NO: 1365752 - protein, 9 aa, Homo Sapiens
ITRSTGKDQ

SEQ ID NO: 1365753 - protein, 9 aa, Homo Sapiens
VVMDPKKDV

SEQ ID NO: 1365754 - protein, 9 aa, Homo Sapiens
RLFLDVVVR

SEQ ID NO: 1365755 - protein, 9 aa, Homo Sapiens
SGETGSRSV

SEQ ID NO: 1365756 - protein, 9 aa, Homo Sapiens
TYTNSVCQG

SEQ ID NO: 1365757 - protein, 9 aa, Homo Sapiens
AAINSQINL

SEQ ID NO: 1365758 - protein, 9 aa, Homo Sapiens
SLCKPSSLP

SEQ ID NO: 1365759 - protein, 9 aa, Homo Sapiens
AIYVGPVAI

SEQ ID NO: 1365760 - protein, 9 aa, Homo Sapiens
RGAAVGAGA

SEQ ID NO: 1365761 - protein, 9 aa, Homo Sapiens
MVKLKLKDE

SEQ ID NO: 1365762 - protein, 9 aa, Homo Sapiens
LTSQGLHED

SEQ ID NO: 1365763 - protein, 9 aa, Homo Sapiens
ESIERDGAK

SEQ ID NO: 1365764 - protein, 9 aa, Homo Sapiens
PSCSAHPCD

SEQ ID NO: 1365765 - protein, 9 aa, Homo Sapiens
HEPQGLQDS

SEQ ID NO: 1365766 - protein, 9 aa, Homo Sapiens
ISVNQGSTN

SEQ ID NO: 1365767 - protein, 9 aa, Homo Sapiens
VPGGKGAGN

SEQ ID NO: 1365768 - protein, 9 aa, Homo Sapiens
PKAPKKTLL

SEQ ID NO: 1365769 - protein, 9 aa, Homo Sapiens
HPAAEEAEQ

SEQ ID NO: 1365770 - protein, 9 aa, Homo Sapiens
AGVEVTVRI

SEQ ID NO: 1365771 - protein, 9 aa, Homo Sapiens
TESETPVPV

SEQ ID NO: 1365772 - protein, 9 aa, Homo Sapiens
WNEGCIMGF

SEQ ID NO: 1365773 - protein, 9 aa, Homo Sapiens
RFKRFFCLP

SEQ ID NO: 1365774 - protein, 9 aa, Homo Sapiens
PKAASGCLD

SEQ ID NO: 1365775 - protein, 9 aa, Homo Sapiens
HKLEPWLRK

SEQ ID NO: 1365776 - protein, 9 aa, Homo Sapiens
VGPVAILRH

SEQ ID NO: 1365777 - protein, 9 aa, Homo Sapiens
RDKMRKRRE

SEQ ID NO: 1365778 - protein, 9 aa, Homo Sapiens
PPHRLLGPS

SEQ ID NO: 1365779 - protein, 9 aa, Homo Sapiens
DRNLGSPLM

SEQ ID NO: 1365780 - protein, 9 aa, Homo Sapiens
KIPKSVQSR

SEQ ID NO: 1365781 - protein, 9 aa, Homo Sapiens
ELLEKQGIG

SEQ ID NO: 1365782 - protein, 9 aa, Homo Sapiens
IHSGGALLA

SEQ ID NO: 1365783 - protein, 9 aa, Homo Sapiens
RKRETRKFC

SEQ ID NO: 1365784 - protein, 9 aa, Homo Sapiens
IENERDSLE

SEQ ID NO: 1365785 - protein, 9 aa, Homo Sapiens
EAQPLQPPR

SEQ ID NO: 1365786 - protein, 9 aa, Homo Sapiens
LRDGGIMYA

SEQ ID NO: 1365787 - protein, 9 aa, Homo Sapiens
NTPAAEDRT

SEQ ID NO: 1365788 - protein, 9 aa, Homo Sapiens
NIAIPNGEI

SEQ ID NO: 1365789 - protein, 9 aa, Homo Sapiens
DPNNVLIEQ

SEQ ID NO: 1365790 - protein, 9 aa, Homo Sapiens
WSAGLAPSL

SEQ ID NO: 1365791 - protein, 9 aa, Homo Sapiens
PSRKAFRRF

SEQ ID NO: 1365792 - protein, 9 aa, Homo Sapiens
AGQEADGVD

SEQ ID NO: 1365793 - protein, 9 aa, Homo Sapiens
NAHVGGNVT

SEQ ID NO: 1365794 - protein, 9 aa, Homo Sapiens
EKYVETKSP

SEQ ID NO: 1365795 - protein, 9 aa, Homo Sapiens
PGTKQGANA

SEQ ID NO: 1365796 - protein, 9 aa, Homo Sapiens
CHSSGGPGC

SEQ ID NO: 1365797 - protein, 9 aa, Homo Sapiens
SPLPPQLSV

SEQ ID NO: 1365798 - protein, 9 aa, Homo Sapiens
QAEGYPTYT

SEQ ID NO: 1365799 - protein, 9 aa, Homo Sapiens
HIEDTPIYG

SEQ ID NO: 1365800 - protein, 9 aa, Homo Sapiens
EAETNQDNA

SEQ ID NO: 1365801 - protein, 9 aa, Homo Sapiens
YPEYQNRKL

SEQ ID NO: 1365802 - protein, 9 aa, Homo Sapiens
GPQRDSVFR

SEQ ID NO: 1365803 - protein, 9 aa, Homo Sapiens
PRSGRFLGC

SEQ ID NO: 1365804 - protein, 9 aa, Homo Sapiens
AGYTKRLRK

SEQ ID NO: 1365805 - protein, 9 aa, Homo Sapiens
YSCMLGKKR

SEQ ID NO: 1365806 - protein, 9 aa, Homo Sapiens
RISVCGCLA

SEQ ID NO: 1365807 - protein, 9 aa, Homo Sapiens
VEAAQEMVA

SEQ ID NO: 1365808 - protein, 9 aa, Homo Sapiens
GTVKLFDFP

SEQ ID NO: 1365809 - protein, 9 aa, Homo Sapiens
FNQNRDGTY

SEQ ID NO: 1365810 - protein, 9 aa, Homo Sapiens
HEITFCIQN

SEQ ID NO: 1365811 - protein, 9 aa, Homo Sapiens
VRSLVNAQQ

SEQ ID NO: 1365812 - protein, 9 aa, Homo Sapiens
VRYILKDYV

SEQ ID NO: 1365813 - protein, 9 aa, Homo Sapiens
PSRGVPIGG

SEQ ID NO: 1365814 - protein, 9 aa, Homo Sapiens
ESGKVHALQ

SEQ ID NO: 1365815 - protein, 9 aa, Homo Sapiens
EELTQHPAT

SEQ ID NO: 1365816 - protein, 9 aa, Homo Sapiens
CIGEKLFME

SEQ ID NO: 1365817 - protein, 9 aa, Homo Sapiens
AELTGLSPG

SEQ ID NO: 1365818 - protein, 9 aa, Homo Sapiens
AGLEKNHCR

SEQ ID NO: 1365819 - protein, 9 aa, Homo Sapiens
LHRTALSWP

SEQ ID NO: 1365820 - protein, 9 aa, Homo Sapiens
IMLESYKKH

SEQ ID NO: 1365821 - protein, 9 aa, Homo Sapiens
IAERNLSDL

SEQ ID NO: 1365822 - protein, 9 aa, Homo Sapiens
KASSRGTRL

SEQ ID NO: 1365823 - protein, 9 aa, Homo Sapiens
CSLYSHNDV

SEQ ID NO: 1365824 - protein, 9 aa, Homo Sapiens
SLVVQVLQF

SEQ ID NO: 1365825 - protein, 9 aa, Homo Sapiens
RKNKETIRH

SEQ ID NO: 1365826 - protein, 9 aa, Homo Sapiens
GKKRFRNAE

SEQ ID NO: 1365827 - protein, 9 aa, Homo Sapiens
DPAAAFPPP

SEQ ID NO: 1365828 - protein, 9 aa, Homo Sapiens
SENRTMQLV

SEQ ID NO: 1365829 - protein, 9 aa, Homo Sapiens
EAYSKACRK

SEQ ID NO: 1365830 - protein, 9 aa, Homo Sapiens
LKAGQNTRP

SEQ ID NO: 1365831 - protein, 9 aa, Homo Sapiens
LNIITPPPH

SEQ ID NO: 1365832 - protein, 9 aa, Homo Sapiens
EDVIHSGGA

SEQ ID NO: 1365833 - protein, 9 aa, Homo Sapiens
ATTAPSVLT

SEQ ID NO: 1365834 - protein, 9 aa, Homo Sapiens
DQNKHKEAA

SEQ ID NO: 1365835 - protein, 9 aa, Homo Sapiens
CLCKYGSVT

SEQ ID NO: 1365836 - protein, 9 aa, Homo Sapiens
RTALSWPDQ

SEQ ID NO: 1365837 - protein, 9 aa, Homo Sapiens
ASTQRSVWH

SEQ ID NO: 1365838 - protein, 9 aa, Homo Sapiens
TSEVTRLLA

SEQ ID NO: 1365839 - protein, 9 aa, Homo Sapiens
LAARIAERN

SEQ ID NO: 1365840 - protein, 9 aa, Homo Sapiens
KGLVIHHAL

SEQ ID NO: 1365841 - protein, 9 aa, Homo Sapiens
KKLKLAPLQ

SEQ ID NO: 1365842 - protein, 9 aa, Homo Sapiens
EFIKMTFID

SEQ ID NO: 1365843 - protein, 9 aa, Homo Sapiens
SQAVPHRLA

SEQ ID NO: 1365844 - protein, 9 aa, Homo Sapiens
LVMHNFEHY

SEQ ID NO: 1365845 - protein, 9 aa, Homo Sapiens
CRQMLPTLS

SEQ ID NO: 1365846 - protein, 9 aa, Homo Sapiens
SRPPRRRVT

SEQ ID NO: 1365847 - protein, 9 aa, Homo Sapiens
VRPYRAWCH

SEQ ID NO: 1365848 - protein, 9 aa, Homo Sapiens
VEHYSRKVF

SEQ ID NO: 1365849 - protein, 9 aa, Homo Sapiens
QVGRFAMEL

SEQ ID NO: 1365850 - protein, 9 aa, Homo Sapiens
LANRGHAEL

SEQ ID NO: 1365851 - protein, 9 aa, Homo Sapiens
NFVTAVLSK

SEQ ID NO: 1365852 - protein, 9 aa, Homo Sapiens
FNFEFIDLR

SEQ ID NO: 1365853 - protein, 9 aa, Homo Sapiens
EAAIGTTPF

SEQ ID NO: 1365854 - protein, 9 aa, Homo Sapiens
SVVWFPLKI

SEQ ID NO: 1365855 - protein, 9 aa, Homo Sapiens
SAMHFLTAV

SEQ ID NO: 1365856 - protein, 9 aa, Homo Sapiens
LLEYPKHME

SEQ ID NO: 1365857 - protein, 9 aa, Homo Sapiens
LQFYAGMVI

SEQ ID NO: 1365858 - protein, 9 aa, Homo Sapiens
DDEWEKNIE

SEQ ID NO: 1365859 - protein, 9 aa, Homo Sapiens
ADTLPYTAT

SEQ ID NO: 1365860 - protein, 9 aa, Homo Sapiens
GLTLTTLLG

SEQ ID NO: 1365861 - protein, 9 aa, Homo Sapiens
CHCLLTSSE

SEQ ID NO: 1365862 - protein, 9 aa, Homo Sapiens
WNDASCDRK

SEQ ID NO: 1365863 - protein, 9 aa, Homo Sapiens
EEEEEVVVE

SEQ ID NO: 1365864 - protein, 9 aa, Homo Sapiens
LSTTCIQLH

SEQ ID NO: 1365865 - protein, 9 aa, Homo Sapiens
APDQPPQFL

SEQ ID NO: 1365866 - protein, 9 aa, Homo Sapiens
NSPVRDEYE

SEQ ID NO: 1365867 - protein, 9 aa, Homo Sapiens
ECLHEDLHP

SEQ ID NO: 1365868 - protein, 9 aa, Homo Sapiens
HPKHEGIFS

SEQ ID NO: 1365869 - protein, 9 aa, Homo Sapiens
PEEYEGGIS

SEQ ID NO: 1365870 - protein, 9 aa, Homo Sapiens
GRSGPWGKS

SEQ ID NO: 1365871 - protein, 9 aa, Homo Sapiens
VGVYTRNRN

SEQ ID NO: 1365872 - protein, 9 aa, Homo Sapiens
CITSSIHSK

SEQ ID NO: 1365873 - protein, 9 aa, Homo Sapiens
FLIDVVPRD

SEQ ID NO: 1365874 - protein, 9 aa, Homo Sapiens
PRSAFLLAF

SEQ ID NO: 1365875 - protein, 9 aa, Homo Sapiens
SGSFTNLAD

SEQ ID NO: 1365876 - protein, 9 aa, Homo Sapiens
PSTAWSMAP

SEQ ID NO: 1365877 - protein, 9 aa, Homo Sapiens
GKIERVSAE

SEQ ID NO: 1365878 - protein, 9 aa, Homo Sapiens
IQWAPYRQK

SEQ ID NO: 1365879 - protein, 9 aa, Homo Sapiens
PGWKRKRWE

SEQ ID NO: 1365880 - protein, 9 aa, Homo Sapiens
VCCKPVYCM

SEQ ID NO: 1365881 - protein, 9 aa, Homo Sapiens
RVNLRPAVQ

SEQ ID NO: 1365882 - protein, 9 aa, Homo Sapiens
LAEKKQFDP

SEQ ID NO: 1365883 - protein, 9 aa, Homo Sapiens
TTAIGGGVA

SEQ ID NO: 1365884 - protein, 9 aa, Homo Sapiens
CSMGQTWGP

SEQ ID NO: 1365885 - protein, 9 aa, Homo Sapiens
CSPCSSFSR

SEQ ID NO: 1365886 - protein, 9 aa, Homo Sapiens
NGLGVTGRI

SEQ ID NO: 1365887 - protein, 9 aa, Homo Sapiens
GMQQNPART

SEQ ID NO: 1365888 - protein, 9 aa, Homo Sapiens
APVMRTVGI

SEQ ID NO: 1365889 - protein, 9 aa, Homo Sapiens
LQEFSQQAI

SEQ ID NO: 1365890 - protein, 9 aa, Homo Sapiens
VAHLLQRGN

SEQ ID NO: 1365891 - protein, 9 aa, Homo Sapiens
CTDYIGSRT

SEQ ID NO: 1365892 - protein, 9 aa, Homo Sapiens
TFEGPLLNH

SEQ ID NO: 1365893 - protein, 9 aa, Homo Sapiens
PDIDRQTVE

SEQ ID NO: 1365894 - protein, 9 aa, Homo Sapiens
CQSRTSSIY

SEQ ID NO: 1365895 - protein, 9 aa, Homo Sapiens
WSGDSCDGE

SEQ ID NO: 1365896 - protein, 9 aa, Homo Sapiens
QRSAGELEI

SEQ ID NO: 1365897 - protein, 9 aa, Homo Sapiens
ARHVVMQKL

SEQ ID NO: 1365898 - protein, 9 aa, Homo Sapiens
GKDIRNHVV

SEQ ID NO: 1365899 - protein, 9 aa, Homo Sapiens
PMENGSGSR

SEQ ID NO: 1365900 - protein, 9 aa, Homo Sapiens
AADPMPAAT

SEQ ID NO: 1365901 - protein, 9 aa, Homo Sapiens
PSSPPPPLP

SEQ ID NO: 1365902 - protein, 9 aa, Homo Sapiens
AGGPAGWAR

SEQ ID NO: 1365903 - protein, 9 aa, Homo Sapiens
PHRLLGPSR

SEQ ID NO: 1365904 - protein, 9 aa, Homo Sapiens
WIRGTEISL

SEQ ID NO: 1365905 - protein, 9 aa, Homo Sapiens
ERSRKESYS

SEQ ID NO: 1365906 - protein, 9 aa, Homo Sapiens
QPPPPPPAA

SEQ ID NO: 1365907 - protein, 9 aa, Homo Sapiens
AIVDLQMLT

SEQ ID NO: 1365908 - protein, 9 aa, Homo Sapiens
DEDGYYQKM

SEQ ID NO: 1365909 - protein, 9 aa, Homo Sapiens
KRDMSIHDV

SEQ ID NO: 1365910 - protein, 9 aa, Homo Sapiens
AVYVYRSGV

SEQ ID NO: 1365911 - protein, 9 aa, Homo Sapiens
GHPGSCPHG

SEQ ID NO: 1365912 - protein, 9 aa, Homo Sapiens
AGRPGLPGD

SEQ ID NO: 1365913 - protein, 9 aa, Homo Sapiens
LGLLGPPGH

SEQ ID NO: 1365914 - protein, 9 aa, Homo Sapiens
PTTAPPALP

SEQ ID NO: 1365915 - protein, 9 aa, Homo Sapiens
QPDQPRSVR

SEQ ID NO: 1365916 - protein, 9 aa, Homo Sapiens
MAEGHGGLR

SEQ ID NO: 1365917 - protein, 9 aa, Homo Sapiens
LNPAVHFPQ

SEQ ID NO: 1365918 - protein, 9 aa, Homo Sapiens
LRHIVDEAN

SEQ ID NO: 1365919 - protein, 9 aa, Homo Sapiens
REEQGMGPE

SEQ ID NO: 1365920 - protein, 9 aa, Homo Sapiens
QGLPASRTT

SEQ ID NO: 1365921 - protein, 9 aa, Homo Sapiens
EQDMKVFGV

SEQ ID NO: 1365922 - protein, 9 aa, Homo Sapiens
LQPVKKRRV

SEQ ID NO: 1365923 - protein, 9 aa, Homo Sapiens
LFPSKDQPL

SEQ ID NO: 1365924 - protein, 9 aa, Homo Sapiens
GAVILHRKE

SEQ ID NO: 1365925 - protein, 9 aa, Homo Sapiens
WAPEPSTVR

SEQ ID NO: 1365926 - protein, 9 aa, Homo Sapiens
WQHHEITFC

SEQ ID NO: 1365927 - protein, 9 aa, Homo Sapiens
RVTPRDPLL

SEQ ID NO: 1365928 - protein, 9 aa, Homo Sapiens
DISILPLQA

SEQ ID NO: 1365929 - protein, 9 aa, Homo Sapiens
PLEITRSFN

SEQ ID NO: 1365930 - protein, 9 aa, Homo Sapiens
VMEPAHAWF

SEQ ID NO: 1365931 - protein, 9 aa, Homo Sapiens
ALAQLRVHM

SEQ ID NO: 1365932 - protein, 9 aa, Homo Sapiens
ICHRGFLSS

SEQ ID NO: 1365933 - protein, 9 aa, Homo Sapiens
PLCSCCIPD

SEQ ID NO: 1365934 - protein, 9 aa, Homo Sapiens
AERGEPGRQ

SEQ ID NO: 1365935 - protein, 9 aa, Homo Sapiens
PEEERIRHS

SEQ ID NO: 1365936 - protein, 9 aa, Homo Sapiens
GWRSTGPLW

SEQ ID NO: 1365937 - protein, 9 aa, Homo Sapiens
DMCPDTPQL

SEQ ID NO: 1365938 - protein, 9 aa, Homo Sapiens
PKRPPKENL

SEQ ID NO: 1365939 - protein, 9 aa, Homo Sapiens
DRDSHRSQP

SEQ ID NO: 1365940 - protein, 9 aa, Homo Sapiens
KKYNVENQE

SEQ ID NO: 1365941 - protein, 9 aa, Homo Sapiens
LAESPFKVH

SEQ ID NO: 1365942 - protein, 9 aa, Homo Sapiens
EDLHPTSKT

SEQ ID NO: 1365943 - protein, 9 aa, Homo Sapiens
GKVLIGLCF

SEQ ID NO: 1365944 - protein, 9 aa, Homo Sapiens
DLCLPALGS

SEQ ID NO: 1365945 - protein, 9 aa, Homo Sapiens
LPVGCRPLC

SEQ ID NO: 1365946 - protein, 9 aa, Homo Sapiens
PLVSGYVTE

SEQ ID NO: 1365947 - protein, 9 aa, Homo Sapiens
LDFQEEPMT

SEQ ID NO: 1365948 - protein, 9 aa, Homo Sapiens
DECGNTFRH

SEQ ID NO: 1365949 - protein, 9 aa, Homo Sapiens
EEYEGGISV

SEQ ID NO: 1365950 - protein, 9 aa, Homo Sapiens
NIFRKDPLQ

SEQ ID NO: 1365951 - protein, 9 aa, Homo Sapiens
RGGGNPSHR

SEQ ID NO: 1365952 - protein, 9 aa, Homo Sapiens
RNPTPIPTP

SEQ ID NO: 1365953 - protein, 9 aa, Homo Sapiens
GLSESETGH

SEQ ID NO: 1365954 - protein, 9 aa, Homo Sapiens
PALRGHSLD

SEQ ID NO: 1365955 - protein, 9 aa, Homo Sapiens
MAPAHVPAP

SEQ ID NO: 1365956 - protein, 9 aa, Homo Sapiens
AGLGCVAEL

SEQ ID NO: 1365957 - protein, 9 aa, Homo Sapiens
GKTFDSVVM

SEQ ID NO: 1365958 - protein, 9 aa, Homo Sapiens
ELYHTAMYR

SEQ ID NO: 1365959 - protein, 9 aa, Homo Sapiens
RGLGTELSL

SEQ ID NO: 1365960 - protein, 9 aa, Homo Sapiens
RGGRKSGNP

SEQ ID NO: 1365961 - protein, 9 aa, Homo Sapiens
LWGRSGPWG

SEQ ID NO: 1365962 - protein, 9 aa, Homo Sapiens
PLPKEEKKR

SEQ ID NO: 1365963 - protein, 9 aa, Homo Sapiens
GCCLRIHCV

SEQ ID NO: 1365964 - protein, 9 aa, Homo Sapiens
YNVENQEYL

SEQ ID NO: 1365965 - protein, 9 aa, Homo Sapiens
QLVVLVNDS

SEQ ID NO: 1365966 - protein, 9 aa, Homo Sapiens
PHQAQDKLQ

SEQ ID NO: 1365967 - protein, 9 aa, Homo Sapiens
ASRKTWQRR

SEQ ID NO: 1365968 - protein, 9 aa, Homo Sapiens
KYPKKFCPL

SEQ ID NO: 1365969 - protein, 9 aa, Homo Sapiens
AINNSDFWT

SEQ ID NO: 1365970 - protein, 9 aa, Homo Sapiens
MDRPLRIGK

SEQ ID NO: 1365971 - protein, 9 aa, Homo Sapiens
PIVIGLTLT

SEQ ID NO: 1365972 - protein, 9 aa, Homo Sapiens
AQVRRSAAA

SEQ ID NO: 1365973 - protein, 9 aa, Homo Sapiens
GGTGVWLCL

SEQ ID NO: 1365974 - protein, 9 aa, Homo Sapiens
PLGTHPGGS

SEQ ID NO: 1365975 - protein, 9 aa, Homo Sapiens
LDLCFDVLD

SEQ ID NO: 1365976 - protein, 9 aa, Homo Sapiens
YERIPVPCV

SEQ ID NO: 1365977 - protein, 9 aa, Homo Sapiens
HPFRRRAAG

SEQ ID NO: 1365978 - protein, 9 aa, Homo Sapiens
DSCIGEKLF

SEQ ID NO: 1365979 - protein, 9 aa, Homo Sapiens
GVTGLHLEG

SEQ ID NO: 1365980 - protein, 9 aa, Homo Sapiens
QVFTLPTPF

SEQ ID NO: 1365981 - protein, 9 aa, Homo Sapiens
SYSIQDLFA

SEQ ID NO: 1365982 - protein, 9 aa, Homo Sapiens
EIKKSLRHP

SEQ ID NO: 1365983 - protein, 9 aa, Homo Sapiens
VPQNYHIPA

SEQ ID NO: 1365984 - protein, 9 aa, Homo Sapiens
KVEAPGQLV

SEQ ID NO: 1365985 - protein, 9 aa, Homo Sapiens
HRMAPAIVT

SEQ ID NO: 1365986 - protein, 9 aa, Homo Sapiens
PEEPQYGEN

SEQ ID NO: 1365987 - protein, 9 aa, Homo Sapiens
LLHKCCPSS

SEQ ID NO: 1365988 - protein, 9 aa, Homo Sapiens
NEGREGLIQ

SEQ ID NO: 1365989 - protein, 9 aa, Homo Sapiens
QQSRLDELR

SEQ ID NO: 1365990 - protein, 9 aa, Homo Sapiens
YEGGISVLR

SEQ ID NO: 1365991 - protein, 9 aa, Homo Sapiens
WRSTGPLWK

SEQ ID NO: 1365992 - protein, 9 aa, Homo Sapiens
GGAPHEAHY

SEQ ID NO: 1365993 - protein, 9 aa, Homo Sapiens
RLYVLKEEP

SEQ ID NO: 1365994 - protein, 9 aa, Homo Sapiens
DGASSGGAR

SEQ ID NO: 1365995 - protein, 9 aa, Homo Sapiens
KTCASHIGW

SEQ ID NO: 1365996 - protein, 9 aa, Homo Sapiens
DVNRRFRPH

SEQ ID NO: 1365997 - protein, 9 aa, Homo Sapiens
FRETRRRLG

SEQ ID NO: 1365998 - protein, 9 aa, Homo Sapiens
IVGPQVVVF

SEQ ID NO: 1365999 - protein, 9 aa, Homo Sapiens
VHLIYVVEG

SEQ ID NO: 1366000 - protein, 9 aa, Homo Sapiens
VYGQKQILK

SEQ ID NO: 1366001 - protein, 9 aa, Homo Sapiens
DVRRHPASC

SEQ ID NO: 1366002 - protein, 9 aa, Homo Sapiens
EAEGAHHWQ

SEQ ID NO: 1366003 - protein, 9 aa, Homo Sapiens
QGQDWCQEG

SEQ ID NO: 1366004 - protein, 9 aa, Homo Sapiens
RSHTRTHLK

SEQ ID NO: 1366005 - protein, 9 aa, Homo Sapiens
LDEAWEDLQ

SEQ ID NO: 1366006 - protein, 9 aa, Homo Sapiens
FDKVHFSHI

SEQ ID NO: 1366007 - protein, 9 aa, Homo Sapiens
WGDTGRPHG

SEQ ID NO: 1366008 - protein, 9 aa, Homo Sapiens
LRPPHIAPR

SEQ ID NO: 1366009 - protein, 9 aa, Homo Sapiens
VEAPHQKVL

SEQ ID NO: 1366010 - protein, 9 aa, Homo Sapiens
GLGGQHTRG

SEQ ID NO: 1366011 - protein, 9 aa, Homo Sapiens
QVQPKLQRQ

SEQ ID NO: 1366012 - protein, 9 aa, Homo Sapiens
GDQKASSRG

SEQ ID NO: 1366013 - protein, 9 aa, Homo Sapiens
LNHIAAGAG

SEQ ID NO: 1366014 - protein, 9 aa, Homo Sapiens
VDDEELTQH

SEQ ID NO: 1366015 - protein, 9 aa, Homo Sapiens
QVTPRAGAT

SEQ ID NO: 1366016 - protein, 9 aa, Homo Sapiens
SPASTASSS

SEQ ID NO: 1366017 - protein, 9 aa, Homo Sapiens
PKWCNVTQE

SEQ ID NO: 1366018 - protein, 9 aa, Homo Sapiens
RMVLLCEAA

SEQ ID NO: 1366019 - protein, 9 aa, Homo Sapiens
SGRITEELL

SEQ ID NO: 1366020 - protein, 9 aa, Homo Sapiens
TILNGLGVT

SEQ ID NO: 1366021 - protein, 9 aa, Homo Sapiens
LYHSVKMGR

SEQ ID NO: 1366022 - protein, 9 aa, Homo Sapiens
MAPAIVTLG

SEQ ID NO: 1366023 - protein, 9 aa, Homo Sapiens
QKTVTQLIN

SEQ ID NO: 1366024 - protein, 9 aa, Homo Sapiens
RKERQWSLT

SEQ ID NO: 1366025 - protein, 9 aa, Homo Sapiens
MVLAHDLAS

SEQ ID NO: 1366026 - protein, 9 aa, Homo Sapiens
VKPQMALEL

SEQ ID NO: 1366027 - protein, 9 aa, Homo Sapiens
WWQGEEDRE

SEQ ID NO: 1366028 - protein, 9 aa, Homo Sapiens
FGFRNALEG

SEQ ID NO: 1366029 - protein, 9 aa, Homo Sapiens
LLGLHVLQV

SEQ ID NO: 1366030 - protein, 9 aa, Homo Sapiens
RGCWWGQLS

SEQ ID NO: 1366031 - protein, 9 aa, Homo Sapiens
SWISPAINN

SEQ ID NO: 1366032 - protein, 9 aa, Homo Sapiens
ESPRKKFPQ

SEQ ID NO: 1366033 - protein, 9 aa, Homo Sapiens
TFPELLRYL

SEQ ID NO: 1366034 - protein, 9 aa, Homo Sapiens
LTLQPGVTA

SEQ ID NO: 1366035 - protein, 9 aa, Homo Sapiens
TVGESARIQ

SEQ ID NO: 1366036 - protein, 9 aa, Homo Sapiens
LSDSPPLQD

SEQ ID NO: 1366037 - protein, 9 aa, Homo Sapiens
RADHPPAPR

SEQ ID NO: 1366038 - protein, 9 aa, Homo Sapiens
RPTTAPPAL

SEQ ID NO: 1366039 - protein, 9 aa, Homo Sapiens
LKSWEVIFG

SEQ ID NO: 1366040 - protein, 9 aa, Homo Sapiens
RYDDCRDYD

SEQ ID NO: 1366041 - protein, 9 aa, Homo Sapiens
VLALPLRLC

SEQ ID NO: 1366042 - protein, 9 aa, Homo Sapiens
SFFASCLIM

SEQ ID NO: 1366043 - protein, 9 aa, Homo Sapiens
CTILEWLKL

SEQ ID NO: 1366044 - protein, 9 aa, Homo Sapiens
GKKTLFFFK

SEQ ID NO: 1366045 - protein, 9 aa, Homo Sapiens
TAVDCLQAF

SEQ ID NO: 1366046 - protein, 9 aa, Homo Sapiens
SVKMGRGPL

SEQ ID NO: 1366047 - protein, 9 aa, Homo Sapiens
TMLSVRPCS

SEQ ID NO: 1366048 - protein, 9 aa, Homo Sapiens
GFGSTVACY

SEQ ID NO: 1366049 - protein, 9 aa, Homo Sapiens
PSSQFRAPS

SEQ ID NO: 1366050 - protein, 9 aa, Homo Sapiens
PRPPQPRPR

SEQ ID NO: 1366051 - protein, 9 aa, Homo Sapiens
RLPQRIDRL

SEQ ID NO: 1366052 - protein, 9 aa, Homo Sapiens
VEEENLAEN

SEQ ID NO: 1366053 - protein, 9 aa, Homo Sapiens
ERGRGLRAH

SEQ ID NO: 1366054 - protein, 9 aa, Homo Sapiens
AGPSVTSSL

SEQ ID NO: 1366055 - protein, 9 aa, Homo Sapiens
LYEESKTRI

SEQ ID NO: 1366056 - protein, 9 aa, Homo Sapiens
FPTAEQDDP

SEQ ID NO: 1366057 - protein, 9 aa, Homo Sapiens
QGHGQQGQA

SEQ ID NO: 1366058 - protein, 9 aa, Homo Sapiens
RIHKVTKVL

SEQ ID NO: 1366059 - protein, 9 aa, Homo Sapiens
SGKIKSYKR

SEQ ID NO: 1366060 - protein, 9 aa, Homo Sapiens
HNDVGLKSN

SEQ ID NO: 1366061 - protein, 9 aa, Homo Sapiens
VLQVEAPHQ

SEQ ID NO: 1366062 - protein, 9 aa, Homo Sapiens
RGRRADHPP

SEQ ID NO: 1366063 - protein, 9 aa, Homo Sapiens
RRAHNAKHR

SEQ ID NO: 1366064 - protein, 9 aa, Homo Sapiens
LLHQLRNVM

SEQ ID NO: 1366065 - protein, 9 aa, Homo Sapiens
HLEGDGLTS

SEQ ID NO: 1366066 - protein, 9 aa, Homo Sapiens
CLILSLDLK

SEQ ID NO: 1366067 - protein, 9 aa, Homo Sapiens
GGSPQTSST

SEQ ID NO: 1366068 - protein, 9 aa, Homo Sapiens
HEDLHPTSK

SEQ ID NO: 1366069 - protein, 9 aa, Homo Sapiens
LVPQNYHIP

SEQ ID NO: 1366070 - protein, 9 aa, Homo Sapiens
NHRNCIIDQ

SEQ ID NO: 1366071 - protein, 9 aa, Homo Sapiens
NREYFKITI

SEQ ID NO: 1366072 - protein, 9 aa, Homo Sapiens
LSPGEARAP

SEQ ID NO: 1366073 - protein, 9 aa, Homo Sapiens
EKGSRCIPA

SEQ ID NO: 1366074 - protein, 9 aa, Homo Sapiens
IGPLYVFGQ

SEQ ID NO: 1366075 - protein, 9 aa, Homo Sapiens
RVITAAAIG

SEQ ID NO: 1366076 - protein, 9 aa, Homo Sapiens
SVEEQPAQL

SEQ ID NO: 1366077 - protein, 9 aa, Homo Sapiens
LKSCRRQLD

SEQ ID NO: 1366078 - protein, 9 aa, Homo Sapiens
TLQPGVTAV

SEQ ID NO: 1366079 - protein, 9 aa, Homo Sapiens
SNLVALPFP

SEQ ID NO: 1366080 - protein, 9 aa, Homo Sapiens
EGVKTNFID

SEQ ID NO: 1366081 - protein, 9 aa, Homo Sapiens
LVGILRCTH

SEQ ID NO: 1366082 - protein, 9 aa, Homo Sapiens
FQMPQSAYT

SEQ ID NO: 1366083 - protein, 9 aa, Homo Sapiens
LLLQQGAVA

SEQ ID NO: 1366084 - protein, 9 aa, Homo Sapiens
KEVEIKRIN

SEQ ID NO: 1366085 - protein, 9 aa, Homo Sapiens
DRIEPASVV

SEQ ID NO: 1366086 - protein, 9 aa, Homo Sapiens
QQRHPQGPC

SEQ ID NO: 1366087 - protein, 9 aa, Homo Sapiens
DYNMVLAHD

SEQ ID NO: 1366088 - protein, 9 aa, Homo Sapiens
EPGFFSSMQ

SEQ ID NO: 1366089 - protein, 9 aa, Homo Sapiens
CAAVGRAWG

SEQ ID NO: 1366090 - protein, 9 aa, Homo Sapiens
GFVWLWFRD

SEQ ID NO: 1366091 - protein, 9 aa, Homo Sapiens
GCAERFVSS

SEQ ID NO: 1366092 - protein, 9 aa, Homo Sapiens
MNFVHLAHI

SEQ ID NO: 1366093 - protein, 9 aa, Homo Sapiens
GADVLTCLL

SEQ ID NO: 1366094 - protein, 9 aa, Homo Sapiens
AMQISFLQE

SEQ ID NO: 1366095 - protein, 9 aa, Homo Sapiens
PGGIGSCIP

SEQ ID NO: 1366096 - protein, 9 aa, Homo Sapiens
KCKTFILCQ

SEQ ID NO: 1366097 - protein, 9 aa, Homo Sapiens
DMKVFGVDL

SEQ ID NO: 1366098 - protein, 9 aa, Homo Sapiens
EVIEFDGGA

SEQ ID NO: 1366099 - protein, 9 aa, Homo Sapiens
LHLQFYAGM

SEQ ID NO: 1366100 - protein, 9 aa, Homo Sapiens
DCPRTMAGP

SEQ ID NO: 1366101 - protein, 9 aa, Homo Sapiens
VKWNKDGCP

SEQ ID NO: 1366102 - protein, 9 aa, Homo Sapiens
TLSEEEREK

SEQ ID NO: 1366103 - protein, 9 aa, Homo Sapiens
KAVKPNLQA

SEQ ID NO: 1366104 - protein, 9 aa, Homo Sapiens
AFAEQPRGV

SEQ ID NO: 1366105 - protein, 9 aa, Homo Sapiens
SPTSCSGRS

SEQ ID NO: 1366106 - protein, 9 aa, Homo Sapiens
LQPGEKKSQ

SEQ ID NO: 1366107 - protein, 9 aa, Homo Sapiens
PSPGYTQGT

SEQ ID NO: 1366108 - protein, 9 aa, Homo Sapiens
HSTARVVPT

SEQ ID NO: 1366109 - protein, 9 aa, Homo Sapiens
AYSKACRKQ

SEQ ID NO: 1366110 - protein, 9 aa, Homo Sapiens
TANMDNDSG

SEQ ID NO: 1366111 - protein, 9 aa, Homo Sapiens
RSPIPQPRL

SEQ ID NO: 1366112 - protein, 9 aa, Homo Sapiens
QEASSGASS

SEQ ID NO: 1366113 - protein, 9 aa, Homo Sapiens
MFFLMCCLF

SEQ ID NO: 1366114 - protein, 9 aa, Homo Sapiens
FFWTYGSCC

SEQ ID NO: 1366115 - protein, 9 aa, Homo Sapiens
ACFIVSGSL

SEQ ID NO: 1366116 - protein, 9 aa, Homo Sapiens
SGDESIPIM

SEQ ID NO: 1366117 - protein, 9 aa, Homo Sapiens
PAALGTCSI

SEQ ID NO: 1366118 - protein, 9 aa, Homo Sapiens
WVSLQLNLG

SEQ ID NO: 1366119 - protein, 9 aa, Homo Sapiens
LQHSKGRDC

SEQ ID NO: 1366120 - protein, 9 aa, Homo Sapiens
PRPASSASP

SEQ ID NO: 1366121 - protein, 9 aa, Homo Sapiens
SKGKIAQTT

SEQ ID NO: 1366122 - protein, 9 aa, Homo Sapiens
EPASPHWFY

SEQ ID NO: 1366123 - protein, 9 aa, Homo Sapiens
ISTRVNNDN

SEQ ID NO: 1366124 - protein, 9 aa, Homo Sapiens
PVCSRCRRR

SEQ ID NO: 1366125 - protein, 9 aa, Homo Sapiens
NDAAESCIQ

SEQ ID NO: 1366126 - protein, 9 aa, Homo Sapiens
PGLAFIAHP

SEQ ID NO: 1366127 - protein, 9 aa, Homo Sapiens
GAGEGAQEQ

SEQ ID NO: 1366128 - protein, 9 aa, Homo Sapiens
SPSGICLSD

SEQ ID NO: 1366129 - protein, 9 aa, Homo Sapiens
SQKIRSPVV

SEQ ID NO: 1366130 - protein, 9 aa, Homo Sapiens
EDCSVSQTT

SEQ ID NO: 1366131 - protein, 9 aa, Homo Sapiens
DLCHQHATQ

SEQ ID NO: 1366132 - protein, 9 aa, Homo Sapiens
KLKRTEIIG

SEQ ID NO: 1366133 - protein, 9 aa, Homo Sapiens
SVFGTSRLV

SEQ ID NO: 1366134 - protein, 9 aa, Homo Sapiens
KNQEARSLL

SEQ ID NO: 1366135 - protein, 9 aa, Homo Sapiens
KKQFDPVEI

SEQ ID NO: 1366136 - protein, 9 aa, Homo Sapiens
SGEAHDIIA

SEQ ID NO: 1366137 - protein, 9 aa, Homo Sapiens
GVTAVIDNF

SEQ ID NO: 1366138 - protein, 9 aa, Homo Sapiens
QFTAVRLSD

SEQ ID NO: 1366139 - protein, 9 aa, Homo Sapiens
CQGDSDGPL

SEQ ID NO: 1366140 - protein, 9 aa, Homo Sapiens
QKKQECLEV

SEQ ID NO: 1366141 - protein, 9 aa, Homo Sapiens
GLKSWEVIF

SEQ ID NO: 1366142 - protein, 9 aa, Homo Sapiens
GSSPGFSHW

SEQ ID NO: 1366143 - protein, 9 aa, Homo Sapiens
LFVKDFVMM

SEQ ID NO: 1366144 - protein, 9 aa, Homo Sapiens
DDPYMTGRI

SEQ ID NO: 1366145 - protein, 9 aa, Homo Sapiens
PDSDSDDDD

SEQ ID NO: 1366146 - protein, 9 aa, Homo Sapiens
VRLRCQSGS

SEQ ID NO: 1366147 - protein, 9 aa, Homo Sapiens
FCTFSRNGV

SEQ ID NO: 1366148 - protein, 9 aa, Homo Sapiens
GSPGIPGHR

SEQ ID NO: 1366149 - protein, 9 aa, Homo Sapiens
TPDSDSDDD

SEQ ID NO: 1366150 - protein, 9 aa, Homo Sapiens
LVDAIVSRD

SEQ ID NO: 1366151 - protein, 9 aa, Homo Sapiens
GFSHWHTST

SEQ ID NO: 1366152 - protein, 9 aa, Homo Sapiens
EEDISHLTA

SEQ ID NO: 1366153 - protein, 9 aa, Homo Sapiens
GLHEDLHPT

SEQ ID NO: 1366154 - protein, 9 aa, Homo Sapiens
LCRRLETSP

SEQ ID NO: 1366155 - protein, 9 aa, Homo Sapiens
PHKLQPIPP

SEQ ID NO: 1366156 - protein, 9 aa, Homo Sapiens
FVLGEQLST

SEQ ID NO: 1366157 - protein, 9 aa, Homo Sapiens
AMHFLTAVN

SEQ ID NO: 1366158 - protein, 9 aa, Homo Sapiens
CGVTSRCVT

SEQ ID NO: 1366159 - protein, 9 aa, Homo Sapiens
LALQEEPEH

SEQ ID NO: 1366160 - protein, 9 aa, Homo Sapiens
GATPIKRRH

SEQ ID NO: 1366161 - protein, 9 aa, Homo Sapiens
EGGISVLRP

SEQ ID NO: 1366162 - protein, 9 aa, Homo Sapiens
LDGMLTVIG

SEQ ID NO: 1366163 - protein, 9 aa, Homo Sapiens
MATHFQQLG

SEQ ID NO: 1366164 - protein, 9 aa, Homo Sapiens
NTNKIEEFL

SEQ ID NO: 1366165 - protein, 9 aa, Homo Sapiens
DEETYDEDD

SEQ ID NO: 1366166 - protein, 9 aa, Homo Sapiens
DLCMMVANI

SEQ ID NO: 1366167 - protein, 9 aa, Homo Sapiens
YQVKPQMAL

SEQ ID NO: 1366168 - protein, 9 aa, Homo Sapiens
RRGDRYDDC

SEQ ID NO: 1366169 - protein, 9 aa, Homo Sapiens
NHVVQRLCE

SEQ ID NO: 1366170 - protein, 9 aa, Homo Sapiens
YDSLGTSCE

SEQ ID NO: 1366171 - protein, 9 aa, Homo Sapiens
DVQSKQLDQ

SEQ ID NO: 1366172 - protein, 9 aa, Homo Sapiens
VPAERGRGL

SEQ ID NO: 1366173 - protein, 9 aa, Homo Sapiens
GLCKGSGPK

SEQ ID NO: 1366174 - protein, 9 aa, Homo Sapiens
ASVCKRAGG

SEQ ID NO: 1366175 - protein, 9 aa, Homo Sapiens
RAVGFIQAE

SEQ ID NO: 1366176 - protein, 9 aa, Homo Sapiens
LRYKLTFVL

SEQ ID NO: 1366177 - protein, 9 aa, Homo Sapiens
EGASKDLQA

SEQ ID NO: 1366178 - protein, 9 aa, Homo Sapiens
DKAGMATHF

SEQ ID NO: 1366179 - protein, 9 aa, Homo Sapiens
TKESETRAV

SEQ ID NO: 1366180 - protein, 9 aa, Homo Sapiens
TFDSVVMDP

SEQ ID NO: 1366181 - protein, 9 aa, Homo Sapiens
KKTEAAAHS

SEQ ID NO: 1366182 - protein, 9 aa, Homo Sapiens
DLKKTVGES

SEQ ID NO: 1366183 - protein, 9 aa, Homo Sapiens
LLKLFVAIA

SEQ ID NO: 1366184 - protein, 9 aa, Homo Sapiens
KKTVGESAR

SEQ ID NO: 1366185 - protein, 9 aa, Homo Sapiens
LDFERSEGN

SEQ ID NO: 1366186 - protein, 9 aa, Homo Sapiens
ALQGGGPPT

SEQ ID NO: 1366187 - protein, 9 aa, Homo Sapiens
VVLQHEIET

SEQ ID NO: 1366188 - protein, 9 aa, Homo Sapiens
HPQPHKLQP

SEQ ID NO: 1366189 - protein, 9 aa, Homo Sapiens
PESPGHPGS

SEQ ID NO: 1366190 - protein, 9 aa, Homo Sapiens
YHFYCELPA

SEQ ID NO: 1366191 - protein, 9 aa, Homo Sapiens
KRFFCLPSR

SEQ ID NO: 1366192 - protein, 9 aa, Homo Sapiens
YRGPSGELE

SEQ ID NO: 1366193 - protein, 9 aa, Homo Sapiens
RVQGFLLHW

SEQ ID NO: 1366194 - protein, 9 aa, Homo Sapiens
GPRTRARAS

SEQ ID NO: 1366195 - protein, 9 aa, Homo Sapiens
LCYFEFTTD

SEQ ID NO: 1366196 - protein, 9 aa, Homo Sapiens
ADFQDLRPG

SEQ ID NO: 1366197 - protein, 9 aa, Homo Sapiens
GQTVCKNNP

SEQ ID NO: 1366198 - protein, 9 aa, Homo Sapiens
RQKKQECLE

SEQ ID NO: 1366199 - protein, 9 aa, Homo Sapiens
AGGCGPSRV

SEQ ID NO: 1366200 - protein, 9 aa, Homo Sapiens
SSAASRRAS

SEQ ID NO: 1366201 - protein, 9 aa, Homo Sapiens
LQEKQNNQT

SEQ ID NO: 1366202 - protein, 9 aa, Homo Sapiens
IESHACRRF

SEQ ID NO: 1366203 - protein, 9 aa, Homo Sapiens
CRDNTELPH

SEQ ID NO: 1366204 - protein, 9 aa, Homo Sapiens
QNHVSRGDV

SEQ ID NO: 1366205 - protein, 9 aa, Homo Sapiens
EMPIDQKKP

SEQ ID NO: 1366206 - protein, 9 aa, Homo Sapiens
HGSTAQHVV

SEQ ID NO: 1366207 - protein, 9 aa, Homo Sapiens
LERVKRQRG

SEQ ID NO: 1366208 - protein, 9 aa, Homo Sapiens
ATVAAARGL

SEQ ID NO: 1366209 - protein, 9 aa, Homo Sapiens
MSVGMYMDS

SEQ ID NO: 1366210 - protein, 9 aa, Homo Sapiens
DSDGPLMCK

SEQ ID NO: 1366211 - protein, 9 aa, Homo Sapiens
ILYKYLATS

SEQ ID NO: 1366212 - protein, 9 aa, Homo Sapiens
AAAWCPCIR

SEQ ID NO: 1366213 - protein, 9 aa, Homo Sapiens
PQVVVFCMH

SEQ ID NO: 1366214 - protein, 9 aa, Homo Sapiens
ARCPRVGCL

SEQ ID NO: 1366215 - protein, 9 aa, Homo Sapiens
TGFQRAVKK

SEQ ID NO: 1366216 - protein, 9 aa, Homo Sapiens
ASWPRGGNA

SEQ ID NO: 1366217 - protein, 9 aa, Homo Sapiens
GQDWCQEGR

SEQ ID NO: 1366218 - protein, 9 aa, Homo Sapiens
EMVADYQQT

SEQ ID NO: 1366219 - protein, 9 aa, Homo Sapiens
RSVTQAGVR

SEQ ID NO: 1366220 - protein, 9 aa, Homo Sapiens
RPQCPAIPH

SEQ ID NO: 1366221 - protein, 9 aa, Homo Sapiens
VKCCAYDSL

SEQ ID NO: 1366222 - protein, 9 aa, Homo Sapiens
SEEDISHLT

SEQ ID NO: 1366223 - protein, 9 aa, Homo Sapiens
CWMAPEVTE

SEQ ID NO: 1366224 - protein, 9 aa, Homo Sapiens
LKELNIKSD

SEQ ID NO: 1366225 - protein, 9 aa, Homo Sapiens
AEQDDPKQQ

SEQ ID NO: 1366226 - protein, 9 aa, Homo Sapiens
AVQLIDIMK

SEQ ID NO: 1366227 - protein, 9 aa, Homo Sapiens
HQVHLIYVV

SEQ ID NO: 1366228 - protein, 9 aa, Homo Sapiens
PRPNYRLQV

SEQ ID NO: 1366229 - protein, 9 aa, Homo Sapiens
LVTGREGCV

SEQ ID NO: 1366230 - protein, 9 aa, Homo Sapiens
VVSNGDGSI

SEQ ID NO: 1366231 - protein, 9 aa, Homo Sapiens
ISSIQSQES

SEQ ID NO: 1366232 - protein, 9 aa, Homo Sapiens
TLKKAVVHY

SEQ ID NO: 1366233 - protein, 9 aa, Homo Sapiens
DAPSCSAHP

SEQ ID NO: 1366234 - protein, 9 aa, Homo Sapiens
MEKNQEARS

SEQ ID NO: 1366235 - protein, 9 aa, Homo Sapiens
PASNFAAVP

SEQ ID NO: 1366236 - protein, 9 aa, Homo Sapiens
LLVPFSLIM

SEQ ID NO: 1366237 - protein, 9 aa, Homo Sapiens
RSWAVQAFK

SEQ ID NO: 1366238 - protein, 9 aa, Homo Sapiens
QRSAQVDVG

SEQ ID NO: 1366239 - protein, 9 aa, Homo Sapiens
AQKPERMET

SEQ ID NO: 1366240 - protein, 9 aa, Homo Sapiens
RAGLEKNHC

SEQ ID NO: 1366241 - protein, 9 aa, Homo Sapiens
QATLCLQSH

SEQ ID NO: 1366242 - protein, 9 aa, Homo Sapiens
FDMHMTVSK

SEQ ID NO: 1366243 - protein, 9 aa, Homo Sapiens
NLSLKECFI

SEQ ID NO: 1366244 - protein, 9 aa, Homo Sapiens
EDKQTGFQR

SEQ ID NO: 1366245 - protein, 9 aa, Homo Sapiens
PAHSLGAVQ

SEQ ID NO: 1366246 - protein, 9 aa, Homo Sapiens
LHHLQVAVE

SEQ ID NO: 1366247 - protein, 9 aa, Homo Sapiens
MGVTWFKIS

SEQ ID NO: 1366248 - protein, 9 aa, Homo Sapiens
TNPASICDG

SEQ ID NO: 1366249 - protein, 9 aa, Homo Sapiens
SSGGARWGP

SEQ ID NO: 1366250 - protein, 9 aa, Homo Sapiens
FVLKFLDPS

SEQ ID NO: 1366251 - protein, 9 aa, Homo Sapiens
RHFEELETS

SEQ ID NO: 1366252 - protein, 9 aa, Homo Sapiens
TCTVRTACR

SEQ ID NO: 1366253 - protein, 9 aa, Homo Sapiens
SHVESASSM

SEQ ID NO: 1366254 - protein, 9 aa, Homo Sapiens
AQNLDFERS

SEQ ID NO: 1366255 - protein, 9 aa, Homo Sapiens
FLILDLCLD

SEQ ID NO: 1366256 - protein, 9 aa, Homo Sapiens
GPRTPRGTQ

SEQ ID NO: 1366257 - protein, 9 aa, Homo Sapiens
NNYNLAMRY

SEQ ID NO: 1366258 - protein, 9 aa, Homo Sapiens
LVRRNAFLV

SEQ ID NO: 1366259 - protein, 9 aa, Homo Sapiens
RSAQVDVGR

SEQ ID NO: 1366260 - protein, 9 aa, Homo Sapiens
GDVHVGLGR

SEQ ID NO: 1366261 - protein, 9 aa, Homo Sapiens
DRVMHAFCY

SEQ ID NO: 1366262 - protein, 9 aa, Homo Sapiens
LKQPEMSIK

SEQ ID NO: 1366263 - protein, 9 aa, Homo Sapiens
LCLDTVPEV

SEQ ID NO: 1366264 - protein, 9 aa, Homo Sapiens
TVKQCGYSE

SEQ ID NO: 1366265 - protein, 9 aa, Homo Sapiens
GASIFQLFP

SEQ ID NO: 1366266 - protein, 9 aa, Homo Sapiens
SSTCSPPSC

SEQ ID NO: 1366267 - protein, 9 aa, Homo Sapiens
RDTSKLMKI

SEQ ID NO: 1366268 - protein, 9 aa, Homo Sapiens
RQAQTQTSP

SEQ ID NO: 1366269 - protein, 9 aa, Homo Sapiens
LLQECKKNY

SEQ ID NO: 1366270 - protein, 9 aa, Homo Sapiens
AAIGSLICG

SEQ ID NO: 1366271 - protein, 9 aa, Homo Sapiens
GMGISTRVN

SEQ ID NO: 1366272 - protein, 9 aa, Homo Sapiens
PSMRVGAPP

SEQ ID NO: 1366273 - protein, 9 aa, Homo Sapiens
DNARKKAPP

SEQ ID NO: 1366274 - protein, 9 aa, Homo Sapiens
GQGAMEELC

SEQ ID NO: 1366275 - protein, 9 aa, Homo Sapiens
LGLHVLQVE

SEQ ID NO: 1366276 - protein, 9 aa, Homo Sapiens
PVQVGKEQH

SEQ ID NO: 1366277 - protein, 9 aa, Homo Sapiens
IDEYKKTYM

SEQ ID NO: 1366278 - protein, 9 aa, Homo Sapiens
LCLVGTEGL

SEQ ID NO: 1366279 - protein, 9 aa, Homo Sapiens
ESVRQIYSE

SEQ ID NO: 1366280 - protein, 9 aa, Homo Sapiens
MHGSSPGFS

SEQ ID NO: 1366281 - protein, 9 aa, Homo Sapiens
GGSPVGPPS

SEQ ID NO: 1366282 - protein, 9 aa, Homo Sapiens
TPTSTNTVS

SEQ ID NO: 1366283 - protein, 9 aa, Homo Sapiens
SRVQNTAKN

SEQ ID NO: 1366284 - protein, 9 aa, Homo Sapiens
EELCAEVQG

SEQ ID NO: 1366285 - protein, 9 aa, Homo Sapiens
RRHVSSDEE

SEQ ID NO: 1366286 - protein, 9 aa, Homo Sapiens
LLHCLLSTS

SEQ ID NO: 1366287 - protein, 9 aa, Homo Sapiens
LQPPRVCRR

SEQ ID NO: 1366288 - protein, 9 aa, Homo Sapiens
SIRGVVTAG

SEQ ID NO: 1366289 - protein, 9 aa, Homo Sapiens
SPAALPPAL

SEQ ID NO: 1366290 - protein, 9 aa, Homo Sapiens
AFTHNECIA

SEQ ID NO: 1366291 - protein, 9 aa, Homo Sapiens
PRVMLNNGA

SEQ ID NO: 1366292 - protein, 9 aa, Homo Sapiens
KSRQCKCGE

SEQ ID NO: 1366293 - protein, 9 aa, Homo Sapiens
PHDERIVIV

SEQ ID NO: 1366294 - protein, 9 aa, Homo Sapiens
RAAGGCGPS

SEQ ID NO: 1366295 - protein, 9 aa, Homo Sapiens
APTTVTHRM

SEQ ID NO: 1366296 - protein, 9 aa, Homo Sapiens
RVVPTRGDV

SEQ ID NO: 1366297 - protein, 9 aa, Homo Sapiens
GPPQLPSIP

SEQ ID NO: 1366298 - protein, 9 aa, Homo Sapiens
LHEDLHPTS

SEQ ID NO: 1366299 - protein, 9 aa, Homo Sapiens
GTARIWNET

SEQ ID NO: 1366300 - protein, 9 aa, Homo Sapiens
NLPFLNSVS

SEQ ID NO: 1366301 - protein, 9 aa, Homo Sapiens
LHQLRNVMV

SEQ ID NO: 1366302 - protein, 9 aa, Homo Sapiens
LCKYFDKAV

SEQ ID NO: 1366303 - protein, 9 aa, Homo Sapiens
RPAGAAVAA

SEQ ID NO: 1366304 - protein, 9 aa, Homo Sapiens
LPKEEKKRE

SEQ ID NO: 1366305 - protein, 9 aa, Homo Sapiens
VVVIISIVC

SEQ ID NO: 1366306 - protein, 9 aa, Homo Sapiens
EIVSMGTDQ

SEQ ID NO: 1366307 - protein, 9 aa, Homo Sapiens
MAGRRSTRP

SEQ ID NO: 1366308 - protein, 9 aa, Homo Sapiens
PLRVQSVLL

SEQ ID NO: 1366309 - protein, 9 aa, Homo Sapiens
GQEQRSAQV

SEQ ID NO: 1366310 - protein, 9 aa, Homo Sapiens
VGIELGYDI

SEQ ID NO: 1366311 - protein, 9 aa, Homo Sapiens
HLGDGKKMD

SEQ ID NO: 1366312 - protein, 9 aa, Homo Sapiens
GRLLHHQAH

SEQ ID NO: 1366313 - protein, 9 aa, Homo Sapiens
HIALLGSLN

SEQ ID NO: 1366314 - protein, 9 aa, Homo Sapiens
HLDLARRTL

SEQ ID NO: 1366315 - protein, 9 aa, Homo Sapiens
FSSMLELSW

SEQ ID NO: 1366316 - protein, 9 aa, Homo Sapiens
RHQAFMAGL

SEQ ID NO: 1366317 - protein, 9 aa, Homo Sapiens
AHTPTRSHT

SEQ ID NO: 1366318 - protein, 9 aa, Homo Sapiens
LRWEPVPRV

SEQ ID NO: 1366319 - protein, 9 aa, Homo Sapiens
AFGVELTEM

SEQ ID NO: 1366320 - protein, 9 aa, Homo Sapiens
SRQESDPGD

SEQ ID NO: 1366321 - protein, 9 aa, Homo Sapiens
KSYNKLKEN

SEQ ID NO: 1366322 - protein, 9 aa, Homo Sapiens
PCSVTVWCC

SEQ ID NO: 1366323 - protein, 9 aa, Homo Sapiens
EYQTLPEEP

SEQ ID NO: 1366324 - protein, 9 aa, Homo Sapiens
IAALEVVEE

SEQ ID NO: 1366325 - protein, 9 aa, Homo Sapiens
RPHEAVGVR

SEQ ID NO: 1366326 - protein, 9 aa, Homo Sapiens
HPGGSLNGP

SEQ ID NO: 1366327 - protein, 9 aa, Homo Sapiens
VDLFHVQES

SEQ ID NO: 1366328 - protein, 9 aa, Homo Sapiens
ETFGWAPEP

SEQ ID NO: 1366329 - protein, 9 aa, Homo Sapiens
NSLQNYTIA

SEQ ID NO: 1366330 - protein, 9 aa, Homo Sapiens
KTDANSSSW

SEQ ID NO: 1366331 - protein, 9 aa, Homo Sapiens
LWLVLVMDC

SEQ ID NO: 1366332 - protein, 9 aa, Homo Sapiens
EGSGVCRLY

SEQ ID NO: 1366333 - protein, 9 aa, Homo Sapiens
PAIVTLGLL

SEQ ID NO: 1366334 - protein, 9 aa, Homo Sapiens
GDEESDLEN

SEQ ID NO: 1366335 - protein, 9 aa, Homo Sapiens
TPGRTYPVE

SEQ ID NO: 1366336 - protein, 9 aa, Homo Sapiens
HILVSLILL

SEQ ID NO: 1366337 - protein, 9 aa, Homo Sapiens
KVLIGLCFR

SEQ ID NO: 1366338 - protein, 9 aa, Homo Sapiens
LRDGYVLPK

SEQ ID NO: 1366339 - protein, 9 aa, Homo Sapiens
SWTVPGGQF

SEQ ID NO: 1366340 - protein, 9 aa, Homo Sapiens
AVLSKLRFE

SEQ ID NO: 1366341 - protein, 9 aa, Homo Sapiens
ELGGHTAHP

SEQ ID NO: 1366342 - protein, 9 aa, Homo Sapiens
CPKTILSSL

SEQ ID NO: 1366343 - protein, 9 aa, Homo Sapiens
KRTEIIGRS

SEQ ID NO: 1366344 - protein, 9 aa, Homo Sapiens
EQDDPKQQP

SEQ ID NO: 1366345 - protein, 9 aa, Homo Sapiens
LQEKLTGAQ

SEQ ID NO: 1366346 - protein, 9 aa, Homo Sapiens
LFARAGYER

SEQ ID NO: 1366347 - protein, 9 aa, Homo Sapiens
EGGNREDGY

SEQ ID NO: 1366348 - protein, 9 aa, Homo Sapiens
ARPFTCFFR

SEQ ID NO: 1366349 - protein, 9 aa, Homo Sapiens
GWAEATVAA

SEQ ID NO: 1366350 - protein, 9 aa, Homo Sapiens
SVVMDPKKD

SEQ ID NO: 1366351 - protein, 9 aa, Homo Sapiens
LLVGILRCT

SEQ ID NO: 1366352 - protein, 9 aa, Homo Sapiens
PRRRAAWWQ

SEQ ID NO: 1366353 - protein, 9 aa, Homo Sapiens
NFRRAHNAK

SEQ ID NO: 1366354 - protein, 9 aa, Homo Sapiens
ASRGHVHEA

SEQ ID NO: 1366355 - protein, 9 aa, Homo Sapiens
CFSTGIRAH

SEQ ID NO: 1366356 - protein, 9 aa, Homo Sapiens
ETHKLEPWL

SEQ ID NO: 1366357 - protein, 9 aa, Homo Sapiens
SLSSCKTWW

SEQ ID NO: 1366358 - protein, 9 aa, Homo Sapiens
GAENNPGLP

SEQ ID NO: 1366359 - protein, 9 aa, Homo Sapiens
QGMEVVQLN

SEQ ID NO: 1366360 - protein, 9 aa, Homo Sapiens
SSLSPSSTS

SEQ ID NO: 1366361 - protein, 9 aa, Homo Sapiens
AVGRAWGLP

SEQ ID NO: 1366362 - protein, 9 aa, Homo Sapiens
TQAWAPTSR

SEQ ID NO: 1366363 - protein, 9 aa, Homo Sapiens
DSMCLESVG

SEQ ID NO: 1366364 - protein, 9 aa, Homo Sapiens
TAWSMAPST

SEQ ID NO: 1366365 - protein, 9 aa, Homo Sapiens
SLKECFIKL

SEQ ID NO: 1366366 - protein, 9 aa, Homo Sapiens
IAITFILIL

SEQ ID NO: 1366367 - protein, 9 aa, Homo Sapiens
VFPPDEKHW

SEQ ID NO: 1366368 - protein, 9 aa, Homo Sapiens
DPDFLKQPE

SEQ ID NO: 1366369 - protein, 9 aa, Homo Sapiens
QGQAGMAPV

SEQ ID NO: 1366370 - protein, 9 aa, Homo Sapiens
LVPFSLIMS

SEQ ID NO: 1366371 - protein, 9 aa, Homo Sapiens
FYTPAFFLL

SEQ ID NO: 1366372 - protein, 9 aa, Homo Sapiens
QEAESGSSD

SEQ ID NO: 1366373 - protein, 9 aa, Homo Sapiens
SVDLLGLLN

SEQ ID NO: 1366374 - protein, 9 aa, Homo Sapiens
EFLWFQLAA

SEQ ID NO: 1366375 - protein, 9 aa, Homo Sapiens
PPRATRRPR

SEQ ID NO: 1366376 - protein, 9 aa, Homo Sapiens
SLTRWHHMR

SEQ ID NO: 1366377 - protein, 9 aa, Homo Sapiens
KPVNWTNSA

SEQ ID NO: 1366378 - protein, 9 aa, Homo Sapiens
PYHVFTHNT

SEQ ID NO: 1366379 - protein, 9 aa, Homo Sapiens
WIYDNQRQF

SEQ ID NO: 1366380 - protein, 9 aa, Homo Sapiens
DRVSSEYTY

SEQ ID NO: 1366381 - protein, 9 aa, Homo Sapiens
RTPDQLYRI

SEQ ID NO: 1366382 - protein, 9 aa, Homo Sapiens
QPQILEVSF

SEQ ID NO: 1366383 - protein, 9 aa, Homo Sapiens
AELKDVQSK

SEQ ID NO: 1366384 - protein, 9 aa, Homo Sapiens
ERGGGLRPQ

SEQ ID NO: 1366385 - protein, 9 aa, Homo Sapiens
SDIDEYKKT

SEQ ID NO: 1366386 - protein, 9 aa, Homo Sapiens
SKKGCSKYG

SEQ ID NO: 1366387 - protein, 9 aa, Homo Sapiens
LSCFNFEFI

SEQ ID NO: 1366388 - protein, 9 aa, Homo Sapiens
ANRSIVPTS

SEQ ID NO: 1366389 - protein, 9 aa, Homo Sapiens
LGQYRATLI

SEQ ID NO: 1366390 - protein, 9 aa, Homo Sapiens
TLKAGQNTR

SEQ ID NO: 1366391 - protein, 9 aa, Homo Sapiens
NMDQIRNWQ

SEQ ID NO: 1366392 - protein, 9 aa, Homo Sapiens
QHRGRELRF

SEQ ID NO: 1366393 - protein, 9 aa, Homo Sapiens
AEEAEQHQG

SEQ ID NO: 1366394 - protein, 9 aa, Homo Sapiens
KMLQKRVEN

SEQ ID NO: 1366395 - protein, 9 aa, Homo Sapiens
VRLPQRIDR

SEQ ID NO: 1366396 - protein, 9 aa, Homo Sapiens
QQFLSSSSR

SEQ ID NO: 1366397 - protein, 9 aa, Homo Sapiens
CTVRTACRY

SEQ ID NO: 1366398 - protein, 9 aa, Homo Sapiens
QPALRGHSL

SEQ ID NO: 1366399 - protein, 9 aa, Homo Sapiens
RHVSSDEEH

SEQ ID NO: 1366400 - protein, 9 aa, Homo Sapiens
VSVSCKPVC

SEQ ID NO: 1366401 - protein, 9 aa, Homo Sapiens
LSSLWNWRE

SEQ ID NO: 1366402 - protein, 9 aa, Homo Sapiens
SLGRLLHHQ

SEQ ID NO: 1366403 - protein, 9 aa, Homo Sapiens
DTVSSCWPG

SEQ ID NO: 1366404 - protein, 9 aa, Homo Sapiens
GDHSNNDRE

SEQ ID NO: 1366405 - protein, 9 aa, Homo Sapiens
TLNIAIPNG

SEQ ID NO: 1366406 - protein, 9 aa, Homo Sapiens
RVAAWLAQH

SEQ ID NO: 1366407 - protein, 9 aa, Homo Sapiens
ACPGAPEPS

SEQ ID NO: 1366408 - protein, 8 aa, Homo Sapiens
SAAQGWDR

SEQ ID NO: 1366409 - protein, 9 aa, Homo Sapiens
TARPSPSQN

SEQ ID NO: 1366410 - protein, 9 aa, Homo Sapiens
TSFFPHCSL

SEQ ID NO: 1366411 - protein, 9 aa, Homo Sapiens
CHISKLSLS

SEQ ID NO: 1366412 - protein, 9 aa, Homo Sapiens
LAELVEFYQ

SEQ ID NO: 1366413 - protein, 9 aa, Homo Sapiens
SGEGCPVSG

SEQ ID NO: 1366414 - protein, 9 aa, Homo Sapiens
ASVQLAGDK

SEQ ID NO: 1366415 - protein, 9 aa, Homo Sapiens
MEFGQIHHL

SEQ ID NO: 1366416 - protein, 9 aa, Homo Sapiens
VGMPSAVSC

SEQ ID NO: 1366417 - protein, 9 aa, Homo Sapiens
HSSGGPGCC

SEQ ID NO: 1366418 - protein, 9 aa, Homo Sapiens
IIVIYNSVF

SEQ ID NO: 1366419 - protein, 9 aa, Homo Sapiens
VRRDAFLVL

SEQ ID NO: 1366420 - protein, 9 aa, Homo Sapiens
QADQEHRVG

SEQ ID NO: 1366421 - protein, 9 aa, Homo Sapiens
PAAPPHRLL

SEQ ID NO: 1366422 - protein, 9 aa, Homo Sapiens
EQLRDREKQ

SEQ ID NO: 1366423 - protein, 9 aa, Homo Sapiens
GHGYYMAVG

SEQ ID NO: 1366424 - protein, 9 aa, Homo Sapiens
AGAGLGCVA

SEQ ID NO: 1366425 - protein, 9 aa, Homo Sapiens
AVKPLAESP

SEQ ID NO: 1366426 - protein, 9 aa, Homo Sapiens
GSFFASCLI

SEQ ID NO: 1366427 - protein, 9 aa, Homo Sapiens
SCIGSFFAS

SEQ ID NO: 1366428 - protein, 9 aa, Homo Sapiens
ERSEGNTIA

SEQ ID NO: 1366429 - protein, 9 aa, Homo Sapiens
CGAVGNNRV

SEQ ID NO: 1366430 - protein, 9 aa, Homo Sapiens
GSPVGPPSS

SEQ ID NO: 1366431 - protein, 9 aa, Homo Sapiens
GHVLAPKDK

SEQ ID NO: 1366432 - protein, 9 aa, Homo Sapiens
LNLLLEYPK

SEQ ID NO: 1366433 - protein, 9 aa, Homo Sapiens
DRLSTTCIQ

SEQ ID NO: 1366434 - protein, 9 aa, Homo Sapiens
LPTLPPTRS

SEQ ID NO: 1366435 - protein, 9 aa, Homo Sapiens
RGAALGGVA

SEQ ID NO: 1366436 - protein, 9 aa, Homo Sapiens
MRQKKQECL

SEQ ID NO: 1366437 - protein, 9 aa, Homo Sapiens
GRHQRGRGG

SEQ ID NO: 1366438 - protein, 9 aa, Homo Sapiens
RILTYQCGI

SEQ ID NO: 1366439 - protein, 9 aa, Homo Sapiens
KSKQNLNAK

SEQ ID NO: 1366440 - protein, 9 aa, Homo Sapiens
NGNPDPEIT

SEQ ID NO: 1366441 - protein, 9 aa, Homo Sapiens
DLLLDEKNN

SEQ ID NO: 1366442 - protein, 9 aa, Homo Sapiens
IGGKFGTSI

SEQ ID NO: 1366443 - protein, 9 aa, Homo Sapiens
GLDLKGDGL

SEQ ID NO: 1366444 - protein, 9 aa, Homo Sapiens
KSWEVIFGY

SEQ ID NO: 1366445 - protein, 9 aa, Homo Sapiens
VGPQVVVFC

SEQ ID NO: 1366446 - protein, 9 aa, Homo Sapiens
PPPGTKQGA

SEQ ID NO: 1366447 - protein, 9 aa, Homo Sapiens
RVGLSGPLV

SEQ ID NO: 1366448 - protein, 9 aa, Homo Sapiens
TNIPAIQEK

SEQ ID NO: 1366449 - protein, 9 aa, Homo Sapiens
GLWNRSPLP

SEQ ID NO: 1366450 - protein, 9 aa, Homo Sapiens
HAKDDAGQE

SEQ ID NO: 1366451 - protein, 9 aa, Homo Sapiens
SAQIQERRS

SEQ ID NO: 1366452 - protein, 9 aa, Homo Sapiens
PVQPRLEGT

SEQ ID NO: 1366453 - protein, 9 aa, Homo Sapiens
PSQAVPHRL

SEQ ID NO: 1366454 - protein, 9 aa, Homo Sapiens
HIGGRILAI

SEQ ID NO: 1366455 - protein, 9 aa, Homo Sapiens
HWLTESGRL

SEQ ID NO: 1366456 - protein, 9 aa, Homo Sapiens
EECGAVGNN

SEQ ID NO: 1366457 - protein, 9 aa, Homo Sapiens
IGNVCHAKG

SEQ ID NO: 1366458 - protein, 9 aa, Homo Sapiens
NKWEIVSMG

SEQ ID NO: 1366459 - protein, 9 aa, Homo Sapiens
VFCQEDFLY

SEQ ID NO: 1366460 - protein, 9 aa, Homo Sapiens
YELQHRGRE

SEQ ID NO: 1366461 - protein, 9 aa, Homo Sapiens
ARTSIIDST

SEQ ID NO: 1366462 - protein, 9 aa, Homo Sapiens
FTLPTPFPE

SEQ ID NO: 1366463 - protein, 9 aa, Homo Sapiens
SSSSLTSSP

SEQ ID NO: 1366464 - protein, 9 aa, Homo Sapiens
ETTANYTDS

SEQ ID NO: 1366465 - protein, 9 aa, Homo Sapiens
KGLVVRTVH

SEQ ID NO: 1366466 - protein, 9 aa, Homo Sapiens
AERGRGLRA

SEQ ID NO: 1366467 - protein, 9 aa, Homo Sapiens
RLRFKRPQP

SEQ ID NO: 1366468 - protein, 9 aa, Homo Sapiens
GVALRCDTR

SEQ ID NO: 1366469 - protein, 9 aa, Homo Sapiens
LFLIVSVLS

SEQ ID NO: 1366470 - protein, 9 aa, Homo Sapiens
QCRVELAEK

SEQ ID NO: 1366471 - protein, 9 aa, Homo Sapiens
DSQEDKKKF

SEQ ID NO: 1366472 - protein, 9 aa, Homo Sapiens
LVVYLGTTT

SEQ ID NO: 1366473 - protein, 9 aa, Homo Sapiens
SLSIHHSFS

SEQ ID NO: 1366474 - protein, 9 aa, Homo Sapiens
EREATITRS

SEQ ID NO: 1366475 - protein, 9 aa, Homo Sapiens
NAAARVMTN

SEQ ID NO: 1366476 - protein, 9 aa, Homo Sapiens
VWREVLTGE

SEQ ID NO: 1366477 - protein, 9 aa, Homo Sapiens
WISPAINNS

SEQ ID NO: 1366478 - protein, 9 aa, Homo Sapiens
GFEVMERIK

SEQ ID NO: 1366479 - protein, 9 aa, Homo Sapiens
PRRAALHLQ

SEQ ID NO: 1366480 - protein, 9 aa, Homo Sapiens
KQNLNAKTL

SEQ ID NO: 1366481 - protein, 9 aa, Homo Sapiens
KRGTIILTA

SEQ ID NO: 1366482 - protein, 9 aa, Homo Sapiens
DLTTRRCDF

SEQ ID NO: 1366483 - protein, 9 aa, Homo Sapiens
LTEMDSSGE

SEQ ID NO: 1366484 - protein, 9 aa, Homo Sapiens
TVAAARGLL

SEQ ID NO: 1366485 - protein, 9 aa, Homo Sapiens
WGHLDLARR

SEQ ID NO: 1366486 - protein, 9 aa, Homo Sapiens
EGATKLACL

SEQ ID NO: 1366487 - protein, 9 aa, Homo Sapiens
SVGDTSRPP

SEQ ID NO: 1366488 - protein, 9 aa, Homo Sapiens
PAEQSLTEH

SEQ ID NO: 1366489 - protein, 9 aa, Homo Sapiens
DLNDKKGDI

SEQ ID NO: 1366490 - protein, 9 aa, Homo Sapiens
TATLSCLGE

SEQ ID NO: 1366491 - protein, 9 aa, Homo Sapiens
GRSRKEAEL

SEQ ID NO: 1366492 - protein, 9 aa, Homo Sapiens
GCAGPSCFS

SEQ ID NO: 1366493 - protein, 9 aa, Homo Sapiens
DLKPEDLLL

SEQ ID NO: 1366494 - protein, 9 aa, Homo Sapiens
QEHRGHHTL

SEQ ID NO: 1366495 - protein, 9 aa, Homo Sapiens
ACSEGLYHE

SEQ ID NO: 1366496 - protein, 9 aa, Homo Sapiens
VEHGVQDTV

SEQ ID NO: 1366497 - protein, 9 aa, Homo Sapiens
MQQKGFSII

SEQ ID NO: 1366498 - protein, 9 aa, Homo Sapiens
SIQFASRQN

SEQ ID NO: 1366499 - protein, 9 aa, Homo Sapiens
KQDRDSHRS

SEQ ID NO: 1366500 - protein, 9 aa, Homo Sapiens
VEWRMSRLK

SEQ ID NO: 1366501 - protein, 9 aa, Homo Sapiens
SVFKRTSPL

SEQ ID NO: 1366502 - protein, 9 aa, Homo Sapiens
DDMGKNVHE

SEQ ID NO: 1366503 - protein, 9 aa, Homo Sapiens
EHSKEGKAW

SEQ ID NO: 1366504 - protein, 9 aa, Homo Sapiens
VLIKNMMKL

SEQ ID NO: 1366505 - protein, 9 aa, Homo Sapiens
KSLALSPRL

SEQ ID NO: 1366506 - protein, 9 aa, Homo Sapiens
VHVGLGRLL

SEQ ID NO: 1366507 - protein, 9 aa, Homo Sapiens
FYAGMVIGQ

SEQ ID NO: 1366508 - protein, 9 aa, Homo Sapiens
LSKKGCSKY

SEQ ID NO: 1366509 - protein, 9 aa, Homo Sapiens
HQMKCLTAV

SEQ ID NO: 1366510 - protein, 9 aa, Homo Sapiens
KLLCRQMLP

SEQ ID NO: 1366511 - protein, 9 aa, Homo Sapiens
VEDMCPDTP

SEQ ID NO: 1366512 - protein, 9 aa, Homo Sapiens
ASGRDREAR

SEQ ID NO: 1366513 - protein, 9 aa, Homo Sapiens
LAEPALGAY

SEQ ID NO: 1366514 - protein, 9 aa, Homo Sapiens
KVNKSKQNL

SEQ ID NO: 1366515 - protein, 9 aa, Homo Sapiens
YNSPHHRVT

SEQ ID NO: 1366516 - protein, 9 aa, Homo Sapiens
SSQFRAPSH

SEQ ID NO: 1366517 - protein, 9 aa, Homo Sapiens
AAAFPPPGT

SEQ ID NO: 1366518 - protein, 9 aa, Homo Sapiens
ALGSSRLPR

SEQ ID NO: 1366519 - protein, 9 aa, Homo Sapiens
GNPPSKRVS

SEQ ID NO: 1366520 - protein, 9 aa, Homo Sapiens
QLSAESVGD

SEQ ID NO: 1366521 - protein, 9 aa, Homo Sapiens
NRHRGKNEN

SEQ ID NO: 1366522 - protein, 9 aa, Homo Sapiens
NGLYITTIV

SEQ ID NO: 1366523 - protein, 9 aa, Homo Sapiens
PHKCNDCGK

SEQ ID NO: 1366524 - protein, 9 aa, Homo Sapiens
TNFIDRIFI

SEQ ID NO: 1366525 - protein, 9 aa, Homo Sapiens
SNFAAVPAF

SEQ ID NO: 1366526 - protein, 9 aa, Homo Sapiens
ATNFNEKIS

SEQ ID NO: 1366527 - protein, 9 aa, Homo Sapiens
RDAFLVLDL

SEQ ID NO: 1366528 - protein, 9 aa, Homo Sapiens
VVVCNCFGF

SEQ ID NO: 1366529 - protein, 9 aa, Homo Sapiens
PQPRPRRSS

SEQ ID NO: 1366530 - protein, 9 aa, Homo Sapiens
LAPDVLRHQ

SEQ ID NO: 1366531 - protein, 9 aa, Homo Sapiens
AAGRPPRME

SEQ ID NO: 1366532 - protein, 9 aa, Homo Sapiens
KLTVGKRNR

SEQ ID NO: 1366533 - protein, 9 aa, Homo Sapiens
GHLGDGKKM

SEQ ID NO: 1366534 - protein, 9 aa, Homo Sapiens
GSLVHSDAL

SEQ ID NO: 1366535 - protein, 9 aa, Homo Sapiens
IPKIETAHP

SEQ ID NO: 1366536 - protein, 9 aa, Homo Sapiens
GGCGPSRVR

SEQ ID NO: 1366537 - protein, 9 aa, Homo Sapiens
TLQQCRVEL

SEQ ID NO: 1366538 - protein, 9 aa, Homo Sapiens
KTKSWPLCC

SEQ ID NO: 1366539 - protein, 9 aa, Homo Sapiens
WLWFRDTLN

SEQ ID NO: 1366540 - protein, 9 aa, Homo Sapiens
KQCGYSEVY

SEQ ID NO: 1366541 - protein, 9 aa, Homo Sapiens
VTVWCCRAS

SEQ ID NO: 1366542 - protein, 9 aa, Homo Sapiens
QQVQCLVPA

SEQ ID NO: 1366543 - protein, 9 aa, Homo Sapiens
RIHTGQKPH

SEQ ID NO: 1366544 - protein, 9 aa, Homo Sapiens
RKMQKGWWQ

SEQ ID NO: 1366545 - protein, 9 aa, Homo Sapiens
FILCQLEVA

SEQ ID NO: 1366546 - protein, 9 aa, Homo Sapiens
IIKLETGIR

SEQ ID NO: 1366547 - protein, 9 aa, Homo Sapiens
ATLLFCLLV

SEQ ID NO: 1366548 - protein, 9 aa, Homo Sapiens
VFSVTVPHD

SEQ ID NO: 1366549 - protein, 9 aa, Homo Sapiens
VRPCSVTVW

SEQ ID NO: 1366550 - protein, 9 aa, Homo Sapiens
TIGPLYVFG

SEQ ID NO: 1366551 - protein, 9 aa, Homo Sapiens
TVSSCWPGR

SEQ ID NO: 1366552 - protein, 9 aa, Homo Sapiens
PPPPWGLQR

SEQ ID NO: 1366553 - protein, 9 aa, Homo Sapiens
RSHVGKDSR

SEQ ID NO: 1366554 - protein, 9 aa, Homo Sapiens
DVTFPELLR

SEQ ID NO: 1366555 - protein, 9 aa, Homo Sapiens
YSDDKPERN

SEQ ID NO: 1366556 - protein, 9 aa, Homo Sapiens
PKEEKKREG

SEQ ID NO: 1366557 - protein, 9 aa, Homo Sapiens
LFSLGMRTG

SEQ ID NO: 1366558 - protein, 9 aa, Homo Sapiens
KKTRNVFRN

SEQ ID NO: 1366559 - protein, 9 aa, Homo Sapiens
STGLLDNLL

SEQ ID NO: 1366560 - protein, 9 aa, Homo Sapiens
SQVTITMYM

SEQ ID NO: 1366561 - protein, 9 aa, Homo Sapiens
EKKQFDPVE

SEQ ID NO: 1366562 - protein, 9 aa, Homo Sapiens
LGQRSLWEG

SEQ ID NO: 1366563 - protein, 9 aa, Homo Sapiens
GNRSLCGLE

SEQ ID NO: 1366564 - protein, 9 aa, Homo Sapiens
CYVAVRHPL

SEQ ID NO: 1366565 - protein, 9 aa, Homo Sapiens
CHSHTAVQD

SEQ ID NO: 1366566 - protein, 9 aa, Homo Sapiens
DEEPHKFYV

SEQ ID NO: 1366567 - protein, 9 aa, Homo Sapiens
VRITGINHK

SEQ ID NO: 1366568 - protein, 9 aa, Homo Sapiens
KTFDSVVMD

SEQ ID NO: 1366569 - protein, 9 aa, Homo Sapiens
NPTPIPTPA

SEQ ID NO: 1366570 - protein, 9 aa, Homo Sapiens
DFQDLRPGA

SEQ ID NO: 1366571 - protein, 9 aa, Homo Sapiens
ASMREPGLL

SEQ ID NO: 1366572 - protein, 9 aa, Homo Sapiens
ACRRFLSLE

SEQ ID NO: 1366573 - protein, 9 aa, Homo Sapiens
VGPACAVVG

SEQ ID NO: 1366574 - protein, 9 aa, Homo Sapiens
DFVTPIQQP

SEQ ID NO: 1366575 - protein, 9 aa, Homo Sapiens
QPVKKRRVD

SEQ ID NO: 1366576 - protein, 9 aa, Homo Sapiens
QLLKSGEVK

SEQ ID NO: 1366577 - protein, 9 aa, Homo Sapiens
IRIHKVTKV

SEQ ID NO: 1366578 - protein, 9 aa, Homo Sapiens
SQEDKKKFK

SEQ ID NO: 1366579 - protein, 9 aa, Homo Sapiens
IYSFKQGNF

SEQ ID NO: 1366580 - protein, 9 aa, Homo Sapiens
ALSRLHLVA

SEQ ID NO: 1366581 - protein, 9 aa, Homo Sapiens
YFRADGFAD

SEQ ID NO: 1366582 - protein, 9 aa, Homo Sapiens
PDEIDIADT

SEQ ID NO: 1366583 - protein, 9 aa, Homo Sapiens
LSVVWFPLK

SEQ ID NO: 1366584 - protein, 9 aa, Homo Sapiens
QAQVLPFGT

SEQ ID NO: 1366585 - protein, 9 aa, Homo Sapiens
VGHMPGEFP

SEQ ID NO: 1366586 - protein, 9 aa, Homo Sapiens
KKVMAPVLS

SEQ ID NO: 1366587 - protein, 9 aa, Homo Sapiens
NEPEAETNQ

SEQ ID NO: 1366588 - protein, 9 aa, Homo Sapiens
MENGSGSRR

SEQ ID NO: 1366589 - protein, 9 aa, Homo Sapiens
GSSVGDTSR

SEQ ID NO: 1366590 - protein, 9 aa, Homo Sapiens
NQREVCIVA

SEQ ID NO: 1366591 - protein, 9 aa, Homo Sapiens
RTQRRLEGI

SEQ ID NO: 1366592 - protein, 9 aa, Homo Sapiens
STPTSTNTV

SEQ ID NO: 1366593 - protein, 9 aa, Homo Sapiens
QKRTEESVR

SEQ ID NO: 1366594 - protein, 9 aa, Homo Sapiens
QRCPGYYES

SEQ ID NO: 1366595 - protein, 9 aa, Homo Sapiens
SLEFIKMTF

SEQ ID NO: 1366596 - protein, 9 aa, Homo Sapiens
LCQTDPSGT

SEQ ID NO: 1366597 - protein, 9 aa, Homo Sapiens
RVSNETLVS

SEQ ID NO: 1366598 - protein, 9 aa, Homo Sapiens
TGMLNSRII

SEQ ID NO: 1366599 - protein, 9 aa, Homo Sapiens
TPVDQLQQD

SEQ ID NO: 1366600 - protein, 9 aa, Homo Sapiens
VKVPAKSML

SEQ ID NO: 1366601 - protein, 9 aa, Homo Sapiens
PGGGPEQQA

SEQ ID NO: 1366602 - protein, 9 aa, Homo Sapiens
SETGHMEEV

SEQ ID NO: 1366603 - protein, 9 aa, Homo Sapiens
YAGMVIGQE

SEQ ID NO: 1366604 - protein, 9 aa, Homo Sapiens
EFGQIHHLK

SEQ ID NO: 1366605 - protein, 9 aa, Homo Sapiens
VTSAFPTAE

SEQ ID NO: 1366606 - protein, 9 aa, Homo Sapiens
VGESARIQR

SEQ ID NO: 1366607 - protein, 9 aa, Homo Sapiens
QRIDRLSSL

SEQ ID NO: 1366608 - protein, 9 aa, Homo Sapiens
AVSIMWGLD

SEQ ID NO: 1366609 - protein, 9 aa, Homo Sapiens
AKSPGWKRK

SEQ ID NO: 1366610 - protein, 9 aa, Homo Sapiens
GLCHRPGLG

SEQ ID NO: 1366611 - protein, 9 aa, Homo Sapiens
CARLPSDPL

SEQ ID NO: 1366612 - protein, 9 aa, Homo Sapiens
IQQPPSPLP

SEQ ID NO: 1366613 - protein, 9 aa, Homo Sapiens
KQKVSEETY

SEQ ID NO: 1366614 - protein, 9 aa, Homo Sapiens
IGEKSLRRS

SEQ ID NO: 1366615 - protein, 9 aa, Homo Sapiens
RWNDASCDR

SEQ ID NO: 1366616 - protein, 9 aa, Homo Sapiens
QVTTTLKLI

SEQ ID NO: 1366617 - protein, 9 aa, Homo Sapiens
FDMNDATGD

SEQ ID NO: 1366618 - protein, 9 aa, Homo Sapiens
GASVVTSLI

SEQ ID NO: 1366619 - protein, 9 aa, Homo Sapiens
PLSSLLLYE

SEQ ID NO: 1366620 - protein, 9 aa, Homo Sapiens
DAKMTPEDH

SEQ ID NO: 1366621 - protein, 9 aa, Homo Sapiens
EASSGASSP

SEQ ID NO: 1366622 - protein, 9 aa, Homo Sapiens
ARSLLAEQR

SEQ ID NO: 1366623 - protein, 9 aa, Homo Sapiens
KRTEESVRY

SEQ ID NO: 1366624 - protein, 9 aa, Homo Sapiens
RALRARGPS

SEQ ID NO: 1366625 - protein, 9 aa, Homo Sapiens
LKNYLREVS

SEQ ID NO: 1366626 - protein, 9 aa, Homo Sapiens
GRRILHENM

SEQ ID NO: 1366627 - protein, 9 aa, Homo Sapiens
TKAGTKYTS

SEQ ID NO: 1366628 - protein, 9 aa, Homo Sapiens
KPKKQKLMA

SEQ ID NO: 1366629 - protein, 9 aa, Homo Sapiens
LKGDGLASE

SEQ ID NO: 1366630 - protein, 9 aa, Homo Sapiens
QIPTNRVKV

SEQ ID NO: 1366631 - protein, 9 aa, Homo Sapiens
SMREKRKSL

SEQ ID NO: 1366632 - protein, 9 aa, Homo Sapiens
QEGRHQRGR

SEQ ID NO: 1366633 - protein, 9 aa, Homo Sapiens
TPMYFFLSD

SEQ ID NO: 1366634 - protein, 9 aa, Homo Sapiens
AIQEVLEEQ

SEQ ID NO: 1366635 - protein, 9 aa, Homo Sapiens
GSGLCKGSG

SEQ ID NO: 1366636 - protein, 9 aa, Homo Sapiens
EYPVRRHQC

SEQ ID NO: 1366637 - protein, 9 aa, Homo Sapiens
IALLGSLNP

SEQ ID NO: 1366638 - protein, 9 aa, Homo Sapiens
VLSYIDLSV

SEQ ID NO: 1366639 - protein, 9 aa, Homo Sapiens
RKSGNPPSK

SEQ ID NO: 1366640 - protein, 9 aa, Homo Sapiens
HTAVQDYSY

SEQ ID NO: 1366641 - protein, 9 aa, Homo Sapiens
GAGTLAARA

SEQ ID NO: 1366642 - protein, 9 aa, Homo Sapiens
CLQSHRPPE

SEQ ID NO: 1366643 - protein, 9 aa, Homo Sapiens
DCRDYDSPE

SEQ ID NO: 1366644 - protein, 9 aa, Homo Sapiens
EPAAPPHRL

SEQ ID NO: 1366645 - protein, 9 aa, Homo Sapiens
PRLSLVVTG

SEQ ID NO: 1366646 - protein, 9 aa, Homo Sapiens
WFGFAGTSG

SEQ ID NO: 1366647 - protein, 9 aa, Homo Sapiens
PASPHWFYC

SEQ ID NO: 1366648 - protein, 9 aa, Homo Sapiens
HSGTFDCFR

SEQ ID NO: 1366649 - protein, 9 aa, Homo Sapiens
HPRVMLNNG

SEQ ID NO: 1366650 - protein, 9 aa, Homo Sapiens
VPDLDPLDY

SEQ ID NO: 1366651 - protein, 9 aa, Homo Sapiens
PLPQSPATP

SEQ ID NO: 1366652 - protein, 9 aa, Homo Sapiens
ATPGSQTIM

SEQ ID NO: 1366653 - protein, 9 aa, Homo Sapiens
SSSGPMGVQ

SEQ ID NO: 1366654 - protein, 9 aa, Homo Sapiens
KGFSIIEHT

SEQ ID NO: 1366655 - protein, 9 aa, Homo Sapiens
ASCRHGYPL

SEQ ID NO: 1366656 - protein, 9 aa, Homo Sapiens
NGVTRLHFE

SEQ ID NO: 1366657 - protein, 9 aa, Homo Sapiens
AVGAGAGLG

SEQ ID NO: 1366658 - protein, 9 aa, Homo Sapiens
GFDFGVRRN

SEQ ID NO: 1366659 - protein, 9 aa, Homo Sapiens
KGRVVSNGD

SEQ ID NO: 1366660 - protein, 9 aa, Homo Sapiens
HHPEGSSGS

SEQ ID NO: 1366661 - protein, 9 aa, Homo Sapiens
QNRGMKWKK

SEQ ID NO: 1366662 - protein, 9 aa, Homo Sapiens
TFVLGEQLS

SEQ ID NO: 1366663 - protein, 9 aa, Homo Sapiens
QGETKRARG

SEQ ID NO: 1366664 - protein, 9 aa, Homo Sapiens
PVAVTLLDT

SEQ ID NO: 1366665 - protein, 9 aa, Homo Sapiens
ICGGVCSSG

SEQ ID NO: 1366666 - protein, 9 aa, Homo Sapiens
PDSIADTLK

SEQ ID NO: 1366667 - protein, 9 aa, Homo Sapiens
SNFEIVNLL

SEQ ID NO: 1366668 - protein, 9 aa, Homo Sapiens
WFYVAFFTS

SEQ ID NO: 1366669 - protein, 9 aa, Homo Sapiens
EAPLHPPRG

SEQ ID NO: 1366670 - protein, 9 aa, Homo Sapiens
VFGTSRLVA

SEQ ID NO: 1366671 - protein, 9 aa, Homo Sapiens
TSMDREKEA

SEQ ID NO: 1366672 - protein, 9 aa, Homo Sapiens
SGRNRVGRQ

SEQ ID NO: 1366673 - protein, 9 aa, Homo Sapiens
LRELQRKGG

SEQ ID NO: 1366674 - protein, 9 aa, Homo Sapiens
TKSWPLCCC

SEQ ID NO: 1366675 - protein, 9 aa, Homo Sapiens
EHASGRTCT

SEQ ID NO: 1366676 - protein, 9 aa, Homo Sapiens
RPRPPQPRP

SEQ ID NO: 1366677 - protein, 9 aa, Homo Sapiens
ALRSHTRTH

SEQ ID NO: 1366678 - protein, 9 aa, Homo Sapiens
FRTQERAAA

SEQ ID NO: 1366679 - protein, 9 aa, Homo Sapiens
ITGGPTPAS

SEQ ID NO: 1366680 - protein, 9 aa, Homo Sapiens
WMLTRTMLS

SEQ ID NO: 1366681 - protein, 9 aa, Homo Sapiens
LAADPMPAA

SEQ ID NO: 1366682 - protein, 9 aa, Homo Sapiens
SRESALYLL

SEQ ID NO: 1366683 - protein, 9 aa, Homo Sapiens
AEPALGAYR

SEQ ID NO: 1366684 - protein, 9 aa, Homo Sapiens
LRIFPEVAA

SEQ ID NO: 1366685 - protein, 9 aa, Homo Sapiens
AHQADGREE

SEQ ID NO: 1366686 - protein, 9 aa, Homo Sapiens
RTAAPPGQA

SEQ ID NO: 1366687 - protein, 9 aa, Homo Sapiens
GDREVTRCG

SEQ ID NO: 1366688 - protein, 9 aa, Homo Sapiens
VPSAGVGIA

SEQ ID NO: 1366689 - protein, 9 aa, Homo Sapiens
LAISEILFT

SEQ ID NO: 1366690 - protein, 9 aa, Homo Sapiens
VLKMTYTNS

SEQ ID NO: 1366691 - protein, 9 aa, Homo Sapiens
RTSASRQTC

SEQ ID NO: 1366692 - protein, 9 aa, Homo Sapiens
GTEVHTNTN

SEQ ID NO: 1366693 - protein, 9 aa, Homo Sapiens
RRECMLASL

SEQ ID NO: 1366694 - protein, 9 aa, Homo Sapiens
DLSTYRPLP

SEQ ID NO: 1366695 - protein, 9 aa, Homo Sapiens
ADEEEPVEL

SEQ ID NO: 1366696 - protein, 9 aa, Homo Sapiens
SLISVNQGS

SEQ ID NO: 1366697 - protein, 9 aa, Homo Sapiens
DGCPLQVEK

SEQ ID NO: 1366698 - protein, 9 aa, Homo Sapiens
MVDDEELTQ

SEQ ID NO: 1366699 - protein, 9 aa, Homo Sapiens
ALEYFMKQI

SEQ ID NO: 1366700 - protein, 9 aa, Homo Sapiens
WTPSPSHSP

SEQ ID NO: 1366701 - protein, 9 aa, Homo Sapiens
TGQTVCKNN

SEQ ID NO: 1366702 - protein, 9 aa, Homo Sapiens
AMVVRTGFS

SEQ ID NO: 1366703 - protein, 9 aa, Homo Sapiens
EAQKPERME

SEQ ID NO: 1366704 - protein, 9 aa, Homo Sapiens
RPASPAPAQ

SEQ ID NO: 1366705 - protein, 9 aa, Homo Sapiens
EKQDRDSHR

SEQ ID NO: 1366706 - protein, 9 aa, Homo Sapiens
DAFLVLDLC

SEQ ID NO: 1366707 - protein, 9 aa, Homo Sapiens
IGMKQEMEK

SEQ ID NO: 1366708 - protein, 9 aa, Homo Sapiens
YVSEDLNDK

SEQ ID NO: 1366709 - protein, 9 aa, Homo Sapiens
MNNKKKPFL

SEQ ID NO: 1366710 - protein, 9 aa, Homo Sapiens
LPYTATTAP

SEQ ID NO: 1366711 - protein, 9 aa, Homo Sapiens
VLRPPAQCL

SEQ ID NO: 1366712 - protein, 9 aa, Homo Sapiens
TGERPHGRG

SEQ ID NO: 1366713 - protein, 9 aa, Homo Sapiens
LCRLTIKKI

SEQ ID NO: 1366714 - protein, 9 aa, Homo Sapiens
ESLGNNHLS

SEQ ID NO: 1366715 - protein, 9 aa, Homo Sapiens
LILWPQAAP

SEQ ID NO: 1366716 - protein, 9 aa, Homo Sapiens
VHNRCSKDW

SEQ ID NO: 1366717 - protein, 9 aa, Homo Sapiens
GNECSQRFR

SEQ ID NO: 1366718 - protein, 9 aa, Homo Sapiens
GVQDTVEVG

SEQ ID NO: 1366719 - protein, 9 aa, Homo Sapiens
AVKPNLQAL

SEQ ID NO: 1366720 - protein, 9 aa, Homo Sapiens
DISHLTACF

SEQ ID NO: 1366721 - protein, 9 aa, Homo Sapiens
NDLGPACTV

SEQ ID NO: 1366722 - protein, 9 aa, Homo Sapiens
QESASKEQH

SEQ ID NO: 1366723 - protein, 9 aa, Homo Sapiens
KGSRCIPAY

SEQ ID NO: 1366724 - protein, 9 aa, Homo Sapiens
RVGGPGPRV

SEQ ID NO: 1366725 - protein, 9 aa, Homo Sapiens
TSRPPYRGR

SEQ ID NO: 1366726 - protein, 9 aa, Homo Sapiens
ESETRAVGK

SEQ ID NO: 1366727 - protein, 9 aa, Homo Sapiens
SKTRISQFN

SEQ ID NO: 1366728 - protein, 9 aa, Homo Sapiens
DGFEVMERI

SEQ ID NO: 1366729 - protein, 9 aa, Homo Sapiens
PVDGGIYVC

SEQ ID NO: 1366730 - protein, 9 aa, Homo Sapiens
FAGVGYVRG

SEQ ID NO: 1366731 - protein, 9 aa, Homo Sapiens
SEYSSSSSG

SEQ ID NO: 1366732 - protein, 9 aa, Homo Sapiens
RDCRDNTEL

SEQ ID NO: 1366733 - protein, 9 aa, Homo Sapiens
LPCPLPATV

SEQ ID NO: 1366734 - protein, 9 aa, Homo Sapiens
VSLTLSPHH

SEQ ID NO: 1366735 - protein, 9 aa, Homo Sapiens
GAGVDVIAP

SEQ ID NO: 1366736 - protein, 9 aa, Homo Sapiens
YEDRHPKHE

SEQ ID NO: 1366737 - protein, 9 aa, Homo Sapiens
EKDSWKVKA

SEQ ID NO: 1366738 - protein, 9 aa, Homo Sapiens
DQLMFTLHF

SEQ ID NO: 1366739 - protein, 9 aa, Homo Sapiens
CVWNCHRYI

SEQ ID NO: 1366740 - protein, 9 aa, Homo Sapiens
AKMKGCPHW

SEQ ID NO: 1366741 - protein, 9 aa, Homo Sapiens
PELPADTAA

SEQ ID NO: 1366742 - protein, 9 aa, Homo Sapiens
LPAVVKLVC

SEQ ID NO: 1366743 - protein, 9 aa, Homo Sapiens
QPRSVRYIL

SEQ ID NO: 1366744 - protein, 9 aa, Homo Sapiens
EGAAGGVDD

SEQ ID NO: 1366745 - protein, 9 aa, Homo Sapiens
KPGSNAHVG

SEQ ID NO: 1366746 - protein, 9 aa, Homo Sapiens
IPGKKRGTI

SEQ ID NO: 1366747 - protein, 9 aa, Homo Sapiens
HVCQNHVSR

SEQ ID NO: 1366748 - protein, 9 aa, Homo Sapiens
RFINPGLLV

SEQ ID NO: 1366749 - protein, 9 aa, Homo Sapiens
MVVLIMVWG

SEQ ID NO: 1366750 - protein, 9 aa, Homo Sapiens
TPPCPASFC

SEQ ID NO: 1366751 - protein, 9 aa, Homo Sapiens
ESELRTSHE

SEQ ID NO: 1366752 - protein, 9 aa, Homo Sapiens
LGNNTKLKE

SEQ ID NO: 1366753 - protein, 9 aa, Homo Sapiens
KAPPGLHPL

SEQ ID NO: 1366754 - protein, 9 aa, Homo Sapiens
QRLSRPTKT

SEQ ID NO: 1366755 - protein, 9 aa, Homo Sapiens
HSVPDEIDI

SEQ ID NO: 1366756 - protein, 9 aa, Homo Sapiens
YHALYISVL

SEQ ID NO: 1366757 - protein, 9 aa, Homo Sapiens
VSAPQATMQ

SEQ ID NO: 1366758 - protein, 9 aa, Homo Sapiens
LPLSAVTAL

SEQ ID NO: 1366759 - protein, 9 aa, Homo Sapiens
VCLLFFSTC

SEQ ID NO: 1366760 - protein, 9 aa, Homo Sapiens
MVGFWPEVL

SEQ ID NO: 1366761 - protein, 9 aa, Homo Sapiens
VFTHNTSKE

SEQ ID NO: 1366762 - protein, 9 aa, Homo Sapiens
PPALPHAGP

SEQ ID NO: 1366763 - protein, 9 aa, Homo Sapiens
PHGRGECGK

SEQ ID NO: 1366764 - protein, 9 aa, Homo Sapiens
AHLLQRGNL

SEQ ID NO: 1366765 - protein, 9 aa, Homo Sapiens
SDGPLMCKD

SEQ ID NO: 1366766 - protein, 9 aa, Homo Sapiens
GGTLSIPPV

SEQ ID NO: 1366767 - protein, 9 aa, Homo Sapiens
PQPGLPHGY

SEQ ID NO: 1366768 - protein, 9 aa, Homo Sapiens
PSNCTPGHT

SEQ ID NO: 1366769 - protein, 9 aa, Homo Sapiens
VSGSLSVAA

SEQ ID NO: 1366770 - protein, 9 aa, Homo Sapiens
GNMIIVMLT

SEQ ID NO: 1366771 - protein, 9 aa, Homo Sapiens
INTIWKSTV

SEQ ID NO: 1366772 - protein, 9 aa, Homo Sapiens
RRPRPPQPR

SEQ ID NO: 1366773 - protein, 9 aa, Homo Sapiens
IRTGPWKTK

SEQ ID NO: 1366774 - protein, 9 aa, Homo Sapiens
RPLGMQQNP

SEQ ID NO: 1366775 - protein, 9 aa, Homo Sapiens
NLWGDTGRP

SEQ ID NO: 1366776 - protein, 9 aa, Homo Sapiens
AQEQVPVEE

SEQ ID NO: 1366777 - protein, 9 aa, Homo Sapiens
AAHRRPTQT

SEQ ID NO: 1366778 - protein, 9 aa, Homo Sapiens
ANGNPDPEI

SEQ ID NO: 1366779 - protein, 9 aa, Homo Sapiens
AQGQATLCL

SEQ ID NO: 1366780 - protein, 9 aa, Homo Sapiens
RLQVSESVA

SEQ ID NO: 1366781 - protein, 9 aa, Homo Sapiens
KDQPLLVRR

SEQ ID NO: 1366782 - protein, 9 aa, Homo Sapiens
QIRGYVFKE

SEQ ID NO: 1366783 - protein, 9 aa, Homo Sapiens
TPVPVAAET

SEQ ID NO: 1366784 - protein, 9 aa, Homo Sapiens
TSETEYQVQ

SEQ ID NO: 1366785 - protein, 9 aa, Homo Sapiens
FEFIDLRFC

SEQ ID NO: 1366786 - protein, 9 aa, Homo Sapiens
ESDPGDDDV

SEQ ID NO: 1366787 - protein, 9 aa, Homo Sapiens
CKTCASHIG

SEQ ID NO: 1366788 - protein, 9 aa, Homo Sapiens
CKGSGPKTP

SEQ ID NO: 1366789 - protein, 9 aa, Homo Sapiens
PHAVLRGQN

SEQ ID NO: 1366790 - protein, 9 aa, Homo Sapiens
PWPRLSLVV

SEQ ID NO: 1366791 - protein, 9 aa, Homo Sapiens
SPPTTTEVI

SEQ ID NO: 1366792 - protein, 9 aa, Homo Sapiens
QGLIAVDVF

SEQ ID NO: 1366793 - protein, 9 aa, Homo Sapiens
QLINSILLA

SEQ ID NO: 1366794 - protein, 9 aa, Homo Sapiens
AAGGVDDED

SEQ ID NO: 1366795 - protein, 9 aa, Homo Sapiens
DSTKIATGQ

SEQ ID NO: 1366796 - protein, 9 aa, Homo Sapiens
RKPGCARQE

SEQ ID NO: 1366797 - protein, 9 aa, Homo Sapiens
MVAHAVPNP

SEQ ID NO: 1366798 - protein, 9 aa, Homo Sapiens
RGHVHEASP

SEQ ID NO: 1366799 - protein, 9 aa, Homo Sapiens
SLDRNLGSP

SEQ ID NO: 1366800 - protein, 9 aa, Homo Sapiens
GLCSGLRLQ

SEQ ID NO: 1366801 - protein, 9 aa, Homo Sapiens
LSDLSFVDI

SEQ ID NO: 1366802 - protein, 9 aa, Homo Sapiens
VLERRTPDQ

SEQ ID NO: 1366803 - protein, 9 aa, Homo Sapiens
IYDNQRQFM

SEQ ID NO: 1366804 - protein, 9 aa, Homo Sapiens
ETEHQVQGG

SEQ ID NO: 1366805 - protein, 9 aa, Homo Sapiens
MRDKMRKRR

SEQ ID NO: 1366806 - protein, 9 aa, Homo Sapiens
VLSPLVQPL

SEQ ID NO: 1366807 - protein, 9 aa, Homo Sapiens
ETEHQVQGR

SEQ ID NO: 1366808 - protein, 9 aa, Homo Sapiens
KAEARARRH

SEQ ID NO: 1366809 - protein, 9 aa, Homo Sapiens
SISAPLHKP

SEQ ID NO: 1366810 - protein, 9 aa, Homo Sapiens
FETVAMDRP

SEQ ID NO: 1366811 - protein, 9 aa, Homo Sapiens
VVWPSAVVL

SEQ ID NO: 1366812 - protein, 9 aa, Homo Sapiens
GTRCSSTSA

SEQ ID NO: 1366813 - protein, 9 aa, Homo Sapiens
RQNRSSLYR

SEQ ID NO: 1366814 - protein, 9 aa, Homo Sapiens
VRYSAKGPC

SEQ ID NO: 1366815 - protein, 9 aa, Homo Sapiens
PGCCHSSGG

SEQ ID NO: 1366816 - protein, 9 aa, Homo Sapiens
TLNNHEDST

SEQ ID NO: 1366817 - protein, 9 aa, Homo Sapiens
QDVSHNGLH

SEQ ID NO: 1366818 - protein, 9 aa, Homo Sapiens
LFLFFTLLL

SEQ ID NO: 1366819 - protein, 9 aa, Homo Sapiens
QQSSSDCYR

SEQ ID NO: 1366820 - protein, 9 aa, Homo Sapiens
QAVSLFAQV

SEQ ID NO: 1366821 - protein, 9 aa, Homo Sapiens
LDNLLALGL

SEQ ID NO: 1366822 - protein, 9 aa, Homo Sapiens
EQMEKNQEA

SEQ ID NO: 1366823 - protein, 9 aa, Homo Sapiens
LGTKLPRLS

SEQ ID NO: 1366824 - protein, 9 aa, Homo Sapiens
QQQQQHSSS

SEQ ID NO: 1366825 - protein, 9 aa, Homo Sapiens
PQPPPPPPA

SEQ ID NO: 1366826 - protein, 9 aa, Homo Sapiens
KNSTLEPVV

SEQ ID NO: 1366827 - protein, 9 aa, Homo Sapiens
PNFVTAVLS

SEQ ID NO: 1366828 - protein, 9 aa, Homo Sapiens
AELTDTRRP

SEQ ID NO: 1366829 - protein, 9 aa, Homo Sapiens
EVTEQVRGY

SEQ ID NO: 1366830 - protein, 9 aa, Homo Sapiens
CTFLQLAIC

SEQ ID NO: 1366831 - protein, 9 aa, Homo Sapiens
PTAEQDDPK

SEQ ID NO: 1366832 - protein, 9 aa, Homo Sapiens
CMTQLVSSQ

SEQ ID NO: 1366833 - protein, 9 aa, Homo Sapiens
AIAYVECIT

SEQ ID NO: 1366834 - protein, 9 aa, Homo Sapiens
NPRFDEVFY

SEQ ID NO: 1366835 - protein, 9 aa, Homo Sapiens
RLGFADLFS

SEQ ID NO: 1366836 - protein, 9 aa, Homo Sapiens
AAAIGSLIC

SEQ ID NO: 1366837 - protein, 9 aa, Homo Sapiens
QSRVKTWYE

SEQ ID NO: 1366838 - protein, 9 aa, Homo Sapiens
ANKIRKSEL

SEQ ID NO: 1366839 - protein, 9 aa, Homo Sapiens
KVRTDSDRW

SEQ ID NO: 1366840 - protein, 9 aa, Homo Sapiens
LNPCPFPFS

SEQ ID NO: 1366841 - protein, 9 aa, Homo Sapiens
PTPDESSDQ

SEQ ID NO: 1366842 - protein, 9 aa, Homo Sapiens
VEVTSLLRN

SEQ ID NO: 1366843 - protein, 9 aa, Homo Sapiens
LEWLKLTPD

SEQ ID NO: 1366844 - protein, 9 aa, Homo Sapiens
ELSSSSQRL

SEQ ID NO: 1366845 - protein, 9 aa, Homo Sapiens
ADRGPANGS

SEQ ID NO: 1366846 - protein, 9 aa, Homo Sapiens
HQCEEVARA

SEQ ID NO: 1366847 - protein, 9 aa, Homo Sapiens
VPTTNGTLP

SEQ ID NO: 1366848 - protein, 9 aa, Homo Sapiens
CGACCPCWA

SEQ ID NO: 1366849 - protein, 9 aa, Homo Sapiens
REIYRGPSG

SEQ ID NO: 1366850 - protein, 9 aa, Homo Sapiens
LAPLQVTTT

SEQ ID NO: 1366851 - protein, 9 aa, Homo Sapiens
QQKGFSIIE

SEQ ID NO: 1366852 - protein, 9 aa, Homo Sapiens
RQSYKEAMG

SEQ ID NO: 1366853 - protein, 9 aa, Homo Sapiens
ISPAINNSD

SEQ ID NO: 1366854 - protein, 9 aa, Homo Sapiens
LLTSSETGG

SEQ ID NO: 1366855 - protein, 9 aa, Homo Sapiens
PKLRSTANM

SEQ ID NO: 1366856 - protein, 9 aa, Homo Sapiens
DTAACILKG

SEQ ID NO: 1366857 - protein, 9 aa, Homo Sapiens
GGPLCSCCI

SEQ ID NO: 1366858 - protein, 9 aa, Homo Sapiens
QFGMYVIDS

SEQ ID NO: 1366859 - protein, 9 aa, Homo Sapiens
QAPQVAMLP

SEQ ID NO: 1366860 - protein, 9 aa, Homo Sapiens
EEQRQEEEA

SEQ ID NO: 1366861 - protein, 9 aa, Homo Sapiens
AIPNGEIPD

SEQ ID NO: 1366862 - protein, 9 aa, Homo Sapiens
DYAGLASVE

SEQ ID NO: 1366863 - protein, 9 aa, Homo Sapiens
PVATLSPGE

SEQ ID NO: 1366864 - protein, 9 aa, Homo Sapiens
KQLGRRILH

SEQ ID NO: 1366865 - protein, 9 aa, Homo Sapiens
RHFLPEQFS

SEQ ID NO: 1366866 - protein, 9 aa, Homo Sapiens
NCLGKKKKL

SEQ ID NO: 1366867 - protein, 9 aa, Homo Sapiens
HQLAASWLV

SEQ ID NO: 1366868 - protein, 9 aa, Homo Sapiens
LPEKGLVIH

SEQ ID NO: 1366869 - protein, 9 aa, Homo Sapiens
SQQAISRTH

SEQ ID NO: 1366870 - protein, 9 aa, Homo Sapiens
FTHPQQPSP

SEQ ID NO: 1366871 - protein, 9 aa, Homo Sapiens
VSAGTVECL

SEQ ID NO: 1366872 - protein, 9 aa, Homo Sapiens
SVALPTDLD

SEQ ID NO: 1366873 - protein, 9 aa, Homo Sapiens
CWWGQLSLQ

SEQ ID NO: 1366874 - protein, 9 aa, Homo Sapiens
QGANAQGET

SEQ ID NO: 1366875 - protein, 9 aa, Homo Sapiens
GMHLFQSER

SEQ ID NO: 1366876 - protein, 9 aa, Homo Sapiens
VKPKWCNVT

SEQ ID NO: 1366877 - protein, 9 aa, Homo Sapiens
QLSVTPTVS

SEQ ID NO: 1366878 - protein, 9 aa, Homo Sapiens
TTTLKLILV

SEQ ID NO: 1366879 - protein, 9 aa, Homo Sapiens
GQEADGVDG

SEQ ID NO: 1366880 - protein, 9 aa, Homo Sapiens
RCPRVGCLH

SEQ ID NO: 1366881 - protein, 9 aa, Homo Sapiens
AIHRAHRES

SEQ ID NO: 1366882 - protein, 9 aa, Homo Sapiens
ANKAITDAA

SEQ ID NO: 1366883 - protein, 9 aa, Homo Sapiens
GLKSNGKYT

SEQ ID NO: 1366884 - protein, 9 aa, Homo Sapiens
SVGMYMDSC

SEQ ID NO: 1366885 - protein, 9 aa, Homo Sapiens
KLLWFYVAF

SEQ ID NO: 1366886 - protein, 9 aa, Homo Sapiens
ADQEHRVGG

SEQ ID NO: 1366887 - protein, 9 aa, Homo Sapiens
ATLSCSEIC

SEQ ID NO: 1366888 - protein, 9 aa, Homo Sapiens
EVERAFGYY

SEQ ID NO: 1366889 - protein, 9 aa, Homo Sapiens
RRFLSLEQY

SEQ ID NO: 1366890 - protein, 9 aa, Homo Sapiens
RVVSSDLVP

SEQ ID NO: 1366891 - protein, 9 aa, Homo Sapiens
AQATPDRVL

SEQ ID NO: 1366892 - protein, 9 aa, Homo Sapiens
GSTNSDRGD

SEQ ID NO: 1366893 - protein, 9 aa, Homo Sapiens
CTLVMEYVV

SEQ ID NO: 1366894 - protein, 9 aa, Homo Sapiens
CPLSTWSAS

SEQ ID NO: 1366895 - protein, 9 aa, Homo Sapiens
YRADKCAVD

SEQ ID NO: 1366896 - protein, 9 aa, Homo Sapiens
CWASPSSAA

SEQ ID NO: 1366897 - protein, 9 aa, Homo Sapiens
RAVGGQHEE

SEQ ID NO: 1366898 - protein, 9 aa, Homo Sapiens
DELVACSLI

SEQ ID NO: 1366899 - protein, 9 aa, Homo Sapiens
DLQMLTYLN

SEQ ID NO: 1366900 - protein, 9 aa, Homo Sapiens
PENPFLSVH

SEQ ID NO: 1366901 - protein, 9 aa, Homo Sapiens
VLFVRNLAA

SEQ ID NO: 1366902 - protein, 9 aa, Homo Sapiens
SDSDDDDAH

SEQ ID NO: 1366903 - protein, 9 aa, Homo Sapiens
STGKDQCPA

SEQ ID NO: 1366904 - protein, 9 aa, Homo Sapiens
NAVDIKTED

SEQ ID NO: 1366905 - protein, 9 aa, Homo Sapiens
LVAGPSTAW

SEQ ID NO: 1366906 - protein, 9 aa, Homo Sapiens
CSAVFDPFW

SEQ ID NO: 1366907 - protein, 9 aa, Homo Sapiens
AVYMYPEYQ

SEQ ID NO: 1366908 - protein, 9 aa, Homo Sapiens
QCAKLLNSS

SEQ ID NO: 1366909 - protein, 9 aa, Homo Sapiens
EYDSRLRIQ

SEQ ID NO: 1366910 - protein, 9 aa, Homo Sapiens
VLPVCSRCR

SEQ ID NO: 1366911 - protein, 9 aa, Homo Sapiens
LVSLDIFQM

SEQ ID NO: 1366912 - protein, 9 aa, Homo Sapiens
ALSGPRPAS

SEQ ID NO: 1366913 - protein, 9 aa, Homo Sapiens
CSLISVNQG

SEQ ID NO: 1366914 - protein, 9 aa, Homo Sapiens
IRRNAFLIL

SEQ ID NO: 1366915 - protein, 9 aa, Homo Sapiens
FSRREGGGT

SEQ ID NO: 1366916 - protein, 9 aa, Homo Sapiens
AGPTADEEE

SEQ ID NO: 1366917 - protein, 9 aa, Homo Sapiens
VDADCVVGS

SEQ ID NO: 1366918 - protein, 9 aa, Homo Sapiens
ERIKGDQYI

SEQ ID NO: 1366919 - protein, 9 aa, Homo Sapiens
VFCMHHQRC

SEQ ID NO: 1366920 - protein, 9 aa, Homo Sapiens
VSFSESGPL

SEQ ID NO: 1366921 - protein, 9 aa, Homo Sapiens
VRQGAPIFQ

SEQ ID NO: 1366922 - protein, 9 aa, Homo Sapiens
GYCLPLGLH

SEQ ID NO: 1366923 - protein, 9 aa, Homo Sapiens
HCSDYCSAF

SEQ ID NO: 1366924 - protein, 9 aa, Homo Sapiens
LCSGLRLQD

SEQ ID NO: 1366925 - protein, 9 aa, Homo Sapiens
QPGLPHGYP

SEQ ID NO: 1366926 - protein, 9 aa, Homo Sapiens
SSVELTGMS

SEQ ID NO: 1366927 - protein, 9 aa, Homo Sapiens
PTSRGQRQK

SEQ ID NO: 1366928 - protein, 9 aa, Homo Sapiens
YAAHNTYHH

SEQ ID NO: 1366929 - protein, 9 aa, Homo Sapiens
ESHMASIKA

SEQ ID NO: 1366930 - protein, 9 aa, Homo Sapiens
CEESNMDIY

SEQ ID NO: 1366931 - protein, 9 aa, Homo Sapiens
KRKTNNPRF

SEQ ID NO: 1366932 - protein, 9 aa, Homo Sapiens
CCPCWASPS

SEQ ID NO: 1366933 - protein, 9 aa, Homo Sapiens
SQANQLNYG

SEQ ID NO: 1366934 - protein, 9 aa, Homo Sapiens
AQLQVGRFA

SEQ ID NO: 1366935 - protein, 9 aa, Homo Sapiens
PEVLKMTYT

SEQ ID NO: 1366936 - protein, 9 aa, Homo Sapiens
TRSTGKDQC

SEQ ID NO: 1366937 - protein, 9 aa, Homo Sapiens
CLVALGHAY

SEQ ID NO: 1366938 - protein, 9 aa, Homo Sapiens
QFEDGLAVV

SEQ ID NO: 1366939 - protein, 9 aa, Homo Sapiens
RNGSRKCPP

SEQ ID NO: 1366940 - protein, 9 aa, Homo Sapiens
RFFCLPSRW

SEQ ID NO: 1366941 - protein, 9 aa, Homo Sapiens
SEALVCLLV

SEQ ID NO: 1366942 - protein, 9 aa, Homo Sapiens
VLRPQQIWH

SEQ ID NO: 1366943 - protein, 9 aa, Homo Sapiens
DDEEPHKFY

SEQ ID NO: 1366944 - protein, 9 aa, Homo Sapiens
GTTIFQLFS

SEQ ID NO: 1366945 - protein, 9 aa, Homo Sapiens
LFFTLLLSW

SEQ ID NO: 1366946 - protein, 9 aa, Homo Sapiens
EGQGAMEEL

SEQ ID NO: 1366947 - protein, 9 aa, Homo Sapiens
KRFLRKKIK

SEQ ID NO: 1366948 - protein, 9 aa, Homo Sapiens
GKKRGTIIL

SEQ ID NO: 1366949 - protein, 9 aa, Homo Sapiens
TSCLPPFSH

SEQ ID NO: 1366950 - protein, 9 aa, Homo Sapiens
VMAPVLSDV

SEQ ID NO: 1366951 - protein, 9 aa, Homo Sapiens
NGQWKGRAP

SEQ ID NO: 1366952 - protein, 9 aa, Homo Sapiens
VGVRPYRAW

SEQ ID NO: 1366953 - protein, 9 aa, Homo Sapiens
RARASAGPV

SEQ ID NO: 1366954 - protein, 9 aa, Homo Sapiens
LVVLSGVPL

SEQ ID NO: 1366955 - protein, 9 aa, Homo Sapiens
GYTRVSSAH

SEQ ID NO: 1366956 - protein, 9 aa, Homo Sapiens
VKSRQCKCG

SEQ ID NO: 1366957 - protein, 9 aa, Homo Sapiens
IFQLFPSKD

SEQ ID NO: 1366958 - protein, 9 aa, Homo Sapiens
VKCKSCPVA

SEQ ID NO: 1366959 - protein, 9 aa, Homo Sapiens
VSSDLVPQN

SEQ ID NO: 1366960 - protein, 9 aa, Homo Sapiens
PLWNEGCIM

SEQ ID NO: 1366961 - protein, 9 aa, Homo Sapiens
NFCPEVTRK

SEQ ID NO: 1366962 - protein, 9 aa, Homo Sapiens
RALRPLHAL

SEQ ID NO: 1366963 - protein, 9 aa, Homo Sapiens
SFTNLADHN

SEQ ID NO: 1366964 - protein, 9 aa, Homo Sapiens
ELTGMSATT

SEQ ID NO: 1366965 - protein, 9 aa, Homo Sapiens
MAKAFALRI

SEQ ID NO: 1366966 - protein, 9 aa, Homo Sapiens
ADQEEVSGH

SEQ ID NO: 1366967 - protein, 9 aa, Homo Sapiens
GYPRPGAHS

SEQ ID NO: 1366968 - protein, 9 aa, Homo Sapiens
LPHAGPPGP

SEQ ID NO: 1366969 - protein, 9 aa, Homo Sapiens
QQEAESGSS

SEQ ID NO: 1366970 - protein, 9 aa, Homo Sapiens
PKSSSFSRC

SEQ ID NO: 1366971 - protein, 9 aa, Homo Sapiens
RNHVVQRLC

SEQ ID NO: 1366972 - protein, 9 aa, Homo Sapiens
ELLHQLRNV

SEQ ID NO: 1366973 - protein, 9 aa, Homo Sapiens
GIELGYDIL

SEQ ID NO: 1366974 - protein, 9 aa, Homo Sapiens
QGLWNRSPL

SEQ ID NO: 1366975 - protein, 9 aa, Homo Sapiens
SPIGLGGQH

SEQ ID NO: 1366976 - protein, 9 aa, Homo Sapiens
NAFLILDLC

SEQ ID NO: 1366977 - protein, 9 aa, Homo Sapiens
RGPWGAAPR

SEQ ID NO: 1366978 - protein, 9 aa, Homo Sapiens
LSSCKTWWT

SEQ ID NO: 1366979 - protein, 9 aa, Homo Sapiens
NNQKKQGNE

SEQ ID NO: 1366980 - protein, 9 aa, Homo Sapiens
STWSASYTG

SEQ ID NO: 1366981 - protein, 9 aa, Homo Sapiens
QNTRPGKDE

SEQ ID NO: 1366982 - protein, 9 aa, Homo Sapiens
PLQDGSLDR

SEQ ID NO: 1366983 - protein, 9 aa, Homo Sapiens
RSCLHRRRA

SEQ ID NO: 1366984 - protein, 9 aa, Homo Sapiens
AFLVLDLCF

SEQ ID NO: 1366985 - protein, 9 aa, Homo Sapiens
LSEEIGKAR

SEQ ID NO: 1366986 - protein, 9 aa, Homo Sapiens
AFLVLDLCL

SEQ ID NO: 1366987 - protein, 9 aa, Homo Sapiens
QHTRGASGR

SEQ ID NO: 1366988 - protein, 9 aa, Homo Sapiens
CVRLEGRDP

SEQ ID NO: 1366989 - protein, 9 aa, Homo Sapiens
IWSTCCSMG

SEQ ID NO: 1366990 - protein, 9 aa, Homo Sapiens
KPERMETKW

SEQ ID NO: 1366991 - protein, 9 aa, Homo Sapiens
GSRKCPPHL

SEQ ID NO: 1366992 - protein, 9 aa, Homo Sapiens
FASCLIMGL

SEQ ID NO: 1366993 - protein, 9 aa, Homo Sapiens
QPRARHFLP

SEQ ID NO: 1366994 - protein, 9 aa, Homo Sapiens
VRTVHEHFN

SEQ ID NO: 1366995 - protein, 9 aa, Homo Sapiens
FLSLPRTTK

SEQ ID NO: 1366996 - protein, 9 aa, Homo Sapiens
PSVTSSLSS

SEQ ID NO: 1366997 - protein, 9 aa, Homo Sapiens
MTPTLRARD

SEQ ID NO: 1366998 - protein, 9 aa, Homo Sapiens
SKYAAHNTY

SEQ ID NO: 1366999 - protein, 9 aa, Homo Sapiens
PRPSAHLLM

SEQ ID NO: 1367000 - protein, 9 aa, Homo Sapiens
PTKTRMLYH

SEQ ID NO: 1367001 - protein, 9 aa, Homo Sapiens
IQLHQDLVL

SEQ ID NO: 1367002 - protein, 9 aa, Homo Sapiens
PALGTELSY

SEQ ID NO: 1367003 - protein, 9 aa, Homo Sapiens
RNSQAHGNF

SEQ ID NO: 1367004 - protein, 9 aa, Homo Sapiens
DAIAYVECI

SEQ ID NO: 1367005 - protein, 9 aa, Homo Sapiens
LSWGSPTRM

SEQ ID NO: 1367006 - protein, 9 aa, Homo Sapiens
EELLGKYLS

SEQ ID NO: 1367007 - protein, 9 aa, Homo Sapiens
GEAELTDTR

SEQ ID NO: 1367008 - protein, 9 aa, Homo Sapiens
IHHALSRLH

SEQ ID NO: 1367009 - protein, 9 aa, Homo Sapiens
THPKSVQPH

SEQ ID NO: 1367010 - protein, 9 aa, Homo Sapiens
YCELPAVVK

SEQ ID NO: 1367011 - protein, 9 aa, Homo Sapiens
PPPSLPLPR

SEQ ID NO: 1367012 - protein, 9 aa, Homo Sapiens
VQRLGRTSC

SEQ ID NO: 1367013 - protein, 9 aa, Homo Sapiens
FGFVHDLVP

SEQ ID NO: 1367014 - protein, 9 aa, Homo Sapiens
PTSRTPWGA

SEQ ID NO: 1367015 - protein, 9 aa, Homo Sapiens
QQHSSSSSN

SEQ ID NO: 1367016 - protein, 9 aa, Homo Sapiens
SQRFRKSKK

SEQ ID NO: 1367017 - protein, 9 aa, Homo Sapiens
GAPPQNPRP

SEQ ID NO: 1367018 - protein, 9 aa, Homo Sapiens
SYNKLKENL

SEQ ID NO: 1367019 - protein, 9 aa, Homo Sapiens
GPKTPCVHG

SEQ ID NO: 1367020 - protein, 9 aa, Homo Sapiens
PDSCIGEKL

SEQ ID NO: 1367021 - protein, 9 aa, Homo Sapiens
LCAEVQGSA

SEQ ID NO: 1367022 - protein, 9 aa, Homo Sapiens
IYGRTKELT

SEQ ID NO: 1367023 - protein, 9 aa, Homo Sapiens
MHASGTSVM

SEQ ID NO: 1367024 - protein, 9 aa, Homo Sapiens
SMRVGAPPQ

SEQ ID NO: 1367025 - protein, 9 aa, Homo Sapiens
LDSVTGLDL

SEQ ID NO: 1367026 - protein, 9 aa, Homo Sapiens
LEKEQEKRR

SEQ ID NO: 1367027 - protein, 9 aa, Homo Sapiens
LHPPRGGFG

SEQ ID NO: 1367028 - protein, 9 aa, Homo Sapiens
KRAIQEVLE

SEQ ID NO: 1367029 - protein, 9 aa, Homo Sapiens
TSVFLLSHK

SEQ ID NO: 1367030 - protein, 9 aa, Homo Sapiens
SGSSARHVV

SEQ ID NO: 1367031 - protein, 9 aa, Homo Sapiens
MHFVARVHN

SEQ ID NO: 1367032 - protein, 9 aa, Homo Sapiens
MDCPYHVFT

SEQ ID NO: 1367033 - protein, 9 aa, Homo Sapiens
GKLAESEGM

SEQ ID NO: 1367034 - protein, 9 aa, Homo Sapiens
KQGANAQGE

SEQ ID NO: 1367035 - protein, 9 aa, Homo Sapiens
AARPFGREE

SEQ ID NO: 1367036 - protein, 9 aa, Homo Sapiens
EIIKLETGI

SEQ ID NO: 1367037 - protein, 9 aa, Homo Sapiens
ILRHNLNNV

SEQ ID NO: 1367038 - protein, 9 aa, Homo Sapiens
GSHKGGHFQ

SEQ ID NO: 1367039 - protein, 9 aa, Homo Sapiens
LSKAYTNHC

SEQ ID NO: 1367040 - protein, 9 aa, Homo Sapiens
LGFAGVGYV

SEQ ID NO: 1367041 - protein, 9 aa, Homo Sapiens
VLRDGGIMY

SEQ ID NO: 1367042 - protein, 9 aa, Homo Sapiens
IRKVTSVKH

SEQ ID NO: 1367043 - protein, 9 aa, Homo Sapiens
APRRAALHL

SEQ ID NO: 1367044 - protein, 9 aa, Homo Sapiens
PQCTFFFLH

SEQ ID NO: 1367045 - protein, 9 aa, Homo Sapiens
SLVTGREGC

SEQ ID NO: 1367046 - protein, 9 aa, Homo Sapiens
TFSFFIGHY

SEQ ID NO: 1367047 - protein, 9 aa, Homo Sapiens
LVLQLISFT

SEQ ID NO: 1367048 - protein, 9 aa, Homo Sapiens
EEVVVEEEL

SEQ ID NO: 1367049 - protein, 9 aa, Homo Sapiens
TNSSNLVAL

SEQ ID NO: 1367050 - protein, 9 aa, Homo Sapiens
KWNKDGCPL

SEQ ID NO: 1367051 - protein, 9 aa, Homo Sapiens
SIMWGLDKA

SEQ ID NO: 1367052 - protein, 9 aa, Homo Sapiens
LRQFFDRVS

SEQ ID NO: 1367053 - protein, 9 aa, Homo Sapiens
ETKSLALSP

SEQ ID NO: 1367054 - protein, 9 aa, Homo Sapiens
SSIQQELYS

SEQ ID NO: 1367055 - protein, 9 aa, Homo Sapiens
KERQWSLTK

SEQ ID NO: 1367056 - protein, 9 aa, Homo Sapiens
IVMLTLSNI

SEQ ID NO: 1367057 - protein, 9 aa, Homo Sapiens
ALRDSPSSQ

SEQ ID NO: 1367058 - protein, 9 aa, Homo Sapiens
NNLNDYSVR

SEQ ID NO: 1367059 - protein, 9 aa, Homo Sapiens
KQRVAAWLA

SEQ ID NO: 1367060 - protein, 9 aa, Homo Sapiens
LPCLQSAST

SEQ ID NO: 1367061 - protein, 9 aa, Homo Sapiens
HVLAPKDKK

SEQ ID NO: 1367062 - protein, 9 aa, Homo Sapiens
GRHPFRRRA

SEQ ID NO: 1367063 - protein, 9 aa, Homo Sapiens
ATTAIGGGV

SEQ ID NO: 1367064 - protein, 9 aa, Homo Sapiens
GSGLDPAAS

SEQ ID NO: 1367065 - protein, 9 aa, Homo Sapiens
SPDSTKIAT

SEQ ID NO: 1367066 - protein, 9 aa, Homo Sapiens
RWWLQVTPK

SEQ ID NO: 1367067 - protein, 9 aa, Homo Sapiens
PQILEVSFN

SEQ ID NO: 1367068 - protein, 9 aa, Homo Sapiens
FLFFTLLLS

SEQ ID NO: 1367069 - protein, 9 aa, Homo Sapiens
HTSTAALIF

SEQ ID NO: 1367070 - protein, 9 aa, Homo Sapiens
PYYISLSED

SEQ ID NO: 1367071 - protein, 9 aa, Homo Sapiens
EDRCQTCPM

SEQ ID NO: 1367072 - protein, 9 aa, Homo Sapiens
HFAHLQYAS

SEQ ID NO: 1367073 - protein, 9 aa, Homo Sapiens
CQIADSTML

SEQ ID NO: 1367074 - protein, 9 aa, Homo Sapiens
HVVQRLCES

SEQ ID NO: 1367075 - protein, 9 aa, Homo Sapiens
DTILHQRGQ

SEQ ID NO: 1367076 - protein, 9 aa, Homo Sapiens
LDLCLDILN

SEQ ID NO: 1367077 - protein, 9 aa, Homo Sapiens
PFPNPEQGL

SEQ ID NO: 1367078 - protein, 9 aa, Homo Sapiens
DNRILTYQC

SEQ ID NO: 1367079 - protein, 9 aa, Homo Sapiens
LDLCLDILD

SEQ ID NO: 1367080 - protein, 9 aa, Homo Sapiens
LCPLSTWSA

SEQ ID NO: 1367081 - protein, 9 aa, Homo Sapiens
NSNSNSNSS

SEQ ID NO: 1367082 - protein, 9 aa, Homo Sapiens
GLHVLQVEA

SEQ ID NO: 1367083 - protein, 9 aa, Homo Sapiens
TVAYSPKRP

SEQ ID NO: 1367084 - protein, 9 aa, Homo Sapiens
RPDRRECML

SEQ ID NO: 1367085 - protein, 9 aa, Homo Sapiens
IDSKNKPQS

SEQ ID NO: 1367086 - protein, 9 aa, Homo Sapiens
RAAPAMAEV

SEQ ID NO: 1367087 - protein, 9 aa, Homo Sapiens
CIRAIENID

SEQ ID NO: 1367088 - protein, 9 aa, Homo Sapiens
LDNFKRVFK

SEQ ID NO: 1367089 - protein, 9 aa, Homo Sapiens
LTYSAICKK

SEQ ID NO: 1367090 - protein, 9 aa, Homo Sapiens
SLPQMQYPD

SEQ ID NO: 1367091 - protein, 9 aa, Homo Sapiens
FNGLRFVGR

SEQ ID NO: 1367092 - protein, 9 aa, Homo Sapiens
YITTIVEMT

SEQ ID NO: 1367093 - protein, 9 aa, Homo Sapiens
GGNAPLGTH

SEQ ID NO: 1367094 - protein, 9 aa, Homo Sapiens
LLHGPYHFQ

SEQ ID NO: 1367095 - protein, 9 aa, Homo Sapiens
PLDSPPATC

SEQ ID NO: 1367096 - protein, 9 aa, Homo Sapiens
VHTNTNKIE

SEQ ID NO: 1367097 - protein, 9 aa, Homo Sapiens
VPLDSPPAT

SEQ ID NO: 1367098 - protein, 9 aa, Homo Sapiens
VLGCMAEGH

SEQ ID NO: 1367099 - protein, 9 aa, Homo Sapiens
ESGSSDTEE

SEQ ID NO: 1367100 - protein, 9 aa, Homo Sapiens
QEQVPVEEQ

SEQ ID NO: 1367101 - protein, 9 aa, Homo Sapiens
HLSDNCTIL

SEQ ID NO: 1367102 - protein, 9 aa, Homo Sapiens
AIAITFILI

SEQ ID NO: 1367103 - protein, 9 aa, Homo Sapiens
AESCIQDPS

SEQ ID NO: 1367104 - protein, 9 aa, Homo Sapiens
LPGQDTVSS

SEQ ID NO: 1367105 - protein, 9 aa, Homo Sapiens
PPGTKQGAN

SEQ ID NO: 1367106 - protein, 9 aa, Homo Sapiens
AALSLYASG

SEQ ID NO: 1367107 - protein, 9 aa, Homo Sapiens
GMRSDVWRE

SEQ ID NO: 1367108 - protein, 9 aa, Homo Sapiens
ARWGPRSPS

SEQ ID NO: 1367109 - protein, 9 aa, Homo Sapiens
PAIPHGHPP

SEQ ID NO: 1367110 - protein, 9 aa, Homo Sapiens
IQVNVSFPA

SEQ ID NO: 1367111 - protein, 9 aa, Homo Sapiens
LCNGEMFFI

SEQ ID NO: 1367112 - protein, 9 aa, Homo Sapiens
FGVELTEMD

SEQ ID NO: 1367113 - protein, 9 aa, Homo Sapiens
RRILHENMD

SEQ ID NO: 1367114 - protein, 9 aa, Homo Sapiens
SVMMTHQLP

SEQ ID NO: 1367115 - protein, 9 aa, Homo Sapiens
RTPRGTQPC

SEQ ID NO: 1367116 - protein, 9 aa, Homo Sapiens
QPSRWPSSQ

SEQ ID NO: 1367117 - protein, 9 aa, Homo Sapiens
GYSLSSGRN

SEQ ID NO: 1367118 - protein, 9 aa, Homo Sapiens
RGCCLRIHC

SEQ ID NO: 1367119 - protein, 9 aa, Homo Sapiens
GIPQQCIIL

SEQ ID NO: 1367120 - protein, 9 aa, Homo Sapiens
KGKIAQTTH

SEQ ID NO: 1367121 - protein, 9 aa, Homo Sapiens
EGQTVPHQA

SEQ ID NO: 1367122 - protein, 9 aa, Homo Sapiens
PGLGSKGKI

SEQ ID NO: 1367123 - protein, 9 aa, Homo Sapiens
SEEEREKVL

SEQ ID NO: 1367124 - protein, 9 aa, Homo Sapiens
MYMDSCSVL

SEQ ID NO: 1367125 - protein, 9 aa, Homo Sapiens
QAGERGQKS

SEQ ID NO: 1367126 - protein, 9 aa, Homo Sapiens
FQDLRPGAC

SEQ ID NO: 1367127 - protein, 9 aa, Homo Sapiens
RYTQAWAPT

SEQ ID NO: 1367128 - protein, 9 aa, Homo Sapiens
KKSGKIKSY

SEQ ID NO: 1367129 - protein, 9 aa, Homo Sapiens
HLVAGVLAA

SEQ ID NO: 1367130 - protein, 9 aa, Homo Sapiens
EKAFTHNEC

SEQ ID NO: 1367131 - protein, 9 aa, Homo Sapiens
SPPLQDGSL

SEQ ID NO: 1367132 - protein, 9 aa, Homo Sapiens
QKKDGKKRE

SEQ ID NO: 1367133 - protein, 9 aa, Homo Sapiens
HGYPEPFSG

SEQ ID NO: 1367134 - protein, 9 aa, Homo Sapiens
TDTAIDATP

SEQ ID NO: 1367135 - protein, 9 aa, Homo Sapiens
SHNSISRES

SEQ ID NO: 1367136 - protein, 9 aa, Homo Sapiens
NLGSPLMSE

SEQ ID NO: 1367137 - protein, 9 aa, Homo Sapiens
RCAHTQQGH

SEQ ID NO: 1367138 - protein, 9 aa, Homo Sapiens
AKSMLKDFD

SEQ ID NO: 1367139 - protein, 9 aa, Homo Sapiens
PRPRRSSPP

SEQ ID NO: 1367140 - protein, 9 aa, Homo Sapiens
IGKVYLKKT

SEQ ID NO: 1367141 - protein, 9 aa, Homo Sapiens
QGPRTRARA

SEQ ID NO: 1367142 - protein, 9 aa, Homo Sapiens
RIVGPQVVV

SEQ ID NO: 1367143 - protein, 9 aa, Homo Sapiens
TADVHHYLC

SEQ ID NO: 1367144 - protein, 9 aa, Homo Sapiens
CINGSEEPS

SEQ ID NO: 1367145 - protein, 9 aa, Homo Sapiens
PNGDIYCTF

SEQ ID NO: 1367146 - protein, 9 aa, Homo Sapiens
ACRKQQVAA

SEQ ID NO: 1367147 - protein, 9 aa, Homo Sapiens
PRDQVALDS

SEQ ID NO: 1367148 - protein, 9 aa, Homo Sapiens
ENYIRTQES

SEQ ID NO: 1367149 - protein, 9 aa, Homo Sapiens
QTCPCPSSW

SEQ ID NO: 1367150 - protein, 9 aa, Homo Sapiens
TPSPSHSPP

SEQ ID NO: 1367151 - protein, 9 aa, Homo Sapiens
PSCRWSGFC

SEQ ID NO: 1367152 - protein, 9 aa, Homo Sapiens
ASNFAAVPA

SEQ ID NO: 1367153 - protein, 9 aa, Homo Sapiens
CNVLRPPHI

SEQ ID NO: 1367154 - protein, 9 aa, Homo Sapiens
GEARAPLES

SEQ ID NO: 1367155 - protein, 9 aa, Homo Sapiens
VDGGIYVCR

SEQ ID NO: 1367156 - protein, 9 aa, Homo Sapiens
LGMQQNPAR

SEQ ID NO: 1367157 - protein, 9 aa, Homo Sapiens
GGQFDSFIV

SEQ ID NO: 1367158 - protein, 9 aa, Homo Sapiens
KEWLPQNDL

SEQ ID NO: 1367159 - protein, 9 aa, Homo Sapiens
SVVLITTLL

SEQ ID NO: 1367160 - protein, 9 aa, Homo Sapiens
ECKKNYSSN

SEQ ID NO: 1367161 - protein, 9 aa, Homo Sapiens
HKSKKKFKD

SEQ ID NO: 1367162 - protein, 9 aa, Homo Sapiens
DQALAQLRV

SEQ ID NO: 1367163 - protein, 9 aa, Homo Sapiens
TKQGANAQG

SEQ ID NO: 1367164 - protein, 9 aa, Homo Sapiens
RKDLTYSAI

SEQ ID NO: 1367165 - protein, 9 aa, Homo Sapiens
RTSQAFAEQ

SEQ ID NO: 1367166 - protein, 9 aa, Homo Sapiens
VEAYIDFDE

SEQ ID NO: 1367167 - protein, 9 aa, Homo Sapiens
PSAGVGIAL

SEQ ID NO: 1367168 - protein, 9 aa, Homo Sapiens
QGGLKYSRY

SEQ ID NO: 1367169 - protein, 9 aa, Homo Sapiens
RIAERNLSD

SEQ ID NO: 1367170 - protein, 9 aa, Homo Sapiens
DGLASECLH

SEQ ID NO: 1367171 - protein, 9 aa, Homo Sapiens
QNLDFERSE

SEQ ID NO: 1367172 - protein, 9 aa, Homo Sapiens
LLTSGHLPP

SEQ ID NO: 1367173 - protein, 9 aa, Homo Sapiens
PALGRLRGR

SEQ ID NO: 1367174 - protein, 9 aa, Homo Sapiens
EGYSLSSGR

SEQ ID NO: 1367175 - protein, 9 aa, Homo Sapiens
KTLFFFKSE

SEQ ID NO: 1367176 - protein, 9 aa, Homo Sapiens
QQIMKELNK

SEQ ID NO: 1367177 - protein, 9 aa, Homo Sapiens
EEDNAGRAV

SEQ ID NO: 1367178 - protein, 9 aa, Homo Sapiens
PPDLLGPAG

SEQ ID NO: 1367179 - protein, 9 aa, Homo Sapiens
NLLRCICKF

SEQ ID NO: 1367180 - protein, 9 aa, Homo Sapiens
RLEGIEHMY

SEQ ID NO: 1367181 - protein, 9 aa, Homo Sapiens
REPGLLIFF

SEQ ID NO: 1367182 - protein, 9 aa, Homo Sapiens
EFVFLGFAG

SEQ ID NO: 1367183 - protein, 9 aa, Homo Sapiens
STTQAIEYN

SEQ ID NO: 1367184 - protein, 9 aa, Homo Sapiens
ALPNVTFLP

SEQ ID NO: 1367185 - protein, 9 aa, Homo Sapiens
EEHSLEVHC

SEQ ID NO: 1367186 - protein, 9 aa, Homo Sapiens
SMGQTWGPR

SEQ ID NO: 1367187 - protein, 9 aa, Homo Sapiens
RHQCEEVAR

SEQ ID NO: 1367188 - protein, 9 aa, Homo Sapiens
FCFTASHID

SEQ ID NO: 1367189 - protein, 9 aa, Homo Sapiens
ASECLHEDL

SEQ ID NO: 1367190 - protein, 9 aa, Homo Sapiens
APLHKPEME

SEQ ID NO: 1367191 - protein, 9 aa, Homo Sapiens
LRPLHALSQ

SEQ ID NO: 1367192 - protein, 9 aa, Homo Sapiens
TVAVMNEHH

SEQ ID NO: 1367193 - protein, 9 aa, Homo Sapiens
KTFEKKGGK

SEQ ID NO: 1367194 - protein, 9 aa, Homo Sapiens
AVNNFKNEA

SEQ ID NO: 1367195 - protein, 9 aa, Homo Sapiens
RRGRACARP

SEQ ID NO: 1367196 - protein, 9 aa, Homo Sapiens
EEQDAHPES

SEQ ID NO: 1367197 - protein, 9 aa, Homo Sapiens
HTSAMMKLP

SEQ ID NO: 1367198 - protein, 9 aa, Homo Sapiens
PVGPLDKAR

SEQ ID NO: 1367199 - protein, 9 aa, Homo Sapiens
AKEGHQMPQ

SEQ ID NO: 1367200 - protein, 9 aa, Homo Sapiens
AAPAGPQRD

SEQ ID NO: 1367201 - protein, 9 aa, Homo Sapiens
IIGRSWFPS

SEQ ID NO: 1367202 - protein, 9 aa, Homo Sapiens
VWPSAVVLD

SEQ ID NO: 1367203 - protein, 9 aa, Homo Sapiens
GGGLRPQEG

SEQ ID NO: 1367204 - protein, 9 aa, Homo Sapiens
GARWGPRSP

SEQ ID NO: 1367205 - protein, 9 aa, Homo Sapiens
AGVDVIAPR

SEQ ID NO: 1367206 - protein, 9 aa, Homo Sapiens
RLGRTSCLP

SEQ ID NO: 1367207 - protein, 9 aa, Homo Sapiens
KQGMEVVQL

SEQ ID NO: 1367208 - protein, 9 aa, Homo Sapiens
CSEFLWFQL

SEQ ID NO: 1367209 - protein, 9 aa, Homo Sapiens
ECLEVQRQL

SEQ ID NO: 1367210 - protein, 9 aa, Homo Sapiens
GSPPGSLLS

SEQ ID NO: 1367211 - protein, 9 aa, Homo Sapiens
QMKRPLGMQ

SEQ ID NO: 1367212 - protein, 9 aa, Homo Sapiens
SCDRKLGAW

SEQ ID NO: 1367213 - protein, 9 aa, Homo Sapiens
DATPSAPLD

SEQ ID NO: 1367214 - protein, 9 aa, Homo Sapiens
ETNQDNASA

SEQ ID NO: 1367215 - protein, 9 aa, Homo Sapiens
FCPLEIDYG

SEQ ID NO: 1367216 - protein, 9 aa, Homo Sapiens
IQAALSLYA

SEQ ID NO: 1367217 - protein, 9 aa, Homo Sapiens
WEPVPRVQG

SEQ ID NO: 1367218 - protein, 9 aa, Homo Sapiens
GHCSDYCSA

SEQ ID NO: 1367219 - protein, 9 aa, Homo Sapiens
LLDPDSMDD

SEQ ID NO: 1367220 - protein, 9 aa, Homo Sapiens
SETEHQVQG

SEQ ID NO: 1367221 - protein, 9 aa, Homo Sapiens
SPGYTQGTG

SEQ ID NO: 1367222 - protein, 9 aa, Homo Sapiens
RAIQEVLEE

SEQ ID NO: 1367223 - protein, 9 aa, Homo Sapiens
YQTLPEEPQ

SEQ ID NO: 1367224 - protein, 9 aa, Homo Sapiens
KAQFSLEEK

SEQ ID NO: 1367225 - protein, 9 aa, Homo Sapiens
IQLMLLFLI

SEQ ID NO: 1367226 - protein, 9 aa, Homo Sapiens
SDFDDEEPH

SEQ ID NO: 1367227 - protein, 9 aa, Homo Sapiens
EHQAHQADG

SEQ ID NO: 1367228 - protein, 9 aa, Homo Sapiens
AGSYQVKPQ

SEQ ID NO: 1367229 - protein, 9 aa, Homo Sapiens
RIIEIMQKP

SEQ ID NO: 1367230 - protein, 9 aa, Homo Sapiens
PTICECWRE

SEQ ID NO: 1367231 - protein, 9 aa, Homo Sapiens
GGNLLQVLM

SEQ ID NO: 1367232 - protein, 9 aa, Homo Sapiens
PEECGAVGN

SEQ ID NO: 1367233 - protein, 9 aa, Homo Sapiens
SRLHLVATP

SEQ ID NO: 1367234 - protein, 9 aa, Homo Sapiens
GKGGKNRHR

SEQ ID NO: 1367235 - protein, 9 aa, Homo Sapiens
EGRHQRGRG

SEQ ID NO: 1367236 - protein, 9 aa, Homo Sapiens
PALGSSRLP

SEQ ID NO: 1367237 - protein, 9 aa, Homo Sapiens
PGVKKDSED

SEQ ID NO: 1367238 - protein, 9 aa, Homo Sapiens
IYQTPGLGS

SEQ ID NO: 1367239 - protein, 9 aa, Homo Sapiens
HLPEVCDGM

SEQ ID NO: 1367240 - protein, 9 aa, Homo Sapiens
QSPATPVSG

SEQ ID NO: 1367241 - protein, 9 aa, Homo Sapiens
RLHFESDGL

SEQ ID NO: 1367242 - protein, 9 aa, Homo Sapiens
EENLANRGH

SEQ ID NO: 1367243 - protein, 9 aa, Homo Sapiens
AIPHGHPPP

SEQ ID NO: 1367244 - protein, 9 aa, Homo Sapiens
NGSRKCPPH

SEQ ID NO: 1367245 - protein, 9 aa, Homo Sapiens
HRPGTPPPL

SEQ ID NO: 1367246 - protein, 9 aa, Homo Sapiens
LVTAIAVDC

SEQ ID NO: 1367247 - protein, 9 aa, Homo Sapiens
SLPCPLPAT

SEQ ID NO: 1367248 - protein, 9 aa, Homo Sapiens
ASFNITSST

SEQ ID NO: 1367249 - protein, 9 aa, Homo Sapiens
HSGKPPAMR

SEQ ID NO: 1367250 - protein, 9 aa, Homo Sapiens
MGDQKASSR

SEQ ID NO: 1367251 - protein, 9 aa, Homo Sapiens
RRYRDTKGP

SEQ ID NO: 1367252 - protein, 9 aa, Homo Sapiens
VFKRTSPLL

SEQ ID NO: 1367253 - protein, 9 aa, Homo Sapiens
REEFKEPKA

SEQ ID NO: 1367254 - protein, 9 aa, Homo Sapiens
VMNEHHEAI

SEQ ID NO: 1367255 - protein, 9 aa, Homo Sapiens
VVVFEAVLN

SEQ ID NO: 1367256 - protein, 9 aa, Homo Sapiens
VTSVKHLKA

SEQ ID NO: 1367257 - protein, 9 aa, Homo Sapiens
TRAVGKSQD

SEQ ID NO: 1367258 - protein, 9 aa, Homo Sapiens
VELTEMDSS

SEQ ID NO: 1367259 - protein, 9 aa, Homo Sapiens
PEPENFSSM

SEQ ID NO: 1367260 - protein, 9 aa, Homo Sapiens
MVYLPGIHG

SEQ ID NO: 1367261 - protein, 9 aa, Homo Sapiens
QKALFLEPR

SEQ ID NO: 1367262 - protein, 9 aa, Homo Sapiens
TKLPRLSKG

SEQ ID NO: 1367263 - protein, 9 aa, Homo Sapiens
VTSLCKPSS

SEQ ID NO: 1367264 - protein, 9 aa, Homo Sapiens
EHIDFVTPI

SEQ ID NO: 1367265 - protein, 9 aa, Homo Sapiens
MTPYYISLS

SEQ ID NO: 1367266 - protein, 9 aa, Homo Sapiens
LQVTPRAGA

SEQ ID NO: 1367267 - protein, 9 aa, Homo Sapiens
NSRIIEIMQ

SEQ ID NO: 1367268 - protein, 9 aa, Homo Sapiens
WPDQHCSLP

SEQ ID NO: 1367269 - protein, 9 aa, Homo Sapiens
ATSQGLWNR

SEQ ID NO: 1367270 - protein, 9 aa, Homo Sapiens
GGPGPRVDA

SEQ ID NO: 1367271 - protein, 9 aa, Homo Sapiens
SSQGTLSLQ

SEQ ID NO: 1367272 - protein, 9 aa, Homo Sapiens
AEVQGSAGG

SEQ ID NO: 1367273 - protein, 9 aa, Homo Sapiens
SGRLISHMG

SEQ ID NO: 1367274 - protein, 9 aa, Homo Sapiens
DCPMVLKVV

SEQ ID NO: 1367275 - protein, 9 aa, Homo Sapiens
AGDKRDALL

SEQ ID NO: 1367276 - protein, 9 aa, Homo Sapiens
KWRRQPVLQ

SEQ ID NO: 1367277 - protein, 9 aa, Homo Sapiens
VAGVLAASA

SEQ ID NO: 1367278 - protein, 9 aa, Homo Sapiens
ATGRAAPAM

SEQ ID NO: 1367279 - protein, 9 aa, Homo Sapiens
FESDGLTSQ

SEQ ID NO: 1367280 - protein, 9 aa, Homo Sapiens
DANLEGKKR

SEQ ID NO: 1367281 - protein, 9 aa, Homo Sapiens
ACVSKNSSS

SEQ ID NO: 1367282 - protein, 9 aa, Homo Sapiens
DRPTGVGVY

SEQ ID NO: 1367283 - protein, 9 aa, Homo Sapiens
CRRQLDNFK

SEQ ID NO: 1367284 - protein, 9 aa, Homo Sapiens
DTSRPPYRG

SEQ ID NO: 1367285 - protein, 9 aa, Homo Sapiens
DSPRASQTE

SEQ ID NO: 1367286 - protein, 9 aa, Homo Sapiens
SCQSRTSSI

SEQ ID NO: 1367287 - protein, 9 aa, Homo Sapiens
HTRVDEYHI

SEQ ID NO: 1367288 - protein, 9 aa, Homo Sapiens
LRCSQNFCP

SEQ ID NO: 1367289 - protein, 9 aa, Homo Sapiens
EDLHPTSET

SEQ ID NO: 1367290 - protein, 9 aa, Homo Sapiens
ALQCHISKL

SEQ ID NO: 1367291 - protein, 9 aa, Homo Sapiens
SIMPAQTAA

SEQ ID NO: 1367292 - protein, 9 aa, Homo Sapiens
LVACSLISV

SEQ ID NO: 1367293 - protein, 9 aa, Homo Sapiens
SLTVCLLFF

SEQ ID NO: 1367294 - protein, 9 aa, Homo Sapiens
AGPSTAWSM

SEQ ID NO: 1367295 - protein, 9 aa, Homo Sapiens
IDFDEDDNL

SEQ ID NO: 1367296 - protein, 9 aa, Homo Sapiens
YRGILEASS

SEQ ID NO: 1367297 - protein, 9 aa, Homo Sapiens
ERVEHCAKE

SEQ ID NO: 1367298 - protein, 9 aa, Homo Sapiens
RHCGATVDV

SEQ ID NO: 1367299 - protein, 9 aa, Homo Sapiens
KSWGRWCWW

SEQ ID NO: 1367300 - protein, 9 aa, Homo Sapiens
SDEEAVEEP

SEQ ID NO: 1367301 - protein, 9 aa, Homo Sapiens
VALRCDTRL

SEQ ID NO: 1367302 - protein, 9 aa, Homo Sapiens
LSDYGPPSP

SEQ ID NO: 1367303 - protein, 9 aa, Homo Sapiens
CKSKEVEIK

SEQ ID NO: 1367304 - protein, 9 aa, Homo Sapiens
LEQQEAESG

SEQ ID NO: 1367305 - protein, 9 aa, Homo Sapiens
ELQPTRSYE

SEQ ID NO: 1367306 - protein, 9 aa, Homo Sapiens
HQTQYRPIF

SEQ ID NO: 1367307 - protein, 9 aa, Homo Sapiens
PPQPGLPHG

SEQ ID NO: 1367308 - protein, 9 aa, Homo Sapiens
KSCRRQLDN

SEQ ID NO: 1367309 - protein, 9 aa, Homo Sapiens
WSRDQGFCQ

SEQ ID NO: 1367310 - protein, 9 aa, Homo Sapiens
PMIIHCIAG

SEQ ID NO: 1367311 - protein, 9 aa, Homo Sapiens
AALPPALGT

SEQ ID NO: 1367312 - protein, 9 aa, Homo Sapiens
LFSGKDQPL

SEQ ID NO: 1367313 - protein, 9 aa, Homo Sapiens
RGNLHGQAE

SEQ ID NO: 1367314 - protein, 9 aa, Homo Sapiens
RADEVRLRC

SEQ ID NO: 1367315 - protein, 9 aa, Homo Sapiens
GRSWFPSAP

SEQ ID NO: 1367316 - protein, 9 aa, Homo Sapiens
IYVVEGGTL

SEQ ID NO: 1367317 - protein, 9 aa, Homo Sapiens
TLSWGSPTR

SEQ ID NO: 1367318 - protein, 9 aa, Homo Sapiens
LGKKTLFFF

SEQ ID NO: 1367319 - protein, 9 aa, Homo Sapiens
PTALVAGPS

SEQ ID NO: 1367320 - protein, 9 aa, Homo Sapiens
QCLFHRPLR

SEQ ID NO: 1367321 - protein, 9 aa, Homo Sapiens
RCSQAVANG

SEQ ID NO: 1367322 - protein, 9 aa, Homo Sapiens
LDYAGLASV

SEQ ID NO: 1367323 - protein, 9 aa, Homo Sapiens
TQSILTRVG

SEQ ID NO: 1367324 - protein, 9 aa, Homo Sapiens
PHLVAGVLA

SEQ ID NO: 1367325 - protein, 9 aa, Homo Sapiens
SESQESHMA

SEQ ID NO: 1367326 - protein, 9 aa, Homo Sapiens
SVIRQVLEN

SEQ ID NO: 1367327 - protein, 9 aa, Homo Sapiens
LNNHEDSTY

SEQ ID NO: 1367328 - protein, 9 aa, Homo Sapiens
MVAFKMGFK

SEQ ID NO: 1367329 - protein, 9 aa, Homo Sapiens
WNLCLPAPA

SEQ ID NO: 1367330 - protein, 9 aa, Homo Sapiens
GRPHGDIYG

SEQ ID NO: 1367331 - protein, 9 aa, Homo Sapiens
SVMYRSQSE

SEQ ID NO: 1367332 - protein, 9 aa, Homo Sapiens
GMGVGSGLC

SEQ ID NO: 1367333 - protein, 9 aa, Homo Sapiens
RAHVIFQSP

SEQ ID NO: 1367334 - protein, 9 aa, Homo Sapiens
GRADRLLRG

SEQ ID NO: 1367335 - protein, 9 aa, Homo Sapiens
NIARLEEET

SEQ ID NO: 1367336 - protein, 9 aa, Homo Sapiens
GVELTEMDS

SEQ ID NO: 1367337 - protein, 9 aa, Homo Sapiens
FLQLAICCC

SEQ ID NO: 1367338 - protein, 9 aa, Homo Sapiens
GIPGHRGEM

SEQ ID NO: 1367339 - protein, 9 aa, Homo Sapiens
SLTCPLDSG

SEQ ID NO: 1367340 - protein, 9 aa, Homo Sapiens
EMLPAGLIQ

SEQ ID NO: 1367341 - protein, 9 aa, Homo Sapiens
ECDGCEEDN

SEQ ID NO: 1367342 - protein, 9 aa, Homo Sapiens
DTQNSFADC

SEQ ID NO: 1367343 - protein, 9 aa, Homo Sapiens
NMDIYLMPT

SEQ ID NO: 1367344 - protein, 9 aa, Homo Sapiens
VLQLISFTL

SEQ ID NO: 1367345 - protein, 9 aa, Homo Sapiens
SGRASRKTW

SEQ ID NO: 1367346 - protein, 9 aa, Homo Sapiens
PRRSSPPRR

SEQ ID NO: 1367347 - protein, 9 aa, Homo Sapiens
KDSWKVKAL

SEQ ID NO: 1367348 - protein, 9 aa, Homo Sapiens
HRDLKPEDL

SEQ ID NO: 1367349 - protein, 9 aa, Homo Sapiens
VSVLSPRRL

SEQ ID NO: 1367350 - protein, 9 aa, Homo Sapiens
VDQLQQDGL

SEQ ID NO: 1367351 - protein, 9 aa, Homo Sapiens
TVKQAVRRL

SEQ ID NO: 1367352 - protein, 9 aa, Homo Sapiens
LIQLLKSGE

SEQ ID NO: 1367353 - protein, 9 aa, Homo Sapiens
SLLRNFEEV

SEQ ID NO: 1367354 - protein, 9 aa, Homo Sapiens
TSVMRSCHT

SEQ ID NO: 1367355 - protein, 9 aa, Homo Sapiens
APRSGRFLG

SEQ ID NO: 1367356 - protein, 9 aa, Homo Sapiens
KYVETKSPH

SEQ ID NO: 1367357 - protein, 9 aa, Homo Sapiens
IHSTARVVP

SEQ ID NO: 1367358 - protein, 9 aa, Homo Sapiens
SSLWNWREM

SEQ ID NO: 1367359 - protein, 9 aa, Homo Sapiens
EAAAVVMVV

SEQ ID NO: 1367360 - protein, 9 aa, Homo Sapiens
PLPVQPRLE

SEQ ID NO: 1367361 - protein, 9 aa, Homo Sapiens
VKVKDNNYN

SEQ ID NO: 1367362 - protein, 9 aa, Homo Sapiens
APSVLTALG

SEQ ID NO: 1367363 - protein, 9 aa, Homo Sapiens
PLWKKPWGF

SEQ ID NO: 1367364 - protein, 9 aa, Homo Sapiens
GVAYPVRIG

SEQ ID NO: 1367365 - protein, 9 aa, Homo Sapiens
LGTCSIWST

SEQ ID NO: 1367366 - protein, 9 aa, Homo Sapiens
FDVHNHRWR

SEQ ID NO: 1367367 - protein, 9 aa, Homo Sapiens
EQKRSRAQE

SEQ ID NO: 1367368 - protein, 9 aa, Homo Sapiens
EQFGMYVID

SEQ ID NO: 1367369 - protein, 9 aa, Homo Sapiens
MHHICFFLV

SEQ ID NO: 1367370 - protein, 9 aa, Homo Sapiens
LETGIRELH

SEQ ID NO: 1367371 - protein, 9 aa, Homo Sapiens
FMKQINDAH

SEQ ID NO: 1367372 - protein, 9 aa, Homo Sapiens
SLQERGGGL

SEQ ID NO: 1367373 - protein, 9 aa, Homo Sapiens
GTSILSYFN

SEQ ID NO: 1367374 - protein, 9 aa, Homo Sapiens
NWREMMGCL

SEQ ID NO: 1367375 - protein, 9 aa, Homo Sapiens
ADKCAVDIG

SEQ ID NO: 1367376 - protein, 9 aa, Homo Sapiens
APQVAMLPK

SEQ ID NO: 1367377 - protein, 9 aa, Homo Sapiens
PRRRLWPPS

SEQ ID NO: 1367378 - protein, 9 aa, Homo Sapiens
IAGVGRTGT

SEQ ID NO: 1367379 - protein, 9 aa, Homo Sapiens
KYMVKLKLK

SEQ ID NO: 1367380 - protein, 9 aa, Homo Sapiens
IHTQMQQKG

SEQ ID NO: 1367381 - protein, 9 aa, Homo Sapiens
QERGGGLRP

SEQ ID NO: 1367382 - protein, 9 aa, Homo Sapiens
QDGSLDRNL

SEQ ID NO: 1367383 - protein, 9 aa, Homo Sapiens
NQGKRNKDG

SEQ ID NO: 1367384 - protein, 9 aa, Homo Sapiens
HEHFNLNVA

SEQ ID NO: 1367385 - protein, 9 aa, Homo Sapiens
LNTHNLLFK

SEQ ID NO: 1367386 - protein, 9 aa, Homo Sapiens
KKTLFFFKS

SEQ ID NO: 1367387 - protein, 9 aa, Homo Sapiens
HLHWHSGDR

SEQ ID NO: 1367388 - protein, 9 aa, Homo Sapiens
VLEKRVQEL

SEQ ID NO: 1367389 - protein, 9 aa, Homo Sapiens
DPVLGEDEV

SEQ ID NO: 1367390 - protein, 9 aa, Homo Sapiens
RGNWWRKSW

SEQ ID NO: 1367391 - protein, 9 aa, Homo Sapiens
ETVAPTSSP

SEQ ID NO: 1367392 - protein, 9 aa, Homo Sapiens
RIRNILDVS

SEQ ID NO: 1367393 - protein, 9 aa, Homo Sapiens
FYCELPAVV

SEQ ID NO: 1367394 - protein, 9 aa, Homo Sapiens
IICVTVGDA

SEQ ID NO: 1367395 - protein, 9 aa, Homo Sapiens
AAPRAGRGR

SEQ ID NO: 1367396 - protein, 9 aa, Homo Sapiens
KSSGALEKE

SEQ ID NO: 1367397 - protein, 9 aa, Homo Sapiens
ISHAGHVLA

SEQ ID NO: 1367398 - protein, 9 aa, Homo Sapiens
HVLQVEAPH

SEQ ID NO: 1367399 - protein, 9 aa, Homo Sapiens
SIERDGAKS

SEQ ID NO: 1367400 - protein, 9 aa, Homo Sapiens
EGLKSWEVI

SEQ ID NO: 1367401 - protein, 9 aa, Homo Sapiens
NSSRESDNH

SEQ ID NO: 1367402 - protein, 9 aa, Homo Sapiens
LCCAAVGRA

SEQ ID NO: 1367403 - protein, 9 aa, Homo Sapiens
GVEIHDKLQ

SEQ ID NO: 1367404 - protein, 9 aa, Homo Sapiens
GRTRPSSDR

SEQ ID NO: 1367405 - protein, 9 aa, Homo Sapiens
FKYGHYNER

SEQ ID NO: 1367406 - protein, 9 aa, Homo Sapiens
QDRDSHRSQ

SEQ ID NO: 1367407 - protein, 9 aa, Homo Sapiens
PFFDMHMTV

SEQ ID NO: 1367408 - protein, 9 aa, Homo Sapiens
LPYLSAVEF

SEQ ID NO: 1367409 - protein, 9 aa, Homo Sapiens
ISIVCMFLA

SEQ ID NO: 1367410 - protein, 9 aa, Homo Sapiens
GQDTVSSCW

SEQ ID NO: 1367411 - protein, 9 aa, Homo Sapiens
LSAPTTVTH

SEQ ID NO: 1367412 - protein, 9 aa, Homo Sapiens
AEAGGAGEG

SEQ ID NO: 1367413 - protein, 9 aa, Homo Sapiens
CLSYYEDRH

SEQ ID NO: 1367414 - protein, 9 aa, Homo Sapiens
LQLELYHTA

SEQ ID NO: 1367415 - protein, 9 aa, Homo Sapiens
ASRQTCPCP

SEQ ID NO: 1367416 - protein, 9 aa, Homo Sapiens
ARVEVAAGP

SEQ ID NO: 1367417 - protein, 9 aa, Homo Sapiens
STRSGPFFY

SEQ ID NO: 1367418 - protein, 9 aa, Homo Sapiens
LSAVTALLP

SEQ ID NO: 1367419 - protein, 9 aa, Homo Sapiens
DLAHILTHL

SEQ ID NO: 1367420 - protein, 9 aa, Homo Sapiens
CPVDGGIYV

SEQ ID NO: 1367421 - protein, 9 aa, Homo Sapiens
DGFSCGGNL

SEQ ID NO: 1367422 - protein, 9 aa, Homo Sapiens
GLLLPLAPA

SEQ ID NO: 1367423 - protein, 9 aa, Homo Sapiens
VRPVATLSP

SEQ ID NO: 1367424 - protein, 9 aa, Homo Sapiens
LWGAEEGAA

SEQ ID NO: 1367425 - protein, 9 aa, Homo Sapiens
KRPPKENLS

SEQ ID NO: 1367426 - protein, 9 aa, Homo Sapiens
LRARDQTHS

SEQ ID NO: 1367427 - protein, 9 aa, Homo Sapiens
PGQDTVSSC

SEQ ID NO: 1367428 - protein, 9 aa, Homo Sapiens
SSPKAPGLM

SEQ ID NO: 1367429 - protein, 9 aa, Homo Sapiens
PQPPKSFQL

SEQ ID NO: 1367430 - protein, 9 aa, Homo Sapiens
CCLRIHCVA

SEQ ID NO: 1367431 - protein, 9 aa, Homo Sapiens
PASAVSCQS

SEQ ID NO: 1367432 - protein, 9 aa, Homo Sapiens
SGRGSGGKW

SEQ ID NO: 1367433 - protein, 9 aa, Homo Sapiens
LSHRTITGA

SEQ ID NO: 1367434 - protein, 9 aa, Homo Sapiens
VQGGLFLDV

SEQ ID NO: 1367435 - protein, 9 aa, Homo Sapiens
GLSWTVPGG

SEQ ID NO: 1367436 - protein, 9 aa, Homo Sapiens
LRPPAQCLW

SEQ ID NO: 1367437 - protein, 9 aa, Homo Sapiens
QMPQSAYTG

SEQ ID NO: 1367438 - protein, 9 aa, Homo Sapiens
KCCAYDSLG

SEQ ID NO: 1367439 - protein, 9 aa, Homo Sapiens
TAFLNTTQL

SEQ ID NO: 1367440 - protein, 9 aa, Homo Sapiens
DTANPCLIL

SEQ ID NO: 1367441 - protein, 9 aa, Homo Sapiens
EDGLAVVKF

SEQ ID NO: 1367442 - protein, 9 aa, Homo Sapiens
WTLCGACCP

SEQ ID NO: 1367443 - protein, 9 aa, Homo Sapiens
GGLFLDVVV

SEQ ID NO: 1367444 - protein, 9 aa, Homo Sapiens
PLLIRRNAF

SEQ ID NO: 1367445 - protein, 9 aa, Homo Sapiens
LPLLGKAVP

SEQ ID NO: 1367446 - protein, 9 aa, Homo Sapiens
HITSLKEAA

SEQ ID NO: 1367447 - protein, 9 aa, Homo Sapiens
RNEPCAVVQ

SEQ ID NO: 1367448 - protein, 9 aa, Homo Sapiens
VIRGRCLVA

SEQ ID NO: 1367449 - protein, 9 aa, Homo Sapiens
AWSLIGHLH

SEQ ID NO: 1367450 - protein, 9 aa, Homo Sapiens
QRSVWHRPQ

SEQ ID NO: 1367451 - protein, 9 aa, Homo Sapiens
HHQAHSPLG

SEQ ID NO: 1367452 - protein, 9 aa, Homo Sapiens
DPLLHKCCP

SEQ ID NO: 1367453 - protein, 9 aa, Homo Sapiens
HVHRRVCVL

SEQ ID NO: 1367454 - protein, 9 aa, Homo Sapiens
VSCFSTTTL

SEQ ID NO: 1367455 - protein, 9 aa, Homo Sapiens
SSSSQRLLR

SEQ ID NO: 1367456 - protein, 9 aa, Homo Sapiens
TLDPIIAVE

SEQ ID NO: 1367457 - protein, 9 aa, Homo Sapiens
LAGRGRPGA

SEQ ID NO: 1367458 - protein, 9 aa, Homo Sapiens
YTNSVCQGQ

SEQ ID NO: 1367459 - protein, 9 aa, Homo Sapiens
LRVLTACLT

SEQ ID NO: 1367460 - protein, 9 aa, Homo Sapiens
LQQGAVAND

SEQ ID NO: 1367461 - protein, 9 aa, Homo Sapiens
LALPMENGS

SEQ ID NO: 1367462 - protein, 9 aa, Homo Sapiens
AVFDPFWDL

SEQ ID NO: 1367463 - protein, 9 aa, Homo Sapiens
GSGGDIPGQ

SEQ ID NO: 1367464 - protein, 9 aa, Homo Sapiens
DCSVSQTTL

SEQ ID NO: 1367465 - protein, 9 aa, Homo Sapiens
GEHLCDAPQ

SEQ ID NO: 1367466 - protein, 9 aa, Homo Sapiens
GSYQVKPQM

SEQ ID NO: 1367467 - protein, 9 aa, Homo Sapiens
VQDARTGQS

SEQ ID NO: 1367468 - protein, 9 aa, Homo Sapiens
MRILYKYLA

SEQ ID NO: 1367469 - protein, 9 aa, Homo Sapiens
QFVLKFLDP

SEQ ID NO: 1367470 - protein, 9 aa, Homo Sapiens
MQQNPARTC

SEQ ID NO: 1367471 - protein, 9 aa, Homo Sapiens
VPHQAQDKL

SEQ ID NO: 1367472 - protein, 9 aa, Homo Sapiens
DTNDSPPVF

SEQ ID NO: 1367473 - protein, 9 aa, Homo Sapiens
LHSQLPHPH

SEQ ID NO: 1367474 - protein, 9 aa, Homo Sapiens
GSLNEKSEG

SEQ ID NO: 1367475 - protein, 9 aa, Homo Sapiens
EDAIAYVEC

SEQ ID NO: 1367476 - protein, 9 aa, Homo Sapiens
RTMAGPSAS

SEQ ID NO: 1367477 - protein, 9 aa, Homo Sapiens
ETRRRLGVE

SEQ ID NO: 1367478 - protein, 9 aa, Homo Sapiens
YVVEGGTLI

SEQ ID NO: 1367479 - protein, 9 aa, Homo Sapiens
LVQPLAFHS

SEQ ID NO: 1367480 - protein, 9 aa, Homo Sapiens
ADHPPAPRR

SEQ ID NO: 1367481 - protein, 9 aa, Homo Sapiens
CFSLTCPLD

SEQ ID NO: 1367482 - protein, 9 aa, Homo Sapiens
PPHIAPRDQ

SEQ ID NO: 1367483 - protein, 9 aa, Homo Sapiens
LGCMAEGHG

SEQ ID NO: 1367484 - protein, 9 aa, Homo Sapiens
FSRCGPGSQ

SEQ ID NO: 1367485 - protein, 9 aa, Homo Sapiens
MYNSPHHRV

SEQ ID NO: 1367486 - protein, 9 aa, Homo Sapiens
PWGAMVPRG

SEQ ID NO: 1367487 - protein, 9 aa, Homo Sapiens
DIPDGLFWM

SEQ ID NO: 1367488 - protein, 9 aa, Homo Sapiens
PMHSGTFDC

SEQ ID NO: 1367489 - protein, 9 aa, Homo Sapiens
EKEPLRVKP

SEQ ID NO: 1367490 - protein, 9 aa, Homo Sapiens
QRTSQAFAE

SEQ ID NO: 1367491 - protein, 9 aa, Homo Sapiens
FFFFFFETK

SEQ ID NO: 1367492 - protein, 9 aa, Homo Sapiens
VSRWLQNAL

SEQ ID NO: 1367493 - protein, 9 aa, Homo Sapiens
CHKVIRGRC

SEQ ID NO: 1367494 - protein, 9 aa, Homo Sapiens
SAGPVTRRS

SEQ ID NO: 1367495 - protein, 9 aa, Homo Sapiens
ANLEGKKRF

SEQ ID NO: 1367496 - protein, 9 aa, Homo Sapiens
TSIIDSTVT

SEQ ID NO: 1367497 - protein, 9 aa, Homo Sapiens
QILGEAMAP

SEQ ID NO: 1367498 - protein, 9 aa, Homo Sapiens
VRADEVRLR

SEQ ID NO: 1367499 - protein, 9 aa, Homo Sapiens
QKLVKVRTD

SEQ ID NO: 1367500 - protein, 9 aa, Homo Sapiens
GILTEQRMI

SEQ ID NO: 1367501 - protein, 9 aa, Homo Sapiens
NPSHRETVA

SEQ ID NO: 1367502 - protein, 9 aa, Homo Sapiens
AALPHHLPE

SEQ ID NO: 1367503 - protein, 9 aa, Homo Sapiens
CRKQGMEVV

SEQ ID NO: 1367504 - protein, 9 aa, Homo Sapiens
AANGNPDPE

SEQ ID NO: 1367505 - protein, 9 aa, Homo Sapiens
HGQQGQAGM

SEQ ID NO: 1367506 - protein, 9 aa, Homo Sapiens
RAVKKVRLE

SEQ ID NO: 1367507 - protein, 9 aa, Homo Sapiens
KLSCFNFEF

SEQ ID NO: 1367508 - protein, 9 aa, Homo Sapiens
YRHEMLPAG

SEQ ID NO: 1367509 - protein, 9 aa, Homo Sapiens
PPSPGYTQG

SEQ ID NO: 1367510 - protein, 9 aa, Homo Sapiens
AGPEEAAGP

SEQ ID NO: 1367511 - protein, 9 aa, Homo Sapiens
LRPRSVVIQ

SEQ ID NO: 1367512 - protein, 9 aa, Homo Sapiens
PDSMDDEFE

SEQ ID NO: 1367513 - protein, 9 aa, Homo Sapiens
WWRKSWGRW

SEQ ID NO: 1367514 - protein, 9 aa, Homo Sapiens
HGGLRSGPA

SEQ ID NO: 1367515 - protein, 9 aa, Homo Sapiens
PGPHSGATP

SEQ ID NO: 1367516 - protein, 9 aa, Homo Sapiens
AAAPSPEKR

SEQ ID NO: 1367517 - protein, 9 aa, Homo Sapiens
DGSDAPLEA

SEQ ID NO: 1367518 - protein, 9 aa, Homo Sapiens
VAVDGSVIR

SEQ ID NO: 1367519 - protein, 9 aa, Homo Sapiens
AGVGYVRGW

SEQ ID NO: 1367520 - protein, 9 aa, Homo Sapiens
PCSSFSRRE

SEQ ID NO: 1367521 - protein, 9 aa, Homo Sapiens
FLQIPTNRV

SEQ ID NO: 1367522 - protein, 9 aa, Homo Sapiens
DPVNHYHIG

SEQ ID NO: 1367523 - protein, 9 aa, Homo Sapiens
QHYVRKVLE

SEQ ID NO: 1367524 - protein, 9 aa, Homo Sapiens
PMPAATIVH

SEQ ID NO: 1367525 - protein, 9 aa, Homo Sapiens
ARVHNRCSK

SEQ ID NO: 1367526 - protein, 9 aa, Homo Sapiens
RRRKERQWS

SEQ ID NO: 1367527 - protein, 9 aa, Homo Sapiens
RRRAAGGCG

SEQ ID NO: 1367528 - protein, 9 aa, Homo Sapiens
AVGEPGFFS

SEQ ID NO: 1367529 - protein, 9 aa, Homo Sapiens
AICCCHCLL

SEQ ID NO: 1367530 - protein, 9 aa, Homo Sapiens
GFAGVGYVR

SEQ ID NO: 1367531 - protein, 9 aa, Homo Sapiens
VLAHDLASR

SEQ ID NO: 1367532 - protein, 9 aa, Homo Sapiens
GPVHLVQQC

SEQ ID NO: 1367533 - protein, 9 aa, Homo Sapiens
SVSCKPVCC

SEQ ID NO: 1367534 - protein, 9 aa, Homo Sapiens
LWFRDTLNL

SEQ ID NO: 1367535 - protein, 9 aa, Homo Sapiens
LVVRTVHEH

SEQ ID NO: 1367536 - protein, 9 aa, Homo Sapiens
VALPLRGGT

SEQ ID NO: 1367537 - protein, 9 aa, Homo Sapiens
SRVMSVGMY

SEQ ID NO: 1367538 - protein, 9 aa, Homo Sapiens
VCSRCRRRR

SEQ ID NO: 1367539 - protein, 9 aa, Homo Sapiens
VLAACSQHF

SEQ ID NO: 1367540 - protein, 9 aa, Homo Sapiens
PVAVKPLAE

SEQ ID NO: 1367541 - protein, 9 aa, Homo Sapiens
KVFCQEDFL

SEQ ID NO: 1367542 - protein, 9 aa, Homo Sapiens
KGAFAAIGS

SEQ ID NO: 1367543 - protein, 9 aa, Homo Sapiens
QGGGPPTAP

SEQ ID NO: 1367544 - protein, 9 aa, Homo Sapiens
SSTAWCTST

SEQ ID NO: 1367545 - protein, 9 aa, Homo Sapiens
LDLLLVILH

SEQ ID NO: 1367546 - protein, 9 aa, Homo Sapiens
PPAAAAPSP

SEQ ID NO: 1367547 - protein, 9 aa, Homo Sapiens
EGFSQANQL

SEQ ID NO: 1367548 - protein, 9 aa, Homo Sapiens
DAGQEADGV

SEQ ID NO: 1367549 - protein, 9 aa, Homo Sapiens
PQQIWHGPV

SEQ ID NO: 1367550 - protein, 9 aa, Homo Sapiens
PLQLLVEPC

SEQ ID NO: 1367551 - protein, 9 aa, Homo Sapiens
SVLIKNMMK

SEQ ID NO: 1367552 - protein, 9 aa, Homo Sapiens
SVPSTTRRA

SEQ ID NO: 1367553 - protein, 9 aa, Homo Sapiens
LPPRATRRP

SEQ ID NO: 1367554 - protein, 9 aa, Homo Sapiens
GASKDLQAR

SEQ ID NO: 1367555 - protein, 9 aa, Homo Sapiens
ETGIRELHD

SEQ ID NO: 1367556 - protein, 9 aa, Homo Sapiens
RASAGPVTR

SEQ ID NO: 1367557 - protein, 9 aa, Homo Sapiens
TGVGVYTAM

SEQ ID NO: 1367558 - protein, 9 aa, Homo Sapiens
GGPAGWARQ

SEQ ID NO: 1367559 - protein, 9 aa, Homo Sapiens
WIITGGPTP

SEQ ID NO: 1367560 - protein, 9 aa, Homo Sapiens
QASHCRCAT

SEQ ID NO: 1367561 - protein, 9 aa, Homo Sapiens
TTHQQCFSY

SEQ ID NO: 1367562 - protein, 9 aa, Homo Sapiens
AHLPGQDTV

SEQ ID NO: 1367563 - protein, 9 aa, Homo Sapiens
EGDGLTSQG

SEQ ID NO: 1367564 - protein, 9 aa, Homo Sapiens
CLLCWTPCH

SEQ ID NO: 1367565 - protein, 9 aa, Homo Sapiens
EEIGKARCE

SEQ ID NO: 1367566 - protein, 9 aa, Homo Sapiens
SWAVQAFKA

SEQ ID NO: 1367567 - protein, 9 aa, Homo Sapiens
WKLWGAEEG

SEQ ID NO: 1367568 - protein, 9 aa, Homo Sapiens
EAHDIIAED

SEQ ID NO: 1367569 - protein, 9 aa, Homo Sapiens
TIAPNSHFH

SEQ ID NO: 1367570 - protein, 9 aa, Homo Sapiens
DWIDSVLAF

SEQ ID NO: 1367571 - protein, 9 aa, Homo Sapiens
GPQVVVFCM

SEQ ID NO: 1367572 - protein, 9 aa, Homo Sapiens
VLFSTGLLD

SEQ ID NO: 1367573 - protein, 9 aa, Homo Sapiens
SRWNYRHTP

SEQ ID NO: 1367574 - protein, 9 aa, Homo Sapiens
GPIPISSEL

SEQ ID NO: 1367575 - protein, 9 aa, Homo Sapiens
FAKQQSWWR

SEQ ID NO: 1367576 - protein, 9 aa, Homo Sapiens
LQRGNLHGQ

SEQ ID NO: 1367577 - protein, 9 aa, Homo Sapiens
HSISESFSK

SEQ ID NO: 1367578 - protein, 9 aa, Homo Sapiens
QQAERGEPG

SEQ ID NO: 1367579 - protein, 9 aa, Homo Sapiens
TRFKRFFCL

SEQ ID NO: 1367580 - protein, 9 aa, Homo Sapiens
KTIHIWDVR

SEQ ID NO: 1367581 - protein, 9 aa, Homo Sapiens
LQPPGDCPR

SEQ ID NO: 1367582 - protein, 9 aa, Homo Sapiens
VIYCGMRFV

SEQ ID NO: 1367583 - protein, 9 aa, Homo Sapiens
EQMKRPLGM

SEQ ID NO: 1367584 - protein, 9 aa, Homo Sapiens
NFPRELSSF

SEQ ID NO: 1367585 - protein, 9 aa, Homo Sapiens
TSSNFLLAS

SEQ ID NO: 1367586 - protein, 9 aa, Homo Sapiens
FLIQLLKSG

SEQ ID NO: 1367587 - protein, 9 aa, Homo Sapiens
KYVLCASEF

SEQ ID NO: 1367588 - protein, 9 aa, Homo Sapiens
LEYPKHMET

SEQ ID NO: 1367589 - protein, 9 aa, Homo Sapiens
GIPNPSVTW

SEQ ID NO: 1367590 - protein, 9 aa, Homo Sapiens
IRCTEPSPA

SEQ ID NO: 1367591 - protein, 9 aa, Homo Sapiens
PEIQNNQKK

SEQ ID NO: 1367592 - protein, 9 aa, Homo Sapiens
GAVYMYPEY

SEQ ID NO: 1367593 - protein, 9 aa, Homo Sapiens
FFVLVNLEV

SEQ ID NO: 1367594 - protein, 9 aa, Homo Sapiens
VAMLPKLLC

SEQ ID NO: 1367595 - protein, 9 aa, Homo Sapiens
TKYPKKFCP

SEQ ID NO: 1367596 - protein, 9 aa, Homo Sapiens
CGMRFVAAF

SEQ ID NO: 1367597 - protein, 9 aa, Homo Sapiens
FFRTEKGNI

SEQ ID NO: 1367598 - protein, 9 aa, Homo Sapiens
PFNEDTTSM

SEQ ID NO: 1367599 - protein, 9 aa, Homo Sapiens
VSALSGPRP

SEQ ID NO: 1367600 - protein, 9 aa, Homo Sapiens
APRRHGLSP

SEQ ID NO: 1367601 - protein, 9 aa, Homo Sapiens
DVLQKAQFS

SEQ ID NO: 1367602 - protein, 9 aa, Homo Sapiens
LQALRARFS

SEQ ID NO: 1367603 - protein, 9 aa, Homo Sapiens
NTDISILPL

SEQ ID NO: 1367604 - protein, 9 aa, Homo Sapiens
KAASGCLDI

SEQ ID NO: 1367605 - protein, 9 aa, Homo Sapiens
LLKATSTAT

SEQ ID NO: 1367606 - protein, 9 aa, Homo Sapiens
VYLGTTTGS

SEQ ID NO: 1367607 - protein, 9 aa, Homo Sapiens
LAPENPFLS

SEQ ID NO: 1367608 - protein, 9 aa, Homo Sapiens
TFPCEMTPP

SEQ ID NO: 1367609 - protein, 9 aa, Homo Sapiens
LMEKKINNQ

SEQ ID NO: 1367610 - protein, 9 aa, Homo Sapiens
EQLPESVLQ

SEQ ID NO: 1367611 - protein, 9 aa, Homo Sapiens
MYPEYQNRK

SEQ ID NO: 1367612 - protein, 9 aa, Homo Sapiens
RRQLDNFKR

SEQ ID NO: 1367613 - protein, 9 aa, Homo Sapiens
TVWCCRASR

SEQ ID NO: 1367614 - protein, 9 aa, Homo Sapiens
RIGSSSASL

SEQ ID NO: 1367615 - protein, 9 aa, Homo Sapiens
LKPLPMVLP

SEQ ID NO: 1367616 - protein, 9 aa, Homo Sapiens
STETTQQLK

SEQ ID NO: 1367617 - protein, 9 aa, Homo Sapiens
LSFASLRPR

SEQ ID NO: 1367618 - protein, 9 aa, Homo Sapiens
PEDRYTQAW

SEQ ID NO: 1367619 - protein, 9 aa, Homo Sapiens
AGPSRGPPP

SEQ ID NO: 1367620 - protein, 9 aa, Homo Sapiens
EDLNDKKGD

SEQ ID NO: 1367621 - protein, 9 aa, Homo Sapiens
LPAGLIQAQ

SEQ ID NO: 1367622 - protein, 9 aa, Homo Sapiens
DGSPVFVAF

SEQ ID NO: 1367623 - protein, 9 aa, Homo Sapiens
LPFCKSHII

SEQ ID NO: 1367624 - protein, 9 aa, Homo Sapiens
TDGIHPLSS

SEQ ID NO: 1367625 - protein, 9 aa, Homo Sapiens
EMKVYMDYN

SEQ ID NO: 1367626 - protein, 9 aa, Homo Sapiens
WNIFRKDPL

SEQ ID NO: 1367627 - protein, 9 aa, Homo Sapiens
DGLAVVKFF

SEQ ID NO: 1367628 - protein, 9 aa, Homo Sapiens
RQFFDRVSS

SEQ ID NO: 1367629 - protein, 9 aa, Homo Sapiens
HEIETDPAL

SEQ ID NO: 1367630 - protein, 9 aa, Homo Sapiens
LGRTSCLPP

SEQ ID NO: 1367631 - protein, 9 aa, Homo Sapiens
ARAPLESVR

SEQ ID NO: 1367632 - protein, 9 aa, Homo Sapiens
YSKACRKQQ

SEQ ID NO: 1367633 - protein, 9 aa, Homo Sapiens
DTHNVSVWR

SEQ ID NO: 1367634 - protein, 9 aa, Homo Sapiens
VAEAAAVVM

SEQ ID NO: 1367635 - protein, 9 aa, Homo Sapiens
GKDRKETVA

SEQ ID NO: 1367636 - protein, 9 aa, Homo Sapiens
VTGREGCVP

SEQ ID NO: 1367637 - protein, 9 aa, Homo Sapiens
QNNQTWNIV

SEQ ID NO: 1367638 - protein, 9 aa, Homo Sapiens
AVVLMPPEQ

SEQ ID NO: 1367639 - protein, 9 aa, Homo Sapiens
AFLLAFSPD

SEQ ID NO: 1367640 - protein, 9 aa, Homo Sapiens
GHHTLLTEE

SEQ ID NO: 1367641 - protein, 9 aa, Homo Sapiens
PYGMSLPPR

SEQ ID NO: 1367642 - protein, 9 aa, Homo Sapiens
RETVAPTSS

SEQ ID NO: 1367643 - protein, 9 aa, Homo Sapiens
ELGGRADRL

SEQ ID NO: 1367644 - protein, 9 aa, Homo Sapiens
DKLQGQDWC

SEQ ID NO: 1367645 - protein, 9 aa, Homo Sapiens
DSSVMMTHQ

SEQ ID NO: 1367646 - protein, 9 aa, Homo Sapiens
VSEETYTMA

SEQ ID NO: 1367647 - protein, 9 aa, Homo Sapiens
PPATCHNNI

SEQ ID NO: 1367648 - protein, 9 aa, Homo Sapiens
NRSPLPSPP

SEQ ID NO: 1367649 - protein, 9 aa, Homo Sapiens
VENYIRTQE

SEQ ID NO: 1367650 - protein, 9 aa, Homo Sapiens
VWLWFRDTL

SEQ ID NO: 1367651 - protein, 9 aa, Homo Sapiens
AAARPFGRE

SEQ ID NO: 1367652 - protein, 9 aa, Homo Sapiens
PCTSVPSTT

SEQ ID NO: 1367653 - protein, 9 aa, Homo Sapiens
HPLSSLLLY

SEQ ID NO: 1367654 - protein, 9 aa, Homo Sapiens
AWCTSTEMG

SEQ ID NO: 1367655 - protein, 9 aa, Homo Sapiens
QAHSPLGSV

SEQ ID NO: 1367656 - protein, 9 aa, Homo Sapiens
DSGNKGVIL

SEQ ID NO: 1367657 - protein, 9 aa, Homo Sapiens
SPSPAQPYL

SEQ ID NO: 1367658 - protein, 9 aa, Homo Sapiens
SQGLHEDLH

SEQ ID NO: 1367659 - protein, 9 aa, Homo Sapiens
GVKDVTGSP

SEQ ID NO: 1367660 - protein, 9 aa, Homo Sapiens
DECLCKYGS

SEQ ID NO: 1367661 - protein, 9 aa, Homo Sapiens
AICHRGFLS

SEQ ID NO: 1367662 - protein, 9 aa, Homo Sapiens
RVLPVCSRC

SEQ ID NO: 1367663 - protein, 9 aa, Homo Sapiens
VDESEKKSS

SEQ ID NO: 1367664 - protein, 9 aa, Homo Sapiens
DREARAAHR

SEQ ID NO: 1367665 - protein, 9 aa, Homo Sapiens
YPKMHHICF

SEQ ID NO: 1367666 - protein, 9 aa, Homo Sapiens
NCLCYFEFT

SEQ ID NO: 1367667 - protein, 9 aa, Homo Sapiens
KNVLLLWIR

SEQ ID NO: 1367668 - protein, 9 aa, Homo Sapiens
PGKDIRNHV

SEQ ID NO: 1367669 - protein, 9 aa, Homo Sapiens
PVPCHLSDN

SEQ ID NO: 1367670 - protein, 9 aa, Homo Sapiens
HAWFECETS

SEQ ID NO: 1367671 - protein, 9 aa, Homo Sapiens
SAVTALLPP

SEQ ID NO: 1367672 - protein, 9 aa, Homo Sapiens
QLVYRRHCG

SEQ ID NO: 1367673 - protein, 9 aa, Homo Sapiens
CLGAPAQHG

SEQ ID NO: 1367674 - protein, 9 aa, Homo Sapiens
KSLQLPASP

SEQ ID NO: 1367675 - protein, 9 aa, Homo Sapiens
DLVPYLYRN

SEQ ID NO: 1367676 - protein, 9 aa, Homo Sapiens
NIQASVSRW

SEQ ID NO: 1367677 - protein, 9 aa, Homo Sapiens
MCFLSLPRT

SEQ ID NO: 1367678 - protein, 9 aa, Homo Sapiens
ARHFLPEQF

SEQ ID NO: 1367679 - protein, 9 aa, Homo Sapiens
QGSAGGQPE

SEQ ID NO: 1367680 - protein, 9 aa, Homo Sapiens
EAGGAGEGA

SEQ ID NO: 1367681 - protein, 9 aa, Homo Sapiens
ALVSVSACF

SEQ ID NO: 1367682 - protein, 9 aa, Homo Sapiens
MVVRPVATL

SEQ ID NO: 1367683 - protein, 9 aa, Homo Sapiens
FPELLRYLV

SEQ ID NO: 1367684 - protein, 9 aa, Homo Sapiens
CQEGRHQRG

SEQ ID NO: 1367685 - protein, 9 aa, Homo Sapiens
VQDTVEVGE

SEQ ID NO: 1367686 - protein, 9 aa, Homo Sapiens
RNGVSPCWS

SEQ ID NO: 1367687 - protein, 9 aa, Homo Sapiens
PRLVSNPSL

SEQ ID NO: 1367688 - protein, 9 aa, Homo Sapiens
AGRAVGGQH

SEQ ID NO: 1367689 - protein, 9 aa, Homo Sapiens
TPLRVQSVL

SEQ ID NO: 1367690 - protein, 9 aa, Homo Sapiens
FPQVVKECR

SEQ ID NO: 1367691 - protein, 9 aa, Homo Sapiens
EHRVGGPGP

SEQ ID NO: 1367692 - protein, 9 aa, Homo Sapiens
IGGRILAIN

SEQ ID NO: 1367693 - protein, 9 aa, Homo Sapiens
GRLRGRRAD

SEQ ID NO: 1367694 - protein, 9 aa, Homo Sapiens
MLSVRPCSV

SEQ ID NO: 1367695 - protein, 9 aa, Homo Sapiens
YVGWAEATV

SEQ ID NO: 1367696 - protein, 9 aa, Homo Sapiens
GVTRLHFES

SEQ ID NO: 1367697 - protein, 9 aa, Homo Sapiens
HDQMQKVDQ

SEQ ID NO: 1367698 - protein, 9 aa, Homo Sapiens
GPLYVFGQC

SEQ ID NO: 1367699 - protein, 9 aa, Homo Sapiens
RTTRLILEG

SEQ ID NO: 1367700 - protein, 9 aa, Homo Sapiens
PGCCHVVQP

SEQ ID NO: 1367701 - protein, 9 aa, Homo Sapiens
ERPKRWGQV

SEQ ID NO: 1367702 - protein, 9 aa, Homo Sapiens
FHIQQVEWR

SEQ ID NO: 1367703 - protein, 9 aa, Homo Sapiens
ERLHLLCEK

SEQ ID NO: 1367704 - protein, 9 aa, Homo Sapiens
ANRGHAELE

SEQ ID NO: 1367705 - protein, 9 aa, Homo Sapiens
SPEKRLGMG

SEQ ID NO: 1367706 - protein, 9 aa, Homo Sapiens
HHGQHTHGP

SEQ ID NO: 1367707 - protein, 9 aa, Homo Sapiens
TLVMEYVVG

SEQ ID NO: 1367708 - protein, 9 aa, Homo Sapiens
YNKVPVEKQ

SEQ ID NO: 1367709 - protein, 9 aa, Homo Sapiens
APPQNPRPS

SEQ ID NO: 1367710 - protein, 9 aa, Homo Sapiens
KYSFQKACM

SEQ ID NO: 1367711 - protein, 9 aa, Homo Sapiens
LQYASFKVD

SEQ ID NO: 1367712 - protein, 9 aa, Homo Sapiens
SIENERDSL

SEQ ID NO: 1367713 - protein, 9 aa, Homo Sapiens
ALLLICGGV

SEQ ID NO: 1367714 - protein, 9 aa, Homo Sapiens
PQPHKLQPI

SEQ ID NO: 1367715 - protein, 9 aa, Homo Sapiens
EVGEGQGAM

SEQ ID NO: 1367716 - protein, 9 aa, Homo Sapiens
PPSSSQSAG

SEQ ID NO: 1367717 - protein, 9 aa, Homo Sapiens
LTVGKRNRN

SEQ ID NO: 1367718 - protein, 9 aa, Homo Sapiens
RTRRPAGAA

SEQ ID NO: 1367719 - protein, 9 aa, Homo Sapiens
GSKLALPME

SEQ ID NO: 1367720 - protein, 9 aa, Homo Sapiens
FAEQPRGVV

SEQ ID NO: 1367721 - protein, 9 aa, Homo Sapiens
DEWEKNIEI

SEQ ID NO: 1367722 - protein, 9 aa, Homo Sapiens
GEIYPKMHH

SEQ ID NO: 1367723 - protein, 9 aa, Homo Sapiens
LHAHPPGPG

SEQ ID NO: 1367724 - protein, 9 aa, Homo Sapiens
LCLDILNGV

SEQ ID NO: 1367725 - protein, 9 aa, Homo Sapiens
EVRMPVLFD

SEQ ID NO: 1367726 - protein, 9 aa, Homo Sapiens
RPGACGPVK

SEQ ID NO: 1367727 - protein, 9 aa, Homo Sapiens
SDLKKTVGE

SEQ ID NO: 1367728 - protein, 9 aa, Homo Sapiens
ASAVSGGSR

SEQ ID NO: 1367729 - protein, 9 aa, Homo Sapiens
RKIEVNNAA

SEQ ID NO: 1367730 - protein, 9 aa, Homo Sapiens
TKIILHQKR

SEQ ID NO: 1367731 - protein, 9 aa, Homo Sapiens
PDRRECMLA

SEQ ID NO: 1367732 - protein, 9 aa, Homo Sapiens
DSREDPVGT

SEQ ID NO: 1367733 - protein, 9 aa, Homo Sapiens
GPPKARCPR

SEQ ID NO: 1367734 - protein, 9 aa, Homo Sapiens
DQPLLIRRN

SEQ ID NO: 1367735 - protein, 9 aa, Homo Sapiens
TCQGDSDGP

SEQ ID NO: 1367736 - protein, 9 aa, Homo Sapiens
QIRDRVMHA

SEQ ID NO: 1367737 - protein, 9 aa, Homo Sapiens
NEDTTSMIL

SEQ ID NO: 1367738 - protein, 9 aa, Homo Sapiens
ASVVTSLIK

SEQ ID NO: 1367739 - protein, 9 aa, Homo Sapiens
VVRPVATLS

SEQ ID NO: 1367740 - protein, 9 aa, Homo Sapiens
GVTWFKISL

SEQ ID NO: 1367741 - protein, 9 aa, Homo Sapiens
TRHLKDEMA

SEQ ID NO: 1367742 - protein, 9 aa, Homo Sapiens
VGMVAFKMG

SEQ ID NO: 1367743 - protein, 9 aa, Homo Sapiens
QKREMEHWK

SEQ ID NO: 1367744 - protein, 9 aa, Homo Sapiens
VQDVARRCR

SEQ ID NO: 1367745 - protein, 9 aa, Homo Sapiens
CPDCPKSLC

SEQ ID NO: 1367746 - protein, 9 aa, Homo Sapiens
PAAAQKVVA

SEQ ID NO: 1367747 - protein, 9 aa, Homo Sapiens
DDEELTQHP

SEQ ID NO: 1367748 - protein, 9 aa, Homo Sapiens
HPESPGHPG

SEQ ID NO: 1367749 - protein, 9 aa, Homo Sapiens
LHLEGDGLT

SEQ ID NO: 1367750 - protein, 9 aa, Homo Sapiens
VELRQVTQK

SEQ ID NO: 1367751 - protein, 9 aa, Homo Sapiens
PEHSKEGKA

SEQ ID NO: 1367752 - protein, 9 aa, Homo Sapiens
VTPRAGATA

SEQ ID NO: 1367753 - protein, 9 aa, Homo Sapiens
TPYYISLSE

SEQ ID NO: 1367754 - protein, 9 aa, Homo Sapiens
AQEMVADYQ

SEQ ID NO: 1367755 - protein, 9 aa, Homo Sapiens
PGQRVIHVT

SEQ ID NO: 1367756 - protein, 9 aa, Homo Sapiens
CVSVSCKPV

SEQ ID NO: 1367757 - protein, 9 aa, Homo Sapiens
DAKDTAACI

SEQ ID NO: 1367758 - protein, 9 aa, Homo Sapiens
SLWNWREMM

SEQ ID NO: 1367759 - protein, 9 aa, Homo Sapiens
SLLIAADTL

SEQ ID NO: 1367760 - protein, 9 aa, Homo Sapiens
SPQTSSTAR

SEQ ID NO: 1367761 - protein, 9 aa, Homo Sapiens
PRVSGSHKG

SEQ ID NO: 1367762 - protein, 9 aa, Homo Sapiens
WAPTSRTPW

SEQ ID NO: 1367763 - protein, 9 aa, Homo Sapiens
PEDLLLDEK

SEQ ID NO: 1367764 - protein, 9 aa, Homo Sapiens
AYAMRLGIG

SEQ ID NO: 1367765 - protein, 9 aa, Homo Sapiens
KMGFKTQEY

SEQ ID NO: 1367766 - protein, 9 aa, Homo Sapiens
KGLFNIYHP

SEQ ID NO: 1367767 - protein, 9 aa, Homo Sapiens
WSGFCGGWL

SEQ ID NO: 1367768 - protein, 9 aa, Homo Sapiens
LEALTGQGM

SEQ ID NO: 1367769 - protein, 9 aa, Homo Sapiens
VGGPGPRVD

SEQ ID NO: 1367770 - protein, 9 aa, Homo Sapiens
TRPLCTGHP

SEQ ID NO: 1367771 - protein, 9 aa, Homo Sapiens
TDSAPTVSG

SEQ ID NO: 1367772 - protein, 9 aa, Homo Sapiens
PDEETYDED

SEQ ID NO: 1367773 - protein, 9 aa, Homo Sapiens
RRLRACRAG

SEQ ID NO: 1367774 - protein, 9 aa, Homo Sapiens
HPSSNGRPA

SEQ ID NO: 1367775 - protein, 9 aa, Homo Sapiens
VITIDRIEP

SEQ ID NO: 1367776 - protein, 9 aa, Homo Sapiens
PLSPGNSEP

SEQ ID NO: 1367777 - protein, 9 aa, Homo Sapiens
LSGPGMHLF

SEQ ID NO: 1367778 - protein, 9 aa, Homo Sapiens
LEAAKIEKK

SEQ ID NO: 1367779 - protein, 9 aa, Homo Sapiens
TNTVSVCRA

SEQ ID NO: 1367780 - protein, 9 aa, Homo Sapiens
DLLSVVWFP

SEQ ID NO: 1367781 - protein, 9 aa, Homo Sapiens
KALCCAAVG

SEQ ID NO: 1367782 - protein, 9 aa, Homo Sapiens
VGDVYIKST

SEQ ID NO: 1367783 - protein, 9 aa, Homo Sapiens
QALAQLRVH

SEQ ID NO: 1367784 - protein, 9 aa, Homo Sapiens
RIPVPCVNA

SEQ ID NO: 1367785 - protein, 9 aa, Homo Sapiens
MSSKDDMGK

SEQ ID NO: 1367786 - protein, 9 aa, Homo Sapiens
ENERDSLEF

SEQ ID NO: 1367787 - protein, 9 aa, Homo Sapiens
KKKLKLAPL

SEQ ID NO: 1367788 - protein, 9 aa, Homo Sapiens
FASRQNLHE

SEQ ID NO: 1367789 - protein, 9 aa, Homo Sapiens
SDSQEDKKK

SEQ ID NO: 1367790 - protein, 9 aa, Homo Sapiens
NCVYVVNIA

SEQ ID NO: 1367791 - protein, 9 aa, Homo Sapiens
PVNWTNSAI

SEQ ID NO: 1367792 - protein, 9 aa, Homo Sapiens
QLDNFKRVF

SEQ ID NO: 1367793 - protein, 9 aa, Homo Sapiens
LAGDRCHRA

SEQ ID NO: 1367794 - protein, 9 aa, Homo Sapiens
QDVARRCRN

SEQ ID NO: 1367795 - protein, 9 aa, Homo Sapiens
LGAFDKKAQ

SEQ ID NO: 1367796 - protein, 9 aa, Homo Sapiens
PPKSFQLHP

SEQ ID NO: 1367797 - protein, 9 aa, Homo Sapiens
EPEEERIRH

SEQ ID NO: 1367798 - protein, 9 aa, Homo Sapiens
EQHQGPVHL

SEQ ID NO: 1367799 - protein, 9 aa, Homo Sapiens
KPLAQVPLS

SEQ ID NO: 1367800 - protein, 9 aa, Homo Sapiens
ACFEKTHHC

SEQ ID NO: 1367801 - protein, 9 aa, Homo Sapiens
TRCCSPCCQ

SEQ ID NO: 1367802 - protein, 9 aa, Homo Sapiens
LEKQGIGMK

SEQ ID NO: 1367803 - protein, 9 aa, Homo Sapiens
YLDPTDAAD

SEQ ID NO: 1367804 - protein, 9 aa, Homo Sapiens
QMRNSQAHG

SEQ ID NO: 1367805 - protein, 9 aa, Homo Sapiens
KNLIMDHMV

SEQ ID NO: 1367806 - protein, 9 aa, Homo Sapiens
PASSGEGCP

SEQ ID NO: 1367807 - protein, 9 aa, Homo Sapiens
DSSGSLNEK

SEQ ID NO: 1367808 - protein, 9 aa, Homo Sapiens
QLDTQLKNL

SEQ ID NO: 1367809 - protein, 9 aa, Homo Sapiens
KKSLRHPLG

SEQ ID NO: 1367810 - protein, 9 aa, Homo Sapiens
PSRVRGEAE

SEQ ID NO: 1367811 - protein, 9 aa, Homo Sapiens
EGLPLLGKA

SEQ ID NO: 1367812 - protein, 9 aa, Homo Sapiens
QCKCGEVCS

SEQ ID NO: 1367813 - protein, 9 aa, Homo Sapiens
LPFPHAAIL

SEQ ID NO: 1367814 - protein, 9 aa, Homo Sapiens
AGTLKAGQN

SEQ ID NO: 1367815 - protein, 9 aa, Homo Sapiens
PGSQKALFL

SEQ ID NO: 1367816 - protein, 9 aa, Homo Sapiens
HCLYYLGMP

SEQ ID NO: 1367817 - protein, 9 aa, Homo Sapiens
RFNGLRFVG

SEQ ID NO: 1367818 - protein, 9 aa, Homo Sapiens
DAGEHLCDA

SEQ ID NO: 1367819 - protein, 9 aa, Homo Sapiens
AHRRPTQTA

SEQ ID NO: 1367820 - protein, 9 aa, Homo Sapiens
ALCSQRRLR

SEQ ID NO: 1367821 - protein, 9 aa, Homo Sapiens
PLLVRRDAF

SEQ ID NO: 1367822 - protein, 9 aa, Homo Sapiens
SERWPSGRR

SEQ ID NO: 1367823 - protein, 9 aa, Homo Sapiens
GKWRRQPVL

SEQ ID NO: 1367824 - protein, 9 aa, Homo Sapiens
VLAPDVLRH

SEQ ID NO: 1367825 - protein, 9 aa, Homo Sapiens
AVDCYVAVR

SEQ ID NO: 1367826 - protein, 9 aa, Homo Sapiens
WDPIAGALR

SEQ ID NO: 1367827 - protein, 9 aa, Homo Sapiens
TRKVPLDSP

SEQ ID NO: 1367828 - protein, 9 aa, Homo Sapiens
PPRGGFGGR

SEQ ID NO: 1367829 - protein, 9 aa, Homo Sapiens
VKLKLKDEA

SEQ ID NO: 1367830 - protein, 9 aa, Homo Sapiens
AISLDGGAI

SEQ ID NO: 1367831 - protein, 9 aa, Homo Sapiens
HQADQEHRV

SEQ ID NO: 1367832 - protein, 9 aa, Homo Sapiens
RARPFTCFF

SEQ ID NO: 1367833 - protein, 9 aa, Homo Sapiens
KFKDPNNVL

SEQ ID NO: 1367834 - protein, 9 aa, Homo Sapiens
AAVAAARAG

SEQ ID NO: 1367835 - protein, 9 aa, Homo Sapiens
RQGTTIFQL

SEQ ID NO: 1367836 - protein, 9 aa, Homo Sapiens
ELTGLSPGV

SEQ ID NO: 1367837 - protein, 9 aa, Homo Sapiens
ENGQWKGRA

SEQ ID NO: 1367838 - protein, 9 aa, Homo Sapiens
HLQVAVECD

SEQ ID NO: 1367839 - protein, 9 aa, Homo Sapiens
VSGDFGDGH

SEQ ID NO: 1367840 - protein, 9 aa, Homo Sapiens
GDQSSPIGL

SEQ ID NO: 1367841 - protein, 9 aa, Homo Sapiens
QAQDKLQGQ

SEQ ID NO: 1367842 - protein, 9 aa, Homo Sapiens
TRSSPRLRF

SEQ ID NO: 1367843 - protein, 9 aa, Homo Sapiens
MDNDSGGSR

SEQ ID NO: 1367844 - protein, 9 aa, Homo Sapiens
VSGHQADQE

SEQ ID NO: 1367845 - protein, 9 aa, Homo Sapiens
LPSPAKEGH

SEQ ID NO: 1367846 - protein, 9 aa, Homo Sapiens
NAHNSKEDE

SEQ ID NO: 1367847 - protein, 9 aa, Homo Sapiens
RETRKFCLT

SEQ ID NO: 1367848 - protein, 9 aa, Homo Sapiens
GEVKSSTPA

SEQ ID NO: 1367849 - protein, 9 aa, Homo Sapiens
LSRPTKTRM

SEQ ID NO: 1367850 - protein, 9 aa, Homo Sapiens
GRGAAVGAG

SEQ ID NO: 1367851 - protein, 9 aa, Homo Sapiens
PRDPLLHKC

SEQ ID NO: 1367852 - protein, 9 aa, Homo Sapiens
GGNREDGYL

SEQ ID NO: 1367853 - protein, 9 aa, Homo Sapiens
KDQCPASAV

SEQ ID NO: 1367854 - protein, 9 aa, Homo Sapiens
TYWVSLQLN

SEQ ID NO: 1367855 - protein, 9 aa, Homo Sapiens
SNSSRESDN

SEQ ID NO: 1367856 - protein, 9 aa, Homo Sapiens
FCGGWLPAG

SEQ ID NO: 1367857 - protein, 9 aa, Homo Sapiens
PALGLGQYR

SEQ ID NO: 1367858 - protein, 9 aa, Homo Sapiens
AEATVAAAR

SEQ ID NO: 1367859 - protein, 9 aa, Homo Sapiens
SSPTSCSGR

SEQ ID NO: 1367860 - protein, 9 aa, Homo Sapiens
LQQQRERKN

SEQ ID NO: 1367861 - protein, 9 aa, Homo Sapiens
SQSVVGNHP

SEQ ID NO: 1367862 - protein, 9 aa, Homo Sapiens
LKMEIKKSL

SEQ ID NO: 1367863 - protein, 9 aa, Homo Sapiens
NQKKQGNEQ

SEQ ID NO: 1367864 - protein, 9 aa, Homo Sapiens
ARPALGRLR

SEQ ID NO: 1367865 - protein, 9 aa, Homo Sapiens
RSIENERDS

SEQ ID NO: 1367866 - protein, 9 aa, Homo Sapiens
DEELTQHPA

SEQ ID NO: 1367867 - protein, 9 aa, Homo Sapiens
PGSQTIMPC

SEQ ID NO: 1367868 - protein, 9 aa, Homo Sapiens
CRLYVLKEE

SEQ ID NO: 1367869 - protein, 9 aa, Homo Sapiens
EPLIHIQLA

SEQ ID NO: 1367870 - protein, 9 aa, Homo Sapiens
RVKRQRGDP

SEQ ID NO: 1367871 - protein, 9 aa, Homo Sapiens
PLSTWSASY

SEQ ID NO: 1367872 - protein, 9 aa, Homo Sapiens
ITEHIDFVT

SEQ ID NO: 1367873 - protein, 9 aa, Homo Sapiens
DVHHYLCTD

SEQ ID NO: 1367874 - protein, 9 aa, Homo Sapiens
VTIQRWYRQ

SEQ ID NO: 1367875 - protein, 9 aa, Homo Sapiens
ENFSSMLEL

SEQ ID NO: 1367876 - protein, 9 aa, Homo Sapiens
RKVTSVKHL

SEQ ID NO: 1367877 - protein, 9 aa, Homo Sapiens
DSTVTMKGL

SEQ ID NO: 1367878 - protein, 9 aa, Homo Sapiens
QSWWRKLFG

SEQ ID NO: 1367879 - protein, 9 aa, Homo Sapiens
SGRSSTAWC

SEQ ID NO: 1367880 - protein, 9 aa, Homo Sapiens
RVIKCDPDR

SEQ ID NO: 1367881 - protein, 9 aa, Homo Sapiens
QERLDCING

SEQ ID NO: 1367882 - protein, 9 aa, Homo Sapiens
VAPTSSPAP

SEQ ID NO: 1367883 - protein, 9 aa, Homo Sapiens
EETRHLKDE

SEQ ID NO: 1367884 - protein, 9 aa, Homo Sapiens
GVSMAHKVA

SEQ ID NO: 1367885 - protein, 9 aa, Homo Sapiens
KLWGAEEGA

SEQ ID NO: 1367886 - protein, 9 aa, Homo Sapiens
LPHPHPTPT

SEQ ID NO: 1367887 - protein, 9 aa, Homo Sapiens
WAEATVAAA

SEQ ID NO: 1367888 - protein, 9 aa, Homo Sapiens
AYKKAIMVG

SEQ ID NO: 1367889 - protein, 9 aa, Homo Sapiens
KAAKLSKAY

SEQ ID NO: 1367890 - protein, 9 aa, Homo Sapiens
LKEWLPQND

SEQ ID NO: 1367891 - protein, 9 aa, Homo Sapiens
GKKRERSRK

SEQ ID NO: 1367892 - protein, 9 aa, Homo Sapiens
EADCMSLLN

SEQ ID NO: 1367893 - protein, 9 aa, Homo Sapiens
SNTIDVCNA

SEQ ID NO: 1367894 - protein, 9 aa, Homo Sapiens
KGPMIIHCI

SEQ ID NO: 1367895 - protein, 9 aa, Homo Sapiens
PKRAIQEVL

SEQ ID NO: 1367896 - protein, 9 aa, Homo Sapiens
IKKSLRHPL

SEQ ID NO: 1367897 - protein, 9 aa, Homo Sapiens
EGRDPAAAF

SEQ ID NO: 1367898 - protein, 9 aa, Homo Sapiens
SMHKEKRVY

SEQ ID NO: 1367899 - protein, 9 aa, Homo Sapiens
MGARGTFLK

SEQ ID NO: 1367900 - protein, 9 aa, Homo Sapiens
IMFETVNTP

SEQ ID NO: 1367901 - protein, 9 aa, Homo Sapiens
NDASCDRKL

SEQ ID NO: 1367902 - protein, 9 aa, Homo Sapiens
VIGQGLVGM

SEQ ID NO: 1367903 - protein, 9 aa, Homo Sapiens
GLVGMTPRD

SEQ ID NO: 1367904 - protein, 9 aa, Homo Sapiens
ADTLKQAFT

SEQ ID NO: 1367905 - protein, 9 aa, Homo Sapiens
DNLQVWGSD

SEQ ID NO: 1367906 - protein, 9 aa, Homo Sapiens
CQKKKELDK

SEQ ID NO: 1367907 - protein, 9 aa, Homo Sapiens
KDQSPICAV

SEQ ID NO: 1367908 - protein, 9 aa, Homo Sapiens
HGGPPKARC

SEQ ID NO: 1367909 - protein, 9 aa, Homo Sapiens
SMVYLPGIH

SEQ ID NO: 1367910 - protein, 9 aa, Homo Sapiens
REVAEAAAV

SEQ ID NO: 1367911 - protein, 9 aa, Homo Sapiens
VVKFFLLEK

SEQ ID NO: 1367912 - protein, 9 aa, Homo Sapiens
QPGWPEDPV

SEQ ID NO: 1367913 - protein, 9 aa, Homo Sapiens
PHEAHYLHL

SEQ ID NO: 1367914 - protein, 9 aa, Homo Sapiens
VDVFLVLVA

SEQ ID NO: 1367915 - protein, 9 aa, Homo Sapiens
VCLLCWTPC

SEQ ID NO: 1367916 - protein, 9 aa, Homo Sapiens
LKKSYNKLK

SEQ ID NO: 1367917 - protein, 9 aa, Homo Sapiens
VQAAMGSAQ

SEQ ID NO: 1367918 - protein, 9 aa, Homo Sapiens
QSHGGPPKA

SEQ ID NO: 1367919 - protein, 9 aa, Homo Sapiens
TRSFNQNRD

SEQ ID NO: 1367920 - protein, 9 aa, Homo Sapiens
VLVSCSSVE

SEQ ID NO: 1367921 - protein, 9 aa, Homo Sapiens
QGQATLCLQ

SEQ ID NO: 1367922 - protein, 9 aa, Homo Sapiens
ERSRPHAVL

SEQ ID NO: 1367923 - protein, 9 aa, Homo Sapiens
DKMRKRREE

SEQ ID NO: 1367924 - protein, 9 aa, Homo Sapiens
SHFHLFDEN

SEQ ID NO: 1367925 - protein, 9 aa, Homo Sapiens
ERWPSGRRP

SEQ ID NO: 1367926 - protein, 9 aa, Homo Sapiens
CPQLLQRGA

SEQ ID NO: 1367927 - protein, 9 aa, Homo Sapiens
VSYLPRDLS

SEQ ID NO: 1367928 - protein, 9 aa, Homo Sapiens
AELGGHTAH

SEQ ID NO: 1367929 - protein, 9 aa, Homo Sapiens
DSPRSAFLL

SEQ ID NO: 1367930 - protein, 9 aa, Homo Sapiens
PYKCAICHR

SEQ ID NO: 1367931 - protein, 9 aa, Homo Sapiens
TSTNTVSVC

SEQ ID NO: 1367932 - protein, 9 aa, Homo Sapiens
TRKFCLTPR

SEQ ID NO: 1367933 - protein, 9 aa, Homo Sapiens
FVTAVLSKL

SEQ ID NO: 1367934 - protein, 9 aa, Homo Sapiens
MVPRGVSMA

SEQ ID NO: 1367935 - protein, 9 aa, Homo Sapiens
SGRDREARA

SEQ ID NO: 1367936 - protein, 9 aa, Homo Sapiens
ASGRTCTVR

SEQ ID NO: 1367937 - protein, 9 aa, Homo Sapiens
KLTFVLGEQ

SEQ ID NO: 1367938 - protein, 9 aa, Homo Sapiens
GPRQPSVAS

SEQ ID NO: 1367939 - protein, 9 aa, Homo Sapiens
YDEDDAAFC

SEQ ID NO: 1367940 - protein, 9 aa, Homo Sapiens
SPSENDTHC

SEQ ID NO: 1367941 - protein, 9 aa, Homo Sapiens
CGPSRVRGE

SEQ ID NO: 1367942 - protein, 9 aa, Homo Sapiens
PGAENNPGL

SEQ ID NO: 1367943 - protein, 9 aa, Homo Sapiens
PSSWMTPTL

SEQ ID NO: 1367944 - protein, 9 aa, Homo Sapiens
MYLFLCALA

SEQ ID NO: 1367945 - protein, 9 aa, Homo Sapiens
EDHWSYSSN

SEQ ID NO: 1367946 - protein, 9 aa, Homo Sapiens
ATGQTDNII

SEQ ID NO: 1367947 - protein, 9 aa, Homo Sapiens
CLPAPAHFL

SEQ ID NO: 1367948 - protein, 9 aa, Homo Sapiens
LPSTSFFPH

SEQ ID NO: 1367949 - protein, 9 aa, Homo Sapiens
LMLLFLILG

SEQ ID NO: 1367950 - protein, 9 aa, Homo Sapiens
KSPGWKRKR

SEQ ID NO: 1367951 - protein, 9 aa, Homo Sapiens
HYGHQAPQV

SEQ ID NO: 1367952 - protein, 9 aa, Homo Sapiens
RACLPAQTT

SEQ ID NO: 1367953 - protein, 9 aa, Homo Sapiens
QIGRTVASN

SEQ ID NO: 1367954 - protein, 9 aa, Homo Sapiens
EIRKPCPVD

SEQ ID NO: 1367955 - protein, 9 aa, Homo Sapiens
YRQQVQRRG

SEQ ID NO: 1367956 - protein, 9 aa, Homo Sapiens
ILGEAMAPA

SEQ ID NO: 1367957 - protein, 9 aa, Homo Sapiens
LPFPRVDPS

SEQ ID NO: 1367958 - protein, 9 aa, Homo Sapiens
EVIFGYIEH

SEQ ID NO: 1367959 - protein, 9 aa, Homo Sapiens
SRELGGRAD

SEQ ID NO: 1367960 - protein, 9 aa, Homo Sapiens
IDSIRGVVT

SEQ ID NO: 1367961 - protein, 9 aa, Homo Sapiens
SKEALLRVT

SEQ ID NO: 1367962 - protein, 9 aa, Homo Sapiens
HCGATVDVV

SEQ ID NO: 1367963 - protein, 9 aa, Homo Sapiens
AKQQSWWRK

SEQ ID NO: 1367964 - protein, 9 aa, Homo Sapiens
GGAVILHRK

SEQ ID NO: 1367965 - protein, 9 aa, Homo Sapiens
AARARPALG

SEQ ID NO: 1367966 - protein, 9 aa, Homo Sapiens
ILNGVTRLH

SEQ ID NO: 1367967 - protein, 9 aa, Homo Sapiens
RAPRSGRFL

SEQ ID NO: 1367968 - protein, 9 aa, Homo Sapiens
YAQNLDFER

SEQ ID NO: 1367969 - protein, 9 aa, Homo Sapiens
CSEGLYHEV

SEQ ID NO: 1367970 - protein, 9 aa, Homo Sapiens
IDDKEPLIH

SEQ ID NO: 1367971 - protein, 9 aa, Homo Sapiens
SYSGHLKGA

SEQ ID NO: 1367972 - protein, 9 aa, Homo Sapiens
THRVIHTGE

SEQ ID NO: 1367973 - protein, 9 aa, Homo Sapiens
SAFPTAEQD

SEQ ID NO: 1367974 - protein, 9 aa, Homo Sapiens
WSTCCSMGQ

SEQ ID NO: 1367975 - protein, 9 aa, Homo Sapiens
SCSGRSSTA

SEQ ID NO: 1367976 - protein, 9 aa, Homo Sapiens
DNNNLNDYS

SEQ ID NO: 1367977 - protein, 9 aa, Homo Sapiens
GHLHAHPPG

SEQ ID NO: 1367978 - protein, 9 aa, Homo Sapiens
QAWAPTSRT

SEQ ID NO: 1367979 - protein, 9 aa, Homo Sapiens
HQVQGGLFL

SEQ ID NO: 1367980 - protein, 9 aa, Homo Sapiens
MLESYKKHI

SEQ ID NO: 1367981 - protein, 9 aa, Homo Sapiens
GPWKTKLLC

SEQ ID NO: 1367982 - protein, 9 aa, Homo Sapiens
VVIQQPPSP

SEQ ID NO: 1367983 - protein, 9 aa, Homo Sapiens
TNISNHGDL

SEQ ID NO: 1367984 - protein, 9 aa, Homo Sapiens
HLKAHLHWH

SEQ ID NO: 1367985 - protein, 9 aa, Homo Sapiens
WSTTQAIEY

SEQ ID NO: 1367986 - protein, 9 aa, Homo Sapiens
RPAALGTCS

SEQ ID NO: 1367987 - protein, 9 aa, Homo Sapiens
ALLKLETTA

SEQ ID NO: 1367988 - protein, 9 aa, Homo Sapiens
KHNSPEMKV

SEQ ID NO: 1367989 - protein, 9 aa, Homo Sapiens
GGNPSHRET

SEQ ID NO: 1367990 - protein, 9 aa, Homo Sapiens
SETEYQVQG

SEQ ID NO: 1367991 - protein, 9 aa, Homo Sapiens
EGGGTNISN

SEQ ID NO: 1367992 - protein, 9 aa, Homo Sapiens
QAFKAACET

SEQ ID NO: 1367993 - protein, 9 aa, Homo Sapiens
AWSMAPSTS

SEQ ID NO: 1367994 - protein, 9 aa, Homo Sapiens
TSNFLGTAT

SEQ ID NO: 1367995 - protein, 9 aa, Homo Sapiens
RDVNRRFRP

SEQ ID NO: 1367996 - protein, 9 aa, Homo Sapiens
LSQRLFSVR

SEQ ID NO: 1367997 - protein, 9 aa, Homo Sapiens
YHSALGVGM

SEQ ID NO: 1367998 - protein, 9 aa, Homo Sapiens
SKDQPLLVR

SEQ ID NO: 1367999 - protein, 9 aa, Homo Sapiens
DGREEEERH

SEQ ID NO: 1368000 - protein, 9 aa, Homo Sapiens
LRMFLKRDM

SEQ ID NO: 1368001 - protein, 9 aa, Homo Sapiens
WTPCDRPHR

SEQ ID NO: 1368002 - protein, 9 aa, Homo Sapiens
ALRPLHALS

SEQ ID NO: 1368003 - protein, 9 aa, Homo Sapiens
LVYRDQNKH

SEQ ID NO: 1368004 - protein, 9 aa, Homo Sapiens
MAHKVATPG

SEQ ID NO: 1368005 - protein, 9 aa, Homo Sapiens
LDLARRTLY

SEQ ID NO: 1368006 - protein, 9 aa, Homo Sapiens
TPTRSHTAV

SEQ ID NO: 1368007 - protein, 9 aa, Homo Sapiens
PPGQAVSLF

SEQ ID NO: 1368008 - protein, 9 aa, Homo Sapiens
FSLGMRTGE

SEQ ID NO: 1368009 - protein, 9 aa, Homo Sapiens
PAVQLIDIM

SEQ ID NO: 1368010 - protein, 9 aa, Homo Sapiens
APLVSGYVT

SEQ ID NO: 1368011 - protein, 9 aa, Homo Sapiens
DGGAGSVLR

SEQ ID NO: 1368012 - protein, 9 aa, Homo Sapiens
RKPKRANCV

SEQ ID NO: 1368013 - protein, 9 aa, Homo Sapiens
QLKNLSEAR

SEQ ID NO: 1368014 - protein, 9 aa, Homo Sapiens
CCAYDSLGT

SEQ ID NO: 1368015 - protein, 9 aa, Homo Sapiens
GPEPENFSS

SEQ ID NO: 1368016 - protein, 9 aa, Homo Sapiens
NGQRIAETG

SEQ ID NO: 1368017 - protein, 9 aa, Homo Sapiens
ELDFSHFHL

SEQ ID NO: 1368018 - protein, 9 aa, Homo Sapiens
FDDEEPHKF

SEQ ID NO: 1368019 - protein, 9 aa, Homo Sapiens
ERDGAKSLI

SEQ ID NO: 1368020 - protein, 9 aa, Homo Sapiens
KNYSSNWSW

SEQ ID NO: 1368021 - protein, 9 aa, Homo Sapiens
NAEEKANKA

SEQ ID NO: 1368022 - protein, 9 aa, Homo Sapiens
VENQEYLQS

SEQ ID NO: 1368023 - protein, 9 aa, Homo Sapiens
WQGEEDREN

SEQ ID NO: 1368024 - protein, 9 aa, Homo Sapiens
RRRLGVEIH

SEQ ID NO: 1368025 - protein, 9 aa, Homo Sapiens
CIPDPMGLS

SEQ ID NO: 1368026 - protein, 9 aa, Homo Sapiens
SVGKIERVS

SEQ ID NO: 1368027 - protein, 9 aa, Homo Sapiens
KAFRGLAEL

SEQ ID NO: 1368028 - protein, 9 aa, Homo Sapiens
PRHNGAYAM

SEQ ID NO: 1368029 - protein, 9 aa, Homo Sapiens
ASKDLQARY

SEQ ID NO: 1368030 - protein, 9 aa, Homo Sapiens
MTGRIACAN

SEQ ID NO: 1368031 - protein, 9 aa, Homo Sapiens
GAISLQPLP

SEQ ID NO: 1368032 - protein, 9 aa, Homo Sapiens
ESGPHSHCL

SEQ ID NO: 1368033 - protein, 9 aa, Homo Sapiens
KWQHHEITF

SEQ ID NO: 1368034 - protein, 9 aa, Homo Sapiens
WPPGPVAAA

SEQ ID NO: 1368035 - protein, 9 aa, Homo Sapiens
ERQWQEELQ

SEQ ID NO: 1368036 - protein, 9 aa, Homo Sapiens
SLKFENGQR

SEQ ID NO: 1368037 - protein, 9 aa, Homo Sapiens
GPYHFQGPM

SEQ ID NO: 1368038 - protein, 9 aa, Homo Sapiens
LLLLLLIVL

SEQ ID NO: 1368039 - protein, 9 aa, Homo Sapiens
STGPLWKKP

SEQ ID NO: 1368040 - protein, 9 aa, Homo Sapiens
TVSEGGCSR

SEQ ID NO: 1368041 - protein, 9 aa, Homo Sapiens
AVTALLPPR

SEQ ID NO: 1368042 - protein, 9 aa, Homo Sapiens
PVSQPLPRG

SEQ ID NO: 1368043 - protein, 9 aa, Homo Sapiens
KAQKMCEEV

SEQ ID NO: 1368044 - protein, 9 aa, Homo Sapiens
SVTVPHDER

SEQ ID NO: 1368045 - protein, 9 aa, Homo Sapiens
VELTGMSAT

SEQ ID NO: 1368046 - protein, 9 aa, Homo Sapiens
TRTMLSVRP

SEQ ID NO: 1368047 - protein, 9 aa, Homo Sapiens
VKKDSEDEI

SEQ ID NO: 1368048 - protein, 9 aa, Homo Sapiens
VEVTVRISH

SEQ ID NO: 1368049 - protein, 9 aa, Homo Sapiens
FFFLHKEFL

SEQ ID NO: 1368050 - protein, 9 aa, Homo Sapiens
GCHKKKPVN

SEQ ID NO: 1368051 - protein, 9 aa, Homo Sapiens
GMRTGEVRT

SEQ ID NO: 1368052 - protein, 9 aa, Homo Sapiens
LRKIDRLST

SEQ ID NO: 1368053 - protein, 9 aa, Homo Sapiens
FAKMKGCPH

SEQ ID NO: 1368054 - protein, 9 aa, Homo Sapiens
PRRRTPPRK

SEQ ID NO: 1368055 - protein, 9 aa, Homo Sapiens
SDPLLTSKV

SEQ ID NO: 1368056 - protein, 9 aa, Homo Sapiens
KSCPVAQSA

SEQ ID NO: 1368057 - protein, 9 aa, Homo Sapiens
KIWFQNRGM

SEQ ID NO: 1368058 - protein, 9 aa, Homo Sapiens
ETMCDVTVV

SEQ ID NO: 1368059 - protein, 9 aa, Homo Sapiens
KKRERSRKE

SEQ ID NO: 1368060 - protein, 9 aa, Homo Sapiens
WHPRVMLNN

SEQ ID NO: 1368061 - protein, 9 aa, Homo Sapiens
QKPGSNAHV

SEQ ID NO: 1368062 - protein, 9 aa, Homo Sapiens
PLELQPPGD

SEQ ID NO: 1368063 - protein, 9 aa, Homo Sapiens
IVNLLLDAD

SEQ ID NO: 1368064 - protein, 9 aa, Homo Sapiens
AALEVVEEE

SEQ ID NO: 1368065 - protein, 9 aa, Homo Sapiens
CCAAVGRAW

SEQ ID NO: 1368066 - protein, 9 aa, Homo Sapiens
SFASLRPRS

SEQ ID NO: 1368067 - protein, 9 aa, Homo Sapiens
PDGEPNAHN

SEQ ID NO: 1368068 - protein, 9 aa, Homo Sapiens
GPVAILRHN

SEQ ID NO: 1368069 - protein, 9 aa, Homo Sapiens
FCHLCPFLH

SEQ ID NO: 1368070 - protein, 9 aa, Homo Sapiens
RRPAGAAVA

SEQ ID NO: 1368071 - protein, 9 aa, Homo Sapiens
QQQQHSSSS

SEQ ID NO: 1368072 - protein, 9 aa, Homo Sapiens
SVTSSLSSC

SEQ ID NO: 1368073 - protein, 9 aa, Homo Sapiens
SSWMTPTLR

SEQ ID NO: 1368074 - protein, 9 aa, Homo Sapiens
SASLHPASG

SEQ ID NO: 1368075 - protein, 9 aa, Homo Sapiens
VSEGGCSRY

SEQ ID NO: 1368076 - protein, 9 aa, Homo Sapiens
NEKSEGTGV

SEQ ID NO: 1368077 - protein, 9 aa, Homo Sapiens
KTNFIDRIF

SEQ ID NO: 1368078 - protein, 9 aa, Homo Sapiens
FKRPSHLAG

SEQ ID NO: 1368079 - protein, 9 aa, Homo Sapiens
KVPLDSPPA

SEQ ID NO: 1368080 - protein, 9 aa, Homo Sapiens
EPMNFVHLA

SEQ ID NO: 1368081 - protein, 9 aa, Homo Sapiens
SLRPGAENN

SEQ ID NO: 1368082 - protein, 9 aa, Homo Sapiens
LVATPGVKK

SEQ ID NO: 1368083 - protein, 9 aa, Homo Sapiens
IGHGSKWTL

SEQ ID NO: 1368084 - protein, 9 aa, Homo Sapiens
VNNDNASCR

SEQ ID NO: 1368085 - protein, 9 aa, Homo Sapiens
RVTVLTSLS

SEQ ID NO: 1368086 - protein, 9 aa, Homo Sapiens
LILGKVLIG

SEQ ID NO: 1368087 - protein, 9 aa, Homo Sapiens
QKSLTVCLL

SEQ ID NO: 1368088 - protein, 9 aa, Homo Sapiens
TCTVLRNID

SEQ ID NO: 1368089 - protein, 9 aa, Homo Sapiens
PHDAKDTAA

SEQ ID NO: 1368090 - protein, 9 aa, Homo Sapiens
GCGPSRVRG

SEQ ID NO: 1368091 - protein, 9 aa, Homo Sapiens
PGGSLNGPS

SEQ ID NO: 1368092 - protein, 9 aa, Homo Sapiens
AAVSTATKK

SEQ ID NO: 1368093 - protein, 9 aa, Homo Sapiens
YPVRRHQCE

SEQ ID NO: 1368094 - protein, 9 aa, Homo Sapiens
HLIYVVEGG

SEQ ID NO: 1368095 - protein, 9 aa, Homo Sapiens
EDFAMQISF

SEQ ID NO: 1368096 - protein, 9 aa, Homo Sapiens
GGALLAPAT

SEQ ID NO: 1368097 - protein, 9 aa, Homo Sapiens
RHLPKLQEA

SEQ ID NO: 1368098 - protein, 9 aa, Homo Sapiens
AIAAVGEPG

SEQ ID NO: 1368099 - protein, 9 aa, Homo Sapiens
QWKGRAPHG

SEQ ID NO: 1368100 - protein, 9 aa, Homo Sapiens
AQEDVTLEQ

SEQ ID NO: 1368101 - protein, 9 aa, Homo Sapiens
RHPASCLGA

SEQ ID NO: 1368102 - protein, 9 aa, Homo Sapiens
RAKFRTQER

SEQ ID NO: 1368103 - protein, 9 aa, Homo Sapiens
KAANNPNHR

SEQ ID NO: 1368104 - protein, 9 aa, Homo Sapiens
GCSRYSPMS

SEQ ID NO: 1368105 - protein, 9 aa, Homo Sapiens
GPSCFSTGI

SEQ ID NO: 1368106 - protein, 9 aa, Homo Sapiens
FNEDTTSMI

SEQ ID NO: 1368107 - protein, 9 aa, Homo Sapiens
DLCSMSNTS

SEQ ID NO: 1368108 - protein, 9 aa, Homo Sapiens
RRSQRCPGY

SEQ ID NO: 1368109 - protein, 9 aa, Homo Sapiens
QHWLTESGR

SEQ ID NO: 1368110 - protein, 9 aa, Homo Sapiens
LVLDLCFDV

SEQ ID NO: 1368111 - protein, 9 aa, Homo Sapiens
LRFTHPQQP

SEQ ID NO: 1368112 - protein, 9 aa, Homo Sapiens
NDSPPVFSR

SEQ ID NO: 1368113 - protein, 9 aa, Homo Sapiens
HKFYVHIKP

SEQ ID NO: 1368114 - protein, 9 aa, Homo Sapiens
TEHQVQGGL

SEQ ID NO: 1368115 - protein, 9 aa, Homo Sapiens
GGVAGPSRG

SEQ ID NO: 1368116 - protein, 9 aa, Homo Sapiens
YIDLSVWCY

SEQ ID NO: 1368117 - protein, 9 aa, Homo Sapiens
TRSGPFFYI

SEQ ID NO: 1368118 - protein, 9 aa, Homo Sapiens
TSLLRNFEE

SEQ ID NO: 1368119 - protein, 9 aa, Homo Sapiens
LERRTPDQL

SEQ ID NO: 1368120 - protein, 9 aa, Homo Sapiens
LHPTSKTEH

SEQ ID NO: 1368121 - protein, 9 aa, Homo Sapiens
FRVHITLHD

SEQ ID NO: 1368122 - protein, 9 aa, Homo Sapiens
YSSNYLHWG

SEQ ID NO: 1368123 - protein, 9 aa, Homo Sapiens
LKGAFAAIG

SEQ ID NO: 1368124 - protein, 9 aa, Homo Sapiens
LQVEAPHQK

SEQ ID NO: 1368125 - protein, 9 aa, Homo Sapiens
KGSLSAMHF

SEQ ID NO: 1368126 - protein, 9 aa, Homo Sapiens
PRGVVLPSP

SEQ ID NO: 1368127 - protein, 9 aa, Homo Sapiens
NHDQMQKVD

SEQ ID NO: 1368128 - protein, 9 aa, Homo Sapiens
SLFVGGLSP

SEQ ID NO: 1368129 - protein, 9 aa, Homo Sapiens
RLAIGNGMR

SEQ ID NO: 1368130 - protein, 9 aa, Homo Sapiens
ICTNPASIC

SEQ ID NO: 1368131 - protein, 9 aa, Homo Sapiens
FLNTTQLPC

SEQ ID NO: 1368132 - protein, 9 aa, Homo Sapiens
NARKKAPPP

SEQ ID NO: 1368133 - protein, 9 aa, Homo Sapiens
TVAGATAQI

SEQ ID NO: 1368134 - protein, 9 aa, Homo Sapiens
FLLFLFFTL

SEQ ID NO: 1368135 - protein, 9 aa, Homo Sapiens
ALSWPDQHC

SEQ ID NO: 1368136 - protein, 9 aa, Homo Sapiens
LPSIPVSQP

SEQ ID NO: 1368137 - protein, 9 aa, Homo Sapiens
LVLDLCLDI

SEQ ID NO: 1368138 - protein, 9 aa, Homo Sapiens
VLLCLDTVP

SEQ ID NO: 1368139 - protein, 9 aa, Homo Sapiens
NGRVNLRPA

SEQ ID NO: 1368140 - protein, 9 aa, Homo Sapiens
TTVTHRMAP

SEQ ID NO: 1368141 - protein, 9 aa, Homo Sapiens
ECMLASLWE

SEQ ID NO: 1368142 - protein, 9 aa, Homo Sapiens
FVLSPRDRG

SEQ ID NO: 1368143 - protein, 9 aa, Homo Sapiens
GQHDDDGAA

SEQ ID NO: 1368144 - protein, 9 aa, Homo Sapiens
SLRRSVVGT

SEQ ID NO: 1368145 - protein, 9 aa, Homo Sapiens
TVASFNITS

SEQ ID NO: 1368146 - protein, 9 aa, Homo Sapiens
TGINHKNLI

SEQ ID NO: 1368147 - protein, 9 aa, Homo Sapiens
PTRTAAPPG

SEQ ID NO: 1368148 - protein, 9 aa, Homo Sapiens
LVKVKDNNY

SEQ ID NO: 1368149 - protein, 9 aa, Homo Sapiens
GSSQKRYRA

SEQ ID NO: 1368150 - protein, 9 aa, Homo Sapiens
LERSRPHAV

SEQ ID NO: 1368151 - protein, 9 aa, Homo Sapiens
GHLAEPALG

SEQ ID NO: 1368152 - protein, 9 aa, Homo Sapiens
AVDGSVIRQ

SEQ ID NO: 1368153 - protein, 9 aa, Homo Sapiens
LSHNSISRE

SEQ ID NO: 1368154 - protein, 9 aa, Homo Sapiens
QRFEDLTTR

SEQ ID NO: 1368155 - protein, 9 aa, Homo Sapiens
AYIDFDEDD

SEQ ID NO: 1368156 - protein, 9 aa, Homo Sapiens
PGCARQEEG

SEQ ID NO: 1368157 - protein, 9 aa, Homo Sapiens
YEQDMKVFG

SEQ ID NO: 1368158 - protein, 9 aa, Homo Sapiens
GRDGQGHGQ

SEQ ID NO: 1368159 - protein, 9 aa, Homo Sapiens
TVNQKKAKI

SEQ ID NO: 1368160 - protein, 9 aa, Homo Sapiens
QLKELNIKS

SEQ ID NO: 1368161 - protein, 9 aa, Homo Sapiens
GREGCVPSN

SEQ ID NO: 1368162 - protein, 9 aa, Homo Sapiens
DEDDNLEEG

SEQ ID NO: 1368163 - protein, 9 aa, Homo Sapiens
SHRETVAPT

SEQ ID NO: 1368164 - protein, 9 aa, Homo Sapiens
EQFTAVRLS

SEQ ID NO: 1368165 - protein, 9 aa, Homo Sapiens
SWEDVKTDK

SEQ ID NO: 1368166 - protein, 9 aa, Homo Sapiens
VVTGDQSSP

SEQ ID NO: 1368167 - protein, 9 aa, Homo Sapiens
EPENFSSML

SEQ ID NO: 1368168 - protein, 9 aa, Homo Sapiens
HAEGQVADQ

SEQ ID NO: 1368169 - protein, 9 aa, Homo Sapiens
PFSLRGNWW

SEQ ID NO: 1368170 - protein, 9 aa, Homo Sapiens
PKIETAHPP

SEQ ID NO: 1368171 - protein, 9 aa, Homo Sapiens
HHRVTDCVR

SEQ ID NO: 1368172 - protein, 9 aa, Homo Sapiens
ELACQKQSL

SEQ ID NO: 1368173 - protein, 9 aa, Homo Sapiens
GEAFPFPNP

SEQ ID NO: 1368174 - protein, 9 aa, Homo Sapiens
LEQLHQLHS

SEQ ID NO: 1368175 - protein, 9 aa, Homo Sapiens
MLYHSGKPP

SEQ ID NO: 1368176 - protein, 9 aa, Homo Sapiens
KDPNNVLIE

SEQ ID NO: 1368177 - protein, 9 aa, Homo Sapiens
EDDEWEKNI

SEQ ID NO: 1368178 - protein, 9 aa, Homo Sapiens
ASCLGAPAQ

SEQ ID NO: 1368179 - protein, 9 aa, Homo Sapiens
LCLPALGSS

SEQ ID NO: 1368180 - protein, 9 aa, Homo Sapiens
SMKSHSVPD

SEQ ID NO: 1368181 - protein, 9 aa, Homo Sapiens
TSAFPTAEQ

SEQ ID NO: 1368182 - protein, 9 aa, Homo Sapiens
GICLSDEYM

SEQ ID NO: 1368183 - protein, 9 aa, Homo Sapiens
SGAISLQPL

SEQ ID NO: 1368184 - protein, 9 aa, Homo Sapiens
ELCAEVQGS

SEQ ID NO: 1368185 - protein, 9 aa, Homo Sapiens
SQRSAGELE

SEQ ID NO: 1368186 - protein, 9 aa, Homo Sapiens
VGMSRGAVK

SEQ ID NO: 1368187 - protein, 9 aa, Homo Sapiens
QRGNLHGQA

SEQ ID NO: 1368188 - protein, 9 aa, Homo Sapiens
RSGVPGGKG

SEQ ID NO: 1368189 - protein, 9 aa, Homo Sapiens
FDSVVMDPK

SEQ ID NO: 1368190 - protein, 9 aa, Homo Sapiens
AVANDQDLQ

SEQ ID NO: 1368191 - protein, 9 aa, Homo Sapiens
SNCIRAIEN

SEQ ID NO: 1368192 - protein, 9 aa, Homo Sapiens
SPVRDEYEF

SEQ ID NO: 1368193 - protein, 9 aa, Homo Sapiens
KADQLMFTL

SEQ ID NO: 1368194 - protein, 9 aa, Homo Sapiens
MAPSTSAAA

SEQ ID NO: 1368195 - protein, 9 aa, Homo Sapiens
LQQDGLQLR

SEQ ID NO: 1368196 - protein, 9 aa, Homo Sapiens
LLCWTPCHL

SEQ ID NO: 1368197 - protein, 9 aa, Homo Sapiens
EGTKAGTKY

SEQ ID NO: 1368198 - protein, 9 aa, Homo Sapiens
RLHLLCEKD

SEQ ID NO: 1368199 - protein, 9 aa, Homo Sapiens
APNSHFHVL

SEQ ID NO: 1368200 - protein, 9 aa, Homo Sapiens
GHQADQEHR

SEQ ID NO: 1368201 - protein, 9 aa, Homo Sapiens
CGEVCSELW

SEQ ID NO: 1368202 - protein, 9 aa, Homo Sapiens
TAIGGGVAR

SEQ ID NO: 1368203 - protein, 9 aa, Homo Sapiens
PTRSHTAVR

SEQ ID NO: 1368204 - protein, 9 aa, Homo Sapiens
DDGSDAPLE

SEQ ID NO: 1368205 - protein, 9 aa, Homo Sapiens
GPRVDAEDE

SEQ ID NO: 1368206 - protein, 9 aa, Homo Sapiens
GHQMPQQPQ

SEQ ID NO: 1368207 - protein, 9 aa, Homo Sapiens
GPLRACLPA

SEQ ID NO: 1368208 - protein, 9 aa, Homo Sapiens
EMFFITNDV

SEQ ID NO: 1368209 - protein, 9 aa, Homo Sapiens
RDLGTVAGA

SEQ ID NO: 1368210 - protein, 9 aa, Homo Sapiens
CCLFVNLAC

SEQ ID NO: 1368211 - protein, 9 aa, Homo Sapiens
GGQLAALTD

SEQ ID NO: 1368212 - protein, 9 aa, Homo Sapiens
RLRYKLTFV

SEQ ID NO: 1368213 - protein, 9 aa, Homo Sapiens
AACPGAPEP

SEQ ID NO: 1368214 - protein, 9 aa, Homo Sapiens
ESREIYRGP

SEQ ID NO: 1368215 - protein, 9 aa, Homo Sapiens
DPSPQDQHQ

SEQ ID NO: 1368216 - protein, 9 aa, Homo Sapiens
SSLSSCKTW

SEQ ID NO: 1368217 - protein, 9 aa, Homo Sapiens
KNNPNMSDP

SEQ ID NO: 1368218 - protein, 9 aa, Homo Sapiens
LSRLHLVAT

SEQ ID NO: 1368219 - protein, 9 aa, Homo Sapiens
LCGACCPCW

SEQ ID NO: 1368220 - protein, 9 aa, Homo Sapiens
YASVCKRAG

SEQ ID NO: 1368221 - protein, 9 aa, Homo Sapiens
AEIKNVLLL

SEQ ID NO: 1368222 - protein, 9 aa, Homo Sapiens
SVQPHKDLI

SEQ ID NO: 1368223 - protein, 9 aa, Homo Sapiens
RALFMVTSC

SEQ ID NO: 1368224 - protein, 9 aa, Homo Sapiens
VGRDGQGHG

SEQ ID NO: 1368225 - protein, 9 aa, Homo Sapiens
PPRTCDSRF

SEQ ID NO: 1368226 - protein, 9 aa, Homo Sapiens
FVDSLSIHH

SEQ ID NO: 1368227 - protein, 9 aa, Homo Sapiens
AVFDEALLT

SEQ ID NO: 1368228 - protein, 9 aa, Homo Sapiens
HLESDGLTS

SEQ ID NO: 1368229 - protein, 9 aa, Homo Sapiens
TVGKRNRNE

SEQ ID NO: 1368230 - protein, 9 aa, Homo Sapiens
MQGLIAVDV

SEQ ID NO: 1368231 - protein, 9 aa, Homo Sapiens
AEGGAPHEA

SEQ ID NO: 1368232 - protein, 9 aa, Homo Sapiens
LRCSRECAG

SEQ ID NO: 1368233 - protein, 9 aa, Homo Sapiens
RQPGLLLQQ

SEQ ID NO: 1368234 - protein, 9 aa, Homo Sapiens
LLSVVWFPL

SEQ ID NO: 1368235 - protein, 9 aa, Homo Sapiens
ATETFKLTE

SEQ ID NO: 1368236 - protein, 9 aa, Homo Sapiens
ASSMEQLTR

SEQ ID NO: 1368237 - protein, 9 aa, Homo Sapiens
SLRPRSVVI

SEQ ID NO: 1368238 - protein, 9 aa, Homo Sapiens
SGTETAERC

SEQ ID NO: 1368239 - protein, 9 aa, Homo Sapiens
RNTVKKIKI

SEQ ID NO: 1368240 - protein, 9 aa, Homo Sapiens
PLTATANYS

SEQ ID NO: 1368241 - protein, 9 aa, Homo Sapiens
FDPVEIKVV

SEQ ID NO: 1368242 - protein, 9 aa, Homo Sapiens
CPLEIDYGQ

SEQ ID NO: 1368243 - protein, 9 aa, Homo Sapiens
GLHHLQVAV

SEQ ID NO: 1368244 - protein, 9 aa, Homo Sapiens
DQFSWEDVK

SEQ ID NO: 1368245 - protein, 9 aa, Homo Sapiens
TGDQSSPIG

SEQ ID NO: 1368246 - protein, 9 aa, Homo Sapiens
RRADHPPAP

SEQ ID NO: 1368247 - protein, 9 aa, Homo Sapiens
PKVSSLARR

SEQ ID NO: 1368248 - protein, 9 aa, Homo Sapiens
QATMQARSF

SEQ ID NO: 1368249 - protein, 9 aa, Homo Sapiens
CPGAPEPSF

SEQ ID NO: 1368250 - protein, 9 aa, Homo Sapiens
ECGKAFKRP

SEQ ID NO: 1368251 - protein, 9 aa, Homo Sapiens
FPKLSCFNF

SEQ ID NO: 1368252 - protein, 9 aa, Homo Sapiens
VVVRQGAPI

SEQ ID NO: 1368253 - protein, 9 aa, Homo Sapiens
ADLLSVVWF

SEQ ID NO: 1368254 - protein, 9 aa, Homo Sapiens
KKVQIQRIT

SEQ ID NO: 1368255 - protein, 9 aa, Homo Sapiens
LLVSQVTIT

SEQ ID NO: 1368256 - protein, 9 aa, Homo Sapiens
IDLSVWCYY

SEQ ID NO: 1368257 - protein, 9 aa, Homo Sapiens
ITGAKPLKK

SEQ ID NO: 1368258 - protein, 9 aa, Homo Sapiens
SYQVKPQMA

SEQ ID NO: 1368259 - protein, 9 aa, Homo Sapiens
CFISYGIEH

SEQ ID NO: 1368260 - protein, 9 aa, Homo Sapiens
RYWSTTQAI

SEQ ID NO: 1368261 - protein, 9 aa, Homo Sapiens
QAISRTHEI

SEQ ID NO: 1368262 - protein, 9 aa, Homo Sapiens
PRQWLRPQC

SEQ ID NO: 1368263 - protein, 9 aa, Homo Sapiens
CPRTMAGPS

SEQ ID NO: 1368264 - protein, 9 aa, Homo Sapiens
RLRKRETRK

SEQ ID NO: 1368265 - protein, 9 aa, Homo Sapiens
RYAVSIMWG

SEQ ID NO: 1368266 - protein, 9 aa, Homo Sapiens
FKRTSPLLT

SEQ ID NO: 1368267 - protein, 9 aa, Homo Sapiens
VEDSGHYCC

SEQ ID NO: 1368268 - protein, 9 aa, Homo Sapiens
SVKHLKAIP

SEQ ID NO: 1368269 - protein, 9 aa, Homo Sapiens
VSCKPVCCK

SEQ ID NO: 1368270 - protein, 9 aa, Homo Sapiens
QRHENQTHT

SEQ ID NO: 1368271 - protein, 9 aa, Homo Sapiens
LLLICGGVC

SEQ ID NO: 1368272 - protein, 9 aa, Homo Sapiens
LETSPTEGL

SEQ ID NO: 1368273 - protein, 9 aa, Homo Sapiens
APSTSAAAW

SEQ ID NO: 1368274 - protein, 9 aa, Homo Sapiens
IPTPARTLT

SEQ ID NO: 1368275 - protein, 9 aa, Homo Sapiens
QQGHVHRRV

SEQ ID NO: 1368276 - protein, 9 aa, Homo Sapiens
FPFSLRGNW

SEQ ID NO: 1368277 - protein, 9 aa, Homo Sapiens
PIGSVCYER

SEQ ID NO: 1368278 - protein, 9 aa, Homo Sapiens
PTMVAHAVP

SEQ ID NO: 1368279 - protein, 9 aa, Homo Sapiens
RVSLPEDRY

SEQ ID NO: 1368280 - protein, 9 aa, Homo Sapiens
NGMRSDVWR

SEQ ID NO: 1368281 - protein, 9 aa, Homo Sapiens
RRATSRDVN

SEQ ID NO: 1368282 - protein, 9 aa, Homo Sapiens
MHLFQSERW

SEQ ID NO: 1368283 - protein, 9 aa, Homo Sapiens
AQKVVASLK

SEQ ID NO: 1368284 - protein, 9 aa, Homo Sapiens
HLVATPGVK

SEQ ID NO: 1368285 - protein, 9 aa, Homo Sapiens
FFLSDLSFV

SEQ ID NO: 1368286 - protein, 9 aa, Homo Sapiens
SEEVEGAAG

SEQ ID NO: 1368287 - protein, 9 aa, Homo Sapiens
QKQILKRVN

SEQ ID NO: 1368288 - protein, 9 aa, Homo Sapiens
LPGQAFEYI

SEQ ID NO: 1368289 - protein, 9 aa, Homo Sapiens
VIFGYIEHG

SEQ ID NO: 1368290 - protein, 9 aa, Homo Sapiens
AEQHQGPVH

SEQ ID NO: 1368291 - protein, 9 aa, Homo Sapiens
STVTMKGLE

SEQ ID NO: 1368292 - protein, 9 aa, Homo Sapiens
MLNSRIIEI

SEQ ID NO: 1368293 - protein, 9 aa, Homo Sapiens
RKAEARARR

SEQ ID NO: 1368294 - protein, 9 aa, Homo Sapiens
VVQVLQFQE

SEQ ID NO: 1368295 - protein, 9 aa, Homo Sapiens
SCDEDGYYQ

SEQ ID NO: 1368296 - protein, 9 aa, Homo Sapiens
LHFIQLMLL

SEQ ID NO: 1368297 - protein, 9 aa, Homo Sapiens
PRRMRGTAA

SEQ ID NO: 1368298 - protein, 9 aa, Homo Sapiens
ACSQHFKKL

SEQ ID NO: 1368299 - protein, 9 aa, Homo Sapiens
QPQSVLCAT

SEQ ID NO: 1368300 - protein, 9 aa, Homo Sapiens
QQPQVPLSV

SEQ ID NO: 1368301 - protein, 9 aa, Homo Sapiens
NENRLSMSE

SEQ ID NO: 1368302 - protein, 9 aa, Homo Sapiens
DTISIINNV

SEQ ID NO: 1368303 - protein, 9 aa, Homo Sapiens
SAGRMTFPC

SEQ ID NO: 1368304 - protein, 9 aa, Homo Sapiens
SLTTGSFLS

SEQ ID NO: 1368305 - protein, 9 aa, Homo Sapiens
KLSKAYTNH

SEQ ID NO: 1368306 - protein, 9 aa, Homo Sapiens
LCHQHATQK

SEQ ID NO: 1368307 - protein, 9 aa, Homo Sapiens
GKVMPFRRQ

SEQ ID NO: 1368308 - protein, 9 aa, Homo Sapiens
CVIQRRAKM

SEQ ID NO: 1368309 - protein, 9 aa, Homo Sapiens
CLAVGMSRG

SEQ ID NO: 1368310 - protein, 9 aa, Homo Sapiens
NWSCRTLEP

SEQ ID NO: 1368311 - protein, 9 aa, Homo Sapiens
MKVYMDYNA

SEQ ID NO: 1368312 - protein, 9 aa, Homo Sapiens
WSQSVVGNH

SEQ ID NO: 1368313 - protein, 9 aa, Homo Sapiens
PAKKQRKPK

SEQ ID NO: 1368314 - protein, 9 aa, Homo Sapiens
RPEEYEGGI

SEQ ID NO: 1368315 - protein, 9 aa, Homo Sapiens
VECGVTSRC

SEQ ID NO: 1368316 - protein, 9 aa, Homo Sapiens
LGVGMPSAV

SEQ ID NO: 1368317 - protein, 9 aa, Homo Sapiens
HITLHDEEA

SEQ ID NO: 1368318 - protein, 9 aa, Homo Sapiens
PQQTPNGAV

SEQ ID NO: 1368319 - protein, 9 aa, Homo Sapiens
RVYGSTFSF

SEQ ID NO: 1368320 - protein, 9 aa, Homo Sapiens
GPGCCHVVQ

SEQ ID NO: 1368321 - protein, 9 aa, Homo Sapiens
ACFLEETEG

SEQ ID NO: 1368322 - protein, 9 aa, Homo Sapiens
LHPLPGEPQ

SEQ ID NO: 1368323 - protein, 9 aa, Homo Sapiens
GLFNIYHPL

SEQ ID NO: 1368324 - protein, 9 aa, Homo Sapiens
AGDTNLGDR

SEQ ID NO: 1368325 - protein, 9 aa, Homo Sapiens
AGTSGYLSP

SEQ ID NO: 1368326 - protein, 9 aa, Homo Sapiens
VRQIYSEHN

SEQ ID NO: 1368327 - protein, 9 aa, Homo Sapiens
DTYNSFIVS

SEQ ID NO: 1368328 - protein, 9 aa, Homo Sapiens
LLLVLALPL

SEQ ID NO: 1368329 - protein, 9 aa, Homo Sapiens
EEVDFAGSS

SEQ ID NO: 1368330 - protein, 9 aa, Homo Sapiens
QEHRVGGPG

SEQ ID NO: 1368331 - protein, 9 aa, Homo Sapiens
MSLQEREAT

SEQ ID NO: 1368332 - protein, 9 aa, Homo Sapiens
DAMGNYMLD

SEQ ID NO: 1368333 - protein, 9 aa, Homo Sapiens
QQEEISRLV

SEQ ID NO: 1368334 - protein, 9 aa, Homo Sapiens
KFENGQRIA

SEQ ID NO: 1368335 - protein, 9 aa, Homo Sapiens
LQQRHPQGP

SEQ ID NO: 1368336 - protein, 9 aa, Homo Sapiens
PMHGSSPGF

SEQ ID NO: 1368337 - protein, 9 aa, Homo Sapiens
RGGVAGPSR

SEQ ID NO: 1368338 - protein, 9 aa, Homo Sapiens
CPASAVSCQ

SEQ ID NO: 1368339 - protein, 9 aa, Homo Sapiens
ADPMPAATI

SEQ ID NO: 1368340 - protein, 9 aa, Homo Sapiens
MLIFAALQC

SEQ ID NO: 1368341 - protein, 9 aa, Homo Sapiens
GPTADEEEP

SEQ ID NO: 1368342 - protein, 9 aa, Homo Sapiens
KEDFAMQIS

SEQ ID NO: 1368343 - protein, 9 aa, Homo Sapiens
EAYIDFDED

SEQ ID NO: 1368344 - protein, 9 aa, Homo Sapiens
AGMETTCTV

SEQ ID NO: 1368345 - protein, 9 aa, Homo Sapiens
HLVGRHCGN

SEQ ID NO: 1368346 - protein, 9 aa, Homo Sapiens
RHCDEHRGG

SEQ ID NO: 1368347 - protein, 9 aa, Homo Sapiens
VCRLYVLKE

SEQ ID NO: 1368348 - protein, 9 aa, Homo Sapiens
KRETRKFCL

SEQ ID NO: 1368349 - protein, 9 aa, Homo Sapiens
PAPAQGQAT

SEQ ID NO: 1368350 - protein, 9 aa, Homo Sapiens
PTLSTLQQR

SEQ ID NO: 1368351 - protein, 9 aa, Homo Sapiens
RPPAQCLWL

SEQ ID NO: 1368352 - protein, 9 aa, Homo Sapiens
TRRPRALCS

SEQ ID NO: 1368353 - protein, 9 aa, Homo Sapiens
GDCPRTMAG

SEQ ID NO: 1368354 - protein, 9 aa, Homo Sapiens
QAGGEVKSS

SEQ ID NO: 1368355 - protein, 9 aa, Homo Sapiens
QSHRDLPSK

SEQ ID NO: 1368356 - protein, 9 aa, Homo Sapiens
MREKRKSLQ

SEQ ID NO: 1368357 - protein, 9 aa, Homo Sapiens
RGLRAHPVA

SEQ ID NO: 1368358 - protein, 9 aa, Homo Sapiens
IPDGLFWML

SEQ ID NO: 1368359 - protein, 9 aa, Homo Sapiens
GVISSRLRN

SEQ ID NO: 1368360 - protein, 9 aa, Homo Sapiens
HACDQPGIA

SEQ ID NO: 1368361 - protein, 9 aa, Homo Sapiens
ARLLGLHVL

SEQ ID NO: 1368362 - protein, 9 aa, Homo Sapiens
MENSHPPPP

SEQ ID NO: 1368363 - protein, 9 aa, Homo Sapiens
AAVPAFSHY

SEQ ID NO: 1368364 - protein, 9 aa, Homo Sapiens
MVIGQEVRM

SEQ ID NO: 1368365 - protein, 9 aa, Homo Sapiens
RSAFLLAFS

SEQ ID NO: 1368366 - protein, 9 aa, Homo Sapiens
GLAELVEFY

SEQ ID NO: 1368367 - protein, 9 aa, Homo Sapiens
TTTLSWGSP

SEQ ID NO: 1368368 - protein, 9 aa, Homo Sapiens
MLPAGLIQA

SEQ ID NO: 1368369 - protein, 9 aa, Homo Sapiens
EVRLRCQSG

SEQ ID NO: 1368370 - protein, 9 aa, Homo Sapiens
PEVTEQVRG

SEQ ID NO: 1368371 - protein, 9 aa, Homo Sapiens
RPPKENLSP

SEQ ID NO: 1368372 - protein, 9 aa, Homo Sapiens
SPCSSFSRR

SEQ ID NO: 1368373 - protein, 9 aa, Homo Sapiens
VAWHPLGLC

SEQ ID NO: 1368374 - protein, 9 aa, Homo Sapiens
HLARVYGST

SEQ ID NO: 1368375 - protein, 9 aa, Homo Sapiens
MQMYNSPHH

SEQ ID NO: 1368376 - protein, 9 aa, Homo Sapiens
RDRLRFTHP

SEQ ID NO: 1368377 - protein, 9 aa, Homo Sapiens
LHLVATPGV

SEQ ID NO: 1368378 - protein, 9 aa, Homo Sapiens
RHSIVFLEW

SEQ ID NO: 1368379 - protein, 9 aa, Homo Sapiens
LVEELRPNP

SEQ ID NO: 1368380 - protein, 9 aa, Homo Sapiens
QDGKNFTQG

SEQ ID NO: 1368381 - protein, 9 aa, Homo Sapiens
ICSTKLTQS

SEQ ID NO: 1368382 - protein, 9 aa, Homo Sapiens
PAIHRAHRE

SEQ ID NO: 1368383 - protein, 9 aa, Homo Sapiens
ASAVSCQSR

SEQ ID NO: 1368384 - protein, 9 aa, Homo Sapiens
ARAGAARAR

SEQ ID NO: 1368385 - protein, 9 aa, Homo Sapiens
EEEERHLEA

SEQ ID NO: 1368386 - protein, 9 aa, Homo Sapiens
AQTLQQCRV

SEQ ID NO: 1368387 - protein, 9 aa, Homo Sapiens
EPVQCDEQG

SEQ ID NO: 1368388 - protein, 9 aa, Homo Sapiens
AKAFALRIF

SEQ ID NO: 1368389 - protein, 9 aa, Homo Sapiens
TKLKNYLRE

SEQ ID NO: 1368390 - protein, 9 aa, Homo Sapiens
FRTEKGNIK

SEQ ID NO: 1368391 - protein, 9 aa, Homo Sapiens
QHAGARQVG

SEQ ID NO: 1368392 - protein, 9 aa, Homo Sapiens
PKLSCFNFE

SEQ ID NO: 1368393 - protein, 9 aa, Homo Sapiens
SLDRYWSTT

SEQ ID NO: 1368394 - protein, 9 aa, Homo Sapiens
IQRWYRQQV

SEQ ID NO: 1368395 - protein, 9 aa, Homo Sapiens
PPRFLQRSP

SEQ ID NO: 1368396 - protein, 9 aa, Homo Sapiens
CCHCLLTSS

SEQ ID NO: 1368397 - protein, 9 aa, Homo Sapiens
GDIYCTFNF

SEQ ID NO: 1368398 - protein, 9 aa, Homo Sapiens
TDLDVAGPT

SEQ ID NO: 1368399 - protein, 9 aa, Homo Sapiens
AAPPHRLLG

SEQ ID NO: 1368400 - protein, 9 aa, Homo Sapiens
TRVSSAHLP

SEQ ID NO: 1368401 - protein, 9 aa, Homo Sapiens
RTSSIYQTP

SEQ ID NO: 1368402 - protein, 9 aa, Homo Sapiens
LCKPSSLPA

SEQ ID NO: 1368403 - protein, 9 aa, Homo Sapiens
TLAADPMPA

SEQ ID NO: 1368404 - protein, 9 aa, Homo Sapiens
GGFGGRRRQ

SEQ ID NO: 1368405 - protein, 9 aa, Homo Sapiens
CVHGYTRVS

SEQ ID NO: 1368406 - protein, 9 aa, Homo Sapiens
GGLSPGLSP

SEQ ID NO: 1368407 - protein, 9 aa, Homo Sapiens
PFVKGCAER

SEQ ID NO: 1368408 - protein, 9 aa, Homo Sapiens
SHAKDDAGQ

SEQ ID NO: 1368409 - protein, 9 aa, Homo Sapiens
YLRVSLPED

SEQ ID NO: 1368410 - protein, 9 aa, Homo Sapiens
EEGELHYAA

SEQ ID NO: 1368411 - protein, 9 aa, Homo Sapiens
FFFFETKSL

SEQ ID NO: 1368412 - protein, 9 aa, Homo Sapiens
MLCAANGNP

SEQ ID NO: 1368413 - protein, 9 aa, Homo Sapiens
LCSAQPAIS

SEQ ID NO: 1368414 - protein, 9 aa, Homo Sapiens
RFEVIEFDG

SEQ ID NO: 1368415 - protein, 9 aa, Homo Sapiens
PLVLENQHL

SEQ ID NO: 1368416 - protein, 9 aa, Homo Sapiens
ERVKRQRGD

SEQ ID NO: 1368417 - protein, 9 aa, Homo Sapiens
KQIRDRVMH

SEQ ID NO: 1368418 - protein, 9 aa, Homo Sapiens
KTEHQVQGG

SEQ ID NO: 1368419 - protein, 9 aa, Homo Sapiens
VSITNTKTR

SEQ ID NO: 1368420 - protein, 9 aa, Homo Sapiens
LIYVVEGGT

SEQ ID NO: 1368421 - protein, 9 aa, Homo Sapiens
TSRGQRQKS

SEQ ID NO: 1368422 - protein, 9 aa, Homo Sapiens
TMVAHAVPN

SEQ ID NO: 1368423 - protein, 9 aa, Homo Sapiens
PWLPAKALR

SEQ ID NO: 1368424 - protein, 9 aa, Homo Sapiens
RKSLQLPAS

SEQ ID NO: 1368425 - protein, 9 aa, Homo Sapiens
GYYQKMQCD

SEQ ID NO: 1368426 - protein, 9 aa, Homo Sapiens
AGMATHFQQ

SEQ ID NO: 1368427 - protein, 9 aa, Homo Sapiens
LVTGDDFGT

SEQ ID NO: 1368428 - protein, 9 aa, Homo Sapiens
RGRWVTSGI

SEQ ID NO: 1368429 - protein, 9 aa, Homo Sapiens
RSVWHRPQG

SEQ ID NO: 1368430 - protein, 9 aa, Homo Sapiens
FVAIAITFI

SEQ ID NO: 1368431 - protein, 9 aa, Homo Sapiens
TTAPSVLTA

SEQ ID NO: 1368432 - protein, 9 aa, Homo Sapiens
SPAAAQKVV

SEQ ID NO: 1368433 - protein, 9 aa, Homo Sapiens
KRRVELILE

SEQ ID NO: 1368434 - protein, 9 aa, Homo Sapiens
TGASTPARS

SEQ ID NO: 1368435 - protein, 9 aa, Homo Sapiens
VGKKGQACE

SEQ ID NO: 1368436 - protein, 9 aa, Homo Sapiens
MREPGLLIF

SEQ ID NO: 1368437 - protein, 9 aa, Homo Sapiens
RMAGRRSTR

SEQ ID NO: 1368438 - protein, 9 aa, Homo Sapiens
SPPPLPARS

SEQ ID NO: 1368439 - protein, 9 aa, Homo Sapiens
LRVHMADME

SEQ ID NO: 1368440 - protein, 9 aa, Homo Sapiens
RRRAAWWQS

SEQ ID NO: 1368441 - protein, 9 aa, Homo Sapiens
NECSQRFRK

SEQ ID NO: 1368442 - protein, 9 aa, Homo Sapiens
PPKARCPRV

SEQ ID NO: 1368443 - protein, 9 aa, Homo Sapiens
APLESVRQI

SEQ ID NO: 1368444 - protein, 9 aa, Homo Sapiens
FLVKCCAYD

SEQ ID NO: 1368445 - protein, 9 aa, Homo Sapiens
GIALGGYII

SEQ ID NO: 1368446 - protein, 9 aa, Homo Sapiens
RSSTRHHKQ

SEQ ID NO: 1368447 - protein, 9 aa, Homo Sapiens
RNVTERKDH

SEQ ID NO: 1368448 - protein, 9 aa, Homo Sapiens
GVDVIAPRR

SEQ ID NO: 1368449 - protein, 9 aa, Homo Sapiens
SPKERWEPQ

SEQ ID NO: 1368450 - protein, 9 aa, Homo Sapiens
PAQCLWLVL

SEQ ID NO: 1368451 - protein, 9 aa, Homo Sapiens
LKYSFQKAC

SEQ ID NO: 1368452 - protein, 9 aa, Homo Sapiens
MMKLPFCKS

SEQ ID NO: 1368453 - protein, 9 aa, Homo Sapiens
RECAGGCEC

SEQ ID NO: 1368454 - protein, 9 aa, Homo Sapiens
LFHRPLRCC

SEQ ID NO: 1368455 - protein, 9 aa, Homo Sapiens
ELNIKSDSA

SEQ ID NO: 1368456 - protein, 9 aa, Homo Sapiens
NSNSSRESD

SEQ ID NO: 1368457 - protein, 9 aa, Homo Sapiens
QFWIYDNQR

SEQ ID NO: 1368458 - protein, 9 aa, Homo Sapiens
NSQAHGNFL

SEQ ID NO: 1368459 - protein, 9 aa, Homo Sapiens
PQFLLHGPY

SEQ ID NO: 1368460 - protein, 9 aa, Homo Sapiens
SRVKTWYEY

SEQ ID NO: 1368461 - protein, 9 aa, Homo Sapiens
NYTIAPNSH

SEQ ID NO: 1368462 - protein, 9 aa, Homo Sapiens
ERRTPDQLY

SEQ ID NO: 1368463 - protein, 9 aa, Homo Sapiens
FKVNKSKQN

SEQ ID NO: 1368464 - protein, 9 aa, Homo Sapiens
CHLCPFLHF

SEQ ID NO: 1368465 - protein, 9 aa, Homo Sapiens
PASPAPAQG

SEQ ID NO: 1368466 - protein, 9 aa, Homo Sapiens
SVRYILKDY

SEQ ID NO: 1368467 - protein, 9 aa, Homo Sapiens
KTEAAAHSL

SEQ ID NO: 1368468 - protein, 9 aa, Homo Sapiens
NNNWVPDVG

SEQ ID NO: 1368469 - protein, 9 aa, Homo Sapiens
LKRTEIIGR

SEQ ID NO: 1368470 - protein, 9 aa, Homo Sapiens
KSLKILQIR

SEQ ID NO: 1368471 - protein, 9 aa, Homo Sapiens
LSPLVQPLA

SEQ ID NO: 1368472 - protein, 9 aa, Homo Sapiens
VKQCGYSEV

SEQ ID NO: 1368473 - protein, 9 aa, Homo Sapiens
ENGQRIAET

SEQ ID NO: 1368474 - protein, 9 aa, Homo Sapiens
LSTSSNFLL

SEQ ID NO: 1368475 - protein, 9 aa, Homo Sapiens
RTSCLPPFS

SEQ ID NO: 1368476 - protein, 9 aa, Homo Sapiens
TYSAICKKC

SEQ ID NO: 1368477 - protein, 9 aa, Homo Sapiens
SAMMKLPFC

SEQ ID NO: 1368478 - protein, 9 aa, Homo Sapiens
PWGAAPRAG

SEQ ID NO: 1368479 - protein, 9 aa, Homo Sapiens
DPSALRSHT

SEQ ID NO: 1368480 - protein, 9 aa, Homo Sapiens
YHIEDTPIY

SEQ ID NO: 1368481 - protein, 9 aa, Homo Sapiens
GQAGMAPVG

SEQ ID NO: 1368482 - protein, 9 aa, Homo Sapiens
YKCDECGNT

SEQ ID NO: 1368483 - protein, 9 aa, Homo Sapiens
KDGYESDAP

SEQ ID NO: 1368484 - protein, 9 aa, Homo Sapiens
DSVLAFSRS

SEQ ID NO: 1368485 - protein, 9 aa, Homo Sapiens
ADLFSKWAD

SEQ ID NO: 1368486 - protein, 9 aa, Homo Sapiens
VGILRCTHL

SEQ ID NO: 1368487 - protein, 9 aa, Homo Sapiens
PLEKLQVDD

SEQ ID NO: 1368488 - protein, 9 aa, Homo Sapiens
VPSSDEEAV

SEQ ID NO: 1368489 - protein, 9 aa, Homo Sapiens
ALPLRLCRQ

SEQ ID NO: 1368490 - protein, 9 aa, Homo Sapiens
WPSGRRPKR

SEQ ID NO: 1368491 - protein, 9 aa, Homo Sapiens
VKMGRGPLS

SEQ ID NO: 1368492 - protein, 9 aa, Homo Sapiens
QIVDPTVGN

SEQ ID NO: 1368493 - protein, 9 aa, Homo Sapiens
AERFVSSPE

SEQ ID NO: 1368494 - protein, 9 aa, Homo Sapiens
FVTPIQQPA

SEQ ID NO: 1368495 - protein, 9 aa, Homo Sapiens
LLVEELRPN

SEQ ID NO: 1368496 - protein, 9 aa, Homo Sapiens
PVRIGSSSA

SEQ ID NO: 1368497 - protein, 9 aa, Homo Sapiens
DNLLALGLL

SEQ ID NO: 1368498 - protein, 9 aa, Homo Sapiens
SGGPGCCHS

SEQ ID NO: 1368499 - protein, 9 aa, Homo Sapiens
PAGPSISIP

SEQ ID NO: 1368500 - protein, 9 aa, Homo Sapiens
CAHTQQGHV

SEQ ID NO: 1368501 - protein, 9 aa, Homo Sapiens
TCSPPSCSP

SEQ ID NO: 1368502 - protein, 9 aa, Homo Sapiens
SSQAGGEVK

SEQ ID NO: 1368503 - protein, 9 aa, Homo Sapiens
RLRACRAGG

SEQ ID NO: 1368504 - protein, 9 aa, Homo Sapiens
SAYTGEKTY

SEQ ID NO: 1368505 - protein, 9 aa, Homo Sapiens
ACTVDSSQG

SEQ ID NO: 1368506 - protein, 9 aa, Homo Sapiens
SEPLTATAN

SEQ ID NO: 1368507 - protein, 9 aa, Homo Sapiens
CLDTVPEVY

SEQ ID NO: 1368508 - protein, 9 aa, Homo Sapiens
HQVQGRLWM

SEQ ID NO: 1368509 - protein, 9 aa, Homo Sapiens
IADSTMLQA

SEQ ID NO: 1368510 - protein, 9 aa, Homo Sapiens
PPGPHSGAT

SEQ ID NO: 1368511 - protein, 9 aa, Homo Sapiens
HFKKLFTSG

SEQ ID NO: 1368512 - protein, 9 aa, Homo Sapiens
SRAACRPTL

SEQ ID NO: 1368513 - protein, 9 aa, Homo Sapiens
CECWRENLL

SEQ ID NO: 1368514 - protein, 9 aa, Homo Sapiens
GPSRGPPPQ

SEQ ID NO: 1368515 - protein, 9 aa, Homo Sapiens
DPQPPKSFQ

SEQ ID NO: 1368516 - protein, 9 aa, Homo Sapiens
VNNAAARVM

SEQ ID NO: 1368517 - protein, 9 aa, Homo Sapiens
YKKAIMVGF

SEQ ID NO: 1368518 - protein, 9 aa, Homo Sapiens
PPALGTELS

SEQ ID NO: 1368519 - protein, 9 aa, Homo Sapiens
RSGGRSGCS

SEQ ID NO: 1368520 - protein, 9 aa, Homo Sapiens
NLKRFFDGV

SEQ ID NO: 1368521 - protein, 9 aa, Homo Sapiens
LRQVTQKRT

SEQ ID NO: 1368522 - protein, 9 aa, Homo Sapiens
NRRLRTLEE

SEQ ID NO: 1368523 - protein, 9 aa, Homo Sapiens
VTWLKDDQP

SEQ ID NO: 1368524 - protein, 9 aa, Homo Sapiens
RHLEAEGAH

SEQ ID NO: 1368525 - protein, 9 aa, Homo Sapiens
VDLQMLTYL

SEQ ID NO: 1368526 - protein, 9 aa, Homo Sapiens
GLEAIYLLS

SEQ ID NO: 1368527 - protein, 9 aa, Homo Sapiens
HVVQPDSVY

SEQ ID NO: 1368528 - protein, 9 aa, Homo Sapiens
ALGAYRTNA

SEQ ID NO: 1368529 - protein, 8 aa, Homo Sapiens
MPSCNRSC

SEQ ID NO: 1368530 - protein, 9 aa, Homo Sapiens
VQSVLLLGV

SEQ ID NO: 1368531 - protein, 9 aa, Homo Sapiens
LGVEIHDKL

SEQ ID NO: 1368532 - protein, 9 aa, Homo Sapiens
QRSLWEGGN

SEQ ID NO: 1368533 - protein, 9 aa, Homo Sapiens
QSAYTGEKT

SEQ ID NO: 1368534 - protein, 9 aa, Homo Sapiens
RPTQTAAGR

SEQ ID NO: 1368535 - protein, 9 aa, Homo Sapiens
ISLDRYWST

SEQ ID NO: 1368536 - protein, 9 aa, Homo Sapiens
QRGQHDDDG

SEQ ID NO: 1368537 - protein, 9 aa, Homo Sapiens
PASCLGAPA

SEQ ID NO: 1368538 - protein, 9 aa, Homo Sapiens
EPLRVKPLK

SEQ ID NO: 1368539 - protein, 9 aa, Homo Sapiens
ITKESETRA

SEQ ID NO: 1368540 - protein, 9 aa, Homo Sapiens
IVPTSRGQR

SEQ ID NO: 1368541 - protein, 9 aa, Homo Sapiens
STRATSQGL

SEQ ID NO: 1368542 - protein, 9 aa, Homo Sapiens
AYHPEFITA

SEQ ID NO: 1368543 - protein, 9 aa, Homo Sapiens
PLEALTGQG

SEQ ID NO: 1368544 - protein, 9 aa, Homo Sapiens
QCEAMFDRT

SEQ ID NO: 1368545 - protein, 9 aa, Homo Sapiens
QTPPQPQSV

SEQ ID NO: 1368546 - protein, 9 aa, Homo Sapiens
RRRPRPPQP

SEQ ID NO: 1368547 - protein, 9 aa, Homo Sapiens
GGARWGPRS

SEQ ID NO: 1368548 - protein, 9 aa, Homo Sapiens
PLLVSSPER

SEQ ID NO: 1368549 - protein, 9 aa, Homo Sapiens
YVETSGYYY

SEQ ID NO: 1368550 - protein, 9 aa, Homo Sapiens
MGPAEDRCQ

SEQ ID NO: 1368551 - protein, 9 aa, Homo Sapiens
GQHEEVDFA

SEQ ID NO: 1368552 - protein, 9 aa, Homo Sapiens
WNKDGCPLQ

SEQ ID NO: 1368553 - protein, 9 aa, Homo Sapiens
QYVETSGYY

SEQ ID NO: 1368554 - protein, 9 aa, Homo Sapiens
AAQKVVASL

SEQ ID NO: 1368555 - protein, 9 aa, Homo Sapiens
ELRERARLL

SEQ ID NO: 1368556 - protein, 9 aa, Homo Sapiens
NRHSIVFLE

SEQ ID NO: 1368557 - protein, 9 aa, Homo Sapiens
RRRATSRDV

SEQ ID NO: 1368558 - protein, 9 aa, Homo Sapiens
GFSCGGNLL

SEQ ID NO: 1368559 - protein, 9 aa, Homo Sapiens
HTPPCPASF

SEQ ID NO: 1368560 - protein, 9 aa, Homo Sapiens
SNSNSSRES

SEQ ID NO: 1368561 - protein, 9 aa, Homo Sapiens
DIPDRPTGV

SEQ ID NO: 1368562 - protein, 9 aa, Homo Sapiens
IEITPQRSK

SEQ ID NO: 1368563 - protein, 9 aa, Homo Sapiens
AHAWFECET

SEQ ID NO: 1368564 - protein, 9 aa, Homo Sapiens
SPRSAFLLA

SEQ ID NO: 1368565 - protein, 9 aa, Homo Sapiens
IGSSSASLA

SEQ ID NO: 1368566 - protein, 9 aa, Homo Sapiens
CPAIPHGHP

SEQ ID NO: 1368567 - protein, 9 aa, Homo Sapiens
QKGWWQGEE

SEQ ID NO: 1368568 - protein, 9 aa, Homo Sapiens
SLHPASGRA

SEQ ID NO: 1368569 - protein, 9 aa, Homo Sapiens
PGPGTWTPC

SEQ ID NO: 1368570 - protein, 9 aa, Homo Sapiens
LVYRRHCGA

SEQ ID NO: 1368571 - protein, 9 aa, Homo Sapiens
VEKIFKYGH

SEQ ID NO: 1368572 - protein, 9 aa, Homo Sapiens
RQIYSEHNY

SEQ ID NO: 1368573 - protein, 9 aa, Homo Sapiens
DQLQQDGLQ

SEQ ID NO: 1368574 - protein, 9 aa, Homo Sapiens
SGDSCDGEE

SEQ ID NO: 1368575 - protein, 9 aa, Homo Sapiens
ARGGGNPSH

SEQ ID NO: 1368576 - protein, 9 aa, Homo Sapiens
LWQAFRRFG

SEQ ID NO: 1368577 - protein, 9 aa, Homo Sapiens
ISVLRPQQI

SEQ ID NO: 1368578 - protein, 9 aa, Homo Sapiens
ENFPRELSS

SEQ ID NO: 1368579 - protein, 9 aa, Homo Sapiens
VVQRLCESK

SEQ ID NO: 1368580 - protein, 9 aa, Homo Sapiens
VALPTDLDV

SEQ ID NO: 1368581 - protein, 9 aa, Homo Sapiens
HHLQVAVEC

SEQ ID NO: 1368582 - protein, 9 aa, Homo Sapiens
TPSKKKLKL

SEQ ID NO: 1368583 - protein, 9 aa, Homo Sapiens
YSSGRNRVG

SEQ ID NO: 1368584 - protein, 9 aa, Homo Sapiens
YKYMVKLKL

SEQ ID NO: 1368585 - protein, 9 aa, Homo Sapiens
SVSALSGPR

SEQ ID NO: 1368586 - protein, 9 aa, Homo Sapiens
EEISRLVHI

SEQ ID NO: 1368587 - protein, 9 aa, Homo Sapiens
TSRLVASQI

SEQ ID NO: 1368588 - protein, 9 aa, Homo Sapiens
CPLQVEKNL

SEQ ID NO: 1368589 - protein, 9 aa, Homo Sapiens
DDKEPLIHI

SEQ ID NO: 1368590 - protein, 9 aa, Homo Sapiens
AICKKCGLD

SEQ ID NO: 1368591 - protein, 9 aa, Homo Sapiens
VLAFSRSLH

SEQ ID NO: 1368592 - protein, 9 aa, Homo Sapiens
VTPIQQPAM

SEQ ID NO: 1368593 - protein, 9 aa, Homo Sapiens
SLIMSSYGL

SEQ ID NO: 1368594 - protein, 9 aa, Homo Sapiens
LVKAMVVRT

SEQ ID NO: 1368595 - protein, 9 aa, Homo Sapiens
PFSLIMSSY

SEQ ID NO: 1368596 - protein, 9 aa, Homo Sapiens
QPCTSVPST

SEQ ID NO: 1368597 - protein, 9 aa, Homo Sapiens
NWTNSAICN

SEQ ID NO: 1368598 - protein, 9 aa, Homo Sapiens
LDKARKAKI

SEQ ID NO: 1368599 - protein, 9 aa, Homo Sapiens
AGSLYEPAS

SEQ ID NO: 1368600 - protein, 9 aa, Homo Sapiens
DPIIAVEGL

SEQ ID NO: 1368601 - protein, 9 aa, Homo Sapiens
HRESKVIQW

SEQ ID NO: 1368602 - protein, 9 aa, Homo Sapiens
DKPERNCYF

SEQ ID NO: 1368603 - protein, 9 aa, Homo Sapiens
TSGHLPPSS

SEQ ID NO: 1368604 - protein, 9 aa, Homo Sapiens
PSPPQQTPN

SEQ ID NO: 1368605 - protein, 9 aa, Homo Sapiens
YLREVSITN

SEQ ID NO: 1368606 - protein, 9 aa, Homo Sapiens
ATRRPRALC

SEQ ID NO: 1368607 - protein, 9 aa, Homo Sapiens
KKGQACEQL

SEQ ID NO: 1368608 - protein, 9 aa, Homo Sapiens
QPRLEGTGL

SEQ ID NO: 1368609 - protein, 9 aa, Homo Sapiens
HHLPEVCDG

SEQ ID NO: 1368610 - protein, 9 aa, Homo Sapiens
RSRLGRVMC

SEQ ID NO: 1368611 - protein, 9 aa, Homo Sapiens
VEVRHNSSC

SEQ ID NO: 1368612 - protein, 9 aa, Homo Sapiens
NQTWNIVQE

SEQ ID NO: 1368613 - protein, 9 aa, Homo Sapiens
MLGKKRSLA

SEQ ID NO: 1368614 - protein, 9 aa, Homo Sapiens
SGASSPTSC

SEQ ID NO: 1368615 - protein, 9 aa, Homo Sapiens
CDGMGQRAL

SEQ ID NO: 1368616 - protein, 9 aa, Homo Sapiens
RKAALEGAS

SEQ ID NO: 1368617 - protein, 9 aa, Homo Sapiens
PPGPVAAAP

SEQ ID NO: 1368618 - protein, 9 aa, Homo Sapiens
TPLASMPFS

SEQ ID NO: 1368619 - protein, 9 aa, Homo Sapiens
SQNFCPEVT

SEQ ID NO: 1368620 - protein, 9 aa, Homo Sapiens
RPKRWGQVS

SEQ ID NO: 1368621 - protein, 9 aa, Homo Sapiens
AHFPSVALP

SEQ ID NO: 1368622 - protein, 9 aa, Homo Sapiens
VSGLCRRLE

SEQ ID NO: 1368623 - protein, 9 aa, Homo Sapiens
KIETAHPPL

SEQ ID NO: 1368624 - protein, 9 aa, Homo Sapiens
WDNEEDLQM

SEQ ID NO: 1368625 - protein, 9 aa, Homo Sapiens
IAVDCYVAV

SEQ ID NO: 1368626 - protein, 9 aa, Homo Sapiens
IEPVQCDEQ

SEQ ID NO: 1368627 - protein, 9 aa, Homo Sapiens
RVSGSHKGG

SEQ ID NO: 1368628 - protein, 9 aa, Homo Sapiens
ISHLTACFE

SEQ ID NO: 1368629 - protein, 9 aa, Homo Sapiens
FPTGRYPVR

SEQ ID NO: 1368630 - protein, 9 aa, Homo Sapiens
SVSRWLQNA

SEQ ID NO: 1368631 - protein, 9 aa, Homo Sapiens
RNGERVNHV

SEQ ID NO: 1368632 - protein, 9 aa, Homo Sapiens
TRRAVLVSC

SEQ ID NO: 1368633 - protein, 9 aa, Homo Sapiens
RDREKQMSS

SEQ ID NO: 1368634 - protein, 9 aa, Homo Sapiens
GQSPIGSVC

SEQ ID NO: 1368635 - protein, 9 aa, Homo Sapiens
WASPSSAAS

SEQ ID NO: 1368636 - protein, 9 aa, Homo Sapiens
PEVCDGMGQ

SEQ ID NO: 1368637 - protein, 9 aa, Homo Sapiens
PVNHYHIGS

SEQ ID NO: 1368638 - protein, 9 aa, Homo Sapiens
ASVHNPDLC

SEQ ID NO: 1368639 - protein, 9 aa, Homo Sapiens
SEGNYILTC

SEQ ID NO: 1368640 - protein, 9 aa, Homo Sapiens
SGKPPAMRS

SEQ ID NO: 1368641 - protein, 9 aa, Homo Sapiens
GEGRGYPRP

SEQ ID NO: 1368642 - protein, 9 aa, Homo Sapiens
HKCCPSSWM

SEQ ID NO: 1368643 - protein, 9 aa, Homo Sapiens
VDCLQAFWD

SEQ ID NO: 1368644 - protein, 9 aa, Homo Sapiens
FKNEAGYTK

SEQ ID NO: 1368645 - protein, 9 aa, Homo Sapiens
METCQKKKE

SEQ ID NO: 1368646 - protein, 9 aa, Homo Sapiens
GTFLKNQIG

SEQ ID NO: 1368647 - protein, 9 aa, Homo Sapiens
GQNTRPGKD

SEQ ID NO: 1368648 - protein, 9 aa, Homo Sapiens
LNNGAGVDV

SEQ ID NO: 1368649 - protein, 9 aa, Homo Sapiens
RQNPHLRNE

SEQ ID NO: 1368650 - protein, 9 aa, Homo Sapiens
HIDFVTPIQ

SEQ ID NO: 1368651 - protein, 9 aa, Homo Sapiens
VTALLPPRA

SEQ ID NO: 1368652 - protein, 9 aa, Homo Sapiens
NQVARFNGL

SEQ ID NO: 1368653 - protein, 9 aa, Homo Sapiens
FRVQDVARR

SEQ ID NO: 1368654 - protein, 9 aa, Homo Sapiens
IQSQESGYQ

SEQ ID NO: 1368655 - protein, 9 aa, Homo Sapiens
GLHPLPGEP

SEQ ID NO: 1368656 - protein, 9 aa, Homo Sapiens
ARAAHRRPT

SEQ ID NO: 1368657 - protein, 9 aa, Homo Sapiens
KPDNVLVNE

SEQ ID NO: 1368658 - protein, 9 aa, Homo Sapiens
AISTVEILL

SEQ ID NO: 1368659 - protein, 9 aa, Homo Sapiens
QVILHVCQN

SEQ ID NO: 1368660 - protein, 9 aa, Homo Sapiens
DRAPRSGRF

SEQ ID NO: 1368661 - protein, 9 aa, Homo Sapiens
PHHRVTDCV

SEQ ID NO: 1368662 - protein, 9 aa, Homo Sapiens
LAPVAWHPL

SEQ ID NO: 1368663 - protein, 9 aa, Homo Sapiens
AISLQPLPT

SEQ ID NO: 1368664 - protein, 9 aa, Homo Sapiens
WLTESGRLI

SEQ ID NO: 1368665 - protein, 9 aa, Homo Sapiens
PTAPRRHGL

SEQ ID NO: 1368666 - protein, 9 aa, Homo Sapiens
HTNTNKIEE

SEQ ID NO: 1368667 - protein, 9 aa, Homo Sapiens
ERFRSFSPL

SEQ ID NO: 1368668 - protein, 9 aa, Homo Sapiens
TSRLHDLYD

SEQ ID NO: 1368669 - protein, 9 aa, Homo Sapiens
HHCLLCPKT

SEQ ID NO: 1368670 - protein, 9 aa, Homo Sapiens
YRLQVSESV

SEQ ID NO: 1368671 - protein, 9 aa, Homo Sapiens
QNYTIAPNS

SEQ ID NO: 1368672 - protein, 9 aa, Homo Sapiens
RPRALCSQR

SEQ ID NO: 1368673 - protein, 9 aa, Homo Sapiens
PRVGCLHSQ

SEQ ID NO: 1368674 - protein, 9 aa, Homo Sapiens
TGRPHGDIY

SEQ ID NO: 1368675 - protein, 9 aa, Homo Sapiens
CKTFILCQL

SEQ ID NO: 1368676 - protein, 9 aa, Homo Sapiens
FQNSTFGFR

SEQ ID NO: 1368677 - protein, 9 aa, Homo Sapiens
DREKQMSSL

SEQ ID NO: 1368678 - protein, 9 aa, Homo Sapiens
LPLQASEFP

SEQ ID NO: 1368679 - protein, 9 aa, Homo Sapiens
SQGLPASRT

SEQ ID NO: 1368680 - protein, 9 aa, Homo Sapiens
HQLPSRNLE

SEQ ID NO: 1368681 - protein, 9 aa, Homo Sapiens
TGPLWKKPW

SEQ ID NO: 1368682 - protein, 9 aa, Homo Sapiens
DLQRRRKER

SEQ ID NO: 1368683 - protein, 9 aa, Homo Sapiens
CDPDRLRAC

SEQ ID NO: 1368684 - protein, 9 aa, Homo Sapiens
TCCSMGQTW

SEQ ID NO: 1368685 - protein, 9 aa, Homo Sapiens
KDLWEHIED

SEQ ID NO: 1368686 - protein, 9 aa, Homo Sapiens
LPSRWNYRH

SEQ ID NO: 1368687 - protein, 9 aa, Homo Sapiens
HKQPETSNM

SEQ ID NO: 1368688 - protein, 9 aa, Homo Sapiens
DARGLRVLT

SEQ ID NO: 1368689 - protein, 9 aa, Homo Sapiens
ELPHIIKKQ

SEQ ID NO: 1368690 - protein, 9 aa, Homo Sapiens
AHILTHLQL

SEQ ID NO: 1368691 - protein, 9 aa, Homo Sapiens
KGCAERFVS

SEQ ID NO: 1368692 - protein, 9 aa, Homo Sapiens
SSRLRNEMK

SEQ ID NO: 1368693 - protein, 9 aa, Homo Sapiens
RRPWEGGNR

SEQ ID NO: 1368694 - protein, 9 aa, Homo Sapiens
SLTEHSDLE

SEQ ID NO: 1368695 - protein, 9 aa, Homo Sapiens
SLVLAEYWA

SEQ ID NO: 1368696 - protein, 9 aa, Homo Sapiens
TTSMILRID

SEQ ID NO: 1368697 - protein, 9 aa, Homo Sapiens
PYLYRNNLQ

SEQ ID NO: 1368698 - protein, 9 aa, Homo Sapiens
DNQREVCIV

SEQ ID NO: 1368699 - protein, 9 aa, Homo Sapiens
VGDTSRPPY

SEQ ID NO: 1368700 - protein, 9 aa, Homo Sapiens
QEEPEHSKE

SEQ ID NO: 1368701 - protein, 9 aa, Homo Sapiens
SDYNMVLAH

SEQ ID NO: 1368702 - protein, 9 aa, Homo Sapiens
DAISLDGGA

SEQ ID NO: 1368703 - protein, 9 aa, Homo Sapiens
KERQSYKEA

SEQ ID NO: 1368704 - protein, 9 aa, Homo Sapiens
LNYGVDNAE

SEQ ID NO: 1368705 - protein, 9 aa, Homo Sapiens
YRVLWDDNC

SEQ ID NO: 1368706 - protein, 9 aa, Homo Sapiens
GIVGNQPKA

SEQ ID NO: 1368707 - protein, 9 aa, Homo Sapiens
RDSPSSQPS

SEQ ID NO: 1368708 - protein, 9 aa, Homo Sapiens
AMYVAIQAA

SEQ ID NO: 1368709 - protein, 9 aa, Homo Sapiens
NFNEKISIP

SEQ ID NO: 1368710 - protein, 9 aa, Homo Sapiens
DFERSEGNT

SEQ ID NO: 1368711 - protein, 9 aa, Homo Sapiens
NLQPRARHF

SEQ ID NO: 1368712 - protein, 9 aa, Homo Sapiens
KADEGRADL

SEQ ID NO: 1368713 - protein, 9 aa, Homo Sapiens
DCGYCSAVF

SEQ ID NO: 1368714 - protein, 9 aa, Homo Sapiens
QQPPSPLPP

SEQ ID NO: 1368715 - protein, 9 aa, Homo Sapiens
WMQGLIAVD

SEQ ID NO: 1368716 - protein, 9 aa, Homo Sapiens
SSNSNSSRE

SEQ ID NO: 1368717 - protein, 9 aa, Homo Sapiens
GPSRNLLLI

SEQ ID NO: 1368718 - protein, 9 aa, Homo Sapiens
EDDAAFCLE

SEQ ID NO: 1368719 - protein, 9 aa, Homo Sapiens
FLIYLRWMT

SEQ ID NO: 1368720 - protein, 9 aa, Homo Sapiens
SSLYRREES

SEQ ID NO: 1368721 - protein, 9 aa, Homo Sapiens
NARVADLAH

SEQ ID NO: 1368722 - protein, 9 aa, Homo Sapiens
GLCSAQPAI

SEQ ID NO: 1368723 - protein, 9 aa, Homo Sapiens
QLELYHTAM

SEQ ID NO: 1368724 - protein, 9 aa, Homo Sapiens
LVKCCAYDS

SEQ ID NO: 1368725 - protein, 9 aa, Homo Sapiens
HPKSVQPHK

SEQ ID NO: 1368726 - protein, 9 aa, Homo Sapiens
EKLRCMYRN

SEQ ID NO: 1368727 - protein, 9 aa, Homo Sapiens
FSISAPLHK

SEQ ID NO: 1368728 - protein, 9 aa, Homo Sapiens
AFTYQSGSG

SEQ ID NO: 1368729 - protein, 9 aa, Homo Sapiens
GKRNRNEDD

SEQ ID NO: 1368730 - protein, 9 aa, Homo Sapiens
DFGVRRNGE

SEQ ID NO: 1368731 - protein, 9 aa, Homo Sapiens
KEVVVFEAV

SEQ ID NO: 1368732 - protein, 9 aa, Homo Sapiens
LGEAMAPAH

SEQ ID NO: 1368733 - protein, 9 aa, Homo Sapiens
TQKREMEHW

SEQ ID NO: 1368734 - protein, 9 aa, Homo Sapiens
GDTGRPHGD

SEQ ID NO: 1368735 - protein, 9 aa, Homo Sapiens
LKNQIGRTV

SEQ ID NO: 1368736 - protein, 9 aa, Homo Sapiens
VDAIVSRDT

SEQ ID NO: 1368737 - protein, 9 aa, Homo Sapiens
KQAVRRLNE

SEQ ID NO: 1368738 - protein, 9 aa, Homo Sapiens
PTTPVQAWL

SEQ ID NO: 1368739 - protein, 9 aa, Homo Sapiens
RTFEHFCDV

SEQ ID NO: 1368740 - protein, 9 aa, Homo Sapiens
GYDILGSII

SEQ ID NO: 1368741 - protein, 9 aa, Homo Sapiens
MEEQRQEEE

SEQ ID NO: 1368742 - protein, 9 aa, Homo Sapiens
PSHYRVLWD

SEQ ID NO: 1368743 - protein, 9 aa, Homo Sapiens
ELLEVFDLC

SEQ ID NO: 1368744 - protein, 9 aa, Homo Sapiens
ATSDNLQVW

SEQ ID NO: 1368745 - protein, 9 aa, Homo Sapiens
GAEEGAAAL

SEQ ID NO: 1368746 - protein, 9 aa, Homo Sapiens
LRMVLLCEA

SEQ ID NO: 1368747 - protein, 9 aa, Homo Sapiens
RKKVVEEEQ

SEQ ID NO: 1368748 - protein, 9 aa, Homo Sapiens
ENMDQIRNW

SEQ ID NO: 1368749 - protein, 9 aa, Homo Sapiens
ANMDNDSGG

SEQ ID NO: 1368750 - protein, 9 aa, Homo Sapiens
VACSLISVN

SEQ ID NO: 1368751 - protein, 9 aa, Homo Sapiens
RGHLHAHPP

SEQ ID NO: 1368752 - protein, 9 aa, Homo Sapiens
PAERGRGLR

SEQ ID NO: 1368753 - protein, 9 aa, Homo Sapiens
EQQAERGEP

SEQ ID NO: 1368754 - protein, 9 aa, Homo Sapiens
VYSSLTTHR

SEQ ID NO: 1368755 - protein, 9 aa, Homo Sapiens
VRGGQDQFS

SEQ ID NO: 1368756 - protein, 9 aa, Homo Sapiens
VPDSIADTL

SEQ ID NO: 1368757 - protein, 9 aa, Homo Sapiens
LKAHLHWHS

SEQ ID NO: 1368758 - protein, 9 aa, Homo Sapiens
PLTFTDSAP

SEQ ID NO: 1368759 - protein, 9 aa, Homo Sapiens
LPGHCSDYC

SEQ ID NO: 1368760 - protein, 9 aa, Homo Sapiens
TFVDSLSIH

SEQ ID NO: 1368761 - protein, 9 aa, Homo Sapiens
KSEGTGVAL

SEQ ID NO: 1368762 - protein, 9 aa, Homo Sapiens
QPPSPLPPQ

SEQ ID NO: 1368763 - protein, 9 aa, Homo Sapiens
DTPKVSSLA

SEQ ID NO: 1368764 - protein, 9 aa, Homo Sapiens
IMPAQTAAW

SEQ ID NO: 1368765 - protein, 9 aa, Homo Sapiens
GINHKNLIM

SEQ ID NO: 1368766 - protein, 9 aa, Homo Sapiens
SSGRGSGGK

SEQ ID NO: 1368767 - protein, 9 aa, Homo Sapiens
GAIHIGGRI

SEQ ID NO: 1368768 - protein, 9 aa, Homo Sapiens
AAPAMAEVS

SEQ ID NO: 1368769 - protein, 9 aa, Homo Sapiens
KVEDSGHYC

SEQ ID NO: 1368770 - protein, 9 aa, Homo Sapiens
SRNGVSPCW

SEQ ID NO: 1368771 - protein, 9 aa, Homo Sapiens
INHKNLIMD

SEQ ID NO: 1368772 - protein, 9 aa, Homo Sapiens
RAPAPQGPR

SEQ ID NO: 1368773 - protein, 9 aa, Homo Sapiens
STATKKVFR

SEQ ID NO: 1368774 - protein, 9 aa, Homo Sapiens
TESELRTSH

SEQ ID NO: 1368775 - protein, 9 aa, Homo Sapiens
QRKRQKQKV

SEQ ID NO: 1368776 - protein, 9 aa, Homo Sapiens
NYIRTQESA

SEQ ID NO: 1368777 - protein, 9 aa, Homo Sapiens
TACFEKTHH

SEQ ID NO: 1368778 - protein, 9 aa, Homo Sapiens
AYKYMVKLK

SEQ ID NO: 1368779 - protein, 9 aa, Homo Sapiens
TPGLGSKGK

SEQ ID NO: 1368780 - protein, 9 aa, Homo Sapiens
ILWVQAAMG

SEQ ID NO: 1368781 - protein, 9 aa, Homo Sapiens
LGVTGRIVD

SEQ ID NO: 1368782 - protein, 9 aa, Homo Sapiens
CTKALCCAA

SEQ ID NO: 1368783 - protein, 9 aa, Homo Sapiens
QFYAGMVIG

SEQ ID NO: 1368784 - protein, 9 aa, Homo Sapiens
ASTPARSFL

SEQ ID NO: 1368785 - protein, 9 aa, Homo Sapiens
CTTSNFLGT

SEQ ID NO: 1368786 - protein, 9 aa, Homo Sapiens
GSVIRQVLE

SEQ ID NO: 1368787 - protein, 9 aa, Homo Sapiens
VTKVLNFTT

SEQ ID NO: 1368788 - protein, 9 aa, Homo Sapiens
SHMASIKAE

SEQ ID NO: 1368789 - protein, 9 aa, Homo Sapiens
SCKPVCCKS

SEQ ID NO: 1368790 - protein, 9 aa, Homo Sapiens
CEAMFDRTT

SEQ ID NO: 1368791 - protein, 9 aa, Homo Sapiens
GLSWAPLVS

SEQ ID NO: 1368792 - protein, 9 aa, Homo Sapiens
LIDVVPRDE

SEQ ID NO: 1368793 - protein, 9 aa, Homo Sapiens
SVLSPRRLR

SEQ ID NO: 1368794 - protein, 9 aa, Homo Sapiens
APQATMQAR

SEQ ID NO: 1368795 - protein, 9 aa, Homo Sapiens
TTLSWGSPT

SEQ ID NO: 1368796 - protein, 9 aa, Homo Sapiens
WPVAVTLLD

SEQ ID NO: 1368797 - protein, 9 aa, Homo Sapiens
VDPSPQDQH

SEQ ID NO: 1368798 - protein, 9 aa, Homo Sapiens
VGDGFSCGG

SEQ ID NO: 1368799 - protein, 9 aa, Homo Sapiens
SLQEASSGA

SEQ ID NO: 1368800 - protein, 9 aa, Homo Sapiens
ETAHPPLPP

SEQ ID NO: 1368801 - protein, 9 aa, Homo Sapiens
TRRSQQPQP

SEQ ID NO: 1368802 - protein, 9 aa, Homo Sapiens
TTRRAVLVS

SEQ ID NO: 1368803 - protein, 9 aa, Homo Sapiens
KEPFLLVRY

SEQ ID NO: 1368804 - protein, 9 aa, Homo Sapiens
ADQLMFTLH

SEQ ID NO: 1368805 - protein, 9 aa, Homo Sapiens
AGPSCFSTG

SEQ ID NO: 1368806 - protein, 9 aa, Homo Sapiens
PHRGTPSLI

SEQ ID NO: 1368807 - protein, 9 aa, Homo Sapiens
VVVNFITFF

SEQ ID NO: 1368808 - protein, 9 aa, Homo Sapiens
DGYVLPKHR

SEQ ID NO: 1368809 - protein, 9 aa, Homo Sapiens
DSEGNYILT

SEQ ID NO: 1368810 - protein, 9 aa, Homo Sapiens
AAAPGPLLR

SEQ ID NO: 1368811 - protein, 9 aa, Homo Sapiens
DQPPQFLLH

SEQ ID NO: 1368812 - protein, 9 aa, Homo Sapiens
HNVSVWREV

SEQ ID NO: 1368813 - protein, 9 aa, Homo Sapiens
SLTTHRVIH

SEQ ID NO: 1368814 - protein, 9 aa, Homo Sapiens
RPVATLSPG

SEQ ID NO: 1368815 - protein, 9 aa, Homo Sapiens
CLLWDVPAH

SEQ ID NO: 1368816 - protein, 9 aa, Homo Sapiens
FEDLTTRRC

SEQ ID NO: 1368817 - protein, 9 aa, Homo Sapiens
ETTCTVLRN

SEQ ID NO: 1368818 - protein, 9 aa, Homo Sapiens
IHTGQKPHK

SEQ ID NO: 1368819 - protein, 9 aa, Homo Sapiens
TTRRCDFQG

SEQ ID NO: 1368820 - protein, 9 aa, Homo Sapiens
NNPNMSDPE

SEQ ID NO: 1368821 - protein, 9 aa, Homo Sapiens
SWWRKLFGP

SEQ ID NO: 1368822 - protein, 9 aa, Homo Sapiens
LRPLSHRTI

SEQ ID NO: 1368823 - protein, 9 aa, Homo Sapiens
MQKQRVAAW

SEQ ID NO: 1368824 - protein, 9 aa, Homo Sapiens
NSPDWGGAV

SEQ ID NO: 1368825 - protein, 9 aa, Homo Sapiens
LAYKKAIMV

SEQ ID NO: 1368826 - protein, 9 aa, Homo Sapiens
VIGHGSKWT

SEQ ID NO: 1368827 - protein, 9 aa, Homo Sapiens
ILEWLKLTP

SEQ ID NO: 1368828 - protein, 9 aa, Homo Sapiens
WPSAVVLDL

SEQ ID NO: 1368829 - protein, 9 aa, Homo Sapiens
YFRLTADVH

SEQ ID NO: 1368830 - protein, 9 aa, Homo Sapiens
LPQRIDRLS

SEQ ID NO: 1368831 - protein, 9 aa, Homo Sapiens
FLLVRYSAK

SEQ ID NO: 1368832 - protein, 9 aa, Homo Sapiens
QHEIETDPA

SEQ ID NO: 1368833 - protein, 9 aa, Homo Sapiens
IAAKMMSAV

SEQ ID NO: 1368834 - protein, 9 aa, Homo Sapiens
VAVMNEHHE

SEQ ID NO: 1368835 - protein, 9 aa, Homo Sapiens
QTTVPDGEP

SEQ ID NO: 1368836 - protein, 9 aa, Homo Sapiens
IACYGGQLA

SEQ ID NO: 1368837 - protein, 9 aa, Homo Sapiens
ELRTSHEAR

SEQ ID NO: 1368838 - protein, 9 aa, Homo Sapiens
SYRDCQAAG

SEQ ID NO: 1368839 - protein, 9 aa, Homo Sapiens
STEMTPYYI

SEQ ID NO: 1368840 - protein, 9 aa, Homo Sapiens
GTKIILHQK

SEQ ID NO: 1368841 - protein, 9 aa, Homo Sapiens
RRAFTYQSG

SEQ ID NO: 1368842 - protein, 9 aa, Homo Sapiens
KTKLKNYLR

SEQ ID NO: 1368843 - protein, 9 aa, Homo Sapiens
QLSVMYRSQ

SEQ ID NO: 1368844 - protein, 9 aa, Homo Sapiens
IYVGPVAIL

SEQ ID NO: 1368845 - protein, 9 aa, Homo Sapiens
RLLRERKSS

SEQ ID NO: 1368846 - protein, 9 aa, Homo Sapiens
GLQRTSQAF

SEQ ID NO: 1368847 - protein, 9 aa, Homo Sapiens
VCLLVLDAN

SEQ ID NO: 1368848 - protein, 9 aa, Homo Sapiens
QGLKWQHHE

SEQ ID NO: 1368849 - protein, 9 aa, Homo Sapiens
HMLDIFHEV

SEQ ID NO: 1368850 - protein, 9 aa, Homo Sapiens
ALKSVFPPD

SEQ ID NO: 1368851 - protein, 9 aa, Homo Sapiens
VPAKSMLKD

SEQ ID NO: 1368852 - protein, 9 aa, Homo Sapiens
VGLSGPLVL

SEQ ID NO: 1368853 - protein, 9 aa, Homo Sapiens
SPQPALRGH

SEQ ID NO: 1368854 - protein, 9 aa, Homo Sapiens
QQGQAGMAP

SEQ ID NO: 1368855 - protein, 9 aa, Homo Sapiens
QVAVECDGC

SEQ ID NO: 1368856 - protein, 9 aa, Homo Sapiens
ANDLESTSK

SEQ ID NO: 1368857 - protein, 9 aa, Homo Sapiens
PVEEQDAHP

SEQ ID NO: 1368858 - protein, 9 aa, Homo Sapiens
LTEDNPNLL

SEQ ID NO: 1368859 - protein, 9 aa, Homo Sapiens
DEALLTIFH

SEQ ID NO: 1368860 - protein, 9 aa, Homo Sapiens
VLRHQVHLI

SEQ ID NO: 1368861 - protein, 9 aa, Homo Sapiens
KDIHQEYRE

SEQ ID NO: 1368862 - protein, 9 aa, Homo Sapiens
IQHWLTESG

SEQ ID NO: 1368863 - protein, 9 aa, Homo Sapiens
WVQAAMGSA

SEQ ID NO: 1368864 - protein, 9 aa, Homo Sapiens
GAAGGVDDE

SEQ ID NO: 1368865 - protein, 9 aa, Homo Sapiens
VVTSFAPRR

SEQ ID NO: 1368866 - protein, 9 aa, Homo Sapiens
KRSLAPLKE

SEQ ID NO: 1368867 - protein, 9 aa, Homo Sapiens
VIFIIFRII

SEQ ID NO: 1368868 - protein, 9 aa, Homo Sapiens
AKMTPEDHE

SEQ ID NO: 1368869 - protein, 9 aa, Homo Sapiens
HAGARQVGS

SEQ ID NO: 1368870 - protein, 9 aa, Homo Sapiens
PIPPGSQKA

SEQ ID NO: 1368871 - protein, 9 aa, Homo Sapiens
RGLPFPRVD

SEQ ID NO: 1368872 - protein, 9 aa, Homo Sapiens
LGAYRTNAS

SEQ ID NO: 1368873 - protein, 9 aa, Homo Sapiens
KMSLQEREA

SEQ ID NO: 1368874 - protein, 9 aa, Homo Sapiens
LIYLRWMTP

SEQ ID NO: 1368875 - protein, 9 aa, Homo Sapiens
VTIPNGDIY

SEQ ID NO: 1368876 - protein, 9 aa, Homo Sapiens
MPQSFFFFF

SEQ ID NO: 1368877 - protein, 9 aa, Homo Sapiens
SLSSGRNIA

SEQ ID NO: 1368878 - protein, 9 aa, Homo Sapiens
YTVAHLLQR

SEQ ID NO: 1368879 - protein, 9 aa, Homo Sapiens
IIVMLTLSN

SEQ ID NO: 1368880 - protein, 9 aa, Homo Sapiens
GRCLVALGH

SEQ ID NO: 1368881 - protein, 9 aa, Homo Sapiens
QLPSIPVSQ

SEQ ID NO: 1368882 - protein, 9 aa, Homo Sapiens
EVEEEEEVV

SEQ ID NO: 1368883 - protein, 9 aa, Homo Sapiens
LAQLRVHMA

SEQ ID NO: 1368884 - protein, 9 aa, Homo Sapiens
IEDHWSYSS

SEQ ID NO: 1368885 - protein, 9 aa, Homo Sapiens
QLHQLHSDS

SEQ ID NO: 1368886 - protein, 9 aa, Homo Sapiens
RGDRYDDCR

SEQ ID NO: 1368887 - protein, 9 aa, Homo Sapiens
PPRPANFFC

SEQ ID NO: 1368888 - protein, 9 aa, Homo Sapiens
TVPKYRIQS

SEQ ID NO: 1368889 - protein, 9 aa, Homo Sapiens
RTTKATQKR

SEQ ID NO: 1368890 - protein, 9 aa, Homo Sapiens
RHHKQPETS

SEQ ID NO: 1368891 - protein, 9 aa, Homo Sapiens
TQSSGSQQA

SEQ ID NO: 1368892 - protein, 9 aa, Homo Sapiens
FPSKDQPLL

SEQ ID NO: 1368893 - protein, 9 aa, Homo Sapiens
HPFFNDLED

SEQ ID NO: 1368894 - protein, 9 aa, Homo Sapiens
RPYRAWCHE

SEQ ID NO: 1368895 - protein, 9 aa, Homo Sapiens
FDPHRGTPS

SEQ ID NO: 1368896 - protein, 9 aa, Homo Sapiens
AKMMSAVAI

SEQ ID NO: 1368897 - protein, 9 aa, Homo Sapiens
YSIQDLFAR

SEQ ID NO: 1368898 - protein, 9 aa, Homo Sapiens
IQASVSRWL

SEQ ID NO: 1368899 - protein, 9 aa, Homo Sapiens
NLSEARYKD

SEQ ID NO: 1368900 - protein, 9 aa, Homo Sapiens
QSPICAVCR

SEQ ID NO: 1368901 - protein, 9 aa, Homo Sapiens
SSTRHHKQP

SEQ ID NO: 1368902 - protein, 9 aa, Homo Sapiens
ATHFQQLGP

SEQ ID NO: 1368903 - protein, 9 aa, Homo Sapiens
DSVVMDPKK

SEQ ID NO: 1368904 - protein, 9 aa, Homo Sapiens
LQIPTNRVK

SEQ ID NO: 1368905 - protein, 9 aa, Homo Sapiens
LTMCFLSLP

SEQ ID NO: 1368906 - protein, 9 aa, Homo Sapiens
LESSWSGDS

SEQ ID NO: 1368907 - protein, 9 aa, Homo Sapiens
GMETTCTVL

SEQ ID NO: 1368908 - protein, 9 aa, Homo Sapiens
CNDNQREVC

SEQ ID NO: 1368909 - protein, 9 aa, Homo Sapiens
YRRRSQRCP

SEQ ID NO: 1368910 - protein, 9 aa, Homo Sapiens
KIRKSELIA

SEQ ID NO: 1368911 - protein, 9 aa, Homo Sapiens
LRVKPLKEV

SEQ ID NO: 1368912 - protein, 9 aa, Homo Sapiens
LDCINGSEE

SEQ ID NO: 1368913 - protein, 9 aa, Homo Sapiens
DSAPTVSGV

SEQ ID NO: 1368914 - protein, 9 aa, Homo Sapiens
HALYISVLR

SEQ ID NO: 1368915 - protein, 9 aa, Homo Sapiens
AAAQKVVAS

SEQ ID NO: 1368916 - protein, 9 aa, Homo Sapiens
TANYTDSQR

SEQ ID NO: 1368917 - protein, 9 aa, Homo Sapiens
PLDSGSPEG

SEQ ID NO: 1368918 - protein, 9 aa, Homo Sapiens
DEGGEPAGQ

SEQ ID NO: 1368919 - protein, 9 aa, Homo Sapiens
CTPSRAAFP

SEQ ID NO: 1368920 - protein, 9 aa, Homo Sapiens
MEIKKSLRH

SEQ ID NO: 1368921 - protein, 9 aa, Homo Sapiens
SKKKFKDPN

SEQ ID NO: 1368922 - protein, 9 aa, Homo Sapiens
MQLHPVQGT

SEQ ID NO: 1368923 - protein, 9 aa, Homo Sapiens
WHHMRGETT

SEQ ID NO: 1368924 - protein, 9 aa, Homo Sapiens
GTPRLCQTD

SEQ ID NO: 1368925 - protein, 9 aa, Homo Sapiens
TTARQPSRW

SEQ ID NO: 1368926 - protein, 9 aa, Homo Sapiens
FAAVPAFSH

SEQ ID NO: 1368927 - protein, 9 aa, Homo Sapiens
AVVKFFLLE

SEQ ID NO: 1368928 - protein, 9 aa, Homo Sapiens
CGKSLKKRS

SEQ ID NO: 1368929 - protein, 9 aa, Homo Sapiens
QNQNQLSVM

SEQ ID NO: 1368930 - protein, 9 aa, Homo Sapiens
AHTLAVYVY

SEQ ID NO: 1368931 - protein, 9 aa, Homo Sapiens
AGTLVAVVL

SEQ ID NO: 1368932 - protein, 9 aa, Homo Sapiens
PCWSLAGLV

SEQ ID NO: 1368933 - protein, 9 aa, Homo Sapiens
LFNGGVTLR

SEQ ID NO: 1368934 - protein, 9 aa, Homo Sapiens
VRQWVITLA

SEQ ID NO: 1368935 - protein, 9 aa, Homo Sapiens
LLVRYSAKG

SEQ ID NO: 1368936 - protein, 9 aa, Homo Sapiens
KEVLDSQCL

SEQ ID NO: 1368937 - protein, 9 aa, Homo Sapiens
QANKIRKSE

SEQ ID NO: 1368938 - protein, 9 aa, Homo Sapiens
TIQRWYRQQ

SEQ ID NO: 1368939 - protein, 9 aa, Homo Sapiens
NVCHAKGKQ

SEQ ID NO: 1368940 - protein, 9 aa, Homo Sapiens
IRGRCLVAL

SEQ ID NO: 1368941 - protein, 9 aa, Homo Sapiens
SKWTLSRFF

SEQ ID NO: 1368942 - protein, 9 aa, Homo Sapiens
EVKRMETCQ

SEQ ID NO: 1368943 - protein, 9 aa, Homo Sapiens
SLPTCKGLF

SEQ ID NO: 1368944 - protein, 9 aa, Homo Sapiens
AYFRFDMND

SEQ ID NO: 1368945 - protein, 9 aa, Homo Sapiens
YVAIQAALS

SEQ ID NO: 1368946 - protein, 9 aa, Homo Sapiens
LRKDIHQEY

SEQ ID NO: 1368947 - protein, 9 aa, Homo Sapiens
CSGLRLQDV

SEQ ID NO: 1368948 - protein, 9 aa, Homo Sapiens
LLLLIVLCA

SEQ ID NO: 1368949 - protein, 9 aa, Homo Sapiens
KSVVISTKD

SEQ ID NO: 1368950 - protein, 9 aa, Homo Sapiens
PVPRVQGFL

SEQ ID NO: 1368951 - protein, 9 aa, Homo Sapiens
SRLHDLYDK

SEQ ID NO: 1368952 - protein, 9 aa, Homo Sapiens
CLHRRRAFT

SEQ ID NO: 1368953 - protein, 9 aa, Homo Sapiens
CGYSEVYLD

SEQ ID NO: 1368954 - protein, 9 aa, Homo Sapiens
EEVSGHQAD

SEQ ID NO: 1368955 - protein, 9 aa, Homo Sapiens
VKALDEILQ

SEQ ID NO: 1368956 - protein, 9 aa, Homo Sapiens
QMPQYSSPS

SEQ ID NO: 1368957 - protein, 9 aa, Homo Sapiens
NAANTVLRQ

SEQ ID NO: 1368958 - protein, 9 aa, Homo Sapiens
VSEDLNDKK

SEQ ID NO: 1368959 - protein, 9 aa, Homo Sapiens
ACLPAQTTV

SEQ ID NO: 1368960 - protein, 9 aa, Homo Sapiens
DRLRFTHPQ

SEQ ID NO: 1368961 - protein, 9 aa, Homo Sapiens
LQHEIETDP

SEQ ID NO: 1368962 - protein, 9 aa, Homo Sapiens
LFNQLAPEN

SEQ ID NO: 1368963 - protein, 9 aa, Homo Sapiens
PQALPEKGL

SEQ ID NO: 1368964 - protein, 9 aa, Homo Sapiens
DLGPACTVD

SEQ ID NO: 1368965 - protein, 9 aa, Homo Sapiens
PGAPEPSFL

SEQ ID NO: 1368966 - protein, 9 aa, Homo Sapiens
GAARARPAL

SEQ ID NO: 1368967 - protein, 9 aa, Homo Sapiens
NYNLLRCIC

SEQ ID NO: 1368968 - protein, 9 aa, Homo Sapiens
TSFFWTYGS

SEQ ID NO: 1368969 - protein, 9 aa, Homo Sapiens
IDKACSEGL

SEQ ID NO: 1368970 - protein, 9 aa, Homo Sapiens
SSSVSGDFG

SEQ ID NO: 1368971 - protein, 9 aa, Homo Sapiens
VLESIERDG

SEQ ID NO: 1368972 - protein, 9 aa, Homo Sapiens
GTKYTSSKL

SEQ ID NO: 1368973 - protein, 9 aa, Homo Sapiens
AFAELCRKQ

SEQ ID NO: 1368974 - protein, 9 aa, Homo Sapiens
SPEMKVYMD

SEQ ID NO: 1368975 - protein, 9 aa, Homo Sapiens
DSLGTSCET

SEQ ID NO: 1368976 - protein, 9 aa, Homo Sapiens
FEYQTLPEE

SEQ ID NO: 1368977 - protein, 9 aa, Homo Sapiens
GPAGWARQA

SEQ ID NO: 1368978 - protein, 9 aa, Homo Sapiens
AATAIMCGL

SEQ ID NO: 1368979 - protein, 9 aa, Homo Sapiens
QTLQQCRVE

SEQ ID NO: 1368980 - protein, 9 aa, Homo Sapiens
PHPSMRVGA

SEQ ID NO: 1368981 - protein, 9 aa, Homo Sapiens
KLQRQAQTQ

SEQ ID NO: 1368982 - protein, 9 aa, Homo Sapiens
VRAPQTPPQ

SEQ ID NO: 1368983 - protein, 9 aa, Homo Sapiens
RKDIHQEYR

SEQ ID NO: 1368984 - protein, 9 aa, Homo Sapiens
AKDDAGQEA

SEQ ID NO: 1368985 - protein, 9 aa, Homo Sapiens
SNSNSNSNS

SEQ ID NO: 1368986 - protein, 9 aa, Homo Sapiens
HNRCSKDWP

SEQ ID NO: 1368987 - protein, 9 aa, Homo Sapiens
PQLLQRGAR

SEQ ID NO: 1368988 - protein, 9 aa, Homo Sapiens
PGQAVSLFA

SEQ ID NO: 1368989 - protein, 9 aa, Homo Sapiens
SQAFAEQPR

SEQ ID NO: 1368990 - protein, 9 aa, Homo Sapiens
EEEEVVVEE

SEQ ID NO: 1368991 - protein, 9 aa, Homo Sapiens
TEAGVEVTV

SEQ ID NO: 1368992 - protein, 9 aa, Homo Sapiens
ETSPTEGLA

SEQ ID NO: 1368993 - protein, 9 aa, Homo Sapiens
QVKPQMALE

SEQ ID NO: 1368994 - protein, 9 aa, Homo Sapiens
AEVSIQVNV

SEQ ID NO: 1368995 - protein, 9 aa, Homo Sapiens
GNFLEDGES

SEQ ID NO: 1368996 - protein, 9 aa, Homo Sapiens
APQGPRTRA

SEQ ID NO: 1368997 - protein, 9 aa, Homo Sapiens
TPRDLGTVA

SEQ ID NO: 1368998 - protein, 9 aa, Homo Sapiens
QDKLQGQDW

SEQ ID NO: 1368999 - protein, 9 aa, Homo Sapiens
IHRAHRESK

SEQ ID NO: 1369000 - protein, 9 aa, Homo Sapiens
ATPIKRRHV

SEQ ID NO: 1369001 - protein, 9 aa, Homo Sapiens
RQKMELDEA

SEQ ID NO: 1369002 - protein, 9 aa, Homo Sapiens
EKKSSGALE

SEQ ID NO: 1369003 - protein, 9 aa, Homo Sapiens
SDRLKEASG

SEQ ID NO: 1369004 - protein, 9 aa, Homo Sapiens
RRKHPPVES

SEQ ID NO: 1369005 - protein, 9 aa, Homo Sapiens
FGDWIDSVL

SEQ ID NO: 1369006 - protein, 9 aa, Homo Sapiens
LAEYWATLQ

SEQ ID NO: 1369007 - protein, 9 aa, Homo Sapiens
LCKYGSVTV

SEQ ID NO: 1369008 - protein, 9 aa, Homo Sapiens
GTAATGRAA

SEQ ID NO: 1369009 - protein, 9 aa, Homo Sapiens
SHSNFEIVN

SEQ ID NO: 1369010 - protein, 9 aa, Homo Sapiens
VHITLHDEE

SEQ ID NO: 1369011 - protein, 9 aa, Homo Sapiens
CSRECAGGC

SEQ ID NO: 1369012 - protein, 9 aa, Homo Sapiens
IIAVEGLRK

SEQ ID NO: 1369013 - protein, 9 aa, Homo Sapiens
GVSHRARPF

SEQ ID NO: 1369014 - protein, 9 aa, Homo Sapiens
AAQLVRSLV

SEQ ID NO: 1369015 - protein, 9 aa, Homo Sapiens
EKGFSWRSN

SEQ ID NO: 1369016 - protein, 9 aa, Homo Sapiens
GLAFIAHPK

SEQ ID NO: 1369017 - protein, 9 aa, Homo Sapiens
DKQTGFQRA

SEQ ID NO: 1369018 - protein, 9 aa, Homo Sapiens
HLCPFLHFI

SEQ ID NO: 1369019 - protein, 9 aa, Homo Sapiens
HGPLVLQLI

SEQ ID NO: 1369020 - protein, 9 aa, Homo Sapiens
LGRVMCSMA

SEQ ID NO: 1369021 - protein, 9 aa, Homo Sapiens
HLSLPQMQY

SEQ ID NO: 1369022 - protein, 9 aa, Homo Sapiens
LKKAVVHYD

SEQ ID NO: 1369023 - protein, 9 aa, Homo Sapiens
PSPSHSPPT

SEQ ID NO: 1369024 - protein, 9 aa, Homo Sapiens
ERWEPQPGR

SEQ ID NO: 1369025 - protein, 9 aa, Homo Sapiens
GSPLMSEFR

SEQ ID NO: 1369026 - protein, 9 aa, Homo Sapiens
NSKEDERQW

SEQ ID NO: 1369027 - protein, 9 aa, Homo Sapiens
DVLRDGGIM

SEQ ID NO: 1369028 - protein, 9 aa, Homo Sapiens
DGAAALPHH

SEQ ID NO: 1369029 - protein, 9 aa, Homo Sapiens
NDQKDQLSP

SEQ ID NO: 1369030 - protein, 9 aa, Homo Sapiens
VAIAALEVV

SEQ ID NO: 1369031 - protein, 9 aa, Homo Sapiens
PGDDDVKKP

SEQ ID NO: 1369032 - protein, 9 aa, Homo Sapiens
LGRLLAPGR

SEQ ID NO: 1369033 - protein, 9 aa, Homo Sapiens
PRAGLEKNH

SEQ ID NO: 1369034 - protein, 9 aa, Homo Sapiens
GVKSRQCKC

SEQ ID NO: 1369035 - protein, 9 aa, Homo Sapiens
EAMFDRTTR

SEQ ID NO: 1369036 - protein, 9 aa, Homo Sapiens
FPRVDPSPQ

SEQ ID NO: 1369037 - protein, 9 aa, Homo Sapiens
WQHSPVPCH

SEQ ID NO: 1369038 - protein, 9 aa, Homo Sapiens
STTCIQLHQ

SEQ ID NO: 1369039 - protein, 9 aa, Homo Sapiens
KNSTSFFWT

SEQ ID NO: 1369040 - protein, 9 aa, Homo Sapiens
GKGAGNEGT

SEQ ID NO: 1369041 - protein, 9 aa, Homo Sapiens
KSGNPPSKR

SEQ ID NO: 1369042 - protein, 9 aa, Homo Sapiens
GLSGPLVLE

SEQ ID NO: 1369043 - protein, 9 aa, Homo Sapiens
RAEGGAPHE

SEQ ID NO: 1369044 - protein, 9 aa, Homo Sapiens
ECLYSQDGS

SEQ ID NO: 1369045 - protein, 9 aa, Homo Sapiens
INPGLLVNV

SEQ ID NO: 1369046 - protein, 9 aa, Homo Sapiens
PLPTRFKRF

SEQ ID NO: 1369047 - protein, 9 aa, Homo Sapiens
TWGPRTPRG

SEQ ID NO: 1369048 - protein, 9 aa, Homo Sapiens
VLGEQLSTE

SEQ ID NO: 1369049 - protein, 9 aa, Homo Sapiens
SRCIPAYHP

SEQ ID NO: 1369050 - protein, 9 aa, Homo Sapiens
LKKTVGESA

SEQ ID NO: 1369051 - protein, 9 aa, Homo Sapiens
SCLGISVLA

SEQ ID NO: 1369052 - protein, 9 aa, Homo Sapiens
DRQGGLKYS

SEQ ID NO: 1369053 - protein, 9 aa, Homo Sapiens
TAQKSQRKR

SEQ ID NO: 1369054 - protein, 9 aa, Homo Sapiens
INNQIIVNT

SEQ ID NO: 1369055 - protein, 9 aa, Homo Sapiens
WTMSTITMS

SEQ ID NO: 1369056 - protein, 9 aa, Homo Sapiens
NDVGLKSNG

SEQ ID NO: 1369057 - protein, 9 aa, Homo Sapiens
AGTKYTSSK

SEQ ID NO: 1369058 - protein, 9 aa, Homo Sapiens
SRNLLLIGK

SEQ ID NO: 1369059 - protein, 9 aa, Homo Sapiens
TSTEMGARG

SEQ ID NO: 1369060 - protein, 9 aa, Homo Sapiens
ALAISEILF

SEQ ID NO: 1369061 - protein, 9 aa, Homo Sapiens
RPSHYRVLW

SEQ ID NO: 1369062 - protein, 9 aa, Homo Sapiens
LESSKENLQ

SEQ ID NO: 1369063 - protein, 9 aa, Homo Sapiens
ALPFPHAAI

SEQ ID NO: 1369064 - protein, 9 aa, Homo Sapiens
ERGEEYLGA

SEQ ID NO: 1369065 - protein, 9 aa, Homo Sapiens
PVGPPSSPS

SEQ ID NO: 1369066 - protein, 9 aa, Homo Sapiens
LGTVAGATA

SEQ ID NO: 1369067 - protein, 9 aa, Homo Sapiens
RGVPIGGRF

SEQ ID NO: 1369068 - protein, 9 aa, Homo Sapiens
YKCEECEKG

SEQ ID NO: 1369069 - protein, 9 aa, Homo Sapiens
QVQGGLFLD

SEQ ID NO: 1369070 - protein, 9 aa, Homo Sapiens
HQHATQKEV

SEQ ID NO: 1369071 - protein, 9 aa, Homo Sapiens
SAPTTVTHR

SEQ ID NO: 1369072 - protein, 9 aa, Homo Sapiens
QFIEKKIQR

SEQ ID NO: 1369073 - protein, 9 aa, Homo Sapiens
LCQLEVAGK

SEQ ID NO: 1369074 - protein, 9 aa, Homo Sapiens
GSFTNLADH

SEQ ID NO: 1369075 - protein, 9 aa, Homo Sapiens
PNYRLQVSE

SEQ ID NO: 1369076 - protein, 9 aa, Homo Sapiens
TPSAPLDLE

SEQ ID NO: 1369077 - protein, 9 aa, Homo Sapiens
SRQTCPCPS

SEQ ID NO: 1369078 - protein, 9 aa, Homo Sapiens
SSSSNSNSN

SEQ ID NO: 1369079 - protein, 9 aa, Homo Sapiens
RARRHRALS

SEQ ID NO: 1369080 - protein, 9 aa, Homo Sapiens
RARLLGLHV

SEQ ID NO: 1369081 - protein, 9 aa, Homo Sapiens
SQPLPRGFL

SEQ ID NO: 1369082 - protein, 9 aa, Homo Sapiens
LEGKKRFRN

SEQ ID NO: 1369083 - protein, 9 aa, Homo Sapiens
TIACYGGQL

SEQ ID NO: 1369084 - protein, 9 aa, Homo Sapiens
DIRNHVVQR

SEQ ID NO: 1369085 - protein, 9 aa, Homo Sapiens
QNPHLRNEP

SEQ ID NO: 1369086 - protein, 9 aa, Homo Sapiens
TNSAICNKW

SEQ ID NO: 1369087 - protein, 9 aa, Homo Sapiens
VGWHPRVML

SEQ ID NO: 1369088 - protein, 9 aa, Homo Sapiens
HQSLIWSRD

SEQ ID NO: 1369089 - protein, 9 aa, Homo Sapiens
LTFVLGEQL

SEQ ID NO: 1369090 - protein, 9 aa, Homo Sapiens
AELIIQVTP

SEQ ID NO: 1369091 - protein, 9 aa, Homo Sapiens
WEPWLPAKA

SEQ ID NO: 1369092 - protein, 9 aa, Homo Sapiens
KVFGVDLAL

SEQ ID NO: 1369093 - protein, 9 aa, Homo Sapiens
QSFFFFFFF

SEQ ID NO: 1369094 - protein, 9 aa, Homo Sapiens
KHILVSLIL

SEQ ID NO: 1369095 - protein, 9 aa, Homo Sapiens
RMAPAIVTL

SEQ ID NO: 1369096 - protein, 9 aa, Homo Sapiens
RSQQPQPHR

SEQ ID NO: 1369097 - protein, 9 aa, Homo Sapiens
LRCTHLAAM

SEQ ID NO: 1369098 - protein, 9 aa, Homo Sapiens
DSEDEIQAP

SEQ ID NO: 1369099 - protein, 9 aa, Homo Sapiens
GSGGPCTCL

SEQ ID NO: 1369100 - protein, 9 aa, Homo Sapiens
QDAPSCSAH

SEQ ID NO: 1369101 - protein, 9 aa, Homo Sapiens
RSVVIQQPP

SEQ ID NO: 1369102 - protein, 9 aa, Homo Sapiens
APSLVTAED

SEQ ID NO: 1369103 - protein, 9 aa, Homo Sapiens
AGVLAASAP

SEQ ID NO: 1369104 - protein, 9 aa, Homo Sapiens
EDLTTRRCD

SEQ ID NO: 1369105 - protein, 9 aa, Homo Sapiens
LAKSTWLNN

SEQ ID NO: 1369106 - protein, 9 aa, Homo Sapiens
CNAVDIKTE

SEQ ID NO: 1369107 - protein, 9 aa, Homo Sapiens
AYDSLGTSC

SEQ ID NO: 1369108 - protein, 9 aa, Homo Sapiens
SVRELQPCF

SEQ ID NO: 1369109 - protein, 9 aa, Homo Sapiens
PVPVAAETA

SEQ ID NO: 1369110 - protein, 9 aa, Homo Sapiens
AKKQRKPKR

SEQ ID NO: 1369111 - protein, 9 aa, Homo Sapiens
STKDTMSTG

SEQ ID NO: 1369112 - protein, 9 aa, Homo Sapiens
CAYDSLGTS

SEQ ID NO: 1369113 - protein, 9 aa, Homo Sapiens
VVRTVHEHF

SEQ ID NO: 1369114 - protein, 9 aa, Homo Sapiens
FRRFSSPRI

SEQ ID NO: 1369115 - protein, 9 aa, Homo Sapiens
YGHQAPQVA

SEQ ID NO: 1369116 - protein, 9 aa, Homo Sapiens
QTGFQRAVK

SEQ ID NO: 1369117 - protein, 9 aa, Homo Sapiens
GSPPPLPAR

SEQ ID NO: 1369118 - protein, 9 aa, Homo Sapiens
VRCSQCQCT

SEQ ID NO: 1369119 - protein, 9 aa, Homo Sapiens
GAYRTNASI

SEQ ID NO: 1369120 - protein, 9 aa, Homo Sapiens
VREEFKEPK

SEQ ID NO: 1369121 - protein, 9 aa, Homo Sapiens
RSIVPTSRG

SEQ ID NO: 1369122 - protein, 9 aa, Homo Sapiens
RDSVFRLSG

SEQ ID NO: 1369123 - protein, 9 aa, Homo Sapiens
PQGLQDSSK

SEQ ID NO: 1369124 - protein, 9 aa, Homo Sapiens
LWGPWNPCQ

SEQ ID NO: 1369125 - protein, 9 aa, Homo Sapiens
HRGRELRFN

SEQ ID NO: 1369126 - protein, 9 aa, Homo Sapiens
EEASVHNPD

SEQ ID NO: 1369127 - protein, 9 aa, Homo Sapiens
GEPAGQHAE

SEQ ID NO: 1369128 - protein, 9 aa, Homo Sapiens
TIYGRTKEL

SEQ ID NO: 1369129 - protein, 9 aa, Homo Sapiens
KNRKNKETI

SEQ ID NO: 1369130 - protein, 9 aa, Homo Sapiens
SILSYFNFL

SEQ ID NO: 1369131 - protein, 9 aa, Homo Sapiens
YKCAICHRG

SEQ ID NO: 1369132 - protein, 9 aa, Homo Sapiens
GFLQIPTNR

SEQ ID NO: 1369133 - protein, 9 aa, Homo Sapiens
AICNKWEIV

SEQ ID NO: 1369134 - protein, 9 aa, Homo Sapiens
NTKEVVVFE

SEQ ID NO: 1369135 - protein, 9 aa, Homo Sapiens
SRNTFAELT

SEQ ID NO: 1369136 - protein, 9 aa, Homo Sapiens
NGERVEHYS

SEQ ID NO: 1369137 - protein, 9 aa, Homo Sapiens
SASSMEQLT

SEQ ID NO: 1369138 - protein, 9 aa, Homo Sapiens
DKCAVDIGG

SEQ ID NO: 1369139 - protein, 9 aa, Homo Sapiens
PAPRRDPPG

SEQ ID NO: 1369140 - protein, 9 aa, Homo Sapiens
RNLDPDDNA

SEQ ID NO: 1369141 - protein, 9 aa, Homo Sapiens
YSLSSGRNI

SEQ ID NO: 1369142 - protein, 9 aa, Homo Sapiens
AVGFIQAEG

SEQ ID NO: 1369143 - protein, 9 aa, Homo Sapiens
SLRDGYVLP

SEQ ID NO: 1369144 - protein, 9 aa, Homo Sapiens
HGRGECGKA

SEQ ID NO: 1369145 - protein, 9 aa, Homo Sapiens
NWQHSPVPC

SEQ ID NO: 1369146 - protein, 9 aa, Homo Sapiens
EKSIQFASR

SEQ ID NO: 1369147 - protein, 9 aa, Homo Sapiens
CTSTEMGAR

SEQ ID NO: 1369148 - protein, 9 aa, Homo Sapiens
SPSPPQQTP

SEQ ID NO: 1369149 - protein, 9 aa, Homo Sapiens
RGHAELETA

SEQ ID NO: 1369150 - protein, 9 aa, Homo Sapiens
EEPHKFYVH

SEQ ID NO: 1369151 - protein, 9 aa, Homo Sapiens
LHALSQFEG

SEQ ID NO: 1369152 - protein, 9 aa, Homo Sapiens
LISFTLLAG

SEQ ID NO: 1369153 - protein, 9 aa, Homo Sapiens
SRLGRVMCS

SEQ ID NO: 1369154 - protein, 9 aa, Homo Sapiens
KYLATSLFP

SEQ ID NO: 1369155 - protein, 9 aa, Homo Sapiens
RESVAEHGS

SEQ ID NO: 1369156 - protein, 9 aa, Homo Sapiens
LVALPFPHA

SEQ ID NO: 1369157 - protein, 9 aa, Homo Sapiens
KMVKSLKKV

SEQ ID NO: 1369158 - protein, 9 aa, Homo Sapiens
GPAEDRCQT

SEQ ID NO: 1369159 - protein, 9 aa, Homo Sapiens
HVSRGDVHV

SEQ ID NO: 1369160 - protein, 9 aa, Homo Sapiens
GWSQSVVGN

SEQ ID NO: 1369161 - protein, 9 aa, Homo Sapiens
CLGKKKKLM

SEQ ID NO: 1369162 - protein, 9 aa, Homo Sapiens
NQWETPQRI

SEQ ID NO: 1369163 - protein, 9 aa, Homo Sapiens
TRPAALGTC

SEQ ID NO: 1369164 - protein, 9 aa, Homo Sapiens
QKVLAPDVL

SEQ ID NO: 1369165 - protein, 9 aa, Homo Sapiens
RGTFLKNQI

SEQ ID NO: 1369166 - protein, 9 aa, Homo Sapiens
KHLLPLWNE

SEQ ID NO: 1369167 - protein, 9 aa, Homo Sapiens
MLSLSIMPA

SEQ ID NO: 1369168 - protein, 9 aa, Homo Sapiens
KKFKTKTKS

SEQ ID NO: 1369169 - protein, 9 aa, Homo Sapiens
QSPIGSVCY

SEQ ID NO: 1369170 - protein, 9 aa, Homo Sapiens
PTSETEHQV

SEQ ID NO: 1369171 - protein, 9 aa, Homo Sapiens
TSSTARPSP

SEQ ID NO: 1369172 - protein, 9 aa, Homo Sapiens
DQHAGARQV

SEQ ID NO: 1369173 - protein, 9 aa, Homo Sapiens
LKWQHHEIT

SEQ ID NO: 1369174 - protein, 9 aa, Homo Sapiens
PKLQRQAQT

SEQ ID NO: 1369175 - protein, 9 aa, Homo Sapiens
DIYLMPTVP

SEQ ID NO: 1369176 - protein, 9 aa, Homo Sapiens
DIDFAADES

SEQ ID NO: 1369177 - protein, 9 aa, Homo Sapiens
ISRESALYL

SEQ ID NO: 1369178 - protein, 9 aa, Homo Sapiens
RHNLSLKEC

SEQ ID NO: 1369179 - protein, 9 aa, Homo Sapiens
LVMEYVVGG

SEQ ID NO: 1369180 - protein, 9 aa, Homo Sapiens
FFASCLIMG

SEQ ID NO: 1369181 - protein, 9 aa, Homo Sapiens
LSGWSQSVV

SEQ ID NO: 1369182 - protein, 9 aa, Homo Sapiens
SGPWGKSFR

SEQ ID NO: 1369183 - protein, 9 aa, Homo Sapiens
IPDRPTGVG

SEQ ID NO: 1369184 - protein, 9 aa, Homo Sapiens
GGTLIWPVA

SEQ ID NO: 1369185 - protein, 9 aa, Homo Sapiens
VIYNSVFMQ

SEQ ID NO: 1369186 - protein, 9 aa, Homo Sapiens
RSPVVSGVS

SEQ ID NO: 1369187 - protein, 9 aa, Homo Sapiens
VHKLPQCLL

SEQ ID NO: 1369188 - protein, 9 aa, Homo Sapiens
KEAADMTCH

SEQ ID NO: 1369189 - protein, 9 aa, Homo Sapiens
RGRGGVAGP

SEQ ID NO: 1369190 - protein, 9 aa, Homo Sapiens
GRADLCHQH

SEQ ID NO: 1369191 - protein, 9 aa, Homo Sapiens
THQQCFSYS

SEQ ID NO: 1369192 - protein, 9 aa, Homo Sapiens
AVVIFIIFR

SEQ ID NO: 1369193 - protein, 9 aa, Homo Sapiens
SVWHRPQGC

SEQ ID NO: 1369194 - protein, 9 aa, Homo Sapiens
GPGMHLFQS

SEQ ID NO: 1369195 - protein, 9 aa, Homo Sapiens
RAPLESVRQ

SEQ ID NO: 1369196 - protein, 9 aa, Homo Sapiens
FKTLSEEER

SEQ ID NO: 1369197 - protein, 9 aa, Homo Sapiens
SCKTWWTMS

SEQ ID NO: 1369198 - protein, 9 aa, Homo Sapiens
GPVAAAPAA

SEQ ID NO: 1369199 - protein, 9 aa, Homo Sapiens
LNLQPRARH

SEQ ID NO: 1369200 - protein, 9 aa, Homo Sapiens
SDCFISYGI

SEQ ID NO: 1369201 - protein, 9 aa, Homo Sapiens
RPRSVVIQQ

SEQ ID NO: 1369202 - protein, 9 aa, Homo Sapiens
KRTSPLLTH

SEQ ID NO: 1369203 - protein, 9 aa, Homo Sapiens
ISILPLQAS

SEQ ID NO: 1369204 - protein, 9 aa, Homo Sapiens
GPPMREVAE

SEQ ID NO: 1369205 - protein, 9 aa, Homo Sapiens
LWNWREMMG

SEQ ID NO: 1369206 - protein, 9 aa, Homo Sapiens
HKVATPGSQ

SEQ ID NO: 1369207 - protein, 9 aa, Homo Sapiens
NTVSVCRAT

SEQ ID NO: 1369208 - protein, 9 aa, Homo Sapiens
PPRVCRRRW

SEQ ID NO: 1369209 - protein, 9 aa, Homo Sapiens
NTSVFLLSH

SEQ ID NO: 1369210 - protein, 9 aa, Homo Sapiens
AIVSRDTSK

SEQ ID NO: 1369211 - protein, 9 aa, Homo Sapiens
LARRTLYQE

SEQ ID NO: 1369212 - protein, 9 aa, Homo Sapiens
IESVENFKD

SEQ ID NO: 1369213 - protein, 9 aa, Homo Sapiens
GELKPLPMV

SEQ ID NO: 1369214 - protein, 9 aa, Homo Sapiens
LSPRRLRND

SEQ ID NO: 1369215 - protein, 9 aa, Homo Sapiens
LLGKAVPVP

SEQ ID NO: 1369216 - protein, 9 aa, Homo Sapiens
VFAKMKGCP

SEQ ID NO: 1369217 - protein, 9 aa, Homo Sapiens
ELRGQEQRS

SEQ ID NO: 1369218 - protein, 9 aa, Homo Sapiens
RLRGHRAAS

SEQ ID NO: 1369219 - protein, 9 aa, Homo Sapiens
LPLGSGGPC

SEQ ID NO: 1369220 - protein, 9 aa, Homo Sapiens
GPGPRQPSV

SEQ ID NO: 1369221 - protein, 9 aa, Homo Sapiens
FKSFSSTPP

SEQ ID NO: 1369222 - protein, 9 aa, Homo Sapiens
DGSGGDIPG

SEQ ID NO: 1369223 - protein, 9 aa, Homo Sapiens
PEAIVDLQM

SEQ ID NO: 1369224 - protein, 9 aa, Homo Sapiens
QSHRPPEAP

SEQ ID NO: 1369225 - protein, 9 aa, Homo Sapiens
TTANYTDSQ

SEQ ID NO: 1369226 - protein, 9 aa, Homo Sapiens
CTDCGYCSA

SEQ ID NO: 1369227 - protein, 9 aa, Homo Sapiens
ITNTKTREN

SEQ ID NO: 1369228 - protein, 9 aa, Homo Sapiens
VPTRGDVHS

SEQ ID NO: 1369229 - protein, 9 aa, Homo Sapiens
PCPPPVTPL

SEQ ID NO: 1369230 - protein, 9 aa, Homo Sapiens
RGGNAPLGT

SEQ ID NO: 1369231 - protein, 9 aa, Homo Sapiens
SNFLLASVG

SEQ ID NO: 1369232 - protein, 9 aa, Homo Sapiens
GRKDLTYSA

SEQ ID NO: 1369233 - protein, 9 aa, Homo Sapiens
AIHIGGRIL

SEQ ID NO: 1369234 - protein, 9 aa, Homo Sapiens
CHQLAASWL

SEQ ID NO: 1369235 - protein, 9 aa, Homo Sapiens
PIFTTPGRT

SEQ ID NO: 1369236 - protein, 9 aa, Homo Sapiens
QLRDREKQM

SEQ ID NO: 1369237 - protein, 9 aa, Homo Sapiens
VHGERLHLL

SEQ ID NO: 1369238 - protein, 9 aa, Homo Sapiens
PHGYPEPFS

SEQ ID NO: 1369239 - protein, 9 aa, Homo Sapiens
RFRNAEVHQ

SEQ ID NO: 1369240 - protein, 9 aa, Homo Sapiens
TARIWNETV

SEQ ID NO: 1369241 - protein, 9 aa, Homo Sapiens
LFSYPSSQF

SEQ ID NO: 1369242 - protein, 9 aa, Homo Sapiens
KDTNDSPPV

SEQ ID NO: 1369243 - protein, 9 aa, Homo Sapiens
RLCNGEMFF

SEQ ID NO: 1369244 - protein, 9 aa, Homo Sapiens
FGVRRNGER

SEQ ID NO: 1369245 - protein, 9 aa, Homo Sapiens
PKARCPRVG

SEQ ID NO: 1369246 - protein, 9 aa, Homo Sapiens
GEEEEDDEE

SEQ ID NO: 1369247 - protein, 9 aa, Homo Sapiens
SAESVGDVY

SEQ ID NO: 1369248 - protein, 9 aa, Homo Sapiens
RERARLLGL

SEQ ID NO: 1369249 - protein, 9 aa, Homo Sapiens
LHFESDGLT

SEQ ID NO: 1369250 - protein, 9 aa, Homo Sapiens
SLPGQPPMH

SEQ ID NO: 1369251 - protein, 9 aa, Homo Sapiens
RGPSGELEQ

SEQ ID NO: 1369252 - protein, 9 aa, Homo Sapiens
VIEFDGGAG

SEQ ID NO: 1369253 - protein, 9 aa, Homo Sapiens
DSVFRLSGP

SEQ ID NO: 1369254 - protein, 9 aa, Homo Sapiens
CLGRLDLQC

SEQ ID NO: 1369255 - protein, 9 aa, Homo Sapiens
AQCLWLVLV

SEQ ID NO: 1369256 - protein, 9 aa, Homo Sapiens
GRAEVSIQV

SEQ ID NO: 1369257 - protein, 9 aa, Homo Sapiens
LDPAASSEK

SEQ ID NO: 1369258 - protein, 9 aa, Homo Sapiens
PKHMETFDQ

SEQ ID NO: 1369259 - protein, 9 aa, Homo Sapiens
GNNNWVPDV

SEQ ID NO: 1369260 - protein, 9 aa, Homo Sapiens
DMSLCVVRY

SEQ ID NO: 1369261 - protein, 9 aa, Homo Sapiens
VQFIWKKTF

SEQ ID NO: 1369262 - protein, 9 aa, Homo Sapiens
DGVKDVTGS

SEQ ID NO: 1369263 - protein, 9 aa, Homo Sapiens
RFLGCAGPS

SEQ ID NO: 1369264 - protein, 9 aa, Homo Sapiens
ARVADLAHI

SEQ ID NO: 1369265 - protein, 9 aa, Homo Sapiens
AQFSLEEKY

SEQ ID NO: 1369266 - protein, 9 aa, Homo Sapiens
ESVENFKDG

SEQ ID NO: 1369267 - protein, 9 aa, Homo Sapiens
QKKPKKQKL

SEQ ID NO: 1369268 - protein, 9 aa, Homo Sapiens
LVHIQKNAD

SEQ ID NO: 1369269 - protein, 9 aa, Homo Sapiens
RNEGREGLI

SEQ ID NO: 1369270 - protein, 9 aa, Homo Sapiens
LTGMSATTT

SEQ ID NO: 1369271 - protein, 9 aa, Homo Sapiens
GFLNGLYIT

SEQ ID NO: 1369272 - protein, 9 aa, Homo Sapiens
FRIIGIMTR

SEQ ID NO: 1369273 - protein, 9 aa, Homo Sapiens
FFCLPSRWN

SEQ ID NO: 1369274 - protein, 9 aa, Homo Sapiens
SPICAVCRE

SEQ ID NO: 1369275 - protein, 9 aa, Homo Sapiens
VPDGEPNAH

SEQ ID NO: 1369276 - protein, 9 aa, Homo Sapiens
YFMKQINDA

SEQ ID NO: 1369277 - protein, 9 aa, Homo Sapiens
VKRMETCQK

SEQ ID NO: 1369278 - protein, 9 aa, Homo Sapiens
SLKSLKILQ

SEQ ID NO: 1369279 - protein, 9 aa, Homo Sapiens
YCGMRFVAA

SEQ ID NO: 1369280 - protein, 9 aa, Homo Sapiens
SAGLAPSLV

SEQ ID NO: 1369281 - protein, 9 aa, Homo Sapiens
SEGTKAGTK

SEQ ID NO: 1369282 - protein, 9 aa, Homo Sapiens
NPPSKRVSI

SEQ ID NO: 1369283 - protein, 9 aa, Homo Sapiens
EKLTGAQRQ

SEQ ID NO: 1369284 - protein, 9 aa, Homo Sapiens
CPHGSTAQH

SEQ ID NO: 1369285 - protein, 9 aa, Homo Sapiens
LTEHSDLEE

SEQ ID NO: 1369286 - protein, 9 aa, Homo Sapiens
LSGVPLLCK

SEQ ID NO: 1369287 - protein, 9 aa, Homo Sapiens
RVDMPITVS

SEQ ID NO: 1369288 - protein, 9 aa, Homo Sapiens
YWSTTQAIE

SEQ ID NO: 1369289 - protein, 9 aa, Homo Sapiens
KEQHPAAEE

SEQ ID NO: 1369290 - protein, 9 aa, Homo Sapiens
PFCKSHIIN

SEQ ID NO: 1369291 - protein, 9 aa, Homo Sapiens
NHGDLSLQE

SEQ ID NO: 1369292 - protein, 9 aa, Homo Sapiens
GIEDCSVSQ

SEQ ID NO: 1369293 - protein, 9 aa, Homo Sapiens
IAVEGLRKR

SEQ ID NO: 1369294 - protein, 9 aa, Homo Sapiens
FQLLSGKDQ

SEQ ID NO: 1369295 - protein, 9 aa, Homo Sapiens
EKQVFKNLQ

SEQ ID NO: 1369296 - protein, 9 aa, Homo Sapiens
GGIGSCIPC

SEQ ID NO: 1369297 - protein, 9 aa, Homo Sapiens
AELSSSSQR

SEQ ID NO: 1369298 - protein, 9 aa, Homo Sapiens
RADLCHQHA

SEQ ID NO: 1369299 - protein, 9 aa, Homo Sapiens
QTLPEEPQY

SEQ ID NO: 1369300 - protein, 9 aa, Homo Sapiens
VMHFVARVH

SEQ ID NO: 1369301 - protein, 9 aa, Homo Sapiens
HRPLRCCLK

SEQ ID NO: 1369302 - protein, 9 aa, Homo Sapiens
ESGPLGNSS

SEQ ID NO: 1369303 - protein, 9 aa, Homo Sapiens
GGKFGTSIL

SEQ ID NO: 1369304 - protein, 9 aa, Homo Sapiens
EGRGYPRPG

SEQ ID NO: 1369305 - protein, 9 aa, Homo Sapiens
AHGNFLEDG

SEQ ID NO: 1369306 - protein, 9 aa, Homo Sapiens
NYRHTPPCP

SEQ ID NO: 1369307 - protein, 9 aa, Homo Sapiens
EVTFSFIPL

SEQ ID NO: 1369308 - protein, 9 aa, Homo Sapiens
CSQHFKKLF

SEQ ID NO: 1369309 - protein, 9 aa, Homo Sapiens
QNRSSLYRR

SEQ ID NO: 1369310 - protein, 9 aa, Homo Sapiens
MEHWKTKKE

SEQ ID NO: 1369311 - protein, 9 aa, Homo Sapiens
RLDFQEEPM

SEQ ID NO: 1369312 - protein, 9 aa, Homo Sapiens
RGILKTYSD

SEQ ID NO: 1369313 - protein, 9 aa, Homo Sapiens
PDMQKQRVA

SEQ ID NO: 1369314 - protein, 9 aa, Homo Sapiens
VFNFLFLIY

SEQ ID NO: 1369315 - protein, 9 aa, Homo Sapiens
LVAGVLAAS

SEQ ID NO: 1369316 - protein, 9 aa, Homo Sapiens
EAGYTKRLR

SEQ ID NO: 1369317 - protein, 9 aa, Homo Sapiens
KVHLFSYPS

SEQ ID NO: 1369318 - protein, 9 aa, Homo Sapiens
HCAVLEKRV

SEQ ID NO: 1369319 - protein, 9 aa, Homo Sapiens
VTGRTAQRC

SEQ ID NO: 1369320 - protein, 9 aa, Homo Sapiens
TTSNFLGTA

SEQ ID NO: 1369321 - protein, 9 aa, Homo Sapiens
AQIQERRSL

SEQ ID NO: 1369322 - protein, 9 aa, Homo Sapiens
ILEASSELF

SEQ ID NO: 1369323 - protein, 9 aa, Homo Sapiens
RVLWDDNCF

SEQ ID NO: 1369324 - protein, 9 aa, Homo Sapiens
KEPLIHIQL

SEQ ID NO: 1369325 - protein, 9 aa, Homo Sapiens
RVGAPPQNP

SEQ ID NO: 1369326 - protein, 9 aa, Homo Sapiens
SFNPDCERA

SEQ ID NO: 1369327 - protein, 9 aa, Homo Sapiens
KEGHQMPQQ

SEQ ID NO: 1369328 - protein, 9 aa, Homo Sapiens
SGSMREKRK

SEQ ID NO: 1369329 - protein, 9 aa, Homo Sapiens
IGSFFASCL

SEQ ID NO: 1369330 - protein, 9 aa, Homo Sapiens
VIKCDPDRL

SEQ ID NO: 1369331 - protein, 9 aa, Homo Sapiens
MPVLFDVAL

SEQ ID NO: 1369332 - protein, 9 aa, Homo Sapiens
VTSGIYLAF

SEQ ID NO: 1369333 - protein, 9 aa, Homo Sapiens
RKERKGDHS

SEQ ID NO: 1369334 - protein, 9 aa, Homo Sapiens
VVGSSQKRY

SEQ ID NO: 1369335 - protein, 9 aa, Homo Sapiens
AVTLLDTIL

SEQ ID NO: 1369336 - protein, 9 aa, Homo Sapiens
PIQANVVPT

SEQ ID NO: 1369337 - protein, 9 aa, Homo Sapiens
KNSQSEEHS

SEQ ID NO: 1369338 - protein, 9 aa, Homo Sapiens
VHMLSLSIM

SEQ ID NO: 1369339 - protein, 9 aa, Homo Sapiens
RGRPGAGPE

SEQ ID NO: 1369340 - protein, 9 aa, Homo Sapiens
DEDLAKADE

SEQ ID NO: 1369341 - protein, 9 aa, Homo Sapiens
CFEKTHHCL

SEQ ID NO: 1369342 - protein, 9 aa, Homo Sapiens
QPGEKKSQA

SEQ ID NO: 1369343 - protein, 9 aa, Homo Sapiens
KLTQSVDLL

SEQ ID NO: 1369344 - protein, 9 aa, Homo Sapiens
STPPLILTC

SEQ ID NO: 1369345 - protein, 9 aa, Homo Sapiens
VGCRPLCPA

SEQ ID NO: 1369346 - protein, 9 aa, Homo Sapiens
AAWCPCIRG

SEQ ID NO: 1369347 - protein, 9 aa, Homo Sapiens
CLVPAERGR

SEQ ID NO: 1369348 - protein, 9 aa, Homo Sapiens
HTLAVYVYR

SEQ ID NO: 1369349 - protein, 9 aa, Homo Sapiens
AHMLDIFHE

SEQ ID NO: 1369350 - protein, 9 aa, Homo Sapiens
LSPGNSEPL

SEQ ID NO: 1369351 - protein, 9 aa, Homo Sapiens
TLEKIDKAC

SEQ ID NO: 1369352 - protein, 9 aa, Homo Sapiens
AIELTLVLT

SEQ ID NO: 1369353 - protein, 9 aa, Homo Sapiens
TIDRIEPAS

SEQ ID NO: 1369354 - protein, 9 aa, Homo Sapiens
LGEDEGGEP

SEQ ID NO: 1369355 - protein, 9 aa, Homo Sapiens
SSIQSQESG

SEQ ID NO: 1369356 - protein, 9 aa, Homo Sapiens
TQKRTEESV

SEQ ID NO: 1369357 - protein, 9 aa, Homo Sapiens
HIAAGAGDG

SEQ ID NO: 1369358 - protein, 9 aa, Homo Sapiens
EITRSFNQN

SEQ ID NO: 1369359 - protein, 9 aa, Homo Sapiens
PLPRGFLRE

SEQ ID NO: 1369360 - protein, 9 aa, Homo Sapiens
RRLRTLEEQ

SEQ ID NO: 1369361 - protein, 9 aa, Homo Sapiens
MCLESVGFC

SEQ ID NO: 1369362 - protein, 9 aa, Homo Sapiens
ALPEKGLVI

SEQ ID NO: 1369363 - protein, 9 aa, Homo Sapiens
LPLLLNGEV

SEQ ID NO: 1369364 - protein, 9 aa, Homo Sapiens
KSTVMKRKV

SEQ ID NO: 1369365 - protein, 9 aa, Homo Sapiens
DEYKKTYME

SEQ ID NO: 1369366 - protein, 9 aa, Homo Sapiens
CTSVPSTTR

SEQ ID NO: 1369367 - protein, 9 aa, Homo Sapiens
RSTRATSQG

SEQ ID NO: 1369368 - protein, 9 aa, Homo Sapiens
FLILGKVLI

SEQ ID NO: 1369369 - protein, 9 aa, Homo Sapiens
IELTLVLTE

SEQ ID NO: 1369370 - protein, 9 aa, Homo Sapiens
LDPLDYAGL

SEQ ID NO: 1369371 - protein, 9 aa, Homo Sapiens
HLRRRPRPP

SEQ ID NO: 1369372 - protein, 9 aa, Homo Sapiens
TLLFCLLVV

SEQ ID NO: 1369373 - protein, 9 aa, Homo Sapiens
KIDRLSTTC

SEQ ID NO: 1369374 - protein, 9 aa, Homo Sapiens
EEVEGAAGG

SEQ ID NO: 1369375 - protein, 9 aa, Homo Sapiens
NYILTCSAT

SEQ ID NO: 1369376 - protein, 9 aa, Homo Sapiens
PRTRARASA

SEQ ID NO: 1369377 - protein, 9 aa, Homo Sapiens
NNGNKTEVE

SEQ ID NO: 1369378 - protein, 9 aa, Homo Sapiens
LGPPGHRFW

SEQ ID NO: 1369379 - protein, 9 aa, Homo Sapiens
SINTIWKST

SEQ ID NO: 1369380 - protein, 9 aa, Homo Sapiens
EGCIMGFIS

SEQ ID NO: 1369381 - protein, 9 aa, Homo Sapiens
GAYAMRLGI

SEQ ID NO: 1369382 - protein, 9 aa, Homo Sapiens
FSTPTSTNT

SEQ ID NO: 1369383 - protein, 9 aa, Homo Sapiens
FRWWLQVTP

SEQ ID NO: 1369384 - protein, 9 aa, Homo Sapiens
VHALQPLDH

SEQ ID NO: 1369385 - protein, 9 aa, Homo Sapiens
GICTNPASI

SEQ ID NO: 1369386 - protein, 9 aa, Homo Sapiens
VPLSVHKLP

SEQ ID NO: 1369387 - protein, 9 aa, Homo Sapiens
GVRPYRAWC

SEQ ID NO: 1369388 - protein, 9 aa, Homo Sapiens
ATAIMCGLC

SEQ ID NO: 1369389 - protein, 9 aa, Homo Sapiens
TLHFVRGMH

SEQ ID NO: 1369390 - protein, 9 aa, Homo Sapiens
AAFPTGRYP

SEQ ID NO: 1369391 - protein, 9 aa, Homo Sapiens
RCMYRNATG

SEQ ID NO: 1369392 - protein, 9 aa, Homo Sapiens
DYGPPSPGY

SEQ ID NO: 1369393 - protein, 9 aa, Homo Sapiens
ASVLLCLDT

SEQ ID NO: 1369394 - protein, 9 aa, Homo Sapiens
AANTVLRQL

SEQ ID NO: 1369395 - protein, 9 aa, Homo Sapiens
FQLTATDTA

SEQ ID NO: 1369396 - protein, 9 aa, Homo Sapiens
TLSLQRLSR

SEQ ID NO: 1369397 - protein, 9 aa, Homo Sapiens
QSLTEHSDL

SEQ ID NO: 1369398 - protein, 9 aa, Homo Sapiens
EYFATNFNE

SEQ ID NO: 1369399 - protein, 9 aa, Homo Sapiens
VPVEEQDAH

SEQ ID NO: 1369400 - protein, 9 aa, Homo Sapiens
KVKDNNYNL

SEQ ID NO: 1369401 - protein, 9 aa, Homo Sapiens
PDNVLVNES

SEQ ID NO: 1369402 - protein, 9 aa, Homo Sapiens
VADLAHILT

SEQ ID NO: 1369403 - protein, 9 aa, Homo Sapiens
PLDKARKAK

SEQ ID NO: 1369404 - protein, 9 aa, Homo Sapiens
HPPAPRRDP

SEQ ID NO: 1369405 - protein, 9 aa, Homo Sapiens
LLIRRNAFL

SEQ ID NO: 1369406 - protein, 9 aa, Homo Sapiens
PLHHSPRQW

SEQ ID NO: 1369407 - protein, 9 aa, Homo Sapiens
TDPISKERQ

SEQ ID NO: 1369408 - protein, 9 aa, Homo Sapiens
KPIDLKDRG

SEQ ID NO: 1369409 - protein, 9 aa, Homo Sapiens
RNCIIDQIF

SEQ ID NO: 1369410 - protein, 9 aa, Homo Sapiens
FIQLMLLFL

SEQ ID NO: 1369411 - protein, 9 aa, Homo Sapiens
FDFLIDVVP

SEQ ID NO: 1369412 - protein, 9 aa, Homo Sapiens
GTSRLHDLY

SEQ ID NO: 1369413 - protein, 9 aa, Homo Sapiens
EKSEGTGVA

SEQ ID NO: 1369414 - protein, 9 aa, Homo Sapiens
FVALEIYFP

SEQ ID NO: 1369415 - protein, 9 aa, Homo Sapiens
IKQLGRRIL

SEQ ID NO: 1369416 - protein, 9 aa, Homo Sapiens
GTETAERCR

SEQ ID NO: 1369417 - protein, 9 aa, Homo Sapiens
IMENRLLMR

SEQ ID NO: 1369418 - protein, 9 aa, Homo Sapiens
VCQNHVSRG

SEQ ID NO: 1369419 - protein, 9 aa, Homo Sapiens
PSASLHPAS

SEQ ID NO: 1369420 - protein, 9 aa, Homo Sapiens
TPKDDPAIA

SEQ ID NO: 1369421 - protein, 9 aa, Homo Sapiens
NDKKGDILL

SEQ ID NO: 1369422 - protein, 9 aa, Homo Sapiens
GLQDSSKGP

SEQ ID NO: 1369423 - protein, 9 aa, Homo Sapiens
CCCHCLLTS

SEQ ID NO: 1369424 - protein, 9 aa, Homo Sapiens
LLSAPTTVT

SEQ ID NO: 1369425 - protein, 9 aa, Homo Sapiens
HCKEKAFTH

SEQ ID NO: 1369426 - protein, 9 aa, Homo Sapiens
DDAGQEADG

SEQ ID NO: 1369427 - protein, 9 aa, Homo Sapiens
RRVDMPITV

SEQ ID NO: 1369428 - protein, 9 aa, Homo Sapiens
LEQQAAIRK

SEQ ID NO: 1369429 - protein, 9 aa, Homo Sapiens
IAADTLPYT

SEQ ID NO: 1369430 - protein, 9 aa, Homo Sapiens
TPGTRCSST

SEQ ID NO: 1369431 - protein, 9 aa, Homo Sapiens
PLQVTTTLK

SEQ ID NO: 1369432 - protein, 9 aa, Homo Sapiens
PYTELPHII

SEQ ID NO: 1369433 - protein, 9 aa, Homo Sapiens
LSGKDQPLL

SEQ ID NO: 1369434 - protein, 9 aa, Homo Sapiens
VAYSPKRPP

SEQ ID NO: 1369435 - protein, 9 aa, Homo Sapiens
PEQQAERGE

SEQ ID NO: 1369436 - protein, 9 aa, Homo Sapiens
LCSEFLWFQ

SEQ ID NO: 1369437 - protein, 9 aa, Homo Sapiens
WHRPASPAP

SEQ ID NO: 1369438 - protein, 9 aa, Homo Sapiens
FSHSISESF

SEQ ID NO: 1369439 - protein, 9 aa, Homo Sapiens
RRAKFRTQE

SEQ ID NO: 1369440 - protein, 9 aa, Homo Sapiens
AFRGLAELV

SEQ ID NO: 1369441 - protein, 9 aa, Homo Sapiens
AGDRCHRAQ

SEQ ID NO: 1369442 - protein, 9 aa, Homo Sapiens
IVTLGLLLP

SEQ ID NO: 1369443 - protein, 9 aa, Homo Sapiens
SPRGNRSLC

SEQ ID NO: 1369444 - protein, 9 aa, Homo Sapiens
HKVTKVLNF

SEQ ID NO: 1369445 - protein, 9 aa, Homo Sapiens
RRRWRRVLP

SEQ ID NO: 1369446 - protein, 9 aa, Homo Sapiens
CPPPVTPLR

SEQ ID NO: 1369447 - protein, 9 aa, Homo Sapiens
HLFQSERWP

SEQ ID NO: 1369448 - protein, 9 aa, Homo Sapiens
QSLQQCVAS

SEQ ID NO: 1369449 - protein, 9 aa, Homo Sapiens
LAHILTHLQ

SEQ ID NO: 1369450 - protein, 9 aa, Homo Sapiens
ALGVGMPSA

SEQ ID NO: 1369451 - protein, 9 aa, Homo Sapiens
QGFETLQQF

SEQ ID NO: 1369452 - protein, 9 aa, Homo Sapiens
SCMLGKKRS

SEQ ID NO: 1369453 - protein, 9 aa, Homo Sapiens
KIFKYGHYN

SEQ ID NO: 1369454 - protein, 9 aa, Homo Sapiens
EHHEAIPVL

SEQ ID NO: 1369455 - protein, 9 aa, Homo Sapiens
PVGTELIYR

SEQ ID NO: 1369456 - protein, 9 aa, Homo Sapiens
INNSARNIL

SEQ ID NO: 1369457 - protein, 9 aa, Homo Sapiens
GFIQAEGYP

SEQ ID NO: 1369458 - protein, 9 aa, Homo Sapiens
LLTNIPAIQ

SEQ ID NO: 1369459 - protein, 9 aa, Homo Sapiens
FDPLLDLSL

SEQ ID NO: 1369460 - protein, 9 aa, Homo Sapiens
RWGPRSPSP

SEQ ID NO: 1369461 - protein, 9 aa, Homo Sapiens
VESLGNNHL

SEQ ID NO: 1369462 - protein, 9 aa, Homo Sapiens
VLWASSKVE

SEQ ID NO: 1369463 - protein, 9 aa, Homo Sapiens
CLPAQTTVP

SEQ ID NO: 1369464 - protein, 9 aa, Homo Sapiens
RRRCFVLSP

SEQ ID NO: 1369465 - protein, 9 aa, Homo Sapiens
WAFLSKKGC

SEQ ID NO: 1369466 - protein, 9 aa, Homo Sapiens
KMAIQQIMK

SEQ ID NO: 1369467 - protein, 9 aa, Homo Sapiens
DPGDDDVKK

SEQ ID NO: 1369468 - protein, 9 aa, Homo Sapiens
KATETFKLT

SEQ ID NO: 1369469 - protein, 9 aa, Homo Sapiens
TMSTITMSS

SEQ ID NO: 1369470 - protein, 9 aa, Homo Sapiens
KSFSSTPPL

SEQ ID NO: 1369471 - protein, 9 aa, Homo Sapiens
AVDCLQAFW

SEQ ID NO: 1369472 - protein, 9 aa, Homo Sapiens
LLSTSASVS

SEQ ID NO: 1369473 - protein, 9 aa, Homo Sapiens
EGWDNEEDL

SEQ ID NO: 1369474 - protein, 9 aa, Homo Sapiens
MPMLCPLST

SEQ ID NO: 1369475 - protein, 9 aa, Homo Sapiens
AINSQINLE

SEQ ID NO: 1369476 - protein, 9 aa, Homo Sapiens
PDQHCSLPI

SEQ ID NO: 1369477 - protein, 9 aa, Homo Sapiens
YPSSQFRAP

SEQ ID NO: 1369478 - protein, 9 aa, Homo Sapiens
GGQHTRGAS

SEQ ID NO: 1369479 - protein, 9 aa, Homo Sapiens
QKDQLSPRV

SEQ ID NO: 1369480 - protein, 9 aa, Homo Sapiens
WGHPSSNGR

SEQ ID NO: 1369481 - protein, 9 aa, Homo Sapiens
GVCRLYVLK

SEQ ID NO: 1369482 - protein, 9 aa, Homo Sapiens
AQLQEKLTG

SEQ ID NO: 1369483 - protein, 9 aa, Homo Sapiens
WSMAPSTSA

SEQ ID NO: 1369484 - protein, 9 aa, Homo Sapiens
VTQLINSIL

SEQ ID NO: 1369485 - protein, 9 aa, Homo Sapiens
VLRKLFDQH

SEQ ID NO: 1369486 - protein, 9 aa, Homo Sapiens
YVLCASEFV

SEQ ID NO: 1369487 - protein, 9 aa, Homo Sapiens
NVVPTMHSW

SEQ ID NO: 1369488 - protein, 9 aa, Homo Sapiens
KSARMPAQL

SEQ ID NO: 1369489 - protein, 9 aa, Homo Sapiens
AFPTGRYPV

SEQ ID NO: 1369490 - protein, 9 aa, Homo Sapiens
CNCFGFVGN

SEQ ID NO: 1369491 - protein, 9 aa, Homo Sapiens
ASTKITALP

SEQ ID NO: 1369492 - protein, 9 aa, Homo Sapiens
ARVVVNVED

SEQ ID NO: 1369493 - protein, 9 aa, Homo Sapiens
ILVMLEIVT

SEQ ID NO: 1369494 - protein, 9 aa, Homo Sapiens
EKGLVIHHA

SEQ ID NO: 1369495 - protein, 9 aa, Homo Sapiens
GREGLIQAR

SEQ ID NO: 1369496 - protein, 9 aa, Homo Sapiens
VYMYPEYQN

SEQ ID NO: 1369497 - protein, 9 aa, Homo Sapiens
HLLVEELRP

SEQ ID NO: 1369498 - protein, 9 aa, Homo Sapiens
DLLTNIPAI

SEQ ID NO: 1369499 - protein, 9 aa, Homo Sapiens
AAHFPSVAL

SEQ ID NO: 1369500 - protein, 9 aa, Homo Sapiens
VQGSAGGQP

SEQ ID NO: 1369501 - protein, 9 aa, Homo Sapiens
KIATGQTDN

SEQ ID NO: 1369502 - protein, 9 aa, Homo Sapiens
YKIPKSVQS

SEQ ID NO: 1369503 - protein, 9 aa, Homo Sapiens
KMRKRREEN

SEQ ID NO: 1369504 - protein, 9 aa, Homo Sapiens
LQERVEHCA

SEQ ID NO: 1369505 - protein, 9 aa, Homo Sapiens
PTVPKHLTM

SEQ ID NO: 1369506 - protein, 9 aa, Homo Sapiens
ITAAAIGSL

SEQ ID NO: 1369507 - protein, 9 aa, Homo Sapiens
VDVGRDGQG

SEQ ID NO: 1369508 - protein, 9 aa, Homo Sapiens
NLAATVTEE

SEQ ID NO: 1369509 - protein, 9 aa, Homo Sapiens
SVNQGSTNS

SEQ ID NO: 1369510 - protein, 9 aa, Homo Sapiens
LLAPGRGAA

SEQ ID NO: 1369511 - protein, 9 aa, Homo Sapiens
GKKGQACEQ

SEQ ID NO: 1369512 - protein, 9 aa, Homo Sapiens
MAPEVTEQV

SEQ ID NO: 1369513 - protein, 9 aa, Homo Sapiens
KSYKRECIN

SEQ ID NO: 1369514 - protein, 9 aa, Homo Sapiens
VGPLDKARK

SEQ ID NO: 1369515 - protein, 9 aa, Homo Sapiens
QHSKGRDCR

SEQ ID NO: 1369516 - protein, 9 aa, Homo Sapiens
TSRPSHYRV

SEQ ID NO: 1369517 - protein, 9 aa, Homo Sapiens
SFFPHCSLL

SEQ ID NO: 1369518 - protein, 9 aa, Homo Sapiens
PPTICECWR

SEQ ID NO: 1369519 - protein, 9 aa, Homo Sapiens
YGMSLPPRS

SEQ ID NO: 1369520 - protein, 9 aa, Homo Sapiens
RTITGAKPL

SEQ ID NO: 1369521 - protein, 9 aa, Homo Sapiens
RAASALRTR

SEQ ID NO: 1369522 - protein, 9 aa, Homo Sapiens
RLEGATKLA

SEQ ID NO: 1369523 - protein, 9 aa, Homo Sapiens
MKLPFCKSH

SEQ ID NO: 1369524 - protein, 9 aa, Homo Sapiens
VSHRARPFT

SEQ ID NO: 1369525 - protein, 9 aa, Homo Sapiens
NIEITPQRS

SEQ ID NO: 1369526 - protein, 9 aa, Homo Sapiens
TTCIQLHQD

SEQ ID NO: 1369527 - protein, 9 aa, Homo Sapiens
GMGDQKASS

SEQ ID NO: 1369528 - protein, 9 aa, Homo Sapiens
SCSSVELTG

SEQ ID NO: 1369529 - protein, 9 aa, Homo Sapiens
MEMHYGHQA

SEQ ID NO: 1369530 - protein, 9 aa, Homo Sapiens
NLNDYSVRE

SEQ ID NO: 1369531 - protein, 9 aa, Homo Sapiens
FKEPKARNT

SEQ ID NO: 1369532 - protein, 9 aa, Homo Sapiens
EKEQEKRRE

SEQ ID NO: 1369533 - protein, 9 aa, Homo Sapiens
APRRRAAWW

SEQ ID NO: 1369534 - protein, 9 aa, Homo Sapiens
RRRRCFVLS

SEQ ID NO: 1369535 - protein, 9 aa, Homo Sapiens
PSAVVLDLA

SEQ ID NO: 1369536 - protein, 9 aa, Homo Sapiens
HLPKLQEAP

SEQ ID NO: 1369537 - protein, 9 aa, Homo Sapiens
VWFPLKIAY

SEQ ID NO: 1369538 - protein, 9 aa, Homo Sapiens
MTPEDHEKL

SEQ ID NO: 1369539 - protein, 9 aa, Homo Sapiens
HRHLRRRPR

SEQ ID NO: 1369540 - protein, 9 aa, Homo Sapiens
VNRNVVLVG

SEQ ID NO: 1369541 - protein, 9 aa, Homo Sapiens
HVEAYIDFD

SEQ ID NO: 1369542 - protein, 9 aa, Homo Sapiens
RLKTIDIQA

SEQ ID NO: 1369543 - protein, 9 aa, Homo Sapiens
FLLHGPYHF

SEQ ID NO: 1369544 - protein, 9 aa, Homo Sapiens
TGICTNPAS

SEQ ID NO: 1369545 - protein, 9 aa, Homo Sapiens
DYSVRELQP

SEQ ID NO: 1369546 - protein, 9 aa, Homo Sapiens
EEPEHSKEG

SEQ ID NO: 1369547 - protein, 9 aa, Homo Sapiens
NCKSKEVEI

SEQ ID NO: 1369548 - protein, 9 aa, Homo Sapiens
RLGMGVGSG

SEQ ID NO: 1369549 - protein, 9 aa, Homo Sapiens
GSTVACYYY

SEQ ID NO: 1369550 - protein, 9 aa, Homo Sapiens
EGEEEEDDE

SEQ ID NO: 1369551 - protein, 9 aa, Homo Sapiens
AELCRKQGM

SEQ ID NO: 1369552 - protein, 9 aa, Homo Sapiens
YNSFIVSGI

SEQ ID NO: 1369553 - protein, 9 aa, Homo Sapiens
TKTKSWPLC

SEQ ID NO: 1369554 - protein, 9 aa, Homo Sapiens
PKPRRKPGC

SEQ ID NO: 1369555 - protein, 9 aa, Homo Sapiens
DGSLDRNLG

SEQ ID NO: 1369556 - protein, 9 aa, Homo Sapiens
EETREEPTE

SEQ ID NO: 1369557 - protein, 9 aa, Homo Sapiens
QGAMEELCA

SEQ ID NO: 1369558 - protein, 9 aa, Homo Sapiens
QEGPGRHPF

SEQ ID NO: 1369559 - protein, 9 aa, Homo Sapiens
ERPARTPPG

SEQ ID NO: 1369560 - protein, 9 aa, Homo Sapiens
SFSESGPLG

SEQ ID NO: 1369561 - protein, 9 aa, Homo Sapiens
RILHENMDQ

SEQ ID NO: 1369562 - protein, 9 aa, Homo Sapiens
SCLGAPAQH

SEQ ID NO: 1369563 - protein, 9 aa, Homo Sapiens
KEPLRVKPL

SEQ ID NO: 1369564 - protein, 9 aa, Homo Sapiens
GRPPRMELP

SEQ ID NO: 1369565 - protein, 9 aa, Homo Sapiens
LLSTRAGGS

SEQ ID NO: 1369566 - protein, 9 aa, Homo Sapiens
FTCFFRYMK

SEQ ID NO: 1369567 - protein, 9 aa, Homo Sapiens
HGAELKDVQ

SEQ ID NO: 1369568 - protein, 9 aa, Homo Sapiens
KSLRRSVVG

SEQ ID NO: 1369569 - protein, 9 aa, Homo Sapiens
CRHGYPLSW

SEQ ID NO: 1369570 - protein, 9 aa, Homo Sapiens
VLSPRDRGV

SEQ ID NO: 1369571 - protein, 9 aa, Homo Sapiens
PTSCSGRSS

SEQ ID NO: 1369572 - protein, 9 aa, Homo Sapiens
QRRLEGIEH

SEQ ID NO: 1369573 - protein, 9 aa, Homo Sapiens
LLQKSTETT

SEQ ID NO: 1369574 - protein, 9 aa, Homo Sapiens
GTLSIPPVQ

SEQ ID NO: 1369575 - protein, 9 aa, Homo Sapiens
VPLLCKRCW

SEQ ID NO: 1369576 - protein, 9 aa, Homo Sapiens
SVRPCSVTV

SEQ ID NO: 1369577 - protein, 9 aa, Homo Sapiens
QFSWEDVKT

SEQ ID NO: 1369578 - protein, 9 aa, Homo Sapiens
QRLLRERKS

SEQ ID NO: 1369579 - protein, 9 aa, Homo Sapiens
MELDEAWED

SEQ ID NO: 1369580 - protein, 9 aa, Homo Sapiens
LTLSLTTGS

SEQ ID NO: 1369581 - protein, 9 aa, Homo Sapiens
TPDRVLFML

SEQ ID NO: 1369582 - protein, 9 aa, Homo Sapiens
HNNVSTQSS

SEQ ID NO: 1369583 - protein, 9 aa, Homo Sapiens
TLSPGEARA

SEQ ID NO: 1369584 - protein, 9 aa, Homo Sapiens
DTPQLEGLM

SEQ ID NO: 1369585 - protein, 9 aa, Homo Sapiens
ASSRGTRLV

SEQ ID NO: 1369586 - protein, 9 aa, Homo Sapiens
QCVLLLVLD

SEQ ID NO: 1369587 - protein, 9 aa, Homo Sapiens
MLNNGAGVD

SEQ ID NO: 1369588 - protein, 9 aa, Homo Sapiens
SGDAGEHLC

SEQ ID NO: 1369589 - protein, 9 aa, Homo Sapiens
AQMHASGTS

SEQ ID NO: 1369590 - protein, 9 aa, Homo Sapiens
ASSCLGISV

SEQ ID NO: 1369591 - protein, 9 aa, Homo Sapiens
PAPSLPCPL

SEQ ID NO: 1369592 - protein, 9 aa, Homo Sapiens
GSPGGIGSC

SEQ ID NO: 1369593 - protein, 9 aa, Homo Sapiens
GEKSLRRSV

SEQ ID NO: 1369594 - protein, 9 aa, Homo Sapiens
RTRARASAG

SEQ ID NO: 1369595 - protein, 9 aa, Homo Sapiens
GKDQPLLIR

SEQ ID NO: 1369596 - protein, 9 aa, Homo Sapiens
SRECAGGCE

SEQ ID NO: 1369597 - protein, 9 aa, Homo Sapiens
ISGLLVNRN

SEQ ID NO: 1369598 - protein, 9 aa, Homo Sapiens
NSHPPPPPP

SEQ ID NO: 1369599 - protein, 9 aa, Homo Sapiens
PQESDTGAF

SEQ ID NO: 1369600 - protein, 9 aa, Homo Sapiens
IGSRTFEHF

SEQ ID NO: 1369601 - protein, 9 aa, Homo Sapiens
AVNRRLRTL

SEQ ID NO: 1369602 - protein, 9 aa, Homo Sapiens
LIFYYVTGF

SEQ ID NO: 1369603 - protein, 9 aa, Homo Sapiens
SGCSGSFLY

SEQ ID NO: 1369604 - protein, 9 aa, Homo Sapiens
EPALGAYRT

SEQ ID NO: 1369605 - protein, 9 aa, Homo Sapiens
VAGPSTAWS

SEQ ID NO: 1369606 - protein, 9 aa, Homo Sapiens
HSPPTTTEV

SEQ ID NO: 1369607 - protein, 9 aa, Homo Sapiens
LDSPPATCH

SEQ ID NO: 1369608 - protein, 9 aa, Homo Sapiens
NALLLICGG

SEQ ID NO: 1369609 - protein, 9 aa, Homo Sapiens
CKYFDKAVT

SEQ ID NO: 1369610 - protein, 9 aa, Homo Sapiens
CMGPAEDRC

SEQ ID NO: 1369611 - protein, 9 aa, Homo Sapiens
VARRCRNGF

SEQ ID NO: 1369612 - protein, 9 aa, Homo Sapiens
SVCQGQRFY

SEQ ID NO: 1369613 - protein, 9 aa, Homo Sapiens
LSYSIQDLF

SEQ ID NO: 1369614 - protein, 9 aa, Homo Sapiens
TYNSFIVSG

SEQ ID NO: 1369615 - protein, 9 aa, Homo Sapiens
VRHNSSCAP

SEQ ID NO: 1369616 - protein, 9 aa, Homo Sapiens
STKITALPN

SEQ ID NO: 1369617 - protein, 9 aa, Homo Sapiens
PGMWSPKER

SEQ ID NO: 1369618 - protein, 9 aa, Homo Sapiens
QCAKSFNSD

SEQ ID NO: 1369619 - protein, 9 aa, Homo Sapiens
CEECEKGFS

SEQ ID NO: 1369620 - protein, 9 aa, Homo Sapiens
ATSRDVNRR

SEQ ID NO: 1369621 - protein, 9 aa, Homo Sapiens
REEEERHLE

SEQ ID NO: 1369622 - protein, 9 aa, Homo Sapiens
FGTVKLFDF

SEQ ID NO: 1369623 - protein, 9 aa, Homo Sapiens
QSCCVSVSC

SEQ ID NO: 1369624 - protein, 9 aa, Homo Sapiens
LEHSLSKDT

SEQ ID NO: 1369625 - protein, 9 aa, Homo Sapiens
KCKSCPVAQ

SEQ ID NO: 1369626 - protein, 9 aa, Homo Sapiens
LQKSTETTQ

SEQ ID NO: 1369627 - protein, 9 aa, Homo Sapiens
VQPLAFHSL

SEQ ID NO: 1369628 - protein, 9 aa, Homo Sapiens
QRHPQGPCP

SEQ ID NO: 1369629 - protein, 9 aa, Homo Sapiens
IQDLFARAG

SEQ ID NO: 1369630 - protein, 9 aa, Homo Sapiens
TVCLLFFST

SEQ ID NO: 1369631 - protein, 9 aa, Homo Sapiens
VGIPGKKRG

SEQ ID NO: 1369632 - protein, 9 aa, Homo Sapiens
QTVELRLGG

SEQ ID NO: 1369633 - protein, 9 aa, Homo Sapiens
GLLVNVLPK

SEQ ID NO: 1369634 - protein, 9 aa, Homo Sapiens
RCGPGSQLN

SEQ ID NO: 1369635 - protein, 9 aa, Homo Sapiens
HLRSLRPGA

SEQ ID NO: 1369636 - protein, 9 aa, Homo Sapiens
IWKSTVMKR

SEQ ID NO: 1369637 - protein, 9 aa, Homo Sapiens
EVSLTLSPH

SEQ ID NO: 1369638 - protein, 9 aa, Homo Sapiens
QKGFSIIEH

SEQ ID NO: 1369639 - protein, 9 aa, Homo Sapiens
PPTRSSPRL

SEQ ID NO: 1369640 - protein, 9 aa, Homo Sapiens
EIYRGPSGE

SEQ ID NO: 1369641 - protein, 9 aa, Homo Sapiens
LQKAQFSLE

SEQ ID NO: 1369642 - protein, 9 aa, Homo Sapiens
GLLLALSFA

SEQ ID NO: 1369643 - protein, 9 aa, Homo Sapiens
HRLATAPKT

SEQ ID NO: 1369644 - protein, 9 aa, Homo Sapiens
LLSGKDQPL

SEQ ID NO: 1369645 - protein, 9 aa, Homo Sapiens
MPYGAPIIG

SEQ ID NO: 1369646 - protein, 9 aa, Homo Sapiens
VIGQEVRMP

SEQ ID NO: 1369647 - protein, 9 aa, Homo Sapiens
KAGLWSQRH

SEQ ID NO: 1369648 - protein, 9 aa, Homo Sapiens
PHEAVGVRP

SEQ ID NO: 1369649 - protein, 9 aa, Homo Sapiens
PPLEKLQVD

SEQ ID NO: 1369650 - protein, 9 aa, Homo Sapiens
RQKQKVQRR

SEQ ID NO: 1369651 - protein, 9 aa, Homo Sapiens
NVVTSFAPR

SEQ ID NO: 1369652 - protein, 9 aa, Homo Sapiens
GHLVGRHCG

SEQ ID NO: 1369653 - protein, 9 aa, Homo Sapiens
AISEILFTV

SEQ ID NO: 1369654 - protein, 9 aa, Homo Sapiens
SLCGWRSTG

SEQ ID NO: 1369655 - protein, 9 aa, Homo Sapiens
LIMVWGHPS

SEQ ID NO: 1369656 - protein, 9 aa, Homo Sapiens
GADPSRGVP

SEQ ID NO: 1369657 - protein, 9 aa, Homo Sapiens
PAMRSGGDW

SEQ ID NO: 1369658 - protein, 9 aa, Homo Sapiens
KIRSPVVSG

SEQ ID NO: 1369659 - protein, 9 aa, Homo Sapiens
EEEREKVLK

SEQ ID NO: 1369660 - protein, 9 aa, Homo Sapiens
LVSNPSLHE

SEQ ID NO: 1369661 - protein, 9 aa, Homo Sapiens
DLGMGDQKA

SEQ ID NO: 1369662 - protein, 9 aa, Homo Sapiens
PRPANFFCI

SEQ ID NO: 1369663 - protein, 9 aa, Homo Sapiens
SAFLLAFSP

SEQ ID NO: 1369664 - protein, 9 aa, Homo Sapiens
QCPASAVSC

SEQ ID NO: 1369665 - protein, 9 aa, Homo Sapiens
FWGGACFIV

SEQ ID NO: 1369666 - protein, 9 aa, Homo Sapiens
SKQNLNAKT

SEQ ID NO: 1369667 - protein, 9 aa, Homo Sapiens
TTTRLPPCA

SEQ ID NO: 1369668 - protein, 9 aa, Homo Sapiens
LRGHSLDFY

SEQ ID NO: 1369669 - protein, 9 aa, Homo Sapiens
RDQVALDSP

SEQ ID NO: 1369670 - protein, 9 aa, Homo Sapiens
GKNRHRGKN

SEQ ID NO: 1369671 - protein, 9 aa, Homo Sapiens
KNQVARFNG

SEQ ID NO: 1369672 - protein, 9 aa, Homo Sapiens
EVTSLLRNF

SEQ ID NO: 1369673 - protein, 9 aa, Homo Sapiens
QIQERRSLL

SEQ ID NO: 1369674 - protein, 9 aa, Homo Sapiens
ALYQGAYSQ

SEQ ID NO: 1369675 - protein, 9 aa, Homo Sapiens
LEKRVQELQ

SEQ ID NO: 1369676 - protein, 9 aa, Homo Sapiens
NHIAAGAGD

SEQ ID NO: 1369677 - protein, 9 aa, Homo Sapiens
KAVTLREEQ

SEQ ID NO: 1369678 - protein, 9 aa, Homo Sapiens
CFRVQDVAR

SEQ ID NO: 1369679 - protein, 9 aa, Homo Sapiens
KSVFPPDEK

SEQ ID NO: 1369680 - protein, 9 aa, Homo Sapiens
LKFENGQRI

SEQ ID NO: 1369681 - protein, 9 aa, Homo Sapiens
TLAVYVYRS

SEQ ID NO: 1369682 - protein, 9 aa, Homo Sapiens
WVTSGIYLA

SEQ ID NO: 1369683 - protein, 9 aa, Homo Sapiens
GGKGAGNEG

SEQ ID NO: 1369684 - protein, 9 aa, Homo Sapiens
PTGRYPVRS

SEQ ID NO: 1369685 - protein, 9 aa, Homo Sapiens
CCHSSGGPG

SEQ ID NO: 1369686 - protein, 9 aa, Homo Sapiens
SSNLVALPF

SEQ ID NO: 1369687 - protein, 9 aa, Homo Sapiens
CQILGEAMA

SEQ ID NO: 1369688 - protein, 9 aa, Homo Sapiens
WGRGCCLRI

SEQ ID NO: 1369689 - protein, 9 aa, Homo Sapiens
KESETRAVG

SEQ ID NO: 1369690 - protein, 9 aa, Homo Sapiens
WPEVLKMTY

SEQ ID NO: 1369691 - protein, 9 aa, Homo Sapiens
CAKLLNSSK

SEQ ID NO: 1369692 - protein, 9 aa, Homo Sapiens
RKQGMEVVQ

SEQ ID NO: 1369693 - protein, 9 aa, Homo Sapiens
ITMSSPRRM

SEQ ID NO: 1369694 - protein, 9 aa, Homo Sapiens
QQCVLLLVL

SEQ ID NO: 1369695 - protein, 9 aa, Homo Sapiens
TKSPHEAAY

SEQ ID NO: 1369696 - protein, 9 aa, Homo Sapiens
ALRGHSLDF

SEQ ID NO: 1369697 - protein, 9 aa, Homo Sapiens
GLRVLTACL

SEQ ID NO: 1369698 - protein, 9 aa, Homo Sapiens
CSAQPAIST

SEQ ID NO: 1369699 - protein, 9 aa, Homo Sapiens
SRQCKCGEV

SEQ ID NO: 1369700 - protein, 9 aa, Homo Sapiens
DCPKSLCYP

SEQ ID NO: 1369701 - protein, 9 aa, Homo Sapiens
AVAAARAGA

SEQ ID NO: 1369702 - protein, 9 aa, Homo Sapiens
SRLVHIQKN

SEQ ID NO: 1369703 - protein, 9 aa, Homo Sapiens
NDTLNIAIP

SEQ ID NO: 1369704 - protein, 9 aa, Homo Sapiens
NPNMSDPEE

SEQ ID NO: 1369705 - protein, 9 aa, Homo Sapiens
WCWWGRGCC

SEQ ID NO: 1369706 - protein, 9 aa, Homo Sapiens
AFLILDLCL

SEQ ID NO: 1369707 - protein, 9 aa, Homo Sapiens
HAGMETTCT

SEQ ID NO: 1369708 - protein, 9 aa, Homo Sapiens
VRLCNGEMF

SEQ ID NO: 1369709 - protein, 9 aa, Homo Sapiens
VLKKTRNVF

SEQ ID NO: 1369710 - protein, 9 aa, Homo Sapiens
NNWVPDVGS

SEQ ID NO: 1369711 - protein, 9 aa, Homo Sapiens
NGDGSISYE

SEQ ID NO: 1369712 - protein, 9 aa, Homo Sapiens
EGRADLCHQ

SEQ ID NO: 1369713 - protein, 9 aa, Homo Sapiens
EEATVECGV

SEQ ID NO: 1369714 - protein, 9 aa, Homo Sapiens
YVGWHPRVM

SEQ ID NO: 1369715 - protein, 9 aa, Homo Sapiens
NRLLMRDPE

SEQ ID NO: 1369716 - protein, 9 aa, Homo Sapiens
IRNILDVSM

SEQ ID NO: 1369717 - protein, 9 aa, Homo Sapiens
DVHVGLGRL

SEQ ID NO: 1369718 - protein, 9 aa, Homo Sapiens
LRKKIKAQK

SEQ ID NO: 1369719 - protein, 9 aa, Homo Sapiens
GQLQSTRRV

SEQ ID NO: 1369720 - protein, 9 aa, Homo Sapiens
NVGEKVFCQ

SEQ ID NO: 1369721 - protein, 9 aa, Homo Sapiens
KTLSINTIW

SEQ ID NO: 1369722 - protein, 9 aa, Homo Sapiens
DCSKGSLVH

SEQ ID NO: 1369723 - protein, 9 aa, Homo Sapiens
KKRSLAPLK

SEQ ID NO: 1369724 - protein, 9 aa, Homo Sapiens
SVLRPQQIW

SEQ ID NO: 1369725 - protein, 9 aa, Homo Sapiens
RQRELRELQ

SEQ ID NO: 1369726 - protein, 9 aa, Homo Sapiens
AGPSISIPA

SEQ ID NO: 1369727 - protein, 9 aa, Homo Sapiens
TEHQVQGRL

SEQ ID NO: 1369728 - protein, 9 aa, Homo Sapiens
ETRKFCLTP

SEQ ID NO: 1369729 - protein, 9 aa, Homo Sapiens
RSHTAVRPA

SEQ ID NO: 1369730 - protein, 9 aa, Homo Sapiens
KLPQCLLSA

SEQ ID NO: 1369731 - protein, 9 aa, Homo Sapiens
WMNVLPYLS

SEQ ID NO: 1369732 - protein, 9 aa, Homo Sapiens
VILHVCQNH

SEQ ID NO: 1369733 - protein, 9 aa, Homo Sapiens
EKNIEITPQ

SEQ ID NO: 1369734 - protein, 9 aa, Homo Sapiens
GPMHGSSPG

SEQ ID NO: 1369735 - protein, 9 aa, Homo Sapiens
FMAGLAQNK

SEQ ID NO: 1369736 - protein, 9 aa, Homo Sapiens
AQIQRPIQV

SEQ ID NO: 1369737 - protein, 9 aa, Homo Sapiens
QPHKLQPIP

SEQ ID NO: 1369738 - protein, 9 aa, Homo Sapiens
PRWTLCGAC

SEQ ID NO: 1369739 - protein, 9 aa, Homo Sapiens
DRGPANGSP

SEQ ID NO: 1369740 - protein, 9 aa, Homo Sapiens
LQASMREPG

SEQ ID NO: 1369741 - protein, 9 aa, Homo Sapiens
HMLSLSIMP

SEQ ID NO: 1369742 - protein, 9 aa, Homo Sapiens
MPQSAYTGE

SEQ ID NO: 1369743 - protein, 9 aa, Homo Sapiens
GNKGVILFS

SEQ ID NO: 1369744 - protein, 9 aa, Homo Sapiens
ISKERQSYK

SEQ ID NO: 1369745 - protein, 9 aa, Homo Sapiens
VFSPTPDES

SEQ ID NO: 1369746 - protein, 9 aa, Homo Sapiens
GFADLFSKW

SEQ ID NO: 1369747 - protein, 9 aa, Homo Sapiens
GASGRDREA

SEQ ID NO: 1369748 - protein, 9 aa, Homo Sapiens
SLPSMLREA

SEQ ID NO: 1369749 - protein, 9 aa, Homo Sapiens
AEQAYKYMV

SEQ ID NO: 1369750 - protein, 9 aa, Homo Sapiens
NEGCIMGFI

SEQ ID NO: 1369751 - protein, 9 aa, Homo Sapiens
MGQRALRGY

SEQ ID NO: 1369752 - protein, 9 aa, Homo Sapiens
TFVIYCGMR

SEQ ID NO: 1369753 - protein, 9 aa, Homo Sapiens
NSVGKIERV

SEQ ID NO: 1369754 - protein, 9 aa, Homo Sapiens
TGQKPHKCN

SEQ ID NO: 1369755 - protein, 9 aa, Homo Sapiens
VKMAIQQIM

SEQ ID NO: 1369756 - protein, 9 aa, Homo Sapiens
QHVVGLHHL

SEQ ID NO: 1369757 - protein, 9 aa, Homo Sapiens
RFLQRSPIP

SEQ ID NO: 1369758 - protein, 9 aa, Homo Sapiens
QAGMAPVGP

SEQ ID NO: 1369759 - protein, 9 aa, Homo Sapiens
KRLAKSPGW

SEQ ID NO: 1369760 - protein, 9 aa, Homo Sapiens
RIDRLSSLS

SEQ ID NO: 1369761 - protein, 9 aa, Homo Sapiens
RIEPASVVD

SEQ ID NO: 1369762 - protein, 9 aa, Homo Sapiens
TEHIDFVTP

SEQ ID NO: 1369763 - protein, 9 aa, Homo Sapiens
DAWSLIGHL

SEQ ID NO: 1369764 - protein, 9 aa, Homo Sapiens
TLQQRHPQG

SEQ ID NO: 1369765 - protein, 9 aa, Homo Sapiens
NSTYWVSLQ

SEQ ID NO: 1369766 - protein, 9 aa, Homo Sapiens
KGDGLASEC

SEQ ID NO: 1369767 - protein, 9 aa, Homo Sapiens
RRKERQWSL

SEQ ID NO: 1369768 - protein, 9 aa, Homo Sapiens
LVGTEGLPL

SEQ ID NO: 1369769 - protein, 9 aa, Homo Sapiens
YGAGAIRPA

SEQ ID NO: 1369770 - protein, 9 aa, Homo Sapiens
HVGIELGYD

SEQ ID NO: 1369771 - protein, 9 aa, Homo Sapiens
THFQQLGPP

SEQ ID NO: 1369772 - protein, 9 aa, Homo Sapiens
GSRVQNTAK

SEQ ID NO: 1369773 - protein, 9 aa, Homo Sapiens
KVYLKKTDF

SEQ ID NO: 1369774 - protein, 9 aa, Homo Sapiens
SHKGGHFQD

SEQ ID NO: 1369775 - protein, 9 aa, Homo Sapiens
RLAAGTLVA

SEQ ID NO: 1369776 - protein, 9 aa, Homo Sapiens
LAYEKAQES

SEQ ID NO: 1369777 - protein, 9 aa, Homo Sapiens
GRSGCSGSF

SEQ ID NO: 1369778 - protein, 9 aa, Homo Sapiens
KSKTKLKNY

SEQ ID NO: 1369779 - protein, 9 aa, Homo Sapiens
RPPTICECW

SEQ ID NO: 1369780 - protein, 9 aa, Homo Sapiens
RCHRAQEYA

SEQ ID NO: 1369781 - protein, 9 aa, Homo Sapiens
LCFRHLDLL

SEQ ID NO: 1369782 - protein, 9 aa, Homo Sapiens
VLRPPHIAP

SEQ ID NO: 1369783 - protein, 9 aa, Homo Sapiens
CTFCFTASH

SEQ ID NO: 1369784 - protein, 9 aa, Homo Sapiens
PAAAAPSPE

SEQ ID NO: 1369785 - protein, 9 aa, Homo Sapiens
LAKADEGRA

SEQ ID NO: 1369786 - protein, 9 aa, Homo Sapiens
TYTFQLTAT

SEQ ID NO: 1369787 - protein, 9 aa, Homo Sapiens
SGKDQPLLV

SEQ ID NO: 1369788 - protein, 9 aa, Homo Sapiens
DLENLAGEI

SEQ ID NO: 1369789 - protein, 9 aa, Homo Sapiens
VIAPRRAAL

SEQ ID NO: 1369790 - protein, 9 aa, Homo Sapiens
TLRPWPRLS

SEQ ID NO: 1369791 - protein, 9 aa, Homo Sapiens
STNSDRGDV

SEQ ID NO: 1369792 - protein, 9 aa, Homo Sapiens
SHGADVLTC

SEQ ID NO: 1369793 - protein, 9 aa, Homo Sapiens
TQQGHVHRR

SEQ ID NO: 1369794 - protein, 9 aa, Homo Sapiens
FLMCCLFVN

SEQ ID NO: 1369795 - protein, 9 aa, Homo Sapiens
SLNGPSSGR

SEQ ID NO: 1369796 - protein, 9 aa, Homo Sapiens
HFVARVHNR

SEQ ID NO: 1369797 - protein, 9 aa, Homo Sapiens
SGKDQPLLI

SEQ ID NO: 1369798 - protein, 9 aa, Homo Sapiens
RNAFLILDL

SEQ ID NO: 1369799 - protein, 9 aa, Homo Sapiens
SDPLTHLAP

SEQ ID NO: 1369800 - protein, 9 aa, Homo Sapiens
SWPDQHCSL

SEQ ID NO: 1369801 - protein, 9 aa, Homo Sapiens
LDRNLGSPL

SEQ ID NO: 1369802 - protein, 9 aa, Homo Sapiens
ETIRHITQQ

SEQ ID NO: 1369803 - protein, 9 aa, Homo Sapiens
RLRHSTLRP

SEQ ID NO: 1369804 - protein, 9 aa, Homo Sapiens
SGVISSRLR

SEQ ID NO: 1369805 - protein, 9 aa, Homo Sapiens
EHQVQGGLF

SEQ ID NO: 1369806 - protein, 9 aa, Homo Sapiens
VKVRTDSDR

SEQ ID NO: 1369807 - protein, 9 aa, Homo Sapiens
GSTAQHVVG

SEQ ID NO: 1369808 - protein, 9 aa, Homo Sapiens
LCSMSNTSV

SEQ ID NO: 1369809 - protein, 9 aa, Homo Sapiens
GAAGYCLPL

SEQ ID NO: 1369810 - protein, 9 aa, Homo Sapiens
LPALGSSRL

SEQ ID NO: 1369811 - protein, 9 aa, Homo Sapiens
WEIVSMGTD

SEQ ID NO: 1369812 - protein, 9 aa, Homo Sapiens
TLKLILVML

SEQ ID NO: 1369813 - protein, 9 aa, Homo Sapiens
VSTPGTRCS

SEQ ID NO: 1369814 - protein, 9 aa, Homo Sapiens
RHCGNSFPL

SEQ ID NO: 1369815 - protein, 9 aa, Homo Sapiens
YISVLRKLF

SEQ ID NO: 1369816 - protein, 9 aa, Homo Sapiens
RYSPMSSST

SEQ ID NO: 1369817 - protein, 9 aa, Homo Sapiens
NTAVEDASG

SEQ ID NO: 1369818 - protein, 9 aa, Homo Sapiens
AAESCIQDP

SEQ ID NO: 1369819 - protein, 9 aa, Homo Sapiens
LSTYRPLPD

SEQ ID NO: 1369820 - protein, 9 aa, Homo Sapiens
NGGVTLRMV

SEQ ID NO: 1369821 - protein, 9 aa, Homo Sapiens
QTVCKNNPN

SEQ ID NO: 1369822 - protein, 9 aa, Homo Sapiens
MQKPGSNAH

SEQ ID NO: 1369823 - protein, 9 aa, Homo Sapiens
FVGAVYMYP

SEQ ID NO: 1369824 - protein, 9 aa, Homo Sapiens
GPGNLNTNM

SEQ ID NO: 1369825 - protein, 9 aa, Homo Sapiens
SDSALQAYK

SEQ ID NO: 1369826 - protein, 9 aa, Homo Sapiens
PMVLKVVGP

SEQ ID NO: 1369827 - protein, 9 aa, Homo Sapiens
LRKRETRKF

SEQ ID NO: 1369828 - protein, 9 aa, Homo Sapiens
LGLGQYRAT

SEQ ID NO: 1369829 - protein, 9 aa, Homo Sapiens
GGLKYSRYL

SEQ ID NO: 1369830 - protein, 9 aa, Homo Sapiens
YVIDSKNKP

SEQ ID NO: 1369831 - protein, 9 aa, Homo Sapiens
CGMEFGQIH

SEQ ID NO: 1369832 - protein, 9 aa, Homo Sapiens
RRSAAAPGP

SEQ ID NO: 1369833 - protein, 9 aa, Homo Sapiens
FGSTVACYY

SEQ ID NO: 1369834 - protein, 9 aa, Homo Sapiens
PSLPCPLPA

SEQ ID NO: 1369835 - protein, 9 aa, Homo Sapiens
VELILERDK

SEQ ID NO: 1369836 - protein, 9 aa, Homo Sapiens
NPGLLVNVL

SEQ ID NO: 1369837 - protein, 9 aa, Homo Sapiens
LSLPSMLRE

SEQ ID NO: 1369838 - protein, 9 aa, Homo Sapiens
ASIFQLFPS

SEQ ID NO: 1369839 - protein, 9 aa, Homo Sapiens
GNNGNKTEV

SEQ ID NO: 1369840 - protein, 9 aa, Homo Sapiens
LFWMLTRTM

SEQ ID NO: 1369841 - protein, 9 aa, Homo Sapiens
AVGTSQKSR

SEQ ID NO: 1369842 - protein, 9 aa, Homo Sapiens
QKKAKIKKK

SEQ ID NO: 1369843 - protein, 9 aa, Homo Sapiens
TRRRLGVEI

SEQ ID NO: 1369844 - protein, 9 aa, Homo Sapiens
SGHLKGAFA

SEQ ID NO: 1369845 - protein, 9 aa, Homo Sapiens
TLAARALRA

SEQ ID NO: 1369846 - protein, 9 aa, Homo Sapiens
DCINGSEEP

SEQ ID NO: 1369847 - protein, 9 aa, Homo Sapiens
AESPFKVHL

SEQ ID NO: 1369848 - protein, 9 aa, Homo Sapiens
GLDPAASSE

SEQ ID NO: 1369849 - protein, 9 aa, Homo Sapiens
RNILDVSMG

SEQ ID NO: 1369850 - protein, 9 aa, Homo Sapiens
VMHNFEHYF

SEQ ID NO: 1369851 - protein, 9 aa, Homo Sapiens
DQIVDPTVG

SEQ ID NO: 1369852 - protein, 9 aa, Homo Sapiens
FDKAVTLRE

SEQ ID NO: 1369853 - protein, 9 aa, Homo Sapiens
DDDAHFFSV

SEQ ID NO: 1369854 - protein, 9 aa, Homo Sapiens
PCASLAAAP

SEQ ID NO: 1369855 - protein, 9 aa, Homo Sapiens
LTGAQRQLG

SEQ ID NO: 1369856 - protein, 9 aa, Homo Sapiens
QASVSRWLQ

SEQ ID NO: 1369857 - protein, 9 aa, Homo Sapiens
TSGKRPREG

SEQ ID NO: 1369858 - protein, 9 aa, Homo Sapiens
DGCEEDNAG

SEQ ID NO: 1369859 - protein, 9 aa, Homo Sapiens
STSASVSGA

SEQ ID NO: 1369860 - protein, 9 aa, Homo Sapiens
EVCIVAQRR

SEQ ID NO: 1369861 - protein, 9 aa, Homo Sapiens
NDPDFLKQP

SEQ ID NO: 1369862 - protein, 9 aa, Homo Sapiens
PEPAAPPHR

SEQ ID NO: 1369863 - protein, 9 aa, Homo Sapiens
FNSKEALLR

SEQ ID NO: 1369864 - protein, 9 aa, Homo Sapiens
LIGHLHLAK

SEQ ID NO: 1369865 - protein, 9 aa, Homo Sapiens
TPSRAAFPT

SEQ ID NO: 1369866 - protein, 9 aa, Homo Sapiens
IAPRDQVAL

SEQ ID NO: 1369867 - protein, 9 aa, Homo Sapiens
THHCLLCPK

SEQ ID NO: 1369868 - protein, 9 aa, Homo Sapiens
QLPKRAIQE

SEQ ID NO: 1369869 - protein, 9 aa, Homo Sapiens
PQPQSVLCA

SEQ ID NO: 1369870 - protein, 9 aa, Homo Sapiens
SMEQLTRET

SEQ ID NO: 1369871 - protein, 9 aa, Homo Sapiens
GSSAALERF

SEQ ID NO: 1369872 - protein, 9 aa, Homo Sapiens
GGTNISNHG

SEQ ID NO: 1369873 - protein, 9 aa, Homo Sapiens
KLKLAPLQV

SEQ ID NO: 1369874 - protein, 9 aa, Homo Sapiens
PWGLQRTSQ

SEQ ID NO: 1369875 - protein, 9 aa, Homo Sapiens
QEEISRLVH

SEQ ID NO: 1369876 - protein, 9 aa, Homo Sapiens
ADGVDGHHH

SEQ ID NO: 1369877 - protein, 9 aa, Homo Sapiens
SAHTPTRSH

SEQ ID NO: 1369878 - protein, 9 aa, Homo Sapiens
PPQFLLHGP

SEQ ID NO: 1369879 - protein, 9 aa, Homo Sapiens
RRRSQRCPG

SEQ ID NO: 1369880 - protein, 9 aa, Homo Sapiens
EPVLERRTP

SEQ ID NO: 1369881 - protein, 9 aa, Homo Sapiens
LREHPQPHK

SEQ ID NO: 1369882 - protein, 9 aa, Homo Sapiens
KEVSLTLSP

SEQ ID NO: 1369883 - protein, 9 aa, Homo Sapiens
RARHFLPEQ

SEQ ID NO: 1369884 - protein, 9 aa, Homo Sapiens
LLRPNGVQA

SEQ ID NO: 1369885 - protein, 9 aa, Homo Sapiens
KEDERQWQE

SEQ ID NO: 1369886 - protein, 9 aa, Homo Sapiens
LPRVSGSHK

SEQ ID NO: 1369887 - protein, 9 aa, Homo Sapiens
ASRQNLHEI

SEQ ID NO: 1369888 - protein, 9 aa, Homo Sapiens
YSSNWSWGV

SEQ ID NO: 1369889 - protein, 9 aa, Homo Sapiens
FELEKKTEA

SEQ ID NO: 1369890 - protein, 9 aa, Homo Sapiens
KEQHYVRKV

SEQ ID NO: 1369891 - protein, 9 aa, Homo Sapiens
GGLRPQEGP

SEQ ID NO: 1369892 - protein, 9 aa, Homo Sapiens
LCLPAPAHF

SEQ ID NO: 1369893 - protein, 9 aa, Homo Sapiens
GCQGGLPGQ

SEQ ID NO: 1369894 - protein, 9 aa, Homo Sapiens
GRPAIHRAH

SEQ ID NO: 1369895 - protein, 9 aa, Homo Sapiens
RLYHSVKMG

SEQ ID NO: 1369896 - protein, 9 aa, Homo Sapiens
WLAPVAWHP

SEQ ID NO: 1369897 - protein, 9 aa, Homo Sapiens
TAPCASLAA

SEQ ID NO: 1369898 - protein, 9 aa, Homo Sapiens
TLRMVLLCE

SEQ ID NO: 1369899 - protein, 9 aa, Homo Sapiens
PLRIGKKNS

SEQ ID NO: 1369900 - protein, 9 aa, Homo Sapiens
NWVPDVGST

SEQ ID NO: 1369901 - protein, 9 aa, Homo Sapiens
ETGHMEEVE

SEQ ID NO: 1369902 - protein, 9 aa, Homo Sapiens
HLPPSSSQS

SEQ ID NO: 1369903 - protein, 9 aa, Homo Sapiens
KPEDLLLDE

SEQ ID NO: 1369904 - protein, 9 aa, Homo Sapiens
PCALKSVFP

SEQ ID NO: 1369905 - protein, 9 aa, Homo Sapiens
GHPEPGVEE

SEQ ID NO: 1369906 - protein, 9 aa, Homo Sapiens
LVLAEYWAT

SEQ ID NO: 1369907 - protein, 9 aa, Homo Sapiens
CQGGLPGQA

SEQ ID NO: 1369908 - protein, 9 aa, Homo Sapiens
RSQFVLKFL

SEQ ID NO: 1369909 - protein, 9 aa, Homo Sapiens
AGSSVGDTS

SEQ ID NO: 1369910 - protein, 9 aa, Homo Sapiens
CHKKKPVNW

SEQ ID NO: 1369911 - protein, 9 aa, Homo Sapiens
HFLPEQFSK

SEQ ID NO: 1369912 - protein, 9 aa, Homo Sapiens
IIITRVSNE

SEQ ID NO: 1369913 - protein, 9 aa, Homo Sapiens
DVLDSVTGL

SEQ ID NO: 1369914 - protein, 9 aa, Homo Sapiens
TSGDELVAC

SEQ ID NO: 1369915 - protein, 9 aa, Homo Sapiens
KGGHFQDTG

SEQ ID NO: 1369916 - protein, 9 aa, Homo Sapiens
RLSGPGMHL

SEQ ID NO: 1369917 - protein, 9 aa, Homo Sapiens
RCTTSNFLG

SEQ ID NO: 1369918 - protein, 9 aa, Homo Sapiens
RTLEPNPVT

SEQ ID NO: 1369919 - protein, 9 aa, Homo Sapiens
ILTCSATGG

SEQ ID NO: 1369920 - protein, 9 aa, Homo Sapiens
AEDRCQTCP

SEQ ID NO: 1369921 - protein, 9 aa, Homo Sapiens
FRYMKLAYK

SEQ ID NO: 1369922 - protein, 9 aa, Homo Sapiens
INILYNDAA

SEQ ID NO: 1369923 - protein, 9 aa, Homo Sapiens
LAKSPGWKR

SEQ ID NO: 1369924 - protein, 9 aa, Homo Sapiens
QLTATDTAG

SEQ ID NO: 1369925 - protein, 9 aa, Homo Sapiens
TICECWREN

SEQ ID NO: 1369926 - protein, 9 aa, Homo Sapiens
GTARGGGNP

SEQ ID NO: 1369927 - protein, 9 aa, Homo Sapiens
SKVEAPGQL

SEQ ID NO: 1369928 - protein, 9 aa, Homo Sapiens
FFDMHMTVS

SEQ ID NO: 1369929 - protein, 9 aa, Homo Sapiens
YRDTKGPFL

SEQ ID NO: 1369930 - protein, 9 aa, Homo Sapiens
VTGDDFGTV

SEQ ID NO: 1369931 - protein, 9 aa, Homo Sapiens
DEESDLENL

SEQ ID NO: 1369932 - protein, 9 aa, Homo Sapiens
ILTDNCLCY

SEQ ID NO: 1369933 - protein, 9 aa, Homo Sapiens
LIWSRDQGF

SEQ ID NO: 1369934 - protein, 9 aa, Homo Sapiens
RLRCQSGSG

SEQ ID NO: 1369935 - protein, 9 aa, Homo Sapiens
ADPNFVTAV

SEQ ID NO: 1369936 - protein, 9 aa, Homo Sapiens
QLLSERLLR

SEQ ID NO: 1369937 - protein, 9 aa, Homo Sapiens
VADQEEVSG

SEQ ID NO: 1369938 - protein, 9 aa, Homo Sapiens
HSAGRMTFP

SEQ ID NO: 1369939 - protein, 9 aa, Homo Sapiens
APPGQAVSL

SEQ ID NO: 1369940 - protein, 9 aa, Homo Sapiens
DDPAIALLN

SEQ ID NO: 1369941 - protein, 9 aa, Homo Sapiens
EKCKTFILC

SEQ ID NO: 1369942 - protein, 9 aa, Homo Sapiens
QSVLCATGG

SEQ ID NO: 1369943 - protein, 9 aa, Homo Sapiens
KRSRAQERR

SEQ ID NO: 1369944 - protein, 9 aa, Homo Sapiens
MRTGEVRTA

SEQ ID NO: 1369945 - protein, 9 aa, Homo Sapiens
VAFGVELTE

SEQ ID NO: 1369946 - protein, 9 aa, Homo Sapiens
PCPLPATVG

SEQ ID NO: 1369947 - protein, 9 aa, Homo Sapiens
PAALPPALG

SEQ ID NO: 1369948 - protein, 9 aa, Homo Sapiens
SLQACVSKN

SEQ ID NO: 1369949 - protein, 9 aa, Homo Sapiens
LPMVLPSIH

SEQ ID NO: 1369950 - protein, 9 aa, Homo Sapiens
VHFSHITHP

SEQ ID NO: 1369951 - protein, 9 aa, Homo Sapiens
HFESDGLTS

SEQ ID NO: 1369952 - protein, 9 aa, Homo Sapiens
VLIGLCFRH

SEQ ID NO: 1369953 - protein, 9 aa, Homo Sapiens
LGCAGPSCF

SEQ ID NO: 1369954 - protein, 9 aa, Homo Sapiens
WNYRHTPPC

SEQ ID NO: 1369955 - protein, 9 aa, Homo Sapiens
VIISIVCMF

SEQ ID NO: 1369956 - protein, 9 aa, Homo Sapiens
STAALIFYY

SEQ ID NO: 1369957 - protein, 9 aa, Homo Sapiens
PDRPTGVGV

SEQ ID NO: 1369958 - protein, 9 aa, Homo Sapiens
SHLKAHLHW

SEQ ID NO: 1369959 - protein, 9 aa, Homo Sapiens
VAAGPPMRE

SEQ ID NO: 1369960 - protein, 9 aa, Homo Sapiens
VMPFRRQPG

SEQ ID NO: 1369961 - protein, 9 aa, Homo Sapiens
ASVSRWLQN

SEQ ID NO: 1369962 - protein, 9 aa, Homo Sapiens
RFCAWPSAI

SEQ ID NO: 1369963 - protein, 9 aa, Homo Sapiens
QNSTFGFRN

SEQ ID NO: 1369964 - protein, 9 aa, Homo Sapiens
ILHVCQNHV

SEQ ID NO: 1369965 - protein, 9 aa, Homo Sapiens
VAFRSSTKK

SEQ ID NO: 1369966 - protein, 9 aa, Homo Sapiens
AAGYCLPLG

SEQ ID NO: 1369967 - protein, 9 aa, Homo Sapiens
PDTANPCLI

SEQ ID NO: 1369968 - protein, 9 aa, Homo Sapiens
LKSRLKTID

SEQ ID NO: 1369969 - protein, 9 aa, Homo Sapiens
GYERFMPKS

SEQ ID NO: 1369970 - protein, 9 aa, Homo Sapiens
DCRDNTELP

SEQ ID NO: 1369971 - protein, 9 aa, Homo Sapiens
QHACFGLFG

SEQ ID NO: 1369972 - protein, 9 aa, Homo Sapiens
GQHTRGASG

SEQ ID NO: 1369973 - protein, 9 aa, Homo Sapiens
GSLLNHRHS

SEQ ID NO: 1369974 - protein, 9 aa, Homo Sapiens
PTDLDVAGP

SEQ ID NO: 1369975 - protein, 9 aa, Homo Sapiens
DVLTCLLLP

SEQ ID NO: 1369976 - protein, 9 aa, Homo Sapiens
TPDESSDQN

SEQ ID NO: 1369977 - protein, 9 aa, Homo Sapiens
PFTCFFRYM

SEQ ID NO: 1369978 - protein, 9 aa, Homo Sapiens
YPHLVAGVL

SEQ ID NO: 1369979 - protein, 9 aa, Homo Sapiens
GRDREARAA

SEQ ID NO: 1369980 - protein, 9 aa, Homo Sapiens
RHNGAYAMR

SEQ ID NO: 1369981 - protein, 9 aa, Homo Sapiens
HRRRAFTYQ

SEQ ID NO: 1369982 - protein, 9 aa, Homo Sapiens
GQATLCLQS

SEQ ID NO: 1369983 - protein, 9 aa, Homo Sapiens
NPVAVKPLA

SEQ ID NO: 1369984 - protein, 9 aa, Homo Sapiens
NLQEQLRDR

SEQ ID NO: 1369985 - protein, 9 aa, Homo Sapiens
RGEEYLGAF

SEQ ID NO: 1369986 - protein, 9 aa, Homo Sapiens
FVLVNLEVT

SEQ ID NO: 1369987 - protein, 9 aa, Homo Sapiens
AEGWDNEED

SEQ ID NO: 1369988 - protein, 9 aa, Homo Sapiens
SDSPPLQDG

SEQ ID NO: 1369989 - protein, 9 aa, Homo Sapiens
SWNIFRKDP

SEQ ID NO: 1369990 - protein, 9 aa, Homo Sapiens
QVPLSCETS

SEQ ID NO: 1369991 - protein, 9 aa, Homo Sapiens
FQMHDEGVL

SEQ ID NO: 1369992 - protein, 9 aa, Homo Sapiens
TLEPVVAIY

SEQ ID NO: 1369993 - protein, 9 aa, Homo Sapiens
SWSGDSCDG

SEQ ID NO: 1369994 - protein, 9 aa, Homo Sapiens
NVSTQSSGS

SEQ ID NO: 1369995 - protein, 9 aa, Homo Sapiens
QTWNIVQEH

SEQ ID NO: 1369996 - protein, 9 aa, Homo Sapiens
LGSSRLPRG

SEQ ID NO: 1369997 - protein, 9 aa, Homo Sapiens
AAGPPMREV

SEQ ID NO: 1369998 - protein, 9 aa, Homo Sapiens
CARPACAPV

SEQ ID NO: 1369999 - protein, 9 aa, Homo Sapiens
DFDGTPRLC

SEQ ID NO: 1370000 - protein, 9 aa, Homo Sapiens
RETRRRLGV

SEQ ID NO: 1370001 - protein, 9 aa, Homo Sapiens
HQAPQVAML

SEQ ID NO: 1370002 - protein, 9 aa, Homo Sapiens
LCVVRYVAS

SEQ ID NO: 1370003 - protein, 9 aa, Homo Sapiens
TLSINTIWK

SEQ ID NO: 1370004 - protein, 9 aa, Homo Sapiens
HVALYQGAY

SEQ ID NO: 1370005 - protein, 9 aa, Homo Sapiens
LLTIFHPKK

SEQ ID NO: 1370006 - protein, 9 aa, Homo Sapiens
PRARHFLPE

SEQ ID NO: 1370007 - protein, 9 aa, Homo Sapiens
PEMSIKYGT

SEQ ID NO: 1370008 - protein, 9 aa, Homo Sapiens
GHSDIDFAA

SEQ ID NO: 1370009 - protein, 9 aa, Homo Sapiens
LRPPRTCDS

SEQ ID NO: 1370010 - protein, 9 aa, Homo Sapiens
LLPLWNEGC

SEQ ID NO: 1370011 - protein, 9 aa, Homo Sapiens
RPKPMGVTW

SEQ ID NO: 1370012 - protein, 9 aa, Homo Sapiens
RWTLCGACC

SEQ ID NO: 1370013 - protein, 9 aa, Homo Sapiens
MKRKVVIKF

SEQ ID NO: 1370014 - protein, 9 aa, Homo Sapiens
SSEYTYRML

SEQ ID NO: 1370015 - protein, 9 aa, Homo Sapiens
GQPLVGRTR

SEQ ID NO: 1370016 - protein, 9 aa, Homo Sapiens
YTSDCFISY

SEQ ID NO: 1370017 - protein, 9 aa, Homo Sapiens
LPTCKGLFN

SEQ ID NO: 1370018 - protein, 9 aa, Homo Sapiens
RASRKTWQR

SEQ ID NO: 1370019 - protein, 9 aa, Homo Sapiens
TMCFLSLPR

SEQ ID NO: 1370020 - protein, 9 aa, Homo Sapiens
DVTLEQLPE

SEQ ID NO: 1370021 - protein, 9 aa, Homo Sapiens
QRSPIPQPR

SEQ ID NO: 1370022 - protein, 9 aa, Homo Sapiens
WRMSRLKGE

SEQ ID NO: 1370023 - protein, 9 aa, Homo Sapiens
YIGSRTFEH

SEQ ID NO: 1370024 - protein, 9 aa, Homo Sapiens
CLPALGSSR

SEQ ID NO: 1370025 - protein, 9 aa, Homo Sapiens
GRRPKRLRG

SEQ ID NO: 1370026 - protein, 9 aa, Homo Sapiens
AVSCFSTTT

SEQ ID NO: 1370027 - protein, 9 aa, Homo Sapiens
DRGILKTYS

SEQ ID NO: 1370028 - protein, 9 aa, Homo Sapiens
ESRYTSDCF

SEQ ID NO: 1370029 - protein, 9 aa, Homo Sapiens
LAAGTLVAV

SEQ ID NO: 1370030 - protein, 9 aa, Homo Sapiens
HHALSRLHL

SEQ ID NO: 1370031 - protein, 9 aa, Homo Sapiens
LGGVALRCD

SEQ ID NO: 1370032 - protein, 9 aa, Homo Sapiens
EAMAPAHVP

SEQ ID NO: 1370033 - protein, 9 aa, Homo Sapiens
PPHQMKCLT

SEQ ID NO: 1370034 - protein, 9 aa, Homo Sapiens
FWTYGSCCS

SEQ ID NO: 1370035 - protein, 9 aa, Homo Sapiens
FLFLIVSVL

SEQ ID NO: 1370036 - protein, 9 aa, Homo Sapiens
LVVTSLCKP

SEQ ID NO: 1370037 - protein, 9 aa, Homo Sapiens
RSSTAWCTS

SEQ ID NO: 1370038 - protein, 9 aa, Homo Sapiens
NASTQRSVW

SEQ ID NO: 1370039 - protein, 9 aa, Homo Sapiens
RVNNDNASC

SEQ ID NO: 1370040 - protein, 9 aa, Homo Sapiens
PGIPGHRGE

SEQ ID NO: 1370041 - protein, 9 aa, Homo Sapiens
KTHHCLLCP

SEQ ID NO: 1370042 - protein, 9 aa, Homo Sapiens
EVVEEENLA

SEQ ID NO: 1370043 - protein, 9 aa, Homo Sapiens
EDPVGTELI

SEQ ID NO: 1370044 - protein, 9 aa, Homo Sapiens
CSVSQTTLD

SEQ ID NO: 1370045 - protein, 9 aa, Homo Sapiens
RRPTQTAAG

SEQ ID NO: 1370046 - protein, 9 aa, Homo Sapiens
TRVDEYHIE

SEQ ID NO: 1370047 - protein, 9 aa, Homo Sapiens
PCPVDGGIY

SEQ ID NO: 1370048 - protein, 9 aa, Homo Sapiens
GCSGSFLYQ

SEQ ID NO: 1370049 - protein, 9 aa, Homo Sapiens
DLAKADEGR

SEQ ID NO: 1370050 - protein, 9 aa, Homo Sapiens
AVTLREEQH

SEQ ID NO: 1370051 - protein, 9 aa, Homo Sapiens
NNVSTQSSG

SEQ ID NO: 1370052 - protein, 9 aa, Homo Sapiens
RVHITLHDE

SEQ ID NO: 1370053 - protein, 9 aa, Homo Sapiens
AVSTATKKV

SEQ ID NO: 1370054 - protein, 9 aa, Homo Sapiens
SLSIMPAQT

SEQ ID NO: 1370055 - protein, 9 aa, Homo Sapiens
AVILHRKEG

SEQ ID NO: 1370056 - protein, 9 aa, Homo Sapiens
LVSVSACFL

SEQ ID NO: 1370057 - protein, 9 aa, Homo Sapiens
SGNKGVILF

SEQ ID NO: 1370058 - protein, 9 aa, Homo Sapiens
ADMTCHGEP

SEQ ID NO: 1370059 - protein, 9 aa, Homo Sapiens
AALHLQFYA

SEQ ID NO: 1370060 - protein, 9 aa, Homo Sapiens
HEAVGVRPY

SEQ ID NO: 1370061 - protein, 9 aa, Homo Sapiens
PPMHSGTFD

SEQ ID NO: 1370062 - protein, 9 aa, Homo Sapiens
RPWPRLSLV

SEQ ID NO: 1370063 - protein, 9 aa, Homo Sapiens
LVRRDAFLV

SEQ ID NO: 1370064 - protein, 9 aa, Homo Sapiens
DFVMMSRVM

SEQ ID NO: 1370065 - protein, 9 aa, Homo Sapiens
TDTRRPPAA

SEQ ID NO: 1370066 - protein, 9 aa, Homo Sapiens
KDDPAIALL

SEQ ID NO: 1370067 - protein, 9 aa, Homo Sapiens
YHFQGPMHG

SEQ ID NO: 1370068 - protein, 9 aa, Homo Sapiens
ICECWRENL

SEQ ID NO: 1370069 - protein, 9 aa, Homo Sapiens
ADCGCMLQI

SEQ ID NO: 1370070 - protein, 9 aa, Homo Sapiens
DCGCMLQIR

SEQ ID NO: 1370071 - protein, 9 aa, Homo Sapiens
RQVGSVGGL

SEQ ID NO: 1370072 - protein, 9 aa, Homo Sapiens
RSGGDWLAP

SEQ ID NO: 1370073 - protein, 9 aa, Homo Sapiens
SPRLRFCAW

SEQ ID NO: 1370074 - protein, 9 aa, Homo Sapiens
DKACSEGLY

SEQ ID NO: 1370075 - protein, 9 aa, Homo Sapiens
CFYTPAFFL

SEQ ID NO: 1370076 - protein, 9 aa, Homo Sapiens
LLEVFDLCM

SEQ ID NO: 1370077 - protein, 9 aa, Homo Sapiens
HGFAVGIPQ

SEQ ID NO: 1370078 - protein, 9 aa, Homo Sapiens
LIGKSYPTK

SEQ ID NO: 1370079 - protein, 9 aa, Homo Sapiens
RDTLNLMLL

SEQ ID NO: 1370080 - protein, 9 aa, Homo Sapiens
KMDLDGMLT

SEQ ID NO: 1370081 - protein, 9 aa, Homo Sapiens
GNNHLSQNS

SEQ ID NO: 1370082 - protein, 9 aa, Homo Sapiens
PGTWTPCDR

SEQ ID NO: 1370083 - protein, 9 aa, Homo Sapiens
KKAFRGLAE

SEQ ID NO: 1370084 - protein, 9 aa, Homo Sapiens
PCATRWPPR

SEQ ID NO: 1370085 - protein, 9 aa, Homo Sapiens
GKTDANSSS

SEQ ID NO: 1370086 - protein, 9 aa, Homo Sapiens
EGGTLIWPV

SEQ ID NO: 1370087 - protein, 9 aa, Homo Sapiens
QDLFARAGY

SEQ ID NO: 1370088 - protein, 9 aa, Homo Sapiens
LCLQSHRPP

SEQ ID NO: 1370089 - protein, 9 aa, Homo Sapiens
CEEDNAGRA

SEQ ID NO: 1370090 - protein, 9 aa, Homo Sapiens
YPLLLLLLI

SEQ ID NO: 1370091 - protein, 9 aa, Homo Sapiens
KSDLNTHNL

SEQ ID NO: 1370092 - protein, 9 aa, Homo Sapiens
CPASFCTFS

SEQ ID NO: 1370093 - protein, 9 aa, Homo Sapiens
QPLPRGFLR

SEQ ID NO: 1370094 - protein, 9 aa, Homo Sapiens
SLAAAPPPP

SEQ ID NO: 1370095 - protein, 9 aa, Homo Sapiens
VLQHEIETD

SEQ ID NO: 1370096 - protein, 9 aa, Homo Sapiens
VHQTSGDEL

SEQ ID NO: 1370097 - protein, 9 aa, Homo Sapiens
DLYSSGRNR

SEQ ID NO: 1370098 - protein, 9 aa, Homo Sapiens
CTNPASICD

SEQ ID NO: 1370099 - protein, 9 aa, Homo Sapiens
FATNFNEKI

SEQ ID NO: 1370100 - protein, 9 aa, Homo Sapiens
GDELVACSL

SEQ ID NO: 1370101 - protein, 9 aa, Homo Sapiens
EESLQACVS

SEQ ID NO: 1370102 - protein, 9 aa, Homo Sapiens
SMPFSTTPV

SEQ ID NO: 1370103 - protein, 9 aa, Homo Sapiens
LLVLALPLR

SEQ ID NO: 1370104 - protein, 9 aa, Homo Sapiens
KWCNVTQEK

SEQ ID NO: 1370105 - protein, 9 aa, Homo Sapiens
PLCTGHPEP

SEQ ID NO: 1370106 - protein, 9 aa, Homo Sapiens
ASPAPAQGQ

SEQ ID NO: 1370107 - protein, 9 aa, Homo Sapiens
NLDPDDNAR

SEQ ID NO: 1370108 - protein, 9 aa, Homo Sapiens
NIPAIQEKL

SEQ ID NO: 1370109 - protein, 9 aa, Homo Sapiens
EHGSRRESI

SEQ ID NO: 1370110 - protein, 9 aa, Homo Sapiens
WSCRTLEPN

SEQ ID NO: 1370111 - protein, 9 aa, Homo Sapiens
NFEIVNLLL

SEQ ID NO: 1370112 - protein, 9 aa, Homo Sapiens
FSTGLLDNL

SEQ ID NO: 1370113 - protein, 9 aa, Homo Sapiens
SRLKTIDIQ

SEQ ID NO: 1370114 - protein, 9 aa, Homo Sapiens
SGGRSGCSG

SEQ ID NO: 1370115 - protein, 9 aa, Homo Sapiens
KRVEAAQEM

SEQ ID NO: 1370116 - protein, 9 aa, Homo Sapiens
ATFVDSLSI

SEQ ID NO: 1370117 - protein, 9 aa, Homo Sapiens
RPPRTCDSR

SEQ ID NO: 1370118 - protein, 9 aa, Homo Sapiens
KCLTAVDCL

SEQ ID NO: 1370119 - protein, 9 aa, Homo Sapiens
LCPFLHFIQ

SEQ ID NO: 1370120 - protein, 9 aa, Homo Sapiens
WGGAVILHR

SEQ ID NO: 1370121 - protein, 9 aa, Homo Sapiens
GYVGWHPRV

SEQ ID NO: 1370122 - protein, 9 aa, Homo Sapiens
ALPHAGPPG

SEQ ID NO: 1370123 - protein, 9 aa, Homo Sapiens
WGAAPRAGR

SEQ ID NO: 1370124 - protein, 9 aa, Homo Sapiens
PLQPPRVCR

SEQ ID NO: 1370125 - protein, 9 aa, Homo Sapiens
YRQNRSSLY

SEQ ID NO: 1370126 - protein, 9 aa, Homo Sapiens
FSWNLCLPA

SEQ ID NO: 1370127 - protein, 9 aa, Homo Sapiens
HPVAEAGGA

SEQ ID NO: 1370128 - protein, 9 aa, Homo Sapiens
PAQTTVPDG

SEQ ID NO: 1370129 - protein, 9 aa, Homo Sapiens
DKKKFKTKT

SEQ ID NO: 1370130 - protein, 9 aa, Homo Sapiens
SARMPAQLF

SEQ ID NO: 1370131 - protein, 9 aa, Homo Sapiens
QQVANENRL

SEQ ID NO: 1370132 - protein, 9 aa, Homo Sapiens
QDCVRLEGR

SEQ ID NO: 1370133 - protein, 9 aa, Homo Sapiens
VHLVQQCVL

SEQ ID NO: 1370134 - protein, 9 aa, Homo Sapiens
EEEPVELRG

SEQ ID NO: 1370135 - protein, 9 aa, Homo Sapiens
LTSGHLPPS

SEQ ID NO: 1370136 - protein, 9 aa, Homo Sapiens
YGAPIIGFV

SEQ ID NO: 1370137 - protein, 9 aa, Homo Sapiens
ACWPKDVGF

SEQ ID NO: 1370138 - protein, 9 aa, Homo Sapiens
DQASHCRCA

SEQ ID NO: 1370139 - protein, 9 aa, Homo Sapiens
TEELLGKYL

SEQ ID NO: 1370140 - protein, 9 aa, Homo Sapiens
TPGSQTIMP

SEQ ID NO: 1370141 - protein, 9 aa, Homo Sapiens
KPQMALELM

SEQ ID NO: 1370142 - protein, 9 aa, Homo Sapiens
QWLRPQCPA

SEQ ID NO: 1370143 - protein, 9 aa, Homo Sapiens
CSQNFCPEV

SEQ ID NO: 1370144 - protein, 9 aa, Homo Sapiens
KIEAEPWQR

SEQ ID NO: 1370145 - protein, 9 aa, Homo Sapiens
DSGHYCCVV

SEQ ID NO: 1370146 - protein, 9 aa, Homo Sapiens
DSCSVLIKN

SEQ ID NO: 1370147 - protein, 9 aa, Homo Sapiens
GLWSQRHLP

SEQ ID NO: 1370148 - protein, 9 aa, Homo Sapiens
RFKHINNSA

SEQ ID NO: 1370149 - protein, 9 aa, Homo Sapiens
NSNSNSSNS

SEQ ID NO: 1370150 - protein, 9 aa, Homo Sapiens
TEDDEWEKN

SEQ ID NO: 1370151 - protein, 9 aa, Homo Sapiens
AAHNTYHHC

SEQ ID NO: 1370152 - protein, 9 aa, Homo Sapiens
TEDNPNLLM

SEQ ID NO: 1370153 - protein, 9 aa, Homo Sapiens
KILQIRGYV

SEQ ID NO: 1370154 - protein, 9 aa, Homo Sapiens
YTIAPNSHF

SEQ ID NO: 1370155 - protein, 9 aa, Homo Sapiens
DGYYQKMQC

SEQ ID NO: 1370156 - protein, 9 aa, Homo Sapiens
WCNVTQEKS

SEQ ID NO: 1370157 - protein, 9 aa, Homo Sapiens
VGTARIWNE

SEQ ID NO: 1370158 - protein, 9 aa, Homo Sapiens
PVGCRPLCP

SEQ ID NO: 1370159 - protein, 9 aa, Homo Sapiens
SPTRMAGRR

SEQ ID NO: 1370160 - protein, 9 aa, Homo Sapiens
VGSGLCKGS

SEQ ID NO: 1370161 - protein, 9 aa, Homo Sapiens
RGRCLVALG

SEQ ID NO: 1370162 - protein, 9 aa, Homo Sapiens
GPSISIPAA

SEQ ID NO: 1370163 - protein, 9 aa, Homo Sapiens
KPSSLPASQ

SEQ ID NO: 1370164 - protein, 9 aa, Homo Sapiens
LIYSFKQGN

SEQ ID NO: 1370165 - protein, 9 aa, Homo Sapiens
STYQYVETS

SEQ ID NO: 1370166 - protein, 9 aa, Homo Sapiens
IASKVSDPL

SEQ ID NO: 1370167 - protein, 9 aa, Homo Sapiens
LAESEGMKA

SEQ ID NO: 1370168 - protein, 9 aa, Homo Sapiens
APIFQLLSG

SEQ ID NO: 1370169 - protein, 9 aa, Homo Sapiens
NWLAARIAE

SEQ ID NO: 1370170 - protein, 9 aa, Homo Sapiens
SKQKVSEET

SEQ ID NO: 1370171 - protein, 9 aa, Homo Sapiens
KVPVEKQVF

SEQ ID NO: 1370172 - protein, 9 aa, Homo Sapiens
FQLFSGKDQ

SEQ ID NO: 1370173 - protein, 9 aa, Homo Sapiens
PCPDCPKSL

SEQ ID NO: 1370174 - protein, 9 aa, Homo Sapiens
KYFQCLFHR

SEQ ID NO: 1370175 - protein, 9 aa, Homo Sapiens
GPMIIHCIA

SEQ ID NO: 1370176 - protein, 9 aa, Homo Sapiens
STSSNFLLA

SEQ ID NO: 1370177 - protein, 9 aa, Homo Sapiens
TCPLDSGSP

SEQ ID NO: 1370178 - protein, 9 aa, Homo Sapiens
GDESIPIMY

SEQ ID NO: 1370179 - protein, 9 aa, Homo Sapiens
QRERKNARA

SEQ ID NO: 1370180 - protein, 9 aa, Homo Sapiens
LNHRHSHET

SEQ ID NO: 1370181 - protein, 9 aa, Homo Sapiens
SDLVPQNYH

SEQ ID NO: 1370182 - protein, 9 aa, Homo Sapiens
VLDLCFDVL

SEQ ID NO: 1370183 - protein, 9 aa, Homo Sapiens
QKMELDEAW

SEQ ID NO: 1370184 - protein, 9 aa, Homo Sapiens
RACARPACA

SEQ ID NO: 1370185 - protein, 9 aa, Homo Sapiens
LYITTIVEM

SEQ ID NO: 1370186 - protein, 9 aa, Homo Sapiens
PPPHQMKCL

SEQ ID NO: 1370187 - protein, 9 aa, Homo Sapiens
HSDIDFAAD

SEQ ID NO: 1370188 - protein, 9 aa, Homo Sapiens
MNDATGDLD

SEQ ID NO: 1370189 - protein, 9 aa, Homo Sapiens
MCGLCKPPP

SEQ ID NO: 1370190 - protein, 9 aa, Homo Sapiens
GMSRGAVKF

SEQ ID NO: 1370191 - protein, 9 aa, Homo Sapiens
RVPFVKGCA

SEQ ID NO: 1370192 - protein, 9 aa, Homo Sapiens
SSGEGCPVS

SEQ ID NO: 1370193 - protein, 9 aa, Homo Sapiens
GGSRVSQRP

SEQ ID NO: 1370194 - protein, 9 aa, Homo Sapiens
CILAGDRCH

SEQ ID NO: 1370195 - protein, 9 aa, Homo Sapiens
RRLETSPTE

SEQ ID NO: 1370196 - protein, 9 aa, Homo Sapiens
RPNYRLQVS

SEQ ID NO: 1370197 - protein, 9 aa, Homo Sapiens
LNGVTRLHF

SEQ ID NO: 1370198 - protein, 9 aa, Homo Sapiens
YQVQGGLFL

SEQ ID NO: 1370199 - protein, 9 aa, Homo Sapiens
LNGVTRLHL

SEQ ID NO: 1370200 - protein, 9 aa, Homo Sapiens
ANAQGETKR

SEQ ID NO: 1370201 - protein, 9 aa, Homo Sapiens
LVLLTSGHL

SEQ ID NO: 1370202 - protein, 9 aa, Homo Sapiens
IRHITQQVE

SEQ ID NO: 1370203 - protein, 9 aa, Homo Sapiens
CHRDLKPED

SEQ ID NO: 1370204 - protein, 9 aa, Homo Sapiens
HLLCEKDGK

SEQ ID NO: 1370205 - protein, 9 aa, Homo Sapiens
VCRRRWRRV

SEQ ID NO: 1370206 - protein, 9 aa, Homo Sapiens
ESPGHPGSC

SEQ ID NO: 1370207 - protein, 9 aa, Homo Sapiens
VTVRISHTL

SEQ ID NO: 1370208 - protein, 9 aa, Homo Sapiens
WVITLALAA

SEQ ID NO: 1370209 - protein, 9 aa, Homo Sapiens
RTGPWKTKL

SEQ ID NO: 1370210 - protein, 9 aa, Homo Sapiens
GQHTHGPLR

SEQ ID NO: 1370211 - protein, 9 aa, Homo Sapiens
ETYDEDDAA

SEQ ID NO: 1370212 - protein, 9 aa, Homo Sapiens
DYAFTAIST

SEQ ID NO: 1370213 - protein, 9 aa, Homo Sapiens
LHGPYHFQG

SEQ ID NO: 1370214 - protein, 9 aa, Homo Sapiens
TGDDFGTVK

SEQ ID NO: 1370215 - protein, 9 aa, Homo Sapiens
MVKSLKKVM

SEQ ID NO: 1370216 - protein, 9 aa, Homo Sapiens
ALRGYVGWH

SEQ ID NO: 1370217 - protein, 9 aa, Homo Sapiens
SVTGLDLKG

SEQ ID NO: 1370218 - protein, 9 aa, Homo Sapiens
RRQPVLQAR

SEQ ID NO: 1370219 - protein, 9 aa, Homo Sapiens
RFKRPQPTR

SEQ ID NO: 1370220 - protein, 9 aa, Homo Sapiens
TFFFLHKEF

SEQ ID NO: 1370221 - protein, 9 aa, Homo Sapiens
HGCQGGLPG

SEQ ID NO: 1370222 - protein, 9 aa, Homo Sapiens
EVKSSTPAQ

SEQ ID NO: 1370223 - protein, 9 aa, Homo Sapiens
SICDGDNDC

SEQ ID NO: 1370224 - protein, 9 aa, Homo Sapiens
PLGLCSAQP

SEQ ID NO: 1370225 - protein, 9 aa, Homo Sapiens
LTRTMLSVR

SEQ ID NO: 1370226 - protein, 9 aa, Homo Sapiens
ELDEAWEDL

SEQ ID NO: 1370227 - protein, 9 aa, Homo Sapiens
KAYTNHCIG

SEQ ID NO: 1370228 - protein, 9 aa, Homo Sapiens
WPRLSLVVT

SEQ ID NO: 1370229 - protein, 9 aa, Homo Sapiens
PRSPSPPQQ

SEQ ID NO: 1370230 - protein, 9 aa, Homo Sapiens
NSVCQGQRF

SEQ ID NO: 1370231 - protein, 9 aa, Homo Sapiens
CKPSSLPAS

SEQ ID NO: 1370232 - protein, 9 aa, Homo Sapiens
DLHPTSETE

SEQ ID NO: 1370233 - protein, 9 aa, Homo Sapiens
PVLGEDEVG

SEQ ID NO: 1370234 - protein, 9 aa, Homo Sapiens
DNPNLLMAQ

SEQ ID NO: 1370235 - protein, 9 aa, Homo Sapiens
LCYPSKLAA

SEQ ID NO: 1370236 - protein, 9 aa, Homo Sapiens
RHEMLPAGL

SEQ ID NO: 1370237 - protein, 9 aa, Homo Sapiens
FLSDLSFVD

SEQ ID NO: 1370238 - protein, 9 aa, Homo Sapiens
YTQAWAPTS

SEQ ID NO: 1370239 - protein, 9 aa, Homo Sapiens
TGSFLSCAV

SEQ ID NO: 1370240 - protein, 9 aa, Homo Sapiens
HGYYMAVGT

SEQ ID NO: 1370241 - protein, 9 aa, Homo Sapiens
QGDSDGPLM

SEQ ID NO: 1370242 - protein, 9 aa, Homo Sapiens
RADRLLRGL

SEQ ID NO: 1370243 - protein, 9 aa, Homo Sapiens
VFGVDLALL

SEQ ID NO: 1370244 - protein, 9 aa, Homo Sapiens
CHRPGLGGQ

SEQ ID NO: 1370245 - protein, 9 aa, Homo Sapiens
QAVPHRLAT

SEQ ID NO: 1370246 - protein, 9 aa, Homo Sapiens
CAWPSAISP

SEQ ID NO: 1370247 - protein, 9 aa, Homo Sapiens
VYSDDKPER

SEQ ID NO: 1370248 - protein, 9 aa, Homo Sapiens
TKEGCHKKK

SEQ ID NO: 1370249 - protein, 9 aa, Homo Sapiens
DAEDEEGQT

SEQ ID NO: 1370250 - protein, 9 aa, Homo Sapiens
LKTIDIQAT

SEQ ID NO: 1370251 - protein, 9 aa, Homo Sapiens
APAIVTLGL

SEQ ID NO: 1370252 - protein, 9 aa, Homo Sapiens
RPFTCFFRY

SEQ ID NO: 1370253 - protein, 9 aa, Homo Sapiens
CGWRSTGPL

SEQ ID NO: 1370254 - protein, 9 aa, Homo Sapiens
SGICLSDEY

SEQ ID NO: 1370255 - protein, 9 aa, Homo Sapiens
AWMNVLPYL

SEQ ID NO: 1370256 - protein, 9 aa, Homo Sapiens
QLPESVLQD

SEQ ID NO: 1370257 - protein, 9 aa, Homo Sapiens
EISRLVHIQ

SEQ ID NO: 1370258 - protein, 9 aa, Homo Sapiens
RLLHHQAHS

SEQ ID NO: 1370259 - protein, 9 aa, Homo Sapiens
LSGSFTNLA

SEQ ID NO: 1370260 - protein, 9 aa, Homo Sapiens
SLFVKDFVM

SEQ ID NO: 1370261 - protein, 9 aa, Homo Sapiens
AHTQQGHVH

SEQ ID NO: 1370262 - protein, 9 aa, Homo Sapiens
RGYERIPVP

SEQ ID NO: 1370263 - protein, 9 aa, Homo Sapiens
CPCPSSWCV

SEQ ID NO: 1370264 - protein, 9 aa, Homo Sapiens
YLRWMTPDS

SEQ ID NO: 1370265 - protein, 9 aa, Homo Sapiens
VRMPVLFDV

SEQ ID NO: 1370266 - protein, 9 aa, Homo Sapiens
LPKHRELRV

SEQ ID NO: 1370267 - protein, 9 aa, Homo Sapiens
DSGSPEGVV

SEQ ID NO: 1370268 - protein, 9 aa, Homo Sapiens
LPPPSLPLP

SEQ ID NO: 1370269 - protein, 9 aa, Homo Sapiens
TVDLEAFLA

SEQ ID NO: 1370270 - protein, 9 aa, Homo Sapiens
NRQEDAHML

SEQ ID NO: 1370271 - protein, 9 aa, Homo Sapiens
NFTQGNCVN

SEQ ID NO: 1370272 - protein, 9 aa, Homo Sapiens
LGMGVGSGL

SEQ ID NO: 1370273 - protein, 9 aa, Homo Sapiens
TGLHLEGDG

SEQ ID NO: 1370274 - protein, 9 aa, Homo Sapiens
RGGGLRPQE

SEQ ID NO: 1370275 - protein, 9 aa, Homo Sapiens
GCVSHGADV

SEQ ID NO: 1370276 - protein, 9 aa, Homo Sapiens
SGGALLAPA

SEQ ID NO: 1370277 - protein, 9 aa, Homo Sapiens
CLHEDLHPT

SEQ ID NO: 1370278 - protein, 9 aa, Homo Sapiens
GLPASRTTA

SEQ ID NO: 1370279 - protein, 9 aa, Homo Sapiens
TKRARGCWW

SEQ ID NO: 1370280 - protein, 9 aa, Homo Sapiens
KGQACEQLA

SEQ ID NO: 1370281 - protein, 9 aa, Homo Sapiens
ISTVEILLK

SEQ ID NO: 1370282 - protein, 9 aa, Homo Sapiens
PKLLCRQML

SEQ ID NO: 1370283 - protein, 9 aa, Homo Sapiens
YNIGNVCHA

SEQ ID NO: 1370284 - protein, 9 aa, Homo Sapiens
PPQQTPNGA

SEQ ID NO: 1370285 - protein, 9 aa, Homo Sapiens
STATLSCLG

SEQ ID NO: 1370286 - protein, 9 aa, Homo Sapiens
GPLCSCCIP

SEQ ID NO: 1370287 - protein, 9 aa, Homo Sapiens
AEVHQTSGD

SEQ ID NO: 1370288 - protein, 9 aa, Homo Sapiens
HNSPEMKVY

SEQ ID NO: 1370289 - protein, 9 aa, Homo Sapiens
IGQEVRMPV

SEQ ID NO: 1370290 - protein, 9 aa, Homo Sapiens
ARKVQRRNL

SEQ ID NO: 1370291 - protein, 9 aa, Homo Sapiens
KSFRSTRAT

SEQ ID NO: 1370292 - protein, 9 aa, Homo Sapiens
KRYEAQKPE

SEQ ID NO: 1370293 - protein, 9 aa, Homo Sapiens
MSRGAVKFG

SEQ ID NO: 1370294 - protein, 9 aa, Homo Sapiens
ADLAHILTH

SEQ ID NO: 1370295 - protein, 9 aa, Homo Sapiens
PLPPPGQRV

SEQ ID NO: 1370296 - protein, 9 aa, Homo Sapiens
SSELFKFTI

SEQ ID NO: 1370297 - protein, 9 aa, Homo Sapiens
IDATPSAPL

SEQ ID NO: 1370298 - protein, 9 aa, Homo Sapiens
QSSGSQQAW

SEQ ID NO: 1370299 - protein, 9 aa, Homo Sapiens
QQSWWRKLF

SEQ ID NO: 1370300 - protein, 9 aa, Homo Sapiens
APLQVTTTL

SEQ ID NO: 1370301 - protein, 9 aa, Homo Sapiens
PHSHCLYYL

SEQ ID NO: 1370302 - protein, 9 aa, Homo Sapiens
RLGRVMCSM

SEQ ID NO: 1370303 - protein, 9 aa, Homo Sapiens
ALEAAKIEK

SEQ ID NO: 1370304 - protein, 9 aa, Homo Sapiens
AHIGSGEMG

SEQ ID NO: 1370305 - protein, 9 aa, Homo Sapiens
TFEKKGGKK

SEQ ID NO: 1370306 - protein, 9 aa, Homo Sapiens
EEKANKAIT

SEQ ID NO: 1370307 - protein, 9 aa, Homo Sapiens
FKHINNSAR

SEQ ID NO: 1370308 - protein, 9 aa, Homo Sapiens
NQGSTNSDR

SEQ ID NO: 1370309 - protein, 9 aa, Homo Sapiens
VITAAAIGS

SEQ ID NO: 1370310 - protein, 9 aa, Homo Sapiens
MELPVGCRP

SEQ ID NO: 1370311 - protein, 9 aa, Homo Sapiens
LEGIEHMYQ

SEQ ID NO: 1370312 - protein, 9 aa, Homo Sapiens
SRCRRRRCF

SEQ ID NO: 1370313 - protein, 9 aa, Homo Sapiens
QMQKVDQYL

SEQ ID NO: 1370314 - protein, 9 aa, Homo Sapiens
AIMCGLCKP

SEQ ID NO: 1370315 - protein, 9 aa, Homo Sapiens
LNTDISILP

SEQ ID NO: 1370316 - protein, 9 aa, Homo Sapiens
FLPLGSGGP

SEQ ID NO: 1370317 - protein, 9 aa, Homo Sapiens
QVQDARTGQ

SEQ ID NO: 1370318 - protein, 9 aa, Homo Sapiens
IHKVTKVLN

SEQ ID NO: 1370319 - protein, 9 aa, Homo Sapiens
LRDSPSSQP

SEQ ID NO: 1370320 - protein, 9 aa, Homo Sapiens
PVLQARRPA

SEQ ID NO: 1370321 - protein, 9 aa, Homo Sapiens
SEGMKAVLR

SEQ ID NO: 1370322 - protein, 9 aa, Homo Sapiens
MTVSKPEQW

SEQ ID NO: 1370323 - protein, 9 aa, Homo Sapiens
IHKVADPWG

SEQ ID NO: 1370324 - protein, 9 aa, Homo Sapiens
RGVVTAGKV

SEQ ID NO: 1370325 - protein, 9 aa, Homo Sapiens
LPPSSSQSA

SEQ ID NO: 1370326 - protein, 9 aa, Homo Sapiens
CLRIHCVAK

SEQ ID NO: 1370327 - protein, 9 aa, Homo Sapiens
APHQKVLAP

SEQ ID NO: 1370328 - protein, 9 aa, Homo Sapiens
RSQRCPGYY

SEQ ID NO: 1370329 - protein, 9 aa, Homo Sapiens
ESFSKQCES

SEQ ID NO: 1370330 - protein, 9 aa, Homo Sapiens
LVKVFRNEG

SEQ ID NO: 1370331 - protein, 9 aa, Homo Sapiens
AFDVHNHRW

SEQ ID NO: 1370332 - protein, 9 aa, Homo Sapiens
LRTSHEARG

SEQ ID NO: 1370333 - protein, 9 aa, Homo Sapiens
FKIRCTEPS

SEQ ID NO: 1370334 - protein, 9 aa, Homo Sapiens
SWCVAGPSV

SEQ ID NO: 1370335 - protein, 9 aa, Homo Sapiens
SSVGDTSRP

SEQ ID NO: 1370336 - protein, 9 aa, Homo Sapiens
RELGGRADR

SEQ ID NO: 1370337 - protein, 9 aa, Homo Sapiens
VGNHPMHQQ

SEQ ID NO: 1370338 - protein, 9 aa, Homo Sapiens
AHVGGNVTS

SEQ ID NO: 1370339 - protein, 9 aa, Homo Sapiens
GSSRLPRGP

SEQ ID NO: 1370340 - protein, 9 aa, Homo Sapiens
IVSRDTSKL

SEQ ID NO: 1370341 - protein, 9 aa, Homo Sapiens
TATDTAGQR

SEQ ID NO: 1370342 - protein, 9 aa, Homo Sapiens
RTLQRVGVY

SEQ ID NO: 1370343 - protein, 9 aa, Homo Sapiens
YRRHCGATV

SEQ ID NO: 1370344 - protein, 9 aa, Homo Sapiens
NRVGRQERG

SEQ ID NO: 1370345 - protein, 9 aa, Homo Sapiens
RPIQVQTGG

SEQ ID NO: 1370346 - protein, 9 aa, Homo Sapiens
AAEEAEQHQ

SEQ ID NO: 1370347 - protein, 9 aa, Homo Sapiens
PQSVLCATG

SEQ ID NO: 1370348 - protein, 9 aa, Homo Sapiens
TLFKSARMP

SEQ ID NO: 1370349 - protein, 9 aa, Homo Sapiens
LYSLEFIKM

SEQ ID NO: 1370350 - protein, 9 aa, Homo Sapiens
FIPLAKSTW

SEQ ID NO: 1370351 - protein, 9 aa, Homo Sapiens
SGAEMDRAP

SEQ ID NO: 1370352 - protein, 9 aa, Homo Sapiens
AHHVLFIAL

SEQ ID NO: 1370353 - protein, 9 aa, Homo Sapiens
IMCGLCKPP

SEQ ID NO: 1370354 - protein, 9 aa, Homo Sapiens
LLLIVLCAL

SEQ ID NO: 1370355 - protein, 9 aa, Homo Sapiens
KYNVENQEY

SEQ ID NO: 1370356 - protein, 9 aa, Homo Sapiens
KKIKAQKMC

SEQ ID NO: 1370357 - protein, 9 aa, Homo Sapiens
LDILDGVTG

SEQ ID NO: 1370358 - protein, 9 aa, Homo Sapiens
PQRDSVFRL

SEQ ID NO: 1370359 - protein, 9 aa, Homo Sapiens
FGGRRRQRR

SEQ ID NO: 1370360 - protein, 9 aa, Homo Sapiens
WTISHAGHV

SEQ ID NO: 1370361 - protein, 9 aa, Homo Sapiens
LPRGFLREH

SEQ ID NO: 1370362 - protein, 9 aa, Homo Sapiens
NTVLRQLDM

SEQ ID NO: 1370363 - protein, 9 aa, Homo Sapiens
NRGNECSQR

SEQ ID NO: 1370364 - protein, 9 aa, Homo Sapiens
LQNYTIAPN

SEQ ID NO: 1370365 - protein, 9 aa, Homo Sapiens
GNNTKLKEW

SEQ ID NO: 1370366 - protein, 9 aa, Homo Sapiens
GTNISNHGD

SEQ ID NO: 1370367 - protein, 9 aa, Homo Sapiens
RRPLQTLLS

SEQ ID NO: 1370368 - protein, 9 aa, Homo Sapiens
VMMTHQLPS

SEQ ID NO: 1370369 - protein, 9 aa, Homo Sapiens
LLRCICKFL

SEQ ID NO: 1370370 - protein, 9 aa, Homo Sapiens
LWGDTGRPH

SEQ ID NO: 1370371 - protein, 9 aa, Homo Sapiens
ESSWSGDSC

SEQ ID NO: 1370372 - protein, 9 aa, Homo Sapiens
PPGQRVIHV

SEQ ID NO: 1370373 - protein, 9 aa, Homo Sapiens
RPAIHRAHR

SEQ ID NO: 1370374 - protein, 9 aa, Homo Sapiens
PFFNDLEDC

SEQ ID NO: 1370375 - protein, 9 aa, Homo Sapiens
ETKRARGCW

SEQ ID NO: 1370376 - protein, 9 aa, Homo Sapiens
VLFDVALPL

SEQ ID NO: 1370377 - protein, 9 aa, Homo Sapiens
DRQRELREL

SEQ ID NO: 1370378 - protein, 9 aa, Homo Sapiens
ANENRLSMS

SEQ ID NO: 1370379 - protein, 9 aa, Homo Sapiens
NVLPYLSAV

SEQ ID NO: 1370380 - protein, 9 aa, Homo Sapiens
TCQKKKELD

SEQ ID NO: 1370381 - protein, 9 aa, Homo Sapiens
SHYRVLWDD

SEQ ID NO: 1370382 - protein, 9 aa, Homo Sapiens
AVAIANGGG

SEQ ID NO: 1370383 - protein, 9 aa, Homo Sapiens
KPKWCNVTQ

SEQ ID NO: 1370384 - protein, 9 aa, Homo Sapiens
LLDLSLDIP

SEQ ID NO: 1370385 - protein, 9 aa, Homo Sapiens
KNEAGYTKR

SEQ ID NO: 1370386 - protein, 9 aa, Homo Sapiens
FDSEGNYIL

SEQ ID NO: 1370387 - protein, 9 aa, Homo Sapiens
LFSVRHRSL

SEQ ID NO: 1370388 - protein, 9 aa, Homo Sapiens
VFYEQDMKV

SEQ ID NO: 1370389 - protein, 9 aa, Homo Sapiens
HRVIHTGEK

SEQ ID NO: 1370390 - protein, 9 aa, Homo Sapiens
LHPTSETEY

SEQ ID NO: 1370391 - protein, 9 aa, Homo Sapiens
PVTRRSQQP

SEQ ID NO: 1370392 - protein, 9 aa, Homo Sapiens
LDPDSMDDE

SEQ ID NO: 1370393 - protein, 9 aa, Homo Sapiens
TQNSFADCG

SEQ ID NO: 1370394 - protein, 9 aa, Homo Sapiens
SAVSGGSRV

SEQ ID NO: 1370395 - protein, 9 aa, Homo Sapiens
QGDPELQPT

SEQ ID NO: 1370396 - protein, 9 aa, Homo Sapiens
LFVRNLAAT

SEQ ID NO: 1370397 - protein, 9 aa, Homo Sapiens
LMDGSGGDI

SEQ ID NO: 1370398 - protein, 9 aa, Homo Sapiens
GGPGCCHSS

SEQ ID NO: 1370399 - protein, 9 aa, Homo Sapiens
NQNRDGTYE

SEQ ID NO: 1370400 - protein, 9 aa, Homo Sapiens
RALCSQRRL

SEQ ID NO: 1370401 - protein, 9 aa, Homo Sapiens
IAQTTHQQC

SEQ ID NO: 1370402 - protein, 9 aa, Homo Sapiens
LGGHAAICP

SEQ ID NO: 1370403 - protein, 9 aa, Homo Sapiens
KDVGFVALE

SEQ ID NO: 1370404 - protein, 9 aa, Homo Sapiens
VPKHLTMCF

SEQ ID NO: 1370405 - protein, 9 aa, Homo Sapiens
FSFIPLAKS

SEQ ID NO: 1370406 - protein, 9 aa, Homo Sapiens
EGAQEQVPV

SEQ ID NO: 1370407 - protein, 9 aa, Homo Sapiens
PGRRRKHPP

SEQ ID NO: 1370408 - protein, 9 aa, Homo Sapiens
VSLFAQVRR

SEQ ID NO: 1370409 - protein, 9 aa, Homo Sapiens
THKLEPWLR

SEQ ID NO: 1370410 - protein, 9 aa, Homo Sapiens
EPLTATANY

SEQ ID NO: 1370411 - protein, 9 aa, Homo Sapiens
SSAHLPGQD

SEQ ID NO: 1370412 - protein, 9 aa, Homo Sapiens
TSSETGGCC

SEQ ID NO: 1370413 - protein, 9 aa, Homo Sapiens
LQRSPIPQP

SEQ ID NO: 1370414 - protein, 9 aa, Homo Sapiens
VDVKMAIQQ

SEQ ID NO: 1370415 - protein, 9 aa, Homo Sapiens
LMSLFVKDF

SEQ ID NO: 1370416 - protein, 9 aa, Homo Sapiens
LSPGLSPEE

SEQ ID NO: 1370417 - protein, 9 aa, Homo Sapiens
AIMVGFWPE

SEQ ID NO: 1370418 - protein, 9 aa, Homo Sapiens
LTRWHHMRG

SEQ ID NO: 1370419 - protein, 9 aa, Homo Sapiens
GLVVRTVHE

SEQ ID NO: 1370420 - protein, 9 aa, Homo Sapiens
LIPKAPKKT

SEQ ID NO: 1370421 - protein, 9 aa, Homo Sapiens
SRPTTAPPA

SEQ ID NO: 1370422 - protein, 9 aa, Homo Sapiens
CDECGNTFR

SEQ ID NO: 1370423 - protein, 9 aa, Homo Sapiens
TTPNVCSLC

SEQ ID NO: 1370424 - protein, 9 aa, Homo Sapiens
EYSSSSSGP

SEQ ID NO: 1370425 - protein, 9 aa, Homo Sapiens
VTAVLSKLR

SEQ ID NO: 1370426 - protein, 9 aa, Homo Sapiens
WLNLLLEYP

SEQ ID NO: 1370427 - protein, 9 aa, Homo Sapiens
EPGSGVSVV

SEQ ID NO: 1370428 - protein, 9 aa, Homo Sapiens
GVSVVLITT

SEQ ID NO: 1370429 - protein, 9 aa, Homo Sapiens
SNMDRSWKI

SEQ ID NO: 1370430 - protein, 9 aa, Homo Sapiens
LAAIELTLV

SEQ ID NO: 1370431 - protein, 9 aa, Homo Sapiens
ARIIGEKSL

SEQ ID NO: 1370432 - protein, 9 aa, Homo Sapiens
FYEAPIFTT

SEQ ID NO: 1370433 - protein, 9 aa, Homo Sapiens
LHVGIELGY

SEQ ID NO: 1370434 - protein, 9 aa, Homo Sapiens
REVTGRTAQ

SEQ ID NO: 1370435 - protein, 9 aa, Homo Sapiens
AAALPHHLP

SEQ ID NO: 1370436 - protein, 9 aa, Homo Sapiens
IAVFSVTVP

SEQ ID NO: 1370437 - protein, 9 aa, Homo Sapiens
VMSVGMYMD

SEQ ID NO: 1370438 - protein, 9 aa, Homo Sapiens
THLAAMDVN

SEQ ID NO: 1370439 - protein, 9 aa, Homo Sapiens
PKARNTKKE

SEQ ID NO: 1370440 - protein, 9 aa, Homo Sapiens
PHIALLGSL

SEQ ID NO: 1370441 - protein, 9 aa, Homo Sapiens
EPPLEKLQV

SEQ ID NO: 1370442 - protein, 9 aa, Homo Sapiens
HLMEKKINN

SEQ ID NO: 1370443 - protein, 9 aa, Homo Sapiens
DVPAHSLGA

SEQ ID NO: 1370444 - protein, 9 aa, Homo Sapiens
YFDKAVTLR

SEQ ID NO: 1370445 - protein, 9 aa, Homo Sapiens
VVRYVASSL

SEQ ID NO: 1370446 - protein, 9 aa, Homo Sapiens
IQFASRQNL

SEQ ID NO: 1370447 - protein, 9 aa, Homo Sapiens
REYFKITIY

SEQ ID NO: 1370448 - protein, 9 aa, Homo Sapiens
GLGSKGKIA

SEQ ID NO: 1370449 - protein, 9 aa, Homo Sapiens
SQLIPEECG

SEQ ID NO: 1370450 - protein, 9 aa, Homo Sapiens
IPHGHPPPP

SEQ ID NO: 1370451 - protein, 9 aa, Homo Sapiens
REARAAHRR

SEQ ID NO: 1370452 - protein, 9 aa, Homo Sapiens
QEELQQVQC

SEQ ID NO: 1370453 - protein, 9 aa, Homo Sapiens
GTIGPLYVF

SEQ ID NO: 1370454 - protein, 9 aa, Homo Sapiens
LLIGKSYPT

SEQ ID NO: 1370455 - protein, 9 aa, Homo Sapiens
PERPKRWGQ

SEQ ID NO: 1370456 - protein, 9 aa, Homo Sapiens
SNHGDLSLQ

SEQ ID NO: 1370457 - protein, 9 aa, Homo Sapiens
QGSTNSDRG

SEQ ID NO: 1370458 - protein, 9 aa, Homo Sapiens
ARGCWWGQL

SEQ ID NO: 1370459 - protein, 9 aa, Homo Sapiens
LQSTRRVQH

SEQ ID NO: 1370460 - protein, 9 aa, Homo Sapiens
MQARSFSDS

SEQ ID NO: 1370461 - protein, 9 aa, Homo Sapiens
EANRSIVPT

SEQ ID NO: 1370462 - protein, 9 aa, Homo Sapiens
QHTHGPLRA

SEQ ID NO: 1370463 - protein, 9 aa, Homo Sapiens
SQKKPKKQK

SEQ ID NO: 1370464 - protein, 9 aa, Homo Sapiens
EHWKTKKEL

SEQ ID NO: 1370465 - protein, 9 aa, Homo Sapiens
KRIRNILDV

SEQ ID NO: 1370466 - protein, 9 aa, Homo Sapiens
IKEVIGHGS

SEQ ID NO: 1370467 - protein, 9 aa, Homo Sapiens
SGKVHALQP

SEQ ID NO: 1370468 - protein, 9 aa, Homo Sapiens
VAYFRFDMN

SEQ ID NO: 1370469 - protein, 9 aa, Homo Sapiens
TLKSCRRQL

SEQ ID NO: 1370470 - protein, 9 aa, Homo Sapiens
VSACFLEET

SEQ ID NO: 1370471 - protein, 9 aa, Homo Sapiens
ESNMDIYLM

SEQ ID NO: 1370472 - protein, 9 aa, Homo Sapiens
NLADTHPFF

SEQ ID NO: 1370473 - protein, 9 aa, Homo Sapiens
QPLPTRFKR

SEQ ID NO: 1370474 - protein, 9 aa, Homo Sapiens
GQTVPHQAQ

SEQ ID NO: 1370475 - protein, 9 aa, Homo Sapiens
RGPPQLPSI

SEQ ID NO: 1370476 - protein, 9 aa, Homo Sapiens
VPEPAAPPH

SEQ ID NO: 1370477 - protein, 9 aa, Homo Sapiens
HPVFLIQLL

SEQ ID NO: 1370478 - protein, 9 aa, Homo Sapiens
NHEDSTYYY

SEQ ID NO: 1370479 - protein, 9 aa, Homo Sapiens
PPWGLQRTS

SEQ ID NO: 1370480 - protein, 9 aa, Homo Sapiens
SSRLPRGPP

SEQ ID NO: 1370481 - protein, 9 aa, Homo Sapiens
SCVWNCHRY

SEQ ID NO: 1370482 - protein, 9 aa, Homo Sapiens
NVTILNGLG

SEQ ID NO: 1370483 - protein, 9 aa, Homo Sapiens
IYSEHNYCR

SEQ ID NO: 1370484 - protein, 9 aa, Homo Sapiens
SVMRSCHTA

SEQ ID NO: 1370485 - protein, 9 aa, Homo Sapiens
KLVKVRTDS

SEQ ID NO: 1370486 - protein, 9 aa, Homo Sapiens
AAVVMVVRP

SEQ ID NO: 1370487 - protein, 9 aa, Homo Sapiens
LSVWCYYCQ

SEQ ID NO: 1370488 - protein, 9 aa, Homo Sapiens
SAICNKWEI

SEQ ID NO: 1370489 - protein, 9 aa, Homo Sapiens
LPLGLHLFL

SEQ ID NO: 1370490 - protein, 9 aa, Homo Sapiens
SPVPCHLSD

SEQ ID NO: 1370491 - protein, 9 aa, Homo Sapiens
ILGKVLIGL

SEQ ID NO: 1370492 - protein, 9 aa, Homo Sapiens
SSLVVQVLQ

SEQ ID NO: 1370493 - protein, 9 aa, Homo Sapiens
NFVANTCRL

SEQ ID NO: 1370494 - protein, 9 aa, Homo Sapiens
AVHFPQVVK

SEQ ID NO: 1370495 - protein, 9 aa, Homo Sapiens
CFVLSPRDR

SEQ ID NO: 1370496 - protein, 9 aa, Homo Sapiens
SQRKRQKQK

SEQ ID NO: 1370497 - protein, 9 aa, Homo Sapiens
NYLREVSIT

SEQ ID NO: 1370498 - protein, 9 aa, Homo Sapiens
APYRQKMHP

SEQ ID NO: 1370499 - protein, 9 aa, Homo Sapiens
ALEGASKDL

SEQ ID NO: 1370500 - protein, 9 aa, Homo Sapiens
RNLAATVTE

SEQ ID NO: 1370501 - protein, 9 aa, Homo Sapiens
LMCCLFVNL

SEQ ID NO: 1370502 - protein, 9 aa, Homo Sapiens
KAGMATHFQ

SEQ ID NO: 1370503 - protein, 9 aa, Homo Sapiens
NGTSVVLQH

SEQ ID NO: 1370504 - protein, 9 aa, Homo Sapiens
PTSDTPKVS

SEQ ID NO: 1370505 - protein, 9 aa, Homo Sapiens
RESKVIQWA

SEQ ID NO: 1370506 - protein, 9 aa, Homo Sapiens
ALGRLRGRR

SEQ ID NO: 1370507 - protein, 9 aa, Homo Sapiens
VLQARRPAR

SEQ ID NO: 1370508 - protein, 9 aa, Homo Sapiens
EATAPCASL

SEQ ID NO: 1370509 - protein, 9 aa, Homo Sapiens
GVPIGGRFD

SEQ ID NO: 1370510 - protein, 9 aa, Homo Sapiens
GLLGPPGHR

SEQ ID NO: 1370511 - protein, 9 aa, Homo Sapiens
GRSQGLPAS

SEQ ID NO: 1370512 - protein, 9 aa, Homo Sapiens
GFQRAVKKV

SEQ ID NO: 1370513 - protein, 9 aa, Homo Sapiens
NTDSIHWCG

SEQ ID NO: 1370514 - protein, 9 aa, Homo Sapiens
SESFSKQCE

SEQ ID NO: 1370515 - protein, 9 aa, Homo Sapiens
GKDQCPASA

SEQ ID NO: 1370516 - protein, 9 aa, Homo Sapiens
SGGKWRRQP

SEQ ID NO: 1370517 - protein, 9 aa, Homo Sapiens
PLVLQLISF

SEQ ID NO: 1370518 - protein, 9 aa, Homo Sapiens
MDLDGMLTV

SEQ ID NO: 1370519 - protein, 9 aa, Homo Sapiens
DKKKKKKKI

SEQ ID NO: 1370520 - protein, 9 aa, Homo Sapiens
SPERPKRWG

SEQ ID NO: 1370521 - protein, 9 aa, Homo Sapiens
YCWKGMTLE

SEQ ID NO: 1370522 - protein, 9 aa, Homo Sapiens
GLASECLHE

SEQ ID NO: 1370523 - protein, 9 aa, Homo Sapiens
YMYPEYQNR

SEQ ID NO: 1370524 - protein, 9 aa, Homo Sapiens
AFDKVHFSH

SEQ ID NO: 1370525 - protein, 9 aa, Homo Sapiens
MGKNVHELE

SEQ ID NO: 1370526 - protein, 9 aa, Homo Sapiens
PVVSGVSQP

SEQ ID NO: 1370527 - protein, 9 aa, Homo Sapiens
ALDSPTSTA

SEQ ID NO: 1370528 - protein, 9 aa, Homo Sapiens
GPLVLQLIS

SEQ ID NO: 1370529 - protein, 9 aa, Homo Sapiens
ILAAIELTL

SEQ ID NO: 1370530 - protein, 9 aa, Homo Sapiens
KKRGTIILT

SEQ ID NO: 1370531 - protein, 9 aa, Homo Sapiens
KPCPVDGGI

SEQ ID NO: 1370532 - protein, 9 aa, Homo Sapiens
PKPMGVTWF

SEQ ID NO: 1370533 - protein, 9 aa, Homo Sapiens
SSAHHVLFI

SEQ ID NO: 1370534 - protein, 9 aa, Homo Sapiens
LHQRGQHDD

SEQ ID NO: 1370535 - protein, 9 aa, Homo Sapiens
GYSEVYLDC

SEQ ID NO: 1370536 - protein, 9 aa, Homo Sapiens
VHFPQVVKE

SEQ ID NO: 1370537 - protein, 9 aa, Homo Sapiens
PMGPGNLNT

SEQ ID NO: 1370538 - protein, 9 aa, Homo Sapiens
LCRKQGMEV

SEQ ID NO: 1370539 - protein, 9 aa, Homo Sapiens
ICPQLLQRG

SEQ ID NO: 1370540 - protein, 9 aa, Homo Sapiens
GQWKGRAPH

SEQ ID NO: 1370541 - protein, 9 aa, Homo Sapiens
PAQPYLRVS

SEQ ID NO: 1370542 - protein, 9 aa, Homo Sapiens
GSRGHLHAH

SEQ ID NO: 1370543 - protein, 9 aa, Homo Sapiens
IGLTLTTLL

SEQ ID NO: 1370544 - protein, 9 aa, Homo Sapiens
MAVVPIVIG

SEQ ID NO: 1370545 - protein, 9 aa, Homo Sapiens
LDPDDNARK

SEQ ID NO: 1370546 - protein, 9 aa, Homo Sapiens
TVVVGSRSF

SEQ ID NO: 1370547 - protein, 9 aa, Homo Sapiens
SMREPGLLI

SEQ ID NO: 1370548 - protein, 9 aa, Homo Sapiens
IERDGAKSL

SEQ ID NO: 1370549 - protein, 9 aa, Homo Sapiens
YVVVNFITF

SEQ ID NO: 1370550 - protein, 9 aa, Homo Sapiens
GMYMDSCSV

SEQ ID NO: 1370551 - protein, 9 aa, Homo Sapiens
RLLRPNGVQ

SEQ ID NO: 1370552 - protein, 9 aa, Homo Sapiens
FGTSRLVAS

SEQ ID NO: 1370553 - protein, 9 aa, Homo Sapiens
RGNRSLCGL

SEQ ID NO: 1370554 - protein, 9 aa, Homo Sapiens
TALLPPRAT

SEQ ID NO: 1370555 - protein, 9 aa, Homo Sapiens
DPSDIICVT

SEQ ID NO: 1370556 - protein, 9 aa, Homo Sapiens
HYMCQLCKS

SEQ ID NO: 1370557 - protein, 9 aa, Homo Sapiens
LLLLLIVLC

SEQ ID NO: 1370558 - protein, 9 aa, Homo Sapiens
KVQIQRITD

SEQ ID NO: 1370559 - protein, 9 aa, Homo Sapiens
TAVLSKLRF

SEQ ID NO: 1370560 - protein, 9 aa, Homo Sapiens
EVSTPGTRC

SEQ ID NO: 1370561 - protein, 9 aa, Homo Sapiens
RPGAGPEEA

SEQ ID NO: 1370562 - protein, 9 aa, Homo Sapiens
LLKSGEVKK

SEQ ID NO: 1370563 - protein, 9 aa, Homo Sapiens
DCHQLAASW

SEQ ID NO: 1370564 - protein, 9 aa, Homo Sapiens
DLKDQIVDP

SEQ ID NO: 1370565 - protein, 9 aa, Homo Sapiens
TRNLDPDDN

SEQ ID NO: 1370566 - protein, 9 aa, Homo Sapiens
KCGASYAPV

SEQ ID NO: 1370567 - protein, 9 aa, Homo Sapiens
WKDVPVERV

SEQ ID NO: 1370568 - protein, 9 aa, Homo Sapiens
PTPGVNSSA

SEQ ID NO: 1370569 - protein, 9 aa, Homo Sapiens
STARVVPTR

SEQ ID NO: 1370570 - protein, 9 aa, Homo Sapiens
TTPGRTYPV

SEQ ID NO: 1370571 - protein, 9 aa, Homo Sapiens
SCLIMGLVY

SEQ ID NO: 1370572 - protein, 9 aa, Homo Sapiens
GTAQKSQRK

SEQ ID NO: 1370573 - protein, 9 aa, Homo Sapiens
ENRLSMSES

SEQ ID NO: 1370574 - protein, 9 aa, Homo Sapiens
HCLLCPKTI

SEQ ID NO: 1370575 - protein, 9 aa, Homo Sapiens
PAARASPAW

SEQ ID NO: 1370576 - protein, 9 aa, Homo Sapiens
RTSIIDSTV

SEQ ID NO: 1370577 - protein, 9 aa, Homo Sapiens
QCLLSAPTT

SEQ ID NO: 1370578 - protein, 9 aa, Homo Sapiens
ASICDGDND

SEQ ID NO: 1370579 - protein, 9 aa, Homo Sapiens
GGEPAGQHA

SEQ ID NO: 1370580 - protein, 9 aa, Homo Sapiens
TPMYFFLAT

SEQ ID NO: 1370581 - protein, 9 aa, Homo Sapiens
MALYSLEFI

SEQ ID NO: 1370582 - protein, 9 aa, Homo Sapiens
GLEKNHCRN

SEQ ID NO: 1370583 - protein, 9 aa, Homo Sapiens
IQRPIQVQT

SEQ ID NO: 1370584 - protein, 9 aa, Homo Sapiens
QGGLPGQAF

SEQ ID NO: 1370585 - protein, 9 aa, Homo Sapiens
GAGAGLGCV

SEQ ID NO: 1370586 - protein, 9 aa, Homo Sapiens
GPACTVDSS

SEQ ID NO: 1370587 - protein, 9 aa, Homo Sapiens
PSRNLLLIG

SEQ ID NO: 1370588 - protein, 9 aa, Homo Sapiens
ITPPPHQMK

SEQ ID NO: 1370589 - protein, 9 aa, Homo Sapiens
QDETHKLEP

SEQ ID NO: 1370590 - protein, 9 aa, Homo Sapiens
HGDLSLQEA

SEQ ID NO: 1370591 - protein, 9 aa, Homo Sapiens
AEFAKQQSW

SEQ ID NO: 1370592 - protein, 9 aa, Homo Sapiens
FHRPLRCCL

SEQ ID NO: 1370593 - protein, 9 aa, Homo Sapiens
PRGPPQLPS

SEQ ID NO: 1370594 - protein, 9 aa, Homo Sapiens
LEVSFNPDC

SEQ ID NO: 1370595 - protein, 9 aa, Homo Sapiens
KGSLVHSDA

SEQ ID NO: 1370596 - protein, 9 aa, Homo Sapiens
IRHSQRLRG

SEQ ID NO: 1370597 - protein, 9 aa, Homo Sapiens
FPRELSSFW

SEQ ID NO: 1370598 - protein, 9 aa, Homo Sapiens
PTSETEYQV

SEQ ID NO: 1370599 - protein, 9 aa, Homo Sapiens
RFEDLTTRR

SEQ ID NO: 1370600 - protein, 9 aa, Homo Sapiens
TAACILKGL

SEQ ID NO: 1370601 - protein, 9 aa, Homo Sapiens
TPVSGPVRL

SEQ ID NO: 1370602 - protein, 9 aa, Homo Sapiens
LAIGNGMRS

SEQ ID NO: 1370603 - protein, 9 aa, Homo Sapiens
VEHCAKEAE

SEQ ID NO: 1370604 - protein, 9 aa, Homo Sapiens
FLDVVVRQG

SEQ ID NO: 1370605 - protein, 9 aa, Homo Sapiens
SQQPQPHRH

SEQ ID NO: 1370606 - protein, 9 aa, Homo Sapiens
CRPTLCPWT

SEQ ID NO: 1370607 - protein, 9 aa, Homo Sapiens
IATGQTDNI

SEQ ID NO: 1370608 - protein, 9 aa, Homo Sapiens
PHPTPTSDT

SEQ ID NO: 1370609 - protein, 9 aa, Homo Sapiens
KCCPSSWMT

SEQ ID NO: 1370610 - protein, 9 aa, Homo Sapiens
VAIANGGGV

SEQ ID NO: 1370611 - protein, 9 aa, Homo Sapiens
CARQEEGTR

SEQ ID NO: 1370612 - protein, 9 aa, Homo Sapiens
MWSPKERWE

SEQ ID NO: 1370613 - protein, 9 aa, Homo Sapiens
LPPCATRWP

SEQ ID NO: 1370614 - protein, 9 aa, Homo Sapiens
IPEECGAVG

SEQ ID NO: 1370615 - protein, 9 aa, Homo Sapiens
TEISLCGWR

SEQ ID NO: 1370616 - protein, 9 aa, Homo Sapiens
RGLAELVEF

SEQ ID NO: 1370617 - protein, 9 aa, Homo Sapiens
NPCPFPFSL

SEQ ID NO: 1370618 - protein, 9 aa, Homo Sapiens
RHSHETGQY

SEQ ID NO: 1370619 - protein, 9 aa, Homo Sapiens
RELQRKGGP

SEQ ID NO: 1370620 - protein, 9 aa, Homo Sapiens
MKLAYKKAI

SEQ ID NO: 1370621 - protein, 9 aa, Homo Sapiens
VSMEEQRQE

SEQ ID NO: 1370622 - protein, 9 aa, Homo Sapiens
SIPAAKPAA

SEQ ID NO: 1370623 - protein, 9 aa, Homo Sapiens
IDRIEPASV

SEQ ID NO: 1370624 - protein, 9 aa, Homo Sapiens
WGQLSLQVT

SEQ ID NO: 1370625 - protein, 9 aa, Homo Sapiens
ASSSTCSPP

SEQ ID NO: 1370626 - protein, 9 aa, Homo Sapiens
LGKVLIGLC

SEQ ID NO: 1370627 - protein, 9 aa, Homo Sapiens
DTGNNNWVP

SEQ ID NO: 1370628 - protein, 9 aa, Homo Sapiens
ARNAEEKAN

SEQ ID NO: 1370629 - protein, 9 aa, Homo Sapiens
TSDNLQVWG

SEQ ID NO: 1370630 - protein, 9 aa, Homo Sapiens
SPSSAASRR

SEQ ID NO: 1370631 - protein, 9 aa, Homo Sapiens
GLAVVKFFL

SEQ ID NO: 1370632 - protein, 9 aa, Homo Sapiens
PLLTHQVFN

SEQ ID NO: 1370633 - protein, 9 aa, Homo Sapiens
HENMDQIRN

SEQ ID NO: 1370634 - protein, 9 aa, Homo Sapiens
LPRLGFADL

SEQ ID NO: 1370635 - protein, 9 aa, Homo Sapiens
FEERTESEL

SEQ ID NO: 1370636 - protein, 9 aa, Homo Sapiens
AAVGEPGFF

SEQ ID NO: 1370637 - protein, 9 aa, Homo Sapiens
GAGPEEAAG

SEQ ID NO: 1370638 - protein, 9 aa, Homo Sapiens
NTIWKSTVM

SEQ ID NO: 1370639 - protein, 9 aa, Homo Sapiens
TSGYLSPEV

SEQ ID NO: 1370640 - protein, 9 aa, Homo Sapiens
ENCVYVVNI

SEQ ID NO: 1370641 - protein, 9 aa, Homo Sapiens
PMPTTPVQA

SEQ ID NO: 1370642 - protein, 9 aa, Homo Sapiens
LLLALSFAS

SEQ ID NO: 1370643 - protein, 9 aa, Homo Sapiens
AEGSVEETR

SEQ ID NO: 1370644 - protein, 9 aa, Homo Sapiens
DPDSMDDEF

SEQ ID NO: 1370645 - protein, 9 aa, Homo Sapiens
VHEHFNLNV

SEQ ID NO: 1370646 - protein, 9 aa, Homo Sapiens
KETVALILK

SEQ ID NO: 1370647 - protein, 9 aa, Homo Sapiens
IGEKLFMEM

SEQ ID NO: 1370648 - protein, 9 aa, Homo Sapiens
IAVDVFLVL

SEQ ID NO: 1370649 - protein, 9 aa, Homo Sapiens
DLQCAKLLN

SEQ ID NO: 1370650 - protein, 9 aa, Homo Sapiens
MHYMCQLCK

SEQ ID NO: 1370651 - protein, 9 aa, Homo Sapiens
EPVELRGQE

SEQ ID NO: 1370652 - protein, 9 aa, Homo Sapiens
RGNECSQRF

SEQ ID NO: 1370653 - protein, 9 aa, Homo Sapiens
SSSQSAGIT

SEQ ID NO: 1370654 - protein, 9 aa, Homo Sapiens
QCKTCASHI

SEQ ID NO: 1370655 - protein, 9 aa, Homo Sapiens
SAPLHKPEM

SEQ ID NO: 1370656 - protein, 9 aa, Homo Sapiens
QTHTLEKQI

SEQ ID NO: 1370657 - protein, 9 aa, Homo Sapiens
GPSRVRGEA

SEQ ID NO: 1370658 - protein, 9 aa, Homo Sapiens
RALRGYVGW

SEQ ID NO: 1370659 - protein, 9 aa, Homo Sapiens
LHQFIEKKI

SEQ ID NO: 1370660 - protein, 9 aa, Homo Sapiens
LPDSPRSAF

SEQ ID NO: 1370661 - protein, 9 aa, Homo Sapiens
QKMQCDQSS

SEQ ID NO: 1370662 - protein, 9 aa, Homo Sapiens
NRKNKETIR

SEQ ID NO: 1370663 - protein, 9 aa, Homo Sapiens
KVVGPACAV

SEQ ID NO: 1370664 - protein, 9 aa, Homo Sapiens
THSAGRMTF

SEQ ID NO: 1370665 - protein, 9 aa, Homo Sapiens
SLPLTFTDS

SEQ ID NO: 1370666 - protein, 9 aa, Homo Sapiens
HEKLGFPGA

SEQ ID NO: 1370667 - protein, 9 aa, Homo Sapiens
LAATVTEEI

SEQ ID NO: 1370668 - protein, 9 aa, Homo Sapiens
KNFTQGNCV

SEQ ID NO: 1370669 - protein, 9 aa, Homo Sapiens
PDCPKSLCY

SEQ ID NO: 1370670 - protein, 9 aa, Homo Sapiens
ATDTAGQRS

SEQ ID NO: 1370671 - protein, 9 aa, Homo Sapiens
EFAKQQSWW

SEQ ID NO: 1370672 - protein, 9 aa, Homo Sapiens
LVREVTGRT

SEQ ID NO: 1370673 - protein, 9 aa, Homo Sapiens
SSRESDNHS

SEQ ID NO: 1370674 - protein, 9 aa, Homo Sapiens
WFRDTLNLM

SEQ ID NO: 1370675 - protein, 9 aa, Homo Sapiens
DSEEVEGAA

SEQ ID NO: 1370676 - protein, 9 aa, Homo Sapiens
ERLLRPNGV

SEQ ID NO: 1370677 - protein, 9 aa, Homo Sapiens
PNRKLIYSF

SEQ ID NO: 1370678 - protein, 9 aa, Homo Sapiens
TSQGLWNRS

SEQ ID NO: 1370679 - protein, 9 aa, Homo Sapiens
HKLQPIPPG

SEQ ID NO: 1370680 - protein, 9 aa, Homo Sapiens
EEAEQHQGP

SEQ ID NO: 1370681 - protein, 9 aa, Homo Sapiens
RCCSPCCQP

SEQ ID NO: 1370682 - protein, 9 aa, Homo Sapiens
VEELRPNPD

SEQ ID NO: 1370683 - protein, 9 aa, Homo Sapiens
KNLSEARYK

SEQ ID NO: 1370684 - protein, 9 aa, Homo Sapiens
SFIPLAKST

SEQ ID NO: 1370685 - protein, 9 aa, Homo Sapiens
ALRTRRPAG

SEQ ID NO: 1370686 - protein, 9 aa, Homo Sapiens
VTVMEPAHA

SEQ ID NO: 1370687 - protein, 9 aa, Homo Sapiens
REEEPPLEK

SEQ ID NO: 1370688 - protein, 9 aa, Homo Sapiens
TVEVTSLLR

SEQ ID NO: 1370689 - protein, 9 aa, Homo Sapiens
NVLVNESKT

SEQ ID NO: 1370690 - protein, 9 aa, Homo Sapiens
GTCSIWSTC

SEQ ID NO: 1370691 - protein, 9 aa, Homo Sapiens
QPGIAVFCI

SEQ ID NO: 1370692 - protein, 9 aa, Homo Sapiens
KRPKPMGVT

SEQ ID NO: 1370693 - protein, 9 aa, Homo Sapiens
VGVYGQKQI

SEQ ID NO: 1370694 - protein, 9 aa, Homo Sapiens
GATAQIQRP

SEQ ID NO: 1370695 - protein, 9 aa, Homo Sapiens
ARGTFLKNQ

SEQ ID NO: 1370696 - protein, 9 aa, Homo Sapiens
PSPAQPYLR

SEQ ID NO: 1370697 - protein, 9 aa, Homo Sapiens
GPGLAFIAH

SEQ ID NO: 1370698 - protein, 9 aa, Homo Sapiens
TLSLTTGSF

SEQ ID NO: 1370699 - protein, 9 aa, Homo Sapiens
CFRHLDLLL

SEQ ID NO: 1370700 - protein, 9 aa, Homo Sapiens
HMTVSKPEQ

SEQ ID NO: 1370701 - protein, 9 aa, Homo Sapiens
TLQRVGVYG

SEQ ID NO: 1370702 - protein, 9 aa, Homo Sapiens
QKQRVAAWL

SEQ ID NO: 1370703 - protein, 9 aa, Homo Sapiens
LQPEGRSSS

SEQ ID NO: 1370704 - protein, 9 aa, Homo Sapiens
DDAAFCLEM

SEQ ID NO: 1370705 - protein, 9 aa, Homo Sapiens
HRHSHETGQ

SEQ ID NO: 1370706 - protein, 9 aa, Homo Sapiens
ASMPFSTTP

SEQ ID NO: 1370707 - protein, 9 aa, Homo Sapiens
SLAGLVLLT

SEQ ID NO: 1370708 - protein, 9 aa, Homo Sapiens
SSPSPAQPY

SEQ ID NO: 1370709 - protein, 9 aa, Homo Sapiens
PRLLDPDSM

SEQ ID NO: 1370710 - protein, 9 aa, Homo Sapiens
PIKRRHVSS

SEQ ID NO: 1370711 - protein, 9 aa, Homo Sapiens
TAPRRHGLS

SEQ ID NO: 1370712 - protein, 9 aa, Homo Sapiens
ANIQASVSR

SEQ ID NO: 1370713 - protein, 9 aa, Homo Sapiens
RWPSGRRPK

SEQ ID NO: 1370714 - protein, 9 aa, Homo Sapiens
PIRLTLGTC

SEQ ID NO: 1370715 - protein, 9 aa, Homo Sapiens
PPAAPAGPQ

SEQ ID NO: 1370716 - protein, 9 aa, Homo Sapiens
TGFYVGWAE

SEQ ID NO: 1370717 - protein, 9 aa, Homo Sapiens
MHGILTEQR

SEQ ID NO: 1370718 - protein, 9 aa, Homo Sapiens
LLERLQAQQ

SEQ ID NO: 1370719 - protein, 9 aa, Homo Sapiens
QDLVLRPPA

SEQ ID NO: 1370720 - protein, 9 aa, Homo Sapiens
QIIVNTVNQ

SEQ ID NO: 1370721 - protein, 9 aa, Homo Sapiens
SPAKEGHQM

SEQ ID NO: 1370722 - protein, 9 aa, Homo Sapiens
VLKVVGPAC

SEQ ID NO: 1370723 - protein, 9 aa, Homo Sapiens
MNLTLSLTT

SEQ ID NO: 1370724 - protein, 9 aa, Homo Sapiens
TGLDLKGDG

SEQ ID NO: 1370725 - protein, 9 aa, Homo Sapiens
DLRKKVVEE

SEQ ID NO: 1370726 - protein, 9 aa, Homo Sapiens
RTDSDRWSL

SEQ ID NO: 1370727 - protein, 9 aa, Homo Sapiens
GVLLVMHNF

SEQ ID NO: 1370728 - protein, 9 aa, Homo Sapiens
PPPPAAPAA

SEQ ID NO: 1370729 - protein, 9 aa, Homo Sapiens
SSCAPVFLQ

SEQ ID NO: 1370730 - protein, 9 aa, Homo Sapiens
LQEASSGAS

SEQ ID NO: 1370731 - protein, 9 aa, Homo Sapiens
PPPPAAPAG

SEQ ID NO: 1370732 - protein, 9 aa, Homo Sapiens
RIKGDQYIV

SEQ ID NO: 1370733 - protein, 9 aa, Homo Sapiens
GTSVMRSCH

SEQ ID NO: 1370734 - protein, 9 aa, Homo Sapiens
PMVLPSIHQ

SEQ ID NO: 1370735 - protein, 9 aa, Homo Sapiens
VIRLRFKRP

SEQ ID NO: 1370736 - protein, 9 aa, Homo Sapiens
EEPDSCIGE

SEQ ID NO: 1370737 - protein, 9 aa, Homo Sapiens
KPTLDPIIA

SEQ ID NO: 1370738 - protein, 9 aa, Homo Sapiens
WTVAQCKTC

SEQ ID NO: 1370739 - protein, 9 aa, Homo Sapiens
IRKPCPVDG

SEQ ID NO: 1370740 - protein, 9 aa, Homo Sapiens
SGTSVMRSC

SEQ ID NO: 1370741 - protein, 9 aa, Homo Sapiens
LRALRPLHA

SEQ ID NO: 1370742 - protein, 9 aa, Homo Sapiens
NPHLRNEPC

SEQ ID NO: 1370743 - protein, 9 aa, Homo Sapiens
SGSPPGSLL

SEQ ID NO: 1370744 - protein, 9 aa, Homo Sapiens
PFRRQPGLL

SEQ ID NO: 1370745 - protein, 9 aa, Homo Sapiens
GRAPHGPVT

SEQ ID NO: 1370746 - protein, 9 aa, Homo Sapiens
DNVLVNESK

SEQ ID NO: 1370747 - protein, 9 aa, Homo Sapiens
EVEGAAGGV

SEQ ID NO: 1370748 - protein, 9 aa, Homo Sapiens
ARTGQSLVV

SEQ ID NO: 1370749 - protein, 9 aa, Homo Sapiens
FFTLLLSWE

SEQ ID NO: 1370750 - protein, 9 aa, Homo Sapiens
QVDASSCLG

SEQ ID NO: 1370751 - protein, 9 aa, Homo Sapiens
YRSGVPGGK

SEQ ID NO: 1370752 - protein, 9 aa, Homo Sapiens
VLKFLDPSF

SEQ ID NO: 1370753 - protein, 9 aa, Homo Sapiens
RPANFFCIF

SEQ ID NO: 1370754 - protein, 9 aa, Homo Sapiens
HHWQEGLGE

SEQ ID NO: 1370755 - protein, 9 aa, Homo Sapiens
AHPPLPPAH

SEQ ID NO: 1370756 - protein, 9 aa, Homo Sapiens
SEARLDTLT

SEQ ID NO: 1370757 - protein, 9 aa, Homo Sapiens
LKLFVAIAI

SEQ ID NO: 1370758 - protein, 9 aa, Homo Sapiens
IFQMHDEGV

SEQ ID NO: 1370759 - protein, 9 aa, Homo Sapiens
REEPTEIKE

SEQ ID NO: 1370760 - protein, 9 aa, Homo Sapiens
ITIDRIEPA

SEQ ID NO: 1370761 - protein, 9 aa, Homo Sapiens
EPHKFYVHI

SEQ ID NO: 1370762 - protein, 9 aa, Homo Sapiens
SLLLVLALP

SEQ ID NO: 1370763 - protein, 9 aa, Homo Sapiens
VFVAFRSST

SEQ ID NO: 1370764 - protein, 9 aa, Homo Sapiens
CCNRHSIVF

SEQ ID NO: 1370765 - protein, 9 aa, Homo Sapiens
STAWSMAPS

SEQ ID NO: 1370766 - protein, 9 aa, Homo Sapiens
VCMFLADLI

SEQ ID NO: 1370767 - protein, 9 aa, Homo Sapiens
KVHFSHITH

SEQ ID NO: 1370768 - protein, 9 aa, Homo Sapiens
RAHRESKVI

SEQ ID NO: 1370769 - protein, 9 aa, Homo Sapiens
NQNQLSVMY

SEQ ID NO: 1370770 - protein, 9 aa, Homo Sapiens
AAQKCHKKT

SEQ ID NO: 1370771 - protein, 9 aa, Homo Sapiens
RQVQDARTG

SEQ ID NO: 1370772 - protein, 9 aa, Homo Sapiens
VALPAPAFF

SEQ ID NO: 1370773 - protein, 9 aa, Homo Sapiens
NSPEMKVYM

SEQ ID NO: 1370774 - protein, 9 aa, Homo Sapiens
VRRHPASCL

SEQ ID NO: 1370775 - protein, 9 aa, Homo Sapiens
SKERQSYKE

SEQ ID NO: 1370776 - protein, 9 aa, Homo Sapiens
WASSKVEAP

SEQ ID NO: 1370777 - protein, 9 aa, Homo Sapiens
PPSGSPPGS

SEQ ID NO: 1370778 - protein, 9 aa, Homo Sapiens
PPPVTPLRV

SEQ ID NO: 1370779 - protein, 9 aa, Homo Sapiens
LLLIGKSYP

SEQ ID NO: 1370780 - protein, 9 aa, Homo Sapiens
IQANVVPTM

SEQ ID NO: 1370781 - protein, 9 aa, Homo Sapiens
GTLVAVVLM

SEQ ID NO: 1370782 - protein, 9 aa, Homo Sapiens
AAQEADAIS

SEQ ID NO: 1370783 - protein, 9 aa, Homo Sapiens
NIRTGPWKT

SEQ ID NO: 1370784 - protein, 9 aa, Homo Sapiens
DSIIVIYNS

SEQ ID NO: 1370785 - protein, 9 aa, Homo Sapiens
TIPNGDIYC

SEQ ID NO: 1370786 - protein, 9 aa, Homo Sapiens
GRGECGKAF

SEQ ID NO: 1370787 - protein, 9 aa, Homo Sapiens
LEPAPSLPC

SEQ ID NO: 1370788 - protein, 9 aa, Homo Sapiens
RGMKWKKDS

SEQ ID NO: 1370789 - protein, 9 aa, Homo Sapiens
EVQGSAGGQ

SEQ ID NO: 1370790 - protein, 9 aa, Homo Sapiens
ELFSKVPPL

SEQ ID NO: 1370791 - protein, 9 aa, Homo Sapiens
NVAYFRFDM

SEQ ID NO: 1370792 - protein, 9 aa, Homo Sapiens
VKRKTNNPR

SEQ ID NO: 1370793 - protein, 9 aa, Homo Sapiens
GLVIHHALS

SEQ ID NO: 1370794 - protein, 9 aa, Homo Sapiens
VDCYVAVRH

SEQ ID NO: 1370795 - protein, 9 aa, Homo Sapiens
ADGREEEER

SEQ ID NO: 1370796 - protein, 9 aa, Homo Sapiens
MTSWISPAI

SEQ ID NO: 1370797 - protein, 9 aa, Homo Sapiens
RKRREENSR

SEQ ID NO: 1370798 - protein, 9 aa, Homo Sapiens
PSSDRLKEA

SEQ ID NO: 1370799 - protein, 9 aa, Homo Sapiens
VAVECDGCE

SEQ ID NO: 1370800 - protein, 9 aa, Homo Sapiens
MEELCAEVQ

SEQ ID NO: 1370801 - protein, 9 aa, Homo Sapiens
VEGAAGGVD

SEQ ID NO: 1370802 - protein, 9 aa, Homo Sapiens
KNIEITPQR

SEQ ID NO: 1370803 - protein, 9 aa, Homo Sapiens
SHSISESFS

SEQ ID NO: 1370804 - protein, 9 aa, Homo Sapiens
NQLNYGVDN

SEQ ID NO: 1370805 - protein, 9 aa, Homo Sapiens
PSTSGKRPR

SEQ ID NO: 1370806 - protein, 9 aa, Homo Sapiens
SLQRLSRPT

SEQ ID NO: 1370807 - protein, 9 aa, Homo Sapiens
SSSTISSIQ

SEQ ID NO: 1370808 - protein, 9 aa, Homo Sapiens
IGGGVARVE

SEQ ID NO: 1370809 - protein, 9 aa, Homo Sapiens
RYRDTKGPF

SEQ ID NO: 1370810 - protein, 9 aa, Homo Sapiens
TSASVSGAA

SEQ ID NO: 1370811 - protein, 9 aa, Homo Sapiens
ESRQESDPG

SEQ ID NO: 1370812 - protein, 9 aa, Homo Sapiens
QKSQRKRQK

SEQ ID NO: 1370813 - protein, 9 aa, Homo Sapiens
RGGSPQTSS

SEQ ID NO: 1370814 - protein, 9 aa, Homo Sapiens
PPSCSPCSS

SEQ ID NO: 1370815 - protein, 9 aa, Homo Sapiens
LDIFQMHDE

SEQ ID NO: 1370816 - protein, 9 aa, Homo Sapiens
PPGLHPLPG

SEQ ID NO: 1370817 - protein, 9 aa, Homo Sapiens
CNRHSIVFL

SEQ ID NO: 1370818 - protein, 9 aa, Homo Sapiens
DPLTHLAPK

SEQ ID NO: 1370819 - protein, 9 aa, Homo Sapiens
CRLTIKKIK

SEQ ID NO: 1370820 - protein, 9 aa, Homo Sapiens
GHYNERDEI

SEQ ID NO: 1370821 - protein, 9 aa, Homo Sapiens
MASVQLAGD

SEQ ID NO: 1370822 - protein, 9 aa, Homo Sapiens
KSKKKFKDP

SEQ ID NO: 1370823 - protein, 9 aa, Homo Sapiens
GSNCIRAIE

SEQ ID NO: 1370824 - protein, 9 aa, Homo Sapiens
LLCEKDGKA

SEQ ID NO: 1370825 - protein, 9 aa, Homo Sapiens
ICLSDEYMG

SEQ ID NO: 1370826 - protein, 9 aa, Homo Sapiens
LALSFASLR

SEQ ID NO: 1370827 - protein, 9 aa, Homo Sapiens
DLRPGACGP

SEQ ID NO: 1370828 - protein, 9 aa, Homo Sapiens
GRPEEYEGG

SEQ ID NO: 1370829 - protein, 9 aa, Homo Sapiens
RPAVQLIDI

SEQ ID NO: 1370830 - protein, 9 aa, Homo Sapiens
RESALYLLE

SEQ ID NO: 1370831 - protein, 9 aa, Homo Sapiens
DSIADTLKQ

SEQ ID NO: 1370832 - protein, 9 aa, Homo Sapiens
RRSSPPRRP

SEQ ID NO: 1370833 - protein, 9 aa, Homo Sapiens
DQPRSVRYI

SEQ ID NO: 1370834 - protein, 9 aa, Homo Sapiens
LRTRRPAGA

SEQ ID NO: 1370835 - protein, 9 aa, Homo Sapiens
FRGLAELVE

SEQ ID NO: 1370836 - protein, 9 aa, Homo Sapiens
KMQKGWWQG

SEQ ID NO: 1370837 - protein, 9 aa, Homo Sapiens
KQKVQRRNS

SEQ ID NO: 1370838 - protein, 9 aa, Homo Sapiens
ARAEGWDNE

SEQ ID NO: 1370839 - protein, 9 aa, Homo Sapiens
GYVLPKHRE

SEQ ID NO: 1370840 - protein, 9 aa, Homo Sapiens
RCIPAYHPE

SEQ ID NO: 1370841 - protein, 9 aa, Homo Sapiens
SSETGGCCC

SEQ ID NO: 1370842 - protein, 9 aa, Homo Sapiens
RRCFVLSPR

SEQ ID NO: 1370843 - protein, 9 aa, Homo Sapiens
LHQSLIWSR

SEQ ID NO: 1370844 - protein, 9 aa, Homo Sapiens
MLMPYGAPI

SEQ ID NO: 1370845 - protein, 9 aa, Homo Sapiens
MGPGNLNTN

SEQ ID NO: 1370846 - protein, 9 aa, Homo Sapiens
ESGVISSRL

SEQ ID NO: 1370847 - protein, 9 aa, Homo Sapiens
AQDCVRLEG

SEQ ID NO: 1370848 - protein, 9 aa, Homo Sapiens
HRSQPERQD

SEQ ID NO: 1370849 - protein, 9 aa, Homo Sapiens
YPSNMDRSW

SEQ ID NO: 1370850 - protein, 9 aa, Homo Sapiens
GLLPVSAND

SEQ ID NO: 1370851 - protein, 9 aa, Homo Sapiens
GIHPLSSLL

SEQ ID NO: 1370852 - protein, 9 aa, Homo Sapiens
RLAEKKQFD

SEQ ID NO: 1370853 - protein, 9 aa, Homo Sapiens
HLQYASFKV

SEQ ID NO: 1370854 - protein, 9 aa, Homo Sapiens
AVGGQHEEV

SEQ ID NO: 1370855 - protein, 9 aa, Homo Sapiens
HPLPGEPQP

SEQ ID NO: 1370856 - protein, 9 aa, Homo Sapiens
RSRPHAVLR

SEQ ID NO: 1370857 - protein, 9 aa, Homo Sapiens
AQDKLQGQD

SEQ ID NO: 1370858 - protein, 9 aa, Homo Sapiens
QCQCTAQDG

SEQ ID NO: 1370859 - protein, 9 aa, Homo Sapiens
FAGSSPKAP

SEQ ID NO: 1370860 - protein, 9 aa, Homo Sapiens
TFGWAPEPS

SEQ ID NO: 1370861 - protein, 9 aa, Homo Sapiens
IWSRDQGFC

SEQ ID NO: 1370862 - protein, 9 aa, Homo Sapiens
GLFLDVVVR

SEQ ID NO: 1370863 - protein, 9 aa, Homo Sapiens
VISSRLRNE

SEQ ID NO: 1370864 - protein, 9 aa, Homo Sapiens
EVCDGMGQR

SEQ ID NO: 1370865 - protein, 9 aa, Homo Sapiens
CKGLFNIYH

SEQ ID NO: 1370866 - protein, 9 aa, Homo Sapiens
QVTPKVIFF

SEQ ID NO: 1370867 - protein, 9 aa, Homo Sapiens
SHSPPTTTE

SEQ ID NO: 1370868 - protein, 9 aa, Homo Sapiens
KRMETCQKK

SEQ ID NO: 1370869 - protein, 9 aa, Homo Sapiens
ISIQLGQRS

SEQ ID NO: 1370870 - protein, 9 aa, Homo Sapiens
DSLSIHHSF

SEQ ID NO: 1370871 - protein, 9 aa, Homo Sapiens
CAERFVSSP

SEQ ID NO: 1370872 - protein, 9 aa, Homo Sapiens
PASRTTALL

SEQ ID NO: 1370873 - protein, 9 aa, Homo Sapiens
CMAEGHGGL

SEQ ID NO: 1370874 - protein, 9 aa, Homo Sapiens
VLPYLSAVE

SEQ ID NO: 1370875 - protein, 9 aa, Homo Sapiens
FDGVKDVTG

SEQ ID NO: 1370876 - protein, 9 aa, Homo Sapiens
LRHQVHLIY

SEQ ID NO: 1370877 - protein, 9 aa, Homo Sapiens
SSPPRRPLQ

SEQ ID NO: 1370878 - protein, 9 aa, Homo Sapiens
KPLKEVHKV

SEQ ID NO: 1370879 - protein, 9 aa, Homo Sapiens
VGKDSRGLG

SEQ ID NO: 1370880 - protein, 9 aa, Homo Sapiens
FSGKDQPLL

SEQ ID NO: 1370881 - protein, 9 aa, Homo Sapiens
CYFEFTTDK

SEQ ID NO: 1370882 - protein, 9 aa, Homo Sapiens
LILVMLEIV

SEQ ID NO: 1370883 - protein, 9 aa, Homo Sapiens
SHIDICLRK

SEQ ID NO: 1370884 - protein, 9 aa, Homo Sapiens
GWPEDPVLG

SEQ ID NO: 1370885 - protein, 9 aa, Homo Sapiens
CPPDLLGPA

SEQ ID NO: 1370886 - protein, 9 aa, Homo Sapiens
SPAPAQGQA

SEQ ID NO: 1370887 - protein, 9 aa, Homo Sapiens
KTEYDSRLR

SEQ ID NO: 1370888 - protein, 9 aa, Homo Sapiens
LFPKLSCFN

SEQ ID NO: 1370889 - protein, 9 aa, Homo Sapiens
LDPIIAVEG

SEQ ID NO: 1370890 - protein, 9 aa, Homo Sapiens
FYVAFFTSP

SEQ ID NO: 1370891 - protein, 9 aa, Homo Sapiens
QVALDSPTS

SEQ ID NO: 1370892 - protein, 9 aa, Homo Sapiens
RTGQSLVVF

SEQ ID NO: 1370893 - protein, 9 aa, Homo Sapiens
ARDDDSGNK

SEQ ID NO: 1370894 - protein, 9 aa, Homo Sapiens
TRSHTAVRP

SEQ ID NO: 1370895 - protein, 9 aa, Homo Sapiens
KIILHQKRE

SEQ ID NO: 1370896 - protein, 9 aa, Homo Sapiens
ITRVSNETL

SEQ ID NO: 1370897 - protein, 9 aa, Homo Sapiens
IVFLEWKRW

SEQ ID NO: 1370898 - protein, 9 aa, Homo Sapiens
SRYTSDCFI

SEQ ID NO: 1370899 - protein, 9 aa, Homo Sapiens
TAWCTSTEM

SEQ ID NO: 1370900 - protein, 9 aa, Homo Sapiens
ILCQLEVAG

SEQ ID NO: 1370901 - protein, 9 aa, Homo Sapiens
SAHHVLFIA

SEQ ID NO: 1370902 - protein, 9 aa, Homo Sapiens
ELKDVQSKQ

SEQ ID NO: 1370903 - protein, 9 aa, Homo Sapiens
KGSGPKTPC

SEQ ID NO: 1370904 - protein, 9 aa, Homo Sapiens
DPTDAADPR

SEQ ID NO: 1370905 - protein, 9 aa, Homo Sapiens
PDGLFWMLT

SEQ ID NO: 1370906 - protein, 9 aa, Homo Sapiens
RMPAQLFFK

SEQ ID NO: 1370907 - protein, 9 aa, Homo Sapiens
EKYVLCASE

SEQ ID NO: 1370908 - protein, 9 aa, Homo Sapiens
RMQMYNSPH

SEQ ID NO: 1370909 - protein, 9 aa, Homo Sapiens
MEYVVGGEL

SEQ ID NO: 1370910 - protein, 9 aa, Homo Sapiens
AYPVRIGSS

SEQ ID NO: 1370911 - protein, 9 aa, Homo Sapiens
GMPSAVSCF

SEQ ID NO: 1370912 - protein, 9 aa, Homo Sapiens
NNFKNEAGY

SEQ ID NO: 1370913 - protein, 9 aa, Homo Sapiens
KIMHYMCQL

SEQ ID NO: 1370914 - protein, 9 aa, Homo Sapiens
QLVRSLVNA

SEQ ID NO: 1370915 - protein, 9 aa, Homo Sapiens
LALPLRLCR

SEQ ID NO: 1370916 - protein, 9 aa, Homo Sapiens
KDVQSKQLD

SEQ ID NO: 1370917 - protein, 9 aa, Homo Sapiens
AVEDASGDE

SEQ ID NO: 1370918 - protein, 9 aa, Homo Sapiens
SSDLVPQNY

SEQ ID NO: 1370919 - protein, 9 aa, Homo Sapiens
GSLLSSGTA

SEQ ID NO: 1370920 - protein, 9 aa, Homo Sapiens
QLHPQPVTI

SEQ ID NO: 1370921 - protein, 9 aa, Homo Sapiens
LPPQLSVTP

SEQ ID NO: 1370922 - protein, 9 aa, Homo Sapiens
CRPLCPAQM

SEQ ID NO: 1370923 - protein, 9 aa, Homo Sapiens
GLSTSSNFL

SEQ ID NO: 1370924 - protein, 9 aa, Homo Sapiens
HQAFMAGLA

SEQ ID NO: 1370925 - protein, 9 aa, Homo Sapiens
TSATTPNVC

SEQ ID NO: 1370926 - protein, 9 aa, Homo Sapiens
ECGMEFGQI

SEQ ID NO: 1370927 - protein, 9 aa, Homo Sapiens
GDTNLGDRE

SEQ ID NO: 1370928 - protein, 9 aa, Homo Sapiens
GLSPGLSPE

SEQ ID NO: 1370929 - protein, 9 aa, Homo Sapiens
TLLTEEVAR

SEQ ID NO: 1370930 - protein, 9 aa, Homo Sapiens
ILHQRGQHD

SEQ ID NO: 1370931 - protein, 9 aa, Homo Sapiens
SSKVEAPGQ

SEQ ID NO: 1370932 - protein, 9 aa, Homo Sapiens
CHLSDNCTI

SEQ ID NO: 1370933 - protein, 9 aa, Homo Sapiens
MLLFLILGK

SEQ ID NO: 1370934 - protein, 9 aa, Homo Sapiens
GWHPRVMLN

SEQ ID NO: 1370935 - protein, 9 aa, Homo Sapiens
RVEHCAKEA

SEQ ID NO: 1370936 - protein, 9 aa, Homo Sapiens
NVSVWREVL

SEQ ID NO: 1370937 - protein, 9 aa, Homo Sapiens
GRASRKTWQ

SEQ ID NO: 1370938 - protein, 9 aa, Homo Sapiens
CKEKAFTHN

SEQ ID NO: 1370939 - protein, 9 aa, Homo Sapiens
PHTSTAALI

SEQ ID NO: 1370940 - protein, 9 aa, Homo Sapiens
LLDMARHSA

SEQ ID NO: 1370941 - protein, 9 aa, Homo Sapiens
VNQGSTNSD

SEQ ID NO: 1370942 - protein, 9 aa, Homo Sapiens
SSAALERFR

SEQ ID NO: 1370943 - protein, 9 aa, Homo Sapiens
AIGNGMRSD

SEQ ID NO: 1370944 - protein, 9 aa, Homo Sapiens
FRLTADVHH

SEQ ID NO: 1370945 - protein, 9 aa, Homo Sapiens
EGYPTYTNV

SEQ ID NO: 1370946 - protein, 9 aa, Homo Sapiens
LISCVWNCH

SEQ ID NO: 1370947 - protein, 9 aa, Homo Sapiens
THNECIACC

SEQ ID NO: 1370948 - protein, 9 aa, Homo Sapiens
PQEGPGRHP

SEQ ID NO: 1370949 - protein, 9 aa, Homo Sapiens
HYRVLWDDN

SEQ ID NO: 1370950 - protein, 9 aa, Homo Sapiens
KKAKIKKKT

SEQ ID NO: 1370951 - protein, 9 aa, Homo Sapiens
CTVDSSQGQ

SEQ ID NO: 1370952 - protein, 9 aa, Homo Sapiens
KETIRHITQ

SEQ ID NO: 1370953 - protein, 9 aa, Homo Sapiens
SHRTITGAK

SEQ ID NO: 1370954 - protein, 9 aa, Homo Sapiens
VPTMHSWYE

SEQ ID NO: 1370955 - protein, 9 aa, Homo Sapiens
GFWPEVLKM

SEQ ID NO: 1370956 - protein, 9 aa, Homo Sapiens
PKSLCYPSK

SEQ ID NO: 1370957 - protein, 9 aa, Homo Sapiens
GSRTFEHFC

SEQ ID NO: 1370958 - protein, 9 aa, Homo Sapiens
ALSFASLRP

SEQ ID NO: 1370959 - protein, 9 aa, Homo Sapiens
SLARRLDFQ

SEQ ID NO: 1370960 - protein, 9 aa, Homo Sapiens
QSYKEAMGR

SEQ ID NO: 1370961 - protein, 9 aa, Homo Sapiens
RPLHALSQF

SEQ ID NO: 1370962 - protein, 9 aa, Homo Sapiens
ASALRTRRP

SEQ ID NO: 1370963 - protein, 9 aa, Homo Sapiens
YYMAVGTSQ

SEQ ID NO: 1370964 - protein, 9 aa, Homo Sapiens
HCGNSFPLN

SEQ ID NO: 1370965 - protein, 9 aa, Homo Sapiens
GIGMKQEME

SEQ ID NO: 1370966 - protein, 9 aa, Homo Sapiens
AALQCHISK

SEQ ID NO: 1370967 - protein, 9 aa, Homo Sapiens
ATTTARQPS

SEQ ID NO: 1370968 - protein, 9 aa, Homo Sapiens
SVGAGPIPI

SEQ ID NO: 1370969 - protein, 9 aa, Homo Sapiens
RWHHMRGET

SEQ ID NO: 1370970 - protein, 9 aa, Homo Sapiens
RTLEEQGAT

SEQ ID NO: 1370971 - protein, 9 aa, Homo Sapiens
ARARPALGR

SEQ ID NO: 1370972 - protein, 9 aa, Homo Sapiens
PAPRRRTPP

SEQ ID NO: 1370973 - protein, 9 aa, Homo Sapiens
GPCPPPVTP

SEQ ID NO: 1370974 - protein, 9 aa, Homo Sapiens
TFAELTGLS

SEQ ID NO: 1370975 - protein, 9 aa, Homo Sapiens
NHLSQNSHE

SEQ ID NO: 1370976 - protein, 9 aa, Homo Sapiens
ESDLENLAG

SEQ ID NO: 1370977 - protein, 9 aa, Homo Sapiens
PVEKQVFKN

SEQ ID NO: 1370978 - protein, 9 aa, Homo Sapiens
KREMEHWKT

SEQ ID NO: 1370979 - protein, 9 aa, Homo Sapiens
TKTRENHLV

SEQ ID NO: 1370980 - protein, 9 aa, Homo Sapiens
GDYFRADGF

SEQ ID NO: 1370981 - protein, 9 aa, Homo Sapiens
GMRFVAAFG

SEQ ID NO: 1370982 - protein, 9 aa, Homo Sapiens
TQRSVWHRP

SEQ ID NO: 1370983 - protein, 9 aa, Homo Sapiens
LEASSELFK

SEQ ID NO: 1370984 - protein, 9 aa, Homo Sapiens
LKLAPLQVT

SEQ ID NO: 1370985 - protein, 9 aa, Homo Sapiens
ALQEEPEHS

SEQ ID NO: 1370986 - protein, 9 aa, Homo Sapiens
DVTVVVGSR

SEQ ID NO: 1370987 - protein, 9 aa, Homo Sapiens
PPAQCLWLV

SEQ ID NO: 1370988 - protein, 9 aa, Homo Sapiens
VWSAGLAPS

SEQ ID NO: 1370989 - protein, 9 aa, Homo Sapiens
PLAPADLCL

SEQ ID NO: 1370990 - protein, 9 aa, Homo Sapiens
VGLKSNGKY

SEQ ID NO: 1370991 - protein, 9 aa, Homo Sapiens
VAGPSVTSS

SEQ ID NO: 1370992 - protein, 9 aa, Homo Sapiens
FPCEMTPPM

SEQ ID NO: 1370993 - protein, 9 aa, Homo Sapiens
SEEPGGGPE

SEQ ID NO: 1370994 - protein, 9 aa, Homo Sapiens
WSLAGLVLL

SEQ ID NO: 1370995 - protein, 9 aa, Homo Sapiens
SMDREKEAL

SEQ ID NO: 1370996 - protein, 9 aa, Homo Sapiens
SVELTGMSA

SEQ ID NO: 1370997 - protein, 9 aa, Homo Sapiens
LNDYSVREL

SEQ ID NO: 1370998 - protein, 9 aa, Homo Sapiens
GETKRARGC

SEQ ID NO: 1370999 - protein, 9 aa, Homo Sapiens
CSRCRRRRC

SEQ ID NO: 1371000 - protein, 9 aa, Homo Sapiens
VVGGELFDR

SEQ ID NO: 1371001 - protein, 9 aa, Homo Sapiens
LKVAVDGSV

SEQ ID NO: 1371002 - protein, 9 aa, Homo Sapiens
EAPIFTTPG

SEQ ID NO: 1371003 - protein, 9 aa, Homo Sapiens
EGDEESDLE

SEQ ID NO: 1371004 - protein, 9 aa, Homo Sapiens
GGGNPSHRE

SEQ ID NO: 1371005 - protein, 9 aa, Homo Sapiens
VAVTLLDTI

SEQ ID NO: 1371006 - protein, 9 aa, Homo Sapiens
NEIIKLETG

SEQ ID NO: 1371007 - protein, 9 aa, Homo Sapiens
LPPDFKIRC

SEQ ID NO: 1371008 - protein, 9 aa, Homo Sapiens
LPLRLCRQP

SEQ ID NO: 1371009 - protein, 9 aa, Homo Sapiens
WTVPGGQFD

SEQ ID NO: 1371010 - protein, 9 aa, Homo Sapiens
AEQSLTEHS

SEQ ID NO: 1371011 - protein, 9 aa, Homo Sapiens
RDCQAAGTA

SEQ ID NO: 1371012 - protein, 9 aa, Homo Sapiens
PLLLLLLIV

SEQ ID NO: 1371013 - protein, 9 aa, Homo Sapiens
LDTQLKNLS

SEQ ID NO: 1371014 - protein, 9 aa, Homo Sapiens
KRERSRKES

SEQ ID NO: 1371015 - protein, 9 aa, Homo Sapiens
PRAGRGRWS

SEQ ID NO: 1371016 - protein, 9 aa, Homo Sapiens
DEEEPVELR

SEQ ID NO: 1371017 - protein, 9 aa, Homo Sapiens
SQEELLHQL

SEQ ID NO: 1371018 - protein, 9 aa, Homo Sapiens
RGGQDQFSW

SEQ ID NO: 1371019 - protein, 9 aa, Homo Sapiens
TLPEEPQYG

SEQ ID NO: 1371020 - protein, 9 aa, Homo Sapiens
PTCKGLFNI

SEQ ID NO: 1371021 - protein, 9 aa, Homo Sapiens
PNPSVTWLK

SEQ ID NO: 1371022 - protein, 9 aa, Homo Sapiens
IPPVQARDS

SEQ ID NO: 1371023 - protein, 9 aa, Homo Sapiens
AVVMVVRPV

SEQ ID NO: 1371024 - protein, 9 aa, Homo Sapiens
SAALERFRS

SEQ ID NO: 1371025 - protein, 9 aa, Homo Sapiens
APHLWGRSG

SEQ ID NO: 1371026 - protein, 9 aa, Homo Sapiens
SNSNSNSSN

SEQ ID NO: 1371027 - protein, 9 aa, Homo Sapiens
QRVAAWLAQ

SEQ ID NO: 1371028 - protein, 9 aa, Homo Sapiens
HGDEGPGPA

SEQ ID NO: 1371029 - protein, 9 aa, Homo Sapiens
WRRVLPVCS

SEQ ID NO: 1371030 - protein, 9 aa, Homo Sapiens
AAGTAQKSQ

SEQ ID NO: 1371031 - protein, 9 aa, Homo Sapiens
TAALIFYYV

SEQ ID NO: 1371032 - protein, 9 aa, Homo Sapiens
QRPPTICEC

SEQ ID NO: 1371033 - protein, 9 aa, Homo Sapiens
HNHRWRSLT

SEQ ID NO: 1371034 - protein, 9 aa, Homo Sapiens
SASRQTCPC

SEQ ID NO: 1371035 - protein, 9 aa, Homo Sapiens
GACCPCWAS

SEQ ID NO: 1371036 - protein, 9 aa, Homo Sapiens
SLRCSRECA

SEQ ID NO: 1371037 - protein, 9 aa, Homo Sapiens
QSVLLLGVP

SEQ ID NO: 1371038 - protein, 9 aa, Homo Sapiens
FTTPGRTYP

SEQ ID NO: 1371039 - protein, 9 aa, Homo Sapiens
LYHSALGVG

SEQ ID NO: 1371040 - protein, 9 aa, Homo Sapiens
PIPISSELC

SEQ ID NO: 1371041 - protein, 9 aa, Homo Sapiens
LLLGVPQTA

SEQ ID NO: 1371042 - protein, 9 aa, Homo Sapiens
VRALCQIAD

SEQ ID NO: 1371043 - protein, 9 aa, Homo Sapiens
GSSDTEEKD

SEQ ID NO: 1371044 - protein, 9 aa, Homo Sapiens
YFNTPAAED

SEQ ID NO: 1371045 - protein, 9 aa, Homo Sapiens
GHYCCVVRN

SEQ ID NO: 1371046 - protein, 9 aa, Homo Sapiens
CEQLARILQ

SEQ ID NO: 1371047 - protein, 9 aa, Homo Sapiens
RRHGLSPRW

SEQ ID NO: 1371048 - protein, 9 aa, Homo Sapiens
CPKSLCYPS

SEQ ID NO: 1371049 - protein, 9 aa, Homo Sapiens
IRGVVTAGK

SEQ ID NO: 1371050 - protein, 9 aa, Homo Sapiens
TLSQRSAGE

SEQ ID NO: 1371051 - protein, 9 aa, Homo Sapiens
GKEGVKTNF

SEQ ID NO: 1371052 - protein, 9 aa, Homo Sapiens
ETPQRIYRQ

SEQ ID NO: 1371053 - protein, 9 aa, Homo Sapiens
GMGQRALRG

SEQ ID NO: 1371054 - protein, 9 aa, Homo Sapiens
FTNLADHNP

SEQ ID NO: 1371055 - protein, 9 aa, Homo Sapiens
VPAHSLGAV

SEQ ID NO: 1371056 - protein, 9 aa, Homo Sapiens
HRGEMGPLG

SEQ ID NO: 1371057 - protein, 9 aa, Homo Sapiens
GTQPCTSVP

SEQ ID NO: 1371058 - protein, 9 aa, Homo Sapiens
SSPVRAPQT

SEQ ID NO: 1371059 - protein, 9 aa, Homo Sapiens
MAVGTSQKS

SEQ ID NO: 1371060 - protein, 9 aa, Homo Sapiens
PVELRGQEQ

SEQ ID NO: 1371061 - protein, 9 aa, Homo Sapiens
GYEKDLWEH

SEQ ID NO: 1371062 - protein, 9 aa, Homo Sapiens
RQESDPGDD

SEQ ID NO: 1371063 - protein, 9 aa, Homo Sapiens
LNISGLLVN

SEQ ID NO: 1371064 - protein, 9 aa, Homo Sapiens
EELLHQLRN

SEQ ID NO: 1371065 - protein, 9 aa, Homo Sapiens
RNLARVVVN

SEQ ID NO: 1371066 - protein, 9 aa, Homo Sapiens
GPGCCHSSG

SEQ ID NO: 1371067 - protein, 9 aa, Homo Sapiens
LVSFSESGP

SEQ ID NO: 1371068 - protein, 9 aa, Homo Sapiens
WMTPTLRAR

SEQ ID NO: 1371069 - protein, 9 aa, Homo Sapiens
PRALCSQRR

SEQ ID NO: 1371070 - protein, 9 aa, Homo Sapiens
LKLETTANY

SEQ ID NO: 1371071 - protein, 9 aa, Homo Sapiens
SILPLQASE

SEQ ID NO: 1371072 - protein, 9 aa, Homo Sapiens
GFADQSPGN

SEQ ID NO: 1371073 - protein, 9 aa, Homo Sapiens
TADEEEPVE

SEQ ID NO: 1371074 - protein, 9 aa, Homo Sapiens
HSDSFPMEL

SEQ ID NO: 1371075 - protein, 9 aa, Homo Sapiens
SSDCYRYDS

SEQ ID NO: 1371076 - protein, 9 aa, Homo Sapiens
SIPVSQPLP

SEQ ID NO: 1371077 - protein, 9 aa, Homo Sapiens
RLSKYAAHN

SEQ ID NO: 1371078 - protein, 9 aa, Homo Sapiens
LEKSIQFAS

SEQ ID NO: 1371079 - protein, 9 aa, Homo Sapiens
GGGTNISNH

SEQ ID NO: 1371080 - protein, 9 aa, Homo Sapiens
LGRLLHHQA

SEQ ID NO: 1371081 - protein, 9 aa, Homo Sapiens
PLLLNGEVA

SEQ ID NO: 1371082 - protein, 9 aa, Homo Sapiens
ALSSEALVC

SEQ ID NO: 1371083 - protein, 9 aa, Homo Sapiens
QPGVTAVID

SEQ ID NO: 1371084 - protein, 9 aa, Homo Sapiens
EAVESLGNN

SEQ ID NO: 1371085 - protein, 9 aa, Homo Sapiens
DEEANNDIF

SEQ ID NO: 1371086 - protein, 9 aa, Homo Sapiens
LFLEPRRRL

SEQ ID NO: 1371087 - protein, 9 aa, Homo Sapiens
SSIYQTPGL

SEQ ID NO: 1371088 - protein, 9 aa, Homo Sapiens
SAHPCDSSL

SEQ ID NO: 1371089 - protein, 9 aa, Homo Sapiens
SKGRDCRDN

SEQ ID NO: 1371090 - protein, 9 aa, Homo Sapiens
TKKVFRVYQ

SEQ ID NO: 1371091 - protein, 9 aa, Homo Sapiens
VCNAVDIKT

SEQ ID NO: 1371092 - protein, 9 aa, Homo Sapiens
LKQDGKNFT

SEQ ID NO: 1371093 - protein, 9 aa, Homo Sapiens
RCSRECAGG

SEQ ID NO: 1371094 - protein, 9 aa, Homo Sapiens
VSHGADVLT

SEQ ID NO: 1371095 - protein, 9 aa, Homo Sapiens
TRLPPCATR

SEQ ID NO: 1371096 - protein, 9 aa, Homo Sapiens
IAHPKAVTM

SEQ ID NO: 1371097 - protein, 9 aa, Homo Sapiens
LYHSGKPPA

SEQ ID NO: 1371098 - protein, 9 aa, Homo Sapiens
RKSELIANG

SEQ ID NO: 1371099 - protein, 9 aa, Homo Sapiens
GTYTFQLTA

SEQ ID NO: 1371100 - protein, 9 aa, Homo Sapiens
TSAMMKLPF

SEQ ID NO: 1371101 - protein, 9 aa, Homo Sapiens
SSVMMTHQL

SEQ ID NO: 1371102 - protein, 9 aa, Homo Sapiens
RHSQRLRGT

SEQ ID NO: 1371103 - protein, 9 aa, Homo Sapiens
AHPPGPGPP

SEQ ID NO: 1371104 - protein, 9 aa, Homo Sapiens
QMLPTLSTL

SEQ ID NO: 1371105 - protein, 9 aa, Homo Sapiens
ARVVPTRGD

SEQ ID NO: 1371106 - protein, 9 aa, Homo Sapiens
NQTVLSPLV

SEQ ID NO: 1371107 - protein, 9 aa, Homo Sapiens
RQTCPCPSS

SEQ ID NO: 1371108 - protein, 9 aa, Homo Sapiens
SPVFVAFRS

SEQ ID NO: 1371109 - protein, 9 aa, Homo Sapiens
LWKKPWGFL

SEQ ID NO: 1371110 - protein, 9 aa, Homo Sapiens
HASGRTCTV

SEQ ID NO: 1371111 - protein, 9 aa, Homo Sapiens
KHKKLLWFY

SEQ ID NO: 1371112 - protein, 9 aa, Homo Sapiens
NGNKTEVER

SEQ ID NO: 1371113 - protein, 9 aa, Homo Sapiens
AFPTAEQDD

SEQ ID NO: 1371114 - protein, 9 aa, Homo Sapiens
GLCRRLETS

SEQ ID NO: 1371115 - protein, 9 aa, Homo Sapiens
PGPVAAAPA

SEQ ID NO: 1371116 - protein, 9 aa, Homo Sapiens
QILPRLGFA

SEQ ID NO: 1371117 - protein, 9 aa, Homo Sapiens
DSMDDEFEL

SEQ ID NO: 1371118 - protein, 9 aa, Homo Sapiens
TIFQLFSGK

SEQ ID NO: 1371119 - protein, 9 aa, Homo Sapiens
SCPVAQSAM

SEQ ID NO: 1371120 - protein, 9 aa, Homo Sapiens
FYQCAKSFN

SEQ ID NO: 1371121 - protein, 9 aa, Homo Sapiens
FYDECLCKY

SEQ ID NO: 1371122 - protein, 9 aa, Homo Sapiens
GGRADRLLR

SEQ ID NO: 1371123 - protein, 9 aa, Homo Sapiens
IVNTVNQKK

SEQ ID NO: 1371124 - protein, 9 aa, Homo Sapiens
HAAICPQLL

SEQ ID NO: 1371125 - protein, 9 aa, Homo Sapiens
CDRQRELRE

SEQ ID NO: 1371126 - protein, 9 aa, Homo Sapiens
GTASVFGTS

SEQ ID NO: 1371127 - protein, 9 aa, Homo Sapiens
PRVCRRRWR

SEQ ID NO: 1371128 - protein, 9 aa, Homo Sapiens
AKLSKAYTN

SEQ ID NO: 1371129 - protein, 9 aa, Homo Sapiens
APRRDPPGQ

SEQ ID NO: 1371130 - protein, 9 aa, Homo Sapiens
MRKRREENS

SEQ ID NO: 1371131 - protein, 9 aa, Homo Sapiens
PSPHSTRSG

SEQ ID NO: 1371132 - protein, 9 aa, Homo Sapiens
IHQEYREDF

SEQ ID NO: 1371133 - protein, 9 aa, Homo Sapiens
EPVPRVQGF

SEQ ID NO: 1371134 - protein, 9 aa, Homo Sapiens
TKLKEWLPQ

SEQ ID NO: 1371135 - protein, 9 aa, Homo Sapiens
LRGNWWRKS

SEQ ID NO: 1371136 - protein, 9 aa, Homo Sapiens
LISIQLGQR

SEQ ID NO: 1371137 - protein, 9 aa, Homo Sapiens
ASFCTFSRN

SEQ ID NO: 1371138 - protein, 9 aa, Homo Sapiens
RGCVSHGAD

SEQ ID NO: 1371139 - protein, 9 aa, Homo Sapiens
PHLRNEPCA

SEQ ID NO: 1371140 - protein, 9 aa, Homo Sapiens
APEPSTVRL

SEQ ID NO: 1371141 - protein, 9 aa, Homo Sapiens
SFSSTPPLI

SEQ ID NO: 1371142 - protein, 9 aa, Homo Sapiens
QLAICCCHC

SEQ ID NO: 1371143 - protein, 9 aa, Homo Sapiens
ILHENMDQI

SEQ ID NO: 1371144 - protein, 9 aa, Homo Sapiens
QGMGPEPAA

SEQ ID NO: 1371145 - protein, 9 aa, Homo Sapiens
SALRSHTRT

SEQ ID NO: 1371146 - protein, 9 aa, Homo Sapiens
KFRTQERAA

SEQ ID NO: 1371147 - protein, 9 aa, Homo Sapiens
RVELILERD

SEQ ID NO: 1371148 - protein, 9 aa, Homo Sapiens
TCIQLHQDL

SEQ ID NO: 1371149 - protein, 9 aa, Homo Sapiens
PSQKIRSPV

SEQ ID NO: 1371150 - protein, 9 aa, Homo Sapiens
FETLQQFDK

SEQ ID NO: 1371151 - protein, 9 aa, Homo Sapiens
DVGFVALEI

SEQ ID NO: 1371152 - protein, 9 aa, Homo Sapiens
LGKKRSLAP

SEQ ID NO: 1371153 - protein, 9 aa, Homo Sapiens
RKLIYSFKQ

SEQ ID NO: 1371154 - protein, 9 aa, Homo Sapiens
FIAHPKAVT

SEQ ID NO: 1371155 - protein, 9 aa, Homo Sapiens
QACVSKNSS

SEQ ID NO: 1371156 - protein, 9 aa, Homo Sapiens
FCLPSRWNY

SEQ ID NO: 1371157 - protein, 9 aa, Homo Sapiens
ACMTQLVSS

SEQ ID NO: 1371158 - protein, 9 aa, Homo Sapiens
IKSDSALQA

SEQ ID NO: 1371159 - protein, 9 aa, Homo Sapiens
WAVQAFKAA

SEQ ID NO: 1371160 - protein, 9 aa, Homo Sapiens
QNKHKEAAH

SEQ ID NO: 1371161 - protein, 9 aa, Homo Sapiens
LTTHRVIHT

SEQ ID NO: 1371162 - protein, 9 aa, Homo Sapiens
IKNSQSEEH

SEQ ID NO: 1371163 - protein, 9 aa, Homo Sapiens
RAALHLQFY

SEQ ID NO: 1371164 - protein, 9 aa, Homo Sapiens
ISESFSKQC

SEQ ID NO: 1371165 - protein, 9 aa, Homo Sapiens
NLLMAQRRH

SEQ ID NO: 1371166 - protein, 9 aa, Homo Sapiens
SAQLQEKLT

SEQ ID NO: 1371167 - protein, 9 aa, Homo Sapiens
SRDVNRRFR

SEQ ID NO: 1371168 - protein, 9 aa, Homo Sapiens
PAASSEKAS

SEQ ID NO: 1371169 - protein, 9 aa, Homo Sapiens
DSLTRWHHM

SEQ ID NO: 1371170 - protein, 9 aa, Homo Sapiens
RIHCVAKDP

SEQ ID NO: 1371171 - protein, 9 aa, Homo Sapiens
REKRKSLQL

SEQ ID NO: 1371172 - protein, 9 aa, Homo Sapiens
KLLQECKKN

SEQ ID NO: 1371173 - protein, 9 aa, Homo Sapiens
VARVEVAAG

SEQ ID NO: 1371174 - protein, 9 aa, Homo Sapiens
SPVGPPSSP

SEQ ID NO: 1371175 - protein, 9 aa, Homo Sapiens
ERKNARAEQ

SEQ ID NO: 1371176 - protein, 9 aa, Homo Sapiens
SWAPLVSGY

SEQ ID NO: 1371177 - protein, 9 aa, Homo Sapiens
TLQQFDKKM

SEQ ID NO: 1371178 - protein, 9 aa, Homo Sapiens
EPTAWNETA

SEQ ID NO: 1371179 - protein, 9 aa, Homo Sapiens
SAVVDSMCL

SEQ ID NO: 1371180 - protein, 9 aa, Homo Sapiens
RWYRQQVQR

SEQ ID NO: 1371181 - protein, 9 aa, Homo Sapiens
RKQGSRVQN

SEQ ID NO: 1371182 - protein, 9 aa, Homo Sapiens
CSVTVWCCR

SEQ ID NO: 1371183 - protein, 9 aa, Homo Sapiens
QCDEQGMAF

SEQ ID NO: 1371184 - protein, 9 aa, Homo Sapiens
GSQTIMPCP

SEQ ID NO: 1371185 - protein, 9 aa, Homo Sapiens
TEYDSRLRI

SEQ ID NO: 1371186 - protein, 9 aa, Homo Sapiens
NKRREPIPG

SEQ ID NO: 1371187 - protein, 9 aa, Homo Sapiens
LRHSTLRPW

SEQ ID NO: 1371188 - protein, 9 aa, Homo Sapiens
KREEQGMGP

SEQ ID NO: 1371189 - protein, 9 aa, Homo Sapiens
GVKKDSEDE

SEQ ID NO: 1371190 - protein, 9 aa, Homo Sapiens
SSWCVAGPS

SEQ ID NO: 1371191 - protein, 9 aa, Homo Sapiens
WCPCIRGPW

SEQ ID NO: 1371192 - protein, 9 aa, Homo Sapiens
KTVGESARI

SEQ ID NO: 1371193 - protein, 9 aa, Homo Sapiens
IFRIIGIMT

SEQ ID NO: 1371194 - protein, 9 aa, Homo Sapiens
VEEQDAHPE

SEQ ID NO: 1371195 - protein, 9 aa, Homo Sapiens
TRRPAGAAV

SEQ ID NO: 1371196 - protein, 9 aa, Homo Sapiens
SLKKVMAPV

SEQ ID NO: 1371197 - protein, 9 aa, Homo Sapiens
GRSSTAWCT

SEQ ID NO: 1371198 - protein, 9 aa, Homo Sapiens
MRDPERRWF

SEQ ID NO: 1371199 - protein, 9 aa, Homo Sapiens
RRWRRVLPV

SEQ ID NO: 1371200 - protein, 9 aa, Homo Sapiens
GQGHGQQGQ

SEQ ID NO: 1371201 - protein, 9 aa, Homo Sapiens
ARLPSDPLT

SEQ ID NO: 1371202 - protein, 9 aa, Homo Sapiens
FLGCAGPSC

SEQ ID NO: 1371203 - protein, 9 aa, Homo Sapiens
RVTHADREQ

SEQ ID NO: 1371204 - protein, 9 aa, Homo Sapiens
KHVSSAHHV

SEQ ID NO: 1371205 - protein, 9 aa, Homo Sapiens
SWGRWCWWG

SEQ ID NO: 1371206 - protein, 9 aa, Homo Sapiens
SAVVLDLAQ

SEQ ID NO: 1371207 - protein, 9 aa, Homo Sapiens
TSKTEHQVQ

SEQ ID NO: 1371208 - protein, 9 aa, Homo Sapiens
EYEGGISVL

SEQ ID NO: 1371209 - protein, 9 aa, Homo Sapiens
SEYPVRRHQ

SEQ ID NO: 1371210 - protein, 9 aa, Homo Sapiens
RVSGETGSR

SEQ ID NO: 1371211 - protein, 9 aa, Homo Sapiens
GSPTRMAGR

SEQ ID NO: 1371212 - protein, 9 aa, Homo Sapiens
SRRASWPRG

SEQ ID NO: 1371213 - protein, 9 aa, Homo Sapiens
SPRISVCGC

SEQ ID NO: 1371214 - protein, 9 aa, Homo Sapiens
YTELPHIIK

SEQ ID NO: 1371215 - protein, 9 aa, Homo Sapiens
RRESYSTNV

SEQ ID NO: 1371216 - protein, 9 aa, Homo Sapiens
ARGYERIPV

SEQ ID NO: 1371217 - protein, 9 aa, Homo Sapiens
QMYNSPHHR

SEQ ID NO: 1371218 - protein, 9 aa, Homo Sapiens
NKSDLNTHN

SEQ ID NO: 1371219 - protein, 9 aa, Homo Sapiens
DPDTANPCL

SEQ ID NO: 1371220 - protein, 9 aa, Homo Sapiens
PPAKKQRKP

SEQ ID NO: 1371221 - protein, 9 aa, Homo Sapiens
ELSGSFTNL

SEQ ID NO: 1371222 - protein, 9 aa, Homo Sapiens
PRTTKATQK

SEQ ID NO: 1371223 - protein, 9 aa, Homo Sapiens
AHVIFQSPS

SEQ ID NO: 1371224 - protein, 9 aa, Homo Sapiens
DTLKQAFTC

SEQ ID NO: 1371225 - protein, 9 aa, Homo Sapiens
ISVLRKLFD

SEQ ID NO: 1371226 - protein, 9 aa, Homo Sapiens
ANNPNHRNC

SEQ ID NO: 1371227 - protein, 9 aa, Homo Sapiens
SPLMSEFRK

SEQ ID NO: 1371228 - protein, 9 aa, Homo Sapiens
KKEDFAMQI

SEQ ID NO: 1371229 - protein, 9 aa, Homo Sapiens
GNYILTCSA

SEQ ID NO: 1371230 - protein, 9 aa, Homo Sapiens
RRRKHPPVE

SEQ ID NO: 1371231 - protein, 9 aa, Homo Sapiens
QWAPYRQKM

SEQ ID NO: 1371232 - protein, 9 aa, Homo Sapiens
RLGVEIHDK

SEQ ID NO: 1371233 - protein, 9 aa, Homo Sapiens
AARAGAARA

SEQ ID NO: 1371234 - protein, 9 aa, Homo Sapiens
TSVVLQHEI

SEQ ID NO: 1371235 - protein, 9 aa, Homo Sapiens
KFLAFYQCA

SEQ ID NO: 1371236 - protein, 9 aa, Homo Sapiens
PASICDGDN

SEQ ID NO: 1371237 - protein, 9 aa, Homo Sapiens
VLAQPSTSG

SEQ ID NO: 1371238 - protein, 9 aa, Homo Sapiens
KRREPIPGL

SEQ ID NO: 1371239 - protein, 9 aa, Homo Sapiens
RAGRGRWSG

SEQ ID NO: 1371240 - protein, 9 aa, Homo Sapiens
NLLLIGKSY

SEQ ID NO: 1371241 - protein, 9 aa, Homo Sapiens
VSCSSVELT

SEQ ID NO: 1371242 - protein, 9 aa, Homo Sapiens
VSIMWGLDK

SEQ ID NO: 1371243 - protein, 9 aa, Homo Sapiens
RDRVMHAFC

SEQ ID NO: 1371244 - protein, 9 aa, Homo Sapiens
FVAFRSSTK

SEQ ID NO: 1371245 - protein, 9 aa, Homo Sapiens
LLPPRATRR

SEQ ID NO: 1371246 - protein, 9 aa, Homo Sapiens
DVDCHQLAA

SEQ ID NO: 1371247 - protein, 9 aa, Homo Sapiens
YFATNFNEK

SEQ ID NO: 1371248 - protein, 9 aa, Homo Sapiens
ALHLQFYAG

SEQ ID NO: 1371249 - protein, 9 aa, Homo Sapiens
KLTPDLQRR

SEQ ID NO: 1371250 - protein, 9 aa, Homo Sapiens
QDSSKGPLT

SEQ ID NO: 1371251 - protein, 9 aa, Homo Sapiens
ELKKSYNKL

SEQ ID NO: 1371252 - protein, 9 aa, Homo Sapiens
TLDSPRASQ

SEQ ID NO: 1371253 - protein, 9 aa, Homo Sapiens
TNGTLPIRS

SEQ ID NO: 1371254 - protein, 9 aa, Homo Sapiens
SVGDVYIKS

SEQ ID NO: 1371255 - protein, 9 aa, Homo Sapiens
PKAPGLMEE

SEQ ID NO: 1371256 - protein, 9 aa, Homo Sapiens
AGSSPKAPG

SEQ ID NO: 1371257 - protein, 9 aa, Homo Sapiens
EDHEKLGFP

SEQ ID NO: 1371258 - protein, 9 aa, Homo Sapiens
LLRRMESMH

SEQ ID NO: 1371259 - protein, 9 aa, Homo Sapiens
RNLPGHCSD

SEQ ID NO: 1371260 - protein, 9 aa, Homo Sapiens
LPVQPRLEG

SEQ ID NO: 1371261 - protein, 9 aa, Homo Sapiens
PAIALLNNR

SEQ ID NO: 1371262 - protein, 9 aa, Homo Sapiens
GYCSAVFDP

SEQ ID NO: 1371263 - protein, 9 aa, Homo Sapiens
HEDLHPTSE

SEQ ID NO: 1371264 - protein, 9 aa, Homo Sapiens
SSFSRREGG

SEQ ID NO: 1371265 - protein, 9 aa, Homo Sapiens
PSHLAGHKQ

SEQ ID NO: 1371266 - protein, 9 aa, Homo Sapiens
SLSAMHFLT

SEQ ID NO: 1371267 - protein, 9 aa, Homo Sapiens
KIERVSAET

SEQ ID NO: 1371268 - protein, 9 aa, Homo Sapiens
RAHTLAVYV

SEQ ID NO: 1371269 - protein, 9 aa, Homo Sapiens
PCTCLPPPS

SEQ ID NO: 1371270 - protein, 9 aa, Homo Sapiens
CKCGEVCSE

SEQ ID NO: 1371271 - protein, 9 aa, Homo Sapiens
PIPGLEAIY

SEQ ID NO: 1371272 - protein, 9 aa, Homo Sapiens
GSGEAHDII

SEQ ID NO: 1371273 - protein, 9 aa, Homo Sapiens
PKTPCVHGY

SEQ ID NO: 1371274 - protein, 9 aa, Homo Sapiens
TPCHLSTVV

SEQ ID NO: 1371275 - protein, 9 aa, Homo Sapiens
EASVALPTD

SEQ ID NO: 1371276 - protein, 9 aa, Homo Sapiens
QLRVHMADM

SEQ ID NO: 1371277 - protein, 9 aa, Homo Sapiens
IHAGMETTC

SEQ ID NO: 1371278 - protein, 9 aa, Homo Sapiens
SCSPCSSFS

SEQ ID NO: 1371279 - protein, 9 aa, Homo Sapiens
IGLGGQHTR

SEQ ID NO: 1371280 - protein, 9 aa, Homo Sapiens
DEGVLINST

SEQ ID NO: 1371281 - protein, 9 aa, Homo Sapiens
GNVCHAKGK

SEQ ID NO: 1371282 - protein, 9 aa, Homo Sapiens
YSSPSPAQP

SEQ ID NO: 1371283 - protein, 9 aa, Homo Sapiens
RPPHIAPRD

SEQ ID NO: 1371284 - protein, 9 aa, Homo Sapiens
DLDGMLTVI

SEQ ID NO: 1371285 - protein, 9 aa, Homo Sapiens
EDLAKADEG

SEQ ID NO: 1371286 - protein, 9 aa, Homo Sapiens
PNHRNCIID

SEQ ID NO: 1371287 - protein, 9 aa, Homo Sapiens
AYSPKRPPK

SEQ ID NO: 1371288 - protein, 9 aa, Homo Sapiens
PDVLRHQVH

SEQ ID NO: 1371289 - protein, 9 aa, Homo Sapiens
QYASFKVDS

SEQ ID NO: 1371290 - protein, 9 aa, Homo Sapiens
KTFSLSEEI

SEQ ID NO: 1371291 - protein, 9 aa, Homo Sapiens
SVAEHGSRR

SEQ ID NO: 1371292 - protein, 9 aa, Homo Sapiens
LAQPSTSGK

SEQ ID NO: 1371293 - protein, 9 aa, Homo Sapiens
SARHVVMQK

SEQ ID NO: 1371294 - protein, 9 aa, Homo Sapiens
GGRSGCSGS

SEQ ID NO: 1371295 - protein, 9 aa, Homo Sapiens
KALDEILQE

SEQ ID NO: 1371296 - protein, 9 aa, Homo Sapiens
RVLTACLTE

SEQ ID NO: 1371297 - protein, 9 aa, Homo Sapiens
HLDLLLVIL

SEQ ID NO: 1371298 - protein, 9 aa, Homo Sapiens
VHGYTRVSS

SEQ ID NO: 1371299 - protein, 9 aa, Homo Sapiens
QIIITRVSN

SEQ ID NO: 1371300 - protein, 9 aa, Homo Sapiens
IMVWGHPSS

SEQ ID NO: 1371301 - protein, 9 aa, Homo Sapiens
KQTGFQRAV

SEQ ID NO: 1371302 - protein, 9 aa, Homo Sapiens
RERSRKESY

SEQ ID NO: 1371303 - protein, 9 aa, Homo Sapiens
LREAAIGTT

SEQ ID NO: 1371304 - protein, 9 aa, Homo Sapiens
SMCLESVGF

SEQ ID NO: 1371305 - protein, 9 aa, Homo Sapiens
VNTVNQKKA

SEQ ID NO: 1371306 - protein, 9 aa, Homo Sapiens
INDTLNIAI

SEQ ID NO: 1371307 - protein, 9 aa, Homo Sapiens
DVGRAEVSI

SEQ ID NO: 1371308 - protein, 9 aa, Homo Sapiens
PSMLREAAI

SEQ ID NO: 1371309 - protein, 9 aa, Homo Sapiens
QNFCPEVTR

SEQ ID NO: 1371310 - protein, 9 aa, Homo Sapiens
LINSILLAA

SEQ ID NO: 1371311 - protein, 9 aa, Homo Sapiens
GNYMLDKFS

SEQ ID NO: 1371312 - protein, 9 aa, Homo Sapiens
HADIKPDNV

SEQ ID NO: 1371313 - protein, 9 aa, Homo Sapiens
LLGSLNPCP

SEQ ID NO: 1371314 - protein, 9 aa, Homo Sapiens
DRQTVELRL

SEQ ID NO: 1371315 - protein, 9 aa, Homo Sapiens
TPCDRPHRP

SEQ ID NO: 1371316 - protein, 9 aa, Homo Sapiens
SRGVPIGGR

SEQ ID NO: 1371317 - protein, 9 aa, Homo Sapiens
RQLDNFKRV

SEQ ID NO: 1371318 - protein, 9 aa, Homo Sapiens
HLVVYLGTT

SEQ ID NO: 1371319 - protein, 9 aa, Homo Sapiens
QRRRKERQW

SEQ ID NO: 1371320 - protein, 9 aa, Homo Sapiens
EMHYGHQAP

SEQ ID NO: 1371321 - protein, 9 aa, Homo Sapiens
HPSMRVGAP

SEQ ID NO: 1371322 - protein, 9 aa, Homo Sapiens
TETFKLTEM

SEQ ID NO: 1371323 - protein, 9 aa, Homo Sapiens
GHSLDFYQG

SEQ ID NO: 1371324 - protein, 9 aa, Homo Sapiens
PENFSSMLE

SEQ ID NO: 1371325 - protein, 9 aa, Homo Sapiens
AWPSAISPT

SEQ ID NO: 1371326 - protein, 9 aa, Homo Sapiens
DRKERKGDH

SEQ ID NO: 1371327 - protein, 9 aa, Homo Sapiens
TVPKHLTMC

SEQ ID NO: 1371328 - protein, 9 aa, Homo Sapiens
NPNLLMAQR

SEQ ID NO: 1371329 - protein, 9 aa, Homo Sapiens
RVMCSMANC

SEQ ID NO: 1371330 - protein, 9 aa, Homo Sapiens
LQRLSRPTK

SEQ ID NO: 1371331 - protein, 9 aa, Homo Sapiens
RRVTPRDPL

SEQ ID NO: 1371332 - protein, 9 aa, Homo Sapiens
QLQVGRFAM

SEQ ID NO: 1371333 - protein, 9 aa, Homo Sapiens
SVRHNLSLK

SEQ ID NO: 1371334 - protein, 9 aa, Homo Sapiens
LVQQCVLLL

SEQ ID NO: 1371335 - protein, 9 aa, Homo Sapiens
LLWDVPAHS

SEQ ID NO: 1371336 - protein, 9 aa, Homo Sapiens
HAGFRSQFV

SEQ ID NO: 1371337 - protein, 9 aa, Homo Sapiens
GHMPGEFPV

SEQ ID NO: 1371338 - protein, 9 aa, Homo Sapiens
VVVFCMHHQ

SEQ ID NO: 1371339 - protein, 9 aa, Homo Sapiens
LIWPVAVTL

SEQ ID NO: 1371340 - protein, 9 aa, Homo Sapiens
QSSPIGLGG

SEQ ID NO: 1371341 - protein, 9 aa, Homo Sapiens
GLKYSRYLS

SEQ ID NO: 1371342 - protein, 9 aa, Homo Sapiens
CKRAGGPPG

SEQ ID NO: 1371343 - protein, 9 aa, Homo Sapiens
ISTKDTMST

SEQ ID NO: 1371344 - protein, 9 aa, Homo Sapiens
VNQKKAKIK

SEQ ID NO: 1371345 - protein, 9 aa, Homo Sapiens
KEMPIDQKK

SEQ ID NO: 1371346 - protein, 9 aa, Homo Sapiens
YRRNLARVV

SEQ ID NO: 1371347 - protein, 9 aa, Homo Sapiens
PPLVGSFIR

SEQ ID NO: 1371348 - protein, 9 aa, Homo Sapiens
HIAPRDQVA

SEQ ID NO: 1371349 - protein, 9 aa, Homo Sapiens
FADLFSKWA

SEQ ID NO: 1371350 - protein, 9 aa, Homo Sapiens
DIFQMHDEG

SEQ ID NO: 1371351 - protein, 9 aa, Homo Sapiens
RVQDVARRC

SEQ ID NO: 1371352 - protein, 9 aa, Homo Sapiens
DVYIKSTET

SEQ ID NO: 1371353 - protein, 9 aa, Homo Sapiens
CLDILNGVT

SEQ ID NO: 1371354 - protein, 9 aa, Homo Sapiens
ANYNLLRCI

SEQ ID NO: 1371355 - protein, 9 aa, Homo Sapiens
RLKEASGTD

SEQ ID NO: 1371356 - protein, 9 aa, Homo Sapiens
PRMELPVGC

SEQ ID NO: 1371357 - protein, 9 aa, Homo Sapiens
QKKQGNEQN

SEQ ID NO: 1371358 - protein, 9 aa, Homo Sapiens
EKHLFVDVG

SEQ ID NO: 1371359 - protein, 9 aa, Homo Sapiens
WKRWLQKST

SEQ ID NO: 1371360 - protein, 9 aa, Homo Sapiens
RGEAELTDT

SEQ ID NO: 1371361 - protein, 9 aa, Homo Sapiens
GDIPGQPLV

SEQ ID NO: 1371362 - protein, 9 aa, Homo Sapiens
RVKPLKEVH

SEQ ID NO: 1371363 - protein, 9 aa, Homo Sapiens
TFSLSEEIG

SEQ ID NO: 1371364 - protein, 9 aa, Homo Sapiens
AWHPLGLCS

SEQ ID NO: 1371365 - protein, 9 aa, Homo Sapiens
TNTKTRENH

SEQ ID NO: 1371366 - protein, 9 aa, Homo Sapiens
RHGDEGPGP

SEQ ID NO: 1371367 - protein, 9 aa, Homo Sapiens
RKETVALIL

SEQ ID NO: 1371368 - protein, 9 aa, Homo Sapiens
DPAASSEKA

SEQ ID NO: 1371369 - protein, 9 aa, Homo Sapiens
YGSTFSFFI

SEQ ID NO: 1371370 - protein, 9 aa, Homo Sapiens
GLGQYRATL

SEQ ID NO: 1371371 - protein, 9 aa, Homo Sapiens
TGELVKAMV

SEQ ID NO: 1371372 - protein, 9 aa, Homo Sapiens
AEKLRCMYR

SEQ ID NO: 1371373 - protein, 9 aa, Homo Sapiens
DGPLMCKDS

SEQ ID NO: 1371374 - protein, 9 aa, Homo Sapiens
SRGHLHAHP

SEQ ID NO: 1371375 - protein, 9 aa, Homo Sapiens
EITPQRSKA

SEQ ID NO: 1371376 - protein, 9 aa, Homo Sapiens
PVFVAFRSS

SEQ ID NO: 1371377 - protein, 9 aa, Homo Sapiens
GQPPMHSGT

SEQ ID NO: 1371378 - protein, 9 aa, Homo Sapiens
HVIFQSPSE

SEQ ID NO: 1371379 - protein, 9 aa, Homo Sapiens
GFSQANQLN

SEQ ID NO: 1371380 - protein, 9 aa, Homo Sapiens
DSIHWCGIS

SEQ ID NO: 1371381 - protein, 9 aa, Homo Sapiens
GMGPEPAAP

SEQ ID NO: 1371382 - protein, 9 aa, Homo Sapiens
DHPPAPRRD

SEQ ID NO: 1371383 - protein, 9 aa, Homo Sapiens
LLWFYVAFF

SEQ ID NO: 1371384 - protein, 9 aa, Homo Sapiens
IRKAEARAR

SEQ ID NO: 1371385 - protein, 9 aa, Homo Sapiens
GFYVGWAEA

SEQ ID NO: 1371386 - protein, 9 aa, Homo Sapiens
HGVQDTVEV

SEQ ID NO: 1371387 - protein, 9 aa, Homo Sapiens
AHPKAVTMM

SEQ ID NO: 1371388 - protein, 9 aa, Homo Sapiens
YHNDVGLKS

SEQ ID NO: 1371389 - protein, 9 aa, Homo Sapiens
EMGARGTFL

SEQ ID NO: 1371390 - protein, 9 aa, Homo Sapiens
YMVKLKLKD

SEQ ID NO: 1371391 - protein, 9 aa, Homo Sapiens
AQKMCEEVC

SEQ ID NO: 1371392 - protein, 9 aa, Homo Sapiens
IFQLLSGKD

SEQ ID NO: 1371393 - protein, 9 aa, Homo Sapiens
ILTRVGRTL

SEQ ID NO: 1371394 - protein, 9 aa, Homo Sapiens
KDRKERKGD

SEQ ID NO: 1371395 - protein, 9 aa, Homo Sapiens
KLEPWLRKN

SEQ ID NO: 1371396 - protein, 9 aa, Homo Sapiens
ICSLYSHND

SEQ ID NO: 1371397 - protein, 9 aa, Homo Sapiens
GCARQEEGT

SEQ ID NO: 1371398 - protein, 9 aa, Homo Sapiens
HSGATPLHH

SEQ ID NO: 1371399 - protein, 9 aa, Homo Sapiens
SGRTCTVRT

SEQ ID NO: 1371400 - protein, 9 aa, Homo Sapiens
PSSDEEAVE

SEQ ID NO: 1371401 - protein, 9 aa, Homo Sapiens
YPVRIGSSS

SEQ ID NO: 1371402 - protein, 9 aa, Homo Sapiens
EGREGLIQA

SEQ ID NO: 1371403 - protein, 9 aa, Homo Sapiens
EPGLLIFFL

SEQ ID NO: 1371404 - protein, 9 aa, Homo Sapiens
PVMRTVGIH

SEQ ID NO: 1371405 - protein, 9 aa, Homo Sapiens
ESHHGSHAK

SEQ ID NO: 1371406 - protein, 9 aa, Homo Sapiens
QGAPIFQLL

SEQ ID NO: 1371407 - protein, 9 aa, Homo Sapiens
RGQHDDDGA

SEQ ID NO: 1371408 - protein, 9 aa, Homo Sapiens
TAATGRAAP

SEQ ID NO: 1371409 - protein, 9 aa, Homo Sapiens
LHPASGRAS

SEQ ID NO: 1371410 - protein, 9 aa, Homo Sapiens
HDDDGAAAL

SEQ ID NO: 1371411 - protein, 9 aa, Homo Sapiens
FEGPLLNHI

SEQ ID NO: 1371412 - protein, 9 aa, Homo Sapiens
LCKGSGPKT

SEQ ID NO: 1371413 - protein, 9 aa, Homo Sapiens
SGLDPAASS

SEQ ID NO: 1371414 - protein, 9 aa, Homo Sapiens
KTAFDKVHF

SEQ ID NO: 1371415 - protein, 9 aa, Homo Sapiens
LPHGYPEPF

SEQ ID NO: 1371416 - protein, 9 aa, Homo Sapiens
YHTAMYRNY

SEQ ID NO: 1371417 - protein, 9 aa, Homo Sapiens
AAWLAQHNF

SEQ ID NO: 1371418 - protein, 9 aa, Homo Sapiens
EDAYFNTPA

SEQ ID NO: 1371419 - protein, 9 aa, Homo Sapiens
KEGCHKKKP

SEQ ID NO: 1371420 - protein, 9 aa, Homo Sapiens
TIHQTQYRP

SEQ ID NO: 1371421 - protein, 9 aa, Homo Sapiens
PRLCQTDPS

SEQ ID NO: 1371422 - protein, 9 aa, Homo Sapiens
GSQKALFLE

SEQ ID NO: 1371423 - protein, 9 aa, Homo Sapiens
SLSPSSTSS

SEQ ID NO: 1371424 - protein, 9 aa, Homo Sapiens
VTQDVLKKT

SEQ ID NO: 1371425 - protein, 9 aa, Homo Sapiens
AKVFGPTMV

SEQ ID NO: 1371426 - protein, 9 aa, Homo Sapiens
AFKMGFKTQ

SEQ ID NO: 1371427 - protein, 9 aa, Homo Sapiens
PDQPPQFLL

SEQ ID NO: 1371428 - protein, 9 aa, Homo Sapiens
EIPSQAVPH

SEQ ID NO: 1371429 - protein, 9 aa, Homo Sapiens
GVTRLHLES

SEQ ID NO: 1371430 - protein, 9 aa, Homo Sapiens
LKEQVDASS

SEQ ID NO: 1371431 - protein, 9 aa, Homo Sapiens
EARSLLAEQ

SEQ ID NO: 1371432 - protein, 9 aa, Homo Sapiens
DQFWIYDNQ

SEQ ID NO: 1371433 - protein, 9 aa, Homo Sapiens
GLDKASYEI

SEQ ID NO: 1371434 - protein, 9 aa, Homo Sapiens
SRYSPMSSS

SEQ ID NO: 1371435 - protein, 9 aa, Homo Sapiens
PSHSPPTTT

SEQ ID NO: 1371436 - protein, 9 aa, Homo Sapiens
RSAAAPGPL

SEQ ID NO: 1371437 - protein, 9 aa, Homo Sapiens
LLIVLCALA

SEQ ID NO: 1371438 - protein, 9 aa, Homo Sapiens
APLHPPRGG

SEQ ID NO: 1371439 - protein, 9 aa, Homo Sapiens
MPASNFAAV

SEQ ID NO: 1371440 - protein, 9 aa, Homo Sapiens
VASVLLCLD

SEQ ID NO: 1371441 - protein, 9 aa, Homo Sapiens
MDRSWKIAL

SEQ ID NO: 1371442 - protein, 9 aa, Homo Sapiens
GTKAGTKYT

SEQ ID NO: 1371443 - protein, 9 aa, Homo Sapiens
VQCLVPAER

SEQ ID NO: 1371444 - protein, 9 aa, Homo Sapiens
SQGTLSLQR

SEQ ID NO: 1371445 - protein, 9 aa, Homo Sapiens
LLNHRHSHE

SEQ ID NO: 1371446 - protein, 9 aa, Homo Sapiens
QEEPDSCIG

SEQ ID NO: 1371447 - protein, 9 aa, Homo Sapiens
ACEQLARIL

SEQ ID NO: 1371448 - protein, 9 aa, Homo Sapiens
PGHRGEMGP

SEQ ID NO: 1371449 - protein, 9 aa, Homo Sapiens
VSGETGSRS

SEQ ID NO: 1371450 - protein, 9 aa, Homo Sapiens
DDGAAALPH

SEQ ID NO: 1371451 - protein, 9 aa, Homo Sapiens
SSGRNIALR

SEQ ID NO: 1371452 - protein, 9 aa, Homo Sapiens
ECWRENLLE

SEQ ID NO: 1371453 - protein, 9 aa, Homo Sapiens
TAHPPLPPA

SEQ ID NO: 1371454 - protein, 9 aa, Homo Sapiens
VVMQKLLRK

SEQ ID NO: 1371455 - protein, 9 aa, Homo Sapiens
LRACLPAQT

SEQ ID NO: 1371456 - protein, 9 aa, Homo Sapiens
KAVVHYDRS

SEQ ID NO: 1371457 - protein, 9 aa, Homo Sapiens
IPVSQPLPR

SEQ ID NO: 1371458 - protein, 9 aa, Homo Sapiens
SVSKNPVCK

SEQ ID NO: 1371459 - protein, 9 aa, Homo Sapiens
YVQKLVKVR

SEQ ID NO: 1371460 - protein, 9 aa, Homo Sapiens
DILNGVTRL

SEQ ID NO: 1371461 - protein, 9 aa, Homo Sapiens
SCLHRRRAF

SEQ ID NO: 1371462 - protein, 9 aa, Homo Sapiens
NPFLSVHSS

SEQ ID NO: 1371463 - protein, 9 aa, Homo Sapiens
CLVGTEGLP

SEQ ID NO: 1371464 - protein, 9 aa, Homo Sapiens
KAFRRFSSP

SEQ ID NO: 1371465 - protein, 9 aa, Homo Sapiens
MPCPMPTTP

SEQ ID NO: 1371466 - protein, 9 aa, Homo Sapiens
GVKTNFIDR

SEQ ID NO: 1371467 - protein, 9 aa, Homo Sapiens
DTVEVGEGQ

SEQ ID NO: 1371468 - protein, 9 aa, Homo Sapiens
EADGVDGHH

SEQ ID NO: 1371469 - protein, 9 aa, Homo Sapiens
RGVVLPSPA

SEQ ID NO: 1371470 - protein, 9 aa, Homo Sapiens
LEPNPVTGR

SEQ ID NO: 1371471 - protein, 9 aa, Homo Sapiens
PRTCDSRFA

SEQ ID NO: 1371472 - protein, 9 aa, Homo Sapiens
GMKWKKDSK

SEQ ID NO: 1371473 - protein, 9 aa, Homo Sapiens
ERDSLEFEM

SEQ ID NO: 1371474 - protein, 9 aa, Homo Sapiens
SPHEAAYDA

SEQ ID NO: 1371475 - protein, 9 aa, Homo Sapiens
QFLLHGPYH

SEQ ID NO: 1371476 - protein, 9 aa, Homo Sapiens
QVTITMYMK

SEQ ID NO: 1371477 - protein, 9 aa, Homo Sapiens
SEEHSLEVH

SEQ ID NO: 1371478 - protein, 9 aa, Homo Sapiens
LRNLPGHCS

SEQ ID NO: 1371479 - protein, 9 aa, Homo Sapiens
ESKVIQWAP

SEQ ID NO: 1371480 - protein, 9 aa, Homo Sapiens
QSEEHSLEV

SEQ ID NO: 1371481 - protein, 9 aa, Homo Sapiens
PLLHKCCPS

SEQ ID NO: 1371482 - protein, 9 aa, Homo Sapiens
FSPTPDESS

SEQ ID NO: 1371483 - protein, 9 aa, Homo Sapiens
LQRRRKERQ

SEQ ID NO: 1371484 - protein, 9 aa, Homo Sapiens
VGRFAMELE

SEQ ID NO: 1371485 - protein, 9 aa, Homo Sapiens
LHHSPRQWL

SEQ ID NO: 1371486 - protein, 9 aa, Homo Sapiens
NFVQHACFG

SEQ ID NO: 1371487 - protein, 9 aa, Homo Sapiens
FLFLIYLRW

SEQ ID NO: 1371488 - protein, 9 aa, Homo Sapiens
VKPLKEVHK

SEQ ID NO: 1371489 - protein, 9 aa, Homo Sapiens
LLLPLAPAD

SEQ ID NO: 1371490 - protein, 9 aa, Homo Sapiens
DQSSPIGLG

SEQ ID NO: 1371491 - protein, 9 aa, Homo Sapiens
AQLRVHMAD

SEQ ID NO: 1371492 - protein, 9 aa, Homo Sapiens
RSRAQERRR

SEQ ID NO: 1371493 - protein, 9 aa, Homo Sapiens
VMEYVVGGE

SEQ ID NO: 1371494 - protein, 9 aa, Homo Sapiens
AAPGQSPIG

SEQ ID NO: 1371495 - protein, 9 aa, Homo Sapiens
HKCNDCGKA

SEQ ID NO: 1371496 - protein, 9 aa, Homo Sapiens
APGQSPIGS

SEQ ID NO: 1371497 - protein, 9 aa, Homo Sapiens
AEHGSRRES

SEQ ID NO: 1371498 - protein, 9 aa, Homo Sapiens
GAALGGVAL

SEQ ID NO: 1371499 - protein, 9 aa, Homo Sapiens
EHRGHHTLL

SEQ ID NO: 1371500 - protein, 9 aa, Homo Sapiens
HLHAHPPGP

SEQ ID NO: 1371501 - protein, 9 aa, Homo Sapiens
EKRKSLQLP

SEQ ID NO: 1371502 - protein, 9 aa, Homo Sapiens
IDRLSTTCI

SEQ ID NO: 1371503 - protein, 9 aa, Homo Sapiens
IEFDGGAGS

SEQ ID NO: 1371504 - protein, 9 aa, Homo Sapiens
AQQSRLDEL

SEQ ID NO: 1371505 - protein, 9 aa, Homo Sapiens
HNPDLCGPV

SEQ ID NO: 1371506 - protein, 9 aa, Homo Sapiens
VTVVVGSRS

SEQ ID NO: 1371507 - protein, 9 aa, Homo Sapiens
RRTLYQEVM

SEQ ID NO: 1371508 - protein, 9 aa, Homo Sapiens
FYEQDMKVF

SEQ ID NO: 1371509 - protein, 9 aa, Homo Sapiens
KDQLSPRVK

SEQ ID NO: 1371510 - protein, 9 aa, Homo Sapiens
ESEKKSSGA

SEQ ID NO: 1371511 - protein, 9 aa, Homo Sapiens
LPGEPQPPP

SEQ ID NO: 1371512 - protein, 9 aa, Homo Sapiens
RKVQRRNLG

SEQ ID NO: 1371513 - protein, 9 aa, Homo Sapiens
LMPYGAPII

SEQ ID NO: 1371514 - protein, 9 aa, Homo Sapiens
WEVIFGYIE

SEQ ID NO: 1371515 - protein, 9 aa, Homo Sapiens
DLSVWCYYC

SEQ ID NO: 1371516 - protein, 9 aa, Homo Sapiens
RTRPSSDRL

SEQ ID NO: 1371517 - protein, 9 aa, Homo Sapiens
VLTALGRSQ

SEQ ID NO: 1371518 - protein, 9 aa, Homo Sapiens
SALRTRRPA

SEQ ID NO: 1371519 - protein, 9 aa, Homo Sapiens
QWQEELQQV

SEQ ID NO: 1371520 - protein, 9 aa, Homo Sapiens
VEKQVFKNL

SEQ ID NO: 1371521 - protein, 9 aa, Homo Sapiens
LAVVKFFLL

SEQ ID NO: 1371522 - protein, 9 aa, Homo Sapiens
HSQRLRGTM

SEQ ID NO: 1371523 - protein, 9 aa, Homo Sapiens
SHVGKDSRG

SEQ ID NO: 1371524 - protein, 9 aa, Homo Sapiens
DITLVPTTN

SEQ ID NO: 1371525 - protein, 9 aa, Homo Sapiens
GLAPSLVTA

SEQ ID NO: 1371526 - protein, 9 aa, Homo Sapiens
FVHDLVPYL

SEQ ID NO: 1371527 - protein, 9 aa, Homo Sapiens
FMPKSDTDK

SEQ ID NO: 1371528 - protein, 9 aa, Homo Sapiens
RVVVNVEDA

SEQ ID NO: 1371529 - protein, 9 aa, Homo Sapiens
EEFKEPKAR

SEQ ID NO: 1371530 - protein, 9 aa, Homo Sapiens
MTHQLPSRN

SEQ ID NO: 1371531 - protein, 9 aa, Homo Sapiens
QNQLSVMYR

SEQ ID NO: 1371532 - protein, 9 aa, Homo Sapiens
KVFRNEGRE

SEQ ID NO: 1371533 - protein, 9 aa, Homo Sapiens
GQRSLWEGG

SEQ ID NO: 1371534 - protein, 9 aa, Homo Sapiens
ITLVPTTNG

SEQ ID NO: 1371535 - protein, 9 aa, Homo Sapiens
GDKRDALLL

SEQ ID NO: 1371536 - protein, 9 aa, Homo Sapiens
YDSRLRIQD

SEQ ID NO: 1371537 - protein, 9 aa, Homo Sapiens
SCIGEKLFM

SEQ ID NO: 1371538 - protein, 9 aa, Homo Sapiens
YYISLSEDV

SEQ ID NO: 1371539 - protein, 9 aa, Homo Sapiens
VVDSMCLES

SEQ ID NO: 1371540 - protein, 9 aa, Homo Sapiens
QRLFSVRHR

SEQ ID NO: 1371541 - protein, 9 aa, Homo Sapiens
HYHIGSGYV

SEQ ID NO: 1371542 - protein, 9 aa, Homo Sapiens
AASGCLDIN

SEQ ID NO: 1371543 - protein, 9 aa, Homo Sapiens
KKSYNKLKE

SEQ ID NO: 1371544 - protein, 9 aa, Homo Sapiens
HSNFEIVNL

SEQ ID NO: 1371545 - protein, 9 aa, Homo Sapiens
GRFLGCAGP

SEQ ID NO: 1371546 - protein, 9 aa, Homo Sapiens
GCPVSGHTD

SEQ ID NO: 1371547 - protein, 9 aa, Homo Sapiens
TQYRPIFPP

SEQ ID NO: 1371548 - protein, 9 aa, Homo Sapiens
WTYGSCCSF

SEQ ID NO: 1371549 - protein, 9 aa, Homo Sapiens
GKKMDLDGM

SEQ ID NO: 1371550 - protein, 9 aa, Homo Sapiens
NLCLPAPAH

SEQ ID NO: 1371551 - protein, 9 aa, Homo Sapiens
QAHQADGRE

SEQ ID NO: 1371552 - protein, 9 aa, Homo Sapiens
ERPIRLTLG

SEQ ID NO: 1371553 - protein, 9 aa, Homo Sapiens
VPIGGRFDR

SEQ ID NO: 1371554 - protein, 9 aa, Homo Sapiens
VVISTKDTM

SEQ ID NO: 1371555 - protein, 9 aa, Homo Sapiens
NRNEDDEVP

SEQ ID NO: 1371556 - protein, 9 aa, Homo Sapiens
HWQEGLGED

SEQ ID NO: 1371557 - protein, 9 aa, Homo Sapiens
QEEVSGHQA

SEQ ID NO: 1371558 - protein, 9 aa, Homo Sapiens
LLTEEVARE

SEQ ID NO: 1371559 - protein, 9 aa, Homo Sapiens
CVSKNSSSL

SEQ ID NO: 1371560 - protein, 9 aa, Homo Sapiens
GLRPQEGPG

SEQ ID NO: 1371561 - protein, 9 aa, Homo Sapiens
EGQVADQEE

SEQ ID NO: 1371562 - protein, 9 aa, Homo Sapiens
LTQHPATTE

SEQ ID NO: 1371563 - protein, 9 aa, Homo Sapiens
EKNSTSFFW

SEQ ID NO: 1371564 - protein, 9 aa, Homo Sapiens
AQPYLRVSL

SEQ ID NO: 1371565 - protein, 9 aa, Homo Sapiens
QEEPMTGFY

SEQ ID NO: 1371566 - protein, 9 aa, Homo Sapiens
QDLRPGACG

SEQ ID NO: 1371567 - protein, 9 aa, Homo Sapiens
PQVILHVCQ

SEQ ID NO: 1371568 - protein, 9 aa, Homo Sapiens
RFFDGVKDV

SEQ ID NO: 1371569 - protein, 9 aa, Homo Sapiens
IPTNRVKVS

SEQ ID NO: 1371570 - protein, 9 aa, Homo Sapiens
SRDTSKLMK

SEQ ID NO: 1371571 - protein, 9 aa, Homo Sapiens
TLCLQSHRP

SEQ ID NO: 1371572 - protein, 9 aa, Homo Sapiens
STSSSSLTS

SEQ ID NO: 1371573 - protein, 9 aa, Homo Sapiens
KYAAHNTYH

SEQ ID NO: 1371574 - protein, 9 aa, Homo Sapiens
VMKRKVVIK

SEQ ID NO: 1371575 - protein, 9 aa, Homo Sapiens
GTEISLCGW

SEQ ID NO: 1371576 - protein, 9 aa, Homo Sapiens
LQRQAQTQT

SEQ ID NO: 1371577 - protein, 9 aa, Homo Sapiens
QLIPEECGA

SEQ ID NO: 1371578 - protein, 9 aa, Homo Sapiens
TLSCSEICY

SEQ ID NO: 1371579 - protein, 9 aa, Homo Sapiens
NTVNQKKAK

SEQ ID NO: 1371580 - protein, 9 aa, Homo Sapiens
APSCSAHPC

SEQ ID NO: 1371581 - protein, 9 aa, Homo Sapiens
PSPPGPHSG

SEQ ID NO: 1371582 - protein, 9 aa, Homo Sapiens
RLSKGSPEE

SEQ ID NO: 1371583 - protein, 9 aa, Homo Sapiens
QQELKKSYN

SEQ ID NO: 1371584 - protein, 9 aa, Homo Sapiens
PKYRIQSYR

SEQ ID NO: 1371585 - protein, 9 aa, Homo Sapiens
GRLFLDVVV

SEQ ID NO: 1371586 - protein, 9 aa, Homo Sapiens
MTQIMFETV

SEQ ID NO: 1371587 - protein, 9 aa, Homo Sapiens
ELLAGVLLV

SEQ ID NO: 1371588 - protein, 9 aa, Homo Sapiens
GHVHRRVCV

SEQ ID NO: 1371589 - protein, 9 aa, Homo Sapiens
PPQPQSVLC

SEQ ID NO: 1371590 - protein, 9 aa, Homo Sapiens
LRCICKFLD

SEQ ID NO: 1371591 - protein, 9 aa, Homo Sapiens
AVVLDLAQA

SEQ ID NO: 1371592 - protein, 9 aa, Homo Sapiens
SETPVPVAA

SEQ ID NO: 1371593 - protein, 9 aa, Homo Sapiens
AKFRTQERA

SEQ ID NO: 1371594 - protein, 9 aa, Homo Sapiens
RPLSHRTIT

SEQ ID NO: 1371595 - protein, 9 aa, Homo Sapiens
DQLSPRVKA

SEQ ID NO: 1371596 - protein, 9 aa, Homo Sapiens
ARASAGPVT

SEQ ID NO: 1371597 - protein, 9 aa, Homo Sapiens
CRRRWRRVL

SEQ ID NO: 1371598 - protein, 9 aa, Homo Sapiens
YGTEVHTNT

SEQ ID NO: 1371599 - protein, 9 aa, Homo Sapiens
GTPSLIMKP

SEQ ID NO: 1371600 - protein, 9 aa, Homo Sapiens
KEEKKREGI

SEQ ID NO: 1371601 - protein, 9 aa, Homo Sapiens
PVLERRTPD

SEQ ID NO: 1371602 - protein, 9 aa, Homo Sapiens
AVRALCQIA

SEQ ID NO: 1371603 - protein, 9 aa, Homo Sapiens
IFGYIEHGE

SEQ ID NO: 1371604 - protein, 9 aa, Homo Sapiens
DEIDIADTV

SEQ ID NO: 1371605 - protein, 9 aa, Homo Sapiens
AVRRLNELY

SEQ ID NO: 1371606 - protein, 9 aa, Homo Sapiens
WGAMVPRGV

SEQ ID NO: 1371607 - protein, 9 aa, Homo Sapiens
AEARARRHR

SEQ ID NO: 1371608 - protein, 9 aa, Homo Sapiens
RLHVSITNT

SEQ ID NO: 1371609 - protein, 9 aa, Homo Sapiens
LGMRTGEVR

SEQ ID NO: 1371610 - protein, 9 aa, Homo Sapiens
RRAPAPQGP

SEQ ID NO: 1371611 - protein, 9 aa, Homo Sapiens
VWNCHRYIN

SEQ ID NO: 1371612 - protein, 9 aa, Homo Sapiens
ERRSLLDGS

SEQ ID NO: 1371613 - protein, 9 aa, Homo Sapiens
SCRRQLDNF

SEQ ID NO: 1371614 - protein, 9 aa, Homo Sapiens
YEKDLWEHI

SEQ ID NO: 1371615 - protein, 9 aa, Homo Sapiens
LGDGKKMDL

SEQ ID NO: 1371616 - protein, 9 aa, Homo Sapiens
VHNPDLCGP

SEQ ID NO: 1371617 - protein, 9 aa, Homo Sapiens
VLGIEDCSV

SEQ ID NO: 1371618 - protein, 9 aa, Homo Sapiens
FAMQISFLQ

SEQ ID NO: 1371619 - protein, 9 aa, Homo Sapiens
LQAQQSRLD

SEQ ID NO: 1371620 - protein, 9 aa, Homo Sapiens
KLPRLSKGS

SEQ ID NO: 1371621 - protein, 9 aa, Homo Sapiens
ADVHHYLCT

SEQ ID NO: 1371622 - protein, 9 aa, Homo Sapiens
PSISIPAAK

SEQ ID NO: 1371623 - protein, 9 aa, Homo Sapiens
SVKDTNDSP

SEQ ID NO: 1371624 - protein, 9 aa, Homo Sapiens
SLQQCVASS

SEQ ID NO: 1371625 - protein, 9 aa, Homo Sapiens
ILSYFNFLR

SEQ ID NO: 1371626 - protein, 9 aa, Homo Sapiens
RLCQTDPSG

SEQ ID NO: 1371627 - protein, 9 aa, Homo Sapiens
IELACQKQS

SEQ ID NO: 1371628 - protein, 9 aa, Homo Sapiens
SCFNFEFID

SEQ ID NO: 1371629 - protein, 9 aa, Homo Sapiens
PESHHGSHA

SEQ ID NO: 1371630 - protein, 9 aa, Homo Sapiens
VCNCFGFVG

SEQ ID NO: 1371631 - protein, 9 aa, Homo Sapiens
AESGKVHAL

SEQ ID NO: 1371632 - protein, 9 aa, Homo Sapiens
WNRSPLPSP

SEQ ID NO: 1371633 - protein, 9 aa, Homo Sapiens
QTVKQCGYS

SEQ ID NO: 1371634 - protein, 9 aa, Homo Sapiens
KLYEAYSKA

SEQ ID NO: 1371635 - protein, 9 aa, Homo Sapiens
KAFKRPSHL

SEQ ID NO: 1371636 - protein, 9 aa, Homo Sapiens
QPSTSGKRP

SEQ ID NO: 1371637 - protein, 9 aa, Homo Sapiens
SDYGPPSPG

SEQ ID NO: 1371638 - protein, 9 aa, Homo Sapiens
DVLRHQVHL

SEQ ID NO: 1371639 - protein, 9 aa, Homo Sapiens
HDLASREWL

SEQ ID NO: 1371640 - protein, 9 aa, Homo Sapiens
PAQDCVRLE

SEQ ID NO: 1371641 - protein, 9 aa, Homo Sapiens
PSSQGTLSL

SEQ ID NO: 1371642 - protein, 9 aa, Homo Sapiens
RKPCPVDGG

SEQ ID NO: 1371643 - protein, 9 aa, Homo Sapiens
CAVLEKRVQ

SEQ ID NO: 1371644 - protein, 9 aa, Homo Sapiens
CPHWPARID

SEQ ID NO: 1371645 - protein, 9 aa, Homo Sapiens
TRARASAGP

SEQ ID NO: 1371646 - protein, 9 aa, Homo Sapiens
SGVPLLCKR

SEQ ID NO: 1371647 - protein, 9 aa, Homo Sapiens
VEGGTLIWP

SEQ ID NO: 1371648 - protein, 9 aa, Homo Sapiens
MPTVPKHLT

SEQ ID NO: 1371649 - protein, 9 aa, Homo Sapiens
VVRQGTTIF

SEQ ID NO: 1371650 - protein, 9 aa, Homo Sapiens
SNYLHWGEP

SEQ ID NO: 1371651 - protein, 9 aa, Homo Sapiens
SSLARRLDF

SEQ ID NO: 1371652 - protein, 9 aa, Homo Sapiens
CVPSNFVAR

SEQ ID NO: 1371653 - protein, 9 aa, Homo Sapiens
GEDEGGEPA

SEQ ID NO: 1371654 - protein, 9 aa, Homo Sapiens
RLEGRDPAA

SEQ ID NO: 1371655 - protein, 9 aa, Homo Sapiens
GSTFSFFIG

SEQ ID NO: 1371656 - protein, 9 aa, Homo Sapiens
RADKCAVDI

SEQ ID NO: 1371657 - protein, 9 aa, Homo Sapiens
GATPSNCTP

SEQ ID NO: 1371658 - protein, 9 aa, Homo Sapiens
DTQLKNLSE

SEQ ID NO: 1371659 - protein, 9 aa, Homo Sapiens
SSNYLHWGE

SEQ ID NO: 1371660 - protein, 9 aa, Homo Sapiens
DSPPATCHN

SEQ ID NO: 1371661 - protein, 9 aa, Homo Sapiens
QMCASLSLL

SEQ ID NO: 1371662 - protein, 9 aa, Homo Sapiens
KSTETTQQL

SEQ ID NO: 1371663 - protein, 9 aa, Homo Sapiens
STCCSMGQT

SEQ ID NO: 1371664 - protein, 9 aa, Homo Sapiens
RYEAQKPER

SEQ ID NO: 1371665 - protein, 9 aa, Homo Sapiens
DRSGGRSGC

SEQ ID NO: 1371666 - protein, 9 aa, Homo Sapiens
PPRRRVTPR

SEQ ID NO: 1371667 - protein, 9 aa, Homo Sapiens
RPHAVLRGQ

SEQ ID NO: 1371668 - protein, 9 aa, Homo Sapiens
GGLPGQAFE

SEQ ID NO: 1371669 - protein, 9 aa, Homo Sapiens
TFQLTATDT

SEQ ID NO: 1371670 - protein, 9 aa, Homo Sapiens
MTFPCEMTP

SEQ ID NO: 1371671 - protein, 9 aa, Homo Sapiens
AARIAERNL

SEQ ID NO: 1371672 - protein, 9 aa, Homo Sapiens
FVMMSRVMS

SEQ ID NO: 1371673 - protein, 9 aa, Homo Sapiens
FTKYPKKFC

SEQ ID NO: 1371674 - protein, 9 aa, Homo Sapiens
LRSLRPGAE

SEQ ID NO: 1371675 - protein, 9 aa, Homo Sapiens
RKRMLSVST

SEQ ID NO: 1371676 - protein, 9 aa, Homo Sapiens
GERLHLLCE

SEQ ID NO: 1371677 - protein, 9 aa, Homo Sapiens
CVAGPSVTS

SEQ ID NO: 1371678 - protein, 9 aa, Homo Sapiens
LVPTTNGTL

SEQ ID NO: 1371679 - protein, 9 aa, Homo Sapiens
SKLNQWCNV

SEQ ID NO: 1371680 - protein, 9 aa, Homo Sapiens
CTECGMEFG

SEQ ID NO: 1371681 - protein, 9 aa, Homo Sapiens
PRATRRPRA

SEQ ID NO: 1371682 - protein, 9 aa, Homo Sapiens
LPEVCDGMG

SEQ ID NO: 1371683 - protein, 9 aa, Homo Sapiens
PFLNSVSKN

SEQ ID NO: 1371684 - protein, 9 aa, Homo Sapiens
TEMGARGTF

SEQ ID NO: 1371685 - protein, 9 aa, Homo Sapiens
RGPANGSPP

SEQ ID NO: 1371686 - protein, 9 aa, Homo Sapiens
GSDAPLEAL

SEQ ID NO: 1371687 - protein, 9 aa, Homo Sapiens
TPLHHSPRQ

SEQ ID NO: 1371688 - protein, 9 aa, Homo Sapiens
LILDLCLDI

SEQ ID NO: 1371689 - protein, 9 aa, Homo Sapiens
PAEDRCQTC

SEQ ID NO: 1371690 - protein, 9 aa, Homo Sapiens
PIGLGGQHT

SEQ ID NO: 1371691 - protein, 9 aa, Homo Sapiens
GHLPPSSSQ

SEQ ID NO: 1371692 - protein, 9 aa, Homo Sapiens
HSLEVHCPS

SEQ ID NO: 1371693 - protein, 9 aa, Homo Sapiens
PAKIEAEPW

SEQ ID NO: 1371694 - protein, 9 aa, Homo Sapiens
DWAFLSKKG

SEQ ID NO: 1371695 - protein, 9 aa, Homo Sapiens
DSWKVKALD

SEQ ID NO: 1371696 - protein, 9 aa, Homo Sapiens
SASCRHGYP

SEQ ID NO: 1371697 - protein, 9 aa, Homo Sapiens
KRSDPVNHY

SEQ ID NO: 1371698 - protein, 9 aa, Homo Sapiens
NLEGKKRFR

SEQ ID NO: 1371699 - protein, 9 aa, Homo Sapiens
PGTPPPLIL

SEQ ID NO: 1371700 - protein, 9 aa, Homo Sapiens
GAPWRHGDE

SEQ ID NO: 1371701 - protein, 9 aa, Homo Sapiens
SPAIAAVGE

SEQ ID NO: 1371702 - protein, 9 aa, Homo Sapiens
EVRHNSSCA

SEQ ID NO: 1371703 - protein, 9 aa, Homo Sapiens
SHCLYYLGM

SEQ ID NO: 1371704 - protein, 9 aa, Homo Sapiens
TVSVCRATG

SEQ ID NO: 1371705 - protein, 9 aa, Homo Sapiens
PEDHEKLGF

SEQ ID NO: 1371706 - protein, 9 aa, Homo Sapiens
VPRVQGFLL

SEQ ID NO: 1371707 - protein, 9 aa, Homo Sapiens
SSRESVAEH

SEQ ID NO: 1371708 - protein, 9 aa, Homo Sapiens
QGGTLSIPP

SEQ ID NO: 1371709 - protein, 9 aa, Homo Sapiens
SVRCSQCQC

SEQ ID NO: 1371710 - protein, 9 aa, Homo Sapiens
VSGNMIIVM

SEQ ID NO: 1371711 - protein, 9 aa, Homo Sapiens
IEVNNAAAR

SEQ ID NO: 1371712 - protein, 9 aa, Homo Sapiens
LTFTDSAPT

SEQ ID NO: 1371713 - protein, 9 aa, Homo Sapiens
GPWGAAPRA

SEQ ID NO: 1371714 - protein, 9 aa, Homo Sapiens
RLVSNPSLH

SEQ ID NO: 1371715 - protein, 9 aa, Homo Sapiens
SVQSRVKTW

SEQ ID NO: 1371716 - protein, 9 aa, Homo Sapiens
DILDGVTGL

SEQ ID NO: 1371717 - protein, 9 aa, Homo Sapiens
LDTILHQRG

SEQ ID NO: 1371718 - protein, 9 aa, Homo Sapiens
KLACLGGGR

SEQ ID NO: 1371719 - protein, 9 aa, Homo Sapiens
KACMTQLVS

SEQ ID NO: 1371720 - protein, 9 aa, Homo Sapiens
EYQQELKKS

SEQ ID NO: 1371721 - protein, 9 aa, Homo Sapiens
RPQPTRLVA

SEQ ID NO: 1371722 - protein, 9 aa, Homo Sapiens
LRTLEEQGA

SEQ ID NO: 1371723 - protein, 9 aa, Homo Sapiens
RDLKPEDLL

SEQ ID NO: 1371724 - protein, 9 aa, Homo Sapiens
ARPFGREEE

SEQ ID NO: 1371725 - protein, 9 aa, Homo Sapiens
VPSTTRRAV

SEQ ID NO: 1371726 - protein, 9 aa, Homo Sapiens
AKTLSINTI

SEQ ID NO: 1371727 - protein, 9 aa, Homo Sapiens
SCFSTTTLS

SEQ ID NO: 1371728 - protein, 9 aa, Homo Sapiens
VSRPPRRRV

SEQ ID NO: 1371729 - protein, 9 aa, Homo Sapiens
LYNDAAESC

SEQ ID NO: 1371730 - protein, 9 aa, Homo Sapiens
IIHCIAGVG

SEQ ID NO: 1371731 - protein, 9 aa, Homo Sapiens
PVRDEYEFT

SEQ ID NO: 1371732 - protein, 9 aa, Homo Sapiens
WFQNRGMKW

SEQ ID NO: 1371733 - protein, 9 aa, Homo Sapiens
LPGIHGPPL

SEQ ID NO: 1371734 - protein, 9 aa, Homo Sapiens
LEKIDKACS

SEQ ID NO: 1371735 - protein, 9 aa, Homo Sapiens
DEVRLRCQS

SEQ ID NO: 1371736 - protein, 9 aa, Homo Sapiens
GIRELHDMF

SEQ ID NO: 1371737 - protein, 9 aa, Homo Sapiens
TAPPALPHA

SEQ ID NO: 1371738 - protein, 9 aa, Homo Sapiens
HPVQGTKII

SEQ ID NO: 1371739 - protein, 9 aa, Homo Sapiens
PSALRSHTR

SEQ ID NO: 1371740 - protein, 9 aa, Homo Sapiens
APLGTHPGG

SEQ ID NO: 1371741 - protein, 9 aa, Homo Sapiens
KSVQPHKDL

SEQ ID NO: 1371742 - protein, 9 aa, Homo Sapiens
PFLHFIQLM

SEQ ID NO: 1371743 - protein, 9 aa, Homo Sapiens
LEKEPLRVK

SEQ ID NO: 1371744 - protein, 9 aa, Homo Sapiens
RGASGRDRE

SEQ ID NO: 1371745 - protein, 9 aa, Homo Sapiens
RTEPTAWNE

SEQ ID NO: 1371746 - protein, 9 aa, Homo Sapiens
KQECLEVQR

SEQ ID NO: 1371747 - protein, 9 aa, Homo Sapiens
EGFDFGVRR

SEQ ID NO: 1371748 - protein, 9 aa, Homo Sapiens
EIKNVLLLW

SEQ ID NO: 1371749 - protein, 9 aa, Homo Sapiens
ESGRLISHM

SEQ ID NO: 1371750 - protein, 9 aa, Homo Sapiens
YAPVMRTVG

SEQ ID NO: 1371751 - protein, 9 aa, Homo Sapiens
QLLERLQAQ

SEQ ID NO: 1371752 - protein, 9 aa, Homo Sapiens
KKNYSSNWS

SEQ ID NO: 1371753 - protein, 9 aa, Homo Sapiens
GPPGHRFWP

SEQ ID NO: 1371754 - protein, 9 aa, Homo Sapiens
STISSIQSQ

SEQ ID NO: 1371755 - protein, 9 aa, Homo Sapiens
PKKFCPLEI

SEQ ID NO: 1371756 - protein, 9 aa, Homo Sapiens
VGIALGGYI

SEQ ID NO: 1371757 - protein, 9 aa, Homo Sapiens
ASCDRKLGA

SEQ ID NO: 1371758 - protein, 9 aa, Homo Sapiens
RLPSDPLTH

SEQ ID NO: 1371759 - protein, 9 aa, Homo Sapiens
LWNRSPLPS

SEQ ID NO: 1371760 - protein, 9 aa, Homo Sapiens
PGPQALPEK

SEQ ID NO: 1371761 - protein, 9 aa, Homo Sapiens
EWKRWLQKS

SEQ ID NO: 1371762 - protein, 9 aa, Homo Sapiens
WPRGGNAPL

SEQ ID NO: 1371763 - protein, 9 aa, Homo Sapiens
LQERGGGLR

SEQ ID NO: 1371764 - protein, 9 aa, Homo Sapiens
SGGSRVSQR

SEQ ID NO: 1371765 - protein, 9 aa, Homo Sapiens
KSELIANGS

SEQ ID NO: 1371766 - protein, 9 aa, Homo Sapiens
EECEKGFSW

SEQ ID NO: 1371767 - protein, 9 aa, Homo Sapiens
IFAALQCHI

SEQ ID NO: 1371768 - protein, 9 aa, Homo Sapiens
HDLYDKFEE

SEQ ID NO: 1371769 - protein, 9 aa, Homo Sapiens
SFAPRRRAA

SEQ ID NO: 1371770 - protein, 9 aa, Homo Sapiens
LSAESVGDV

SEQ ID NO: 1371771 - protein, 9 aa, Homo Sapiens
LHYAALSFH

SEQ ID NO: 1371772 - protein, 9 aa, Homo Sapiens
PLPMVLPSI

SEQ ID NO: 1371773 - protein, 9 aa, Homo Sapiens
PSKLNQWCN

SEQ ID NO: 1371774 - protein, 9 aa, Homo Sapiens
FFLHKEFLL

SEQ ID NO: 1371775 - protein, 9 aa, Homo Sapiens
CPSSWMTPT

SEQ ID NO: 1371776 - protein, 9 aa, Homo Sapiens
MKRPLGMQQ

SEQ ID NO: 1371777 - protein, 9 aa, Homo Sapiens
LAPADLCLP

SEQ ID NO: 1371778 - protein, 9 aa, Homo Sapiens
VGAVYMYPE

SEQ ID NO: 1371779 - protein, 9 aa, Homo Sapiens
RSGDAGEHL

SEQ ID NO: 1371780 - protein, 9 aa, Homo Sapiens
RVICSLYSH

SEQ ID NO: 1371781 - protein, 9 aa, Homo Sapiens
HEAHYLHLQ

SEQ ID NO: 1371782 - protein, 9 aa, Homo Sapiens
VVFCMHHQR

SEQ ID NO: 1371783 - protein, 9 aa, Homo Sapiens
FTAISTVEI

SEQ ID NO: 1371784 - protein, 9 aa, Homo Sapiens
LLPTLPPTR

SEQ ID NO: 1371785 - protein, 9 aa, Homo Sapiens
GDTGNNNWV

SEQ ID NO: 1371786 - protein, 9 aa, Homo Sapiens
HSDLEEAPS

SEQ ID NO: 1371787 - protein, 9 aa, Homo Sapiens
MFEYQTLPE

SEQ ID NO: 1371788 - protein, 9 aa, Homo Sapiens
AAAHFPSVA

SEQ ID NO: 1371789 - protein, 9 aa, Homo Sapiens
QFFDRVSSE

SEQ ID NO: 1371790 - protein, 9 aa, Homo Sapiens
AGRMTFPCE

SEQ ID NO: 1371791 - protein, 9 aa, Homo Sapiens
AIGGGVARV

SEQ ID NO: 1371792 - protein, 9 aa, Homo Sapiens
PLESVRQIY

SEQ ID NO: 1371793 - protein, 9 aa, Homo Sapiens
GSPQTSSTA

SEQ ID NO: 1371794 - protein, 9 aa, Homo Sapiens
MFLKRDMSI

SEQ ID NO: 1371795 - protein, 9 aa, Homo Sapiens
PAAPGQSPI

SEQ ID NO: 1371796 - protein, 9 aa, Homo Sapiens
GPPSGSPPG

SEQ ID NO: 1371797 - protein, 9 aa, Homo Sapiens
DEEAVEEPQ

SEQ ID NO: 1371798 - protein, 9 aa, Homo Sapiens
CQCTAQDGG

SEQ ID NO: 1371799 - protein, 9 aa, Homo Sapiens
AFLSKKGCS

SEQ ID NO: 1371800 - protein, 9 aa, Homo Sapiens
EQRSAQVDV

SEQ ID NO: 1371801 - protein, 9 aa, Homo Sapiens
IVDEANGLI

SEQ ID NO: 1371802 - protein, 9 aa, Homo Sapiens
MMSRVMSVG

SEQ ID NO: 1371803 - protein, 9 aa, Homo Sapiens
VVLIMVWGH

SEQ ID NO: 1371804 - protein, 9 aa, Homo Sapiens
IETAHPPLP

SEQ ID NO: 1371805 - protein, 9 aa, Homo Sapiens
GELHYAALS

SEQ ID NO: 1371806 - protein, 9 aa, Homo Sapiens
MKSHSVPDE

SEQ ID NO: 1371807 - protein, 9 aa, Homo Sapiens
LSSSSQRLL

SEQ ID NO: 1371808 - protein, 9 aa, Homo Sapiens
LKRFFDGVK

SEQ ID NO: 1371809 - protein, 9 aa, Homo Sapiens
VAILRHNLN

SEQ ID NO: 1371810 - protein, 9 aa, Homo Sapiens
DFAGSSPKA

SEQ ID NO: 1371811 - protein, 9 aa, Homo Sapiens
MQVWSAGLA

SEQ ID NO: 1371812 - protein, 9 aa, Homo Sapiens
GDDDVKKPA

SEQ ID NO: 1371813 - protein, 9 aa, Homo Sapiens
GPSGELEQR

SEQ ID NO: 1371814 - protein, 9 aa, Homo Sapiens
VKDVTGSPP

SEQ ID NO: 1371815 - protein, 9 aa, Homo Sapiens
PTRMAGRRS

SEQ ID NO: 1371816 - protein, 9 aa, Homo Sapiens
DDVTFPELL

SEQ ID NO: 1371817 - protein, 9 aa, Homo Sapiens
TKLTQSVDL

SEQ ID NO: 1371818 - protein, 9 aa, Homo Sapiens
STSAHTPTR

SEQ ID NO: 1371819 - protein, 9 aa, Homo Sapiens
RRHPASCLG

SEQ ID NO: 1371820 - protein, 9 aa, Homo Sapiens
DLCFDVLDS

SEQ ID NO: 1371821 - protein, 9 aa, Homo Sapiens
TSLCKPSSL

SEQ ID NO: 1371822 - protein, 9 aa, Homo Sapiens
IPAIQEKLH

SEQ ID NO: 1371823 - protein, 9 aa, Homo Sapiens
SRVRGEAEL

SEQ ID NO: 1371824 - protein, 9 aa, Homo Sapiens
GPCTCLPPP

SEQ ID NO: 1371825 - protein, 9 aa, Homo Sapiens
SKNPVCKLY

SEQ ID NO: 1371826 - protein, 9 aa, Homo Sapiens
DAHMLDIFH

SEQ ID NO: 1371827 - protein, 9 aa, Homo Sapiens
RGTQPCTSV

SEQ ID NO: 1371828 - protein, 9 aa, Homo Sapiens
RGLLLALSF

SEQ ID NO: 1371829 - protein, 9 aa, Homo Sapiens
RLHLESDGL

SEQ ID NO: 1371830 - protein, 9 aa, Homo Sapiens
GLCSEFLWF

SEQ ID NO: 1371831 - protein, 9 aa, Homo Sapiens
THQLPSRNL

SEQ ID NO: 1371832 - protein, 9 aa, Homo Sapiens
QECKKNYSS

SEQ ID NO: 1371833 - protein, 9 aa, Homo Sapiens
ELGSNCIRA

SEQ ID NO: 1371834 - protein, 9 aa, Homo Sapiens
SIQVNVSFP

SEQ ID NO: 1371835 - protein, 9 aa, Homo Sapiens
VAAARGLLL

SEQ ID NO: 1371836 - protein, 9 aa, Homo Sapiens
RRAVLVSCS

SEQ ID NO: 1371837 - protein, 9 aa, Homo Sapiens
PDSTKIATG

SEQ ID NO: 1371838 - protein, 9 aa, Homo Sapiens
HLKAIPCSS

SEQ ID NO: 1371839 - protein, 9 aa, Homo Sapiens
QPPQFLLHG

SEQ ID NO: 1371840 - protein, 9 aa, Homo Sapiens
LVGASEARL

SEQ ID NO: 1371841 - protein, 9 aa, Homo Sapiens
FEIVNLLLD

SEQ ID NO: 1371842 - protein, 9 aa, Homo Sapiens
QMLELGSNC

SEQ ID NO: 1371843 - protein, 9 aa, Homo Sapiens
PRTMAGPSA

SEQ ID NO: 1371844 - protein, 9 aa, Homo Sapiens
NTTQLPCLQ

SEQ ID NO: 1371845 - protein, 9 aa, Homo Sapiens
AQPLQPPRV

SEQ ID NO: 1371846 - protein, 9 aa, Homo Sapiens
CRRLETSPT

SEQ ID NO: 1371847 - protein, 9 aa, Homo Sapiens
SSPERPKRW

SEQ ID NO: 1371848 - protein, 9 aa, Homo Sapiens
LAKVFGPTM

SEQ ID NO: 1371849 - protein, 9 aa, Homo Sapiens
DDDGAAALP

SEQ ID NO: 1371850 - protein, 9 aa, Homo Sapiens
TFSFIPLAK

SEQ ID NO: 1371851 - protein, 9 aa, Homo Sapiens
LVPYLYRNN

SEQ ID NO: 1371852 - protein, 9 aa, Homo Sapiens
PQSAYTGEK

SEQ ID NO: 1371853 - protein, 9 aa, Homo Sapiens
QPVLQARRP

SEQ ID NO: 1371854 - protein, 9 aa, Homo Sapiens
LQECKKNYS

SEQ ID NO: 1371855 - protein, 9 aa, Homo Sapiens
ECGKSLKKR

SEQ ID NO: 1371856 - protein, 9 aa, Homo Sapiens
CIQLHQDLV

SEQ ID NO: 1371857 - protein, 9 aa, Homo Sapiens
YEAYSKACR

SEQ ID NO: 1371858 - protein, 9 aa, Homo Sapiens
SSNSNSNSN

SEQ ID NO: 1371859 - protein, 9 aa, Homo Sapiens
GPRLVSNPS

SEQ ID NO: 1371860 - protein, 9 aa, Homo Sapiens
TLRARDQTH

SEQ ID NO: 1371861 - protein, 9 aa, Homo Sapiens
IHGPPLRVP

SEQ ID NO: 1371862 - protein, 9 aa, Homo Sapiens
SRNFVQHAC

SEQ ID NO: 1371863 - protein, 9 aa, Homo Sapiens
FWPEVLKMT

SEQ ID NO: 1371864 - protein, 9 aa, Homo Sapiens
PAQMCASLS

SEQ ID NO: 1371865 - protein, 9 aa, Homo Sapiens
GQKQILKRV

SEQ ID NO: 1371866 - protein, 9 aa, Homo Sapiens
TLGTCPTKE

SEQ ID NO: 1371867 - protein, 9 aa, Homo Sapiens
AVLVSCSSV

SEQ ID NO: 1371868 - protein, 9 aa, Homo Sapiens
TVMKRKVVI

SEQ ID NO: 1371869 - protein, 9 aa, Homo Sapiens
DSDSDDDDA

SEQ ID NO: 1371870 - protein, 9 aa, Homo Sapiens
PGKKRGTII

SEQ ID NO: 1371871 - protein, 9 aa, Homo Sapiens
PYGAPIIGF

SEQ ID NO: 1371872 - protein, 9 aa, Homo Sapiens
VPKYRIQSY

SEQ ID NO: 1371873 - protein, 9 aa, Homo Sapiens
NPSLHETSS

SEQ ID NO: 1371874 - protein, 9 aa, Homo Sapiens
TESRKFDPL

SEQ ID NO: 1371875 - protein, 9 aa, Homo Sapiens
YLMPTVPKH

SEQ ID NO: 1371876 - protein, 9 aa, Homo Sapiens
VVIISIVCM

SEQ ID NO: 1371877 - protein, 9 aa, Homo Sapiens
AEGHGGLRS

SEQ ID NO: 1371878 - protein, 9 aa, Homo Sapiens
HQTSGDELV

SEQ ID NO: 1371879 - protein, 9 aa, Homo Sapiens
LKKTRNVFR

SEQ ID NO: 1371880 - protein, 9 aa, Homo Sapiens
DQTHSAGRM

SEQ ID NO: 1371881 - protein, 9 aa, Homo Sapiens
AAARVMTNK

SEQ ID NO: 1371882 - protein, 9 aa, Homo Sapiens
FWMLTRTML

SEQ ID NO: 1371883 - protein, 9 aa, Homo Sapiens
AAPPGQAVS

SEQ ID NO: 1371884 - protein, 9 aa, Homo Sapiens
LSTLQQRHP

SEQ ID NO: 1371885 - protein, 9 aa, Homo Sapiens
APDVLRHQV

SEQ ID NO: 1371886 - protein, 9 aa, Homo Sapiens
RTMLSVRPC

SEQ ID NO: 1371887 - protein, 9 aa, Homo Sapiens
PPRRPLQTL

SEQ ID NO: 1371888 - protein, 9 aa, Homo Sapiens
HTAAVSTAT

SEQ ID NO: 1371889 - protein, 9 aa, Homo Sapiens
LHWHSGDRP

SEQ ID NO: 1371890 - protein, 9 aa, Homo Sapiens
ETPVPVAAE

SEQ ID NO: 1371891 - protein, 9 aa, Homo Sapiens
HQAHQADGR

SEQ ID NO: 1371892 - protein, 9 aa, Homo Sapiens
CGLEVATLG

SEQ ID NO: 1371893 - protein, 9 aa, Homo Sapiens
DFDDEEPHK

SEQ ID NO: 1371894 - protein, 9 aa, Homo Sapiens
QECLEVQRQ

SEQ ID NO: 1371895 - protein, 9 aa, Homo Sapiens
EAFPFPNPE

SEQ ID NO: 1371896 - protein, 9 aa, Homo Sapiens
VCIVAQRRG

SEQ ID NO: 1371897 - protein, 9 aa, Homo Sapiens
TEGLPLLGK

SEQ ID NO: 1371898 - protein, 9 aa, Homo Sapiens
VVMVVRPVA

SEQ ID NO: 1371899 - protein, 9 aa, Homo Sapiens
PRGVSMAHK

SEQ ID NO: 1371900 - protein, 9 aa, Homo Sapiens
DSEEDISHL

SEQ ID NO: 1371901 - protein, 9 aa, Homo Sapiens
EKIDKACSE

SEQ ID NO: 1371902 - protein, 9 aa, Homo Sapiens
RNRVGRQER

SEQ ID NO: 1371903 - protein, 9 aa, Homo Sapiens
CQAAGTAQK

SEQ ID NO: 1371904 - protein, 9 aa, Homo Sapiens
AGAARARPA

SEQ ID NO: 1371905 - protein, 9 aa, Homo Sapiens
WYRQQVQRR

SEQ ID NO: 1371906 - protein, 9 aa, Homo Sapiens
HGHPPPPPW

SEQ ID NO: 1371907 - protein, 9 aa, Homo Sapiens
IRSPVVSGV

SEQ ID NO: 1371908 - protein, 9 aa, Homo Sapiens
EEQPAQLRC

SEQ ID NO: 1371909 - protein, 9 aa, Homo Sapiens
TVKLFDFPC

SEQ ID NO: 1371910 - protein, 9 aa, Homo Sapiens
QKASSRGTR

SEQ ID NO: 1371911 - protein, 9 aa, Homo Sapiens
EHSDLEEAP

SEQ ID NO: 1371912 - protein, 9 aa, Homo Sapiens
CVSHGADVL

SEQ ID NO: 1371913 - protein, 9 aa, Homo Sapiens
LQQCRVELA

SEQ ID NO: 1371914 - protein, 9 aa, Homo Sapiens
LKKVMAPVL

SEQ ID NO: 1371915 - protein, 9 aa, Homo Sapiens
RKPKTLNNH

SEQ ID NO: 1371916 - protein, 9 aa, Homo Sapiens
VVVEEELVG

SEQ ID NO: 1371917 - protein, 9 aa, Homo Sapiens
RITGINHKN

SEQ ID NO: 1371918 - protein, 9 aa, Homo Sapiens
HVQESGWEH

SEQ ID NO: 1371919 - protein, 9 aa, Homo Sapiens
GTKLPRLSK

SEQ ID NO: 1371920 - protein, 9 aa, Homo Sapiens
DFDEDDNLE

SEQ ID NO: 1371921 - protein, 9 aa, Homo Sapiens
RGTPSLIMK

SEQ ID NO: 1371922 - protein, 9 aa, Homo Sapiens
TTPSKKKLK

SEQ ID NO: 1371923 - protein, 9 aa, Homo Sapiens
CATRWPPRP

SEQ ID NO: 1371924 - protein, 9 aa, Homo Sapiens
STCSPPSCS

SEQ ID NO: 1371925 - protein, 9 aa, Homo Sapiens
DSDDDDAHF

SEQ ID NO: 1371926 - protein, 9 aa, Homo Sapiens
NLQPEGRSS

SEQ ID NO: 1371927 - protein, 9 aa, Homo Sapiens
GVDESEKKS

SEQ ID NO: 1371928 - protein, 9 aa, Homo Sapiens
VVEEENLAE

SEQ ID NO: 1371929 - protein, 9 aa, Homo Sapiens
GRVVSNGDG

SEQ ID NO: 1371930 - protein, 9 aa, Homo Sapiens
KTWQRRLRA

SEQ ID NO: 1371931 - protein, 9 aa, Homo Sapiens
MHYGHQAPQ

SEQ ID NO: 1371932 - protein, 9 aa, Homo Sapiens
GRLLAPGRG

SEQ ID NO: 1371933 - protein, 9 aa, Homo Sapiens
LPPPGQRVI

SEQ ID NO: 1371934 - protein, 9 aa, Homo Sapiens
WEKPIDLKD

SEQ ID NO: 1371935 - protein, 9 aa, Homo Sapiens
STLGVCTFL

SEQ ID NO: 1371936 - protein, 9 aa, Homo Sapiens
NNQTWNIVQ

SEQ ID NO: 1371937 - protein, 9 aa, Homo Sapiens
ESYKKHILV

SEQ ID NO: 1371938 - protein, 9 aa, Homo Sapiens
EFGTLKKAV

SEQ ID NO: 1371939 - protein, 9 aa, Homo Sapiens
ILYNDAAES

SEQ ID NO: 1371940 - protein, 9 aa, Homo Sapiens
VTSLLRNFE

SEQ ID NO: 1371941 - protein, 9 aa, Homo Sapiens
GLIQAQRDY

SEQ ID NO: 1371942 - protein, 9 aa, Homo Sapiens
KLAESEGMK

SEQ ID NO: 1371943 - protein, 9 aa, Homo Sapiens
RWPSSQGTL

SEQ ID NO: 1371944 - protein, 9 aa, Homo Sapiens
KGFLNGLYI

SEQ ID NO: 1371945 - protein, 9 aa, Homo Sapiens
HEEVDFAGS

SEQ ID NO: 1371946 - protein, 9 aa, Homo Sapiens
SESGVISSR

SEQ ID NO: 1371947 - protein, 9 aa, Homo Sapiens
TYQYVETSG

SEQ ID NO: 1371948 - protein, 9 aa, Homo Sapiens
QERRSLLDG

SEQ ID NO: 1371949 - protein, 9 aa, Homo Sapiens
KDTISIINN

SEQ ID NO: 1371950 - protein, 9 aa, Homo Sapiens
GVGMPSAVS

SEQ ID NO: 1371951 - protein, 9 aa, Homo Sapiens
NLARVVVNV

SEQ ID NO: 1371952 - protein, 9 aa, Homo Sapiens
SVFPPDEKH

SEQ ID NO: 1371953 - protein, 9 aa, Homo Sapiens
KGMTLEQQA

SEQ ID NO: 1371954 - protein, 9 aa, Homo Sapiens
RPPRMELPV

SEQ ID NO: 1371955 - protein, 9 aa, Homo Sapiens
EYKKTYMEM

SEQ ID NO: 1371956 - protein, 9 aa, Homo Sapiens
QKQKVQRRN

SEQ ID NO: 1371957 - protein, 9 aa, Homo Sapiens
GNPSHRETV

SEQ ID NO: 1371958 - protein, 9 aa, Homo Sapiens
SSSQRLLRE

SEQ ID NO: 1371959 - protein, 9 aa, Homo Sapiens
ADTAATVED

SEQ ID NO: 1371960 - protein, 9 aa, Homo Sapiens
GLLDNLLAL

SEQ ID NO: 1371961 - protein, 9 aa, Homo Sapiens
GVPGGKGAG

SEQ ID NO: 1371962 - protein, 9 aa, Homo Sapiens
HCAKEAEKT

SEQ ID NO: 1371963 - protein, 9 aa, Homo Sapiens
LRRSVVGTP

SEQ ID NO: 1371964 - protein, 9 aa, Homo Sapiens
TEVERAFGY

SEQ ID NO: 1371965 - protein, 9 aa, Homo Sapiens
FFCIFSRDG

SEQ ID NO: 1371966 - protein, 9 aa, Homo Sapiens
CFNFEFIDL

SEQ ID NO: 1371967 - protein, 9 aa, Homo Sapiens
ASLAAAPPP

SEQ ID NO: 1371968 - protein, 9 aa, Homo Sapiens
RHENQTHTL

SEQ ID NO: 1371969 - protein, 9 aa, Homo Sapiens
AGPQRDSVF

SEQ ID NO: 1371970 - protein, 9 aa, Homo Sapiens
PIIAVEGLR

SEQ ID NO: 1371971 - protein, 9 aa, Homo Sapiens
DITEHIDFV

SEQ ID NO: 1371972 - protein, 9 aa, Homo Sapiens
PPLILWPQA

SEQ ID NO: 1371973 - protein, 9 aa, Homo Sapiens
QANQLNYGV

SEQ ID NO: 1371974 - protein, 9 aa, Homo Sapiens
IKKIGVVVC

SEQ ID NO: 1371975 - protein, 9 aa, Homo Sapiens
QKPERMETK

SEQ ID NO: 1371976 - protein, 9 aa, Homo Sapiens
RSLWEGGNG

SEQ ID NO: 1371977 - protein, 9 aa, Homo Sapiens
PAGAAVAAA

SEQ ID NO: 1371978 - protein, 9 aa, Homo Sapiens
GRYFFRTEK

SEQ ID NO: 1371979 - protein, 9 aa, Homo Sapiens
TQSVDLLGL

SEQ ID NO: 1371980 - protein, 9 aa, Homo Sapiens
KAALEGASK

SEQ ID NO: 1371981 - protein, 9 aa, Homo Sapiens
LETSMDREK

SEQ ID NO: 1371982 - protein, 9 aa, Homo Sapiens
TGLLDNLLA

SEQ ID NO: 1371983 - protein, 9 aa, Homo Sapiens
AGSLLNHRH

SEQ ID NO: 1371984 - protein, 9 aa, Homo Sapiens
AVCRESREH

SEQ ID NO: 1371985 - protein, 9 aa, Homo Sapiens
SKAYTNHCI

SEQ ID NO: 1371986 - protein, 9 aa, Homo Sapiens
ATAPCASLA

SEQ ID NO: 1371987 - protein, 9 aa, Homo Sapiens
ENPFLSVHS

SEQ ID NO: 1371988 - protein, 9 aa, Homo Sapiens
LSCYVVVNF

SEQ ID NO: 1371989 - protein, 9 aa, Homo Sapiens
PRIPYTELP

SEQ ID NO: 1371990 - protein, 9 aa, Homo Sapiens
LARVYGSTF

SEQ ID NO: 1371991 - protein, 9 aa, Homo Sapiens
FDFGVRRNG

SEQ ID NO: 1371992 - protein, 9 aa, Homo Sapiens
SQRHLPKLQ

SEQ ID NO: 1371993 - protein, 9 aa, Homo Sapiens
LVDADCVVG

SEQ ID NO: 1371994 - protein, 9 aa, Homo Sapiens
DTNLGDREV

SEQ ID NO: 1371995 - protein, 9 aa, Homo Sapiens
SSNGRPAIH

SEQ ID NO: 1371996 - protein, 9 aa, Homo Sapiens
SSMLELSWK

SEQ ID NO: 1371997 - protein, 9 aa, Homo Sapiens
RAHPVAEAG

SEQ ID NO: 1371998 - protein, 9 aa, Homo Sapiens
GHRAASALR

SEQ ID NO: 1371999 - protein, 9 aa, Homo Sapiens
CSAHPCDSS

SEQ ID NO: 1372000 - protein, 9 aa, Homo Sapiens
RVEVAAGPP

SEQ ID NO: 1372001 - protein, 9 aa, Homo Sapiens
VNTPAMYVA

SEQ ID NO: 1372002 - protein, 9 aa, Homo Sapiens
FLGFAGVGY

SEQ ID NO: 1372003 - protein, 9 aa, Homo Sapiens
VDDPYMTGR

SEQ ID NO: 1372004 - protein, 9 aa, Homo Sapiens
KAQLQVGRF

SEQ ID NO: 1372005 - protein, 9 aa, Homo Sapiens
GPVQVGKEQ

SEQ ID NO: 1372006 - protein, 9 aa, Homo Sapiens
MRNSQAHGN

SEQ ID NO: 1372007 - protein, 9 aa, Homo Sapiens
SNAHVGGNV

SEQ ID NO: 1372008 - protein, 9 aa, Homo Sapiens
SGPMGVQAR

SEQ ID NO: 1372009 - protein, 9 aa, Homo Sapiens
SWKVKALDE

SEQ ID NO: 1372010 - protein, 9 aa, Homo Sapiens
VIATLLFCL

SEQ ID NO: 1372011 - protein, 9 aa, Homo Sapiens
NHKNLIMDH

SEQ ID NO: 1372012 - protein, 9 aa, Homo Sapiens
LVRSLVNAQ

SEQ ID NO: 1372013 - protein, 9 aa, Homo Sapiens
VAGATAQIQ

SEQ ID NO: 1372014 - protein, 9 aa, Homo Sapiens
CSDTGASTP

SEQ ID NO: 1372015 - protein, 9 aa, Homo Sapiens
TAVRPAARA

SEQ ID NO: 1372016 - protein, 9 aa, Homo Sapiens
VSLQLNLGT

SEQ ID NO: 1372017 - protein, 9 aa, Homo Sapiens
PSPEKRLGM

SEQ ID NO: 1372018 - protein, 9 aa, Homo Sapiens
LDSPRASQT

SEQ ID NO: 1372019 - protein, 9 aa, Homo Sapiens
LQRTSQAFA

SEQ ID NO: 1372020 - protein, 9 aa, Homo Sapiens
TASSSTCSP

SEQ ID NO: 1372021 - protein, 9 aa, Homo Sapiens
HGQHTHGPL

SEQ ID NO: 1372022 - protein, 9 aa, Homo Sapiens
AACRPTLCP

SEQ ID NO: 1372023 - protein, 9 aa, Homo Sapiens
LPQCLLSAP

SEQ ID NO: 1372024 - protein, 9 aa, Homo Sapiens
PGEPQPPPP

SEQ ID NO: 1372025 - protein, 9 aa, Homo Sapiens
CEKGFSWRS

SEQ ID NO: 1372026 - protein, 9 aa, Homo Sapiens
IYRGPSGEL

SEQ ID NO: 1372027 - protein, 9 aa, Homo Sapiens
VAGPSRGPP

SEQ ID NO: 1372028 - protein, 9 aa, Homo Sapiens
TELAEKLRC

SEQ ID NO: 1372029 - protein, 9 aa, Homo Sapiens
LNGLGVTGR

SEQ ID NO: 1372030 - protein, 9 aa, Homo Sapiens
LSPRVKALK

SEQ ID NO: 1372031 - protein, 9 aa, Homo Sapiens
AVLEKRVQE

SEQ ID NO: 1372032 - protein, 9 aa, Homo Sapiens
HDAKDTAAC

SEQ ID NO: 1372033 - protein, 9 aa, Homo Sapiens
SGGDIPGQP

SEQ ID NO: 1372034 - protein, 9 aa, Homo Sapiens
ALYISVLRK

SEQ ID NO: 1372035 - protein, 9 aa, Homo Sapiens
ESHACRRFL

SEQ ID NO: 1372036 - protein, 9 aa, Homo Sapiens
TVMEPAHAW

SEQ ID NO: 1372037 - protein, 9 aa, Homo Sapiens
DPMPAATIV

SEQ ID NO: 1372038 - protein, 9 aa, Homo Sapiens
DTLPYTATT

SEQ ID NO: 1372039 - protein, 9 aa, Homo Sapiens
DIPGQPLVG

SEQ ID NO: 1372040 - protein, 9 aa, Homo Sapiens
VMRRGRACA

SEQ ID NO: 1372041 - protein, 9 aa, Homo Sapiens
RGSGGKWRR

SEQ ID NO: 1372042 - protein, 9 aa, Homo Sapiens
HRTALSWPD

SEQ ID NO: 1372043 - protein, 9 aa, Homo Sapiens
TEIIGRSWF

SEQ ID NO: 1372044 - protein, 9 aa, Homo Sapiens
VNSVGKIER

SEQ ID NO: 1372045 - protein, 9 aa, Homo Sapiens
YQKMQCDQS

SEQ ID NO: 1372046 - protein, 9 aa, Homo Sapiens
KFCPLEIDY

SEQ ID NO: 1372047 - protein, 9 aa, Homo Sapiens
EVIGHGSKW

SEQ ID NO: 1372048 - protein, 9 aa, Homo Sapiens
GFETLQQFD

SEQ ID NO: 1372049 - protein, 9 aa, Homo Sapiens
PGIAVFCIM

SEQ ID NO: 1372050 - protein, 9 aa, Homo Sapiens
YLSAVEFHS

SEQ ID NO: 1372051 - protein, 9 aa, Homo Sapiens
KPERNCYFT

SEQ ID NO: 1372052 - protein, 9 aa, Homo Sapiens
ALSLYASGR

SEQ ID NO: 1372053 - protein, 9 aa, Homo Sapiens
QLNYGVDNA

SEQ ID NO: 1372054 - protein, 9 aa, Homo Sapiens
GDLSLQEAS

SEQ ID NO: 1372055 - protein, 9 aa, Homo Sapiens
LARVVVNVE

SEQ ID NO: 1372056 - protein, 9 aa, Homo Sapiens
AMYRNYQRK

SEQ ID NO: 1372057 - protein, 9 aa, Homo Sapiens
CICKFLDEV

SEQ ID NO: 1372058 - protein, 9 aa, Homo Sapiens
KQQSWWRKL

SEQ ID NO: 1372059 - protein, 9 aa, Homo Sapiens
SRTPWGAMV

SEQ ID NO: 1372060 - protein, 9 aa, Homo Sapiens
PLLGKAVPV

SEQ ID NO: 1372061 - protein, 9 aa, Homo Sapiens
FVFLGFAGV

SEQ ID NO: 1372062 - protein, 9 aa, Homo Sapiens
TKEVVVFEA

SEQ ID NO: 1372063 - protein, 9 aa, Homo Sapiens
PKTILSSLW

SEQ ID NO: 1372064 - protein, 9 aa, Homo Sapiens
LRPQQIWHG

SEQ ID NO: 1372065 - protein, 9 aa, Homo Sapiens
KKKFKTKTK

SEQ ID NO: 1372066 - protein, 9 aa, Homo Sapiens
LLAGVLLVM

SEQ ID NO: 1372067 - protein, 9 aa, Homo Sapiens
GASYAPVMR

SEQ ID NO: 1372068 - protein, 9 aa, Homo Sapiens
MFETVNTPA

SEQ ID NO: 1372069 - protein, 9 aa, Homo Sapiens
KHLMEKKIN

SEQ ID NO: 1372070 - protein, 9 aa, Homo Sapiens
ASTASSSTC

SEQ ID NO: 1372071 - protein, 9 aa, Homo Sapiens
VGTSRLHDL

SEQ ID NO: 1372072 - protein, 9 aa, Homo Sapiens
RRDPPGQPV

SEQ ID NO: 1372073 - protein, 9 aa, Homo Sapiens
CKRPKPMGV

SEQ ID NO: 1372074 - protein, 9 aa, Homo Sapiens
DSDLKKTVG

SEQ ID NO: 1372075 - protein, 9 aa, Homo Sapiens
NKDGCPLQV

SEQ ID NO: 1372076 - protein, 9 aa, Homo Sapiens
TAWNETADL

SEQ ID NO: 1372077 - protein, 9 aa, Homo Sapiens
RILYKYLAT

SEQ ID NO: 1372078 - protein, 9 aa, Homo Sapiens
LGKAVPVPQ

SEQ ID NO: 1372079 - protein, 9 aa, Homo Sapiens
SIQLGQRSL

SEQ ID NO: 1372080 - protein, 9 aa, Homo Sapiens
RRRLWPPSP

SEQ ID NO: 1372081 - protein, 9 aa, Homo Sapiens
SNSSNSSKP

SEQ ID NO: 1372082 - protein, 9 aa, Homo Sapiens
QLISFTLLA

SEQ ID NO: 1372083 - protein, 9 aa, Homo Sapiens
GAFDKKAQA

SEQ ID NO: 1372084 - protein, 9 aa, Homo Sapiens
INNSDFWTY

SEQ ID NO: 1372085 - protein, 9 aa, Homo Sapiens
KMELDEAWE

SEQ ID NO: 1372086 - protein, 9 aa, Homo Sapiens
GALRDSPSS

SEQ ID NO: 1372087 - protein, 9 aa, Homo Sapiens
QLIEPVQCD

SEQ ID NO: 1372088 - protein, 9 aa, Homo Sapiens
SIFQLFPSK

SEQ ID NO: 1372089 - protein, 9 aa, Homo Sapiens
NKKKPFLGM

SEQ ID NO: 1372090 - protein, 9 aa, Homo Sapiens
SRTQRRLEG

SEQ ID NO: 1372091 - protein, 9 aa, Homo Sapiens
FFFFFETKS

SEQ ID NO: 1372092 - protein, 9 aa, Homo Sapiens
RSLAPLKEE

SEQ ID NO: 1372093 - protein, 9 aa, Homo Sapiens
EYPKHMETF

SEQ ID NO: 1372094 - protein, 9 aa, Homo Sapiens
FTLHFVRGM

SEQ ID NO: 1372095 - protein, 9 aa, Homo Sapiens
HNLLFKPPV

SEQ ID NO: 1372096 - protein, 9 aa, Homo Sapiens
VQGRLFLDV

SEQ ID NO: 1372097 - protein, 9 aa, Homo Sapiens
REATITRST

SEQ ID NO: 1372098 - protein, 9 aa, Homo Sapiens
QQQQQQHSS

SEQ ID NO: 1372099 - protein, 9 aa, Homo Sapiens
FLWFQLAAR

SEQ ID NO: 1372100 - protein, 9 aa, Homo Sapiens
GDGSISYES

SEQ ID NO: 1372101 - protein, 9 aa, Homo Sapiens
GLHLEGDGL

SEQ ID NO: 1372102 - protein, 9 aa, Homo Sapiens
QFDPVEIKV

SEQ ID NO: 1372103 - protein, 9 aa, Homo Sapiens
FLEPRRRLW

SEQ ID NO: 1372104 - protein, 9 aa, Homo Sapiens
QCHISKLSL

SEQ ID NO: 1372105 - protein, 9 aa, Homo Sapiens
IIEIMQKPR

SEQ ID NO: 1372106 - protein, 9 aa, Homo Sapiens
CWPKDVGFV

SEQ ID NO: 1372107 - protein, 9 aa, Homo Sapiens
VPIVIGLTL

SEQ ID NO: 1372108 - protein, 9 aa, Homo Sapiens
RAACRPTLC

SEQ ID NO: 1372109 - protein, 9 aa, Homo Sapiens
DESGPHSHC

SEQ ID NO: 1372110 - protein, 9 aa, Homo Sapiens
HGSRRESIA

SEQ ID NO: 1372111 - protein, 9 aa, Homo Sapiens
VGCLHSQLP

SEQ ID NO: 1372112 - protein, 9 aa, Homo Sapiens
VLSKLRFEV

SEQ ID NO: 1372113 - protein, 9 aa, Homo Sapiens
GGDWLAPVA

SEQ ID NO: 1372114 - protein, 9 aa, Homo Sapiens
IYCTFNFAS

SEQ ID NO: 1372115 - protein, 9 aa, Homo Sapiens
RPSHLAGHK

SEQ ID NO: 1372116 - protein, 9 aa, Homo Sapiens
KDGCPLQVE

SEQ ID NO: 1372117 - protein, 9 aa, Homo Sapiens
VDEYHIEDT

SEQ ID NO: 1372118 - protein, 9 aa, Homo Sapiens
PAGPQRDSV

SEQ ID NO: 1372119 - protein, 9 aa, Homo Sapiens
TRWHHMRGE

SEQ ID NO: 1372120 - protein, 9 aa, Homo Sapiens
SSDRLKEAS

SEQ ID NO: 1372121 - protein, 9 aa, Homo Sapiens
IADTLKQAF

SEQ ID NO: 1372122 - protein, 9 aa, Homo Sapiens
GEGCPVSGH

SEQ ID NO: 1372123 - protein, 9 aa, Homo Sapiens
LVMDCPYHV

SEQ ID NO: 1372124 - protein, 9 aa, Homo Sapiens
MRLGIGLLL

SEQ ID NO: 1372125 - protein, 9 aa, Homo Sapiens
TFLKNQIGR

SEQ ID NO: 1372126 - protein, 9 aa, Homo Sapiens
AGPIPISSE

SEQ ID NO: 1372127 - protein, 9 aa, Homo Sapiens
RGRVSRPPR

SEQ ID NO: 1372128 - protein, 9 aa, Homo Sapiens
LGGRADRLL

SEQ ID NO: 1372129 - protein, 9 aa, Homo Sapiens
SRALFMVTS

SEQ ID NO: 1372130 - protein, 9 aa, Homo Sapiens
LKYFQCLFH

SEQ ID NO: 1372131 - protein, 9 aa, Homo Sapiens
ARHSAPERP

SEQ ID NO: 1372132 - protein, 9 aa, Homo Sapiens
GSVDLFHVQ

SEQ ID NO: 1372133 - protein, 9 aa, Homo Sapiens
GTGVWLCLV

SEQ ID NO: 1372134 - protein, 9 aa, Homo Sapiens
QWSLWGPWN

SEQ ID NO: 1372135 - protein, 9 aa, Homo Sapiens
LVAVVLMPP

SEQ ID NO: 1372136 - protein, 9 aa, Homo Sapiens
VICSLYSHN

SEQ ID NO: 1372137 - protein, 9 aa, Homo Sapiens
PADLCLPAL

SEQ ID NO: 1372138 - protein, 9 aa, Homo Sapiens
NKGVILFSI

SEQ ID NO: 1372139 - protein, 9 aa, Homo Sapiens
AVPVPQVIL

SEQ ID NO: 1372140 - protein, 9 aa, Homo Sapiens
GLAQNKEWL

SEQ ID NO: 1372141 - protein, 9 aa, Homo Sapiens
VAAWLAQHN

SEQ ID NO: 1372142 - protein, 9 aa, Homo Sapiens
VTSSLSSCK

SEQ ID NO: 1372143 - protein, 9 aa, Homo Sapiens
QYRPIFPPH

SEQ ID NO: 1372144 - protein, 9 aa, Homo Sapiens
PLHPPRGGF

SEQ ID NO: 1372145 - protein, 9 aa, Homo Sapiens
GHAELETAL

SEQ ID NO: 1372146 - protein, 9 aa, Homo Sapiens
PDLDPLDYA

SEQ ID NO: 1372147 - protein, 9 aa, Homo Sapiens
PTLPPTRSS

SEQ ID NO: 1372148 - protein, 9 aa, Homo Sapiens
RHSTLRPWP

SEQ ID NO: 1372149 - protein, 9 aa, Homo Sapiens
IMVGFWPEV

SEQ ID NO: 1372150 - protein, 9 aa, Homo Sapiens
IMHYMCQLC

SEQ ID NO: 1372151 - protein, 9 aa, Homo Sapiens
VVVRQGTTI

SEQ ID NO: 1372152 - protein, 9 aa, Homo Sapiens
DMQKQRVAA

SEQ ID NO: 1372153 - protein, 9 aa, Homo Sapiens
QPTRSYEIA

SEQ ID NO: 1372154 - protein, 9 aa, Homo Sapiens
APPGLHPLP

SEQ ID NO: 1372155 - protein, 9 aa, Homo Sapiens
FQGPMHGSS

SEQ ID NO: 1372156 - protein, 9 aa, Homo Sapiens
YVLPKHREL

SEQ ID NO: 1372157 - protein, 9 aa, Homo Sapiens
HTAMYRNYQ

SEQ ID NO: 1372158 - protein, 9 aa, Homo Sapiens
HFLTAVNLE

SEQ ID NO: 1372159 - protein, 9 aa, Homo Sapiens
PPAAPAAAR

SEQ ID NO: 1372160 - protein, 9 aa, Homo Sapiens
SVEETREEP

SEQ ID NO: 1372161 - protein, 9 aa, Homo Sapiens
SGDELVACS

SEQ ID NO: 1372162 - protein, 9 aa, Homo Sapiens
QKIRSPVVS

SEQ ID NO: 1372163 - protein, 9 aa, Homo Sapiens
YSVRELQPC

SEQ ID NO: 1372164 - protein, 9 aa, Homo Sapiens
RVGVYGQKQ

SEQ ID NO: 1372165 - protein, 9 aa, Homo Sapiens
LACLGGGRR

SEQ ID NO: 1372166 - protein, 9 aa, Homo Sapiens
VAFKMGFKT

SEQ ID NO: 1372167 - protein, 9 aa, Homo Sapiens
DPVGPLDKA

SEQ ID NO: 1372168 - protein, 9 aa, Homo Sapiens
NSKEALLRV

SEQ ID NO: 1372169 - protein, 9 aa, Homo Sapiens
EQVPVEEQD

SEQ ID NO: 1372170 - protein, 9 aa, Homo Sapiens
VEIKRINKE

SEQ ID NO: 1372171 - protein, 9 aa, Homo Sapiens
LSVMYRSQS

SEQ ID NO: 1372172 - protein, 9 aa, Homo Sapiens
KKFKDPNNV

SEQ ID NO: 1372173 - protein, 9 aa, Homo Sapiens
CSSFSRREG

SEQ ID NO: 1372174 - protein, 9 aa, Homo Sapiens
LDLAQALRD

SEQ ID NO: 1372175 - protein, 9 aa, Homo Sapiens
KYGHYNERD

SEQ ID NO: 1372176 - protein, 9 aa, Homo Sapiens
YNDAAESCI

SEQ ID NO: 1372177 - protein, 9 aa, Homo Sapiens
DIDRQTVEL

SEQ ID NO: 1372178 - protein, 9 aa, Homo Sapiens
STNTVSVCR

SEQ ID NO: 1372179 - protein, 9 aa, Homo Sapiens
ALGGYIIKK

SEQ ID NO: 1372180 - protein, 9 aa, Homo Sapiens
RHAPECDGP

SEQ ID NO: 1372181 - protein, 9 aa, Homo Sapiens
CLDILDGVT

SEQ ID NO: 1372182 - protein, 9 aa, Homo Sapiens
WGPWNPCQV

SEQ ID NO: 1372183 - protein, 9 aa, Homo Sapiens
DPLQLLVEP

SEQ ID NO: 1372184 - protein, 9 aa, Homo Sapiens
TYDEDDAAF

SEQ ID NO: 1372185 - protein, 9 aa, Homo Sapiens
DPFFDMHMT

SEQ ID NO: 1372186 - protein, 9 aa, Homo Sapiens
RVENYIRTQ

SEQ ID NO: 1372187 - protein, 9 aa, Homo Sapiens
NKSKQNLNA

SEQ ID NO: 1372188 - protein, 9 aa, Homo Sapiens
DCQAAGTAQ

SEQ ID NO: 1372189 - protein, 9 aa, Homo Sapiens
TGREGCVPS

SEQ ID NO: 1372190 - protein, 9 aa, Homo Sapiens
YEQANKIRK

SEQ ID NO: 1372191 - protein, 9 aa, Homo Sapiens
AATVEDMLP

SEQ ID NO: 1372192 - protein, 9 aa, Homo Sapiens
DAGRYFFRT

SEQ ID NO: 1372193 - protein, 9 aa, Homo Sapiens
PTPTSDTPK

SEQ ID NO: 1372194 - protein, 9 aa, Homo Sapiens
ACSDTGAST

SEQ ID NO: 1372195 - protein, 9 aa, Homo Sapiens
VTAVIDNFY

SEQ ID NO: 1372196 - protein, 9 aa, Homo Sapiens
RSPSPPQQT

SEQ ID NO: 1372197 - protein, 9 aa, Homo Sapiens
SSDEEAVEE

SEQ ID NO: 1372198 - protein, 9 aa, Homo Sapiens
NAFLVLDLC

SEQ ID NO: 1372199 - protein, 9 aa, Homo Sapiens
DGMLTVIGQ

SEQ ID NO: 1372200 - protein, 9 aa, Homo Sapiens
IPDPMGLSF

SEQ ID NO: 1372201 - protein, 9 aa, Homo Sapiens
SPPRRPLQT

SEQ ID NO: 1372202 - protein, 9 aa, Homo Sapiens
ADEVRLRCQ

SEQ ID NO: 1372203 - protein, 9 aa, Homo Sapiens
GTLSLQRLS

SEQ ID NO: 1372204 - protein, 9 aa, Homo Sapiens
EAELTDTRR

SEQ ID NO: 1372205 - protein, 9 aa, Homo Sapiens
LGYGAGAIR

SEQ ID NO: 1372206 - protein, 9 aa, Homo Sapiens
PQSFFFFFF

SEQ ID NO: 1372207 - protein, 9 aa, Homo Sapiens
GSKWTLSRF

SEQ ID NO: 1372208 - protein, 9 aa, Homo Sapiens
NMPMLCPLS

SEQ ID NO: 1372209 - protein, 9 aa, Homo Sapiens
AAGTLVAVV

SEQ ID NO: 1372210 - protein, 9 aa, Homo Sapiens
ITALPNVTF

SEQ ID NO: 1372211 - protein, 9 aa, Homo Sapiens
PYTATTAPS

SEQ ID NO: 1372212 - protein, 9 aa, Homo Sapiens
RDDDSGNKG

SEQ ID NO: 1372213 - protein, 9 aa, Homo Sapiens
IPNPSVTWL

SEQ ID NO: 1372214 - protein, 9 aa, Homo Sapiens
DVFLVLVAI

SEQ ID NO: 1372215 - protein, 9 aa, Homo Sapiens
RFTHPQQPS

SEQ ID NO: 1372216 - protein, 9 aa, Homo Sapiens
GEKVFCQED

SEQ ID NO: 1372217 - protein, 9 aa, Homo Sapiens
PLLDLSLDI

SEQ ID NO: 1372218 - protein, 9 aa, Homo Sapiens
PKKTLLKCW

SEQ ID NO: 1372219 - protein, 9 aa, Homo Sapiens
GDGLTSQGL

SEQ ID NO: 1372220 - protein, 9 aa, Homo Sapiens
QDIPDGLFW

SEQ ID NO: 1372221 - protein, 9 aa, Homo Sapiens
ESASSMEQL

SEQ ID NO: 1372222 - protein, 9 aa, Homo Sapiens
QGGLFLDVV

SEQ ID NO: 1372223 - protein, 9 aa, Homo Sapiens
RRTPDQLYR

SEQ ID NO: 1372224 - protein, 9 aa, Homo Sapiens
EHHPEGSSG

SEQ ID NO: 1372225 - protein, 9 aa, Homo Sapiens
HVGGNVTSN

SEQ ID NO: 1372226 - protein, 9 aa, Homo Sapiens
GSRCIPAYH

SEQ ID NO: 1372227 - protein, 9 aa, Homo Sapiens
KRFRNAEVH

SEQ ID NO: 1372228 - protein, 9 aa, Homo Sapiens
AAKMMSAVA

SEQ ID NO: 1372229 - protein, 9 aa, Homo Sapiens
ESEGSGVCR

SEQ ID NO: 1372230 - protein, 9 aa, Homo Sapiens
LHENMDQIR

SEQ ID NO: 1372231 - protein, 9 aa, Homo Sapiens
GSVEEQPAQ

SEQ ID NO: 1372232 - protein, 9 aa, Homo Sapiens
LSRNFVQHA

SEQ ID NO: 1372233 - protein, 9 aa, Homo Sapiens
GDRYDDCRD

SEQ ID NO: 1372234 - protein, 9 aa, Homo Sapiens
YCSAVFDPF

SEQ ID NO: 1372235 - protein, 9 aa, Homo Sapiens
VTSFAPRRR

SEQ ID NO: 1372236 - protein, 9 aa, Homo Sapiens
CLWLVLVMD

SEQ ID NO: 1372237 - protein, 9 aa, Homo Sapiens
LTEQRMIFI

SEQ ID NO: 1372238 - protein, 9 aa, Homo Sapiens
PCTDYIGSR

SEQ ID NO: 1372239 - protein, 9 aa, Homo Sapiens
TEMTPYYIS

SEQ ID NO: 1372240 - protein, 9 aa, Homo Sapiens
PVHLVQQCV

SEQ ID NO: 1372241 - protein, 9 aa, Homo Sapiens
GQQGQAGMA

SEQ ID NO: 1372242 - protein, 9 aa, Homo Sapiens
LRGHRAASA

SEQ ID NO: 1372243 - protein, 9 aa, Homo Sapiens
SCAPVFLQF

SEQ ID NO: 1372244 - protein, 9 aa, Homo Sapiens
PPRMELPVG

SEQ ID NO: 1372245 - protein, 9 aa, Homo Sapiens
PLVQPLAFH

SEQ ID NO: 1372246 - protein, 9 aa, Homo Sapiens
LHPVQGTKI

SEQ ID NO: 1372247 - protein, 9 aa, Homo Sapiens
MRRGRACAR

SEQ ID NO: 1372248 - protein, 9 aa, Homo Sapiens
TGPRLVSNP

SEQ ID NO: 1372249 - protein, 9 aa, Homo Sapiens
PSSPVRAPQ

SEQ ID NO: 1372250 - protein, 9 aa, Homo Sapiens
PGAGPEEAA

SEQ ID NO: 1372251 - protein, 9 aa, Homo Sapiens
VWEKPIDLK

SEQ ID NO: 1372252 - protein, 9 aa, Homo Sapiens
LRKKVVEEE

SEQ ID NO: 1372253 - protein, 9 aa, Homo Sapiens
LYQGAYSQI

SEQ ID NO: 1372254 - protein, 9 aa, Homo Sapiens
RPTKTRMLY

SEQ ID NO: 1372255 - protein, 9 aa, Homo Sapiens
GDTSRPPYR

SEQ ID NO: 1372256 - protein, 9 aa, Homo Sapiens
KHLKAIPCS

SEQ ID NO: 1372257 - protein, 9 aa, Homo Sapiens
RDPAAAFPP

SEQ ID NO: 1372258 - protein, 9 aa, Homo Sapiens
LFLIYLRWM

SEQ ID NO: 1372259 - protein, 9 aa, Homo Sapiens
GAAVGAGAG

SEQ ID NO: 1372260 - protein, 9 aa, Homo Sapiens
VVYLGTTTG

SEQ ID NO: 1372261 - protein, 9 aa, Homo Sapiens
CVASSIQQE

SEQ ID NO: 1372262 - protein, 9 aa, Homo Sapiens
KVATPGSQT

SEQ ID NO: 1372263 - protein, 9 aa, Homo Sapiens
PHSGATPLH

SEQ ID NO: 1372264 - protein, 9 aa, Homo Sapiens
VPHRLATAP

SEQ ID NO: 1372265 - protein, 8 aa, Homo Sapiens
RLTHICCC

SEQ ID NO: 1372266 - protein, 9 aa, Homo Sapiens
AKVKRNVTE

SEQ ID NO: 1372267 - protein, 9 aa, Homo Sapiens
VSKNSSSLL

SEQ ID NO: 1372268 - protein, 9 aa, Homo Sapiens
QGTKIILHQ

SEQ ID NO: 1372269 - protein, 9 aa, Homo Sapiens
GACFIVSGS

SEQ ID NO: 1372270 - protein, 9 aa, Homo Sapiens
PLDYAGLAS

SEQ ID NO: 1372271 - protein, 9 aa, Homo Sapiens
NMIIVMLTL

SEQ ID NO: 1372272 - protein, 9 aa, Homo Sapiens
CPAQMCASL

SEQ ID NO: 1372273 - protein, 9 aa, Homo Sapiens
AHKVATPGS

SEQ ID NO: 1372274 - protein, 9 aa, Homo Sapiens
TECGMEFGQ

SEQ ID NO: 1372275 - protein, 9 aa, Homo Sapiens
RAAFPTGRY

SEQ ID NO: 1372276 - protein, 9 aa, Homo Sapiens
KQGSRVQNT

SEQ ID NO: 1372277 - protein, 9 aa, Homo Sapiens
IQAPHLWGR

SEQ ID NO: 1372278 - protein, 9 aa, Homo Sapiens
PSNMDRSWK

SEQ ID NO: 1372279 - protein, 9 aa, Homo Sapiens
AESEGMKAV

SEQ ID NO: 1372280 - protein, 9 aa, Homo Sapiens
IAKRRVELI

SEQ ID NO: 1372281 - protein, 9 aa, Homo Sapiens
RADGFADQS

SEQ ID NO: 1372282 - protein, 9 aa, Homo Sapiens
PLSAVTALL

SEQ ID NO: 1372283 - protein, 9 aa, Homo Sapiens
FVIYCGMRF

SEQ ID NO: 1372284 - protein, 9 aa, Homo Sapiens
ERFMPKSDT

SEQ ID NO: 1372285 - protein, 9 aa, Homo Sapiens
TPIPTPART

SEQ ID NO: 1372286 - protein, 9 aa, Homo Sapiens
SSFSISAPL

SEQ ID NO: 1372287 - protein, 9 aa, Homo Sapiens
LQGGGPPTA

SEQ ID NO: 1372288 - protein, 9 aa, Homo Sapiens
IMVDDEELT

SEQ ID NO: 1372289 - protein, 9 aa, Homo Sapiens
TAMYRNYQR

SEQ ID NO: 1372290 - protein, 9 aa, Homo Sapiens
IPKAPKKTL

SEQ ID NO: 1372291 - protein, 9 aa, Homo Sapiens
KALFLEPRR

SEQ ID NO: 1372292 - protein, 9 aa, Homo Sapiens
IPPGSQKAL

SEQ ID NO: 1372293 - protein, 9 aa, Homo Sapiens
GWDNEEDLQ

SEQ ID NO: 1372294 - protein, 9 aa, Homo Sapiens
STKIATGQT

SEQ ID NO: 1372295 - protein, 9 aa, Homo Sapiens
DEHRGGSPQ

SEQ ID NO: 1372296 - protein, 9 aa, Homo Sapiens
GVGSGLCKG

SEQ ID NO: 1372297 - protein, 9 aa, Homo Sapiens
PGADPSRGV

SEQ ID NO: 1372298 - protein, 9 aa, Homo Sapiens
DWGGAVILH

SEQ ID NO: 1372299 - protein, 9 aa, Homo Sapiens
KDIRNHVVQ

SEQ ID NO: 1372300 - protein, 9 aa, Homo Sapiens
LNTKEVVVF

SEQ ID NO: 1372301 - protein, 9 aa, Homo Sapiens
NQKKAKIKK

SEQ ID NO: 1372302 - protein, 9 aa, Homo Sapiens
ELGYDILGS

SEQ ID NO: 1372303 - protein, 9 aa, Homo Sapiens
VQPDSVYCS

SEQ ID NO: 1372304 - protein, 9 aa, Homo Sapiens
DRYTQAWAP

SEQ ID NO: 1372305 - protein, 9 aa, Homo Sapiens
EKKREVILN

SEQ ID NO: 1372306 - protein, 9 aa, Homo Sapiens
HNSKEDERQ

SEQ ID NO: 1372307 - protein, 9 aa, Homo Sapiens
YLDRGILKT

SEQ ID NO: 1372308 - protein, 9 aa, Homo Sapiens
VAAAQLVRS

SEQ ID NO: 1372309 - protein, 9 aa, Homo Sapiens
VLDEDLAKA

SEQ ID NO: 1372310 - protein, 9 aa, Homo Sapiens
VARVHNRCS

SEQ ID NO: 1372311 - protein, 9 aa, Homo Sapiens
AVRQWVITL

SEQ ID NO: 1372312 - protein, 9 aa, Homo Sapiens
PGHCSDYCS

SEQ ID NO: 1372313 - protein, 9 aa, Homo Sapiens
LLVRRNAFL

SEQ ID NO: 1372314 - protein, 9 aa, Homo Sapiens
VEAPGQLVH

SEQ ID NO: 1372315 - protein, 9 aa, Homo Sapiens
EAFLAAVPA

SEQ ID NO: 1372316 - protein, 9 aa, Homo Sapiens
PGRHPFRRR

SEQ ID NO: 1372317 - protein, 9 aa, Homo Sapiens
TVPHDERIV

SEQ ID NO: 1372318 - protein, 9 aa, Homo Sapiens
QEARSLLAE

SEQ ID NO: 1372319 - protein, 9 aa, Homo Sapiens
HIDICLRKR

SEQ ID NO: 1372320 - protein, 9 aa, Homo Sapiens
VLTACLTEK

SEQ ID NO: 1372321 - protein, 9 aa, Homo Sapiens
VVGLHHLQV

SEQ ID NO: 1372322 - protein, 9 aa, Homo Sapiens
QEKLTGAQR

SEQ ID NO: 1372323 - protein, 9 aa, Homo Sapiens
IVDPTVGNN

SEQ ID NO: 1372324 - protein, 9 aa, Homo Sapiens
AAAQLVRSL

SEQ ID NO: 1372325 - protein, 9 aa, Homo Sapiens
RLPRGPPQL

SEQ ID NO: 1372326 - protein, 9 aa, Homo Sapiens
QVPLSVHKL

SEQ ID NO: 1372327 - protein, 9 aa, Homo Sapiens
PGNSEPLTA

SEQ ID NO: 1372328 - protein, 9 aa, Homo Sapiens
KSMLKDFDG

SEQ ID NO: 1372329 - protein, 9 aa, Homo Sapiens
RQPSVASSV

SEQ ID NO: 1372330 - protein, 9 aa, Homo Sapiens
RREPIPGLE

SEQ ID NO: 1372331 - protein, 9 aa, Homo Sapiens
RPKRLRGHR

SEQ ID NO: 1372332 - protein, 9 aa, Homo Sapiens
VGGQHEEVD

SEQ ID NO: 1372333 - protein, 9 aa, Homo Sapiens
VGTSQKSRT

SEQ ID NO: 1372334 - protein, 9 aa, Homo Sapiens
SSTISSIQS

SEQ ID NO: 1372335 - protein, 9 aa, Homo Sapiens
KECFIKLPK

SEQ ID NO: 1372336 - protein, 9 aa, Homo Sapiens
DIQATNALD

SEQ ID NO: 1372337 - protein, 9 aa, Homo Sapiens
AVMNEHHEA

SEQ ID NO: 1372338 - protein, 9 aa, Homo Sapiens
EAPGQLVHF

SEQ ID NO: 1372339 - protein, 9 aa, Homo Sapiens
PNLLMAQRR

SEQ ID NO: 1372340 - protein, 9 aa, Homo Sapiens
GSSARHVVM

SEQ ID NO: 1372341 - protein, 9 aa, Homo Sapiens
KVPPLVGSF

SEQ ID NO: 1372342 - protein, 9 aa, Homo Sapiens
EAEPWQRRE

SEQ ID NO: 1372343 - protein, 9 aa, Homo Sapiens
PHRLATAPK

SEQ ID NO: 1372344 - protein, 9 aa, Homo Sapiens
CCVSVSCKP

SEQ ID NO: 1372345 - protein, 9 aa, Homo Sapiens
VVPTRGDVH

SEQ ID NO: 1372346 - protein, 9 aa, Homo Sapiens
REKQMSSLK

SEQ ID NO: 1372347 - protein, 9 aa, Homo Sapiens
RHTPPCPAS

SEQ ID NO: 1372348 - protein, 9 aa, Homo Sapiens
DFAADESGL

SEQ ID NO: 1372349 - protein, 9 aa, Homo Sapiens
YMCQLCKSL

SEQ ID NO: 1372350 - protein, 9 aa, Homo Sapiens
RRNAFLVLD

SEQ ID NO: 1372351 - protein, 9 aa, Homo Sapiens
LDEDLAKAD

SEQ ID NO: 1372352 - protein, 9 aa, Homo Sapiens
LPEEPQYGE

SEQ ID NO: 1372353 - protein, 9 aa, Homo Sapiens
TLLLSWETS

SEQ ID NO: 1372354 - protein, 9 aa, Homo Sapiens
ALVCLLVLD

SEQ ID NO: 1372355 - protein, 9 aa, Homo Sapiens
RSGCSGSFL

SEQ ID NO: 1372356 - protein, 9 aa, Homo Sapiens
GPANGSPPP

SEQ ID NO: 1372357 - protein, 9 aa, Homo Sapiens
IIQEESGIH

SEQ ID NO: 1372358 - protein, 9 aa, Homo Sapiens
VGEKVFCQE

SEQ ID NO: 1372359 - protein, 9 aa, Homo Sapiens
SVVIQQPPS

SEQ ID NO: 1372360 - protein, 9 aa, Homo Sapiens
QRHLPKLQE

SEQ ID NO: 1372361 - protein, 9 aa, Homo Sapiens
KQLPKRAIQ

SEQ ID NO: 1372362 - protein, 9 aa, Homo Sapiens
LKILQIRGY

SEQ ID NO: 1372363 - protein, 9 aa, Homo Sapiens
VKPYECQQC

SEQ ID NO: 1372364 - protein, 9 aa, Homo Sapiens
NCVIQRRAK

SEQ ID NO: 1372365 - protein, 9 aa, Homo Sapiens
TWWTMSTIT

SEQ ID NO: 1372366 - protein, 9 aa, Homo Sapiens
ANGSPPPLP

SEQ ID NO: 1372367 - protein, 9 aa, Homo Sapiens
DNCTILEWL

SEQ ID NO: 1372368 - protein, 9 aa, Homo Sapiens
KEPKARNTK

SEQ ID NO: 1372369 - protein, 9 aa, Homo Sapiens
TWNIVQEHL

SEQ ID NO: 1372370 - protein, 9 aa, Homo Sapiens
TGPWKTKLL

SEQ ID NO: 1372371 - protein, 9 aa, Homo Sapiens
EPDSCIGEK

SEQ ID NO: 1372372 - protein, 9 aa, Homo Sapiens
QEDKKKFKT

SEQ ID NO: 1372373 - protein, 9 aa, Homo Sapiens
VKDNNYNLA

SEQ ID NO: 1372374 - protein, 9 aa, Homo Sapiens
LQLISFTLL

SEQ ID NO: 1372375 - protein, 9 aa, Homo Sapiens
GPSTAWSMA

SEQ ID NO: 1372376 - protein, 9 aa, Homo Sapiens
SLQNYTIAP

SEQ ID NO: 1372377 - protein, 9 aa, Homo Sapiens
RKLQERVEH

SEQ ID NO: 1372378 - protein, 9 aa, Homo Sapiens
HHEITFCIQ

SEQ ID NO: 1372379 - protein, 9 aa, Homo Sapiens
GRRRKHPPV

SEQ ID NO: 1372380 - protein, 9 aa, Homo Sapiens
QQCRVELAE

SEQ ID NO: 1372381 - protein, 9 aa, Homo Sapiens
PVQARDSGY

SEQ ID NO: 1372382 - protein, 9 aa, Homo Sapiens
LGSGGPCTC

SEQ ID NO: 1372383 - protein, 9 aa, Homo Sapiens
AAPGPLLRW

SEQ ID NO: 1372384 - protein, 9 aa, Homo Sapiens
CEHDVLRDG

SEQ ID NO: 1372385 - protein, 9 aa, Homo Sapiens
NRSSTRHHK

SEQ ID NO: 1372386 - protein, 9 aa, Homo Sapiens
RSLVNAQQV

SEQ ID NO: 1372387 - protein, 9 aa, Homo Sapiens
ELVKAMVVR

SEQ ID NO: 1372388 - protein, 9 aa, Homo Sapiens
KRLRGHRAA

SEQ ID NO: 1372389 - protein, 9 aa, Homo Sapiens
RCSQCQCTA

SEQ ID NO: 1372390 - protein, 9 aa, Homo Sapiens
EHLCDAPQD

SEQ ID NO: 1372391 - protein, 9 aa, Homo Sapiens
REGCVPSNF

SEQ ID NO: 1372392 - protein, 9 aa, Homo Sapiens
MLKDFDGTR

SEQ ID NO: 1372393 - protein, 9 aa, Homo Sapiens
STRPAALGT

SEQ ID NO: 1372394 - protein, 9 aa, Homo Sapiens
PEKGLVIHH

SEQ ID NO: 1372395 - protein, 9 aa, Homo Sapiens
KLPFCKSHI

SEQ ID NO: 1372396 - protein, 9 aa, Homo Sapiens
HMEEVERQV

SEQ ID NO: 1372397 - protein, 9 aa, Homo Sapiens
PPKENLSPG

SEQ ID NO: 1372398 - protein, 9 aa, Homo Sapiens
LLQQGAVAN

SEQ ID NO: 1372399 - protein, 9 aa, Homo Sapiens
FTVDLEAFL

SEQ ID NO: 1372400 - protein, 9 aa, Homo Sapiens
KSHSVPDEI

SEQ ID NO: 1372401 - protein, 9 aa, Homo Sapiens
YMPRGAEAD

SEQ ID NO: 1372402 - protein, 9 aa, Homo Sapiens
MVWGHPSSN

SEQ ID NO: 1372403 - protein, 9 aa, Homo Sapiens
SGSSDTEEK

SEQ ID NO: 1372404 - protein, 9 aa, Homo Sapiens
PLRKIDRLS

SEQ ID NO: 1372405 - protein, 9 aa, Homo Sapiens
LSLQEASSG

SEQ ID NO: 1372406 - protein, 9 aa, Homo Sapiens
ESVAEHGSR

SEQ ID NO: 1372407 - protein, 9 aa, Homo Sapiens
TDQASHCRC

SEQ ID NO: 1372408 - protein, 9 aa, Homo Sapiens
VTAGKVCVL

SEQ ID NO: 1372409 - protein, 9 aa, Homo Sapiens
DSVQRLGRT

SEQ ID NO: 1372410 - protein, 9 aa, Homo Sapiens
PRFDEVFYF

SEQ ID NO: 1372411 - protein, 9 aa, Homo Sapiens
AVGIPQQCI

SEQ ID NO: 1372412 - protein, 9 aa, Homo Sapiens
PPQLSVTPT

SEQ ID NO: 1372413 - protein, 9 aa, Homo Sapiens
MQLVVLVND

SEQ ID NO: 1372414 - protein, 9 aa, Homo Sapiens
GHLHLAKQE

SEQ ID NO: 1372415 - protein, 9 aa, Homo Sapiens
AMVPRGVSM

SEQ ID NO: 1372416 - protein, 9 aa, Homo Sapiens
HQFIEKKIQ

SEQ ID NO: 1372417 - protein, 9 aa, Homo Sapiens
KMTPEDHEK

SEQ ID NO: 1372418 - protein, 9 aa, Homo Sapiens
ECGAVGNNR

SEQ ID NO: 1372419 - protein, 9 aa, Homo Sapiens
DVARRCRNG

SEQ ID NO: 1372420 - protein, 9 aa, Homo Sapiens
THPGGSLNG

SEQ ID NO: 1372421 - protein, 9 aa, Homo Sapiens
VTGLHLEGD

SEQ ID NO: 1372422 - protein, 9 aa, Homo Sapiens
TKATETFKL

SEQ ID NO: 1372423 - protein, 9 aa, Homo Sapiens
AALGTCSIW

SEQ ID NO: 1372424 - protein, 9 aa, Homo Sapiens
IARLEEETR

SEQ ID NO: 1372425 - protein, 9 aa, Homo Sapiens
PSVALPAPA

SEQ ID NO: 1372426 - protein, 9 aa, Homo Sapiens
LGDYFRADG

SEQ ID NO: 1372427 - protein, 9 aa, Homo Sapiens
LHVLQVEAP

SEQ ID NO: 1372428 - protein, 9 aa, Homo Sapiens
SVSACFLEE

SEQ ID NO: 1372429 - protein, 9 aa, Homo Sapiens
CMLASLWEM

SEQ ID NO: 1372430 - protein, 9 aa, Homo Sapiens
IFIIFRIIG

SEQ ID NO: 1372431 - protein, 9 aa, Homo Sapiens
KVKALDEIL

SEQ ID NO: 1372432 - protein, 9 aa, Homo Sapiens
PKSVQPHKD

SEQ ID NO: 1372433 - protein, 9 aa, Homo Sapiens
PRLEGTGLA

SEQ ID NO: 1372434 - protein, 9 aa, Homo Sapiens
VVVVGVIAT

SEQ ID NO: 1372435 - protein, 9 aa, Homo Sapiens
RLLMRDPER

SEQ ID NO: 1372436 - protein, 9 aa, Homo Sapiens
EKRVQELQA

SEQ ID NO: 1372437 - protein, 9 aa, Homo Sapiens
AFPFPNPEQ

SEQ ID NO: 1372438 - protein, 9 aa, Homo Sapiens
CVAELGGHT

SEQ ID NO: 1372439 - protein, 9 aa, Homo Sapiens
EKTHHCLLC

SEQ ID NO: 1372440 - protein, 9 aa, Homo Sapiens
WHTSTGPAQ

SEQ ID NO: 1372441 - protein, 9 aa, Homo Sapiens
AFTAISTVE

SEQ ID NO: 1372442 - protein, 9 aa, Homo Sapiens
TNMNVNMNM

SEQ ID NO: 1372443 - protein, 9 aa, Homo Sapiens
VPVAAETAD

SEQ ID NO: 1372444 - protein, 9 aa, Homo Sapiens
PLHKPEMET

SEQ ID NO: 1372445 - protein, 9 aa, Homo Sapiens
QIPLELPLL

SEQ ID NO: 1372446 - protein, 9 aa, Homo Sapiens
MDGSGGDIP

SEQ ID NO: 1372447 - protein, 9 aa, Homo Sapiens
VLLLVLDED

SEQ ID NO: 1372448 - protein, 9 aa, Homo Sapiens
PQGPRTRAR

SEQ ID NO: 1372449 - protein, 9 aa, Homo Sapiens
RPHGRGECG

SEQ ID NO: 1372450 - protein, 9 aa, Homo Sapiens
ELVKVKDNN

SEQ ID NO: 1372451 - protein, 9 aa, Homo Sapiens
LFVGGLSPG

SEQ ID NO: 1372452 - protein, 9 aa, Homo Sapiens
TTAPPALPH

SEQ ID NO: 1372453 - protein, 9 aa, Homo Sapiens
PLHALSQFE

SEQ ID NO: 1372454 - protein, 9 aa, Homo Sapiens
PEDPVLGED

SEQ ID NO: 1372455 - protein, 9 aa, Homo Sapiens
LVVQVLQFQ

SEQ ID NO: 1372456 - protein, 9 aa, Homo Sapiens
AFMAGLAQN

SEQ ID NO: 1372457 - protein, 9 aa, Homo Sapiens
WGSDYSHSE

SEQ ID NO: 1372458 - protein, 9 aa, Homo Sapiens
RSSLYRREE

SEQ ID NO: 1372459 - protein, 9 aa, Homo Sapiens
REGGGTNIS

SEQ ID NO: 1372460 - protein, 9 aa, Homo Sapiens
TLPITLLRN

SEQ ID NO: 1372461 - protein, 9 aa, Homo Sapiens
MGQTWGPRT

SEQ ID NO: 1372462 - protein, 9 aa, Homo Sapiens
TASVFGTSR

SEQ ID NO: 1372463 - protein, 9 aa, Homo Sapiens
EAPHQKVLA

SEQ ID NO: 1372464 - protein, 9 aa, Homo Sapiens
GRRPTALVA

SEQ ID NO: 1372465 - protein, 9 aa, Homo Sapiens
VVLVNDSDF

SEQ ID NO: 1372466 - protein, 9 aa, Homo Sapiens
EGSGLDPAA

SEQ ID NO: 1372467 - protein, 9 aa, Homo Sapiens
FIRIHKVTK

SEQ ID NO: 1372468 - protein, 9 aa, Homo Sapiens
LHHQAHSPL

SEQ ID NO: 1372469 - protein, 9 aa, Homo Sapiens
DFQEEPMTG

SEQ ID NO: 1372470 - protein, 9 aa, Homo Sapiens
VKSLKKVMA

SEQ ID NO: 1372471 - protein, 9 aa, Homo Sapiens
AEQPRGVVL

SEQ ID NO: 1372472 - protein, 9 aa, Homo Sapiens
RSWKIALPV

SEQ ID NO: 1372473 - protein, 9 aa, Homo Sapiens
QESDPGDDD

SEQ ID NO: 1372474 - protein, 9 aa, Homo Sapiens
APSSPPPPL

SEQ ID NO: 1372475 - protein, 9 aa, Homo Sapiens
RLLAPGRGA

SEQ ID NO: 1372476 - protein, 9 aa, Homo Sapiens
FDEALLTIF

SEQ ID NO: 1372477 - protein, 9 aa, Homo Sapiens
RLRFCAWPS

SEQ ID NO: 1372478 - protein, 9 aa, Homo Sapiens
MKQINDAHH

SEQ ID NO: 1372479 - protein, 9 aa, Homo Sapiens
RAQATPDRV

SEQ ID NO: 1372480 - protein, 9 aa, Homo Sapiens
TIRHITQQV

SEQ ID NO: 1372481 - protein, 9 aa, Homo Sapiens
LAKLRKDIH

SEQ ID NO: 1372482 - protein, 9 aa, Homo Sapiens
LILAAIELT

SEQ ID NO: 1372483 - protein, 9 aa, Homo Sapiens
AGLVLLTSG

SEQ ID NO: 1372484 - protein, 9 aa, Homo Sapiens
SKEVEIKRI

SEQ ID NO: 1372485 - protein, 9 aa, Homo Sapiens
PRRHGLSPR

SEQ ID NO: 1372486 - protein, 9 aa, Homo Sapiens
KVGRPGRRR

SEQ ID NO: 1372487 - protein, 9 aa, Homo Sapiens
QREVCIVAQ

SEQ ID NO: 1372488 - protein, 9 aa, Homo Sapiens
VEVGEGQGA

SEQ ID NO: 1372489 - protein, 9 aa, Homo Sapiens
DLCLDILNG

SEQ ID NO: 1372490 - protein, 9 aa, Homo Sapiens
NNDNASCRL

SEQ ID NO: 1372491 - protein, 9 aa, Homo Sapiens
SGNPPSKRV

SEQ ID NO: 1372492 - protein, 9 aa, Homo Sapiens
KLRSTANMD

SEQ ID NO: 1372493 - protein, 9 aa, Homo Sapiens
EELSGSFTN

SEQ ID NO: 1372494 - protein, 9 aa, Homo Sapiens
PTTNGTLPI

SEQ ID NO: 1372495 - protein, 9 aa, Homo Sapiens
QAVANGPSH

SEQ ID NO: 1372496 - protein, 9 aa, Homo Sapiens
VIGLTLTTL

SEQ ID NO: 1372497 - protein, 9 aa, Homo Sapiens
PSPLPPQLS

SEQ ID NO: 1372498 - protein, 9 aa, Homo Sapiens
SGSHKGGHF

SEQ ID NO: 1372499 - protein, 9 aa, Homo Sapiens
EAAQEMVAD

SEQ ID NO: 1372500 - protein, 9 aa, Homo Sapiens
TLVLTEDSG

SEQ ID NO: 1372501 - protein, 9 aa, Homo Sapiens
NSSNSSKPR

SEQ ID NO: 1372502 - protein, 9 aa, Homo Sapiens
CPPHLVEVE

SEQ ID NO: 1372503 - protein, 9 aa, Homo Sapiens
NFKNEAGYT

SEQ ID NO: 1372504 - protein, 9 aa, Homo Sapiens
PAYHPEFIT

SEQ ID NO: 1372505 - protein, 9 aa, Homo Sapiens
GLFSLGMRT

SEQ ID NO: 1372506 - protein, 9 aa, Homo Sapiens
RGPGPRQPS

SEQ ID NO: 1372507 - protein, 9 aa, Homo Sapiens
VNHYHIGSG

SEQ ID NO: 1372508 - protein, 9 aa, Homo Sapiens
KTYSDSQED

SEQ ID NO: 1372509 - protein, 9 aa, Homo Sapiens
VVGKTFDSV

SEQ ID NO: 1372510 - protein, 9 aa, Homo Sapiens
EVLDSQCLV

SEQ ID NO: 1372511 - protein, 9 aa, Homo Sapiens
LQVWGSDYS

SEQ ID NO: 1372512 - protein, 9 aa, Homo Sapiens
DLQKEVLDS

SEQ ID NO: 1372513 - protein, 9 aa, Homo Sapiens
LVLVMDCPY

SEQ ID NO: 1372514 - protein, 9 aa, Homo Sapiens
RDLPSKLNQ

SEQ ID NO: 1372515 - protein, 9 aa, Homo Sapiens
DERQWQEEL

SEQ ID NO: 1372516 - protein, 9 aa, Homo Sapiens
RFPRPNYRL

SEQ ID NO: 1372517 - protein, 9 aa, Homo Sapiens
SSGGPGCCH

SEQ ID NO: 1372518 - protein, 9 aa, Homo Sapiens
GGVTLRMVL

SEQ ID NO: 1372519 - protein, 9 aa, Homo Sapiens
GALLAPATR

SEQ ID NO: 1372520 - protein, 9 aa, Homo Sapiens
EWRMSRLKG

SEQ ID NO: 1372521 - protein, 9 aa, Homo Sapiens
MSSYGLILA

SEQ ID NO: 1372522 - protein, 9 aa, Homo Sapiens
NGPSHSLGW

SEQ ID NO: 1372523 - protein, 9 aa, Homo Sapiens
IKCGASYAP

SEQ ID NO: 1372524 - protein, 9 aa, Homo Sapiens
NEHHEAIPV

SEQ ID NO: 1372525 - protein, 9 aa, Homo Sapiens
KDLTYSAIC

SEQ ID NO: 1372526 - protein, 9 aa, Homo Sapiens
TNQDNASAL

SEQ ID NO: 1372527 - protein, 9 aa, Homo Sapiens
FTHNTSKET

SEQ ID NO: 1372528 - protein, 9 aa, Homo Sapiens
GPLLRWSRG

SEQ ID NO: 1372529 - protein, 9 aa, Homo Sapiens
LWVQAAMGS

SEQ ID NO: 1372530 - protein, 9 aa, Homo Sapiens
YFFLATLSC

SEQ ID NO: 1372531 - protein, 9 aa, Homo Sapiens
TVPHQAQDK

SEQ ID NO: 1372532 - protein, 9 aa, Homo Sapiens
LRFCHLCPF

SEQ ID NO: 1372533 - protein, 9 aa, Homo Sapiens
IPGQPLVGR

SEQ ID NO: 1372534 - protein, 9 aa, Homo Sapiens
ESETPVPVA

SEQ ID NO: 1372535 - protein, 9 aa, Homo Sapiens
DRLRACQEQ

SEQ ID NO: 1372536 - protein, 9 aa, Homo Sapiens
TAPSVLTAL

SEQ ID NO: 1372537 - protein, 9 aa, Homo Sapiens
DWLAPVAWH

SEQ ID NO: 1372538 - protein, 9 aa, Homo Sapiens
GRDCRDNTE

SEQ ID NO: 1372539 - protein, 9 aa, Homo Sapiens
LHRRRAFTY

SEQ ID NO: 1372540 - protein, 9 aa, Homo Sapiens
HPPPPPWGL

SEQ ID NO: 1372541 - protein, 9 aa, Homo Sapiens
MPFRRQPGL

SEQ ID NO: 1372542 - protein, 9 aa, Homo Sapiens
DLEAFLAAV

SEQ ID NO: 1372543 - protein, 9 aa, Homo Sapiens
FGPAKIEAE

SEQ ID NO: 1372544 - protein, 9 aa, Homo Sapiens
RVLFMLLNA

SEQ ID NO: 1372545 - protein, 9 aa, Homo Sapiens
GSGVSVVLI

SEQ ID NO: 1372546 - protein, 9 aa, Homo Sapiens
LTYQCGIPT

SEQ ID NO: 1372547 - protein, 9 aa, Homo Sapiens
QHGRRPTAL

SEQ ID NO: 1372548 - protein, 9 aa, Homo Sapiens
SLNEKSEGT

SEQ ID NO: 1372549 - protein, 9 aa, Homo Sapiens
HPKAVTMMP

SEQ ID NO: 1372550 - protein, 9 aa, Homo Sapiens
LLMRDPERR

SEQ ID NO: 1372551 - protein, 9 aa, Homo Sapiens
CCPSSWMTP

SEQ ID NO: 1372552 - protein, 9 aa, Homo Sapiens
ELPVGCRPL

SEQ ID NO: 1372553 - protein, 9 aa, Homo Sapiens
VVEEEQKNH

SEQ ID NO: 1372554 - protein, 9 aa, Homo Sapiens
NNHEDSTYY

SEQ ID NO: 1372555 - protein, 9 aa, Homo Sapiens
IDFVTPIQQ

SEQ ID NO: 1372556 - protein, 9 aa, Homo Sapiens
NSISRESAL

SEQ ID NO: 1372557 - protein, 9 aa, Homo Sapiens
AYTNHCIGA

SEQ ID NO: 1372558 - protein, 9 aa, Homo Sapiens
AARGLLLAL

SEQ ID NO: 1372559 - protein, 9 aa, Homo Sapiens
PLSDSPPLQ

SEQ ID NO: 1372560 - protein, 9 aa, Homo Sapiens
SSLVLAEYW

SEQ ID NO: 1372561 - protein, 9 aa, Homo Sapiens
QQFDKKMSG

SEQ ID NO: 1372562 - protein, 9 aa, Homo Sapiens
AAFPPPGTK

SEQ ID NO: 1372563 - protein, 9 aa, Homo Sapiens
PDQPRSVRY

SEQ ID NO: 1372564 - protein, 9 aa, Homo Sapiens
DQMQKVDQY

SEQ ID NO: 1372565 - protein, 9 aa, Homo Sapiens
SVGTARIWN

SEQ ID NO: 1372566 - protein, 9 aa, Homo Sapiens
KNQIGRTVA

SEQ ID NO: 1372567 - protein, 9 aa, Homo Sapiens
KKLLWFYVA

SEQ ID NO: 1372568 - protein, 9 aa, Homo Sapiens
MSLCVVRYV

SEQ ID NO: 1372569 - protein, 9 aa, Homo Sapiens
GEGAQEQVP

SEQ ID NO: 1372570 - protein, 9 aa, Homo Sapiens
SESGPLGNS

SEQ ID NO: 1372571 - protein, 9 aa, Homo Sapiens
VSRDTSKLM

SEQ ID NO: 1372572 - protein, 9 aa, Homo Sapiens
HYSRKVFVG

SEQ ID NO: 1372573 - protein, 9 aa, Homo Sapiens
IITGGPTPA

SEQ ID NO: 1372574 - protein, 9 aa, Homo Sapiens
PCDRPHRPV

SEQ ID NO: 1372575 - protein, 9 aa, Homo Sapiens
ERVTHADRE

SEQ ID NO: 1372576 - protein, 9 aa, Homo Sapiens
PVQCDEQGM

SEQ ID NO: 1372577 - protein, 9 aa, Homo Sapiens
IRGTEISLC

SEQ ID NO: 1372578 - protein, 9 aa, Homo Sapiens
LAKTIACYG

SEQ ID NO: 1372579 - protein, 9 aa, Homo Sapiens
PISKERQSY

SEQ ID NO: 1372580 - protein, 9 aa, Homo Sapiens
KAIMVGFWP

SEQ ID NO: 1372581 - protein, 9 aa, Homo Sapiens
KKPKKQKLM

SEQ ID NO: 1372582 - protein, 9 aa, Homo Sapiens
FQKTVTQLI

SEQ ID NO: 1372583 - protein, 9 aa, Homo Sapiens
PQTSSTARP

SEQ ID NO: 1372584 - protein, 9 aa, Homo Sapiens
ALSTEMTPY

SEQ ID NO: 1372585 - protein, 9 aa, Homo Sapiens
QHPAAEEAE

SEQ ID NO: 1372586 - protein, 9 aa, Homo Sapiens
IYCGMRFVA

SEQ ID NO: 1372587 - protein, 9 aa, Homo Sapiens
KTHPKSVQP

SEQ ID NO: 1372588 - protein, 9 aa, Homo Sapiens
GPQALPEKG

SEQ ID NO: 1372589 - protein, 9 aa, Homo Sapiens
RQWLRPQCP

SEQ ID NO: 1372590 - protein, 9 aa, Homo Sapiens
YPKKFCPLE

SEQ ID NO: 1372591 - protein, 9 aa, Homo Sapiens
GVLAASAPV

SEQ ID NO: 1372592 - protein, 9 aa, Homo Sapiens
PGLLIFFLF

SEQ ID NO: 1372593 - protein, 9 aa, Homo Sapiens
HNSSCAPVF

SEQ ID NO: 1372594 - protein, 9 aa, Homo Sapiens
MPAATIVHF

SEQ ID NO: 1372595 - protein, 9 aa, Homo Sapiens
LRGYVGWHP

SEQ ID NO: 1372596 - protein, 9 aa, Homo Sapiens
FNTPAAEDR

SEQ ID NO: 1372597 - protein, 9 aa, Homo Sapiens
QHHEITFCI

SEQ ID NO: 1372598 - protein, 9 aa, Homo Sapiens
KEALLRVTV

SEQ ID NO: 1372599 - protein, 9 aa, Homo Sapiens
LELPLLLNG

SEQ ID NO: 1372600 - protein, 9 aa, Homo Sapiens
IIASKVSDP

SEQ ID NO: 1372601 - protein, 9 aa, Homo Sapiens
GFAGTSGYL

SEQ ID NO: 1372602 - protein, 9 aa, Homo Sapiens
SCFSTGIRA

SEQ ID NO: 1372603 - protein, 9 aa, Homo Sapiens
RRQRRAPAP

SEQ ID NO: 1372604 - protein, 9 aa, Homo Sapiens
ALPPALGTE

SEQ ID NO: 1372605 - protein, 9 aa, Homo Sapiens
HMPGEFPVS

SEQ ID NO: 1372606 - protein, 9 aa, Homo Sapiens
TSLKEAADM

SEQ ID NO: 1372607 - protein, 9 aa, Homo Sapiens
ISAPLHKPE

SEQ ID NO: 1372608 - protein, 9 aa, Homo Sapiens
IQQVEWRMS

SEQ ID NO: 1372609 - protein, 9 aa, Homo Sapiens
LLGPPGHRF

SEQ ID NO: 1372610 - protein, 9 aa, Homo Sapiens
CWRENLLEH

SEQ ID NO: 1372611 - protein, 9 aa, Homo Sapiens
VHNHRWRSL

SEQ ID NO: 1372612 - protein, 9 aa, Homo Sapiens
WLRPQCPAI

SEQ ID NO: 1372613 - protein, 9 aa, Homo Sapiens
EDKKKFKTK

SEQ ID NO: 1372614 - protein, 9 aa, Homo Sapiens
AWFGFAGTS

SEQ ID NO: 1372615 - protein, 9 aa, Homo Sapiens
PDLLGPAGR

SEQ ID NO: 1372616 - protein, 9 aa, Homo Sapiens
APCASLAAA

SEQ ID NO: 1372617 - protein, 9 aa, Homo Sapiens
SLIWSRDQG

SEQ ID NO: 1372618 - protein, 9 aa, Homo Sapiens
KKKKKKKIK

SEQ ID NO: 1372619 - protein, 9 aa, Homo Sapiens
IKEPGSGVS

SEQ ID NO: 1372620 - protein, 9 aa, Homo Sapiens
FVRNLAATV

SEQ ID NO: 1372621 - protein, 9 aa, Homo Sapiens
EKKREGIFQ

SEQ ID NO: 1372622 - protein, 9 aa, Homo Sapiens
LTAVDCLQA

SEQ ID NO: 1372623 - protein, 9 aa, Homo Sapiens
QLKDILRPP

SEQ ID NO: 1372624 - protein, 9 aa, Homo Sapiens
ARVYGSTFS

SEQ ID NO: 1372625 - protein, 9 aa, Homo Sapiens
KQILKRVNL

SEQ ID NO: 1372626 - protein, 9 aa, Homo Sapiens
VNWTNSAIC

SEQ ID NO: 1372627 - protein, 9 aa, Homo Sapiens
AGRRSTRPA

SEQ ID NO: 1372628 - protein, 9 aa, Homo Sapiens
ESDGLTSQG

SEQ ID NO: 1372629 - protein, 9 aa, Homo Sapiens
HMASIKAEA

SEQ ID NO: 1372630 - protein, 9 aa, Homo Sapiens
AQPSTSGKR

SEQ ID NO: 1372631 - protein, 9 aa, Homo Sapiens
ALCCAAVGR

SEQ ID NO: 1372632 - protein, 9 aa, Homo Sapiens
VTQKRTEES

SEQ ID NO: 1372633 - protein, 9 aa, Homo Sapiens
EDAHMLDIF

SEQ ID NO: 1372634 - protein, 9 aa, Homo Sapiens
SPLRVICSL

SEQ ID NO: 1372635 - protein, 9 aa, Homo Sapiens
LQDSSKGPL

SEQ ID NO: 1372636 - protein, 9 aa, Homo Sapiens
ASPLRVICS

SEQ ID NO: 1372637 - protein, 9 aa, Homo Sapiens
VPVERVTHA

SEQ ID NO: 1372638 - protein, 9 aa, Homo Sapiens
PKERWEPQP

SEQ ID NO: 1372639 - protein, 9 aa, Homo Sapiens
TVAHLLQRG

SEQ ID NO: 1372640 - protein, 9 aa, Homo Sapiens
HQEYREDFV

SEQ ID NO: 1372641 - protein, 9 aa, Homo Sapiens
APAGPQRDS

SEQ ID NO: 1372642 - protein, 9 aa, Homo Sapiens
YAVSIMWGL

SEQ ID NO: 1372643 - protein, 9 aa, Homo Sapiens
ILPRLGFAD

SEQ ID NO: 1372644 - protein, 9 aa, Homo Sapiens
RGGGSGGGS

SEQ ID NO: 1372645 - protein, 9 aa, Homo Sapiens
HQLHSDSFP

SEQ ID NO: 1372646 - protein, 9 aa, Homo Sapiens
WGRWCWWGR

SEQ ID NO: 1372647 - protein, 9 aa, Homo Sapiens
ARQPSRWPS

SEQ ID NO: 1372648 - protein, 9 aa, Homo Sapiens
RGGTGVWLC

SEQ ID NO: 1372649 - protein, 9 aa, Homo Sapiens
RFRKSKKKK

SEQ ID NO: 1372650 - protein, 9 aa, Homo Sapiens
HLEAEGAHH

SEQ ID NO: 1372651 - protein, 9 aa, Homo Sapiens
RNSPDWGGA

SEQ ID NO: 1372652 - protein, 9 aa, Homo Sapiens
SGNMIIVML

SEQ ID NO: 1372653 - protein, 9 aa, Homo Sapiens
PRAGATAGP

SEQ ID NO: 1372654 - protein, 9 aa, Homo Sapiens
VHHYLCTDV

SEQ ID NO: 1372655 - protein, 9 aa, Homo Sapiens
GRNIALRND

SEQ ID NO: 1372656 - protein, 9 aa, Homo Sapiens
DPIAGALRD

SEQ ID NO: 1372657 - protein, 9 aa, Homo Sapiens
VETKSPHEA

SEQ ID NO: 1372658 - protein, 9 aa, Homo Sapiens
MGRKKVQIQ

SEQ ID NO: 1372659 - protein, 9 aa, Homo Sapiens
TFCFTASHI

SEQ ID NO: 1372660 - protein, 9 aa, Homo Sapiens
SIQSQESGY

SEQ ID NO: 1372661 - protein, 9 aa, Homo Sapiens
GGISVLRPQ

SEQ ID NO: 1372662 - protein, 9 aa, Homo Sapiens
AIAALEVVE

SEQ ID NO: 1372663 - protein, 9 aa, Homo Sapiens
RQQVQRRGA

SEQ ID NO: 1372664 - protein, 9 aa, Homo Sapiens
PLYVFGQCV

SEQ ID NO: 1372665 - protein, 9 aa, Homo Sapiens
GVLGIEDCS

SEQ ID NO: 1372666 - protein, 9 aa, Homo Sapiens
AMGNYMLDK

SEQ ID NO: 1372667 - protein, 9 aa, Homo Sapiens
SIWSTCCSM

SEQ ID NO: 1372668 - protein, 9 aa, Homo Sapiens
EGGEPAGQH

SEQ ID NO: 1372669 - protein, 9 aa, Homo Sapiens
KQAQVLPFG

SEQ ID NO: 1372670 - protein, 9 aa, Homo Sapiens
LDGVTGLHL

SEQ ID NO: 1372671 - protein, 9 aa, Homo Sapiens
VSMGTDQAS

SEQ ID NO: 1372672 - protein, 9 aa, Homo Sapiens
KLKEWLPQN

SEQ ID NO: 1372673 - protein, 9 aa, Homo Sapiens
GMVIGQEVR

SEQ ID NO: 1372674 - protein, 9 aa, Homo Sapiens
LLRYLVDED

SEQ ID NO: 1372675 - protein, 9 aa, Homo Sapiens
VQESGWEHV

SEQ ID NO: 1372676 - protein, 9 aa, Homo Sapiens
EQVDASSCL

SEQ ID NO: 1372677 - protein, 9 aa, Homo Sapiens
SQAHGNFLE

SEQ ID NO: 1372678 - protein, 9 aa, Homo Sapiens
PPSKRVSIS

SEQ ID NO: 1372679 - protein, 9 aa, Homo Sapiens
TSQRQRKRM

SEQ ID NO: 1372680 - protein, 9 aa, Homo Sapiens
CNVTQEKSG

SEQ ID NO: 1372681 - protein, 9 aa, Homo Sapiens
LIMSSYGLI

SEQ ID NO: 1372682 - protein, 9 aa, Homo Sapiens
PRLYHSVKM

SEQ ID NO: 1372683 - protein, 9 aa, Homo Sapiens
LTQSVDLLG

SEQ ID NO: 1372684 - protein, 9 aa, Homo Sapiens
MVADYQQTI

SEQ ID NO: 1372685 - protein, 9 aa, Homo Sapiens
NVRLCNGEM

SEQ ID NO: 1372686 - protein, 9 aa, Homo Sapiens
GATKLACLG

SEQ ID NO: 1372687 - protein, 9 aa, Homo Sapiens
EELQQVQCL

SEQ ID NO: 1372688 - protein, 9 aa, Homo Sapiens
NMKQRHENQ

SEQ ID NO: 1372689 - protein, 9 aa, Homo Sapiens
VVKWNKDGC

SEQ ID NO: 1372690 - protein, 9 aa, Homo Sapiens
TVACYYYLL

SEQ ID NO: 1372691 - protein, 9 aa, Homo Sapiens
AGERGQKSR

SEQ ID NO: 1372692 - protein, 9 aa, Homo Sapiens
QAHGNFLED

SEQ ID NO: 1372693 - protein, 9 aa, Homo Sapiens
RAPQTPPQP

SEQ ID NO: 1372694 - protein, 9 aa, Homo Sapiens
TWTPCDRPH

SEQ ID NO: 1372695 - protein, 9 aa, Homo Sapiens
LQPGVTAVI

SEQ ID NO: 1372696 - protein, 9 aa, Homo Sapiens
SVENFKDGY

SEQ ID NO: 1372697 - protein, 9 aa, Homo Sapiens
LCASEFVCE

SEQ ID NO: 1372698 - protein, 9 aa, Homo Sapiens
GGTIGPLYV

SEQ ID NO: 1372699 - protein, 9 aa, Homo Sapiens
DKGNYRCTT

SEQ ID NO: 1372700 - protein, 9 aa, Homo Sapiens
TSMILRIDL

SEQ ID NO: 1372701 - protein, 9 aa, Homo Sapiens
HAGPPGPQA

SEQ ID NO: 1372702 - protein, 9 aa, Homo Sapiens
VLSPRRLRN

SEQ ID NO: 1372703 - protein, 9 aa, Homo Sapiens
MHDEGVLIN

SEQ ID NO: 1372704 - protein, 9 aa, Homo Sapiens
QRKRMLSVS

SEQ ID NO: 1372705 - protein, 9 aa, Homo Sapiens
RGAEADCMS

SEQ ID NO: 1372706 - protein, 9 aa, Homo Sapiens
HTRTHLKEK

SEQ ID NO: 1372707 - protein, 9 aa, Homo Sapiens
SQFVLKFLD

SEQ ID NO: 1372708 - protein, 9 aa, Homo Sapiens
RALCQIADS

SEQ ID NO: 1372709 - protein, 9 aa, Homo Sapiens
NEPCAVVQY

SEQ ID NO: 1372710 - protein, 9 aa, Homo Sapiens
RMETCQKKK

SEQ ID NO: 1372711 - protein, 9 aa, Homo Sapiens
VFLIQLLKS

SEQ ID NO: 1372712 - protein, 9 aa, Homo Sapiens
AVRPAARAS

SEQ ID NO: 1372713 - protein, 9 aa, Homo Sapiens
AFRRFSSPR

SEQ ID NO: 1372714 - protein, 9 aa, Homo Sapiens
SRESDNHSP

SEQ ID NO: 1372715 - protein, 9 aa, Homo Sapiens
YYEDRHPKH

SEQ ID NO: 1372716 - protein, 9 aa, Homo Sapiens
YVGDGFSCG

SEQ ID NO: 1372717 - protein, 9 aa, Homo Sapiens
QAALSLYAS

SEQ ID NO: 1372718 - protein, 9 aa, Homo Sapiens
KMEIKKSLR

SEQ ID NO: 1372719 - protein, 9 aa, Homo Sapiens
PCPSSWCVA

SEQ ID NO: 1372720 - protein, 9 aa, Homo Sapiens
LPADTAATV

SEQ ID NO: 1372721 - protein, 9 aa, Homo Sapiens
AIQEKLHQL

SEQ ID NO: 1372722 - protein, 9 aa, Homo Sapiens
GMYVIDSKN

SEQ ID NO: 1372723 - protein, 9 aa, Homo Sapiens
ACEHQAHQA

SEQ ID NO: 1372724 - protein, 9 aa, Homo Sapiens
WPLCCCNRH

SEQ ID NO: 1372725 - protein, 9 aa, Homo Sapiens
FEVMERIKG

SEQ ID NO: 1372726 - protein, 9 aa, Homo Sapiens
EGPGRHPFR

SEQ ID NO: 1372727 - protein, 9 aa, Homo Sapiens
VNRRFRPHR

SEQ ID NO: 1372728 - protein, 9 aa, Homo Sapiens
QYRATLINE

SEQ ID NO: 1372729 - protein, 9 aa, Homo Sapiens
GDGECGKSL

SEQ ID NO: 1372730 - protein, 9 aa, Homo Sapiens
FDLCMMVAN

SEQ ID NO: 1372731 - protein, 9 aa, Homo Sapiens
ESSSTISSI

SEQ ID NO: 1372732 - protein, 9 aa, Homo Sapiens
GPLGNSSGS

SEQ ID NO: 1372733 - protein, 9 aa, Homo Sapiens
KPPRFLQRS

SEQ ID NO: 1372734 - protein, 9 aa, Homo Sapiens
AHAAEIKNV

SEQ ID NO: 1372735 - protein, 9 aa, Homo Sapiens
ARARRHRAL

SEQ ID NO: 1372736 - protein, 9 aa, Homo Sapiens
SDPVNHYHI

SEQ ID NO: 1372737 - protein, 9 aa, Homo Sapiens
TAVIDNFYI

SEQ ID NO: 1372738 - protein, 9 aa, Homo Sapiens
QVHLIYVVE

SEQ ID NO: 1372739 - protein, 9 aa, Homo Sapiens
PQVPLSVHK

SEQ ID NO: 1372740 - protein, 9 aa, Homo Sapiens
PDRVLFMLL

SEQ ID NO: 1372741 - protein, 9 aa, Homo Sapiens
CFLEETEGI

SEQ ID NO: 1372742 - protein, 9 aa, Homo Sapiens
GFAVGIPQQ

SEQ ID NO: 1372743 - protein, 9 aa, Homo Sapiens
ELPADTAAT

SEQ ID NO: 1372744 - protein, 9 aa, Homo Sapiens
PPSLPLPRT

SEQ ID NO: 1372745 - protein, 9 aa, Homo Sapiens
LLFLILGKV

SEQ ID NO: 1372746 - protein, 9 aa, Homo Sapiens
TDSIHWCGI

SEQ ID NO: 1372747 - protein, 9 aa, Homo Sapiens
RDLSTYRPL

SEQ ID NO: 1372748 - protein, 9 aa, Homo Sapiens
RQGASIFQL

SEQ ID NO: 1372749 - protein, 9 aa, Homo Sapiens
FSQANQLNY

SEQ ID NO: 1372750 - protein, 9 aa, Homo Sapiens
IGSCIPCPD

SEQ ID NO: 1372751 - protein, 9 aa, Homo Sapiens
TQERAAAAA

SEQ ID NO: 1372752 - protein, 9 aa, Homo Sapiens
EKRREMEKE

SEQ ID NO: 1372753 - protein, 9 aa, Homo Sapiens
SKKKLKLAP

SEQ ID NO: 1372754 - protein, 9 aa, Homo Sapiens
FQSPSENDT

SEQ ID NO: 1372755 - protein, 9 aa, Homo Sapiens
HVVMQKLLR

SEQ ID NO: 1372756 - protein, 9 aa, Homo Sapiens
ACSLISVNQ

SEQ ID NO: 1372757 - protein, 9 aa, Homo Sapiens
YRCTTSNFL

SEQ ID NO: 1372758 - protein, 9 aa, Homo Sapiens
SGPHSHCLY

SEQ ID NO: 1372759 - protein, 9 aa, Homo Sapiens
WSWGVCFMW

SEQ ID NO: 1372760 - protein, 9 aa, Homo Sapiens
RWVTSGIYL

SEQ ID NO: 1372761 - protein, 9 aa, Homo Sapiens
DIDEYKKTY

SEQ ID NO: 1372762 - protein, 9 aa, Homo Sapiens
ASLSLLIAA

SEQ ID NO: 1372763 - protein, 9 aa, Homo Sapiens
QGLHEDLHP

SEQ ID NO: 1372764 - protein, 9 aa, Homo Sapiens
TGGTIGPLY

SEQ ID NO: 1372765 - protein, 9 aa, Homo Sapiens
LPRDLSTYR

SEQ ID NO: 1372766 - protein, 9 aa, Homo Sapiens
RGSRGHLHA

SEQ ID NO: 1372767 - protein, 9 aa, Homo Sapiens
EPMTGFYVG

SEQ ID NO: 1372768 - protein, 9 aa, Homo Sapiens
AEKKQFDPV

SEQ ID NO: 1372769 - protein, 9 aa, Homo Sapiens
HEDSTYYYL

SEQ ID NO: 1372770 - protein, 9 aa, Homo Sapiens
LSLKECFIK

SEQ ID NO: 1372771 - protein, 9 aa, Homo Sapiens
PVRNPTPIP

SEQ ID NO: 1372772 - protein, 8 aa, Homo Sapiens
YGPGSQLG

SEQ ID NO: 1372773 - protein, 9 aa, Homo Sapiens
QDTVSSCWP

SEQ ID NO: 1372774 - protein, 9 aa, Homo Sapiens
SGDFGDGHH

SEQ ID NO: 1372775 - protein, 9 aa, Homo Sapiens
LERFRSFSP

SEQ ID NO: 1372776 - protein, 9 aa, Homo Sapiens
PVTPLRVQS

SEQ ID NO: 1372777 - protein, 9 aa, Homo Sapiens
QELKKSYNK

SEQ ID NO: 1372778 - protein, 9 aa, Homo Sapiens
APRAGRGRW

SEQ ID NO: 1372779 - protein, 9 aa, Homo Sapiens
NFLFLIYLR

SEQ ID NO: 1372780 - protein, 9 aa, Homo Sapiens
DAYFNTPAA

SEQ ID NO: 1372781 - protein, 9 aa, Homo Sapiens
QGHVHRRVC

SEQ ID NO: 1372782 - protein, 9 aa, Homo Sapiens
CWWGRGCCL

SEQ ID NO: 1372783 - protein, 9 aa, Homo Sapiens
FRADGFADQ

SEQ ID NO: 1372784 - protein, 9 aa, Homo Sapiens
QIMFETVNT

SEQ ID NO: 1372785 - protein, 9 aa, Homo Sapiens
SSKTFEKKG

SEQ ID NO: 1372786 - protein, 9 aa, Homo Sapiens
CRTLEPNPV

SEQ ID NO: 1372787 - protein, 9 aa, Homo Sapiens
FRSFSPLKE

SEQ ID NO: 1372788 - protein, 9 aa, Homo Sapiens
ARIWNETVS

SEQ ID NO: 1372789 - protein, 9 aa, Homo Sapiens
ASAGPVTRR

SEQ ID NO: 1372790 - protein, 9 aa, Homo Sapiens
EPGLFSLGM

SEQ ID NO: 1372791 - protein, 9 aa, Homo Sapiens
EPKARNTKK

SEQ ID NO: 1372792 - protein, 9 aa, Homo Sapiens
APEVTEQVR

SEQ ID NO: 1372793 - protein, 9 aa, Homo Sapiens
PTRVITAAA

SEQ ID NO: 1372794 - protein, 9 aa, Homo Sapiens
EVDFAGSSP

SEQ ID NO: 1372795 - protein, 9 aa, Homo Sapiens
ETSMDREKE

SEQ ID NO: 1372796 - protein, 9 aa, Homo Sapiens
SHHGSHAKD

SEQ ID NO: 1372797 - protein, 9 aa, Homo Sapiens
ALFLEPRRR

SEQ ID NO: 1372798 - protein, 9 aa, Homo Sapiens
SRPSHYRVL

SEQ ID NO: 1372799 - protein, 9 aa, Homo Sapiens
SRKAFRRFS

SEQ ID NO: 1372800 - protein, 9 aa, Homo Sapiens
KKAVVHYDR

SEQ ID NO: 1372801 - protein, 9 aa, Homo Sapiens
CSRYSPMSS

SEQ ID NO: 1372802 - protein, 9 aa, Homo Sapiens
QGKDRKETV

SEQ ID NO: 1372803 - protein, 9 aa, Homo Sapiens
RHQRGRGGV

SEQ ID NO: 1372804 - protein, 9 aa, Homo Sapiens
TRVGRTLSK

SEQ ID NO: 1372805 - protein, 9 aa, Homo Sapiens
SSGASSPTS

SEQ ID NO: 1372806 - protein, 9 aa, Homo Sapiens
PLCPAQMCA

SEQ ID NO: 1372807 - protein, 9 aa, Homo Sapiens
WCQEGRHQR

SEQ ID NO: 1372808 - protein, 9 aa, Homo Sapiens
ALADLLSVV

SEQ ID NO: 1372809 - protein, 9 aa, Homo Sapiens
GLSPRWTLC

SEQ ID NO: 1372810 - protein, 9 aa, Homo Sapiens
AYVECITSS

SEQ ID NO: 1372811 - protein, 9 aa, Homo Sapiens
GKSFRSTRA

SEQ ID NO: 1372812 - protein, 9 aa, Homo Sapiens
PRRRVTPRD

SEQ ID NO: 1372813 - protein, 9 aa, Homo Sapiens
GAQEQVPVE

SEQ ID NO: 1372814 - protein, 9 aa, Homo Sapiens
KLQERVEHC

SEQ ID NO: 1372815 - protein, 9 aa, Homo Sapiens
ALVAGPSTA

SEQ ID NO: 1372816 - protein, 9 aa, Homo Sapiens
SLGMRTGEV

SEQ ID NO: 1372817 - protein, 9 aa, Homo Sapiens
CFIVSGSLS

SEQ ID NO: 1372818 - protein, 9 aa, Homo Sapiens
FRNAEVHQT

SEQ ID NO: 1372819 - protein, 9 aa, Homo Sapiens
LNDKKGDIL

SEQ ID NO: 1372820 - protein, 9 aa, Homo Sapiens
CPDTPQLEG

SEQ ID NO: 1372821 - protein, 9 aa, Homo Sapiens
SPGWKRKRW

SEQ ID NO: 1372822 - protein, 9 aa, Homo Sapiens
EVVVFEAVL

SEQ ID NO: 1372823 - protein, 9 aa, Homo Sapiens
VHDLVPYLY

SEQ ID NO: 1372824 - protein, 9 aa, Homo Sapiens
KGRDCRDNT

SEQ ID NO: 1372825 - protein, 9 aa, Homo Sapiens
SVTWLKDDQ

SEQ ID NO: 1372826 - protein, 9 aa, Homo Sapiens
PGEKKSQAS

SEQ ID NO: 1372827 - protein, 9 aa, Homo Sapiens
VTVPHDERI

SEQ ID NO: 1372828 - protein, 9 aa, Homo Sapiens
AVVPIVIGL

SEQ ID NO: 1372829 - protein, 9 aa, Homo Sapiens
HIQQVEWRM

SEQ ID NO: 1372830 - protein, 9 aa, Homo Sapiens
CLLFFSTCY

SEQ ID NO: 1372831 - protein, 9 aa, Homo Sapiens
YMKLAYKKA

SEQ ID NO: 1372832 - protein, 9 aa, Homo Sapiens
LISVNQGST

SEQ ID NO: 1372833 - protein, 9 aa, Homo Sapiens
HQADGREEE

SEQ ID NO: 1372834 - protein, 9 aa, Homo Sapiens
YQYVETSGY

SEQ ID NO: 1372835 - protein, 9 aa, Homo Sapiens
SGHQADQEH

SEQ ID NO: 1372836 - protein, 9 aa, Homo Sapiens
YRPIFPPHS

SEQ ID NO: 1372837 - protein, 9 aa, Homo Sapiens
EHSLSKDTI

SEQ ID NO: 1372838 - protein, 9 aa, Homo Sapiens
KVMPFRRQP

SEQ ID NO: 1372839 - protein, 9 aa, Homo Sapiens
TLVAVVLMP

SEQ ID NO: 1372840 - protein, 9 aa, Homo Sapiens
VNLRPAVQL

SEQ ID NO: 1372841 - protein, 9 aa, Homo Sapiens
ACCPCWASP

SEQ ID NO: 1372842 - protein, 9 aa, Homo Sapiens
SAPDQPPQF

SEQ ID NO: 1372843 - protein, 9 aa, Homo Sapiens
DRLKEASGT

SEQ ID NO: 1372844 - protein, 9 aa, Homo Sapiens
SRGLGTELS

SEQ ID NO: 1372845 - protein, 9 aa, Homo Sapiens
ALDEILQEK

SEQ ID NO: 1372846 - protein, 9 aa, Homo Sapiens
TMLCAANGN

SEQ ID NO: 1372847 - protein, 9 aa, Homo Sapiens
VQIQRITDE

SEQ ID NO: 1372848 - protein, 9 aa, Homo Sapiens
SKGSLVHSD

SEQ ID NO: 1372849 - protein, 9 aa, Homo Sapiens
ARRTLYQEV

SEQ ID NO: 1372850 - protein, 9 aa, Homo Sapiens
SRKFDPLLD

SEQ ID NO: 1372851 - protein, 9 aa, Homo Sapiens
ISGSSARHV

SEQ ID NO: 1372852 - protein, 9 aa, Homo Sapiens
LGTELSYLN

SEQ ID NO: 1372853 - protein, 9 aa, Homo Sapiens
SREDPVGTE

SEQ ID NO: 1372854 - protein, 9 aa, Homo Sapiens
LPMENGSGS

SEQ ID NO: 1372855 - protein, 9 aa, Homo Sapiens
RSQGLPASR

SEQ ID NO: 1372856 - protein, 9 aa, Homo Sapiens
LSTRAGGSA

SEQ ID NO: 1372857 - protein, 9 aa, Homo Sapiens
GRRADHPPA

SEQ ID NO: 1372858 - protein, 9 aa, Homo Sapiens
GAPEPSFLR

SEQ ID NO: 1372859 - protein, 9 aa, Homo Sapiens
KLRCMYRNA

SEQ ID NO: 1372860 - protein, 9 aa, Homo Sapiens
DRYDDCRDY

SEQ ID NO: 1372861 - protein, 9 aa, Homo Sapiens
FDVALPLRG

SEQ ID NO: 1372862 - protein, 9 aa, Homo Sapiens
AGPPMREVA

SEQ ID NO: 1372863 - protein, 9 aa, Homo Sapiens
ARKAKIRVK

SEQ ID NO: 1372864 - protein, 9 aa, Homo Sapiens
PVKKRRVDM

SEQ ID NO: 1372865 - protein, 9 aa, Homo Sapiens
MFFITNDVT

SEQ ID NO: 1372866 - protein, 9 aa, Homo Sapiens
HSLSKDTIS

SEQ ID NO: 1372867 - protein, 9 aa, Homo Sapiens
QANYNLLRC

SEQ ID NO: 1372868 - protein, 9 aa, Homo Sapiens
TTNGTLPIR

SEQ ID NO: 1372869 - protein, 9 aa, Homo Sapiens
SLPRTTKAT

SEQ ID NO: 1372870 - protein, 9 aa, Homo Sapiens
LHPTSETEH

SEQ ID NO: 1372871 - protein, 9 aa, Homo Sapiens
DRYWSTTQA

SEQ ID NO: 1372872 - protein, 9 aa, Homo Sapiens
CASLAAAPP

SEQ ID NO: 1372873 - protein, 9 aa, Homo Sapiens
GNLNTNMNV

SEQ ID NO: 1372874 - protein, 9 aa, Homo Sapiens
LLHHQAHSP

SEQ ID NO: 1372875 - protein, 9 aa, Homo Sapiens
KALRTLRIG

SEQ ID NO: 1372876 - protein, 9 aa, Homo Sapiens
QNGERVEHY

SEQ ID NO: 1372877 - protein, 9 aa, Homo Sapiens
TKVLNFTTK

SEQ ID NO: 1372878 - protein, 9 aa, Homo Sapiens
RGDVHVGLG

SEQ ID NO: 1372879 - protein, 9 aa, Homo Sapiens
DDNARKKAP

SEQ ID NO: 1372880 - protein, 9 aa, Homo Sapiens
YCLPLGLHL

SEQ ID NO: 1372881 - protein, 9 aa, Homo Sapiens
ADCVVGSSQ

SEQ ID NO: 1372882 - protein, 9 aa, Homo Sapiens
LLMAQRRHK

SEQ ID NO: 1372883 - protein, 9 aa, Homo Sapiens
QEVRMPVLF

SEQ ID NO: 1372884 - protein, 9 aa, Homo Sapiens
APTSRTPWG

SEQ ID NO: 1372885 - protein, 9 aa, Homo Sapiens
ERHLEAEGA

SEQ ID NO: 1372886 - protein, 9 aa, Homo Sapiens
KTGGSGEAH

SEQ ID NO: 1372887 - protein, 9 aa, Homo Sapiens
TCPCPSSWC

SEQ ID NO: 1372888 - protein, 9 aa, Homo Sapiens
PGLLVNVLP

SEQ ID NO: 1372889 - protein, 9 aa, Homo Sapiens
KAKIKKKTG

SEQ ID NO: 1372890 - protein, 9 aa, Homo Sapiens
WEESLQACV

SEQ ID NO: 1372891 - protein, 9 aa, Homo Sapiens
WSLQQQRER

SEQ ID NO: 1372892 - protein, 9 aa, Homo Sapiens
GSLSAMHFL

SEQ ID NO: 1372893 - protein, 9 aa, Homo Sapiens
TDAADPRVA

SEQ ID NO: 1372894 - protein, 9 aa, Homo Sapiens
HTPTRSHTA

SEQ ID NO: 1372895 - protein, 9 aa, Homo Sapiens
AFKPLAQVP

SEQ ID NO: 1372896 - protein, 9 aa, Homo Sapiens
RLAKSPGWK

SEQ ID NO: 1372897 - protein, 9 aa, Homo Sapiens
YMAVGTSQK

SEQ ID NO: 1372898 - protein, 9 aa, Homo Sapiens
PRSVRYILK

SEQ ID NO: 1372899 - protein, 9 aa, Homo Sapiens
AQKSQRKRQ

SEQ ID NO: 1372900 - protein, 9 aa, Homo Sapiens
KNHCRNPDG

SEQ ID NO: 1372901 - protein, 9 aa, Homo Sapiens
ILTEQRMIF

SEQ ID NO: 1372902 - protein, 9 aa, Homo Sapiens
PEPGVEEPG

SEQ ID NO: 1372903 - protein, 9 aa, Homo Sapiens
VRHRSLHRH

SEQ ID NO: 1372904 - protein, 9 aa, Homo Sapiens
SSSNSNSNS

SEQ ID NO: 1372905 - protein, 9 aa, Homo Sapiens
STEMGARGT

SEQ ID NO: 1372906 - protein, 9 aa, Homo Sapiens
EPCAVVQYK

SEQ ID NO: 1372907 - protein, 9 aa, Homo Sapiens
RLLLQQGAV

SEQ ID NO: 1372908 - protein, 9 aa, Homo Sapiens
TQLKNLSEA

SEQ ID NO: 1372909 - protein, 9 aa, Homo Sapiens
VVPRDELKP

SEQ ID NO: 1372910 - protein, 9 aa, Homo Sapiens
GQPESHHGS

SEQ ID NO: 1372911 - protein, 9 aa, Homo Sapiens
ILGYGAGAI

SEQ ID NO: 1372912 - protein, 9 aa, Homo Sapiens
LEWKRWLQK

SEQ ID NO: 1372913 - protein, 9 aa, Homo Sapiens
SNLWGDTGR

SEQ ID NO: 1372914 - protein, 9 aa, Homo Sapiens
AGEHLCDAP

SEQ ID NO: 1372915 - protein, 9 aa, Homo Sapiens
SPNAANTVL

SEQ ID NO: 1372916 - protein, 9 aa, Homo Sapiens
SQAGGEVKS

SEQ ID NO: 1372917 - protein, 9 aa, Homo Sapiens
SVVGNHPMH

SEQ ID NO: 1372918 - protein, 9 aa, Homo Sapiens
PLRGGTGVW

SEQ ID NO: 1372919 - protein, 9 aa, Homo Sapiens
NSTFGFRNA

SEQ ID NO: 1372920 - protein, 9 aa, Homo Sapiens
SKPRPSAHL

SEQ ID NO: 1372921 - protein, 9 aa, Homo Sapiens
SSARHVVMQ

SEQ ID NO: 1372922 - protein, 9 aa, Homo Sapiens
SIVPTSRGQ

SEQ ID NO: 1372923 - protein, 9 aa, Homo Sapiens
SEETYTMAT

SEQ ID NO: 1372924 - protein, 9 aa, Homo Sapiens
AGATAQIQR

SEQ ID NO: 1372925 - protein, 9 aa, Homo Sapiens
GQSLVVFPS

SEQ ID NO: 1372926 - protein, 9 aa, Homo Sapiens
LFHVQESGW

SEQ ID NO: 1372927 - protein, 9 aa, Homo Sapiens
RLTLGTCPT

SEQ ID NO: 1372928 - protein, 9 aa, Homo Sapiens
LLWIRGTEI

SEQ ID NO: 1372929 - protein, 9 aa, Homo Sapiens
YFFRTEKGN

SEQ ID NO: 1372930 - protein, 9 aa, Homo Sapiens
WPKDVGFVA

SEQ ID NO: 1372931 - protein, 9 aa, Homo Sapiens
SDAPLEALT

SEQ ID NO: 1372932 - protein, 9 aa, Homo Sapiens
SYYEDRHPK

SEQ ID NO: 1372933 - protein, 9 aa, Homo Sapiens
RWSRGRVSR

SEQ ID NO: 1372934 - protein, 9 aa, Homo Sapiens
NKIRKSELI

SEQ ID NO: 1372935 - protein, 9 aa, Homo Sapiens
AGQNTRPGK

SEQ ID NO: 1372936 - protein, 9 aa, Homo Sapiens
PPEAPLHPP

SEQ ID NO: 1372937 - protein, 9 aa, Homo Sapiens
REDPVGTEL

SEQ ID NO: 1372938 - protein, 9 aa, Homo Sapiens
LDMARHSAP

SEQ ID NO: 1372939 - protein, 9 aa, Homo Sapiens
TSILSYFNF

SEQ ID NO: 1372940 - protein, 9 aa, Homo Sapiens
AAGSYQVKP

SEQ ID NO: 1372941 - protein, 9 aa, Homo Sapiens
CGATVDVVM

SEQ ID NO: 1372942 - protein, 9 aa, Homo Sapiens
PDWGGAVIL

SEQ ID NO: 1372943 - protein, 9 aa, Homo Sapiens
ACRAGGPAG

SEQ ID NO: 1372944 - protein, 9 aa, Homo Sapiens
EDRYTQAWA

SEQ ID NO: 1372945 - protein, 9 aa, Homo Sapiens
NILYNDAAE

SEQ ID NO: 1372946 - protein, 9 aa, Homo Sapiens
REMEHWKTK

SEQ ID NO: 1372947 - protein, 9 aa, Homo Sapiens
HIWDVRTTK

SEQ ID NO: 1372948 - protein, 9 aa, Homo Sapiens
RHPFRRRAA

SEQ ID NO: 1372949 - protein, 9 aa, Homo Sapiens
AAGVIRRLD

SEQ ID NO: 1372950 - protein, 9 aa, Homo Sapiens
AGGAGEGAQ

SEQ ID NO: 1372951 - protein, 9 aa, Homo Sapiens
HMRGETTLW

SEQ ID NO: 1372952 - protein, 9 aa, Homo Sapiens
GFSIIEHTR

SEQ ID NO: 1372953 - protein, 9 aa, Homo Sapiens
HGPPLRVPW

SEQ ID NO: 1372954 - protein, 9 aa, Homo Sapiens
FRRRAAGGC

SEQ ID NO: 1372955 - protein, 9 aa, Homo Sapiens
LLICGGVCS

SEQ ID NO: 1372956 - protein, 9 aa, Homo Sapiens
MLWQAFRRF

SEQ ID NO: 1372957 - protein, 9 aa, Homo Sapiens
VIHHALSRL

SEQ ID NO: 1372958 - protein, 9 aa, Homo Sapiens
NSFADCGCM

SEQ ID NO: 1372959 - protein, 9 aa, Homo Sapiens
TVAQCKTCA

SEQ ID NO: 1372960 - protein, 9 aa, Homo Sapiens
VGSVGGLQW

SEQ ID NO: 1372961 - protein, 9 aa, Homo Sapiens
ASLRPRSVV

SEQ ID NO: 1372962 - protein, 9 aa, Homo Sapiens
VENFKDGYE

SEQ ID NO: 1372963 - protein, 9 aa, Homo Sapiens
LDSPTSTAQ

SEQ ID NO: 1372964 - protein, 9 aa, Homo Sapiens
DTIAKRRVE

SEQ ID NO: 1372965 - protein, 9 aa, Homo Sapiens
EESNMDIYL

SEQ ID NO: 1372966 - protein, 9 aa, Homo Sapiens
TMAGPSASL

SEQ ID NO: 1372967 - protein, 9 aa, Homo Sapiens
LCQILGEAM

SEQ ID NO: 1372968 - protein, 9 aa, Homo Sapiens
PRFLQRSPI

SEQ ID NO: 1372969 - protein, 9 aa, Homo Sapiens
MTRCCSPCC

SEQ ID NO: 1372970 - protein, 9 aa, Homo Sapiens
KLMSLFVKD

SEQ ID NO: 1372971 - protein, 9 aa, Homo Sapiens
VRIGSSSAS

SEQ ID NO: 1372972 - protein, 9 aa, Homo Sapiens
SRREGGGTN

SEQ ID NO: 1372973 - protein, 9 aa, Homo Sapiens
MHMTVSKPE

SEQ ID NO: 1372974 - protein, 9 aa, Homo Sapiens
SCGGNLLQV

SEQ ID NO: 1372975 - protein, 9 aa, Homo Sapiens
DTHPFFNDL

SEQ ID NO: 1372976 - protein, 9 aa, Homo Sapiens
VIQWAPYRQ

SEQ ID NO: 1372977 - protein, 9 aa, Homo Sapiens
SCCIPDPMG

SEQ ID NO: 1372978 - protein, 9 aa, Homo Sapiens
GPLDKARKA

SEQ ID NO: 1372979 - protein, 9 aa, Homo Sapiens
PSPAKEGHQ

SEQ ID NO: 1372980 - protein, 9 aa, Homo Sapiens
GGGVARVEV

SEQ ID NO: 1372981 - protein, 9 aa, Homo Sapiens
NCTPGHTPF

SEQ ID NO: 1372982 - protein, 9 aa, Homo Sapiens
GLTASRGHV

SEQ ID NO: 1372983 - protein, 9 aa, Homo Sapiens
MNVLPYLSA

SEQ ID NO: 1372984 - protein, 9 aa, Homo Sapiens
AVSGGSRVS

SEQ ID NO: 1372985 - protein, 9 aa, Homo Sapiens
CSPNAANTV

SEQ ID NO: 1372986 - protein, 9 aa, Homo Sapiens
HQRGRGGVA

SEQ ID NO: 1372987 - protein, 9 aa, Homo Sapiens
AFDSEGNYI

SEQ ID NO: 1372988 - protein, 9 aa, Homo Sapiens
LFDVALPLR

SEQ ID NO: 1372989 - protein, 9 aa, Homo Sapiens
HGSSPGFSH

SEQ ID NO: 1372990 - protein, 9 aa, Homo Sapiens
CELPAVVKL

SEQ ID NO: 1372991 - protein, 9 aa, Homo Sapiens
QEADGVDGH

SEQ ID NO: 1372992 - protein, 9 aa, Homo Sapiens
RVEKIFKYG

SEQ ID NO: 1372993 - protein, 9 aa, Homo Sapiens
CNGEMFFIT

SEQ ID NO: 1372994 - protein, 9 aa, Homo Sapiens
DVGRDGQGH

SEQ ID NO: 1372995 - protein, 9 aa, Homo Sapiens
NEAGYTKRL

SEQ ID NO: 1372996 - protein, 9 aa, Homo Sapiens
NIKSDSALQ

SEQ ID NO: 1372997 - protein, 9 aa, Homo Sapiens
TRLHFESDG

SEQ ID NO: 1372998 - protein, 9 aa, Homo Sapiens
ELQHRGREL

SEQ ID NO: 1372999 - protein, 9 aa, Homo Sapiens
FRKDPLQLL

SEQ ID NO: 1373000 - protein, 9 aa, Homo Sapiens
LPSKLNQWC

SEQ ID NO: 1373001 - protein, 9 aa, Homo Sapiens
CPCWASPSS

SEQ ID NO: 1373002 - protein, 9 aa, Homo Sapiens
PADTAATVE

SEQ ID NO: 1373003 - protein, 9 aa, Homo Sapiens
PDLQRRRKE

SEQ ID NO: 1373004 - protein, 9 aa, Homo Sapiens
NSTLEPVVA

SEQ ID NO: 1373005 - protein, 9 aa, Homo Sapiens
MPSRALFMV

SEQ ID NO: 1373006 - protein, 9 aa, Homo Sapiens
VHLAHIGSG

SEQ ID NO: 1373007 - protein, 9 aa, Homo Sapiens
SFSISAPLH

SEQ ID NO: 1373008 - protein, 9 aa, Homo Sapiens
KARKAKIRV

SEQ ID NO: 1373009 - protein, 9 aa, Homo Sapiens
VRLSDSRIA

SEQ ID NO: 1373010 - protein, 9 aa, Homo Sapiens
RDVLQKAQF

SEQ ID NO: 1373011 - protein, 9 aa, Homo Sapiens
SNGRPAIHR

SEQ ID NO: 1373012 - protein, 9 aa, Homo Sapiens
SVVTSLIKQ

SEQ ID NO: 1373013 - protein, 9 aa, Homo Sapiens
LLQRGNLHG

SEQ ID NO: 1373014 - protein, 9 aa, Homo Sapiens
SPGHPGSCP

SEQ ID NO: 1373015 - protein, 9 aa, Homo Sapiens
PGGKGAGNE

SEQ ID NO: 1373016 - protein, 9 aa, Homo Sapiens
PYLSAVEFH

SEQ ID NO: 1373017 - protein, 9 aa, Homo Sapiens
LENQWETPQ

SEQ ID NO: 1373018 - protein, 9 aa, Homo Sapiens
METTCTVLR

SEQ ID NO: 1373019 - protein, 9 aa, Homo Sapiens
KEGVKTNFI

SEQ ID NO: 1373020 - protein, 9 aa, Homo Sapiens
GKWYHNDVG

SEQ ID NO: 1373021 - protein, 9 aa, Homo Sapiens
LRGGTGVWL

SEQ ID NO: 1373022 - protein, 9 aa, Homo Sapiens
HKVIRGRCL

SEQ ID NO: 1373023 - protein, 9 aa, Homo Sapiens
DDCRDYDSP

SEQ ID NO: 1373024 - protein, 9 aa, Homo Sapiens
SVCKRAGGP

SEQ ID NO: 1373025 - protein, 9 aa, Homo Sapiens
QILEVSFNP

SEQ ID NO: 1373026 - protein, 9 aa, Homo Sapiens
NLVKCKSCP

SEQ ID NO: 1373027 - protein, 9 aa, Homo Sapiens
EKVFCQEDF

SEQ ID NO: 1373028 - protein, 9 aa, Homo Sapiens
IKRRHVSSD

SEQ ID NO: 1373029 - protein, 9 aa, Homo Sapiens
GAEMDRAPR

SEQ ID NO: 1373030 - protein, 9 aa, Homo Sapiens
FSTTTLSWG

SEQ ID NO: 1373031 - protein, 9 aa, Homo Sapiens
SECLHEDLH

SEQ ID NO: 1373032 - protein, 9 aa, Homo Sapiens
RKIDRLSTT

SEQ ID NO: 1373033 - protein, 9 aa, Homo Sapiens
ALCQIADST

SEQ ID NO: 1373034 - protein, 9 aa, Homo Sapiens
RRHRALSQA

SEQ ID NO: 1373035 - protein, 9 aa, Homo Sapiens
QIQRPIQVQ

SEQ ID NO: 1373036 - protein, 9 aa, Homo Sapiens
PFFQNSTFG

SEQ ID NO: 1373037 - protein, 9 aa, Homo Sapiens
VYGSTFSFF

SEQ ID NO: 1373038 - protein, 9 aa, Homo Sapiens
VVRQGAPIF

SEQ ID NO: 1373039 - protein, 9 aa, Homo Sapiens
TASRGHVHE

SEQ ID NO: 1373040 - protein, 9 aa, Homo Sapiens
AFKAACETF

SEQ ID NO: 1373041 - protein, 9 aa, Homo Sapiens
GKEQHPAAE

SEQ ID NO: 1373042 - protein, 9 aa, Homo Sapiens
LSLLIAADT

SEQ ID NO: 1373043 - protein, 9 aa, Homo Sapiens
DPTVGNNKT

SEQ ID NO: 1373044 - protein, 9 aa, Homo Sapiens
VTGDQSSPI

SEQ ID NO: 1373045 - protein, 9 aa, Homo Sapiens
CSGRSSTAW

SEQ ID NO: 1373046 - protein, 9 aa, Homo Sapiens
SETMCDVTV

SEQ ID NO: 1373047 - protein, 9 aa, Homo Sapiens
AHPVAEAGG

SEQ ID NO: 1373048 - protein, 9 aa, Homo Sapiens
VLVNESKTI

SEQ ID NO: 1373049 - protein, 9 aa, Homo Sapiens
NNKKKPFLG

SEQ ID NO: 1373050 - protein, 9 aa, Homo Sapiens
RPPAAAAPS

SEQ ID NO: 1373051 - protein, 9 aa, Homo Sapiens
PGQAFEYIL

SEQ ID NO: 1373052 - protein, 9 aa, Homo Sapiens
SPPQPGLPH

SEQ ID NO: 1373053 - protein, 9 aa, Homo Sapiens
DTAIDATPS

SEQ ID NO: 1373054 - protein, 9 aa, Homo Sapiens
TRPSSDRLK

SEQ ID NO: 1373055 - protein, 9 aa, Homo Sapiens
SVRLPQRID

SEQ ID NO: 1373056 - protein, 9 aa, Homo Sapiens
QKVSEETYT

SEQ ID NO: 1373057 - protein, 9 aa, Homo Sapiens
ASPHWFYCK

SEQ ID NO: 1373058 - protein, 9 aa, Homo Sapiens
GMAPVGPVQ

SEQ ID NO: 1373059 - protein, 9 aa, Homo Sapiens
KYFDKAVTL

SEQ ID NO: 1373060 - protein, 9 aa, Homo Sapiens
VITVAVMNE

SEQ ID NO: 1373061 - protein, 9 aa, Homo Sapiens
PRDLGTVAG

SEQ ID NO: 1373062 - protein, 9 aa, Homo Sapiens
VLCASEFVC

SEQ ID NO: 1373063 - protein, 9 aa, Homo Sapiens
QEADAISLD

SEQ ID NO: 1373064 - protein, 9 aa, Homo Sapiens
DVVPRDELK

SEQ ID NO: 1373065 - protein, 9 aa, Homo Sapiens
CQLCKSLDH

SEQ ID NO: 1373066 - protein, 9 aa, Homo Sapiens
ALVGASEAR

SEQ ID NO: 1373067 - protein, 9 aa, Homo Sapiens
LDKFSPSSP

SEQ ID NO: 1373068 - protein, 9 aa, Homo Sapiens
YRDCQAAGT

SEQ ID NO: 1373069 - protein, 9 aa, Homo Sapiens
ALPTDLDVA

SEQ ID NO: 1373070 - protein, 9 aa, Homo Sapiens
SWPLCCCNR

SEQ ID NO: 1373071 - protein, 9 aa, Homo Sapiens
VDSLSIHHS

SEQ ID NO: 1373072 - protein, 9 aa, Homo Sapiens
HPTSETEYQ

SEQ ID NO: 1373073 - protein, 9 aa, Homo Sapiens
RKTNNPRFD

SEQ ID NO: 1373074 - protein, 9 aa, Homo Sapiens
ECSGAISLQ

SEQ ID NO: 1373075 - protein, 9 aa, Homo Sapiens
LLRWSRGRV

SEQ ID NO: 1373076 - protein, 9 aa, Homo Sapiens
SKTKLKNYL

SEQ ID NO: 1373077 - protein, 9 aa, Homo Sapiens
DLMSSKDDM

SEQ ID NO: 1373078 - protein, 9 aa, Homo Sapiens
QNSFADCGC

SEQ ID NO: 1373079 - protein, 9 aa, Homo Sapiens
GVVTAGKVC

SEQ ID NO: 1373080 - protein, 9 aa, Homo Sapiens
AYSQILLEL

SEQ ID NO: 1373081 - protein, 9 aa, Homo Sapiens
DSPTSTAQT

SEQ ID NO: 1373082 - protein, 9 aa, Homo Sapiens
QPPAKKQRK

SEQ ID NO: 1373083 - protein, 9 aa, Homo Sapiens
PMYFFLATL

SEQ ID NO: 1373084 - protein, 9 aa, Homo Sapiens
SLESSKENL

SEQ ID NO: 1373085 - protein, 9 aa, Homo Sapiens
RGTAATGRA

SEQ ID NO: 1373086 - protein, 9 aa, Homo Sapiens
WETPQRIYR

SEQ ID NO: 1373087 - protein, 9 aa, Homo Sapiens
LQPTRSYEI

SEQ ID NO: 1373088 - protein, 9 aa, Homo Sapiens
VKAPPGLHP

SEQ ID NO: 1373089 - protein, 9 aa, Homo Sapiens
FRSTRATSQ

SEQ ID NO: 1373090 - protein, 9 aa, Homo Sapiens
NSVSKNPVC

SEQ ID NO: 1373091 - protein, 9 aa, Homo Sapiens
LAPSLVTAE

SEQ ID NO: 1373092 - protein, 9 aa, Homo Sapiens
VVRQGASIF

SEQ ID NO: 1373093 - protein, 9 aa, Homo Sapiens
VSRAACRPT

SEQ ID NO: 1373094 - protein, 9 aa, Homo Sapiens
EFIDLRFCH

SEQ ID NO: 1373095 - protein, 9 aa, Homo Sapiens
PAMAEVSTP

SEQ ID NO: 1373096 - protein, 9 aa, Homo Sapiens
LPHIIKKQK

SEQ ID NO: 1373097 - protein, 9 aa, Homo Sapiens
DIYCTFNFA

SEQ ID NO: 1373098 - protein, 9 aa, Homo Sapiens
GQGLVGMTP

SEQ ID NO: 1373099 - protein, 9 aa, Homo Sapiens
YRIQSYRDC

SEQ ID NO: 1373100 - protein, 9 aa, Homo Sapiens
LAHIGSGEM

SEQ ID NO: 1373101 - protein, 9 aa, Homo Sapiens
VGTELIYRQ

SEQ ID NO: 1373102 - protein, 9 aa, Homo Sapiens
LMFTLHFVR

SEQ ID NO: 1373103 - protein, 9 aa, Homo Sapiens
AAPSPEKRL

SEQ ID NO: 1373104 - protein, 9 aa, Homo Sapiens
RVVGHMPGE

SEQ ID NO: 1373105 - protein, 9 aa, Homo Sapiens
DNWLAARIA

SEQ ID NO: 1373106 - protein, 9 aa, Homo Sapiens
YMLDKFSPS

SEQ ID NO: 1373107 - protein, 9 aa, Homo Sapiens
GAMEELCAE

SEQ ID NO: 1373108 - protein, 9 aa, Homo Sapiens
SLGNNHLSQ

SEQ ID NO: 1373109 - protein, 9 aa, Homo Sapiens
PSGICLSDE

SEQ ID NO: 1373110 - protein, 9 aa, Homo Sapiens
VYRADKCAV

SEQ ID NO: 1373111 - protein, 9 aa, Homo Sapiens
IVSVLSPRR

SEQ ID NO: 1373112 - protein, 9 aa, Homo Sapiens
DVIAPRRAA

SEQ ID NO: 1373113 - protein, 9 aa, Homo Sapiens
GQIHHLKQH

SEQ ID NO: 1373114 - protein, 9 aa, Homo Sapiens
VWLCLVGTE

SEQ ID NO: 1373115 - protein, 9 aa, Homo Sapiens
WGVCFMWNT

SEQ ID NO: 1373116 - protein, 9 aa, Homo Sapiens
CLYYLGMPY

SEQ ID NO: 1373117 - protein, 9 aa, Homo Sapiens
ENQEYLQSK

SEQ ID NO: 1373118 - protein, 9 aa, Homo Sapiens
LFKSARMPA

SEQ ID NO: 1373119 - protein, 9 aa, Homo Sapiens
DGIHPLSSL

SEQ ID NO: 1373120 - protein, 9 aa, Homo Sapiens
MQKVDQYLY

SEQ ID NO: 1373121 - protein, 9 aa, Homo Sapiens
AMRLGIGLL

SEQ ID NO: 1373122 - protein, 9 aa, Homo Sapiens
LAGVLLVMH

SEQ ID NO: 1373123 - protein, 9 aa, Homo Sapiens
AHPCDSSLP

SEQ ID NO: 1373124 - protein, 9 aa, Homo Sapiens
GCVAELGGH

SEQ ID NO: 1373125 - protein, 9 aa, Homo Sapiens
MKGCPHWPA

SEQ ID NO: 1373126 - protein, 9 aa, Homo Sapiens
RLDTDGIHP

SEQ ID NO: 1373127 - protein, 9 aa, Homo Sapiens
LPASRTTAL

SEQ ID NO: 1373128 - protein, 9 aa, Homo Sapiens
PQPALRGHS

SEQ ID NO: 1373129 - protein, 9 aa, Homo Sapiens
SKVPPLVGS

SEQ ID NO: 1373130 - protein, 9 aa, Homo Sapiens
PNLQALRAR

SEQ ID NO: 1373131 - protein, 9 aa, Homo Sapiens
NLVALPFPH

SEQ ID NO: 1373132 - protein, 9 aa, Homo Sapiens
RLHLVATPG

SEQ ID NO: 1373133 - protein, 9 aa, Homo Sapiens
IIGEKSLRR

SEQ ID NO: 1373134 - protein, 9 aa, Homo Sapiens
HFHLFDENN

SEQ ID NO: 1373135 - protein, 9 aa, Homo Sapiens
QCTAQDGGP

SEQ ID NO: 1373136 - protein, 9 aa, Homo Sapiens
GMTPRDLGT

SEQ ID NO: 1373137 - protein, 9 aa, Homo Sapiens
PCWASPSSA

SEQ ID NO: 1373138 - protein, 9 aa, Homo Sapiens
PTSTNTVSV

SEQ ID NO: 1373139 - protein, 9 aa, Homo Sapiens
WTNSAICNK

SEQ ID NO: 1373140 - protein, 9 aa, Homo Sapiens
PWLRKNYLI

SEQ ID NO: 1373141 - protein, 9 aa, Homo Sapiens
STVKQAVRR

SEQ ID NO: 1373142 - protein, 9 aa, Homo Sapiens
GVVVCNCFG

SEQ ID NO: 1373143 - protein, 9 aa, Homo Sapiens
AIGSLICGL

SEQ ID NO: 1373144 - protein, 9 aa, Homo Sapiens
DAHPESPGH

SEQ ID NO: 1373145 - protein, 9 aa, Homo Sapiens
LQEREATIT

SEQ ID NO: 1373146 - protein, 9 aa, Homo Sapiens
PMTGFYVGW

SEQ ID NO: 1373147 - protein, 9 aa, Homo Sapiens
MPTTPVQAW

SEQ ID NO: 1373148 - protein, 9 aa, Homo Sapiens
LHSDSFPME

SEQ ID NO: 1373149 - protein, 9 aa, Homo Sapiens
ANGPSHSLG

SEQ ID NO: 1373150 - protein, 9 aa, Homo Sapiens
RLHDLYDKF

SEQ ID NO: 1373151 - protein, 9 aa, Homo Sapiens
APLEALTGQ

SEQ ID NO: 1373152 - protein, 9 aa, Homo Sapiens
PTPFPETQP

SEQ ID NO: 1373153 - protein, 9 aa, Homo Sapiens
EQRQEEEAR

SEQ ID NO: 1373154 - protein, 9 aa, Homo Sapiens
NPSVTWLKD

SEQ ID NO: 1373155 - protein, 9 aa, Homo Sapiens
LRNGSRKCP

SEQ ID NO: 1373156 - protein, 9 aa, Homo Sapiens
QQVEWRMSR

SEQ ID NO: 1373157 - protein, 9 aa, Homo Sapiens
TLPTPFPET

SEQ ID NO: 1373158 - protein, 9 aa, Homo Sapiens
SKDDMGKNV

SEQ ID NO: 1373159 - protein, 9 aa, Homo Sapiens
SETLAADPM

SEQ ID NO: 1373160 - protein, 9 aa, Homo Sapiens
KTIACYGGQ

SEQ ID NO: 1373161 - protein, 9 aa, Homo Sapiens
ALRCDTRLH

SEQ ID NO: 1373162 - protein, 9 aa, Homo Sapiens
ASRTTALLR

SEQ ID NO: 1373163 - protein, 9 aa, Homo Sapiens
NKTEVERAF

SEQ ID NO: 1373164 - protein, 9 aa, Homo Sapiens
KRRHVSSDE

SEQ ID NO: 1373165 - protein, 9 aa, Homo Sapiens
GCWWGQLSL

SEQ ID NO: 1373166 - protein, 9 aa, Homo Sapiens
TGNNNWVPD

SEQ ID NO: 1373167 - protein, 9 aa, Homo Sapiens
HKEAAHLLN

SEQ ID NO: 1373168 - protein, 9 aa, Homo Sapiens
ESMHKEKRV

SEQ ID NO: 1373169 - protein, 9 aa, Homo Sapiens
ELNHDQMQK

SEQ ID NO: 1373170 - protein, 9 aa, Homo Sapiens
QGPCPPPVT

SEQ ID NO: 1373171 - protein, 9 aa, Homo Sapiens
GQYRATLIN

SEQ ID NO: 1373172 - protein, 9 aa, Homo Sapiens
IGLCFRHLD

SEQ ID NO: 1373173 - protein, 9 aa, Homo Sapiens
EYDSIIVIY

SEQ ID NO: 1373174 - protein, 9 aa, Homo Sapiens
LTHLAPKCR

SEQ ID NO: 1373175 - protein, 9 aa, Homo Sapiens
LGRSQGLPA

SEQ ID NO: 1373176 - protein, 9 aa, Homo Sapiens
PAAEDRTSL

SEQ ID NO: 1373177 - protein, 9 aa, Homo Sapiens
HENQTHTLE

SEQ ID NO: 1373178 - protein, 9 aa, Homo Sapiens
YKLTFVLGE

SEQ ID NO: 1373179 - protein, 9 aa, Homo Sapiens
MGFKTQEYP

SEQ ID NO: 1373180 - protein, 9 aa, Homo Sapiens
PLERSRPHA

SEQ ID NO: 1373181 - protein, 9 aa, Homo Sapiens
GDKKKKKKK

SEQ ID NO: 1373182 - protein, 9 aa, Homo Sapiens
SSQLIPEEC

SEQ ID NO: 1373183 - protein, 9 aa, Homo Sapiens
ATLCLQSHR

SEQ ID NO: 1373184 - protein, 9 aa, Homo Sapiens
LPPALGTEL

SEQ ID NO: 1373185 - protein, 9 aa, Homo Sapiens
VVSSDLVPQ

SEQ ID NO: 1373186 - protein, 9 aa, Homo Sapiens
YSPKRPPKE

SEQ ID NO: 1373187 - protein, 9 aa, Homo Sapiens
MWGLDKASY

SEQ ID NO: 1373188 - protein, 9 aa, Homo Sapiens
STSFFPHCS

SEQ ID NO: 1373189 - protein, 9 aa, Homo Sapiens
KKAIMVGFW

SEQ ID NO: 1373190 - protein, 9 aa, Homo Sapiens
QFDKKMSGG

SEQ ID NO: 1373191 - protein, 9 aa, Homo Sapiens
PRGGNAPLG

SEQ ID NO: 1373192 - protein, 9 aa, Homo Sapiens
SRGAVKFGR

SEQ ID NO: 1373193 - protein, 9 aa, Homo Sapiens
DLLGPAGRP

SEQ ID NO: 1373194 - protein, 9 aa, Homo Sapiens
PMGVTWFKI

SEQ ID NO: 1373195 - protein, 9 aa, Homo Sapiens
LRPNPDGVE

SEQ ID NO: 1373196 - protein, 9 aa, Homo Sapiens
GDAGEHLCD

SEQ ID NO: 1373197 - protein, 9 aa, Homo Sapiens
ANGIPNPSV

SEQ ID NO: 1373198 - protein, 9 aa, Homo Sapiens
THNVSVWRE

SEQ ID NO: 1373199 - protein, 9 aa, Homo Sapiens
CVYVVNIAE

SEQ ID NO: 1373200 - protein, 9 aa, Homo Sapiens
SMSNTSVFL

SEQ ID NO: 1373201 - protein, 9 aa, Homo Sapiens
DGTPRLCQT

SEQ ID NO: 1373202 - protein, 9 aa, Homo Sapiens
TNSDRGDVR

SEQ ID NO: 1373203 - protein, 9 aa, Homo Sapiens
LTLGTCPTK

SEQ ID NO: 1373204 - protein, 9 aa, Homo Sapiens
VECITSSIH

SEQ ID NO: 1373205 - protein, 9 aa, Homo Sapiens
LRRRPRPPQ

SEQ ID NO: 1373206 - protein, 9 aa, Homo Sapiens
HAAEIKNVL

SEQ ID NO: 1373207 - protein, 9 aa, Homo Sapiens
APSPEKRLG

SEQ ID NO: 1373208 - protein, 9 aa, Homo Sapiens
TQQLKRSAG

SEQ ID NO: 1373209 - protein, 9 aa, Homo Sapiens
RPIRLTLGT

SEQ ID NO: 1373210 - protein, 9 aa, Homo Sapiens
KCGEVCSEL

SEQ ID NO: 1373211 - protein, 9 aa, Homo Sapiens
ERQSYKEAM

SEQ ID NO: 1373212 - protein, 9 aa, Homo Sapiens
EDNPNLLMA

SEQ ID NO: 1373213 - protein, 9 aa, Homo Sapiens
EDISHLTAC

SEQ ID NO: 1373214 - protein, 9 aa, Homo Sapiens
IPSQAVPHR

SEQ ID NO: 1373215 - protein, 9 aa, Homo Sapiens
WRHGDEGPG

SEQ ID NO: 1373216 - protein, 9 aa, Homo Sapiens
LPEDRYTQA

SEQ ID NO: 1373217 - protein, 9 aa, Homo Sapiens
GDGFSCGGN

SEQ ID NO: 1373218 - protein, 9 aa, Homo Sapiens
NSARNILVE

SEQ ID NO: 1373219 - protein, 9 aa, Homo Sapiens
IGKSYPTKV

SEQ ID NO: 1373220 - protein, 9 aa, Homo Sapiens
GARGTFLKN

SEQ ID NO: 1373221 - protein, 9 aa, Homo Sapiens
PFPRVDPSP

SEQ ID NO: 1373222 - protein, 9 aa, Homo Sapiens
QINDAHHGG

SEQ ID NO: 1373223 - protein, 9 aa, Homo Sapiens
QFSLEEKYT

SEQ ID NO: 1373224 - protein, 9 aa, Homo Sapiens
EPEAETNQD

SEQ ID NO: 1373225 - protein, 9 aa, Homo Sapiens
KYHALYISV

SEQ ID NO: 1373226 - protein, 9 aa, Homo Sapiens
SSNFLLASV

SEQ ID NO: 1373227 - protein, 9 aa, Homo Sapiens
NAEVHQTSG

SEQ ID NO: 1373228 - protein, 9 aa, Homo Sapiens
QCGYSEVYL

SEQ ID NO: 1373229 - protein, 9 aa, Homo Sapiens
RPGAHSPRA

SEQ ID NO: 1373230 - protein, 9 aa, Homo Sapiens
PKMHHICFF

SEQ ID NO: 1373231 - protein, 9 aa, Homo Sapiens
EYFKITIYG

SEQ ID NO: 1373232 - protein, 9 aa, Homo Sapiens
VCTFLQLAI

SEQ ID NO: 1373233 - protein, 9 aa, Homo Sapiens
SLYEPASPH

SEQ ID NO: 1373234 - protein, 9 aa, Homo Sapiens
CAANGNPDP

SEQ ID NO: 1373235 - protein, 9 aa, Homo Sapiens
LPSPPGPHS

SEQ ID NO: 1373236 - protein, 9 aa, Homo Sapiens
ALLPPRATR

SEQ ID NO: 1373237 - protein, 9 aa, Homo Sapiens
IKCDPDRLR

SEQ ID NO: 1373238 - protein, 9 aa, Homo Sapiens
QTSGDELVA

SEQ ID NO: 1373239 - protein, 9 aa, Homo Sapiens
PQQPQVPLS

SEQ ID NO: 1373240 - protein, 9 aa, Homo Sapiens
YGFGSTVAC

SEQ ID NO: 1373241 - protein, 9 aa, Homo Sapiens
CLLSAPTTV

SEQ ID NO: 1373242 - protein, 9 aa, Homo Sapiens
PVAEAGGAG

SEQ ID NO: 1373243 - protein, 9 aa, Homo Sapiens
TSLPLTFTD

SEQ ID NO: 1373244 - protein, 9 aa, Homo Sapiens
PPFRKVGSF

SEQ ID NO: 1373245 - protein, 9 aa, Homo Sapiens
LVVTGDQSS

SEQ ID NO: 1373246 - protein, 9 aa, Homo Sapiens
QLGQRSLWE

SEQ ID NO: 1373247 - protein, 9 aa, Homo Sapiens
LCSQRRLRH

SEQ ID NO: 1373248 - protein, 9 aa, Homo Sapiens
LKSVFPPDE

SEQ ID NO: 1373249 - protein, 9 aa, Homo Sapiens
HAHPPGPGP

SEQ ID NO: 1373250 - protein, 9 aa, Homo Sapiens
QRKPKRANC

SEQ ID NO: 1373251 - protein, 9 aa, Homo Sapiens
TNDSPPVFS

SEQ ID NO: 1373252 - protein, 9 aa, Homo Sapiens
TQVQPKLQR

SEQ ID NO: 1373253 - protein, 9 aa, Homo Sapiens
FTLLLSWET

SEQ ID NO: 1373254 - protein, 9 aa, Homo Sapiens
SLKILQIRG

SEQ ID NO: 1373255 - protein, 9 aa, Homo Sapiens
HLFSYPSSQ

SEQ ID NO: 1373256 - protein, 9 aa, Homo Sapiens
CIPAYHPEF

SEQ ID NO: 1373257 - protein, 9 aa, Homo Sapiens
NRTMQLVVL

SEQ ID NO: 1373258 - protein, 9 aa, Homo Sapiens
GIAVFCIMD

SEQ ID NO: 1373259 - protein, 9 aa, Homo Sapiens
HNSISRESA

SEQ ID NO: 1373260 - protein, 9 aa, Homo Sapiens
FCPEVTRKQ

SEQ ID NO: 1373261 - protein, 9 aa, Homo Sapiens
RVDPSPQDQ

SEQ ID NO: 1373262 - protein, 9 aa, Homo Sapiens
SQTIMPCPM

SEQ ID NO: 1373263 - protein, 9 aa, Homo Sapiens
CLHSQLPHP

SEQ ID NO: 1373264 - protein, 9 aa, Homo Sapiens
QRFRKSKKK

SEQ ID NO: 1373265 - protein, 9 aa, Homo Sapiens
RRCRNGFVG

SEQ ID NO: 1373266 - protein, 9 aa, Homo Sapiens
PTRGDVHSQ

SEQ ID NO: 1373267 - protein, 9 aa, Homo Sapiens
FINPGLLVN

SEQ ID NO: 1373268 - protein, 9 aa, Homo Sapiens
QSPSENDTH

SEQ ID NO: 1373269 - protein, 9 aa, Homo Sapiens
TVRTACRYD

SEQ ID NO: 1373270 - protein, 9 aa, Homo Sapiens
TSVSALSGP

SEQ ID NO: 1373271 - protein, 9 aa, Homo Sapiens
QHATQKEVS

SEQ ID NO: 1373272 - protein, 9 aa, Homo Sapiens
VLAEYWATL

SEQ ID NO: 1373273 - protein, 9 aa, Homo Sapiens
EKKTEAAAH

SEQ ID NO: 1373274 - protein, 9 aa, Homo Sapiens
DDTHNVSVW

SEQ ID NO: 1373275 - protein, 9 aa, Homo Sapiens
RLRNSPVRD

SEQ ID NO: 1373276 - protein, 9 aa, Homo Sapiens
GVRRNGERV

SEQ ID NO: 1373277 - protein, 9 aa, Homo Sapiens
KSWPLCCCN

SEQ ID NO: 1373278 - protein, 9 aa, Homo Sapiens
DGLFWMLTR

SEQ ID NO: 1373279 - protein, 9 aa, Homo Sapiens
LNTTQLPCL

SEQ ID NO: 1373280 - protein, 9 aa, Homo Sapiens
QEFSQQAIS

SEQ ID NO: 1373281 - protein, 9 aa, Homo Sapiens
VESASSMEQ

SEQ ID NO: 1373282 - protein, 9 aa, Homo Sapiens
ADESGLWVI

SEQ ID NO: 1373283 - protein, 9 aa, Homo Sapiens
LAASWLVCL

SEQ ID NO: 1373284 - protein, 9 aa, Homo Sapiens
RASQTEHIQ

SEQ ID NO: 1373285 - protein, 9 aa, Homo Sapiens
VGMTPRDLG

SEQ ID NO: 1373286 - protein, 9 aa, Homo Sapiens
ASRRASWPR

SEQ ID NO: 1373287 - protein, 9 aa, Homo Sapiens
DLDVAGPTW

SEQ ID NO: 1373288 - protein, 9 aa, Homo Sapiens
CTVLRNIDN

SEQ ID NO: 1373289 - protein, 9 aa, Homo Sapiens
RLSLVVTGD

SEQ ID NO: 1373290 - protein, 9 aa, Homo Sapiens
RLTADVHHY

SEQ ID NO: 1373291 - protein, 9 aa, Homo Sapiens
LSGPLVLEN

SEQ ID NO: 1373292 - protein, 9 aa, Homo Sapiens
PGACGPVKE

SEQ ID NO: 1373293 - protein, 9 aa, Homo Sapiens
GPSASLHPA

SEQ ID NO: 1373294 - protein, 9 aa, Homo Sapiens
RYTSDCFIS

SEQ ID NO: 1373295 - protein, 9 aa, Homo Sapiens
RRAALHLQF

SEQ ID NO: 1373296 - protein, 9 aa, Homo Sapiens
HCIAGVGRT

SEQ ID NO: 1373297 - protein, 9 aa, Homo Sapiens
PSCFSTGIR

SEQ ID NO: 1373298 - protein, 9 aa, Homo Sapiens
GSAGGQPES

SEQ ID NO: 1373299 - protein, 9 aa, Homo Sapiens
ANQLNYGVD

SEQ ID NO: 1373300 - protein, 9 aa, Homo Sapiens
QLPCLQSAS

SEQ ID NO: 1373301 - protein, 9 aa, Homo Sapiens
DTTSMILRI

SEQ ID NO: 1373302 - protein, 9 aa, Homo Sapiens
RLQAQQSRL

SEQ ID NO: 1373303 - protein, 9 aa, Homo Sapiens
QRDSVFRLS

SEQ ID NO: 1373304 - protein, 9 aa, Homo Sapiens
AARASPAWR

SEQ ID NO: 1373305 - protein, 9 aa, Homo Sapiens
LRACRAGGP

SEQ ID NO: 1373306 - protein, 9 aa, Homo Sapiens
KVSEETYTM

SEQ ID NO: 1373307 - protein, 9 aa, Homo Sapiens
RNAFLVLDL

SEQ ID NO: 1373308 - protein, 9 aa, Homo Sapiens
SSGRNRVGR

SEQ ID NO: 1373309 - protein, 9 aa, Homo Sapiens
DALPSTSFF

SEQ ID NO: 1373310 - protein, 9 aa, Homo Sapiens
LDLQCAKLL

SEQ ID NO: 1373311 - protein, 9 aa, Homo Sapiens
SGATPLHHS

SEQ ID NO: 1373312 - protein, 9 aa, Homo Sapiens
HDVLRDGGI

SEQ ID NO: 1373313 - protein, 9 aa, Homo Sapiens
GNSEPLTAT

SEQ ID NO: 1373314 - protein, 9 aa, Homo Sapiens
GRKKVQIQR

SEQ ID NO: 1373315 - protein, 9 aa, Homo Sapiens
VGLSWTVPG

SEQ ID NO: 1373316 - protein, 9 aa, Homo Sapiens
TRVITAAAI

SEQ ID NO: 1373317 - protein, 9 aa, Homo Sapiens
HDEEANNDI

SEQ ID NO: 1373318 - protein, 9 aa, Homo Sapiens
GPLLNHIAA

SEQ ID NO: 1373319 - protein, 9 aa, Homo Sapiens
SGVCRLYVL

SEQ ID NO: 1373320 - protein, 9 aa, Homo Sapiens
DSEEYFATN

SEQ ID NO: 1373321 - protein, 9 aa, Homo Sapiens
KPRPSAHLL

SEQ ID NO: 1373322 - protein, 9 aa, Homo Sapiens
EKRLGMGVG

SEQ ID NO: 1373323 - protein, 9 aa, Homo Sapiens
QSILTRVGR

SEQ ID NO: 1373324 - protein, 9 aa, Homo Sapiens
NGRPAIHRA

SEQ ID NO: 1373325 - protein, 9 aa, Homo Sapiens
APSLPCPLP

SEQ ID NO: 1373326 - protein, 9 aa, Homo Sapiens
EAQTLQQCR

SEQ ID NO: 1373327 - protein, 9 aa, Homo Sapiens
AQCEAMFDR

SEQ ID NO: 1373328 - protein, 9 aa, Homo Sapiens
PVFLIQLLK

SEQ ID NO: 1373329 - protein, 9 aa, Homo Sapiens
VTPLRVQSV

SEQ ID NO: 1373330 - protein, 9 aa, Homo Sapiens
DPISKERQS

SEQ ID NO: 1373331 - protein, 9 aa, Homo Sapiens
LDVVVRQGA

SEQ ID NO: 1373332 - protein, 9 aa, Homo Sapiens
LELYHTAMY

SEQ ID NO: 1373333 - protein, 9 aa, Homo Sapiens
VERVTHADR

SEQ ID NO: 1373334 - protein, 9 aa, Homo Sapiens
SSGTARGGG

SEQ ID NO: 1373335 - protein, 9 aa, Homo Sapiens
STRVNNDNA

SEQ ID NO: 1373336 - protein, 9 aa, Homo Sapiens
SRPTKTRML

SEQ ID NO: 1373337 - protein, 9 aa, Homo Sapiens
PAQGQATLC

SEQ ID NO: 1373338 - protein, 9 aa, Homo Sapiens
ADSSVMMTH

SEQ ID NO: 1373339 - protein, 9 aa, Homo Sapiens
KHLFVDVGV

SEQ ID NO: 1373340 - protein, 9 aa, Homo Sapiens
YWVSLQLNL

SEQ ID NO: 1373341 - protein, 9 aa, Homo Sapiens
LDVVVRQGT

SEQ ID NO: 1373342 - protein, 9 aa, Homo Sapiens
AILRHNLNN

SEQ ID NO: 1373343 - protein, 9 aa, Homo Sapiens
LPAKALRTL

SEQ ID NO: 1373344 - protein, 9 aa, Homo Sapiens
PSRGPPPQW

SEQ ID NO: 1373345 - protein, 9 aa, Homo Sapiens
HATFVDSLS

SEQ ID NO: 1373346 - protein, 9 aa, Homo Sapiens
NSDRGDVRR

SEQ ID NO: 1373347 - protein, 9 aa, Homo Sapiens
KKVVEEEQK

SEQ ID NO: 1373348 - protein, 9 aa, Homo Sapiens
FDGTPRLCQ

SEQ ID NO: 1373349 - protein, 9 aa, Homo Sapiens
RAGGPAGWA

SEQ ID NO: 1373350 - protein, 9 aa, Homo Sapiens
INDAHHGGW

SEQ ID NO: 1373351 - protein, 9 aa, Homo Sapiens
LLLEYPKHM

SEQ ID NO: 1373352 - protein, 9 aa, Homo Sapiens
HPASGRASR

SEQ ID NO: 1373353 - protein, 9 aa, Homo Sapiens
ASEARLDTL

SEQ ID NO: 1373354 - protein, 9 aa, Homo Sapiens
TAAGRPPRM

SEQ ID NO: 1373355 - protein, 9 aa, Homo Sapiens
IPAAKPAAA

SEQ ID NO: 1373356 - protein, 9 aa, Homo Sapiens
PAHAWFECE

SEQ ID NO: 1373357 - protein, 9 aa, Homo Sapiens
LLCPKTILS

SEQ ID NO: 1373358 - protein, 9 aa, Homo Sapiens
PKIPKIETA

SEQ ID NO: 1373359 - protein, 9 aa, Homo Sapiens
SDLSFVDIC

SEQ ID NO: 1373360 - protein, 9 aa, Homo Sapiens
DHWSYSSNY

SEQ ID NO: 1373361 - protein, 9 aa, Homo Sapiens
AASSEKASA

SEQ ID NO: 1373362 - protein, 9 aa, Homo Sapiens
LEEETRHLK

SEQ ID NO: 1373363 - protein, 9 aa, Homo Sapiens
SQRLLRERK

SEQ ID NO: 1373364 - protein, 9 aa, Homo Sapiens
AWTVAQCKT

SEQ ID NO: 1373365 - protein, 9 aa, Homo Sapiens
LLEKSTQRH

SEQ ID NO: 1373366 - protein, 9 aa, Homo Sapiens
YGFYDECLC

SEQ ID NO: 1373367 - protein, 9 aa, Homo Sapiens
RMESMHKEK

SEQ ID NO: 1373368 - protein, 9 aa, Homo Sapiens
HQKVLAPDV

SEQ ID NO: 1373369 - protein, 9 aa, Homo Sapiens
EERPIRLTL

SEQ ID NO: 1373370 - protein, 9 aa, Homo Sapiens
AEAAAVVMV

SEQ ID NO: 1373371 - protein, 9 aa, Homo Sapiens
SSKENLQPE

SEQ ID NO: 1373372 - protein, 9 aa, Homo Sapiens
PPAPRRDPP

SEQ ID NO: 1373373 - protein, 9 aa, Homo Sapiens
TEHSDLEEA

SEQ ID NO: 1373374 - protein, 9 aa, Homo Sapiens
ASSGEGCPV

SEQ ID NO: 1373375 - protein, 9 aa, Homo Sapiens
VRNLAATVT

SEQ ID NO: 1373376 - protein, 9 aa, Homo Sapiens
RRPRALCSQ

SEQ ID NO: 1373377 - protein, 9 aa, Homo Sapiens
AVEEPQSRR

SEQ ID NO: 1373378 - protein, 9 aa, Homo Sapiens
VFDEALLTI

SEQ ID NO: 1373379 - protein, 9 aa, Homo Sapiens
QDAHPESPG

SEQ ID NO: 1373380 - protein, 9 aa, Homo Sapiens
SPVVSGVSQ

SEQ ID NO: 1373381 - protein, 9 aa, Homo Sapiens
GCSKYGGNL

SEQ ID NO: 1373382 - protein, 9 aa, Homo Sapiens
IDIQATNAL

SEQ ID NO: 1373383 - protein, 9 aa, Homo Sapiens
RFSSPRISV

SEQ ID NO: 1373384 - protein, 9 aa, Homo Sapiens
SSGPMGVQA

SEQ ID NO: 1373385 - protein, 9 aa, Homo Sapiens
FSSPRISVC

SEQ ID NO: 1373386 - protein, 9 aa, Homo Sapiens
KTVKPKWCN

SEQ ID NO: 1373387 - protein, 9 aa, Homo Sapiens
AAQEMVADY

SEQ ID NO: 1373388 - protein, 9 aa, Homo Sapiens
AELYEESKT

SEQ ID NO: 1373389 - protein, 9 aa, Homo Sapiens
EIKEHHPEG

SEQ ID NO: 1373390 - protein, 9 aa, Homo Sapiens
NVTERKDHR

SEQ ID NO: 1373391 - protein, 9 aa, Homo Sapiens
TVHEHFNLN

SEQ ID NO: 1373392 - protein, 9 aa, Homo Sapiens
KTNNPRFDE

SEQ ID NO: 1373393 - protein, 9 aa, Homo Sapiens
DQIRNWQHS

SEQ ID NO: 1373394 - protein, 9 aa, Homo Sapiens
TGIRELHDM

SEQ ID NO: 1373395 - protein, 9 aa, Homo Sapiens
IFQSPSEND

SEQ ID NO: 1373396 - protein, 9 aa, Homo Sapiens
SFIVSGILN

SEQ ID NO: 1373397 - protein, 9 aa, Homo Sapiens
VLDLCLDIL

SEQ ID NO: 1373398 - protein, 9 aa, Homo Sapiens
EGSVEETRE

SEQ ID NO: 1373399 - protein, 9 aa, Homo Sapiens
PKDVGFVAL

SEQ ID NO: 1373400 - protein, 9 aa, Homo Sapiens
EMCNTDSIH

SEQ ID NO: 1373401 - protein, 9 aa, Homo Sapiens
RPQEGPGRH

SEQ ID NO: 1373402 - protein, 9 aa, Homo Sapiens
RMLYHSGKP

SEQ ID NO: 1373403 - protein, 9 aa, Homo Sapiens
TRMLYHSGK

SEQ ID NO: 1373404 - protein, 9 aa, Homo Sapiens
QAQQSRLDE

SEQ ID NO: 1373405 - protein, 9 aa, Homo Sapiens
EGNYILTCS

SEQ ID NO: 1373406 - protein, 9 aa, Homo Sapiens
TKATQKREM

SEQ ID NO: 1373407 - protein, 9 aa, Homo Sapiens
RPPQPRPRR

SEQ ID NO: 1373408 - protein, 9 aa, Homo Sapiens
AGARQVGSV

SEQ ID NO: 1373409 - protein, 9 aa, Homo Sapiens
ETGGCCCWR

SEQ ID NO: 1373410 - protein, 9 aa, Homo Sapiens
RVRGEAELT

SEQ ID NO: 1373411 - protein, 9 aa, Homo Sapiens
IKIWFQNRG

SEQ ID NO: 1373412 - protein, 9 aa, Homo Sapiens
SHYRQNRSS

SEQ ID NO: 1373413 - protein, 9 aa, Homo Sapiens
FNFLFLIYL

SEQ ID NO: 1373414 - protein, 9 aa, Homo Sapiens
VPHDERIVI

SEQ ID NO: 1373415 - protein, 9 aa, Homo Sapiens
SCRWSGFCG

SEQ ID NO: 1373416 - protein, 9 aa, Homo Sapiens
DKAVTLREE

SEQ ID NO: 1373417 - protein, 9 aa, Homo Sapiens
FLIVSVLSP

SEQ ID NO: 1373418 - protein, 9 aa, Homo Sapiens
GRRSTRPAA

SEQ ID NO: 1373419 - protein, 9 aa, Homo Sapiens
GPPGPQALP

SEQ ID NO: 1373420 - protein, 9 aa, Homo Sapiens
YVGPVAILR

SEQ ID NO: 1373421 - protein, 9 aa, Homo Sapiens
QLHPVQGTK

SEQ ID NO: 1373422 - protein, 9 aa, Homo Sapiens
EVAAGPPMR

SEQ ID NO: 1373423 - protein, 9 aa, Homo Sapiens
PACTVDSSQ

SEQ ID NO: 1373424 - protein, 9 aa, Homo Sapiens
RLQDVSHNG

SEQ ID NO: 1373425 - protein, 9 aa, Homo Sapiens
MPAQTAAWR

SEQ ID NO: 1373426 - protein, 9 aa, Homo Sapiens
EQAYKYMVK

SEQ ID NO: 1373427 - protein, 9 aa, Homo Sapiens
ERVEHYSRK

SEQ ID NO: 1373428 - protein, 9 aa, Homo Sapiens
QVLQFQEEV

SEQ ID NO: 1373429 - protein, 9 aa, Homo Sapiens
AFLNTTQLP

SEQ ID NO: 1373430 - protein, 9 aa, Homo Sapiens
KGCPHWPAR

SEQ ID NO: 1373431 - protein, 9 aa, Homo Sapiens
QRELRELQR

SEQ ID NO: 1373432 - protein, 9 aa, Homo Sapiens
TGQLQSTRR

SEQ ID NO: 1373433 - protein, 9 aa, Homo Sapiens
AWEPWLPAK

SEQ ID NO: 1373434 - protein, 9 aa, Homo Sapiens
ATVECGVTS

SEQ ID NO: 1373435 - protein, 9 aa, Homo Sapiens
SGIHKVADP

SEQ ID NO: 1373436 - protein, 9 aa, Homo Sapiens
IVIYNSVFM

SEQ ID NO: 1373437 - protein, 9 aa, Homo Sapiens
DPLERSRPH

SEQ ID NO: 1373438 - protein, 9 aa, Homo Sapiens
RVSSAHLPG

SEQ ID NO: 1373439 - protein, 9 aa, Homo Sapiens
PEMKVYMDY

SEQ ID NO: 1373440 - protein, 9 aa, Homo Sapiens
HRGHHTLLT

SEQ ID NO: 1373441 - protein, 9 aa, Homo Sapiens
DGEPNAHNS

SEQ ID NO: 1373442 - protein, 9 aa, Homo Sapiens
LSLPRTTKA

SEQ ID NO: 1373443 - protein, 9 aa, Homo Sapiens
QPSVASSVS

SEQ ID NO: 1373444 - protein, 9 aa, Homo Sapiens
TLVPTTNGT

SEQ ID NO: 1373445 - protein, 9 aa, Homo Sapiens
AFRSWAVQA

SEQ ID NO: 1373446 - protein, 9 aa, Homo Sapiens
ASPASTASS

SEQ ID NO: 1373447 - protein, 9 aa, Homo Sapiens
ILAGDRCHR

SEQ ID NO: 1373448 - protein, 9 aa, Homo Sapiens
YVYRSGVPG

SEQ ID NO: 1373449 - protein, 9 aa, Homo Sapiens
TMQLVVLVN

SEQ ID NO: 1373450 - protein, 9 aa, Homo Sapiens
KKFCPLEID

SEQ ID NO: 1373451 - protein, 9 aa, Homo Sapiens
HGRRPTALV

SEQ ID NO: 1373452 - protein, 9 aa, Homo Sapiens
FRRQPGLLL

SEQ ID NO: 1373453 - protein, 9 aa, Homo Sapiens
PWGKSFRST

SEQ ID NO: 1373454 - protein, 9 aa, Homo Sapiens
KTPCVHGYT

SEQ ID NO: 1373455 - protein, 9 aa, Homo Sapiens
RLALQEEPE

SEQ ID NO: 1373456 - protein, 9 aa, Homo Sapiens
QGAVANDQD

SEQ ID NO: 1373457 - protein, 9 aa, Homo Sapiens
CVVGSSQKR

SEQ ID NO: 1373458 - protein, 9 aa, Homo Sapiens
PPTAPRRHG

SEQ ID NO: 1373459 - protein, 9 aa, Homo Sapiens
MCASLSLLI

SEQ ID NO: 1373460 - protein, 9 aa, Homo Sapiens
SWPRGGNAP

SEQ ID NO: 1373461 - protein, 9 aa, Homo Sapiens
GGVARVEVA

SEQ ID NO: 1373462 - protein, 9 aa, Homo Sapiens
ADEGRADLC

SEQ ID NO: 1373463 - protein, 9 aa, Homo Sapiens
TRHHKQPET

SEQ ID NO: 1373464 - protein, 9 aa, Homo Sapiens
RLSTTCIQL

SEQ ID NO: 1373465 - protein, 9 aa, Homo Sapiens
IMRQKKQEC

SEQ ID NO: 1373466 - protein, 9 aa, Homo Sapiens
LDFSHFHLF

SEQ ID NO: 1373467 - protein, 9 aa, Homo Sapiens
LLIAADTLP

SEQ ID NO: 1373468 - protein, 9 aa, Homo Sapiens
YKYLATSLF

SEQ ID NO: 1373469 - protein, 9 aa, Homo Sapiens
MPIDQKKPK

SEQ ID NO: 1373470 - protein, 9 aa, Homo Sapiens
ISRNTFAEL

SEQ ID NO: 1373471 - protein, 9 aa, Homo Sapiens
GAGAIRPAV

SEQ ID NO: 1373472 - protein, 9 aa, Homo Sapiens
AAVGAGAGL

SEQ ID NO: 1373473 - protein, 9 aa, Homo Sapiens
HGPYHFQGP

SEQ ID NO: 1373474 - protein, 9 aa, Homo Sapiens
KMKGCPHWP

SEQ ID NO: 1373475 - protein, 9 aa, Homo Sapiens
PLSHRTITG

SEQ ID NO: 1373476 - protein, 9 aa, Homo Sapiens
FIQAEGYPT

SEQ ID NO: 1373477 - protein, 9 aa, Homo Sapiens
LLVNRNVVL

SEQ ID NO: 1373478 - protein, 9 aa, Homo Sapiens
QEKQNNQTW

SEQ ID NO: 1373479 - protein, 9 aa, Homo Sapiens
LLCKYFDKA

SEQ ID NO: 1373480 - protein, 9 aa, Homo Sapiens
DEGRADLCH

SEQ ID NO: 1373481 - protein, 9 aa, Homo Sapiens
TCKGLFNIY

SEQ ID NO: 1373482 - protein, 9 aa, Homo Sapiens
NDNQREVCI

SEQ ID NO: 1373483 - protein, 9 aa, Homo Sapiens
TELNHDQMQ

SEQ ID NO: 1373484 - protein, 9 aa, Homo Sapiens
AEGAHHWQE

SEQ ID NO: 1373485 - protein, 9 aa, Homo Sapiens
NFSHSISES

SEQ ID NO: 1373486 - protein, 9 aa, Homo Sapiens
RNLLLIGKS

SEQ ID NO: 1373487 - protein, 9 aa, Homo Sapiens
VLKQDGKNF

SEQ ID NO: 1373488 - protein, 9 aa, Homo Sapiens
KVSSLARRL

SEQ ID NO: 1373489 - protein, 9 aa, Homo Sapiens
QKACMTQLV

SEQ ID NO: 1373490 - protein, 9 aa, Homo Sapiens
ICCCHCLLT

SEQ ID NO: 1373491 - protein, 9 aa, Homo Sapiens
DDSGNKGVI

SEQ ID NO: 1373492 - protein, 9 aa, Homo Sapiens
SFAAGVIRR

SEQ ID NO: 1373493 - protein, 9 aa, Homo Sapiens
HPEGSSGSE

SEQ ID NO: 1373494 - protein, 9 aa, Homo Sapiens
LRERARLLG

SEQ ID NO: 1373495 - protein, 9 aa, Homo Sapiens
LSPSGICLS

SEQ ID NO: 1373496 - protein, 9 aa, Homo Sapiens
MQPQILEVS

SEQ ID NO: 1373497 - protein, 9 aa, Homo Sapiens
QLLSGKDQP

SEQ ID NO: 1373498 - protein, 9 aa, Homo Sapiens
LPFNEDTTS

SEQ ID NO: 1373499 - protein, 9 aa, Homo Sapiens
LGFADLFSK

SEQ ID NO: 1373500 - protein, 9 aa, Homo Sapiens
SSSSRSLFN

SEQ ID NO: 1373501 - protein, 9 aa, Homo Sapiens
PEGSSGSEV

SEQ ID NO: 1373502 - protein, 9 aa, Homo Sapiens
QQGAVANDQ

SEQ ID NO: 1373503 - protein, 9 aa, Homo Sapiens
SNMDIYLMP

SEQ ID NO: 1373504 - protein, 9 aa, Homo Sapiens
ELTLVLTED

SEQ ID NO: 1373505 - protein, 9 aa, Homo Sapiens
APIFTTPGR

SEQ ID NO: 1373506 - protein, 9 aa, Homo Sapiens
LELGSNCIR

SEQ ID NO: 1373507 - protein, 9 aa, Homo Sapiens
EEERPIRLT

SEQ ID NO: 1373508 - protein, 9 aa, Homo Sapiens
FLRKKIKAQ

SEQ ID NO: 1373509 - protein, 9 aa, Homo Sapiens
RPALGRLRG

SEQ ID NO: 1373510 - protein, 9 aa, Homo Sapiens
YILTCSATG

SEQ ID NO: 1373511 - protein, 9 aa, Homo Sapiens
ESGIHKVAD

SEQ ID NO: 1373512 - protein, 9 aa, Homo Sapiens
STYWVSLQL

SEQ ID NO: 1373513 - protein, 9 aa, Homo Sapiens
RVMLNNGAG

SEQ ID NO: 1373514 - protein, 9 aa, Homo Sapiens
DGGIMYAKR

SEQ ID NO: 1373515 - protein, 9 aa, Homo Sapiens
VQTPVDQLQ

SEQ ID NO: 1373516 - protein, 9 aa, Homo Sapiens
LFNIYHPLD

SEQ ID NO: 1373517 - protein, 9 aa, Homo Sapiens
HMAKAFALR

SEQ ID NO: 1373518 - protein, 9 aa, Homo Sapiens
EDEEGQTVP

SEQ ID NO: 1373519 - protein, 9 aa, Homo Sapiens
KPAGPSISI

SEQ ID NO: 1373520 - protein, 9 aa, Homo Sapiens
SESETGHME

SEQ ID NO: 1373521 - protein, 9 aa, Homo Sapiens
QKTVKPKWC

SEQ ID NO: 1373522 - protein, 9 aa, Homo Sapiens
VYRSGVPGG

SEQ ID NO: 1373523 - protein, 9 aa, Homo Sapiens
TSAHTPTRS

SEQ ID NO: 1373524 - protein, 9 aa, Homo Sapiens
ENSHPPPPP

SEQ ID NO: 1373525 - protein, 9 aa, Homo Sapiens
DFLKQPEMS

SEQ ID NO: 1373526 - protein, 9 aa, Homo Sapiens
KYRIQSYRD

SEQ ID NO: 1373527 - protein, 9 aa, Homo Sapiens
YTGELVKAM

SEQ ID NO: 1373528 - protein, 9 aa, Homo Sapiens
ARFNGLRFV

SEQ ID NO: 1373529 - protein, 9 aa, Homo Sapiens
VVVNVEDAN

SEQ ID NO: 1373530 - protein, 9 aa, Homo Sapiens
HACRRFLSL

SEQ ID NO: 1373531 - protein, 9 aa, Homo Sapiens
LLVSSPERP

SEQ ID NO: 1373532 - protein, 9 aa, Homo Sapiens
HRARPFTCF

SEQ ID NO: 1373533 - protein, 9 aa, Homo Sapiens
AANNPNHRN

SEQ ID NO: 1373534 - protein, 9 aa, Homo Sapiens
CRAGGPAGW

SEQ ID NO: 1373535 - protein, 9 aa, Homo Sapiens
FRSWAVQAF

SEQ ID NO: 1373536 - protein, 9 aa, Homo Sapiens
RRNLGVSGR

SEQ ID NO: 1373537 - protein, 9 aa, Homo Sapiens
TPKVIFFWL

SEQ ID NO: 1373538 - protein, 9 aa, Homo Sapiens
IRLTLGTCP

SEQ ID NO: 1373539 - protein, 9 aa, Homo Sapiens
LLCLDTVPE

SEQ ID NO: 1373540 - protein, 9 aa, Homo Sapiens
AGASVVTSL

SEQ ID NO: 1373541 - protein, 9 aa, Homo Sapiens
RARDQTHSA

SEQ ID NO: 1373542 - protein, 9 aa, Homo Sapiens
KKHILVSLI

SEQ ID NO: 1373543 - protein, 9 aa, Homo Sapiens
LHDEEANND

SEQ ID NO: 1373544 - protein, 9 aa, Homo Sapiens
QCTFFFLHK

SEQ ID NO: 1373545 - protein, 9 aa, Homo Sapiens
AGAAVAAAR

SEQ ID NO: 1373546 - protein, 9 aa, Homo Sapiens
FSHFHLFDE

SEQ ID NO: 1373547 - protein, 9 aa, Homo Sapiens
EVSYLPRDL

SEQ ID NO: 1373548 - protein, 9 aa, Homo Sapiens
PAAEEAEQH

SEQ ID NO: 1373549 - protein, 9 aa, Homo Sapiens
LFSTGLLDN

SEQ ID NO: 1373550 - protein, 9 aa, Homo Sapiens
LNAKTLSIN

SEQ ID NO: 1373551 - protein, 9 aa, Homo Sapiens
KPYKCAICH

SEQ ID NO: 1373552 - protein, 9 aa, Homo Sapiens
QRAVKKVRL

SEQ ID NO: 1373553 - protein, 9 aa, Homo Sapiens
YSLPTCKGL

SEQ ID NO: 1373554 - protein, 9 aa, Homo Sapiens
KPGCARQEE

SEQ ID NO: 1373555 - protein, 9 aa, Homo Sapiens
YELDFSHFH

SEQ ID NO: 1373556 - protein, 9 aa, Homo Sapiens
KATSTATLS

SEQ ID NO: 1373557 - protein, 9 aa, Homo Sapiens
PRDLSTYRP

SEQ ID NO: 1373558 - protein, 9 aa, Homo Sapiens
ETVALILKA

SEQ ID NO: 1373559 - protein, 9 aa, Homo Sapiens
LVSQVTITM

SEQ ID NO: 1373560 - protein, 9 aa, Homo Sapiens
CGGVCSSGI

SEQ ID NO: 1373561 - protein, 9 aa, Homo Sapiens
TTQAIEYNL

SEQ ID NO: 1373562 - protein, 9 aa, Homo Sapiens
KGKGGKNRH

SEQ ID NO: 1373563 - protein, 9 aa, Homo Sapiens
ASHIDICLR

SEQ ID NO: 1373564 - protein, 9 aa, Homo Sapiens
NQLAPENPF

SEQ ID NO: 1373565 - protein, 9 aa, Homo Sapiens
KTWWTMSTI

SEQ ID NO: 1373566 - protein, 9 aa, Homo Sapiens
KQVFKNLQL

SEQ ID NO: 1373567 - protein, 9 aa, Homo Sapiens
HPTPTSDTP

SEQ ID NO: 1373568 - protein, 9 aa, Homo Sapiens
SGKRPREGE

SEQ ID NO: 1373569 - protein, 9 aa, Homo Sapiens
HATQKEVSL

SEQ ID NO: 1373570 - protein, 9 aa, Homo Sapiens
VNNFKNEAG

SEQ ID NO: 1373571 - protein, 9 aa, Homo Sapiens
LEQLPESVL

SEQ ID NO: 1373572 - protein, 9 aa, Homo Sapiens
WKRKRWEMD

SEQ ID NO: 1373573 - protein, 9 aa, Homo Sapiens
VWCYYCQAY

SEQ ID NO: 1373574 - protein, 9 aa, Homo Sapiens
LAACSQHFK

SEQ ID NO: 1373575 - protein, 9 aa, Homo Sapiens
GGPCTCLPP

SEQ ID NO: 1373576 - protein, 9 aa, Homo Sapiens
LHCLLSTSA

SEQ ID NO: 1373577 - protein, 9 aa, Homo Sapiens
PPGSLLSSG

SEQ ID NO: 1373578 - protein, 9 aa, Homo Sapiens
SPSSTSSSS

SEQ ID NO: 1373579 - protein, 9 aa, Homo Sapiens
NTNMNVNMN

SEQ ID NO: 1373580 - protein, 9 aa, Homo Sapiens
CGASYAPVM

SEQ ID NO: 1373581 - protein, 9 aa, Homo Sapiens
IDLKDRGDL

SEQ ID NO: 1373582 - protein, 9 aa, Homo Sapiens
HWKTKKELE

SEQ ID NO: 1373583 - protein, 9 aa, Homo Sapiens
RFRSFSPLK

SEQ ID NO: 1373584 - protein, 9 aa, Homo Sapiens
VVLDLAQAL

SEQ ID NO: 1373585 - protein, 9 aa, Homo Sapiens
SVLAFSRSL

SEQ ID NO: 1373586 - protein, 9 aa, Homo Sapiens
AQTTHQQCF

SEQ ID NO: 1373587 - protein, 9 aa, Homo Sapiens
LWSQRHLPK

SEQ ID NO: 1373588 - protein, 9 aa, Homo Sapiens
RMFLKRDMS

SEQ ID NO: 1373589 - protein, 9 aa, Homo Sapiens
QRALRGYVG

SEQ ID NO: 1373590 - protein, 9 aa, Homo Sapiens
KPLPMVLPS

SEQ ID NO: 1373591 - protein, 9 aa, Homo Sapiens
MAVRQWVIT

SEQ ID NO: 1373592 - protein, 9 aa, Homo Sapiens
CLFHRPLRC

SEQ ID NO: 1373593 - protein, 9 aa, Homo Sapiens
KRRVDMPIT

SEQ ID NO: 1373594 - protein, 9 aa, Homo Sapiens
AAEDRTSLK

SEQ ID NO: 1373595 - protein, 9 aa, Homo Sapiens
GEAHDIIAE

SEQ ID NO: 1373596 - protein, 9 aa, Homo Sapiens
RRKPGCARQ

SEQ ID NO: 1373597 - protein, 9 aa, Homo Sapiens
CAEVQGSAG

SEQ ID NO: 1373598 - protein, 9 aa, Homo Sapiens
QGIGMKQEM

SEQ ID NO: 1373599 - protein, 9 aa, Homo Sapiens
PHQKVLAPD

SEQ ID NO: 1373600 - protein, 9 aa, Homo Sapiens
PLAKSTWLN

SEQ ID NO: 1373601 - protein, 9 aa, Homo Sapiens
IVDLQMLTY

SEQ ID NO: 1373602 - protein, 9 aa, Homo Sapiens
CHQHATQKE

SEQ ID NO: 1373603 - protein, 9 aa, Homo Sapiens
FRTEPTAWN

SEQ ID NO: 1373604 - protein, 9 aa, Homo Sapiens
TEQRMIFIP

SEQ ID NO: 1373605 - protein, 9 aa, Homo Sapiens
PELQPTRSY

SEQ ID NO: 1373606 - protein, 9 aa, Homo Sapiens
EAAKIEKKR

SEQ ID NO: 1373607 - protein, 9 aa, Homo Sapiens
GGCSRYSPM

SEQ ID NO: 1373608 - protein, 9 aa, Homo Sapiens
AAKIEKKRE

SEQ ID NO: 1373609 - protein, 9 aa, Homo Sapiens
QAVRRLNEL

SEQ ID NO: 1373610 - protein, 9 aa, Homo Sapiens
ERIRHSQRL

SEQ ID NO: 1373611 - protein, 9 aa, Homo Sapiens
ITRSFNQNR

SEQ ID NO: 1373612 - protein, 9 aa, Homo Sapiens
GGPPGNEHL

SEQ ID NO: 1373613 - protein, 9 aa, Homo Sapiens
VSLPEDRYT

SEQ ID NO: 1373614 - protein, 9 aa, Homo Sapiens
EELRPNPDG

SEQ ID NO: 1373615 - protein, 9 aa, Homo Sapiens
AGAIRPAVP

SEQ ID NO: 1373616 - protein, 9 aa, Homo Sapiens
NILDVSMGA

SEQ ID NO: 1373617 - protein, 9 aa, Homo Sapiens
KDNNYNLAM

SEQ ID NO: 1373618 - protein, 9 aa, Homo Sapiens
LLLDMARHS

SEQ ID NO: 1373619 - protein, 9 aa, Homo Sapiens
SNSNSSNSS

SEQ ID NO: 1373620 - protein, 9 aa, Homo Sapiens
RCPGYYESG

SEQ ID NO: 1373621 - protein, 9 aa, Homo Sapiens
DEAWEDLQG

SEQ ID NO: 1373622 - protein, 9 aa, Homo Sapiens
TSASRQTCP

SEQ ID NO: 1373623 - protein, 9 aa, Homo Sapiens
MMLMPYGAP

SEQ ID NO: 1373624 - protein, 9 aa, Homo Sapiens
DLVPQNYHI

SEQ ID NO: 1373625 - protein, 9 aa, Homo Sapiens
PLRACLPAQ

SEQ ID NO: 1373626 - protein, 9 aa, Homo Sapiens
ELETSMDRE

SEQ ID NO: 1373627 - protein, 9 aa, Homo Sapiens
HAGHVLAPK

SEQ ID NO: 1373628 - protein, 9 aa, Homo Sapiens
QPQPHRHLR

SEQ ID NO: 1373629 - protein, 9 aa, Homo Sapiens
SALVGASEA

SEQ ID NO: 1373630 - protein, 9 aa, Homo Sapiens
GGAGSVLRI

SEQ ID NO: 1373631 - protein, 9 aa, Homo Sapiens
LPHDAKDTA

SEQ ID NO: 1373632 - protein, 9 aa, Homo Sapiens
VSNPSLHET

SEQ ID NO: 1373633 - protein, 9 aa, Homo Sapiens
PFLLVRYSA

SEQ ID NO: 1373634 - protein, 9 aa, Homo Sapiens
HPTSKTEHQ

SEQ ID NO: 1373635 - protein, 9 aa, Homo Sapiens
DLFARAGYE

SEQ ID NO: 1373636 - protein, 9 aa, Homo Sapiens
RDTKGPFLI

SEQ ID NO: 1373637 - protein, 9 aa, Homo Sapiens
CSKGSLVHS

SEQ ID NO: 1373638 - protein, 9 aa, Homo Sapiens
TAIMCGLCK

SEQ ID NO: 1373639 - protein, 9 aa, Homo Sapiens
CHAKGKQLS

SEQ ID NO: 1373640 - protein, 9 aa, Homo Sapiens
RDQNKHKEA

SEQ ID NO: 1373641 - protein, 9 aa, Homo Sapiens
TGLCHRPGL

SEQ ID NO: 1373642 - protein, 9 aa, Homo Sapiens
IAAVGEPGF

SEQ ID NO: 1373643 - protein, 9 aa, Homo Sapiens
SKTFEKKGG

SEQ ID NO: 1373644 - protein, 9 aa, Homo Sapiens
QQCGKAFIY

SEQ ID NO: 1373645 - protein, 9 aa, Homo Sapiens
SLSLLIAAD

SEQ ID NO: 1373646 - protein, 9 aa, Homo Sapiens
LIGLCFRHL

SEQ ID NO: 1373647 - protein, 9 aa, Homo Sapiens
IQGLKWQHH

SEQ ID NO: 1373648 - protein, 9 aa, Homo Sapiens
AIAVDCYVA

SEQ ID NO: 1373649 - protein, 9 aa, Homo Sapiens
PGTRCSSTS

SEQ ID NO: 1373650 - protein, 9 aa, Homo Sapiens
GTPPPLILW

SEQ ID NO: 1373651 - protein, 9 aa, Homo Sapiens
GGKWRRQPV

SEQ ID NO: 1373652 - protein, 9 aa, Homo Sapiens
VGAGAGLGC

SEQ ID NO: 1373653 - protein, 9 aa, Homo Sapiens
PGPLLRWSR

SEQ ID NO: 1373654 - protein, 9 aa, Homo Sapiens
VSSAHHVLF

SEQ ID NO: 1373655 - protein, 9 aa, Homo Sapiens
ASVFGTSRL

SEQ ID NO: 1373656 - protein, 9 aa, Homo Sapiens
RVIPEAIVD

SEQ ID NO: 1373657 - protein, 9 aa, Homo Sapiens
SLSSLVVQV

SEQ ID NO: 1373658 - protein, 9 aa, Homo Sapiens
LSAQIQERR

SEQ ID NO: 1373659 - protein, 9 aa, Homo Sapiens
PVSANDLES

SEQ ID NO: 1373660 - protein, 9 aa, Homo Sapiens
KLALPMENG

SEQ ID NO: 1373661 - protein, 9 aa, Homo Sapiens
VGMYMDSCS

SEQ ID NO: 1373662 - protein, 9 aa, Homo Sapiens
MSVENCVYV

SEQ ID NO: 1373663 - protein, 9 aa, Homo Sapiens
PGLMEEVVV

SEQ ID NO: 1373664 - protein, 9 aa, Homo Sapiens
SSCLGISVL

SEQ ID NO: 1373665 - protein, 9 aa, Homo Sapiens
REVKRMETC

SEQ ID NO: 1373666 - protein, 9 aa, Homo Sapiens
EEVEEEEEV

SEQ ID NO: 1373667 - protein, 9 aa, Homo Sapiens
WLAARIAER

SEQ ID NO: 1373668 - protein, 9 aa, Homo Sapiens
FDRVSSEYT

SEQ ID NO: 1373669 - protein, 9 aa, Homo Sapiens
SIQDLFARA

SEQ ID NO: 1373670 - protein, 9 aa, Homo Sapiens
SQRQRKRML

SEQ ID NO: 1373671 - protein, 9 aa, Homo Sapiens
ELVACSLIS

SEQ ID NO: 1373672 - protein, 9 aa, Homo Sapiens
CYYYLLPGL

SEQ ID NO: 1373673 - protein, 9 aa, Homo Sapiens
QALRARFSE

SEQ ID NO: 1373674 - protein, 9 aa, Homo Sapiens
MEEVVVHAE

SEQ ID NO: 1373675 - protein, 9 aa, Homo Sapiens
KYPHLVAGV

SEQ ID NO: 1373676 - protein, 9 aa, Homo Sapiens
RDPLLHKCC

SEQ ID NO: 1373677 - protein, 9 aa, Homo Sapiens
SPPGPHSGA

SEQ ID NO: 1373678 - protein, 9 aa, Homo Sapiens
LKRDMSIHD

SEQ ID NO: 1373679 - protein, 9 aa, Homo Sapiens
EIIGRSWFP

SEQ ID NO: 1373680 - protein, 9 aa, Homo Sapiens
SYAPVMRTV

SEQ ID NO: 1373681 - protein, 9 aa, Homo Sapiens
DRSWKIALP

SEQ ID NO: 1373682 - protein, 9 aa, Homo Sapiens
VTFSFIPLA

SEQ ID NO: 1373683 - protein, 9 aa, Homo Sapiens
LWDVPAHSL

SEQ ID NO: 1373684 - protein, 9 aa, Homo Sapiens
DGHSHLVVY

SEQ ID NO: 1373685 - protein, 9 aa, Homo Sapiens
GDITLVPTT

SEQ ID NO: 1373686 - protein, 9 aa, Homo Sapiens
GQRIAETGV

SEQ ID NO: 1373687 - protein, 9 aa, Homo Sapiens
LNGLYITTI

SEQ ID NO: 1373688 - protein, 9 aa, Homo Sapiens
PQGPCPPPV

SEQ ID NO: 1373689 - protein, 9 aa, Homo Sapiens
LFAQVRRSA

SEQ ID NO: 1373690 - protein, 9 aa, Homo Sapiens
NRILTYQCG

SEQ ID NO: 1373691 - protein, 9 aa, Homo Sapiens
KVLKQDGKN

SEQ ID NO: 1373692 - protein, 9 aa, Homo Sapiens
YTRVSSAHL

SEQ ID NO: 1373693 - protein, 9 aa, Homo Sapiens
VGFIQAEGY

SEQ ID NO: 1373694 - protein, 9 aa, Homo Sapiens
WGSPTRMAG

SEQ ID NO: 1373695 - protein, 9 aa, Homo Sapiens
ATGHLVGRH

SEQ ID NO: 1373696 - protein, 9 aa, Homo Sapiens
VLQFQEEVF

SEQ ID NO: 1373697 - protein, 9 aa, Homo Sapiens
SCRTLEPNP

SEQ ID NO: 1373698 - protein, 9 aa, Homo Sapiens
ALYSLEFIK

SEQ ID NO: 1373699 - protein, 9 aa, Homo Sapiens
TPSNCTPGH

SEQ ID NO: 1373700 - protein, 9 aa, Homo Sapiens
FKRPQPTRL

SEQ ID NO: 1373701 - protein, 9 aa, Homo Sapiens
IYLMPTVPK

SEQ ID NO: 1373702 - protein, 9 aa, Homo Sapiens
QGSRVQNTA

SEQ ID NO: 1373703 - protein, 9 aa, Homo Sapiens
KVLAPDVLR

SEQ ID NO: 1373704 - protein, 9 aa, Homo Sapiens
GISTRVNND

SEQ ID NO: 1373705 - protein, 9 aa, Homo Sapiens
RKDPLQLLV

SEQ ID NO: 1373706 - protein, 9 aa, Homo Sapiens
LHVSITNTK

SEQ ID NO: 1373707 - protein, 9 aa, Homo Sapiens
NGVSPCWSL

SEQ ID NO: 1373708 - protein, 9 aa, Homo Sapiens
VLPKHRELR

SEQ ID NO: 1373709 - protein, 9 aa, Homo Sapiens
ERPHGRGEC

SEQ ID NO: 1373710 - protein, 9 aa, Homo Sapiens
NFAAVPAFS

SEQ ID NO: 1373711 - protein, 9 aa, Homo Sapiens
TPPLILTCS

SEQ ID NO: 1373712 - protein, 9 aa, Homo Sapiens
KDFVMMSRV

SEQ ID NO: 1373713 - protein, 9 aa, Homo Sapiens
VAMDRPLRI

SEQ ID NO: 1373714 - protein, 9 aa, Homo Sapiens
GSMREKRKS

SEQ ID NO: 1373715 - protein, 9 aa, Homo Sapiens
QPESHHGSH

SEQ ID NO: 1373716 - protein, 9 aa, Homo Sapiens
QASMREPGL

SEQ ID NO: 1373717 - protein, 9 aa, Homo Sapiens
HDLVPYLYR

SEQ ID NO: 1373718 - protein, 9 aa, Homo Sapiens
IQVQTGGRL

SEQ ID NO: 1373719 - protein, 9 aa, Homo Sapiens
QLGRRILHE

SEQ ID NO: 1373720 - protein, 9 aa, Homo Sapiens
FHVQESGWE

SEQ ID NO: 1373721 - protein, 9 aa, Homo Sapiens
HRGKNENES

SEQ ID NO: 1373722 - protein, 9 aa, Homo Sapiens
SQCQCTAQD

SEQ ID NO: 1373723 - protein, 9 aa, Homo Sapiens
TQTAAGRPP

SEQ ID NO: 1373724 - protein, 9 aa, Homo Sapiens
KMTYTNSVC

SEQ ID NO: 1373725 - protein, 9 aa, Homo Sapiens
GVIATLLFC

SEQ ID NO: 1373726 - protein, 9 aa, Homo Sapiens
GRGYPRPGA

SEQ ID NO: 1373727 - protein, 9 aa, Homo Sapiens
EERGEEYLG

SEQ ID NO: 1373728 - protein, 9 aa, Homo Sapiens
KKKFKDPNN

SEQ ID NO: 1373729 - protein, 9 aa, Homo Sapiens
VGRAEVSIQ

SEQ ID NO: 1373730 - protein, 9 aa, Homo Sapiens
HRVGGPGPR

SEQ ID NO: 1373731 - protein, 9 aa, Homo Sapiens
VPFVKGCAE

SEQ ID NO: 1373732 - protein, 9 aa, Homo Sapiens
GDVYIKSTE

SEQ ID NO: 1373733 - protein, 9 aa, Homo Sapiens
QLQSTRRVQ

SEQ ID NO: 1373734 - protein, 9 aa, Homo Sapiens
GGPPTAPRR

SEQ ID NO: 1373735 - protein, 9 aa, Homo Sapiens
DLPSKLNQW

SEQ ID NO: 1373736 - protein, 9 aa, Homo Sapiens
QQPQPHRHL

SEQ ID NO: 1373737 - protein, 9 aa, Homo Sapiens
VAELYEESK

SEQ ID NO: 1373738 - protein, 9 aa, Homo Sapiens
HGERLHLLC

SEQ ID NO: 1373739 - protein, 9 aa, Homo Sapiens
SHRDLPSKL

SEQ ID NO: 1373740 - protein, 9 aa, Homo Sapiens
HKKKPVNWT

SEQ ID NO: 1373741 - protein, 9 aa, Homo Sapiens
ESDNHSPAV

SEQ ID NO: 1373742 - protein, 9 aa, Homo Sapiens
GSSSASLAN

SEQ ID NO: 1373743 - protein, 9 aa, Homo Sapiens
EARARRHRA

SEQ ID NO: 1373744 - protein, 9 aa, Homo Sapiens
MDIYLMPTV

SEQ ID NO: 1373745 - protein, 9 aa, Homo Sapiens
LPRTTKATQ

SEQ ID NO: 1373746 - protein, 9 aa, Homo Sapiens
EAAAHSLPQ

SEQ ID NO: 1373747 - protein, 9 aa, Homo Sapiens
DASSCLGIS

SEQ ID NO: 1373748 - protein, 9 aa, Homo Sapiens
VRLAIGNGM

SEQ ID NO: 1373749 - protein, 9 aa, Homo Sapiens
KITIYGRTK

SEQ ID NO: 1373750 - protein, 9 aa, Homo Sapiens
ADGFADQSP

SEQ ID NO: 1373751 - protein, 9 aa, Homo Sapiens
RATRRPRAL

SEQ ID NO: 1373752 - protein, 9 aa, Homo Sapiens
KKRRVDMPI

SEQ ID NO: 1373753 - protein, 9 aa, Homo Sapiens
DGKNFTQGN

SEQ ID NO: 1373754 - protein, 9 aa, Homo Sapiens
VECLYSQDG

SEQ ID NO: 1373755 - protein, 9 aa, Homo Sapiens
PPAMRSGGD

SEQ ID NO: 1373756 - protein, 9 aa, Homo Sapiens
IRKTEYDSR

SEQ ID NO: 1373757 - protein, 9 aa, Homo Sapiens
NNAAARVMT

SEQ ID NO: 1373758 - protein, 9 aa, Homo Sapiens
CPVSGHTDT

SEQ ID NO: 1373759 - protein, 9 aa, Homo Sapiens
CSQRFRKSK

SEQ ID NO: 1373760 - protein, 9 aa, Homo Sapiens
KVHALQPLD

SEQ ID NO: 1373761 - protein, 9 aa, Homo Sapiens
PKSVQSRVK

SEQ ID NO: 1373762 - protein, 9 aa, Homo Sapiens
PAAPAGPQR

SEQ ID NO: 1373763 - protein, 9 aa, Homo Sapiens
RRKAALEGA

SEQ ID NO: 1373764 - protein, 9 aa, Homo Sapiens
LLNPAVHFP

SEQ ID NO: 1373765 - protein, 9 aa, Homo Sapiens
LSWPDQHCS

SEQ ID NO: 1373766 - protein, 9 aa, Homo Sapiens
NGEMFFITN

SEQ ID NO: 1373767 - protein, 9 aa, Homo Sapiens
GHLSLPQMQ

SEQ ID NO: 1373768 - protein, 9 aa, Homo Sapiens
PRLRFCAWP

SEQ ID NO: 1373769 - protein, 9 aa, Homo Sapiens
LFKSFSSTP

SEQ ID NO: 1373770 - protein, 9 aa, Homo Sapiens
SVSGNMIIV

SEQ ID NO: 1373771 - protein, 9 aa, Homo Sapiens
AVDIKTEDL

SEQ ID NO: 1373772 - protein, 9 aa, Homo Sapiens
ISKQQFLSS

SEQ ID NO: 1373773 - protein, 9 aa, Homo Sapiens
TPPPHQMKC

SEQ ID NO: 1373774 - protein, 9 aa, Homo Sapiens
PTRFKRFFC

SEQ ID NO: 1373775 - protein, 9 aa, Homo Sapiens
AASALRTRR

SEQ ID NO: 1373776 - protein, 9 aa, Homo Sapiens
DLCLDILDG

SEQ ID NO: 1373777 - protein, 9 aa, Homo Sapiens
LFLLFLFFT

SEQ ID NO: 1373778 - protein, 9 aa, Homo Sapiens
SASPASTAS

SEQ ID NO: 1373779 - protein, 9 aa, Homo Sapiens
GGQHEEVDF

SEQ ID NO: 1373780 - protein, 9 aa, Homo Sapiens
SDIDFAADE

SEQ ID NO: 1373781 - protein, 9 aa, Homo Sapiens
LPAQTTVPD

SEQ ID NO: 1373782 - protein, 9 aa, Homo Sapiens
DGSVIRQVL

SEQ ID NO: 1373783 - protein, 9 aa, Homo Sapiens
FGPTMVAHA

SEQ ID NO: 1373784 - protein, 9 aa, Homo Sapiens
VEEEEEVVV

SEQ ID NO: 1373785 - protein, 9 aa, Homo Sapiens
KVIQWAPYR

SEQ ID NO: 1373786 - protein, 9 aa, Homo Sapiens
VVASLKANG

SEQ ID NO: 1373787 - protein, 9 aa, Homo Sapiens
WLCLVGTEG

SEQ ID NO: 1373788 - protein, 9 aa, Homo Sapiens
FFFETKSLA

SEQ ID NO: 1373789 - protein, 9 aa, Homo Sapiens
DKTIHIWDV

SEQ ID NO: 1373790 - protein, 9 aa, Homo Sapiens
KRANCVIQR

SEQ ID NO: 1373791 - protein, 9 aa, Homo Sapiens
VAEHGSRRE

SEQ ID NO: 1373792 - protein, 9 aa, Homo Sapiens
FFPHCSLLR

SEQ ID NO: 1373793 - protein, 9 aa, Homo Sapiens
ERGQKSRDE

SEQ ID NO: 1373794 - protein, 9 aa, Homo Sapiens
PLSVHKLPQ

SEQ ID NO: 1373795 - protein, 9 aa, Homo Sapiens
VLIMVWGHP

SEQ ID NO: 1373796 - protein, 9 aa, Homo Sapiens
ATLSPGEAR

SEQ ID NO: 1373797 - protein, 9 aa, Homo Sapiens
QAFMAGLAQ

SEQ ID NO: 1373798 - protein, 9 aa, Homo Sapiens
SGVSVVLIT

SEQ ID NO: 1373799 - protein, 9 aa, Homo Sapiens
RPAARASPA

SEQ ID NO: 1373800 - protein, 9 aa, Homo Sapiens
KDSRGLGTE

SEQ ID NO: 1373801 - protein, 9 aa, Homo Sapiens
RVVSNGDGS

SEQ ID NO: 1373802 - protein, 9 aa, Homo Sapiens
PDTPQLEGL

SEQ ID NO: 1373803 - protein, 9 aa, Homo Sapiens
SLEFEMRHL

SEQ ID NO: 1373804 - protein, 9 aa, Homo Sapiens
TRATSQGLW

SEQ ID NO: 1373805 - protein, 9 aa, Homo Sapiens
AACSQHFKK

SEQ ID NO: 1373806 - protein, 9 aa, Homo Sapiens
ETVNTPAMY

SEQ ID NO: 1373807 - protein, 9 aa, Homo Sapiens
LSIMPAQTA

SEQ ID NO: 1373808 - protein, 9 aa, Homo Sapiens
LTDNCLCYF

SEQ ID NO: 1373809 - protein, 9 aa, Homo Sapiens
ALLGSLNPC

SEQ ID NO: 1373810 - protein, 9 aa, Homo Sapiens
CAVDIGGLI

SEQ ID NO: 1373811 - protein, 9 aa, Homo Sapiens
PVAWHPLGL

SEQ ID NO: 1373812 - protein, 9 aa, Homo Sapiens
PLILWPQAA

SEQ ID NO: 1373813 - protein, 9 aa, Homo Sapiens
SVHKLPQCL

SEQ ID NO: 1373814 - protein, 9 aa, Homo Sapiens
PGQPPMHSG

SEQ ID NO: 1373815 - protein, 9 aa, Homo Sapiens
FKMGFKTQE

SEQ ID NO: 1373816 - protein, 9 aa, Homo Sapiens
GAYSQILLE

SEQ ID NO: 1373817 - protein, 9 aa, Homo Sapiens
IAIPNGEIP

SEQ ID NO: 1373818 - protein, 9 aa, Homo Sapiens
SHLTACFEK

SEQ ID NO: 1373819 - protein, 9 aa, Homo Sapiens
HEMLPAGLI

SEQ ID NO: 1373820 - protein, 9 aa, Homo Sapiens
TTKSVVIST

SEQ ID NO: 1373821 - protein, 9 aa, Homo Sapiens
AACILKGLN

SEQ ID NO: 1373822 - protein, 9 aa, Homo Sapiens
VVVRQGASI

SEQ ID NO: 1373823 - protein, 9 aa, Homo Sapiens
PPMREVAEA

SEQ ID NO: 1373824 - protein, 9 aa, Homo Sapiens
PHPHPTPTS

SEQ ID NO: 1373825 - protein, 9 aa, Homo Sapiens
HLTACFEKT

SEQ ID NO: 1373826 - protein, 9 aa, Homo Sapiens
DSLRMFLKR

SEQ ID NO: 1373827 - protein, 9 aa, Homo Sapiens
YGNTVTGLC

SEQ ID NO: 1373828 - protein, 9 aa, Homo Sapiens
LLNHIAAGA

SEQ ID NO: 1373829 - protein, 9 aa, Homo Sapiens
CGCMLQIRN

SEQ ID NO: 1373830 - protein, 9 aa, Homo Sapiens
CTHLAAMDV

SEQ ID NO: 1373831 - protein, 9 aa, Homo Sapiens
MVLPSIHQL

SEQ ID NO: 1373832 - protein, 9 aa, Homo Sapiens
EGLGEDEGG

SEQ ID NO: 1373833 - protein, 9 aa, Homo Sapiens
GPEEAAGPT

SEQ ID NO: 1373834 - protein, 9 aa, Homo Sapiens
RGHSLDFYQ

SEQ ID NO: 1373835 - protein, 9 aa, Homo Sapiens
PDGSPVFVA

SEQ ID NO: 1373836 - protein, 9 aa, Homo Sapiens
KPRRKPGCA

SEQ ID NO: 1373837 - protein, 9 aa, Homo Sapiens
VENCVYVVN

SEQ ID NO: 1373838 - protein, 9 aa, Homo Sapiens
AVIDNFYIC

SEQ ID NO: 1373839 - protein, 9 aa, Homo Sapiens
SCYVVVNFI

SEQ ID NO: 1373840 - protein, 9 aa, Homo Sapiens
QTTHQQCFS

SEQ ID NO: 1373841 - protein, 9 aa, Homo Sapiens
LQPIPPGSQ

SEQ ID NO: 1373842 - protein, 9 aa, Homo Sapiens
STLRPWPRL

SEQ ID NO: 1373843 - protein, 9 aa, Homo Sapiens
SQCLVEALG

SEQ ID NO: 1373844 - protein, 9 aa, Homo Sapiens
PLPPQLSVT

SEQ ID NO: 1373845 - protein, 9 aa, Homo Sapiens
PGYTQGTGN

SEQ ID NO: 1373846 - protein, 9 aa, Homo Sapiens
PAKEGHQMP

SEQ ID NO: 1373847 - protein, 9 aa, Homo Sapiens
ARGLLLALS

SEQ ID NO: 1373848 - protein, 9 aa, Homo Sapiens
AIALLNNRN

SEQ ID NO: 1373849 - protein, 9 aa, Homo Sapiens
YRDQNKHKE

SEQ ID NO: 1373850 - protein, 9 aa, Homo Sapiens
QQCVASSIQ

SEQ ID NO: 1373851 - protein, 9 aa, Homo Sapiens
QWETPQRIY

SEQ ID NO: 1373852 - protein, 9 aa, Homo Sapiens
WWTMSTITM

SEQ ID NO: 1373853 - protein, 9 aa, Homo Sapiens
GTLKAGQNT

SEQ ID NO: 1373854 - protein, 9 aa, Homo Sapiens
DDDSGNKGV

SEQ ID NO: 1373855 - protein, 9 aa, Homo Sapiens
RREMEKERK

SEQ ID NO: 1373856 - protein, 9 aa, Homo Sapiens
CSTKLTQSV

SEQ ID NO: 1373857 - protein, 9 aa, Homo Sapiens
AGRPPRMEL

SEQ ID NO: 1373858 - protein, 9 aa, Homo Sapiens
QSVVGNHPM

SEQ ID NO: 1373859 - protein, 9 aa, Homo Sapiens
KIGVVVCNC

SEQ ID NO: 1373860 - protein, 9 aa, Homo Sapiens
VSSEYTYRM

SEQ ID NO: 1373861 - protein, 9 aa, Homo Sapiens
AFLAAVPAR

SEQ ID NO: 1373862 - protein, 9 aa, Homo Sapiens
GQDQFSWED

SEQ ID NO: 1373863 - protein, 9 aa, Homo Sapiens
DPAIALLNN

SEQ ID NO: 1373864 - protein, 9 aa, Homo Sapiens
RARGCWWGQ

SEQ ID NO: 1373865 - protein, 9 aa, Homo Sapiens
HRLLGPSRW

SEQ ID NO: 1373866 - protein, 9 aa, Homo Sapiens
QHEEVDFAG

SEQ ID NO: 1373867 - protein, 9 aa, Homo Sapiens
RACRAGGPA

SEQ ID NO: 1373868 - protein, 9 aa, Homo Sapiens
LRPNGVQAV

SEQ ID NO: 1373869 - protein, 9 aa, Homo Sapiens
RSRKEAELI

SEQ ID NO: 1373870 - protein, 9 aa, Homo Sapiens
YQCGIPTSL

SEQ ID NO: 1373871 - protein, 9 aa, Homo Sapiens
PTGVGVYTA

SEQ ID NO: 1373872 - protein, 9 aa, Homo Sapiens
QCLVPAERG

SEQ ID NO: 1373873 - protein, 9 aa, Homo Sapiens
EPNAHNSKE

SEQ ID NO: 1373874 - protein, 9 aa, Homo Sapiens
TSRTPWGAM

SEQ ID NO: 1373875 - protein, 9 aa, Homo Sapiens
LGRLDLQCA

SEQ ID NO: 1373876 - protein, 9 aa, Homo Sapiens
IPVPCVNAV

SEQ ID NO: 1373877 - protein, 9 aa, Homo Sapiens
TLEEQGATW

SEQ ID NO: 1373878 - protein, 9 aa, Homo Sapiens
ELYEESKTR

SEQ ID NO: 1373879 - protein, 9 aa, Homo Sapiens
QVQGRLWML

SEQ ID NO: 1373880 - protein, 9 aa, Homo Sapiens
TRGASGRDR

SEQ ID NO: 1373881 - protein, 9 aa, Homo Sapiens
CCHVVQPDS

SEQ ID NO: 1373882 - protein, 9 aa, Homo Sapiens
QHDDDGAAA

SEQ ID NO: 1373883 - protein, 9 aa, Homo Sapiens
TPGVKKDSE

SEQ ID NO: 1373884 - protein, 9 aa, Homo Sapiens
IRVVGHMPG

SEQ ID NO: 1373885 - protein, 9 aa, Homo Sapiens
VGHGYYMAV

SEQ ID NO: 1373886 - protein, 9 aa, Homo Sapiens
KIEKKREVI

SEQ ID NO: 1373887 - protein, 9 aa, Homo Sapiens
RRPKRLRGH

SEQ ID NO: 1373888 - protein, 9 aa, Homo Sapiens
REVCIVAQR

SEQ ID NO: 1373889 - protein, 9 aa, Homo Sapiens
SVENCVYVV

SEQ ID NO: 1373890 - protein, 9 aa, Homo Sapiens
DESSDQNSR

SEQ ID NO: 1373891 - protein, 9 aa, Homo Sapiens
TAAAIGSLI

SEQ ID NO: 1373892 - protein, 9 aa, Homo Sapiens
PITLLRNIT

SEQ ID NO: 1373893 - protein, 9 aa, Homo Sapiens
AHNSKEDER

SEQ ID NO: 1373894 - protein, 9 aa, Homo Sapiens
CLLCPKTIL

SEQ ID NO: 1373895 - protein, 9 aa, Homo Sapiens
ATTPNVCSL

SEQ ID NO: 1373896 - protein, 9 aa, Homo Sapiens
RHATFVDSL

SEQ ID NO: 1373897 - protein, 9 aa, Homo Sapiens
QCLWLVLVM

SEQ ID NO: 1373898 - protein, 9 aa, Homo Sapiens
RIIGEKSLR

SEQ ID NO: 1373899 - protein, 9 aa, Homo Sapiens
DNAGRAVGG

SEQ ID NO: 1373900 - protein, 9 aa, Homo Sapiens
APGRGAAVG

SEQ ID NO: 1373901 - protein, 9 aa, Homo Sapiens
STAWCTSTE

SEQ ID NO: 1373902 - protein, 9 aa, Homo Sapiens
SGVPGGKGA

SEQ ID NO: 1373903 - protein, 9 aa, Homo Sapiens
SSPRRMRGT

SEQ ID NO: 1373904 - protein, 9 aa, Homo Sapiens
SIIASKVSD

SEQ ID NO: 1373905 - protein, 9 aa, Homo Sapiens
DVVVRQGAS

SEQ ID NO: 1373906 - protein, 9 aa, Homo Sapiens
DVVVRQGAP

SEQ ID NO: 1373907 - protein, 9 aa, Homo Sapiens
EIQAPHLWG

SEQ ID NO: 1373908 - protein, 9 aa, Homo Sapiens
DQPGIAVFC

SEQ ID NO: 1373909 - protein, 9 aa, Homo Sapiens
HRDLPSKLN

SEQ ID NO: 1373910 - protein, 9 aa, Homo Sapiens
QPRPRRSSP

SEQ ID NO: 1373911 - protein, 9 aa, Homo Sapiens
QPLLVRRNA

SEQ ID NO: 1373912 - protein, 9 aa, Homo Sapiens
MHKEKRVYS

SEQ ID NO: 1373913 - protein, 9 aa, Homo Sapiens
PPLPLSAVT

SEQ ID NO: 1373914 - protein, 9 aa, Homo Sapiens
FGVKAPPGL

SEQ ID NO: 1373915 - protein, 9 aa, Homo Sapiens
ASKEQHYVR

SEQ ID NO: 1373916 - protein, 9 aa, Homo Sapiens
ILNGLGVTG

SEQ ID NO: 1373917 - protein, 9 aa, Homo Sapiens
VAIAITFIL

SEQ ID NO: 1373918 - protein, 9 aa, Homo Sapiens
AELVEFYQQ

SEQ ID NO: 1373919 - protein, 9 aa, Homo Sapiens
GHAAICPQL

SEQ ID NO: 1373920 - protein, 9 aa, Homo Sapiens
YTATTAPSV

SEQ ID NO: 1373921 - protein, 9 aa, Homo Sapiens
IMWGLDKAS

SEQ ID NO: 1373922 - protein, 9 aa, Homo Sapiens
CSSVELTGM

SEQ ID NO: 1373923 - protein, 9 aa, Homo Sapiens
NTFAELTGL

SEQ ID NO: 1373924 - protein, 9 aa, Homo Sapiens
ADAISLDGG

SEQ ID NO: 1373925 - protein, 9 aa, Homo Sapiens
VGPVQVGKE

SEQ ID NO: 1373926 - protein, 9 aa, Homo Sapiens
KPDGSPVFV

SEQ ID NO: 1373927 - protein, 9 aa, Homo Sapiens
PSVLTALGR

SEQ ID NO: 1373928 - protein, 9 aa, Homo Sapiens
EKANKAITD

SEQ ID NO: 1373929 - protein, 9 aa, Homo Sapiens
SEEYFATNF

SEQ ID NO: 1373930 - protein, 9 aa, Homo Sapiens
AAVGRAWGL

SEQ ID NO: 1373931 - protein, 9 aa, Homo Sapiens
CTKATETFK

SEQ ID NO: 1373932 - protein, 9 aa, Homo Sapiens
SLFAQVRRS

SEQ ID NO: 1373933 - protein, 9 aa, Homo Sapiens
IDLRFCHLC

SEQ ID NO: 1373934 - protein, 9 aa, Homo Sapiens
AGGPPGNEH

SEQ ID NO: 1373935 - protein, 9 aa, Homo Sapiens
DQFDFLIDV

SEQ ID NO: 1373936 - protein, 9 aa, Homo Sapiens
PGPRQPSVA

SEQ ID NO: 1373937 - protein, 9 aa, Homo Sapiens
TRSYEIASL

SEQ ID NO: 1373938 - protein, 9 aa, Homo Sapiens
GYPLSWMKE

SEQ ID NO: 1373939 - protein, 9 aa, Homo Sapiens
EEEPPLEKL

SEQ ID NO: 1373940 - protein, 9 aa, Homo Sapiens
RGHHTLLTE

SEQ ID NO: 1373941 - protein, 9 aa, Homo Sapiens
QPLLIRRNA

SEQ ID NO: 1373942 - protein, 9 aa, Homo Sapiens
EPSTVRLDP

SEQ ID NO: 1373943 - protein, 9 aa, Homo Sapiens
LAARALRAR

SEQ ID NO: 1373944 - protein, 9 aa, Homo Sapiens
PTTVTHRMA

SEQ ID NO: 1373945 - protein, 9 aa, Homo Sapiens
NSQINLELY

SEQ ID NO: 1373946 - protein, 9 aa, Homo Sapiens
VAVVLMPPE

SEQ ID NO: 1373947 - protein, 9 aa, Homo Sapiens
HRYINGRNS

SEQ ID NO: 1373948 - protein, 9 aa, Homo Sapiens
ELRELQRKG

SEQ ID NO: 1373949 - protein, 9 aa, Homo Sapiens
ISFTLLAGL

SEQ ID NO: 1373950 - protein, 9 aa, Homo Sapiens
HTAVRPAAR

SEQ ID NO: 1373951 - protein, 9 aa, Homo Sapiens
RERKNARAE

SEQ ID NO: 1373952 - protein, 9 aa, Homo Sapiens
VHGAELKDV

SEQ ID NO: 1373953 - protein, 9 aa, Homo Sapiens
QHQGPVHLV

SEQ ID NO: 1373954 - protein, 9 aa, Homo Sapiens
ELRPNPDGV

SEQ ID NO: 1373955 - protein, 9 aa, Homo Sapiens
EASSELFKF

SEQ ID NO: 1373956 - protein, 9 aa, Homo Sapiens
HKVADPWGG

SEQ ID NO: 1373957 - protein, 9 aa, Homo Sapiens
PGAPWRHGD

SEQ ID NO: 1373958 - protein, 9 aa, Homo Sapiens
RAVLVSCSS

SEQ ID NO: 1373959 - protein, 9 aa, Homo Sapiens
RSTANMDND

SEQ ID NO: 1373960 - protein, 9 aa, Homo Sapiens
IIRKTEYDS

SEQ ID NO: 1373961 - protein, 9 aa, Homo Sapiens
RPTGVGVYT

SEQ ID NO: 1373962 - protein, 9 aa, Homo Sapiens
ILRPPRTCD

SEQ ID NO: 1373963 - protein, 9 aa, Homo Sapiens
LLGPAGRPG

SEQ ID NO: 1373964 - protein, 9 aa, Homo Sapiens
SMDDEFELS

SEQ ID NO: 1373965 - protein, 9 aa, Homo Sapiens
NHVSRGDVH

SEQ ID NO: 1373966 - protein, 9 aa, Homo Sapiens
MNEHHEAIP

SEQ ID NO: 1373967 - protein, 9 aa, Homo Sapiens
GRWNDASCD

SEQ ID NO: 1373968 - protein, 9 aa, Homo Sapiens
HNGAYAMRL

SEQ ID NO: 1373969 - protein, 9 aa, Homo Sapiens
ISVKDTNDS

SEQ ID NO: 1373970 - protein, 9 aa, Homo Sapiens
PPPGQRVIH

SEQ ID NO: 1373971 - protein, 9 aa, Homo Sapiens
GERGQKSRD

SEQ ID NO: 1373972 - protein, 9 aa, Homo Sapiens
WGLDKASYE

SEQ ID NO: 1373973 - protein, 9 aa, Homo Sapiens
STANMDNDS

SEQ ID NO: 1373974 - protein, 9 aa, Homo Sapiens
CDEHRGGSP

SEQ ID NO: 1373975 - protein, 9 aa, Homo Sapiens
DPASSGEGC

SEQ ID NO: 1373976 - protein, 9 aa, Homo Sapiens
ISTPTDFLW

SEQ ID NO: 1373977 - protein, 9 aa, Homo Sapiens
VALYQGAYS

SEQ ID NO: 1373978 - protein, 9 aa, Homo Sapiens
LVSSPERPK

SEQ ID NO: 1373979 - protein, 9 aa, Homo Sapiens
GSGGKWRRQ

SEQ ID NO: 1373980 - protein, 9 aa, Homo Sapiens
SKACRKQQV

SEQ ID NO: 1373981 - protein, 9 aa, Homo Sapiens
SPLLTHQVF

SEQ ID NO: 1373982 - protein, 9 aa, Homo Sapiens
LEYFMKQIN

SEQ ID NO: 1373983 - protein, 9 aa, Homo Sapiens
PVQGTKIIL

SEQ ID NO: 1373984 - protein, 9 aa, Homo Sapiens
YASFKVDSS

SEQ ID NO: 1373985 - protein, 9 aa, Homo Sapiens
LVMLEIVTE

SEQ ID NO: 1373986 - protein, 9 aa, Homo Sapiens
PLGLHLFLL

SEQ ID NO: 1373987 - protein, 9 aa, Homo Sapiens
HAVLRGQNL

SEQ ID NO: 1373988 - protein, 9 aa, Homo Sapiens
AWIITGGPT

SEQ ID NO: 1373989 - protein, 9 aa, Homo Sapiens
VSASCRHGY

SEQ ID NO: 1373990 - protein, 9 aa, Homo Sapiens
QDQFSWEDV

SEQ ID NO: 1373991 - protein, 9 aa, Homo Sapiens
DSQCLVEAL

SEQ ID NO: 1373992 - protein, 9 aa, Homo Sapiens
LRSHTRTHL

SEQ ID NO: 1373993 - protein, 9 aa, Homo Sapiens
LTDTRRPPA

SEQ ID NO: 1373994 - protein, 9 aa, Homo Sapiens
HVGLGRLLA

SEQ ID NO: 1373995 - protein, 9 aa, Homo Sapiens
GGEVKSSTP

SEQ ID NO: 1373996 - protein, 9 aa, Homo Sapiens
VQSKQLDQI

SEQ ID NO: 1373997 - protein, 9 aa, Homo Sapiens
KTLSQRSAG

SEQ ID NO: 1373998 - protein, 9 aa, Homo Sapiens
GDSPLPVQP

SEQ ID NO: 1373999 - protein, 9 aa, Homo Sapiens
GRITEELLG

SEQ ID NO: 1374000 - protein, 9 aa, Homo Sapiens
EFKEPKARN

SEQ ID NO: 1374001 - protein, 9 aa, Homo Sapiens
FVQHACFGL

SEQ ID NO: 1374002 - protein, 9 aa, Homo Sapiens
MRSDVWREF

SEQ ID NO: 1374003 - protein, 9 aa, Homo Sapiens
GIHKVADPW

SEQ ID NO: 1374004 - protein, 9 aa, Homo Sapiens
LQSHRPPEA

SEQ ID NO: 1374005 - protein, 9 aa, Homo Sapiens
QRMIFIPSS

SEQ ID NO: 1374006 - protein, 9 aa, Homo Sapiens
MCNTDSIHW

SEQ ID NO: 1374007 - protein, 9 aa, Homo Sapiens
LGCVAELGG

SEQ ID NO: 1374008 - protein, 9 aa, Homo Sapiens
TGAQRQLGQ

SEQ ID NO: 1374009 - protein, 9 aa, Homo Sapiens
GLGRLLAPG

SEQ ID NO: 1374010 - protein, 9 aa, Homo Sapiens
HFPQVVKEC

SEQ ID NO: 1374011 - protein, 9 aa, Homo Sapiens
ILQIRGYVF

SEQ ID NO: 1374012 - protein, 9 aa, Homo Sapiens
FIKMTFIDL

SEQ ID NO: 1374013 - protein, 9 aa, Homo Sapiens
PASSASPAS

SEQ ID NO: 1374014 - protein, 9 aa, Homo Sapiens
RSLRPGAEN

SEQ ID NO: 1374015 - protein, 9 aa, Homo Sapiens
ISLQPLPTR

SEQ ID NO: 1374016 - protein, 9 aa, Homo Sapiens
VRNPTPIPT

SEQ ID NO: 1374017 - protein, 9 aa, Homo Sapiens
SALGVGMPS

SEQ ID NO: 1374018 - protein, 9 aa, Homo Sapiens
EEKKREGIF

SEQ ID NO: 1374019 - protein, 9 aa, Homo Sapiens
EEERIRHSQ

SEQ ID NO: 1374020 - protein, 9 aa, Homo Sapiens
IFRTLQRVG

SEQ ID NO: 1374021 - protein, 9 aa, Homo Sapiens
LLRCSQNFC

SEQ ID NO: 1374022 - protein, 9 aa, Homo Sapiens
PDSPRSAFL

SEQ ID NO: 1374023 - protein, 9 aa, Homo Sapiens
RVSQRPFRD

SEQ ID NO: 1374024 - protein, 9 aa, Homo Sapiens
NHRHSHETG

SEQ ID NO: 1374025 - protein, 9 aa, Homo Sapiens
LSESQESHM

SEQ ID NO: 1374026 - protein, 9 aa, Homo Sapiens
TAGKVCVLD

SEQ ID NO: 1374027 - protein, 9 aa, Homo Sapiens
ASSIQQELY

SEQ ID NO: 1374028 - protein, 9 aa, Homo Sapiens
RQCKCGEVC

SEQ ID NO: 1374029 - protein, 9 aa, Homo Sapiens
HLLESSWSG

SEQ ID NO: 1374030 - protein, 9 aa, Homo Sapiens
SRWLQNALD

SEQ ID NO: 1374031 - protein, 9 aa, Homo Sapiens
RGEMGPLGQ

SEQ ID NO: 1374032 - protein, 9 aa, Homo Sapiens
DQEHRVGGP

SEQ ID NO: 1374033 - protein, 9 aa, Homo Sapiens
AVANGPSHS

SEQ ID NO: 1374034 - protein, 9 aa, Homo Sapiens
LVGMTPRDL

SEQ ID NO: 1374035 - protein, 9 aa, Homo Sapiens
GSEEPGGGP

SEQ ID NO: 1374036 - protein, 9 aa, Homo Sapiens
FGQIHHLKQ

SEQ ID NO: 1374037 - protein, 9 aa, Homo Sapiens
AETNQDNAS

SEQ ID NO: 1374038 - protein, 9 aa, Homo Sapiens
TTIFQLFSG

SEQ ID NO: 1374039 - protein, 9 aa, Homo Sapiens
LSYYEDRHP

SEQ ID NO: 1374040 - protein, 9 aa, Homo Sapiens
AYTGEKTYK

SEQ ID NO: 1374041 - protein, 9 aa, Homo Sapiens
KENLQPEGR

SEQ ID NO: 1374042 - protein, 9 aa, Homo Sapiens
KCDPDRLRA

SEQ ID NO: 1374043 - protein, 9 aa, Homo Sapiens
KQNNQTWNI

SEQ ID NO: 1374044 - protein, 9 aa, Homo Sapiens
TVAPTSSPA

SEQ ID NO: 1374045 - protein, 9 aa, Homo Sapiens
SQLPHPHPT

SEQ ID NO: 1374046 - protein, 9 aa, Homo Sapiens
RQPSRWPSS

SEQ ID NO: 1374047 - protein, 9 aa, Homo Sapiens
VDVGVYTRN

SEQ ID NO: 1374048 - protein, 9 aa, Homo Sapiens
VAAARAGAA

SEQ ID NO: 1374049 - protein, 9 aa, Homo Sapiens
ALPLRGGTG

SEQ ID NO: 1374050 - protein, 9 aa, Homo Sapiens
NSEPLTATA

SEQ ID NO: 1374051 - protein, 9 aa, Homo Sapiens
PQNYHIPAG

SEQ ID NO: 1374052 - protein, 9 aa, Homo Sapiens
ERLDCINGS

SEQ ID NO: 1374053 - protein, 9 aa, Homo Sapiens
GSGVCRLYV

SEQ ID NO: 1374054 - protein, 9 aa, Homo Sapiens
LSSSSRSLF

SEQ ID NO: 1374055 - protein, 9 aa, Homo Sapiens
AESVGDVYI

SEQ ID NO: 1374056 - protein, 9 aa, Homo Sapiens
RVHNRCSKD

SEQ ID NO: 1374057 - protein, 9 aa, Homo Sapiens
GGSGEAHDI

SEQ ID NO: 1374058 - protein, 9 aa, Homo Sapiens
PAGRPGLPG

SEQ ID NO: 1374059 - protein, 9 aa, Homo Sapiens
LGGQHTRGA

SEQ ID NO: 1374060 - protein, 9 aa, Homo Sapiens
LCALAISEI

SEQ ID NO: 1374061 - protein, 9 aa, Homo Sapiens
TEPTAWNET

SEQ ID NO: 1374062 - protein, 9 aa, Homo Sapiens
NGLRFVGRS

SEQ ID NO: 1374063 - protein, 9 aa, Homo Sapiens
ESEGMKAVL

SEQ ID NO: 1374064 - protein, 9 aa, Homo Sapiens
HRAHRESKV

SEQ ID NO: 1374065 - protein, 9 aa, Homo Sapiens
QGPMHGSSP

SEQ ID NO: 1374066 - protein, 9 aa, Homo Sapiens
AGRYFFRTE

SEQ ID NO: 1374067 - protein, 9 aa, Homo Sapiens
SPIPQPRLP

SEQ ID NO: 1374068 - protein, 9 aa, Homo Sapiens
LQVTPKVIF

SEQ ID NO: 1374069 - protein, 9 aa, Homo Sapiens
SMAPSTSAA

SEQ ID NO: 1374070 - protein, 9 aa, Homo Sapiens
ESQEELLHQ

SEQ ID NO: 1374071 - protein, 9 aa, Homo Sapiens
KVFGPTMVA

SEQ ID NO: 1374072 - protein, 9 aa, Homo Sapiens
WGKSFRSTR

SEQ ID NO: 1374073 - protein, 9 aa, Homo Sapiens
LRCMYRNAT

SEQ ID NO: 1374074 - protein, 9 aa, Homo Sapiens
AALIFYYVT

SEQ ID NO: 1374075 - protein, 9 aa, Homo Sapiens
ILDLCLDIL

SEQ ID NO: 1374076 - protein, 9 aa, Homo Sapiens
SPHHRVTDC

SEQ ID NO: 1374077 - protein, 9 aa, Homo Sapiens
VHAESGKVH

SEQ ID NO: 1374078 - protein, 9 aa, Homo Sapiens
AGEGAQEQV

SEQ ID NO: 1374079 - protein, 9 aa, Homo Sapiens
SAAAPGPLL

SEQ ID NO: 1374080 - protein, 9 aa, Homo Sapiens
SSKDDMGKN

SEQ ID NO: 1374081 - protein, 9 aa, Homo Sapiens
SAALVREVT

SEQ ID NO: 1374082 - protein, 9 aa, Homo Sapiens
TTRLPPCAT

SEQ ID NO: 1374083 - protein, 9 aa, Homo Sapiens
LRDREKQMS

SEQ ID NO: 1374084 - protein, 9 aa, Homo Sapiens
QMQQKGFSI

SEQ ID NO: 1374085 - protein, 9 aa, Homo Sapiens
NTIDVCNAV

SEQ ID NO: 1374086 - protein, 9 aa, Homo Sapiens
RSTGPLWKK

SEQ ID NO: 1374087 - protein, 9 aa, Homo Sapiens
CCCNRHSIV

SEQ ID NO: 1374088 - protein, 9 aa, Homo Sapiens
SQHFKKLFT

SEQ ID NO: 1374089 - protein, 9 aa, Homo Sapiens
IPLAKSTWL

SEQ ID NO: 1374090 - protein, 9 aa, Homo Sapiens
SPIGSVCYE

SEQ ID NO: 1374091 - protein, 9 aa, Homo Sapiens
WGRSGPWGK

SEQ ID NO: 1374092 - protein, 9 aa, Homo Sapiens
TNSVCQGQR

SEQ ID NO: 1374093 - protein, 9 aa, Homo Sapiens
MRVGAPPQN

SEQ ID NO: 1374094 - protein, 9 aa, Homo Sapiens
FLVLDLCFD

SEQ ID NO: 1374095 - protein, 9 aa, Homo Sapiens
VMDCPYHVF

SEQ ID NO: 1374096 - protein, 9 aa, Homo Sapiens
HRGGSPQTS

SEQ ID NO: 1374097 - protein, 9 aa, Homo Sapiens
WNPCQVPCS

SEQ ID NO: 1374098 - protein, 9 aa, Homo Sapiens
CIAGVGRTG

SEQ ID NO: 1374099 - protein, 9 aa, Homo Sapiens
EKHLMEKKI

SEQ ID NO: 1374100 - protein, 9 aa, Homo Sapiens
FVDVGVYTR

SEQ ID NO: 1374101 - protein, 9 aa, Homo Sapiens
LQDGSLDRN

SEQ ID NO: 1374102 - protein, 9 aa, Homo Sapiens
GTSGYLSPE

SEQ ID NO: 1374103 - protein, 9 aa, Homo Sapiens
SVSGDFGDG

SEQ ID NO: 1374104 - protein, 9 aa, Homo Sapiens
LPSMLREAA

SEQ ID NO: 1374105 - protein, 9 aa, Homo Sapiens
SKVIQWAPY

SEQ ID NO: 1374106 - protein, 9 aa, Homo Sapiens
LQLAICCCH

SEQ ID NO: 1374107 - protein, 9 aa, Homo Sapiens
SEFLWFQLA

SEQ ID NO: 1374108 - protein, 9 aa, Homo Sapiens
SDCYRYDSA

SEQ ID NO: 1374109 - protein, 9 aa, Homo Sapiens
QDWCQEGRH

SEQ ID NO: 1374110 - protein, 9 aa, Homo Sapiens
GGGPPTAPR

SEQ ID NO: 1374111 - protein, 9 aa, Homo Sapiens
SLVHSDALH

SEQ ID NO: 1374112 - protein, 9 aa, Homo Sapiens
MYVAIQAAL

SEQ ID NO: 1374113 - protein, 9 aa, Homo Sapiens
HQVQGRLFL

SEQ ID NO: 1374114 - protein, 9 aa, Homo Sapiens
QVFKNLQLF

SEQ ID NO: 1374115 - protein, 9 aa, Homo Sapiens
DTCQGDSDG

SEQ ID NO: 1374116 - protein, 9 aa, Homo Sapiens
VLSRNFVQH

SEQ ID NO: 1374117 - protein, 9 aa, Homo Sapiens
VRPAARASP

SEQ ID NO: 1374118 - protein, 9 aa, Homo Sapiens
EDPVLGEDE

SEQ ID NO: 1374119 - protein, 9 aa, Homo Sapiens
FLSSSSRSL

SEQ ID NO: 1374120 - protein, 9 aa, Homo Sapiens
QTQYRPIFP

SEQ ID NO: 1374121 - protein, 9 aa, Homo Sapiens
EVTRLLAEL

SEQ ID NO: 1374122 - protein, 9 aa, Homo Sapiens
TPPPLILWP

SEQ ID NO: 1374123 - protein, 9 aa, Homo Sapiens
EGHGGLRSG

SEQ ID NO: 1374124 - protein, 9 aa, Homo Sapiens
RVSSEYTYR

SEQ ID NO: 1374125 - protein, 8 aa, Homo Sapiens
ALRVTRNS

SEQ ID NO: 1374126 - protein, 9 aa, Homo Sapiens
AEPWQRREY

SEQ ID NO: 1374127 - protein, 9 aa, Homo Sapiens
LIHIQLADG

SEQ ID NO: 1374128 - protein, 9 aa, Homo Sapiens
TSVPSTTRR

SEQ ID NO: 1374129 - protein, 9 aa, Homo Sapiens
FFFFFFFFE

SEQ ID NO: 1374130 - protein, 9 aa, Homo Sapiens
TSGRITEEL

SEQ ID NO: 1374131 - protein, 9 aa, Homo Sapiens
EGKKRFRNA

SEQ ID NO: 1374132 - protein, 9 aa, Homo Sapiens
ATKKVFRVY

SEQ ID NO: 1374133 - protein, 9 aa, Homo Sapiens
VAAETADPL

SEQ ID NO: 1374134 - protein, 9 aa, Homo Sapiens
GAAALPHHL

SEQ ID NO: 1374135 - protein, 9 aa, Homo Sapiens
PTRSSPRLR

SEQ ID NO: 1374136 - protein, 9 aa, Homo Sapiens
SRKEAELII

SEQ ID NO: 1374137 - protein, 9 aa, Homo Sapiens
LECSGAISL

SEQ ID NO: 1374138 - protein, 9 aa, Homo Sapiens
PEQKRSRAQ

SEQ ID NO: 1374139 - protein, 9 aa, Homo Sapiens
CTGHPEPGV

SEQ ID NO: 1374140 - protein, 9 aa, Homo Sapiens
RGILEASSE

SEQ ID NO: 1374141 - protein, 9 aa, Homo Sapiens
GKPPAMRSG

SEQ ID NO: 1374142 - protein, 9 aa, Homo Sapiens
TSAAAWCPC

SEQ ID NO: 1374143 - protein, 9 aa, Homo Sapiens
GDGLASECL

SEQ ID NO: 1374144 - protein, 9 aa, Homo Sapiens
SEVTRLLAE

SEQ ID NO: 1374145 - protein, 9 aa, Homo Sapiens
RQPVLQARR

SEQ ID NO: 1374146 - protein, 9 aa, Homo Sapiens
LYNIGNVCH

SEQ ID NO: 1374147 - protein, 9 aa, Homo Sapiens
PSTSFFPHC

SEQ ID NO: 1374148 - protein, 9 aa, Homo Sapiens
CKYGSVTVW

SEQ ID NO: 1374149 - protein, 9 aa, Homo Sapiens
NSPHHRVTD

SEQ ID NO: 1374150 - protein, 9 aa, Homo Sapiens
EKKIMHYMC

SEQ ID NO: 1374151 - protein, 9 aa, Homo Sapiens
HHKQPETSN

SEQ ID NO: 1374152 - protein, 9 aa, Homo Sapiens
SAVSCQSRT

SEQ ID NO: 1374153 - protein, 9 aa, Homo Sapiens
VISTKDTMS

SEQ ID NO: 1374154 - protein, 9 aa, Homo Sapiens
GEAMAPAHV

SEQ ID NO: 1374155 - protein, 9 aa, Homo Sapiens
EDSGHYCCV

SEQ ID NO: 1374156 - protein, 9 aa, Homo Sapiens
AAAHSLPQQ

SEQ ID NO: 1374157 - protein, 9 aa, Homo Sapiens
FARAEGWDN

SEQ ID NO: 1374158 - protein, 9 aa, Homo Sapiens
SSGALEKEN

SEQ ID NO: 1374159 - protein, 9 aa, Homo Sapiens
GFRNALEGF

SEQ ID NO: 1374160 - protein, 9 aa, Homo Sapiens
IALGGYIIK

SEQ ID NO: 1374161 - protein, 9 aa, Homo Sapiens
KACSEGLYH

SEQ ID NO: 1374162 - protein, 9 aa, Homo Sapiens
REALNTKEV

SEQ ID NO: 1374163 - protein, 9 aa, Homo Sapiens
GPHSGATPL

SEQ ID NO: 1374164 - protein, 9 aa, Homo Sapiens
DSLEFEMRH

SEQ ID NO: 1374165 - protein, 9 aa, Homo Sapiens
ACYGGQLAA

SEQ ID NO: 1374166 - protein, 9 aa, Homo Sapiens
SPKRPPKEN

SEQ ID NO: 1374167 - protein, 9 aa, Homo Sapiens
LPLRGGTGV

SEQ ID NO: 1374168 - protein, 9 aa, Homo Sapiens
IERVSAETT

SEQ ID NO: 1374169 - protein, 9 aa, Homo Sapiens
AEEKANKAI

SEQ ID NO: 1374170 - protein, 9 aa, Homo Sapiens
TIAKRRVEL

SEQ ID NO: 1374171 - protein, 9 aa, Homo Sapiens
LKNLSEARY

SEQ ID NO: 1374172 - protein, 9 aa, Homo Sapiens
TGIRAHTLA

SEQ ID NO: 1374173 - protein, 9 aa, Homo Sapiens
YVECITSSI

SEQ ID NO: 1374174 - protein, 9 aa, Homo Sapiens
CGKAFKRPS

SEQ ID NO: 1374175 - protein, 9 aa, Homo Sapiens
PEAETNQDN

SEQ ID NO: 1374176 - protein, 9 aa, Homo Sapiens
FVNDQFWIY

SEQ ID NO: 1374177 - protein, 9 aa, Homo Sapiens
STIRVVGHM

SEQ ID NO: 1374178 - protein, 9 aa, Homo Sapiens
QACEQLARI

SEQ ID NO: 1374179 - protein, 9 aa, Homo Sapiens
RANCVIQRR

SEQ ID NO: 1374180 - protein, 9 aa, Homo Sapiens
STLEPVVAI

SEQ ID NO: 1374181 - protein, 9 aa, Homo Sapiens
EGPLLNHIA

SEQ ID NO: 1374182 - protein, 9 aa, Homo Sapiens
DSSKGPLTK

SEQ ID NO: 1374183 - protein, 9 aa, Homo Sapiens
STFGFRNAL

SEQ ID NO: 1374184 - protein, 9 aa, Homo Sapiens
PSVTWLKDD

SEQ ID NO: 1374185 - protein, 9 aa, Homo Sapiens
EQLHQLHSD

SEQ ID NO: 1374186 - protein, 9 aa, Homo Sapiens
RPGRRRKHP

SEQ ID NO: 1374187 - protein, 9 aa, Homo Sapiens
ANPCLILSL

SEQ ID NO: 1374188 - protein, 9 aa, Homo Sapiens
TMQARSFSD

SEQ ID NO: 1374189 - protein, 9 aa, Homo Sapiens
KTIDIQATN

SEQ ID NO: 1374190 - protein, 9 aa, Homo Sapiens
RCQSGSGFL

SEQ ID NO: 1374191 - protein, 9 aa, Homo Sapiens
PSTVRLDPR

SEQ ID NO: 1374192 - protein, 9 aa, Homo Sapiens
NGETSVGTA

SEQ ID NO: 1374193 - protein, 9 aa, Homo Sapiens
AAEIKNVLL

SEQ ID NO: 1374194 - protein, 9 aa, Homo Sapiens
LRLQDVSHN

SEQ ID NO: 1374195 - protein, 9 aa, Homo Sapiens
IHCVAKDPW

SEQ ID NO: 1374196 - protein, 9 aa, Homo Sapiens
PPPLILWPQ

SEQ ID NO: 1374197 - protein, 9 aa, Homo Sapiens
HLFVDVGVY

SEQ ID NO: 1374198 - protein, 9 aa, Homo Sapiens
LCAANGNPD

SEQ ID NO: 1374199 - protein, 9 aa, Homo Sapiens
KIDKACSEG

SEQ ID NO: 1374200 - protein, 9 aa, Homo Sapiens
TFLQLAICC

SEQ ID NO: 1374201 - protein, 9 aa, Homo Sapiens
KDPLQLLVE

SEQ ID NO: 1374202 - protein, 9 aa, Homo Sapiens
SPLPVQPRL

SEQ ID NO: 1374203 - protein, 9 aa, Homo Sapiens
QKEVSLTLS

SEQ ID NO: 1374204 - protein, 9 aa, Homo Sapiens
PVAAETADP

SEQ ID NO: 1374205 - protein, 9 aa, Homo Sapiens
PGSCPHGST

SEQ ID NO: 1374206 - protein, 9 aa, Homo Sapiens
GTVAGATAQ

SEQ ID NO: 1374207 - protein, 9 aa, Homo Sapiens
VRQGASIFQ

SEQ ID NO: 1374208 - protein, 9 aa, Homo Sapiens
QEGLGEDEG

SEQ ID NO: 1374209 - protein, 9 aa, Homo Sapiens
DILRPPRTC

SEQ ID NO: 1374210 - protein, 9 aa, Homo Sapiens
DGKKRERSR

SEQ ID NO: 1374211 - protein, 9 aa, Homo Sapiens
LRWSRGRVS

SEQ ID NO: 1374212 - protein, 9 aa, Homo Sapiens
GGPEQQAER

SEQ ID NO: 1374213 - protein, 9 aa, Homo Sapiens
ISQKKPKKQ

SEQ ID NO: 1374214 - protein, 9 aa, Homo Sapiens
DPLLTSKVN

SEQ ID NO: 1374215 - protein, 9 aa, Homo Sapiens
CYGGQLAAL

SEQ ID NO: 1374216 - protein, 9 aa, Homo Sapiens
CRVELAEKH

SEQ ID NO: 1374217 - protein, 9 aa, Homo Sapiens
SVLTALGRS

SEQ ID NO: 1374218 - protein, 9 aa, Homo Sapiens
MSAVAIANG

SEQ ID NO: 1374219 - protein, 9 aa, Homo Sapiens
FAAGVIRRL

SEQ ID NO: 1374220 - protein, 9 aa, Homo Sapiens
TPRGTQPCT

SEQ ID NO: 1374221 - protein, 9 aa, Homo Sapiens
VAEAGGAGE

SEQ ID NO: 1374222 - protein, 9 aa, Homo Sapiens
LPQMQYPDS

SEQ ID NO: 1374223 - protein, 9 aa, Homo Sapiens
IVKVPAKSM

SEQ ID NO: 1374224 - protein, 9 aa, Homo Sapiens
GPGRHPFRR

SEQ ID NO: 1374225 - protein, 9 aa, Homo Sapiens
RKCPPHLVE

SEQ ID NO: 1374226 - protein, 9 aa, Homo Sapiens
FSQQAISRT

SEQ ID NO: 1374227 - protein, 9 aa, Homo Sapiens
VRRNAFLVL

SEQ ID NO: 1374228 - protein, 9 aa, Homo Sapiens
SVLLLGVPQ

SEQ ID NO: 1374229 - protein, 9 aa, Homo Sapiens
AVPHRLATA

SEQ ID NO: 1374230 - protein, 9 aa, Homo Sapiens
VTPRDPLLH

SEQ ID NO: 1374231 - protein, 9 aa, Homo Sapiens
NNQIIVNTV

SEQ ID NO: 1374232 - protein, 9 aa, Homo Sapiens
HGNFLEDGE

SEQ ID NO: 1374233 - protein, 9 aa, Homo Sapiens
RRLRHSTLR

SEQ ID NO: 1374234 - protein, 9 aa, Homo Sapiens
GREEEPPLE

SEQ ID NO: 1374235 - protein, 9 aa, Homo Sapiens
APAMAEVST

SEQ ID NO: 1374236 - protein, 9 aa, Homo Sapiens
LKYSRYLSL

SEQ ID NO: 1374237 - protein, 9 aa, Homo Sapiens
SSDQNSRSS

SEQ ID NO: 1374238 - protein, 9 aa, Homo Sapiens
KPLAESPFK

SEQ ID NO: 1374239 - protein, 9 aa, Homo Sapiens
RSLRCSREC

SEQ ID NO: 1374240 - protein, 9 aa, Homo Sapiens
VVCNCFGFV

SEQ ID NO: 1374241 - protein, 9 aa, Homo Sapiens
TPTSDTPKV

SEQ ID NO: 1374242 - protein, 9 aa, Homo Sapiens
LDILNGVTR

SEQ ID NO: 1374243 - protein, 9 aa, Homo Sapiens
IESQEELLH

SEQ ID NO: 1374244 - protein, 9 aa, Homo Sapiens
GHPSSNGRP

SEQ ID NO: 1374245 - protein, 9 aa, Homo Sapiens
DFARAEGWD

SEQ ID NO: 1374246 - protein, 9 aa, Homo Sapiens
VAIQAALSL

SEQ ID NO: 1374247 - protein, 9 aa, Homo Sapiens
EATITRSTG

SEQ ID NO: 1374248 - protein, 9 aa, Homo Sapiens
HLCDAPQDS

SEQ ID NO: 1374249 - protein, 9 aa, Homo Sapiens
GRLISHMGS

SEQ ID NO: 1374250 - protein, 9 aa, Homo Sapiens
IRDRVMHAF

SEQ ID NO: 1374251 - protein, 9 aa, Homo Sapiens
HTGQKPHKC

SEQ ID NO: 1374252 - protein, 9 aa, Homo Sapiens
SHVALYQGA

SEQ ID NO: 1374253 - protein, 9 aa, Homo Sapiens
FIVSGSLSV

SEQ ID NO: 1374254 - protein, 9 aa, Homo Sapiens
WLPAKALRT

SEQ ID NO: 1374255 - protein, 9 aa, Homo Sapiens
ASSGASSPT

SEQ ID NO: 1374256 - protein, 9 aa, Homo Sapiens
GHHHGQHTH

SEQ ID NO: 1374257 - protein, 9 aa, Homo Sapiens
SQQVANENR

SEQ ID NO: 1374258 - protein, 9 aa, Homo Sapiens
SVQRLGRTS

SEQ ID NO: 1374259 - protein, 9 aa, Homo Sapiens
SQRLFSVRH

SEQ ID NO: 1374260 - protein, 9 aa, Homo Sapiens
RAFKPLAQV

SEQ ID NO: 1374261 - protein, 9 aa, Homo Sapiens
SFSRREGGG

SEQ ID NO: 1374262 - protein, 9 aa, Homo Sapiens
LAVGMSRGA

SEQ ID NO: 1374263 - protein, 9 aa, Homo Sapiens
SYSSNYLHW

SEQ ID NO: 1374264 - protein, 9 aa, Homo Sapiens
QERRREGRS

SEQ ID NO: 1374265 - protein, 9 aa, Homo Sapiens
EVHQTSGDE

SEQ ID NO: 1374266 - protein, 9 aa, Homo Sapiens
LKECFIKLP

SEQ ID NO: 1374267 - protein, 9 aa, Homo Sapiens
CSMSNTSVF

SEQ ID NO: 1374268 - protein, 9 aa, Homo Sapiens
STRHHKQPE

SEQ ID NO: 1374269 - protein, 9 aa, Homo Sapiens
SVWEKPIDL

SEQ ID NO: 1374270 - protein, 9 aa, Homo Sapiens
ADVLTCLLL

SEQ ID NO: 1374271 - protein, 9 aa, Homo Sapiens
QHFKKLFTS

SEQ ID NO: 1374272 - protein, 9 aa, Homo Sapiens
AKADEGRAD

SEQ ID NO: 1374273 - protein, 9 aa, Homo Sapiens
ALGRSQGLP

SEQ ID NO: 1374274 - protein, 9 aa, Homo Sapiens
EVFDLCMMV

SEQ ID NO: 1374275 - protein, 9 aa, Homo Sapiens
YSSLTTHRV

SEQ ID NO: 1374276 - protein, 9 aa, Homo Sapiens
MEPAHAWFE

SEQ ID NO: 1374277 - protein, 9 aa, Homo Sapiens
WSYSSNYLH

SEQ ID NO: 1374278 - protein, 9 aa, Homo Sapiens
VREVTGRTA

SEQ ID NO: 1374279 - protein, 9 aa, Homo Sapiens
SGYVTEDGD

SEQ ID NO: 1374280 - protein, 9 aa, Homo Sapiens
SKAAKLSKA

SEQ ID NO: 1374281 - protein, 9 aa, Homo Sapiens
VKQAVRRLN

SEQ ID NO: 1374282 - protein, 9 aa, Homo Sapiens
APAPQGPRT

SEQ ID NO: 1374283 - protein, 9 aa, Homo Sapiens
DPSRGVPIG

SEQ ID NO: 1374284 - protein, 9 aa, Homo Sapiens
FQLFPSKDQ

SEQ ID NO: 1374285 - protein, 9 aa, Homo Sapiens
FNSTYWVSL

SEQ ID NO: 1374286 - protein, 9 aa, Homo Sapiens
LVSCSSVEL

SEQ ID NO: 1374287 - protein, 9 aa, Homo Sapiens
TSHLKAHLH

SEQ ID NO: 1374288 - protein, 9 aa, Homo Sapiens
RFLRKKIKA

SEQ ID NO: 1374289 - protein, 9 aa, Homo Sapiens
VMVVRPVAT

SEQ ID NO: 1374290 - protein, 9 aa, Homo Sapiens
YHSVKMGRG

SEQ ID NO: 1374291 - protein, 9 aa, Homo Sapiens
FTASHIDIC

SEQ ID NO: 1374292 - protein, 9 aa, Homo Sapiens
GVYGQKQIL

SEQ ID NO: 1374293 - protein, 9 aa, Homo Sapiens
SMFFLMCCL

SEQ ID NO: 1374294 - protein, 9 aa, Homo Sapiens
GTSVVLQHE

SEQ ID NO: 1374295 - protein, 9 aa, Homo Sapiens
TYSDSQEDE

SEQ ID NO: 1374296 - protein, 9 aa, Homo Sapiens
DGVDGHHHG

SEQ ID NO: 1374297 - protein, 9 aa, Homo Sapiens
TPDLQRRRK

SEQ ID NO: 1374298 - protein, 9 aa, Homo Sapiens
PIVDDPYMT

SEQ ID NO: 1374299 - protein, 9 aa, Homo Sapiens
EADAISLDG

SEQ ID NO: 1374300 - protein, 9 aa, Homo Sapiens
GASEARLDT

SEQ ID NO: 1374301 - protein, 9 aa, Homo Sapiens
FVPPDIDRQ

SEQ ID NO: 1374302 - protein, 9 aa, Homo Sapiens
WYHNDVGLK

SEQ ID NO: 1374303 - protein, 9 aa, Homo Sapiens
FTQSILTRV

SEQ ID NO: 1374304 - protein, 9 aa, Homo Sapiens
TISSIQSQE

SEQ ID NO: 1374305 - protein, 9 aa, Homo Sapiens
VSQPLPRGF

SEQ ID NO: 1374306 - protein, 9 aa, Homo Sapiens
SEKKSSGAL

SEQ ID NO: 1374307 - protein, 9 aa, Homo Sapiens
NTVTGLCHR

SEQ ID NO: 1374308 - protein, 9 aa, Homo Sapiens
DPDRLRACQ

SEQ ID NO: 1374309 - protein, 9 aa, Homo Sapiens
CYRYDSATG

SEQ ID NO: 1374310 - protein, 9 aa, Homo Sapiens
GSLNPCPFP

SEQ ID NO: 1374311 - protein, 9 aa, Homo Sapiens
QQQRERKNA

SEQ ID NO: 1374312 - protein, 9 aa, Homo Sapiens
CPSSWCVAG

SEQ ID NO: 1374313 - protein, 9 aa, Homo Sapiens
RGAGTLAAR

SEQ ID NO: 1374314 - protein, 9 aa, Homo Sapiens
KTLSEEERE

SEQ ID NO: 1374315 - protein, 9 aa, Homo Sapiens
FDKKMSGGQ

SEQ ID NO: 1374316 - protein, 9 aa, Homo Sapiens
LNSRIIEIM

SEQ ID NO: 1374317 - protein, 9 aa, Homo Sapiens
LRKMQKGWW

SEQ ID NO: 1374318 - protein, 9 aa, Homo Sapiens
FSLRGNWWR

SEQ ID NO: 1374319 - protein, 9 aa, Homo Sapiens
FSESGPLGN

SEQ ID NO: 1374320 - protein, 9 aa, Homo Sapiens
YRHTPPCPA

SEQ ID NO: 1374321 - protein, 9 aa, Homo Sapiens
ARMPAQLFF

SEQ ID NO: 1374322 - protein, 9 aa, Homo Sapiens
QDARTGQSL

SEQ ID NO: 1374323 - protein, 9 aa, Homo Sapiens
PRSVVIQQP

SEQ ID NO: 1374324 - protein, 9 aa, Homo Sapiens
LYEPASPHW

SEQ ID NO: 1374325 - protein, 9 aa, Homo Sapiens
EDEIQAPHL

SEQ ID NO: 1374326 - protein, 9 aa, Homo Sapiens
VFRNEGREG

SEQ ID NO: 1374327 - protein, 9 aa, Homo Sapiens
AWAPTSRTP

SEQ ID NO: 1374328 - protein, 9 aa, Homo Sapiens
DPELQPTRS

SEQ ID NO: 1374329 - protein, 9 aa, Homo Sapiens
PSRAAFPTG

SEQ ID NO: 1374330 - protein, 9 aa, Homo Sapiens
FILTDNCLC

SEQ ID NO: 1374331 - protein, 9 aa, Homo Sapiens
VFRLSGPGM

SEQ ID NO: 1374332 - protein, 9 aa, Homo Sapiens
NHYHIGSGY

SEQ ID NO: 1374333 - protein, 9 aa, Homo Sapiens
GVLINSTRQ

SEQ ID NO: 1374334 - protein, 9 aa, Homo Sapiens
EKGSLSAMH

SEQ ID NO: 1374335 - protein, 9 aa, Homo Sapiens
HLSVWEKPI

SEQ ID NO: 1374336 - protein, 9 aa, Homo Sapiens
IQQIMKELN

SEQ ID NO: 1374337 - protein, 9 aa, Homo Sapiens
EEQGMGPEP

SEQ ID NO: 1374338 - protein, 9 aa, Homo Sapiens
FRKVGSFDP

SEQ ID NO: 1374339 - protein, 9 aa, Homo Sapiens
LQEQLRDRE

SEQ ID NO: 1374340 - protein, 9 aa, Homo Sapiens
VDVIAPRRA

SEQ ID NO: 1374341 - protein, 9 aa, Homo Sapiens
SPGEARAPL

SEQ ID NO: 1374342 - protein, 9 aa, Homo Sapiens
ICVTVGDAA

SEQ ID NO: 1374343 - protein, 9 aa, Homo Sapiens
NLVSLDIFQ

SEQ ID NO: 1374344 - protein, 9 aa, Homo Sapiens
GGEAFPFPN

SEQ ID NO: 1374345 - protein, 9 aa, Homo Sapiens
KTLNNHEDS

SEQ ID NO: 1374346 - protein, 9 aa, Homo Sapiens
FTNLLPSLA

SEQ ID NO: 1374347 - protein, 9 aa, Homo Sapiens
SLCGLEVAT

SEQ ID NO: 1374348 - protein, 9 aa, Homo Sapiens
RSDPVNHYH

SEQ ID NO: 1374349 - protein, 9 aa, Homo Sapiens
ENEPEAETN

SEQ ID NO: 1374350 - protein, 9 aa, Homo Sapiens
GACSDTGAS

SEQ ID NO: 1374351 - protein, 9 aa, Homo Sapiens
QAYKYMVKL

SEQ ID NO: 1374352 - protein, 9 aa, Homo Sapiens
PVRAPQTPP

SEQ ID NO: 1374353 - protein, 9 aa, Homo Sapiens
YHVFTHNTS

SEQ ID NO: 1374354 - protein, 9 aa, Homo Sapiens
AMLPKLLCR

SEQ ID NO: 1374355 - protein, 9 aa, Homo Sapiens
LETTANYTD

SEQ ID NO: 1374356 - protein, 9 aa, Homo Sapiens
GDWLAPVAW

SEQ ID NO: 1374357 - protein, 9 aa, Homo Sapiens
GFKTQEYPE

SEQ ID NO: 1374358 - protein, 9 aa, Homo Sapiens
RNTFAELTG

SEQ ID NO: 1374359 - protein, 9 aa, Homo Sapiens
PQSPATPVS

SEQ ID NO: 1374360 - protein, 9 aa, Homo Sapiens
YFRFDMNDA

SEQ ID NO: 1374361 - protein, 9 aa, Homo Sapiens
EAELIIQVT

SEQ ID NO: 1374362 - protein, 9 aa, Homo Sapiens
QRRLRHSTL

SEQ ID NO: 1374363 - protein, 9 aa, Homo Sapiens
GDDVTFPEL

SEQ ID NO: 1374364 - protein, 9 aa, Homo Sapiens
KKMDLDGML

SEQ ID NO: 1374365 - protein, 9 aa, Homo Sapiens
TTCTVLRNI

SEQ ID NO: 1374366 - protein, 9 aa, Homo Sapiens
RIPYTELPH

SEQ ID NO: 1374367 - protein, 9 aa, Homo Sapiens
PAPQGPRTR

SEQ ID NO: 1374368 - protein, 9 aa, Homo Sapiens
LSTWSASYT

SEQ ID NO: 1374369 - protein, 9 aa, Homo Sapiens
RDEYEFTES

SEQ ID NO: 1374370 - protein, 9 aa, Homo Sapiens
GGVCSSGIF

SEQ ID NO: 1374371 - protein, 9 aa, Homo Sapiens
SANDLESTS

SEQ ID NO: 1374372 - protein, 9 aa, Homo Sapiens
SPDWGGAVI

SEQ ID NO: 1374373 - protein, 9 aa, Homo Sapiens
LVKVRTDSD

SEQ ID NO: 1374374 - protein, 9 aa, Homo Sapiens
AGYLERVKR

SEQ ID NO: 1374375 - protein, 9 aa, Homo Sapiens
KMHHICFFL

SEQ ID NO: 1374376 - protein, 9 aa, Homo Sapiens
DKARKAKIR

SEQ ID NO: 1374377 - protein, 9 aa, Homo Sapiens
FGDGHHSVS

SEQ ID NO: 1374378 - protein, 9 aa, Homo Sapiens
KRQKQKVQR

SEQ ID NO: 1374379 - protein, 9 aa, Homo Sapiens
ADLCHQHAT

SEQ ID NO: 1374380 - protein, 9 aa, Homo Sapiens
VQVLQFQEE

SEQ ID NO: 1374381 - protein, 9 aa, Homo Sapiens
CLLTSSETG

SEQ ID NO: 1374382 - protein, 9 aa, Homo Sapiens
FSRNGVSPC

SEQ ID NO: 1374383 - protein, 9 aa, Homo Sapiens
PGAAGYCLP

SEQ ID NO: 1374384 - protein, 9 aa, Homo Sapiens
EGGCSRYSP

SEQ ID NO: 1374385 - protein, 9 aa, Homo Sapiens
LRNSPVRDE

SEQ ID NO: 1374386 - protein, 9 aa, Homo Sapiens
TSTAALIFY

SEQ ID NO: 1374387 - protein, 9 aa, Homo Sapiens
ELTEMDSSG

SEQ ID NO: 1374388 - protein, 9 aa, Homo Sapiens
WPPFRKVGS

SEQ ID NO: 1374389 - protein, 9 aa, Homo Sapiens
SRAQERRRE

SEQ ID NO: 1374390 - protein, 9 aa, Homo Sapiens
WLKLTPDLQ

SEQ ID NO: 1374391 - protein, 9 aa, Homo Sapiens
LSEARYKDL

SEQ ID NO: 1374392 - protein, 9 aa, Homo Sapiens
TITGAKPLK

SEQ ID NO: 1374393 - protein, 9 aa, Homo Sapiens
KVTKVLNFT

SEQ ID NO: 1374394 - protein, 9 aa, Homo Sapiens
TQLPCLQSA

SEQ ID NO: 1374395 - protein, 9 aa, Homo Sapiens
DYFRADGFA

SEQ ID NO: 1374396 - protein, 9 aa, Homo Sapiens
GGKNRHRGK

SEQ ID NO: 1374397 - protein, 9 aa, Homo Sapiens
KVKRNVTER

SEQ ID NO: 1374398 - protein, 9 aa, Homo Sapiens
RRNGERVNH

SEQ ID NO: 1374399 - protein, 9 aa, Homo Sapiens
KGSDGDGEC

SEQ ID NO: 1374400 - protein, 9 aa, Homo Sapiens
SLSPSGICL

SEQ ID NO: 1374401 - protein, 9 aa, Homo Sapiens
GNTVTGLCH

SEQ ID NO: 1374402 - protein, 9 aa, Homo Sapiens
PTPIPTPAR

SEQ ID NO: 1374403 - protein, 9 aa, Homo Sapiens
NAGRAVGGQ

SEQ ID NO: 1374404 - protein, 9 aa, Homo Sapiens
CPMVLKVVG

SEQ ID NO: 1374405 - protein, 9 aa, Homo Sapiens
PRQPSVASS

SEQ ID NO: 1374406 - protein, 9 aa, Homo Sapiens
AGLAQNKEW

SEQ ID NO: 1374407 - protein, 9 aa, Homo Sapiens
EEAAGPTAD

SEQ ID NO: 1374408 - protein, 9 aa, Homo Sapiens
FIESHACRR

SEQ ID NO: 1374409 - protein, 9 aa, Homo Sapiens
QQTPNGAVR

SEQ ID NO: 1374410 - protein, 9 aa, Homo Sapiens
LQEEPEHSK

SEQ ID NO: 1374411 - protein, 9 aa, Homo Sapiens
GMKAVLRTS

SEQ ID NO: 1374412 - protein, 9 aa, Homo Sapiens
LAFYQCAKS

SEQ ID NO: 1374413 - protein, 9 aa, Homo Sapiens
DTAATVEDM

SEQ ID NO: 1374414 - protein, 9 aa, Homo Sapiens
AQMCASLSL

SEQ ID NO: 1374415 - protein, 9 aa, Homo Sapiens
EQQEAESGS

SEQ ID NO: 1374416 - protein, 9 aa, Homo Sapiens
QLMLLFLIL

SEQ ID NO: 1374417 - protein, 9 aa, Homo Sapiens
GILRCTHLA

SEQ ID NO: 1374418 - protein, 9 aa, Homo Sapiens
SVLRKLFDQ

SEQ ID NO: 1374419 - protein, 9 aa, Homo Sapiens
TEQVRGYDF

SEQ ID NO: 1374420 - protein, 9 aa, Homo Sapiens
LGYDILGSI

SEQ ID NO: 1374421 - protein, 9 aa, Homo Sapiens
LTGLSPGVT

SEQ ID NO: 1374422 - protein, 9 aa, Homo Sapiens
RFLSLEQYL

SEQ ID NO: 1374423 - protein, 9 aa, Homo Sapiens
LNGPSSGRG

SEQ ID NO: 1374424 - protein, 9 aa, Homo Sapiens
QSSLVLAEY

SEQ ID NO: 1374425 - protein, 9 aa, Homo Sapiens
VMRKQGSRV

SEQ ID NO: 1374426 - protein, 9 aa, Homo Sapiens
RKGRVVSNG

SEQ ID NO: 1374427 - protein, 9 aa, Homo Sapiens
DRRECMLAS

SEQ ID NO: 1374428 - protein, 9 aa, Homo Sapiens
TRVNNDNAS

SEQ ID NO: 1374429 - protein, 9 aa, Homo Sapiens
PDFKIRCTE

SEQ ID NO: 1374430 - protein, 9 aa, Homo Sapiens
RCTHLAAMD

SEQ ID NO: 1374431 - protein, 9 aa, Homo Sapiens
KQQFLSSSS

SEQ ID NO: 1374432 - protein, 9 aa, Homo Sapiens
HTQMQQKGF

SEQ ID NO: 1374433 - protein, 9 aa, Homo Sapiens
KQINDAHHG

SEQ ID NO: 1374434 - protein, 9 aa, Homo Sapiens
VQCDEQGMA

SEQ ID NO: 1374435 - protein, 9 aa, Homo Sapiens
QTSSTARPS

SEQ ID NO: 1374436 - protein, 9 aa, Homo Sapiens
ETREEPTEI

SEQ ID NO: 1374437 - protein, 9 aa, Homo Sapiens
ALIFYYVTG

SEQ ID NO: 1374438 - protein, 9 aa, Homo Sapiens
FSTGIRAHT

SEQ ID NO: 1374439 - protein, 9 aa, Homo Sapiens
PTLRARDQT

SEQ ID NO: 1374440 - protein, 9 aa, Homo Sapiens
DKLTVGKRN

SEQ ID NO: 1374441 - protein, 9 aa, Homo Sapiens
GETSVGTAR

SEQ ID NO: 1374442 - protein, 9 aa, Homo Sapiens
DAIVSRDTS

SEQ ID NO: 1374443 - protein, 9 aa, Homo Sapiens
LQQCVASSI

SEQ ID NO: 1374444 - protein, 9 aa, Homo Sapiens
GAKSLIERY

SEQ ID NO: 1374445 - protein, 9 aa, Homo Sapiens
TVECLYSQD

SEQ ID NO: 1374446 - protein, 9 aa, Homo Sapiens
VTERKDHRP

SEQ ID NO: 1374447 - protein, 9 aa, Homo Sapiens
AQTVASFNI

SEQ ID NO: 1374448 - protein, 9 aa, Homo Sapiens
SRCGPGSQL

SEQ ID NO: 1374449 - protein, 9 aa, Homo Sapiens
EMDRAPRSG

SEQ ID NO: 1374450 - protein, 9 aa, Homo Sapiens
HCRNPDGDV

SEQ ID NO: 1374451 - protein, 9 aa, Homo Sapiens
AGHVLAPKD

SEQ ID NO: 1374452 - protein, 9 aa, Homo Sapiens
GHLKGAFAA

SEQ ID NO: 1374453 - protein, 9 aa, Homo Sapiens
KCAVDIGGL

SEQ ID NO: 1374454 - protein, 9 aa, Homo Sapiens
LKSGEVKKQ

SEQ ID NO: 1374455 - protein, 9 aa, Homo Sapiens
RDSHRSQPE

SEQ ID NO: 1374456 - protein, 9 aa, Homo Sapiens
AFIAHPKAV

SEQ ID NO: 1374457 - protein, 9 aa, Homo Sapiens
SGPEPENFS

SEQ ID NO: 1374458 - protein, 9 aa, Homo Sapiens
ELPDSPRSA

SEQ ID NO: 1374459 - protein, 9 aa, Homo Sapiens
EVYLDPTDA

SEQ ID NO: 1374460 - protein, 9 aa, Homo Sapiens
LLFLFFTLL

SEQ ID NO: 1374461 - protein, 9 aa, Homo Sapiens
NLQVWGSDY

SEQ ID NO: 1374462 - protein, 9 aa, Homo Sapiens
MAGLAQNKE

SEQ ID NO: 1374463 - protein, 9 aa, Homo Sapiens
EALLRVTVL

SEQ ID NO: 1374464 - protein, 9 aa, Homo Sapiens
LRVTVLTSL

SEQ ID NO: 1374465 - protein, 9 aa, Homo Sapiens
SISRESALY

SEQ ID NO: 1374466 - protein, 9 aa, Homo Sapiens
SGRWNDASC

SEQ ID NO: 1374467 - protein, 9 aa, Homo Sapiens
GLKWQHHEI

SEQ ID NO: 1374468 - protein, 9 aa, Homo Sapiens
YMEMHYGHQ

SEQ ID NO: 1374469 - protein, 9 aa, Homo Sapiens
NPCLILSLD

SEQ ID NO: 1374470 - protein, 9 aa, Homo Sapiens
APAAARPFG

SEQ ID NO: 1374471 - protein, 9 aa, Homo Sapiens
KEPGSGVSV

SEQ ID NO: 1374472 - protein, 9 aa, Homo Sapiens
ELLRYLVDE

SEQ ID NO: 1374473 - protein, 9 aa, Homo Sapiens
TLLLDMARH

SEQ ID NO: 1374474 - protein, 9 aa, Homo Sapiens
MLPKLLCRQ

SEQ ID NO: 1374475 - protein, 9 aa, Homo Sapiens
TEYQVQGGL

SEQ ID NO: 1374476 - protein, 9 aa, Homo Sapiens
ECITSSIHS

SEQ ID NO: 1374477 - protein, 9 aa, Homo Sapiens
QVDVGRDGQ

SEQ ID NO: 1374478 - protein, 9 aa, Homo Sapiens
AGYERFMPK

SEQ ID NO: 1374479 - protein, 9 aa, Homo Sapiens
IPGLEAIYL

SEQ ID NO: 1374480 - protein, 9 aa, Homo Sapiens
SPRQWLRPQ

SEQ ID NO: 1374481 - protein, 9 aa, Homo Sapiens
LGKMSFLRR

SEQ ID NO: 1374482 - protein, 9 aa, Homo Sapiens
FAQVRRSAA

SEQ ID NO: 1374483 - protein, 9 aa, Homo Sapiens
TVRISHTLY

SEQ ID NO: 1374484 - protein, 9 aa, Homo Sapiens
KEVIGHGSK

SEQ ID NO: 1374485 - protein, 9 aa, Homo Sapiens
LPRLSKGSP

SEQ ID NO: 1374486 - protein, 9 aa, Homo Sapiens
AVSEGTKAG

SEQ ID NO: 1374487 - protein, 9 aa, Homo Sapiens
IKAQKMCEE

SEQ ID NO: 1374488 - protein, 9 aa, Homo Sapiens
DPVEIKVVK

SEQ ID NO: 1374489 - protein, 9 aa, Homo Sapiens
SAASRRASW

SEQ ID NO: 1374490 - protein, 9 aa, Homo Sapiens
AGRGRPGAG

SEQ ID NO: 1374491 - protein, 9 aa, Homo Sapiens
GSLSPSGIC

SEQ ID NO: 1374492 - protein, 9 aa, Homo Sapiens
SNCTPGHTP

SEQ ID NO: 1374493 - protein, 9 aa, Homo Sapiens
PSRALFMVT

SEQ ID NO: 1374494 - protein, 9 aa, Homo Sapiens
VVNVEDAND

SEQ ID NO: 1374495 - protein, 9 aa, Homo Sapiens
GILEASSEL

SEQ ID NO: 1374496 - protein, 9 aa, Homo Sapiens
RRCSQAVAN

SEQ ID NO: 1374497 - protein, 9 aa, Homo Sapiens
ANCVIQRRA

SEQ ID NO: 1374498 - protein, 9 aa, Homo Sapiens
LDTDGIHPL

SEQ ID NO: 1374499 - protein, 9 aa, Homo Sapiens
QEDAHMLDI

SEQ ID NO: 1374500 - protein, 9 aa, Homo Sapiens
HRPPEAPLH

SEQ ID NO: 1374501 - protein, 9 aa, Homo Sapiens
SSSSGPMGV

SEQ ID NO: 1374502 - protein, 9 aa, Homo Sapiens
EPAGQHAEP

SEQ ID NO: 1374503 - protein, 9 aa, Homo Sapiens
RGDVRRHPA

SEQ ID NO: 1374504 - protein, 9 aa, Homo Sapiens
PLPGEPQPP

SEQ ID NO: 1374505 - protein, 9 aa, Homo Sapiens
VGEGQGAME

SEQ ID NO: 1374506 - protein, 9 aa, Homo Sapiens
PEEAAGPTA

SEQ ID NO: 1374507 - protein, 9 aa, Homo Sapiens
ESASKEQHY

SEQ ID NO: 1374508 - protein, 9 aa, Homo Sapiens
GQLLSERLL

SEQ ID NO: 1374509 - protein, 9 aa, Homo Sapiens
PQSHGGPPK

SEQ ID NO: 1374510 - protein, 9 aa, Homo Sapiens
SEGSGVCRL

SEQ ID NO: 1374511 - protein, 9 aa, Homo Sapiens
LMRDPERRW

SEQ ID NO: 1374512 - protein, 9 aa, Homo Sapiens
LYSSGRNRV

SEQ ID NO: 1374513 - protein, 9 aa, Homo Sapiens
KLRKDIHQE

SEQ ID NO: 1374514 - protein, 9 aa, Homo Sapiens
VKPNLQALR

SEQ ID NO: 1374515 - protein, 9 aa, Homo Sapiens
VTLRMVLLC

SEQ ID NO: 1374516 - protein, 9 aa, Homo Sapiens
RGYPRPGAH

SEQ ID NO: 1374517 - protein, 9 aa, Homo Sapiens
NLLPSLAYE

SEQ ID NO: 1374518 - protein, 9 aa, Homo Sapiens
LSSTVKQAV

SEQ ID NO: 1374519 - protein, 9 aa, Homo Sapiens
SSSDCYRYD

SEQ ID NO: 1374520 - protein, 9 aa, Homo Sapiens
RVDAEDEEG

SEQ ID NO: 1374521 - protein, 9 aa, Homo Sapiens
EQRMIFIPS

SEQ ID NO: 1374522 - protein, 9 aa, Homo Sapiens
KCEECEKGF

SEQ ID NO: 1374523 - protein, 9 aa, Homo Sapiens
TGGSGEAHD

SEQ ID NO: 1374524 - protein, 9 aa, Homo Sapiens
VLSGVPLLC

SEQ ID NO: 1374525 - protein, 9 aa, Homo Sapiens
QRVGVYGQK

SEQ ID NO: 1374526 - protein, 9 aa, Homo Sapiens
FGFAGTSGY

SEQ ID NO: 1374527 - protein, 9 aa, Homo Sapiens
KKQECLEVQ

SEQ ID NO: 1374528 - protein, 9 aa, Homo Sapiens
RLETSPTEG

SEQ ID NO: 1374529 - protein, 9 aa, Homo Sapiens
VAELGGHTA

SEQ ID NO: 1374530 - protein, 9 aa, Homo Sapiens
RAEGWDNEE

SEQ ID NO: 1374531 - protein, 9 aa, Homo Sapiens
CLEVQRQLA

SEQ ID NO: 1374532 - protein, 9 aa, Homo Sapiens
GIHGPPLRV

SEQ ID NO: 1374533 - protein, 9 aa, Homo Sapiens
SDDKPERNC

SEQ ID NO: 1374534 - protein, 9 aa, Homo Sapiens
KSLRHPLGR

SEQ ID NO: 1374535 - protein, 9 aa, Homo Sapiens
ERIPVPCVN

SEQ ID NO: 1374536 - protein, 9 aa, Homo Sapiens
FSVRHRSLH

SEQ ID NO: 1374537 - protein, 9 aa, Homo Sapiens
QTVASFNIT

SEQ ID NO: 1374538 - protein, 9 aa, Homo Sapiens
KITALPNVT

SEQ ID NO: 1374539 - protein, 9 aa, Homo Sapiens
STGIRAHTL

SEQ ID NO: 1374540 - protein, 9 aa, Homo Sapiens
RHPQGPCPP

SEQ ID NO: 1374541 - protein, 9 aa, Homo Sapiens
AASWLVCLC

SEQ ID NO: 1374542 - protein, 9 aa, Homo Sapiens
RCICKFLDE

SEQ ID NO: 1374543 - protein, 9 aa, Homo Sapiens
LFLCALAIS

SEQ ID NO: 1374544 - protein, 9 aa, Homo Sapiens
IRGPWPPGP

SEQ ID NO: 1374545 - protein, 9 aa, Homo Sapiens
PLELPLLLN

SEQ ID NO: 1374546 - protein, 9 aa, Homo Sapiens
MDQIRNWQH

SEQ ID NO: 1374547 - protein, 9 aa, Homo Sapiens
LLCRQMLPT

SEQ ID NO: 1374548 - protein, 9 aa, Homo Sapiens
HVGKDSRGL

SEQ ID NO: 1374549 - protein, 9 aa, Homo Sapiens
PAFYELQHR

SEQ ID NO: 1374550 - protein, 9 aa, Homo Sapiens
ALRNGSRKC

SEQ ID NO: 1374551 - protein, 9 aa, Homo Sapiens
REPIPGLEA

SEQ ID NO: 1374552 - protein, 9 aa, Homo Sapiens
SSTPPLILT

SEQ ID NO: 1374553 - protein, 9 aa, Homo Sapiens
LLVLDEDLA

SEQ ID NO: 1374554 - protein, 9 aa, Homo Sapiens
ESHVESASS

SEQ ID NO: 1374555 - protein, 9 aa, Homo Sapiens
HHVLFIALA

SEQ ID NO: 1374556 - protein, 9 aa, Homo Sapiens
PGNLNTNMN

SEQ ID NO: 1374557 - protein, 9 aa, Homo Sapiens
AGYCLPLGL

SEQ ID NO: 1374558 - protein, 9 aa, Homo Sapiens
RLFSVRHRS

SEQ ID NO: 1374559 - protein, 9 aa, Homo Sapiens
PRGAEADCM

SEQ ID NO: 1374560 - protein, 9 aa, Homo Sapiens
RLPPCATRW

SEQ ID NO: 1374561 - protein, 9 aa, Homo Sapiens
NLLLDADVC

SEQ ID NO: 1374562 - protein, 9 aa, Homo Sapiens
RKRQKQKVQ

SEQ ID NO: 1374563 - protein, 9 aa, Homo Sapiens
WRAQATPDR

SEQ ID NO: 1374564 - protein, 9 aa, Homo Sapiens
SSPIGLGGQ

SEQ ID NO: 1374565 - protein, 9 aa, Homo Sapiens
LGSPLMSEF

SEQ ID NO: 1374566 - protein, 9 aa, Homo Sapiens
VISTPTDFL

SEQ ID NO: 1374567 - protein, 9 aa, Homo Sapiens
GGSLNGPSS

SEQ ID NO: 1374568 - protein, 9 aa, Homo Sapiens
LRCQSGSGF

SEQ ID NO: 1374569 - protein, 9 aa, Homo Sapiens
TQMQQKGFS

SEQ ID NO: 1374570 - protein, 9 aa, Homo Sapiens
KTKTKSWPL

SEQ ID NO: 1374571 - protein, 9 aa, Homo Sapiens
VVWFPLKIA

SEQ ID NO: 1374572 - protein, 9 aa, Homo Sapiens
PATPVSGPV

SEQ ID NO: 1374573 - protein, 9 aa, Homo Sapiens
HVLFIALAL

SEQ ID NO: 1374574 - protein, 9 aa, Homo Sapiens
NISNHGDLS

SEQ ID NO: 1374575 - protein, 9 aa, Homo Sapiens
KEQVDASSC

SEQ ID NO: 1374576 - protein, 9 aa, Homo Sapiens
ELQPPGDCP

SEQ ID NO: 1374577 - protein, 9 aa, Homo Sapiens
PTFVIYCGM

SEQ ID NO: 1374578 - protein, 9 aa, Homo Sapiens
TNFNEKISI

SEQ ID NO: 1374579 - protein, 9 aa, Homo Sapiens
GPSSGRGSG

SEQ ID NO: 1374580 - protein, 9 aa, Homo Sapiens
PPCATRWPP

SEQ ID NO: 1374581 - protein, 9 aa, Homo Sapiens
NRLSMSESV

SEQ ID NO: 1374582 - protein, 9 aa, Homo Sapiens
HASGTSVMR

SEQ ID NO: 1374583 - protein, 9 aa, Homo Sapiens
DLTYSAICK

SEQ ID NO: 1374584 - protein, 9 aa, Homo Sapiens
VCKNNPNMS

SEQ ID NO: 1374585 - protein, 9 aa, Homo Sapiens
FQLHPQPVT

SEQ ID NO: 1374586 - protein, 9 aa, Homo Sapiens
ARPACAPVL

SEQ ID NO: 1374587 - protein, 9 aa, Homo Sapiens
QLAGDKRDA

SEQ ID NO: 1374588 - protein, 9 aa, Homo Sapiens
IPYTELPHI

SEQ ID NO: 1374589 - protein, 9 aa, Homo Sapiens
IFNLADTHP

SEQ ID NO: 1374590 - protein, 9 aa, Homo Sapiens
CHLSTVVAL

SEQ ID NO: 1374591 - protein, 9 aa, Homo Sapiens
VQVFTLPTP

SEQ ID NO: 1374592 - protein, 9 aa, Homo Sapiens
PRVDAEDEE

SEQ ID NO: 1374593 - protein, 9 aa, Homo Sapiens
NWWRKSWGR

SEQ ID NO: 1374594 - protein, 9 aa, Homo Sapiens
RTQERAAAA

SEQ ID NO: 1374595 - protein, 9 aa, Homo Sapiens
TALPNVTFL

SEQ ID NO: 1374596 - protein, 9 aa, Homo Sapiens
SGGGSGSSS

SEQ ID NO: 1374597 - protein, 9 aa, Homo Sapiens
KAVPVPQVI

SEQ ID NO: 1374598 - protein, 9 aa, Homo Sapiens
WGFLQIPTN

SEQ ID NO: 1374599 - protein, 9 aa, Homo Sapiens
LSPSSTSSS

SEQ ID NO: 1374600 - protein, 9 aa, Homo Sapiens
PANGSPPPL

SEQ ID NO: 1374601 - protein, 9 aa, Homo Sapiens
RAAHRRPTQ

SEQ ID NO: 1374602 - protein, 9 aa, Homo Sapiens
FAGTSGYLS

SEQ ID NO: 1374603 - protein, 9 aa, Homo Sapiens
KEQEKRREM

SEQ ID NO: 1374604 - protein, 9 aa, Homo Sapiens
WNCHRYING

SEQ ID NO: 1374605 - protein, 9 aa, Homo Sapiens
AAIELTLVL

SEQ ID NO: 1374606 - protein, 9 aa, Homo Sapiens
DKHKKLLWF

SEQ ID NO: 1374607 - protein, 9 aa, Homo Sapiens
DRHPKHEGI

SEQ ID NO: 1374608 - protein, 9 aa, Homo Sapiens
KFKTKTKSW

SEQ ID NO: 1374609 - protein, 9 aa, Homo Sapiens
HALSQFEGM

SEQ ID NO: 1374610 - protein, 9 aa, Homo Sapiens
PLRLCRQPL

SEQ ID NO: 1374611 - protein, 9 aa, Homo Sapiens
RDKAGMATH

SEQ ID NO: 1374612 - protein, 9 aa, Homo Sapiens
WKVKALDEI

SEQ ID NO: 1374613 - protein, 9 aa, Homo Sapiens
NKREEQGMG

SEQ ID NO: 1374614 - protein, 9 aa, Homo Sapiens
VLPSPAKEG

SEQ ID NO: 1374615 - protein, 9 aa, Homo Sapiens
CSIWSTCCS

SEQ ID NO: 1374616 - protein, 9 aa, Homo Sapiens
VFLEWKRWL

SEQ ID NO: 1374617 - protein, 9 aa, Homo Sapiens
TGRIACANV

SEQ ID NO: 1374618 - protein, 9 aa, Homo Sapiens
TPNVCSLCG

SEQ ID NO: 1374619 - protein, 9 aa, Homo Sapiens
LVRYSAKGP

SEQ ID NO: 1374620 - protein, 9 aa, Homo Sapiens
FDGGAGSVL

SEQ ID NO: 1374621 - protein, 9 aa, Homo Sapiens
SSTVKQAVR

SEQ ID NO: 1374622 - protein, 9 aa, Homo Sapiens
HVFTHNTSK

SEQ ID NO: 1374623 - protein, 9 aa, Homo Sapiens
WSPKERWEP

SEQ ID NO: 1374624 - protein, 9 aa, Homo Sapiens
YRHATFVDS

SEQ ID NO: 1374625 - protein, 9 aa, Homo Sapiens
CQNGERVEH

SEQ ID NO: 1374626 - protein, 9 aa, Homo Sapiens
SGGARWGPR

SEQ ID NO: 1374627 - protein, 9 aa, Homo Sapiens
CYVVVNFIT

SEQ ID NO: 1374628 - protein, 9 aa, Homo Sapiens
RGYVGWHPR

SEQ ID NO: 1374629 - protein, 9 aa, Homo Sapiens
EGHQMPQQP

SEQ ID NO: 1374630 - protein, 9 aa, Homo Sapiens
VTILNGLGV

SEQ ID NO: 1374631 - protein, 9 aa, Homo Sapiens
VYVVNIAET

SEQ ID NO: 1374632 - protein, 9 aa, Homo Sapiens
PPVQARDSG

SEQ ID NO: 1374633 - protein, 9 aa, Homo Sapiens
RAATAIMCG

SEQ ID NO: 1374634 - protein, 9 aa, Homo Sapiens
YGKEGVKTN

SEQ ID NO: 1374635 - protein, 9 aa, Homo Sapiens
STPGTRCSS

SEQ ID NO: 1374636 - protein, 9 aa, Homo Sapiens
MTYTNSVCQ

SEQ ID NO: 1374637 - protein, 9 aa, Homo Sapiens
LRVSLPEDR

SEQ ID NO: 1374638 - protein, 9 aa, Homo Sapiens
GAVANDQDL

SEQ ID NO: 1374639 - protein, 9 aa, Homo Sapiens
VVTAGKVCV

SEQ ID NO: 1374640 - protein, 9 aa, Homo Sapiens
SGRGRWVTS

SEQ ID NO: 1374641 - protein, 9 aa, Homo Sapiens
APIIGFVCG

SEQ ID NO: 1374642 - protein, 9 aa, Homo Sapiens
FVGGLSPGL

SEQ ID NO: 1374643 - protein, 9 aa, Homo Sapiens
GPHSHCLYY

SEQ ID NO: 1374644 - protein, 9 aa, Homo Sapiens
REAAIGTTP

SEQ ID NO: 1374645 - protein, 9 aa, Homo Sapiens
FKSARMPAQ

SEQ ID NO: 1374646 - protein, 9 aa, Homo Sapiens
EKNHCRNPD

SEQ ID NO: 1374647 - protein, 9 aa, Homo Sapiens
EEEKREVGA

SEQ ID NO: 1374648 - protein, 9 aa, Homo Sapiens
HSKGRDCRD

SEQ ID NO: 1374649 - protein, 9 aa, Homo Sapiens
QSLIWSRDQ

SEQ ID NO: 1374650 - protein, 9 aa, Homo Sapiens
SMLREAAIG

SEQ ID NO: 1374651 - protein, 9 aa, Homo Sapiens
CGPGSQLNT

SEQ ID NO: 1374652 - protein, 9 aa, Homo Sapiens
VPDVGSTWW

SEQ ID NO: 1374653 - protein, 9 aa, Homo Sapiens
DPYMTGRIA

SEQ ID NO: 1374654 - protein, 9 aa, Homo Sapiens
PRLSKGSPE

SEQ ID NO: 1374655 - protein, 9 aa, Homo Sapiens
VGRPGRRRK

SEQ ID NO: 1374656 - protein, 9 aa, Homo Sapiens
RGGFGGRRR

SEQ ID NO: 1374657 - protein, 9 aa, Homo Sapiens
RTEKGNIKW

SEQ ID NO: 1374658 - protein, 9 aa, Homo Sapiens
VLQPVKKRR

SEQ ID NO: 1374659 - protein, 9 aa, Homo Sapiens
IRNWQHSPV

SEQ ID NO: 1374660 - protein, 9 aa, Homo Sapiens
TATLFKSAR

SEQ ID NO: 1374661 - protein, 9 aa, Homo Sapiens
EVKRIRNIL

SEQ ID NO: 1374662 - protein, 9 aa, Homo Sapiens
QVEWRMSRL

SEQ ID NO: 1374663 - protein, 9 aa, Homo Sapiens
MEENLANRG

SEQ ID NO: 1374664 - protein, 9 aa, Homo Sapiens
AVRLSDSRI

SEQ ID NO: 1374665 - protein, 9 aa, Homo Sapiens
DPLLDLSLD

SEQ ID NO: 1374666 - protein, 9 aa, Homo Sapiens
QVWGSDYSH

SEQ ID NO: 1374667 - protein, 9 aa, Homo Sapiens
KSRLKTIDI

SEQ ID NO: 1374668 - protein, 9 aa, Homo Sapiens
MLCPLSTWS

SEQ ID NO: 1374669 - protein, 9 aa, Homo Sapiens
EDNAGRAVG

SEQ ID NO: 1374670 - protein, 9 aa, Homo Sapiens
TVLSPLVQP

SEQ ID NO: 1374671 - protein, 9 aa, Homo Sapiens
GQAFEYILY

SEQ ID NO: 1374672 - protein, 9 aa, Homo Sapiens
SEHNYCRLI

SEQ ID NO: 1374673 - protein, 9 aa, Homo Sapiens
FLQRSPIPQ

SEQ ID NO: 1374674 - protein, 9 aa, Homo Sapiens
LESDGLTSQ

SEQ ID NO: 1374675 - protein, 9 aa, Homo Sapiens
AWCPCIRGP

SEQ ID NO: 1374676 - protein, 9 aa, Homo Sapiens
MNKSDLNTH

SEQ ID NO: 1374677 - protein, 9 aa, Homo Sapiens
HFEELETSM

SEQ ID NO: 1374678 - protein, 9 aa, Homo Sapiens
GMTLEQQAA

SEQ ID NO: 1374679 - protein, 9 aa, Homo Sapiens
LTACLTEKG

SEQ ID NO: 1374680 - protein, 9 aa, Homo Sapiens
AHHWQEGLG

SEQ ID NO: 1374681 - protein, 9 aa, Homo Sapiens
QRQKMELDE

SEQ ID NO: 1374682 - protein, 9 aa, Homo Sapiens
FYCTKATET

SEQ ID NO: 1374683 - protein, 9 aa, Homo Sapiens
YNVGEKVFC

SEQ ID NO: 1374684 - protein, 9 aa, Homo Sapiens
CLPPPSLPL

SEQ ID NO: 1374685 - protein, 9 aa, Homo Sapiens
ELPLLLNGE

SEQ ID NO: 1374686 - protein, 9 aa, Homo Sapiens
SSEYPVRRH

SEQ ID NO: 1374687 - protein, 9 aa, Homo Sapiens
TRLHLESDG

SEQ ID NO: 1374688 - protein, 9 aa, Homo Sapiens
LEVFDLCMM

SEQ ID NO: 1374689 - protein, 9 aa, Homo Sapiens
HLVQQCVLL

SEQ ID NO: 1374690 - protein, 9 aa, Homo Sapiens
PAQLRCEME

SEQ ID NO: 1374691 - protein, 9 aa, Homo Sapiens
LSERLLRPN

SEQ ID NO: 1374692 - protein, 9 aa, Homo Sapiens
SELRTSHEA

SEQ ID NO: 1374693 - protein, 9 aa, Homo Sapiens
DASGDESIP

SEQ ID NO: 1374694 - protein, 9 aa, Homo Sapiens
EKIFKYGHY

SEQ ID NO: 1374695 - protein, 9 aa, Homo Sapiens
RYVASSLFL

SEQ ID NO: 1374696 - protein, 9 aa, Homo Sapiens
DLSHNSISR

SEQ ID NO: 1374697 - protein, 9 aa, Homo Sapiens
RPTLCPWTI

SEQ ID NO: 1374698 - protein, 9 aa, Homo Sapiens
QAPHLWGRS

SEQ ID NO: 1374699 - protein, 9 aa, Homo Sapiens
GRLDLQCAK

SEQ ID NO: 1374700 - protein, 9 aa, Homo Sapiens
AEMDRAPRS

SEQ ID NO: 1374701 - protein, 9 aa, Homo Sapiens
CAVCRESRE

SEQ ID NO: 1374702 - protein, 9 aa, Homo Sapiens
LLRNFEEVC

SEQ ID NO: 1374703 - protein, 9 aa, Homo Sapiens
PGDCPRTMA

SEQ ID NO: 1374704 - protein, 9 aa, Homo Sapiens
MFDRTTRLI

SEQ ID NO: 1374705 - protein, 9 aa, Homo Sapiens
RTEIIGRSW

SEQ ID NO: 1374706 - protein, 9 aa, Homo Sapiens
VAYPVRIGS

SEQ ID NO: 1374707 - protein, 9 aa, Homo Sapiens
LYHTAMYRN

SEQ ID NO: 1374708 - protein, 9 aa, Homo Sapiens
CALKSVFPP

SEQ ID NO: 1374709 - protein, 9 aa, Homo Sapiens
TQIMFETVN

SEQ ID NO: 1374710 - protein, 9 aa, Homo Sapiens
RIIGIMTRF

SEQ ID NO: 1374711 - protein, 9 aa, Homo Sapiens
YPRDRLRFT

SEQ ID NO: 1374712 - protein, 9 aa, Homo Sapiens
SASKEQHYV

SEQ ID NO: 1374713 - protein, 9 aa, Homo Sapiens
EKKAFRGLA

SEQ ID NO: 1374714 - protein, 9 aa, Homo Sapiens
PPPWGLQRT

SEQ ID NO: 1374715 - protein, 9 aa, Homo Sapiens
AAGSVGAGP

SEQ ID NO: 1374716 - protein, 9 aa, Homo Sapiens
SSTARPSPS

SEQ ID NO: 1374717 - protein, 9 aa, Homo Sapiens
EASVHNPDL

SEQ ID NO: 1374718 - protein, 9 aa, Homo Sapiens
VSVVLITTL

SEQ ID NO: 1374719 - protein, 9 aa, Homo Sapiens
DGECGKSLK

SEQ ID NO: 1374720 - protein, 9 aa, Homo Sapiens
RATLINEYS

SEQ ID NO: 1374721 - protein, 9 aa, Homo Sapiens
IVDDPYMTG

SEQ ID NO: 1374722 - protein, 9 aa, Homo Sapiens
QPLQPPRVC

SEQ ID NO: 1374723 - protein, 9 aa, Homo Sapiens
EEPVELRGQ

SEQ ID NO: 1374724 - protein, 9 aa, Homo Sapiens
ARLDTLTIL

SEQ ID NO: 1374725 - protein, 9 aa, Homo Sapiens
KSIQFASRQ

SEQ ID NO: 1374726 - protein, 9 aa, Homo Sapiens
TRRCDFQGL

SEQ ID NO: 1374727 - protein, 9 aa, Homo Sapiens
HDNWLAARI

SEQ ID NO: 1374728 - protein, 9 aa, Homo Sapiens
VMYRSQSEL

SEQ ID NO: 1374729 - protein, 9 aa, Homo Sapiens
TITMSSPRR

SEQ ID NO: 1374730 - protein, 9 aa, Homo Sapiens
VHAEGQVAD

SEQ ID NO: 1374731 - protein, 9 aa, Homo Sapiens
KMGRGPLSD

SEQ ID NO: 1374732 - protein, 9 aa, Homo Sapiens
TEATAPCAS

SEQ ID NO: 1374733 - protein, 9 aa, Homo Sapiens
GTEGLPLLG

SEQ ID NO: 1374734 - protein, 9 aa, Homo Sapiens
QKVVASLKA

SEQ ID NO: 1374735 - protein, 9 aa, Homo Sapiens
AALEGASKD

SEQ ID NO: 1374736 - protein, 9 aa, Homo Sapiens
LRIHCVAKD

SEQ ID NO: 1374737 - protein, 9 aa, Homo Sapiens
IKPDNVLVN

SEQ ID NO: 1374738 - protein, 9 aa, Homo Sapiens
YLFLCALAI

SEQ ID NO: 1374739 - protein, 9 aa, Homo Sapiens
VTTTLKLIL

SEQ ID NO: 1374740 - protein, 9 aa, Homo Sapiens
PHIAPRDQV

SEQ ID NO: 1374741 - protein, 9 aa, Homo Sapiens
LSKYAAHNT

SEQ ID NO: 1374742 - protein, 9 aa, Homo Sapiens
SKTEHQVQG

SEQ ID NO: 1374743 - protein, 9 aa, Homo Sapiens
CNTDSIHWC

SEQ ID NO: 1374744 - protein, 9 aa, Homo Sapiens
NGDIYCTFN

SEQ ID NO: 1374745 - protein, 9 aa, Homo Sapiens
DRCHRAQEY

SEQ ID NO: 1374746 - protein, 9 aa, Homo Sapiens
GKFGTSILS

SEQ ID NO: 1374747 - protein, 9 aa, Homo Sapiens
FKRSDPVNH

SEQ ID NO: 1374748 - protein, 9 aa, Homo Sapiens
LIVLCALAA

SEQ ID NO: 1374749 - protein, 9 aa, Homo Sapiens
LLLKATSTA

SEQ ID NO: 1374750 - protein, 9 aa, Homo Sapiens
VGKEQHPAA

SEQ ID NO: 1374751 - protein, 9 aa, Homo Sapiens
LSLVVTGDQ

SEQ ID NO: 1374752 - protein, 9 aa, Homo Sapiens
RGLRVLTAC

SEQ ID NO: 1374753 - protein, 9 aa, Homo Sapiens
QRPIQVQTG

SEQ ID NO: 1374754 - protein, 9 aa, Homo Sapiens
RWSGFCGGW

SEQ ID NO: 1374755 - protein, 9 aa, Homo Sapiens
AVESLGNNH

SEQ ID NO: 1374756 - protein, 9 aa, Homo Sapiens
NPEQGLALS

SEQ ID NO: 1374757 - protein, 9 aa, Homo Sapiens
SGRGPGPRQ

SEQ ID NO: 1374758 - protein, 9 aa, Homo Sapiens
GFCGGWLPA

SEQ ID NO: 1374759 - protein, 9 aa, Homo Sapiens
QFIWKKTFV

SEQ ID NO: 1374760 - protein, 9 aa, Homo Sapiens
GFYDECLCK

SEQ ID NO: 1374761 - protein, 9 aa, Homo Sapiens
LQACVSKNS

SEQ ID NO: 1374762 - protein, 9 aa, Homo Sapiens
LTPDLQRRR

SEQ ID NO: 1374763 - protein, 9 aa, Homo Sapiens
SDTGASTPA

SEQ ID NO: 1374764 - protein, 9 aa, Homo Sapiens
VRQGTTIFQ

SEQ ID NO: 1374765 - protein, 9 aa, Homo Sapiens
CWTPCHLST

SEQ ID NO: 1374766 - protein, 9 aa, Homo Sapiens
TAKVKRNVT

SEQ ID NO: 1374767 - protein, 9 aa, Homo Sapiens
VETSGYYYD

SEQ ID NO: 1374768 - protein, 9 aa, Homo Sapiens
AAGPTADEE

SEQ ID NO: 1374769 - protein, 9 aa, Homo Sapiens
ALGTELSYL

SEQ ID NO: 1374770 - protein, 9 aa, Homo Sapiens
KGWWQGEED

SEQ ID NO: 1374771 - protein, 9 aa, Homo Sapiens
KDTAACILK

SEQ ID NO: 1374772 - protein, 9 aa, Homo Sapiens
PHHLPEVCD

SEQ ID NO: 1374773 - protein, 9 aa, Homo Sapiens
GKVYLKKTD

SEQ ID NO: 1374774 - protein, 9 aa, Homo Sapiens
DDAHFFSVG

SEQ ID NO: 1374775 - protein, 9 aa, Homo Sapiens
CPYHVFTHN

SEQ ID NO: 1374776 - protein, 9 aa, Homo Sapiens
VGKVMPFRR

SEQ ID NO: 1374777 - protein, 9 aa, Homo Sapiens
RHRGKNENE

SEQ ID NO: 1374778 - protein, 9 aa, Homo Sapiens
PDDNARKKA

SEQ ID NO: 1374779 - protein, 9 aa, Homo Sapiens
NYSSNWSWG

SEQ ID NO: 1374780 - protein, 9 aa, Homo Sapiens
GVWLCLVGT

SEQ ID NO: 1374781 - protein, 9 aa, Homo Sapiens
SWHRPASPA

SEQ ID NO: 1374782 - protein, 9 aa, Homo Sapiens
AVGMSRGAV

SEQ ID NO: 1374783 - protein, 9 aa, Homo Sapiens
DQVALDSPT

SEQ ID NO: 1374784 - protein, 9 aa, Homo Sapiens
RPCSVTVWC

SEQ ID NO: 1374785 - protein, 9 aa, Homo Sapiens
MEKKINNQI

SEQ ID NO: 1374786 - protein, 9 aa, Homo Sapiens
RTSPLLTHQ

SEQ ID NO: 1374787 - protein, 9 aa, Homo Sapiens
LLVRRDAFL

SEQ ID NO: 1374788 - protein, 9 aa, Homo Sapiens
FLLASVGSV

SEQ ID NO: 1374789 - protein, 9 aa, Homo Sapiens
PPCPASFCT

SEQ ID NO: 1374790 - protein, 9 aa, Homo Sapiens
NSQSEEHSL

SEQ ID NO: 1374791 - protein, 9 aa, Homo Sapiens
APVAWHPLG

SEQ ID NO: 1374792 - protein, 9 aa, Homo Sapiens
CSVLIKNMM

SEQ ID NO: 1374793 - protein, 9 aa, Homo Sapiens
PAKALRTLR

SEQ ID NO: 1374794 - protein, 9 aa, Homo Sapiens
RLSAQIQER

SEQ ID NO: 1374795 - protein, 9 aa, Homo Sapiens
SVQLAGDKR

SEQ ID NO: 1374796 - protein, 9 aa, Homo Sapiens
LKATSTATL

SEQ ID NO: 1374797 - protein, 9 aa, Homo Sapiens
GSDGDGECG

SEQ ID NO: 1374798 - protein, 9 aa, Homo Sapiens
VPFSLIMSS

SEQ ID NO: 1374799 - protein, 9 aa, Homo Sapiens
FNLADTHPF

SEQ ID NO: 1374800 - protein, 9 aa, Homo Sapiens
KLFVAIAIT

SEQ ID NO: 1374801 - protein, 9 aa, Homo Sapiens
LQVAVECDG

SEQ ID NO: 1374802 - protein, 9 aa, Homo Sapiens
RGECGKAFS

SEQ ID NO: 1374803 - protein, 9 aa, Homo Sapiens
PLIHIQLAD

SEQ ID NO: 1374804 - protein, 9 aa, Homo Sapiens
CRDYDSPER

SEQ ID NO: 1374805 - protein, 9 aa, Homo Sapiens
HVSITNTKT

SEQ ID NO: 1374806 - protein, 9 aa, Homo Sapiens
QKKKEDFAM

SEQ ID NO: 1374807 - protein, 9 aa, Homo Sapiens
AKRRVELIL

SEQ ID NO: 1374808 - protein, 9 aa, Homo Sapiens
DVMRKQGSR

SEQ ID NO: 1374809 - protein, 9 aa, Homo Sapiens
EAADMTCHG

SEQ ID NO: 1374810 - protein, 9 aa, Homo Sapiens
YKKTYMEMH

SEQ ID NO: 1374811 - protein, 9 aa, Homo Sapiens
RLLGLHVLQ

SEQ ID NO: 1374812 - protein, 9 aa, Homo Sapiens
NLNTNMNVN

SEQ ID NO: 1374813 - protein, 9 aa, Homo Sapiens
FAPRRRAAW

SEQ ID NO: 1374814 - protein, 9 aa, Homo Sapiens
CPLPATVGV

SEQ ID NO: 1374815 - protein, 9 aa, Homo Sapiens
IISIVCMFL

SEQ ID NO: 1374816 - protein, 9 aa, Homo Sapiens
FETVNTPAM

SEQ ID NO: 1374817 - protein, 9 aa, Homo Sapiens
ETLAADPMP

SEQ ID NO: 1374818 - protein, 9 aa, Homo Sapiens
PEEASVHNP

SEQ ID NO: 1374819 - protein, 9 aa, Homo Sapiens
RASWPRGGN

SEQ ID NO: 1374820 - protein, 9 aa, Homo Sapiens
PRFPRPNYR

SEQ ID NO: 1374821 - protein, 9 aa, Homo Sapiens
LIAADTLPY

SEQ ID NO: 1374822 - protein, 9 aa, Homo Sapiens
SIADTLKQA

SEQ ID NO: 1374823 - protein, 9 aa, Homo Sapiens
STSAAAWCP

SEQ ID NO: 1374824 - protein, 9 aa, Homo Sapiens
GRGRPGAGP

SEQ ID NO: 1374825 - protein, 9 aa, Homo Sapiens
ALRARFSEI

SEQ ID NO: 1374826 - protein, 9 aa, Homo Sapiens
FFDRVSSEY

SEQ ID NO: 1374827 - protein, 9 aa, Homo Sapiens
SGLCKGSGP

SEQ ID NO: 1374828 - protein, 9 aa, Homo Sapiens
QKSTETTQQ

SEQ ID NO: 1374829 - protein, 9 aa, Homo Sapiens
VNVTILNGL

SEQ ID NO: 1374830 - protein, 9 aa, Homo Sapiens
LIAVDVFLV

SEQ ID NO: 1374831 - protein, 9 aa, Homo Sapiens
RIRHSQRLR

SEQ ID NO: 1374832 - protein, 9 aa, Homo Sapiens
IQLLKSGEV

SEQ ID NO: 1374833 - protein, 9 aa, Homo Sapiens
AALVREVTG

SEQ ID NO: 1374834 - protein, 9 aa, Homo Sapiens
AKDTAACIL

SEQ ID NO: 1374835 - protein, 9 aa, Homo Sapiens
KVRNTVKKI

SEQ ID NO: 1374836 - protein, 9 aa, Homo Sapiens
STELAEKLR

SEQ ID NO: 1374837 - protein, 9 aa, Homo Sapiens
KLKNYLREV

SEQ ID NO: 1374838 - protein, 9 aa, Homo Sapiens
LLDTILHQR

SEQ ID NO: 1374839 - protein, 9 aa, Homo Sapiens
TILSSLWNW

SEQ ID NO: 1374840 - protein, 9 aa, Homo Sapiens
VPTSRGQRQ

SEQ ID NO: 1374841 - protein, 9 aa, Homo Sapiens
LGLCSAQPA

SEQ ID NO: 1374842 - protein, 9 aa, Homo Sapiens
QRWYRQQVQ

SEQ ID NO: 1374843 - protein, 9 aa, Homo Sapiens
EGMKAVLRT

SEQ ID NO: 1374844 - protein, 9 aa, Homo Sapiens
AVEGLRKRA

SEQ ID NO: 1374845 - protein, 9 aa, Homo Sapiens
HIVDEANGL

SEQ ID NO: 1374846 - protein, 9 aa, Homo Sapiens
VQGFLLHWQ

SEQ ID NO: 1374847 - protein, 9 aa, Homo Sapiens
VIDSKNKPQ

SEQ ID NO: 1374848 - protein, 9 aa, Homo Sapiens
TKALCCAAV

SEQ ID NO: 1374849 - protein, 9 aa, Homo Sapiens
ASHYRQNRS

SEQ ID NO: 1374850 - protein, 9 aa, Homo Sapiens
EGCPVSGHT

SEQ ID NO: 1374851 - protein, 9 aa, Homo Sapiens
VMCSMANCL

SEQ ID NO: 1374852 - protein, 9 aa, Homo Sapiens
CELSCYVVV

SEQ ID NO: 1374853 - protein, 9 aa, Homo Sapiens
RYMKLAYKK

SEQ ID NO: 1374854 - protein, 9 aa, Homo Sapiens
ARQVGSVGG

SEQ ID NO: 1374855 - protein, 9 aa, Homo Sapiens
GKIAQTTHQ

SEQ ID NO: 1374856 - protein, 9 aa, Homo Sapiens
DDIPDRPTG

SEQ ID NO: 1374857 - protein, 9 aa, Homo Sapiens
VTAIAVDCY

SEQ ID NO: 1374858 - protein, 9 aa, Homo Sapiens
EFDGGAGSV

SEQ ID NO: 1374859 - protein, 9 aa, Homo Sapiens
DVALPLRGG

SEQ ID NO: 1374860 - protein, 9 aa, Homo Sapiens
SDQSSLVLA

SEQ ID NO: 1374861 - protein, 9 aa, Homo Sapiens
RLSRPTKTR

SEQ ID NO: 1374862 - protein, 9 aa, Homo Sapiens
FKITIYGRT

SEQ ID NO: 1374863 - protein, 9 aa, Homo Sapiens
QTGGTIGPL

SEQ ID NO: 1374864 - protein, 9 aa, Homo Sapiens
GPPTAPRRH

SEQ ID NO: 1374865 - protein, 9 aa, Homo Sapiens
PGSNAHVGG

SEQ ID NO: 1374866 - protein, 9 aa, Homo Sapiens
SGRRPKRLR

SEQ ID NO: 1374867 - protein, 9 aa, Homo Sapiens
IRKSELIAN

SEQ ID NO: 1374868 - protein, 9 aa, Homo Sapiens
LVFAKMKGC

SEQ ID NO: 1374869 - protein, 9 aa, Homo Sapiens
PSSAASRRA

SEQ ID NO: 1374870 - protein, 9 aa, Homo Sapiens
AVDIGGLII

SEQ ID NO: 1374871 - protein, 9 aa, Homo Sapiens
ASSKVEAPG

SEQ ID NO: 1374872 - protein, 9 aa, Homo Sapiens
LHQLHSDSF

SEQ ID NO: 1374873 - protein, 9 aa, Homo Sapiens
LNCLGKKKK

SEQ ID NO: 1374874 - protein, 9 aa, Homo Sapiens
TELPHIIKK

SEQ ID NO: 1374875 - protein, 9 aa, Homo Sapiens
LEMCNTDSI

SEQ ID NO: 1374876 - protein, 9 aa, Homo Sapiens
DVGLKSNGK

SEQ ID NO: 1374877 - protein, 9 aa, Homo Sapiens
EEGDEESDL

SEQ ID NO: 1374878 - protein, 9 aa, Homo Sapiens
HSHLVVYLG

SEQ ID NO: 1374879 - protein, 9 aa, Homo Sapiens
VPRGVSMAH

SEQ ID NO: 1374880 - protein, 9 aa, Homo Sapiens
ATQKREMEH

SEQ ID NO: 1374881 - protein, 9 aa, Homo Sapiens
ATPGVKKDS

SEQ ID NO: 1374882 - protein, 9 aa, Homo Sapiens
QPQVPLSVH

SEQ ID NO: 1374883 - protein, 9 aa, Homo Sapiens
LIGSVEEQP

SEQ ID NO: 1374884 - protein, 9 aa, Homo Sapiens
RNLVSLDIF

SEQ ID NO: 1374885 - protein, 9 aa, Homo Sapiens
EVSIQVNVS

SEQ ID NO: 1374886 - protein, 9 aa, Homo Sapiens
ASSASPAST

SEQ ID NO: 1374887 - protein, 9 aa, Homo Sapiens
GSCIPCPDE

SEQ ID NO: 1374888 - protein, 9 aa, Homo Sapiens
GVGYVRGWL

SEQ ID NO: 1374889 - protein, 9 aa, Homo Sapiens
SPGIPGHRG

SEQ ID NO: 1374890 - protein, 9 aa, Homo Sapiens
RRCDFQGLI

SEQ ID NO: 1374891 - protein, 9 aa, Homo Sapiens
RHLRRRPRP

SEQ ID NO: 1374892 - protein, 9 aa, Homo Sapiens
MIIVMLTLS

SEQ ID NO: 1374893 - protein, 9 aa, Homo Sapiens
YFQCLFHRP

SEQ ID NO: 1374894 - protein, 9 aa, Homo Sapiens
PIQVQTGGR

SEQ ID NO: 1374895 - protein, 9 aa, Homo Sapiens
DMARHSAPE

SEQ ID NO: 1374896 - protein, 9 aa, Homo Sapiens
EHGVQDTVE

SEQ ID NO: 1374897 - protein, 9 aa, Homo Sapiens
DSPPVFSRD

SEQ ID NO: 1374898 - protein, 9 aa, Homo Sapiens
NPASICDGD

SEQ ID NO: 1374899 - protein, 9 aa, Homo Sapiens
TLCGACCPC

SEQ ID NO: 1374900 - protein, 9 aa, Homo Sapiens
TTQQLKRSA

SEQ ID NO: 1374901 - protein, 9 aa, Homo Sapiens
SDIICVTVG

SEQ ID NO: 1374902 - protein, 9 aa, Homo Sapiens
RVIHTGEKP

SEQ ID NO: 1374903 - protein, 9 aa, Homo Sapiens
AVQDYSYFF

SEQ ID NO: 1374904 - protein, 9 aa, Homo Sapiens
AIRPAVPTG

SEQ ID NO: 1374905 - protein, 9 aa, Homo Sapiens
LPTRFKRFF

SEQ ID NO: 1374906 - protein, 9 aa, Homo Sapiens
DSVTGLDLK

SEQ ID NO: 1374907 - protein, 9 aa, Homo Sapiens
NDQFWIYDN

SEQ ID NO: 1374908 - protein, 9 aa, Homo Sapiens
PCWMAPEVT

SEQ ID NO: 1374909 - protein, 9 aa, Homo Sapiens
GMSATTTAR

SEQ ID NO: 1374910 - protein, 9 aa, Homo Sapiens
VPYLYRNNL

SEQ ID NO: 1374911 - protein, 9 aa, Homo Sapiens
GSLNGPSSG

SEQ ID NO: 1374912 - protein, 9 aa, Homo Sapiens
RTVHEHFNL

SEQ ID NO: 1374913 - protein, 9 aa, Homo Sapiens
VGFVALEIY

SEQ ID NO: 1374914 - protein, 9 aa, Homo Sapiens
EMEHWKTKK

SEQ ID NO: 1374915 - protein, 9 aa, Homo Sapiens
SFQKACMTQ

SEQ ID NO: 1374916 - protein, 9 aa, Homo Sapiens
QCPAIPHGH

SEQ ID NO: 1374917 - protein, 9 aa, Homo Sapiens
PDAWSLIGH

SEQ ID NO: 1374918 - protein, 9 aa, Homo Sapiens
SSAPDQPPQ

SEQ ID NO: 1374919 - protein, 9 aa, Homo Sapiens
HHTLLTEEV

SEQ ID NO: 1374920 - protein, 9 aa, Homo Sapiens
PSLPLPRTS

SEQ ID NO: 1374921 - protein, 9 aa, Homo Sapiens
YSSSSSGPM

SEQ ID NO: 1374922 - protein, 9 aa, Homo Sapiens
IGSVCYERN

SEQ ID NO: 1374923 - protein, 9 aa, Homo Sapiens
SLVVTGDQS

SEQ ID NO: 1374924 - protein, 9 aa, Homo Sapiens
PCPMPTTPV

SEQ ID NO: 1374925 - protein, 9 aa, Homo Sapiens
GSPVFVAFR

SEQ ID NO: 1374926 - protein, 9 aa, Homo Sapiens
KPQAGERGQ

SEQ ID NO: 1374927 - protein, 9 aa, Homo Sapiens
DTGRPHGDI

SEQ ID NO: 1374928 - protein, 9 aa, Homo Sapiens
GRVNLRPAV

SEQ ID NO: 1374929 - protein, 9 aa, Homo Sapiens
IPNGDIYCT

SEQ ID NO: 1374930 - protein, 9 aa, Homo Sapiens
ARSGDAGEH

SEQ ID NO: 1374931 - protein, 9 aa, Homo Sapiens
SLRGNWWRK

SEQ ID NO: 1374932 - protein, 9 aa, Homo Sapiens
LLESSWSGD

SEQ ID NO: 1374933 - protein, 9 aa, Homo Sapiens
MREVAEAAA

SEQ ID NO: 1374934 - protein, 9 aa, Homo Sapiens
KKKPVNWTN

SEQ ID NO: 1374935 - protein, 9 aa, Homo Sapiens
AVDVFLVLV

SEQ ID NO: 1374936 - protein, 9 aa, Homo Sapiens
GAPGAPWRH

SEQ ID NO: 1374937 - protein, 9 aa, Homo Sapiens
CFSTTTLSW

SEQ ID NO: 1374938 - protein, 9 aa, Homo Sapiens
RMPVLFDVA

SEQ ID NO: 1374939 - protein, 9 aa, Homo Sapiens
TDRLQVAMK

SEQ ID NO: 1374940 - protein, 9 aa, Homo Sapiens
SLSKHMKIH

SEQ ID NO: 1374941 - protein, 9 aa, Homo Sapiens
MTNLTELAL

SEQ ID NO: 1374942 - protein, 9 aa, Homo Sapiens
MQAVLHIIR

SEQ ID NO: 1374943 - protein, 9 aa, Homo Sapiens
VTGDMDILR

SEQ ID NO: 1374944 - protein, 9 aa, Homo Sapiens
KEGPGLQGG

SEQ ID NO: 1374945 - protein, 9 aa, Homo Sapiens
YYKTGSIRP

SEQ ID NO: 1374946 - protein, 9 aa, Homo Sapiens
GRPNPAPRK

SEQ ID NO: 1374947 - protein, 9 aa, Homo Sapiens
TNLNLGRNY

SEQ ID NO: 1374948 - protein, 9 aa, Homo Sapiens
REFIADILN

SEQ ID NO: 1374949 - protein, 9 aa, Homo Sapiens
QQHQKWYQK

SEQ ID NO: 1374950 - protein, 9 aa, Homo Sapiens
EAKAKLERK

SEQ ID NO: 1374951 - protein, 9 aa, Homo Sapiens
LGILLTSET

SEQ ID NO: 1374952 - protein, 9 aa, Homo Sapiens
SKVAAEVPN

SEQ ID NO: 1374953 - protein, 9 aa, Homo Sapiens
LNEELQKIY

SEQ ID NO: 1374954 - protein, 9 aa, Homo Sapiens
PPPGTLRGS

SEQ ID NO: 1374955 - protein, 9 aa, Homo Sapiens
TDLGQEVSW

SEQ ID NO: 1374956 - protein, 9 aa, Homo Sapiens
SHSRPGPMH

SEQ ID NO: 1374957 - protein, 9 aa, Homo Sapiens
GQVHFLWMK

SEQ ID NO: 1374958 - protein, 9 aa, Homo Sapiens
QKVSELHRA

SEQ ID NO: 1374959 - protein, 9 aa, Homo Sapiens
NTPPACPQA

SEQ ID NO: 1374960 - protein, 9 aa, Homo Sapiens
PRRNRAAQR

SEQ ID NO: 1374961 - protein, 9 aa, Homo Sapiens
LQGYHRELE

SEQ ID NO: 1374962 - protein, 9 aa, Homo Sapiens
ARSLPAVQF

SEQ ID NO: 1374963 - protein, 9 aa, Homo Sapiens
NKITVLGVG

SEQ ID NO: 1374964 - protein, 9 aa, Homo Sapiens
IPPPGTLRG

SEQ ID NO: 1374965 - protein, 9 aa, Homo Sapiens
HVPRCGKVY

SEQ ID NO: 1374966 - protein, 9 aa, Homo Sapiens
ETETKQTFK

SEQ ID NO: 1374967 - protein, 9 aa, Homo Sapiens
DQPATEPLD

SEQ ID NO: 1374968 - protein, 9 aa, Homo Sapiens
RKISRKDGT

SEQ ID NO: 1374969 - protein, 9 aa, Homo Sapiens
QHQKWYQKF

SEQ ID NO: 1374970 - protein, 9 aa, Homo Sapiens
LLGAVVQVK

SEQ ID NO: 1374971 - protein, 9 aa, Homo Sapiens
DIDVQNVEV

SEQ ID NO: 1374972 - protein, 9 aa, Homo Sapiens
SEHFSPQAR

SEQ ID NO: 1374973 - protein, 9 aa, Homo Sapiens
ALFEGYSSY

SEQ ID NO: 1374974 - protein, 9 aa, Homo Sapiens
QLRIAAVEK

SEQ ID NO: 1374975 - protein, 9 aa, Homo Sapiens
PIILSNEDV

SEQ ID NO: 1374976 - protein, 9 aa, Homo Sapiens
TRGKLKRVD

SEQ ID NO: 1374977 - protein, 9 aa, Homo Sapiens
VVQTSAKNA

SEQ ID NO: 1374978 - protein, 9 aa, Homo Sapiens
KILGRYYKT

SEQ ID NO: 1374979 - protein, 9 aa, Homo Sapiens
FRNKLSQQH

SEQ ID NO: 1374980 - protein, 9 aa, Homo Sapiens
SETGIHIDP

SEQ ID NO: 1374981 - protein, 9 aa, Homo Sapiens
KCPVGIGES

SEQ ID NO: 1374982 - protein, 9 aa, Homo Sapiens
LNDKLQNEI

SEQ ID NO: 1374983 - protein, 9 aa, Homo Sapiens
HYGEKHFEC

SEQ ID NO: 1374984 - protein, 9 aa, Homo Sapiens
ASPPPEQKT

SEQ ID NO: 1374985 - protein, 9 aa, Homo Sapiens
MTYTPGTCE

SEQ ID NO: 1374986 - protein, 9 aa, Homo Sapiens
THKGNATHD

SEQ ID NO: 1374987 - protein, 9 aa, Homo Sapiens
MGEPKGSWS

SEQ ID NO: 1374988 - protein, 9 aa, Homo Sapiens
LKAPLPAGQ

SEQ ID NO: 1374989 - protein, 9 aa, Homo Sapiens
AGRVQDALC

SEQ ID NO: 1374990 - protein, 9 aa, Homo Sapiens
SLERANPYF

SEQ ID NO: 1374991 - protein, 9 aa, Homo Sapiens
HIVGYFDYA

SEQ ID NO: 1374992 - protein, 9 aa, Homo Sapiens
KLQEQMNKL

SEQ ID NO: 1374993 - protein, 9 aa, Homo Sapiens
VLGVGAVGM

SEQ ID NO: 1374994 - protein, 9 aa, Homo Sapiens
KKSEGNIMP

SEQ ID NO: 1374995 - protein, 9 aa, Homo Sapiens
KEIALFRNK

SEQ ID NO: 1374996 - protein, 9 aa, Homo Sapiens
HPSSLSKHM

SEQ ID NO: 1374997 - protein, 9 aa, Homo Sapiens
IYNFTGQHF

SEQ ID NO: 1374998 - protein, 9 aa, Homo Sapiens
PPPAPPCLF

SEQ ID NO: 1374999 - protein, 9 aa, Homo Sapiens
NFEEYFEIV

SEQ ID NO: 1375000 - protein, 9 aa, Homo Sapiens
LTDFPQMQL

SEQ ID NO: 1375001 - protein, 9 aa, Homo Sapiens
QVAMKVIPR

SEQ ID NO: 1375002 - protein, 9 aa, Homo Sapiens
FSEKEKELQ

SEQ ID NO: 1375003 - protein, 9 aa, Homo Sapiens
IESETAASK

SEQ ID NO: 1375004 - protein, 9 aa, Homo Sapiens
SHMESDELN

SEQ ID NO: 1375005 - protein, 9 aa, Homo Sapiens
TDTLTLEVR

SEQ ID NO: 1375006 - protein, 9 aa, Homo Sapiens
SHPKPLSPT

SEQ ID NO: 1375007 - protein, 9 aa, Homo Sapiens
PTEGQILLF

SEQ ID NO: 1375008 - protein, 9 aa, Homo Sapiens
VLFRVYSNT

SEQ ID NO: 1375009 - protein, 9 aa, Homo Sapiens
KQTFKEFRC

SEQ ID NO: 1375010 - protein, 9 aa, Homo Sapiens
HPLIEPIPD

SEQ ID NO: 1375011 - protein, 9 aa, Homo Sapiens
GMPFTSASF

SEQ ID NO: 1375012 - protein, 9 aa, Homo Sapiens
EVRLRLGYC

SEQ ID NO: 1375013 - protein, 9 aa, Homo Sapiens
ATATRSVWK

SEQ ID NO: 1375014 - protein, 9 aa, Homo Sapiens
AYLAIPQHA

SEQ ID NO: 1375015 - protein, 9 aa, Homo Sapiens
VAPSVHSDN

SEQ ID NO: 1375016 - protein, 9 aa, Homo Sapiens
DVQNVEVDD

SEQ ID NO: 1375017 - protein, 9 aa, Homo Sapiens
RTLPTPHCF

SEQ ID NO: 1375018 - protein, 9 aa, Homo Sapiens
QRYVVLAQL

SEQ ID NO: 1375019 - protein, 9 aa, Homo Sapiens
LRSLQHFAE

SEQ ID NO: 1375020 - protein, 9 aa, Homo Sapiens
VNNDHFLYR

SEQ ID NO: 1375021 - protein, 9 aa, Homo Sapiens
AEVPNGSKQ

SEQ ID NO: 1375022 - protein, 9 aa, Homo Sapiens
PATEPLDLH

SEQ ID NO: 1375023 - protein, 9 aa, Homo Sapiens
HQDLFDDFE

SEQ ID NO: 1375024 - protein, 9 aa, Homo Sapiens
VKIRVNDVN

SEQ ID NO: 1375025 - protein, 9 aa, Homo Sapiens
SVRTTRGKL

SEQ ID NO: 1375026 - protein, 9 aa, Homo Sapiens
SQEREFIAD

SEQ ID NO: 1375027 - protein, 9 aa, Homo Sapiens
DSESQSDVG

SEQ ID NO: 1375028 - protein, 9 aa, Homo Sapiens
HTVIMQKYE

SEQ ID NO: 1375029 - protein, 9 aa, Homo Sapiens
ILSNEDVRH

SEQ ID NO: 1375030 - protein, 9 aa, Homo Sapiens
SPAGYMPYC

SEQ ID NO: 1375031 - protein, 9 aa, Homo Sapiens
IKLAVNCKA

SEQ ID NO: 1375032 - protein, 9 aa, Homo Sapiens
KQELGHVIH

SEQ ID NO: 1375033 - protein, 9 aa, Homo Sapiens
ISESMLERL

SEQ ID NO: 1375034 - protein, 9 aa, Homo Sapiens
HTGCMFRLT

SEQ ID NO: 1375035 - protein, 9 aa, Homo Sapiens
DENDGEHQD

SEQ ID NO: 1375036 - protein, 9 aa, Homo Sapiens
PGPLGADGA

SEQ ID NO: 1375037 - protein, 9 aa, Homo Sapiens
ILSGTVQNI

SEQ ID NO: 1375038 - protein, 9 aa, Homo Sapiens
PKGSWSGKN

SEQ ID NO: 1375039 - protein, 9 aa, Homo Sapiens
DVHVCMMCL

SEQ ID NO: 1375040 - protein, 9 aa, Homo Sapiens
KAASPPPEQ

SEQ ID NO: 1375041 - protein, 9 aa, Homo Sapiens
NNKVSVSAT

SEQ ID NO: 1375042 - protein, 9 aa, Homo Sapiens
CCAVEIMHM

SEQ ID NO: 1375043 - protein, 9 aa, Homo Sapiens
VQTSAKNAI

SEQ ID NO: 1375044 - protein, 9 aa, Homo Sapiens
WIELYKHDR

SEQ ID NO: 1375045 - protein, 9 aa, Homo Sapiens
APPPSLQSP

SEQ ID NO: 1375046 - protein, 9 aa, Homo Sapiens
CKAEATPLT

SEQ ID NO: 1375047 - protein, 9 aa, Homo Sapiens
EQRIVKLSE

SEQ ID NO: 1375048 - protein, 9 aa, Homo Sapiens
IPQHANLFI

SEQ ID NO: 1375049 - protein, 9 aa, Homo Sapiens
APKANDHQG

SEQ ID NO: 1375050 - protein, 9 aa, Homo Sapiens
QYEMPEFSL

SEQ ID NO: 1375051 - protein, 9 aa, Homo Sapiens
SGKNYSNVH

SEQ ID NO: 1375052 - protein, 9 aa, Homo Sapiens
DLFDDFEWV

SEQ ID NO: 1375053 - protein, 9 aa, Homo Sapiens
IPNYLNQEI

SEQ ID NO: 1375054 - protein, 9 aa, Homo Sapiens
LIKLQLLFL

SEQ ID NO: 1375055 - protein, 9 aa, Homo Sapiens
IIVNSTYVT

SEQ ID NO: 1375056 - protein, 9 aa, Homo Sapiens
TLPRRCRSW

SEQ ID NO: 1375057 - protein, 9 aa, Homo Sapiens
GEPAHHPGC

SEQ ID NO: 1375058 - protein, 9 aa, Homo Sapiens
LQPQRYLEV

SEQ ID NO: 1375059 - protein, 9 aa, Homo Sapiens
HDLNDKLQN

SEQ ID NO: 1375060 - protein, 9 aa, Homo Sapiens
RLWQLKAPL

SEQ ID NO: 1375061 - protein, 9 aa, Homo Sapiens
PMHTIAFPD

SEQ ID NO: 1375062 - protein, 9 aa, Homo Sapiens
HVCHVPRCG

SEQ ID NO: 1375063 - protein, 9 aa, Homo Sapiens
REEAKEGPG

SEQ ID NO: 1375064 - protein, 9 aa, Homo Sapiens
SWRSWQSRH

SEQ ID NO: 1375065 - protein, 9 aa, Homo Sapiens
KLGGTYWAL

SEQ ID NO: 1375066 - protein, 9 aa, Homo Sapiens
TTLTTMMVI

SEQ ID NO: 1375067 - protein, 9 aa, Homo Sapiens
CMMCLRAIM

SEQ ID NO: 1375068 - protein, 9 aa, Homo Sapiens
LIDQLLQQF

SEQ ID NO: 1375069 - protein, 9 aa, Homo Sapiens
PWPQVGATF

SEQ ID NO: 1375070 - protein, 9 aa, Homo Sapiens
RHTETSSGG

SEQ ID NO: 1375071 - protein, 9 aa, Homo Sapiens
PCGWEVVRA

SEQ ID NO: 1375072 - protein, 9 aa, Homo Sapiens
QCPQKKNHL

SEQ ID NO: 1375073 - protein, 9 aa, Homo Sapiens
VSHTKKPKV

SEQ ID NO: 1375074 - protein, 9 aa, Homo Sapiens
MPFTSASFS

SEQ ID NO: 1375075 - protein, 9 aa, Homo Sapiens
NFTGQHFPF

SEQ ID NO: 1375076 - protein, 9 aa, Homo Sapiens
EIRLKAGRN

SEQ ID NO: 1375077 - protein, 9 aa, Homo Sapiens
LTHKGNATH

SEQ ID NO: 1375078 - protein, 9 aa, Homo Sapiens
MDQKASPQT

SEQ ID NO: 1375079 - protein, 9 aa, Homo Sapiens
GLLVQQLYP

SEQ ID NO: 1375080 - protein, 9 aa, Homo Sapiens
YTGFKINDQ

SEQ ID NO: 1375081 - protein, 9 aa, Homo Sapiens
TAETLTFLH

SEQ ID NO: 1375082 - protein, 9 aa, Homo Sapiens
QQLYPQPPQ

SEQ ID NO: 1375083 - protein, 9 aa, Homo Sapiens
FDQKQELGH

SEQ ID NO: 1375084 - protein, 9 aa, Homo Sapiens
LDSTMRILS

SEQ ID NO: 1375085 - protein, 9 aa, Homo Sapiens
EKELQNKLE

SEQ ID NO: 1375086 - protein, 9 aa, Homo Sapiens
KCFLLESEL

SEQ ID NO: 1375087 - protein, 9 aa, Homo Sapiens
RKNNITSKT

SEQ ID NO: 1375088 - protein, 9 aa, Homo Sapiens
AKEEKVVPE

SEQ ID NO: 1375089 - protein, 9 aa, Homo Sapiens
PGTLRGSRT

SEQ ID NO: 1375090 - protein, 9 aa, Homo Sapiens
NSSMLPRRG

SEQ ID NO: 1375091 - protein, 9 aa, Homo Sapiens
EKKYSPCGW

SEQ ID NO: 1375092 - protein, 9 aa, Homo Sapiens
IGLLPVLNP

SEQ ID NO: 1375093 - protein, 9 aa, Homo Sapiens
SRTAAGPRW

SEQ ID NO: 1375094 - protein, 9 aa, Homo Sapiens
SAGPAGFPG

SEQ ID NO: 1375095 - protein, 9 aa, Homo Sapiens
HPFISTNIQ

SEQ ID NO: 1375096 - protein, 9 aa, Homo Sapiens
MLPRRGALL

SEQ ID NO: 1375097 - protein, 9 aa, Homo Sapiens
MLIFTLATT

SEQ ID NO: 1375098 - protein, 9 aa, Homo Sapiens
HSRPGPMHT

SEQ ID NO: 1375099 - protein, 9 aa, Homo Sapiens
TNLTELALR

SEQ ID NO: 1375100 - protein, 9 aa, Homo Sapiens
SPILTIITL

SEQ ID NO: 1375101 - protein, 9 aa, Homo Sapiens
AAVGCVQYD

SEQ ID NO: 1375102 - protein, 9 aa, Homo Sapiens
SKETLFNAS

SEQ ID NO: 1375103 - protein, 9 aa, Homo Sapiens
FIRPVMQAV

SEQ ID NO: 1375104 - protein, 9 aa, Homo Sapiens
FAESSHLTR

SEQ ID NO: 1375105 - protein, 9 aa, Homo Sapiens
LFQIPLPEH

SEQ ID NO: 1375106 - protein, 9 aa, Homo Sapiens
AKEGPGLQG

SEQ ID NO: 1375107 - protein, 9 aa, Homo Sapiens
WKRSPWLQL

SEQ ID NO: 1375108 - protein, 9 aa, Homo Sapiens
PFTGHPLIE

SEQ ID NO: 1375109 - protein, 9 aa, Homo Sapiens
EVILLPNPP

SEQ ID NO: 1375110 - protein, 9 aa, Homo Sapiens
KRKYRLMGI

SEQ ID NO: 1375111 - protein, 9 aa, Homo Sapiens
QDLFDDFEW

SEQ ID NO: 1375112 - protein, 9 aa, Homo Sapiens
DSRNSSMLP

SEQ ID NO: 1375113 - protein, 9 aa, Homo Sapiens
IYEKLGGTY

SEQ ID NO: 1375114 - protein, 9 aa, Homo Sapiens
RMTSPFTRL

SEQ ID NO: 1375115 - protein, 9 aa, Homo Sapiens
REKAAKVFF

SEQ ID NO: 1375116 - protein, 9 aa, Homo Sapiens
LIVFTIWIA

SEQ ID NO: 1375117 - protein, 9 aa, Homo Sapiens
LSSLTGDLP

SEQ ID NO: 1375118 - protein, 9 aa, Homo Sapiens
VAIFKNLTT

SEQ ID NO: 1375119 - protein, 9 aa, Homo Sapiens
ARELRLPIR

SEQ ID NO: 1375120 - protein, 9 aa, Homo Sapiens
AVLHIIRET

SEQ ID NO: 1375121 - protein, 9 aa, Homo Sapiens
RQLDSIYRR

SEQ ID NO: 1375122 - protein, 9 aa, Homo Sapiens
REEQHEKDF

SEQ ID NO: 1375123 - protein, 9 aa, Homo Sapiens
PRWAVPVHV

SEQ ID NO: 1375124 - protein, 9 aa, Homo Sapiens
GRNYASGYA

SEQ ID NO: 1375125 - protein, 9 aa, Homo Sapiens
SLQHFAEAF

SEQ ID NO: 1375126 - protein, 9 aa, Homo Sapiens
VTPLQRVHY

SEQ ID NO: 1375127 - protein, 9 aa, Homo Sapiens
HSFRNHIVG

SEQ ID NO: 1375128 - protein, 9 aa, Homo Sapiens
PDVCKHLCM

SEQ ID NO: 1375129 - protein, 9 aa, Homo Sapiens
ENRGTSPVT

SEQ ID NO: 1375130 - protein, 9 aa, Homo Sapiens
GHVAAVGCV

SEQ ID NO: 1375131 - protein, 9 aa, Homo Sapiens
GLKITTPQE

SEQ ID NO: 1375132 - protein, 9 aa, Homo Sapiens
WFKRFCWLS

SEQ ID NO: 1375133 - protein, 9 aa, Homo Sapiens
PEDFLQASL

SEQ ID NO: 1375134 - protein, 9 aa, Homo Sapiens
EKFGFHPFI

SEQ ID NO: 1375135 - protein, 9 aa, Homo Sapiens
IRTCYDSED

SEQ ID NO: 1375136 - protein, 9 aa, Homo Sapiens
LLSIDSMLD

SEQ ID NO: 1375137 - protein, 9 aa, Homo Sapiens
EETSSSASN

SEQ ID NO: 1375138 - protein, 9 aa, Homo Sapiens
SSSASNQPY

SEQ ID NO: 1375139 - protein, 9 aa, Homo Sapiens
NQEIKILAK

SEQ ID NO: 1375140 - protein, 9 aa, Homo Sapiens
TLKITAHNE

SEQ ID NO: 1375141 - protein, 9 aa, Homo Sapiens
IKHEKTVHI

SEQ ID NO: 1375142 - protein, 9 aa, Homo Sapiens
RASIDGFDG

SEQ ID NO: 1375143 - protein, 9 aa, Homo Sapiens
VGAGATTVP

SEQ ID NO: 1375144 - protein, 9 aa, Homo Sapiens
DSSVTGDMD

SEQ ID NO: 1375145 - protein, 9 aa, Homo Sapiens
PGLLPPLNV

SEQ ID NO: 1375146 - protein, 9 aa, Homo Sapiens
SEWGKYGMR

SEQ ID NO: 1375147 - protein, 9 aa, Homo Sapiens
DTRPVPGST

SEQ ID NO: 1375148 - protein, 9 aa, Homo Sapiens
FCTLLHYHQ

SEQ ID NO: 1375149 - protein, 9 aa, Homo Sapiens
KAHTGKMYA

SEQ ID NO: 1375150 - protein, 9 aa, Homo Sapiens
HSDDDDDMM

SEQ ID NO: 1375151 - protein, 9 aa, Homo Sapiens
AKQVQLFMT

SEQ ID NO: 1375152 - protein, 9 aa, Homo Sapiens
IVFTIWIAP

SEQ ID NO: 1375153 - protein, 9 aa, Homo Sapiens
QAVERKIES

SEQ ID NO: 1375154 - protein, 9 aa, Homo Sapiens
KLTAGHELQ

SEQ ID NO: 1375155 - protein, 9 aa, Homo Sapiens
PLTFDALIK

SEQ ID NO: 1375156 - protein, 9 aa, Homo Sapiens
GLACCAVEI

SEQ ID NO: 1375157 - protein, 9 aa, Homo Sapiens
TLEVRLRLG

SEQ ID NO: 1375158 - protein, 9 aa, Homo Sapiens
RSQNRLQSP

SEQ ID NO: 1375159 - protein, 9 aa, Homo Sapiens
VKACNPLDT

SEQ ID NO: 1375160 - protein, 9 aa, Homo Sapiens
WAVPVHVPG

SEQ ID NO: 1375161 - protein, 9 aa, Homo Sapiens
ETLTFLHAH

SEQ ID NO: 1375162 - protein, 9 aa, Homo Sapiens
FTSASFSGG

SEQ ID NO: 1375163 - protein, 9 aa, Homo Sapiens
FDGYFRSRT

SEQ ID NO: 1375164 - protein, 9 aa, Homo Sapiens
SLTNLLADN

SEQ ID NO: 1375165 - protein, 9 aa, Homo Sapiens
STPNKIELA

SEQ ID NO: 1375166 - protein, 9 aa, Homo Sapiens
AVGCVQYDG

SEQ ID NO: 1375167 - protein, 9 aa, Homo Sapiens
GSYYMISRL

SEQ ID NO: 1375168 - protein, 9 aa, Homo Sapiens
YGEKHFECS

SEQ ID NO: 1375169 - protein, 9 aa, Homo Sapiens
LLVAKEEKV

SEQ ID NO: 1375170 - protein, 9 aa, Homo Sapiens
TESNGFCQL

SEQ ID NO: 1375171 - protein, 9 aa, Homo Sapiens
YSLERANPY

SEQ ID NO: 1375172 - protein, 9 aa, Homo Sapiens
ASVLDSLAG

SEQ ID NO: 1375173 - protein, 9 aa, Homo Sapiens
APDTRPVPG

SEQ ID NO: 1375174 - protein, 9 aa, Homo Sapiens
SLDSTMRIL

SEQ ID NO: 1375175 - protein, 9 aa, Homo Sapiens
GFRRRPKTM

SEQ ID NO: 1375176 - protein, 9 aa, Homo Sapiens
RCRSWERAP

SEQ ID NO: 1375177 - protein, 9 aa, Homo Sapiens
GPLIFLVCH

SEQ ID NO: 1375178 - protein, 9 aa, Homo Sapiens
RATESHRCL

SEQ ID NO: 1375179 - protein, 9 aa, Homo Sapiens
DDWIELYKH

SEQ ID NO: 1375180 - protein, 9 aa, Homo Sapiens
KPFTGHPLI

SEQ ID NO: 1375181 - protein, 9 aa, Homo Sapiens
EHLSTQIVA

SEQ ID NO: 1375182 - protein, 9 aa, Homo Sapiens
VPSPPHEHQ

SEQ ID NO: 1375183 - protein, 9 aa, Homo Sapiens
AAGPQATLP

SEQ ID NO: 1375184 - protein, 9 aa, Homo Sapiens
HQKWYQKFL

SEQ ID NO: 1375185 - protein, 9 aa, Homo Sapiens
IVEKVACPI

SEQ ID NO: 1375186 - protein, 9 aa, Homo Sapiens
EVSSNSWGI

SEQ ID NO: 1375187 - protein, 9 aa, Homo Sapiens
QPATEPLDL

SEQ ID NO: 1375188 - protein, 9 aa, Homo Sapiens
SKAPPPSLQ

SEQ ID NO: 1375189 - protein, 9 aa, Homo Sapiens
FSLDSTMRI

SEQ ID NO: 1375190 - protein, 9 aa, Homo Sapiens
GAVVQVKIR

SEQ ID NO: 1375191 - protein, 9 aa, Homo Sapiens
VQVNPVRRA

SEQ ID NO: 1375192 - protein, 9 aa, Homo Sapiens
QGLLVQQLY

SEQ ID NO: 1375193 - protein, 9 aa, Homo Sapiens
RYTCVAFGY

SEQ ID NO: 1375194 - protein, 9 aa, Homo Sapiens
GMDLATLKI

SEQ ID NO: 1375195 - protein, 9 aa, Homo Sapiens
YGCRKAHTG

SEQ ID NO: 1375196 - protein, 9 aa, Homo Sapiens
RKNSKTSNY

SEQ ID NO: 1375197 - protein, 9 aa, Homo Sapiens
QIPLPEHGM

SEQ ID NO: 1375198 - protein, 9 aa, Homo Sapiens
SRKDGTYLD

SEQ ID NO: 1375199 - protein, 9 aa, Homo Sapiens
HLSTQIVAP

SEQ ID NO: 1375200 - protein, 9 aa, Homo Sapiens
LRGSRTAAG

SEQ ID NO: 1375201 - protein, 9 aa, Homo Sapiens
SVWKRSPWL

SEQ ID NO: 1375202 - protein, 9 aa, Homo Sapiens
QVILPPWPQ

SEQ ID NO: 1375203 - protein, 9 aa, Homo Sapiens
LPYQVVQVN

SEQ ID NO: 1375204 - protein, 9 aa, Homo Sapiens
SSGMPHHGE

SEQ ID NO: 1375205 - protein, 9 aa, Homo Sapiens
LVRPRPGIG

SEQ ID NO: 1375206 - protein, 9 aa, Homo Sapiens
LIFEHMEVM

SEQ ID NO: 1375207 - protein, 9 aa, Homo Sapiens
GMNRSPILT

SEQ ID NO: 1375208 - protein, 9 aa, Homo Sapiens
VDDWIELYK

SEQ ID NO: 1375209 - protein, 9 aa, Homo Sapiens
PVNVGQLLA

SEQ ID NO: 1375210 - protein, 9 aa, Homo Sapiens
ESETAASKE

SEQ ID NO: 1375211 - protein, 9 aa, Homo Sapiens
GFCQLFPGL

SEQ ID NO: 1375212 - protein, 9 aa, Homo Sapiens
MKVIPRNRV

SEQ ID NO: 1375213 - protein, 9 aa, Homo Sapiens
MPLHWQDAM

SEQ ID NO: 1375214 - protein, 9 aa, Homo Sapiens
RAAREEQHE

SEQ ID NO: 1375215 - protein, 9 aa, Homo Sapiens
LYKHDRDIA

SEQ ID NO: 1375216 - protein, 9 aa, Homo Sapiens
QQEASRICV

SEQ ID NO: 1375217 - protein, 9 aa, Homo Sapiens
VEIMHMAAP

SEQ ID NO: 1375218 - protein, 9 aa, Homo Sapiens
ESNGFCQLF

SEQ ID NO: 1375219 - protein, 9 aa, Homo Sapiens
IKHTVIMQK

SEQ ID NO: 1375220 - protein, 9 aa, Homo Sapiens
ISRKDGTYL

SEQ ID NO: 1375221 - protein, 9 aa, Homo Sapiens
MMQRSMSHP

SEQ ID NO: 1375222 - protein, 9 aa, Homo Sapiens
MKHSNLYLV

SEQ ID NO: 1375223 - protein, 9 aa, Homo Sapiens
PLSNGSTKS

SEQ ID NO: 1375224 - protein, 9 aa, Homo Sapiens
GEPKGSWSG

SEQ ID NO: 1375225 - protein, 9 aa, Homo Sapiens
EGSEQMTEL

SEQ ID NO: 1375226 - protein, 9 aa, Homo Sapiens
DEDDLMLDV

SEQ ID NO: 1375227 - protein, 9 aa, Homo Sapiens
AKLGKSYNM

SEQ ID NO: 1375228 - protein, 9 aa, Homo Sapiens
HPMKSRLRC

SEQ ID NO: 1375229 - protein, 9 aa, Homo Sapiens
RKSRKPQNQ

SEQ ID NO: 1375230 - protein, 9 aa, Homo Sapiens
YNYAVLLPL

SEQ ID NO: 1375231 - protein, 9 aa, Homo Sapiens
AGPAGFPGA

SEQ ID NO: 1375232 - protein, 9 aa, Homo Sapiens
DVRHLRSLL

SEQ ID NO: 1375233 - protein, 9 aa, Homo Sapiens
RKPQNQQFP

SEQ ID NO: 1375234 - protein, 9 aa, Homo Sapiens
QMRKSPNGT

SEQ ID NO: 1375235 - protein, 9 aa, Homo Sapiens
KAVWCSEDK

SEQ ID NO: 1375236 - protein, 9 aa, Homo Sapiens
AHDGQNCLD

SEQ ID NO: 1375237 - protein, 9 aa, Homo Sapiens
QCISVKFKS

SEQ ID NO: 1375238 - protein, 9 aa, Homo Sapiens
QNSKKLTAG

SEQ ID NO: 1375239 - protein, 9 aa, Homo Sapiens
IMQRKQMET

SEQ ID NO: 1375240 - protein, 9 aa, Homo Sapiens
SRQKNEKMP

SEQ ID NO: 1375241 - protein, 9 aa, Homo Sapiens
SWQSRHSGA

SEQ ID NO: 1375242 - protein, 9 aa, Homo Sapiens
LLAGRKRKN

SEQ ID NO: 1375243 - protein, 9 aa, Homo Sapiens
RLRCTMLVA

SEQ ID NO: 1375244 - protein, 9 aa, Homo Sapiens
KFYTGFKIN

SEQ ID NO: 1375245 - protein, 9 aa, Homo Sapiens
CTPFLGQHG

SEQ ID NO: 1375246 - protein, 9 aa, Homo Sapiens
FGLLLTHKG

SEQ ID NO: 1375247 - protein, 9 aa, Homo Sapiens
CKHLCMINN

SEQ ID NO: 1375248 - protein, 9 aa, Homo Sapiens
NKVSVSATP

SEQ ID NO: 1375249 - protein, 9 aa, Homo Sapiens
IKNENRGTS

SEQ ID NO: 1375250 - protein, 9 aa, Homo Sapiens
QRKQMETYL

SEQ ID NO: 1375251 - protein, 9 aa, Homo Sapiens
DDDDMMMTT

SEQ ID NO: 1375252 - protein, 9 aa, Homo Sapiens
GQEVSWTTV

SEQ ID NO: 1375253 - protein, 9 aa, Homo Sapiens
TNLLADNRY

SEQ ID NO: 1375254 - protein, 9 aa, Homo Sapiens
GALGCTPFL

SEQ ID NO: 1375255 - protein, 9 aa, Homo Sapiens
SQVILPPWP

SEQ ID NO: 1375256 - protein, 9 aa, Homo Sapiens
ELYKHDRDI

SEQ ID NO: 1375257 - protein, 9 aa, Homo Sapiens
LEWFKRFCW

SEQ ID NO: 1375258 - protein, 9 aa, Homo Sapiens
MRKSPNGTI

SEQ ID NO: 1375259 - protein, 9 aa, Homo Sapiens
ELLEAKAKL

SEQ ID NO: 1375260 - protein, 9 aa, Homo Sapiens
YEFICRKWQ

SEQ ID NO: 1375261 - protein, 9 aa, Homo Sapiens
LSCVISVLY

SEQ ID NO: 1375262 - protein, 9 aa, Homo Sapiens
IDSMLDSSD

SEQ ID NO: 1375263 - protein, 9 aa, Homo Sapiens
IAPKANDHQ

SEQ ID NO: 1375264 - protein, 9 aa, Homo Sapiens
CVILPSKLY

SEQ ID NO: 1375265 - protein, 9 aa, Homo Sapiens
PVCSVAAMT

SEQ ID NO: 1375266 - protein, 9 aa, Homo Sapiens
PLHSIRNLK

SEQ ID NO: 1375267 - protein, 9 aa, Homo Sapiens
EYKEKFGFH

SEQ ID NO: 1375268 - protein, 9 aa, Homo Sapiens
AALFEGYSS

SEQ ID NO: 1375269 - protein, 9 aa, Homo Sapiens
LRDPSQERE

SEQ ID NO: 1375270 - protein, 9 aa, Homo Sapiens
LASPGPNGD

SEQ ID NO: 1375271 - protein, 9 aa, Homo Sapiens
VSDITSSGA

SEQ ID NO: 1375272 - protein, 9 aa, Homo Sapiens
KQMRKSPNG

SEQ ID NO: 1375273 - protein, 9 aa, Homo Sapiens
KKDDVHVCM

SEQ ID NO: 1375274 - protein, 9 aa, Homo Sapiens
GVFQKLIAP

SEQ ID NO: 1375275 - protein, 9 aa, Homo Sapiens
VIIGDQNHL

SEQ ID NO: 1375276 - protein, 9 aa, Homo Sapiens
DAMESSPGH

SEQ ID NO: 1375277 - protein, 9 aa, Homo Sapiens
SAPDTRPVP

SEQ ID NO: 1375278 - protein, 9 aa, Homo Sapiens
FDALIKLQL

SEQ ID NO: 1375279 - protein, 9 aa, Homo Sapiens
GPNGDSSPT

SEQ ID NO: 1375280 - protein, 9 aa, Homo Sapiens
SALDELFDI

SEQ ID NO: 1375281 - protein, 9 aa, Homo Sapiens
VEDKMFSLL

SEQ ID NO: 1375282 - protein, 9 aa, Homo Sapiens
NMSKSKFDN

SEQ ID NO: 1375283 - protein, 9 aa, Homo Sapiens
TETSSGGQA

SEQ ID NO: 1375284 - protein, 9 aa, Homo Sapiens
QDEVQQHQK

SEQ ID NO: 1375285 - protein, 9 aa, Homo Sapiens
SNGFCQLFP

SEQ ID NO: 1375286 - protein, 9 aa, Homo Sapiens
HDLQGPPLD

SEQ ID NO: 1375287 - protein, 9 aa, Homo Sapiens
AEEVKWDYA

SEQ ID NO: 1375288 - protein, 9 aa, Homo Sapiens
NLQPQRYLE

SEQ ID NO: 1375289 - protein, 9 aa, Homo Sapiens
YFIHNRPQL

SEQ ID NO: 1375290 - protein, 9 aa, Homo Sapiens
DHFLYRGEV

SEQ ID NO: 1375291 - protein, 9 aa, Homo Sapiens
LDELFDIMD

SEQ ID NO: 1375292 - protein, 9 aa, Homo Sapiens
FRVYSNTLL

SEQ ID NO: 1375293 - protein, 9 aa, Homo Sapiens
RNTCGSEPV

SEQ ID NO: 1375294 - protein, 9 aa, Homo Sapiens
GILAVKLGS

SEQ ID NO: 1375295 - protein, 9 aa, Homo Sapiens
VGKTWSHIM

SEQ ID NO: 1375296 - protein, 9 aa, Homo Sapiens
AFIYEKLGG

SEQ ID NO: 1375297 - protein, 9 aa, Homo Sapiens
QKLQEQMNK

SEQ ID NO: 1375298 - protein, 9 aa, Homo Sapiens
PKANDHQGF

SEQ ID NO: 1375299 - protein, 9 aa, Homo Sapiens
QICDQCGKC

SEQ ID NO: 1375300 - protein, 9 aa, Homo Sapiens
FTGHPLIEP

SEQ ID NO: 1375301 - protein, 9 aa, Homo Sapiens
IMHMAAPRY

SEQ ID NO: 1375302 - protein, 9 aa, Homo Sapiens
NLIKHTVIM

SEQ ID NO: 1375303 - protein, 9 aa, Homo Sapiens
IKTVIQTKS

SEQ ID NO: 1375304 - protein, 9 aa, Homo Sapiens
AKVFFETFN

SEQ ID NO: 1375305 - protein, 9 aa, Homo Sapiens
FKEFRCQVS

SEQ ID NO: 1375306 - protein, 9 aa, Homo Sapiens
SYNMIGKDD

SEQ ID NO: 1375307 - protein, 9 aa, Homo Sapiens
SPTGIKNEN

SEQ ID NO: 1375308 - protein, 9 aa, Homo Sapiens
GKNYSNVHT

SEQ ID NO: 1375309 - protein, 9 aa, Homo Sapiens
LPTPHCFKI

SEQ ID NO: 1375310 - protein, 9 aa, Homo Sapiens
RNLKKSKHI

SEQ ID NO: 1375311 - protein, 9 aa, Homo Sapiens
QNQQFPDTE

SEQ ID NO: 1375312 - protein, 9 aa, Homo Sapiens
LMSVESKKL

SEQ ID NO: 1375313 - protein, 9 aa, Homo Sapiens
VAQETPGSR

SEQ ID NO: 1375314 - protein, 9 aa, Homo Sapiens
GERPYACPK

SEQ ID NO: 1375315 - protein, 9 aa, Homo Sapiens
AFILGSIRD

SEQ ID NO: 1375316 - protein, 9 aa, Homo Sapiens
GICPHFAED

SEQ ID NO: 1375317 - protein, 9 aa, Homo Sapiens
TAGHELQPL

SEQ ID NO: 1375318 - protein, 9 aa, Homo Sapiens
LLARSVLFE

SEQ ID NO: 1375319 - protein, 9 aa, Homo Sapiens
MMTTTTTTL

SEQ ID NO: 1375320 - protein, 9 aa, Homo Sapiens
ILLTSETFY

SEQ ID NO: 1375321 - protein, 9 aa, Homo Sapiens
FTRLRERML

SEQ ID NO: 1375322 - protein, 9 aa, Homo Sapiens
NAQDPPMVV

SEQ ID NO: 1375323 - protein, 9 aa, Homo Sapiens
NDEMLSLNE

SEQ ID NO: 1375324 - protein, 9 aa, Homo Sapiens
AAGRVQDAL

SEQ ID NO: 1375325 - protein, 9 aa, Homo Sapiens
EEQGNQTAQ

SEQ ID NO: 1375326 - protein, 9 aa, Homo Sapiens
NTCGSEPVA

SEQ ID NO: 1375327 - protein, 9 aa, Homo Sapiens
QNEIANKDS

SEQ ID NO: 1375328 - protein, 9 aa, Homo Sapiens
LFRVYSNTL

SEQ ID NO: 1375329 - protein, 9 aa, Homo Sapiens
PPAGRPNPA

SEQ ID NO: 1375330 - protein, 9 aa, Homo Sapiens
FSKGGHLCL

SEQ ID NO: 1375331 - protein, 9 aa, Homo Sapiens
AGRKRKNSK

SEQ ID NO: 1375332 - protein, 9 aa, Homo Sapiens
NGDSSPTKD

SEQ ID NO: 1375333 - protein, 9 aa, Homo Sapiens
SQNRLQSPS

SEQ ID NO: 1375334 - protein, 9 aa, Homo Sapiens
ALDELFDIM

SEQ ID NO: 1375335 - protein, 9 aa, Homo Sapiens
LTNLLADNR

SEQ ID NO: 1375336 - protein, 9 aa, Homo Sapiens
KNENRGTSP

SEQ ID NO: 1375337 - protein, 9 aa, Homo Sapiens
HEKTVHIYG

SEQ ID NO: 1375338 - protein, 9 aa, Homo Sapiens
RPTEDVQAS

SEQ ID NO: 1375339 - protein, 9 aa, Homo Sapiens
VPDRSDKNK

SEQ ID NO: 1375340 - protein, 9 aa, Homo Sapiens
IAPSLHRPM

SEQ ID NO: 1375341 - protein, 9 aa, Homo Sapiens
RKRKYRLMG

SEQ ID NO: 1375342 - protein, 9 aa, Homo Sapiens
QSLTNLLAD

SEQ ID NO: 1375343 - protein, 9 aa, Homo Sapiens
RIPPPGTLR

SEQ ID NO: 1375344 - protein, 9 aa, Homo Sapiens
RVPPTLNIF

SEQ ID NO: 1375345 - protein, 9 aa, Homo Sapiens
IAVSDITSS

SEQ ID NO: 1375346 - protein, 9 aa, Homo Sapiens
PIGSAGPAG

SEQ ID NO: 1375347 - protein, 9 aa, Homo Sapiens
SIRDEKRTH

SEQ ID NO: 1375348 - protein, 9 aa, Homo Sapiens
YSSASRRTD

SEQ ID NO: 1375349 - protein, 9 aa, Homo Sapiens
KQHVCHVPR

SEQ ID NO: 1375350 - protein, 9 aa, Homo Sapiens
LFVMPYNYA

SEQ ID NO: 1375351 - protein, 9 aa, Homo Sapiens
NENRGTSPV

SEQ ID NO: 1375352 - protein, 9 aa, Homo Sapiens
VDFCTLLHY

SEQ ID NO: 1375353 - protein, 9 aa, Homo Sapiens
NQNDHSEEH

SEQ ID NO: 1375354 - protein, 9 aa, Homo Sapiens
DWIELYKHD

SEQ ID NO: 1375355 - protein, 9 aa, Homo Sapiens
KWDYAPNKN

SEQ ID NO: 1375356 - protein, 9 aa, Homo Sapiens
LREEAKEGP

SEQ ID NO: 1375357 - protein, 9 aa, Homo Sapiens
ILEWFKRFC

SEQ ID NO: 1375358 - protein, 9 aa, Homo Sapiens
LAIPQHANL

SEQ ID NO: 1375359 - protein, 9 aa, Homo Sapiens
AAREEQHEK

SEQ ID NO: 1375360 - protein, 9 aa, Homo Sapiens
SAGVLAKIV

SEQ ID NO: 1375361 - protein, 9 aa, Homo Sapiens
LHSPTLKIC

SEQ ID NO: 1375362 - protein, 9 aa, Homo Sapiens
LPAVQFDER

SEQ ID NO: 1375363 - protein, 9 aa, Homo Sapiens
DQCGKCFLL

SEQ ID NO: 1375364 - protein, 9 aa, Homo Sapiens
GEQLENSPS

SEQ ID NO: 1375365 - protein, 9 aa, Homo Sapiens
LSGERIKRL

SEQ ID NO: 1375366 - protein, 9 aa, Homo Sapiens
ESKKLPIHF

SEQ ID NO: 1375367 - protein, 9 aa, Homo Sapiens
SSRKNNITS

SEQ ID NO: 1375368 - protein, 9 aa, Homo Sapiens
GCRKAHTGK

SEQ ID NO: 1375369 - protein, 9 aa, Homo Sapiens
LYATDLGQE

SEQ ID NO: 1375370 - protein, 9 aa, Homo Sapiens
RLRLGYCHC

SEQ ID NO: 1375371 - protein, 9 aa, Homo Sapiens
RSETGIHID

SEQ ID NO: 1375372 - protein, 9 aa, Homo Sapiens
DAIYHVTVV

SEQ ID NO: 1375373 - protein, 9 aa, Homo Sapiens
AVLLSHPDL

SEQ ID NO: 1375374 - protein, 9 aa, Homo Sapiens
DQKQELGHV

SEQ ID NO: 1375375 - protein, 9 aa, Homo Sapiens
QKLIAPKAN

SEQ ID NO: 1375376 - protein, 9 aa, Homo Sapiens
PYSLERANP

SEQ ID NO: 1375377 - protein, 9 aa, Homo Sapiens
KCVEFIKDT

SEQ ID NO: 1375378 - protein, 9 aa, Homo Sapiens
HIMREDDIK

SEQ ID NO: 1375379 - protein, 9 aa, Homo Sapiens
RWHKSGLLH

SEQ ID NO: 1375380 - protein, 9 aa, Homo Sapiens
YLLLASVLD

SEQ ID NO: 1375381 - protein, 9 aa, Homo Sapiens
GTRHTETSS

SEQ ID NO: 1375382 - protein, 9 aa, Homo Sapiens
GHPAAASIY

SEQ ID NO: 1375383 - protein, 9 aa, Homo Sapiens
MYEELNEMG

SEQ ID NO: 1375384 - protein, 9 aa, Homo Sapiens
LLMSMHNID

SEQ ID NO: 1375385 - protein, 9 aa, Homo Sapiens
CRSWERAPR

SEQ ID NO: 1375386 - protein, 9 aa, Homo Sapiens
AGATYREVQ

SEQ ID NO: 1375387 - protein, 9 aa, Homo Sapiens
GDMDILRSL

SEQ ID NO: 1375388 - protein, 9 aa, Homo Sapiens
LHSIRNLKK

SEQ ID NO: 1375389 - protein, 9 aa, Homo Sapiens
GSEQMTELA

SEQ ID NO: 1375390 - protein, 9 aa, Homo Sapiens
SNVHTSVIP

SEQ ID NO: 1375391 - protein, 9 aa, Homo Sapiens
EEKYLTLQG

SEQ ID NO: 1375392 - protein, 9 aa, Homo Sapiens
QWKCDNDND

SEQ ID NO: 1375393 - protein, 9 aa, Homo Sapiens
NAAAALFEG

SEQ ID NO: 1375394 - protein, 9 aa, Homo Sapiens
RPGLLPPLN

SEQ ID NO: 1375395 - protein, 9 aa, Homo Sapiens
KYEFICRKW

SEQ ID NO: 1375396 - protein, 9 aa, Homo Sapiens
EFELRLQGY

SEQ ID NO: 1375397 - protein, 9 aa, Homo Sapiens
TLINAQDPP

SEQ ID NO: 1375398 - protein, 9 aa, Homo Sapiens
TAGTTMGKG

SEQ ID NO: 1375399 - protein, 9 aa, Homo Sapiens
DDLWEDITD

SEQ ID NO: 1375400 - protein, 9 aa, Homo Sapiens
QDALCGEMP

SEQ ID NO: 1375401 - protein, 9 aa, Homo Sapiens
ATESHRCLR

SEQ ID NO: 1375402 - protein, 9 aa, Homo Sapiens
FCKAPVLVR

SEQ ID NO: 1375403 - protein, 9 aa, Homo Sapiens
VNAFKEIQA

SEQ ID NO: 1375404 - protein, 9 aa, Homo Sapiens
PCVILPSKL

SEQ ID NO: 1375405 - protein, 9 aa, Homo Sapiens
WQSRHSGAT

SEQ ID NO: 1375406 - protein, 9 aa, Homo Sapiens
RRNRAAQRN

SEQ ID NO: 1375407 - protein, 9 aa, Homo Sapiens
SRICVHCHR

SEQ ID NO: 1375408 - protein, 9 aa, Homo Sapiens
QFGTLLGNN

SEQ ID NO: 1375409 - protein, 9 aa, Homo Sapiens
TVQNIDYPH

SEQ ID NO: 1375410 - protein, 9 aa, Homo Sapiens
ERQLDSIYR

SEQ ID NO: 1375411 - protein, 9 aa, Homo Sapiens
PRRCRSWER

SEQ ID NO: 1375412 - protein, 9 aa, Homo Sapiens
IMQKYEEQK

SEQ ID NO: 1375413 - protein, 9 aa, Homo Sapiens
DGKTINVKF

SEQ ID NO: 1375414 - protein, 9 aa, Homo Sapiens
LTGDLPLNE

SEQ ID NO: 1375415 - protein, 9 aa, Homo Sapiens
ENEDVSMKF

SEQ ID NO: 1375416 - protein, 9 aa, Homo Sapiens
SFPEVILLP

SEQ ID NO: 1375417 - protein, 9 aa, Homo Sapiens
CISEQWKCD

SEQ ID NO: 1375418 - protein, 9 aa, Homo Sapiens
FISLSGERI

SEQ ID NO: 1375419 - protein, 9 aa, Homo Sapiens
DDVHVCMMC

SEQ ID NO: 1375420 - protein, 9 aa, Homo Sapiens
SASRRTDLS

SEQ ID NO: 1375421 - protein, 9 aa, Homo Sapiens
AGRPNPAPR

SEQ ID NO: 1375422 - protein, 9 aa, Homo Sapiens
PPAPPCLFT

SEQ ID NO: 1375423 - protein, 9 aa, Homo Sapiens
YKCPVGIGE

SEQ ID NO: 1375424 - protein, 9 aa, Homo Sapiens
VHYGEKHFE

SEQ ID NO: 1375425 - protein, 9 aa, Homo Sapiens
VKLSEANKL

SEQ ID NO: 1375426 - protein, 9 aa, Homo Sapiens
ARLGMDQKA

SEQ ID NO: 1375427 - protein, 9 aa, Homo Sapiens
ILLGFPCPT

SEQ ID NO: 1375428 - protein, 9 aa, Homo Sapiens
MESDELNGA

SEQ ID NO: 1375429 - protein, 9 aa, Homo Sapiens
MTSPFTRLR

SEQ ID NO: 1375430 - protein, 9 aa, Homo Sapiens
PAPPCLFTA

SEQ ID NO: 1375431 - protein, 9 aa, Homo Sapiens
GWEVVRAEI

SEQ ID NO: 1375432 - protein, 9 aa, Homo Sapiens
LSHYSSGMP

SEQ ID NO: 1375433 - protein, 9 aa, Homo Sapiens
MGPPRSETG

SEQ ID NO: 1375434 - protein, 9 aa, Homo Sapiens
LMSMHNIDH

SEQ ID NO: 1375435 - protein, 9 aa, Homo Sapiens
GCTPFLGQH

SEQ ID NO: 1375436 - protein, 9 aa, Homo Sapiens
CTCAPSTLH

SEQ ID NO: 1375437 - protein, 9 aa, Homo Sapiens
KRWYFTGEQ

SEQ ID NO: 1375438 - protein, 9 aa, Homo Sapiens
VSPISESML

SEQ ID NO: 1375439 - protein, 9 aa, Homo Sapiens
TGDLPLNEK

SEQ ID NO: 1375440 - protein, 9 aa, Homo Sapiens
SKQCPQKKN

SEQ ID NO: 1375441 - protein, 9 aa, Homo Sapiens
PTGIKNENR

SEQ ID NO: 1375442 - protein, 9 aa, Homo Sapiens
QNRLQSPSK

SEQ ID NO: 1375443 - protein, 9 aa, Homo Sapiens
YLDAIYHVT

SEQ ID NO: 1375444 - protein, 9 aa, Homo Sapiens
CTLLHYHQI

SEQ ID NO: 1375445 - protein, 9 aa, Homo Sapiens
EFKLKQMRK

SEQ ID NO: 1375446 - protein, 9 aa, Homo Sapiens
EGINLRSWG

SEQ ID NO: 1375447 - protein, 9 aa, Homo Sapiens
NRPQLCFLA

SEQ ID NO: 1375448 - protein, 9 aa, Homo Sapiens
TPQEQFTLI

SEQ ID NO: 1375449 - protein, 9 aa, Homo Sapiens
KLGKSYNMI

SEQ ID NO: 1375450 - protein, 9 aa, Homo Sapiens
GKLKRVDVE

SEQ ID NO: 1375451 - protein, 9 aa, Homo Sapiens
WHKSGLLHA

SEQ ID NO: 1375452 - protein, 9 aa, Homo Sapiens
GLLVAQETP

SEQ ID NO: 1375453 - protein, 9 aa, Homo Sapiens
LAGRKRKNS

SEQ ID NO: 1375454 - protein, 9 aa, Homo Sapiens
HCSRSCGEG

SEQ ID NO: 1375455 - protein, 9 aa, Homo Sapiens
EDIDVQNVE

SEQ ID NO: 1375456 - protein, 9 aa, Homo Sapiens
LKKTVYNVM

SEQ ID NO: 1375457 - protein, 9 aa, Homo Sapiens
EFIKDTGLC

SEQ ID NO: 1375458 - protein, 9 aa, Homo Sapiens
SIGAIVVQT

SEQ ID NO: 1375459 - protein, 9 aa, Homo Sapiens
TAQLQGMNI

SEQ ID NO: 1375460 - protein, 9 aa, Homo Sapiens
KLQNEIANK

SEQ ID NO: 1375461 - protein, 9 aa, Homo Sapiens
QPQRYLEVQ

SEQ ID NO: 1375462 - protein, 9 aa, Homo Sapiens
KHTVIMQKY

SEQ ID NO: 1375463 - protein, 9 aa, Homo Sapiens
PQAEFQSYI

SEQ ID NO: 1375464 - protein, 9 aa, Homo Sapiens
AAAALFEGY

SEQ ID NO: 1375465 - protein, 9 aa, Homo Sapiens
DPEDFLQAS

SEQ ID NO: 1375466 - protein, 9 aa, Homo Sapiens
EWFKRFCWL

SEQ ID NO: 1375467 - protein, 9 aa, Homo Sapiens
HTSVIPFQN

SEQ ID NO: 1375468 - protein, 9 aa, Homo Sapiens
RSEGINLRS

SEQ ID NO: 1375469 - protein, 9 aa, Homo Sapiens
KKTVYNVMD

SEQ ID NO: 1375470 - protein, 9 aa, Homo Sapiens
YVKIYFVPD

SEQ ID NO: 1375471 - protein, 9 aa, Homo Sapiens
PPACPQAYQ

SEQ ID NO: 1375472 - protein, 9 aa, Homo Sapiens
VLAKIVKPS

SEQ ID NO: 1375473 - protein, 9 aa, Homo Sapiens
HYKKEGSEQ

SEQ ID NO: 1375474 - protein, 9 aa, Homo Sapiens
NEVSSNSWG

SEQ ID NO: 1375475 - protein, 9 aa, Homo Sapiens
QFDERLQPL

SEQ ID NO: 1375476 - protein, 9 aa, Homo Sapiens
ALIVFTIWI

SEQ ID NO: 1375477 - protein, 9 aa, Homo Sapiens
PGPMHTIAF

SEQ ID NO: 1375478 - protein, 9 aa, Homo Sapiens
MNRSPILTI

SEQ ID NO: 1375479 - protein, 9 aa, Homo Sapiens
CPALLVAKE

SEQ ID NO: 1375480 - protein, 9 aa, Homo Sapiens
ATQIDFSSS

SEQ ID NO: 1375481 - protein, 9 aa, Homo Sapiens
RNYASGYAH

SEQ ID NO: 1375482 - protein, 9 aa, Homo Sapiens
IPLPEHGMQ

SEQ ID NO: 1375483 - protein, 9 aa, Homo Sapiens
SLEQRIVKL

SEQ ID NO: 1375484 - protein, 9 aa, Homo Sapiens
YQVVQVNPV

SEQ ID NO: 1375485 - protein, 9 aa, Homo Sapiens
TAAGPRWAV

SEQ ID NO: 1375486 - protein, 9 aa, Homo Sapiens
DSLHDQGHS

SEQ ID NO: 1375487 - protein, 9 aa, Homo Sapiens
NYASGYAHY

SEQ ID NO: 1375488 - protein, 9 aa, Homo Sapiens
RYFIHNRPQ

SEQ ID NO: 1375489 - protein, 9 aa, Homo Sapiens
FSKQCPQKK

SEQ ID NO: 1375490 - protein, 9 aa, Homo Sapiens
INAQDPPMV

SEQ ID NO: 1375491 - protein, 9 aa, Homo Sapiens
QQMGEPKGS

SEQ ID NO: 1375492 - protein, 9 aa, Homo Sapiens
GSIRDEKRT

SEQ ID NO: 1375493 - protein, 9 aa, Homo Sapiens
LLQQTKDQF

SEQ ID NO: 1375494 - protein, 9 aa, Homo Sapiens
VSMKFLHGA

SEQ ID NO: 1375495 - protein, 9 aa, Homo Sapiens
IIQSNEVSS

SEQ ID NO: 1375496 - protein, 9 aa, Homo Sapiens
DALIDQLLQ

SEQ ID NO: 1375497 - protein, 9 aa, Homo Sapiens
SPARELRLP

SEQ ID NO: 1375498 - protein, 9 aa, Homo Sapiens
LWMKHSNLY

SEQ ID NO: 1375499 - protein, 9 aa, Homo Sapiens
ALVEAIVEK

SEQ ID NO: 1375500 - protein, 9 aa, Homo Sapiens
VRNTCGSEP

SEQ ID NO: 1375501 - protein, 9 aa, Homo Sapiens
RLQGYHREL

SEQ ID NO: 1375502 - protein, 9 aa, Homo Sapiens
PTLKICTCA

SEQ ID NO: 1375503 - protein, 9 aa, Homo Sapiens
DGYFRSRTL

SEQ ID NO: 1375504 - protein, 9 aa, Homo Sapiens
SDEDIDVQN

SEQ ID NO: 1375505 - protein, 9 aa, Homo Sapiens
LSGTVQNID

SEQ ID NO: 1375506 - protein, 9 aa, Homo Sapiens
QQTKDQFLS

SEQ ID NO: 1375507 - protein, 9 aa, Homo Sapiens
LLGPEFGGA

SEQ ID NO: 1375508 - protein, 9 aa, Homo Sapiens
YNFTGQHFP

SEQ ID NO: 1375509 - protein, 9 aa, Homo Sapiens
QGFHKFVID

SEQ ID NO: 1375510 - protein, 9 aa, Homo Sapiens
VETRKNAEV

SEQ ID NO: 1375511 - protein, 9 aa, Homo Sapiens
TYLDDSWVN

SEQ ID NO: 1375512 - protein, 9 aa, Homo Sapiens
YEELNEMGH

SEQ ID NO: 1375513 - protein, 9 aa, Homo Sapiens
QDPPMVVVR

SEQ ID NO: 1375514 - protein, 9 aa, Homo Sapiens
SPQQMGEPK

SEQ ID NO: 1375515 - protein, 9 aa, Homo Sapiens
TRHTETSSG

SEQ ID NO: 1375516 - protein, 9 aa, Homo Sapiens
SIVRKRVPP

SEQ ID NO: 1375517 - protein, 9 aa, Homo Sapiens
LRLGYCHCC

SEQ ID NO: 1375518 - protein, 9 aa, Homo Sapiens
KKEIALFRN

SEQ ID NO: 1375519 - protein, 9 aa, Homo Sapiens
GDVIAVSDI

SEQ ID NO: 1375520 - protein, 9 aa, Homo Sapiens
DLPLNEKLD

SEQ ID NO: 1375521 - protein, 9 aa, Homo Sapiens
RYVVLAQLW

SEQ ID NO: 1375522 - protein, 9 aa, Homo Sapiens
TCGSEPVAP

SEQ ID NO: 1375523 - protein, 9 aa, Homo Sapiens
ASRRTDLSY

SEQ ID NO: 1375524 - protein, 9 aa, Homo Sapiens
PTPHCFKIG

SEQ ID NO: 1375525 - protein, 9 aa, Homo Sapiens
QELGHVIHL

SEQ ID NO: 1375526 - protein, 9 aa, Homo Sapiens
LSIDSMLDS

SEQ ID NO: 1375527 - protein, 9 aa, Homo Sapiens
PPRSETGIH

SEQ ID NO: 1375528 - protein, 9 aa, Homo Sapiens
FIHNRPQLC

SEQ ID NO: 1375529 - protein, 9 aa, Homo Sapiens
AGVLAKIVK

SEQ ID NO: 1375530 - protein, 9 aa, Homo Sapiens
VAMKVIPRN

SEQ ID NO: 1375531 - protein, 9 aa, Homo Sapiens
EFQSYIRTC

SEQ ID NO: 1375532 - protein, 9 aa, Homo Sapiens
PLLQQTKDQ

SEQ ID NO: 1375533 - protein, 9 aa, Homo Sapiens
QMETLSGDR

SEQ ID NO: 1375534 - protein, 9 aa, Homo Sapiens
PIIQSNEVS

SEQ ID NO: 1375535 - protein, 9 aa, Homo Sapiens
PLQRVHYGE

SEQ ID NO: 1375536 - protein, 9 aa, Homo Sapiens
QSKQPDMTN

SEQ ID NO: 1375537 - protein, 9 aa, Homo Sapiens
VERKIESQA

SEQ ID NO: 1375538 - protein, 9 aa, Homo Sapiens
SFVGKTWSH

SEQ ID NO: 1375539 - protein, 9 aa, Homo Sapiens
QNKLEELKK

SEQ ID NO: 1375540 - protein, 9 aa, Homo Sapiens
KNYLDAIYH

SEQ ID NO: 1375541 - protein, 9 aa, Homo Sapiens
PRCGKVYGK

SEQ ID NO: 1375542 - protein, 9 aa, Homo Sapiens
DLATLKITA

SEQ ID NO: 1375543 - protein, 9 aa, Homo Sapiens
CPKCGKAFR

SEQ ID NO: 1375544 - protein, 9 aa, Homo Sapiens
FICRKWQMM

SEQ ID NO: 1375545 - protein, 9 aa, Homo Sapiens
SSHLTRHRR

SEQ ID NO: 1375546 - protein, 9 aa, Homo Sapiens
WSQVILPPW

SEQ ID NO: 1375547 - protein, 9 aa, Homo Sapiens
IGLGRVMRT

SEQ ID NO: 1375548 - protein, 9 aa, Homo Sapiens
DERYTCVAF

SEQ ID NO: 1375549 - protein, 9 aa, Homo Sapiens
NSFPEVILL

SEQ ID NO: 1375550 - protein, 9 aa, Homo Sapiens
AKAQSAALE

SEQ ID NO: 1375551 - protein, 9 aa, Homo Sapiens
PTEIIEITD

SEQ ID NO: 1375552 - protein, 9 aa, Homo Sapiens
RTTRGKLKR

SEQ ID NO: 1375553 - protein, 9 aa, Homo Sapiens
LGFSKGGHL

SEQ ID NO: 1375554 - protein, 9 aa, Homo Sapiens
PRTVEIIVN

SEQ ID NO: 1375555 - protein, 9 aa, Homo Sapiens
VQNIDYPHY

SEQ ID NO: 1375556 - protein, 9 aa, Homo Sapiens
PGIGLGRVM

SEQ ID NO: 1375557 - protein, 9 aa, Homo Sapiens
PALLVAKEE

SEQ ID NO: 1375558 - protein, 9 aa, Homo Sapiens
QEIYNFTGQ

SEQ ID NO: 1375559 - protein, 9 aa, Homo Sapiens
GSRTAAGPR

SEQ ID NO: 1375560 - protein, 9 aa, Homo Sapiens
GTYLDDSWV

SEQ ID NO: 1375561 - protein, 9 aa, Homo Sapiens
SQAEWVGAG

SEQ ID NO: 1375562 - protein, 9 aa, Homo Sapiens
RSPILTIIT

SEQ ID NO: 1375563 - protein, 9 aa, Homo Sapiens
TETKQTFKE

SEQ ID NO: 1375564 - protein, 9 aa, Homo Sapiens
INTIMGNNK

SEQ ID NO: 1375565 - protein, 9 aa, Homo Sapiens
TVLGVGAVG

SEQ ID NO: 1375566 - protein, 9 aa, Homo Sapiens
TEVNAFKEI

SEQ ID NO: 1375567 - protein, 9 aa, Homo Sapiens
SKGGHLCLS

SEQ ID NO: 1375568 - protein, 9 aa, Homo Sapiens
WQLRIAAVE

SEQ ID NO: 1375569 - protein, 9 aa, Homo Sapiens
HKNTLTDFP

SEQ ID NO: 1375570 - protein, 9 aa, Homo Sapiens
FVPDRSDKN

SEQ ID NO: 1375571 - protein, 9 aa, Homo Sapiens
KQMETLSGD

SEQ ID NO: 1375572 - protein, 9 aa, Homo Sapiens
HPKPLSPTA

SEQ ID NO: 1375573 - protein, 9 aa, Homo Sapiens
LLPPLNVNL

SEQ ID NO: 1375574 - protein, 9 aa, Homo Sapiens
EEVKWDYAP

SEQ ID NO: 1375575 - protein, 9 aa, Homo Sapiens
IDSRNSSML

SEQ ID NO: 1375576 - protein, 9 aa, Homo Sapiens
QSYIRTCYD

SEQ ID NO: 1375577 - protein, 9 aa, Homo Sapiens
MGGMNRSPI

SEQ ID NO: 1375578 - protein, 9 aa, Homo Sapiens
VDDLEHLDK

SEQ ID NO: 1375579 - protein, 9 aa, Homo Sapiens
SATQIDFSS

SEQ ID NO: 1375580 - protein, 9 aa, Homo Sapiens
LGLEMRDTQ

SEQ ID NO: 1375581 - protein, 9 aa, Homo Sapiens
GNIMPLHWQ

SEQ ID NO: 1375582 - protein, 9 aa, Homo Sapiens
NESAGVLAK

SEQ ID NO: 1375583 - protein, 9 aa, Homo Sapiens
IVAPSVHSD

SEQ ID NO: 1375584 - protein, 9 aa, Homo Sapiens
RPKTMTYTP

SEQ ID NO: 1375585 - protein, 9 aa, Homo Sapiens
AMESSPGHP

SEQ ID NO: 1375586 - protein, 9 aa, Homo Sapiens
CHPSSYTTH

SEQ ID NO: 1375587 - protein, 9 aa, Homo Sapiens
CFKIGEEAE

SEQ ID NO: 1375588 - protein, 9 aa, Homo Sapiens
LFEGYSSYP

SEQ ID NO: 1375589 - protein, 9 aa, Homo Sapiens
METLSGDRV

SEQ ID NO: 1375590 - protein, 9 aa, Homo Sapiens
LHSALDELF

SEQ ID NO: 1375591 - protein, 9 aa, Homo Sapiens
LPVSRQKNE

SEQ ID NO: 1375592 - protein, 9 aa, Homo Sapiens
AKAKLERKL

SEQ ID NO: 1375593 - protein, 9 aa, Homo Sapiens
ERLHAGATY

SEQ ID NO: 1375594 - protein, 9 aa, Homo Sapiens
PARLGMDQK

SEQ ID NO: 1375595 - protein, 9 aa, Homo Sapiens
FQIPLPEHG

SEQ ID NO: 1375596 - protein, 9 aa, Homo Sapiens
WPQVGATFG

SEQ ID NO: 1375597 - protein, 9 aa, Homo Sapiens
TLPEKQSTE

SEQ ID NO: 1375598 - protein, 9 aa, Homo Sapiens
KEKELQNKL

SEQ ID NO: 1375599 - protein, 9 aa, Homo Sapiens
HIYGHVTLM

SEQ ID NO: 1375600 - protein, 9 aa, Homo Sapiens
GTLLGNNES

SEQ ID NO: 1375601 - protein, 9 aa, Homo Sapiens
QLLQQFASF

SEQ ID NO: 1375602 - protein, 9 aa, Homo Sapiens
AATIQAVER

SEQ ID NO: 1375603 - protein, 9 aa, Homo Sapiens
ESSENTDVN

SEQ ID NO: 1375604 - protein, 9 aa, Homo Sapiens
LPAGQKELN

SEQ ID NO: 1375605 - protein, 9 aa, Homo Sapiens
NTSSRKNNI

SEQ ID NO: 1375606 - protein, 9 aa, Homo Sapiens
VRHLRSLLK

SEQ ID NO: 1375607 - protein, 9 aa, Homo Sapiens
FILGSIRDE

SEQ ID NO: 1375608 - protein, 9 aa, Homo Sapiens
TPNKIELAK

SEQ ID NO: 1375609 - protein, 9 aa, Homo Sapiens
SESMLERLS

SEQ ID NO: 1375610 - protein, 9 aa, Homo Sapiens
KKYSPCGWE

SEQ ID NO: 1375611 - protein, 9 aa, Homo Sapiens
DYHQDLFDD

SEQ ID NO: 1375612 - protein, 9 aa, Homo Sapiens
TVRSGLDLK

SEQ ID NO: 1375613 - protein, 9 aa, Homo Sapiens
ESMLERLSK

SEQ ID NO: 1375614 - protein, 9 aa, Homo Sapiens
SEFGMETVI

SEQ ID NO: 1375615 - protein, 9 aa, Homo Sapiens
EIYNFTGQH

SEQ ID NO: 1375616 - protein, 9 aa, Homo Sapiens
LRSLPVNVG

SEQ ID NO: 1375617 - protein, 9 aa, Homo Sapiens
FHPFISTNI

SEQ ID NO: 1375618 - protein, 9 aa, Homo Sapiens
HRCLRIPPP

SEQ ID NO: 1375619 - protein, 9 aa, Homo Sapiens
PEGTLPEKQ

SEQ ID NO: 1375620 - protein, 9 aa, Homo Sapiens
LAQSVRNTC

SEQ ID NO: 1375621 - protein, 9 aa, Homo Sapiens
SRSEGINLR

SEQ ID NO: 1375622 - protein, 9 aa, Homo Sapiens
SLLMSMHNI

SEQ ID NO: 1375623 - protein, 9 aa, Homo Sapiens
PAAAAAGPQ

SEQ ID NO: 1375624 - protein, 9 aa, Homo Sapiens
KEEKVVPES

SEQ ID NO: 1375625 - protein, 9 aa, Homo Sapiens
NCKAEATPL

SEQ ID NO: 1375626 - protein, 9 aa, Homo Sapiens
SILQDGKLH

SEQ ID NO: 1375627 - protein, 9 aa, Homo Sapiens
WMPGRQPTT

SEQ ID NO: 1375628 - protein, 9 aa, Homo Sapiens
NVMDKNRCE

SEQ ID NO: 1375629 - protein, 9 aa, Homo Sapiens
FKEIQALQT

SEQ ID NO: 1375630 - protein, 9 aa, Homo Sapiens
GATYREVQK

SEQ ID NO: 1375631 - protein, 9 aa, Homo Sapiens
VEIIVNSTY

SEQ ID NO: 1375632 - protein, 9 aa, Homo Sapiens
ITTPSKKKN

SEQ ID NO: 1375633 - protein, 9 aa, Homo Sapiens
FDDALIDQL

SEQ ID NO: 1375634 - protein, 9 aa, Homo Sapiens
LQNEIANKD

SEQ ID NO: 1375635 - protein, 9 aa, Homo Sapiens
SEGINLRSW

SEQ ID NO: 1375636 - protein, 9 aa, Homo Sapiens
LGYCHCCYQ

SEQ ID NO: 1375637 - protein, 9 aa, Homo Sapiens
MESSPGHPA

SEQ ID NO: 1375638 - protein, 9 aa, Homo Sapiens
ELQNKLEEL

SEQ ID NO: 1375639 - protein, 9 aa, Homo Sapiens
HMESDELNG

SEQ ID NO: 1375640 - protein, 9 aa, Homo Sapiens
TFKEFRCQV

SEQ ID NO: 1375641 - protein, 9 aa, Homo Sapiens
VLPIIVFLS

SEQ ID NO: 1375642 - protein, 9 aa, Homo Sapiens
GHPLIEPIP

SEQ ID NO: 1375643 - protein, 9 aa, Homo Sapiens
DELFDIMDS

SEQ ID NO: 1375644 - protein, 9 aa, Homo Sapiens
KRFCWLSLL

SEQ ID NO: 1375645 - protein, 9 aa, Homo Sapiens
ATHDLQGPP

SEQ ID NO: 1375646 - protein, 9 aa, Homo Sapiens
SDDDDDMMM

SEQ ID NO: 1375647 - protein, 9 aa, Homo Sapiens
QKAASPPPE

SEQ ID NO: 1375648 - protein, 9 aa, Homo Sapiens
KLSEANKLA

SEQ ID NO: 1375649 - protein, 9 aa, Homo Sapiens
DLALLRSLQ

SEQ ID NO: 1375650 - protein, 9 aa, Homo Sapiens
TVEIIVNST

SEQ ID NO: 1375651 - protein, 9 aa, Homo Sapiens
CPCVILPSK

SEQ ID NO: 1375652 - protein, 9 aa, Homo Sapiens
TTRGKLKRV

SEQ ID NO: 1375653 - protein, 9 aa, Homo Sapiens
KQVQLFMTD

SEQ ID NO: 1375654 - protein, 9 aa, Homo Sapiens
GPIGSAGPA

SEQ ID NO: 1375655 - protein, 9 aa, Homo Sapiens
KEVGDVIAV

SEQ ID NO: 1375656 - protein, 9 aa, Homo Sapiens
GSHGMDAVR

SEQ ID NO: 1375657 - protein, 9 aa, Homo Sapiens
ITSHMESDE

SEQ ID NO: 1375658 - protein, 9 aa, Homo Sapiens
HGYDQPATE

SEQ ID NO: 1375659 - protein, 9 aa, Homo Sapiens
DLNDKLQNE

SEQ ID NO: 1375660 - protein, 9 aa, Homo Sapiens
VGCVQYDGR

SEQ ID NO: 1375661 - protein, 9 aa, Homo Sapiens
TTMGKGVTT

SEQ ID NO: 1375662 - protein, 9 aa, Homo Sapiens
KAAKVFFET

SEQ ID NO: 1375663 - protein, 9 aa, Homo Sapiens
PERQLDSIY

SEQ ID NO: 1375664 - protein, 9 aa, Homo Sapiens
ETGIHIDPL

SEQ ID NO: 1375665 - protein, 9 aa, Homo Sapiens
KLIKTVIQT

SEQ ID NO: 1375666 - protein, 9 aa, Homo Sapiens
QNHLMLIIN

SEQ ID NO: 1375667 - protein, 9 aa, Homo Sapiens
RAAQRNPAL

SEQ ID NO: 1375668 - protein, 9 aa, Homo Sapiens
EDEEEEEEK

SEQ ID NO: 1375669 - protein, 9 aa, Homo Sapiens
TSSSASNQP

SEQ ID NO: 1375670 - protein, 9 aa, Homo Sapiens
VAKEEKVVP

SEQ ID NO: 1375671 - protein, 9 aa, Homo Sapiens
PACPQAYQS

SEQ ID NO: 1375672 - protein, 9 aa, Homo Sapiens
CNPLDTGPM

SEQ ID NO: 1375673 - protein, 9 aa, Homo Sapiens
SVFGLLLTH

SEQ ID NO: 1375674 - protein, 9 aa, Homo Sapiens
KDIVSEFGM

SEQ ID NO: 1375675 - protein, 9 aa, Homo Sapiens
DENEDVSMK

SEQ ID NO: 1375676 - protein, 9 aa, Homo Sapiens
FEGYSSYPG

SEQ ID NO: 1375677 - protein, 9 aa, Homo Sapiens
KELQNKLEE

SEQ ID NO: 1375678 - protein, 9 aa, Homo Sapiens
HFLWMKHSN

SEQ ID NO: 1375679 - protein, 9 aa, Homo Sapiens
LWQLKAPLP

SEQ ID NO: 1375680 - protein, 9 aa, Homo Sapiens
PKCGKAFRQ

SEQ ID NO: 1375681 - protein, 9 aa, Homo Sapiens
QRVHYGEKH

SEQ ID NO: 1375682 - protein, 9 aa, Homo Sapiens
LFRNKLSQQ

SEQ ID NO: 1375683 - protein, 9 aa, Homo Sapiens
SGLLHAEGS

SEQ ID NO: 1375684 - protein, 9 aa, Homo Sapiens
ISRLLGPEF

SEQ ID NO: 1375685 - protein, 9 aa, Homo Sapiens
DITDSLHDQ

SEQ ID NO: 1375686 - protein, 9 aa, Homo Sapiens
VGDVIAVSD

SEQ ID NO: 1375687 - protein, 9 aa, Homo Sapiens
EDEEMLQTA

SEQ ID NO: 1375688 - protein, 9 aa, Homo Sapiens
QDYEEDEED

SEQ ID NO: 1375689 - protein, 9 aa, Homo Sapiens
KELQWPDEE

SEQ ID NO: 1375690 - protein, 9 aa, Homo Sapiens
CSRSCGEGL

SEQ ID NO: 1375691 - protein, 9 aa, Homo Sapiens
FELRLQGYH

SEQ ID NO: 1375692 - protein, 9 aa, Homo Sapiens
GFPCPTEGQ

SEQ ID NO: 1375693 - protein, 9 aa, Homo Sapiens
MTTTTTTLT

SEQ ID NO: 1375694 - protein, 9 aa, Homo Sapiens
FYTGFKIND

SEQ ID NO: 1375695 - protein, 9 aa, Homo Sapiens
YHVTVVYEG

SEQ ID NO: 1375696 - protein, 9 aa, Homo Sapiens
KAPPPSLQS

SEQ ID NO: 1375697 - protein, 9 aa, Homo Sapiens
KGSWSGKNP

SEQ ID NO: 1375698 - protein, 9 aa, Homo Sapiens
EVQQHQKWY

SEQ ID NO: 1375699 - protein, 9 aa, Homo Sapiens
RSCGEGLRS

SEQ ID NO: 1375700 - protein, 9 aa, Homo Sapiens
VSRQKNEKM

SEQ ID NO: 1375701 - protein, 9 aa, Homo Sapiens
DDENDGEHQ

SEQ ID NO: 1375702 - protein, 9 aa, Homo Sapiens
QDLKLFEKK

SEQ ID NO: 1375703 - protein, 9 aa, Homo Sapiens
EMLQTADGE

SEQ ID NO: 1375704 - protein, 9 aa, Homo Sapiens
GFHLAHDGQ

SEQ ID NO: 1375705 - protein, 9 aa, Homo Sapiens
QEQFTLISS

SEQ ID NO: 1375706 - protein, 9 aa, Homo Sapiens
QAEWVGAGA

SEQ ID NO: 1375707 - protein, 9 aa, Homo Sapiens
PSPPHEHQE

SEQ ID NO: 1375708 - protein, 9 aa, Homo Sapiens
ELRLPIRDG

SEQ ID NO: 1375709 - protein, 9 aa, Homo Sapiens
YNVMDKNRC

SEQ ID NO: 1375710 - protein, 9 aa, Homo Sapiens
SASSATQID

SEQ ID NO: 1375711 - protein, 9 aa, Homo Sapiens
QTSAKNAIN

SEQ ID NO: 1375712 - protein, 9 aa, Homo Sapiens
TLLHYHQIL

SEQ ID NO: 1375713 - protein, 9 aa, Homo Sapiens
TSAPDTRPV

SEQ ID NO: 1375714 - protein, 9 aa, Homo Sapiens
MMCLRAIMN

SEQ ID NO: 1375715 - protein, 9 aa, Homo Sapiens
TGCMFRLTF

SEQ ID NO: 1375716 - protein, 9 aa, Homo Sapiens
CLRIPPPGT

SEQ ID NO: 1375717 - protein, 9 aa, Homo Sapiens
KIRVNDVND

SEQ ID NO: 1375718 - protein, 9 aa, Homo Sapiens
ALGCTPFLG

SEQ ID NO: 1375719 - protein, 9 aa, Homo Sapiens
ATDLGQEVS

SEQ ID NO: 1375720 - protein, 9 aa, Homo Sapiens
FWQRSADPI

SEQ ID NO: 1375721 - protein, 9 aa, Homo Sapiens
DKMFSLLKR

SEQ ID NO: 1375722 - protein, 9 aa, Homo Sapiens
ACDYHQDLF

SEQ ID NO: 1375723 - protein, 9 aa, Homo Sapiens
ISFGGMPFT

SEQ ID NO: 1375724 - protein, 9 aa, Homo Sapiens
QKNEKMPLL

SEQ ID NO: 1375725 - protein, 9 aa, Homo Sapiens
ELHRATESH

SEQ ID NO: 1375726 - protein, 9 aa, Homo Sapiens
GNLQPQRYL

SEQ ID NO: 1375727 - protein, 9 aa, Homo Sapiens
LLKKEIALF

SEQ ID NO: 1375728 - protein, 9 aa, Homo Sapiens
NEELQKIYK

SEQ ID NO: 1375729 - protein, 9 aa, Homo Sapiens
HWRVHTGQK

SEQ ID NO: 1375730 - protein, 9 aa, Homo Sapiens
KNREKAAKV

SEQ ID NO: 1375731 - protein, 9 aa, Homo Sapiens
NKRWYFTGE

SEQ ID NO: 1375732 - protein, 9 aa, Homo Sapiens
PPCLFTADT

SEQ ID NO: 1375733 - protein, 9 aa, Homo Sapiens
EMLSLNEEL

SEQ ID NO: 1375734 - protein, 9 aa, Homo Sapiens
SNQPYQRET

SEQ ID NO: 1375735 - protein, 9 aa, Homo Sapiens
KRQDNQNDH

SEQ ID NO: 1375736 - protein, 9 aa, Homo Sapiens
ALASPGPNG

SEQ ID NO: 1375737 - protein, 9 aa, Homo Sapiens
EPAHHPGCQ

SEQ ID NO: 1375738 - protein, 9 aa, Homo Sapiens
FKLKQMRKS

SEQ ID NO: 1375739 - protein, 9 aa, Homo Sapiens
CSEFELRLQ

SEQ ID NO: 1375740 - protein, 9 aa, Homo Sapiens
PARELRLPI

SEQ ID NO: 1375741 - protein, 9 aa, Homo Sapiens
TQIVAPSVH

SEQ ID NO: 1375742 - protein, 9 aa, Homo Sapiens
PCPALLVAK

SEQ ID NO: 1375743 - protein, 9 aa, Homo Sapiens
KHEKTVHIY

SEQ ID NO: 1375744 - protein, 9 aa, Homo Sapiens
AAFIYEKLG

SEQ ID NO: 1375745 - protein, 9 aa, Homo Sapiens
ALHSALDEL

SEQ ID NO: 1375746 - protein, 9 aa, Homo Sapiens
YSNVHTSVI

SEQ ID NO: 1375747 - protein, 9 aa, Homo Sapiens
PDFISLSGE

SEQ ID NO: 1375748 - protein, 9 aa, Homo Sapiens
AGPQATLPF

SEQ ID NO: 1375749 - protein, 9 aa, Homo Sapiens
EVPEEYSEH

SEQ ID NO: 1375750 - protein, 9 aa, Homo Sapiens
NYLNQEIKI

SEQ ID NO: 1375751 - protein, 9 aa, Homo Sapiens
RKQMETYLK

SEQ ID NO: 1375752 - protein, 9 aa, Homo Sapiens
PGICPHFAE

SEQ ID NO: 1375753 - protein, 9 aa, Homo Sapiens
NYLDAIYHV

SEQ ID NO: 1375754 - protein, 9 aa, Homo Sapiens
ASKETLFNA

SEQ ID NO: 1375755 - protein, 9 aa, Homo Sapiens
PPSVTAGPR

SEQ ID NO: 1375756 - protein, 9 aa, Homo Sapiens
MYFFLGILL

SEQ ID NO: 1375757 - protein, 9 aa, Homo Sapiens
QSVRNTCGS

SEQ ID NO: 1375758 - protein, 9 aa, Homo Sapiens
LDSIYRRQG

SEQ ID NO: 1375759 - protein, 9 aa, Homo Sapiens
GLLPVLNPT

SEQ ID NO: 1375760 - protein, 9 aa, Homo Sapiens
RKNAEVSLE

SEQ ID NO: 1375761 - protein, 9 aa, Homo Sapiens
FEHMEVMTD

SEQ ID NO: 1375762 - protein, 9 aa, Homo Sapiens
LKQMRKSPN

SEQ ID NO: 1375763 - protein, 9 aa, Homo Sapiens
TSTSESWVQ

SEQ ID NO: 1375764 - protein, 9 aa, Homo Sapiens
NEDVRHLRS

SEQ ID NO: 1375765 - protein, 9 aa, Homo Sapiens
ALVSPISES

SEQ ID NO: 1375766 - protein, 9 aa, Homo Sapiens
LSNGSTKSS

SEQ ID NO: 1375767 - protein, 9 aa, Homo Sapiens
HVIHLSNLP

SEQ ID NO: 1375768 - protein, 9 aa, Homo Sapiens
ALLRSLQHF

SEQ ID NO: 1375769 - protein, 9 aa, Homo Sapiens
ELNEMGHKP

SEQ ID NO: 1375770 - protein, 9 aa, Homo Sapiens
VILPSKLYL

SEQ ID NO: 1375771 - protein, 9 aa, Homo Sapiens
GDQNHLMLI

SEQ ID NO: 1375772 - protein, 9 aa, Homo Sapiens
GWMPGRQPT

SEQ ID NO: 1375773 - protein, 9 aa, Homo Sapiens
KSLASEWGK

SEQ ID NO: 1375774 - protein, 9 aa, Homo Sapiens
PIIVFLSCV

SEQ ID NO: 1375775 - protein, 9 aa, Homo Sapiens
GQHFPFFWT

SEQ ID NO: 1375776 - protein, 9 aa, Homo Sapiens
SLNEELQKI

SEQ ID NO: 1375777 - protein, 9 aa, Homo Sapiens
IALFRNKLS

SEQ ID NO: 1375778 - protein, 9 aa, Homo Sapiens
KACNPLDTG

SEQ ID NO: 1375779 - protein, 9 aa, Homo Sapiens
AAAAAGPQA

SEQ ID NO: 1375780 - protein, 9 aa, Homo Sapiens
SSASNQPYQ

SEQ ID NO: 1375781 - protein, 9 aa, Homo Sapiens
ILPSKLYLR

SEQ ID NO: 1375782 - protein, 9 aa, Homo Sapiens
FAEDIWPEQ

SEQ ID NO: 1375783 - protein, 9 aa, Homo Sapiens
LACCAVEIM

SEQ ID NO: 1375784 - protein, 9 aa, Homo Sapiens
LSKHMKIHC

SEQ ID NO: 1375785 - protein, 9 aa, Homo Sapiens
VQFDERLQP

SEQ ID NO: 1375786 - protein, 9 aa, Homo Sapiens
MKSRLRCTM

SEQ ID NO: 1375787 - protein, 9 aa, Homo Sapiens
WRSWQSRHS

SEQ ID NO: 1375788 - protein, 9 aa, Homo Sapiens
TQDEVQQHQ

SEQ ID NO: 1375789 - protein, 9 aa, Homo Sapiens
LQTADGESM

SEQ ID NO: 1375790 - protein, 9 aa, Homo Sapiens
GAIVVQTSA

SEQ ID NO: 1375791 - protein, 9 aa, Homo Sapiens
NTLTDFPQM

SEQ ID NO: 1375792 - protein, 9 aa, Homo Sapiens
PHCFKIGEE

SEQ ID NO: 1375793 - protein, 9 aa, Homo Sapiens
VPPTLNIFI

SEQ ID NO: 1375794 - protein, 9 aa, Homo Sapiens
LTAGHELQP

SEQ ID NO: 1375795 - protein, 9 aa, Homo Sapiens
VMDKNRCEL

SEQ ID NO: 1375796 - protein, 9 aa, Homo Sapiens
YEMPEFSLD

SEQ ID NO: 1375797 - protein, 9 aa, Homo Sapiens
PKTMTYTPG

SEQ ID NO: 1375798 - protein, 9 aa, Homo Sapiens
CGLLVAQET

SEQ ID NO: 1375799 - protein, 9 aa, Homo Sapiens
IKLLARSVL

SEQ ID NO: 1375800 - protein, 9 aa, Homo Sapiens
KEKFGFHPF

SEQ ID NO: 1375801 - protein, 9 aa, Homo Sapiens
GHKPDVELL

SEQ ID NO: 1375802 - protein, 9 aa, Homo Sapiens
DFMHKNTLT

SEQ ID NO: 1375803 - protein, 9 aa, Homo Sapiens
AKLERKLSE

SEQ ID NO: 1375804 - protein, 9 aa, Homo Sapiens
SYIRTCYDS

SEQ ID NO: 1375805 - protein, 9 aa, Homo Sapiens
HQDYEEDEE

SEQ ID NO: 1375806 - protein, 9 aa, Homo Sapiens
KFGFHPFIS

SEQ ID NO: 1375807 - protein, 9 aa, Homo Sapiens
SMSHPKPLS

SEQ ID NO: 1375808 - protein, 9 aa, Homo Sapiens
LVLNSFPEV

SEQ ID NO: 1375809 - protein, 9 aa, Homo Sapiens
AIVEKVACP

SEQ ID NO: 1375810 - protein, 9 aa, Homo Sapiens
RQKNEKMPL

SEQ ID NO: 1375811 - protein, 9 aa, Homo Sapiens
CNQSSFWQR

SEQ ID NO: 1375812 - protein, 9 aa, Homo Sapiens
CFLLESELL

SEQ ID NO: 1375813 - protein, 9 aa, Homo Sapiens
SEGNIMPLH

SEQ ID NO: 1375814 - protein, 9 aa, Homo Sapiens
FFFPQKVSE

SEQ ID NO: 1375815 - protein, 9 aa, Homo Sapiens
PAIQSLTNL

SEQ ID NO: 1375816 - protein, 9 aa, Homo Sapiens
SLPLSGVED

SEQ ID NO: 1375817 - protein, 9 aa, Homo Sapiens
PEEKYLTLQ

SEQ ID NO: 1375818 - protein, 9 aa, Homo Sapiens
LKITAHNER

SEQ ID NO: 1375819 - protein, 9 aa, Homo Sapiens
RQPTTHAEA

SEQ ID NO: 1375820 - protein, 9 aa, Homo Sapiens
QAVLHIIRE

SEQ ID NO: 1375821 - protein, 9 aa, Homo Sapiens
QKWYQKFLA

SEQ ID NO: 1375822 - protein, 9 aa, Homo Sapiens
KITVLGVGA

SEQ ID NO: 1375823 - protein, 9 aa, Homo Sapiens
GIGESLPCV

SEQ ID NO: 1375824 - protein, 9 aa, Homo Sapiens
HPLLQQTKD

SEQ ID NO: 1375825 - protein, 9 aa, Homo Sapiens
EELNEMGHK

SEQ ID NO: 1375826 - protein, 9 aa, Homo Sapiens
LLHYHQILA

SEQ ID NO: 1375827 - protein, 9 aa, Homo Sapiens
VRTTRGKLK

SEQ ID NO: 1375828 - protein, 9 aa, Homo Sapiens
IQMTPVNKT

SEQ ID NO: 1375829 - protein, 9 aa, Homo Sapiens
FCQLFPGLR

SEQ ID NO: 1375830 - protein, 9 aa, Homo Sapiens
WQRSADPIR

SEQ ID NO: 1375831 - protein, 9 aa, Homo Sapiens
KVFFETFNV

SEQ ID NO: 1375832 - protein, 9 aa, Homo Sapiens
EKQSTEQAI

SEQ ID NO: 1375833 - protein, 9 aa, Homo Sapiens
EVKWDYAPN

SEQ ID NO: 1375834 - protein, 9 aa, Homo Sapiens
TVLPPGEGG

SEQ ID NO: 1375835 - protein, 9 aa, Homo Sapiens
ILAVKLGSV

SEQ ID NO: 1375836 - protein, 9 aa, Homo Sapiens
LLGLEMRDT

SEQ ID NO: 1375837 - protein, 9 aa, Homo Sapiens
RFCWLSLLS

SEQ ID NO: 1375838 - protein, 9 aa, Homo Sapiens
LIKTVIQTK

SEQ ID NO: 1375839 - protein, 9 aa, Homo Sapiens
LNLGRNYAS

SEQ ID NO: 1375840 - protein, 9 aa, Homo Sapiens
FCWLSLLSS

SEQ ID NO: 1375841 - protein, 9 aa, Homo Sapiens
TSPRKVPAP

SEQ ID NO: 1375842 - protein, 9 aa, Homo Sapiens
KRVPPTLNI

SEQ ID NO: 1375843 - protein, 9 aa, Homo Sapiens
AQMLIFTLA

SEQ ID NO: 1375844 - protein, 9 aa, Homo Sapiens
IGDQNHLML

SEQ ID NO: 1375845 - protein, 9 aa, Homo Sapiens
KAPLPAGQK

SEQ ID NO: 1375846 - protein, 9 aa, Homo Sapiens
LLQDLKLFE

SEQ ID NO: 1375847 - protein, 9 aa, Homo Sapiens
LPPWPQVGA

SEQ ID NO: 1375848 - protein, 9 aa, Homo Sapiens
LLLGTVLPP

SEQ ID NO: 1375849 - protein, 9 aa, Homo Sapiens
LSNEDVRHL

SEQ ID NO: 1375850 - protein, 9 aa, Homo Sapiens
DMTNLTELA

SEQ ID NO: 1375851 - protein, 9 aa, Homo Sapiens
AASPPPEQK

SEQ ID NO: 1375852 - protein, 9 aa, Homo Sapiens
ERYTCVAFG

SEQ ID NO: 1375853 - protein, 9 aa, Homo Sapiens
DSVQTDTLT

SEQ ID NO: 1375854 - protein, 9 aa, Homo Sapiens
NLNLGRNYA

SEQ ID NO: 1375855 - protein, 9 aa, Homo Sapiens
QNCLDVDEC

SEQ ID NO: 1375856 - protein, 9 aa, Homo Sapiens
RRAAREEQH

SEQ ID NO: 1375857 - protein, 9 aa, Homo Sapiens
FEIVTPKIN

SEQ ID NO: 1375858 - protein, 9 aa, Homo Sapiens
GSIKDIVSE

SEQ ID NO: 1375859 - protein, 9 aa, Homo Sapiens
VIDSRNSSM

SEQ ID NO: 1375860 - protein, 9 aa, Homo Sapiens
SGLDLKANK

SEQ ID NO: 1375861 - protein, 9 aa, Homo Sapiens
DKLQNEIAN

SEQ ID NO: 1375862 - protein, 9 aa, Homo Sapiens
DNLIKHTVI

SEQ ID NO: 1375863 - protein, 9 aa, Homo Sapiens
TMMVITTMR

SEQ ID NO: 1375864 - protein, 9 aa, Homo Sapiens
SESQSDVGS

SEQ ID NO: 1375865 - protein, 9 aa, Homo Sapiens
FVMGPPRSE

SEQ ID NO: 1375866 - protein, 9 aa, Homo Sapiens
KVACPICMT

SEQ ID NO: 1375867 - protein, 9 aa, Homo Sapiens
NDKLQNEIA

SEQ ID NO: 1375868 - protein, 9 aa, Homo Sapiens
KSEGNIMPL

SEQ ID NO: 1375869 - protein, 9 aa, Homo Sapiens
GRQPTTHAE

SEQ ID NO: 1375870 - protein, 9 aa, Homo Sapiens
NEMGHKPDV

SEQ ID NO: 1375871 - protein, 9 aa, Homo Sapiens
RYYKTGSIR

SEQ ID NO: 1375872 - protein, 9 aa, Homo Sapiens
SFGGMPFTS

SEQ ID NO: 1375873 - protein, 9 aa, Homo Sapiens
HPPAIQSLT

SEQ ID NO: 1375874 - protein, 9 aa, Homo Sapiens
RRTDLSYSE

SEQ ID NO: 1375875 - protein, 9 aa, Homo Sapiens
PPPPLHSIR

SEQ ID NO: 1375876 - protein, 9 aa, Homo Sapiens
VFLSCVISV

SEQ ID NO: 1375877 - protein, 9 aa, Homo Sapiens
SVLFRVYSN

SEQ ID NO: 1375878 - protein, 9 aa, Homo Sapiens
FIYEKLGGT

SEQ ID NO: 1375879 - protein, 9 aa, Homo Sapiens
RLPARSIFD

SEQ ID NO: 1375880 - protein, 9 aa, Homo Sapiens
HAHCECFYG

SEQ ID NO: 1375881 - protein, 9 aa, Homo Sapiens
IRDEKRTHD

SEQ ID NO: 1375882 - protein, 9 aa, Homo Sapiens
KFPVTSTPN

SEQ ID NO: 1375883 - protein, 9 aa, Homo Sapiens
SPPAGRPNP

SEQ ID NO: 1375884 - protein, 9 aa, Homo Sapiens
YFVPDRSDK

SEQ ID NO: 1375885 - protein, 9 aa, Homo Sapiens
TEGQILLFV

SEQ ID NO: 1375886 - protein, 9 aa, Homo Sapiens
PSLQSPSRL

SEQ ID NO: 1375887 - protein, 9 aa, Homo Sapiens
ETAASKETL

SEQ ID NO: 1375888 - protein, 9 aa, Homo Sapiens
LARSVLFEQ

SEQ ID NO: 1375889 - protein, 9 aa, Homo Sapiens
LTLQGFHKF

SEQ ID NO: 1375890 - protein, 9 aa, Homo Sapiens
ESQSDVGSS

SEQ ID NO: 1375891 - protein, 9 aa, Homo Sapiens
SILSGTVQN

SEQ ID NO: 1375892 - protein, 9 aa, Homo Sapiens
TLQGFHKFV

SEQ ID NO: 1375893 - protein, 9 aa, Homo Sapiens
FPILFFFFP

SEQ ID NO: 1375894 - protein, 9 aa, Homo Sapiens
RIGLLPVLN

SEQ ID NO: 1375895 - protein, 9 aa, Homo Sapiens
FRLTFCSAN

SEQ ID NO: 1375896 - protein, 9 aa, Homo Sapiens
GLLLTHKGN

SEQ ID NO: 1375897 - protein, 9 aa, Homo Sapiens
DVIAVSDIT

SEQ ID NO: 1375898 - protein, 9 aa, Homo Sapiens
KSRKPQNQQ

SEQ ID NO: 1375899 - protein, 9 aa, Homo Sapiens
TESHRCLRI

SEQ ID NO: 1375900 - protein, 9 aa, Homo Sapiens
QVQLFMTDN

SEQ ID NO: 1375901 - protein, 9 aa, Homo Sapiens
ITVLGVGAV

SEQ ID NO: 1375902 - protein, 9 aa, Homo Sapiens
LDTGPMVVH

SEQ ID NO: 1375903 - protein, 9 aa, Homo Sapiens
DNQNDHSEE

SEQ ID NO: 1375904 - protein, 9 aa, Homo Sapiens
PSEQKAASP

SEQ ID NO: 1375905 - protein, 9 aa, Homo Sapiens
IGSAGPAGF

SEQ ID NO: 1375906 - protein, 9 aa, Homo Sapiens
IILSNEDVR

SEQ ID NO: 1375907 - protein, 9 aa, Homo Sapiens
TYRYFIHNR

SEQ ID NO: 1375908 - protein, 9 aa, Homo Sapiens
FTLATTVAA

SEQ ID NO: 1375909 - protein, 9 aa, Homo Sapiens
ALLVAKEEK

SEQ ID NO: 1375910 - protein, 9 aa, Homo Sapiens
WQDAMESSP

SEQ ID NO: 1375911 - protein, 9 aa, Homo Sapiens
NSHKEPQIA

SEQ ID NO: 1375912 - protein, 9 aa, Homo Sapiens
LGADGAQGR

SEQ ID NO: 1375913 - protein, 9 aa, Homo Sapiens
ITDEDDDVL

SEQ ID NO: 1375914 - protein, 9 aa, Homo Sapiens
KVPSPPHEH

SEQ ID NO: 1375915 - protein, 9 aa, Homo Sapiens
KAYLAIPQH

SEQ ID NO: 1375916 - protein, 9 aa, Homo Sapiens
LKKEIALFR

SEQ ID NO: 1375917 - protein, 9 aa, Homo Sapiens
EKCVEFIKD

SEQ ID NO: 1375918 - protein, 9 aa, Homo Sapiens
KQPDMTNLT

SEQ ID NO: 1375919 - protein, 9 aa, Homo Sapiens
GAGATTVPL

SEQ ID NO: 1375920 - protein, 9 aa, Homo Sapiens
AREEQHEKD

SEQ ID NO: 1375921 - protein, 9 aa, Homo Sapiens
KNNITSKTE

SEQ ID NO: 1375922 - protein, 9 aa, Homo Sapiens
SCSRGSHGM

SEQ ID NO: 1375923 - protein, 9 aa, Homo Sapiens
EGLRSRTRA

SEQ ID NO: 1375924 - protein, 9 aa, Homo Sapiens
GRVIENPAK

SEQ ID NO: 1375925 - protein, 9 aa, Homo Sapiens
PEQVVQRYV

SEQ ID NO: 1375926 - protein, 9 aa, Homo Sapiens
ETRKNAEVS

SEQ ID NO: 1375927 - protein, 9 aa, Homo Sapiens
QNDHSEEHD

SEQ ID NO: 1375928 - protein, 9 aa, Homo Sapiens
LEHLDKASK

SEQ ID NO: 1375929 - protein, 9 aa, Homo Sapiens
KLRSLPVNV

SEQ ID NO: 1375930 - protein, 9 aa, Homo Sapiens
LASVLDSLA

SEQ ID NO: 1375931 - protein, 9 aa, Homo Sapiens
GYDQPATEP

SEQ ID NO: 1375932 - protein, 9 aa, Homo Sapiens
RKDGTYLDD

SEQ ID NO: 1375933 - protein, 9 aa, Homo Sapiens
SFAESSHLT

SEQ ID NO: 1375934 - protein, 9 aa, Homo Sapiens
RRCRSWERA

SEQ ID NO: 1375935 - protein, 9 aa, Homo Sapiens
IVRKRVPPT

SEQ ID NO: 1375936 - protein, 9 aa, Homo Sapiens
PPGTLRGSR

SEQ ID NO: 1375937 - protein, 9 aa, Homo Sapiens
NPAPRKASE

SEQ ID NO: 1375938 - protein, 9 aa, Homo Sapiens
LDSRSEGIN

SEQ ID NO: 1375939 - protein, 9 aa, Homo Sapiens
PKRRLPARS

SEQ ID NO: 1375940 - protein, 9 aa, Homo Sapiens
QVNPVRRAE

SEQ ID NO: 1375941 - protein, 9 aa, Homo Sapiens
RNHIVGYFD

SEQ ID NO: 1375942 - protein, 9 aa, Homo Sapiens
DSLAGACGL

SEQ ID NO: 1375943 - protein, 9 aa, Homo Sapiens
VSDEDIDVQ

SEQ ID NO: 1375944 - protein, 9 aa, Homo Sapiens
TVHIYGHVT

SEQ ID NO: 1375945 - protein, 9 aa, Homo Sapiens
AMSKSLASE

SEQ ID NO: 1375946 - protein, 9 aa, Homo Sapiens
LEQRIVKLS

SEQ ID NO: 1375947 - protein, 9 aa, Homo Sapiens
HEIDHFFCK

SEQ ID NO: 1375948 - protein, 9 aa, Homo Sapiens
TRPVPGSTA

SEQ ID NO: 1375949 - protein, 9 aa, Homo Sapiens
MPEFSLDST

SEQ ID NO: 1375950 - protein, 9 aa, Homo Sapiens
PNKIELAKD

SEQ ID NO: 1375951 - protein, 9 aa, Homo Sapiens
KVSELHRAT

SEQ ID NO: 1375952 - protein, 9 aa, Homo Sapiens
WVTDSESQS

SEQ ID NO: 1375953 - protein, 9 aa, Homo Sapiens
FVAIFKNLT

SEQ ID NO: 1375954 - protein, 9 aa, Homo Sapiens
GVEDKMFSL

SEQ ID NO: 1375955 - protein, 9 aa, Homo Sapiens
SKKLTAGHE

SEQ ID NO: 1375956 - protein, 9 aa, Homo Sapiens
TNSHKEPQI

SEQ ID NO: 1375957 - protein, 9 aa, Homo Sapiens
LGVGAVGMA

SEQ ID NO: 1375958 - protein, 9 aa, Homo Sapiens
DNAAAALFE

SEQ ID NO: 1375959 - protein, 9 aa, Homo Sapiens
IQPYSLERA

SEQ ID NO: 1375960 - protein, 9 aa, Homo Sapiens
KFDNQFYSV

SEQ ID NO: 1375961 - protein, 9 aa, Homo Sapiens
RSWQSRHSG

SEQ ID NO: 1375962 - protein, 9 aa, Homo Sapiens
IVAFHAKQV

SEQ ID NO: 1375963 - protein, 9 aa, Homo Sapiens
HSEEHDDGG

SEQ ID NO: 1375964 - protein, 9 aa, Homo Sapiens
AVWCSEDKQ

SEQ ID NO: 1375965 - protein, 9 aa, Homo Sapiens
SNGRCISEQ

SEQ ID NO: 1375966 - protein, 9 aa, Homo Sapiens
HMEVMTDFE

SEQ ID NO: 1375967 - protein, 9 aa, Homo Sapiens
VNCKAEATP

SEQ ID NO: 1375968 - protein, 9 aa, Homo Sapiens
IGNRKRKYR

SEQ ID NO: 1375969 - protein, 9 aa, Homo Sapiens
LHAHCECFY

SEQ ID NO: 1375970 - protein, 9 aa, Homo Sapiens
AIVVQTSAK

SEQ ID NO: 1375971 - protein, 9 aa, Homo Sapiens
HVTVVYEGK

SEQ ID NO: 1375972 - protein, 9 aa, Homo Sapiens
CSPPARLGM

SEQ ID NO: 1375973 - protein, 9 aa, Homo Sapiens
DELNGAYKA

SEQ ID NO: 1375974 - protein, 9 aa, Homo Sapiens
EQKAASPPP

SEQ ID NO: 1375975 - protein, 9 aa, Homo Sapiens
SRKPQNQQF

SEQ ID NO: 1375976 - protein, 9 aa, Homo Sapiens
LRIPPPGTL

SEQ ID NO: 1375977 - protein, 9 aa, Homo Sapiens
EKLGGTYWA

SEQ ID NO: 1375978 - protein, 9 aa, Homo Sapiens
TMTYTPGTC

SEQ ID NO: 1375979 - protein, 9 aa, Homo Sapiens
WLRDPSQER

SEQ ID NO: 1375980 - protein, 9 aa, Homo Sapiens
QSPQVAGIL

SEQ ID NO: 1375981 - protein, 9 aa, Homo Sapiens
YRRQGSSTS

SEQ ID NO: 1375982 - protein, 9 aa, Homo Sapiens
EKVACPICM

SEQ ID NO: 1375983 - protein, 9 aa, Homo Sapiens
LWTEVNAFK

SEQ ID NO: 1375984 - protein, 9 aa, Homo Sapiens
QNVEVDDYF

SEQ ID NO: 1375985 - protein, 9 aa, Homo Sapiens
HGMQFGGSM

SEQ ID NO: 1375986 - protein, 9 aa, Homo Sapiens
STLTLLQDL

SEQ ID NO: 1375987 - protein, 9 aa, Homo Sapiens
KNEKMPLLE

SEQ ID NO: 1375988 - protein, 9 aa, Homo Sapiens
HKGNATHDN

SEQ ID NO: 1375989 - protein, 9 aa, Homo Sapiens
LPEKQSTEQ

SEQ ID NO: 1375990 - protein, 9 aa, Homo Sapiens
YKAYLAIPQ

SEQ ID NO: 1375991 - protein, 9 aa, Homo Sapiens
DGKLHLEKE

SEQ ID NO: 1375992 - protein, 9 aa, Homo Sapiens
PVMQAVLHI

SEQ ID NO: 1375993 - protein, 9 aa, Homo Sapiens
SPISESMLE

SEQ ID NO: 1375994 - protein, 9 aa, Homo Sapiens
QPDVCKHLC

SEQ ID NO: 1375995 - protein, 9 aa, Homo Sapiens
MPYCHPSSY

SEQ ID NO: 1375996 - protein, 9 aa, Homo Sapiens
SVTAGPRLW

SEQ ID NO: 1375997 - protein, 9 aa, Homo Sapiens
GKTINVKFA

SEQ ID NO: 1375998 - protein, 9 aa, Homo Sapiens
LHRATESHR

SEQ ID NO: 1375999 - protein, 9 aa, Homo Sapiens
NDHFLYRGE

SEQ ID NO: 1376000 - protein, 9 aa, Homo Sapiens
YSLLMSMHN

SEQ ID NO: 1376001 - protein, 9 aa, Homo Sapiens
VEHCQKLQE

SEQ ID NO: 1376002 - protein, 9 aa, Homo Sapiens
NDGEHQDYE

SEQ ID NO: 1376003 - protein, 9 aa, Homo Sapiens
PFTRLRERM

SEQ ID NO: 1376004 - protein, 9 aa, Homo Sapiens
ISLSGERIK

SEQ ID NO: 1376005 - protein, 9 aa, Homo Sapiens
VFTIWIAPS

SEQ ID NO: 1376006 - protein, 9 aa, Homo Sapiens
HYNMSKSKF

SEQ ID NO: 1376007 - protein, 9 aa, Homo Sapiens
TRRHSWRSW

SEQ ID NO: 1376008 - protein, 9 aa, Homo Sapiens
VFGLLLTHK

SEQ ID NO: 1376009 - protein, 9 aa, Homo Sapiens
CGNLSCRSD

SEQ ID NO: 1376010 - protein, 9 aa, Homo Sapiens
HGQVHFLWM

SEQ ID NO: 1376011 - protein, 9 aa, Homo Sapiens
SSDSVQTDT

SEQ ID NO: 1376012 - protein, 9 aa, Homo Sapiens
LQNKLEELK

SEQ ID NO: 1376013 - protein, 9 aa, Homo Sapiens
GLLPPLNVN

SEQ ID NO: 1376014 - protein, 9 aa, Homo Sapiens
ARCGNLSCR

SEQ ID NO: 1376015 - protein, 9 aa, Homo Sapiens
AFKEIQALQ

SEQ ID NO: 1376016 - protein, 9 aa, Homo Sapiens
ENESSDSVQ

SEQ ID NO: 1376017 - protein, 9 aa, Homo Sapiens
LSSVSHTKK

SEQ ID NO: 1376018 - protein, 9 aa, Homo Sapiens
CGKCFLLES

SEQ ID NO: 1376019 - protein, 9 aa, Homo Sapiens
CPTEGQILL

SEQ ID NO: 1376020 - protein, 9 aa, Homo Sapiens
TTTTTTLTT

SEQ ID NO: 1376021 - protein, 9 aa, Homo Sapiens
KDTGLCTEG

SEQ ID NO: 1376022 - protein, 9 aa, Homo Sapiens
PSVTAGPRL

SEQ ID NO: 1376023 - protein, 9 aa, Homo Sapiens
ATRSVWKRS

SEQ ID NO: 1376024 - protein, 9 aa, Homo Sapiens
QPDMTNLTE

SEQ ID NO: 1376025 - protein, 9 aa, Homo Sapiens
EHMEVMTDF

SEQ ID NO: 1376026 - protein, 9 aa, Homo Sapiens
ESSHLTRHR

SEQ ID NO: 1376027 - protein, 9 aa, Homo Sapiens
RVHYGEKHF

SEQ ID NO: 1376028 - protein, 9 aa, Homo Sapiens
TAKVPSPPH

SEQ ID NO: 1376029 - protein, 9 aa, Homo Sapiens
HFLYRGEVS

SEQ ID NO: 1376030 - protein, 9 aa, Homo Sapiens
RQPDVCKHL

SEQ ID NO: 1376031 - protein, 9 aa, Homo Sapiens
TSHMESDEL

SEQ ID NO: 1376032 - protein, 9 aa, Homo Sapiens
YLAIPQHAN

SEQ ID NO: 1376033 - protein, 9 aa, Homo Sapiens
KNYSNVHTS

SEQ ID NO: 1376034 - protein, 9 aa, Homo Sapiens
FGAPKRRLP

SEQ ID NO: 1376035 - protein, 9 aa, Homo Sapiens
LFFFFPQKV

SEQ ID NO: 1376036 - protein, 9 aa, Homo Sapiens
KTINVKFAK

SEQ ID NO: 1376037 - protein, 9 aa, Homo Sapiens
LGCTPFLGQ

SEQ ID NO: 1376038 - protein, 9 aa, Homo Sapiens
LSGVEDKMF

SEQ ID NO: 1376039 - protein, 9 aa, Homo Sapiens
LMRVPPSVT

SEQ ID NO: 1376040 - protein, 9 aa, Homo Sapiens
QHVCHVPRC

SEQ ID NO: 1376041 - protein, 9 aa, Homo Sapiens
SDSVQTDTL

SEQ ID NO: 1376042 - protein, 9 aa, Homo Sapiens
FVMPYNYAV

SEQ ID NO: 1376043 - protein, 9 aa, Homo Sapiens
GTLRGSRTA

SEQ ID NO: 1376044 - protein, 9 aa, Homo Sapiens
RTVEIIVNS

SEQ ID NO: 1376045 - protein, 9 aa, Homo Sapiens
GKTWSHIMR

SEQ ID NO: 1376046 - protein, 9 aa, Homo Sapiens
HTSGIKKAV

SEQ ID NO: 1376047 - protein, 9 aa, Homo Sapiens
ELQWPDEEI

SEQ ID NO: 1376048 - protein, 9 aa, Homo Sapiens
SSPGHPAAA

SEQ ID NO: 1376049 - protein, 9 aa, Homo Sapiens
SPLSNGSTK

SEQ ID NO: 1376050 - protein, 9 aa, Homo Sapiens
KIVKPSPSL

SEQ ID NO: 1376051 - protein, 9 aa, Homo Sapiens
VLPPGEGGA

SEQ ID NO: 1376052 - protein, 9 aa, Homo Sapiens
PQVAGILAV

SEQ ID NO: 1376053 - protein, 9 aa, Homo Sapiens
LVQQLYPQP

SEQ ID NO: 1376054 - protein, 9 aa, Homo Sapiens
QNKITVLGV

SEQ ID NO: 1376055 - protein, 9 aa, Homo Sapiens
SPFTRLRER

SEQ ID NO: 1376056 - protein, 9 aa, Homo Sapiens
YDQPATEPL

SEQ ID NO: 1376057 - protein, 9 aa, Homo Sapiens
AATATRSVW

SEQ ID NO: 1376058 - protein, 9 aa, Homo Sapiens
FFFFPQKVS

SEQ ID NO: 1376059 - protein, 9 aa, Homo Sapiens
PYNYAVLLP

SEQ ID NO: 1376060 - protein, 9 aa, Homo Sapiens
TLLQDLKLF

SEQ ID NO: 1376061 - protein, 9 aa, Homo Sapiens
AYTPRTVEI

SEQ ID NO: 1376062 - protein, 9 aa, Homo Sapiens
RSGLDLKAN

SEQ ID NO: 1376063 - protein, 9 aa, Homo Sapiens
YPHATHDLQ

SEQ ID NO: 1376064 - protein, 9 aa, Homo Sapiens
DGEHQDYEE

SEQ ID NO: 1376065 - protein, 9 aa, Homo Sapiens
AQDPPMVVV

SEQ ID NO: 1376066 - protein, 9 aa, Homo Sapiens
QHEKDFFGR

SEQ ID NO: 1376067 - protein, 9 aa, Homo Sapiens
AERLHAGAT

SEQ ID NO: 1376068 - protein, 9 aa, Homo Sapiens
LATLKITAH

SEQ ID NO: 1376069 - protein, 9 aa, Homo Sapiens
EDIWPEQGV

SEQ ID NO: 1376070 - protein, 9 aa, Homo Sapiens
TRLRERMLS

SEQ ID NO: 1376071 - protein, 9 aa, Homo Sapiens
AVEKIPLSQ

SEQ ID NO: 1376072 - protein, 9 aa, Homo Sapiens
ASPGPNGDS

SEQ ID NO: 1376073 - protein, 9 aa, Homo Sapiens
DLWEDITDS

SEQ ID NO: 1376074 - protein, 9 aa, Homo Sapiens
TTTLTTMMV

SEQ ID NO: 1376075 - protein, 9 aa, Homo Sapiens
DSIYRRQGS

SEQ ID NO: 1376076 - protein, 9 aa, Homo Sapiens
VLPVSRQKN

SEQ ID NO: 1376077 - protein, 9 aa, Homo Sapiens
QGKLIKTVI

SEQ ID NO: 1376078 - protein, 9 aa, Homo Sapiens
ISHTRPGLL

SEQ ID NO: 1376079 - protein, 9 aa, Homo Sapiens
DVCKHLCMI

SEQ ID NO: 1376080 - protein, 9 aa, Homo Sapiens
ELARCGNLS

SEQ ID NO: 1376081 - protein, 9 aa, Homo Sapiens
HRPTEDVQA

SEQ ID NO: 1376082 - protein, 9 aa, Homo Sapiens
MKFLHGALG

SEQ ID NO: 1376083 - protein, 9 aa, Homo Sapiens
KIYFVPDRS

SEQ ID NO: 1376084 - protein, 9 aa, Homo Sapiens
VFQKLIAPK

SEQ ID NO: 1376085 - protein, 9 aa, Homo Sapiens
PQQMGEPKG

SEQ ID NO: 1376086 - protein, 9 aa, Homo Sapiens
DLEHLDKAS

SEQ ID NO: 1376087 - protein, 9 aa, Homo Sapiens
RPVPGSTAP

SEQ ID NO: 1376088 - protein, 9 aa, Homo Sapiens
IQSNEVSSN

SEQ ID NO: 1376089 - protein, 9 aa, Homo Sapiens
MRDTQRASK

SEQ ID NO: 1376090 - protein, 9 aa, Homo Sapiens
KTVHIYGHV

SEQ ID NO: 1376091 - protein, 9 aa, Homo Sapiens
KKAVWCSED

SEQ ID NO: 1376092 - protein, 9 aa, Homo Sapiens
MPGRQPTTH

SEQ ID NO: 1376093 - protein, 9 aa, Homo Sapiens
IAAVEKIPL

SEQ ID NO: 1376094 - protein, 9 aa, Homo Sapiens
ATAHTGCMF

SEQ ID NO: 1376095 - protein, 9 aa, Homo Sapiens
SHAAGRVQD

SEQ ID NO: 1376096 - protein, 9 aa, Homo Sapiens
VPGSTAPPA

SEQ ID NO: 1376097 - protein, 9 aa, Homo Sapiens
QPYSLERAN

SEQ ID NO: 1376098 - protein, 9 aa, Homo Sapiens
ERPYACPKC

SEQ ID NO: 1376099 - protein, 9 aa, Homo Sapiens
SYRQPDVCK

SEQ ID NO: 1376100 - protein, 9 aa, Homo Sapiens
PSSLSKHMK

SEQ ID NO: 1376101 - protein, 9 aa, Homo Sapiens
AAEVPNGSK

SEQ ID NO: 1376102 - protein, 9 aa, Homo Sapiens
VSEFGMETV

SEQ ID NO: 1376103 - protein, 9 aa, Homo Sapiens
TICIPNYLN

SEQ ID NO: 1376104 - protein, 9 aa, Homo Sapiens
FLSCVISVL

SEQ ID NO: 1376105 - protein, 9 aa, Homo Sapiens
PPARLGMDQ

SEQ ID NO: 1376106 - protein, 9 aa, Homo Sapiens
AGWMPGRQP

SEQ ID NO: 1376107 - protein, 9 aa, Homo Sapiens
PRPGIGLGR

SEQ ID NO: 1376108 - protein, 9 aa, Homo Sapiens
KEGSEQMTE

SEQ ID NO: 1376109 - protein, 9 aa, Homo Sapiens
EDVSMKFLH

SEQ ID NO: 1376110 - protein, 9 aa, Homo Sapiens
KQMETYLKK

SEQ ID NO: 1376111 - protein, 9 aa, Homo Sapiens
NLTELALRL

SEQ ID NO: 1376112 - protein, 9 aa, Homo Sapiens
DDEDEEMLQ

SEQ ID NO: 1376113 - protein, 9 aa, Homo Sapiens
PAKAQSAAL

SEQ ID NO: 1376114 - protein, 9 aa, Homo Sapiens
ITDSLHDQG

SEQ ID NO: 1376115 - protein, 9 aa, Homo Sapiens
TGEQLENSP

SEQ ID NO: 1376116 - protein, 9 aa, Homo Sapiens
RENESSDSV

SEQ ID NO: 1376117 - protein, 9 aa, Homo Sapiens
GHVIHLSNL

SEQ ID NO: 1376118 - protein, 9 aa, Homo Sapiens
EQMTELADV

SEQ ID NO: 1376119 - protein, 9 aa, Homo Sapiens
AGPRWAVPV

SEQ ID NO: 1376120 - protein, 9 aa, Homo Sapiens
ESLLSIDSM

SEQ ID NO: 1376121 - protein, 9 aa, Homo Sapiens
PAGHPGPLG

SEQ ID NO: 1376122 - protein, 9 aa, Homo Sapiens
TLTLLQDLK

SEQ ID NO: 1376123 - protein, 9 aa, Homo Sapiens
SDSSVTGDM

SEQ ID NO: 1376124 - protein, 9 aa, Homo Sapiens
SLKLRSLPV

SEQ ID NO: 1376125 - protein, 9 aa, Homo Sapiens
VEKCVEFIK

SEQ ID NO: 1376126 - protein, 9 aa, Homo Sapiens
KTVIQTKSG

SEQ ID NO: 1376127 - protein, 9 aa, Homo Sapiens
LVAKEEKVV

SEQ ID NO: 1376128 - protein, 9 aa, Homo Sapiens
YKEKFGFHP

SEQ ID NO: 1376129 - protein, 9 aa, Homo Sapiens
TRPGLLPPL

SEQ ID NO: 1376130 - protein, 9 aa, Homo Sapiens
IGGVTSTSE

SEQ ID NO: 1376131 - protein, 9 aa, Homo Sapiens
QETPGSRPA

SEQ ID NO: 1376132 - protein, 9 aa, Homo Sapiens
VKREFVAIF

SEQ ID NO: 1376133 - protein, 9 aa, Homo Sapiens
ARSVLFEQA

SEQ ID NO: 1376134 - protein, 9 aa, Homo Sapiens
MGHVAAVGC

SEQ ID NO: 1376135 - protein, 9 aa, Homo Sapiens
ILGSIRDEK

SEQ ID NO: 1376136 - protein, 9 aa, Homo Sapiens
LIKHTVIMQ

SEQ ID NO: 1376137 - protein, 9 aa, Homo Sapiens
LWEDITDSL

SEQ ID NO: 1376138 - protein, 9 aa, Homo Sapiens
STSESWVQK

SEQ ID NO: 1376139 - protein, 9 aa, Homo Sapiens
SESWVQKME

SEQ ID NO: 1376140 - protein, 9 aa, Homo Sapiens
HCCYQLVQT

SEQ ID NO: 1376141 - protein, 9 aa, Homo Sapiens
PEHGMQFGG

SEQ ID NO: 1376142 - protein, 9 aa, Homo Sapiens
HVDFCTLLH

SEQ ID NO: 1376143 - protein, 9 aa, Homo Sapiens
LDEIQPYSL

SEQ ID NO: 1376144 - protein, 9 aa, Homo Sapiens
QTADGESMN

SEQ ID NO: 1376145 - protein, 9 aa, Homo Sapiens
AHSFRNHIV

SEQ ID NO: 1376146 - protein, 9 aa, Homo Sapiens
QVAGILAVK

SEQ ID NO: 1376147 - protein, 9 aa, Homo Sapiens
EHLDKASKV

SEQ ID NO: 1376148 - protein, 9 aa, Homo Sapiens
SHKEPQIAP

SEQ ID NO: 1376149 - protein, 9 aa, Homo Sapiens
CPQKKNHLV

SEQ ID NO: 1376150 - protein, 9 aa, Homo Sapiens
DVEFLEEQS

SEQ ID NO: 1376151 - protein, 9 aa, Homo Sapiens
GHPGPLGAD

SEQ ID NO: 1376152 - protein, 9 aa, Homo Sapiens
AKVPSPPHE

SEQ ID NO: 1376153 - protein, 9 aa, Homo Sapiens
RVYSNTLLV

SEQ ID NO: 1376154 - protein, 9 aa, Homo Sapiens
YACPKCGKA

SEQ ID NO: 1376155 - protein, 9 aa, Homo Sapiens
FLHAHCECF

SEQ ID NO: 1376156 - protein, 9 aa, Homo Sapiens
RGSHGMDAV

SEQ ID NO: 1376157 - protein, 9 aa, Homo Sapiens
NKKPFTGHP

SEQ ID NO: 1376158 - protein, 9 aa, Homo Sapiens
KSGLLHAEG

SEQ ID NO: 1376159 - protein, 9 aa, Homo Sapiens
GAGWMPGRQ

SEQ ID NO: 1376160 - protein, 9 aa, Homo Sapiens
IQCGLLVAQ

SEQ ID NO: 1376161 - protein, 9 aa, Homo Sapiens
DTGPMVVHC

SEQ ID NO: 1376162 - protein, 9 aa, Homo Sapiens
LSTQIVAPS

SEQ ID NO: 1376163 - protein, 9 aa, Homo Sapiens
SYTHPSSLS

SEQ ID NO: 1376164 - protein, 9 aa, Homo Sapiens
KRRLPARSI

SEQ ID NO: 1376165 - protein, 9 aa, Homo Sapiens
SGMPHHGEA

SEQ ID NO: 1376166 - protein, 9 aa, Homo Sapiens
EQGNQTAQL

SEQ ID NO: 1376167 - protein, 9 aa, Homo Sapiens
GILLTSETF

SEQ ID NO: 1376168 - protein, 9 aa, Homo Sapiens
PVSRQKNEK

SEQ ID NO: 1376169 - protein, 9 aa, Homo Sapiens
PLSGVEDKM

SEQ ID NO: 1376170 - protein, 9 aa, Homo Sapiens
VFNTPPACP

SEQ ID NO: 1376171 - protein, 9 aa, Homo Sapiens
GDLPLNEKL

SEQ ID NO: 1376172 - protein, 9 aa, Homo Sapiens
LLGPLIFLV

SEQ ID NO: 1376173 - protein, 9 aa, Homo Sapiens
SCGEGLRSR

SEQ ID NO: 1376174 - protein, 9 aa, Homo Sapiens
AGILAVKLG

SEQ ID NO: 1376175 - protein, 9 aa, Homo Sapiens
HCQKLQEQM

SEQ ID NO: 1376176 - protein, 9 aa, Homo Sapiens
GKLIKTVIQ

SEQ ID NO: 1376177 - protein, 9 aa, Homo Sapiens
VTDSESQSD

SEQ ID NO: 1376178 - protein, 9 aa, Homo Sapiens
DEMLSLNEE

SEQ ID NO: 1376179 - protein, 9 aa, Homo Sapiens
GYCHCCYQL

SEQ ID NO: 1376180 - protein, 9 aa, Homo Sapiens
PISESMLER

SEQ ID NO: 1376181 - protein, 9 aa, Homo Sapiens
LPCNQSSFW

SEQ ID NO: 1376182 - protein, 9 aa, Homo Sapiens
HSYRQPDVC

SEQ ID NO: 1376183 - protein, 9 aa, Homo Sapiens
LLHLGALPY

SEQ ID NO: 1376184 - protein, 9 aa, Homo Sapiens
LNEMGHKPD

SEQ ID NO: 1376185 - protein, 9 aa, Homo Sapiens
SGASRRSQN

SEQ ID NO: 1376186 - protein, 9 aa, Homo Sapiens
PNGSKQELQ

SEQ ID NO: 1376187 - protein, 9 aa, Homo Sapiens
AGTTMGKGV

SEQ ID NO: 1376188 - protein, 9 aa, Homo Sapiens
GNNKVSVSA

SEQ ID NO: 1376189 - protein, 9 aa, Homo Sapiens
SVEESSENT

SEQ ID NO: 1376190 - protein, 9 aa, Homo Sapiens
IGESLPCVK

SEQ ID NO: 1376191 - protein, 9 aa, Homo Sapiens
FDDFEWVHV

SEQ ID NO: 1376192 - protein, 9 aa, Homo Sapiens
GIKNENRGT

SEQ ID NO: 1376193 - protein, 9 aa, Homo Sapiens
AIPQHANLF

SEQ ID NO: 1376194 - protein, 9 aa, Homo Sapiens
DVSMKFLHG

SEQ ID NO: 1376195 - protein, 9 aa, Homo Sapiens
SHRCLRIPP

SEQ ID NO: 1376196 - protein, 9 aa, Homo Sapiens
MLKFYTGFK

SEQ ID NO: 1376197 - protein, 9 aa, Homo Sapiens
LQVAMKVIP

SEQ ID NO: 1376198 - protein, 9 aa, Homo Sapiens
KDDVHVCMM

SEQ ID NO: 1376199 - protein, 9 aa, Homo Sapiens
RPGIGLGRV

SEQ ID NO: 1376200 - protein, 9 aa, Homo Sapiens
FHRPDFISL

SEQ ID NO: 1376201 - protein, 9 aa, Homo Sapiens
QVHFLWMKH

SEQ ID NO: 1376202 - protein, 9 aa, Homo Sapiens
VLLSHPDLL

SEQ ID NO: 1376203 - protein, 9 aa, Homo Sapiens
MSKSLASEW

SEQ ID NO: 1376204 - protein, 9 aa, Homo Sapiens
PIVETRKNA

SEQ ID NO: 1376205 - protein, 9 aa, Homo Sapiens
CHVPRCGKV

SEQ ID NO: 1376206 - protein, 9 aa, Homo Sapiens
HSWRSWQSR

SEQ ID NO: 1376207 - protein, 9 aa, Homo Sapiens
NEDVSMKFL

SEQ ID NO: 1376208 - protein, 9 aa, Homo Sapiens
LIFTLATTV

SEQ ID NO: 1376209 - protein, 9 aa, Homo Sapiens
GIGLGRVMR

SEQ ID NO: 1376210 - protein, 9 aa, Homo Sapiens
ESHRCLRIP

SEQ ID NO: 1376211 - protein, 9 aa, Homo Sapiens
SFWQRSADP

SEQ ID NO: 1376212 - protein, 9 aa, Homo Sapiens
AASKETLFN

SEQ ID NO: 1376213 - protein, 9 aa, Homo Sapiens
WEDITDSLH

SEQ ID NO: 1376214 - protein, 9 aa, Homo Sapiens
TLTFLHAHC

SEQ ID NO: 1376215 - protein, 9 aa, Homo Sapiens
RVIENPAKA

SEQ ID NO: 1376216 - protein, 9 aa, Homo Sapiens
LLDSRSEGI

SEQ ID NO: 1376217 - protein, 9 aa, Homo Sapiens
SKSKFDNQF

SEQ ID NO: 1376218 - protein, 9 aa, Homo Sapiens
MMVITTMRL

SEQ ID NO: 1376219 - protein, 9 aa, Homo Sapiens
NGSTKSSAS

SEQ ID NO: 1376220 - protein, 9 aa, Homo Sapiens
ASQFGTLLG

SEQ ID NO: 1376221 - protein, 9 aa, Homo Sapiens
GPMHTIAFP

SEQ ID NO: 1376222 - protein, 9 aa, Homo Sapiens
IVETRKNAE

SEQ ID NO: 1376223 - protein, 9 aa, Homo Sapiens
SKQPDMTNL

SEQ ID NO: 1376224 - protein, 9 aa, Homo Sapiens
NRAAQRNPA

SEQ ID NO: 1376225 - protein, 9 aa, Homo Sapiens
KVAAEVPNG

SEQ ID NO: 1376226 - protein, 9 aa, Homo Sapiens
SLTGDLPLN

SEQ ID NO: 1376227 - protein, 9 aa, Homo Sapiens
KQCPQKKNH

SEQ ID NO: 1376228 - protein, 9 aa, Homo Sapiens
LGRYYKTGS

SEQ ID NO: 1376229 - protein, 9 aa, Homo Sapiens
LMGHVAAVG

SEQ ID NO: 1376230 - protein, 9 aa, Homo Sapiens
ESWVQKMET

SEQ ID NO: 1376231 - protein, 9 aa, Homo Sapiens
TVIMQKYEE

SEQ ID NO: 1376232 - protein, 9 aa, Homo Sapiens
KPAFILGSI

SEQ ID NO: 1376233 - protein, 9 aa, Homo Sapiens
SEKEKELQN

SEQ ID NO: 1376234 - protein, 9 aa, Homo Sapiens
IDHFFCKAP

SEQ ID NO: 1376235 - protein, 9 aa, Homo Sapiens
ISHAAGRVQ

SEQ ID NO: 1376236 - protein, 9 aa, Homo Sapiens
SSENTDVNN

SEQ ID NO: 1376237 - protein, 9 aa, Homo Sapiens
MISVEESSE

SEQ ID NO: 1376238 - protein, 9 aa, Homo Sapiens
SVLFEQAVR

SEQ ID NO: 1376239 - protein, 9 aa, Homo Sapiens
SCRSDLQVA

SEQ ID NO: 1376240 - protein, 9 aa, Homo Sapiens
SSMLPRRGA

SEQ ID NO: 1376241 - protein, 9 aa, Homo Sapiens
DALIKLQLL

SEQ ID NO: 1376242 - protein, 9 aa, Homo Sapiens
ACPKCGKAF

SEQ ID NO: 1376243 - protein, 9 aa, Homo Sapiens
GKSFAESSH

SEQ ID NO: 1376244 - protein, 9 aa, Homo Sapiens
AVVNSVLFR

SEQ ID NO: 1376245 - protein, 9 aa, Homo Sapiens
RPRPGIGLG

SEQ ID NO: 1376246 - protein, 9 aa, Homo Sapiens
EIALFRNKL

SEQ ID NO: 1376247 - protein, 9 aa, Homo Sapiens
GIKKAVWCS

SEQ ID NO: 1376248 - protein, 9 aa, Homo Sapiens
PGHPAAASI

SEQ ID NO: 1376249 - protein, 9 aa, Homo Sapiens
EAKEGPGLQ

SEQ ID NO: 1376250 - protein, 9 aa, Homo Sapiens
DDLMLDVEF

SEQ ID NO: 1376251 - protein, 9 aa, Homo Sapiens
YKKEGSEQM

SEQ ID NO: 1376252 - protein, 9 aa, Homo Sapiens
EVSWTTVFL

SEQ ID NO: 1376253 - protein, 9 aa, Homo Sapiens
SNEVSSNSW

SEQ ID NO: 1376254 - protein, 9 aa, Homo Sapiens
QLDSIYRRQ

SEQ ID NO: 1376255 - protein, 9 aa, Homo Sapiens
SGIKKAVWC

SEQ ID NO: 1376256 - protein, 9 aa, Homo Sapiens
SDELNGAYK

SEQ ID NO: 1376257 - protein, 9 aa, Homo Sapiens
MHNIDHAQR

SEQ ID NO: 1376258 - protein, 9 aa, Homo Sapiens
RSILSGTVQ

SEQ ID NO: 1376259 - protein, 9 aa, Homo Sapiens
GCMFRLTFC

SEQ ID NO: 1376260 - protein, 9 aa, Homo Sapiens
GFKINDQTG

SEQ ID NO: 1376261 - protein, 9 aa, Homo Sapiens
SPRKVPAPS

SEQ ID NO: 1376262 - protein, 9 aa, Homo Sapiens
EEYSEHFSP

SEQ ID NO: 1376263 - protein, 9 aa, Homo Sapiens
PLIEPIPDS

SEQ ID NO: 1376264 - protein, 9 aa, Homo Sapiens
GPRWAVPVH

SEQ ID NO: 1376265 - protein, 9 aa, Homo Sapiens
PPPLHSIRN

SEQ ID NO: 1376266 - protein, 9 aa, Homo Sapiens
PAPSPKSSG

SEQ ID NO: 1376267 - protein, 9 aa, Homo Sapiens
VAGILAVKL

SEQ ID NO: 1376268 - protein, 9 aa, Homo Sapiens
ESLKLRSLP

SEQ ID NO: 1376269 - protein, 9 aa, Homo Sapiens
GQPGALGCT

SEQ ID NO: 1376270 - protein, 9 aa, Homo Sapiens
TTTTTLTTM

SEQ ID NO: 1376271 - protein, 9 aa, Homo Sapiens
IKDIVSEFG

SEQ ID NO: 1376272 - protein, 9 aa, Homo Sapiens
EKEKELQNK

SEQ ID NO: 1376273 - protein, 9 aa, Homo Sapiens
RNRAAQRNP

SEQ ID NO: 1376274 - protein, 9 aa, Homo Sapiens
VWCSEDKQI

SEQ ID NO: 1376275 - protein, 9 aa, Homo Sapiens
GFSKQCPQK

SEQ ID NO: 1376276 - protein, 9 aa, Homo Sapiens
SYIMQRKQM

SEQ ID NO: 1376277 - protein, 9 aa, Homo Sapiens
VAFHAKQVQ

SEQ ID NO: 1376278 - protein, 9 aa, Homo Sapiens
TPQNKITVL

SEQ ID NO: 1376279 - protein, 9 aa, Homo Sapiens
LQRVHYGEK

SEQ ID NO: 1376280 - protein, 9 aa, Homo Sapiens
AQETPGSRP

SEQ ID NO: 1376281 - protein, 9 aa, Homo Sapiens
DLIFEHMEV

SEQ ID NO: 1376282 - protein, 9 aa, Homo Sapiens
KAKLERKLS

SEQ ID NO: 1376283 - protein, 9 aa, Homo Sapiens
SIDSMLDSS

SEQ ID NO: 1376284 - protein, 9 aa, Homo Sapiens
GRTLPRRCR

SEQ ID NO: 1376285 - protein, 9 aa, Homo Sapiens
GFDGYFRSR

SEQ ID NO: 1376286 - protein, 9 aa, Homo Sapiens
IFEHMEVMT

SEQ ID NO: 1376287 - protein, 9 aa, Homo Sapiens
VLREEAKEG

SEQ ID NO: 1376288 - protein, 9 aa, Homo Sapiens
CYKAYLAIP

SEQ ID NO: 1376289 - protein, 9 aa, Homo Sapiens
ALFRNKLSQ

SEQ ID NO: 1376290 - protein, 9 aa, Homo Sapiens
NFVDDLEHL

SEQ ID NO: 1376291 - protein, 9 aa, Homo Sapiens
KKTISDPED

SEQ ID NO: 1376292 - protein, 9 aa, Homo Sapiens
QCGLLVAQE

SEQ ID NO: 1376293 - protein, 9 aa, Homo Sapiens
CDQCGKCFL

SEQ ID NO: 1376294 - protein, 9 aa, Homo Sapiens
KLAVNCKAE

SEQ ID NO: 1376295 - protein, 9 aa, Homo Sapiens
WPDEEIRLK

SEQ ID NO: 1376296 - protein, 9 aa, Homo Sapiens
VPRCGKVYG

SEQ ID NO: 1376297 - protein, 9 aa, Homo Sapiens
YIQMTPVNK

SEQ ID NO: 1376298 - protein, 9 aa, Homo Sapiens
AHTGKMYAM

SEQ ID NO: 1376299 - protein, 9 aa, Homo Sapiens
FRRRPKTMT

SEQ ID NO: 1376300 - protein, 9 aa, Homo Sapiens
IVFLSCVIS

SEQ ID NO: 1376301 - protein, 9 aa, Homo Sapiens
DLMLDVEFL

SEQ ID NO: 1376302 - protein, 9 aa, Homo Sapiens
LGPLIFLVC

SEQ ID NO: 1376303 - protein, 9 aa, Homo Sapiens
RRLPARSIF

SEQ ID NO: 1376304 - protein, 9 aa, Homo Sapiens
SESLLSIDS

SEQ ID NO: 1376305 - protein, 9 aa, Homo Sapiens
EETETKQTF

SEQ ID NO: 1376306 - protein, 9 aa, Homo Sapiens
QGYHRELES

SEQ ID NO: 1376307 - protein, 9 aa, Homo Sapiens
TPPACPQAY

SEQ ID NO: 1376308 - protein, 9 aa, Homo Sapiens
PQNKITVLG

SEQ ID NO: 1376309 - protein, 9 aa, Homo Sapiens
RVPPSVTAG

SEQ ID NO: 1376310 - protein, 9 aa, Homo Sapiens
DHFFCKAPV

SEQ ID NO: 1376311 - protein, 9 aa, Homo Sapiens
HDGQNCLDV

SEQ ID NO: 1376312 - protein, 9 aa, Homo Sapiens
EQWKCDNDN

SEQ ID NO: 1376313 - protein, 9 aa, Homo Sapiens
YNMIGKDDS

SEQ ID NO: 1376314 - protein, 9 aa, Homo Sapiens
MHTIAFPDS

SEQ ID NO: 1376315 - protein, 9 aa, Homo Sapiens
HFAEDIWPE

SEQ ID NO: 1376316 - protein, 9 aa, Homo Sapiens
ITGTAGTTM

SEQ ID NO: 1376317 - protein, 9 aa, Homo Sapiens
RRPKTMTYT

SEQ ID NO: 1376318 - protein, 9 aa, Homo Sapiens
EHQDYEEDE

SEQ ID NO: 1376319 - protein, 9 aa, Homo Sapiens
TGTAGTTMG

SEQ ID NO: 1376320 - protein, 9 aa, Homo Sapiens
NESSDSVQT

SEQ ID NO: 1376321 - protein, 9 aa, Homo Sapiens
PLPEHGMQF

SEQ ID NO: 1376322 - protein, 9 aa, Homo Sapiens
YHQDLFDDF

SEQ ID NO: 1376323 - protein, 9 aa, Homo Sapiens
ENDGEHQDY

SEQ ID NO: 1376324 - protein, 9 aa, Homo Sapiens
DDDDDMMMT

SEQ ID NO: 1376325 - protein, 9 aa, Homo Sapiens
FHLAHDGQN

SEQ ID NO: 1376326 - protein, 9 aa, Homo Sapiens
LYPQPPQGP

SEQ ID NO: 1376327 - protein, 9 aa, Homo Sapiens
GASRRSQNR

SEQ ID NO: 1376328 - protein, 9 aa, Homo Sapiens
FVGKTWSHI

SEQ ID NO: 1376329 - protein, 9 aa, Homo Sapiens
TLLGNNESE

SEQ ID NO: 1376330 - protein, 9 aa, Homo Sapiens
LALLRSLQH

SEQ ID NO: 1376331 - protein, 9 aa, Homo Sapiens
AGYMPYCHP

SEQ ID NO: 1376332 - protein, 9 aa, Homo Sapiens
PHEHQEAEN

SEQ ID NO: 1376333 - protein, 9 aa, Homo Sapiens
LRCTMLVAK

SEQ ID NO: 1376334 - protein, 9 aa, Homo Sapiens
DGFDGYFRS

SEQ ID NO: 1376335 - protein, 9 aa, Homo Sapiens
ALIDQLLQQ

SEQ ID NO: 1376336 - protein, 9 aa, Homo Sapiens
LNQEIKILA

SEQ ID NO: 1376337 - protein, 9 aa, Homo Sapiens
YEKLGGTYW

SEQ ID NO: 1376338 - protein, 9 aa, Homo Sapiens
SPPARLGMD

SEQ ID NO: 1376339 - protein, 9 aa, Homo Sapiens
ATLKITAHN

SEQ ID NO: 1376340 - protein, 9 aa, Homo Sapiens
VQDALCGEM

SEQ ID NO: 1376341 - protein, 9 aa, Homo Sapiens
AQLQGMNID

SEQ ID NO: 1376342 - protein, 9 aa, Homo Sapiens
QTDTLTLEV

SEQ ID NO: 1376343 - protein, 9 aa, Homo Sapiens
GPQATLPFP

SEQ ID NO: 1376344 - protein, 9 aa, Homo Sapiens
LGSIRDEKR

SEQ ID NO: 1376345 - protein, 9 aa, Homo Sapiens
RCTMLVAKV

SEQ ID NO: 1376346 - protein, 9 aa, Homo Sapiens
LSHPDLLHL

SEQ ID NO: 1376347 - protein, 9 aa, Homo Sapiens
HVFNTPPAC

SEQ ID NO: 1376348 - protein, 9 aa, Homo Sapiens
PYCHPSSYT

SEQ ID NO: 1376349 - protein, 9 aa, Homo Sapiens
YLNQEIKIL

SEQ ID NO: 1376350 - protein, 9 aa, Homo Sapiens
SVESKKLPI

SEQ ID NO: 1376351 - protein, 9 aa, Homo Sapiens
PEVILLPNP

SEQ ID NO: 1376352 - protein, 9 aa, Homo Sapiens
VQTDTLTLE

SEQ ID NO: 1376353 - protein, 9 aa, Homo Sapiens
TWSHIMRED

SEQ ID NO: 1376354 - protein, 9 aa, Homo Sapiens
VLFEQAVRI

SEQ ID NO: 1376355 - protein, 9 aa, Homo Sapiens
EASRICVHC

SEQ ID NO: 1376356 - protein, 9 aa, Homo Sapiens
HGMDAVRSA

SEQ ID NO: 1376357 - protein, 9 aa, Homo Sapiens
LEAKAKLER

SEQ ID NO: 1376358 - protein, 9 aa, Homo Sapiens
SPPPEQKTA

SEQ ID NO: 1376359 - protein, 9 aa, Homo Sapiens
HPDLLHLGA

SEQ ID NO: 1376360 - protein, 9 aa, Homo Sapiens
AEDIWPEQG

SEQ ID NO: 1376361 - protein, 9 aa, Homo Sapiens
HEHQEAENA

SEQ ID NO: 1376362 - protein, 9 aa, Homo Sapiens
IVVQTSAKN

SEQ ID NO: 1376363 - protein, 9 aa, Homo Sapiens
IIGDQNHLM

SEQ ID NO: 1376364 - protein, 9 aa, Homo Sapiens
RSLPVNVGQ

SEQ ID NO: 1376365 - protein, 9 aa, Homo Sapiens
SVLDSLAGA

SEQ ID NO: 1376366 - protein, 9 aa, Homo Sapiens
MQRSMSHPK

SEQ ID NO: 1376367 - protein, 9 aa, Homo Sapiens
FFDDALIDQ

SEQ ID NO: 1376368 - protein, 9 aa, Homo Sapiens
RKAHTGKMY

SEQ ID NO: 1376369 - protein, 9 aa, Homo Sapiens
SSASRRTDL

SEQ ID NO: 1376370 - protein, 9 aa, Homo Sapiens
KLHLEKEYQ

SEQ ID NO: 1376371 - protein, 9 aa, Homo Sapiens
QEVSWTTVF

SEQ ID NO: 1376372 - protein, 9 aa, Homo Sapiens
RLGMDQKAS

SEQ ID NO: 1376373 - protein, 9 aa, Homo Sapiens
EVYGCRKAH

SEQ ID NO: 1376374 - protein, 9 aa, Homo Sapiens
TQQEASRIC

SEQ ID NO: 1376375 - protein, 9 aa, Homo Sapiens
AVVQVKIRV

SEQ ID NO: 1376376 - protein, 9 aa, Homo Sapiens
ASSATQIDF

SEQ ID NO: 1376377 - protein, 9 aa, Homo Sapiens
VNKTKTALG

SEQ ID NO: 1376378 - protein, 9 aa, Homo Sapiens
GMPHHGEAS

SEQ ID NO: 1376379 - protein, 9 aa, Homo Sapiens
PAGRPNPAP

SEQ ID NO: 1376380 - protein, 9 aa, Homo Sapiens
FEEYFEIVT

SEQ ID NO: 1376381 - protein, 9 aa, Homo Sapiens
RNSPARELR

SEQ ID NO: 1376382 - protein, 9 aa, Homo Sapiens
EIIVNSTYV

SEQ ID NO: 1376383 - protein, 9 aa, Homo Sapiens
SGVEDKMFS

SEQ ID NO: 1376384 - protein, 9 aa, Homo Sapiens
HSPTLKICT

SEQ ID NO: 1376385 - protein, 9 aa, Homo Sapiens
QATLPFPLA

SEQ ID NO: 1376386 - protein, 9 aa, Homo Sapiens
QMLIFTLAT

SEQ ID NO: 1376387 - protein, 9 aa, Homo Sapiens
RLVLNSFPE

SEQ ID NO: 1376388 - protein, 9 aa, Homo Sapiens
RSMSHPKPL

SEQ ID NO: 1376389 - protein, 9 aa, Homo Sapiens
PILFFFFPQ

SEQ ID NO: 1376390 - protein, 9 aa, Homo Sapiens
RISHTRPGL

SEQ ID NO: 1376391 - protein, 9 aa, Homo Sapiens
GRCISEQWK

SEQ ID NO: 1376392 - protein, 9 aa, Homo Sapiens
LRIAAVEKI

SEQ ID NO: 1376393 - protein, 9 aa, Homo Sapiens
YFTGEQLEN

SEQ ID NO: 1376394 - protein, 9 aa, Homo Sapiens
GRYYKTGSI

SEQ ID NO: 1376395 - protein, 9 aa, Homo Sapiens
PHPLLQQTK

SEQ ID NO: 1376396 - protein, 9 aa, Homo Sapiens
KLERKLSEK

SEQ ID NO: 1376397 - protein, 9 aa, Homo Sapiens
RIAAVEKIP

SEQ ID NO: 1376398 - protein, 9 aa, Homo Sapiens
AAAFIYEKL

SEQ ID NO: 1376399 - protein, 9 aa, Homo Sapiens
PEKQSTEQA

SEQ ID NO: 1376400 - protein, 9 aa, Homo Sapiens
EITDEDDDV

SEQ ID NO: 1376401 - protein, 9 aa, Homo Sapiens
LLVAQETPG

SEQ ID NO: 1376402 - protein, 9 aa, Homo Sapiens
YAVLLPLLD

SEQ ID NO: 1376403 - protein, 9 aa, Homo Sapiens
AAAGPQATL

SEQ ID NO: 1376404 - protein, 9 aa, Homo Sapiens
PNTSSRKNN

SEQ ID NO: 1376405 - protein, 9 aa, Homo Sapiens
HLAHDGQNC

SEQ ID NO: 1376406 - protein, 9 aa, Homo Sapiens
SHPDLLHLG

SEQ ID NO: 1376407 - protein, 9 aa, Homo Sapiens
DEIQPYSLE

SEQ ID NO: 1376408 - protein, 9 aa, Homo Sapiens
GVTSTSESW

SEQ ID NO: 1376409 - protein, 9 aa, Homo Sapiens
AAKVFFETF

SEQ ID NO: 1376410 - protein, 9 aa, Homo Sapiens
LLLASVLDS

SEQ ID NO: 1376411 - protein, 9 aa, Homo Sapiens
CGWEVVRAE

SEQ ID NO: 1376412 - protein, 9 aa, Homo Sapiens
KKPFTGHPL

SEQ ID NO: 1376413 - protein, 9 aa, Homo Sapiens
IKLQLLFLN

SEQ ID NO: 1376414 - protein, 9 aa, Homo Sapiens
TPVNKTKTA

SEQ ID NO: 1376415 - protein, 9 aa, Homo Sapiens
CSRGSHGMD

SEQ ID NO: 1376416 - protein, 9 aa, Homo Sapiens
EFGMETVIL

SEQ ID NO: 1376417 - protein, 9 aa, Homo Sapiens
CDYHQDLFD

SEQ ID NO: 1376418 - protein, 9 aa, Homo Sapiens
TRIGLLPVL

SEQ ID NO: 1376419 - protein, 9 aa, Homo Sapiens
ISVEESSEN

SEQ ID NO: 1376420 - protein, 9 aa, Homo Sapiens
RKQMETLSG

SEQ ID NO: 1376421 - protein, 9 aa, Homo Sapiens
FLGFSKQCP

SEQ ID NO: 1376422 - protein, 9 aa, Homo Sapiens
SKILGRYYK

SEQ ID NO: 1376423 - protein, 9 aa, Homo Sapiens
LDSLAGACG

SEQ ID NO: 1376424 - protein, 9 aa, Homo Sapiens
EDITDSLHD

SEQ ID NO: 1376425 - protein, 9 aa, Homo Sapiens
TLATTVAAV

SEQ ID NO: 1376426 - protein, 9 aa, Homo Sapiens
EIMHMAAPR

SEQ ID NO: 1376427 - protein, 9 aa, Homo Sapiens
NDHSEEHDD

SEQ ID NO: 1376428 - protein, 9 aa, Homo Sapiens
NPDLIFEHM

SEQ ID NO: 1376429 - protein, 9 aa, Homo Sapiens
VRTWIGNRK

SEQ ID NO: 1376430 - protein, 9 aa, Homo Sapiens
VEFIKDTGL

SEQ ID NO: 1376431 - protein, 9 aa, Homo Sapiens
TEIIEITDE

SEQ ID NO: 1376432 - protein, 9 aa, Homo Sapiens
KDQFLSPTL

SEQ ID NO: 1376433 - protein, 9 aa, Homo Sapiens
WTEVNAFKE

SEQ ID NO: 1376434 - protein, 9 aa, Homo Sapiens
EQHEKDFFG

SEQ ID NO: 1376435 - protein, 9 aa, Homo Sapiens
YIRTCYDSE

SEQ ID NO: 1376436 - protein, 9 aa, Homo Sapiens
TLYSSASRR

SEQ ID NO: 1376437 - protein, 9 aa, Homo Sapiens
LKLFEKKVV

SEQ ID NO: 1376438 - protein, 9 aa, Homo Sapiens
PGRQPTTHA

SEQ ID NO: 1376439 - protein, 9 aa, Homo Sapiens
KHQVIIGDQ

SEQ ID NO: 1376440 - protein, 9 aa, Homo Sapiens
VKIYFVPDR

SEQ ID NO: 1376441 - protein, 9 aa, Homo Sapiens
QPHGYDQPA

SEQ ID NO: 1376442 - protein, 9 aa, Homo Sapiens
ANPDLIFEH

SEQ ID NO: 1376443 - protein, 9 aa, Homo Sapiens
MGNNKVSVS

SEQ ID NO: 1376444 - protein, 9 aa, Homo Sapiens
CMGGMNRSP

SEQ ID NO: 1376445 - protein, 9 aa, Homo Sapiens
RIVKLSEAN

SEQ ID NO: 1376446 - protein, 9 aa, Homo Sapiens
AYASQFGTL

SEQ ID NO: 1376447 - protein, 9 aa, Homo Sapiens
TSPFTRLRE

SEQ ID NO: 1376448 - protein, 9 aa, Homo Sapiens
IKKAVWCSE

SEQ ID NO: 1376449 - protein, 9 aa, Homo Sapiens
EWVGAGATT

SEQ ID NO: 1376450 - protein, 9 aa, Homo Sapiens
KRKNSKTSN

SEQ ID NO: 1376451 - protein, 9 aa, Homo Sapiens
NPLDTGPMV

SEQ ID NO: 1376452 - protein, 9 aa, Homo Sapiens
EMRDTQRAS

SEQ ID NO: 1376453 - protein, 9 aa, Homo Sapiens
HPGPLGADG

SEQ ID NO: 1376454 - protein, 9 aa, Homo Sapiens
PPPSLQSPS

SEQ ID NO: 1376455 - protein, 9 aa, Homo Sapiens
KTLINAQDP

SEQ ID NO: 1376456 - protein, 9 aa, Homo Sapiens
HTGKMYAMK

SEQ ID NO: 1376457 - protein, 9 aa, Homo Sapiens
YIAAEEVKW

SEQ ID NO: 1376458 - protein, 9 aa, Homo Sapiens
LLLTHKGNA

SEQ ID NO: 1376459 - protein, 9 aa, Homo Sapiens
LQEQMNKLR

SEQ ID NO: 1376460 - protein, 9 aa, Homo Sapiens
FPCPTEGQI

SEQ ID NO: 1376461 - protein, 9 aa, Homo Sapiens
SKKLPIHFQ

SEQ ID NO: 1376462 - protein, 9 aa, Homo Sapiens
EIDHFFCKA

SEQ ID NO: 1376463 - protein, 9 aa, Homo Sapiens
VLDSLAGAC

SEQ ID NO: 1376464 - protein, 9 aa, Homo Sapiens
SRLRCTMLV

SEQ ID NO: 1376465 - protein, 9 aa, Homo Sapiens
FDERYTCVA

SEQ ID NO: 1376466 - protein, 9 aa, Homo Sapiens
WILSSVSHT

SEQ ID NO: 1376467 - protein, 9 aa, Homo Sapiens
LPEHGMQFG

SEQ ID NO: 1376468 - protein, 9 aa, Homo Sapiens
MHKNTLTDF

SEQ ID NO: 1376469 - protein, 9 aa, Homo Sapiens
SVSQAEWVG

SEQ ID NO: 1376470 - protein, 9 aa, Homo Sapiens
ESAGVLAKI

SEQ ID NO: 1376471 - protein, 9 aa, Homo Sapiens
NLGRNYASG

SEQ ID NO: 1376472 - protein, 9 aa, Homo Sapiens
DEHLSTQIV

SEQ ID NO: 1376473 - protein, 9 aa, Homo Sapiens
HTKKPKVMV

SEQ ID NO: 1376474 - protein, 9 aa, Homo Sapiens
LLGTVLPPG

SEQ ID NO: 1376475 - protein, 9 aa, Homo Sapiens
VEKVACPIC

SEQ ID NO: 1376476 - protein, 9 aa, Homo Sapiens
TGIKNENRG

SEQ ID NO: 1376477 - protein, 9 aa, Homo Sapiens
NSVLFRVYS

SEQ ID NO: 1376478 - protein, 9 aa, Homo Sapiens
LRLPIRDGN

SEQ ID NO: 1376479 - protein, 9 aa, Homo Sapiens
LSCRSDLQV

SEQ ID NO: 1376480 - protein, 9 aa, Homo Sapiens
EYSEHFSPQ

SEQ ID NO: 1376481 - protein, 9 aa, Homo Sapiens
TCVAFGYQD

SEQ ID NO: 1376482 - protein, 9 aa, Homo Sapiens
LLVQQLYPQ

SEQ ID NO: 1376483 - protein, 9 aa, Homo Sapiens
ICDQCGKCF

SEQ ID NO: 1376484 - protein, 9 aa, Homo Sapiens
SSVSHTKKP

SEQ ID NO: 1376485 - protein, 9 aa, Homo Sapiens
HKEPQIAPP

SEQ ID NO: 1376486 - protein, 9 aa, Homo Sapiens
QCGKCFLLE

SEQ ID NO: 1376487 - protein, 9 aa, Homo Sapiens
STKSSASLP

SEQ ID NO: 1376488 - protein, 9 aa, Homo Sapiens
KSRLRCTML

SEQ ID NO: 1376489 - protein, 9 aa, Homo Sapiens
VHDLNDKLQ

SEQ ID NO: 1376490 - protein, 9 aa, Homo Sapiens
MAATIQAVE

SEQ ID NO: 1376491 - protein, 9 aa, Homo Sapiens
DFISLSGER

SEQ ID NO: 1376492 - protein, 9 aa, Homo Sapiens
TPRTVEIIV

SEQ ID NO: 1376493 - protein, 9 aa, Homo Sapiens
QEREFIADI

SEQ ID NO: 1376494 - protein, 9 aa, Homo Sapiens
RLHAGATYR

SEQ ID NO: 1376495 - protein, 9 aa, Homo Sapiens
ACPQAYQST

SEQ ID NO: 1376496 - protein, 9 aa, Homo Sapiens
LYRGEVSRS

SEQ ID NO: 1376497 - protein, 9 aa, Homo Sapiens
AIYHVTVVY

SEQ ID NO: 1376498 - protein, 9 aa, Homo Sapiens
VWKRSPWLQ

SEQ ID NO: 1376499 - protein, 9 aa, Homo Sapiens
LLASVLDSL

SEQ ID NO: 1376500 - protein, 9 aa, Homo Sapiens
SLQSPSRLP

SEQ ID NO: 1376501 - protein, 9 aa, Homo Sapiens
FKNLTTTGR

SEQ ID NO: 1376502 - protein, 9 aa, Homo Sapiens
GMDQKASPQ

SEQ ID NO: 1376503 - protein, 9 aa, Homo Sapiens
LPVNVGQLL

SEQ ID NO: 1376504 - protein, 9 aa, Homo Sapiens
NGRCISEQW

SEQ ID NO: 1376505 - protein, 9 aa, Homo Sapiens
ACCAVEIMH

SEQ ID NO: 1376506 - protein, 9 aa, Homo Sapiens
VCHVPRCGK

SEQ ID NO: 1376507 - protein, 9 aa, Homo Sapiens
QRSMSHPKP

SEQ ID NO: 1376508 - protein, 9 aa, Homo Sapiens
SASNQPYQR

SEQ ID NO: 1376509 - protein, 9 aa, Homo Sapiens
KTGSIRPGV

SEQ ID NO: 1376510 - protein, 9 aa, Homo Sapiens
LAKIVKPSP

SEQ ID NO: 1376511 - protein, 9 aa, Homo Sapiens
TGNLQPQRY

SEQ ID NO: 1376512 - protein, 9 aa, Homo Sapiens
NHIVGYFDY

SEQ ID NO: 1376513 - protein, 9 aa, Homo Sapiens
SRNSSMLPR

SEQ ID NO: 1376514 - protein, 9 aa, Homo Sapiens
YRGEVSRSL

SEQ ID NO: 1376515 - protein, 9 aa, Homo Sapiens
LEVRLRLGY

SEQ ID NO: 1376516 - protein, 9 aa, Homo Sapiens
CYQLVQTHL

SEQ ID NO: 1376517 - protein, 9 aa, Homo Sapiens
PQRKSRKPQ

SEQ ID NO: 1376518 - protein, 9 aa, Homo Sapiens
RPVMQAVLH

SEQ ID NO: 1376519 - protein, 9 aa, Homo Sapiens
AGRTLPRRC

SEQ ID NO: 1376520 - protein, 9 aa, Homo Sapiens
CLFTADTYD

SEQ ID NO: 1376521 - protein, 9 aa, Homo Sapiens
TFDALIKLQ

SEQ ID NO: 1376522 - protein, 9 aa, Homo Sapiens
MDLATLKIT

SEQ ID NO: 1376523 - protein, 9 aa, Homo Sapiens
SDPEDFLQA

SEQ ID NO: 1376524 - protein, 9 aa, Homo Sapiens
DIVSEFGME

SEQ ID NO: 1376525 - protein, 9 aa, Homo Sapiens
VGIGESLPC

SEQ ID NO: 1376526 - protein, 9 aa, Homo Sapiens
YMPYCHPSS

SEQ ID NO: 1376527 - protein, 9 aa, Homo Sapiens
DLGQEVSWT

SEQ ID NO: 1376528 - protein, 9 aa, Homo Sapiens
IAAEEVKWD

SEQ ID NO: 1376529 - protein, 9 aa, Homo Sapiens
GGMNRSPIL

SEQ ID NO: 1376530 - protein, 9 aa, Homo Sapiens
YFEIVTPKI

SEQ ID NO: 1376531 - protein, 9 aa, Homo Sapiens
TSSRKNNIT

SEQ ID NO: 1376532 - protein, 9 aa, Homo Sapiens
YATDLGQEV

SEQ ID NO: 1376533 - protein, 9 aa, Homo Sapiens
DEDEEMLQT

SEQ ID NO: 1376534 - protein, 9 aa, Homo Sapiens
FGQPGALGC

SEQ ID NO: 1376535 - protein, 9 aa, Homo Sapiens
VMQAVLHII

SEQ ID NO: 1376536 - protein, 9 aa, Homo Sapiens
LQDGKLHLE

SEQ ID NO: 1376537 - protein, 9 aa, Homo Sapiens
LLTHKGNAT

SEQ ID NO: 1376538 - protein, 9 aa, Homo Sapiens
KSYNMIGKD

SEQ ID NO: 1376539 - protein, 9 aa, Homo Sapiens
DNQNSKKLT

SEQ ID NO: 1376540 - protein, 9 aa, Homo Sapiens
ILFFFFPQK

SEQ ID NO: 1376541 - protein, 9 aa, Homo Sapiens
RKWQMMFTD

SEQ ID NO: 1376542 - protein, 9 aa, Homo Sapiens
EDVRHLRSL

SEQ ID NO: 1376543 - protein, 9 aa, Homo Sapiens
HSALDELFD

SEQ ID NO: 1376544 - protein, 9 aa, Homo Sapiens
FKRFCWLSL

SEQ ID NO: 1376545 - protein, 9 aa, Homo Sapiens
QWPDEEIRL

SEQ ID NO: 1376546 - protein, 9 aa, Homo Sapiens
IMPLHWQDA

SEQ ID NO: 1376547 - protein, 9 aa, Homo Sapiens
TLTTMMVIT

SEQ ID NO: 1376548 - protein, 9 aa, Homo Sapiens
LNFVDDLEH

SEQ ID NO: 1376549 - protein, 9 aa, Homo Sapiens
GFHPFISTN

SEQ ID NO: 1376550 - protein, 9 aa, Homo Sapiens
VESKKLPIH

SEQ ID NO: 1376551 - protein, 9 aa, Homo Sapiens
NRKRKYRLM

SEQ ID NO: 1376552 - protein, 9 aa, Homo Sapiens
MFRLTFCSA

SEQ ID NO: 1376553 - protein, 9 aa, Homo Sapiens
SPTLKICTC

SEQ ID NO: 1376554 - protein, 9 aa, Homo Sapiens
DLLHLGALP

SEQ ID NO: 1376555 - protein, 9 aa, Homo Sapiens
ILLGPLIFL

SEQ ID NO: 1376556 - protein, 9 aa, Homo Sapiens
SSLTGDLPL

SEQ ID NO: 1376557 - protein, 9 aa, Homo Sapiens
VYNVMDKNR

SEQ ID NO: 1376558 - protein, 9 aa, Homo Sapiens
PEFSLDSTM

SEQ ID NO: 1376559 - protein, 9 aa, Homo Sapiens
VTSPRKVPA

SEQ ID NO: 1376560 - protein, 9 aa, Homo Sapiens
CGEGLRSRT

SEQ ID NO: 1376561 - protein, 9 aa, Homo Sapiens
GFSKGGHLC

SEQ ID NO: 1376562 - protein, 9 aa, Homo Sapiens
SMLPRRGAL

SEQ ID NO: 1376563 - protein, 9 aa, Homo Sapiens
LIAPKANDH

SEQ ID NO: 1376564 - protein, 9 aa, Homo Sapiens
RRHSWRSWQ

SEQ ID NO: 1376565 - protein, 9 aa, Homo Sapiens
QSPSRLPGP

SEQ ID NO: 1376566 - protein, 9 aa, Homo Sapiens
STRTTVRSG

SEQ ID NO: 1376567 - protein, 9 aa, Homo Sapiens
CKAPVLVRL

SEQ ID NO: 1376568 - protein, 9 aa, Homo Sapiens
PAVQFDERL

SEQ ID NO: 1376569 - protein, 9 aa, Homo Sapiens
PLNEKLDRE

SEQ ID NO: 1376570 - protein, 9 aa, Homo Sapiens
CCYQLVQTH

SEQ ID NO: 1376571 - protein, 9 aa, Homo Sapiens
VLNSFPEVI

SEQ ID NO: 1376572 - protein, 9 aa, Homo Sapiens
GDFMHKNTL

SEQ ID NO: 1376573 - protein, 9 aa, Homo Sapiens
WIAPSLHRP

SEQ ID NO: 1376574 - protein, 9 aa, Homo Sapiens
SHGMDAVRS

SEQ ID NO: 1376575 - protein, 9 aa, Homo Sapiens
PNGDSSPTK

SEQ ID NO: 1376576 - protein, 9 aa, Homo Sapiens
GKCFLLESE

SEQ ID NO: 1376577 - protein, 9 aa, Homo Sapiens
EEFKLKQMR

SEQ ID NO: 1376578 - protein, 9 aa, Homo Sapiens
SFPPIVETR

SEQ ID NO: 1376579 - protein, 9 aa, Homo Sapiens
QMTPVNKTK

SEQ ID NO: 1376580 - protein, 9 aa, Homo Sapiens
SEQKAASPP

SEQ ID NO: 1376581 - protein, 9 aa, Homo Sapiens
MPYNYAVLL

SEQ ID NO: 1376582 - protein, 9 aa, Homo Sapiens
LGFSKQCPQ

SEQ ID NO: 1376583 - protein, 9 aa, Homo Sapiens
TGHPLIEPI

SEQ ID NO: 1376584 - protein, 9 aa, Homo Sapiens
NGFCQLFPG

SEQ ID NO: 1376585 - protein, 9 aa, Homo Sapiens
TKSSASLPL

SEQ ID NO: 1376586 - protein, 9 aa, Homo Sapiens
NNDHFLYRG

SEQ ID NO: 1376587 - protein, 9 aa, Homo Sapiens
IMGNNKVSV

SEQ ID NO: 1376588 - protein, 9 aa, Homo Sapiens
SYYMISRLL

SEQ ID NO: 1376589 - protein, 9 aa, Homo Sapiens
SPCGWEVVR

SEQ ID NO: 1376590 - protein, 9 aa, Homo Sapiens
VQRYVVLAQ

SEQ ID NO: 1376591 - protein, 9 aa, Homo Sapiens
LINAQDPPM

SEQ ID NO: 1376592 - protein, 9 aa, Homo Sapiens
FTNLNLGRN

SEQ ID NO: 1376593 - protein, 9 aa, Homo Sapiens
VVDDWIELY

SEQ ID NO: 1376594 - protein, 9 aa, Homo Sapiens
SRRSQNRLQ

SEQ ID NO: 1376595 - protein, 9 aa, Homo Sapiens
LSDSSVTGD

SEQ ID NO: 1376596 - protein, 9 aa, Homo Sapiens
YPQPPQGPQ

SEQ ID NO: 1376597 - protein, 9 aa, Homo Sapiens
RLLGPEFGG

SEQ ID NO: 1376598 - protein, 9 aa, Homo Sapiens
RTAAGPRWA

SEQ ID NO: 1376599 - protein, 9 aa, Homo Sapiens
ESDELNGAY

SEQ ID NO: 1376600 - protein, 9 aa, Homo Sapiens
LATTVAAVQ

SEQ ID NO: 1376601 - protein, 9 aa, Homo Sapiens
GYIQMTPVN

SEQ ID NO: 1376602 - protein, 9 aa, Homo Sapiens
SNEDVRHLR

SEQ ID NO: 1376603 - protein, 9 aa, Homo Sapiens
LTTMMVITT

SEQ ID NO: 1376604 - protein, 9 aa, Homo Sapiens
ELRLQGYHR

SEQ ID NO: 1376605 - protein, 9 aa, Homo Sapiens
KYSPCGWEV

SEQ ID NO: 1376606 - protein, 9 aa, Homo Sapiens
HYSSGMPHH

SEQ ID NO: 1376607 - protein, 9 aa, Homo Sapiens
ESSDSVQTD

SEQ ID NO: 1376608 - protein, 9 aa, Homo Sapiens
LFGAPKRRL

SEQ ID NO: 1376609 - protein, 9 aa, Homo Sapiens
LQGFHKFVI

SEQ ID NO: 1376610 - protein, 9 aa, Homo Sapiens
PDMTNLTEL

SEQ ID NO: 1376611 - protein, 9 aa, Homo Sapiens
SRRTDLSYS

SEQ ID NO: 1376612 - protein, 9 aa, Homo Sapiens
TDEDDDVLS

SEQ ID NO: 1376613 - protein, 9 aa, Homo Sapiens
GHLCLSMAS

SEQ ID NO: 1376614 - protein, 9 aa, Homo Sapiens
TINTIMGNN

SEQ ID NO: 1376615 - protein, 9 aa, Homo Sapiens
IVGYFDYAF

SEQ ID NO: 1376616 - protein, 9 aa, Homo Sapiens
CQKLQEQMN

SEQ ID NO: 1376617 - protein, 9 aa, Homo Sapiens
VSELHRATE

SEQ ID NO: 1376618 - protein, 9 aa, Homo Sapiens
GTVQNIDYP

SEQ ID NO: 1376619 - protein, 9 aa, Homo Sapiens
KSSASLPLT

SEQ ID NO: 1376620 - protein, 9 aa, Homo Sapiens
GTAGTTMGK

SEQ ID NO: 1376621 - protein, 9 aa, Homo Sapiens
FGFHPFIST

SEQ ID NO: 1376622 - protein, 9 aa, Homo Sapiens
LASEWGKYG

SEQ ID NO: 1376623 - protein, 9 aa, Homo Sapiens
PLGADGAQG

SEQ ID NO: 1376624 - protein, 9 aa, Homo Sapiens
LLGFPCPTE

SEQ ID NO: 1376625 - protein, 9 aa, Homo Sapiens
VIQTKSGSL

SEQ ID NO: 1376626 - protein, 9 aa, Homo Sapiens
SIRNLKKSK

SEQ ID NO: 1376627 - protein, 9 aa, Homo Sapiens
SNLRKQMET

SEQ ID NO: 1376628 - protein, 9 aa, Homo Sapiens
IDVQNVEVD

SEQ ID NO: 1376629 - protein, 9 aa, Homo Sapiens
QFDERYTCV

SEQ ID NO: 1376630 - protein, 9 aa, Homo Sapiens
TGQHFPFFW

SEQ ID NO: 1376631 - protein, 9 aa, Homo Sapiens
LHAGATYRE

SEQ ID NO: 1376632 - protein, 9 aa, Homo Sapiens
LIGQCISVK

SEQ ID NO: 1376633 - protein, 9 aa, Homo Sapiens
LLEAKAKLE

SEQ ID NO: 1376634 - protein, 9 aa, Homo Sapiens
PAFILGSIR

SEQ ID NO: 1376635 - protein, 9 aa, Homo Sapiens
ASNQPYQRE

SEQ ID NO: 1376636 - protein, 9 aa, Homo Sapiens
FPPIVETRK

SEQ ID NO: 1376637 - protein, 9 aa, Homo Sapiens
QVVQRYVVL

SEQ ID NO: 1376638 - protein, 9 aa, Homo Sapiens
LKICTCAPS

SEQ ID NO: 1376639 - protein, 9 aa, Homo Sapiens
NVKFAKGSK

SEQ ID NO: 1376640 - protein, 9 aa, Homo Sapiens
TKQTFKEFR

SEQ ID NO: 1376641 - protein, 9 aa, Homo Sapiens
EMGHKPDVE

SEQ ID NO: 1376642 - protein, 9 aa, Homo Sapiens
LGMDQKASP

SEQ ID NO: 1376643 - protein, 9 aa, Homo Sapiens
RSLPAVQFD

SEQ ID NO: 1376644 - protein, 9 aa, Homo Sapiens
LTSETFYTF

SEQ ID NO: 1376645 - protein, 9 aa, Homo Sapiens
TATRSVWKR

SEQ ID NO: 1376646 - protein, 9 aa, Homo Sapiens
FFLGILLTS

SEQ ID NO: 1376647 - protein, 9 aa, Homo Sapiens
KYLTLQGFH

SEQ ID NO: 1376648 - protein, 9 aa, Homo Sapiens
QRNPALAGS

SEQ ID NO: 1376649 - protein, 9 aa, Homo Sapiens
FPQKVSELH

SEQ ID NO: 1376650 - protein, 9 aa, Homo Sapiens
VQNVEVDDY

SEQ ID NO: 1376651 - protein, 9 aa, Homo Sapiens
GLEMRDTQR

SEQ ID NO: 1376652 - protein, 9 aa, Homo Sapiens
PGALGCTPF

SEQ ID NO: 1376653 - protein, 9 aa, Homo Sapiens
SVSHTKKPK

SEQ ID NO: 1376654 - protein, 9 aa, Homo Sapiens
LGRNYASGY

SEQ ID NO: 1376655 - protein, 9 aa, Homo Sapiens
LLRSLQHFA

SEQ ID NO: 1376656 - protein, 9 aa, Homo Sapiens
SNDEMLSLN

SEQ ID NO: 1376657 - protein, 9 aa, Homo Sapiens
ICVHCHRNL

SEQ ID NO: 1376658 - protein, 9 aa, Homo Sapiens
TLKICTCAP

SEQ ID NO: 1376659 - protein, 9 aa, Homo Sapiens
LYSSASRRT

SEQ ID NO: 1376660 - protein, 9 aa, Homo Sapiens
QSNEVSSNS

SEQ ID NO: 1376661 - protein, 9 aa, Homo Sapiens
FDERLQPLL

SEQ ID NO: 1376662 - protein, 9 aa, Homo Sapiens
EMPEFSLDS

SEQ ID NO: 1376663 - protein, 9 aa, Homo Sapiens
DEDIDVQNV

SEQ ID NO: 1376664 - protein, 9 aa, Homo Sapiens
WQLKAPLPA

SEQ ID NO: 1376665 - protein, 9 aa, Homo Sapiens
LPIIVFLSC

SEQ ID NO: 1376666 - protein, 9 aa, Homo Sapiens
VYKCPVGIG

SEQ ID NO: 1376667 - protein, 9 aa, Homo Sapiens
TLTDFPQMQ

SEQ ID NO: 1376668 - protein, 9 aa, Homo Sapiens
YTPRTVEII

SEQ ID NO: 1376669 - protein, 9 aa, Homo Sapiens
ETKQTFKEF

SEQ ID NO: 1376670 - protein, 9 aa, Homo Sapiens
TSHSRPGPM

SEQ ID NO: 1376671 - protein, 9 aa, Homo Sapiens
DFLQASLKD

SEQ ID NO: 1376672 - protein, 9 aa, Homo Sapiens
LHWQDAMES

SEQ ID NO: 1376673 - protein, 9 aa, Homo Sapiens
WMKHSNLYL

SEQ ID NO: 1376674 - protein, 9 aa, Homo Sapiens
DVYKCPVGI

SEQ ID NO: 1376675 - protein, 9 aa, Homo Sapiens
CVLPVSRQK

SEQ ID NO: 1376676 - protein, 9 aa, Homo Sapiens
CAVEIMHMA

SEQ ID NO: 1376677 - protein, 9 aa, Homo Sapiens
QDAMESSPG

SEQ ID NO: 1376678 - protein, 9 aa, Homo Sapiens
YNMSKSKFD

SEQ ID NO: 1376679 - protein, 9 aa, Homo Sapiens
DPSQEREFI

SEQ ID NO: 1376680 - protein, 9 aa, Homo Sapiens
FQKLIAPKA

SEQ ID NO: 1376681 - protein, 9 aa, Homo Sapiens
SSLSKHMKI

SEQ ID NO: 1376682 - protein, 9 aa, Homo Sapiens
AAEEVKWDY

SEQ ID NO: 1376683 - protein, 9 aa, Homo Sapiens
PYVKIYFVP

SEQ ID NO: 1376684 - protein, 9 aa, Homo Sapiens
MISRLLGPE

SEQ ID NO: 1376685 - protein, 9 aa, Homo Sapiens
TPHCFKIGE

SEQ ID NO: 1376686 - protein, 9 aa, Homo Sapiens
CGSEPVAPN

SEQ ID NO: 1376687 - protein, 9 aa, Homo Sapiens
SSVTGDMDI

SEQ ID NO: 1376688 - protein, 9 aa, Homo Sapiens
HCFKIGEEA

SEQ ID NO: 1376689 - protein, 9 aa, Homo Sapiens
NKIELAKDE

SEQ ID NO: 1376690 - protein, 9 aa, Homo Sapiens
SIKDIVSEF

SEQ ID NO: 1376691 - protein, 9 aa, Homo Sapiens
ASIDGFDGY

SEQ ID NO: 1376692 - protein, 9 aa, Homo Sapiens
VRPRPGIGL

SEQ ID NO: 1376693 - protein, 9 aa, Homo Sapiens
CQLFPGLRP

SEQ ID NO: 1376694 - protein, 9 aa, Homo Sapiens
THPSSLSKH

SEQ ID NO: 1376695 - protein, 9 aa, Homo Sapiens
DDALIDQLL

SEQ ID NO: 1376696 - protein, 9 aa, Homo Sapiens
TFLHAHCEC

SEQ ID NO: 1376697 - protein, 9 aa, Homo Sapiens
IRPVMQAVL

SEQ ID NO: 1376698 - protein, 9 aa, Homo Sapiens
TMAATIQAV

SEQ ID NO: 1376699 - protein, 9 aa, Homo Sapiens
PCNQSSFWQ

SEQ ID NO: 1376700 - protein, 9 aa, Homo Sapiens
ICRKWQMMF

SEQ ID NO: 1376701 - protein, 9 aa, Homo Sapiens
RCLRIPPPG

SEQ ID NO: 1376702 - protein, 9 aa, Homo Sapiens
VLHIIRETE

SEQ ID NO: 1376703 - protein, 9 aa, Homo Sapiens
HSIRNLKKS

SEQ ID NO: 1376704 - protein, 9 aa, Homo Sapiens
QKQELGHVI

SEQ ID NO: 1376705 - protein, 9 aa, Homo Sapiens
HIKLAVNCK

SEQ ID NO: 1376706 - protein, 9 aa, Homo Sapiens
SKHMKIHCK

SEQ ID NO: 1376707 - protein, 9 aa, Homo Sapiens
PVLREEAKE

SEQ ID NO: 1376708 - protein, 9 aa, Homo Sapiens
TRTTVRSGL

SEQ ID NO: 1376709 - protein, 9 aa, Homo Sapiens
VPEGTLPEK

SEQ ID NO: 1376710 - protein, 9 aa, Homo Sapiens
VPPSVTAGP

SEQ ID NO: 1376711 - protein, 9 aa, Homo Sapiens
AGHPGPLGA

SEQ ID NO: 1376712 - protein, 9 aa, Homo Sapiens
LPLNEKLDR

SEQ ID NO: 1376713 - protein, 9 aa, Homo Sapiens
AVLLPLLDD

SEQ ID NO: 1376714 - protein, 9 aa, Homo Sapiens
EDFLQASLK

SEQ ID NO: 1376715 - protein, 9 aa, Homo Sapiens
EVPNGSKQE

SEQ ID NO: 1376716 - protein, 9 aa, Homo Sapiens
DMMMTTTTT

SEQ ID NO: 1376717 - protein, 9 aa, Homo Sapiens
VRKRVPPTL

SEQ ID NO: 1376718 - protein, 9 aa, Homo Sapiens
QAEFQSYIR

SEQ ID NO: 1376719 - protein, 9 aa, Homo Sapiens
STRIGLLPV

SEQ ID NO: 1376720 - protein, 9 aa, Homo Sapiens
SLTNSHKEP

SEQ ID NO: 1376721 - protein, 9 aa, Homo Sapiens
ISNLRKQME

SEQ ID NO: 1376722 - protein, 9 aa, Homo Sapiens
LGQEVSWTT

SEQ ID NO: 1376723 - protein, 9 aa, Homo Sapiens
IFKNLTTTG

SEQ ID NO: 1376724 - protein, 9 aa, Homo Sapiens
LQGPPLDAY

SEQ ID NO: 1376725 - protein, 9 aa, Homo Sapiens
QEASRICVH

SEQ ID NO: 1376726 - protein, 9 aa, Homo Sapiens
SPGHPAAAS

SEQ ID NO: 1376727 - protein, 9 aa, Homo Sapiens
YYMISRLLG

SEQ ID NO: 1376728 - protein, 9 aa, Homo Sapiens
VMGPPRSET

SEQ ID NO: 1376729 - protein, 9 aa, Homo Sapiens
RQDNQNDHS

SEQ ID NO: 1376730 - protein, 9 aa, Homo Sapiens
EIIEITDED

SEQ ID NO: 1376731 - protein, 9 aa, Homo Sapiens
QVIIGDQNH

SEQ ID NO: 1376732 - protein, 9 aa, Homo Sapiens
KKLTAGHEL

SEQ ID NO: 1376733 - protein, 9 aa, Homo Sapiens
VLMRVPPSV

SEQ ID NO: 1376734 - protein, 9 aa, Homo Sapiens
AQRNPALAG

SEQ ID NO: 1376735 - protein, 9 aa, Homo Sapiens
QVKIRVNDV

SEQ ID NO: 1376736 - protein, 9 aa, Homo Sapiens
VPEEYSEHF

SEQ ID NO: 1376737 - protein, 9 aa, Homo Sapiens
DGQNCLDVD

SEQ ID NO: 1376738 - protein, 9 aa, Homo Sapiens
HVAAVGCVQ

SEQ ID NO: 1376739 - protein, 9 aa, Homo Sapiens
LTFLHAHCE

SEQ ID NO: 1376740 - protein, 9 aa, Homo Sapiens
SIYRRQGSS

SEQ ID NO: 1376741 - protein, 9 aa, Homo Sapiens
GPLGADGAQ

SEQ ID NO: 1376742 - protein, 9 aa, Homo Sapiens
ENTDVNNLL

SEQ ID NO: 1376743 - protein, 9 aa, Homo Sapiens
RKSPNGTIR

SEQ ID NO: 1376744 - protein, 9 aa, Homo Sapiens
QNIDYPHYC

SEQ ID NO: 1376745 - protein, 9 aa, Homo Sapiens
LSIVRKRVP

SEQ ID NO: 1376746 - protein, 9 aa, Homo Sapiens
QGNQTAQLQ

SEQ ID NO: 1376747 - protein, 9 aa, Homo Sapiens
VNSVLFRVY

SEQ ID NO: 1376748 - protein, 9 aa, Homo Sapiens
AVQFDERLQ

SEQ ID NO: 1376749 - protein, 9 aa, Homo Sapiens
SEQWKCDND

SEQ ID NO: 1376750 - protein, 9 aa, Homo Sapiens
AESSHLTRH

SEQ ID NO: 1376751 - protein, 9 aa, Homo Sapiens
LMLDVEFLE

SEQ ID NO: 1376752 - protein, 9 aa, Homo Sapiens
SQSDVGSSS

SEQ ID NO: 1376753 - protein, 9 aa, Homo Sapiens
KRMTSPFTR

SEQ ID NO: 1376754 - protein, 9 aa, Homo Sapiens
SEFELRLQG

SEQ ID NO: 1376755 - protein, 9 aa, Homo Sapiens
LTNSHKEPQ

SEQ ID NO: 1376756 - protein, 9 aa, Homo Sapiens
VTSTSESWV

SEQ ID NO: 1376757 - protein, 9 aa, Homo Sapiens
ALPIIQSNE

SEQ ID NO: 1376758 - protein, 9 aa, Homo Sapiens
ICTCAPSTL

SEQ ID NO: 1376759 - protein, 9 aa, Homo Sapiens
NPAKAQSAA

SEQ ID NO: 1376760 - protein, 9 aa, Homo Sapiens
VIMQKYEEQ

SEQ ID NO: 1376761 - protein, 9 aa, Homo Sapiens
YCHCCYQLV

SEQ ID NO: 1376762 - protein, 9 aa, Homo Sapiens
YSSGMPHHG

SEQ ID NO: 1376763 - protein, 9 aa, Homo Sapiens
QTFKEFRCQ

SEQ ID NO: 1376764 - protein, 9 aa, Homo Sapiens
HAKLGKSYN

SEQ ID NO: 1376765 - protein, 9 aa, Homo Sapiens
LQWPDEEIR

SEQ ID NO: 1376766 - protein, 9 aa, Homo Sapiens
PCLFTADTY

SEQ ID NO: 1376767 - protein, 9 aa, Homo Sapiens
KLRRWHKSG

SEQ ID NO: 1376768 - protein, 9 aa, Homo Sapiens
PAVTGNLQP

SEQ ID NO: 1376769 - protein, 9 aa, Homo Sapiens
KDGTYLDDS

SEQ ID NO: 1376770 - protein, 9 aa, Homo Sapiens
PQRYLEVQY

SEQ ID NO: 1376771 - protein, 9 aa, Homo Sapiens
GLLHAEGSR

SEQ ID NO: 1376772 - protein, 9 aa, Homo Sapiens
SKSLASEWG

SEQ ID NO: 1376773 - protein, 9 aa, Homo Sapiens
GTTMGKGVT

SEQ ID NO: 1376774 - protein, 9 aa, Homo Sapiens
LGKSYNMIG

SEQ ID NO: 1376775 - protein, 9 aa, Homo Sapiens
QEQMNKLRK

SEQ ID NO: 1376776 - protein, 9 aa, Homo Sapiens
YRYFIHNRP

SEQ ID NO: 1376777 - protein, 9 aa, Homo Sapiens
GGHLCLSMA

SEQ ID NO: 1376778 - protein, 9 aa, Homo Sapiens
EGYSSYPGS

SEQ ID NO: 1376779 - protein, 9 aa, Homo Sapiens
PAAASIYTN

SEQ ID NO: 1376780 - protein, 9 aa, Homo Sapiens
INVKFAKGS

SEQ ID NO: 1376781 - protein, 9 aa, Homo Sapiens
STESNGFCQ

SEQ ID NO: 1376782 - protein, 9 aa, Homo Sapiens
PGLLLGTVL

SEQ ID NO: 1376783 - protein, 9 aa, Homo Sapiens
TYREVQKLM

SEQ ID NO: 1376784 - protein, 9 aa, Homo Sapiens
NNITSKTET

SEQ ID NO: 1376785 - protein, 9 aa, Homo Sapiens
NSKKLTAGH

SEQ ID NO: 1376786 - protein, 9 aa, Homo Sapiens
GYFRSRTLA

SEQ ID NO: 1376787 - protein, 9 aa, Homo Sapiens
FLGILLTSE

SEQ ID NO: 1376788 - protein, 9 aa, Homo Sapiens
AHTGCMFRL

SEQ ID NO: 1376789 - protein, 9 aa, Homo Sapiens
MSHPKPLSP

SEQ ID NO: 1376790 - protein, 9 aa, Homo Sapiens
ISDPEDFLQ

SEQ ID NO: 1376791 - protein, 9 aa, Homo Sapiens
DQNHLMLII

SEQ ID NO: 1376792 - protein, 9 aa, Homo Sapiens
QLQGMNIDS

SEQ ID NO: 1376793 - protein, 9 aa, Homo Sapiens
LNSFPEVIL

SEQ ID NO: 1376794 - protein, 9 aa, Homo Sapiens
CPHFAEDIW

SEQ ID NO: 1376795 - protein, 9 aa, Homo Sapiens
LTDRLQVAM

SEQ ID NO: 1376796 - protein, 9 aa, Homo Sapiens
EDKMFSLLK

SEQ ID NO: 1376797 - protein, 9 aa, Homo Sapiens
RCGNLSCRS

SEQ ID NO: 1376798 - protein, 9 aa, Homo Sapiens
THDLQGPPL

SEQ ID NO: 1376799 - protein, 9 aa, Homo Sapiens
SPPHEHQEA

SEQ ID NO: 1376800 - protein, 9 aa, Homo Sapiens
MDYSLLMSM

SEQ ID NO: 1376801 - protein, 9 aa, Homo Sapiens
AVEIMHMAA

SEQ ID NO: 1376802 - protein, 9 aa, Homo Sapiens
IFTLATTVA

SEQ ID NO: 1376803 - protein, 9 aa, Homo Sapiens
YCHPSSYTT

SEQ ID NO: 1376804 - protein, 9 aa, Homo Sapiens
YTCVAFGYQ

SEQ ID NO: 1376805 - protein, 9 aa, Homo Sapiens
QPSEQKAAS

SEQ ID NO: 1376806 - protein, 9 aa, Homo Sapiens
VRSGLDLKA

SEQ ID NO: 1376807 - protein, 9 aa, Homo Sapiens
AMKVIPRNR

SEQ ID NO: 1376808 - protein, 9 aa, Homo Sapiens
ALIKLQLLF

SEQ ID NO: 1376809 - protein, 9 aa, Homo Sapiens
YKTLINAQD

SEQ ID NO: 1376810 - protein, 9 aa, Homo Sapiens
RNSSMLPRR

SEQ ID NO: 1376811 - protein, 9 aa, Homo Sapiens
SVTGDMDIL

SEQ ID NO: 1376812 - protein, 9 aa, Homo Sapiens
AIFKNLTTT

SEQ ID NO: 1376813 - protein, 9 aa, Homo Sapiens
LRLQGYHRE

SEQ ID NO: 1376814 - protein, 9 aa, Homo Sapiens
AVTGNLQPQ

SEQ ID NO: 1376815 - protein, 9 aa, Homo Sapiens
PPHEHQEAE

SEQ ID NO: 1376816 - protein, 9 aa, Homo Sapiens
TEKKYSPCG

SEQ ID NO: 1376817 - protein, 9 aa, Homo Sapiens
AAVEKIPLS

SEQ ID NO: 1376818 - protein, 9 aa, Homo Sapiens
HNRPQLCFL

SEQ ID NO: 1376819 - protein, 9 aa, Homo Sapiens
DDMMMTTTT

SEQ ID NO: 1376820 - protein, 9 aa, Homo Sapiens
LGFPCPTEG

SEQ ID NO: 1376821 - protein, 9 aa, Homo Sapiens
EPKGSWSGK

SEQ ID NO: 1376822 - protein, 9 aa, Homo Sapiens
IVSEFGMET

SEQ ID NO: 1376823 - protein, 9 aa, Homo Sapiens
NYAVLLPLL

SEQ ID NO: 1376824 - protein, 9 aa, Homo Sapiens
IVTPKINQT

SEQ ID NO: 1376825 - protein, 9 aa, Homo Sapiens
ITTPQEQFT

SEQ ID NO: 1376826 - protein, 9 aa, Homo Sapiens
VVQVNPVRR

SEQ ID NO: 1376827 - protein, 9 aa, Homo Sapiens
NMIGKDDSM

SEQ ID NO: 1376828 - protein, 9 aa, Homo Sapiens
ESTRTTVRS

SEQ ID NO: 1376829 - protein, 9 aa, Homo Sapiens
AHVDFCTLL

SEQ ID NO: 1376830 - protein, 9 aa, Homo Sapiens
SSPISASSA

SEQ ID NO: 1376831 - protein, 9 aa, Homo Sapiens
AKIVKPSPS

SEQ ID NO: 1376832 - protein, 9 aa, Homo Sapiens
PRSETGIHI

SEQ ID NO: 1376833 - protein, 9 aa, Homo Sapiens
LEMRDTQRA

SEQ ID NO: 1376834 - protein, 9 aa, Homo Sapiens
EAIVEKVAC

SEQ ID NO: 1376835 - protein, 9 aa, Homo Sapiens
KLWTEVNAF

SEQ ID NO: 1376836 - protein, 9 aa, Homo Sapiens
VPNTSSRKN

SEQ ID NO: 1376837 - protein, 9 aa, Homo Sapiens
TRSVWKRSP

SEQ ID NO: 1376838 - protein, 9 aa, Homo Sapiens
GQCISVKFK

SEQ ID NO: 1376839 - protein, 9 aa, Homo Sapiens
LKRVDVEES

SEQ ID NO: 1376840 - protein, 9 aa, Homo Sapiens
ILGRYYKTG

SEQ ID NO: 1376841 - protein, 9 aa, Homo Sapiens
RGYIQMTPV

SEQ ID NO: 1376842 - protein, 9 aa, Homo Sapiens
KLKRVDVEE

SEQ ID NO: 1376843 - protein, 9 aa, Homo Sapiens
KTQQEASRI

SEQ ID NO: 1376844 - protein, 9 aa, Homo Sapiens
KFLHGALGR

SEQ ID NO: 1376845 - protein, 9 aa, Homo Sapiens
ELFDIMDSR

SEQ ID NO: 1376846 - protein, 9 aa, Homo Sapiens
NNKRWYFTG

SEQ ID NO: 1376847 - protein, 9 aa, Homo Sapiens
ASRICVHCH

SEQ ID NO: 1376848 - protein, 9 aa, Homo Sapiens
SGTRHTETS

SEQ ID NO: 1376849 - protein, 9 aa, Homo Sapiens
RCISEQWKC

SEQ ID NO: 1376850 - protein, 9 aa, Homo Sapiens
TIWIAPSLH

SEQ ID NO: 1376851 - protein, 9 aa, Homo Sapiens
RCGKVYGKT

SEQ ID NO: 1376852 - protein, 9 aa, Homo Sapiens
LLSHPDLLH

SEQ ID NO: 1376853 - protein, 9 aa, Homo Sapiens
REFVAIFKN

SEQ ID NO: 1376854 - protein, 9 aa, Homo Sapiens
AETLTFLHA

SEQ ID NO: 1376855 - protein, 9 aa, Homo Sapiens
KMMQRSMSH

SEQ ID NO: 1376856 - protein, 9 aa, Homo Sapiens
PWILSSVSH

SEQ ID NO: 1376857 - protein, 9 aa, Homo Sapiens
TDSESQSDV

SEQ ID NO: 1376858 - protein, 9 aa, Homo Sapiens
DEEMLQTAD

SEQ ID NO: 1376859 - protein, 9 aa, Homo Sapiens
KTISDPEDF

SEQ ID NO: 1376860 - protein, 9 aa, Homo Sapiens
PNYLNQEIK

SEQ ID NO: 1376861 - protein, 9 aa, Homo Sapiens
ETSSSASNQ

SEQ ID NO: 1376862 - protein, 9 aa, Homo Sapiens
TRKNAEVSL

SEQ ID NO: 1376863 - protein, 9 aa, Homo Sapiens
TISDPEDFL

SEQ ID NO: 1376864 - protein, 9 aa, Homo Sapiens
IEITDEDDD

SEQ ID NO: 1376865 - protein, 9 aa, Homo Sapiens
VSQAEWVGA

SEQ ID NO: 1376866 - protein, 9 aa, Homo Sapiens
LPLSGVEDK

SEQ ID NO: 1376867 - protein, 9 aa, Homo Sapiens
LARCGNLSC

SEQ ID NO: 1376868 - protein, 9 aa, Homo Sapiens
ENPAKAQSA

SEQ ID NO: 1376869 - protein, 9 aa, Homo Sapiens
ILQDGKLHL

SEQ ID NO: 1376870 - protein, 9 aa, Homo Sapiens
RPDFISLSG

SEQ ID NO: 1376871 - protein, 9 aa, Homo Sapiens
IKDTGLCTE

SEQ ID NO: 1376872 - protein, 9 aa, Homo Sapiens
ESIGAIVVQ

SEQ ID NO: 1376873 - protein, 9 aa, Homo Sapiens
DSMLDSSDS

SEQ ID NO: 1376874 - protein, 9 aa, Homo Sapiens
RTLPRRCRS

SEQ ID NO: 1376875 - protein, 9 aa, Homo Sapiens
HPAAASIYT

SEQ ID NO: 1376876 - protein, 9 aa, Homo Sapiens
NSPARELRL

SEQ ID NO: 1376877 - protein, 9 aa, Homo Sapiens
LQHFAEAFK

SEQ ID NO: 1376878 - protein, 9 aa, Homo Sapiens
SFLGFSKQC

SEQ ID NO: 1376879 - protein, 9 aa, Homo Sapiens
NTIMGNNKV

SEQ ID NO: 1376880 - protein, 9 aa, Homo Sapiens
ICIPNYLNQ

SEQ ID NO: 1376881 - protein, 9 aa, Homo Sapiens
YSPCGWEVV

SEQ ID NO: 1376882 - protein, 9 aa, Homo Sapiens
CISVKFKSD

SEQ ID NO: 1376883 - protein, 9 aa, Homo Sapiens
EWVTDSESQ

SEQ ID NO: 1376884 - protein, 9 aa, Homo Sapiens
IRNLKKSKH

SEQ ID NO: 1376885 - protein, 9 aa, Homo Sapiens
EGTLPEKQS

SEQ ID NO: 1376886 - protein, 9 aa, Homo Sapiens
TVYNVMDKN

SEQ ID NO: 1376887 - protein, 9 aa, Homo Sapiens
LLTSETFYT

SEQ ID NO: 1376888 - protein, 9 aa, Homo Sapiens
PDEEIRLKA

SEQ ID NO: 1376889 - protein, 9 aa, Homo Sapiens
PLHWQDAME

SEQ ID NO: 1376890 - protein, 9 aa, Homo Sapiens
RDTQRASKE

SEQ ID NO: 1376891 - protein, 9 aa, Homo Sapiens
DFCTLLHYH

SEQ ID NO: 1376892 - protein, 9 aa, Homo Sapiens
SIDGFDGYF

SEQ ID NO: 1376893 - protein, 9 aa, Homo Sapiens
KLIAPKAND

SEQ ID NO: 1376894 - protein, 9 aa, Homo Sapiens
IWLIGQCIS

SEQ ID NO: 1376895 - protein, 9 aa, Homo Sapiens
QRKSRKPQN

SEQ ID NO: 1376896 - protein, 9 aa, Homo Sapiens
LAVKLGSVV

SEQ ID NO: 1376897 - protein, 9 aa, Homo Sapiens
DTLTLEVRL

SEQ ID NO: 1376898 - protein, 9 aa, Homo Sapiens
GYMPYCHPS

SEQ ID NO: 1376899 - protein, 9 aa, Homo Sapiens
NLSCRSDLQ

SEQ ID NO: 1376900 - protein, 9 aa, Homo Sapiens
FLWMKHSNL

SEQ ID NO: 1376901 - protein, 9 aa, Homo Sapiens
PVNKTKTAL

SEQ ID NO: 1376902 - protein, 9 aa, Homo Sapiens
MGKGVTTVT

SEQ ID NO: 1376903 - protein, 9 aa, Homo Sapiens
AVNCKAEAT

SEQ ID NO: 1376904 - protein, 9 aa, Homo Sapiens
AFHAKQVQL

SEQ ID NO: 1376905 - protein, 9 aa, Homo Sapiens
CHCCYQLVQ

SEQ ID NO: 1376906 - protein, 9 aa, Homo Sapiens
YRQPDVCKH

SEQ ID NO: 1376907 - protein, 9 aa, Homo Sapiens
DITSHMESD

SEQ ID NO: 1376908 - protein, 9 aa, Homo Sapiens
KISRKDGTY

SEQ ID NO: 1376909 - protein, 9 aa, Homo Sapiens
FDNQFYSVE

SEQ ID NO: 1376910 - protein, 9 aa, Homo Sapiens
VAAVGCVQY

SEQ ID NO: 1376911 - protein, 9 aa, Homo Sapiens
DRLQVAMKV

SEQ ID NO: 1376912 - protein, 9 aa, Homo Sapiens
LVEAIVEKV

SEQ ID NO: 1376913 - protein, 9 aa, Homo Sapiens
KCGKAFRQR

SEQ ID NO: 1376914 - protein, 9 aa, Homo Sapiens
GGMPFTSAS

SEQ ID NO: 1376915 - protein, 9 aa, Homo Sapiens
HFSPQARSL

SEQ ID NO: 1376916 - protein, 9 aa, Homo Sapiens
NAFKEIQAL

SEQ ID NO: 1376917 - protein, 9 aa, Homo Sapiens
VGYFDYAFT

SEQ ID NO: 1376918 - protein, 9 aa, Homo Sapiens
ILKKTVYNV

SEQ ID NO: 1376919 - protein, 9 aa, Homo Sapiens
RICVHCHRN

SEQ ID NO: 1376920 - protein, 9 aa, Homo Sapiens
LGHVIHLSN

SEQ ID NO: 1376921 - protein, 9 aa, Homo Sapiens
IDGFDGYFR

SEQ ID NO: 1376922 - protein, 9 aa, Homo Sapiens
VVQRYVVLA

SEQ ID NO: 1376923 - protein, 9 aa, Homo Sapiens
CVAFGYQDC

SEQ ID NO: 1376924 - protein, 9 aa, Homo Sapiens
TPLQRVHYG

SEQ ID NO: 1376925 - protein, 9 aa, Homo Sapiens
RSLEQRIVK

SEQ ID NO: 1376926 - protein, 9 aa, Homo Sapiens
NVHTSVIPF

SEQ ID NO: 1376927 - protein, 9 aa, Homo Sapiens
TSESWVQKM

SEQ ID NO: 1376928 - protein, 9 aa, Homo Sapiens
VIWLIGQCI

SEQ ID NO: 1376929 - protein, 9 aa, Homo Sapiens
TTPQEQFTL

SEQ ID NO: 1376930 - protein, 9 aa, Homo Sapiens
MTPVNKTKT

SEQ ID NO: 1376931 - protein, 9 aa, Homo Sapiens
FTGQHFPFF

SEQ ID NO: 1376932 - protein, 9 aa, Homo Sapiens
FYIAAEEVK

SEQ ID NO: 1376933 - protein, 9 aa, Homo Sapiens
GGVTSTSES

SEQ ID NO: 1376934 - protein, 9 aa, Homo Sapiens
SGTVQNIDY

SEQ ID NO: 1376935 - protein, 9 aa, Homo Sapiens
FIKDTGLCT

SEQ ID NO: 1376936 - protein, 9 aa, Homo Sapiens
FFPQKVSEL

SEQ ID NO: 1376937 - protein, 9 aa, Homo Sapiens
VEESSENTD

SEQ ID NO: 1376938 - protein, 9 aa, Homo Sapiens
KREFVAIFK

SEQ ID NO: 1376939 - protein, 9 aa, Homo Sapiens
VTGNLQPQR

SEQ ID NO: 1376940 - protein, 9 aa, Homo Sapiens
QGPPLDAYS

SEQ ID NO: 1376941 - protein, 9 aa, Homo Sapiens
NLRKQMETL

SEQ ID NO: 1376942 - protein, 9 aa, Homo Sapiens
PLDTGPMVV

SEQ ID NO: 1376943 - protein, 9 aa, Homo Sapiens
RLPIRDGNT

SEQ ID NO: 1376944 - protein, 9 aa, Homo Sapiens
SMHNIDHAQ

SEQ ID NO: 1376945 - protein, 9 aa, Homo Sapiens
MSVESKKLP

SEQ ID NO: 1376946 - protein, 9 aa, Homo Sapiens
LKFYTGFKI

SEQ ID NO: 1376947 - protein, 9 aa, Homo Sapiens
KWQMMFTDE

SEQ ID NO: 1376948 - protein, 9 aa, Homo Sapiens
AAGPRWAVP

SEQ ID NO: 1376949 - protein, 9 aa, Homo Sapiens
VQQLYPQPP

SEQ ID NO: 1376950 - protein, 9 aa, Homo Sapiens
ASEWGKYGM

SEQ ID NO: 1376951 - protein, 9 aa, Homo Sapiens
RGSRTAAGP

SEQ ID NO: 1376952 - protein, 9 aa, Homo Sapiens
DQGKLIKTV

SEQ ID NO: 1376953 - protein, 9 aa, Homo Sapiens
LPRRCRSWE

SEQ ID NO: 1376954 - protein, 9 aa, Homo Sapiens
TLRGSRTAA

SEQ ID NO: 1376955 - protein, 9 aa, Homo Sapiens
TTMMVITTM

SEQ ID NO: 1376956 - protein, 9 aa, Homo Sapiens
KVPAPSPKS

SEQ ID NO: 1376957 - protein, 9 aa, Homo Sapiens
SLPVNVGQL

SEQ ID NO: 1376958 - protein, 9 aa, Homo Sapiens
LGTVLPPGE

SEQ ID NO: 1376959 - protein, 9 aa, Homo Sapiens
ALPYQVVQV

SEQ ID NO: 1376960 - protein, 9 aa, Homo Sapiens
LDVEFLEEQ

SEQ ID NO: 1376961 - protein, 9 aa, Homo Sapiens
FTIWIAPSL

SEQ ID NO: 1376962 - protein, 9 aa, Homo Sapiens
SRSCGEGLR

SEQ ID NO: 1376963 - protein, 9 aa, Homo Sapiens
QMGEPKGSW

SEQ ID NO: 1376964 - protein, 9 aa, Homo Sapiens
IDQLLQQFA

SEQ ID NO: 1376965 - protein, 9 aa, Homo Sapiens
VEAIVEKVA

SEQ ID NO: 1376966 - protein, 9 aa, Homo Sapiens
EEYFEIVTP

SEQ ID NO: 1376967 - protein, 9 aa, Homo Sapiens
EKYLTLQGF

SEQ ID NO: 1376968 - protein, 9 aa, Homo Sapiens
RGKLKRVDV

SEQ ID NO: 1376969 - protein, 9 aa, Homo Sapiens
PVPGSTAPP

SEQ ID NO: 1376970 - protein, 9 aa, Homo Sapiens
CRKAHTGKM

SEQ ID NO: 1376971 - protein, 9 aa, Homo Sapiens
DTQRASKEK

SEQ ID NO: 1376972 - protein, 9 aa, Homo Sapiens
WLIGQCISV

SEQ ID NO: 1376973 - protein, 9 aa, Homo Sapiens
GQNCLDVDE

SEQ ID NO: 1376974 - protein, 9 aa, Homo Sapiens
NQSSFWQRS

SEQ ID NO: 1376975 - protein, 9 aa, Homo Sapiens
DYKTLINAQ

SEQ ID NO: 1376976 - protein, 9 aa, Homo Sapiens
DLQGPPLDA

SEQ ID NO: 1376977 - protein, 9 aa, Homo Sapiens
HQVIIGDQN

SEQ ID NO: 1376978 - protein, 9 aa, Homo Sapiens
AGFPGAPGP

SEQ ID NO: 1376979 - protein, 9 aa, Homo Sapiens
LHLEKEYQA

SEQ ID NO: 1376980 - protein, 9 aa, Homo Sapiens
RRSQNRLQS

SEQ ID NO: 1376981 - protein, 9 aa, Homo Sapiens
NRLQSPSKQ

SEQ ID NO: 1376982 - protein, 9 aa, Homo Sapiens
SRGSHGMDA

SEQ ID NO: 1376983 - protein, 9 aa, Homo Sapiens
SLSGERIKR

SEQ ID NO: 1376984 - protein, 9 aa, Homo Sapiens
CWLSLLSSW

SEQ ID NO: 1376985 - protein, 9 aa, Homo Sapiens
GEHQDYEED

SEQ ID NO: 1376986 - protein, 9 aa, Homo Sapiens
ASRRSQNRL

SEQ ID NO: 1376987 - protein, 9 aa, Homo Sapiens
NQPYQRETP

SEQ ID NO: 1376988 - protein, 9 aa, Homo Sapiens
HLDKASKVS

SEQ ID NO: 1376989 - protein, 9 aa, Homo Sapiens
SHIMREDDI

SEQ ID NO: 1376990 - protein, 9 aa, Homo Sapiens
PDLLHLGAL

SEQ ID NO: 1376991 - protein, 9 aa, Homo Sapiens
EFVAIFKNL

SEQ ID NO: 1376992 - protein, 9 aa, Homo Sapiens
FPEVILLPN

SEQ ID NO: 1376993 - protein, 9 aa, Homo Sapiens
LGMDLATLK

SEQ ID NO: 1376994 - protein, 9 aa, Homo Sapiens
IDGKTINVK

SEQ ID NO: 1376995 - protein, 9 aa, Homo Sapiens
LIFLVCHLF

SEQ ID NO: 1376996 - protein, 9 aa, Homo Sapiens
IYFVPDRSD

SEQ ID NO: 1376997 - protein, 9 aa, Homo Sapiens
QTKDQFLSP

SEQ ID NO: 1376998 - protein, 9 aa, Homo Sapiens
PVGIGESLP

SEQ ID NO: 1376999 - protein, 9 aa, Homo Sapiens
SVVDDWIEL

SEQ ID NO: 1377000 - protein, 9 aa, Homo Sapiens
LQDLKLFEK

SEQ ID NO: 1377001 - protein, 9 aa, Homo Sapiens
DQLLQQFAS

SEQ ID NO: 1377002 - protein, 9 aa, Homo Sapiens
PGPNGDSSP

SEQ ID NO: 1377003 - protein, 9 aa, Homo Sapiens
ICPHFAEDI

SEQ ID NO: 1377004 - protein, 9 aa, Homo Sapiens
LFDIMDSRC

SEQ ID NO: 1377005 - protein, 9 aa, Homo Sapiens
HAKQVQLFM

SEQ ID NO: 1377006 - protein, 9 aa, Homo Sapiens
TSTPNKIEL

SEQ ID NO: 1377007 - protein, 9 aa, Homo Sapiens
KEPQIAPPE

SEQ ID NO: 1377008 - protein, 9 aa, Homo Sapiens
IWIAPSLHR

SEQ ID NO: 1377009 - protein, 9 aa, Homo Sapiens
KSKFDNQFY

SEQ ID NO: 1377010 - protein, 9 aa, Homo Sapiens
APSPKSSGP

SEQ ID NO: 1377011 - protein, 9 aa, Homo Sapiens
GPPRSETGI

SEQ ID NO: 1377012 - protein, 9 aa, Homo Sapiens
PQKVSELHR

SEQ ID NO: 1377013 - protein, 9 aa, Homo Sapiens
AEWVGAGAT

SEQ ID NO: 1377014 - protein, 9 aa, Homo Sapiens
KLQLLFLNN

SEQ ID NO: 1377015 - protein, 9 aa, Homo Sapiens
RGEVSRSLE

SEQ ID NO: 1377016 - protein, 9 aa, Homo Sapiens
LGAVVQVKI

SEQ ID NO: 1377017 - protein, 9 aa, Homo Sapiens
SENTDVNNL

SEQ ID NO: 1377018 - protein, 9 aa, Homo Sapiens
VYGCRKAHT

SEQ ID NO: 1377019 - protein, 9 aa, Homo Sapiens
HATHDLQGP

SEQ ID NO: 1377020 - protein, 9 aa, Homo Sapiens
LELLEAKAK

SEQ ID NO: 1377021 - protein, 9 aa, Homo Sapiens
HALPYQVVQ

SEQ ID NO: 1377022 - protein, 9 aa, Homo Sapiens
EVNAFKEIQ

SEQ ID NO: 1377023 - protein, 9 aa, Homo Sapiens
SVQTDTLTL

SEQ ID NO: 1377024 - protein, 9 aa, Homo Sapiens
EEMLQTADG

SEQ ID NO: 1377025 - protein, 9 aa, Homo Sapiens
SLLSIDSML

SEQ ID NO: 1377026 - protein, 9 aa, Homo Sapiens
ATEPLDLHN

SEQ ID NO: 1377027 - protein, 9 aa, Homo Sapiens
VHIYGHVTL

SEQ ID NO: 1377028 - protein, 9 aa, Homo Sapiens
CMFRLTFCS

SEQ ID NO: 1377029 - protein, 9 aa, Homo Sapiens
KAEATPLTL

SEQ ID NO: 1377030 - protein, 9 aa, Homo Sapiens
MLDVEFLEE

SEQ ID NO: 1377031 - protein, 9 aa, Homo Sapiens
PISASSATQ

SEQ ID NO: 1377032 - protein, 9 aa, Homo Sapiens
QHSCSRGSH

SEQ ID NO: 1377033 - protein, 9 aa, Homo Sapiens
LPIHFQEKE

SEQ ID NO: 1377034 - protein, 9 aa, Homo Sapiens
RIKHEKTVH

SEQ ID NO: 1377035 - protein, 9 aa, Homo Sapiens
EYFEIVTPK

SEQ ID NO: 1377036 - protein, 9 aa, Homo Sapiens
KAQSAALEE

SEQ ID NO: 1377037 - protein, 9 aa, Homo Sapiens
AAASIYTNF

SEQ ID NO: 1377038 - protein, 9 aa, Homo Sapiens
EKAAKVFFE

SEQ ID NO: 1377039 - protein, 9 aa, Homo Sapiens
FGGMPFTSA

SEQ ID NO: 1377040 - protein, 9 aa, Homo Sapiens
IELYKHDRD

SEQ ID NO: 1377041 - protein, 9 aa, Homo Sapiens
EKTVHIYGH

SEQ ID NO: 1377042 - protein, 9 aa, Homo Sapiens
KKEGSEQMT

SEQ ID NO: 1377043 - protein, 9 aa, Homo Sapiens
EALASPGPN

SEQ ID NO: 1377044 - protein, 9 aa, Homo Sapiens
KTWSHIMRE

SEQ ID NO: 1377045 - protein, 9 aa, Homo Sapiens
KITAHNERK

SEQ ID NO: 1377046 - protein, 9 aa, Homo Sapiens
HLEKEYQAK

SEQ ID NO: 1377047 - protein, 9 aa, Homo Sapiens
EHCQKLQEQ

SEQ ID NO: 1377048 - protein, 9 aa, Homo Sapiens
GCVQYDGRR

SEQ ID NO: 1377049 - protein, 9 aa, Homo Sapiens
FVDDLEHLD

SEQ ID NO: 1377050 - protein, 9 aa, Homo Sapiens
RDPSQEREF

SEQ ID NO: 1377051 - protein, 9 aa, Homo Sapiens
PMKSRLRCT

SEQ ID NO: 1377052 - protein, 9 aa, Homo Sapiens
HEKDFFGRV

SEQ ID NO: 1377053 - protein, 9 aa, Homo Sapiens
GSTKSSASL

SEQ ID NO: 1377054 - protein, 9 aa, Homo Sapiens
HSCSRGSHG

SEQ ID NO: 1377055 - protein, 9 aa, Homo Sapiens
GAPKRRLPA

SEQ ID NO: 1377056 - protein, 9 aa, Homo Sapiens
RSVLFEQAV

SEQ ID NO: 1377057 - protein, 9 aa, Homo Sapiens
YKTGSIRPG

SEQ ID NO: 1377058 - protein, 9 aa, Homo Sapiens
PQATLPFPL

SEQ ID NO: 1377059 - protein, 9 aa, Homo Sapiens
TDSLHDQGH

SEQ ID NO: 1377060 - protein, 9 aa, Homo Sapiens
LTLLQDLKL

SEQ ID NO: 1377061 - protein, 9 aa, Homo Sapiens
RTWIGNRKR

SEQ ID NO: 1377062 - protein, 9 aa, Homo Sapiens
YIMQRKQME

SEQ ID NO: 1377063 - protein, 9 aa, Homo Sapiens
KPQNQQFPD

SEQ ID NO: 1377064 - protein, 9 aa, Homo Sapiens
LQSPSRLPG

SEQ ID NO: 1377065 - protein, 9 aa, Homo Sapiens
MSMHNIDHA

SEQ ID NO: 1377066 - protein, 9 aa, Homo Sapiens
LAVNCKAEA

SEQ ID NO: 1377067 - protein, 9 aa, Homo Sapiens
SQFGTLLGN

SEQ ID NO: 1377068 - protein, 9 aa, Homo Sapiens
KTMTYTPGT

SEQ ID NO: 1377069 - protein, 9 aa, Homo Sapiens
YFFLGILLT

SEQ ID NO: 1377070 - protein, 9 aa, Homo Sapiens
VCKHLCMIN

SEQ ID NO: 1377071 - protein, 9 aa, Homo Sapiens
VTPKINQTF

SEQ ID NO: 1377072 - protein, 9 aa, Homo Sapiens
TWIGNRKRK

SEQ ID NO: 1377073 - protein, 9 aa, Homo Sapiens
YASQFGTLL

SEQ ID NO: 1377074 - protein, 9 aa, Homo Sapiens
RKRKNSKTS

SEQ ID NO: 1377075 - protein, 9 aa, Homo Sapiens
DYSLLMSMH

SEQ ID NO: 1377076 - protein, 9 aa, Homo Sapiens
LFEQAVRIL

SEQ ID NO: 1377077 - protein, 9 aa, Homo Sapiens
NYSNVHTSV

SEQ ID NO: 1377078 - protein, 9 aa, Homo Sapiens
RVIWLIGQC

SEQ ID NO: 1377079 - protein, 9 aa, Homo Sapiens
PAHHPGCQL

SEQ ID NO: 1377080 - protein, 9 aa, Homo Sapiens
VQVKIRVND

SEQ ID NO: 1377081 - protein, 9 aa, Homo Sapiens
CPVGIGESL

SEQ ID NO: 1377082 - protein, 9 aa, Homo Sapiens
PYACPKCGK

SEQ ID NO: 1377083 - protein, 9 aa, Homo Sapiens
SELHRATES

SEQ ID NO: 1377084 - protein, 9 aa, Homo Sapiens
LRKQMETLS

SEQ ID NO: 1377085 - protein, 9 aa, Homo Sapiens
GVLAKIVKP

SEQ ID NO: 1377086 - protein, 9 aa, Homo Sapiens
DGTYLDDSW

SEQ ID NO: 1377087 - protein, 9 aa, Homo Sapiens
EDDLMLDVE

SEQ ID NO: 1377088 - protein, 9 aa, Homo Sapiens
NSKTSNYLI

SEQ ID NO: 1377089 - protein, 9 aa, Homo Sapiens
EGNIMPLHW

SEQ ID NO: 1377090 - protein, 9 aa, Homo Sapiens
PRKVPAPSP

SEQ ID NO: 1377091 - protein, 9 aa, Homo Sapiens
IVKLSEANK

SEQ ID NO: 1377092 - protein, 9 aa, Homo Sapiens
PSQEREFIA

SEQ ID NO: 1377093 - protein, 9 aa, Homo Sapiens
VILPPWPQV

SEQ ID NO: 1377094 - protein, 9 aa, Homo Sapiens
RVQDALCGE

SEQ ID NO: 1377095 - protein, 9 aa, Homo Sapiens
RTTVRSGLD

SEQ ID NO: 1377096 - protein, 9 aa, Homo Sapiens
VILLGPLIF

SEQ ID NO: 1377097 - protein, 9 aa, Homo Sapiens
HAGATYREV

SEQ ID NO: 1377098 - protein, 9 aa, Homo Sapiens
NRGTSPVTQ

SEQ ID NO: 1377099 - protein, 9 aa, Homo Sapiens
FQSYIRTCY

SEQ ID NO: 1377100 - protein, 9 aa, Homo Sapiens
TRTLPTPHC

SEQ ID NO: 1377101 - protein, 9 aa, Homo Sapiens
PFTSASFSG

SEQ ID NO: 1377102 - protein, 9 aa, Homo Sapiens
ASPPAGRPN

SEQ ID NO: 1377103 - protein, 9 aa, Homo Sapiens
IENPAKAQS

SEQ ID NO: 1377104 - protein, 9 aa, Homo Sapiens
IIEITDEDD

SEQ ID NO: 1377105 - protein, 9 aa, Homo Sapiens
LFDDFEWVH

SEQ ID NO: 1377106 - protein, 9 aa, Homo Sapiens
NGSKQELQD

SEQ ID NO: 1377107 - protein, 9 aa, Homo Sapiens
QLKAPLPAG

SEQ ID NO: 1377108 - protein, 9 aa, Homo Sapiens
TINVKFAKG

SEQ ID NO: 1377109 - protein, 9 aa, Homo Sapiens
WVGAGATTV

SEQ ID NO: 1377110 - protein, 9 aa, Homo Sapiens
DVPEGTLPE

SEQ ID NO: 1377111 - protein, 9 aa, Homo Sapiens
HWQDAMESS

SEQ ID NO: 1377112 - protein, 9 aa, Homo Sapiens
SEQMTELAD

SEQ ID NO: 1377113 - protein, 9 aa, Homo Sapiens
SCMGGMNRS

SEQ ID NO: 1377114 - protein, 9 aa, Homo Sapiens
VVNSVLFRV

SEQ ID NO: 1377115 - protein, 9 aa, Homo Sapiens
SMKFLHGAL

SEQ ID NO: 1377116 - protein, 9 aa, Homo Sapiens
RPNPAPRKA

SEQ ID NO: 1377117 - protein, 9 aa, Homo Sapiens
PVTSTPNKI

SEQ ID NO: 1377118 - protein, 9 aa, Homo Sapiens
GEGLRSRTR

SEQ ID NO: 1377119 - protein, 9 aa, Homo Sapiens
SPISASSAT

SEQ ID NO: 1377120 - protein, 9 aa, Homo Sapiens
SRPGPMHTI

SEQ ID NO: 1377121 - protein, 9 aa, Homo Sapiens
KLKQMRKSP

SEQ ID NO: 1377122 - protein, 9 aa, Homo Sapiens
KKLPIHFQE

SEQ ID NO: 1377123 - protein, 9 aa, Homo Sapiens
PPGLLLGTV

SEQ ID NO: 1377124 - protein, 9 aa, Homo Sapiens
LRRWHKSGL

SEQ ID NO: 1377125 - protein, 9 aa, Homo Sapiens
DSRSEGINL

SEQ ID NO: 1377126 - protein, 9 aa, Homo Sapiens
SHCSRSCGE

SEQ ID NO: 1377127 - protein, 9 aa, Homo Sapiens
IIVFLSCVI

SEQ ID NO: 1377128 - protein, 9 aa, Homo Sapiens
ISEQWKCDN

SEQ ID NO: 1377129 - protein, 9 aa, Homo Sapiens
DPEQVVQRY

SEQ ID NO: 1377130 - protein, 9 aa, Homo Sapiens
PPAIQSLTN

SEQ ID NO: 1377131 - protein, 9 aa, Homo Sapiens
WIGNRKRKY

SEQ ID NO: 1377132 - protein, 9 aa, Homo Sapiens
TIQAVERKI

SEQ ID NO: 1377133 - protein, 9 aa, Homo Sapiens
TSGIKKAVW

SEQ ID NO: 1377134 - protein, 9 aa, Homo Sapiens
RPTEIIEIT

SEQ ID NO: 1377135 - protein, 9 aa, Homo Sapiens
DHSEEHDDG

SEQ ID NO: 1377136 - protein, 9 aa, Homo Sapiens
DDLEHLDKA

SEQ ID NO: 1377137 - protein, 9 aa, Homo Sapiens
AQSVRNTCG

SEQ ID NO: 1377138 - protein, 9 aa, Homo Sapiens
RSLQHFAEA

SEQ ID NO: 1377139 - protein, 9 aa, Homo Sapiens
EESSENTDV

SEQ ID NO: 1377140 - protein, 9 aa, Homo Sapiens
QIVAPSVHS

SEQ ID NO: 1377141 - protein, 9 aa, Homo Sapiens
KNTLTDFPQ

SEQ ID NO: 1377142 - protein, 9 aa, Homo Sapiens
VHFLWMKHS

SEQ ID NO: 1377143 - protein, 9 aa, Homo Sapiens
GTVLPPGEG

SEQ ID NO: 1377144 - protein, 9 aa, Homo Sapiens
FMHKNTLTD

SEQ ID NO: 1377145 - protein, 9 aa, Homo Sapiens
IQSLTNLLA

SEQ ID NO: 1377146 - protein, 9 aa, Homo Sapiens
FTGEQLENS

SEQ ID NO: 1377147 - protein, 9 aa, Homo Sapiens
GLLLGTVLP

SEQ ID NO: 1377148 - protein, 9 aa, Homo Sapiens
HRATESHRC

SEQ ID NO: 1377149 - protein, 9 aa, Homo Sapiens
PHATHDLQG

SEQ ID NO: 1377150 - protein, 9 aa, Homo Sapiens
TTVRSGLDL

SEQ ID NO: 1377151 - protein, 9 aa, Homo Sapiens
LGGTYWALL

SEQ ID NO: 1377152 - protein, 9 aa, Homo Sapiens
ELGHVIHLS

SEQ ID NO: 1377153 - protein, 9 aa, Homo Sapiens
RELRLPIRD

SEQ ID NO: 1377154 - protein, 9 aa, Homo Sapiens
TIMGNNKVS

SEQ ID NO: 1377155 - protein, 9 aa, Homo Sapiens
IHNRPQLCF

SEQ ID NO: 1377156 - protein, 9 aa, Homo Sapiens
PEEYSEHFS

SEQ ID NO: 1377157 - protein, 9 aa, Homo Sapiens
ILPPWPQVG

SEQ ID NO: 1377158 - protein, 9 aa, Homo Sapiens
VPNGSKQEL

SEQ ID NO: 1377159 - protein, 9 aa, Homo Sapiens
EAMSKSLAS

SEQ ID NO: 1377160 - protein, 9 aa, Homo Sapiens
TVIQTKSGS

SEQ ID NO: 1377161 - protein, 9 aa, Homo Sapiens
PQHANLFIN

SEQ ID NO: 1377162 - protein, 9 aa, Homo Sapiens
QSDVGSSSD

SEQ ID NO: 1377163 - protein, 9 aa, Homo Sapiens
QMETYLKKI

SEQ ID NO: 1377164 - protein, 9 aa, Homo Sapiens
YLTLQGFHK

SEQ ID NO: 1377165 - protein, 9 aa, Homo Sapiens
LSLNEELQK

SEQ ID NO: 1377166 - protein, 9 aa, Homo Sapiens
KNSKTSNYL

SEQ ID NO: 1377167 - protein, 9 aa, Homo Sapiens
LIVAFHAKQ

SEQ ID NO: 1377168 - protein, 9 aa, Homo Sapiens
LDLALLRSL

SEQ ID NO: 1377169 - protein, 9 aa, Homo Sapiens
QRIVKLSEA

SEQ ID NO: 1377170 - protein, 9 aa, Homo Sapiens
VHTSVIPFQ

SEQ ID NO: 1377171 - protein, 9 aa, Homo Sapiens
QPGALGCTP

SEQ ID NO: 1377172 - protein, 9 aa, Homo Sapiens
SHYSSGMPH

SEQ ID NO: 1377173 - protein, 9 aa, Homo Sapiens
IGQCISVKF

SEQ ID NO: 1377174 - protein, 9 aa, Homo Sapiens
CVEFIKDTG

SEQ ID NO: 1377175 - protein, 9 aa, Homo Sapiens
YHSDDDDDM

SEQ ID NO: 1377176 - protein, 9 aa, Homo Sapiens
PDTRPVPGS

SEQ ID NO: 1377177 - protein, 9 aa, Homo Sapiens
MMMTTTTTT

SEQ ID NO: 1377178 - protein, 9 aa, Homo Sapiens
TAHTGCMFR

SEQ ID NO: 1377179 - protein, 9 aa, Homo Sapiens
ATIQAVERK

SEQ ID NO: 1377180 - protein, 9 aa, Homo Sapiens
TAASKETLF

SEQ ID NO: 1377181 - protein, 9 aa, Homo Sapiens
AESLTNSHK

SEQ ID NO: 1377182 - protein, 9 aa, Homo Sapiens
ISASSATQI

SEQ ID NO: 1377183 - protein, 9 aa, Homo Sapiens
IYRRQGSST

SEQ ID NO: 1377184 - protein, 9 aa, Homo Sapiens
LPIIQSNEV

SEQ ID NO: 1377185 - protein, 9 aa, Homo Sapiens
APLPAGQKE

SEQ ID NO: 1377186 - protein, 9 aa, Homo Sapiens
PYQVVQVNP

SEQ ID NO: 1377187 - protein, 9 aa, Homo Sapiens
TMGKGVTTV

SEQ ID NO: 1377188 - protein, 9 aa, Homo Sapiens
KGGHLCLSM

SEQ ID NO: 1377189 - protein, 9 aa, Homo Sapiens
RWYFTGEQL

SEQ ID NO: 1377190 - protein, 9 aa, Homo Sapiens
TLPTPHCFK

SEQ ID NO: 1377191 - protein, 9 aa, Homo Sapiens
WRVHTGQKP

SEQ ID NO: 1377192 - protein, 9 aa, Homo Sapiens
AAQRNPALA

SEQ ID NO: 1377193 - protein, 9 aa, Homo Sapiens
PSESLLSID

SEQ ID NO: 1377194 - protein, 9 aa, Homo Sapiens
MLSLNEELQ

SEQ ID NO: 1377195 - protein, 9 aa, Homo Sapiens
TGDMDILRS

SEQ ID NO: 1377196 - protein, 9 aa, Homo Sapiens
QVLPIIVFL

SEQ ID NO: 1377197 - protein, 9 aa, Homo Sapiens
EQVVQRYVV

SEQ ID NO: 1377198 - protein, 9 aa, Homo Sapiens
SPQVAGILA

SEQ ID NO: 1377199 - protein, 9 aa, Homo Sapiens
HTRPGLLPP

SEQ ID NO: 1377200 - protein, 9 aa, Homo Sapiens
SRLLGPEFG

SEQ ID NO: 1377201 - protein, 9 aa, Homo Sapiens
LLGFSKGGH

SEQ ID NO: 1377202 - protein, 9 aa, Homo Sapiens
FLYRGEVSR

SEQ ID NO: 1377203 - protein, 9 aa, Homo Sapiens
VCMMCLRAI

SEQ ID NO: 1377204 - protein, 9 aa, Homo Sapiens
QMTELADVF

SEQ ID NO: 1377205 - protein, 9 aa, Homo Sapiens
YVVLAQLWA

SEQ ID NO: 1377206 - protein, 9 aa, Homo Sapiens
VHVCMMCLR

SEQ ID NO: 1377207 - protein, 9 aa, Homo Sapiens
ACNPLDTGP

SEQ ID NO: 1377208 - protein, 9 aa, Homo Sapiens
YISNLRKQM

SEQ ID NO: 1377209 - protein, 9 aa, Homo Sapiens
FPVTSTPNK

SEQ ID NO: 1377210 - protein, 9 aa, Homo Sapiens
EIVTPKINQ

SEQ ID NO: 1377211 - protein, 9 aa, Homo Sapiens
VTAGPRLWN

SEQ ID NO: 1377212 - protein, 9 aa, Homo Sapiens
TGFKINDQT

SEQ ID NO: 1377213 - protein, 9 aa, Homo Sapiens
RKRVPPTLN

SEQ ID NO: 1377214 - protein, 9 aa, Homo Sapiens
RKVPAPSPK

SEQ ID NO: 1377215 - protein, 9 aa, Homo Sapiens
QSSFWQRSA

SEQ ID NO: 1377216 - protein, 9 aa, Homo Sapiens
GPAGHPGPL

SEQ ID NO: 1377217 - protein, 9 aa, Homo Sapiens
RRWHKSGLL

SEQ ID NO: 1377218 - protein, 9 aa, Homo Sapiens
VVQVKIRVN

SEQ ID NO: 1377219 - protein, 9 aa, Homo Sapiens
HAAGRVQDA

SEQ ID NO: 1377220 - protein, 9 aa, Homo Sapiens
VEFLEEQSL

SEQ ID NO: 1377221 - protein, 9 aa, Homo Sapiens
FGTLLGNNE

SEQ ID NO: 1377222 - protein, 9 aa, Homo Sapiens
VKWDYAPNK

SEQ ID NO: 1377223 - protein, 9 aa, Homo Sapiens
VQEIYNFTG

SEQ ID NO: 1377224 - protein, 9 aa, Homo Sapiens
VIENPAKAQ

SEQ ID NO: 1377225 - protein, 9 aa, Homo Sapiens
LLVRPRPGI

SEQ ID NO: 1377226 - protein, 9 aa, Homo Sapiens
IQAVERKIE

SEQ ID NO: 1377227 - protein, 9 aa, Homo Sapiens
EEAKEGPGL

SEQ ID NO: 1377228 - protein, 9 aa, Homo Sapiens
SVRNTCGSE

SEQ ID NO: 1377229 - protein, 9 aa, Homo Sapiens
NPYVKIYFV

SEQ ID NO: 1377230 - protein, 9 aa, Homo Sapiens
WYFTGEQLE

SEQ ID NO: 1377231 - protein, 9 aa, Homo Sapiens
HVCMMCLRA

SEQ ID NO: 1377232 - protein, 9 aa, Homo Sapiens
NRSPILTII

SEQ ID NO: 1377233 - protein, 9 aa, Homo Sapiens
LHYHQILAR

SEQ ID NO: 1377234 - protein, 9 aa, Homo Sapiens
CRKWQMMFT

SEQ ID NO: 1377235 - protein, 9 aa, Homo Sapiens
RPYACPKCG

SEQ ID NO: 1377236 - protein, 9 aa, Homo Sapiens
ESLTNSHKE

SEQ ID NO: 1377237 - protein, 9 aa, Homo Sapiens
PLIFLVCHL

SEQ ID NO: 1377238 - protein, 9 aa, Homo Sapiens
FHAKQVQLF

SEQ ID NO: 1377239 - protein, 9 aa, Homo Sapiens
EVGDVIAVS

SEQ ID NO: 1377240 - protein, 9 aa, Homo Sapiens
DEVQQHQKW

SEQ ID NO: 1377241 - protein, 9 aa, Homo Sapiens
SKFDNQFYS

SEQ ID NO: 1377242 - protein, 9 aa, Homo Sapiens
AIQSLTNLL

SEQ ID NO: 1377243 - protein, 9 aa, Homo Sapiens
RRRPKTMTY

SEQ ID NO: 1377244 - protein, 9 aa, Homo Sapiens
ILSSVSHTK

SEQ ID NO: 1377245 - protein, 9 aa, Homo Sapiens
KFAKGSKRD

SEQ ID NO: 1377246 - protein, 9 aa, Homo Sapiens
GKSYNMIGK

SEQ ID NO: 1377247 - protein, 9 aa, Homo Sapiens
NQNSKKLTA

SEQ ID NO: 1377248 - protein, 9 aa, Homo Sapiens
WSHIMREDD

SEQ ID NO: 1377249 - protein, 9 aa, Homo Sapiens
KITTPQEQF

SEQ ID NO: 1377250 - protein, 9 aa, Homo Sapiens
MGHKPDVEL

SEQ ID NO: 1377251 - protein, 9 aa, Homo Sapiens
KPRRNRAAQ

SEQ ID NO: 1377252 - protein, 9 aa, Homo Sapiens
PTLLDSRSE

SEQ ID NO: 1377253 - protein, 9 aa, Homo Sapiens
RTDLSYSES

SEQ ID NO: 1377254 - protein, 9 aa, Homo Sapiens
VKFAKGSKR

SEQ ID NO: 1377255 - protein, 9 aa, Homo Sapiens
KAPVLVRLA

SEQ ID NO: 1377256 - protein, 9 aa, Homo Sapiens
HRPDFISLS

SEQ ID NO: 1377257 - protein, 9 aa, Homo Sapiens
EHGMQFGGS

SEQ ID NO: 1377258 - protein, 9 aa, Homo Sapiens
PAGYMPYCH

SEQ ID NO: 1377259 - protein, 9 aa, Homo Sapiens
RPQLCFLAM

SEQ ID NO: 1377260 - protein, 9 aa, Homo Sapiens
CIPNYLNQE

SEQ ID NO: 1377261 - protein, 9 aa, Homo Sapiens
LTFDALIKL

SEQ ID NO: 1377262 - protein, 9 aa, Homo Sapiens
PPLHSIRNL

SEQ ID NO: 1377263 - protein, 9 aa, Homo Sapiens
LVSPISESM

SEQ ID NO: 1377264 - protein, 9 aa, Homo Sapiens
SISFGGMPF

SEQ ID NO: 1377265 - protein, 9 aa, Homo Sapiens
PPIVETRKN

SEQ ID NO: 1377266 - protein, 9 aa, Homo Sapiens
GNLSCRSDL

SEQ ID NO: 1377267 - protein, 9 aa, Homo Sapiens
DDDMMMTTT

SEQ ID NO: 1377268 - protein, 9 aa, Homo Sapiens
FNTPPACPQ

SEQ ID NO: 1377269 - protein, 9 aa, Homo Sapiens
SNGSTKSSA

SEQ ID NO: 1377270 - protein, 9 aa, Homo Sapiens
RLQVAMKVI

SEQ ID NO: 1377271 - protein, 9 aa, Homo Sapiens
EIQPYSLER

SEQ ID NO: 1377272 - protein, 9 aa, Homo Sapiens
QTAQLQGMN

SEQ ID NO: 1377273 - protein, 9 aa, Homo Sapiens
DEEIRLKAG

SEQ ID NO: 1377274 - protein, 9 aa, Homo Sapiens
KLPIHFQEK

SEQ ID NO: 1377275 - protein, 9 aa, Homo Sapiens
EEQHEKDFF

SEQ ID NO: 1377276 - protein, 9 aa, Homo Sapiens
PNPAPRKAS

SEQ ID NO: 1377277 - protein, 9 aa, Homo Sapiens
VRLRLGYCH

SEQ ID NO: 1377278 - protein, 9 aa, Homo Sapiens
HKSGLLHAE

SEQ ID NO: 1377279 - protein, 9 aa, Homo Sapiens
LQQTKDQFL

SEQ ID NO: 1377280 - protein, 9 aa, Homo Sapiens
QDNQNDHSE

SEQ ID NO: 1377281 - protein, 9 aa, Homo Sapiens
AAALFEGYS

SEQ ID NO: 1377282 - protein, 9 aa, Homo Sapiens
AVSDITSSG

SEQ ID NO: 1377283 - protein, 9 aa, Homo Sapiens
VAAEVPNGS

SEQ ID NO: 1377284 - protein, 9 aa, Homo Sapiens
YSEHFSPQA

SEQ ID NO: 1377285 - protein, 9 aa, Homo Sapiens
FKINDQTGN

SEQ ID NO: 1377286 - protein, 9 aa, Homo Sapiens
CTMLVAKVT

SEQ ID NO: 1377287 - protein, 9 aa, Homo Sapiens
MPHHGEASH

SEQ ID NO: 1377288 - protein, 9 aa, Homo Sapiens
GKLHLEKEY

SEQ ID NO: 1377289 - protein, 9 aa, Homo Sapiens
RAQMLIFTL

SEQ ID NO: 1377290 - protein, 9 aa, Homo Sapiens
RKRMTSPFT

SEQ ID NO: 1377291 - protein, 9 aa, Homo Sapiens
PHGYDQPAT

SEQ ID NO: 1377292 - protein, 9 aa, Homo Sapiens
PPWPQVGAT

SEQ ID NO: 1377293 - protein, 9 aa, Homo Sapiens
RPGPMHTIA

SEQ ID NO: 1377294 - protein, 9 aa, Homo Sapiens
ATYREVQKL

SEQ ID NO: 1377295 - protein, 9 aa, Homo Sapiens
PPSLQSPSR

SEQ ID NO: 1377296 - protein, 9 aa, Homo Sapiens
VTSTPNKIE

SEQ ID NO: 1377297 - protein, 9 aa, Homo Sapiens
SSFWQRSAD

SEQ ID NO: 1377298 - protein, 9 aa, Homo Sapiens
HTETSSGGQ

SEQ ID NO: 1377299 - protein, 9 aa, Homo Sapiens
FSTESNGFC

SEQ ID NO: 1377300 - protein, 9 aa, Homo Sapiens
ESSPGHPAA

SEQ ID NO: 1377301 - protein, 9 aa, Homo Sapiens
NREKAAKVF

SEQ ID NO: 1377302 - protein, 9 aa, Homo Sapiens
PHVFNTPPA

SEQ ID NO: 1377303 - protein, 9 aa, Homo Sapiens
RHWRVHTGQ

SEQ ID NO: 1377304 - protein, 9 aa, Homo Sapiens
EHFSPQARS

SEQ ID NO: 1377305 - protein, 9 aa, Homo Sapiens
MSKSKFDNQ

SEQ ID NO: 1377306 - protein, 9 aa, Homo Sapiens
APKRRLPAR

SEQ ID NO: 1377307 - protein, 9 aa, Homo Sapiens
VIAVSDITS

SEQ ID NO: 1377308 - protein, 9 aa, Homo Sapiens
TLTLEVRLR

SEQ ID NO: 1377309 - protein, 9 aa, Homo Sapiens
SLASEWGKY

SEQ ID NO: 1377310 - protein, 9 aa, Homo Sapiens
HQPPPAPPC

SEQ ID NO: 1377311 - protein, 9 aa, Homo Sapiens
PQNQQFPDT

SEQ ID NO: 1377312 - protein, 9 aa, Homo Sapiens
MLQTADGES

SEQ ID NO: 1377313 - protein, 9 aa, Homo Sapiens
VPAPSPKSS

SEQ ID NO: 1377314 - protein, 9 aa, Homo Sapiens
KLLARSVLF

SEQ ID NO: 1377315 - protein, 9 aa, Homo Sapiens
AALVSPISE

SEQ ID NO: 1377316 - protein, 9 aa, Homo Sapiens
QPPPAPPCL

SEQ ID NO: 1377317 - protein, 9 aa, Homo Sapiens
PCPTEGQIL

SEQ ID NO: 1377318 - protein, 9 aa, Homo Sapiens
QDGKLHLEK

SEQ ID NO: 1377319 - protein, 9 aa, Homo Sapiens
SPGPNGDSS

SEQ ID NO: 1377320 - protein, 9 aa, Homo Sapiens
HFFCKAPVL

SEQ ID NO: 1377321 - protein, 9 aa, Homo Sapiens
RQFDERYTC

SEQ ID NO: 1377322 - protein, 9 aa, Homo Sapiens
HLCLSMASF

SEQ ID NO: 1377323 - protein, 9 aa, Homo Sapiens
APPCLFTAD

SEQ ID NO: 1377324 - protein, 9 aa, Homo Sapiens
DLSDSSVTG

SEQ ID NO: 1377325 - protein, 9 aa, Homo Sapiens
SKNREKAAK

SEQ ID NO: 1377326 - protein, 9 aa, Homo Sapiens
NQTAQLQGM

SEQ ID NO: 1377327 - protein, 9 aa, Homo Sapiens
AEFQSYIRT

SEQ ID NO: 1377328 - protein, 9 aa, Homo Sapiens
IYHVTVVYE

SEQ ID NO: 1377329 - protein, 9 aa, Homo Sapiens
MQRKQMETY

SEQ ID NO: 1377330 - protein, 9 aa, Homo Sapiens
SHTRPGLLP

SEQ ID NO: 1377331 - protein, 9 aa, Homo Sapiens
SFRNHIVGY

SEQ ID NO: 1377332 - protein, 9 aa, Homo Sapiens
IFLVCHLFV

SEQ ID NO: 1377333 - protein, 9 aa, Homo Sapiens
KINDQTGNA

SEQ ID NO: 1377334 - protein, 9 aa, Homo Sapiens
RLGYCHCCY

SEQ ID NO: 1377335 - protein, 9 aa, Homo Sapiens
LVEHCQKLQ

SEQ ID NO: 1377336 - protein, 9 aa, Homo Sapiens
GTLPEKQST

SEQ ID NO: 1377337 - protein, 9 aa, Homo Sapiens
GRVQDALCG

SEQ ID NO: 1377338 - protein, 9 aa, Homo Sapiens
GRKRKNSKT

SEQ ID NO: 1377339 - protein, 9 aa, Homo Sapiens
EEIRLKAGR

SEQ ID NO: 1377340 - protein, 9 aa, Homo Sapiens
TTTTLTTMM

SEQ ID NO: 1377341 - protein, 9 aa, Homo Sapiens
RSVWKRSPW

SEQ ID NO: 1377342 - protein, 9 aa, Homo Sapiens
VMPYNYAVL

SEQ ID NO: 1377343 - protein, 9 aa, Homo Sapiens
PLPAGQKEL

SEQ ID NO: 1377344 - protein, 9 aa, Homo Sapiens
QSGTRHTET

SEQ ID NO: 1377345 - protein, 9 aa, Homo Sapiens
NLSHYSSGM

SEQ ID NO: 1377346 - protein, 9 aa, Homo Sapiens
PQEQFTLIS

SEQ ID NO: 1377347 - protein, 9 aa, Homo Sapiens
GNQTAQLQG

SEQ ID NO: 1377348 - protein, 9 aa, Homo Sapiens
KTVYNVMDK

SEQ ID NO: 1377349 - protein, 9 aa, Homo Sapiens
SHTKKPKVM

SEQ ID NO: 1377350 - protein, 9 aa, Homo Sapiens
VEKIPLSQE

SEQ ID NO: 1377351 - protein, 9 aa, Homo Sapiens
LKLRSLPVN

SEQ ID NO: 1377352 - protein, 9 aa, Homo Sapiens
SRKNNITSK

SEQ ID NO: 1377353 - protein, 9 aa, Homo Sapiens
QPTTHAEAQ

SEQ ID NO: 1377354 - protein, 9 aa, Homo Sapiens
TQRASKEKE

SEQ ID NO: 1377355 - protein, 9 aa, Homo Sapiens
PPTLNIFIP

SEQ ID NO: 1377356 - protein, 9 aa, Homo Sapiens
LLGNNESER

SEQ ID NO: 1377357 - protein, 9 aa, Homo Sapiens
GNRKRKYRL

SEQ ID NO: 1377358 - protein, 9 aa, Homo Sapiens
KETLFNASQ

SEQ ID NO: 1377359 - protein, 9 aa, Homo Sapiens
LDAIYHVTV

SEQ ID NO: 1377360 - protein, 9 aa, Homo Sapiens
EFICRKWQM

SEQ ID NO: 1377361 - protein, 9 aa, Homo Sapiens
EFSLDSTMR

SEQ ID NO: 1377362 - protein, 9 aa, Homo Sapiens
YTHPSSLSK

SEQ ID NO: 1377363 - protein, 9 aa, Homo Sapiens
LPARSIFDG

SEQ ID NO: 1377364 - protein, 9 aa, Homo Sapiens
VQQHQKWYQ

SEQ ID NO: 1377365 - protein, 9 aa, Homo Sapiens
VSYIMQRKQ

SEQ ID NO: 1377366 - protein, 9 aa, Homo Sapiens
LTLEVRLRL

SEQ ID NO: 1377367 - protein, 9 aa, Homo Sapiens
MRVPPSVTA

SEQ ID NO: 1377368 - protein, 9 aa, Homo Sapiens
EREFIADIL

SEQ ID NO: 1377369 - protein, 9 aa, Homo Sapiens
NIMPLHWQD

SEQ ID NO: 1377370 - protein, 9 aa, Homo Sapiens
FFCKAPVLV

SEQ ID NO: 1377371 - protein, 9 aa, Homo Sapiens
AAAAGPQAT

SEQ ID NO: 1377372 - protein, 9 aa, Homo Sapiens
LVAQETPGS

SEQ ID NO: 1377373 - protein, 9 aa, Homo Sapiens
FRNHIVGYF

SEQ ID NO: 1377374 - protein, 9 aa, Homo Sapiens
WQMMFTDED

SEQ ID NO: 1377375 - protein, 9 aa, Homo Sapiens
GSAGPAGFP

SEQ ID NO: 1377376 - protein, 9 aa, Homo Sapiens
QLYPQPPQG

SEQ ID NO: 1377377 - protein, 9 aa, Homo Sapiens
LKITTPQEQ

SEQ ID NO: 1377378 - protein, 9 aa, Homo Sapiens
IGAIVVQTS

SEQ ID NO: 1377379 - protein, 9 aa, Homo Sapiens
TKDQFLSPT

SEQ ID NO: 1377380 - protein, 9 aa, Homo Sapiens
LERANPYFE

SEQ ID NO: 1377381 - protein, 9 aa, Homo Sapiens
SSATQIDFS

SEQ ID NO: 1377382 - protein, 9 aa, Homo Sapiens
SETAASKET

SEQ ID NO: 1377383 - protein, 9 aa, Homo Sapiens
DLKLFEKKV

SEQ ID NO: 1377384 - protein, 9 aa, Homo Sapiens
RWAVPVHVP

SEQ ID NO: 1377385 - protein, 9 aa, Homo Sapiens
QVVQVNPVR

SEQ ID NO: 1377386 - protein, 9 aa, Homo Sapiens
LAHDGQNCL

SEQ ID NO: 1377387 - protein, 9 aa, Homo Sapiens
PHFAEDIWP

SEQ ID NO: 1377388 - protein, 9 aa, Homo Sapiens
SLPAVQFDE

SEQ ID NO: 1377389 - protein, 9 aa, Homo Sapiens
YMISRLLGP

SEQ ID NO: 1377390 - protein, 9 aa, Homo Sapiens
LVILLGPLI

SEQ ID NO: 1377391 - protein, 9 aa, Homo Sapiens
EWQLRIAAV

SEQ ID NO: 1377392 - protein, 9 aa, Homo Sapiens
PDLIFEHME

SEQ ID NO: 1377393 - protein, 9 aa, Homo Sapiens
AVERKIESQ

SEQ ID NO: 1377394 - protein, 9 aa, Homo Sapiens
STQIVAPSV

SEQ ID NO: 1377395 - protein, 9 aa, Homo Sapiens
TLLDSRSEG

SEQ ID NO: 1377396 - protein, 9 aa, Homo Sapiens
NGLKITTPQ

SEQ ID NO: 1377397 - protein, 9 aa, Homo Sapiens
RHSWRSWQS

SEQ ID NO: 1377398 - protein, 9 aa, Homo Sapiens
KSFAESSHL

SEQ ID NO: 1377399 - protein, 9 aa, Homo Sapiens
KICTCAPST

SEQ ID NO: 1377400 - protein, 9 aa, Homo Sapiens
PLAGRPSLL

SEQ ID NO: 1377401 - protein, 9 aa, Homo Sapiens
VKNAAANVF

SEQ ID NO: 1377402 - protein, 9 aa, Homo Sapiens
HEAVFTMGG

SEQ ID NO: 1377403 - protein, 9 aa, Homo Sapiens
GYVHFSYKA

SEQ ID NO: 1377404 - protein, 9 aa, Homo Sapiens
PIPTIATIP

SEQ ID NO: 1377405 - protein, 9 aa, Homo Sapiens
SPQPQLSTF

SEQ ID NO: 1377406 - protein, 9 aa, Homo Sapiens
KHSACALVL

SEQ ID NO: 1377407 - protein, 9 aa, Homo Sapiens
PQLSSARPF

SEQ ID NO: 1377408 - protein, 9 aa, Homo Sapiens
SDLSTFCFY

SEQ ID NO: 1377409 - protein, 9 aa, Homo Sapiens
GRRYLLRWS

SEQ ID NO: 1377410 - protein, 9 aa, Homo Sapiens
TNFTLEPLN

SEQ ID NO: 1377411 - protein, 9 aa, Homo Sapiens
RFLGSVIRR

SEQ ID NO: 1377412 - protein, 9 aa, Homo Sapiens
CSLVLDHQP

SEQ ID NO: 1377413 - protein, 9 aa, Homo Sapiens
TSKDKTELV

SEQ ID NO: 1377414 - protein, 9 aa, Homo Sapiens
QRGLEDIFG

SEQ ID NO: 1377415 - protein, 9 aa, Homo Sapiens
ICDGPVFHM

SEQ ID NO: 1377416 - protein, 9 aa, Homo Sapiens
SDKEKRGEE

SEQ ID NO: 1377417 - protein, 9 aa, Homo Sapiens
CKEAINVLS

SEQ ID NO: 1377418 - protein, 9 aa, Homo Sapiens
AGLAGALGA

SEQ ID NO: 1377419 - protein, 9 aa, Homo Sapiens
YPSEGMAGG

SEQ ID NO: 1377420 - protein, 9 aa, Homo Sapiens
EYNTSREYD

SEQ ID NO: 1377421 - protein, 9 aa, Homo Sapiens
QDSQALTIQ

SEQ ID NO: 1377422 - protein, 9 aa, Homo Sapiens
GLTAVMEFR

SEQ ID NO: 1377423 - protein, 9 aa, Homo Sapiens
FLQPNKYFL

SEQ ID NO: 1377424 - protein, 9 aa, Homo Sapiens
TQGSRMTDR

SEQ ID NO: 1377425 - protein, 9 aa, Homo Sapiens
DYFKLAPIM

SEQ ID NO: 1377426 - protein, 9 aa, Homo Sapiens
HPRIVRYFN

SEQ ID NO: 1377427 - protein, 9 aa, Homo Sapiens
LQPNKYFLE

SEQ ID NO: 1377428 - protein, 9 aa, Homo Sapiens
LGSVIRRRH

SEQ ID NO: 1377429 - protein, 9 aa, Homo Sapiens
TGLTAVMEF

SEQ ID NO: 1377430 - protein, 9 aa, Homo Sapiens
KEMENNENS

SEQ ID NO: 1377431 - protein, 9 aa, Homo Sapiens
IPIYEKQRD

SEQ ID NO: 1377432 - protein, 9 aa, Homo Sapiens
WSNTHCSSY

SEQ ID NO: 1377433 - protein, 9 aa, Homo Sapiens
KTRGEFRLQ

SEQ ID NO: 1377434 - protein, 9 aa, Homo Sapiens
LTAENRMLT

SEQ ID NO: 1377435 - protein, 9 aa, Homo Sapiens
HITGLTAVM

SEQ ID NO: 1377436 - protein, 9 aa, Homo Sapiens
LIIPIYEKQ

SEQ ID NO: 1377437 - protein, 9 aa, Homo Sapiens
ISLGSLRSM

SEQ ID NO: 1377438 - protein, 9 aa, Homo Sapiens
TKAAVSSFV

SEQ ID NO: 1377439 - protein, 9 aa, Homo Sapiens
ETRTQGSRM

SEQ ID NO: 1377440 - protein, 9 aa, Homo Sapiens
ALQATLNYG

SEQ ID NO: 1377441 - protein, 9 aa, Homo Sapiens
IMDNGFAGY

SEQ ID NO: 1377442 - protein, 9 aa, Homo Sapiens
SEDLTERAA

SEQ ID NO: 1377443 - protein, 9 aa, Homo Sapiens
VPISAILSS

SEQ ID NO: 1377444 - protein, 9 aa, Homo Sapiens
TQQLQSVVV

SEQ ID NO: 1377445 - protein, 9 aa, Homo Sapiens
FEESLVNMT

SEQ ID NO: 1377446 - protein, 9 aa, Homo Sapiens
TRGEFRLQD

SEQ ID NO: 1377447 - protein, 9 aa, Homo Sapiens
QERSYTRDL

SEQ ID NO: 1377448 - protein, 9 aa, Homo Sapiens
EDLSNCRDV

SEQ ID NO: 1377449 - protein, 9 aa, Homo Sapiens
RIAAYHMMR

SEQ ID NO: 1377450 - protein, 9 aa, Homo Sapiens
DHQPDNIKA

SEQ ID NO: 1377451 - protein, 9 aa, Homo Sapiens
PISAILSSY

SEQ ID NO: 1377452 - protein, 9 aa, Homo Sapiens
NPRLLKTRG

SEQ ID NO: 1377453 - protein, 9 aa, Homo Sapiens
YRCECREVY

SEQ ID NO: 1377454 - protein, 9 aa, Homo Sapiens
QDDMNAPSH

SEQ ID NO: 1377455 - protein, 9 aa, Homo Sapiens
DLEVVGNPR

SEQ ID NO: 1377456 - protein, 9 aa, Homo Sapiens
QWQEWNSWS

SEQ ID NO: 1377457 - protein, 9 aa, Homo Sapiens
WNSWSQCSV

SEQ ID NO: 1377458 - protein, 9 aa, Homo Sapiens
ANPGEHLAQ

SEQ ID NO: 1377459 - protein, 9 aa, Homo Sapiens
NRPEALPNS

SEQ ID NO: 1377460 - protein, 9 aa, Homo Sapiens
VSVGPCLTL

SEQ ID NO: 1377461 - protein, 9 aa, Homo Sapiens
ACALVLHGH

SEQ ID NO: 1377462 - protein, 9 aa, Homo Sapiens
FSLLQSANP

SEQ ID NO: 1377463 - protein, 9 aa, Homo Sapiens
SLLLPCVFH

SEQ ID NO: 1377464 - protein, 9 aa, Homo Sapiens
LRSCSLVLD

SEQ ID NO: 1377465 - protein, 9 aa, Homo Sapiens
LGMAMVQVT

SEQ ID NO: 1377466 - protein, 9 aa, Homo Sapiens
EFLQPNKYF

SEQ ID NO: 1377467 - protein, 9 aa, Homo Sapiens
ASIVKGQHG

SEQ ID NO: 1377468 - protein, 9 aa, Homo Sapiens
QPLAGRPSL

SEQ ID NO: 1377469 - protein, 9 aa, Homo Sapiens
SIQYDNVGR

SEQ ID NO: 1377470 - protein, 9 aa, Homo Sapiens
ADTVAKVQV

SEQ ID NO: 1377471 - protein, 9 aa, Homo Sapiens
VPRSSLFSE

SEQ ID NO: 1377472 - protein, 9 aa, Homo Sapiens
DAPRWWTSA

SEQ ID NO: 1377473 - protein, 9 aa, Homo Sapiens
HGGLHSANR

SEQ ID NO: 1377474 - protein, 9 aa, Homo Sapiens
QKALLHKFT

SEQ ID NO: 1377475 - protein, 9 aa, Homo Sapiens
EKYVSPLNR

SEQ ID NO: 1377476 - protein, 9 aa, Homo Sapiens
GKLVNSKKL

SEQ ID NO: 1377477 - protein, 9 aa, Homo Sapiens
LVNSKKLSS

SEQ ID NO: 1377478 - protein, 9 aa, Homo Sapiens
EDLTERAAT

SEQ ID NO: 1377479 - protein, 9 aa, Homo Sapiens
VPQLRREKS

SEQ ID NO: 1377480 - protein, 9 aa, Homo Sapiens
SLDIKAVAS

SEQ ID NO: 1377481 - protein, 9 aa, Homo Sapiens
LVSRQVSED

SEQ ID NO: 1377482 - protein, 9 aa, Homo Sapiens
WNGNFSFPI

SEQ ID NO: 1377483 - protein, 9 aa, Homo Sapiens
EAYGLCHCL

SEQ ID NO: 1377484 - protein, 9 aa, Homo Sapiens
FKLAPIMFG

SEQ ID NO: 1377485 - protein, 9 aa, Homo Sapiens
VDGQWQEWN

SEQ ID NO: 1377486 - protein, 9 aa, Homo Sapiens
SHNRPEALP

SEQ ID NO: 1377487 - protein, 9 aa, Homo Sapiens
GQHGMSEMD

SEQ ID NO: 1377488 - protein, 9 aa, Homo Sapiens
LVTSGPMSP

SEQ ID NO: 1377489 - protein, 9 aa, Homo Sapiens
ATKAAVSSF

SEQ ID NO: 1377490 - protein, 9 aa, Homo Sapiens
QATLNYGSL

SEQ ID NO: 1377491 - protein, 9 aa, Homo Sapiens
EAINVLSHL

SEQ ID NO: 1377492 - protein, 9 aa, Homo Sapiens
RTQGSRMTD

SEQ ID NO: 1377493 - protein, 9 aa, Homo Sapiens
WDTLTLKCL

SEQ ID NO: 1377494 - protein, 9 aa, Homo Sapiens
ETLYVEAIA

SEQ ID NO: 1377495 - protein, 9 aa, Homo Sapiens
VVKGGEKHV

SEQ ID NO: 1377496 - protein, 9 aa, Homo Sapiens
LAKLEHPRI

SEQ ID NO: 1377497 - protein, 9 aa, Homo Sapiens
KENENKIKK

SEQ ID NO: 1377498 - protein, 9 aa, Homo Sapiens
NKYFLEQID

SEQ ID NO: 1377499 - protein, 9 aa, Homo Sapiens
SVSPQDNSV

SEQ ID NO: 1377500 - protein, 9 aa, Homo Sapiens
PQPQLSTFP

SEQ ID NO: 1377501 - protein, 9 aa, Homo Sapiens
AEGCQPLLT

SEQ ID NO: 1377502 - protein, 9 aa, Homo Sapiens
IPTILVSAT

SEQ ID NO: 1377503 - protein, 9 aa, Homo Sapiens
SFSLLQSAN

SEQ ID NO: 1377504 - protein, 9 aa, Homo Sapiens
DSQALTIQL

SEQ ID NO: 1377505 - protein, 9 aa, Homo Sapiens
ATCNRADYF

SEQ ID NO: 1377506 - protein, 9 aa, Homo Sapiens
SMVKSLLLV

SEQ ID NO: 1377507 - protein, 9 aa, Homo Sapiens
YNCKEAINV

SEQ ID NO: 1377508 - protein, 9 aa, Homo Sapiens
RVICTGRNL

SEQ ID NO: 1377509 - protein, 9 aa, Homo Sapiens
EEIEVMSKS

SEQ ID NO: 1377510 - protein, 9 aa, Homo Sapiens
RWPILTIIT

SEQ ID NO: 1377511 - protein, 9 aa, Homo Sapiens
RWSTLDRFP

SEQ ID NO: 1377512 - protein, 9 aa, Homo Sapiens
PRLLKTRGE

SEQ ID NO: 1377513 - protein, 9 aa, Homo Sapiens
KTLVQRLAI

SEQ ID NO: 1377514 - protein, 9 aa, Homo Sapiens
DALLGIGDL

SEQ ID NO: 1377515 - protein, 9 aa, Homo Sapiens
ALSCFLHTR

SEQ ID NO: 1377516 - protein, 9 aa, Homo Sapiens
DMNAPSHCL

SEQ ID NO: 1377517 - protein, 9 aa, Homo Sapiens
TIILSAEDL

SEQ ID NO: 1377518 - protein, 9 aa, Homo Sapiens
AMVQVTSVF

SEQ ID NO: 1377519 - protein, 9 aa, Homo Sapiens
DTLTLKCLS

SEQ ID NO: 1377520 - protein, 9 aa, Homo Sapiens
VSPQDNSVD

SEQ ID NO: 1377521 - protein, 9 aa, Homo Sapiens
ELNEAFLNS

SEQ ID NO: 1377522 - protein, 9 aa, Homo Sapiens
NLVAAFEES

SEQ ID NO: 1377523 - protein, 9 aa, Homo Sapiens
NNDMPIPCN

SEQ ID NO: 1377524 - protein, 9 aa, Homo Sapiens
ANVFRETWL

SEQ ID NO: 1377525 - protein, 9 aa, Homo Sapiens
HSSMFLDSK

SEQ ID NO: 1377526 - protein, 9 aa, Homo Sapiens
LPAYLNSLK

SEQ ID NO: 1377527 - protein, 9 aa, Homo Sapiens
DVSHNRPEA

SEQ ID NO: 1377528 - protein, 9 aa, Homo Sapiens
GEFRLQDDM

SEQ ID NO: 1377529 - protein, 9 aa, Homo Sapiens
GMAMVQVTS

SEQ ID NO: 1377530 - protein, 9 aa, Homo Sapiens
VNSRTGVGR

SEQ ID NO: 1377531 - protein, 9 aa, Homo Sapiens
YVHFSYKAS

SEQ ID NO: 1377532 - protein, 9 aa, Homo Sapiens
LDGLIKETK

SEQ ID NO: 1377533 - protein, 9 aa, Homo Sapiens
NTHCSSYKG

SEQ ID NO: 1377534 - protein, 9 aa, Homo Sapiens
PVFLRSLGK

SEQ ID NO: 1377535 - protein, 9 aa, Homo Sapiens
TAVMEFRED

SEQ ID NO: 1377536 - protein, 9 aa, Homo Sapiens
IEKYVSPLN

SEQ ID NO: 1377537 - protein, 9 aa, Homo Sapiens
STMSGWLQL

SEQ ID NO: 1377538 - protein, 9 aa, Homo Sapiens
QEWNSWSQC

SEQ ID NO: 1377539 - protein, 9 aa, Homo Sapiens
DDEEFIRGR

SEQ ID NO: 1377540 - protein, 9 aa, Homo Sapiens
ITGLTAVME

SEQ ID NO: 1377541 - protein, 9 aa, Homo Sapiens
EKQRDFERL

SEQ ID NO: 1377542 - protein, 9 aa, Homo Sapiens
QSFFARLKK

SEQ ID NO: 1377543 - protein, 9 aa, Homo Sapiens
GSLDIKAVA

SEQ ID NO: 1377544 - protein, 9 aa, Homo Sapiens
KALLHKFTP

SEQ ID NO: 1377545 - protein, 9 aa, Homo Sapiens
SCSLVLDHQ

SEQ ID NO: 1377546 - protein, 9 aa, Homo Sapiens
TQAPTFTQQ

SEQ ID NO: 1377547 - protein, 9 aa, Homo Sapiens
NYLNHHVNR

SEQ ID NO: 1377548 - protein, 9 aa, Homo Sapiens
PENRAEKIW

SEQ ID NO: 1377549 - protein, 9 aa, Homo Sapiens
SPWTWLQAQ

SEQ ID NO: 1377550 - protein, 9 aa, Homo Sapiens
GQWQEWNSW

SEQ ID NO: 1377551 - protein, 9 aa, Homo Sapiens
GSVIRRRHL

SEQ ID NO: 1377552 - protein, 9 aa, Homo Sapiens
SLYIDITVL

SEQ ID NO: 1377553 - protein, 9 aa, Homo Sapiens
RSYTRDLLG

SEQ ID NO: 1377554 - protein, 9 aa, Homo Sapiens
PIPCNQNFI

SEQ ID NO: 1377555 - protein, 9 aa, Homo Sapiens
LPSDLPKPP

SEQ ID NO: 1377556 - protein, 9 aa, Homo Sapiens
TLNYGSLKS

SEQ ID NO: 1377557 - protein, 9 aa, Homo Sapiens
QGGEKRKDA

SEQ ID NO: 1377558 - protein, 9 aa, Homo Sapiens
IRGNDAGRF

SEQ ID NO: 1377559 - protein, 9 aa, Homo Sapiens
LIKETKENE

SEQ ID NO: 1377560 - protein, 9 aa, Homo Sapiens
FFARLKKKK

SEQ ID NO: 1377561 - protein, 9 aa, Homo Sapiens
GLIKETKEN

SEQ ID NO: 1377562 - protein, 9 aa, Homo Sapiens
APKGASGIR

SEQ ID NO: 1377563 - protein, 9 aa, Homo Sapiens
RGEPQNKRT

SEQ ID NO: 1377564 - protein, 9 aa, Homo Sapiens
LSSHGGLHS

SEQ ID NO: 1377565 - protein, 9 aa, Homo Sapiens
KDSDKEKRG

SEQ ID NO: 1377566 - protein, 9 aa, Homo Sapiens
EGCQPLLTP

SEQ ID NO: 1377567 - protein, 9 aa, Homo Sapiens
PISISADLA

SEQ ID NO: 1377568 - protein, 9 aa, Homo Sapiens
IIPIYEKQR

SEQ ID NO: 1377569 - protein, 9 aa, Homo Sapiens
YVSPLNRSF

SEQ ID NO: 1377570 - protein, 9 aa, Homo Sapiens
TELVTSGPM

SEQ ID NO: 1377571 - protein, 9 aa, Homo Sapiens
KLAASILGG

SEQ ID NO: 1377572 - protein, 9 aa, Homo Sapiens
KLIEKYVSP

SEQ ID NO: 1377573 - protein, 9 aa, Homo Sapiens
REKSLLLWN

SEQ ID NO: 1377574 - protein, 9 aa, Homo Sapiens
PWLAVEIPH

SEQ ID NO: 1377575 - protein, 9 aa, Homo Sapiens
ELPSDLPKP

SEQ ID NO: 1377576 - protein, 9 aa, Homo Sapiens
SIVKGQHGM

SEQ ID NO: 1377577 - protein, 9 aa, Homo Sapiens
QEDLLSPVQ

SEQ ID NO: 1377578 - protein, 9 aa, Homo Sapiens
HAGLAGALG

SEQ ID NO: 1377579 - protein, 9 aa, Homo Sapiens
REVYIREDD

SEQ ID NO: 1377580 - protein, 9 aa, Homo Sapiens
LLDDDVVIV

SEQ ID NO: 1377581 - protein, 9 aa, Homo Sapiens
PQDNSVDRM

SEQ ID NO: 1377582 - protein, 9 aa, Homo Sapiens
MPIPCNQNF

SEQ ID NO: 1377583 - protein, 9 aa, Homo Sapiens
APARLHPDG

SEQ ID NO: 1377584 - protein, 9 aa, Homo Sapiens
SVPISAILS

SEQ ID NO: 1377585 - protein, 9 aa, Homo Sapiens
QSPIPCKLY

SEQ ID NO: 1377586 - protein, 9 aa, Homo Sapiens
LDDDVVIVD

SEQ ID NO: 1377587 - protein, 9 aa, Homo Sapiens
EGMAGGINP

SEQ ID NO: 1377588 - protein, 9 aa, Homo Sapiens
QSLTLTRHK

SEQ ID NO: 1377589 - protein, 9 aa, Homo Sapiens
SCFLHTRLG

SEQ ID NO: 1377590 - protein, 9 aa, Homo Sapiens
NGRWIGRLA

SEQ ID NO: 1377591 - protein, 9 aa, Homo Sapiens
QLQSVVVLE

SEQ ID NO: 1377592 - protein, 9 aa, Homo Sapiens
LPNANYPSE

SEQ ID NO: 1377593 - protein, 9 aa, Homo Sapiens
DTKTLVQRL

SEQ ID NO: 1377594 - protein, 9 aa, Homo Sapiens
RSPSKTGRQ

SEQ ID NO: 1377595 - protein, 9 aa, Homo Sapiens
WTSATTTLS

SEQ ID NO: 1377596 - protein, 9 aa, Homo Sapiens
NNFSQSSEL

SEQ ID NO: 1377597 - protein, 9 aa, Homo Sapiens
YNTSREYDR

SEQ ID NO: 1377598 - protein, 9 aa, Homo Sapiens
SLGKGDWFG

SEQ ID NO: 1377599 - protein, 9 aa, Homo Sapiens
LEETINIHE

SEQ ID NO: 1377600 - protein, 9 aa, Homo Sapiens
PKGASGIRE

SEQ ID NO: 1377601 - protein, 9 aa, Homo Sapiens
DKEKRGEED

SEQ ID NO: 1377602 - protein, 9 aa, Homo Sapiens
PRVICTGRN

SEQ ID NO: 1377603 - protein, 9 aa, Homo Sapiens
NVFRETWLI

SEQ ID NO: 1377604 - protein, 9 aa, Homo Sapiens
CGNNFSQSS

SEQ ID NO: 1377605 - protein, 9 aa, Homo Sapiens
EKKERKQSF

SEQ ID NO: 1377606 - protein, 9 aa, Homo Sapiens
FSYGGVHPY

SEQ ID NO: 1377607 - protein, 9 aa, Homo Sapiens
PARLHPDGL

SEQ ID NO: 1377608 - protein, 9 aa, Homo Sapiens
TINIHEMEA

SEQ ID NO: 1377609 - protein, 9 aa, Homo Sapiens
QTKYLARPE

SEQ ID NO: 1377610 - protein, 9 aa, Homo Sapiens
SREYKQERS

SEQ ID NO: 1377611 - protein, 9 aa, Homo Sapiens
IILSAEDLS

SEQ ID NO: 1377612 - protein, 9 aa, Homo Sapiens
YQAPLSTKV

SEQ ID NO: 1377613 - protein, 9 aa, Homo Sapiens
QALSCFLHT

SEQ ID NO: 1377614 - protein, 9 aa, Homo Sapiens
GLPAQGGEK

SEQ ID NO: 1377615 - protein, 9 aa, Homo Sapiens
EIPHLIQKG

SEQ ID NO: 1377616 - protein, 9 aa, Homo Sapiens
ILEETINIH

SEQ ID NO: 1377617 - protein, 9 aa, Homo Sapiens
GRNLYGAKS

SEQ ID NO: 1377618 - protein, 9 aa, Homo Sapiens
GPKCTGVCD

SEQ ID NO: 1377619 - protein, 9 aa, Homo Sapiens
LQEALQDSQ

SEQ ID NO: 1377620 - protein, 9 aa, Homo Sapiens
EYKQERSYT

SEQ ID NO: 1377621 - protein, 9 aa, Homo Sapiens
LEDIFGLVV

SEQ ID NO: 1377622 - protein, 9 aa, Homo Sapiens
SLLQSANPG

SEQ ID NO: 1377623 - protein, 9 aa, Homo Sapiens
MIVGNATKA

SEQ ID NO: 1377624 - protein, 9 aa, Homo Sapiens
TLVQRLAIL

SEQ ID NO: 1377625 - protein, 9 aa, Homo Sapiens
EDEEEIIPL

SEQ ID NO: 1377626 - protein, 9 aa, Homo Sapiens
TMSGWLQLL

SEQ ID NO: 1377627 - protein, 9 aa, Homo Sapiens
PQLSTFPKK

SEQ ID NO: 1377628 - protein, 9 aa, Homo Sapiens
MNAPSHCLP

SEQ ID NO: 1377629 - protein, 9 aa, Homo Sapiens
LGAPGPDGN

SEQ ID NO: 1377630 - protein, 9 aa, Homo Sapiens
KDAPRWWTS

SEQ ID NO: 1377631 - protein, 9 aa, Homo Sapiens
YNNDMPIPC

SEQ ID NO: 1377632 - protein, 9 aa, Homo Sapiens
RKHSACALV

SEQ ID NO: 1377633 - protein, 9 aa, Homo Sapiens
PNANYPSEG

SEQ ID NO: 1377634 - protein, 9 aa, Homo Sapiens
GFAGYVHFS

SEQ ID NO: 1377635 - protein, 9 aa, Homo Sapiens
ESLVNMTSR

SEQ ID NO: 1377636 - protein, 9 aa, Homo Sapiens
VSKRYGFVS

SEQ ID NO: 1377637 - protein, 9 aa, Homo Sapiens
LQDHWGSTM

SEQ ID NO: 1377638 - protein, 9 aa, Homo Sapiens
LLFVELVST

SEQ ID NO: 1377639 - protein, 9 aa, Homo Sapiens
RTPKERKPS

SEQ ID NO: 1377640 - protein, 9 aa, Homo Sapiens
EDPVFLRSL

SEQ ID NO: 1377641 - protein, 9 aa, Homo Sapiens
GLEDIFGLV

SEQ ID NO: 1377642 - protein, 9 aa, Homo Sapiens
SANPGEHLA

SEQ ID NO: 1377643 - protein, 9 aa, Homo Sapiens
LHTRLGKLA

SEQ ID NO: 1377644 - protein, 9 aa, Homo Sapiens
VFLRSLGKG

SEQ ID NO: 1377645 - protein, 9 aa, Homo Sapiens
PEDSLSTAP

SEQ ID NO: 1377646 - protein, 9 aa, Homo Sapiens
QVFSHIFLL

SEQ ID NO: 1377647 - protein, 9 aa, Homo Sapiens
LKAIAYWMS

SEQ ID NO: 1377648 - protein, 9 aa, Homo Sapiens
ETKENENKI

SEQ ID NO: 1377649 - protein, 9 aa, Homo Sapiens
EFRLQDDMN

SEQ ID NO: 1377650 - protein, 9 aa, Homo Sapiens
EQNRVEENR

SEQ ID NO: 1377651 - protein, 9 aa, Homo Sapiens
KEFLQPNKY

SEQ ID NO: 1377652 - protein, 9 aa, Homo Sapiens
IIRGNDAGR

SEQ ID NO: 1377653 - protein, 9 aa, Homo Sapiens
TLYVEAIAF

SEQ ID NO: 1377654 - protein, 9 aa, Homo Sapiens
LDVSHNRPE

SEQ ID NO: 1377655 - protein, 9 aa, Homo Sapiens
KQERSYTRD

SEQ ID NO: 1377656 - protein, 9 aa, Homo Sapiens
VNSKKLSST

SEQ ID NO: 1377657 - protein, 9 aa, Homo Sapiens
GRLATDSDW

SEQ ID NO: 1377658 - protein, 9 aa, Homo Sapiens
SATTTLSLL

SEQ ID NO: 1377659 - protein, 9 aa, Homo Sapiens
CFYLRIFEK

SEQ ID NO: 1377660 - protein, 9 aa, Homo Sapiens
VICTGRNLY

SEQ ID NO: 1377661 - protein, 9 aa, Homo Sapiens
ILRTPKERK

SEQ ID NO: 1377662 - protein, 9 aa, Homo Sapiens
GEKRKDAPR

SEQ ID NO: 1377663 - protein, 9 aa, Homo Sapiens
DDENTPENR

SEQ ID NO: 1377664 - protein, 9 aa, Homo Sapiens
LAASILGGV

SEQ ID NO: 1377665 - protein, 9 aa, Homo Sapiens
SLKGKLVNS

SEQ ID NO: 1377666 - protein, 9 aa, Homo Sapiens
GKDSDKEKR

SEQ ID NO: 1377667 - protein, 9 aa, Homo Sapiens
PAFVVKGGE

SEQ ID NO: 1377668 - protein, 9 aa, Homo Sapiens
LRSMVKSLL

SEQ ID NO: 1377669 - protein, 9 aa, Homo Sapiens
DENTPENRA

SEQ ID NO: 1377670 - protein, 9 aa, Homo Sapiens
PRIVRYFNA

SEQ ID NO: 1377671 - protein, 9 aa, Homo Sapiens
GFWSNTHCS

SEQ ID NO: 1377672 - protein, 9 aa, Homo Sapiens
YECSQCGNN

SEQ ID NO: 1377673 - protein, 9 aa, Homo Sapiens
LTAVMEFRE

SEQ ID NO: 1377674 - protein, 9 aa, Homo Sapiens
MMEVASVCM

SEQ ID NO: 1377675 - protein, 9 aa, Homo Sapiens
TGRNLYGAK

SEQ ID NO: 1377676 - protein, 9 aa, Homo Sapiens
TKTLVQRLA

SEQ ID NO: 1377677 - protein, 9 aa, Homo Sapiens
QKVKNGIPS

SEQ ID NO: 1377678 - protein, 9 aa, Homo Sapiens
RQVSEDLTE

SEQ ID NO: 1377679 - protein, 9 aa, Homo Sapiens
DEADELPSD

SEQ ID NO: 1377680 - protein, 9 aa, Homo Sapiens
SPLNRSFRG

SEQ ID NO: 1377681 - protein, 9 aa, Homo Sapiens
RQHPGADPQ

SEQ ID NO: 1377682 - protein, 9 aa, Homo Sapiens
CECREVYIR

SEQ ID NO: 1377683 - protein, 9 aa, Homo Sapiens
LKNFLLRVN

SEQ ID NO: 1377684 - protein, 9 aa, Homo Sapiens
LAGALGAPG

SEQ ID NO: 1377685 - protein, 9 aa, Homo Sapiens
WIGRLATDS

SEQ ID NO: 1377686 - protein, 9 aa, Homo Sapiens
NMTPSAVGR

SEQ ID NO: 1377687 - protein, 9 aa, Homo Sapiens
EEIVIIWDS

SEQ ID NO: 1377688 - protein, 9 aa, Homo Sapiens
TRTQGSRMT

SEQ ID NO: 1377689 - protein, 9 aa, Homo Sapiens
NYPSEGMAG

SEQ ID NO: 1377690 - protein, 9 aa, Homo Sapiens
FVVKGGEKH

SEQ ID NO: 1377691 - protein, 9 aa, Homo Sapiens
DQKVKNGIP

SEQ ID NO: 1377692 - protein, 9 aa, Homo Sapiens
SCSSLYIDI

SEQ ID NO: 1377693 - protein, 9 aa, Homo Sapiens
YGPKCTGVC

SEQ ID NO: 1377694 - protein, 9 aa, Homo Sapiens
SQQALSCFL

SEQ ID NO: 1377695 - protein, 9 aa, Homo Sapiens
PGCDTSDKV

SEQ ID NO: 1377696 - protein, 9 aa, Homo Sapiens
SYRIIRGND

SEQ ID NO: 1377697 - protein, 9 aa, Homo Sapiens
AGITGTCQH

SEQ ID NO: 1377698 - protein, 9 aa, Homo Sapiens
QAPTFTQQL

SEQ ID NO: 1377699 - protein, 9 aa, Homo Sapiens
CPHEAVFTM

SEQ ID NO: 1377700 - protein, 9 aa, Homo Sapiens
LPSCSSLYI

SEQ ID NO: 1377701 - protein, 9 aa, Homo Sapiens
RIVRYFNAW

SEQ ID NO: 1377702 - protein, 9 aa, Homo Sapiens
ILSAEDLSN

SEQ ID NO: 1377703 - protein, 9 aa, Homo Sapiens
GNNFSQSSE

SEQ ID NO: 1377704 - protein, 9 aa, Homo Sapiens
HSANRETAF

SEQ ID NO: 1377705 - protein, 9 aa, Homo Sapiens
IEVMSKSID

SEQ ID NO: 1377706 - protein, 9 aa, Homo Sapiens
KDKTELVTS

SEQ ID NO: 1377707 - protein, 9 aa, Homo Sapiens
SVSTIEPQE

SEQ ID NO: 1377708 - protein, 9 aa, Homo Sapiens
IGLGMAMVQ

SEQ ID NO: 1377709 - protein, 9 aa, Homo Sapiens
SKTGRQAGR

SEQ ID NO: 1377710 - protein, 9 aa, Homo Sapiens
SKSSDQAII

SEQ ID NO: 1377711 - protein, 9 aa, Homo Sapiens
AVFTMGGNA

SEQ ID NO: 1377712 - protein, 9 aa, Homo Sapiens
QAPLSTKVF

SEQ ID NO: 1377713 - protein, 9 aa, Homo Sapiens
VTRCNFTSQ

SEQ ID NO: 1377714 - protein, 9 aa, Homo Sapiens
RAAEAKEME

SEQ ID NO: 1377715 - protein, 9 aa, Homo Sapiens
EALQDSQAL

SEQ ID NO: 1377716 - protein, 9 aa, Homo Sapiens
SARPFPAQR

SEQ ID NO: 1377717 - protein, 9 aa, Homo Sapiens
FLHTRLGKL

SEQ ID NO: 1377718 - protein, 9 aa, Homo Sapiens
GVSKRYGFV

SEQ ID NO: 1377719 - protein, 9 aa, Homo Sapiens
IVIIWDSVT

SEQ ID NO: 1377720 - protein, 9 aa, Homo Sapiens
EPEQNRVEE

SEQ ID NO: 1377721 - protein, 9 aa, Homo Sapiens
HWGSTMSGW

SEQ ID NO: 1377722 - protein, 9 aa, Homo Sapiens
SFPISISAD

SEQ ID NO: 1377723 - protein, 9 aa, Homo Sapiens
SHGGLHSAN

SEQ ID NO: 1377724 - protein, 9 aa, Homo Sapiens
AINVLSHLP

SEQ ID NO: 1377725 - protein, 9 aa, Homo Sapiens
SGIREDPNL

SEQ ID NO: 1377726 - protein, 9 aa, Homo Sapiens
DEEEIIPLA

SEQ ID NO: 1377727 - protein, 9 aa, Homo Sapiens
LKGKLVNSK

SEQ ID NO: 1377728 - protein, 9 aa, Homo Sapiens
PELNEAFLN

SEQ ID NO: 1377729 - protein, 9 aa, Homo Sapiens
GLAGALGAP

SEQ ID NO: 1377730 - protein, 9 aa, Homo Sapiens
PRSPQPQLS

SEQ ID NO: 1377731 - protein, 9 aa, Homo Sapiens
PVPRSSLFS

SEQ ID NO: 1377732 - protein, 9 aa, Homo Sapiens
NFSFPISIS

SEQ ID NO: 1377733 - protein, 9 aa, Homo Sapiens
RRKGSLDIK

SEQ ID NO: 1377734 - protein, 9 aa, Homo Sapiens
ATLNYGSLK

SEQ ID NO: 1377735 - protein, 9 aa, Homo Sapiens
RVQKALLHK

SEQ ID NO: 1377736 - protein, 9 aa, Homo Sapiens
LREAYGLCH

SEQ ID NO: 1377737 - protein, 9 aa, Homo Sapiens
MTPSAVGRE

SEQ ID NO: 1377738 - protein, 9 aa, Homo Sapiens
PSAVGRERH

SEQ ID NO: 1377739 - protein, 9 aa, Homo Sapiens
ESRMRIAAY

SEQ ID NO: 1377740 - protein, 9 aa, Homo Sapiens
RLATDSDWM

SEQ ID NO: 1377741 - protein, 9 aa, Homo Sapiens
ADEADELPS

SEQ ID NO: 1377742 - protein, 9 aa, Homo Sapiens
KQSFFARLK

SEQ ID NO: 1377743 - protein, 9 aa, Homo Sapiens
INVLSHLPS

SEQ ID NO: 1377744 - protein, 9 aa, Homo Sapiens
RREKSLLLW

SEQ ID NO: 1377745 - protein, 9 aa, Homo Sapiens
APPRVICTG

SEQ ID NO: 1377746 - protein, 9 aa, Homo Sapiens
ALQDSQALT

SEQ ID NO: 1377747 - protein, 9 aa, Homo Sapiens
TSSKSSDQA

SEQ ID NO: 1377748 - protein, 9 aa, Homo Sapiens
CALVLHGHN

SEQ ID NO: 1377749 - protein, 9 aa, Homo Sapiens
KAIAYWMSI

SEQ ID NO: 1377750 - protein, 9 aa, Homo Sapiens
CELGRYGPK

SEQ ID NO: 1377751 - protein, 9 aa, Homo Sapiens
ANYPSEGMA

SEQ ID NO: 1377752 - protein, 9 aa, Homo Sapiens
KRLGGSSVM

SEQ ID NO: 1377753 - protein, 9 aa, Homo Sapiens
GIREDPNLV

SEQ ID NO: 1377754 - protein, 9 aa, Homo Sapiens
ECSQCGNNF

SEQ ID NO: 1377755 - protein, 9 aa, Homo Sapiens
ENLDCPELN

SEQ ID NO: 1377756 - protein, 9 aa, Homo Sapiens
YHMMRNLTA

SEQ ID NO: 1377757 - protein, 9 aa, Homo Sapiens
KKLHEYNTS

SEQ ID NO: 1377758 - protein, 9 aa, Homo Sapiens
KNFLLRVNM

SEQ ID NO: 1377759 - protein, 9 aa, Homo Sapiens
EAADRGEPQ

SEQ ID NO: 1377760 - protein, 9 aa, Homo Sapiens
IPVPSSPAP

SEQ ID NO: 1377761 - protein, 9 aa, Homo Sapiens
KVLTAENRM

SEQ ID NO: 1377762 - protein, 9 aa, Homo Sapiens
VILEETINI

SEQ ID NO: 1377763 - protein, 9 aa, Homo Sapiens
CREVYIRED

SEQ ID NO: 1377764 - protein, 9 aa, Homo Sapiens
ANLVAAFEE

SEQ ID NO: 1377765 - protein, 9 aa, Homo Sapiens
LWIPAFVVK

SEQ ID NO: 1377766 - protein, 9 aa, Homo Sapiens
QHPGADPQG

SEQ ID NO: 1377767 - protein, 9 aa, Homo Sapiens
LGSLRSMVK

SEQ ID NO: 1377768 - protein, 9 aa, Homo Sapiens
QGYQAPLST

SEQ ID NO: 1377769 - protein, 9 aa, Homo Sapiens
LLHKFTPEI

SEQ ID NO: 1377770 - protein, 9 aa, Homo Sapiens
SNTHCSSYK

SEQ ID NO: 1377771 - protein, 9 aa, Homo Sapiens
LGIGLGMAM

SEQ ID NO: 1377772 - protein, 9 aa, Homo Sapiens
LSVPISAIL

SEQ ID NO: 1377773 - protein, 9 aa, Homo Sapiens
IPHLIQKGV

SEQ ID NO: 1377774 - protein, 9 aa, Homo Sapiens
GRYGPKCTG

SEQ ID NO: 1377775 - protein, 9 aa, Homo Sapiens
PLGALSVPI

SEQ ID NO: 1377776 - protein, 9 aa, Homo Sapiens
FYLRIFEKM

SEQ ID NO: 1377777 - protein, 9 aa, Homo Sapiens
SLFSESFVV

SEQ ID NO: 1377778 - protein, 9 aa, Homo Sapiens
NIHEMEAKA

SEQ ID NO: 1377779 - protein, 9 aa, Homo Sapiens
CSSLYIDIT

SEQ ID NO: 1377780 - protein, 9 aa, Homo Sapiens
KREKRLGGS

SEQ ID NO: 1377781 - protein, 9 aa, Homo Sapiens
AKVQVVEFS

SEQ ID NO: 1377782 - protein, 9 aa, Homo Sapiens
DELPSDLPK

SEQ ID NO: 1377783 - protein, 9 aa, Homo Sapiens
SSARPFPAQ

SEQ ID NO: 1377784 - protein, 9 aa, Homo Sapiens
NTPENRAEK

SEQ ID NO: 1377785 - protein, 9 aa, Homo Sapiens
PAQGGEKRK

SEQ ID NO: 1377786 - protein, 9 aa, Homo Sapiens
TGVGRHLTS

SEQ ID NO: 1377787 - protein, 9 aa, Homo Sapiens
DRTGVSKRY

SEQ ID NO: 1377788 - protein, 9 aa, Homo Sapiens
EHPRIVRYF

SEQ ID NO: 1377789 - protein, 9 aa, Homo Sapiens
AGALGAPGP

SEQ ID NO: 1377790 - protein, 9 aa, Homo Sapiens
FEEIVIIWD

SEQ ID NO: 1377791 - protein, 9 aa, Homo Sapiens
SRTGVGRHL

SEQ ID NO: 1377792 - protein, 9 aa, Homo Sapiens
NANYPSEGM

SEQ ID NO: 1377793 - protein, 9 aa, Homo Sapiens
VGRHLTSLA

SEQ ID NO: 1377794 - protein, 9 aa, Homo Sapiens
GYQAPLSTK

SEQ ID NO: 1377795 - protein, 9 aa, Homo Sapiens
YIDITVLRT

SEQ ID NO: 1377796 - protein, 9 aa, Homo Sapiens
SGFWSNTHC

SEQ ID NO: 1377797 - protein, 9 aa, Homo Sapiens
LRWSTLDRF

SEQ ID NO: 1377798 - protein, 9 aa, Homo Sapiens
RPFPAQRNS

SEQ ID NO: 1377799 - protein, 9 aa, Homo Sapiens
KGHITGLTA

SEQ ID NO: 1377800 - protein, 9 aa, Homo Sapiens
LGNHLKETL

SEQ ID NO: 1377801 - protein, 9 aa, Homo Sapiens
LPAQGGEKR

SEQ ID NO: 1377802 - protein, 9 aa, Homo Sapiens
NQSLTLTRH

SEQ ID NO: 1377803 - protein, 9 aa, Homo Sapiens
AAVTSQSPI

SEQ ID NO: 1377804 - protein, 9 aa, Homo Sapiens
ALLHKFTPE

SEQ ID NO: 1377805 - protein, 9 aa, Homo Sapiens
QGSRMTDRV

SEQ ID NO: 1377806 - protein, 9 aa, Homo Sapiens
LLLPCVFHD

SEQ ID NO: 1377807 - protein, 9 aa, Homo Sapiens
RVGSPWTWL

SEQ ID NO: 1377808 - protein, 9 aa, Homo Sapiens
TLSLLLPCV

SEQ ID NO: 1377809 - protein, 9 aa, Homo Sapiens
AFEESLVNM

SEQ ID NO: 1377810 - protein, 9 aa, Homo Sapiens
HEILREAYG

SEQ ID NO: 1377811 - protein, 9 aa, Homo Sapiens
GNPRLLKTR

SEQ ID NO: 1377812 - protein, 9 aa, Homo Sapiens
AYGLCHCLP

SEQ ID NO: 1377813 - protein, 9 aa, Homo Sapiens
WLDVSHNRP

SEQ ID NO: 1377814 - protein, 9 aa, Homo Sapiens
SKSIDFPLT

SEQ ID NO: 1377815 - protein, 9 aa, Homo Sapiens
QDHWGSTMS

SEQ ID NO: 1377816 - protein, 9 aa, Homo Sapiens
IGRLATDSD

SEQ ID NO: 1377817 - protein, 9 aa, Homo Sapiens
KETKENENK

SEQ ID NO: 1377818 - protein, 9 aa, Homo Sapiens
QLSSHGGLH

SEQ ID NO: 1377819 - protein, 9 aa, Homo Sapiens
PQLRREKSL

SEQ ID NO: 1377820 - protein, 9 aa, Homo Sapiens
LNEAFLNSQ

SEQ ID NO: 1377821 - protein, 9 aa, Homo Sapiens
LYVEAIAFP

SEQ ID NO: 1377822 - protein, 9 aa, Homo Sapiens
GTIILSAED

SEQ ID NO: 1377823 - protein, 9 aa, Homo Sapiens
KGKLVNSKK

SEQ ID NO: 1377824 - protein, 9 aa, Homo Sapiens
RTGVGRHLT

SEQ ID NO: 1377825 - protein, 9 aa, Homo Sapiens
VGGRRYLLR

SEQ ID NO: 1377826 - protein, 9 aa, Homo Sapiens
ESLLDDDVV

SEQ ID NO: 1377827 - protein, 9 aa, Homo Sapiens
TPRSPQPQL

SEQ ID NO: 1377828 - protein, 9 aa, Homo Sapiens
QYECSQCGN

SEQ ID NO: 1377829 - protein, 9 aa, Homo Sapiens
AAANVFRET

SEQ ID NO: 1377830 - protein, 9 aa, Homo Sapiens
TTLSLLLPC

SEQ ID NO: 1377831 - protein, 9 aa, Homo Sapiens
KEAINVLSH

SEQ ID NO: 1377832 - protein, 9 aa, Homo Sapiens
IEPQEDLLS

SEQ ID NO: 1377833 - protein, 9 aa, Homo Sapiens
GTSSKSSDQ

SEQ ID NO: 1377834 - protein, 9 aa, Homo Sapiens
LIEKYVSPL

SEQ ID NO: 1377835 - protein, 9 aa, Homo Sapiens
LYALNVLKS

SEQ ID NO: 1377836 - protein, 9 aa, Homo Sapiens
YLRIFEKMF

SEQ ID NO: 1377837 - protein, 9 aa, Homo Sapiens
SSLTHVPGI

SEQ ID NO: 1377838 - protein, 9 aa, Homo Sapiens
KVKSVSPQD

SEQ ID NO: 1377839 - protein, 9 aa, Homo Sapiens
PEGERQHSS

SEQ ID NO: 1377840 - protein, 9 aa, Homo Sapiens
LPCVFHDLE

SEQ ID NO: 1377841 - protein, 9 aa, Homo Sapiens
EILREAYGL

SEQ ID NO: 1377842 - protein, 9 aa, Homo Sapiens
EMENNENSN

SEQ ID NO: 1377843 - protein, 9 aa, Homo Sapiens
DNSVDRMAA

SEQ ID NO: 1377844 - protein, 9 aa, Homo Sapiens
FPAQRNSQP

SEQ ID NO: 1377845 - protein, 9 aa, Homo Sapiens
QRDFERLAH

SEQ ID NO: 1377846 - protein, 9 aa, Homo Sapiens
PLNELERLF

SEQ ID NO: 1377847 - protein, 9 aa, Homo Sapiens
PSDLPKPPS

SEQ ID NO: 1377848 - protein, 9 aa, Homo Sapiens
REKRLGGSS

SEQ ID NO: 1377849 - protein, 9 aa, Homo Sapiens
FAGYVHFSY

SEQ ID NO: 1377850 - protein, 9 aa, Homo Sapiens
TIEPQEDLL

SEQ ID NO: 1377851 - protein, 9 aa, Homo Sapiens
SPAPIATID

SEQ ID NO: 1377852 - protein, 9 aa, Homo Sapiens
EVVGNPRLL

SEQ ID NO: 1377853 - protein, 9 aa, Homo Sapiens
YEKQRDFER

SEQ ID NO: 1377854 - protein, 9 aa, Homo Sapiens
FHDLEVVGN

SEQ ID NO: 1377855 - protein, 9 aa, Homo Sapiens
ALAKLEHPR

SEQ ID NO: 1377856 - protein, 9 aa, Homo Sapiens
RSLGKGDWF

SEQ ID NO: 1377857 - protein, 9 aa, Homo Sapiens
ALLGIGDLE

SEQ ID NO: 1377858 - protein, 9 aa, Homo Sapiens
SQSPIPCKL

SEQ ID NO: 1377859 - protein, 9 aa, Homo Sapiens
GIGDLETMP

SEQ ID NO: 1377860 - protein, 9 aa, Homo Sapiens
KSSDQAIIT

SEQ ID NO: 1377861 - protein, 9 aa, Homo Sapiens
LQDSQALTI

SEQ ID NO: 1377862 - protein, 9 aa, Homo Sapiens
GSLRSMVKS

SEQ ID NO: 1377863 - protein, 9 aa, Homo Sapiens
NVLKSSLTH

SEQ ID NO: 1377864 - protein, 9 aa, Homo Sapiens
PVTRCNFTS

SEQ ID NO: 1377865 - protein, 9 aa, Homo Sapiens
PRWWTSATT

SEQ ID NO: 1377866 - protein, 9 aa, Homo Sapiens
GCDTSDKVF

SEQ ID NO: 1377867 - protein, 9 aa, Homo Sapiens
NSWSQCSVT

SEQ ID NO: 1377868 - protein, 9 aa, Homo Sapiens
RGEFRLQDD

SEQ ID NO: 1377869 - protein, 9 aa, Homo Sapiens
KGQHGMSEM

SEQ ID NO: 1377870 - protein, 9 aa, Homo Sapiens
EEDPEAADR

SEQ ID NO: 1377871 - protein, 9 aa, Homo Sapiens
AVEIPHLIQ

SEQ ID NO: 1377872 - protein, 9 aa, Homo Sapiens
IKALIDQKV

SEQ ID NO: 1377873 - protein, 9 aa, Homo Sapiens
PESLLDDDV

SEQ ID NO: 1377874 - protein, 9 aa, Homo Sapiens
HSGRQHPGA

SEQ ID NO: 1377875 - protein, 9 aa, Homo Sapiens
ICTGRNLYG

SEQ ID NO: 1377876 - protein, 9 aa, Homo Sapiens
KCTGVCDCA

SEQ ID NO: 1377877 - protein, 9 aa, Homo Sapiens
SLVLDHQPD

SEQ ID NO: 1377878 - protein, 9 aa, Homo Sapiens
QCGNNFSQS

SEQ ID NO: 1377879 - protein, 9 aa, Homo Sapiens
VYIREDDGK

SEQ ID NO: 1377880 - protein, 9 aa, Homo Sapiens
RHLTSLALP

SEQ ID NO: 1377881 - protein, 9 aa, Homo Sapiens
TGTCQHTQL

SEQ ID NO: 1377882 - protein, 9 aa, Homo Sapiens
VLKSSLTHV

SEQ ID NO: 1377883 - protein, 9 aa, Homo Sapiens
PEAADRGEP

SEQ ID NO: 1377884 - protein, 9 aa, Homo Sapiens
VELVSTAEK

SEQ ID NO: 1377885 - protein, 9 aa, Homo Sapiens
NSSPESLLD

SEQ ID NO: 1377886 - protein, 9 aa, Homo Sapiens
VIRRRHLQR

SEQ ID NO: 1377887 - protein, 9 aa, Homo Sapiens
KYVSPLNRS

SEQ ID NO: 1377888 - protein, 9 aa, Homo Sapiens
DRRKGSLDI

SEQ ID NO: 1377889 - protein, 9 aa, Homo Sapiens
VWDTLTLKC

SEQ ID NO: 1377890 - protein, 9 aa, Homo Sapiens
GAMMEVASV

SEQ ID NO: 1377891 - protein, 9 aa, Homo Sapiens
EDIFGLVVF

SEQ ID NO: 1377892 - protein, 9 aa, Homo Sapiens
VLYPGCDTS

SEQ ID NO: 1377893 - protein, 9 aa, Homo Sapiens
LQSANPGEH

SEQ ID NO: 1377894 - protein, 9 aa, Homo Sapiens
SSPAPIATI

SEQ ID NO: 1377895 - protein, 9 aa, Homo Sapiens
VDDEEFIRG

SEQ ID NO: 1377896 - protein, 9 aa, Homo Sapiens
IWRKHSACA

SEQ ID NO: 1377897 - protein, 9 aa, Homo Sapiens
LNSLKNFLL

SEQ ID NO: 1377898 - protein, 9 aa, Homo Sapiens
AEAKEMENN

SEQ ID NO: 1377899 - protein, 9 aa, Homo Sapiens
AVSFEEIVI

SEQ ID NO: 1377900 - protein, 9 aa, Homo Sapiens
VSEDLTERA

SEQ ID NO: 1377901 - protein, 9 aa, Homo Sapiens
KTELVTSGP

SEQ ID NO: 1377902 - protein, 9 aa, Homo Sapiens
LTLKCLSLL

SEQ ID NO: 1377903 - protein, 9 aa, Homo Sapiens
NCKEAINVL

SEQ ID NO: 1377904 - protein, 9 aa, Homo Sapiens
PCVFHDLEV

SEQ ID NO: 1377905 - protein, 9 aa, Homo Sapiens
MRIAAYHMM

SEQ ID NO: 1377906 - protein, 9 aa, Homo Sapiens
IPTIATIPT

SEQ ID NO: 1377907 - protein, 9 aa, Homo Sapiens
DKTELVTSG

SEQ ID NO: 1377908 - protein, 9 aa, Homo Sapiens
PSKTGRQAG

SEQ ID NO: 1377909 - protein, 9 aa, Homo Sapiens
QALTIQLLA

SEQ ID NO: 1377910 - protein, 9 aa, Homo Sapiens
AVMEFREDS

SEQ ID NO: 1377911 - protein, 9 aa, Homo Sapiens
KERKQSFFA

SEQ ID NO: 1377912 - protein, 9 aa, Homo Sapiens
DPEAADRGE

SEQ ID NO: 1377913 - protein, 9 aa, Homo Sapiens
SQPLAGRPS

SEQ ID NO: 1377914 - protein, 9 aa, Homo Sapiens
GSRMTDRVP

SEQ ID NO: 1377915 - protein, 9 aa, Homo Sapiens
NHHVNRINF

SEQ ID NO: 1377916 - protein, 9 aa, Homo Sapiens
RYGPKCTGV

SEQ ID NO: 1377917 - protein, 9 aa, Homo Sapiens
HNGRWIGRL

SEQ ID NO: 1377918 - protein, 9 aa, Homo Sapiens
EKSLLLWNV

SEQ ID NO: 1377919 - protein, 9 aa, Homo Sapiens
AQGGEKRKD

SEQ ID NO: 1377920 - protein, 9 aa, Homo Sapiens
ENRAEKIWK

SEQ ID NO: 1377921 - protein, 9 aa, Homo Sapiens
SPSKTGRQA

SEQ ID NO: 1377922 - protein, 9 aa, Homo Sapiens
YPGCDTSDK

SEQ ID NO: 1377923 - protein, 9 aa, Homo Sapiens
ERFLGSVIR

SEQ ID NO: 1377924 - protein, 9 aa, Homo Sapiens
LLPCVFHDL

SEQ ID NO: 1377925 - protein, 9 aa, Homo Sapiens
KKERKQSFF

SEQ ID NO: 1377926 - protein, 9 aa, Homo Sapiens
GGEKRKDAP

SEQ ID NO: 1377927 - protein, 9 aa, Homo Sapiens
STKVFSSWD

SEQ ID NO: 1377928 - protein, 9 aa, Homo Sapiens
RKGSLDIKA

SEQ ID NO: 1377929 - protein, 9 aa, Homo Sapiens
WMSIQYDNV

SEQ ID NO: 1377930 - protein, 9 aa, Homo Sapiens
EKRKDAPRW

SEQ ID NO: 1377931 - protein, 9 aa, Homo Sapiens
SLTLREVSV

SEQ ID NO: 1377932 - protein, 9 aa, Homo Sapiens
EDETRTQGS

SEQ ID NO: 1377933 - protein, 9 aa, Homo Sapiens
NVLSHLPSH

SEQ ID NO: 1377934 - protein, 9 aa, Homo Sapiens
DIKAVASRA

SEQ ID NO: 1377935 - protein, 9 aa, Homo Sapiens
GLGPEDSLS

SEQ ID NO: 1377936 - protein, 9 aa, Homo Sapiens
RIPVPSSPA

SEQ ID NO: 1377937 - protein, 9 aa, Homo Sapiens
PNMTPSAVG

SEQ ID NO: 1377938 - protein, 9 aa, Homo Sapiens
CSQCGNNFS

SEQ ID NO: 1377939 - protein, 9 aa, Homo Sapiens
TPENRAEKI

SEQ ID NO: 1377940 - protein, 9 aa, Homo Sapiens
TPSALQATL

SEQ ID NO: 1377941 - protein, 9 aa, Homo Sapiens
WRKREKRLG

SEQ ID NO: 1377942 - protein, 9 aa, Homo Sapiens
VLSHLPSHH

SEQ ID NO: 1377943 - protein, 9 aa, Homo Sapiens
VSFEEIVII

SEQ ID NO: 1377944 - protein, 9 aa, Homo Sapiens
IPAILRTPK

SEQ ID NO: 1377945 - protein, 9 aa, Homo Sapiens
SYTRDLLGP

SEQ ID NO: 1377946 - protein, 9 aa, Homo Sapiens
FNQSLTLTR

SEQ ID NO: 1377947 - protein, 9 aa, Homo Sapiens
RMRIAAYHM

SEQ ID NO: 1377948 - protein, 9 aa, Homo Sapiens
VPLPVPRSS

SEQ ID NO: 1377949 - protein, 9 aa, Homo Sapiens
IIPLAQRLT

SEQ ID NO: 1377950 - protein, 9 aa, Homo Sapiens
EPEGERQHS

SEQ ID NO: 1377951 - protein, 9 aa, Homo Sapiens
FSFPISISA

SEQ ID NO: 1377952 - protein, 9 aa, Homo Sapiens
EFIRGRHIQ

SEQ ID NO: 1377953 - protein, 9 aa, Homo Sapiens
QLSSARPFP

SEQ ID NO: 1377954 - protein, 9 aa, Homo Sapiens
SCMGGMNRW

SEQ ID NO: 1377955 - protein, 9 aa, Homo Sapiens
SVLWIPAFV

SEQ ID NO: 1377956 - protein, 9 aa, Homo Sapiens
ENNYLNHHV

SEQ ID NO: 1377957 - protein, 9 aa, Homo Sapiens
YWMSIQYDN

SEQ ID NO: 1377958 - protein, 9 aa, Homo Sapiens
REVSVGPCL

SEQ ID NO: 1377959 - protein, 9 aa, Homo Sapiens
PNKYFLEQI

SEQ ID NO: 1377960 - protein, 9 aa, Homo Sapiens
IAAYHMMRN

SEQ ID NO: 1377961 - protein, 9 aa, Homo Sapiens
CNQNFIIHS

SEQ ID NO: 1377962 - protein, 9 aa, Homo Sapiens
VAHICDGPV

SEQ ID NO: 1377963 - protein, 9 aa, Homo Sapiens
LNHHVNRIN

SEQ ID NO: 1377964 - protein, 9 aa, Homo Sapiens
LVQRLAILT

SEQ ID NO: 1377965 - protein, 9 aa, Homo Sapiens
IFGLVVFLG

SEQ ID NO: 1377966 - protein, 9 aa, Homo Sapiens
ESEDEEEII

SEQ ID NO: 1377967 - protein, 9 aa, Homo Sapiens
LLKTRGEFR

SEQ ID NO: 1377968 - protein, 9 aa, Homo Sapiens
SSPESLLDD

SEQ ID NO: 1377969 - protein, 9 aa, Homo Sapiens
ERKQSFFAR

SEQ ID NO: 1377970 - protein, 9 aa, Homo Sapiens
LIDQKVKNG

SEQ ID NO: 1377971 - protein, 9 aa, Homo Sapiens
RSKLAASIL

SEQ ID NO: 1377972 - protein, 9 aa, Homo Sapiens
LRTPKERKP

SEQ ID NO: 1377973 - protein, 9 aa, Homo Sapiens
LEHPRIVRY

SEQ ID NO: 1377974 - protein, 9 aa, Homo Sapiens
EEIIPLAQR

SEQ ID NO: 1377975 - protein, 9 aa, Homo Sapiens
PAYLNSLKN

SEQ ID NO: 1377976 - protein, 9 aa, Homo Sapiens
NRSLKGKLV

SEQ ID NO: 1377977 - protein, 9 aa, Homo Sapiens
SSHGGLHSA

SEQ ID NO: 1377978 - protein, 9 aa, Homo Sapiens
NRVEENREP

SEQ ID NO: 1377979 - protein, 9 aa, Homo Sapiens
LSCFLHTRL

SEQ ID NO: 1377980 - protein, 9 aa, Homo Sapiens
KLVNSKKLS

SEQ ID NO: 1377981 - protein, 9 aa, Homo Sapiens
LYPGCDTSD

SEQ ID NO: 1377982 - protein, 9 aa, Homo Sapiens
RTNFTLEPL

SEQ ID NO: 1377983 - protein, 9 aa, Homo Sapiens
LIWRKHSAC

SEQ ID NO: 1377984 - protein, 9 aa, Homo Sapiens
IPCKLYSSS

SEQ ID NO: 1377985 - protein, 9 aa, Homo Sapiens
GPEDSLSTA

SEQ ID NO: 1377986 - protein, 9 aa, Homo Sapiens
PHNGRWIGR

SEQ ID NO: 1377987 - protein, 9 aa, Homo Sapiens
WQEWNSWSQ

SEQ ID NO: 1377988 - protein, 9 aa, Homo Sapiens
DDMNAPSHC

SEQ ID NO: 1377989 - protein, 9 aa, Homo Sapiens
IYEKQRDFE

SEQ ID NO: 1377990 - protein, 9 aa, Homo Sapiens
SPIPCKLYS

SEQ ID NO: 1377991 - protein, 9 aa, Homo Sapiens
VQRGLEDIF

SEQ ID NO: 1377992 - protein, 9 aa, Homo Sapiens
LRSLGKGDW

SEQ ID NO: 1377993 - protein, 9 aa, Homo Sapiens
DMPIPCNQN

SEQ ID NO: 1377994 - protein, 9 aa, Homo Sapiens
ALIDQKVKN

SEQ ID NO: 1377995 - protein, 9 aa, Homo Sapiens
VFSHIFLLC

SEQ ID NO: 1377996 - protein, 9 aa, Homo Sapiens
HDLEVVGNP

SEQ ID NO: 1377997 - protein, 9 aa, Homo Sapiens
PTFTQQLQS

SEQ ID NO: 1377998 - protein, 9 aa, Homo Sapiens
PVPSSPAPI

SEQ ID NO: 1377999 - protein, 9 aa, Homo Sapiens
GRWIGRLAT

SEQ ID NO: 1378000 - protein, 9 aa, Homo Sapiens
GGLHSANRE

SEQ ID NO: 1378001 - protein, 9 aa, Homo Sapiens
LGALSVPIS

SEQ ID NO: 1378002 - protein, 9 aa, Homo Sapiens
NDMPIPCNQ

SEQ ID NO: 1378003 - protein, 9 aa, Homo Sapiens
SKRYGFVSF

SEQ ID NO: 1378004 - protein, 9 aa, Homo Sapiens
SFFARLKKK

SEQ ID NO: 1378005 - protein, 9 aa, Homo Sapiens
PAPIATIDL

SEQ ID NO: 1378006 - protein, 9 aa, Homo Sapiens
MENNENSNS

SEQ ID NO: 1378007 - protein, 9 aa, Homo Sapiens
KEEIEVMSK

SEQ ID NO: 1378008 - protein, 9 aa, Homo Sapiens
SPESLLDDD

SEQ ID NO: 1378009 - protein, 9 aa, Homo Sapiens
EESLVNMTS

SEQ ID NO: 1378010 - protein, 9 aa, Homo Sapiens
RLGGSSVMA

SEQ ID NO: 1378011 - protein, 9 aa, Homo Sapiens
DVLLFVELV

SEQ ID NO: 1378012 - protein, 9 aa, Homo Sapiens
IRRRHLQRI

SEQ ID NO: 1378013 - protein, 9 aa, Homo Sapiens
TSQETLRVL

SEQ ID NO: 1378014 - protein, 9 aa, Homo Sapiens
GNDAGRFRL

SEQ ID NO: 1378015 - protein, 9 aa, Homo Sapiens
LTLREVSVG

SEQ ID NO: 1378016 - protein, 9 aa, Homo Sapiens
DLGLGPEDS

SEQ ID NO: 1378017 - protein, 9 aa, Homo Sapiens
ACAEGCQPL

SEQ ID NO: 1378018 - protein, 9 aa, Homo Sapiens
APTFTQQLQ

SEQ ID NO: 1378019 - protein, 9 aa, Homo Sapiens
CNFTSQETL

SEQ ID NO: 1378020 - protein, 9 aa, Homo Sapiens
CMGGMNRWP

SEQ ID NO: 1378021 - protein, 9 aa, Homo Sapiens
HPYMWEPQE

SEQ ID NO: 1378022 - protein, 9 aa, Homo Sapiens
QSANPGEHL

SEQ ID NO: 1378023 - protein, 9 aa, Homo Sapiens
LVAAFEESL

SEQ ID NO: 1378024 - protein, 9 aa, Homo Sapiens
NDAGRFRLD

SEQ ID NO: 1378025 - protein, 9 aa, Homo Sapiens
SSLYIDITV

SEQ ID NO: 1378026 - protein, 9 aa, Homo Sapiens
QQLQSVVVL

SEQ ID NO: 1378027 - protein, 9 aa, Homo Sapiens
TVDDEEFIR

SEQ ID NO: 1378028 - protein, 9 aa, Homo Sapiens
SRMRIAAYH

SEQ ID NO: 1378029 - protein, 9 aa, Homo Sapiens
LARPERARL

SEQ ID NO: 1378030 - protein, 9 aa, Homo Sapiens
ALGAPGPDG

SEQ ID NO: 1378031 - protein, 9 aa, Homo Sapiens
LNIPAILRT

SEQ ID NO: 1378032 - protein, 9 aa, Homo Sapiens
RSMVKSLLL

SEQ ID NO: 1378033 - protein, 9 aa, Homo Sapiens
RWIGRLATD

SEQ ID NO: 1378034 - protein, 9 aa, Homo Sapiens
KYLARPERA

SEQ ID NO: 1378035 - protein, 9 aa, Homo Sapiens
KWRKREKRL

SEQ ID NO: 1378036 - protein, 9 aa, Homo Sapiens
VLLFVELVS

SEQ ID NO: 1378037 - protein, 9 aa, Homo Sapiens
AASILGGVD

SEQ ID NO: 1378038 - protein, 9 aa, Homo Sapiens
SALQATLNY

SEQ ID NO: 1378039 - protein, 9 aa, Homo Sapiens
SVIRRRHLQ

SEQ ID NO: 1378040 - protein, 9 aa, Homo Sapiens
NIPAILRTP

SEQ ID NO: 1378041 - protein, 9 aa, Homo Sapiens
IGDLETMPD

SEQ ID NO: 1378042 - protein, 9 aa, Homo Sapiens
GALSVPISA

SEQ ID NO: 1378043 - protein, 9 aa, Homo Sapiens
QVSEDLTER

SEQ ID NO: 1378044 - protein, 9 aa, Homo Sapiens
ELVTSGPMS

SEQ ID NO: 1378045 - protein, 9 aa, Homo Sapiens
FIRGRHIQR

SEQ ID NO: 1378046 - protein, 9 aa, Homo Sapiens
PQEDLLSPV

SEQ ID NO: 1378047 - protein, 9 aa, Homo Sapiens
VQRLAILTG

SEQ ID NO: 1378048 - protein, 9 aa, Homo Sapiens
MNRWPILTI

SEQ ID NO: 1378049 - protein, 9 aa, Homo Sapiens
GVGRHLTSL

SEQ ID NO: 1378050 - protein, 9 aa, Homo Sapiens
SGRQHPGAD

SEQ ID NO: 1378051 - protein, 9 aa, Homo Sapiens
LHPDGLPAQ

SEQ ID NO: 1378052 - protein, 9 aa, Homo Sapiens
PDDENTPEN

SEQ ID NO: 1378053 - protein, 9 aa, Homo Sapiens
PLPVPRSSL

SEQ ID NO: 1378054 - protein, 9 aa, Homo Sapiens
INIHEMEAK

SEQ ID NO: 1378055 - protein, 9 aa, Homo Sapiens
GGRRYLLRW

SEQ ID NO: 1378056 - protein, 9 aa, Homo Sapiens
RGLEDIFGL

SEQ ID NO: 1378057 - protein, 9 aa, Homo Sapiens
TLTLKCLSL

SEQ ID NO: 1378058 - protein, 9 aa, Homo Sapiens
MSGWLQLLS

SEQ ID NO: 1378059 - protein, 9 aa, Homo Sapiens
PHLIQKGVI

SEQ ID NO: 1378060 - protein, 9 aa, Homo Sapiens
VVEFSHRLN

SEQ ID NO: 1378061 - protein, 9 aa, Homo Sapiens
HNRPEALPN

SEQ ID NO: 1378062 - protein, 9 aa, Homo Sapiens
AAFEESLVN

SEQ ID NO: 1378063 - protein, 9 aa, Homo Sapiens
PSCSSLYID

SEQ ID NO: 1378064 - protein, 9 aa, Homo Sapiens
VMSKSIDFP

SEQ ID NO: 1378065 - protein, 9 aa, Homo Sapiens
KGASGIRED

SEQ ID NO: 1378066 - protein, 9 aa, Homo Sapiens
APIATIDLV

SEQ ID NO: 1378067 - protein, 9 aa, Homo Sapiens
RSCSLVLDH

SEQ ID NO: 1378068 - protein, 9 aa, Homo Sapiens
CTGRNLYGA

SEQ ID NO: 1378069 - protein, 9 aa, Homo Sapiens
AYWMSIQYD

SEQ ID NO: 1378070 - protein, 9 aa, Homo Sapiens
DPVFLRSLG

SEQ ID NO: 1378071 - protein, 9 aa, Homo Sapiens
RRYLLRWST

SEQ ID NO: 1378072 - protein, 9 aa, Homo Sapiens
LDALLGIGD

SEQ ID NO: 1378073 - protein, 9 aa, Homo Sapiens
CQPLLTPAP

SEQ ID NO: 1378074 - protein, 9 aa, Homo Sapiens
PDGLPAQGG

SEQ ID NO: 1378075 - protein, 9 aa, Homo Sapiens
EPLNELERL

SEQ ID NO: 1378076 - protein, 9 aa, Homo Sapiens
TLEPLNELE

SEQ ID NO: 1378077 - protein, 9 aa, Homo Sapiens
ARPERARLA

SEQ ID NO: 1378078 - protein, 9 aa, Homo Sapiens
DRGEPQNKR

SEQ ID NO: 1378079 - protein, 9 aa, Homo Sapiens
LLQSANPGE

SEQ ID NO: 1378080 - protein, 9 aa, Homo Sapiens
YGLCHCLPV

SEQ ID NO: 1378081 - protein, 9 aa, Homo Sapiens
FTSQETLRV

SEQ ID NO: 1378082 - protein, 9 aa, Homo Sapiens
LKVLTAENR

SEQ ID NO: 1378083 - protein, 9 aa, Homo Sapiens
SEDPVFLRS

SEQ ID NO: 1378084 - protein, 9 aa, Homo Sapiens
QDNSVDRMA

SEQ ID NO: 1378085 - protein, 9 aa, Homo Sapiens
DLDALLGIG

SEQ ID NO: 1378086 - protein, 9 aa, Homo Sapiens
SKLAASILG

SEQ ID NO: 1378087 - protein, 9 aa, Homo Sapiens
NRMLTSKLK

SEQ ID NO: 1378088 - protein, 9 aa, Homo Sapiens
MSIQYDNVG

SEQ ID NO: 1378089 - protein, 9 aa, Homo Sapiens
VGSPWTWLQ

SEQ ID NO: 1378090 - protein, 9 aa, Homo Sapiens
NFSQPLAGR

SEQ ID NO: 1378091 - protein, 9 aa, Homo Sapiens
PSALQATLN

SEQ ID NO: 1378092 - protein, 9 aa, Homo Sapiens
STFCFYLRI

SEQ ID NO: 1378093 - protein, 9 aa, Homo Sapiens
ADGAMMEVA

SEQ ID NO: 1378094 - protein, 9 aa, Homo Sapiens
TFQVFSHIF

SEQ ID NO: 1378095 - protein, 9 aa, Homo Sapiens
WTVDDEEFI

SEQ ID NO: 1378096 - protein, 9 aa, Homo Sapiens
GGVHPYMWE

SEQ ID NO: 1378097 - protein, 9 aa, Homo Sapiens
SKENNYLNH

SEQ ID NO: 1378098 - protein, 9 aa, Homo Sapiens
SQETLRVLL

SEQ ID NO: 1378099 - protein, 9 aa, Homo Sapiens
EQTKYLARP

SEQ ID NO: 1378100 - protein, 9 aa, Homo Sapiens
KTGRQAGRE

SEQ ID NO: 1378101 - protein, 9 aa, Homo Sapiens
TKENENKIK

SEQ ID NO: 1378102 - protein, 9 aa, Homo Sapiens
LAGRPSLLR

SEQ ID NO: 1378103 - protein, 9 aa, Homo Sapiens
REDETRTQG

SEQ ID NO: 1378104 - protein, 9 aa, Homo Sapiens
WGSTMSGWL

SEQ ID NO: 1378105 - protein, 9 aa, Homo Sapiens
WLAVEIPHL

SEQ ID NO: 1378106 - protein, 9 aa, Homo Sapiens
AADRGEPQN

SEQ ID NO: 1378107 - protein, 9 aa, Homo Sapiens
FWSNTHCSS

SEQ ID NO: 1378108 - protein, 9 aa, Homo Sapiens
KRYGFVSFF

SEQ ID NO: 1378109 - protein, 9 aa, Homo Sapiens
RKREKRLGG

SEQ ID NO: 1378110 - protein, 9 aa, Homo Sapiens
LEVVGNPRL

SEQ ID NO: 1378111 - protein, 9 aa, Homo Sapiens
EWNSWSQCS

SEQ ID NO: 1378112 - protein, 9 aa, Homo Sapiens
LGLGPEDSL

SEQ ID NO: 1378113 - protein, 9 aa, Homo Sapiens
KAAVSSFVQ

SEQ ID NO: 1378114 - protein, 9 aa, Homo Sapiens
NRWPILTII

SEQ ID NO: 1378115 - protein, 9 aa, Homo Sapiens
TPIPTIATI

SEQ ID NO: 1378116 - protein, 9 aa, Homo Sapiens
VEIPHLIQK

SEQ ID NO: 1378117 - protein, 9 aa, Homo Sapiens
WIPAFVVKG

SEQ ID NO: 1378118 - protein, 9 aa, Homo Sapiens
CFLHTRLGK

SEQ ID NO: 1378119 - protein, 9 aa, Homo Sapiens
IREDPNLVP

SEQ ID NO: 1378120 - protein, 9 aa, Homo Sapiens
HPGADPQGG

SEQ ID NO: 1378121 - protein, 9 aa, Homo Sapiens
QPLLTPAPL

SEQ ID NO: 1378122 - protein, 9 aa, Homo Sapiens
RYGFVSFFN

SEQ ID NO: 1378123 - protein, 9 aa, Homo Sapiens
GFCPHEAVF

SEQ ID NO: 1378124 - protein, 9 aa, Homo Sapiens
REAYGLCHC

SEQ ID NO: 1378125 - protein, 9 aa, Homo Sapiens
PIYEKQRDF

SEQ ID NO: 1378126 - protein, 9 aa, Homo Sapiens
SAVGRERHS

SEQ ID NO: 1378127 - protein, 9 aa, Homo Sapiens
FLRSLGKGD

SEQ ID NO: 1378128 - protein, 9 aa, Homo Sapiens
TLREVSVGP

SEQ ID NO: 1378129 - protein, 9 aa, Homo Sapiens
WRVQKALLH

SEQ ID NO: 1378130 - protein, 9 aa, Homo Sapiens
KHSGRQHPG

SEQ ID NO: 1378131 - protein, 9 aa, Homo Sapiens
DTSDKVFTY

SEQ ID NO: 1378132 - protein, 9 aa, Homo Sapiens
NNYLNHHVN

SEQ ID NO: 1378133 - protein, 9 aa, Homo Sapiens
STIEPQEDL

SEQ ID NO: 1378134 - protein, 9 aa, Homo Sapiens
RMLTSKLKE

SEQ ID NO: 1378135 - protein, 9 aa, Homo Sapiens
PVPNMTPSA

SEQ ID NO: 1378136 - protein, 9 aa, Homo Sapiens
NAAANVFRE

SEQ ID NO: 1378137 - protein, 9 aa, Homo Sapiens
VSPLNRSFR

SEQ ID NO: 1378138 - protein, 9 aa, Homo Sapiens
GTCQHTQLI

SEQ ID NO: 1378139 - protein, 9 aa, Homo Sapiens
VKSVSPQDN

SEQ ID NO: 1378140 - protein, 9 aa, Homo Sapiens
CNRADYFKL

SEQ ID NO: 1378141 - protein, 9 aa, Homo Sapiens
DIFGLVVFL

SEQ ID NO: 1378142 - protein, 9 aa, Homo Sapiens
ENRMLTSKL

SEQ ID NO: 1378143 - protein, 9 aa, Homo Sapiens
AHICDGPVF

SEQ ID NO: 1378144 - protein, 9 aa, Homo Sapiens
MVKSLLLVP

SEQ ID NO: 1378145 - protein, 9 aa, Homo Sapiens
DSDKEKRGE

SEQ ID NO: 1378146 - protein, 9 aa, Homo Sapiens
NSRTGVGRH

SEQ ID NO: 1378147 - protein, 9 aa, Homo Sapiens
HGKDSDKEK

SEQ ID NO: 1378148 - protein, 9 aa, Homo Sapiens
FRETWLIYK

SEQ ID NO: 1378149 - protein, 9 aa, Homo Sapiens
IACAEGCQP

SEQ ID NO: 1378150 - protein, 9 aa, Homo Sapiens
RGNDAGRFR

SEQ ID NO: 1378151 - protein, 9 aa, Homo Sapiens
DCPELNEAF

SEQ ID NO: 1378152 - protein, 9 aa, Homo Sapiens
DGAMMEVAS

SEQ ID NO: 1378153 - protein, 9 aa, Homo Sapiens
PLLTPAPLC

SEQ ID NO: 1378154 - protein, 9 aa, Homo Sapiens
SEDEEEIIP

SEQ ID NO: 1378155 - protein, 9 aa, Homo Sapiens
FQVFSHIFL

SEQ ID NO: 1378156 - protein, 9 aa, Homo Sapiens
DAGRFRLDI

SEQ ID NO: 1378157 - protein, 9 aa, Homo Sapiens
RKQSFFARL

SEQ ID NO: 1378158 - protein, 9 aa, Homo Sapiens
AMMEVASVC

SEQ ID NO: 1378159 - protein, 9 aa, Homo Sapiens
KSLLLWNVF

SEQ ID NO: 1378160 - protein, 9 aa, Homo Sapiens
VAGITGTCQ

SEQ ID NO: 1378161 - protein, 9 aa, Homo Sapiens
RPERARLAY

SEQ ID NO: 1378162 - protein, 9 aa, Homo Sapiens
GLGMAMVQV

SEQ ID NO: 1378163 - protein, 9 aa, Homo Sapiens
LDCPELNEA

SEQ ID NO: 1378164 - protein, 9 aa, Homo Sapiens
MAMVQVTSV

SEQ ID NO: 1378165 - protein, 9 aa, Homo Sapiens
ATPRSPQPQ

SEQ ID NO: 1378166 - protein, 9 aa, Homo Sapiens
EIIPLAQRL

SEQ ID NO: 1378167 - protein, 9 aa, Homo Sapiens
KNAAANVFR

SEQ ID NO: 1378168 - protein, 9 aa, Homo Sapiens
AGYVHFSYK

SEQ ID NO: 1378169 - protein, 9 aa, Homo Sapiens
HKFTPEIKD

SEQ ID NO: 1378170 - protein, 9 aa, Homo Sapiens
WPILTIITL

SEQ ID NO: 1378171 - protein, 9 aa, Homo Sapiens
QPNKYFLEQ

SEQ ID NO: 1378172 - protein, 9 aa, Homo Sapiens
TAENRMLTS

SEQ ID NO: 1378173 - protein, 9 aa, Homo Sapiens
GNFSFPISI

SEQ ID NO: 1378174 - protein, 9 aa, Homo Sapiens
TSQSPIPCK

SEQ ID NO: 1378175 - protein, 9 aa, Homo Sapiens
FLGSVIRRR

SEQ ID NO: 1378176 - protein, 9 aa, Homo Sapiens
VPSSPAPIA

SEQ ID NO: 1378177 - protein, 9 aa, Homo Sapiens
GHAGLAGAL

SEQ ID NO: 1378178 - protein, 9 aa, Homo Sapiens
YFLEQIDSA

SEQ ID NO: 1378179 - protein, 9 aa, Homo Sapiens
PEQNRVEEN

SEQ ID NO: 1378180 - protein, 9 aa, Homo Sapiens
SHCLPTDLF

SEQ ID NO: 1378181 - protein, 9 aa, Homo Sapiens
SDLPKPPSP

SEQ ID NO: 1378182 - protein, 9 aa, Homo Sapiens
PIPCKLYSS

SEQ ID NO: 1378183 - protein, 9 aa, Homo Sapiens
QVAHICDGP

SEQ ID NO: 1378184 - protein, 9 aa, Homo Sapiens
TKVFSSWDF

SEQ ID NO: 1378185 - protein, 9 aa, Homo Sapiens
LNVLKSSLT

SEQ ID NO: 1378186 - protein, 9 aa, Homo Sapiens
SQALTIQLL

SEQ ID NO: 1378187 - protein, 9 aa, Homo Sapiens
NGNFSFPIS

SEQ ID NO: 1378188 - protein, 9 aa, Homo Sapiens
QHSSMFLDS

SEQ ID NO: 1378189 - protein, 9 aa, Homo Sapiens
NGTSSKSSD

SEQ ID NO: 1378190 - protein, 9 aa, Homo Sapiens
EVASVCMGQ

SEQ ID NO: 1378191 - protein, 9 aa, Homo Sapiens
DETRTQGSR

SEQ ID NO: 1378192 - protein, 9 aa, Homo Sapiens
LDVLLFVEL

SEQ ID NO: 1378193 - protein, 9 aa, Homo Sapiens
LKEEIEVMS

SEQ ID NO: 1378194 - protein, 9 aa, Homo Sapiens
TCNRADYFK

SEQ ID NO: 1378195 - protein, 9 aa, Homo Sapiens
FEQTKYLAR

SEQ ID NO: 1378196 - protein, 9 aa, Homo Sapiens
SAEDLSNCR

SEQ ID NO: 1378197 - protein, 9 aa, Homo Sapiens
DHWGSTMSG

SEQ ID NO: 1378198 - protein, 9 aa, Homo Sapiens
LGGSSVMAE

SEQ ID NO: 1378199 - protein, 9 aa, Homo Sapiens
EDSLSTAPS

SEQ ID NO: 1378200 - protein, 9 aa, Homo Sapiens
QLRREKSLL

SEQ ID NO: 1378201 - protein, 9 aa, Homo Sapiens
TIPTILVSA

SEQ ID NO: 1378202 - protein, 9 aa, Homo Sapiens
ITGTCQHTQ

SEQ ID NO: 1378203 - protein, 9 aa, Homo Sapiens
ARPFPAQRN

SEQ ID NO: 1378204 - protein, 9 aa, Homo Sapiens
RREHQVAHI

SEQ ID NO: 1378205 - protein, 9 aa, Homo Sapiens
ELVSRQVSE

SEQ ID NO: 1378206 - protein, 9 aa, Homo Sapiens
ENTPENRAE

SEQ ID NO: 1378207 - protein, 9 aa, Homo Sapiens
ERQHSSMFL

SEQ ID NO: 1378208 - protein, 9 aa, Homo Sapiens
AIAYWMSIQ

SEQ ID NO: 1378209 - protein, 9 aa, Homo Sapiens
LLRWSTLDR

SEQ ID NO: 1378210 - protein, 9 aa, Homo Sapiens
DLSNCRDVA

SEQ ID NO: 1378211 - protein, 9 aa, Homo Sapiens
GDLETMPDD

SEQ ID NO: 1378212 - protein, 9 aa, Homo Sapiens
HEYNTSREY

SEQ ID NO: 1378213 - protein, 9 aa, Homo Sapiens
SRQVSEDLT

SEQ ID NO: 1378214 - protein, 9 aa, Homo Sapiens
RLQDDMNAP

SEQ ID NO: 1378215 - protein, 9 aa, Homo Sapiens
ILREAYGLC

SEQ ID NO: 1378216 - protein, 9 aa, Homo Sapiens
EDPEAADRG

SEQ ID NO: 1378217 - protein, 9 aa, Homo Sapiens
NTSREYDRL

SEQ ID NO: 1378218 - protein, 9 aa, Homo Sapiens
GRHLTSLAL

SEQ ID NO: 1378219 - protein, 9 aa, Homo Sapiens
ATTTLSLLL

SEQ ID NO: 1378220 - protein, 9 aa, Homo Sapiens
LSAEDLSNC

SEQ ID NO: 1378221 - protein, 9 aa, Homo Sapiens
KVQVVEFSH

SEQ ID NO: 1378222 - protein, 9 aa, Homo Sapiens
VNFSQPLAG

SEQ ID NO: 1378223 - protein, 9 aa, Homo Sapiens
VFTMGGNAE

SEQ ID NO: 1378224 - protein, 9 aa, Homo Sapiens
PWTWLQAQI

SEQ ID NO: 1378225 - protein, 9 aa, Homo Sapiens
RQHSSMFLD

SEQ ID NO: 1378226 - protein, 9 aa, Homo Sapiens
VSTIEPQED

SEQ ID NO: 1378227 - protein, 9 aa, Homo Sapiens
VFRETWLIY

SEQ ID NO: 1378228 - protein, 9 aa, Homo Sapiens
GERQHSSMF

SEQ ID NO: 1378229 - protein, 9 aa, Homo Sapiens
IIWDSVTWE

SEQ ID NO: 1378230 - protein, 9 aa, Homo Sapiens
HICDGPVFH

SEQ ID NO: 1378231 - protein, 9 aa, Homo Sapiens
SKDKTELVT

SEQ ID NO: 1378232 - protein, 9 aa, Homo Sapiens
EAKEMENNE

SEQ ID NO: 1378233 - protein, 9 aa, Homo Sapiens
ETINIHEME

SEQ ID NO: 1378234 - protein, 9 aa, Homo Sapiens
KSVSPQDNS

SEQ ID NO: 1378235 - protein, 9 aa, Homo Sapiens
PLSTKVFSS

SEQ ID NO: 1378236 - protein, 9 aa, Homo Sapiens
VIIWDSVTW

SEQ ID NO: 1378237 - protein, 9 aa, Homo Sapiens
EVYIREDDG

SEQ ID NO: 1378238 - protein, 9 aa, Homo Sapiens
LLGIGDLET

SEQ ID NO: 1378239 - protein, 9 aa, Homo Sapiens
EKRGEEDSE

SEQ ID NO: 1378240 - protein, 9 aa, Homo Sapiens
VGNPRLLKT

SEQ ID NO: 1378241 - protein, 9 aa, Homo Sapiens
APSHCLPTD

SEQ ID NO: 1378242 - protein, 9 aa, Homo Sapiens
GSPWTWLQA

SEQ ID NO: 1378243 - protein, 9 aa, Homo Sapiens
QHTQLIFVF

SEQ ID NO: 1378244 - protein, 9 aa, Homo Sapiens
ECREVYIRE

SEQ ID NO: 1378245 - protein, 9 aa, Homo Sapiens
EKRLGGSSV

SEQ ID NO: 1378246 - protein, 9 aa, Homo Sapiens
QQALSCFLH

SEQ ID NO: 1378247 - protein, 9 aa, Homo Sapiens
RSPQPQLST

SEQ ID NO: 1378248 - protein, 9 aa, Homo Sapiens
RCNGTSSKS

SEQ ID NO: 1378249 - protein, 9 aa, Homo Sapiens
SESEDEEEI

SEQ ID NO: 1378250 - protein, 9 aa, Homo Sapiens
GIGLGMAMV

SEQ ID NO: 1378251 - protein, 9 aa, Homo Sapiens
SDKVFTYAK

SEQ ID NO: 1378252 - protein, 9 aa, Homo Sapiens
GCQPLLTPA

SEQ ID NO: 1378253 - protein, 9 aa, Homo Sapiens
CPELNEAFL

SEQ ID NO: 1378254 - protein, 9 aa, Homo Sapiens
LEPLNELER

SEQ ID NO: 1378255 - protein, 9 aa, Homo Sapiens
LGPEDSLST

SEQ ID NO: 1378256 - protein, 9 aa, Homo Sapiens
FCPHEAVFT

SEQ ID NO: 1378257 - protein, 9 aa, Homo Sapiens
THCSSYKGY

SEQ ID NO: 1378258 - protein, 9 aa, Homo Sapiens
VLTAENRML

SEQ ID NO: 1378259 - protein, 9 aa, Homo Sapiens
SSDQAIITL

SEQ ID NO: 1378260 - protein, 9 aa, Homo Sapiens
TSDKVFTYA

SEQ ID NO: 1378261 - protein, 9 aa, Homo Sapiens
ADELPSDLP

SEQ ID NO: 1378262 - protein, 9 aa, Homo Sapiens
GRQHPGADP

SEQ ID NO: 1378263 - protein, 9 aa, Homo Sapiens
APSRSPSKT

SEQ ID NO: 1378264 - protein, 9 aa, Homo Sapiens
PEALPNSLL

SEQ ID NO: 1378265 - protein, 9 aa, Homo Sapiens
HPDGLPAQG

SEQ ID NO: 1378266 - protein, 9 aa, Homo Sapiens
EHQVAHICD

SEQ ID NO: 1378267 - protein, 9 aa, Homo Sapiens
GALGAPGPD

SEQ ID NO: 1378268 - protein, 9 aa, Homo Sapiens
GMNRWPILT

SEQ ID NO: 1378269 - protein, 9 aa, Homo Sapiens
VEPEQNRVE

SEQ ID NO: 1378270 - protein, 9 aa, Homo Sapiens
QVVEFSHRL

SEQ ID NO: 1378271 - protein, 9 aa, Homo Sapiens
LQDDMNAPS

SEQ ID NO: 1378272 - protein, 9 aa, Homo Sapiens
YEPEGERQH

SEQ ID NO: 1378273 - protein, 9 aa, Homo Sapiens
AFVVKGGEK

SEQ ID NO: 1378274 - protein, 9 aa, Homo Sapiens
CNGTSSKSS

SEQ ID NO: 1378275 - protein, 9 aa, Homo Sapiens
YLNHHVNRI

SEQ ID NO: 1378276 - protein, 9 aa, Homo Sapiens
VDRARVGSP

SEQ ID NO: 1378277 - protein, 9 aa, Homo Sapiens
KALIDQKVK

SEQ ID NO: 1378278 - protein, 9 aa, Homo Sapiens
MSKSIDFPL

SEQ ID NO: 1378279 - protein, 9 aa, Homo Sapiens
RWWTSATTT

SEQ ID NO: 1378280 - protein, 9 aa, Homo Sapiens
LYIDITVLR

SEQ ID NO: 1378281 - protein, 9 aa, Homo Sapiens
VAAFEESLV

SEQ ID NO: 1378282 - protein, 9 aa, Homo Sapiens
YKQERSYTR

SEQ ID NO: 1378283 - protein, 9 aa, Homo Sapiens
NIKALIDQK

SEQ ID NO: 1378284 - protein, 9 aa, Homo Sapiens
AEDLSNCRD

SEQ ID NO: 1378285 - protein, 9 aa, Homo Sapiens
AAYHMMRNL

SEQ ID NO: 1378286 - protein, 9 aa, Homo Sapiens
APRWWTSAT

SEQ ID NO: 1378287 - protein, 9 aa, Homo Sapiens
IRGRHIQRG

SEQ ID NO: 1378288 - protein, 9 aa, Homo Sapiens
GASGIREDP

SEQ ID NO: 1378289 - protein, 9 aa, Homo Sapiens
NATKAAVSS

SEQ ID NO: 1378290 - protein, 9 aa, Homo Sapiens
YSVSTIEPQ

SEQ ID NO: 1378291 - protein, 9 aa, Homo Sapiens
LQATLNYGS

SEQ ID NO: 1378292 - protein, 9 aa, Homo Sapiens
ATIPTILVS

SEQ ID NO: 1378293 - protein, 9 aa, Homo Sapiens
VSHNRPEAL

SEQ ID NO: 1378294 - protein, 9 aa, Homo Sapiens
SSGFWSNTH

SEQ ID NO: 1378295 - protein, 9 aa, Homo Sapiens
DGQWQEWNS

SEQ ID NO: 1378296 - protein, 9 aa, Homo Sapiens
KRGEEDSEN

SEQ ID NO: 1378297 - protein, 9 aa, Homo Sapiens
YSLDVLLFV

SEQ ID NO: 1378298 - protein, 9 aa, Homo Sapiens
REYKQERSY

SEQ ID NO: 1378299 - protein, 9 aa, Homo Sapiens
HLIQKGVIQ

SEQ ID NO: 1378300 - protein, 9 aa, Homo Sapiens
KRKDAPRWW

SEQ ID NO: 1378301 - protein, 9 aa, Homo Sapiens
QNRVEENRE

SEQ ID NO: 1378302 - protein, 9 aa, Homo Sapiens
MDNGFAGYV

SEQ ID NO: 1378303 - protein, 9 aa, Homo Sapiens
SLKNFLLRV

SEQ ID NO: 1378304 - protein, 9 aa, Homo Sapiens
LKTRGEFRL

SEQ ID NO: 1378305 - protein, 9 aa, Homo Sapiens
FPDTKTLVQ

SEQ ID NO: 1378306 - protein, 9 aa, Homo Sapiens
LHSANRETA

SEQ ID NO: 1378307 - protein, 9 aa, Homo Sapiens
QPQLSTFPK

SEQ ID NO: 1378308 - protein, 9 aa, Homo Sapiens
LSTFCFYLR

SEQ ID NO: 1378309 - protein, 9 aa, Homo Sapiens
CAEGCQPLL

SEQ ID NO: 1378310 - protein, 9 aa, Homo Sapiens
CDTSDKVFT

SEQ ID NO: 1378311 - protein, 9 aa, Homo Sapiens
AAPSRSPSK

SEQ ID NO: 1378312 - protein, 9 aa, Homo Sapiens
VSRQVSEDL

SEQ ID NO: 1378313 - protein, 9 aa, Homo Sapiens
FRLQDDMNA

SEQ ID NO: 1378314 - protein, 9 aa, Homo Sapiens
GLHSANRET

SEQ ID NO: 1378315 - protein, 9 aa, Homo Sapiens
VEENREPFR

SEQ ID NO: 1378316 - protein, 9 aa, Homo Sapiens
TVAKVQVVE

SEQ ID NO: 1378317 - protein, 9 aa, Homo Sapiens
NFTSQETLR

SEQ ID NO: 1378318 - protein, 9 aa, Homo Sapiens
SSLFSESFV

SEQ ID NO: 1378319 - protein, 9 aa, Homo Sapiens
IPCNQNFII

SEQ ID NO: 1378320 - protein, 9 aa, Homo Sapiens
AYHMMRNLT

SEQ ID NO: 1378321 - protein, 9 aa, Homo Sapiens
LRREKSLLL

SEQ ID NO: 1378322 - protein, 9 aa, Homo Sapiens
GITGTCQHT

SEQ ID NO: 1378323 - protein, 9 aa, Homo Sapiens
NEAFLNSQK

SEQ ID NO: 1378324 - protein, 9 aa, Homo Sapiens
AAGAGTFQV

SEQ ID NO: 1378325 - protein, 9 aa, Homo Sapiens
TPLGALSVP

SEQ ID NO: 1378326 - protein, 9 aa, Homo Sapiens
LHEYNTSRE

SEQ ID NO: 1378327 - protein, 9 aa, Homo Sapiens
SRSPSKTGR

SEQ ID NO: 1378328 - protein, 9 aa, Homo Sapiens
FNSSPESLL

SEQ ID NO: 1378329 - protein, 9 aa, Homo Sapiens
IADGAMMEV

SEQ ID NO: 1378330 - protein, 9 aa, Homo Sapiens
MVPQLRREK

SEQ ID NO: 1378331 - protein, 9 aa, Homo Sapiens
GNATKAAVS

SEQ ID NO: 1378332 - protein, 9 aa, Homo Sapiens
YLLRWSTLD

SEQ ID NO: 1378333 - protein, 9 aa, Homo Sapiens
PPRVICTGR

SEQ ID NO: 1378334 - protein, 9 aa, Homo Sapiens
AKEMENNEN

SEQ ID NO: 1378335 - protein, 9 aa, Homo Sapiens
RSSLFSESF

SEQ ID NO: 1378336 - protein, 9 aa, Homo Sapiens
KLHEYNTSR

SEQ ID NO: 1378337 - protein, 9 aa, Homo Sapiens
PTIATIPTI

SEQ ID NO: 1378338 - protein, 9 aa, Homo Sapiens
DGLIKETKE

SEQ ID NO: 1378339 - protein, 9 aa, Homo Sapiens
SACALVLHG

SEQ ID NO: 1378340 - protein, 9 aa, Homo Sapiens
PLNRSFRGQ

SEQ ID NO: 1378341 - protein, 9 aa, Homo Sapiens
EPQEDLLSP

SEQ ID NO: 1378342 - protein, 9 aa, Homo Sapiens
LKSSLTHVP

SEQ ID NO: 1378343 - protein, 9 aa, Homo Sapiens
VFHDLEVVG

SEQ ID NO: 1378344 - protein, 9 aa, Homo Sapiens
KSSLTHVPG

SEQ ID NO: 1378345 - protein, 9 aa, Homo Sapiens
SLTLTRHKI

SEQ ID NO: 1378346 - protein, 9 aa, Homo Sapiens
SYRCECREV

SEQ ID NO: 1378347 - protein, 9 aa, Homo Sapiens
ADRGEPQNK

SEQ ID NO: 1378348 - protein, 9 aa, Homo Sapiens
CVFHDLEVV

SEQ ID NO: 1378349 - protein, 9 aa, Homo Sapiens
GMSEMDGRW

SEQ ID NO: 1378350 - protein, 9 aa, Homo Sapiens
EVSVGPCLT

SEQ ID NO: 1378351 - protein, 9 aa, Homo Sapiens
KLEHPRIVR

SEQ ID NO: 1378352 - protein, 9 aa, Homo Sapiens
AKLEHPRIV

SEQ ID NO: 1378353 - protein, 9 aa, Homo Sapiens
QDLGLGPED

SEQ ID NO: 1378354 - protein, 9 aa, Homo Sapiens
TGVSKRYGF

SEQ ID NO: 1378355 - protein, 9 aa, Homo Sapiens
VVGNPRLLK

SEQ ID NO: 1378356 - protein, 9 aa, Homo Sapiens
LVVNFSQPL

SEQ ID NO: 1378357 - protein, 9 aa, Homo Sapiens
LFVELVSTA

SEQ ID NO: 1378358 - protein, 9 aa, Homo Sapiens
QLSTFPKKP

SEQ ID NO: 1378359 - protein, 9 aa, Homo Sapiens
IAYWMSIQY

SEQ ID NO: 1378360 - protein, 9 aa, Homo Sapiens
ARVGSPWTW

SEQ ID NO: 1378361 - protein, 9 aa, Homo Sapiens
APLSTKVFS

SEQ ID NO: 1378362 - protein, 9 aa, Homo Sapiens
LSSARPFPA

SEQ ID NO: 1378363 - protein, 9 aa, Homo Sapiens
RLLKTRGEF

SEQ ID NO: 1378364 - protein, 9 aa, Homo Sapiens
VQKALLHKF

SEQ ID NO: 1378365 - protein, 9 aa, Homo Sapiens
VHPYMWEPQ

SEQ ID NO: 1378366 - protein, 9 aa, Homo Sapiens
REHQVAHIC

SEQ ID NO: 1378367 - protein, 9 aa, Homo Sapiens
NFTLEPLNE

SEQ ID NO: 1378368 - protein, 9 aa, Homo Sapiens
LDIKAVASR

SEQ ID NO: 1378369 - protein, 9 aa, Homo Sapiens
SLRSMVKSL

SEQ ID NO: 1378370 - protein, 9 aa, Homo Sapiens
SEGMAGGIN

SEQ ID NO: 1378371 - protein, 9 aa, Homo Sapiens
GLCHCLPVL

SEQ ID NO: 1378372 - protein, 9 aa, Homo Sapiens
IDQKVKNGI

SEQ ID NO: 1378373 - protein, 9 aa, Homo Sapiens
TKYLARPER

SEQ ID NO: 1378374 - protein, 9 aa, Homo Sapiens
EAVFTMGGN

SEQ ID NO: 1378375 - protein, 9 aa, Homo Sapiens
TIATIPTIL

SEQ ID NO: 1378376 - protein, 9 aa, Homo Sapiens
LAVEIPHLI

SEQ ID NO: 1378377 - protein, 9 aa, Homo Sapiens
NPGEHLAQG

SEQ ID NO: 1378378 - protein, 9 aa, Homo Sapiens
DEEFIRGRH

SEQ ID NO: 1378379 - protein, 9 aa, Homo Sapiens
AILRTPKER

SEQ ID NO: 1378380 - protein, 9 aa, Homo Sapiens
ADYFKLAPI

SEQ ID NO: 1378381 - protein, 9 aa, Homo Sapiens
DSLSTAPSC

SEQ ID NO: 1378382 - protein, 9 aa, Homo Sapiens
YGFCPHEAV

SEQ ID NO: 1378383 - protein, 9 aa, Homo Sapiens
HVWDTLTLK

SEQ ID NO: 1378384 - protein, 9 aa, Homo Sapiens
ELGRYGPKC

SEQ ID NO: 1378385 - protein, 9 aa, Homo Sapiens
LGRYGPKCT

SEQ ID NO: 1378386 - protein, 9 aa, Homo Sapiens
HQVAHICDG

SEQ ID NO: 1378387 - protein, 9 aa, Homo Sapiens
ISISADLAP

SEQ ID NO: 1378388 - protein, 9 aa, Homo Sapiens
ASSGFWSNT

SEQ ID NO: 1378389 - protein, 9 aa, Homo Sapiens
IQYLVRLGS

SEQ ID NO: 1378390 - protein, 9 aa, Homo Sapiens
SILGGVDQI

SEQ ID NO: 1378391 - protein, 9 aa, Homo Sapiens
IDITVLRTA

SEQ ID NO: 1378392 - protein, 9 aa, Homo Sapiens
IPAFVVKGG

SEQ ID NO: 1378393 - protein, 9 aa, Homo Sapiens
PHEAVFTMG

SEQ ID NO: 1378394 - protein, 9 aa, Homo Sapiens
LVLDHQPDN

SEQ ID NO: 1378395 - protein, 9 aa, Homo Sapiens
SRTNFTLEP

SEQ ID NO: 1378396 - protein, 9 aa, Homo Sapiens
VLDHQPDNI

SEQ ID NO: 1378397 - protein, 9 aa, Homo Sapiens
GNHLKETLY

SEQ ID NO: 1378398 - protein, 9 aa, Homo Sapiens
YFKLAPIMF

SEQ ID NO: 1378399 - protein, 9 aa, Homo Sapiens
KENNYLNHH

SEQ ID NO: 1378400 - protein, 9 aa, Homo Sapiens
ALNVLKSSL

SEQ ID NO: 1378401 - protein, 9 aa, Homo Sapiens
RVEENREPF

SEQ ID NO: 1378402 - protein, 9 aa, Homo Sapiens
FRSKLAASI

SEQ ID NO: 1378403 - protein, 9 aa, Homo Sapiens
QHGMSEMDG

SEQ ID NO: 1378404 - protein, 9 aa, Homo Sapiens
TCQHTQLIF

SEQ ID NO: 1378405 - protein, 9 aa, Homo Sapiens
AAIHVWDTL

SEQ ID NO: 1378406 - protein, 9 aa, Homo Sapiens
AVGRERHSC

SEQ ID NO: 1378407 - protein, 9 aa, Homo Sapiens
HLKETLYVE

SEQ ID NO: 1378408 - protein, 9 aa, Homo Sapiens
RTGVSKRYG

SEQ ID NO: 1378409 - protein, 9 aa, Homo Sapiens
GVHPYMWEP

SEQ ID NO: 1378410 - protein, 9 aa, Homo Sapiens
NGFAGYVHF

SEQ ID NO: 1378411 - protein, 9 aa, Homo Sapiens
FTQQLQSVV

SEQ ID NO: 1378412 - protein, 9 aa, Homo Sapiens
LGIGDLETM

SEQ ID NO: 1378413 - protein, 9 aa, Homo Sapiens
LHKFTPEIK

SEQ ID NO: 1378414 - protein, 9 aa, Homo Sapiens
KQRDFERLA

SEQ ID NO: 1378415 - protein, 9 aa, Homo Sapiens
TSREYDRLY

SEQ ID NO: 1378416 - protein, 9 aa, Homo Sapiens
PSRSPSKTG

SEQ ID NO: 1378417 - protein, 9 aa, Homo Sapiens
WRKHSACAL

SEQ ID NO: 1378418 - protein, 9 aa, Homo Sapiens
LREVSVGPC

SEQ ID NO: 1378419 - protein, 9 aa, Homo Sapiens
PRSSLFSES

SEQ ID NO: 1378420 - protein, 9 aa, Homo Sapiens
NRADYFKLA

SEQ ID NO: 1378421 - protein, 9 aa, Homo Sapiens
CQHTQLIFV

SEQ ID NO: 1378422 - protein, 9 aa, Homo Sapiens
VLWIPAFVV

SEQ ID NO: 1378423 - protein, 9 aa, Homo Sapiens
ARLHPDGLP

SEQ ID NO: 1378424 - protein, 9 aa, Homo Sapiens
DTVAKVQVV

SEQ ID NO: 1378425 - protein, 9 aa, Homo Sapiens
DGLPAQGGE

SEQ ID NO: 1378426 - protein, 9 aa, Homo Sapiens
KEKRGEEDS

SEQ ID NO: 1378427 - protein, 9 aa, Homo Sapiens
YLNSLKNFL

SEQ ID NO: 1378428 - protein, 9 aa, Homo Sapiens
ASGIREDPN

SEQ ID NO: 1378429 - protein, 9 aa, Homo Sapiens
ALSVPISAI

SEQ ID NO: 1378430 - protein, 9 aa, Homo Sapiens
FVELVSTAE

SEQ ID NO: 1378431 - protein, 9 aa, Homo Sapiens
RSLKGKLVN

SEQ ID NO: 1378432 - protein, 9 aa, Homo Sapiens
PAPARLHPD

SEQ ID NO: 1378433 - protein, 9 aa, Homo Sapiens
FSQPLAGRP

SEQ ID NO: 1378434 - protein, 9 aa, Homo Sapiens
RKDAPRWWT

SEQ ID NO: 1378435 - protein, 9 aa, Homo Sapiens
RYLLRWSTL

SEQ ID NO: 1378436 - protein, 9 aa, Homo Sapiens
FTLEPLNEL

SEQ ID NO: 1378437 - protein, 9 aa, Homo Sapiens
SSKSSDQAI

SEQ ID NO: 1378438 - protein, 9 aa, Homo Sapiens
SLDVLLFVE

SEQ ID NO: 1378439 - protein, 9 aa, Homo Sapiens
EEEIIPLAQ

SEQ ID NO: 1378440 - protein, 9 aa, Homo Sapiens
ESFSYGGVH

SEQ ID NO: 1378441 - protein, 9 aa, Homo Sapiens
MEVASVCMG

SEQ ID NO: 1378442 - protein, 9 aa, Homo Sapiens
GHITGLTAV

SEQ ID NO: 1378443 - protein, 9 aa, Homo Sapiens
KVKNGIPSN

SEQ ID NO: 1378444 - protein, 9 aa, Homo Sapiens
SQCGNNFSQ

SEQ ID NO: 1378445 - protein, 9 aa, Homo Sapiens
AIHVWDTLT

SEQ ID NO: 1378446 - protein, 9 aa, Homo Sapiens
KYFLEQIDS

SEQ ID NO: 1378447 - protein, 9 aa, Homo Sapiens
LFPDTKTLV

SEQ ID NO: 1378448 - protein, 9 aa, Homo Sapiens
FPISISADL

SEQ ID NO: 1378449 - protein, 9 aa, Homo Sapiens
TFCFYLRIF

SEQ ID NO: 1378450 - protein, 9 aa, Homo Sapiens
KETLYVEAI

SEQ ID NO: 1378451 - protein, 9 aa, Homo Sapiens
EIEVMSKSI

SEQ ID NO: 1378452 - protein, 9 aa, Homo Sapiens
SPQDNSVDR

SEQ ID NO: 1378453 - protein, 9 aa, Homo Sapiens
TSATTTLSL

SEQ ID NO: 1378454 - protein, 9 aa, Homo Sapiens
SFEEIVIIW

SEQ ID NO: 1378455 - protein, 9 aa, Homo Sapiens
RIIRGNDAG

SEQ ID NO: 1378456 - protein, 9 aa, Homo Sapiens
AANVFRETW

SEQ ID NO: 1378457 - protein, 9 aa, Homo Sapiens
NLDCPELNE

SEQ ID NO: 1378458 - protein, 9 aa, Homo Sapiens
YLARPERAR

SEQ ID NO: 1378459 - protein, 9 aa, Homo Sapiens
PVQRGLEDI

SEQ ID NO: 1378460 - protein, 9 aa, Homo Sapiens
RADYFKLAP

SEQ ID NO: 1378461 - protein, 9 aa, Homo Sapiens
DLSTFCFYL

SEQ ID NO: 1378462 - protein, 9 aa, Homo Sapiens
QKHSGRQHP

SEQ ID NO: 1378463 - protein, 9 aa, Homo Sapiens
YALNVLKSS

SEQ ID NO: 1378464 - protein, 9 aa, Homo Sapiens
LKETLYVEA

SEQ ID NO: 1378465 - protein, 9 aa, Homo Sapiens
GSTMSGWLQ

SEQ ID NO: 1378466 - protein, 9 aa, Homo Sapiens
KGSLDIKAV

SEQ ID NO: 1378467 - protein, 9 aa, Homo Sapiens
AENRMLTSK

SEQ ID NO: 1378468 - protein, 9 aa, Homo Sapiens
PSHCLPTDL

SEQ ID NO: 1378469 - protein, 9 aa, Homo Sapiens
RLHPDGLPA

SEQ ID NO: 1378470 - protein, 9 aa, Homo Sapiens
FCFYLRIFE

SEQ ID NO: 1378471 - protein, 9 aa, Homo Sapiens
AYLNSLKNF

SEQ ID NO: 1378472 - protein, 9 aa, Homo Sapiens
VVNFSQPLA

SEQ ID NO: 1378473 - protein, 9 aa, Homo Sapiens
LSLLLPCVF

SEQ ID NO: 1378474 - protein, 9 aa, Homo Sapiens
HSACALVLH

SEQ ID NO: 1378475 - protein, 9 aa, Homo Sapiens
TDRTGVSKR

SEQ ID NO: 1378476 - protein, 9 aa, Homo Sapiens
RARVGSPWT

SEQ ID NO: 1378477 - protein, 9 aa, Homo Sapiens
NHLKETLYV

SEQ ID NO: 1378478 - protein, 9 aa, Homo Sapiens
SYGGVHPYM

SEQ ID NO: 1378479 - protein, 9 aa, Homo Sapiens
MGGMNRWPI

SEQ ID NO: 1378480 - protein, 9 aa, Homo Sapiens
SMIVGNATK

SEQ ID NO: 1378481 - protein, 9 aa, Homo Sapiens
PKCTGVCDC

SEQ ID NO: 1378482 - protein, 9 aa, Homo Sapiens
VASVCMGQM

SEQ ID NO: 1378483 - protein, 9 aa, Homo Sapiens
DTSKDKTEL

SEQ ID NO: 1378484 - protein, 9 aa, Homo Sapiens
WWTSATTTL

SEQ ID NO: 1378485 - protein, 9 aa, Homo Sapiens
SFSYGGVHP

SEQ ID NO: 1378486 - protein, 9 aa, Homo Sapiens
LPVPRSSLF

SEQ ID NO: 1378487 - protein, 9 aa, Homo Sapiens
IKETKENEN

SEQ ID NO: 1378488 - protein, 9 aa, Homo Sapiens
SLGSLRSMV

SEQ ID NO: 1378489 - protein, 9 aa, Homo Sapiens
PAILRTPKE

SEQ ID NO: 1378490 - protein, 9 aa, Homo Sapiens
LTLTRHKII

SEQ ID NO: 1378491 - protein, 9 aa, Homo Sapiens
TTTLSLLLP

SEQ ID NO: 1378492 - protein, 9 aa, Homo Sapiens
GTFQVFSHI

SEQ ID NO: 1378493 - protein, 9 aa, Homo Sapiens
HHVNRINFY

SEQ ID NO: 1378494 - protein, 9 aa, Homo Sapiens
IHVWDTLTL

SEQ ID NO: 1378495 - protein, 9 aa, Homo Sapiens
LAPKGASGI

SEQ ID NO: 1378496 - protein, 9 aa, Homo Sapiens
ATPSALQAT

SEQ ID NO: 1378497 - protein, 9 aa, Homo Sapiens
PCNQNFIIH

SEQ ID NO: 1378498 - protein, 9 aa, Homo Sapiens
VKGQHGMSE

SEQ ID NO: 1378499 - protein, 9 aa, Homo Sapiens
TFTQQLQSV

SEQ ID NO: 1378500 - protein, 9 aa, Homo Sapiens
VPNMTPSAV

SEQ ID NO: 1378501 - protein, 9 aa, Homo Sapiens
RCNFTSQET

SEQ ID NO: 1378502 - protein, 9 aa, Homo Sapiens
IVGNATKAA

SEQ ID NO: 1378503 - protein, 9 aa, Homo Sapiens
EGERQHSSM

SEQ ID NO: 1378504 - protein, 9 aa, Homo Sapiens
PSSPAPIAT

SEQ ID NO: 1378505 - protein, 9 aa, Homo Sapiens
VAKVQVVEF

SEQ ID NO: 1378506 - protein, 9 aa, Homo Sapiens
PSEGMAGGI

SEQ ID NO: 1378507 - protein, 9 aa, Homo Sapiens
LDHQPDNIK

SEQ ID NO: 1378508 - protein, 9 aa, Homo Sapiens
DNGFAGYVH

SEQ ID NO: 1378509 - protein, 9 aa, Homo Sapiens
TPKERKPSK

SEQ ID NO: 1378510 - protein, 9 aa, Homo Sapiens
ERSYTRDLL

SEQ ID NO: 1378511 - protein, 9 aa, Homo Sapiens
GGMNRWPIL

SEQ ID NO: 1378512 - protein, 9 aa, Homo Sapiens
VTSQSPIPC

SEQ ID NO: 1378513 - protein, 9 aa, Homo Sapiens
SLLDDDVVI

SEQ ID NO: 1378514 - protein, 9 aa, Homo Sapiens
TPSAVGRER

SEQ ID NO: 1378515 - protein, 9 aa, Homo Sapiens
EADELPSDL

SEQ ID NO: 1378516 - protein, 9 aa, Homo Sapiens
NSLKNFLLR

SEQ ID NO: 1378517 - protein, 9 aa, Homo Sapiens
TQKHSGRQH

SEQ ID NO: 1378518 - protein, 9 aa, Homo Sapiens
PDTKTLVQR

SEQ ID NO: 1378519 - protein, 9 aa, Homo Sapiens
DRARVGSPW

SEQ ID NO: 1378520 - protein, 9 aa, Homo Sapiens
LSTKVFSSW

SEQ ID NO: 1378521 - protein, 9 aa, Homo Sapiens
PFRSKLAAS

SEQ ID NO: 1378522 - protein, 9 aa, Homo Sapiens
AAEAKEMEN

SEQ ID NO: 1378523 - protein, 9 aa, Homo Sapiens
NRAEKIWKY

SEQ ID NO: 1378524 - protein, 9 aa, Homo Sapiens
IVKGQHGMS

SEQ ID NO: 1378525 - protein, 9 aa, Homo Sapiens
IATIPTILV

SEQ ID NO: 1378526 - protein, 9 aa, Homo Sapiens
AVTSQSPIP

SEQ ID NO: 1378527 - protein, 9 aa, Homo Sapiens
HGMSEMDGR

SEQ ID NO: 1378528 - protein, 9 aa, Homo Sapiens
EIVIIWDSV

SEQ ID NO: 1378529 - protein, 9 aa, Homo Sapiens
VQVVEFSHR

SEQ ID NO: 1378530 - protein, 9 aa, Homo Sapiens
ASILGGVDQ

SEQ ID NO: 1378531 - protein, 9 aa, Homo Sapiens
MVQVTSVFG

SEQ ID NO: 1378532 - protein, 9 aa, Homo Sapiens
TRCNFTSQE

SEQ ID NO: 1378533 - protein, 9 aa, Homo Sapiens
RPEALPNSL

SEQ ID NO: 1378534 - protein, 9 aa, Homo Sapiens
AGTFQVFSH

SEQ ID NO: 1378535 - protein, 9 aa, Homo Sapiens
GAGTFQVFS

SEQ ID NO: 1378536 - protein, 9 aa, Homo Sapiens
IKAVASRAT

SEQ ID NO: 1378537 - protein, 9 aa, Homo Sapiens
YRIIRGNDA

SEQ ID NO: 1378538 - protein, 9 aa, Homo Sapiens
EEFIRGRHI

SEQ ID NO: 1378539 - protein, 9 aa, Homo Sapiens
DRAAEAKEM

SEQ ID NO: 1378540 - protein, 9 aa, Homo Sapiens
IHEMEAKAS

SEQ ID NO: 1378541 - protein, 9 aa, Homo Sapiens
NAPSHCLPT

SEQ ID NO: 1378542 - protein, 9 aa, Homo Sapiens
EVMSKSIDF

SEQ ID NO: 1378543 - protein, 9 aa, Homo Sapiens
RRRHLQRII

SEQ ID NO: 1378544 - protein, 9 aa, Homo Sapiens
YGGVHPYMW

SEQ ID NO: 1378545 - protein, 9 aa, Homo Sapiens
AGAGTFQVF

SEQ ID NO: 1378546 - protein, 9 aa, Homo Sapiens
VGNATKAAV

SEQ ID NO: 1378547 - protein, 9 aa, Homo Sapiens
QEALQDSQA

SEQ ID NO: 1378548 - protein, 9 aa, Homo Sapiens
RCECREVYI

SEQ ID NO: 1378549 - protein, 9 aa, Homo Sapiens
EETINIHEM

SEQ ID NO: 1378550 - protein, 9 aa, Homo Sapiens
PFPAQRNSQ

SEQ ID NO: 1378551 - protein, 9 aa, Homo Sapiens
FKWTCTVSR

SEQ ID NO: 1378552 - protein, 9 aa, Homo Sapiens
LQRVRKNHS

SEQ ID NO: 1378553 - protein, 9 aa, Homo Sapiens
LRYYFLVYN

SEQ ID NO: 1378554 - protein, 9 aa, Homo Sapiens
GNLSMEDFL

SEQ ID NO: 1378555 - protein, 9 aa, Homo Sapiens
HQRNAAPRP

SEQ ID NO: 1378556 - protein, 9 aa, Homo Sapiens
FVSGFVVFT

SEQ ID NO: 1378557 - protein, 9 aa, Homo Sapiens
ACSPSYTGG

SEQ ID NO: 1378558 - protein, 9 aa, Homo Sapiens
HCLECWSTY

SEQ ID NO: 1378559 - protein, 9 aa, Homo Sapiens
WKDFLATSS

SEQ ID NO: 1378560 - protein, 9 aa, Homo Sapiens
EPRMRSSKE

SEQ ID NO: 1378561 - protein, 9 aa, Homo Sapiens
TRRRRQRRT

SEQ ID NO: 1378562 - protein, 9 aa, Homo Sapiens
NPRNGTSLR

SEQ ID NO: 1378563 - protein, 9 aa, Homo Sapiens
GELAFRKGG

SEQ ID NO: 1378564 - protein, 9 aa, Homo Sapiens
IRATPEASA

SEQ ID NO: 1378565 - protein, 9 aa, Homo Sapiens
IIRVVSFTE

SEQ ID NO: 1378566 - protein, 9 aa, Homo Sapiens
QHNFTLAFS

SEQ ID NO: 1378567 - protein, 9 aa, Homo Sapiens
SPPQLLFSS

SEQ ID NO: 1378568 - protein, 9 aa, Homo Sapiens
EEPVEGAVI

SEQ ID NO: 1378569 - protein, 9 aa, Homo Sapiens
PGQEETVHI

SEQ ID NO: 1378570 - protein, 9 aa, Homo Sapiens
YGKRSQTVG

SEQ ID NO: 1378571 - protein, 9 aa, Homo Sapiens
KIIFLTEGL

SEQ ID NO: 1378572 - protein, 9 aa, Homo Sapiens
MQNNRRELW

SEQ ID NO: 1378573 - protein, 9 aa, Homo Sapiens
CTRLHGNIL

SEQ ID NO: 1378574 - protein, 9 aa, Homo Sapiens
DQPDNIAHI

SEQ ID NO: 1378575 - protein, 9 aa, Homo Sapiens
AIGGGVARV

SEQ ID NO: 1378576 - protein, 9 aa, Homo Sapiens
PLESVRQIY

SEQ ID NO: 1378577 - protein, 9 aa, Homo Sapiens
LDPAKRQHN

SEQ ID NO: 1378578 - protein, 9 aa, Homo Sapiens
REKRQAVNM

SEQ ID NO: 1378579 - protein, 9 aa, Homo Sapiens
ATSVEVTVA

SEQ ID NO: 1378580 - protein, 9 aa, Homo Sapiens
LDHRKASVV

SEQ ID NO: 1378581 - protein, 9 aa, Homo Sapiens
LAALVDIVR

SEQ ID NO: 1378582 - protein, 9 aa, Homo Sapiens
NTPVIRKSR

SEQ ID NO: 1378583 - protein, 9 aa, Homo Sapiens
LQEDLAYSG

SEQ ID NO: 1378584 - protein, 9 aa, Homo Sapiens
TTKNFSCQW

SEQ ID NO: 1378585 - protein, 9 aa, Homo Sapiens
AGTNMVGER

SEQ ID NO: 1378586 - protein, 9 aa, Homo Sapiens
PMDIFDMFG

SEQ ID NO: 1378587 - protein, 9 aa, Homo Sapiens
KLALEPGSP

SEQ ID NO: 1378588 - protein, 9 aa, Homo Sapiens
TVKFTPTSV

SEQ ID NO: 1378589 - protein, 9 aa, Homo Sapiens
RSRVELLLG

SEQ ID NO: 1378590 - protein, 9 aa, Homo Sapiens
IKAKGAAVR

SEQ ID NO: 1378591 - protein, 9 aa, Homo Sapiens
WSLPAEPCP

SEQ ID NO: 1378592 - protein, 9 aa, Homo Sapiens
ALTLGVERT

SEQ ID NO: 1378593 - protein, 9 aa, Homo Sapiens
DNSESVTTV

SEQ ID NO: 1378594 - protein, 9 aa, Homo Sapiens
FPLGVEFVV

SEQ ID NO: 1378595 - protein, 9 aa, Homo Sapiens
PGTLPKAGA

SEQ ID NO: 1378596 - protein, 9 aa, Homo Sapiens
SPHIQRQVA

SEQ ID NO: 1378597 - protein, 9 aa, Homo Sapiens
RRGPQGGAQ

SEQ ID NO: 1378598 - protein, 9 aa, Homo Sapiens
RSMPPRQAQ

SEQ ID NO: 1378599 - protein, 9 aa, Homo Sapiens
SVRQIYSEH

SEQ ID NO: 1378600 - protein, 9 aa, Homo Sapiens
APPFPAKVQ

SEQ ID NO: 1378601 - protein, 9 aa, Homo Sapiens
CQRSTQTVF

SEQ ID NO: 1378602 - protein, 9 aa, Homo Sapiens
YQSVHTLGH

SEQ ID NO: 1378603 - protein, 9 aa, Homo Sapiens
FREVPQQRL

SEQ ID NO: 1378604 - protein, 9 aa, Homo Sapiens
RTQGLECRT

SEQ ID NO: 1378605 - protein, 9 aa, Homo Sapiens
PGDFREVPQ

SEQ ID NO: 1378606 - protein, 9 aa, Homo Sapiens
WKQRQARLG

SEQ ID NO: 1378607 - protein, 9 aa, Homo Sapiens
LLQAPLEQH

SEQ ID NO: 1378608 - protein, 9 aa, Homo Sapiens
QVPRLPAQL

SEQ ID NO: 1378609 - protein, 9 aa, Homo Sapiens
EQGAKKHTM

SEQ ID NO: 1378610 - protein, 9 aa, Homo Sapiens
LGDEIGRKV

SEQ ID NO: 1378611 - protein, 9 aa, Homo Sapiens
KLAEVGKCL

SEQ ID NO: 1378612 - protein, 9 aa, Homo Sapiens
PGEARAPLE

SEQ ID NO: 1378613 - protein, 9 aa, Homo Sapiens
ECGPVVAGR

SEQ ID NO: 1378614 - protein, 9 aa, Homo Sapiens
THPLLLPAP

SEQ ID NO: 1378615 - protein, 9 aa, Homo Sapiens
AWAPRSSCR

SEQ ID NO: 1378616 - protein, 9 aa, Homo Sapiens
FTTFDMGGH

SEQ ID NO: 1378617 - protein, 9 aa, Homo Sapiens
YTQENICQI

SEQ ID NO: 1378618 - protein, 9 aa, Homo Sapiens
LCHGQVQGQ

SEQ ID NO: 1378619 - protein, 9 aa, Homo Sapiens
LPSPRPPPL

SEQ ID NO: 1378620 - protein, 9 aa, Homo Sapiens
CGRPRGSKR

SEQ ID NO: 1378621 - protein, 9 aa, Homo Sapiens
KDIALVMQT

SEQ ID NO: 1378622 - protein, 9 aa, Homo Sapiens
QRRPRHGHH

SEQ ID NO: 1378623 - protein, 9 aa, Homo Sapiens
RHLHHLEAL

SEQ ID NO: 1378624 - protein, 9 aa, Homo Sapiens
GRPWEPSAL

SEQ ID NO: 1378625 - protein, 9 aa, Homo Sapiens
PTEEEKEDP

SEQ ID NO: 1378626 - protein, 9 aa, Homo Sapiens
DCNIYDSAT

SEQ ID NO: 1378627 - protein, 9 aa, Homo Sapiens
EVPPCDHHG

SEQ ID NO: 1378628 - protein, 9 aa, Homo Sapiens
LNYFLMCAP

SEQ ID NO: 1378629 - protein, 9 aa, Homo Sapiens
TCPIRSEGK

SEQ ID NO: 1378630 - protein, 9 aa, Homo Sapiens
SQSPHASLR

SEQ ID NO: 1378631 - protein, 9 aa, Homo Sapiens
EHVPSSPFQ

SEQ ID NO: 1378632 - protein, 9 aa, Homo Sapiens
VFECEVVNP

SEQ ID NO: 1378633 - protein, 9 aa, Homo Sapiens
PKKKSFSFI

SEQ ID NO: 1378634 - protein, 9 aa, Homo Sapiens
SYEVKPFLA

SEQ ID NO: 1378635 - protein, 9 aa, Homo Sapiens
TRSRFFLQF

SEQ ID NO: 1378636 - protein, 9 aa, Homo Sapiens
SLAIALFTS

SEQ ID NO: 1378637 - protein, 9 aa, Homo Sapiens
SVVVTYFVF

SEQ ID NO: 1378638 - protein, 9 aa, Homo Sapiens
CSPSYTGGR

SEQ ID NO: 1378639 - protein, 9 aa, Homo Sapiens
GVAFNLFML

SEQ ID NO: 1378640 - protein, 9 aa, Homo Sapiens
SLCCCCRCC

SEQ ID NO: 1378641 - protein, 9 aa, Homo Sapiens
GKSQLSLSL

SEQ ID NO: 1378642 - protein, 9 aa, Homo Sapiens
SEASITIAV

SEQ ID NO: 1378643 - protein, 9 aa, Homo Sapiens
FCFSCNLRT

SEQ ID NO: 1378644 - protein, 9 aa, Homo Sapiens
MSPIPPYPA

SEQ ID NO: 1378645 - protein, 9 aa, Homo Sapiens
KASEAGDVP

SEQ ID NO: 1378646 - protein, 9 aa, Homo Sapiens
ALVMQTEIE

SEQ ID NO: 1378647 - protein, 9 aa, Homo Sapiens
LTLPLTINL

SEQ ID NO: 1378648 - protein, 9 aa, Homo Sapiens
AAAVVMVVR

SEQ ID NO: 1378649 - protein, 9 aa, Homo Sapiens
VGTPAYVAP

SEQ ID NO: 1378650 - protein, 9 aa, Homo Sapiens
AVLQHGDEA

SEQ ID NO: 1378651 - protein, 9 aa, Homo Sapiens
EQSACHGYC

SEQ ID NO: 1378652 - protein, 9 aa, Homo Sapiens
KKNEPRMRS

SEQ ID NO: 1378653 - protein, 9 aa, Homo Sapiens
KSATNPPQL

SEQ ID NO: 1378654 - protein, 9 aa, Homo Sapiens
EAGESSHKE

SEQ ID NO: 1378655 - protein, 9 aa, Homo Sapiens
DRDSYVHEL

SEQ ID NO: 1378656 - protein, 9 aa, Homo Sapiens
MLARSSRAS

SEQ ID NO: 1378657 - protein, 9 aa, Homo Sapiens
TIFFCERIP

SEQ ID NO: 1378658 - protein, 9 aa, Homo Sapiens
ATLPINPTI

SEQ ID NO: 1378659 - protein, 9 aa, Homo Sapiens
CLLRHAWPI

SEQ ID NO: 1378660 - protein, 9 aa, Homo Sapiens
SWGLETNIP

SEQ ID NO: 1378661 - protein, 9 aa, Homo Sapiens
GTEEEISDT

SEQ ID NO: 1378662 - protein, 9 aa, Homo Sapiens
IQDVSMKFR

SEQ ID NO: 1378663 - protein, 9 aa, Homo Sapiens
VGAPRFSSV

SEQ ID NO: 1378664 - protein, 9 aa, Homo Sapiens
VPSSPFQVT

SEQ ID NO: 1378665 - protein, 9 aa, Homo Sapiens
NADLLFSDS

SEQ ID NO: 1378666 - protein, 9 aa, Homo Sapiens
KAFHEDYSR

SEQ ID NO: 1378667 - protein, 9 aa, Homo Sapiens
GNCTYQEGQ

SEQ ID NO: 1378668 - protein, 9 aa, Homo Sapiens
RTLYRDGML

SEQ ID NO: 1378669 - protein, 9 aa, Homo Sapiens
GSYTIVLKA

SEQ ID NO: 1378670 - protein, 9 aa, Homo Sapiens
GSHFWIQDK

SEQ ID NO: 1378671 - protein, 9 aa, Homo Sapiens
EASITIAVS

SEQ ID NO: 1378672 - protein, 9 aa, Homo Sapiens
RAVVDIVKR

SEQ ID NO: 1378673 - protein, 9 aa, Homo Sapiens
KVSKKKDSQ

SEQ ID NO: 1378674 - protein, 9 aa, Homo Sapiens
CKLGASGQE

SEQ ID NO: 1378675 - protein, 9 aa, Homo Sapiens
GVCHRTKVC

SEQ ID NO: 1378676 - protein, 9 aa, Homo Sapiens
QEVRGSHRG

SEQ ID NO: 1378677 - protein, 9 aa, Homo Sapiens
KYIMTCLYK

SEQ ID NO: 1378678 - protein, 9 aa, Homo Sapiens
DQREKAKKL

SEQ ID NO: 1378679 - protein, 9 aa, Homo Sapiens
QKKNEPRMR

SEQ ID NO: 1378680 - protein, 9 aa, Homo Sapiens
KRIPQDICP

SEQ ID NO: 1378681 - protein, 9 aa, Homo Sapiens
ARGSKDFSF

SEQ ID NO: 1378682 - protein, 9 aa, Homo Sapiens
PLVLKLLGR

SEQ ID NO: 1378683 - protein, 9 aa, Homo Sapiens
QKHETRRKS

SEQ ID NO: 1378684 - protein, 9 aa, Homo Sapiens
LGHPAGGHR

SEQ ID NO: 1378685 - protein, 9 aa, Homo Sapiens
ALVTIRSIC

SEQ ID NO: 1378686 - protein, 9 aa, Homo Sapiens
KKNLCCFKW

SEQ ID NO: 1378687 - protein, 9 aa, Homo Sapiens
LSMGGPETL

SEQ ID NO: 1378688 - protein, 9 aa, Homo Sapiens
HAVKIDGLT

SEQ ID NO: 1378689 - protein, 9 aa, Homo Sapiens
EIKENDRSL

SEQ ID NO: 1378690 - protein, 9 aa, Homo Sapiens
LVDIHLWQP

SEQ ID NO: 1378691 - protein, 9 aa, Homo Sapiens
TGVSELPGL

SEQ ID NO: 1378692 - protein, 9 aa, Homo Sapiens
FDMGGHVQA

SEQ ID NO: 1378693 - protein, 9 aa, Homo Sapiens
ELMNSVMVG

SEQ ID NO: 1378694 - protein, 9 aa, Homo Sapiens
KCPCRTLQT

SEQ ID NO: 1378695 - protein, 9 aa, Homo Sapiens
CAGTNMVGE

SEQ ID NO: 1378696 - protein, 9 aa, Homo Sapiens
VKKFRTWVE

SEQ ID NO: 1378697 - protein, 9 aa, Homo Sapiens
GGCLPPEPG

SEQ ID NO: 1378698 - protein, 9 aa, Homo Sapiens
IYKKDFGKN

SEQ ID NO: 1378699 - protein, 9 aa, Homo Sapiens
RKEELSRNS

SEQ ID NO: 1378700 - protein, 9 aa, Homo Sapiens
RSSSKASSI

SEQ ID NO: 1378701 - protein, 9 aa, Homo Sapiens
KAFKCSSAL

SEQ ID NO: 1378702 - protein, 9 aa, Homo Sapiens
AERYRAQGR

SEQ ID NO: 1378703 - protein, 9 aa, Homo Sapiens
ITWRKSAEC

SEQ ID NO: 1378704 - protein, 9 aa, Homo Sapiens
QPFRLCHVT

SEQ ID NO: 1378705 - protein, 9 aa, Homo Sapiens
QIDVAQKKI

SEQ ID NO: 1378706 - protein, 9 aa, Homo Sapiens
GDDYIFHCR

SEQ ID NO: 1378707 - protein, 9 aa, Homo Sapiens
VVMVVRPVA

SEQ ID NO: 1378708 - protein, 9 aa, Homo Sapiens
RGNPVPSYK

SEQ ID NO: 1378709 - protein, 9 aa, Homo Sapiens
HHSEYQQSP

SEQ ID NO: 1378710 - protein, 9 aa, Homo Sapiens
ANSTCWQGW

SEQ ID NO: 1378711 - protein, 9 aa, Homo Sapiens
KIFALLELL

SEQ ID NO: 1378712 - protein, 9 aa, Homo Sapiens
SALLQAPLE

SEQ ID NO: 1378713 - protein, 9 aa, Homo Sapiens
YIMTCLYKY

SEQ ID NO: 1378714 - protein, 9 aa, Homo Sapiens
CYWRLLKAL

SEQ ID NO: 1378715 - protein, 9 aa, Homo Sapiens
WNAVEMLKF

SEQ ID NO: 1378716 - protein, 9 aa, Homo Sapiens
GDHGVWAGG

SEQ ID NO: 1378717 - protein, 9 aa, Homo Sapiens
GRGHGEVPE

SEQ ID NO: 1378718 - protein, 9 aa, Homo Sapiens
ALQLGRNSI

SEQ ID NO: 1378719 - protein, 9 aa, Homo Sapiens
HHGDTLEGA

SEQ ID NO: 1378720 - protein, 9 aa, Homo Sapiens
ESSGDSDPY

SEQ ID NO: 1378721 - protein, 9 aa, Homo Sapiens
LLGRGPAAL

SEQ ID NO: 1378722 - protein, 9 aa, Homo Sapiens
LETSWGLET

SEQ ID NO: 1378723 - protein, 9 aa, Homo Sapiens
TMRSLKGAM

SEQ ID NO: 1378724 - protein, 9 aa, Homo Sapiens
EALQLGRNS

SEQ ID NO: 1378725 - protein, 9 aa, Homo Sapiens
FEHCSEVSE

SEQ ID NO: 1378726 - protein, 9 aa, Homo Sapiens
RFSSVVGLV

SEQ ID NO: 1378727 - protein, 9 aa, Homo Sapiens
HIFHERFPF

SEQ ID NO: 1378728 - protein, 9 aa, Homo Sapiens
TAWLQLQPA

SEQ ID NO: 1378729 - protein, 9 aa, Homo Sapiens
ASAWAPRSS

SEQ ID NO: 1378730 - protein, 9 aa, Homo Sapiens
AGGASWAHA

SEQ ID NO: 1378731 - protein, 9 aa, Homo Sapiens
LFQVSPHIQ

SEQ ID NO: 1378732 - protein, 9 aa, Homo Sapiens
TPGISQYLQ

SEQ ID NO: 1378733 - protein, 9 aa, Homo Sapiens
ERQLFEFFV

SEQ ID NO: 1378734 - protein, 9 aa, Homo Sapiens
HYPHFWKDF

SEQ ID NO: 1378735 - protein, 9 aa, Homo Sapiens
YHGTIDSLP

SEQ ID NO: 1378736 - protein, 9 aa, Homo Sapiens
HLHHLEALQ

SEQ ID NO: 1378737 - protein, 9 aa, Homo Sapiens
VTYFVFVIA

SEQ ID NO: 1378738 - protein, 9 aa, Homo Sapiens
NDIRVQLLN

SEQ ID NO: 1378739 - protein, 9 aa, Homo Sapiens
DGEFKNLKN

SEQ ID NO: 1378740 - protein, 9 aa, Homo Sapiens
AECKSRGSV

SEQ ID NO: 1378741 - protein, 9 aa, Homo Sapiens
VPRLPAQLP

SEQ ID NO: 1378742 - protein, 9 aa, Homo Sapiens
AELDPAKRQ

SEQ ID NO: 1378743 - protein, 9 aa, Homo Sapiens
NYNPFAWMF

SEQ ID NO: 1378744 - protein, 9 aa, Homo Sapiens
PKCPGGRRR

SEQ ID NO: 1378745 - protein, 9 aa, Homo Sapiens
RTVLENPRN

SEQ ID NO: 1378746 - protein, 9 aa, Homo Sapiens
WLVKRSRVE

SEQ ID NO: 1378747 - protein, 9 aa, Homo Sapiens
QKKREKRQA

SEQ ID NO: 1378748 - protein, 9 aa, Homo Sapiens
DDGEVEDEV

SEQ ID NO: 1378749 - protein, 9 aa, Homo Sapiens
LPATPITPA

SEQ ID NO: 1378750 - protein, 9 aa, Homo Sapiens
WGLKKIFAL

SEQ ID NO: 1378751 - protein, 9 aa, Homo Sapiens
IELAESFKS

SEQ ID NO: 1378752 - protein, 9 aa, Homo Sapiens
ELLEVEETR

SEQ ID NO: 1378753 - protein, 9 aa, Homo Sapiens
KQTGKKREP

SEQ ID NO: 1378754 - protein, 9 aa, Homo Sapiens
CLECWSTYS

SEQ ID NO: 1378755 - protein, 9 aa, Homo Sapiens
LVRPLWDKI

SEQ ID NO: 1378756 - protein, 9 aa, Homo Sapiens
KVYLKKKQI

SEQ ID NO: 1378757 - protein, 9 aa, Homo Sapiens
PKHARTFVV

SEQ ID NO: 1378758 - protein, 9 aa, Homo Sapiens
ECEVVNPDS

SEQ ID NO: 1378759 - protein, 9 aa, Homo Sapiens
LLALLLLLP

SEQ ID NO: 1378760 - protein, 9 aa, Homo Sapiens
SDLCQRSTQ

SEQ ID NO: 1378761 - protein, 9 aa, Homo Sapiens
VQSHAVKID

SEQ ID NO: 1378762 - protein, 9 aa, Homo Sapiens
EIVWNAVEM

SEQ ID NO: 1378763 - protein, 9 aa, Homo Sapiens
EGKAAWAEY

SEQ ID NO: 1378764 - protein, 9 aa, Homo Sapiens
LGISWSPDG

SEQ ID NO: 1378765 - protein, 9 aa, Homo Sapiens
CVAYAATRD

SEQ ID NO: 1378766 - protein, 9 aa, Homo Sapiens
SEPLQIIIN

SEQ ID NO: 1378767 - protein, 9 aa, Homo Sapiens
LEQQCELRV

SEQ ID NO: 1378768 - protein, 9 aa, Homo Sapiens
SCQWPTEGR

SEQ ID NO: 1378769 - protein, 9 aa, Homo Sapiens
SRTPPEAIT

SEQ ID NO: 1378770 - protein, 9 aa, Homo Sapiens
RVGEVLSSI

SEQ ID NO: 1378771 - protein, 9 aa, Homo Sapiens
PSPNYNPFA

SEQ ID NO: 1378772 - protein, 9 aa, Homo Sapiens
MTCLYKYVF

SEQ ID NO: 1378773 - protein, 9 aa, Homo Sapiens
MFSIGCAKQ

SEQ ID NO: 1378774 - protein, 9 aa, Homo Sapiens
APPMDSSYT

SEQ ID NO: 1378775 - protein, 9 aa, Homo Sapiens
LPLNSLHTV

SEQ ID NO: 1378776 - protein, 9 aa, Homo Sapiens
VAFLILFTM

SEQ ID NO: 1378777 - protein, 9 aa, Homo Sapiens
RGPGNQLRN

SEQ ID NO: 1378778 - protein, 9 aa, Homo Sapiens
APLPILCVF

SEQ ID NO: 1378779 - protein, 9 aa, Homo Sapiens
QAAWRKMQW

SEQ ID NO: 1378780 - protein, 9 aa, Homo Sapiens
AAHKDFKKG

SEQ ID NO: 1378781 - protein, 9 aa, Homo Sapiens
IDVQGKKIL

SEQ ID NO: 1378782 - protein, 9 aa, Homo Sapiens
SSAALPLNS

SEQ ID NO: 1378783 - protein, 9 aa, Homo Sapiens
AVTFEWTSS

SEQ ID NO: 1378784 - protein, 9 aa, Homo Sapiens
PDTAWLQLQ

SEQ ID NO: 1378785 - protein, 9 aa, Homo Sapiens
TTISHSPLQ

SEQ ID NO: 1378786 - protein, 9 aa, Homo Sapiens
TSSERGERA

SEQ ID NO: 1378787 - protein, 9 aa, Homo Sapiens
HAEMVHGAF

SEQ ID NO: 1378788 - protein, 9 aa, Homo Sapiens
IDSLPNLKE

SEQ ID NO: 1378789 - protein, 9 aa, Homo Sapiens
PRSSSKASS

SEQ ID NO: 1378790 - protein, 9 aa, Homo Sapiens
GHHEYTESM

SEQ ID NO: 1378791 - protein, 9 aa, Homo Sapiens
VLKLLGRGP

SEQ ID NO: 1378792 - protein, 9 aa, Homo Sapiens
TTGSQRIEI

SEQ ID NO: 1378793 - protein, 9 aa, Homo Sapiens
DFKKGSWCL

SEQ ID NO: 1378794 - protein, 9 aa, Homo Sapiens
VSEIFELSE

SEQ ID NO: 1378795 - protein, 9 aa, Homo Sapiens
SLEDPALLV

SEQ ID NO: 1378796 - protein, 9 aa, Homo Sapiens
PMQNNRREL

SEQ ID NO: 1378797 - protein, 9 aa, Homo Sapiens
CSLHGKKCA

SEQ ID NO: 1378798 - protein, 9 aa, Homo Sapiens
ISAVPTKSS

SEQ ID NO: 1378799 - protein, 9 aa, Homo Sapiens
YWLVQQHCL

SEQ ID NO: 1378800 - protein, 9 aa, Homo Sapiens
EEEGKAAWA

SEQ ID NO: 1378801 - protein, 9 aa, Homo Sapiens
PAPWTLTIQ

SEQ ID NO: 1378802 - protein, 9 aa, Homo Sapiens
PSQTARAPE

SEQ ID NO: 1378803 - protein, 9 aa, Homo Sapiens
DIFIVDQHD

SEQ ID NO: 1378804 - protein, 9 aa, Homo Sapiens
EPGLWREQQ

SEQ ID NO: 1378805 - protein, 9 aa, Homo Sapiens
LPLFLLLID

SEQ ID NO: 1378806 - protein, 9 aa, Homo Sapiens
NITVLGGEV

SEQ ID NO: 1378807 - protein, 9 aa, Homo Sapiens
ECQLGHPAG

SEQ ID NO: 1378808 - protein, 9 aa, Homo Sapiens
LKLKLRDKR

SEQ ID NO: 1378809 - protein, 9 aa, Homo Sapiens
GHTHSSAQI

SEQ ID NO: 1378810 - protein, 9 aa, Homo Sapiens
RWTGTGKNF

SEQ ID NO: 1378811 - protein, 9 aa, Homo Sapiens
TSRSDIYFT

SEQ ID NO: 1378812 - protein, 9 aa, Homo Sapiens
PPEGWKLLK

SEQ ID NO: 1378813 - protein, 9 aa, Homo Sapiens
CLNYCDELS

SEQ ID NO: 1378814 - protein, 9 aa, Homo Sapiens
LVWHYCTLT

SEQ ID NO: 1378815 - protein, 9 aa, Homo Sapiens
QSHSAVHGG

SEQ ID NO: 1378816 - protein, 9 aa, Homo Sapiens
QSSSDCNIY

SEQ ID NO: 1378817 - protein, 9 aa, Homo Sapiens
RLLGAVSKG

SEQ ID NO: 1378818 - protein, 9 aa, Homo Sapiens
GQHGPLTGW

SEQ ID NO: 1378819 - protein, 9 aa, Homo Sapiens
EHNYCRLIL

SEQ ID NO: 1378820 - protein, 9 aa, Homo Sapiens
RLKDIALVM

SEQ ID NO: 1378821 - protein, 9 aa, Homo Sapiens
LPLTINLLE

SEQ ID NO: 1378822 - protein, 9 aa, Homo Sapiens
DTVIVVSEP

SEQ ID NO: 1378823 - protein, 9 aa, Homo Sapiens
LMFNAGDGF

SEQ ID NO: 1378824 - protein, 9 aa, Homo Sapiens
IITNCCLFC

SEQ ID NO: 1378825 - protein, 9 aa, Homo Sapiens
GARINHIFH

SEQ ID NO: 1378826 - protein, 9 aa, Homo Sapiens
KDWKSATNP

SEQ ID NO: 1378827 - protein, 9 aa, Homo Sapiens
LLPNCIPHK

SEQ ID NO: 1378828 - protein, 9 aa, Homo Sapiens
SLDHFLAIH

SEQ ID NO: 1378829 - protein, 9 aa, Homo Sapiens
YLAQSVQSH

SEQ ID NO: 1378830 - protein, 9 aa, Homo Sapiens
TCWQGWALS

SEQ ID NO: 1378831 - protein, 9 aa, Homo Sapiens
IVCLPGCLN

SEQ ID NO: 1378832 - protein, 9 aa, Homo Sapiens
NLAALCLGC

SEQ ID NO: 1378833 - protein, 9 aa, Homo Sapiens
TEKLAEVGK

SEQ ID NO: 1378834 - protein, 9 aa, Homo Sapiens
RRELWSLFD

SEQ ID NO: 1378835 - protein, 9 aa, Homo Sapiens
GGVKMTPTE

SEQ ID NO: 1378836 - protein, 9 aa, Homo Sapiens
QNIHLIVHQ

SEQ ID NO: 1378837 - protein, 9 aa, Homo Sapiens
KMHKCKCCD

SEQ ID NO: 1378838 - protein, 9 aa, Homo Sapiens
LYRDGMLEN

SEQ ID NO: 1378839 - protein, 9 aa, Homo Sapiens
TYMGSFMDT

SEQ ID NO: 1378840 - protein, 9 aa, Homo Sapiens
SQRKEELSR

SEQ ID NO: 1378841 - protein, 9 aa, Homo Sapiens
GQPSVTGVS

SEQ ID NO: 1378842 - protein, 9 aa, Homo Sapiens
QEPPCTRLH

SEQ ID NO: 1378843 - protein, 9 aa, Homo Sapiens
AQLLGCSHV

SEQ ID NO: 1378844 - protein, 9 aa, Homo Sapiens
GLPATPITP

SEQ ID NO: 1378845 - protein, 9 aa, Homo Sapiens
VVTYFVFVI

SEQ ID NO: 1378846 - protein, 9 aa, Homo Sapiens
TPTSPRGKP

SEQ ID NO: 1378847 - protein, 9 aa, Homo Sapiens
LATMFSIGC

SEQ ID NO: 1378848 - protein, 9 aa, Homo Sapiens
EYSKCLCHS

SEQ ID NO: 1378849 - protein, 9 aa, Homo Sapiens
KKTGSVRKA

SEQ ID NO: 1378850 - protein, 9 aa, Homo Sapiens
ELKGWGGDC

SEQ ID NO: 1378851 - protein, 9 aa, Homo Sapiens
HCNLARDLH

SEQ ID NO: 1378852 - protein, 9 aa, Homo Sapiens
PKQATQPKE

SEQ ID NO: 1378853 - protein, 9 aa, Homo Sapiens
YNAHAPPHT

SEQ ID NO: 1378854 - protein, 9 aa, Homo Sapiens
SPIPPYPAS

SEQ ID NO: 1378855 - protein, 9 aa, Homo Sapiens
CTYQEGQWH

SEQ ID NO: 1378856 - protein, 9 aa, Homo Sapiens
LQLQPAVCP

SEQ ID NO: 1378857 - protein, 9 aa, Homo Sapiens
ALEPGSPYK

SEQ ID NO: 1378858 - protein, 9 aa, Homo Sapiens
CATTDKLWE

SEQ ID NO: 1378859 - protein, 9 aa, Homo Sapiens
VINILQPVL

SEQ ID NO: 1378860 - protein, 9 aa, Homo Sapiens
LTDPKEQRK

SEQ ID NO: 1378861 - protein, 9 aa, Homo Sapiens
KSYCQVRLN

SEQ ID NO: 1378862 - protein, 9 aa, Homo Sapiens
TSLQFSLMA

SEQ ID NO: 1378863 - protein, 9 aa, Homo Sapiens
IPKSPKQAT

SEQ ID NO: 1378864 - protein, 9 aa, Homo Sapiens
GSLRQISGR

SEQ ID NO: 1378865 - protein, 9 aa, Homo Sapiens
SGGARINHI

SEQ ID NO: 1378866 - protein, 9 aa, Homo Sapiens
TVHIVALDR

SEQ ID NO: 1378867 - protein, 9 aa, Homo Sapiens
LGRRGWRPL

SEQ ID NO: 1378868 - protein, 9 aa, Homo Sapiens
YRIHTGKKP

SEQ ID NO: 1378869 - protein, 9 aa, Homo Sapiens
QSQARELPL

SEQ ID NO: 1378870 - protein, 9 aa, Homo Sapiens
FPRESCLLS

SEQ ID NO: 1378871 - protein, 9 aa, Homo Sapiens
GDTLEGACG

SEQ ID NO: 1378872 - protein, 9 aa, Homo Sapiens
QEETVHIVA

SEQ ID NO: 1378873 - protein, 9 aa, Homo Sapiens
IGNERLPSL

SEQ ID NO: 1378874 - protein, 9 aa, Homo Sapiens
DPAKRQHNF

SEQ ID NO: 1378875 - protein, 9 aa, Homo Sapiens
MVSAGDTLP

SEQ ID NO: 1378876 - protein, 9 aa, Homo Sapiens
ALAPALALE

SEQ ID NO: 1378877 - protein, 9 aa, Homo Sapiens
QKCDWFFPV

SEQ ID NO: 1378878 - protein, 9 aa, Homo Sapiens
KIIKLLYGK

SEQ ID NO: 1378879 - protein, 9 aa, Homo Sapiens
AKQEKRTAC

SEQ ID NO: 1378880 - protein, 9 aa, Homo Sapiens
LSETRNQVD

SEQ ID NO: 1378881 - protein, 9 aa, Homo Sapiens
YVFMCPQGS

SEQ ID NO: 1378882 - protein, 9 aa, Homo Sapiens
AAVTFEWTS

SEQ ID NO: 1378883 - protein, 9 aa, Homo Sapiens
LTWQLWHRE

SEQ ID NO: 1378884 - protein, 9 aa, Homo Sapiens
LDIQVPSNP

SEQ ID NO: 1378885 - protein, 9 aa, Homo Sapiens
LWGHLVRIK

SEQ ID NO: 1378886 - protein, 9 aa, Homo Sapiens
LLRHAWPIT

SEQ ID NO: 1378887 - protein, 9 aa, Homo Sapiens
SDYIPAQQD

SEQ ID NO: 1378888 - protein, 9 aa, Homo Sapiens
NLCCFKWTC

SEQ ID NO: 1378889 - protein, 9 aa, Homo Sapiens
KKTKRATTE

SEQ ID NO: 1378890 - protein, 9 aa, Homo Sapiens
ASSSSEPLQ

SEQ ID NO: 1378891 - protein, 9 aa, Homo Sapiens
QVLPAPSRA

SEQ ID NO: 1378892 - protein, 9 aa, Homo Sapiens
HLVRIKPTQ

SEQ ID NO: 1378893 - protein, 9 aa, Homo Sapiens
RVQLPIVST

SEQ ID NO: 1378894 - protein, 9 aa, Homo Sapiens
GELVTGLPG

SEQ ID NO: 1378895 - protein, 9 aa, Homo Sapiens
AHYNAHAPP

SEQ ID NO: 1378896 - protein, 9 aa, Homo Sapiens
TTAIGGGVA

SEQ ID NO: 1378897 - protein, 9 aa, Homo Sapiens
QTYHKEAHN

SEQ ID NO: 1378898 - protein, 9 aa, Homo Sapiens
FLLLNDSNI

SEQ ID NO: 1378899 - protein, 9 aa, Homo Sapiens
CRPSCCSTP

SEQ ID NO: 1378900 - protein, 9 aa, Homo Sapiens
SVRKANRMP

SEQ ID NO: 1378901 - protein, 9 aa, Homo Sapiens
TDLGRRGWR

SEQ ID NO: 1378902 - protein, 9 aa, Homo Sapiens
PHASLRNIH

SEQ ID NO: 1378903 - protein, 9 aa, Homo Sapiens
KKAKSLAMT

SEQ ID NO: 1378904 - protein, 9 aa, Homo Sapiens
YIFHCRPPD

SEQ ID NO: 1378905 - protein, 9 aa, Homo Sapiens
SMSPIPPYP

SEQ ID NO: 1378906 - protein, 9 aa, Homo Sapiens
GVINILQPV

SEQ ID NO: 1378907 - protein, 9 aa, Homo Sapiens
NKDTVIVVS

SEQ ID NO: 1378908 - protein, 9 aa, Homo Sapiens
RRRQRRTVT

SEQ ID NO: 1378909 - protein, 9 aa, Homo Sapiens
PSPISLPLD

SEQ ID NO: 1378910 - protein, 9 aa, Homo Sapiens
YCAGHTHSS

SEQ ID NO: 1378911 - protein, 9 aa, Homo Sapiens
ERNVRTATT

SEQ ID NO: 1378912 - protein, 9 aa, Homo Sapiens
SFTELSRIL

SEQ ID NO: 1378913 - protein, 9 aa, Homo Sapiens
MKQLIGNIL

SEQ ID NO: 1378914 - protein, 9 aa, Homo Sapiens
YRDGMLENY

SEQ ID NO: 1378915 - protein, 9 aa, Homo Sapiens
TDKLWEQIY

SEQ ID NO: 1378916 - protein, 9 aa, Homo Sapiens
QQQKIRKYT

SEQ ID NO: 1378917 - protein, 9 aa, Homo Sapiens
LLWPAVPVK

SEQ ID NO: 1378918 - protein, 9 aa, Homo Sapiens
LPNMIPTNR

SEQ ID NO: 1378919 - protein, 9 aa, Homo Sapiens
LGSGYWLVQ

SEQ ID NO: 1378920 - protein, 9 aa, Homo Sapiens
RPLRGAATR

SEQ ID NO: 1378921 - protein, 9 aa, Homo Sapiens
EIRMQLHMS

SEQ ID NO: 1378922 - protein, 9 aa, Homo Sapiens
VDAVRARAL

SEQ ID NO: 1378923 - protein, 9 aa, Homo Sapiens
TKRATTEDL

SEQ ID NO: 1378924 - protein, 9 aa, Homo Sapiens
VEVAAGPPM

SEQ ID NO: 1378925 - protein, 9 aa, Homo Sapiens
GGRAAEEED

SEQ ID NO: 1378926 - protein, 9 aa, Homo Sapiens
EEEALEIKE

SEQ ID NO: 1378927 - protein, 9 aa, Homo Sapiens
VASVYHEKI

SEQ ID NO: 1378928 - protein, 9 aa, Homo Sapiens
NYFLMCAPK

SEQ ID NO: 1378929 - protein, 9 aa, Homo Sapiens
NMIPTNRQP

SEQ ID NO: 1378930 - protein, 9 aa, Homo Sapiens
SHSPLQPVC

SEQ ID NO: 1378931 - protein, 9 aa, Homo Sapiens
WSLSCRNVW

SEQ ID NO: 1378932 - protein, 9 aa, Homo Sapiens
ANEVDYVPS

SEQ ID NO: 1378933 - protein, 9 aa, Homo Sapiens
LYLKKKQEP

SEQ ID NO: 1378934 - protein, 9 aa, Homo Sapiens
VLFQVSPHI

SEQ ID NO: 1378935 - protein, 9 aa, Homo Sapiens
PHRLGRGRR

SEQ ID NO: 1378936 - protein, 9 aa, Homo Sapiens
DYDRMSSSP

SEQ ID NO: 1378937 - protein, 9 aa, Homo Sapiens
VLLMFNAGD

SEQ ID NO: 1378938 - protein, 9 aa, Homo Sapiens
FDGQHGKKV

SEQ ID NO: 1378939 - protein, 9 aa, Homo Sapiens
TELSRILWF

SEQ ID NO: 1378940 - protein, 9 aa, Homo Sapiens
TEQMKCLEQ

SEQ ID NO: 1378941 - protein, 9 aa, Homo Sapiens
QTALHESEG

SEQ ID NO: 1378942 - protein, 9 aa, Homo Sapiens
SIARARNRE

SEQ ID NO: 1378943 - protein, 9 aa, Homo Sapiens
SRYTQENIC

SEQ ID NO: 1378944 - protein, 9 aa, Homo Sapiens
PELRKKLRK

SEQ ID NO: 1378945 - protein, 9 aa, Homo Sapiens
HYVHRVGAN

SEQ ID NO: 1378946 - protein, 9 aa, Homo Sapiens
DIRVQLLNY

SEQ ID NO: 1378947 - protein, 9 aa, Homo Sapiens
WAPRSSCRA

SEQ ID NO: 1378948 - protein, 9 aa, Homo Sapiens
CVAAGRGHG

SEQ ID NO: 1378949 - protein, 9 aa, Homo Sapiens
GSNEVTTRY

SEQ ID NO: 1378950 - protein, 9 aa, Homo Sapiens
FLAALVDIV

SEQ ID NO: 1378951 - protein, 9 aa, Homo Sapiens
PHHSLPARE

SEQ ID NO: 1378952 - protein, 9 aa, Homo Sapiens
GVGAVPLTA

SEQ ID NO: 1378953 - protein, 9 aa, Homo Sapiens
GAVPLTASG

SEQ ID NO: 1378954 - protein, 9 aa, Homo Sapiens
HKCKCCDYE

SEQ ID NO: 1378955 - protein, 9 aa, Homo Sapiens
DWGGPEVPD

SEQ ID NO: 1378956 - protein, 9 aa, Homo Sapiens
FMEIVWNAV

SEQ ID NO: 1378957 - protein, 9 aa, Homo Sapiens
EVRGSHRGV

SEQ ID NO: 1378958 - protein, 9 aa, Homo Sapiens
ELSFPLGVE

SEQ ID NO: 1378959 - protein, 9 aa, Homo Sapiens
PDNIAHIKA

SEQ ID NO: 1378960 - protein, 9 aa, Homo Sapiens
WLLRSEKSS

SEQ ID NO: 1378961 - protein, 9 aa, Homo Sapiens
ATQPKEGDI

SEQ ID NO: 1378962 - protein, 9 aa, Homo Sapiens
RAALAPALA

SEQ ID NO: 1378963 - protein, 9 aa, Homo Sapiens
SDSGVCLCG

SEQ ID NO: 1378964 - protein, 9 aa, Homo Sapiens
ALQSTTGSQ

SEQ ID NO: 1378965 - protein, 9 aa, Homo Sapiens
DHRKASVVV

SEQ ID NO: 1378966 - protein, 9 aa, Homo Sapiens
VKNVADTLV

SEQ ID NO: 1378967 - protein, 9 aa, Homo Sapiens
QGQQERRDP

SEQ ID NO: 1378968 - protein, 9 aa, Homo Sapiens
HACCGLCHG

SEQ ID NO: 1378969 - protein, 9 aa, Homo Sapiens
LAALCLGCC

SEQ ID NO: 1378970 - protein, 9 aa, Homo Sapiens
TRGHHEYTE

SEQ ID NO: 1378971 - protein, 9 aa, Homo Sapiens
GSPMQNNRR

SEQ ID NO: 1378972 - protein, 9 aa, Homo Sapiens
DRLESEGNV

SEQ ID NO: 1378973 - protein, 9 aa, Homo Sapiens
LKLLGRGPA

SEQ ID NO: 1378974 - protein, 9 aa, Homo Sapiens
GGVVTILEA

SEQ ID NO: 1378975 - protein, 9 aa, Homo Sapiens
AFHEDYSRL

SEQ ID NO: 1378976 - protein, 9 aa, Homo Sapiens
PHRPSCYSQ

SEQ ID NO: 1378977 - protein, 9 aa, Homo Sapiens
SLTTPGPTW

SEQ ID NO: 1378978 - protein, 9 aa, Homo Sapiens
SQNCISLSE

SEQ ID NO: 1378979 - protein, 9 aa, Homo Sapiens
SLSETRNQV

SEQ ID NO: 1378980 - protein, 9 aa, Homo Sapiens
AVGKARRRN

SEQ ID NO: 1378981 - protein, 9 aa, Homo Sapiens
PPQLLFSSL

SEQ ID NO: 1378982 - protein, 9 aa, Homo Sapiens
ASSIPSHPS

SEQ ID NO: 1378983 - protein, 9 aa, Homo Sapiens
HKRGSHFWI

SEQ ID NO: 1378984 - protein, 9 aa, Homo Sapiens
IEEFSIVRP

SEQ ID NO: 1378985 - protein, 9 aa, Homo Sapiens
PPMREVAEA

SEQ ID NO: 1378986 - protein, 9 aa, Homo Sapiens
HFAQDCKQS

SEQ ID NO: 1378987 - protein, 9 aa, Homo Sapiens
GRAAEEEDG

SEQ ID NO: 1378988 - protein, 9 aa, Homo Sapiens
ENAAVDAVR

SEQ ID NO: 1378989 - protein, 9 aa, Homo Sapiens
ALKLKLRDK

SEQ ID NO: 1378990 - protein, 9 aa, Homo Sapiens
AAWRKMQWD

SEQ ID NO: 1378991 - protein, 9 aa, Homo Sapiens
RCPAELPAV

SEQ ID NO: 1378992 - protein, 9 aa, Homo Sapiens
SYVHELMTY

SEQ ID NO: 1378993 - protein, 9 aa, Homo Sapiens
FSIVRPISR

SEQ ID NO: 1378994 - protein, 9 aa, Homo Sapiens
RIQMVHSSS

SEQ ID NO: 1378995 - protein, 9 aa, Homo Sapiens
RAGVTSIRA

SEQ ID NO: 1378996 - protein, 9 aa, Homo Sapiens
DRAGVTSIR

SEQ ID NO: 1378997 - protein, 9 aa, Homo Sapiens
RNNIRKNVF

SEQ ID NO: 1378998 - protein, 9 aa, Homo Sapiens
GDFREVPQQ

SEQ ID NO: 1378999 - protein, 9 aa, Homo Sapiens
KYNEDFERA

SEQ ID NO: 1379000 - protein, 9 aa, Homo Sapiens
ELSLNYFLM

SEQ ID NO: 1379001 - protein, 9 aa, Homo Sapiens
VCVLGRIGD

SEQ ID NO: 1379002 - protein, 9 aa, Homo Sapiens
SLKGAMAQH

SEQ ID NO: 1379003 - protein, 9 aa, Homo Sapiens
EDGDFVIEM

SEQ ID NO: 1379004 - protein, 9 aa, Homo Sapiens
YKTVDGDVF

SEQ ID NO: 1379005 - protein, 9 aa, Homo Sapiens
CKSRGSVHP

SEQ ID NO: 1379006 - protein, 9 aa, Homo Sapiens
EKMRHNHLI

SEQ ID NO: 1379007 - protein, 9 aa, Homo Sapiens
KNHSSRLTL

SEQ ID NO: 1379008 - protein, 9 aa, Homo Sapiens
TPADQRRPR

SEQ ID NO: 1379009 - protein, 9 aa, Homo Sapiens
YTKILQQQQ

SEQ ID NO: 1379010 - protein, 9 aa, Homo Sapiens
PITPTPQVP

SEQ ID NO: 1379011 - protein, 9 aa, Homo Sapiens
FLTLPLTIN

SEQ ID NO: 1379012 - protein, 9 aa, Homo Sapiens
VQYKWPQWL

SEQ ID NO: 1379013 - protein, 9 aa, Homo Sapiens
QLDRQLQLV

SEQ ID NO: 1379014 - protein, 9 aa, Homo Sapiens
KISTTSSER

SEQ ID NO: 1379015 - protein, 9 aa, Homo Sapiens
APLESVRQI

SEQ ID NO: 1379016 - protein, 9 aa, Homo Sapiens
TSIRTVLPH

SEQ ID NO: 1379017 - protein, 9 aa, Homo Sapiens
FLYQLYCLF

SEQ ID NO: 1379018 - protein, 9 aa, Homo Sapiens
ILFAKVSQD

SEQ ID NO: 1379019 - protein, 9 aa, Homo Sapiens
MRGLEEPGP

SEQ ID NO: 1379020 - protein, 9 aa, Homo Sapiens
QGKKILFHY

SEQ ID NO: 1379021 - protein, 9 aa, Homo Sapiens
KPLTLSLHR

SEQ ID NO: 1379022 - protein, 9 aa, Homo Sapiens
TWRKSAECK

SEQ ID NO: 1379023 - protein, 9 aa, Homo Sapiens
LALEPGSPY

SEQ ID NO: 1379024 - protein, 9 aa, Homo Sapiens
AEATRGHHE

SEQ ID NO: 1379025 - protein, 9 aa, Homo Sapiens
QISRSSQSL

SEQ ID NO: 1379026 - protein, 9 aa, Homo Sapiens
SYGTIIMEG

SEQ ID NO: 1379027 - protein, 9 aa, Homo Sapiens
CSTRTVPTT

SEQ ID NO: 1379028 - protein, 9 aa, Homo Sapiens
ASNSLFNTV

SEQ ID NO: 1379029 - protein, 9 aa, Homo Sapiens
LTKKKERAL

SEQ ID NO: 1379030 - protein, 9 aa, Homo Sapiens
IKLLYGKRS

SEQ ID NO: 1379031 - protein, 9 aa, Homo Sapiens
RSRFFLQFR

SEQ ID NO: 1379032 - protein, 9 aa, Homo Sapiens
SPNYNPFAW

SEQ ID NO: 1379033 - protein, 9 aa, Homo Sapiens
QNKNTPSTA

SEQ ID NO: 1379034 - protein, 9 aa, Homo Sapiens
LFSDSSQSD

SEQ ID NO: 1379035 - protein, 9 aa, Homo Sapiens
RSANKFVDS

SEQ ID NO: 1379036 - protein, 9 aa, Homo Sapiens
VGNREKILN

SEQ ID NO: 1379037 - protein, 9 aa, Homo Sapiens
FLATSSPTR

SEQ ID NO: 1379038 - protein, 9 aa, Homo Sapiens
ASEMKQLIG

SEQ ID NO: 1379039 - protein, 9 aa, Homo Sapiens
HFWKDFLAT

SEQ ID NO: 1379040 - protein, 9 aa, Homo Sapiens
SYKWLRNGT

SEQ ID NO: 1379041 - protein, 9 aa, Homo Sapiens
KEELQENSS

SEQ ID NO: 1379042 - protein, 9 aa, Homo Sapiens
ITEKLAEVG

SEQ ID NO: 1379043 - protein, 9 aa, Homo Sapiens
SMQTEGKKN

SEQ ID NO: 1379044 - protein, 9 aa, Homo Sapiens
ERKDDRERE

SEQ ID NO: 1379045 - protein, 9 aa, Homo Sapiens
FQQHAPVEC

SEQ ID NO: 1379046 - protein, 9 aa, Homo Sapiens
RVQLLNYVI

SEQ ID NO: 1379047 - protein, 9 aa, Homo Sapiens
VSKVQSHAV

SEQ ID NO: 1379048 - protein, 9 aa, Homo Sapiens
IVRPISRGA

SEQ ID NO: 1379049 - protein, 9 aa, Homo Sapiens
EPKMHKCKC

SEQ ID NO: 1379050 - protein, 9 aa, Homo Sapiens
VRGSHRGVP

SEQ ID NO: 1379051 - protein, 9 aa, Homo Sapiens
PISLPLDRP

SEQ ID NO: 1379052 - protein, 9 aa, Homo Sapiens
SEAPGQTPE

SEQ ID NO: 1379053 - protein, 9 aa, Homo Sapiens
KNHHHSEYQ

SEQ ID NO: 1379054 - protein, 9 aa, Homo Sapiens
PSPRPPPLV

SEQ ID NO: 1379055 - protein, 9 aa, Homo Sapiens
NTTKNFSCQ

SEQ ID NO: 1379056 - protein, 9 aa, Homo Sapiens
SSSDCNIYD

SEQ ID NO: 1379057 - protein, 9 aa, Homo Sapiens
ISYAEQYPE

SEQ ID NO: 1379058 - protein, 9 aa, Homo Sapiens
LVRIKPTQS

SEQ ID NO: 1379059 - protein, 9 aa, Homo Sapiens
GRVGGSHQE

SEQ ID NO: 1379060 - protein, 9 aa, Homo Sapiens
STPDNQGRS

SEQ ID NO: 1379061 - protein, 9 aa, Homo Sapiens
RQQPTDPHR

SEQ ID NO: 1379062 - protein, 9 aa, Homo Sapiens
DGEIVYAKS

SEQ ID NO: 1379063 - protein, 9 aa, Homo Sapiens
SVLSVIYAS

SEQ ID NO: 1379064 - protein, 9 aa, Homo Sapiens
VAEAAAVVM

SEQ ID NO: 1379065 - protein, 9 aa, Homo Sapiens
RHRNESKSR

SEQ ID NO: 1379066 - protein, 9 aa, Homo Sapiens
SELPGLPSA

SEQ ID NO: 1379067 - protein, 9 aa, Homo Sapiens
DKRKCFEIM

SEQ ID NO: 1379068 - protein, 9 aa, Homo Sapiens
DFREVPQQR

SEQ ID NO: 1379069 - protein, 9 aa, Homo Sapiens
GAPPAGVGL

SEQ ID NO: 1379070 - protein, 9 aa, Homo Sapiens
KQEPPCTRL

SEQ ID NO: 1379071 - protein, 9 aa, Homo Sapiens
HLSINPVKQ

SEQ ID NO: 1379072 - protein, 9 aa, Homo Sapiens
LCHVTTGKY

SEQ ID NO: 1379073 - protein, 9 aa, Homo Sapiens
NVVGTVRVL

SEQ ID NO: 1379074 - protein, 9 aa, Homo Sapiens
AVPARLRHL

SEQ ID NO: 1379075 - protein, 9 aa, Homo Sapiens
LANEVDYVP

SEQ ID NO: 1379076 - protein, 9 aa, Homo Sapiens
PLQRQQIKD

SEQ ID NO: 1379077 - protein, 9 aa, Homo Sapiens
AVPCVPSPC

SEQ ID NO: 1379078 - protein, 9 aa, Homo Sapiens
DTDEKYNFE

SEQ ID NO: 1379079 - protein, 9 aa, Homo Sapiens
NAFLSGSNF

SEQ ID NO: 1379080 - protein, 9 aa, Homo Sapiens
SRNNIRKNV

SEQ ID NO: 1379081 - protein, 9 aa, Homo Sapiens
AQALMPPVP

SEQ ID NO: 1379082 - protein, 9 aa, Homo Sapiens
PTDPGSPPE

SEQ ID NO: 1379083 - protein, 9 aa, Homo Sapiens
VRNLAALCL

SEQ ID NO: 1379084 - protein, 9 aa, Homo Sapiens
LVLAGGASW

SEQ ID NO: 1379085 - protein, 9 aa, Homo Sapiens
RLNKVLYPP

SEQ ID NO: 1379086 - protein, 9 aa, Homo Sapiens
EPGDPDAVV

SEQ ID NO: 1379087 - protein, 9 aa, Homo Sapiens
FHYPHFWKD

SEQ ID NO: 1379088 - protein, 9 aa, Homo Sapiens
WPEDRPLPV

SEQ ID NO: 1379089 - protein, 9 aa, Homo Sapiens
YTIDIFFCA

SEQ ID NO: 1379090 - protein, 9 aa, Homo Sapiens
LVEHESTKR

SEQ ID NO: 1379091 - protein, 9 aa, Homo Sapiens
RMPKDVNIQ

SEQ ID NO: 1379092 - protein, 9 aa, Homo Sapiens
LVAYMLSVT

SEQ ID NO: 1379093 - protein, 9 aa, Homo Sapiens
IRVGEVLSS

SEQ ID NO: 1379094 - protein, 9 aa, Homo Sapiens
NHEWIGNER

SEQ ID NO: 1379095 - protein, 9 aa, Homo Sapiens
LFILCGLGG

SEQ ID NO: 1379096 - protein, 9 aa, Homo Sapiens
SEVQVTYMG

SEQ ID NO: 1379097 - protein, 9 aa, Homo Sapiens
PEPGDPDAV

SEQ ID NO: 1379098 - protein, 9 aa, Homo Sapiens
QWPTEGRIQ

SEQ ID NO: 1379099 - protein, 9 aa, Homo Sapiens
SIRTVLPHI

SEQ ID NO: 1379100 - protein, 9 aa, Homo Sapiens
PQEGPHIPG

SEQ ID NO: 1379101 - protein, 9 aa, Homo Sapiens
EAAWTGASP

SEQ ID NO: 1379102 - protein, 9 aa, Homo Sapiens
IISAVPTKS

SEQ ID NO: 1379103 - protein, 9 aa, Homo Sapiens
LPVSQEFIL

SEQ ID NO: 1379104 - protein, 9 aa, Homo Sapiens
KAENLLLGA

SEQ ID NO: 1379105 - protein, 9 aa, Homo Sapiens
RGKPVGKEA

SEQ ID NO: 1379106 - protein, 9 aa, Homo Sapiens
RLTATRRFS

SEQ ID NO: 1379107 - protein, 9 aa, Homo Sapiens
ELSRILWFK

SEQ ID NO: 1379108 - protein, 9 aa, Homo Sapiens
WSGVAFNLF

SEQ ID NO: 1379109 - protein, 9 aa, Homo Sapiens
GASGQESEE

SEQ ID NO: 1379110 - protein, 9 aa, Homo Sapiens
RPRCFLTLP

SEQ ID NO: 1379111 - protein, 9 aa, Homo Sapiens
AVKTCRWQC

SEQ ID NO: 1379112 - protein, 9 aa, Homo Sapiens
ALHLQAQQR

SEQ ID NO: 1379113 - protein, 9 aa, Homo Sapiens
STPTSPDSL

SEQ ID NO: 1379114 - protein, 9 aa, Homo Sapiens
VGEGLIPGD

SEQ ID NO: 1379115 - protein, 9 aa, Homo Sapiens
RGGKWRSGM

SEQ ID NO: 1379116 - protein, 9 aa, Homo Sapiens
TAAGISQLL

SEQ ID NO: 1379117 - protein, 9 aa, Homo Sapiens
PYKWTWEGC

SEQ ID NO: 1379118 - protein, 9 aa, Homo Sapiens
LTLSLHRWT

SEQ ID NO: 1379119 - protein, 9 aa, Homo Sapiens
RCCCCCGER

SEQ ID NO: 1379120 - protein, 9 aa, Homo Sapiens
REKQKKLER

SEQ ID NO: 1379121 - protein, 9 aa, Homo Sapiens
VQTAQDRAG

SEQ ID NO: 1379122 - protein, 9 aa, Homo Sapiens
NPWYVLLCV

SEQ ID NO: 1379123 - protein, 9 aa, Homo Sapiens
HRHWVLGIS

SEQ ID NO: 1379124 - protein, 9 aa, Homo Sapiens
CLPPEPGDP

SEQ ID NO: 1379125 - protein, 9 aa, Homo Sapiens
VPSLMARLI

SEQ ID NO: 1379126 - protein, 9 aa, Homo Sapiens
LKKKQISRS

SEQ ID NO: 1379127 - protein, 9 aa, Homo Sapiens
EALEIKEND

SEQ ID NO: 1379128 - protein, 9 aa, Homo Sapiens
YDRMSSSPC

SEQ ID NO: 1379129 - protein, 9 aa, Homo Sapiens
RGSKDFSFR

SEQ ID NO: 1379130 - protein, 9 aa, Homo Sapiens
DFTPSLSVG

SEQ ID NO: 1379131 - protein, 9 aa, Homo Sapiens
RDGMLENYR

SEQ ID NO: 1379132 - protein, 9 aa, Homo Sapiens
WREDLTIKR

SEQ ID NO: 1379133 - protein, 9 aa, Homo Sapiens
SSSEPLQII

SEQ ID NO: 1379134 - protein, 9 aa, Homo Sapiens
LVALDHRKA

SEQ ID NO: 1379135 - protein, 9 aa, Homo Sapiens
VDGEIVYAK

SEQ ID NO: 1379136 - protein, 9 aa, Homo Sapiens
QWLHQQTEK

SEQ ID NO: 1379137 - protein, 9 aa, Homo Sapiens
ETNIPQRSA

SEQ ID NO: 1379138 - protein, 9 aa, Homo Sapiens
SSSKASSID

SEQ ID NO: 1379139 - protein, 9 aa, Homo Sapiens
SEAGDVPFN

SEQ ID NO: 1379140 - protein, 9 aa, Homo Sapiens
IFSLAIALF

SEQ ID NO: 1379141 - protein, 9 aa, Homo Sapiens
GGASWAHAS

SEQ ID NO: 1379142 - protein, 9 aa, Homo Sapiens
GWALSLSGG

SEQ ID NO: 1379143 - protein, 9 aa, Homo Sapiens
VVNPDSKGE

SEQ ID NO: 1379144 - protein, 9 aa, Homo Sapiens
NHTTNCFGD

SEQ ID NO: 1379145 - protein, 9 aa, Homo Sapiens
FTELSRILW

SEQ ID NO: 1379146 - protein, 9 aa, Homo Sapiens
CWSTYSLPV

SEQ ID NO: 1379147 - protein, 9 aa, Homo Sapiens
VSFTELSRI

SEQ ID NO: 1379148 - protein, 9 aa, Homo Sapiens
NFELERGDL

SEQ ID NO: 1379149 - protein, 9 aa, Homo Sapiens
ALCSNLSVK

SEQ ID NO: 1379150 - protein, 9 aa, Homo Sapiens
RVSLLNTTK

SEQ ID NO: 1379151 - protein, 9 aa, Homo Sapiens
VAPPFPAKV

SEQ ID NO: 1379152 - protein, 9 aa, Homo Sapiens
APEASWSPA

SEQ ID NO: 1379153 - protein, 9 aa, Homo Sapiens
TQGKNHHHS

SEQ ID NO: 1379154 - protein, 9 aa, Homo Sapiens
ALPLNSLHT

SEQ ID NO: 1379155 - protein, 9 aa, Homo Sapiens
FFIDHSPRS

SEQ ID NO: 1379156 - protein, 9 aa, Homo Sapiens
GVEGKAGTA

SEQ ID NO: 1379157 - protein, 9 aa, Homo Sapiens
ETTVKFTPT

SEQ ID NO: 1379158 - protein, 9 aa, Homo Sapiens
PQQEVVDTT

SEQ ID NO: 1379159 - protein, 9 aa, Homo Sapiens
KKHLEFLGA

SEQ ID NO: 1379160 - protein, 9 aa, Homo Sapiens
TGKKREPER

SEQ ID NO: 1379161 - protein, 9 aa, Homo Sapiens
ECIISAVPT

SEQ ID NO: 1379162 - protein, 9 aa, Homo Sapiens
DVPFNHEIL

SEQ ID NO: 1379163 - protein, 9 aa, Homo Sapiens
GVSGHFAQD

SEQ ID NO: 1379164 - protein, 9 aa, Homo Sapiens
CAPKHARTF

SEQ ID NO: 1379165 - protein, 9 aa, Homo Sapiens
VVGTVRVLQ

SEQ ID NO: 1379166 - protein, 9 aa, Homo Sapiens
DCGNCTYQE

SEQ ID NO: 1379167 - protein, 9 aa, Homo Sapiens
EDFLKTRVS

SEQ ID NO: 1379168 - protein, 9 aa, Homo Sapiens
QKDCGNCTY

SEQ ID NO: 1379169 - protein, 9 aa, Homo Sapiens
ASVFSVLSV

SEQ ID NO: 1379170 - protein, 9 aa, Homo Sapiens
EQYPEFESM

SEQ ID NO: 1379171 - protein, 9 aa, Homo Sapiens
LTPGVHEGC

SEQ ID NO: 1379172 - protein, 9 aa, Homo Sapiens
MLSFSEPSS

SEQ ID NO: 1379173 - protein, 9 aa, Homo Sapiens
VMQTEIEEQ

SEQ ID NO: 1379174 - protein, 9 aa, Homo Sapiens
YTIVLKAVL

SEQ ID NO: 1379175 - protein, 9 aa, Homo Sapiens
LSPGEARAP

SEQ ID NO: 1379176 - protein, 9 aa, Homo Sapiens
GQQQDYGSA

SEQ ID NO: 1379177 - protein, 9 aa, Homo Sapiens
LHRWTGTGK

SEQ ID NO: 1379178 - protein, 9 aa, Homo Sapiens
DLCQRSTQT

SEQ ID NO: 1379179 - protein, 9 aa, Homo Sapiens
SQNSCSCSN

SEQ ID NO: 1379180 - protein, 9 aa, Homo Sapiens
SYAEQYPEF

SEQ ID NO: 1379181 - protein, 9 aa, Homo Sapiens
SEFDGQHGK

SEQ ID NO: 1379182 - protein, 9 aa, Homo Sapiens
KEAHNSWDS

SEQ ID NO: 1379183 - protein, 9 aa, Homo Sapiens
LLMFNAGDG

SEQ ID NO: 1379184 - protein, 9 aa, Homo Sapiens
GIRKWKKGL

SEQ ID NO: 1379185 - protein, 9 aa, Homo Sapiens
RKMQWDHCT

SEQ ID NO: 1379186 - protein, 9 aa, Homo Sapiens
VPVKRWSLS

SEQ ID NO: 1379187 - protein, 9 aa, Homo Sapiens
IITEEEALE

SEQ ID NO: 1379188 - protein, 9 aa, Homo Sapiens
EDLLSIRCP

SEQ ID NO: 1379189 - protein, 9 aa, Homo Sapiens
QQARAVVDI

SEQ ID NO: 1379190 - protein, 9 aa, Homo Sapiens
TSSYHSKHL

SEQ ID NO: 1379191 - protein, 9 aa, Homo Sapiens
ALFTSALLP

SEQ ID NO: 1379192 - protein, 9 aa, Homo Sapiens
VLSVIYASQ

SEQ ID NO: 1379193 - protein, 9 aa, Homo Sapiens
LPSVWSWAG

SEQ ID NO: 1379194 - protein, 9 aa, Homo Sapiens
EAVFECEVV

SEQ ID NO: 1379195 - protein, 9 aa, Homo Sapiens
ESSHKEDTD

SEQ ID NO: 1379196 - protein, 9 aa, Homo Sapiens
GRGPAALWG

SEQ ID NO: 1379197 - protein, 9 aa, Homo Sapiens
FTSALLPVD

SEQ ID NO: 1379198 - protein, 9 aa, Homo Sapiens
TIDSLPNLK

SEQ ID NO: 1379199 - protein, 9 aa, Homo Sapiens
TFVVFVQVK

SEQ ID NO: 1379200 - protein, 9 aa, Homo Sapiens
PGNQLRNHY

SEQ ID NO: 1379201 - protein, 9 aa, Homo Sapiens
PDNQGRSRA

SEQ ID NO: 1379202 - protein, 9 aa, Homo Sapiens
ERIRLGLKE

SEQ ID NO: 1379203 - protein, 9 aa, Homo Sapiens
TRRKSKYNE

SEQ ID NO: 1379204 - protein, 9 aa, Homo Sapiens
QKLPKKKKE

SEQ ID NO: 1379205 - protein, 9 aa, Homo Sapiens
NFRRHSWSG

SEQ ID NO: 1379206 - protein, 9 aa, Homo Sapiens
YLHACRHRN

SEQ ID NO: 1379207 - protein, 9 aa, Homo Sapiens
NPVPSYKWL

SEQ ID NO: 1379208 - protein, 9 aa, Homo Sapiens
AGRGPAALH

SEQ ID NO: 1379209 - protein, 9 aa, Homo Sapiens
RTVTCQIMV

SEQ ID NO: 1379210 - protein, 9 aa, Homo Sapiens
GLKKIFALL

SEQ ID NO: 1379211 - protein, 9 aa, Homo Sapiens
STSQTFPRE

SEQ ID NO: 1379212 - protein, 9 aa, Homo Sapiens
LLYGKRSQT

SEQ ID NO: 1379213 - protein, 9 aa, Homo Sapiens
IKRNSIFNC

SEQ ID NO: 1379214 - protein, 9 aa, Homo Sapiens
LVQQHCLEC

SEQ ID NO: 1379215 - protein, 9 aa, Homo Sapiens
ITPQFLYQL

SEQ ID NO: 1379216 - protein, 9 aa, Homo Sapiens
PAQQDVLRT

SEQ ID NO: 1379217 - protein, 9 aa, Homo Sapiens
AAHPTDPGS

SEQ ID NO: 1379218 - protein, 9 aa, Homo Sapiens
GPGTDFVAE

SEQ ID NO: 1379219 - protein, 9 aa, Homo Sapiens
EYTIDIFFC

SEQ ID NO: 1379220 - protein, 9 aa, Homo Sapiens
LPWIRSSHS

SEQ ID NO: 1379221 - protein, 9 aa, Homo Sapiens
PRGKPVGKE

SEQ ID NO: 1379222 - protein, 9 aa, Homo Sapiens
MSGGRCALL

SEQ ID NO: 1379223 - protein, 9 aa, Homo Sapiens
RKYLKHRLS

SEQ ID NO: 1379224 - protein, 9 aa, Homo Sapiens
PNSQPQVHP

SEQ ID NO: 1379225 - protein, 9 aa, Homo Sapiens
CNLRTAYIL

SEQ ID NO: 1379226 - protein, 9 aa, Homo Sapiens
TIENVKAKV

SEQ ID NO: 1379227 - protein, 9 aa, Homo Sapiens
EFKNLKNLH

SEQ ID NO: 1379228 - protein, 9 aa, Homo Sapiens
LVMQTEIEE

SEQ ID NO: 1379229 - protein, 9 aa, Homo Sapiens
QEKEGIFFI

SEQ ID NO: 1379230 - protein, 9 aa, Homo Sapiens
LQRLASEFH

SEQ ID NO: 1379231 - protein, 9 aa, Homo Sapiens
EECIISAVP

SEQ ID NO: 1379232 - protein, 9 aa, Homo Sapiens
INLLEELSL

SEQ ID NO: 1379233 - protein, 9 aa, Homo Sapiens
CSEVSEIFE

SEQ ID NO: 1379234 - protein, 9 aa, Homo Sapiens
AIQNPQAPE

SEQ ID NO: 1379235 - protein, 9 aa, Homo Sapiens
TTDKLWEQI

SEQ ID NO: 1379236 - protein, 9 aa, Homo Sapiens
NSQNCISLS

SEQ ID NO: 1379237 - protein, 9 aa, Homo Sapiens
LSVGSDTTD

SEQ ID NO: 1379238 - protein, 9 aa, Homo Sapiens
YCQVRLNEL

SEQ ID NO: 1379239 - protein, 9 aa, Homo Sapiens
VSAGDTLPI

SEQ ID NO: 1379240 - protein, 9 aa, Homo Sapiens
SKDFSFREI

SEQ ID NO: 1379241 - protein, 9 aa, Homo Sapiens
GQPFRLCHV

SEQ ID NO: 1379242 - protein, 9 aa, Homo Sapiens
GEKPYKWTW

SEQ ID NO: 1379243 - protein, 9 aa, Homo Sapiens
EFDGQHGKK

SEQ ID NO: 1379244 - protein, 9 aa, Homo Sapiens
KNEPRMRSS

SEQ ID NO: 1379245 - protein, 9 aa, Homo Sapiens
QKHERIRLG

SEQ ID NO: 1379246 - protein, 9 aa, Homo Sapiens
AMPARGGKW

SEQ ID NO: 1379247 - protein, 9 aa, Homo Sapiens
YHSKHLKTH

SEQ ID NO: 1379248 - protein, 9 aa, Homo Sapiens
KSLKDEEQE

SEQ ID NO: 1379249 - protein, 9 aa, Homo Sapiens
ERDFTPSLS

SEQ ID NO: 1379250 - protein, 9 aa, Homo Sapiens
FNAGDGFSF

SEQ ID NO: 1379251 - protein, 9 aa, Homo Sapiens
RDFTPSLSV

SEQ ID NO: 1379252 - protein, 9 aa, Homo Sapiens
QQPLRRGPQ

SEQ ID NO: 1379253 - protein, 9 aa, Homo Sapiens
TLGVERTRS

SEQ ID NO: 1379254 - protein, 9 aa, Homo Sapiens
GLDQLDRQL

SEQ ID NO: 1379255 - protein, 9 aa, Homo Sapiens
DPNTPVIRK

SEQ ID NO: 1379256 - protein, 9 aa, Homo Sapiens
QQHCLECWS

SEQ ID NO: 1379257 - protein, 9 aa, Homo Sapiens
IQVRKKQKH

SEQ ID NO: 1379258 - protein, 9 aa, Homo Sapiens
VQRDRLESE

SEQ ID NO: 1379259 - protein, 9 aa, Homo Sapiens
RPPDQKIPK

SEQ ID NO: 1379260 - protein, 9 aa, Homo Sapiens
KDCMKGGKC

SEQ ID NO: 1379261 - protein, 9 aa, Homo Sapiens
CCDYETAEQ

SEQ ID NO: 1379262 - protein, 9 aa, Homo Sapiens
RLGLKEFVC

SEQ ID NO: 1379263 - protein, 9 aa, Homo Sapiens
GIQFSDRLK

SEQ ID NO: 1379264 - protein, 9 aa, Homo Sapiens
IEMSATLPI

SEQ ID NO: 1379265 - protein, 9 aa, Homo Sapiens
PALALEIPS

SEQ ID NO: 1379266 - protein, 9 aa, Homo Sapiens
PASEGSSKK

SEQ ID NO: 1379267 - protein, 9 aa, Homo Sapiens
TTLLNTPPE

SEQ ID NO: 1379268 - protein, 9 aa, Homo Sapiens
QSHAVKIDG

SEQ ID NO: 1379269 - protein, 9 aa, Homo Sapiens
LLNTPPEGW

SEQ ID NO: 1379270 - protein, 9 aa, Homo Sapiens
GMQDLVEDL

SEQ ID NO: 1379271 - protein, 9 aa, Homo Sapiens
CFEIMNPKS

SEQ ID NO: 1379272 - protein, 9 aa, Homo Sapiens
LYHGTIDSL

SEQ ID NO: 1379273 - protein, 9 aa, Homo Sapiens
RNLAALCLG

SEQ ID NO: 1379274 - protein, 9 aa, Homo Sapiens
DVQGKKILF

SEQ ID NO: 1379275 - protein, 9 aa, Homo Sapiens
VVRLLGAVS

SEQ ID NO: 1379276 - protein, 9 aa, Homo Sapiens
QIMVMMWMG

SEQ ID NO: 1379277 - protein, 9 aa, Homo Sapiens
KEFNRRIRD

SEQ ID NO: 1379278 - protein, 9 aa, Homo Sapiens
GMCDCFSDS

SEQ ID NO: 1379279 - protein, 9 aa, Homo Sapiens
PGQTPELAG

SEQ ID NO: 1379280 - protein, 9 aa, Homo Sapiens
RLIQEKGSV

SEQ ID NO: 1379281 - protein, 9 aa, Homo Sapiens
EMDEEGNLS

SEQ ID NO: 1379282 - protein, 9 aa, Homo Sapiens
LTYDNYMTE

SEQ ID NO: 1379283 - protein, 9 aa, Homo Sapiens
NARSPPQLL

SEQ ID NO: 1379284 - protein, 9 aa, Homo Sapiens
SDRLKLFGM

SEQ ID NO: 1379285 - protein, 9 aa, Homo Sapiens
ASDHVKVVT

SEQ ID NO: 1379286 - protein, 9 aa, Homo Sapiens
RSMSPIPPY

SEQ ID NO: 1379287 - protein, 9 aa, Homo Sapiens
GAATRMGTP

SEQ ID NO: 1379288 - protein, 9 aa, Homo Sapiens
QEVLKKKTG

SEQ ID NO: 1379289 - protein, 9 aa, Homo Sapiens
EDEDGGVGD

SEQ ID NO: 1379290 - protein, 9 aa, Homo Sapiens
PQDICPDQK

SEQ ID NO: 1379291 - protein, 9 aa, Homo Sapiens
RQAQCLLRH

SEQ ID NO: 1379292 - protein, 9 aa, Homo Sapiens
GTVHLGSGY

SEQ ID NO: 1379293 - protein, 9 aa, Homo Sapiens
IVDQHDTDE

SEQ ID NO: 1379294 - protein, 9 aa, Homo Sapiens
PKAGAASAW

SEQ ID NO: 1379295 - protein, 9 aa, Homo Sapiens
KEALVTIRS

SEQ ID NO: 1379296 - protein, 9 aa, Homo Sapiens
HGGVCHRTK

SEQ ID NO: 1379297 - protein, 9 aa, Homo Sapiens
LSPAPSTPA

SEQ ID NO: 1379298 - protein, 9 aa, Homo Sapiens
EFFVVVSLH

SEQ ID NO: 1379299 - protein, 9 aa, Homo Sapiens
ALDHRKASV

SEQ ID NO: 1379300 - protein, 9 aa, Homo Sapiens
LTTPGPTWP

SEQ ID NO: 1379301 - protein, 9 aa, Homo Sapiens
MSTATFLAS

SEQ ID NO: 1379302 - protein, 9 aa, Homo Sapiens
YQQSPVQRQ

SEQ ID NO: 1379303 - protein, 9 aa, Homo Sapiens
KNFSCQWPT

SEQ ID NO: 1379304 - protein, 9 aa, Homo Sapiens
LEKISTTSS

SEQ ID NO: 1379305 - protein, 9 aa, Homo Sapiens
GSQSPHASL

SEQ ID NO: 1379306 - protein, 9 aa, Homo Sapiens
DHHNNSLPR

SEQ ID NO: 1379307 - protein, 9 aa, Homo Sapiens
PCVPSPCRN

SEQ ID NO: 1379308 - protein, 9 aa, Homo Sapiens
LEVEETRCF

SEQ ID NO: 1379309 - protein, 9 aa, Homo Sapiens
IRRVSPGQG

SEQ ID NO: 1379310 - protein, 9 aa, Homo Sapiens
TRDMAQAKV

SEQ ID NO: 1379311 - protein, 9 aa, Homo Sapiens
FRSMSPIPP

SEQ ID NO: 1379312 - protein, 9 aa, Homo Sapiens
MCAPKHART

SEQ ID NO: 1379313 - protein, 9 aa, Homo Sapiens
RAPLESVRQ

SEQ ID NO: 1379314 - protein, 9 aa, Homo Sapiens
NEDFERAWR

SEQ ID NO: 1379315 - protein, 9 aa, Homo Sapiens
PVCATTDKL

SEQ ID NO: 1379316 - protein, 9 aa, Homo Sapiens
NLSMEDFLK

SEQ ID NO: 1379317 - protein, 9 aa, Homo Sapiens
MVYVAQSAG

SEQ ID NO: 1379318 - protein, 9 aa, Homo Sapiens
LFEFFVVVS

SEQ ID NO: 1379319 - protein, 9 aa, Homo Sapiens
GPPMREVAE

SEQ ID NO: 1379320 - protein, 9 aa, Homo Sapiens
WPAVPVKRW

SEQ ID NO: 1379321 - protein, 9 aa, Homo Sapiens
SQPQVHPVP

SEQ ID NO: 1379322 - protein, 9 aa, Homo Sapiens
HHHSEYQQS

SEQ ID NO: 1379323 - protein, 9 aa, Homo Sapiens
AVEWLSGLL

SEQ ID NO: 1379324 - protein, 9 aa, Homo Sapiens
ETHSHSLKK

SEQ ID NO: 1379325 - protein, 9 aa, Homo Sapiens
LNQVLVDIH

SEQ ID NO: 1379326 - protein, 9 aa, Homo Sapiens
GLGPQRKPL

SEQ ID NO: 1379327 - protein, 9 aa, Homo Sapiens
LGRFRSMSP

SEQ ID NO: 1379328 - protein, 9 aa, Homo Sapiens
NAGPCPENS

SEQ ID NO: 1379329 - protein, 9 aa, Homo Sapiens
ERLVLAGGA

SEQ ID NO: 1379330 - protein, 9 aa, Homo Sapiens
QTFPRESCL

SEQ ID NO: 1379331 - protein, 9 aa, Homo Sapiens
TRAEEPVEG

SEQ ID NO: 1379332 - protein, 9 aa, Homo Sapiens
GAERIVELL

SEQ ID NO: 1379333 - protein, 9 aa, Homo Sapiens
PTDPHRLGR

SEQ ID NO: 1379334 - protein, 9 aa, Homo Sapiens
LGCSHVCSR

SEQ ID NO: 1379335 - protein, 9 aa, Homo Sapiens
LMNSVMVGT

SEQ ID NO: 1379336 - protein, 9 aa, Homo Sapiens
PRLEKLWNG

SEQ ID NO: 1379337 - protein, 9 aa, Homo Sapiens
IAQELEERL

SEQ ID NO: 1379338 - protein, 9 aa, Homo Sapiens
IIKLLYGKR

SEQ ID NO: 1379339 - protein, 9 aa, Homo Sapiens
LAPALALEI

SEQ ID NO: 1379340 - protein, 9 aa, Homo Sapiens
EKKTGSVRK

SEQ ID NO: 1379341 - protein, 9 aa, Homo Sapiens
GSLCCCCRC

SEQ ID NO: 1379342 - protein, 9 aa, Homo Sapiens
RVLQAFLPD

SEQ ID NO: 1379343 - protein, 9 aa, Homo Sapiens
EDGGVGDGD

SEQ ID NO: 1379344 - protein, 9 aa, Homo Sapiens
AGPCPENSL

SEQ ID NO: 1379345 - protein, 9 aa, Homo Sapiens
GRIQMVHSS

SEQ ID NO: 1379346 - protein, 9 aa, Homo Sapiens
LQAPLEQHT

SEQ ID NO: 1379347 - protein, 9 aa, Homo Sapiens
GVWGLKKIF

SEQ ID NO: 1379348 - protein, 9 aa, Homo Sapiens
PLLLPLLSG

SEQ ID NO: 1379349 - protein, 9 aa, Homo Sapiens
GAASAWAPR

SEQ ID NO: 1379350 - protein, 9 aa, Homo Sapiens
RECKLGASG

SEQ ID NO: 1379351 - protein, 9 aa, Homo Sapiens
VQQHCLECW

SEQ ID NO: 1379352 - protein, 9 aa, Homo Sapiens
RYKIWCNIH

SEQ ID NO: 1379353 - protein, 9 aa, Homo Sapiens
PHDSTQGKN

SEQ ID NO: 1379354 - protein, 9 aa, Homo Sapiens
VATQQTTAS

SEQ ID NO: 1379355 - protein, 9 aa, Homo Sapiens
GHFAQDCKQ

SEQ ID NO: 1379356 - protein, 9 aa, Homo Sapiens
AVSKGQPTL

SEQ ID NO: 1379357 - protein, 9 aa, Homo Sapiens
NAGTVHLGS

SEQ ID NO: 1379358 - protein, 9 aa, Homo Sapiens
NQGGPRRGW

SEQ ID NO: 1379359 - protein, 9 aa, Homo Sapiens
LVPHACCGL

SEQ ID NO: 1379360 - protein, 9 aa, Homo Sapiens
CSNLTSSSL

SEQ ID NO: 1379361 - protein, 9 aa, Homo Sapiens
AVLYLKKKQ

SEQ ID NO: 1379362 - protein, 9 aa, Homo Sapiens
FHYDNTPGI

SEQ ID NO: 1379363 - protein, 9 aa, Homo Sapiens
LVTGLPGSV

SEQ ID NO: 1379364 - protein, 9 aa, Homo Sapiens
HQERRLPGA

SEQ ID NO: 1379365 - protein, 9 aa, Homo Sapiens
GMTFTTFDM

SEQ ID NO: 1379366 - protein, 9 aa, Homo Sapiens
TAIGGGVAR

SEQ ID NO: 1379367 - protein, 9 aa, Homo Sapiens
QYPEFESMG

SEQ ID NO: 1379368 - protein, 9 aa, Homo Sapiens
ISVVVTYFV

SEQ ID NO: 1379369 - protein, 9 aa, Homo Sapiens
LLTWQLWHR

SEQ ID NO: 1379370 - protein, 9 aa, Homo Sapiens
FSCQWPTEG

SEQ ID NO: 1379371 - protein, 9 aa, Homo Sapiens
ITLCSSLLE

SEQ ID NO: 1379372 - protein, 9 aa, Homo Sapiens
SGDGNKKPA

SEQ ID NO: 1379373 - protein, 9 aa, Homo Sapiens
QERQLFEFF

SEQ ID NO: 1379374 - protein, 9 aa, Homo Sapiens
GISRQIPPF

SEQ ID NO: 1379375 - protein, 9 aa, Homo Sapiens
SPDTKKNSI

SEQ ID NO: 1379376 - protein, 9 aa, Homo Sapiens
NSSTPKREK

SEQ ID NO: 1379377 - protein, 9 aa, Homo Sapiens
TATTNRAGL

SEQ ID NO: 1379378 - protein, 9 aa, Homo Sapiens
HHSVSVQDG

SEQ ID NO: 1379379 - protein, 9 aa, Homo Sapiens
QALMPPVPC

SEQ ID NO: 1379380 - protein, 9 aa, Homo Sapiens
RKSEVQVTY

SEQ ID NO: 1379381 - protein, 9 aa, Homo Sapiens
GSLGSFVAM

SEQ ID NO: 1379382 - protein, 9 aa, Homo Sapiens
HKDFKKGSW

SEQ ID NO: 1379383 - protein, 9 aa, Homo Sapiens
SGLLDALLK

SEQ ID NO: 1379384 - protein, 9 aa, Homo Sapiens
QKKLERERM

SEQ ID NO: 1379385 - protein, 9 aa, Homo Sapiens
SGFVVFTVL

SEQ ID NO: 1379386 - protein, 9 aa, Homo Sapiens
LPLLLPLLS

SEQ ID NO: 1379387 - protein, 9 aa, Homo Sapiens
SSYTKILQQ

SEQ ID NO: 1379388 - protein, 9 aa, Homo Sapiens
VTSCCRPSC

SEQ ID NO: 1379389 - protein, 9 aa, Homo Sapiens
FCERIPKPQ

SEQ ID NO: 1379390 - protein, 9 aa, Homo Sapiens
DVFSELSFP

SEQ ID NO: 1379391 - protein, 9 aa, Homo Sapiens
TLVRPLWDK

SEQ ID NO: 1379392 - protein, 9 aa, Homo Sapiens
TLPINPTII

SEQ ID NO: 1379393 - protein, 9 aa, Homo Sapiens
TARAPEASW

SEQ ID NO: 1379394 - protein, 9 aa, Homo Sapiens
FAQFIIDGR

SEQ ID NO: 1379395 - protein, 9 aa, Homo Sapiens
GCPFHDGDY

SEQ ID NO: 1379396 - protein, 9 aa, Homo Sapiens
LLEELSLNY

SEQ ID NO: 1379397 - protein, 9 aa, Homo Sapiens
EELTEEEGK

SEQ ID NO: 1379398 - protein, 9 aa, Homo Sapiens
KPFILTRDM

SEQ ID NO: 1379399 - protein, 9 aa, Homo Sapiens
ERGGGCLPP

SEQ ID NO: 1379400 - protein, 9 aa, Homo Sapiens
TCAGTNMVG

SEQ ID NO: 1379401 - protein, 9 aa, Homo Sapiens
EELSLNYFL

SEQ ID NO: 1379402 - protein, 9 aa, Homo Sapiens
NFTKLAKKN

SEQ ID NO: 1379403 - protein, 9 aa, Homo Sapiens
TSCCRPSCC

SEQ ID NO: 1379404 - protein, 9 aa, Homo Sapiens
MVPLGETHS

SEQ ID NO: 1379405 - protein, 9 aa, Homo Sapiens
VEKTRAYKV

SEQ ID NO: 1379406 - protein, 9 aa, Homo Sapiens
QLQLVTSRS

SEQ ID NO: 1379407 - protein, 9 aa, Homo Sapiens
SHKEDTDGH

SEQ ID NO: 1379408 - protein, 9 aa, Homo Sapiens
EKQKKLERE

SEQ ID NO: 1379409 - protein, 9 aa, Homo Sapiens
VQVKRGPGN

SEQ ID NO: 1379410 - protein, 9 aa, Homo Sapiens
ARSIARARN

SEQ ID NO: 1379411 - protein, 9 aa, Homo Sapiens
PPVPCMGPP

SEQ ID NO: 1379412 - protein, 9 aa, Homo Sapiens
LCCFKWTCT

SEQ ID NO: 1379413 - protein, 9 aa, Homo Sapiens
AGHQRPFLE

SEQ ID NO: 1379414 - protein, 9 aa, Homo Sapiens
HHEYTESMC

SEQ ID NO: 1379415 - protein, 9 aa, Homo Sapiens
VHELMTYIE

SEQ ID NO: 1379416 - protein, 9 aa, Homo Sapiens
YTVQTAQDR

SEQ ID NO: 1379417 - protein, 9 aa, Homo Sapiens
IIIILSLME

SEQ ID NO: 1379418 - protein, 9 aa, Homo Sapiens
KITEIKDGE

SEQ ID NO: 1379419 - protein, 9 aa, Homo Sapiens
LLCHGQVQG

SEQ ID NO: 1379420 - protein, 9 aa, Homo Sapiens
GLENWLLRS

SEQ ID NO: 1379421 - protein, 9 aa, Homo Sapiens
KPKEQEKEG

SEQ ID NO: 1379422 - protein, 9 aa, Homo Sapiens
GDPDAVVAS

SEQ ID NO: 1379423 - protein, 9 aa, Homo Sapiens
YVLEPSPIS

SEQ ID NO: 1379424 - protein, 9 aa, Homo Sapiens
HYPRECKLG

SEQ ID NO: 1379425 - protein, 9 aa, Homo Sapiens
PKMHKCKCC

SEQ ID NO: 1379426 - protein, 9 aa, Homo Sapiens
VGKARRRNA

SEQ ID NO: 1379427 - protein, 9 aa, Homo Sapiens
DSGVCLCGT

SEQ ID NO: 1379428 - protein, 9 aa, Homo Sapiens
DSQNCEDAQ

SEQ ID NO: 1379429 - protein, 9 aa, Homo Sapiens
TCRWQCIEC

SEQ ID NO: 1379430 - protein, 9 aa, Homo Sapiens
QRPRCFLTL

SEQ ID NO: 1379431 - protein, 9 aa, Homo Sapiens
DAYQSVHTL

SEQ ID NO: 1379432 - protein, 9 aa, Homo Sapiens
QFSLMAKGS

SEQ ID NO: 1379433 - protein, 9 aa, Homo Sapiens
IFHCRPPDQ

SEQ ID NO: 1379434 - protein, 9 aa, Homo Sapiens
KVSSAKFPK

SEQ ID NO: 1379435 - protein, 9 aa, Homo Sapiens
SQEFILCCL

SEQ ID NO: 1379436 - protein, 9 aa, Homo Sapiens
PINTDIGLP

SEQ ID NO: 1379437 - protein, 9 aa, Homo Sapiens
SQPKKCPCR

SEQ ID NO: 1379438 - protein, 9 aa, Homo Sapiens
NFSCQWPTE

SEQ ID NO: 1379439 - protein, 9 aa, Homo Sapiens
NRRVCALML

SEQ ID NO: 1379440 - protein, 9 aa, Homo Sapiens
HSLPAREGS

SEQ ID NO: 1379441 - protein, 9 aa, Homo Sapiens
HRIIGAVRT

SEQ ID NO: 1379442 - protein, 9 aa, Homo Sapiens
PQFLYQLYC

SEQ ID NO: 1379443 - protein, 9 aa, Homo Sapiens
VHYRIHTGK

SEQ ID NO: 1379444 - protein, 9 aa, Homo Sapiens
NHLIKTAQP

SEQ ID NO: 1379445 - protein, 9 aa, Homo Sapiens
TTTLLNTPP

SEQ ID NO: 1379446 - protein, 9 aa, Homo Sapiens
KREKRQAVN

SEQ ID NO: 1379447 - protein, 9 aa, Homo Sapiens
LPAPWTLTI

SEQ ID NO: 1379448 - protein, 9 aa, Homo Sapiens
MKTGLRCGT

SEQ ID NO: 1379449 - protein, 9 aa, Homo Sapiens
PKSPKQATQ

SEQ ID NO: 1379450 - protein, 9 aa, Homo Sapiens
GVIEETGFH

SEQ ID NO: 1379451 - protein, 9 aa, Homo Sapiens
EVTTRYEEK

SEQ ID NO: 1379452 - protein, 9 aa, Homo Sapiens
LLPAPWTLT

SEQ ID NO: 1379453 - protein, 9 aa, Homo Sapiens
EAPGQTPEL

SEQ ID NO: 1379454 - protein, 9 aa, Homo Sapiens
SAGDTLPIE

SEQ ID NO: 1379455 - protein, 9 aa, Homo Sapiens
NMMCQHTMI

SEQ ID NO: 1379456 - protein, 9 aa, Homo Sapiens
RNREYFRFS

SEQ ID NO: 1379457 - protein, 9 aa, Homo Sapiens
FLLVWHYCT

SEQ ID NO: 1379458 - protein, 9 aa, Homo Sapiens
GPGPHHSLP

SEQ ID NO: 1379459 - protein, 9 aa, Homo Sapiens
RYRAQGRSA

SEQ ID NO: 1379460 - protein, 9 aa, Homo Sapiens
EKILIGTVF

SEQ ID NO: 1379461 - protein, 9 aa, Homo Sapiens
ERYRAQGRS

SEQ ID NO: 1379462 - protein, 9 aa, Homo Sapiens
AFGQFWGGL

SEQ ID NO: 1379463 - protein, 9 aa, Homo Sapiens
HEKILIGTV

SEQ ID NO: 1379464 - protein, 9 aa, Homo Sapiens
ITSLQFSLM

SEQ ID NO: 1379465 - protein, 9 aa, Homo Sapiens
ETSSYGTII

SEQ ID NO: 1379466 - protein, 9 aa, Homo Sapiens
TVNSPGPLE

SEQ ID NO: 1379467 - protein, 9 aa, Homo Sapiens
ANYSPGGLP

SEQ ID NO: 1379468 - protein, 9 aa, Homo Sapiens
PVVAGRGPA

SEQ ID NO: 1379469 - protein, 9 aa, Homo Sapiens
PIEGWSHFD

SEQ ID NO: 1379470 - protein, 9 aa, Homo Sapiens
LTLGVERTR

SEQ ID NO: 1379471 - protein, 9 aa, Homo Sapiens
CFEEDPGCK

SEQ ID NO: 1379472 - protein, 9 aa, Homo Sapiens
DDYIFHCRP

SEQ ID NO: 1379473 - protein, 9 aa, Homo Sapiens
AHIKAKGAA

SEQ ID NO: 1379474 - protein, 9 aa, Homo Sapiens
HSVSVQDGI

SEQ ID NO: 1379475 - protein, 9 aa, Homo Sapiens
AFLSGSNFG

SEQ ID NO: 1379476 - protein, 9 aa, Homo Sapiens
LQSTTGSQR

SEQ ID NO: 1379477 - protein, 9 aa, Homo Sapiens
GLWMLARSS

SEQ ID NO: 1379478 - protein, 9 aa, Homo Sapiens
RRRRQRRTV

SEQ ID NO: 1379479 - protein, 9 aa, Homo Sapiens
TTRKEHWIH

SEQ ID NO: 1379480 - protein, 9 aa, Homo Sapiens
LWEQIYATA

SEQ ID NO: 1379481 - protein, 9 aa, Homo Sapiens
LPYQDPDGE

SEQ ID NO: 1379482 - protein, 9 aa, Homo Sapiens
LQLVTSRSD

SEQ ID NO: 1379483 - protein, 9 aa, Homo Sapiens
FELERGDLG

SEQ ID NO: 1379484 - protein, 9 aa, Homo Sapiens
CMKGGKCQE

SEQ ID NO: 1379485 - protein, 9 aa, Homo Sapiens
TASSIPSHP

SEQ ID NO: 1379486 - protein, 9 aa, Homo Sapiens
SRQIPPFGP

SEQ ID NO: 1379487 - protein, 9 aa, Homo Sapiens
RPSVYSNVA

SEQ ID NO: 1379488 - protein, 9 aa, Homo Sapiens
QSAPPIRRV

SEQ ID NO: 1379489 - protein, 9 aa, Homo Sapiens
VQCYWRLLK

SEQ ID NO: 1379490 - protein, 9 aa, Homo Sapiens
YPNGHFVCV

SEQ ID NO: 1379491 - protein, 9 aa, Homo Sapiens
LNSTETSKV

SEQ ID NO: 1379492 - protein, 9 aa, Homo Sapiens
SFVSGFVVF

SEQ ID NO: 1379493 - protein, 9 aa, Homo Sapiens
KQLIGNILE

SEQ ID NO: 1379494 - protein, 9 aa, Homo Sapiens
SCVAAGRGH

SEQ ID NO: 1379495 - protein, 9 aa, Homo Sapiens
DGYDIWEAI

SEQ ID NO: 1379496 - protein, 9 aa, Homo Sapiens
EPSPISLPL

SEQ ID NO: 1379497 - protein, 9 aa, Homo Sapiens
LLTDPKEQR

SEQ ID NO: 1379498 - protein, 9 aa, Homo Sapiens
RQIYSEHNY

SEQ ID NO: 1379499 - protein, 9 aa, Homo Sapiens
LSRILWFKV

SEQ ID NO: 1379500 - protein, 9 aa, Homo Sapiens
VTLTVPIVP

SEQ ID NO: 1379501 - protein, 9 aa, Homo Sapiens
QVTTAMLSF

SEQ ID NO: 1379502 - protein, 9 aa, Homo Sapiens
SPSKKQKKR

SEQ ID NO: 1379503 - protein, 9 aa, Homo Sapiens
EPGQCFCRF

SEQ ID NO: 1379504 - protein, 9 aa, Homo Sapiens
TGILMLSMG

SEQ ID NO: 1379505 - protein, 9 aa, Homo Sapiens
TLPLTINLL

SEQ ID NO: 1379506 - protein, 9 aa, Homo Sapiens
IPTNRQPRD

SEQ ID NO: 1379507 - protein, 9 aa, Homo Sapiens
SPFRSMPPR

SEQ ID NO: 1379508 - protein, 9 aa, Homo Sapiens
ESVRQIYSE

SEQ ID NO: 1379509 - protein, 9 aa, Homo Sapiens
PWIRSSHSM

SEQ ID NO: 1379510 - protein, 9 aa, Homo Sapiens
ALTGSQSPH

SEQ ID NO: 1379511 - protein, 9 aa, Homo Sapiens
QILHSRVQL

SEQ ID NO: 1379512 - protein, 9 aa, Homo Sapiens
FRKGGVVTI

SEQ ID NO: 1379513 - protein, 9 aa, Homo Sapiens
PPLSPAPST

SEQ ID NO: 1379514 - protein, 9 aa, Homo Sapiens
RSAPGTLPK

SEQ ID NO: 1379515 - protein, 9 aa, Homo Sapiens
SAQGGRAAE

SEQ ID NO: 1379516 - protein, 9 aa, Homo Sapiens
KIEHTETDA

SEQ ID NO: 1379517 - protein, 9 aa, Homo Sapiens
YAAVFAQFI

SEQ ID NO: 1379518 - protein, 9 aa, Homo Sapiens
WPCCMKTGL

SEQ ID NO: 1379519 - protein, 9 aa, Homo Sapiens
LNQIRATPE

SEQ ID NO: 1379520 - protein, 9 aa, Homo Sapiens
DIWEAISEG

SEQ ID NO: 1379521 - protein, 9 aa, Homo Sapiens
ASITIAVSS

SEQ ID NO: 1379522 - protein, 9 aa, Homo Sapiens
TSPTHPLLL

SEQ ID NO: 1379523 - protein, 9 aa, Homo Sapiens
YQEGQWHCG

SEQ ID NO: 1379524 - protein, 9 aa, Homo Sapiens
VALKLKLRD

SEQ ID NO: 1379525 - protein, 9 aa, Homo Sapiens
PAVQHCNLA

SEQ ID NO: 1379526 - protein, 9 aa, Homo Sapiens
SYLAQSVQS

SEQ ID NO: 1379527 - protein, 9 aa, Homo Sapiens
VKASEAGDV

SEQ ID NO: 1379528 - protein, 9 aa, Homo Sapiens
RREEREREK

SEQ ID NO: 1379529 - protein, 9 aa, Homo Sapiens
LNYCDELSL

SEQ ID NO: 1379530 - protein, 9 aa, Homo Sapiens
VGLLPRVMC

SEQ ID NO: 1379531 - protein, 9 aa, Homo Sapiens
CDSITSNVL

SEQ ID NO: 1379532 - protein, 9 aa, Homo Sapiens
ALLQEDLAY

SEQ ID NO: 1379533 - protein, 9 aa, Homo Sapiens
CQWPTEGRI

SEQ ID NO: 1379534 - protein, 9 aa, Homo Sapiens
PLTINLLEE

SEQ ID NO: 1379535 - protein, 9 aa, Homo Sapiens
VWGSLTVQN

SEQ ID NO: 1379536 - protein, 9 aa, Homo Sapiens
CHSYCCIRS

SEQ ID NO: 1379537 - protein, 9 aa, Homo Sapiens
QSYPGQQQD

SEQ ID NO: 1379538 - protein, 9 aa, Homo Sapiens
SASSSSEPL

SEQ ID NO: 1379539 - protein, 9 aa, Homo Sapiens
TDPGSPPEC

SEQ ID NO: 1379540 - protein, 9 aa, Homo Sapiens
TDKGGFFCE

SEQ ID NO: 1379541 - protein, 9 aa, Homo Sapiens
GAEKITGDL

SEQ ID NO: 1379542 - protein, 9 aa, Homo Sapiens
ACCGLCHGG

SEQ ID NO: 1379543 - protein, 9 aa, Homo Sapiens
MIEPGQCFC

SEQ ID NO: 1379544 - protein, 9 aa, Homo Sapiens
QGIALQSTT

SEQ ID NO: 1379545 - protein, 9 aa, Homo Sapiens
QHCNLARDL

SEQ ID NO: 1379546 - protein, 9 aa, Homo Sapiens
DSYVHELMT

SEQ ID NO: 1379547 - protein, 9 aa, Homo Sapiens
DMTGFLCAL

SEQ ID NO: 1379548 - protein, 9 aa, Homo Sapiens
LISCLGAFG

SEQ ID NO: 1379549 - protein, 9 aa, Homo Sapiens
IRKWKKGLG

SEQ ID NO: 1379550 - protein, 9 aa, Homo Sapiens
RMRSSKESL

SEQ ID NO: 1379551 - protein, 9 aa, Homo Sapiens
HLIKTAQPY

SEQ ID NO: 1379552 - protein, 9 aa, Homo Sapiens
AVPTKSSRK

SEQ ID NO: 1379553 - protein, 9 aa, Homo Sapiens
IKDGEFKNL

SEQ ID NO: 1379554 - protein, 9 aa, Homo Sapiens
TTPPLPPRR

SEQ ID NO: 1379555 - protein, 9 aa, Homo Sapiens
NIPQRSAPG

SEQ ID NO: 1379556 - protein, 9 aa, Homo Sapiens
VSKKKDSQN

SEQ ID NO: 1379557 - protein, 9 aa, Homo Sapiens
MSGRKACST

SEQ ID NO: 1379558 - protein, 9 aa, Homo Sapiens
SLQGIQFSD

SEQ ID NO: 1379559 - protein, 9 aa, Homo Sapiens
NNQGGPRRG

SEQ ID NO: 1379560 - protein, 9 aa, Homo Sapiens
NPVKQEETP

SEQ ID NO: 1379561 - protein, 9 aa, Homo Sapiens
QLIGNILEE

SEQ ID NO: 1379562 - protein, 9 aa, Homo Sapiens
LSMEDFLKT

SEQ ID NO: 1379563 - protein, 9 aa, Homo Sapiens
ILTRDMAQA

SEQ ID NO: 1379564 - protein, 9 aa, Homo Sapiens
TPWLNHVSC

SEQ ID NO: 1379565 - protein, 9 aa, Homo Sapiens
DYSRLYQLA

SEQ ID NO: 1379566 - protein, 9 aa, Homo Sapiens
HPLLLPAPW

SEQ ID NO: 1379567 - protein, 9 aa, Homo Sapiens
PTSPTHPLL

SEQ ID NO: 1379568 - protein, 9 aa, Homo Sapiens
VPFPVRRAI

SEQ ID NO: 1379569 - protein, 9 aa, Homo Sapiens
IVSGFLTAL

SEQ ID NO: 1379570 - protein, 9 aa, Homo Sapiens
VSMCAAFCY

SEQ ID NO: 1379571 - protein, 9 aa, Homo Sapiens
MVHGAFQAQ

SEQ ID NO: 1379572 - protein, 9 aa, Homo Sapiens
ILETSWGLE

SEQ ID NO: 1379573 - protein, 9 aa, Homo Sapiens
ARPLRGAAT

SEQ ID NO: 1379574 - protein, 9 aa, Homo Sapiens
VVTSVKEMD

SEQ ID NO: 1379575 - protein, 9 aa, Homo Sapiens
LLGCSHVCS

SEQ ID NO: 1379576 - protein, 9 aa, Homo Sapiens
SQLTVSSLR

SEQ ID NO: 1379577 - protein, 9 aa, Homo Sapiens
QQWPCCMKT

SEQ ID NO: 1379578 - protein, 9 aa, Homo Sapiens
KAKSLAMTV

SEQ ID NO: 1379579 - protein, 9 aa, Homo Sapiens
SGRLFILCG

SEQ ID NO: 1379580 - protein, 9 aa, Homo Sapiens
YDISVVVTY

SEQ ID NO: 1379581 - protein, 9 aa, Homo Sapiens
DEDLKAIKF

SEQ ID NO: 1379582 - protein, 9 aa, Homo Sapiens
GHRHWVLGI

SEQ ID NO: 1379583 - protein, 9 aa, Homo Sapiens
EAHNSWDSP

SEQ ID NO: 1379584 - protein, 9 aa, Homo Sapiens
YFLSTNNAF

SEQ ID NO: 1379585 - protein, 9 aa, Homo Sapiens
PLQPVCATT

SEQ ID NO: 1379586 - protein, 9 aa, Homo Sapiens
FVVFVQVKR

SEQ ID NO: 1379587 - protein, 9 aa, Homo Sapiens
KHTMPFWRI

SEQ ID NO: 1379588 - protein, 9 aa, Homo Sapiens
CCCRCCCCC

SEQ ID NO: 1379589 - protein, 9 aa, Homo Sapiens
ITPASGLHS

SEQ ID NO: 1379590 - protein, 9 aa, Homo Sapiens
KCVKSLVVQ

SEQ ID NO: 1379591 - protein, 9 aa, Homo Sapiens
GGKTPWLNH

SEQ ID NO: 1379592 - protein, 9 aa, Homo Sapiens
PCDHHGDTL

SEQ ID NO: 1379593 - protein, 9 aa, Homo Sapiens
PWKAKRQEA

SEQ ID NO: 1379594 - protein, 9 aa, Homo Sapiens
ERGDLGYLV

SEQ ID NO: 1379595 - protein, 9 aa, Homo Sapiens
LTALLALLV

SEQ ID NO: 1379596 - protein, 9 aa, Homo Sapiens
FSSLEDPAL

SEQ ID NO: 1379597 - protein, 9 aa, Homo Sapiens
QRDPRLNKV

SEQ ID NO: 1379598 - protein, 9 aa, Homo Sapiens
LTPTSPRGK

SEQ ID NO: 1379599 - protein, 9 aa, Homo Sapiens
CCCCRCCCC

SEQ ID NO: 1379600 - protein, 9 aa, Homo Sapiens
HESTKRRKK

SEQ ID NO: 1379601 - protein, 9 aa, Homo Sapiens
LVAPPFPAK

SEQ ID NO: 1379602 - protein, 9 aa, Homo Sapiens
HESHVVRLC

SEQ ID NO: 1379603 - protein, 9 aa, Homo Sapiens
GPLTGWAAS

SEQ ID NO: 1379604 - protein, 9 aa, Homo Sapiens
VRKANRMPK

SEQ ID NO: 1379605 - protein, 9 aa, Homo Sapiens
QDICPDQKI

SEQ ID NO: 1379606 - protein, 9 aa, Homo Sapiens
PQVHPVPGN

SEQ ID NO: 1379607 - protein, 9 aa, Homo Sapiens
GDGATVPLQ

SEQ ID NO: 1379608 - protein, 9 aa, Homo Sapiens
QAPLEQHTV

SEQ ID NO: 1379609 - protein, 9 aa, Homo Sapiens
TGDLEEMRK

SEQ ID NO: 1379610 - protein, 9 aa, Homo Sapiens
RERGGGCLP

SEQ ID NO: 1379611 - protein, 9 aa, Homo Sapiens
KHRLSVVSN

SEQ ID NO: 1379612 - protein, 9 aa, Homo Sapiens
TGAASGVAA

SEQ ID NO: 1379613 - protein, 9 aa, Homo Sapiens
GTIDSLPNL

SEQ ID NO: 1379614 - protein, 9 aa, Homo Sapiens
LDDGEVEDE

SEQ ID NO: 1379615 - protein, 9 aa, Homo Sapiens
LNDDNCQAF

SEQ ID NO: 1379616 - protein, 9 aa, Homo Sapiens
IFNCSIRRK

SEQ ID NO: 1379617 - protein, 9 aa, Homo Sapiens
TKVCAVPDT

SEQ ID NO: 1379618 - protein, 9 aa, Homo Sapiens
VPIVPFPVR

SEQ ID NO: 1379619 - protein, 9 aa, Homo Sapiens
QVQWWLLQI

SEQ ID NO: 1379620 - protein, 9 aa, Homo Sapiens
LDRQLQLVT

SEQ ID NO: 1379621 - protein, 9 aa, Homo Sapiens
FRLCHVTTG

SEQ ID NO: 1379622 - protein, 9 aa, Homo Sapiens
EYVLEPSPI

SEQ ID NO: 1379623 - protein, 9 aa, Homo Sapiens
TPTEEEKED

SEQ ID NO: 1379624 - protein, 9 aa, Homo Sapiens
VAQSAGRLM

SEQ ID NO: 1379625 - protein, 9 aa, Homo Sapiens
PEASWSPAS

SEQ ID NO: 1379626 - protein, 9 aa, Homo Sapiens
QAVYLLVQY

SEQ ID NO: 1379627 - protein, 9 aa, Homo Sapiens
CENPAVPCV

SEQ ID NO: 1379628 - protein, 9 aa, Homo Sapiens
QEKRTACAQ

SEQ ID NO: 1379629 - protein, 9 aa, Homo Sapiens
LAEVGKCLA

SEQ ID NO: 1379630 - protein, 9 aa, Homo Sapiens
LLEVEETRC

SEQ ID NO: 1379631 - protein, 9 aa, Homo Sapiens
IENVKAKVQ

SEQ ID NO: 1379632 - protein, 9 aa, Homo Sapiens
KCRCESTIV

SEQ ID NO: 1379633 - protein, 9 aa, Homo Sapiens
EKEGIFFID

SEQ ID NO: 1379634 - protein, 9 aa, Homo Sapiens
GGEHVPSSP

SEQ ID NO: 1379635 - protein, 9 aa, Homo Sapiens
SCSNLTSSS

SEQ ID NO: 1379636 - protein, 9 aa, Homo Sapiens
KKQEPPCTR

SEQ ID NO: 1379637 - protein, 9 aa, Homo Sapiens
LVSLPWIRS

SEQ ID NO: 1379638 - protein, 9 aa, Homo Sapiens
LRKKTCLPF

SEQ ID NO: 1379639 - protein, 9 aa, Homo Sapiens
QLLFSSLED

SEQ ID NO: 1379640 - protein, 9 aa, Homo Sapiens
LPKAGAASA

SEQ ID NO: 1379641 - protein, 9 aa, Homo Sapiens
NKKPASEGS

SEQ ID NO: 1379642 - protein, 9 aa, Homo Sapiens
EGRIQMVHS

SEQ ID NO: 1379643 - protein, 9 aa, Homo Sapiens
AENAAVDAV

SEQ ID NO: 1379644 - protein, 9 aa, Homo Sapiens
IETMRSLKG

SEQ ID NO: 1379645 - protein, 9 aa, Homo Sapiens
DRPLPVDAG

SEQ ID NO: 1379646 - protein, 9 aa, Homo Sapiens
LWNFELERG

SEQ ID NO: 1379647 - protein, 9 aa, Homo Sapiens
SSLSAPLPI

SEQ ID NO: 1379648 - protein, 9 aa, Homo Sapiens
RTACAQKKL

SEQ ID NO: 1379649 - protein, 9 aa, Homo Sapiens
KCLCHSYCC

SEQ ID NO: 1379650 - protein, 9 aa, Homo Sapiens
GRGRGRPCG

SEQ ID NO: 1379651 - protein, 9 aa, Homo Sapiens
RPRHPRHHQ

SEQ ID NO: 1379652 - protein, 9 aa, Homo Sapiens
ARRLAYLHE

SEQ ID NO: 1379653 - protein, 9 aa, Homo Sapiens
TDPKEQRKE

SEQ ID NO: 1379654 - protein, 9 aa, Homo Sapiens
VKRWSLSCR

SEQ ID NO: 1379655 - protein, 9 aa, Homo Sapiens
KLSTIALTL

SEQ ID NO: 1379656 - protein, 9 aa, Homo Sapiens
GDEAAWTGA

SEQ ID NO: 1379657 - protein, 9 aa, Homo Sapiens
EIMNPKSFI

SEQ ID NO: 1379658 - protein, 9 aa, Homo Sapiens
FSIGCAKQT

SEQ ID NO: 1379659 - protein, 9 aa, Homo Sapiens
SRVQLPIVS

SEQ ID NO: 1379660 - protein, 9 aa, Homo Sapiens
NEVDYVPSL

SEQ ID NO: 1379661 - protein, 9 aa, Homo Sapiens
TYQEGQWHC

SEQ ID NO: 1379662 - protein, 9 aa, Homo Sapiens
LLWGHLVRI

SEQ ID NO: 1379663 - protein, 9 aa, Homo Sapiens
APALALEIP

SEQ ID NO: 1379664 - protein, 9 aa, Homo Sapiens
FKVVTSVKE

SEQ ID NO: 1379665 - protein, 9 aa, Homo Sapiens
VQEVLKKKT

SEQ ID NO: 1379666 - protein, 9 aa, Homo Sapiens
RKANRMPKD

SEQ ID NO: 1379667 - protein, 9 aa, Homo Sapiens
GPGNQLRNH

SEQ ID NO: 1379668 - protein, 9 aa, Homo Sapiens
SERGERAHF

SEQ ID NO: 1379669 - protein, 9 aa, Homo Sapiens
KNDCKFCFS

SEQ ID NO: 1379670 - protein, 9 aa, Homo Sapiens
ITSSYHSKH

SEQ ID NO: 1379671 - protein, 9 aa, Homo Sapiens
CPRSQSQII

SEQ ID NO: 1379672 - protein, 9 aa, Homo Sapiens
SAPATVPGL

SEQ ID NO: 1379673 - protein, 9 aa, Homo Sapiens
PLSPPKKKS

SEQ ID NO: 1379674 - protein, 9 aa, Homo Sapiens
EYGGGYGPV

SEQ ID NO: 1379675 - protein, 9 aa, Homo Sapiens
PFRSMPPRQ

SEQ ID NO: 1379676 - protein, 9 aa, Homo Sapiens
SLLRPLTPG

SEQ ID NO: 1379677 - protein, 9 aa, Homo Sapiens
VSPVRDLDR

SEQ ID NO: 1379678 - protein, 9 aa, Homo Sapiens
PARLRHLLC

SEQ ID NO: 1379679 - protein, 9 aa, Homo Sapiens
PGLWREQQH

SEQ ID NO: 1379680 - protein, 9 aa, Homo Sapiens
GARPLRGAA

SEQ ID NO: 1379681 - protein, 9 aa, Homo Sapiens
IWCPFIPRR

SEQ ID NO: 1379682 - protein, 9 aa, Homo Sapiens
HRPSCYSQV

SEQ ID NO: 1379683 - protein, 9 aa, Homo Sapiens
KQEKRTACA

SEQ ID NO: 1379684 - protein, 9 aa, Homo Sapiens
FVQVKRGPG

SEQ ID NO: 1379685 - protein, 9 aa, Homo Sapiens
ETRRKSKYN

SEQ ID NO: 1379686 - protein, 9 aa, Homo Sapiens
VTYMGSFMD

SEQ ID NO: 1379687 - protein, 9 aa, Homo Sapiens
FLKTRVSLL

SEQ ID NO: 1379688 - protein, 9 aa, Homo Sapiens
SIRCPAELP

SEQ ID NO: 1379689 - protein, 9 aa, Homo Sapiens
VSQQNKNTP

SEQ ID NO: 1379690 - protein, 9 aa, Homo Sapiens
SWTRTCPRT

SEQ ID NO: 1379691 - protein, 9 aa, Homo Sapiens
KFCFSCNLR

SEQ ID NO: 1379692 - protein, 9 aa, Homo Sapiens
FEIMNPKSF

SEQ ID NO: 1379693 - protein, 9 aa, Homo Sapiens
FIMNDTHVD

SEQ ID NO: 1379694 - protein, 9 aa, Homo Sapiens
VQSQARELP

SEQ ID NO: 1379695 - protein, 9 aa, Homo Sapiens
SEFHAEKLA

SEQ ID NO: 1379696 - protein, 9 aa, Homo Sapiens
KLKLRDKRK

SEQ ID NO: 1379697 - protein, 9 aa, Homo Sapiens
VSEASITIA

SEQ ID NO: 1379698 - protein, 9 aa, Homo Sapiens
GKSVWGSLT

SEQ ID NO: 1379699 - protein, 9 aa, Homo Sapiens
FLTEGLSTL

SEQ ID NO: 1379700 - protein, 9 aa, Homo Sapiens
IEPGQCFCR

SEQ ID NO: 1379701 - protein, 9 aa, Homo Sapiens
EGAVIIPGA

SEQ ID NO: 1379702 - protein, 9 aa, Homo Sapiens
VTGVSELPG

SEQ ID NO: 1379703 - protein, 9 aa, Homo Sapiens
EVAEAAAVV

SEQ ID NO: 1379704 - protein, 9 aa, Homo Sapiens
ATVPGLWML

SEQ ID NO: 1379705 - protein, 9 aa, Homo Sapiens
RDHAISLSG

SEQ ID NO: 1379706 - protein, 9 aa, Homo Sapiens
RIRDEKGEI

SEQ ID NO: 1379707 - protein, 9 aa, Homo Sapiens
SLALHLQAQ

SEQ ID NO: 1379708 - protein, 9 aa, Homo Sapiens
SDRDSYVHE

SEQ ID NO: 1379709 - protein, 9 aa, Homo Sapiens
PAVNPWYVL

SEQ ID NO: 1379710 - protein, 9 aa, Homo Sapiens
PVECQLGHP

SEQ ID NO: 1379711 - protein, 9 aa, Homo Sapiens
QAVEWLSGL

SEQ ID NO: 1379712 - protein, 9 aa, Homo Sapiens
QAVGRQLGP

SEQ ID NO: 1379713 - protein, 9 aa, Homo Sapiens
IPKPQVINI

SEQ ID NO: 1379714 - protein, 9 aa, Homo Sapiens
GSIETDRGG

SEQ ID NO: 1379715 - protein, 9 aa, Homo Sapiens
AAVLFVCTL

SEQ ID NO: 1379716 - protein, 9 aa, Homo Sapiens
TSPDSLRKH

SEQ ID NO: 1379717 - protein, 9 aa, Homo Sapiens
AALCLGCCG

SEQ ID NO: 1379718 - protein, 9 aa, Homo Sapiens
TPPEAITLC

SEQ ID NO: 1379719 - protein, 9 aa, Homo Sapiens
TSFVSGFVV

SEQ ID NO: 1379720 - protein, 9 aa, Homo Sapiens
FNCSIRRKS

SEQ ID NO: 1379721 - protein, 9 aa, Homo Sapiens
YSNMIEPGQ

SEQ ID NO: 1379722 - protein, 9 aa, Homo Sapiens
PRCFLTLPL

SEQ ID NO: 1379723 - protein, 9 aa, Homo Sapiens
CSHVCSRTP

SEQ ID NO: 1379724 - protein, 9 aa, Homo Sapiens
CFSCNLRTA

SEQ ID NO: 1379725 - protein, 9 aa, Homo Sapiens
HSRVQLPIV

SEQ ID NO: 1379726 - protein, 9 aa, Homo Sapiens
LLNYVISSF

SEQ ID NO: 1379727 - protein, 9 aa, Homo Sapiens
RQIPPFGPP

SEQ ID NO: 1379728 - protein, 9 aa, Homo Sapiens
YSNVARQLH

SEQ ID NO: 1379729 - protein, 9 aa, Homo Sapiens
GQELSAHQA

SEQ ID NO: 1379730 - protein, 9 aa, Homo Sapiens
LGYEWDLVD

SEQ ID NO: 1379731 - protein, 9 aa, Homo Sapiens
EVPDSLALH

SEQ ID NO: 1379732 - protein, 9 aa, Homo Sapiens
HRQQPTDPH

SEQ ID NO: 1379733 - protein, 9 aa, Homo Sapiens
VLSSIFFEL

SEQ ID NO: 1379734 - protein, 9 aa, Homo Sapiens
TCVAYAATR

SEQ ID NO: 1379735 - protein, 9 aa, Homo Sapiens
PSDRDSYVH

SEQ ID NO: 1379736 - protein, 9 aa, Homo Sapiens
PSEAPGQTP

SEQ ID NO: 1379737 - protein, 9 aa, Homo Sapiens
LMPPVPCMG

SEQ ID NO: 1379738 - protein, 9 aa, Homo Sapiens
ALHLACASD

SEQ ID NO: 1379739 - protein, 9 aa, Homo Sapiens
DVQILHSRV

SEQ ID NO: 1379740 - protein, 9 aa, Homo Sapiens
CIISAVPTK

SEQ ID NO: 1379741 - protein, 9 aa, Homo Sapiens
DCKFCFSCN

SEQ ID NO: 1379742 - protein, 9 aa, Homo Sapiens
RVRKNHSSR

SEQ ID NO: 1379743 - protein, 9 aa, Homo Sapiens
RKEHEIRMQ

SEQ ID NO: 1379744 - protein, 9 aa, Homo Sapiens
GVARVEVAA

SEQ ID NO: 1379745 - protein, 9 aa, Homo Sapiens
SMGGPETLG

SEQ ID NO: 1379746 - protein, 9 aa, Homo Sapiens
SCKDCMKGG

SEQ ID NO: 1379747 - protein, 9 aa, Homo Sapiens
VSPGLDQLD

SEQ ID NO: 1379748 - protein, 9 aa, Homo Sapiens
DPHRLGRGR

SEQ ID NO: 1379749 - protein, 9 aa, Homo Sapiens
LSPPKKKSF

SEQ ID NO: 1379750 - protein, 9 aa, Homo Sapiens
VSQDHHNNS

SEQ ID NO: 1379751 - protein, 9 aa, Homo Sapiens
NCGVSGHFA

SEQ ID NO: 1379752 - protein, 9 aa, Homo Sapiens
LSLPNMIPT

SEQ ID NO: 1379753 - protein, 9 aa, Homo Sapiens
SPSYTGGRG

SEQ ID NO: 1379754 - protein, 9 aa, Homo Sapiens
CRTHRAVLA

SEQ ID NO: 1379755 - protein, 9 aa, Homo Sapiens
RVQATSVEV

SEQ ID NO: 1379756 - protein, 9 aa, Homo Sapiens
DNNQGGPRR

SEQ ID NO: 1379757 - protein, 9 aa, Homo Sapiens
FEFFVVVSL

SEQ ID NO: 1379758 - protein, 9 aa, Homo Sapiens
VHGAFQAQR

SEQ ID NO: 1379759 - protein, 9 aa, Homo Sapiens
DFERAWRED

SEQ ID NO: 1379760 - protein, 9 aa, Homo Sapiens
RHPRHHQTF

SEQ ID NO: 1379761 - protein, 9 aa, Homo Sapiens
RGSHFWIQD

SEQ ID NO: 1379762 - protein, 9 aa, Homo Sapiens
GKKCAVSVE

SEQ ID NO: 1379763 - protein, 9 aa, Homo Sapiens
SGSPMQNNR

SEQ ID NO: 1379764 - protein, 9 aa, Homo Sapiens
IQNPQAPEA

SEQ ID NO: 1379765 - protein, 9 aa, Homo Sapiens
EFNRRIRDE

SEQ ID NO: 1379766 - protein, 9 aa, Homo Sapiens
EKVSKKKDS

SEQ ID NO: 1379767 - protein, 9 aa, Homo Sapiens
AHNSWDSPA

SEQ ID NO: 1379768 - protein, 9 aa, Homo Sapiens
TVQTAQDRA

SEQ ID NO: 1379769 - protein, 9 aa, Homo Sapiens
NHYIIRVVS

SEQ ID NO: 1379770 - protein, 9 aa, Homo Sapiens
TMPFWRISS

SEQ ID NO: 1379771 - protein, 9 aa, Homo Sapiens
YKWLRNGTE

SEQ ID NO: 1379772 - protein, 9 aa, Homo Sapiens
WMGGKTPWL

SEQ ID NO: 1379773 - protein, 9 aa, Homo Sapiens
KPYKWTWEG

SEQ ID NO: 1379774 - protein, 9 aa, Homo Sapiens
EREGKGKSQ

SEQ ID NO: 1379775 - protein, 9 aa, Homo Sapiens
HHQPLLPVS

SEQ ID NO: 1379776 - protein, 9 aa, Homo Sapiens
TETHEHKKK

SEQ ID NO: 1379777 - protein, 9 aa, Homo Sapiens
HASGPGPHH

SEQ ID NO: 1379778 - protein, 9 aa, Homo Sapiens
AFQQHAPVE

SEQ ID NO: 1379779 - protein, 9 aa, Homo Sapiens
ITIAVSSAH

SEQ ID NO: 1379780 - protein, 9 aa, Homo Sapiens
PHACCGLCH

SEQ ID NO: 1379781 - protein, 9 aa, Homo Sapiens
TEEEKEDPE

SEQ ID NO: 1379782 - protein, 9 aa, Homo Sapiens
TLPKAGAAS

SEQ ID NO: 1379783 - protein, 9 aa, Homo Sapiens
SGVWGLKKI

SEQ ID NO: 1379784 - protein, 9 aa, Homo Sapiens
KEGIFFIDH

SEQ ID NO: 1379785 - protein, 9 aa, Homo Sapiens
TPDNQGRSR

SEQ ID NO: 1379786 - protein, 9 aa, Homo Sapiens
CPDYDRMSS

SEQ ID NO: 1379787 - protein, 9 aa, Homo Sapiens
TDPHRLGRG

SEQ ID NO: 1379788 - protein, 9 aa, Homo Sapiens
DIFFCANVV

SEQ ID NO: 1379789 - protein, 9 aa, Homo Sapiens
ENVCLNYCD

SEQ ID NO: 1379790 - protein, 9 aa, Homo Sapiens
HYCTLTIRE

SEQ ID NO: 1379791 - protein, 9 aa, Homo Sapiens
FQLLTDPKE

SEQ ID NO: 1379792 - protein, 9 aa, Homo Sapiens
PRNGTSLRV

SEQ ID NO: 1379793 - protein, 9 aa, Homo Sapiens
GSVPGKEGS

SEQ ID NO: 1379794 - protein, 9 aa, Homo Sapiens
GRFRSMSPI

SEQ ID NO: 1379795 - protein, 9 aa, Homo Sapiens
GSLWPEDRP

SEQ ID NO: 1379796 - protein, 9 aa, Homo Sapiens
DHFLAIHNP

SEQ ID NO: 1379797 - protein, 9 aa, Homo Sapiens
GSWCLFCNL

SEQ ID NO: 1379798 - protein, 9 aa, Homo Sapiens
ERKIIFLTE

SEQ ID NO: 1379799 - protein, 9 aa, Homo Sapiens
HPEFEEDGD

SEQ ID NO: 1379800 - protein, 9 aa, Homo Sapiens
HAPVECQLG

SEQ ID NO: 1379801 - protein, 9 aa, Homo Sapiens
LVTSRSDIY

SEQ ID NO: 1379802 - protein, 9 aa, Homo Sapiens
LSSTCVAYA

SEQ ID NO: 1379803 - protein, 9 aa, Homo Sapiens
NSPGPLEEL

SEQ ID NO: 1379804 - protein, 9 aa, Homo Sapiens
SSERGERAH

SEQ ID NO: 1379805 - protein, 9 aa, Homo Sapiens
TWVERRQFN

SEQ ID NO: 1379806 - protein, 9 aa, Homo Sapiens
VVASSSGGR

SEQ ID NO: 1379807 - protein, 9 aa, Homo Sapiens
RQQQKIRKY

SEQ ID NO: 1379808 - protein, 9 aa, Homo Sapiens
NPPQLKELY

SEQ ID NO: 1379809 - protein, 9 aa, Homo Sapiens
EARAPLESV

SEQ ID NO: 1379810 - protein, 9 aa, Homo Sapiens
SSPFQVTAL

SEQ ID NO: 1379811 - protein, 9 aa, Homo Sapiens
VGTEEEISD

SEQ ID NO: 1379812 - protein, 9 aa, Homo Sapiens
CNIYDSATG

SEQ ID NO: 1379813 - protein, 9 aa, Homo Sapiens
QVFLKMILG

SEQ ID NO: 1379814 - protein, 9 aa, Homo Sapiens
LRDKRKCFE

SEQ ID NO: 1379815 - protein, 9 aa, Homo Sapiens
GLEEPGPRP

SEQ ID NO: 1379816 - protein, 9 aa, Homo Sapiens
VVGEGLIPG

SEQ ID NO: 1379817 - protein, 9 aa, Homo Sapiens
KAKQEKRTA

SEQ ID NO: 1379818 - protein, 9 aa, Homo Sapiens
AEMVHGAFQ

SEQ ID NO: 1379819 - protein, 9 aa, Homo Sapiens
GTIIMEGMP

SEQ ID NO: 1379820 - protein, 9 aa, Homo Sapiens
EEALEIKEN

SEQ ID NO: 1379821 - protein, 9 aa, Homo Sapiens
ELSVGSDTT

SEQ ID NO: 1379822 - protein, 9 aa, Homo Sapiens
ARARNREYF

SEQ ID NO: 1379823 - protein, 9 aa, Homo Sapiens
AYKVCTIRY

SEQ ID NO: 1379824 - protein, 9 aa, Homo Sapiens
ITEEEALEI

SEQ ID NO: 1379825 - protein, 9 aa, Homo Sapiens
LDQLDRQLQ

SEQ ID NO: 1379826 - protein, 9 aa, Homo Sapiens
WRPLGDSLI

SEQ ID NO: 1379827 - protein, 9 aa, Homo Sapiens
RTPPEAITL

SEQ ID NO: 1379828 - protein, 9 aa, Homo Sapiens
MRHNHLIKT

SEQ ID NO: 1379829 - protein, 9 aa, Homo Sapiens
VFTVLGYMA

SEQ ID NO: 1379830 - protein, 9 aa, Homo Sapiens
LPLQRQQIK

SEQ ID NO: 1379831 - protein, 9 aa, Homo Sapiens
AQRTLYRDG

SEQ ID NO: 1379832 - protein, 9 aa, Homo Sapiens
REGSLWPED

SEQ ID NO: 1379833 - protein, 9 aa, Homo Sapiens
TIVCLPGCL

SEQ ID NO: 1379834 - protein, 9 aa, Homo Sapiens
QEVGLLPRV

SEQ ID NO: 1379835 - protein, 9 aa, Homo Sapiens
LLSIRCPAE

SEQ ID NO: 1379836 - protein, 9 aa, Homo Sapiens
HPVVRNLAA

SEQ ID NO: 1379837 - protein, 9 aa, Homo Sapiens
SLAMTVTTS

SEQ ID NO: 1379838 - protein, 9 aa, Homo Sapiens
TYFVFVIAV

SEQ ID NO: 1379839 - protein, 9 aa, Homo Sapiens
DAGSALLQA

SEQ ID NO: 1379840 - protein, 9 aa, Homo Sapiens
HVPSSPFQV

SEQ ID NO: 1379841 - protein, 9 aa, Homo Sapiens
KKNSIGEKF

SEQ ID NO: 1379842 - protein, 9 aa, Homo Sapiens
RTIFFCERI

SEQ ID NO: 1379843 - protein, 9 aa, Homo Sapiens
ATFLASKDE

SEQ ID NO: 1379844 - protein, 9 aa, Homo Sapiens
TEGRIQMVH

SEQ ID NO: 1379845 - protein, 9 aa, Homo Sapiens
VRVLQAFLP

SEQ ID NO: 1379846 - protein, 9 aa, Homo Sapiens
NELWIAITK

SEQ ID NO: 1379847 - protein, 9 aa, Homo Sapiens
PFLQAVYLL

SEQ ID NO: 1379848 - protein, 9 aa, Homo Sapiens
QEVPPCDHH

SEQ ID NO: 1379849 - protein, 9 aa, Homo Sapiens
EGFDWSDRN

SEQ ID NO: 1379850 - protein, 9 aa, Homo Sapiens
TFTTFDMGG

SEQ ID NO: 1379851 - protein, 9 aa, Homo Sapiens
YRAQGRSAN

SEQ ID NO: 1379852 - protein, 9 aa, Homo Sapiens
VVFTVLGYM

SEQ ID NO: 1379853 - protein, 9 aa, Homo Sapiens
GDCPKGPQN

SEQ ID NO: 1379854 - protein, 9 aa, Homo Sapiens
HSPRSWTRT

SEQ ID NO: 1379855 - protein, 9 aa, Homo Sapiens
HPRHHQTFA

SEQ ID NO: 1379856 - protein, 9 aa, Homo Sapiens
PEFESMGDH

SEQ ID NO: 1379857 - protein, 9 aa, Homo Sapiens
EKITGDLEE

SEQ ID NO: 1379858 - protein, 9 aa, Homo Sapiens
QDPDGENKR

SEQ ID NO: 1379859 - protein, 9 aa, Homo Sapiens
QVQGQQERR

SEQ ID NO: 1379860 - protein, 9 aa, Homo Sapiens
FHCRPPDQK

SEQ ID NO: 1379861 - protein, 9 aa, Homo Sapiens
ATRMGTPRL

SEQ ID NO: 1379862 - protein, 9 aa, Homo Sapiens
MQANARLTA

SEQ ID NO: 1379863 - protein, 9 aa, Homo Sapiens
CPKGPQNPS

SEQ ID NO: 1379864 - protein, 9 aa, Homo Sapiens
LAGWRPLGD

SEQ ID NO: 1379865 - protein, 9 aa, Homo Sapiens
PRESCLLST

SEQ ID NO: 1379866 - protein, 9 aa, Homo Sapiens
PAKRQHNFT

SEQ ID NO: 1379867 - protein, 9 aa, Homo Sapiens
IVVSVGVDG

SEQ ID NO: 1379868 - protein, 9 aa, Homo Sapiens
VCAVPDTAW

SEQ ID NO: 1379869 - protein, 9 aa, Homo Sapiens
HACRHRNES

SEQ ID NO: 1379870 - protein, 9 aa, Homo Sapiens
QFLYQLYCL

SEQ ID NO: 1379871 - protein, 9 aa, Homo Sapiens
PEGPHRPSC

SEQ ID NO: 1379872 - protein, 9 aa, Homo Sapiens
QDLAFQQHA

SEQ ID NO: 1379873 - protein, 9 aa, Homo Sapiens
SLHRWTGTG

SEQ ID NO: 1379874 - protein, 9 aa, Homo Sapiens
CCFKWTCTV

SEQ ID NO: 1379875 - protein, 9 aa, Homo Sapiens
CVLGRIGDL

SEQ ID NO: 1379876 - protein, 9 aa, Homo Sapiens
TPTPQVPRL

SEQ ID NO: 1379877 - protein, 9 aa, Homo Sapiens
AGESSHKED

SEQ ID NO: 1379878 - protein, 9 aa, Homo Sapiens
QSNHTTNCF

SEQ ID NO: 1379879 - protein, 9 aa, Homo Sapiens
IQFSDRLKL

SEQ ID NO: 1379880 - protein, 9 aa, Homo Sapiens
ARLTATRRF

SEQ ID NO: 1379881 - protein, 9 aa, Homo Sapiens
TPTSVITSV

SEQ ID NO: 1379882 - protein, 9 aa, Homo Sapiens
MDSSYTKIL

SEQ ID NO: 1379883 - protein, 9 aa, Homo Sapiens
ATTNRAGLL

SEQ ID NO: 1379884 - protein, 9 aa, Homo Sapiens
PCTRLHGNI

SEQ ID NO: 1379885 - protein, 9 aa, Homo Sapiens
NPFAWMFFL

SEQ ID NO: 1379886 - protein, 9 aa, Homo Sapiens
PIRRVSPGQ

SEQ ID NO: 1379887 - protein, 9 aa, Homo Sapiens
MQTEGKKNL

SEQ ID NO: 1379888 - protein, 9 aa, Homo Sapiens
SMPPRQAQC

SEQ ID NO: 1379889 - protein, 9 aa, Homo Sapiens
LKQKKNEPR

SEQ ID NO: 1379890 - protein, 9 aa, Homo Sapiens
GYEWDLVDF

SEQ ID NO: 1379891 - protein, 9 aa, Homo Sapiens
FIDHSPRSW

SEQ ID NO: 1379892 - protein, 9 aa, Homo Sapiens
FDMFGGGGR

SEQ ID NO: 1379893 - protein, 9 aa, Homo Sapiens
VKKIIKLLY

SEQ ID NO: 1379894 - protein, 9 aa, Homo Sapiens
THISSAALP

SEQ ID NO: 1379895 - protein, 9 aa, Homo Sapiens
CQVRLNELL

SEQ ID NO: 1379896 - protein, 9 aa, Homo Sapiens
QREKAKKLD

SEQ ID NO: 1379897 - protein, 9 aa, Homo Sapiens
LVKRSRVEL

SEQ ID NO: 1379898 - protein, 9 aa, Homo Sapiens
LSTNNAFSG

SEQ ID NO: 1379899 - protein, 9 aa, Homo Sapiens
TETTVKFTP

SEQ ID NO: 1379900 - protein, 9 aa, Homo Sapiens
VMVVRPVAT

SEQ ID NO: 1379901 - protein, 9 aa, Homo Sapiens
GILMLSMGG

SEQ ID NO: 1379902 - protein, 9 aa, Homo Sapiens
IMVMMWMGG

SEQ ID NO: 1379903 - protein, 9 aa, Homo Sapiens
ALEIKENDR

SEQ ID NO: 1379904 - protein, 9 aa, Homo Sapiens
NSIFNCSIR

SEQ ID NO: 1379905 - protein, 9 aa, Homo Sapiens
LTVQNSPKG

SEQ ID NO: 1379906 - protein, 9 aa, Homo Sapiens
QQTTASSIP

SEQ ID NO: 1379907 - protein, 9 aa, Homo Sapiens
HAPPHTMQP

SEQ ID NO: 1379908 - protein, 9 aa, Homo Sapiens
RSEKSSYQK

SEQ ID NO: 1379909 - protein, 9 aa, Homo Sapiens
GNILEESDI

SEQ ID NO: 1379910 - protein, 9 aa, Homo Sapiens
DQHDTDEKY

SEQ ID NO: 1379911 - protein, 9 aa, Homo Sapiens
NGELVTGLP

SEQ ID NO: 1379912 - protein, 9 aa, Homo Sapiens
CAVSVETRL

SEQ ID NO: 1379913 - protein, 9 aa, Homo Sapiens
DMFGGGGRM

SEQ ID NO: 1379914 - protein, 9 aa, Homo Sapiens
RPLWDKIAM

SEQ ID NO: 1379915 - protein, 9 aa, Homo Sapiens
AGTAAVADP

SEQ ID NO: 1379916 - protein, 9 aa, Homo Sapiens
VEEFYKKKS

SEQ ID NO: 1379917 - protein, 9 aa, Homo Sapiens
NIPQQEVVD

SEQ ID NO: 1379918 - protein, 9 aa, Homo Sapiens
NFLLVWHYC

SEQ ID NO: 1379919 - protein, 9 aa, Homo Sapiens
TSSPTRRRR

SEQ ID NO: 1379920 - protein, 9 aa, Homo Sapiens
DEKGEIEQE

SEQ ID NO: 1379921 - protein, 9 aa, Homo Sapiens
KEDTDGHVA

SEQ ID NO: 1379922 - protein, 9 aa, Homo Sapiens
NPPRHPSIH

SEQ ID NO: 1379923 - protein, 9 aa, Homo Sapiens
MDEEGNLSM

SEQ ID NO: 1379924 - protein, 9 aa, Homo Sapiens
TLSPGEARA

SEQ ID NO: 1379925 - protein, 9 aa, Homo Sapiens
RESCLLSTT

SEQ ID NO: 1379926 - protein, 9 aa, Homo Sapiens
SAVHGGVCH

SEQ ID NO: 1379927 - protein, 9 aa, Homo Sapiens
SPPAARRWM

SEQ ID NO: 1379928 - protein, 9 aa, Homo Sapiens
SSEPLQIII

SEQ ID NO: 1379929 - protein, 9 aa, Homo Sapiens
QIYSEHNYC

SEQ ID NO: 1379930 - protein, 9 aa, Homo Sapiens
VVPQLQLVT

SEQ ID NO: 1379931 - protein, 9 aa, Homo Sapiens
FVAMPRNGS

SEQ ID NO: 1379932 - protein, 9 aa, Homo Sapiens
LTIQVLPAP

SEQ ID NO: 1379933 - protein, 9 aa, Homo Sapiens
CGVSGHFAQ

SEQ ID NO: 1379934 - protein, 9 aa, Homo Sapiens
PWTLTIQVL

SEQ ID NO: 1379935 - protein, 9 aa, Homo Sapiens
RAQGRSANK

SEQ ID NO: 1379936 - protein, 9 aa, Homo Sapiens
LGETHSHSL

SEQ ID NO: 1379937 - protein, 9 aa, Homo Sapiens
LSVIYASQT

SEQ ID NO: 1379938 - protein, 9 aa, Homo Sapiens
KLAKKNRNS

SEQ ID NO: 1379939 - protein, 9 aa, Homo Sapiens
TSEDEQSNH

SEQ ID NO: 1379940 - protein, 9 aa, Homo Sapiens
EEELTEEEG

SEQ ID NO: 1379941 - protein, 9 aa, Homo Sapiens
QNESVEKTR

SEQ ID NO: 1379942 - protein, 9 aa, Homo Sapiens
GKWRSGMDF

SEQ ID NO: 1379943 - protein, 9 aa, Homo Sapiens
KVKEDEDGG

SEQ ID NO: 1379944 - protein, 9 aa, Homo Sapiens
AVYLLVQYI

SEQ ID NO: 1379945 - protein, 9 aa, Homo Sapiens
LTNQGKKYY

SEQ ID NO: 1379946 - protein, 9 aa, Homo Sapiens
LEEPGPRPT

SEQ ID NO: 1379947 - protein, 9 aa, Homo Sapiens
KSKYNEDFE

SEQ ID NO: 1379948 - protein, 9 aa, Homo Sapiens
KDFSFREIM

SEQ ID NO: 1379949 - protein, 9 aa, Homo Sapiens
KKTGSNEVT

SEQ ID NO: 1379950 - protein, 9 aa, Homo Sapiens
VIRKSRGTS

SEQ ID NO: 1379951 - protein, 9 aa, Homo Sapiens
TRCFIFRRN

SEQ ID NO: 1379952 - protein, 9 aa, Homo Sapiens
GKAQWGGES

SEQ ID NO: 1379953 - protein, 9 aa, Homo Sapiens
QQHAPVECQ

SEQ ID NO: 1379954 - protein, 9 aa, Homo Sapiens
QWGGESSGD

SEQ ID NO: 1379955 - protein, 9 aa, Homo Sapiens
PFILTRDMA

SEQ ID NO: 1379956 - protein, 9 aa, Homo Sapiens
ASGVAAVTF

SEQ ID NO: 1379957 - protein, 9 aa, Homo Sapiens
WLVQQHCLE

SEQ ID NO: 1379958 - protein, 9 aa, Homo Sapiens
NMIEPGQCF

SEQ ID NO: 1379959 - protein, 9 aa, Homo Sapiens
AQAVEWLSG

SEQ ID NO: 1379960 - protein, 9 aa, Homo Sapiens
IENAFLSGS

SEQ ID NO: 1379961 - protein, 9 aa, Homo Sapiens
QEVVDTTGL

SEQ ID NO: 1379962 - protein, 9 aa, Homo Sapiens
PRHHQTFAG

SEQ ID NO: 1379963 - protein, 9 aa, Homo Sapiens
AQSDYIPAQ

SEQ ID NO: 1379964 - protein, 9 aa, Homo Sapiens
IFIVDQHDT

SEQ ID NO: 1379965 - protein, 9 aa, Homo Sapiens
PSYKWLRNG

SEQ ID NO: 1379966 - protein, 9 aa, Homo Sapiens
REQEVPPCD

SEQ ID NO: 1379967 - protein, 9 aa, Homo Sapiens
EKNLIWQVF

SEQ ID NO: 1379968 - protein, 9 aa, Homo Sapiens
KEKMRHNHL

SEQ ID NO: 1379969 - protein, 9 aa, Homo Sapiens
QIIENVDVC

SEQ ID NO: 1379970 - protein, 9 aa, Homo Sapiens
FLIEKNLIW

SEQ ID NO: 1379971 - protein, 9 aa, Homo Sapiens
SAHQAPSPP

SEQ ID NO: 1379972 - protein, 9 aa, Homo Sapiens
LNTPPEGWK

SEQ ID NO: 1379973 - protein, 9 aa, Homo Sapiens
VSVGVDGEI

SEQ ID NO: 1379974 - protein, 9 aa, Homo Sapiens
HARTFVVFV

SEQ ID NO: 1379975 - protein, 9 aa, Homo Sapiens
WGCPFHDGD

SEQ ID NO: 1379976 - protein, 9 aa, Homo Sapiens
LGVVLARES

SEQ ID NO: 1379977 - protein, 9 aa, Homo Sapiens
APSTPATPS

SEQ ID NO: 1379978 - protein, 9 aa, Homo Sapiens
VVDIVKRYN

SEQ ID NO: 1379979 - protein, 9 aa, Homo Sapiens
LWDKIAMEK

SEQ ID NO: 1379980 - protein, 9 aa, Homo Sapiens
IKRQQQKIR

SEQ ID NO: 1379981 - protein, 9 aa, Homo Sapiens
GAVSKGQPT

SEQ ID NO: 1379982 - protein, 9 aa, Homo Sapiens
LQIAQELEE

SEQ ID NO: 1379983 - protein, 9 aa, Homo Sapiens
KTGILMLSM

SEQ ID NO: 1379984 - protein, 9 aa, Homo Sapiens
HEDYSRLYQ

SEQ ID NO: 1379985 - protein, 9 aa, Homo Sapiens
MPPVPCMGP

SEQ ID NO: 1379986 - protein, 9 aa, Homo Sapiens
RRKKQAELD

SEQ ID NO: 1379987 - protein, 9 aa, Homo Sapiens
VKPFLAALV

SEQ ID NO: 1379988 - protein, 9 aa, Homo Sapiens
RPGPGHLTV

SEQ ID NO: 1379989 - protein, 9 aa, Homo Sapiens
PVKRWSLSC

SEQ ID NO: 1379990 - protein, 9 aa, Homo Sapiens
RYEEKKTGS

SEQ ID NO: 1379991 - protein, 9 aa, Homo Sapiens
LQQHNIPQQ

SEQ ID NO: 1379992 - protein, 9 aa, Homo Sapiens
TRTCPRTNS

SEQ ID NO: 1379993 - protein, 9 aa, Homo Sapiens
CLKVNPDDR

SEQ ID NO: 1379994 - protein, 9 aa, Homo Sapiens
LQHGDEAAW

SEQ ID NO: 1379995 - protein, 9 aa, Homo Sapiens
SYSNMIEPG

SEQ ID NO: 1379996 - protein, 9 aa, Homo Sapiens
GQCFCRFDL

SEQ ID NO: 1379997 - protein, 9 aa, Homo Sapiens
RVVSFTELS

SEQ ID NO: 1379998 - protein, 9 aa, Homo Sapiens
KGAMAQHES

SEQ ID NO: 1379999 - protein, 9 aa, Homo Sapiens
VTSRSDIYF

SEQ ID NO: 1380000 - protein, 9 aa, Homo Sapiens
MKGCLKVNP

SEQ ID NO: 1380001 - protein, 9 aa, Homo Sapiens
NEKEEEEEG

SEQ ID NO: 1380002 - protein, 9 aa, Homo Sapiens
SLPWIRSSH

SEQ ID NO: 1380003 - protein, 9 aa, Homo Sapiens
SGYWLVQQH

SEQ ID NO: 1380004 - protein, 9 aa, Homo Sapiens
VAMPRNGSR

SEQ ID NO: 1380005 - protein, 9 aa, Homo Sapiens
EVLSSIFFE

SEQ ID NO: 1380006 - protein, 9 aa, Homo Sapiens
KKREPEREK

SEQ ID NO: 1380007 - protein, 9 aa, Homo Sapiens
TPTSPTHPL

SEQ ID NO: 1380008 - protein, 9 aa, Homo Sapiens
PPCDHHGDT

SEQ ID NO: 1380009 - protein, 9 aa, Homo Sapiens
KRRKKQAEL

SEQ ID NO: 1380010 - protein, 9 aa, Homo Sapiens
EMKQLIGNI

SEQ ID NO: 1380011 - protein, 9 aa, Homo Sapiens
EMVHGAFQA

SEQ ID NO: 1380012 - protein, 9 aa, Homo Sapiens
TIRSICQQN

SEQ ID NO: 1380013 - protein, 9 aa, Homo Sapiens
RTEGQASPP

SEQ ID NO: 1380014 - protein, 9 aa, Homo Sapiens
QLSLSLLLW

SEQ ID NO: 1380015 - protein, 9 aa, Homo Sapiens
SCWLVKRSR

SEQ ID NO: 1380016 - protein, 9 aa, Homo Sapiens
GYDIWEAIS

SEQ ID NO: 1380017 - protein, 9 aa, Homo Sapiens
GGDHGVWAG

SEQ ID NO: 1380018 - protein, 9 aa, Homo Sapiens
LLLPAPWTL

SEQ ID NO: 1380019 - protein, 9 aa, Homo Sapiens
SLSCRNVWS

SEQ ID NO: 1380020 - protein, 9 aa, Homo Sapiens
VCATTDKLW

SEQ ID NO: 1380021 - protein, 9 aa, Homo Sapiens
IVVSEPSED

SEQ ID NO: 1380022 - protein, 9 aa, Homo Sapiens
RMQLHMSTL

SEQ ID NO: 1380023 - protein, 9 aa, Homo Sapiens
VSQEFILCC

SEQ ID NO: 1380024 - protein, 9 aa, Homo Sapiens
YGTIIMEGM

SEQ ID NO: 1380025 - protein, 9 aa, Homo Sapiens
HEYTESMCL

SEQ ID NO: 1380026 - protein, 9 aa, Homo Sapiens
IIWCPFIPR

SEQ ID NO: 1380027 - protein, 9 aa, Homo Sapiens
MNSVMVGTE

SEQ ID NO: 1380028 - protein, 9 aa, Homo Sapiens
EQMKCLEQQ

SEQ ID NO: 1380029 - protein, 9 aa, Homo Sapiens
IFDSIIIIL

SEQ ID NO: 1380030 - protein, 9 aa, Homo Sapiens
KAGAASAWA

SEQ ID NO: 1380031 - protein, 9 aa, Homo Sapiens
LSGGARINH

SEQ ID NO: 1380032 - protein, 9 aa, Homo Sapiens
EDVFSELSF

SEQ ID NO: 1380033 - protein, 9 aa, Homo Sapiens
ETCSHIKEK

SEQ ID NO: 1380034 - protein, 9 aa, Homo Sapiens
NIYDSATGY

SEQ ID NO: 1380035 - protein, 9 aa, Homo Sapiens
LSAHQAPSP

SEQ ID NO: 1380036 - protein, 9 aa, Homo Sapiens
VPDSLALHL

SEQ ID NO: 1380037 - protein, 9 aa, Homo Sapiens
KCLEQQCEL

SEQ ID NO: 1380038 - protein, 9 aa, Homo Sapiens
SLGVIEETG

SEQ ID NO: 1380039 - protein, 9 aa, Homo Sapiens
PTRRRRQRR

SEQ ID NO: 1380040 - protein, 9 aa, Homo Sapiens
QEDLAYSGF

SEQ ID NO: 1380041 - protein, 9 aa, Homo Sapiens
GYWLVQQHC

SEQ ID NO: 1380042 - protein, 9 aa, Homo Sapiens
LFVCTLHPS

SEQ ID NO: 1380043 - protein, 9 aa, Homo Sapiens
EPGSPYKFL

SEQ ID NO: 1380044 - protein, 9 aa, Homo Sapiens
GVAAVTFEW

SEQ ID NO: 1380045 - protein, 9 aa, Homo Sapiens
IPINTDIGL

SEQ ID NO: 1380046 - protein, 9 aa, Homo Sapiens
SITSLQFSL

SEQ ID NO: 1380047 - protein, 9 aa, Homo Sapiens
ILLSLLCRY

SEQ ID NO: 1380048 - protein, 9 aa, Homo Sapiens
GWDSRCAPG

SEQ ID NO: 1380049 - protein, 9 aa, Homo Sapiens
DREYKDHLS

SEQ ID NO: 1380050 - protein, 9 aa, Homo Sapiens
DPRSSSKAS

SEQ ID NO: 1380051 - protein, 9 aa, Homo Sapiens
MKSEKRILL

SEQ ID NO: 1380052 - protein, 9 aa, Homo Sapiens
HFITWRKSA

SEQ ID NO: 1380053 - protein, 9 aa, Homo Sapiens
NGHFVCVLG

SEQ ID NO: 1380054 - protein, 9 aa, Homo Sapiens
EVRLIELAE

SEQ ID NO: 1380055 - protein, 9 aa, Homo Sapiens
LQKHERIRL

SEQ ID NO: 1380056 - protein, 9 aa, Homo Sapiens
KCDWFFPVF

SEQ ID NO: 1380057 - protein, 9 aa, Homo Sapiens
RVELLLGHP

SEQ ID NO: 1380058 - protein, 9 aa, Homo Sapiens
SSLEDPALL

SEQ ID NO: 1380059 - protein, 9 aa, Homo Sapiens
GWSHFDSLY

SEQ ID NO: 1380060 - protein, 9 aa, Homo Sapiens
YLKKKQISR

SEQ ID NO: 1380061 - protein, 9 aa, Homo Sapiens
RSPPQLLFS

SEQ ID NO: 1380062 - protein, 9 aa, Homo Sapiens
SSGGRTAAV

SEQ ID NO: 1380063 - protein, 9 aa, Homo Sapiens
LKDEEQERR

SEQ ID NO: 1380064 - protein, 9 aa, Homo Sapiens
ADQRRPRHG

SEQ ID NO: 1380065 - protein, 9 aa, Homo Sapiens
LISPDTKKN

SEQ ID NO: 1380066 - protein, 9 aa, Homo Sapiens
CPQGSPSSP

SEQ ID NO: 1380067 - protein, 9 aa, Homo Sapiens
GGEYGGGYG

SEQ ID NO: 1380068 - protein, 9 aa, Homo Sapiens
KAVQELLPN

SEQ ID NO: 1380069 - protein, 9 aa, Homo Sapiens
SNDIEGIDR

SEQ ID NO: 1380070 - protein, 9 aa, Homo Sapiens
LIASFSHHS

SEQ ID NO: 1380071 - protein, 9 aa, Homo Sapiens
FRRHSWSGV

SEQ ID NO: 1380072 - protein, 9 aa, Homo Sapiens
EPLQIIINP

SEQ ID NO: 1380073 - protein, 9 aa, Homo Sapiens
THERERDFT

SEQ ID NO: 1380074 - protein, 9 aa, Homo Sapiens
GQQSSSDCN

SEQ ID NO: 1380075 - protein, 9 aa, Homo Sapiens
HIWKVPDVE

SEQ ID NO: 1380076 - protein, 9 aa, Homo Sapiens
GCSHVCSRT

SEQ ID NO: 1380077 - protein, 9 aa, Homo Sapiens
REVAEAAAV

SEQ ID NO: 1380078 - protein, 9 aa, Homo Sapiens
PRRAKTAVR

SEQ ID NO: 1380079 - protein, 9 aa, Homo Sapiens
IIFLTEGLS

SEQ ID NO: 1380080 - protein, 9 aa, Homo Sapiens
TFEKKRGKN

SEQ ID NO: 1380081 - protein, 9 aa, Homo Sapiens
LENPRNGTS

SEQ ID NO: 1380082 - protein, 9 aa, Homo Sapiens
QATQPKEGD

SEQ ID NO: 1380083 - protein, 9 aa, Homo Sapiens
AETMARRLA

SEQ ID NO: 1380084 - protein, 9 aa, Homo Sapiens
ELDPAKRQH

SEQ ID NO: 1380085 - protein, 9 aa, Homo Sapiens
KLQKKKNKE

SEQ ID NO: 1380086 - protein, 9 aa, Homo Sapiens
MKAKQEKRT

SEQ ID NO: 1380087 - protein, 9 aa, Homo Sapiens
GESSGDSDP

SEQ ID NO: 1380088 - protein, 9 aa, Homo Sapiens
FFKGRVSMC

SEQ ID NO: 1380089 - protein, 9 aa, Homo Sapiens
GPQRKPLRR

SEQ ID NO: 1380090 - protein, 9 aa, Homo Sapiens
IFDMFGGGG

SEQ ID NO: 1380091 - protein, 9 aa, Homo Sapiens
EWIDMTGFL

SEQ ID NO: 1380092 - protein, 9 aa, Homo Sapiens
EKELDQREK

SEQ ID NO: 1380093 - protein, 9 aa, Homo Sapiens
MDIFDMFGG

SEQ ID NO: 1380094 - protein, 9 aa, Homo Sapiens
RIRVGEVLS

SEQ ID NO: 1380095 - protein, 9 aa, Homo Sapiens
VIEETGFHH

SEQ ID NO: 1380096 - protein, 9 aa, Homo Sapiens
EYDAREQRV

SEQ ID NO: 1380097 - protein, 9 aa, Homo Sapiens
IVLKAVLGM

SEQ ID NO: 1380098 - protein, 9 aa, Homo Sapiens
VPGLWMLAR

SEQ ID NO: 1380099 - protein, 9 aa, Homo Sapiens
GWRPLRKTA

SEQ ID NO: 1380100 - protein, 9 aa, Homo Sapiens
IMSLDHFLA

SEQ ID NO: 1380101 - protein, 9 aa, Homo Sapiens
KEDEDGGVG

SEQ ID NO: 1380102 - protein, 9 aa, Homo Sapiens
EFEEDGDFV

SEQ ID NO: 1380103 - protein, 9 aa, Homo Sapiens
LRRLGDEIG

SEQ ID NO: 1380104 - protein, 9 aa, Homo Sapiens
SGVCLCGTF

SEQ ID NO: 1380105 - protein, 9 aa, Homo Sapiens
GKNDCKFCF

SEQ ID NO: 1380106 - protein, 9 aa, Homo Sapiens
WYVLLCVSG

SEQ ID NO: 1380107 - protein, 9 aa, Homo Sapiens
HRNESKSRK

SEQ ID NO: 1380108 - protein, 9 aa, Homo Sapiens
SGRKACSTR

SEQ ID NO: 1380109 - protein, 9 aa, Homo Sapiens
PAPSRALPL

SEQ ID NO: 1380110 - protein, 9 aa, Homo Sapiens
EGPHRPSCY

SEQ ID NO: 1380111 - protein, 9 aa, Homo Sapiens
NSDLLDDGE

SEQ ID NO: 1380112 - protein, 9 aa, Homo Sapiens
AVRRAAQQW

SEQ ID NO: 1380113 - protein, 9 aa, Homo Sapiens
QLVTSRSDI

SEQ ID NO: 1380114 - protein, 9 aa, Homo Sapiens
SAALPLNSL

SEQ ID NO: 1380115 - protein, 9 aa, Homo Sapiens
WSPTLTKHK

SEQ ID NO: 1380116 - protein, 9 aa, Homo Sapiens
FNKDTVIVV

SEQ ID NO: 1380117 - protein, 9 aa, Homo Sapiens
KFPKDKFVE

SEQ ID NO: 1380118 - protein, 9 aa, Homo Sapiens
LALLLLLPL

SEQ ID NO: 1380119 - protein, 9 aa, Homo Sapiens
HHVVRLLGA

SEQ ID NO: 1380120 - protein, 9 aa, Homo Sapiens
SCNLRTAYI

SEQ ID NO: 1380121 - protein, 9 aa, Homo Sapiens
KYLKHRLSV

SEQ ID NO: 1380122 - protein, 9 aa, Homo Sapiens
QTGKKREPE

SEQ ID NO: 1380123 - protein, 9 aa, Homo Sapiens
IHFITWRKS

SEQ ID NO: 1380124 - protein, 9 aa, Homo Sapiens
CPGGRRRGR

SEQ ID NO: 1380125 - protein, 9 aa, Homo Sapiens
GNPVPSYKW

SEQ ID NO: 1380126 - protein, 9 aa, Homo Sapiens
SMEDFLKTR

SEQ ID NO: 1380127 - protein, 9 aa, Homo Sapiens
SAVPTKSSR

SEQ ID NO: 1380128 - protein, 9 aa, Homo Sapiens
CVPSPCRNG

SEQ ID NO: 1380129 - protein, 9 aa, Homo Sapiens
HGQVQGQQE

SEQ ID NO: 1380130 - protein, 9 aa, Homo Sapiens
YNCGVSGHF

SEQ ID NO: 1380131 - protein, 9 aa, Homo Sapiens
KKEAYSAAT

SEQ ID NO: 1380132 - protein, 9 aa, Homo Sapiens
HETRRKSKY

SEQ ID NO: 1380133 - protein, 9 aa, Homo Sapiens
NNIRKNVFK

SEQ ID NO: 1380134 - protein, 9 aa, Homo Sapiens
ECKLGASGQ

SEQ ID NO: 1380135 - protein, 9 aa, Homo Sapiens
IMTCLYKYV

SEQ ID NO: 1380136 - protein, 9 aa, Homo Sapiens
SEYQQSPVQ

SEQ ID NO: 1380137 - protein, 9 aa, Homo Sapiens
SSSGGRTAA

SEQ ID NO: 1380138 - protein, 9 aa, Homo Sapiens
TCYHPTIVC

SEQ ID NO: 1380139 - protein, 9 aa, Homo Sapiens
NVFVPQRPQ

SEQ ID NO: 1380140 - protein, 9 aa, Homo Sapiens
LFSSLEDPA

SEQ ID NO: 1380141 - protein, 9 aa, Homo Sapiens
AGPPMREVA

SEQ ID NO: 1380142 - protein, 9 aa, Homo Sapiens
QGLECRTHR

SEQ ID NO: 1380143 - protein, 9 aa, Homo Sapiens
VPLQHHVWT

SEQ ID NO: 1380144 - protein, 9 aa, Homo Sapiens
KRGPGNQLR

SEQ ID NO: 1380145 - protein, 9 aa, Homo Sapiens
GLRCGTWTC

SEQ ID NO: 1380146 - protein, 9 aa, Homo Sapiens
LYGAERIVE

SEQ ID NO: 1380147 - protein, 9 aa, Homo Sapiens
DNVTVLEYD

SEQ ID NO: 1380148 - protein, 9 aa, Homo Sapiens
TTFDMGGHV

SEQ ID NO: 1380149 - protein, 9 aa, Homo Sapiens
EALPLFLLL

SEQ ID NO: 1380150 - protein, 9 aa, Homo Sapiens
RRLAYLHED

SEQ ID NO: 1380151 - protein, 9 aa, Homo Sapiens
SLHGKKCAV

SEQ ID NO: 1380152 - protein, 9 aa, Homo Sapiens
DGNKKPASE

SEQ ID NO: 1380153 - protein, 9 aa, Homo Sapiens
HSKHLKTHH

SEQ ID NO: 1380154 - protein, 9 aa, Homo Sapiens
YHPTIVCLP

SEQ ID NO: 1380155 - protein, 9 aa, Homo Sapiens
QELLPNCIP

SEQ ID NO: 1380156 - protein, 9 aa, Homo Sapiens
KLWEQIYAT

SEQ ID NO: 1380157 - protein, 9 aa, Homo Sapiens
ITNCCLFCF

SEQ ID NO: 1380158 - protein, 9 aa, Homo Sapiens
ACKKLQKKK

SEQ ID NO: 1380159 - protein, 9 aa, Homo Sapiens
RPPPLVRCH

SEQ ID NO: 1380160 - protein, 9 aa, Homo Sapiens
QLPASPLLL

SEQ ID NO: 1380161 - protein, 9 aa, Homo Sapiens
SDSSQSDPE

SEQ ID NO: 1380162 - protein, 9 aa, Homo Sapiens
PGDPDAVVA

SEQ ID NO: 1380163 - protein, 9 aa, Homo Sapiens
HQAPSPPAH

SEQ ID NO: 1380164 - protein, 9 aa, Homo Sapiens
NLTNQGKKY

SEQ ID NO: 1380165 - protein, 9 aa, Homo Sapiens
SYTGGRGRS

SEQ ID NO: 1380166 - protein, 9 aa, Homo Sapiens
CICPEGPHR

SEQ ID NO: 1380167 - protein, 9 aa, Homo Sapiens
HRLSVVSNR

SEQ ID NO: 1380168 - protein, 9 aa, Homo Sapiens
GIDREYKDH

SEQ ID NO: 1380169 - protein, 9 aa, Homo Sapiens
LDHFLAIHN

SEQ ID NO: 1380170 - protein, 9 aa, Homo Sapiens
IHLWQPDAC

SEQ ID NO: 1380171 - protein, 9 aa, Homo Sapiens
KEQEKEGIF

SEQ ID NO: 1380172 - protein, 9 aa, Homo Sapiens
TSLGVIEET

SEQ ID NO: 1380173 - protein, 9 aa, Homo Sapiens
VSRYKIWCN

SEQ ID NO: 1380174 - protein, 9 aa, Homo Sapiens
EEQGAKKHT

SEQ ID NO: 1380175 - protein, 9 aa, Homo Sapiens
MFGGGGRMQ

SEQ ID NO: 1380176 - protein, 9 aa, Homo Sapiens
NLLLGANLN

SEQ ID NO: 1380177 - protein, 9 aa, Homo Sapiens
GEHSYLAQS

SEQ ID NO: 1380178 - protein, 9 aa, Homo Sapiens
AAEKEDIKC

SEQ ID NO: 1380179 - protein, 9 aa, Homo Sapiens
GSKDFSFRE

SEQ ID NO: 1380180 - protein, 9 aa, Homo Sapiens
ALLQAPLEQ

SEQ ID NO: 1380181 - protein, 9 aa, Homo Sapiens
ENPRNGTSL

SEQ ID NO: 1380182 - protein, 9 aa, Homo Sapiens
GGRTAAVGK

SEQ ID NO: 1380183 - protein, 9 aa, Homo Sapiens
YQKCDWFFP

SEQ ID NO: 1380184 - protein, 9 aa, Homo Sapiens
VDQHDTDEK

SEQ ID NO: 1380185 - protein, 9 aa, Homo Sapiens
CPRTNSPQA

SEQ ID NO: 1380186 - protein, 9 aa, Homo Sapiens
EKCRCESTI

SEQ ID NO: 1380187 - protein, 9 aa, Homo Sapiens
LAISLTTPG

SEQ ID NO: 1380188 - protein, 9 aa, Homo Sapiens
NVASTPDNQ

SEQ ID NO: 1380189 - protein, 9 aa, Homo Sapiens
FQLPGQKLS

SEQ ID NO: 1380190 - protein, 9 aa, Homo Sapiens
PPEQSACHG

SEQ ID NO: 1380191 - protein, 9 aa, Homo Sapiens
ACIVSGFLT

SEQ ID NO: 1380192 - protein, 9 aa, Homo Sapiens
THEHKKKHW

SEQ ID NO: 1380193 - protein, 9 aa, Homo Sapiens
SSAQIHQER

SEQ ID NO: 1380194 - protein, 9 aa, Homo Sapiens
SGPGPHHSL

SEQ ID NO: 1380195 - protein, 9 aa, Homo Sapiens
GGARINHIF

SEQ ID NO: 1380196 - protein, 9 aa, Homo Sapiens
PNYNPFAWM

SEQ ID NO: 1380197 - protein, 9 aa, Homo Sapiens
GQAAHPTDP

SEQ ID NO: 1380198 - protein, 9 aa, Homo Sapiens
GKVYLKKKQ

SEQ ID NO: 1380199 - protein, 9 aa, Homo Sapiens
ECKSRGSVH

SEQ ID NO: 1380200 - protein, 9 aa, Homo Sapiens
FSVLSVIYA

SEQ ID NO: 1380201 - protein, 9 aa, Homo Sapiens
KKQKKREKR

SEQ ID NO: 1380202 - protein, 9 aa, Homo Sapiens
EDPGCKWMD

SEQ ID NO: 1380203 - protein, 9 aa, Homo Sapiens
RDMAQAKVF

SEQ ID NO: 1380204 - protein, 9 aa, Homo Sapiens
RNESKSRKY

SEQ ID NO: 1380205 - protein, 9 aa, Homo Sapiens
DLLDDGEVE

SEQ ID NO: 1380206 - protein, 9 aa, Homo Sapiens
THAEMVHGA

SEQ ID NO: 1380207 - protein, 9 aa, Homo Sapiens
YLVLTLTKK

SEQ ID NO: 1380208 - protein, 9 aa, Homo Sapiens
EASWSPASG

SEQ ID NO: 1380209 - protein, 9 aa, Homo Sapiens
PLFLLLIDL

SEQ ID NO: 1380210 - protein, 9 aa, Homo Sapiens
YGAERIVEL

SEQ ID NO: 1380211 - protein, 9 aa, Homo Sapiens
PLPVDAGED

SEQ ID NO: 1380212 - protein, 9 aa, Homo Sapiens
RCAPGTQVR

SEQ ID NO: 1380213 - protein, 9 aa, Homo Sapiens
QVKRGPGNQ

SEQ ID NO: 1380214 - protein, 9 aa, Homo Sapiens
QARLGYEWD

SEQ ID NO: 1380215 - protein, 9 aa, Homo Sapiens
WWLLQIAQE

SEQ ID NO: 1380216 - protein, 9 aa, Homo Sapiens
IGNILEESD

SEQ ID NO: 1380217 - protein, 9 aa, Homo Sapiens
RCESTIVDC

SEQ ID NO: 1380218 - protein, 9 aa, Homo Sapiens
AGSALLQAP

SEQ ID NO: 1380219 - protein, 9 aa, Homo Sapiens
EPGRVGGSH

SEQ ID NO: 1380220 - protein, 9 aa, Homo Sapiens
GVVLARESL

SEQ ID NO: 1380221 - protein, 9 aa, Homo Sapiens
FTPSLSVGK

SEQ ID NO: 1380222 - protein, 9 aa, Homo Sapiens
VRKNHSSRL

SEQ ID NO: 1380223 - protein, 9 aa, Homo Sapiens
FLTALLALL

SEQ ID NO: 1380224 - protein, 9 aa, Homo Sapiens
WMSDHLSIN

SEQ ID NO: 1380225 - protein, 9 aa, Homo Sapiens
DEPKFMSKS

SEQ ID NO: 1380226 - protein, 9 aa, Homo Sapiens
YGPAGFDPG

SEQ ID NO: 1380227 - protein, 9 aa, Homo Sapiens
GQHGKKVPT

SEQ ID NO: 1380228 - protein, 9 aa, Homo Sapiens
THSHSLKKD

SEQ ID NO: 1380229 - protein, 9 aa, Homo Sapiens
MANSTWGCP

SEQ ID NO: 1380230 - protein, 9 aa, Homo Sapiens
HPPEPGLWR

SEQ ID NO: 1380231 - protein, 9 aa, Homo Sapiens
VFGILIKRQ

SEQ ID NO: 1380232 - protein, 9 aa, Homo Sapiens
CRCCCCCGE

SEQ ID NO: 1380233 - protein, 9 aa, Homo Sapiens
PPPLSPAPS

SEQ ID NO: 1380234 - protein, 9 aa, Homo Sapiens
MMAAVKTCR

SEQ ID NO: 1380235 - protein, 9 aa, Homo Sapiens
AQFIIDGRS

SEQ ID NO: 1380236 - protein, 9 aa, Homo Sapiens
DLYGAERIV

SEQ ID NO: 1380237 - protein, 9 aa, Homo Sapiens
LQNHTLTQH

SEQ ID NO: 1380238 - protein, 9 aa, Homo Sapiens
YSALLQEDL

SEQ ID NO: 1380239 - protein, 9 aa, Homo Sapiens
EGPHIPGDG

SEQ ID NO: 1380240 - protein, 9 aa, Homo Sapiens
DVAQKKIQD

SEQ ID NO: 1380241 - protein, 9 aa, Homo Sapiens
EEREREKKG

SEQ ID NO: 1380242 - protein, 9 aa, Homo Sapiens
SDHVKVVTL

SEQ ID NO: 1380243 - protein, 9 aa, Homo Sapiens
TGLNEALPL

SEQ ID NO: 1380244 - protein, 9 aa, Homo Sapiens
EGKAGTAAV

SEQ ID NO: 1380245 - protein, 9 aa, Homo Sapiens
HGKKCAVSV

SEQ ID NO: 1380246 - protein, 9 aa, Homo Sapiens
VEMKSEKRI

SEQ ID NO: 1380247 - protein, 9 aa, Homo Sapiens
QNSDLLDDG

SEQ ID NO: 1380248 - protein, 9 aa, Homo Sapiens
QNELWIAIT

SEQ ID NO: 1380249 - protein, 9 aa, Homo Sapiens
SQRLRVLYQ

SEQ ID NO: 1380250 - protein, 9 aa, Homo Sapiens
GSHRGVPLV

SEQ ID NO: 1380251 - protein, 9 aa, Homo Sapiens
FSHHSVSVQ

SEQ ID NO: 1380252 - protein, 9 aa, Homo Sapiens
QRKEPWKAK

SEQ ID NO: 1380253 - protein, 9 aa, Homo Sapiens
KDGEFKNLK

SEQ ID NO: 1380254 - protein, 9 aa, Homo Sapiens
ESVEKTRAY

SEQ ID NO: 1380255 - protein, 9 aa, Homo Sapiens
GGPEVPDSL

SEQ ID NO: 1380256 - protein, 9 aa, Homo Sapiens
SVPGKEGSS

SEQ ID NO: 1380257 - protein, 9 aa, Homo Sapiens
PISTPTSPD

SEQ ID NO: 1380258 - protein, 9 aa, Homo Sapiens
EDFERAWRE

SEQ ID NO: 1380259 - protein, 9 aa, Homo Sapiens
MIRPSVYSN

SEQ ID NO: 1380260 - protein, 9 aa, Homo Sapiens
EEGNLSMED

SEQ ID NO: 1380261 - protein, 9 aa, Homo Sapiens
FPPESKQKG

SEQ ID NO: 1380262 - protein, 9 aa, Homo Sapiens
GSGDGNKKP

SEQ ID NO: 1380263 - protein, 9 aa, Homo Sapiens
DHLGLGWTE

SEQ ID NO: 1380264 - protein, 9 aa, Homo Sapiens
VHPVPGNPP

SEQ ID NO: 1380265 - protein, 9 aa, Homo Sapiens
CESTIVDCS

SEQ ID NO: 1380266 - protein, 9 aa, Homo Sapiens
ACRHRNESK

SEQ ID NO: 1380267 - protein, 9 aa, Homo Sapiens
VAVYFSQAV

SEQ ID NO: 1380268 - protein, 9 aa, Homo Sapiens
PTSVITSVY

SEQ ID NO: 1380269 - protein, 9 aa, Homo Sapiens
GLLDALLKT

SEQ ID NO: 1380270 - protein, 9 aa, Homo Sapiens
ARAPLESVR

SEQ ID NO: 1380271 - protein, 9 aa, Homo Sapiens
ETDAVDPRS

SEQ ID NO: 1380272 - protein, 9 aa, Homo Sapiens
LEDPALLVP

SEQ ID NO: 1380273 - protein, 9 aa, Homo Sapiens
NDCKFCFSC

SEQ ID NO: 1380274 - protein, 9 aa, Homo Sapiens
RGYRERGGG

SEQ ID NO: 1380275 - protein, 9 aa, Homo Sapiens
AQAIQNPQA

SEQ ID NO: 1380276 - protein, 9 aa, Homo Sapiens
LFAKVSQDH

SEQ ID NO: 1380277 - protein, 9 aa, Homo Sapiens
LRPLTPGVH

SEQ ID NO: 1380278 - protein, 9 aa, Homo Sapiens
RVGGSHQEQ

SEQ ID NO: 1380279 - protein, 9 aa, Homo Sapiens
RQISGRHLL

SEQ ID NO: 1380280 - protein, 9 aa, Homo Sapiens
TCAQLFTTR

SEQ ID NO: 1380281 - protein, 9 aa, Homo Sapiens
LKKKTGSNE

SEQ ID NO: 1380282 - protein, 9 aa, Homo Sapiens
EREREKKGR

SEQ ID NO: 1380283 - protein, 9 aa, Homo Sapiens
LTVPIVPFP

SEQ ID NO: 1380284 - protein, 9 aa, Homo Sapiens
FNRRIRDEK

SEQ ID NO: 1380285 - protein, 9 aa, Homo Sapiens
TGSQSPHAS

SEQ ID NO: 1380286 - protein, 9 aa, Homo Sapiens
EWIGNERLP

SEQ ID NO: 1380287 - protein, 9 aa, Homo Sapiens
RTCPRTNSP

SEQ ID NO: 1380288 - protein, 9 aa, Homo Sapiens
GFGGGEYGG

SEQ ID NO: 1380289 - protein, 9 aa, Homo Sapiens
KRQQQKIRK

SEQ ID NO: 1380290 - protein, 9 aa, Homo Sapiens
LPLLTWQLW

SEQ ID NO: 1380291 - protein, 9 aa, Homo Sapiens
PRMRSSKES

SEQ ID NO: 1380292 - protein, 9 aa, Homo Sapiens
REREGKGKS

SEQ ID NO: 1380293 - protein, 9 aa, Homo Sapiens
AFKCSSALN

SEQ ID NO: 1380294 - protein, 9 aa, Homo Sapiens
GGGVARVEV

SEQ ID NO: 1380295 - protein, 9 aa, Homo Sapiens
KNTPSTAGL

SEQ ID NO: 1380296 - protein, 9 aa, Homo Sapiens
KHYVHRVGA

SEQ ID NO: 1380297 - protein, 9 aa, Homo Sapiens
VTTAMLSFS

SEQ ID NO: 1380298 - protein, 9 aa, Homo Sapiens
TVQCYWRLL

SEQ ID NO: 1380299 - protein, 9 aa, Homo Sapiens
HERERDFTP

SEQ ID NO: 1380300 - protein, 9 aa, Homo Sapiens
GDFVIEMEN

SEQ ID NO: 1380301 - protein, 9 aa, Homo Sapiens
DNIAHIKAK

SEQ ID NO: 1380302 - protein, 9 aa, Homo Sapiens
EFSIVRPIS

SEQ ID NO: 1380303 - protein, 9 aa, Homo Sapiens
IKCVKSLVV

SEQ ID NO: 1380304 - protein, 9 aa, Homo Sapiens
TVLEYDARE

SEQ ID NO: 1380305 - protein, 9 aa, Homo Sapiens
PAREGSLWP

SEQ ID NO: 1380306 - protein, 9 aa, Homo Sapiens
VKTCRWQCI

SEQ ID NO: 1380307 - protein, 9 aa, Homo Sapiens
KEMDEEGNL

SEQ ID NO: 1380308 - protein, 9 aa, Homo Sapiens
MCPQGSPSS

SEQ ID NO: 1380309 - protein, 9 aa, Homo Sapiens
RSSCRAVGM

SEQ ID NO: 1380310 - protein, 9 aa, Homo Sapiens
CHGYCAGHT

SEQ ID NO: 1380311 - protein, 9 aa, Homo Sapiens
NALTGSQSP

SEQ ID NO: 1380312 - protein, 9 aa, Homo Sapiens
RPLTPGVHE

SEQ ID NO: 1380313 - protein, 9 aa, Homo Sapiens
GSPPECGPV

SEQ ID NO: 1380314 - protein, 9 aa, Homo Sapiens
DICPDQKIQ

SEQ ID NO: 1380315 - protein, 9 aa, Homo Sapiens
DWKSATNPP

SEQ ID NO: 1380316 - protein, 9 aa, Homo Sapiens
FNFLLVWHY

SEQ ID NO: 1380317 - protein, 9 aa, Homo Sapiens
QRKEELSRN

SEQ ID NO: 1380318 - protein, 9 aa, Homo Sapiens
GSVRKANRM

SEQ ID NO: 1380319 - protein, 9 aa, Homo Sapiens
VLLIMSLDH

SEQ ID NO: 1380320 - protein, 9 aa, Homo Sapiens
GTAAVADPH

SEQ ID NO: 1380321 - protein, 9 aa, Homo Sapiens
SSGDSDPYS

SEQ ID NO: 1380322 - protein, 9 aa, Homo Sapiens
SVSKVQSHA

SEQ ID NO: 1380323 - protein, 9 aa, Homo Sapiens
SVEVTVAGF

SEQ ID NO: 1380324 - protein, 9 aa, Homo Sapiens
SLPPKKIKT

SEQ ID NO: 1380325 - protein, 9 aa, Homo Sapiens
AVDPRSNGR

SEQ ID NO: 1380326 - protein, 9 aa, Homo Sapiens
QPVCATTDK

SEQ ID NO: 1380327 - protein, 9 aa, Homo Sapiens
NWDVLFQVS

SEQ ID NO: 1380328 - protein, 9 aa, Homo Sapiens
SIPLRDGGD

SEQ ID NO: 1380329 - protein, 9 aa, Homo Sapiens
TTASSIPSH

SEQ ID NO: 1380330 - protein, 9 aa, Homo Sapiens
KCSSALNTH

SEQ ID NO: 1380331 - protein, 9 aa, Homo Sapiens
AHAPPHTMQ

SEQ ID NO: 1380332 - protein, 9 aa, Homo Sapiens
VAPEVLRSK

SEQ ID NO: 1380333 - protein, 9 aa, Homo Sapiens
GVKMTPTEE

SEQ ID NO: 1380334 - protein, 9 aa, Homo Sapiens
AWTGASPNL

SEQ ID NO: 1380335 - protein, 9 aa, Homo Sapiens
AKFPKDKFV

SEQ ID NO: 1380336 - protein, 9 aa, Homo Sapiens
KRFCAERQD

SEQ ID NO: 1380337 - protein, 9 aa, Homo Sapiens
RNAAPRPAN

SEQ ID NO: 1380338 - protein, 9 aa, Homo Sapiens
LWIAITKCC

SEQ ID NO: 1380339 - protein, 9 aa, Homo Sapiens
SMCAAFCYE

SEQ ID NO: 1380340 - protein, 9 aa, Homo Sapiens
TFTLRKKTC

SEQ ID NO: 1380341 - protein, 9 aa, Homo Sapiens
PVSEASITI

SEQ ID NO: 1380342 - protein, 9 aa, Homo Sapiens
GSVHPDKWV

SEQ ID NO: 1380343 - protein, 9 aa, Homo Sapiens
FRHLHHLEA

SEQ ID NO: 1380344 - protein, 9 aa, Homo Sapiens
YCRENVCLN

SEQ ID NO: 1380345 - protein, 9 aa, Homo Sapiens
WLSGLLDAL

SEQ ID NO: 1380346 - protein, 9 aa, Homo Sapiens
LQKKKNKEE

SEQ ID NO: 1380347 - protein, 9 aa, Homo Sapiens
TKNFSCQWP

SEQ ID NO: 1380348 - protein, 9 aa, Homo Sapiens
ERAWREDLT

SEQ ID NO: 1380349 - protein, 9 aa, Homo Sapiens
VVSVGVDGE

SEQ ID NO: 1380350 - protein, 9 aa, Homo Sapiens
KQTYHKEAH

SEQ ID NO: 1380351 - protein, 9 aa, Homo Sapiens
TVPIVPFPV

SEQ ID NO: 1380352 - protein, 9 aa, Homo Sapiens
TPQFLYQLY

SEQ ID NO: 1380353 - protein, 9 aa, Homo Sapiens
NESVEKTRA

SEQ ID NO: 1380354 - protein, 9 aa, Homo Sapiens
EAYSAATAA

SEQ ID NO: 1380355 - protein, 9 aa, Homo Sapiens
KKQTGKKRE

SEQ ID NO: 1380356 - protein, 9 aa, Homo Sapiens
SRFFLQFRF

SEQ ID NO: 1380357 - protein, 9 aa, Homo Sapiens
AYGPAGFDP

SEQ ID NO: 1380358 - protein, 9 aa, Homo Sapiens
FWKDFLATS

SEQ ID NO: 1380359 - protein, 9 aa, Homo Sapiens
NYCDELSLY

SEQ ID NO: 1380360 - protein, 9 aa, Homo Sapiens
NPKSFIYSE

SEQ ID NO: 1380361 - protein, 9 aa, Homo Sapiens
KEYSKCLCH

SEQ ID NO: 1380362 - protein, 9 aa, Homo Sapiens
PVATLSPGE

SEQ ID NO: 1380363 - protein, 9 aa, Homo Sapiens
TINGKFQLP

SEQ ID NO: 1380364 - protein, 9 aa, Homo Sapiens
GLETNIPQR

SEQ ID NO: 1380365 - protein, 9 aa, Homo Sapiens
DSIIIILSL

SEQ ID NO: 1380366 - protein, 9 aa, Homo Sapiens
QTELQNHTL

SEQ ID NO: 1380367 - protein, 9 aa, Homo Sapiens
SEKRILLSL

SEQ ID NO: 1380368 - protein, 9 aa, Homo Sapiens
EPVEGAVII

SEQ ID NO: 1380369 - protein, 9 aa, Homo Sapiens
TPPEQSACH

SEQ ID NO: 1380370 - protein, 9 aa, Homo Sapiens
MKCLEQQCE

SEQ ID NO: 1380371 - protein, 9 aa, Homo Sapiens
MWMGGKTPW

SEQ ID NO: 1380372 - protein, 9 aa, Homo Sapiens
NPYGLVAPP

SEQ ID NO: 1380373 - protein, 9 aa, Homo Sapiens
YGYSTPTSP

SEQ ID NO: 1380374 - protein, 9 aa, Homo Sapiens
IFLLVAYML

SEQ ID NO: 1380375 - protein, 9 aa, Homo Sapiens
YVAQSAGRL

SEQ ID NO: 1380376 - protein, 9 aa, Homo Sapiens
SFSEPSSCG

SEQ ID NO: 1380377 - protein, 9 aa, Homo Sapiens
LAEATRGHH

SEQ ID NO: 1380378 - protein, 9 aa, Homo Sapiens
DLAFQQHAP

SEQ ID NO: 1380379 - protein, 9 aa, Homo Sapiens
PSKKTKRAT

SEQ ID NO: 1380380 - protein, 9 aa, Homo Sapiens
DLAYSGFEC

SEQ ID NO: 1380381 - protein, 9 aa, Homo Sapiens
HGDTLEGAC

SEQ ID NO: 1380382 - protein, 9 aa, Homo Sapiens
QGGRAAEEE

SEQ ID NO: 1380383 - protein, 9 aa, Homo Sapiens
SHHSVSVQD

SEQ ID NO: 1380384 - protein, 9 aa, Homo Sapiens
KRNSIFNCS

SEQ ID NO: 1380385 - protein, 9 aa, Homo Sapiens
SQLSLSLLL

SEQ ID NO: 1380386 - protein, 9 aa, Homo Sapiens
SLLLWPAVP

SEQ ID NO: 1380387 - protein, 9 aa, Homo Sapiens
VPLTASGNS

SEQ ID NO: 1380388 - protein, 9 aa, Homo Sapiens
DIASDLCQR

SEQ ID NO: 1380389 - protein, 9 aa, Homo Sapiens
TALLALLVS

SEQ ID NO: 1380390 - protein, 9 aa, Homo Sapiens
SPPKKKSFS

SEQ ID NO: 1380391 - protein, 9 aa, Homo Sapiens
KMTPTEEEK

SEQ ID NO: 1380392 - protein, 9 aa, Homo Sapiens
DHLSINPVK

SEQ ID NO: 1380393 - protein, 9 aa, Homo Sapiens
QDRAGVTSI

SEQ ID NO: 1380394 - protein, 9 aa, Homo Sapiens
DLANEVDYV

SEQ ID NO: 1380395 - protein, 9 aa, Homo Sapiens
WIDMTGFLC

SEQ ID NO: 1380396 - protein, 9 aa, Homo Sapiens
KPASEGSSK

SEQ ID NO: 1380397 - protein, 9 aa, Homo Sapiens
NNRRELWSL

SEQ ID NO: 1380398 - protein, 9 aa, Homo Sapiens
ILIKRQQQK

SEQ ID NO: 1380399 - protein, 9 aa, Homo Sapiens
SWAGRPWEP

SEQ ID NO: 1380400 - protein, 9 aa, Homo Sapiens
PLTYDNYMT

SEQ ID NO: 1380401 - protein, 9 aa, Homo Sapiens
NCIPHKLYR

SEQ ID NO: 1380402 - protein, 9 aa, Homo Sapiens
NPAVPCVPS

SEQ ID NO: 1380403 - protein, 9 aa, Homo Sapiens
HPVPGNPPS

SEQ ID NO: 1380404 - protein, 9 aa, Homo Sapiens
HELMTYIEV

SEQ ID NO: 1380405 - protein, 9 aa, Homo Sapiens
PGQKLSIPQ

SEQ ID NO: 1380406 - protein, 9 aa, Homo Sapiens
KKIIKLLYG

SEQ ID NO: 1380407 - protein, 9 aa, Homo Sapiens
KRGSHFWIQ

SEQ ID NO: 1380408 - protein, 9 aa, Homo Sapiens
DIFDMFGGG

SEQ ID NO: 1380409 - protein, 9 aa, Homo Sapiens
GSVSTIIRL

SEQ ID NO: 1380410 - protein, 9 aa, Homo Sapiens
SRILWFKVV

SEQ ID NO: 1380411 - protein, 9 aa, Homo Sapiens
LQPAVCPRH

SEQ ID NO: 1380412 - protein, 9 aa, Homo Sapiens
DVNIQVRKK

SEQ ID NO: 1380413 - protein, 9 aa, Homo Sapiens
RQKSLKDEE

SEQ ID NO: 1380414 - protein, 9 aa, Homo Sapiens
CRTLQTSSY

SEQ ID NO: 1380415 - protein, 9 aa, Homo Sapiens
PGVHEGCAE

SEQ ID NO: 1380416 - protein, 9 aa, Homo Sapiens
LNDSNITVL

SEQ ID NO: 1380417 - protein, 9 aa, Homo Sapiens
EYQQSPVQR

SEQ ID NO: 1380418 - protein, 9 aa, Homo Sapiens
ENRRIPINT

SEQ ID NO: 1380419 - protein, 9 aa, Homo Sapiens
GSLTVQNSP

SEQ ID NO: 1380420 - protein, 9 aa, Homo Sapiens
NCCLFCFWK

SEQ ID NO: 1380421 - protein, 9 aa, Homo Sapiens
TASGNSFDV

SEQ ID NO: 1380422 - protein, 9 aa, Homo Sapiens
ENWLLRSEK

SEQ ID NO: 1380423 - protein, 9 aa, Homo Sapiens
CSIRRKSKA

SEQ ID NO: 1380424 - protein, 9 aa, Homo Sapiens
GTRSRFFLQ
